United States Patent 11,369,692 (MATERIALS AND METHODS FOR TREATMENT OF DUCHENNE MUSCULAR DYSTROPHY) - sequence listing, part 34

SEQ ID NO: 1124497 - DNA, 22 bp, Artificial Sequence
  chemically synthesized
aagtctgataagaagcactcta

SEQ ID NO: 1124498 - DNA, 22 bp, Artificial Sequence
  chemically synthesized
agtctgataagaagcactctac

SEQ ID NO: 1124499 - DNA, 22 bp, Artificial Sequence
  chemically synthesized
agagagaagaggctgtagagtg

SEQ ID NO: 1124500 - DNA, 22 bp, Artificial Sequence
  chemically synthesized
cagagagaagaggctgtagagt

SEQ ID NO: 1124501 - DNA, 22 bp, Artificial Sequence
  chemically synthesized
ataagaagcactctacagcctc

SEQ ID NO: 1124502 - DNA, 22 bp, Artificial Sequence
  chemically synthesized
gcaggcttcagagagaagaggc

SEQ ID NO: 1124503 - DNA, 22 bp, Artificial Sequence
  chemically synthesized
gctagcaggcttcagagagaag

SEQ ID NO: 1124504 - DNA, 22 bp, Artificial Sequence
  chemically synthesized
agctagcaggcttcagagagaa

SEQ ID NO: 1124505 - DNA, 22 bp, Artificial Sequence
  chemically synthesized
tagctagcaggcttcagagaga

SEQ ID NO: 1124506 - DNA, 22 bp, Artificial Sequence
  chemically synthesized
ttagctagcaggcttcagagag

SEQ ID NO: 1124507 - DNA, 22 bp, Artificial Sequence
  chemically synthesized
tacagcctcttctctctgaagc

SEQ ID NO: 1124508 - DNA, 22 bp, Artificial Sequence
  chemically synthesized
cagcctcttctctctgaagcct

SEQ ID NO: 1124509 - DNA, 22 bp, Artificial Sequence
  chemically synthesized
ttctctctgaagcctgctagct

SEQ ID NO: 1124510 - DNA, 22 bp, Artificial Sequence
  chemically synthesized
ctctctgaagcctgctagctaa

SEQ ID NO: 1124511 - DNA, 22 bp, Artificial Sequence
  chemically synthesized
tctctgaagcctgctagctaaa

SEQ ID NO: 1124512 - DNA, 22 bp, Artificial Sequence
  chemically synthesized
tctgaagcctgctagctaaaag

SEQ ID NO: 1124513 - DNA, 22 bp, Artificial Sequence
  chemically synthesized
tgaagcctgctagctaaaagct

SEQ ID NO: 1124514 - DNA, 22 bp, Artificial Sequence
  chemically synthesized
tcatgtagatgaagcttttagc

SEQ ID NO: 1124515 - DNA, 22 bp, Artificial Sequence
  chemically synthesized
atcatgtagatgaagcttttag

SEQ ID NO: 1124516 - DNA, 22 bp, Artificial Sequence
  chemically synthesized
aagcctgctagctaaaagcttc

SEQ ID NO: 1124517 - DNA, 22 bp, Artificial Sequence
  chemically synthesized
tatcatgtagatgaagctttta

SEQ ID NO: 1124518 - DNA, 22 bp, Artificial Sequence
  chemically synthesized
ctagctaaaagcttcatctaca

SEQ ID NO: 1124519 - DNA, 22 bp, Artificial Sequence
  chemically synthesized
gctaaaagcttcatctacatga

SEQ ID NO: 1124520 - DNA, 22 bp, Artificial Sequence
  chemically synthesized
aaagcttcatctacatgataaa

SEQ ID NO: 1124521 - DNA, 22 bp, Artificial Sequence
  chemically synthesized
tggataccaaagttttatcatg

SEQ ID NO: 1124522 - DNA, 22 bp, Artificial Sequence
  chemically synthesized
catctacatgataaaactttgg

SEQ ID NO: 1124523 - DNA, 22 bp, Artificial Sequence
  chemically synthesized
atctacatgataaaactttggt

SEQ ID NO: 1124524 - DNA, 22 bp, Artificial Sequence
  chemically synthesized
catgataaaactttggtatcca

SEQ ID NO: 1124525 - DNA, 22 bp, Artificial Sequence
  chemically synthesized
agataagacattgtggatacca

SEQ ID NO: 1124526 - DNA, 22 bp, Artificial Sequence
  chemically synthesized
ggttgagataagacattgtgga

SEQ ID NO: 1124527 - DNA, 22 bp, Artificial Sequence
  chemically synthesized
gggttgagataagacattgtgg

SEQ ID NO: 1124528 - DNA, 22 bp, Artificial Sequence
  chemically synthesized
tggtatccacaatgtcttatct

SEQ ID NO: 1124529 - DNA, 22 bp, Artificial Sequence
  chemically synthesized
ggtatccacaatgtcttatctc

SEQ ID NO: 1124530 - DNA, 22 bp, Artificial Sequence
  chemically synthesized
gtatccacaatgtcttatctca

SEQ ID NO: 1124531 - DNA, 22 bp, Artificial Sequence
  chemically synthesized
ggatcaatagaaaggaatgttt

SEQ ID NO: 1124532 - DNA, 22 bp, Artificial Sequence
  chemically synthesized
atctcaacccaaacattccttt

SEQ ID NO: 1124533 - DNA, 22 bp, Artificial Sequence
  chemically synthesized
tctcaacccaaacattcctttc

SEQ ID NO: 1124534 - DNA, 22 bp, Artificial Sequence
  chemically synthesized
aacccaaacattcctttctatt

SEQ ID NO: 1124535 - DNA, 22 bp, Artificial Sequence
  chemically synthesized
aagacctgggatcaatagaaag

SEQ ID NO: 1124536 - DNA, 22 bp, Artificial Sequence
  chemically synthesized
tctaaagacctgggatcaatag

SEQ ID NO: 1124537 - DNA, 22 bp, Artificial Sequence
  chemically synthesized
gtctaaagacctgggatcaata

SEQ ID NO: 1124538 - DNA, 22 bp, Artificial Sequence
  chemically synthesized
agtttgtctaaagacctgggat

SEQ ID NO: 1124539 - DNA, 22 bp, Artificial Sequence
  chemically synthesized
ctttctattgatcccaggtctt

SEQ ID NO: 1124540 - DNA, 22 bp, Artificial Sequence
  chemically synthesized
gttgagtttgtctaaagacctg

SEQ ID NO: 1124541 - DNA, 22 bp, Artificial Sequence
  chemically synthesized
tctattgatcccaggtctttag

SEQ ID NO: 1124542 - DNA, 22 bp, Artificial Sequence
  chemically synthesized
ctattgatcccaggtctttaga

SEQ ID NO: 1124543 - DNA, 22 bp, Artificial Sequence
  chemically synthesized
tattgatcccaggtctttagac

SEQ ID NO: 1124544 - DNA, 22 bp, Artificial Sequence
  chemically synthesized
ttgatcccaggtctttagacaa

SEQ ID NO: 1124545 - DNA, 22 bp, Artificial Sequence
  chemically synthesized
acaattggttgagtttgtctaa

SEQ ID NO: 1124546 - DNA, 22 bp, Artificial Sequence
  chemically synthesized
atcccaggtctttagacaaact

SEQ ID NO: 1124547 - DNA, 22 bp, Artificial Sequence
  chemically synthesized
gttgacaattggttgagtttgt

SEQ ID NO: 1124548 - DNA, 22 bp, Artificial Sequence
  chemically synthesized
tggttgacaattggttgagttt

SEQ ID NO: 1124549 - DNA, 22 bp, Artificial Sequence
  chemically synthesized
ctggttgacaattggttgagtt

SEQ ID NO: 1124550 - DNA, 22 bp, Artificial Sequence
  chemically synthesized
tctggttgacaattggttgagt

SEQ ID NO: 1124551 - DNA, 22 bp, Artificial Sequence
  chemically synthesized
tagacaaactcaaccaattgtc

SEQ ID NO: 1124552 - DNA, 22 bp, Artificial Sequence
  chemically synthesized
agacaaactcaaccaattgtca

SEQ ID NO: 1124553 - DNA, 22 bp, Artificial Sequence
  chemically synthesized
gacaaactcaaccaattgtcaa

SEQ ID NO: 1124554 - DNA, 22 bp, Artificial Sequence
  chemically synthesized
aacattttctggttgacaattg

SEQ ID NO: 1124555 - DNA, 22 bp, Artificial Sequence
  chemically synthesized
aaacattttctggttgacaatt

SEQ ID NO: 1124556 - DNA, 22 bp, Artificial Sequence
  chemically synthesized
aaccaattgtcaaccagaaaat

SEQ ID NO: 1124557 - DNA, 22 bp, Artificial Sequence
  chemically synthesized
taggtaaatttaaacattttct

SEQ ID NO: 1124558 - DNA, 22 bp, Artificial Sequence
  chemically synthesized
tcaaccagaaaatgtttaaatt

SEQ ID NO: 1124559 - DNA, 22 bp, Artificial Sequence
  chemically synthesized
caggctgtaggtaaatttaaac

SEQ ID NO: 1124560 - DNA, 22 bp, Artificial Sequence
  chemically synthesized
ccaggctgtaggtaaatttaaa

SEQ ID NO: 1124561 - DNA, 22 bp, Artificial Sequence
  chemically synthesized
aaatttacctacagcctggaag

SEQ ID NO: 1124562 - DNA, 22 bp, Artificial Sequence
  chemically synthesized
aatttacctacagcctggaagc

SEQ ID NO: 1124563 - DNA, 22 bp, Artificial Sequence
  chemically synthesized
ggtgggggtgggggcttccagg

SEQ ID NO: 1124564 - DNA, 22 bp, Artificial Sequence
  chemically synthesized
acctacagcctggaagccccca

SEQ ID NO: 1124565 - DNA, 22 bp, Artificial Sequence
  chemically synthesized
cctacagcctggaagcccccac

SEQ ID NO: 1124566 - DNA, 22 bp, Artificial Sequence
  chemically synthesized
cagcctggaagcccccaccccc

SEQ ID NO: 1124567 - DNA, 22 bp, Artificial Sequence
  chemically synthesized
gaagcccccacccccacccagt

SEQ ID NO: 1124568 - DNA, 22 bp, Artificial Sequence
  chemically synthesized
gtccagaaaggcaggacaactg

SEQ ID NO: 1124569 - DNA, 22 bp, Artificial Sequence
  chemically synthesized
ggtccagaaaggcaggacaact

SEQ ID NO: 1124570 - DNA, 22 bp, Artificial Sequence
  chemically synthesized
gtttggtccagaaaggcaggac

SEQ ID NO: 1124571 - DNA, 22 bp, Artificial Sequence
  chemically synthesized
tcctgcctttctggaccaaacc

SEQ ID NO: 1124572 - DNA, 22 bp, Artificial Sequence
  chemically synthesized
cctttctggaccaaaccaatgt

SEQ ID NO: 1124573 - DNA, 22 bp, Artificial Sequence
  chemically synthesized
tctggaccaaaccaatgtattt

SEQ ID NO: 1124574 - DNA, 22 bp, Artificial Sequence
  chemically synthesized
ctggaccaaaccaatgtatttc

SEQ ID NO: 1124575 - DNA, 22 bp, Artificial Sequence
  chemically synthesized
tggaccaaaccaatgtatttct

SEQ ID NO: 1124576 - DNA, 22 bp, Artificial Sequence
  chemically synthesized
gaccaaaccaatgtatttcttt

SEQ ID NO: 1124577 - DNA, 22 bp, Artificial Sequence
  chemically synthesized
aaaaaaaaaaaaaaaaaaagaa

SEQ ID NO: 1124578 - DNA, 22 bp, Artificial Sequence
  chemically synthesized
ctttttttttttttttttttta

SEQ ID NO: 1124579 - DNA, 22 bp, Artificial Sequence
  chemically synthesized
ttttttttttttttttttttaa

SEQ ID NO: 1124580 - DNA, 22 bp, Artificial Sequence
  chemically synthesized
aaaaaaataaaattaaaaaaaa

SEQ ID NO: 1124581 - DNA, 22 bp, Artificial Sequence
  chemically synthesized
ttttttttttttttttttaatt

SEQ ID NO: 1124582 - DNA, 22 bp, Artificial Sequence
  chemically synthesized
tttttttttttttttttaattt

SEQ ID NO: 1124583 - DNA, 22 bp, Artificial Sequence
  chemically synthesized
ttttttttttttttttaatttt

SEQ ID NO: 1124584 - DNA, 22 bp, Artificial Sequence
  chemically synthesized
tttttttttttttttaatttta

SEQ ID NO: 1124585 - DNA, 22 bp, Artificial Sequence
  chemically synthesized
ttttttttttttttaattttat

SEQ ID NO: 1124586 - DNA, 22 bp, Artificial Sequence
  chemically synthesized
cgtctgaaaaaaataaaattaa

SEQ ID NO: 1124587 - DNA, 22 bp, Artificial Sequence
  chemically synthesized
tttttttttttttaattttatt

SEQ ID NO: 1124588 - DNA, 22 bp, Artificial Sequence
  chemically synthesized
ttttttttttttaattttattt

SEQ ID NO: 1124589 - DNA, 22 bp, Artificial Sequence
  chemically synthesized
tttttttttttaattttatttt

SEQ ID NO: 1124590 - DNA, 22 bp, Artificial Sequence
  chemically synthesized
ttttttttttaattttattttt

SEQ ID NO: 1124591 - DNA, 22 bp, Artificial Sequence
  chemically synthesized
tttttttttaattttatttttt

SEQ ID NO: 1124592 - DNA, 22 bp, Artificial Sequence
  chemically synthesized
ttttttttaattttattttttt

SEQ ID NO: 1124593 - DNA, 22 bp, Artificial Sequence
  chemically synthesized
tttttttaattttatttttttc

SEQ ID NO: 1124594 - DNA, 22 bp, Artificial Sequence
  chemically synthesized
ttttttaattttatttttttca

SEQ ID NO: 1124595 - DNA, 22 bp, Artificial Sequence
  chemically synthesized
tttttaattttatttttttcag

SEQ ID NO: 1124596 - DNA, 22 bp, Artificial Sequence
  chemically synthesized
ttttaattttatttttttcaga

SEQ ID NO: 1124597 - DNA, 22 bp, Artificial Sequence
  chemically synthesized
tttaattttatttttttcagac

SEQ ID NO: 1124598 - DNA, 22 bp, Artificial Sequence
  chemically synthesized
ttaattttatttttttcagacg

SEQ ID NO: 1124599 - DNA, 22 bp, Artificial Sequence
  chemically synthesized
taattttatttttttcagacgg

SEQ ID NO: 1124600 - DNA, 22 bp, Artificial Sequence
  chemically synthesized
aattttatttttttcagacgga

SEQ ID NO: 1124601 - DNA, 22 bp, Artificial Sequence
  chemically synthesized
attttatttttttcagacggag

SEQ ID NO: 1124602 - DNA, 22 bp, Artificial Sequence
  chemically synthesized
ggcaacagagcgagactccgtc

SEQ ID NO: 1124603 - DNA, 22 bp, Artificial Sequence
  chemically synthesized
tatttttttcagacggagtctc

SEQ ID NO: 1124604 - DNA, 22 bp, Artificial Sequence
  chemically synthesized
gggcaacagagcgagactccgt

SEQ ID NO: 1124605 - DNA, 22 bp, Artificial Sequence
  chemically synthesized
atttttttcagacggagtctcg

SEQ ID NO: 1124606 - DNA, 22 bp, Artificial Sequence
  chemically synthesized
tttttttcagacggagtctcgc

SEQ ID NO: 1124607 - DNA, 22 bp, Artificial Sequence
  chemically synthesized
ttttcagacggagtctcgctct

SEQ ID NO: 1124608 - DNA, 22 bp, Artificial Sequence
  chemically synthesized
tttcagacggagtctcgctctg

SEQ ID NO: 1124609 - DNA, 22 bp, Artificial Sequence
  chemically synthesized
cagcttgggcaacagagcgaga

SEQ ID NO: 1124610 - DNA, 22 bp, Artificial Sequence
  chemically synthesized
ttcagacggagtctcgctctgt

SEQ ID NO: 1124611 - DNA, 22 bp, Artificial Sequence
  chemically synthesized
tcagacggagtctcgctctgtt

SEQ ID NO: 1124612 - DNA, 22 bp, Artificial Sequence
  chemically synthesized
cagacggagtctcgctctgttg

SEQ ID NO: 1124613 - DNA, 22 bp, Artificial Sequence
  chemically synthesized
agacggagtctcgctctgttgc

SEQ ID NO: 1124614 - DNA, 22 bp, Artificial Sequence
  chemically synthesized
cactccagcttgggcaacagag

SEQ ID NO: 1124615 - DNA, 22 bp, Artificial Sequence
  chemically synthesized
tgtcactgcactccagcttggg

SEQ ID NO: 1124616 - DNA, 22 bp, Artificial Sequence
  chemically synthesized
gctctgttgcccaagctggagt

SEQ ID NO: 1124617 - DNA, 22 bp, Artificial Sequence
  chemically synthesized
tgttgcccaagctggagtgcag

SEQ ID NO: 1124618 - DNA, 22 bp, Artificial Sequence
  chemically synthesized
ttgcccaagctggagtgcagtg

SEQ ID NO: 1124619 - DNA, 22 bp, Artificial Sequence
  chemically synthesized
cccaagctggagtgcagtgaca

SEQ ID NO: 1124620 - DNA, 22 bp, Artificial Sequence
  chemically synthesized
cagtgagccaagattgtgtcac

SEQ ID NO: 1124621 - DNA, 22 bp, Artificial Sequence
  chemically synthesized
gagtgcagtgacacaatcttgg

SEQ ID NO: 1124622 - DNA, 22 bp, Artificial Sequence
  chemically synthesized
ggaggcggaggttgcagtgagc

SEQ ID NO: 1124623 - DNA, 22 bp, Artificial Sequence
  chemically synthesized
ggctcactgcaacctccgcctc

SEQ ID NO: 1124624 - DNA, 22 bp, Artificial Sequence
  chemically synthesized
gctcactgcaacctccgcctcc

SEQ ID NO: 1124625 - DNA, 22 bp, Artificial Sequence
  chemically synthesized
actgcaacctccgcctcccagg

SEQ ID NO: 1124626 - DNA, 22 bp, Artificial Sequence
  chemically synthesized
caacctccgcctcccaggttca

SEQ ID NO: 1124627 - DNA, 22 bp, Artificial Sequence
  chemically synthesized
aggcaggagaatggtgtgaacc

SEQ ID NO: 1124628 - DNA, 22 bp, Artificial Sequence
  chemically synthesized
cgcctcccaggttcacaccatt

SEQ ID NO: 1124629 - DNA, 22 bp, Artificial Sequence
  chemically synthesized
ccaggttcacaccattctcctg

SEQ ID NO: 1124630 - DNA, 22 bp, Artificial Sequence
  chemically synthesized
gggaggctgaggcaggagaatg

SEQ ID NO: 1124631 - DNA, 22 bp, Artificial Sequence
  chemically synthesized
ctcgggaggctgaggcaggaga

SEQ ID NO: 1124632 - DNA, 22 bp, Artificial Sequence
  chemically synthesized
acaccattctcctgcctcagcc

SEQ ID NO: 1124633 - DNA, 22 bp, Artificial Sequence
  chemically synthesized
tagtcccagctactcgggaggc

SEQ ID NO: 1124634 - DNA, 22 bp, Artificial Sequence
  chemically synthesized
tcctgcctcagcctcccgagta

SEQ ID NO: 1124635 - DNA, 22 bp, Artificial Sequence
  chemically synthesized
ctgcctcagcctcccgagtagc

SEQ ID NO: 1124636 - DNA, 22 bp, Artificial Sequence
  chemically synthesized
cctcagcctcccgagtagctgg

SEQ ID NO: 1124637 - DNA, 22 bp, Artificial Sequence
  chemically synthesized
agcctcccgagtagctgggact

SEQ ID NO: 1124638 - DNA, 22 bp, Artificial Sequence
  chemically synthesized
ccgagtagctgggactacaggc

SEQ ID NO: 1124639 - DNA, 22 bp, Artificial Sequence
  chemically synthesized
gccagacgtggcggcaggcgcc

SEQ ID NO: 1124640 - DNA, 22 bp, Artificial Sequence
  chemically synthesized
ggactacaggcgcctgccgcca

SEQ ID NO: 1124641 - DNA, 22 bp, Artificial Sequence
  chemically synthesized
caggcgcctgccgccacgtctg

SEQ ID NO: 1124642 - DNA, 22 bp, Artificial Sequence
  chemically synthesized
ccgccacgtctggctaattttt

SEQ ID NO: 1124643 - DNA, 22 bp, Artificial Sequence
  chemically synthesized
tgaaaaatagggaaaaaaaatt

SEQ ID NO: 1124644 - DNA, 22 bp, Artificial Sequence
  chemically synthesized
tatgaaaaatagggaaaaaaaa

SEQ ID NO: 1124645 - DNA, 22 bp, Artificial Sequence
  chemically synthesized
gctaattttttttccctatttt

SEQ ID NO: 1124646 - DNA, 22 bp, Artificial Sequence
  chemically synthesized
attttttttccctatttttcat

SEQ ID NO: 1124647 - DNA, 22 bp, Artificial Sequence
  chemically synthesized
tttttccctatttttcatagag

SEQ ID NO: 1124648 - DNA, 22 bp, Artificial Sequence
  chemically synthesized
ttttccctatttttcatagaga

SEQ ID NO: 1124649 - DNA, 22 bp, Artificial Sequence
  chemically synthesized
tttccctatttttcatagagac

SEQ ID NO: 1124650 - DNA, 22 bp, Artificial Sequence
  chemically synthesized
ttccctatttttcatagagacg

SEQ ID NO: 1124651 - DNA, 22 bp, Artificial Sequence
  chemically synthesized
tccctatttttcatagagacgg

SEQ ID NO: 1124652 - DNA, 22 bp, Artificial Sequence
  chemically synthesized
ccctatttttcatagagacggg

SEQ ID NO: 1124653 - DNA, 22 bp, Artificial Sequence
  chemically synthesized
aaacagtgaaaccccgtctcta

SEQ ID NO: 1124654 - DNA, 22 bp, Artificial Sequence
  chemically synthesized
cctatttttcatagagacgggg

SEQ ID NO: 1124655 - DNA, 22 bp, Artificial Sequence
  chemically synthesized
gctgaaacagtgaaaccccgtc

SEQ ID NO: 1124656 - DNA, 22 bp, Artificial Sequence
  chemically synthesized
tttttcatagagacggggtttc

SEQ ID NO: 1124657 - DNA, 22 bp, Artificial Sequence
  chemically synthesized
ttcatagagacggggtttcact

SEQ ID NO: 1124658 - DNA, 22 bp, Artificial Sequence
  chemically synthesized
tcatagagacggggtttcactg

SEQ ID NO: 1124659 - DNA, 22 bp, Artificial Sequence
  chemically synthesized
catagagacggggtttcactgt

SEQ ID NO: 1124660 - DNA, 22 bp, Artificial Sequence
  chemically synthesized
atagagacggggtttcactgtt

SEQ ID NO: 1124661 - DNA, 22 bp, Artificial Sequence
  chemically synthesized
cactgtttcagccaggatggtc

SEQ ID NO: 1124662 - DNA, 22 bp, Artificial Sequence
  chemically synthesized
actgtttcagccaggatggtct

SEQ ID NO: 1124663 - DNA, 22 bp, Artificial Sequence
  chemically synthesized
tttcagccaggatggtctcgat

SEQ ID NO: 1124664 - DNA, 22 bp, Artificial Sequence
  chemically synthesized
cagccaggatggtctcgatctc

SEQ ID NO: 1124665 - DNA, 22 bp, Artificial Sequence
  chemically synthesized
agccaggatggtctcgatctcc

SEQ ID NO: 1124666 - DNA, 22 bp, Artificial Sequence
  chemically synthesized
agtcgggcggatcacaaggtca

SEQ ID NO: 1124667 - DNA, 22 bp, Artificial Sequence
  chemically synthesized
gatctcctgaccttgtgatccg

SEQ ID NO: 1124668 - DNA, 22 bp, Artificial Sequence
  chemically synthesized
ggaggctgagtcgggcggatca

SEQ ID NO: 1124669 - DNA, 22 bp, Artificial Sequence
  chemically synthesized
gggaggctgagtcgggcggatc

SEQ ID NO: 1124670 - DNA, 22 bp, Artificial Sequence
  chemically synthesized
tgggaggctgagtcgggcggat

SEQ ID NO: 1124671 - DNA, 22 bp, Artificial Sequence
  chemically synthesized
ctgaccttgtgatccgcccgac

SEQ ID NO: 1124672 - DNA, 22 bp, Artificial Sequence
  chemically synthesized
accttgtgatccgcccgactca

SEQ ID NO: 1124673 - DNA, 22 bp, Artificial Sequence
  chemically synthesized
gtgatccgcccgactcagcctc

SEQ ID NO: 1124674 - DNA, 22 bp, Artificial Sequence
  chemically synthesized
tgatccgcccgactcagcctcc

SEQ ID NO: 1124675 - DNA, 22 bp, Artificial Sequence
  chemically synthesized
taatcccagcactttgggaggc

SEQ ID NO: 1124676 - DNA, 22 bp, Artificial Sequence
  chemically synthesized
acacctgtaatcccagcacttt

SEQ ID NO: 1124677 - DNA, 22 bp, Artificial Sequence
  chemically synthesized
agcctcccaaagtgctgggatt

SEQ ID NO: 1124678 - DNA, 22 bp, Artificial Sequence
  chemically synthesized
ccaaagtgctgggattacaggt

SEQ ID NO: 1124679 - DNA, 22 bp, Artificial Sequence
  chemically synthesized
gcgcggtggctcacacctgtaa

SEQ ID NO: 1124680 - DNA, 22 bp, Artificial Sequence
  chemically synthesized
acctggcgcggtggctcacacc

SEQ ID NO: 1124681 - DNA, 22 bp, Artificial Sequence
  chemically synthesized
gacctggcgcggtggctcacac

SEQ ID NO: 1124682 - DNA, 22 bp, Artificial Sequence
  chemically synthesized
ggattacaggtgtgagccaccg

SEQ ID NO: 1124683 - DNA, 22 bp, Artificial Sequence
  chemically synthesized
gtttgacctggcgcggtggctc

SEQ ID NO: 1124684 - DNA, 22 bp, Artificial Sequence
  chemically synthesized
caggtgtgagccaccgcgccag

SEQ ID NO: 1124685 - DNA, 22 bp, Artificial Sequence
  chemically synthesized
agaaatacattggtttgacctg

SEQ ID NO: 1124686 - DNA, 22 bp, Artificial Sequence
  chemically synthesized
aagaaatacattggtttgacct

SEQ ID NO: 1124687 - DNA, 22 bp, Artificial Sequence
  chemically synthesized
cttaaatgtacttgattgatgt

SEQ ID NO: 1124688 - DNA, 22 bp, Artificial Sequence
  chemically synthesized
gggaggcatgagacatcaatca

SEQ ID NO: 1124689 - DNA, 22 bp, Artificial Sequence
  chemically synthesized
ttaaatgtacttgattgatgtc

SEQ ID NO: 1124690 - DNA, 22 bp, Artificial Sequence
  chemically synthesized
agggaggcatgagacatcaatc

SEQ ID NO: 1124691 - DNA, 22 bp, Artificial Sequence
  chemically synthesized
tagggaggcatgagacatcaat

SEQ ID NO: 1124692 - DNA, 22 bp, Artificial Sequence
  chemically synthesized
aaatgtacttgattgatgtctc

SEQ ID NO: 1124693 - DNA, 22 bp, Artificial Sequence
  chemically synthesized
aatgtacttgattgatgtctca

SEQ ID NO: 1124694 - DNA, 22 bp, Artificial Sequence
  chemically synthesized
cacattttagggaggcatgaga

SEQ ID NO: 1124695 - DNA, 22 bp, Artificial Sequence
  chemically synthesized
acacattttagggaggcatgag

SEQ ID NO: 1124696 - DNA, 22 bp, Artificial Sequence
  chemically synthesized
tacacattttagggaggcatga

SEQ ID NO: 1124697 - DNA, 22 bp, Artificial Sequence
  chemically synthesized
gattgatgtctcatgcctccct

SEQ ID NO: 1124698 - DNA, 22 bp, Artificial Sequence
  chemically synthesized
attgatgtctcatgcctcccta

SEQ ID NO: 1124699 - DNA, 22 bp, Artificial Sequence
  chemically synthesized
gttttacacattttagggaggc

SEQ ID NO: 1124700 - DNA, 22 bp, Artificial Sequence
  chemically synthesized
ggttttacacattttagggagg

SEQ ID NO: 1124701 - DNA, 22 bp, Artificial Sequence
  chemically synthesized
atgtctcatgcctccctaaaat

SEQ ID NO: 1124702 - DNA, 22 bp, Artificial Sequence
  chemically synthesized
atgcctccctaaaatgtgtaaa

SEQ ID NO: 1124703 - DNA, 22 bp, Artificial Sequence
  chemically synthesized
gggtgcagcttggttttacaca

SEQ ID NO: 1124704 - DNA, 22 bp, Artificial Sequence
  chemically synthesized
cctaaaatgtgtaaaaccaagc

SEQ ID NO: 1124705 - DNA, 22 bp, Artificial Sequence
  chemically synthesized
aaatgtgtaaaaccaagctgca

SEQ ID NO: 1124706 - DNA, 22 bp, Artificial Sequence
  chemically synthesized
acgacatgtgcccaaggtggtt

SEQ ID NO: 1124707 - DNA, 22 bp, Artificial Sequence
  chemically synthesized
caccccaaccaccttgggcaca

SEQ ID NO: 1124708 - DNA, 22 bp, Artificial Sequence
  chemically synthesized
aggaagtcctgacgacatgtgc

SEQ ID NO: 1124709 - DNA, 22 bp, Artificial Sequence
  chemically synthesized
gggcacatgtcgtcaggacttc

SEQ ID NO: 1124710 - DNA, 22 bp, Artificial Sequence
  chemically synthesized
ggcacatgtcgtcaggacttcc

SEQ ID NO: 1124711 - DNA, 22 bp, Artificial Sequence
  chemically synthesized
tgacacagcctcaggaagtcct

SEQ ID NO: 1124712 - DNA, 22 bp, Artificial Sequence
  chemically synthesized
gcgcgcctgtgacacagcctca

SEQ ID NO: 1124713 - DNA, 22 bp, Artificial Sequence
  chemically synthesized
cctgaggctgtgtcacaggcgc

SEQ ID NO: 1124714 - DNA, 22 bp, Artificial Sequence
  chemically synthesized
ctgaggctgtgtcacaggcgcg

SEQ ID NO: 1124715 - DNA, 22 bp, Artificial Sequence
  chemically synthesized
aggctgtgtcacaggcgcgcga

SEQ ID NO: 1124716 - DNA, 22 bp, Artificial Sequence
  chemically synthesized
ccaaggtggaattcgcgcgcct

SEQ ID NO: 1124717 - DNA, 22 bp, Artificial Sequence
  chemically synthesized
gccaaggtggaattcgcgcgcc

SEQ ID NO: 1124718 - DNA, 22 bp, Artificial Sequence
  chemically synthesized
tgccaaggtggaattcgcgcgc

SEQ ID NO: 1124719 - DNA, 22 bp, Artificial Sequence
  chemically synthesized
ttgccaaggtggaattcgcgcg

SEQ ID NO: 1124720 - DNA, 22 bp, Artificial Sequence
  chemically synthesized
tgtcacaggcgcgcgaattcca

SEQ ID NO: 1124721 - DNA, 22 bp, Artificial Sequence
  chemically synthesized
atttttgccaaggtggaattcg

SEQ ID NO: 1124722 - DNA, 22 bp, Artificial Sequence
  chemically synthesized
caccttggcaaaaatcaacttt

SEQ ID NO: 1124723 - DNA, 22 bp, Artificial Sequence
  chemically synthesized
ggcaaaaatcaacttttttttt

SEQ ID NO: 1124724 - DNA, 22 bp, Artificial Sequence
  chemically synthesized
gcaaaaatcaactttttttttt

SEQ ID NO: 1124725 - DNA, 22 bp, Artificial Sequence
  chemically synthesized
tttttttttttttttttttttt

SEQ ID NO: 1124726 - DNA, 22 bp, Artificial Sequence
  chemically synthesized
tttttttttttttttttttttt

SEQ ID NO: 1124727 - DNA, 22 bp, Artificial Sequence
  chemically synthesized
aaaaaaaaaaaaaaaaaaaaaa

SEQ ID NO: 1124728 - DNA, 22 bp, Artificial Sequence
  chemically synthesized
tttttttttttttttttttttt

SEQ ID NO: 1124729 - DNA, 22 bp, Artificial Sequence
  chemically synthesized
tttttttttttttttttttttt

SEQ ID NO: 1124730 - DNA, 22 bp, Artificial Sequence
  chemically synthesized
tttttttttttttttttttttt

SEQ ID NO: 1124731 - DNA, 22 bp, Artificial Sequence
  chemically synthesized
tttttttttttttttttttttt

SEQ ID NO: 1124732 - DNA, 22 bp, Artificial Sequence
  chemically synthesized
tctcaaaaaaaaaaaaaaaaaa

SEQ ID NO: 1124733 - DNA, 22 bp, Artificial Sequence
  chemically synthesized
tttttttttttttttttttttt

SEQ ID NO: 1124734 - DNA, 22 bp, Artificial Sequence
  chemically synthesized
gtctcaaaaaaaaaaaaaaaaa

SEQ ID NO: 1124735 - DNA, 22 bp, Artificial Sequence
  chemically synthesized
tttttttttttttttttttttt

SEQ ID NO: 1124736 - DNA, 22 bp, Artificial Sequence
  chemically synthesized
tgtctcaaaaaaaaaaaaaaaa

SEQ ID NO: 1124737 - DNA, 22 bp, Artificial Sequence
  chemically synthesized
tttttttttttttttttttttt

SEQ ID NO: 1124738 - DNA, 22 bp, Artificial Sequence
  chemically synthesized
tttttttttttttttttttttt

SEQ ID NO: 1124739 - DNA, 22 bp, Artificial Sequence
  chemically synthesized
tttttttttttttttttttttt

SEQ ID NO: 1124740 - DNA, 22 bp, Artificial Sequence
  chemically synthesized
tttttttttttttttttttttt

SEQ ID NO: 1124741 - DNA, 22 bp, Artificial Sequence
  chemically synthesized
tttttttttttttttttttttt

SEQ ID NO: 1124742 - DNA, 22 bp, Artificial Sequence
  chemically synthesized
tttttttttttttttttttttt

SEQ ID NO: 1124743 - DNA, 22 bp, Artificial Sequence
  chemically synthesized
tttttttttttttttttttttg

SEQ ID NO: 1124744 - DNA, 22 bp, Artificial Sequence
  chemically synthesized
ttttttttttttttttttttga

SEQ ID NO: 1124745 - DNA, 22 bp, Artificial Sequence
  chemically synthesized
tttttttttttttttttttgag

SEQ ID NO: 1124746 - DNA, 22 bp, Artificial Sequence
  chemically synthesized
ttttttttttttttttttgaga

SEQ ID NO: 1124747 - DNA, 22 bp, Artificial Sequence
  chemically synthesized
tttttttttttttttttgagac

SEQ ID NO: 1124748 - DNA, 22 bp, Artificial Sequence
  chemically synthesized
ttttttttttttttttgagaca

SEQ ID NO: 1124749 - DNA, 22 bp, Artificial Sequence
  chemically synthesized
tttttttttttttttgagacaa

SEQ ID NO: 1124750 - DNA, 22 bp, Artificial Sequence
  chemically synthesized
ttttttttttttttgagacaaa

SEQ ID NO: 1124751 - DNA, 22 bp, Artificial Sequence
  chemically synthesized
tttttttttttttgagacaaag

SEQ ID NO: 1124752 - DNA, 22 bp, Artificial Sequence
  chemically synthesized
ttttttttttttgagacaaagt

SEQ ID NO: 1124753 - DNA, 22 bp, Artificial Sequence
  chemically synthesized
tttttttttttgagacaaagtc

SEQ ID NO: 1124754 - DNA, 22 bp, Artificial Sequence
  chemically synthesized
ttttttttttgagacaaagtct

SEQ ID NO: 1124755 - DNA, 22 bp, Artificial Sequence
  chemically synthesized
ggtgatagaatgagactttgtc

SEQ ID NO: 1124756 - DNA, 22 bp, Artificial Sequence
  chemically synthesized
tttttttttgagacaaagtctc

SEQ ID NO: 1124757 - DNA, 22 bp, Artificial Sequence
  chemically synthesized
ttttttttgagacaaagtctca

SEQ ID NO: 1124758 - DNA, 22 bp, Artificial Sequence
  chemically synthesized
tttttttgagacaaagtctcat

SEQ ID NO: 1124759 - DNA, 22 bp, Artificial Sequence
  chemically synthesized
ttttttgagacaaagtctcatt

SEQ ID NO: 1124760 - DNA, 22 bp, Artificial Sequence
  chemically synthesized
tttttgagacaaagtctcattc

SEQ ID NO: 1124761 - DNA, 22 bp, Artificial Sequence
  chemically synthesized
ttttgagacaaagtctcattct

SEQ ID NO: 1124762 - DNA, 22 bp, Artificial Sequence
  chemically synthesized
tttgagacaaagtctcattcta

SEQ ID NO: 1124763 - DNA, 22 bp, Artificial Sequence
  chemically synthesized
cagcctgggtgatagaatgaga

SEQ ID NO: 1124764 - DNA, 22 bp, Artificial Sequence
  chemically synthesized
ttgagacaaagtctcattctat

SEQ ID NO: 1124765 - DNA, 22 bp, Artificial Sequence
  chemically synthesized
tgagacaaagtctcattctatc

SEQ ID NO: 1124766 - DNA, 22 bp, Artificial Sequence
  chemically synthesized
gagacaaagtctcattctatca

SEQ ID NO: 1124767 - DNA, 22 bp, Artificial Sequence
  chemically synthesized
agacaaagtctcattctatcac

SEQ ID NO: 1124768 - DNA, 22 bp, Artificial Sequence
  chemically synthesized
cactccagcctgggtgatagaa

SEQ ID NO: 1124769 - DNA, 22 bp, Artificial Sequence
  chemically synthesized
tgccactgcactccagcctggg

SEQ ID NO: 1124770 - DNA, 22 bp, Artificial Sequence
  chemically synthesized
attctatcacccaggctggagt

SEQ ID NO: 1124771 - DNA, 22 bp, Artificial Sequence
  chemically synthesized
tatcacccaggctggagtgcag

SEQ ID NO: 1124772 - DNA, 22 bp, Artificial Sequence
  chemically synthesized
tcacccaggctggagtgcagtg

SEQ ID NO: 1124773 - DNA, 22 bp, Artificial Sequence
  chemically synthesized
cagtgagattgtgccactgcac

SEQ ID NO: 1124774 - DNA, 22 bp, Artificial Sequence
  chemically synthesized
gagtgcagtggcacaatctcac

SEQ ID NO: 1124775 - DNA, 22 bp, Artificial Sequence
  chemically synthesized
tccccaggaggcgggggttgca

SEQ ID NO: 1124776 - DNA, 22 bp, Artificial Sequence
  chemically synthesized
gtccccaggaggcgggggttgc

SEQ ID NO: 1124777 - DNA, 22 bp, Artificial Sequence
  chemically synthesized
cttgtccccaggaggcgggggt

SEQ ID NO: 1124778 - DNA, 22 bp, Artificial Sequence
  chemically synthesized
actgcaacccccgcctcctggg

SEQ ID NO: 1124779 - DNA, 22 bp, Artificial Sequence
  chemically synthesized
caacccccgcctcctggggaca

SEQ ID NO: 1124780 - DNA, 22 bp, Artificial Sequence
  chemically synthesized
aggcacgagaattgcttgtccc

SEQ ID NO: 1124781 - DNA, 22 bp, Artificial Sequence
  chemically synthesized
ctggggacaagcaattctcgtg

SEQ ID NO: 1124782 - DNA, 22 bp, Artificial Sequence
  chemically synthesized
gggaggctgaggcacgagaatt

SEQ ID NO: 1124783 - DNA, 22 bp, Artificial Sequence
  chemically synthesized
gggacaagcaattctcgtgcct

SEQ ID NO: 1124784 - DNA, 22 bp, Artificial Sequence
  chemically synthesized
ggtactcgggaggctgaggcac

SEQ ID NO: 1124785 - DNA, 22 bp, Artificial Sequence
  chemically synthesized
atcctaggtactcgggaggctg

SEQ ID NO: 1124786 - DNA, 22 bp, Artificial Sequence
  chemically synthesized
tcgtgcctcagcctcccgagta

SEQ ID NO: 1124787 - DNA, 22 bp, Artificial Sequence
  chemically synthesized
cctaatcctaggtactcgggag

SEQ ID NO: 1124788 - DNA, 22 bp, Artificial Sequence
  chemically synthesized
gcctaatcctaggtactcggga

SEQ ID NO: 1124789 - DNA, 22 bp, Artificial Sequence
  chemically synthesized
gtgcctcagcctcccgagtacc

SEQ ID NO: 1124790 - DNA, 22 bp, Artificial Sequence
  chemically synthesized
tgcctaatcctaggtactcggg

SEQ ID NO: 1124791 - DNA, 22 bp, Artificial Sequence
  chemically synthesized
attttgcctaatcctaggtact

SEQ ID NO: 1124792 - DNA, 22 bp, Artificial Sequence
  chemically synthesized
agcctcccgagtacctaggatt

SEQ ID NO: 1124793 - DNA, 22 bp, Artificial Sequence
  chemically synthesized
gaaagttgattttgcctaatcc

SEQ ID NO: 1124794 - DNA, 22 bp, Artificial Sequence
  chemically synthesized
ccgagtacctaggattaggcaa

SEQ ID NO: 1124795 - DNA, 22 bp, Artificial Sequence
  chemically synthesized
agaaagttgattttgcctaatc

SEQ ID NO: 1124796 - DNA, 22 bp, Artificial Sequence
  chemically synthesized
atttagaaagttgattttgcct

SEQ ID NO: 1124797 - DNA, 22 bp, Artificial Sequence
  chemically synthesized
agttaatttagaaagttgattt

SEQ ID NO: 1124798 - DNA, 22 bp, Artificial Sequence
  chemically synthesized
ggattaggcaaaatcaactttc

SEQ ID NO: 1124799 - DNA, 22 bp, Artificial Sequence
  chemically synthesized
ggcaaaatcaactttctaaatt

SEQ ID NO: 1124800 - DNA, 22 bp, Artificial Sequence
  chemically synthesized
agacaggtctcagttaatttag

SEQ ID NO: 1124801 - DNA, 22 bp, Artificial Sequence
  chemically synthesized
tctaaattaactgagacctgtc

SEQ ID NO: 1124802 - DNA, 22 bp, Artificial Sequence
  chemically synthesized
ctaaattaactgagacctgtct

SEQ ID NO: 1124803 - DNA, 22 bp, Artificial Sequence
  chemically synthesized
taaattaactgagacctgtctc

SEQ ID NO: 1124804 - DNA, 22 bp, Artificial Sequence
  chemically synthesized
aattaactgagacctgtctcag

SEQ ID NO: 1124805 - DNA, 22 bp, Artificial Sequence
  chemically synthesized
tagacccagaaaatctgagaca

SEQ ID NO: 1124806 - DNA, 22 bp, Artificial Sequence
  chemically synthesized
actgagacctgtctcagatttt

SEQ ID NO: 1124807 - DNA, 22 bp, Artificial Sequence
  chemically synthesized
tattgtagacccagaaaatctg

SEQ ID NO: 1124808 - DNA, 22 bp, Artificial Sequence
  chemically synthesized
gtattgtagacccagaaaatct

SEQ ID NO: 1124809 - DNA, 22 bp, Artificial Sequence
  chemically synthesized
agacctgtctcagattttctgg

SEQ ID NO: 1124810 - DNA, 22 bp, Artificial Sequence
  chemically synthesized
tctcagattttctgggtctaca

SEQ ID NO: 1124811 - DNA, 22 bp, Artificial Sequence
  chemically synthesized
aaaagcatttgtattgtagacc

SEQ ID NO: 1124812 - DNA, 22 bp, Artificial Sequence
  chemically synthesized
aaaaagcatttgtattgtagac

SEQ ID NO: 1124813 - DNA, 22 bp, Artificial Sequence
  chemically synthesized
agattttctgggtctacaatac

SEQ ID NO: 1124814 - DNA, 22 bp, Artificial Sequence
  chemically synthesized
taaaaagcatttgtattgtaga

SEQ ID NO: 1124815 - DNA, 22 bp, Artificial Sequence
  chemically synthesized
ttaaaaagcatttgtattgtag

SEQ ID NO: 1124816 - DNA, 22 bp, Artificial Sequence
  chemically synthesized
tctgggtctacaatacaaatgc

SEQ ID NO: 1124817 - DNA, 22 bp, Artificial Sequence
  chemically synthesized
ctgggtctacaatacaaatgct

SEQ ID NO: 1124818 - DNA, 22 bp, Artificial Sequence
  chemically synthesized
tgggtctacaatacaaatgctt

SEQ ID NO: 1124819 - DNA, 22 bp, Artificial Sequence
  chemically synthesized
ggtctacaatacaaatgctttt

SEQ ID NO: 1124820 - DNA, 22 bp, Artificial Sequence
  chemically synthesized
caagtaatttttaaaaagcatt

SEQ ID NO: 1124821 - DNA, 22 bp, Artificial Sequence
  chemically synthesized
acaagtaatttttaaaaagcat

SEQ ID NO: 1124822 - DNA, 22 bp, Artificial Sequence
  chemically synthesized
caatacaaatgctttttaaaaa

SEQ ID NO: 1124823 - DNA, 22 bp, Artificial Sequence
  chemically synthesized
tttaaaaattacttgtaaatat

SEQ ID NO: 1124824 - DNA, 22 bp, Artificial Sequence
  chemically synthesized
ttaaaaattacttgtaaatatg

SEQ ID NO: 1124825 - DNA, 22 bp, Artificial Sequence
  chemically synthesized
taaaaattacttgtaaatatgt

SEQ ID NO: 1124826 - DNA, 22 bp, Artificial Sequence
  chemically synthesized
aaaaattacttgtaaatatgtt

SEQ ID NO: 1124827 - DNA, 22 bp, Artificial Sequence
  chemically synthesized
gagaggtaagtaaacatattta

SEQ ID NO: 1124828 - DNA, 22 bp, Artificial Sequence
  chemically synthesized
aaaattacttgtaaatatgttt

SEQ ID NO: 1124829 - DNA, 22 bp, Artificial Sequence
  chemically synthesized
attagagaggtaagtaaacata

SEQ ID NO: 1124830 - DNA, 22 bp, Artificial Sequence
  chemically synthesized
aattagagaggtaagtaaacat

SEQ ID NO: 1124831 - DNA, 22 bp, Artificial Sequence
  chemically synthesized
taattagagaggtaagtaaaca

SEQ ID NO: 1124832 - DNA, 22 bp, Artificial Sequence
  chemically synthesized
cttgtaaatatgtttacttacc

SEQ ID NO: 1124833 - DNA, 22 bp, Artificial Sequence
  chemically synthesized
tttaattagagaggtaagtaaa

SEQ ID NO: 1124834 - DNA, 22 bp, Artificial Sequence
  chemically synthesized
gtaaatatgtttacttacctct

SEQ ID NO: 1124835 - DNA, 22 bp, Artificial Sequence
  chemically synthesized
taaatatgtttacttacctctc

SEQ ID NO: 1124836 - DNA, 22 bp, Artificial Sequence
  chemically synthesized
ggtcaaaacctctttaattaga

SEQ ID NO: 1124837 - DNA, 22 bp, Artificial Sequence
  chemically synthesized
gggtcaaaacctctttaattag

SEQ ID NO: 1124838 - DNA, 22 bp, Artificial Sequence
  chemically synthesized
acttacctctctaattaaagag

SEQ ID NO: 1124839 - DNA, 22 bp, Artificial Sequence
  chemically synthesized
cttacctctctaattaaagagg

SEQ ID NO: 1124840 - DNA, 22 bp, Artificial Sequence
  chemically synthesized
acctctctaattaaagaggttt

SEQ ID NO: 1124841 - DNA, 22 bp, Artificial Sequence
  chemically synthesized
tatcttgggtcaaaacctcttt

SEQ ID NO: 1124842 - DNA, 22 bp, Artificial Sequence
  chemically synthesized
cctctctaattaaagaggtttt

SEQ ID NO: 1124843 - DNA, 22 bp, Artificial Sequence
  chemically synthesized
gtatcttgggtcaaaacctctt

SEQ ID NO: 1124844 - DNA, 22 bp, Artificial Sequence
  chemically synthesized
tgtatcttgggtcaaaacctct

SEQ ID NO: 1124845 - DNA, 22 bp, Artificial Sequence
  chemically synthesized
ttgtatcttgggtcaaaacctc

SEQ ID NO: 1124846 - DNA, 22 bp, Artificial Sequence
  chemically synthesized
tctaattaaagaggttttgacc

SEQ ID NO: 1124847 - DNA, 22 bp, Artificial Sequence
  chemically synthesized
taattaaagaggttttgaccca

SEQ ID NO: 1124848 - DNA, 22 bp, Artificial Sequence
  chemically synthesized
agtttttgtatcttgggtcaaa

SEQ ID NO: 1124849 - DNA, 22 bp, Artificial Sequence
  chemically synthesized
attaaagaggttttgacccaag

SEQ ID NO: 1124850 - DNA, 22 bp, Artificial Sequence
  chemically synthesized
aagaggttttgacccaagatac

SEQ ID NO: 1124851 - DNA, 22 bp, Artificial Sequence
  chemically synthesized
atctcagtttttgtatcttggg

SEQ ID NO: 1124852 - DNA, 22 bp, Artificial Sequence
  chemically synthesized
tgacccaagatacaaaaactga

SEQ ID NO: 1124853 - DNA, 22 bp, Artificial Sequence
  chemically synthesized
gacccaagatacaaaaactgag

SEQ ID NO: 1124854 - DNA, 22 bp, Artificial Sequence
  chemically synthesized
acccaagatacaaaaactgaga

SEQ ID NO: 1124855 - DNA, 22 bp, Artificial Sequence
  chemically synthesized
agatcagctttgcttatattgt

SEQ ID NO: 1124856 - DNA, 22 bp, Artificial Sequence
  chemically synthesized
gaatatgaaagccacaatataa

SEQ ID NO: 1124857 - DNA, 22 bp, Artificial Sequence
  chemically synthesized
tgcttatattgtggctttcata

SEQ ID NO: 1124858 - DNA, 22 bp, Artificial Sequence
  chemically synthesized
atgtaattggaatatgaaagcc

SEQ ID NO: 1124859 - DNA, 22 bp, Artificial Sequence
  chemically synthesized
gcttatattgtggctttcatat

SEQ ID NO: 1124860 - DNA, 22 bp, Artificial Sequence
  chemically synthesized
cttatattgtggctttcatatt

SEQ ID NO: 1124861 - DNA, 22 bp, Artificial Sequence
  chemically synthesized
atattgtggctttcatattcca

SEQ ID NO: 1124862 - DNA, 22 bp, Artificial Sequence
  chemically synthesized
tattgtggctttcatattccaa

SEQ ID NO: 1124863 - DNA, 22 bp, Artificial Sequence
  chemically synthesized
tggctttcatattccaattaca

SEQ ID NO: 1124864 - DNA, 22 bp, Artificial Sequence
  chemically synthesized
gatgaatagactaatgtaattg

SEQ ID NO: 1124865 - DNA, 22 bp, Artificial Sequence
  chemically synthesized
ctagatgaatagactaatgtaa

SEQ ID NO: 1124866 - DNA, 22 bp, Artificial Sequence
  chemically synthesized
tcatattccaattacattagtc

SEQ ID NO: 1124867 - DNA, 22 bp, Artificial Sequence
  chemically synthesized
catattccaattacattagtct

SEQ ID NO: 1124868 - DNA, 22 bp, Artificial Sequence
  chemically synthesized
atattccaattacattagtcta

SEQ ID NO: 1124869 - DNA, 22 bp, Artificial Sequence
  chemically synthesized
attgctagatgaatagactaat

SEQ ID NO: 1124870 - DNA, 22 bp, Artificial Sequence
  chemically synthesized
gattgctagatgaatagactaa

SEQ ID NO: 1124871 - DNA, 22 bp, Artificial Sequence
  chemically synthesized
caattacattagtctattcatc

SEQ ID NO: 1124872 - DNA, 22 bp, Artificial Sequence
  chemically synthesized
atttgattgctagatgaataga

SEQ ID NO: 1124873 - DNA, 22 bp, Artificial Sequence
  chemically synthesized
aatttgattgctagatgaatag

SEQ ID NO: 1124874 - DNA, 22 bp, Artificial Sequence
  chemically synthesized
tttaatttgattgctagatgaa

SEQ ID NO: 1124875 - DNA, 22 bp, Artificial Sequence
  chemically synthesized
atttaatttgattgctagatga

SEQ ID NO: 1124876 - DNA, 22 bp, Artificial Sequence
  chemically synthesized
cattagtctattcatctagcaa

SEQ ID NO: 1124877 - DNA, 22 bp, Artificial Sequence
  chemically synthesized
tatttaatttgattgctagatg

SEQ ID NO: 1124878 - DNA, 22 bp, Artificial Sequence
  chemically synthesized
gtctattcatctagcaatcaaa

SEQ ID NO: 1124879 - DNA, 22 bp, Artificial Sequence
  chemically synthesized
gattttatttaatttgattgct

SEQ ID NO: 1124880 - DNA, 22 bp, Artificial Sequence
  chemically synthesized
agattttatttaatttgattgc

SEQ ID NO: 1124881 - DNA, 22 bp, Artificial Sequence
  chemically synthesized
tagattttatttaatttgattg

SEQ ID NO: 1124882 - DNA, 22 bp, Artificial Sequence
  chemically synthesized
ttcatctagcaatcaaattaaa

SEQ ID NO: 1124883 - DNA, 22 bp, Artificial Sequence
  chemically synthesized
atctagcaatcaaattaaataa

SEQ ID NO: 1124884 - DNA, 22 bp, Artificial Sequence
  chemically synthesized
taacatctttagattttattta

SEQ ID NO: 1124885 - DNA, 22 bp, Artificial Sequence
  chemically synthesized
gcaatcaaattaaataaaatct

SEQ ID NO: 1124886 - DNA, 22 bp, Artificial Sequence
  chemically synthesized
ggaattataacatctttagatt

SEQ ID NO: 1124887 - DNA, 22 bp, Artificial Sequence
  chemically synthesized
taactgggaattataacatctt

SEQ ID NO: 1124888 - DNA, 22 bp, Artificial Sequence
  chemically synthesized
aataaaatctaaagatgttata

SEQ ID NO: 1124889 - DNA, 22 bp, Artificial Sequence
  chemically synthesized
ttataactgggaattataacat

SEQ ID NO: 1124890 - DNA, 22 bp, Artificial Sequence
  chemically synthesized
attataactgggaattataaca

SEQ ID NO: 1124891 - DNA, 22 bp, Artificial Sequence
  chemically synthesized
tattataactgggaattataac

SEQ ID NO: 1124892 - DNA, 22 bp, Artificial Sequence
  chemically synthesized
ttattataactgggaattataa

SEQ ID NO: 1124893 - DNA, 22 bp, Artificial Sequence
  chemically synthesized
tttattataactgggaattata

SEQ ID NO: 1124894 - DNA, 22 bp, Artificial Sequence
  chemically synthesized
aagatgttataattcccagtta

SEQ ID NO: 1124895 - DNA, 22 bp, Artificial Sequence
  chemically synthesized
taggctttttattataactggg

SEQ ID NO: 1124896 - DNA, 22 bp, Artificial Sequence
  chemically synthesized
ataggctttttattataactgg

SEQ ID NO: 1124897 - DNA, 22 bp, Artificial Sequence
  chemically synthesized
taattcccagttataataaaaa

SEQ ID NO: 1124898 - DNA, 22 bp, Artificial Sequence
  chemically synthesized
aagagtttataggctttttatt

SEQ ID NO: 1124899 - DNA, 22 bp, Artificial Sequence
  chemically synthesized
ccagttataataaaaagcctat

SEQ ID NO: 1124900 - DNA, 22 bp, Artificial Sequence
  chemically synthesized
taataaaaagcctataaactct

SEQ ID NO: 1124901 - DNA, 22 bp, Artificial Sequence
  chemically synthesized
tgtaaaccactgaagagtttat

SEQ ID NO: 1124902 - DNA, 22 bp, Artificial Sequence
  chemically synthesized
caggtgctgtgtaaaccactga

SEQ ID NO: 1124903 - DNA, 22 bp, Artificial Sequence
  chemically synthesized
ttccaggtgctgtgtaaaccac

SEQ ID NO: 1124904 - DNA, 22 bp, Artificial Sequence
  chemically synthesized
taaactcttcagtggtttacac

SEQ ID NO: 1124905 - DNA, 22 bp, Artificial Sequence
  chemically synthesized
ttcagtggtttacacagcacct

SEQ ID NO: 1124906 - DNA, 22 bp, Artificial Sequence
  chemically synthesized
tcacattgttccaggtgctgtg

SEQ ID NO: 1124907 - DNA, 22 bp, Artificial Sequence
  chemically synthesized
cagtggtttacacagcacctgg

SEQ ID NO: 1124908 - DNA, 22 bp, Artificial Sequence
  chemically synthesized
agtggtttacacagcacctgga

SEQ ID NO: 1124909 - DNA, 22 bp, Artificial Sequence
  chemically synthesized
tcatctgtcacattgttccagg

SEQ ID NO: 1124910 - DNA, 22 bp, Artificial Sequence
  chemically synthesized
tgtcatctgtcacattgttcca

SEQ ID NO: 1124911 - DNA, 22 bp, Artificial Sequence
  chemically synthesized
acacagcacctggaacaatgtg

SEQ ID NO: 1124912 - DNA, 22 bp, Artificial Sequence
  chemically synthesized
cacagcacctggaacaatgtga

SEQ ID NO: 1124913 - DNA, 22 bp, Artificial Sequence
  chemically synthesized
gaacaatgtgacagatgacaga

SEQ ID NO: 1124914 - DNA, 22 bp, Artificial Sequence
  chemically synthesized
aagacagagtcctctgtcatct

SEQ ID NO: 1124915 - DNA, 22 bp, Artificial Sequence
  chemically synthesized
actgaagacagagtcctctgtc

SEQ ID NO: 1124916 - DNA, 22 bp, Artificial Sequence
  chemically synthesized
cactaactgaagacagagtcct

SEQ ID NO: 1124917 - DNA, 22 bp, Artificial Sequence
  chemically synthesized
ccactaactgaagacagagtcc

SEQ ID NO: 1124918 - DNA, 22 bp, Artificial Sequence
  chemically synthesized
atatagcagtttccactaactg

SEQ ID NO: 1124919 - DNA, 22 bp, Artificial Sequence
  chemically synthesized
tgtcttcagttagtggaaactg

SEQ ID NO: 1124920 - DNA, 22 bp, Artificial Sequence
  chemically synthesized
tcttcagttagtggaaactgct

SEQ ID NO: 1124921 - DNA, 22 bp, Artificial Sequence
  chemically synthesized
cagttagtggaaactgctatat

SEQ ID NO: 1124922 - DNA, 22 bp, Artificial Sequence
  chemically synthesized
ataggaatgttaatatagcagt

SEQ ID NO: 1124923 - DNA, 22 bp, Artificial Sequence
  chemically synthesized
agttagtggaaactgctatatt

SEQ ID NO: 1124924 - DNA, 22 bp, Artificial Sequence
  chemically synthesized
gataggaatgttaatatagcag

SEQ ID NO: 1124925 - DNA, 22 bp, Artificial Sequence
  chemically synthesized
tgataggaatgttaatatagca

SEQ ID NO: 1124926 - DNA, 22 bp, Artificial Sequence
  chemically synthesized
ttgataggaatgttaatatagc

SEQ ID NO: 1124927 - DNA, 22 bp, Artificial Sequence
  chemically synthesized
gtggaaactgctatattaacat

SEQ ID NO: 1124928 - DNA, 22 bp, Artificial Sequence
  chemically synthesized
ctatattaacattcctatcaaa

SEQ ID NO: 1124929 - DNA, 22 bp, Artificial Sequence
  chemically synthesized
tattaacattcctatcaaaaat

SEQ ID NO: 1124930 - DNA, 22 bp, Artificial Sequence
  chemically synthesized
acattcctatcaaaaatctatt

SEQ ID NO: 1124931 - DNA, 22 bp, Artificial Sequence
  chemically synthesized
ctatcaaaaatctatttttcct

SEQ ID NO: 1124932 - DNA, 22 bp, Artificial Sequence
  chemically synthesized
tcaaaaatctatttttccttat

SEQ ID NO: 1124933 - DNA, 22 bp, Artificial Sequence
  chemically synthesized
agaccatgcaaatataaggaaa

SEQ ID NO: 1124934 - DNA, 22 bp, Artificial Sequence
  chemically synthesized
gagaccatgcaaatataaggaa

SEQ ID NO: 1124935 - DNA, 22 bp, Artificial Sequence
  chemically synthesized
tttttccttatatttgcatggt

SEQ ID NO: 1124936 - DNA, 22 bp, Artificial Sequence
  chemically synthesized
gaaatacatttgagaccatgca

SEQ ID NO: 1124937 - DNA, 22 bp, Artificial Sequence
  chemically synthesized
ttccttatatttgcatggtctc

SEQ ID NO: 1124938 - DNA, 22 bp, Artificial Sequence
  chemically synthesized
tccttatatttgcatggtctca

SEQ ID NO: 1124939 - DNA, 22 bp, Artificial Sequence
  chemically synthesized
ccttatatttgcatggtctcaa

SEQ ID NO: 1124940 - DNA, 22 bp, Artificial Sequence
  chemically synthesized
cttatatttgcatggtctcaaa

SEQ ID NO: 1124941 - DNA, 22 bp, Artificial Sequence
  chemically synthesized
atatttgcatggtctcaaatgt

SEQ ID NO: 1124942 - DNA, 22 bp, Artificial Sequence
  chemically synthesized
tatttgcatggtctcaaatgta

SEQ ID NO: 1124943 - DNA, 22 bp, Artificial Sequence
  chemically synthesized
gcatggtctcaaatgtatttct

SEQ ID NO: 1124944 - DNA, 22 bp, Artificial Sequence
  chemically synthesized
catggtctcaaatgtatttcta

SEQ ID NO: 1124945 - DNA, 22 bp, Artificial Sequence
  chemically synthesized
cacatataaaactagaaataca

SEQ ID NO: 1124946 - DNA, 22 bp, Artificial Sequence
  chemically synthesized
aaattacacatataaaactaga

SEQ ID NO: 1124947 - DNA, 22 bp, Artificial Sequence
  chemically synthesized
aaaattacacatataaaactag

SEQ ID NO: 1124948 - DNA, 22 bp, Artificial Sequence
  chemically synthesized
aaatgtatttctagttttatat

SEQ ID NO: 1124949 - DNA, 22 bp, Artificial Sequence
  chemically synthesized
ctagttttatatgtgtaatttt

SEQ ID NO: 1124950 - DNA, 22 bp, Artificial Sequence
  chemically synthesized
tagttttatatgtgtaatttta

SEQ ID NO: 1124951 - DNA, 22 bp, Artificial Sequence
  chemically synthesized
tgagtgatgtgcttaaaattac

SEQ ID NO: 1124952 - DNA, 22 bp, Artificial Sequence
  chemically synthesized
gttttatatgtgtaattttaag

SEQ ID NO: 1124953 - DNA, 22 bp, Artificial Sequence
  chemically synthesized
atgagtgatgtgcttaaaatta

SEQ ID NO: 1124954 - DNA, 22 bp, Artificial Sequence
  chemically synthesized
tatgagtgatgtgcttaaaatt

SEQ ID NO: 1124955 - DNA, 22 bp, Artificial Sequence
  chemically synthesized
tatatgtgtaattttaagcaca

SEQ ID NO: 1124956 - DNA, 22 bp, Artificial Sequence
  chemically synthesized
ttttatgagtgatgtgcttaaa

SEQ ID NO: 1124957 - DNA, 22 bp, Artificial Sequence
  chemically synthesized
atatgtgtaattttaagcacat

SEQ ID NO: 1124958 - DNA, 22 bp, Artificial Sequence
  chemically synthesized
tatgtgtaattttaagcacatc

SEQ ID NO: 1124959 - DNA, 22 bp, Artificial Sequence
  chemically synthesized
aaacatattattttatgagtga

SEQ ID NO: 1124960 - DNA, 22 bp, Artificial Sequence
  chemically synthesized
taagcacatcactcataaaata

SEQ ID NO: 1124961 - DNA, 22 bp, Artificial Sequence
  chemically synthesized
aagcacatcactcataaaataa

SEQ ID NO: 1124962 - DNA, 22 bp, Artificial Sequence
  chemically synthesized
tactgaaacatattattttatg

SEQ ID NO: 1124963 - DNA, 22 bp, Artificial Sequence
  chemically synthesized
agcacatcactcataaaataat

SEQ ID NO: 1124964 - DNA, 22 bp, Artificial Sequence
  chemically synthesized
ctgtactgaaacatattatttt

SEQ ID NO: 1124965 - DNA, 22 bp, Artificial Sequence
  chemically synthesized
actgtactgaaacatattattt

SEQ ID NO: 1124966 - DNA, 22 bp, Artificial Sequence
  chemically synthesized
tactgtactgaaacatattatt

SEQ ID NO: 1124967 - DNA, 22 bp, Artificial Sequence
  chemically synthesized
aattttactgtactgaaacata

SEQ ID NO: 1124968 - DNA, 22 bp, Artificial Sequence
  chemically synthesized
ataaaataatatgtttcagtac

SEQ ID NO: 1124969 - DNA, 22 bp, Artificial Sequence
  chemically synthesized
aaatcattaaattttactgtac

SEQ ID NO: 1124970 - DNA, 22 bp, Artificial Sequence
  chemically synthesized
cagtacagtaaaatttaatgat

SEQ ID NO: 1124971 - DNA, 22 bp, Artificial Sequence
  chemically synthesized
agtacagtaaaatttaatgatt

SEQ ID NO: 1124972 - DNA, 22 bp, Artificial Sequence
  chemically synthesized
agtgcaatctgaaatcattaaa

SEQ ID NO: 1124973 - DNA, 22 bp, Artificial Sequence
  chemically synthesized
cagtgcaatctgaaatcattaa

SEQ ID NO: 1124974 - DNA, 22 bp, Artificial Sequence
  chemically synthesized
tcagtgcaatctgaaatcatta

SEQ ID NO: 1124975 - DNA, 22 bp, Artificial Sequence
  chemically synthesized
aagatgcctttcagtgcaatct

SEQ ID NO: 1124976 - DNA, 22 bp, Artificial Sequence
  chemically synthesized
aaagatgcctttcagtgcaatc

SEQ ID NO: 1124977 - DNA, 22 bp, Artificial Sequence
  chemically synthesized
taaagatgcctttcagtgcaat

SEQ ID NO: 1124978 - DNA, 22 bp, Artificial Sequence
  chemically synthesized
aatgatttcagattgcactgaa

SEQ ID NO: 1124979 - DNA, 22 bp, Artificial Sequence
  chemically synthesized
ttaaagatgcctttcagtgcaa

SEQ ID NO: 1124980 - DNA, 22 bp, Artificial Sequence
  chemically synthesized
atgatttcagattgcactgaaa

SEQ ID NO: 1124981 - DNA, 22 bp, Artificial Sequence
  chemically synthesized
gtatcttttaaagatgcctttc

SEQ ID NO: 1124982 - DNA, 22 bp, Artificial Sequence
  chemically synthesized
cagattgcactgaaaggcatct

SEQ ID NO: 1124983 - DNA, 22 bp, Artificial Sequence
  chemically synthesized
agtatcttttaaagatgccttt

SEQ ID NO: 1124984 - DNA, 22 bp, Artificial Sequence
  chemically synthesized
agattgcactgaaaggcatctt

SEQ ID NO: 1124985 - DNA, 22 bp, Artificial Sequence
  chemically synthesized
tagtatcttttaaagatgcctt

SEQ ID NO: 1124986 - DNA, 22 bp, Artificial Sequence
  chemically synthesized
ttagtatcttttaaagatgcct

SEQ ID NO: 1124987 - DNA, 22 bp, Artificial Sequence
  chemically synthesized
tttagtatcttttaaagatgcc

SEQ ID NO: 1124988 - DNA, 22 bp, Artificial Sequence
  chemically synthesized
cactgaaaggcatctttaaaag

SEQ ID NO: 1124989 - DNA, 22 bp, Artificial Sequence
  chemically synthesized
attttttagtatcttttaaaga

SEQ ID NO: 1124990 - DNA, 22 bp, Artificial Sequence
  chemically synthesized
aaaggcatctttaaaagatact

SEQ ID NO: 1124991 - DNA, 22 bp, Artificial Sequence
  chemically synthesized
taaaagatactaaaaaatcaat

SEQ ID NO: 1124992 - DNA, 22 bp, Artificial Sequence
  chemically synthesized
aaaagatactaaaaaatcaatt

SEQ ID NO: 1124993 - DNA, 22 bp, Artificial Sequence
  chemically synthesized
aaagatactaaaaaatcaattt

SEQ ID NO: 1124994 - DNA, 22 bp, Artificial Sequence
  chemically synthesized
ggacaaggtaaacgccacagaa

SEQ ID NO: 1124995 - DNA, 22 bp, Artificial Sequence
  chemically synthesized
aggacaaggtaaacgccacaga

SEQ ID NO: 1124996 - DNA, 22 bp, Artificial Sequence
  chemically synthesized
aaaaatcaatttctgtggcgtt

SEQ ID NO: 1124997 - DNA, 22 bp, Artificial Sequence
  chemically synthesized
taggacaaggtaaacgccacag

SEQ ID NO: 1124998 - DNA, 22 bp, Artificial Sequence
  chemically synthesized
ctgtggcgtttaccttgtccta

SEQ ID NO: 1124999 - DNA, 22 bp, Artificial Sequence
  chemically synthesized
tgtggcgtttaccttgtcctaa

SEQ ID NO: 1125000 - DNA, 22 bp, Artificial Sequence
  chemically synthesized
aataggcatattttaggacaag

SEQ ID NO: 1125001 - DNA, 22 bp, Artificial Sequence
  chemically synthesized
tggcgtttaccttgtcctaaaa

SEQ ID NO: 1125002 - DNA, 22 bp, Artificial Sequence
  chemically synthesized
accttgtcctaaaatatgccta

SEQ ID NO: 1125003 - DNA, 22 bp, Artificial Sequence
  chemically synthesized
ccttgtcctaaaatatgcctat

SEQ ID NO: 1125004 - DNA, 22 bp, Artificial Sequence
  chemically synthesized
aggcacatgttaaataggcata

SEQ ID NO: 1125005 - DNA, 22 bp, Artificial Sequence
  chemically synthesized
gaggcacatgttaaataggcat

SEQ ID NO: 1125006 - DNA, 22 bp, Artificial Sequence
  chemically synthesized
tgaggcacatgttaaataggca

SEQ ID NO: 1125007 - DNA, 22 bp, Artificial Sequence
  chemically synthesized
gtcctaaaatatgcctatttaa

SEQ ID NO: 1125008 - DNA, 22 bp, Artificial Sequence
  chemically synthesized
ttgaggcacatgttaaataggc

SEQ ID NO: 1125009 - DNA, 22 bp, Artificial Sequence
  chemically synthesized
tcctaaaatatgcctatttaac

SEQ ID NO: 1125010 - DNA, 22 bp, Artificial Sequence
  chemically synthesized
agcttttgaggcacatgttaaa

SEQ ID NO: 1125011 - DNA, 22 bp, Artificial Sequence
  chemically synthesized
aaatatgcctatttaacatgtg

SEQ ID NO: 1125012 - DNA, 22 bp, Artificial Sequence
  chemically synthesized
gaattcagcttttgaggcacat

SEQ ID NO: 1125013 - DNA, 22 bp, Artificial Sequence
  chemically synthesized
gactagaattcagcttttgagg

SEQ ID NO: 1125014 - DNA, 22 bp, Artificial Sequence
  chemically synthesized
tttaacatgtgcctcaaaagct

SEQ ID NO: 1125015 - DNA, 22 bp, Artificial Sequence
  chemically synthesized
ggactagaattcagcttttgag

SEQ ID NO: 1125016 - DNA, 22 bp, Artificial Sequence
  chemically synthesized
aacatgtgcctcaaaagctgaa

SEQ ID NO: 1125017 - DNA, 22 bp, Artificial Sequence
  chemically synthesized
acatgtgcctcaaaagctgaat

SEQ ID NO: 1125018 - DNA, 22 bp, Artificial Sequence
  chemically synthesized
tgcttggactagaattcagctt

SEQ ID NO: 1125019 - DNA, 22 bp, Artificial Sequence
  chemically synthesized
gtgcttggactagaattcagct

SEQ ID NO: 1125020 - DNA, 22 bp, Artificial Sequence
  chemically synthesized
tgtgcttggactagaattcagc

SEQ ID NO: 1125021 - DNA, 22 bp, Artificial Sequence
  chemically synthesized
aaaagctgaattctagtccaag

SEQ ID NO: 1125022 - DNA, 22 bp, Artificial Sequence
  chemically synthesized
aggacaatattttgtgcttgga

SEQ ID NO: 1125023 - DNA, 22 bp, Artificial Sequence
  chemically synthesized
aaggacaatattttgtgcttgg

SEQ ID NO: 1125024 - DNA, 22 bp, Artificial Sequence
  chemically synthesized
taaggacaatattttgtgcttg

SEQ ID NO: 1125025 - DNA, 22 bp, Artificial Sequence
  chemically synthesized
aattctagtccaagcacaaaat

SEQ ID NO: 1125026 - DNA, 22 bp, Artificial Sequence
  chemically synthesized
tagtccaagcacaaaatattgt

SEQ ID NO: 1125027 - DNA, 22 bp, Artificial Sequence
  chemically synthesized
gtccaagcacaaaatattgtcc

SEQ ID NO: 1125028 - DNA, 22 bp, Artificial Sequence
  chemically synthesized
ataataaagaagatgtacaatt

SEQ ID NO: 1125029 - DNA, 22 bp, Artificial Sequence
  chemically synthesized
tccttaaaattgtacatcttct

SEQ ID NO: 1125030 - DNA, 22 bp, Artificial Sequence
  chemically synthesized
aaaattgtacatcttctttatt

SEQ ID NO: 1125031 - DNA, 22 bp, Artificial Sequence
  chemically synthesized
aaattgtacatcttctttatta

SEQ ID NO: 1125032 - DNA, 22 bp, Artificial Sequence
  chemically synthesized
ggtatgccataattgataataa

SEQ ID NO: 1125033 - DNA, 22 bp, Artificial Sequence
  chemically synthesized
tacatcttctttattatcaatt

SEQ ID NO: 1125034 - DNA, 22 bp, Artificial Sequence
  chemically synthesized
ctttattatcaattatggcata

SEQ ID NO: 1125035 - DNA, 22 bp, Artificial Sequence
  chemically synthesized
tttattatcaattatggcatac

SEQ ID NO: 1125036 - DNA, 22 bp, Artificial Sequence
  chemically synthesized
agtatataattcggtatgccat

SEQ ID NO: 1125037 - DNA, 22 bp, Artificial Sequence
  chemically synthesized
tattatcaattatggcataccg

SEQ ID NO: 1125038 - DNA, 22 bp, Artificial Sequence
  chemically synthesized
attatcaattatggcataccga

SEQ ID NO: 1125039 - DNA, 22 bp, Artificial Sequence
  chemically synthesized
ttatcaattatggcataccgaa

SEQ ID NO: 1125040 - DNA, 22 bp, Artificial Sequence
  chemically synthesized
tcaattatggcataccgaatta

SEQ ID NO: 1125041 - DNA, 22 bp, Artificial Sequence
  chemically synthesized
aacatactaagtatataattcg

SEQ ID NO: 1125042 - DNA, 22 bp, Artificial Sequence
  chemically synthesized
aaacatactaagtatataattc

SEQ ID NO: 1125043 - DNA, 22 bp, Artificial Sequence
  chemically synthesized
taaacatactaagtatataatt

SEQ ID NO: 1125044 - DNA, 22 bp, Artificial Sequence
  chemically synthesized
ttaaacatactaagtatataat

SEQ ID NO: 1125045 - DNA, 22 bp, Artificial Sequence
  chemically synthesized
tggcataccgaattatatactt

SEQ ID NO: 1125046 - DNA, 22 bp, Artificial Sequence
  chemically synthesized
aaaagcagaatttttaaacata

SEQ ID NO: 1125047 - DNA, 22 bp, Artificial Sequence
  chemically synthesized
aaaaagcagaatttttaaacat

SEQ ID NO: 1125048 - DNA, 22 bp, Artificial Sequence
  chemically synthesized
taaaaagcagaatttttaaaca

SEQ ID NO: 1125049 - DNA, 22 bp, Artificial Sequence
  chemically synthesized
tatacttagtatgtttaaaaat

SEQ ID NO: 1125050 - DNA, 22 bp, Artificial Sequence
  chemically synthesized
agtatgtttaaaaattctgctt

SEQ ID NO: 1125051 - DNA, 22 bp, Artificial Sequence
  chemically synthesized
gtatgtttaaaaattctgcttt

SEQ ID NO: 1125052 - DNA, 22 bp, Artificial Sequence
  chemically synthesized
aaaaattctgctttttaaaata

SEQ ID NO: 1125053 - DNA, 22 bp, Artificial Sequence
  chemically synthesized
aaaattctgctttttaaaatac

SEQ ID NO: 1125054 - DNA, 22 bp, Artificial Sequence
  chemically synthesized
tatgcaagggcatgtattttaa

SEQ ID NO: 1125055 - DNA, 22 bp, Artificial Sequence
  chemically synthesized
gtatgcaagggcatgtatttta

SEQ ID NO: 1125056 - DNA, 22 bp, Artificial Sequence
  chemically synthesized
tgctttttaaaatacatgccct

SEQ ID NO: 1125057 - DNA, 22 bp, Artificial Sequence
  chemically synthesized
aatttgtatgcaagggcatgta

SEQ ID NO: 1125058 - DNA, 22 bp, Artificial Sequence
  chemically synthesized
ctttttaaaatacatgcccttg

SEQ ID NO: 1125059 - DNA, 22 bp, Artificial Sequence
  chemically synthesized
tttaaaatacatgcccttgcat

SEQ ID NO: 1125060 - DNA, 22 bp, Artificial Sequence
  chemically synthesized
ttaaaatacatgcccttgcata

SEQ ID NO: 1125061 - DNA, 22 bp, Artificial Sequence
  chemically synthesized
taaaatacatgcccttgcatac

SEQ ID NO: 1125062 - DNA, 22 bp, Artificial Sequence
  chemically synthesized
aaaatacatgcccttgcataca

SEQ ID NO: 1125063 - DNA, 22 bp, Artificial Sequence
  chemically synthesized
aatcattcaatttgtatgcaag

SEQ ID NO: 1125064 - DNA, 22 bp, Artificial Sequence
  chemically synthesized
aaatacatgcccttgcatacaa

SEQ ID NO: 1125065 - DNA, 22 bp, Artificial Sequence
  chemically synthesized
aaacattaaatcattcaatttg

SEQ ID NO: 1125066 - DNA, 22 bp, Artificial Sequence
  chemically synthesized
aaaacattaaatcattcaattt

SEQ ID NO: 1125067 - DNA, 22 bp, Artificial Sequence
  chemically synthesized
gcatacaaattgaatgatttaa

SEQ ID NO: 1125068 - DNA, 22 bp, Artificial Sequence
  chemically synthesized
catacaaattgaatgatttaat

SEQ ID NO: 1125069 - DNA, 22 bp, Artificial Sequence
  chemically synthesized
atagcttaaaacattaaatcat

SEQ ID NO: 1125070 - DNA, 22 bp, Artificial Sequence
  chemically synthesized
gcattaatagcttaaaacatta

SEQ ID NO: 1125071 - DNA, 22 bp, Artificial Sequence
  chemically synthesized
ggcattaatagcttaaaacatt

SEQ ID NO: 1125072 - DNA, 22 bp, Artificial Sequence
  chemically synthesized
tggcattaatagcttaaaacat

SEQ ID NO: 1125073 - DNA, 22 bp, Artificial Sequence
  chemically synthesized
ttggcattaatagcttaaaaca

SEQ ID NO: 1125074 - DNA, 22 bp, Artificial Sequence
  chemically synthesized
aatgatttaatgttttaagcta

SEQ ID NO: 1125075 - DNA, 22 bp, Artificial Sequence
  chemically synthesized
agacatttttggcattaatagc

SEQ ID NO: 1125076 - DNA, 22 bp, Artificial Sequence
  chemically synthesized
aatgttttaagctattaatgcc

SEQ ID NO: 1125077 - DNA, 22 bp, Artificial Sequence
  chemically synthesized
atgttttaagctattaatgcca

SEQ ID NO: 1125078 - DNA, 22 bp, Artificial Sequence
  chemically synthesized
taagctattaatgccaaaaatg

SEQ ID NO: 1125079 - DNA, 22 bp, Artificial Sequence
  chemically synthesized
aagctattaatgccaaaaatgt

SEQ ID NO: 1125080 - DNA, 22 bp, Artificial Sequence
  chemically synthesized
agctattaatgccaaaaatgtc

SEQ ID NO: 1125081 - DNA, 22 bp, Artificial Sequence
  chemically synthesized
ttaatgccaaaaatgtctgagt

SEQ ID NO: 1125082 - DNA, 22 bp, Artificial Sequence
  chemically synthesized
atgccaaaaatgtctgagttat

SEQ ID NO: 1125083 - DNA, 22 bp, Artificial Sequence
  chemically synthesized
agttatttggtattgatattca

SEQ ID NO: 1125084 - DNA, 22 bp, Artificial Sequence
  chemically synthesized
tgggtgccaagatgaatatcaa

SEQ ID NO: 1125085 - DNA, 22 bp, Artificial Sequence
  chemically synthesized
tatgggtgccaagatgaatatc

SEQ ID NO: 1125086 - DNA, 22 bp, Artificial Sequence
  chemically synthesized
tttggtattgatattcatcttg

SEQ ID NO: 1125087 - DNA, 22 bp, Artificial Sequence
  chemically synthesized
ggtattgatattcatcttggca

SEQ ID NO: 1125088 - DNA, 22 bp, Artificial Sequence
  chemically synthesized
gtattgatattcatcttggcac

SEQ ID NO: 1125089 - DNA, 22 bp, Artificial Sequence
  chemically synthesized
atattcatcttggcacccatag

SEQ ID NO: 1125090 - DNA, 22 bp, Artificial Sequence
  chemically synthesized
caatcaacgattctatgggtgc

SEQ ID NO: 1125091 - DNA, 22 bp, Artificial Sequence
  chemically synthesized
actgcaatcaacgattctatgg

SEQ ID NO: 1125092 - DNA, 22 bp, Artificial Sequence
  chemically synthesized
cactgcaatcaacgattctatg

SEQ ID NO: 1125093 - DNA, 22 bp, Artificial Sequence
  chemically synthesized
atcttggcacccatagaatcgt

SEQ ID NO: 1125094 - DNA, 22 bp, Artificial Sequence
  chemically synthesized
ttcactgcaatcaacgattcta

SEQ ID NO: 1125095 - DNA, 22 bp, Artificial Sequence
  chemically synthesized
tcttcactgcaatcaacgattc

SEQ ID NO: 1125096 - DNA, 22 bp, Artificial Sequence
  chemically synthesized
ggcacccatagaatcgttgatt

SEQ ID NO: 1125097 - DNA, 22 bp, Artificial Sequence
  chemically synthesized
gcacccatagaatcgttgattg

SEQ ID NO: 1125098 - DNA, 22 bp, Artificial Sequence
  chemically synthesized
ttctcttcactgcaatcaacga

SEQ ID NO: 1125099 - DNA, 22 bp, Artificial Sequence
  chemically synthesized
attctcttcactgcaatcaacg

SEQ ID NO: 1125100 - DNA, 22 bp, Artificial Sequence
  chemically synthesized
tattctcttcactgcaatcaac

SEQ ID NO: 1125101 - DNA, 22 bp, Artificial Sequence
  chemically synthesized
cagcagttttattctcttcact

SEQ ID NO: 1125102 - DNA, 22 bp, Artificial Sequence
  chemically synthesized
acagcagttttattctcttcac

SEQ ID NO: 1125103 - DNA, 22 bp, Artificial Sequence
  chemically synthesized
tacagcagttttattctcttca

SEQ ID NO: 1125104 - DNA, 22 bp, Artificial Sequence
  chemically synthesized
attgcagtgaagagaataaaac

SEQ ID NO: 1125105 - DNA, 22 bp, Artificial Sequence
  chemically synthesized
cagtgaagagaataaaactgct

SEQ ID NO: 1125106 - DNA, 22 bp, Artificial Sequence
  chemically synthesized
tgcagagaagcaatattttaca

SEQ ID NO: 1125107 - DNA, 22 bp, Artificial Sequence
  chemically synthesized
gtgcagagaagcaatattttac

SEQ ID NO: 1125108 - DNA, 22 bp, Artificial Sequence
  chemically synthesized
tgtgcagagaagcaatatttta

SEQ ID NO: 1125109 - DNA, 22 bp, Artificial Sequence
  chemically synthesized
ctttgtgcagagaagcaatatt

SEQ ID NO: 1125110 - DNA, 22 bp, Artificial Sequence
  chemically synthesized
actttgtgcagagaagcaatat

SEQ ID NO: 1125111 - DNA, 22 bp, Artificial Sequence
  chemically synthesized
tactttgtgcagagaagcaata

SEQ ID NO: 1125112 - DNA, 22 bp, Artificial Sequence
  chemically synthesized
ctgtaaaatattgcttctctgc

SEQ ID NO: 1125113 - DNA, 22 bp, Artificial Sequence
  chemically synthesized
taaaatattgcttctctgcaca

SEQ ID NO: 1125114 - DNA, 22 bp, Artificial Sequence
  chemically synthesized
ggtaagttttactttgtgcaga

SEQ ID NO: 1125115 - DNA, 22 bp, Artificial Sequence
  chemically synthesized
aggtaagttttactttgtgcag

SEQ ID NO: 1125116 - DNA, 22 bp, Artificial Sequence
  chemically synthesized
taggtaagttttactttgtgca

SEQ ID NO: 1125117 - DNA, 22 bp, Artificial Sequence
  chemically synthesized
cttctctgcacaaagtaaaact

SEQ ID NO: 1125118 - DNA, 22 bp, Artificial Sequence
  chemically synthesized
ctctgcacaaagtaaaacttac

SEQ ID NO: 1125119 - DNA, 22 bp, Artificial Sequence
  chemically synthesized
tctgcacaaagtaaaacttacc

SEQ ID NO: 1125120 - DNA, 22 bp, Artificial Sequence
  chemically synthesized
tgcacaaagtaaaacttaccta

SEQ ID NO: 1125121 - DNA, 22 bp, Artificial Sequence
  chemically synthesized
cacaaagtaaaacttacctaaa

SEQ ID NO: 1125122 - DNA, 22 bp, Artificial Sequence
  chemically synthesized
ccagacgtcaaaatattttagg

SEQ ID NO: 1125123 - DNA, 22 bp, Artificial Sequence
  chemically synthesized
cctaccagacgtcaaaatattt

SEQ ID NO: 1125124 - DNA, 22 bp, Artificial Sequence
  chemically synthesized
tacctaccagacgtcaaaatat

SEQ ID NO: 1125125 - DNA, 22 bp, Artificial Sequence
  chemically synthesized
ctacctaccagacgtcaaaata

SEQ ID NO: 1125126 - DNA, 22 bp, Artificial Sequence
  chemically synthesized
acctaaaatattttgacgtctg

SEQ ID NO: 1125127 - DNA, 22 bp, Artificial Sequence
  chemically synthesized
cctaaaatattttgacgtctgg

SEQ ID NO: 1125128 - DNA, 22 bp, Artificial Sequence
  chemically synthesized
aaatattttgacgtctggtagg

SEQ ID NO: 1125129 - DNA, 22 bp, Artificial Sequence
  chemically synthesized
acatcatttctacctaccagac

SEQ ID NO: 1125130 - DNA, 22 bp, Artificial Sequence
  chemically synthesized
aacatcatttctacctaccaga

SEQ ID NO: 1125131 - DNA, 22 bp, Artificial Sequence
  chemically synthesized
taacatcatttctacctaccag

SEQ ID NO: 1125132 - DNA, 22 bp, Artificial Sequence
  chemically synthesized
ttttaacatcatttctacctac

SEQ ID NO: 1125133 - DNA, 22 bp, Artificial Sequence
  chemically synthesized
tgacgtctggtaggtagaaatg

SEQ ID NO: 1125134 - DNA, 22 bp, Artificial Sequence
  chemically synthesized
gacgtctggtaggtagaaatga

SEQ ID NO: 1125135 - DNA, 22 bp, Artificial Sequence
  chemically synthesized
acgtctggtaggtagaaatgat

SEQ ID NO: 1125136 - DNA, 22 bp, Artificial Sequence
  chemically synthesized
gtaggtagaaatgatgttaaaa

SEQ ID NO: 1125137 - DNA, 22 bp, Artificial Sequence
  chemically synthesized
aggtaggaagattattttaaca

SEQ ID NO: 1125138 - DNA, 22 bp, Artificial Sequence
  chemically synthesized
ataccaaattaaggtaggaaga

SEQ ID NO: 1125139 - DNA, 22 bp, Artificial Sequence
  chemically synthesized
aataccaaattaaggtaggaag

SEQ ID NO: 1125140 - DNA, 22 bp, Artificial Sequence
  chemically synthesized
aaataatcttcctaccttaatt

SEQ ID NO: 1125141 - DNA, 22 bp, Artificial Sequence
  chemically synthesized
agatttaataccaaattaaggt

SEQ ID NO: 1125142 - DNA, 22 bp, Artificial Sequence
  chemically synthesized
cctaccttaatttggtattaaa

SEQ ID NO: 1125143 - DNA, 22 bp, Artificial Sequence
  chemically synthesized
aaatgattaagatttaatacca

SEQ ID NO: 1125144 - DNA, 22 bp, Artificial Sequence
  chemically synthesized
ctaccttaatttggtattaaat

SEQ ID NO: 1125145 - DNA, 22 bp, Artificial Sequence
  chemically synthesized
gaaatgattaagatttaatacc

SEQ ID NO: 1125146 - DNA, 22 bp, Artificial Sequence
  chemically synthesized
tgaaatgattaagatttaatac

SEQ ID NO: 1125147 - DNA, 22 bp, Artificial Sequence
  chemically synthesized
ccttaatttggtattaaatctt

SEQ ID NO: 1125148 - DNA, 22 bp, Artificial Sequence
  chemically synthesized
aatttggtattaaatcttaatc

SEQ ID NO: 1125149 - DNA, 22 bp, Artificial Sequence
  chemically synthesized
atttggtattaaatcttaatca

SEQ ID NO: 1125150 - DNA, 22 bp, Artificial Sequence
  chemically synthesized
ggtattaaatcttaatcatttc

SEQ ID NO: 1125151 - DNA, 22 bp, Artificial Sequence
  chemically synthesized
ccaatgaattttgaaatgatta

SEQ ID NO: 1125152 - DNA, 22 bp, Artificial Sequence
  chemically synthesized
gtattaaatcttaatcatttca

SEQ ID NO: 1125153 - DNA, 22 bp, Artificial Sequence
  chemically synthesized
aatcttaatcatttcaaaattc

SEQ ID NO: 1125154 - DNA, 22 bp, Artificial Sequence
  chemically synthesized
aatcatttcaaaattcattggt

SEQ ID NO: 1125155 - DNA, 22 bp, Artificial Sequence
  chemically synthesized
gaaataaatattaccaatgaat

SEQ ID NO: 1125156 - DNA, 22 bp, Artificial Sequence
  chemically synthesized
atcatttcaaaattcattggta

SEQ ID NO: 1125157 - DNA, 22 bp, Artificial Sequence
  chemically synthesized
agaaataaatattaccaatgaa

SEQ ID NO: 1125158 - DNA, 22 bp, Artificial Sequence
  chemically synthesized
tagaaataaatattaccaatga

SEQ ID NO: 1125159 - DNA, 22 bp, Artificial Sequence
  chemically synthesized
caaaattcattggtaatattta

SEQ ID NO: 1125160 - DNA, 22 bp, Artificial Sequence
  chemically synthesized
aaaattcattggtaatatttat

SEQ ID NO: 1125161 - DNA, 22 bp, Artificial Sequence
  chemically synthesized
attggtaatatttatttctaaa

SEQ ID NO: 1125162 - DNA, 22 bp, Artificial Sequence
  chemically synthesized
aatcatgtcacactttagaaat

SEQ ID NO: 1125163 - DNA, 22 bp, Artificial Sequence
  chemically synthesized
gtaatatttatttctaaagtgt

SEQ ID NO: 1125164 - DNA, 22 bp, Artificial Sequence
  chemically synthesized
ttcaatcatgtcacactttaga

SEQ ID NO: 1125165 - DNA, 22 bp, Artificial Sequence
  chemically synthesized
atttctaaagtgtgacatgatt

SEQ ID NO: 1125166 - DNA, 22 bp, Artificial Sequence
  chemically synthesized
tttctaaagtgtgacatgattg

SEQ ID NO: 1125167 - DNA, 22 bp, Artificial Sequence
  chemically synthesized
ctaaagtgtgacatgattgaac

SEQ ID NO: 1125168 - DNA, 22 bp, Artificial Sequence
  chemically synthesized
taaagtgtgacatgattgaaca

SEQ ID NO: 1125169 - DNA, 22 bp, Artificial Sequence
  chemically synthesized
taaatgtgacatctgttcaatc

SEQ ID NO: 1125170 - DNA, 22 bp, Artificial Sequence
  chemically synthesized
aagtgtgacatgattgaacaga

SEQ ID NO: 1125171 - DNA, 22 bp, Artificial Sequence
  chemically synthesized
ataaatgtgacatctgttcaat

SEQ ID NO: 1125172 - DNA, 22 bp, Artificial Sequence
  chemically synthesized
aacaaaacttataaatgtgaca

SEQ ID NO: 1125173 - DNA, 22 bp, Artificial Sequence
  chemically synthesized
aaacaaaacttataaatgtgac

SEQ ID NO: 1125174 - DNA, 22 bp, Artificial Sequence
  chemically synthesized
aacagatgtcacatttataagt

SEQ ID NO: 1125175 - DNA, 22 bp, Artificial Sequence
  chemically synthesized
aaagatatttaaacaaaactta

SEQ ID NO: 1125176 - DNA, 22 bp, Artificial Sequence
  chemically synthesized
tcaaagatatttaaacaaaact

SEQ ID NO: 1125177 - DNA, 22 bp, Artificial Sequence
  chemically synthesized
tctcaaagatatttaaacaaaa

SEQ ID NO: 1125178 - DNA, 22 bp, Artificial Sequence
  chemically synthesized
ctctcaaagatatttaaacaaa

SEQ ID NO: 1125179 - DNA, 22 bp, Artificial Sequence
  chemically synthesized
tttctctcaaagatatttaaac

SEQ ID NO: 1125180 - DNA, 22 bp, Artificial Sequence
  chemically synthesized
ataagttttgtttaaatatctt

SEQ ID NO: 1125181 - DNA, 22 bp, Artificial Sequence
  chemically synthesized
taagttttgtttaaatatcttt

SEQ ID NO: 1125182 - DNA, 22 bp, Artificial Sequence
  chemically synthesized
aggttgtttctctcaaagatat

SEQ ID NO: 1125183 - DNA, 22 bp, Artificial Sequence
  chemically synthesized
aaggttgtttctctcaaagata

SEQ ID NO: 1125184 - DNA, 22 bp, Artificial Sequence
  chemically synthesized
taaggttgtttctctcaaagat

SEQ ID NO: 1125185 - DNA, 22 bp, Artificial Sequence
  chemically synthesized
ttaaggttgtttctctcaaaga

SEQ ID NO: 1125186 - DNA, 22 bp, Artificial Sequence
  chemically synthesized
tgtttaaatatctttgagagaa

SEQ ID NO: 1125187 - DNA, 22 bp, Artificial Sequence
  chemically synthesized
gtttaaatatctttgagagaaa

SEQ ID NO: 1125188 - DNA, 22 bp, Artificial Sequence
  chemically synthesized
tttaaatatctttgagagaaac

SEQ ID NO: 1125189 - DNA, 22 bp, Artificial Sequence
  chemically synthesized
atttttaaggttgtttctctca

SEQ ID NO: 1125190 - DNA, 22 bp, Artificial Sequence
  chemically synthesized
aatttttaaggttgtttctctc

SEQ ID NO: 1125191 - DNA, 22 bp, Artificial Sequence
  chemically synthesized
taatttttaaggttgtttctct

SEQ ID NO: 1125192 - DNA, 22 bp, Artificial Sequence
  chemically synthesized
aaatatctttgagagaaacaac

SEQ ID NO: 1125193 - DNA, 22 bp, Artificial Sequence
  chemically synthesized
ttaatttttaaggttgtttctc

SEQ ID NO: 1125194 - DNA, 22 bp, Artificial Sequence
  chemically synthesized
aatatctttgagagaaacaacc

SEQ ID NO: 1125195 - DNA, 22 bp, Artificial Sequence
  chemically synthesized
ccttttaatttttaaggttgtt

SEQ ID NO: 1125196 - DNA, 22 bp, Artificial Sequence
  chemically synthesized
accttttaatttttaaggttgt

SEQ ID NO: 1125197 - DNA, 22 bp, Artificial Sequence
  chemically synthesized
ttaccttttaatttttaaggtt

SEQ ID NO: 1125198 - DNA, 22 bp, Artificial Sequence
  chemically synthesized
cttaccttttaatttttaaggt

SEQ ID NO: 1125199 - DNA, 22 bp, Artificial Sequence
  chemically synthesized
tgagagaaacaaccttaaaaat

SEQ ID NO: 1125200 - DNA, 22 bp, Artificial Sequence
  chemically synthesized
gagagaaacaaccttaaaaatt

SEQ ID NO: 1125201 - DNA, 22 bp, Artificial Sequence
  chemically synthesized
agagaaacaaccttaaaaatta

SEQ ID NO: 1125202 - DNA, 22 bp, Artificial Sequence
  chemically synthesized
tgggggtttcttaccttttaat

SEQ ID NO: 1125203 - DNA, 22 bp, Artificial Sequence
  chemically synthesized
gtgggggtttcttaccttttaa

SEQ ID NO: 1125204 - DNA, 22 bp, Artificial Sequence
  chemically synthesized
gaatttgtgggggtttcttacc

SEQ ID NO: 1125205 - DNA, 22 bp, Artificial Sequence
  chemically synthesized
aaaaattaaaaggtaagaaacc

SEQ ID NO: 1125206 - DNA, 22 bp, Artificial Sequence
  chemically synthesized
agaatttgtgggggtttcttac

SEQ ID NO: 1125207 - DNA, 22 bp, Artificial Sequence
  chemically synthesized
aaaattaaaaggtaagaaaccc

SEQ ID NO: 1125208 - DNA, 22 bp, Artificial Sequence
  chemically synthesized
tagaatttgtgggggtttctta

SEQ ID NO: 1125209 - DNA, 22 bp, Artificial Sequence
  chemically synthesized
acattttagaatttgtgggggt

SEQ ID NO: 1125210 - DNA, 22 bp, Artificial Sequence
  chemically synthesized
aaaggtaagaaacccccacaaa

SEQ ID NO: 1125211 - DNA, 22 bp, Artificial Sequence
  chemically synthesized
atgtagcagtatctgacatttt

SEQ ID NO: 1125212 - DNA, 22 bp, Artificial Sequence
  chemically synthesized
taatgtagcagtatctgacatt

SEQ ID NO: 1125213 - DNA, 22 bp, Artificial Sequence
  chemically synthesized
ctctaatgtagcagtatctgac

SEQ ID NO: 1125214 - DNA, 22 bp, Artificial Sequence
  chemically synthesized
attcctctaatgtagcagtatc

SEQ ID NO: 1125215 - DNA, 22 bp, Artificial Sequence
  chemically synthesized
taaaatgtcagatactgctaca

SEQ ID NO: 1125216 - DNA, 22 bp, Artificial Sequence
  chemically synthesized
aaatgtcagatactgctacatt

SEQ ID NO: 1125217 - DNA, 22 bp, Artificial Sequence
  chemically synthesized
taactaattcctctaatgtagc

SEQ ID NO: 1125218 - DNA, 22 bp, Artificial Sequence
  chemically synthesized
ataactaattcctctaatgtag

SEQ ID NO: 1125219 - DNA, 22 bp, Artificial Sequence
  chemically synthesized
tataactaattcctctaatgta

SEQ ID NO: 1125220 - DNA, 22 bp, Artificial Sequence
  chemically synthesized
gctttataactaattcctctaa

SEQ ID NO: 1125221 - DNA, 22 bp, Artificial Sequence
  chemically synthesized
ggctttataactaattcctcta

SEQ ID NO: 1125222 - DNA, 22 bp, Artificial Sequence
  chemically synthesized
cttggctttataactaattcct

SEQ ID NO: 1125223 - DNA, 22 bp, Artificial Sequence
  chemically synthesized
ctacattagaggaattagttat

SEQ ID NO: 1125224 - DNA, 22 bp, Artificial Sequence
  chemically synthesized
cattagaggaattagttataaa

SEQ ID NO: 1125225 - DNA, 22 bp, Artificial Sequence
  chemically synthesized
acactccttggctttataacta

SEQ ID NO: 1125226 - DNA, 22 bp, Artificial Sequence
  chemically synthesized
cacactccttggctttataact

SEQ ID NO: 1125227 - DNA, 22 bp, Artificial Sequence
  chemically synthesized
tcacactccttggctttataac

SEQ ID NO: 1125228 - DNA, 22 bp, Artificial Sequence
  chemically synthesized
gaggaattagttataaagccaa

SEQ ID NO: 1125229 - DNA, 22 bp, Artificial Sequence
  chemically synthesized
cccacgtgttttcacactcctt

SEQ ID NO: 1125230 - DNA, 22 bp, Artificial Sequence
  chemically synthesized
gttataaagccaaggagtgtga

SEQ ID NO: 1125231 - DNA, 22 bp, Artificial Sequence
  chemically synthesized
gcccacgtgttttcacactcct

SEQ ID NO: 1125232 - DNA, 22 bp, Artificial Sequence
  chemically synthesized
tgcccacgtgttttcacactcc

SEQ ID NO: 1125233 - DNA, 22 bp, Artificial Sequence
  chemically synthesized
ttgcccacgtgttttcacactc

SEQ ID NO: 1125234 - DNA, 22 bp, Artificial Sequence
  chemically synthesized
taaagccaaggagtgtgaaaac

SEQ ID NO: 1125235 - DNA, 22 bp, Artificial Sequence
  chemically synthesized
ggtcatgcagtttttgcccacg

SEQ ID NO: 1125236 - DNA, 22 bp, Artificial Sequence
  chemically synthesized
tgggtcatgcagtttttgccca

SEQ ID NO: 1125237 - DNA, 22 bp, Artificial Sequence
  chemically synthesized
ccatcctctgggtcatgcagtt

SEQ ID NO: 1125238 - DNA, 22 bp, Artificial Sequence
  chemically synthesized
cccatcctctgggtcatgcagt

SEQ ID NO: 1125239 - DNA, 22 bp, Artificial Sequence
  chemically synthesized
tttcccatcctctgggtcatgc

SEQ ID NO: 1125240 - DNA, 22 bp, Artificial Sequence
  chemically synthesized
atttcccatcctctgggtcatg

SEQ ID NO: 1125241 - DNA, 22 bp, Artificial Sequence
  chemically synthesized
tatttcccatcctctgggtcat

SEQ ID NO: 1125242 - DNA, 22 bp, Artificial Sequence
  chemically synthesized
gcagcattttatttcccatcct

SEQ ID NO: 1125243 - DNA, 22 bp, Artificial Sequence
  chemically synthesized
agcagcattttatttcccatcc

SEQ ID NO: 1125244 - DNA, 22 bp, Artificial Sequence
  chemically synthesized
catgacccagaggatgggaaat

SEQ ID NO: 1125245 - DNA, 22 bp, Artificial Sequence
  chemically synthesized
tggcttagcagcattttatttc

SEQ ID NO: 1125246 - DNA, 22 bp, Artificial Sequence
  chemically synthesized
ggcatctgtggcttagcagcat

SEQ ID NO: 1125247 - DNA, 22 bp, Artificial Sequence
  chemically synthesized
aggcatctgtggcttagcagca

SEQ ID NO: 1125248 - DNA, 22 bp, Artificial Sequence
  chemically synthesized
taggcatctgtggcttagcagc

SEQ ID NO: 1125249 - DNA, 22 bp, Artificial Sequence
  chemically synthesized
ctaagccacagatgcctaaagc

SEQ ID NO: 1125250 - DNA, 22 bp, Artificial Sequence
  chemically synthesized
aaaatgaaaaataggctttagg

SEQ ID NO: 1125251 - DNA, 22 bp, Artificial Sequence
  chemically synthesized
agccacagatgcctaaagccta

SEQ ID NO: 1125252 - DNA, 22 bp, Artificial Sequence
  chemically synthesized
ttgaaaatgaaaaataggcttt

SEQ ID NO: 1125253 - DNA, 22 bp, Artificial Sequence
  chemically synthesized
attgaaaatgaaaaataggctt

SEQ ID NO: 1125254 - DNA, 22 bp, Artificial Sequence
  chemically synthesized
aatttattgaaaatgaaaaata

SEQ ID NO: 1125255 - DNA, 22 bp, Artificial Sequence
  chemically synthesized
caatttattgaaaatgaaaaat

SEQ ID NO: 1125256 - DNA, 22 bp, Artificial Sequence
  chemically synthesized
tcaatttattgaaaatgaaaaa

SEQ ID NO: 1125257 - DNA, 22 bp, Artificial Sequence
  chemically synthesized
aagcctatttttcattttcaat

SEQ ID NO: 1125258 - DNA, 22 bp, Artificial Sequence
  chemically synthesized
aaagggactttcaatttattga

SEQ ID NO: 1125259 - DNA, 22 bp, Artificial Sequence
  chemically synthesized
caaagggactttcaatttattg

SEQ ID NO: 1125260 - DNA, 22 bp, Artificial Sequence
  chemically synthesized
tttttcattttcaataaattga

SEQ ID NO: 1125261 - DNA, 22 bp, Artificial Sequence
  chemically synthesized
ttcattttcaataaattgaaag

SEQ ID NO: 1125262 - DNA, 22 bp, Artificial Sequence
  chemically synthesized
tcattttcaataaattgaaagt

SEQ ID NO: 1125263 - DNA, 22 bp, Artificial Sequence
  chemically synthesized
cattttcaataaattgaaagtc

SEQ ID NO: 1125264 - DNA, 22 bp, Artificial Sequence
  chemically synthesized
attttcaataaattgaaagtcc

SEQ ID NO: 1125265 - DNA, 22 bp, Artificial Sequence
  chemically synthesized
tcaataaattgaaagtcccttt

SEQ ID NO: 1125266 - DNA, 22 bp, Artificial Sequence
  chemically synthesized
caataaattgaaagtccctttg

SEQ ID NO: 1125267 - DNA, 22 bp, Artificial Sequence
  chemically synthesized
aataaattgaaagtccctttga

SEQ ID NO: 1125268 - DNA, 22 bp, Artificial Sequence
  chemically synthesized
cacagaagtgtgtttcaaaggg

SEQ ID NO: 1125269 - DNA, 22 bp, Artificial Sequence
  chemically synthesized
gcacagaagtgtgtttcaaagg

SEQ ID NO: 1125270 - DNA, 22 bp, Artificial Sequence
  chemically synthesized
ttgcacagaagtgtgtttcaaa

SEQ ID NO: 1125271 - DNA, 22 bp, Artificial Sequence
  chemically synthesized
cttgcacagaagtgtgtttcaa

SEQ ID NO: 1125272 - DNA, 22 bp, Artificial Sequence
  chemically synthesized
tcttgcacagaagtgtgtttca

SEQ ID NO: 1125273 - DNA, 22 bp, Artificial Sequence
  chemically synthesized
aaagtccctttgaaacacactt

SEQ ID NO: 1125274 - DNA, 22 bp, Artificial Sequence
  chemically synthesized
aggtgattttcttgcacagaag

SEQ ID NO: 1125275 - DNA, 22 bp, Artificial Sequence
  chemically synthesized
tgaaacacacttctgtgcaaga

SEQ ID NO: 1125276 - DNA, 22 bp, Artificial Sequence
  chemically synthesized
gaaacacacttctgtgcaagaa

SEQ ID NO: 1125277 - DNA, 22 bp, Artificial Sequence
  chemically synthesized
aaacacacttctgtgcaagaaa

SEQ ID NO: 1125278 - DNA, 22 bp, Artificial Sequence
  chemically synthesized
tgttaaggtgattttcttgcac

SEQ ID NO: 1125279 - DNA, 22 bp, Artificial Sequence
  chemically synthesized
acctgtgttaaggtgattttct

SEQ ID NO: 1125280 - DNA, 22 bp, Artificial Sequence
  chemically synthesized
ttaacctgtgttaaggtgattt

SEQ ID NO: 1125281 - DNA, 22 bp, Artificial Sequence
  chemically synthesized
ctgtgcaagaaaatcaccttaa

SEQ ID NO: 1125282 - DNA, 22 bp, Artificial Sequence
  chemically synthesized
tattaacctgtgttaaggtgat

SEQ ID NO: 1125283 - DNA, 22 bp, Artificial Sequence
  chemically synthesized
tgtgcaagaaaatcaccttaac

SEQ ID NO: 1125284 - DNA, 22 bp, Artificial Sequence
  chemically synthesized
ctattaacctgtgttaaggtga

SEQ ID NO: 1125285 - DNA, 22 bp, Artificial Sequence
  chemically synthesized
tgcaagaaaatcaccttaacac

SEQ ID NO: 1125286 - DNA, 22 bp, Artificial Sequence
  chemically synthesized
agagaatatttctattaacctg

SEQ ID NO: 1125287 - DNA, 22 bp, Artificial Sequence
  chemically synthesized
aagagaatatttctattaacct

SEQ ID NO: 1125288 - DNA, 22 bp, Artificial Sequence
  chemically synthesized
tcatttaagagaatatttctat

SEQ ID NO: 1125289 - DNA, 22 bp, Artificial Sequence
  chemically synthesized
aacacaggttaatagaaatatt

SEQ ID NO: 1125290 - DNA, 22 bp, Artificial Sequence
  chemically synthesized
acacaggttaatagaaatattc

SEQ ID NO: 1125291 - DNA, 22 bp, Artificial Sequence
  chemically synthesized
atctatcatttaagagaatatt

SEQ ID NO: 1125292 - DNA, 22 bp, Artificial Sequence
  chemically synthesized
catctatcatttaagagaatat

SEQ ID NO: 1125293 - DNA, 22 bp, Artificial Sequence
  chemically synthesized
atagaaatattctcttaaatga

SEQ ID NO: 1125294 - DNA, 22 bp, Artificial Sequence
  chemically synthesized
acaggatttcatctatcattta

SEQ ID NO: 1125295 - DNA, 22 bp, Artificial Sequence
  chemically synthesized
tgacaggatttcatctatcatt

SEQ ID NO: 1125296 - DNA, 22 bp, Artificial Sequence
  chemically synthesized
ctctgacaggatttcatctatc

SEQ ID NO: 1125297 - DNA, 22 bp, Artificial Sequence
  chemically synthesized
ttactctgacaggatttcatct

SEQ ID NO: 1125298 - DNA, 22 bp, Artificial Sequence
  chemically synthesized
tcttaaatgatagatgaaatcc

SEQ ID NO: 1125299 - DNA, 22 bp, Artificial Sequence
  chemically synthesized
attactctgacaggatttcatc

SEQ ID NO: 1125300 - DNA, 22 bp, Artificial Sequence
  chemically synthesized
ttaaatgatagatgaaatcctg

SEQ ID NO: 1125301 - DNA, 22 bp, Artificial Sequence
  chemically synthesized
aaatgatagatgaaatcctgtc

SEQ ID NO: 1125302 - DNA, 22 bp, Artificial Sequence
  chemically synthesized
aatgatagatgaaatcctgtca

SEQ ID NO: 1125303 - DNA, 22 bp, Artificial Sequence
  chemically synthesized
tatgatcatagatttattactc

SEQ ID NO: 1125304 - DNA, 22 bp, Artificial Sequence
  chemically synthesized
tattgtatgatcatagatttat

SEQ ID NO: 1125305 - DNA, 22 bp, Artificial Sequence
  chemically synthesized
tcagagtaataaatctatgatc

SEQ ID NO: 1125306 - DNA, 22 bp, Artificial Sequence
  chemically synthesized
agtatattatattgtatgatca

SEQ ID NO: 1125307 - DNA, 22 bp, Artificial Sequence
  chemically synthesized
gagtatattatattgtatgatc

SEQ ID NO: 1125308 - DNA, 22 bp, Artificial Sequence
  chemically synthesized
aacttgagtatattatattgta

SEQ ID NO: 1125309 - DNA, 22 bp, Artificial Sequence
  chemically synthesized
caacttgagtatattatattgt

SEQ ID NO: 1125310 - DNA, 22 bp, Artificial Sequence
  chemically synthesized
tcaacttgagtatattatattg

SEQ ID NO: 1125311 - DNA, 22 bp, Artificial Sequence
  chemically synthesized
tgatcatacaatataatatact

SEQ ID NO: 1125312 - DNA, 22 bp, Artificial Sequence
  chemically synthesized
aggattttcaacttgagtatat

SEQ ID NO: 1125313 - DNA, 22 bp, Artificial Sequence
  chemically synthesized
aaatatatgactcaggattttc

SEQ ID NO: 1125314 - DNA, 22 bp, Artificial Sequence
  chemically synthesized
aaaatatatgactcaggatttt

SEQ ID NO: 1125315 - DNA, 22 bp, Artificial Sequence
  chemically synthesized
taaaatatatgactcaggattt

SEQ ID NO: 1125316 - DNA, 22 bp, Artificial Sequence
  chemically synthesized
attttaaaatatatgactcagg

SEQ ID NO: 1125317 - DNA, 22 bp, Artificial Sequence
  chemically synthesized
aagttgaaaatcctgagtcata

SEQ ID NO: 1125318 - DNA, 22 bp, Artificial Sequence
  chemically synthesized
gattttaaaatatatgactcag

SEQ ID NO: 1125319 - DNA, 22 bp, Artificial Sequence
  chemically synthesized
catttgattttaaaatatatga

SEQ ID NO: 1125320 - DNA, 22 bp, Artificial Sequence
  chemically synthesized
aaaatcctgagtcatatatttt

SEQ ID NO: 1125321 - DNA, 22 bp, Artificial Sequence
  chemically synthesized
acatttgattttaaaatatatg

SEQ ID NO: 1125322 - DNA, 22 bp, Artificial Sequence
  chemically synthesized
tacatttgattttaaaatatat

SEQ ID NO: 1125323 - DNA, 22 bp, Artificial Sequence
  chemically synthesized
agtcatatattttaaaatcaaa

SEQ ID NO: 1125324 - DNA, 22 bp, Artificial Sequence
  chemically synthesized
aataaactttacatttgatttt

SEQ ID NO: 1125325 - DNA, 22 bp, Artificial Sequence
  chemically synthesized
aaataaactttacatttgattt

SEQ ID NO: 1125326 - DNA, 22 bp, Artificial Sequence
  chemically synthesized
taaataaactttacatttgatt

SEQ ID NO: 1125327 - DNA, 22 bp, Artificial Sequence
  chemically synthesized
atcattttaaataaactttaca

SEQ ID NO: 1125328 - DNA, 22 bp, Artificial Sequence
  chemically synthesized
catcattttaaataaactttac

SEQ ID NO: 1125329 - DNA, 22 bp, Artificial Sequence
  chemically synthesized
taaaatcaaatgtaaagtttat

SEQ ID NO: 1125330 - DNA, 22 bp, Artificial Sequence
  chemically synthesized
aaaatcaaatgtaaagtttatt

SEQ ID NO: 1125331 - DNA, 22 bp, Artificial Sequence
  chemically synthesized
aaatcaaatgtaaagtttattt

SEQ ID NO: 1125332 - DNA, 22 bp, Artificial Sequence
  chemically synthesized
ggtttcatcattttaaataaac

SEQ ID NO: 1125333 - DNA, 22 bp, Artificial Sequence
  chemically synthesized
gggtttcatcattttaaataaa

SEQ ID NO: 1125334 - DNA, 22 bp, Artificial Sequence
  chemically synthesized
tgggtttcatcattttaaataa

SEQ ID NO: 1125335 - DNA, 22 bp, Artificial Sequence
  chemically synthesized
ttgggtttcatcattttaaata

SEQ ID NO: 1125336 - DNA, 22 bp, Artificial Sequence
  chemically synthesized
atttaaaatgatgaaacccaaa

SEQ ID NO: 1125337 - DNA, 22 bp, Artificial Sequence
  chemically synthesized
tttaaaatgatgaaacccaaaa

SEQ ID NO: 1125338 - DNA, 22 bp, Artificial Sequence
  chemically synthesized
aaaatgatgaaacccaaaagct

SEQ ID NO: 1125339 - DNA, 22 bp, Artificial Sequence
  chemically synthesized
aaatgatgaaacccaaaagctg

SEQ ID NO: 1125340 - DNA, 22 bp, Artificial Sequence
  chemically synthesized
tcataaggacataggcagcttt

SEQ ID NO: 1125341 - DNA, 22 bp, Artificial Sequence
  chemically synthesized
atcataaggacataggcagctt

SEQ ID NO: 1125342 - DNA, 22 bp, Artificial Sequence
  chemically synthesized
tttatcataaggacataggcag

SEQ ID NO: 1125343 - DNA, 22 bp, Artificial Sequence
  chemically synthesized
atttatcataaggacataggca

SEQ ID NO: 1125344 - DNA, 22 bp, Artificial Sequence
  chemically synthesized
gtgacccacatttatttatcat

SEQ ID NO: 1125345 - DNA, 22 bp, Artificial Sequence
  chemically synthesized
cctatgtccttatgataaataa

SEQ ID NO: 1125346 - DNA, 22 bp, Artificial Sequence
  chemically synthesized
tagtgacccacatttatttatc

SEQ ID NO: 1125347 - DNA, 22 bp, Artificial Sequence
  chemically synthesized
tgtccttatgataaataaatgt

SEQ ID NO: 1125348 - DNA, 22 bp, Artificial Sequence
  chemically synthesized
atgataaataaatgtgggtcac

SEQ ID NO: 1125349 - DNA, 22 bp, Artificial Sequence
  chemically synthesized
tgataaataaatgtgggtcact

SEQ ID NO: 1125350 - DNA, 22 bp, Artificial Sequence
  chemically synthesized
aaagggaatgtgcgccctctag

SEQ ID NO: 1125351 - DNA, 22 bp, Artificial Sequence
  chemically synthesized
tgaaagggaatgtgcgccctct

SEQ ID NO: 1125352 - DNA, 22 bp, Artificial Sequence
  chemically synthesized
aagacaagctctgaaagggaat

SEQ ID NO: 1125353 - DNA, 22 bp, Artificial Sequence
  chemically synthesized
gagggcgcacattccctttcag

SEQ ID NO: 1125354 - DNA, 22 bp, Artificial Sequence
  chemically synthesized
cctttcagagcttgtcttcaat

SEQ ID NO: 1125355 - DNA, 22 bp, Artificial Sequence
  chemically synthesized
tcagagcttgtcttcaatttgg

SEQ ID NO: 1125356 - DNA, 22 bp, Artificial Sequence
  chemically synthesized
cagagcttgtcttcaatttggc

SEQ ID NO: 1125357 - DNA, 22 bp, Artificial Sequence
  chemically synthesized
agagcttgtcttcaatttggct

SEQ ID NO: 1125358 - DNA, 22 bp, Artificial Sequence
  chemically synthesized
gtcttcaatttggcttctttcg

SEQ ID NO: 1125359 - DNA, 22 bp, Artificial Sequence
  chemically synthesized
tcttcaatttggcttctttcgt

SEQ ID NO: 1125360 - DNA, 22 bp, Artificial Sequence
  chemically synthesized
tgcagataagaaaacgaaagaa

SEQ ID NO: 1125361 - DNA, 22 bp, Artificial Sequence
  chemically synthesized
caatttggcttctttcgttttc

SEQ ID NO: 1125362 - DNA, 22 bp, Artificial Sequence
  chemically synthesized
aatttggcttctttcgttttct

SEQ ID NO: 1125363 - DNA, 22 bp, Artificial Sequence
  chemically synthesized
gttatgcagataagaaaacgaa

SEQ ID NO: 1125364 - DNA, 22 bp, Artificial Sequence
  chemically synthesized
cgttatgcagataagaaaacga

SEQ ID NO: 1125365 - DNA, 22 bp, Artificial Sequence
  chemically synthesized
tcgttatgcagataagaaaacg

SEQ ID NO: 1125366 - DNA, 22 bp, Artificial Sequence
  chemically synthesized
ggcttctttcgttttcttatct

SEQ ID NO: 1125367 - DNA, 22 bp, Artificial Sequence
  chemically synthesized
gcttctttcgttttcttatctg

SEQ ID NO: 1125368 - DNA, 22 bp, Artificial Sequence
  chemically synthesized
ctttcgttttcttatctgcata

SEQ ID NO: 1125369 - DNA, 22 bp, Artificial Sequence
  chemically synthesized
tttcgttttcttatctgcataa

SEQ ID NO: 1125370 - DNA, 22 bp, Artificial Sequence
  chemically synthesized
tcgttttcttatctgcataacg

SEQ ID NO: 1125371 - DNA, 22 bp, Artificial Sequence
  chemically synthesized
tcaccatattttcgttatgcag

SEQ ID NO: 1125372 - DNA, 22 bp, Artificial Sequence
  chemically synthesized
cgttttcttatctgcataacga

SEQ ID NO: 1125373 - DNA, 22 bp, Artificial Sequence
  chemically synthesized
gtcaccatattttcgttatgca

SEQ ID NO: 1125374 - DNA, 22 bp, Artificial Sequence
  chemically synthesized
gttttcttatctgcataacgaa

SEQ ID NO: 1125375 - DNA, 22 bp, Artificial Sequence
  chemically synthesized
atttgtcaccatattttcgtta

SEQ ID NO: 1125376 - DNA, 22 bp, Artificial Sequence
  chemically synthesized
tcttatctgcataacgaaaata

SEQ ID NO: 1125377 - DNA, 22 bp, Artificial Sequence
  chemically synthesized
catttgtcaccatattttcgtt

SEQ ID NO: 1125378 - DNA, 22 bp, Artificial Sequence
  chemically synthesized
cttatctgcataacgaaaatat

SEQ ID NO: 1125379 - DNA, 22 bp, Artificial Sequence
  chemically synthesized
ttatctgcataacgaaaatatg

SEQ ID NO: 1125380 - DNA, 22 bp, Artificial Sequence
  chemically synthesized
atctgcataacgaaaatatggt

SEQ ID NO: 1125381 - DNA, 22 bp, Artificial Sequence
  chemically synthesized
tctgcataacgaaaatatggtg

SEQ ID NO: 1125382 - DNA, 22 bp, Artificial Sequence
  chemically synthesized
cataacgaaaatatggtgacaa

SEQ ID NO: 1125383 - DNA, 22 bp, Artificial Sequence
  chemically synthesized
catgaaaatttcatttgtcacc

SEQ ID NO: 1125384 - DNA, 22 bp, Artificial Sequence
  chemically synthesized
ccatgaaaatttcatttgtcac

SEQ ID NO: 1125385 - DNA, 22 bp, Artificial Sequence
  chemically synthesized
tgtaagtaaaacttccatgaaa

SEQ ID NO: 1125386 - DNA, 22 bp, Artificial Sequence
  chemically synthesized
tgtgtaagtaaaacttccatga

SEQ ID NO: 1125387 - DNA, 22 bp, Artificial Sequence
  chemically synthesized
ctgtgtaagtaaaacttccatg

SEQ ID NO: 1125388 - DNA, 22 bp, Artificial Sequence
  chemically synthesized
tatttctgtgtaagtaaaactt

SEQ ID NO: 1125389 - DNA, 22 bp, Artificial Sequence
  chemically synthesized
atatttctgtgtaagtaaaact

SEQ ID NO: 1125390 - DNA, 22 bp, Artificial Sequence
  chemically synthesized
tatatttctgtgtaagtaaaac

SEQ ID NO: 1125391 - DNA, 22 bp, Artificial Sequence
  chemically synthesized
tcatggaagttttacttacaca

SEQ ID NO: 1125392 - DNA, 22 bp, Artificial Sequence
  chemically synthesized
catggaagttttacttacacag

SEQ ID NO: 1125393 - DNA, 22 bp, Artificial Sequence
  chemically synthesized
atggaagttttacttacacaga

SEQ ID NO: 1125394 - DNA, 22 bp, Artificial Sequence
  chemically synthesized
gacattttatatttctgtgtaa

SEQ ID NO: 1125395 - DNA, 22 bp, Artificial Sequence
  chemically synthesized
ggacattttatatttctgtgta

SEQ ID NO: 1125396 - DNA, 22 bp, Artificial Sequence
  chemically synthesized
tggacattttatatttctgtgt

SEQ ID NO: 1125397 - DNA, 22 bp, Artificial Sequence
  chemically synthesized
tatctttggacattttatattt

SEQ ID NO: 1125398 - DNA, 22 bp, Artificial Sequence
  chemically synthesized
tacttacacagaaatataaaat

SEQ ID NO: 1125399 - DNA, 22 bp, Artificial Sequence
  chemically synthesized
acttacacagaaatataaaatg

SEQ ID NO: 1125400 - DNA, 22 bp, Artificial Sequence
  chemically synthesized
cttacacagaaatataaaatgt

SEQ ID NO: 1125401 - DNA, 22 bp, Artificial Sequence
  chemically synthesized
tctatatctttggacattttat

SEQ ID NO: 1125402 - DNA, 22 bp, Artificial Sequence
  chemically synthesized
atctatatctttggacatttta

SEQ ID NO: 1125403 - DNA, 22 bp, Artificial Sequence
  chemically synthesized
acacagaaatataaaatgtcca

SEQ ID NO: 1125404 - DNA, 22 bp, Artificial Sequence
  chemically synthesized
tatctatatctttggacatttt

SEQ ID NO: 1125405 - DNA, 22 bp, Artificial Sequence
  chemically synthesized
cacagaaatataaaatgtccaa

SEQ ID NO: 1125406 - DNA, 22 bp, Artificial Sequence
  chemically synthesized
ttttatctatatctttggacat

SEQ ID NO: 1125407 - DNA, 22 bp, Artificial Sequence
  chemically synthesized
tacactattttatctatatctt

SEQ ID NO: 1125408 - DNA, 22 bp, Artificial Sequence
  chemically synthesized
gtacactattttatctatatct

SEQ ID NO: 1125409 - DNA, 22 bp, Artificial Sequence
  chemically synthesized
tttgtacactattttatctata

SEQ ID NO: 1125410 - DNA, 22 bp, Artificial Sequence
  chemically synthesized
catattatttgtacactatttt

SEQ ID NO: 1125411 - DNA, 22 bp, Artificial Sequence
  chemically synthesized
acatattatttgtacactattt

SEQ ID NO: 1125412 - DNA, 22 bp, Artificial Sequence
  chemically synthesized
cttacatattatttgtacacta

SEQ ID NO: 1125413 - DNA, 22 bp, Artificial Sequence
  chemically synthesized
acttacatattatttgtacact

SEQ ID NO: 1125414 - DNA, 22 bp, Artificial Sequence
  chemically synthesized
agagtgtcttacttacatatta

SEQ ID NO: 1125415 - DNA, 22 bp, Artificial Sequence
  chemically synthesized
acagtgcatctgagagtgtctt

SEQ ID NO: 1125416 - DNA, 22 bp, Artificial Sequence
  chemically synthesized
aacagtgcatctgagagtgtct

SEQ ID NO: 1125417 - DNA, 22 bp, Artificial Sequence
  chemically synthesized
taacagtgcatctgagagtgtc

SEQ ID NO: 1125418 - DNA, 22 bp, Artificial Sequence
  chemically synthesized
aaggcattttaacagtgcatct

SEQ ID NO: 1125419 - DNA, 22 bp, Artificial Sequence
  chemically synthesized
tcagatgcactgttaaaatgcc

SEQ ID NO: 1125420 - DNA, 22 bp, Artificial Sequence
  chemically synthesized
aaaatggctgaaggcattttaa

SEQ ID NO: 1125421 - DNA, 22 bp, Artificial Sequence
  chemically synthesized
agatgcactgttaaaatgcctt

SEQ ID NO: 1125422 - DNA, 22 bp, Artificial Sequence
  chemically synthesized
tgtgtacctcaaaatggctgaa

SEQ ID NO: 1125423 - DNA, 22 bp, Artificial Sequence
  chemically synthesized
gtgtgtacctcaaaatggctga

SEQ ID NO: 1125424 - DNA, 22 bp, Artificial Sequence
  chemically synthesized
ttaaaatgccttcagccatttt

SEQ ID NO: 1125425 - DNA, 22 bp, Artificial Sequence
  chemically synthesized
tgtgtgtacctcaaaatggctg

SEQ ID NO: 1125426 - DNA, 22 bp, Artificial Sequence
  chemically synthesized
ttgtgtgtacctcaaaatggct

SEQ ID NO: 1125427 - DNA, 22 bp, Artificial Sequence
  chemically synthesized
aaatgccttcagccattttgag

SEQ ID NO: 1125428 - DNA, 22 bp, Artificial Sequence
  chemically synthesized
aaggtacttttgtgtgtacctc

SEQ ID NO: 1125429 - DNA, 22 bp, Artificial Sequence
  chemically synthesized
caaggtacttttgtgtgtacct

SEQ ID NO: 1125430 - DNA, 22 bp, Artificial Sequence
  chemically synthesized
cagccattttgaggtacacaca

SEQ ID NO: 1125431 - DNA, 22 bp, Artificial Sequence
  chemically synthesized
agccattttgaggtacacacaa

SEQ ID NO: 1125432 - DNA, 22 bp, Artificial Sequence
  chemically synthesized
tggcttcaaggtacttttgtgt

SEQ ID NO: 1125433 - DNA, 22 bp, Artificial Sequence
  chemically synthesized
tgaggtacacacaaaagtacct

SEQ ID NO: 1125434 - DNA, 22 bp, Artificial Sequence
  chemically synthesized
gaggtacacacaaaagtacctt

SEQ ID NO: 1125435 - DNA, 22 bp, Artificial Sequence
  chemically synthesized
aggtacacacaaaagtaccttg

SEQ ID NO: 1125436 - DNA, 22 bp, Artificial Sequence
  chemically synthesized
tgtattatggcttcaaggtact

SEQ ID NO: 1125437 - DNA, 22 bp, Artificial Sequence
  chemically synthesized
tatgtattatggcttcaaggta

SEQ ID NO: 1125438 - DNA, 22 bp, Artificial Sequence
  chemically synthesized
aagggattctatgtattatggc

SEQ ID NO: 1125439 - DNA, 22 bp, Artificial Sequence
  chemically synthesized
tcaagggattctatgtattatg

SEQ ID NO: 1125440 - DNA, 22 bp, Artificial Sequence
  chemically synthesized
ctcaagggattctatgtattat

SEQ ID NO: 1125441 - DNA, 22 bp, Artificial Sequence
  chemically synthesized
tctcaagggattctatgtatta

SEQ ID NO: 1125442 - DNA, 22 bp, Artificial Sequence
  chemically synthesized
gaagccataatacatagaatcc

SEQ ID NO: 1125443 - DNA, 22 bp, Artificial Sequence
  chemically synthesized
aagccataatacatagaatccc

SEQ ID NO: 1125444 - DNA, 22 bp, Artificial Sequence
  chemically synthesized
tggacatattttctcaagggat

SEQ ID NO: 1125445 - DNA, 22 bp, Artificial Sequence
  chemically synthesized
caaactgtggacatattttctc

SEQ ID NO: 1125446 - DNA, 22 bp, Artificial Sequence
  chemically synthesized
tccaaactgtggacatattttc

SEQ ID NO: 1125447 - DNA, 22 bp, Artificial Sequence
  chemically synthesized
gagaaaatatgtccacagtttg

SEQ ID NO: 1125448 - DNA, 22 bp, Artificial Sequence
  chemically synthesized
agcatgactctccaaactgtgg

SEQ ID NO: 1125449 - DNA, 22 bp, Artificial Sequence
  chemically synthesized
agaaaatatgtccacagtttgg

SEQ ID NO: 1125450 - DNA, 22 bp, Artificial Sequence
  chemically synthesized
aactaagcatgactctccaaac

SEQ ID NO: 1125451 - DNA, 22 bp, Artificial Sequence
  chemically synthesized
gaactaagcatgactctccaaa

SEQ ID NO: 1125452 - DNA, 22 bp, Artificial Sequence
  chemically synthesized
tttgaactaagcatgactctcc

SEQ ID NO: 1125453 - DNA, 22 bp, Artificial Sequence
  chemically synthesized
aattatttgaactaagcatgac

SEQ ID NO: 1125454 - DNA, 22 bp, Artificial Sequence
  chemically synthesized
ctaaattatttgaactaagcat

SEQ ID NO: 1125455 - DNA, 22 bp, Artificial Sequence
  chemically synthesized
actaaattatttgaactaagca

SEQ ID NO: 1125456 - DNA, 22 bp, Artificial Sequence
  chemically synthesized
tactaaattatttgaactaagc

SEQ ID NO: 1125457 - DNA, 22 bp, Artificial Sequence
  chemically synthesized
ggagagtcatgcttagttcaaa

SEQ ID NO: 1125458 - DNA, 22 bp, Artificial Sequence
  chemically synthesized
gagagtcatgcttagttcaaat

SEQ ID NO: 1125459 - DNA, 22 bp, Artificial Sequence
  chemically synthesized
agttcaaataatttagtaaaat

SEQ ID NO: 1125460 - DNA, 22 bp, Artificial Sequence
  chemically synthesized
gttcaaataatttagtaaaatt

SEQ ID NO: 1125461 - DNA, 22 bp, Artificial Sequence
  chemically synthesized
cataatccagaaaattttacta

SEQ ID NO: 1125462 - DNA, 22 bp, Artificial Sequence
  chemically synthesized
ctacataatccagaaaatttta

SEQ ID NO: 1125463 - DNA, 22 bp, Artificial Sequence
  chemically synthesized
aaataatttagtaaaattttct

SEQ ID NO: 1125464 - DNA, 22 bp, Artificial Sequence
  chemically synthesized
gctacataatccagaaaatttt

SEQ ID NO: 1125465 - DNA, 22 bp, Artificial Sequence
  chemically synthesized
cttgctacataatccagaaaat

SEQ ID NO: 1125466 - DNA, 22 bp, Artificial Sequence
  chemically synthesized
agtaaaattttctggattatgt

SEQ ID NO: 1125467 - DNA, 22 bp, Artificial Sequence
  chemically synthesized
gtaaaattttctggattatgta

SEQ ID NO: 1125468 - DNA, 22 bp, Artificial Sequence
  chemically synthesized
ggaaggaaaactacttgctaca

SEQ ID NO: 1125469 - DNA, 22 bp, Artificial Sequence
  chemically synthesized
gggaaggaaaactacttgctac

SEQ ID NO: 1125470 - DNA, 22 bp, Artificial Sequence
  chemically synthesized
tctggattatgtagcaagtagt

SEQ ID NO: 1125471 - DNA, 22 bp, Artificial Sequence
  chemically synthesized
ctggattatgtagcaagtagtt

SEQ ID NO: 1125472 - DNA, 22 bp, Artificial Sequence
  chemically synthesized
tggattatgtagcaagtagttt

SEQ ID NO: 1125473 - DNA, 22 bp, Artificial Sequence
  chemically synthesized
gattatgtagcaagtagttttc

SEQ ID NO: 1125474 - DNA, 22 bp, Artificial Sequence
  chemically synthesized
tgtagcaagtagttttccttcc

SEQ ID NO: 1125475 - DNA, 22 bp, Artificial Sequence
  chemically synthesized
aaatcaatgaacttgggaagga

SEQ ID NO: 1125476 - DNA, 22 bp, Artificial Sequence
  chemically synthesized
gttaaaatcaatgaacttggga

SEQ ID NO: 1125477 - DNA, 22 bp, Artificial Sequence
  chemically synthesized
tccttcccaagttcattgattt

SEQ ID NO: 1125478 - DNA, 22 bp, Artificial Sequence
  chemically synthesized
aaaaattagttaaaatcaatga

SEQ ID NO: 1125479 - DNA, 22 bp, Artificial Sequence
  chemically synthesized
ccttcccaagttcattgatttt

SEQ ID NO: 1125480 - DNA, 22 bp, Artificial Sequence
  chemically synthesized
cttcccaagttcattgatttta

SEQ ID NO: 1125481 - DNA, 22 bp, Artificial Sequence
  chemically synthesized
cccaagttcattgattttaact

SEQ ID NO: 1125482 - DNA, 22 bp, Artificial Sequence
  chemically synthesized
ccaagttcattgattttaacta

SEQ ID NO: 1125483 - DNA, 22 bp, Artificial Sequence
  chemically synthesized
aacattcaaaaattagttaaaa

SEQ ID NO: 1125484 - DNA, 22 bp, Artificial Sequence
  chemically synthesized
actaaacattcaaaaattagtt

SEQ ID NO: 1125485 - DNA, 22 bp, Artificial Sequence
  chemically synthesized
aactaaacattcaaaaattagt

SEQ ID NO: 1125486 - DNA, 22 bp, Artificial Sequence
  chemically synthesized
attgattttaactaatttttga

SEQ ID NO: 1125487 - DNA, 22 bp, Artificial Sequence
  chemically synthesized
attttaactaatttttgaatgt

SEQ ID NO: 1125488 - DNA, 22 bp, Artificial Sequence
  chemically synthesized
taactaatttttgaatgtttag

SEQ ID NO: 1125489 - DNA, 22 bp, Artificial Sequence
  chemically synthesized
aactaatttttgaatgtttagt

SEQ ID NO: 1125490 - DNA, 22 bp, Artificial Sequence
  chemically synthesized
actaatttttgaatgtttagtt

SEQ ID NO: 1125491 - DNA, 22 bp, Artificial Sequence
  chemically synthesized
atttttgaatgtttagttaaat

SEQ ID NO: 1125492 - DNA, 22 bp, Artificial Sequence
  chemically synthesized
ttgaatgtttagttaaatatgt

SEQ ID NO: 1125493 - DNA, 22 bp, Artificial Sequence
  chemically synthesized
tgaatgtttagttaaatatgtg

SEQ ID NO: 1125494 - DNA, 22 bp, Artificial Sequence
  chemically synthesized
gaatgtttagttaaatatgtgg

SEQ ID NO: 1125495 - DNA, 22 bp, Artificial Sequence
  chemically synthesized
gagtacgagtgtccacatattt

SEQ ID NO: 1125496 - DNA, 22 bp, Artificial Sequence
  chemically synthesized
aatgtttagttaaatatgtgga

SEQ ID NO: 1125497 - DNA, 22 bp, Artificial Sequence
  chemically synthesized
agagtacgagtgtccacatatt

SEQ ID NO: 1125498 - DNA, 22 bp, Artificial Sequence
  chemically synthesized
tagagtacgagtgtccacatat

SEQ ID NO: 1125499 - DNA, 22 bp, Artificial Sequence
  chemically synthesized
ttagagtacgagtgtccacata

SEQ ID NO: 1125500 - DNA, 22 bp, Artificial Sequence
  chemically synthesized
agttaaatatgtggacactcgt

SEQ ID NO: 1125501 - DNA, 22 bp, Artificial Sequence
  chemically synthesized
gttaaatatgtggacactcgta

SEQ ID NO: 1125502 - DNA, 22 bp, Artificial Sequence
  chemically synthesized
agcagatttttagagtacgagt

SEQ ID NO: 1125503 - DNA, 22 bp, Artificial Sequence
  chemically synthesized
aatatgtggacactcgtactct

SEQ ID NO: 1125504 - DNA, 22 bp, Artificial Sequence
  chemically synthesized
aagcagatttttagagtacgag

SEQ ID NO: 1125505 - DNA, 22 bp, Artificial Sequence
  chemically synthesized
taagcagatttttagagtacga

SEQ ID NO: 1125506 - DNA, 22 bp, Artificial Sequence
  chemically synthesized
ggagtataattttaagcagatt

SEQ ID NO: 1125507 - DNA, 22 bp, Artificial Sequence
  chemically synthesized
aggagtataattttaagcagat

SEQ ID NO: 1125508 - DNA, 22 bp, Artificial Sequence
  chemically synthesized
gtactctaaaaatctgcttaaa

SEQ ID NO: 1125509 - DNA, 22 bp, Artificial Sequence
  chemically synthesized
taaaaatctgcttaaaattata

SEQ ID NO: 1125510 - DNA, 22 bp, Artificial Sequence
  chemically synthesized
ggtgatttaggagtataatttt

SEQ ID NO: 1125511 - DNA, 22 bp, Artificial Sequence
  chemically synthesized
aaaatctgcttaaaattatact

SEQ ID NO: 1125512 - DNA, 22 bp, Artificial Sequence
  chemically synthesized
aggtgatttaggagtataattt

SEQ ID NO: 1125513 - DNA, 22 bp, Artificial Sequence
  chemically synthesized
taggtgatttaggagtataatt

SEQ ID NO: 1125514 - DNA, 22 bp, Artificial Sequence
  chemically synthesized
cttaaaattatactcctaaatc

SEQ ID NO: 1125515 - DNA, 22 bp, Artificial Sequence
  chemically synthesized
aaaaactttaggtgatttagga

SEQ ID NO: 1125516 - DNA, 22 bp, Artificial Sequence
  chemically synthesized
aaaaaactttaggtgatttagg

SEQ ID NO: 1125517 - DNA, 22 bp, Artificial Sequence
  chemically synthesized
aaaattatactcctaaatcacc

SEQ ID NO: 1125518 - DNA, 22 bp, Artificial Sequence
  chemically synthesized
taaaaaactttaggtgatttag

SEQ ID NO: 1125519 - DNA, 22 bp, Artificial Sequence
  chemically synthesized
aaattatactcctaaatcacct

SEQ ID NO: 1125520 - DNA, 22 bp, Artificial Sequence
  chemically synthesized
gcattttaaaaaactttaggtg

SEQ ID NO: 1125521 - DNA, 22 bp, Artificial Sequence
  chemically synthesized
tactcctaaatcacctaaagtt

SEQ ID NO: 1125522 - DNA, 22 bp, Artificial Sequence
  chemically synthesized
ggcattttaaaaaactttaggt

SEQ ID NO: 1125523 - DNA, 22 bp, Artificial Sequence
  chemically synthesized
ctaaatcacctaaagtttttta

SEQ ID NO: 1125524 - DNA, 22 bp, Artificial Sequence
  chemically synthesized
aatcacctaaagttttttaaaa

SEQ ID NO: 1125525 - DNA, 22 bp, Artificial Sequence
  chemically synthesized
aatgaaagtttggcattttaaa

SEQ ID NO: 1125526 - DNA, 22 bp, Artificial Sequence
  chemically synthesized
gaatgaaagtttggcattttaa

SEQ ID NO: 1125527 - DNA, 22 bp, Artificial Sequence
  chemically synthesized
aagttttttaaaatgccaaact

SEQ ID NO: 1125528 - DNA, 22 bp, Artificial Sequence
  chemically synthesized
aatttgaatgaaagtttggcat

SEQ ID NO: 1125529 - DNA, 22 bp, Artificial Sequence
  chemically synthesized
aaatttgaatgaaagtttggca

SEQ ID NO: 1125530 - DNA, 22 bp, Artificial Sequence
  chemically synthesized
taaatttgaatgaaagtttggc

SEQ ID NO: 1125531 - DNA, 22 bp, Artificial Sequence
  chemically synthesized
tttaaatttgaatgaaagtttg

SEQ ID NO: 1125532 - DNA, 22 bp, Artificial Sequence
  chemically synthesized
tttaaaatgccaaactttcatt

SEQ ID NO: 1125533 - DNA, 22 bp, Artificial Sequence
  chemically synthesized
ttaaaatgccaaactttcattc

SEQ ID NO: 1125534 - DNA, 22 bp, Artificial Sequence
  chemically synthesized
ttctttaaatttgaatgaaagt

SEQ ID NO: 1125535 - DNA, 22 bp, Artificial Sequence
  chemically synthesized
taaaatgccaaactttcattca

SEQ ID NO: 1125536 - DNA, 22 bp, Artificial Sequence
  chemically synthesized
aaaatgccaaactttcattcaa

SEQ ID NO: 1125537 - DNA, 22 bp, Artificial Sequence
  chemically synthesized
tgttctttaaatttgaatgaaa

SEQ ID NO: 1125538 - DNA, 22 bp, Artificial Sequence
  chemically synthesized
aaatgccaaactttcattcaaa

SEQ ID NO: 1125539 - DNA, 22 bp, Artificial Sequence
  chemically synthesized
ctgttctttaaatttgaatgaa

SEQ ID NO: 1125540 - DNA, 22 bp, Artificial Sequence
  chemically synthesized
tctgttctttaaatttgaatga

SEQ ID NO: 1125541 - DNA, 22 bp, Artificial Sequence
  chemically synthesized
ttctgttctttaaatttgaatg

SEQ ID NO: 1125542 - DNA, 22 bp, Artificial Sequence
  chemically synthesized
ttttctgttctttaaatttgaa

SEQ ID NO: 1125543 - DNA, 22 bp, Artificial Sequence
  chemically synthesized
tcattcaaatttaaagaacaga

SEQ ID NO: 1125544 - DNA, 22 bp, Artificial Sequence
  chemically synthesized
cattcaaatttaaagaacagaa

SEQ ID NO: 1125545 - DNA, 22 bp, Artificial Sequence
  chemically synthesized
attcaaatttaaagaacagaaa

SEQ ID NO: 1125546 - DNA, 22 bp, Artificial Sequence
  chemically synthesized
aaatttaaagaacagaaaagag

SEQ ID NO: 1125547 - DNA, 22 bp, Artificial Sequence
  chemically synthesized
aaatgatatatatgtctctttt

SEQ ID NO: 1125548 - DNA, 22 bp, Artificial Sequence
  chemically synthesized
aaaatgatatatatgtctcttt

SEQ ID NO: 1125549 - DNA, 22 bp, Artificial Sequence
  chemically synthesized
aaagaacagaaaagagacatat

SEQ ID NO: 1125550 - DNA, 22 bp, Artificial Sequence
  chemically synthesized
aagaacagaaaagagacatata

SEQ ID NO: 1125551 - DNA, 22 bp, Artificial Sequence
  chemically synthesized
agatgcttaaaatgatatatat

SEQ ID NO: 1125552 - DNA, 22 bp, Artificial Sequence
  chemically synthesized
attaagatgcttaaaatgatat

SEQ ID NO: 1125553 - DNA, 22 bp, Artificial Sequence
  chemically synthesized
tgacctgattaagatgcttaaa

SEQ ID NO: 1125554 - DNA, 22 bp, Artificial Sequence
  chemically synthesized
aaagcctgtgacctgattaaga

SEQ ID NO: 1125555 - DNA, 22 bp, Artificial Sequence
  chemically synthesized
gaaagcctgtgacctgattaag

SEQ ID NO: 1125556 - DNA, 22 bp, Artificial Sequence
  chemically synthesized
tgaaagcctgtgacctgattaa

SEQ ID NO: 1125557 - DNA, 22 bp, Artificial Sequence
  chemically synthesized
ttgaaagcctgtgacctgatta

SEQ ID NO: 1125558 - DNA, 22 bp, Artificial Sequence
  chemically synthesized
tttgaaagcctgtgacctgatt

SEQ ID NO: 1125559 - DNA, 22 bp, Artificial Sequence
  chemically synthesized
taagcatcttaatcaggtcaca

SEQ ID NO: 1125560 - DNA, 22 bp, Artificial Sequence
  chemically synthesized
tttttgaaagcctgtgacctga

SEQ ID NO: 1125561 - DNA, 22 bp, Artificial Sequence
  chemically synthesized
aagcatcttaatcaggtcacag

SEQ ID NO: 1125562 - DNA, 22 bp, Artificial Sequence
  chemically synthesized
ctttttgaaagcctgtgacctg

SEQ ID NO: 1125563 - DNA, 22 bp, Artificial Sequence
  chemically synthesized
agcatcttaatcaggtcacagg

SEQ ID NO: 1125564 - DNA, 22 bp, Artificial Sequence
  chemically synthesized
tctttttgaaagcctgtgacct

SEQ ID NO: 1125565 - DNA, 22 bp, Artificial Sequence
  chemically synthesized
agttttctttttgaaagcctgt

SEQ ID NO: 1125566 - DNA, 22 bp, Artificial Sequence
  chemically synthesized
aatcaggtcacaggctttcaaa

SEQ ID NO: 1125567 - DNA, 22 bp, Artificial Sequence
  chemically synthesized
atcaggtcacaggctttcaaaa

SEQ ID NO: 1125568 - DNA, 22 bp, Artificial Sequence
  chemically synthesized
agcgattaagttttctttttga

SEQ ID NO: 1125569 - DNA, 22 bp, Artificial Sequence
  chemically synthesized
gagcgattaagttttctttttg

SEQ ID NO: 1125570 - DNA, 22 bp, Artificial Sequence
  chemically synthesized
ttgagcgattaagttttctttt

SEQ ID NO: 1125571 - DNA, 22 bp, Artificial Sequence
  chemically synthesized
cttgagcgattaagttttcttt

SEQ ID NO: 1125572 - DNA, 22 bp, Artificial Sequence
  chemically synthesized
tcaaaaagaaaacttaatcgct

SEQ ID NO: 1125573 - DNA, 22 bp, Artificial Sequence
  chemically synthesized
caaaaagaaaacttaatcgctc

SEQ ID NO: 1125574 - DNA, 22 bp, Artificial Sequence
  chemically synthesized
aaaaagaaaacttaatcgctca

SEQ ID NO: 1125575 - DNA, 22 bp, Artificial Sequence
  chemically synthesized
cagataacatacaaggtttctt

SEQ ID NO: 1125576 - DNA, 22 bp, Artificial Sequence
  chemically synthesized
ttacagataacatacaaggttt

SEQ ID NO: 1125577 - DNA, 22 bp, Artificial Sequence
  chemically synthesized
aatcgctcaagaaaccttgtat

SEQ ID NO: 1125578 - DNA, 22 bp, Artificial Sequence
  chemically synthesized
atcgctcaagaaaccttgtatg

SEQ ID NO: 1125579 - DNA, 22 bp, Artificial Sequence
  chemically synthesized
aagaaaccttgtatgttatctg

SEQ ID NO: 1125580 - DNA, 22 bp, Artificial Sequence
  chemically synthesized
caaaaataaaagctattacaga

SEQ ID NO: 1125581 - DNA, 22 bp, Artificial Sequence
  chemically synthesized
gtatgttatctgtaatagcttt

SEQ ID NO: 1125582 - DNA, 22 bp, Artificial Sequence
  chemically synthesized
tatgttatctgtaatagctttt

SEQ ID NO: 1125583 - DNA, 22 bp, Artificial Sequence
  chemically synthesized
tctgtaatagcttttatttttg

SEQ ID NO: 1125584 - DNA, 22 bp, Artificial Sequence
  chemically synthesized
atgatcaatctgcaaaaataaa

SEQ ID NO: 1125585 - DNA, 22 bp, Artificial Sequence
  chemically synthesized
ttcatgatcaatctgcaaaaat

SEQ ID NO: 1125586 - DNA, 22 bp, Artificial Sequence
  chemically synthesized
taatagcttttatttttgcaga

SEQ ID NO: 1125587 - DNA, 22 bp, Artificial Sequence
  chemically synthesized
tattcatgatcaatctgcaaaa

SEQ ID NO: 1125588 - DNA, 22 bp, Artificial Sequence
  chemically synthesized
ctattcatgatcaatctgcaaa

SEQ ID NO: 1125589 - DNA, 22 bp, Artificial Sequence
  chemically synthesized
tctattcatgatcaatctgcaa

SEQ ID NO: 1125590 - DNA, 22 bp, Artificial Sequence
  chemically synthesized
ttctattcatgatcaatctgca

SEQ ID NO: 1125591 - DNA, 22 bp, Artificial Sequence
  chemically synthesized
ttatttttgcagattgatcatg

SEQ ID NO: 1125592 - DNA, 22 bp, Artificial Sequence
  chemically synthesized
aacttttctattcatgatcaat

SEQ ID NO: 1125593 - DNA, 22 bp, Artificial Sequence
  chemically synthesized
tatttttgcagattgatcatga

SEQ ID NO: 1125594 - DNA, 22 bp, Artificial Sequence
  chemically synthesized
caacttttctattcatgatcaa

SEQ ID NO: 1125595 - DNA, 22 bp, Artificial Sequence
  chemically synthesized
atttttgcagattgatcatgaa

SEQ ID NO: 1125596 - DNA, 22 bp, Artificial Sequence
  chemically synthesized
tttttgcagattgatcatgaat

SEQ ID NO: 1125597 - DNA, 22 bp, Artificial Sequence
  chemically synthesized
ttgcagattgatcatgaataga

SEQ ID NO: 1125598 - DNA, 22 bp, Artificial Sequence
  chemically synthesized
tgcagattgatcatgaatagaa

SEQ ID NO: 1125599 - DNA, 22 bp, Artificial Sequence
  chemically synthesized
gcagattgatcatgaatagaaa

SEQ ID NO: 1125600 - DNA, 22 bp, Artificial Sequence
  chemically synthesized
cagattgatcatgaatagaaaa

SEQ ID NO: 1125601 - DNA, 22 bp, Artificial Sequence
  chemically synthesized
aatgaagatcttcaacttttct

SEQ ID NO: 1125602 - DNA, 22 bp, Artificial Sequence
  chemically synthesized
atcatgaatagaaaagttgaag

SEQ ID NO: 1125603 - DNA, 22 bp, Artificial Sequence
  chemically synthesized
aaactaaatgaagatcttcaac

SEQ ID NO: 1125604 - DNA, 22 bp, Artificial Sequence
  chemically synthesized
tgtattgaaactaaatgaagat

SEQ ID NO: 1125605 - DNA, 22 bp, Artificial Sequence
  chemically synthesized
actgtgtattgaaactaaatga

SEQ ID NO: 1125606 - DNA, 22 bp, Artificial Sequence
  chemically synthesized
cactgtgtattgaaactaaatg

SEQ ID NO: 1125607 - DNA, 22 bp, Artificial Sequence
  chemically synthesized
aagatcttcatttagtttcaat

SEQ ID NO: 1125608 - DNA, 22 bp, Artificial Sequence
  chemically synthesized
agtgcttcactgtgtattgaaa

SEQ ID NO: 1125609 - DNA, 22 bp, Artificial Sequence
  chemically synthesized
actcagtgcttcactgtgtatt

SEQ ID NO: 1125610 - DNA, 22 bp, Artificial Sequence
  chemically synthesized
catttagtttcaatacacagtg

SEQ ID NO: 1125611 - DNA, 22 bp, Artificial Sequence
  chemically synthesized
gactcagtgcttcactgtgtat

SEQ ID NO: 1125612 - DNA, 22 bp, Artificial Sequence
  chemically synthesized
atttagtttcaatacacagtga

SEQ ID NO: 1125613 - DNA, 22 bp, Artificial Sequence
  chemically synthesized
agtttcaatacacagtgaagca

SEQ ID NO: 1125614 - DNA, 22 bp, Artificial Sequence
  chemically synthesized
gtttcaatacacagtgaagcac

SEQ ID NO: 1125615 - DNA, 22 bp, Artificial Sequence
  chemically synthesized
agtcttgactcagtgcttcact

SEQ ID NO: 1125616 - DNA, 22 bp, Artificial Sequence
  chemically synthesized
gagtcttgactcagtgcttcac

SEQ ID NO: 1125617 - DNA, 22 bp, Artificial Sequence
  chemically synthesized
ttgagtcttgactcagtgcttc

SEQ ID NO: 1125618 - DNA, 22 bp, Artificial Sequence
  chemically synthesized
caatacacagtgaagcactgag

SEQ ID NO: 1125619 - DNA, 22 bp, Artificial Sequence
  chemically synthesized
aatacacagtgaagcactgagt

SEQ ID NO: 1125620 - DNA, 22 bp, Artificial Sequence
  chemically synthesized
ttcttgagtcttgactcagtgc

SEQ ID NO: 1125621 - DNA, 22 bp, Artificial Sequence
  chemically synthesized
agacagacctgttcttgagtct

SEQ ID NO: 1125622 - DNA, 22 bp, Artificial Sequence
  chemically synthesized
gattcagacagacctgttcttg

SEQ ID NO: 1125623 - DNA, 22 bp, Artificial Sequence
  chemically synthesized
ggattcagacagacctgttctt

SEQ ID NO: 1125624 - DNA, 22 bp, Artificial Sequence
  chemically synthesized
agtcaagactcaagaacaggtc

SEQ ID NO: 1125625 - DNA, 22 bp, Artificial Sequence
  chemically synthesized
tggattcagacagacctgttct

SEQ ID NO: 1125626 - DNA, 22 bp, Artificial Sequence
  chemically synthesized
tagaaatctttggattcagaca

SEQ ID NO: 1125627 - DNA, 22 bp, Artificial Sequence
  chemically synthesized
aagaacaggtctgtctgaatcc

SEQ ID NO: 1125628 - DNA, 22 bp, Artificial Sequence
  chemically synthesized
tctgaatccaaagatttctaca

SEQ ID NO: 1125629 - DNA, 22 bp, Artificial Sequence
  chemically synthesized
aatccaaagatttctacaacac

SEQ ID NO: 1125630 - DNA, 22 bp, Artificial Sequence
  chemically synthesized
gaacaaaagaaaaatgtagtgt

SEQ ID NO: 1125631 - DNA, 22 bp, Artificial Sequence
  chemically synthesized
ggaacaaaagaaaaatgtagtg

SEQ ID NO: 1125632 - DNA, 22 bp, Artificial Sequence
  chemically synthesized
tttggaacaaaagaaaaatgta

SEQ ID NO: 1125633 - DNA, 22 bp, Artificial Sequence
  chemically synthesized
atttggaacaaaagaaaaatgt

SEQ ID NO: 1125634 - DNA, 22 bp, Artificial Sequence
  chemically synthesized
ctacaacactacatttttcttt

SEQ ID NO: 1125635 - DNA, 22 bp, Artificial Sequence
  chemically synthesized
tacaacactacatttttctttt

SEQ ID NO: 1125636 - DNA, 22 bp, Artificial Sequence
  chemically synthesized
gtttatttggaacaaaagaaaa

SEQ ID NO: 1125637 - DNA, 22 bp, Artificial Sequence
  chemically synthesized
caacactacatttttcttttgt

SEQ ID NO: 1125638 - DNA, 22 bp, Artificial Sequence
  chemically synthesized
tcgtttatttggaacaaaagaa

SEQ ID NO: 1125639 - DNA, 22 bp, Artificial Sequence
  chemically synthesized
ctcgtttatttggaacaaaaga

SEQ ID NO: 1125640 - DNA, 22 bp, Artificial Sequence
  chemically synthesized
catttttcttttgttccaaata

SEQ ID NO: 1125641 - DNA, 22 bp, Artificial Sequence
  chemically synthesized
agatgggtttctcgtttatttg

SEQ ID NO: 1125642 - DNA, 22 bp, Artificial Sequence
  chemically synthesized
ttcttttgttccaaataaacga

SEQ ID NO: 1125643 - DNA, 22 bp, Artificial Sequence
  chemically synthesized
aagatgggtttctcgtttattt

SEQ ID NO: 1125644 - DNA, 22 bp, Artificial Sequence
  chemically synthesized
tcttttgttccaaataaacgag

SEQ ID NO: 1125645 - DNA, 22 bp, Artificial Sequence
  chemically synthesized
taagatgggtttctcgtttatt

SEQ ID NO: 1125646 - DNA, 22 bp, Artificial Sequence
  chemically synthesized
cttttgttccaaataaacgaga

SEQ ID NO: 1125647 - DNA, 22 bp, Artificial Sequence
  chemically synthesized
ttaagatgggtttctcgtttat

SEQ ID NO: 1125648 - DNA, 22 bp, Artificial Sequence
  chemically synthesized
ttttgttccaaataaacgagaa

SEQ ID NO: 1125649 - DNA, 22 bp, Artificial Sequence
  chemically synthesized
tttaagatgggtttctcgttta

SEQ ID NO: 1125650 - DNA, 22 bp, Artificial Sequence
  chemically synthesized
ttttaagatgggtttctcgttt

SEQ ID NO: 1125651 - DNA, 22 bp, Artificial Sequence
  chemically synthesized
ttgttccaaataaacgagaaac

SEQ ID NO: 1125652 - DNA, 22 bp, Artificial Sequence
  chemically synthesized
tttttaagatgggtttctcgtt

SEQ ID NO: 1125653 - DNA, 22 bp, Artificial Sequence
  chemically synthesized
tgttccaaataaacgagaaacc

SEQ ID NO: 1125654 - DNA, 22 bp, Artificial Sequence
  chemically synthesized
ttttttaagatgggtttctcgt

SEQ ID NO: 1125655 - DNA, 22 bp, Artificial Sequence
  chemically synthesized
gttccaaataaacgagaaaccc

SEQ ID NO: 1125656 - DNA, 22 bp, Artificial Sequence
  chemically synthesized
tttttttaagatgggtttctcg

SEQ ID NO: 1125657 - DNA, 22 bp, Artificial Sequence
  chemically synthesized
ttccaaataaacgagaaaccca

SEQ ID NO: 1125658 - DNA, 22 bp, Artificial Sequence
  chemically synthesized
ttttttttttaagatgggtttc

SEQ ID NO: 1125659 - DNA, 22 bp, Artificial Sequence
  chemically synthesized
caaataaacgagaaacccatct

SEQ ID NO: 1125660 - DNA, 22 bp, Artificial Sequence
  chemically synthesized
attttttttttaagatgggttt

SEQ ID NO: 1125661 - DNA, 22 bp, Artificial Sequence
  chemically synthesized
tccttattttttttttaagatg

SEQ ID NO: 1125662 - DNA, 22 bp, Artificial Sequence
  chemically synthesized
atccttattttttttttaagat

SEQ ID NO: 1125663 - DNA, 22 bp, Artificial Sequence
  chemically synthesized
acttatccttatttttttttta

SEQ ID NO: 1125664 - DNA, 22 bp, Artificial Sequence
  chemically synthesized
tattgacttatccttatttttt

SEQ ID NO: 1125665 - DNA, 22 bp, Artificial Sequence
  chemically synthesized
tatattgacttatccttatttt

SEQ ID NO: 1125666 - DNA, 22 bp, Artificial Sequence
  chemically synthesized
aaaaaaaaaataaggataagtc

SEQ ID NO: 1125667 - DNA, 22 bp, Artificial Sequence
  chemically synthesized
aaaaaaaaataaggataagtca

SEQ ID NO: 1125668 - DNA, 22 bp, Artificial Sequence
  chemically synthesized
tgtagcaatgaacagtaattct

SEQ ID NO: 1125669 - DNA, 22 bp, Artificial Sequence
  chemically synthesized
tactgtgtagcaatgaacagta

SEQ ID NO: 1125670 - DNA, 22 bp, Artificial Sequence
  chemically synthesized
ctgtactgtgtagcaatgaaca

SEQ ID NO: 1125671 - DNA, 22 bp, Artificial Sequence
  chemically synthesized
aattactgtactgtgtagcaat

SEQ ID NO: 1125672 - DNA, 22 bp, Artificial Sequence
  chemically synthesized
ctgttcattgctacacagtaca

SEQ ID NO: 1125673 - DNA, 22 bp, Artificial Sequence
  chemically synthesized
ttcattgctacacagtacagta

SEQ ID NO: 1125674 - DNA, 22 bp, Artificial Sequence
  chemically synthesized
attgctacacagtacagtaatt

SEQ ID NO: 1125675 - DNA, 22 bp, Artificial Sequence
  chemically synthesized
ctacacagtacagtaatttagt

SEQ ID NO: 1125676 - DNA, 22 bp, Artificial Sequence
  chemically synthesized
cacagtacagtaatttagtggt

SEQ ID NO: 1125677 - DNA, 22 bp, Artificial Sequence
  chemically synthesized
atataatccaagatagcgtagt

SEQ ID NO: 1125678 - DNA, 22 bp, Artificial Sequence
  chemically synthesized
agtggttttgactacgctatct

SEQ ID NO: 1125679 - DNA, 22 bp, Artificial Sequence
  chemically synthesized
tcatataatccaagatagcgta

SEQ ID NO: 1125680 - DNA, 22 bp, Artificial Sequence
  chemically synthesized
gtggttttgactacgctatctt

SEQ ID NO: 1125681 - DNA, 22 bp, Artificial Sequence
  chemically synthesized
tgactacgctatcttggattat

SEQ ID NO: 1125682 - DNA, 22 bp, Artificial Sequence
  chemically synthesized
gactacgctatcttggattata

SEQ ID NO: 1125683 - DNA, 22 bp, Artificial Sequence
  chemically synthesized
actacgctatcttggattatat

SEQ ID NO: 1125684 - DNA, 22 bp, Artificial Sequence
  chemically synthesized
aatcaaattctcatataatcca

SEQ ID NO: 1125685 - DNA, 22 bp, Artificial Sequence
  chemically synthesized
caatcaaattctcatataatcc

SEQ ID NO: 1125686 - DNA, 22 bp, Artificial Sequence
  chemically synthesized
cgctatcttggattatatgaga

SEQ ID NO: 1125687 - DNA, 22 bp, Artificial Sequence
  chemically synthesized
gagacttcaatcaaattctcat

SEQ ID NO: 1125688 - DNA, 22 bp, Artificial Sequence
  chemically synthesized
tcttggattatatgagaatttg

SEQ ID NO: 1125689 - DNA, 22 bp, Artificial Sequence
  chemically synthesized
ggattatatgagaatttgattg

SEQ ID NO: 1125690 - DNA, 22 bp, Artificial Sequence
  chemically synthesized
gattatatgagaatttgattga

SEQ ID NO: 1125691 - DNA, 22 bp, Artificial Sequence
  chemically synthesized
atattagagacttcaatcaaat

SEQ ID NO: 1125692 - DNA, 22 bp, Artificial Sequence
  chemically synthesized
tatgagaatttgattgaagtct

SEQ ID NO: 1125693 - DNA, 22 bp, Artificial Sequence
  chemically synthesized
atatcctgatattagagacttc

SEQ ID NO: 1125694 - DNA, 22 bp, Artificial Sequence
  chemically synthesized
agaattaatatcctgatattag

SEQ ID NO: 1125695 - DNA, 22 bp, Artificial Sequence
  chemically synthesized
gattgaagtctctaatatcagg

SEQ ID NO: 1125696 - DNA, 22 bp, Artificial Sequence
  chemically synthesized
cagaattaatatcctgatatta

SEQ ID NO: 1125697 - DNA, 22 bp, Artificial Sequence
  chemically synthesized
attgaagtctctaatatcagga

SEQ ID NO: 1125698 - DNA, 22 bp, Artificial Sequence
  chemically synthesized
aagtctctaatatcaggatatt

SEQ ID NO: 1125699 - DNA, 22 bp, Artificial Sequence
  chemically synthesized
atgaaaaatttcagaattaata

SEQ ID NO: 1125700 - DNA, 22 bp, Artificial Sequence
  chemically synthesized
taatatcaggatattaattctg

SEQ ID NO: 1125701 - DNA, 22 bp, Artificial Sequence
  chemically synthesized
aatgaaaaatttcagaattaat

SEQ ID NO: 1125702 - DNA, 22 bp, Artificial Sequence
  chemically synthesized
taatgaaaaatttcagaattaa

SEQ ID NO: 1125703 - DNA, 22 bp, Artificial Sequence
  chemically synthesized
atatcaggatattaattctgaa

SEQ ID NO: 1125704 - DNA, 22 bp, Artificial Sequence
  chemically synthesized
aggatcatattttaatgaaaaa

SEQ ID NO: 1125705 - DNA, 22 bp, Artificial Sequence
  chemically synthesized
attctgaaatttttcattaaaa

SEQ ID NO: 1125706 - DNA, 22 bp, Artificial Sequence
  chemically synthesized
tgaaatttttcattaaaatatg

SEQ ID NO: 1125707 - DNA, 22 bp, Artificial Sequence
  chemically synthesized
aaatttttcattaaaatatgat

SEQ ID NO: 1125708 - DNA, 22 bp, Artificial Sequence
  chemically synthesized
ttcattaaaatatgatccttag

SEQ ID NO: 1125709 - DNA, 22 bp, Artificial Sequence
  chemically synthesized
tcattaaaatatgatccttagt

SEQ ID NO: 1125710 - DNA, 22 bp, Artificial Sequence
  chemically synthesized
cattaaaatatgatccttagtt

SEQ ID NO: 1125711 - DNA, 22 bp, Artificial Sequence
  chemically synthesized
attaaaatatgatccttagttg

SEQ ID NO: 1125712 - DNA, 22 bp, Artificial Sequence
  chemically synthesized
gggtacaaagtatacaactaag

SEQ ID NO: 1125713 - DNA, 22 bp, Artificial Sequence
  chemically synthesized
aaatatgatccttagttgtata

SEQ ID NO: 1125714 - DNA, 22 bp, Artificial Sequence
  chemically synthesized
ccattagggtacaaagtataca

SEQ ID NO: 1125715 - DNA, 22 bp, Artificial Sequence
  chemically synthesized
tattgccattagggtacaaagt

SEQ ID NO: 1125716 - DNA, 22 bp, Artificial Sequence
  chemically synthesized
atattgccattagggtacaaag

SEQ ID NO: 1125717 - DNA, 22 bp, Artificial Sequence
  chemically synthesized
tatattgccattagggtacaaa

SEQ ID NO: 1125718 - DNA, 22 bp, Artificial Sequence
  chemically synthesized
agttgtatactttgtaccctaa

SEQ ID NO: 1125719 - DNA, 22 bp, Artificial Sequence
  chemically synthesized
gttgtatactttgtaccctaat

SEQ ID NO: 1125720 - DNA, 22 bp, Artificial Sequence
  chemically synthesized
ttttatattgccattagggtac

SEQ ID NO: 1125721 - DNA, 22 bp, Artificial Sequence
  chemically synthesized
tatactttgtaccctaatggca

SEQ ID NO: 1125722 - DNA, 22 bp, Artificial Sequence
  chemically synthesized
tgtaccctaatggcaatataaa

SEQ ID NO: 1125723 - DNA, 22 bp, Artificial Sequence
  chemically synthesized
gtaccctaatggcaatataaaa

SEQ ID NO: 1125724 - DNA, 22 bp, Artificial Sequence
  chemically synthesized
ggaaataaattattttatattg

SEQ ID NO: 1125725 - DNA, 22 bp, Artificial Sequence
  chemically synthesized
taccctaatggcaatataaaat

SEQ ID NO: 1125726 - DNA, 22 bp, Artificial Sequence
  chemically synthesized
atggcaatataaaataatttat

SEQ ID NO: 1125727 - DNA, 22 bp, Artificial Sequence
  chemically synthesized
caaggtaataataaattgggaa

SEQ ID NO: 1125728 - DNA, 22 bp, Artificial Sequence
  chemically synthesized
atttcccaatttattattacct

SEQ ID NO: 1125729 - DNA, 22 bp, Artificial Sequence
  chemically synthesized
agggaaattccaaggtaataat

SEQ ID NO: 1125730 - DNA, 22 bp, Artificial Sequence
  chemically synthesized
tttcccaatttattattacctt

SEQ ID NO: 1125731 - DNA, 22 bp, Artificial Sequence
  chemically synthesized
cccaatttattattaccttgga

SEQ ID NO: 1125732 - DNA, 22 bp, Artificial Sequence
  chemically synthesized
ccaatttattattaccttggaa

SEQ ID NO: 1125733 - DNA, 22 bp, Artificial Sequence
  chemically synthesized
ggaaattaagggaaattccaag

SEQ ID NO: 1125734 - DNA, 22 bp, Artificial Sequence
  chemically synthesized
aggaaattaagggaaattccaa

SEQ ID NO: 1125735 - DNA, 22 bp, Artificial Sequence
  chemically synthesized
taggaaattaagggaaattcca

SEQ ID NO: 1125736 - DNA, 22 bp, Artificial Sequence
  chemically synthesized
attattaccttggaatttccct

SEQ ID NO: 1125737 - DNA, 22 bp, Artificial Sequence
  chemically synthesized
ttattaccttggaatttccctt

SEQ ID NO: 1125738 - DNA, 22 bp, Artificial Sequence
  chemically synthesized
ttaccttggaatttcccttaat

SEQ ID NO: 1125739 - DNA, 22 bp, Artificial Sequence
  chemically synthesized
aggattttaggaaattaaggga

SEQ ID NO: 1125740 - DNA, 22 bp, Artificial Sequence
  chemically synthesized
ccttggaatttcccttaatttc

SEQ ID NO: 1125741 - DNA, 22 bp, Artificial Sequence
  chemically synthesized
ggaatttcccttaatttcctaa

SEQ ID NO: 1125742 - DNA, 22 bp, Artificial Sequence
  chemically synthesized
gaatttcccttaatttcctaaa

SEQ ID NO: 1125743 - DNA, 22 bp, Artificial Sequence
  chemically synthesized
gaaagttgaggattttaggaaa

SEQ ID NO: 1125744 - DNA, 22 bp, Artificial Sequence
  chemically synthesized
cccttaatttcctaaaatcctc

SEQ ID NO: 1125745 - DNA, 22 bp, Artificial Sequence
  chemically synthesized
ccttaatttcctaaaatcctca

SEQ ID NO: 1125746 - DNA, 22 bp, Artificial Sequence
  chemically synthesized
aatttcctaaaatcctcaactt

SEQ ID NO: 1125747 - DNA, 22 bp, Artificial Sequence
  chemically synthesized
atttcctaaaatcctcaacttt

SEQ ID NO: 1125748 - DNA, 22 bp, Artificial Sequence
  chemically synthesized
tatcatcagattagaaagttga

SEQ ID NO: 1125749 - DNA, 22 bp, Artificial Sequence
  chemically synthesized
cctaaaatcctcaactttctaa

SEQ ID NO: 1125750 - DNA, 22 bp, Artificial Sequence
  chemically synthesized
ctaaaatcctcaactttctaat

SEQ ID NO: 1125751 - DNA, 22 bp, Artificial Sequence
  chemically synthesized
aaatcctcaactttctaatctg

SEQ ID NO: 1125752 - DNA, 22 bp, Artificial Sequence
  chemically synthesized
atgtgagaaattgtatcatcag

SEQ ID NO: 1125753 - DNA, 22 bp, Artificial Sequence
  chemically synthesized
aactttctaatctgatgataca

SEQ ID NO: 1125754 - DNA, 22 bp, Artificial Sequence
  chemically synthesized
tgatgtgagaaattgtatcatc

SEQ ID NO: 1125755 - DNA, 22 bp, Artificial Sequence
  chemically synthesized
tctgatgtgagaaattgtatca

SEQ ID NO: 1125756 - DNA, 22 bp, Artificial Sequence
  chemically synthesized
ctctgatgtgagaaattgtatc

SEQ ID NO: 1125757 - DNA, 22 bp, Artificial Sequence
  chemically synthesized
tctaatctgatgatacaatttc

SEQ ID NO: 1125758 - DNA, 22 bp, Artificial Sequence
  chemically synthesized
tctctgatgtgagaaattgtat

SEQ ID NO: 1125759 - DNA, 22 bp, Artificial Sequence
  chemically synthesized
ctaatctgatgatacaatttct

SEQ ID NO: 1125760 - DNA, 22 bp, Artificial Sequence
  chemically synthesized
taatctgatgatacaatttctc

SEQ ID NO: 1125761 - DNA, 22 bp, Artificial Sequence
  chemically synthesized
atctgatgatacaatttctcac

SEQ ID NO: 1125762 - DNA, 22 bp, Artificial Sequence
  chemically synthesized
atattttctctgatgtgagaaa

SEQ ID NO: 1125763 - DNA, 22 bp, Artificial Sequence
  chemically synthesized
aatattttctctgatgtgagaa

SEQ ID NO: 1125764 - DNA, 22 bp, Artificial Sequence
  chemically synthesized
atgatacaatttctcacatcag

SEQ ID NO: 1125765 - DNA, 22 bp, Artificial Sequence
  chemically synthesized
tgcttaatattttctctgatgt

SEQ ID NO: 1125766 - DNA, 22 bp, Artificial Sequence
  chemically synthesized
atctatgcttaatattttctct

SEQ ID NO: 1125767 - DNA, 22 bp, Artificial Sequence
  chemically synthesized
catctatgcttaatattttctc

SEQ ID NO: 1125768 - DNA, 22 bp, Artificial Sequence
  chemically synthesized
tcatctatgcttaatattttct

SEQ ID NO: 1125769 - DNA, 22 bp, Artificial Sequence
  chemically synthesized
ttcatctatgcttaatattttc

SEQ ID NO: 1125770 - DNA, 22 bp, Artificial Sequence
  chemically synthesized
ctcacatcagagaaaatattaa

SEQ ID NO: 1125771 - DNA, 22 bp, Artificial Sequence
  chemically synthesized
tttcatctatgcttaatatttt

SEQ ID NO: 1125772 - DNA, 22 bp, Artificial Sequence
  chemically synthesized
tcacatcagagaaaatattaag

SEQ ID NO: 1125773 - DNA, 22 bp, Artificial Sequence
  chemically synthesized
ttttcatctatgcttaatattt

SEQ ID NO: 1125774 - DNA, 22 bp, Artificial Sequence
  chemically synthesized
acatcagagaaaatattaagca

SEQ ID NO: 1125775 - DNA, 22 bp, Artificial Sequence
  chemically synthesized
tataataagtagtaactttttt

SEQ ID NO: 1125776 - DNA, 22 bp, Artificial Sequence
  chemically synthesized
agcatagatgaaaaaagttact

SEQ ID NO: 1125777 - DNA, 22 bp, Artificial Sequence
  chemically synthesized
accacattatataataagtagt

SEQ ID NO: 1125778 - DNA, 22 bp, Artificial Sequence
  chemically synthesized
aaccacattatataataagtag

SEQ ID NO: 1125779 - DNA, 22 bp, Artificial Sequence
  chemically synthesized
accatggtcttaaccacattat

SEQ ID NO: 1125780 - DNA, 22 bp, Artificial Sequence
  chemically synthesized
ctacttattatataatgtggtt

SEQ ID NO: 1125781 - DNA, 22 bp, Artificial Sequence
  chemically synthesized
cttattatataatgtggttaag

SEQ ID NO: 1125782 - DNA, 22 bp, Artificial Sequence
  chemically synthesized
gagctcaccatggtcttaacca

SEQ ID NO: 1125783 - DNA, 22 bp, Artificial Sequence
  chemically synthesized
attatataatgtggttaagacc

SEQ ID NO: 1125784 - DNA, 22 bp, Artificial Sequence
  chemically synthesized
ggagctcaccatggtcttaacc

SEQ ID NO: 1125785 - DNA, 22 bp, Artificial Sequence
  chemically synthesized
ttatataatgtggttaagacca

SEQ ID NO: 1125786 - DNA, 22 bp, Artificial Sequence
  chemically synthesized
tggagctcaccatggtcttaac

SEQ ID NO: 1125787 - DNA, 22 bp, Artificial Sequence
  chemically synthesized
ttggagctcaccatggtcttaa

SEQ ID NO: 1125788 - DNA, 22 bp, Artificial Sequence
  chemically synthesized
tataatgtggttaagaccatgg

SEQ ID NO: 1125789 - DNA, 22 bp, Artificial Sequence
  chemically synthesized
caagtgcaagacttttggagct

SEQ ID NO: 1125790 - DNA, 22 bp, Artificial Sequence
  chemically synthesized
agaccatggtgagctccaaaag

SEQ ID NO: 1125791 - DNA, 22 bp, Artificial Sequence
  chemically synthesized
ccaagtgcaagacttttggagc

SEQ ID NO: 1125792 - DNA, 22 bp, Artificial Sequence
  chemically synthesized
tccaagtgcaagacttttggag

SEQ ID NO: 1125793 - DNA, 22 bp, Artificial Sequence
  chemically synthesized
ttccaagtgcaagacttttgga

SEQ ID NO: 1125794 - DNA, 22 bp, Artificial Sequence
  chemically synthesized
tttccaagtgcaagacttttgg

SEQ ID NO: 1125795 - DNA, 22 bp, Artificial Sequence
  chemically synthesized
ttttccaagtgcaagacttttg

SEQ ID NO: 1125796 - DNA, 22 bp, Artificial Sequence
  chemically synthesized
tttttccaagtgcaagactttt

SEQ ID NO: 1125797 - DNA, 22 bp, Artificial Sequence
  chemically synthesized
ttttttccaagtgcaagacttt

SEQ ID NO: 1125798 - DNA, 22 bp, Artificial Sequence
  chemically synthesized
aacttttttttccaagtgcaag

SEQ ID NO: 1125799 - DNA, 22 bp, Artificial Sequence
  chemically synthesized
caaaagtcttgcacttggaaaa

SEQ ID NO: 1125800 - DNA, 22 bp, Artificial Sequence
  chemically synthesized
catataattgaacttttttttc

SEQ ID NO: 1125801 - DNA, 22 bp, Artificial Sequence
  chemically synthesized
ccatataattgaactttttttt

SEQ ID NO: 1125802 - DNA, 22 bp, Artificial Sequence
  chemically synthesized
gcacttggaaaaaaaagttcaa

SEQ ID NO: 1125803 - DNA, 22 bp, Artificial Sequence
  chemically synthesized
cacttggaaaaaaaagttcaat

SEQ ID NO: 1125804 - DNA, 22 bp, Artificial Sequence
  chemically synthesized
ggaaaaaaaagttcaattatat

SEQ ID NO: 1125805 - DNA, 22 bp, Artificial Sequence
  chemically synthesized
gaaaaaaaagttcaattatatg

SEQ ID NO: 1125806 - DNA, 22 bp, Artificial Sequence
  chemically synthesized
agcatcaaaaataagtggaatt

SEQ ID NO: 1125807 - DNA, 22 bp, Artificial Sequence
  chemically synthesized
aattatatggaaattccactta

SEQ ID NO: 1125808 - DNA, 22 bp, Artificial Sequence
  chemically synthesized
cagcatcaaaaataagtggaat

SEQ ID NO: 1125809 - DNA, 22 bp, Artificial Sequence
  chemically synthesized
tcagcatcaaaaataagtggaa

SEQ ID NO: 1125810 - DNA, 22 bp, Artificial Sequence
  chemically synthesized
ttcagcatcaaaaataagtgga

SEQ ID NO: 1125811 - DNA, 22 bp, Artificial Sequence
  chemically synthesized
tttcagcatcaaaaataagtgg

SEQ ID NO: 1125812 - DNA, 22 bp, Artificial Sequence
  chemically synthesized
tatggaaattccacttattttt

SEQ ID NO: 1125813 - DNA, 22 bp, Artificial Sequence
  chemically synthesized
gatgtctttttcagcatcaaaa

SEQ ID NO: 1125814 - DNA, 22 bp, Artificial Sequence
  chemically synthesized
agatgtctttttcagcatcaaa

SEQ ID NO: 1125815 - DNA, 22 bp, Artificial Sequence
  chemically synthesized
cacttatttttgatgctgaaaa

SEQ ID NO: 1125816 - DNA, 22 bp, Artificial Sequence
  chemically synthesized
aaatttagatgtctttttcagc

SEQ ID NO: 1125817 - DNA, 22 bp, Artificial Sequence
  chemically synthesized
aaaatttagatgtctttttcag

SEQ ID NO: 1125818 - DNA, 22 bp, Artificial Sequence
  chemically synthesized
taaaatttagatgtctttttca

SEQ ID NO: 1125819 - DNA, 22 bp, Artificial Sequence
  chemically synthesized
atttttgatgctgaaaaagaca

SEQ ID NO: 1125820 - DNA, 22 bp, Artificial Sequence
  chemically synthesized
tttttgatgctgaaaaagacat

SEQ ID NO: 1125821 - DNA, 22 bp, Artificial Sequence
  chemically synthesized
tttaaaatttagatgtcttttt

SEQ ID NO: 1125822 - DNA, 22 bp, Artificial Sequence
  chemically synthesized
ctttaaaatttagatgtctttt

SEQ ID NO: 1125823 - DNA, 22 bp, Artificial Sequence
  chemically synthesized
ttgatgctgaaaaagacatcta

SEQ ID NO: 1125824 - DNA, 22 bp, Artificial Sequence
  chemically synthesized
tgatgctgaaaaagacatctaa

SEQ ID NO: 1125825 - DNA, 22 bp, Artificial Sequence
  chemically synthesized
gatgctgaaaaagacatctaaa

SEQ ID NO: 1125826 - DNA, 22 bp, Artificial Sequence
  chemically synthesized
atgctgaaaaagacatctaaat

SEQ ID NO: 1125827 - DNA, 22 bp, Artificial Sequence
  chemically synthesized
aaaagatttctttaaaatttag

SEQ ID NO: 1125828 - DNA, 22 bp, Artificial Sequence
  chemically synthesized
aaaaagacatctaaattttaaa

SEQ ID NO: 1125829 - DNA, 22 bp, Artificial Sequence
  chemically synthesized
actgaaaagatttctttaaaat

SEQ ID NO: 1125830 - DNA, 22 bp, Artificial Sequence
  chemically synthesized
cactgaaaagatttctttaaaa

SEQ ID NO: 1125831 - DNA, 22 bp, Artificial Sequence
  chemically synthesized
tcactgaaaagatttctttaaa

SEQ ID NO: 1125832 - DNA, 22 bp, Artificial Sequence
  chemically synthesized
ttcactgaaaagatttctttaa

SEQ ID NO: 1125833 - DNA, 22 bp, Artificial Sequence
  chemically synthesized
tttcactgaaaagatttcttta

SEQ ID NO: 1125834 - DNA, 22 bp, Artificial Sequence
  chemically synthesized
aattttaaagaaatcttttcag

SEQ ID NO: 1125835 - DNA, 22 bp, Artificial Sequence
  chemically synthesized
taaagaaatcttttcagtgaaa

SEQ ID NO: 1125836 - DNA, 22 bp, Artificial Sequence
  chemically synthesized
aaagaaatcttttcagtgaaaa

SEQ ID NO: 1125837 - DNA, 22 bp, Artificial Sequence
  chemically synthesized
aagaaatcttttcagtgaaaaa

SEQ ID NO: 1125838 - DNA, 22 bp, Artificial Sequence
  chemically synthesized
aatacagagacctttttcactg

SEQ ID NO: 1125839 - DNA, 22 bp, Artificial Sequence
  chemically synthesized
aaatacagagacctttttcact

SEQ ID NO: 1125840 - DNA, 22 bp, Artificial Sequence
  chemically synthesized
taaatacagagacctttttcac

SEQ ID NO: 1125841 - DNA, 22 bp, Artificial Sequence
  chemically synthesized
tctttaaatacagagacctttt

SEQ ID NO: 1125842 - DNA, 22 bp, Artificial Sequence
  chemically synthesized
ttcagtgaaaaaggtctctgta

SEQ ID NO: 1125843 - DNA, 22 bp, Artificial Sequence
  chemically synthesized
attatctttaaatacagagacc

SEQ ID NO: 1125844 - DNA, 22 bp, Artificial Sequence
  chemically synthesized
tcagtgaaaaaggtctctgtat

SEQ ID NO: 1125845 - DNA, 22 bp, Artificial Sequence
  chemically synthesized
gattatctttaaatacagagac

SEQ ID NO: 1125846 - DNA, 22 bp, Artificial Sequence
  chemically synthesized
cagtgaaaaaggtctctgtatt

SEQ ID NO: 1125847 - DNA, 22 bp, Artificial Sequence
  chemically synthesized
agtgaaaaaggtctctgtattt

SEQ ID NO: 1125848 - DNA, 22 bp, Artificial Sequence
  chemically synthesized
tgtatttaaagataatcaagtg

SEQ ID NO: 1125849 - DNA, 22 bp, Artificial Sequence
  chemically synthesized
tatttaaagataatcaagtgtt

SEQ ID NO: 1125850 - DNA, 22 bp, Artificial Sequence
  chemically synthesized
gtgtcccatggcaacacttgat

SEQ ID NO: 1125851 - DNA, 22 bp, Artificial Sequence
  chemically synthesized
tagtgtcccatggcaacacttg

SEQ ID NO: 1125852 - DNA, 22 bp, Artificial Sequence
  chemically synthesized
aaagataatcaagtgttgccat

SEQ ID NO: 1125853 - DNA, 22 bp, Artificial Sequence
  chemically synthesized
aagataatcaagtgttgccatg

SEQ ID NO: 1125854 - DNA, 22 bp, Artificial Sequence
  chemically synthesized
actctagtgtcccatggcaaca

SEQ ID NO: 1125855 - DNA, 22 bp, Artificial Sequence
  chemically synthesized
aagtatcattgactctagtgtc

SEQ ID NO: 1125856 - DNA, 22 bp, Artificial Sequence
  chemically synthesized
tgaagtatcattgactctagtg

SEQ ID NO: 1125857 - DNA, 22 bp, Artificial Sequence
  chemically synthesized
ccatgggacactagagtcaatg

SEQ ID NO: 1125858 - DNA, 22 bp, Artificial Sequence
  chemically synthesized
cattctgaagtatcattgactc

SEQ ID NO: 1125859 - DNA, 22 bp, Artificial Sequence
  chemically synthesized
tacattctgaagtatcattgac

SEQ ID NO: 1125860 - DNA, 22 bp, Artificial Sequence
  chemically synthesized
ttctacattctgaagtatcatt

SEQ ID NO: 1125861 - DNA, 22 bp, Artificial Sequence
  chemically synthesized
tgtctgttctacattctgaagt

SEQ ID NO: 1125862 - DNA, 22 bp, Artificial Sequence
  chemically synthesized
gagtcaatgatacttcagaatg

SEQ ID NO: 1125863 - DNA, 22 bp, Artificial Sequence
  chemically synthesized
gattatgtctgttctacattct

SEQ ID NO: 1125864 - DNA, 22 bp, Artificial Sequence
  chemically synthesized
tagattatgtctgttctacatt

SEQ ID NO: 1125865 - DNA, 22 bp, Artificial Sequence
  chemically synthesized
ttctagattatgtctgttctac

SEQ ID NO: 1125866 - DNA, 22 bp, Artificial Sequence
  chemically synthesized
attctagattatgtctgttcta

SEQ ID NO: 1125867 - DNA, 22 bp, Artificial Sequence
  chemically synthesized
cagaatgtagaacagacataat

SEQ ID NO: 1125868 - DNA, 22 bp, Artificial Sequence
  chemically synthesized
cacttattctagattatgtctg

SEQ ID NO: 1125869 - DNA, 22 bp, Artificial Sequence
  chemically synthesized
agaatgtagaacagacataatc

SEQ ID NO: 1125870 - DNA, 22 bp, Artificial Sequence
  chemically synthesized
tggaagctgcacttattctaga

SEQ ID NO: 1125871 - DNA, 22 bp, Artificial Sequence
  chemically synthesized
ccaaagtctatggaagctgcac

SEQ ID NO: 1125872 - DNA, 22 bp, Artificial Sequence
  chemically synthesized
gccaaagtctatggaagctgca

SEQ ID NO: 1125873 - DNA, 22 bp, Artificial Sequence
  chemically synthesized
gaataagtgcagcttccataga

SEQ ID NO: 1125874 - DNA, 22 bp, Artificial Sequence
  chemically synthesized
agaatttgccaaagtctatgga

SEQ ID NO: 1125875 - DNA, 22 bp, Artificial Sequence
  chemically synthesized
aagaatttgccaaagtctatgg

SEQ ID NO: 1125876 - DNA, 22 bp, Artificial Sequence
  chemically synthesized
cttaagaatttgccaaagtcta

SEQ ID NO: 1125877 - DNA, 22 bp, Artificial Sequence
  chemically synthesized
ggactccttaagaatttgccaa

SEQ ID NO: 1125878 - DNA, 22 bp, Artificial Sequence
  chemically synthesized
ccatagactttggcaaattctt

SEQ ID NO: 1125879 - DNA, 22 bp, Artificial Sequence
  chemically synthesized
catagactttggcaaattctta

SEQ ID NO: 1125880 - DNA, 22 bp, Artificial Sequence
  chemically synthesized
actgggactccttaagaatttg

SEQ ID NO: 1125881 - DNA, 22 bp, Artificial Sequence
  chemically synthesized
gactgggactccttaagaattt

SEQ ID NO: 1125882 - DNA, 22 bp, Artificial Sequence
  chemically synthesized
tggcaaattcttaaggagtccc

SEQ ID NO: 1125883 - DNA, 22 bp, Artificial Sequence
  chemically synthesized
ggcaaattcttaaggagtccca

SEQ ID NO: 1125884 - DNA, 22 bp, Artificial Sequence
  chemically synthesized
gcaaattcttaaggagtcccag

SEQ ID NO: 1125885 - DNA, 22 bp, Artificial Sequence
  chemically synthesized
aaataaaatgcttgactgggac

SEQ ID NO: 1125886 - DNA, 22 bp, Artificial Sequence
  chemically synthesized
gctgaaataaaatgcttgactg

SEQ ID NO: 1125887 - DNA, 22 bp, Artificial Sequence
  chemically synthesized
ttaaggagtcccagtcaagcat

SEQ ID NO: 1125888 - DNA, 22 bp, Artificial Sequence
  chemically synthesized
agctgaaataaaatgcttgact

SEQ ID NO: 1125889 - DNA, 22 bp, Artificial Sequence
  chemically synthesized
aaggagtcccagtcaagcattt

SEQ ID NO: 1125890 - DNA, 22 bp, Artificial Sequence
  chemically synthesized
aggagtcccagtcaagcatttt

SEQ ID NO: 1125891 - DNA, 22 bp, Artificial Sequence
  chemically synthesized
tttagctgaaataaaatgcttg

SEQ ID NO: 1125892 - DNA, 22 bp, Artificial Sequence
  chemically synthesized
atcaaattatttagctgaaata

SEQ ID NO: 1125893 - DNA, 22 bp, Artificial Sequence
  chemically synthesized
catcaaattatttagctgaaat

SEQ ID NO: 1125894 - DNA, 22 bp, Artificial Sequence
  chemically synthesized
aaggtgatttcatcaaattatt

SEQ ID NO: 1125895 - DNA, 22 bp, Artificial Sequence
  chemically synthesized
tatttcagctaaataatttgat

SEQ ID NO: 1125896 - DNA, 22 bp, Artificial Sequence
  chemically synthesized
atttcagctaaataatttgatg

SEQ ID NO: 1125897 - DNA, 22 bp, Artificial Sequence
  chemically synthesized
tttcagctaaataatttgatga

SEQ ID NO: 1125898 - DNA, 22 bp, Artificial Sequence
  chemically synthesized
cagctaaataatttgatgaaat

SEQ ID NO: 1125899 - DNA, 22 bp, Artificial Sequence
  chemically synthesized
agctaaataatttgatgaaatc

SEQ ID NO: 1125900 - DNA, 22 bp, Artificial Sequence
  chemically synthesized
taataagttaaaggtgatttca

SEQ ID NO: 1125901 - DNA, 22 bp, Artificial Sequence
  chemically synthesized
aataatttgatgaaatcacctt

SEQ ID NO: 1125902 - DNA, 22 bp, Artificial Sequence
  chemically synthesized
tgttgtaataagttaaaggtga

SEQ ID NO: 1125903 - DNA, 22 bp, Artificial Sequence
  chemically synthesized
ctatgttgtaataagttaaagg

SEQ ID NO: 1125904 - DNA, 22 bp, Artificial Sequence
  chemically synthesized
gctatgttgtaataagttaaag

SEQ ID NO: 1125905 - DNA, 22 bp, Artificial Sequence
  chemically synthesized
gatgaaatcacctttaacttat

SEQ ID NO: 1125906 - DNA, 22 bp, Artificial Sequence
  chemically synthesized
atgaaatcacctttaacttatt

SEQ ID NO: 1125907 - DNA, 22 bp, Artificial Sequence
  chemically synthesized
gccttgctatgttgtaataagt

SEQ ID NO: 1125908 - DNA, 22 bp, Artificial Sequence
  chemically synthesized
ctcgccttgctatgttgtaata

SEQ ID NO: 1125909 - DNA, 22 bp, Artificial Sequence
  chemically synthesized
taacttattacaacatagcaag

SEQ ID NO: 1125910 - DNA, 22 bp, Artificial Sequence
  chemically synthesized
aacttattacaacatagcaagg

SEQ ID NO: 1125911 - DNA, 22 bp, Artificial Sequence
  chemically synthesized
ggaaattcctcgccttgctatg

SEQ ID NO: 1125912 - DNA, 22 bp, Artificial Sequence
  chemically synthesized
acttattacaacatagcaaggc

SEQ ID NO: 1125913 - DNA, 22 bp, Artificial Sequence
  chemically synthesized
cggaaattcctcgccttgctat

SEQ ID NO: 1125914 - DNA, 22 bp, Artificial Sequence
  chemically synthesized
attacaacatagcaaggcgagg

SEQ ID NO: 1125915 - DNA, 22 bp, Artificial Sequence
  chemically synthesized
ccttcggaaattcctcgccttg

SEQ ID NO: 1125916 - DNA, 22 bp, Artificial Sequence
  chemically synthesized
ttacaacatagcaaggcgagga

SEQ ID NO: 1125917 - DNA, 22 bp, Artificial Sequence
  chemically synthesized
caacatagcaaggcgaggaatt

SEQ ID NO: 1125918 - DNA, 22 bp, Artificial Sequence
  chemically synthesized
gggtgttgccttcggaaattcc

SEQ ID NO: 1125919 - DNA, 22 bp, Artificial Sequence
  chemically synthesized
agggtgttgccttcggaaattc

SEQ ID NO: 1125920 - DNA, 22 bp, Artificial Sequence
  chemically synthesized
gcttagggtgttgccttcggaa

SEQ ID NO: 1125921 - DNA, 22 bp, Artificial Sequence
  chemically synthesized
ccgaaggcaacaccctaagcta

SEQ ID NO: 1125922 - DNA, 22 bp, Artificial Sequence
  chemically synthesized
cgaaggcaacaccctaagctag

SEQ ID NO: 1125923 - DNA, 22 bp, Artificial Sequence
  chemically synthesized
aacccagacagcctagcttagg

SEQ ID NO: 1125924 - DNA, 22 bp, Artificial Sequence
  chemically synthesized
gaacccagacagcctagcttag

SEQ ID NO: 1125925 - DNA, 22 bp, Artificial Sequence
  chemically synthesized
ggatttgaacccagacagccta

SEQ ID NO: 1125926 - DNA, 22 bp, Artificial Sequence
  chemically synthesized
agctaggctgtctgggttcaaa

SEQ ID NO: 1125927 - DNA, 22 bp, Artificial Sequence
  chemically synthesized
ggctgtctgggttcaaatccta

SEQ ID NO: 1125928 - DNA, 22 bp, Artificial Sequence
  chemically synthesized
caggaagcatcgcagctaggat

SEQ ID NO: 1125929 - DNA, 22 bp, Artificial Sequence
  chemically synthesized
tctgggttcaaatcctagctgc

SEQ ID NO: 1125930 - DNA, 22 bp, Artificial Sequence
  chemically synthesized
acaggaagcatcgcagctagga

SEQ ID NO: 1125931 - DNA, 22 bp, Artificial Sequence
  chemically synthesized
ggttcaaatcctagctgcgatg

SEQ ID NO: 1125932 - DNA, 22 bp, Artificial Sequence
  chemically synthesized
aaatcctagctgcgatgcttcc

SEQ ID NO: 1125933 - DNA, 22 bp, Artificial Sequence
  chemically synthesized
atggtcacatagtttacaggaa

SEQ ID NO: 1125934 - DNA, 22 bp, Artificial Sequence
  chemically synthesized
gctgcgatgcttcctgtaaact

SEQ ID NO: 1125935 - DNA, 22 bp, Artificial Sequence
  chemically synthesized
ctcatggtcacatagtttacag

SEQ ID NO: 1125936 - DNA, 22 bp, Artificial Sequence
  chemically synthesized
gctcatggtcacatagtttaca

SEQ ID NO: 1125937 - DNA, 22 bp, Artificial Sequence
  chemically synthesized
cgatgcttcctgtaaactatgt

SEQ ID NO: 1125938 - DNA, 22 bp, Artificial Sequence
  chemically synthesized
aagtgacttgctcatggtcaca

SEQ ID NO: 1125939 - DNA, 22 bp, Artificial Sequence
  chemically synthesized
cctgtaaactatgtgaccatga

SEQ ID NO: 1125940 - DNA, 22 bp, Artificial Sequence
  chemically synthesized
caagtgacttgctcatggtcac

SEQ ID NO: 1125941 - DNA, 22 bp, Artificial Sequence
  chemically synthesized
ctgtaaactatgtgaccatgag

SEQ ID NO: 1125942 - DNA, 22 bp, Artificial Sequence
  chemically synthesized
taaactatgtgaccatgagcaa

SEQ ID NO: 1125943 - DNA, 22 bp, Artificial Sequence
  chemically synthesized
tgtgaccatgagcaagtcactt

SEQ ID NO: 1125944 - DNA, 22 bp, Artificial Sequence
  chemically synthesized
ccaatgataacaatgtgtcata

SEQ ID NO: 1125945 - DNA, 22 bp, Artificial Sequence
  chemically synthesized
gccaatgataacaatgtgtcat

SEQ ID NO: 1125946 - DNA, 22 bp, Artificial Sequence
  chemically synthesized
tgccaatgataacaatgtgtca

SEQ ID NO: 1125947 - DNA, 22 bp, Artificial Sequence
  chemically synthesized
gaaatttctatgacacattgtt

SEQ ID NO: 1125948 - DNA, 22 bp, Artificial Sequence
  chemically synthesized
tttgccaatgataacaatgtgt

SEQ ID NO: 1125949 - DNA, 22 bp, Artificial Sequence
  chemically synthesized
aaatttctatgacacattgtta

SEQ ID NO: 1125950 - DNA, 22 bp, Artificial Sequence
  chemically synthesized
tcactctttgccaatgataaca

SEQ ID NO: 1125951 - DNA, 22 bp, Artificial Sequence
  chemically synthesized
ctatgacacattgttatcattg

SEQ ID NO: 1125952 - DNA, 22 bp, Artificial Sequence
  chemically synthesized
tatgacacattgttatcattgg

SEQ ID NO: 1125953 - DNA, 22 bp, Artificial Sequence
  chemically synthesized
ttgtcactctttgccaatgata

SEQ ID NO: 1125954 - DNA, 22 bp, Artificial Sequence
  chemically synthesized
tgacacattgttatcattggca

SEQ ID NO: 1125955 - DNA, 22 bp, Artificial Sequence
  chemically synthesized
ttattgtcactctttgccaatg

SEQ ID NO: 1125956 - DNA, 22 bp, Artificial Sequence
  chemically synthesized
attattgtcactctttgccaat

SEQ ID NO: 1125957 - DNA, 22 bp, Artificial Sequence
  chemically synthesized
tattattgtcactctttgccaa

SEQ ID NO: 1125958 - DNA, 22 bp, Artificial Sequence
  chemically synthesized
ttatcattggcaaagagtgaca

SEQ ID NO: 1125959 - DNA, 22 bp, Artificial Sequence
  chemically synthesized
tcattggcaaagagtgacaata

SEQ ID NO: 1125960 - DNA, 22 bp, Artificial Sequence
  chemically synthesized
cgaagtaagttttattattgtc

SEQ ID NO: 1125961 - DNA, 22 bp, Artificial Sequence
  chemically synthesized
gcaaagagtgacaataataaaa

SEQ ID NO: 1125962 - DNA, 22 bp, Artificial Sequence
  chemically synthesized
aaatagcattacgaagtaagtt

SEQ ID NO: 1125963 - DNA, 22 bp, Artificial Sequence
  chemically synthesized
aaaatagcattacgaagtaagt

SEQ ID NO: 1125964 - DNA, 22 bp, Artificial Sequence
  chemically synthesized
acacttaaaatagcattacgaa

SEQ ID NO: 1125965 - DNA, 22 bp, Artificial Sequence
  chemically synthesized
cacacttaaaatagcattacga

SEQ ID NO: 1125966 - DNA, 22 bp, Artificial Sequence
  chemically synthesized
atgtatttcacacttaaaatag

SEQ ID NO: 1125967 - DNA, 22 bp, Artificial Sequence
  chemically synthesized
acttcgtaatgctattttaagt

SEQ ID NO: 1125968 - DNA, 22 bp, Artificial Sequence
  chemically synthesized
cttcgtaatgctattttaagtg

SEQ ID NO: 1125969 - DNA, 22 bp, Artificial Sequence
  chemically synthesized
cgtaatgctattttaagtgtga

SEQ ID NO: 1125970 - DNA, 22 bp, Artificial Sequence
  chemically synthesized
gtaatgctattttaagtgtgaa

SEQ ID NO: 1125971 - DNA, 22 bp, Artificial Sequence
  chemically synthesized
catattaatgtatttcacactt

SEQ ID NO: 1125972 - DNA, 22 bp, Artificial Sequence
  chemically synthesized
ctacatattaatgtatttcaca

SEQ ID NO: 1125973 - DNA, 22 bp, Artificial Sequence
  chemically synthesized
gctacatattaatgtatttcac

SEQ ID NO: 1125974 - DNA, 22 bp, Artificial Sequence
  chemically synthesized
ttttaagtgtgaaatacattaa

SEQ ID NO: 1125975 - DNA, 22 bp, Artificial Sequence
  chemically synthesized
taagtgtgaaatacattaatat

SEQ ID NO: 1125976 - DNA, 22 bp, Artificial Sequence
  chemically synthesized
aagtgtgaaatacattaatatg

SEQ ID NO: 1125977 - DNA, 22 bp, Artificial Sequence
  chemically synthesized
agtgtgaaatacattaatatgt

SEQ ID NO: 1125978 - DNA, 22 bp, Artificial Sequence
  chemically synthesized
ccaagtatttgctacatattaa

SEQ ID NO: 1125979 - DNA, 22 bp, Artificial Sequence
  chemically synthesized
taccaagtatttgctacatatt

SEQ ID NO: 1125980 - DNA, 22 bp, Artificial Sequence
  chemically synthesized
ctaccaagtatttgctacatat

SEQ ID NO: 1125981 - DNA, 22 bp, Artificial Sequence
  chemically synthesized
atatgtagcaaatacttggtag

SEQ ID NO: 1125982 - DNA, 22 bp, Artificial Sequence
  chemically synthesized
atatgtatatggcttctaccaa

SEQ ID NO: 1125983 - DNA, 22 bp, Artificial Sequence
  chemically synthesized
ataacaatagctaatatgtata

SEQ ID NO: 1125984 - DNA, 22 bp, Artificial Sequence
  chemically synthesized
ggtagaagccatatacatatta

SEQ ID NO: 1125985 - DNA, 22 bp, Artificial Sequence
  chemically synthesized
gtagaagccatatacatattag

SEQ ID NO: 1125986 - DNA, 22 bp, Artificial Sequence
  chemically synthesized
gctattgttattaatatcttcc

SEQ ID NO: 1125987 - DNA, 22 bp, Artificial Sequence
  chemically synthesized
aaaaaggatcatggaagatatt

SEQ ID NO: 1125988 - DNA, 22 bp, Artificial Sequence
  chemically synthesized
ttgttattaatatcttccatga

SEQ ID NO: 1125989 - DNA, 22 bp, Artificial Sequence
  chemically synthesized
ttattaatatcttccatgatcc

SEQ ID NO: 1125990 - DNA, 22 bp, Artificial Sequence
  chemically synthesized
ttaatatcttccatgatccttt

SEQ ID NO: 1125991 - DNA, 22 bp, Artificial Sequence
  chemically synthesized
aagccagttaaaaaaggatcat

SEQ ID NO: 1125992 - DNA, 22 bp, Artificial Sequence
  chemically synthesized
aaagccagttaaaaaaggatca

SEQ ID NO: 1125993 - DNA, 22 bp, Artificial Sequence
  chemically synthesized
atatcttccatgatcctttttt

SEQ ID NO: 1125994 - DNA, 22 bp, Artificial Sequence
  chemically synthesized
ccatgatccttttttaactggc

SEQ ID NO: 1125995 - DNA, 22 bp, Artificial Sequence
  chemically synthesized
catgatccttttttaactggct

SEQ ID NO: 1125996 - DNA, 22 bp, Artificial Sequence
  chemically synthesized
ttttaactggctttaagcccta

SEQ ID NO: 1125997 - DNA, 22 bp, Artificial Sequence
  chemically synthesized
tttaactggctttaagccctat

SEQ ID NO: 1125998 - DNA, 22 bp, Artificial Sequence
  chemically synthesized
ttaactggctttaagccctatg

SEQ ID NO: 1125999 - DNA, 22 bp, Artificial Sequence
  chemically synthesized
taactggctttaagccctatgc

SEQ ID NO: 1126000 - DNA, 22 bp, Artificial Sequence
  chemically synthesized
aactggctttaagccctatgcc

SEQ ID NO: 1126001 - DNA, 22 bp, Artificial Sequence
  chemically synthesized
actggctttaagccctatgcca

SEQ ID NO: 1126002 - DNA, 22 bp, Artificial Sequence
  chemically synthesized
gctttaagccctatgccatttc

SEQ ID NO: 1126003 - DNA, 22 bp, Artificial Sequence
  chemically synthesized
taagccctatgccatttctcac

SEQ ID NO: 1126004 - DNA, 22 bp, Artificial Sequence
  chemically synthesized
acacgtgagaaagtgagaaatg

SEQ ID NO: 1126005 - DNA, 22 bp, Artificial Sequence
  chemically synthesized
aagccctatgccatttctcact

SEQ ID NO: 1126006 - DNA, 22 bp, Artificial Sequence
  chemically synthesized
agccctatgccatttctcactt

SEQ ID NO: 1126007 - DNA, 22 bp, Artificial Sequence
  chemically synthesized
tcacacgtgagaaagtgagaaa

SEQ ID NO: 1126008 - DNA, 22 bp, Artificial Sequence
  chemically synthesized
ctctcacacgtgagaaagtgag

SEQ ID NO: 1126009 - DNA, 22 bp, Artificial Sequence
  chemically synthesized
tgccatttctcactttctcacg

SEQ ID NO: 1126010 - DNA, 22 bp, Artificial Sequence
  chemically synthesized
ctcactttctcacgtgtgagag

SEQ ID NO: 1126011 - DNA, 22 bp, Artificial Sequence
  chemically synthesized
tcactttctcacgtgtgagagt

SEQ ID NO: 1126012 - DNA, 22 bp, Artificial Sequence
  chemically synthesized
actttctcacgtgtgagagtag

SEQ ID NO: 1126013 - DNA, 22 bp, Artificial Sequence
  chemically synthesized
aaacaaatatgactactctcac

SEQ ID NO: 1126014 - DNA, 22 bp, Artificial Sequence
  chemically synthesized
tctcacgtgtgagagtagtcat

SEQ ID NO: 1126015 - DNA, 22 bp, Artificial Sequence
  chemically synthesized
ctcacgtgtgagagtagtcata

SEQ ID NO: 1126016 - DNA, 22 bp, Artificial Sequence
  chemically synthesized
tcacgtgtgagagtagtcatat

SEQ ID NO: 1126017 - DNA, 22 bp, Artificial Sequence
  chemically synthesized
acgtgtgagagtagtcatattt

SEQ ID NO: 1126018 - DNA, 22 bp, Artificial Sequence
  chemically synthesized
agaagacactaaaacaaatatg

SEQ ID NO: 1126019 - DNA, 22 bp, Artificial Sequence
  chemically synthesized
tcagtcattaagaagacactaa

SEQ ID NO: 1126020 - DNA, 22 bp, Artificial Sequence
  chemically synthesized
atcagtcattaagaagacacta

SEQ ID NO: 1126021 - DNA, 22 bp, Artificial Sequence
  chemically synthesized
tatcagtcattaagaagacact

SEQ ID NO: 1126022 - DNA, 22 bp, Artificial Sequence
  chemically synthesized
ctttatcagtcattaagaagac

SEQ ID NO: 1126023 - DNA, 22 bp, Artificial Sequence
  chemically synthesized
actttatcagtcattaagaaga

SEQ ID NO: 1126024 - DNA, 22 bp, Artificial Sequence
  chemically synthesized
tactttatcagtcattaagaag

SEQ ID NO: 1126025 - DNA, 22 bp, Artificial Sequence
  chemically synthesized
ttactttatcagtcattaagaa

SEQ ID NO: 1126026 - DNA, 22 bp, Artificial Sequence
  chemically synthesized
gttttagtgtcttcttaatgac

SEQ ID NO: 1126027 - DNA, 22 bp, Artificial Sequence
  chemically synthesized
ttttagtgtcttcttaatgact

SEQ ID NO: 1126028 - DNA, 22 bp, Artificial Sequence
  chemically synthesized
tagtgtcttcttaatgactgat

SEQ ID NO: 1126029 - DNA, 22 bp, Artificial Sequence
  chemically synthesized
agtgtcttcttaatgactgata

SEQ ID NO: 1126030 - DNA, 22 bp, Artificial Sequence
  chemically synthesized
tggcttttactttatcagtcat

SEQ ID NO: 1126031 - DNA, 22 bp, Artificial Sequence
  chemically synthesized
gtgtcttcttaatgactgataa

SEQ ID NO: 1126032 - DNA, 22 bp, Artificial Sequence
  chemically synthesized
caattgtggcttttactttatc

SEQ ID NO: 1126033 - DNA, 22 bp, Artificial Sequence
  chemically synthesized
cttaatgactgataaagtaaaa

SEQ ID NO: 1126034 - DNA, 22 bp, Artificial Sequence
  chemically synthesized
ttaatgactgataaagtaaaag

SEQ ID NO: 1126035 - DNA, 22 bp, Artificial Sequence
  chemically synthesized
ttccaattgtggcttttacttt

SEQ ID NO: 1126036 - DNA, 22 bp, Artificial Sequence
  chemically synthesized
aatgactgataaagtaaaagcc

SEQ ID NO: 1126037 - DNA, 22 bp, Artificial Sequence
  chemically synthesized
atgactgataaagtaaaagcca

SEQ ID NO: 1126038 - DNA, 22 bp, Artificial Sequence
  chemically synthesized
ttattccaattgtggcttttac

SEQ ID NO: 1126039 - DNA, 22 bp, Artificial Sequence
  chemically synthesized
gttattccaattgtggctttta

SEQ ID NO: 1126040 - DNA, 22 bp, Artificial Sequence
  chemically synthesized
ttgttattccaattgtggcttt

SEQ ID NO: 1126041 - DNA, 22 bp, Artificial Sequence
  chemically synthesized
ttcttgttattccaattgtggc

SEQ ID NO: 1126042 - DNA, 22 bp, Artificial Sequence
  chemically synthesized
ataaagtaaaagccacaattgg

SEQ ID NO: 1126043 - DNA, 22 bp, Artificial Sequence
  chemically synthesized
attcttgttattccaattgtgg

SEQ ID NO: 1126044 - DNA, 22 bp, Artificial Sequence
  chemically synthesized
tattcttgttattccaattgtg

SEQ ID NO: 1126045 - DNA, 22 bp, Artificial Sequence
  chemically synthesized
ttattcttgttattccaattgt

SEQ ID NO: 1126046 - DNA, 22 bp, Artificial Sequence
  chemically synthesized
cagtttttattcttgttattcc

SEQ ID NO: 1126047 - DNA, 22 bp, Artificial Sequence
  chemically synthesized
gcagtttttattcttgttattc

SEQ ID NO: 1126048 - DNA, 22 bp, Artificial Sequence
  chemically synthesized
tgtttgcagtttttattcttgt

SEQ ID NO: 1126049 - DNA, 22 bp, Artificial Sequence
  chemically synthesized
tagctgtgtttgcagtttttat

SEQ ID NO: 1126050 - DNA, 22 bp, Artificial Sequence
  chemically synthesized
gaataacaagaataaaaactgc

SEQ ID NO: 1126051 - DNA, 22 bp, Artificial Sequence
  chemically synthesized
ttatagctgtgtttgcagtttt

SEQ ID NO: 1126052 - DNA, 22 bp, Artificial Sequence
  chemically synthesized
gttatagctgtgtttgcagttt

SEQ ID NO: 1126053 - DNA, 22 bp, Artificial Sequence
  chemically synthesized
tgttatagctgtgtttgcagtt

SEQ ID NO: 1126054 - DNA, 22 bp, Artificial Sequence
  chemically synthesized
tctttgttatagctgtgtttgc

SEQ ID NO: 1126055 - DNA, 22 bp, Artificial Sequence
  chemically synthesized
attgtctttgttatagctgtgt

SEQ ID NO: 1126056 - DNA, 22 bp, Artificial Sequence
  chemically synthesized
cattgtctttgttatagctgtg

SEQ ID NO: 1126057 - DNA, 22 bp, Artificial Sequence
  chemically synthesized
tatgtttcattgtctttgttat

SEQ ID NO: 1126058 - DNA, 22 bp, Artificial Sequence
  chemically synthesized
caaacacagctataacaaagac

SEQ ID NO: 1126059 - DNA, 22 bp, Artificial Sequence
  chemically synthesized
atatgtttcattgtctttgtta

SEQ ID NO: 1126060 - DNA, 22 bp, Artificial Sequence
  chemically synthesized
tttatatgtttcattgtctttg

SEQ ID NO: 1126061 - DNA, 22 bp, Artificial Sequence
  chemically synthesized
gtttatatgtttcattgtcttt

SEQ ID NO: 1126062 - DNA, 22 bp, Artificial Sequence
  chemically synthesized
tgtttatatgtttcattgtctt

SEQ ID NO: 1126063 - DNA, 22 bp, Artificial Sequence
  chemically synthesized
ttgtttatatgtttcattgtct

SEQ ID NO: 1126064 - DNA, 22 bp, Artificial Sequence
  chemically synthesized
atttttgtttatatgtttcatt

SEQ ID NO: 1126065 - DNA, 22 bp, Artificial Sequence
  chemically synthesized
taacaaagacaatgaaacatat

SEQ ID NO: 1126066 - DNA, 22 bp, Artificial Sequence
  chemically synthesized
ttgatttttgtttatatgtttc

SEQ ID NO: 1126067 - DNA, 22 bp, Artificial Sequence
  chemically synthesized
ctgttgatttttgtttatatgt

SEQ ID NO: 1126068 - DNA, 22 bp, Artificial Sequence
  chemically synthesized
gctgttgatttttgtttatatg

SEQ ID NO: 1126069 - DNA, 22 bp, Artificial Sequence
  chemically synthesized
tgctgttgatttttgtttatat

SEQ ID NO: 1126070 - DNA, 22 bp, Artificial Sequence
  chemically synthesized
ttttgctgttgatttttgttta

SEQ ID NO: 1126071 - DNA, 22 bp, Artificial Sequence
  chemically synthesized
atgggtaaaatgagactatttt

SEQ ID NO: 1126072 - DNA, 22 bp, Artificial Sequence
  chemically synthesized
cggcactaatgggtaaaatgag

SEQ ID NO: 1126073 - DNA, 22 bp, Artificial Sequence
  chemically synthesized
gggattccggcactaatgggta

SEQ ID NO: 1126074 - DNA, 22 bp, Artificial Sequence
  chemically synthesized
ggggattccggcactaatgggt

SEQ ID NO: 1126075 - DNA, 22 bp, Artificial Sequence
  chemically synthesized
tggggattccggcactaatggg

SEQ ID NO: 1126076 - DNA, 22 bp, Artificial Sequence
  chemically synthesized
attttacccattagtgccggaa

SEQ ID NO: 1126077 - DNA, 22 bp, Artificial Sequence
  chemically synthesized
tacccattagtgccggaatccc

SEQ ID NO: 1126078 - DNA, 22 bp, Artificial Sequence
  chemically synthesized
acccattagtgccggaatcccc

SEQ ID NO: 1126079 - DNA, 22 bp, Artificial Sequence
  chemically synthesized
cccattagtgccggaatcccca

SEQ ID NO: 1126080 - DNA, 22 bp, Artificial Sequence
  chemically synthesized
tcccatagaacatactttgggg

SEQ ID NO: 1126081 - DNA, 22 bp, Artificial Sequence
  chemically synthesized
gtcccatagaacatactttggg

SEQ ID NO: 1126082 - DNA, 22 bp, Artificial Sequence
  chemically synthesized
gtgccggaatccccaaagtatg

SEQ ID NO: 1126083 - DNA, 22 bp, Artificial Sequence
  chemically synthesized
gatggcagaccatatttgtccc

SEQ ID NO: 1126084 - DNA, 22 bp, Artificial Sequence
  chemically synthesized
ccaaattagatggcagaccata

SEQ ID NO: 1126085 - DNA, 22 bp, Artificial Sequence
  chemically synthesized
tatgggacaaatatggtctgcc

SEQ ID NO: 1126086 - DNA, 22 bp, Artificial Sequence
  chemically synthesized
accaaattagatggcagaccat

SEQ ID NO: 1126087 - DNA, 22 bp, Artificial Sequence
  chemically synthesized
tgggacaaatatggtctgccat

SEQ ID NO: 1126088 - DNA, 22 bp, Artificial Sequence
  chemically synthesized
tttaccaaattagatggcagac

SEQ ID NO: 1126089 - DNA, 22 bp, Artificial Sequence
  chemically synthesized
atttaccaaattagatggcaga

SEQ ID NO: 1126090 - DNA, 22 bp, Artificial Sequence
  chemically synthesized
tatttaccaaattagatggcag

SEQ ID NO: 1126091 - DNA, 22 bp, Artificial Sequence
  chemically synthesized
cagtaaaattttatttaccaaa

SEQ ID NO: 1126092 - DNA, 22 bp, Artificial Sequence
  chemically synthesized
ccatctaatttggtaaataaaa

SEQ ID NO: 1126093 - DNA, 22 bp, Artificial Sequence
  chemically synthesized
agttccagtaaaattttattta

SEQ ID NO: 1126094 - DNA, 22 bp, Artificial Sequence
  chemically synthesized
atttggtaaataaaattttact

SEQ ID NO: 1126095 - DNA, 22 bp, Artificial Sequence
  chemically synthesized
ggtaaataaaattttactggaa

SEQ ID NO: 1126096 - DNA, 22 bp, Artificial Sequence
  chemically synthesized
gtaaataaaattttactggaac

SEQ ID NO: 1126097 - DNA, 22 bp, Artificial Sequence
  chemically synthesized
tactggaactcagtcatgctca

SEQ ID NO: 1126098 - DNA, 22 bp, Artificial Sequence
  chemically synthesized
actggaactcagtcatgctcat

SEQ ID NO: 1126099 - DNA, 22 bp, Artificial Sequence
  chemically synthesized
ctggaactcagtcatgctcatt

SEQ ID NO: 1126100 - DNA, 22 bp, Artificial Sequence
  chemically synthesized
gaactcagtcatgctcattcat

SEQ ID NO: 1126101 - DNA, 22 bp, Artificial Sequence
  chemically synthesized
agtcatgctcattcatttatac

SEQ ID NO: 1126102 - DNA, 22 bp, Artificial Sequence
  chemically synthesized
gaaagcagccataaacaatgta

SEQ ID NO: 1126103 - DNA, 22 bp, Artificial Sequence
  chemically synthesized
attcatttatacattgtttatg

SEQ ID NO: 1126104 - DNA, 22 bp, Artificial Sequence
  chemically synthesized
tagctagaaagcagccataaac

SEQ ID NO: 1126105 - DNA, 22 bp, Artificial Sequence
  chemically synthesized
atttatacattgtttatggctg

SEQ ID NO: 1126106 - DNA, 22 bp, Artificial Sequence
  chemically synthesized
ctatagctagaaagcagccata

SEQ ID NO: 1126107 - DNA, 22 bp, Artificial Sequence
  chemically synthesized
atacattgtttatggctgcttt

SEQ ID NO: 1126108 - DNA, 22 bp, Artificial Sequence
  chemically synthesized
tacattgtttatggctgctttc

SEQ ID NO: 1126109 - DNA, 22 bp, Artificial Sequence
  chemically synthesized
ctgctatagctagaaagcagcc

SEQ ID NO: 1126110 - DNA, 22 bp, Artificial Sequence
  chemically synthesized
tgctgctatagctagaaagcag

SEQ ID NO: 1126111 - DNA, 22 bp, Artificial Sequence
  chemically synthesized
tttatggctgctttctagctat

SEQ ID NO: 1126112 - DNA, 22 bp, Artificial Sequence
  chemically synthesized
aactctgctgctatagctagaa

SEQ ID NO: 1126113 - DNA, 22 bp, Artificial Sequence
  chemically synthesized
atggctgctttctagctatagc

SEQ ID NO: 1126114 - DNA, 22 bp, Artificial Sequence
  chemically synthesized
ctcaactctgctgctatagcta

SEQ ID NO: 1126115 - DNA, 22 bp, Artificial Sequence
  chemically synthesized
tggctgctttctagctatagca

SEQ ID NO: 1126116 - DNA, 22 bp, Artificial Sequence
  chemically synthesized
aaactactcaactctgctgcta

SEQ ID NO: 1126117 - DNA, 22 bp, Artificial Sequence
  chemically synthesized
ctttctagctatagcagcagag

SEQ ID NO: 1126118 - DNA, 22 bp, Artificial Sequence
  chemically synthesized
aaaactactcaactctgctgct

SEQ ID NO: 1126119 - DNA, 22 bp, Artificial Sequence
  chemically synthesized
taaaactactcaactctgctgc

SEQ ID NO: 1126120 - DNA, 22 bp, Artificial Sequence
  chemically synthesized
tctagctatagcagcagagttg

SEQ ID NO: 1126121 - DNA, 22 bp, Artificial Sequence
  chemically synthesized
ctagctatagcagcagagttga

SEQ ID NO: 1126122 - DNA, 22 bp, Artificial Sequence
  chemically synthesized
ttttaaaactactcaactctgc

SEQ ID NO: 1126123 - DNA, 22 bp, Artificial Sequence
  chemically synthesized
tagctatagcagcagagttgag

SEQ ID NO: 1126124 - DNA, 22 bp, Artificial Sequence
  chemically synthesized
attttaaaactactcaactctg

SEQ ID NO: 1126125 - DNA, 22 bp, Artificial Sequence
  chemically synthesized
gctatagcagcagagttgagta

SEQ ID NO: 1126126 - DNA, 22 bp, Artificial Sequence
  chemically synthesized
tagcagcagagttgagtagttt

SEQ ID NO: 1126127 - DNA, 22 bp, Artificial Sequence
  chemically synthesized
tgtatcataaaatttattttaa

SEQ ID NO: 1126128 - DNA, 22 bp, Artificial Sequence
  chemically synthesized
gtgtatcataaaatttatttta

SEQ ID NO: 1126129 - DNA, 22 bp, Artificial Sequence
  chemically synthesized
tgtgtatcataaaatttatttt

SEQ ID NO: 1126130 - DNA, 22 bp, Artificial Sequence
  chemically synthesized
agtagttttaaaataaatttta

SEQ ID NO: 1126131 - DNA, 22 bp, Artificial Sequence
  chemically synthesized
ggttttgtgtatcataaaattt

SEQ ID NO: 1126132 - DNA, 22 bp, Artificial Sequence
  chemically synthesized
aggttttgtgtatcataaaatt

SEQ ID NO: 1126133 - DNA, 22 bp, Artificial Sequence
  chemically synthesized
taggttttgtgtatcataaaat

SEQ ID NO: 1126134 - DNA, 22 bp, Artificial Sequence
  chemically synthesized
taaaataaattttatgatacac

SEQ ID NO: 1126135 - DNA, 22 bp, Artificial Sequence
  chemically synthesized
aaaataaattttatgatacaca

SEQ ID NO: 1126136 - DNA, 22 bp, Artificial Sequence
  chemically synthesized
aaataaattttatgatacacaa

SEQ ID NO: 1126137 - DNA, 22 bp, Artificial Sequence
  chemically synthesized
tatgatacacaaaacctaaaat

SEQ ID NO: 1126138 - DNA, 22 bp, Artificial Sequence
  chemically synthesized
atgatacacaaaacctaaaata

SEQ ID NO: 1126139 - DNA, 22 bp, Artificial Sequence
  chemically synthesized
tgatacacaaaacctaaaatat

SEQ ID NO: 1126140 - DNA, 22 bp, Artificial Sequence
  chemically synthesized
aagggccagagagtaaatattt

SEQ ID NO: 1126141 - DNA, 22 bp, Artificial Sequence
  chemically synthesized
taaagggccagagagtaaatat

SEQ ID NO: 1126142 - DNA, 22 bp, Artificial Sequence
  chemically synthesized
tctaaagggccagagagtaaat

SEQ ID NO: 1126143 - DNA, 22 bp, Artificial Sequence
  chemically synthesized
ctctaaagggccagagagtaaa

SEQ ID NO: 1126144 - DNA, 22 bp, Artificial Sequence
  chemically synthesized
tctctaaagggccagagagtaa

SEQ ID NO: 1126145 - DNA, 22 bp, Artificial Sequence
  chemically synthesized
aaatatttactctctggccctt

SEQ ID NO: 1126146 - DNA, 22 bp, Artificial Sequence
  chemically synthesized
actctctggccctttagagaaa

SEQ ID NO: 1126147 - DNA, 22 bp, Artificial Sequence
  chemically synthesized
ctctctggccctttagagaaaa

SEQ ID NO: 1126148 - DNA, 22 bp, Artificial Sequence
  chemically synthesized
tctggccctttagagaaaactt

SEQ ID NO: 1126149 - DNA, 22 bp, Artificial Sequence
  chemically synthesized
tggccctttagagaaaactttt

SEQ ID NO: 1126150 - DNA, 22 bp, Artificial Sequence
  chemically synthesized
ggaagggggaaagaaaagtttt

SEQ ID NO: 1126151 - DNA, 22 bp, Artificial Sequence
  chemically synthesized
gccctttagagaaaacttttct

SEQ ID NO: 1126152 - DNA, 22 bp, Artificial Sequence
  chemically synthesized
tagagaaaacttttctttcccc

SEQ ID NO: 1126153 - DNA, 22 bp, Artificial Sequence
  chemically synthesized
agagaaaacttttctttccccc

SEQ ID NO: 1126154 - DNA, 22 bp, Artificial Sequence
  chemically synthesized
atagactgggaagggggaaaga

SEQ ID NO: 1126155 - DNA, 22 bp, Artificial Sequence
  chemically synthesized
gagaaaacttttctttccccct

SEQ ID NO: 1126156 - DNA, 22 bp, Artificial Sequence
  chemically synthesized
catagactgggaagggggaaag

SEQ ID NO: 1126157 - DNA, 22 bp, Artificial Sequence
  chemically synthesized
gtttcatagactgggaaggggg

SEQ ID NO: 1126158 - DNA, 22 bp, Artificial Sequence
  chemically synthesized
ggtttcatagactgggaagggg

SEQ ID NO: 1126159 - DNA, 22 bp, Artificial Sequence
  chemically synthesized
ccttggtttcatagactgggaa

SEQ ID NO: 1126160 - DNA, 22 bp, Artificial Sequence
  chemically synthesized
ttctttcccccttcccagtcta

SEQ ID NO: 1126161 - DNA, 22 bp, Artificial Sequence
  chemically synthesized
accttggtttcatagactggga

SEQ ID NO: 1126162 - DNA, 22 bp, Artificial Sequence
  chemically synthesized
tctttcccccttcccagtctat

SEQ ID NO: 1126163 - DNA, 22 bp, Artificial Sequence
  chemically synthesized
ctttcccccttcccagtctatg

SEQ ID NO: 1126164 - DNA, 22 bp, Artificial Sequence
  chemically synthesized
tttcccccttcccagtctatga

SEQ ID NO: 1126165 - DNA, 22 bp, Artificial Sequence
  chemically synthesized
tcccccttcccagtctatgaaa

SEQ ID NO: 1126166 - DNA, 22 bp, Artificial Sequence
  chemically synthesized
cccccttcccagtctatgaaac

SEQ ID NO: 1126167 - DNA, 22 bp, Artificial Sequence
  chemically synthesized
ccccttcccagtctatgaaacc

SEQ ID NO: 1126168 - DNA, 22 bp, Artificial Sequence
  chemically synthesized
cccagtctatgaaaccaaggta

SEQ ID NO: 1126169 - DNA, 22 bp, Artificial Sequence
  chemically synthesized
ccagtctatgaaaccaaggtaa

SEQ ID NO: 1126170 - DNA, 22 bp, Artificial Sequence
  chemically synthesized
ggagagagaggccatcttacct

SEQ ID NO: 1126171 - DNA, 22 bp, Artificial Sequence
  chemically synthesized
tgaaaccaaggtaagatggcct

SEQ ID NO: 1126172 - DNA, 22 bp, Artificial Sequence
  chemically synthesized
agagttgggagagagaggccat

SEQ ID NO: 1126173 - DNA, 22 bp, Artificial Sequence
  chemically synthesized
gagagttgggagagagaggcca

SEQ ID NO: 1126174 - DNA, 22 bp, Artificial Sequence
  chemically synthesized
acttgagagttgggagagagag

SEQ ID NO: 1126175 - DNA, 22 bp, Artificial Sequence
  chemically synthesized
atctcacttgagagttgggaga

SEQ ID NO: 1126176 - DNA, 22 bp, Artificial Sequence
  chemically synthesized
gatctcacttgagagttgggag

SEQ ID NO: 1126177 - DNA, 22 bp, Artificial Sequence
  chemically synthesized
tgatctcacttgagagttggga

SEQ ID NO: 1126178 - DNA, 22 bp, Artificial Sequence
  chemically synthesized
tctctcccaactctcaagtgag

SEQ ID NO: 1126179 - DNA, 22 bp, Artificial Sequence
  chemically synthesized
tctcccaactctcaagtgagat

SEQ ID NO: 1126180 - DNA, 22 bp, Artificial Sequence
  chemically synthesized
tcccaactctcaagtgagatca

SEQ ID NO: 1126181 - DNA, 22 bp, Artificial Sequence
  chemically synthesized
ccaactctcaagtgagatcaaa

SEQ ID NO: 1126182 - DNA, 22 bp, Artificial Sequence
  chemically synthesized
tgaaccatatcattttgatctc

SEQ ID NO: 1126183 - DNA, 22 bp, Artificial Sequence
  chemically synthesized
ctgtgaaccatatcattttgat

SEQ ID NO: 1126184 - DNA, 22 bp, Artificial Sequence
  chemically synthesized
tcaagtgagatcaaaatgatat

SEQ ID NO: 1126185 - DNA, 22 bp, Artificial Sequence
  chemically synthesized
aagtgagatcaaaatgatatgg

SEQ ID NO: 1126186 - DNA, 22 bp, Artificial Sequence
  chemically synthesized
agagagagaaatatgatatggc

SEQ ID NO: 1126187 - DNA, 22 bp, Artificial Sequence
  chemically synthesized
gagagagagaaatatgatatgg

SEQ ID NO: 1126188 - DNA, 22 bp, Artificial Sequence
  chemically synthesized
tgagagagagaaatatgatatg

SEQ ID NO: 1126189 - DNA, 22 bp, Artificial Sequence
  chemically synthesized
ttgagagagagaaatatgatat

SEQ ID NO: 1126190 - DNA, 22 bp, Artificial Sequence
  chemically synthesized
acagtagccatatcatatttct

SEQ ID NO: 1126191 - DNA, 22 bp, Artificial Sequence
  chemically synthesized
catatttttgagagagagaaat

SEQ ID NO: 1126192 - DNA, 22 bp, Artificial Sequence
  chemically synthesized
ctctctctcaaaaatatgcaat

SEQ ID NO: 1126193 - DNA, 22 bp, Artificial Sequence
  chemically synthesized
tctctctcaaaaatatgcaatg

SEQ ID NO: 1126194 - DNA, 22 bp, Artificial Sequence
  chemically synthesized
gtcatggggagccattgcatat

SEQ ID NO: 1126195 - DNA, 22 bp, Artificial Sequence
  chemically synthesized
tctctcaaaaatatgcaatggc

SEQ ID NO: 1126196 - DNA, 22 bp, Artificial Sequence
  chemically synthesized
tggtcatggggagccattgcat

SEQ ID NO: 1126197 - DNA, 22 bp, Artificial Sequence
  chemically synthesized
ctggtcatggggagccattgca

SEQ ID NO: 1126198 - DNA, 22 bp, Artificial Sequence
  chemically synthesized
tctcaaaaatatgcaatggctc

SEQ ID NO: 1126199 - DNA, 22 bp, Artificial Sequence
  chemically synthesized
tcaaaaatatgcaatggctccc

SEQ ID NO: 1126200 - DNA, 22 bp, Artificial Sequence
  chemically synthesized
aaaaatatgcaatggctcccca

SEQ ID NO: 1126201 - DNA, 22 bp, Artificial Sequence
  chemically synthesized
aaccttctggtcatggggagcc

SEQ ID NO: 1126202 - DNA, 22 bp, Artificial Sequence
  chemically synthesized
aaaccttctggtcatggggagc

SEQ ID NO: 1126203 - DNA, 22 bp, Artificial Sequence
  chemically synthesized
aggcatgtagacttaaaccttc

SEQ ID NO: 1126204 - DNA, 22 bp, Artificial Sequence
  chemically synthesized
cccatgaccagaaggtttaagt

SEQ ID NO: 1126205 - DNA, 22 bp, Artificial Sequence
  chemically synthesized
aataaaagattaaggcatgtag

SEQ ID NO: 1126206 - DNA, 22 bp, Artificial Sequence
  chemically synthesized
aagtctacatgccttaatcttt

SEQ ID NO: 1126207 - DNA, 22 bp, Artificial Sequence
  chemically synthesized
agtctacatgccttaatctttt

SEQ ID NO: 1126208 - DNA, 22 bp, Artificial Sequence
  chemically synthesized
aaggtattcaataaaagattaa

SEQ ID NO: 1126209 - DNA, 22 bp, Artificial Sequence
  chemically synthesized
catgccttaatcttttattgaa

SEQ ID NO: 1126210 - DNA, 22 bp, Artificial Sequence
  chemically synthesized
ataataactaaaggtattcaat

SEQ ID NO: 1126211 - DNA, 22 bp, Artificial Sequence
  chemically synthesized
aatcttttattgaataccttta

SEQ ID NO: 1126212 - DNA, 22 bp, Artificial Sequence
  chemically synthesized
atcttttattgaatacctttag

SEQ ID NO: 1126213 - DNA, 22 bp, Artificial Sequence
  chemically synthesized
agttcataataactaaaggtat

SEQ ID NO: 1126214 - DNA, 22 bp, Artificial Sequence
  chemically synthesized
ttattgaatacctttagttatt

SEQ ID NO: 1126215 - DNA, 22 bp, Artificial Sequence
  chemically synthesized
tattgaatacctttagttatta

SEQ ID NO: 1126216 - DNA, 22 bp, Artificial Sequence
  chemically synthesized
attgaatacctttagttattat

SEQ ID NO: 1126217 - DNA, 22 bp, Artificial Sequence
  chemically synthesized
ttgaatacctttagttattatg

SEQ ID NO: 1126218 - DNA, 22 bp, Artificial Sequence
  chemically synthesized
aatacctttagttattatgaac

SEQ ID NO: 1126219 - DNA, 22 bp, Artificial Sequence
  chemically synthesized
aaaaggtaggttgagttcataa

SEQ ID NO: 1126220 - DNA, 22 bp, Artificial Sequence
  chemically synthesized
tagttattatgaactcaaccta

SEQ ID NO: 1126221 - DNA, 22 bp, Artificial Sequence
  chemically synthesized
agttattatgaactcaacctac

SEQ ID NO: 1126222 - DNA, 22 bp, Artificial Sequence
  chemically synthesized
gttattatgaactcaacctacc

SEQ ID NO: 1126223 - DNA, 22 bp, Artificial Sequence
  chemically synthesized
ttatgaactcaacctacctttt

SEQ ID NO: 1126224 - DNA, 22 bp, Artificial Sequence
  chemically synthesized
tgaactcaacctaccttttcaa

SEQ ID NO: 1126225 - DNA, 22 bp, Artificial Sequence
  chemically synthesized
gaagtaaggaatgaggttgaaa

SEQ ID NO: 1126226 - DNA, 22 bp, Artificial Sequence
  chemically synthesized
agaagtaaggaatgaggttgaa

SEQ ID NO: 1126227 - DNA, 22 bp, Artificial Sequence
  chemically synthesized
aacctaccttttcaacctcatt

SEQ ID NO: 1126228 - DNA, 22 bp, Artificial Sequence
  chemically synthesized
ccttttcaacctcattccttac

SEQ ID NO: 1126229 - DNA, 22 bp, Artificial Sequence
  chemically synthesized
ttcaacctcattccttacttct

SEQ ID NO: 1126230 - DNA, 22 bp, Artificial Sequence
  chemically synthesized
tcaacctcattccttacttcta

SEQ ID NO: 1126231 - DNA, 22 bp, Artificial Sequence
  chemically synthesized
caacctcattccttacttctaa

SEQ ID NO: 1126232 - DNA, 22 bp, Artificial Sequence
  chemically synthesized
aacctcattccttacttctaaa

SEQ ID NO: 1126233 - DNA, 22 bp, Artificial Sequence
  chemically synthesized
attccttacttctaaacttcct

SEQ ID NO: 1126234 - DNA, 22 bp, Artificial Sequence
  chemically synthesized
cttacttctaaacttcctttac

SEQ ID NO: 1126235 - DNA, 22 bp, Artificial Sequence
  chemically synthesized
acttctaaacttcctttacttc

SEQ ID NO: 1126236 - DNA, 22 bp, Artificial Sequence
  chemically synthesized
cagcagaagtatgaagtaaagg

SEQ ID NO: 1126237 - DNA, 22 bp, Artificial Sequence
  chemically synthesized
cttctaaacttcctttacttca

SEQ ID NO: 1126238 - DNA, 22 bp, Artificial Sequence
  chemically synthesized
ctaaacttcctttacttcatac

SEQ ID NO: 1126239 - DNA, 22 bp, Artificial Sequence
  chemically synthesized
cctccagcagaagtatgaagta

SEQ ID NO: 1126240 - DNA, 22 bp, Artificial Sequence
  chemically synthesized
taaacttcctttacttcatact

SEQ ID NO: 1126241 - DNA, 22 bp, Artificial Sequence
  chemically synthesized
gcctccagcagaagtatgaagt

SEQ ID NO: 1126242 - DNA, 22 bp, Artificial Sequence
  chemically synthesized
aacttcctttacttcatacttc

SEQ ID NO: 1126243 - DNA, 22 bp, Artificial Sequence
  chemically synthesized
tttgcctccagcagaagtatga

SEQ ID NO: 1126244 - DNA, 22 bp, Artificial Sequence
  chemically synthesized
gtttgcctccagcagaagtatg

SEQ ID NO: 1126245 - DNA, 22 bp, Artificial Sequence
  chemically synthesized
ttgtttgcctccagcagaagta

SEQ ID NO: 1126246 - DNA, 22 bp, Artificial Sequence
  chemically synthesized
cctttacttcatacttctgctg

SEQ ID NO: 1126247 - DNA, 22 bp, Artificial Sequence
  chemically synthesized
ctttacttcatacttctgctgg

SEQ ID NO: 1126248 - DNA, 22 bp, Artificial Sequence
  chemically synthesized
tacttcatacttctgctggagg

SEQ ID NO: 1126249 - DNA, 22 bp, Artificial Sequence
  chemically synthesized
acttcatacttctgctggaggc

SEQ ID NO: 1126250 - DNA, 22 bp, Artificial Sequence
  chemically synthesized
cttcatacttctgctggaggca

SEQ ID NO: 1126251 - DNA, 22 bp, Artificial Sequence
  chemically synthesized
agtattcttgtttgcctccagc

SEQ ID NO: 1126252 - DNA, 22 bp, Artificial Sequence
  chemically synthesized
catacttctgctggaggcaaac

SEQ ID NO: 1126253 - DNA, 22 bp, Artificial Sequence
  chemically synthesized
atacttctgctggaggcaaaca

SEQ ID NO: 1126254 - DNA, 22 bp, Artificial Sequence
  chemically synthesized
ctgctggaggcaaacaagaata

SEQ ID NO: 1126255 - DNA, 22 bp, Artificial Sequence
  chemically synthesized
catgggattaagtattcttgtt

SEQ ID NO: 1126256 - DNA, 22 bp, Artificial Sequence
  chemically synthesized
tgctggaggcaaacaagaatac

SEQ ID NO: 1126257 - DNA, 22 bp, Artificial Sequence
  chemically synthesized
acatgggattaagtattcttgt

SEQ ID NO: 1126258 - DNA, 22 bp, Artificial Sequence
  chemically synthesized
ctggaggcaaacaagaatactt

SEQ ID NO: 1126259 - DNA, 22 bp, Artificial Sequence
  chemically synthesized
gaggcaaacaagaatacttaat

SEQ ID NO: 1126260 - DNA, 22 bp, Artificial Sequence
  chemically synthesized
tatgcgaacaaaacttacatgg

SEQ ID NO: 1126261 - DNA, 22 bp, Artificial Sequence
  chemically synthesized
aatcccatgtaagttttgttcg

SEQ ID NO: 1126262 - DNA, 22 bp, Artificial Sequence
  chemically synthesized
atcccatgtaagttttgttcgc

SEQ ID NO: 1126263 - DNA, 22 bp, Artificial Sequence
  chemically synthesized
caggggaaagcctgtatgcgaa

SEQ ID NO: 1126264 - DNA, 22 bp, Artificial Sequence
  chemically synthesized
attgcaggggaaagcctgtatg

SEQ ID NO: 1126265 - DNA, 22 bp, Artificial Sequence
  chemically synthesized
tgttcgcatacaggctttcccc

SEQ ID NO: 1126266 - DNA, 22 bp, Artificial Sequence
  chemically synthesized
gttcgcatacaggctttcccct

SEQ ID NO: 1126267 - DNA, 22 bp, Artificial Sequence
  chemically synthesized
ttcgcatacaggctttcccctg

SEQ ID NO: 1126268 - DNA, 22 bp, Artificial Sequence
  chemically synthesized
gcatacaggctttcccctgcaa

SEQ ID NO: 1126269 - DNA, 22 bp, Artificial Sequence
  chemically synthesized
aagatgaggaaagtgacaattc

SEQ ID NO: 1126270 - DNA, 22 bp, Artificial Sequence
  chemically synthesized
tcccctgcaatgaattgtcact

SEQ ID NO: 1126271 - DNA, 22 bp, Artificial Sequence
  chemically synthesized
cccctgcaatgaattgtcactt

SEQ ID NO: 1126272 - DNA, 22 bp, Artificial Sequence
  chemically synthesized
ccctgcaatgaattgtcacttt

SEQ ID NO: 1126273 - DNA, 22 bp, Artificial Sequence
  chemically synthesized
ggctcaagatgaggaaagtgac

SEQ ID NO: 1126274 - DNA, 22 bp, Artificial Sequence
  chemically synthesized
caatgaattgtcactttcctca

SEQ ID NO: 1126275 - DNA, 22 bp, Artificial Sequence
  chemically synthesized
tcactttcctcatcttgagccc

SEQ ID NO: 1126276 - DNA, 22 bp, Artificial Sequence
  chemically synthesized
aagagtagggaagcattgggct

SEQ ID NO: 1126277 - DNA, 22 bp, Artificial Sequence
  chemically synthesized
tcctcatcttgagcccaatgct

SEQ ID NO: 1126278 - DNA, 22 bp, Artificial Sequence
  chemically synthesized
cctcatcttgagcccaatgctt

SEQ ID NO: 1126279 - DNA, 22 bp, Artificial Sequence
  chemically synthesized
ctcatcttgagcccaatgcttc

SEQ ID NO: 1126280 - DNA, 22 bp, Artificial Sequence
  chemically synthesized
atcttgagcccaatgcttccct

SEQ ID NO: 1126281 - DNA, 22 bp, Artificial Sequence
  chemically synthesized
gataattaaagagtagggaagc

SEQ ID NO: 1126282 - DNA, 22 bp, Artificial Sequence
  chemically synthesized
gagcccaatgcttccctactct

SEQ ID NO: 1126283 - DNA, 22 bp, Artificial Sequence
  chemically synthesized
agcccaatgcttccctactctt

SEQ ID NO: 1126284 - DNA, 22 bp, Artificial Sequence
  chemically synthesized
actggataattaaagagtaggg

SEQ ID NO: 1126285 - DNA, 22 bp, Artificial Sequence
  chemically synthesized
gcatctgactggataattaaag

SEQ ID NO: 1126286 - DNA, 22 bp, Artificial Sequence
  chemically synthesized
ccctactctttaattatccagt

SEQ ID NO: 1126287 - DNA, 22 bp, Artificial Sequence
  chemically synthesized
cctactctttaattatccagtc

SEQ ID NO: 1126288 - DNA, 22 bp, Artificial Sequence
  chemically synthesized
ctctttaattatccagtcagat

SEQ ID NO: 1126289 - DNA, 22 bp, Artificial Sequence
  chemically synthesized
tgggaaaattagcatctgactg

SEQ ID NO: 1126290 - DNA, 22 bp, Artificial Sequence
  chemically synthesized
atgggaaaattagcatctgact

SEQ ID NO: 1126291 - DNA, 22 bp, Artificial Sequence
  chemically synthesized
tttaattatccagtcagatgct

SEQ ID NO: 1126292 - DNA, 22 bp, Artificial Sequence
  chemically synthesized
taattatccagtcagatgctaa

SEQ ID NO: 1126293 - DNA, 22 bp, Artificial Sequence
  chemically synthesized
aattatccagtcagatgctaat

SEQ ID NO: 1126294 - DNA, 22 bp, Artificial Sequence
  chemically synthesized
attatccagtcagatgctaatt

SEQ ID NO: 1126295 - DNA, 22 bp, Artificial Sequence
  chemically synthesized
tccagtcagatgctaattttcc

SEQ ID NO: 1126296 - DNA, 22 bp, Artificial Sequence
  chemically synthesized
agaggcatggaagacttatggg

SEQ ID NO: 1126297 - DNA, 22 bp, Artificial Sequence
  chemically synthesized
gagaggcatggaagacttatgg

SEQ ID NO: 1126298 - DNA, 22 bp, Artificial Sequence
  chemically synthesized
cttgagaggcatggaagactta

SEQ ID NO: 1126299 - DNA, 22 bp, Artificial Sequence
  chemically synthesized
attttcccataagtcttccatg

SEQ ID NO: 1126300 - DNA, 22 bp, Artificial Sequence
  chemically synthesized
ctgcttgagaggcatggaagac

SEQ ID NO: 1126301 - DNA, 22 bp, Artificial Sequence
  chemically synthesized
cctgcttgagaggcatggaaga

SEQ ID NO: 1126302 - DNA, 22 bp, Artificial Sequence
  chemically synthesized
tcccataagtcttccatgcctc

SEQ ID NO: 1126303 - DNA, 22 bp, Artificial Sequence
  chemically synthesized
cccataagtcttccatgcctct

SEQ ID NO: 1126304 - DNA, 22 bp, Artificial Sequence
  chemically synthesized
acttcctgcttgagaggcatgg

SEQ ID NO: 1126305 - DNA, 22 bp, Artificial Sequence
  chemically synthesized
ccataagtcttccatgcctctc

SEQ ID NO: 1126306 - DNA, 22 bp, Artificial Sequence
  chemically synthesized
ccatgcctctcaagcaggaagt

SEQ ID NO: 1126307 - DNA, 22 bp, Artificial Sequence
  chemically synthesized
catgcctctcaagcaggaagtg

SEQ ID NO: 1126308 - DNA, 22 bp, Artificial Sequence
  chemically synthesized
aggaagaaaagttcacttcctg

SEQ ID NO: 1126309 - DNA, 22 bp, Artificial Sequence
  chemically synthesized
aaggaagaaaagttcacttcct

SEQ ID NO: 1126310 - DNA, 22 bp, Artificial Sequence
  chemically synthesized
taaggaagaaaagttcacttcc

SEQ ID NO: 1126311 - DNA, 22 bp, Artificial Sequence
  chemically synthesized
tcaagcaggaagtgaacttttc

SEQ ID NO: 1126312 - DNA, 22 bp, Artificial Sequence
  chemically synthesized
aagcaggaagtgaacttttctt

SEQ ID NO: 1126313 - DNA, 22 bp, Artificial Sequence
  chemically synthesized
gaaaagttttaaggaagaaaag

SEQ ID NO: 1126314 - DNA, 22 bp, Artificial Sequence
  chemically synthesized
ataaaatgttagaaaagtttta

SEQ ID NO: 1126315 - DNA, 22 bp, Artificial Sequence
  chemically synthesized
ttcttccttaaaacttttctaa

SEQ ID NO: 1126316 - DNA, 22 bp, Artificial Sequence
  chemically synthesized
tcttccttaaaacttttctaac

SEQ ID NO: 1126317 - DNA, 22 bp, Artificial Sequence
  chemically synthesized
cttccttaaaacttttctaaca

SEQ ID NO: 1126318 - DNA, 22 bp, Artificial Sequence
  chemically synthesized
ttccttaaaacttttctaacat

SEQ ID NO: 1126319 - DNA, 22 bp, Artificial Sequence
  chemically synthesized
ccttaaaacttttctaacattt

SEQ ID NO: 1126320 - DNA, 22 bp, Artificial Sequence
  chemically synthesized
cttaaaacttttctaacatttt

SEQ ID NO: 1126321 - DNA, 22 bp, Artificial Sequence
  chemically synthesized
aaaacttttctaacattttatt

SEQ ID NO: 1126322 - DNA, 22 bp, Artificial Sequence
  chemically synthesized
aaacttttctaacattttatta

SEQ ID NO: 1126323 - DNA, 22 bp, Artificial Sequence
  chemically synthesized
tcatgaagaagtactaataaaa

SEQ ID NO: 1126324 - DNA, 22 bp, Artificial Sequence
  chemically synthesized
ttctaacattttattagtactt

SEQ ID NO: 1126325 - DNA, 22 bp, Artificial Sequence
  chemically synthesized
tctaacattttattagtacttc

SEQ ID NO: 1126326 - DNA, 22 bp, Artificial Sequence
  chemically synthesized
ctaacattttattagtacttct

SEQ ID NO: 1126327 - DNA, 22 bp, Artificial Sequence
  chemically synthesized
taacattttattagtacttctt

SEQ ID NO: 1126328 - DNA, 22 bp, Artificial Sequence
  chemically synthesized
acattttattagtacttcttca

SEQ ID NO: 1126329 - DNA, 22 bp, Artificial Sequence
  chemically synthesized
tattagtacttcttcatgacag

SEQ ID NO: 1126330 - DNA, 22 bp, Artificial Sequence
  chemically synthesized
attagtacttcttcatgacagt

SEQ ID NO: 1126331 - DNA, 22 bp, Artificial Sequence
  chemically synthesized
cacccagcataaactgtcatga

SEQ ID NO: 1126332 - DNA, 22 bp, Artificial Sequence
  chemically synthesized
ttagtacttcttcatgacagtt

SEQ ID NO: 1126333 - DNA, 22 bp, Artificial Sequence
  chemically synthesized
gcacccagcataaactgtcatg

SEQ ID NO: 1126334 - DNA, 22 bp, Artificial Sequence
  chemically synthesized
gtacttcttcatgacagtttat

SEQ ID NO: 1126335 - DNA, 22 bp, Artificial Sequence
  chemically synthesized
cttcatgacagtttatgctggg

SEQ ID NO: 1126336 - DNA, 22 bp, Artificial Sequence
  chemically synthesized
aggaagcttgcacccagcataa

SEQ ID NO: 1126337 - DNA, 22 bp, Artificial Sequence
  chemically synthesized
ttcatgacagtttatgctgggt

SEQ ID NO: 1126338 - DNA, 22 bp, Artificial Sequence
  chemically synthesized
catgacagtttatgctgggtgc

SEQ ID NO: 1126339 - DNA, 22 bp, Artificial Sequence
  chemically synthesized
atgacagtttatgctgggtgca

SEQ ID NO: 1126340 - DNA, 22 bp, Artificial Sequence
  chemically synthesized
cctcaggaagcttgcacccagc

SEQ ID NO: 1126341 - DNA, 22 bp, Artificial Sequence
  chemically synthesized
ccctcaggaagcttgcacccag

SEQ ID NO: 1126342 - DNA, 22 bp, Artificial Sequence
  chemically synthesized
tccctcaggaagcttgcaccca

SEQ ID NO: 1126343 - DNA, 22 bp, Artificial Sequence
  chemically synthesized
agctttccctcaggaagcttgc

SEQ ID NO: 1126344 - DNA, 22 bp, Artificial Sequence
  chemically synthesized
atgctgggtgcaagcttcctga

SEQ ID NO: 1126345 - DNA, 22 bp, Artificial Sequence
  chemically synthesized
tgctgggtgcaagcttcctgag

SEQ ID NO: 1126346 - DNA, 22 bp, Artificial Sequence
  chemically synthesized
taaatctaagctttccctcagg

SEQ ID NO: 1126347 - DNA, 22 bp, Artificial Sequence
  chemically synthesized
ggtgcaagcttcctgagggaaa

SEQ ID NO: 1126348 - DNA, 22 bp, Artificial Sequence
  chemically synthesized
actgtaaatctaagctttccct

SEQ ID NO: 1126349 - DNA, 22 bp, Artificial Sequence
  chemically synthesized
aactgtaaatctaagctttccc

SEQ ID NO: 1126350 - DNA, 22 bp, Artificial Sequence
  chemically synthesized
taactgtaaatctaagctttcc

SEQ ID NO: 1126351 - DNA, 22 bp, Artificial Sequence
  chemically synthesized
ctttaactgtaaatctaagctt

SEQ ID NO: 1126352 - DNA, 22 bp, Artificial Sequence
  chemically synthesized
cctgagggaaagcttagattta

SEQ ID NO: 1126353 - DNA, 22 bp, Artificial Sequence
  chemically synthesized
ctgagggaaagcttagatttac

SEQ ID NO: 1126354 - DNA, 22 bp, Artificial Sequence
  chemically synthesized
cagttactttaactgtaaatct

SEQ ID NO: 1126355 - DNA, 22 bp, Artificial Sequence
  chemically synthesized
agggaaagcttagatttacagt

SEQ ID NO: 1126356 - DNA, 22 bp, Artificial Sequence
  chemically synthesized
agatttacagttaaagtaactg

SEQ ID NO: 1126357 - DNA, 22 bp, Artificial Sequence
  chemically synthesized
gatttacagttaaagtaactgg

SEQ ID NO: 1126358 - DNA, 22 bp, Artificial Sequence
  chemically synthesized
tggtatgtaaaacactccagtt

SEQ ID NO: 1126359 - DNA, 22 bp, Artificial Sequence
  chemically synthesized
acagttaaagtaactggagtgt

SEQ ID NO: 1126360 - DNA, 22 bp, Artificial Sequence
  chemically synthesized
cagttaaagtaactggagtgtt

SEQ ID NO: 1126361 - DNA, 22 bp, Artificial Sequence
  chemically synthesized
ctatggtatgtaaaacactcca

SEQ ID NO: 1126362 - DNA, 22 bp, Artificial Sequence
  chemically synthesized
aagtaactggagtgttttacat

SEQ ID NO: 1126363 - DNA, 22 bp, Artificial Sequence
  chemically synthesized
atggattgctatggtatgtaaa

SEQ ID NO: 1126364 - DNA, 22 bp, Artificial Sequence
  chemically synthesized
gagtgttttacataccatagca

SEQ ID NO: 1126365 - DNA, 22 bp, Artificial Sequence
  chemically synthesized
atatctaatggattgctatggt

SEQ ID NO: 1126366 - DNA, 22 bp, Artificial Sequence
  chemically synthesized
aactaatatctaatggattgct

SEQ ID NO: 1126367 - DNA, 22 bp, Artificial Sequence
  chemically synthesized
tacataccatagcaatccatta

SEQ ID NO: 1126368 - DNA, 22 bp, Artificial Sequence
  chemically synthesized
acataccatagcaatccattag

SEQ ID NO: 1126369 - DNA, 22 bp, Artificial Sequence
  chemically synthesized
cataccatagcaatccattaga

SEQ ID NO: 1126370 - DNA, 22 bp, Artificial Sequence
  chemically synthesized
actcaactaatatctaatggat

SEQ ID NO: 1126371 - DNA, 22 bp, Artificial Sequence
  chemically synthesized
ttcactcaactaatatctaatg

SEQ ID NO: 1126372 - DNA, 22 bp, Artificial Sequence
  chemically synthesized
ctattcactcaactaatatcta

SEQ ID NO: 1126373 - DNA, 22 bp, Artificial Sequence
  chemically synthesized
cctattcactcaactaatatct

SEQ ID NO: 1126374 - DNA, 22 bp, Artificial Sequence
  chemically synthesized
tcctattcactcaactaatatc

SEQ ID NO: 1126375 - DNA, 22 bp, Artificial Sequence
  chemically synthesized
attttcctattcactcaactaa

SEQ ID NO: 1126376 - DNA, 22 bp, Artificial Sequence
  chemically synthesized
atgctaattttcctattcactc

SEQ ID NO: 1126377 - DNA, 22 bp, Artificial Sequence
  chemically synthesized
catgctaattttcctattcact

SEQ ID NO: 1126378 - DNA, 22 bp, Artificial Sequence
  chemically synthesized
gatattagttgagtgaatagga

SEQ ID NO: 1126379 - DNA, 22 bp, Artificial Sequence
  chemically synthesized
tcatgctaattttcctattcac

SEQ ID NO: 1126380 - DNA, 22 bp, Artificial Sequence
  chemically synthesized
gttttcatgctaattttcctat

SEQ ID NO: 1126381 - DNA, 22 bp, Artificial Sequence
  chemically synthesized
gttgagtgaataggaaaattag

SEQ ID NO: 1126382 - DNA, 22 bp, Artificial Sequence
  chemically synthesized
agtgaataggaaaattagcatg

SEQ ID NO: 1126383 - DNA, 22 bp, Artificial Sequence
  chemically synthesized
gcatgaaaactaatgttgctgt

SEQ ID NO: 1126384 - DNA, 22 bp, Artificial Sequence
  chemically synthesized
aagaaagaagagacagcaacat

SEQ ID NO: 1126385 - DNA, 22 bp, Artificial Sequence
  chemically synthesized
caagaaagaagagacagcaaca

SEQ ID NO: 1126386 - DNA, 22 bp, Artificial Sequence
  chemically synthesized
atgttgctgtctcttctttctt

SEQ ID NO: 1126387 - DNA, 22 bp, Artificial Sequence
  chemically synthesized
tgagtccacatcatttcaagaa

SEQ ID NO: 1126388 - DNA, 22 bp, Artificial Sequence
  chemically synthesized
ctgtctcttctttcttgaaatg

SEQ ID NO: 1126389 - DNA, 22 bp, Artificial Sequence
  chemically synthesized
tctcttctttcttgaaatgatg

SEQ ID NO: 1126390 - DNA, 22 bp, Artificial Sequence
  chemically synthesized
ttctttcttgaaatgatgtgga

SEQ ID NO: 1126391 - DNA, 22 bp, Artificial Sequence
  chemically synthesized
tagtcattatgagtccacatca

SEQ ID NO: 1126392 - DNA, 22 bp, Artificial Sequence
  chemically synthesized
ctttcttgaaatgatgtggact

SEQ ID NO: 1126393 - DNA, 22 bp, Artificial Sequence
  chemically synthesized
tttcttgaaatgatgtggactc

SEQ ID NO: 1126394 - DNA, 22 bp, Artificial Sequence
  chemically synthesized
tgtagtcattatgagtccacat

SEQ ID NO: 1126395 - DNA, 22 bp, Artificial Sequence
  chemically synthesized
ctgtagtcattatgagtccaca

SEQ ID NO: 1126396 - DNA, 22 bp, Artificial Sequence
  chemically synthesized
tcttgaaatgatgtggactcat

SEQ ID NO: 1126397 - DNA, 22 bp, Artificial Sequence
  chemically synthesized
cttgaaatgatgtggactcata

SEQ ID NO: 1126398 - DNA, 22 bp, Artificial Sequence
  chemically synthesized
ttgaaatgatgtggactcataa

SEQ ID NO: 1126399 - DNA, 22 bp, Artificial Sequence
  chemically synthesized
gaaatgatgtggactcataatg

SEQ ID NO: 1126400 - DNA, 22 bp, Artificial Sequence
  chemically synthesized
aaatgatgtggactcataatga

SEQ ID NO: 1126401 - DNA, 22 bp, Artificial Sequence
  chemically synthesized
aacacttctgtagtcattatga

SEQ ID NO: 1126402 - DNA, 22 bp, Artificial Sequence
  chemically synthesized
gaacacttctgtagtcattatg

SEQ ID NO: 1126403 - DNA, 22 bp, Artificial Sequence
  chemically synthesized
tgaacacttctgtagtcattat

SEQ ID NO: 1126404 - DNA, 22 bp, Artificial Sequence
  chemically synthesized
tttgaacacttctgtagtcatt

SEQ ID NO: 1126405 - DNA, 22 bp, Artificial Sequence
  chemically synthesized
ctttgaacacttctgtagtcat

SEQ ID NO: 1126406 - DNA, 22 bp, Artificial Sequence
  chemically synthesized
ataatgactacagaagtgttca

SEQ ID NO: 1126407 - DNA, 22 bp, Artificial Sequence
  chemically synthesized
cagaagtgttcaaagaaaccca

SEQ ID NO: 1126408 - DNA, 22 bp, Artificial Sequence
  chemically synthesized
aaagaaacccaccatgcattgg

SEQ ID NO: 1126409 - DNA, 22 bp, Artificial Sequence
  chemically synthesized
ccacagggtccaagtcatcatc

SEQ ID NO: 1126410 - DNA, 22 bp, Artificial Sequence
  chemically synthesized
cctcccacagggtccaagtcat

SEQ ID NO: 1126411 - DNA, 22 bp, Artificial Sequence
  chemically synthesized
aattgcctcccacagggtccaa

SEQ ID NO: 1126412 - DNA, 22 bp, Artificial Sequence
  chemically synthesized
aaattgcctcccacagggtcca

SEQ ID NO: 1126413 - DNA, 22 bp, Artificial Sequence
  chemically synthesized
gatgatgacttggaccctgtgg

SEQ ID NO: 1126414 - DNA, 22 bp, Artificial Sequence
  chemically synthesized
aagtttaaattgcctcccacag

SEQ ID NO: 1126415 - DNA, 22 bp, Artificial Sequence
  chemically synthesized
aaagtttaaattgcctcccaca

SEQ ID NO: 1126416 - DNA, 22 bp, Artificial Sequence
  chemically synthesized
ggaccctgtgggaggcaattta

SEQ ID NO: 1126417 - DNA, 22 bp, Artificial Sequence
  chemically synthesized
gaccctgtgggaggcaatttaa

SEQ ID NO: 1126418 - DNA, 22 bp, Artificial Sequence
  chemically synthesized
agagagtttaaagtttaaattg

SEQ ID NO: 1126419 - DNA, 22 bp, Artificial Sequence
  chemically synthesized
tgggaggcaatttaaactttaa

SEQ ID NO: 1126420 - DNA, 22 bp, Artificial Sequence
  chemically synthesized
acactgagagagtttaaagttt

SEQ ID NO: 1126421 - DNA, 22 bp, Artificial Sequence
  chemically synthesized
cacactgagagagtttaaagtt

SEQ ID NO: 1126422 - DNA, 22 bp, Artificial Sequence
  chemically synthesized
tcacactgagagagtttaaagt

SEQ ID NO: 1126423 - DNA, 22 bp, Artificial Sequence
  chemically synthesized
aaggacctttcacactgagaga

SEQ ID NO: 1126424 - DNA, 22 bp, Artificial Sequence
  chemically synthesized
aaactttaaactctctcagtgt

SEQ ID NO: 1126425 - DNA, 22 bp, Artificial Sequence
  chemically synthesized
aactttaaactctctcagtgtg

SEQ ID NO: 1126426 - DNA, 22 bp, Artificial Sequence
  chemically synthesized
aactcaaggacctttcacactg

SEQ ID NO: 1126427 - DNA, 22 bp, Artificial Sequence
  chemically synthesized
aaactcaaggacctttcacact

SEQ ID NO: 1126428 - DNA, 22 bp, Artificial Sequence
  chemically synthesized
taaactctctcagtgtgaaagg

SEQ ID NO: 1126429 - DNA, 22 bp, Artificial Sequence
  chemically synthesized
aaactctctcagtgtgaaaggt

SEQ ID NO: 1126430 - DNA, 22 bp, Artificial Sequence
  chemically synthesized
ttaaactcaaggacctttcaca

SEQ ID NO: 1126431 - DNA, 22 bp, Artificial Sequence
  chemically synthesized
aactctctcagtgtgaaaggtc

SEQ ID NO: 1126432 - DNA, 22 bp, Artificial Sequence
  chemically synthesized
tcttaaactcaaggacctttca

SEQ ID NO: 1126433 - DNA, 22 bp, Artificial Sequence
  chemically synthesized
ctcttaaactcaaggacctttc

SEQ ID NO: 1126434 - DNA, 22 bp, Artificial Sequence
  chemically synthesized
tctcagtgtgaaaggtccttga

SEQ ID NO: 1126435 - DNA, 22 bp, Artificial Sequence
  chemically synthesized
acttctcttaaactcaaggacc

SEQ ID NO: 1126436 - DNA, 22 bp, Artificial Sequence
  chemically synthesized
tcagtgtgaaaggtccttgagt

SEQ ID NO: 1126437 - DNA, 22 bp, Artificial Sequence
  chemically synthesized
agtgtgaaaggtccttgagttt

SEQ ID NO: 1126438 - DNA, 22 bp, Artificial Sequence
  chemically synthesized
gagtttaagagaagtcaacatg

SEQ ID NO: 1126439 - DNA, 22 bp, Artificial Sequence
  chemically synthesized
agtttaagagaagtcaacatgc

SEQ ID NO: 1126440 - DNA, 22 bp, Artificial Sequence
  chemically synthesized
aaagacccacaagcatgttgac

SEQ ID NO: 1126441 - DNA, 22 bp, Artificial Sequence
  chemically synthesized
gaaagacccacaagcatgttga

SEQ ID NO: 1126442 - DNA, 22 bp, Artificial Sequence
  chemically synthesized
aagagaagtcaacatgcttgtg

SEQ ID NO: 1126443 - DNA, 22 bp, Artificial Sequence
  chemically synthesized
agagaagtcaacatgcttgtgg

SEQ ID NO: 1126444 - DNA, 22 bp, Artificial Sequence
  chemically synthesized
aacttgaaagacccacaagcat

SEQ ID NO: 1126445 - DNA, 22 bp, Artificial Sequence
  chemically synthesized
aaacttgaaagacccacaagca

SEQ ID NO: 1126446 - DNA, 22 bp, Artificial Sequence
  chemically synthesized
tttaaacttgaaagacccacaa

SEQ ID NO: 1126447 - DNA, 22 bp, Artificial Sequence
  chemically synthesized
gaagttatttaaacttgaaaga

SEQ ID NO: 1126448 - DNA, 22 bp, Artificial Sequence
  chemically synthesized
gtgggtctttcaagtttaaata

SEQ ID NO: 1126449 - DNA, 22 bp, Artificial Sequence
  chemically synthesized
tgggtctttcaagtttaaataa

SEQ ID NO: 1126450 - DNA, 22 bp, Artificial Sequence
  chemically synthesized
gaacccgggttggaagttattt

SEQ ID NO: 1126451 - DNA, 22 bp, Artificial Sequence
  chemically synthesized
ggaacccgggttggaagttatt

SEQ ID NO: 1126452 - DNA, 22 bp, Artificial Sequence
  chemically synthesized
tggaacccgggttggaagttat

SEQ ID NO: 1126453 - DNA, 22 bp, Artificial Sequence
  chemically synthesized
ttggaacccgggttggaagtta

SEQ ID NO: 1126454 - DNA, 22 bp, Artificial Sequence
  chemically synthesized
tcaagtttaaataacttccaac

SEQ ID NO: 1126455 - DNA, 22 bp, Artificial Sequence
  chemically synthesized
caagtttaaataacttccaacc

SEQ ID NO: 1126456 - DNA, 22 bp, Artificial Sequence
  chemically synthesized
aagtttaaataacttccaaccc

SEQ ID NO: 1126457 - DNA, 22 bp, Artificial Sequence
  chemically synthesized
gatccttttggaacccgggttg

SEQ ID NO: 1126458 - DNA, 22 bp, Artificial Sequence
  chemically synthesized
aaataacttccaacccgggttc

SEQ ID NO: 1126459 - DNA, 22 bp, Artificial Sequence
  chemically synthesized
aataacttccaacccgggttcc

SEQ ID NO: 1126460 - DNA, 22 bp, Artificial Sequence
  chemically synthesized
cactagatccttttggaacccg

SEQ ID NO: 1126461 - DNA, 22 bp, Artificial Sequence
  chemically synthesized
ccaacccgggttccaaaaggat

SEQ ID NO: 1126462 - DNA, 22 bp, Artificial Sequence
  chemically synthesized
caacccgggttccaaaaggatc

SEQ ID NO: 1126463 - DNA, 22 bp, Artificial Sequence
  chemically synthesized
cacattgcactagatccttttg

SEQ ID NO: 1126464 - DNA, 22 bp, Artificial Sequence
  chemically synthesized
ccacattgcactagatcctttt

SEQ ID NO: 1126465 - DNA, 22 bp, Artificial Sequence
  chemically synthesized
tccacattgcactagatccttt

SEQ ID NO: 1126466 - DNA, 22 bp, Artificial Sequence
  chemically synthesized
aaatggctttccacattgcact

SEQ ID NO: 1126467 - DNA, 22 bp, Artificial Sequence
  chemically synthesized
caaaaggatctagtgcaatgtg

SEQ ID NO: 1126468 - DNA, 22 bp, Artificial Sequence
  chemically synthesized
gtgcaatgtggaaagccatttc

SEQ ID NO: 1126469 - DNA, 22 bp, Artificial Sequence
  chemically synthesized
agtacacgtcagattgaaatgg

SEQ ID NO: 1126470 - DNA, 22 bp, Artificial Sequence
  chemically synthesized
gcagtggggcattaagtacacg

SEQ ID NO: 1126471 - DNA, 22 bp, Artificial Sequence
  chemically synthesized
caatctgacgtgtacttaatgc

SEQ ID NO: 1126472 - DNA, 22 bp, Artificial Sequence
  chemically synthesized
aatctgacgtgtacttaatgcc

SEQ ID NO: 1126473 - DNA, 22 bp, Artificial Sequence
  chemically synthesized
acgtgtacttaatgccccactg

SEQ ID NO: 1126474 - DNA, 22 bp, Artificial Sequence
  chemically synthesized
aaacaggtcatgatgctggcag

SEQ ID NO: 1126475 - DNA, 22 bp, Artificial Sequence
  chemically synthesized
aatgccccactgccagcatcat

SEQ ID NO: 1126476 - DNA, 22 bp, Artificial Sequence
  chemically synthesized
atgccccactgccagcatcatg

SEQ ID NO: 1126477 - DNA, 22 bp, Artificial Sequence
  chemically synthesized
ccagcatcatgacctgtttcaa

SEQ ID NO: 1126478 - DNA, 22 bp, Artificial Sequence
  chemically synthesized
acacagtagatggattgaaaca

SEQ ID NO: 1126479 - DNA, 22 bp, Artificial Sequence
  chemically synthesized
ctaacacagtagatggattgaa

SEQ ID NO: 1126480 - DNA, 22 bp, Artificial Sequence
  chemically synthesized
actaacacagtagatggattga

SEQ ID NO: 1126481 - DNA, 22 bp, Artificial Sequence
  chemically synthesized
tttcaatccatctactgtgtta

SEQ ID NO: 1126482 - DNA, 22 bp, Artificial Sequence
  chemically synthesized
atagtgatgcttactaacacag

SEQ ID NO: 1126483 - DNA, 22 bp, Artificial Sequence
  chemically synthesized
caatccatctactgtgttagta

SEQ ID NO: 1126484 - DNA, 22 bp, Artificial Sequence
  chemically synthesized
aatccatctactgtgttagtaa

SEQ ID NO: 1126485 - DNA, 22 bp, Artificial Sequence
  chemically synthesized
aagttcatagtgatgcttacta

SEQ ID NO: 1126486 - DNA, 22 bp, Artificial Sequence
  chemically synthesized
actaaagttcatagtgatgctt

SEQ ID NO: 1126487 - DNA, 22 bp, Artificial Sequence
  chemically synthesized
gactaaagttcatagtgatgct

SEQ ID NO: 1126488 - DNA, 22 bp, Artificial Sequence
  chemically synthesized
ctgtgttagtaagcatcactat

SEQ ID NO: 1126489 - DNA, 22 bp, Artificial Sequence
  chemically synthesized
tgactaaagttcatagtgatgc

SEQ ID NO: 1126490 - DNA, 22 bp, Artificial Sequence
  chemically synthesized
tgttagtaagcatcactatgaa

SEQ ID NO: 1126491 - DNA, 22 bp, Artificial Sequence
  chemically synthesized
ttttgactaaagttcatagtga

SEQ ID NO: 1126492 - DNA, 22 bp, Artificial Sequence
  chemically synthesized
tgttttgactaaagttcatagt

SEQ ID NO: 1126493 - DNA, 22 bp, Artificial Sequence
  chemically synthesized
ctgttttgactaaagttcatag

SEQ ID NO: 1126494 - DNA, 22 bp, Artificial Sequence
  chemically synthesized
gtaagcatcactatgaacttta

SEQ ID NO: 1126495 - DNA, 22 bp, Artificial Sequence
  chemically synthesized
cttctgttttgactaaagttca

SEQ ID NO: 1126496 - DNA, 22 bp, Artificial Sequence
  chemically synthesized
tgaactttagtcaaaacagaag

SEQ ID NO: 1126497 - DNA, 22 bp, Artificial Sequence
  chemically synthesized
agcaatgagtattacttctgtt

SEQ ID NO: 1126498 - DNA, 22 bp, Artificial Sequence
  chemically synthesized
ttaagcaatgagtattacttct

SEQ ID NO: 1126499 - DNA, 22 bp, Artificial Sequence
  chemically synthesized
gttaagcaatgagtattacttc

SEQ ID NO: 1126500 - DNA, 22 bp, Artificial Sequence
  chemically synthesized
tagtcaaaacagaagtaatact

SEQ ID NO: 1126501 - DNA, 22 bp, Artificial Sequence
  chemically synthesized
tgttaagcaatgagtattactt

SEQ ID NO: 1126502 - DNA, 22 bp, Artificial Sequence
  chemically synthesized
agtcaaaacagaagtaatactc

SEQ ID NO: 1126503 - DNA, 22 bp, Artificial Sequence
  chemically synthesized
gtcaaaacagaagtaatactca

SEQ ID NO: 1126504 - DNA, 22 bp, Artificial Sequence
  chemically synthesized
aaaaccggctttgttaagcaat

SEQ ID NO: 1126505 - DNA, 22 bp, Artificial Sequence
  chemically synthesized
actaaaaaccggctttgttaag

SEQ ID NO: 1126506 - DNA, 22 bp, Artificial Sequence
  chemically synthesized
gctgactaaaaaccggctttgt

SEQ ID NO: 1126507 - DNA, 22 bp, Artificial Sequence
  chemically synthesized
attgcttaacaaagccggtttt

SEQ ID NO: 1126508 - DNA, 22 bp, Artificial Sequence
  chemically synthesized
cttaacaaagccggtttttagt

SEQ ID NO: 1126509 - DNA, 22 bp, Artificial Sequence
  chemically synthesized
aacaaagccggtttttagtcag

SEQ ID NO: 1126510 - DNA, 22 bp, Artificial Sequence
  chemically synthesized
tgtaagtgctagctgactaaaa

SEQ ID NO: 1126511 - DNA, 22 bp, Artificial Sequence
  chemically synthesized
acaaagccggtttttagtcagc

SEQ ID NO: 1126512 - DNA, 22 bp, Artificial Sequence
  chemically synthesized
ttatgtaagtgctagctgacta

SEQ ID NO: 1126513 - DNA, 22 bp, Artificial Sequence
  chemically synthesized
gttatgtaagtgctagctgact

SEQ ID NO: 1126514 - DNA, 22 bp, Artificial Sequence
  chemically synthesized
tgttatgtaagtgctagctgac

SEQ ID NO: 1126515 - DNA, 22 bp, Artificial Sequence
  chemically synthesized
tggtattttgttatgtaagtgc

SEQ ID NO: 1126516 - DNA, 22 bp, Artificial Sequence
  chemically synthesized
ttagtcagctagcacttacata

SEQ ID NO: 1126517 - DNA, 22 bp, Artificial Sequence
  chemically synthesized
tagtcagctagcacttacataa

SEQ ID NO: 1126518 - DNA, 22 bp, Artificial Sequence
  chemically synthesized
agtcagctagcacttacataac

SEQ ID NO: 1126519 - DNA, 22 bp, Artificial Sequence
  chemically synthesized
gtcagctagcacttacataaca

SEQ ID NO: 1126520 - DNA, 22 bp, Artificial Sequence
  chemically synthesized
gcacttacataacaaaatacca

SEQ ID NO: 1126521 - DNA, 22 bp, Artificial Sequence
  chemically synthesized
agccacccagtctatggtattt

SEQ ID NO: 1126522 - DNA, 22 bp, Artificial Sequence
  chemically synthesized
acataacaaaataccatagact

SEQ ID NO: 1126523 - DNA, 22 bp, Artificial Sequence
  chemically synthesized
gttaagccacccagtctatggt

SEQ ID NO: 1126524 - DNA, 22 bp, Artificial Sequence
  chemically synthesized
cataacaaaataccatagactg

SEQ ID NO: 1126525 - DNA, 22 bp, Artificial Sequence
  chemically synthesized
ttggttaagccacccagtctat

SEQ ID NO: 1126526 - DNA, 22 bp, Artificial Sequence
  chemically synthesized
cgagaaataagtggctgttggt

SEQ ID NO: 1126527 - DNA, 22 bp, Artificial Sequence
  chemically synthesized
ggtggcttaaccaacagccact

SEQ ID NO: 1126528 - DNA, 22 bp, Artificial Sequence
  chemically synthesized
tagaactgcgagaaataagtgg

SEQ ID NO: 1126529 - DNA, 22 bp, Artificial Sequence
  chemically synthesized
aaccaacagccacttatttctc

SEQ ID NO: 1126530 - DNA, 22 bp, Artificial Sequence
  chemically synthesized
accaacagccacttatttctcg

SEQ ID NO: 1126531 - DNA, 22 bp, Artificial Sequence
  chemically synthesized
tagcctatagaactgcgagaaa

SEQ ID NO: 1126532 - DNA, 22 bp, Artificial Sequence
  chemically synthesized
gaattgtagcctatagaactgc

SEQ ID NO: 1126533 - DNA, 22 bp, Artificial Sequence
  chemically synthesized
ggaattgtagcctatagaactg

SEQ ID NO: 1126534 - DNA, 22 bp, Artificial Sequence
  chemically synthesized
tggaattgtagcctatagaact

SEQ ID NO: 1126535 - DNA, 22 bp, Artificial Sequence
  chemically synthesized
atttctcgcagttctataggct

SEQ ID NO: 1126536 - DNA, 22 bp, Artificial Sequence
  chemically synthesized
tttctcgcagttctataggcta

SEQ ID NO: 1126537 - DNA, 22 bp, Artificial Sequence
  chemically synthesized
attttggaattgtagcctatag

SEQ ID NO: 1126538 - DNA, 22 bp, Artificial Sequence
  chemically synthesized
aattttggaattgtagcctata

SEQ ID NO: 1126539 - DNA, 22 bp, Artificial Sequence
  chemically synthesized
ctcgcagttctataggctacaa

SEQ ID NO: 1126540 - DNA, 22 bp, Artificial Sequence
  chemically synthesized
tcgcagttctataggctacaat

SEQ ID NO: 1126541 - DNA, 22 bp, Artificial Sequence
  chemically synthesized
gcagttctataggctacaattc

SEQ ID NO: 1126542 - DNA, 22 bp, Artificial Sequence
  chemically synthesized
gtaccttaattttggaattgta

SEQ ID NO: 1126543 - DNA, 22 bp, Artificial Sequence
  chemically synthesized
ctggtaccttaattttggaatt

SEQ ID NO: 1126544 - DNA, 22 bp, Artificial Sequence
  chemically synthesized
tataggctacaattccaaaatt

SEQ ID NO: 1126545 - DNA, 22 bp, Artificial Sequence
  chemically synthesized
taggctacaattccaaaattaa

SEQ ID NO: 1126546 - DNA, 22 bp, Artificial Sequence
  chemically synthesized
atcctgctggtaccttaatttt

SEQ ID NO: 1126547 - DNA, 22 bp, Artificial Sequence
  chemically synthesized
caattccaaaattaaggtacca

SEQ ID NO: 1126548 - DNA, 22 bp, Artificial Sequence
  chemically synthesized
caaaattaaggtaccagcagga

SEQ ID NO: 1126549 - DNA, 22 bp, Artificial Sequence
  chemically synthesized
tcaccaggaactgatcctgctg

SEQ ID NO: 1126550 - DNA, 22 bp, Artificial Sequence
  chemically synthesized
aggtaccagcaggatcagttcc

SEQ ID NO: 1126551 - DNA, 22 bp, Artificial Sequence
  chemically synthesized
caagccaggaagaaggctgtca

SEQ ID NO: 1126552 - DNA, 22 bp, Artificial Sequence
  chemically synthesized
tctacaagccaggaagaaggct

SEQ ID NO: 1126553 - DNA, 22 bp, Artificial Sequence
  chemically synthesized
ctggtgacagccttcttcctgg

SEQ ID NO: 1126554 - DNA, 22 bp, Artificial Sequence
  chemically synthesized
gtgacagccttcttcctggctt

SEQ ID NO: 1126555 - DNA, 22 bp, Artificial Sequence
  chemically synthesized
taccagaggctgtctacaagcc

SEQ ID NO: 1126556 - DNA, 22 bp, Artificial Sequence
  chemically synthesized
cttcctggcttgtagacagcct

SEQ ID NO: 1126557 - DNA, 22 bp, Artificial Sequence
  chemically synthesized
ttcctggcttgtagacagcctc

SEQ ID NO: 1126558 - DNA, 22 bp, Artificial Sequence
  chemically synthesized
cctggcttgtagacagcctctg

SEQ ID NO: 1126559 - DNA, 22 bp, Artificial Sequence
  chemically synthesized
ctggcttgtagacagcctctgg

SEQ ID NO: 1126560 - DNA, 22 bp, Artificial Sequence
  chemically synthesized
gcttgtagacagcctctggtat

SEQ ID NO: 1126561 - DNA, 22 bp, Artificial Sequence
  chemically synthesized
gtagacagcctctggtatagtt

SEQ ID NO: 1126562 - DNA, 22 bp, Artificial Sequence
  chemically synthesized
tagacagcctctggtatagttt

SEQ ID NO: 1126563 - DNA, 22 bp, Artificial Sequence
  chemically synthesized
ggaagggacgaatatccaaact

SEQ ID NO: 1126564 - DNA, 22 bp, Artificial Sequence
  chemically synthesized
gggaagggacgaatatccaaac

SEQ ID NO: 1126565 - DNA, 22 bp, Artificial Sequence
  chemically synthesized
tggtatagtttggatattcgtc

SEQ ID NO: 1126566 - DNA, 22 bp, Artificial Sequence
  chemically synthesized
gtatagtttggatattcgtccc

SEQ ID NO: 1126567 - DNA, 22 bp, Artificial Sequence
  chemically synthesized
agcataagatttgggaagggac

SEQ ID NO: 1126568 - DNA, 22 bp, Artificial Sequence
  chemically synthesized
ggatattcgtcccttcccaaat

SEQ ID NO: 1126569 - DNA, 22 bp, Artificial Sequence
  chemically synthesized
gatattcgtcccttcccaaatc

SEQ ID NO: 1126570 - DNA, 22 bp, Artificial Sequence
  chemically synthesized
caattcagcataagatttggga

SEQ ID NO: 1126571 - DNA, 22 bp, Artificial Sequence
  chemically synthesized
acaattcagcataagatttggg

SEQ ID NO: 1126572 - DNA, 22 bp, Artificial Sequence
  chemically synthesized
gtcccttcccaaatcttatgct

SEQ ID NO: 1126573 - DNA, 22 bp, Artificial Sequence
  chemically synthesized
gagtttacaattcagcataaga

SEQ ID NO: 1126574 - DNA, 22 bp, Artificial Sequence
  chemically synthesized
cccaaatcttatgctgaattgt

SEQ ID NO: 1126575 - DNA, 22 bp, Artificial Sequence
  chemically synthesized
ccaaatcttatgctgaattgta

SEQ ID NO: 1126576 - DNA, 22 bp, Artificial Sequence
  chemically synthesized
cagcactggagtttacaattca

SEQ ID NO: 1126577 - DNA, 22 bp, Artificial Sequence
  chemically synthesized
ccagcactggagtttacaattc

SEQ ID NO: 1126578 - DNA, 22 bp, Artificial Sequence
  chemically synthesized
atgctgaattgtaaactccagt

SEQ ID NO: 1126579 - DNA, 22 bp, Artificial Sequence
  chemically synthesized
tgctgaattgtaaactccagtg

SEQ ID NO: 1126580 - DNA, 22 bp, Artificial Sequence
  chemically synthesized
aattgtaaactccagtgctgga

SEQ ID NO: 1126581 - DNA, 22 bp, Artificial Sequence
  chemically synthesized
ccaccaggccccatttccagca

SEQ ID NO: 1126582 - DNA, 22 bp, Artificial Sequence
  chemically synthesized
taaactccagtgctggaaatgg

SEQ ID NO: 1126583 - DNA, 22 bp, Artificial Sequence
  chemically synthesized
cagtgctggaaatggggcctgg

SEQ ID NO: 1126584 - DNA, 22 bp, Artificial Sequence
  chemically synthesized
gaaatggggcctggtggcaggt

SEQ ID NO: 1126585 - DNA, 22 bp, Artificial Sequence
  chemically synthesized
ccatgatccaaacacctgccac

SEQ ID NO: 1126586 - DNA, 22 bp, Artificial Sequence
  chemically synthesized
gtggcaggtgtttggatcatgg

SEQ ID NO: 1126587 - DNA, 22 bp, Artificial Sequence
  chemically synthesized
agccgtgagggatccgctccca

SEQ ID NO: 1126588 - DNA, 22 bp, Artificial Sequence
  chemically synthesized
ggatcatgggagcggatccctc

SEQ ID NO: 1126589 - DNA, 22 bp, Artificial Sequence
  chemically synthesized
gatcatgggagcggatccctca

SEQ ID NO: 1126590 - DNA, 22 bp, Artificial Sequence
  chemically synthesized
tcgcaaagacagcactaagccg

SEQ ID NO: 1126591 - DNA, 22 bp, Artificial Sequence
  chemically synthesized
actatcgcaaagacagcactaa

SEQ ID NO: 1126592 - DNA, 22 bp, Artificial Sequence
  chemically synthesized
acggcttagtgctgtctttgcg

SEQ ID NO: 1126593 - DNA, 22 bp, Artificial Sequence
  chemically synthesized
aggagaactcactatcgcaaag

SEQ ID NO: 1126594 - DNA, 22 bp, Artificial Sequence
  chemically synthesized
tcaggagaactcactatcgcaa

SEQ ID NO: 1126595 - DNA, 22 bp, Artificial Sequence
  chemically synthesized
agtgctgtctttgcgatagtga

SEQ ID NO: 1126596 - DNA, 22 bp, Artificial Sequence
  chemically synthesized
tctcaggagaactcactatcgc

SEQ ID NO: 1126597 - DNA, 22 bp, Artificial Sequence
  chemically synthesized
gtgctgtctttgcgatagtgag

SEQ ID NO: 1126598 - DNA, 22 bp, Artificial Sequence
  chemically synthesized
tctttgcgatagtgagttctcc

SEQ ID NO: 1126599 - DNA, 22 bp, Artificial Sequence
  chemically synthesized
tgcgatagtgagttctcctgag

SEQ ID NO: 1126600 - DNA, 22 bp, Artificial Sequence
  chemically synthesized
taagtgagttctctcaggagaa

SEQ ID NO: 1126601 - DNA, 22 bp, Artificial Sequence
  chemically synthesized
gcgatagtgagttctcctgaga

SEQ ID NO: 1126602 - DNA, 22 bp, Artificial Sequence
  chemically synthesized
gtaagtgagttctctcaggaga

SEQ ID NO: 1126603 - DNA, 22 bp, Artificial Sequence
  chemically synthesized
cgatagtgagttctcctgagag

SEQ ID NO: 1126604 - DNA, 22 bp, Artificial Sequence
  chemically synthesized
tcctgagagaactcacttacaa

SEQ ID NO: 1126605 - DNA, 22 bp, Artificial Sequence
  chemically synthesized
ctgagagaactcacttacaaat

SEQ ID NO: 1126606 - DNA, 22 bp, Artificial Sequence
  chemically synthesized
agagaactcacttacaaatgtg

SEQ ID NO: 1126607 - DNA, 22 bp, Artificial Sequence
  chemically synthesized
acttacaaatgtgtgccacctc

SEQ ID NO: 1126608 - DNA, 22 bp, Artificial Sequence
  chemically synthesized
acaaatgtgtgccacctccccc

SEQ ID NO: 1126609 - DNA, 22 bp, Artificial Sequence
  chemically synthesized
caaatgtgtgccacctccccct

SEQ ID NO: 1126610 - DNA, 22 bp, Artificial Sequence
  chemically synthesized
cccctgcactgtctcactctcc

SEQ ID NO: 1126611 - DNA, 22 bp, Artificial Sequence
  chemically synthesized
cactgtctcactctccttgtcc

SEQ ID NO: 1126612 - DNA, 22 bp, Artificial Sequence
  chemically synthesized
tctcactctccttgtcccattc

SEQ ID NO: 1126613 - DNA, 22 bp, Artificial Sequence
  chemically synthesized
actctccttgtcccattcttcc

SEQ ID NO: 1126614 - DNA, 22 bp, Artificial Sequence
  chemically synthesized
tccttgtcccattcttccatgt

SEQ ID NO: 1126615 - DNA, 22 bp, Artificial Sequence
  chemically synthesized
cttgtcccattcttccatgtga

SEQ ID NO: 1126616 - DNA, 22 bp, Artificial Sequence
  chemically synthesized
gtcccattcttccatgtgatgt

SEQ ID NO: 1126617 - DNA, 22 bp, Artificial Sequence
  chemically synthesized
tcccattcttccatgtgatgtg

SEQ ID NO: 1126618 - DNA, 22 bp, Artificial Sequence
  chemically synthesized
ttccatgtgatgtgactgtttc

SEQ ID NO: 1126619 - DNA, 22 bp, Artificial Sequence
  chemically synthesized
ccatgtgatgtgactgtttccc

SEQ ID NO: 1126620 - DNA, 22 bp, Artificial Sequence
  chemically synthesized
catgtgatgtgactgtttcccc

SEQ ID NO: 1126621 - DNA, 22 bp, Artificial Sequence
  chemically synthesized
aatcatgatggaaggcaaaggg

SEQ ID NO: 1126622 - DNA, 22 bp, Artificial Sequence
  chemically synthesized
caatcatgatggaaggcaaagg

SEQ ID NO: 1126623 - DNA, 22 bp, Artificial Sequence
  chemically synthesized
tcaatcatgatggaaggcaaag

SEQ ID NO: 1126624 - DNA, 22 bp, Artificial Sequence
  chemically synthesized
tttcccctttgccttccatcat

SEQ ID NO: 1126625 - DNA, 22 bp, Artificial Sequence
  chemically synthesized
cccctttgccttccatcatgat

SEQ ID NO: 1126626 - DNA, 22 bp, Artificial Sequence
  chemically synthesized
aggaagctttcaatcatgatgg

SEQ ID NO: 1126627 - DNA, 22 bp, Artificial Sequence
  chemically synthesized
ccctttgccttccatcatgatt

SEQ ID NO: 1126628 - DNA, 22 bp, Artificial Sequence
  chemically synthesized
tgccttccatcatgattgaaag

SEQ ID NO: 1126629 - DNA, 22 bp, Artificial Sequence
  chemically synthesized
gccttccatcatgattgaaagc

SEQ ID NO: 1126630 - DNA, 22 bp, Artificial Sequence
  chemically synthesized
ccttccatcatgattgaaagct

SEQ ID NO: 1126631 - DNA, 22 bp, Artificial Sequence
  chemically synthesized
gggaggtctcaggaagctttca

SEQ ID NO: 1126632 - DNA, 22 bp, Artificial Sequence
  chemically synthesized
ccatcatgattgaaagcttcct

SEQ ID NO: 1126633 - DNA, 22 bp, Artificial Sequence
  chemically synthesized
tggggaggtctcaggaagcttt

SEQ ID NO: 1126634 - DNA, 22 bp, Artificial Sequence
  chemically synthesized
catcatgattgaaagcttcctg

SEQ ID NO: 1126635 - DNA, 22 bp, Artificial Sequence
  chemically synthesized
ctggggaggtctcaggaagctt

SEQ ID NO: 1126636 - DNA, 22 bp, Artificial Sequence
  chemically synthesized
cttctggggaggtctcaggaag

SEQ ID NO: 1126637 - DNA, 22 bp, Artificial Sequence
  chemically synthesized
aaagcttcctgagacctcccca

SEQ ID NO: 1126638 - DNA, 22 bp, Artificial Sequence
  chemically synthesized
cctgagacctccccagaagcag

SEQ ID NO: 1126639 - DNA, 22 bp, Artificial Sequence
  chemically synthesized
ctgagacctccccagaagcaga

SEQ ID NO: 1126640 - DNA, 22 bp, Artificial Sequence
  chemically synthesized
agacctccccagaagcagacgc

SEQ ID NO: 1126641 - DNA, 22 bp, Artificial Sequence
  chemically synthesized
tagaggaagcatggtggcgtct

SEQ ID NO: 1126642 - DNA, 22 bp, Artificial Sequence
  chemically synthesized
cccagaagcagacgccaccatg

SEQ ID NO: 1126643 - DNA, 22 bp, Artificial Sequence
  chemically synthesized
caagctgtagaggaagcatggt

SEQ ID NO: 1126644 - DNA, 22 bp, Artificial Sequence
  chemically synthesized
tgcaagctgtagaggaagcatg

SEQ ID NO: 1126645 - DNA, 22 bp, Artificial Sequence
  chemically synthesized
acggttctgcaagctgtagagg

SEQ ID NO: 1126646 - DNA, 22 bp, Artificial Sequence
  chemically synthesized
gctcacggttctgcaagctgta

SEQ ID NO: 1126647 - DNA, 22 bp, Artificial Sequence
  chemically synthesized
actggctcacggttctgcaagc

SEQ ID NO: 1126648 - DNA, 22 bp, Artificial Sequence
  chemically synthesized
aactggctcacggttctgcaag

SEQ ID NO: 1126649 - DNA, 22 bp, Artificial Sequence
  chemically synthesized
cctctacagcttgcagaaccgt

SEQ ID NO: 1126650 - DNA, 22 bp, Artificial Sequence
  chemically synthesized
ctctacagcttgcagaaccgtg

SEQ ID NO: 1126651 - DNA, 22 bp, Artificial Sequence
  chemically synthesized
atttaactggctcacggttctg

SEQ ID NO: 1126652 - DNA, 22 bp, Artificial Sequence
  chemically synthesized
tacagcttgcagaaccgtgagc

SEQ ID NO: 1126653 - DNA, 22 bp, Artificial Sequence
  chemically synthesized
cagcttgcagaaccgtgagcca

SEQ ID NO: 1126654 - DNA, 22 bp, Artificial Sequence
  chemically synthesized
gcagaaccgtgagccagttaaa

SEQ ID NO: 1126655 - DNA, 22 bp, Artificial Sequence
  chemically synthesized
catgaaaattgatttaactggc

SEQ ID NO: 1126656 - DNA, 22 bp, Artificial Sequence
  chemically synthesized
cagaaccgtgagccagttaaat

SEQ ID NO: 1126657 - DNA, 22 bp, Artificial Sequence
  chemically synthesized
acatgaaaattgatttaactgg

SEQ ID NO: 1126658 - DNA, 22 bp, Artificial Sequence
  chemically synthesized
agtgacttacatgaaaattgat

SEQ ID NO: 1126659 - DNA, 22 bp, Artificial Sequence
  chemically synthesized
caactgagtgacttacatgaaa

SEQ ID NO: 1126660 - DNA, 22 bp, Artificial Sequence
  chemically synthesized
aatcaattttcatgtaagtcac

SEQ ID NO: 1126661 - DNA, 22 bp, Artificial Sequence
  chemically synthesized
tcatgtaagtcactcagttgca

SEQ ID NO: 1126662 - DNA, 22 bp, Artificial Sequence
  chemically synthesized
taaagaaatacctgcaactgag

SEQ ID NO: 1126663 - DNA, 22 bp, Artificial Sequence
  chemically synthesized
catgtaagtcactcagttgcag

SEQ ID NO: 1126664 - DNA, 22 bp, Artificial Sequence
  chemically synthesized
atgtaagtcactcagttgcagg

SEQ ID NO: 1126665 - DNA, 22 bp, Artificial Sequence
  chemically synthesized
ttataaagaaatacctgcaact

SEQ ID NO: 1126666 - DNA, 22 bp, Artificial Sequence
  chemically synthesized
cactgttataaagaaatacctg

SEQ ID NO: 1126667 - DNA, 22 bp, Artificial Sequence
  chemically synthesized
gcactgttataaagaaatacct

SEQ ID NO: 1126668 - DNA, 22 bp, Artificial Sequence
  chemically synthesized
ttgcactgttataaagaaatac

SEQ ID NO: 1126669 - DNA, 22 bp, Artificial Sequence
  chemically synthesized
ttcttgcactgttataaagaaa

SEQ ID NO: 1126670 - DNA, 22 bp, Artificial Sequence
  chemically synthesized
agttgcaggtatttctttataa

SEQ ID NO: 1126671 - DNA, 22 bp, Artificial Sequence
  chemically synthesized
ggctgttcttgcactgttataa

SEQ ID NO: 1126672 - DNA, 22 bp, Artificial Sequence
  chemically synthesized
caggtatttctttataacagtg

SEQ ID NO: 1126673 - DNA, 22 bp, Artificial Sequence
  chemically synthesized
aggctgttcttgcactgttata

SEQ ID NO: 1126674 - DNA, 22 bp, Artificial Sequence
  chemically synthesized
tcttaggctgttcttgcactgt

SEQ ID NO: 1126675 - DNA, 22 bp, Artificial Sequence
  chemically synthesized
ctttataacagtgcaagaacag

SEQ ID NO: 1126676 - DNA, 22 bp, Artificial Sequence
  chemically synthesized
tttataacagtgcaagaacagc

SEQ ID NO: 1126677 - DNA, 22 bp, Artificial Sequence
  chemically synthesized
tataacagtgcaagaacagcct

SEQ ID NO: 1126678 - DNA, 22 bp, Artificial Sequence
  chemically synthesized
ataacagtgcaagaacagccta

SEQ ID NO: 1126679 - DNA, 22 bp, Artificial Sequence
  chemically synthesized
taacagtgcaagaacagcctaa

SEQ ID NO: 1126680 - DNA, 22 bp, Artificial Sequence
  chemically synthesized
ggaggacacagcaagaaggagg

SEQ ID NO: 1126681 - DNA, 22 bp, Artificial Sequence
  chemically synthesized
gggaggacacagcaagaaggag

SEQ ID NO: 1126682 - DNA, 22 bp, Artificial Sequence
  chemically synthesized
ccttgggaggacacagcaagaa

SEQ ID NO: 1126683 - DNA, 22 bp, Artificial Sequence
  chemically synthesized
agacaacctccttcttgctgtg

SEQ ID NO: 1126684 - DNA, 22 bp, Artificial Sequence
  chemically synthesized
cctgccttgggaggacacagca

SEQ ID NO: 1126685 - DNA, 22 bp, Artificial Sequence
  chemically synthesized
tccctgccttgggaggacacag

SEQ ID NO: 1126686 - DNA, 22 bp, Artificial Sequence
  chemically synthesized
ctccctgccttgggaggacaca

SEQ ID NO: 1126687 - DNA, 22 bp, Artificial Sequence
  chemically synthesized
tctccctgccttgggaggacac

SEQ ID NO: 1126688 - DNA, 22 bp, Artificial Sequence
  chemically synthesized
tttctccctgccttgggaggac

SEQ ID NO: 1126689 - DNA, 22 bp, Artificial Sequence
  chemically synthesized
cttcttgctgtgtcctcccaag

SEQ ID NO: 1126690 - DNA, 22 bp, Artificial Sequence
  chemically synthesized
cttgctgtgtcctcccaaggca

SEQ ID NO: 1126691 - DNA, 22 bp, Artificial Sequence
  chemically synthesized
gctctttctccctgccttggga

SEQ ID NO: 1126692 - DNA, 22 bp, Artificial Sequence
  chemically synthesized
ttgctgtgtcctcccaaggcag

SEQ ID NO: 1126693 - DNA, 22 bp, Artificial Sequence
  chemically synthesized
gctgtgtcctcccaaggcaggg

SEQ ID NO: 1126694 - DNA, 22 bp, Artificial Sequence
  chemically synthesized
ctggctctttctccctgccttg

SEQ ID NO: 1126695 - DNA, 22 bp, Artificial Sequence
  chemically synthesized
ctgtgtcctcccaaggcaggga

SEQ ID NO: 1126696 - DNA, 22 bp, Artificial Sequence
  chemically synthesized
gctggctctttctccctgcctt

SEQ ID NO: 1126697 - DNA, 22 bp, Artificial Sequence
  chemically synthesized
tgtcctcccaaggcagggagaa

SEQ ID NO: 1126698 - DNA, 22 bp, Artificial Sequence
  chemically synthesized
ccaaggcagggagaaagagcca

SEQ ID NO: 1126699 - DNA, 22 bp, Artificial Sequence
  chemically synthesized
taagaagacacaacaaagagct

SEQ ID NO: 1126700 - DNA, 22 bp, Artificial Sequence
  chemically synthesized
ataagaagacacaacaaagagc

SEQ ID NO: 1126701 - DNA, 22 bp, Artificial Sequence
  chemically synthesized
gggcccttataagaagacacaa

SEQ ID NO: 1126702 - DNA, 22 bp, Artificial Sequence
  chemically synthesized
tttgttgtgtcttcttataagg

SEQ ID NO: 1126703 - DNA, 22 bp, Artificial Sequence
  chemically synthesized
aggagattagggcccttataag

SEQ ID NO: 1126704 - DNA, 22 bp, Artificial Sequence
  chemically synthesized
tgttgtgtcttcttataagggc

SEQ ID NO: 1126705 - DNA, 22 bp, Artificial Sequence
  chemically synthesized
gttgtgtcttcttataagggcc

SEQ ID NO: 1126706 - DNA, 22 bp, Artificial Sequence
  chemically synthesized
tgaggagattagggcccttata

SEQ ID NO: 1126707 - DNA, 22 bp, Artificial Sequence
  chemically synthesized
ttgtgtcttcttataagggccc

SEQ ID NO: 1126708 - DNA, 22 bp, Artificial Sequence
  chemically synthesized
ctgaggagattagggcccttat

SEQ ID NO: 1126709 - DNA, 22 bp, Artificial Sequence
  chemically synthesized
ttctgaggagattagggccctt

SEQ ID NO: 1126710 - DNA, 22 bp, Artificial Sequence
  chemically synthesized
tgtcttcttataagggccctaa

SEQ ID NO: 1126711 - DNA, 22 bp, Artificial Sequence
  chemically synthesized
cttataagggccctaatctcct

SEQ ID NO: 1126712 - DNA, 22 bp, Artificial Sequence
  chemically synthesized
ttataagggccctaatctcctc

SEQ ID NO: 1126713 - DNA, 22 bp, Artificial Sequence
  chemically synthesized
ataagggccctaatctcctcag

SEQ ID NO: 1126714 - DNA, 22 bp, Artificial Sequence
  chemically synthesized
taagggccctaatctcctcaga

SEQ ID NO: 1126715 - DNA, 22 bp, Artificial Sequence
  chemically synthesized
atctcctcagaagagccctatc

SEQ ID NO: 1126716 - DNA, 22 bp, Artificial Sequence
  chemically synthesized
gatgaggtcatgaagatagggc

SEQ ID NO: 1126717 - DNA, 22 bp, Artificial Sequence
  chemically synthesized
agatgaggtcatgaagataggg

SEQ ID NO: 1126718 - DNA, 22 bp, Artificial Sequence
  chemically synthesized
ctcagaagagccctatcttcat

SEQ ID NO: 1126719 - DNA, 22 bp, Artificial Sequence
  chemically synthesized
atttagatgaggtcatgaagat

SEQ ID NO: 1126720 - DNA, 22 bp, Artificial Sequence
  chemically synthesized
agaagagccctatcttcatgac

SEQ ID NO: 1126721 - DNA, 22 bp, Artificial Sequence
  chemically synthesized
gatttagatgaggtcatgaaga

SEQ ID NO: 1126722 - DNA, 22 bp, Artificial Sequence
  chemically synthesized
gaagataatttgatttagatga

SEQ ID NO: 1126723 - DNA, 22 bp, Artificial Sequence
  chemically synthesized
tcttcatgacctcatctaaatc

SEQ ID NO: 1126724 - DNA, 22 bp, Artificial Sequence
  chemically synthesized
ggaagataatttgatttagatg

SEQ ID NO: 1126725 - DNA, 22 bp, Artificial Sequence
  chemically synthesized
tggaagataatttgatttagat

SEQ ID NO: 1126726 - DNA, 22 bp, Artificial Sequence
  chemically synthesized
catgacctcatctaaatcaaat

SEQ ID NO: 1126727 - DNA, 22 bp, Artificial Sequence
  chemically synthesized
atgacctcatctaaatcaaatt

SEQ ID NO: 1126728 - DNA, 22 bp, Artificial Sequence
  chemically synthesized
atctaaatcaaattatcttcca

SEQ ID NO: 1126729 - DNA, 22 bp, Artificial Sequence
  chemically synthesized
gaaatggagactttggaagata

SEQ ID NO: 1126730 - DNA, 22 bp, Artificial Sequence
  chemically synthesized
ggaaatggagactttggaagat

SEQ ID NO: 1126731 - DNA, 22 bp, Artificial Sequence
  chemically synthesized
aatcaaattatcttccaaagtc

SEQ ID NO: 1126732 - DNA, 22 bp, Artificial Sequence
  chemically synthesized
tcttccaaagtctccatttcca

SEQ ID NO: 1126733 - DNA, 22 bp, Artificial Sequence
  chemically synthesized
caatgtgatggaatttggaaat

SEQ ID NO: 1126734 - DNA, 22 bp, Artificial Sequence
  chemically synthesized
ccaaagtctccatttccaaatt

SEQ ID NO: 1126735 - DNA, 22 bp, Artificial Sequence
  chemically synthesized
caaagtctccatttccaaattc

SEQ ID NO: 1126736 - DNA, 22 bp, Artificial Sequence
  chemically synthesized
atctccaatgtgatggaatttg

SEQ ID NO: 1126737 - DNA, 22 bp, Artificial Sequence
  chemically synthesized
taatctccaatgtgatggaatt

SEQ ID NO: 1126738 - DNA, 22 bp, Artificial Sequence
  chemically synthesized
catttccaaattccatcacatt

SEQ ID NO: 1126739 - DNA, 22 bp, Artificial Sequence
  chemically synthesized
aagctctaatctccaatgtgat

SEQ ID NO: 1126740 - DNA, 22 bp, Artificial Sequence
  chemically synthesized
ccaaattccatcacattggaga

SEQ ID NO: 1126741 - DNA, 22 bp, Artificial Sequence
  chemically synthesized
caaattccatcacattggagat

SEQ ID NO: 1126742 - DNA, 22 bp, Artificial Sequence
  chemically synthesized
tattgaagctctaatctccaat

SEQ ID NO: 1126743 - DNA, 22 bp, Artificial Sequence
  chemically synthesized
atattgaagctctaatctccaa

SEQ ID NO: 1126744 - DNA, 22 bp, Artificial Sequence
  chemically synthesized
ttatattgaagctctaatctcc

SEQ ID NO: 1126745 - DNA, 22 bp, Artificial Sequence
  chemically synthesized
catcacattggagattagagct

SEQ ID NO: 1126746 - DNA, 22 bp, Artificial Sequence
  chemically synthesized
aattcttatattgaagctctaa

SEQ ID NO: 1126747 - DNA, 22 bp, Artificial Sequence
  chemically synthesized
cctaaattcttatattgaagct

SEQ ID NO: 1126748 - DNA, 22 bp, Artificial Sequence
  chemically synthesized
gagattagagcttcaatataag

SEQ ID NO: 1126749 - DNA, 22 bp, Artificial Sequence
  chemically synthesized
tgtcctccctaaattcttatat

SEQ ID NO: 1126750 - DNA, 22 bp, Artificial Sequence
  chemically synthesized
gagcttcaatataagaatttag

SEQ ID NO: 1126751 - DNA, 22 bp, Artificial Sequence
  chemically synthesized
aattgtgtcctccctaaattct

SEQ ID NO: 1126752 - DNA, 22 bp, Artificial Sequence
  chemically synthesized
caatataagaatttagggagga

SEQ ID NO: 1126753 - DNA, 22 bp, Artificial Sequence
  chemically synthesized
aatataagaatttagggaggac

SEQ ID NO: 1126754 - DNA, 22 bp, Artificial Sequence
  chemically synthesized
ggatggcctgaattgtgtcctc

SEQ ID NO: 1126755 - DNA, 22 bp, Artificial Sequence
  chemically synthesized
agggaggacacaattcaggcca

SEQ ID NO: 1126756 - DNA, 22 bp, Artificial Sequence
  chemically synthesized
gggaggacacaattcaggccat

SEQ ID NO: 1126757 - DNA, 22 bp, Artificial Sequence
  chemically synthesized
aggccatcccagcctggcatca

SEQ ID NO: 1126758 - DNA, 22 bp, Artificial Sequence
  chemically synthesized
ccacagagatataaaaatgatg

SEQ ID NO: 1126759 - DNA, 22 bp, Artificial Sequence
  chemically synthesized
tgctaccacagagatataaaaa

SEQ ID NO: 1126760 - DNA, 22 bp, Artificial Sequence
  chemically synthesized
gcatcatttttatatctctgtg

SEQ ID NO: 1126761 - DNA, 22 bp, Artificial Sequence
  chemically synthesized
ttatatctctgtggtagcataa

SEQ ID NO: 1126762 - DNA, 22 bp, Artificial Sequence
  chemically synthesized
tatatctctgtggtagcataat

SEQ ID NO: 1126763 - DNA, 22 bp, Artificial Sequence
  chemically synthesized
atatctctgtggtagcataata

SEQ ID NO: 1126764 - DNA, 22 bp, Artificial Sequence
  chemically synthesized
caaatgaacacatattatgcta

SEQ ID NO: 1126765 - DNA, 22 bp, Artificial Sequence
  chemically synthesized
tatctctgtggtagcataatat

SEQ ID NO: 1126766 - DNA, 22 bp, Artificial Sequence
  chemically synthesized
acaaatgaacacatattatgct

SEQ ID NO: 1126767 - DNA, 22 bp, Artificial Sequence
  chemically synthesized
tacaaatgaacacatattatgc

SEQ ID NO: 1126768 - DNA, 22 bp, Artificial Sequence
  chemically synthesized
tttacaaatgaacacatattat

SEQ ID NO: 1126769 - DNA, 22 bp, Artificial Sequence
  chemically synthesized
tgtggtagcataatatgtgttc

SEQ ID NO: 1126770 - DNA, 22 bp, Artificial Sequence
  chemically synthesized
tctctttacaaatgaacacata

SEQ ID NO: 1126771 - DNA, 22 bp, Artificial Sequence
  chemically synthesized
tggtagcataatatgtgttcat

SEQ ID NO: 1126772 - DNA, 22 bp, Artificial Sequence
  chemically synthesized
gtcagaaacctgtctctttaca

SEQ ID NO: 1126773 - DNA, 22 bp, Artificial Sequence
  chemically synthesized
cctggtcagaaacctgtctctt

SEQ ID NO: 1126774 - DNA, 22 bp, Artificial Sequence
  chemically synthesized
ccctggtcagaaacctgtctct

SEQ ID NO: 1126775 - DNA, 22 bp, Artificial Sequence
  chemically synthesized
atttgtaaagagacaggtttct

SEQ ID NO: 1126776 - DNA, 22 bp, Artificial Sequence
  chemically synthesized
gtaaagagacaggtttctgacc

SEQ ID NO: 1126777 - DNA, 22 bp, Artificial Sequence
  chemically synthesized
taaagagacaggtttctgacca

SEQ ID NO: 1126778 - DNA, 22 bp, Artificial Sequence
  chemically synthesized
gtaaagtcttccctggtcagaa

SEQ ID NO: 1126779 - DNA, 22 bp, Artificial Sequence
  chemically synthesized
agtaaagtcttccctggtcaga

SEQ ID NO: 1126780 - DNA, 22 bp, Artificial Sequence
  chemically synthesized
ttagtaaagtcttccctggtca

SEQ ID NO: 1126781 - DNA, 22 bp, Artificial Sequence
  chemically synthesized
agagtattcttagtaaagtctt

SEQ ID NO: 1126782 - DNA, 22 bp, Artificial Sequence
  chemically synthesized
ctgaccagggaagactttacta

SEQ ID NO: 1126783 - DNA, 22 bp, Artificial Sequence
  chemically synthesized
tgagagtattcttagtaaagtc

SEQ ID NO: 1126784 - DNA, 22 bp, Artificial Sequence
  chemically synthesized
tgaccagggaagactttactaa

SEQ ID NO: 1126785 - DNA, 22 bp, Artificial Sequence
  chemically synthesized
ctgagagtattcttagtaaagt

SEQ ID NO: 1126786 - DNA, 22 bp, Artificial Sequence
  chemically synthesized
accagggaagactttactaaga

SEQ ID NO: 1126787 - DNA, 22 bp, Artificial Sequence
  chemically synthesized
acatcttctgagagtattctta

SEQ ID NO: 1126788 - DNA, 22 bp, Artificial Sequence
  chemically synthesized
tgacatcttctgagagtattct

SEQ ID NO: 1126789 - DNA, 22 bp, Artificial Sequence
  chemically synthesized
ttctgacatcttctgagagtat

SEQ ID NO: 1126790 - DNA, 22 bp, Artificial Sequence
  chemically synthesized
attctgacatcttctgagagta

SEQ ID NO: 1126791 - DNA, 22 bp, Artificial Sequence
  chemically synthesized
ttattctgacatcttctgagag

SEQ ID NO: 1126792 - DNA, 22 bp, Artificial Sequence
  chemically synthesized
tactaagaatactctcagaaga

SEQ ID NO: 1126793 - DNA, 22 bp, Artificial Sequence
  chemically synthesized
actaagaatactctcagaagat

SEQ ID NO: 1126794 - DNA, 22 bp, Artificial Sequence
  chemically synthesized
ctaagaatactctcagaagatg

SEQ ID NO: 1126795 - DNA, 22 bp, Artificial Sequence
  chemically synthesized
ttcttattctgacatcttctga

SEQ ID NO: 1126796 - DNA, 22 bp, Artificial Sequence
  chemically synthesized
agaatactctcagaagatgtca

SEQ ID NO: 1126797 - DNA, 22 bp, Artificial Sequence
  chemically synthesized
tatattattcttattctgacat

SEQ ID NO: 1126798 - DNA, 22 bp, Artificial Sequence
  chemically synthesized
atatattattcttattctgaca

SEQ ID NO: 1126799 - DNA, 22 bp, Artificial Sequence
  chemically synthesized
tcagaagatgtcagaataagaa

SEQ ID NO: 1126800 - DNA, 22 bp, Artificial Sequence
  chemically synthesized
agaagatgtcagaataagaata

SEQ ID NO: 1126801 - DNA, 22 bp, Artificial Sequence
  chemically synthesized
ccatgaccacatttatatatta

SEQ ID NO: 1126802 - DNA, 22 bp, Artificial Sequence
  chemically synthesized
cccatgaccacatttatatatt

SEQ ID NO: 1126803 - DNA, 22 bp, Artificial Sequence
  chemically synthesized
agggatggtatcttcccatgac

SEQ ID NO: 1126804 - DNA, 22 bp, Artificial Sequence
  chemically synthesized
attcagggatggtatcttccca

SEQ ID NO: 1126805 - DNA, 22 bp, Artificial Sequence
  chemically synthesized
ttaattcagggatggtatcttc

SEQ ID NO: 1126806 - DNA, 22 bp, Artificial Sequence
  chemically synthesized
caattattaattcagggatggt

SEQ ID NO: 1126807 - DNA, 22 bp, Artificial Sequence
  chemically synthesized
ccaattattaattcagggatgg

SEQ ID NO: 1126808 - DNA, 22 bp, Artificial Sequence
  chemically synthesized
agtttccaattattaattcagg

SEQ ID NO: 1126809 - DNA, 22 bp, Artificial Sequence
  chemically synthesized
cccaggagaaagttgagtttcc

SEQ ID NO: 1126810 - DNA, 22 bp, Artificial Sequence
  chemically synthesized
aattaataattggaaactcaac

SEQ ID NO: 1126811 - DNA, 22 bp, Artificial Sequence
  chemically synthesized
ccccaggagaaagttgagtttc

SEQ ID NO: 1126812 - DNA, 22 bp, Artificial Sequence
  chemically synthesized
tccccaggagaaagttgagttt

SEQ ID NO: 1126813 - DNA, 22 bp, Artificial Sequence
  chemically synthesized
ctttccccaggagaaagttgag

SEQ ID NO: 1126814 - DNA, 22 bp, Artificial Sequence
  chemically synthesized
ataattggaaactcaactttct

SEQ ID NO: 1126815 - DNA, 22 bp, Artificial Sequence
  chemically synthesized
gaaactcaactttctcctgggg

SEQ ID NO: 1126816 - DNA, 22 bp, Artificial Sequence
  chemically synthesized
aaaaacaatgtctcctttcccc

SEQ ID NO: 1126817 - DNA, 22 bp, Artificial Sequence
  chemically synthesized
aactttctcctggggaaaggag

SEQ ID NO: 1126818 - DNA, 22 bp, Artificial Sequence
  chemically synthesized
aaaaaacaatgtctcctttccc

SEQ ID NO: 1126819 - DNA, 22 bp, Artificial Sequence
  chemically synthesized
tctcctggggaaaggagacatt

SEQ ID NO: 1126820 - DNA, 22 bp, Artificial Sequence
  chemically synthesized
catttaaaaaacaatgtctcct

SEQ ID NO: 1126821 - DNA, 22 bp, Artificial Sequence
  chemically synthesized
ctcctggggaaaggagacattg

SEQ ID NO: 1126822 - DNA, 22 bp, Artificial Sequence
  chemically synthesized
acatttaaaaaacaatgtctcc

SEQ ID NO: 1126823 - DNA, 22 bp, Artificial Sequence
  chemically synthesized
tcctggggaaaggagacattgt

SEQ ID NO: 1126824 - DNA, 22 bp, Artificial Sequence
  chemically synthesized
ctggggaaaggagacattgttt

SEQ ID NO: 1126825 - DNA, 22 bp, Artificial Sequence
  chemically synthesized
gggaaaggagacattgtttttt

SEQ ID NO: 1126826 - DNA, 22 bp, Artificial Sequence
  chemically synthesized
aagaacgtttacatttaaaaaa

SEQ ID NO: 1126827 - DNA, 22 bp, Artificial Sequence
  chemically synthesized
gaagaacgtttacatttaaaaa

SEQ ID NO: 1126828 - DNA, 22 bp, Artificial Sequence
  chemically synthesized
tcttgaagaacgtttacattta

SEQ ID NO: 1126829 - DNA, 22 bp, Artificial Sequence
  chemically synthesized
gtcttgaagaacgtttacattt

SEQ ID NO: 1126830 - DNA, 22 bp, Artificial Sequence
  chemically synthesized
ttttttaaatgtaaacgttctt

SEQ ID NO: 1126831 - DNA, 22 bp, Artificial Sequence
  chemically synthesized
tttaaatgtaaacgttcttcaa

SEQ ID NO: 1126832 - DNA, 22 bp, Artificial Sequence
  chemically synthesized
catgtgtttgtcttgaagaacg

SEQ ID NO: 1126833 - DNA, 22 bp, Artificial Sequence
  chemically synthesized
ttaaatgtaaacgttcttcaag

SEQ ID NO: 1126834 - DNA, 22 bp, Artificial Sequence
  chemically synthesized
taaatgtaaacgttcttcaaga

SEQ ID NO: 1126835 - DNA, 22 bp, Artificial Sequence
  chemically synthesized
aaatgtaaacgttcttcaagac

SEQ ID NO: 1126836 - DNA, 22 bp, Artificial Sequence
  chemically synthesized
aatgtaaacgttcttcaagaca

SEQ ID NO: 1126837 - DNA, 22 bp, Artificial Sequence
  chemically synthesized
tattacatgtgtttgtcttgaa

SEQ ID NO: 1126838 - DNA, 22 bp, Artificial Sequence
  chemically synthesized
tggaaattatattacatgtgtt

SEQ ID NO: 1126839 - DNA, 22 bp, Artificial Sequence
  chemically synthesized
ttcaagacaaacacatgtaata

SEQ ID NO: 1126840 - DNA, 22 bp, Artificial Sequence
  chemically synthesized
caagacaaacacatgtaatata

SEQ ID NO: 1126841 - DNA, 22 bp, Artificial Sequence
  chemically synthesized
aagacaaacacatgtaatataa

SEQ ID NO: 1126842 - DNA, 22 bp, Artificial Sequence
  chemically synthesized
acactgtggaaattatattaca

SEQ ID NO: 1126843 - DNA, 22 bp, Artificial Sequence
  chemically synthesized
ccctcacactgtggaaattata

SEQ ID NO: 1126844 - DNA, 22 bp, Artificial Sequence
  chemically synthesized
gccctcacactgtggaaattat

SEQ ID NO: 1126845 - DNA, 22 bp, Artificial Sequence
  chemically synthesized
tttgccctcacactgtggaaat

SEQ ID NO: 1126846 - DNA, 22 bp, Artificial Sequence
  chemically synthesized
cctgtttgccctcacactgtgg

SEQ ID NO: 1126847 - DNA, 22 bp, Artificial Sequence
  chemically synthesized
ccctgtttgccctcacactgtg

SEQ ID NO: 1126848 - DNA, 22 bp, Artificial Sequence
  chemically synthesized
ccacagtgtgagggcaaacagg

SEQ ID NO: 1126849 - DNA, 22 bp, Artificial Sequence
  chemically synthesized
cacagtgtgagggcaaacaggg

SEQ ID NO: 1126850 - DNA, 22 bp, Artificial Sequence
  chemically synthesized
aaatggaatgtatatggccttc

SEQ ID NO: 1126851 - DNA, 22 bp, Artificial Sequence
  chemically synthesized
gtcacccctgaaatggaatgta

SEQ ID NO: 1126852 - DNA, 22 bp, Artificial Sequence
  chemically synthesized
cgtcacccctgaaatggaatgt

SEQ ID NO: 1126853 - DNA, 22 bp, Artificial Sequence
  chemically synthesized
tttcgtcacccctgaaatggaa

SEQ ID NO: 1126854 - DNA, 22 bp, Artificial Sequence
  chemically synthesized
cccaagaatctatttcgtcacc

SEQ ID NO: 1126855 - DNA, 22 bp, Artificial Sequence
  chemically synthesized
catttcaggggtgacgaaatag

SEQ ID NO: 1126856 - DNA, 22 bp, Artificial Sequence
  chemically synthesized
atctccccaagaatctatttcg

SEQ ID NO: 1126857 - DNA, 22 bp, Artificial Sequence
  chemically synthesized
aatctccccaagaatctatttc

SEQ ID NO: 1126858 - DNA, 22 bp, Artificial Sequence
  chemically synthesized
caggggtgacgaaatagattct

SEQ ID NO: 1126859 - DNA, 22 bp, Artificial Sequence
  chemically synthesized
aggggtgacgaaatagattctt

SEQ ID NO: 1126860 - DNA, 22 bp, Artificial Sequence
  chemically synthesized
agccacttaatctccccaagaa

SEQ ID NO: 1126861 - DNA, 22 bp, Artificial Sequence
  chemically synthesized
aagccacttaatctccccaaga

SEQ ID NO: 1126862 - DNA, 22 bp, Artificial Sequence
  chemically synthesized
tgtgacttaagccacttaatct

SEQ ID NO: 1126863 - DNA, 22 bp, Artificial Sequence
  chemically synthesized
ttggggagattaagtggcttaa

SEQ ID NO: 1126864 - DNA, 22 bp, Artificial Sequence
  chemically synthesized
ggggagattaagtggcttaagt

SEQ ID NO: 1126865 - DNA, 22 bp, Artificial Sequence
  chemically synthesized
ataaactatgtgacttaagcca

SEQ ID NO: 1126866 - DNA, 22 bp, Artificial Sequence
  chemically synthesized
gggagattaagtggcttaagtc

SEQ ID NO: 1126867 - DNA, 22 bp, Artificial Sequence
  chemically synthesized
ctcataaactatgtgacttaag

SEQ ID NO: 1126868 - DNA, 22 bp, Artificial Sequence
  chemically synthesized
tgctcataaactatgtgactta

SEQ ID NO: 1126869 - DNA, 22 bp, Artificial Sequence
  chemically synthesized
ctgctcataaactatgtgactt

SEQ ID NO: 1126870 - DNA, 22 bp, Artificial Sequence
  chemically synthesized
agtggcttaagtcacatagttt

SEQ ID NO: 1126871 - DNA, 22 bp, Artificial Sequence
  chemically synthesized
aagtcacatagtttatgagcag

SEQ ID NO: 1126872 - DNA, 22 bp, Artificial Sequence
  chemically synthesized
gccgtgcatcttctgctcataa

SEQ ID NO: 1126873 - DNA, 22 bp, Artificial Sequence
  chemically synthesized
agtcacatagtttatgagcaga

SEQ ID NO: 1126874 - DNA, 22 bp, Artificial Sequence
  chemically synthesized
tggccgtgcatcttctgctcat

SEQ ID NO: 1126875 - DNA, 22 bp, Artificial Sequence
  chemically synthesized
atgagcagaagatgcacggcca

SEQ ID NO: 1126876 - DNA, 22 bp, Artificial Sequence
  chemically synthesized
tgagcagaagatgcacggccag

SEQ ID NO: 1126877 - DNA, 22 bp, Artificial Sequence
  chemically synthesized
cacagatgggttctggccgtgc

SEQ ID NO: 1126878 - DNA, 22 bp, Artificial Sequence
  chemically synthesized
ctgcacagatgggttctggccg

SEQ ID NO: 1126879 - DNA, 22 bp, Artificial Sequence
  chemically synthesized
agagcagatgggcatattactg

SEQ ID NO: 1126880 - DNA, 22 bp, Artificial Sequence
  chemically synthesized
tgcagtaatatgcccatctgct

SEQ ID NO: 1126881 - DNA, 22 bp, Artificial Sequence
  chemically synthesized
ctctcagatctattccccacat

SEQ ID NO: 1126882 - DNA, 22 bp, Artificial Sequence
  chemically synthesized
tcagatctattccccacatttc

SEQ ID NO: 1126883 - DNA, 22 bp, Artificial Sequence
  chemically synthesized
agatctattccccacatttctt

SEQ ID NO: 1126884 - DNA, 22 bp, Artificial Sequence
  chemically synthesized
atacagaaagtacagaagaaat

SEQ ID NO: 1126885 - DNA, 22 bp, Artificial Sequence
  chemically synthesized
taatacagaaagtacagaagaa

SEQ ID NO: 1126886 - DNA, 22 bp, Artificial Sequence
  chemically synthesized
ttccccacatttcttctgtact

SEQ ID NO: 1126887 - DNA, 22 bp, Artificial Sequence
  chemically synthesized
cccacatttcttctgtactttc

SEQ ID NO: 1126888 - DNA, 22 bp, Artificial Sequence
  chemically synthesized
cttctgtactttctgtattaga

SEQ ID NO: 1126889 - DNA, 22 bp, Artificial Sequence
  chemically synthesized
ttctgtactttctgtattagag

SEQ ID NO: 1126890 - DNA, 22 bp, Artificial Sequence
  chemically synthesized
ctgtactttctgtattagaggg

SEQ ID NO: 1126891 - DNA, 22 bp, Artificial Sequence
  chemically synthesized
ggaaatgtatatccctctaata

SEQ ID NO: 1126892 - DNA, 22 bp, Artificial Sequence
  chemically synthesized
tgtactttctgtattagaggga

SEQ ID NO: 1126893 - DNA, 22 bp, Artificial Sequence
  chemically synthesized
tactttctgtattagagggata

SEQ ID NO: 1126894 - DNA, 22 bp, Artificial Sequence
  chemically synthesized
tctgtattagagggatatacat

SEQ ID NO: 1126895 - DNA, 22 bp, Artificial Sequence
  chemically synthesized
ctgtattagagggatatacatt

SEQ ID NO: 1126896 - DNA, 22 bp, Artificial Sequence
  chemically synthesized
tgtattagagggatatacattt

SEQ ID NO: 1126897 - DNA, 22 bp, Artificial Sequence
  chemically synthesized
tattagagggatatacatttcc

SEQ ID NO: 1126898 - DNA, 22 bp, Artificial Sequence
  chemically synthesized
gagggatatacatttcccaaca

SEQ ID NO: 1126899 - DNA, 22 bp, Artificial Sequence
  chemically synthesized
ggagggcaagtggtgttgggaa

SEQ ID NO: 1126900 - DNA, 22 bp, Artificial Sequence
  chemically synthesized
cccaacaccacttgccctccta

SEQ ID NO: 1126901 - DNA, 22 bp, Artificial Sequence
  chemically synthesized
caaatgaacaattaggagggca

SEQ ID NO: 1126902 - DNA, 22 bp, Artificial Sequence
  chemically synthesized
ccaacaccacttgccctcctaa

SEQ ID NO: 1126903 - DNA, 22 bp, Artificial Sequence
  chemically synthesized
cctccaaatgaacaattaggag

SEQ ID NO: 1126904 - DNA, 22 bp, Artificial Sequence
  chemically synthesized
ccattgcctccaaatgaacaat

SEQ ID NO: 1126905 - DNA, 22 bp, Artificial Sequence
  chemically synthesized
tgccattgcctccaaatgaaca

SEQ ID NO: 1126906 - DNA, 22 bp, Artificial Sequence
  chemically synthesized
gccctcctaattgttcatttgg

SEQ ID NO: 1126907 - DNA, 22 bp, Artificial Sequence
  chemically synthesized
ccctcctaattgttcatttgga

SEQ ID NO: 1126908 - DNA, 22 bp, Artificial Sequence
  chemically synthesized
ctaattgttcatttggaggcaa

SEQ ID NO: 1126909 - DNA, 22 bp, Artificial Sequence
  chemically synthesized
caatattctgccattgcctcca

SEQ ID NO: 1126910 - DNA, 22 bp, Artificial Sequence
  chemically synthesized
ccaatattctgccattgcctcc

SEQ ID NO: 1126911 - DNA, 22 bp, Artificial Sequence
  chemically synthesized
attgttcatttggaggcaatgg

SEQ ID NO: 1126912 - DNA, 22 bp, Artificial Sequence
  chemically synthesized
ttcatttggaggcaatggcaga

SEQ ID NO: 1126913 - DNA, 22 bp, Artificial Sequence
  chemically synthesized
ccaccttccaatattctgccat

SEQ ID NO: 1126914 - DNA, 22 bp, Artificial Sequence
  chemically synthesized
atttggaggcaatggcagaata

SEQ ID NO: 1126915 - DNA, 22 bp, Artificial Sequence
  chemically synthesized
ctcccaccttccaatattctgc

SEQ ID NO: 1126916 - DNA, 22 bp, Artificial Sequence
  chemically synthesized
cctcccaccttccaatattctg

SEQ ID NO: 1126917 - DNA, 22 bp, Artificial Sequence
  chemically synthesized
ggaggcaatggcagaatattgg

SEQ ID NO: 1126918 - DNA, 22 bp, Artificial Sequence
  chemically synthesized
gaggcaatggcagaatattgga

SEQ ID NO: 1126919 - DNA, 22 bp, Artificial Sequence
  chemically synthesized
ttcctcccaccttccaatattc

SEQ ID NO: 1126920 - DNA, 22 bp, Artificial Sequence
  chemically synthesized
tcttcctcccaccttccaatat

SEQ ID NO: 1126921 - DNA, 22 bp, Artificial Sequence
  chemically synthesized
ctcttcctcccaccttccaata

SEQ ID NO: 1126922 - DNA, 22 bp, Artificial Sequence
  chemically synthesized
tctcttcctcccaccttccaat

SEQ ID NO: 1126923 - DNA, 22 bp, Artificial Sequence
  chemically synthesized
ttctcttcctcccaccttccaa

SEQ ID NO: 1126924 - DNA, 22 bp, Artificial Sequence
  chemically synthesized
gcttttctcttcctcccacctt

SEQ ID NO: 1126925 - DNA, 22 bp, Artificial Sequence
  chemically synthesized
ggcttttctcttcctcccacct

SEQ ID NO: 1126926 - DNA, 22 bp, Artificial Sequence
  chemically synthesized
gaaggtgggaggaagagaaaag

SEQ ID NO: 1126927 - DNA, 22 bp, Artificial Sequence
  chemically synthesized
gagaagaaaaaagaccttggct

SEQ ID NO: 1126928 - DNA, 22 bp, Artificial Sequence
  chemically synthesized
gaaatgccacccaaggtagttg

SEQ ID NO: 1126929 - DNA, 22 bp, Artificial Sequence
  chemically synthesized
ttttcttctccaactaccttgg

SEQ ID NO: 1126930 - DNA, 22 bp, Artificial Sequence
  chemically synthesized
tagaaatgccacccaaggtagt

SEQ ID NO: 1126931 - DNA, 22 bp, Artificial Sequence
  chemically synthesized
tttcttctccaactaccttggg

SEQ ID NO: 1126932 - DNA, 22 bp, Artificial Sequence
  chemically synthesized
ttcttctccaactaccttgggt

SEQ ID NO: 1126933 - DNA, 22 bp, Artificial Sequence
  chemically synthesized
tcttctccaactaccttgggtg

SEQ ID NO: 1126934 - DNA, 22 bp, Artificial Sequence
  chemically synthesized
ctctagaaatgccacccaaggt

SEQ ID NO: 1126935 - DNA, 22 bp, Artificial Sequence
  chemically synthesized
cttctccaactaccttgggtgg

SEQ ID NO: 1126936 - DNA, 22 bp, Artificial Sequence
  chemically synthesized
ttctccaactaccttgggtggc

SEQ ID NO: 1126937 - DNA, 22 bp, Artificial Sequence
  chemically synthesized
ctccaactaccttgggtggcat

SEQ ID NO: 1126938 - DNA, 22 bp, Artificial Sequence
  chemically synthesized
tccaactaccttgggtggcatt

SEQ ID NO: 1126939 - DNA, 22 bp, Artificial Sequence
  chemically synthesized
caactaccttgggtggcatttc

SEQ ID NO: 1126940 - DNA, 22 bp, Artificial Sequence
  chemically synthesized
ccttgggtggcatttctagagc

SEQ ID NO: 1126941 - DNA, 22 bp, Artificial Sequence
  chemically synthesized
gggtggcatttctagagcagat

SEQ ID NO: 1126942 - DNA, 22 bp, Artificial Sequence
  chemically synthesized
ggtggcatttctagagcagatg

SEQ ID NO: 1126943 - DNA, 22 bp, Artificial Sequence
  chemically synthesized
ctagagcagatgtatctctgct

SEQ ID NO: 1126944 - DNA, 22 bp, Artificial Sequence
  chemically synthesized
tagagcagatgtatctctgctg

SEQ ID NO: 1126945 - DNA, 22 bp, Artificial Sequence
  chemically synthesized
gagcagatgtatctctgctgtg

SEQ ID NO: 1126946 - DNA, 22 bp, Artificial Sequence
  chemically synthesized
tccagagaaaacagaagccaca

SEQ ID NO: 1126947 - DNA, 22 bp, Artificial Sequence
  chemically synthesized
gctatccagagaaaacagaagc

SEQ ID NO: 1126948 - DNA, 22 bp, Artificial Sequence
  chemically synthesized
tgctgtggcttctgttttctct

SEQ ID NO: 1126949 - DNA, 22 bp, Artificial Sequence
  chemically synthesized
ctgtggcttctgttttctctgg

SEQ ID NO: 1126950 - DNA, 22 bp, Artificial Sequence
  chemically synthesized
tggcttctgttttctctggata

SEQ ID NO: 1126951 - DNA, 22 bp, Artificial Sequence
  chemically synthesized
aagagggagctagctatccaga

SEQ ID NO: 1126952 - DNA, 22 bp, Artificial Sequence
  chemically synthesized
ttgaagagggagctagctatcc

SEQ ID NO: 1126953 - DNA, 22 bp, Artificial Sequence
  chemically synthesized
ctgttttctctggatagctagc

SEQ ID NO: 1126954 - DNA, 22 bp, Artificial Sequence
  chemically synthesized
tgttttctctggatagctagct

SEQ ID NO: 1126955 - DNA, 22 bp, Artificial Sequence
  chemically synthesized
ttttctctggatagctagctcc

SEQ ID NO: 1126956 - DNA, 22 bp, Artificial Sequence
  chemically synthesized
gattgttgaagagggagctagc

SEQ ID NO: 1126957 - DNA, 22 bp, Artificial Sequence
  chemically synthesized
tctctggatagctagctccctc

SEQ ID NO: 1126958 - DNA, 22 bp, Artificial Sequence
  chemically synthesized
ctctggatagctagctccctct

SEQ ID NO: 1126959 - DNA, 22 bp, Artificial Sequence
  chemically synthesized
tctggatagctagctccctctt

SEQ ID NO: 1126960 - DNA, 22 bp, Artificial Sequence
  chemically synthesized
tggatagctagctccctcttca

SEQ ID NO: 1126961 - DNA, 22 bp, Artificial Sequence
  chemically synthesized
gatagctagctccctcttcaac

SEQ ID NO: 1126962 - DNA, 22 bp, Artificial Sequence
  chemically synthesized
ccaggcagaaaattggattgtt

SEQ ID NO: 1126963 - DNA, 22 bp, Artificial Sequence
  chemically synthesized
gctccctcttcaacaatccaat

SEQ ID NO: 1126964 - DNA, 22 bp, Artificial Sequence
  chemically synthesized
cctcttcaacaatccaattttc

SEQ ID NO: 1126965 - DNA, 22 bp, Artificial Sequence
  chemically synthesized
ggactgccaggcagaaaattgg

SEQ ID NO: 1126966 - DNA, 22 bp, Artificial Sequence
  chemically synthesized
ttcaacaatccaattttctgcc

SEQ ID NO: 1126967 - DNA, 22 bp, Artificial Sequence
  chemically synthesized
caacaatccaattttctgcctg

SEQ ID NO: 1126968 - DNA, 22 bp, Artificial Sequence
  chemically synthesized
aacaatccaattttctgcctgg

SEQ ID NO: 1126969 - DNA, 22 bp, Artificial Sequence
  chemically synthesized
aagttaggactgccaggcagaa

SEQ ID NO: 1126970 - DNA, 22 bp, Artificial Sequence
  chemically synthesized
aactaaagttaggactgccagg

SEQ ID NO: 1126971 - DNA, 22 bp, Artificial Sequence
  chemically synthesized
tctgcctggcagtcctaacttt

SEQ ID NO: 1126972 - DNA, 22 bp, Artificial Sequence
  chemically synthesized
ctgcctggcagtcctaacttta

SEQ ID NO: 1126973 - DNA, 22 bp, Artificial Sequence
  chemically synthesized
tgcctggcagtcctaactttag

SEQ ID NO: 1126974 - DNA, 22 bp, Artificial Sequence
  chemically synthesized
acagagattaaactaaagttag

SEQ ID NO: 1126975 - DNA, 22 bp, Artificial Sequence
  chemically synthesized
cctggcagtcctaactttagtt

SEQ ID NO: 1126976 - DNA, 22 bp, Artificial Sequence
  chemically synthesized
taacagagattaaactaaagtt

SEQ ID NO: 1126977 - DNA, 22 bp, Artificial Sequence
  chemically synthesized
ctaacagagattaaactaaagt

SEQ ID NO: 1126978 - DNA, 22 bp, Artificial Sequence
  chemically synthesized
tctaacagagattaaactaaag

SEQ ID NO: 1126979 - DNA, 22 bp, Artificial Sequence
  chemically synthesized
gcagtcctaactttagtttaat

SEQ ID NO: 1126980 - DNA, 22 bp, Artificial Sequence
  chemically synthesized
gggctttctaacagagattaaa

SEQ ID NO: 1126981 - DNA, 22 bp, Artificial Sequence
  chemically synthesized
actttagtttaatctctgttag

SEQ ID NO: 1126982 - DNA, 22 bp, Artificial Sequence
  chemically synthesized
agaagctggggctttctaacag

SEQ ID NO: 1126983 - DNA, 22 bp, Artificial Sequence
  chemically synthesized
tagtttaatctctgttagaaag

SEQ ID NO: 1126984 - DNA, 22 bp, Artificial Sequence
  chemically synthesized
agtttaatctctgttagaaagc

SEQ ID NO: 1126985 - DNA, 22 bp, Artificial Sequence
  chemically synthesized
gtttaatctctgttagaaagcc

SEQ ID NO: 1126986 - DNA, 22 bp, Artificial Sequence
  chemically synthesized
aatctctgttagaaagccccag

SEQ ID NO: 1126987 - DNA, 22 bp, Artificial Sequence
  chemically synthesized
atctctgttagaaagccccagc

SEQ ID NO: 1126988 - DNA, 22 bp, Artificial Sequence
  chemically synthesized
ccagagctcagaagctggggct

SEQ ID NO: 1126989 - DNA, 22 bp, Artificial Sequence
  chemically synthesized
tgttagaaagccccagcttctg

SEQ ID NO: 1126990 - DNA, 22 bp, Artificial Sequence
  chemically synthesized
ttagaaagccccagcttctgag

SEQ ID NO: 1126991 - DNA, 22 bp, Artificial Sequence
  chemically synthesized
gaaagccccagcttctgagctc

SEQ ID NO: 1126992 - DNA, 22 bp, Artificial Sequence
  chemically synthesized
ctgagctctggtaatatcactt

SEQ ID NO: 1126993 - DNA, 22 bp, Artificial Sequence
  chemically synthesized
tgagctctggtaatatcacttt

SEQ ID NO: 1126994 - DNA, 22 bp, Artificial Sequence
  chemically synthesized
agctctggtaatatcacttttt

SEQ ID NO: 1126995 - DNA, 22 bp, Artificial Sequence
  chemically synthesized
gagaaacaatacagaaaaagtg

SEQ ID NO: 1126996 - DNA, 22 bp, Artificial Sequence
  chemically synthesized
tggtaatatcactttttctgta

SEQ ID NO: 1126997 - DNA, 22 bp, Artificial Sequence
  chemically synthesized
gtaatatcactttttctgtatt

SEQ ID NO: 1126998 - DNA, 22 bp, Artificial Sequence
  chemically synthesized
gagctggagaaacaatacagaa

SEQ ID NO: 1126999 - DNA, 22 bp, Artificial Sequence
  chemically synthesized
atatccctagagctggagaaac

SEQ ID NO: 1127000 - DNA, 22 bp, Artificial Sequence
  chemically synthesized
tttctgtattgtttctccagct

SEQ ID NO: 1127001 - DNA, 22 bp, Artificial Sequence
  chemically synthesized
ttctgtattgtttctccagctc

SEQ ID NO: 1127002 - DNA, 22 bp, Artificial Sequence
  chemically synthesized
ctaatatccctagagctggaga

SEQ ID NO: 1127003 - DNA, 22 bp, Artificial Sequence
  chemically synthesized
tctgtattgtttctccagctct

SEQ ID NO: 1127004 - DNA, 22 bp, Artificial Sequence
  chemically synthesized
ctgtattgtttctccagctcta

SEQ ID NO: 1127005 - DNA, 22 bp, Artificial Sequence
  chemically synthesized
tgtattgtttctccagctctag

SEQ ID NO: 1127006 - DNA, 22 bp, Artificial Sequence
  chemically synthesized
tattgtttctccagctctaggg

SEQ ID NO: 1127007 - DNA, 22 bp, Artificial Sequence
  chemically synthesized
tttctccagctctagggatatt

SEQ ID NO: 1127008 - DNA, 22 bp, Artificial Sequence
  chemically synthesized
ctccagctctagggatattagc

SEQ ID NO: 1127009 - DNA, 22 bp, Artificial Sequence
  chemically synthesized
tccagctctagggatattagca

SEQ ID NO: 1127010 - DNA, 22 bp, Artificial Sequence
  chemically synthesized
cagctctagggatattagcagc

SEQ ID NO: 1127011 - DNA, 22 bp, Artificial Sequence
  chemically synthesized
gtaacgtaaggaagctgctaat

SEQ ID NO: 1127012 - DNA, 22 bp, Artificial Sequence
  chemically synthesized
tagggatattagcagcttcctt

SEQ ID NO: 1127013 - DNA, 22 bp, Artificial Sequence
  chemically synthesized
gggatattagcagcttccttac

SEQ ID NO: 1127014 - DNA, 22 bp, Artificial Sequence
  chemically synthesized
aaagcactagtaacgtaaggaa

SEQ ID NO: 1127015 - DNA, 22 bp, Artificial Sequence
  chemically synthesized
gcagcttccttacgttactagt

SEQ ID NO: 1127016 - DNA, 22 bp, Artificial Sequence
  chemically synthesized
ccttacgttactagtgctttga

SEQ ID NO: 1127017 - DNA, 22 bp, Artificial Sequence
  chemically synthesized
cttacgttactagtgctttgag

SEQ ID NO: 1127018 - DNA, 22 bp, Artificial Sequence
  chemically synthesized
acgttactagtgctttgagttg

SEQ ID NO: 1127019 - DNA, 22 bp, Artificial Sequence
  chemically synthesized
cgttactagtgctttgagttgc

SEQ ID NO: 1127020 - DNA, 22 bp, Artificial Sequence
  chemically synthesized
ctagtgctttgagttgcctctc

SEQ ID NO: 1127021 - DNA, 22 bp, Artificial Sequence
  chemically synthesized
gtgctttgagttgcctctccat

SEQ ID NO: 1127022 - DNA, 22 bp, Artificial Sequence
  chemically synthesized
agacgcagcgcaggggatggag

SEQ ID NO: 1127023 - DNA, 22 bp, Artificial Sequence
  chemically synthesized
tgagttgcctctccatcccctg

SEQ ID NO: 1127024 - DNA, 22 bp, Artificial Sequence
  chemically synthesized
gagttgcctctccatcccctgc

SEQ ID NO: 1127025 - DNA, 22 bp, Artificial Sequence
  chemically synthesized
agttgcctctccatcccctgcg

SEQ ID NO: 1127026 - DNA, 22 bp, Artificial Sequence
  chemically synthesized
cctctccatcccctgcgctgcg

SEQ ID NO: 1127027 - DNA, 22 bp, Artificial Sequence
  chemically synthesized
tccatcccctgcgctgcgtctc

SEQ ID NO: 1127028 - DNA, 22 bp, Artificial Sequence
  chemically synthesized
catcccctgcgctgcgtctcag

SEQ ID NO: 1127029 - DNA, 22 bp, Artificial Sequence
  chemically synthesized
agcaggtagtagaaaactgaga

SEQ ID NO: 1127030 - DNA, 22 bp, Artificial Sequence
  chemically synthesized
gctaagcaggtagtagaaaact

SEQ ID NO: 1127031 - DNA, 22 bp, Artificial Sequence
  chemically synthesized
cgctgcgtctcagttttctact

SEQ ID NO: 1127032 - DNA, 22 bp, Artificial Sequence
  chemically synthesized
cgtctcagttttctactacctg

SEQ ID NO: 1127033 - DNA, 22 bp, Artificial Sequence
  chemically synthesized
agttttctactacctgcttagc

SEQ ID NO: 1127034 - DNA, 22 bp, Artificial Sequence
  chemically synthesized
tctactacctgcttagccaatt

SEQ ID NO: 1127035 - DNA, 22 bp, Artificial Sequence
  chemically synthesized
ctactacctgcttagccaattc

SEQ ID NO: 1127036 - DNA, 22 bp, Artificial Sequence
  chemically synthesized
tactacctgcttagccaattcc

SEQ ID NO: 1127037 - DNA, 22 bp, Artificial Sequence
  chemically synthesized
ctacctgcttagccaattcctt

SEQ ID NO: 1127038 - DNA, 22 bp, Artificial Sequence
  chemically synthesized
cctgcttagccaattccttata

SEQ ID NO: 1127039 - DNA, 22 bp, Artificial Sequence
  chemically synthesized
cttagccaattccttatattac

SEQ ID NO: 1127040 - DNA, 22 bp, Artificial Sequence
  chemically synthesized
aagagaggaaacgtaatataag

SEQ ID NO: 1127041 - DNA, 22 bp, Artificial Sequence
  chemically synthesized
aaagagaggaaacgtaatataa

SEQ ID NO: 1127042 - DNA, 22 bp, Artificial Sequence
  chemically synthesized
agccaattccttatattacgtt

SEQ ID NO: 1127043 - DNA, 22 bp, Artificial Sequence
  chemically synthesized
gccaattccttatattacgttt

SEQ ID NO: 1127044 - DNA, 22 bp, Artificial Sequence
  chemically synthesized
tgatttaaagagaggaaacgta

SEQ ID NO: 1127045 - DNA, 22 bp, Artificial Sequence
  chemically synthesized
cttatattacgtttcctctctt

SEQ ID NO: 1127046 - DNA, 22 bp, Artificial Sequence
  chemically synthesized
atattacgtttcctctctttaa

SEQ ID NO: 1127047 - DNA, 22 bp, Artificial Sequence
  chemically synthesized
tattacgtttcctctctttaaa

SEQ ID NO: 1127048 - DNA, 22 bp, Artificial Sequence
  chemically synthesized
cgtttcctctctttaaatcaca

SEQ ID NO: 1127049 - DNA, 22 bp, Artificial Sequence
  chemically synthesized
cctctctttaaatcacagtgat

SEQ ID NO: 1127050 - DNA, 22 bp, Artificial Sequence
  chemically synthesized
ctctctttaaatcacagtgatt

SEQ ID NO: 1127051 - DNA, 22 bp, Artificial Sequence
  chemically synthesized
tcagaaaaacaaaatcactgtg

SEQ ID NO: 1127052 - DNA, 22 bp, Artificial Sequence
  chemically synthesized
gtcagaaaaacaaaatcactgt

SEQ ID NO: 1127053 - DNA, 22 bp, Artificial Sequence
  chemically synthesized
tctttaaatcacagtgattttg

SEQ ID NO: 1127054 - DNA, 22 bp, Artificial Sequence
  chemically synthesized
tttaaatcacagtgattttgtt

SEQ ID NO: 1127055 - DNA, 22 bp, Artificial Sequence
  chemically synthesized
taaatcacagtgattttgtttt

SEQ ID NO: 1127056 - DNA, 22 bp, Artificial Sequence
  chemically synthesized
aaatcacagtgattttgttttt

SEQ ID NO: 1127057 - DNA, 22 bp, Artificial Sequence
  chemically synthesized
aatcacagtgattttgtttttc

SEQ ID NO: 1127058 - DNA, 22 bp, Artificial Sequence
  chemically synthesized
tgcgagtcttgtcagaaaaaca

SEQ ID NO: 1127059 - DNA, 22 bp, Artificial Sequence
  chemically synthesized
gtgcgagtcttgtcagaaaaac

SEQ ID NO: 1127060 - DNA, 22 bp, Artificial Sequence
  chemically synthesized
tgtgcgagtcttgtcagaaaaa

SEQ ID NO: 1127061 - DNA, 22 bp, Artificial Sequence
  chemically synthesized
caggttttgtgcgagtcttgtc

SEQ ID NO: 1127062 - DNA, 22 bp, Artificial Sequence
  chemically synthesized
ccaggttttgtgcgagtcttgt

SEQ ID NO: 1127063 - DNA, 22 bp, Artificial Sequence
  chemically synthesized
tccaggttttgtgcgagtcttg

SEQ ID NO: 1127064 - DNA, 22 bp, Artificial Sequence
  chemically synthesized
tgtttttctgacaagactcgca

SEQ ID NO: 1127065 - DNA, 22 bp, Artificial Sequence
  chemically synthesized
gtttttctgacaagactcgcac

SEQ ID NO: 1127066 - DNA, 22 bp, Artificial Sequence
  chemically synthesized
tttttctgacaagactcgcaca

SEQ ID NO: 1127067 - DNA, 22 bp, Artificial Sequence
  chemically synthesized
ttctgacaagactcgcacaaaa

SEQ ID NO: 1127068 - DNA, 22 bp, Artificial Sequence
  chemically synthesized
tctgacaagactcgcacaaaac

SEQ ID NO: 1127069 - DNA, 22 bp, Artificial Sequence
  chemically synthesized
ctgacaagactcgcacaaaacc

SEQ ID NO: 1127070 - DNA, 22 bp, Artificial Sequence
  chemically synthesized
tgacaagactcgcacaaaacct

SEQ ID NO: 1127071 - DNA, 22 bp, Artificial Sequence
  chemically synthesized
acaagactcgcacaaaacctgg

SEQ ID NO: 1127072 - DNA, 22 bp, Artificial Sequence
  chemically synthesized
atgagggattttccaggttttg

SEQ ID NO: 1127073 - DNA, 22 bp, Artificial Sequence
  chemically synthesized
gatgttgatgagggattttcca

SEQ ID NO: 1127074 - DNA, 22 bp, Artificial Sequence
  chemically synthesized
gcacaaaacctggaaaatccct

SEQ ID NO: 1127075 - DNA, 22 bp, Artificial Sequence
  chemically synthesized
ttggatgttgatgagggatttt

SEQ ID NO: 1127076 - DNA, 22 bp, Artificial Sequence
  chemically synthesized
attggatgttgatgagggattt

SEQ ID NO: 1127077 - DNA, 22 bp, Artificial Sequence
  chemically synthesized
gaaaatccctcatcaacatcca

SEQ ID NO: 1127078 - DNA, 22 bp, Artificial Sequence
  chemically synthesized
aataaatatttattggatgttg

SEQ ID NO: 1127079 - DNA, 22 bp, Artificial Sequence
  chemically synthesized
atcaacatccaataaatattta

SEQ ID NO: 1127080 - DNA, 22 bp, Artificial Sequence
  chemically synthesized
atagtaggtattgaataaatat

SEQ ID NO: 1127081 - DNA, 22 bp, Artificial Sequence
  chemically synthesized
attcaatacctactatgagctg

SEQ ID NO: 1127082 - DNA, 22 bp, Artificial Sequence
  chemically synthesized
ttcaatacctactatgagctga

SEQ ID NO: 1127083 - DNA, 22 bp, Artificial Sequence
  chemically synthesized
aatacctactatgagctgactt

SEQ ID NO: 1127084 - DNA, 22 bp, Artificial Sequence
  chemically synthesized
taatgcataaagcagaagtcag

SEQ ID NO: 1127085 - DNA, 22 bp, Artificial Sequence
  chemically synthesized
ctatgagctgacttctgcttta

SEQ ID NO: 1127086 - DNA, 22 bp, Artificial Sequence
  chemically synthesized
tgagctgacttctgctttatgc

SEQ ID NO: 1127087 - DNA, 22 bp, Artificial Sequence
  chemically synthesized
tacacctataatgcataaagca

SEQ ID NO: 1127088 - DNA, 22 bp, Artificial Sequence
  chemically synthesized
acttctgctttatgcattatag

SEQ ID NO: 1127089 - DNA, 22 bp, Artificial Sequence
  chemically synthesized
tcatctgtacacctataatgca

SEQ ID NO: 1127090 - DNA, 22 bp, Artificial Sequence
  chemically synthesized
gtcatctgtacacctataatgc

SEQ ID NO: 1127091 - DNA, 22 bp, Artificial Sequence
  chemically synthesized
ttgtcatctgtacacctataat

SEQ ID NO: 1127092 - DNA, 22 bp, Artificial Sequence
  chemically synthesized
ctgctttatgcattataggtgt

SEQ ID NO: 1127093 - DNA, 22 bp, Artificial Sequence
  chemically synthesized
cttgtcatctgtacacctataa

SEQ ID NO: 1127094 - DNA, 22 bp, Artificial Sequence
  chemically synthesized
tgctttatgcattataggtgta

SEQ ID NO: 1127095 - DNA, 22 bp, Artificial Sequence
  chemically synthesized
ctttatgcattataggtgtaca

SEQ ID NO: 1127096 - DNA, 22 bp, Artificial Sequence
  chemically synthesized
tatgcattataggtgtacagat

SEQ ID NO: 1127097 - DNA, 22 bp, Artificial Sequence
  chemically synthesized
atgcattataggtgtacagatg

SEQ ID NO: 1127098 - DNA, 22 bp, Artificial Sequence
  chemically synthesized
tgcattataggtgtacagatga

SEQ ID NO: 1127099 - DNA, 22 bp, Artificial Sequence
  chemically synthesized
taggtgtacagatgacaagaaa

SEQ ID NO: 1127100 - DNA, 22 bp, Artificial Sequence
  chemically synthesized
agggaagaaatcatttcttgtc

SEQ ID NO: 1127101 - DNA, 22 bp, Artificial Sequence
  chemically synthesized
gagggaagaaatcatttcttgt

SEQ ID NO: 1127102 - DNA, 22 bp, Artificial Sequence
  chemically synthesized
cagtaaacgccttgagggaaga

SEQ ID NO: 1127103 - DNA, 22 bp, Artificial Sequence
  chemically synthesized
tatctccagtaaacgccttgag

SEQ ID NO: 1127104 - DNA, 22 bp, Artificial Sequence
  chemically synthesized
cttccctcaaggcgtttactgg

SEQ ID NO: 1127105 - DNA, 22 bp, Artificial Sequence
  chemically synthesized
ttccctcaaggcgtttactgga

SEQ ID NO: 1127106 - DNA, 22 bp, Artificial Sequence
  chemically synthesized
catgcctgtatctccagtaaac

SEQ ID NO: 1127107 - DNA, 22 bp, Artificial Sequence
  chemically synthesized
gcatgcctgtatctccagtaaa

SEQ ID NO: 1127108 - DNA, 22 bp, Artificial Sequence
  chemically synthesized
ccctcaaggcgtttactggaga

SEQ ID NO: 1127109 - DNA, 22 bp, Artificial Sequence
  chemically synthesized
tgcatgcctgtatctccagtaa

SEQ ID NO: 1127110 - DNA, 22 bp, Artificial Sequence
  chemically synthesized
cctcaaggcgtttactggagat

SEQ ID NO: 1127111 - DNA, 22 bp, Artificial Sequence
  chemically synthesized
ttgcatgcctgtatctccagta

SEQ ID NO: 1127112 - DNA, 22 bp, Artificial Sequence
  chemically synthesized
tttttgcatgcctgtatctcca

SEQ ID NO: 1127113 - DNA, 22 bp, Artificial Sequence
  chemically synthesized
aaggcgtttactggagatacag

SEQ ID NO: 1127114 - DNA, 22 bp, Artificial Sequence
  chemically synthesized
atttttgcatgcctgtatctcc

SEQ ID NO: 1127115 - DNA, 22 bp, Artificial Sequence
  chemically synthesized
tatttttgcatgcctgtatctc

SEQ ID NO: 1127116 - DNA, 22 bp, Artificial Sequence
  chemically synthesized
actggagatacaggcatgcaaa

SEQ ID NO: 1127117 - DNA, 22 bp, Artificial Sequence
  chemically synthesized
ctggagatacaggcatgcaaaa

SEQ ID NO: 1127118 - DNA, 22 bp, Artificial Sequence
  chemically synthesized
gagatacaggcatgcaaaaata

SEQ ID NO: 1127119 - DNA, 22 bp, Artificial Sequence
  chemically synthesized
tatggtaatgactttatttttg

SEQ ID NO: 1127120 - DNA, 22 bp, Artificial Sequence
  chemically synthesized
ccaaattgtatggtaatgactt

SEQ ID NO: 1127121 - DNA, 22 bp, Artificial Sequence
  chemically synthesized
gccaaattgtatggtaatgact

SEQ ID NO: 1127122 - DNA, 22 bp, Artificial Sequence
  chemically synthesized
aaacacttgccaaattgtatgg

SEQ ID NO: 1127123 - DNA, 22 bp, Artificial Sequence
  chemically synthesized
ttaaaacacttgccaaattgta

SEQ ID NO: 1127124 - DNA, 22 bp, Artificial Sequence
  chemically synthesized
tattaaaacacttgccaaattg

SEQ ID NO: 1127125 - DNA, 22 bp, Artificial Sequence
  chemically synthesized
ctattaaaacacttgccaaatt

SEQ ID NO: 1127126 - DNA, 22 bp, Artificial Sequence
  chemically synthesized
ccatacaatttggcaagtgttt

SEQ ID NO: 1127127 - DNA, 22 bp, Artificial Sequence
  chemically synthesized
acacttctattaaaacacttgc

SEQ ID NO: 1127128 - DNA, 22 bp, Artificial Sequence
  chemically synthesized
aacacttctattaaaacacttg

SEQ ID NO: 1127129 - DNA, 22 bp, Artificial Sequence
  chemically synthesized
taacacttctattaaaacactt

SEQ ID NO: 1127130 - DNA, 22 bp, Artificial Sequence
  chemically synthesized
ttaacacttctattaaaacact

SEQ ID NO: 1127131 - DNA, 22 bp, Artificial Sequence
  chemically synthesized
tttaacacttctattaaaacac

SEQ ID NO: 1127132 - DNA, 22 bp, Artificial Sequence
  chemically synthesized
agcctttttaacacttctatta

SEQ ID NO: 1127133 - DNA, 22 bp, Artificial Sequence
  chemically synthesized
ggcaagtgttttaatagaagtg

SEQ ID NO: 1127134 - DNA, 22 bp, Artificial Sequence
  chemically synthesized
gcaagtgttttaatagaagtgt

SEQ ID NO: 1127135 - DNA, 22 bp, Artificial Sequence
  chemically synthesized
tcagcctttttaacacttctat

SEQ ID NO: 1127136 - DNA, 22 bp, Artificial Sequence
  chemically synthesized
ctcagcctttttaacacttcta

SEQ ID NO: 1127137 - DNA, 22 bp, Artificial Sequence
  chemically synthesized
taatagaagtgttaaaaaggct

SEQ ID NO: 1127138 - DNA, 22 bp, Artificial Sequence
  chemically synthesized
aatagaagtgttaaaaaggctg

SEQ ID NO: 1127139 - DNA, 22 bp, Artificial Sequence
  chemically synthesized
atagaagtgttaaaaaggctga

SEQ ID NO: 1127140 - DNA, 22 bp, Artificial Sequence
  chemically synthesized
aaaaggctgagaagtggcctgg

SEQ ID NO: 1127141 - DNA, 22 bp, Artificial Sequence
  chemically synthesized
gaggcatgagccacagtgccag

SEQ ID NO: 1127142 - DNA, 22 bp, Artificial Sequence
  chemically synthesized
agaagtggcctggcactgtggc

SEQ ID NO: 1127143 - DNA, 22 bp, Artificial Sequence
  chemically synthesized
ggattagaggcatgagccacag

SEQ ID NO: 1127144 - DNA, 22 bp, Artificial Sequence
  chemically synthesized
gcactgtggctcatgcctctaa

SEQ ID NO: 1127145 - DNA, 22 bp, Artificial Sequence
  chemically synthesized
ccaaagtactgggattagaggc

SEQ ID NO: 1127146 - DNA, 22 bp, Artificial Sequence
  chemically synthesized
tggctcatgcctctaatcccag

SEQ ID NO: 1127147 - DNA, 22 bp, Artificial Sequence
  chemically synthesized
aggcctcccaaagtactgggat

SEQ ID NO: 1127148 - DNA, 22 bp, Artificial Sequence
  chemically synthesized
atgcctctaatcccagtacttt

SEQ ID NO: 1127149 - DNA, 22 bp, Artificial Sequence
  chemically synthesized
ctaaggcctcccaaagtactgg

SEQ ID NO: 1127150 - DNA, 22 bp, Artificial Sequence
  chemically synthesized
taatcccagtactttgggaggc

SEQ ID NO: 1127151 - DNA, 22 bp, Artificial Sequence
  chemically synthesized
atcccagtactttgggaggcct

SEQ ID NO: 1127152 - DNA, 22 bp, Artificial Sequence
  chemically synthesized
atgatccgactgctaaggcctc

SEQ ID NO: 1127153 - DNA, 22 bp, Artificial Sequence
  chemically synthesized
acctcatgatccgactgctaag

SEQ ID NO: 1127154 - DNA, 22 bp, Artificial Sequence
  chemically synthesized
ttgacctcatgatccgactgct

SEQ ID NO: 1127155 - DNA, 22 bp, Artificial Sequence
  chemically synthesized
tgggaggccttagcagtcggat

SEQ ID NO: 1127156 - DNA, 22 bp, Artificial Sequence
  chemically synthesized
gggaggccttagcagtcggatc

SEQ ID NO: 1127157 - DNA, 22 bp, Artificial Sequence
  chemically synthesized
ggaggccttagcagtcggatca

SEQ ID NO: 1127158 - DNA, 22 bp, Artificial Sequence
  chemically synthesized
atctgttgacctcatgatccga

SEQ ID NO: 1127159 - DNA, 22 bp, Artificial Sequence
  chemically synthesized
gatctgttgacctcatgatccg

SEQ ID NO: 1127160 - DNA, 22 bp, Artificial Sequence
  chemically synthesized
agcagtcggatcatgaggtcaa

SEQ ID NO: 1127161 - DNA, 22 bp, Artificial Sequence
  chemically synthesized
gcagtcggatcatgaggtcaac

SEQ ID NO: 1127162 - DNA, 22 bp, Artificial Sequence
  chemically synthesized
ggatgggcttgatctgttgacc

SEQ ID NO: 1127163 - DNA, 22 bp, Artificial Sequence
  chemically synthesized
gctaggatgggcttgatctgtt

SEQ ID NO: 1127164 - DNA, 22 bp, Artificial Sequence
  chemically synthesized
accgtgttggctaggatgggct

SEQ ID NO: 1127165 - DNA, 22 bp, Artificial Sequence
  chemically synthesized
caccgtgttggctaggatgggc

SEQ ID NO: 1127166 - DNA, 22 bp, Artificial Sequence
  chemically synthesized
gtagagatggggtttcaccgtg

SEQ ID NO: 1127167 - DNA, 22 bp, Artificial Sequence
  chemically synthesized
agtagagatggggtttcaccgt

SEQ ID NO: 1127168 - DNA, 22 bp, Artificial Sequence
  chemically synthesized
tagtagagatggggtttcaccg

SEQ ID NO: 1127169 - DNA, 22 bp, Artificial Sequence
  chemically synthesized
ttagtagagatggggtttcacc

SEQ ID NO: 1127170 - DNA, 22 bp, Artificial Sequence
  chemically synthesized
gccaacacggtgaaaccccatc

SEQ ID NO: 1127171 - DNA, 22 bp, Artificial Sequence
  chemically synthesized
tatttttagtagagatggggtt

SEQ ID NO: 1127172 - DNA, 22 bp, Artificial Sequence
  chemically synthesized
gtatttttagtagagatggggt

SEQ ID NO: 1127173 - DNA, 22 bp, Artificial Sequence
  chemically synthesized
tgtatttttagtagagatgggg

SEQ ID NO: 1127174 - DNA, 22 bp, Artificial Sequence
  chemically synthesized
ttgtatttttagtagagatggg

SEQ ID NO: 1127175 - DNA, 22 bp, Artificial Sequence
  chemically synthesized
atttttgtatttttagtagaga

SEQ ID NO: 1127176 - DNA, 22 bp, Artificial Sequence
  chemically synthesized
tactaaaaatacaaaaattagc

SEQ ID NO: 1127177 - DNA, 22 bp, Artificial Sequence
  chemically synthesized
ctaaaaatacaaaaattagctg

SEQ ID NO: 1127178 - DNA, 22 bp, Artificial Sequence
  chemically synthesized
aaaatacaaaaattagctgggc

SEQ ID NO: 1127179 - DNA, 22 bp, Artificial Sequence
  chemically synthesized
caggcaagggccaccatgccca

SEQ ID NO: 1127180 - DNA, 22 bp, Artificial Sequence
  chemically synthesized
gcactacaggcaagggccacca

SEQ ID NO: 1127181 - DNA, 22 bp, Artificial Sequence
  chemically synthesized
gctgggcatggtggcccttgcc

SEQ ID NO: 1127182 - DNA, 22 bp, Artificial Sequence
  chemically synthesized
ggcatggtggcccttgcctgta

SEQ ID NO: 1127183 - DNA, 22 bp, Artificial Sequence
  chemically synthesized
ccaagtagctggcactacaggc

SEQ ID NO: 1127184 - DNA, 22 bp, Artificial Sequence
  chemically synthesized
agcctcccaagtagctggcact

SEQ ID NO: 1127185 - DNA, 22 bp, Artificial Sequence
  chemically synthesized
cctcagcctcccaagtagctgg

SEQ ID NO: 1127186 - DNA, 22 bp, Artificial Sequence
  chemically synthesized
gcctgtagtgccagctacttgg

SEQ ID NO: 1127187 - DNA, 22 bp, Artificial Sequence
  chemically synthesized
cctgtagtgccagctacttggg

SEQ ID NO: 1127188 - DNA, 22 bp, Artificial Sequence
  chemically synthesized
tcctgcctcagcctcccaagta

SEQ ID NO: 1127189 - DNA, 22 bp, Artificial Sequence
  chemically synthesized
tagtgccagctacttgggaggc

SEQ ID NO: 1127190 - DNA, 22 bp, Artificial Sequence
  chemically synthesized
aagcgattgtcctgcctcagcc

SEQ ID NO: 1127191 - DNA, 22 bp, Artificial Sequence
  chemically synthesized
cttgggaggctgaggcaggaca

SEQ ID NO: 1127192 - DNA, 22 bp, Artificial Sequence
  chemically synthesized
gggaggctgaggcaggacaatc

SEQ ID NO: 1127193 - DNA, 22 bp, Artificial Sequence
  chemically synthesized
ggaggctgaggcaggacaatcg

SEQ ID NO: 1127194 - DNA, 22 bp, Artificial Sequence
  chemically synthesized
ccccgtgggttcaagcgattgt

SEQ ID NO: 1127195 - DNA, 22 bp, Artificial Sequence
  chemically synthesized
tgccccgtgggttcaagcgatt

SEQ ID NO: 1127196 - DNA, 22 bp, Artificial Sequence
  chemically synthesized
aggcaggacaatcgcttgaacc

SEQ ID NO: 1127197 - DNA, 22 bp, Artificial Sequence
  chemically synthesized
catcctctgccccgtgggttca

SEQ ID NO: 1127198 - DNA, 22 bp, Artificial Sequence
  chemically synthesized
ctgcatcctctgccccgtgggt

SEQ ID NO: 1127199 - DNA, 22 bp, Artificial Sequence
  chemically synthesized
actgcatcctctgccccgtggg

SEQ ID NO: 1127200 - DNA, 22 bp, Artificial Sequence
  chemically synthesized
agcttactgcatcctctgcccc

SEQ ID NO: 1127201 - DNA, 22 bp, Artificial Sequence
  chemically synthesized
gaacccacggggcagaggatgc

SEQ ID NO: 1127202 - DNA, 22 bp, Artificial Sequence
  chemically synthesized
aacccacggggcagaggatgca

SEQ ID NO: 1127203 - DNA, 22 bp, Artificial Sequence
  chemically synthesized
gagtgcagtggcgcgatctcag

SEQ ID NO: 1127204 - DNA, 22 bp, Artificial Sequence
  chemically synthesized
ccagtctggagtgcagtggcgc

SEQ ID NO: 1127205 - DNA, 22 bp, Artificial Sequence
  chemically synthesized
ttgccagtctggagtgcagtgg

SEQ ID NO: 1127206 - DNA, 22 bp, Artificial Sequence
  chemically synthesized
tgttgccagtctggagtgcagt

SEQ ID NO: 1127207 - DNA, 22 bp, Artificial Sequence
  chemically synthesized
agatcgcgccactgcactccag

SEQ ID NO: 1127208 - DNA, 22 bp, Artificial Sequence
  chemically synthesized
actctgttgccagtctggagtg

SEQ ID NO: 1127209 - DNA, 22 bp, Artificial Sequence
  chemically synthesized
cactccagactggcaacagagt

SEQ ID NO: 1127210 - DNA, 22 bp, Artificial Sequence
  chemically synthesized
gagacggagtctcactctgttg

SEQ ID NO: 1127211 - DNA, 22 bp, Artificial Sequence
  chemically synthesized
ggagacggagtctcactctgtt

SEQ ID NO: 1127212 - DNA, 22 bp, Artificial Sequence
  chemically synthesized
tggagacggagtctcactctgt

SEQ ID NO: 1127213 - DNA, 22 bp, Artificial Sequence
  chemically synthesized
ttggagacggagtctcactctg

SEQ ID NO: 1127214 - DNA, 22 bp, Artificial Sequence
  chemically synthesized
cagactggcaacagagtgagac

SEQ ID NO: 1127215 - DNA, 22 bp, Artificial Sequence
  chemically synthesized
tttggagacggagtctcactct

SEQ ID NO: 1127216 - DNA, 22 bp, Artificial Sequence
  chemically synthesized
ttttggagacggagtctcactc

SEQ ID NO: 1127217 - DNA, 22 bp, Artificial Sequence
  chemically synthesized
tttttggagacggagtctcact

SEQ ID NO: 1127218 - DNA, 22 bp, Artificial Sequence
  chemically synthesized
ttttttggagacggagtctcac

SEQ ID NO: 1127219 - DNA, 22 bp, Artificial Sequence
  chemically synthesized
tttttttggagacggagtctca

SEQ ID NO: 1127220 - DNA, 22 bp, Artificial Sequence
  chemically synthesized
ttttttttggagacggagtctc

SEQ ID NO: 1127221 - DNA, 22 bp, Artificial Sequence
  chemically synthesized
tttttttttggagacggagtct

SEQ ID NO: 1127222 - DNA, 22 bp, Artificial Sequence
  chemically synthesized
gcaacagagtgagactccgtct

SEQ ID NO: 1127223 - DNA, 22 bp, Artificial Sequence
  chemically synthesized
ttttttttttggagacggagtc

SEQ ID NO: 1127224 - DNA, 22 bp, Artificial Sequence
  chemically synthesized
tttttttttttggagacggagt

SEQ ID NO: 1127225 - DNA, 22 bp, Artificial Sequence
  chemically synthesized
ttttttttttttggagacggag

SEQ ID NO: 1127226 - DNA, 22 bp, Artificial Sequence
  chemically synthesized
tttttttttttttggagacgga

SEQ ID NO: 1127227 - DNA, 22 bp, Artificial Sequence
  chemically synthesized
ttttttttttttttggagacgg

SEQ ID NO: 1127228 - DNA, 22 bp, Artificial Sequence
  chemically synthesized
tttttttttttttttggagacg

SEQ ID NO: 1127229 - DNA, 22 bp, Artificial Sequence
  chemically synthesized
ttttttttttttttttggagac

SEQ ID NO: 1127230 - DNA, 22 bp, Artificial Sequence
  chemically synthesized
tttttttttttttttttggaga

SEQ ID NO: 1127231 - DNA, 22 bp, Artificial Sequence
  chemically synthesized
ttttttttttttttttttggag

SEQ ID NO: 1127232 - DNA, 22 bp, Artificial Sequence
  chemically synthesized
tttttttttttttttttttgga

SEQ ID NO: 1127233 - DNA, 22 bp, Artificial Sequence
  chemically synthesized
ttttttttttttttttttttgg

SEQ ID NO: 1127234 - DNA, 22 bp, Artificial Sequence
  chemically synthesized
tttttttttttttttttttttg

SEQ ID NO: 1127235 - DNA, 22 bp, Artificial Sequence
  chemically synthesized
cgtctccaaaaaaaaaaaaaaa

SEQ ID NO: 1127236 - DNA, 22 bp, Artificial Sequence
  chemically synthesized
tgtgtttttttttttttttttt

SEQ ID NO: 1127237 - DNA, 22 bp, Artificial Sequence
  chemically synthesized
gtgtgttttttttttttttttt

SEQ ID NO: 1127238 - DNA, 22 bp, Artificial Sequence
  chemically synthesized
caaaaaaaaaaaaaaaaaaaaa

SEQ ID NO: 1127239 - DNA, 22 bp, Artificial Sequence
  chemically synthesized
agccatttgtgtgttttttttt

SEQ ID NO: 1127240 - DNA, 22 bp, Artificial Sequence
  chemically synthesized
tcagccatttgtgtgttttttt

SEQ ID NO: 1127241 - DNA, 22 bp, Artificial Sequence
  chemically synthesized
cagaggcagttctcagccattt

SEQ ID NO: 1127242 - DNA, 22 bp, Artificial Sequence
  chemically synthesized
gcagaggcagttctcagccatt

SEQ ID NO: 1127243 - DNA, 22 bp, Artificial Sequence
  chemically synthesized
accttgcagaggcagttctcag

SEQ ID NO: 1127244 - DNA, 22 bp, Artificial Sequence
  chemically synthesized
tctaaccttgcagaggcagttc

SEQ ID NO: 1127245 - DNA, 22 bp, Artificial Sequence
  chemically synthesized
gttatctaaccttgcagaggca

SEQ ID NO: 1127246 - DNA, 22 bp, Artificial Sequence
  chemically synthesized
tggttatctaaccttgcagagg

SEQ ID NO: 1127247 - DNA, 22 bp, Artificial Sequence
  chemically synthesized
ctggttatctaaccttgcagag

SEQ ID NO: 1127248 - DNA, 22 bp, Artificial Sequence
  chemically synthesized
tctggttatctaaccttgcaga

SEQ ID NO: 1127249 - DNA, 22 bp, Artificial Sequence
  chemically synthesized
agaactgcctctgcaaggttag

SEQ ID NO: 1127250 - DNA, 22 bp, Artificial Sequence
  chemically synthesized
tctttctggttatctaaccttg

SEQ ID NO: 1127251 - DNA, 22 bp, Artificial Sequence
  chemically synthesized
gtctttctggttatctaacctt

SEQ ID NO: 1127252 - DNA, 22 bp, Artificial Sequence
  chemically synthesized
cctctgcaaggttagataacca

SEQ ID NO: 1127253 - DNA, 22 bp, Artificial Sequence
  chemically synthesized
accaccttgtctttctggttat

SEQ ID NO: 1127254 - DNA, 22 bp, Artificial Sequence
  chemically synthesized
tgcaaggttagataaccagaaa

SEQ ID NO: 1127255 - DNA, 22 bp, Artificial Sequence
  chemically synthesized
caaggttagataaccagaaaga

SEQ ID NO: 1127256 - DNA, 22 bp, Artificial Sequence
  chemically synthesized
ctaaccaccttgtctttctggt

SEQ ID NO: 1127257 - DNA, 22 bp, Artificial Sequence
  chemically synthesized
gataaccagaaagacaaggtgg

SEQ ID NO: 1127258 - DNA, 22 bp, Artificial Sequence
  chemically synthesized
ccaccgtgctactaaccacctt

SEQ ID NO: 1127259 - DNA, 22 bp, Artificial Sequence
  chemically synthesized
cctgccaccgtgctactaacca

SEQ ID NO: 1127260 - DNA, 22 bp, Artificial Sequence
  chemically synthesized
ccatgttacctgccaccgtgct

SEQ ID NO: 1127261 - DNA, 22 bp, Artificial Sequence
  chemically synthesized
ccattcccatgttacctgccac

SEQ ID NO: 1127262 - DNA, 22 bp, Artificial Sequence
  chemically synthesized
cccattcccatgttacctgcca

SEQ ID NO: 1127263 - DNA, 22 bp, Artificial Sequence
  chemically synthesized
tcccattcccatgttacctgcc

SEQ ID NO: 1127264 - DNA, 22 bp, Artificial Sequence
  chemically synthesized
ttcccattcccatgttacctgc

SEQ ID NO: 1127265 - DNA, 22 bp, Artificial Sequence
  chemically synthesized
gtagcacggtggcaggtaacat

SEQ ID NO: 1127266 - DNA, 22 bp, Artificial Sequence
  chemically synthesized
tttcccattcccatgttacctg

SEQ ID NO: 1127267 - DNA, 22 bp, Artificial Sequence
  chemically synthesized
tttttcccattcccatgttacc

SEQ ID NO: 1127268 - DNA, 22 bp, Artificial Sequence
  chemically synthesized
ctttttcccattcccatgttac

SEQ ID NO: 1127269 - DNA, 22 bp, Artificial Sequence
  chemically synthesized
tctttttcccattcccatgtta

SEQ ID NO: 1127270 - DNA, 22 bp, Artificial Sequence
  chemically synthesized
gatacctttctttttcccattc

SEQ ID NO: 1127271 - DNA, 22 bp, Artificial Sequence
  chemically synthesized
agatacctttctttttcccatt

SEQ ID NO: 1127272 - DNA, 22 bp, Artificial Sequence
  chemically synthesized
tagatacctttctttttcccat

SEQ ID NO: 1127273 - DNA, 22 bp, Artificial Sequence
  chemically synthesized
tttagatacctttctttttccc

SEQ ID NO: 1127274 - DNA, 22 bp, Artificial Sequence
  chemically synthesized
tctttagatacctttctttttc

SEQ ID NO: 1127275 - DNA, 22 bp, Artificial Sequence
  chemically synthesized
agattctctttagatacctttc

SEQ ID NO: 1127276 - DNA, 22 bp, Artificial Sequence
  chemically synthesized
cctaagattctctttagatacc

SEQ ID NO: 1127277 - DNA, 22 bp, Artificial Sequence
  chemically synthesized
tgcctaagattctctttagata

SEQ ID NO: 1127278 - DNA, 22 bp, Artificial Sequence
  chemically synthesized
tctgcctaagattctctttaga

SEQ ID NO: 1127279 - DNA, 22 bp, Artificial Sequence
  chemically synthesized
ctctgcctaagattctctttag

SEQ ID NO: 1127280 - DNA, 22 bp, Artificial Sequence
  chemically synthesized
tctctgcctaagattctcttta

SEQ ID NO: 1127281 - DNA, 22 bp, Artificial Sequence
  chemically synthesized
ttttctctgcctaagattctct

SEQ ID NO: 1127282 - DNA, 22 bp, Artificial Sequence
  chemically synthesized
ctgttttctctgcctaagattc

SEQ ID NO: 1127283 - DNA, 22 bp, Artificial Sequence
  chemically synthesized
tacctactgttttctctgccta

SEQ ID NO: 1127284 - DNA, 22 bp, Artificial Sequence
  chemically synthesized
gtacctactgttttctctgcct

SEQ ID NO: 1127285 - DNA, 22 bp, Artificial Sequence
  chemically synthesized
aagagaatcttaggcagagaaa

SEQ ID NO: 1127286 - DNA, 22 bp, Artificial Sequence
  chemically synthesized
tgtacctactgttttctctgcc

SEQ ID NO: 1127287 - DNA, 22 bp, Artificial Sequence
  chemically synthesized
tttgtacctactgttttctctg

SEQ ID NO: 1127288 - DNA, 22 bp, Artificial Sequence
  chemically synthesized
ctttgtacctactgttttctct

SEQ ID NO: 1127289 - DNA, 22 bp, Artificial Sequence
  chemically synthesized
tttctttgtacctactgttttc

SEQ ID NO: 1127290 - DNA, 22 bp, Artificial Sequence
  chemically synthesized
tgtttctttgtacctactgttt

SEQ ID NO: 1127291 - DNA, 22 bp, Artificial Sequence
  chemically synthesized
ctgtttctttgtacctactgtt

SEQ ID NO: 1127292 - DNA, 22 bp, Artificial Sequence
  chemically synthesized
aggcagagaaaacagtaggtac

SEQ ID NO: 1127293 - DNA, 22 bp, Artificial Sequence
  chemically synthesized
ggcagagaaaacagtaggtaca

SEQ ID NO: 1127294 - DNA, 22 bp, Artificial Sequence
  chemically synthesized
agcttctgtttctttgtaccta

SEQ ID NO: 1127295 - DNA, 22 bp, Artificial Sequence
  chemically synthesized
aagcttctgtttctttgtacct

SEQ ID NO: 1127296 - DNA, 22 bp, Artificial Sequence
  chemically synthesized
ttaagcttctgtttctttgtac

SEQ ID NO: 1127297 - DNA, 22 bp, Artificial Sequence
  chemically synthesized
cttaagcttctgtttctttgta

SEQ ID NO: 1127298 - DNA, 22 bp, Artificial Sequence
  chemically synthesized
tcttaagcttctgtttctttgt

SEQ ID NO: 1127299 - DNA, 22 bp, Artificial Sequence
  chemically synthesized
tgctttcttaagcttctgtttc

SEQ ID NO: 1127300 - DNA, 22 bp, Artificial Sequence
  chemically synthesized
tgtgctttcttaagcttctgtt

SEQ ID NO: 1127301 - DNA, 22 bp, Artificial Sequence
  chemically synthesized
caaatgctctgtgctttcttaa

SEQ ID NO: 1127302 - DNA, 22 bp, Artificial Sequence
  chemically synthesized
atctccaaatgctctgtgcttt

SEQ ID NO: 1127303 - DNA, 22 bp, Artificial Sequence
  chemically synthesized
gatctccaaatgctctgtgctt

SEQ ID NO: 1127304 - DNA, 22 bp, Artificial Sequence
  chemically synthesized
tgatctccaaatgctctgtgct

SEQ ID NO: 1127305 - DNA, 22 bp, Artificial Sequence
  chemically synthesized
tttgatctccaaatgctctgtg

SEQ ID NO: 1127306 - DNA, 22 bp, Artificial Sequence
  chemically synthesized
aagaaagcacagagcatttgga

SEQ ID NO: 1127307 - DNA, 22 bp, Artificial Sequence
  chemically synthesized
agaaagcacagagcatttggag

SEQ ID NO: 1127308 - DNA, 22 bp, Artificial Sequence
  chemically synthesized
accactctttgatctccaaatg

SEQ ID NO: 1127309 - DNA, 22 bp, Artificial Sequence
  chemically synthesized
aattaaccactctttgatctcc

SEQ ID NO: 1127310 - DNA, 22 bp, Artificial Sequence
  chemically synthesized
aaattaaccactctttgatctc

SEQ ID NO: 1127311 - DNA, 22 bp, Artificial Sequence
  chemically synthesized
gcttaaattaaccactctttga

SEQ ID NO: 1127312 - DNA, 22 bp, Artificial Sequence
  chemically synthesized
agcttaaattaaccactctttg

SEQ ID NO: 1127313 - DNA, 22 bp, Artificial Sequence
  chemically synthesized
tagcttaaattaaccactcttt

SEQ ID NO: 1127314 - DNA, 22 bp, Artificial Sequence
  chemically synthesized
ggagatcaaagagtggttaatt

SEQ ID NO: 1127315 - DNA, 22 bp, Artificial Sequence
  chemically synthesized
tgctttagcttaaattaaccac

SEQ ID NO: 1127316 - DNA, 22 bp, Artificial Sequence
  chemically synthesized
gagatcaaagagtggttaattt

SEQ ID NO: 1127317 - DNA, 22 bp, Artificial Sequence
  chemically synthesized
ccctatgctttagcttaaatta

SEQ ID NO: 1127318 - DNA, 22 bp, Artificial Sequence
  chemically synthesized
cgcactgccctatgctttagct

SEQ ID NO: 1127319 - DNA, 22 bp, Artificial Sequence
  chemically synthesized
ttccgcactgccctatgcttta

SEQ ID NO: 1127320 - DNA, 22 bp, Artificial Sequence
  chemically synthesized
gttccgcactgccctatgcttt

SEQ ID NO: 1127321 - DNA, 22 bp, Artificial Sequence
  chemically synthesized
tgttccgcactgccctatgctt

SEQ ID NO: 1127322 - DNA, 22 bp, Artificial Sequence
  chemically synthesized
atttaagctaaagcatagggca

SEQ ID NO: 1127323 - DNA, 22 bp, Artificial Sequence
  chemically synthesized
aactttgttccgcactgcccta

SEQ ID NO: 1127324 - DNA, 22 bp, Artificial Sequence
  chemically synthesized
aagctaaagcatagggcagtgc

SEQ ID NO: 1127325 - DNA, 22 bp, Artificial Sequence
  chemically synthesized
agctaaagcatagggcagtgcg

SEQ ID NO: 1127326 - DNA, 22 bp, Artificial Sequence
  chemically synthesized
aagcatagggcagtgcggaaca

SEQ ID NO: 1127327 - DNA, 22 bp, Artificial Sequence
  chemically synthesized
aagtctgaactttgttccgcac

SEQ ID NO: 1127328 - DNA, 22 bp, Artificial Sequence
  chemically synthesized
ctaaagtctgaactttgttccg

SEQ ID NO: 1127329 - DNA, 22 bp, Artificial Sequence
  chemically synthesized
tctgctaaagtctgaactttgt

SEQ ID NO: 1127330 - DNA, 22 bp, Artificial Sequence
  chemically synthesized
actgtctgctaaagtctgaact

SEQ ID NO: 1127331 - DNA, 22 bp, Artificial Sequence
  chemically synthesized
atagcaaacagttcactgtctg

SEQ ID NO: 1127332 - DNA, 22 bp, Artificial Sequence
  chemically synthesized
agactttagcagacagtgaact

SEQ ID NO: 1127333 - DNA, 22 bp, Artificial Sequence
  chemically synthesized
cagactaatagcaaacagttca

SEQ ID NO: 1127334 - DNA, 22 bp, Artificial Sequence
  chemically synthesized
acagactaatagcaaacagttc

SEQ ID NO: 1127335 - DNA, 22 bp, Artificial Sequence
  chemically synthesized
tagcagacagtgaactgtttgc

SEQ ID NO: 1127336 - DNA, 22 bp, Artificial Sequence
  chemically synthesized
agcagacagtgaactgtttgct

SEQ ID NO: 1127337 - DNA, 22 bp, Artificial Sequence
  chemically synthesized
ttacagactaatagcaaacagt

SEQ ID NO: 1127338 - DNA, 22 bp, Artificial Sequence
  chemically synthesized
gcagacagtgaactgtttgcta

SEQ ID NO: 1127339 - DNA, 22 bp, Artificial Sequence
  chemically synthesized
cttacagactaatagcaaacag

SEQ ID NO: 1127340 - DNA, 22 bp, Artificial Sequence
  chemically synthesized
ttcttacagactaatagcaaac

SEQ ID NO: 1127341 - DNA, 22 bp, Artificial Sequence
  chemically synthesized
cttcttacagactaatagcaaa

SEQ ID NO: 1127342 - DNA, 22 bp, Artificial Sequence
  chemically synthesized
tcttcttacagactaatagcaa

SEQ ID NO: 1127343 - DNA, 22 bp, Artificial Sequence
  chemically synthesized
ttcttcttacagactaatagca

SEQ ID NO: 1127344 - DNA, 22 bp, Artificial Sequence
  chemically synthesized
ttttcttcttacagactaatag

SEQ ID NO: 1127345 - DNA, 22 bp, Artificial Sequence
  chemically synthesized
tttgctattagtctgtaagaag

SEQ ID NO: 1127346 - DNA, 22 bp, Artificial Sequence
  chemically synthesized
gtgaaaactcttttcttcttac

SEQ ID NO: 1127347 - DNA, 22 bp, Artificial Sequence
  chemically synthesized
gctattagtctgtaagaagaaa

SEQ ID NO: 1127348 - DNA, 22 bp, Artificial Sequence
  chemically synthesized
ctattagtctgtaagaagaaaa

SEQ ID NO: 1127349 - DNA, 22 bp, Artificial Sequence
  chemically synthesized
tggtgaaaactcttttcttctt

SEQ ID NO: 1127350 - DNA, 22 bp, Artificial Sequence
  chemically synthesized
ttagtctgtaagaagaaaagag

SEQ ID NO: 1127351 - DNA, 22 bp, Artificial Sequence
  chemically synthesized
tactctggtgaaaactcttttc

SEQ ID NO: 1127352 - DNA, 22 bp, Artificial Sequence
  chemically synthesized
gtctgtaagaagaaaagagttt

SEQ ID NO: 1127353 - DNA, 22 bp, Artificial Sequence
  chemically synthesized
atactctggtgaaaactctttt

SEQ ID NO: 1127354 - DNA, 22 bp, Artificial Sequence
  chemically synthesized
atttatactctggtgaaaactc

SEQ ID NO: 1127355 - DNA, 22 bp, Artificial Sequence
  chemically synthesized
taagaagaaaagagttttcacc

SEQ ID NO: 1127356 - DNA, 22 bp, Artificial Sequence
  chemically synthesized
agttgatttatactctggtgaa

SEQ ID NO: 1127357 - DNA, 22 bp, Artificial Sequence
  chemically synthesized
agtgactcagttgatttatact

SEQ ID NO: 1127358 - DNA, 22 bp, Artificial Sequence
  chemically synthesized
ttcagtgactcagttgatttat

SEQ ID NO: 1127359 - DNA, 22 bp, Artificial Sequence
  chemically synthesized
gttcagtgactcagttgattta

SEQ ID NO: 1127360 - DNA, 22 bp, Artificial Sequence
  chemically synthesized
tcaccagagtataaatcaactg

SEQ ID NO: 1127361 - DNA, 22 bp, Artificial Sequence
  chemically synthesized
caccagagtataaatcaactga

SEQ ID NO: 1127362 - DNA, 22 bp, Artificial Sequence
  chemically synthesized
accagagtataaatcaactgag

SEQ ID NO: 1127363 - DNA, 22 bp, Artificial Sequence
  chemically synthesized
agtcactgaacaaacgatttga

SEQ ID NO: 1127364 - DNA, 22 bp, Artificial Sequence
  chemically synthesized
aaagcaaaataagatcaaatcg

SEQ ID NO: 1127365 - DNA, 22 bp, Artificial Sequence
  chemically synthesized
aacaaacgatttgatcttattt

SEQ ID NO: 1127366 - DNA, 22 bp, Artificial Sequence
  chemically synthesized
ggcaattaaaagcaaaataaga

SEQ ID NO: 1127367 - DNA, 22 bp, Artificial Sequence
  chemically synthesized
gatcttattttgcttttaattg

SEQ ID NO: 1127368 - DNA, 22 bp, Artificial Sequence
  chemically synthesized
atcttattttgcttttaattgc

SEQ ID NO: 1127369 - DNA, 22 bp, Artificial Sequence
  chemically synthesized
tcaagaaagttcggcaattaaa

SEQ ID NO: 1127370 - DNA, 22 bp, Artificial Sequence
  chemically synthesized
gtcaagaaagttcggcaattaa

SEQ ID NO: 1127371 - DNA, 22 bp, Artificial Sequence
  chemically synthesized
tgtcaagaaagttcggcaatta

SEQ ID NO: 1127372 - DNA, 22 bp, Artificial Sequence
  chemically synthesized
attttgcttttaattgccgaac

SEQ ID NO: 1127373 - DNA, 22 bp, Artificial Sequence
  chemically synthesized
ttttgcttttaattgccgaact

SEQ ID NO: 1127374 - DNA, 22 bp, Artificial Sequence
  chemically synthesized
ctttgtcaagaaagttcggcaa

SEQ ID NO: 1127375 - DNA, 22 bp, Artificial Sequence
  chemically synthesized
cctttgtcaagaaagttcggca

SEQ ID NO: 1127376 - DNA, 22 bp, Artificial Sequence
  chemically synthesized
tgcttttaattgccgaactttc

SEQ ID NO: 1127377 - DNA, 22 bp, Artificial Sequence
  chemically synthesized
gcttttaattgccgaactttct

SEQ ID NO: 1127378 - DNA, 22 bp, Artificial Sequence
  chemically synthesized
cttcctttgtcaagaaagttcg

SEQ ID NO: 1127379 - DNA, 22 bp, Artificial Sequence
  chemically synthesized
cttttaattgccgaactttctt

SEQ ID NO: 1127380 - DNA, 22 bp, Artificial Sequence
  chemically synthesized
ttaattgccgaactttcttgac

SEQ ID NO: 1127381 - DNA, 22 bp, Artificial Sequence
  chemically synthesized
taattgccgaactttcttgaca

SEQ ID NO: 1127382 - DNA, 22 bp, Artificial Sequence
  chemically synthesized
aattgccgaactttcttgacaa

SEQ ID NO: 1127383 - DNA, 22 bp, Artificial Sequence
  chemically synthesized
attgccgaactttcttgacaaa

SEQ ID NO: 1127384 - DNA, 22 bp, Artificial Sequence
  chemically synthesized
ccgaactttcttgacaaaggaa

SEQ ID NO: 1127385 - DNA, 22 bp, Artificial Sequence
  chemically synthesized
tcttgacaaaggaaggagtaca

SEQ ID NO: 1127386 - DNA, 22 bp, Artificial Sequence
  chemically synthesized
cttgacaaaggaaggagtacat

SEQ ID NO: 1127387 - DNA, 22 bp, Artificial Sequence
  chemically synthesized
ttgacaaaggaaggagtacatt

SEQ ID NO: 1127388 - DNA, 22 bp, Artificial Sequence
  chemically synthesized
gacaaaggaaggagtacattga

SEQ ID NO: 1127389 - DNA, 22 bp, Artificial Sequence
  chemically synthesized
acaaaggaaggagtacattgat

SEQ ID NO: 1127390 - DNA, 22 bp, Artificial Sequence
  chemically synthesized
agccagaatataaatcaatgta

SEQ ID NO: 1127391 - DNA, 22 bp, Artificial Sequence
  chemically synthesized
gagccagaatataaatcaatgt

SEQ ID NO: 1127392 - DNA, 22 bp, Artificial Sequence
  chemically synthesized
agataagaagcttgagccagaa

SEQ ID NO: 1127393 - DNA, 22 bp, Artificial Sequence
  chemically synthesized
atttatattctggctcaagctt

SEQ ID NO: 1127394 - DNA, 22 bp, Artificial Sequence
  chemically synthesized
atattctggctcaagcttctta

SEQ ID NO: 1127395 - DNA, 22 bp, Artificial Sequence
  chemically synthesized
tattctggctcaagcttcttat

SEQ ID NO: 1127396 - DNA, 22 bp, Artificial Sequence
  chemically synthesized
tggctcaagcttcttatctcaa

SEQ ID NO: 1127397 - DNA, 22 bp, Artificial Sequence
  chemically synthesized
gctcaagcttcttatctcaatt

SEQ ID NO: 1127398 - DNA, 22 bp, Artificial Sequence
  chemically synthesized
gtaccagtccacaattgagata

SEQ ID NO: 1127399 - DNA, 22 bp, Artificial Sequence
  chemically synthesized
agtaccagtccacaattgagat

SEQ ID NO: 1127400 - DNA, 22 bp, Artificial Sequence
  chemically synthesized
tagtaccagtccacaattgaga

SEQ ID NO: 1127401 - DNA, 22 bp, Artificial Sequence
  chemically synthesized
ttagtaccagtccacaattgag

SEQ ID NO: 1127402 - DNA, 22 bp, Artificial Sequence
  chemically synthesized
aagcttcttatctcaattgtgg

SEQ ID NO: 1127403 - DNA, 22 bp, Artificial Sequence
  chemically synthesized
tttagtaccagtccacaattga

SEQ ID NO: 1127404 - DNA, 22 bp, Artificial Sequence
  chemically synthesized
cttatctcaattgtggactggt

SEQ ID NO: 1127405 - DNA, 22 bp, Artificial Sequence
  chemically synthesized
ttatctcaattgtggactggta

SEQ ID NO: 1127406 - DNA, 22 bp, Artificial Sequence
  chemically synthesized
caaactttttagtaccagtcca

SEQ ID NO: 1127407 - DNA, 22 bp, Artificial Sequence
  chemically synthesized
atctcaattgtggactggtact

SEQ ID NO: 1127408 - DNA, 22 bp, Artificial Sequence
  chemically synthesized
tctcaattgtggactggtacta

SEQ ID NO: 1127409 - DNA, 22 bp, Artificial Sequence
  chemically synthesized
aattgtggactggtactaaaaa

SEQ ID NO: 1127410 - DNA, 22 bp, Artificial Sequence
  chemically synthesized
caaataatctgcaaacttttta

SEQ ID NO: 1127411 - DNA, 22 bp, Artificial Sequence
  chemically synthesized
tggactggtactaaaaagtttg

SEQ ID NO: 1127412 - DNA, 22 bp, Artificial Sequence
  chemically synthesized
ctccaaataatctgcaaacttt

SEQ ID NO: 1127413 - DNA, 22 bp, Artificial Sequence
  chemically synthesized
gtactaaaaagtttgcagatta

SEQ ID NO: 1127414 - DNA, 22 bp, Artificial Sequence
  chemically synthesized
aaaagtttgcagattatttgga

SEQ ID NO: 1127415 - DNA, 22 bp, Artificial Sequence
  chemically synthesized
aaaaaaataccagtgctactcc

SEQ ID NO: 1127416 - DNA, 22 bp, Artificial Sequence
  chemically synthesized
gcagattatttggagtagcact

SEQ ID NO: 1127417 - DNA, 22 bp, Artificial Sequence
  chemically synthesized
aaaaaaaataccagtgctactc

SEQ ID NO: 1127418 - DNA, 22 bp, Artificial Sequence
  chemically synthesized
cagattatttggagtagcactg

SEQ ID NO: 1127419 - DNA, 22 bp, Artificial Sequence
  chemically synthesized
taaaaaaaataccagtgctact

SEQ ID NO: 1127420 - DNA, 22 bp, Artificial Sequence
  chemically synthesized
ttaaaaaaaataccagtgctac

SEQ ID NO: 1127421 - DNA, 22 bp, Artificial Sequence
  chemically synthesized
tttaaaaaaaataccagtgcta

SEQ ID NO: 1127422 - DNA, 22 bp, Artificial Sequence
  chemically synthesized
ttttaaaaaaaataccagtgct

SEQ ID NO: 1127423 - DNA, 22 bp, Artificial Sequence
  chemically synthesized
cttttttaaaaaaaataccagt

SEQ ID NO: 1127424 - DNA, 22 bp, Artificial Sequence
  chemically synthesized
tttggagtagcactggtatttt

SEQ ID NO: 1127425 - DNA, 22 bp, Artificial Sequence
  chemically synthesized
ctccttttttaaaaaaaatacc

SEQ ID NO: 1127426 - DNA, 22 bp, Artificial Sequence
  chemically synthesized
ggagtagcactggtattttttt

SEQ ID NO: 1127427 - DNA, 22 bp, Artificial Sequence
  chemically synthesized
gagtagcactggtatttttttt

SEQ ID NO: 1127428 - DNA, 22 bp, Artificial Sequence
  chemically synthesized
tgctccttttttaaaaaaaata

SEQ ID NO: 1127429 - DNA, 22 bp, Artificial Sequence
  chemically synthesized
ctctgctccttttttaaaaaaa

SEQ ID NO: 1127430 - DNA, 22 bp, Artificial Sequence
  chemically synthesized
tcctctgctccttttttaaaaa

SEQ ID NO: 1127431 - DNA, 22 bp, Artificial Sequence
  chemically synthesized
ctcctctgctccttttttaaaa

SEQ ID NO: 1127432 - DNA, 22 bp, Artificial Sequence
  chemically synthesized
ccttctcctctgctcctttttt

SEQ ID NO: 1127433 - DNA, 22 bp, Artificial Sequence
  chemically synthesized
gtattttttttaaaaaaggagc

SEQ ID NO: 1127434 - DNA, 22 bp, Artificial Sequence
  chemically synthesized
actcccttctcctctgctcctt

SEQ ID NO: 1127435 - DNA, 22 bp, Artificial Sequence
  chemically synthesized
cactcccttctcctctgctcct

SEQ ID NO: 1127436 - DNA, 22 bp, Artificial Sequence
  chemically synthesized
tttttaaaaaaggagcagagga

SEQ ID NO: 1127437 - DNA, 22 bp, Artificial Sequence
  chemically synthesized
ttttaaaaaaggagcagaggag

SEQ ID NO: 1127438 - DNA, 22 bp, Artificial Sequence
  chemically synthesized
tttaaaaaaggagcagaggaga

SEQ ID NO: 1127439 - DNA, 22 bp, Artificial Sequence
  chemically synthesized
ttaaaaaaggagcagaggagaa

SEQ ID NO: 1127440 - DNA, 22 bp, Artificial Sequence
  chemically synthesized
taaaaaaggagcagaggagaag

SEQ ID NO: 1127441 - DNA, 22 bp, Artificial Sequence
  chemically synthesized
cagcttcactcccttctcctct

SEQ ID NO: 1127442 - DNA, 22 bp, Artificial Sequence
  chemically synthesized
aaaaaaggagcagaggagaagg

SEQ ID NO: 1127443 - DNA, 22 bp, Artificial Sequence
  chemically synthesized
aaaaaggagcagaggagaaggg

SEQ ID NO: 1127444 - DNA, 22 bp, Artificial Sequence
  chemically synthesized
tccagcttcactcccttctcct

SEQ ID NO: 1127445 - DNA, 22 bp, Artificial Sequence
  chemically synthesized
cctctccagcttcactcccttc

SEQ ID NO: 1127446 - DNA, 22 bp, Artificial Sequence
  chemically synthesized
cctacctctccagcttcactcc

SEQ ID NO: 1127447 - DNA, 22 bp, Artificial Sequence
  chemically synthesized
gctgcctacctctccagcttca

SEQ ID NO: 1127448 - DNA, 22 bp, Artificial Sequence
  chemically synthesized
agctgcctacctctccagcttc

SEQ ID NO: 1127449 - DNA, 22 bp, Artificial Sequence
  chemically synthesized
tagctgcctacctctccagctt

SEQ ID NO: 1127450 - DNA, 22 bp, Artificial Sequence
  chemically synthesized
tgatctttagctgcctacctct

SEQ ID NO: 1127451 - DNA, 22 bp, Artificial Sequence
  chemically synthesized
gtgatctttagctgcctacctc

SEQ ID NO: 1127452 - DNA, 22 bp, Artificial Sequence
  chemically synthesized
tgtgatctttagctgcctacct

SEQ ID NO: 1127453 - DNA, 22 bp, Artificial Sequence
  chemically synthesized
ttgtgatctttagctgcctacc

SEQ ID NO: 1127454 - DNA, 22 bp, Artificial Sequence
  chemically synthesized
ttttgtgatctttagctgccta

SEQ ID NO: 1127455 - DNA, 22 bp, Artificial Sequence
  chemically synthesized
gagaggtaggcagctaaagatc

SEQ ID NO: 1127456 - DNA, 22 bp, Artificial Sequence
  chemically synthesized
aaatgcatggcgtagaaattct

SEQ ID NO: 1127457 - DNA, 22 bp, Artificial Sequence
  chemically synthesized
aagatcacaaaagaatttctac

SEQ ID NO: 1127458 - DNA, 22 bp, Artificial Sequence
  chemically synthesized
gaaatgcatggcgtagaaattc

SEQ ID NO: 1127459 - DNA, 22 bp, Artificial Sequence
  chemically synthesized
cccataaatcttgaaatgcatg

SEQ ID NO: 1127460 - DNA, 22 bp, Artificial Sequence
  chemically synthesized
ccctgcccataaatcttgaaat

SEQ ID NO: 1127461 - DNA, 22 bp, Artificial Sequence
  chemically synthesized
ctacgccatgcatttcaagatt

SEQ ID NO: 1127462 - DNA, 22 bp, Artificial Sequence
  chemically synthesized
tacgccatgcatttcaagattt

SEQ ID NO: 1127463 - DNA, 22 bp, Artificial Sequence
  chemically synthesized
ttcccctgcccataaatcttga

SEQ ID NO: 1127464 - DNA, 22 bp, Artificial Sequence
  chemically synthesized
cgccatgcatttcaagatttat

SEQ ID NO: 1127465 - DNA, 22 bp, Artificial Sequence
  chemically synthesized
gattattcccctgcccataaat

SEQ ID NO: 1127466 - DNA, 22 bp, Artificial Sequence
  chemically synthesized
attagattattcccctgcccat

SEQ ID NO: 1127467 - DNA, 22 bp, Artificial Sequence
  chemically synthesized
aattagattattcccctgccca

SEQ ID NO: 1127468 - DNA, 22 bp, Artificial Sequence
  chemically synthesized
taattagattattcccctgccc

SEQ ID NO: 1127469 - DNA, 22 bp, Artificial Sequence
  chemically synthesized
caagatttatgggcaggggaat

SEQ ID NO: 1127470 - DNA, 22 bp, Artificial Sequence
  chemically synthesized
aagatttatgggcaggggaata

SEQ ID NO: 1127471 - DNA, 22 bp, Artificial Sequence
  chemically synthesized
atgggcaggggaataatctaat

SEQ ID NO: 1127472 - DNA, 22 bp, Artificial Sequence
  chemically synthesized
tgggcaggggaataatctaatt

SEQ ID NO: 1127473 - DNA, 22 bp, Artificial Sequence
  chemically synthesized
aaatgcagttttaattagatta

SEQ ID NO: 1127474 - DNA, 22 bp, Artificial Sequence
  chemically synthesized
aaaatgcagttttaattagatt

SEQ ID NO: 1127475 - DNA, 22 bp, Artificial Sequence
  chemically synthesized
ccgagggatatcttaaaatgca

SEQ ID NO: 1127476 - DNA, 22 bp, Artificial Sequence
  chemically synthesized
attaaaactgcattttaagata

SEQ ID NO: 1127477 - DNA, 22 bp, Artificial Sequence
  chemically synthesized
cagcctcccgagggatatctta

SEQ ID NO: 1127478 - DNA, 22 bp, Artificial Sequence
  chemically synthesized
aaactgcattttaagatatccc

SEQ ID NO: 1127479 - DNA, 22 bp, Artificial Sequence
  chemically synthesized
acagcctcccgagggatatctt

SEQ ID NO: 1127480 - DNA, 22 bp, Artificial Sequence
  chemically synthesized
tacagcctcccgagggatatct

SEQ ID NO: 1127481 - DNA, 22 bp, Artificial Sequence
  chemically synthesized
ttacagcctcccgagggatatc

SEQ ID NO: 1127482 - DNA, 22 bp, Artificial Sequence
  chemically synthesized
tttacagcctcccgagggatat

SEQ ID NO: 1127483 - DNA, 22 bp, Artificial Sequence
  chemically synthesized
cattttaagatatccctcggga

SEQ ID NO: 1127484 - DNA, 22 bp, Artificial Sequence
  chemically synthesized
taagatatccctcgggaggctg

SEQ ID NO: 1127485 - DNA, 22 bp, Artificial Sequence
  chemically synthesized
aagatatccctcgggaggctgt

SEQ ID NO: 1127486 - DNA, 22 bp, Artificial Sequence
  chemically synthesized
tccatgctttttacagcctccc

SEQ ID NO: 1127487 - DNA, 22 bp, Artificial Sequence
  chemically synthesized
agatatccctcgggaggctgta

SEQ ID NO: 1127488 - DNA, 22 bp, Artificial Sequence
  chemically synthesized
atccatgctttttacagcctcc

SEQ ID NO: 1127489 - DNA, 22 bp, Artificial Sequence
  chemically synthesized
ttatccatgctttttacagcct

SEQ ID NO: 1127490 - DNA, 22 bp, Artificial Sequence
  chemically synthesized
tcttatccatgctttttacagc

SEQ ID NO: 1127491 - DNA, 22 bp, Artificial Sequence
  chemically synthesized
acctctcttatccatgcttttt

SEQ ID NO: 1127492 - DNA, 22 bp, Artificial Sequence
  chemically synthesized
gggaggctgtaaaaagcatgga

SEQ ID NO: 1127493 - DNA, 22 bp, Artificial Sequence
  chemically synthesized
atctcacctctcttatccatgc

SEQ ID NO: 1127494 - DNA, 22 bp, Artificial Sequence
  chemically synthesized
tgatctcacctctcttatccat

SEQ ID NO: 1127495 - DNA, 22 bp, Artificial Sequence
  chemically synthesized
taaaaagcatggataagagagg

SEQ ID NO: 1127496 - DNA, 22 bp, Artificial Sequence
  chemically synthesized
cctctgatctcacctctcttat

SEQ ID NO: 1127497 - DNA, 22 bp, Artificial Sequence
  chemically synthesized
tgcctctgatctcacctctctt

SEQ ID NO: 1127498 - DNA, 22 bp, Artificial Sequence
  chemically synthesized
tctgcctctgatctcacctctc

SEQ ID NO: 1127499 - DNA, 22 bp, Artificial Sequence
  chemically synthesized
ctctgcctctgatctcacctct

SEQ ID NO: 1127500 - DNA, 22 bp, Artificial Sequence
  chemically synthesized
atttctctgcctctgatctcac

SEQ ID NO: 1127501 - DNA, 22 bp, Artificial Sequence
  chemically synthesized
actgatttctctgcctctgatc

SEQ ID NO: 1127502 - DNA, 22 bp, Artificial Sequence
  chemically synthesized
aactgatttctctgcctctgat

SEQ ID NO: 1127503 - DNA, 22 bp, Artificial Sequence
  chemically synthesized
taactgatttctctgcctctga

SEQ ID NO: 1127504 - DNA, 22 bp, Artificial Sequence
  chemically synthesized
ttaactgatttctctgcctctg

SEQ ID NO: 1127505 - DNA, 22 bp, Artificial Sequence
  chemically synthesized
tatgaaatttttaactgatttc

SEQ ID NO: 1127506 - DNA, 22 bp, Artificial Sequence
  chemically synthesized
tgtatgaaatttttaactgatt

SEQ ID NO: 1127507 - DNA, 22 bp, Artificial Sequence
  chemically synthesized
ctgtatgaaatttttaactgat

SEQ ID NO: 1127508 - DNA, 22 bp, Artificial Sequence
  chemically synthesized
tctgtatgaaatttttaactga

SEQ ID NO: 1127509 - DNA, 22 bp, Artificial Sequence
  chemically synthesized
ttctgtatgaaatttttaactg

SEQ ID NO: 1127510 - DNA, 22 bp, Artificial Sequence
  chemically synthesized
aaatttttctgtatgaaatttt

SEQ ID NO: 1127511 - DNA, 22 bp, Artificial Sequence
  chemically synthesized
aaactgaaatttttctgtatga

SEQ ID NO: 1127512 - DNA, 22 bp, Artificial Sequence
  chemically synthesized
gttaaaactgaaatttttctgt

SEQ ID NO: 1127513 - DNA, 22 bp, Artificial Sequence
  chemically synthesized
aaaatttcatacagaaaaattt

SEQ ID NO: 1127514 - DNA, 22 bp, Artificial Sequence
  chemically synthesized
tagttaaaactgaaatttttct

SEQ ID NO: 1127515 - DNA, 22 bp, Artificial Sequence
  chemically synthesized
actctagttaaaactgaaattt

SEQ ID NO: 1127516 - DNA, 22 bp, Artificial Sequence
  chemically synthesized
cactctagttaaaactgaaatt

SEQ ID NO: 1127517 - DNA, 22 bp, Artificial Sequence
  chemically synthesized
catacagaaaaatttcagtttt

SEQ ID NO: 1127518 - DNA, 22 bp, Artificial Sequence
  chemically synthesized
atacagaaaaatttcagtttta

SEQ ID NO: 1127519 - DNA, 22 bp, Artificial Sequence
  chemically synthesized
ccttcactctagttaaaactga

SEQ ID NO: 1127520 - DNA, 22 bp, Artificial Sequence
  chemically synthesized
ctgccttcactctagttaaaac

SEQ ID NO: 1127521 - DNA, 22 bp, Artificial Sequence
  chemically synthesized
gctgccttcactctagttaaaa

SEQ ID NO: 1127522 - DNA, 22 bp, Artificial Sequence
  chemically synthesized
catccttgctgccttcactcta

SEQ ID NO: 1127523 - DNA, 22 bp, Artificial Sequence
  chemically synthesized
cagttttaactagagtgaaggc

SEQ ID NO: 1127524 - DNA, 22 bp, Artificial Sequence
  chemically synthesized
tacatccttgctgccttcactc

SEQ ID NO: 1127525 - DNA, 22 bp, Artificial Sequence
  chemically synthesized
agttttaactagagtgaaggca

SEQ ID NO: 1127526 - DNA, 22 bp, Artificial Sequence
  chemically synthesized
ctacatccttgctgccttcact

SEQ ID NO: 1127527 - DNA, 22 bp, Artificial Sequence
  chemically synthesized
tctacatccttgctgccttcac

SEQ ID NO: 1127528 - DNA, 22 bp, Artificial Sequence
  chemically synthesized
ttctacatccttgctgccttca

SEQ ID NO: 1127529 - DNA, 22 bp, Artificial Sequence
  chemically synthesized
tttctacatccttgctgccttc

SEQ ID NO: 1127530 - DNA, 22 bp, Artificial Sequence
  chemically synthesized
ttttctacatccttgctgcctt

SEQ ID NO: 1127531 - DNA, 22 bp, Artificial Sequence
  chemically synthesized
taactagagtgaaggcagcaag

SEQ ID NO: 1127532 - DNA, 22 bp, Artificial Sequence
  chemically synthesized
aactagagtgaaggcagcaagg

SEQ ID NO: 1127533 - DNA, 22 bp, Artificial Sequence
  chemically synthesized
actagagtgaaggcagcaagga

SEQ ID NO: 1127534 - DNA, 22 bp, Artificial Sequence
  chemically synthesized
tttttttctacatccttgctgc

SEQ ID NO: 1127535 - DNA, 22 bp, Artificial Sequence
  chemically synthesized
ttatttttttctacatccttgc

SEQ ID NO: 1127536 - DNA, 22 bp, Artificial Sequence
  chemically synthesized
gagtgaaggcagcaaggatgta

SEQ ID NO: 1127537 - DNA, 22 bp, Artificial Sequence
  chemically synthesized
gttatttttttctacatccttg

SEQ ID NO: 1127538 - DNA, 22 bp, Artificial Sequence
  chemically synthesized
gtttgttatttttttctacatc

SEQ ID NO: 1127539 - DNA, 22 bp, Artificial Sequence
  chemically synthesized
agtttgttatttttttctacat

SEQ ID NO: 1127540 - DNA, 22 bp, Artificial Sequence
  chemically synthesized
tagtttgttatttttttctaca

SEQ ID NO: 1127541 - DNA, 22 bp, Artificial Sequence
  chemically synthesized
tttagtttgttatttttttcta

SEQ ID NO: 1127542 - DNA, 22 bp, Artificial Sequence
  chemically synthesized
tctttagtttgttatttttttc

SEQ ID NO: 1127543 - DNA, 22 bp, Artificial Sequence
  chemically synthesized
aattctctttagtttgttattt

SEQ ID NO: 1127544 - DNA, 22 bp, Artificial Sequence
  chemically synthesized
ttaaattctctttagtttgtta

SEQ ID NO: 1127545 - DNA, 22 bp, Artificial Sequence
  chemically synthesized
caaatgtacctgttaaattctc

SEQ ID NO: 1127546 - DNA, 22 bp, Artificial Sequence
  chemically synthesized
aatccctccaaatgtacctgtt

SEQ ID NO: 1127547 - DNA, 22 bp, Artificial Sequence
  chemically synthesized
aagagaatttaacaggtacatt

SEQ ID NO: 1127548 - DNA, 22 bp, Artificial Sequence
  chemically synthesized
ccacatcactaaatccctccaa

SEQ ID NO: 1127549 - DNA, 22 bp, Artificial Sequence
  chemically synthesized
aacaggtacatttggagggatt

SEQ ID NO: 1127550 - DNA, 22 bp, Artificial Sequence
  chemically synthesized
acaggtacatttggagggattt

SEQ ID NO: 1127551 - DNA, 22 bp, Artificial Sequence
  chemically synthesized
atatctgccacatcactaaatc

SEQ ID NO: 1127552 - DNA, 22 bp, Artificial Sequence
  chemically synthesized
gatatctgccacatcactaaat

SEQ ID NO: 1127553 - DNA, 22 bp, Artificial Sequence
  chemically synthesized
ggagggatttagtgatgtggca

SEQ ID NO: 1127554 - DNA, 22 bp, Artificial Sequence
  chemically synthesized
gagggatttagtgatgtggcag

SEQ ID NO: 1127555 - DNA, 22 bp, Artificial Sequence
  chemically synthesized
acagtggtcttgatatctgcca

SEQ ID NO: 1127556 - DNA, 22 bp, Artificial Sequence
  chemically synthesized
agtgatgtggcagatatcaaga

SEQ ID NO: 1127557 - DNA, 22 bp, Artificial Sequence
  chemically synthesized
gtgatgtggcagatatcaagac

SEQ ID NO: 1127558 - DNA, 22 bp, Artificial Sequence
  chemically synthesized
tgcagccattcacagtggtctt

SEQ ID NO: 1127559 - DNA, 22 bp, Artificial Sequence
  chemically synthesized
tgcagtgagcaacctgtgcagc

SEQ ID NO: 1127560 - DNA, 22 bp, Artificial Sequence
  chemically synthesized
gtgcagtgagcaacctgtgcag

SEQ ID NO: 1127561 - DNA, 22 bp, Artificial Sequence
  chemically synthesized
tgaatggctgcacaggttgctc

SEQ ID NO: 1127562 - DNA, 22 bp, Artificial Sequence
  chemically synthesized
aacttgtgcagtgagcaacctg

SEQ ID NO: 1127563 - DNA, 22 bp, Artificial Sequence
  chemically synthesized
cacaggttgctcactgcacaag

SEQ ID NO: 1127564 - DNA, 22 bp, Artificial Sequence
  chemically synthesized
agaatggtacatcctgaacttg

SEQ ID NO: 1127565 - DNA, 22 bp, Artificial Sequence
  chemically synthesized
taagaatggtacatcctgaact

SEQ ID NO: 1127566 - DNA, 22 bp, Artificial Sequence
  chemically synthesized
ctcactgcacaagttcaggatg

SEQ ID NO: 1127567 - DNA, 22 bp, Artificial Sequence
  chemically synthesized
actgcacaagttcaggatgtac

SEQ ID NO: 1127568 - DNA, 22 bp, Artificial Sequence
  chemically synthesized
cacaagttcaggatgtaccatt

SEQ ID NO: 1127569 - DNA, 22 bp, Artificial Sequence
  chemically synthesized
acatcatagtctctaagaatgg

SEQ ID NO: 1127570 - DNA, 22 bp, Artificial Sequence
  chemically synthesized
aggatgtaccattcttagagac

SEQ ID NO: 1127571 - DNA, 22 bp, Artificial Sequence
  chemically synthesized
gagagggtcattcacatcatag

SEQ ID NO: 1127572 - DNA, 22 bp, Artificial Sequence
  chemically synthesized
tagagagggtcattcacatcat

SEQ ID NO: 1127573 - DNA, 22 bp, Artificial Sequence
  chemically synthesized
ttagagactatgatgtgaatga

SEQ ID NO: 1127574 - DNA, 22 bp, Artificial Sequence
  chemically synthesized
agagactatgatgtgaatgacc

SEQ ID NO: 1127575 - DNA, 22 bp, Artificial Sequence
  chemically synthesized
gagactatgatgtgaatgaccc

SEQ ID NO: 1127576 - DNA, 22 bp, Artificial Sequence
  chemically synthesized
tgatgtgaatgaccctctctag

SEQ ID NO: 1127577 - DNA, 22 bp, Artificial Sequence
  chemically synthesized
gatcgtataactctagagaggg

SEQ ID NO: 1127578 - DNA, 22 bp, Artificial Sequence
  chemically synthesized
agatcgtataactctagagagg

SEQ ID NO: 1127579 - DNA, 22 bp, Artificial Sequence
  chemically synthesized
gagtttagatcgtataactcta

SEQ ID NO: 1127580 - DNA, 22 bp, Artificial Sequence
  chemically synthesized
ggagtttagatcgtataactct

SEQ ID NO: 1127581 - DNA, 22 bp, Artificial Sequence
  chemically synthesized
tggagtttagatcgtataactc

SEQ ID NO: 1127582 - DNA, 22 bp, Artificial Sequence
  chemically synthesized
tctagagttatacgatctaaac

SEQ ID NO: 1127583 - DNA, 22 bp, Artificial Sequence
  chemically synthesized
tagagttatacgatctaaactc

SEQ ID NO: 1127584 - DNA, 22 bp, Artificial Sequence
  chemically synthesized
aaatatagttttggagtttaga

SEQ ID NO: 1127585 - DNA, 22 bp, Artificial Sequence
  chemically synthesized
gagttatacgatctaaactcca

SEQ ID NO: 1127586 - DNA, 22 bp, Artificial Sequence
  chemically synthesized
tacgatctaaactccaaaacta

SEQ ID NO: 1127587 - DNA, 22 bp, Artificial Sequence
  chemically synthesized
gaatctaaaatatagttttgga

SEQ ID NO: 1127588 - DNA, 22 bp, Artificial Sequence
  chemically synthesized
actggaatctaaaatatagttt

SEQ ID NO: 1127589 - DNA, 22 bp, Artificial Sequence
  chemically synthesized
tgactggaatctaaaatatagt

SEQ ID NO: 1127590 - DNA, 22 bp, Artificial Sequence
  chemically synthesized
ctgactggaatctaaaatatag

SEQ ID NO: 1127591 - DNA, 22 bp, Artificial Sequence
  chemically synthesized
aactccaaaactatattttaga

SEQ ID NO: 1127592 - DNA, 22 bp, Artificial Sequence
  chemically synthesized
gatttctgactggaatctaaaa

SEQ ID NO: 1127593 - DNA, 22 bp, Artificial Sequence
  chemically synthesized
caaaactatattttagattcca

SEQ ID NO: 1127594 - DNA, 22 bp, Artificial Sequence
  chemically synthesized
ctggatttctgactggaatcta

SEQ ID NO: 1127595 - DNA, 22 bp, Artificial Sequence
  chemically synthesized
tattttagattccagtcagaaa

SEQ ID NO: 1127596 - DNA, 22 bp, Artificial Sequence
  chemically synthesized
tgtattcctggatttctgactg

SEQ ID NO: 1127597 - DNA, 22 bp, Artificial Sequence
  chemically synthesized
tagattccagtcagaaatccag

SEQ ID NO: 1127598 - DNA, 22 bp, Artificial Sequence
  chemically synthesized
agattccagtcagaaatccagg

SEQ ID NO: 1127599 - DNA, 22 bp, Artificial Sequence
  chemically synthesized
gattccagtcagaaatccagga

SEQ ID NO: 1127600 - DNA, 22 bp, Artificial Sequence
  chemically synthesized
taggctatgtattcctggattt

SEQ ID NO: 1127601 - DNA, 22 bp, Artificial Sequence
  chemically synthesized
ataggctatgtattcctggatt

SEQ ID NO: 1127602 - DNA, 22 bp, Artificial Sequence
  chemically synthesized
cagtcagaaatccaggaataca

SEQ ID NO: 1127603 - DNA, 22 bp, Artificial Sequence
  chemically synthesized
aaatgcttataggctatgtatt

SEQ ID NO: 1127604 - DNA, 22 bp, Artificial Sequence
  chemically synthesized
tataattcaaatgcttataggc

SEQ ID NO: 1127605 - DNA, 22 bp, Artificial Sequence
  chemically synthesized
atccctgtataattcaaatgct

SEQ ID NO: 1127606 - DNA, 22 bp, Artificial Sequence
  chemically synthesized
atgttcatccctgtataattca

SEQ ID NO: 1127607 - DNA, 22 bp, Artificial Sequence
  chemically synthesized
ctgatgttcatccctgtataat

SEQ ID NO: 1127608 - DNA, 22 bp, Artificial Sequence
  chemically synthesized
taagcatttgaattatacaggg

SEQ ID NO: 1127609 - DNA, 22 bp, Artificial Sequence
  chemically synthesized
tcctgatgttcatccctgtata

SEQ ID NO: 1127610 - DNA, 22 bp, Artificial Sequence
  chemically synthesized
tctcctgatgttcatccctgta

SEQ ID NO: 1127611 - DNA, 22 bp, Artificial Sequence
  chemically synthesized
cctctctcctgatgttcatccc

SEQ ID NO: 1127612 - DNA, 22 bp, Artificial Sequence
  chemically synthesized
gaattatacagggatgaacatc

SEQ ID NO: 1127613 - DNA, 22 bp, Artificial Sequence
  chemically synthesized
tccctctctcctgatgttcatc

SEQ ID NO: 1127614 - DNA, 22 bp, Artificial Sequence
  chemically synthesized
aattatacagggatgaacatca

SEQ ID NO: 1127615 - DNA, 22 bp, Artificial Sequence
  chemically synthesized
cctctccctctctcctgatgtt

SEQ ID NO: 1127616 - DNA, 22 bp, Artificial Sequence
  chemically synthesized
tacagggatgaacatcaggaga

SEQ ID NO: 1127617 - DNA, 22 bp, Artificial Sequence
  chemically synthesized
tacctctccctctctcctgatg

SEQ ID NO: 1127618 - DNA, 22 bp, Artificial Sequence
  chemically synthesized
ctacctctccctctctcctgat

SEQ ID NO: 1127619 - DNA, 22 bp, Artificial Sequence
  chemically synthesized
atatttctacctctccctctct

SEQ ID NO: 1127620 - DNA, 22 bp, Artificial Sequence
  chemically synthesized
acaaattgatatttctacctct

SEQ ID NO: 1127621 - DNA, 22 bp, Artificial Sequence
  chemically synthesized
attcacaaattgatatttctac

SEQ ID NO: 1127622 - DNA, 22 bp, Artificial Sequence
  chemically synthesized
gattcacaaattgatatttcta

SEQ ID NO: 1127623 - DNA, 22 bp, Artificial Sequence
  chemically synthesized
tgattcacaaattgatatttct

SEQ ID NO: 1127624 - DNA, 22 bp, Artificial Sequence
  chemically synthesized
ttgattcacaaattgatatttc

SEQ ID NO: 1127625 - DNA, 22 bp, Artificial Sequence
  chemically synthesized
tatttttgattcacaaattgat

SEQ ID NO: 1127626 - DNA, 22 bp, Artificial Sequence
  chemically synthesized
tcatcacctatatttttgattc

SEQ ID NO: 1127627 - DNA, 22 bp, Artificial Sequence
  chemically synthesized
atcatcacctatatttttgatt

SEQ ID NO: 1127628 - DNA, 22 bp, Artificial Sequence
  chemically synthesized
tatcatcacctatatttttgat

SEQ ID NO: 1127629 - DNA, 22 bp, Artificial Sequence
  chemically synthesized
taatctttatcatcacctatat

SEQ ID NO: 1127630 - DNA, 22 bp, Artificial Sequence
  chemically synthesized
gtgaatcaaaaatataggtgat

SEQ ID NO: 1127631 - DNA, 22 bp, Artificial Sequence
  chemically synthesized
ataatctttatcatcacctata

SEQ ID NO: 1127632 - DNA, 22 bp, Artificial Sequence
  chemically synthesized
tgaatcaaaaatataggtgatg

SEQ ID NO: 1127633 - DNA, 22 bp, Artificial Sequence
  chemically synthesized
gggaaatatcatttataatctt

SEQ ID NO: 1127634 - DNA, 22 bp, Artificial Sequence
  chemically synthesized
ggggaaatatcatttataatct

SEQ ID NO: 1127635 - DNA, 22 bp, Artificial Sequence
  chemically synthesized
tggggaaatatcatttataatc

SEQ ID NO: 1127636 - DNA, 22 bp, Artificial Sequence
  chemically synthesized
ttggggaaatatcatttataat

SEQ ID NO: 1127637 - DNA, 22 bp, Artificial Sequence
  chemically synthesized
tttggggaaatatcatttataa

SEQ ID NO: 1127638 - DNA, 22 bp, Artificial Sequence
  chemically synthesized
ttttttggggaaatatcattta

SEQ ID NO: 1127639 - DNA, 22 bp, Artificial Sequence
  chemically synthesized
attttttggggaaatatcattt

SEQ ID NO: 1127640 - DNA, 22 bp, Artificial Sequence
  chemically synthesized
tattttttggggaaatatcatt

SEQ ID NO: 1127641 - DNA, 22 bp, Artificial Sequence
  chemically synthesized
tgatgctttattttttggggaa

SEQ ID NO: 1127642 - DNA, 22 bp, Artificial Sequence
  chemically synthesized
atgatgctttattttttgggga

SEQ ID NO: 1127643 - DNA, 22 bp, Artificial Sequence
  chemically synthesized
taaatgatatttccccaaaaaa

SEQ ID NO: 1127644 - DNA, 22 bp, Artificial Sequence
  chemically synthesized
ttatgatgctttattttttggg

SEQ ID NO: 1127645 - DNA, 22 bp, Artificial Sequence
  chemically synthesized
cttatgatgctttattttttgg

SEQ ID NO: 1127646 - DNA, 22 bp, Artificial Sequence
  chemically synthesized
ttcttatgatgctttatttttt

SEQ ID NO: 1127647 - DNA, 22 bp, Artificial Sequence
  chemically synthesized
cttcttatgatgctttattttt

SEQ ID NO: 1127648 - DNA, 22 bp, Artificial Sequence
  chemically synthesized
tcttcttatgatgctttatttt

SEQ ID NO: 1127649 - DNA, 22 bp, Artificial Sequence
  chemically synthesized
ttttcttcttatgatgctttat

SEQ ID NO: 1127650 - DNA, 22 bp, Artificial Sequence
  chemically synthesized
attttcttcttatgatgcttta

SEQ ID NO: 1127651 - DNA, 22 bp, Artificial Sequence
  chemically synthesized
tattttcttcttatgatgcttt

SEQ ID NO: 1127652 - DNA, 22 bp, Artificial Sequence
  chemically synthesized
ccccaaaaaataaagcatcata

SEQ ID NO: 1127653 - DNA, 22 bp, Artificial Sequence
  chemically synthesized
cccaaaaaataaagcatcataa

SEQ ID NO: 1127654 - DNA, 22 bp, Artificial Sequence
  chemically synthesized
tgattttattttcttcttatga

SEQ ID NO: 1127655 - DNA, 22 bp, Artificial Sequence
  chemically synthesized
aaattgtgattttattttcttc

SEQ ID NO: 1127656 - DNA, 22 bp, Artificial Sequence
  chemically synthesized
cataagactcaaattgtgattt

SEQ ID NO: 1127657 - DNA, 22 bp, Artificial Sequence
  chemically synthesized
atgtcagtctacataagactca

SEQ ID NO: 1127658 - DNA, 22 bp, Artificial Sequence
  chemically synthesized
aatgtcagtctacataagactc

SEQ ID NO: 1127659 - DNA, 22 bp, Artificial Sequence
  chemically synthesized
taatgtcagtctacataagact

SEQ ID NO: 1127660 - DNA, 22 bp, Artificial Sequence
  chemically synthesized
ccctttaatgtcagtctacata

SEQ ID NO: 1127661 - DNA, 22 bp, Artificial Sequence
  chemically synthesized
ctgccctttaatgtcagtctac

SEQ ID NO: 1127662 - DNA, 22 bp, Artificial Sequence
  chemically synthesized
gagtcttatgtagactgacatt

SEQ ID NO: 1127663 - DNA, 22 bp, Artificial Sequence
  chemically synthesized
ttcctgccctttaatgtcagtc

SEQ ID NO: 1127664 - DNA, 22 bp, Artificial Sequence
  chemically synthesized
agtcttatgtagactgacatta

SEQ ID NO: 1127665 - DNA, 22 bp, Artificial Sequence
  chemically synthesized
tattcctgccctttaatgtcag

SEQ ID NO: 1127666 - DNA, 22 bp, Artificial Sequence
  chemically synthesized
ctattcctgccctttaatgtca

SEQ ID NO: 1127667 - DNA, 22 bp, Artificial Sequence
  chemically synthesized
atgtagactgacattaaagggc

SEQ ID NO: 1127668 - DNA, 22 bp, Artificial Sequence
  chemically synthesized
tcttctattcctgccctttaat

SEQ ID NO: 1127669 - DNA, 22 bp, Artificial Sequence
  chemically synthesized
tgtagactgacattaaagggca

SEQ ID NO: 1127670 - DNA, 22 bp, Artificial Sequence
  chemically synthesized
cctgtcttctattcctgccctt

SEQ ID NO: 1127671 - DNA, 22 bp, Artificial Sequence
  chemically synthesized
ccctgtcttctattcctgccct

SEQ ID NO: 1127672 - DNA, 22 bp, Artificial Sequence
  chemically synthesized
acattaaagggcaggaatagaa

SEQ ID NO: 1127673 - DNA, 22 bp, Artificial Sequence
  chemically synthesized
aagggcaggaatagaagacagg

SEQ ID NO: 1127674 - DNA, 22 bp, Artificial Sequence
  chemically synthesized
agagtatatcttccctgtcttc

SEQ ID NO: 1127675 - DNA, 22 bp, Artificial Sequence
  chemically synthesized
cagagtatatcttccctgtctt

SEQ ID NO: 1127676 - DNA, 22 bp, Artificial Sequence
  chemically synthesized
tcagagtatatcttccctgtct

SEQ ID NO: 1127677 - DNA, 22 bp, Artificial Sequence
  chemically synthesized
tttcagagtatatcttccctgt

SEQ ID NO: 1127678 - DNA, 22 bp, Artificial Sequence
  chemically synthesized
ctttcagagtatatcttccctg

SEQ ID NO: 1127679 - DNA, 22 bp, Artificial Sequence
  chemically synthesized
tctttcagagtatatcttccct

SEQ ID NO: 1127680 - DNA, 22 bp, Artificial Sequence
  chemically synthesized
ttttctttcagagtatatcttc

SEQ ID NO: 1127681 - DNA, 22 bp, Artificial Sequence
  chemically synthesized
ctgttttctttcagagtatatc

SEQ ID NO: 1127682 - DNA, 22 bp, Artificial Sequence
  chemically synthesized
tcctgttttctttcagagtata

SEQ ID NO: 1127683 - DNA, 22 bp, Artificial Sequence
  chemically synthesized
tctcctgttttctttcagagta

SEQ ID NO: 1127684 - DNA, 22 bp, Artificial Sequence
  chemically synthesized
ttctctcctgttttctttcaga

SEQ ID NO: 1127685 - DNA, 22 bp, Artificial Sequence
  chemically synthesized
ggacattgttctctcctgtttt

SEQ ID NO: 1127686 - DNA, 22 bp, Artificial Sequence
  chemically synthesized
tgggacattgttctctcctgtt

SEQ ID NO: 1127687 - DNA, 22 bp, Artificial Sequence
  chemically synthesized
ctgggacattgttctctcctgt

SEQ ID NO: 1127688 - DNA, 22 bp, Artificial Sequence
  chemically synthesized
tgaaagaaaacaggagagaaca

SEQ ID NO: 1127689 - DNA, 22 bp, Artificial Sequence
  chemically synthesized
aaagaaaacaggagagaacaat

SEQ ID NO: 1127690 - DNA, 22 bp, Artificial Sequence
  chemically synthesized
cagtttctgggacattgttctc

SEQ ID NO: 1127691 - DNA, 22 bp, Artificial Sequence
  chemically synthesized
ctgcagtttctgggacattgtt

SEQ ID NO: 1127692 - DNA, 22 bp, Artificial Sequence
  chemically synthesized
tcctgcagtttctgggacattg

SEQ ID NO: 1127693 - DNA, 22 bp, Artificial Sequence
  chemically synthesized
tctcctgcagtttctgggacat

SEQ ID NO: 1127694 - DNA, 22 bp, Artificial Sequence
  chemically synthesized
ctctcctgcagtttctgggaca

SEQ ID NO: 1127695 - DNA, 22 bp, Artificial Sequence
  chemically synthesized
tctctcctgcagtttctgggac

SEQ ID NO: 1127696 - DNA, 22 bp, Artificial Sequence
  chemically synthesized
ttctctcctgcagtttctggga

SEQ ID NO: 1127697 - DNA, 22 bp, Artificial Sequence
  chemically synthesized
aaatttttctctcctgcagttt

SEQ ID NO: 1127698 - DNA, 22 bp, Artificial Sequence
  chemically synthesized
gaaatttttctctcctgcagtt

SEQ ID NO: 1127699 - DNA, 22 bp, Artificial Sequence
  chemically synthesized
ttgaaatttttctctcctgcag

SEQ ID NO: 1127700 - DNA, 22 bp, Artificial Sequence
  chemically synthesized
cttgaaatttttctctcctgca

SEQ ID NO: 1127701 - DNA, 22 bp, Artificial Sequence
  chemically synthesized
gtcccttcttgaaatttttctc

SEQ ID NO: 1127702 - DNA, 22 bp, Artificial Sequence
  chemically synthesized
caggagagaaaaatttcaagaa

SEQ ID NO: 1127703 - DNA, 22 bp, Artificial Sequence
  chemically synthesized
acagaaatgattagtcccttct

SEQ ID NO: 1127704 - DNA, 22 bp, Artificial Sequence
  chemically synthesized
gacagaaatgattagtcccttc

SEQ ID NO: 1127705 - DNA, 22 bp, Artificial Sequence
  chemically synthesized
tgcttgacagaaatgattagtc

SEQ ID NO: 1127706 - DNA, 22 bp, Artificial Sequence
  chemically synthesized
gtgcttgacagaaatgattagt

SEQ ID NO: 1127707 - DNA, 22 bp, Artificial Sequence
  chemically synthesized
caagaagggactaatcatttct

SEQ ID NO: 1127708 - DNA, 22 bp, Artificial Sequence
  chemically synthesized
aagaagggactaatcatttctg

SEQ ID NO: 1127709 - DNA, 22 bp, Artificial Sequence
  chemically synthesized
tcttgtgcttgacagaaatgat

SEQ ID NO: 1127710 - DNA, 22 bp, Artificial Sequence
  chemically synthesized
gtcttgtgcttgacagaaatga

SEQ ID NO: 1127711 - DNA, 22 bp, Artificial Sequence
  chemically synthesized
tgtcttgtgcttgacagaaatg

SEQ ID NO: 1127712 - DNA, 22 bp, Artificial Sequence
  chemically synthesized
acctttgtcttgtgcttgacag

SEQ ID NO: 1127713 - DNA, 22 bp, Artificial Sequence
  chemically synthesized
gacctttgtcttgtgcttgaca

SEQ ID NO: 1127714 - DNA, 22 bp, Artificial Sequence
  chemically synthesized
tgacctttgtcttgtgcttgac

SEQ ID NO: 1127715 - DNA, 22 bp, Artificial Sequence
  chemically synthesized
ttgacctttgtcttgtgcttga

SEQ ID NO: 1127716 - DNA, 22 bp, Artificial Sequence
  chemically synthesized
tttgacctttgtcttgtgcttg

SEQ ID NO: 1127717 - DNA, 22 bp, Artificial Sequence
  chemically synthesized
atcatttctgtcaagcacaaga

SEQ ID NO: 1127718 - DNA, 22 bp, Artificial Sequence
  chemically synthesized
cctttttgacctttgtcttgtg

SEQ ID NO: 1127719 - DNA, 22 bp, Artificial Sequence
  chemically synthesized
ccctttttgacctttgtcttgt

SEQ ID NO: 1127720 - DNA, 22 bp, Artificial Sequence
  chemically synthesized
tccctttttgacctttgtcttg

SEQ ID NO: 1127721 - DNA, 22 bp, Artificial Sequence
  chemically synthesized
ttccctttttgacctttgtctt

SEQ ID NO: 1127722 - DNA, 22 bp, Artificial Sequence
  chemically synthesized
ctgtcaagcacaagacaaaggt

SEQ ID NO: 1127723 - DNA, 22 bp, Artificial Sequence
  chemically synthesized
tgtcaagcacaagacaaaggtc

SEQ ID NO: 1127724 - DNA, 22 bp, Artificial Sequence
  chemically synthesized
ttttccctttttgacctttgtc

SEQ ID NO: 1127725 - DNA, 22 bp, Artificial Sequence
  chemically synthesized
tcaagcacaagacaaaggtcaa

SEQ ID NO: 1127726 - DNA, 22 bp, Artificial Sequence
  chemically synthesized
agttcttttccctttttgacct

SEQ ID NO: 1127727 - DNA, 22 bp, Artificial Sequence
  chemically synthesized
cagttcttttccctttttgacc

SEQ ID NO: 1127728 - DNA, 22 bp, Artificial Sequence
  chemically synthesized
ttcagttcttttccctttttga

SEQ ID NO: 1127729 - DNA, 22 bp, Artificial Sequence
  chemically synthesized
caaaggtcactcttcagttctt

SEQ ID NO: 1127730 - DNA, 22 bp, Artificial Sequence
  chemically synthesized
ccagctccaaaggtcactcttc

SEQ ID NO: 1127731 - DNA, 22 bp, Artificial Sequence
  chemically synthesized
attgccagctccaaaggtcact

SEQ ID NO: 1127732 - DNA, 22 bp, Artificial Sequence
  chemically synthesized
aattgccagctccaaaggtcac

SEQ ID NO: 1127733 - DNA, 22 bp, Artificial Sequence
  chemically synthesized
cttaattgccagctccaaaggt

SEQ ID NO: 1127734 - DNA, 22 bp, Artificial Sequence
  chemically synthesized
aagagtgacctttggagctggc

SEQ ID NO: 1127735 - DNA, 22 bp, Artificial Sequence
  chemically synthesized
tggagctggcaattaaggagct

SEQ ID NO: 1127736 - DNA, 22 bp, Artificial Sequence
  chemically synthesized
ggagctggcaattaaggagctc

SEQ ID NO: 1127737 - DNA, 22 bp, Artificial Sequence
  chemically synthesized
gagctggcaattaaggagctct

SEQ ID NO: 1127738 - DNA, 22 bp, Artificial Sequence
  chemically synthesized
agcaaggtcgccagagagctcc

SEQ ID NO: 1127739 - DNA, 22 bp, Artificial Sequence
  chemically synthesized
tcagcaaggtcgccagagagct

SEQ ID NO: 1127740 - DNA, 22 bp, Artificial Sequence
  chemically synthesized
gcaattaaggagctctctggcg

SEQ ID NO: 1127741 - DNA, 22 bp, Artificial Sequence
  chemically synthesized
ctctcagcaaggtcgccagaga

SEQ ID NO: 1127742 - DNA, 22 bp, Artificial Sequence
  chemically synthesized
aggagctctctggcgaccttgc

SEQ ID NO: 1127743 - DNA, 22 bp, Artificial Sequence
  chemically synthesized
aaactgctctcagcaaggtcgc

SEQ ID NO: 1127744 - DNA, 22 bp, Artificial Sequence
  chemically synthesized
tctggcgaccttgctgagagca

SEQ ID NO: 1127745 - DNA, 22 bp, Artificial Sequence
  chemically synthesized
tggcgaccttgctgagagcagt

SEQ ID NO: 1127746 - DNA, 22 bp, Artificial Sequence
  chemically synthesized
gcgaccttgctgagagcagttt

SEQ ID NO: 1127747 - DNA, 22 bp, Artificial Sequence
  chemically synthesized
catcgagcactgaaactgctct

SEQ ID NO: 1127748 - DNA, 22 bp, Artificial Sequence
  chemically synthesized
tacatcgagcactgaaactgct

SEQ ID NO: 1127749 - DNA, 22 bp, Artificial Sequence
  chemically synthesized
gctgagagcagtttcagtgctc

SEQ ID NO: 1127750 - DNA, 22 bp, Artificial Sequence
  chemically synthesized
atactctacatcgagcactgaa

SEQ ID NO: 1127751 - DNA, 22 bp, Artificial Sequence
  chemically synthesized
ctgagagcagtttcagtgctcg

SEQ ID NO: 1127752 - DNA, 22 bp, Artificial Sequence
  chemically synthesized
tcatactctacatcgagcactg

SEQ ID NO: 1127753 - DNA, 22 bp, Artificial Sequence
  chemically synthesized
agagcagtttcagtgctcgatg

SEQ ID NO: 1127754 - DNA, 22 bp, Artificial Sequence
  chemically synthesized
ccctctcatactctacatcgag

SEQ ID NO: 1127755 - DNA, 22 bp, Artificial Sequence
  chemically synthesized
accctctcatactctacatcga

SEQ ID NO: 1127756 - DNA, 22 bp, Artificial Sequence
  chemically synthesized
taccctctcatactctacatcg

SEQ ID NO: 1127757 - DNA, 22 bp, Artificial Sequence
  chemically synthesized
ctttaccctctcatactctaca

SEQ ID NO: 1127758 - DNA, 22 bp, Artificial Sequence
  chemically synthesized
cctttaccctctcatactctac

SEQ ID NO: 1127759 - DNA, 22 bp, Artificial Sequence
  chemically synthesized
cagtgctcgatgtagagtatga

SEQ ID NO: 1127760 - DNA, 22 bp, Artificial Sequence
  chemically synthesized
tcctttaccctctcatactcta

SEQ ID NO: 1127761 - DNA, 22 bp, Artificial Sequence
  chemically synthesized
agtgctcgatgtagagtatgag

SEQ ID NO: 1127762 - DNA, 22 bp, Artificial Sequence
  chemically synthesized
tttcctttaccctctcatactc

SEQ ID NO: 1127763 - DNA, 22 bp, Artificial Sequence
  chemically synthesized
attctttcctttaccctctcat

SEQ ID NO: 1127764 - DNA, 22 bp, Artificial Sequence
  chemically synthesized
gatgtagagtatgagagggtaa

SEQ ID NO: 1127765 - DNA, 22 bp, Artificial Sequence
  chemically synthesized
ctgattctttcctttaccctct

SEQ ID NO: 1127766 - DNA, 22 bp, Artificial Sequence
  chemically synthesized
cggactcctgattctttccttt

SEQ ID NO: 1127767 - DNA, 22 bp, Artificial Sequence
  chemically synthesized
acggactcctgattctttcctt

SEQ ID NO: 1127768 - DNA, 22 bp, Artificial Sequence
  chemically synthesized
ccttacggactcctgattcttt

SEQ ID NO: 1127769 - DNA, 22 bp, Artificial Sequence
  chemically synthesized
tattcccttacggactcctgat

SEQ ID NO: 1127770 - DNA, 22 bp, Artificial Sequence
  chemically synthesized
tctgtattcccttacggactcc

SEQ ID NO: 1127771 - DNA, 22 bp, Artificial Sequence
  chemically synthesized
aactatctgtattcccttacgg

SEQ ID NO: 1127772 - DNA, 22 bp, Artificial Sequence
  chemically synthesized
atcagaagacctgaactatctg

SEQ ID NO: 1127773 - DNA, 22 bp, Artificial Sequence
  chemically synthesized
aatcagaagacctgaactatct

SEQ ID NO: 1127774 - DNA, 22 bp, Artificial Sequence
  chemically synthesized
taatcagaagacctgaactatc

SEQ ID NO: 1127775 - DNA, 22 bp, Artificial Sequence
  chemically synthesized
ttaatcagaagacctgaactat

SEQ ID NO: 1127776 - DNA, 22 bp, Artificial Sequence
  chemically synthesized
aggtcttctgattaaaaactga

SEQ ID NO: 1127777 - DNA, 22 bp, Artificial Sequence
  chemically synthesized
agtgcaaataaaagtcagtttt

SEQ ID NO: 1127778 - DNA, 22 bp, Artificial Sequence
  chemically synthesized
ctgattaaaaactgacttttat

SEQ ID NO: 1127779 - DNA, 22 bp, Artificial Sequence
  chemically synthesized
tgattaaaaactgacttttatt

SEQ ID NO: 1127780 - DNA, 22 bp, Artificial Sequence
  chemically synthesized
attaaaaactgacttttatttg

SEQ ID NO: 1127781 - DNA, 22 bp, Artificial Sequence
  chemically synthesized
aaaactgacttttatttgcact

SEQ ID NO: 1127782 - DNA, 22 bp, Artificial Sequence
  chemically synthesized
aaaggagaagcatagttgagtg

SEQ ID NO: 1127783 - DNA, 22 bp, Artificial Sequence
  chemically synthesized
acttttatttgcactcaactat

SEQ ID NO: 1127784 - DNA, 22 bp, Artificial Sequence
  chemically synthesized
ttatttgcactcaactatgctt

SEQ ID NO: 1127785 - DNA, 22 bp, Artificial Sequence
  chemically synthesized
atctaaaaggagaagcatagtt

SEQ ID NO: 1127786 - DNA, 22 bp, Artificial Sequence
  chemically synthesized
tatttgcactcaactatgcttc

SEQ ID NO: 1127787 - DNA, 22 bp, Artificial Sequence
  chemically synthesized
atttgcactcaactatgcttct

SEQ ID NO: 1127788 - DNA, 22 bp, Artificial Sequence
  chemically synthesized
tttgcactcaactatgcttctc

SEQ ID NO: 1127789 - DNA, 22 bp, Artificial Sequence
  chemically synthesized
ttcatctaaaaggagaagcata

SEQ ID NO: 1127790 - DNA, 22 bp, Artificial Sequence
  chemically synthesized
attcatctaaaaggagaagcat

SEQ ID NO: 1127791 - DNA, 22 bp, Artificial Sequence
  chemically synthesized
gcactcaactatgcttctcctt

SEQ ID NO: 1127792 - DNA, 22 bp, Artificial Sequence
  chemically synthesized
cactcaactatgcttctccttt

SEQ ID NO: 1127793 - DNA, 22 bp, Artificial Sequence
  chemically synthesized
atacttattcatctaaaaggag

SEQ ID NO: 1127794 - DNA, 22 bp, Artificial Sequence
  chemically synthesized
aactatgcttctccttttagat

SEQ ID NO: 1127795 - DNA, 22 bp, Artificial Sequence
  chemically synthesized
tgcttctccttttagatgaata

SEQ ID NO: 1127796 - DNA, 22 bp, Artificial Sequence
  chemically synthesized
ctccttttagatgaataagtat

SEQ ID NO: 1127797 - DNA, 22 bp, Artificial Sequence
  chemically synthesized
tccttttagatgaataagtatg

SEQ ID NO: 1127798 - DNA, 22 bp, Artificial Sequence
  chemically synthesized
cttttagatgaataagtatgag

SEQ ID NO: 1127799 - DNA, 22 bp, Artificial Sequence
  chemically synthesized
ttagatgaataagtatgagtac

SEQ ID NO: 1127800 - DNA, 22 bp, Artificial Sequence
  chemically synthesized
tagatgaataagtatgagtacc

SEQ ID NO: 1127801 - DNA, 22 bp, Artificial Sequence
  chemically synthesized
agtgaagaaaatggtactcata

SEQ ID NO: 1127802 - DNA, 22 bp, Artificial Sequence
  chemically synthesized
agatgaataagtatgagtacca

SEQ ID NO: 1127803 - DNA, 22 bp, Artificial Sequence
  chemically synthesized
gagtgaagaaaatggtactcat

SEQ ID NO: 1127804 - DNA, 22 bp, Artificial Sequence
  chemically synthesized
gatgaataagtatgagtaccat

SEQ ID NO: 1127805 - DNA, 22 bp, Artificial Sequence
  chemically synthesized
tgagtgaagaaaatggtactca

SEQ ID NO: 1127806 - DNA, 22 bp, Artificial Sequence
  chemically synthesized
ttgagtgaagaaaatggtactc

SEQ ID NO: 1127807 - DNA, 22 bp, Artificial Sequence
  chemically synthesized
tttgagtgaagaaaatggtact

SEQ ID NO: 1127808 - DNA, 22 bp, Artificial Sequence
  chemically synthesized
gttttttgagtgaagaaaatgg

SEQ ID NO: 1127809 - DNA, 22 bp, Artificial Sequence
  chemically synthesized
ttcgttttttgagtgaagaaaa

SEQ ID NO: 1127810 - DNA, 22 bp, Artificial Sequence
  chemically synthesized
gttcgttttttgagtgaagaaa

SEQ ID NO: 1127811 - DNA, 22 bp, Artificial Sequence
  chemically synthesized
tgttcgttttttgagtgaagaa

SEQ ID NO: 1127812 - DNA, 22 bp, Artificial Sequence
  chemically synthesized
catataattttgttcgtttttt

SEQ ID NO: 1127813 - DNA, 22 bp, Artificial Sequence
  chemically synthesized
tcttcactcaaaaaacgaacaa

SEQ ID NO: 1127814 - DNA, 22 bp, Artificial Sequence
  chemically synthesized
ttacatataattttgttcgttt

SEQ ID NO: 1127815 - DNA, 22 bp, Artificial Sequence
  chemically synthesized
cttcactcaaaaaacgaacaaa

SEQ ID NO: 1127816 - DNA, 22 bp, Artificial Sequence
  chemically synthesized
ttcactcaaaaaacgaacaaaa

SEQ ID NO: 1127817 - DNA, 22 bp, Artificial Sequence
  chemically synthesized
cactcaaaaaacgaacaaaatt

SEQ ID NO: 1127818 - DNA, 22 bp, Artificial Sequence
  chemically synthesized
actcaaaaaacgaacaaaatta

SEQ ID NO: 1127819 - DNA, 22 bp, Artificial Sequence
  chemically synthesized
aaaaaacgaacaaaattatatg

SEQ ID NO: 1127820 - DNA, 22 bp, Artificial Sequence
  chemically synthesized
ccagagctgttacatataattt

SEQ ID NO: 1127821 - DNA, 22 bp, Artificial Sequence
  chemically synthesized
tatgtaacagctctgggaatgt

SEQ ID NO: 1127822 - DNA, 22 bp, Artificial Sequence
  chemically synthesized
tgggaatgtgatcctgtcttct

SEQ ID NO: 1127823 - DNA, 22 bp, Artificial Sequence
  chemically synthesized
ggaatgtgatcctgtcttcttt

SEQ ID NO: 1127824 - DNA, 22 bp, Artificial Sequence
  chemically synthesized
tcttctttcgtgttgatattct

SEQ ID NO: 1127825 - DNA, 22 bp, Artificial Sequence
  chemically synthesized
ctttcgtgttgatattctttta

SEQ ID NO: 1127826 - DNA, 22 bp, Artificial Sequence
  chemically synthesized
tttcgtgttgatattcttttac

SEQ ID NO: 1127827 - DNA, 22 bp, Artificial Sequence
  chemically synthesized
cagaatgcaaggcgtaaaagaa

SEQ ID NO: 1127828 - DNA, 22 bp, Artificial Sequence
  chemically synthesized
tcgtgttgatattcttttacgc

SEQ ID NO: 1127829 - DNA, 22 bp, Artificial Sequence
  chemically synthesized
ccagaatgcaaggcgtaaaaga

SEQ ID NO: 1127830 - DNA, 22 bp, Artificial Sequence
  chemically synthesized
cgtgttgatattcttttacgcc

SEQ ID NO: 1127831 - DNA, 22 bp, Artificial Sequence
  chemically synthesized
gtgttgatattcttttacgcct

SEQ ID NO: 1127832 - DNA, 22 bp, Artificial Sequence
  chemically synthesized
ttccagaatgcaaggcgtaaaa

SEQ ID NO: 1127833 - DNA, 22 bp, Artificial Sequence
  chemically synthesized
atattcttttacgccttgcatt

SEQ ID NO: 1127834 - DNA, 22 bp, Artificial Sequence
  chemically synthesized
ttttacgccttgcattctggaa

SEQ ID NO: 1127835 - DNA, 22 bp, Artificial Sequence
  chemically synthesized
ttacgccttgcattctggaaga

SEQ ID NO: 1127836 - DNA, 22 bp, Artificial Sequence
  chemically synthesized
tacgccttgcattctggaagaa

SEQ ID NO: 1127837 - DNA, 22 bp, Artificial Sequence
  chemically synthesized
tgtgaaaatgtattcttccaga

SEQ ID NO: 1127838 - DNA, 22 bp, Artificial Sequence
  chemically synthesized
acgccttgcattctggaagaat

SEQ ID NO: 1127839 - DNA, 22 bp, Artificial Sequence
  chemically synthesized
cgccttgcattctggaagaata

SEQ ID NO: 1127840 - DNA, 22 bp, Artificial Sequence
  chemically synthesized
gcattctggaagaatacatttt

SEQ ID NO: 1127841 - DNA, 22 bp, Artificial Sequence
  chemically synthesized
cattctggaagaatacattttc

SEQ ID NO: 1127842 - DNA, 22 bp, Artificial Sequence
  chemically synthesized
cagtagctatgtgaaaatgtat

SEQ ID NO: 1127843 - DNA, 22 bp, Artificial Sequence
  chemically synthesized
gctacagtagctatgtgaaaat

SEQ ID NO: 1127844 - DNA, 22 bp, Artificial Sequence
  chemically synthesized
tggaagaatacattttcacata

SEQ ID NO: 1127845 - DNA, 22 bp, Artificial Sequence
  chemically synthesized
gaagaatacattttcacatagc

SEQ ID NO: 1127846 - DNA, 22 bp, Artificial Sequence
  chemically synthesized
gatgtctggctacagtagctat

SEQ ID NO: 1127847 - DNA, 22 bp, Artificial Sequence
  chemically synthesized
ggatgtctggctacagtagcta

SEQ ID NO: 1127848 - DNA, 22 bp, Artificial Sequence
  chemically synthesized
tggatgtctggctacagtagct

SEQ ID NO: 1127849 - DNA, 22 bp, Artificial Sequence
  chemically synthesized
tcacatagctactgtagccaga

SEQ ID NO: 1127850 - DNA, 22 bp, Artificial Sequence
  chemically synthesized
tatctttggatgtctggctaca

SEQ ID NO: 1127851 - DNA, 22 bp, Artificial Sequence
  chemically synthesized
cacatagctactgtagccagac

SEQ ID NO: 1127852 - DNA, 22 bp, Artificial Sequence
  chemically synthesized
acatagctactgtagccagaca

SEQ ID NO: 1127853 - DNA, 22 bp, Artificial Sequence
  chemically synthesized
tgagatactatatctttggatg

SEQ ID NO: 1127854 - DNA, 22 bp, Artificial Sequence
  chemically synthesized
ctgtagccagacatccaaagat

SEQ ID NO: 1127855 - DNA, 22 bp, Artificial Sequence
  chemically synthesized
tagccagacatccaaagatata

SEQ ID NO: 1127856 - DNA, 22 bp, Artificial Sequence
  chemically synthesized
gtcctatgagatactatatctt

SEQ ID NO: 1127857 - DNA, 22 bp, Artificial Sequence
  chemically synthesized
agaactggtcctatgagatact

SEQ ID NO: 1127858 - DNA, 22 bp, Artificial Sequence
  chemically synthesized
tattgagaactggtcctatgag

SEQ ID NO: 1127859 - DNA, 22 bp, Artificial Sequence
  chemically synthesized
ataggaccagttctcaatatag

SEQ ID NO: 1127860 - DNA, 22 bp, Artificial Sequence
  chemically synthesized
tgaatagaaatgcactatattg

SEQ ID NO: 1127861 - DNA, 22 bp, Artificial Sequence
  chemically synthesized
aagctgtgaatagaaatgcact

SEQ ID NO: 1127862 - DNA, 22 bp, Artificial Sequence
  chemically synthesized
tcaatatagtgcatttctattc

SEQ ID NO: 1127863 - DNA, 22 bp, Artificial Sequence
  chemically synthesized
aattcaagctgtgaatagaaat

SEQ ID NO: 1127864 - DNA, 22 bp, Artificial Sequence
  chemically synthesized
aatatagtgcatttctattcac

SEQ ID NO: 1127865 - DNA, 22 bp, Artificial Sequence
  chemically synthesized
tgtagtagatgctcaattcaag

SEQ ID NO: 1127866 - DNA, 22 bp, Artificial Sequence
  chemically synthesized
ctattcacagcttgaattgagc

SEQ ID NO: 1127867 - DNA, 22 bp, Artificial Sequence
  chemically synthesized
tgtgtagtagatgctcaattca

SEQ ID NO: 1127868 - DNA, 22 bp, Artificial Sequence
  chemically synthesized
tattcacagcttgaattgagca

SEQ ID NO: 1127869 - DNA, 22 bp, Artificial Sequence
  chemically synthesized
ctgtgtagtagatgctcaattc

SEQ ID NO: 1127870 - DNA, 22 bp, Artificial Sequence
  chemically synthesized
ttcacagcttgaattgagcatc

SEQ ID NO: 1127871 - DNA, 22 bp, Artificial Sequence
  chemically synthesized
acagcttgaattgagcatctac

SEQ ID NO: 1127872 - DNA, 22 bp, Artificial Sequence
  chemically synthesized
tgtgatgtcttctgtgtagtag

SEQ ID NO: 1127873 - DNA, 22 bp, Artificial Sequence
  chemically synthesized
gaattgagcatctactacacag

SEQ ID NO: 1127874 - DNA, 22 bp, Artificial Sequence
  chemically synthesized
aattgagcatctactacacaga

SEQ ID NO: 1127875 - DNA, 22 bp, Artificial Sequence
  chemically synthesized
cctgtgtgatgtcttctgtgta

SEQ ID NO: 1127876 - DNA, 22 bp, Artificial Sequence
  chemically synthesized
agcatctactacacagaagaca

SEQ ID NO: 1127877 - DNA, 22 bp, Artificial Sequence
  chemically synthesized
gttacctgtgtgatgtcttctg

SEQ ID NO: 1127878 - DNA, 22 bp, Artificial Sequence
  chemically synthesized
ttcgttacctgtgtgatgtctt

SEQ ID NO: 1127879 - DNA, 22 bp, Artificial Sequence
  chemically synthesized
gttcgttacctgtgtgatgtct

SEQ ID NO: 1127880 - DNA, 22 bp, Artificial Sequence
  chemically synthesized
ttgttcgttacctgtgtgatgt

SEQ ID NO: 1127881 - DNA, 22 bp, Artificial Sequence
  chemically synthesized
ctacacagaagacatcacacag

SEQ ID NO: 1127882 - DNA, 22 bp, Artificial Sequence
  chemically synthesized
cttgttcgttacctgtgtgatg

SEQ ID NO: 1127883 - DNA, 22 bp, Artificial Sequence
  chemically synthesized
cacagaagacatcacacaggta

SEQ ID NO: 1127884 - DNA, 22 bp, Artificial Sequence
  chemically synthesized
ggccaggatccatttcttgttc

SEQ ID NO: 1127885 - DNA, 22 bp, Artificial Sequence
  chemically synthesized
cctgggccaggatccatttctt

SEQ ID NO: 1127886 - DNA, 22 bp, Artificial Sequence
  chemically synthesized
ccctgggccaggatccatttct

SEQ ID NO: 1127887 - DNA, 22 bp, Artificial Sequence
  chemically synthesized
aagcttccctgggccaggatcc

SEQ ID NO: 1127888 - DNA, 22 bp, Artificial Sequence
  chemically synthesized
gaattaaagcttccctgggcca

SEQ ID NO: 1127889 - DNA, 22 bp, Artificial Sequence
  chemically synthesized
atccactagaattaaagcttcc

SEQ ID NO: 1127890 - DNA, 22 bp, Artificial Sequence
  chemically synthesized
catccactagaattaaagcttc

SEQ ID NO: 1127891 - DNA, 22 bp, Artificial Sequence
  chemically synthesized
tttcatccactagaattaaagc

SEQ ID NO: 1127892 - DNA, 22 bp, Artificial Sequence
  chemically synthesized
gtttcatccactagaattaaag

SEQ ID NO: 1127893 - DNA, 22 bp, Artificial Sequence
  chemically synthesized
gcccagggaagctttaattcta

SEQ ID NO: 1127894 - DNA, 22 bp, Artificial Sequence
  chemically synthesized
tccatatgcttgtttcatccac

SEQ ID NO: 1127895 - DNA, 22 bp, Artificial Sequence
  chemically synthesized
taattctagtggatgaaacaag

SEQ ID NO: 1127896 - DNA, 22 bp, Artificial Sequence
  chemically synthesized
aattctagtggatgaaacaagc

SEQ ID NO: 1127897 - DNA, 22 bp, Artificial Sequence
  chemically synthesized
attctagtggatgaaacaagca

SEQ ID NO: 1127898 - DNA, 22 bp, Artificial Sequence
  chemically synthesized
tagtggatgaaacaagcatatg

SEQ ID NO: 1127899 - DNA, 22 bp, Artificial Sequence
  chemically synthesized
gtggatgaaacaagcatatgga

SEQ ID NO: 1127900 - DNA, 22 bp, Artificial Sequence
  chemically synthesized
tgatgaaatgatctatccatat

SEQ ID NO: 1127901 - DNA, 22 bp, Artificial Sequence
  chemically synthesized
atgatgaaatgatctatccata

SEQ ID NO: 1127902 - DNA, 22 bp, Artificial Sequence
  chemically synthesized
tatgatgaaatgatctatccat

SEQ ID NO: 1127903 - DNA, 22 bp, Artificial Sequence
  chemically synthesized
ctttatgatgaaatgatctatc

SEQ ID NO: 1127904 - DNA, 22 bp, Artificial Sequence
  chemically synthesized
ctgctttatgatgaaatgatct

SEQ ID NO: 1127905 - DNA, 22 bp, Artificial Sequence
  chemically synthesized
actgctttatgatgaaatgatc

SEQ ID NO: 1127906 - DNA, 22 bp, Artificial Sequence
  chemically synthesized
tgacaccttactgctttatgat

SEQ ID NO: 1127907 - DNA, 22 bp, Artificial Sequence
  chemically synthesized
gtgacaccttactgctttatga

SEQ ID NO: 1127908 - DNA, 22 bp, Artificial Sequence
  chemically synthesized
catcttgtgacaccttactgct

SEQ ID NO: 1127909 - DNA, 22 bp, Artificial Sequence
  chemically synthesized
ttgcatcttgtgacaccttact

SEQ ID NO: 1127910 - DNA, 22 bp, Artificial Sequence
  chemically synthesized
catcataaagcagtaaggtgtc

SEQ ID NO: 1127911 - DNA, 22 bp, Artificial Sequence
  chemically synthesized
atcataaagcagtaaggtgtca

SEQ ID NO: 1127912 - DNA, 22 bp, Artificial Sequence
  chemically synthesized
ctgttgcatcttgtgacacctt

SEQ ID NO: 1127913 - DNA, 22 bp, Artificial Sequence
  chemically synthesized
agggatgctactgttgcatctt

SEQ ID NO: 1127914 - DNA, 22 bp, Artificial Sequence
  chemically synthesized
ggcaggttaagggatgctactg

SEQ ID NO: 1127915 - DNA, 22 bp, Artificial Sequence
  chemically synthesized
ctgggcaggttaagggatgcta

SEQ ID NO: 1127916 - DNA, 22 bp, Artificial Sequence
  chemically synthesized
ttcctgggcaggttaagggatg

SEQ ID NO: 1127917 - DNA, 22 bp, Artificial Sequence
  chemically synthesized
acaggggccatctattcctggg

SEQ ID NO: 1127918 - DNA, 22 bp, Artificial Sequence
  chemically synthesized
aacctgcccaggaatagatggc

SEQ ID NO: 1127919 - DNA, 22 bp, Artificial Sequence
  chemically synthesized
acctgcccaggaatagatggcc

SEQ ID NO: 1127920 - DNA, 22 bp, Artificial Sequence
  chemically synthesized
agaggcctgacaggggccatct

SEQ ID NO: 1127921 - DNA, 22 bp, Artificial Sequence
  chemically synthesized
cccaggaatagatggcccctgt

SEQ ID NO: 1127922 - DNA, 22 bp, Artificial Sequence
  chemically synthesized
ggctcagaggcctgacaggggc

SEQ ID NO: 1127923 - DNA, 22 bp, Artificial Sequence
  chemically synthesized
gggctcagaggcctgacagggg

SEQ ID NO: 1127924 - DNA, 22 bp, Artificial Sequence
  chemically synthesized
gcttgggctcagaggcctgaca

SEQ ID NO: 1127925 - DNA, 22 bp, Artificial Sequence
  chemically synthesized
agcttgggctcagaggcctgac

SEQ ID NO: 1127926 - DNA, 22 bp, Artificial Sequence
  chemically synthesized
tcaggcctctgagcccaagcta

SEQ ID NO: 1127927 - DNA, 22 bp, Artificial Sequence
  chemically synthesized
tgagcccaagctaagccatcct

SEQ ID NO: 1127928 - DNA, 22 bp, Artificial Sequence
  chemically synthesized
agcccaagctaagccatccttt

SEQ ID NO: 1127929 - DNA, 22 bp, Artificial Sequence
  chemically synthesized
agccatcctttcccctatgacc

SEQ ID NO: 1127930 - DNA, 22 bp, Artificial Sequence
  chemically synthesized
gacgtaaaggtgcaggtcatag

SEQ ID NO: 1127931 - DNA, 22 bp, Artificial Sequence
  chemically synthesized
tcccctatgacctgcaccttta

SEQ ID NO: 1127932 - DNA, 22 bp, Artificial Sequence
  chemically synthesized
cccctatgacctgcacctttac

SEQ ID NO: 1127933 - DNA, 22 bp, Artificial Sequence
  chemically synthesized
ccctatgacctgcacctttacg

SEQ ID NO: 1127934 - DNA, 22 bp, Artificial Sequence
  chemically synthesized
aggccatctggacgtaaaggtg

SEQ ID NO: 1127935 - DNA, 22 bp, Artificial Sequence
  chemically synthesized
caggccatctggacgtaaaggt

SEQ ID NO: 1127936 - DNA, 22 bp, Artificial Sequence
  chemically synthesized
cttcaggccatctggacgtaaa

SEQ ID NO: 1127937 - DNA, 22 bp, Artificial Sequence
  chemically synthesized
tgacctgcacctttacgtccag

SEQ ID NO: 1127938 - DNA, 22 bp, Artificial Sequence
  chemically synthesized
agttgcttcaggccatctggac

SEQ ID NO: 1127939 - DNA, 22 bp, Artificial Sequence
  chemically synthesized
cagttgcttcaggccatctgga

SEQ ID NO: 1127940 - DNA, 22 bp, Artificial Sequence
  chemically synthesized
cacctttacgtccagatggcct

SEQ ID NO: 1127941 - DNA, 22 bp, Artificial Sequence
  chemically synthesized
ttcagttgcttcaggccatctg

SEQ ID NO: 1127942 - DNA, 22 bp, Artificial Sequence
  chemically synthesized
tacgtccagatggcctgaagca

SEQ ID NO: 1127943 - DNA, 22 bp, Artificial Sequence
  chemically synthesized
tgattcttcagttgcttcaggc

SEQ ID NO: 1127944 - DNA, 22 bp, Artificial Sequence
  chemically synthesized
acgtccagatggcctgaagcaa

SEQ ID NO: 1127945 - DNA, 22 bp, Artificial Sequence
  chemically synthesized
gtgattcttcagttgcttcagg

SEQ ID NO: 1127946 - DNA, 22 bp, Artificial Sequence
  chemically synthesized
cgtccagatggcctgaagcaac

SEQ ID NO: 1127947 - DNA, 22 bp, Artificial Sequence
  chemically synthesized
tgtgattcttcagttgcttcag

SEQ ID NO: 1127948 - DNA, 22 bp, Artificial Sequence
  chemically synthesized
ttgtgattcttcagttgcttca

SEQ ID NO: 1127949 - DNA, 22 bp, Artificial Sequence
  chemically synthesized
ttttgtgattcttcagttgctt

SEQ ID NO: 1127950 - DNA, 22 bp, Artificial Sequence
  chemically synthesized
cttttgtgattcttcagttgct

SEQ ID NO: 1127951 - DNA, 22 bp, Artificial Sequence
  chemically synthesized
acttcttttgtgattcttcagt

SEQ ID NO: 1127952 - DNA, 22 bp, Artificial Sequence
  chemically synthesized
cacttcttttgtgattcttcag

SEQ ID NO: 1127953 - DNA, 22 bp, Artificial Sequence
  chemically synthesized
tcacttcttttgtgattcttca

SEQ ID NO: 1127954 - DNA, 22 bp, Artificial Sequence
  chemically synthesized
aagcaactgaagaatcacaaaa

SEQ ID NO: 1127955 - DNA, 22 bp, Artificial Sequence
  chemically synthesized
aagaatcacaaaagaagtgaaa

SEQ ID NO: 1127956 - DNA, 22 bp, Artificial Sequence
  chemically synthesized
aggcagcaaccgggcattttca

SEQ ID NO: 1127957 - DNA, 22 bp, Artificial Sequence
  chemically synthesized
ctgccttaactgatgacattcc

SEQ ID NO: 1127958 - DNA, 22 bp, Artificial Sequence
  chemically synthesized
ccttaactgatgacattccacc

SEQ ID NO: 1127959 - DNA, 22 bp, Artificial Sequence
  chemically synthesized
aactgatgacattccaccattg

SEQ ID NO: 1127960 - DNA, 22 bp, Artificial Sequence
  chemically synthesized
actgatgacattccaccattgt

SEQ ID NO: 1127961 - DNA, 22 bp, Artificial Sequence
  chemically synthesized
atgacattccaccattgtgatt

SEQ ID NO: 1127962 - DNA, 22 bp, Artificial Sequence
  chemically synthesized
aggtggggcaaaaacaaatcac

SEQ ID NO: 1127963 - DNA, 22 bp, Artificial Sequence
  chemically synthesized
caccattgtgatttgtttttgc

SEQ ID NO: 1127964 - DNA, 22 bp, Artificial Sequence
  chemically synthesized
ggttaaggtggggcaaaaacaa

SEQ ID NO: 1127965 - DNA, 22 bp, Artificial Sequence
  chemically synthesized
atcgctcggttaaggtggggca

SEQ ID NO: 1127966 - DNA, 22 bp, Artificial Sequence
  chemically synthesized
tgatttgtttttgccccacctt

SEQ ID NO: 1127967 - DNA, 22 bp, Artificial Sequence
  chemically synthesized
gtttttgccccaccttaaccga

SEQ ID NO: 1127968 - DNA, 22 bp, Artificial Sequence
  chemically synthesized
tttttgccccaccttaaccgag

SEQ ID NO: 1127969 - DNA, 22 bp, Artificial Sequence
  chemically synthesized
acaaggttaatcgctcggttaa

SEQ ID NO: 1127970 - DNA, 22 bp, Artificial Sequence
  chemically synthesized
cacaaggttaatcgctcggtta

SEQ ID NO: 1127971 - DNA, 22 bp, Artificial Sequence
  chemically synthesized
ttgccccaccttaaccgagcga

SEQ ID NO: 1127972 - DNA, 22 bp, Artificial Sequence
  chemically synthesized
tgccccaccttaaccgagcgat

SEQ ID NO: 1127973 - DNA, 22 bp, Artificial Sequence
  chemically synthesized
gccccaccttaaccgagcgatt

SEQ ID NO: 1127974 - DNA, 22 bp, Artificial Sequence
  chemically synthesized
ccccaccttaaccgagcgatta

SEQ ID NO: 1127975 - DNA, 22 bp, Artificial Sequence
  chemically synthesized
aaccgagcgattaaccttgtga

SEQ ID NO: 1127976 - DNA, 22 bp, Artificial Sequence
  chemically synthesized
accgagcgattaaccttgtgaa

SEQ ID NO: 1127977 - DNA, 22 bp, Artificial Sequence
  chemically synthesized
agccaggagaaggaatttcaca

SEQ ID NO: 1127978 - DNA, 22 bp, Artificial Sequence
  chemically synthesized
gagccaggagaaggaatttcac

SEQ ID NO: 1127979 - DNA, 22 bp, Artificial Sequence
  chemically synthesized
tgagccaggagaaggaatttca

SEQ ID NO: 1127980 - DNA, 22 bp, Artificial Sequence
  chemically synthesized
accttgtgaaattccttctcct

SEQ ID NO: 1127981 - DNA, 22 bp, Artificial Sequence
  chemically synthesized
gtgaaattccttctcctggctc

SEQ ID NO: 1127982 - DNA, 22 bp, Artificial Sequence
  chemically synthesized
tgaaattccttctcctggctca

SEQ ID NO: 1127983 - DNA, 22 bp, Artificial Sequence
  chemically synthesized
agtgggggaggttttgagccag

SEQ ID NO: 1127984 - DNA, 22 bp, Artificial Sequence
  chemically synthesized
cttctcctggctcaaaacctcc

SEQ ID NO: 1127985 - DNA, 22 bp, Artificial Sequence
  chemically synthesized
ctcctggctcaaaacctccccc

SEQ ID NO: 1127986 - DNA, 22 bp, Artificial Sequence
  chemically synthesized
tcctggctcaaaacctccccca

SEQ ID NO: 1127987 - DNA, 22 bp, Artificial Sequence
  chemically synthesized
ctggctcaaaacctcccccact

SEQ ID NO: 1127988 - DNA, 22 bp, Artificial Sequence
  chemically synthesized
gctcaaaacctcccccactgag

SEQ ID NO: 1127989 - DNA, 22 bp, Artificial Sequence
  chemically synthesized
aaaacctcccccactgagcacc

SEQ ID NO: 1127990 - DNA, 22 bp, Artificial Sequence
  chemically synthesized
ccccactgagcaccttgtgacc

SEQ ID NO: 1127991 - DNA, 22 bp, Artificial Sequence
  chemically synthesized
tgggcaggggcgggggtcacaa

SEQ ID NO: 1127992 - DNA, 22 bp, Artificial Sequence
  chemically synthesized
gtgggcaggggcgggggtcaca

SEQ ID NO: 1127993 - DNA, 22 bp, Artificial Sequence
  chemically synthesized
ttgtgggcaggggcgggggtca

SEQ ID NO: 1127994 - DNA, 22 bp, Artificial Sequence
  chemically synthesized
tcttgtgggcaggggcgggggt

SEQ ID NO: 1127995 - DNA, 22 bp, Artificial Sequence
  chemically synthesized
agcaccttgtgacccccgcccc

SEQ ID NO: 1127996 - DNA, 22 bp, Artificial Sequence
  chemically synthesized
ctcttgtgggcaggggcggggg

SEQ ID NO: 1127997 - DNA, 22 bp, Artificial Sequence
  chemically synthesized
tctcttgtgggcaggggcgggg

SEQ ID NO: 1127998 - DNA, 22 bp, Artificial Sequence
  chemically synthesized
ttctcttgtgggcaggggcggg

SEQ ID NO: 1127999 - DNA, 22 bp, Artificial Sequence
  chemically synthesized
gtgacccccgcccctgcccaca

SEQ ID NO: 1128000 - DNA, 22 bp, Artificial Sequence
  chemically synthesized
tgacccccgcccctgcccacaa

SEQ ID NO: 1128001 - DNA, 22 bp, Artificial Sequence
  chemically synthesized
cagtcaaaggggatttttctct

SEQ ID NO: 1128002 - DNA, 22 bp, Artificial Sequence
  chemically synthesized
cccacaagagaaaaatcccctt

SEQ ID NO: 1128003 - DNA, 22 bp, Artificial Sequence
  chemically synthesized
ggtgggtagtggaaaattacag

SEQ ID NO: 1128004 - DNA, 22 bp, Artificial Sequence
  chemically synthesized
gggtgggtagtggaaaattaca

SEQ ID NO: 1128005 - DNA, 22 bp, Artificial Sequence
  chemically synthesized
tgactgtaattttccactaccc

SEQ ID NO: 1128006 - DNA, 22 bp, Artificial Sequence
  chemically synthesized
taggatttgggtgggtagtgga

SEQ ID NO: 1128007 - DNA, 22 bp, Artificial Sequence
  chemically synthesized
gactgtaattttccactaccca

SEQ ID NO: 1128008 - DNA, 22 bp, Artificial Sequence
  chemically synthesized
ataggatttgggtgggtagtgg

SEQ ID NO: 1128009 - DNA, 22 bp, Artificial Sequence
  chemically synthesized
actgtaattttccactacccac

SEQ ID NO: 1128010 - DNA, 22 bp, Artificial Sequence
  chemically synthesized
tataggatttgggtgggtagtg

SEQ ID NO: 1128011 - DNA, 22 bp, Artificial Sequence
  chemically synthesized
taattttccactacccacccaa

SEQ ID NO: 1128012 - DNA, 22 bp, Artificial Sequence
  chemically synthesized
tccactacccacccaaatccta

SEQ ID NO: 1128013 - DNA, 22 bp, Artificial Sequence
  chemically synthesized
ccactacccacccaaatcctat

SEQ ID NO: 1128014 - DNA, 22 bp, Artificial Sequence
  chemically synthesized
cactacccacccaaatcctata

SEQ ID NO: 1128015 - DNA, 22 bp, Artificial Sequence
  chemically synthesized
cccacccaaatcctataaaacg

SEQ ID NO: 1128016 - DNA, 22 bp, Artificial Sequence
  chemically synthesized
taaaacggccccacccctatct

SEQ ID NO: 1128017 - DNA, 22 bp, Artificial Sequence
  chemically synthesized
aaaagagagtcacggaagggag

SEQ ID NO: 1128018 - DNA, 22 bp, Artificial Sequence
  chemically synthesized
agtctgaaaagagagtcacgga

SEQ ID NO: 1128019 - DNA, 22 bp, Artificial Sequence
  chemically synthesized
tctcccttccgtgactctcttt

SEQ ID NO: 1128020 - DNA, 22 bp, Artificial Sequence
  chemically synthesized
ccttccgtgactctcttttcag

SEQ ID NO: 1128021 - DNA, 22 bp, Artificial Sequence
  chemically synthesized
ccgtgactctcttttcagactc

SEQ ID NO: 1128022 - DNA, 22 bp, Artificial Sequence
  chemically synthesized
cgtgactctcttttcagactca

SEQ ID NO: 1128023 - DNA, 22 bp, Artificial Sequence
  chemically synthesized
ggtgcaggcaggctgagtctga

SEQ ID NO: 1128024 - DNA, 22 bp, Artificial Sequence
  chemically synthesized
acctgggtgcaggcaggctgag

SEQ ID NO: 1128025 - DNA, 22 bp, Artificial Sequence
  chemically synthesized
cacctgggtgcaggcaggctga

SEQ ID NO: 1128026 - DNA, 22 bp, Artificial Sequence
  chemically synthesized
tcttttcagactcagcctgcct

SEQ ID NO: 1128027 - DNA, 22 bp, Artificial Sequence
  chemically synthesized
ttttcagactcagcctgcctgc

SEQ ID NO: 1128028 - DNA, 22 bp, Artificial Sequence
  chemically synthesized
tttcacctgggtgcaggcaggc

SEQ ID NO: 1128029 - DNA, 22 bp, Artificial Sequence
  chemically synthesized
ttcagactcagcctgcctgcac

SEQ ID NO: 1128030 - DNA, 22 bp, Artificial Sequence
  chemically synthesized
tcagactcagcctgcctgcacc

SEQ ID NO: 1128031 - DNA, 22 bp, Artificial Sequence
  chemically synthesized
cagactcagcctgcctgcaccc

SEQ ID NO: 1128032 - DNA, 22 bp, Artificial Sequence
  chemically synthesized
tctatttcacctgggtgcaggc

SEQ ID NO: 1128033 - DNA, 22 bp, Artificial Sequence
  chemically synthesized
agactcagcctgcctgcaccca

SEQ ID NO: 1128034 - DNA, 22 bp, Artificial Sequence
  chemically synthesized
agcctgcctgcacccaggtgaa

SEQ ID NO: 1128035 - DNA, 22 bp, Artificial Sequence
  chemically synthesized
cctgcacccaggtgaaatagac

SEQ ID NO: 1128036 - DNA, 22 bp, Artificial Sequence
  chemically synthesized
cacccaggtgaaatagacagcc

SEQ ID NO: 1128037 - DNA, 22 bp, Artificial Sequence
  chemically synthesized
tgtgagcaacaaggctgtctat

SEQ ID NO: 1128038 - DNA, 22 bp, Artificial Sequence
  chemically synthesized
gtgtgagcaacaaggctgtcta

SEQ ID NO: 1128039 - DNA, 22 bp, Artificial Sequence
  chemically synthesized
tgtgtgagcaacaaggctgtct

SEQ ID NO: 1128040 - DNA, 22 bp, Artificial Sequence
  chemically synthesized
gttgctcacacaaagcctgttt

SEQ ID NO: 1128041 - DNA, 22 bp, Artificial Sequence
  chemically synthesized
ttgctcacacaaagcctgtttg

SEQ ID NO: 1128042 - DNA, 22 bp, Artificial Sequence
  chemically synthesized
ctcacacaaagcctgtttggtg

SEQ ID NO: 1128043 - DNA, 22 bp, Artificial Sequence
  chemically synthesized
acacaaagcctgtttggtggtc

SEQ ID NO: 1128044 - DNA, 22 bp, Artificial Sequence
  chemically synthesized
acgtatgtccgtgtgaagagac

SEQ ID NO: 1128045 - DNA, 22 bp, Artificial Sequence
  chemically synthesized
cacgtatgtccgtgtgaagaga

SEQ ID NO: 1128046 - DNA, 22 bp, Artificial Sequence
  chemically synthesized
tcacgtatgtccgtgtgaagag

SEQ ID NO: 1128047 - DNA, 22 bp, Artificial Sequence
  chemically synthesized
tttggtggtctcttcacacgga

SEQ ID NO: 1128048 - DNA, 22 bp, Artificial Sequence
  chemically synthesized
ggtggtctcttcacacggacat

SEQ ID NO: 1128049 - DNA, 22 bp, Artificial Sequence
  chemically synthesized
gtggtctcttcacacggacata

SEQ ID NO: 1128050 - DNA, 22 bp, Artificial Sequence
  chemically synthesized
ttcacacggacatacgtgaaag

SEQ ID NO: 1128051 - DNA, 22 bp, Artificial Sequence
  chemically synthesized
cacacggacatacgtgaaagcc

SEQ ID NO: 1128052 - DNA, 22 bp, Artificial Sequence
  chemically synthesized
acacggacatacgtgaaagccc

SEQ ID NO: 1128053 - DNA, 22 bp, Artificial Sequence
  chemically synthesized
tgacagcccccataaaggggct

SEQ ID NO: 1128054 - DNA, 22 bp, Artificial Sequence
  chemically synthesized
atgacagcccccataaaggggc

SEQ ID NO: 1128055 - DNA, 22 bp, Artificial Sequence
  chemically synthesized
cttatgacagcccccataaagg

SEQ ID NO: 1128056 - DNA, 22 bp, Artificial Sequence
  chemically synthesized
ccttatgacagcccccataaag

SEQ ID NO: 1128057 - DNA, 22 bp, Artificial Sequence
  chemically synthesized
tccttatgacagcccccataaa

SEQ ID NO: 1128058 - DNA, 22 bp, Artificial Sequence
  chemically synthesized
tttccttatgacagcccccata

SEQ ID NO: 1128059 - DNA, 22 bp, Artificial Sequence
  chemically synthesized
tctttccttatgacagccccca

SEQ ID NO: 1128060 - DNA, 22 bp, Artificial Sequence
  chemically synthesized
attctctttccttatgacagcc

SEQ ID NO: 1128061 - DNA, 22 bp, Artificial Sequence
  chemically synthesized
tatgggggctgtcataaggaaa

SEQ ID NO: 1128062 - DNA, 22 bp, Artificial Sequence
  chemically synthesized
atgggggctgtcataaggaaag

SEQ ID NO: 1128063 - DNA, 22 bp, Artificial Sequence
  chemically synthesized
acccctgattctctttccttat

SEQ ID NO: 1128064 - DNA, 22 bp, Artificial Sequence
  chemically synthesized
tgggggctgtcataaggaaaga

SEQ ID NO: 1128065 - DNA, 22 bp, Artificial Sequence
  chemically synthesized
cagtctgacccctgattctctt

SEQ ID NO: 1128066 - DNA, 22 bp, Artificial Sequence
  chemically synthesized
acagtctgacccctgattctct

SEQ ID NO: 1128067 - DNA, 22 bp, Artificial Sequence
  chemically synthesized
tcataaggaaagagaatcaggg

SEQ ID NO: 1128068 - DNA, 22 bp, Artificial Sequence
  chemically synthesized
tcatttacagtctgacccctga

SEQ ID NO: 1128069 - DNA, 22 bp, Artificial Sequence
  chemically synthesized
gtcatttacagtctgacccctg

SEQ ID NO: 1128070 - DNA, 22 bp, Artificial Sequence
  chemically synthesized
gagtgtcttgtcatttacagtc

SEQ ID NO: 1128071 - DNA, 22 bp, Artificial Sequence
  chemically synthesized
actggagtgtcttgtcatttac

SEQ ID NO: 1128072 - DNA, 22 bp, Artificial Sequence
  chemically synthesized
gaaatcagttcactggagtgtc

SEQ ID NO: 1128073 - DNA, 22 bp, Artificial Sequence
  chemically synthesized
ggaaatcagttcactggagtgt

SEQ ID NO: 1128074 - DNA, 22 bp, Artificial Sequence
  chemically synthesized
taaatgacaagacactccagtg

SEQ ID NO: 1128075 - DNA, 22 bp, Artificial Sequence
  chemically synthesized
tggaaatcagttcactggagtg

SEQ ID NO: 1128076 - DNA, 22 bp, Artificial Sequence
  chemically synthesized
gggcccacactttggaaatcag

SEQ ID NO: 1128077 - DNA, 22 bp, Artificial Sequence
  chemically synthesized
agggcccacactttggaaatca

SEQ ID NO: 1128078 - DNA, 22 bp, Artificial Sequence
  chemically synthesized
cagtgaactgatttccaaagtg

SEQ ID NO: 1128079 - DNA, 22 bp, Artificial Sequence
  chemically synthesized
atttagggcccacactttggaa

SEQ ID NO: 1128080 - DNA, 22 bp, Artificial Sequence
  chemically synthesized
ctgatttagggcccacactttg

SEQ ID NO: 1128081 - DNA, 22 bp, Artificial Sequence
  chemically synthesized
ctactgatttagggcccacact

SEQ ID NO: 1128082 - DNA, 22 bp, Artificial Sequence
  chemically synthesized
ctgctactgatttagggcccac

SEQ ID NO: 1128083 - DNA, 22 bp, Artificial Sequence
  chemically synthesized
atttccaaagtgtgggccctaa

SEQ ID NO: 1128084 - DNA, 22 bp, Artificial Sequence
  chemically synthesized
tgctgctactgatttagggccc

SEQ ID NO: 1128085 - DNA, 22 bp, Artificial Sequence
  chemically synthesized
ccaaagtgtgggccctaaatca

SEQ ID NO: 1128086 - DNA, 22 bp, Artificial Sequence
  chemically synthesized
caaagtgtgggccctaaatcag

SEQ ID NO: 1128087 - DNA, 22 bp, Artificial Sequence
  chemically synthesized
acaaggtcccacgtgattctgc

SEQ ID NO: 1128088 - DNA, 22 bp, Artificial Sequence
  chemically synthesized
aatcagtagcagcagaatcacg

SEQ ID NO: 1128089 - DNA, 22 bp, Artificial Sequence
  chemically synthesized
taacaaggtcccacgtgattct

SEQ ID NO: 1128090 - DNA, 22 bp, Artificial Sequence
  chemically synthesized
ctaacaaggtcccacgtgattc

SEQ ID NO: 1128091 - DNA, 22 bp, Artificial Sequence
  chemically synthesized
atttctaacaaggtcccacgtg

SEQ ID NO: 1128092 - DNA, 22 bp, Artificial Sequence
  chemically synthesized
aatttctaacaaggtcccacgt

SEQ ID NO: 1128093 - DNA, 22 bp, Artificial Sequence
  chemically synthesized
taatttctaacaaggtcccacg

SEQ ID NO: 1128094 - DNA, 22 bp, Artificial Sequence
  chemically synthesized
gttagaaattaaaattcttggg

SEQ ID NO: 1128095 - DNA, 22 bp, Artificial Sequence
  chemically synthesized
ttagaaattaaaattcttgggc

SEQ ID NO: 1128096 - DNA, 22 bp, Artificial Sequence
  chemically synthesized
gaaattaaaattcttgggcacc

SEQ ID NO: 1128097 - DNA, 22 bp, Artificial Sequence
  chemically synthesized
ataggcgtggagtggtgcccaa

SEQ ID NO: 1128098 - DNA, 22 bp, Artificial Sequence
  chemically synthesized
taataggcgtggagtggtgccc

SEQ ID NO: 1128099 - DNA, 22 bp, Artificial Sequence
  chemically synthesized
aaattcttgggcaccactccac

SEQ ID NO: 1128100 - DNA, 22 bp, Artificial Sequence
  chemically synthesized
attctaataggcgtggagtggt

SEQ ID NO: 1128101 - DNA, 22 bp, Artificial Sequence
  chemically synthesized
taattctaataggcgtggagtg

SEQ ID NO: 1128102 - DNA, 22 bp, Artificial Sequence
  chemically synthesized
ctaattctaataggcgtggagt

SEQ ID NO: 1128103 - DNA, 22 bp, Artificial Sequence
  chemically synthesized
ttgggcaccactccacgcctat

SEQ ID NO: 1128104 - DNA, 22 bp, Artificial Sequence
  chemically synthesized
gggcaccactccacgcctatta

SEQ ID NO: 1128105 - DNA, 22 bp, Artificial Sequence
  chemically synthesized
ggcaccactccacgcctattag

SEQ ID NO: 1128106 - DNA, 22 bp, Artificial Sequence
  chemically synthesized
cacgcctattagaattagaaac

SEQ ID NO: 1128107 - DNA, 22 bp, Artificial Sequence
  chemically synthesized
ttagaattagaaactctggtga

SEQ ID NO: 1128108 - DNA, 22 bp, Artificial Sequence
  chemically synthesized
agcatgcgtcggagtcaccaga

SEQ ID NO: 1128109 - DNA, 22 bp, Artificial Sequence
  chemically synthesized
gaattagaaactctggtgactc

SEQ ID NO: 1128110 - DNA, 22 bp, Artificial Sequence
  chemically synthesized
cagcatgcgtcggagtcaccag

SEQ ID NO: 1128111 - DNA, 22 bp, Artificial Sequence
  chemically synthesized
gaaactctggtgactccgacgc

SEQ ID NO: 1128112 - DNA, 22 bp, Artificial Sequence
  chemically synthesized
atgcttcagcatgcgtcggagt

SEQ ID NO: 1128113 - DNA, 22 bp, Artificial Sequence
  chemically synthesized
tcatgcttcagcatgcgtcgga

SEQ ID NO: 1128114 - DNA, 22 bp, Artificial Sequence
  chemically synthesized
tggtgactccgacgcatgctga

SEQ ID NO: 1128115 - DNA, 22 bp, Artificial Sequence
  chemically synthesized
gtgactccgacgcatgctgaag

SEQ ID NO: 1128116 - DNA, 22 bp, Artificial Sequence
  chemically synthesized
cgacgcatgctgaagcatgaga

SEQ ID NO: 1128117 - DNA, 22 bp, Artificial Sequence
  chemically synthesized
gcatgacaacagtggttctcat

SEQ ID NO: 1128118 - DNA, 22 bp, Artificial Sequence
  chemically synthesized
gcactggcatgacaacagtggt

SEQ ID NO: 1128119 - DNA, 22 bp, Artificial Sequence
  chemically synthesized
aagcatgagaaccactgttgtc

SEQ ID NO: 1128120 - DNA, 22 bp, Artificial Sequence
  chemically synthesized
agaaccctcgcactggcatgac

SEQ ID NO: 1128121 - DNA, 22 bp, Artificial Sequence
  chemically synthesized
gagaaccctcgcactggcatga

SEQ ID NO: 1128122 - DNA, 22 bp, Artificial Sequence
  chemically synthesized
ttgtcatgccagtgcgagggtt

SEQ ID NO: 1128123 - DNA, 22 bp, Artificial Sequence
  chemically synthesized
tcatgccagtgcgagggttctc

SEQ ID NO: 1128124 - DNA, 22 bp, Artificial Sequence
  chemically synthesized
tacaccataaaatttgagaacc

SEQ ID NO: 1128125 - DNA, 22 bp, Artificial Sequence
  chemically synthesized
atacaccataaaatttgagaac

SEQ ID NO: 1128126 - DNA, 22 bp, Artificial Sequence
  chemically synthesized
ggtgatacttatacaccataaa

SEQ ID NO: 1128127 - DNA, 22 bp, Artificial Sequence
  chemically synthesized
tcggtgatacttatacaccata

SEQ ID NO: 1128128 - DNA, 22 bp, Artificial Sequence
  chemically synthesized
tcaaattttatggtgtataagt

SEQ ID NO: 1128129 - DNA, 22 bp, Artificial Sequence
  chemically synthesized
aaattttatggtgtataagtat

SEQ ID NO: 1128130 - DNA, 22 bp, Artificial Sequence
  chemically synthesized
caagcactctcggtgatactta

SEQ ID NO: 1128131 - DNA, 22 bp, Artificial Sequence
  chemically synthesized
acaagcactctcggtgatactt

SEQ ID NO: 1128132 - DNA, 22 bp, Artificial Sequence
  chemically synthesized
tacaagcactctcggtgatact

SEQ ID NO: 1128133 - DNA, 22 bp, Artificial Sequence
  chemically synthesized
tatggtgtataagtatcaccga

SEQ ID NO: 1128134 - DNA, 22 bp, Artificial Sequence
  chemically synthesized
atggtgtataagtatcaccgag

SEQ ID NO: 1128135 - DNA, 22 bp, Artificial Sequence
  chemically synthesized
tggtgtataagtatcaccgaga

SEQ ID NO: 1128136 - DNA, 22 bp, Artificial Sequence
  chemically synthesized
gtgggcccaaaaatattttaca

SEQ ID NO: 1128137 - DNA, 22 bp, Artificial Sequence
  chemically synthesized
ctggtgggcccaaaaatatttt

SEQ ID NO: 1128138 - DNA, 22 bp, Artificial Sequence
  chemically synthesized
gtaaaatatttttgggcccacc

SEQ ID NO: 1128139 - DNA, 22 bp, Artificial Sequence
  chemically synthesized
taaaatatttttgggcccacca

SEQ ID NO: 1128140 - DNA, 22 bp, Artificial Sequence
  chemically synthesized
aatcagaaacactgctggtggg

SEQ ID NO: 1128141 - DNA, 22 bp, Artificial Sequence
  chemically synthesized
ctgaatcagaaacactgctggt

SEQ ID NO: 1128142 - DNA, 22 bp, Artificial Sequence
  chemically synthesized
ttgggcccaccagcagtgtttc

SEQ ID NO: 1128143 - DNA, 22 bp, Artificial Sequence
  chemically synthesized
tgggcccaccagcagtgtttct

SEQ ID NO: 1128144 - DNA, 22 bp, Artificial Sequence
  chemically synthesized
gggcccaccagcagtgtttctg

SEQ ID NO: 1128145 - DNA, 22 bp, Artificial Sequence
  chemically synthesized
ggcccaccagcagtgtttctga

SEQ ID NO: 1128146 - DNA, 22 bp, Artificial Sequence
  chemically synthesized
ccaaacctgctgaatcagaaac

SEQ ID NO: 1128147 - DNA, 22 bp, Artificial Sequence
  chemically synthesized
cccaaacctgctgaatcagaaa

SEQ ID NO: 1128148 - DNA, 22 bp, Artificial Sequence
  chemically synthesized
gagggcccttcccaaacctgct

SEQ ID NO: 1128149 - DNA, 22 bp, Artificial Sequence
  chemically synthesized
ggagggcccttcccaaacctgc

SEQ ID NO: 1128150 - DNA, 22 bp, Artificial Sequence
  chemically synthesized
ctgattcagcaggtttgggaag

SEQ ID NO: 1128151 - DNA, 22 bp, Artificial Sequence
  chemically synthesized
tgattcagcaggtttgggaagg

SEQ ID NO: 1128152 - DNA, 22 bp, Artificial Sequence
  chemically synthesized
attcagcaggtttgggaagggc

SEQ ID NO: 1128153 - DNA, 22 bp, Artificial Sequence
  chemically synthesized
agcaggtttgggaagggccctc

SEQ ID NO: 1128154 - DNA, 22 bp, Artificial Sequence
  chemically synthesized
aaatgcagatttggagggccct

SEQ ID NO: 1128155 - DNA, 22 bp, Artificial Sequence
  chemically synthesized
gaaatgcagatttggagggccc

SEQ ID NO: 1128156 - DNA, 22 bp, Artificial Sequence
  chemically synthesized
tgaaatgcagatttggagggcc

SEQ ID NO: 1128157 - DNA, 22 bp, Artificial Sequence
  chemically synthesized
tttgaaatgcagatttggaggg

SEQ ID NO: 1128158 - DNA, 22 bp, Artificial Sequence
  chemically synthesized
ctttgaaatgcagatttggagg

SEQ ID NO: 1128159 - DNA, 22 bp, Artificial Sequence
  chemically synthesized
gggaagggccctccaaatctgc

SEQ ID NO: 1128160 - DNA, 22 bp, Artificial Sequence
  chemically synthesized
ggaagggccctccaaatctgca

SEQ ID NO: 1128161 - DNA, 22 bp, Artificial Sequence
  chemically synthesized
ggaccttctttgaaatgcagat

SEQ ID NO: 1128162 - DNA, 22 bp, Artificial Sequence
  chemically synthesized
caaatctgcatttcaaagaagg

SEQ ID NO: 1128163 - DNA, 22 bp, Artificial Sequence
  chemically synthesized
catttcaaagaaggtcccaggt

SEQ ID NO: 1128164 - DNA, 22 bp, Artificial Sequence
  chemically synthesized
caaagaaggtcccaggtgatga

SEQ ID NO: 1128165 - DNA, 22 bp, Artificial Sequence
  chemically synthesized
aaagaaggtcccaggtgatgat

SEQ ID NO: 1128166 - DNA, 22 bp, Artificial Sequence
  chemically synthesized
cagtgcatgaaacagtatcatc

SEQ ID NO: 1128167 - DNA, 22 bp, Artificial Sequence
  chemically synthesized
aaactgcagtgcatgaaacagt

SEQ ID NO: 1128168 - DNA, 22 bp, Artificial Sequence
  chemically synthesized
gaacagtaatattcaaactgca

SEQ ID NO: 1128169 - DNA, 22 bp, Artificial Sequence
  chemically synthesized
agaacagtaatattcaaactgc

SEQ ID NO: 1128170 - DNA, 22 bp, Artificial Sequence
  chemically synthesized
tttcatgcactgcagtttgaat

SEQ ID NO: 1128171 - DNA, 22 bp, Artificial Sequence
  chemically synthesized
catgcactgcagtttgaatatt

SEQ ID NO: 1128172 - DNA, 22 bp, Artificial Sequence
  chemically synthesized
atgcactgcagtttgaatatta

SEQ ID NO: 1128173 - DNA, 22 bp, Artificial Sequence
  chemically synthesized
cagtttgaatattactgttcta

SEQ ID NO: 1128174 - DNA, 22 bp, Artificial Sequence
  chemically synthesized
tgggatcagagaatacttagaa

SEQ ID NO: 1128175 - DNA, 22 bp, Artificial Sequence
  chemically synthesized
gaatattactgttctaagtatt

SEQ ID NO: 1128176 - DNA, 22 bp, Artificial Sequence
  chemically synthesized
aatattactgttctaagtattc

SEQ ID NO: 1128177 - DNA, 22 bp, Artificial Sequence
  chemically synthesized
ctgttctaagtattctctgatc

SEQ ID NO: 1128178 - DNA, 22 bp, Artificial Sequence
  chemically synthesized
gagaatgctatgggatcagaga

SEQ ID NO: 1128179 - DNA, 22 bp, Artificial Sequence
  chemically synthesized
ttctaagtattctctgatccca

SEQ ID NO: 1128180 - DNA, 22 bp, Artificial Sequence
  chemically synthesized
tagagaatgctatgggatcaga

SEQ ID NO: 1128181 - DNA, 22 bp, Artificial Sequence
  chemically synthesized
taagtattctctgatcccatag

SEQ ID NO: 1128182 - DNA, 22 bp, Artificial Sequence
  chemically synthesized
agtattctctgatcccatagca

SEQ ID NO: 1128183 - DNA, 22 bp, Artificial Sequence
  chemically synthesized
tctgatcccatagcattctcta

SEQ ID NO: 1128184 - DNA, 22 bp, Artificial Sequence
  chemically synthesized
tgatcccatagcattctctaga

SEQ ID NO: 1128185 - DNA, 22 bp, Artificial Sequence
  chemically synthesized
atcccatagcattctctagaat

SEQ ID NO: 1128186 - DNA, 22 bp, Artificial Sequence
  chemically synthesized
aagaatatagtaatgtgaattc

SEQ ID NO: 1128187 - DNA, 22 bp, Artificial Sequence
  chemically synthesized
gaagaatatagtaatgtgaatt

SEQ ID NO: 1128188 - DNA, 22 bp, Artificial Sequence
  chemically synthesized
tgaagaatatagtaatgtgaat

SEQ ID NO: 1128189 - DNA, 22 bp, Artificial Sequence
  chemically synthesized
tctagaattcacattactatat

SEQ ID NO: 1128190 - DNA, 22 bp, Artificial Sequence
  chemically synthesized
tagaattcacattactatattc

SEQ ID NO: 1128191 - DNA, 22 bp, Artificial Sequence
  chemically synthesized
gaattcacattactatattctt

SEQ ID NO: 1128192 - DNA, 22 bp, Artificial Sequence
  chemically synthesized
acattactatattcttcaaaac

SEQ ID NO: 1128193 - DNA, 22 bp, Artificial Sequence
  chemically synthesized
ctatattcttcaaaacactgct

SEQ ID NO: 1128194 - DNA, 22 bp, Artificial Sequence
  chemically synthesized
tattcttcaaaacactgctatt

SEQ ID NO: 1128195 - DNA, 22 bp, Artificial Sequence
  chemically synthesized
ttcaaaacactgctattgattt

SEQ ID NO: 1128196 - DNA, 22 bp, Artificial Sequence
  chemically synthesized
tgcatcaagaataaatcaatag

SEQ ID NO: 1128197 - DNA, 22 bp, Artificial Sequence
  chemically synthesized
atgcatcaagaataaatcaata

SEQ ID NO: 1128198 - DNA, 22 bp, Artificial Sequence
  chemically synthesized
caaaacactgctattgatttat

SEQ ID NO: 1128199 - DNA, 22 bp, Artificial Sequence
  chemically synthesized
aaaacactgctattgatttatt

SEQ ID NO: 1128200 - DNA, 22 bp, Artificial Sequence
  chemically synthesized
tcttatgcatcaagaataaatc

SEQ ID NO: 1128201 - DNA, 22 bp, Artificial Sequence
  chemically synthesized
tgttgtcttatgcatcaagaat

SEQ ID NO: 1128202 - DNA, 22 bp, Artificial Sequence
  chemically synthesized
ctattgatttattcttgatgca

SEQ ID NO: 1128203 - DNA, 22 bp, Artificial Sequence
  chemically synthesized
ttgatttattcttgatgcataa

SEQ ID NO: 1128204 - DNA, 22 bp, Artificial Sequence
  chemically synthesized
agattatgttgtcttatgcatc

SEQ ID NO: 1128205 - DNA, 22 bp, Artificial Sequence
  chemically synthesized
gagattatgttgtcttatgcat

SEQ ID NO: 1128206 - DNA, 22 bp, Artificial Sequence
  chemically synthesized
atttattcttgatgcataagac

SEQ ID NO: 1128207 - DNA, 22 bp, Artificial Sequence
  chemically synthesized
ttgagattatgttgtcttatgc

SEQ ID NO: 1128208 - DNA, 22 bp, Artificial Sequence
  chemically synthesized
attcttgatgcataagacaaca

SEQ ID NO: 1128209 - DNA, 22 bp, Artificial Sequence
  chemically synthesized
ttcttgatgcataagacaacat

SEQ ID NO: 1128210 - DNA, 22 bp, Artificial Sequence
  chemically synthesized
ttgatgcataagacaacataat

SEQ ID NO: 1128211 - DNA, 22 bp, Artificial Sequence
  chemically synthesized
aatgttcttgagattatgttgt

SEQ ID NO: 1128212 - DNA, 22 bp, Artificial Sequence
  chemically synthesized
gatgcataagacaacataatct

SEQ ID NO: 1128213 - DNA, 22 bp, Artificial Sequence
  chemically synthesized
atgcataagacaacataatctc

SEQ ID NO: 1128214 - DNA, 22 bp, Artificial Sequence
  chemically synthesized
ttaaatgttcttgagattatgt

SEQ ID NO: 1128215 - DNA, 22 bp, Artificial Sequence
  chemically synthesized
aaaaagataaccatctattaaa

SEQ ID NO: 1128216 - DNA, 22 bp, Artificial Sequence
  chemically synthesized
aagaacatttaatagatggtta

SEQ ID NO: 1128217 - DNA, 22 bp, Artificial Sequence
  chemically synthesized
acatcctcaaaaagataaccat

SEQ ID NO: 1128218 - DNA, 22 bp, Artificial Sequence
  chemically synthesized
cacatcctcaaaaagataacca

SEQ ID NO: 1128219 - DNA, 22 bp, Artificial Sequence
  chemically synthesized
aatagatggttatctttttgag

SEQ ID NO: 1128220 - DNA, 22 bp, Artificial Sequence
  chemically synthesized
atagatggttatctttttgagg

SEQ ID NO: 1128221 - DNA, 22 bp, Artificial Sequence
  chemically synthesized
cataccatcttcacatcctcaa

SEQ ID NO: 1128222 - DNA, 22 bp, Artificial Sequence
  chemically synthesized
gcataccatcttcacatcctca

SEQ ID NO: 1128223 - DNA, 22 bp, Artificial Sequence
  chemically synthesized
tctttttgaggatgtgaagatg

SEQ ID NO: 1128224 - DNA, 22 bp, Artificial Sequence
  chemically synthesized
tttgaggatgtgaagatggtat

SEQ ID NO: 1128225 - DNA, 22 bp, Artificial Sequence
  chemically synthesized
ttgaggatgtgaagatggtatg

SEQ ID NO: 1128226 - DNA, 22 bp, Artificial Sequence
  chemically synthesized
tgaggatgtgaagatggtatgc

SEQ ID NO: 1128227 - DNA, 22 bp, Artificial Sequence
  chemically synthesized
gaggatgtgaagatggtatgca

SEQ ID NO: 1128228 - DNA, 22 bp, Artificial Sequence
  chemically synthesized
aggatgtgaagatggtatgcaa

SEQ ID NO: 1128229 - DNA, 22 bp, Artificial Sequence
  chemically synthesized
aaaaaaaaaaaaaaagaaatag

SEQ ID NO: 1128230 - DNA, 22 bp, Artificial Sequence
  chemically synthesized
ttaaaaaaaaaaaaaaaagaaa

SEQ ID NO: 1128231 - DNA, 22 bp, Artificial Sequence
  chemically synthesized
gttaaaaaaaaaaaaaaaagaa

SEQ ID NO: 1128232 - DNA, 22 bp, Artificial Sequence
  chemically synthesized
tgttaaaaaaaaaaaaaaaaga

SEQ ID NO: 1128233 - DNA, 22 bp, Artificial Sequence
  chemically synthesized
ttgttaaaaaaaaaaaaaaaag

SEQ ID NO: 1128234 - DNA, 22 bp, Artificial Sequence
  chemically synthesized
tttgttaaaaaaaaaaaaaaaa

SEQ ID NO: 1128235 - DNA, 22 bp, Artificial Sequence
  chemically synthesized
ttttttgttaaaaaaaaaaaaa

SEQ ID NO: 1128236 - DNA, 22 bp, Artificial Sequence
  chemically synthesized
ctatttcttttttttttttttt

SEQ ID NO: 1128237 - DNA, 22 bp, Artificial Sequence
  chemically synthesized
tatttctttttttttttttttt

SEQ ID NO: 1128238 - DNA, 22 bp, Artificial Sequence
  chemically synthesized
tttcttttttttttttttttaa

SEQ ID NO: 1128239 - DNA, 22 bp, Artificial Sequence
  chemically synthesized
gacactattttttgttaaaaaa

SEQ ID NO: 1128240 - DNA, 22 bp, Artificial Sequence
  chemically synthesized
cttttttttttttttttaacaa

SEQ ID NO: 1128241 - DNA, 22 bp, Artificial Sequence
  chemically synthesized
agacactattttttgttaaaaa

SEQ ID NO: 1128242 - DNA, 22 bp, Artificial Sequence
  chemically synthesized
ttttttttttttttttaacaaa

SEQ ID NO: 1128243 - DNA, 22 bp, Artificial Sequence
  chemically synthesized
tagacactattttttgttaaaa

SEQ ID NO: 1128244 - DNA, 22 bp, Artificial Sequence
  chemically synthesized
ttttttttttttttaacaaaaa

SEQ ID NO: 1128245 - DNA, 22 bp, Artificial Sequence
  chemically synthesized
tttttttttttttaacaaaaaa

SEQ ID NO: 1128246 - DNA, 22 bp, Artificial Sequence
  chemically synthesized
ttttttttttttaacaaaaaat

SEQ ID NO: 1128247 - DNA, 22 bp, Artificial Sequence
  chemically synthesized
gctttagacactattttttgtt

SEQ ID NO: 1128248 - DNA, 22 bp, Artificial Sequence
  chemically synthesized
tttttttttttaacaaaaaata

SEQ ID NO: 1128249 - DNA, 22 bp, Artificial Sequence
  chemically synthesized
cgctttagacactattttttgt

SEQ ID NO: 1128250 - DNA, 22 bp, Artificial Sequence
  chemically synthesized
ttttttttttaacaaaaaatag

SEQ ID NO: 1128251 - DNA, 22 bp, Artificial Sequence
  chemically synthesized
tttttttttaacaaaaaatagt

SEQ ID NO: 1128252 - DNA, 22 bp, Artificial Sequence
  chemically synthesized
ttttttttaacaaaaaatagtg

SEQ ID NO: 1128253 - DNA, 22 bp, Artificial Sequence
  chemically synthesized
tttttttaacaaaaaatagtgt

SEQ ID NO: 1128254 - DNA, 22 bp, Artificial Sequence
  chemically synthesized
ttttttaacaaaaaatagtgtc

SEQ ID NO: 1128255 - DNA, 22 bp, Artificial Sequence
  chemically synthesized
tttttaacaaaaaatagtgtct

SEQ ID NO: 1128256 - DNA, 22 bp, Artificial Sequence
  chemically synthesized
aaatttcgctttagacactatt

SEQ ID NO: 1128257 - DNA, 22 bp, Artificial Sequence
  chemically synthesized
ttttaacaaaaaatagtgtcta

SEQ ID NO: 1128258 - DNA, 22 bp, Artificial Sequence
  chemically synthesized
tttaacaaaaaatagtgtctaa

SEQ ID NO: 1128259 - DNA, 22 bp, Artificial Sequence
  chemically synthesized
ttaacaaaaaatagtgtctaaa

SEQ ID NO: 1128260 - DNA, 22 bp, Artificial Sequence
  chemically synthesized
taacaaaaaatagtgtctaaag

SEQ ID NO: 1128261 - DNA, 22 bp, Artificial Sequence
  chemically synthesized
aacaaaaaatagtgtctaaagc

SEQ ID NO: 1128262 - DNA, 22 bp, Artificial Sequence
  chemically synthesized
acaaaaaatagtgtctaaagcg

SEQ ID NO: 1128263 - DNA, 22 bp, Artificial Sequence
  chemically synthesized
gtcataaattcaaatttcgctt

SEQ ID NO: 1128264 - DNA, 22 bp, Artificial Sequence
  chemically synthesized
ggtcataaattcaaatttcgct

SEQ ID NO: 1128265 - DNA, 22 bp, Artificial Sequence
  chemically synthesized
aagcgaaatttgaatttatgac

SEQ ID NO: 1128266 - DNA, 22 bp, Artificial Sequence
  chemically synthesized
aaggaaaatgaccttggtcata

SEQ ID NO: 1128267 - DNA, 22 bp, Artificial Sequence
  chemically synthesized
gaatttatgaccaaggtcattt

SEQ ID NO: 1128268 - DNA, 22 bp, Artificial Sequence
  chemically synthesized
tgtattaaaggaaaatgacctt

SEQ ID NO: 1128269 - DNA, 22 bp, Artificial Sequence
  chemically synthesized
aatttatgaccaaggtcatttt

SEQ ID NO: 1128270 - DNA, 22 bp, Artificial Sequence
  chemically synthesized
atgtattaaaggaaaatgacct

SEQ ID NO: 1128271 - DNA, 22 bp, Artificial Sequence
  chemically synthesized
tatgtattaaaggaaaatgacc

SEQ ID NO: 1128272 - DNA, 22 bp, Artificial Sequence
  chemically synthesized
ttatgtattaaaggaaaatgac

SEQ ID NO: 1128273 - DNA, 22 bp, Artificial Sequence
  chemically synthesized
tttatgtattaaaggaaaatga

SEQ ID NO: 1128274 - DNA, 22 bp, Artificial Sequence
  chemically synthesized
atgaccaaggtcattttccttt

SEQ ID NO: 1128275 - DNA, 22 bp, Artificial Sequence
  chemically synthesized
tgaccaaggtcattttccttta

SEQ ID NO: 1128276 - DNA, 22 bp, Artificial Sequence
  chemically synthesized
ctttttatgtattaaaggaaaa

SEQ ID NO: 1128277 - DNA, 22 bp, Artificial Sequence
  chemically synthesized
caatgtcatgttactttttatg

SEQ ID NO: 1128278 - DNA, 22 bp, Artificial Sequence
  chemically synthesized
tcctttaatacataaaaagtaa

SEQ ID NO: 1128279 - DNA, 22 bp, Artificial Sequence
  chemically synthesized
cctttaatacataaaaagtaac

SEQ ID NO: 1128280 - DNA, 22 bp, Artificial Sequence
  chemically synthesized
ctttaatacataaaaagtaaca

SEQ ID NO: 1128281 - DNA, 22 bp, Artificial Sequence
  chemically synthesized
tagttgcaatgtcatgttactt

SEQ ID NO: 1128282 - DNA, 22 bp, Artificial Sequence
  chemically synthesized
taatacataaaaagtaacatga

SEQ ID NO: 1128283 - DNA, 22 bp, Artificial Sequence
  chemically synthesized
aatacataaaaagtaacatgac

SEQ ID NO: 1128284 - DNA, 22 bp, Artificial Sequence
  chemically synthesized
atacataaaaagtaacatgaca

SEQ ID NO: 1128285 - DNA, 22 bp, Artificial Sequence
  chemically synthesized
gtgttatagttgcaatgtcatg

SEQ ID NO: 1128286 - DNA, 22 bp, Artificial Sequence
  chemically synthesized
tagtgttatagttgcaatgtca

SEQ ID NO: 1128287 - DNA, 22 bp, Artificial Sequence
  chemically synthesized
aatccattctagtgttatagtt

SEQ ID NO: 1128288 - DNA, 22 bp, Artificial Sequence
  chemically synthesized
ctaaatccattctagtgttata

SEQ ID NO: 1128289 - DNA, 22 bp, Artificial Sequence
  chemically synthesized
tcctaaatccattctagtgtta

SEQ ID NO: 1128290 - DNA, 22 bp, Artificial Sequence
  chemically synthesized
actctcctaaatccattctagt

SEQ ID NO: 1128291 - DNA, 22 bp, Artificial Sequence
  chemically synthesized
caactataacactagaatggat

SEQ ID NO: 1128292 - DNA, 22 bp, Artificial Sequence
  chemically synthesized
gtgctgactctcctaaatccat

SEQ ID NO: 1128293 - DNA, 22 bp, Artificial Sequence
  chemically synthesized
taacactagaatggatttagga

SEQ ID NO: 1128294 - DNA, 22 bp, Artificial Sequence
  chemically synthesized
gaatggatttaggagagtcagc

SEQ ID NO: 1128295 - DNA, 22 bp, Artificial Sequence
  chemically synthesized
caaaataaggactggtgctgac

SEQ ID NO: 1128296 - DNA, 22 bp, Artificial Sequence
  chemically synthesized
agttgcaaaataaggactggtg

SEQ ID NO: 1128297 - DNA, 22 bp, Artificial Sequence
  chemically synthesized
aggagagtcagcaccagtcctt

SEQ ID NO: 1128298 - DNA, 22 bp, Artificial Sequence
  chemically synthesized
cagttgcaaaataaggactggt

SEQ ID NO: 1128299 - DNA, 22 bp, Artificial Sequence
  chemically synthesized
ggagagtcagcaccagtcctta

SEQ ID NO: 1128300 - DNA, 22 bp, Artificial Sequence
  chemically synthesized
tcagttgcaaaataaggactgg

SEQ ID NO: 1128301 - DNA, 22 bp, Artificial Sequence
  chemically synthesized
ctttcagttgcaaaataaggac

SEQ ID NO: 1128302 - DNA, 22 bp, Artificial Sequence
  chemically synthesized
gctttcagttgcaaaataagga

SEQ ID NO: 1128303 - DNA, 22 bp, Artificial Sequence
  chemically synthesized
aataacttgctttcagttgcaa

SEQ ID NO: 1128304 - DNA, 22 bp, Artificial Sequence
  chemically synthesized
attttgcaactgaaagcaagtt

SEQ ID NO: 1128305 - DNA, 22 bp, Artificial Sequence
  chemically synthesized
ttttgcaactgaaagcaagtta

SEQ ID NO: 1128306 - DNA, 22 bp, Artificial Sequence
  chemically synthesized
tgcaactgaaagcaagttattt

SEQ ID NO: 1128307 - DNA, 22 bp, Artificial Sequence
  chemically synthesized
gcaactgaaagcaagttattta

SEQ ID NO: 1128308 - DNA, 22 bp, Artificial Sequence
  chemically synthesized
caactgaaagcaagttatttaa

SEQ ID NO: 1128309 - DNA, 22 bp, Artificial Sequence
  chemically synthesized
aggtccagaaaggttaaataac

SEQ ID NO: 1128310 - DNA, 22 bp, Artificial Sequence
  chemically synthesized
attgaggtccagaaaggttaaa

SEQ ID NO: 1128311 - DNA, 22 bp, Artificial Sequence
  chemically synthesized
aaagcaagttatttaacctttc

SEQ ID NO: 1128312 - DNA, 22 bp, Artificial Sequence
  chemically synthesized
caggttaattgaggtccagaaa

SEQ ID NO: 1128313 - DNA, 22 bp, Artificial Sequence
  chemically synthesized
acaggttaattgaggtccagaa

SEQ ID NO: 1128314 - DNA, 22 bp, Artificial Sequence
  chemically synthesized
tttaacctttctggacctcaat

SEQ ID NO: 1128315 - DNA, 22 bp, Artificial Sequence
  chemically synthesized
aacctttctggacctcaattaa

SEQ ID NO: 1128316 - DNA, 22 bp, Artificial Sequence
  chemically synthesized
acctttctggacctcaattaac

SEQ ID NO: 1128317 - DNA, 22 bp, Artificial Sequence
  chemically synthesized
tgcatgtttacaggttaattga

SEQ ID NO: 1128318 - DNA, 22 bp, Artificial Sequence
  chemically synthesized
atgcatgtttacaggttaattg

SEQ ID NO: 1128319 - DNA, 22 bp, Artificial Sequence
  chemically synthesized
tctggacctcaattaacctgta

SEQ ID NO: 1128320 - DNA, 22 bp, Artificial Sequence
  chemically synthesized
ctggacctcaattaacctgtaa

SEQ ID NO: 1128321 - DNA, 22 bp, Artificial Sequence
  chemically synthesized
tggacctcaattaacctgtaaa

SEQ ID NO: 1128322 - DNA, 22 bp, Artificial Sequence
  chemically synthesized
gacttatgcatgtttacaggtt

SEQ ID NO: 1128323 - DNA, 22 bp, Artificial Sequence
  chemically synthesized
gacctcaattaacctgtaaaca

SEQ ID NO: 1128324 - DNA, 22 bp, Artificial Sequence
  chemically synthesized
aattaacctgtaaacatgcata

SEQ ID NO: 1128325 - DNA, 22 bp, Artificial Sequence
  chemically synthesized
aggagactagacttatgcatgt

SEQ ID NO: 1128326 - DNA, 22 bp, Artificial Sequence
  chemically synthesized
ctaaggagactagacttatgca

SEQ ID NO: 1128327 - DNA, 22 bp, Artificial Sequence
  chemically synthesized
acctgtaaacatgcataagtct

SEQ ID NO: 1128328 - DNA, 22 bp, Artificial Sequence
  chemically synthesized
cctaaggagactagacttatgc

SEQ ID NO: 1128329 - DNA, 22 bp, Artificial Sequence
  chemically synthesized
tcctaaggagactagacttatg

SEQ ID NO: 1128330 - DNA, 22 bp, Artificial Sequence
  chemically synthesized
ttcctaaggagactagacttat

SEQ ID NO: 1128331 - DNA, 22 bp, Artificial Sequence
  chemically synthesized
tttcctaaggagactagactta

SEQ ID NO: 1128332 - DNA, 22 bp, Artificial Sequence
  chemically synthesized
ttttcctaaggagactagactt

SEQ ID NO: 1128333 - DNA, 22 bp, Artificial Sequence
  chemically synthesized
taaacatgcataagtctagtct

SEQ ID NO: 1128334 - DNA, 22 bp, Artificial Sequence
  chemically synthesized
tttttcctaaggagactagact

SEQ ID NO: 1128335 - DNA, 22 bp, Artificial Sequence
  chemically synthesized
tttttttcctaaggagactaga

SEQ ID NO: 1128336 - DNA, 22 bp, Artificial Sequence
  chemically synthesized
ctttttttcctaaggagactag

SEQ ID NO: 1128337 - DNA, 22 bp, Artificial Sequence
  chemically synthesized
cttctttttttcctaaggagac

SEQ ID NO: 1128338 - DNA, 22 bp, Artificial Sequence
  chemically synthesized
gcttctttttttcctaaggaga

SEQ ID NO: 1128339 - DNA, 22 bp, Artificial Sequence
  chemically synthesized
gatgatttgcttctttttttcc

SEQ ID NO: 1128340 - DNA, 22 bp, Artificial Sequence
  chemically synthesized
agatgatttgcttctttttttc

SEQ ID NO: 1128341 - DNA, 22 bp, Artificial Sequence
  chemically synthesized
tagatgatttgcttcttttttt

SEQ ID NO: 1128342 - DNA, 22 bp, Artificial Sequence
  chemically synthesized
gtctccttaggaaaaaaagaag

SEQ ID NO: 1128343 - DNA, 22 bp, Artificial Sequence
  chemically synthesized
cttaggaaaaaaagaagcaaat

SEQ ID NO: 1128344 - DNA, 22 bp, Artificial Sequence
  chemically synthesized
aggaaaaaaagaagcaaatcat

SEQ ID NO: 1128345 - DNA, 22 bp, Artificial Sequence
  chemically synthesized
ggaaaaaaagaagcaaatcatc

SEQ ID NO: 1128346 - DNA, 22 bp, Artificial Sequence
  chemically synthesized
gcacagcccatagaaacaaaac

SEQ ID NO: 1128347 - DNA, 22 bp, Artificial Sequence
  chemically synthesized
ttggcacagcccatagaaacaa

SEQ ID NO: 1128348 - DNA, 22 bp, Artificial Sequence
  chemically synthesized
cctattggcacagcccatagaa

SEQ ID NO: 1128349 - DNA, 22 bp, Artificial Sequence
  chemically synthesized
aaatgttttgtttctatgggct

SEQ ID NO: 1128350 - DNA, 22 bp, Artificial Sequence
  chemically synthesized
gcctattggcacagcccataga

SEQ ID NO: 1128351 - DNA, 22 bp, Artificial Sequence
  chemically synthesized
tgcctattggcacagcccatag

SEQ ID NO: 1128352 - DNA, 22 bp, Artificial Sequence
  chemically synthesized
ttgcctattggcacagcccata

SEQ ID NO: 1128353 - DNA, 22 bp, Artificial Sequence
  chemically synthesized
tgtttctatgggctgtgccaat

SEQ ID NO: 1128354 - DNA, 22 bp, Artificial Sequence
  chemically synthesized
gtttctatgggctgtgccaata

SEQ ID NO: 1128355 - DNA, 22 bp, Artificial Sequence
  chemically synthesized
tttctatgggctgtgccaatag

SEQ ID NO: 1128356 - DNA, 22 bp, Artificial Sequence
  chemically synthesized
ctatgggctgtgccaataggca

SEQ ID NO: 1128357 - DNA, 22 bp, Artificial Sequence
  chemically synthesized
tatgggctgtgccaataggcaa

SEQ ID NO: 1128358 - DNA, 22 bp, Artificial Sequence
  chemically synthesized
agtaatgacacttttgcctatt

SEQ ID NO: 1128359 - DNA, 22 bp, Artificial Sequence
  chemically synthesized
tgggctgtgccaataggcaaaa

SEQ ID NO: 1128360 - DNA, 22 bp, Artificial Sequence
  chemically synthesized
aactcagtaatgacacttttgc

SEQ ID NO: 1128361 - DNA, 22 bp, Artificial Sequence
  chemically synthesized
tgccaataggcaaaagtgtcat

SEQ ID NO: 1128362 - DNA, 22 bp, Artificial Sequence
  chemically synthesized
ggatgttaaactcagtaatgac

SEQ ID NO: 1128363 - DNA, 22 bp, Artificial Sequence
  chemically synthesized
aaatatctgggatgttaaactc

SEQ ID NO: 1128364 - DNA, 22 bp, Artificial Sequence
  chemically synthesized
atcctaaaatatctgggatgtt

SEQ ID NO: 1128365 - DNA, 22 bp, Artificial Sequence
  chemically synthesized
ctgagtttaacatcccagatat

SEQ ID NO: 1128366 - DNA, 22 bp, Artificial Sequence
  chemically synthesized
agtttaacatcccagatatttt

SEQ ID NO: 1128367 - DNA, 22 bp, Artificial Sequence
  chemically synthesized
aacatcccagatattttaggat

SEQ ID NO: 1128368 - DNA, 22 bp, Artificial Sequence
  chemically synthesized
tatgataaattgatcctaaaat

SEQ ID NO: 1128369 - DNA, 22 bp, Artificial Sequence
  chemically synthesized
acatcccagatattttaggatc

SEQ ID NO: 1128370 - DNA, 22 bp, Artificial Sequence
  chemically synthesized
tatatgataaattgatcctaaa

SEQ ID NO: 1128371 - DNA, 22 bp, Artificial Sequence
  chemically synthesized
atgttctatatgataaattgat

SEQ ID NO: 1128372 - DNA, 22 bp, Artificial Sequence
  chemically synthesized
aatgttctatatgataaattga

SEQ ID NO: 1128373 - DNA, 22 bp, Artificial Sequence
  chemically synthesized
taatgttctatatgataaattg

SEQ ID NO: 1128374 - DNA, 22 bp, Artificial Sequence
  chemically synthesized
ttaatgttctatatgataaatt

SEQ ID NO: 1128375 - DNA, 22 bp, Artificial Sequence
  chemically synthesized
tttaatgttctatatgataaat

SEQ ID NO: 1128376 - DNA, 22 bp, Artificial Sequence
  chemically synthesized
ttttaatgttctatatgataaa

SEQ ID NO: 1128377 - DNA, 22 bp, Artificial Sequence
  chemically synthesized
tttttaatgttctatatgataa

SEQ ID NO: 1128378 - DNA, 22 bp, Artificial Sequence
  chemically synthesized
ttttttaatgttctatatgata

SEQ ID NO: 1128379 - DNA, 22 bp, Artificial Sequence
  chemically synthesized
taggatcaatttatcatataga

SEQ ID NO: 1128380 - DNA, 22 bp, Artificial Sequence
  chemically synthesized
tttttttaatgttctatatgat

SEQ ID NO: 1128381 - DNA, 22 bp, Artificial Sequence
  chemically synthesized
aggatcaatttatcatatagaa

SEQ ID NO: 1128382 - DNA, 22 bp, Artificial Sequence
  chemically synthesized
ttttttttaatgttctatatga

SEQ ID NO: 1128383 - DNA, 22 bp, Artificial Sequence
  chemically synthesized
ggatcaatttatcatatagaac

SEQ ID NO: 1128384 - DNA, 22 bp, Artificial Sequence
  chemically synthesized
tttttttttaatgttctatatg

SEQ ID NO: 1128385 - DNA, 22 bp, Artificial Sequence
  chemically synthesized
atcatatagaacattaaaaaaa

SEQ ID NO: 1128386 - DNA, 22 bp, Artificial Sequence
  chemically synthesized
tcatatagaacattaaaaaaaa

SEQ ID NO: 1128387 - DNA, 22 bp, Artificial Sequence
  chemically synthesized
atgtgtccgtgaactttttttt

SEQ ID NO: 1128388 - DNA, 22 bp, Artificial Sequence
  chemically synthesized
gataattaatgtgtccgtgaac

SEQ ID NO: 1128389 - DNA, 22 bp, Artificial Sequence
  chemically synthesized
aaaaaaaaaagttcacggacac

SEQ ID NO: 1128390 - DNA, 22 bp, Artificial Sequence
  chemically synthesized
attagataattaatgtgtccgt

SEQ ID NO: 1128391 - DNA, 22 bp, Artificial Sequence
  chemically synthesized
aaggacctaattagataattaa

SEQ ID NO: 1128392 - DNA, 22 bp, Artificial Sequence
  chemically synthesized
gaaggacctaattagataatta

SEQ ID NO: 1128393 - DNA, 22 bp, Artificial Sequence
  chemically synthesized
acggacacattaattatctaat

SEQ ID NO: 1128394 - DNA, 22 bp, Artificial Sequence
  chemically synthesized
tttgaaggacctaattagataa

SEQ ID NO: 1128395 - DNA, 22 bp, Artificial Sequence
  chemically synthesized
attatctaattaggtccttcaa

SEQ ID NO: 1128396 - DNA, 22 bp, Artificial Sequence
  chemically synthesized
tctaattaggtccttcaaataa

SEQ ID NO: 1128397 - DNA, 22 bp, Artificial Sequence
  chemically synthesized
attaggtccttcaaataacttg

SEQ ID NO: 1128398 - DNA, 22 bp, Artificial Sequence
  chemically synthesized
tatggcaaaatataccaagtta

SEQ ID NO: 1128399 - DNA, 22 bp, Artificial Sequence
  chemically synthesized
ggtccttcaaataacttggtat

SEQ ID NO: 1128400 - DNA, 22 bp, Artificial Sequence
  chemically synthesized
aaagttgtatggcaaaatatac

SEQ ID NO: 1128401 - DNA, 22 bp, Artificial Sequence
  chemically synthesized
caaataacttggtatattttgc

SEQ ID NO: 1128402 - DNA, 22 bp, Artificial Sequence
  chemically synthesized
aaataacttggtatattttgcc

SEQ ID NO: 1128403 - DNA, 22 bp, Artificial Sequence
  chemically synthesized
aaatctgaaagttgtatggcaa

SEQ ID NO: 1128404 - DNA, 22 bp, Artificial Sequence
  chemically synthesized
ggtatattttgccatacaactt

SEQ ID NO: 1128405 - DNA, 22 bp, Artificial Sequence
  chemically synthesized
gtatattttgccatacaacttt

SEQ ID NO: 1128406 - DNA, 22 bp, Artificial Sequence
  chemically synthesized
aactaaaatctgaaagttgtat

SEQ ID NO: 1128407 - DNA, 22 bp, Artificial Sequence
  chemically synthesized
taaactaaaatctgaaagttgt

SEQ ID NO: 1128408 - DNA, 22 bp, Artificial Sequence
  chemically synthesized
ctaaactaaaatctgaaagttg

SEQ ID NO: 1128409 - DNA, 22 bp, Artificial Sequence
  chemically synthesized
tgccatacaactttcagatttt

SEQ ID NO: 1128410 - DNA, 22 bp, Artificial Sequence
  chemically synthesized
agtttctaaactaaaatctgaa

SEQ ID NO: 1128411 - DNA, 22 bp, Artificial Sequence
  chemically synthesized
gccatacaactttcagatttta

SEQ ID NO: 1128412 - DNA, 22 bp, Artificial Sequence
  chemically synthesized
cagtttctaaactaaaatctga

SEQ ID NO: 1128413 - DNA, 22 bp, Artificial Sequence
  chemically synthesized
ccatacaactttcagattttag

SEQ ID NO: 1128414 - DNA, 22 bp, Artificial Sequence
  chemically synthesized
taacttcagtttctaaactaaa

SEQ ID NO: 1128415 - DNA, 22 bp, Artificial Sequence
  chemically synthesized
attataacttcagtttctaaac

SEQ ID NO: 1128416 - DNA, 22 bp, Artificial Sequence
  chemically synthesized
tcagattttagtttagaaactg

SEQ ID NO: 1128417 - DNA, 22 bp, Artificial Sequence
  chemically synthesized
cagattttagtttagaaactga

SEQ ID NO: 1128418 - DNA, 22 bp, Artificial Sequence
  chemically synthesized
agattttagtttagaaactgaa

SEQ ID NO: 1128419 - DNA, 22 bp, Artificial Sequence
  chemically synthesized
gatattgattataacttcagtt

SEQ ID NO: 1128420 - DNA, 22 bp, Artificial Sequence
  chemically synthesized
agatattgattataacttcagt

SEQ ID NO: 1128421 - DNA, 22 bp, Artificial Sequence
  chemically synthesized
tagatattgattataacttcag

SEQ ID NO: 1128422 - DNA, 22 bp, Artificial Sequence
  chemically synthesized
tagtttagaaactgaagttata

SEQ ID NO: 1128423 - DNA, 22 bp, Artificial Sequence
  chemically synthesized
agtttagaaactgaagttataa

SEQ ID NO: 1128424 - DNA, 22 bp, Artificial Sequence
  chemically synthesized
gtttagaaactgaagttataat

SEQ ID NO: 1128425 - DNA, 22 bp, Artificial Sequence
  chemically synthesized
ttttagatattgattataactt

SEQ ID NO: 1128426 - DNA, 22 bp, Artificial Sequence
  chemically synthesized
gttttagatattgattataact

SEQ ID NO: 1128427 - DNA, 22 bp, Artificial Sequence
  chemically synthesized
tgttttagatattgattataac

SEQ ID NO: 1128428 - DNA, 22 bp, Artificial Sequence
  chemically synthesized
ttgttttagatattgattataa

SEQ ID NO: 1128429 - DNA, 22 bp, Artificial Sequence
  chemically synthesized
agaaactgaagttataatcaat

SEQ ID NO: 1128430 - DNA, 22 bp, Artificial Sequence
  chemically synthesized
gaaactgaagttataatcaata

SEQ ID NO: 1128431 - DNA, 22 bp, Artificial Sequence
  chemically synthesized
aaacatttttgttttagatatt

SEQ ID NO: 1128432 - DNA, 22 bp, Artificial Sequence
  chemically synthesized
aagttataatcaatatctaaaa

SEQ ID NO: 1128433 - DNA, 22 bp, Artificial Sequence
  chemically synthesized
taatcaatatctaaaacaaaaa

SEQ ID NO: 1128434 - DNA, 22 bp, Artificial Sequence
  chemically synthesized
atgcctaaaacatttttgtttt

SEQ ID NO: 1128435 - DNA, 22 bp, Artificial Sequence
  chemically synthesized
tgagactcatgcctaaaacatt

SEQ ID NO: 1128436 - DNA, 22 bp, Artificial Sequence
  chemically synthesized
gtgagactcatgcctaaaacat

SEQ ID NO: 1128437 - DNA, 22 bp, Artificial Sequence
  chemically synthesized
tgtgagactcatgcctaaaaca

SEQ ID NO: 1128438 - DNA, 22 bp, Artificial Sequence
  chemically synthesized
aaacaaaaatgttttaggcatg

SEQ ID NO: 1128439 - DNA, 22 bp, Artificial Sequence
  chemically synthesized
cagttttgtgagactcatgcct

SEQ ID NO: 1128440 - DNA, 22 bp, Artificial Sequence
  chemically synthesized
tgcagttttgtgagactcatgc

SEQ ID NO: 1128441 - DNA, 22 bp, Artificial Sequence
  chemically synthesized
taggcatgagtctcacaaaact

SEQ ID NO: 1128442 - DNA, 22 bp, Artificial Sequence
  chemically synthesized
aggcatgagtctcacaaaactg

SEQ ID NO: 1128443 - DNA, 22 bp, Artificial Sequence
  chemically synthesized
ggcatgagtctcacaaaactgc

SEQ ID NO: 1128444 - DNA, 22 bp, Artificial Sequence
  chemically synthesized
acaaaactgcagagcggtctta

SEQ ID NO: 1128445 - DNA, 22 bp, Artificial Sequence
  chemically synthesized
gaaagaaaatagataacagata

SEQ ID NO: 1128446 - DNA, 22 bp, Artificial Sequence
  chemically synthesized
cagagcggtcttatctgttatc

SEQ ID NO: 1128447 - DNA, 22 bp, Artificial Sequence
  chemically synthesized
tggaaagaaaatagataacaga

SEQ ID NO: 1128448 - DNA, 22 bp, Artificial Sequence
  chemically synthesized
atctgttatctattttctttcc

SEQ ID NO: 1128449 - DNA, 22 bp, Artificial Sequence
  chemically synthesized
tgtcacatctctggaaagaaaa

SEQ ID NO: 1128450 - DNA, 22 bp, Artificial Sequence
  chemically synthesized
tctgttatctattttctttcca

SEQ ID NO: 1128451 - DNA, 22 bp, Artificial Sequence
  chemically synthesized
ttatctattttctttccagaga

SEQ ID NO: 1128452 - DNA, 22 bp, Artificial Sequence
  chemically synthesized
aattgtgtcacatctctggaaa

SEQ ID NO: 1128453 - DNA, 22 bp, Artificial Sequence
  chemically synthesized
tctattttctttccagagatgt

SEQ ID NO: 1128454 - DNA, 22 bp, Artificial Sequence
  chemically synthesized
ttttctttccagagatgtgaca

SEQ ID NO: 1128455 - DNA, 22 bp, Artificial Sequence
  chemically synthesized
tctttccagagatgtgacacaa

SEQ ID NO: 1128456 - DNA, 22 bp, Artificial Sequence
  chemically synthesized
ctttccagagatgtgacacaat

SEQ ID NO: 1128457 - DNA, 22 bp, Artificial Sequence
  chemically synthesized
tttccagagatgtgacacaatt

SEQ ID NO: 1128458 - DNA, 22 bp, Artificial Sequence
  chemically synthesized
tccagagatgtgacacaattta

SEQ ID NO: 1128459 - DNA, 22 bp, Artificial Sequence
  chemically synthesized
tccagatgaagttaaattgtgt

SEQ ID NO: 1128460 - DNA, 22 bp, Artificial Sequence
  chemically synthesized
ccagagatgtgacacaatttaa

SEQ ID NO: 1128461 - DNA, 22 bp, Artificial Sequence
  chemically synthesized
cagagatgtgacacaatttaac

SEQ ID NO: 1128462 - DNA, 22 bp, Artificial Sequence
  chemically synthesized
ctgtccagatgaagttaaattg

SEQ ID NO: 1128463 - DNA, 22 bp, Artificial Sequence
  chemically synthesized
tggctgctgtccagatgaagtt

SEQ ID NO: 1128464 - DNA, 22 bp, Artificial Sequence
  chemically synthesized
atggctgctgtccagatgaagt

SEQ ID NO: 1128465 - DNA, 22 bp, Artificial Sequence
  chemically synthesized
tatggctgctgtccagatgaag

SEQ ID NO: 1128466 - DNA, 22 bp, Artificial Sequence
  chemically synthesized
ttatggctgctgtccagatgaa

SEQ ID NO: 1128467 - DNA, 22 bp, Artificial Sequence
  chemically synthesized
tttatggctgctgtccagatga

SEQ ID NO: 1128468 - DNA, 22 bp, Artificial Sequence
  chemically synthesized
tttttatggctgctgtccagat

SEQ ID NO: 1128469 - DNA, 22 bp, Artificial Sequence
  chemically synthesized
ctttttatggctgctgtccaga

SEQ ID NO: 1128470 - DNA, 22 bp, Artificial Sequence
  chemically synthesized
tctttttatggctgctgtccag

SEQ ID NO: 1128471 - DNA, 22 bp, Artificial Sequence
  chemically synthesized
aacttcatctggacagcagcca

SEQ ID NO: 1128472 - DNA, 22 bp, Artificial Sequence
  chemically synthesized
attttctttttatggctgctgt

SEQ ID NO: 1128473 - DNA, 22 bp, Artificial Sequence
  chemically synthesized
acttcatctggacagcagccat

SEQ ID NO: 1128474 - DNA, 22 bp, Artificial Sequence
  chemically synthesized
gattttctttttatggctgctg

SEQ ID NO: 1128475 - DNA, 22 bp, Artificial Sequence
  chemically synthesized
tttgattttctttttatggctg

SEQ ID NO: 1128476 - DNA, 22 bp, Artificial Sequence
  chemically synthesized
catctggacagcagccataaaa

SEQ ID NO: 1128477 - DNA, 22 bp, Artificial Sequence
  chemically synthesized
gtttgattttctttttatggct

SEQ ID NO: 1128478 - DNA, 22 bp, Artificial Sequence
  chemically synthesized
atctggacagcagccataaaaa

SEQ ID NO: 1128479 - DNA, 22 bp, Artificial Sequence
  chemically synthesized
tttgtttgattttctttttatg

SEQ ID NO: 1128480 - DNA, 22 bp, Artificial Sequence
  chemically synthesized
gtttgtttgattttctttttat

SEQ ID NO: 1128481 - DNA, 22 bp, Artificial Sequence
  chemically synthesized
tgtttgtttgattttcttttta

SEQ ID NO: 1128482 - DNA, 22 bp, Artificial Sequence
  chemically synthesized
gacagcagccataaaaagaaaa

SEQ ID NO: 1128483 - DNA, 22 bp, Artificial Sequence
  chemically synthesized
ttgtttgtttgattttcttttt

SEQ ID NO: 1128484 - DNA, 22 bp, Artificial Sequence
  chemically synthesized
tttgtttgtttgattttctttt

SEQ ID NO: 1128485 - DNA, 22 bp, Artificial Sequence
  chemically synthesized
ttttttgtttgtttgattttct

SEQ ID NO: 1128486 - DNA, 22 bp, Artificial Sequence
  chemically synthesized
tgttttttgtttgtttgatttt

SEQ ID NO: 1128487 - DNA, 22 bp, Artificial Sequence
  chemically synthesized
ctgttttttgtttgtttgattt

SEQ ID NO: 1128488 - DNA, 22 bp, Artificial Sequence
  chemically synthesized
tttctgttttttgtttgtttga

SEQ ID NO: 1128489 - DNA, 22 bp, Artificial Sequence
  chemically synthesized
gtttctgttttttgtttgtttg

SEQ ID NO: 1128490 - DNA, 22 bp, Artificial Sequence
  chemically synthesized
agtttgtttctgttttttgttt

SEQ ID NO: 1128491 - DNA, 22 bp, Artificial Sequence
  chemically synthesized
cagtttgtttctgttttttgtt

SEQ ID NO: 1128492 - DNA, 22 bp, Artificial Sequence
  chemically synthesized
tcagtttgtttctgttttttgt

SEQ ID NO: 1128493 - DNA, 22 bp, Artificial Sequence
  chemically synthesized
ttcagtttgtttctgttttttg

SEQ ID NO: 1128494 - DNA, 22 bp, Artificial Sequence
  chemically synthesized
cttttcagtttgtttctgtttt

SEQ ID NO: 1128495 - DNA, 22 bp, Artificial Sequence
  chemically synthesized
tacttttcagtttgtttctgtt

SEQ ID NO: 1128496 - DNA, 22 bp, Artificial Sequence
  chemically synthesized
tatattctacttttcagtttgt

SEQ ID NO: 1128497 - DNA, 22 bp, Artificial Sequence
  chemically synthesized
ttatatattctacttttcagtt

SEQ ID NO: 1128498 - DNA, 22 bp, Artificial Sequence
  chemically synthesized
ttattatatattctacttttca

SEQ ID NO: 1128499 - DNA, 22 bp, Artificial Sequence
  chemically synthesized
aattattattatatattctact

SEQ ID NO: 1128500 - DNA, 22 bp, Artificial Sequence
  chemically synthesized
catacctgaattattattatat

SEQ ID NO: 1128501 - DNA, 22 bp, Artificial Sequence
  chemically synthesized
aaaagtagaatatataataata

SEQ ID NO: 1128502 - DNA, 22 bp, Artificial Sequence
  chemically synthesized
atctacatacctgaattattat

SEQ ID NO: 1128503 - DNA, 22 bp, Artificial Sequence
  chemically synthesized
actgatctacatacctgaatta

SEQ ID NO: 1128504 - DNA, 22 bp, Artificial Sequence
  chemically synthesized
cataggaggataaattgactga

SEQ ID NO: 1128505 - DNA, 22 bp, Artificial Sequence
  chemically synthesized
aggtatgtagatcagtcaattt

SEQ ID NO: 1128506 - DNA, 22 bp, Artificial Sequence
  chemically synthesized
actacataggaggataaattga

SEQ ID NO: 1128507 - DNA, 22 bp, Artificial Sequence
  chemically synthesized
catcctaactacataggaggat

SEQ ID NO: 1128508 - DNA, 22 bp, Artificial Sequence
  chemically synthesized
ctgcatcctaactacataggag

SEQ ID NO: 1128509 - DNA, 22 bp, Artificial Sequence
  chemically synthesized
cctgcatcctaactacatagga

SEQ ID NO: 1128510 - DNA, 22 bp, Artificial Sequence
  chemically synthesized
tttcctgcatcctaactacata

SEQ ID NO: 1128511 - DNA, 22 bp, Artificial Sequence
  chemically synthesized
atcctcctatgtagttaggatg

SEQ ID NO: 1128512 - DNA, 22 bp, Artificial Sequence
  chemically synthesized
ggctatttcctgcatcctaact

SEQ ID NO: 1128513 - DNA, 22 bp, Artificial Sequence
  chemically synthesized
tcctcctatgtagttaggatgc

SEQ ID NO: 1128514 - DNA, 22 bp, Artificial Sequence
  chemically synthesized
tcggctatttcctgcatcctaa

SEQ ID NO: 1128515 - DNA, 22 bp, Artificial Sequence
  chemically synthesized
ctcggctatttcctgcatccta

SEQ ID NO: 1128516 - DNA, 22 bp, Artificial Sequence
  chemically synthesized
tctcggctatttcctgcatcct

SEQ ID NO: 1128517 - DNA, 22 bp, Artificial Sequence
  chemically synthesized
ctatgtagttaggatgcaggaa

SEQ ID NO: 1128518 - DNA, 22 bp, Artificial Sequence
  chemically synthesized
ctttctcggctatttcctgcat

SEQ ID NO: 1128519 - DNA, 22 bp, Artificial Sequence
  chemically synthesized
gctttctcggctatttcctgca

SEQ ID NO: 1128520 - DNA, 22 bp, Artificial Sequence
  chemically synthesized
tgtagttaggatgcaggaaata

SEQ ID NO: 1128521 - DNA, 22 bp, Artificial Sequence
  chemically synthesized
ggatgcaggaaatagccgagaa

SEQ ID NO: 1128522 - DNA, 22 bp, Artificial Sequence
  chemically synthesized
cagggtaagcagacagaatgta

SEQ ID NO: 1128523 - DNA, 22 bp, Artificial Sequence
  chemically synthesized
cctccagggtaagcagacagaa

SEQ ID NO: 1128524 - DNA, 22 bp, Artificial Sequence
  chemically synthesized
ccctccagggtaagcagacaga

SEQ ID NO: 1128525 - DNA, 22 bp, Artificial Sequence
  chemically synthesized
tccctccagggtaagcagacag

SEQ ID NO: 1128526 - DNA, 22 bp, Artificial Sequence
  chemically synthesized
ttccctccagggtaagcagaca

SEQ ID NO: 1128527 - DNA, 22 bp, Artificial Sequence
  chemically synthesized
tttccctccagggtaagcagac

SEQ ID NO: 1128528 - DNA, 22 bp, Artificial Sequence
  chemically synthesized
ttttttccctccagggtaagca

SEQ ID NO: 1128529 - DNA, 22 bp, Artificial Sequence
  chemically synthesized
acattctgtctgcttaccctgg

SEQ ID NO: 1128530 - DNA, 22 bp, Artificial Sequence
  chemically synthesized
cattctgtctgcttaccctgga

SEQ ID NO: 1128531 - DNA, 22 bp, Artificial Sequence
  chemically synthesized
gtctgttttttccctccagggt

SEQ ID NO: 1128532 - DNA, 22 bp, Artificial Sequence
  chemically synthesized
tgtctgcttaccctggagggaa

SEQ ID NO: 1128533 - DNA, 22 bp, Artificial Sequence
  chemically synthesized
tctgcttaccctggagggaaaa

SEQ ID NO: 1128534 - DNA, 22 bp, Artificial Sequence
  chemically synthesized
acctggtctgttttttccctcc

SEQ ID NO: 1128535 - DNA, 22 bp, Artificial Sequence
  chemically synthesized
cttaccctggagggaaaaaaca

SEQ ID NO: 1128536 - DNA, 22 bp, Artificial Sequence
  chemically synthesized
agttcacctggtctgttttttc

SEQ ID NO: 1128537 - DNA, 22 bp, Artificial Sequence
  chemically synthesized
accctggagggaaaaaacagac

SEQ ID NO: 1128538 - DNA, 22 bp, Artificial Sequence
  chemically synthesized
ccctggagggaaaaaacagacc

SEQ ID NO: 1128539 - DNA, 22 bp, Artificial Sequence
  chemically synthesized
gagggaaaaaacagaccaggtg

SEQ ID NO: 1128540 - DNA, 22 bp, Artificial Sequence
  chemically synthesized
aaatgcctcagttcacctggtc

SEQ ID NO: 1128541 - DNA, 22 bp, Artificial Sequence
  chemically synthesized
gaaatgcctcagttcacctggt

SEQ ID NO: 1128542 - DNA, 22 bp, Artificial Sequence
  chemically synthesized
tgaaatgcctcagttcacctgg

SEQ ID NO: 1128543 - DNA, 22 bp, Artificial Sequence
  chemically synthesized
aaggataatgtagaggcatttt

SEQ ID NO: 1128544 - DNA, 22 bp, Artificial Sequence
  chemically synthesized
aggcatttcaaaatgcctctac

SEQ ID NO: 1128545 - DNA, 22 bp, Artificial Sequence
  chemically synthesized
tcctcaaggataatgtagaggc

SEQ ID NO: 1128546 - DNA, 22 bp, Artificial Sequence
  chemically synthesized
gtcctcaaggataatgtagagg

SEQ ID NO: 1128547 - DNA, 22 bp, Artificial Sequence
  chemically synthesized
tgtcctcaaggataatgtagag

SEQ ID NO: 1128548 - DNA, 22 bp, Artificial Sequence
  chemically synthesized
caaaatgcctctacattatcct

SEQ ID NO: 1128549 - DNA, 22 bp, Artificial Sequence
  chemically synthesized
aaaatgcctctacattatcctt

SEQ ID NO: 1128550 - DNA, 22 bp, Artificial Sequence
  chemically synthesized
tacattatccttgaggacaaag

SEQ ID NO: 1128551 - DNA, 22 bp, Artificial Sequence
  chemically synthesized
ataaatgaatatctttgtcctc

SEQ ID NO: 1128552 - DNA, 22 bp, Artificial Sequence
  chemically synthesized
cattatccttgaggacaaagat

SEQ ID NO: 1128553 - DNA, 22 bp, Artificial Sequence
  chemically synthesized
tccttgaggacaaagatattca

SEQ ID NO: 1128554 - DNA, 22 bp, Artificial Sequence
  chemically synthesized
gaggacaaagatattcatttat

SEQ ID NO: 1128555 - DNA, 22 bp, Artificial Sequence
  chemically synthesized
aggacaaagatattcatttatg

SEQ ID NO: 1128556 - DNA, 22 bp, Artificial Sequence
  chemically synthesized
ccccaagtaaagcgttcataaa

SEQ ID NO: 1128557 - DNA, 22 bp, Artificial Sequence
  chemically synthesized
cccccaagtaaagcgttcataa

SEQ ID NO: 1128558 - DNA, 22 bp, Artificial Sequence
  chemically synthesized
atttatgaacgctttacttggg

SEQ ID NO: 1128559 - DNA, 22 bp, Artificial Sequence
  chemically synthesized
ataaagataatttcccccaagt

SEQ ID NO: 1128560 - DNA, 22 bp, Artificial Sequence
  chemically synthesized
atgaacgctttacttgggggaa

SEQ ID NO: 1128561 - DNA, 22 bp, Artificial Sequence
  chemically synthesized
aataaagataatttcccccaag

SEQ ID NO: 1128562 - DNA, 22 bp, Artificial Sequence
  chemically synthesized
tgaacgctttacttgggggaaa

SEQ ID NO: 1128563 - DNA, 22 bp, Artificial Sequence
  chemically synthesized
tacttgggggaaattatcttta

SEQ ID NO: 1128564 - DNA, 22 bp, Artificial Sequence
  chemically synthesized
acttgggggaaattatctttat

SEQ ID NO: 1128565 - DNA, 22 bp, Artificial Sequence
  chemically synthesized
cttgggggaaattatctttatt

SEQ ID NO: 1128566 - DNA, 22 bp, Artificial Sequence
  chemically synthesized
gggggaaattatctttattaag

SEQ ID NO: 1128567 - DNA, 22 bp, Artificial Sequence
  chemically synthesized
agtgaatgccatcttaataaag

SEQ ID NO: 1128568 - DNA, 22 bp, Artificial Sequence
  chemically synthesized
ggggaaattatctttattaaga

SEQ ID NO: 1128569 - DNA, 22 bp, Artificial Sequence
  chemically synthesized
aagtgaatgccatcttaataaa

SEQ ID NO: 1128570 - DNA, 22 bp, Artificial Sequence
  chemically synthesized
taagtgaatgccatcttaataa

SEQ ID NO: 1128571 - DNA, 22 bp, Artificial Sequence
  chemically synthesized
ttaagtgaatgccatcttaata

SEQ ID NO: 1128572 - DNA, 22 bp, Artificial Sequence
  chemically synthesized
tttttaagtgaatgccatctta

SEQ ID NO: 1128573 - DNA, 22 bp, Artificial Sequence
  chemically synthesized
tctttattaagatggcattcac

SEQ ID NO: 1128574 - DNA, 22 bp, Artificial Sequence
  chemically synthesized
tattaagatggcattcacttaa

SEQ ID NO: 1128575 - DNA, 22 bp, Artificial Sequence
  chemically synthesized
attaagatggcattcacttaaa

SEQ ID NO: 1128576 - DNA, 22 bp, Artificial Sequence
  chemically synthesized
ttaagatggcattcacttaaaa

SEQ ID NO: 1128577 - DNA, 22 bp, Artificial Sequence
  chemically synthesized
agatggcattcacttaaaaaca

SEQ ID NO: 1128578 - DNA, 22 bp, Artificial Sequence
  chemically synthesized
acttaaaaacaatttgccattc

SEQ ID NO: 1128579 - DNA, 22 bp, Artificial Sequence
  chemically synthesized
aaaaacaatttgccattcattc

SEQ ID NO: 1128580 - DNA, 22 bp, Artificial Sequence
  chemically synthesized
aaaacaatttgccattcattct

SEQ ID NO: 1128581 - DNA, 22 bp, Artificial Sequence
  chemically synthesized
tagcaaccaggcagaatgaatg

SEQ ID NO: 1128582 - DNA, 22 bp, Artificial Sequence
  chemically synthesized
gtagcaaccaggcagaatgaat

SEQ ID NO: 1128583 - DNA, 22 bp, Artificial Sequence
  chemically synthesized
tgtagcaaccaggcagaatgaa

SEQ ID NO: 1128584 - DNA, 22 bp, Artificial Sequence
  chemically synthesized
ttgtagcaaccaggcagaatga

SEQ ID NO: 1128585 - DNA, 22 bp, Artificial Sequence
  chemically synthesized
tacttttgtagcaaccaggcag

SEQ ID NO: 1128586 - DNA, 22 bp, Artificial Sequence
  chemically synthesized
atacttttgtagcaaccaggca

SEQ ID NO: 1128587 - DNA, 22 bp, Artificial Sequence
  chemically synthesized
gccattcattctgcctggttgc

SEQ ID NO: 1128588 - DNA, 22 bp, Artificial Sequence
  chemically synthesized
ccattcattctgcctggttgct

SEQ ID NO: 1128589 - DNA, 22 bp, Artificial Sequence
  chemically synthesized
atttatacttttgtagcaacca

SEQ ID NO: 1128590 - DNA, 22 bp, Artificial Sequence
  chemically synthesized
aatttatacttttgtagcaacc

SEQ ID NO: 1128591 - DNA, 22 bp, Artificial Sequence
  chemically synthesized
taatttatacttttgtagcaac

SEQ ID NO: 1128592 - DNA, 22 bp, Artificial Sequence
  chemically synthesized
attctgcctggttgctacaaaa

SEQ ID NO: 1128593 - DNA, 22 bp, Artificial Sequence
  chemically synthesized
tgcctggttgctacaaaagtat

SEQ ID NO: 1128594 - DNA, 22 bp, Artificial Sequence
  chemically synthesized
cctggttgctacaaaagtataa

SEQ ID NO: 1128595 - DNA, 22 bp, Artificial Sequence
  chemically synthesized
aaaaaagctttaatttatactt

SEQ ID NO: 1128596 - DNA, 22 bp, Artificial Sequence
  chemically synthesized
aaaaaaagctttaatttatact

SEQ ID NO: 1128597 - DNA, 22 bp, Artificial Sequence
  chemically synthesized
gttgctacaaaagtataaatta

SEQ ID NO: 1128598 - DNA, 22 bp, Artificial Sequence
  chemically synthesized
taaaaaaagctttaatttatac

SEQ ID NO: 1128599 - DNA, 22 bp, Artificial Sequence
  chemically synthesized
ttaaaaaaagctttaatttata

SEQ ID NO: 1128600 - DNA, 22 bp, Artificial Sequence
  chemically synthesized
ctacaaaagtataaattaaagc

SEQ ID NO: 1128601 - DNA, 22 bp, Artificial Sequence
  chemically synthesized
caaaagtataaattaaagcttt

SEQ ID NO: 1128602 - DNA, 22 bp, Artificial Sequence
  chemically synthesized
agggatttttaaaaaaagcttt

SEQ ID NO: 1128603 - DNA, 22 bp, Artificial Sequence
  chemically synthesized
aagggatttttaaaaaaagctt

SEQ ID NO: 1128604 - DNA, 22 bp, Artificial Sequence
  chemically synthesized
taagggatttttaaaaaaagct

SEQ ID NO: 1128605 - DNA, 22 bp, Artificial Sequence
  chemically synthesized
ttttaagggatttttaaaaaaa

SEQ ID NO: 1128606 - DNA, 22 bp, Artificial Sequence
  chemically synthesized
aagctttttttaaaaatccctt

SEQ ID NO: 1128607 - DNA, 22 bp, Artificial Sequence
  chemically synthesized
tttttaaaaatcccttaaaata

SEQ ID NO: 1128608 - DNA, 22 bp, Artificial Sequence
  chemically synthesized
ttttaaaaatcccttaaaataa

SEQ ID NO: 1128609 - DNA, 22 bp, Artificial Sequence
  chemically synthesized
atcatgtagcagttattttaag

SEQ ID NO: 1128610 - DNA, 22 bp, Artificial Sequence
  chemically synthesized
tttaaaaatcccttaaaataac

SEQ ID NO: 1128611 - DNA, 22 bp, Artificial Sequence
  chemically synthesized
ttaaaaatcccttaaaataact

SEQ ID NO: 1128612 - DNA, 22 bp, Artificial Sequence
  chemically synthesized
taaaaatcccttaaaataactg

SEQ ID NO: 1128613 - DNA, 22 bp, Artificial Sequence
  chemically synthesized
ctaatcatgtagcagttatttt

SEQ ID NO: 1128614 - DNA, 22 bp, Artificial Sequence
  chemically synthesized
aaaaatcccttaaaataactgc

SEQ ID NO: 1128615 - DNA, 22 bp, Artificial Sequence
  chemically synthesized
cctaatcatgtagcagttattt

SEQ ID NO: 1128616 - DNA, 22 bp, Artificial Sequence
  chemically synthesized
aaaatcccttaaaataactgct

SEQ ID NO: 1128617 - DNA, 22 bp, Artificial Sequence
  chemically synthesized
cttcctaatcatgtagcagtta

SEQ ID NO: 1128618 - DNA, 22 bp, Artificial Sequence
  chemically synthesized
aaaataactgctacatgattag

SEQ ID NO: 1128619 - DNA, 22 bp, Artificial Sequence
  chemically synthesized
aaataactgctacatgattagg

SEQ ID NO: 1128620 - DNA, 22 bp, Artificial Sequence
  chemically synthesized
tccaggagattacttcctaatc

SEQ ID NO: 1128621 - DNA, 22 bp, Artificial Sequence
  chemically synthesized
atccaggagattacttcctaat

SEQ ID NO: 1128622 - DNA, 22 bp, Artificial Sequence
  chemically synthesized
ctacatgattaggaagtaatct

SEQ ID NO: 1128623 - DNA, 22 bp, Artificial Sequence
  chemically synthesized
gtatttatccaggagattactt

SEQ ID NO: 1128624 - DNA, 22 bp, Artificial Sequence
  chemically synthesized
catgattaggaagtaatctcct

SEQ ID NO: 1128625 - DNA, 22 bp, Artificial Sequence
  chemically synthesized
attggtatttatccaggagatt

SEQ ID NO: 1128626 - DNA, 22 bp, Artificial Sequence
  chemically synthesized
gttaattggtatttatccagga

SEQ ID NO: 1128627 - DNA, 22 bp, Artificial Sequence
  chemically synthesized
ggaagtaatctcctggataaat

SEQ ID NO: 1128628 - DNA, 22 bp, Artificial Sequence
  chemically synthesized
tctagttaattggtatttatcc

SEQ ID NO: 1128629 - DNA, 22 bp, Artificial Sequence
  chemically synthesized
ttatctagttaattggtattta

SEQ ID NO: 1128630 - DNA, 22 bp, Artificial Sequence
  chemically synthesized
gatctattatctagttaattgg

SEQ ID NO: 1128631 - DNA, 22 bp, Artificial Sequence
  chemically synthesized
ctggataaataccaattaacta

SEQ ID NO: 1128632 - DNA, 22 bp, Artificial Sequence
  chemically synthesized
gataaataccaattaactagat

SEQ ID NO: 1128633 - DNA, 22 bp, Artificial Sequence
  chemically synthesized
gggtaaaactagatctattatc

SEQ ID NO: 1128634 - DNA, 22 bp, Artificial Sequence
  chemically synthesized
agcctagggtaaaactagatct

SEQ ID NO: 1128635 - DNA, 22 bp, Artificial Sequence
  chemically synthesized
actagataatagatctagtttt

SEQ ID NO: 1128636 - DNA, 22 bp, Artificial Sequence
  chemically synthesized
gataatagatctagttttaccc

SEQ ID NO: 1128637 - DNA, 22 bp, Artificial Sequence
  chemically synthesized
tcagagtaaggaactcagccta

SEQ ID NO: 1128638 - DNA, 22 bp, Artificial Sequence
  chemically synthesized
gttttaccctaggctgagttcc

SEQ ID NO: 1128639 - DNA, 22 bp, Artificial Sequence
  chemically synthesized
taccctaggctgagttccttac

SEQ ID NO: 1128640 - DNA, 22 bp, Artificial Sequence
  chemically synthesized
accctaggctgagttccttact

SEQ ID NO: 1128641 - DNA, 22 bp, Artificial Sequence
  chemically synthesized
ccctaggctgagttccttactc

SEQ ID NO: 1128642 - DNA, 22 bp, Artificial Sequence
  chemically synthesized
ggctgagttccttactctgata

SEQ ID NO: 1128643 - DNA, 22 bp, Artificial Sequence
  chemically synthesized
tacacgtaggtaattatcagag

SEQ ID NO: 1128644 - DNA, 22 bp, Artificial Sequence
  chemically synthesized
agttccttactctgataattac

SEQ ID NO: 1128645 - DNA, 22 bp, Artificial Sequence
  chemically synthesized
ttgtacacgtaggtaattatca

SEQ ID NO: 1128646 - DNA, 22 bp, Artificial Sequence
  chemically synthesized
cttactctgataattacctacg

SEQ ID NO: 1128647 - DNA, 22 bp, Artificial Sequence
  chemically synthesized
actctgataattacctacgtgt

SEQ ID NO: 1128648 - DNA, 22 bp, Artificial Sequence
  chemically synthesized
ctctgataattacctacgtgta

SEQ ID NO: 1128649 - DNA, 22 bp, Artificial Sequence
  chemically synthesized
agtgatattattgtacacgtag

SEQ ID NO: 1128650 - DNA, 22 bp, Artificial Sequence
  chemically synthesized
tgataattacctacgtgtacaa

SEQ ID NO: 1128651 - DNA, 22 bp, Artificial Sequence
  chemically synthesized
ataattacctacgtgtacaata

SEQ ID NO: 1128652 - DNA, 22 bp, Artificial Sequence
  chemically synthesized
caattcagtgatattattgtac

SEQ ID NO: 1128653 - DNA, 22 bp, Artificial Sequence
  chemically synthesized
ctgcaattcagtgatattattg

SEQ ID NO: 1128654 - DNA, 22 bp, Artificial Sequence
  chemically synthesized
cctacgtgtacaataatatcac

SEQ ID NO: 1128655 - DNA, 22 bp, Artificial Sequence
  chemically synthesized
ttcctgcaattcagtgatatta

SEQ ID NO: 1128656 - DNA, 22 bp, Artificial Sequence
  chemically synthesized
cgtgtacaataatatcactgaa

SEQ ID NO: 1128657 - DNA, 22 bp, Artificial Sequence
  chemically synthesized
atagcaaattattcctgcaatt

SEQ ID NO: 1128658 - DNA, 22 bp, Artificial Sequence
  chemically synthesized
taatagcaaattattcctgcaa

SEQ ID NO: 1128659 - DNA, 22 bp, Artificial Sequence
  chemically synthesized
ctaatagcaaattattcctgca

SEQ ID NO: 1128660 - DNA, 22 bp, Artificial Sequence
  chemically synthesized
tttctaatagcaaattattcct

SEQ ID NO: 1128661 - DNA, 22 bp, Artificial Sequence
  chemically synthesized
aattgcaggaataatttgctat

SEQ ID NO: 1128662 - DNA, 22 bp, Artificial Sequence
  chemically synthesized
caggaataatttgctattagaa

SEQ ID NO: 1128663 - DNA, 22 bp, Artificial Sequence
  chemically synthesized
ggtcacaagataattatttcta

SEQ ID NO: 1128664 - DNA, 22 bp, Artificial Sequence
  chemically synthesized
gggtcacaagataattatttct

SEQ ID NO: 1128665 - DNA, 22 bp, Artificial Sequence
  chemically synthesized
gctattagaaataattatcttg

SEQ ID NO: 1128666 - DNA, 22 bp, Artificial Sequence
  chemically synthesized
ctattagaaataattatcttgt

SEQ ID NO: 1128667 - DNA, 22 bp, Artificial Sequence
  chemically synthesized
atgatcttgggtcacaagataa

SEQ ID NO: 1128668 - DNA, 22 bp, Artificial Sequence
  chemically synthesized
ttagaaataattatcttgtgac

SEQ ID NO: 1128669 - DNA, 22 bp, Artificial Sequence
  chemically synthesized
gaaataattatcttgtgaccca

SEQ ID NO: 1128670 - DNA, 22 bp, Artificial Sequence
  chemically synthesized
caaaagtgtctgatgatcttgg

SEQ ID NO: 1128671 - DNA, 22 bp, Artificial Sequence
  chemically synthesized
gcaaaagtgtctgatgatcttg

SEQ ID NO: 1128672 - DNA, 22 bp, Artificial Sequence
  chemically synthesized
tcttgtgacccaagatcatcag

SEQ ID NO: 1128673 - DNA, 22 bp, Artificial Sequence
  chemically synthesized
gtgacccaagatcatcagacac

SEQ ID NO: 1128674 - DNA, 22 bp, Artificial Sequence
  chemically synthesized
agatttgcaaaagtgtctgatg

SEQ ID NO: 1128675 - DNA, 22 bp, Artificial Sequence
  chemically synthesized
tgacccaagatcatcagacact

SEQ ID NO: 1128676 - DNA, 22 bp, Artificial Sequence
  chemically synthesized
cactgagatttgcaaaagtgtc

SEQ ID NO: 1128677 - DNA, 22 bp, Artificial Sequence
  chemically synthesized
acactgagatttgcaaaagtgt

SEQ ID NO: 1128678 - DNA, 22 bp, Artificial Sequence
  chemically synthesized
tacactgagatttgcaaaagtg

SEQ ID NO: 1128679 - DNA, 22 bp, Artificial Sequence
  chemically synthesized
tttacactgagatttgcaaaag

SEQ ID NO: 1128680 - DNA, 22 bp, Artificial Sequence
  chemically synthesized
tctttacactgagatttgcaaa

SEQ ID NO: 1128681 - DNA, 22 bp, Artificial Sequence
  chemically synthesized
ctctttacactgagatttgcaa

SEQ ID NO: 1128682 - DNA, 22 bp, Artificial Sequence
  chemically synthesized
tctctttacactgagatttgca

SEQ ID NO: 1128683 - DNA, 22 bp, Artificial Sequence
  chemically synthesized
ttctctttacactgagatttgc

SEQ ID NO: 1128684 - DNA, 22 bp, Artificial Sequence
  chemically synthesized
cataaatttttctctttacact

SEQ ID NO: 1128685 - DNA, 22 bp, Artificial Sequence
  chemically synthesized
ttgcaaatctcagtgtaaagag

SEQ ID NO: 1128686 - DNA, 22 bp, Artificial Sequence
  chemically synthesized
tgcaaatctcagtgtaaagaga

SEQ ID NO: 1128687 - DNA, 22 bp, Artificial Sequence
  chemically synthesized
gcaaatctcagtgtaaagagaa

SEQ ID NO: 1128688 - DNA, 22 bp, Artificial Sequence
  chemically synthesized
ttgcataaatttttctctttac

SEQ ID NO: 1128689 - DNA, 22 bp, Artificial Sequence
  chemically synthesized
caaatctcagtgtaaagagaaa

SEQ ID NO: 1128690 - DNA, 22 bp, Artificial Sequence
  chemically synthesized
attgcataaatttttctcttta

SEQ ID NO: 1128691 - DNA, 22 bp, Artificial Sequence
  chemically synthesized
tatttattgcataaatttttct

SEQ ID NO: 1128692 - DNA, 22 bp, Artificial Sequence
  chemically synthesized
agtgtaaagagaaaaatttatg

SEQ ID NO: 1128693 - DNA, 22 bp, Artificial Sequence
  chemically synthesized
catatgttgtatttattgcata

SEQ ID NO: 1128694 - DNA, 22 bp, Artificial Sequence
  chemically synthesized
tacatatgttgtatttattgca

SEQ ID NO: 1128695 - DNA, 22 bp, Artificial Sequence
  chemically synthesized
ctacatatgttgtatttattgc

SEQ ID NO: 1128696 - DNA, 22 bp, Artificial Sequence
  chemically synthesized
tacagtttctacatatgttgta

SEQ ID NO: 1128697 - DNA, 22 bp, Artificial Sequence
  chemically synthesized
atgcaataaatacaacatatgt

SEQ ID NO: 1128698 - DNA, 22 bp, Artificial Sequence
  chemically synthesized
tgcaataaatacaacatatgta

SEQ ID NO: 1128699 - DNA, 22 bp, Artificial Sequence
  chemically synthesized
aataattatacagtttctacat

SEQ ID NO: 1128700 - DNA, 22 bp, Artificial Sequence
  chemically synthesized
ctaaataattatacagtttcta

SEQ ID NO: 1128701 - DNA, 22 bp, Artificial Sequence
  chemically synthesized
gtcgattcctaaataattatac

SEQ ID NO: 1128702 - DNA, 22 bp, Artificial Sequence
  chemically synthesized
agtcgattcctaaataattata

SEQ ID NO: 1128703 - DNA, 22 bp, Artificial Sequence
  chemically synthesized
aggtacatttagtcgattccta

SEQ ID NO: 1128704 - DNA, 22 bp, Artificial Sequence
  chemically synthesized
tataattatttaggaatcgact

SEQ ID NO: 1128705 - DNA, 22 bp, Artificial Sequence
  chemically synthesized
tctaaggtacatttagtcgatt

SEQ ID NO: 1128706 - DNA, 22 bp, Artificial Sequence
  chemically synthesized
actatctaaggtacatttagtc

SEQ ID NO: 1128707 - DNA, 22 bp, Artificial Sequence
  chemically synthesized
aactatctaaggtacatttagt

SEQ ID NO: 1128708 - DNA, 22 bp, Artificial Sequence
  chemically synthesized
tttaggaatcgactaaatgtac

SEQ ID NO: 1128709 - DNA, 22 bp, Artificial Sequence
  chemically synthesized
ttaactatctaaggtacattta

SEQ ID NO: 1128710 - DNA, 22 bp, Artificial Sequence
  chemically synthesized
cttaactatctaaggtacattt

SEQ ID NO: 1128711 - DNA, 22 bp, Artificial Sequence
  chemically synthesized
aggaatcgactaaatgtacctt

SEQ ID NO: 1128712 - DNA, 22 bp, Artificial Sequence
  chemically synthesized
ggaatcgactaaatgtacctta

SEQ ID NO: 1128713 - DNA, 22 bp, Artificial Sequence
  chemically synthesized
ccacatagtttcttaactatct

SEQ ID NO: 1128714 - DNA, 22 bp, Artificial Sequence
  chemically synthesized
aatgtaccttagatagttaaga

SEQ ID NO: 1128715 - DNA, 22 bp, Artificial Sequence
  chemically synthesized
taccacatagtttcttaactat

SEQ ID NO: 1128716 - DNA, 22 bp, Artificial Sequence
  chemically synthesized
ctaccacatagtttcttaacta

SEQ ID NO: 1128717 - DNA, 22 bp, Artificial Sequence
  chemically synthesized
tctaccacatagtttcttaact

SEQ ID NO: 1128718 - DNA, 22 bp, Artificial Sequence
  chemically synthesized
agctttctaccacatagtttct

SEQ ID NO: 1128719 - DNA, 22 bp, Artificial Sequence
  chemically synthesized
agatagttaagaaactatgtgg

SEQ ID NO: 1128720 - DNA, 22 bp, Artificial Sequence
  chemically synthesized
gatagttaagaaactatgtggt

SEQ ID NO: 1128721 - DNA, 22 bp, Artificial Sequence
  chemically synthesized
aaattcagctttctaccacata

SEQ ID NO: 1128722 - DNA, 22 bp, Artificial Sequence
  chemically synthesized
aaaattcagctttctaccacat

SEQ ID NO: 1128723 - DNA, 22 bp, Artificial Sequence
  chemically synthesized
agaaactatgtggtagaaagct

SEQ ID NO: 1128724 - DNA, 22 bp, Artificial Sequence
  chemically synthesized
agggatttaaaattcagctttc

SEQ ID NO: 1128725 - DNA, 22 bp, Artificial Sequence
  chemically synthesized
tgtggtagaaagctgaatttta

SEQ ID NO: 1128726 - DNA, 22 bp, Artificial Sequence
  chemically synthesized
cccaaaacaattaagggattta

SEQ ID NO: 1128727 - DNA, 22 bp, Artificial Sequence
  chemically synthesized
acccaaaacaattaagggattt

SEQ ID NO: 1128728 - DNA, 22 bp, Artificial Sequence
  chemically synthesized
tttacccaaaacaattaaggga

SEQ ID NO: 1128729 - DNA, 22 bp, Artificial Sequence
  chemically synthesized
atttacccaaaacaattaaggg

SEQ ID NO: 1128730 - DNA, 22 bp, Artificial Sequence
  chemically synthesized
aattttaaatcccttaattgtt

SEQ ID NO: 1128731 - DNA, 22 bp, Artificial Sequence
  chemically synthesized
taaatcccttaattgttttggg

SEQ ID NO: 1128732 - DNA, 22 bp, Artificial Sequence
  chemically synthesized
aaatcccttaattgttttgggt

SEQ ID NO: 1128733 - DNA, 22 bp, Artificial Sequence
  chemically synthesized
aatcccttaattgttttgggta

SEQ ID NO: 1128734 - DNA, 22 bp, Artificial Sequence
  chemically synthesized
gggtatccttatttacccaaaa

SEQ ID NO: 1128735 - DNA, 22 bp, Artificial Sequence
  chemically synthesized
aattgttttgggtaaataagga

SEQ ID NO: 1128736 - DNA, 22 bp, Artificial Sequence
  chemically synthesized
cccattagggtatccttattta

SEQ ID NO: 1128737 - DNA, 22 bp, Artificial Sequence
  chemically synthesized
attgttttgggtaaataaggat

SEQ ID NO: 1128738 - DNA, 22 bp, Artificial Sequence
  chemically synthesized
acccattagggtatccttattt

SEQ ID NO: 1128739 - DNA, 22 bp, Artificial Sequence
  chemically synthesized
tacccattagggtatccttatt

SEQ ID NO: 1128740 - DNA, 22 bp, Artificial Sequence
  chemically synthesized
ttttgggtaaataaggataccc

SEQ ID NO: 1128741 - DNA, 22 bp, Artificial Sequence
  chemically synthesized
tgggtaaataaggataccctaa

SEQ ID NO: 1128742 - DNA, 22 bp, Artificial Sequence
  chemically synthesized
caattttacccattagggtatc

SEQ ID NO: 1128743 - DNA, 22 bp, Artificial Sequence
  chemically synthesized
gggtaaataaggataccctaat

SEQ ID NO: 1128744 - DNA, 22 bp, Artificial Sequence
  chemically synthesized
ggtaaataaggataccctaatg

SEQ ID NO: 1128745 - DNA, 22 bp, Artificial Sequence
  chemically synthesized
ataattccaattttacccatta

SEQ ID NO: 1128746 - DNA, 22 bp, Artificial Sequence
  chemically synthesized
aataattccaattttacccatt

SEQ ID NO: 1128747 - DNA, 22 bp, Artificial Sequence
  chemically synthesized
taataattccaattttacccat

SEQ ID NO: 1128748 - DNA, 22 bp, Artificial Sequence
  chemically synthesized
atgatctttaataattccaatt

SEQ ID NO: 1128749 - DNA, 22 bp, Artificial Sequence
  chemically synthesized
atgggtaaaattggaattatta

SEQ ID NO: 1128750 - DNA, 22 bp, Artificial Sequence
  chemically synthesized
gaattattaaagatcatcagga

SEQ ID NO: 1128751 - DNA, 22 bp, Artificial Sequence
  chemically synthesized
ataataaacgtgaccatcctga

SEQ ID NO: 1128752 - DNA, 22 bp, Artificial Sequence
  chemically synthesized
aataataaacgtgaccatcctg

SEQ ID NO: 1128753 - DNA, 22 bp, Artificial Sequence
  chemically synthesized
ttaaagatcatcaggatggtca

SEQ ID NO: 1128754 - DNA, 22 bp, Artificial Sequence
  chemically synthesized
ttaataataaacgtgaccatcc

SEQ ID NO: 1128755 - DNA, 22 bp, Artificial Sequence
  chemically synthesized
aagatcatcaggatggtcacgt

SEQ ID NO: 1128756 - DNA, 22 bp, Artificial Sequence
  chemically synthesized
ttcttaataataaacgtgacca

SEQ ID NO: 1128757 - DNA, 22 bp, Artificial Sequence
  chemically synthesized
gaattgttcttaataataaacg

SEQ ID NO: 1128758 - DNA, 22 bp, Artificial Sequence
  chemically synthesized
ctggaattgttcttaataataa

SEQ ID NO: 1128759 - DNA, 22 bp, Artificial Sequence
  chemically synthesized
cctggaattgttcttaataata

SEQ ID NO: 1128760 - DNA, 22 bp, Artificial Sequence
  chemically synthesized
ttcctggaattgttcttaataa

SEQ ID NO: 1128761 - DNA, 22 bp, Artificial Sequence
  chemically synthesized
gctcttcctggaattgttctta

SEQ ID NO: 1128762 - DNA, 22 bp, Artificial Sequence
  chemically synthesized
cctagctcttcctggaattgtt

SEQ ID NO: 1128763 - DNA, 22 bp, Artificial Sequence
  chemically synthesized
tacctagctcttcctggaattg

SEQ ID NO: 1128764 - DNA, 22 bp, Artificial Sequence
  chemically synthesized
attattaagaacaattccagga

SEQ ID NO: 1128765 - DNA, 22 bp, Artificial Sequence
  chemically synthesized
ttattaagaacaattccaggaa

SEQ ID NO: 1128766 - DNA, 22 bp, Artificial Sequence
  chemically synthesized
ttaagaacaattccaggaagag

SEQ ID NO: 1128767 - DNA, 22 bp, Artificial Sequence
  chemically synthesized
aaaattctacctagctcttcct

SEQ ID NO: 1128768 - DNA, 22 bp, Artificial Sequence
  chemically synthesized
agaacaattccaggaagagcta

SEQ ID NO: 1128769 - DNA, 22 bp, Artificial Sequence
  chemically synthesized
aaaaattctacctagctcttcc

SEQ ID NO: 1128770 - DNA, 22 bp, Artificial Sequence
  chemically synthesized
caggaagagctaggtagaattt

SEQ ID NO: 1128771 - DNA, 22 bp, Artificial Sequence
  chemically synthesized
aatatcatttaaaaattctacc

SEQ ID NO: 1128772 - DNA, 22 bp, Artificial Sequence
  chemically synthesized
caatatcatttaaaaattctac

SEQ ID NO: 1128773 - DNA, 22 bp, Artificial Sequence
  chemically synthesized
acatttcaatatcatttaaaaa

SEQ ID NO: 1128774 - DNA, 22 bp, Artificial Sequence
  chemically synthesized
gacatttcaatatcatttaaaa

SEQ ID NO: 1128775 - DNA, 22 bp, Artificial Sequence
  chemically synthesized
ggtagaatttttaaatgatatt

SEQ ID NO: 1128776 - DNA, 22 bp, Artificial Sequence
  chemically synthesized
aaatttgacatttcaatatcat

SEQ ID NO: 1128777 - DNA, 22 bp, Artificial Sequence
  chemically synthesized
ttaaatgatattgaaatgtcaa

SEQ ID NO: 1128778 - DNA, 22 bp, Artificial Sequence
  chemically synthesized
taaatgatattgaaatgtcaaa

SEQ ID NO: 1128779 - DNA, 22 bp, Artificial Sequence
  chemically synthesized
cagtaactaaaatttgacattt

SEQ ID NO: 1128780 - DNA, 22 bp, Artificial Sequence
  chemically synthesized
aaatgatattgaaatgtcaaat

SEQ ID NO: 1128781 - DNA, 22 bp, Artificial Sequence
  chemically synthesized
aatgatattgaaatgtcaaatt

SEQ ID NO: 1128782 - DNA, 22 bp, Artificial Sequence
  chemically synthesized
aaataattgcagtaactaaaat

SEQ ID NO: 1128783 - DNA, 22 bp, Artificial Sequence
  chemically synthesized
aaatgtcaaattttagttactg

SEQ ID NO: 1128784 - DNA, 22 bp, Artificial Sequence
  chemically synthesized
tagttactgcaattatttgaat

SEQ ID NO: 1128785 - DNA, 22 bp, Artificial Sequence
  chemically synthesized
agttactgcaattatttgaatt

SEQ ID NO: 1128786 - DNA, 22 bp, Artificial Sequence
  chemically synthesized
gttactgcaattatttgaatta

SEQ ID NO: 1128787 - DNA, 22 bp, Artificial Sequence
  chemically synthesized
ctgcaattatttgaattatata

SEQ ID NO: 1128788 - DNA, 22 bp, Artificial Sequence
  chemically synthesized
agagagtgaatggtatataatt

SEQ ID NO: 1128789 - DNA, 22 bp, Artificial Sequence
  chemically synthesized
caattatttgaattatatacca

SEQ ID NO: 1128790 - DNA, 22 bp, Artificial Sequence
  chemically synthesized
ttgagagagtgaatggtatata

SEQ ID NO: 1128791 - DNA, 22 bp, Artificial Sequence
  chemically synthesized
gttgagagagtgaatggtatat

SEQ ID NO: 1128792 - DNA, 22 bp, Artificial Sequence
  chemically synthesized
tttgaattatataccattcact

SEQ ID NO: 1128793 - DNA, 22 bp, Artificial Sequence
  chemically synthesized
gaattatataccattcactctc

SEQ ID NO: 1128794 - DNA, 22 bp, Artificial Sequence
  chemically synthesized
aattatataccattcactctct

SEQ ID NO: 1128795 - DNA, 22 bp, Artificial Sequence
  chemically synthesized
tataccattcactctctcaaca

SEQ ID NO: 1128796 - DNA, 22 bp, Artificial Sequence
  chemically synthesized
actctctcaacaaacatttatt

SEQ ID NO: 1128797 - DNA, 22 bp, Artificial Sequence
  chemically synthesized
tctcaacaaacatttattggtt

SEQ ID NO: 1128798 - DNA, 22 bp, Artificial Sequence
  chemically synthesized
tcaacaaacatttattggttac

SEQ ID NO: 1128799 - DNA, 22 bp, Artificial Sequence
  chemically synthesized
aacaaacatttattggttactt

SEQ ID NO: 1128800 - DNA, 22 bp, Artificial Sequence
  chemically synthesized
tagcaaataccgtggatacaat

SEQ ID NO: 1128801 - DNA, 22 bp, Artificial Sequence
  chemically synthesized
attggttacttattgtatccac

SEQ ID NO: 1128802 - DNA, 22 bp, Artificial Sequence
  chemically synthesized
ttggttacttattgtatccacg

SEQ ID NO: 1128803 - DNA, 22 bp, Artificial Sequence
  chemically synthesized
gttacttattgtatccacggta

SEQ ID NO: 1128804 - DNA, 22 bp, Artificial Sequence
  chemically synthesized
cattgtagcaaataccgtggat

SEQ ID NO: 1128805 - DNA, 22 bp, Artificial Sequence
  chemically synthesized
cttattgtatccacggtatttg

SEQ ID NO: 1128806 - DNA, 22 bp, Artificial Sequence
  chemically synthesized
gattccattgtagcaaataccg

SEQ ID NO: 1128807 - DNA, 22 bp, Artificial Sequence
  chemically synthesized
agattccattgtagcaaatacc

SEQ ID NO: 1128808 - DNA, 22 bp, Artificial Sequence
  chemically synthesized
attgtatccacggtatttgcta

SEQ ID NO: 1128809 - DNA, 22 bp, Artificial Sequence
  chemically synthesized
ttgtatccacggtatttgctac

SEQ ID NO: 1128810 - DNA, 22 bp, Artificial Sequence
  chemically synthesized
cttagattccattgtagcaaat

SEQ ID NO: 1128811 - DNA, 22 bp, Artificial Sequence
  chemically synthesized
acttagattccattgtagcaaa

SEQ ID NO: 1128812 - DNA, 22 bp, Artificial Sequence
  chemically synthesized
tatccacggtatttgctacaat

SEQ ID NO: 1128813 - DNA, 22 bp, Artificial Sequence
  chemically synthesized
tacttagattccattgtagcaa

SEQ ID NO: 1128814 - DNA, 22 bp, Artificial Sequence
  chemically synthesized
tgttttacttagattccattgt

SEQ ID NO: 1128815 - DNA, 22 bp, Artificial Sequence
  chemically synthesized
atgttttacttagattccattg

SEQ ID NO: 1128816 - DNA, 22 bp, Artificial Sequence
  chemically synthesized
tatgttttacttagattccatt

SEQ ID NO: 1128817 - DNA, 22 bp, Artificial Sequence
  chemically synthesized
tttatgttttacttagattcca

SEQ ID NO: 1128818 - DNA, 22 bp, Artificial Sequence
  chemically synthesized
ctttatgttttacttagattcc

SEQ ID NO: 1128819 - DNA, 22 bp, Artificial Sequence
  chemically synthesized
gctacaatggaatctaagtaaa

SEQ ID NO: 1128820 - DNA, 22 bp, Artificial Sequence
  chemically synthesized
ctacaatggaatctaagtaaaa

SEQ ID NO: 1128821 - DNA, 22 bp, Artificial Sequence
  chemically synthesized
cacttctttatgttttacttag

SEQ ID NO: 1128822 - DNA, 22 bp, Artificial Sequence
  chemically synthesized
caatggaatctaagtaaaacat

SEQ ID NO: 1128823 - DNA, 22 bp, Artificial Sequence
  chemically synthesized
ttacacttctttatgttttact

SEQ ID NO: 1128824 - DNA, 22 bp, Artificial Sequence
  chemically synthesized
ttattacacttctttatgtttt

SEQ ID NO: 1128825 - DNA, 22 bp, Artificial Sequence
  chemically synthesized
agtaaaacataaagaagtgtaa

SEQ ID NO: 1128826 - DNA, 22 bp, Artificial Sequence
  chemically synthesized
cccgtcaaaacaaaggaagcct

SEQ ID NO: 1128827 - DNA, 22 bp, Artificial Sequence
  chemically synthesized
attgcccgtcaaaacaaaggaa

SEQ ID NO: 1128828 - DNA, 22 bp, Artificial Sequence
  chemically synthesized
tcattgcccgtcaaaacaaagg

SEQ ID NO: 1128829 - DNA, 22 bp, Artificial Sequence
  chemically synthesized
ctcattgcccgtcaaaacaaag

SEQ ID NO: 1128830 - DNA, 22 bp, Artificial Sequence
  chemically synthesized
cctttgttttgacgggcaatga

SEQ ID NO: 1128831 - DNA, 22 bp, Artificial Sequence
  chemically synthesized
acataaaatttctcattgcccg

SEQ ID NO: 1128832 - DNA, 22 bp, Artificial Sequence
  chemically synthesized
ctttgttttgacgggcaatgag

SEQ ID NO: 1128833 - DNA, 22 bp, Artificial Sequence
  chemically synthesized
tgttttgacgggcaatgagaaa

SEQ ID NO: 1128834 - DNA, 22 bp, Artificial Sequence
  chemically synthesized
gttttgacgggcaatgagaaat

SEQ ID NO: 1128835 - DNA, 22 bp, Artificial Sequence
  chemically synthesized
ttttgacgggcaatgagaaatt

SEQ ID NO: 1128836 - DNA, 22 bp, Artificial Sequence
  chemically synthesized
tgacgggcaatgagaaatttta

SEQ ID NO: 1128837 - DNA, 22 bp, Artificial Sequence
  chemically synthesized
atgccactcacataaaatttct

SEQ ID NO: 1128838 - DNA, 22 bp, Artificial Sequence
  chemically synthesized
gacgggcaatgagaaattttat

SEQ ID NO: 1128839 - DNA, 22 bp, Artificial Sequence
  chemically synthesized
catgccactcacataaaatttc

SEQ ID NO: 1128840 - DNA, 22 bp, Artificial Sequence
  chemically synthesized
acgggcaatgagaaattttatg

SEQ ID NO: 1128841 - DNA, 22 bp, Artificial Sequence
  chemically synthesized
tatgccttcatgccactcacat

SEQ ID NO: 1128842 - DNA, 22 bp, Artificial Sequence
  chemically synthesized
ttgtatgccttcatgccactca

SEQ ID NO: 1128843 - DNA, 22 bp, Artificial Sequence
  chemically synthesized
gttgtatgccttcatgccactc

SEQ ID NO: 1128844 - DNA, 22 bp, Artificial Sequence
  chemically synthesized
tgttgtatgccttcatgccact

SEQ ID NO: 1128845 - DNA, 22 bp, Artificial Sequence
  chemically synthesized
gttttgttgtatgccttcatgc

SEQ ID NO: 1128846 - DNA, 22 bp, Artificial Sequence
  chemically synthesized
tatgtgagtggcatgaaggcat

SEQ ID NO: 1128847 - DNA, 22 bp, Artificial Sequence
  chemically synthesized
atgtgagtggcatgaaggcata

SEQ ID NO: 1128848 - DNA, 22 bp, Artificial Sequence
  chemically synthesized
tgtgagtggcatgaaggcatac

SEQ ID NO: 1128849 - DNA, 22 bp, Artificial Sequence
  chemically synthesized
cattcgttttgttgtatgcctt

SEQ ID NO: 1128850 - DNA, 22 bp, Artificial Sequence
  chemically synthesized
cattacattcgttttgttgtat

SEQ ID NO: 1128851 - DNA, 22 bp, Artificial Sequence
  chemically synthesized
agccagtaaattacattacatt

SEQ ID NO: 1128852 - DNA, 22 bp, Artificial Sequence
  chemically synthesized
cagccagtaaattacattacat

SEQ ID NO: 1128853 - DNA, 22 bp, Artificial Sequence
  chemically synthesized
cacttcagccagtaaattacat

SEQ ID NO: 1128854 - DNA, 22 bp, Artificial Sequence
  chemically synthesized
ttccacttcagccagtaaatta

SEQ ID NO: 1128855 - DNA, 22 bp, Artificial Sequence
  chemically synthesized
ccaataatcattattccacttc

SEQ ID NO: 1128856 - DNA, 22 bp, Artificial Sequence
  chemically synthesized
cccaataatcattattccactt

SEQ ID NO: 1128857 - DNA, 22 bp, Artificial Sequence
  chemically synthesized
actggctgaagtggaataatga

SEQ ID NO: 1128858 - DNA, 22 bp, Artificial Sequence
  chemically synthesized
ccttcccaataatcattattcc

SEQ ID NO: 1128859 - DNA, 22 bp, Artificial Sequence
  chemically synthesized
ctggctgaagtggaataatgat

SEQ ID NO: 1128860 - DNA, 22 bp, Artificial Sequence
  chemically synthesized
gctgaagtggaataatgattat

SEQ ID NO: 1128861 - DNA, 22 bp, Artificial Sequence
  chemically synthesized
tgtctaccttcccaataatcat

SEQ ID NO: 1128862 - DNA, 22 bp, Artificial Sequence
  chemically synthesized
atgtctaccttcccaataatca

SEQ ID NO: 1128863 - DNA, 22 bp, Artificial Sequence
  chemically synthesized
aagtggaataatgattattggg

SEQ ID NO: 1128864 - DNA, 22 bp, Artificial Sequence
  chemically synthesized
tatgtctaccttcccaataatc

SEQ ID NO: 1128865 - DNA, 22 bp, Artificial Sequence
  chemically synthesized
attttatgtctaccttcccaat

SEQ ID NO: 1128866 - DNA, 22 bp, Artificial Sequence
  chemically synthesized
cactaattttatgtctaccttc

SEQ ID NO: 1128867 - DNA, 22 bp, Artificial Sequence
  chemically synthesized
tccactaattttatgtctacct

SEQ ID NO: 1128868 - DNA, 22 bp, Artificial Sequence
  chemically synthesized
attctccactaattttatgtct

SEQ ID NO: 1128869 - DNA, 22 bp, Artificial Sequence
  chemically synthesized
ttgggaaggtagacataaaatt

SEQ ID NO: 1128870 - DNA, 22 bp, Artificial Sequence
  chemically synthesized
tcattctccactaattttatgt

SEQ ID NO: 1128871 - DNA, 22 bp, Artificial Sequence
  chemically synthesized
ggaaggtagacataaaattagt

SEQ ID NO: 1128872 - DNA, 22 bp, Artificial Sequence
  chemically synthesized
ttctcattctccactaatttta

SEQ ID NO: 1128873 - DNA, 22 bp, Artificial Sequence
  chemically synthesized
agtattattctcattctccact

SEQ ID NO: 1128874 - DNA, 22 bp, Artificial Sequence
  chemically synthesized
tggcattcagtattattctcat

SEQ ID NO: 1128875 - DNA, 22 bp, Artificial Sequence
  chemically synthesized
ctatggcattcagtattattct

SEQ ID NO: 1128876 - DNA, 22 bp, Artificial Sequence
  chemically synthesized
cctatggcattcagtattattc

SEQ ID NO: 1128877 - DNA, 22 bp, Artificial Sequence
  chemically synthesized
gtggagaatgagaataatactg

SEQ ID NO: 1128878 - DNA, 22 bp, Artificial Sequence
  chemically synthesized
caaaataaaacccaagtgcttc

SEQ ID NO: 1128879 - DNA, 22 bp, Artificial Sequence
  chemically synthesized
aatgccataggaagcacttggg

SEQ ID NO: 1128880 - DNA, 22 bp, Artificial Sequence
  chemically synthesized
ccataaatccagatacctccaa

SEQ ID NO: 1128881 - DNA, 22 bp, Artificial Sequence
  chemically synthesized
gggttttattttggaggtatct

SEQ ID NO: 1128882 - DNA, 22 bp, Artificial Sequence
  chemically synthesized
ggttttattttggaggtatctg

SEQ ID NO: 1128883 - DNA, 22 bp, Artificial Sequence
  chemically synthesized
tattttggaggtatctggattt

SEQ ID NO: 1128884 - DNA, 22 bp, Artificial Sequence
  chemically synthesized
attttggaggtatctggattta

SEQ ID NO: 1128885 - DNA, 22 bp, Artificial Sequence
  chemically synthesized
ttttggaggtatctggatttat

SEQ ID NO: 1128886 - DNA, 22 bp, Artificial Sequence
  chemically synthesized
tggaggtatctggatttatggg

SEQ ID NO: 1128887 - DNA, 22 bp, Artificial Sequence
  chemically synthesized
ggaggtatctggatttatggga

SEQ ID NO: 1128888 - DNA, 22 bp, Artificial Sequence
  chemically synthesized
gaggtatctggatttatgggaa

SEQ ID NO: 1128889 - DNA, 22 bp, Artificial Sequence
  chemically synthesized
cagacatgcgaattcccataaa

SEQ ID NO: 1128890 - DNA, 22 bp, Artificial Sequence
  chemically synthesized
tccagacatgcgaattcccata

SEQ ID NO: 1128891 - DNA, 22 bp, Artificial Sequence
  chemically synthesized
atgtctctccagacatgcgaat

SEQ ID NO: 1128892 - DNA, 22 bp, Artificial Sequence
  chemically synthesized
gatttatgggaattcgcatgtc

SEQ ID NO: 1128893 - DNA, 22 bp, Artificial Sequence
  chemically synthesized
gatgtctctccagacatgcgaa

SEQ ID NO: 1128894 - DNA, 22 bp, Artificial Sequence
  chemically synthesized
tgatgtctctccagacatgcga

SEQ ID NO: 1128895 - DNA, 22 bp, Artificial Sequence
  chemically synthesized
ttgatgtctctccagacatgcg

SEQ ID NO: 1128896 - DNA, 22 bp, Artificial Sequence
  chemically synthesized
tttgatgtctctccagacatgc

SEQ ID NO: 1128897 - DNA, 22 bp, Artificial Sequence
  chemically synthesized
atgggaattcgcatgtctggag

SEQ ID NO: 1128898 - DNA, 22 bp, Artificial Sequence
  chemically synthesized
tgggaattcgcatgtctggaga

SEQ ID NO: 1128899 - DNA, 22 bp, Artificial Sequence
  chemically synthesized
aaatgatgctttttgatgtctc

SEQ ID NO: 1128900 - DNA, 22 bp, Artificial Sequence
  chemically synthesized
gcatgtctggagagacatcaaa

SEQ ID NO: 1128901 - DNA, 22 bp, Artificial Sequence
  chemically synthesized
gagagacatcaaaaagcatcat

SEQ ID NO: 1128902 - DNA, 22 bp, Artificial Sequence
  chemically synthesized
aaatgaatatatctaaaatgat

SEQ ID NO: 1128903 - DNA, 22 bp, Artificial Sequence
  chemically synthesized
ctaaaatgaatatatctaaaat

SEQ ID NO: 1128904 - DNA, 22 bp, Artificial Sequence
  chemically synthesized
actaaaatgaatatatctaaaa

SEQ ID NO: 1128905 - DNA, 22 bp, Artificial Sequence
  chemically synthesized
atttactaaaatgaatatatct

SEQ ID NO: 1128906 - DNA, 22 bp, Artificial Sequence
  chemically synthesized
attgatttactaaaatgaatat

SEQ ID NO: 1128907 - DNA, 22 bp, Artificial Sequence
  chemically synthesized
taattgatttactaaaatgaat

SEQ ID NO: 1128908 - DNA, 22 bp, Artificial Sequence
  chemically synthesized
ctaattgatttactaaaatgaa

SEQ ID NO: 1128909 - DNA, 22 bp, Artificial Sequence
  chemically synthesized
tctaattgatttactaaaatga

SEQ ID NO: 1128910 - DNA, 22 bp, Artificial Sequence
  chemically synthesized
tagatatattcattttagtaaa

SEQ ID NO: 1128911 - DNA, 22 bp, Artificial Sequence
  chemically synthesized
ctttctaattgatttactaaaa

SEQ ID NO: 1128912 - DNA, 22 bp, Artificial Sequence
  chemically synthesized
agatatattcattttagtaaat

SEQ ID NO: 1128913 - DNA, 22 bp, Artificial Sequence
  chemically synthesized
gatatattcattttagtaaatc

SEQ ID NO: 1128914 - DNA, 22 bp, Artificial Sequence
  chemically synthesized
ccctcctttctaattgatttac

SEQ ID NO: 1128915 - DNA, 22 bp, Artificial Sequence
  chemically synthesized
attttagtaaatcaattagaaa

SEQ ID NO: 1128916 - DNA, 22 bp, Artificial Sequence
  chemically synthesized
tagtaaatcaattagaaaggag

SEQ ID NO: 1128917 - DNA, 22 bp, Artificial Sequence
  chemically synthesized
agtaaatcaattagaaaggagg

SEQ ID NO: 1128918 - DNA, 22 bp, Artificial Sequence
  chemically synthesized
gtaaatcaattagaaaggaggg

SEQ ID NO: 1128919 - DNA, 22 bp, Artificial Sequence
  chemically synthesized
tggagagaactgccctcctttc

SEQ ID NO: 1128920 - DNA, 22 bp, Artificial Sequence
  chemically synthesized
actgtggagagaactgccctcc

SEQ ID NO: 1128921 - DNA, 22 bp, Artificial Sequence
  chemically synthesized
gaaaggagggcagttctctcca

SEQ ID NO: 1128922 - DNA, 22 bp, Artificial Sequence
  chemically synthesized
agccatatacctcactgtggag

SEQ ID NO: 1128923 - DNA, 22 bp, Artificial Sequence
  chemically synthesized
tctccacagtgaggtatatggc

SEQ ID NO: 1128924 - DNA, 22 bp, Artificial Sequence
  chemically synthesized
tccacagtgaggtatatggctc

SEQ ID NO: 1128925 - DNA, 22 bp, Artificial Sequence
  chemically synthesized
cacagtgaggtatatggctcag

SEQ ID NO: 1128926 - DNA, 22 bp, Artificial Sequence
  chemically synthesized
ccaagtccataacctgagccat

SEQ ID NO: 1128927 - DNA, 22 bp, Artificial Sequence
  chemically synthesized
gaattgccaagtccataacctg

SEQ ID NO: 1128928 - DNA, 22 bp, Artificial Sequence
  chemically synthesized
attcgaattgccaagtccataa

SEQ ID NO: 1128929 - DNA, 22 bp, Artificial Sequence
  chemically synthesized
atgttcattcgaattgccaagt

SEQ ID NO: 1128930 - DNA, 22 bp, Artificial Sequence
  chemically synthesized
catgttcattcgaattgccaag

SEQ ID NO: 1128931 - DNA, 22 bp, Artificial Sequence
  chemically synthesized
aggttatggacttggcaattcg

SEQ ID NO: 1128932 - DNA, 22 bp, Artificial Sequence
  chemically synthesized
tggacttggcaattcgaatgaa

SEQ ID NO: 1128933 - DNA, 22 bp, Artificial Sequence
  chemically synthesized
cgtcatttcatgttcattcgaa

SEQ ID NO: 1128934 - DNA, 22 bp, Artificial Sequence
  chemically synthesized
ccgtcatttcatgttcattcga

SEQ ID NO: 1128935 - DNA, 22 bp, Artificial Sequence
  chemically synthesized
ggcaattcgaatgaacatgaaa

SEQ ID NO: 1128936 - DNA, 22 bp, Artificial Sequence
  chemically synthesized
gcaattcgaatgaacatgaaat

SEQ ID NO: 1128937 - DNA, 22 bp, Artificial Sequence
  chemically synthesized
gaatgaacatgaaatgacggaa

SEQ ID NO: 1128938 - DNA, 22 bp, Artificial Sequence
  chemically synthesized
ggcaagtgccatcatttccgtc

SEQ ID NO: 1128939 - DNA, 22 bp, Artificial Sequence
  chemically synthesized
ttgggcaagtgccatcatttcc

SEQ ID NO: 1128940 - DNA, 22 bp, Artificial Sequence
  chemically synthesized
tattattgggcaagtgccatca

SEQ ID NO: 1128941 - DNA, 22 bp, Artificial Sequence
  chemically synthesized
gattgtattattgggcaagtgc

SEQ ID NO: 1128942 - DNA, 22 bp, Artificial Sequence
  chemically synthesized
taattagattgtattattgggc

SEQ ID NO: 1128943 - DNA, 22 bp, Artificial Sequence
  chemically synthesized
ttataattagattgtattattg

SEQ ID NO: 1128944 - DNA, 22 bp, Artificial Sequence
  chemically synthesized
attataattagattgtattatt

SEQ ID NO: 1128945 - DNA, 22 bp, Artificial Sequence
  chemically synthesized
tttattataattagattgtatt

SEQ ID NO: 1128946 - DNA, 22 bp, Artificial Sequence
  chemically synthesized
atttattataattagattgtat

SEQ ID NO: 1128947 - DNA, 22 bp, Artificial Sequence
  chemically synthesized
cttatttattataattagattg

SEQ ID NO: 1128948 - DNA, 22 bp, Artificial Sequence
  chemically synthesized
gcccaataatacaatctaatta

SEQ ID NO: 1128949 - DNA, 22 bp, Artificial Sequence
  chemically synthesized
ccttatttattataattagatt

SEQ ID NO: 1128950 - DNA, 22 bp, Artificial Sequence
  chemically synthesized
cccaataatacaatctaattat

SEQ ID NO: 1128951 - DNA, 22 bp, Artificial Sequence
  chemically synthesized
tccttatttattataattagat

SEQ ID NO: 1128952 - DNA, 22 bp, Artificial Sequence
  chemically synthesized
ttccttatttattataattaga

SEQ ID NO: 1128953 - DNA, 22 bp, Artificial Sequence
  chemically synthesized
ttttccttatttattataatta

SEQ ID NO: 1128954 - DNA, 22 bp, Artificial Sequence
  chemically synthesized
cttttccttatttattataatt

SEQ ID NO: 1128955 - DNA, 22 bp, Artificial Sequence
  chemically synthesized
tcttttccttatttattataat

SEQ ID NO: 1128956 - DNA, 22 bp, Artificial Sequence
  chemically synthesized
ctttcttttccttatttattat

SEQ ID NO: 1128957 - DNA, 22 bp, Artificial Sequence
  chemically synthesized
tactttcttttccttatttatt

SEQ ID NO: 1128958 - DNA, 22 bp, Artificial Sequence
  chemically synthesized
ctactttcttttccttatttat

SEQ ID NO: 1128959 - DNA, 22 bp, Artificial Sequence
  chemically synthesized
ttctactttcttttccttattt

SEQ ID NO: 1128960 - DNA, 22 bp, Artificial Sequence
  chemically synthesized
cttctactttcttttccttatt

SEQ ID NO: 1128961 - DNA, 22 bp, Artificial Sequence
  chemically synthesized
tcttctactttcttttccttat

SEQ ID NO: 1128962 - DNA, 22 bp, Artificial Sequence
  chemically synthesized
ttcttctactttcttttcctta

SEQ ID NO: 1128963 - DNA, 22 bp, Artificial Sequence
  chemically synthesized
attataataaataaggaaaaga

SEQ ID NO: 1128964 - DNA, 22 bp, Artificial Sequence
  chemically synthesized
taataaataaggaaaagaaagt

SEQ ID NO: 1128965 - DNA, 22 bp, Artificial Sequence
  chemically synthesized
tgaatttttcttctactttctt

SEQ ID NO: 1128966 - DNA, 22 bp, Artificial Sequence
  chemically synthesized
tgtgaatttttcttctactttc

SEQ ID NO: 1128967 - DNA, 22 bp, Artificial Sequence
  chemically synthesized
gttctgtgaatttttcttctac

SEQ ID NO: 1128968 - DNA, 22 bp, Artificial Sequence
  chemically synthesized
tagttctgtgaatttttcttct

SEQ ID NO: 1128969 - DNA, 22 bp, Artificial Sequence
  chemically synthesized
acatctctagttctgtgaattt

SEQ ID NO: 1128970 - DNA, 22 bp, Artificial Sequence
  chemically synthesized
ccacctgacatctctagttctg

SEQ ID NO: 1128971 - DNA, 22 bp, Artificial Sequence
  chemically synthesized
accacctgacatctctagttct

SEQ ID NO: 1128972 - DNA, 22 bp, Artificial Sequence
  chemically synthesized
acagaactagagatgtcaggtg

SEQ ID NO: 1128973 - DNA, 22 bp, Artificial Sequence
  chemically synthesized
aaaacagaatttaccacctgac

SEQ ID NO: 1128974 - DNA, 22 bp, Artificial Sequence
  chemically synthesized
caaaacagaatttaccacctga

SEQ ID NO: 1128975 - DNA, 22 bp, Artificial Sequence
  chemically synthesized
ttcaaaacagaatttaccacct

SEQ ID NO: 1128976 - DNA, 22 bp, Artificial Sequence
  chemically synthesized
ctcttcaaaacagaatttacca

SEQ ID NO: 1128977 - DNA, 22 bp, Artificial Sequence
  chemically synthesized
gagatgtcaggtggtaaattct

SEQ ID NO: 1128978 - DNA, 22 bp, Artificial Sequence
  chemically synthesized
cctcttcaaaacagaatttacc

SEQ ID NO: 1128979 - DNA, 22 bp, Artificial Sequence
  chemically synthesized
tcctcttcaaaacagaatttac

SEQ ID NO: 1128980 - DNA, 22 bp, Artificial Sequence
  chemically synthesized
ttttcctcttcaaaacagaatt

SEQ ID NO: 1128981 - DNA, 22 bp, Artificial Sequence
  chemically synthesized
ctgttttcctcttcaaaacaga

SEQ ID NO: 1128982 - DNA, 22 bp, Artificial Sequence
  chemically synthesized
cctgttttcctcttcaaaacag

SEQ ID NO: 1128983 - DNA, 22 bp, Artificial Sequence
  chemically synthesized
ccttcctgttttcctcttcaaa

SEQ ID NO: 1128984 - DNA, 22 bp, Artificial Sequence
  chemically synthesized
tgttttgaagaggaaaacagga

SEQ ID NO: 1128985 - DNA, 22 bp, Artificial Sequence
  chemically synthesized
ttttgaagaggaaaacaggaag

SEQ ID NO: 1128986 - DNA, 22 bp, Artificial Sequence
  chemically synthesized
tgaagaggaaaacaggaaggta

SEQ ID NO: 1128987 - DNA, 22 bp, Artificial Sequence
  chemically synthesized
gaagaggaaaacaggaaggtaa

SEQ ID NO: 1128988 - DNA, 22 bp, Artificial Sequence
  chemically synthesized
agaaatgtaaaattaccttcct

SEQ ID NO: 1128989 - DNA, 22 bp, Artificial Sequence
  chemically synthesized
aagaggaaaacaggaaggtaat

SEQ ID NO: 1128990 - DNA, 22 bp, Artificial Sequence
  chemically synthesized
aaacctaagaaatgtaaaatta

SEQ ID NO: 1128991 - DNA, 22 bp, Artificial Sequence
  chemically synthesized
tctcaaacctaagaaatgtaaa

SEQ ID NO: 1128992 - DNA, 22 bp, Artificial Sequence
  chemically synthesized
tacatttcttaggtttgagata

SEQ ID NO: 1128993 - DNA, 22 bp, Artificial Sequence
  chemically synthesized
cataataaacattatctcaaac

SEQ ID NO: 1128994 - DNA, 22 bp, Artificial Sequence
  chemically synthesized
acatttcttaggtttgagataa

SEQ ID NO: 1128995 - DNA, 22 bp, Artificial Sequence
  chemically synthesized
catttcttaggtttgagataat

SEQ ID NO: 1128996 - DNA, 22 bp, Artificial Sequence
  chemically synthesized
cttaggtttgagataatgttta

SEQ ID NO: 1128997 - DNA, 22 bp, Artificial Sequence
  chemically synthesized
ttaggtttgagataatgtttat

SEQ ID NO: 1128998 - DNA, 22 bp, Artificial Sequence
  chemically synthesized
aggtttgagataatgtttatta

SEQ ID NO: 1128999 - DNA, 22 bp, Artificial Sequence
  chemically synthesized
ggtttgagataatgtttattat

SEQ ID NO: 1129000 - DNA, 22 bp, Artificial Sequence
  chemically synthesized
gagataatgtttattatggaat

SEQ ID NO: 1129001 - DNA, 22 bp, Artificial Sequence
  chemically synthesized
agataatgtttattatggaatt

SEQ ID NO: 1129002 - DNA, 22 bp, Artificial Sequence
  chemically synthesized
tcgacagggaaaaattccataa

SEQ ID NO: 1129003 - DNA, 22 bp, Artificial Sequence
  chemically synthesized
ttatcgacagggaaaaattcca

SEQ ID NO: 1129004 - DNA, 22 bp, Artificial Sequence
  chemically synthesized
attatggaatttttccctgtcg

SEQ ID NO: 1129005 - DNA, 22 bp, Artificial Sequence
  chemically synthesized
ttatggaatttttccctgtcga

SEQ ID NO: 1129006 - DNA, 22 bp, Artificial Sequence
  chemically synthesized
tggaatttttccctgtcgataa

SEQ ID NO: 1129007 - DNA, 22 bp, Artificial Sequence
  chemically synthesized
ttccctgtcgataatagatgac

SEQ ID NO: 1129008 - DNA, 22 bp, Artificial Sequence
  chemically synthesized
tccctgtcgataatagatgact

SEQ ID NO: 1129009 - DNA, 22 bp, Artificial Sequence
  chemically synthesized
ccctgtcgataatagatgacta

SEQ ID NO: 1129010 - DNA, 22 bp, Artificial Sequence
  chemically synthesized
cctgtcgataatagatgactac

SEQ ID NO: 1129011 - DNA, 22 bp, Artificial Sequence
  chemically synthesized
tcgataatagatgactaccatc

SEQ ID NO: 1129012 - DNA, 22 bp, Artificial Sequence
  chemically synthesized
ccatctccatcactacctccac

SEQ ID NO: 1129013 - DNA, 22 bp, Artificial Sequence
  chemically synthesized
catcactacctccaccaccatc

SEQ ID NO: 1129014 - DNA, 22 bp, Artificial Sequence
  chemically synthesized
cctccaccaccatcatcatcat

SEQ ID NO: 1129015 - DNA, 22 bp, Artificial Sequence
  chemically synthesized
caccaccatcatcatcatctct

SEQ ID NO: 1129016 - DNA, 22 bp, Artificial Sequence
  chemically synthesized
tactatcgttacctctcccacc

SEQ ID NO: 1129017 - DNA, 22 bp, Artificial Sequence
  chemically synthesized
ctatcgttacctctcccaccat

SEQ ID NO: 1129018 - DNA, 22 bp, Artificial Sequence
  chemically synthesized
tcgttacctctcccaccatcac

SEQ ID NO: 1129019 - DNA, 22 bp, Artificial Sequence
  chemically synthesized
cctctcccaccatcacttctac

SEQ ID NO: 1129020 - DNA, 22 bp, Artificial Sequence
  chemically synthesized
tggtgggtaggaggagtagaag

SEQ ID NO: 1129021 - DNA, 22 bp, Artificial Sequence
  chemically synthesized
tcccaccatcacttctactcct

SEQ ID NO: 1129022 - DNA, 22 bp, Artificial Sequence
  chemically synthesized
ccaccatcacttctactcctcc

SEQ ID NO: 1129023 - DNA, 22 bp, Artificial Sequence
  chemically synthesized
ctactcctcctacccaccacaa

SEQ ID NO: 1129024 - DNA, 22 bp, Artificial Sequence
  chemically synthesized
tactcctcctacccaccacaat

SEQ ID NO: 1129025 - DNA, 22 bp, Artificial Sequence
  chemically synthesized
ctcctcctacccaccacaatct

SEQ ID NO: 1129026 - DNA, 22 bp, Artificial Sequence
  chemically synthesized
ctcctacccaccacaatcttcc

SEQ ID NO: 1129027 - DNA, 22 bp, Artificial Sequence
  chemically synthesized
ctacccaccacaatcttcctcc

SEQ ID NO: 1129028 - DNA, 22 bp, Artificial Sequence
  chemically synthesized
cccaccacaatcttcctccatc

SEQ ID NO: 1129029 - DNA, 22 bp, Artificial Sequence
  chemically synthesized
cctccatcttcatcatctctat

SEQ ID NO: 1129030 - DNA, 22 bp, Artificial Sequence
  chemically synthesized
gtggtggagaccatagagatga

SEQ ID NO: 1129031 - DNA, 22 bp, Artificial Sequence
  chemically synthesized
ctccatcttcatcatctctatg

SEQ ID NO: 1129032 - DNA, 22 bp, Artificial Sequence
  chemically synthesized
ggtggtggagaccatagagatg

SEQ ID NO: 1129033 - DNA, 22 bp, Artificial Sequence
  chemically synthesized
catcttcatcatctctatggtc

SEQ ID NO: 1129034 - DNA, 22 bp, Artificial Sequence
  chemically synthesized
tttggtggtggagaccatagag

SEQ ID NO: 1129035 - DNA, 22 bp, Artificial Sequence
  chemically synthesized
atttggtggtggagaccataga

SEQ ID NO: 1129036 - DNA, 22 bp, Artificial Sequence
  chemically synthesized
ttatttggtggtggagaccata

SEQ ID NO: 1129037 - DNA, 22 bp, Artificial Sequence
  chemically synthesized
catcatctctatggtctccacc

SEQ ID NO: 1129038 - DNA, 22 bp, Artificial Sequence
  chemically synthesized
atcatctctatggtctccacca

SEQ ID NO: 1129039 - DNA, 22 bp, Artificial Sequence
  chemically synthesized
gattcttatttggtggtggaga

SEQ ID NO: 1129040 - DNA, 22 bp, Artificial Sequence
  chemically synthesized
tatggtctccaccaccaaataa

SEQ ID NO: 1129041 - DNA, 22 bp, Artificial Sequence
  chemically synthesized
tggtctccaccaccaaataaga

SEQ ID NO: 1129042 - DNA, 22 bp, Artificial Sequence
  chemically synthesized
caccaccaaataagaatcgaac

SEQ ID NO: 1129043 - DNA, 22 bp, Artificial Sequence
  chemically synthesized
aataaatgcagtggttcgattc

SEQ ID NO: 1129044 - DNA, 22 bp, Artificial Sequence
  chemically synthesized
aggtggtaaacattcaataaat

SEQ ID NO: 1129045 - DNA, 22 bp, Artificial Sequence
  chemically synthesized
aaggtggtaaacattcaataaa

SEQ ID NO: 1129046 - DNA, 22 bp, Artificial Sequence
  chemically synthesized
taaggtggtaaacattcaataa

SEQ ID NO: 1129047 - DNA, 22 bp, Artificial Sequence
  chemically synthesized
cctttaaggtggtaaacattca

SEQ ID NO: 1129048 - DNA, 22 bp, Artificial Sequence
  chemically synthesized
catttattgaatgtttaccacc

SEQ ID NO: 1129049 - DNA, 22 bp, Artificial Sequence
  chemically synthesized
atacattgcctttaaggtggta

SEQ ID NO: 1129050 - DNA, 22 bp, Artificial Sequence
  chemically synthesized
aatacattgcctttaaggtggt

SEQ ID NO: 1129051 - DNA, 22 bp, Artificial Sequence
  chemically synthesized
attgaatgtttaccaccttaaa

SEQ ID NO: 1129052 - DNA, 22 bp, Artificial Sequence
  chemically synthesized
ttgaatgtttaccaccttaaag

SEQ ID NO: 1129053 - DNA, 22 bp, Artificial Sequence
  chemically synthesized
aatgtttaccaccttaaaggca

SEQ ID NO: 1129054 - DNA, 22 bp, Artificial Sequence
  chemically synthesized
aataagcatttaatacattgcc

SEQ ID NO: 1129055 - DNA, 22 bp, Artificial Sequence
  chemically synthesized
accaccttaaaggcaatgtatt

SEQ ID NO: 1129056 - DNA, 22 bp, Artificial Sequence
  chemically synthesized
ccaccttaaaggcaatgtatta

SEQ ID NO: 1129057 - DNA, 22 bp, Artificial Sequence
  chemically synthesized
aaaggcaatgtattaaatgctt

SEQ ID NO: 1129058 - DNA, 22 bp, Artificial Sequence
  chemically synthesized
aaggcaatgtattaaatgctta

SEQ ID NO: 1129059 - DNA, 22 bp, Artificial Sequence
  chemically synthesized
tcatgaggattaaataagcatt

SEQ ID NO: 1129060 - DNA, 22 bp, Artificial Sequence
  chemically synthesized
taaaacaactgtcatgaggatt

SEQ ID NO: 1129061 - DNA, 22 bp, Artificial Sequence
  chemically synthesized
aatgcttatttaatcctcatga

SEQ ID NO: 1129062 - DNA, 22 bp, Artificial Sequence
  chemically synthesized
ataaaacaactgtcatgaggat

SEQ ID NO: 1129063 - DNA, 22 bp, Artificial Sequence
  chemically synthesized
tataaaacaactgtcatgagga

SEQ ID NO: 1129064 - DNA, 22 bp, Artificial Sequence
  chemically synthesized
actttataaaacaactgtcatg

SEQ ID NO: 1129065 - DNA, 22 bp, Artificial Sequence
  chemically synthesized
atttaatcctcatgacagttgt

SEQ ID NO: 1129066 - DNA, 22 bp, Artificial Sequence
  chemically synthesized
tcactttataaaacaactgtca

SEQ ID NO: 1129067 - DNA, 22 bp, Artificial Sequence
  chemically synthesized
tttaatcctcatgacagttgtt

SEQ ID NO: 1129068 - DNA, 22 bp, Artificial Sequence
  chemically synthesized
aatcctcatgacagttgtttta

SEQ ID NO: 1129069 - DNA, 22 bp, Artificial Sequence
  chemically synthesized
atcctcatgacagttgttttat

SEQ ID NO: 1129070 - DNA, 22 bp, Artificial Sequence
  chemically synthesized
cagtattctcactttataaaac

SEQ ID NO: 1129071 - DNA, 22 bp, Artificial Sequence
  chemically synthesized
atgacagttgttttataaagtg

SEQ ID NO: 1129072 - DNA, 22 bp, Artificial Sequence
  chemically synthesized
agattccagtattctcacttta

SEQ ID NO: 1129073 - DNA, 22 bp, Artificial Sequence
  chemically synthesized
tgcctcagattccagtattctc

SEQ ID NO: 1129074 - DNA, 22 bp, Artificial Sequence
  chemically synthesized
ttttataaagtgagaatactgg

SEQ ID NO: 1129075 - DNA, 22 bp, Artificial Sequence
  chemically synthesized
tataaagtgagaatactggaat

SEQ ID NO: 1129076 - DNA, 22 bp, Artificial Sequence
  chemically synthesized
tctgtgcctcagattccagtat

SEQ ID NO: 1129077 - DNA, 22 bp, Artificial Sequence
  chemically synthesized
ataaagtgagaatactggaatc

SEQ ID NO: 1129078 - DNA, 22 bp, Artificial Sequence
  chemically synthesized
taaagtgagaatactggaatct

SEQ ID NO: 1129079 - DNA, 22 bp, Artificial Sequence
  chemically synthesized
ttatctgtgcctcagattccag

SEQ ID NO: 1129080 - DNA, 22 bp, Artificial Sequence
  chemically synthesized
gttatctgtgcctcagattcca

SEQ ID NO: 1129081 - DNA, 22 bp, Artificial Sequence
  chemically synthesized
cttgttatctgtgcctcagatt

SEQ ID NO: 1129082 - DNA, 22 bp, Artificial Sequence
  chemically synthesized
gaatctgaggcacagataacaa

SEQ ID NO: 1129083 - DNA, 22 bp, Artificial Sequence
  chemically synthesized
tgagcgcaggcaaattacttgt

SEQ ID NO: 1129084 - DNA, 22 bp, Artificial Sequence
  chemically synthesized
aggcacagataacaagtaattt

SEQ ID NO: 1129085 - DNA, 22 bp, Artificial Sequence
  chemically synthesized
atgagcgcaggcaaattacttg

SEQ ID NO: 1129086 - DNA, 22 bp, Artificial Sequence
  chemically synthesized
gcttatgagcgcaggcaaatta

SEQ ID NO: 1129087 - DNA, 22 bp, Artificial Sequence
  chemically synthesized
ctagcttatgagcgcaggcaaa

SEQ ID NO: 1129088 - DNA, 22 bp, Artificial Sequence
  chemically synthesized
attactagcttatgagcgcagg

SEQ ID NO: 1129089 - DNA, 22 bp, Artificial Sequence
  chemically synthesized
aattactagcttatgagcgcag

SEQ ID NO: 1129090 - DNA, 22 bp, Artificial Sequence
  chemically synthesized
taattactagcttatgagcgca

SEQ ID NO: 1129091 - DNA, 22 bp, Artificial Sequence
  chemically synthesized
ttttaattactagcttatgagc

SEQ ID NO: 1129092 - DNA, 22 bp, Artificial Sequence
  chemically synthesized
cctgttttaattactagcttat

SEQ ID NO: 1129093 - DNA, 22 bp, Artificial Sequence
  chemically synthesized
gcctgcgctcataagctagtaa

SEQ ID NO: 1129094 - DNA, 22 bp, Artificial Sequence
  chemically synthesized
cctgcgctcataagctagtaat

SEQ ID NO: 1129095 - DNA, 22 bp, Artificial Sequence
  chemically synthesized
cgctcataagctagtaattaaa

SEQ ID NO: 1129096 - DNA, 22 bp, Artificial Sequence
  chemically synthesized
tgaaacctgcctgttttaatta

SEQ ID NO: 1129097 - DNA, 22 bp, Artificial Sequence
  chemically synthesized
gtgaaacctgcctgttttaatt

SEQ ID NO: 1129098 - DNA, 22 bp, Artificial Sequence
  chemically synthesized
ataagctagtaattaaaacagg

SEQ ID NO: 1129099 - DNA, 22 bp, Artificial Sequence
  chemically synthesized
tggtatttgtgaaacctgcctg

SEQ ID NO: 1129100 - DNA, 22 bp, Artificial Sequence
  chemically synthesized
gtaattaaaacaggcaggtttc

SEQ ID NO: 1129101 - DNA, 22 bp, Artificial Sequence
  chemically synthesized
aaacaggcaggtttcacaaata

SEQ ID NO: 1129102 - DNA, 22 bp, Artificial Sequence
  chemically synthesized
taggtaagaacctgtggtattt

SEQ ID NO: 1129103 - DNA, 22 bp, Artificial Sequence
  chemically synthesized
ataggtaagaacctgtggtatt

SEQ ID NO: 1129104 - DNA, 22 bp, Artificial Sequence
  chemically synthesized
acttataggtaagaacctgtgg

SEQ ID NO: 1129105 - DNA, 22 bp, Artificial Sequence
  chemically synthesized
tcacttataggtaagaacctgt

SEQ ID NO: 1129106 - DNA, 22 bp, Artificial Sequence
  chemically synthesized
cacaaataccacaggttcttac

SEQ ID NO: 1129107 - DNA, 22 bp, Artificial Sequence
  chemically synthesized
acaaataccacaggttcttacc

SEQ ID NO: 1129108 - DNA, 22 bp, Artificial Sequence
  chemically synthesized
tctctcacttataggtaagaac

SEQ ID NO: 1129109 - DNA, 22 bp, Artificial Sequence
  chemically synthesized
atctctcacttataggtaagaa

SEQ ID NO: 1129110 - DNA, 22 bp, Artificial Sequence
  chemically synthesized
agtgtttatctctcacttatag

SEQ ID NO: 1129111 - DNA, 22 bp, Artificial Sequence
  chemically synthesized
ttacctataagtgagagataaa

SEQ ID NO: 1129112 - DNA, 22 bp, Artificial Sequence
  chemically synthesized
acctataagtgagagataaaca

SEQ ID NO: 1129113 - DNA, 22 bp, Artificial Sequence
  chemically synthesized
cctataagtgagagataaacac

SEQ ID NO: 1129114 - DNA, 22 bp, Artificial Sequence
  chemically synthesized
taagtgagagataaacactgag

SEQ ID NO: 1129115 - DNA, 22 bp, Artificial Sequence
  chemically synthesized
tgtccatgtgtactcagtgttt

SEQ ID NO: 1129116 - DNA, 22 bp, Artificial Sequence
  chemically synthesized
gtgtccatgtgtactcagtgtt

SEQ ID NO: 1129117 - DNA, 22 bp, Artificial Sequence
  chemically synthesized
tgtgtccatgtgtactcagtgt

SEQ ID NO: 1129118 - DNA, 22 bp, Artificial Sequence
  chemically synthesized
tttgtgtccatgtgtactcagt

SEQ ID NO: 1129119 - DNA, 22 bp, Artificial Sequence
  chemically synthesized
ctttgtgtccatgtgtactcag

SEQ ID NO: 1129120 - DNA, 22 bp, Artificial Sequence
  chemically synthesized
ccttctttgtgtccatgtgtac

SEQ ID NO: 1129121 - DNA, 22 bp, Artificial Sequence
  chemically synthesized
ttcccttctttgtgtccatgtg

SEQ ID NO: 1129122 - DNA, 22 bp, Artificial Sequence
  chemically synthesized
ttattcccttctttgtgtccat

SEQ ID NO: 1129123 - DNA, 22 bp, Artificial Sequence
  chemically synthesized
agtacacatggacacaaagaag

SEQ ID NO: 1129124 - DNA, 22 bp, Artificial Sequence
  chemically synthesized
aaataggccccagtgtctatta

SEQ ID NO: 1129125 - DNA, 22 bp, Artificial Sequence
  chemically synthesized
tcaaataggccccagtgtctat

SEQ ID NO: 1129126 - DNA, 22 bp, Artificial Sequence
  chemically synthesized
cactctcaaataggccccagtg

SEQ ID NO: 1129127 - DNA, 22 bp, Artificial Sequence
  chemically synthesized
ccactctcaaataggccccagt

SEQ ID NO: 1129128 - DNA, 22 bp, Artificial Sequence
  chemically synthesized
ccaccttccactctcaaatagg

SEQ ID NO: 1129129 - DNA, 22 bp, Artificial Sequence
  chemically synthesized
cctcccaccttccactctcaaa

SEQ ID NO: 1129130 - DNA, 22 bp, Artificial Sequence
  chemically synthesized
gggcctatttgagagtggaagg

SEQ ID NO: 1129131 - DNA, 22 bp, Artificial Sequence
  chemically synthesized
acctgcctcccaccttccactc

SEQ ID NO: 1129132 - DNA, 22 bp, Artificial Sequence
  chemically synthesized
tttgagagtggaaggtgggagg

SEQ ID NO: 1129133 - DNA, 22 bp, Artificial Sequence
  chemically synthesized
ccatcctcacctgcctcccacc

SEQ ID NO: 1129134 - DNA, 22 bp, Artificial Sequence
  chemically synthesized
cccatcctcacctgcctcccac

SEQ ID NO: 1129135 - DNA, 22 bp, Artificial Sequence
  chemically synthesized
gagagtggaaggtgggaggcag

SEQ ID NO: 1129136 - DNA, 22 bp, Artificial Sequence
  chemically synthesized
tcccatcctcacctgcctccca

SEQ ID NO: 1129137 - DNA, 22 bp, Artificial Sequence
  chemically synthesized
agagtggaaggtgggaggcagg

SEQ ID NO: 1129138 - DNA, 22 bp, Artificial Sequence
  chemically synthesized
ataggtagttttcccatcctca

SEQ ID NO: 1129139 - DNA, 22 bp, Artificial Sequence
  chemically synthesized
aggtaatcagcataatatctga

SEQ ID NO: 1129140 - DNA, 22 bp, Artificial Sequence
  chemically synthesized
tcaggtaatcagcataatatct

SEQ ID NO: 1129141 - DNA, 22 bp, Artificial Sequence
  chemically synthesized
tctctcaggtaatcagcataat

SEQ ID NO: 1129142 - DNA, 22 bp, Artificial Sequence
  chemically synthesized
gtctctcaggtaatcagcataa

SEQ ID NO: 1129143 - DNA, 22 bp, Artificial Sequence
  chemically synthesized
cctatcagatattatgctgatt

SEQ ID NO: 1129144 - DNA, 22 bp, Artificial Sequence
  chemically synthesized
tgtctctcaggtaatcagcata

SEQ ID NO: 1129145 - DNA, 22 bp, Artificial Sequence
  chemically synthesized
tcagatattatgctgattacct

SEQ ID NO: 1129146 - DNA, 22 bp, Artificial Sequence
  chemically synthesized
tgctgattacctgagagacaaa

SEQ ID NO: 1129147 - DNA, 22 bp, Artificial Sequence
  chemically synthesized
gtgtacagataattttgtctct

SEQ ID NO: 1129148 - DNA, 22 bp, Artificial Sequence
  chemically synthesized
ggtgtacagataattttgtctc

SEQ ID NO: 1129149 - DNA, 22 bp, Artificial Sequence
  chemically synthesized
attacctgagagacaaaattat

SEQ ID NO: 1129150 - DNA, 22 bp, Artificial Sequence
  chemically synthesized
tttggtgtacagataattttgt

SEQ ID NO: 1129151 - DNA, 22 bp, Artificial Sequence
  chemically synthesized
cctgagagacaaaattatctgt

SEQ ID NO: 1129152 - DNA, 22 bp, Artificial Sequence
  chemically synthesized
tggctgtttggtgtacagataa

SEQ ID NO: 1129153 - DNA, 22 bp, Artificial Sequence
  chemically synthesized
agagacaaaattatctgtacac

SEQ ID NO: 1129154 - DNA, 22 bp, Artificial Sequence
  chemically synthesized
cgtgttgtggctgtttggtgta

SEQ ID NO: 1129155 - DNA, 22 bp, Artificial Sequence
  chemically synthesized
tctgtacaccaaacagccacaa

SEQ ID NO: 1129156 - DNA, 22 bp, Artificial Sequence
  chemically synthesized
tacaccaaacagccacaacacg

SEQ ID NO: 1129157 - DNA, 22 bp, Artificial Sequence
  chemically synthesized
catgggtaaattgcgtgttgtg

SEQ ID NO: 1129158 - DNA, 22 bp, Artificial Sequence
  chemically synthesized
ttacatgggtaaattgcgtgtt

SEQ ID NO: 1129159 - DNA, 22 bp, Artificial Sequence
  chemically synthesized
gttacatgggtaaattgcgtgt

SEQ ID NO: 1129160 - DNA, 22 bp, Artificial Sequence
  chemically synthesized
acgtgtaggtttgttacatggg

SEQ ID NO: 1129161 - DNA, 22 bp, Artificial Sequence
  chemically synthesized
aaggggttaacgtgtaggtttg

SEQ ID NO: 1129162 - DNA, 22 bp, Artificial Sequence
  chemically synthesized
acccatgtaacaaacctacacg

SEQ ID NO: 1129163 - DNA, 22 bp, Artificial Sequence
  chemically synthesized
cccatgtaacaaacctacacgt

SEQ ID NO: 1129164 - DNA, 22 bp, Artificial Sequence
  chemically synthesized
ggttcaaggggttaacgtgtag

SEQ ID NO: 1129165 - DNA, 22 bp, Artificial Sequence
  chemically synthesized
aggttcaaggggttaacgtgta

SEQ ID NO: 1129166 - DNA, 22 bp, Artificial Sequence
  chemically synthesized
gtttaggttcaaggggttaacg

SEQ ID NO: 1129167 - DNA, 22 bp, Artificial Sequence
  chemically synthesized
agtttaggttcaaggggttaac

SEQ ID NO: 1129168 - DNA, 22 bp, Artificial Sequence
  chemically synthesized
tagtttaggttcaaggggttaa

SEQ ID NO: 1129169 - DNA, 22 bp, Artificial Sequence
  chemically synthesized
ttagtttaggttcaaggggtta

SEQ ID NO: 1129170 - DNA, 22 bp, Artificial Sequence
  chemically synthesized
cacgttaaccccttgaacctaa

SEQ ID NO: 1129171 - DNA, 22 bp, Artificial Sequence
  chemically synthesized
ccaacttttagtttaggttcaa

SEQ ID NO: 1129172 - DNA, 22 bp, Artificial Sequence
  chemically synthesized
cccaacttttagtttaggttca

SEQ ID NO: 1129173 - DNA, 22 bp, Artificial Sequence
  chemically synthesized
tcccaacttttagtttaggttc

SEQ ID NO: 1129174 - DNA, 22 bp, Artificial Sequence
  chemically synthesized
ttcccaacttttagtttaggtt

SEQ ID NO: 1129175 - DNA, 22 bp, Artificial Sequence
  chemically synthesized
tttcccaacttttagtttaggt

SEQ ID NO: 1129176 - DNA, 22 bp, Artificial Sequence
  chemically synthesized
ttttcccaacttttagtttagg

SEQ ID NO: 1129177 - DNA, 22 bp, Artificial Sequence
  chemically synthesized
tttttcccaacttttagtttag

SEQ ID NO: 1129178 - DNA, 22 bp, Artificial Sequence
  chemically synthesized
accccttgaacctaaactaaaa

SEQ ID NO: 1129179 - DNA, 22 bp, Artificial Sequence
  chemically synthesized
ttttttcccaacttttagttta

SEQ ID NO: 1129180 - DNA, 22 bp, Artificial Sequence
  chemically synthesized
tttttttcccaacttttagttt

SEQ ID NO: 1129181 - DNA, 22 bp, Artificial Sequence
  chemically synthesized
ttttttttcccaacttttagtt

SEQ ID NO: 1129182 - DNA, 22 bp, Artificial Sequence
  chemically synthesized
tttttttttcccaacttttagt

SEQ ID NO: 1129183 - DNA, 22 bp, Artificial Sequence
  chemically synthesized
gaacctaaactaaaagttggga

SEQ ID NO: 1129184 - DNA, 22 bp, Artificial Sequence
  chemically synthesized
aacctaaactaaaagttgggaa

SEQ ID NO: 1129185 - DNA, 22 bp, Artificial Sequence
  chemically synthesized
ccctttttttttttcccaactt

SEQ ID NO: 1129186 - DNA, 22 bp, Artificial Sequence
  chemically synthesized
aactaaaagttgggaaaaaaaa

SEQ ID NO: 1129187 - DNA, 22 bp, Artificial Sequence
  chemically synthesized
aatgctgccctttttttttttc

SEQ ID NO: 1129188 - DNA, 22 bp, Artificial Sequence
  chemically synthesized
gaatgctgcccttttttttttt

SEQ ID NO: 1129189 - DNA, 22 bp, Artificial Sequence
  chemically synthesized
aaagttgggaaaaaaaaaaagg

SEQ ID NO: 1129190 - DNA, 22 bp, Artificial Sequence
  chemically synthesized
aggtttgaatgctgcccttttt

SEQ ID NO: 1129191 - DNA, 22 bp, Artificial Sequence
  chemically synthesized
ctgaggtttgaatgctgccctt

SEQ ID NO: 1129192 - DNA, 22 bp, Artificial Sequence
  chemically synthesized
ggaaaaaaaaaaagggcagcat

SEQ ID NO: 1129193 - DNA, 22 bp, Artificial Sequence
  chemically synthesized
gaatcagaattactgaggtttg

SEQ ID NO: 1129194 - DNA, 22 bp, Artificial Sequence
  chemically synthesized
ggaatcagaattactgaggttt

SEQ ID NO: 1129195 - DNA, 22 bp, Artificial Sequence
  chemically synthesized
tggaatcagaattactgaggtt

SEQ ID NO: 1129196 - DNA, 22 bp, Artificial Sequence
  chemically synthesized
ttggaatcagaattactgaggt

SEQ ID NO: 1129197 - DNA, 22 bp, Artificial Sequence
  chemically synthesized
cttttggaatcagaattactga

SEQ ID NO: 1129198 - DNA, 22 bp, Artificial Sequence
  chemically synthesized
aaacctcagtaattctgattcc

SEQ ID NO: 1129199 - DNA, 22 bp, Artificial Sequence
  chemically synthesized
agtaattctgattccaaaagca

SEQ ID NO: 1129200 - DNA, 22 bp, Artificial Sequence
  chemically synthesized
tgattccaaaagcaatgatttt

SEQ ID NO: 1129201 - DNA, 22 bp, Artificial Sequence
  chemically synthesized
attccaaaagcaatgatttttt

SEQ ID NO: 1129202 - DNA, 22 bp, Artificial Sequence
  chemically synthesized
caaaagcaatgattttttccat

SEQ ID NO: 1129203 - DNA, 22 bp, Artificial Sequence
  chemically synthesized
gagaagtagcaaatatggaaaa

SEQ ID NO: 1129204 - DNA, 22 bp, Artificial Sequence
  chemically synthesized
tgtgtctagagaagtagcaaat

SEQ ID NO: 1129205 - DNA, 22 bp, Artificial Sequence
  chemically synthesized
cctgtgtgtctagagaagtagc

SEQ ID NO: 1129206 - DNA, 22 bp, Artificial Sequence
  chemically synthesized
tttccatatttgctacttctct

SEQ ID NO: 1129207 - DNA, 22 bp, Artificial Sequence
  chemically synthesized
ttccatatttgctacttctcta

SEQ ID NO: 1129208 - DNA, 22 bp, Artificial Sequence
  chemically synthesized
tccatatttgctacttctctag

SEQ ID NO: 1129209 - DNA, 22 bp, Artificial Sequence
  chemically synthesized
ccatatttgctacttctctaga

SEQ ID NO: 1129210 - DNA, 22 bp, Artificial Sequence
  chemically synthesized
attgcctgtgtgtctagagaag

SEQ ID NO: 1129211 - DNA, 22 bp, Artificial Sequence
  chemically synthesized
catatttgctacttctctagac

SEQ ID NO: 1129212 - DNA, 22 bp, Artificial Sequence
  chemically synthesized
taattcattgcctgtgtgtcta

SEQ ID NO: 1129213 - DNA, 22 bp, Artificial Sequence
  chemically synthesized
gctacttctctagacacacagg

SEQ ID NO: 1129214 - DNA, 22 bp, Artificial Sequence
  chemically synthesized
ctacttctctagacacacaggc

SEQ ID NO: 1129215 - DNA, 22 bp, Artificial Sequence
  chemically synthesized
gttataattcattgcctgtgtg

SEQ ID NO: 1129216 - DNA, 22 bp, Artificial Sequence
  chemically synthesized
agttataattcattgcctgtgt

SEQ ID NO: 1129217 - DNA, 22 bp, Artificial Sequence
  chemically synthesized
cttctctagacacacaggcaat

SEQ ID NO: 1129218 - DNA, 22 bp, Artificial Sequence
  chemically synthesized
tagttataattcattgcctgtg

SEQ ID NO: 1129219 - DNA, 22 bp, Artificial Sequence
  chemically synthesized
ctctagacacacaggcaatgaa

SEQ ID NO: 1129220 - DNA, 22 bp, Artificial Sequence
  chemically synthesized
tctagacacacaggcaatgaat

SEQ ID NO: 1129221 - DNA, 22 bp, Artificial Sequence
  chemically synthesized
tagacacacaggcaatgaatta

SEQ ID NO: 1129222 - DNA, 22 bp, Artificial Sequence
  chemically synthesized
gacacacaggcaatgaattata

SEQ ID NO: 1129223 - DNA, 22 bp, Artificial Sequence
  chemically synthesized
cacacatattttagttataatt

SEQ ID NO: 1129224 - DNA, 22 bp, Artificial Sequence
  chemically synthesized
tacattgcacacatattttagt

SEQ ID NO: 1129225 - DNA, 22 bp, Artificial Sequence
  chemically synthesized
atacattgcacacatattttag

SEQ ID NO: 1129226 - DNA, 22 bp, Artificial Sequence
  chemically synthesized
cttatacattgcacacatattt

SEQ ID NO: 1129227 - DNA, 22 bp, Artificial Sequence
  chemically synthesized
taactaaaatatgtgtgcaatg

SEQ ID NO: 1129228 - DNA, 22 bp, Artificial Sequence
  chemically synthesized
accatacctacttatacattgc

SEQ ID NO: 1129229 - DNA, 22 bp, Artificial Sequence
  chemically synthesized
aaatatgtgtgcaatgtataag

SEQ ID NO: 1129230 - DNA, 22 bp, Artificial Sequence
  chemically synthesized
caattaaccatacctacttata

SEQ ID NO: 1129231 - DNA, 22 bp, Artificial Sequence
  chemically synthesized
ccaattaaccatacctacttat

SEQ ID NO: 1129232 - DNA, 22 bp, Artificial Sequence
  chemically synthesized
cttccaattaaccatacctact

SEQ ID NO: 1129233 - DNA, 22 bp, Artificial Sequence
  chemically synthesized
ttccttccaattaaccatacct

SEQ ID NO: 1129234 - DNA, 22 bp, Artificial Sequence
  chemically synthesized
gttccttccaattaaccatacc

SEQ ID NO: 1129235 - DNA, 22 bp, Artificial Sequence
  chemically synthesized
atcaaatgcaaacatttgttcc

SEQ ID NO: 1129236 - DNA, 22 bp, Artificial Sequence
  chemically synthesized
attggaaggaacaaatgtttgc

SEQ ID NO: 1129237 - DNA, 22 bp, Artificial Sequence
  chemically synthesized
aatgttcatcaaatgcaaacat

SEQ ID NO: 1129238 - DNA, 22 bp, Artificial Sequence
  chemically synthesized
gaaggaacaaatgtttgcattt

SEQ ID NO: 1129239 - DNA, 22 bp, Artificial Sequence
  chemically synthesized
cctcaatgttcatcaaatgcaa

SEQ ID NO: 1129240 - DNA, 22 bp, Artificial Sequence
  chemically synthesized
gcatttgatgaacattgaggca

SEQ ID NO: 1129241 - DNA, 22 bp, Artificial Sequence
  chemically synthesized
catttgatgaacattgaggcag

SEQ ID NO: 1129242 - DNA, 22 bp, Artificial Sequence
  chemically synthesized
tgcatccagcaactgcctcaat

SEQ ID NO: 1129243 - DNA, 22 bp, Artificial Sequence
  chemically synthesized
gtgcatccagcaactgcctcaa

SEQ ID NO: 1129244 - DNA, 22 bp, Artificial Sequence
  chemically synthesized
gatgaacattgaggcagttgct

SEQ ID NO: 1129245 - DNA, 22 bp, Artificial Sequence
  chemically synthesized
atgaacattgaggcagttgctg

SEQ ID NO: 1129246 - DNA, 22 bp, Artificial Sequence
  chemically synthesized
cgcttgtgcatccagcaactgc

SEQ ID NO: 1129247 - DNA, 22 bp, Artificial Sequence
  chemically synthesized
ccgcttgtgcatccagcaactg

SEQ ID NO: 1129248 - DNA, 22 bp, Artificial Sequence
  chemically synthesized
tttccgcttgtgcatccagcaa

SEQ ID NO: 1129249 - DNA, 22 bp, Artificial Sequence
  chemically synthesized
aggcagttgctggatgcacaag

SEQ ID NO: 1129250 - DNA, 22 bp, Artificial Sequence
  chemically synthesized
aagctatttccgcttgtgcatc

SEQ ID NO: 1129251 - DNA, 22 bp, Artificial Sequence
  chemically synthesized
taaagctatttccgcttgtgca

SEQ ID NO: 1129252 - DNA, 22 bp, Artificial Sequence
  chemically synthesized
tatctctaaagctatttccgct

SEQ ID NO: 1129253 - DNA, 22 bp, Artificial Sequence
  chemically synthesized
ctggatgcacaagcggaaatag

SEQ ID NO: 1129254 - DNA, 22 bp, Artificial Sequence
  chemically synthesized
atatctctaaagctatttccgc

SEQ ID NO: 1129255 - DNA, 22 bp, Artificial Sequence
  chemically synthesized
tatatctctaaagctatttccg

SEQ ID NO: 1129256 - DNA, 22 bp, Artificial Sequence
  chemically synthesized
gatgcacaagcggaaatagctt

SEQ ID NO: 1129257 - DNA, 22 bp, Artificial Sequence
  chemically synthesized
aagctttatatctctaaagcta

SEQ ID NO: 1129258 - DNA, 22 bp, Artificial Sequence
  chemically synthesized
aaattaaagctttatatctcta

SEQ ID NO: 1129259 - DNA, 22 bp, Artificial Sequence
  chemically synthesized
cctcaaattaaagctttatatc

SEQ ID NO: 1129260 - DNA, 22 bp, Artificial Sequence
  chemically synthesized
tccctcaaattaaagctttata

SEQ ID NO: 1129261 - DNA, 22 bp, Artificial Sequence
  chemically synthesized
tagagatataaagctttaattt

SEQ ID NO: 1129262 - DNA, 22 bp, Artificial Sequence
  chemically synthesized
agagatataaagctttaatttg

SEQ ID NO: 1129263 - DNA, 22 bp, Artificial Sequence
  chemically synthesized
gagatataaagctttaatttga

SEQ ID NO: 1129264 - DNA, 22 bp, Artificial Sequence
  chemically synthesized
cagatgtgacactctccctcaa

SEQ ID NO: 1129265 - DNA, 22 bp, Artificial Sequence
  chemically synthesized
taatttgagggagagtgtcaca

SEQ ID NO: 1129266 - DNA, 22 bp, Artificial Sequence
  chemically synthesized
aatttgagggagagtgtcacat

SEQ ID NO: 1129267 - DNA, 22 bp, Artificial Sequence
  chemically synthesized
atttgagggagagtgtcacatc

SEQ ID NO: 1129268 - DNA, 22 bp, Artificial Sequence
  chemically synthesized
gagggagagtgtcacatctgga

SEQ ID NO: 1129269 - DNA, 22 bp, Artificial Sequence
  chemically synthesized
agggagagtgtcacatctggag

SEQ ID NO: 1129270 - DNA, 22 bp, Artificial Sequence
  chemically synthesized
ccaaatcatgtagctccagatg

SEQ ID NO: 1129271 - DNA, 22 bp, Artificial Sequence
  chemically synthesized
actcccaaatcatgtagctcca

SEQ ID NO: 1129272 - DNA, 22 bp, Artificial Sequence
  chemically synthesized
agtgactgactcccaaatcatg

SEQ ID NO: 1129273 - DNA, 22 bp, Artificial Sequence
  chemically synthesized
taagtgactgactcccaaatca

SEQ ID NO: 1129274 - DNA, 22 bp, Artificial Sequence
  chemically synthesized
gagctacatgatttgggagtca

SEQ ID NO: 1129275 - DNA, 22 bp, Artificial Sequence
  chemically synthesized
gctctaagtgactgactcccaa

SEQ ID NO: 1129276 - DNA, 22 bp, Artificial Sequence
  chemically synthesized
catgatttgggagtcagtcact

SEQ ID NO: 1129277 - DNA, 22 bp, Artificial Sequence
  chemically synthesized
gagcctggctctaagtgactga

SEQ ID NO: 1129278 - DNA, 22 bp, Artificial Sequence
  chemically synthesized
attcgagcctggctctaagtga

SEQ ID NO: 1129279 - DNA, 22 bp, Artificial Sequence
  chemically synthesized
gggagtcagtcacttagagcca

SEQ ID NO: 1129280 - DNA, 22 bp, Artificial Sequence
  chemically synthesized
ggagtcagtcacttagagccag

SEQ ID NO: 1129281 - DNA, 22 bp, Artificial Sequence
  chemically synthesized
attgattcgagcctggctctaa

SEQ ID NO: 1129282 - DNA, 22 bp, Artificial Sequence
  chemically synthesized
tcattgattcgagcctggctct

SEQ ID NO: 1129283 - DNA, 22 bp, Artificial Sequence
  chemically synthesized
ctctcattgattcgagcctggc

SEQ ID NO: 1129284 - DNA, 22 bp, Artificial Sequence
  chemically synthesized
tctcctctcattgattcgagcc

SEQ ID NO: 1129285 - DNA, 22 bp, Artificial Sequence
  chemically synthesized
agagccaggctcgaatcaatga

SEQ ID NO: 1129286 - DNA, 22 bp, Artificial Sequence
  chemically synthesized
gattatctcctctcattgattc

SEQ ID NO: 1129287 - DNA, 22 bp, Artificial Sequence
  chemically synthesized
gagccaggctcgaatcaatgag

SEQ ID NO: 1129288 - DNA, 22 bp, Artificial Sequence
  chemically synthesized
tctggattatctcctctcattg

SEQ ID NO: 1129289 - DNA, 22 bp, Artificial Sequence
  chemically synthesized
atctggattatctcctctcatt

SEQ ID NO: 1129290 - DNA, 22 bp, Artificial Sequence
  chemically synthesized
tatctggattatctcctctcat

SEQ ID NO: 1129291 - DNA, 22 bp, Artificial Sequence
  chemically synthesized
tttatctggattatctcctctc

SEQ ID NO: 1129292 - DNA, 22 bp, Artificial Sequence
  chemically synthesized
ctttatctggattatctcctct

SEQ ID NO: 1129293 - DNA, 22 bp, Artificial Sequence
  chemically synthesized
gaatcaatgagaggagataatc

SEQ ID NO: 1129294 - DNA, 22 bp, Artificial Sequence
  chemically synthesized
acttctttatctggattatctc

SEQ ID NO: 1129295 - DNA, 22 bp, Artificial Sequence
  chemically synthesized
gacttctttatctggattatct

SEQ ID NO: 1129296 - DNA, 22 bp, Artificial Sequence
  chemically synthesized
tgacttctttatctggattatc

SEQ ID NO: 1129297 - DNA, 22 bp, Artificial Sequence
  chemically synthesized
ttgacttctttatctggattat

SEQ ID NO: 1129298 - DNA, 22 bp, Artificial Sequence
  chemically synthesized
caggcatgagccaccatgcccg

SEQ ID NO: 1129299 - DNA, 22 bp, Artificial Sequence
  chemically synthesized
ggattacaggcatgagccacca

SEQ ID NO: 1129300 - DNA, 22 bp, Artificial Sequence
  chemically synthesized
ccaaagtgctgggattacaggc

SEQ ID NO: 1129301 - DNA, 22 bp, Artificial Sequence
  chemically synthesized
agcctcccaaagtgctgggatt

SEQ ID NO: 1129302 - DNA, 22 bp, Artificial Sequence
  chemically synthesized
cagcctcccaaagtgctgggat

SEQ ID NO: 1129303 - DNA, 22 bp, Artificial Sequence
  chemically synthesized
atgcctgtaatcccagcacttt

SEQ ID NO: 1129304 - DNA, 22 bp, Artificial Sequence
  chemically synthesized
taatcccagcactttgggaggc

SEQ ID NO: 1129305 - DNA, 22 bp, Artificial Sequence
  chemically synthesized
gtgatccacccacttcagcctc

SEQ ID NO: 1129306 - DNA, 22 bp, Artificial Sequence
  chemically synthesized
acctcgtgatccacccacttca

SEQ ID NO: 1129307 - DNA, 22 bp, Artificial Sequence
  chemically synthesized
ctgacctcgtgatccacccact

SEQ ID NO: 1129308 - DNA, 22 bp, Artificial Sequence
  chemically synthesized
tgggaggctgaagtgggtggat

SEQ ID NO: 1129309 - DNA, 22 bp, Artificial Sequence
  chemically synthesized
gggaggctgaagtgggtggatc

SEQ ID NO: 1129310 - DNA, 22 bp, Artificial Sequence
  chemically synthesized
ggaggctgaagtgggtggatca

SEQ ID NO: 1129311 - DNA, 22 bp, Artificial Sequence
  chemically synthesized
agctcctgacctcgtgatccac

SEQ ID NO: 1129312 - DNA, 22 bp, Artificial Sequence
  chemically synthesized
gagctcctgacctcgtgatcca

SEQ ID NO: 1129313 - DNA, 22 bp, Artificial Sequence
  chemically synthesized
aagtgggtggatcacgaggtca

SEQ ID NO: 1129314 - DNA, 22 bp, Artificial Sequence
  chemically synthesized
gtcttgagctcctgacctcgtg

SEQ ID NO: 1129315 - DNA, 22 bp, Artificial Sequence
  chemically synthesized
gccaggctggtcttgagctcct

SEQ ID NO: 1129316 - DNA, 22 bp, Artificial Sequence
  chemically synthesized
ggccaggctggtcttgagctcc

SEQ ID NO: 1129317 - DNA, 22 bp, Artificial Sequence
  chemically synthesized
accatcttggccaggctggtct

SEQ ID NO: 1129318 - DNA, 22 bp, Artificial Sequence
  chemically synthesized
caccatcttggccaggctggtc

SEQ ID NO: 1129319 - DNA, 22 bp, Artificial Sequence
  chemically synthesized
aagaccagcctggccaagatgg

SEQ ID NO: 1129320 - DNA, 22 bp, Artificial Sequence
  chemically synthesized
gtagagacagggtttcaccatc

SEQ ID NO: 1129321 - DNA, 22 bp, Artificial Sequence
  chemically synthesized
agtagagacagggtttcaccat

SEQ ID NO: 1129322 - DNA, 22 bp, Artificial Sequence
  chemically synthesized
tagtagagacagggtttcacca

SEQ ID NO: 1129323 - DNA, 22 bp, Artificial Sequence
  chemically synthesized
ttagtagagacagggtttcacc

SEQ ID NO: 1129324 - DNA, 22 bp, Artificial Sequence
  chemically synthesized
tttagtagagacagggtttcac

SEQ ID NO: 1129325 - DNA, 22 bp, Artificial Sequence
  chemically synthesized
gccaagatggtgaaaccctgtc

SEQ ID NO: 1129326 - DNA, 22 bp, Artificial Sequence
  chemically synthesized
tattttttagtagagacagggt

SEQ ID NO: 1129327 - DNA, 22 bp, Artificial Sequence
  chemically synthesized
gtattttttagtagagacaggg

SEQ ID NO: 1129328 - DNA, 22 bp, Artificial Sequence
  chemically synthesized
tgtattttttagtagagacagg

SEQ ID NO: 1129329 - DNA, 22 bp, Artificial Sequence
  chemically synthesized
ttgtattttttagtagagacag

SEQ ID NO: 1129330 - DNA, 22 bp, Artificial Sequence
  chemically synthesized
tttgtattttttagtagagaca

SEQ ID NO: 1129331 - DNA, 22 bp, Artificial Sequence
  chemically synthesized
ttttgtattttttagtagagac

SEQ ID NO: 1129332 - DNA, 22 bp, Artificial Sequence
  chemically synthesized
tttttgtattttttagtagaga

SEQ ID NO: 1129333 - DNA, 22 bp, Artificial Sequence
  chemically synthesized
attttttttgtattttttagta

SEQ ID NO: 1129334 - DNA, 22 bp, Artificial Sequence
  chemically synthesized
tctctactaaaaaatacaaaaa

SEQ ID NO: 1129335 - DNA, 22 bp, Artificial Sequence
  chemically synthesized
tactaaaaaatacaaaaaaaat

SEQ ID NO: 1129336 - DNA, 22 bp, Artificial Sequence
  chemically synthesized
ctaaaaaatacaaaaaaaatta

SEQ ID NO: 1129337 - DNA, 22 bp, Artificial Sequence
  chemically synthesized
caccacatccggctaatttttt

SEQ ID NO: 1129338 - DNA, 22 bp, Artificial Sequence
  chemically synthesized
aaaaatacaaaaaaaattagcc

SEQ ID NO: 1129339 - DNA, 22 bp, Artificial Sequence
  chemically synthesized
caggcaccctccaccacatccg

SEQ ID NO: 1129340 - DNA, 22 bp, Artificial Sequence
  chemically synthesized
gaattacaggcaccctccacca

SEQ ID NO: 1129341 - DNA, 22 bp, Artificial Sequence
  chemically synthesized
gccggatgtggtggagggtgcc

SEQ ID NO: 1129342 - DNA, 22 bp, Artificial Sequence
  chemically synthesized
ccgagtagctggaattacaggc

SEQ ID NO: 1129343 - DNA, 22 bp, Artificial Sequence
  chemically synthesized
aacctcccgagtagctggaatt

SEQ ID NO: 1129344 - DNA, 22 bp, Artificial Sequence
  chemically synthesized
cctcaacctcccgagtagctgg

SEQ ID NO: 1129345 - DNA, 22 bp, Artificial Sequence
  chemically synthesized
tgcctcaacctcccgagtagct

SEQ ID NO: 1129346 - DNA, 22 bp, Artificial Sequence
  chemically synthesized
tctgcctcaacctcccgagtag

SEQ ID NO: 1129347 - DNA, 22 bp, Artificial Sequence
  chemically synthesized
taattccagctactcgggaggt

SEQ ID NO: 1129348 - DNA, 22 bp, Artificial Sequence
  chemically synthesized
cagctactcgggaggttgaggc

SEQ ID NO: 1129349 - DNA, 22 bp, Artificial Sequence
  chemically synthesized
aagcaattctctgcctcaacct

SEQ ID NO: 1129350 - DNA, 22 bp, Artificial Sequence
  chemically synthesized
caagcaattctctgcctcaacc

SEQ ID NO: 1129351 - DNA, 22 bp, Artificial Sequence
  chemically synthesized
gtttcaagcaattctctgcctc

SEQ ID NO: 1129352 - DNA, 22 bp, Artificial Sequence
  chemically synthesized
ctcgggaggttgaggcagagaa

SEQ ID NO: 1129353 - DNA, 22 bp, Artificial Sequence
  chemically synthesized
ctggtttcaagcaattctctgc

SEQ ID NO: 1129354 - DNA, 22 bp, Artificial Sequence
  chemically synthesized
gggaggttgaggcagagaattg

SEQ ID NO: 1129355 - DNA, 22 bp, Artificial Sequence
  chemically synthesized
cgcctcctggtttcaagcaatt

SEQ ID NO: 1129356 - DNA, 22 bp, Artificial Sequence
  chemically synthesized
aggcagagaattgcttgaaacc

SEQ ID NO: 1129357 - DNA, 22 bp, Artificial Sequence
  chemically synthesized
caacctccgcctcctggtttca

SEQ ID NO: 1129358 - DNA, 22 bp, Artificial Sequence
  chemically synthesized
ctgcaacctccgcctcctggtt

SEQ ID NO: 1129359 - DNA, 22 bp, Artificial Sequence
  chemically synthesized
actgcaacctccgcctcctggt

SEQ ID NO: 1129360 - DNA, 22 bp, Artificial Sequence
  chemically synthesized
agcttactgcaacctccgcctc

SEQ ID NO: 1129361 - DNA, 22 bp, Artificial Sequence
  chemically synthesized
cttgaaaccaggaggcggaggt

SEQ ID NO: 1129362 - DNA, 22 bp, Artificial Sequence
  chemically synthesized
gaaaccaggaggcggaggttgc

SEQ ID NO: 1129363 - DNA, 22 bp, Artificial Sequence
  chemically synthesized
aaaccaggaggcggaggttgca

SEQ ID NO: 1129364 - DNA, 22 bp, Artificial Sequence
  chemically synthesized
gagtgcagtggcgggatctcag

SEQ ID NO: 1129365 - DNA, 22 bp, Artificial Sequence
  chemically synthesized
cagtaagctgagatcccgccac

SEQ ID NO: 1129366 - DNA, 22 bp, Artificial Sequence
  chemically synthesized
tcacccaggctggagtgcagtg

SEQ ID NO: 1129367 - DNA, 22 bp, Artificial Sequence
  chemically synthesized
tgtcacccaggctggagtgcag

SEQ ID NO: 1129368 - DNA, 22 bp, Artificial Sequence
  chemically synthesized
agatcccgccactgcactccag

SEQ ID NO: 1129369 - DNA, 22 bp, Artificial Sequence
  chemically synthesized
ctctgtcacccaggctggagtg

SEQ ID NO: 1129370 - DNA, 22 bp, Artificial Sequence
  chemically synthesized
gctctgtcacccaggctggagt

SEQ ID NO: 1129371 - DNA, 22 bp, Artificial Sequence
  chemically synthesized
cactccagcctgggtgacagag

SEQ ID NO: 1129372 - DNA, 22 bp, Artificial Sequence
  chemically synthesized
agacagtgtcttgctctgtcac

SEQ ID NO: 1129373 - DNA, 22 bp, Artificial Sequence
  chemically synthesized
gagacagtgtcttgctctgtca

SEQ ID NO: 1129374 - DNA, 22 bp, Artificial Sequence
  chemically synthesized
tgagacagtgtcttgctctgtc

SEQ ID NO: 1129375 - DNA, 22 bp, Artificial Sequence
  chemically synthesized
cagcctgggtgacagagcaaga

SEQ ID NO: 1129376 - DNA, 22 bp, Artificial Sequence
  chemically synthesized
ttttgagacagtgtcttgctct

SEQ ID NO: 1129377 - DNA, 22 bp, Artificial Sequence
  chemically synthesized
attttgagacagtgtcttgctc

SEQ ID NO: 1129378 - DNA, 22 bp, Artificial Sequence
  chemically synthesized
tattttgagacagtgtcttgct

SEQ ID NO: 1129379 - DNA, 22 bp, Artificial Sequence
  chemically synthesized
ttattttgagacagtgtcttgc

SEQ ID NO: 1129380 - DNA, 22 bp, Artificial Sequence
  chemically synthesized
ttttattttgagacagtgtctt

SEQ ID NO: 1129381 - DNA, 22 bp, Artificial Sequence
  chemically synthesized
ggtgacagagcaagacactgtc

SEQ ID NO: 1129382 - DNA, 22 bp, Artificial Sequence
  chemically synthesized
cttttattttgagacagtgtct

SEQ ID NO: 1129383 - DNA, 22 bp, Artificial Sequence
  chemically synthesized
acttcttttattttgagacagt

SEQ ID NO: 1129384 - DNA, 22 bp, Artificial Sequence
  chemically synthesized
tgacttcttttattttgagaca

SEQ ID NO: 1129385 - DNA, 22 bp, Artificial Sequence
  chemically synthesized
ctgacttcttttattttgagac

SEQ ID NO: 1129386 - DNA, 22 bp, Artificial Sequence
  chemically synthesized
tctgacttcttttattttgaga

SEQ ID NO: 1129387 - DNA, 22 bp, Artificial Sequence
  chemically synthesized
cctttctgacttcttttatttt

SEQ ID NO: 1129388 - DNA, 22 bp, Artificial Sequence
  chemically synthesized
gcctttctgacttcttttattt

SEQ ID NO: 1129389 - DNA, 22 bp, Artificial Sequence
  chemically synthesized
tgcctttctgacttcttttatt

SEQ ID NO: 1129390 - DNA, 22 bp, Artificial Sequence
  chemically synthesized
tttgcctttctgacttctttta

SEQ ID NO: 1129391 - DNA, 22 bp, Artificial Sequence
  chemically synthesized
tctcaaaataaaagaagtcaga

SEQ ID NO: 1129392 - DNA, 22 bp, Artificial Sequence
  chemically synthesized
aaaataaaagaagtcagaaagg

SEQ ID NO: 1129393 - DNA, 22 bp, Artificial Sequence
  chemically synthesized
tgggagtatcacacagatccat

SEQ ID NO: 1129394 - DNA, 22 bp, Artificial Sequence
  chemically synthesized
ctatgggagtatcacacagatc

SEQ ID NO: 1129395 - DNA, 22 bp, Artificial Sequence
  chemically synthesized
ttcctatgggagtatcacacag

SEQ ID NO: 1129396 - DNA, 22 bp, Artificial Sequence
  chemically synthesized
attcctatgggagtatcacaca

SEQ ID NO: 1129397 - DNA, 22 bp, Artificial Sequence
  chemically synthesized
ccttattcctatgggagtatca

SEQ ID NO: 1129398 - DNA, 22 bp, Artificial Sequence
  chemically synthesized
tgccttattcctatgggagtat

SEQ ID NO: 1129399 - DNA, 22 bp, Artificial Sequence
  chemically synthesized
ctgccttattcctatgggagta

SEQ ID NO: 1129400 - DNA, 22 bp, Artificial Sequence
  chemically synthesized
cttctgccttattcctatggga

SEQ ID NO: 1129401 - DNA, 22 bp, Artificial Sequence
  chemically synthesized
ttccttctgccttattcctatg

SEQ ID NO: 1129402 - DNA, 22 bp, Artificial Sequence
  chemically synthesized
tgtgatactcccataggaataa

SEQ ID NO: 1129403 - DNA, 22 bp, Artificial Sequence
  chemically synthesized
attccttctgccttattcctat

SEQ ID NO: 1129404 - DNA, 22 bp, Artificial Sequence
  chemically synthesized
tattccttctgccttattccta

SEQ ID NO: 1129405 - DNA, 22 bp, Artificial Sequence
  chemically synthesized
ttttattccttctgccttattc

SEQ ID NO: 1129406 - DNA, 22 bp, Artificial Sequence
  chemically synthesized
gttttattccttctgccttatt

SEQ ID NO: 1129407 - DNA, 22 bp, Artificial Sequence
  chemically synthesized
acttgttttattccttctgcct

SEQ ID NO: 1129408 - DNA, 22 bp, Artificial Sequence
  chemically synthesized
ccataggaataaggcagaagga

SEQ ID NO: 1129409 - DNA, 22 bp, Artificial Sequence
  chemically synthesized
cctgacttgttttattccttct

SEQ ID NO: 1129410 - DNA, 22 bp, Artificial Sequence
  chemically synthesized
acctgacttgttttattccttc

SEQ ID NO: 1129411 - DNA, 22 bp, Artificial Sequence
  chemically synthesized
tacctgacttgttttattcctt

SEQ ID NO: 1129412 - DNA, 22 bp, Artificial Sequence
  chemically synthesized
tttacctgacttgttttattcc

SEQ ID NO: 1129413 - DNA, 22 bp, Artificial Sequence
  chemically synthesized
tcacccacgactctttacctga

SEQ ID NO: 1129414 - DNA, 22 bp, Artificial Sequence
  chemically synthesized
ccagttgtcacccacgactctt

SEQ ID NO: 1129415 - DNA, 22 bp, Artificial Sequence
  chemically synthesized
tgacacactaccagttgtcacc

SEQ ID NO: 1129416 - DNA, 22 bp, Artificial Sequence
  chemically synthesized
tgtgacacactaccagttgtca

SEQ ID NO: 1129417 - DNA, 22 bp, Artificial Sequence
  chemically synthesized
ctgtgacacactaccagttgtc

SEQ ID NO: 1129418 - DNA, 22 bp, Artificial Sequence
  chemically synthesized
cagcttctgtgacacactacca

SEQ ID NO: 1129419 - DNA, 22 bp, Artificial Sequence
  chemically synthesized
ccagcttctgtgacacactacc

SEQ ID NO: 1129420 - DNA, 22 bp, Artificial Sequence
  chemically synthesized
ttccagcttctgtgacacacta

SEQ ID NO: 1129421 - DNA, 22 bp, Artificial Sequence
  chemically synthesized
gtagtgtgtcacagaagctgga

SEQ ID NO: 1129422 - DNA, 22 bp, Artificial Sequence
  chemically synthesized
aatgatgtcctcttccagcttc

SEQ ID NO: 1129423 - DNA, 22 bp, Artificial Sequence
  chemically synthesized
aaatgatgtcctcttccagctt

SEQ ID NO: 1129424 - DNA, 22 bp, Artificial Sequence
  chemically synthesized
tttaaatgatgtcctcttccag

SEQ ID NO: 1129425 - DNA, 22 bp, Artificial Sequence
  chemically synthesized
atttaaatgatgtcctcttcca

SEQ ID NO: 1129426 - DNA, 22 bp, Artificial Sequence
  chemically synthesized
tatttaaatgatgtcctcttcc

SEQ ID NO: 1129427 - DNA, 22 bp, Artificial Sequence
  chemically synthesized
aatagtgttttatttaaatgat

SEQ ID NO: 1129428 - DNA, 22 bp, Artificial Sequence
  chemically synthesized
gaagaggacatcatttaaataa

SEQ ID NO: 1129429 - DNA, 22 bp, Artificial Sequence
  chemically synthesized
ttgaatagtgttttatttaaat

SEQ ID NO: 1129430 - DNA, 22 bp, Artificial Sequence
  chemically synthesized
accatctgttgaatagtgtttt

SEQ ID NO: 1129431 - DNA, 22 bp, Artificial Sequence
  chemically synthesized
gaccatctgttgaatagtgttt

SEQ ID NO: 1129432 - DNA, 22 bp, Artificial Sequence
  chemically synthesized
aaataaaacactattcaacaga

SEQ ID NO: 1129433 - DNA, 22 bp, Artificial Sequence
  chemically synthesized
aggtcttgaccatctgttgaat

SEQ ID NO: 1129434 - DNA, 22 bp, Artificial Sequence
  chemically synthesized
aataaaacactattcaacagat

SEQ ID NO: 1129435 - DNA, 22 bp, Artificial Sequence
  chemically synthesized
aatattgaggtcttgaccatct

SEQ ID NO: 1129436 - DNA, 22 bp, Artificial Sequence
  chemically synthesized
actgaatattgaggtcttgacc

SEQ ID NO: 1129437 - DNA, 22 bp, Artificial Sequence
  chemically synthesized
cactgaatattgaggtcttgac

SEQ ID NO: 1129438 - DNA, 22 bp, Artificial Sequence
  chemically synthesized
ttcaacagatggtcaagacctc

SEQ ID NO: 1129439 - DNA, 22 bp, Artificial Sequence
  chemically synthesized
aacagatggtcaagacctcaat

SEQ ID NO: 1129440 - DNA, 22 bp, Artificial Sequence
  chemically synthesized
atatttcactgaatattgaggt

SEQ ID NO: 1129441 - DNA, 22 bp, Artificial Sequence
  chemically synthesized
aagcccactaatatttcactga

SEQ ID NO: 1129442 - DNA, 22 bp, Artificial Sequence
  chemically synthesized
aatattcagtgaaatattagtg

SEQ ID NO: 1129443 - DNA, 22 bp, Artificial Sequence
  chemically synthesized
tatcatctgaagcccactaata

SEQ ID NO: 1129444 - DNA, 22 bp, Artificial Sequence
  chemically synthesized
gtatcatctgaagcccactaat

SEQ ID NO: 1129445 - DNA, 22 bp, Artificial Sequence
  chemically synthesized
tgtatcatctgaagcccactaa

SEQ ID NO: 1129446 - DNA, 22 bp, Artificial Sequence
  chemically synthesized
ttgtatcatctgaagcccacta

SEQ ID NO: 1129447 - DNA, 22 bp, Artificial Sequence
  chemically synthesized
agtgaaatattagtgggcttca

SEQ ID NO: 1129448 - DNA, 22 bp, Artificial Sequence
  chemically synthesized
gtgccccgtttttgtatcatct

SEQ ID NO: 1129449 - DNA, 22 bp, Artificial Sequence
  chemically synthesized
gtgggcttcagatgatacaaaa

SEQ ID NO: 1129450 - DNA, 22 bp, Artificial Sequence
  chemically synthesized
gctagtgccccgtttttgtatc

SEQ ID NO: 1129451 - DNA, 22 bp, Artificial Sequence
  chemically synthesized
tattagctagtgccccgttttt

SEQ ID NO: 1129452 - DNA, 22 bp, Artificial Sequence
  chemically synthesized
atattagctagtgccccgtttt

SEQ ID NO: 1129453 - DNA, 22 bp, Artificial Sequence
  chemically synthesized
cagatgatacaaaaacggggca

SEQ ID NO: 1129454 - DNA, 22 bp, Artificial Sequence
  chemically synthesized
tatattagctagtgccccgttt

SEQ ID NO: 1129455 - DNA, 22 bp, Artificial Sequence
  chemically synthesized
agatgatacaaaaacggggcac

SEQ ID NO: 1129456 - DNA, 22 bp, Artificial Sequence
  chemically synthesized
gctaatataaagcttatggtta

SEQ ID NO: 1129457 - DNA, 22 bp, Artificial Sequence
  chemically synthesized
atataaagcttatggttatatt

SEQ ID NO: 1129458 - DNA, 22 bp, Artificial Sequence
  chemically synthesized
aagaggcatcatgcaaatataa

SEQ ID NO: 1129459 - DNA, 22 bp, Artificial Sequence
  chemically synthesized
atggttatatttgcatgatgcc

SEQ ID NO: 1129460 - DNA, 22 bp, Artificial Sequence
  chemically synthesized
tggttatatttgcatgatgcct

SEQ ID NO: 1129461 - DNA, 22 bp, Artificial Sequence
  chemically synthesized
taatgattaaagaggcatcatg

SEQ ID NO: 1129462 - DNA, 22 bp, Artificial Sequence
  chemically synthesized
tatttgcatgatgcctctttaa

SEQ ID NO: 1129463 - DNA, 22 bp, Artificial Sequence
  chemically synthesized
aagtattgtaatgattaaagag

SEQ ID NO: 1129464 - DNA, 22 bp, Artificial Sequence
  chemically synthesized
gcatgatgcctctttaatcatt

SEQ ID NO: 1129465 - DNA, 22 bp, Artificial Sequence
  chemically synthesized
ttaaagtattgtaatgattaaa

SEQ ID NO: 1129466 - DNA, 22 bp, Artificial Sequence
  chemically synthesized
catgatgcctctttaatcatta

SEQ ID NO: 1129467 - DNA, 22 bp, Artificial Sequence
  chemically synthesized
gttaaagtattgtaatgattaa

SEQ ID NO: 1129468 - DNA, 22 bp, Artificial Sequence
  chemically synthesized
tttaatcattacaatactttaa

SEQ ID NO: 1129469 - DNA, 22 bp, Artificial Sequence
  chemically synthesized
taatcattacaatactttaaca

SEQ ID NO: 1129470 - DNA, 22 bp, Artificial Sequence
  chemically synthesized
aatcattacaatactttaacaa

SEQ ID NO: 1129471 - DNA, 22 bp, Artificial Sequence
  chemically synthesized
cagggtggaatcttgttaaagt

SEQ ID NO: 1129472 - DNA, 22 bp, Artificial Sequence
  chemically synthesized
atcattacaatactttaacaag

SEQ ID NO: 1129473 - DNA, 22 bp, Artificial Sequence
  chemically synthesized
tctacagggtggaatcttgtta

SEQ ID NO: 1129474 - DNA, 22 bp, Artificial Sequence
  chemically synthesized
caatactttaacaagattccac

SEQ ID NO: 1129475 - DNA, 22 bp, Artificial Sequence
  chemically synthesized
ataattgtctacagggtggaat

SEQ ID NO: 1129476 - DNA, 22 bp, Artificial Sequence
  chemically synthesized
attgataattgtctacagggtg

SEQ ID NO: 1129477 - DNA, 22 bp, Artificial Sequence
  chemically synthesized
taacaagattccaccctgtaga

SEQ ID NO: 1129478 - DNA, 22 bp, Artificial Sequence
  chemically synthesized
aacaagattccaccctgtagac

SEQ ID NO: 1129479 - DNA, 22 bp, Artificial Sequence
  chemically synthesized
acaagattccaccctgtagaca

SEQ ID NO: 1129480 - DNA, 22 bp, Artificial Sequence
  chemically synthesized
attaattgataattgtctacag

SEQ ID NO: 1129481 - DNA, 22 bp, Artificial Sequence
  chemically synthesized
caccctgtagacaattatcaat

SEQ ID NO: 1129482 - DNA, 22 bp, Artificial Sequence
  chemically synthesized
ggaacaaattcattaattgata

SEQ ID NO: 1129483 - DNA, 22 bp, Artificial Sequence
  chemically synthesized
aggaacaaattcattaattgat

SEQ ID NO: 1129484 - DNA, 22 bp, Artificial Sequence
  chemically synthesized
tagacaattatcaattaatgaa

SEQ ID NO: 1129485 - DNA, 22 bp, Artificial Sequence
  chemically synthesized
tcaattaatgaatttgttccta

SEQ ID NO: 1129486 - DNA, 22 bp, Artificial Sequence
  chemically synthesized
atgaatttgttcctaaatgttt

SEQ ID NO: 1129487 - DNA, 22 bp, Artificial Sequence
  chemically synthesized
gttcctaaatgtttgccttttt

SEQ ID NO: 1129488 - DNA, 22 bp, Artificial Sequence
  chemically synthesized
aacgaagatagcaaaaaggcaa

SEQ ID NO: 1129489 - DNA, 22 bp, Artificial Sequence
  chemically synthesized
ttcctaaatgtttgcctttttg

SEQ ID NO: 1129490 - DNA, 22 bp, Artificial Sequence
  chemically synthesized
ctaaatgtttgcctttttgcta

SEQ ID NO: 1129491 - DNA, 22 bp, Artificial Sequence
  chemically synthesized
gactgaacgaagatagcaaaaa

SEQ ID NO: 1129492 - DNA, 22 bp, Artificial Sequence
  chemically synthesized
agactgaacgaagatagcaaaa

SEQ ID NO: 1129493 - DNA, 22 bp, Artificial Sequence
  chemically synthesized
aatgtttgcctttttgctatct

SEQ ID NO: 1129494 - DNA, 22 bp, Artificial Sequence
  chemically synthesized
gcctttttgctatcttcgttca

SEQ ID NO: 1129495 - DNA, 22 bp, Artificial Sequence
  chemically synthesized
ataaatttagactgaacgaaga

SEQ ID NO: 1129496 - DNA, 22 bp, Artificial Sequence
  chemically synthesized
cctttttgctatcttcgttcag

SEQ ID NO: 1129497 - DNA, 22 bp, Artificial Sequence
  chemically synthesized
attgataaatttagactgaacg

SEQ ID NO: 1129498 - DNA, 22 bp, Artificial Sequence
  chemically synthesized
tttgctatcttcgttcagtcta

SEQ ID NO: 1129499 - DNA, 22 bp, Artificial Sequence
  chemically synthesized
gattgataaatttagactgaac

SEQ ID NO: 1129500 - DNA, 22 bp, Artificial Sequence
  chemically synthesized
ttgctatcttcgttcagtctaa

SEQ ID NO: 1129501 - DNA, 22 bp, Artificial Sequence
  chemically synthesized
tgctatcttcgttcagtctaaa

SEQ ID NO: 1129502 - DNA, 22 bp, Artificial Sequence
  chemically synthesized
gctatcttcgttcagtctaaat

SEQ ID NO: 1129503 - DNA, 22 bp, Artificial Sequence
  chemically synthesized
ctatcttcgttcagtctaaatt

SEQ ID NO: 1129504 - DNA, 22 bp, Artificial Sequence
  chemically synthesized
tcttcgttcagtctaaatttat

SEQ ID NO: 1129505 - DNA, 22 bp, Artificial Sequence
  chemically synthesized
cgttcagtctaaatttatcaat

SEQ ID NO: 1129506 - DNA, 22 bp, Artificial Sequence
  chemically synthesized
gttcagtctaaatttatcaatc

SEQ ID NO: 1129507 - DNA, 22 bp, Artificial Sequence
  chemically synthesized
tatacgacacttgattgataaa

SEQ ID NO: 1129508 - DNA, 22 bp, Artificial Sequence
  chemically synthesized
agtctaaatttatcaatcaagt

SEQ ID NO: 1129509 - DNA, 22 bp, Artificial Sequence
  chemically synthesized
aacacgctatatacgacacttg

SEQ ID NO: 1129510 - DNA, 22 bp, Artificial Sequence
  chemically synthesized
aatttatcaatcaagtgtcgta

SEQ ID NO: 1129511 - DNA, 22 bp, Artificial Sequence
  chemically synthesized
tctgaacacgctatatacgaca

SEQ ID NO: 1129512 - DNA, 22 bp, Artificial Sequence
  chemically synthesized
atcaatcaagtgtcgtatatag

SEQ ID NO: 1129513 - DNA, 22 bp, Artificial Sequence
  chemically synthesized
tcaatcaagtgtcgtatatagc

SEQ ID NO: 1129514 - DNA, 22 bp, Artificial Sequence
  chemically synthesized
gacggcaaaattatctgaacac

SEQ ID NO: 1129515 - DNA, 22 bp, Artificial Sequence
  chemically synthesized
ggacggcaaaattatctgaaca

SEQ ID NO: 1129516 - DNA, 22 bp, Artificial Sequence
  chemically synthesized
atttggacggcaaaattatctg

SEQ ID NO: 1129517 - DNA, 22 bp, Artificial Sequence
  chemically synthesized
aagtgtgtcctgatttggacgg

SEQ ID NO: 1129518 - DNA, 22 bp, Artificial Sequence
  chemically synthesized
agataattttgccgtccaaatc

SEQ ID NO: 1129519 - DNA, 22 bp, Artificial Sequence
  chemically synthesized
tcaagtgtgtcctgatttggac

SEQ ID NO: 1129520 - DNA, 22 bp, Artificial Sequence
  chemically synthesized
actctcaagtgtgtcctgattt

SEQ ID NO: 1129521 - DNA, 22 bp, Artificial Sequence
  chemically synthesized
cactctcaagtgtgtcctgatt

SEQ ID NO: 1129522 - DNA, 22 bp, Artificial Sequence
  chemically synthesized
tcactctcaagtgtgtcctgat

SEQ ID NO: 1129523 - DNA, 22 bp, Artificial Sequence
  chemically synthesized
tgccgtccaaatcaggacacac

SEQ ID NO: 1129524 - DNA, 22 bp, Artificial Sequence
  chemically synthesized
gccgtccaaatcaggacacact

SEQ ID NO: 1129525 - DNA, 22 bp, Artificial Sequence
  chemically synthesized
ccgtccaaatcaggacacactt

SEQ ID NO: 1129526 - DNA, 22 bp, Artificial Sequence
  chemically synthesized
tatatagcatcaactttcactc

SEQ ID NO: 1129527 - DNA, 22 bp, Artificial Sequence
  chemically synthesized
gagagtgaaagttgatgctata

SEQ ID NO: 1129528 - DNA, 22 bp, Artificial Sequence
  chemically synthesized
agagtgaaagttgatgctatat

SEQ ID NO: 1129529 - DNA, 22 bp, Artificial Sequence
  chemically synthesized
tcccagcataattatatatagc

SEQ ID NO: 1129530 - DNA, 22 bp, Artificial Sequence
  chemically synthesized
ttgtcccagcataattatatat

SEQ ID NO: 1129531 - DNA, 22 bp, Artificial Sequence
  chemically synthesized
cacctgttgtcccagcataatt

SEQ ID NO: 1129532 - DNA, 22 bp, Artificial Sequence
  chemically synthesized
atgctatatataattatgctgg

SEQ ID NO: 1129533 - DNA, 22 bp, Artificial Sequence
  chemically synthesized
tatataattatgctgggacaac

SEQ ID NO: 1129534 - DNA, 22 bp, Artificial Sequence
  chemically synthesized
aagccatcccagttacacctgt

SEQ ID NO: 1129535 - DNA, 22 bp, Artificial Sequence
  chemically synthesized
tgctgggacaacaggtgtaact

SEQ ID NO: 1129536 - DNA, 22 bp, Artificial Sequence
  chemically synthesized
cctgaagccatcccagttacac

SEQ ID NO: 1129537 - DNA, 22 bp, Artificial Sequence
  chemically synthesized
acctgaagccatcccagttaca

SEQ ID NO: 1129538 - DNA, 22 bp, Artificial Sequence
  chemically synthesized
ggacaacaggtgtaactgggat

SEQ ID NO: 1129539 - DNA, 22 bp, Artificial Sequence
  chemically synthesized
atttacctgaagccatcccagt

SEQ ID NO: 1129540 - DNA, 22 bp, Artificial Sequence
  chemically synthesized
ttgatttacctgaagccatccc

SEQ ID NO: 1129541 - DNA, 22 bp, Artificial Sequence
  chemically synthesized
aggtaatcctattgatttacct

SEQ ID NO: 1129542 - DNA, 22 bp, Artificial Sequence
  chemically synthesized
ggatggcttcaggtaaatcaat

SEQ ID NO: 1129543 - DNA, 22 bp, Artificial Sequence
  chemically synthesized
caggtaaatcaataggattacc

SEQ ID NO: 1129544 - DNA, 22 bp, Artificial Sequence
  chemically synthesized
aggtaaatcaataggattacct

SEQ ID NO: 1129545 - DNA, 22 bp, Artificial Sequence
  chemically synthesized
atagatatatgactaaggtaat

SEQ ID NO: 1129546 - DNA, 22 bp, Artificial Sequence
  chemically synthesized
catagatatatgactaaggtaa

SEQ ID NO: 1129547 - DNA, 22 bp, Artificial Sequence
  chemically synthesized
tcatagatatatgactaaggta

SEQ ID NO: 1129548 - DNA, 22 bp, Artificial Sequence
  chemically synthesized
ttcatagatatatgactaaggt

SEQ ID NO: 1129549 - DNA, 22 bp, Artificial Sequence
  chemically synthesized
tttcatagatatatgactaagg

SEQ ID NO: 1129550 - DNA, 22 bp, Artificial Sequence
  chemically synthesized
ccttagtcatatatctatgaaa

SEQ ID NO: 1129551 - DNA, 22 bp, Artificial Sequence
  chemically synthesized
agtcatatatctatgaaaaaga

SEQ ID NO: 1129552 - DNA, 22 bp, Artificial Sequence
  chemically synthesized
tatagtaaaatgtctttttcat

SEQ ID NO: 1129553 - DNA, 22 bp, Artificial Sequence
  chemically synthesized
gtcatatatctatgaaaaagac

SEQ ID NO: 1129554 - DNA, 22 bp, Artificial Sequence
  chemically synthesized
ggctgtatagtaaaatgtcttt

SEQ ID NO: 1129555 - DNA, 22 bp, Artificial Sequence
  chemically synthesized
tgaaaaagacattttactatac

SEQ ID NO: 1129556 - DNA, 22 bp, Artificial Sequence
  chemically synthesized
caaaacctgggctgtatagtaa

SEQ ID NO: 1129557 - DNA, 22 bp, Artificial Sequence
  chemically synthesized
aggtagctacaaaacctgggct

SEQ ID NO: 1129558 - DNA, 22 bp, Artificial Sequence
  chemically synthesized
tactatacagcccaggttttgt

SEQ ID NO: 1129559 - DNA, 22 bp, Artificial Sequence
  chemically synthesized
actatacagcccaggttttgta

SEQ ID NO: 1129560 - DNA, 22 bp, Artificial Sequence
  chemically synthesized
aactgaggtagctacaaaacct

SEQ ID NO: 1129561 - DNA, 22 bp, Artificial Sequence
  chemically synthesized
ctatacagcccaggttttgtag

SEQ ID NO: 1129562 - DNA, 22 bp, Artificial Sequence
  chemically synthesized
gaactgaggtagctacaaaacc

SEQ ID NO: 1129563 - DNA, 22 bp, Artificial Sequence
  chemically synthesized
tacagcccaggttttgtagcta

SEQ ID NO: 1129564 - DNA, 22 bp, Artificial Sequence
  chemically synthesized
agacaggatttgaactgaggta

SEQ ID NO: 1129565 - DNA, 22 bp, Artificial Sequence
  chemically synthesized
tgtagctacctcagttcaaatc

SEQ ID NO: 1129566 - DNA, 22 bp, Artificial Sequence
  chemically synthesized
gtagctacctcagttcaaatcc

SEQ ID NO: 1129567 - DNA, 22 bp, Artificial Sequence
  chemically synthesized
tagctacctcagttcaaatcct

SEQ ID NO: 1129568 - DNA, 22 bp, Artificial Sequence
  chemically synthesized
cagtgtacctcagacaggattt

SEQ ID NO: 1129569 - DNA, 22 bp, Artificial Sequence
  chemically synthesized
cctcagttcaaatcctgtctga

SEQ ID NO: 1129570 - DNA, 22 bp, Artificial Sequence
  chemically synthesized
agttcaaatcctgtctgaggta

SEQ ID NO: 1129571 - DNA, 22 bp, Artificial Sequence
  chemically synthesized
tacacagctacagtgtacctca

SEQ ID NO: 1129572 - DNA, 22 bp, Artificial Sequence
  chemically synthesized
aaatcctgtctgaggtacactg

SEQ ID NO: 1129573 - DNA, 22 bp, Artificial Sequence
  chemically synthesized
taaaattatacacagctacagt

SEQ ID NO: 1129574 - DNA, 22 bp, Artificial Sequence
  chemically synthesized
ataaaattatacacagctacag

SEQ ID NO: 1129575 - DNA, 22 bp, Artificial Sequence
  chemically synthesized
tctgaggtacactgtagctgtg

SEQ ID NO: 1129576 - DNA, 22 bp, Artificial Sequence
  chemically synthesized
tataaaattatacacagctaca

SEQ ID NO: 1129577 - DNA, 22 bp, Artificial Sequence
  chemically synthesized
ctttataaaattatacacagct

SEQ ID NO: 1129578 - DNA, 22 bp, Artificial Sequence
  chemically synthesized
aggtacactgtagctgtgtata

SEQ ID NO: 1129579 - DNA, 22 bp, Artificial Sequence
  chemically synthesized
taattactttataaaattatac

SEQ ID NO: 1129580 - DNA, 22 bp, Artificial Sequence
  chemically synthesized
tagctgtgtataattttataaa

SEQ ID NO: 1129581 - DNA, 22 bp, Artificial Sequence
  chemically synthesized
tgtataattttataaagtaatt

SEQ ID NO: 1129582 - DNA, 22 bp, Artificial Sequence
  chemically synthesized
ccaaaataggtatggctataat

SEQ ID NO: 1129583 - DNA, 22 bp, Artificial Sequence
  chemically synthesized
tataaagtaattatagccatac

SEQ ID NO: 1129584 - DNA, 22 bp, Artificial Sequence
  chemically synthesized
ataaagtaattatagccatacc

SEQ ID NO: 1129585 - DNA, 22 bp, Artificial Sequence
  chemically synthesized
taaagtaattatagccatacct

SEQ ID NO: 1129586 - DNA, 22 bp, Artificial Sequence
  chemically synthesized
ccagtaacctcccaaaataggt

SEQ ID NO: 1129587 - DNA, 22 bp, Artificial Sequence
  chemically synthesized
cccagtaacctcccaaaatagg

SEQ ID NO: 1129588 - DNA, 22 bp, Artificial Sequence
  chemically synthesized
tcccagtaacctcccaaaatag

SEQ ID NO: 1129589 - DNA, 22 bp, Artificial Sequence
  chemically synthesized
ttcccagtaacctcccaaaata

SEQ ID NO: 1129590 - DNA, 22 bp, Artificial Sequence
  chemically synthesized
tagccatacctattttgggagg

SEQ ID NO: 1129591 - DNA, 22 bp, Artificial Sequence
  chemically synthesized
ttttgggaggttactgggaaaa

SEQ ID NO: 1129592 - DNA, 22 bp, Artificial Sequence
  chemically synthesized
gcatcgcatgtatttttcccag

SEQ ID NO: 1129593 - DNA, 22 bp, Artificial Sequence
  chemically synthesized
tgggaggttactgggaaaaata

SEQ ID NO: 1129594 - DNA, 22 bp, Artificial Sequence
  chemically synthesized
gggaggttactgggaaaaatac

SEQ ID NO: 1129595 - DNA, 22 bp, Artificial Sequence
  chemically synthesized
ttggcatcgcatgtatttttcc

SEQ ID NO: 1129596 - DNA, 22 bp, Artificial Sequence
  chemically synthesized
ggaggttactgggaaaaataca

SEQ ID NO: 1129597 - DNA, 22 bp, Artificial Sequence
  chemically synthesized
attggcatcgcatgtatttttc

SEQ ID NO: 1129598 - DNA, 22 bp, Artificial Sequence
  chemically synthesized
tattggcatcgcatgtattttt

SEQ ID NO: 1129599 - DNA, 22 bp, Artificial Sequence
  chemically synthesized
ctgggaaaaatacatgcgatgc

SEQ ID NO: 1129600 - DNA, 22 bp, Artificial Sequence
  chemically synthesized
agtgctttattggcatcgcatg

SEQ ID NO: 1129601 - DNA, 22 bp, Artificial Sequence
  chemically synthesized
ggaaaaatacatgcgatgccaa

SEQ ID NO: 1129602 - DNA, 22 bp, Artificial Sequence
  chemically synthesized
agtagtagattcagtgctttat

SEQ ID NO: 1129603 - DNA, 22 bp, Artificial Sequence
  chemically synthesized
tgtgctcagtagtagattcagt

SEQ ID NO: 1129604 - DNA, 22 bp, Artificial Sequence
  chemically synthesized
ttatgtgctcagtagtagattc

SEQ ID NO: 1129605 - DNA, 22 bp, Artificial Sequence
  chemically synthesized
attatgtgctcagtagtagatt

SEQ ID NO: 1129606 - DNA, 22 bp, Artificial Sequence
  chemically synthesized
aggatttattatgtgctcagta

SEQ ID NO: 1129607 - DNA, 22 bp, Artificial Sequence
  chemically synthesized
aatctactactgagcacataat

SEQ ID NO: 1129608 - DNA, 22 bp, Artificial Sequence
  chemically synthesized
acataaattgaggatttattat

SEQ ID NO: 1129609 - DNA, 22 bp, Artificial Sequence
  chemically synthesized
ctactgagcacataataaatcc

SEQ ID NO: 1129610 - DNA, 22 bp, Artificial Sequence
  chemically synthesized
ctgagcacataataaatcctca

SEQ ID NO: 1129611 - DNA, 22 bp, Artificial Sequence
  chemically synthesized
agcacataataaatcctcaatt

SEQ ID NO: 1129612 - DNA, 22 bp, Artificial Sequence
  chemically synthesized
aaataaaagctaacataaattg

SEQ ID NO: 1129613 - DNA, 22 bp, Artificial Sequence
  chemically synthesized
caaataaaagctaacataaatt

SEQ ID NO: 1129614 - DNA, 22 bp, Artificial Sequence
  chemically synthesized
ttcaaataaaagctaacataaa

SEQ ID NO: 1129615 - DNA, 22 bp, Artificial Sequence
  chemically synthesized
aatttatgttagcttttatttg

SEQ ID NO: 1129616 - DNA, 22 bp, Artificial Sequence
  chemically synthesized
atgttagcttttatttgaagaa

SEQ ID NO: 1129617 - DNA, 22 bp, Artificial Sequence
  chemically synthesized
tgttagcttttatttgaagaat

SEQ ID NO: 1129618 - DNA, 22 bp, Artificial Sequence
  chemically synthesized
ggcacatacagaaagattcttc

SEQ ID NO: 1129619 - DNA, 22 bp, Artificial Sequence
  chemically synthesized
gcttttatttgaagaatctttc

SEQ ID NO: 1129620 - DNA, 22 bp, Artificial Sequence
  chemically synthesized
ttatttgaagaatctttctgta

SEQ ID NO: 1129621 - DNA, 22 bp, Artificial Sequence
  chemically synthesized
tatttgaagaatctttctgtat

SEQ ID NO: 1129622 - DNA, 22 bp, Artificial Sequence
  chemically synthesized
atttgaagaatctttctgtatg

SEQ ID NO: 1129623 - DNA, 22 bp, Artificial Sequence
  chemically synthesized
tttgaagaatctttctgtatgt

SEQ ID NO: 1129624 - DNA, 22 bp, Artificial Sequence
  chemically synthesized
gaagaatctttctgtatgtgcc

SEQ ID NO: 1129625 - DNA, 22 bp, Artificial Sequence
  chemically synthesized
aagaatctttctgtatgtgccc

SEQ ID NO: 1129626 - DNA, 22 bp, Artificial Sequence
  chemically synthesized
aatgagaagtcccattgggcac

SEQ ID NO: 1129627 - DNA, 22 bp, Artificial Sequence
  chemically synthesized
tctgtatgtgcccaatgggact

SEQ ID NO: 1129628 - DNA, 22 bp, Artificial Sequence
  chemically synthesized
ctgtatgtgcccaatgggactt

SEQ ID NO: 1129629 - DNA, 22 bp, Artificial Sequence
  chemically synthesized
tgtatgtgcccaatgggacttc

SEQ ID NO: 1129630 - DNA, 22 bp, Artificial Sequence
  chemically synthesized
tatgtgcccaatgggacttctc

SEQ ID NO: 1129631 - DNA, 22 bp, Artificial Sequence
  chemically synthesized
tatgtgcctaaatgagaagtcc

SEQ ID NO: 1129632 - DNA, 22 bp, Artificial Sequence
  chemically synthesized
gtatgtgcctaaatgagaagtc

SEQ ID NO: 1129633 - DNA, 22 bp, Artificial Sequence
  chemically synthesized
tgtatgtgcctaaatgagaagt

SEQ ID NO: 1129634 - DNA, 22 bp, Artificial Sequence
  chemically synthesized
ttgtatgtgcctaaatgagaag

SEQ ID NO: 1129635 - DNA, 22 bp, Artificial Sequence
  chemically synthesized
ggcaatttttgtatgtgcctaa

SEQ ID NO: 1129636 - DNA, 22 bp, Artificial Sequence
  chemically synthesized
cggcaatttttgtatgtgccta

SEQ ID NO: 1129637 - DNA, 22 bp, Artificial Sequence
  chemically synthesized
tcggcaatttttgtatgtgcct

SEQ ID NO: 1129638 - DNA, 22 bp, Artificial Sequence
  chemically synthesized
ctcatttaggcacatacaaaaa

SEQ ID NO: 1129639 - DNA, 22 bp, Artificial Sequence
  chemically synthesized
tcatttaggcacatacaaaaat

SEQ ID NO: 1129640 - DNA, 22 bp, Artificial Sequence
  chemically synthesized
atttaggcacatacaaaaattg

SEQ ID NO: 1129641 - DNA, 22 bp, Artificial Sequence
  chemically synthesized
aggcacatacaaaaattgccga

SEQ ID NO: 1129642 - DNA, 22 bp, Artificial Sequence
  chemically synthesized
tatcataagttttcggcaattt

SEQ ID NO: 1129643 - DNA, 22 bp, Artificial Sequence
  chemically synthesized
ggcacatacaaaaattgccgaa

SEQ ID NO: 1129644 - DNA, 22 bp, Artificial Sequence
  chemically synthesized
gtatcataagttttcggcaatt

SEQ ID NO: 1129645 - DNA, 22 bp, Artificial Sequence
  chemically synthesized
tttgtatcataagttttcggca

SEQ ID NO: 1129646 - DNA, 22 bp, Artificial Sequence
  chemically synthesized
gtttgtatcataagttttcggc

SEQ ID NO: 1129647 - DNA, 22 bp, Artificial Sequence
  chemically synthesized
caaaatttgtttgtatcataag

SEQ ID NO: 1129648 - DNA, 22 bp, Artificial Sequence
  chemically synthesized
tccaaaatttgtttgtatcata

SEQ ID NO: 1129649 - DNA, 22 bp, Artificial Sequence
  chemically synthesized
tctccaaaatttgtttgtatca

SEQ ID NO: 1129650 - DNA, 22 bp, Artificial Sequence
  chemically synthesized
ccgaaaacttatgatacaaaca

SEQ ID NO: 1129651 - DNA, 22 bp, Artificial Sequence
  chemically synthesized
ctctccaaaatttgtttgtatc

SEQ ID NO: 1129652 - DNA, 22 bp, Artificial Sequence
  chemically synthesized
atgatacaaacaaattttggag

SEQ ID NO: 1129653 - DNA, 22 bp, Artificial Sequence
  chemically synthesized
tgatacaaacaaattttggaga

SEQ ID NO: 1129654 - DNA, 22 bp, Artificial Sequence
  chemically synthesized
gtggtgaaataccttctctcca

SEQ ID NO: 1129655 - DNA, 22 bp, Artificial Sequence
  chemically synthesized
tggagagaaggtatttcaccac

SEQ ID NO: 1129656 - DNA, 22 bp, Artificial Sequence
  chemically synthesized
ggagagaaggtatttcaccact

SEQ ID NO: 1129657 - DNA, 22 bp, Artificial Sequence
  chemically synthesized
gagagaaggtatttcaccacta

SEQ ID NO: 1129658 - DNA, 22 bp, Artificial Sequence
  chemically synthesized
aggaaagagtggctagtggtga

SEQ ID NO: 1129659 - DNA, 22 bp, Artificial Sequence
  chemically synthesized
caggaaagagtggctagtggtg

SEQ ID NO: 1129660 - DNA, 22 bp, Artificial Sequence
  chemically synthesized
tcaggaaagagtggctagtggt

SEQ ID NO: 1129661 - DNA, 22 bp, Artificial Sequence
  chemically synthesized
ttttcaggaaagagtggctagt

SEQ ID NO: 1129662 - DNA, 22 bp, Artificial Sequence
  chemically synthesized
gttttcaggaaagagtggctag

SEQ ID NO: 1129663 - DNA, 22 bp, Artificial Sequence
  chemically synthesized
tgttttcaggaaagagtggcta

SEQ ID NO: 1129664 - DNA, 22 bp, Artificial Sequence
  chemically synthesized
ttgttttcaggaaagagtggct

SEQ ID NO: 1129665 - DNA, 22 bp, Artificial Sequence
  chemically synthesized
tttgttttcaggaaagagtggc

SEQ ID NO: 1129666 - DNA, 22 bp, Artificial Sequence
  chemically synthesized
tttttgttttcaggaaagagtg

SEQ ID NO: 1129667 - DNA, 22 bp, Artificial Sequence
  chemically synthesized
ctttttgttttcaggaaagagt

SEQ ID NO: 1129668 - DNA, 22 bp, Artificial Sequence
  chemically synthesized
caccactagccactctttcctg

SEQ ID NO: 1129669 - DNA, 22 bp, Artificial Sequence
  chemically synthesized
accactagccactctttcctga

SEQ ID NO: 1129670 - DNA, 22 bp, Artificial Sequence
  chemically synthesized
acttctttttgttttcaggaaa

SEQ ID NO: 1129671 - DNA, 22 bp, Artificial Sequence
  chemically synthesized
tgacttctttttgttttcagga

SEQ ID NO: 1129672 - DNA, 22 bp, Artificial Sequence
  chemically synthesized
gccactctttcctgaaaacaaa

SEQ ID NO: 1129673 - DNA, 22 bp, Artificial Sequence
  chemically synthesized
tttcctgaaaacaaaaagaagt

SEQ ID NO: 1129674 - DNA, 22 bp, Artificial Sequence
  chemically synthesized
tcctgaaaacaaaaagaagtca

SEQ ID NO: 1129675 - DNA, 22 bp, Artificial Sequence
  chemically synthesized
cctgaaaacaaaaagaagtcag

SEQ ID NO: 1129676 - DNA, 22 bp, Artificial Sequence
  chemically synthesized
ctgaaaacaaaaagaagtcaga

SEQ ID NO: 1129677 - DNA, 22 bp, Artificial Sequence
  chemically synthesized
aaaacaaaaagaagtcagaaca

SEQ ID NO: 1129678 - DNA, 22 bp, Artificial Sequence
  chemically synthesized
gaaaaaaaaaaaaagtgtgttc

SEQ ID NO: 1129679 - DNA, 22 bp, Artificial Sequence
  chemically synthesized
tgttggaaaaaaaaaaaaagtg

SEQ ID NO: 1129680 - DNA, 22 bp, Artificial Sequence
  chemically synthesized
gagaatggattgtgttggaaaa

SEQ ID NO: 1129681 - DNA, 22 bp, Artificial Sequence
  chemically synthesized
ggagaatggattgtgttggaaa

SEQ ID NO: 1129682 - DNA, 22 bp, Artificial Sequence
  chemically synthesized
tttggagaatggattgtgttgg

SEQ ID NO: 1129683 - DNA, 22 bp, Artificial Sequence
  chemically synthesized
tttttttttttccaacacaatc

SEQ ID NO: 1129684 - DNA, 22 bp, Artificial Sequence
  chemically synthesized
ttttttttttccaacacaatcc

SEQ ID NO: 1129685 - DNA, 22 bp, Artificial Sequence
  chemically synthesized
tttttttttccaacacaatcca

SEQ ID NO: 1129686 - DNA, 22 bp, Artificial Sequence
  chemically synthesized
ctgtttggagaatggattgtgt

SEQ ID NO: 1129687 - DNA, 22 bp, Artificial Sequence
  chemically synthesized
ttttttttccaacacaatccat

SEQ ID NO: 1129688 - DNA, 22 bp, Artificial Sequence
  chemically synthesized
tttttttccaacacaatccatt

SEQ ID NO: 1129689 - DNA, 22 bp, Artificial Sequence
  chemically synthesized
ttttttccaacacaatccattc

SEQ ID NO: 1129690 - DNA, 22 bp, Artificial Sequence
  chemically synthesized
tttttccaacacaatccattct

SEQ ID NO: 1129691 - DNA, 22 bp, Artificial Sequence
  chemically synthesized
gctcctgtttggagaatggatt

SEQ ID NO: 1129692 - DNA, 22 bp, Artificial Sequence
  chemically synthesized
ttttccaacacaatccattctc

SEQ ID NO: 1129693 - DNA, 22 bp, Artificial Sequence
  chemically synthesized
tttccaacacaatccattctcc

SEQ ID NO: 1129694 - DNA, 22 bp, Artificial Sequence
  chemically synthesized
ttccaacacaatccattctcca

SEQ ID NO: 1129695 - DNA, 22 bp, Artificial Sequence
  chemically synthesized
ttggctcctgtttggagaatgg

SEQ ID NO: 1129696 - DNA, 22 bp, Artificial Sequence
  chemically synthesized
tccaacacaatccattctccaa

SEQ ID NO: 1129697 - DNA, 22 bp, Artificial Sequence
  chemically synthesized
ccaacacaatccattctccaaa

SEQ ID NO: 1129698 - DNA, 22 bp, Artificial Sequence
  chemically synthesized
caacacaatccattctccaaac

SEQ ID NO: 1129699 - DNA, 22 bp, Artificial Sequence
  chemically synthesized
ttattggctcctgtttggagaa

SEQ ID NO: 1129700 - DNA, 22 bp, Artificial Sequence
  chemically synthesized
attattggctcctgtttggaga

SEQ ID NO: 1129701 - DNA, 22 bp, Artificial Sequence
  chemically synthesized
aaaagcttattattggctcctg

SEQ ID NO: 1129702 - DNA, 22 bp, Artificial Sequence
  chemically synthesized
caaaagcttattattggctcct

SEQ ID NO: 1129703 - DNA, 22 bp, Artificial Sequence
  chemically synthesized
tcttcaaaagcttattattggc

SEQ ID NO: 1129704 - DNA, 22 bp, Artificial Sequence
  chemically synthesized
tccaaacaggagccaataataa

SEQ ID NO: 1129705 - DNA, 22 bp, Artificial Sequence
  chemically synthesized
tgtcttcaaaagcttattattg

SEQ ID NO: 1129706 - DNA, 22 bp, Artificial Sequence
  chemically synthesized
caaacaggagccaataataagc

SEQ ID NO: 1129707 - DNA, 22 bp, Artificial Sequence
  chemically synthesized
atgtcaatctctgtcttcaaaa

SEQ ID NO: 1129708 - DNA, 22 bp, Artificial Sequence
  chemically synthesized
attcatgtcaatctctgtcttc

SEQ ID NO: 1129709 - DNA, 22 bp, Artificial Sequence
  chemically synthesized
ttgaagacagagattgacatga

SEQ ID NO: 1129710 - DNA, 22 bp, Artificial Sequence
  chemically synthesized
tgaagacagagattgacatgaa

SEQ ID NO: 1129711 - DNA, 22 bp, Artificial Sequence
  chemically synthesized
gaagacagagattgacatgaat

SEQ ID NO: 1129712 - DNA, 22 bp, Artificial Sequence
  chemically synthesized
aagacagagattgacatgaatc

SEQ ID NO: 1129713 - DNA, 22 bp, Artificial Sequence
  chemically synthesized
acagagcaagctgattcatgtc

SEQ ID NO: 1129714 - DNA, 22 bp, Artificial Sequence
  chemically synthesized
atacagaaattaacagagcaag

SEQ ID NO: 1129715 - DNA, 22 bp, Artificial Sequence
  chemically synthesized
acatgaatcagcttgctctgtt

SEQ ID NO: 1129716 - DNA, 22 bp, Artificial Sequence
  chemically synthesized
cctaatacagaaattaacagag

SEQ ID NO: 1129717 - DNA, 22 bp, Artificial Sequence
  chemically synthesized
gcctaatacagaaattaacaga

SEQ ID NO: 1129718 - DNA, 22 bp, Artificial Sequence
  chemically synthesized
aggacttgcctaatacagaaat

SEQ ID NO: 1129719 - DNA, 22 bp, Artificial Sequence
  chemically synthesized
caggacttgcctaatacagaaa

SEQ ID NO: 1129720 - DNA, 22 bp, Artificial Sequence
  chemically synthesized
gctctgttaatttctgtattag

SEQ ID NO: 1129721 - DNA, 22 bp, Artificial Sequence
  chemically synthesized
ctctgttaatttctgtattagg

SEQ ID NO: 1129722 - DNA, 22 bp, Artificial Sequence
  chemically synthesized
tgttaatttctgtattaggcaa

SEQ ID NO: 1129723 - DNA, 22 bp, Artificial Sequence
  chemically synthesized
atgtcttcaggacttgcctaat

SEQ ID NO: 1129724 - DNA, 22 bp, Artificial Sequence
  chemically synthesized
ttaatttctgtattaggcaagt

SEQ ID NO: 1129725 - DNA, 22 bp, Artificial Sequence
  chemically synthesized
aatgtcttcaggacttgcctaa

SEQ ID NO: 1129726 - DNA, 22 bp, Artificial Sequence
  chemically synthesized
taatgtcttcaggacttgccta

SEQ ID NO: 1129727 - DNA, 22 bp, Artificial Sequence
  chemically synthesized
ttaatgtcttcaggacttgcct

SEQ ID NO: 1129728 - DNA, 22 bp, Artificial Sequence
  chemically synthesized
atttctgtattaggcaagtcct

SEQ ID NO: 1129729 - DNA, 22 bp, Artificial Sequence
  chemically synthesized
ctgtattaggcaagtcctgaag

SEQ ID NO: 1129730 - DNA, 22 bp, Artificial Sequence
  chemically synthesized
tgtattaggcaagtcctgaaga

SEQ ID NO: 1129731 - DNA, 22 bp, Artificial Sequence
  chemically synthesized
acacttttaatgtcttcaggac

SEQ ID NO: 1129732 - DNA, 22 bp, Artificial Sequence
  chemically synthesized
tattaggcaagtcctgaagaca

SEQ ID NO: 1129733 - DNA, 22 bp, Artificial Sequence
  chemically synthesized
cctaacacttttaatgtcttca

SEQ ID NO: 1129734 - DNA, 22 bp, Artificial Sequence
  chemically synthesized
ggcaagtcctgaagacattaaa

SEQ ID NO: 1129735 - DNA, 22 bp, Artificial Sequence
  chemically synthesized
gttgcctaacacttttaatgtc

SEQ ID NO: 1129736 - DNA, 22 bp, Artificial Sequence
  chemically synthesized
aagacattaaaagtgttaggca

SEQ ID NO: 1129737 - DNA, 22 bp, Artificial Sequence
  chemically synthesized
aaagtgttaggcaactaggtgt

SEQ ID NO: 1129738 - DNA, 22 bp, Artificial Sequence
  chemically synthesized
caaacagagtaatagggacacc

SEQ ID NO: 1129739 - DNA, 22 bp, Artificial Sequence
  chemically synthesized
tccaaacagagtaatagggaca

SEQ ID NO: 1129740 - DNA, 22 bp, Artificial Sequence
  chemically synthesized
ggcaactaggtgtccctattac

SEQ ID NO: 1129741 - DNA, 22 bp, Artificial Sequence
  chemically synthesized
caacagttctccaaacagagta

SEQ ID NO: 1129742 - DNA, 22 bp, Artificial Sequence
  chemically synthesized
ggtgtccctattactctgtttg

SEQ ID NO: 1129743 - DNA, 22 bp, Artificial Sequence
  chemically synthesized
ttactctgtttggagaactgtt

SEQ ID NO: 1129744 - DNA, 22 bp, Artificial Sequence
  chemically synthesized
caacaaccctccaacagttctc

SEQ ID NO: 1129745 - DNA, 22 bp, Artificial Sequence
  chemically synthesized
ctctgtttggagaactgttgga

SEQ ID NO: 1129746 - DNA, 22 bp, Artificial Sequence
  chemically synthesized
tgtttggagaactgttggaggg

SEQ ID NO: 1129747 - DNA, 22 bp, Artificial Sequence
  chemically synthesized
tttggagaactgttggagggtt

SEQ ID NO: 1129748 - DNA, 22 bp, Artificial Sequence
  chemically synthesized
caacattccaacaaccctccaa

SEQ ID NO: 1129749 - DNA, 22 bp, Artificial Sequence
  chemically synthesized
gcaacattccaacaaccctcca

SEQ ID NO: 1129750 - DNA, 22 bp, Artificial Sequence
  chemically synthesized
tgcaacattccaacaaccctcc

SEQ ID NO: 1129751 - DNA, 22 bp, Artificial Sequence
  chemically synthesized
ggagaactgttggagggttgtt

SEQ ID NO: 1129752 - DNA, 22 bp, Artificial Sequence
  chemically synthesized
gagaactgttggagggttgttg

SEQ ID NO: 1129753 - DNA, 22 bp, Artificial Sequence
  chemically synthesized
tggatactttgcaacattccaa

SEQ ID NO: 1129754 - DNA, 22 bp, Artificial Sequence
  chemically synthesized
ttggagggttgttggaatgttg

SEQ ID NO: 1129755 - DNA, 22 bp, Artificial Sequence
  chemically synthesized
atggatactttgcaacattcca

SEQ ID NO: 1129756 - DNA, 22 bp, Artificial Sequence
  chemically synthesized
gagggttgttggaatgttgcaa

SEQ ID NO: 1129757 - DNA, 22 bp, Artificial Sequence
  chemically synthesized
ttggaatgttgcaaagtatcca

SEQ ID NO: 1129758 - DNA, 22 bp, Artificial Sequence
  chemically synthesized
gaatgttgcaaagtatccataa

SEQ ID NO: 1129759 - DNA, 22 bp, Artificial Sequence
  chemically synthesized
gtggacatacagatttatggat

SEQ ID NO: 1129760 - DNA, 22 bp, Artificial Sequence
  chemically synthesized
agtggacatacagatttatgga

SEQ ID NO: 1129761 - DNA, 22 bp, Artificial Sequence
  chemically synthesized
caaagtatccataaatctgtat

SEQ ID NO: 1129762 - DNA, 22 bp, Artificial Sequence
  chemically synthesized
tagacaacgcttagtggacata

SEQ ID NO: 1129763 - DNA, 22 bp, Artificial Sequence
  chemically synthesized
atagacaacgcttagtggacat

SEQ ID NO: 1129764 - DNA, 22 bp, Artificial Sequence
  chemically synthesized
tatgtccactaagcgttgtcta

SEQ ID NO: 1129765 - DNA, 22 bp, Artificial Sequence
  chemically synthesized
aacatgtgtttatagacaacgc

SEQ ID NO: 1129766 - DNA, 22 bp, Artificial Sequence
  chemically synthesized
tcacattaaacatgtgtttata

SEQ ID NO: 1129767 - DNA, 22 bp, Artificial Sequence
  chemically synthesized
agcgttgtctataaacacatgt

SEQ ID NO: 1129768 - DNA, 22 bp, Artificial Sequence
  chemically synthesized
ttgtcacattaaacatgtgttt

SEQ ID NO: 1129769 - DNA, 22 bp, Artificial Sequence
  chemically synthesized
gttgtcacattaaacatgtgtt

SEQ ID NO: 1129770 - DNA, 22 bp, Artificial Sequence
  chemically synthesized
tttgttgtcacattaaacatgt

SEQ ID NO: 1129771 - DNA, 22 bp, Artificial Sequence
  chemically synthesized
gtttgttgtcacattaaacatg

SEQ ID NO: 1129772 - DNA, 22 bp, Artificial Sequence
  chemically synthesized
tctataaacacatgtttaatgt

SEQ ID NO: 1129773 - DNA, 22 bp, Artificial Sequence
  chemically synthesized
acttgtttgttgtcacattaaa

SEQ ID NO: 1129774 - DNA, 22 bp, Artificial Sequence
  chemically synthesized
taaacacatgtttaatgtgaca

SEQ ID NO: 1129775 - DNA, 22 bp, Artificial Sequence
  chemically synthesized
aatgtgacaacaaacaagttaa

SEQ ID NO: 1129776 - DNA, 22 bp, Artificial Sequence
  chemically synthesized
gtaagatgtacattaacttgtt

SEQ ID NO: 1129777 - DNA, 22 bp, Artificial Sequence
  chemically synthesized
atgtgacaacaaacaagttaat

SEQ ID NO: 1129778 - DNA, 22 bp, Artificial Sequence
  chemically synthesized
ctagtaagatgtacattaactt

SEQ ID NO: 1129779 - DNA, 22 bp, Artificial Sequence
  chemically synthesized
ttcctagtaagatgtacattaa

SEQ ID NO: 1129780 - DNA, 22 bp, Artificial Sequence
  chemically synthesized
ttattcctagtaagatgtacat

SEQ ID NO: 1129781 - DNA, 22 bp, Artificial Sequence
  chemically synthesized
attattcctagtaagatgtaca

SEQ ID NO: 1129782 - DNA, 22 bp, Artificial Sequence
  chemically synthesized
tattattcctagtaagatgtac

SEQ ID NO: 1129783 - DNA, 22 bp, Artificial Sequence
  chemically synthesized
ttattattcctagtaagatgta

SEQ ID NO: 1129784 - DNA, 22 bp, Artificial Sequence
  chemically synthesized
ttttattattcctagtaagatg

SEQ ID NO: 1129785 - DNA, 22 bp, Artificial Sequence
  chemically synthesized
cttttattattcctagtaagat

SEQ ID NO: 1129786 - DNA, 22 bp, Artificial Sequence
  chemically synthesized
atgtacatcttactaggaataa

SEQ ID NO: 1129787 - DNA, 22 bp, Artificial Sequence
  chemically synthesized
atgaatttcttttattattcct

SEQ ID NO: 1129788 - DNA, 22 bp, Artificial Sequence
  chemically synthesized
gatgaatttcttttattattcc

SEQ ID NO: 1129789 - DNA, 22 bp, Artificial Sequence
  chemically synthesized
tgatgaatttcttttattattc

SEQ ID NO: 1129790 - DNA, 22 bp, Artificial Sequence
  chemically synthesized
ttgatgaatttcttttattatt

SEQ ID NO: 1129791 - DNA, 22 bp, Artificial Sequence
  chemically synthesized
actaggaataataaaagaaatt

SEQ ID NO: 1129792 - DNA, 22 bp, Artificial Sequence
  chemically synthesized
ctaggaataataaaagaaattc

SEQ ID NO: 1129793 - DNA, 22 bp, Artificial Sequence
  chemically synthesized
ggaataataaaagaaattcatc

SEQ ID NO: 1129794 - DNA, 22 bp, Artificial Sequence
  chemically synthesized
atcaaaagcttcacggatttgt

SEQ ID NO: 1129795 - DNA, 22 bp, Artificial Sequence
  chemically synthesized
atggagtgaaaagcataatggc

SEQ ID NO: 1129796 - DNA, 22 bp, Artificial Sequence
  chemically synthesized
cacggatttgtgccattatgct

SEQ ID NO: 1129797 - DNA, 22 bp, Artificial Sequence
  chemically synthesized
acggatttgtgccattatgctt

SEQ ID NO: 1129798 - DNA, 22 bp, Artificial Sequence
  chemically synthesized
gtgccattatgcttttcactcc

SEQ ID NO: 1129799 - DNA, 22 bp, Artificial Sequence
  chemically synthesized
acaaaaattgatggagtgaaaa

SEQ ID NO: 1129800 - DNA, 22 bp, Artificial Sequence
  chemically synthesized
tgccattatgcttttcactcca

SEQ ID NO: 1129801 - DNA, 22 bp, Artificial Sequence
  chemically synthesized
tgcttttcactccatcaatttt

SEQ ID NO: 1129802 - DNA, 22 bp, Artificial Sequence
  chemically synthesized
ttcactccatcaatttttgtta

SEQ ID NO: 1129803 - DNA, 22 bp, Artificial Sequence
  chemically synthesized
tcactccatcaatttttgttag

SEQ ID NO: 1129804 - DNA, 22 bp, Artificial Sequence
  chemically synthesized
cactccatcaatttttgttaga

SEQ ID NO: 1129805 - DNA, 22 bp, Artificial Sequence
  chemically synthesized
actccatcaatttttgttagat

SEQ ID NO: 1129806 - DNA, 22 bp, Artificial Sequence
  chemically synthesized
catcaatttttgttagattttc

SEQ ID NO: 1129807 - DNA, 22 bp, Artificial Sequence
  chemically synthesized
acgatggtaatagaaaatctaa

SEQ ID NO: 1129808 - DNA, 22 bp, Artificial Sequence
  chemically synthesized
ctcacgatggtaatagaaaatc

SEQ ID NO: 1129809 - DNA, 22 bp, Artificial Sequence
  chemically synthesized
tactcacgatggtaatagaaaa

SEQ ID NO: 1129810 - DNA, 22 bp, Artificial Sequence
  chemically synthesized
ttgttagattttctattaccat

SEQ ID NO: 1129811 - DNA, 22 bp, Artificial Sequence
  chemically synthesized
tgttagattttctattaccatc

SEQ ID NO: 1129812 - DNA, 22 bp, Artificial Sequence
  chemically synthesized
gttagattttctattaccatcg

SEQ ID NO: 1129813 - DNA, 22 bp, Artificial Sequence
  chemically synthesized
ttagattttctattaccatcgt

SEQ ID NO: 1129814 - DNA, 22 bp, Artificial Sequence
  chemically synthesized
caagcactctactcacgatggt

SEQ ID NO: 1129815 - DNA, 22 bp, Artificial Sequence
  chemically synthesized
gattttctattaccatcgtgag

SEQ ID NO: 1129816 - DNA, 22 bp, Artificial Sequence
  chemically synthesized
ccaagcactctactcacgatgg

SEQ ID NO: 1129817 - DNA, 22 bp, Artificial Sequence
  chemically synthesized
tctattaccatcgtgagtagag

SEQ ID NO: 1129818 - DNA, 22 bp, Artificial Sequence
  chemically synthesized
ctattaccatcgtgagtagagt

SEQ ID NO: 1129819 - DNA, 22 bp, Artificial Sequence
  chemically synthesized
tattaccatcgtgagtagagtg

SEQ ID NO: 1129820 - DNA, 22 bp, Artificial Sequence
  chemically synthesized
aggaacttccaagcactctact

SEQ ID NO: 1129821 - DNA, 22 bp, Artificial Sequence
  chemically synthesized
ttaccatcgtgagtagagtgct

SEQ ID NO: 1129822 - DNA, 22 bp, Artificial Sequence
  chemically synthesized
caggaacttccaagcactctac

SEQ ID NO: 1129823 - DNA, 22 bp, Artificial Sequence
  chemically synthesized
tcaggaacttccaagcactcta

SEQ ID NO: 1129824 - DNA, 22 bp, Artificial Sequence
  chemically synthesized
ccatcgtgagtagagtgcttgg

SEQ ID NO: 1129825 - DNA, 22 bp, Artificial Sequence
  chemically synthesized
tggcaacaactttcaggaactt

SEQ ID NO: 1129826 - DNA, 22 bp, Artificial Sequence
  chemically synthesized
gtggcaacaactttcaggaact

SEQ ID NO: 1129827 - DNA, 22 bp, Artificial Sequence
  chemically synthesized
tgtggcaacaactttcaggaac

SEQ ID NO: 1129828 - DNA, 22 bp, Artificial Sequence
  chemically synthesized
ttgtggcaacaactttcaggaa

SEQ ID NO: 1129829 - DNA, 22 bp, Artificial Sequence
  chemically synthesized
tttgtggcaacaactttcagga

SEQ ID NO: 1129830 - DNA, 22 bp, Artificial Sequence
  chemically synthesized
tttttgtggcaacaactttcag

SEQ ID NO: 1129831 - DNA, 22 bp, Artificial Sequence
  chemically synthesized
ggaagttcctgaaagttgttgc

SEQ ID NO: 1129832 - DNA, 22 bp, Artificial Sequence
  chemically synthesized
gaagttcctgaaagttgttgcc

SEQ ID NO: 1129833 - DNA, 22 bp, Artificial Sequence
  chemically synthesized
gcattctttttgtggcaacaac

SEQ ID NO: 1129834 - DNA, 22 bp, Artificial Sequence
  chemically synthesized
ctgaaagttgttgccacaaaaa

SEQ ID NO: 1129835 - DNA, 22 bp, Artificial Sequence
  chemically synthesized
aaagttgttgccacaaaaagaa

SEQ ID NO: 1129836 - DNA, 22 bp, Artificial Sequence
  chemically synthesized
tgaatattagcattctttttgt

SEQ ID NO: 1129837 - DNA, 22 bp, Artificial Sequence
  chemically synthesized
tatgaatattagcattcttttt

SEQ ID NO: 1129838 - DNA, 22 bp, Artificial Sequence
  chemically synthesized
ttgccacaaaaagaatgctaat

SEQ ID NO: 1129839 - DNA, 22 bp, Artificial Sequence
  chemically synthesized
aaactctatgaatattagcatt

SEQ ID NO: 1129840 - DNA, 22 bp, Artificial Sequence
  chemically synthesized
ccacaaaaagaatgctaatatt

SEQ ID NO: 1129841 - DNA, 22 bp, Artificial Sequence
  chemically synthesized
tcaaactctatgaatattagca

SEQ ID NO: 1129842 - DNA, 22 bp, Artificial Sequence
  chemically synthesized
cagtcaaatggctctcaaactc

SEQ ID NO: 1129843 - DNA, 22 bp, Artificial Sequence
  chemically synthesized
atattcatagagtttgagagcc

SEQ ID NO: 1129844 - DNA, 22 bp, Artificial Sequence
  chemically synthesized
ctccagtcaaatggctctcaaa

SEQ ID NO: 1129845 - DNA, 22 bp, Artificial Sequence
  chemically synthesized
gctccagtcaaatggctctcaa

SEQ ID NO: 1129846 - DNA, 22 bp, Artificial Sequence
  chemically synthesized
atagagtttgagagccatttga

SEQ ID NO: 1129847 - DNA, 22 bp, Artificial Sequence
  chemically synthesized
gcgacccttgctccagtcaaat

SEQ ID NO: 1129848 - DNA, 22 bp, Artificial Sequence
  chemically synthesized
ggcgacccttgctccagtcaaa

SEQ ID NO: 1129849 - DNA, 22 bp, Artificial Sequence
  chemically synthesized
gagagccatttgactggagcaa

SEQ ID NO: 1129850 - DNA, 22 bp, Artificial Sequence
  chemically synthesized
agagccatttgactggagcaag

SEQ ID NO: 1129851 - DNA, 22 bp, Artificial Sequence
  chemically synthesized
gactggagcaagggtcgccaaa

SEQ ID NO: 1129852 - DNA, 22 bp, Artificial Sequence
  chemically synthesized
tcacagaaaaagtttggcgacc

SEQ ID NO: 1129853 - DNA, 22 bp, Artificial Sequence
  chemically synthesized
actggagcaagggtcgccaaac

SEQ ID NO: 1129854 - DNA, 22 bp, Artificial Sequence
  chemically synthesized
gagcaagggtcgccaaactttt

SEQ ID NO: 1129855 - DNA, 22 bp, Artificial Sequence
  chemically synthesized
tcctatcacagaaaaagtttgg

SEQ ID NO: 1129856 - DNA, 22 bp, Artificial Sequence
  chemically synthesized
cctatcctatcacagaaaaagt

SEQ ID NO: 1129857 - DNA, 22 bp, Artificial Sequence
  chemically synthesized
ttacctatcctatcacagaaaa

SEQ ID NO: 1129858 - DNA, 22 bp, Artificial Sequence
  chemically synthesized
attacctatcctatcacagaaa

SEQ ID NO: 1129859 - DNA, 22 bp, Artificial Sequence
  chemically synthesized
aaatatttattacctatcctat

SEQ ID NO: 1129860 - DNA, 22 bp, Artificial Sequence
  chemically synthesized
tttctgtgataggataggtaat

SEQ ID NO: 1129861 - DNA, 22 bp, Artificial Sequence
  chemically synthesized
ttctgtgataggataggtaata

SEQ ID NO: 1129862 - DNA, 22 bp, Artificial Sequence
  chemically synthesized
tctgtgataggataggtaataa

SEQ ID NO: 1129863 - DNA, 22 bp, Artificial Sequence
  chemically synthesized
ctgtgataggataggtaataaa

SEQ ID NO: 1129864 - DNA, 22 bp, Artificial Sequence
  chemically synthesized
tgtgataggataggtaataaat

SEQ ID NO: 1129865 - DNA, 22 bp, Artificial Sequence
  chemically synthesized
tgataggataggtaataaatat

SEQ ID NO: 1129866 - DNA, 22 bp, Artificial Sequence
  chemically synthesized
tatagtccacaaagcctaaaat

SEQ ID NO: 1129867 - DNA, 22 bp, Artificial Sequence
  chemically synthesized
taacacaaactgtatagtccac

SEQ ID NO: 1129868 - DNA, 22 bp, Artificial Sequence
  chemically synthesized
taggctttgtggactatacagt

SEQ ID NO: 1129869 - DNA, 22 bp, Artificial Sequence
  chemically synthesized
aggctttgtggactatacagtt

SEQ ID NO: 1129870 - DNA, 22 bp, Artificial Sequence
  chemically synthesized
ggctttgtggactatacagttt

SEQ ID NO: 1129871 - DNA, 22 bp, Artificial Sequence
  chemically synthesized
aatagttgtaacacaaactgta

SEQ ID NO: 1129872 - DNA, 22 bp, Artificial Sequence
  chemically synthesized
gaatagttgtaacacaaactgt

SEQ ID NO: 1129873 - DNA, 22 bp, Artificial Sequence
  chemically synthesized
tgtggactatacagtttgtgtt

SEQ ID NO: 1129874 - DNA, 22 bp, Artificial Sequence
  chemically synthesized
gtggactatacagtttgtgtta

SEQ ID NO: 1129875 - DNA, 22 bp, Artificial Sequence
  chemically synthesized
tggactatacagtttgtgttac

SEQ ID NO: 1129876 - DNA, 22 bp, Artificial Sequence
  chemically synthesized
tacagtttgtgttacaactatt

SEQ ID NO: 1129877 - DNA, 22 bp, Artificial Sequence
  chemically synthesized
caacggcagagtttgaatagtt

SEQ ID NO: 1129878 - DNA, 22 bp, Artificial Sequence
  chemically synthesized
gtgttacaactattcaaactct

SEQ ID NO: 1129879 - DNA, 22 bp, Artificial Sequence
  chemically synthesized
tgttacaactattcaaactctg

SEQ ID NO: 1129880 - DNA, 22 bp, Artificial Sequence
  chemically synthesized
gcattacaacggcagagtttga

SEQ ID NO: 1129881 - DNA, 22 bp, Artificial Sequence
  chemically synthesized
cgcattacaacggcagagtttg

SEQ ID NO: 1129882 - DNA, 22 bp, Artificial Sequence
  chemically synthesized
tcgcattacaacggcagagttt

SEQ ID NO: 1129883 - DNA, 22 bp, Artificial Sequence
  chemically synthesized
caactattcaaactctgccgtt

SEQ ID NO: 1129884 - DNA, 22 bp, Artificial Sequence
  chemically synthesized
ctttcgcattacaacggcagag

SEQ ID NO: 1129885 - DNA, 22 bp, Artificial Sequence
  chemically synthesized
ttcaaactctgccgttgtaatg

SEQ ID NO: 1129886 - DNA, 22 bp, Artificial Sequence
  chemically synthesized
tgattactttcgcattacaacg

SEQ ID NO: 1129887 - DNA, 22 bp, Artificial Sequence
  chemically synthesized
atgattactttcgcattacaac

SEQ ID NO: 1129888 - DNA, 22 bp, Artificial Sequence
  chemically synthesized
aaactctgccgttgtaatgcga

SEQ ID NO: 1129889 - DNA, 22 bp, Artificial Sequence
  chemically synthesized
tcacttatgattactttcgcat

SEQ ID NO: 1129890 - DNA, 22 bp, Artificial Sequence
  chemically synthesized
atcacttatgattactttcgca

SEQ ID NO: 1129891 - DNA, 22 bp, Artificial Sequence
  chemically synthesized
tgccgttgtaatgcgaaagtaa

SEQ ID NO: 1129892 - DNA, 22 bp, Artificial Sequence
  chemically synthesized
ccgttgtaatgcgaaagtaatc

SEQ ID NO: 1129893 - DNA, 22 bp, Artificial Sequence
  chemically synthesized
tttatcacttatgattactttc

SEQ ID NO: 1129894 - DNA, 22 bp, Artificial Sequence
  chemically synthesized
atttatcacttatgattacttt

SEQ ID NO: 1129895 - DNA, 22 bp, Artificial Sequence
  chemically synthesized
atttatttatcacttatgatta

SEQ ID NO: 1129896 - DNA, 22 bp, Artificial Sequence
  chemically synthesized
taatgcgaaagtaatcataagt

SEQ ID NO: 1129897 - DNA, 22 bp, Artificial Sequence
  chemically synthesized
gtggaacacagccaaactcatt

SEQ ID NO: 1129898 - DNA, 22 bp, Artificial Sequence
  chemically synthesized
agtggaacacagccaaactcat

SEQ ID NO: 1129899 - DNA, 22 bp, Artificial Sequence
  chemically synthesized
tagtggaacacagccaaactca

SEQ ID NO: 1129900 - DNA, 22 bp, Artificial Sequence
  chemically synthesized
taaataatgttttagtggaaca

SEQ ID NO: 1129901 - DNA, 22 bp, Artificial Sequence
  chemically synthesized
ggctgtgttccactaaaacatt

SEQ ID NO: 1129902 - DNA, 22 bp, Artificial Sequence
  chemically synthesized
agtgttataaataatgttttag

SEQ ID NO: 1129903 - DNA, 22 bp, Artificial Sequence
  chemically synthesized
gctgtgttccactaaaacatta

SEQ ID NO: 1129904 - DNA, 22 bp, Artificial Sequence
  chemically synthesized
cagtgttataaataatgtttta

SEQ ID NO: 1129905 - DNA, 22 bp, Artificial Sequence
  chemically synthesized
tgttccactaaaacattattta

SEQ ID NO: 1129906 - DNA, 22 bp, Artificial Sequence
  chemically synthesized
aaatttcagtgttataaataat

SEQ ID NO: 1129907 - DNA, 22 bp, Artificial Sequence
  chemically synthesized
cactaaaacattatttataaca

SEQ ID NO: 1129908 - DNA, 22 bp, Artificial Sequence
  chemically synthesized
aaacattatttataacactgaa

SEQ ID NO: 1129909 - DNA, 22 bp, Artificial Sequence
  chemically synthesized
cataaaattcaaatttcagtgt

SEQ ID NO: 1129910 - DNA, 22 bp, Artificial Sequence
  chemically synthesized
tttataacactgaaatttgaat

SEQ ID NO: 1129911 - DNA, 22 bp, Artificial Sequence
  chemically synthesized
ataacactgaaatttgaatttt

SEQ ID NO: 1129912 - DNA, 22 bp, Artificial Sequence
  chemically synthesized
taacactgaaatttgaatttta

SEQ ID NO: 1129913 - DNA, 22 bp, Artificial Sequence
  chemically synthesized
tgacatgtcaaaattacataaa

SEQ ID NO: 1129914 - DNA, 22 bp, Artificial Sequence
  chemically synthesized
atgacatgtcaaaattacataa

SEQ ID NO: 1129915 - DNA, 22 bp, Artificial Sequence
  chemically synthesized
aaatttgaattttatgtaattt

SEQ ID NO: 1129916 - DNA, 22 bp, Artificial Sequence
  chemically synthesized
tatgacatgtcaaaattacata

SEQ ID NO: 1129917 - DNA, 22 bp, Artificial Sequence
  chemically synthesized
gaattttatgtaattttgacat

SEQ ID NO: 1129918 - DNA, 22 bp, Artificial Sequence
  chemically synthesized
aattttatgtaattttgacatg

SEQ ID NO: 1129919 - DNA, 22 bp, Artificial Sequence
  chemically synthesized
tatgtaattttgacatgtcata

SEQ ID NO: 1129920 - DNA, 22 bp, Artificial Sequence
  chemically synthesized
atgtaattttgacatgtcataa

SEQ ID NO: 1129921 - DNA, 22 bp, Artificial Sequence
  chemically synthesized
tgtaattttgacatgtcataaa

SEQ ID NO: 1129922 - DNA, 22 bp, Artificial Sequence
  chemically synthesized
tgacatgtcataaaatattatt

SEQ ID NO: 1129923 - DNA, 22 bp, Artificial Sequence
  chemically synthesized
gacatgtcataaaatattattt

SEQ ID NO: 1129924 - DNA, 22 bp, Artificial Sequence
  chemically synthesized
acatgtcataaaatattatttt

SEQ ID NO: 1129925 - DNA, 22 bp, Artificial Sequence
  chemically synthesized
aaaataatcaaaagaaaaataa

SEQ ID NO: 1129926 - DNA, 22 bp, Artificial Sequence
  chemically synthesized
aaatggttgaaaataatcaaaa

SEQ ID NO: 1129927 - DNA, 22 bp, Artificial Sequence
  chemically synthesized
caaatggttgaaaataatcaaa

SEQ ID NO: 1129928 - DNA, 22 bp, Artificial Sequence
  chemically synthesized
tcaaatggttgaaaataatcaa

SEQ ID NO: 1129929 - DNA, 22 bp, Artificial Sequence
  chemically synthesized
tttttcttttgattattttcaa

SEQ ID NO: 1129930 - DNA, 22 bp, Artificial Sequence
  chemically synthesized
cgttttcaaatggttgaaaata

SEQ ID NO: 1129931 - DNA, 22 bp, Artificial Sequence
  chemically synthesized
acgttttcaaatggttgaaaat

SEQ ID NO: 1129932 - DNA, 22 bp, Artificial Sequence
  chemically synthesized
ttcttttgattattttcaacca

SEQ ID NO: 1129933 - DNA, 22 bp, Artificial Sequence
  chemically synthesized
tacgttttcaaatggttgaaaa

SEQ ID NO: 1129934 - DNA, 22 bp, Artificial Sequence
  chemically synthesized
tcttttgattattttcaaccat

SEQ ID NO: 1129935 - DNA, 22 bp, Artificial Sequence
  chemically synthesized
ttacgttttcaaatggttgaaa

SEQ ID NO: 1129936 - DNA, 22 bp, Artificial Sequence
  chemically synthesized
cttttgattattttcaaccatt

SEQ ID NO: 1129937 - DNA, 22 bp, Artificial Sequence
  chemically synthesized
ttttgattattttcaaccattt

SEQ ID NO: 1129938 - DNA, 22 bp, Artificial Sequence
  chemically synthesized
ttgattattttcaaccatttga

SEQ ID NO: 1129939 - DNA, 22 bp, Artificial Sequence
  chemically synthesized
tgattattttcaaccatttgaa

SEQ ID NO: 1129940 - DNA, 22 bp, Artificial Sequence
  chemically synthesized
gattattttcaaccatttgaaa

SEQ ID NO: 1129941 - DNA, 22 bp, Artificial Sequence
  chemically synthesized
attattttcaaccatttgaaaa

SEQ ID NO: 1129942 - DNA, 22 bp, Artificial Sequence
  chemically synthesized
ttttcaaccatttgaaaacgta

SEQ ID NO: 1129943 - DNA, 22 bp, Artificial Sequence
  chemically synthesized
tcaaccatttgaaaacgtaaaa

SEQ ID NO: 1129944 - DNA, 22 bp, Artificial Sequence
  chemically synthesized
caaccatttgaaaacgtaaaaa

SEQ ID NO: 1129945 - DNA, 22 bp, Artificial Sequence
  chemically synthesized
aaccatttgaaaacgtaaaaac

SEQ ID NO: 1129946 - DNA, 22 bp, Artificial Sequence
  chemically synthesized
atcagccaagaagtgtttttac

SEQ ID NO: 1129947 - DNA, 22 bp, Artificial Sequence
  chemically synthesized
gaaaacgtaaaaacacttcttg

SEQ ID NO: 1129948 - DNA, 22 bp, Artificial Sequence
  chemically synthesized
aaaacgtaaaaacacttcttgg

SEQ ID NO: 1129949 - DNA, 22 bp, Artificial Sequence
  chemically synthesized
gtatggctcatcagccaagaag

SEQ ID NO: 1129950 - DNA, 22 bp, Artificial Sequence
  chemically synthesized
ggtatggctcatcagccaagaa

SEQ ID NO: 1129951 - DNA, 22 bp, Artificial Sequence
  chemically synthesized
ccagtttggtatggctcatcag

SEQ ID NO: 1129952 - DNA, 22 bp, Artificial Sequence
  chemically synthesized
cttggctgatgagccataccaa

SEQ ID NO: 1129953 - DNA, 22 bp, Artificial Sequence
  chemically synthesized
ttggctgatgagccataccaaa

SEQ ID NO: 1129954 - DNA, 22 bp, Artificial Sequence
  chemically synthesized
gcatgctgccagtttggtatgg

SEQ ID NO: 1129955 - DNA, 22 bp, Artificial Sequence
  chemically synthesized
agcatgctgccagtttggtatg

SEQ ID NO: 1129956 - DNA, 22 bp, Artificial Sequence
  chemically synthesized
ggctgatgagccataccaaact

SEQ ID NO: 1129957 - DNA, 22 bp, Artificial Sequence
  chemically synthesized
gctgatgagccataccaaactg

SEQ ID NO: 1129958 - DNA, 22 bp, Artificial Sequence
  chemically synthesized
atgagccataccaaactggcag

SEQ ID NO: 1129959 - DNA, 22 bp, Artificial Sequence
  chemically synthesized
accaaatttagcatgctgccag

SEQ ID NO: 1129960 - DNA, 22 bp, Artificial Sequence
  chemically synthesized
ctaaccaaatttagcatgctgc

SEQ ID NO: 1129961 - DNA, 22 bp, Artificial Sequence
  chemically synthesized
agacctgctaaccaaatttagc

SEQ ID NO: 1129962 - DNA, 22 bp, Artificial Sequence
  chemically synthesized
gcagcatgctaaatttggttag

SEQ ID NO: 1129963 - DNA, 22 bp, Artificial Sequence
  chemically synthesized
aatttggttagcaggtcttagt

SEQ ID NO: 1129964 - DNA, 22 bp, Artificial Sequence
  chemically synthesized
gtccaggggtcaccaaactaag

SEQ ID NO: 1129965 - DNA, 22 bp, Artificial Sequence
  chemically synthesized
ggttagcaggtcttagtttggt

SEQ ID NO: 1129966 - DNA, 22 bp, Artificial Sequence
  chemically synthesized
gttagcaggtcttagtttggtg

SEQ ID NO: 1129967 - DNA, 22 bp, Artificial Sequence
  chemically synthesized
gcaggtcttagtttggtgaccc

SEQ ID NO: 1129968 - DNA, 22 bp, Artificial Sequence
  chemically synthesized
agcaaatccactagtccagggg

SEQ ID NO: 1129969 - DNA, 22 bp, Artificial Sequence
  chemically synthesized
agtttggtgacccctggactag

SEQ ID NO: 1129970 - DNA, 22 bp, Artificial Sequence
  chemically synthesized
gtttggtgacccctggactagt

SEQ ID NO: 1129971 - DNA, 22 bp, Artificial Sequence
  chemically synthesized
gctaagcaaatccactagtcca

SEQ ID NO: 1129972 - DNA, 22 bp, Artificial Sequence
  chemically synthesized
ggctaagcaaatccactagtcc

SEQ ID NO: 1129973 - DNA, 22 bp, Artificial Sequence
  chemically synthesized
ggtgacccctggactagtggat

SEQ ID NO: 1129974 - DNA, 22 bp, Artificial Sequence
  chemically synthesized
gtgacccctggactagtggatt

SEQ ID NO: 1129975 - DNA, 22 bp, Artificial Sequence
  chemically synthesized
tgtcagcttggctaagcaaatc

SEQ ID NO: 1129976 - DNA, 22 bp, Artificial Sequence
  chemically synthesized
gactagtggatttgcttagcca

SEQ ID NO: 1129977 - DNA, 22 bp, Artificial Sequence
  chemically synthesized
gttgtgtcagcttggctaagca

SEQ ID NO: 1129978 - DNA, 22 bp, Artificial Sequence
  chemically synthesized
cctggttgtgtcagcttggcta

SEQ ID NO: 1129979 - DNA, 22 bp, Artificial Sequence
  chemically synthesized
gtggatttgcttagccaagctg

SEQ ID NO: 1129980 - DNA, 22 bp, Artificial Sequence
  chemically synthesized
tccctggttgtgtcagcttggc

SEQ ID NO: 1129981 - DNA, 22 bp, Artificial Sequence
  chemically synthesized
ctccctggttgtgtcagcttgg

SEQ ID NO: 1129982 - DNA, 22 bp, Artificial Sequence
  chemically synthesized
tctccctggttgtgtcagcttg

SEQ ID NO: 1129983 - DNA, 22 bp, Artificial Sequence
  chemically synthesized
ttctccctggttgtgtcagctt

SEQ ID NO: 1129984 - DNA, 22 bp, Artificial Sequence
  chemically synthesized
gcttagccaagctgacacaacc

SEQ ID NO: 1129985 - DNA, 22 bp, Artificial Sequence
  chemically synthesized
cttagccaagctgacacaacca

SEQ ID NO: 1129986 - DNA, 22 bp, Artificial Sequence
  chemically synthesized
ggccttttctccctggttgtgt

SEQ ID NO: 1129987 - DNA, 22 bp, Artificial Sequence
  chemically synthesized
agccaagctgacacaaccaggg

SEQ ID NO: 1129988 - DNA, 22 bp, Artificial Sequence
  chemically synthesized
gccaagctgacacaaccaggga

SEQ ID NO: 1129989 - DNA, 22 bp, Artificial Sequence
  chemically synthesized
acacaaccagggagaaaaggcc

SEQ ID NO: 1129990 - DNA, 22 bp, Artificial Sequence
  chemically synthesized
caaagtaaatcactgggccttt

SEQ ID NO: 1129991 - DNA, 22 bp, Artificial Sequence
  chemically synthesized
ataattccaaagtaaatcactg

SEQ ID NO: 1129992 - DNA, 22 bp, Artificial Sequence
  chemically synthesized
gataattccaaagtaaatcact

SEQ ID NO: 1129993 - DNA, 22 bp, Artificial Sequence
  chemically synthesized
tgataattccaaagtaaatcac

SEQ ID NO: 1129994 - DNA, 22 bp, Artificial Sequence
  chemically synthesized
ctttgataattccaaagtaaat

SEQ ID NO: 1129995 - DNA, 22 bp, Artificial Sequence
  chemically synthesized
tgacctactttgataattccaa

SEQ ID NO: 1129996 - DNA, 22 bp, Artificial Sequence
  chemically synthesized
atgacctactttgataattcca

SEQ ID NO: 1129997 - DNA, 22 bp, Artificial Sequence
  chemically synthesized
atgacttatgacctactttgat

SEQ ID NO: 1129998 - DNA, 22 bp, Artificial Sequence
  chemically synthesized
actttggaattatcaaagtagg

SEQ ID NO: 1129999 - DNA, 22 bp, Artificial Sequence
  chemically synthesized
ctttggaattatcaaagtaggt

SEQ ID NO: 1130000 - DNA, 22 bp, Artificial Sequence
  chemically synthesized
actaatgacttatgacctactt

SEQ ID NO: 1130001 - DNA, 22 bp, Artificial Sequence
  chemically synthesized
tggaattatcaaagtaggtcat

SEQ ID NO: 1130002 - DNA, 22 bp, Artificial Sequence
  chemically synthesized
ggaattatcaaagtaggtcata

SEQ ID NO: 1130003 - DNA, 22 bp, Artificial Sequence
  chemically synthesized
gaattatcaaagtaggtcataa

SEQ ID NO: 1130004 - DNA, 22 bp, Artificial Sequence
  chemically synthesized
ttaactaatgacttatgaccta

SEQ ID NO: 1130005 - DNA, 22 bp, Artificial Sequence
  chemically synthesized
tattaactaatgacttatgacc

SEQ ID NO: 1130006 - DNA, 22 bp, Artificial Sequence
  chemically synthesized
tctattaactaatgacttatga

SEQ ID NO: 1130007 - DNA, 22 bp, Artificial Sequence
  chemically synthesized
ctctattaactaatgacttatg

SEQ ID NO: 1130008 - DNA, 22 bp, Artificial Sequence
  chemically synthesized
tcaaagtaggtcataagtcatt

SEQ ID NO: 1130009 - DNA, 22 bp, Artificial Sequence
  chemically synthesized
gtacttctctattaactaatga

SEQ ID NO: 1130010 - DNA, 22 bp, Artificial Sequence
  chemically synthesized
agtacttctctattaactaatg

SEQ ID NO: 1130011 - DNA, 22 bp, Artificial Sequence
  chemically synthesized
ggatgtttagtacttctctatt

SEQ ID NO: 1130012 - DNA, 22 bp, Artificial Sequence
  chemically synthesized
gggatgtttagtacttctctat

SEQ ID NO: 1130013 - DNA, 22 bp, Artificial Sequence
  chemically synthesized
tttgggatgtttagtacttctc

SEQ ID NO: 1130014 - DNA, 22 bp, Artificial Sequence
  chemically synthesized
gttaatagagaagtactaaaca

SEQ ID NO: 1130015 - DNA, 22 bp, Artificial Sequence
  chemically synthesized
atagagaagtactaaacatccc

SEQ ID NO: 1130016 - DNA, 22 bp, Artificial Sequence
  chemically synthesized
aaatatattatttgggatgttt

SEQ ID NO: 1130017 - DNA, 22 bp, Artificial Sequence
  chemically synthesized
ttcaaatatattatttgggatg

SEQ ID NO: 1130018 - DNA, 22 bp, Artificial Sequence
  chemically synthesized
gagaagttattcaaatatatta

SEQ ID NO: 1130019 - DNA, 22 bp, Artificial Sequence
  chemically synthesized
aacatcccaaataatatatttg

SEQ ID NO: 1130020 - DNA, 22 bp, Artificial Sequence
  chemically synthesized
agaaaaaaaataaatctagaga

SEQ ID NO: 1130021 - DNA, 22 bp, Artificial Sequence
  chemically synthesized
taagaaaaaaaataaatctaga

SEQ ID NO: 1130022 - DNA, 22 bp, Artificial Sequence
  chemically synthesized
gaataacttctctagatttatt

SEQ ID NO: 1130023 - DNA, 22 bp, Artificial Sequence
  chemically synthesized
aataacttctctagatttattt

SEQ ID NO: 1130024 - DNA, 22 bp, Artificial Sequence
  chemically synthesized
ctctagatttattttttttctt

SEQ ID NO: 1130025 - DNA, 22 bp, Artificial Sequence
  chemically synthesized
tctagatttattttttttctta

SEQ ID NO: 1130026 - DNA, 22 bp, Artificial Sequence
  chemically synthesized
tagatttattttttttcttaga

SEQ ID NO: 1130027 - DNA, 22 bp, Artificial Sequence
  chemically synthesized
gatttattttttttcttagaac

SEQ ID NO: 1130028 - DNA, 22 bp, Artificial Sequence
  chemically synthesized
attttttttcttagaacatctg

SEQ ID NO: 1130029 - DNA, 22 bp, Artificial Sequence
  chemically synthesized
aaaataccatgtcagatgttct

SEQ ID NO: 1130030 - DNA, 22 bp, Artificial Sequence
  chemically synthesized
ttttttttcttagaacatctga

SEQ ID NO: 1130031 - DNA, 22 bp, Artificial Sequence
  chemically synthesized
tttttcttagaacatctgacat

SEQ ID NO: 1130032 - DNA, 22 bp, Artificial Sequence
  chemically synthesized
ttttcttagaacatctgacatg

SEQ ID NO: 1130033 - DNA, 22 bp, Artificial Sequence
  chemically synthesized
tttcttagaacatctgacatgg

SEQ ID NO: 1130034 - DNA, 22 bp, Artificial Sequence
  chemically synthesized
ttcttagaacatctgacatggt

SEQ ID NO: 1130035 - DNA, 22 bp, Artificial Sequence
  chemically synthesized
tcttagaacatctgacatggta

SEQ ID NO: 1130036 - DNA, 22 bp, Artificial Sequence
  chemically synthesized
cttagaacatctgacatggtat

SEQ ID NO: 1130037 - DNA, 22 bp, Artificial Sequence
  chemically synthesized
ttagaacatctgacatggtatt

SEQ ID NO: 1130038 - DNA, 22 bp, Artificial Sequence
  chemically synthesized
agaacatctgacatggtatttt

SEQ ID NO: 1130039 - DNA, 22 bp, Artificial Sequence
  chemically synthesized
gaacatctgacatggtattttt

SEQ ID NO: 1130040 - DNA, 22 bp, Artificial Sequence
  chemically synthesized
aaaagaacacacatctaaaaat

SEQ ID NO: 1130041 - DNA, 22 bp, Artificial Sequence
  chemically synthesized
gaaaagaacacacatctaaaaa

SEQ ID NO: 1130042 - DNA, 22 bp, Artificial Sequence
  chemically synthesized
acatggtatttttagatgtgtg

SEQ ID NO: 1130043 - DNA, 22 bp, Artificial Sequence
  chemically synthesized
ttagatgtgtgttcttttcaaa

SEQ ID NO: 1130044 - DNA, 22 bp, Artificial Sequence
  chemically synthesized
tagatgtgtgttcttttcaaac

SEQ ID NO: 1130045 - DNA, 22 bp, Artificial Sequence
  chemically synthesized
agatgtgtgttcttttcaaact

SEQ ID NO: 1130046 - DNA, 22 bp, Artificial Sequence
  chemically synthesized
gatgtgtgttcttttcaaactt

SEQ ID NO: 1130047 - DNA, 22 bp, Artificial Sequence
  chemically synthesized
tgtataccagggtagagaagtt

SEQ ID NO: 1130048 - DNA, 22 bp, Artificial Sequence
  chemically synthesized
gtgtataccagggtagagaagt

SEQ ID NO: 1130049 - DNA, 22 bp, Artificial Sequence
  chemically synthesized
ttttcaaacttctctaccctgg

SEQ ID NO: 1130050 - DNA, 22 bp, Artificial Sequence
  chemically synthesized
gaatttgtgtataccagggtag

SEQ ID NO: 1130051 - DNA, 22 bp, Artificial Sequence
  chemically synthesized
ttcaaacttctctaccctggta

SEQ ID NO: 1130052 - DNA, 22 bp, Artificial Sequence
  chemically synthesized
tcaaacttctctaccctggtat

SEQ ID NO: 1130053 - DNA, 22 bp, Artificial Sequence
  chemically synthesized
caaacttctctaccctggtata

SEQ ID NO: 1130054 - DNA, 22 bp, Artificial Sequence
  chemically synthesized
aaacttctctaccctggtatac

SEQ ID NO: 1130055 - DNA, 22 bp, Artificial Sequence
  chemically synthesized
acattagaatttgtgtatacca

SEQ ID NO: 1130056 - DNA, 22 bp, Artificial Sequence
  chemically synthesized
gacattagaatttgtgtatacc

SEQ ID NO: 1130057 - DNA, 22 bp, Artificial Sequence
  chemically synthesized
ctctaccctggtatacacaaat

SEQ ID NO: 1130058 - DNA, 22 bp, Artificial Sequence
  chemically synthesized
tctaccctggtatacacaaatt

SEQ ID NO: 1130059 - DNA, 22 bp, Artificial Sequence
  chemically synthesized
taccctggtatacacaaattct

SEQ ID NO: 1130060 - DNA, 22 bp, Artificial Sequence
  chemically synthesized
ccctggtatacacaaattctaa

SEQ ID NO: 1130061 - DNA, 22 bp, Artificial Sequence
  chemically synthesized
atggaacacttgacattagaat

SEQ ID NO: 1130062 - DNA, 22 bp, Artificial Sequence
  chemically synthesized
gtatacacaaattctaatgtca

SEQ ID NO: 1130063 - DNA, 22 bp, Artificial Sequence
  chemically synthesized
gaaactcatggaacacttgaca

SEQ ID NO: 1130064 - DNA, 22 bp, Artificial Sequence
  chemically synthesized
agaaactcatggaacacttgac

SEQ ID NO: 1130065 - DNA, 22 bp, Artificial Sequence
  chemically synthesized
taatgtcaagtgttccatgagt

SEQ ID NO: 1130066 - DNA, 22 bp, Artificial Sequence
  chemically synthesized
atgtcaagtgttccatgagttt

SEQ ID NO: 1130067 - DNA, 22 bp, Artificial Sequence
  chemically synthesized
agcagcatatgtttagaaactc

SEQ ID NO: 1130068 - DNA, 22 bp, Artificial Sequence
  chemically synthesized
aagcagcatatgtttagaaact

SEQ ID NO: 1130069 - DNA, 22 bp, Artificial Sequence
  chemically synthesized
taagcagcatatgtttagaaac

SEQ ID NO: 1130070 - DNA, 22 bp, Artificial Sequence
  chemically synthesized
ttaagcagcatatgtttagaaa

SEQ ID NO: 1130071 - DNA, 22 bp, Artificial Sequence
  chemically synthesized
catgagtttctaaacatatgct

SEQ ID NO: 1130072 - DNA, 22 bp, Artificial Sequence
  chemically synthesized
ccgtatgtttttaagcagcata

SEQ ID NO: 1130073 - DNA, 22 bp, Artificial Sequence
  chemically synthesized
ctaaacatatgctgcttaaaaa

SEQ ID NO: 1130074 - DNA, 22 bp, Artificial Sequence
  chemically synthesized
taaacatatgctgcttaaaaac

SEQ ID NO: 1130075 - DNA, 22 bp, Artificial Sequence
  chemically synthesized
aaatctgccgtatgtttttaag

SEQ ID NO: 1130076 - DNA, 22 bp, Artificial Sequence
  chemically synthesized
aacatatgctgcttaaaaacat

SEQ ID NO: 1130077 - DNA, 22 bp, Artificial Sequence
  chemically synthesized
cttaaaaacatacggcagattt

SEQ ID NO: 1130078 - DNA, 22 bp, Artificial Sequence
  chemically synthesized
agaaagaacgttaaaatctgcc

SEQ ID NO: 1130079 - DNA, 22 bp, Artificial Sequence
  chemically synthesized
aaaaacatacggcagattttaa

SEQ ID NO: 1130080 - DNA, 22 bp, Artificial Sequence
  chemically synthesized
aaaacatacggcagattttaac

SEQ ID NO: 1130081 - DNA, 22 bp, Artificial Sequence
  chemically synthesized
agattaagaaagaacgttaaaa

SEQ ID NO: 1130082 - DNA, 22 bp, Artificial Sequence
  chemically synthesized
taagattaagaaagaacgttaa

SEQ ID NO: 1130083 - DNA, 22 bp, Artificial Sequence
  chemically synthesized
taattctaagattaagaaagaa

SEQ ID NO: 1130084 - DNA, 22 bp, Artificial Sequence
  chemically synthesized
ttgtaattctaagattaagaaa

SEQ ID NO: 1130085 - DNA, 22 bp, Artificial Sequence
  chemically synthesized
taacgttctttcttaatcttag

SEQ ID NO: 1130086 - DNA, 22 bp, Artificial Sequence
  chemically synthesized
aacgttctttcttaatcttaga

SEQ ID NO: 1130087 - DNA, 22 bp, Artificial Sequence
  chemically synthesized
acgttctttcttaatcttagaa

SEQ ID NO: 1130088 - DNA, 22 bp, Artificial Sequence
  chemically synthesized
cagttattgtaattctaagatt

SEQ ID NO: 1130089 - DNA, 22 bp, Artificial Sequence
  chemically synthesized
attccagttattgtaattctaa

SEQ ID NO: 1130090 - DNA, 22 bp, Artificial Sequence
  chemically synthesized
cattccagttattgtaattcta

SEQ ID NO: 1130091 - DNA, 22 bp, Artificial Sequence
  chemically synthesized
tttcttaatcttagaattacaa

SEQ ID NO: 1130092 - DNA, 22 bp, Artificial Sequence
  chemically synthesized
tcattccagttattgtaattct

SEQ ID NO: 1130093 - DNA, 22 bp, Artificial Sequence
  chemically synthesized
tcttaatcttagaattacaata

SEQ ID NO: 1130094 - DNA, 22 bp, Artificial Sequence
  chemically synthesized
cttaatcttagaattacaataa

SEQ ID NO: 1130095 - DNA, 22 bp, Artificial Sequence
  chemically synthesized
ttaatcttagaattacaataac

SEQ ID NO: 1130096 - DNA, 22 bp, Artificial Sequence
  chemically synthesized
cctttcattccagttattgtaa

SEQ ID NO: 1130097 - DNA, 22 bp, Artificial Sequence
  chemically synthesized
ccctttcattccagttattgta

SEQ ID NO: 1130098 - DNA, 22 bp, Artificial Sequence
  chemically synthesized
aatcttagaattacaataactg

SEQ ID NO: 1130099 - DNA, 22 bp, Artificial Sequence
  chemically synthesized
atcttagaattacaataactgg

SEQ ID NO: 1130100 - DNA, 22 bp, Artificial Sequence
  chemically synthesized
agaattacaataactggaatga

SEQ ID NO: 1130101 - DNA, 22 bp, Artificial Sequence
  chemically synthesized
gaattacaataactggaatgaa

SEQ ID NO: 1130102 - DNA, 22 bp, Artificial Sequence
  chemically synthesized
aaaggtacaatttccctttcat

SEQ ID NO: 1130103 - DNA, 22 bp, Artificial Sequence
  chemically synthesized
caataactggaatgaaagggaa

SEQ ID NO: 1130104 - DNA, 22 bp, Artificial Sequence
  chemically synthesized
aaaaggtacaatttccctttca

SEQ ID NO: 1130105 - DNA, 22 bp, Artificial Sequence
  chemically synthesized
taaaaggtacaatttccctttc

SEQ ID NO: 1130106 - DNA, 22 bp, Artificial Sequence
  chemically synthesized
ttttaaaaggtacaatttccct

SEQ ID NO: 1130107 - DNA, 22 bp, Artificial Sequence
  chemically synthesized
gaatgaaagggaaattgtacct

SEQ ID NO: 1130108 - DNA, 22 bp, Artificial Sequence
  chemically synthesized
gcataaaaattattttaaaagg

SEQ ID NO: 1130109 - DNA, 22 bp, Artificial Sequence
  chemically synthesized
taccttttaaaataatttttat

SEQ ID NO: 1130110 - DNA, 22 bp, Artificial Sequence
  chemically synthesized
tgagtgcaaagctggcataaaa

SEQ ID NO: 1130111 - DNA, 22 bp, Artificial Sequence
  chemically synthesized
atgagtgcaaagctggcataaa

SEQ ID NO: 1130112 - DNA, 22 bp, Artificial Sequence
  chemically synthesized
ttaaaataatttttatgccagc

SEQ ID NO: 1130113 - DNA, 22 bp, Artificial Sequence
  chemically synthesized
tatgagtgcaaagctggcataa

SEQ ID NO: 1130114 - DNA, 22 bp, Artificial Sequence
  chemically synthesized
taaaataatttttatgccagct

SEQ ID NO: 1130115 - DNA, 22 bp, Artificial Sequence
  chemically synthesized
aaaataatttttatgccagctt

SEQ ID NO: 1130116 - DNA, 22 bp, Artificial Sequence
  chemically synthesized
aaataatttttatgccagcttt

SEQ ID NO: 1130117 - DNA, 22 bp, Artificial Sequence
  chemically synthesized
ttatgccagctttgcactcata

SEQ ID NO: 1130118 - DNA, 22 bp, Artificial Sequence
  chemically synthesized
tatgccagctttgcactcataa

SEQ ID NO: 1130119 - DNA, 22 bp, Artificial Sequence
  chemically synthesized
atgccagctttgcactcataaa

SEQ ID NO: 1130120 - DNA, 22 bp, Artificial Sequence
  chemically synthesized
tgccagctttgcactcataaaa

SEQ ID NO: 1130121 - DNA, 22 bp, Artificial Sequence
  chemically synthesized
aaatgatggcaataaaatttta

SEQ ID NO: 1130122 - DNA, 22 bp, Artificial Sequence
  chemically synthesized
tgcactcataaaattttattgc

SEQ ID NO: 1130123 - DNA, 22 bp, Artificial Sequence
  chemically synthesized
gcactcataaaattttattgcc

SEQ ID NO: 1130124 - DNA, 22 bp, Artificial Sequence
  chemically synthesized
cactcataaaattttattgcca

SEQ ID NO: 1130125 - DNA, 22 bp, Artificial Sequence
  chemically synthesized
ataaaattttattgccatcatt

SEQ ID NO: 1130126 - DNA, 22 bp, Artificial Sequence
  chemically synthesized
tattgccatcattttaatatat

SEQ ID NO: 1130127 - DNA, 22 bp, Artificial Sequence
  chemically synthesized
attgccatcattttaatatatc

SEQ ID NO: 1130128 - DNA, 22 bp, Artificial Sequence
  chemically synthesized
tgtaaatcagtggatatattaa

SEQ ID NO: 1130129 - DNA, 22 bp, Artificial Sequence
  chemically synthesized
ttgccatcattttaatatatcc

SEQ ID NO: 1130130 - DNA, 22 bp, Artificial Sequence
  chemically synthesized
ccatcattttaatatatccact

SEQ ID NO: 1130131 - DNA, 22 bp, Artificial Sequence
  chemically synthesized
ggtattatgtaaatcagtggat

SEQ ID NO: 1130132 - DNA, 22 bp, Artificial Sequence
  chemically synthesized
taatatatccactgatttacat

SEQ ID NO: 1130133 - DNA, 22 bp, Artificial Sequence
  chemically synthesized
aatatatccactgatttacata

SEQ ID NO: 1130134 - DNA, 22 bp, Artificial Sequence
  chemically synthesized
atatatccactgatttacataa

SEQ ID NO: 1130135 - DNA, 22 bp, Artificial Sequence
  chemically synthesized
gataagttaggtattatgtaaa

SEQ ID NO: 1130136 - DNA, 22 bp, Artificial Sequence
  chemically synthesized
agataagttaggtattatgtaa

SEQ ID NO: 1130137 - DNA, 22 bp, Artificial Sequence
  chemically synthesized
tagataagttaggtattatgta

SEQ ID NO: 1130138 - DNA, 22 bp, Artificial Sequence
  chemically synthesized
tgcattttagataagttaggta

SEQ ID NO: 1130139 - DNA, 22 bp, Artificial Sequence
  chemically synthesized
atttacataatacctaacttat

SEQ ID NO: 1130140 - DNA, 22 bp, Artificial Sequence
  chemically synthesized
acataatacctaacttatctaa

SEQ ID NO: 1130141 - DNA, 22 bp, Artificial Sequence
  chemically synthesized
cataatacctaacttatctaaa

SEQ ID NO: 1130142 - DNA, 22 bp, Artificial Sequence
  chemically synthesized
agaattatgcattttagataag

SEQ ID NO: 1130143 - DNA, 22 bp, Artificial Sequence
  chemically synthesized
ttcagaattatgcattttagat

SEQ ID NO: 1130144 - DNA, 22 bp, Artificial Sequence
  chemically synthesized
tgactattcagaattatgcatt

SEQ ID NO: 1130145 - DNA, 22 bp, Artificial Sequence
  chemically synthesized
gtgactattcagaattatgcat

SEQ ID NO: 1130146 - DNA, 22 bp, Artificial Sequence
  chemically synthesized
acttatctaaaatgcataattc

SEQ ID NO: 1130147 - DNA, 22 bp, Artificial Sequence
  chemically synthesized
tgtgactattcagaattatgca

SEQ ID NO: 1130148 - DNA, 22 bp, Artificial Sequence
  chemically synthesized
ttgtgactattcagaattatgc

SEQ ID NO: 1130149 - DNA, 22 bp, Artificial Sequence
  chemically synthesized
tttgtgactattcagaattatg

SEQ ID NO: 1130150 - DNA, 22 bp, Artificial Sequence
  chemically synthesized
atctaaaatgcataattctgaa

SEQ ID NO: 1130151 - DNA, 22 bp, Artificial Sequence
  chemically synthesized
tctaaaatgcataattctgaat

SEQ ID NO: 1130152 - DNA, 22 bp, Artificial Sequence
  chemically synthesized
atctttttgtgactattcagaa

SEQ ID NO: 1130153 - DNA, 22 bp, Artificial Sequence
  chemically synthesized
aaatgcataattctgaatagtc

SEQ ID NO: 1130154 - DNA, 22 bp, Artificial Sequence
  chemically synthesized
actgatctttttgtgactattc

SEQ ID NO: 1130155 - DNA, 22 bp, Artificial Sequence
  chemically synthesized
aactgatctttttgtgactatt

SEQ ID NO: 1130156 - DNA, 22 bp, Artificial Sequence
  chemically synthesized
taactgatctttttgtgactat

SEQ ID NO: 1130157 - DNA, 22 bp, Artificial Sequence
  chemically synthesized
ttaactgatctttttgtgacta

SEQ ID NO: 1130158 - DNA, 22 bp, Artificial Sequence
  chemically synthesized
gaatttttaactgatctttttg

SEQ ID NO: 1130159 - DNA, 22 bp, Artificial Sequence
  chemically synthesized
tgaatagtcacaaaaagatcag

SEQ ID NO: 1130160 - DNA, 22 bp, Artificial Sequence
  chemically synthesized
aatagtcacaaaaagatcagtt

SEQ ID NO: 1130161 - DNA, 22 bp, Artificial Sequence
  chemically synthesized
aaggtgttagaatttttaactg

SEQ ID NO: 1130162 - DNA, 22 bp, Artificial Sequence
  chemically synthesized
gaaggtgttagaatttttaact

SEQ ID NO: 1130163 - DNA, 22 bp, Artificial Sequence
  chemically synthesized
tcttgaaggtgttagaattttt

SEQ ID NO: 1130164 - DNA, 22 bp, Artificial Sequence
  chemically synthesized
atcttgaaggtgttagaatttt

SEQ ID NO: 1130165 - DNA, 22 bp, Artificial Sequence
  chemically synthesized
taaagtcttatcttgaaggtgt

SEQ ID NO: 1130166 - DNA, 22 bp, Artificial Sequence
  chemically synthesized
ataaagtcttatcttgaaggtg

SEQ ID NO: 1130167 - DNA, 22 bp, Artificial Sequence
  chemically synthesized
aaaattctaacaccttcaagat

SEQ ID NO: 1130168 - DNA, 22 bp, Artificial Sequence
  chemically synthesized
atatttataaagtcttatcttg

SEQ ID NO: 1130169 - DNA, 22 bp, Artificial Sequence
  chemically synthesized
gatatttataaagtcttatctt

SEQ ID NO: 1130170 - DNA, 22 bp, Artificial Sequence
  chemically synthesized
tgatatttataaagtcttatct

SEQ ID NO: 1130171 - DNA, 22 bp, Artificial Sequence
  chemically synthesized
taacaccttcaagataagactt

SEQ ID NO: 1130172 - DNA, 22 bp, Artificial Sequence
  chemically synthesized
tttgatatttataaagtcttat

SEQ ID NO: 1130173 - DNA, 22 bp, Artificial Sequence
  chemically synthesized
acaccttcaagataagacttta

SEQ ID NO: 1130174 - DNA, 22 bp, Artificial Sequence
  chemically synthesized
ttctttgatatttataaagtct

SEQ ID NO: 1130175 - DNA, 22 bp, Artificial Sequence
  chemically synthesized
ctgttctttgatatttataaag

SEQ ID NO: 1130176 - DNA, 22 bp, Artificial Sequence
  chemically synthesized
cctgttctttgatatttataaa

SEQ ID NO: 1130177 - DNA, 22 bp, Artificial Sequence
  chemically synthesized
caagataagactttataaatat

SEQ ID NO: 1130178 - DNA, 22 bp, Artificial Sequence
  chemically synthesized
aagataagactttataaatatc

SEQ ID NO: 1130179 - DNA, 22 bp, Artificial Sequence
  chemically synthesized
cagaacacatttcctgttcttt

SEQ ID NO: 1130180 - DNA, 22 bp, Artificial Sequence
  chemically synthesized
tataaatatcaaagaacaggaa

SEQ ID NO: 1130181 - DNA, 22 bp, Artificial Sequence
  chemically synthesized
ataaatatcaaagaacaggaaa

SEQ ID NO: 1130182 - DNA, 22 bp, Artificial Sequence
  chemically synthesized
taaatatcaaagaacaggaaat

SEQ ID NO: 1130183 - DNA, 22 bp, Artificial Sequence
  chemically synthesized
aatcaggagtaattacagaaca

SEQ ID NO: 1130184 - DNA, 22 bp, Artificial Sequence
  chemically synthesized
cgcatcctaaatcaggagtaat

SEQ ID NO: 1130185 - DNA, 22 bp, Artificial Sequence
  chemically synthesized
agtctgcgcatcctaaatcagg

SEQ ID NO: 1130186 - DNA, 22 bp, Artificial Sequence
  chemically synthesized
tgtaattactcctgatttagga

SEQ ID NO: 1130187 - DNA, 22 bp, Artificial Sequence
  chemically synthesized
taattactcctgatttaggatg

SEQ ID NO: 1130188 - DNA, 22 bp, Artificial Sequence
  chemically synthesized
ctcctgatttaggatgcgcaga

SEQ ID NO: 1130189 - DNA, 22 bp, Artificial Sequence
  chemically synthesized
ctgatttaggatgcgcagactg

SEQ ID NO: 1130190 - DNA, 22 bp, Artificial Sequence
  chemically synthesized
atttaggatgcgcagactgaga

SEQ ID NO: 1130191 - DNA, 22 bp, Artificial Sequence
  chemically synthesized
cgagaacatgatgtctcagtct

SEQ ID NO: 1130192 - DNA, 22 bp, Artificial Sequence
  chemically synthesized
acgagaacatgatgtctcagtc

SEQ ID NO: 1130193 - DNA, 22 bp, Artificial Sequence
  chemically synthesized
aggatgcgcagactgagacatc

SEQ ID NO: 1130194 - DNA, 22 bp, Artificial Sequence
  chemically synthesized
ggatgcgcagactgagacatca

SEQ ID NO: 1130195 - DNA, 22 bp, Artificial Sequence
  chemically synthesized
gtagtttacgagaacatgatgt

SEQ ID NO: 1130196 - DNA, 22 bp, Artificial Sequence
  chemically synthesized
agacatcatgttctcgtaaact

SEQ ID NO: 1130197 - DNA, 22 bp, Artificial Sequence
  chemically synthesized
taatagatgggatccatcctgg

SEQ ID NO: 1130198 - DNA, 22 bp, Artificial Sequence
  chemically synthesized
tcgtaaactaccaggatggatc

SEQ ID NO: 1130199 - DNA, 22 bp, Artificial Sequence
  chemically synthesized
gtaaactaccaggatggatccc

SEQ ID NO: 1130200 - DNA, 22 bp, Artificial Sequence
  chemically synthesized
ccaggatggatcccatctatta

SEQ ID NO: 1130201 - DNA, 22 bp, Artificial Sequence
  chemically synthesized
atgaagaagtacacctataata

SEQ ID NO: 1130202 - DNA, 22 bp, Artificial Sequence
  chemically synthesized
catgaagaagtacacctataat

SEQ ID NO: 1130203 - DNA, 22 bp, Artificial Sequence
  chemically synthesized
tcatgaagaagtacacctataa

SEQ ID NO: 1130204 - DNA, 22 bp, Artificial Sequence
  chemically synthesized
ttataggtgtacttcttcatga

SEQ ID NO: 1130205 - DNA, 22 bp, Artificial Sequence
  chemically synthesized
taggtgtacttcttcatgaaaa

SEQ ID NO: 1130206 - DNA, 22 bp, Artificial Sequence
  chemically synthesized
cagtaacggaaagtgcattttc

SEQ ID NO: 1130207 - DNA, 22 bp, Artificial Sequence
  chemically synthesized
ccagtaacggaaagtgcatttt

SEQ ID NO: 1130208 - DNA, 22 bp, Artificial Sequence
  chemically synthesized
tccagtaacggaaagtgcattt

SEQ ID NO: 1130209 - DNA, 22 bp, Artificial Sequence
  chemically synthesized
ttccagtaacggaaagtgcatt

SEQ ID NO: 1130210 - DNA, 22 bp, Artificial Sequence
  chemically synthesized
tttccagtaacggaaagtgcat

SEQ ID NO: 1130211 - DNA, 22 bp, Artificial Sequence
  chemically synthesized
ttttccagtaacggaaagtgca

SEQ ID NO: 1130212 - DNA, 22 bp, Artificial Sequence
  chemically synthesized
cttcatgaaaatgcactttccg

SEQ ID NO: 1130213 - DNA, 22 bp, Artificial Sequence
  chemically synthesized
tttttccagtaacggaaagtgc

SEQ ID NO: 1130214 - DNA, 22 bp, Artificial Sequence
  chemically synthesized
ttcatgaaaatgcactttccgt

SEQ ID NO: 1130215 - DNA, 22 bp, Artificial Sequence
  chemically synthesized
ttttttccagtaacggaaagtg

SEQ ID NO: 1130216 - DNA, 22 bp, Artificial Sequence
  chemically synthesized
catgaaaatgcactttccgtta

SEQ ID NO: 1130217 - DNA, 22 bp, Artificial Sequence
  chemically synthesized
atgaaaatgcactttccgttac

SEQ ID NO: 1130218 - DNA, 22 bp, Artificial Sequence
  chemically synthesized
aatgtcttttttttccagtaac

SEQ ID NO: 1130219 - DNA, 22 bp, Artificial Sequence
  chemically synthesized
cattaaatgtcttttttttcca

SEQ ID NO: 1130220 - DNA, 22 bp, Artificial Sequence
  chemically synthesized
gcattaaatgtcttttttttcc

SEQ ID NO: 1130221 - DNA, 22 bp, Artificial Sequence
  chemically synthesized
tgcattaaatgtcttttttttc

SEQ ID NO: 1130222 - DNA, 22 bp, Artificial Sequence
  chemically synthesized
tccgttactggaaaaaaaagac

SEQ ID NO: 1130223 - DNA, 22 bp, Artificial Sequence
  chemically synthesized
ccgttactggaaaaaaaagaca

SEQ ID NO: 1130224 - DNA, 22 bp, Artificial Sequence
  chemically synthesized
cgttactggaaaaaaaagacat

SEQ ID NO: 1130225 - DNA, 22 bp, Artificial Sequence
  chemically synthesized
gttttgcattaaatgtcttttt

SEQ ID NO: 1130226 - DNA, 22 bp, Artificial Sequence
  chemically synthesized
ctggaaaaaaaagacatttaat

SEQ ID NO: 1130227 - DNA, 22 bp, Artificial Sequence
  chemically synthesized
gaaaaaaaagacatttaatgca

SEQ ID NO: 1130228 - DNA, 22 bp, Artificial Sequence
  chemically synthesized
agtccctagttttgcattaaat

SEQ ID NO: 1130229 - DNA, 22 bp, Artificial Sequence
  chemically synthesized
ttgagtccctagttttgcatta

SEQ ID NO: 1130230 - DNA, 22 bp, Artificial Sequence
  chemically synthesized
gttgagtccctagttttgcatt

SEQ ID NO: 1130231 - DNA, 22 bp, Artificial Sequence
  chemically synthesized
cttgttgagtccctagttttgc

SEQ ID NO: 1130232 - DNA, 22 bp, Artificial Sequence
  chemically synthesized
aatgcaaaactagggactcaac

SEQ ID NO: 1130233 - DNA, 22 bp, Artificial Sequence
  chemically synthesized
atgcaaaactagggactcaaca

SEQ ID NO: 1130234 - DNA, 22 bp, Artificial Sequence
  chemically synthesized
taaagggcctgcttgttgagtc

SEQ ID NO: 1130235 - DNA, 22 bp, Artificial Sequence
  chemically synthesized
ataaagggcctgcttgttgagt

SEQ ID NO: 1130236 - DNA, 22 bp, Artificial Sequence
  chemically synthesized
cttataaagggcctgcttgttg

SEQ ID NO: 1130237 - DNA, 22 bp, Artificial Sequence
  chemically synthesized
ccttataaagggcctgcttgtt

SEQ ID NO: 1130238 - DNA, 22 bp, Artificial Sequence
  chemically synthesized
ttccttataaagggcctgcttg

SEQ ID NO: 1130239 - DNA, 22 bp, Artificial Sequence
  chemically synthesized
cttccttataaagggcctgctt

SEQ ID NO: 1130240 - DNA, 22 bp, Artificial Sequence
  chemically synthesized
tcttccttataaagggcctgct

SEQ ID NO: 1130241 - DNA, 22 bp, Artificial Sequence
  chemically synthesized
gggactcaacaagcaggccctt

SEQ ID NO: 1130242 - DNA, 22 bp, Artificial Sequence
  chemically synthesized
ttcttccttataaagggcctgc

SEQ ID NO: 1130243 - DNA, 22 bp, Artificial Sequence
  chemically synthesized
tttcttccttataaagggcctg

SEQ ID NO: 1130244 - DNA, 22 bp, Artificial Sequence
  chemically synthesized
ttttcttccttataaagggcct

SEQ ID NO: 1130245 - DNA, 22 bp, Artificial Sequence
  chemically synthesized
tttttcttccttataaagggcc

SEQ ID NO: 1130246 - DNA, 22 bp, Artificial Sequence
  chemically synthesized
ttttttcttccttataaagggc

SEQ ID NO: 1130247 - DNA, 22 bp, Artificial Sequence
  chemically synthesized
tttttttcttccttataaaggg

SEQ ID NO: 1130248 - DNA, 22 bp, Artificial Sequence
  chemically synthesized
ttttttttcttccttataaagg

SEQ ID NO: 1130249 - DNA, 22 bp, Artificial Sequence
  chemically synthesized
aacaagcaggccctttataagg

SEQ ID NO: 1130250 - DNA, 22 bp, Artificial Sequence
  chemically synthesized
tttttttttcttccttataaag

SEQ ID NO: 1130251 - DNA, 22 bp, Artificial Sequence
  chemically synthesized
ttttttttttcttccttataaa

SEQ ID NO: 1130252 - DNA, 22 bp, Artificial Sequence
  chemically synthesized
ttttttttttttcttccttata

SEQ ID NO: 1130253 - DNA, 22 bp, Artificial Sequence
  chemically synthesized
cttttttttttttcttccttat

SEQ ID NO: 1130254 - DNA, 22 bp, Artificial Sequence
  chemically synthesized
tcttttttttttttcttcctta

SEQ ID NO: 1130255 - DNA, 22 bp, Artificial Sequence
  chemically synthesized
tttcttttttttttttcttcct

SEQ ID NO: 1130256 - DNA, 22 bp, Artificial Sequence
  chemically synthesized
ctttcttttttttttttcttcc

SEQ ID NO: 1130257 - DNA, 22 bp, Artificial Sequence
  chemically synthesized
tctttcttttttttttttcttc

SEQ ID NO: 1130258 - DNA, 22 bp, Artificial Sequence
  chemically synthesized
tttctttcttttttttttttct

SEQ ID NO: 1130259 - DNA, 22 bp, Artificial Sequence
  chemically synthesized
ctttctttcttttttttttttc

SEQ ID NO: 1130260 - DNA, 22 bp, Artificial Sequence
  chemically synthesized
tataaggaagaaaaaaaaaaaa

SEQ ID NO: 1130261 - DNA, 22 bp, Artificial Sequence
  chemically synthesized
ataaggaagaaaaaaaaaaaag

SEQ ID NO: 1130262 - DNA, 22 bp, Artificial Sequence
  chemically synthesized
taaggaagaaaaaaaaaaaaga

SEQ ID NO: 1130263 - DNA, 22 bp, Artificial Sequence
  chemically synthesized
aaagtttctttctttctttttt

SEQ ID NO: 1130264 - DNA, 22 bp, Artificial Sequence
  chemically synthesized
atcctaaaagtttctttctttc

SEQ ID NO: 1130265 - DNA, 22 bp, Artificial Sequence
  chemically synthesized
aatcctaaaagtttctttcttt

SEQ ID NO: 1130266 - DNA, 22 bp, Artificial Sequence
  chemically synthesized
taatcctaaaagtttctttctt

SEQ ID NO: 1130267 - DNA, 22 bp, Artificial Sequence
  chemically synthesized
tggtagcattttaatcctaaaa

SEQ ID NO: 1130268 - DNA, 22 bp, Artificial Sequence
  chemically synthesized
ctgtggtagcattttaatccta

SEQ ID NO: 1130269 - DNA, 22 bp, Artificial Sequence
  chemically synthesized
ttaggattaaaatgctaccaca

SEQ ID NO: 1130270 - DNA, 22 bp, Artificial Sequence
  chemically synthesized
taggattaaaatgctaccacag

SEQ ID NO: 1130271 - DNA, 22 bp, Artificial Sequence
  chemically synthesized
aggattaaaatgctaccacagt

SEQ ID NO: 1130272 - DNA, 22 bp, Artificial Sequence
  chemically synthesized
ggattaaaatgctaccacagta

SEQ ID NO: 1130273 - DNA, 22 bp, Artificial Sequence
  chemically synthesized
taggtgataaactactgtggta

SEQ ID NO: 1130274 - DNA, 22 bp, Artificial Sequence
  chemically synthesized
aaatgctaccacagtagtttat

SEQ ID NO: 1130275 - DNA, 22 bp, Artificial Sequence
  chemically synthesized
tagaaactataggtgataaact

SEQ ID NO: 1130276 - DNA, 22 bp, Artificial Sequence
  chemically synthesized
ccacagtagtttatcacctata

SEQ ID NO: 1130277 - DNA, 22 bp, Artificial Sequence
  chemically synthesized
atcacctatagtttctatagtt

SEQ ID NO: 1130278 - DNA, 22 bp, Artificial Sequence
  chemically synthesized
tcacctatagtttctatagttt

SEQ ID NO: 1130279 - DNA, 22 bp, Artificial Sequence
  chemically synthesized
gggtgaaagaagaaactataga

SEQ ID NO: 1130280 - DNA, 22 bp, Artificial Sequence
  chemically synthesized
tggggtgaaagaagaaactata

SEQ ID NO: 1130281 - DNA, 22 bp, Artificial Sequence
  chemically synthesized
ctggggtgaaagaagaaactat

SEQ ID NO: 1130282 - DNA, 22 bp, Artificial Sequence
  chemically synthesized
tctggggtgaaagaagaaacta

SEQ ID NO: 1130283 - DNA, 22 bp, Artificial Sequence
  chemically synthesized
tagtttctatagtttcttcttt

SEQ ID NO: 1130284 - DNA, 22 bp, Artificial Sequence
  chemically synthesized
ctatagtttcttctttcacccc

SEQ ID NO: 1130285 - DNA, 22 bp, Artificial Sequence
  chemically synthesized
tatagtttcttctttcacccca

SEQ ID NO: 1130286 - DNA, 22 bp, Artificial Sequence
  chemically synthesized
tagtttcttctttcaccccaga

SEQ ID NO: 1130287 - DNA, 22 bp, Artificial Sequence
  chemically synthesized
atggaaatggtgttttctgggg

SEQ ID NO: 1130288 - DNA, 22 bp, Artificial Sequence
  chemically synthesized
aatggaaatggtgttttctggg

SEQ ID NO: 1130289 - DNA, 22 bp, Artificial Sequence
  chemically synthesized
cttctttcaccccagaaaacac

SEQ ID NO: 1130290 - DNA, 22 bp, Artificial Sequence
  chemically synthesized
ttctttcaccccagaaaacacc

SEQ ID NO: 1130291 - DNA, 22 bp, Artificial Sequence
  chemically synthesized
ctttcaccccagaaaacaccat

SEQ ID NO: 1130292 - DNA, 22 bp, Artificial Sequence
  chemically synthesized
tttcaccccagaaaacaccatt

SEQ ID NO: 1130293 - DNA, 22 bp, Artificial Sequence
  chemically synthesized
tcaccccagaaaacaccatttc

SEQ ID NO: 1130294 - DNA, 22 bp, Artificial Sequence
  chemically synthesized
caccccagaaaacaccatttcc

SEQ ID NO: 1130295 - DNA, 22 bp, Artificial Sequence
  chemically synthesized
accccagaaaacaccatttcca

SEQ ID NO: 1130296 - DNA, 22 bp, Artificial Sequence
  chemically synthesized
tcgcaacagaaagtaaatgctt

SEQ ID NO: 1130297 - DNA, 22 bp, Artificial Sequence
  chemically synthesized
ccattaagcatttactttctgt

SEQ ID NO: 1130298 - DNA, 22 bp, Artificial Sequence
  chemically synthesized
cattaagcatttactttctgtt

SEQ ID NO: 1130299 - DNA, 22 bp, Artificial Sequence
  chemically synthesized
agcatttactttctgttgcgat

SEQ ID NO: 1130300 - DNA, 22 bp, Artificial Sequence
  chemically synthesized
acaagaaatcactatcgcaaca

SEQ ID NO: 1130301 - DNA, 22 bp, Artificial Sequence
  chemically synthesized
cacaagaaatcactatcgcaac

SEQ ID NO: 1130302 - DNA, 22 bp, Artificial Sequence
  chemically synthesized
tcacaagaaatcactatcgcaa

SEQ ID NO: 1130303 - DNA, 22 bp, Artificial Sequence
  chemically synthesized
actttctgttgcgatagtgatt

SEQ ID NO: 1130304 - DNA, 22 bp, Artificial Sequence
  chemically synthesized
ctttctgttgcgatagtgattt

SEQ ID NO: 1130305 - DNA, 22 bp, Artificial Sequence
  chemically synthesized
aaactttcacaagaaatcacta

SEQ ID NO: 1130306 - DNA, 22 bp, Artificial Sequence
  chemically synthesized
aaaactttcacaagaaatcact

SEQ ID NO: 1130307 - DNA, 22 bp, Artificial Sequence
  chemically synthesized
tctgttgcgatagtgatttctt

SEQ ID NO: 1130308 - DNA, 22 bp, Artificial Sequence
  chemically synthesized
taaaactttcacaagaaatcac

SEQ ID NO: 1130309 - DNA, 22 bp, Artificial Sequence
  chemically synthesized
ctgttgcgatagtgatttcttg

SEQ ID NO: 1130310 - DNA, 22 bp, Artificial Sequence
  chemically synthesized
tgttgcgatagtgatttcttgt

SEQ ID NO: 1130311 - DNA, 22 bp, Artificial Sequence
  chemically synthesized
ttgcgatagtgatttcttgtga

SEQ ID NO: 1130312 - DNA, 22 bp, Artificial Sequence
  chemically synthesized
cgatagtgatttcttgtgaaag

SEQ ID NO: 1130313 - DNA, 22 bp, Artificial Sequence
  chemically synthesized
tgaagtacattttaaaactttc

SEQ ID NO: 1130314 - DNA, 22 bp, Artificial Sequence
  chemically synthesized
cttgtgaaagttttaaaatgta

SEQ ID NO: 1130315 - DNA, 22 bp, Artificial Sequence
  chemically synthesized
ttgtgaaagttttaaaatgtac

SEQ ID NO: 1130316 - DNA, 22 bp, Artificial Sequence
  chemically synthesized
gtgaaagttttaaaatgtactt

SEQ ID NO: 1130317 - DNA, 22 bp, Artificial Sequence
  chemically synthesized
tgaaagttttaaaatgtacttc

SEQ ID NO: 1130318 - DNA, 22 bp, Artificial Sequence
  chemically synthesized
atgtagtgagaaaaattatgaa

SEQ ID NO: 1130319 - DNA, 22 bp, Artificial Sequence
  chemically synthesized
taaaatgtacttcataattttt

SEQ ID NO: 1130320 - DNA, 22 bp, Artificial Sequence
  chemically synthesized
aaaatgtacttcataatttttc

SEQ ID NO: 1130321 - DNA, 22 bp, Artificial Sequence
  chemically synthesized
aaatgtacttcataatttttct

SEQ ID NO: 1130322 - DNA, 22 bp, Artificial Sequence
  chemically synthesized
taatgtcagttaatgtagtgag

SEQ ID NO: 1130323 - DNA, 22 bp, Artificial Sequence
  chemically synthesized
cataatttttctcactacatta

SEQ ID NO: 1130324 - DNA, 22 bp, Artificial Sequence
  chemically synthesized
ataatttttctcactacattaa

SEQ ID NO: 1130325 - DNA, 22 bp, Artificial Sequence
  chemically synthesized
gggtacctgtaatgtcagttaa

SEQ ID NO: 1130326 - DNA, 22 bp, Artificial Sequence
  chemically synthesized
ttctcactacattaactgacat

SEQ ID NO: 1130327 - DNA, 22 bp, Artificial Sequence
  chemically synthesized
tctcactacattaactgacatt

SEQ ID NO: 1130328 - DNA, 22 bp, Artificial Sequence
  chemically synthesized
ctcactacattaactgacatta

SEQ ID NO: 1130329 - DNA, 22 bp, Artificial Sequence
  chemically synthesized
tcactacattaactgacattac

SEQ ID NO: 1130330 - DNA, 22 bp, Artificial Sequence
  chemically synthesized
actacattaactgacattacag

SEQ ID NO: 1130331 - DNA, 22 bp, Artificial Sequence
  chemically synthesized
cattaactgacattacaggtac

SEQ ID NO: 1130332 - DNA, 22 bp, Artificial Sequence
  chemically synthesized
cagaatcctcgggtacctgtaa

SEQ ID NO: 1130333 - DNA, 22 bp, Artificial Sequence
  chemically synthesized
ccagaatcctcgggtacctgta

SEQ ID NO: 1130334 - DNA, 22 bp, Artificial Sequence
  chemically synthesized
actgacattacaggtacccgag

SEQ ID NO: 1130335 - DNA, 22 bp, Artificial Sequence
  chemically synthesized
acattacaggtacccgaggatt

SEQ ID NO: 1130336 - DNA, 22 bp, Artificial Sequence
  chemically synthesized
agcaatatttccagaatcctcg

SEQ ID NO: 1130337 - DNA, 22 bp, Artificial Sequence
  chemically synthesized
cagcaatatttccagaatcctc

SEQ ID NO: 1130338 - DNA, 22 bp, Artificial Sequence
  chemically synthesized
caggtacccgaggattctggaa

SEQ ID NO: 1130339 - DNA, 22 bp, Artificial Sequence
  chemically synthesized
acttcagcaatatttccagaat

SEQ ID NO: 1130340 - DNA, 22 bp, Artificial Sequence
  chemically synthesized
cacttcagcaatatttccagaa

SEQ ID NO: 1130341 - DNA, 22 bp, Artificial Sequence
  chemically synthesized
tcacttcagcaatatttccaga

SEQ ID NO: 1130342 - DNA, 22 bp, Artificial Sequence
  chemically synthesized
gtggtgttttcacttcagcaat

SEQ ID NO: 1130343 - DNA, 22 bp, Artificial Sequence
  chemically synthesized
ttggtggtgttttcacttcagc

SEQ ID NO: 1130344 - DNA, 22 bp, Artificial Sequence
  chemically synthesized
gttggtggtgttttcacttcag

SEQ ID NO: 1130345 - DNA, 22 bp, Artificial Sequence
  chemically synthesized
tggaaatattgctgaagtgaaa

SEQ ID NO: 1130346 - DNA, 22 bp, Artificial Sequence
  chemically synthesized
tgttggtggtgttttcacttca

SEQ ID NO: 1130347 - DNA, 22 bp, Artificial Sequence
  chemically synthesized
gaaatattgctgaagtgaaaac

SEQ ID NO: 1130348 - DNA, 22 bp, Artificial Sequence
  chemically synthesized
cagcagttttgttggtggtgtt

SEQ ID NO: 1130349 - DNA, 22 bp, Artificial Sequence
  chemically synthesized
acagcagttttgttggtggtgt

SEQ ID NO: 1130350 - DNA, 22 bp, Artificial Sequence
  chemically synthesized
ctgaagtgaaaacaccaccaac

SEQ ID NO: 1130351 - DNA, 22 bp, Artificial Sequence
  chemically synthesized
aagtgaaaacaccaccaacaaa

SEQ ID NO: 1130352 - DNA, 22 bp, Artificial Sequence
  chemically synthesized
atttacagcagttttgttggtg

SEQ ID NO: 1130353 - DNA, 22 bp, Artificial Sequence
  chemically synthesized
caaatgaagtggagaaaactca

SEQ ID NO: 1130354 - DNA, 22 bp, Artificial Sequence
  chemically synthesized
tctgcaaatgaagtggagaaaa

SEQ ID NO: 1130355 - DNA, 22 bp, Artificial Sequence
  chemically synthesized
ctgtaaatgagttttctccact

SEQ ID NO: 1130356 - DNA, 22 bp, Artificial Sequence
  chemically synthesized
atctgcaaatgaagtggagaaa

SEQ ID NO: 1130357 - DNA, 22 bp, Artificial Sequence
  chemically synthesized
tatctgcaaatgaagtggagaa

SEQ ID NO: 1130358 - DNA, 22 bp, Artificial Sequence
  chemically synthesized
ttatctgcaaatgaagtggaga

SEQ ID NO: 1130359 - DNA, 22 bp, Artificial Sequence
  chemically synthesized
taaatgagttttctccacttca

SEQ ID NO: 1130360 - DNA, 22 bp, Artificial Sequence
  chemically synthesized
agcttttatctgcaaatgaagt

SEQ ID NO: 1130361 - DNA, 22 bp, Artificial Sequence
  chemically synthesized
aagcttttatctgcaaatgaag

SEQ ID NO: 1130362 - DNA, 22 bp, Artificial Sequence
  chemically synthesized
tctccacttcatttgcagataa

SEQ ID NO: 1130363 - DNA, 22 bp, Artificial Sequence
  chemically synthesized
ctccacttcatttgcagataaa

SEQ ID NO: 1130364 - DNA, 22 bp, Artificial Sequence
  chemically synthesized
tccacttcatttgcagataaaa

SEQ ID NO: 1130365 - DNA, 22 bp, Artificial Sequence
  chemically synthesized
cacttcatttgcagataaaagc

SEQ ID NO: 1130366 - DNA, 22 bp, Artificial Sequence
  chemically synthesized
catttgcagataaaagcttaag

SEQ ID NO: 1130367 - DNA, 22 bp, Artificial Sequence
  chemically synthesized
atttgcagataaaagcttaaga

SEQ ID NO: 1130368 - DNA, 22 bp, Artificial Sequence
  chemically synthesized
gcagataaaagcttaagatgct

SEQ ID NO: 1130369 - DNA, 22 bp, Artificial Sequence
  chemically synthesized
ggaaaaggtgagagcatcttaa

SEQ ID NO: 1130370 - DNA, 22 bp, Artificial Sequence
  chemically synthesized
cagataaaagcttaagatgctc

SEQ ID NO: 1130371 - DNA, 22 bp, Artificial Sequence
  chemically synthesized
aaattaggaaaaggtgagagca

SEQ ID NO: 1130372 - DNA, 22 bp, Artificial Sequence
  chemically synthesized
tgaaattaggaaaaggtgagag

SEQ ID NO: 1130373 - DNA, 22 bp, Artificial Sequence
  chemically synthesized
aagatgctctcaccttttccta

SEQ ID NO: 1130374 - DNA, 22 bp, Artificial Sequence
  chemically synthesized
agatgctctcaccttttcctaa

SEQ ID NO: 1130375 - DNA, 22 bp, Artificial Sequence
  chemically synthesized
tggattctgaaattaggaaaag

SEQ ID NO: 1130376 - DNA, 22 bp, Artificial Sequence
  chemically synthesized
ctgtggattctgaaattaggaa

SEQ ID NO: 1130377 - DNA, 22 bp, Artificial Sequence
  chemically synthesized
tcaccttttcctaatttcagaa

SEQ ID NO: 1130378 - DNA, 22 bp, Artificial Sequence
  chemically synthesized
accttttcctaatttcagaatc

SEQ ID NO: 1130379 - DNA, 22 bp, Artificial Sequence
  chemically synthesized
ttcctaatttcagaatccacag

SEQ ID NO: 1130380 - DNA, 22 bp, Artificial Sequence
  chemically synthesized
tcctaatttcagaatccacagt

SEQ ID NO: 1130381 - DNA, 22 bp, Artificial Sequence
  chemically synthesized
cctaatttcagaatccacagta

SEQ ID NO: 1130382 - DNA, 22 bp, Artificial Sequence
  chemically synthesized
ctaatttcagaatccacagtaa

SEQ ID NO: 1130383 - DNA, 22 bp, Artificial Sequence
  chemically synthesized
atttcagaatccacagtaatct

SEQ ID NO: 1130384 - DNA, 22 bp, Artificial Sequence
  chemically synthesized
cccaaaagaagaggcagattac

SEQ ID NO: 1130385 - DNA, 22 bp, Artificial Sequence
  chemically synthesized
cagaatccacagtaatctgcct

SEQ ID NO: 1130386 - DNA, 22 bp, Artificial Sequence
  chemically synthesized
agaatccacagtaatctgcctc

SEQ ID NO: 1130387 - DNA, 22 bp, Artificial Sequence
  chemically synthesized
caccaccacctccccaaaagaa

SEQ ID NO: 1130388 - DNA, 22 bp, Artificial Sequence
  chemically synthesized
ccaccaccacctccccaaaaga

SEQ ID NO: 1130389 - DNA, 22 bp, Artificial Sequence
  chemically synthesized
cctcttcttttggggaggtggt

SEQ ID NO: 1130390 - DNA, 22 bp, Artificial Sequence
  chemically synthesized
ttcttttggggaggtggtggtg

SEQ ID NO: 1130391 - DNA, 22 bp, Artificial Sequence
  chemically synthesized
aagaggaacttccaccaccacc

SEQ ID NO: 1130392 - DNA, 22 bp, Artificial Sequence
  chemically synthesized
cttttggggaggtggtggtgga

SEQ ID NO: 1130393 - DNA, 22 bp, Artificial Sequence
  chemically synthesized
ttttggggaggtggtggtggaa

SEQ ID NO: 1130394 - DNA, 22 bp, Artificial Sequence
  chemically synthesized
ttggggaggtggtggtggaagt

SEQ ID NO: 1130395 - DNA, 22 bp, Artificial Sequence
  chemically synthesized
tggggaggtggtggtggaagtt

SEQ ID NO: 1130396 - DNA, 22 bp, Artificial Sequence
  chemically synthesized
ggggaggtggtggtggaagttc

SEQ ID NO: 1130397 - DNA, 22 bp, Artificial Sequence
  chemically synthesized
gggaggtggtggtggaagttcc

SEQ ID NO: 1130398 - DNA, 22 bp, Artificial Sequence
  chemically synthesized
gtaaagcatgctcaagaggaac

SEQ ID NO: 1130399 - DNA, 22 bp, Artificial Sequence
  chemically synthesized
ctcttgagcatgctttaccagg

SEQ ID NO: 1130400 - DNA, 22 bp, Artificial Sequence
  chemically synthesized
ttgagcatgctttaccaggatc

SEQ ID NO: 1130401 - DNA, 22 bp, Artificial Sequence
  chemically synthesized
gagcatgctttaccaggatctg

SEQ ID NO: 1130402 - DNA, 22 bp, Artificial Sequence
  chemically synthesized
agcatgctttaccaggatctgt

SEQ ID NO: 1130403 - DNA, 22 bp, Artificial Sequence
  chemically synthesized
cggtgaccacaagggaacagat

SEQ ID NO: 1130404 - DNA, 22 bp, Artificial Sequence
  chemically synthesized
taccaggatctgttcccttgtg

SEQ ID NO: 1130405 - DNA, 22 bp, Artificial Sequence
  chemically synthesized
accaggatctgttcccttgtgg

SEQ ID NO: 1130406 - DNA, 22 bp, Artificial Sequence
  chemically synthesized
ccaggatctgttcccttgtggt

SEQ ID NO: 1130407 - DNA, 22 bp, Artificial Sequence
  chemically synthesized
ttcccttgtggtcaccgtagtt

SEQ ID NO: 1130408 - DNA, 22 bp, Artificial Sequence
  chemically synthesized
taatggaaacagtaactacggt

SEQ ID NO: 1130409 - DNA, 22 bp, Artificial Sequence
  chemically synthesized
ccttgtggtcaccgtagttact

SEQ ID NO: 1130410 - DNA, 22 bp, Artificial Sequence
  chemically synthesized
gtggtcaccgtagttactgttt

SEQ ID NO: 1130411 - DNA, 22 bp, Artificial Sequence
  chemically synthesized
tggtcaccgtagttactgtttc

SEQ ID NO: 1130412 - DNA, 22 bp, Artificial Sequence
  chemically synthesized
acacagacaactgtaatggaaa

SEQ ID NO: 1130413 - DNA, 22 bp, Artificial Sequence
  chemically synthesized
ctgtttccattacagttgtctg

SEQ ID NO: 1130414 - DNA, 22 bp, Artificial Sequence
  chemically synthesized
agccatcactaacacagacaac

SEQ ID NO: 1130415 - DNA, 22 bp, Artificial Sequence
  chemically synthesized
tttccattacagttgtctgtgt

SEQ ID NO: 1130416 - DNA, 22 bp, Artificial Sequence
  chemically synthesized
ccattacagttgtctgtgttag

SEQ ID NO: 1130417 - DNA, 22 bp, Artificial Sequence
  chemically synthesized
cattacagttgtctgtgttagt

SEQ ID NO: 1130418 - DNA, 22 bp, Artificial Sequence
  chemically synthesized
cagttgtctgtgttagtgatgg

SEQ ID NO: 1130419 - DNA, 22 bp, Artificial Sequence
  chemically synthesized
tcaccaccactcagccatcact

SEQ ID NO: 1130420 - DNA, 22 bp, Artificial Sequence
  chemically synthesized
tctgtgttagtgatggctgagt

SEQ ID NO: 1130421 - DNA, 22 bp, Artificial Sequence
  chemically synthesized
tgttagtgatggctgagtggtg

SEQ ID NO: 1130422 - DNA, 22 bp, Artificial Sequence
  chemically synthesized
acaggctgtcaccaccactcag

SEQ ID NO: 1130423 - DNA, 22 bp, Artificial Sequence
  chemically synthesized
cacaggctgtcaccaccactca

SEQ ID NO: 1130424 - DNA, 22 bp, Artificial Sequence
  chemically synthesized
gtgatggctgagtggtggtgac

SEQ ID NO: 1130425 - DNA, 22 bp, Artificial Sequence
  chemically synthesized
acagatttcacaggctgtcacc

SEQ ID NO: 1130426 - DNA, 22 bp, Artificial Sequence
  chemically synthesized
tcacagatttcacaggctgtca

SEQ ID NO: 1130427 - DNA, 22 bp, Artificial Sequence
  chemically synthesized
ctcacagatttcacaggctgtc

SEQ ID NO: 1130428 - DNA, 22 bp, Artificial Sequence
  chemically synthesized
agtggtggtgacagcctgtgaa

SEQ ID NO: 1130429 - DNA, 22 bp, Artificial Sequence
  chemically synthesized
aatacttctcacagatttcaca

SEQ ID NO: 1130430 - DNA, 22 bp, Artificial Sequence
  chemically synthesized
caatacttctcacagatttcac

SEQ ID NO: 1130431 - DNA, 22 bp, Artificial Sequence
  chemically synthesized
tttcaatacttctcacagattt

SEQ ID NO: 1130432 - DNA, 22 bp, Artificial Sequence
  chemically synthesized
tgtttcaatacttctcacagat

SEQ ID NO: 1130433 - DNA, 22 bp, Artificial Sequence
  chemically synthesized
acctctgtttcaatacttctca

SEQ ID NO: 1130434 - DNA, 22 bp, Artificial Sequence
  chemically synthesized
tgaaatctgtgagaagtattga

SEQ ID NO: 1130435 - DNA, 22 bp, Artificial Sequence
  chemically synthesized
gcaatgtctgacctctgtttca

SEQ ID NO: 1130436 - DNA, 22 bp, Artificial Sequence
  chemically synthesized
tgagaagtattgaaacagaggt

SEQ ID NO: 1130437 - DNA, 22 bp, Artificial Sequence
  chemically synthesized
tagcaatgtctgacctctgttt

SEQ ID NO: 1130438 - DNA, 22 bp, Artificial Sequence
  chemically synthesized
ctagcaatgtctgacctctgtt

SEQ ID NO: 1130439 - DNA, 22 bp, Artificial Sequence
  chemically synthesized
tctagcaatgtctgacctctgt

SEQ ID NO: 1130440 - DNA, 22 bp, Artificial Sequence
  chemically synthesized
aagtctttctagcaatgtctga

SEQ ID NO: 1130441 - DNA, 22 bp, Artificial Sequence
  chemically synthesized
aaacagaggtcagacattgcta

SEQ ID NO: 1130442 - DNA, 22 bp, Artificial Sequence
  chemically synthesized
ctgaagtctttctagcaatgtc

SEQ ID NO: 1130443 - DNA, 22 bp, Artificial Sequence
  chemically synthesized
actgaagtctttctagcaatgt

SEQ ID NO: 1130444 - DNA, 22 bp, Artificial Sequence
  chemically synthesized
tactgaagtctttctagcaatg

SEQ ID NO: 1130445 - DNA, 22 bp, Artificial Sequence
  chemically synthesized
caagcagtctttactgaagtct

SEQ ID NO: 1130446 - DNA, 22 bp, Artificial Sequence
  chemically synthesized
ctagaaagacttcagtaaagac

SEQ ID NO: 1130447 - DNA, 22 bp, Artificial Sequence
  chemically synthesized
ccactccaagcagtctttactg

SEQ ID NO: 1130448 - DNA, 22 bp, Artificial Sequence
  chemically synthesized
gccactccaagcagtctttact

SEQ ID NO: 1130449 - DNA, 22 bp, Artificial Sequence
  chemically synthesized
tgccactccaagcagtctttac

SEQ ID NO: 1130450 - DNA, 22 bp, Artificial Sequence
  chemically synthesized
gaaagacttcagtaaagactgc

SEQ ID NO: 1130451 - DNA, 22 bp, Artificial Sequence
  chemically synthesized
ctttgccactccaagcagtctt

SEQ ID NO: 1130452 - DNA, 22 bp, Artificial Sequence
  chemically synthesized
cctttgccactccaagcagtct

SEQ ID NO: 1130453 - DNA, 22 bp, Artificial Sequence
  chemically synthesized
tcctttgccactccaagcagtc

SEQ ID NO: 1130454 - DNA, 22 bp, Artificial Sequence
  chemically synthesized
ttttcctttgccactccaagca

SEQ ID NO: 1130455 - DNA, 22 bp, Artificial Sequence
  chemically synthesized
cagtaaagactgcttggagtgg

SEQ ID NO: 1130456 - DNA, 22 bp, Artificial Sequence
  chemically synthesized
agtaaagactgcttggagtggc

SEQ ID NO: 1130457 - DNA, 22 bp, Artificial Sequence
  chemically synthesized
attattttcctttgccactcca

SEQ ID NO: 1130458 - DNA, 22 bp, Artificial Sequence
  chemically synthesized
tcattattttcctttgccactc

SEQ ID NO: 1130459 - DNA, 22 bp, Artificial Sequence
  chemically synthesized
ctcattattttcctttgccact

SEQ ID NO: 1130460 - DNA, 22 bp, Artificial Sequence
  chemically synthesized
cttggagtggcaaaggaaaata

SEQ ID NO: 1130461 - DNA, 22 bp, Artificial Sequence
  chemically synthesized
ggagtggcaaaggaaaataatg

SEQ ID NO: 1130462 - DNA, 22 bp, Artificial Sequence
  chemically synthesized
gagtggcaaaggaaaataatga

SEQ ID NO: 1130463 - DNA, 22 bp, Artificial Sequence
  chemically synthesized
ccaacaagcaagaacagtttct

SEQ ID NO: 1130464 - DNA, 22 bp, Artificial Sequence
  chemically synthesized
aaggtcaatctaccaacaagca

SEQ ID NO: 1130465 - DNA, 22 bp, Artificial Sequence
  chemically synthesized
atctgaaggtcaatctaccaac

SEQ ID NO: 1130466 - DNA, 22 bp, Artificial Sequence
  chemically synthesized
gatctgaaggtcaatctaccaa

SEQ ID NO: 1130467 - DNA, 22 bp, Artificial Sequence
  chemically synthesized
tgatctgaaggtcaatctacca

SEQ ID NO: 1130468 - DNA, 22 bp, Artificial Sequence
  chemically synthesized
ttcttgcttgttggtagattga

SEQ ID NO: 1130469 - DNA, 22 bp, Artificial Sequence
  chemically synthesized
ttttgatctgaaggtcaatcta

SEQ ID NO: 1130470 - DNA, 22 bp, Artificial Sequence
  chemically synthesized
ttgcttgttggtagattgacct

SEQ ID NO: 1130471 - DNA, 22 bp, Artificial Sequence
  chemically synthesized
gcttgttggtagattgaccttc

SEQ ID NO: 1130472 - DNA, 22 bp, Artificial Sequence
  chemically synthesized
cttgttggtagattgaccttca

SEQ ID NO: 1130473 - DNA, 22 bp, Artificial Sequence
  chemically synthesized
gttggtagattgaccttcagat

SEQ ID NO: 1130474 - DNA, 22 bp, Artificial Sequence
  chemically synthesized
ttggtagattgaccttcagatc

SEQ ID NO: 1130475 - DNA, 22 bp, Artificial Sequence
  chemically synthesized
gtagattgaccttcagatcaaa

SEQ ID NO: 1130476 - DNA, 22 bp, Artificial Sequence
  chemically synthesized
aatatggtgctattttgatctg

SEQ ID NO: 1130477 - DNA, 22 bp, Artificial Sequence
  chemically synthesized
caatatggtgctattttgatct

SEQ ID NO: 1130478 - DNA, 22 bp, Artificial Sequence
  chemically synthesized
gcttcaatatggtgctattttg

SEQ ID NO: 1130479 - DNA, 22 bp, Artificial Sequence
  chemically synthesized
ggcttcaatatggtgctatttt

SEQ ID NO: 1130480 - DNA, 22 bp, Artificial Sequence
  chemically synthesized
accttcagatcaaaatagcacc

SEQ ID NO: 1130481 - DNA, 22 bp, Artificial Sequence
  chemically synthesized
tttggcttcaatatggtgctat

SEQ ID NO: 1130482 - DNA, 22 bp, Artificial Sequence
  chemically synthesized
atttggcttcaatatggtgcta

SEQ ID NO: 1130483 - DNA, 22 bp, Artificial Sequence
  chemically synthesized
tatttggcttcaatatggtgct

SEQ ID NO: 1130484 - DNA, 22 bp, Artificial Sequence
  chemically synthesized
cagatcaaaatagcaccatatt

SEQ ID NO: 1130485 - DNA, 22 bp, Artificial Sequence
  chemically synthesized
agatcaaaatagcaccatattg

SEQ ID NO: 1130486 - DNA, 22 bp, Artificial Sequence
  chemically synthesized
agtcagataaaacaattttatt

SEQ ID NO: 1130487 - DNA, 22 bp, Artificial Sequence
  chemically synthesized
aagtcagataaaacaattttat

SEQ ID NO: 1130488 - DNA, 22 bp, Artificial Sequence
  chemically synthesized
aagccaaataaaattgttttat

SEQ ID NO: 1130489 - DNA, 22 bp, Artificial Sequence
  chemically synthesized
agtgaaccaaacttaagtcaga

SEQ ID NO: 1130490 - DNA, 22 bp, Artificial Sequence
  chemically synthesized
cagtgaaccaaacttaagtcag

SEQ ID NO: 1130491 - DNA, 22 bp, Artificial Sequence
  chemically synthesized
tttcagtgaaccaaacttaagt

SEQ ID NO: 1130492 - DNA, 22 bp, Artificial Sequence
  chemically synthesized
ttttatctgacttaagtttggt

SEQ ID NO: 1130493 - DNA, 22 bp, Artificial Sequence
  chemically synthesized
ctatttcagtgaaccaaactta

SEQ ID NO: 1130494 - DNA, 22 bp, Artificial Sequence
  chemically synthesized
gctatttcagtgaaccaaactt

SEQ ID NO: 1130495 - DNA, 22 bp, Artificial Sequence
  chemically synthesized
tatctgacttaagtttggttca

SEQ ID NO: 1130496 - DNA, 22 bp, Artificial Sequence
  chemically synthesized
atctgacttaagtttggttcac

SEQ ID NO: 1130497 - DNA, 22 bp, Artificial Sequence
  chemically synthesized
tctgacttaagtttggttcact

SEQ ID NO: 1130498 - DNA, 22 bp, Artificial Sequence
  chemically synthesized
ccttgctatttcagtgaaccaa

SEQ ID NO: 1130499 - DNA, 22 bp, Artificial Sequence
  chemically synthesized
cccttgctatttcagtgaacca

SEQ ID NO: 1130500 - DNA, 22 bp, Artificial Sequence
  chemically synthesized
tcccttgctatttcagtgaacc

SEQ ID NO: 1130501 - DNA, 22 bp, Artificial Sequence
  chemically synthesized
acttaagtttggttcactgaaa

SEQ ID NO: 1130502 - DNA, 22 bp, Artificial Sequence
  chemically synthesized
ctttcccttgctatttcagtga

SEQ ID NO: 1130503 - DNA, 22 bp, Artificial Sequence
  chemically synthesized
aagtttggttcactgaaatagc

SEQ ID NO: 1130504 - DNA, 22 bp, Artificial Sequence
  chemically synthesized
agtttggttcactgaaatagca

SEQ ID NO: 1130505 - DNA, 22 bp, Artificial Sequence
  chemically synthesized
agattactttcccttgctattt

SEQ ID NO: 1130506 - DNA, 22 bp, Artificial Sequence
  chemically synthesized
ggttcactgaaatagcaaggga

SEQ ID NO: 1130507 - DNA, 22 bp, Artificial Sequence
  chemically synthesized
gttcactgaaatagcaagggaa

SEQ ID NO: 1130508 - DNA, 22 bp, Artificial Sequence
  chemically synthesized
gatgttgagattactttccctt

SEQ ID NO: 1130509 - DNA, 22 bp, Artificial Sequence
  chemically synthesized
actgaaatagcaagggaaagta

SEQ ID NO: 1130510 - DNA, 22 bp, Artificial Sequence
  chemically synthesized
cgatgttgagattactttccct

SEQ ID NO: 1130511 - DNA, 22 bp, Artificial Sequence
  chemically synthesized
tcgatgttgagattactttccc

SEQ ID NO: 1130512 - DNA, 22 bp, Artificial Sequence
  chemically synthesized
aaatagcaagggaaagtaatct

SEQ ID NO: 1130513 - DNA, 22 bp, Artificial Sequence
  chemically synthesized
actttcgatgttgagattactt

SEQ ID NO: 1130514 - DNA, 22 bp, Artificial Sequence
  chemically synthesized
aattgactttcgatgttgagat

SEQ ID NO: 1130515 - DNA, 22 bp, Artificial Sequence
  chemically synthesized
aaggggcgctaaattgactttc

SEQ ID NO: 1130516 - DNA, 22 bp, Artificial Sequence
  chemically synthesized
aacatcgaaagtcaatttagcg

SEQ ID NO: 1130517 - DNA, 22 bp, Artificial Sequence
  chemically synthesized
accaatatattgaaggggcgct

SEQ ID NO: 1130518 - DNA, 22 bp, Artificial Sequence
  chemically synthesized
gaccaatatattgaaggggcgc

SEQ ID NO: 1130519 - DNA, 22 bp, Artificial Sequence
  chemically synthesized
cagtttgaccaatatattgaag

SEQ ID NO: 1130520 - DNA, 22 bp, Artificial Sequence
  chemically synthesized
ctacagtttgaccaatatattg

SEQ ID NO: 1130521 - DNA, 22 bp, Artificial Sequence
  chemically synthesized
cctacagtttgaccaatatatt

SEQ ID NO: 1130522 - DNA, 22 bp, Artificial Sequence
  chemically synthesized
agcgccccttcaatatattggt

SEQ ID NO: 1130523 - DNA, 22 bp, Artificial Sequence
  chemically synthesized
gcgccccttcaatatattggtc

SEQ ID NO: 1130524 - DNA, 22 bp, Artificial Sequence
  chemically synthesized
tttcctacagtttgaccaatat

SEQ ID NO: 1130525 - DNA, 22 bp, Artificial Sequence
  chemically synthesized
atttcctacagtttgaccaata

SEQ ID NO: 1130526 - DNA, 22 bp, Artificial Sequence
  chemically synthesized
caatatattggtcaaactgtag

SEQ ID NO: 1130527 - DNA, 22 bp, Artificial Sequence
  chemically synthesized
aatatattggtcaaactgtagg

SEQ ID NO: 1130528 - DNA, 22 bp, Artificial Sequence
  chemically synthesized
cccccaccccttatttcctaca

SEQ ID NO: 1130529 - DNA, 22 bp, Artificial Sequence
  chemically synthesized
tgcccccaccccttatttccta

SEQ ID NO: 1130530 - DNA, 22 bp, Artificial Sequence
  chemically synthesized
gtcaaactgtaggaaataaggg

SEQ ID NO: 1130531 - DNA, 22 bp, Artificial Sequence
  chemically synthesized
ctctgcccccaccccttatttc

SEQ ID NO: 1130532 - DNA, 22 bp, Artificial Sequence
  chemically synthesized
tcctctgcccccaccccttatt

SEQ ID NO: 1130533 - DNA, 22 bp, Artificial Sequence
  chemically synthesized
ctcctctgcccccaccccttat

SEQ ID NO: 1130534 - DNA, 22 bp, Artificial Sequence
  chemically synthesized
tctcctctgcccccacccctta

SEQ ID NO: 1130535 - DNA, 22 bp, Artificial Sequence
  chemically synthesized
ttctcctctgcccccacccctt

SEQ ID NO: 1130536 - DNA, 22 bp, Artificial Sequence
  chemically synthesized
taggaaataaggggtgggggca

SEQ ID NO: 1130537 - DNA, 22 bp, Artificial Sequence
  chemically synthesized
catttttctcctctgcccccac

SEQ ID NO: 1130538 - DNA, 22 bp, Artificial Sequence
  chemically synthesized
tacatttttctcctctgccccc

SEQ ID NO: 1130539 - DNA, 22 bp, Artificial Sequence
  chemically synthesized
tactctacatttttctcctctg

SEQ ID NO: 1130540 - DNA, 22 bp, Artificial Sequence
  chemically synthesized
tcagaatgaattatactctaca

SEQ ID NO: 1130541 - DNA, 22 bp, Artificial Sequence
  chemically synthesized
actatcagaatgaattatactc

SEQ ID NO: 1130542 - DNA, 22 bp, Artificial Sequence
  chemically synthesized
aacagcatgtagaattaactat

SEQ ID NO: 1130543 - DNA, 22 bp, Artificial Sequence
  chemically synthesized
aaacagcatgtagaattaacta

SEQ ID NO: 1130544 - DNA, 22 bp, Artificial Sequence
  chemically synthesized
taaacagcatgtagaattaact

SEQ ID NO: 1130545 - DNA, 22 bp, Artificial Sequence
  chemically synthesized
attctgatagttaattctacat

SEQ ID NO: 1130546 - DNA, 22 bp, Artificial Sequence
  chemically synthesized
tgatagttaattctacatgctg

SEQ ID NO: 1130547 - DNA, 22 bp, Artificial Sequence
  chemically synthesized
atagttaattctacatgctgtt

SEQ ID NO: 1130548 - DNA, 22 bp, Artificial Sequence
  chemically synthesized
atgtaaacattttaaacagcat

SEQ ID NO: 1130549 - DNA, 22 bp, Artificial Sequence
  chemically synthesized
attctacatgctgtttaaaatg

SEQ ID NO: 1130550 - DNA, 22 bp, Artificial Sequence
  chemically synthesized
atattaatgtaaacattttaaa

SEQ ID NO: 1130551 - DNA, 22 bp, Artificial Sequence
  chemically synthesized
tacatgctgtttaaaatgttta

SEQ ID NO: 1130552 - DNA, 22 bp, Artificial Sequence
  chemically synthesized
catgctgtttaaaatgtttaca

SEQ ID NO: 1130553 - DNA, 22 bp, Artificial Sequence
  chemically synthesized
gtaacattcatattaatgtaaa

SEQ ID NO: 1130554 - DNA, 22 bp, Artificial Sequence
  chemically synthesized
tttaaaatgtttacattaatat

SEQ ID NO: 1130555 - DNA, 22 bp, Artificial Sequence
  chemically synthesized
aaaatgtttacattaatatgaa

SEQ ID NO: 1130556 - DNA, 22 bp, Artificial Sequence
  chemically synthesized
aaatgtttacattaatatgaat

SEQ ID NO: 1130557 - DNA, 22 bp, Artificial Sequence
  chemically synthesized
atgtacgttagtaacattcata

SEQ ID NO: 1130558 - DNA, 22 bp, Artificial Sequence
  chemically synthesized
acattaatatgaatgttactaa

SEQ ID NO: 1130559 - DNA, 22 bp, Artificial Sequence
  chemically synthesized
cattaatatgaatgttactaac

SEQ ID NO: 1130560 - DNA, 22 bp, Artificial Sequence
  chemically synthesized
gtactgatgtacgttagtaaca

SEQ ID NO: 1130561 - DNA, 22 bp, Artificial Sequence
  chemically synthesized
atatgaatgttactaacgtaca

SEQ ID NO: 1130562 - DNA, 22 bp, Artificial Sequence
  chemically synthesized
ggcaatggaattggtactgatg

SEQ ID NO: 1130563 - DNA, 22 bp, Artificial Sequence
  chemically synthesized
taggcaatggaattggtactga

SEQ ID NO: 1130564 - DNA, 22 bp, Artificial Sequence
  chemically synthesized
ctaacgtacatcagtaccaatt

SEQ ID NO: 1130565 - DNA, 22 bp, Artificial Sequence
  chemically synthesized
acgtacatcagtaccaattcca

SEQ ID NO: 1130566 - DNA, 22 bp, Artificial Sequence
  chemically synthesized
aaatgttctaggcaatggaatt

SEQ ID NO: 1130567 - DNA, 22 bp, Artificial Sequence
  chemically synthesized
aaaatgttctaggcaatggaat

SEQ ID NO: 1130568 - DNA, 22 bp, Artificial Sequence
  chemically synthesized
ataagcatttaaaatgttctag

SEQ ID NO: 1130569 - DNA, 22 bp, Artificial Sequence
  chemically synthesized
ttaataagcatttaaaatgttc

SEQ ID NO: 1130570 - DNA, 22 bp, Artificial Sequence
  chemically synthesized
cattgcctagaacattttaaat

SEQ ID NO: 1130571 - DNA, 22 bp, Artificial Sequence
  chemically synthesized
caaactattaataagcatttaa

SEQ ID NO: 1130572 - DNA, 22 bp, Artificial Sequence
  chemically synthesized
cctagaacattttaaatgctta

SEQ ID NO: 1130573 - DNA, 22 bp, Artificial Sequence
  chemically synthesized
tacaaactattaataagcattt

SEQ ID NO: 1130574 - DNA, 22 bp, Artificial Sequence
  chemically synthesized
gaacattttaaatgcttattaa

SEQ ID NO: 1130575 - DNA, 22 bp, Artificial Sequence
  chemically synthesized
taaatgcttattaatagtttgt

SEQ ID NO: 1130576 - DNA, 22 bp, Artificial Sequence
  chemically synthesized
aaatgcttattaatagtttgta

SEQ ID NO: 1130577 - DNA, 22 bp, Artificial Sequence
  chemically synthesized
aatgcttattaatagtttgtag

SEQ ID NO: 1130578 - DNA, 22 bp, Artificial Sequence
  chemically synthesized
attaatagtttgtagaatgcat

SEQ ID NO: 1130579 - DNA, 22 bp, Artificial Sequence
  chemically synthesized
ttaatagtttgtagaatgcatt

SEQ ID NO: 1130580 - DNA, 22 bp, Artificial Sequence
  chemically synthesized
atagtttgtagaatgcattttt

SEQ ID NO: 1130581 - DNA, 22 bp, Artificial Sequence
  chemically synthesized
gtagaatgcatttttggttatc

SEQ ID NO: 1130582 - DNA, 22 bp, Artificial Sequence
  chemically synthesized
tagaatgcatttttggttatca

SEQ ID NO: 1130583 - DNA, 22 bp, Artificial Sequence
  chemically synthesized
ttggttatcatacacattgatt

SEQ ID NO: 1130584 - DNA, 22 bp, Artificial Sequence
  chemically synthesized
tggttatcatacacattgatta

SEQ ID NO: 1130585 - DNA, 22 bp, Artificial Sequence
  chemically synthesized
ggttatcatacacattgattat

SEQ ID NO: 1130586 - DNA, 22 bp, Artificial Sequence
  chemically synthesized
gttatcatacacattgattatt

SEQ ID NO: 1130587 - DNA, 22 bp, Artificial Sequence
  chemically synthesized
tcatacacattgattattttat

SEQ ID NO: 1130588 - DNA, 22 bp, Artificial Sequence
  chemically synthesized
aaaatgtataacataaaataat

SEQ ID NO: 1130589 - DNA, 22 bp, Artificial Sequence
  chemically synthesized
aaaaatgtataacataaaataa

SEQ ID NO: 1130590 - DNA, 22 bp, Artificial Sequence
  chemically synthesized
tttaaaaatgtataacataaaa

SEQ ID NO: 1130591 - DNA, 22 bp, Artificial Sequence
  chemically synthesized
atttaaaaatgtataacataaa

SEQ ID NO: 1130592 - DNA, 22 bp, Artificial Sequence
  chemically synthesized
tatttaaaaatgtataacataa

SEQ ID NO: 1130593 - DNA, 22 bp, Artificial Sequence
  chemically synthesized
attattttatgttatacatttt

SEQ ID NO: 1130594 - DNA, 22 bp, Artificial Sequence
  chemically synthesized
aaataattttatttaaaaatgt

SEQ ID NO: 1130595 - DNA, 22 bp, Artificial Sequence
  chemically synthesized
ttttatgttatacatttttaaa

SEQ ID NO: 1130596 - DNA, 22 bp, Artificial Sequence
  chemically synthesized
tatgttatacatttttaaataa

SEQ ID NO: 1130597 - DNA, 22 bp, Artificial Sequence
  chemically synthesized
atgttatacatttttaaataaa

SEQ ID NO: 1130598 - DNA, 22 bp, Artificial Sequence
  chemically synthesized
tgttatacatttttaaataaaa

SEQ ID NO: 1130599 - DNA, 22 bp, Artificial Sequence
  chemically synthesized
ccaagttgaaataattttattt

SEQ ID NO: 1130600 - DNA, 22 bp, Artificial Sequence
  chemically synthesized
tacatttttaaataaaattatt

SEQ ID NO: 1130601 - DNA, 22 bp, Artificial Sequence
  chemically synthesized
attaccaagttgaaataatttt

SEQ ID NO: 1130602 - DNA, 22 bp, Artificial Sequence
  chemically synthesized
ttaaataaaattatttcaactt

SEQ ID NO: 1130603 - DNA, 22 bp, Artificial Sequence
  chemically synthesized
taaataaaattatttcaacttg

SEQ ID NO: 1130604 - DNA, 22 bp, Artificial Sequence
  chemically synthesized
aaataaaattatttcaacttgg

SEQ ID NO: 1130605 - DNA, 22 bp, Artificial Sequence
  chemically synthesized
aataaaattatttcaacttggt

SEQ ID NO: 1130606 - DNA, 22 bp, Artificial Sequence
  chemically synthesized
aagagtcgttcattaccaagtt

SEQ ID NO: 1130607 - DNA, 22 bp, Artificial Sequence
  chemically synthesized
attaaagagtcgttcattacca

SEQ ID NO: 1130608 - DNA, 22 bp, Artificial Sequence
  chemically synthesized
gattaaagagtcgttcattacc

SEQ ID NO: 1130609 - DNA, 22 bp, Artificial Sequence
  chemically synthesized
tttcaacttggtaatgaacgac

SEQ ID NO: 1130610 - DNA, 22 bp, Artificial Sequence
  chemically synthesized
tttgattaaagagtcgttcatt

SEQ ID NO: 1130611 - DNA, 22 bp, Artificial Sequence
  chemically synthesized
atttgattaaagagtcgttcat

SEQ ID NO: 1130612 - DNA, 22 bp, Artificial Sequence
  chemically synthesized
caacttggtaatgaacgactct

SEQ ID NO: 1130613 - DNA, 22 bp, Artificial Sequence
  chemically synthesized
aacttggtaatgaacgactctt

SEQ ID NO: 1130614 - DNA, 22 bp, Artificial Sequence
  chemically synthesized
acttatttgattaaagagtcgt

SEQ ID NO: 1130615 - DNA, 22 bp, Artificial Sequence
  chemically synthesized
cacttatttgattaaagagtcg

SEQ ID NO: 1130616 - DNA, 22 bp, Artificial Sequence
  chemically synthesized
ggtaatgaacgactctttaatc

SEQ ID NO: 1130617 - DNA, 22 bp, Artificial Sequence
  chemically synthesized
tttcacttatttgattaaagag

SEQ ID NO: 1130618 - DNA, 22 bp, Artificial Sequence
  chemically synthesized
gtaatgaacgactctttaatca

SEQ ID NO: 1130619 - DNA, 22 bp, Artificial Sequence
  chemically synthesized
aaagctgtttcacttatttgat

SEQ ID NO: 1130620 - DNA, 22 bp, Artificial Sequence
  chemically synthesized
aaaagctgtttcacttatttga

SEQ ID NO: 1130621 - DNA, 22 bp, Artificial Sequence
  chemically synthesized
taaaagctgtttcacttatttg

SEQ ID NO: 1130622 - DNA, 22 bp, Artificial Sequence
  chemically synthesized
tttaatcaaataagtgaaacag

SEQ ID NO: 1130623 - DNA, 22 bp, Artificial Sequence
  chemically synthesized
taattttaaaagctgtttcact

SEQ ID NO: 1130624 - DNA, 22 bp, Artificial Sequence
  chemically synthesized
taatcaaataagtgaaacagct

SEQ ID NO: 1130625 - DNA, 22 bp, Artificial Sequence
  chemically synthesized
aatcaaataagtgaaacagctt

SEQ ID NO: 1130626 - DNA, 22 bp, Artificial Sequence
  chemically synthesized
ttgtaattttaaaagctgtttc

SEQ ID NO: 1130627 - DNA, 22 bp, Artificial Sequence
  chemically synthesized
atcaaataagtgaaacagcttt

SEQ ID NO: 1130628 - DNA, 22 bp, Artificial Sequence
  chemically synthesized
attgtaattttaaaagctgttt

SEQ ID NO: 1130629 - DNA, 22 bp, Artificial Sequence
  chemically synthesized
tattgtaattttaaaagctgtt

SEQ ID NO: 1130630 - DNA, 22 bp, Artificial Sequence
  chemically synthesized
ttattgtaattttaaaagctgt

SEQ ID NO: 1130631 - DNA, 22 bp, Artificial Sequence
  chemically synthesized
accttttattgtaattttaaaa

SEQ ID NO: 1130632 - DNA, 22 bp, Artificial Sequence
  chemically synthesized
tgttaaccttttattgtaattt

SEQ ID NO: 1130633 - DNA, 22 bp, Artificial Sequence
  chemically synthesized
atgttaaccttttattgtaatt

SEQ ID NO: 1130634 - DNA, 22 bp, Artificial Sequence
  chemically synthesized
tatgttaaccttttattgtaat

SEQ ID NO: 1130635 - DNA, 22 bp, Artificial Sequence
  chemically synthesized
ttaaaattacaataaaaggtta

SEQ ID NO: 1130636 - DNA, 22 bp, Artificial Sequence
  chemically synthesized
taaaattacaataaaaggttaa

SEQ ID NO: 1130637 - DNA, 22 bp, Artificial Sequence
  chemically synthesized
aaaattacaataaaaggttaac

SEQ ID NO: 1130638 - DNA, 22 bp, Artificial Sequence
  chemically synthesized
aaattacaataaaaggttaaca

SEQ ID NO: 1130639 - DNA, 22 bp, Artificial Sequence
  chemically synthesized
atacatactttatgttaacctt

SEQ ID NO: 1130640 - DNA, 22 bp, Artificial Sequence
  chemically synthesized
caataaaaggttaacataaagt

SEQ ID NO: 1130641 - DNA, 22 bp, Artificial Sequence
  chemically synthesized
acataaagtatgtattagtcca

SEQ ID NO: 1130642 - DNA, 22 bp, Artificial Sequence
  chemically synthesized
aacataaagatatatatggact

SEQ ID NO: 1130643 - DNA, 22 bp, Artificial Sequence
  chemically synthesized
aataacattcaacataaagata

SEQ ID NO: 1130644 - DNA, 22 bp, Artificial Sequence
  chemically synthesized
gaataacattcaacataaagat

SEQ ID NO: 1130645 - DNA, 22 bp, Artificial Sequence
  chemically synthesized
gtccatatatatctttatgttg

SEQ ID NO: 1130646 - DNA, 22 bp, Artificial Sequence
  chemically synthesized
gcatttgaataacattcaacat

SEQ ID NO: 1130647 - DNA, 22 bp, Artificial Sequence
  chemically synthesized
agcatttgaataacattcaaca

SEQ ID NO: 1130648 - DNA, 22 bp, Artificial Sequence
  chemically synthesized
tagcatttgaataacattcaac

SEQ ID NO: 1130649 - DNA, 22 bp, Artificial Sequence
  chemically synthesized
ttagcatttgaataacattcaa

SEQ ID NO: 1130650 - DNA, 22 bp, Artificial Sequence
  chemically synthesized
tttagcatttgaataacattca

SEQ ID NO: 1130651 - DNA, 22 bp, Artificial Sequence
  chemically synthesized
tatgttgaatgttattcaaatg

SEQ ID NO: 1130652 - DNA, 22 bp, Artificial Sequence
  chemically synthesized
atgttgaatgttattcaaatgc

SEQ ID NO: 1130653 - DNA, 22 bp, Artificial Sequence
  chemically synthesized
tgttgaatgttattcaaatgct

SEQ ID NO: 1130654 - DNA, 22 bp, Artificial Sequence
  chemically synthesized
aatgttattcaaatgctaaaaa

SEQ ID NO: 1130655 - DNA, 22 bp, Artificial Sequence
  chemically synthesized
ttcaaatgctaaaaaacacact

SEQ ID NO: 1130656 - DNA, 22 bp, Artificial Sequence
  chemically synthesized
aatcaaacaagagtagtgtgtt

SEQ ID NO: 1130657 - DNA, 22 bp, Artificial Sequence
  chemically synthesized
aaatgctaaaaaacacactact

SEQ ID NO: 1130658 - DNA, 22 bp, Artificial Sequence
  chemically synthesized
aaatcaaacaagagtagtgtgt

SEQ ID NO: 1130659 - DNA, 22 bp, Artificial Sequence
  chemically synthesized
atttaaatcaaacaagagtagt

SEQ ID NO: 1130660 - DNA, 22 bp, Artificial Sequence
  chemically synthesized
aaaaacacactactcttgtttg

SEQ ID NO: 1130661 - DNA, 22 bp, Artificial Sequence
  chemically synthesized
aacataatcactaatttaaatc

SEQ ID NO: 1130662 - DNA, 22 bp, Artificial Sequence
  chemically synthesized
gaacataatcactaatttaaat

SEQ ID NO: 1130663 - DNA, 22 bp, Artificial Sequence
  chemically synthesized
ctcttgtttgatttaaattagt

SEQ ID NO: 1130664 - DNA, 22 bp, Artificial Sequence
  chemically synthesized
ttgtttgatttaaattagtgat

SEQ ID NO: 1130665 - DNA, 22 bp, Artificial Sequence
  chemically synthesized
gtttgatttaaattagtgatta

SEQ ID NO: 1130666 - DNA, 22 bp, Artificial Sequence
  chemically synthesized
tttgatttaaattagtgattat

SEQ ID NO: 1130667 - DNA, 22 bp, Artificial Sequence
  chemically synthesized
aaatatttgaacataatcacta

SEQ ID NO: 1130668 - DNA, 22 bp, Artificial Sequence
  chemically synthesized
gatttaaattagtgattatgtt

SEQ ID NO: 1130669 - DNA, 22 bp, Artificial Sequence
  chemically synthesized
atttaaattagtgattatgttc

SEQ ID NO: 1130670 - DNA, 22 bp, Artificial Sequence
  chemically synthesized
aaattagtgattatgttcaaat

SEQ ID NO: 1130671 - DNA, 22 bp, Artificial Sequence
  chemically synthesized
aattagtgattatgttcaaata

SEQ ID NO: 1130672 - DNA, 22 bp, Artificial Sequence
  chemically synthesized
gtgattatgttcaaatatttga

SEQ ID NO: 1130673 - DNA, 22 bp, Artificial Sequence
  chemically synthesized
tgttcaaatatttgagttccca

SEQ ID NO: 1130674 - DNA, 22 bp, Artificial Sequence
  chemically synthesized
cagtgatgaatatgggaactca

SEQ ID NO: 1130675 - DNA, 22 bp, Artificial Sequence
  chemically synthesized
aaatatttgagttcccatattc

SEQ ID NO: 1130676 - DNA, 22 bp, Artificial Sequence
  chemically synthesized
gagttcccatattcatcactgg

SEQ ID NO: 1130677 - DNA, 22 bp, Artificial Sequence
  chemically synthesized
agttcccatattcatcactgga

SEQ ID NO: 1130678 - DNA, 22 bp, Artificial Sequence
  chemically synthesized
aaccaagaagtgtctccagtga

SEQ ID NO: 1130679 - DNA, 22 bp, Artificial Sequence
  chemically synthesized
taaaccaagaagtgtctccagt

SEQ ID NO: 1130680 - DNA, 22 bp, Artificial Sequence
  chemically synthesized
ccatattcatcactggagacac

SEQ ID NO: 1130681 - DNA, 22 bp, Artificial Sequence
  chemically synthesized
agattctaaaccaagaagtgtc

SEQ ID NO: 1130682 - DNA, 22 bp, Artificial Sequence
  chemically synthesized
atcactggagacacttcttggt

SEQ ID NO: 1130683 - DNA, 22 bp, Artificial Sequence
  chemically synthesized
gagacacttcttggtttagaat

SEQ ID NO: 1130684 - DNA, 22 bp, Artificial Sequence
  chemically synthesized
cttggtttagaatctcaattac

SEQ ID NO: 1130685 - DNA, 22 bp, Artificial Sequence
  chemically synthesized
ttggtttagaatctcaattacc

SEQ ID NO: 1130686 - DNA, 22 bp, Artificial Sequence
  chemically synthesized
ggtttagaatctcaattacctc

SEQ ID NO: 1130687 - DNA, 22 bp, Artificial Sequence
  chemically synthesized
gtttagaatctcaattacctcc

SEQ ID NO: 1130688 - DNA, 22 bp, Artificial Sequence
  chemically synthesized
ccaaaagtatgaacaggaggta

SEQ ID NO: 1130689 - DNA, 22 bp, Artificial Sequence
  chemically synthesized
agaatctcaattacctcctgtt

SEQ ID NO: 1130690 - DNA, 22 bp, Artificial Sequence
  chemically synthesized
gaatctcaattacctcctgttc

SEQ ID NO: 1130691 - DNA, 22 bp, Artificial Sequence
  chemically synthesized
aattacctcctgttcatacttt

SEQ ID NO: 1130692 - DNA, 22 bp, Artificial Sequence
  chemically synthesized
cctcctgttcatacttttggca

SEQ ID NO: 1130693 - DNA, 22 bp, Artificial Sequence
  chemically synthesized
cccccggcccgctgccaaaagt

SEQ ID NO: 1130694 - DNA, 22 bp, Artificial Sequence
  chemically synthesized
ttgcccccggcccgctgccaaa

SEQ ID NO: 1130695 - DNA, 22 bp, Artificial Sequence
  chemically synthesized
ctgttcatacttttggcagcgg

SEQ ID NO: 1130696 - DNA, 22 bp, Artificial Sequence
  chemically synthesized
ttcatacttttggcagcgggcc

SEQ ID NO: 1130697 - DNA, 22 bp, Artificial Sequence
  chemically synthesized
atacttttggcagcgggccggg

SEQ ID NO: 1130698 - DNA, 22 bp, Artificial Sequence
  chemically synthesized
ttggcagcgggccgggggcaac

SEQ ID NO: 1130699 - DNA, 22 bp, Artificial Sequence
  chemically synthesized
tggcagcgggccgggggcaaca

SEQ ID NO: 1130700 - DNA, 22 bp, Artificial Sequence
  chemically synthesized
ggcagcgggccgggggcaacag

SEQ ID NO: 1130701 - DNA, 22 bp, Artificial Sequence
  chemically synthesized
gcagcgggccgggggcaacagt

SEQ ID NO: 1130702 - DNA, 22 bp, Artificial Sequence
  chemically synthesized
caaagatggatgaactgttgcc

SEQ ID NO: 1130703 - DNA, 22 bp, Artificial Sequence
  chemically synthesized
ttccaaagatggatgaactgtt

SEQ ID NO: 1130704 - DNA, 22 bp, Artificial Sequence
  chemically synthesized
acaaaatgtattattccaaaga

SEQ ID NO: 1130705 - DNA, 22 bp, Artificial Sequence
  chemically synthesized
gctcacaaaatgtattattcca

SEQ ID NO: 1130706 - DNA, 22 bp, Artificial Sequence
  chemically synthesized
ggctcacaaaatgtattattcc

SEQ ID NO: 1130707 - DNA, 22 bp, Artificial Sequence
  chemically synthesized
atccatctttggaataatacat

SEQ ID NO: 1130708 - DNA, 22 bp, Artificial Sequence
  chemically synthesized
atgtcttggctcacaaaatgta

SEQ ID NO: 1130709 - DNA, 22 bp, Artificial Sequence
  chemically synthesized
tcatgtcttggctcacaaaatg

SEQ ID NO: 1130710 - DNA, 22 bp, Artificial Sequence
  chemically synthesized
tggaataatacattttgtgagc

SEQ ID NO: 1130711 - DNA, 22 bp, Artificial Sequence
  chemically synthesized
ggaataatacattttgtgagcc

SEQ ID NO: 1130712 - DNA, 22 bp, Artificial Sequence
  chemically synthesized
gaataatacattttgtgagcca

SEQ ID NO: 1130713 - DNA, 22 bp, Artificial Sequence
  chemically synthesized
aggtgatggcctctcatgtctt

SEQ ID NO: 1130714 - DNA, 22 bp, Artificial Sequence
  chemically synthesized
tgtgagccaagacatgagaggc

SEQ ID NO: 1130715 - DNA, 22 bp, Artificial Sequence
  chemically synthesized
gtgagccaagacatgagaggcc

SEQ ID NO: 1130716 - DNA, 22 bp, Artificial Sequence
  chemically synthesized
tgagccaagacatgagaggcca

SEQ ID NO: 1130717 - DNA, 22 bp, Artificial Sequence
  chemically synthesized
gtaatgcccatgtattgaggtg

SEQ ID NO: 1130718 - DNA, 22 bp, Artificial Sequence
  chemically synthesized
tctcgtaatgcccatgtattga

SEQ ID NO: 1130719 - DNA, 22 bp, Artificial Sequence
  chemically synthesized
tctatctcgtaatgcccatgta

SEQ ID NO: 1130720 - DNA, 22 bp, Artificial Sequence
  chemically synthesized
gtctatctcgtaatgcccatgt

SEQ ID NO: 1130721 - DNA, 22 bp, Artificial Sequence
  chemically synthesized
tatgacttgtctatctcgtaat

SEQ ID NO: 1130722 - DNA, 22 bp, Artificial Sequence
  chemically synthesized
aatacatgggcattacgagata

SEQ ID NO: 1130723 - DNA, 22 bp, Artificial Sequence
  chemically synthesized
accattatatgacttgtctatc

SEQ ID NO: 1130724 - DNA, 22 bp, Artificial Sequence
  chemically synthesized
tctcaccattatatgacttgtc

SEQ ID NO: 1130725 - DNA, 22 bp, Artificial Sequence
  chemically synthesized
cgagatagacaagtcatataat

SEQ ID NO: 1130726 - DNA, 22 bp, Artificial Sequence
  chemically synthesized
tgagacggagaatatgataagg

SEQ ID NO: 1130727 - DNA, 22 bp, Artificial Sequence
  chemically synthesized
tgtgagacggagaatatgataa

SEQ ID NO: 1130728 - DNA, 22 bp, Artificial Sequence
  chemically synthesized
cttatcatattctccgtctcac

SEQ ID NO: 1130729 - DNA, 22 bp, Artificial Sequence
  chemically synthesized
atcatattctccgtctcacaga

SEQ ID NO: 1130730 - DNA, 22 bp, Artificial Sequence
  chemically synthesized
tcatattctccgtctcacagag

SEQ ID NO: 1130731 - DNA, 22 bp, Artificial Sequence
  chemically synthesized
caatcgtcatgagaggagctct

SEQ ID NO: 1130732 - DNA, 22 bp, Artificial Sequence
  chemically synthesized
tccgtctcacagagctcctctc

SEQ ID NO: 1130733 - DNA, 22 bp, Artificial Sequence
  chemically synthesized
cgtctcacagagctcctctcat

SEQ ID NO: 1130734 - DNA, 22 bp, Artificial Sequence
  chemically synthesized
acagagctcctctcatgacgat

SEQ ID NO: 1130735 - DNA, 22 bp, Artificial Sequence
  chemically synthesized
ctctcatgacgattgtaacgtt

SEQ ID NO: 1130736 - DNA, 22 bp, Artificial Sequence
  chemically synthesized
ccatcccaagaggtaacgttac

SEQ ID NO: 1130737 - DNA, 22 bp, Artificial Sequence
  chemically synthesized
tcatgacgattgtaacgttacc

SEQ ID NO: 1130738 - DNA, 22 bp, Artificial Sequence
  chemically synthesized
atgacgattgtaacgttacctc

SEQ ID NO: 1130739 - DNA, 22 bp, Artificial Sequence
  chemically synthesized
taacgttacctcttgggatggt

SEQ ID NO: 1130740 - DNA, 22 bp, Artificial Sequence
  chemically synthesized
ccagaaggataatgattaccat

SEQ ID NO: 1130741 - DNA, 22 bp, Artificial Sequence
  chemically synthesized
cctcttgggatggtaatcatta

SEQ ID NO: 1130742 - DNA, 22 bp, Artificial Sequence
  chemically synthesized
gattgccagaaggataatgatt

SEQ ID NO: 1130743 - DNA, 22 bp, Artificial Sequence
  chemically synthesized
ttgggatggtaatcattatcct

SEQ ID NO: 1130744 - DNA, 22 bp, Artificial Sequence
  chemically synthesized
gggatggtaatcattatccttc

SEQ ID NO: 1130745 - DNA, 22 bp, Artificial Sequence
  chemically synthesized
ggatggtaatcattatccttct

SEQ ID NO: 1130746 - DNA, 22 bp, Artificial Sequence
  chemically synthesized
catataagttggattgccagaa

SEQ ID NO: 1130747 - DNA, 22 bp, Artificial Sequence
  chemically synthesized
gcatataagttggattgccaga

SEQ ID NO: 1130748 - DNA, 22 bp, Artificial Sequence
  chemically synthesized
tccttctggcaatccaacttat

SEQ ID NO: 1130749 - DNA, 22 bp, Artificial Sequence
  chemically synthesized
gaaacagaccttgcatataagt

SEQ ID NO: 1130750 - DNA, 22 bp, Artificial Sequence
  chemically synthesized
ctggcaatccaacttatatgca

SEQ ID NO: 1130751 - DNA, 22 bp, Artificial Sequence
  chemically synthesized
ggaaacagaccttgcatataag

SEQ ID NO: 1130752 - DNA, 22 bp, Artificial Sequence
  chemically synthesized
tggcaatccaacttatatgcaa

SEQ ID NO: 1130753 - DNA, 22 bp, Artificial Sequence
  chemically synthesized
gcaatccaacttatatgcaagg

SEQ ID NO: 1130754 - DNA, 22 bp, Artificial Sequence
  chemically synthesized
cttggaaacagaccttgcatat

SEQ ID NO: 1130755 - DNA, 22 bp, Artificial Sequence
  chemically synthesized
ccttggaaacagaccttgcata

SEQ ID NO: 1130756 - DNA, 22 bp, Artificial Sequence
  chemically synthesized
tgacttccttggaaacagacct

SEQ ID NO: 1130757 - DNA, 22 bp, Artificial Sequence
  chemically synthesized
gtgacttccttggaaacagacc

SEQ ID NO: 1130758 - DNA, 22 bp, Artificial Sequence
  chemically synthesized
ttgtgacttccttggaaacaga

SEQ ID NO: 1130759 - DNA, 22 bp, Artificial Sequence
  chemically synthesized
atatgcaaggtctgtttccaag

SEQ ID NO: 1130760 - DNA, 22 bp, Artificial Sequence
  chemically synthesized
tatgcaaggtctgtttccaagg

SEQ ID NO: 1130761 - DNA, 22 bp, Artificial Sequence
  chemically synthesized
aatgcaggcctcttgtgacttc

SEQ ID NO: 1130762 - DNA, 22 bp, Artificial Sequence
  chemically synthesized
caatgcaggcctcttgtgactt

SEQ ID NO: 1130763 - DNA, 22 bp, Artificial Sequence
  chemically synthesized
tttccaaggaagtcacaagagg

SEQ ID NO: 1130764 - DNA, 22 bp, Artificial Sequence
  chemically synthesized
ccaaggaagtcacaagaggcct

SEQ ID NO: 1130765 - DNA, 22 bp, Artificial Sequence
  chemically synthesized
caaggaagtcacaagaggcctg

SEQ ID NO: 1130766 - DNA, 22 bp, Artificial Sequence
  chemically synthesized
taaccagaggcagtttcaatgc

SEQ ID NO: 1130767 - DNA, 22 bp, Artificial Sequence
  chemically synthesized
gtaaccagaggcagtttcaatg

SEQ ID NO: 1130768 - DNA, 22 bp, Artificial Sequence
  chemically synthesized
cttgtaaccagaggcagtttca

SEQ ID NO: 1130769 - DNA, 22 bp, Artificial Sequence
  chemically synthesized
gcttgtaaccagaggcagtttc

SEQ ID NO: 1130770 - DNA, 22 bp, Artificial Sequence
  chemically synthesized
tgcttgtaaccagaggcagttt

SEQ ID NO: 1130771 - DNA, 22 bp, Artificial Sequence
  chemically synthesized
ctttgcttgtaaccagaggcag

SEQ ID NO: 1130772 - DNA, 22 bp, Artificial Sequence
  chemically synthesized
ctcctttgcttgtaaccagagg

SEQ ID NO: 1130773 - DNA, 22 bp, Artificial Sequence
  chemically synthesized
cattgaaactgcctctggttac

SEQ ID NO: 1130774 - DNA, 22 bp, Artificial Sequence
  chemically synthesized
aaactgcctctggttacaagca

SEQ ID NO: 1130775 - DNA, 22 bp, Artificial Sequence
  chemically synthesized
cctctggttacaagcaaaggag

SEQ ID NO: 1130776 - DNA, 22 bp, Artificial Sequence
  chemically synthesized
tggttacaagcaaaggagcagg

SEQ ID NO: 1130777 - DNA, 22 bp, Artificial Sequence
  chemically synthesized
acccagccagatccctgctcct

SEQ ID NO: 1130778 - DNA, 22 bp, Artificial Sequence
  chemically synthesized
gttacaagcaaaggagcaggga

SEQ ID NO: 1130779 - DNA, 22 bp, Artificial Sequence
  chemically synthesized
gacccagccagatccctgctcc

SEQ ID NO: 1130780 - DNA, 22 bp, Artificial Sequence
  chemically synthesized
caagcaaaggagcagggatctg

SEQ ID NO: 1130781 - DNA, 22 bp, Artificial Sequence
  chemically synthesized
aaatgaatcttgacccagccag

SEQ ID NO: 1130782 - DNA, 22 bp, Artificial Sequence
  chemically synthesized
ctaaaatgaatcttgacccagc

SEQ ID NO: 1130783 - DNA, 22 bp, Artificial Sequence
  chemically synthesized
aggaaaattgctaaaatgaatc

SEQ ID NO: 1130784 - DNA, 22 bp, Artificial Sequence
  chemically synthesized
gctgggtcaagattcattttag

SEQ ID NO: 1130785 - DNA, 22 bp, Artificial Sequence
  chemically synthesized
ggtcaagattcattttagcaat

SEQ ID NO: 1130786 - DNA, 22 bp, Artificial Sequence
  chemically synthesized
gcaaattcaggaaaattgctaa

SEQ ID NO: 1130787 - DNA, 22 bp, Artificial Sequence
  chemically synthesized
ggcaaattcaggaaaattgcta

SEQ ID NO: 1130788 - DNA, 22 bp, Artificial Sequence
  chemically synthesized
ttggcaaattcaggaaaattgc

SEQ ID NO: 1130789 - DNA, 22 bp, Artificial Sequence
  chemically synthesized
cctcttggcaaattcaggaaaa

SEQ ID NO: 1130790 - DNA, 22 bp, Artificial Sequence
  chemically synthesized
acctcttggcaaattcaggaaa

SEQ ID NO: 1130791 - DNA, 22 bp, Artificial Sequence
  chemically synthesized
attttagcaattttcctgaatt

SEQ ID NO: 1130792 - DNA, 22 bp, Artificial Sequence
  chemically synthesized
ccttacctcttggcaaattcag

SEQ ID NO: 1130793 - DNA, 22 bp, Artificial Sequence
  chemically synthesized
tagcaattttcctgaatttgcc

SEQ ID NO: 1130794 - DNA, 22 bp, Artificial Sequence
  chemically synthesized
cccttacctcttggcaaattca

SEQ ID NO: 1130795 - DNA, 22 bp, Artificial Sequence
  chemically synthesized
agcaattttcctgaatttgcca

SEQ ID NO: 1130796 - DNA, 22 bp, Artificial Sequence
  chemically synthesized
gcaattttcctgaatttgccaa

SEQ ID NO: 1130797 - DNA, 22 bp, Artificial Sequence
  chemically synthesized
tcctgaatttgccaagaggtaa

SEQ ID NO: 1130798 - DNA, 22 bp, Artificial Sequence
  chemically synthesized
caaacccttcccttacctcttg

SEQ ID NO: 1130799 - DNA, 22 bp, Artificial Sequence
  chemically synthesized
cctgaatttgccaagaggtaag

SEQ ID NO: 1130800 - DNA, 22 bp, Artificial Sequence
  chemically synthesized
ctgaatttgccaagaggtaagg

SEQ ID NO: 1130801 - DNA, 22 bp, Artificial Sequence
  chemically synthesized
ctacaaacccttcccttacctc

SEQ ID NO: 1130802 - DNA, 22 bp, Artificial Sequence
  chemically synthesized
aatttgccaagaggtaagggaa

SEQ ID NO: 1130803 - DNA, 22 bp, Artificial Sequence
  chemically synthesized
gccaagaggtaagggaagggtt

SEQ ID NO: 1130804 - DNA, 22 bp, Artificial Sequence
  chemically synthesized
ccaagaggtaagggaagggttt

SEQ ID NO: 1130805 - DNA, 22 bp, Artificial Sequence
  chemically synthesized
gtgtatgaggcagggagattac

SEQ ID NO: 1130806 - DNA, 22 bp, Artificial Sequence
  chemically synthesized
gtagtaatctccctgcctcata

SEQ ID NO: 1130807 - DNA, 22 bp, Artificial Sequence
  chemically synthesized
tagtaatctccctgcctcatac

SEQ ID NO: 1130808 - DNA, 22 bp, Artificial Sequence
  chemically synthesized
cctgcctcatacacgaggactg

SEQ ID NO: 1130809 - DNA, 22 bp, Artificial Sequence
  chemically synthesized
acatgaaaggaatcagtcctcg

SEQ ID NO: 1130810 - DNA, 22 bp, Artificial Sequence
  chemically synthesized
cctcatacacgaggactgattc

SEQ ID NO: 1130811 - DNA, 22 bp, Artificial Sequence
  chemically synthesized
ctcacatgaaaggaatcagtcc

SEQ ID NO: 1130812 - DNA, 22 bp, Artificial Sequence
  chemically synthesized
cctcacatgaaaggaatcagtc

SEQ ID NO: 1130813 - DNA, 22 bp, Artificial Sequence
  chemically synthesized
atacacgaggactgattccttt

SEQ ID NO: 1130814 - DNA, 22 bp, Artificial Sequence
  chemically synthesized
ccatttcctcacatgaaaggaa

SEQ ID NO: 1130815 - DNA, 22 bp, Artificial Sequence
  chemically synthesized
cccatttcctcacatgaaagga

SEQ ID NO: 1130816 - DNA, 22 bp, Artificial Sequence
  chemically synthesized
tcccatttcctcacatgaaagg

SEQ ID NO: 1130817 - DNA, 22 bp, Artificial Sequence
  chemically synthesized
ttcccatttcctcacatgaaag

SEQ ID NO: 1130818 - DNA, 22 bp, Artificial Sequence
  chemically synthesized
aggcttttcccatttcctcaca

SEQ ID NO: 1130819 - DNA, 22 bp, Artificial Sequence
  chemically synthesized
attcctttcatgtgaggaaatg

SEQ ID NO: 1130820 - DNA, 22 bp, Artificial Sequence
  chemically synthesized
ctttcatgtgaggaaatgggaa

SEQ ID NO: 1130821 - DNA, 22 bp, Artificial Sequence
  chemically synthesized
tcatgtgaggaaatgggaaaag

SEQ ID NO: 1130822 - DNA, 22 bp, Artificial Sequence
  chemically synthesized
catgtgaggaaatgggaaaagc

SEQ ID NO: 1130823 - DNA, 22 bp, Artificial Sequence
  chemically synthesized
atgtgaggaaatgggaaaagcc

SEQ ID NO: 1130824 - DNA, 22 bp, Artificial Sequence
  chemically synthesized
aaataagaagatcctgaggctt

SEQ ID NO: 1130825 - DNA, 22 bp, Artificial Sequence
  chemically synthesized
gaagctgaaataagaagatcct

SEQ ID NO: 1130826 - DNA, 22 bp, Artificial Sequence
  chemically synthesized
ggaagctgaaataagaagatcc

SEQ ID NO: 1130827 - DNA, 22 bp, Artificial Sequence
  chemically synthesized
ccaatttggaagctgaaataag

SEQ ID NO: 1130828 - DNA, 22 bp, Artificial Sequence
  chemically synthesized
aggatcttcttatttcagcttc

SEQ ID NO: 1130829 - DNA, 22 bp, Artificial Sequence
  chemically synthesized
attgccaatttggaagctgaaa

SEQ ID NO: 1130830 - DNA, 22 bp, Artificial Sequence
  chemically synthesized
ttcattgccaatttggaagctg

SEQ ID NO: 1130831 - DNA, 22 bp, Artificial Sequence
  chemically synthesized
actgttcattgccaatttggaa

SEQ ID NO: 1130832 - DNA, 22 bp, Artificial Sequence
  chemically synthesized
cttatttcagcttccaaattgg

SEQ ID NO: 1130833 - DNA, 22 bp, Artificial Sequence
  chemically synthesized
cactgttcattgccaatttgga

SEQ ID NO: 1130834 - DNA, 22 bp, Artificial Sequence
  chemically synthesized
ttatttcagcttccaaattggc

SEQ ID NO: 1130835 - DNA, 22 bp, Artificial Sequence
  chemically synthesized
atttcagcttccaaattggcaa

SEQ ID NO: 1130836 - DNA, 22 bp, Artificial Sequence
  chemically synthesized
cttcactgttcattgccaattt

SEQ ID NO: 1130837 - DNA, 22 bp, Artificial Sequence
  chemically synthesized
tttcagcttccaaattggcaat

SEQ ID NO: 1130838 - DNA, 22 bp, Artificial Sequence
  chemically synthesized
ttccttcactgttcattgccaa

SEQ ID NO: 1130839 - DNA, 22 bp, Artificial Sequence
  chemically synthesized
cagcttccaaattggcaatgaa

SEQ ID NO: 1130840 - DNA, 22 bp, Artificial Sequence
  chemically synthesized
attccttcactgttcattgcca

SEQ ID NO: 1130841 - DNA, 22 bp, Artificial Sequence
  chemically synthesized
agcttccaaattggcaatgaac

SEQ ID NO: 1130842 - DNA, 22 bp, Artificial Sequence
  chemically synthesized
tattccttcactgttcattgcc

SEQ ID NO: 1130843 - DNA, 22 bp, Artificial Sequence
  chemically synthesized
ccaaattggcaatgaacagtga

SEQ ID NO: 1130844 - DNA, 22 bp, Artificial Sequence
  chemically synthesized
caaattggcaatgaacagtgaa

SEQ ID NO: 1130845 - DNA, 22 bp, Artificial Sequence
  chemically synthesized
gcaatgaacagtgaaggaataa

SEQ ID NO: 1130846 - DNA, 22 bp, Artificial Sequence
  chemically synthesized
agacatcatggaaaagatttta

SEQ ID NO: 1130847 - DNA, 22 bp, Artificial Sequence
  chemically synthesized
aagacatcatggaaaagatttt

SEQ ID NO: 1130848 - DNA, 22 bp, Artificial Sequence
  chemically synthesized
cttaagacatcatggaaaagat

SEQ ID NO: 1130849 - DNA, 22 bp, Artificial Sequence
  chemically synthesized
acttaagacatcatggaaaaga

SEQ ID NO: 1130850 - DNA, 22 bp, Artificial Sequence
  chemically synthesized
tacttaagacatcatggaaaag

SEQ ID NO: 1130851 - DNA, 22 bp, Artificial Sequence
  chemically synthesized
ttacttaagacatcatggaaaa

SEQ ID NO: 1130852 - DNA, 22 bp, Artificial Sequence
  chemically synthesized
ttccatgatgtcttaagtaaaa

SEQ ID NO: 1130853 - DNA, 22 bp, Artificial Sequence
  chemically synthesized
tccatgatgtcttaagtaaaaa

SEQ ID NO: 1130854 - DNA, 22 bp, Artificial Sequence
  chemically synthesized
ccatgatgtcttaagtaaaaat

SEQ ID NO: 1130855 - DNA, 22 bp, Artificial Sequence
  chemically synthesized
catgatgtcttaagtaaaaatt

SEQ ID NO: 1130856 - DNA, 22 bp, Artificial Sequence
  chemically synthesized
tgtatgtcaaagcaatttttac

SEQ ID NO: 1130857 - DNA, 22 bp, Artificial Sequence
  chemically synthesized
agctatgtatgtcaaagcaatt

SEQ ID NO: 1130858 - DNA, 22 bp, Artificial Sequence
  chemically synthesized
aagctatgtatgtcaaagcaat

SEQ ID NO: 1130859 - DNA, 22 bp, Artificial Sequence
  chemically synthesized
taagctatgtatgtcaaagcaa

SEQ ID NO: 1130860 - DNA, 22 bp, Artificial Sequence
  chemically synthesized
ttaagctatgtatgtcaaagca

SEQ ID NO: 1130861 - DNA, 22 bp, Artificial Sequence
  chemically synthesized
tttaagctatgtatgtcaaagc

SEQ ID NO: 1130862 - DNA, 22 bp, Artificial Sequence
  chemically synthesized
aagtaaaaattgctttgacata

SEQ ID NO: 1130863 - DNA, 22 bp, Artificial Sequence
  chemically synthesized
agtaaaaattgctttgacatac

SEQ ID NO: 1130864 - DNA, 22 bp, Artificial Sequence
  chemically synthesized
ctttgacatacatagcttaaaa

SEQ ID NO: 1130865 - DNA, 22 bp, Artificial Sequence
  chemically synthesized
acaaaaggtagcctttttaagc

SEQ ID NO: 1130866 - DNA, 22 bp, Artificial Sequence
  chemically synthesized
tgacatacatagcttaaaaagg

SEQ ID NO: 1130867 - DNA, 22 bp, Artificial Sequence
  chemically synthesized
aacaaaaggtagcctttttaag

SEQ ID NO: 1130868 - DNA, 22 bp, Artificial Sequence
  chemically synthesized
gacatacatagcttaaaaaggc

SEQ ID NO: 1130869 - DNA, 22 bp, Artificial Sequence
  chemically synthesized
taacaaaaggtagcctttttaa

SEQ ID NO: 1130870 - DNA, 22 bp, Artificial Sequence
  chemically synthesized
acatacatagcttaaaaaggct

SEQ ID NO: 1130871 - DNA, 22 bp, Artificial Sequence
  chemically synthesized
aaaaaggctaccttttgttaaa

SEQ ID NO: 1130872 - DNA, 22 bp, Artificial Sequence
  chemically synthesized
aaaaggctaccttttgttaaag

SEQ ID NO: 1130873 - DNA, 22 bp, Artificial Sequence
  chemically synthesized
acataggtaaagatatgtcttt

SEQ ID NO: 1130874 - DNA, 22 bp, Artificial Sequence
  chemically synthesized
ccttttgttaaagacatatctt

SEQ ID NO: 1130875 - DNA, 22 bp, Artificial Sequence
  chemically synthesized
ttgttaaagacatatctttacc

SEQ ID NO: 1130876 - DNA, 22 bp, Artificial Sequence
  chemically synthesized
tgttaaagacatatctttacct

SEQ ID NO: 1130877 - DNA, 22 bp, Artificial Sequence
  chemically synthesized
agtccctcacataggtaaagat

SEQ ID NO: 1130878 - DNA, 22 bp, Artificial Sequence
  chemically synthesized
gttaaagacatatctttaccta

SEQ ID NO: 1130879 - DNA, 22 bp, Artificial Sequence
  chemically synthesized
cagtccctcacataggtaaaga

SEQ ID NO: 1130880 - DNA, 22 bp, Artificial Sequence
  chemically synthesized
ttaaagacatatctttacctat

SEQ ID NO: 1130881 - DNA, 22 bp, Artificial Sequence
  chemically synthesized
aagacatatctttacctatgtg

SEQ ID NO: 1130882 - DNA, 22 bp, Artificial Sequence
  chemically synthesized
tacctatgtgagggactgaagg

SEQ ID NO: 1130883 - DNA, 22 bp, Artificial Sequence
  chemically synthesized
acctatgtgagggactgaagga

SEQ ID NO: 1130884 - DNA, 22 bp, Artificial Sequence
  chemically synthesized
ccaaaatggaaatccttcagtc

SEQ ID NO: 1130885 - DNA, 22 bp, Artificial Sequence
  chemically synthesized
cctatgtgagggactgaaggat

SEQ ID NO: 1130886 - DNA, 22 bp, Artificial Sequence
  chemically synthesized
tgtgagggactgaaggatttcc

SEQ ID NO: 1130887 - DNA, 22 bp, Artificial Sequence
  chemically synthesized
gcctaccaaaatggaaatcctt

SEQ ID NO: 1130888 - DNA, 22 bp, Artificial Sequence
  chemically synthesized
agcctaccaaaatggaaatcct

SEQ ID NO: 1130889 - DNA, 22 bp, Artificial Sequence
  chemically synthesized
tagcctaccaaaatggaaatcc

SEQ ID NO: 1130890 - DNA, 22 bp, Artificial Sequence
  chemically synthesized
ttagcctaccaaaatggaaatc

SEQ ID NO: 1130891 - DNA, 22 bp, Artificial Sequence
  chemically synthesized
gtatccttttagcctaccaaaa

SEQ ID NO: 1130892 - DNA, 22 bp, Artificial Sequence
  chemically synthesized
aaggatttccattttggtaggc

SEQ ID NO: 1130893 - DNA, 22 bp, Artificial Sequence
  chemically synthesized
agtatccttttagcctaccaaa

SEQ ID NO: 1130894 - DNA, 22 bp, Artificial Sequence
  chemically synthesized
ttagtatccttttagcctacca

SEQ ID NO: 1130895 - DNA, 22 bp, Artificial Sequence
  chemically synthesized
ccattttggtaggctaaaagga

SEQ ID NO: 1130896 - DNA, 22 bp, Artificial Sequence
  chemically synthesized
taattcttagtatccttttagc

SEQ ID NO: 1130897 - DNA, 22 bp, Artificial Sequence
  chemically synthesized
cattttggtaggctaaaaggat

SEQ ID NO: 1130898 - DNA, 22 bp, Artificial Sequence
  chemically synthesized
tggtaggctaaaaggatactaa

SEQ ID NO: 1130899 - DNA, 22 bp, Artificial Sequence
  chemically synthesized
ggtaggctaaaaggatactaag

SEQ ID NO: 1130900 - DNA, 22 bp, Artificial Sequence
  chemically synthesized
gtaggctaaaaggatactaaga

SEQ ID NO: 1130901 - DNA, 22 bp, Artificial Sequence
  chemically synthesized
aaaggatactaagaattacagt

SEQ ID NO: 1130902 - DNA, 22 bp, Artificial Sequence
  chemically synthesized
gcaaatgtagaaactgtaattc

SEQ ID NO: 1130903 - DNA, 22 bp, Artificial Sequence
  chemically synthesized
ggcaaatgtagaaactgtaatt

SEQ ID NO: 1130904 - DNA, 22 bp, Artificial Sequence
  chemically synthesized
tgcttggcaaatgtagaaactg

SEQ ID NO: 1130905 - DNA, 22 bp, Artificial Sequence
  chemically synthesized
agaattacagtttctacatttg

SEQ ID NO: 1130906 - DNA, 22 bp, Artificial Sequence
  chemically synthesized
cagtttctacatttgccaagca

SEQ ID NO: 1130907 - DNA, 22 bp, Artificial Sequence
  chemically synthesized
gagaagataaaacctgtgcttg

SEQ ID NO: 1130908 - DNA, 22 bp, Artificial Sequence
  chemically synthesized
ctacatttgccaagcacaggtt

SEQ ID NO: 1130909 - DNA, 22 bp, Artificial Sequence
  chemically synthesized
tacatttgccaagcacaggttt

SEQ ID NO: 1130910 - DNA, 22 bp, Artificial Sequence
  chemically synthesized
catttgccaagcacaggtttta

SEQ ID NO: 1130911 - DNA, 22 bp, Artificial Sequence
  chemically synthesized
gccaagcacaggttttatcttc

SEQ ID NO: 1130912 - DNA, 22 bp, Artificial Sequence
  chemically synthesized
ccaagcacaggttttatcttct

SEQ ID NO: 1130913 - DNA, 22 bp, Artificial Sequence
  chemically synthesized
tggagatcctagagaagataaa

SEQ ID NO: 1130914 - DNA, 22 bp, Artificial Sequence
  chemically synthesized
aataatgaatctatggagatcc

SEQ ID NO: 1130915 - DNA, 22 bp, Artificial Sequence
  chemically synthesized
tatcttctctaggatctccata

SEQ ID NO: 1130916 - DNA, 22 bp, Artificial Sequence
  chemically synthesized
atcttctctaggatctccatag

SEQ ID NO: 1130917 - DNA, 22 bp, Artificial Sequence
  chemically synthesized
taaataatgaatctatggagat

SEQ ID NO: 1130918 - DNA, 22 bp, Artificial Sequence
  chemically synthesized
tcttctctaggatctccataga

SEQ ID NO: 1130919 - DNA, 22 bp, Artificial Sequence
  chemically synthesized
attctaaataatgaatctatgg

SEQ ID NO: 1130920 - DNA, 22 bp, Artificial Sequence
  chemically synthesized
ctctaggatctccatagattca

SEQ ID NO: 1130921 - DNA, 22 bp, Artificial Sequence
  chemically synthesized
tctaggatctccatagattcat

SEQ ID NO: 1130922 - DNA, 22 bp, Artificial Sequence
  chemically synthesized
taggatctccatagattcatta

SEQ ID NO: 1130923 - DNA, 22 bp, Artificial Sequence
  chemically synthesized
ggatctccatagattcattatt

SEQ ID NO: 1130924 - DNA, 22 bp, Artificial Sequence
  chemically synthesized
agtgattcattctaaataatga

SEQ ID NO: 1130925 - DNA, 22 bp, Artificial Sequence
  chemically synthesized
catagattcattatttagaatg

SEQ ID NO: 1130926 - DNA, 22 bp, Artificial Sequence
  chemically synthesized
aggttcagtgattcattctaaa

SEQ ID NO: 1130927 - DNA, 22 bp, Artificial Sequence
  chemically synthesized
gaggttcagtgattcattctaa

SEQ ID NO: 1130928 - DNA, 22 bp, Artificial Sequence
  chemically synthesized
tttgaggttcagtgattcattc

SEQ ID NO: 1130929 - DNA, 22 bp, Artificial Sequence
  chemically synthesized
attatttagaatgaatcactga

SEQ ID NO: 1130930 - DNA, 22 bp, Artificial Sequence
  chemically synthesized
aagttgtttgaggttcagtgat

SEQ ID NO: 1130931 - DNA, 22 bp, Artificial Sequence
  chemically synthesized
tttagaatgaatcactgaacct

SEQ ID NO: 1130932 - DNA, 22 bp, Artificial Sequence
  chemically synthesized
agaatgaatcactgaacctcaa

SEQ ID NO: 1130933 - DNA, 22 bp, Artificial Sequence
  chemically synthesized
gaatgaatcactgaacctcaaa

SEQ ID NO: 1130934 - DNA, 22 bp, Artificial Sequence
  chemically synthesized
taattaaagttgtttgaggttc

SEQ ID NO: 1130935 - DNA, 22 bp, Artificial Sequence
  chemically synthesized
ataattaaagttgtttgaggtt

SEQ ID NO: 1130936 - DNA, 22 bp, Artificial Sequence
  chemically synthesized
tcaacagacttataattaaagt

SEQ ID NO: 1130937 - DNA, 22 bp, Artificial Sequence
  chemically synthesized
aacctcaaacaactttaattat

SEQ ID NO: 1130938 - DNA, 22 bp, Artificial Sequence
  chemically synthesized
gtcaacagacttataattaaag

SEQ ID NO: 1130939 - DNA, 22 bp, Artificial Sequence
  chemically synthesized
aaacaactttaattataagtct

SEQ ID NO: 1130940 - DNA, 22 bp, Artificial Sequence
  chemically synthesized
acataacttgtcaacagactta

SEQ ID NO: 1130941 - DNA, 22 bp, Artificial Sequence
  chemically synthesized
gacataacttgtcaacagactt

SEQ ID NO: 1130942 - DNA, 22 bp, Artificial Sequence
  chemically synthesized
taattataagtctgttgacaag

SEQ ID NO: 1130943 - DNA, 22 bp, Artificial Sequence
  chemically synthesized
atcttgacataacttgtcaaca

SEQ ID NO: 1130944 - DNA, 22 bp, Artificial Sequence
  chemically synthesized
aattataagtctgttgacaagt

SEQ ID NO: 1130945 - DNA, 22 bp, Artificial Sequence
  chemically synthesized
catcttgacataacttgtcaac

SEQ ID NO: 1130946 - DNA, 22 bp, Artificial Sequence
  chemically synthesized
attataagtctgttgacaagtt

SEQ ID NO: 1130947 - DNA, 22 bp, Artificial Sequence
  chemically synthesized
tcatcttgacataacttgtcaa

SEQ ID NO: 1130948 - DNA, 22 bp, Artificial Sequence
  chemically synthesized
ctttcatcttgacataacttgt

SEQ ID NO: 1130949 - DNA, 22 bp, Artificial Sequence
  chemically synthesized
taagtctgttgacaagttatgt

SEQ ID NO: 1130950 - DNA, 22 bp, Artificial Sequence
  chemically synthesized
tgctttcatcttgacataactt

SEQ ID NO: 1130951 - DNA, 22 bp, Artificial Sequence
  chemically synthesized
ctgctttcatcttgacataact

SEQ ID NO: 1130952 - DNA, 22 bp, Artificial Sequence
  chemically synthesized
tctgctttcatcttgacataac

SEQ ID NO: 1130953 - DNA, 22 bp, Artificial Sequence
  chemically synthesized
ctttctgctttcatcttgacat

SEQ ID NO: 1130954 - DNA, 22 bp, Artificial Sequence
  chemically synthesized
ttgacaagttatgtcaagatga

SEQ ID NO: 1130955 - DNA, 22 bp, Artificial Sequence
  chemically synthesized
acaagttatgtcaagatgaaag

SEQ ID NO: 1130956 - DNA, 22 bp, Artificial Sequence
  chemically synthesized
tgttgctttctgctttcatctt

SEQ ID NO: 1130957 - DNA, 22 bp, Artificial Sequence
  chemically synthesized
gagctatgttgctttctgcttt

SEQ ID NO: 1130958 - DNA, 22 bp, Artificial Sequence
  chemically synthesized
agagctatgttgctttctgctt

SEQ ID NO: 1130959 - DNA, 22 bp, Artificial Sequence
  chemically synthesized
tgtcaagatgaaagcagaaagc

SEQ ID NO: 1130960 - DNA, 22 bp, Artificial Sequence
  chemically synthesized
tagagctatgttgctttctgct

SEQ ID NO: 1130961 - DNA, 22 bp, Artificial Sequence
  chemically synthesized
ttagagctatgttgctttctgc

SEQ ID NO: 1130962 - DNA, 22 bp, Artificial Sequence
  chemically synthesized
tttagagctatgttgctttctg

SEQ ID NO: 1130963 - DNA, 22 bp, Artificial Sequence
  chemically synthesized
ttttagagctatgttgctttct

SEQ ID NO: 1130964 - DNA, 22 bp, Artificial Sequence
  chemically synthesized
tttttagagctatgttgctttc

SEQ ID NO: 1130965 - DNA, 22 bp, Artificial Sequence
  chemically synthesized
agctttttttagagctatgttg

SEQ ID NO: 1130966 - DNA, 22 bp, Artificial Sequence
  chemically synthesized
aagctttttttagagctatgtt

SEQ ID NO: 1130967 - DNA, 22 bp, Artificial Sequence
  chemically synthesized
taagctttttttagagctatgt

SEQ ID NO: 1130968 - DNA, 22 bp, Artificial Sequence
  chemically synthesized
tattttaagctttttttagagc

SEQ ID NO: 1130969 - DNA, 22 bp, Artificial Sequence
  chemically synthesized
atattttaagctttttttagag

SEQ ID NO: 1130970 - DNA, 22 bp, Artificial Sequence
  chemically synthesized
agtttatattttaagctttttt

SEQ ID NO: 1130971 - DNA, 22 bp, Artificial Sequence
  chemically synthesized
gagtttatattttaagcttttt

SEQ ID NO: 1130972 - DNA, 22 bp, Artificial Sequence
  chemically synthesized
taaaaaaagcttaaaatataaa

SEQ ID NO: 1130973 - DNA, 22 bp, Artificial Sequence
  chemically synthesized
aaaaaagcttaaaatataaact

SEQ ID NO: 1130974 - DNA, 22 bp, Artificial Sequence
  chemically synthesized
ggtgcaatgtttgagtttatat

SEQ ID NO: 1130975 - DNA, 22 bp, Artificial Sequence
  chemically synthesized
tgttgggtgcaatgtttgagtt

SEQ ID NO: 1130976 - DNA, 22 bp, Artificial Sequence
  chemically synthesized
gtgttgggtgcaatgtttgagt

SEQ ID NO: 1130977 - DNA, 22 bp, Artificial Sequence
  chemically synthesized
tgtgttgggtgcaatgtttgag

SEQ ID NO: 1130978 - DNA, 22 bp, Artificial Sequence
  chemically synthesized
aaaatataaactcaaacattgc

SEQ ID NO: 1130979 - DNA, 22 bp, Artificial Sequence
  chemically synthesized
aaatataaactcaaacattgca

SEQ ID NO: 1130980 - DNA, 22 bp, Artificial Sequence
  chemically synthesized
aaacattgcacccaacacaaaa

SEQ ID NO: 1130981 - DNA, 22 bp, Artificial Sequence
  chemically synthesized
tcacgtaatggtcattttgtgt

SEQ ID NO: 1130982 - DNA, 22 bp, Artificial Sequence
  chemically synthesized
atcacgtaatggtcattttgtg

SEQ ID NO: 1130983 - DNA, 22 bp, Artificial Sequence
  chemically synthesized
tatcacgtaatggtcattttgt

SEQ ID NO: 1130984 - DNA, 22 bp, Artificial Sequence
  chemically synthesized
cacccaacacaaaatgaccatt

SEQ ID NO: 1130985 - DNA, 22 bp, Artificial Sequence
  chemically synthesized
attttatcacgtaatggtcatt

SEQ ID NO: 1130986 - DNA, 22 bp, Artificial Sequence
  chemically synthesized
gaaataaaactaattttatcac

SEQ ID NO: 1130987 - DNA, 22 bp, Artificial Sequence
  chemically synthesized
actagaaataaaactaatttta

SEQ ID NO: 1130988 - DNA, 22 bp, Artificial Sequence
  chemically synthesized
gactagaaataaaactaatttt

SEQ ID NO: 1130989 - DNA, 22 bp, Artificial Sequence
  chemically synthesized
tgactagaaataaaactaattt

SEQ ID NO: 1130990 - DNA, 22 bp, Artificial Sequence
  chemically synthesized
ttgactagaaataaaactaatt

SEQ ID NO: 1130991 - DNA, 22 bp, Artificial Sequence
  chemically synthesized
tttgactagaaataaaactaat

SEQ ID NO: 1130992 - DNA, 22 bp, Artificial Sequence
  chemically synthesized
tttttgactagaaataaaacta

SEQ ID NO: 1130993 - DNA, 22 bp, Artificial Sequence
  chemically synthesized
cgtgataaaattagttttattt

SEQ ID NO: 1130994 - DNA, 22 bp, Artificial Sequence
  chemically synthesized
ctttttgactagaaataaaact

SEQ ID NO: 1130995 - DNA, 22 bp, Artificial Sequence
  chemically synthesized
tctttttgactagaaataaaac

SEQ ID NO: 1130996 - DNA, 22 bp, Artificial Sequence
  chemically synthesized
cattttctttttgactagaaat

SEQ ID NO: 1130997 - DNA, 22 bp, Artificial Sequence
  chemically synthesized
gttttatttctagtcaaaaaga

SEQ ID NO: 1130998 - DNA, 22 bp, Artificial Sequence
  chemically synthesized
aaaactacattttctttttgac

SEQ ID NO: 1130999 - DNA, 22 bp, Artificial Sequence
  chemically synthesized
ctaaaaactacattttcttttt

SEQ ID NO: 1131000 - DNA, 22 bp, Artificial Sequence
  chemically synthesized
tatttctagtcaaaaagaaaat

SEQ ID NO: 1131001 - DNA, 22 bp, Artificial Sequence
  chemically synthesized
atttctagtcaaaaagaaaatg

SEQ ID NO: 1131002 - DNA, 22 bp, Artificial Sequence
  chemically synthesized
tttctagtcaaaaagaaaatgt

SEQ ID NO: 1131003 - DNA, 22 bp, Artificial Sequence
  chemically synthesized
ctagtcaaaaagaaaatgtagt

SEQ ID NO: 1131004 - DNA, 22 bp, Artificial Sequence
  chemically synthesized
tagtcaaaaagaaaatgtagtt

SEQ ID NO: 1131005 - DNA, 22 bp, Artificial Sequence
  chemically synthesized
gaatcctactaaaaactacatt

SEQ ID NO: 1131006 - DNA, 22 bp, Artificial Sequence
  chemically synthesized
gtcaaaaagaaaatgtagtttt

SEQ ID NO: 1131007 - DNA, 22 bp, Artificial Sequence
  chemically synthesized
ggaatcctactaaaaactacat

SEQ ID NO: 1131008 - DNA, 22 bp, Artificial Sequence
  chemically synthesized
ttggaatcctactaaaaactac

SEQ ID NO: 1131009 - DNA, 22 bp, Artificial Sequence
  chemically synthesized
caaagtaaatgctcttggaatc

SEQ ID NO: 1131010 - DNA, 22 bp, Artificial Sequence
  chemically synthesized
ttagtaggattccaagagcatt

SEQ ID NO: 1131011 - DNA, 22 bp, Artificial Sequence
  chemically synthesized
tagtaggattccaagagcattt

SEQ ID NO: 1131012 - DNA, 22 bp, Artificial Sequence
  chemically synthesized
aaattacaaagtaaatgctctt

SEQ ID NO: 1131013 - DNA, 22 bp, Artificial Sequence
  chemically synthesized
agtaggattccaagagcattta

SEQ ID NO: 1131014 - DNA, 22 bp, Artificial Sequence
  chemically synthesized
gtaggattccaagagcatttac

SEQ ID NO: 1131015 - DNA, 22 bp, Artificial Sequence
  chemically synthesized
aaaaatattcaaattacaaagt

SEQ ID NO: 1131016 - DNA, 22 bp, Artificial Sequence
  chemically synthesized
caagagcatttactttgtaatt

SEQ ID NO: 1131017 - DNA, 22 bp, Artificial Sequence
  chemically synthesized
atggttaaaaaatattcaaatt

SEQ ID NO: 1131018 - DNA, 22 bp, Artificial Sequence
  chemically synthesized
tcatggttaaaaaatattcaaa

SEQ ID NO: 1131019 - DNA, 22 bp, Artificial Sequence
  chemically synthesized
ctcatggttaaaaaatattcaa

SEQ ID NO: 1131020 - DNA, 22 bp, Artificial Sequence
  chemically synthesized
tctcatggttaaaaaatattca

SEQ ID NO: 1131021 - DNA, 22 bp, Artificial Sequence
  chemically synthesized
actttgtaatttgaatattttt

SEQ ID NO: 1131022 - DNA, 22 bp, Artificial Sequence
  chemically synthesized
ctttgtaatttgaatatttttt

SEQ ID NO: 1131023 - DNA, 22 bp, Artificial Sequence
  chemically synthesized
tgtaatttgaatattttttaac

SEQ ID NO: 1131024 - DNA, 22 bp, Artificial Sequence
  chemically synthesized
gtaatttgaatattttttaacc

SEQ ID NO: 1131025 - DNA, 22 bp, Artificial Sequence
  chemically synthesized
taatttgaatattttttaacca

SEQ ID NO: 1131026 - DNA, 22 bp, Artificial Sequence
  chemically synthesized
caaagcaagttttctcatggtt

SEQ ID NO: 1131027 - DNA, 22 bp, Artificial Sequence
  chemically synthesized
gaatattttttaaccatgagaa

SEQ ID NO: 1131028 - DNA, 22 bp, Artificial Sequence
  chemically synthesized
gcaaagcaagttttctcatggt

SEQ ID NO: 1131029 - DNA, 22 bp, Artificial Sequence
  chemically synthesized
aatattttttaaccatgagaaa

SEQ ID NO: 1131030 - DNA, 22 bp, Artificial Sequence
  chemically synthesized
tgcaaagcaagttttctcatgg

SEQ ID NO: 1131031 - DNA, 22 bp, Artificial Sequence
  chemically synthesized
tttgcaaagcaagttttctcat

SEQ ID NO: 1131032 - DNA, 22 bp, Artificial Sequence
  chemically synthesized
ctttgcaaagcaagttttctca

SEQ ID NO: 1131033 - DNA, 22 bp, Artificial Sequence
  chemically synthesized
tctttgcaaagcaagttttctc

SEQ ID NO: 1131034 - DNA, 22 bp, Artificial Sequence
  chemically synthesized
tttaaccatgagaaaacttgct

SEQ ID NO: 1131035 - DNA, 22 bp, Artificial Sequence
  chemically synthesized
ttaaccatgagaaaacttgctt

SEQ ID NO: 1131036 - DNA, 22 bp, Artificial Sequence
  chemically synthesized
taaccatgagaaaacttgcttt

SEQ ID NO: 1131037 - DNA, 22 bp, Artificial Sequence
  chemically synthesized
cattttctttgcaaagcaagtt

SEQ ID NO: 1131038 - DNA, 22 bp, Artificial Sequence
  chemically synthesized
aaccatgagaaaacttgctttg

SEQ ID NO: 1131039 - DNA, 22 bp, Artificial Sequence
  chemically synthesized
accatgagaaaacttgctttgc

SEQ ID NO: 1131040 - DNA, 22 bp, Artificial Sequence
  chemically synthesized
aaaactgcattttctttgcaaa

SEQ ID NO: 1131041 - DNA, 22 bp, Artificial Sequence
  chemically synthesized
ctaaaaactgcattttctttgc

SEQ ID NO: 1131042 - DNA, 22 bp, Artificial Sequence
  chemically synthesized
gctttgcaaagaaaatgcagtt

SEQ ID NO: 1131043 - DNA, 22 bp, Artificial Sequence
  chemically synthesized
ctttgcaaagaaaatgcagttt

SEQ ID NO: 1131044 - DNA, 22 bp, Artificial Sequence
  chemically synthesized
ggatcctactaaaaactgcatt

SEQ ID NO: 1131045 - DNA, 22 bp, Artificial Sequence
  chemically synthesized
gggatcctactaaaaactgcat

SEQ ID NO: 1131046 - DNA, 22 bp, Artificial Sequence
  chemically synthesized
tgcaaagaaaatgcagttttta

SEQ ID NO: 1131047 - DNA, 22 bp, Artificial Sequence
  chemically synthesized
gcaaagaaaatgcagtttttag

SEQ ID NO: 1131048 - DNA, 22 bp, Artificial Sequence
  chemically synthesized
caaagaaaatgcagtttttagt

SEQ ID NO: 1131049 - DNA, 22 bp, Artificial Sequence
  chemically synthesized
tcttgggatcctactaaaaact

SEQ ID NO: 1131050 - DNA, 22 bp, Artificial Sequence
  chemically synthesized
ttagtaggatcccaagataatt

SEQ ID NO: 1131051 - DNA, 22 bp, Artificial Sequence
  chemically synthesized
tagtaggatcccaagataattt

SEQ ID NO: 1131052 - DNA, 22 bp, Artificial Sequence
  chemically synthesized
aaataaaaaaataaattatctt

SEQ ID NO: 1131053 - DNA, 22 bp, Artificial Sequence
  chemically synthesized
agtaggatcccaagataattta

SEQ ID NO: 1131054 - DNA, 22 bp, Artificial Sequence
  chemically synthesized
gtaggatcccaagataatttat

SEQ ID NO: 1131055 - DNA, 22 bp, Artificial Sequence
  chemically synthesized
aaaaaatattcaaataaaaaaa

SEQ ID NO: 1131056 - DNA, 22 bp, Artificial Sequence
  chemically synthesized
atggttaaaaaaatattcaaat

SEQ ID NO: 1131057 - DNA, 22 bp, Artificial Sequence
  chemically synthesized
atttttttatttgaatattttt

SEQ ID NO: 1131058 - DNA, 22 bp, Artificial Sequence
  chemically synthesized
tttttttatttgaatatttttt

SEQ ID NO: 1131059 - DNA, 22 bp, Artificial Sequence
  chemically synthesized
ttttatttgaatatttttttaa

SEQ ID NO: 1131060 - DNA, 22 bp, Artificial Sequence
  chemically synthesized
tttatttgaatatttttttaac

SEQ ID NO: 1131061 - DNA, 22 bp, Artificial Sequence
  chemically synthesized
ttatttgaatatttttttaacc

SEQ ID NO: 1131062 - DNA, 22 bp, Artificial Sequence
  chemically synthesized
tatttgaatatttttttaacca

SEQ ID NO: 1131063 - DNA, 22 bp, Artificial Sequence
  chemically synthesized
atttgaatatttttttaaccat

SEQ ID NO: 1131064 - DNA, 22 bp, Artificial Sequence
  chemically synthesized
tttgaatatttttttaaccatg

SEQ ID NO: 1131065 - DNA, 22 bp, Artificial Sequence
  chemically synthesized
gaatatttttttaaccatgagc

SEQ ID NO: 1131066 - DNA, 22 bp, Artificial Sequence
  chemically synthesized
aatatttttttaaccatgagca

SEQ ID NO: 1131067 - DNA, 22 bp, Artificial Sequence
  chemically synthesized
tatgcaaagaaagtgtgctcat

SEQ ID NO: 1131068 - DNA, 22 bp, Artificial Sequence
  chemically synthesized
ttttaaccatgagcacactttc

SEQ ID NO: 1131069 - DNA, 22 bp, Artificial Sequence
  chemically synthesized
tttaaccatgagcacactttct

SEQ ID NO: 1131070 - DNA, 22 bp, Artificial Sequence
  chemically synthesized
cactgtatgcaaagaaagtgtg

SEQ ID NO: 1131071 - DNA, 22 bp, Artificial Sequence
  chemically synthesized
ttaaccatgagcacactttctt

SEQ ID NO: 1131072 - DNA, 22 bp, Artificial Sequence
  chemically synthesized
taaccatgagcacactttcttt

SEQ ID NO: 1131073 - DNA, 22 bp, Artificial Sequence
  chemically synthesized
aaccatgagcacactttctttg

SEQ ID NO: 1131074 - DNA, 22 bp, Artificial Sequence
  chemically synthesized
accatgagcacactttctttgc

SEQ ID NO: 1131075 - DNA, 22 bp, Artificial Sequence
  chemically synthesized
gcctccactgtatgcaaagaaa

SEQ ID NO: 1131076 - DNA, 22 bp, Artificial Sequence
  chemically synthesized
tagcctccactgtatgcaaaga

SEQ ID NO: 1131077 - DNA, 22 bp, Artificial Sequence
  chemically synthesized
ctagcctccactgtatgcaaag

SEQ ID NO: 1131078 - DNA, 22 bp, Artificial Sequence
  chemically synthesized
tcttctagcctccactgtatgc

SEQ ID NO: 1131079 - DNA, 22 bp, Artificial Sequence
  chemically synthesized
tctttgcatacagtggaggcta

SEQ ID NO: 1131080 - DNA, 22 bp, Artificial Sequence
  chemically synthesized
ctttgcatacagtggaggctag

SEQ ID NO: 1131081 - DNA, 22 bp, Artificial Sequence
  chemically synthesized
tttgcatacagtggaggctaga

SEQ ID NO: 1131082 - DNA, 22 bp, Artificial Sequence
  chemically synthesized
caaaatattatcttctagcctc

SEQ ID NO: 1131083 - DNA, 22 bp, Artificial Sequence
  chemically synthesized
tgcatacagtggaggctagaag

SEQ ID NO: 1131084 - DNA, 22 bp, Artificial Sequence
  chemically synthesized
gcatacagtggaggctagaaga

SEQ ID NO: 1131085 - DNA, 22 bp, Artificial Sequence
  chemically synthesized
catacagtggaggctagaagat

SEQ ID NO: 1131086 - DNA, 22 bp, Artificial Sequence
  chemically synthesized
atctgcaaaatattatcttcta

SEQ ID NO: 1131087 - DNA, 22 bp, Artificial Sequence
  chemically synthesized
aatctgcaaaatattatcttct

SEQ ID NO: 1131088 - DNA, 22 bp, Artificial Sequence
  chemically synthesized
ttaatctgcaaaatattatctt

SEQ ID NO: 1131089 - DNA, 22 bp, Artificial Sequence
  chemically synthesized
cttaatctgcaaaatattatct

SEQ ID NO: 1131090 - DNA, 22 bp, Artificial Sequence
  chemically synthesized
tcttaatctgcaaaatattatc

SEQ ID NO: 1131091 - DNA, 22 bp, Artificial Sequence
  chemically synthesized
ggtattttcttaatctgcaaaa

SEQ ID NO: 1131092 - DNA, 22 bp, Artificial Sequence
  chemically synthesized
gaagataatattttgcagatta

SEQ ID NO: 1131093 - DNA, 22 bp, Artificial Sequence
  chemically synthesized
aaattaggtattttcttaatct

SEQ ID NO: 1131094 - DNA, 22 bp, Artificial Sequence
  chemically synthesized
aaaattaggtattttcttaatc

SEQ ID NO: 1131095 - DNA, 22 bp, Artificial Sequence
  chemically synthesized
tatgtttaaaattaggtatttt

SEQ ID NO: 1131096 - DNA, 22 bp, Artificial Sequence
  chemically synthesized
tgcagattaagaaaatacctaa

SEQ ID NO: 1131097 - DNA, 22 bp, Artificial Sequence
  chemically synthesized
gcagattaagaaaatacctaat

SEQ ID NO: 1131098 - DNA, 22 bp, Artificial Sequence
  chemically synthesized
cagattaagaaaatacctaatt

SEQ ID NO: 1131099 - DNA, 22 bp, Artificial Sequence
  chemically synthesized
gtctgtatgtttaaaattaggt

SEQ ID NO: 1131100 - DNA, 22 bp, Artificial Sequence
  chemically synthesized
tggtctgtatgtttaaaattag

SEQ ID NO: 1131101 - DNA, 22 bp, Artificial Sequence
  chemically synthesized
agaaaatacctaattttaaaca

SEQ ID NO: 1131102 - DNA, 22 bp, Artificial Sequence
  chemically synthesized
cattctggtctgtatgtttaaa

SEQ ID NO: 1131103 - DNA, 22 bp, Artificial Sequence
  chemically synthesized
tgcattctggtctgtatgttta

SEQ ID NO: 1131104 - DNA, 22 bp, Artificial Sequence
  chemically synthesized
attttaaacatacagaccagaa

SEQ ID NO: 1131105 - DNA, 22 bp, Artificial Sequence
  chemically synthesized
agaatctctgcattctggtctg

SEQ ID NO: 1131106 - DNA, 22 bp, Artificial Sequence
  chemically synthesized
cagaatctctgcattctggtct

SEQ ID NO: 1131107 - DNA, 22 bp, Artificial Sequence
  chemically synthesized
tcagaatctctgcattctggtc

SEQ ID NO: 1131108 - DNA, 22 bp, Artificial Sequence
  chemically synthesized
taaacatacagaccagaatgca

SEQ ID NO: 1131109 - DNA, 22 bp, Artificial Sequence
  chemically synthesized
aaacatacagaccagaatgcag

SEQ ID NO: 1131110 - DNA, 22 bp, Artificial Sequence
  chemically synthesized
aacatacagaccagaatgcaga

SEQ ID NO: 1131111 - DNA, 22 bp, Artificial Sequence
  chemically synthesized
gtattttcagaatctctgcatt

SEQ ID NO: 1131112 - DNA, 22 bp, Artificial Sequence
  chemically synthesized
ggtattttcagaatctctgcat

SEQ ID NO: 1131113 - DNA, 22 bp, Artificial Sequence
  chemically synthesized
gcttggtattttcagaatctct

SEQ ID NO: 1131114 - DNA, 22 bp, Artificial Sequence
  chemically synthesized
catgaattagcttggtattttc

SEQ ID NO: 1131115 - DNA, 22 bp, Artificial Sequence
  chemically synthesized
gatataactgcatgaattagct

SEQ ID NO: 1131116 - DNA, 22 bp, Artificial Sequence
  chemically synthesized
tgaaaataccaagctaattcat

SEQ ID NO: 1131117 - DNA, 22 bp, Artificial Sequence
  chemically synthesized
aaaataccaagctaattcatgc

SEQ ID NO: 1131118 - DNA, 22 bp, Artificial Sequence
  chemically synthesized
tgagattggatataactgcatg

SEQ ID NO: 1131119 - DNA, 22 bp, Artificial Sequence
  chemically synthesized
tatgagattggatataactgca

SEQ ID NO: 1131120 - DNA, 22 bp, Artificial Sequence
  chemically synthesized
attcatgcagttatatccaatc

SEQ ID NO: 1131121 - DNA, 22 bp, Artificial Sequence
  chemically synthesized
atgcagttatatccaatctcat

SEQ ID NO: 1131122 - DNA, 22 bp, Artificial Sequence
  chemically synthesized
gtagcacaaatgttctatgaga

SEQ ID NO: 1131123 - DNA, 22 bp, Artificial Sequence
  chemically synthesized
agtagcacaaatgttctatgag

SEQ ID NO: 1131124 - DNA, 22 bp, Artificial Sequence
  chemically synthesized
tagtagcacaaatgttctatga

SEQ ID NO: 1131125 - DNA, 22 bp, Artificial Sequence
  chemically synthesized
ttagtagcacaaatgttctatg

SEQ ID NO: 1131126 - DNA, 22 bp, Artificial Sequence
  chemically synthesized
tatccaatctcatagaacattt

SEQ ID NO: 1131127 - DNA, 22 bp, Artificial Sequence
  chemically synthesized
agagtcaaatttttagtagcac

SEQ ID NO: 1131128 - DNA, 22 bp, Artificial Sequence
  chemically synthesized
atagaacatttgtgctactaaa

SEQ ID NO: 1131129 - DNA, 22 bp, Artificial Sequence
  chemically synthesized
aagagtcaaatttttagtagca

SEQ ID NO: 1131130 - DNA, 22 bp, Artificial Sequence
  chemically synthesized
atttaagagtcaaatttttagt

SEQ ID NO: 1131131 - DNA, 22 bp, Artificial Sequence
  chemically synthesized
gtgctactaaaaatttgactct

SEQ ID NO: 1131132 - DNA, 22 bp, Artificial Sequence
  chemically synthesized
tgctactaaaaatttgactctt

SEQ ID NO: 1131133 - DNA, 22 bp, Artificial Sequence
  chemically synthesized
cagaaattaatttaagagtcaa

SEQ ID NO: 1131134 - DNA, 22 bp, Artificial Sequence
  chemically synthesized
ctaaaaatttgactcttaaatt

SEQ ID NO: 1131135 - DNA, 22 bp, Artificial Sequence
  chemically synthesized
atattacagaaattaatttaag

SEQ ID NO: 1131136 - DNA, 22 bp, Artificial Sequence
  chemically synthesized
aaaatttgactcttaaattaat

SEQ ID NO: 1131137 - DNA, 22 bp, Artificial Sequence
  chemically synthesized
gactcttaaattaatttctgta

SEQ ID NO: 1131138 - DNA, 22 bp, Artificial Sequence
  chemically synthesized
actcttaaattaatttctgtaa

SEQ ID NO: 1131139 - DNA, 22 bp, Artificial Sequence
  chemically synthesized
ttaaattaatttctgtaatatt

SEQ ID NO: 1131140 - DNA, 22 bp, Artificial Sequence
  chemically synthesized
aaattaatttctgtaatattaa

SEQ ID NO: 1131141 - DNA, 22 bp, Artificial Sequence
  chemically synthesized
aattaatttctgtaatattaat

SEQ ID NO: 1131142 - DNA, 22 bp, Artificial Sequence
  chemically synthesized
atttctgtaatattaatatttt

SEQ ID NO: 1131143 - DNA, 22 bp, Artificial Sequence
  chemically synthesized
taagtagataccacgaaaatat

SEQ ID NO: 1131144 - DNA, 22 bp, Artificial Sequence
  chemically synthesized
ctgtaatattaatattttcgtg

SEQ ID NO: 1131145 - DNA, 22 bp, Artificial Sequence
  chemically synthesized
ataagtagataccacgaaaata

SEQ ID NO: 1131146 - DNA, 22 bp, Artificial Sequence
  chemically synthesized
tgtaatattaatattttcgtgg

SEQ ID NO: 1131147 - DNA, 22 bp, Artificial Sequence
  chemically synthesized
tataagtagataccacgaaaat

SEQ ID NO: 1131148 - DNA, 22 bp, Artificial Sequence
  chemically synthesized
taatattaatattttcgtggta

SEQ ID NO: 1131149 - DNA, 22 bp, Artificial Sequence
  chemically synthesized
atattttcgtggtatctactta

SEQ ID NO: 1131150 - DNA, 22 bp, Artificial Sequence
  chemically synthesized
tcgtggtatctacttataaaat

SEQ ID NO: 1131151 - DNA, 22 bp, Artificial Sequence
  chemically synthesized
cgtggtatctacttataaaatt

SEQ ID NO: 1131152 - DNA, 22 bp, Artificial Sequence
  chemically synthesized
gtggtatctacttataaaattg

SEQ ID NO: 1131153 - DNA, 22 bp, Artificial Sequence
  chemically synthesized
catgggcacatgtatccaattt

SEQ ID NO: 1131154 - DNA, 22 bp, Artificial Sequence
  chemically synthesized
ccctccatgggcacatgtatcc

SEQ ID NO: 1131155 - DNA, 22 bp, Artificial Sequence
  chemically synthesized
cttataaaattggatacatgtg

SEQ ID NO: 1131156 - DNA, 22 bp, Artificial Sequence
  chemically synthesized
accctccatgggcacatgtatc

SEQ ID NO: 1131157 - DNA, 22 bp, Artificial Sequence
  chemically synthesized
taccctccatgggcacatgtat

SEQ ID NO: 1131158 - DNA, 22 bp, Artificial Sequence
  chemically synthesized
ataaaattggatacatgtgccc

SEQ ID NO: 1131159 - DNA, 22 bp, Artificial Sequence
  chemically synthesized
taaaattggatacatgtgccca

SEQ ID NO: 1131160 - DNA, 22 bp, Artificial Sequence
  chemically synthesized
cctttaccctccatgggcacat

SEQ ID NO: 1131161 - DNA, 22 bp, Artificial Sequence
  chemically synthesized
ccctttaccctccatgggcaca

SEQ ID NO: 1131162 - DNA, 22 bp, Artificial Sequence
  chemically synthesized
gatacatgtgcccatggagggt

SEQ ID NO: 1131163 - DNA, 22 bp, Artificial Sequence
  chemically synthesized
tcatttccctttaccctccatg

SEQ ID NO: 1131164 - DNA, 22 bp, Artificial Sequence
  chemically synthesized
acagtatatcatgttgtcattt

SEQ ID NO: 1131165 - DNA, 22 bp, Artificial Sequence
  chemically synthesized
cacagtatatcatgttgtcatt

SEQ ID NO: 1131166 - DNA, 22 bp, Artificial Sequence
  chemically synthesized
aatgccgcttcacagtatatca

SEQ ID NO: 1131167 - DNA, 22 bp, Artificial Sequence
  chemically synthesized
aaatgccgcttcacagtatatc

SEQ ID NO: 1131168 - DNA, 22 bp, Artificial Sequence
  chemically synthesized
taaatgccgcttcacagtatat

SEQ ID NO: 1131169 - DNA, 22 bp, Artificial Sequence
  chemically synthesized
ttaaatgccgcttcacagtata

SEQ ID NO: 1131170 - DNA, 22 bp, Artificial Sequence
  chemically synthesized
agtatatttttaaatgccgctt

SEQ ID NO: 1131171 - DNA, 22 bp, Artificial Sequence
  chemically synthesized
aaaggttgagtatatttttaaa

SEQ ID NO: 1131172 - DNA, 22 bp, Artificial Sequence
  chemically synthesized
aaaaggttgagtatatttttaa

SEQ ID NO: 1131173 - DNA, 22 bp, Artificial Sequence
  chemically synthesized
tgaagcggcatttaaaaatata

SEQ ID NO: 1131174 - DNA, 22 bp, Artificial Sequence
  chemically synthesized
ttaaaaggttgagtatattttt

SEQ ID NO: 1131175 - DNA, 22 bp, Artificial Sequence
  chemically synthesized
cttaaaaggttgagtatatttt

SEQ ID NO: 1131176 - DNA, 22 bp, Artificial Sequence
  chemically synthesized
tcttaaaaggttgagtatattt

SEQ ID NO: 1131177 - DNA, 22 bp, Artificial Sequence
  chemically synthesized
tttcttaaaaggttgagtatat

SEQ ID NO: 1131178 - DNA, 22 bp, Artificial Sequence
  chemically synthesized
ctttcttaaaaggttgagtata

SEQ ID NO: 1131179 - DNA, 22 bp, Artificial Sequence
  chemically synthesized
tctttcttaaaaggttgagtat

SEQ ID NO: 1131180 - DNA, 22 bp, Artificial Sequence
  chemically synthesized
ttctttcttaaaaggttgagta

SEQ ID NO: 1131181 - DNA, 22 bp, Artificial Sequence
  chemically synthesized
atttttctttcttaaaaggttg

SEQ ID NO: 1131182 - DNA, 22 bp, Artificial Sequence
  chemically synthesized
aaaaatatactcaaccttttaa

SEQ ID NO: 1131183 - DNA, 22 bp, Artificial Sequence
  chemically synthesized
aaaatatactcaaccttttaag

SEQ ID NO: 1131184 - DNA, 22 bp, Artificial Sequence
  chemically synthesized
aaaatgattcatttttctttct

SEQ ID NO: 1131185 - DNA, 22 bp, Artificial Sequence
  chemically synthesized
aaccttttaagaaagaaaaatg

SEQ ID NO: 1131186 - DNA, 22 bp, Artificial Sequence
  chemically synthesized
ttaaaaatgattcatttttctt

SEQ ID NO: 1131187 - DNA, 22 bp, Artificial Sequence
  chemically synthesized
attaaaaatgattcatttttct

SEQ ID NO: 1131188 - DNA, 22 bp, Artificial Sequence
  chemically synthesized
tattaaaaatgattcatttttc

SEQ ID NO: 1131189 - DNA, 22 bp, Artificial Sequence
  chemically synthesized
ttattaaaaatgattcattttt

SEQ ID NO: 1131190 - DNA, 22 bp, Artificial Sequence
  chemically synthesized
ttttattaaaaatgattcattt

SEQ ID NO: 1131191 - DNA, 22 bp, Artificial Sequence
  chemically synthesized
ttaagaaagaaaaatgaatcat

SEQ ID NO: 1131192 - DNA, 22 bp, Artificial Sequence
  chemically synthesized
taagaaagaaaaatgaatcatt

SEQ ID NO: 1131193 - DNA, 22 bp, Artificial Sequence
  chemically synthesized
aagaaagaaaaatgaatcattt

SEQ ID NO: 1131194 - DNA, 22 bp, Artificial Sequence
  chemically synthesized
ctcttttattaaaaatgattca

SEQ ID NO: 1131195 - DNA, 22 bp, Artificial Sequence
  chemically synthesized
agaaagaaaaatgaatcatttt

SEQ ID NO: 1131196 - DNA, 22 bp, Artificial Sequence
  chemically synthesized
ctactcttttattaaaaatgat

SEQ ID NO: 1131197 - DNA, 22 bp, Artificial Sequence
  chemically synthesized
actactcttttattaaaaatga

SEQ ID NO: 1131198 - DNA, 22 bp, Artificial Sequence
  chemically synthesized
atgtcttactactcttttatta

SEQ ID NO: 1131199 - DNA, 22 bp, Artificial Sequence
  chemically synthesized
cagactcatgtcttactactct

SEQ ID NO: 1131200 - DNA, 22 bp, Artificial Sequence
  chemically synthesized
ttaataaaagagtagtaagaca

SEQ ID NO: 1131201 - DNA, 22 bp, Artificial Sequence
  chemically synthesized
taataaaagagtagtaagacat

SEQ ID NO: 1131202 - DNA, 22 bp, Artificial Sequence
  chemically synthesized
aataaaagagtagtaagacatg

SEQ ID NO: 1131203 - DNA, 22 bp, Artificial Sequence
  chemically synthesized
ataaaagagtagtaagacatga

SEQ ID NO: 1131204 - DNA, 22 bp, Artificial Sequence
  chemically synthesized
tatagaacaattacagactcat

SEQ ID NO: 1131205 - DNA, 22 bp, Artificial Sequence
  chemically synthesized
ttatatagaacaattacagact

SEQ ID NO: 1131206 - DNA, 22 bp, Artificial Sequence
  chemically synthesized
cagtgtagtagtgattattata

SEQ ID NO: 1131207 - DNA, 22 bp, Artificial Sequence
  chemically synthesized
taattgttctatataataatca

SEQ ID NO: 1131208 - DNA, 22 bp, Artificial Sequence
  chemically synthesized
aattacagtgtagtagtgatta

SEQ ID NO: 1131209 - DNA, 22 bp, Artificial Sequence
  chemically synthesized
caattacagtgtagtagtgatt

SEQ ID NO: 1131210 - DNA, 22 bp, Artificial Sequence
  chemically synthesized
ttctatataataatcactacta

SEQ ID NO: 1131211 - DNA, 22 bp, Artificial Sequence
  chemically synthesized
tcaattacagtgtagtagtgat

SEQ ID NO: 1131212 - DNA, 22 bp, Artificial Sequence
  chemically synthesized
ttcaattacagtgtagtagtga

SEQ ID NO: 1131213 - DNA, 22 bp, Artificial Sequence
  chemically synthesized
tatataataatcactactacac

SEQ ID NO: 1131214 - DNA, 22 bp, Artificial Sequence
  chemically synthesized
tataataatcactactacactg

SEQ ID NO: 1131215 - DNA, 22 bp, Artificial Sequence
  chemically synthesized
ctacactgtaattgaaaaatac

SEQ ID NO: 1131216 - DNA, 22 bp, Artificial Sequence
  chemically synthesized
cactgtaattgaaaaatactac

SEQ ID NO: 1131217 - DNA, 22 bp, Artificial Sequence
  chemically synthesized
taattgaaaaatactacttcat

SEQ ID NO: 1131218 - DNA, 22 bp, Artificial Sequence
  chemically synthesized
catcccgaaggaaatgaagtag

SEQ ID NO: 1131219 - DNA, 22 bp, Artificial Sequence
  chemically synthesized
tccatcccgaaggaaatgaagt

SEQ ID NO: 1131220 - DNA, 22 bp, Artificial Sequence
  chemically synthesized
ctccatcccgaaggaaatgaag

SEQ ID NO: 1131221 - DNA, 22 bp, Artificial Sequence
  chemically synthesized
aaaaatactacttcatttcctt

SEQ ID NO: 1131222 - DNA, 22 bp, Artificial Sequence
  chemically synthesized
tttctccatcccgaaggaaatg

SEQ ID NO: 1131223 - DNA, 22 bp, Artificial Sequence
  chemically synthesized
atttctccatcccgaaggaaat

SEQ ID NO: 1131224 - DNA, 22 bp, Artificial Sequence
  chemically synthesized
ttatttctccatcccgaaggaa

SEQ ID NO: 1131225 - DNA, 22 bp, Artificial Sequence
  chemically synthesized
cttatttctccatcccgaagga

SEQ ID NO: 1131226 - DNA, 22 bp, Artificial Sequence
  chemically synthesized
tcttatttctccatcccgaagg

SEQ ID NO: 1131227 - DNA, 22 bp, Artificial Sequence
  chemically synthesized
cttcatttccttcgggatggag

SEQ ID NO: 1131228 - DNA, 22 bp, Artificial Sequence
  chemically synthesized
catttccttcgggatggagaaa

SEQ ID NO: 1131229 - DNA, 22 bp, Artificial Sequence
  chemically synthesized
atttccttcgggatggagaaat

SEQ ID NO: 1131230 - DNA, 22 bp, Artificial Sequence
  chemically synthesized
ccttcgggatggagaaataaga

SEQ ID NO: 1131231 - DNA, 22 bp, Artificial Sequence
  chemically synthesized
cttcgggatggagaaataagaa

SEQ ID NO: 1131232 - DNA, 22 bp, Artificial Sequence
  chemically synthesized
cgggatggagaaataagaaaac

SEQ ID NO: 1131233 - DNA, 22 bp, Artificial Sequence
  chemically synthesized
gggatggagaaataagaaaact

SEQ ID NO: 1131234 - DNA, 22 bp, Artificial Sequence
  chemically synthesized
cagggtgaatgcacagttttct

SEQ ID NO: 1131235 - DNA, 22 bp, Artificial Sequence
  chemically synthesized
acagggtgaatgcacagttttc

SEQ ID NO: 1131236 - DNA, 22 bp, Artificial Sequence
  chemically synthesized
tatttacagggtgaatgcacag

SEQ ID NO: 1131237 - DNA, 22 bp, Artificial Sequence
  chemically synthesized
ccctatatttacagggtgaatg

SEQ ID NO: 1131238 - DNA, 22 bp, Artificial Sequence
  chemically synthesized
taccctatatttacagggtgaa

SEQ ID NO: 1131239 - DNA, 22 bp, Artificial Sequence
  chemically synthesized
tgcattcaccctgtaaatatag

SEQ ID NO: 1131240 - DNA, 22 bp, Artificial Sequence
  chemically synthesized
tatgtaatgagttctaccctat

SEQ ID NO: 1131241 - DNA, 22 bp, Artificial Sequence
  chemically synthesized
accctgtaaatatagggtagaa

SEQ ID NO: 1131242 - DNA, 22 bp, Artificial Sequence
  chemically synthesized
ttatatgtaatgagttctaccc

SEQ ID NO: 1131243 - DNA, 22 bp, Artificial Sequence
  chemically synthesized
gttatatgtaatgagttctacc

SEQ ID NO: 1131244 - DNA, 22 bp, Artificial Sequence
  chemically synthesized
taaatatagggtagaactcatt

SEQ ID NO: 1131245 - DNA, 22 bp, Artificial Sequence
  chemically synthesized
atttgttatatgtaatgagttc

SEQ ID NO: 1131246 - DNA, 22 bp, Artificial Sequence
  chemically synthesized
ttaatttgttatatgtaatgag

SEQ ID NO: 1131247 - DNA, 22 bp, Artificial Sequence
  chemically synthesized
agagtgattattaatttgttat

SEQ ID NO: 1131248 - DNA, 22 bp, Artificial Sequence
  chemically synthesized
gagagtgattattaatttgtta

SEQ ID NO: 1131249 - DNA, 22 bp, Artificial Sequence
  chemically synthesized
tgagagtgattattaatttgtt

SEQ ID NO: 1131250 - DNA, 22 bp, Artificial Sequence
  chemically synthesized
attacatataacaaattaataa

SEQ ID NO: 1131251 - DNA, 22 bp, Artificial Sequence
  chemically synthesized
catataacaaattaataatcac

SEQ ID NO: 1131252 - DNA, 22 bp, Artificial Sequence
  chemically synthesized
tatgaagtaggttttgagagtg

SEQ ID NO: 1131253 - DNA, 22 bp, Artificial Sequence
  chemically synthesized
attgtatgaagtaggttttgag

SEQ ID NO: 1131254 - DNA, 22 bp, Artificial Sequence
  chemically synthesized
tgattgtatgaagtaggttttg

SEQ ID NO: 1131255 - DNA, 22 bp, Artificial Sequence
  chemically synthesized
ataatcactctcaaaacctact

SEQ ID NO: 1131256 - DNA, 22 bp, Artificial Sequence
  chemically synthesized
ttctgattgtatgaagtaggtt

SEQ ID NO: 1131257 - DNA, 22 bp, Artificial Sequence
  chemically synthesized
attctgattgtatgaagtaggt

SEQ ID NO: 1131258 - DNA, 22 bp, Artificial Sequence
  chemically synthesized
tattctgattgtatgaagtagg

SEQ ID NO: 1131259 - DNA, 22 bp, Artificial Sequence
  chemically synthesized
ttattctgattgtatgaagtag

SEQ ID NO: 1131260 - DNA, 22 bp, Artificial Sequence
  chemically synthesized
tttattctgattgtatgaagta

SEQ ID NO: 1131261 - DNA, 22 bp, Artificial Sequence
  chemically synthesized
ttttttattctgattgtatgaa

SEQ ID NO: 1131262 - DNA, 22 bp, Artificial Sequence
  chemically synthesized
tcaaaacctacttcatacaatc

SEQ ID NO: 1131263 - DNA, 22 bp, Artificial Sequence
  chemically synthesized
aaaacctacttcatacaatcag

SEQ ID NO: 1131264 - DNA, 22 bp, Artificial Sequence
  chemically synthesized
attgttttttattctgattgta

SEQ ID NO: 1131265 - DNA, 22 bp, Artificial Sequence
  chemically synthesized
cttcatacaatcagaataaaaa

SEQ ID NO: 1131266 - DNA, 22 bp, Artificial Sequence
  chemically synthesized
catacaatcagaataaaaaaca

SEQ ID NO: 1131267 - DNA, 22 bp, Artificial Sequence
  chemically synthesized
atacaatcagaataaaaaacaa

SEQ ID NO: 1131268 - DNA, 22 bp, Artificial Sequence
  chemically synthesized
gtacatgactgattgtttttta

SEQ ID NO: 1131269 - DNA, 22 bp, Artificial Sequence
  chemically synthesized
agtacatgactgattgtttttt

SEQ ID NO: 1131270 - DNA, 22 bp, Artificial Sequence
  chemically synthesized
taagccataaggaaatttagta

SEQ ID NO: 1131271 - DNA, 22 bp, Artificial Sequence
  chemically synthesized
tagtcaataactataagccata

SEQ ID NO: 1131272 - DNA, 22 bp, Artificial Sequence
  chemically synthesized
aatttccttatggcttatagtt

SEQ ID NO: 1131273 - DNA, 22 bp, Artificial Sequence
  chemically synthesized
ccttatggcttatagttattga

SEQ ID NO: 1131274 - DNA, 22 bp, Artificial Sequence
  chemically synthesized
cttatggcttatagttattgac

SEQ ID NO: 1131275 - DNA, 22 bp, Artificial Sequence
  chemically synthesized
atggcttatagttattgactat

SEQ ID NO: 1131276 - DNA, 22 bp, Artificial Sequence
  chemically synthesized
tggcttatagttattgactata

SEQ ID NO: 1131277 - DNA, 22 bp, Artificial Sequence
  chemically synthesized
agtgtcaataatagttatagtc

SEQ ID NO: 1131278 - DNA, 22 bp, Artificial Sequence
  chemically synthesized
atagttattgactataactatt

SEQ ID NO: 1131279 - DNA, 22 bp, Artificial Sequence
  chemically synthesized
tagttattgactataactatta

SEQ ID NO: 1131280 - DNA, 22 bp, Artificial Sequence
  chemically synthesized
ttgactataactattattgaca

SEQ ID NO: 1131281 - DNA, 22 bp, Artificial Sequence
  chemically synthesized
acacataattaagtgtcaataa

SEQ ID NO: 1131282 - DNA, 22 bp, Artificial Sequence
  chemically synthesized
actataactattattgacactt

SEQ ID NO: 1131283 - DNA, 22 bp, Artificial Sequence
  chemically synthesized
taacacataattaagtgtcaat

SEQ ID NO: 1131284 - DNA, 22 bp, Artificial Sequence
  chemically synthesized
taactattattgacacttaatt

SEQ ID NO: 1131285 - DNA, 22 bp, Artificial Sequence
  chemically synthesized
atgattctaacacataattaag

SEQ ID NO: 1131286 - DNA, 22 bp, Artificial Sequence
  chemically synthesized
ttattgacacttaattatgtgt

SEQ ID NO: 1131287 - DNA, 22 bp, Artificial Sequence
  chemically synthesized
ctaatgattctaacacataatt

SEQ ID NO: 1131288 - DNA, 22 bp, Artificial Sequence
  chemically synthesized
cctaatgattctaacacataat

SEQ ID NO: 1131289 - DNA, 22 bp, Artificial Sequence
  chemically synthesized
ttgacacttaattatgtgttag

SEQ ID NO: 1131290 - DNA, 22 bp, Artificial Sequence
  chemically synthesized
acacttaattatgtgttagaat

SEQ ID NO: 1131291 - DNA, 22 bp, Artificial Sequence
  chemically synthesized
tatttcctaatgattctaacac

SEQ ID NO: 1131292 - DNA, 22 bp, Artificial Sequence
  chemically synthesized
tctatatttcctaatgattcta

SEQ ID NO: 1131293 - DNA, 22 bp, Artificial Sequence
  chemically synthesized
aattatgtgttagaatcattag

SEQ ID NO: 1131294 - DNA, 22 bp, Artificial Sequence
  chemically synthesized
attatgtgttagaatcattagg

SEQ ID NO: 1131295 - DNA, 22 bp, Artificial Sequence
  chemically synthesized
ctgtctatatttcctaatgatt

SEQ ID NO: 1131296 - DNA, 22 bp, Artificial Sequence
  chemically synthesized
tcctgtctatatttcctaatga

SEQ ID NO: 1131297 - DNA, 22 bp, Artificial Sequence
  chemically synthesized
tgtgttagaatcattaggaaat

SEQ ID NO: 1131298 - DNA, 22 bp, Artificial Sequence
  chemically synthesized
gaatcattaggaaatatagaca

SEQ ID NO: 1131299 - DNA, 22 bp, Artificial Sequence
  chemically synthesized
gtagtccctctcctgtctatat

SEQ ID NO: 1131300 - DNA, 22 bp, Artificial Sequence
  chemically synthesized
cgtagtccctctcctgtctata

SEQ ID NO: 1131301 - DNA, 22 bp, Artificial Sequence
  chemically synthesized
ggaaatatagacaggagaggga

SEQ ID NO: 1131302 - DNA, 22 bp, Artificial Sequence
  chemically synthesized
aatggccttcgtagtccctctc

SEQ ID NO: 1131303 - DNA, 22 bp, Artificial Sequence
  chemically synthesized
taataatcaggaggtcatgtta

SEQ ID NO: 1131304 - DNA, 22 bp, Artificial Sequence
  chemically synthesized
cgaaggccatttaacatgacct

SEQ ID NO: 1131305 - DNA, 22 bp, Artificial Sequence
  chemically synthesized
tgtaataatcaggaggtcatgt

SEQ ID NO: 1131306 - DNA, 22 bp, Artificial Sequence
  chemically synthesized
aacatgacctcctgattattac

SEQ ID NO: 1131307 - DNA, 22 bp, Artificial Sequence
  chemically synthesized
acatgacctcctgattattaca

SEQ ID NO: 1131308 - DNA, 22 bp, Artificial Sequence
  chemically synthesized
agggagtagtgagctctgtaat

SEQ ID NO: 1131309 - DNA, 22 bp, Artificial Sequence
  chemically synthesized
cagggagtagtgagctctgtaa

SEQ ID NO: 1131310 - DNA, 22 bp, Artificial Sequence
  chemically synthesized
tttcagggagtagtgagctctg

SEQ ID NO: 1131311 - DNA, 22 bp, Artificial Sequence
  chemically synthesized
ctgattattacagagctcacta

SEQ ID NO: 1131312 - DNA, 22 bp, Artificial Sequence
  chemically synthesized
tgtttcagggagtagtgagctc

SEQ ID NO: 1131313 - DNA, 22 bp, Artificial Sequence
  chemically synthesized
ctgtttcagggagtagtgagct

SEQ ID NO: 1131314 - DNA, 22 bp, Artificial Sequence
  chemically synthesized
tctgtttcagggagtagtgagc

SEQ ID NO: 1131315 - DNA, 22 bp, Artificial Sequence
  chemically synthesized
attattacagagctcactactc

SEQ ID NO: 1131316 - DNA, 22 bp, Artificial Sequence
  chemically synthesized
ttacagagctcactactccctg

SEQ ID NO: 1131317 - DNA, 22 bp, Artificial Sequence
  chemically synthesized
cagagctcactactccctgaaa

SEQ ID NO: 1131318 - DNA, 22 bp, Artificial Sequence
  chemically synthesized
agaaaggagctttctgtttcag

SEQ ID NO: 1131319 - DNA, 22 bp, Artificial Sequence
  chemically synthesized
actactccctgaaacagaaagc

SEQ ID NO: 1131320 - DNA, 22 bp, Artificial Sequence
  chemically synthesized
catgctaagaaaggagctttct

SEQ ID NO: 1131321 - DNA, 22 bp, Artificial Sequence
  chemically synthesized
ctccctgaaacagaaagctcct

SEQ ID NO: 1131322 - DNA, 22 bp, Artificial Sequence
  chemically synthesized
gcatgctaagaaaggagctttc

SEQ ID NO: 1131323 - DNA, 22 bp, Artificial Sequence
  chemically synthesized
cctgaaacagaaagctcctttc

SEQ ID NO: 1131324 - DNA, 22 bp, Artificial Sequence
  chemically synthesized
cttgcatgctaagaaaggagct

SEQ ID NO: 1131325 - DNA, 22 bp, Artificial Sequence
  chemically synthesized
gcttgcatgctaagaaaggagc

SEQ ID NO: 1131326 - DNA, 22 bp, Artificial Sequence
  chemically synthesized
aaacagaaagctcctttcttag

SEQ ID NO: 1131327 - DNA, 22 bp, Artificial Sequence
  chemically synthesized
ctttcttagcatgcaagcaaac

SEQ ID NO: 1131328 - DNA, 22 bp, Artificial Sequence
  chemically synthesized
ccaatggggaaagtttgcttgc

SEQ ID NO: 1131329 - DNA, 22 bp, Artificial Sequence
  chemically synthesized
cccaatggggaaagtttgcttg

SEQ ID NO: 1131330 - DNA, 22 bp, Artificial Sequence
  chemically synthesized
tcccaatggggaaagtttgctt

SEQ ID NO: 1131331 - DNA, 22 bp, Artificial Sequence
  chemically synthesized
tcttagcatgcaagcaaacttt

SEQ ID NO: 1131332 - DNA, 22 bp, Artificial Sequence
  chemically synthesized
cttagcatgcaagcaaactttc

SEQ ID NO: 1131333 - DNA, 22 bp, Artificial Sequence
  chemically synthesized
ttagcatgcaagcaaactttcc

SEQ ID NO: 1131334 - DNA, 22 bp, Artificial Sequence
  chemically synthesized
agcatgcaagcaaactttcccc

SEQ ID NO: 1131335 - DNA, 22 bp, Artificial Sequence
  chemically synthesized
gcatgcaagcaaactttcccca

SEQ ID NO: 1131336 - DNA, 22 bp, Artificial Sequence
  chemically synthesized
agaacatctttcccaatgggga

SEQ ID NO: 1131337 - DNA, 22 bp, Artificial Sequence
  chemically synthesized
ttaagaacatctttcccaatgg

SEQ ID NO: 1131338 - DNA, 22 bp, Artificial Sequence
  chemically synthesized
gttgttaagaacatctttccca

SEQ ID NO: 1131339 - DNA, 22 bp, Artificial Sequence
  chemically synthesized
tggttgttaagaacatctttcc

SEQ ID NO: 1131340 - DNA, 22 bp, Artificial Sequence
  chemically synthesized
tccccattgggaaagatgttct

SEQ ID NO: 1131341 - DNA, 22 bp, Artificial Sequence
  chemically synthesized
ctctggttgttaagaacatctt

SEQ ID NO: 1131342 - DNA, 22 bp, Artificial Sequence
  chemically synthesized
ccccattgggaaagatgttctt

SEQ ID NO: 1131343 - DNA, 22 bp, Artificial Sequence
  chemically synthesized
cccattgggaaagatgttctta

SEQ ID NO: 1131344 - DNA, 22 bp, Artificial Sequence
  chemically synthesized
ggaaagatgttcttaacaacca

SEQ ID NO: 1131345 - DNA, 22 bp, Artificial Sequence
  chemically synthesized
atcaggcaggattcctctggtt

SEQ ID NO: 1131346 - DNA, 22 bp, Artificial Sequence
  chemically synthesized
aatcaggcaggattcctctggt

SEQ ID NO: 1131347 - DNA, 22 bp, Artificial Sequence
  chemically synthesized
ttaacaaccagaggaatcctgc

SEQ ID NO: 1131348 - DNA, 22 bp, Artificial Sequence
  chemically synthesized
aacaaccagaggaatcctgcct

SEQ ID NO: 1131349 - DNA, 22 bp, Artificial Sequence
  chemically synthesized
acaaccagaggaatcctgcctg

SEQ ID NO: 1131350 - DNA, 22 bp, Artificial Sequence
  chemically synthesized
acaagaggaagtcttaatcagg

SEQ ID NO: 1131351 - DNA, 22 bp, Artificial Sequence
  chemically synthesized
aacaagaggaagtcttaatcag

SEQ ID NO: 1131352 - DNA, 22 bp, Artificial Sequence
  chemically synthesized
taacaagaggaagtcttaatca

SEQ ID NO: 1131353 - DNA, 22 bp, Artificial Sequence
  chemically synthesized
cctgattaagacttcctcttgt

SEQ ID NO: 1131354 - DNA, 22 bp, Artificial Sequence
  chemically synthesized
aaaacaagttttaacaagagga

SEQ ID NO: 1131355 - DNA, 22 bp, Artificial Sequence
  chemically synthesized
attaagacttcctcttgttaaa

SEQ ID NO: 1131356 - DNA, 22 bp, Artificial Sequence
  chemically synthesized
agacttcctcttgttaaaactt

SEQ ID NO: 1131357 - DNA, 22 bp, Artificial Sequence
  chemically synthesized
agaactcaaaacaagttttaac

SEQ ID NO: 1131358 - DNA, 22 bp, Artificial Sequence
  chemically synthesized
attcagaactcaaaacaagttt

SEQ ID NO: 1131359 - DNA, 22 bp, Artificial Sequence
  chemically synthesized
cattcagaactcaaaacaagtt

SEQ ID NO: 1131360 - DNA, 22 bp, Artificial Sequence
  chemically synthesized
cctcttgttaaaacttgttttg

SEQ ID NO: 1131361 - DNA, 22 bp, Artificial Sequence
  chemically synthesized
tcattcagaactcaaaacaagt

SEQ ID NO: 1131362 - DNA, 22 bp, Artificial Sequence
  chemically synthesized
ctcttgttaaaacttgttttga

SEQ ID NO: 1131363 - DNA, 22 bp, Artificial Sequence
  chemically synthesized
ctttcattcagaactcaaaaca

SEQ ID NO: 1131364 - DNA, 22 bp, Artificial Sequence
  chemically synthesized
ttgttaaaacttgttttgagtt

SEQ ID NO: 1131365 - DNA, 22 bp, Artificial Sequence
  chemically synthesized
tgctttcattcagaactcaaaa

SEQ ID NO: 1131366 - DNA, 22 bp, Artificial Sequence
  chemically synthesized
gttaaaacttgttttgagttct

SEQ ID NO: 1131367 - DNA, 22 bp, Artificial Sequence
  chemically synthesized
ttaaaacttgttttgagttctg

SEQ ID NO: 1131368 - DNA, 22 bp, Artificial Sequence
  chemically synthesized
ctctgctttcattcagaactca

SEQ ID NO: 1131369 - DNA, 22 bp, Artificial Sequence
  chemically synthesized
actctgctttcattcagaactc

SEQ ID NO: 1131370 - DNA, 22 bp, Artificial Sequence
  chemically synthesized
aaacttgttttgagttctgaat

SEQ ID NO: 1131371 - DNA, 22 bp, Artificial Sequence
  chemically synthesized
aatttactctgctttcattcag

SEQ ID NO: 1131372 - DNA, 22 bp, Artificial Sequence
  chemically synthesized
gttttgagttctgaatgaaagc

SEQ ID NO: 1131373 - DNA, 22 bp, Artificial Sequence
  chemically synthesized
ttttgagttctgaatgaaagca

SEQ ID NO: 1131374 - DNA, 22 bp, Artificial Sequence
  chemically synthesized
tgagttctgaatgaaagcagag

SEQ ID NO: 1131375 - DNA, 22 bp, Artificial Sequence
  chemically synthesized
gagttctgaatgaaagcagagt

SEQ ID NO: 1131376 - DNA, 22 bp, Artificial Sequence
  chemically synthesized
agttctgaatgaaagcagagta

SEQ ID NO: 1131377 - DNA, 22 bp, Artificial Sequence
  chemically synthesized
tgaatgaaagcagagtaaattg

SEQ ID NO: 1131378 - DNA, 22 bp, Artificial Sequence
  chemically synthesized
aatgaaagcagagtaaattgaa

SEQ ID NO: 1131379 - DNA, 22 bp, Artificial Sequence
  chemically synthesized
gaatatcaggtagaaatgatat

SEQ ID NO: 1131380 - DNA, 22 bp, Artificial Sequence
  chemically synthesized
agaatatcaggtagaaatgata

SEQ ID NO: 1131381 - DNA, 22 bp, Artificial Sequence
  chemically synthesized
aaatcttagaatatcaggtaga

SEQ ID NO: 1131382 - DNA, 22 bp, Artificial Sequence
  chemically synthesized
caaatcttagaatatcaggtag

SEQ ID NO: 1131383 - DNA, 22 bp, Artificial Sequence
  chemically synthesized
aatatcatttctacctgatatt

SEQ ID NO: 1131384 - DNA, 22 bp, Artificial Sequence
  chemically synthesized
gatttcaaatcttagaatatca

SEQ ID NO: 1131385 - DNA, 22 bp, Artificial Sequence
  chemically synthesized
ttagatttcaaatcttagaata

SEQ ID NO: 1131386 - DNA, 22 bp, Artificial Sequence
  chemically synthesized
ctacctgatattctaagatttg

SEQ ID NO: 1131387 - DNA, 22 bp, Artificial Sequence
  chemically synthesized
tacctgatattctaagatttga

SEQ ID NO: 1131388 - DNA, 22 bp, Artificial Sequence
  chemically synthesized
cctgatattctaagatttgaaa

SEQ ID NO: 1131389 - DNA, 22 bp, Artificial Sequence
  chemically synthesized
atattctaagatttgaaatcta

SEQ ID NO: 1131390 - DNA, 22 bp, Artificial Sequence
  chemically synthesized
tcagggtcatgattattagatt

SEQ ID NO: 1131391 - DNA, 22 bp, Artificial Sequence
  chemically synthesized
atcagggtcatgattattagat

SEQ ID NO: 1131392 - DNA, 22 bp, Artificial Sequence
  chemically synthesized
taagatttgaaatctaataatc

SEQ ID NO: 1131393 - DNA, 22 bp, Artificial Sequence
  chemically synthesized
agatttgaaatctaataatcat

SEQ ID NO: 1131394 - DNA, 22 bp, Artificial Sequence
  chemically synthesized
gaaatctaataatcatgaccct

SEQ ID NO: 1131395 - DNA, 22 bp, Artificial Sequence
  chemically synthesized
aaatctaataatcatgaccctg

SEQ ID NO: 1131396 - DNA, 22 bp, Artificial Sequence
  chemically synthesized
aaaatgatatttatcagggtca

SEQ ID NO: 1131397 - DNA, 22 bp, Artificial Sequence
  chemically synthesized
gaaaatgatatttatcagggtc

SEQ ID NO: 1131398 - DNA, 22 bp, Artificial Sequence
  chemically synthesized
ataatcatgaccctgataaata

SEQ ID NO: 1131399 - DNA, 22 bp, Artificial Sequence
  chemically synthesized
tagagtttgaaaatgatattta

SEQ ID NO: 1131400 - DNA, 22 bp, Artificial Sequence
  chemically synthesized
gcattatagagtttgaaaatga

SEQ ID NO: 1131401 - DNA, 22 bp, Artificial Sequence
  chemically synthesized
ataaatatcattttcaaactct

SEQ ID NO: 1131402 - DNA, 22 bp, Artificial Sequence
  chemically synthesized
gcaaataactggcattatagag

SEQ ID NO: 1131403 - DNA, 22 bp, Artificial Sequence
  chemically synthesized
tagcaaataactggcattatag

SEQ ID NO: 1131404 - DNA, 22 bp, Artificial Sequence
  chemically synthesized
ctagcaaataactggcattata

SEQ ID NO: 1131405 - DNA, 22 bp, Artificial Sequence
  chemically synthesized
cttctagcaaataactggcatt

SEQ ID NO: 1131406 - DNA, 22 bp, Artificial Sequence
  chemically synthesized
tcaaactctataatgccagtta

SEQ ID NO: 1131407 - DNA, 22 bp, Artificial Sequence
  chemically synthesized
caaactctataatgccagttat

SEQ ID NO: 1131408 - DNA, 22 bp, Artificial Sequence
  chemically synthesized
aaactctataatgccagttatt

SEQ ID NO: 1131409 - DNA, 22 bp, Artificial Sequence
  chemically synthesized
tatctacttctagcaaataact

SEQ ID NO: 1131410 - DNA, 22 bp, Artificial Sequence
  chemically synthesized
tataatgccagttatttgctag

SEQ ID NO: 1131411 - DNA, 22 bp, Artificial Sequence
  chemically synthesized
taatgccagttatttgctagaa

SEQ ID NO: 1131412 - DNA, 22 bp, Artificial Sequence
  chemically synthesized
tttgctagaagtagatataact

SEQ ID NO: 1131413 - DNA, 22 bp, Artificial Sequence
  chemically synthesized
gatgacgaatcaagttatatct

SEQ ID NO: 1131414 - DNA, 22 bp, Artificial Sequence
  chemically synthesized
ggatgacgaatcaagttatatc

SEQ ID NO: 1131415 - DNA, 22 bp, Artificial Sequence
  chemically synthesized
tggatgacgaatcaagttatat

SEQ ID NO: 1131416 - DNA, 22 bp, Artificial Sequence
  chemically synthesized
gctagaagtagatataacttga

SEQ ID NO: 1131417 - DNA, 22 bp, Artificial Sequence
  chemically synthesized
ctagaagtagatataacttgat

SEQ ID NO: 1131418 - DNA, 22 bp, Artificial Sequence
  chemically synthesized
gttttggatgacgaatcaagtt

SEQ ID NO: 1131419 - DNA, 22 bp, Artificial Sequence
  chemically synthesized
gaagtagatataacttgattcg

SEQ ID NO: 1131420 - DNA, 22 bp, Artificial Sequence
  chemically synthesized
gattcgtcatccaaaaccaatg

SEQ ID NO: 1131421 - DNA, 22 bp, Artificial Sequence
  chemically synthesized
attcgtcatccaaaaccaatgt

SEQ ID NO: 1131422 - DNA, 22 bp, Artificial Sequence
  chemically synthesized
gtcatccaaaaccaatgtttct

SEQ ID NO: 1131423 - DNA, 22 bp, Artificial Sequence
  chemically synthesized
tggtgtccaaagccaagaaaca

SEQ ID NO: 1131424 - DNA, 22 bp, Artificial Sequence
  chemically synthesized
actatggtgtccaaagccaaga

SEQ ID NO: 1131425 - DNA, 22 bp, Artificial Sequence
  chemically synthesized
attgactatggtgtccaaagcc

SEQ ID NO: 1131426 - DNA, 22 bp, Artificial Sequence
  chemically synthesized
gattgactatggtgtccaaagc

SEQ ID NO: 1131427 - DNA, 22 bp, Artificial Sequence
  chemically synthesized
tgattgactatggtgtccaaag

SEQ ID NO: 1131428 - DNA, 22 bp, Artificial Sequence
  chemically synthesized
tttgattgactatggtgtccaa

SEQ ID NO: 1131429 - DNA, 22 bp, Artificial Sequence
  chemically synthesized
cttggctttggacaccatagtc

SEQ ID NO: 1131430 - DNA, 22 bp, Artificial Sequence
  chemically synthesized
ttggctttggacaccatagtca

SEQ ID NO: 1131431 - DNA, 22 bp, Artificial Sequence
  chemically synthesized
gaattctttgattgactatggt

SEQ ID NO: 1131432 - DNA, 22 bp, Artificial Sequence
  chemically synthesized
agaattctttgattgactatgg

SEQ ID NO: 1131433 - DNA, 22 bp, Artificial Sequence
  chemically synthesized
ggctttggacaccatagtcaat

SEQ ID NO: 1131434 - DNA, 22 bp, Artificial Sequence
  chemically synthesized
tagaattctttgattgactatg

SEQ ID NO: 1131435 - DNA, 22 bp, Artificial Sequence
  chemically synthesized
gctttggacaccatagtcaatc

SEQ ID NO: 1131436 - DNA, 22 bp, Artificial Sequence
  chemically synthesized
tggacaccatagtcaatcaaag

SEQ ID NO: 1131437 - DNA, 22 bp, Artificial Sequence
  chemically synthesized
ggacaccatagtcaatcaaaga

SEQ ID NO: 1131438 - DNA, 22 bp, Artificial Sequence
  chemically synthesized
gacaccatagtcaatcaaagaa

SEQ ID NO: 1131439 - DNA, 22 bp, Artificial Sequence
  chemically synthesized
cacagttttagaattctttgat

SEQ ID NO: 1131440 - DNA, 22 bp, Artificial Sequence
  chemically synthesized
acacagttttagaattctttga

SEQ ID NO: 1131441 - DNA, 22 bp, Artificial Sequence
  chemically synthesized
aataacttacacagttttagaa

SEQ ID NO: 1131442 - DNA, 22 bp, Artificial Sequence
  chemically synthesized
ctgaataacttacacagtttta

SEQ ID NO: 1131443 - DNA, 22 bp, Artificial Sequence
  chemically synthesized
agctgctgaataacttacacag

SEQ ID NO: 1131444 - DNA, 22 bp, Artificial Sequence
  chemically synthesized
tggttcagctgctgaataactt

SEQ ID NO: 1131445 - DNA, 22 bp, Artificial Sequence
  chemically synthesized
taaaactgtgtaagttattcag

SEQ ID NO: 1131446 - DNA, 22 bp, Artificial Sequence
  chemically synthesized
gtggttcagctgctgaataact

SEQ ID NO: 1131447 - DNA, 22 bp, Artificial Sequence
  chemically synthesized
aaactgtgtaagttattcagca

SEQ ID NO: 1131448 - DNA, 22 bp, Artificial Sequence
  chemically synthesized
tgtaagttattcagcagctgaa

SEQ ID NO: 1131449 - DNA, 22 bp, Artificial Sequence
  chemically synthesized
tagaaaccttgtggttcagctg

SEQ ID NO: 1131450 - DNA, 22 bp, Artificial Sequence
  chemically synthesized
atagaaaccttgtggttcagct

SEQ ID NO: 1131451 - DNA, 22 bp, Artificial Sequence
  chemically synthesized
tatagaaaccttgtggttcagc

SEQ ID NO: 1131452 - DNA, 22 bp, Artificial Sequence
  chemically synthesized
ttcagcagctgaaccacaaggt

SEQ ID NO: 1131453 - DNA, 22 bp, Artificial Sequence
  chemically synthesized
gaattttatagaaaccttgtgg

SEQ ID NO: 1131454 - DNA, 22 bp, Artificial Sequence
  chemically synthesized
agcagctgaaccacaaggtttc

SEQ ID NO: 1131455 - DNA, 22 bp, Artificial Sequence
  chemically synthesized
aaccacaaggtttctataaaat

SEQ ID NO: 1131456 - DNA, 22 bp, Artificial Sequence
  chemically synthesized
aataaacattagaattttatag

SEQ ID NO: 1131457 - DNA, 22 bp, Artificial Sequence
  chemically synthesized
ctataaaattctaatgtttatt

SEQ ID NO: 1131458 - DNA, 22 bp, Artificial Sequence
  chemically synthesized
tataaaattctaatgtttattg

SEQ ID NO: 1131459 - DNA, 22 bp, Artificial Sequence
  chemically synthesized
taaaattctaatgtttattgaa

SEQ ID NO: 1131460 - DNA, 22 bp, Artificial Sequence
  chemically synthesized
tagtgaatatatattcaataaa

SEQ ID NO: 1131461 - DNA, 22 bp, Artificial Sequence
  chemically synthesized
taatgtttattgaatatatatt

SEQ ID NO: 1131462 - DNA, 22 bp, Artificial Sequence
  chemically synthesized
atgtttattgaatatatattca

SEQ ID NO: 1131463 - DNA, 22 bp, Artificial Sequence
  chemically synthesized
aatgtcctatagtgaatatata

SEQ ID NO: 1131464 - DNA, 22 bp, Artificial Sequence
  chemically synthesized
tgaatgtcctatagtgaatata

SEQ ID NO: 1131465 - DNA, 22 bp, Artificial Sequence
  chemically synthesized
ctgaatgtcctatagtgaatat

SEQ ID NO: 1131466 - DNA, 22 bp, Artificial Sequence
  chemically synthesized
attgaatatatattcactatag

SEQ ID NO: 1131467 - DNA, 22 bp, Artificial Sequence
  chemically synthesized
ttgaatatatattcactatagg

SEQ ID NO: 1131468 - DNA, 22 bp, Artificial Sequence
  chemically synthesized
atttctgaatgtcctatagtga

SEQ ID NO: 1131469 - DNA, 22 bp, Artificial Sequence
  chemically synthesized
aatatatattcactataggaca

SEQ ID NO: 1131470 - DNA, 22 bp, Artificial Sequence
  chemically synthesized
ctcatttctgaatgtcctatag

SEQ ID NO: 1131471 - DNA, 22 bp, Artificial Sequence
  chemically synthesized
actcatttctgaatgtcctata

SEQ ID NO: 1131472 - DNA, 22 bp, Artificial Sequence
  chemically synthesized
tactcatttctgaatgtcctat

SEQ ID NO: 1131473 - DNA, 22 bp, Artificial Sequence
  chemically synthesized
ttttactcatttctgaatgtcc

SEQ ID NO: 1131474 - DNA, 22 bp, Artificial Sequence
  chemically synthesized
tattttactcatttctgaatgt

SEQ ID NO: 1131475 - DNA, 22 bp, Artificial Sequence
  chemically synthesized
ctattttactcatttctgaatg

SEQ ID NO: 1131476 - DNA, 22 bp, Artificial Sequence
  chemically synthesized
actataggacattcagaaatga

SEQ ID NO: 1131477 - DNA, 22 bp, Artificial Sequence
  chemically synthesized
taggacattcagaaatgagtaa

SEQ ID NO: 1131478 - DNA, 22 bp, Artificial Sequence
  chemically synthesized
aatatggagtttctattttact

SEQ ID NO: 1131479 - DNA, 22 bp, Artificial Sequence
  chemically synthesized
ctaaatatggagtttctatttt

SEQ ID NO: 1131480 - DNA, 22 bp, Artificial Sequence
  chemically synthesized
agaaatgagtaaaatagaaact

SEQ ID NO: 1131481 - DNA, 22 bp, Artificial Sequence
  chemically synthesized
ccgtaaggttcctaaatatgga

SEQ ID NO: 1131482 - DNA, 22 bp, Artificial Sequence
  chemically synthesized
gccgtaaggttcctaaatatgg

SEQ ID NO: 1131483 - DNA, 22 bp, Artificial Sequence
  chemically synthesized
tgccgtaaggttcctaaatatg

SEQ ID NO: 1131484 - DNA, 22 bp, Artificial Sequence
  chemically synthesized
ttttgccgtaaggttcctaaat

SEQ ID NO: 1131485 - DNA, 22 bp, Artificial Sequence
  chemically synthesized
catatttaggaaccttacggca

SEQ ID NO: 1131486 - DNA, 22 bp, Artificial Sequence
  chemically synthesized
tcatcgtccctattttgccgta

SEQ ID NO: 1131487 - DNA, 22 bp, Artificial Sequence
  chemically synthesized
aggaaccttacggcaaaatagg

SEQ ID NO: 1131488 - DNA, 22 bp, Artificial Sequence
  chemically synthesized
ggaaccttacggcaaaataggg

SEQ ID NO: 1131489 - DNA, 22 bp, Artificial Sequence
  chemically synthesized
tgtgattatcatcgtccctatt

SEQ ID NO: 1131490 - DNA, 22 bp, Artificial Sequence
  chemically synthesized
gtgtgattatcatcgtccctat

SEQ ID NO: 1131491 - DNA, 22 bp, Artificial Sequence
  chemically synthesized
tttgtgtgattatcatcgtccc

SEQ ID NO: 1131492 - DNA, 22 bp, Artificial Sequence
  chemically synthesized
acggcaaaatagggacgatgat

SEQ ID NO: 1131493 - DNA, 22 bp, Artificial Sequence
  chemically synthesized
cggcaaaatagggacgatgata

SEQ ID NO: 1131494 - DNA, 22 bp, Artificial Sequence
  chemically synthesized
acaattatttgtgtgattatca

SEQ ID NO: 1131495 - DNA, 22 bp, Artificial Sequence
  chemically synthesized
cacaattatttgtgtgattatc

SEQ ID NO: 1131496 - DNA, 22 bp, Artificial Sequence
  chemically synthesized
atcttcacaattatttgtgtga

SEQ ID NO: 1131497 - DNA, 22 bp, Artificial Sequence
  chemically synthesized
acgtggcattcatcttcacaat

SEQ ID NO: 1131498 - DNA, 22 bp, Artificial Sequence
  chemically synthesized
cacgtggcattcatcttcacaa

SEQ ID NO: 1131499 - DNA, 22 bp, Artificial Sequence
  chemically synthesized
tcacgtggcattcatcttcaca

SEQ ID NO: 1131500 - DNA, 22 bp, Artificial Sequence
  chemically synthesized
ttcacgtggcattcatcttcac

SEQ ID NO: 1131501 - DNA, 22 bp, Artificial Sequence
  chemically synthesized
gtatttttcacgtggcattcat

SEQ ID NO: 1131502 - DNA, 22 bp, Artificial Sequence
  chemically synthesized
tgaagatgaatgccacgtgaaa

SEQ ID NO: 1131503 - DNA, 22 bp, Artificial Sequence
  chemically synthesized
catactggtatttttcacgtgg

SEQ ID NO: 1131504 - DNA, 22 bp, Artificial Sequence
  chemically synthesized
gcatactggtatttttcacgtg

SEQ ID NO: 1131505 - DNA, 22 bp, Artificial Sequence
  chemically synthesized
tgcatactggtatttttcacgt

SEQ ID NO: 1131506 - DNA, 22 bp, Artificial Sequence
  chemically synthesized
ttttgcatactggtatttttca

SEQ ID NO: 1131507 - DNA, 22 bp, Artificial Sequence
  chemically synthesized
gtgtatgtaattattttgcata

SEQ ID NO: 1131508 - DNA, 22 bp, Artificial Sequence
  chemically synthesized
ggtgtatgtaattattttgcat

SEQ ID NO: 1131509 - DNA, 22 bp, Artificial Sequence
  chemically synthesized
tatgtttggtgtatgtaattat

SEQ ID NO: 1131510 - DNA, 22 bp, Artificial Sequence
  chemically synthesized
ctgtatgtttggtgtatgtaat

SEQ ID NO: 1131511 - DNA, 22 bp, Artificial Sequence
  chemically synthesized
attactgtatgtttggtgtatg

SEQ ID NO: 1131512 - DNA, 22 bp, Artificial Sequence
  chemically synthesized
gattactgtatgtttggtgtat

SEQ ID NO: 1131513 - DNA, 22 bp, Artificial Sequence
  chemically synthesized
cttgattactgtatgtttggtg

SEQ ID NO: 1131514 - DNA, 22 bp, Artificial Sequence
  chemically synthesized
catacaccaaacatacagtaat

SEQ ID NO: 1131515 - DNA, 22 bp, Artificial Sequence
  chemically synthesized
aagagaaaattacttgattact

SEQ ID NO: 1131516 - DNA, 22 bp, Artificial Sequence
  chemically synthesized
aaagagaaaattacttgattac

SEQ ID NO: 1131517 - DNA, 22 bp, Artificial Sequence
  chemically synthesized
ataacatttaaagagaaaatta

SEQ ID NO: 1131518 - DNA, 22 bp, Artificial Sequence
  chemically synthesized
cataacatttaaagagaaaatt

SEQ ID NO: 1131519 - DNA, 22 bp, Artificial Sequence
  chemically synthesized
tcataacatttaaagagaaaat

SEQ ID NO: 1131520 - DNA, 22 bp, Artificial Sequence
  chemically synthesized
ttttcataacatttaaagagaa

SEQ ID NO: 1131521 - DNA, 22 bp, Artificial Sequence
  chemically synthesized
agagaaatctgttttcataaca

SEQ ID NO: 1131522 - DNA, 22 bp, Artificial Sequence
  chemically synthesized
tctctttaaatgttatgaaaac

SEQ ID NO: 1131523 - DNA, 22 bp, Artificial Sequence
  chemically synthesized
ctctttaaatgttatgaaaaca

SEQ ID NO: 1131524 - DNA, 22 bp, Artificial Sequence
  chemically synthesized
tctttaaatgttatgaaaacag

SEQ ID NO: 1131525 - DNA, 22 bp, Artificial Sequence
  chemically synthesized
gctgagagaaatctgttttcat

SEQ ID NO: 1131526 - DNA, 22 bp, Artificial Sequence
  chemically synthesized
tttaaatgttatgaaaacagat

SEQ ID NO: 1131527 - DNA, 22 bp, Artificial Sequence
  chemically synthesized
taaatgttatgaaaacagattt

SEQ ID NO: 1131528 - DNA, 22 bp, Artificial Sequence
  chemically synthesized
aaatgttatgaaaacagatttc

SEQ ID NO: 1131529 - DNA, 22 bp, Artificial Sequence
  chemically synthesized
aatgttatgaaaacagatttct

SEQ ID NO: 1131530 - DNA, 22 bp, Artificial Sequence
  chemically synthesized
aaatgctagctgagagaaatct

SEQ ID NO: 1131531 - DNA, 22 bp, Artificial Sequence
  chemically synthesized
tgaaaacagatttctctcagct

SEQ ID NO: 1131532 - DNA, 22 bp, Artificial Sequence
  chemically synthesized
aatgttaaaatgctagctgaga

SEQ ID NO: 1131533 - DNA, 22 bp, Artificial Sequence
  chemically synthesized
aatctaaatgttaaaatgctag

SEQ ID NO: 1131534 - DNA, 22 bp, Artificial Sequence
  chemically synthesized
ctctcagctagcattttaacat

SEQ ID NO: 1131535 - DNA, 22 bp, Artificial Sequence
  chemically synthesized
tctcagctagcattttaacatt

SEQ ID NO: 1131536 - DNA, 22 bp, Artificial Sequence
  chemically synthesized
tcagctagcattttaacattta

SEQ ID NO: 1131537 - DNA, 22 bp, Artificial Sequence
  chemically synthesized
agctagcattttaacatttaga

SEQ ID NO: 1131538 - DNA, 22 bp, Artificial Sequence
  chemically synthesized
agcatcaaattaaatctaaatg

SEQ ID NO: 1131539 - DNA, 22 bp, Artificial Sequence
  chemically synthesized
cagcatcaaattaaatctaaat

SEQ ID NO: 1131540 - DNA, 22 bp, Artificial Sequence
  chemically synthesized
gcattttaacatttagatttaa

SEQ ID NO: 1131541 - DNA, 22 bp, Artificial Sequence
  chemically synthesized
gccttcagcatcaaattaaatc

SEQ ID NO: 1131542 - DNA, 22 bp, Artificial Sequence
  chemically synthesized
taacatttagatttaatttgat

SEQ ID NO: 1131543 - DNA, 22 bp, Artificial Sequence
  chemically synthesized
aacatttagatttaatttgatg

SEQ ID NO: 1131544 - DNA, 22 bp, Artificial Sequence
  chemically synthesized
acatttagatttaatttgatgc

SEQ ID NO: 1131545 - DNA, 22 bp, Artificial Sequence
  chemically synthesized
tatctagccttcagcatcaaat

SEQ ID NO: 1131546 - DNA, 22 bp, Artificial Sequence
  chemically synthesized
agatttaatttgatgctgaagg

SEQ ID NO: 1131547 - DNA, 22 bp, Artificial Sequence
  chemically synthesized
gatttaatttgatgctgaaggc

SEQ ID NO: 1131548 - DNA, 22 bp, Artificial Sequence
  chemically synthesized
aatttgatgctgaaggctagat

SEQ ID NO: 1131549 - DNA, 22 bp, Artificial Sequence
  chemically synthesized
atttgatgctgaaggctagata

SEQ ID NO: 1131550 - DNA, 22 bp, Artificial Sequence
  chemically synthesized
gatgctgaaggctagatataat

SEQ ID NO: 1131551 - DNA, 22 bp, Artificial Sequence
  chemically synthesized
atgctgaaggctagatataata

SEQ ID NO: 1131552 - DNA, 22 bp, Artificial Sequence
  chemically synthesized
taaacaaggataaatattatat

SEQ ID NO: 1131553 - DNA, 22 bp, Artificial Sequence
  chemically synthesized
aaggctagatataatatttatc

SEQ ID NO: 1131554 - DNA, 22 bp, Artificial Sequence
  chemically synthesized
gatataatatttatccttgttt

SEQ ID NO: 1131555 - DNA, 22 bp, Artificial Sequence
  chemically synthesized
gaaagaccctataaacaaggat

SEQ ID NO: 1131556 - DNA, 22 bp, Artificial Sequence
  chemically synthesized
ttagaaagaccctataaacaag

SEQ ID NO: 1131557 - DNA, 22 bp, Artificial Sequence
  chemically synthesized
ctgttagaaagaccctataaac

SEQ ID NO: 1131558 - DNA, 22 bp, Artificial Sequence
  chemically synthesized
atccttgtttatagggtctttc

SEQ ID NO: 1131559 - DNA, 22 bp, Artificial Sequence
  chemically synthesized
tccttgtttatagggtctttct

SEQ ID NO: 1131560 - DNA, 22 bp, Artificial Sequence
  chemically synthesized
caaaagttactgttagaaagac

SEQ ID NO: 1131561 - DNA, 22 bp, Artificial Sequence
  chemically synthesized
ccaaaagttactgttagaaaga

SEQ ID NO: 1131562 - DNA, 22 bp, Artificial Sequence
  chemically synthesized
gtttatagggtctttctaacag

SEQ ID NO: 1131563 - DNA, 22 bp, Artificial Sequence
  chemically synthesized
tttatagggtctttctaacagt

SEQ ID NO: 1131564 - DNA, 22 bp, Artificial Sequence
  chemically synthesized
tttccaaaagttactgttagaa

SEQ ID NO: 1131565 - DNA, 22 bp, Artificial Sequence
  chemically synthesized
atagggtctttctaacagtaac

SEQ ID NO: 1131566 - DNA, 22 bp, Artificial Sequence
  chemically synthesized
tagggtctttctaacagtaact

SEQ ID NO: 1131567 - DNA, 22 bp, Artificial Sequence
  chemically synthesized
tctaacagtaacttttggaaac

SEQ ID NO: 1131568 - DNA, 22 bp, Artificial Sequence
  chemically synthesized
tgacatgaggttgtttccaaaa

SEQ ID NO: 1131569 - DNA, 22 bp, Artificial Sequence
  chemically synthesized
ctaacagtaacttttggaaaca

SEQ ID NO: 1131570 - DNA, 22 bp, Artificial Sequence
  chemically synthesized
taacagtaacttttggaaacaa

SEQ ID NO: 1131571 - DNA, 22 bp, Artificial Sequence
  chemically synthesized
acagtaacttttggaaacaacc

SEQ ID NO: 1131572 - DNA, 22 bp, Artificial Sequence
  chemically synthesized
aaccatcatctatgacatgagg

SEQ ID NO: 1131573 - DNA, 22 bp, Artificial Sequence
  chemically synthesized
aaaccatcatctatgacatgag

SEQ ID NO: 1131574 - DNA, 22 bp, Artificial Sequence
  chemically synthesized
ttggaaacaacctcatgtcata

SEQ ID NO: 1131575 - DNA, 22 bp, Artificial Sequence
  chemically synthesized
tggaaacaacctcatgtcatag

SEQ ID NO: 1131576 - DNA, 22 bp, Artificial Sequence
  chemically synthesized
ggaaacaacctcatgtcataga

SEQ ID NO: 1131577 - DNA, 22 bp, Artificial Sequence
  chemically synthesized
gaaacaacctcatgtcatagat

SEQ ID NO: 1131578 - DNA, 22 bp, Artificial Sequence
  chemically synthesized
atgtcatagatgatggtttaag

SEQ ID NO: 1131579 - DNA, 22 bp, Artificial Sequence
  chemically synthesized
atataccataatgtacttaaac

SEQ ID NO: 1131580 - DNA, 22 bp, Artificial Sequence
  chemically synthesized
catccacattcatataccataa

SEQ ID NO: 1131581 - DNA, 22 bp, Artificial Sequence
  chemically synthesized
aagtacattatggtatatgaat

SEQ ID NO: 1131582 - DNA, 22 bp, Artificial Sequence
  chemically synthesized
agtacattatggtatatgaatg

SEQ ID NO: 1131583 - DNA, 22 bp, Artificial Sequence
  chemically synthesized
aaatataatactccatccacat

SEQ ID NO: 1131584 - DNA, 22 bp, Artificial Sequence
  chemically synthesized
gaaatataatactccatccaca

SEQ ID NO: 1131585 - DNA, 22 bp, Artificial Sequence
  chemically synthesized
tggtatatgaatgtggatggag

SEQ ID NO: 1131586 - DNA, 22 bp, Artificial Sequence
  chemically synthesized
aaatatttgaaatataatactc

SEQ ID NO: 1131587 - DNA, 22 bp, Artificial Sequence
  chemically synthesized
caatgacattaaaatatttgaa

SEQ ID NO: 1131588 - DNA, 22 bp, Artificial Sequence
  chemically synthesized
ccaatgacattaaaatatttga

SEQ ID NO: 1131589 - DNA, 22 bp, Artificial Sequence
  chemically synthesized
tccaatgacattaaaatatttg

SEQ ID NO: 1131590 - DNA, 22 bp, Artificial Sequence
  chemically synthesized
tatttcaaatattttaatgtca

SEQ ID NO: 1131591 - DNA, 22 bp, Artificial Sequence
  chemically synthesized
caaatattttaatgtcattgga

SEQ ID NO: 1131592 - DNA, 22 bp, Artificial Sequence
  chemically synthesized
aaatattttaatgtcattggaa

SEQ ID NO: 1131593 - DNA, 22 bp, Artificial Sequence
  chemically synthesized
taatgtcattggaaaacgtttg

SEQ ID NO: 1131594 - DNA, 22 bp, Artificial Sequence
  chemically synthesized
aatagtgtaaagcaaacgtttt

SEQ ID NO: 1131595 - DNA, 22 bp, Artificial Sequence
  chemically synthesized
aatgtcattggaaaacgtttgc

SEQ ID NO: 1131596 - DNA, 22 bp, Artificial Sequence
  chemically synthesized
atgtcattggaaaacgtttgct

SEQ ID NO: 1131597 - DNA, 22 bp, Artificial Sequence
  chemically synthesized
ctcaatagtgtaaagcaaacgt

SEQ ID NO: 1131598 - DNA, 22 bp, Artificial Sequence
  chemically synthesized
actcaatagtgtaaagcaaacg

SEQ ID NO: 1131599 - DNA, 22 bp, Artificial Sequence
  chemically synthesized
tttactcaatagtgtaaagcaa

SEQ ID NO: 1131600 - DNA, 22 bp, Artificial Sequence
  chemically synthesized
gaaaacgtttgctttacactat

SEQ ID NO: 1131601 - DNA, 22 bp, Artificial Sequence
  chemically synthesized
gcattgtttactcaatagtgta

SEQ ID NO: 1131602 - DNA, 22 bp, Artificial Sequence
  chemically synthesized
tgtctagcattgtttactcaat

SEQ ID NO: 1131603 - DNA, 22 bp, Artificial Sequence
  chemically synthesized
atgtctagcattgtttactcaa

SEQ ID NO: 1131604 - DNA, 22 bp, Artificial Sequence
  chemically synthesized
gctttacactattgagtaaaca

SEQ ID NO: 1131605 - DNA, 22 bp, Artificial Sequence
  chemically synthesized
ctttacactattgagtaaacaa

SEQ ID NO: 1131606 - DNA, 22 bp, Artificial Sequence
  chemically synthesized
tacactattgagtaaacaatgc

SEQ ID NO: 1131607 - DNA, 22 bp, Artificial Sequence
  chemically synthesized
acactattgagtaaacaatgct

SEQ ID NO: 1131608 - DNA, 22 bp, Artificial Sequence
  chemically synthesized
cactattgagtaaacaatgcta

SEQ ID NO: 1131609 - DNA, 22 bp, Artificial Sequence
  chemically synthesized
ttgagtaaacaatgctagacat

SEQ ID NO: 1131610 - DNA, 22 bp, Artificial Sequence
  chemically synthesized
agtaaacaatgctagacataaa

SEQ ID NO: 1131611 - DNA, 22 bp, Artificial Sequence
  chemically synthesized
tcaaaaatcaaccaatgtttat

SEQ ID NO: 1131612 - DNA, 22 bp, Artificial Sequence
  chemically synthesized
tgtcaaaaatcaaccaatgttt

SEQ ID NO: 1131613 - DNA, 22 bp, Artificial Sequence
  chemically synthesized
tctgtcaaaaatcaaccaatgt

SEQ ID NO: 1131614 - DNA, 22 bp, Artificial Sequence
  chemically synthesized
ctctgtcaaaaatcaaccaatg

SEQ ID NO: 1131615 - DNA, 22 bp, Artificial Sequence
  chemically synthesized
tctctgtcaaaaatcaaccaat

SEQ ID NO: 1131616 - DNA, 22 bp, Artificial Sequence
  chemically synthesized
gacataaacattggttgatttt

SEQ ID NO: 1131617 - DNA, 22 bp, Artificial Sequence
  chemically synthesized
ctttctctgtcaaaaatcaacc

SEQ ID NO: 1131618 - DNA, 22 bp, Artificial Sequence
  chemically synthesized
tactttctctgtcaaaaatcaa

SEQ ID NO: 1131619 - DNA, 22 bp, Artificial Sequence
  chemically synthesized
tctactttctctgtcaaaaatc

SEQ ID NO: 1131620 - DNA, 22 bp, Artificial Sequence
  chemically synthesized
ctctactttctctgtcaaaaat

SEQ ID NO: 1131621 - DNA, 22 bp, Artificial Sequence
  chemically synthesized
tctctactttctctgtcaaaaa

SEQ ID NO: 1131622 - DNA, 22 bp, Artificial Sequence
  chemically synthesized
gttgatttttgacagagaaagt

SEQ ID NO: 1131623 - DNA, 22 bp, Artificial Sequence
  chemically synthesized
atttttgacagagaaagtagag

SEQ ID NO: 1131624 - DNA, 22 bp, Artificial Sequence
  chemically synthesized
tgcaacagaaattttctctact

SEQ ID NO: 1131625 - DNA, 22 bp, Artificial Sequence
  chemically synthesized
ttgacagagaaagtagagaaaa

SEQ ID NO: 1131626 - DNA, 22 bp, Artificial Sequence
  chemically synthesized
tgacagagaaagtagagaaaat

SEQ ID NO: 1131627 - DNA, 22 bp, Artificial Sequence
  chemically synthesized
gacagagaaagtagagaaaatt

SEQ ID NO: 1131628 - DNA, 22 bp, Artificial Sequence
  chemically synthesized
acagagaaagtagagaaaattt

SEQ ID NO: 1131629 - DNA, 22 bp, Artificial Sequence
  chemically synthesized
aaggaatacagaaatatacact

SEQ ID NO: 1131630 - DNA, 22 bp, Artificial Sequence
  chemically synthesized
ctgttgcacagtgtatatttct

SEQ ID NO: 1131631 - DNA, 22 bp, Artificial Sequence
  chemically synthesized
tgttgcacagtgtatatttctg

SEQ ID NO: 1131632 - DNA, 22 bp, Artificial Sequence
  chemically synthesized
ttgcacagtgtatatttctgta

SEQ ID NO: 1131633 - DNA, 22 bp, Artificial Sequence
  chemically synthesized
gaaactaaaggaatacagaaat

SEQ ID NO: 1131634 - DNA, 22 bp, Artificial Sequence
  chemically synthesized
ggaaactaaaggaatacagaaa

SEQ ID NO: 1131635 - DNA, 22 bp, Artificial Sequence
  chemically synthesized
cacagtgtatatttctgtattc

SEQ ID NO: 1131636 - DNA, 22 bp, Artificial Sequence
  chemically synthesized
tggaaactaaaggaatacagaa

SEQ ID NO: 1131637 - DNA, 22 bp, Artificial Sequence
  chemically synthesized
tagaagaactttggaaactaaa

SEQ ID NO: 1131638 - DNA, 22 bp, Artificial Sequence
  chemically synthesized
atagaagaactttggaaactaa

SEQ ID NO: 1131639 - DNA, 22 bp, Artificial Sequence
  chemically synthesized
ctgtattcctttagtttccaaa

SEQ ID NO: 1131640 - DNA, 22 bp, Artificial Sequence
  chemically synthesized
tgtattcctttagtttccaaag

SEQ ID NO: 1131641 - DNA, 22 bp, Artificial Sequence
  chemically synthesized
tattcctttagtttccaaagtt

SEQ ID NO: 1131642 - DNA, 22 bp, Artificial Sequence
  chemically synthesized
ctttagtttccaaagttcttct

SEQ ID NO: 1131643 - DNA, 22 bp, Artificial Sequence
  chemically synthesized
tagtttccaaagttcttctata

SEQ ID NO: 1131644 - DNA, 22 bp, Artificial Sequence
  chemically synthesized
cagataatatcttatagaagaa

SEQ ID NO: 1131645 - DNA, 22 bp, Artificial Sequence
  chemically synthesized
agtttccaaagttcttctataa

SEQ ID NO: 1131646 - DNA, 22 bp, Artificial Sequence
  chemically synthesized
gcagataatatcttatagaaga

SEQ ID NO: 1131647 - DNA, 22 bp, Artificial Sequence
  chemically synthesized
gtttccaaagttcttctataag

SEQ ID NO: 1131648 - DNA, 22 bp, Artificial Sequence
  chemically synthesized
tgcagataatatcttatagaag

SEQ ID NO: 1131649 - DNA, 22 bp, Artificial Sequence
  chemically synthesized
ccaaagttcttctataagatat

SEQ ID NO: 1131650 - DNA, 22 bp, Artificial Sequence
  chemically synthesized
caaagttcttctataagatatt

SEQ ID NO: 1131651 - DNA, 22 bp, Artificial Sequence
  chemically synthesized
ttctataagatattatctgcaa

SEQ ID NO: 1131652 - DNA, 22 bp, Artificial Sequence
  chemically synthesized
caaatgcaacattttgcagata

SEQ ID NO: 1131653 - DNA, 22 bp, Artificial Sequence
  chemically synthesized
ctataagatattatctgcaaaa

SEQ ID NO: 1131654 - DNA, 22 bp, Artificial Sequence
  chemically synthesized
acaaatgcaacattttgcagat

SEQ ID NO: 1131655 - DNA, 22 bp, Artificial Sequence
  chemically synthesized
tataagatattatctgcaaaat

SEQ ID NO: 1131656 - DNA, 22 bp, Artificial Sequence
  chemically synthesized
taagatattatctgcaaaatgt

SEQ ID NO: 1131657 - DNA, 22 bp, Artificial Sequence
  chemically synthesized
cttacaaatgcaacattttgca

SEQ ID NO: 1131658 - DNA, 22 bp, Artificial Sequence
  chemically synthesized
gcttacaaatgcaacattttgc

SEQ ID NO: 1131659 - DNA, 22 bp, Artificial Sequence
  chemically synthesized
tgcttacaaatgcaacattttg

SEQ ID NO: 1131660 - DNA, 22 bp, Artificial Sequence
  chemically synthesized
tttgcttacaaatgcaacattt

SEQ ID NO: 1131661 - DNA, 22 bp, Artificial Sequence
  chemically synthesized
ctttgcttacaaatgcaacatt

SEQ ID NO: 1131662 - DNA, 22 bp, Artificial Sequence
  chemically synthesized
tctttgcttacaaatgcaacat

SEQ ID NO: 1131663 - DNA, 22 bp, Artificial Sequence
  chemically synthesized
ttctttgcttacaaatgcaaca

SEQ ID NO: 1131664 - DNA, 22 bp, Artificial Sequence
  chemically synthesized
tctgcaaaatgttgcatttgta

SEQ ID NO: 1131665 - DNA, 22 bp, Artificial Sequence
  chemically synthesized
caaaatgttgcatttgtaagca

SEQ ID NO: 1131666 - DNA, 22 bp, Artificial Sequence
  chemically synthesized
aaaatttttctttgcttacaaa

SEQ ID NO: 1131667 - DNA, 22 bp, Artificial Sequence
  chemically synthesized
caaaatttttctttgcttacaa

SEQ ID NO: 1131668 - DNA, 22 bp, Artificial Sequence
  chemically synthesized
tcaaaatttttctttgcttaca

SEQ ID NO: 1131669 - DNA, 22 bp, Artificial Sequence
  chemically synthesized
catttgtaagcaaagaaaaatt

SEQ ID NO: 1131670 - DNA, 22 bp, Artificial Sequence
  chemically synthesized
gcaaaactttcaaaatttttct

SEQ ID NO: 1131671 - DNA, 22 bp, Artificial Sequence
  chemically synthesized
ggcaaaactttcaaaatttttc

SEQ ID NO: 1131672 - DNA, 22 bp, Artificial Sequence
  chemically synthesized
gtaagcaaagaaaaattttgaa

SEQ ID NO: 1131673 - DNA, 22 bp, Artificial Sequence
  chemically synthesized
taagcaaagaaaaattttgaaa

SEQ ID NO: 1131674 - DNA, 22 bp, Artificial Sequence
  chemically synthesized
aaacaaacagtttggcaaaact

SEQ ID NO: 1131675 - DNA, 22 bp, Artificial Sequence
  chemically synthesized
aaaacaaacagtttggcaaaac

SEQ ID NO: 1131676 - DNA, 22 bp, Artificial Sequence
  chemically synthesized
tgaaagttttgccaaactgttt

SEQ ID NO: 1131677 - DNA, 22 bp, Artificial Sequence
  chemically synthesized
gaaagttttgccaaactgtttg

SEQ ID NO: 1131678 - DNA, 22 bp, Artificial Sequence
  chemically synthesized
aaagttttgccaaactgtttgt

SEQ ID NO: 1131679 - DNA, 22 bp, Artificial Sequence
  chemically synthesized
tgccaaactgtttgttttaaat

SEQ ID NO: 1131680 - DNA, 22 bp, Artificial Sequence
  chemically synthesized
gccaaactgtttgttttaaatc

SEQ ID NO: 1131681 - DNA, 22 bp, Artificial Sequence
  chemically synthesized
ccaaactgtttgttttaaatct

SEQ ID NO: 1131682 - DNA, 22 bp, Artificial Sequence
  chemically synthesized
atatataaatagaaatgataga

SEQ ID NO: 1131683 - DNA, 22 bp, Artificial Sequence
  chemically synthesized
tttgttttaaatctatcatttc

SEQ ID NO: 1131684 - DNA, 22 bp, Artificial Sequence
  chemically synthesized
aatatataaatagaaatgatag

SEQ ID NO: 1131685 - DNA, 22 bp, Artificial Sequence
  chemically synthesized
gttttaaatctatcatttctat

SEQ ID NO: 1131686 - DNA, 22 bp, Artificial Sequence
  chemically synthesized
ttttaaatctatcatttctatt

SEQ ID NO: 1131687 - DNA, 22 bp, Artificial Sequence
  chemically synthesized
taaatctatcatttctatttat

SEQ ID NO: 1131688 - DNA, 22 bp, Artificial Sequence
  chemically synthesized
aaatctatcatttctatttata

SEQ ID NO: 1131689 - DNA, 22 bp, Artificial Sequence
  chemically synthesized
aatctatcatttctatttatat

SEQ ID NO: 1131690 - DNA, 22 bp, Artificial Sequence
  chemically synthesized
catagatcttaatatataaata

SEQ ID NO: 1131691 - DNA, 22 bp, Artificial Sequence
  chemically synthesized
tcatttctatttatatattaag

SEQ ID NO: 1131692 - DNA, 22 bp, Artificial Sequence
  chemically synthesized
ctatttatatattaagatctat

SEQ ID NO: 1131693 - DNA, 22 bp, Artificial Sequence
  chemically synthesized
tatttatatattaagatctatg

SEQ ID NO: 1131694 - DNA, 22 bp, Artificial Sequence
  chemically synthesized
tttatatattaagatctatgga

SEQ ID NO: 1131695 - DNA, 22 bp, Artificial Sequence
  chemically synthesized
atatattaagatctatggaatc

SEQ ID NO: 1131696 - DNA, 22 bp, Artificial Sequence
  chemically synthesized
tatattaagatctatggaatca

SEQ ID NO: 1131697 - DNA, 22 bp, Artificial Sequence
  chemically synthesized
agtgacaggagtatgattccat

SEQ ID NO: 1131698 - DNA, 22 bp, Artificial Sequence
  chemically synthesized
agatctatggaatcatactcct

SEQ ID NO: 1131699 - DNA, 22 bp, Artificial Sequence
  chemically synthesized
atgcattgagtgacaggagtat

SEQ ID NO: 1131700 - DNA, 22 bp, Artificial Sequence
  chemically synthesized
taatgcattgagtgacaggagt

SEQ ID NO: 1131701 - DNA, 22 bp, Artificial Sequence
  chemically synthesized
tggaatcatactcctgtcactc

SEQ ID NO: 1131702 - DNA, 22 bp, Artificial Sequence
  chemically synthesized
attctaatgcattgagtgacag

SEQ ID NO: 1131703 - DNA, 22 bp, Artificial Sequence
  chemically synthesized
ctcattctaatgcattgagtga

SEQ ID NO: 1131704 - DNA, 22 bp, Artificial Sequence
  chemically synthesized
cctcattctaatgcattgagtg

SEQ ID NO: 1131705 - DNA, 22 bp, Artificial Sequence
  chemically synthesized
tcctcattctaatgcattgagt

SEQ ID NO: 1131706 - DNA, 22 bp, Artificial Sequence
  chemically synthesized
aagttttcctcattctaatgca

SEQ ID NO: 1131707 - DNA, 22 bp, Artificial Sequence
  chemically synthesized
ctgtcactcaatgcattagaat

SEQ ID NO: 1131708 - DNA, 22 bp, Artificial Sequence
  chemically synthesized
gaagttttcctcattctaatgc

SEQ ID NO: 1131709 - DNA, 22 bp, Artificial Sequence
  chemically synthesized
tcactcaatgcattagaatgag

SEQ ID NO: 1131710 - DNA, 22 bp, Artificial Sequence
  chemically synthesized
tcatgcttgaagttttcctcat

SEQ ID NO: 1131711 - DNA, 22 bp, Artificial Sequence
  chemically synthesized
aatgcattagaatgaggaaaac

SEQ ID NO: 1131712 - DNA, 22 bp, Artificial Sequence
  chemically synthesized
atcatgcttgaagttttcctca

SEQ ID NO: 1131713 - DNA, 22 bp, Artificial Sequence
  chemically synthesized
ttatcatgcttgaagttttcct

SEQ ID NO: 1131714 - DNA, 22 bp, Artificial Sequence
  chemically synthesized
ttcttatcatgcttgaagtttt

SEQ ID NO: 1131715 - DNA, 22 bp, Artificial Sequence
  chemically synthesized
gaatgaggaaaacttcaagcat

SEQ ID NO: 1131716 - DNA, 22 bp, Artificial Sequence
  chemically synthesized
cgttattcttatcatgcttgaa

SEQ ID NO: 1131717 - DNA, 22 bp, Artificial Sequence
  chemically synthesized
gtgaaggcactacgttattctt

SEQ ID NO: 1131718 - DNA, 22 bp, Artificial Sequence
  chemically synthesized
agtgaaggcactacgttattct

SEQ ID NO: 1131719 - DNA, 22 bp, Artificial Sequence
  chemically synthesized
caagcatgataagaataacgta

SEQ ID NO: 1131720 - DNA, 22 bp, Artificial Sequence
  chemically synthesized
tagtgaaggcactacgttattc

SEQ ID NO: 1131721 - DNA, 22 bp, Artificial Sequence
  chemically synthesized
aagcatgataagaataacgtag

SEQ ID NO: 1131722 - DNA, 22 bp, Artificial Sequence
  chemically synthesized
aacattttagtgaaggcactac

SEQ ID NO: 1131723 - DNA, 22 bp, Artificial Sequence
  chemically synthesized
ccatattaaacattttagtgaa

SEQ ID NO: 1131724 - DNA, 22 bp, Artificial Sequence
  chemically synthesized
tgccatattaaacattttagtg

SEQ ID NO: 1131725 - DNA, 22 bp, Artificial Sequence
  chemically synthesized
actctgccatattaaacatttt

SEQ ID NO: 1131726 - DNA, 22 bp, Artificial Sequence
  chemically synthesized
gactctgccatattaaacattt

SEQ ID NO: 1131727 - DNA, 22 bp, Artificial Sequence
  chemically synthesized
tgactctgccatattaaacatt

SEQ ID NO: 1131728 - DNA, 22 bp, Artificial Sequence
  chemically synthesized
gttttgactctgccatattaaa

SEQ ID NO: 1131729 - DNA, 22 bp, Artificial Sequence
  chemically synthesized
cactaaaatgtttaatatggca

SEQ ID NO: 1131730 - DNA, 22 bp, Artificial Sequence
  chemically synthesized
tagttttgactctgccatatta

SEQ ID NO: 1131731 - DNA, 22 bp, Artificial Sequence
  chemically synthesized
actaaaatgtttaatatggcag

SEQ ID NO: 1131732 - DNA, 22 bp, Artificial Sequence
  chemically synthesized
ttctagttttgactctgccata

SEQ ID NO: 1131733 - DNA, 22 bp, Artificial Sequence
  chemically synthesized
aaatgtttaatatggcagagtc

SEQ ID NO: 1131734 - DNA, 22 bp, Artificial Sequence
  chemically synthesized
tattctagttttgactctgcca

SEQ ID NO: 1131735 - DNA, 22 bp, Artificial Sequence
  chemically synthesized
tattctattctagttttgactc

SEQ ID NO: 1131736 - DNA, 22 bp, Artificial Sequence
  chemically synthesized
aatatggcagagtcaaaactag

SEQ ID NO: 1131737 - DNA, 22 bp, Artificial Sequence
  chemically synthesized
atatggcagagtcaaaactaga

SEQ ID NO: 1131738 - DNA, 22 bp, Artificial Sequence
  chemically synthesized
aatataggtcaaactatattct

SEQ ID NO: 1131739 - DNA, 22 bp, Artificial Sequence
  chemically synthesized
ttgaatataggtcaaactatat

SEQ ID NO: 1131740 - DNA, 22 bp, Artificial Sequence
  chemically synthesized
gaatagaatatagtttgaccta

SEQ ID NO: 1131741 - DNA, 22 bp, Artificial Sequence
  chemically synthesized
gatacaaagattgttgaatata

SEQ ID NO: 1131742 - DNA, 22 bp, Artificial Sequence
  chemically synthesized
gctagatacaaagattgttgaa

SEQ ID NO: 1131743 - DNA, 22 bp, Artificial Sequence
  chemically synthesized
gacctatattcaacaatctttg

SEQ ID NO: 1131744 - DNA, 22 bp, Artificial Sequence
  chemically synthesized
acctatattcaacaatctttgt

SEQ ID NO: 1131745 - DNA, 22 bp, Artificial Sequence
  chemically synthesized
tattcaacaatctttgtatcta

SEQ ID NO: 1131746 - DNA, 22 bp, Artificial Sequence
  chemically synthesized
aacaatctttgtatctagctaa

SEQ ID NO: 1131747 - DNA, 22 bp, Artificial Sequence
  chemically synthesized
ggtaaaagtatagttagctaga

SEQ ID NO: 1131748 - DNA, 22 bp, Artificial Sequence
  chemically synthesized
tgtatctagctaactatacttt

SEQ ID NO: 1131749 - DNA, 22 bp, Artificial Sequence
  chemically synthesized
gtatctagctaactatactttt

SEQ ID NO: 1131750 - DNA, 22 bp, Artificial Sequence
  chemically synthesized
tatctagctaactatactttta

SEQ ID NO: 1131751 - DNA, 22 bp, Artificial Sequence
  chemically synthesized
gctaactatacttttacccagt

SEQ ID NO: 1131752 - DNA, 22 bp, Artificial Sequence
  chemically synthesized
actatacttttacccagtcacc

SEQ ID NO: 1131753 - DNA, 22 bp, Artificial Sequence
  chemically synthesized
tacttttacccagtcacctttc

SEQ ID NO: 1131754 - DNA, 22 bp, Artificial Sequence
  chemically synthesized
ataatcaaaatgaagaaaggtg

SEQ ID NO: 1131755 - DNA, 22 bp, Artificial Sequence
  chemically synthesized
ttacccagtcacctttcttcat

SEQ ID NO: 1131756 - DNA, 22 bp, Artificial Sequence
  chemically synthesized
tacccagtcacctttcttcatt

SEQ ID NO: 1131757 - DNA, 22 bp, Artificial Sequence
  chemically synthesized
acccagtcacctttcttcattt

SEQ ID NO: 1131758 - DNA, 22 bp, Artificial Sequence
  chemically synthesized
cccagtcacctttcttcatttt

SEQ ID NO: 1131759 - DNA, 22 bp, Artificial Sequence
  chemically synthesized
aatagactcataatcaaaatga

SEQ ID NO: 1131760 - DNA, 22 bp, Artificial Sequence
  chemically synthesized
aaatagactcataatcaaaatg

SEQ ID NO: 1131761 - DNA, 22 bp, Artificial Sequence
  chemically synthesized
gagtcttaaatagactcataat

SEQ ID NO: 1131762 - DNA, 22 bp, Artificial Sequence
  chemically synthesized
tcttcattttgattatgagtct

SEQ ID NO: 1131763 - DNA, 22 bp, Artificial Sequence
  chemically synthesized
agagtcttaaatagactcataa

SEQ ID NO: 1131764 - DNA, 22 bp, Artificial Sequence
  chemically synthesized
cttcattttgattatgagtcta

SEQ ID NO: 1131765 - DNA, 22 bp, Artificial Sequence
  chemically synthesized
tagagtcttaaatagactcata

SEQ ID NO: 1131766 - DNA, 22 bp, Artificial Sequence
  chemically synthesized
ttcattttgattatgagtctat

SEQ ID NO: 1131767 - DNA, 22 bp, Artificial Sequence
  chemically synthesized
cattttgattatgagtctattt

SEQ ID NO: 1131768 - DNA, 22 bp, Artificial Sequence
  chemically synthesized
attttgattatgagtctattta

SEQ ID NO: 1131769 - DNA, 22 bp, Artificial Sequence
  chemically synthesized
tgattatgagtctatttaagac

SEQ ID NO: 1131770 - DNA, 22 bp, Artificial Sequence
  chemically synthesized
gattatgagtctatttaagact

SEQ ID NO: 1131771 - DNA, 22 bp, Artificial Sequence
  chemically synthesized
attatgagtctatttaagactc

SEQ ID NO: 1131772 - DNA, 22 bp, Artificial Sequence
  chemically synthesized
atgatatcattttagagtctta

SEQ ID NO: 1131773 - DNA, 22 bp, Artificial Sequence
  chemically synthesized
catgatatcattttagagtctt

SEQ ID NO: 1131774 - DNA, 22 bp, Artificial Sequence
  chemically synthesized
tgagtctatttaagactctaaa

SEQ ID NO: 1131775 - DNA, 22 bp, Artificial Sequence
  chemically synthesized
tcatgatatcattttagagtct

SEQ ID NO: 1131776 - DNA, 22 bp, Artificial Sequence
  chemically synthesized
ttcatgatatcattttagagtc

SEQ ID NO: 1131777 - DNA, 22 bp, Artificial Sequence
  chemically synthesized
ttttcatgatatcattttagag

SEQ ID NO: 1131778 - DNA, 22 bp, Artificial Sequence
  chemically synthesized
cttttcatgatatcattttaga

SEQ ID NO: 1131779 - DNA, 22 bp, Artificial Sequence
  chemically synthesized
tcttttcatgatatcattttag

SEQ ID NO: 1131780 - DNA, 22 bp, Artificial Sequence
  chemically synthesized
tttaagactctaaaatgatatc

SEQ ID NO: 1131781 - DNA, 22 bp, Artificial Sequence
  chemically synthesized
aagactctaaaatgatatcatg

SEQ ID NO: 1131782 - DNA, 22 bp, Artificial Sequence
  chemically synthesized
agactctaaaatgatatcatga

SEQ ID NO: 1131783 - DNA, 22 bp, Artificial Sequence
  chemically synthesized
taaaatgatatcatgaaaagaa

SEQ ID NO: 1131784 - DNA, 22 bp, Artificial Sequence
  chemically synthesized
aaatgatatcatgaaaagaaaa

SEQ ID NO: 1131785 - DNA, 22 bp, Artificial Sequence
  chemically synthesized
aaaagaaatgtattttcttttc

SEQ ID NO: 1131786 - DNA, 22 bp, Artificial Sequence
  chemically synthesized
aaaaagaaatgtattttctttt

SEQ ID NO: 1131787 - DNA, 22 bp, Artificial Sequence
  chemically synthesized
taaaaagaaatgtattttcttt

SEQ ID NO: 1131788 - DNA, 22 bp, Artificial Sequence
  chemically synthesized
aaatgaatagtattttaaaaag

SEQ ID NO: 1131789 - DNA, 22 bp, Artificial Sequence
  chemically synthesized
cagttaaaatgaatagtatttt

SEQ ID NO: 1131790 - DNA, 22 bp, Artificial Sequence
  chemically synthesized
gcagttaaaatgaatagtattt

SEQ ID NO: 1131791 - DNA, 22 bp, Artificial Sequence
  chemically synthesized
acttgcagttaaaatgaatagt

SEQ ID NO: 1131792 - DNA, 22 bp, Artificial Sequence
  chemically synthesized
ctttttaaaatactattcattt

SEQ ID NO: 1131793 - DNA, 22 bp, Artificial Sequence
  chemically synthesized
tttttaaaatactattcatttt

SEQ ID NO: 1131794 - DNA, 22 bp, Artificial Sequence
  chemically synthesized
tttaaaatactattcattttaa

SEQ ID NO: 1131795 - DNA, 22 bp, Artificial Sequence
  chemically synthesized
ttaaaatactattcattttaac

SEQ ID NO: 1131796 - DNA, 22 bp, Artificial Sequence
  chemically synthesized
taaaatactattcattttaact

SEQ ID NO: 1131797 - DNA, 22 bp, Artificial Sequence
  chemically synthesized
aaaatactattcattttaactg

SEQ ID NO: 1131798 - DNA, 22 bp, Artificial Sequence
  chemically synthesized
aaatactattcattttaactgc

SEQ ID NO: 1131799 - DNA, 22 bp, Artificial Sequence
  chemically synthesized
gggaaattaacttgcagttaaa

SEQ ID NO: 1131800 - DNA, 22 bp, Artificial Sequence
  chemically synthesized
ctagggaaattaacttgcagtt

SEQ ID NO: 1131801 - DNA, 22 bp, Artificial Sequence
  chemically synthesized
actagggaaattaacttgcagt

SEQ ID NO: 1131802 - DNA, 22 bp, Artificial Sequence
  chemically synthesized
tactagggaaattaacttgcag

SEQ ID NO: 1131803 - DNA, 22 bp, Artificial Sequence
  chemically synthesized
ttactagggaaattaacttgca

SEQ ID NO: 1131804 - DNA, 22 bp, Artificial Sequence
  chemically synthesized
ttcattttaactgcaagttaat

SEQ ID NO: 1131805 - DNA, 22 bp, Artificial Sequence
  chemically synthesized
attttaactgcaagttaatttc

SEQ ID NO: 1131806 - DNA, 22 bp, Artificial Sequence
  chemically synthesized
ccatttttactagggaaattaa

SEQ ID NO: 1131807 - DNA, 22 bp, Artificial Sequence
  chemically synthesized
cccatttttactagggaaatta

SEQ ID NO: 1131808 - DNA, 22 bp, Artificial Sequence
  chemically synthesized
taactgcaagttaatttcccta

SEQ ID NO: 1131809 - DNA, 22 bp, Artificial Sequence
  chemically synthesized
aactgcaagttaatttccctag

SEQ ID NO: 1131810 - DNA, 22 bp, Artificial Sequence
  chemically synthesized
actgcaagttaatttccctagt

SEQ ID NO: 1131811 - DNA, 22 bp, Artificial Sequence
  chemically synthesized
tttcccatttttactagggaaa

SEQ ID NO: 1131812 - DNA, 22 bp, Artificial Sequence
  chemically synthesized
caagttaatttccctagtaaaa

SEQ ID NO: 1131813 - DNA, 22 bp, Artificial Sequence
  chemically synthesized
aactatttcccatttttactag

SEQ ID NO: 1131814 - DNA, 22 bp, Artificial Sequence
  chemically synthesized
taaactatttcccatttttact

SEQ ID NO: 1131815 - DNA, 22 bp, Artificial Sequence
  chemically synthesized
ctaaactatttcccatttttac

SEQ ID NO: 1131816 - DNA, 22 bp, Artificial Sequence
  chemically synthesized
atttccctagtaaaaatgggaa

SEQ ID NO: 1131817 - DNA, 22 bp, Artificial Sequence
  chemically synthesized
ccctagtaaaaatgggaaatag

SEQ ID NO: 1131818 - DNA, 22 bp, Artificial Sequence
  chemically synthesized
cctagtaaaaatgggaaatagt

SEQ ID NO: 1131819 - DNA, 22 bp, Artificial Sequence
  chemically synthesized
gtaaaaatgggaaatagtttag

SEQ ID NO: 1131820 - DNA, 22 bp, Artificial Sequence
  chemically synthesized
ccaaatgtaaagacaagtattt

SEQ ID NO: 1131821 - DNA, 22 bp, Artificial Sequence
  chemically synthesized
agaaatacttgtctttacattt

SEQ ID NO: 1131822 - DNA, 22 bp, Artificial Sequence
  chemically synthesized
gaaatacttgtctttacatttg

SEQ ID NO: 1131823 - DNA, 22 bp, Artificial Sequence
  chemically synthesized
agaggaatcagctcccaaatgt

SEQ ID NO: 1131824 - DNA, 22 bp, Artificial Sequence
  chemically synthesized
taagaggaatcagctcccaaat

SEQ ID NO: 1131825 - DNA, 22 bp, Artificial Sequence
  chemically synthesized
gtctttacatttgggagctgat

SEQ ID NO: 1131826 - DNA, 22 bp, Artificial Sequence
  chemically synthesized
tctttacatttgggagctgatt

SEQ ID NO: 1131827 - DNA, 22 bp, Artificial Sequence
  chemically synthesized
tacatttgggagctgattcctc

SEQ ID NO: 1131828 - DNA, 22 bp, Artificial Sequence
  chemically synthesized
taaccactctaagaggaatcag

SEQ ID NO: 1131829 - DNA, 22 bp, Artificial Sequence
  chemically synthesized
acatttgggagctgattcctct

SEQ ID NO: 1131830 - DNA, 22 bp, Artificial Sequence
  chemically synthesized
ataaccactctaagaggaatca

SEQ ID NO: 1131831 - DNA, 22 bp, Artificial Sequence
  chemically synthesized
catttgggagctgattcctctt

SEQ ID NO: 1131832 - DNA, 22 bp, Artificial Sequence
  chemically synthesized
cttataaccactctaagaggaa

SEQ ID NO: 1131833 - DNA, 22 bp, Artificial Sequence
  chemically synthesized
tacttataaccactctaagagg

SEQ ID NO: 1131834 - DNA, 22 bp, Artificial Sequence
  chemically synthesized
gggagctgattcctcttagagt

SEQ ID NO: 1131835 - DNA, 22 bp, Artificial Sequence
  chemically synthesized
ggagctgattcctcttagagtg

SEQ ID NO: 1131836 - DNA, 22 bp, Artificial Sequence
  chemically synthesized
attcctcttagagtggttataa

SEQ ID NO: 1131837 - DNA, 22 bp, Artificial Sequence
  chemically synthesized
caatgcctctacttataaccac

SEQ ID NO: 1131838 - DNA, 22 bp, Artificial Sequence
  chemically synthesized
ctcttagagtggttataagtag

SEQ ID NO: 1131839 - DNA, 22 bp, Artificial Sequence
  chemically synthesized
gctccaatgcctctacttataa

SEQ ID NO: 1131840 - DNA, 22 bp, Artificial Sequence
  chemically synthesized
ttagagtggttataagtagagg

SEQ ID NO: 1131841 - DNA, 22 bp, Artificial Sequence
  chemically synthesized
agagtggttataagtagaggca

SEQ ID NO: 1131842 - DNA, 22 bp, Artificial Sequence
  chemically synthesized
gagtggttataagtagaggcat

SEQ ID NO: 1131843 - DNA, 22 bp, Artificial Sequence
  chemically synthesized
tggagactggctccaatgcctc

SEQ ID NO: 1131844 - DNA, 22 bp, Artificial Sequence
  chemically synthesized
taagtagaggcattggagccag

SEQ ID NO: 1131845 - DNA, 22 bp, Artificial Sequence
  chemically synthesized
ataattgtggagactggctcca

SEQ ID NO: 1131846 - DNA, 22 bp, Artificial Sequence
  chemically synthesized
aataattgtggagactggctcc

SEQ ID NO: 1131847 - DNA, 22 bp, Artificial Sequence
  chemically synthesized
gtgtttaataattgtggagact

SEQ ID NO: 1131848 - DNA, 22 bp, Artificial Sequence
  chemically synthesized
gagccagtctccacaattatta

SEQ ID NO: 1131849 - DNA, 22 bp, Artificial Sequence
  chemically synthesized
tggatctggtgtttaataattg

SEQ ID NO: 1131850 - DNA, 22 bp, Artificial Sequence
  chemically synthesized
cacaattattaaacaccagatc

SEQ ID NO: 1131851 - DNA, 22 bp, Artificial Sequence
  chemically synthesized
ttaaacaccagatccatagttt

SEQ ID NO: 1131852 - DNA, 22 bp, Artificial Sequence
  chemically synthesized
aacaccagatccatagtttata

SEQ ID NO: 1131853 - DNA, 22 bp, Artificial Sequence
  chemically synthesized
atacactgtgacatttggggct

SEQ ID NO: 1131854 - DNA, 22 bp, Artificial Sequence
  chemically synthesized
tacactgtgacatttggggctg

SEQ ID NO: 1131855 - DNA, 22 bp, Artificial Sequence
  chemically synthesized
agataagaaccaaccagcccca

SEQ ID NO: 1131856 - DNA, 22 bp, Artificial Sequence
  chemically synthesized
gagataagaaccaaccagcccc

SEQ ID NO: 1131857 - DNA, 22 bp, Artificial Sequence
  chemically synthesized
tgacatttggggctggttggtt

SEQ ID NO: 1131858 - DNA, 22 bp, Artificial Sequence
  chemically synthesized
ggggctggttggttcttatctc

SEQ ID NO: 1131859 - DNA, 22 bp, Artificial Sequence
  chemically synthesized
gggctggttggttcttatctca

SEQ ID NO: 1131860 - DNA, 22 bp, Artificial Sequence
  chemically synthesized
gttggttcttatctcaaatcta

SEQ ID NO: 1131861 - DNA, 22 bp, Artificial Sequence
  chemically synthesized
gttcttatctcaaatctatgca

SEQ ID NO: 1131862 - DNA, 22 bp, Artificial Sequence
  chemically synthesized
ttatctcaaatctatgcattat

SEQ ID NO: 1131863 - DNA, 22 bp, Artificial Sequence
  chemically synthesized
aagatgaagaaaataatgcata

SEQ ID NO: 1131864 - DNA, 22 bp, Artificial Sequence
  chemically synthesized
aaagatgaagaaaataatgcat

SEQ ID NO: 1131865 - DNA, 22 bp, Artificial Sequence
  chemically synthesized
atctcaaatctatgcattattt

SEQ ID NO: 1131866 - DNA, 22 bp, Artificial Sequence
  chemically synthesized
taaagatgaagaaaataatgca

SEQ ID NO: 1131867 - DNA, 22 bp, Artificial Sequence
  chemically synthesized
tctcaaatctatgcattatttt

SEQ ID NO: 1131868 - DNA, 22 bp, Artificial Sequence
  chemically synthesized
ctttaaagatgaagaaaataat

SEQ ID NO: 1131869 - DNA, 22 bp, Artificial Sequence
  chemically synthesized
actttaaagatgaagaaaataa

SEQ ID NO: 1131870 - DNA, 22 bp, Artificial Sequence
  chemically synthesized
aaatctatgcattattttcttc

SEQ ID NO: 1131871 - DNA, 22 bp, Artificial Sequence
  chemically synthesized
ttactttaaagatgaagaaaat

SEQ ID NO: 1131872 - DNA, 22 bp, Artificial Sequence
  chemically synthesized
ctcttactttaaagatgaagaa

SEQ ID NO: 1131873 - DNA, 22 bp, Artificial Sequence
  chemically synthesized
tgcattattttcttcatcttta

SEQ ID NO: 1131874 - DNA, 22 bp, Artificial Sequence
  chemically synthesized
ttttcttcatctttaaagtaag

SEQ ID NO: 1131875 - DNA, 22 bp, Artificial Sequence
  chemically synthesized
tcttcatctttaaagtaagagt

SEQ ID NO: 1131876 - DNA, 22 bp, Artificial Sequence
  chemically synthesized
cttcatctttaaagtaagagta

SEQ ID NO: 1131877 - DNA, 22 bp, Artificial Sequence
  chemically synthesized
ttcatctttaaagtaagagtaa

SEQ ID NO: 1131878 - DNA, 22 bp, Artificial Sequence
  chemically synthesized
tgaagaaatgtgttactcttac

SEQ ID NO: 1131879 - DNA, 22 bp, Artificial Sequence
  chemically synthesized
catctttaaagtaagagtaaca

SEQ ID NO: 1131880 - DNA, 22 bp, Artificial Sequence
  chemically synthesized
atctttaaagtaagagtaacac

SEQ ID NO: 1131881 - DNA, 22 bp, Artificial Sequence
  chemically synthesized
taaagtaagagtaacacatttc

SEQ ID NO: 1131882 - DNA, 22 bp, Artificial Sequence
  chemically synthesized
aaagtaagagtaacacatttct

SEQ ID NO: 1131883 - DNA, 22 bp, Artificial Sequence
  chemically synthesized
aagtaagagtaacacatttctt

SEQ ID NO: 1131884 - DNA, 22 bp, Artificial Sequence
  chemically synthesized
taacacacctgtgaagaaatgt

SEQ ID NO: 1131885 - DNA, 22 bp, Artificial Sequence
  chemically synthesized
gtaacacacctgtgaagaaatg

SEQ ID NO: 1131886 - DNA, 22 bp, Artificial Sequence
  chemically synthesized
cttgtaacacacctgtgaagaa

SEQ ID NO: 1131887 - DNA, 22 bp, Artificial Sequence
  chemically synthesized
gcttgtaacacacctgtgaaga

SEQ ID NO: 1131888 - DNA, 22 bp, Artificial Sequence
  chemically synthesized
tccttgcttgtaacacacctgt

SEQ ID NO: 1131889 - DNA, 22 bp, Artificial Sequence
  chemically synthesized
cttcacaggtgtgttacaagca

SEQ ID NO: 1131890 - DNA, 22 bp, Artificial Sequence
  chemically synthesized
ttcacaggtgtgttacaagcaa

SEQ ID NO: 1131891 - DNA, 22 bp, Artificial Sequence
  chemically synthesized
cacaggtgtgttacaagcaagg

SEQ ID NO: 1131892 - DNA, 22 bp, Artificial Sequence
  chemically synthesized
acaggtgtgttacaagcaagga

SEQ ID NO: 1131893 - DNA, 22 bp, Artificial Sequence
  chemically synthesized
ccagcccatgaagctgtccttg

SEQ ID NO: 1131894 - DNA, 22 bp, Artificial Sequence
  chemically synthesized
caagcaaggacagcttcatggg

SEQ ID NO: 1131895 - DNA, 22 bp, Artificial Sequence
  chemically synthesized
cataaattaccagcccatgaag

SEQ ID NO: 1131896 - DNA, 22 bp, Artificial Sequence
  chemically synthesized
ggcaactgcataaattaccagc

SEQ ID NO: 1131897 - DNA, 22 bp, Artificial Sequence
  chemically synthesized
catgggctggtaatttatgcag

SEQ ID NO: 1131898 - DNA, 22 bp, Artificial Sequence
  chemically synthesized
atgggctggtaatttatgcagt

SEQ ID NO: 1131899 - DNA, 22 bp, Artificial Sequence
  chemically synthesized
agcaggggccctgggcaactgc

SEQ ID NO: 1131900 - DNA, 22 bp, Artificial Sequence
  chemically synthesized
gtaatttatgcagttgcccagg

SEQ ID NO: 1131901 - DNA, 22 bp, Artificial Sequence
  chemically synthesized
ctgagcaggggccctgggcaac

SEQ ID NO: 1131902 - DNA, 22 bp, Artificial Sequence
  chemically synthesized
atgcagttgcccagggcccctg

SEQ ID NO: 1131903 - DNA, 22 bp, Artificial Sequence
  chemically synthesized
tgcagttgcccagggcccctgc

SEQ ID NO: 1131904 - DNA, 22 bp, Artificial Sequence
  chemically synthesized
cccagggcccctgctcaggagg

SEQ ID NO: 1131905 - DNA, 22 bp, Artificial Sequence
  chemically synthesized
aaaacaagcatggaagcctcct

SEQ ID NO: 1131906 - DNA, 22 bp, Artificial Sequence
  chemically synthesized
gaaaacaagcatggaagcctcc

SEQ ID NO: 1131907 - DNA, 22 bp, Artificial Sequence
  chemically synthesized
ctcaggaggcttccatgcttgt

SEQ ID NO: 1131908 - DNA, 22 bp, Artificial Sequence
  chemically synthesized
aggaggcttccatgcttgtttt

SEQ ID NO: 1131909 - DNA, 22 bp, Artificial Sequence
  chemically synthesized
ccatgcttgttttcaagctctg

SEQ ID NO: 1131910 - DNA, 22 bp, Artificial Sequence
  chemically synthesized
catgcttgttttcaagctctgc

SEQ ID NO: 1131911 - DNA, 22 bp, Artificial Sequence
  chemically synthesized
aagacagtggaagcagagcttg

SEQ ID NO: 1131912 - DNA, 22 bp, Artificial Sequence
  chemically synthesized
caagacagtggaagcagagctt

SEQ ID NO: 1131913 - DNA, 22 bp, Artificial Sequence
  chemically synthesized
gttttcaagctctgcttccact

SEQ ID NO: 1131914 - DNA, 22 bp, Artificial Sequence
  chemically synthesized
ttttcaagctctgcttccactg

SEQ ID NO: 1131915 - DNA, 22 bp, Artificial Sequence
  chemically synthesized
agaatttcaagacagtggaagc

SEQ ID NO: 1131916 - DNA, 22 bp, Artificial Sequence
  chemically synthesized
tcaagctctgcttccactgtct

SEQ ID NO: 1131917 - DNA, 22 bp, Artificial Sequence
  chemically synthesized
caagctctgcttccactgtctt

SEQ ID NO: 1131918 - DNA, 22 bp, Artificial Sequence
  chemically synthesized
aagctctgcttccactgtcttg

SEQ ID NO: 1131919 - DNA, 22 bp, Artificial Sequence
  chemically synthesized
aagacctaagaatttcaagaca

SEQ ID NO: 1131920 - DNA, 22 bp, Artificial Sequence
  chemically synthesized
tgcttccactgtcttgaaattc

SEQ ID NO: 1131921 - DNA, 22 bp, Artificial Sequence
  chemically synthesized
ttcaagacctaagaatttcaag

SEQ ID NO: 1131922 - DNA, 22 bp, Artificial Sequence
  chemically synthesized
cttccactgtcttgaaattctt

SEQ ID NO: 1131923 - DNA, 22 bp, Artificial Sequence
  chemically synthesized
ctgttcaagacctaagaatttc

SEQ ID NO: 1131924 - DNA, 22 bp, Artificial Sequence
  chemically synthesized
cctgttcaagacctaagaattt

SEQ ID NO: 1131925 - DNA, 22 bp, Artificial Sequence
  chemically synthesized
ccactgtcttgaaattcttagg

SEQ ID NO: 1131926 - DNA, 22 bp, Artificial Sequence
  chemically synthesized
cactgtcttgaaattcttaggt

SEQ ID NO: 1131927 - DNA, 22 bp, Artificial Sequence
  chemically synthesized
tcttgaaattcttaggtcttga

SEQ ID NO: 1131928 - DNA, 22 bp, Artificial Sequence
  chemically synthesized
gaaattcttaggtcttgaacag

SEQ ID NO: 1131929 - DNA, 22 bp, Artificial Sequence
  chemically synthesized
aaattcttaggtcttgaacagg

SEQ ID NO: 1131930 - DNA, 22 bp, Artificial Sequence
  chemically synthesized
aaaacaagggcttcctgttcaa

SEQ ID NO: 1131931 - DNA, 22 bp, Artificial Sequence
  chemically synthesized
ttaggtcttgaacaggaagccc

SEQ ID NO: 1131932 - DNA, 22 bp, Artificial Sequence
  chemically synthesized
aggtcttgaacaggaagccctt

SEQ ID NO: 1131933 - DNA, 22 bp, Artificial Sequence
  chemically synthesized
ggtcttgaacaggaagcccttg

SEQ ID NO: 1131934 - DNA, 22 bp, Artificial Sequence
  chemically synthesized
gaacaggaagcccttgttttca

SEQ ID NO: 1131935 - DNA, 22 bp, Artificial Sequence
  chemically synthesized
aacaggaagcccttgttttcag

SEQ ID NO: 1131936 - DNA, 22 bp, Artificial Sequence
  chemically synthesized
tgggcccagtgcaaactgaaaa

SEQ ID NO: 1131937 - DNA, 22 bp, Artificial Sequence
  chemically synthesized
gtgggcccagtgcaaactgaaa

SEQ ID NO: 1131938 - DNA, 22 bp, Artificial Sequence
  chemically synthesized
cataatttgtgggcccagtgca

SEQ ID NO: 1131939 - DNA, 22 bp, Artificial Sequence
  chemically synthesized
gttttcagtttgcactgggccc

SEQ ID NO: 1131940 - DNA, 22 bp, Artificial Sequence
  chemically synthesized
ttttcagtttgcactgggccca

SEQ ID NO: 1131941 - DNA, 22 bp, Artificial Sequence
  chemically synthesized
gctacataatttgtgggcccag

SEQ ID NO: 1131942 - DNA, 22 bp, Artificial Sequence
  chemically synthesized
tcagtttgcactgggcccacaa

SEQ ID NO: 1131943 - DNA, 22 bp, Artificial Sequence
  chemically synthesized
cagtttgcactgggcccacaaa

SEQ ID NO: 1131944 - DNA, 22 bp, Artificial Sequence
  chemically synthesized
agtttgcactgggcccacaaat

SEQ ID NO: 1131945 - DNA, 22 bp, Artificial Sequence
  chemically synthesized
gcactgggcccacaaattatgt

SEQ ID NO: 1131946 - DNA, 22 bp, Artificial Sequence
  chemically synthesized
cactgggcccacaaattatgta

SEQ ID NO: 1131947 - DNA, 22 bp, Artificial Sequence
  chemically synthesized
aaaaccaggactggctacataa

SEQ ID NO: 1131948 - DNA, 22 bp, Artificial Sequence
  chemically synthesized
ggcccacaaattatgtagccag

SEQ ID NO: 1131949 - DNA, 22 bp, Artificial Sequence
  chemically synthesized
tcaaaaccaggactggctacat

SEQ ID NO: 1131950 - DNA, 22 bp, Artificial Sequence
  chemically synthesized
attctcaaaaccaggactggct

SEQ ID NO: 1131951 - DNA, 22 bp, Artificial Sequence
  chemically synthesized
aattctcaaaaccaggactggc

SEQ ID NO: 1131952 - DNA, 22 bp, Artificial Sequence
  chemically synthesized
tgtagccagtcctggttttgag

SEQ ID NO: 1131953 - DNA, 22 bp, Artificial Sequence
  chemically synthesized
tatcatttaattctcaaaacca

SEQ ID NO: 1131954 - DNA, 22 bp, Artificial Sequence
  chemically synthesized
agatattatatcatttaattct

SEQ ID NO: 1131955 - DNA, 22 bp, Artificial Sequence
  chemically synthesized
ttcagatattatatcatttaat

SEQ ID NO: 1131956 - DNA, 22 bp, Artificial Sequence
  chemically synthesized
attcagatattatatcatttaa

SEQ ID NO: 1131957 - DNA, 22 bp, Artificial Sequence
  chemically synthesized
tattcagatattatatcattta

SEQ ID NO: 1131958 - DNA, 22 bp, Artificial Sequence
  chemically synthesized
gttttgagaattaaatgatata

SEQ ID NO: 1131959 - DNA, 22 bp, Artificial Sequence
  chemically synthesized
ttttattcagatattatatcat

SEQ ID NO: 1131960 - DNA, 22 bp, Artificial Sequence
  chemically synthesized
attttattcagatattatatca

SEQ ID NO: 1131961 - DNA, 22 bp, Artificial Sequence
  chemically synthesized
tgagaattaaatgatataatat

SEQ ID NO: 1131962 - DNA, 22 bp, Artificial Sequence
  chemically synthesized
gagaattaaatgatataatatc

SEQ ID NO: 1131963 - DNA, 22 bp, Artificial Sequence
  chemically synthesized
agaattaaatgatataatatct

SEQ ID NO: 1131964 - DNA, 22 bp, Artificial Sequence
  chemically synthesized
aatgatataatatctgaataaa

SEQ ID NO: 1131965 - DNA, 22 bp, Artificial Sequence
  chemically synthesized
tagagcacttattttattcaga

SEQ ID NO: 1131966 - DNA, 22 bp, Artificial Sequence
  chemically synthesized
ccattatagagcacttatttta

SEQ ID NO: 1131967 - DNA, 22 bp, Artificial Sequence
  chemically synthesized
accattatagagcacttatttt

SEQ ID NO: 1131968 - DNA, 22 bp, Artificial Sequence
  chemically synthesized
atatttaccattatagagcact

SEQ ID NO: 1131969 - DNA, 22 bp, Artificial Sequence
  chemically synthesized
aataaaataagtgctctataat

SEQ ID NO: 1131970 - DNA, 22 bp, Artificial Sequence
  chemically synthesized
ctgatatttaccattatagagc

SEQ ID NO: 1131971 - DNA, 22 bp, Artificial Sequence
  chemically synthesized
ctgctgatatttaccattatag

SEQ ID NO: 1131972 - DNA, 22 bp, Artificial Sequence
  chemically synthesized
tataatggtaaatatcagcagt

SEQ ID NO: 1131973 - DNA, 22 bp, Artificial Sequence
  chemically synthesized
taatggtaaatatcagcagtaa

SEQ ID NO: 1131974 - DNA, 22 bp, Artificial Sequence
  chemically synthesized
gaaaagatagtggttactgctg

SEQ ID NO: 1131975 - DNA, 22 bp, Artificial Sequence
  chemically synthesized
agaaaagatagtggttactgct

SEQ ID NO: 1131976 - DNA, 22 bp, Artificial Sequence
  chemically synthesized
agcgtttagaaaagatagtggt

SEQ ID NO: 1131977 - DNA, 22 bp, Artificial Sequence
  chemically synthesized
cctgagcgtttagaaaagatag

SEQ ID NO: 1131978 - DNA, 22 bp, Artificial Sequence
  chemically synthesized
ccctgagcgtttagaaaagata

SEQ ID NO: 1131979 - DNA, 22 bp, Artificial Sequence
  chemically synthesized
aaatttccctgagcgtttagaa

SEQ ID NO: 1131980 - DNA, 22 bp, Artificial Sequence
  chemically synthesized
caaatttccctgagcgtttaga

SEQ ID NO: 1131981 - DNA, 22 bp, Artificial Sequence
  chemically synthesized
ttcaaatttccctgagcgttta

SEQ ID NO: 1131982 - DNA, 22 bp, Artificial Sequence
  chemically synthesized
tcttttctaaacgctcagggaa

SEQ ID NO: 1131983 - DNA, 22 bp, Artificial Sequence
  chemically synthesized
ttctaaacgctcagggaaattt

SEQ ID NO: 1131984 - DNA, 22 bp, Artificial Sequence
  chemically synthesized
tctaaacgctcagggaaatttg

SEQ ID NO: 1131985 - DNA, 22 bp, Artificial Sequence
  chemically synthesized
ctaaacgctcagggaaatttga

SEQ ID NO: 1131986 - DNA, 22 bp, Artificial Sequence
  chemically synthesized
taaacgctcagggaaatttgaa

SEQ ID NO: 1131987 - DNA, 22 bp, Artificial Sequence
  chemically synthesized
aacgctcagggaaatttgaaga

SEQ ID NO: 1131988 - DNA, 22 bp, Artificial Sequence
  chemically synthesized
agtatagaaaaattcttcaaat

SEQ ID NO: 1131989 - DNA, 22 bp, Artificial Sequence
  chemically synthesized
agggaaatttgaagaatttttc

SEQ ID NO: 1131990 - DNA, 22 bp, Artificial Sequence
  chemically synthesized
tgagtaagaaggttgagtatag

SEQ ID NO: 1131991 - DNA, 22 bp, Artificial Sequence
  chemically synthesized
gaagaatttttctatactcaac

SEQ ID NO: 1131992 - DNA, 22 bp, Artificial Sequence
  chemically synthesized
atgagtaagaaggttgagtata

SEQ ID NO: 1131993 - DNA, 22 bp, Artificial Sequence
  chemically synthesized
aagaatttttctatactcaacc

SEQ ID NO: 1131994 - DNA, 22 bp, Artificial Sequence
  chemically synthesized
ttctatactcaaccttcttact

SEQ ID NO: 1131995 - DNA, 22 bp, Artificial Sequence
  chemically synthesized
tctatactcaaccttcttactc

SEQ ID NO: 1131996 - DNA, 22 bp, Artificial Sequence
  chemically synthesized
ctatactcaaccttcttactca

SEQ ID NO: 1131997 - DNA, 22 bp, Artificial Sequence
  chemically synthesized
tatactcaaccttcttactcat

SEQ ID NO: 1131998 - DNA, 22 bp, Artificial Sequence
  chemically synthesized
tactcaaccttcttactcataa

SEQ ID NO: 1131999 - DNA, 22 bp, Artificial Sequence
  chemically synthesized
acatatgtaatcttatgagtaa

SEQ ID NO: 1132000 - DNA, 22 bp, Artificial Sequence
  chemically synthesized
aacatatgtaatcttatgagta

SEQ ID NO: 1132001 - DNA, 22 bp, Artificial Sequence
  chemically synthesized
taacatatgtaatcttatgagt

SEQ ID NO: 1132002 - DNA, 22 bp, Artificial Sequence
  chemically synthesized
ttaacatatgtaatcttatgag

SEQ ID NO: 1132003 - DNA, 22 bp, Artificial Sequence
  chemically synthesized
tttaacatatgtaatcttatga

SEQ ID NO: 1132004 - DNA, 22 bp, Artificial Sequence
  chemically synthesized
aaccttcttactcataagatta

SEQ ID NO: 1132005 - DNA, 22 bp, Artificial Sequence
  chemically synthesized
aatctttttaacatatgtaatc

SEQ ID NO: 1132006 - DNA, 22 bp, Artificial Sequence
  chemically synthesized
cttactcataagattacatatg

SEQ ID NO: 1132007 - DNA, 22 bp, Artificial Sequence
  chemically synthesized
aaatctttttaacatatgtaat

SEQ ID NO: 1132008 - DNA, 22 bp, Artificial Sequence
  chemically synthesized
ttactcataagattacatatgt

SEQ ID NO: 1132009 - DNA, 22 bp, Artificial Sequence
  chemically synthesized
actcataagattacatatgtta

SEQ ID NO: 1132010 - DNA, 22 bp, Artificial Sequence
  chemically synthesized
ctcataagattacatatgttaa

SEQ ID NO: 1132011 - DNA, 22 bp, Artificial Sequence
  chemically synthesized
aagtttaaatctttttaacata

SEQ ID NO: 1132012 - DNA, 22 bp, Artificial Sequence
  chemically synthesized
ataagattacatatgttaaaaa

SEQ ID NO: 1132013 - DNA, 22 bp, Artificial Sequence
  chemically synthesized
aaagtttaaatctttttaacat

SEQ ID NO: 1132014 - DNA, 22 bp, Artificial Sequence
  chemically synthesized
taaagtttaaatctttttaaca

SEQ ID NO: 1132015 - DNA, 22 bp, Artificial Sequence
  chemically synthesized
catatgttaaaaagatttaaac

SEQ ID NO: 1132016 - DNA, 22 bp, Artificial Sequence
  chemically synthesized
aaaagatttaaactttaaaatt

SEQ ID NO: 1132017 - DNA, 22 bp, Artificial Sequence
  chemically synthesized
agaatgagaaaatgtaaatttt

SEQ ID NO: 1132018 - DNA, 22 bp, Artificial Sequence
  chemically synthesized
tcagaatgagaaaatgtaaatt

SEQ ID NO: 1132019 - DNA, 22 bp, Artificial Sequence
  chemically synthesized
ctcagaatgagaaaatgtaaat

SEQ ID NO: 1132020 - DNA, 22 bp, Artificial Sequence
  chemically synthesized
tctcagaatgagaaaatgtaaa

SEQ ID NO: 1132021 - DNA, 22 bp, Artificial Sequence
  chemically synthesized
aaactttaaaatttacattttc

SEQ ID NO: 1132022 - DNA, 22 bp, Artificial Sequence
  chemically synthesized
ttctcagaatgagaaaatgtaa

SEQ ID NO: 1132023 - DNA, 22 bp, Artificial Sequence
  chemically synthesized
aactttaaaatttacattttct

SEQ ID NO: 1132024 - DNA, 22 bp, Artificial Sequence
  chemically synthesized
taaaatttacattttctcattc

SEQ ID NO: 1132025 - DNA, 22 bp, Artificial Sequence
  chemically synthesized
caatttttctcagaatgagaaa

SEQ ID NO: 1132026 - DNA, 22 bp, Artificial Sequence
  chemically synthesized
aaaatttacattttctcattct

SEQ ID NO: 1132027 - DNA, 22 bp, Artificial Sequence
  chemically synthesized
ccaatttttctcagaatgagaa

SEQ ID NO: 1132028 - DNA, 22 bp, Artificial Sequence
  chemically synthesized
aaatttacattttctcattctg

SEQ ID NO: 1132029 - DNA, 22 bp, Artificial Sequence
  chemically synthesized
ttccaatttttctcagaatgag

SEQ ID NO: 1132030 - DNA, 22 bp, Artificial Sequence
  chemically synthesized
acattttctcattctgagaaaa

SEQ ID NO: 1132031 - DNA, 22 bp, Artificial Sequence
  chemically synthesized
cattttctcattctgagaaaaa

SEQ ID NO: 1132032 - DNA, 22 bp, Artificial Sequence
  chemically synthesized
gcaaatgctcttccaatttttc

SEQ ID NO: 1132033 - DNA, 22 bp, Artificial Sequence
  chemically synthesized
tctcattctgagaaaaattgga

SEQ ID NO: 1132034 - DNA, 22 bp, Artificial Sequence
  chemically synthesized
ctcattctgagaaaaattggaa

SEQ ID NO: 1132035 - DNA, 22 bp, Artificial Sequence
  chemically synthesized
tcattctgagaaaaattggaag

SEQ ID NO: 1132036 - DNA, 22 bp, Artificial Sequence
  chemically synthesized
attctgagaaaaattggaagag

SEQ ID NO: 1132037 - DNA, 22 bp, Artificial Sequence
  chemically synthesized
tgagaaaaattggaagagcatt

SEQ ID NO: 1132038 - DNA, 22 bp, Artificial Sequence
  chemically synthesized
agaaaaattggaagagcatttg

SEQ ID NO: 1132039 - DNA, 22 bp, Artificial Sequence
  chemically synthesized
gaataatatcaggatgctggca

SEQ ID NO: 1132040 - DNA, 22 bp, Artificial Sequence
  chemically synthesized
gaagagcatttgccagcatcct

SEQ ID NO: 1132041 - DNA, 22 bp, Artificial Sequence
  chemically synthesized
gccagcatcctgatattattcc

SEQ ID NO: 1132042 - DNA, 22 bp, Artificial Sequence
  chemically synthesized
ccagcatcctgatattattcca

SEQ ID NO: 1132043 - DNA, 22 bp, Artificial Sequence
  chemically synthesized
caagaagaggcacaccctggaa

SEQ ID NO: 1132044 - DNA, 22 bp, Artificial Sequence
  chemically synthesized
ctgcaagaagaggcacaccctg

SEQ ID NO: 1132045 - DNA, 22 bp, Artificial Sequence
  chemically synthesized
actgcaagaagaggcacaccct

SEQ ID NO: 1132046 - DNA, 22 bp, Artificial Sequence
  chemically synthesized
atattattccagggtgtgcctc

SEQ ID NO: 1132047 - DNA, 22 bp, Artificial Sequence
  chemically synthesized
ttccagggtgtgcctcttcttg

SEQ ID NO: 1132048 - DNA, 22 bp, Artificial Sequence
  chemically synthesized
cagggtgtgcctcttcttgcag

SEQ ID NO: 1132049 - DNA, 22 bp, Artificial Sequence
  chemically synthesized
tcaaaataacacaatcttactg

SEQ ID NO: 1132050 - DNA, 22 bp, Artificial Sequence
  chemically synthesized
ttcttgcagtaagattgtgtta

SEQ ID NO: 1132051 - DNA, 22 bp, Artificial Sequence
  chemically synthesized
cttgcagtaagattgtgttatt

SEQ ID NO: 1132052 - DNA, 22 bp, Artificial Sequence
  chemically synthesized
ttgcagtaagattgtgttattt

SEQ ID NO: 1132053 - DNA, 22 bp, Artificial Sequence
  chemically synthesized
ccaggcctatcaaaataacaca

SEQ ID NO: 1132054 - DNA, 22 bp, Artificial Sequence
  chemically synthesized
cccaggcctatcaaaataacac

SEQ ID NO: 1132055 - DNA, 22 bp, Artificial Sequence
  chemically synthesized
gcagtaagattgtgttattttg

SEQ ID NO: 1132056 - DNA, 22 bp, Artificial Sequence
  chemically synthesized
tcccaggcctatcaaaataaca

SEQ ID NO: 1132057 - DNA, 22 bp, Artificial Sequence
  chemically synthesized
cagtaagattgtgttattttga

SEQ ID NO: 1132058 - DNA, 22 bp, Artificial Sequence
  chemically synthesized
ttcccaggcctatcaaaataac

SEQ ID NO: 1132059 - DNA, 22 bp, Artificial Sequence
  chemically synthesized
tttttcccaggcctatcaaaat

SEQ ID NO: 1132060 - DNA, 22 bp, Artificial Sequence
  chemically synthesized
gtttttcccaggcctatcaaaa

SEQ ID NO: 1132061 - DNA, 22 bp, Artificial Sequence
  chemically synthesized
tgttattttgataggcctggga

SEQ ID NO: 1132062 - DNA, 22 bp, Artificial Sequence
  chemically synthesized
agcatagtttgtttttcccagg

SEQ ID NO: 1132063 - DNA, 22 bp, Artificial Sequence
  chemically synthesized
gagcatagtttgtttttcccag

SEQ ID NO: 1132064 - DNA, 22 bp, Artificial Sequence
  chemically synthesized
ttttgataggcctgggaaaaac

SEQ ID NO: 1132065 - DNA, 22 bp, Artificial Sequence
  chemically synthesized
ttgagcatagtttgtttttccc

SEQ ID NO: 1132066 - DNA, 22 bp, Artificial Sequence
  chemically synthesized
cttgagcatagtttgtttttcc

SEQ ID NO: 1132067 - DNA, 22 bp, Artificial Sequence
  chemically synthesized
tgataggcctgggaaaaacaaa

SEQ ID NO: 1132068 - DNA, 22 bp, Artificial Sequence
  chemically synthesized
gataggcctgggaaaaacaaac

SEQ ID NO: 1132069 - DNA, 22 bp, Artificial Sequence
  chemically synthesized
ataggcctgggaaaaacaaact

SEQ ID NO: 1132070 - DNA, 22 bp, Artificial Sequence
  chemically synthesized
atttcttgagcatagtttgttt

SEQ ID NO: 1132071 - DNA, 22 bp, Artificial Sequence
  chemically synthesized
catttcttgagcatagtttgtt

SEQ ID NO: 1132072 - DNA, 22 bp, Artificial Sequence
  chemically synthesized
ggaaaaacaaactatgctcaag

SEQ ID NO: 1132073 - DNA, 22 bp, Artificial Sequence
  chemically synthesized
tgctcaagaaatgaagttcttt

SEQ ID NO: 1132074 - DNA, 22 bp, Artificial Sequence
  chemically synthesized
aagaaatgaagttctttctttc

SEQ ID NO: 1132075 - DNA, 22 bp, Artificial Sequence
  chemically synthesized
aacaagtggaagagaagatgga

SEQ ID NO: 1132076 - DNA, 22 bp, Artificial Sequence
  chemically synthesized
aaacaagtggaagagaagatgg

SEQ ID NO: 1132077 - DNA, 22 bp, Artificial Sequence
  chemically synthesized
taaacaagtggaagagaagatg

SEQ ID NO: 1132078 - DNA, 22 bp, Artificial Sequence
  chemically synthesized
ttaaacaagtggaagagaagat

SEQ ID NO: 1132079 - DNA, 22 bp, Artificial Sequence
  chemically synthesized
tttaaacaagtggaagagaaga

SEQ ID NO: 1132080 - DNA, 22 bp, Artificial Sequence
  chemically synthesized
tttctttccatcttctcttcca

SEQ ID NO: 1132081 - DNA, 22 bp, Artificial Sequence
  chemically synthesized
tctttccatcttctcttccact

SEQ ID NO: 1132082 - DNA, 22 bp, Artificial Sequence
  chemically synthesized
ctttccatcttctcttccactt

SEQ ID NO: 1132083 - DNA, 22 bp, Artificial Sequence
  chemically synthesized
tttccatcttctcttccacttg

SEQ ID NO: 1132084 - DNA, 22 bp, Artificial Sequence
  chemically synthesized
tccatcttctcttccacttgtt

SEQ ID NO: 1132085 - DNA, 22 bp, Artificial Sequence
  chemically synthesized
ccatcttctcttccacttgttt

SEQ ID NO: 1132086 - DNA, 22 bp, Artificial Sequence
  chemically synthesized
catcttctcttccacttgttta

SEQ ID NO: 1132087 - DNA, 22 bp, Artificial Sequence
  chemically synthesized
aatgtgcattttttaaacaagt

SEQ ID NO: 1132088 - DNA, 22 bp, Artificial Sequence
  chemically synthesized
aaatgtgcattttttaaacaag

SEQ ID NO: 1132089 - DNA, 22 bp, Artificial Sequence
  chemically synthesized
taaatgtgcattttttaaacaa

SEQ ID NO: 1132090 - DNA, 22 bp, Artificial Sequence
  chemically synthesized
ttaaatgtgcattttttaaaca

SEQ ID NO: 1132091 - DNA, 22 bp, Artificial Sequence
  chemically synthesized
tttaaatgtgcattttttaaac

SEQ ID NO: 1132092 - DNA, 22 bp, Artificial Sequence
  chemically synthesized
ctcttccacttgtttaaaaaat

SEQ ID NO: 1132093 - DNA, 22 bp, Artificial Sequence
  chemically synthesized
ttttaaatgtgcattttttaaa

SEQ ID NO: 1132094 - DNA, 22 bp, Artificial Sequence
  chemically synthesized
tcttccacttgtttaaaaaatg

SEQ ID NO: 1132095 - DNA, 22 bp, Artificial Sequence
  chemically synthesized
tttttaaatgtgcattttttaa

SEQ ID NO: 1132096 - DNA, 22 bp, Artificial Sequence
  chemically synthesized
ttccacttgtttaaaaaatgca

SEQ ID NO: 1132097 - DNA, 22 bp, Artificial Sequence
  chemically synthesized
tttttttaaatgtgcatttttt

SEQ ID NO: 1132098 - DNA, 22 bp, Artificial Sequence
  chemically synthesized
ctttttttaaatgtgcattttt

SEQ ID NO: 1132099 - DNA, 22 bp, Artificial Sequence
  chemically synthesized
ccacttgtttaaaaaatgcaca

SEQ ID NO: 1132100 - DNA, 22 bp, Artificial Sequence
  chemically synthesized
cacttgtttaaaaaatgcacat

SEQ ID NO: 1132101 - DNA, 22 bp, Artificial Sequence
  chemically synthesized
tgtttctttttttaaatgtgca

SEQ ID NO: 1132102 - DNA, 22 bp, Artificial Sequence
  chemically synthesized
atgtttctttttttaaatgtgc

SEQ ID NO: 1132103 - DNA, 22 bp, Artificial Sequence
  chemically synthesized
gtttaaaaaatgcacatttaaa

SEQ ID NO: 1132104 - DNA, 22 bp, Artificial Sequence
  chemically synthesized
tttaaaaaatgcacatttaaaa

SEQ ID NO: 1132105 - DNA, 22 bp, Artificial Sequence
  chemically synthesized
aaaaaatgcacatttaaaaaaa

SEQ ID NO: 1132106 - DNA, 22 bp, Artificial Sequence
  chemically synthesized
aaaaatgcacatttaaaaaaag

SEQ ID NO: 1132107 - DNA, 22 bp, Artificial Sequence
  chemically synthesized
atgtacttatgtttcttttttt

SEQ ID NO: 1132108 - DNA, 22 bp, Artificial Sequence
  chemically synthesized
gatgtacttatgtttctttttt

SEQ ID NO: 1132109 - DNA, 22 bp, Artificial Sequence
  chemically synthesized
tgatgtacttatgtttcttttt

SEQ ID NO: 1132110 - DNA, 22 bp, Artificial Sequence
  chemically synthesized
ctttgatgtacttatgtttctt

SEQ ID NO: 1132111 - DNA, 22 bp, Artificial Sequence
  chemically synthesized
gctttgatgtacttatgtttct

SEQ ID NO: 1132112 - DNA, 22 bp, Artificial Sequence
  chemically synthesized
aatttgctttgatgtacttatg

SEQ ID NO: 1132113 - DNA, 22 bp, Artificial Sequence
  chemically synthesized
aaaaaaagaaacataagtacat

SEQ ID NO: 1132114 - DNA, 22 bp, Artificial Sequence
  chemically synthesized
aaatttgctttgatgtacttat

SEQ ID NO: 1132115 - DNA, 22 bp, Artificial Sequence
  chemically synthesized
aaaaaagaaacataagtacatc

SEQ ID NO: 1132116 - DNA, 22 bp, Artificial Sequence
  chemically synthesized
taaatttgctttgatgtactta

SEQ ID NO: 1132117 - DNA, 22 bp, Artificial Sequence
  chemically synthesized
tttaaatttgctttgatgtact

SEQ ID NO: 1132118 - DNA, 22 bp, Artificial Sequence
  chemically synthesized
tattctttaaatttgctttgat

SEQ ID NO: 1132119 - DNA, 22 bp, Artificial Sequence
  chemically synthesized
gtattctttaaatttgctttga

SEQ ID NO: 1132120 - DNA, 22 bp, Artificial Sequence
  chemically synthesized
tgtattctttaaatttgctttg

SEQ ID NO: 1132121 - DNA, 22 bp, Artificial Sequence
  chemically synthesized
ttgtattctttaaatttgcttt

SEQ ID NO: 1132122 - DNA, 22 bp, Artificial Sequence
  chemically synthesized
tatgtccttttgtattctttaa

SEQ ID NO: 1132123 - DNA, 22 bp, Artificial Sequence
  chemically synthesized
ttgtatgtccttttgtattctt

SEQ ID NO: 1132124 - DNA, 22 bp, Artificial Sequence
  chemically synthesized
attgtatgtccttttgtattct

SEQ ID NO: 1132125 - DNA, 22 bp, Artificial Sequence
  chemically synthesized
tattgtatgtccttttgtattc

SEQ ID NO: 1132126 - DNA, 22 bp, Artificial Sequence
  chemically synthesized
ttttattgtatgtccttttgta

SEQ ID NO: 1132127 - DNA, 22 bp, Artificial Sequence
  chemically synthesized
attttattgtatgtccttttgt

SEQ ID NO: 1132128 - DNA, 22 bp, Artificial Sequence
  chemically synthesized
tattttattgtatgtccttttg

SEQ ID NO: 1132129 - DNA, 22 bp, Artificial Sequence
  chemically synthesized
aaagaatacaaaaggacataca

SEQ ID NO: 1132130 - DNA, 22 bp, Artificial Sequence
  chemically synthesized
aagaatacaaaaggacatacaa

SEQ ID NO: 1132131 - DNA, 22 bp, Artificial Sequence
  chemically synthesized
gagacagtggtagaaaaaaagt

SEQ ID NO: 1132132 - DNA, 22 bp, Artificial Sequence
  chemically synthesized
ataaactggagacagtggtaga

SEQ ID NO: 1132133 - DNA, 22 bp, Artificial Sequence
  chemically synthesized
ctaataaactggagacagtggt

SEQ ID NO: 1132134 - DNA, 22 bp, Artificial Sequence
  chemically synthesized
tttttctaccactgtctccagt

SEQ ID NO: 1132135 - DNA, 22 bp, Artificial Sequence
  chemically synthesized
ttttctaccactgtctccagtt

SEQ ID NO: 1132136 - DNA, 22 bp, Artificial Sequence
  chemically synthesized
tttctaccactgtctccagttt

SEQ ID NO: 1132137 - DNA, 22 bp, Artificial Sequence
  chemically synthesized
ttctaccactgtctccagttta

SEQ ID NO: 1132138 - DNA, 22 bp, Artificial Sequence
  chemically synthesized
tctaccactgtctccagtttat

SEQ ID NO: 1132139 - DNA, 22 bp, Artificial Sequence
  chemically synthesized
tagtgattcctaataaactgga

SEQ ID NO: 1132140 - DNA, 22 bp, Artificial Sequence
  chemically synthesized
ctaccactgtctccagtttatt

SEQ ID NO: 1132141 - DNA, 22 bp, Artificial Sequence
  chemically synthesized
gtagtgattcctaataaactgg

SEQ ID NO: 1132142 - DNA, 22 bp, Artificial Sequence
  chemically synthesized
taccactgtctccagtttatta

SEQ ID NO: 1132143 - DNA, 22 bp, Artificial Sequence
  chemically synthesized
ccactgtctccagtttattagg

SEQ ID NO: 1132144 - DNA, 22 bp, Artificial Sequence
  chemically synthesized
tctccagtttattaggaatcac

SEQ ID NO: 1132145 - DNA, 22 bp, Artificial Sequence
  chemically synthesized
tacatgacttgtagtgattcct

SEQ ID NO: 1132146 - DNA, 22 bp, Artificial Sequence
  chemically synthesized
cagtttattaggaatcactaca

SEQ ID NO: 1132147 - DNA, 22 bp, Artificial Sequence
  chemically synthesized
agttatacatgacttgtagtga

SEQ ID NO: 1132148 - DNA, 22 bp, Artificial Sequence
  chemically synthesized
ttaagttatacatgacttgtag

SEQ ID NO: 1132149 - DNA, 22 bp, Artificial Sequence
  chemically synthesized
attaggaatcactacaagtcat

SEQ ID NO: 1132150 - DNA, 22 bp, Artificial Sequence
  chemically synthesized
ttaggaatcactacaagtcatg

SEQ ID NO: 1132151 - DNA, 22 bp, Artificial Sequence
  chemically synthesized
ggaatcactacaagtcatgtat

SEQ ID NO: 1132152 - DNA, 22 bp, Artificial Sequence
  chemically synthesized
caagtcatgtataacttaacaa

SEQ ID NO: 1132153 - DNA, 22 bp, Artificial Sequence
  chemically synthesized
agaatgtgtcccagttgttaag

SEQ ID NO: 1132154 - DNA, 22 bp, Artificial Sequence
  chemically synthesized
tcagaatgtgtcccagttgtta

SEQ ID NO: 1132155 - DNA, 22 bp, Artificial Sequence
  chemically synthesized
ctcagaatgtgtcccagttgtt

SEQ ID NO: 1132156 - DNA, 22 bp, Artificial Sequence
  chemically synthesized
aggatgaatttctcagaatgtg

SEQ ID NO: 1132157 - DNA, 22 bp, Artificial Sequence
  chemically synthesized
aacaactgggacacattctgag

SEQ ID NO: 1132158 - DNA, 22 bp, Artificial Sequence
  chemically synthesized
acaactgggacacattctgaga

SEQ ID NO: 1132159 - DNA, 22 bp, Artificial Sequence
  chemically synthesized
tctaaggatgaatttctcagaa

SEQ ID NO: 1132160 - DNA, 22 bp, Artificial Sequence
  chemically synthesized
ggacacattctgagaaattcat

SEQ ID NO: 1132161 - DNA, 22 bp, Artificial Sequence
  chemically synthesized
tgagaaattcatccttagacaa

SEQ ID NO: 1132162 - DNA, 22 bp, Artificial Sequence
  chemically synthesized
agaaattcatccttagacaatt

SEQ ID NO: 1132163 - DNA, 22 bp, Artificial Sequence
  chemically synthesized
gtacaaggacaaaattgtctaa

SEQ ID NO: 1132164 - DNA, 22 bp, Artificial Sequence
  chemically synthesized
atccttagacaattttgtcctt

SEQ ID NO: 1132165 - DNA, 22 bp, Artificial Sequence
  chemically synthesized
cacggcgttcgtacaaggacaa

SEQ ID NO: 1132166 - DNA, 22 bp, Artificial Sequence
  chemically synthesized
agacaattttgtccttgtacga

SEQ ID NO: 1132167 - DNA, 22 bp, Artificial Sequence
  chemically synthesized
gacaattttgtccttgtacgaa

SEQ ID NO: 1132168 - DNA, 22 bp, Artificial Sequence
  chemically synthesized
tgtccttgtacgaacgccgtgg

SEQ ID NO: 1132169 - DNA, 22 bp, Artificial Sequence
  chemically synthesized
tgtaagtacactccacggcgtt

SEQ ID NO: 1132170 - DNA, 22 bp, Artificial Sequence
  chemically synthesized
gtccttgtacgaacgccgtgga

SEQ ID NO: 1132171 - DNA, 22 bp, Artificial Sequence
  chemically synthesized
gtgtaagtacactccacggcgt

SEQ ID NO: 1132172 - DNA, 22 bp, Artificial Sequence
  chemically synthesized
tccttgtacgaacgccgtggag

SEQ ID NO: 1132173 - DNA, 22 bp, Artificial Sequence
  chemically synthesized
ggtttgtgtaagtacactccac

SEQ ID NO: 1132174 - DNA, 22 bp, Artificial Sequence
  chemically synthesized
gtacgaacgccgtggagtgtac

SEQ ID NO: 1132175 - DNA, 22 bp, Artificial Sequence
  chemically synthesized
tacgaacgccgtggagtgtact

SEQ ID NO: 1132176 - DNA, 22 bp, Artificial Sequence
  chemically synthesized
taccatctaggtttgtgtaagt

SEQ ID NO: 1132177 - DNA, 22 bp, Artificial Sequence
  chemically synthesized
acacaaacctagatggtacaga

SEQ ID NO: 1132178 - DNA, 22 bp, Artificial Sequence
  chemically synthesized
gccgtatagtagtctgtaccat

SEQ ID NO: 1132179 - DNA, 22 bp, Artificial Sequence
  chemically synthesized
cacaaacctagatggtacagac

SEQ ID NO: 1132180 - DNA, 22 bp, Artificial Sequence
  chemically synthesized
gatggtacagactactatacgg

SEQ ID NO: 1132181 - DNA, 22 bp, Artificial Sequence
  chemically synthesized
taccacataggttggccgtata

SEQ ID NO: 1132182 - DNA, 22 bp, Artificial Sequence
  chemically synthesized
ctatacggccaacctatgtggt

SEQ ID NO: 1132183 - DNA, 22 bp, Artificial Sequence
  chemically synthesized
tacggccaacctatgtggtaca

SEQ ID NO: 1132184 - DNA, 22 bp, Artificial Sequence
  chemically synthesized
ggagcaataagctgtaccacat

SEQ ID NO: 1132185 - DNA, 22 bp, Artificial Sequence
  chemically synthesized
tagctaggagcaataagctgta

SEQ ID NO: 1132186 - DNA, 22 bp, Artificial Sequence
  chemically synthesized
gtagctaggagcaataagctgt

SEQ ID NO: 1132187 - DNA, 22 bp, Artificial Sequence
  chemically synthesized
tgtggtacagcttattgctcct

SEQ ID NO: 1132188 - DNA, 22 bp, Artificial Sequence
  chemically synthesized
tacaggtttgtagctaggagca

SEQ ID NO: 1132189 - DNA, 22 bp, Artificial Sequence
  chemically synthesized
attgctcctagctacaaacctg

SEQ ID NO: 1132190 - DNA, 22 bp, Artificial Sequence
  chemically synthesized
ttgctcctagctacaaacctgt

SEQ ID NO: 1132191 - DNA, 22 bp, Artificial Sequence
  chemically synthesized
ctcctagctacaaacctgtaca

SEQ ID NO: 1132192 - DNA, 22 bp, Artificial Sequence
  chemically synthesized
ctagctacaaacctgtacagca

SEQ ID NO: 1132193 - DNA, 22 bp, Artificial Sequence
  chemically synthesized
agtatagtcacatgctgtacag

SEQ ID NO: 1132194 - DNA, 22 bp, Artificial Sequence
  chemically synthesized
gctacaaacctgtacagcatgt

SEQ ID NO: 1132195 - DNA, 22 bp, Artificial Sequence
  chemically synthesized
ttcagtatagtcacatgctgta

SEQ ID NO: 1132196 - DNA, 22 bp, Artificial Sequence
  chemically synthesized
caaacctgtacagcatgtgact

SEQ ID NO: 1132197 - DNA, 22 bp, Artificial Sequence
  chemically synthesized
cactattcagtatagtcacatg

SEQ ID NO: 1132198 - DNA, 22 bp, Artificial Sequence
  chemically synthesized
tgcctacactattcagtatagt

SEQ ID NO: 1132199 - DNA, 22 bp, Artificial Sequence
  chemically synthesized
tacagcatgtgactatactgaa

SEQ ID NO: 1132200 - DNA, 22 bp, Artificial Sequence
  chemically synthesized
ccattgtgcctacactattcag

SEQ ID NO: 1132201 - DNA, 22 bp, Artificial Sequence
  chemically synthesized
accattgtgcctacactattca

SEQ ID NO: 1132202 - DNA, 22 bp, Artificial Sequence
  chemically synthesized
tactgaatagtgtaggcacaat

SEQ ID NO: 1132203 - DNA, 22 bp, Artificial Sequence
  chemically synthesized
aatagtgtaggcacaatggtaa

SEQ ID NO: 1132204 - DNA, 22 bp, Artificial Sequence
  chemically synthesized
gatacacaaatacttaccattg

SEQ ID NO: 1132205 - DNA, 22 bp, Artificial Sequence
  chemically synthesized
ggatacacaaatacttaccatt

SEQ ID NO: 1132206 - DNA, 22 bp, Artificial Sequence
  chemically synthesized
gatatgtttggatacacaaata

SEQ ID NO: 1132207 - DNA, 22 bp, Artificial Sequence
  chemically synthesized
cgatatgtttggatacacaaat

SEQ ID NO: 1132208 - DNA, 22 bp, Artificial Sequence
  chemically synthesized
tcgatatgtttggatacacaaa

SEQ ID NO: 1132209 - DNA, 22 bp, Artificial Sequence
  chemically synthesized
tacctttcgatatgtttggata

SEQ ID NO: 1132210 - DNA, 22 bp, Artificial Sequence
  chemically synthesized
ttgtacctttcgatatgtttgg

SEQ ID NO: 1132211 - DNA, 22 bp, Artificial Sequence
  chemically synthesized
attgtacctttcgatatgtttg

SEQ ID NO: 1132212 - DNA, 22 bp, Artificial Sequence
  chemically synthesized
tattgtacctttcgatatgttt

SEQ ID NO: 1132213 - DNA, 22 bp, Artificial Sequence
  chemically synthesized
ttattgtacctttcgatatgtt

SEQ ID NO: 1132214 - DNA, 22 bp, Artificial Sequence
  chemically synthesized
gtgtatccaaacatatcgaaag

SEQ ID NO: 1132215 - DNA, 22 bp, Artificial Sequence
  chemically synthesized
tgtatccaaacatatcgaaagg

SEQ ID NO: 1132216 - DNA, 22 bp, Artificial Sequence
  chemically synthesized
tatcatatttttattgtacctt

SEQ ID NO: 1132217 - DNA, 22 bp, Artificial Sequence
  chemically synthesized
tatatcatatttttattgtacc

SEQ ID NO: 1132218 - DNA, 22 bp, Artificial Sequence
  chemically synthesized
tctatatcatatttttattgta

SEQ ID NO: 1132219 - DNA, 22 bp, Artificial Sequence
  chemically synthesized
tgcccaactctctatatcatat

SEQ ID NO: 1132220 - DNA, 22 bp, Artificial Sequence
  chemically synthesized
atgcccaactctctatatcata

SEQ ID NO: 1132221 - DNA, 22 bp, Artificial Sequence
  chemically synthesized
tatgcccaactctctatatcat

SEQ ID NO: 1132222 - DNA, 22 bp, Artificial Sequence
  chemically synthesized
ttttatgcccaactctctatat

SEQ ID NO: 1132223 - DNA, 22 bp, Artificial Sequence
  chemically synthesized
aagattgttttatgcccaactc

SEQ ID NO: 1132224 - DNA, 22 bp, Artificial Sequence
  chemically synthesized
taaagattgttttatgcccaac

SEQ ID NO: 1132225 - DNA, 22 bp, Artificial Sequence
  chemically synthesized
ctaaagattgttttatgcccaa

SEQ ID NO: 1132226 - DNA, 22 bp, Artificial Sequence
  chemically synthesized
tctaaagattgttttatgccca

SEQ ID NO: 1132227 - DNA, 22 bp, Artificial Sequence
  chemically synthesized
aaaaaattttctaaagattgtt

SEQ ID NO: 1132228 - DNA, 22 bp, Artificial Sequence
  chemically synthesized
aaaaaaattttctaaagattgt

SEQ ID NO: 1132229 - DNA, 22 bp, Artificial Sequence
  chemically synthesized
taaaaaaattttctaaagattg

SEQ ID NO: 1132230 - DNA, 22 bp, Artificial Sequence
  chemically synthesized
ggcataaaacaatctttagaaa

SEQ ID NO: 1132231 - DNA, 22 bp, Artificial Sequence
  chemically synthesized
tgggttttaaaaaaattttcta

SEQ ID NO: 1132232 - DNA, 22 bp, Artificial Sequence
  chemically synthesized
gtgggttttaaaaaaattttct

SEQ ID NO: 1132233 - DNA, 22 bp, Artificial Sequence
  chemically synthesized
tgtgggttttaaaaaaattttc

SEQ ID NO: 1132234 - DNA, 22 bp, Artificial Sequence
  chemically synthesized
gtataattttgtgggttttaaa

SEQ ID NO: 1132235 - DNA, 22 bp, Artificial Sequence
  chemically synthesized
tagaaaatttttttaaaaccca

SEQ ID NO: 1132236 - DNA, 22 bp, Artificial Sequence
  chemically synthesized
agaaaatttttttaaaacccac

SEQ ID NO: 1132237 - DNA, 22 bp, Artificial Sequence
  chemically synthesized
gaaaatttttttaaaacccaca

SEQ ID NO: 1132238 - DNA, 22 bp, Artificial Sequence
  chemically synthesized
ttggtataattttgtgggtttt

SEQ ID NO: 1132239 - DNA, 22 bp, Artificial Sequence
  chemically synthesized
ttttaaaacccacaaaattata

SEQ ID NO: 1132240 - DNA, 22 bp, Artificial Sequence
  chemically synthesized
tttaaaacccacaaaattatac

SEQ ID NO: 1132241 - DNA, 22 bp, Artificial Sequence
  chemically synthesized
ttaaaacccacaaaattatacc

SEQ ID NO: 1132242 - DNA, 22 bp, Artificial Sequence
  chemically synthesized
taaaacccacaaaattatacca

SEQ ID NO: 1132243 - DNA, 22 bp, Artificial Sequence
  chemically synthesized
aaaacccacaaaattataccaa

SEQ ID NO: 1132244 - DNA, 22 bp, Artificial Sequence
  chemically synthesized
aaacccacaaaattataccaac

SEQ ID NO: 1132245 - DNA, 22 bp, Artificial Sequence
  chemically synthesized
tggtccaagagtgttgttggta

SEQ ID NO: 1132246 - DNA, 22 bp, Artificial Sequence
  chemically synthesized
cactgtggtccaagagtgttgt

SEQ ID NO: 1132247 - DNA, 22 bp, Artificial Sequence
  chemically synthesized
ttgcactgtggtccaagagtgt

SEQ ID NO: 1132248 - DNA, 22 bp, Artificial Sequence
  chemically synthesized
attgcactgtggtccaagagtg

SEQ ID NO: 1132249 - DNA, 22 bp, Artificial Sequence
  chemically synthesized
tattgcactgtggtccaagagt

SEQ ID NO: 1132250 - DNA, 22 bp, Artificial Sequence
  chemically synthesized
ttattgcactgtggtccaagag

SEQ ID NO: 1132251 - DNA, 22 bp, Artificial Sequence
  chemically synthesized
taccaacaacactcttggacca

SEQ ID NO: 1132252 - DNA, 22 bp, Artificial Sequence
  chemically synthesized
tttttattgcactgtggtccaa

SEQ ID NO: 1132253 - DNA, 22 bp, Artificial Sequence
  chemically synthesized
tatttttattgcactgtggtcc

SEQ ID NO: 1132254 - DNA, 22 bp, Artificial Sequence
  chemically synthesized
ctatttttattgcactgtggtc

SEQ ID NO: 1132255 - DNA, 22 bp, Artificial Sequence
  chemically synthesized
atttctatttttattgcactgt

SEQ ID NO: 1132256 - DNA, 22 bp, Artificial Sequence
  chemically synthesized
ttggaccacagtgcaataaaaa

SEQ ID NO: 1132257 - DNA, 22 bp, Artificial Sequence
  chemically synthesized
acattgatttctatttttattg

SEQ ID NO: 1132258 - DNA, 22 bp, Artificial Sequence
  chemically synthesized
ggaccacagtgcaataaaaata

SEQ ID NO: 1132259 - DNA, 22 bp, Artificial Sequence
  chemically synthesized
aacattgatttctatttttatt

SEQ ID NO: 1132260 - DNA, 22 bp, Artificial Sequence
  chemically synthesized
gaccacagtgcaataaaaatag

SEQ ID NO: 1132261 - DNA, 22 bp, Artificial Sequence
  chemically synthesized
cttaacattgatttctattttt

SEQ ID NO: 1132262 - DNA, 22 bp, Artificial Sequence
  chemically synthesized
gcttaacattgatttctatttt

SEQ ID NO: 1132263 - DNA, 22 bp, Artificial Sequence
  chemically synthesized
agcaatttgcttaacattgatt

SEQ ID NO: 1132264 - DNA, 22 bp, Artificial Sequence
  chemically synthesized
gagcaatttgcttaacattgat

SEQ ID NO: 1132265 - DNA, 22 bp, Artificial Sequence
  chemically synthesized
tgagcaatttgcttaacattga

SEQ ID NO: 1132266 - DNA, 22 bp, Artificial Sequence
  chemically synthesized
atgtatggttttgagcaatttg

SEQ ID NO: 1132267 - DNA, 22 bp, Artificial Sequence
  chemically synthesized
aatgtatggttttgagcaattt

SEQ ID NO: 1132268 - DNA, 22 bp, Artificial Sequence
  chemically synthesized
taatgtatggttttgagcaatt

SEQ ID NO: 1132269 - DNA, 22 bp, Artificial Sequence
  chemically synthesized
cattttaatgtatggttttgag

SEQ ID NO: 1132270 - DNA, 22 bp, Artificial Sequence
  chemically synthesized
ccattttaatgtatggttttga

SEQ ID NO: 1132271 - DNA, 22 bp, Artificial Sequence
  chemically synthesized
agcaaattgctcaaaaccatac

SEQ ID NO: 1132272 - DNA, 22 bp, Artificial Sequence
  chemically synthesized
atttccattttaatgtatggtt

SEQ ID NO: 1132273 - DNA, 22 bp, Artificial Sequence
  chemically synthesized
gatttccattttaatgtatggt

SEQ ID NO: 1132274 - DNA, 22 bp, Artificial Sequence
  chemically synthesized
tttgatttccattttaatgtat

SEQ ID NO: 1132275 - DNA, 22 bp, Artificial Sequence
  chemically synthesized
gtttgatttccattttaatgta

SEQ ID NO: 1132276 - DNA, 22 bp, Artificial Sequence
  chemically synthesized
ctcaaaaccatacattaaaatg

SEQ ID NO: 1132277 - DNA, 22 bp, Artificial Sequence
  chemically synthesized
aaaaccatacattaaaatggaa

SEQ ID NO: 1132278 - DNA, 22 bp, Artificial Sequence
  chemically synthesized
aggagcagtttgtttgatttcc

SEQ ID NO: 1132279 - DNA, 22 bp, Artificial Sequence
  chemically synthesized
aaatggaaatcaaacaaactgc

SEQ ID NO: 1132280 - DNA, 22 bp, Artificial Sequence
  chemically synthesized
cccagaggtcattcaggagcag

SEQ ID NO: 1132281 - DNA, 22 bp, Artificial Sequence
  chemically synthesized
acccagaggtcattcaggagca

SEQ ID NO: 1132282 - DNA, 22 bp, Artificial Sequence
  chemically synthesized
tttacccagaggtcattcagga

SEQ ID NO: 1132283 - DNA, 22 bp, Artificial Sequence
  chemically synthesized
ttgtttacccagaggtcattca

SEQ ID NO: 1132284 - DNA, 22 bp, Artificial Sequence
  chemically synthesized
attgtttacccagaggtcattc

SEQ ID NO: 1132285 - DNA, 22 bp, Artificial Sequence
  chemically synthesized
tattgtttacccagaggtcatt

SEQ ID NO: 1132286 - DNA, 22 bp, Artificial Sequence
  chemically synthesized
attttattgtttacccagaggt

SEQ ID NO: 1132287 - DNA, 22 bp, Artificial Sequence
  chemically synthesized
aattttattgtttacccagagg

SEQ ID NO: 1132288 - DNA, 22 bp, Artificial Sequence
  chemically synthesized
ctcctgaatgacctctgggtaa

SEQ ID NO: 1132289 - DNA, 22 bp, Artificial Sequence
  chemically synthesized
ctgaatgacctctgggtaaaca

SEQ ID NO: 1132290 - DNA, 22 bp, Artificial Sequence
  chemically synthesized
ccttaattttattgtttaccca

SEQ ID NO: 1132291 - DNA, 22 bp, Artificial Sequence
  chemically synthesized
tgccttaattttattgtttacc

SEQ ID NO: 1132292 - DNA, 22 bp, Artificial Sequence
  chemically synthesized
aatgacctctgggtaaacaata

SEQ ID NO: 1132293 - DNA, 22 bp, Artificial Sequence
  chemically synthesized
ctgccttaattttattgtttac

SEQ ID NO: 1132294 - DNA, 22 bp, Artificial Sequence
  chemically synthesized
atttctgccttaattttattgt

SEQ ID NO: 1132295 - DNA, 22 bp, Artificial Sequence
  chemically synthesized
gatttctgccttaattttattg

SEQ ID NO: 1132296 - DNA, 22 bp, Artificial Sequence
  chemically synthesized
ttgatttctgccttaattttat

SEQ ID NO: 1132297 - DNA, 22 bp, Artificial Sequence
  chemically synthesized
cttgatttctgccttaatttta

SEQ ID NO: 1132298 - DNA, 22 bp, Artificial Sequence
  chemically synthesized
tgggtaaacaataaaattaagg

SEQ ID NO: 1132299 - DNA, 22 bp, Artificial Sequence
  chemically synthesized
ggtaaacaataaaattaaggca

SEQ ID NO: 1132300 - DNA, 22 bp, Artificial Sequence
  chemically synthesized
aaataatttcttgatttctgcc

SEQ ID NO: 1132301 - DNA, 22 bp, Artificial Sequence
  chemically synthesized
caaataatttcttgatttctgc

SEQ ID NO: 1132302 - DNA, 22 bp, Artificial Sequence
  chemically synthesized
gtttcaaataatttcttgattt

SEQ ID NO: 1132303 - DNA, 22 bp, Artificial Sequence
  chemically synthesized
attagtttcaaataatttcttg

SEQ ID NO: 1132304 - DNA, 22 bp, Artificial Sequence
  chemically synthesized
cattagtttcaaataatttctt

SEQ ID NO: 1132305 - DNA, 22 bp, Artificial Sequence
  chemically synthesized
aggcagaaatcaagaaattatt

SEQ ID NO: 1132306 - DNA, 22 bp, Artificial Sequence
  chemically synthesized
tcattagtttcaaataatttct

SEQ ID NO: 1132307 - DNA, 22 bp, Artificial Sequence
  chemically synthesized
aattttcattagtttcaaataa

SEQ ID NO: 1132308 - DNA, 22 bp, Artificial Sequence
  chemically synthesized
aaattttcattagtttcaaata

SEQ ID NO: 1132309 - DNA, 22 bp, Artificial Sequence
  chemically synthesized
taaattttcattagtttcaaat

SEQ ID NO: 1132310 - DNA, 22 bp, Artificial Sequence
  chemically synthesized
ttaaattttcattagtttcaaa

SEQ ID NO: 1132311 - DNA, 22 bp, Artificial Sequence
  chemically synthesized
tttaaattttcattagtttcaa

SEQ ID NO: 1132312 - DNA, 22 bp, Artificial Sequence
  chemically synthesized
catctttttaaattttcattag

SEQ ID NO: 1132313 - DNA, 22 bp, Artificial Sequence
  chemically synthesized
tttgaaactaatgaaaatttaa

SEQ ID NO: 1132314 - DNA, 22 bp, Artificial Sequence
  chemically synthesized
gaaactaatgaaaatttaaaaa

SEQ ID NO: 1132315 - DNA, 22 bp, Artificial Sequence
  chemically synthesized
gtatgttacatctttttaaatt

SEQ ID NO: 1132316 - DNA, 22 bp, Artificial Sequence
  chemically synthesized
aaactaatgaaaatttaaaaag

SEQ ID NO: 1132317 - DNA, 22 bp, Artificial Sequence
  chemically synthesized
tggtatgttacatctttttaaa

SEQ ID NO: 1132318 - DNA, 22 bp, Artificial Sequence
  chemically synthesized
atgaaaatttaaaaagatgtaa

SEQ ID NO: 1132319 - DNA, 22 bp, Artificial Sequence
  chemically synthesized
aaaaagatgtaacataccagaa

SEQ ID NO: 1132320 - DNA, 22 bp, Artificial Sequence
  chemically synthesized
aaaagatgtaacataccagaat

SEQ ID NO: 1132321 - DNA, 22 bp, Artificial Sequence
  chemically synthesized
tgtgtgtcccagagattctggt

SEQ ID NO: 1132322 - DNA, 22 bp, Artificial Sequence
  chemically synthesized
gtgtgtgtcccagagattctgg

SEQ ID NO: 1132323 - DNA, 22 bp, Artificial Sequence
  chemically synthesized
tgtgtgtgtcccagagattctg

SEQ ID NO: 1132324 - DNA, 22 bp, Artificial Sequence
  chemically synthesized
ctttgtgtgtgtcccagagatt

SEQ ID NO: 1132325 - DNA, 22 bp, Artificial Sequence
  chemically synthesized
acgctgctttgtgtgtgtccca

SEQ ID NO: 1132326 - DNA, 22 bp, Artificial Sequence
  chemically synthesized
aacgctgctttgtgtgtgtccc

SEQ ID NO: 1132327 - DNA, 22 bp, Artificial Sequence
  chemically synthesized
ttaacgctgctttgtgtgtgtc

SEQ ID NO: 1132328 - DNA, 22 bp, Artificial Sequence
  chemically synthesized
cctcttaacgctgctttgtgtg

SEQ ID NO: 1132329 - DNA, 22 bp, Artificial Sequence
  chemically synthesized
gcctcttaacgctgctttgtgt

SEQ ID NO: 1132330 - DNA, 22 bp, Artificial Sequence
  chemically synthesized
tgggacacacacaaagcagcgt

SEQ ID NO: 1132331 - DNA, 22 bp, Artificial Sequence
  chemically synthesized
ggacacacacaaagcagcgtta

SEQ ID NO: 1132332 - DNA, 22 bp, Artificial Sequence
  chemically synthesized
gtgccataagcttgcctcttaa

SEQ ID NO: 1132333 - DNA, 22 bp, Artificial Sequence
  chemically synthesized
cgtgccataagcttgcctctta

SEQ ID NO: 1132334 - DNA, 22 bp, Artificial Sequence
  chemically synthesized
atatgggtgtttcgtgccataa

SEQ ID NO: 1132335 - DNA, 22 bp, Artificial Sequence
  chemically synthesized
gatatgggtgtttcgtgccata

SEQ ID NO: 1132336 - DNA, 22 bp, Artificial Sequence
  chemically synthesized
agaggcaagcttatggcacgaa

SEQ ID NO: 1132337 - DNA, 22 bp, Artificial Sequence
  chemically synthesized
tgatatgggtgtttcgtgccat

SEQ ID NO: 1132338 - DNA, 22 bp, Artificial Sequence
  chemically synthesized
ttgatatgggtgtttcgtgcca

SEQ ID NO: 1132339 - DNA, 22 bp, Artificial Sequence
  chemically synthesized
tttgatatgggtgtttcgtgcc

SEQ ID NO: 1132340 - DNA, 22 bp, Artificial Sequence
  chemically synthesized
actttttgatatgggtgtttcg

SEQ ID NO: 1132341 - DNA, 22 bp, Artificial Sequence
  chemically synthesized
taactttttgatatgggtgttt

SEQ ID NO: 1132342 - DNA, 22 bp, Artificial Sequence
  chemically synthesized
ctaactttttgatatgggtgtt

SEQ ID NO: 1132343 - DNA, 22 bp, Artificial Sequence
  chemically synthesized
atggcacgaaacacccatatca

SEQ ID NO: 1132344 - DNA, 22 bp, Artificial Sequence
  chemically synthesized
tggcacgaaacacccatatcaa

SEQ ID NO: 1132345 - DNA, 22 bp, Artificial Sequence
  chemically synthesized
gagatccttctaactttttgat

SEQ ID NO: 1132346 - DNA, 22 bp, Artificial Sequence
  chemically synthesized
taattagagatccttctaactt

SEQ ID NO: 1132347 - DNA, 22 bp, Artificial Sequence
  chemically synthesized
gtaattagagatccttctaact

SEQ ID NO: 1132348 - DNA, 22 bp, Artificial Sequence
  chemically synthesized
tgtaattagagatccttctaac

SEQ ID NO: 1132349 - DNA, 22 bp, Artificial Sequence
  chemically synthesized
gttttgtaattagagatccttc

SEQ ID NO: 1132350 - DNA, 22 bp, Artificial Sequence
  chemically synthesized
tgatgttcgttttgtaattaga

SEQ ID NO: 1132351 - DNA, 22 bp, Artificial Sequence
  chemically synthesized
gtgatgttcgttttgtaattag

SEQ ID NO: 1132352 - DNA, 22 bp, Artificial Sequence
  chemically synthesized
gaaggatctctaattacaaaac

SEQ ID NO: 1132353 - DNA, 22 bp, Artificial Sequence
  chemically synthesized
cttgtgatgttcgttttgtaat

SEQ ID NO: 1132354 - DNA, 22 bp, Artificial Sequence
  chemically synthesized
gttccttgtgatgttcgttttg

SEQ ID NO: 1132355 - DNA, 22 bp, Artificial Sequence
  chemically synthesized
tcgttccttgtgatgttcgttt

SEQ ID NO: 1132356 - DNA, 22 bp, Artificial Sequence
  chemically synthesized
ctcgttccttgtgatgttcgtt

SEQ ID NO: 1132357 - DNA, 22 bp, Artificial Sequence
  chemically synthesized
taattacaaaacgaacatcaca

SEQ ID NO: 1132358 - DNA, 22 bp, Artificial Sequence
  chemically synthesized
tttctcgttccttgtgatgttc

SEQ ID NO: 1132359 - DNA, 22 bp, Artificial Sequence
  chemically synthesized
attacaaaacgaacatcacaag

SEQ ID NO: 1132360 - DNA, 22 bp, Artificial Sequence
  chemically synthesized
ttgtttctcgttccttgtgatg

SEQ ID NO: 1132361 - DNA, 22 bp, Artificial Sequence
  chemically synthesized
caaaacgaacatcacaaggaac

SEQ ID NO: 1132362 - DNA, 22 bp, Artificial Sequence
  chemically synthesized
ctattgtttctcgttccttgtg

SEQ ID NO: 1132363 - DNA, 22 bp, Artificial Sequence
  chemically synthesized
gctattgtttctcgttccttgt

SEQ ID NO: 1132364 - DNA, 22 bp, Artificial Sequence
  chemically synthesized
gtttgctattgtttctcgttcc

SEQ ID NO: 1132365 - DNA, 22 bp, Artificial Sequence
  chemically synthesized
gggttagtttgctattgtttct

SEQ ID NO: 1132366 - DNA, 22 bp, Artificial Sequence
  chemically synthesized
ggggttagtttgctattgtttc

SEQ ID NO: 1132367 - DNA, 22 bp, Artificial Sequence
  chemically synthesized
tggggttagtttgctattgttt

SEQ ID NO: 1132368 - DNA, 22 bp, Artificial Sequence
  chemically synthesized
gctttggggttagtttgctatt

SEQ ID NO: 1132369 - DNA, 22 bp, Artificial Sequence
  chemically synthesized
tagctttggggttagtttgcta

SEQ ID NO: 1132370 - DNA, 22 bp, Artificial Sequence
  chemically synthesized
ctagctttggggttagtttgct

SEQ ID NO: 1132371 - DNA, 22 bp, Artificial Sequence
  chemically synthesized
tcttctagctttggggttagtt

SEQ ID NO: 1132372 - DNA, 22 bp, Artificial Sequence
  chemically synthesized
ctgtcttctagctttggggtta

SEQ ID NO: 1132373 - DNA, 22 bp, Artificial Sequence
  chemically synthesized
cctgtcttctagctttggggtt

SEQ ID NO: 1132374 - DNA, 22 bp, Artificial Sequence
  chemically synthesized
tttcctgtcttctagctttggg

SEQ ID NO: 1132375 - DNA, 22 bp, Artificial Sequence
  chemically synthesized
gttatttcctgtcttctagctt

SEQ ID NO: 1132376 - DNA, 22 bp, Artificial Sequence
  chemically synthesized
ggttatttcctgtcttctagct

SEQ ID NO: 1132377 - DNA, 22 bp, Artificial Sequence
  chemically synthesized
tggttatttcctgtcttctagc

SEQ ID NO: 1132378 - DNA, 22 bp, Artificial Sequence
  chemically synthesized
accccaaagctagaagacagga

SEQ ID NO: 1132379 - DNA, 22 bp, Artificial Sequence
  chemically synthesized
cgattttggttatttcctgtct

SEQ ID NO: 1132380 - DNA, 22 bp, Artificial Sequence
  chemically synthesized
agctccgattttggttatttcc

SEQ ID NO: 1132381 - DNA, 22 bp, Artificial Sequence
  chemically synthesized
gaagacaggaaataaccaaaat

SEQ ID NO: 1132382 - DNA, 22 bp, Artificial Sequence
  chemically synthesized
agttcagctccgattttggtta

SEQ ID NO: 1132383 - DNA, 22 bp, Artificial Sequence
  chemically synthesized
cagttcagctccgattttggtt

SEQ ID NO: 1132384 - DNA, 22 bp, Artificial Sequence
  chemically synthesized
cttcagttcagctccgattttg

SEQ ID NO: 1132385 - DNA, 22 bp, Artificial Sequence
  chemically synthesized
ccttcagttcagctccgatttt

SEQ ID NO: 1132386 - DNA, 22 bp, Artificial Sequence
  chemically synthesized
tccttcagttcagctccgattt

SEQ ID NO: 1132387 - DNA, 22 bp, Artificial Sequence
  chemically synthesized
attttccttcagttcagctccg

SEQ ID NO: 1132388 - DNA, 22 bp, Artificial Sequence
  chemically synthesized
catctcattttccttcagttca

SEQ ID NO: 1132389 - DNA, 22 bp, Artificial Sequence
  chemically synthesized
gcatctcattttccttcagttc

SEQ ID NO: 1132390 - DNA, 22 bp, Artificial Sequence
  chemically synthesized
tgcatctcattttccttcagtt

SEQ ID NO: 1132391 - DNA, 22 bp, Artificial Sequence
  chemically synthesized
ttgcatctcattttccttcagt

SEQ ID NO: 1132392 - DNA, 22 bp, Artificial Sequence
  chemically synthesized
tttgcatctcattttccttcag

SEQ ID NO: 1132393 - DNA, 22 bp, Artificial Sequence
  chemically synthesized
ttttgcatctcattttccttca

SEQ ID NO: 1132394 - DNA, 22 bp, Artificial Sequence
  chemically synthesized
tgcttttttgcatctcattttc

SEQ ID NO: 1132395 - DNA, 22 bp, Artificial Sequence
  chemically synthesized
tgtgcttttttgcatctcattt

SEQ ID NO: 1132396 - DNA, 22 bp, Artificial Sequence
  chemically synthesized
ctgtgcttttttgcatctcatt

SEQ ID NO: 1132397 - DNA, 22 bp, Artificial Sequence
  chemically synthesized
aactgaaggaaaatgagatgca

SEQ ID NO: 1132398 - DNA, 22 bp, Artificial Sequence
  chemically synthesized
tctgtgcttttttgcatctcat

SEQ ID NO: 1132399 - DNA, 22 bp, Artificial Sequence
  chemically synthesized
ttctgtgcttttttgcatctca

SEQ ID NO: 1132400 - DNA, 22 bp, Artificial Sequence
  chemically synthesized
aaggaaaatgagatgcaaaaaa

SEQ ID NO: 1132401 - DNA, 22 bp, Artificial Sequence
  chemically synthesized
accttttctgtgcttttttgca

SEQ ID NO: 1132402 - DNA, 22 bp, Artificial Sequence
  chemically synthesized
attgaccttttctgtgcttttt

SEQ ID NO: 1132403 - DNA, 22 bp, Artificial Sequence
  chemically synthesized
gattcattgaccttttctgtgc

SEQ ID NO: 1132404 - DNA, 22 bp, Artificial Sequence
  chemically synthesized
ctagattcattgaccttttctg

SEQ ID NO: 1132405 - DNA, 22 bp, Artificial Sequence
  chemically synthesized
aaagaaacagctcctagattca

SEQ ID NO: 1132406 - DNA, 22 bp, Artificial Sequence
  chemically synthesized
caaagaaacagctcctagattc

SEQ ID NO: 1132407 - DNA, 22 bp, Artificial Sequence
  chemically synthesized
tttcaaagaaacagctcctaga

SEQ ID NO: 1132408 - DNA, 22 bp, Artificial Sequence
  chemically synthesized
attatttcaaagaaacagctcc

SEQ ID NO: 1132409 - DNA, 22 bp, Artificial Sequence
  chemically synthesized
ttaattatttcaaagaaacagc

SEQ ID NO: 1132410 - DNA, 22 bp, Artificial Sequence
  chemically synthesized
ttattaattatttcaaagaaac

SEQ ID NO: 1132411 - DNA, 22 bp, Artificial Sequence
  chemically synthesized
attattaattatttcaaagaaa

SEQ ID NO: 1132412 - DNA, 22 bp, Artificial Sequence
  chemically synthesized
tattattaattatttcaaagaa

SEQ ID NO: 1132413 - DNA, 22 bp, Artificial Sequence
  chemically synthesized
ggagctgtttctttgaaataat

SEQ ID NO: 1132414 - DNA, 22 bp, Artificial Sequence
  chemically synthesized
tctttattattaattatttcaa

SEQ ID NO: 1132415 - DNA, 22 bp, Artificial Sequence
  chemically synthesized
tttctttgaaataattaataat

SEQ ID NO: 1132416 - DNA, 22 bp, Artificial Sequence
  chemically synthesized
ctttgaaataattaataataaa

SEQ ID NO: 1132417 - DNA, 22 bp, Artificial Sequence
  chemically synthesized
tttgaaataattaataataaag

SEQ ID NO: 1132418 - DNA, 22 bp, Artificial Sequence
  chemically synthesized
ggtagtggtctatctttattat

SEQ ID NO: 1132419 - DNA, 22 bp, Artificial Sequence
  chemically synthesized
tgaaataattaataataaagat

SEQ ID NO: 1132420 - DNA, 22 bp, Artificial Sequence
  chemically synthesized
gaaataattaataataaagata

SEQ ID NO: 1132421 - DNA, 22 bp, Artificial Sequence
  chemically synthesized
taggtagtggtctatctttatt

SEQ ID NO: 1132422 - DNA, 22 bp, Artificial Sequence
  chemically synthesized
aaataattaataataaagatag

SEQ ID NO: 1132423 - DNA, 22 bp, Artificial Sequence
  chemically synthesized
ttctaggtagtggtctatcttt

SEQ ID NO: 1132424 - DNA, 22 bp, Artificial Sequence
  chemically synthesized
ttattctaggtagtggtctatc

SEQ ID NO: 1132425 - DNA, 22 bp, Artificial Sequence
  chemically synthesized
attattctaggtagtggtctat

SEQ ID NO: 1132426 - DNA, 22 bp, Artificial Sequence
  chemically synthesized
tattattctaggtagtggtcta

SEQ ID NO: 1132427 - DNA, 22 bp, Artificial Sequence
  chemically synthesized
ataataaagatagaccactacc

SEQ ID NO: 1132428 - DNA, 22 bp, Artificial Sequence
  chemically synthesized
tttattattctaggtagtggtc

SEQ ID NO: 1132429 - DNA, 22 bp, Artificial Sequence
  chemically synthesized
ctttattattctaggtagtggt

SEQ ID NO: 1132430 - DNA, 22 bp, Artificial Sequence
  chemically synthesized
tctttattattctaggtagtgg

SEQ ID NO: 1132431 - DNA, 22 bp, Artificial Sequence
  chemically synthesized
ttctttattattctaggtagtg

SEQ ID NO: 1132432 - DNA, 22 bp, Artificial Sequence
  chemically synthesized
tttctttattattctaggtagt

SEQ ID NO: 1132433 - DNA, 22 bp, Artificial Sequence
  chemically synthesized
ttttctttattattctaggtag

SEQ ID NO: 1132434 - DNA, 22 bp, Artificial Sequence
  chemically synthesized
tttttctttattattctaggta

SEQ ID NO: 1132435 - DNA, 22 bp, Artificial Sequence
  chemically synthesized
tttttttctttattattctagg

SEQ ID NO: 1132436 - DNA, 22 bp, Artificial Sequence
  chemically synthesized
tctttttttctttattattcta

SEQ ID NO: 1132437 - DNA, 22 bp, Artificial Sequence
  chemically synthesized
tctctttttttctttattattc

SEQ ID NO: 1132438 - DNA, 22 bp, Artificial Sequence
  chemically synthesized
ctctctttttttctttattatt

SEQ ID NO: 1132439 - DNA, 22 bp, Artificial Sequence
  chemically synthesized
agtcttctctctttttttcttt

SEQ ID NO: 1132440 - DNA, 22 bp, Artificial Sequence
  chemically synthesized
cctagaataataaagaaaaaaa

SEQ ID NO: 1132441 - DNA, 22 bp, Artificial Sequence
  chemically synthesized
gagtcttctctctttttttctt

SEQ ID NO: 1132442 - DNA, 22 bp, Artificial Sequence
  chemically synthesized
tttgagtcttctctcttttttt

SEQ ID NO: 1132443 - DNA, 22 bp, Artificial Sequence
  chemically synthesized
gaataataaagaaaaaaagaga

SEQ ID NO: 1132444 - DNA, 22 bp, Artificial Sequence
  chemically synthesized
atttgagtcttctctctttttt

SEQ ID NO: 1132445 - DNA, 22 bp, Artificial Sequence
  chemically synthesized
tgtttatttgagtcttctctct

SEQ ID NO: 1132446 - DNA, 22 bp, Artificial Sequence
  chemically synthesized
ttgtgtttatttgagtcttctc

SEQ ID NO: 1132447 - DNA, 22 bp, Artificial Sequence
  chemically synthesized
attgtgtttatttgagtcttct

SEQ ID NO: 1132448 - DNA, 22 bp, Artificial Sequence
  chemically synthesized
tattgtgtttatttgagtcttc

SEQ ID NO: 1132449 - DNA, 22 bp, Artificial Sequence
  chemically synthesized
ttattgtgtttatttgagtctt

SEQ ID NO: 1132450 - DNA, 22 bp, Artificial Sequence
  chemically synthesized
tttattgtgtttatttgagtct

SEQ ID NO: 1132451 - DNA, 22 bp, Artificial Sequence
  chemically synthesized
tcattttttattgtgtttattt

SEQ ID NO: 1132452 - DNA, 22 bp, Artificial Sequence
  chemically synthesized
gtcattttttattgtgtttatt

SEQ ID NO: 1132453 - DNA, 22 bp, Artificial Sequence
  chemically synthesized
tgtcattttttattgtgtttat

SEQ ID NO: 1132454 - DNA, 22 bp, Artificial Sequence
  chemically synthesized
aaataaacacaataaaaaatga

SEQ ID NO: 1132455 - DNA, 22 bp, Artificial Sequence
  chemically synthesized
tggggtcaatggtaacatcccc

SEQ ID NO: 1132456 - DNA, 22 bp, Artificial Sequence
  chemically synthesized
tgtggggtcaatggtaacatcc

SEQ ID NO: 1132457 - DNA, 22 bp, Artificial Sequence
  chemically synthesized
ctgtggggtcaatggtaacatc

SEQ ID NO: 1132458 - DNA, 22 bp, Artificial Sequence
  chemically synthesized
tttctgtggggtcaatggtaac

SEQ ID NO: 1132459 - DNA, 22 bp, Artificial Sequence
  chemically synthesized
tatttctgtggggtcaatggta

SEQ ID NO: 1132460 - DNA, 22 bp, Artificial Sequence
  chemically synthesized
tctatttctgtggggtcaatgg

SEQ ID NO: 1132461 - DNA, 22 bp, Artificial Sequence
  chemically synthesized
ctctatttctgtggggtcaatg

SEQ ID NO: 1132462 - DNA, 22 bp, Artificial Sequence
  chemically synthesized
tctctatttctgtggggtcaat

SEQ ID NO: 1132463 - DNA, 22 bp, Artificial Sequence
  chemically synthesized
agggttttctctatttctgtgg

SEQ ID NO: 1132464 - DNA, 22 bp, Artificial Sequence
  chemically synthesized
taagggttttctctatttctgt

SEQ ID NO: 1132465 - DNA, 22 bp, Artificial Sequence
  chemically synthesized
ccattgaccccacagaaataga

SEQ ID NO: 1132466 - DNA, 22 bp, Artificial Sequence
  chemically synthesized
accccacagaaatagagaaaac

SEQ ID NO: 1132467 - DNA, 22 bp, Artificial Sequence
  chemically synthesized
tgaatagtctctaagggttttc

SEQ ID NO: 1132468 - DNA, 22 bp, Artificial Sequence
  chemically synthesized
attatgaatagtctctaagggt

SEQ ID NO: 1132469 - DNA, 22 bp, Artificial Sequence
  chemically synthesized
tgtgcataggggtgttcattat

SEQ ID NO: 1132470 - DNA, 22 bp, Artificial Sequence
  chemically synthesized
agagactattcataatgaacac

SEQ ID NO: 1132471 - DNA, 22 bp, Artificial Sequence
  chemically synthesized
gtgtgcataggggtgttcatta

SEQ ID NO: 1132472 - DNA, 22 bp, Artificial Sequence
  chemically synthesized
gagactattcataatgaacacc

SEQ ID NO: 1132473 - DNA, 22 bp, Artificial Sequence
  chemically synthesized
gcttgtgtgcataggggtgttc

SEQ ID NO: 1132474 - DNA, 22 bp, Artificial Sequence
  chemically synthesized
tagcttgtgtgcataggggtgt

SEQ ID NO: 1132475 - DNA, 22 bp, Artificial Sequence
  chemically synthesized
ctagcttgtgtgcataggggtg

SEQ ID NO: 1132476 - DNA, 22 bp, Artificial Sequence
  chemically synthesized
ttcataatgaacacccctatgc

SEQ ID NO: 1132477 - DNA, 22 bp, Artificial Sequence
  chemically synthesized
tctagcttgtgtgcataggggt

SEQ ID NO: 1132478 - DNA, 22 bp, Artificial Sequence
  chemically synthesized
ataatgaacacccctatgcaca

SEQ ID NO: 1132479 - DNA, 22 bp, Artificial Sequence
  chemically synthesized
ggttttctagcttgtgtgcata

SEQ ID NO: 1132480 - DNA, 22 bp, Artificial Sequence
  chemically synthesized
taggttttctagcttgtgtgca

SEQ ID NO: 1132481 - DNA, 22 bp, Artificial Sequence
  chemically synthesized
ctaggttttctagcttgtgtgc

SEQ ID NO: 1132482 - DNA, 22 bp, Artificial Sequence
  chemically synthesized
cttctaggttttctagcttgtg

SEQ ID NO: 1132483 - DNA, 22 bp, Artificial Sequence
  chemically synthesized
tccattgcttctaggttttcta

SEQ ID NO: 1132484 - DNA, 22 bp, Artificial Sequence
  chemically synthesized
tgcacacaagctagaaaaccta

SEQ ID NO: 1132485 - DNA, 22 bp, Artificial Sequence
  chemically synthesized
atccattgcttctaggttttct

SEQ ID NO: 1132486 - DNA, 22 bp, Artificial Sequence
  chemically synthesized
gcaatttatccattgcttctag

SEQ ID NO: 1132487 - DNA, 22 bp, Artificial Sequence
  chemically synthesized
tagcaatttatccattgcttct

SEQ ID NO: 1132488 - DNA, 22 bp, Artificial Sequence
  chemically synthesized
ctagcaatttatccattgcttc

SEQ ID NO: 1132489 - DNA, 22 bp, Artificial Sequence
  chemically synthesized
gaaaacctagaagcaatggata

SEQ ID NO: 1132490 - DNA, 22 bp, Artificial Sequence
  chemically synthesized
taagtttctagcaatttatcca

SEQ ID NO: 1132491 - DNA, 22 bp, Artificial Sequence
  chemically synthesized
gaagcaatggataaattgctag

SEQ ID NO: 1132492 - DNA, 22 bp, Artificial Sequence
  chemically synthesized
gaaagttgtaagtttctagcaa

SEQ ID NO: 1132493 - DNA, 22 bp, Artificial Sequence
  chemically synthesized
ggaaagttgtaagtttctagca

SEQ ID NO: 1132494 - DNA, 22 bp, Artificial Sequence
  chemically synthesized
aaacttggaaagttgtaagttt

SEQ ID NO: 1132495 - DNA, 22 bp, Artificial Sequence
  chemically synthesized
gttcaaacttggaaagttgtaa

SEQ ID NO: 1132496 - DNA, 22 bp, Artificial Sequence
  chemically synthesized
ctggttcaaacttggaaagttg

SEQ ID NO: 1132497 - DNA, 22 bp, Artificial Sequence
  chemically synthesized
ctagaaacttacaactttccaa

SEQ ID NO: 1132498 - DNA, 22 bp, Artificial Sequence
  chemically synthesized
cctggttcaaacttggaaagtt

SEQ ID NO: 1132499 - DNA, 22 bp, Artificial Sequence
  chemically synthesized
ttcctggttcaaacttggaaag

SEQ ID NO: 1132500 - DNA, 22 bp, Artificial Sequence
  chemically synthesized
gaaacttacaactttccaagtt

SEQ ID NO: 1132501 - DNA, 22 bp, Artificial Sequence
  chemically synthesized
cttcctggttcaaacttggaaa

SEQ ID NO: 1132502 - DNA, 22 bp, Artificial Sequence
  chemically synthesized
catttcttcctggttcaaactt

SEQ ID NO: 1132503 - DNA, 22 bp, Artificial Sequence
  chemically synthesized
acaactttccaagtttgaacca

SEQ ID NO: 1132504 - DNA, 22 bp, Artificial Sequence
  chemically synthesized
caactttccaagtttgaaccag

SEQ ID NO: 1132505 - DNA, 22 bp, Artificial Sequence
  chemically synthesized
aatgattccatttcttcctggt

SEQ ID NO: 1132506 - DNA, 22 bp, Artificial Sequence
  chemically synthesized
tccaagtttgaaccaggaagaa

SEQ ID NO: 1132507 - DNA, 22 bp, Artificial Sequence
  chemically synthesized
ccaagtttgaaccaggaagaaa

SEQ ID NO: 1132508 - DNA, 22 bp, Artificial Sequence
  chemically synthesized
caagtttgaaccaggaagaaat

SEQ ID NO: 1132509 - DNA, 22 bp, Artificial Sequence
  chemically synthesized
ttcaatgattccatttcttcct

SEQ ID NO: 1132510 - DNA, 22 bp, Artificial Sequence
  chemically synthesized
gtctgttcaatgattccatttc

SEQ ID NO: 1132511 - DNA, 22 bp, Artificial Sequence
  chemically synthesized
gaaccaggaagaaatggaatca

SEQ ID NO: 1132512 - DNA, 22 bp, Artificial Sequence
  chemically synthesized
aaccaggaagaaatggaatcat

SEQ ID NO: 1132513 - DNA, 22 bp, Artificial Sequence
  chemically synthesized
ttggtctgttcaatgattccat

SEQ ID NO: 1132514 - DNA, 22 bp, Artificial Sequence
  chemically synthesized
attattggtctgttcaatgatt

SEQ ID NO: 1132515 - DNA, 22 bp, Artificial Sequence
  chemically synthesized
ggaactcattattggtctgttc

SEQ ID NO: 1132516 - DNA, 22 bp, Artificial Sequence
  chemically synthesized
cggaactcattattggtctgtt

SEQ ID NO: 1132517 - DNA, 22 bp, Artificial Sequence
  chemically synthesized
atttcggaactcattattggtc

SEQ ID NO: 1132518 - DNA, 22 bp, Artificial Sequence
  chemically synthesized
aatttcggaactcattattggt

SEQ ID NO: 1132519 - DNA, 22 bp, Artificial Sequence
  chemically synthesized
atttaatttcggaactcattat

SEQ ID NO: 1132520 - DNA, 22 bp, Artificial Sequence
  chemically synthesized
aacagaccaataatgagttccg

SEQ ID NO: 1132521 - DNA, 22 bp, Artificial Sequence
  chemically synthesized
ctaatttaatttcggaactcat

SEQ ID NO: 1132522 - DNA, 22 bp, Artificial Sequence
  chemically synthesized
ttcctaatttaatttcggaact

SEQ ID NO: 1132523 - DNA, 22 bp, Artificial Sequence
  chemically synthesized
gttcctaatttaatttcggaac

SEQ ID NO: 1132524 - DNA, 22 bp, Artificial Sequence
  chemically synthesized
tgttcctaatttaatttcggaa

SEQ ID NO: 1132525 - DNA, 22 bp, Artificial Sequence
  chemically synthesized
ttgttcctaatttaatttcgga

SEQ ID NO: 1132526 - DNA, 22 bp, Artificial Sequence
  chemically synthesized
tttgttcctaatttaatttcgg

SEQ ID NO: 1132527 - DNA, 22 bp, Artificial Sequence
  chemically synthesized
gtgggctttttgttcctaattt

SEQ ID NO: 1132528 - DNA, 22 bp, Artificial Sequence
  chemically synthesized
gttggtgggctttttgttccta

SEQ ID NO: 1132529 - DNA, 22 bp, Artificial Sequence
  chemically synthesized
cgaaattaaattaggaacaaaa

SEQ ID NO: 1132530 - DNA, 22 bp, Artificial Sequence
  chemically synthesized
tggttggtgggctttttgttcc

SEQ ID NO: 1132531 - DNA, 22 bp, Artificial Sequence
  chemically synthesized
ctggttggtgggctttttgttc

SEQ ID NO: 1132532 - DNA, 22 bp, Artificial Sequence
  chemically synthesized
tctggttggtgggctttttgtt

SEQ ID NO: 1132533 - DNA, 22 bp, Artificial Sequence
  chemically synthesized
ttctggttggtgggctttttgt

SEQ ID NO: 1132534 - DNA, 22 bp, Artificial Sequence
  chemically synthesized
tttctggttggtgggctttttg

SEQ ID NO: 1132535 - DNA, 22 bp, Artificial Sequence
  chemically synthesized
aattaggaacaaaaagcccacc

SEQ ID NO: 1132536 - DNA, 22 bp, Artificial Sequence
  chemically synthesized
ggctttttctggttggtgggct

SEQ ID NO: 1132537 - DNA, 22 bp, Artificial Sequence
  chemically synthesized
ggaacaaaaagcccaccaacca

SEQ ID NO: 1132538 - DNA, 22 bp, Artificial Sequence
  chemically synthesized
gtcctgggctttttctggttgg

SEQ ID NO: 1132539 - DNA, 22 bp, Artificial Sequence
  chemically synthesized
tctggtcctgggctttttctgg

SEQ ID NO: 1132540 - DNA, 22 bp, Artificial Sequence
  chemically synthesized
aggtgtgaatctgtctggtcct

SEQ ID NO: 1132541 - DNA, 22 bp, Artificial Sequence
  chemically synthesized
gtattcaggtgtgaatctgtct

SEQ ID NO: 1132542 - DNA, 22 bp, Artificial Sequence
  chemically synthesized
ttagtattcaggtgtgaatctg

SEQ ID NO: 1132543 - DNA, 22 bp, Artificial Sequence
  chemically synthesized
tatctgttagtattcaggtgtg

SEQ ID NO: 1132544 - DNA, 22 bp, Artificial Sequence
  chemically synthesized
tatatctgttagtattcaggtg

SEQ ID NO: 1132545 - DNA, 22 bp, Artificial Sequence
  chemically synthesized
ctatatctgttagtattcaggt

SEQ ID NO: 1132546 - DNA, 22 bp, Artificial Sequence
  chemically synthesized
cttctatatctgttagtattca

SEQ ID NO: 1132547 - DNA, 22 bp, Artificial Sequence
  chemically synthesized
ccttctatatctgttagtattc

SEQ ID NO: 1132548 - DNA, 22 bp, Artificial Sequence
  chemically synthesized
tccttctatatctgttagtatt

SEQ ID NO: 1132549 - DNA, 22 bp, Artificial Sequence
  chemically synthesized
ttccttctatatctgttagtat

SEQ ID NO: 1132550 - DNA, 22 bp, Artificial Sequence
  chemically synthesized
acacctgaatactaacagatat

SEQ ID NO: 1132551 - DNA, 22 bp, Artificial Sequence
  chemically synthesized
aatactaacagatatagaagga

SEQ ID NO: 1132552 - DNA, 22 bp, Artificial Sequence
  chemically synthesized
acagatatagaaggaaaagctg

SEQ ID NO: 1132553 - DNA, 22 bp, Artificial Sequence
  chemically synthesized
ataggaatgataccagcttttc

SEQ ID NO: 1132554 - DNA, 22 bp, Artificial Sequence
  chemically synthesized
cataggaatgataccagctttt

SEQ ID NO: 1132555 - DNA, 22 bp, Artificial Sequence
  chemically synthesized
ggagtggtttcataggaatgat

SEQ ID NO: 1132556 - DNA, 22 bp, Artificial Sequence
  chemically synthesized
gggagtggtttcataggaatga

SEQ ID NO: 1132557 - DNA, 22 bp, Artificial Sequence
  chemically synthesized
tgggagtggtttcataggaatg

SEQ ID NO: 1132558 - DNA, 22 bp, Artificial Sequence
  chemically synthesized
ttgggagtggtttcataggaat

SEQ ID NO: 1132559 - DNA, 22 bp, Artificial Sequence
  chemically synthesized
aatttttgggagtggtttcata

SEQ ID NO: 1132560 - DNA, 22 bp, Artificial Sequence
  chemically synthesized
gtatcattcctatgaaaccact

SEQ ID NO: 1132561 - DNA, 22 bp, Artificial Sequence
  chemically synthesized
ctcaatttttgggagtggtttc

SEQ ID NO: 1132562 - DNA, 22 bp, Artificial Sequence
  chemically synthesized
ctatgaaaccactcccaaaaat

SEQ ID NO: 1132563 - DNA, 22 bp, Artificial Sequence
  chemically synthesized
tgaaaccactcccaaaaattga

SEQ ID NO: 1132564 - DNA, 22 bp, Artificial Sequence
  chemically synthesized
ggaaggagccgctcctcaattt

SEQ ID NO: 1132565 - DNA, 22 bp, Artificial Sequence
  chemically synthesized
ccaaaaattgaggagcggctcc

SEQ ID NO: 1132566 - DNA, 22 bp, Artificial Sequence
  chemically synthesized
atagaatgagttaggaaggagc

SEQ ID NO: 1132567 - DNA, 22 bp, Artificial Sequence
  chemically synthesized
cctcatagaatgagttaggaag

SEQ ID NO: 1132568 - DNA, 22 bp, Artificial Sequence
  chemically synthesized
aggagcggctccttcctaactc

SEQ ID NO: 1132569 - DNA, 22 bp, Artificial Sequence
  chemically synthesized
ccctcatagaatgagttaggaa

SEQ ID NO: 1132570 - DNA, 22 bp, Artificial Sequence
  chemically synthesized
cttcctaactcattctatgagg

SEQ ID NO: 1132571 - DNA, 22 bp, Artificial Sequence
  chemically synthesized
cctaactcattctatgagggaa

SEQ ID NO: 1132572 - DNA, 22 bp, Artificial Sequence
  chemically synthesized
ctaactcattctatgagggaag

SEQ ID NO: 1132573 - DNA, 22 bp, Artificial Sequence
  chemically synthesized
gtatcaggacaatgcttccctc

SEQ ID NO: 1132574 - DNA, 22 bp, Artificial Sequence
  chemically synthesized
actcattctatgagggaagcat

SEQ ID NO: 1132575 - DNA, 22 bp, Artificial Sequence
  chemically synthesized
ggtatcaggacaatgcttccct

SEQ ID NO: 1132576 - DNA, 22 bp, Artificial Sequence
  chemically synthesized
tggtatcaggacaatgcttccc

SEQ ID NO: 1132577 - DNA, 22 bp, Artificial Sequence
  chemically synthesized
attctatgagggaagcattgtc

SEQ ID NO: 1132578 - DNA, 22 bp, Artificial Sequence
  chemically synthesized
tatgagggaagcattgtcctga

SEQ ID NO: 1132579 - DNA, 22 bp, Artificial Sequence
  chemically synthesized
ccaggttttggtatcaggacaa

SEQ ID NO: 1132580 - DNA, 22 bp, Artificial Sequence
  chemically synthesized
tgagggaagcattgtcctgata

SEQ ID NO: 1132581 - DNA, 22 bp, Artificial Sequence
  chemically synthesized
tgtgtctgccaggttttggtat

SEQ ID NO: 1132582 - DNA, 22 bp, Artificial Sequence
  chemically synthesized
ttgtgtgtctgccaggttttgg

SEQ ID NO: 1132583 - DNA, 22 bp, Artificial Sequence
  chemically synthesized
tcctgataccaaaacctggcag

SEQ ID NO: 1132584 - DNA, 22 bp, Artificial Sequence
  chemically synthesized
gttgttgtgtgtctgccaggtt

SEQ ID NO: 1132585 - DNA, 22 bp, Artificial Sequence
  chemically synthesized
ggttgttgtgtgtctgccaggt

SEQ ID NO: 1132586 - DNA, 22 bp, Artificial Sequence
  chemically synthesized
tggttgttgtgtgtctgccagg

SEQ ID NO: 1132587 - DNA, 22 bp, Artificial Sequence
  chemically synthesized
ttggttgttgtgtgtctgccag

SEQ ID NO: 1132588 - DNA, 22 bp, Artificial Sequence
  chemically synthesized
tttggttgttgtgtgtctgcca

SEQ ID NO: 1132589 - DNA, 22 bp, Artificial Sequence
  chemically synthesized
ataccaaaacctggcagacaca

SEQ ID NO: 1132590 - DNA, 22 bp, Artificial Sequence
  chemically synthesized
ttttggttgttgtgtgtctgcc

SEQ ID NO: 1132591 - DNA, 22 bp, Artificial Sequence
  chemically synthesized
ttttttggttgttgtgtgtctg

SEQ ID NO: 1132592 - DNA, 22 bp, Artificial Sequence
  chemically synthesized
cttttttggttgttgtgtgtct

SEQ ID NO: 1132593 - DNA, 22 bp, Artificial Sequence
  chemically synthesized
tcttttttggttgttgtgtgtc

SEQ ID NO: 1132594 - DNA, 22 bp, Artificial Sequence
  chemically synthesized
aagttttcttttttggttgttg

SEQ ID NO: 1132595 - DNA, 22 bp, Artificial Sequence
  chemically synthesized
gcagacacacaacaaccaaaaa

SEQ ID NO: 1132596 - DNA, 22 bp, Artificial Sequence
  chemically synthesized
gcctgaagttttcttttttggt

SEQ ID NO: 1132597 - DNA, 22 bp, Artificial Sequence
  chemically synthesized
gggacattggcctgaagttttc

SEQ ID NO: 1132598 - DNA, 22 bp, Artificial Sequence
  chemically synthesized
attagggacattggcctgaagt

SEQ ID NO: 1132599 - DNA, 22 bp, Artificial Sequence
  chemically synthesized
tgttcattagggacattggcct

SEQ ID NO: 1132600 - DNA, 22 bp, Artificial Sequence
  chemically synthesized
catctatgttcattagggacat

SEQ ID NO: 1132601 - DNA, 22 bp, Artificial Sequence
  chemically synthesized
gcatctatgttcattagggaca

SEQ ID NO: 1132602 - DNA, 22 bp, Artificial Sequence
  chemically synthesized
tgcatctatgttcattagggac

SEQ ID NO: 1132603 - DNA, 22 bp, Artificial Sequence
  chemically synthesized
ttgcatctatgttcattaggga

SEQ ID NO: 1132604 - DNA, 22 bp, Artificial Sequence
  chemically synthesized
caggccaatgtccctaatgaac

SEQ ID NO: 1132605 - DNA, 22 bp, Artificial Sequence
  chemically synthesized
aggccaatgtccctaatgaaca

SEQ ID NO: 1132606 - DNA, 22 bp, Artificial Sequence
  chemically synthesized
tttttgcatctatgttcattag

SEQ ID NO: 1132607 - DNA, 22 bp, Artificial Sequence
  chemically synthesized
actatttttgcatctatgttca

SEQ ID NO: 1132608 - DNA, 22 bp, Artificial Sequence
  chemically synthesized
ttgactatttttgcatctatgt

SEQ ID NO: 1132609 - DNA, 22 bp, Artificial Sequence
  chemically synthesized
tgttgactatttttgcatctat

SEQ ID NO: 1132610 - DNA, 22 bp, Artificial Sequence
  chemically synthesized
atgaacatagatgcaaaaatag

SEQ ID NO: 1132611 - DNA, 22 bp, Artificial Sequence
  chemically synthesized
gtattctgttgactatttttgc

SEQ ID NO: 1132612 - DNA, 22 bp, Artificial Sequence
  chemically synthesized
ctggtattctgttgactatttt

SEQ ID NO: 1132613 - DNA, 22 bp, Artificial Sequence
  chemically synthesized
gctggtattctgttgactattt

SEQ ID NO: 1132614 - DNA, 22 bp, Artificial Sequence
  chemically synthesized
ggtttgctggtattctgttgac

SEQ ID NO: 1132615 - DNA, 22 bp, Artificial Sequence
  chemically synthesized
gattgggtttgctggtattctg

SEQ ID NO: 1132616 - DNA, 22 bp, Artificial Sequence
  chemically synthesized
ctggattgggtttgctggtatt

SEQ ID NO: 1132617 - DNA, 22 bp, Artificial Sequence
  chemically synthesized
atgtgctgctggattgggtttg

SEQ ID NO: 1132618 - DNA, 22 bp, Artificial Sequence
  chemically synthesized
gatgtgctgctggattgggttt

SEQ ID NO: 1132619 - DNA, 22 bp, Artificial Sequence
  chemically synthesized
tgatgtgctgctggattgggtt

SEQ ID NO: 1132620 - DNA, 22 bp, Artificial Sequence
  chemically synthesized
ttgatgtgctgctggattgggt

SEQ ID NO: 1132621 - DNA, 22 bp, Artificial Sequence
  chemically synthesized
tttgatgtgctgctggattggg

SEQ ID NO: 1132622 - DNA, 22 bp, Artificial Sequence
  chemically synthesized
gctttttgatgtgctgctggat

SEQ ID NO: 1132623 - DNA, 22 bp, Artificial Sequence
  chemically synthesized
atcatggtggattagctttttg

SEQ ID NO: 1132624 - DNA, 22 bp, Artificial Sequence
  chemically synthesized
gatcatggtggattagcttttt

SEQ ID NO: 1132625 - DNA, 22 bp, Artificial Sequence
  chemically synthesized
cttgatcatggtggattagctt

SEQ ID NO: 1132626 - DNA, 22 bp, Artificial Sequence
  chemically synthesized
ggatagaagctccttgatcatg

SEQ ID NO: 1132627 - DNA, 22 bp, Artificial Sequence
  chemically synthesized
atccaccatgatcaaggagctt

SEQ ID NO: 1132628 - DNA, 22 bp, Artificial Sequence
  chemically synthesized
gcaaccctgggatagaagctcc

SEQ ID NO: 1132629 - DNA, 22 bp, Artificial Sequence
  chemically synthesized
aatcaacctcgcaaccctggga

SEQ ID NO: 1132630 - DNA, 22 bp, Artificial Sequence
  chemically synthesized
ctatcccagggttgcgaggttg

SEQ ID NO: 1132631 - DNA, 22 bp, Artificial Sequence
  chemically synthesized
tgtatgttgaatcaacctcgca

SEQ ID NO: 1132632 - DNA, 22 bp, Artificial Sequence
  chemically synthesized
tatcccagggttgcgaggttga

SEQ ID NO: 1132633 - DNA, 22 bp, Artificial Sequence
  chemically synthesized
gtgtatgttgaatcaacctcgc

SEQ ID NO: 1132634 - DNA, 22 bp, Artificial Sequence
  chemically synthesized
tcccagggttgcgaggttgatt

SEQ ID NO: 1132635 - DNA, 22 bp, Artificial Sequence
  chemically synthesized
acttgtgtatgttgaatcaacc

SEQ ID NO: 1132636 - DNA, 22 bp, Artificial Sequence
  chemically synthesized
ttgacttgtgtatgttgaatca

SEQ ID NO: 1132637 - DNA, 22 bp, Artificial Sequence
  chemically synthesized
attgacttgtgtatgttgaatc

SEQ ID NO: 1132638 - DNA, 22 bp, Artificial Sequence
  chemically synthesized
cgaggttgattcaacatacaca

SEQ ID NO: 1132639 - DNA, 22 bp, Artificial Sequence
  chemically synthesized
attcaacatacacaagtcaata

SEQ ID NO: 1132640 - DNA, 22 bp, Artificial Sequence
  chemically synthesized
aacatacacaagtcaataaatg

SEQ ID NO: 1132641 - DNA, 22 bp, Artificial Sequence
  chemically synthesized
tgtggtgaatcacatttattga

SEQ ID NO: 1132642 - DNA, 22 bp, Artificial Sequence
  chemically synthesized
atgtggtgaatcacatttattg

SEQ ID NO: 1132643 - DNA, 22 bp, Artificial Sequence
  chemically synthesized
tttatgtggtgaatcacattta

SEQ ID NO: 1132644 - DNA, 22 bp, Artificial Sequence
  chemically synthesized
tgtttatgtggtgaatcacatt

SEQ ID NO: 1132645 - DNA, 22 bp, Artificial Sequence
  chemically synthesized
ttctgtttatgtggtgaatcac

SEQ ID NO: 1132646 - DNA, 22 bp, Artificial Sequence
  chemically synthesized
gttctgtttatgtggtgaatca

SEQ ID NO: 1132647 - DNA, 22 bp, Artificial Sequence
  chemically synthesized
tgttctgtttatgtggtgaatc

SEQ ID NO: 1132648 - DNA, 22 bp, Artificial Sequence
  chemically synthesized
ttgttctgtttatgtggtgaat

SEQ ID NO: 1132649 - DNA, 22 bp, Artificial Sequence
  chemically synthesized
tttgttctgtttatgtggtgaa

SEQ ID NO: 1132650 - DNA, 22 bp, Artificial Sequence
  chemically synthesized
attttttgttctgtttatgtgg

SEQ ID NO: 1132651 - DNA, 22 bp, Artificial Sequence
  chemically synthesized
gattttttgttctgtttatgtg

SEQ ID NO: 1132652 - DNA, 22 bp, Artificial Sequence
  chemically synthesized
tgattttttgttctgtttatgt

SEQ ID NO: 1132653 - DNA, 22 bp, Artificial Sequence
  chemically synthesized
ttgattttttgttctgtttatg

SEQ ID NO: 1132654 - DNA, 22 bp, Artificial Sequence
  chemically synthesized
accacataaacagaacaaaaaa

SEQ ID NO: 1132655 - DNA, 22 bp, Artificial Sequence
  chemically synthesized
aaatgatcatgtggtttttgat

SEQ ID NO: 1132656 - DNA, 22 bp, Artificial Sequence
  chemically synthesized
ctgaaatgatcatgtggttttt

SEQ ID NO: 1132657 - DNA, 22 bp, Artificial Sequence
  chemically synthesized
tatctactgaaatgatcatgtg

SEQ ID NO: 1132658 - DNA, 22 bp, Artificial Sequence
  chemically synthesized
tatatctactgaaatgatcatg

SEQ ID NO: 1132659 - DNA, 22 bp, Artificial Sequence
  chemically synthesized
ctatatctactgaaatgatcat

SEQ ID NO: 1132660 - DNA, 22 bp, Artificial Sequence
  chemically synthesized
tctatatctactgaaatgatca

SEQ ID NO: 1132661 - DNA, 22 bp, Artificial Sequence
  chemically synthesized
ttctatatctactgaaatgatc

SEQ ID NO: 1132662 - DNA, 22 bp, Artificial Sequence
  chemically synthesized
taggatgccttttctatatcta

SEQ ID NO: 1132663 - DNA, 22 bp, Artificial Sequence
  chemically synthesized
ataggatgccttttctatatct

SEQ ID NO: 1132664 - DNA, 22 bp, Artificial Sequence
  chemically synthesized
tataggatgccttttctatatc

SEQ ID NO: 1132665 - DNA, 22 bp, Artificial Sequence
  chemically synthesized
aattttataggatgccttttct

SEQ ID NO: 1132666 - DNA, 22 bp, Artificial Sequence
  chemically synthesized
cagtagatatagaaaaggcatc

SEQ ID NO: 1132667 - DNA, 22 bp, Artificial Sequence
  chemically synthesized
agtagatatagaaaaggcatcc

SEQ ID NO: 1132668 - DNA, 22 bp, Artificial Sequence
  chemically synthesized
acatgaaagggtgttgaatttt

SEQ ID NO: 1132669 - DNA, 22 bp, Artificial Sequence
  chemically synthesized
aacatgaaagggtgttgaattt

SEQ ID NO: 1132670 - DNA, 22 bp, Artificial Sequence
  chemically synthesized
taacatgaaagggtgttgaatt

SEQ ID NO: 1132671 - DNA, 22 bp, Artificial Sequence
  chemically synthesized
ttaacatgaaagggtgttgaat

SEQ ID NO: 1132672 - DNA, 22 bp, Artificial Sequence
  chemically synthesized
taaaattcaacaccctttcatg

SEQ ID NO: 1132673 - DNA, 22 bp, Artificial Sequence
  chemically synthesized
tcgaggatttttaacatgaaag

SEQ ID NO: 1132674 - DNA, 22 bp, Artificial Sequence
  chemically synthesized
gtcgaggatttttaacatgaaa

SEQ ID NO: 1132675 - DNA, 22 bp, Artificial Sequence
  chemically synthesized
gtttgtcgaggatttttaacat

SEQ ID NO: 1132676 - DNA, 22 bp, Artificial Sequence
  chemically synthesized
aacaccctttcatgttaaaaat

SEQ ID NO: 1132677 - DNA, 22 bp, Artificial Sequence
  chemically synthesized
agtgcctagtttgtcgaggatt

SEQ ID NO: 1132678 - DNA, 22 bp, Artificial Sequence
  chemically synthesized
cagtgcctagtttgtcgaggat

SEQ ID NO: 1132679 - DNA, 22 bp, Artificial Sequence
  chemically synthesized
tcatgttaaaaatcctcgacaa

SEQ ID NO: 1132680 - DNA, 22 bp, Artificial Sequence
  chemically synthesized
catgttaaaaatcctcgacaaa

SEQ ID NO: 1132681 - DNA, 22 bp, Artificial Sequence
  chemically synthesized
atgttaaaaatcctcgacaaac

SEQ ID NO: 1132682 - DNA, 22 bp, Artificial Sequence
  chemically synthesized
cttcagtgcctagtttgtcgag

SEQ ID NO: 1132683 - DNA, 22 bp, Artificial Sequence
  chemically synthesized
aaaatcctcgacaaactaggca

SEQ ID NO: 1132684 - DNA, 22 bp, Artificial Sequence
  chemically synthesized
aaatatgttccttcagtgccta

SEQ ID NO: 1132685 - DNA, 22 bp, Artificial Sequence
  chemically synthesized
gaaatatgttccttcagtgcct

SEQ ID NO: 1132686 - DNA, 22 bp, Artificial Sequence
  chemically synthesized
tgaaatatgttccttcagtgcc

SEQ ID NO: 1132687 - DNA, 22 bp, Artificial Sequence
  chemically synthesized
gacaaactaggcactgaaggaa

SEQ ID NO: 1132688 - DNA, 22 bp, Artificial Sequence
  chemically synthesized
ctttgaaatatgttccttcagt

SEQ ID NO: 1132689 - DNA, 22 bp, Artificial Sequence
  chemically synthesized
attactttgaaatatgttcctt

SEQ ID NO: 1132690 - DNA, 22 bp, Artificial Sequence
  chemically synthesized
taattactttgaaatatgttcc

SEQ ID NO: 1132691 - DNA, 22 bp, Artificial Sequence
  chemically synthesized
ggcactgaaggaacatatttca

SEQ ID NO: 1132692 - DNA, 22 bp, Artificial Sequence
  chemically synthesized
aaggaacatatttcaaagtaat

SEQ ID NO: 1132693 - DNA, 22 bp, Artificial Sequence
  chemically synthesized
aagatggttctaattactttga

SEQ ID NO: 1132694 - DNA, 22 bp, Artificial Sequence
  chemically synthesized
aaagatggttctaattactttg

SEQ ID NO: 1132695 - DNA, 22 bp, Artificial Sequence
  chemically synthesized
taaagatggttctaattacttt

SEQ ID NO: 1132696 - DNA, 22 bp, Artificial Sequence
  chemically synthesized
ttaaagatggttctaattactt

SEQ ID NO: 1132697 - DNA, 22 bp, Artificial Sequence
  chemically synthesized
tttaaagatggttctaattact

SEQ ID NO: 1132698 - DNA, 22 bp, Artificial Sequence
  chemically synthesized
tggactttttaaagatggttct

SEQ ID NO: 1132699 - DNA, 22 bp, Artificial Sequence
  chemically synthesized
caaagtaattagaaccatcttt

SEQ ID NO: 1132700 - DNA, 22 bp, Artificial Sequence
  chemically synthesized
aaagtaattagaaccatcttta

SEQ ID NO: 1132701 - DNA, 22 bp, Artificial Sequence
  chemically synthesized
gctgtggactttttaaagatgg

SEQ ID NO: 1132702 - DNA, 22 bp, Artificial Sequence
  chemically synthesized
gaaccatctttaaaaagtccac

SEQ ID NO: 1132703 - DNA, 22 bp, Artificial Sequence
  chemically synthesized
agtataatgttggctgtggact

SEQ ID NO: 1132704 - DNA, 22 bp, Artificial Sequence
  chemically synthesized
taaaaagtccacagccaacatt

SEQ ID NO: 1132705 - DNA, 22 bp, Artificial Sequence
  chemically synthesized
cacattcagtataatgttggct

SEQ ID NO: 1132706 - DNA, 22 bp, Artificial Sequence
  chemically synthesized
aaaaagtccacagccaacatta

SEQ ID NO: 1132707 - DNA, 22 bp, Artificial Sequence
  chemically synthesized
gcacattcagtataatgttggc

SEQ ID NO: 1132708 - DNA, 22 bp, Artificial Sequence
  chemically synthesized
aaaagtccacagccaacattat

SEQ ID NO: 1132709 - DNA, 22 bp, Artificial Sequence
  chemically synthesized
tgcacattcagtataatgttgg

SEQ ID NO: 1132710 - DNA, 22 bp, Artificial Sequence
  chemically synthesized
ttgcacattcagtataatgttg

SEQ ID NO: 1132711 - DNA, 22 bp, Artificial Sequence
  chemically synthesized
gcttttgcacattcagtataat

SEQ ID NO: 1132712 - DNA, 22 bp, Artificial Sequence
  chemically synthesized
tggcttttgcacattcagtata

SEQ ID NO: 1132713 - DNA, 22 bp, Artificial Sequence
  chemically synthesized
ctggcttttgcacattcagtat

SEQ ID NO: 1132714 - DNA, 22 bp, Artificial Sequence
  chemically synthesized
tactgaatgtgcaaaagccaga

SEQ ID NO: 1132715 - DNA, 22 bp, Artificial Sequence
  chemically synthesized
aagcacaatgcttctggctttt

SEQ ID NO: 1132716 - DNA, 22 bp, Artificial Sequence
  chemically synthesized
caagcacaatgcttctggcttt

SEQ ID NO: 1132717 - DNA, 22 bp, Artificial Sequence
  chemically synthesized
tcaagcacaatgcttctggctt

SEQ ID NO: 1132718 - DNA, 22 bp, Artificial Sequence
  chemically synthesized
aatgtgcaaaagccagaagcat

SEQ ID NO: 1132719 - DNA, 22 bp, Artificial Sequence
  chemically synthesized
tgccagttttcaagcacaatgc

SEQ ID NO: 1132720 - DNA, 22 bp, Artificial Sequence
  chemically synthesized
atgccagttttcaagcacaatg

SEQ ID NO: 1132721 - DNA, 22 bp, Artificial Sequence
  chemically synthesized
tcttatgccagttttcaagcac

SEQ ID NO: 1132722 - DNA, 22 bp, Artificial Sequence
  chemically synthesized
gtcttatgccagttttcaagca

SEQ ID NO: 1132723 - DNA, 22 bp, Artificial Sequence
  chemically synthesized
tgcttgaaaactggcataagac

SEQ ID NO: 1132724 - DNA, 22 bp, Artificial Sequence
  chemically synthesized
gaaaactggcataagacaaggg

SEQ ID NO: 1132725 - DNA, 22 bp, Artificial Sequence
  chemically synthesized
taagagagggcccccttgtctt

SEQ ID NO: 1132726 - DNA, 22 bp, Artificial Sequence
  chemically synthesized
aaaactggcataagacaagggg

SEQ ID NO: 1132727 - DNA, 22 bp, Artificial Sequence
  chemically synthesized
gtaagagagggcccccttgtct

SEQ ID NO: 1132728 - DNA, 22 bp, Artificial Sequence
  chemically synthesized
gcataagacaagggggccctct

SEQ ID NO: 1132729 - DNA, 22 bp, Artificial Sequence
  chemically synthesized
aatgagatttgtaagagagggc

SEQ ID NO: 1132730 - DNA, 22 bp, Artificial Sequence
  chemically synthesized
tgttcaatgagatttgtaagag

SEQ ID NO: 1132731 - DNA, 22 bp, Artificial Sequence
  chemically synthesized
gtactatgttcaatgagatttg

SEQ ID NO: 1132732 - DNA, 22 bp, Artificial Sequence
  chemically synthesized
tagtactatgttcaatgagatt

SEQ ID NO: 1132733 - DNA, 22 bp, Artificial Sequence
  chemically synthesized
ctagtactatgttcaatgagat

SEQ ID NO: 1132734 - DNA, 22 bp, Artificial Sequence
  chemically synthesized
tcttacaaatctcattgaacat

SEQ ID NO: 1132735 - DNA, 22 bp, Artificial Sequence
  chemically synthesized
ttacaaatctcattgaacatag

SEQ ID NO: 1132736 - DNA, 22 bp, Artificial Sequence
  chemically synthesized
ggatttctagtactatgttcaa

SEQ ID NO: 1132737 - DNA, 22 bp, Artificial Sequence
  chemically synthesized
acaaatctcattgaacatagta

SEQ ID NO: 1132738 - DNA, 22 bp, Artificial Sequence
  chemically synthesized
caaatctcattgaacatagtac

SEQ ID NO: 1132739 - DNA, 22 bp, Artificial Sequence
  chemically synthesized
gctaggatttctagtactatgt

SEQ ID NO: 1132740 - DNA, 22 bp, Artificial Sequence
  chemically synthesized
ggctaggatttctagtactatg

SEQ ID NO: 1132741 - DNA, 22 bp, Artificial Sequence
  chemically synthesized
tggctaggatttctagtactat

SEQ ID NO: 1132742 - DNA, 22 bp, Artificial Sequence
  chemically synthesized
ctttggctaggatttctagtac

SEQ ID NO: 1132743 - DNA, 22 bp, Artificial Sequence
  chemically synthesized
attgaacatagtactagaaatc

SEQ ID NO: 1132744 - DNA, 22 bp, Artificial Sequence
  chemically synthesized
attgctttggctaggatttcta

SEQ ID NO: 1132745 - DNA, 22 bp, Artificial Sequence
  chemically synthesized
aacatagtactagaaatcctag

SEQ ID NO: 1132746 - DNA, 22 bp, Artificial Sequence
  chemically synthesized
ctgattgctttggctaggattt

SEQ ID NO: 1132747 - DNA, 22 bp, Artificial Sequence
  chemically synthesized
cctgattgctttggctaggatt

SEQ ID NO: 1132748 - DNA, 22 bp, Artificial Sequence
  chemically synthesized
tcctgattgctttggctaggat

SEQ ID NO: 1132749 - DNA, 22 bp, Artificial Sequence
  chemically synthesized
tttcctgattgctttggctagg

SEQ ID NO: 1132750 - DNA, 22 bp, Artificial Sequence
  chemically synthesized
tctttcctgattgctttggcta

SEQ ID NO: 1132751 - DNA, 22 bp, Artificial Sequence
  chemically synthesized
ctctttcctgattgctttggct

SEQ ID NO: 1132752 - DNA, 22 bp, Artificial Sequence
  chemically synthesized
tttctctttcctgattgctttg

SEQ ID NO: 1132753 - DNA, 22 bp, Artificial Sequence
  chemically synthesized
gaaatcctagccaaagcaatca

SEQ ID NO: 1132754 - DNA, 22 bp, Artificial Sequence
  chemically synthesized
atttctctttcctgattgcttt

SEQ ID NO: 1132755 - DNA, 22 bp, Artificial Sequence
  chemically synthesized
tatttctctttcctgattgctt

SEQ ID NO: 1132756 - DNA, 22 bp, Artificial Sequence
  chemically synthesized
cctttatttctctttcctgatt

SEQ ID NO: 1132757 - DNA, 22 bp, Artificial Sequence
  chemically synthesized
gccaaagcaatcaggaaagaga

SEQ ID NO: 1132758 - DNA, 22 bp, Artificial Sequence
  chemically synthesized
gattgcctttatttctctttcc

SEQ ID NO: 1132759 - DNA, 22 bp, Artificial Sequence
  chemically synthesized
ggattgcctttatttctctttc

SEQ ID NO: 1132760 - DNA, 22 bp, Artificial Sequence
  chemically synthesized
tttggattgcctttatttctct

SEQ ID NO: 1132761 - DNA, 22 bp, Artificial Sequence
  chemically synthesized
ctatttggattgcctttatttc

SEQ ID NO: 1132762 - DNA, 22 bp, Artificial Sequence
  chemically synthesized
cctatttggattgcctttattt

SEQ ID NO: 1132763 - DNA, 22 bp, Artificial Sequence
  chemically synthesized
ttcctatttggattgcctttat

SEQ ID NO: 1132764 - DNA, 22 bp, Artificial Sequence
  chemically synthesized
tcttcctatttggattgccttt

SEQ ID NO: 1132765 - DNA, 22 bp, Artificial Sequence
  chemically synthesized
ctctcttcctatttggattgcc

SEQ ID NO: 1132766 - DNA, 22 bp, Artificial Sequence
  chemically synthesized
cctctcttcctatttggattgc

SEQ ID NO: 1132767 - DNA, 22 bp, Artificial Sequence
  chemically synthesized
acttcctctcttcctatttgga

SEQ ID NO: 1132768 - DNA, 22 bp, Artificial Sequence
  chemically synthesized
gacttcctctcttcctatttgg

SEQ ID NO: 1132769 - DNA, 22 bp, Artificial Sequence
  chemically synthesized
caaacagggataatttgacttc

SEQ ID NO: 1132770 - DNA, 22 bp, Artificial Sequence
  chemically synthesized
atcgtctgcaaacagggataat

SEQ ID NO: 1132771 - DNA, 22 bp, Artificial Sequence
  chemically synthesized
tccctgtttgcagacgatgagg

SEQ ID NO: 1132772 - DNA, 22 bp, Artificial Sequence
  chemically synthesized
tggccaaagtatagaacctcat

SEQ ID NO: 1132773 - DNA, 22 bp, Artificial Sequence
  chemically synthesized
tttgcagacgatgaggttctat

SEQ ID NO: 1132774 - DNA, 22 bp, Artificial Sequence
  chemically synthesized
gcagacgatgaggttctatact

SEQ ID NO: 1132775 - DNA, 22 bp, Artificial Sequence
  chemically synthesized
cagacgatgaggttctatactt

SEQ ID NO: 1132776 - DNA, 22 bp, Artificial Sequence
  chemically synthesized
ggcagagactatggccaaagta

SEQ ID NO: 1132777 - DNA, 22 bp, Artificial Sequence
  chemically synthesized
gggcagagactatggccaaagt

SEQ ID NO: 1132778 - DNA, 22 bp, Artificial Sequence
  chemically synthesized
tgggcagagactatggccaaag

SEQ ID NO: 1132779 - DNA, 22 bp, Artificial Sequence
  chemically synthesized
ttgggcagagactatggccaaa

SEQ ID NO: 1132780 - DNA, 22 bp, Artificial Sequence
  chemically synthesized
tatactttggccatagtctctg

SEQ ID NO: 1132781 - DNA, 22 bp, Artificial Sequence
  chemically synthesized
tactttggccatagtctctgcc

SEQ ID NO: 1132782 - DNA, 22 bp, Artificial Sequence
  chemically synthesized
tggccatagtctctgcccaaaa

SEQ ID NO: 1132783 - DNA, 22 bp, Artificial Sequence
  chemically synthesized
ggccatagtctctgcccaaaag

SEQ ID NO: 1132784 - DNA, 22 bp, Artificial Sequence
  chemically synthesized
gccatagtctctgcccaaaagc

SEQ ID NO: 1132785 - DNA, 22 bp, Artificial Sequence
  chemically synthesized
tgtatcagatcaatgagctttt

SEQ ID NO: 1132786 - DNA, 22 bp, Artificial Sequence
  chemically synthesized
aggttgtgtatcagatcaatga

SEQ ID NO: 1132787 - DNA, 22 bp, Artificial Sequence
  chemically synthesized
tgcccaaaagctcattgatctg

SEQ ID NO: 1132788 - DNA, 22 bp, Artificial Sequence
  chemically synthesized
cccaaaagctcattgatctgat

SEQ ID NO: 1132789 - DNA, 22 bp, Artificial Sequence
  chemically synthesized
ctgaggttgtgtatcagatcaa

SEQ ID NO: 1132790 - DNA, 22 bp, Artificial Sequence
  chemically synthesized
gctgaggttgtgtatcagatca

SEQ ID NO: 1132791 - DNA, 22 bp, Artificial Sequence
  chemically synthesized
tgctgaggttgtgtatcagatc

SEQ ID NO: 1132792 - DNA, 22 bp, Artificial Sequence
  chemically synthesized
aaactttgctgaggttgtgtat

SEQ ID NO: 1132793 - DNA, 22 bp, Artificial Sequence
  chemically synthesized
attgatctgatacacaacctca

SEQ ID NO: 1132794 - DNA, 22 bp, Artificial Sequence
  chemically synthesized
atctgatacacaacctcagcaa

SEQ ID NO: 1132795 - DNA, 22 bp, Artificial Sequence
  chemically synthesized
gatgctgaaactttgctgaggt

SEQ ID NO: 1132796 - DNA, 22 bp, Artificial Sequence
  chemically synthesized
ggatgctgaaactttgctgagg

SEQ ID NO: 1132797 - DNA, 22 bp, Artificial Sequence
  chemically synthesized
tggatgctgaaactttgctgag

SEQ ID NO: 1132798 - DNA, 22 bp, Artificial Sequence
  chemically synthesized
atacacaacctcagcaaagttt

SEQ ID NO: 1132799 - DNA, 22 bp, Artificial Sequence
  chemically synthesized
attttggatgctgaaactttgc

SEQ ID NO: 1132800 - DNA, 22 bp, Artificial Sequence
  chemically synthesized
tacattgattttggatgctgaa

SEQ ID NO: 1132801 - DNA, 22 bp, Artificial Sequence
  chemically synthesized
atacattgattttggatgctga

SEQ ID NO: 1132802 - DNA, 22 bp, Artificial Sequence
  chemically synthesized
agcaaagtttcagcatccaaaa

SEQ ID NO: 1132803 - DNA, 22 bp, Artificial Sequence
  chemically synthesized
gtgatatttatacattgatttt

SEQ ID NO: 1132804 - DNA, 22 bp, Artificial Sequence
  chemically synthesized
cagcatccaaaatcaatgtata

SEQ ID NO: 1132805 - DNA, 22 bp, Artificial Sequence
  chemically synthesized
agcatccaaaatcaatgtataa

SEQ ID NO: 1132806 - DNA, 22 bp, Artificial Sequence
  chemically synthesized
gtgtgtaggaacactagtgata

SEQ ID NO: 1132807 - DNA, 22 bp, Artificial Sequence
  chemically synthesized
ttggtgtgtaggaacactagtg

SEQ ID NO: 1132808 - DNA, 22 bp, Artificial Sequence
  chemically synthesized
aatgttgttggtgtgtaggaac

SEQ ID NO: 1132809 - DNA, 22 bp, Artificial Sequence
  chemically synthesized
aaatgttgttggtgtgtaggaa

SEQ ID NO: 1132810 - DNA, 22 bp, Artificial Sequence
  chemically synthesized
gcttaaatgttgttggtgtgta

SEQ ID NO: 1132811 - DNA, 22 bp, Artificial Sequence
  chemically synthesized
agcttaaatgttgttggtgtgt

SEQ ID NO: 1132812 - DNA, 22 bp, Artificial Sequence
  chemically synthesized
gtgttcctacacaccaacaaca

SEQ ID NO: 1132813 - DNA, 22 bp, Artificial Sequence
  chemically synthesized
gccttagcttaaatgttgttgg

SEQ ID NO: 1132814 - DNA, 22 bp, Artificial Sequence
  chemically synthesized
ggccttagcttaaatgttgttg

SEQ ID NO: 1132815 - DNA, 22 bp, Artificial Sequence
  chemically synthesized
ctacacaccaacaacatttaag

SEQ ID NO: 1132816 - DNA, 22 bp, Artificial Sequence
  chemically synthesized
atttggccttagcttaaatgtt

SEQ ID NO: 1132817 - DNA, 22 bp, Artificial Sequence
  chemically synthesized
catttggccttagcttaaatgt

SEQ ID NO: 1132818 - DNA, 22 bp, Artificial Sequence
  chemically synthesized
cacaccaacaacatttaagcta

SEQ ID NO: 1132819 - DNA, 22 bp, Artificial Sequence
  chemically synthesized
ttcatttggccttagcttaaat

SEQ ID NO: 1132820 - DNA, 22 bp, Artificial Sequence
  chemically synthesized
tgttcttcatttggccttagct

SEQ ID NO: 1132821 - DNA, 22 bp, Artificial Sequence
  chemically synthesized
aagctaaggccaaatgaagaac

SEQ ID NO: 1132822 - DNA, 22 bp, Artificial Sequence
  chemically synthesized
agctaaggccaaatgaagaaca

SEQ ID NO: 1132823 - DNA, 22 bp, Artificial Sequence
  chemically synthesized
tgaatgggactgtgttcttcat

SEQ ID NO: 1132824 - DNA, 22 bp, Artificial Sequence
  chemically synthesized
aggccaaatgaagaacacagtc

SEQ ID NO: 1132825 - DNA, 22 bp, Artificial Sequence
  chemically synthesized
acaattatgaatgggactgtgt

SEQ ID NO: 1132826 - DNA, 22 bp, Artificial Sequence
  chemically synthesized
gacaattatgaatgggactgtg

SEQ ID NO: 1132827 - DNA, 22 bp, Artificial Sequence
  chemically synthesized
tgacaattatgaatgggactgt

SEQ ID NO: 1132828 - DNA, 22 bp, Artificial Sequence
  chemically synthesized
ttgacaattatgaatgggactg

SEQ ID NO: 1132829 - DNA, 22 bp, Artificial Sequence
  chemically synthesized
tttgacaattatgaatgggact

SEQ ID NO: 1132830 - DNA, 22 bp, Artificial Sequence
  chemically synthesized
tttttgacaattatgaatggga

SEQ ID NO: 1132831 - DNA, 22 bp, Artificial Sequence
  chemically synthesized
ctttttgacaattatgaatggg

SEQ ID NO: 1132832 - DNA, 22 bp, Artificial Sequence
  chemically synthesized
tttctttttgacaattatgaat

SEQ ID NO: 1132833 - DNA, 22 bp, Artificial Sequence
  chemically synthesized
atttctttttgacaattatgaa

SEQ ID NO: 1132834 - DNA, 22 bp, Artificial Sequence
  chemically synthesized
ggtatcttatttctttttgaca

SEQ ID NO: 1132835 - DNA, 22 bp, Artificial Sequence
  chemically synthesized
ctaggtatcttatttctttttg

SEQ ID NO: 1132836 - DNA, 22 bp, Artificial Sequence
  chemically synthesized
ataattgtcaaaaagaaataag

SEQ ID NO: 1132837 - DNA, 22 bp, Artificial Sequence
  chemically synthesized
tattcctaggtatcttatttct

SEQ ID NO: 1132838 - DNA, 22 bp, Artificial Sequence
  chemically synthesized
gctgtattcctaggtatcttat

SEQ ID NO: 1132839 - DNA, 22 bp, Artificial Sequence
  chemically synthesized
agctgtattcctaggtatctta

SEQ ID NO: 1132840 - DNA, 22 bp, Artificial Sequence
  chemically synthesized
tcaaaaagaaataagataccta

SEQ ID NO: 1132841 - DNA, 22 bp, Artificial Sequence
  chemically synthesized
cttagctgtattcctaggtatc

SEQ ID NO: 1132842 - DNA, 22 bp, Artificial Sequence
  chemically synthesized
gcttagctgtattcctaggtat

SEQ ID NO: 1132843 - DNA, 22 bp, Artificial Sequence
  chemically synthesized
cttgcttagctgtattcctagg

SEQ ID NO: 1132844 - DNA, 22 bp, Artificial Sequence
  chemically synthesized
acctccttgcttagctgtattc

SEQ ID NO: 1132845 - DNA, 22 bp, Artificial Sequence
  chemically synthesized
cacctccttgcttagctgtatt

SEQ ID NO: 1132846 - DNA, 22 bp, Artificial Sequence
  chemically synthesized
gcagtgtttcacctccttgctt

SEQ ID NO: 1132847 - DNA, 22 bp, Artificial Sequence
  chemically synthesized
ggaatacagctaagcaaggagg

SEQ ID NO: 1132848 - DNA, 22 bp, Artificial Sequence
  chemically synthesized
agcagtgtttcacctccttgct

SEQ ID NO: 1132849 - DNA, 22 bp, Artificial Sequence
  chemically synthesized
agtttagcagtgtttcacctcc

SEQ ID NO: 1132850 - DNA, 22 bp, Artificial Sequence
  chemically synthesized
tcagtttagcagtgtttcacct

SEQ ID NO: 1132851 - DNA, 22 bp, Artificial Sequence
  chemically synthesized
agcaaggaggtgaaacactgct

SEQ ID NO: 1132852 - DNA, 22 bp, Artificial Sequence
  chemically synthesized
taattctcagtttagcagtgtt

SEQ ID NO: 1132853 - DNA, 22 bp, Artificial Sequence
  chemically synthesized
gtaattctcagtttagcagtgt

SEQ ID NO: 1132854 - DNA, 22 bp, Artificial Sequence
  chemically synthesized
tgtaattctcagtttagcagtg

SEQ ID NO: 1132855 - DNA, 22 bp, Artificial Sequence
  chemically synthesized
agcaatattttgtaattctcag

SEQ ID NO: 1132856 - DNA, 22 bp, Artificial Sequence
  chemically synthesized
gagcaatattttgtaattctca

SEQ ID NO: 1132857 - DNA, 22 bp, Artificial Sequence
  chemically synthesized
cttgagcaatattttgtaattc

SEQ ID NO: 1132858 - DNA, 22 bp, Artificial Sequence
  chemically synthesized
ctaaactgagaattacaaaata

SEQ ID NO: 1132859 - DNA, 22 bp, Artificial Sequence
  chemically synthesized
agttacttgagcaatattttgt

SEQ ID NO: 1132860 - DNA, 22 bp, Artificial Sequence
  chemically synthesized
aactgagaattacaaaatattg

SEQ ID NO: 1132861 - DNA, 22 bp, Artificial Sequence
  chemically synthesized
tgagttacttgagcaatatttt

SEQ ID NO: 1132862 - DNA, 22 bp, Artificial Sequence
  chemically synthesized
agaattacaaaatattgctcaa

SEQ ID NO: 1132863 - DNA, 22 bp, Artificial Sequence
  chemically synthesized
tctctgagttacttgagcaata

SEQ ID NO: 1132864 - DNA, 22 bp, Artificial Sequence
  chemically synthesized
caaaatattgctcaagtaactc

SEQ ID NO: 1132865 - DNA, 22 bp, Artificial Sequence
  chemically synthesized
tgtgttatctctgagttacttg

SEQ ID NO: 1132866 - DNA, 22 bp, Artificial Sequence
  chemically synthesized
gtgtgttatctctgagttactt

SEQ ID NO: 1132867 - DNA, 22 bp, Artificial Sequence
  chemically synthesized
tgtgtgttatctctgagttact

SEQ ID NO: 1132868 - DNA, 22 bp, Artificial Sequence
  chemically synthesized
ttgtgtgttatctctgagttac

SEQ ID NO: 1132869 - DNA, 22 bp, Artificial Sequence
  chemically synthesized
tttgtgtgttatctctgagtta

SEQ ID NO: 1132870 - DNA, 22 bp, Artificial Sequence
  chemically synthesized
cattttttgtgtgttatctctg

SEQ ID NO: 1132871 - DNA, 22 bp, Artificial Sequence
  chemically synthesized
ctcaagtaactcagagataaca

SEQ ID NO: 1132872 - DNA, 22 bp, Artificial Sequence
  chemically synthesized
ccattttttgtgtgttatctct

SEQ ID NO: 1132873 - DNA, 22 bp, Artificial Sequence
  chemically synthesized
tccattttttgtgtgttatctc

SEQ ID NO: 1132874 - DNA, 22 bp, Artificial Sequence
  chemically synthesized
ttccattttttgtgtgttatct

SEQ ID NO: 1132875 - DNA, 22 bp, Artificial Sequence
  chemically synthesized
aagtaactcagagataacacac

SEQ ID NO: 1132876 - DNA, 22 bp, Artificial Sequence
  chemically synthesized
agagataacacacaaaaaatgg

SEQ ID NO: 1132877 - DNA, 22 bp, Artificial Sequence
  chemically synthesized
catgagcatagaatatttttcc

SEQ ID NO: 1132878 - DNA, 22 bp, Artificial Sequence
  chemically synthesized
ccatgagcatagaatatttttc

SEQ ID NO: 1132879 - DNA, 22 bp, Artificial Sequence
  chemically synthesized
ttccatgagcatagaatatttt

SEQ ID NO: 1132880 - DNA, 22 bp, Artificial Sequence
  chemically synthesized
attcttccatgagcatagaata

SEQ ID NO: 1132881 - DNA, 22 bp, Artificial Sequence
  chemically synthesized
tcaatattgattcttccatgag

SEQ ID NO: 1132882 - DNA, 22 bp, Artificial Sequence
  chemically synthesized
tgtcaatattgattcttccatg

SEQ ID NO: 1132883 - DNA, 22 bp, Artificial Sequence
  chemically synthesized
tatgctcatggaagaatcaata

SEQ ID NO: 1132884 - DNA, 22 bp, Artificial Sequence
  chemically synthesized
tgctcatggaagaatcaatatt

SEQ ID NO: 1132885 - DNA, 22 bp, Artificial Sequence
  chemically synthesized
tggccattctgtcaatattgat

SEQ ID NO: 1132886 - DNA, 22 bp, Artificial Sequence
  chemically synthesized
atggaagaatcaatattgacag

SEQ ID NO: 1132887 - DNA, 22 bp, Artificial Sequence
  chemically synthesized
ggcattatggccattctgtcaa

SEQ ID NO: 1132888 - DNA, 22 bp, Artificial Sequence
  chemically synthesized
aggcattatggccattctgtca

SEQ ID NO: 1132889 - DNA, 22 bp, Artificial Sequence
  chemically synthesized
taggcattatggccattctgtc

SEQ ID NO: 1132890 - DNA, 22 bp, Artificial Sequence
  chemically synthesized
aaaagtgctttaggcattatgg

SEQ ID NO: 1132891 - DNA, 22 bp, Artificial Sequence
  chemically synthesized
acagaatggccataatgcctaa

SEQ ID NO: 1132892 - DNA, 22 bp, Artificial Sequence
  chemically synthesized
aattaaaaagtgctttaggcat

SEQ ID NO: 1132893 - DNA, 22 bp, Artificial Sequence
  chemically synthesized
ggaatagcattgaattaaaaag

SEQ ID NO: 1132894 - DNA, 22 bp, Artificial Sequence
  chemically synthesized
gggaatagcattgaattaaaaa

SEQ ID NO: 1132895 - DNA, 22 bp, Artificial Sequence
  chemically synthesized
tgggaatagcattgaattaaaa

SEQ ID NO: 1132896 - DNA, 22 bp, Artificial Sequence
  chemically synthesized
ttgggaatagcattgaattaaa

SEQ ID NO: 1132897 - DNA, 22 bp, Artificial Sequence
  chemically synthesized
tttgggaatagcattgaattaa

SEQ ID NO: 1132898 - DNA, 22 bp, Artificial Sequence
  chemically synthesized
aagcactttttaattcaatgct

SEQ ID NO: 1132899 - DNA, 22 bp, Artificial Sequence
  chemically synthesized
gtagttttttgggaatagcatt

SEQ ID NO: 1132900 - DNA, 22 bp, Artificial Sequence
  chemically synthesized
ttggtagttttttgggaatagc

SEQ ID NO: 1132901 - DNA, 22 bp, Artificial Sequence
  chemically synthesized
tttaattcaatgctattcccaa

SEQ ID NO: 1132902 - DNA, 22 bp, Artificial Sequence
  chemically synthesized
ttaattcaatgctattcccaaa

SEQ ID NO: 1132903 - DNA, 22 bp, Artificial Sequence
  chemically synthesized
taattcaatgctattcccaaaa

SEQ ID NO: 1132904 - DNA, 22 bp, Artificial Sequence
  chemically synthesized
aattcaatgctattcccaaaaa

SEQ ID NO: 1132905 - DNA, 22 bp, Artificial Sequence
  chemically synthesized
attcaatgctattcccaaaaaa

SEQ ID NO: 1132906 - DNA, 22 bp, Artificial Sequence
  chemically synthesized
aatgctattcccaaaaaactac

SEQ ID NO: 1132907 - DNA, 22 bp, Artificial Sequence
  chemically synthesized
agtgaagaatgttattggtagt

SEQ ID NO: 1132908 - DNA, 22 bp, Artificial Sequence
  chemically synthesized
ttcccaaaaaactaccaataac

SEQ ID NO: 1132909 - DNA, 22 bp, Artificial Sequence
  chemically synthesized
ttcagtgaagaatgttattggt

SEQ ID NO: 1132910 - DNA, 22 bp, Artificial Sequence
  chemically synthesized
attcagtgaagaatgttattgg

SEQ ID NO: 1132911 - DNA, 22 bp, Artificial Sequence
  chemically synthesized
ccaaaaaactaccaataacatt

SEQ ID NO: 1132912 - DNA, 22 bp, Artificial Sequence
  chemically synthesized
ttattcagtgaagaatgttatt

SEQ ID NO: 1132913 - DNA, 22 bp, Artificial Sequence
  chemically synthesized
cttattcagtgaagaatgttat

SEQ ID NO: 1132914 - DNA, 22 bp, Artificial Sequence
  chemically synthesized
tcttattcagtgaagaatgtta

SEQ ID NO: 1132915 - DNA, 22 bp, Artificial Sequence
  chemically synthesized
ttcttattcagtgaagaatgtt

SEQ ID NO: 1132916 - DNA, 22 bp, Artificial Sequence
  chemically synthesized
tttcttattcagtgaagaatgt

SEQ ID NO: 1132917 - DNA, 22 bp, Artificial Sequence
  chemically synthesized
ccaataacattcttcactgaat

SEQ ID NO: 1132918 - DNA, 22 bp, Artificial Sequence
  chemically synthesized
aatagtctttttcttattcagt

SEQ ID NO: 1132919 - DNA, 22 bp, Artificial Sequence
  chemically synthesized
aaatagtctttttcttattcag

SEQ ID NO: 1132920 - DNA, 22 bp, Artificial Sequence
  chemically synthesized
taaatagtctttttcttattca

SEQ ID NO: 1132921 - DNA, 22 bp, Artificial Sequence
  chemically synthesized
ttaaatagtctttttcttattc

SEQ ID NO: 1132922 - DNA, 22 bp, Artificial Sequence
  chemically synthesized
aatttttaaatagtctttttct

SEQ ID NO: 1132923 - DNA, 22 bp, Artificial Sequence
  chemically synthesized
ttcactgaataagaaaaagact

SEQ ID NO: 1132924 - DNA, 22 bp, Artificial Sequence
  chemically synthesized
cactgaataagaaaaagactat

SEQ ID NO: 1132925 - DNA, 22 bp, Artificial Sequence
  chemically synthesized
actgaataagaaaaagactatt

SEQ ID NO: 1132926 - DNA, 22 bp, Artificial Sequence
  chemically synthesized
caactgaatttttaaatagtct

SEQ ID NO: 1132927 - DNA, 22 bp, Artificial Sequence
  chemically synthesized
aataagaaaaagactatttaaa

SEQ ID NO: 1132928 - DNA, 22 bp, Artificial Sequence
  chemically synthesized
gtggctccaactgaatttttaa

SEQ ID NO: 1132929 - DNA, 22 bp, Artificial Sequence
  chemically synthesized
agtggctccaactgaattttta

SEQ ID NO: 1132930 - DNA, 22 bp, Artificial Sequence
  chemically synthesized
tagtggctccaactgaattttt

SEQ ID NO: 1132931 - DNA, 22 bp, Artificial Sequence
  chemically synthesized
ttagtggctccaactgaatttt

SEQ ID NO: 1132932 - DNA, 22 bp, Artificial Sequence
  chemically synthesized
ttttagtggctccaactgaatt

SEQ ID NO: 1132933 - DNA, 22 bp, Artificial Sequence
  chemically synthesized
gctcttttagtggctccaactg

SEQ ID NO: 1132934 - DNA, 22 bp, Artificial Sequence
  chemically synthesized
tttaaaaattcagttggagcca

SEQ ID NO: 1132935 - DNA, 22 bp, Artificial Sequence
  chemically synthesized
tggctcttttagtggctccaac

SEQ ID NO: 1132936 - DNA, 22 bp, Artificial Sequence
  chemically synthesized
aaaaattcagttggagccacta

SEQ ID NO: 1132937 - DNA, 22 bp, Artificial Sequence
  chemically synthesized
ttctggctcttttagtggctcc

SEQ ID NO: 1132938 - DNA, 22 bp, Artificial Sequence
  chemically synthesized
aaaattcagttggagccactaa

SEQ ID NO: 1132939 - DNA, 22 bp, Artificial Sequence
  chemically synthesized
gctattctggctcttttagtgg

SEQ ID NO: 1132940 - DNA, 22 bp, Artificial Sequence
  chemically synthesized
ggctattctggctcttttagtg

SEQ ID NO: 1132941 - DNA, 22 bp, Artificial Sequence
  chemically synthesized
agttggagccactaaaagagcc

SEQ ID NO: 1132942 - DNA, 22 bp, Artificial Sequence
  chemically synthesized
ccttggctattctggctctttt

SEQ ID NO: 1132943 - DNA, 22 bp, Artificial Sequence
  chemically synthesized
gagccactaaaagagccagaat

SEQ ID NO: 1132944 - DNA, 22 bp, Artificial Sequence
  chemically synthesized
ggattaccttggctattctggc

SEQ ID NO: 1132945 - DNA, 22 bp, Artificial Sequence
  chemically synthesized
aggattaccttggctattctgg

SEQ ID NO: 1132946 - DNA, 22 bp, Artificial Sequence
  chemically synthesized
cttaggattaccttggctattc

SEQ ID NO: 1132947 - DNA, 22 bp, Artificial Sequence
  chemically synthesized
gcttaggattaccttggctatt

SEQ ID NO: 1132948 - DNA, 22 bp, Artificial Sequence
  chemically synthesized
tgcttaggattaccttggctat

SEQ ID NO: 1132949 - DNA, 22 bp, Artificial Sequence
  chemically synthesized
aaagagccagaatagccaaggt

SEQ ID NO: 1132950 - DNA, 22 bp, Artificial Sequence
  chemically synthesized
ttgcttaggattaccttggcta

SEQ ID NO: 1132951 - DNA, 22 bp, Artificial Sequence
  chemically synthesized
tttgcttaggattaccttggct

SEQ ID NO: 1132952 - DNA, 22 bp, Artificial Sequence
  chemically synthesized
tttttgcttaggattaccttgg

SEQ ID NO: 1132953 - DNA, 22 bp, Artificial Sequence
  chemically synthesized
ctttttgcttaggattaccttg

SEQ ID NO: 1132954 - DNA, 22 bp, Artificial Sequence
  chemically synthesized
tctttttgcttaggattacctt

SEQ ID NO: 1132955 - DNA, 22 bp, Artificial Sequence
  chemically synthesized
ttctttttgcttaggattacct

SEQ ID NO: 1132956 - DNA, 22 bp, Artificial Sequence
  chemically synthesized
tttctttttgcttaggattacc

SEQ ID NO: 1132957 - DNA, 22 bp, Artificial Sequence
  chemically synthesized
ttttctttttgcttaggattac

SEQ ID NO: 1132958 - DNA, 22 bp, Artificial Sequence
  chemically synthesized
cagcttttttctttttgcttag

SEQ ID NO: 1132959 - DNA, 22 bp, Artificial Sequence
  chemically synthesized
agcaaaaagaaaaaagctggaa

SEQ ID NO: 1132960 - DNA, 22 bp, Artificial Sequence
  chemically synthesized
cagtcaggcaatgggatggttc

SEQ ID NO: 1132961 - DNA, 22 bp, Artificial Sequence
  chemically synthesized
gcagtcaggcaatgggatggtt

SEQ ID NO: 1132962 - DNA, 22 bp, Artificial Sequence
  chemically synthesized
gaaccatcccattgcctgactg

SEQ ID NO: 1132963 - DNA, 22 bp, Artificial Sequence
  chemically synthesized
tagtatagtttgcagtcaggca

SEQ ID NO: 1132964 - DNA, 22 bp, Artificial Sequence
  chemically synthesized
gtagtatagtttgcagtcaggc

SEQ ID NO: 1132965 - DNA, 22 bp, Artificial Sequence
  chemically synthesized
tatccttgtagtatagtttgca

SEQ ID NO: 1132966 - DNA, 22 bp, Artificial Sequence
  chemically synthesized
ctatatccttgtagtatagttt

SEQ ID NO: 1132967 - DNA, 22 bp, Artificial Sequence
  chemically synthesized
cctgactgcaaactatactaca

SEQ ID NO: 1132968 - DNA, 22 bp, Artificial Sequence
  chemically synthesized
gttactatatccttgtagtata

SEQ ID NO: 1132969 - DNA, 22 bp, Artificial Sequence
  chemically synthesized
ggttactatatccttgtagtat

SEQ ID NO: 1132970 - DNA, 22 bp, Artificial Sequence
  chemically synthesized
tggttactatatccttgtagta

SEQ ID NO: 1132971 - DNA, 22 bp, Artificial Sequence
  chemically synthesized
actgcaaactatactacaagga

SEQ ID NO: 1132972 - DNA, 22 bp, Artificial Sequence
  chemically synthesized
ttttggttactatatccttgta

SEQ ID NO: 1132973 - DNA, 22 bp, Artificial Sequence
  chemically synthesized
caaactatactacaaggatata

SEQ ID NO: 1132974 - DNA, 22 bp, Artificial Sequence
  chemically synthesized
tactacaaggatatagtaacca

SEQ ID NO: 1132975 - DNA, 22 bp, Artificial Sequence
  chemically synthesized
taccatgctgttttggttacta

SEQ ID NO: 1132976 - DNA, 22 bp, Artificial Sequence
  chemically synthesized
gtaccatgctgttttggttact

SEQ ID NO: 1132977 - DNA, 22 bp, Artificial Sequence
  chemically synthesized
tgtaccatgctgttttggttac

SEQ ID NO: 1132978 - DNA, 22 bp, Artificial Sequence
  chemically synthesized
ttgtaccatgctgttttggtta

SEQ ID NO: 1132979 - DNA, 22 bp, Artificial Sequence
  chemically synthesized
caaggatatagtaaccaaaaca

SEQ ID NO: 1132980 - DNA, 22 bp, Artificial Sequence
  chemically synthesized
tttgtaccatgctgttttggtt

SEQ ID NO: 1132981 - DNA, 22 bp, Artificial Sequence
  chemically synthesized
ttttttgtaccatgctgttttg

SEQ ID NO: 1132982 - DNA, 22 bp, Artificial Sequence
  chemically synthesized
tgtgtctgttttttgtaccatg

SEQ ID NO: 1132983 - DNA, 22 bp, Artificial Sequence
  chemically synthesized
atgtgtctgttttttgtaccat

SEQ ID NO: 1132984 - DNA, 22 bp, Artificial Sequence
  chemically synthesized
gtttatgtgtctgttttttgta

SEQ ID NO: 1132985 - DNA, 22 bp, Artificial Sequence
  chemically synthesized
cattggtttatgtgtctgtttt

SEQ ID NO: 1132986 - DNA, 22 bp, Artificial Sequence
  chemically synthesized
ccattggtttatgtgtctgttt

SEQ ID NO: 1132987 - DNA, 22 bp, Artificial Sequence
  chemically synthesized
tccattggtttatgtgtctgtt

SEQ ID NO: 1132988 - DNA, 22 bp, Artificial Sequence
  chemically synthesized
ttccattggtttatgtgtctgt

SEQ ID NO: 1132989 - DNA, 22 bp, Artificial Sequence
  chemically synthesized
ttttccattggtttatgtgtct

SEQ ID NO: 1132990 - DNA, 22 bp, Artificial Sequence
  chemically synthesized
ttcttttccattggtttatgtg

SEQ ID NO: 1132991 - DNA, 22 bp, Artificial Sequence
  chemically synthesized
tattcttttccattggtttatg

SEQ ID NO: 1132992 - DNA, 22 bp, Artificial Sequence
  chemically synthesized
tctattcttttccattggttta

SEQ ID NO: 1132993 - DNA, 22 bp, Artificial Sequence
  chemically synthesized
gactctctattcttttccattg

SEQ ID NO: 1132994 - DNA, 22 bp, Artificial Sequence
  chemically synthesized
tcgactctctattcttttccat

SEQ ID NO: 1132995 - DNA, 22 bp, Artificial Sequence
  chemically synthesized
ctcgactctctattcttttcca

SEQ ID NO: 1132996 - DNA, 22 bp, Artificial Sequence
  chemically synthesized
tttctcgactctctattctttt

SEQ ID NO: 1132997 - DNA, 22 bp, Artificial Sequence
  chemically synthesized
atttctcgactctctattcttt

SEQ ID NO: 1132998 - DNA, 22 bp, Artificial Sequence
  chemically synthesized
taggtgtgcagccttatttctc

SEQ ID NO: 1132999 - DNA, 22 bp, Artificial Sequence
  chemically synthesized
aagaacagatggttgtaggtgt

SEQ ID NO: 1133000 - DNA, 22 bp, Artificial Sequence
  chemically synthesized
attgaagaacagatggttgtag

SEQ ID NO: 1133001 - DNA, 22 bp, Artificial Sequence
  chemically synthesized
cattgaagaacagatggttgta

SEQ ID NO: 1133002 - DNA, 22 bp, Artificial Sequence
  chemically synthesized
atttcattgaagaacagatggt

SEQ ID NO: 1133003 - DNA, 22 bp, Artificial Sequence
  chemically synthesized
cacacctacaaccatctgttct

SEQ ID NO: 1133004 - DNA, 22 bp, Artificial Sequence
  chemically synthesized
ttgatttcattgaagaacagat

SEQ ID NO: 1133005 - DNA, 22 bp, Artificial Sequence
  chemically synthesized
gttgatttcattgaagaacaga

SEQ ID NO: 1133006 - DNA, 22 bp, Artificial Sequence
  chemically synthesized
tgttgatttcattgaagaacag

SEQ ID NO: 1133007 - DNA, 22 bp, Artificial Sequence
  chemically synthesized
ttgttgatttcattgaagaaca

SEQ ID NO: 1133008 - DNA, 22 bp, Artificial Sequence
  chemically synthesized
tttttgttgatttcattgaaga

SEQ ID NO: 1133009 - DNA, 22 bp, Artificial Sequence
  chemically synthesized
caaccatctgttcttcaatgaa

SEQ ID NO: 1133010 - DNA, 22 bp, Artificial Sequence
  chemically synthesized
gtttttgttgatttcattgaag

SEQ ID NO: 1133011 - DNA, 22 bp, Artificial Sequence
  chemically synthesized
cttgtttttgttgatttcattg

SEQ ID NO: 1133012 - DNA, 22 bp, Artificial Sequence
  chemically synthesized
ccattgcttgtttttgttgatt

SEQ ID NO: 1133013 - DNA, 22 bp, Artificial Sequence
  chemically synthesized
ttcttcaatgaaatcaacaaaa

SEQ ID NO: 1133014 - DNA, 22 bp, Artificial Sequence
  chemically synthesized
cccattgcttgtttttgttgat

SEQ ID NO: 1133015 - DNA, 22 bp, Artificial Sequence
  chemically synthesized
tcccattgcttgtttttgttga

SEQ ID NO: 1133016 - DNA, 22 bp, Artificial Sequence
  chemically synthesized
ttcccattgcttgtttttgttg

SEQ ID NO: 1133017 - DNA, 22 bp, Artificial Sequence
  chemically synthesized
ttcaatgaaatcaacaaaaaca

SEQ ID NO: 1133018 - DNA, 22 bp, Artificial Sequence
  chemically synthesized
caatgaaatcaacaaaaacaag

SEQ ID NO: 1133019 - DNA, 22 bp, Artificial Sequence
  chemically synthesized
aatgaaatcaacaaaaacaagc

SEQ ID NO: 1133020 - DNA, 22 bp, Artificial Sequence
  chemically synthesized
tatatggtgtaaggaaggggtc

SEQ ID NO: 1133021 - DNA, 22 bp, Artificial Sequence
  chemically synthesized
cctattcattggaccccttcct

SEQ ID NO: 1133022 - DNA, 22 bp, Artificial Sequence
  chemically synthesized
gtatatggtgtaaggaaggggt

SEQ ID NO: 1133023 - DNA, 22 bp, Artificial Sequence
  chemically synthesized
tgtatatggtgtaaggaagggg

SEQ ID NO: 1133024 - DNA, 22 bp, Artificial Sequence
  chemically synthesized
ttgtatatggtgtaaggaaggg

SEQ ID NO: 1133025 - DNA, 22 bp, Artificial Sequence
  chemically synthesized
ttcattggaccccttccttaca

SEQ ID NO: 1133026 - DNA, 22 bp, Artificial Sequence
  chemically synthesized
atttttgtatatggtgtaagga

SEQ ID NO: 1133027 - DNA, 22 bp, Artificial Sequence
  chemically synthesized
attggaccccttccttacacca

SEQ ID NO: 1133028 - DNA, 22 bp, Artificial Sequence
  chemically synthesized
gaccccttccttacaccatata

SEQ ID NO: 1133029 - DNA, 22 bp, Artificial Sequence
  chemically synthesized
gggttaatttttgtatatggtg

SEQ ID NO: 1133030 - DNA, 22 bp, Artificial Sequence
  chemically synthesized
ccttacaccatatacaaaaatt

SEQ ID NO: 1133031 - DNA, 22 bp, Artificial Sequence
  chemically synthesized
cttacaccatatacaaaaatta

SEQ ID NO: 1133032 - DNA, 22 bp, Artificial Sequence
  chemically synthesized
atccacctcgggttaatttttg

SEQ ID NO: 1133033 - DNA, 22 bp, Artificial Sequence
  chemically synthesized
aatccacctcgggttaattttt

SEQ ID NO: 1133034 - DNA, 22 bp, Artificial Sequence
  chemically synthesized
acaccatatacaaaaattaacc

SEQ ID NO: 1133035 - DNA, 22 bp, Artificial Sequence
  chemically synthesized
taatccacctcgggttaatttt

SEQ ID NO: 1133036 - DNA, 22 bp, Artificial Sequence
  chemically synthesized
caccatatacaaaaattaaccc

SEQ ID NO: 1133037 - DNA, 22 bp, Artificial Sequence
  chemically synthesized
agtctttaatccacctcgggtt

SEQ ID NO: 1133038 - DNA, 22 bp, Artificial Sequence
  chemically synthesized
aagtctttaatccacctcgggt

SEQ ID NO: 1133039 - DNA, 22 bp, Artificial Sequence
  chemically synthesized
gatttaagtctttaatccacct

SEQ ID NO: 1133040 - DNA, 22 bp, Artificial Sequence
  chemically synthesized
agatttaagtctttaatccacc

SEQ ID NO: 1133041 - DNA, 22 bp, Artificial Sequence
  chemically synthesized
tagatttaagtctttaatccac

SEQ ID NO: 1133042 - DNA, 22 bp, Artificial Sequence
  chemically synthesized
gttttagatttaagtctttaat

SEQ ID NO: 1133043 - DNA, 22 bp, Artificial Sequence
  chemically synthesized
acccgaggtggattaaagactt

SEQ ID NO: 1133044 - DNA, 22 bp, Artificial Sequence
  chemically synthesized
ttggttttagatttaagtcttt

SEQ ID NO: 1133045 - DNA, 22 bp, Artificial Sequence
  chemically synthesized
tagttgttggttttagatttaa

SEQ ID NO: 1133046 - DNA, 22 bp, Artificial Sequence
  chemically synthesized
atagttgttggttttagattta

SEQ ID NO: 1133047 - DNA, 22 bp, Artificial Sequence
  chemically synthesized
tatagttgttggttttagattt

SEQ ID NO: 1133048 - DNA, 22 bp, Artificial Sequence
  chemically synthesized
ttatagttgttggttttagatt

SEQ ID NO: 1133049 - DNA, 22 bp, Artificial Sequence
  chemically synthesized
aagacttaaatctaaaaccaac

SEQ ID NO: 1133050 - DNA, 22 bp, Artificial Sequence
  chemically synthesized
ggtttttatagttgttggtttt

SEQ ID NO: 1133051 - DNA, 22 bp, Artificial Sequence
  chemically synthesized
aggtttttatagttgttggttt

SEQ ID NO: 1133052 - DNA, 22 bp, Artificial Sequence
  chemically synthesized
ttaggtttttatagttgttggt

SEQ ID NO: 1133053 - DNA, 22 bp, Artificial Sequence
  chemically synthesized
cttaggtttttatagttgttgg

SEQ ID NO: 1133054 - DNA, 22 bp, Artificial Sequence
  chemically synthesized
aaatctaaaaccaacaactata

SEQ ID NO: 1133055 - DNA, 22 bp, Artificial Sequence
  chemically synthesized
aatctaaaaccaacaactataa

SEQ ID NO: 1133056 - DNA, 22 bp, Artificial Sequence
  chemically synthesized
tcttcttaggtttttatagttg

SEQ ID NO: 1133057 - DNA, 22 bp, Artificial Sequence
  chemically synthesized
aaaccaacaactataaaaacct

SEQ ID NO: 1133058 - DNA, 22 bp, Artificial Sequence
  chemically synthesized
ggttatcttcttaggtttttat

SEQ ID NO: 1133059 - DNA, 22 bp, Artificial Sequence
  chemically synthesized
cctgggttatcttcttaggttt

SEQ ID NO: 1133060 - DNA, 22 bp, Artificial Sequence
  chemically synthesized
taaaaacctaagaagataaccc

SEQ ID NO: 1133061 - DNA, 22 bp, Artificial Sequence
  chemically synthesized
agaagataacccaggtaatgcc

SEQ ID NO: 1133062 - DNA, 22 bp, Artificial Sequence
  chemically synthesized
aatgtccagagtggcattacct

SEQ ID NO: 1133063 - DNA, 22 bp, Artificial Sequence
  chemically synthesized
caatgtccagagtggcattacc

SEQ ID NO: 1133064 - DNA, 22 bp, Artificial Sequence
  chemically synthesized
cagtttcaatgtccagagtggc

SEQ ID NO: 1133065 - DNA, 22 bp, Artificial Sequence
  chemically synthesized
gcagtttcaatgtccagagtgg

SEQ ID NO: 1133066 - DNA, 22 bp, Artificial Sequence
  chemically synthesized
tgcagtttcaatgtccagagtg

SEQ ID NO: 1133067 - DNA, 22 bp, Artificial Sequence
  chemically synthesized
tgaagtctttgcagtttcaatg

SEQ ID NO: 1133068 - DNA, 22 bp, Artificial Sequence
  chemically synthesized
ttatgaagtctttgcagtttca

SEQ ID NO: 1133069 - DNA, 22 bp, Artificial Sequence
  chemically synthesized
gttatgaagtctttgcagtttc

SEQ ID NO: 1133070 - DNA, 22 bp, Artificial Sequence
  chemically synthesized
tgttatgaagtctttgcagttt

SEQ ID NO: 1133071 - DNA, 22 bp, Artificial Sequence
  chemically synthesized
tggacattgaaactgcaaagac

SEQ ID NO: 1133072 - DNA, 22 bp, Artificial Sequence
  chemically synthesized
gacattgaaactgcaaagactt

SEQ ID NO: 1133073 - DNA, 22 bp, Artificial Sequence
  chemically synthesized
gtgtctttgttatgaagtcttt

SEQ ID NO: 1133074 - DNA, 22 bp, Artificial Sequence
  chemically synthesized
ggtgtctttgttatgaagtctt

SEQ ID NO: 1133075 - DNA, 22 bp, Artificial Sequence
  chemically synthesized
tggtgtctttgttatgaagtct

SEQ ID NO: 1133076 - DNA, 22 bp, Artificial Sequence
  chemically synthesized
ttggtgtctttgttatgaagtc

SEQ ID NO: 1133077 - DNA, 22 bp, Artificial Sequence
  chemically synthesized
aaactgcaaagacttcataaca

SEQ ID NO: 1133078 - DNA, 22 bp, Artificial Sequence
  chemically synthesized
tttttggtgtctttgttatgaa

SEQ ID NO: 1133079 - DNA, 22 bp, Artificial Sequence
  chemically synthesized
caaagacttcataacaaagaca

SEQ ID NO: 1133080 - DNA, 22 bp, Artificial Sequence
  chemically synthesized
aattgtttttggtgtctttgtt

SEQ ID NO: 1133081 - DNA, 22 bp, Artificial Sequence
  chemically synthesized
caattgtttttggtgtctttgt

SEQ ID NO: 1133082 - DNA, 22 bp, Artificial Sequence
  chemically synthesized
tttcaattgtttttggtgtctt

SEQ ID NO: 1133083 - DNA, 22 bp, Artificial Sequence
  chemically synthesized
gtttcaattgtttttggtgtct

SEQ ID NO: 1133084 - DNA, 22 bp, Artificial Sequence
  chemically synthesized
tgtttcaattgtttttggtgtc

SEQ ID NO: 1133085 - DNA, 22 bp, Artificial Sequence
  chemically synthesized
ttgtttcaattgtttttggtgt

SEQ ID NO: 1133086 - DNA, 22 bp, Artificial Sequence
  chemically synthesized
cataacaaagacaccaaaaaca

SEQ ID NO: 1133087 - DNA, 22 bp, Artificial Sequence
  chemically synthesized
ataacaaagacaccaaaaacaa

SEQ ID NO: 1133088 - DNA, 22 bp, Artificial Sequence
  chemically synthesized
tttttgtttcaattgtttttgg

SEQ ID NO: 1133089 - DNA, 22 bp, Artificial Sequence
  chemically synthesized
gtttttgtttcaattgtttttg

SEQ ID NO: 1133090 - DNA, 22 bp, Artificial Sequence
  chemically synthesized
tgtttttgtttcaattgttttt

SEQ ID NO: 1133091 - DNA, 22 bp, Artificial Sequence
  chemically synthesized
ttgtttttgtttcaattgtttt

SEQ ID NO: 1133092 - DNA, 22 bp, Artificial Sequence
  chemically synthesized
aatttttgtttttgtttcaatt

SEQ ID NO: 1133093 - DNA, 22 bp, Artificial Sequence
  chemically synthesized
caatttttgtttttgtttcaat

SEQ ID NO: 1133094 - DNA, 22 bp, Artificial Sequence
  chemically synthesized
tcaatttttgtttttgtttcaa

SEQ ID NO: 1133095 - DNA, 22 bp, Artificial Sequence
  chemically synthesized
ggtcccagttttcaatttttgt

SEQ ID NO: 1133096 - DNA, 22 bp, Artificial Sequence
  chemically synthesized
aaacaaaaacaaaaattgaaaa

SEQ ID NO: 1133097 - DNA, 22 bp, Artificial Sequence
  chemically synthesized
attaggtcccagttttcaattt

SEQ ID NO: 1133098 - DNA, 22 bp, Artificial Sequence
  chemically synthesized
aattaggtcccagttttcaatt

SEQ ID NO: 1133099 - DNA, 22 bp, Artificial Sequence
  chemically synthesized
gtttaattaggtcccagttttc

SEQ ID NO: 1133100 - DNA, 22 bp, Artificial Sequence
  chemically synthesized
agtttaattaggtcccagtttt

SEQ ID NO: 1133101 - DNA, 22 bp, Artificial Sequence
  chemically synthesized
tagtttaattaggtcccagttt

SEQ ID NO: 1133102 - DNA, 22 bp, Artificial Sequence
  chemically synthesized
tttagtttaattaggtcccagt

SEQ ID NO: 1133103 - DNA, 22 bp, Artificial Sequence
  chemically synthesized
aaaactgggacctaattaaact

SEQ ID NO: 1133104 - DNA, 22 bp, Artificial Sequence
  chemically synthesized
tgtagaagttctttagtttaat

SEQ ID NO: 1133105 - DNA, 22 bp, Artificial Sequence
  chemically synthesized
ttgtgtagaagttctttagttt

SEQ ID NO: 1133106 - DNA, 22 bp, Artificial Sequence
  chemically synthesized
gttgtgtagaagttctttagtt

SEQ ID NO: 1133107 - DNA, 22 bp, Artificial Sequence
  chemically synthesized
ggacctaattaaactaaagaac

SEQ ID NO: 1133108 - DNA, 22 bp, Artificial Sequence
  chemically synthesized
tgttgtgtagaagttctttagt

SEQ ID NO: 1133109 - DNA, 22 bp, Artificial Sequence
  chemically synthesized
ttgttgtgtagaagttctttag

SEQ ID NO: 1133110 - DNA, 22 bp, Artificial Sequence
  chemically synthesized
ttttgttgtgtagaagttcttt

SEQ ID NO: 1133111 - DNA, 22 bp, Artificial Sequence
  chemically synthesized
cttttgttgtgtagaagttctt

SEQ ID NO: 1133112 - DNA, 22 bp, Artificial Sequence
  chemically synthesized
attaaactaaagaacttctaca

SEQ ID NO: 1133113 - DNA, 22 bp, Artificial Sequence
  chemically synthesized
aactaaagaacttctacacaac

SEQ ID NO: 1133114 - DNA, 22 bp, Artificial Sequence
  chemically synthesized
atagtttcttttgttgtgtaga

SEQ ID NO: 1133115 - DNA, 22 bp, Artificial Sequence
  chemically synthesized
ttgatagtttcttttgttgtgt

SEQ ID NO: 1133116 - DNA, 22 bp, Artificial Sequence
  chemically synthesized
aagaacttctacacaacaaaag

SEQ ID NO: 1133117 - DNA, 22 bp, Artificial Sequence
  chemically synthesized
tgttgatagtttcttttgttgt

SEQ ID NO: 1133118 - DNA, 22 bp, Artificial Sequence
  chemically synthesized
ctctgttgatagtttcttttgt

SEQ ID NO: 1133119 - DNA, 22 bp, Artificial Sequence
  chemically synthesized
actctgttgatagtttcttttg

SEQ ID NO: 1133120 - DNA, 22 bp, Artificial Sequence
  chemically synthesized
tttactctgttgatagtttctt

SEQ ID NO: 1133121 - DNA, 22 bp, Artificial Sequence
  chemically synthesized
ctacacaacaaaagaaactatc

SEQ ID NO: 1133122 - DNA, 22 bp, Artificial Sequence
  chemically synthesized
tacacaacaaaagaaactatca

SEQ ID NO: 1133123 - DNA, 22 bp, Artificial Sequence
  chemically synthesized
cacaacaaaagaaactatcaac

SEQ ID NO: 1133124 - DNA, 22 bp, Artificial Sequence
  chemically synthesized
tctgtttactctgttgatagtt

SEQ ID NO: 1133125 - DNA, 22 bp, Artificial Sequence
  chemically synthesized
caggttgtctgtttactctgtt

SEQ ID NO: 1133126 - DNA, 22 bp, Artificial Sequence
  chemically synthesized
tgcaggttgtctgtttactctg

SEQ ID NO: 1133127 - DNA, 22 bp, Artificial Sequence
  chemically synthesized
ccattctgcaggttgtctgttt

SEQ ID NO: 1133128 - DNA, 22 bp, Artificial Sequence
  chemically synthesized
tcaacagagtaaacagacaacc

SEQ ID NO: 1133129 - DNA, 22 bp, Artificial Sequence
  chemically synthesized
tcccattctgcaggttgtctgt

SEQ ID NO: 1133130 - DNA, 22 bp, Artificial Sequence
  chemically synthesized
ctcccattctgcaggttgtctg

SEQ ID NO: 1133131 - DNA, 22 bp, Artificial Sequence
  chemically synthesized
tctcccattctgcaggttgtct

SEQ ID NO: 1133132 - DNA, 22 bp, Artificial Sequence
  chemically synthesized
ttctcccattctgcaggttgtc

SEQ ID NO: 1133133 - DNA, 22 bp, Artificial Sequence
  chemically synthesized
caaaatttttctcccattctgc

SEQ ID NO: 1133134 - DNA, 22 bp, Artificial Sequence
  chemically synthesized
gcaaaatttttctcccattctg

SEQ ID NO: 1133135 - DNA, 22 bp, Artificial Sequence
  chemically synthesized
cagaatgggagaaaaattttgc

SEQ ID NO: 1133136 - DNA, 22 bp, Artificial Sequence
  chemically synthesized
tcagatggaaagtttgcaaaat

SEQ ID NO: 1133137 - DNA, 22 bp, Artificial Sequence
  chemically synthesized
gtcagatggaaagtttgcaaaa

SEQ ID NO: 1133138 - DNA, 22 bp, Artificial Sequence
  chemically synthesized
gacccttgtcagatggaaagtt

SEQ ID NO: 1133139 - DNA, 22 bp, Artificial Sequence
  chemically synthesized
tgcaaactttccatctgacaag

SEQ ID NO: 1133140 - DNA, 22 bp, Artificial Sequence
  chemically synthesized
gcaaactttccatctgacaagg

SEQ ID NO: 1133141 - DNA, 22 bp, Artificial Sequence
  chemically synthesized
cagatattagacccttgtcaga

SEQ ID NO: 1133142 - DNA, 22 bp, Artificial Sequence
  chemically synthesized
caaactttccatctgacaaggg

SEQ ID NO: 1133143 - DNA, 22 bp, Artificial Sequence
  chemically synthesized
tagattccagatattagaccct

SEQ ID NO: 1133144 - DNA, 22 bp, Artificial Sequence
  chemically synthesized
tccatctgacaagggtctaata

SEQ ID NO: 1133145 - DNA, 22 bp, Artificial Sequence
  chemically synthesized
gtagattccagatattagaccc

SEQ ID NO: 1133146 - DNA, 22 bp, Artificial Sequence
  chemically synthesized
ccatctgacaagggtctaatat

SEQ ID NO: 1133147 - DNA, 22 bp, Artificial Sequence
  chemically synthesized
catctgacaagggtctaatatc

SEQ ID NO: 1133148 - DNA, 22 bp, Artificial Sequence
  chemically synthesized
cttgtagattccagatattaga

SEQ ID NO: 1133149 - DNA, 22 bp, Artificial Sequence
  chemically synthesized
acaagggtctaatatctggaat

SEQ ID NO: 1133150 - DNA, 22 bp, Artificial Sequence
  chemically synthesized
agttccttgtagattccagata

SEQ ID NO: 1133151 - DNA, 22 bp, Artificial Sequence
  chemically synthesized
aagttccttgtagattccagat

SEQ ID NO: 1133152 - DNA, 22 bp, Artificial Sequence
  chemically synthesized
taaatttaagttccttgtagat

SEQ ID NO: 1133153 - DNA, 22 bp, Artificial Sequence
  chemically synthesized
gtaaatttaagttccttgtaga

SEQ ID NO: 1133154 - DNA, 22 bp, Artificial Sequence
  chemically synthesized
atatctggaatctacaaggaac

SEQ ID NO: 1133155 - DNA, 22 bp, Artificial Sequence
  chemically synthesized
cttgtaaatttaagttccttgt

SEQ ID NO: 1133156 - DNA, 22 bp, Artificial Sequence
  chemically synthesized
gcttgtaaatttaagttccttg

SEQ ID NO: 1133157 - DNA, 22 bp, Artificial Sequence
  chemically synthesized
tgcttgtaaatttaagttcctt

SEQ ID NO: 1133158 - DNA, 22 bp, Artificial Sequence
  chemically synthesized
ttgcttgtaaatttaagttcct

SEQ ID NO: 1133159 - DNA, 22 bp, Artificial Sequence
  chemically synthesized
gaatctacaaggaacttaaatt

SEQ ID NO: 1133160 - DNA, 22 bp, Artificial Sequence
  chemically synthesized
gtttttgcttgtaaatttaagt

SEQ ID NO: 1133161 - DNA, 22 bp, Artificial Sequence
  chemically synthesized
ggtttttgcttgtaaatttaag

SEQ ID NO: 1133162 - DNA, 22 bp, Artificial Sequence
  chemically synthesized
caaggaacttaaatttacaagc

SEQ ID NO: 1133163 - DNA, 22 bp, Artificial Sequence
  chemically synthesized
atggtgatgtttggtttttgct

SEQ ID NO: 1133164 - DNA, 22 bp, Artificial Sequence
  chemically synthesized
aatggtgatgtttggtttttgc

SEQ ID NO: 1133165 - DNA, 22 bp, Artificial Sequence
  chemically synthesized
taatggtgatgtttggtttttg

SEQ ID NO: 1133166 - DNA, 22 bp, Artificial Sequence
  chemically synthesized
aaatttacaagcaaaaaccaaa

SEQ ID NO: 1133167 - DNA, 22 bp, Artificial Sequence
  chemically synthesized
ttaatggtgatgtttggttttt

SEQ ID NO: 1133168 - DNA, 22 bp, Artificial Sequence
  chemically synthesized
aatttacaagcaaaaaccaaac

SEQ ID NO: 1133169 - DNA, 22 bp, Artificial Sequence
  chemically synthesized
tttaatggtgatgtttggtttt

SEQ ID NO: 1133170 - DNA, 22 bp, Artificial Sequence
  chemically synthesized
acaagcaaaaaccaaacatcac

SEQ ID NO: 1133171 - DNA, 22 bp, Artificial Sequence
  chemically synthesized
caagcaaaaaccaaacatcacc

SEQ ID NO: 1133172 - DNA, 22 bp, Artificial Sequence
  chemically synthesized
cccactttttaatggtgatgtt

SEQ ID NO: 1133173 - DNA, 22 bp, Artificial Sequence
  chemically synthesized
gcccactttttaatggtgatgt

SEQ ID NO: 1133174 - DNA, 22 bp, Artificial Sequence
  chemically synthesized
tgcccactttttaatggtgatg

SEQ ID NO: 1133175 - DNA, 22 bp, Artificial Sequence
  chemically synthesized
atgtcctttgcccactttttaa

SEQ ID NO: 1133176 - DNA, 22 bp, Artificial Sequence
  chemically synthesized
gaaagggttcatgtcctttgcc

SEQ ID NO: 1133177 - DNA, 22 bp, Artificial Sequence
  chemically synthesized
tggaaagggttcatgtcctttg

SEQ ID NO: 1133178 - DNA, 22 bp, Artificial Sequence
  chemically synthesized
ctggaaagggttcatgtccttt

SEQ ID NO: 1133179 - DNA, 22 bp, Artificial Sequence
  chemically synthesized
tctggaaagggttcatgtcctt

SEQ ID NO: 1133180 - DNA, 22 bp, Artificial Sequence
  chemically synthesized
aaaagtgggcaaaggacatgaa

SEQ ID NO: 1133181 - DNA, 22 bp, Artificial Sequence
  chemically synthesized
ttctggaaagggttcatgtcct

SEQ ID NO: 1133182 - DNA, 22 bp, Artificial Sequence
  chemically synthesized
tttctggaaagggttcatgtcc

SEQ ID NO: 1133183 - DNA, 22 bp, Artificial Sequence
  chemically synthesized
tatgtatgtctttttctggaaa

SEQ ID NO: 1133184 - DNA, 22 bp, Artificial Sequence
  chemically synthesized
tgtatgtatgtctttttctgga

SEQ ID NO: 1133185 - DNA, 22 bp, Artificial Sequence
  chemically synthesized
ctgtatgtatgtctttttctgg

SEQ ID NO: 1133186 - DNA, 22 bp, Artificial Sequence
  chemically synthesized
tctgtatgtatgtctttttctg

SEQ ID NO: 1133187 - DNA, 22 bp, Artificial Sequence
  chemically synthesized
tccagaaaaagacatacataca

SEQ ID NO: 1133188 - DNA, 22 bp, Artificial Sequence
  chemically synthesized
ccagaaaaagacatacatacag

SEQ ID NO: 1133189 - DNA, 22 bp, Artificial Sequence
  chemically synthesized
cagaaaaagacatacatacaga

SEQ ID NO: 1133190 - DNA, 22 bp, Artificial Sequence
  chemically synthesized
atatgaatgttttctgtatgta

SEQ ID NO: 1133191 - DNA, 22 bp, Artificial Sequence
  chemically synthesized
catatgaatgttttctgtatgt

SEQ ID NO: 1133192 - DNA, 22 bp, Artificial Sequence
  chemically synthesized
tcatatgaatgttttctgtatg

SEQ ID NO: 1133193 - DNA, 22 bp, Artificial Sequence
  chemically synthesized
ttcatatgaatgttttctgtat

SEQ ID NO: 1133194 - DNA, 22 bp, Artificial Sequence
  chemically synthesized
tttcatatgaatgttttctgta

SEQ ID NO: 1133195 - DNA, 22 bp, Artificial Sequence
  chemically synthesized
agcattttttcatatgaatgtt

SEQ ID NO: 1133196 - DNA, 22 bp, Artificial Sequence
  chemically synthesized
atgttcagcattttttcatatg

SEQ ID NO: 1133197 - DNA, 22 bp, Artificial Sequence
  chemically synthesized
ttgatgttcagcattttttcat

SEQ ID NO: 1133198 - DNA, 22 bp, Artificial Sequence
  chemically synthesized
atgattattgatgttcagcatt

SEQ ID NO: 1133199 - DNA, 22 bp, Artificial Sequence
  chemically synthesized
taatgattattgatgttcagca

SEQ ID NO: 1133200 - DNA, 22 bp, Artificial Sequence
  chemically synthesized
atatgaaaaaatgctgaacatc

SEQ ID NO: 1133201 - DNA, 22 bp, Artificial Sequence
  chemically synthesized
tctaatgattattgatgttcag

SEQ ID NO: 1133202 - DNA, 22 bp, Artificial Sequence
  chemically synthesized
ctctaatgattattgatgttca

SEQ ID NO: 1133203 - DNA, 22 bp, Artificial Sequence
  chemically synthesized
cacttctctaatgattattgat

SEQ ID NO: 1133204 - DNA, 22 bp, Artificial Sequence
  chemically synthesized
atctgcacttctctaatgatta

SEQ ID NO: 1133205 - DNA, 22 bp, Artificial Sequence
  chemically synthesized
gatctgcacttctctaatgatt

SEQ ID NO: 1133206 - DNA, 22 bp, Artificial Sequence
  chemically synthesized
tgatctgcacttctctaatgat

SEQ ID NO: 1133207 - DNA, 22 bp, Artificial Sequence
  chemically synthesized
aacatcaataatcattagagaa

SEQ ID NO: 1133208 - DNA, 22 bp, Artificial Sequence
  chemically synthesized
tggttttgatctgcacttctct

SEQ ID NO: 1133209 - DNA, 22 bp, Artificial Sequence
  chemically synthesized
ttgtggttttgatctgcacttc

SEQ ID NO: 1133210 - DNA, 22 bp, Artificial Sequence
  chemically synthesized
attgtggttttgatctgcactt

SEQ ID NO: 1133211 - DNA, 22 bp, Artificial Sequence
  chemically synthesized
gagaagtgcagatcaaaaccac

SEQ ID NO: 1133212 - DNA, 22 bp, Artificial Sequence
  chemically synthesized
gtgtcaaatggtatcttattgt

SEQ ID NO: 1133213 - DNA, 22 bp, Artificial Sequence
  chemically synthesized
actggtgtcaaatggtatctta

SEQ ID NO: 1133214 - DNA, 22 bp, Artificial Sequence
  chemically synthesized
tcactggtgtcaaatggtatct

SEQ ID NO: 1133215 - DNA, 22 bp, Artificial Sequence
  chemically synthesized
ataatagccattctcactggtg

SEQ ID NO: 1133216 - DNA, 22 bp, Artificial Sequence
  chemically synthesized
aataatagccattctcactggt

SEQ ID NO: 1133217 - DNA, 22 bp, Artificial Sequence
  chemically synthesized
ttaataatagccattctcactg

SEQ ID NO: 1133218 - DNA, 22 bp, Artificial Sequence
  chemically synthesized
cttaataatagccattctcact

SEQ ID NO: 1133219 - DNA, 22 bp, Artificial Sequence
  chemically synthesized
acttcttaataatagccattct

SEQ ID NO: 1133220 - DNA, 22 bp, Artificial Sequence
  chemically synthesized
gacttcttaataatagccattc

SEQ ID NO: 1133221 - DNA, 22 bp, Artificial Sequence
  chemically synthesized
gacaccagtgagaatggctatt

SEQ ID NO: 1133222 - DNA, 22 bp, Artificial Sequence
  chemically synthesized
tgacttcttaataatagccatt

SEQ ID NO: 1133223 - DNA, 22 bp, Artificial Sequence
  chemically synthesized
acaccagtgagaatggctatta

SEQ ID NO: 1133224 - DNA, 22 bp, Artificial Sequence
  chemically synthesized
ttgacttcttaataatagccat

SEQ ID NO: 1133225 - DNA, 22 bp, Artificial Sequence
  chemically synthesized
tttgacttcttaataatagcca

SEQ ID NO: 1133226 - DNA, 22 bp, Artificial Sequence
  chemically synthesized
tgattttttgacttcttaataa

SEQ ID NO: 1133227 - DNA, 22 bp, Artificial Sequence
  chemically synthesized
ccagcatctgtgattttttgac

SEQ ID NO: 1133228 - DNA, 22 bp, Artificial Sequence
  chemically synthesized
gccagcatctgtgattttttga

SEQ ID NO: 1133229 - DNA, 22 bp, Artificial Sequence
  chemically synthesized
ttattaagaagtcaaaaaatca

SEQ ID NO: 1133230 - DNA, 22 bp, Artificial Sequence
  chemically synthesized
ttaagaagtcaaaaaatcacag

SEQ ID NO: 1133231 - DNA, 22 bp, Artificial Sequence
  chemically synthesized
agaagtcaaaaaatcacagatg

SEQ ID NO: 1133232 - DNA, 22 bp, Artificial Sequence
  chemically synthesized
tgcaaccttgccagcatctgtg

SEQ ID NO: 1133233 - DNA, 22 bp, Artificial Sequence
  chemically synthesized
tgtgcaaccttgccagcatctg

SEQ ID NO: 1133234 - DNA, 22 bp, Artificial Sequence
  chemically synthesized
ctgtgcaaccttgccagcatct

SEQ ID NO: 1133235 - DNA, 22 bp, Artificial Sequence
  chemically synthesized
tctgtgcaaccttgccagcatc

SEQ ID NO: 1133236 - DNA, 22 bp, Artificial Sequence
  chemically synthesized
ttctgtgcaaccttgccagcat

SEQ ID NO: 1133237 - DNA, 22 bp, Artificial Sequence
  chemically synthesized
ccttttctgtgcaaccttgcca

SEQ ID NO: 1133238 - DNA, 22 bp, Artificial Sequence
  chemically synthesized
gcaaggttgcacagaaaaggga

SEQ ID NO: 1133239 - DNA, 22 bp, Artificial Sequence
  chemically synthesized
cacagaaaagggaacgtttatt

SEQ ID NO: 1133240 - DNA, 22 bp, Artificial Sequence
  chemically synthesized
atatcagcagtgcaataaacgt

SEQ ID NO: 1133241 - DNA, 22 bp, Artificial Sequence
  chemically synthesized
cactaatatcagcagtgcaata

SEQ ID NO: 1133242 - DNA, 22 bp, Artificial Sequence
  chemically synthesized
acactaatatcagcagtgcaat

SEQ ID NO: 1133243 - DNA, 22 bp, Artificial Sequence
  chemically synthesized
atttacactaatatcagcagtg

SEQ ID NO: 1133244 - DNA, 22 bp, Artificial Sequence
  chemically synthesized
aactaatttacactaatatcag

SEQ ID NO: 1133245 - DNA, 22 bp, Artificial Sequence
  chemically synthesized
attgcactgctgatattagtgt

SEQ ID NO: 1133246 - DNA, 22 bp, Artificial Sequence
  chemically synthesized
ttgcactgctgatattagtgta

SEQ ID NO: 1133247 - DNA, 22 bp, Artificial Sequence
  chemically synthesized
cactgctgatattagtgtaaat

SEQ ID NO: 1133248 - DNA, 22 bp, Artificial Sequence
  chemically synthesized
cacggtggctgaactaatttac

SEQ ID NO: 1133249 - DNA, 22 bp, Artificial Sequence
  chemically synthesized
ctgatattagtgtaaattagtt

SEQ ID NO: 1133250 - DNA, 22 bp, Artificial Sequence
  chemically synthesized
ccacggtggctgaactaattta

SEQ ID NO: 1133251 - DNA, 22 bp, Artificial Sequence
  chemically synthesized
tccacggtggctgaactaattt

SEQ ID NO: 1133252 - DNA, 22 bp, Artificial Sequence
  chemically synthesized
atattagtgtaaattagttcag

SEQ ID NO: 1133253 - DNA, 22 bp, Artificial Sequence
  chemically synthesized
ctttccacggtggctgaactaa

SEQ ID NO: 1133254 - DNA, 22 bp, Artificial Sequence
  chemically synthesized
gtgtaaattagttcagccaccg

SEQ ID NO: 1133255 - DNA, 22 bp, Artificial Sequence
  chemically synthesized
gttcagccaccgtggaaagcag

SEQ ID NO: 1133256 - DNA, 22 bp, Artificial Sequence
  chemically synthesized
ggaaatcaccaaactgctttcc

SEQ ID NO: 1133257 - DNA, 22 bp, Artificial Sequence
  chemically synthesized
gggaaatcaccaaactgctttc

SEQ ID NO: 1133258 - DNA, 22 bp, Artificial Sequence
  chemically synthesized
agccaccgtggaaagcagtttg

SEQ ID NO: 1133259 - DNA, 22 bp, Artificial Sequence
  chemically synthesized
tttgggaaatcaccaaactgct

SEQ ID NO: 1133260 - DNA, 22 bp, Artificial Sequence
  chemically synthesized
gttgtttgggaaatcaccaaac

SEQ ID NO: 1133261 - DNA, 22 bp, Artificial Sequence
  chemically synthesized
cgttgtttgggaaatcaccaaa

SEQ ID NO: 1133262 - DNA, 22 bp, Artificial Sequence
  chemically synthesized
tcgttgtttgggaaatcaccaa

SEQ ID NO: 1133263 - DNA, 22 bp, Artificial Sequence
  chemically synthesized
gttttcgttgtttgggaaatca

SEQ ID NO: 1133264 - DNA, 22 bp, Artificial Sequence
  chemically synthesized
tggttttcgttgtttgggaaat

SEQ ID NO: 1133265 - DNA, 22 bp, Artificial Sequence
  chemically synthesized
ggtgatttcccaaacaacgaaa

SEQ ID NO: 1133266 - DNA, 22 bp, Artificial Sequence
  chemically synthesized
gtgatttcccaaacaacgaaaa

SEQ ID NO: 1133267 - DNA, 22 bp, Artificial Sequence
  chemically synthesized
cccaaacaacgaaaaccagaat

SEQ ID NO: 1133268 - DNA, 22 bp, Artificial Sequence
  chemically synthesized
ggtcgaatggtaattctggttt

SEQ ID NO: 1133269 - DNA, 22 bp, Artificial Sequence
  chemically synthesized
ccaaacaacgaaaaccagaatt

SEQ ID NO: 1133270 - DNA, 22 bp, Artificial Sequence
  chemically synthesized
ctgggtcgaatggtaattctgg

SEQ ID NO: 1133271 - DNA, 22 bp, Artificial Sequence
  chemically synthesized
ttgctgggtcgaatggtaattc

SEQ ID NO: 1133272 - DNA, 22 bp, Artificial Sequence
  chemically synthesized
ttattgctgggtcgaatggtaa

SEQ ID NO: 1133273 - DNA, 22 bp, Artificial Sequence
  chemically synthesized
ccattcgacccagcaataacaa

SEQ ID NO: 1133274 - DNA, 22 bp, Artificial Sequence
  chemically synthesized
gtatacccaataattgttattg

SEQ ID NO: 1133275 - DNA, 22 bp, Artificial Sequence
  chemically synthesized
ggtatacccaataattgttatt

SEQ ID NO: 1133276 - DNA, 22 bp, Artificial Sequence
  chemically synthesized
ttggtatacccaataattgtta

SEQ ID NO: 1133277 - DNA, 22 bp, Artificial Sequence
  chemically synthesized
cttggtatacccaataattgtt

SEQ ID NO: 1133278 - DNA, 22 bp, Artificial Sequence
  chemically synthesized
gacccagcaataacaattattg

SEQ ID NO: 1133279 - DNA, 22 bp, Artificial Sequence
  chemically synthesized
ttcttggtatacccaataattg

SEQ ID NO: 1133280 - DNA, 22 bp, Artificial Sequence
  chemically synthesized
tattcttcttggtatacccaat

SEQ ID NO: 1133281 - DNA, 22 bp, Artificial Sequence
  chemically synthesized
atattcttcttggtatacccaa

SEQ ID NO: 1133282 - DNA, 22 bp, Artificial Sequence
  chemically synthesized
agggatttatattcttcttggt

SEQ ID NO: 1133283 - DNA, 22 bp, Artificial Sequence
  chemically synthesized
ttgggtataccaagaagaatat

SEQ ID NO: 1133284 - DNA, 22 bp, Artificial Sequence
  chemically synthesized
gggttgagggatttatattctt

SEQ ID NO: 1133285 - DNA, 22 bp, Artificial Sequence
  chemically synthesized
ggtataccaagaagaatataaa

SEQ ID NO: 1133286 - DNA, 22 bp, Artificial Sequence
  chemically synthesized
agggttgagggatttatattct

SEQ ID NO: 1133287 - DNA, 22 bp, Artificial Sequence
  chemically synthesized
tagggttgagggatttatattc

SEQ ID NO: 1133288 - DNA, 22 bp, Artificial Sequence
  chemically synthesized
aaccctaaagacacatgcacat

SEQ ID NO: 1133289 - DNA, 22 bp, Artificial Sequence
  chemically synthesized
aataaaacatacatgtgcatgt

SEQ ID NO: 1133290 - DNA, 22 bp, Artificial Sequence
  chemically synthesized
caataaaacatacatgtgcatg

SEQ ID NO: 1133291 - DNA, 22 bp, Artificial Sequence
  chemically synthesized
aagacacatgcacatgtatgtt

SEQ ID NO: 1133292 - DNA, 22 bp, Artificial Sequence
  chemically synthesized
tgaataatgcttcaataaaaca

SEQ ID NO: 1133293 - DNA, 22 bp, Artificial Sequence
  chemically synthesized
ttgtgaataatgcttcaataaa

SEQ ID NO: 1133294 - DNA, 22 bp, Artificial Sequence
  chemically synthesized
ctattgtgaataatgcttcaat

SEQ ID NO: 1133295 - DNA, 22 bp, Artificial Sequence
  chemically synthesized
gctattgtgaataatgcttcaa

SEQ ID NO: 1133296 - DNA, 22 bp, Artificial Sequence
  chemically synthesized
catgtgtttgctattgtgaata

SEQ ID NO: 1133297 - DNA, 22 bp, Artificial Sequence
  chemically synthesized
tattgaagcattattcacaata

SEQ ID NO: 1133298 - DNA, 22 bp, Artificial Sequence
  chemically synthesized
attgaagcattattcacaatag

SEQ ID NO: 1133299 - DNA, 22 bp, Artificial Sequence
  chemically synthesized
ttgaagcattattcacaatagc

SEQ ID NO: 1133300 - DNA, 22 bp, Artificial Sequence
  chemically synthesized
attccatgtgtttgctattgtg

SEQ ID NO: 1133301 - DNA, 22 bp, Artificial Sequence
  chemically synthesized
aagcattattcacaatagcaaa

SEQ ID NO: 1133302 - DNA, 22 bp, Artificial Sequence
  chemically synthesized
ggctgattccatgtgtttgcta

SEQ ID NO: 1133303 - DNA, 22 bp, Artificial Sequence
  chemically synthesized
aggctgattccatgtgtttgct

SEQ ID NO: 1133304 - DNA, 22 bp, Artificial Sequence
  chemically synthesized
ttcacaatagcaaacacatgga

SEQ ID NO: 1133305 - DNA, 22 bp, Artificial Sequence
  chemically synthesized
acaatagcaaacacatggaatc

SEQ ID NO: 1133306 - DNA, 22 bp, Artificial Sequence
  chemically synthesized
atgggcatttaggctgattcca

SEQ ID NO: 1133307 - DNA, 22 bp, Artificial Sequence
  chemically synthesized
ccactgatgggcatttaggctg

SEQ ID NO: 1133308 - DNA, 22 bp, Artificial Sequence
  chemically synthesized
tccagtctaccactgatgggca

SEQ ID NO: 1133309 - DNA, 22 bp, Artificial Sequence
  chemically synthesized
atccagtctaccactgatgggc

SEQ ID NO: 1133310 - DNA, 22 bp, Artificial Sequence
  chemically synthesized
cttatccagtctaccactgatg

SEQ ID NO: 1133311 - DNA, 22 bp, Artificial Sequence
  chemically synthesized
ccttatccagtctaccactgat

SEQ ID NO: 1133312 - DNA, 22 bp, Artificial Sequence
  chemically synthesized
tccttatccagtctaccactga

SEQ ID NO: 1133313 - DNA, 22 bp, Artificial Sequence
  chemically synthesized
aatgcccatcagtggtagactg

SEQ ID NO: 1133314 - DNA, 22 bp, Artificial Sequence
  chemically synthesized
cacagtgtatatgtaccacatt

SEQ ID NO: 1133315 - DNA, 22 bp, Artificial Sequence
  chemically synthesized
gataaggaaaatgtggtacata

SEQ ID NO: 1133316 - DNA, 22 bp, Artificial Sequence
  chemically synthesized
catagaattccacagtgtatat

SEQ ID NO: 1133317 - DNA, 22 bp, Artificial Sequence
  chemically synthesized
atggctgcatagaattccacag

SEQ ID NO: 1133318 - DNA, 22 bp, Artificial Sequence
  chemically synthesized
catggctgcatagaattccaca

SEQ ID NO: 1133319 - DNA, 22 bp, Artificial Sequence
  chemically synthesized
tcatggctgcatagaattccac

SEQ ID NO: 1133320 - DNA, 22 bp, Artificial Sequence
  chemically synthesized
ttcatggctgcatagaattcca

SEQ ID NO: 1133321 - DNA, 22 bp, Artificial Sequence
  chemically synthesized
tttcatggctgcatagaattcc

SEQ ID NO: 1133322 - DNA, 22 bp, Artificial Sequence
  chemically synthesized
ttttcatggctgcatagaattc

SEQ ID NO: 1133323 - DNA, 22 bp, Artificial Sequence
  chemically synthesized
ttttttcatggctgcatagaat

SEQ ID NO: 1133324 - DNA, 22 bp, Artificial Sequence
  chemically synthesized
tggaattctatgcagccatgaa

SEQ ID NO: 1133325 - DNA, 22 bp, Artificial Sequence
  chemically synthesized
tatgcagccatgaaaaaagaga

SEQ ID NO: 1133326 - DNA, 22 bp, Artificial Sequence
  chemically synthesized
caaagaacacaatctctttttt

SEQ ID NO: 1133327 - DNA, 22 bp, Artificial Sequence
  chemically synthesized
tgcagccatgaaaaaagagatt

SEQ ID NO: 1133328 - DNA, 22 bp, Artificial Sequence
  chemically synthesized
ctgcaaagaacacaatctcttt

SEQ ID NO: 1133329 - DNA, 22 bp, Artificial Sequence
  chemically synthesized
gctgcaaagaacacaatctctt

SEQ ID NO: 1133330 - DNA, 22 bp, Artificial Sequence
  chemically synthesized
catccatgtttgctgcaaagaa

SEQ ID NO: 1133331 - DNA, 22 bp, Artificial Sequence
  chemically synthesized
cagctccatccatgtttgctgc

SEQ ID NO: 1133332 - DNA, 22 bp, Artificial Sequence
  chemically synthesized
tgttctttgcagcaaacatgga

SEQ ID NO: 1133333 - DNA, 22 bp, Artificial Sequence
  chemically synthesized
tttgcagcaaacatggatggag

SEQ ID NO: 1133334 - DNA, 22 bp, Artificial Sequence
  chemically synthesized
tgcagcaaacatggatggagct

SEQ ID NO: 1133335 - DNA, 22 bp, Artificial Sequence
  chemically synthesized
gcagcaaacatggatggagctg

SEQ ID NO: 1133336 - DNA, 22 bp, Artificial Sequence
  chemically synthesized
cagcaaacatggatggagctgg

SEQ ID NO: 1133337 - DNA, 22 bp, Artificial Sequence
  chemically synthesized
ggataatggcctccagctccat

SEQ ID NO: 1133338 - DNA, 22 bp, Artificial Sequence
  chemically synthesized
aggataatggcctccagctcca

SEQ ID NO: 1133339 - DNA, 22 bp, Artificial Sequence
  chemically synthesized
cttaggataatggcctccagct

SEQ ID NO: 1133340 - DNA, 22 bp, Artificial Sequence
  chemically synthesized
gcttaggataatggcctccagc

SEQ ID NO: 1133341 - DNA, 22 bp, Artificial Sequence
  chemically synthesized
gtttgcttaggataatggcctc

SEQ ID NO: 1133342 - DNA, 22 bp, Artificial Sequence
  chemically synthesized
tgttagtttgcttaggataatg

SEQ ID NO: 1133343 - DNA, 22 bp, Artificial Sequence
  chemically synthesized
ttgtgttagtttgcttaggata

SEQ ID NO: 1133344 - DNA, 22 bp, Artificial Sequence
  chemically synthesized
gaggccattatcctaagcaaac

SEQ ID NO: 1133345 - DNA, 22 bp, Artificial Sequence
  chemically synthesized
tgttattgtgttagtttgctta

SEQ ID NO: 1133346 - DNA, 22 bp, Artificial Sequence
  chemically synthesized
gtgttattgtgttagtttgctt

SEQ ID NO: 1133347 - DNA, 22 bp, Artificial Sequence
  chemically synthesized
tgtgttattgtgttagtttgct

SEQ ID NO: 1133348 - DNA, 22 bp, Artificial Sequence
  chemically synthesized
tcctaagcaaactaacacaata

SEQ ID NO: 1133349 - DNA, 22 bp, Artificial Sequence
  chemically synthesized
agcaaactaacacaataacaca

SEQ ID NO: 1133350 - DNA, 22 bp, Artificial Sequence
  chemically synthesized
acacaataacacaaaatatcac

SEQ ID NO: 1133351 - DNA, 22 bp, Artificial Sequence
  chemically synthesized
gaagtgagaaaatgtgatattt

SEQ ID NO: 1133352 - DNA, 22 bp, Artificial Sequence
  chemically synthesized
agaagtgagaaaatgtgatatt

SEQ ID NO: 1133353 - DNA, 22 bp, Artificial Sequence
  chemically synthesized
ccacttagaagtgagaaaatgt

SEQ ID NO: 1133354 - DNA, 22 bp, Artificial Sequence
  chemically synthesized
tctcccacttagaagtgagaaa

SEQ ID NO: 1133355 - DNA, 22 bp, Artificial Sequence
  chemically synthesized
atctcccacttagaagtgagaa

SEQ ID NO: 1133356 - DNA, 22 bp, Artificial Sequence
  chemically synthesized
aatgtttatctcccacttagaa

SEQ ID NO: 1133357 - DNA, 22 bp, Artificial Sequence
  chemically synthesized
tcaatgtttatctcccacttag

SEQ ID NO: 1133358 - DNA, 22 bp, Artificial Sequence
  chemically synthesized
tctcacttctaagtgggagata

SEQ ID NO: 1133359 - DNA, 22 bp, Artificial Sequence
  chemically synthesized
ctcacttctaagtgggagataa

SEQ ID NO: 1133360 - DNA, 22 bp, Artificial Sequence
  chemically synthesized
tcacttctaagtgggagataaa

SEQ ID NO: 1133361 - DNA, 22 bp, Artificial Sequence
  chemically synthesized
acttctaagtgggagataaaca

SEQ ID NO: 1133362 - DNA, 22 bp, Artificial Sequence
  chemically synthesized
ctaagtgggagataaacattga

SEQ ID NO: 1133363 - DNA, 22 bp, Artificial Sequence
  chemically synthesized
taagtgggagataaacattgag

SEQ ID NO: 1133364 - DNA, 22 bp, Artificial Sequence
  chemically synthesized
agtccgtgtgttctcaatgttt

SEQ ID NO: 1133365 - DNA, 22 bp, Artificial Sequence
  chemically synthesized
gagtccgtgtgttctcaatgtt

SEQ ID NO: 1133366 - DNA, 22 bp, Artificial Sequence
  chemically synthesized
agtgggagataaacattgagaa

SEQ ID NO: 1133367 - DNA, 22 bp, Artificial Sequence
  chemically synthesized
tgagtccgtgtgttctcaatgt

SEQ ID NO: 1133368 - DNA, 22 bp, Artificial Sequence
  chemically synthesized
tttgagtccgtgtgttctcaat

SEQ ID NO: 1133369 - DNA, 22 bp, Artificial Sequence
  chemically synthesized
ctttgagtccgtgtgttctcaa

SEQ ID NO: 1133370 - DNA, 22 bp, Artificial Sequence
  chemically synthesized
tccccttctttgagtccgtgtg

SEQ ID NO: 1133371 - DNA, 22 bp, Artificial Sequence
  chemically synthesized
ttgtccccttctttgagtccgt

SEQ ID NO: 1133372 - DNA, 22 bp, Artificial Sequence
  chemically synthesized
agaacacacggactcaaagaag

SEQ ID NO: 1133373 - DNA, 22 bp, Artificial Sequence
  chemically synthesized
acatagaccaccgtgtctgttg

SEQ ID NO: 1133374 - DNA, 22 bp, Artificial Sequence
  chemically synthesized
aaagaaggggacaacagacacg

SEQ ID NO: 1133375 - DNA, 22 bp, Artificial Sequence
  chemically synthesized
cagcctcacatagaccaccgtg

SEQ ID NO: 1133376 - DNA, 22 bp, Artificial Sequence
  chemically synthesized
ccctccagcctcacatagacca

SEQ ID NO: 1133377 - DNA, 22 bp, Artificial Sequence
  chemically synthesized
accctccagcctcacatagacc

SEQ ID NO: 1133378 - DNA, 22 bp, Artificial Sequence
  chemically synthesized
ttaccctccagcctcacataga

SEQ ID NO: 1133379 - DNA, 22 bp, Artificial Sequence
  chemically synthesized
ctcttaccctccagcctcacat

SEQ ID NO: 1133380 - DNA, 22 bp, Artificial Sequence
  chemically synthesized
accctcctcttaccctccagcc

SEQ ID NO: 1133381 - DNA, 22 bp, Artificial Sequence
  chemically synthesized
atcctcaccctcctcttaccct

SEQ ID NO: 1133382 - DNA, 22 bp, Artificial Sequence
  chemically synthesized
tgtgaggctggagggtaagagg

SEQ ID NO: 1133383 - DNA, 22 bp, Artificial Sequence
  chemically synthesized
aatcctcaccctcctcttaccc

SEQ ID NO: 1133384 - DNA, 22 bp, Artificial Sequence
  chemically synthesized
taatcctcaccctcctcttacc

SEQ ID NO: 1133385 - DNA, 22 bp, Artificial Sequence
  chemically synthesized
ttaatcctcaccctcctcttac

SEQ ID NO: 1133386 - DNA, 22 bp, Artificial Sequence
  chemically synthesized
tttaatcctcaccctcctctta

SEQ ID NO: 1133387 - DNA, 22 bp, Artificial Sequence
  chemically synthesized
ttttaatcctcaccctcctctt

SEQ ID NO: 1133388 - DNA, 22 bp, Artificial Sequence
  chemically synthesized
gagggtaagaggagggtgagga

SEQ ID NO: 1133389 - DNA, 22 bp, Artificial Sequence
  chemically synthesized
aaaaaactacttattgggtact

SEQ ID NO: 1133390 - DNA, 22 bp, Artificial Sequence
  chemically synthesized
atcacccaggtaataagcatag

SEQ ID NO: 1133391 - DNA, 22 bp, Artificial Sequence
  chemically synthesized
cttattgggtactatgcttatt

SEQ ID NO: 1133392 - DNA, 22 bp, Artificial Sequence
  chemically synthesized
catcacccaggtaataagcata

SEQ ID NO: 1133393 - DNA, 22 bp, Artificial Sequence
  chemically synthesized
attgggtactatgcttattacc

SEQ ID NO: 1133394 - DNA, 22 bp, Artificial Sequence
  chemically synthesized
tttcatcacccaggtaataagc

SEQ ID NO: 1133395 - DNA, 22 bp, Artificial Sequence
  chemically synthesized
ttgggtactatgcttattacct

SEQ ID NO: 1133396 - DNA, 22 bp, Artificial Sequence
  chemically synthesized
ggtactatgcttattacctggg

SEQ ID NO: 1133397 - DNA, 22 bp, Artificial Sequence
  chemically synthesized
tacagattatttcatcacccag

SEQ ID NO: 1133398 - DNA, 22 bp, Artificial Sequence
  chemically synthesized
tgcttattacctgggtgatgaa

SEQ ID NO: 1133399 - DNA, 22 bp, Artificial Sequence
  chemically synthesized
ttgtacagattatttcatcacc

SEQ ID NO: 1133400 - DNA, 22 bp, Artificial Sequence
  chemically synthesized
gttgtacagattatttcatcac

SEQ ID NO: 1133401 - DNA, 22 bp, Artificial Sequence
  chemically synthesized
attacctgggtgatgaaataat

SEQ ID NO: 1133402 - DNA, 22 bp, Artificial Sequence
  chemically synthesized
ttacctgggtgatgaaataatc

SEQ ID NO: 1133403 - DNA, 22 bp, Artificial Sequence
  chemically synthesized
cctgggtgatgaaataatctgt

SEQ ID NO: 1133404 - DNA, 22 bp, Artificial Sequence
  chemically synthesized
ggtgatgaaataatctgtacaa

SEQ ID NO: 1133405 - DNA, 22 bp, Artificial Sequence
  chemically synthesized
catgtcacaggggtttgttgta

SEQ ID NO: 1133406 - DNA, 22 bp, Artificial Sequence
  chemically synthesized
tacaacaaacccctgtgacatg

SEQ ID NO: 1133407 - DNA, 22 bp, Artificial Sequence
  chemically synthesized
tcatatagataaattgcatgtc

SEQ ID NO: 1133408 - DNA, 22 bp, Artificial Sequence
  chemically synthesized
gtcatatagataaattgcatgt

SEQ ID NO: 1133409 - DNA, 22 bp, Artificial Sequence
  chemically synthesized
tgacatgcaatttatctatatg

SEQ ID NO: 1133410 - DNA, 22 bp, Artificial Sequence
  chemically synthesized
agaggtacatgtggtggtttgt

SEQ ID NO: 1133411 - DNA, 22 bp, Artificial Sequence
  chemically synthesized
cagaggtacatgtggtggtttg

SEQ ID NO: 1133412 - DNA, 22 bp, Artificial Sequence
  chemically synthesized
atctatatgacaaaccaccaca

SEQ ID NO: 1133413 - DNA, 22 bp, Artificial Sequence
  chemically synthesized
tctatatgacaaaccaccacat

SEQ ID NO: 1133414 - DNA, 22 bp, Artificial Sequence
  chemically synthesized
cttcagaggtacatgtggtggt

SEQ ID NO: 1133415 - DNA, 22 bp, Artificial Sequence
  chemically synthesized
gcttcagaggtacatgtggtgg

SEQ ID NO: 1133416 - DNA, 22 bp, Artificial Sequence
  chemically synthesized
tgcttcagaggtacatgtggtg

SEQ ID NO: 1133417 - DNA, 22 bp, Artificial Sequence
  chemically synthesized
ttgcttcagaggtacatgtggt

SEQ ID NO: 1133418 - DNA, 22 bp, Artificial Sequence
  chemically synthesized
tatgacaaaccaccacatgtac

SEQ ID NO: 1133419 - DNA, 22 bp, Artificial Sequence
  chemically synthesized
tttttgcttcagaggtacatgt

SEQ ID NO: 1133420 - DNA, 22 bp, Artificial Sequence
  chemically synthesized
atttttgcttcagaggtacatg

SEQ ID NO: 1133421 - DNA, 22 bp, Artificial Sequence
  chemically synthesized
tatttttgcttcagaggtacat

SEQ ID NO: 1133422 - DNA, 22 bp, Artificial Sequence
  chemically synthesized
ttatttttgcttcagaggtaca

SEQ ID NO: 1133423 - DNA, 22 bp, Artificial Sequence
  chemically synthesized
cttttatttttgcttcagaggt

SEQ ID NO: 1133424 - DNA, 22 bp, Artificial Sequence
  chemically synthesized
acttttatttttgcttcagagg

SEQ ID NO: 1133425 - DNA, 22 bp, Artificial Sequence
  chemically synthesized
tacttttatttttgcttcagag

SEQ ID NO: 1133426 - DNA, 22 bp, Artificial Sequence
  chemically synthesized
ttacttttatttttgcttcaga

SEQ ID NO: 1133427 - DNA, 22 bp, Artificial Sequence
  chemically synthesized
tttacttttatttttgcttcag

SEQ ID NO: 1133428 - DNA, 22 bp, Artificial Sequence
  chemically synthesized
ttttttacttttatttttgctt

SEQ ID NO: 1133429 - DNA, 22 bp, Artificial Sequence
  chemically synthesized
tattattttttacttttatttt

SEQ ID NO: 1133430 - DNA, 22 bp, Artificial Sequence
  chemically synthesized
tgaagcaaaaataaaagtaaaa

SEQ ID NO: 1133431 - DNA, 22 bp, Artificial Sequence
  chemically synthesized
tactatattattttttactttt

SEQ ID NO: 1133432 - DNA, 22 bp, Artificial Sequence
  chemically synthesized
aagcaaaaataaaagtaaaaaa

SEQ ID NO: 1133433 - DNA, 22 bp, Artificial Sequence
  chemically synthesized
ttatactatattattttttact

SEQ ID NO: 1133434 - DNA, 22 bp, Artificial Sequence
  chemically synthesized
ataatattattatactatatta

SEQ ID NO: 1133435 - DNA, 22 bp, Artificial Sequence
  chemically synthesized
tgagaccactgtcatatatgtg

SEQ ID NO: 1133436 - DNA, 22 bp, Artificial Sequence
  chemically synthesized
agtcaacaatgaaccacatata

SEQ ID NO: 1133437 - DNA, 22 bp, Artificial Sequence
  chemically synthesized
cagtcaacaatgaaccacatat

SEQ ID NO: 1133438 - DNA, 22 bp, Artificial Sequence
  chemically synthesized
tcatatatgtggttcattgttg

SEQ ID NO: 1133439 - DNA, 22 bp, Artificial Sequence
  chemically synthesized
cataacaacatttcagtcaaca

SEQ ID NO: 1133440 - DNA, 22 bp, Artificial Sequence
  chemically synthesized
attgttgactgaaatgttgtta

SEQ ID NO: 1133441 - DNA, 22 bp, Artificial Sequence
  chemically synthesized
cagtcatatgctgcataacaac

SEQ ID NO: 1133442 - DNA, 22 bp, Artificial Sequence
  chemically synthesized
ttgactgaaatgttgttatgca

SEQ ID NO: 1133443 - DNA, 22 bp, Artificial Sequence
  chemically synthesized
actgaaatgttgttatgcagca

SEQ ID NO: 1133444 - DNA, 22 bp, Artificial Sequence
  chemically synthesized
caactacagtcatatgctgcat

SEQ ID NO: 1133445 - DNA, 22 bp, Artificial Sequence
  chemically synthesized
aaatgttgttatgcagcatatg

SEQ ID NO: 1133446 - DNA, 22 bp, Artificial Sequence
  chemically synthesized
gtaattgcaactacagtcatat

SEQ ID NO: 1133447 - DNA, 22 bp, Artificial Sequence
  chemically synthesized
ttatgcagcatatgactgtagt

SEQ ID NO: 1133448 - DNA, 22 bp, Artificial Sequence
  chemically synthesized
tgcagcatatgactgtagttgc

SEQ ID NO: 1133449 - DNA, 22 bp, Artificial Sequence
  chemically synthesized
aatagttcgtaattgcaactac

SEQ ID NO: 1133450 - DNA, 22 bp, Artificial Sequence
  chemically synthesized
aagaatagctgaatagttcgta

SEQ ID NO: 1133451 - DNA, 22 bp, Artificial Sequence
  chemically synthesized
tagttgcaattacgaactattc

SEQ ID NO: 1133452 - DNA, 22 bp, Artificial Sequence
  chemically synthesized
aaattaaagaatagctgaatag

SEQ ID NO: 1133453 - DNA, 22 bp, Artificial Sequence
  chemically synthesized
aaaattaaagaatagctgaata

SEQ ID NO: 1133454 - DNA, 22 bp, Artificial Sequence
  chemically synthesized
caattacgaactattcagctat

SEQ ID NO: 1133455 - DNA, 22 bp, Artificial Sequence
  chemically synthesized
cgaactattcagctattcttta

SEQ ID NO: 1133456 - DNA, 22 bp, Artificial Sequence
  chemically synthesized
ttcagctattctttaattttaa

SEQ ID NO: 1133457 - DNA, 22 bp, Artificial Sequence
  chemically synthesized
agctattctttaattttaaatt

SEQ ID NO: 1133458 - DNA, 22 bp, Artificial Sequence
  chemically synthesized
ttctttaattttaaattcattt

SEQ ID NO: 1133459 - DNA, 22 bp, Artificial Sequence
  chemically synthesized
tttaattttaaattcattttgt

SEQ ID NO: 1133460 - DNA, 22 bp, Artificial Sequence
  chemically synthesized
taattttaaattcattttgttt

SEQ ID NO: 1133461 - DNA, 22 bp, Artificial Sequence
  chemically synthesized
aattttaaattcattttgttta

SEQ ID NO: 1133462 - DNA, 22 bp, Artificial Sequence
  chemically synthesized
attttaaattcattttgtttat

SEQ ID NO: 1133463 - DNA, 22 bp, Artificial Sequence
  chemically synthesized
taaattcattttgtttatgctg

SEQ ID NO: 1133464 - DNA, 22 bp, Artificial Sequence
  chemically synthesized
aaattcattttgtttatgctgt

SEQ ID NO: 1133465 - DNA, 22 bp, Artificial Sequence
  chemically synthesized
aattcattttgtttatgctgtt

SEQ ID NO: 1133466 - DNA, 22 bp, Artificial Sequence
  chemically synthesized
attttgtttatgctgttatttt

SEQ ID NO: 1133467 - DNA, 22 bp, Artificial Sequence
  chemically synthesized
tgtttatgctgttattttatga

SEQ ID NO: 1133468 - DNA, 22 bp, Artificial Sequence
  chemically synthesized
gtttatgctgttattttatgat

SEQ ID NO: 1133469 - DNA, 22 bp, Artificial Sequence
  chemically synthesized
tttatgctgttattttatgata

SEQ ID NO: 1133470 - DNA, 22 bp, Artificial Sequence
  chemically synthesized
atgctgttattttatgatatgg

SEQ ID NO: 1133471 - DNA, 22 bp, Artificial Sequence
  chemically synthesized
tgctgttattttatgatatggt

SEQ ID NO: 1133472 - DNA, 22 bp, Artificial Sequence
  chemically synthesized
ttattttatgatatggtttggc

SEQ ID NO: 1133473 - DNA, 22 bp, Artificial Sequence
  chemically synthesized
ggtggggacagagagccaaacc

SEQ ID NO: 1133474 - DNA, 22 bp, Artificial Sequence
  chemically synthesized
ttttatgatatggtttggctct

SEQ ID NO: 1133475 - DNA, 22 bp, Artificial Sequence
  chemically synthesized
gggtggggacagagagccaaac

SEQ ID NO: 1133476 - DNA, 22 bp, Artificial Sequence
  chemically synthesized
tatgatatggtttggctctctg

SEQ ID NO: 1133477 - DNA, 22 bp, Artificial Sequence
  chemically synthesized
atgatatggtttggctctctgt

SEQ ID NO: 1133478 - DNA, 22 bp, Artificial Sequence
  chemically synthesized
tgatatggtttggctctctgtc

SEQ ID NO: 1133479 - DNA, 22 bp, Artificial Sequence
  chemically synthesized
aacatgaggatttgggtgggga

SEQ ID NO: 1133480 - DNA, 22 bp, Artificial Sequence
  chemically synthesized
ggctctctgtccccacccaaat

SEQ ID NO: 1133481 - DNA, 22 bp, Artificial Sequence
  chemically synthesized
gctctctgtccccacccaaatc

SEQ ID NO: 1133482 - DNA, 22 bp, Artificial Sequence
  chemically synthesized
tctgtccccacccaaatcctca

SEQ ID NO: 1133483 - DNA, 22 bp, Artificial Sequence
  chemically synthesized
tgtccccacccaaatcctcatg

SEQ ID NO: 1133484 - DNA, 22 bp, Artificial Sequence
  chemically synthesized
tccccacccaaatcctcatgtt

SEQ ID NO: 1133485 - DNA, 22 bp, Artificial Sequence
  chemically synthesized
aagacagaattcaacatgagga

SEQ ID NO: 1133486 - DNA, 22 bp, Artificial Sequence
  chemically synthesized
caacactgaagacagaattcaa

SEQ ID NO: 1133487 - DNA, 22 bp, Artificial Sequence
  chemically synthesized
ctccaacactgaagacagaatt

SEQ ID NO: 1133488 - DNA, 22 bp, Artificial Sequence
  chemically synthesized
cctccaacactgaagacagaat

SEQ ID NO: 1133489 - DNA, 22 bp, Artificial Sequence
  chemically synthesized
atgttgaattctgtcttcagtg

SEQ ID NO: 1133490 - DNA, 22 bp, Artificial Sequence
  chemically synthesized
aattctgtcttcagtgttggag

SEQ ID NO: 1133491 - DNA, 22 bp, Artificial Sequence
  chemically synthesized
ccaccaggcccttcctccaaca

SEQ ID NO: 1133492 - DNA, 22 bp, Artificial Sequence
  chemically synthesized
tgtcttcagtgttggaggaagg

SEQ ID NO: 1133493 - DNA, 22 bp, Artificial Sequence
  chemically synthesized
tcttcagtgttggaggaagggc

SEQ ID NO: 1133494 - DNA, 22 bp, Artificial Sequence
  chemically synthesized
cagtgttggaggaagggcctgg

SEQ ID NO: 1133495 - DNA, 22 bp, Artificial Sequence
  chemically synthesized
agtcccctcccaccaggccctt

SEQ ID NO: 1133496 - DNA, 22 bp, Artificial Sequence
  chemically synthesized
agtgttggaggaagggcctggt

SEQ ID NO: 1133497 - DNA, 22 bp, Artificial Sequence
  chemically synthesized
gaggaagggcctggtgggaggg

SEQ ID NO: 1133498 - DNA, 22 bp, Artificial Sequence
  chemically synthesized
gtgggaggggactgaatcatgg

SEQ ID NO: 1133499 - DNA, 22 bp, Artificial Sequence
  chemically synthesized
aatcatgggtgtggacctcccc

SEQ ID NO: 1133500 - DNA, 22 bp, Artificial Sequence
  chemically synthesized
tcaggagagcagcaagggggag

SEQ ID NO: 1133501 - DNA, 22 bp, Artificial Sequence
  chemically synthesized
atcaggagagcagcaaggggga

SEQ ID NO: 1133502 - DNA, 22 bp, Artificial Sequence
  chemically synthesized
ttatcaggagagcagcaagggg

SEQ ID NO: 1133503 - DNA, 22 bp, Artificial Sequence
  chemically synthesized
atgagaactcttatcaggagag

SEQ ID NO: 1133504 - DNA, 22 bp, Artificial Sequence
  chemically synthesized
ccccttgctgctctcctgataa

SEQ ID NO: 1133505 - DNA, 22 bp, Artificial Sequence
  chemically synthesized
gctgctctcctgataagagttc

SEQ ID NO: 1133506 - DNA, 22 bp, Artificial Sequence
  chemically synthesized
ctgctctcctgataagagttct

SEQ ID NO: 1133507 - DNA, 22 bp, Artificial Sequence
  chemically synthesized
ctctcctgataagagttctcat

SEQ ID NO: 1133508 - DNA, 22 bp, Artificial Sequence
  chemically synthesized
tcctgataagagttctcatgag

SEQ ID NO: 1133509 - DNA, 22 bp, Artificial Sequence
  chemically synthesized
aaacaaacaaatctcatgagaa

SEQ ID NO: 1133510 - DNA, 22 bp, Artificial Sequence
  chemically synthesized
caaacaaacaaatctcatgaga

SEQ ID NO: 1133511 - DNA, 22 bp, Artificial Sequence
  chemically synthesized
ctgataagagttctcatgagat

SEQ ID NO: 1133512 - DNA, 22 bp, Artificial Sequence
  chemically synthesized
tcaaacaaacaaatctcatgag

SEQ ID NO: 1133513 - DNA, 22 bp, Artificial Sequence
  chemically synthesized
ataagagttctcatgagatttg

SEQ ID NO: 1133514 - DNA, 22 bp, Artificial Sequence
  chemically synthesized
ccacacactttcaaacaaacaa

SEQ ID NO: 1133515 - DNA, 22 bp, Artificial Sequence
  chemically synthesized
tcatgagatttgtttgtttgaa

SEQ ID NO: 1133516 - DNA, 22 bp, Artificial Sequence
  chemically synthesized
atgagatttgtttgtttgaaag

SEQ ID NO: 1133517 - DNA, 22 bp, Artificial Sequence
  chemically synthesized
gcaagggttgccacacactttc

SEQ ID NO: 1133518 - DNA, 22 bp, Artificial Sequence
  chemically synthesized
gtttgtttgaaagtgtgtggca

SEQ ID NO: 1133519 - DNA, 22 bp, Artificial Sequence
  chemically synthesized
tttgtttgaaagtgtgtggcaa

SEQ ID NO: 1133520 - DNA, 22 bp, Artificial Sequence
  chemically synthesized
gtttgaaagtgtgtggcaaccc

SEQ ID NO: 1133521 - DNA, 22 bp, Artificial Sequence
  chemically synthesized
tttgaaagtgtgtggcaaccct

SEQ ID NO: 1133522 - DNA, 22 bp, Artificial Sequence
  chemically synthesized
gccacgatctggcaagggttgc

SEQ ID NO: 1133523 - DNA, 22 bp, Artificial Sequence
  chemically synthesized
gaaagtgtgtggcaacccttgc

SEQ ID NO: 1133524 - DNA, 22 bp, Artificial Sequence
  chemically synthesized
aaagtgtgtggcaacccttgcc

SEQ ID NO: 1133525 - DNA, 22 bp, Artificial Sequence
  chemically synthesized
aagaagcagactggccacgatc

SEQ ID NO: 1133526 - DNA, 22 bp, Artificial Sequence
  chemically synthesized
aaagaagcagactggccacgat

SEQ ID NO: 1133527 - DNA, 22 bp, Artificial Sequence
  chemically synthesized
gccagatcgtggccagtctgct

SEQ ID NO: 1133528 - DNA, 22 bp, Artificial Sequence
  chemically synthesized
ccagatcgtggccagtctgctt

SEQ ID NO: 1133529 - DNA, 22 bp, Artificial Sequence
  chemically synthesized
cttctttaagtgggaccctgat

SEQ ID NO: 1133530 - DNA, 22 bp, Artificial Sequence
  chemically synthesized
ctttaagtgggaccctgatcca

SEQ ID NO: 1133531 - DNA, 22 bp, Artificial Sequence
  chemically synthesized
tttaagtgggaccctgatccat

SEQ ID NO: 1133532 - DNA, 22 bp, Artificial Sequence
  chemically synthesized
taagtgggaccctgatccatcc

SEQ ID NO: 1133533 - DNA, 22 bp, Artificial Sequence
  chemically synthesized
aagtgggaccctgatccatcct

SEQ ID NO: 1133534 - DNA, 22 bp, Artificial Sequence
  chemically synthesized
agtgggaccctgatccatcctc

SEQ ID NO: 1133535 - DNA, 22 bp, Artificial Sequence
  chemically synthesized
agggaggtcccacccagtgagg

SEQ ID NO: 1133536 - DNA, 22 bp, Artificial Sequence
  chemically synthesized
atccatcctcctcactgggtgg

SEQ ID NO: 1133537 - DNA, 22 bp, Artificial Sequence
  chemically synthesized
aagccccctcagggaggtccca

SEQ ID NO: 1133538 - DNA, 22 bp, Artificial Sequence
  chemically synthesized
ctcactgggtgggacctccctg

SEQ ID NO: 1133539 - DNA, 22 bp, Artificial Sequence
  chemically synthesized
actgggtgggacctccctgagg

SEQ ID NO: 1133540 - DNA, 22 bp, Artificial Sequence
  chemically synthesized
ggtgggacctccctgagggggc

SEQ ID NO: 1133541 - DNA, 22 bp, Artificial Sequence
  chemically synthesized
ggtggaatggctgaagccccct

SEQ ID NO: 1133542 - DNA, 22 bp, Artificial Sequence
  chemically synthesized
aatcctgggtggaatggctgaa

SEQ ID NO: 1133543 - DNA, 22 bp, Artificial Sequence
  chemically synthesized
cctgagggggcttcagccattc

SEQ ID NO: 1133544 - DNA, 22 bp, Artificial Sequence
  chemically synthesized
agggggcttcagccattccacc

SEQ ID NO: 1133545 - DNA, 22 bp, Artificial Sequence
  chemically synthesized
tccattgaatcctgggtggaat

SEQ ID NO: 1133546 - DNA, 22 bp, Artificial Sequence
  chemically synthesized
tatccattgaatcctgggtgga

SEQ ID NO: 1133547 - DNA, 22 bp, Artificial Sequence
  chemically synthesized
cagccattccacccaggattca

SEQ ID NO: 1133548 - DNA, 22 bp, Artificial Sequence
  chemically synthesized
agccattccacccaggattcaa

SEQ ID NO: 1133549 - DNA, 22 bp, Artificial Sequence
  chemically synthesized
cacccaggattcaatggataga

SEQ ID NO: 1133550 - DNA, 22 bp, Artificial Sequence
  chemically synthesized
tcccagggagagatcagagctc

SEQ ID NO: 1133551 - DNA, 22 bp, Artificial Sequence
  chemically synthesized
tgtcccagggagagatcagagc

SEQ ID NO: 1133552 - DNA, 22 bp, Artificial Sequence
  chemically synthesized
aatggatagagctctgatctct

SEQ ID NO: 1133553 - DNA, 22 bp, Artificial Sequence
  chemically synthesized
ccagaagctctgtcccagggag

SEQ ID NO: 1133554 - DNA, 22 bp, Artificial Sequence
  chemically synthesized
ctcccagaagctctgtcccagg

SEQ ID NO: 1133555 - DNA, 22 bp, Artificial Sequence
  chemically synthesized
cctcccagaagctctgtcccag

SEQ ID NO: 1133556 - DNA, 22 bp, Artificial Sequence
  chemically synthesized
tgatctctccctgggacagagc

SEQ ID NO: 1133557 - DNA, 22 bp, Artificial Sequence
  chemically synthesized
atctctccctgggacagagctt

SEQ ID NO: 1133558 - DNA, 22 bp, Artificial Sequence
  chemically synthesized
gtcttcctcccagaagctctgt

SEQ ID NO: 1133559 - DNA, 22 bp, Artificial Sequence
  chemically synthesized
tccctgggacagagcttctggg

SEQ ID NO: 1133560 - DNA, 22 bp, Artificial Sequence
  chemically synthesized
cctgggacagagcttctgggag

SEQ ID NO: 1133561 - DNA, 22 bp, Artificial Sequence
  chemically synthesized
ggacagagcttctgggaggaag

SEQ ID NO: 1133562 - DNA, 22 bp, Artificial Sequence
  chemically synthesized
cagaggtggcagctggtcttcc

SEQ ID NO: 1133563 - DNA, 22 bp, Artificial Sequence
  chemically synthesized
ctgggaggaagaccagctgcca

SEQ ID NO: 1133564 - DNA, 22 bp, Artificial Sequence
  chemically synthesized
tgggaggaagaccagctgccac

SEQ ID NO: 1133565 - DNA, 22 bp, Artificial Sequence
  chemically synthesized
ggaggaagaccagctgccacct

SEQ ID NO: 1133566 - DNA, 22 bp, Artificial Sequence
  chemically synthesized
aaagaactgcagaggtggcagc

SEQ ID NO: 1133567 - DNA, 22 bp, Artificial Sequence
  chemically synthesized
caaagaactgcagaggtggcag

SEQ ID NO: 1133568 - DNA, 22 bp, Artificial Sequence
  chemically synthesized
gtttcaaagaactgcagaggtg

SEQ ID NO: 1133569 - DNA, 22 bp, Artificial Sequence
  chemically synthesized
attagtttcaaagaactgcaga

SEQ ID NO: 1133570 - DNA, 22 bp, Artificial Sequence
  chemically synthesized
tcattagtttcaaagaactgca

SEQ ID NO: 1133571 - DNA, 22 bp, Artificial Sequence
  chemically synthesized
ttctcattagtttcaaagaact

SEQ ID NO: 1133572 - DNA, 22 bp, Artificial Sequence
  chemically synthesized
gttctcattagtttcaaagaac

SEQ ID NO: 1133573 - DNA, 22 bp, Artificial Sequence
  chemically synthesized
ccacctctgcagttctttgaaa

SEQ ID NO: 1133574 - DNA, 22 bp, Artificial Sequence
  chemically synthesized
tgttctcattagtttcaaagaa

SEQ ID NO: 1133575 - DNA, 22 bp, Artificial Sequence
  chemically synthesized
tttgttctcattagtttcaaag

SEQ ID NO: 1133576 - DNA, 22 bp, Artificial Sequence
  chemically synthesized
tctctttgttctcattagtttc

SEQ ID NO: 1133577 - DNA, 22 bp, Artificial Sequence
  chemically synthesized
tgcagttctttgaaactaatga

SEQ ID NO: 1133578 - DNA, 22 bp, Artificial Sequence
  chemically synthesized
cagttctttgaaactaatgaga

SEQ ID NO: 1133579 - DNA, 22 bp, Artificial Sequence
  chemically synthesized
ataaattgtctctttgttctca

SEQ ID NO: 1133580 - DNA, 22 bp, Artificial Sequence
  chemically synthesized
tttgaaactaatgagaacaaag

SEQ ID NO: 1133581 - DNA, 22 bp, Artificial Sequence
  chemically synthesized
tgataaattgtctctttgttct

SEQ ID NO: 1133582 - DNA, 22 bp, Artificial Sequence
  chemically synthesized
tgaaactaatgagaacaaagag

SEQ ID NO: 1133583 - DNA, 22 bp, Artificial Sequence
  chemically synthesized
gaaactaatgagaacaaagaga

SEQ ID NO: 1133584 - DNA, 22 bp, Artificial Sequence
  chemically synthesized
aaactaatgagaacaaagagac

SEQ ID NO: 1133585 - DNA, 22 bp, Artificial Sequence
  chemically synthesized
atgagaacaaagagacaattta

SEQ ID NO: 1133586 - DNA, 22 bp, Artificial Sequence
  chemically synthesized
cgtcccagagattctgataaat

SEQ ID NO: 1133587 - DNA, 22 bp, Artificial Sequence
  chemically synthesized
gctgcgtcccagagattctgat

SEQ ID NO: 1133588 - DNA, 22 bp, Artificial Sequence
  chemically synthesized
agctgcgtcccagagattctga

SEQ ID NO: 1133589 - DNA, 22 bp, Artificial Sequence
  chemically synthesized
tagctgcgtcccagagattctg

SEQ ID NO: 1133590 - DNA, 22 bp, Artificial Sequence
  chemically synthesized
ctttagctgcgtcccagagatt

SEQ ID NO: 1133591 - DNA, 22 bp, Artificial Sequence
  chemically synthesized
acactgctttagctgcgtccca

SEQ ID NO: 1133592 - DNA, 22 bp, Artificial Sequence
  chemically synthesized
atcagaatctctgggacgcagc

SEQ ID NO: 1133593 - DNA, 22 bp, Artificial Sequence
  chemically synthesized
aacactgctttagctgcgtccc

SEQ ID NO: 1133594 - DNA, 22 bp, Artificial Sequence
  chemically synthesized
tcagaatctctgggacgcagct

SEQ ID NO: 1133595 - DNA, 22 bp, Artificial Sequence
  chemically synthesized
ttaacactgctttagctgcgtc

SEQ ID NO: 1133596 - DNA, 22 bp, Artificial Sequence
  chemically synthesized
cctcttaacactgctttagctg

SEQ ID NO: 1133597 - DNA, 22 bp, Artificial Sequence
  chemically synthesized
ccctcttaacactgctttagct

SEQ ID NO: 1133598 - DNA, 22 bp, Artificial Sequence
  chemically synthesized
tgggacgcagctaaagcagtgt

SEQ ID NO: 1133599 - DNA, 22 bp, Artificial Sequence
  chemically synthesized
ggacgcagctaaagcagtgtta

SEQ ID NO: 1133600 - DNA, 22 bp, Artificial Sequence
  chemically synthesized
taaatttccctcttaacactgc

SEQ ID NO: 1133601 - DNA, 22 bp, Artificial Sequence
  chemically synthesized
gtgctataaatttccctcttaa

SEQ ID NO: 1133602 - DNA, 22 bp, Artificial Sequence
  chemically synthesized
agtgctataaatttccctctta

SEQ ID NO: 1133603 - DNA, 22 bp, Artificial Sequence
  chemically synthesized
aagcagtgttaagagggaaatt

SEQ ID NO: 1133604 - DNA, 22 bp, Artificial Sequence
  chemically synthesized
atgtgagcatttagtgctataa

SEQ ID NO: 1133605 - DNA, 22 bp, Artificial Sequence
  chemically synthesized
gatgtgagcatttagtgctata

SEQ ID NO: 1133606 - DNA, 22 bp, Artificial Sequence
  chemically synthesized
agagggaaatttatagcactaa

SEQ ID NO: 1133607 - DNA, 22 bp, Artificial Sequence
  chemically synthesized
tttgatgtgagcatttagtgct

SEQ ID NO: 1133608 - DNA, 22 bp, Artificial Sequence
  chemically synthesized
gctatttgatgtgagcatttag

SEQ ID NO: 1133609 - DNA, 22 bp, Artificial Sequence
  chemically synthesized
tagctatttgatgtgagcattt

SEQ ID NO: 1133610 - DNA, 22 bp, Artificial Sequence
  chemically synthesized
ctagctatttgatgtgagcatt

SEQ ID NO: 1133611 - DNA, 22 bp, Artificial Sequence
  chemically synthesized
tctagctatttgatgtgagcat

SEQ ID NO: 1133612 - DNA, 22 bp, Artificial Sequence
  chemically synthesized
atagcactaaatgctcacatca

SEQ ID NO: 1133613 - DNA, 22 bp, Artificial Sequence
  chemically synthesized
tagcactaaatgctcacatcaa

SEQ ID NO: 1133614 - DNA, 22 bp, Artificial Sequence
  chemically synthesized
agatctttctagctatttgatg

SEQ ID NO: 1133615 - DNA, 22 bp, Artificial Sequence
  chemically synthesized
ttaagatctttctagctatttg

SEQ ID NO: 1133616 - DNA, 22 bp, Artificial Sequence
  chemically synthesized
aatgctcacatcaaatagctag

SEQ ID NO: 1133617 - DNA, 22 bp, Artificial Sequence
  chemically synthesized
ggctgttaagatctttctagct

SEQ ID NO: 1133618 - DNA, 22 bp, Artificial Sequence
  chemically synthesized
acatcaaatagctagaaagatc

SEQ ID NO: 1133619 - DNA, 22 bp, Artificial Sequence
  chemically synthesized
agatgttaggctgttaagatct

SEQ ID NO: 1133620 - DNA, 22 bp, Artificial Sequence
  chemically synthesized
gagatgttaggctgttaagatc

SEQ ID NO: 1133621 - DNA, 22 bp, Artificial Sequence
  chemically synthesized
tttgagatgttaggctgttaag

SEQ ID NO: 1133622 - DNA, 22 bp, Artificial Sequence
  chemically synthesized
atttgagatgttaggctgttaa

SEQ ID NO: 1133623 - DNA, 22 bp, Artificial Sequence
  chemically synthesized
tatttgagatgttaggctgtta

SEQ ID NO: 1133624 - DNA, 22 bp, Artificial Sequence
  chemically synthesized
ttatttgagatgttaggctgtt

SEQ ID NO: 1133625 - DNA, 22 bp, Artificial Sequence
  chemically synthesized
tttatttgagatgttaggctgt

SEQ ID NO: 1133626 - DNA, 22 bp, Artificial Sequence
  chemically synthesized
gaaagatcttaacagcctaaca

SEQ ID NO: 1133627 - DNA, 22 bp, Artificial Sequence
  chemically synthesized
ttttatttgagatgttaggctg

SEQ ID NO: 1133628 - DNA, 22 bp, Artificial Sequence
  chemically synthesized
gtttttttatttgagatgttag

SEQ ID NO: 1133629 - DNA, 22 bp, Artificial Sequence
  chemically synthesized
ctagtttttttatttgagatgt

SEQ ID NO: 1133630 - DNA, 22 bp, Artificial Sequence
  chemically synthesized
gctagtttttttatttgagatg

SEQ ID NO: 1133631 - DNA, 22 bp, Artificial Sequence
  chemically synthesized
aacagcctaacatctcaaataa

SEQ ID NO: 1133632 - DNA, 22 bp, Artificial Sequence
  chemically synthesized
acagcctaacatctcaaataaa

SEQ ID NO: 1133633 - DNA, 22 bp, Artificial Sequence
  chemically synthesized
gtttgctagtttttttatttga

SEQ ID NO: 1133634 - DNA, 22 bp, Artificial Sequence
  chemically synthesized
ggtttgctagtttttttatttg

SEQ ID NO: 1133635 - DNA, 22 bp, Artificial Sequence
  chemically synthesized
ttggtttgctagtttttttatt

SEQ ID NO: 1133636 - DNA, 22 bp, Artificial Sequence
  chemically synthesized
ctcttggtttgctagttttttt

SEQ ID NO: 1133637 - DNA, 22 bp, Artificial Sequence
  chemically synthesized
acatctcaaataaaaaaactag

SEQ ID NO: 1133638 - DNA, 22 bp, Artificial Sequence
  chemically synthesized
gctcttggtttgctagtttttt

SEQ ID NO: 1133639 - DNA, 22 bp, Artificial Sequence
  chemically synthesized
tttgctcttggtttgctagttt

SEQ ID NO: 1133640 - DNA, 22 bp, Artificial Sequence
  chemically synthesized
gtttgctcttggtttgctagtt

SEQ ID NO: 1133641 - DNA, 22 bp, Artificial Sequence
  chemically synthesized
aaataaaaaaactagcaaacca

SEQ ID NO: 1133642 - DNA, 22 bp, Artificial Sequence
  chemically synthesized
tttgtttgctcttggtttgcta

SEQ ID NO: 1133643 - DNA, 22 bp, Artificial Sequence
  chemically synthesized
gtttgtttgctcttggtttgct

SEQ ID NO: 1133644 - DNA, 22 bp, Artificial Sequence
  chemically synthesized
ttgtttgtttgctcttggtttg

SEQ ID NO: 1133645 - DNA, 22 bp, Artificial Sequence
  chemically synthesized
cttgtttgtttgctcttggttt

SEQ ID NO: 1133646 - DNA, 22 bp, Artificial Sequence
  chemically synthesized
tttcttgtttgtttgctcttgg

SEQ ID NO: 1133647 - DNA, 22 bp, Artificial Sequence
  chemically synthesized
gttatttcttgtttgtttgctc

SEQ ID NO: 1133648 - DNA, 22 bp, Artificial Sequence
  chemically synthesized
ggttatttcttgtttgtttgct

SEQ ID NO: 1133649 - DNA, 22 bp, Artificial Sequence
  chemically synthesized
gcaaaccaagagcaaacaaaca

SEQ ID NO: 1133650 - DNA, 22 bp, Artificial Sequence
  chemically synthesized
atcttggttatttcttgtttgt

SEQ ID NO: 1133651 - DNA, 22 bp, Artificial Sequence
  chemically synthesized
tgatcttggttatttcttgttt

SEQ ID NO: 1133652 - DNA, 22 bp, Artificial Sequence
  chemically synthesized
agctctgatcttggttatttct

SEQ ID NO: 1133653 - DNA, 22 bp, Artificial Sequence
  chemically synthesized
agttcagctctgatcttggtta

SEQ ID NO: 1133654 - DNA, 22 bp, Artificial Sequence
  chemically synthesized
cagttcagctctgatcttggtt

SEQ ID NO: 1133655 - DNA, 22 bp, Artificial Sequence
  chemically synthesized
cttcagttcagctctgatcttg

SEQ ID NO: 1133656 - DNA, 22 bp, Artificial Sequence
  chemically synthesized
tctccttcagttcagctctgat

SEQ ID NO: 1133657 - DNA, 22 bp, Artificial Sequence
  chemically synthesized
atctccttcagttcagctctga

SEQ ID NO: 1133658 - DNA, 22 bp, Artificial Sequence
  chemically synthesized
tatctccttcagttcagctctg

SEQ ID NO: 1133659 - DNA, 22 bp, Artificial Sequence
  chemically synthesized
atgtctttatctccttcagttc

SEQ ID NO: 1133660 - DNA, 22 bp, Artificial Sequence
  chemically synthesized
catgtctttatctccttcagtt

SEQ ID NO: 1133661 - DNA, 22 bp, Artificial Sequence
  chemically synthesized
tcatgtctttatctccttcagt

SEQ ID NO: 1133662 - DNA, 22 bp, Artificial Sequence
  chemically synthesized
ttcatgtctttatctccttcag

SEQ ID NO: 1133663 - DNA, 22 bp, Artificial Sequence
  chemically synthesized
gagggtttttcatgtctttatc

SEQ ID NO: 1133664 - DNA, 22 bp, Artificial Sequence
  chemically synthesized
ggagggtttttcatgtctttat

SEQ ID NO: 1133665 - DNA, 22 bp, Artificial Sequence
  chemically synthesized
aactgaaggagataaagacatg

SEQ ID NO: 1133666 - DNA, 22 bp, Artificial Sequence
  chemically synthesized
tggagggtttttcatgtcttta

SEQ ID NO: 1133667 - DNA, 22 bp, Artificial Sequence
  chemically synthesized
ttggagggtttttcatgtcttt

SEQ ID NO: 1133668 - DNA, 22 bp, Artificial Sequence
  chemically synthesized
tttggagggtttttcatgtctt

SEQ ID NO: 1133669 - DNA, 22 bp, Artificial Sequence
  chemically synthesized
aaggagataaagacatgaaaaa

SEQ ID NO: 1133670 - DNA, 22 bp, Artificial Sequence
  chemically synthesized
gttttttggagggtttttcatg

SEQ ID NO: 1133671 - DNA, 22 bp, Artificial Sequence
  chemically synthesized
agttttttggagggtttttcat

SEQ ID NO: 1133672 - DNA, 22 bp, Artificial Sequence
  chemically synthesized
atttagttttttggagggtttt

SEQ ID NO: 1133673 - DNA, 22 bp, Artificial Sequence
  chemically synthesized
gattcatttagttttttggagg

SEQ ID NO: 1133674 - DNA, 22 bp, Artificial Sequence
  chemically synthesized
ctggattcatttagttttttgg

SEQ ID NO: 1133675 - DNA, 22 bp, Artificial Sequence
  chemically synthesized
caaaaaactaaatgaatccagg

SEQ ID NO: 1133676 - DNA, 22 bp, Artificial Sequence
  chemically synthesized
caaaaaccagctcctggattca

SEQ ID NO: 1133677 - DNA, 22 bp, Artificial Sequence
  chemically synthesized
ccaaaaaccagctcctggattc

SEQ ID NO: 1133678 - DNA, 22 bp, Artificial Sequence
  chemically synthesized
tccaaaaaccagctcctggatt

SEQ ID NO: 1133679 - DNA, 22 bp, Artificial Sequence
  chemically synthesized
ttccaaaaaccagctcctggat

SEQ ID NO: 1133680 - DNA, 22 bp, Artificial Sequence
  chemically synthesized
tttccaaaaaccagctcctgga

SEQ ID NO: 1133681 - DNA, 22 bp, Artificial Sequence
  chemically synthesized
ttttccaaaaaccagctcctgg

SEQ ID NO: 1133682 - DNA, 22 bp, Artificial Sequence
  chemically synthesized
tttttttccaaaaaccagctcc

SEQ ID NO: 1133683 - DNA, 22 bp, Artificial Sequence
  chemically synthesized
atttttttccaaaaaccagctc

SEQ ID NO: 1133684 - DNA, 22 bp, Artificial Sequence
  chemically synthesized
aatgaatccaggagctggtttt

SEQ ID NO: 1133685 - DNA, 22 bp, Artificial Sequence
  chemically synthesized
tatttttttccaaaaaccagct

SEQ ID NO: 1133686 - DNA, 22 bp, Artificial Sequence
  chemically synthesized
ttatttttttccaaaaaccagc

SEQ ID NO: 1133687 - DNA, 22 bp, Artificial Sequence
  chemically synthesized
tttttatttttttccaaaaacc

SEQ ID NO: 1133688 - DNA, 22 bp, Artificial Sequence
  chemically synthesized
atttttatttttttccaaaaac

SEQ ID NO: 1133689 - DNA, 22 bp, Artificial Sequence
  chemically synthesized
tatttttatttttttccaaaaa

SEQ ID NO: 1133690 - DNA, 22 bp, Artificial Sequence
  chemically synthesized
ttatttttatttttttccaaaa

SEQ ID NO: 1133691 - DNA, 22 bp, Artificial Sequence
  chemically synthesized
tttatttttatttttttccaaa

SEQ ID NO: 1133692 - DNA, 22 bp, Artificial Sequence
  chemically synthesized
ttttatttttatttttttccaa

SEQ ID NO: 1133693 - DNA, 22 bp, Artificial Sequence
  chemically synthesized
ccttttttatttttattttttt

SEQ ID NO: 1133694 - DNA, 22 bp, Artificial Sequence
  chemically synthesized
gtttttggaaaaaaataaaaat

SEQ ID NO: 1133695 - DNA, 22 bp, Artificial Sequence
  chemically synthesized
ttggaaaaaaataaaaataaaa

SEQ ID NO: 1133696 - DNA, 22 bp, Artificial Sequence
  chemically synthesized
gaagtctaccttttttattttt

SEQ ID NO: 1133697 - DNA, 22 bp, Artificial Sequence
  chemically synthesized
tggaaaaaaataaaaataaaaa

SEQ ID NO: 1133698 - DNA, 22 bp, Artificial Sequence
  chemically synthesized
ggaaaaaaataaaaataaaaaa

SEQ ID NO: 1133699 - DNA, 22 bp, Artificial Sequence
  chemically synthesized
gaaaaaaataaaaataaaaaag

SEQ ID NO: 1133700 - DNA, 22 bp, Artificial Sequence
  chemically synthesized
actagaagtctaccttttttat

SEQ ID NO: 1133701 - DNA, 22 bp, Artificial Sequence
  chemically synthesized
gtctaactagaagtctaccttt

SEQ ID NO: 1133702 - DNA, 22 bp, Artificial Sequence
  chemically synthesized
ttagtctaactagaagtctacc

SEQ ID NO: 1133703 - DNA, 22 bp, Artificial Sequence
  chemically synthesized
attagtctaactagaagtctac

SEQ ID NO: 1133704 - DNA, 22 bp, Artificial Sequence
  chemically synthesized
cttattagtctaactagaagtc

SEQ ID NO: 1133705 - DNA, 22 bp, Artificial Sequence
  chemically synthesized
ccttattagtctaactagaagt

SEQ ID NO: 1133706 - DNA, 22 bp, Artificial Sequence
  chemically synthesized
ttccttattagtctaactagaa

SEQ ID NO: 1133707 - DNA, 22 bp, Artificial Sequence
  chemically synthesized
cttccttattagtctaactaga

SEQ ID NO: 1133708 - DNA, 22 bp, Artificial Sequence
  chemically synthesized
tcttccttattagtctaactag

SEQ ID NO: 1133709 - DNA, 22 bp, Artificial Sequence
  chemically synthesized
ttcttccttattagtctaacta

SEQ ID NO: 1133710 - DNA, 22 bp, Artificial Sequence
  chemically synthesized
ttttcttccttattagtctaac

SEQ ID NO: 1133711 - DNA, 22 bp, Artificial Sequence
  chemically synthesized
tcttttcttccttattagtcta

SEQ ID NO: 1133712 - DNA, 22 bp, Artificial Sequence
  chemically synthesized
tctcttttcttccttattagtc

SEQ ID NO: 1133713 - DNA, 22 bp, Artificial Sequence
  chemically synthesized
ctctcttttcttccttattagt

SEQ ID NO: 1133714 - DNA, 22 bp, Artificial Sequence
  chemically synthesized
ttctctcttttcttccttatta

SEQ ID NO: 1133715 - DNA, 22 bp, Artificial Sequence
  chemically synthesized
ctagttagactaataaggaaga

SEQ ID NO: 1133716 - DNA, 22 bp, Artificial Sequence
  chemically synthesized
tagttagactaataaggaagaa

SEQ ID NO: 1133717 - DNA, 22 bp, Artificial Sequence
  chemically synthesized
attcttctctcttttcttcctt

SEQ ID NO: 1133718 - DNA, 22 bp, Artificial Sequence
  chemically synthesized
gttagactaataaggaagaaaa

SEQ ID NO: 1133719 - DNA, 22 bp, Artificial Sequence
  chemically synthesized
gattcttctctcttttcttcct

SEQ ID NO: 1133720 - DNA, 22 bp, Artificial Sequence
  chemically synthesized
tttgattcttctctcttttctt

SEQ ID NO: 1133721 - DNA, 22 bp, Artificial Sequence
  chemically synthesized
gactaataaggaagaaaagaga

SEQ ID NO: 1133722 - DNA, 22 bp, Artificial Sequence
  chemically synthesized
atttgattcttctctcttttct

SEQ ID NO: 1133723 - DNA, 22 bp, Artificial Sequence
  chemically synthesized
ataaggaagaaaagagagaaga

SEQ ID NO: 1133724 - DNA, 22 bp, Artificial Sequence
  chemically synthesized
tgtttatttgattcttctctct

SEQ ID NO: 1133725 - DNA, 22 bp, Artificial Sequence
  chemically synthesized
attgtgtttatttgattcttct

SEQ ID NO: 1133726 - DNA, 22 bp, Artificial Sequence
  chemically synthesized
cattgtgtttatttgattcttc

SEQ ID NO: 1133727 - DNA, 22 bp, Artificial Sequence
  chemically synthesized
tcattgtgtttatttgattctt

SEQ ID NO: 1133728 - DNA, 22 bp, Artificial Sequence
  chemically synthesized
ttcattgtgtttatttgattct

SEQ ID NO: 1133729 - DNA, 22 bp, Artificial Sequence
  chemically synthesized
aaatttttcattgtgtttattt

SEQ ID NO: 1133730 - DNA, 22 bp, Artificial Sequence
  chemically synthesized
caaatttttcattgtgtttatt

SEQ ID NO: 1133731 - DNA, 22 bp, Artificial Sequence
  chemically synthesized
ttcaaatttttcattgtgttta

SEQ ID NO: 1133732 - DNA, 22 bp, Artificial Sequence
  chemically synthesized
ctcttcaaatttttcattgtgt

SEQ ID NO: 1133733 - DNA, 22 bp, Artificial Sequence
  chemically synthesized
gtgatattcctcttcaaatttt

SEQ ID NO: 1133734 - DNA, 22 bp, Artificial Sequence
  chemically synthesized
ttggtgatattcctcttcaaat

SEQ ID NO: 1133735 - DNA, 22 bp, Artificial Sequence
  chemically synthesized
tagaattattggtgatattcct

SEQ ID NO: 1133736 - DNA, 22 bp, Artificial Sequence
  chemically synthesized
tgtagaattattggtgatattc

SEQ ID NO: 1133737 - DNA, 22 bp, Artificial Sequence
  chemically synthesized
ctgtagaattattggtgatatt

SEQ ID NO: 1133738 - DNA, 22 bp, Artificial Sequence
  chemically synthesized
gaagaggaatatcaccaataat

SEQ ID NO: 1133739 - DNA, 22 bp, Artificial Sequence
  chemically synthesized
tatttctgtagaattattggtg

SEQ ID NO: 1133740 - DNA, 22 bp, Artificial Sequence
  chemically synthesized
aagaggaatatcaccaataatt

SEQ ID NO: 1133741 - DNA, 22 bp, Artificial Sequence
  chemically synthesized
gtatttctgtagaattattggt

SEQ ID NO: 1133742 - DNA, 22 bp, Artificial Sequence
  chemically synthesized
tttgtatttctgtagaattatt

SEQ ID NO: 1133743 - DNA, 22 bp, Artificial Sequence
  chemically synthesized
atggttgtttgtatttctgtag

SEQ ID NO: 1133744 - DNA, 22 bp, Artificial Sequence
  chemically synthesized
cctgatggttgtttgtatttct

SEQ ID NO: 1133745 - DNA, 22 bp, Artificial Sequence
  chemically synthesized
tagtattccctgatggttgttt

SEQ ID NO: 1133746 - DNA, 22 bp, Artificial Sequence
  chemically synthesized
tacagaaatacaaacaaccatc

SEQ ID NO: 1133747 - DNA, 22 bp, Artificial Sequence
  chemically synthesized
atagtattccctgatggttgtt

SEQ ID NO: 1133748 - DNA, 22 bp, Artificial Sequence
  chemically synthesized
cagaaatacaaacaaccatcag

SEQ ID NO: 1133749 - DNA, 22 bp, Artificial Sequence
  chemically synthesized
tgtgcatagaggtgtttatagt

SEQ ID NO: 1133750 - DNA, 22 bp, Artificial Sequence
  chemically synthesized
atgtgcatagaggtgtttatag

SEQ ID NO: 1133751 - DNA, 22 bp, Artificial Sequence
  chemically synthesized
gtttatgtgcatagaggtgttt

SEQ ID NO: 1133752 - DNA, 22 bp, Artificial Sequence
  chemically synthesized
tagtttatgtgcatagaggtgt

SEQ ID NO: 1133753 - DNA, 22 bp, Artificial Sequence
  chemically synthesized
ctagtttatgtgcatagaggtg

SEQ ID NO: 1133754 - DNA, 22 bp, Artificial Sequence
  chemically synthesized
tctagtttatgtgcatagaggt

SEQ ID NO: 1133755 - DNA, 22 bp, Artificial Sequence
  chemically synthesized
ggttttctagtttatgtgcata

SEQ ID NO: 1133756 - DNA, 22 bp, Artificial Sequence
  chemically synthesized
taaacacctctatgcacataaa

SEQ ID NO: 1133757 - DNA, 22 bp, Artificial Sequence
  chemically synthesized
taggttttctagtttatgtgca

SEQ ID NO: 1133758 - DNA, 22 bp, Artificial Sequence
  chemically synthesized
ctctaggttttctagtttatgt

SEQ ID NO: 1133759 - DNA, 22 bp, Artificial Sequence
  chemically synthesized
cctctaggttttctagtttatg

SEQ ID NO: 1133760 - DNA, 22 bp, Artificial Sequence
  chemically synthesized
tatgcacataaactagaaaacc

SEQ ID NO: 1133761 - DNA, 22 bp, Artificial Sequence
  chemically synthesized
tccatttcctctaggttttcta

SEQ ID NO: 1133762 - DNA, 22 bp, Artificial Sequence
  chemically synthesized
tgcacataaactagaaaaccta

SEQ ID NO: 1133763 - DNA, 22 bp, Artificial Sequence
  chemically synthesized
atccatttcctctaggttttct

SEQ ID NO: 1133764 - DNA, 22 bp, Artificial Sequence
  chemically synthesized
aataatttatccatttcctcta

SEQ ID NO: 1133765 - DNA, 22 bp, Artificial Sequence
  chemically synthesized
gaaaacctagaggaaatggata

SEQ ID NO: 1133766 - DNA, 22 bp, Artificial Sequence
  chemically synthesized
gaggaaatggataaattattga

SEQ ID NO: 1133767 - DNA, 22 bp, Artificial Sequence
  chemically synthesized
gaggggagaaatgtgttcaata

SEQ ID NO: 1133768 - DNA, 22 bp, Artificial Sequence
  chemically synthesized
agaggggagaaatgtgttcaat

SEQ ID NO: 1133769 - DNA, 22 bp, Artificial Sequence
  chemically synthesized
agtcttagaggggagaaatgtg

SEQ ID NO: 1133770 - DNA, 22 bp, Artificial Sequence
  chemically synthesized
tggttcagtcttagaggggaga

SEQ ID NO: 1133771 - DNA, 22 bp, Artificial Sequence
  chemically synthesized
ttgaacacatttctcccctcta

SEQ ID NO: 1133772 - DNA, 22 bp, Artificial Sequence
  chemically synthesized
atggttcagtcttagaggggag

SEQ ID NO: 1133773 - DNA, 22 bp, Artificial Sequence
  chemically synthesized
tatggttcagtcttagagggga

SEQ ID NO: 1133774 - DNA, 22 bp, Artificial Sequence
  chemically synthesized
aacacatttctcccctctaaga

SEQ ID NO: 1133775 - DNA, 22 bp, Artificial Sequence
  chemically synthesized
ctttatggttcagtcttagagg

SEQ ID NO: 1133776 - DNA, 22 bp, Artificial Sequence
  chemically synthesized
cctttatggttcagtcttagag

SEQ ID NO: 1133777 - DNA, 22 bp, Artificial Sequence
  chemically synthesized
atttcctttatggttcagtctt

SEQ ID NO: 1133778 - DNA, 22 bp, Artificial Sequence
  chemically synthesized
ctcccctctaagactgaaccat

SEQ ID NO: 1133779 - DNA, 22 bp, Artificial Sequence
  chemically synthesized
tcccctctaagactgaaccata

SEQ ID NO: 1133780 - DNA, 22 bp, Artificial Sequence
  chemically synthesized
ccctctaagactgaaccataaa

SEQ ID NO: 1133781 - DNA, 22 bp, Artificial Sequence
  chemically synthesized
agcaattcatttcctttatggt

SEQ ID NO: 1133782 - DNA, 22 bp, Artificial Sequence
  chemically synthesized
taagactgaaccataaaggaaa

SEQ ID NO: 1133783 - DNA, 22 bp, Artificial Sequence
  chemically synthesized
ttcagcaattcatttcctttat

SEQ ID NO: 1133784 - DNA, 22 bp, Artificial Sequence
  chemically synthesized
agactgaaccataaaggaaatg

SEQ ID NO: 1133785 - DNA, 22 bp, Artificial Sequence
  chemically synthesized
atctattcagcaattcatttcc

SEQ ID NO: 1133786 - DNA, 22 bp, Artificial Sequence
  chemically synthesized
aaccataaaggaaatgaattgc

SEQ ID NO: 1133787 - DNA, 22 bp, Artificial Sequence
  chemically synthesized
ttgatctattcagcaattcatt

SEQ ID NO: 1133788 - DNA, 22 bp, Artificial Sequence
  chemically synthesized
agaacgcattattgatctattc

SEQ ID NO: 1133789 - DNA, 22 bp, Artificial Sequence
  chemically synthesized
cagaacgcattattgatctatt

SEQ ID NO: 1133790 - DNA, 22 bp, Artificial Sequence
  chemically synthesized
aatttcagaacgcattattgat

SEQ ID NO: 1133791 - DNA, 22 bp, Artificial Sequence
  chemically synthesized
ctgaatagatcaataatgcgtt

SEQ ID NO: 1133792 - DNA, 22 bp, Artificial Sequence
  chemically synthesized
cctcaatttcagaacgcattat

SEQ ID NO: 1133793 - DNA, 22 bp, Artificial Sequence
  chemically synthesized
aatagatcaataatgcgttctg

SEQ ID NO: 1133794 - DNA, 22 bp, Artificial Sequence
  chemically synthesized
ttgcctcaatttcagaacgcat

SEQ ID NO: 1133795 - DNA, 22 bp, Artificial Sequence
  chemically synthesized
ttattgcctcaatttcagaacg

SEQ ID NO: 1133796 - DNA, 22 bp, Artificial Sequence
  chemically synthesized
attattgcctcaatttcagaac

SEQ ID NO: 1133797 - DNA, 22 bp, Artificial Sequence
  chemically synthesized
gtgggatatttattattgcctc

SEQ ID NO: 1133798 - DNA, 22 bp, Artificial Sequence
  chemically synthesized
gttggtgggatatttattattg

SEQ ID NO: 1133799 - DNA, 22 bp, Artificial Sequence
  chemically synthesized
tgaaattgaggcaataataaat

SEQ ID NO: 1133800 - DNA, 22 bp, Artificial Sequence
  chemically synthesized
aaattgaggcaataataaatat

SEQ ID NO: 1133801 - DNA, 22 bp, Artificial Sequence
  chemically synthesized
ttggttggtgggatatttatta

SEQ ID NO: 1133802 - DNA, 22 bp, Artificial Sequence
  chemically synthesized
gttggttggtgggatatttatt

SEQ ID NO: 1133803 - DNA, 22 bp, Artificial Sequence
  chemically synthesized
tgttggttggtgggatatttat

SEQ ID NO: 1133804 - DNA, 22 bp, Artificial Sequence
  chemically synthesized
ttgttggttggtgggatattta

SEQ ID NO: 1133805 - DNA, 22 bp, Artificial Sequence
  chemically synthesized
aggcaataataaatatcccacc

SEQ ID NO: 1133806 - DNA, 22 bp, Artificial Sequence
  chemically synthesized
ggcttttgttggttggtgggat

SEQ ID NO: 1133807 - DNA, 22 bp, Artificial Sequence
  chemically synthesized
gacctgggcttttgttggttgg

SEQ ID NO: 1133808 - DNA, 22 bp, Artificial Sequence
  chemically synthesized
catctggacctgggcttttgtt

SEQ ID NO: 1133809 - DNA, 22 bp, Artificial Sequence
  chemically synthesized
tgattccatctggacctgggct

SEQ ID NO: 1133810 - DNA, 22 bp, Artificial Sequence
  chemically synthesized
agctatgattccatctggacct

SEQ ID NO: 1133811 - DNA, 22 bp, Artificial Sequence
  chemically synthesized
gtagaattcagctatgattcca

SEQ ID NO: 1133812 - DNA, 22 bp, Artificial Sequence
  chemically synthesized
taccgctagtagaattcagcta

SEQ ID NO: 1133813 - DNA, 22 bp, Artificial Sequence
  chemically synthesized
gtaccgctagtagaattcagct

SEQ ID NO: 1133814 - DNA, 22 bp, Artificial Sequence
  chemically synthesized
tgtaccgctagtagaattcagc

SEQ ID NO: 1133815 - DNA, 22 bp, Artificial Sequence
  chemically synthesized
tttgtaccgctagtagaattca

SEQ ID NO: 1133816 - DNA, 22 bp, Artificial Sequence
  chemically synthesized
ctttgtaccgctagtagaattc

SEQ ID NO: 1133817 - DNA, 22 bp, Artificial Sequence
  chemically synthesized
ttctttgtaccgctagtagaat

SEQ ID NO: 1133818 - DNA, 22 bp, Artificial Sequence
  chemically synthesized
aattctactagcggtacaaaga

SEQ ID NO: 1133819 - DNA, 22 bp, Artificial Sequence
  chemically synthesized
tactagcggtacaaagaagagc

SEQ ID NO: 1133820 - DNA, 22 bp, Artificial Sequence
  chemically synthesized
ctagcggtacaaagaagagctg

SEQ ID NO: 1133821 - DNA, 22 bp, Artificial Sequence
  chemically synthesized
agtggaaatgataccagctctt

SEQ ID NO: 1133822 - DNA, 22 bp, Artificial Sequence
  chemically synthesized
gcggtacaaagaagagctggta

SEQ ID NO: 1133823 - DNA, 22 bp, Artificial Sequence
  chemically synthesized
cagtggaaatgataccagctct

SEQ ID NO: 1133824 - DNA, 22 bp, Artificial Sequence
  chemically synthesized
gaatagtttcagtggaaatgat

SEQ ID NO: 1133825 - DNA, 22 bp, Artificial Sequence
  chemically synthesized
ggaatagtttcagtggaaatga

SEQ ID NO: 1133826 - DNA, 22 bp, Artificial Sequence
  chemically synthesized
tggaatagtttcagtggaaatg

SEQ ID NO: 1133827 - DNA, 22 bp, Artificial Sequence
  chemically synthesized
ttggaatagtttcagtggaaat

SEQ ID NO: 1133828 - DNA, 22 bp, Artificial Sequence
  chemically synthesized
tttggaatagtttcagtggaaa

SEQ ID NO: 1133829 - DNA, 22 bp, Artificial Sequence
  chemically synthesized
ttttggaatagtttcagtggaa

SEQ ID NO: 1133830 - DNA, 22 bp, Artificial Sequence
  chemically synthesized
gtatcatttccactgaaactat

SEQ ID NO: 1133831 - DNA, 22 bp, Artificial Sequence
  chemically synthesized
aatttttttggaatagtttcag

SEQ ID NO: 1133832 - DNA, 22 bp, Artificial Sequence
  chemically synthesized
caatttttttggaatagtttca

SEQ ID NO: 1133833 - DNA, 22 bp, Artificial Sequence
  chemically synthesized
tcaatttttttggaatagtttc

SEQ ID NO: 1133834 - DNA, 22 bp, Artificial Sequence
  chemically synthesized
ttcaatttttttggaatagttt

SEQ ID NO: 1133835 - DNA, 22 bp, Artificial Sequence
  chemically synthesized
ttttcaatttttttggaatagt

SEQ ID NO: 1133836 - DNA, 22 bp, Artificial Sequence
  chemically synthesized
cttttcaatttttttggaatag

SEQ ID NO: 1133837 - DNA, 22 bp, Artificial Sequence
  chemically synthesized
ccactgaaactattccaaaaaa

SEQ ID NO: 1133838 - DNA, 22 bp, Artificial Sequence
  chemically synthesized
cactgaaactattccaaaaaaa

SEQ ID NO: 1133839 - DNA, 22 bp, Artificial Sequence
  chemically synthesized
aaactattccaaaaaaattgaa

SEQ ID NO: 1133840 - DNA, 22 bp, Artificial Sequence
  chemically synthesized
ggagaaatcccttcttttcaat

SEQ ID NO: 1133841 - DNA, 22 bp, Artificial Sequence
  chemically synthesized
gggagaaatcccttcttttcaa

SEQ ID NO: 1133842 - DNA, 22 bp, Artificial Sequence
  chemically synthesized
ttccaaaaaaattgaaaagaag

SEQ ID NO: 1133843 - DNA, 22 bp, Artificial Sequence
  chemically synthesized
caaaaaaattgaaaagaaggga

SEQ ID NO: 1133844 - DNA, 22 bp, Artificial Sequence
  chemically synthesized
ataatataagtttgggagaaat

SEQ ID NO: 1133845 - DNA, 22 bp, Artificial Sequence
  chemically synthesized
aaaagaagggatttctcccaaa

SEQ ID NO: 1133846 - DNA, 22 bp, Artificial Sequence
  chemically synthesized
acctcataatataagtttggga

SEQ ID NO: 1133847 - DNA, 22 bp, Artificial Sequence
  chemically synthesized
ctcccaaacttatattatgagg

SEQ ID NO: 1133848 - DNA, 22 bp, Artificial Sequence
  chemically synthesized
tcccaaacttatattatgaggt

SEQ ID NO: 1133849 - DNA, 22 bp, Artificial Sequence
  chemically synthesized
ccaaacttatattatgaggtca

SEQ ID NO: 1133850 - DNA, 22 bp, Artificial Sequence
  chemically synthesized
gcatcagggtgatgctgacctc

SEQ ID NO: 1133851 - DNA, 22 bp, Artificial Sequence
  chemically synthesized
ggcatcagggtgatgctgacct

SEQ ID NO: 1133852 - DNA, 22 bp, Artificial Sequence
  chemically synthesized
tggcatcagggtgatgctgacc

SEQ ID NO: 1133853 - DNA, 22 bp, Artificial Sequence
  chemically synthesized
atattatgaggtcagcatcacc

SEQ ID NO: 1133854 - DNA, 22 bp, Artificial Sequence
  chemically synthesized
tattatgaggtcagcatcaccc

SEQ ID NO: 1133855 - DNA, 22 bp, Artificial Sequence
  chemically synthesized
ccaggttttggcatcagggtga

SEQ ID NO: 1133856 - DNA, 22 bp, Artificial Sequence
  chemically synthesized
tgaggtcagcatcaccctgatg

SEQ ID NO: 1133857 - DNA, 22 bp, Artificial Sequence
  chemically synthesized
cctcccaggttttggcatcagg

SEQ ID NO: 1133858 - DNA, 22 bp, Artificial Sequence
  chemically synthesized
cctccctcccaggttttggcat

SEQ ID NO: 1133859 - DNA, 22 bp, Artificial Sequence
  chemically synthesized
cctccctccctcccaggttttg

SEQ ID NO: 1133860 - DNA, 22 bp, Artificial Sequence
  chemically synthesized
cctccctccctccctcccaggt

SEQ ID NO: 1133861 - DNA, 22 bp, Artificial Sequence
  chemically synthesized
atgccaaaacctgggagggagg

SEQ ID NO: 1133862 - DNA, 22 bp, Artificial Sequence
  chemically synthesized
cctccctccctccctccctccc

SEQ ID NO: 1133863 - DNA, 22 bp, Artificial Sequence
  chemically synthesized
cccctccctccctccctccctc

SEQ ID NO: 1133864 - DNA, 22 bp, Artificial Sequence
  chemically synthesized
cctccccctccctccctccctc

SEQ ID NO: 1133865 - DNA, 22 bp, Artificial Sequence
  chemically synthesized
tccctccccctccctccctccc

SEQ ID NO: 1133866 - DNA, 22 bp, Artificial Sequence
  chemically synthesized
ggagggagggagggagggaggg

SEQ ID NO: 1133867 - DNA, 22 bp, Artificial Sequence
  chemically synthesized
tctccctccccctccctccctc

SEQ ID NO: 1133868 - DNA, 22 bp, Artificial Sequence
  chemically synthesized
tctctccctccccctccctccc

SEQ ID NO: 1133869 - DNA, 22 bp, Artificial Sequence
  chemically synthesized
tctctctccctccccctccctc

SEQ ID NO: 1133870 - DNA, 22 bp, Artificial Sequence
  chemically synthesized
tctctctctccctccccctccc

SEQ ID NO: 1133871 - DNA, 22 bp, Artificial Sequence
  chemically synthesized
tctctctctctccctccccctc

SEQ ID NO: 1133872 - DNA, 22 bp, Artificial Sequence
  chemically synthesized
tctctctctctctccctccccc

SEQ ID NO: 1133873 - DNA, 22 bp, Artificial Sequence
  chemically synthesized
tctctctctctctctccctccc

SEQ ID NO: 1133874 - DNA, 22 bp, Artificial Sequence
  chemically synthesized
tctctctctctctctctccctc

SEQ ID NO: 1133875 - DNA, 22 bp, Artificial Sequence
  chemically synthesized
tctctctctctctctctctccc

SEQ ID NO: 1133876 - DNA, 22 bp, Artificial Sequence
  chemically synthesized
tctctctctctctctctctctc

SEQ ID NO: 1133877 - DNA, 22 bp, Artificial Sequence
  chemically synthesized
tctctctctctctctctctctc

SEQ ID NO: 1133878 - DNA, 22 bp, Artificial Sequence
  chemically synthesized
tctctctctctctctctctctc

SEQ ID NO: 1133879 - DNA, 22 bp, Artificial Sequence
  chemically synthesized
tctctctctctctctctctctc

SEQ ID NO: 1133880 - DNA, 22 bp, Artificial Sequence
  chemically synthesized
tctctctctctctctctctctc

SEQ ID NO: 1133881 - DNA, 22 bp, Artificial Sequence
  chemically synthesized
tctctctctctctctctctctc

SEQ ID NO: 1133882 - DNA, 22 bp, Artificial Sequence
  chemically synthesized
tctctctctctctctctctctc

SEQ ID NO: 1133883 - DNA, 22 bp, Artificial Sequence
  chemically synthesized
tctctctctctctctctctctc

SEQ ID NO: 1133884 - DNA, 22 bp, Artificial Sequence
  chemically synthesized
tctctctctctctctctctctc

SEQ ID NO: 1133885 - DNA, 22 bp, Artificial Sequence
  chemically synthesized
ctctctctctctctctctctct

SEQ ID NO: 1133886 - DNA, 22 bp, Artificial Sequence
  chemically synthesized
cttctctctctctctctctctc

SEQ ID NO: 1133887 - DNA, 22 bp, Artificial Sequence
  chemically synthesized
ccttctctctctctctctctct

SEQ ID NO: 1133888 - DNA, 22 bp, Artificial Sequence
  chemically synthesized
tccttctctctctctctctctc

SEQ ID NO: 1133889 - DNA, 22 bp, Artificial Sequence
  chemically synthesized
tttccttctctctctctctctc

SEQ ID NO: 1133890 - DNA, 22 bp, Artificial Sequence
  chemically synthesized
ctttccttctctctctctctct

SEQ ID NO: 1133891 - DNA, 22 bp, Artificial Sequence
  chemically synthesized
ttctttccttctctctctctct

SEQ ID NO: 1133892 - DNA, 22 bp, Artificial Sequence
  chemically synthesized
cttctttccttctctctctctc

SEQ ID NO: 1133893 - DNA, 22 bp, Artificial Sequence
  chemically synthesized
tcttctttccttctctctctct

SEQ ID NO: 1133894 - DNA, 22 bp, Artificial Sequence
  chemically synthesized
tttcttctttccttctctctct

SEQ ID NO: 1133895 - DNA, 22 bp, Artificial Sequence
  chemically synthesized
ctttcttctttccttctctctc

SEQ ID NO: 1133896 - DNA, 22 bp, Artificial Sequence
  chemically synthesized
tctttcttctttccttctctct

SEQ ID NO: 1133897 - DNA, 22 bp, Artificial Sequence
  chemically synthesized
tttctttcttctttccttctct

SEQ ID NO: 1133898 - DNA, 22 bp, Artificial Sequence
  chemically synthesized
ctttctttcttctttccttctc

SEQ ID NO: 1133899 - DNA, 22 bp, Artificial Sequence
  chemically synthesized
tctttctttcttctttccttct

SEQ ID NO: 1133900 - DNA, 22 bp, Artificial Sequence
  chemically synthesized
tttctttctttcttctttcctt

SEQ ID NO: 1133901 - DNA, 22 bp, Artificial Sequence
  chemically synthesized
ctttctttctttcttctttcct

SEQ ID NO: 1133902 - DNA, 22 bp, Artificial Sequence
  chemically synthesized
tctttctttctttcttctttcc

SEQ ID NO: 1133903 - DNA, 22 bp, Artificial Sequence
  chemically synthesized
tttctttctttctttcttcttt

SEQ ID NO: 1133904 - DNA, 22 bp, Artificial Sequence
  chemically synthesized
ctttctttctttctttcttctt

SEQ ID NO: 1133905 - DNA, 22 bp, Artificial Sequence
  chemically synthesized
tctttctttctttctttcttct

SEQ ID NO: 1133906 - DNA, 22 bp, Artificial Sequence
  chemically synthesized
tttctttctttctttctttctt

SEQ ID NO: 1133907 - DNA, 22 bp, Artificial Sequence
  chemically synthesized
ctttctttctttctttctttct

SEQ ID NO: 1133908 - DNA, 22 bp, Artificial Sequence
  chemically synthesized
tctttctttctttctttctttc

SEQ ID NO: 1133909 - DNA, 22 bp, Artificial Sequence
  chemically synthesized
tttctttctttctttctttctt

SEQ ID NO: 1133910 - DNA, 22 bp, Artificial Sequence
  chemically synthesized
ctttctttctttctttctttct

SEQ ID NO: 1133911 - DNA, 22 bp, Artificial Sequence
  chemically synthesized
tctttctttctttctttctttc

SEQ ID NO: 1133912 - DNA, 22 bp, Artificial Sequence
  chemically synthesized
tttctttctttctttctttctt

SEQ ID NO: 1133913 - DNA, 22 bp, Artificial Sequence
  chemically synthesized
ctttctttctttctttctttct

SEQ ID NO: 1133914 - DNA, 22 bp, Artificial Sequence
  chemically synthesized
tctttctttctttctttctttc

SEQ ID NO: 1133915 - DNA, 22 bp, Artificial Sequence
  chemically synthesized
tttctttctttctttctttctt

SEQ ID NO: 1133916 - DNA, 22 bp, Artificial Sequence
  chemically synthesized
ctttctttctttctttctttct

SEQ ID NO: 1133917 - DNA, 22 bp, Artificial Sequence
  chemically synthesized
tctttctttctttctttctttc

SEQ ID NO: 1133918 - DNA, 22 bp, Artificial Sequence
  chemically synthesized
tttctttctttctttctttctt

SEQ ID NO: 1133919 - DNA, 22 bp, Artificial Sequence
  chemically synthesized
ctttctttctttctttctttct

SEQ ID NO: 1133920 - DNA, 22 bp, Artificial Sequence
  chemically synthesized
tctttctttctttctttctttc

SEQ ID NO: 1133921 - DNA, 22 bp, Artificial Sequence
  chemically synthesized
tttctttctttctttctttctt

SEQ ID NO: 1133922 - DNA, 22 bp, Artificial Sequence
  chemically synthesized
ctttctttctttctttctttct

SEQ ID NO: 1133923 - DNA, 22 bp, Artificial Sequence
  chemically synthesized
tctttctttctttctttctttc

SEQ ID NO: 1133924 - DNA, 22 bp, Artificial Sequence
  chemically synthesized
tttctttctttctttctttctt

SEQ ID NO: 1133925 - DNA, 22 bp, Artificial Sequence
  chemically synthesized
ctttctttctttctttctttct

SEQ ID NO: 1133926 - DNA, 22 bp, Artificial Sequence
  chemically synthesized
tctttctttctttctttctttc

SEQ ID NO: 1133927 - DNA, 22 bp, Artificial Sequence
  chemically synthesized
tttctttctttctttctttctt

SEQ ID NO: 1133928 - DNA, 22 bp, Artificial Sequence
  chemically synthesized
ctttctttctttctttctttct

SEQ ID NO: 1133929 - DNA, 22 bp, Artificial Sequence
  chemically synthesized
tctttctttctttctttctttc

SEQ ID NO: 1133930 - DNA, 22 bp, Artificial Sequence
  chemically synthesized
tttctttctttctttctttctt

SEQ ID NO: 1133931 - DNA, 22 bp, Artificial Sequence
  chemically synthesized
ctttctttctttctttctttct

SEQ ID NO: 1133932 - DNA, 22 bp, Artificial Sequence
  chemically synthesized
tctttctttctttctttctttc

SEQ ID NO: 1133933 - DNA, 22 bp, Artificial Sequence
  chemically synthesized
tttctttctttctttctttctt

SEQ ID NO: 1133934 - DNA, 22 bp, Artificial Sequence
  chemically synthesized
ctttctttctttctttctttct

SEQ ID NO: 1133935 - DNA, 22 bp, Artificial Sequence
  chemically synthesized
tctttctttctttctttctttc

SEQ ID NO: 1133936 - DNA, 22 bp, Artificial Sequence
  chemically synthesized
tttctttctttctttctttctt

SEQ ID NO: 1133937 - DNA, 22 bp, Artificial Sequence
  chemically synthesized
tctttctttctttctttctttc

SEQ ID NO: 1133938 - DNA, 22 bp, Artificial Sequence
  chemically synthesized
tctctttctttctttctttctt

SEQ ID NO: 1133939 - DNA, 22 bp, Artificial Sequence
  chemically synthesized
tctctctttctttctttctttc

SEQ ID NO: 1133940 - DNA, 22 bp, Artificial Sequence
  chemically synthesized
tctctctctttctttctttctt

SEQ ID NO: 1133941 - DNA, 22 bp, Artificial Sequence
  chemically synthesized
cctctctctctctttctttctt

SEQ ID NO: 1133942 - DNA, 22 bp, Artificial Sequence
  chemically synthesized
tccctctctctctctttctttc

SEQ ID NO: 1133943 - DNA, 22 bp, Artificial Sequence
  chemically synthesized
tctccctctctctctctttctt

SEQ ID NO: 1133944 - DNA, 22 bp, Artificial Sequence
  chemically synthesized
tctctccctctctctctctttc

SEQ ID NO: 1133945 - DNA, 22 bp, Artificial Sequence
  chemically synthesized
ctctctccctctctctctcttt

SEQ ID NO: 1133946 - DNA, 22 bp, Artificial Sequence
  chemically synthesized
tctctctccctctctctctctt

SEQ ID NO: 1133947 - DNA, 22 bp, Artificial Sequence
  chemically synthesized
tttctctctccctctctctctc

SEQ ID NO: 1133948 - DNA, 22 bp, Artificial Sequence
  chemically synthesized
ctttctctctccctctctctct

SEQ ID NO: 1133949 - DNA, 22 bp, Artificial Sequence
  chemically synthesized
tctttctctctccctctctctc

SEQ ID NO: 1133950 - DNA, 22 bp, Artificial Sequence
  chemically synthesized
tttctttctctctccctctctc

SEQ ID NO: 1133951 - DNA, 22 bp, Artificial Sequence
  chemically synthesized
tctttctttctctctccctctc

SEQ ID NO: 1133952 - DNA, 22 bp, Artificial Sequence
  chemically synthesized
tctctttctttctctctccctc

SEQ ID NO: 1133953 - DNA, 22 bp, Artificial Sequence
  chemically synthesized
tctctctttctttctctctccc

SEQ ID NO: 1133954 - DNA, 22 bp, Artificial Sequence
  chemically synthesized
tctctctctttctttctctctc

SEQ ID NO: 1133955 - DNA, 22 bp, Artificial Sequence
  chemically synthesized
tctctctctctttctttctctc

SEQ ID NO: 1133956 - DNA, 22 bp, Artificial Sequence
  chemically synthesized
tctctctctctctttctttctc

SEQ ID NO: 1133957 - DNA, 22 bp, Artificial Sequence
  chemically synthesized
tctctctctctctctttctttc

SEQ ID NO: 1133958 - DNA, 22 bp, Artificial Sequence
  chemically synthesized
tctctctctctctctctttctt

SEQ ID NO: 1133959 - DNA, 22 bp, Artificial Sequence
  chemically synthesized
ctctctctctctctctctttct

SEQ ID NO: 1133960 - DNA, 22 bp, Artificial Sequence
  chemically synthesized
tctctctctctctctctctttc

SEQ ID NO: 1133961 - DNA, 22 bp, Artificial Sequence
  chemically synthesized
tttctctctctctctctctctt

SEQ ID NO: 1133962 - DNA, 22 bp, Artificial Sequence
  chemically synthesized
ctttctctctctctctctctct

SEQ ID NO: 1133963 - DNA, 22 bp, Artificial Sequence
  chemically synthesized
tctttctctctctctctctctc

SEQ ID NO: 1133964 - DNA, 22 bp, Artificial Sequence
  chemically synthesized
tttctttctctctctctctctc

SEQ ID NO: 1133965 - DNA, 22 bp, Artificial Sequence
  chemically synthesized
tctttctttctctctctctctc

SEQ ID NO: 1133966 - DNA, 22 bp, Artificial Sequence
  chemically synthesized
tctctttctttctctctctctc

SEQ ID NO: 1133967 - DNA, 22 bp, Artificial Sequence
  chemically synthesized
ctctctttctttctctctctct

SEQ ID NO: 1133968 - DNA, 22 bp, Artificial Sequence
  chemically synthesized
tctctctttctttctctctctc

SEQ ID NO: 1133969 - DNA, 22 bp, Artificial Sequence
  chemically synthesized
tttctctctttctttctctctc

SEQ ID NO: 1133970 - DNA, 22 bp, Artificial Sequence
  chemically synthesized
ctttctctctttctttctctct

SEQ ID NO: 1133971 - DNA, 22 bp, Artificial Sequence
  chemically synthesized
tctttctctctttctttctctc

SEQ ID NO: 1133972 - DNA, 22 bp, Artificial Sequence
  chemically synthesized
tttctttctctctttctttctc

SEQ ID NO: 1133973 - DNA, 22 bp, Artificial Sequence
  chemically synthesized
ctttctttctctctttctttct

SEQ ID NO: 1133974 - DNA, 22 bp, Artificial Sequence
  chemically synthesized
tctttctttctctctttctttc

SEQ ID NO: 1133975 - DNA, 22 bp, Artificial Sequence
  chemically synthesized
ttctttctttctctctttcttt

SEQ ID NO: 1133976 - DNA, 22 bp, Artificial Sequence
  chemically synthesized
cttttctttctttctctctttc

SEQ ID NO: 1133977 - DNA, 22 bp, Artificial Sequence
  chemically synthesized
gcttttctttctttctctcttt

SEQ ID NO: 1133978 - DNA, 22 bp, Artificial Sequence
  chemically synthesized
aagtttgcttttctttctttct

SEQ ID NO: 1133979 - DNA, 22 bp, Artificial Sequence
  chemically synthesized
gcctgaagtttgcttttctttc

SEQ ID NO: 1133980 - DNA, 22 bp, Artificial Sequence
  chemically synthesized
atcaatgatattagcctgaagt

SEQ ID NO: 1133981 - DNA, 22 bp, Artificial Sequence
  chemically synthesized
catcagtgttcatcaatgatat

SEQ ID NO: 1133982 - DNA, 22 bp, Artificial Sequence
  chemically synthesized
ttgcatcagtgttcatcaatga

SEQ ID NO: 1133983 - DNA, 22 bp, Artificial Sequence
  chemically synthesized
caggctaatatcattgatgaac

SEQ ID NO: 1133984 - DNA, 22 bp, Artificial Sequence
  chemically synthesized
aggctaatatcattgatgaaca

SEQ ID NO: 1133985 - DNA, 22 bp, Artificial Sequence
  chemically synthesized
agaattgttgcatcagtgttca

SEQ ID NO: 1133986 - DNA, 22 bp, Artificial Sequence
  chemically synthesized
atatcattgatgaacactgatg

SEQ ID NO: 1133987 - DNA, 22 bp, Artificial Sequence
  chemically synthesized
gtattgagaattgttgcatcag

SEQ ID NO: 1133988 - DNA, 22 bp, Artificial Sequence
  chemically synthesized
ctggtattgagaattgttgcat

SEQ ID NO: 1133989 - DNA, 22 bp, Artificial Sequence
  chemically synthesized
gctggtattgagaattgttgca

SEQ ID NO: 1133990 - DNA, 22 bp, Artificial Sequence
  chemically synthesized
atgaacactgatgcaacaattc

SEQ ID NO: 1133991 - DNA, 22 bp, Artificial Sequence
  chemically synthesized
gtttgctggtattgagaattgt

SEQ ID NO: 1133992 - DNA, 22 bp, Artificial Sequence
  chemically synthesized
ggtttgctggtattgagaattg

SEQ ID NO: 1133993 - DNA, 22 bp, Artificial Sequence
  chemically synthesized
gatttggtttgctggtattgag

SEQ ID NO: 1133994 - DNA, 22 bp, Artificial Sequence
  chemically synthesized
atgcaacaattctcaataccag

SEQ ID NO: 1133995 - DNA, 22 bp, Artificial Sequence
  chemically synthesized
ctggatttggtttgctggtatt

SEQ ID NO: 1133996 - DNA, 22 bp, Artificial Sequence
  chemically synthesized
atatgctactggatttggtttg

SEQ ID NO: 1133997 - DNA, 22 bp, Artificial Sequence
  chemically synthesized
gatatgctactggatttggttt

SEQ ID NO: 1133998 - DNA, 22 bp, Artificial Sequence
  chemically synthesized
tcaataccagcaaaccaaatcc

SEQ ID NO: 1133999 - DNA, 22 bp, Artificial Sequence
  chemically synthesized
tgatatgctactggatttggtt

SEQ ID NO: 1134000 - DNA, 22 bp, Artificial Sequence
  chemically synthesized
ttgatatgctactggatttggt

SEQ ID NO: 1134001 - DNA, 22 bp, Artificial Sequence
  chemically synthesized
aataccagcaaaccaaatccag

SEQ ID NO: 1134002 - DNA, 22 bp, Artificial Sequence
  chemically synthesized
tttgatatgctactggatttgg

SEQ ID NO: 1134003 - DNA, 22 bp, Artificial Sequence
  chemically synthesized
tggtggataagctttttgatat

SEQ ID NO: 1134004 - DNA, 22 bp, Artificial Sequence
  chemically synthesized
attgtggtggataagctttttg

SEQ ID NO: 1134005 - DNA, 22 bp, Artificial Sequence
  chemically synthesized
gattgtggtggataagcttttt

SEQ ID NO: 1134006 - DNA, 22 bp, Artificial Sequence
  chemically synthesized
gggatgaagcaaacttgattgt

SEQ ID NO: 1134007 - DNA, 22 bp, Artificial Sequence
  chemically synthesized
atccaccacaatcaagtttgct

SEQ ID NO: 1134008 - DNA, 22 bp, Artificial Sequence
  chemically synthesized
tccaccacaatcaagtttgctt

SEQ ID NO: 1134009 - DNA, 22 bp, Artificial Sequence
  chemically synthesized
catgctagggatgaagcaaact

SEQ ID NO: 1134010 - DNA, 22 bp, Artificial Sequence
  chemically synthesized
gcatgctagggatgaagcaaac

SEQ ID NO: 1134011 - DNA, 22 bp, Artificial Sequence
  chemically synthesized
accttgcatgctagggatgaag

SEQ ID NO: 1134012 - DNA, 22 bp, Artificial Sequence
  chemically synthesized
aactaaccttgcatgctaggga

SEQ ID NO: 1134013 - DNA, 22 bp, Artificial Sequence
  chemically synthesized
gcttcatccctagcatgcaagg

SEQ ID NO: 1134014 - DNA, 22 bp, Artificial Sequence
  chemically synthesized
cttcatccctagcatgcaaggt

SEQ ID NO: 1134015 - DNA, 22 bp, Artificial Sequence
  chemically synthesized
catgtgttaaactaaccttgca

SEQ ID NO: 1134016 - DNA, 22 bp, Artificial Sequence
  chemically synthesized
catccctagcatgcaaggttag

SEQ ID NO: 1134017 - DNA, 22 bp, Artificial Sequence
  chemically synthesized
gcatgtgttaaactaaccttgc

SEQ ID NO: 1134018 - DNA, 22 bp, Artificial Sequence
  chemically synthesized
atccctagcatgcaaggttagt

SEQ ID NO: 1134019 - DNA, 22 bp, Artificial Sequence
  chemically synthesized
atttgcatgtgttaaactaacc

SEQ ID NO: 1134020 - DNA, 22 bp, Artificial Sequence
  chemically synthesized
gcatgcaaggttagtttaacac

SEQ ID NO: 1134021 - DNA, 22 bp, Artificial Sequence
  chemically synthesized
gtttaacacatgcaaatcaata

SEQ ID NO: 1134022 - DNA, 22 bp, Artificial Sequence
  chemically synthesized
aacacatgcaaatcaatacatg

SEQ ID NO: 1134023 - DNA, 22 bp, Artificial Sequence
  chemically synthesized
tgtgatgaatcacatgtattga

SEQ ID NO: 1134024 - DNA, 22 bp, Artificial Sequence
  chemically synthesized
acacatgcaaatcaatacatgt

SEQ ID NO: 1134025 - DNA, 22 bp, Artificial Sequence
  chemically synthesized
atgtgatgaatcacatgtattg

SEQ ID NO: 1134026 - DNA, 22 bp, Artificial Sequence
  chemically synthesized
tttatgtgatgaatcacatgta

SEQ ID NO: 1134027 - DNA, 22 bp, Artificial Sequence
  chemically synthesized
tgtttatgtgatgaatcacatg

SEQ ID NO: 1134028 - DNA, 22 bp, Artificial Sequence
  chemically synthesized
gttctgtttatgtgatgaatca

SEQ ID NO: 1134029 - DNA, 22 bp, Artificial Sequence
  chemically synthesized
agttctgtttatgtgatgaatc

SEQ ID NO: 1134030 - DNA, 22 bp, Artificial Sequence
  chemically synthesized
tagttctgtttatgtgatgaat

SEQ ID NO: 1134031 - DNA, 22 bp, Artificial Sequence
  chemically synthesized
tctttagttctgtttatgtgat

SEQ ID NO: 1134032 - DNA, 22 bp, Artificial Sequence
  chemically synthesized
gtctttagttctgtttatgtga

SEQ ID NO: 1134033 - DNA, 22 bp, Artificial Sequence
  chemically synthesized
tgtctttagttctgtttatgtg

SEQ ID NO: 1134034 - DNA, 22 bp, Artificial Sequence
  chemically synthesized
ttgtctttagttctgtttatgt

SEQ ID NO: 1134035 - DNA, 22 bp, Artificial Sequence
  chemically synthesized
atcacataaacagaactaaaga

SEQ ID NO: 1134036 - DNA, 22 bp, Artificial Sequence
  chemically synthesized
agatagtcatgtggtttttgtc

SEQ ID NO: 1134037 - DNA, 22 bp, Artificial Sequence
  chemically synthesized
ttgagatagtcatgtggttttt

SEQ ID NO: 1134038 - DNA, 22 bp, Artificial Sequence
  chemically synthesized
tctattgagatagtcatgtggt

SEQ ID NO: 1134039 - DNA, 22 bp, Artificial Sequence
  chemically synthesized
aagacaaaaaccacatgactat

SEQ ID NO: 1134040 - DNA, 22 bp, Artificial Sequence
  chemically synthesized
gttgtctattgagatagtcatg

SEQ ID NO: 1134041 - DNA, 22 bp, Artificial Sequence
  chemically synthesized
ggttgtctattgagatagtcat

SEQ ID NO: 1134042 - DNA, 22 bp, Artificial Sequence
  chemically synthesized
tggttgtctattgagatagtca

SEQ ID NO: 1134043 - DNA, 22 bp, Artificial Sequence
  chemically synthesized
ttggttgtctattgagatagtc

SEQ ID NO: 1134044 - DNA, 22 bp, Artificial Sequence
  chemically synthesized
aataccttttggttgtctattg

SEQ ID NO: 1134045 - DNA, 22 bp, Artificial Sequence
  chemically synthesized
ttaaataccttttggttgtcta

SEQ ID NO: 1134046 - DNA, 22 bp, Artificial Sequence
  chemically synthesized
attaaataccttttggttgtct

SEQ ID NO: 1134047 - DNA, 22 bp, Artificial Sequence
  chemically synthesized
tattaaataccttttggttgtc

SEQ ID NO: 1134048 - DNA, 22 bp, Artificial Sequence
  chemically synthesized
tctcaatagacaaccaaaaggt

SEQ ID NO: 1134049 - DNA, 22 bp, Artificial Sequence
  chemically synthesized
aattttattaaataccttttgg

SEQ ID NO: 1134050 - DNA, 22 bp, Artificial Sequence
  chemically synthesized
aatagacaaccaaaaggtattt

SEQ ID NO: 1134051 - DNA, 22 bp, Artificial Sequence
  chemically synthesized
acatgaagggatgttgaatttt

SEQ ID NO: 1134052 - DNA, 22 bp, Artificial Sequence
  chemically synthesized
aacatgaagggatgttgaattt

SEQ ID NO: 1134053 - DNA, 22 bp, Artificial Sequence
  chemically synthesized
taacatgaagggatgttgaatt

SEQ ID NO: 1134054 - DNA, 22 bp, Artificial Sequence
  chemically synthesized
ttaacatgaagggatgttgaat

SEQ ID NO: 1134055 - DNA, 22 bp, Artificial Sequence
  chemically synthesized
aataaaattcaacatcccttca

SEQ ID NO: 1134056 - DNA, 22 bp, Artificial Sequence
  chemically synthesized
ataaaattcaacatcccttcat

SEQ ID NO: 1134057 - DNA, 22 bp, Artificial Sequence
  chemically synthesized
agaatttttaacatgaagggat

SEQ ID NO: 1134058 - DNA, 22 bp, Artificial Sequence
  chemically synthesized
ttgagaatttttaacatgaagg

SEQ ID NO: 1134059 - DNA, 22 bp, Artificial Sequence
  chemically synthesized
attgagaatttttaacatgaag

SEQ ID NO: 1134060 - DNA, 22 bp, Artificial Sequence
  chemically synthesized
gtttattgagaatttttaacat

SEQ ID NO: 1134061 - DNA, 22 bp, Artificial Sequence
  chemically synthesized
aacatcccttcatgttaaaaat

SEQ ID NO: 1134062 - DNA, 22 bp, Artificial Sequence
  chemically synthesized
gatacctagtttattgagaatt

SEQ ID NO: 1134063 - DNA, 22 bp, Artificial Sequence
  chemically synthesized
cgatacctagtttattgagaat

SEQ ID NO: 1134064 - DNA, 22 bp, Artificial Sequence
  chemically synthesized
catgttaaaaattctcaataaa

SEQ ID NO: 1134065 - DNA, 22 bp, Artificial Sequence
  chemically synthesized
atgttaaaaattctcaataaac

SEQ ID NO: 1134066 - DNA, 22 bp, Artificial Sequence
  chemically synthesized
cttcgatacctagtttattgag

SEQ ID NO: 1134067 - DNA, 22 bp, Artificial Sequence
  chemically synthesized
aaaattctcaataaactaggta

SEQ ID NO: 1134068 - DNA, 22 bp, Artificial Sequence
  chemically synthesized
aggtatgttccttcgataccta

SEQ ID NO: 1134069 - DNA, 22 bp, Artificial Sequence
  chemically synthesized
gaggtatgttccttcgatacct

SEQ ID NO: 1134070 - DNA, 22 bp, Artificial Sequence
  chemically synthesized
tgaggtatgttccttcgatacc

SEQ ID NO: 1134071 - DNA, 22 bp, Artificial Sequence
  chemically synthesized
tcaataaactaggtatcgaagg

SEQ ID NO: 1134072 - DNA, 22 bp, Artificial Sequence
  chemically synthesized
aataaactaggtatcgaaggaa

SEQ ID NO: 1134073 - DNA, 22 bp, Artificial Sequence
  chemically synthesized
ttttgaggtatgttccttcgat

SEQ ID NO: 1134074 - DNA, 22 bp, Artificial Sequence
  chemically synthesized
ttattttgaggtatgttccttc

SEQ ID NO: 1134075 - DNA, 22 bp, Artificial Sequence
  chemically synthesized
attattttgaggtatgttcctt

SEQ ID NO: 1134076 - DNA, 22 bp, Artificial Sequence
  chemically synthesized
ttattattttgaggtatgttcc

SEQ ID NO: 1134077 - DNA, 22 bp, Artificial Sequence
  chemically synthesized
ggtatcgaaggaacatacctca

SEQ ID NO: 1134078 - DNA, 22 bp, Artificial Sequence
  chemically synthesized
tggctcttattattttgaggta

SEQ ID NO: 1134079 - DNA, 22 bp, Artificial Sequence
  chemically synthesized
atggctcttattattttgaggt

SEQ ID NO: 1134080 - DNA, 22 bp, Artificial Sequence
  chemically synthesized
taatttatggctcttattattt

SEQ ID NO: 1134081 - DNA, 22 bp, Artificial Sequence
  chemically synthesized
ataatttatggctcttattatt

SEQ ID NO: 1134082 - DNA, 22 bp, Artificial Sequence
  chemically synthesized
aaaataataagagccataaatt

SEQ ID NO: 1134083 - DNA, 22 bp, Artificial Sequence
  chemically synthesized
gatgtgggtttataatttatgg

SEQ ID NO: 1134084 - DNA, 22 bp, Artificial Sequence
  chemically synthesized
ggatgtgggtttataatttatg

SEQ ID NO: 1134085 - DNA, 22 bp, Artificial Sequence
  chemically synthesized
cccatttggatgtgggtttata

SEQ ID NO: 1134086 - DNA, 22 bp, Artificial Sequence
  chemically synthesized
gcccatttggatgtgggtttat

SEQ ID NO: 1134087 - DNA, 22 bp, Artificial Sequence
  chemically synthesized
tgcccatttggatgtgggttta

SEQ ID NO: 1134088 - DNA, 22 bp, Artificial Sequence
  chemically synthesized
ttgcccatttggatgtgggttt

SEQ ID NO: 1134089 - DNA, 22 bp, Artificial Sequence
  chemically synthesized
gcttttgcccatttggatgtgg

SEQ ID NO: 1134090 - DNA, 22 bp, Artificial Sequence
  chemically synthesized
tagcttttgcccatttggatgt

SEQ ID NO: 1134091 - DNA, 22 bp, Artificial Sequence
  chemically synthesized
ctagcttttgcccatttggatg

SEQ ID NO: 1134092 - DNA, 22 bp, Artificial Sequence
  chemically synthesized
taaacccacatccaaatgggca

SEQ ID NO: 1134093 - DNA, 22 bp, Artificial Sequence
  chemically synthesized
agggggaatgcttctagctttt

SEQ ID NO: 1134094 - DNA, 22 bp, Artificial Sequence
  chemically synthesized
cagggggaatgcttctagcttt

SEQ ID NO: 1134095 - DNA, 22 bp, Artificial Sequence
  chemically synthesized
tcagggggaatgcttctagctt

SEQ ID NO: 1134096 - DNA, 22 bp, Artificial Sequence
  chemically synthesized
ggccagttttcagggggaatgc

SEQ ID NO: 1134097 - DNA, 22 bp, Artificial Sequence
  chemically synthesized
gggccagttttcagggggaatg

SEQ ID NO: 1134098 - DNA, 22 bp, Artificial Sequence
  chemically synthesized
tcttgggccagttttcaggggg

SEQ ID NO: 1134099 - DNA, 22 bp, Artificial Sequence
  chemically synthesized
atcttgggccagttttcagggg

SEQ ID NO: 1134100 - DNA, 22 bp, Artificial Sequence
  chemically synthesized
gaagcattccccctgaaaactg

SEQ ID NO: 1134101 - DNA, 22 bp, Artificial Sequence
  chemically synthesized
cccctgaaaactggcccaagat

SEQ ID NO: 1134102 - DNA, 22 bp, Artificial Sequence
  chemically synthesized
aaaactggcccaagataaggat

SEQ ID NO: 1134103 - DNA, 22 bp, Artificial Sequence
  chemically synthesized
gcccaagataaggatgccatct

SEQ ID NO: 1134104 - DNA, 22 bp, Artificial Sequence
  chemically synthesized
aaaaggagtggtgagagatggc

SEQ ID NO: 1134105 - DNA, 22 bp, Artificial Sequence
  chemically synthesized
tgttgaaaaggagtggtgagag

SEQ ID NO: 1134106 - DNA, 22 bp, Artificial Sequence
  chemically synthesized
caatactatgttgaaaaggagt

SEQ ID NO: 1134107 - DNA, 22 bp, Artificial Sequence
  chemically synthesized
ccaatactatgttgaaaaggag

SEQ ID NO: 1134108 - DNA, 22 bp, Artificial Sequence
  chemically synthesized
tcaccactccttttcaacatag

SEQ ID NO: 1134109 - DNA, 22 bp, Artificial Sequence
  chemically synthesized
accactccttttcaacatagta

SEQ ID NO: 1134110 - DNA, 22 bp, Artificial Sequence
  chemically synthesized
gtcagaacttccaatactatgt

SEQ ID NO: 1134111 - DNA, 22 bp, Artificial Sequence
  chemically synthesized
cttttcaacatagtattggaag

SEQ ID NO: 1134112 - DNA, 22 bp, Artificial Sequence
  chemically synthesized
ccctggtcagaacttccaatac

SEQ ID NO: 1134113 - DNA, 22 bp, Artificial Sequence
  chemically synthesized
ttcaacatagtattggaagttc

SEQ ID NO: 1134114 - DNA, 22 bp, Artificial Sequence
  chemically synthesized
tcaacatagtattggaagttct

SEQ ID NO: 1134115 - DNA, 22 bp, Artificial Sequence
  chemically synthesized
attgccctggtcagaacttcca

SEQ ID NO: 1134116 - DNA, 22 bp, Artificial Sequence
  chemically synthesized
caacatagtattggaagttctg

SEQ ID NO: 1134117 - DNA, 22 bp, Artificial Sequence
  chemically synthesized
aacatagtattggaagttctga

SEQ ID NO: 1134118 - DNA, 22 bp, Artificial Sequence
  chemically synthesized
cctgattgccctggtcagaact

SEQ ID NO: 1134119 - DNA, 22 bp, Artificial Sequence
  chemically synthesized
ccctgattgccctggtcagaac

SEQ ID NO: 1134120 - DNA, 22 bp, Artificial Sequence
  chemically synthesized
ttccctgattgccctggtcaga

SEQ ID NO: 1134121 - DNA, 22 bp, Artificial Sequence
  chemically synthesized
tcttccctgattgccctggtca

SEQ ID NO: 1134122 - DNA, 22 bp, Artificial Sequence
  chemically synthesized
ctcttccctgattgccctggtc

SEQ ID NO: 1134123 - DNA, 22 bp, Artificial Sequence
  chemically synthesized
tctcttccctgattgccctggt

SEQ ID NO: 1134124 - DNA, 22 bp, Artificial Sequence
  chemically synthesized
tttctcttccctgattgccctg

SEQ ID NO: 1134125 - DNA, 22 bp, Artificial Sequence
  chemically synthesized
gaagttctgaccagggcaatca

SEQ ID NO: 1134126 - DNA, 22 bp, Artificial Sequence
  chemically synthesized
ctttctcttccctgattgccct

SEQ ID NO: 1134127 - DNA, 22 bp, Artificial Sequence
  chemically synthesized
tttctttctcttccctgattgc

SEQ ID NO: 1134128 - DNA, 22 bp, Artificial Sequence
  chemically synthesized
atttctttctcttccctgattg

SEQ ID NO: 1134129 - DNA, 22 bp, Artificial Sequence
  chemically synthesized
tatttctttctcttccctgatt

SEQ ID NO: 1134130 - DNA, 22 bp, Artificial Sequence
  chemically synthesized
tgaccagggcaatcagggaaga

SEQ ID NO: 1134131 - DNA, 22 bp, Artificial Sequence
  chemically synthesized
accagggcaatcagggaagaga

SEQ ID NO: 1134132 - DNA, 22 bp, Artificial Sequence
  chemically synthesized
tgtgaataccctttatttcttt

SEQ ID NO: 1134133 - DNA, 22 bp, Artificial Sequence
  chemically synthesized
ctatgtgaataccctttatttc

SEQ ID NO: 1134134 - DNA, 22 bp, Artificial Sequence
  chemically synthesized
cctatgtgaataccctttattt

SEQ ID NO: 1134135 - DNA, 22 bp, Artificial Sequence
  chemically synthesized
ttcctatgtgaataccctttat

SEQ ID NO: 1134136 - DNA, 22 bp, Artificial Sequence
  chemically synthesized
tcttcctatgtgaatacccttt

SEQ ID NO: 1134137 - DNA, 22 bp, Artificial Sequence
  chemically synthesized
ctctcttcctatgtgaataccc

SEQ ID NO: 1134138 - DNA, 22 bp, Artificial Sequence
  chemically synthesized
cctctcttcctatgtgaatacc

SEQ ID NO: 1134139 - DNA, 22 bp, Artificial Sequence
  chemically synthesized
acttcctctcttcctatgtgaa

SEQ ID NO: 1134140 - DNA, 22 bp, Artificial Sequence
  chemically synthesized
gacttcctctcttcctatgtga

SEQ ID NO: 1134141 - DNA, 22 bp, Artificial Sequence
  chemically synthesized
acataggaagagaggaagtcaa

SEQ ID NO: 1134142 - DNA, 22 bp, Artificial Sequence
  chemically synthesized
aatacaaaaataatttgacttc

SEQ ID NO: 1134143 - DNA, 22 bp, Artificial Sequence
  chemically synthesized
atgtcatctgaatacaaaaata

SEQ ID NO: 1134144 - DNA, 22 bp, Artificial Sequence
  chemically synthesized
gatataggttcatgtcatctga

SEQ ID NO: 1134145 - DNA, 22 bp, Artificial Sequence
  chemically synthesized
tggatataggttcatgtcatct

SEQ ID NO: 1134146 - DNA, 22 bp, Artificial Sequence
  chemically synthesized
tttttgtattcagatgacatga

SEQ ID NO: 1134147 - DNA, 22 bp, Artificial Sequence
  chemically synthesized
ctggatataggttcatgtcatc

SEQ ID NO: 1134148 - DNA, 22 bp, Artificial Sequence
  chemically synthesized
tctggatataggttcatgtcat

SEQ ID NO: 1134149 - DNA, 22 bp, Artificial Sequence
  chemically synthesized
ttgtattcagatgacatgaacc

SEQ ID NO: 1134150 - DNA, 22 bp, Artificial Sequence
  chemically synthesized
tgtattcagatgacatgaacct

SEQ ID NO: 1134151 - DNA, 22 bp, Artificial Sequence
  chemically synthesized
gtattcagatgacatgaaccta

SEQ ID NO: 1134152 - DNA, 22 bp, Artificial Sequence
  chemically synthesized
tattcagatgacatgaacctat

SEQ ID NO: 1134153 - DNA, 22 bp, Artificial Sequence
  chemically synthesized
agatgacatgaacctatatcca

SEQ ID NO: 1134154 - DNA, 22 bp, Artificial Sequence
  chemically synthesized
agacaatgggggttttctggat

SEQ ID NO: 1134155 - DNA, 22 bp, Artificial Sequence
  chemically synthesized
ggctgagacaatgggggttttc

SEQ ID NO: 1134156 - DNA, 22 bp, Artificial Sequence
  chemically synthesized
gggctgagacaatgggggtttt

SEQ ID NO: 1134157 - DNA, 22 bp, Artificial Sequence
  chemically synthesized
tgggctgagacaatgggggttt

SEQ ID NO: 1134158 - DNA, 22 bp, Artificial Sequence
  chemically synthesized
ttgggctgagacaatgggggtt

SEQ ID NO: 1134159 - DNA, 22 bp, Artificial Sequence
  chemically synthesized
tatccagaaaacccccattgtc

SEQ ID NO: 1134160 - DNA, 22 bp, Artificial Sequence
  chemically synthesized
gcttttgggctgagacaatggg

SEQ ID NO: 1134161 - DNA, 22 bp, Artificial Sequence
  chemically synthesized
agcttttgggctgagacaatgg

SEQ ID NO: 1134162 - DNA, 22 bp, Artificial Sequence
  chemically synthesized
aagtcttagcttttgggctgag

SEQ ID NO: 1134163 - DNA, 22 bp, Artificial Sequence
  chemically synthesized
gaagtcttagcttttgggctga

SEQ ID NO: 1134164 - DNA, 22 bp, Artificial Sequence
  chemically synthesized
tctcagcccaaaagctaagact

SEQ ID NO: 1134165 - DNA, 22 bp, Artificial Sequence
  chemically synthesized
tagtatagtttgaagtcttagc

SEQ ID NO: 1134166 - DNA, 22 bp, Artificial Sequence
  chemically synthesized
gtagtatagtttgaagtcttag

SEQ ID NO: 1134167 - DNA, 22 bp, Artificial Sequence
  chemically synthesized
agcccaaaagctaagacttcaa

SEQ ID NO: 1134168 - DNA, 22 bp, Artificial Sequence
  chemically synthesized
taaccttgtagtatagtttgaa

SEQ ID NO: 1134169 - DNA, 22 bp, Artificial Sequence
  chemically synthesized
gtgactgtaaccttgtagtata

SEQ ID NO: 1134170 - DNA, 22 bp, Artificial Sequence
  chemically synthesized
agacttcaaactatactacaag

SEQ ID NO: 1134171 - DNA, 22 bp, Artificial Sequence
  chemically synthesized
tggtgactgtaaccttgtagta

SEQ ID NO: 1134172 - DNA, 22 bp, Artificial Sequence
  chemically synthesized
ctggtgactgtaaccttgtagt

SEQ ID NO: 1134173 - DNA, 22 bp, Artificial Sequence
  chemically synthesized
tctggtgactgtaaccttgtag

SEQ ID NO: 1134174 - DNA, 22 bp, Artificial Sequence
  chemically synthesized
ttctggtgactgtaaccttgta

SEQ ID NO: 1134175 - DNA, 22 bp, Artificial Sequence
  chemically synthesized
caaactatactacaaggttaca

SEQ ID NO: 1134176 - DNA, 22 bp, Artificial Sequence
  chemically synthesized
aaactatactacaaggttacag

SEQ ID NO: 1134177 - DNA, 22 bp, Artificial Sequence
  chemically synthesized
cttttctggtgactgtaacctt

SEQ ID NO: 1134178 - DNA, 22 bp, Artificial Sequence
  chemically synthesized
tactacaaggttacagtcacca

SEQ ID NO: 1134179 - DNA, 22 bp, Artificial Sequence
  chemically synthesized
caaggttacagtcaccagaaaa

SEQ ID NO: 1134180 - DNA, 22 bp, Artificial Sequence
  chemically synthesized
taccagtaccctgcttttctgg

SEQ ID NO: 1134181 - DNA, 22 bp, Artificial Sequence
  chemically synthesized
gtaccagtaccctgcttttctg

SEQ ID NO: 1134182 - DNA, 22 bp, Artificial Sequence
  chemically synthesized
ttgtaccagtaccctgcttttc

SEQ ID NO: 1134183 - DNA, 22 bp, Artificial Sequence
  chemically synthesized
cagtcaccagaaaagcagggta

SEQ ID NO: 1134184 - DNA, 22 bp, Artificial Sequence
  chemically synthesized
ttcttgtaccagtaccctgctt

SEQ ID NO: 1134185 - DNA, 22 bp, Artificial Sequence
  chemically synthesized
tgtgtctgttcttgtaccagta

SEQ ID NO: 1134186 - DNA, 22 bp, Artificial Sequence
  chemically synthesized
gtctatgtgtctgttcttgtac

SEQ ID NO: 1134187 - DNA, 22 bp, Artificial Sequence
  chemically synthesized
attggtctatgtgtctgttctt

SEQ ID NO: 1134188 - DNA, 22 bp, Artificial Sequence
  chemically synthesized
cattggtctatgtgtctgttct

SEQ ID NO: 1134189 - DNA, 22 bp, Artificial Sequence
  chemically synthesized
tttcattggtctatgtgtctgt

SEQ ID NO: 1134190 - DNA, 22 bp, Artificial Sequence
  chemically synthesized
tgtttcattggtctatgtgtct

SEQ ID NO: 1134191 - DNA, 22 bp, Artificial Sequence
  chemically synthesized
gtacaagaacagacacatagac

SEQ ID NO: 1134192 - DNA, 22 bp, Artificial Sequence
  chemically synthesized
ttctgtttcattggtctatgtg

SEQ ID NO: 1134193 - DNA, 22 bp, Artificial Sequence
  chemically synthesized
tattctgtttcattggtctatg

SEQ ID NO: 1134194 - DNA, 22 bp, Artificial Sequence
  chemically synthesized
tctattctgtttcattggtcta

SEQ ID NO: 1134195 - DNA, 22 bp, Artificial Sequence
  chemically synthesized
agttctctattctgtttcattg

SEQ ID NO: 1134196 - DNA, 22 bp, Artificial Sequence
  chemically synthesized
tgagttctctattctgtttcat

SEQ ID NO: 1134197 - DNA, 22 bp, Artificial Sequence
  chemically synthesized
ctgagttctctattctgtttca

SEQ ID NO: 1134198 - DNA, 22 bp, Artificial Sequence
  chemically synthesized
tttctgagttctctattctgtt

SEQ ID NO: 1134199 - DNA, 22 bp, Artificial Sequence
  chemically synthesized
atttctgagttctctattctgt

SEQ ID NO: 1134200 - DNA, 22 bp, Artificial Sequence
  chemically synthesized
taggtgcgtggtcttatttctg

SEQ ID NO: 1134201 - DNA, 22 bp, Artificial Sequence
  chemically synthesized
agaaataagaccacgcacctac

SEQ ID NO: 1134202 - DNA, 22 bp, Artificial Sequence
  chemically synthesized
tcgaagatcagatggttgtagg

SEQ ID NO: 1134203 - DNA, 22 bp, Artificial Sequence
  chemically synthesized
gtcgaagatcagatggttgtag

SEQ ID NO: 1134204 - DNA, 22 bp, Artificial Sequence
  chemically synthesized
aggtttgtcgaagatcagatgg

SEQ ID NO: 1134205 - DNA, 22 bp, Artificial Sequence
  chemically synthesized
caggtttgtcgaagatcagatg

SEQ ID NO: 1134206 - DNA, 22 bp, Artificial Sequence
  chemically synthesized
tcaggtttgtcgaagatcagat

SEQ ID NO: 1134207 - DNA, 22 bp, Artificial Sequence
  chemically synthesized
ttcaggtttgtcgaagatcaga

SEQ ID NO: 1134208 - DNA, 22 bp, Artificial Sequence
  chemically synthesized
tttcaggtttgtcgaagatcag

SEQ ID NO: 1134209 - DNA, 22 bp, Artificial Sequence
  chemically synthesized
ttttttcaggtttgtcgaagat

SEQ ID NO: 1134210 - DNA, 22 bp, Artificial Sequence
  chemically synthesized
gttttttcaggtttgtcgaaga

SEQ ID NO: 1134211 - DNA, 22 bp, Artificial Sequence
  chemically synthesized
caaccatctgatcttcgacaaa

SEQ ID NO: 1134212 - DNA, 22 bp, Artificial Sequence
  chemically synthesized
cttgttttttcaggtttgtcga

SEQ ID NO: 1134213 - DNA, 22 bp, Artificial Sequence
  chemically synthesized
cccattgcttgttttttcaggt

SEQ ID NO: 1134214 - DNA, 22 bp, Artificial Sequence
  chemically synthesized
atcttcgacaaacctgaaaaaa

SEQ ID NO: 1134215 - DNA, 22 bp, Artificial Sequence
  chemically synthesized
ccccattgcttgttttttcagg

SEQ ID NO: 1134216 - DNA, 22 bp, Artificial Sequence
  chemically synthesized
tccccattgcttgttttttcag

SEQ ID NO: 1134217 - DNA, 22 bp, Artificial Sequence
  chemically synthesized
cgacaaacctgaaaaaacaagc

SEQ ID NO: 1134218 - DNA, 22 bp, Artificial Sequence
  chemically synthesized
gacaaacctgaaaaaacaagca

SEQ ID NO: 1134219 - DNA, 22 bp, Artificial Sequence
  chemically synthesized
aataggcagtcctttccccatt

SEQ ID NO: 1134220 - DNA, 22 bp, Artificial Sequence
  chemically synthesized
aaaaaacaagcaatggggaaag

SEQ ID NO: 1134221 - DNA, 22 bp, Artificial Sequence
  chemically synthesized
tgtattaaataggcagtccttt

SEQ ID NO: 1134222 - DNA, 22 bp, Artificial Sequence
  chemically synthesized
tcccagcactatgtattaaata

SEQ ID NO: 1134223 - DNA, 22 bp, Artificial Sequence
  chemically synthesized
cctatttaatacatagtgctgg

SEQ ID NO: 1134224 - DNA, 22 bp, Artificial Sequence
  chemically synthesized
cataggactatcccagcactat

SEQ ID NO: 1134225 - DNA, 22 bp, Artificial Sequence
  chemically synthesized
tgcataggactatcccagcact

SEQ ID NO: 1134226 - DNA, 22 bp, Artificial Sequence
  chemically synthesized
ctgcataggactatcccagcac

SEQ ID NO: 1134227 - DNA, 22 bp, Artificial Sequence
  chemically synthesized
tttaatacatagtgctgggata

SEQ ID NO: 1134228 - DNA, 22 bp, Artificial Sequence
  chemically synthesized
tctgcataggactatcccagca

SEQ ID NO: 1134229 - DNA, 22 bp, Artificial Sequence
  chemically synthesized
aatacatagtgctgggatagtc

SEQ ID NO: 1134230 - DNA, 22 bp, Artificial Sequence
  chemically synthesized
atacatagtgctgggatagtcc

SEQ ID NO: 1134231 - DNA, 22 bp, Artificial Sequence
  chemically synthesized
aattttctgcataggactatcc

SEQ ID NO: 1134232 - DNA, 22 bp, Artificial Sequence
  chemically synthesized
caattttctgcataggactatc

SEQ ID NO: 1134233 - DNA, 22 bp, Artificial Sequence
  chemically synthesized
tcaattttctgcataggactat

SEQ ID NO: 1134234 - DNA, 22 bp, Artificial Sequence
  chemically synthesized
ggatagtcctatgcagaaaatt

SEQ ID NO: 1134235 - DNA, 22 bp, Artificial Sequence
  chemically synthesized
taaggaagaagtccactttcaa

SEQ ID NO: 1134236 - DNA, 22 bp, Artificial Sequence
  chemically synthesized
tgcagaaaattgaaagtggact

SEQ ID NO: 1134237 - DNA, 22 bp, Artificial Sequence
  chemically synthesized
tatagattgtaaggaagaagtc

SEQ ID NO: 1134238 - DNA, 22 bp, Artificial Sequence
  chemically synthesized
gtatagattgtaaggaagaagt

SEQ ID NO: 1134239 - DNA, 22 bp, Artificial Sequence
  chemically synthesized
tgtatagattgtaaggaagaag

SEQ ID NO: 1134240 - DNA, 22 bp, Artificial Sequence
  chemically synthesized
ttgtatagattgtaaggaagaa

SEQ ID NO: 1134241 - DNA, 22 bp, Artificial Sequence
  chemically synthesized
aaagtggacttcttccttacaa

SEQ ID NO: 1134242 - DNA, 22 bp, Artificial Sequence
  chemically synthesized
atttttgtatagattgtaagga

SEQ ID NO: 1134243 - DNA, 22 bp, Artificial Sequence
  chemically synthesized
agttaatttttgtatagattgt

SEQ ID NO: 1134244 - DNA, 22 bp, Artificial Sequence
  chemically synthesized
gagttaatttttgtatagattg

SEQ ID NO: 1134245 - DNA, 22 bp, Artificial Sequence
  chemically synthesized
cttccttacaatctatacaaaa

SEQ ID NO: 1134246 - DNA, 22 bp, Artificial Sequence
  chemically synthesized
ttccttacaatctatacaaaaa

SEQ ID NO: 1134247 - DNA, 22 bp, Artificial Sequence
  chemically synthesized
ccttacaatctatacaaaaatt

SEQ ID NO: 1134248 - DNA, 22 bp, Artificial Sequence
  chemically synthesized
cttacaatctatacaaaaatta

SEQ ID NO: 1134249 - DNA, 22 bp, Artificial Sequence
  chemically synthesized
atccatcttgagttaatttttg

SEQ ID NO: 1134250 - DNA, 22 bp, Artificial Sequence
  chemically synthesized
aatccatcttgagttaattttt

SEQ ID NO: 1134251 - DNA, 22 bp, Artificial Sequence
  chemically synthesized
acaatctatacaaaaattaact

SEQ ID NO: 1134252 - DNA, 22 bp, Artificial Sequence
  chemically synthesized
taatccatcttgagttaatttt

SEQ ID NO: 1134253 - DNA, 22 bp, Artificial Sequence
  chemically synthesized
caatctatacaaaaattaactc

SEQ ID NO: 1134254 - DNA, 22 bp, Artificial Sequence
  chemically synthesized
agtctttaatccatcttgagtt

SEQ ID NO: 1134255 - DNA, 22 bp, Artificial Sequence
  chemically synthesized
aagtctttaatccatcttgagt

SEQ ID NO: 1134256 - DNA, 22 bp, Artificial Sequence
  chemically synthesized
tacaaaaattaactcaagatgg

SEQ ID NO: 1134257 - DNA, 22 bp, Artificial Sequence
  chemically synthesized
catttaagtctttaatccatct

SEQ ID NO: 1134258 - DNA, 22 bp, Artificial Sequence
  chemically synthesized
gcatttaagtctttaatccatc

SEQ ID NO: 1134259 - DNA, 22 bp, Artificial Sequence
  chemically synthesized
tgcatttaagtctttaatccat

SEQ ID NO: 1134260 - DNA, 22 bp, Artificial Sequence
  chemically synthesized
actcaagatggattaaagactt

SEQ ID NO: 1134261 - DNA, 22 bp, Artificial Sequence
  chemically synthesized
gggttttgcatttaagtcttta

SEQ ID NO: 1134262 - DNA, 22 bp, Artificial Sequence
  chemically synthesized
ggggttttgcatttaagtcttt

SEQ ID NO: 1134263 - DNA, 22 bp, Artificial Sequence
  chemically synthesized
aagatggattaaagacttaaat

SEQ ID NO: 1134264 - DNA, 22 bp, Artificial Sequence
  chemically synthesized
tttggggttttgcatttaagtc

SEQ ID NO: 1134265 - DNA, 22 bp, Artificial Sequence
  chemically synthesized
ttgtttggggttttgcatttaa

SEQ ID NO: 1134266 - DNA, 22 bp, Artificial Sequence
  chemically synthesized
attgtttggggttttgcattta

SEQ ID NO: 1134267 - DNA, 22 bp, Artificial Sequence
  chemically synthesized
tattgtttggggttttgcattt

SEQ ID NO: 1134268 - DNA, 22 bp, Artificial Sequence
  chemically synthesized
ttattgtttggggttttgcatt

SEQ ID NO: 1134269 - DNA, 22 bp, Artificial Sequence
  chemically synthesized
aagacttaaatgcaaaacccca

SEQ ID NO: 1134270 - DNA, 22 bp, Artificial Sequence
  chemically synthesized
aggtttttattgtttggggttt

SEQ ID NO: 1134271 - DNA, 22 bp, Artificial Sequence
  chemically synthesized
taaggtttttattgtttggggt

SEQ ID NO: 1134272 - DNA, 22 bp, Artificial Sequence
  chemically synthesized
ctaaggtttttattgtttgggg

SEQ ID NO: 1134273 - DNA, 22 bp, Artificial Sequence
  chemically synthesized
aaatgcaaaaccccaaacaata

SEQ ID NO: 1134274 - DNA, 22 bp, Artificial Sequence
  chemically synthesized
ttctaaggtttttattgtttgg

SEQ ID NO: 1134275 - DNA, 22 bp, Artificial Sequence
  chemically synthesized
aatgcaaaaccccaaacaataa

SEQ ID NO: 1134276 - DNA, 22 bp, Artificial Sequence
  chemically synthesized
cttctaaggtttttattgtttg

SEQ ID NO: 1134277 - DNA, 22 bp, Artificial Sequence
  chemically synthesized
tcttctaaggtttttattgttt

SEQ ID NO: 1134278 - DNA, 22 bp, Artificial Sequence
  chemically synthesized
ggttttcttctaaggtttttat

SEQ ID NO: 1134279 - DNA, 22 bp, Artificial Sequence
  chemically synthesized
cctaggttttcttctaaggttt

SEQ ID NO: 1134280 - DNA, 22 bp, Artificial Sequence
  chemically synthesized
ttacctaggttttcttctaagg

SEQ ID NO: 1134281 - DNA, 22 bp, Artificial Sequence
  chemically synthesized
attacctaggttttcttctaag

SEQ ID NO: 1134282 - DNA, 22 bp, Artificial Sequence
  chemically synthesized
aatcttattacctaggttttct

SEQ ID NO: 1134283 - DNA, 22 bp, Artificial Sequence
  chemically synthesized
tgtcctgaatcttattacctag

SEQ ID NO: 1134284 - DNA, 22 bp, Artificial Sequence
  chemically synthesized
agaagaaaacctaggtaataag

SEQ ID NO: 1134285 - DNA, 22 bp, Artificial Sequence
  chemically synthesized
gaagaaaacctaggtaataaga

SEQ ID NO: 1134286 - DNA, 22 bp, Artificial Sequence
  chemically synthesized
cccatgcctatgtcctgaatct

SEQ ID NO: 1134287 - DNA, 22 bp, Artificial Sequence
  chemically synthesized
gcccatgcctatgtcctgaatc

SEQ ID NO: 1134288 - DNA, 22 bp, Artificial Sequence
  chemically synthesized
tgcccatgcctatgtcctgaat

SEQ ID NO: 1134289 - DNA, 22 bp, Artificial Sequence
  chemically synthesized
ggtaataagattcaggacatag

SEQ ID NO: 1134290 - DNA, 22 bp, Artificial Sequence
  chemically synthesized
atgaaacctttgcccatgccta

SEQ ID NO: 1134291 - DNA, 22 bp, Artificial Sequence
  chemically synthesized
ctcatgaaacctttgcccatgc

SEQ ID NO: 1134292 - DNA, 22 bp, Artificial Sequence
  chemically synthesized
cctcatgaaacctttgcccatg

SEQ ID NO: 1134293 - DNA, 22 bp, Artificial Sequence
  chemically synthesized
tcctcatgaaacctttgcccat

SEQ ID NO: 1134294 - DNA, 22 bp, Artificial Sequence
  chemically synthesized
aggacataggcatgggcaaagg

SEQ ID NO: 1134295 - DNA, 22 bp, Artificial Sequence
  chemically synthesized
ccattttcctcatgaaaccttt

SEQ ID NO: 1134296 - DNA, 22 bp, Artificial Sequence
  chemically synthesized
gccattttcctcatgaaacctt

SEQ ID NO: 1134297 - DNA, 22 bp, Artificial Sequence
  chemically synthesized
tgccattttcctcatgaaacct

SEQ ID NO: 1134298 - DNA, 22 bp, Artificial Sequence
  chemically synthesized
ttgccattttcctcatgaaacc

SEQ ID NO: 1134299 - DNA, 22 bp, Artificial Sequence
  chemically synthesized
cttttgccattttcctcatgaa

SEQ ID NO: 1134300 - DNA, 22 bp, Artificial Sequence
  chemically synthesized
cagttgcttttgccattttcct

SEQ ID NO: 1134301 - DNA, 22 bp, Artificial Sequence
  chemically synthesized
ttgcagttgcttttgccatttt

SEQ ID NO: 1134302 - DNA, 22 bp, Artificial Sequence
  chemically synthesized
gttgcagttgcttttgccattt

SEQ ID NO: 1134303 - DNA, 22 bp, Artificial Sequence
  chemically synthesized
tgttgcagttgcttttgccatt

SEQ ID NO: 1134304 - DNA, 22 bp, Artificial Sequence
  chemically synthesized
ttgttgcagttgcttttgccat

SEQ ID NO: 1134305 - DNA, 22 bp, Artificial Sequence
  chemically synthesized
catgaggaaaatggcaaaagca

SEQ ID NO: 1134306 - DNA, 22 bp, Artificial Sequence
  chemically synthesized
atgaggaaaatggcaaaagcaa

SEQ ID NO: 1134307 - DNA, 22 bp, Artificial Sequence
  chemically synthesized
cttttgttgcagttgcttttgc

SEQ ID NO: 1134308 - DNA, 22 bp, Artificial Sequence
  chemically synthesized
gcttttgttgcagttgcttttg

SEQ ID NO: 1134309 - DNA, 22 bp, Artificial Sequence
  chemically synthesized
tgcttttgttgcagttgctttt

SEQ ID NO: 1134310 - DNA, 22 bp, Artificial Sequence
  chemically synthesized
ttgcttttgttgcagttgcttt

SEQ ID NO: 1134311 - DNA, 22 bp, Artificial Sequence
  chemically synthesized
tcagtttttgcttttgttgcag

SEQ ID NO: 1134312 - DNA, 22 bp, Artificial Sequence
  chemically synthesized
gtcagtttttgcttttgttgca

SEQ ID NO: 1134313 - DNA, 22 bp, Artificial Sequence
  chemically synthesized
tgtcagtttttgcttttgttgc

SEQ ID NO: 1134314 - DNA, 22 bp, Artificial Sequence
  chemically synthesized
gatcccctttgtcagtttttgc

SEQ ID NO: 1134315 - DNA, 22 bp, Artificial Sequence
  chemically synthesized
caacaaaagcaaaaactgacaa

SEQ ID NO: 1134316 - DNA, 22 bp, Artificial Sequence
  chemically synthesized
attagatcccctttgtcagttt

SEQ ID NO: 1134317 - DNA, 22 bp, Artificial Sequence
  chemically synthesized
aattagatcccctttgtcagtt

SEQ ID NO: 1134318 - DNA, 22 bp, Artificial Sequence
  chemically synthesized
gtttaattagatcccctttgtc

SEQ ID NO: 1134319 - DNA, 22 bp, Artificial Sequence
  chemically synthesized
agtttaattagatcccctttgt

SEQ ID NO: 1134320 - DNA, 22 bp, Artificial Sequence
  chemically synthesized
tagtttaattagatcccctttg

SEQ ID NO: 1134321 - DNA, 22 bp, Artificial Sequence
  chemically synthesized
tttagtttaattagatcccctt

SEQ ID NO: 1134322 - DNA, 22 bp, Artificial Sequence
  chemically synthesized
acaaaggggatctaattaaact

SEQ ID NO: 1134323 - DNA, 22 bp, Artificial Sequence
  chemically synthesized
tgcagaagttctttagtttaat

SEQ ID NO: 1134324 - DNA, 22 bp, Artificial Sequence
  chemically synthesized
ctgtgcagaagttctttagttt

SEQ ID NO: 1134325 - DNA, 22 bp, Artificial Sequence
  chemically synthesized
gctgtgcagaagttctttagtt

SEQ ID NO: 1134326 - DNA, 22 bp, Artificial Sequence
  chemically synthesized
tgctgtgcagaagttctttagt

SEQ ID NO: 1134327 - DNA, 22 bp, Artificial Sequence
  chemically synthesized
ttttgctgtgcagaagttcttt

SEQ ID NO: 1134328 - DNA, 22 bp, Artificial Sequence
  chemically synthesized
attttgctgtgcagaagttctt

SEQ ID NO: 1134329 - DNA, 22 bp, Artificial Sequence
  chemically synthesized
attaaactaaagaacttctgca

SEQ ID NO: 1134330 - DNA, 22 bp, Artificial Sequence
  chemically synthesized
aactaaagaacttctgcacagc

SEQ ID NO: 1134331 - DNA, 22 bp, Artificial Sequence
  chemically synthesized
acggtagtttattttgctgtgc

SEQ ID NO: 1134332 - DNA, 22 bp, Artificial Sequence
  chemically synthesized
aagaacttctgcacagcaaaat

SEQ ID NO: 1134333 - DNA, 22 bp, Artificial Sequence
  chemically synthesized
tgacggtagtttattttgctgt

SEQ ID NO: 1134334 - DNA, 22 bp, Artificial Sequence
  chemically synthesized
ctctgacggtagtttattttgc

SEQ ID NO: 1134335 - DNA, 22 bp, Artificial Sequence
  chemically synthesized
actctgacggtagtttattttg

SEQ ID NO: 1134336 - DNA, 22 bp, Artificial Sequence
  chemically synthesized
tttactctgacggtagtttatt

SEQ ID NO: 1134337 - DNA, 22 bp, Artificial Sequence
  chemically synthesized
ctgcacagcaaaataaactacc

SEQ ID NO: 1134338 - DNA, 22 bp, Artificial Sequence
  chemically synthesized
atttactctgacggtagtttat

SEQ ID NO: 1134339 - DNA, 22 bp, Artificial Sequence
  chemically synthesized
tgcacagcaaaataaactaccg

SEQ ID NO: 1134340 - DNA, 22 bp, Artificial Sequence
  chemically synthesized
cacagcaaaataaactaccgtc

SEQ ID NO: 1134341 - DNA, 22 bp, Artificial Sequence
  chemically synthesized
tttatttactctgacggtagtt

SEQ ID NO: 1134342 - DNA, 22 bp, Artificial Sequence
  chemically synthesized
taggctgtttatttactctgac

SEQ ID NO: 1134343 - DNA, 22 bp, Artificial Sequence
  chemically synthesized
tgtaggctgtttatttactctg

SEQ ID NO: 1134344 - DNA, 22 bp, Artificial Sequence
  chemically synthesized
ccattctgtaggctgtttattt

SEQ ID NO: 1134345 - DNA, 22 bp, Artificial Sequence
  chemically synthesized
ccgtcagagtaaataaacagcc

SEQ ID NO: 1134346 - DNA, 22 bp, Artificial Sequence
  chemically synthesized
tcccattctgtaggctgtttat

SEQ ID NO: 1134347 - DNA, 22 bp, Artificial Sequence
  chemically synthesized
ctcccattctgtaggctgttta

SEQ ID NO: 1134348 - DNA, 22 bp, Artificial Sequence
  chemically synthesized
tctcccattctgtaggctgttt

SEQ ID NO: 1134349 - DNA, 22 bp, Artificial Sequence
  chemically synthesized
ttctcccattctgtaggctgtt

SEQ ID NO: 1134350 - DNA, 22 bp, Artificial Sequence
  chemically synthesized
cagaatgggagaaaagttttgc

SEQ ID NO: 1134351 - DNA, 22 bp, Artificial Sequence
  chemically synthesized
tcagatggatagatggcaaaac

SEQ ID NO: 1134352 - DNA, 22 bp, Artificial Sequence
  chemically synthesized
gaccattgtcagatggatagat

SEQ ID NO: 1134353 - DNA, 22 bp, Artificial Sequence
  chemically synthesized
tggaccattgtcagatggatag

SEQ ID NO: 1134354 - DNA, 22 bp, Artificial Sequence
  chemically synthesized
tgccatctatccatctgacaat

SEQ ID NO: 1134355 - DNA, 22 bp, Artificial Sequence
  chemically synthesized
gccatctatccatctgacaatg

SEQ ID NO: 1134356 - DNA, 22 bp, Artificial Sequence
  chemically synthesized
tagactctggaccattgtcaga

SEQ ID NO: 1134357 - DNA, 22 bp, Artificial Sequence
  chemically synthesized
ccatctatccatctgacaatgg

SEQ ID NO: 1134358 - DNA, 22 bp, Artificial Sequence
  chemically synthesized
gtagactctggaccattgtcag

SEQ ID NO: 1134359 - DNA, 22 bp, Artificial Sequence
  chemically synthesized
cttgtagactctggaccattgt

SEQ ID NO: 1134360 - DNA, 22 bp, Artificial Sequence
  chemically synthesized
tccatctgacaatggtccagag

SEQ ID NO: 1134361 - DNA, 22 bp, Artificial Sequence
  chemically synthesized
agttccttgtagactctggacc

SEQ ID NO: 1134362 - DNA, 22 bp, Artificial Sequence
  chemically synthesized
aagttccttgtagactctggac

SEQ ID NO: 1134363 - DNA, 22 bp, Artificial Sequence
  chemically synthesized
tttaagttccttgtagactctg

SEQ ID NO: 1134364 - DNA, 22 bp, Artificial Sequence
  chemically synthesized
gtttaagttccttgtagactct

SEQ ID NO: 1134365 - DNA, 22 bp, Artificial Sequence
  chemically synthesized
acaatggtccagagtctacaag

SEQ ID NO: 1134366 - DNA, 22 bp, Artificial Sequence
  chemically synthesized
taaatttgtttaagttccttgt

SEQ ID NO: 1134367 - DNA, 22 bp, Artificial Sequence
  chemically synthesized
gtaaatttgtttaagttccttg

SEQ ID NO: 1134368 - DNA, 22 bp, Artificial Sequence
  chemically synthesized
ttgtaaatttgtttaagttcct

SEQ ID NO: 1134369 - DNA, 22 bp, Artificial Sequence
  chemically synthesized
cttgtaaatttgtttaagttcc

SEQ ID NO: 1134370 - DNA, 22 bp, Artificial Sequence
  chemically synthesized
tcttgtaaatttgtttaagttc

SEQ ID NO: 1134371 - DNA, 22 bp, Artificial Sequence
  chemically synthesized
ttcttgtaaatttgtttaagtt

SEQ ID NO: 1134372 - DNA, 22 bp, Artificial Sequence
  chemically synthesized
tttcttgtaaatttgtttaagt

SEQ ID NO: 1134373 - DNA, 22 bp, Artificial Sequence
  chemically synthesized
ttttcttgtaaatttgtttaag

SEQ ID NO: 1134374 - DNA, 22 bp, Artificial Sequence
  chemically synthesized
tttttttcttgtaaatttgttt

SEQ ID NO: 1134375 - DNA, 22 bp, Artificial Sequence
  chemically synthesized
gtttttttcttgtaaatttgtt

SEQ ID NO: 1134376 - DNA, 22 bp, Artificial Sequence
  chemically synthesized
caaggaacttaaacaaatttac

SEQ ID NO: 1134377 - DNA, 22 bp, Artificial Sequence
  chemically synthesized
tttgtttttttcttgtaaattt

SEQ ID NO: 1134378 - DNA, 22 bp, Artificial Sequence
  chemically synthesized
aaacaaatttacaagaaaaaaa

SEQ ID NO: 1134379 - DNA, 22 bp, Artificial Sequence
  chemically synthesized
aacaaatttacaagaaaaaaac

SEQ ID NO: 1134380 - DNA, 22 bp, Artificial Sequence
  chemically synthesized
atgaggttatttgtttttttct

SEQ ID NO: 1134381 - DNA, 22 bp, Artificial Sequence
  chemically synthesized
aatgaggttatttgtttttttc

SEQ ID NO: 1134382 - DNA, 22 bp, Artificial Sequence
  chemically synthesized
taatgaggttatttgttttttt

SEQ ID NO: 1134383 - DNA, 22 bp, Artificial Sequence
  chemically synthesized
ttaatgaggttatttgtttttt

SEQ ID NO: 1134384 - DNA, 22 bp, Artificial Sequence
  chemically synthesized
tttaatgaggttatttgttttt

SEQ ID NO: 1134385 - DNA, 22 bp, Artificial Sequence
  chemically synthesized
acaagaaaaaaacaaataacct

SEQ ID NO: 1134386 - DNA, 22 bp, Artificial Sequence
  chemically synthesized
caagaaaaaaacaaataacctc

SEQ ID NO: 1134387 - DNA, 22 bp, Artificial Sequence
  chemically synthesized
cccactttttaatgaggttatt

SEQ ID NO: 1134388 - DNA, 22 bp, Artificial Sequence
  chemically synthesized
gcccactttttaatgaggttat

SEQ ID NO: 1134389 - DNA, 22 bp, Artificial Sequence
  chemically synthesized
tgcccactttttaatgaggtta

SEQ ID NO: 1134390 - DNA, 22 bp, Artificial Sequence
  chemically synthesized
tgtgctttgcccactttttaat

SEQ ID NO: 1134391 - DNA, 22 bp, Artificial Sequence
  chemically synthesized
atgtgctttgcccactttttaa

SEQ ID NO: 1134392 - DNA, 22 bp, Artificial Sequence
  chemically synthesized
tttatgtgctttgcccactttt

SEQ ID NO: 1134393 - DNA, 22 bp, Artificial Sequence
  chemically synthesized
gtttatgtgctttgcccacttt

SEQ ID NO: 1134394 - DNA, 22 bp, Artificial Sequence
  chemically synthesized
attaaaaagtgggcaaagcaca

SEQ ID NO: 1134395 - DNA, 22 bp, Artificial Sequence
  chemically synthesized
agaagtgtttgtttatgtgctt

SEQ ID NO: 1134396 - DNA, 22 bp, Artificial Sequence
  chemically synthesized
aaaagtgggcaaagcacataaa

SEQ ID NO: 1134397 - DNA, 22 bp, Artificial Sequence
  chemically synthesized
gagaagtgtttgtttatgtgct

SEQ ID NO: 1134398 - DNA, 22 bp, Artificial Sequence
  chemically synthesized
tgagaagtgtttgtttatgtgc

SEQ ID NO: 1134399 - DNA, 22 bp, Artificial Sequence
  chemically synthesized
ttgagaagtgtttgtttatgtg

SEQ ID NO: 1134400 - DNA, 22 bp, Artificial Sequence
  chemically synthesized
ttttgagaagtgtttgtttatg

SEQ ID NO: 1134401 - DNA, 22 bp, Artificial Sequence
  chemically synthesized
cttttgagaagtgtttgtttat

SEQ ID NO: 1134402 - DNA, 22 bp, Artificial Sequence
  chemically synthesized
ggtcacatgtatgtcttctttt

SEQ ID NO: 1134403 - DNA, 22 bp, Artificial Sequence
  chemically synthesized
aggtcacatgtatgtcttcttt

SEQ ID NO: 1134404 - DNA, 22 bp, Artificial Sequence
  chemically synthesized
taggtcacatgtatgtcttctt

SEQ ID NO: 1134405 - DNA, 22 bp, Artificial Sequence
  chemically synthesized
ctcaaaagaagacatacatgtg

SEQ ID NO: 1134406 - DNA, 22 bp, Artificial Sequence
  chemically synthesized
tcaaaagaagacatacatgtga

SEQ ID NO: 1134407 - DNA, 22 bp, Artificial Sequence
  chemically synthesized
atatcgttttaggtcacatgta

SEQ ID NO: 1134408 - DNA, 22 bp, Artificial Sequence
  chemically synthesized
aaaagaagacatacatgtgacc

SEQ ID NO: 1134409 - DNA, 22 bp, Artificial Sequence
  chemically synthesized
catatcgttttaggtcacatgt

SEQ ID NO: 1134410 - DNA, 22 bp, Artificial Sequence
  chemically synthesized
tcatatcgttttaggtcacatg

SEQ ID NO: 1134411 - DNA, 22 bp, Artificial Sequence
  chemically synthesized
tttcatatcgttttaggtcaca

SEQ ID NO: 1134412 - DNA, 22 bp, Artificial Sequence
  chemically synthesized
ctttcatatcgttttaggtcac

SEQ ID NO: 1134413 - DNA, 22 bp, Artificial Sequence
  chemically synthesized
tctttcatatcgttttaggtca

SEQ ID NO: 1134414 - DNA, 22 bp, Artificial Sequence
  chemically synthesized
agttttctttcatatcgtttta

SEQ ID NO: 1134415 - DNA, 22 bp, Artificial Sequence
  chemically synthesized
aaacgatatgaaagaaaactca

SEQ ID NO: 1134416 - DNA, 22 bp, Artificial Sequence
  chemically synthesized
atgatcaatgatgttgagtttt

SEQ ID NO: 1134417 - DNA, 22 bp, Artificial Sequence
  chemically synthesized
tcatgatcaatgatgttgagtt

SEQ ID NO: 1134418 - DNA, 22 bp, Artificial Sequence
  chemically synthesized
tctcatgatcaatgatgttgag

SEQ ID NO: 1134419 - DNA, 22 bp, Artificial Sequence
  chemically synthesized
ctctcatgatcaatgatgttga

SEQ ID NO: 1134420 - DNA, 22 bp, Artificial Sequence
  chemically synthesized
atgtgcatttctctcatgatca

SEQ ID NO: 1134421 - DNA, 22 bp, Artificial Sequence
  chemically synthesized
gatgtgcatttctctcatgatc

SEQ ID NO: 1134422 - DNA, 22 bp, Artificial Sequence
  chemically synthesized
tgatgtgcatttctctcatgat

SEQ ID NO: 1134423 - DNA, 22 bp, Artificial Sequence
  chemically synthesized
aacatcattgatcatgagagaa

SEQ ID NO: 1134424 - DNA, 22 bp, Artificial Sequence
  chemically synthesized
tggttttgatgtgcatttctct

SEQ ID NO: 1134425 - DNA, 22 bp, Artificial Sequence
  chemically synthesized
attgtggttttgatgtgcattt

SEQ ID NO: 1134426 - DNA, 22 bp, Artificial Sequence
  chemically synthesized
atcatgagagaaatgcacatca

SEQ ID NO: 1134427 - DNA, 22 bp, Artificial Sequence
  chemically synthesized
tctcattgtggttttgatgtgc

SEQ ID NO: 1134428 - DNA, 22 bp, Artificial Sequence
  chemically synthesized
gcgtgagatgttatctcattgt

SEQ ID NO: 1134429 - DNA, 22 bp, Artificial Sequence
  chemically synthesized
actggcgtgagatgttatctca

SEQ ID NO: 1134430 - DNA, 22 bp, Artificial Sequence
  chemically synthesized
tgactggcgtgagatgttatct

SEQ ID NO: 1134431 - DNA, 22 bp, Artificial Sequence
  chemically synthesized
atagtaaccattctgactggcg

SEQ ID NO: 1134432 - DNA, 22 bp, Artificial Sequence
  chemically synthesized
aatagtaaccattctgactggc

SEQ ID NO: 1134433 - DNA, 22 bp, Artificial Sequence
  chemically synthesized
taatagtaaccattctgactgg

SEQ ID NO: 1134434 - DNA, 22 bp, Artificial Sequence
  chemically synthesized
ttaatagtaaccattctgactg

SEQ ID NO: 1134435 - DNA, 22 bp, Artificial Sequence
  chemically synthesized
tttaatagtaaccattctgact

SEQ ID NO: 1134436 - DNA, 22 bp, Artificial Sequence
  chemically synthesized
actttttaatagtaaccattct

SEQ ID NO: 1134437 - DNA, 22 bp, Artificial Sequence
  chemically synthesized
gactttttaatagtaaccattc

SEQ ID NO: 1134438 - DNA, 22 bp, Artificial Sequence
  chemically synthesized
tgactttttaatagtaaccatt

SEQ ID NO: 1134439 - DNA, 22 bp, Artificial Sequence
  chemically synthesized
acgccagtcagaatggttacta

SEQ ID NO: 1134440 - DNA, 22 bp, Artificial Sequence
  chemically synthesized
tttgactttttaatagtaacca

SEQ ID NO: 1134441 - DNA, 22 bp, Artificial Sequence
  chemically synthesized
ttctttgactttttaatagtaa

SEQ ID NO: 1134442 - DNA, 22 bp, Artificial Sequence
  chemically synthesized
ttgttctttgactttttaatag

SEQ ID NO: 1134443 - DNA, 22 bp, Artificial Sequence
  chemically synthesized
accagcatctattgttctttga

SEQ ID NO: 1134444 - DNA, 22 bp, Artificial Sequence
  chemically synthesized
ctattaaaaagtcaaagaacaa

SEQ ID NO: 1134445 - DNA, 22 bp, Artificial Sequence
  chemically synthesized
ttaaaaagtcaaagaacaatag

SEQ ID NO: 1134446 - DNA, 22 bp, Artificial Sequence
  chemically synthesized
aaaagtcaaagaacaatagatg

SEQ ID NO: 1134447 - DNA, 22 bp, Artificial Sequence
  chemically synthesized
cacaacctcaccagcatctatt

SEQ ID NO: 1134448 - DNA, 22 bp, Artificial Sequence
  chemically synthesized
tccacaacctcaccagcatcta

SEQ ID NO: 1134449 - DNA, 22 bp, Artificial Sequence
  chemically synthesized
ctccacaacctcaccagcatct

SEQ ID NO: 1134450 - DNA, 22 bp, Artificial Sequence
  chemically synthesized
tctccacaacctcaccagcatc

SEQ ID NO: 1134451 - DNA, 22 bp, Artificial Sequence
  chemically synthesized
ttctccacaacctcaccagcat

SEQ ID NO: 1134452 - DNA, 22 bp, Artificial Sequence
  chemically synthesized
ccttttctccacaacctcacca

SEQ ID NO: 1134453 - DNA, 22 bp, Artificial Sequence
  chemically synthesized
gtgaggttgtggagaaaaggga

SEQ ID NO: 1134454 - DNA, 22 bp, Artificial Sequence
  chemically synthesized
tggagaaaagggaacactttta

SEQ ID NO: 1134455 - DNA, 22 bp, Artificial Sequence
  chemically synthesized
ccaccaagagtgtaaaagtgtt

SEQ ID NO: 1134456 - DNA, 22 bp, Artificial Sequence
  chemically synthesized
cactcccaccaagagtgtaaaa

SEQ ID NO: 1134457 - DNA, 22 bp, Artificial Sequence
  chemically synthesized
acactcccaccaagagtgtaaa

SEQ ID NO: 1134458 - DNA, 22 bp, Artificial Sequence
  chemically synthesized
atttacactcccaccaagagtg

SEQ ID NO: 1134459 - DNA, 22 bp, Artificial Sequence
  chemically synthesized
aactaatttacactcccaccaa

SEQ ID NO: 1134460 - DNA, 22 bp, Artificial Sequence
  chemically synthesized
ttacactcttggtgggagtgta

SEQ ID NO: 1134461 - DNA, 22 bp, Artificial Sequence
  chemically synthesized
tacactcttggtgggagtgtaa

SEQ ID NO: 1134462 - DNA, 22 bp, Artificial Sequence
  chemically synthesized
acactcttggtgggagtgtaaa

SEQ ID NO: 1134463 - DNA, 22 bp, Artificial Sequence
  chemically synthesized
cactcttggtgggagtgtaaat

SEQ ID NO: 1134464 - DNA, 22 bp, Artificial Sequence
  chemically synthesized
cacaagggttgaactaatttac

SEQ ID NO: 1134465 - DNA, 22 bp, Artificial Sequence
  chemically synthesized
ttggtgggagtgtaaattagtt

SEQ ID NO: 1134466 - DNA, 22 bp, Artificial Sequence
  chemically synthesized
ccacaagggttgaactaattta

SEQ ID NO: 1134467 - DNA, 22 bp, Artificial Sequence
  chemically synthesized
ggtgggagtgtaaattagttca

SEQ ID NO: 1134468 - DNA, 22 bp, Artificial Sequence
  chemically synthesized
gtgggagtgtaaattagttcaa

SEQ ID NO: 1134469 - DNA, 22 bp, Artificial Sequence
  chemically synthesized
tcttccacaagggttgaactaa

SEQ ID NO: 1134470 - DNA, 22 bp, Artificial Sequence
  chemically synthesized
cgcattgtcttccacaagggtt

SEQ ID NO: 1134471 - DNA, 22 bp, Artificial Sequence
  chemically synthesized
gttcaacccttgtggaagacaa

SEQ ID NO: 1134472 - DNA, 22 bp, Artificial Sequence
  chemically synthesized
agaaatctccgcattgtcttcc

SEQ ID NO: 1134473 - DNA, 22 bp, Artificial Sequence
  chemically synthesized
gagaaatctccgcattgtcttc

SEQ ID NO: 1134474 - DNA, 22 bp, Artificial Sequence
  chemically synthesized
tgagaaatctccgcattgtctt

SEQ ID NO: 1134475 - DNA, 22 bp, Artificial Sequence
  chemically synthesized
aacccttgtggaagacaatgcg

SEQ ID NO: 1134476 - DNA, 22 bp, Artificial Sequence
  chemically synthesized
agtctttgagaaatctccgcat

SEQ ID NO: 1134477 - DNA, 22 bp, Artificial Sequence
  chemically synthesized
gtggaagacaatgcggagattt

SEQ ID NO: 1134478 - DNA, 22 bp, Artificial Sequence
  chemically synthesized
taagtctttgagaaatctccgc

SEQ ID NO: 1134479 - DNA, 22 bp, Artificial Sequence
  chemically synthesized
tggaagacaatgcggagatttc

SEQ ID NO: 1134480 - DNA, 22 bp, Artificial Sequence
  chemically synthesized
cctctaagtctttgagaaatct

SEQ ID NO: 1134481 - DNA, 22 bp, Artificial Sequence
  chemically synthesized
tgcctctaagtctttgagaaat

SEQ ID NO: 1134482 - DNA, 22 bp, Artificial Sequence
  chemically synthesized
ctgcctctaagtctttgagaaa

SEQ ID NO: 1134483 - DNA, 22 bp, Artificial Sequence
  chemically synthesized
tctgcctctaagtctttgagaa

SEQ ID NO: 1134484 - DNA, 22 bp, Artificial Sequence
  chemically synthesized
ttctgcctctaagtctttgaga

SEQ ID NO: 1134485 - DNA, 22 bp, Artificial Sequence
  chemically synthesized
aatggtttttctgcctctaagt

SEQ ID NO: 1134486 - DNA, 22 bp, Artificial Sequence
  chemically synthesized
aaatggtttttctgcctctaag

SEQ ID NO: 1134487 - DNA, 22 bp, Artificial Sequence
  chemically synthesized
ctcaaagacttagaggcagaaa

SEQ ID NO: 1134488 - DNA, 22 bp, Artificial Sequence
  chemically synthesized
gcttaaatggtttttctgcctc

SEQ ID NO: 1134489 - DNA, 22 bp, Artificial Sequence
  chemically synthesized
tcaaagacttagaggcagaaaa

SEQ ID NO: 1134490 - DNA, 22 bp, Artificial Sequence
  chemically synthesized
aaagacttagaggcagaaaaac

SEQ ID NO: 1134491 - DNA, 22 bp, Artificial Sequence
  chemically synthesized
ctggcttaaatggtttttctgc

SEQ ID NO: 1134492 - DNA, 22 bp, Artificial Sequence
  chemically synthesized
agaggcagaaaaaccatttaag

SEQ ID NO: 1134493 - DNA, 22 bp, Artificial Sequence
  chemically synthesized
gaggcagaaaaaccatttaagc

SEQ ID NO: 1134494 - DNA, 22 bp, Artificial Sequence
  chemically synthesized
ggtatatacccagtaatgggat

SEQ ID NO: 1134495 - DNA, 22 bp, Artificial Sequence
  chemically synthesized
gggtatatacccagtaatggga

SEQ ID NO: 1134496 - DNA, 22 bp, Artificial Sequence
  chemically synthesized
aagccagcaatcccattactgg

SEQ ID NO: 1134497 - DNA, 22 bp, Artificial Sequence
  chemically synthesized
agccagcaatcccattactggg

SEQ ID NO: 1134498 - DNA, 22 bp, Artificial Sequence
  chemically synthesized
tatttgggtatatacccagtaa

SEQ ID NO: 1134499 - DNA, 22 bp, Artificial Sequence
  chemically synthesized
atatttgggtatatacccagta

SEQ ID NO: 1134500 - DNA, 22 bp, Artificial Sequence
  chemically synthesized
ctgggtatatacccaaatataa

SEQ ID NO: 1134501 - DNA, 22 bp, Artificial Sequence
  chemically synthesized
taatagaatgatttatatttgg

SEQ ID NO: 1134502 - DNA, 22 bp, Artificial Sequence
  chemically synthesized
ataatagaatgatttatatttg

SEQ ID NO: 1134503 - DNA, 22 bp, Artificial Sequence
  chemically synthesized
tataatagaatgatttatattt

SEQ ID NO: 1134504 - DNA, 22 bp, Artificial Sequence
  chemically synthesized
ggtatatacccaaatataaatc

SEQ ID NO: 1134505 - DNA, 22 bp, Artificial Sequence
  chemically synthesized
caatgatacacatgcatgtatc

SEQ ID NO: 1134506 - DNA, 22 bp, Artificial Sequence
  chemically synthesized
tattataaagatacatgcatgt

SEQ ID NO: 1134507 - DNA, 22 bp, Artificial Sequence
  chemically synthesized
ttataaagatacatgcatgtgt

SEQ ID NO: 1134508 - DNA, 22 bp, Artificial Sequence
  chemically synthesized
taaagatacatgcatgtgtatc

SEQ ID NO: 1134509 - DNA, 22 bp, Artificial Sequence
  chemically synthesized
tgtatagtgttgcaatgataca

SEQ ID NO: 1134510 - DNA, 22 bp, Artificial Sequence
  chemically synthesized
ttgtgtatagtgttgcaatgat

SEQ ID NO: 1134511 - DNA, 22 bp, Artificial Sequence
  chemically synthesized
ctattgtgtatagtgttgcaat

SEQ ID NO: 1134512 - DNA, 22 bp, Artificial Sequence
  chemically synthesized
gctattgtgtatagtgttgcaa

SEQ ID NO: 1134513 - DNA, 22 bp, Artificial Sequence
  chemically synthesized
tgctattgtgtatagtgttgca

SEQ ID NO: 1134514 - DNA, 22 bp, Artificial Sequence
  chemically synthesized
catgtctttgctattgtgtata

SEQ ID NO: 1134515 - DNA, 22 bp, Artificial Sequence
  chemically synthesized
attccatgtctttgctattgtg

SEQ ID NO: 1134516 - DNA, 22 bp, Artificial Sequence
  chemically synthesized
caacactatacacaatagcaaa

SEQ ID NO: 1134517 - DNA, 22 bp, Artificial Sequence
  chemically synthesized
aggttgattccatgtctttgct

SEQ ID NO: 1134518 - DNA, 22 bp, Artificial Sequence
  chemically synthesized
tacacaatagcaaagacatgga

SEQ ID NO: 1134519 - DNA, 22 bp, Artificial Sequence
  chemically synthesized
atgagcattaaggttgattcca

SEQ ID NO: 1134520 - DNA, 22 bp, Artificial Sequence
  chemically synthesized
tcattgatgagcattaaggttg

SEQ ID NO: 1134521 - DNA, 22 bp, Artificial Sequence
  chemically synthesized
tctatcattgatgagcattaag

SEQ ID NO: 1134522 - DNA, 22 bp, Artificial Sequence
  chemically synthesized
gtctatcattgatgagcattaa

SEQ ID NO: 1134523 - DNA, 22 bp, Artificial Sequence
  chemically synthesized
tcttgtctatcattgatgagca

SEQ ID NO: 1134524 - DNA, 22 bp, Artificial Sequence
  chemically synthesized
atcttgtctatcattgatgagc

SEQ ID NO: 1134525 - DNA, 22 bp, Artificial Sequence
  chemically synthesized
tatcttgtctatcattgatgag

SEQ ID NO: 1134526 - DNA, 22 bp, Artificial Sequence
  chemically synthesized
tttatcttgtctatcattgatg

SEQ ID NO: 1134527 - DNA, 22 bp, Artificial Sequence
  chemically synthesized
ctttatcttgtctatcattgat

SEQ ID NO: 1134528 - DNA, 22 bp, Artificial Sequence
  chemically synthesized
tctttatcttgtctatcattga

SEQ ID NO: 1134529 - DNA, 22 bp, Artificial Sequence
  chemically synthesized
aatgctcatcaatgatagacaa

SEQ ID NO: 1134530 - DNA, 22 bp, Artificial Sequence
  chemically synthesized
atgctcatcaatgatagacaag

SEQ ID NO: 1134531 - DNA, 22 bp, Artificial Sequence
  chemically synthesized
atcaatgatagacaagataaag

SEQ ID NO: 1134532 - DNA, 22 bp, Artificial Sequence
  chemically synthesized
gtgtaaatgtaccacattttct

SEQ ID NO: 1134533 - DNA, 22 bp, Artificial Sequence
  chemically synthesized
ggtgtaaatgtaccacattttc

SEQ ID NO: 1134534 - DNA, 22 bp, Artificial Sequence
  chemically synthesized
cttggtgtaaatgtaccacatt

SEQ ID NO: 1134535 - DNA, 22 bp, Artificial Sequence
  chemically synthesized
tagtattccttggtgtaaatgt

SEQ ID NO: 1134536 - DNA, 22 bp, Artificial Sequence
  chemically synthesized
tggcattatagtattccttggt

SEQ ID NO: 1134537 - DNA, 22 bp, Artificial Sequence
  chemically synthesized
gtggcattatagtattccttgg

SEQ ID NO: 1134538 - DNA, 22 bp, Artificial Sequence
  chemically synthesized
gtgtttgtggcattatagtatt

SEQ ID NO: 1134539 - DNA, 22 bp, Artificial Sequence
  chemically synthesized
acaccaaggaatactataatgc

SEQ ID NO: 1134540 - DNA, 22 bp, Artificial Sequence
  chemically synthesized
caccaaggaatactataatgcc

SEQ ID NO: 1134541 - DNA, 22 bp, Artificial Sequence
  chemically synthesized
gttcgtgtttgtggcattatag

SEQ ID NO: 1134542 - DNA, 22 bp, Artificial Sequence
  chemically synthesized
actcgttcgtgtttgtggcatt

SEQ ID NO: 1134543 - DNA, 22 bp, Artificial Sequence
  chemically synthesized
gactcgttcgtgtttgtggcat

SEQ ID NO: 1134544 - DNA, 22 bp, Artificial Sequence
  chemically synthesized
taatgccacaaacacgaacgag

SEQ ID NO: 1134545 - DNA, 22 bp, Artificial Sequence
  chemically synthesized
tgaagaaaagaagtttgactcg

SEQ ID NO: 1134546 - DNA, 22 bp, Artificial Sequence
  chemically synthesized
atgaagaaaagaagtttgactc

SEQ ID NO: 1134547 - DNA, 22 bp, Artificial Sequence
  chemically synthesized
agtgatttatgaagaaaagaag

SEQ ID NO: 1134548 - DNA, 22 bp, Artificial Sequence
  chemically synthesized
aaactgagtgatttatgaagaa

SEQ ID NO: 1134549 - DNA, 22 bp, Artificial Sequence
  chemically synthesized
cttttcttcataaatcactcag

SEQ ID NO: 1134550 - DNA, 22 bp, Artificial Sequence
  chemically synthesized
ttttcttcataaatcactcagt

SEQ ID NO: 1134551 - DNA, 22 bp, Artificial Sequence
  chemically synthesized
ttcttcataaatcactcagttt

SEQ ID NO: 1134552 - DNA, 22 bp, Artificial Sequence
  chemically synthesized
tcttcataaatcactcagtttc

SEQ ID NO: 1134553 - DNA, 22 bp, Artificial Sequence
  chemically synthesized
cttcataaatcactcagtttca

SEQ ID NO: 1134554 - DNA, 22 bp, Artificial Sequence
  chemically synthesized
taaagacatacctgaaactgag

SEQ ID NO: 1134555 - DNA, 22 bp, Artificial Sequence
  chemically synthesized
ttcataaatcactcagtttcag

SEQ ID NO: 1134556 - DNA, 22 bp, Artificial Sequence
  chemically synthesized
cataaatcactcagtttcaggt

SEQ ID NO: 1134557 - DNA, 22 bp, Artificial Sequence
  chemically synthesized
ctataaagacatacctgaaact

SEQ ID NO: 1134558 - DNA, 22 bp, Artificial Sequence
  chemically synthesized
ataaatcactcagtttcaggta

SEQ ID NO: 1134559 - DNA, 22 bp, Artificial Sequence
  chemically synthesized
cactgctataaagacatacctg

SEQ ID NO: 1134560 - DNA, 22 bp, Artificial Sequence
  chemically synthesized
acactgctataaagacatacct

SEQ ID NO: 1134561 - DNA, 22 bp, Artificial Sequence
  chemically synthesized
ttacactgctataaagacatac

SEQ ID NO: 1134562 - DNA, 22 bp, Artificial Sequence
  chemically synthesized
ttcttacactgctataaagaca

SEQ ID NO: 1134563 - DNA, 22 bp, Artificial Sequence
  chemically synthesized
agtttcaggtatgtctttatag

SEQ ID NO: 1134564 - DNA, 22 bp, Artificial Sequence
  chemically synthesized
gcctgttcttacactgctataa

SEQ ID NO: 1134565 - DNA, 22 bp, Artificial Sequence
  chemically synthesized
caggtatgtctttatagcagtg

SEQ ID NO: 1134566 - DNA, 22 bp, Artificial Sequence
  chemically synthesized
aggtatgtctttatagcagtgt

SEQ ID NO: 1134567 - DNA, 22 bp, Artificial Sequence
  chemically synthesized
ttagcctgttcttacactgcta

SEQ ID NO: 1134568 - DNA, 22 bp, Artificial Sequence
  chemically synthesized
attagcctgttcttacactgct

SEQ ID NO: 1134569 - DNA, 22 bp, Artificial Sequence
  chemically synthesized
tatagcagtgtaagaacaggct

SEQ ID NO: 1134570 - DNA, 22 bp, Artificial Sequence
  chemically synthesized
atagcagtgtaagaacaggcta

SEQ ID NO: 1134571 - DNA, 22 bp, Artificial Sequence
  chemically synthesized
tagcagtgtaagaacaggctaa

SEQ ID NO: 1134572 - DNA, 22 bp, Artificial Sequence
  chemically synthesized
agaatatcagtcaaaaataaaa

SEQ ID NO: 1134573 - DNA, 22 bp, Artificial Sequence
  chemically synthesized
ataaattttccttttatttttg

SEQ ID NO: 1134574 - DNA, 22 bp, Artificial Sequence
  chemically synthesized
aattaagaatatcagtcaaaaa

SEQ ID NO: 1134575 - DNA, 22 bp, Artificial Sequence
  chemically synthesized
caattaagaatatcagtcaaaa

SEQ ID NO: 1134576 - DNA, 22 bp, Artificial Sequence
  chemically synthesized
tccttttatttttgactgatat

SEQ ID NO: 1134577 - DNA, 22 bp, Artificial Sequence
  chemically synthesized
ccttttatttttgactgatatt

SEQ ID NO: 1134578 - DNA, 22 bp, Artificial Sequence
  chemically synthesized
cttttatttttgactgatattc

SEQ ID NO: 1134579 - DNA, 22 bp, Artificial Sequence
  chemically synthesized
aaagtttcaattaagaatatca

SEQ ID NO: 1134580 - DNA, 22 bp, Artificial Sequence
  chemically synthesized
ttatttttgactgatattctta

SEQ ID NO: 1134581 - DNA, 22 bp, Artificial Sequence
  chemically synthesized
tatttttgactgatattcttaa

SEQ ID NO: 1134582 - DNA, 22 bp, Artificial Sequence
  chemically synthesized
atttttgactgatattcttaat

SEQ ID NO: 1134583 - DNA, 22 bp, Artificial Sequence
  chemically synthesized
tttttgactgatattcttaatt

SEQ ID NO: 1134584 - DNA, 22 bp, Artificial Sequence
  chemically synthesized
ttgactgatattcttaattgaa

SEQ ID NO: 1134585 - DNA, 22 bp, Artificial Sequence
  chemically synthesized
tgactgatattcttaattgaaa

SEQ ID NO: 1134586 - DNA, 22 bp, Artificial Sequence
  chemically synthesized
gactgatattcttaattgaaac

SEQ ID NO: 1134587 - DNA, 22 bp, Artificial Sequence
  chemically synthesized
actgatattcttaattgaaact

SEQ ID NO: 1134588 - DNA, 22 bp, Artificial Sequence
  chemically synthesized
aatggaaagttaaaagtttcaa

SEQ ID NO: 1134589 - DNA, 22 bp, Artificial Sequence
  chemically synthesized
atattcttaattgaaactttta

SEQ ID NO: 1134590 - DNA, 22 bp, Artificial Sequence
  chemically synthesized
ttaattgaaacttttaactttc

SEQ ID NO: 1134591 - DNA, 22 bp, Artificial Sequence
  chemically synthesized
aattgaaacttttaactttcca

SEQ ID NO: 1134592 - DNA, 22 bp, Artificial Sequence
  chemically synthesized
attgaaacttttaactttccat

SEQ ID NO: 1134593 - DNA, 22 bp, Artificial Sequence
  chemically synthesized
aaacttttaactttccatttaa

SEQ ID NO: 1134594 - DNA, 22 bp, Artificial Sequence
  chemically synthesized
ttaactttccatttaattattt

SEQ ID NO: 1134595 - DNA, 22 bp, Artificial Sequence
  chemically synthesized
taactttccatttaattattta

SEQ ID NO: 1134596 - DNA, 22 bp, Artificial Sequence
  chemically synthesized
aactttccatttaattatttac

SEQ ID NO: 1134597 - DNA, 22 bp, Artificial Sequence
  chemically synthesized
actttccatttaattatttaca

SEQ ID NO: 1134598 - DNA, 22 bp, Artificial Sequence
  chemically synthesized
caaaggcaataatatgtaaata

SEQ ID NO: 1134599 - DNA, 22 bp, Artificial Sequence
  chemically synthesized
tccatttaattatttacatatt

SEQ ID NO: 1134600 - DNA, 22 bp, Artificial Sequence
  chemically synthesized
ccatttaattatttacatatta

SEQ ID NO: 1134601 - DNA, 22 bp, Artificial Sequence
  chemically synthesized
catttaattatttacatattat

SEQ ID NO: 1134602 - DNA, 22 bp, Artificial Sequence
  chemically synthesized
aattatttacatattattgcct

SEQ ID NO: 1134603 - DNA, 22 bp, Artificial Sequence
  chemically synthesized
attatttacatattattgcctt

SEQ ID NO: 1134604 - DNA, 22 bp, Artificial Sequence
  chemically synthesized
tttacatattattgcctttgta

SEQ ID NO: 1134605 - DNA, 22 bp, Artificial Sequence
  chemically synthesized
acatattattgcctttgtaact

SEQ ID NO: 1134606 - DNA, 22 bp, Artificial Sequence
  chemically synthesized
catattattgcctttgtaactt

SEQ ID NO: 1134607 - DNA, 22 bp, Artificial Sequence
  chemically synthesized
tcccagcataacaaaaaagtta

SEQ ID NO: 1134608 - DNA, 22 bp, Artificial Sequence
  chemically synthesized
atcccagcataacaaaaaagtt

SEQ ID NO: 1134609 - DNA, 22 bp, Artificial Sequence
  chemically synthesized
ttgcctttgtaacttttttgtt

SEQ ID NO: 1134610 - DNA, 22 bp, Artificial Sequence
  chemically synthesized
ttatcccagcataacaaaaaag

SEQ ID NO: 1134611 - DNA, 22 bp, Artificial Sequence
  chemically synthesized
cctttgtaacttttttgttatg

SEQ ID NO: 1134612 - DNA, 22 bp, Artificial Sequence
  chemically synthesized
tgtaacttttttgttatgctgg

SEQ ID NO: 1134613 - DNA, 22 bp, Artificial Sequence
  chemically synthesized
aaatctcttatcccagcataac

SEQ ID NO: 1134614 - DNA, 22 bp, Artificial Sequence
  chemically synthesized
gtaacttttttgttatgctggg

SEQ ID NO: 1134615 - DNA, 22 bp, Artificial Sequence
  chemically synthesized
taacttttttgttatgctggga

SEQ ID NO: 1134616 - DNA, 22 bp, Artificial Sequence
  chemically synthesized
ttttgttatgctgggataagag

SEQ ID NO: 1134617 - DNA, 22 bp, Artificial Sequence
  chemically synthesized
tttgttatgctgggataagaga

SEQ ID NO: 1134618 - DNA, 22 bp, Artificial Sequence
  chemically synthesized
ttgttatgctgggataagagat

SEQ ID NO: 1134619 - DNA, 22 bp, Artificial Sequence
  chemically synthesized
tgttatgctgggataagagatt

SEQ ID NO: 1134620 - DNA, 22 bp, Artificial Sequence
  chemically synthesized
gttatgctgggataagagattt

SEQ ID NO: 1134621 - DNA, 22 bp, Artificial Sequence
  chemically synthesized
ttatgctgggataagagatttc

SEQ ID NO: 1134622 - DNA, 22 bp, Artificial Sequence
  chemically synthesized
tgctgggataagagatttcaac

SEQ ID NO: 1134623 - DNA, 22 bp, Artificial Sequence
  chemically synthesized
aaaaggcaagaagttgaaatct

SEQ ID NO: 1134624 - DNA, 22 bp, Artificial Sequence
  chemically synthesized
ggataagagatttcaacttctt

SEQ ID NO: 1134625 - DNA, 22 bp, Artificial Sequence
  chemically synthesized
gaatatctcaaaaggcaagaag

SEQ ID NO: 1134626 - DNA, 22 bp, Artificial Sequence
  chemically synthesized
aaatactagaatatctcaaaag

SEQ ID NO: 1134627 - DNA, 22 bp, Artificial Sequence
  chemically synthesized
caacttcttgccttttgagata

SEQ ID NO: 1134628 - DNA, 22 bp, Artificial Sequence
  chemically synthesized
aacttcttgccttttgagatat

SEQ ID NO: 1134629 - DNA, 22 bp, Artificial Sequence
  chemically synthesized
cttgccttttgagatattctag

SEQ ID NO: 1134630 - DNA, 22 bp, Artificial Sequence
  chemically synthesized
aatattcaaatactagaatatc

SEQ ID NO: 1134631 - DNA, 22 bp, Artificial Sequence
  chemically synthesized
ttgccttttgagatattctagt

SEQ ID NO: 1134632 - DNA, 22 bp, Artificial Sequence
  chemically synthesized
gccttttgagatattctagtat

SEQ ID NO: 1134633 - DNA, 22 bp, Artificial Sequence
  chemically synthesized
ccttttgagatattctagtatt

SEQ ID NO: 1134634 - DNA, 22 bp, Artificial Sequence
  chemically synthesized
ttgagatattctagtatttgaa

SEQ ID NO: 1134635 - DNA, 22 bp, Artificial Sequence
  chemically synthesized
tgagatattctagtatttgaat

SEQ ID NO: 1134636 - DNA, 22 bp, Artificial Sequence
  chemically synthesized
gagatattctagtatttgaata

SEQ ID NO: 1134637 - DNA, 22 bp, Artificial Sequence
  chemically synthesized
agatattctagtatttgaatat

SEQ ID NO: 1134638 - DNA, 22 bp, Artificial Sequence
  chemically synthesized
gtaagtatctaaatattcaaat

SEQ ID NO: 1134639 - DNA, 22 bp, Artificial Sequence
  chemically synthesized
tagtaagtatctaaatattcaa

SEQ ID NO: 1134640 - DNA, 22 bp, Artificial Sequence
  chemically synthesized
ctagtaagtatctaaatattca

SEQ ID NO: 1134641 - DNA, 22 bp, Artificial Sequence
  chemically synthesized
tctagtaagtatctaaatattc

SEQ ID NO: 1134642 - DNA, 22 bp, Artificial Sequence
  chemically synthesized
tagtatttgaatatttagatac

SEQ ID NO: 1134643 - DNA, 22 bp, Artificial Sequence
  chemically synthesized
gtatttgaatatttagatactt

SEQ ID NO: 1134644 - DNA, 22 bp, Artificial Sequence
  chemically synthesized
aatctttctagtaagtatctaa

SEQ ID NO: 1134645 - DNA, 22 bp, Artificial Sequence
  chemically synthesized
gaatctttctagtaagtatcta

SEQ ID NO: 1134646 - DNA, 22 bp, Artificial Sequence
  chemically synthesized
gaatatttagatacttactaga

SEQ ID NO: 1134647 - DNA, 22 bp, Artificial Sequence
  chemically synthesized
aatatttagatacttactagaa

SEQ ID NO: 1134648 - DNA, 22 bp, Artificial Sequence
  chemically synthesized
tagcttgaatctttctagtaag

SEQ ID NO: 1134649 - DNA, 22 bp, Artificial Sequence
  chemically synthesized
atagcttgaatctttctagtaa

SEQ ID NO: 1134650 - DNA, 22 bp, Artificial Sequence
  chemically synthesized
tatagcttgaatctttctagta

SEQ ID NO: 1134651 - DNA, 22 bp, Artificial Sequence
  chemically synthesized
agatacttactagaaagattca

SEQ ID NO: 1134652 - DNA, 22 bp, Artificial Sequence
  chemically synthesized
gatacttactagaaagattcaa

SEQ ID NO: 1134653 - DNA, 22 bp, Artificial Sequence
  chemically synthesized
atactttatagcttgaatcttt

SEQ ID NO: 1134654 - DNA, 22 bp, Artificial Sequence
  chemically synthesized
actagaaagattcaagctataa

SEQ ID NO: 1134655 - DNA, 22 bp, Artificial Sequence
  chemically synthesized
gtaactaatactttatagcttg

SEQ ID NO: 1134656 - DNA, 22 bp, Artificial Sequence
  chemically synthesized
ctagaaagattcaagctataaa

SEQ ID NO: 1134657 - DNA, 22 bp, Artificial Sequence
  chemically synthesized
gaaagattcaagctataaagta

SEQ ID NO: 1134658 - DNA, 22 bp, Artificial Sequence
  chemically synthesized
aattagtaactaatactttata

SEQ ID NO: 1134659 - DNA, 22 bp, Artificial Sequence
  chemically synthesized
tgctaaattagtaactaatact

SEQ ID NO: 1134660 - DNA, 22 bp, Artificial Sequence
  chemically synthesized
atgctaaattagtaactaatac

SEQ ID NO: 1134661 - DNA, 22 bp, Artificial Sequence
  chemically synthesized
tatgctaaattagtaactaata

SEQ ID NO: 1134662 - DNA, 22 bp, Artificial Sequence
  chemically synthesized
aagctataaagtattagttact

SEQ ID NO: 1134663 - DNA, 22 bp, Artificial Sequence
  chemically synthesized
taaagtattagttactaattta

SEQ ID NO: 1134664 - DNA, 22 bp, Artificial Sequence
  chemically synthesized
caaaataaagattttatgctaa

SEQ ID NO: 1134665 - DNA, 22 bp, Artificial Sequence
  chemically synthesized
gcaaaataaagattttatgcta

SEQ ID NO: 1134666 - DNA, 22 bp, Artificial Sequence
  chemically synthesized
gttactaatttagcataaaatc

SEQ ID NO: 1134667 - DNA, 22 bp, Artificial Sequence
  chemically synthesized
ctaatttagcataaaatcttta

SEQ ID NO: 1134668 - DNA, 22 bp, Artificial Sequence
  chemically synthesized
gtatttgcaaaataaagatttt

SEQ ID NO: 1134669 - DNA, 22 bp, Artificial Sequence
  chemically synthesized
atttagcataaaatctttattt

SEQ ID NO: 1134670 - DNA, 22 bp, Artificial Sequence
  chemically synthesized
agcataaaatctttattttgca

SEQ ID NO: 1134671 - DNA, 22 bp, Artificial Sequence
  chemically synthesized
gcataaaatctttattttgcaa

SEQ ID NO: 1134672 - DNA, 22 bp, Artificial Sequence
  chemically synthesized
caagtattagtatttgcaaaat

SEQ ID NO: 1134673 - DNA, 22 bp, Artificial Sequence
  chemically synthesized
ttgcaagtattagtatttgcaa

SEQ ID NO: 1134674 - DNA, 22 bp, Artificial Sequence
  chemically synthesized
ttattgcaagtattagtatttg

SEQ ID NO: 1134675 - DNA, 22 bp, Artificial Sequence
  chemically synthesized
tattttgcaaatactaatactt

SEQ ID NO: 1134676 - DNA, 22 bp, Artificial Sequence
  chemically synthesized
attttgcaaatactaatacttg

SEQ ID NO: 1134677 - DNA, 22 bp, Artificial Sequence
  chemically synthesized
ttttgcaaatactaatacttgc

SEQ ID NO: 1134678 - DNA, 22 bp, Artificial Sequence
  chemically synthesized
gtacctgttattgcaagtatta

SEQ ID NO: 1134679 - DNA, 22 bp, Artificial Sequence
  chemically synthesized
tgcaaatactaatacttgcaat

SEQ ID NO: 1134680 - DNA, 22 bp, Artificial Sequence
  chemically synthesized
gcaaatactaatacttgcaata

SEQ ID NO: 1134681 - DNA, 22 bp, Artificial Sequence
  chemically synthesized
caaatactaatacttgcaataa

SEQ ID NO: 1134682 - DNA, 22 bp, Artificial Sequence
  chemically synthesized
ataactggtacctgttattgca

SEQ ID NO: 1134683 - DNA, 22 bp, Artificial Sequence
  chemically synthesized
cataactggtacctgttattgc

SEQ ID NO: 1134684 - DNA, 22 bp, Artificial Sequence
  chemically synthesized
atacttgcaataacaggtacca

SEQ ID NO: 1134685 - DNA, 22 bp, Artificial Sequence
  chemically synthesized
gcaataacaggtaccagttatg

SEQ ID NO: 1134686 - DNA, 22 bp, Artificial Sequence
  chemically synthesized
caataacaggtaccagttatga

SEQ ID NO: 1134687 - DNA, 22 bp, Artificial Sequence
  chemically synthesized
gatcatgcagaaagcttcataa

SEQ ID NO: 1134688 - DNA, 22 bp, Artificial Sequence
  chemically synthesized
taatgcctggatcatgcagaaa

SEQ ID NO: 1134689 - DNA, 22 bp, Artificial Sequence
  chemically synthesized
ttgtaatgcctggatcatgcag

SEQ ID NO: 1134690 - DNA, 22 bp, Artificial Sequence
  chemically synthesized
attgtaatgcctggatcatgca

SEQ ID NO: 1134691 - DNA, 22 bp, Artificial Sequence
  chemically synthesized
tgaagctttctgcatgatccag

SEQ ID NO: 1134692 - DNA, 22 bp, Artificial Sequence
  chemically synthesized
aaaacacttattgtaatgcctg

SEQ ID NO: 1134693 - DNA, 22 bp, Artificial Sequence
  chemically synthesized
tctgcatgatccaggcattaca

SEQ ID NO: 1134694 - DNA, 22 bp, Artificial Sequence
  chemically synthesized
ctgcatgatccaggcattacaa

SEQ ID NO: 1134695 - DNA, 22 bp, Artificial Sequence
  chemically synthesized
tgcatgatccaggcattacaat

SEQ ID NO: 1134696 - DNA, 22 bp, Artificial Sequence
  chemically synthesized
catgatccaggcattacaataa

SEQ ID NO: 1134697 - DNA, 22 bp, Artificial Sequence
  chemically synthesized
aataagataatcaattcaaaac

SEQ ID NO: 1134698 - DNA, 22 bp, Artificial Sequence
  chemically synthesized
gaataagataatcaattcaaaa

SEQ ID NO: 1134699 - DNA, 22 bp, Artificial Sequence
  chemically synthesized
tgaataagataatcaattcaaa

SEQ ID NO: 1134700 - DNA, 22 bp, Artificial Sequence
  chemically synthesized
ttgaataagataatcaattcaa

SEQ ID NO: 1134701 - DNA, 22 bp, Artificial Sequence
  chemically synthesized
caataagtgttttgaattgatt

SEQ ID NO: 1134702 - DNA, 22 bp, Artificial Sequence
  chemically synthesized
gatcttttgaataagataatca

SEQ ID NO: 1134703 - DNA, 22 bp, Artificial Sequence
  chemically synthesized
tagatcttttgaataagataat

SEQ ID NO: 1134704 - DNA, 22 bp, Artificial Sequence
  chemically synthesized
ctagatcttttgaataagataa

SEQ ID NO: 1134705 - DNA, 22 bp, Artificial Sequence
  chemically synthesized
tctagatcttttgaataagata

SEQ ID NO: 1134706 - DNA, 22 bp, Artificial Sequence
  chemically synthesized
ttctagatcttttgaataagat

SEQ ID NO: 1134707 - DNA, 22 bp, Artificial Sequence
  chemically synthesized
tgaattgattatcttattcaaa

SEQ ID NO: 1134708 - DNA, 22 bp, Artificial Sequence
  chemically synthesized
gaattgattatcttattcaaaa

SEQ ID NO: 1134709 - DNA, 22 bp, Artificial Sequence
  chemically synthesized
aattgattatcttattcaaaag

SEQ ID NO: 1134710 - DNA, 22 bp, Artificial Sequence
  chemically synthesized
attatcttattcaaaagatcta

SEQ ID NO: 1134711 - DNA, 22 bp, Artificial Sequence
  chemically synthesized
tcttattcaaaagatctagaaa

SEQ ID NO: 1134712 - DNA, 22 bp, Artificial Sequence
  chemically synthesized
attcaaaagatctagaaaaact

SEQ ID NO: 1134713 - DNA, 22 bp, Artificial Sequence
  chemically synthesized
ttcaaaagatctagaaaaactc

SEQ ID NO: 1134714 - DNA, 22 bp, Artificial Sequence
  chemically synthesized
caacatagcaagggagtttttc

SEQ ID NO: 1134715 - DNA, 22 bp, Artificial Sequence
  chemically synthesized
acaacatagcaagggagttttt

SEQ ID NO: 1134716 - DNA, 22 bp, Artificial Sequence
  chemically synthesized
aaaagatctagaaaaactccct

SEQ ID NO: 1134717 - DNA, 22 bp, Artificial Sequence
  chemically synthesized
tacaacatagcaagggagtttt

SEQ ID NO: 1134718 - DNA, 22 bp, Artificial Sequence
  chemically synthesized
aagctttacaacatagcaaggg

SEQ ID NO: 1134719 - DNA, 22 bp, Artificial Sequence
  chemically synthesized
ttaaagctttacaacatagcaa

SEQ ID NO: 1134720 - DNA, 22 bp, Artificial Sequence
  chemically synthesized
gaaaaactcccttgctatgttg

SEQ ID NO: 1134721 - DNA, 22 bp, Artificial Sequence
  chemically synthesized
attaaagctttacaacatagca

SEQ ID NO: 1134722 - DNA, 22 bp, Artificial Sequence
  chemically synthesized
ccatttattaaagctttacaac

SEQ ID NO: 1134723 - DNA, 22 bp, Artificial Sequence
  chemically synthesized
ccttgctatgttgtaaagcttt

SEQ ID NO: 1134724 - DNA, 22 bp, Artificial Sequence
  chemically synthesized
gctatgttgtaaagctttaata

SEQ ID NO: 1134725 - DNA, 22 bp, Artificial Sequence
  chemically synthesized
ctatgttgtaaagctttaataa

SEQ ID NO: 1134726 - DNA, 22 bp, Artificial Sequence
  chemically synthesized
tgttgtaaagctttaataaatg

SEQ ID NO: 1134727 - DNA, 22 bp, Artificial Sequence
  chemically synthesized
taaagctttaataaatggtagc

SEQ ID NO: 1134728 - DNA, 22 bp, Artificial Sequence
  chemically synthesized
tgaggtcataatagctaccatt

SEQ ID NO: 1134729 - DNA, 22 bp, Artificial Sequence
  chemically synthesized
taataaatggtagctattatga

SEQ ID NO: 1134730 - DNA, 22 bp, Artificial Sequence
  chemically synthesized
aataaatggtagctattatgac

SEQ ID NO: 1134731 - DNA, 22 bp, Artificial Sequence
  chemically synthesized
ataaatggtagctattatgacc

SEQ ID NO: 1134732 - DNA, 22 bp, Artificial Sequence
  chemically synthesized
gggccattgtgaggtcataata

SEQ ID NO: 1134733 - DNA, 22 bp, Artificial Sequence
  chemically synthesized
agggccattgtgaggtcataat

SEQ ID NO: 1134734 - DNA, 22 bp, Artificial Sequence
  chemically synthesized
ttagggccattgtgaggtcata

SEQ ID NO: 1134735 - DNA, 22 bp, Artificial Sequence
  chemically synthesized
ctcttagggccattgtgaggtc

SEQ ID NO: 1134736 - DNA, 22 bp, Artificial Sequence
  chemically synthesized
actcttagggccattgtgaggt

SEQ ID NO: 1134737 - DNA, 22 bp, Artificial Sequence
  chemically synthesized
gtacttactcttagggccattg

SEQ ID NO: 1134738 - DNA, 22 bp, Artificial Sequence
  chemically synthesized
ttatgacctcacaatggcccta

SEQ ID NO: 1134739 - DNA, 22 bp, Artificial Sequence
  chemically synthesized
tgacctcacaatggccctaaga

SEQ ID NO: 1134740 - DNA, 22 bp, Artificial Sequence
  chemically synthesized
acaatggccctaagagtaagta

SEQ ID NO: 1134741 - DNA, 22 bp, Artificial Sequence
  chemically synthesized
taaaataggaataatattagta

SEQ ID NO: 1134742 - DNA, 22 bp, Artificial Sequence
  chemically synthesized
agagtaagtactaatattattc

SEQ ID NO: 1134743 - DNA, 22 bp, Artificial Sequence
  chemically synthesized
atctataaaataggaataatat

SEQ ID NO: 1134744 - DNA, 22 bp, Artificial Sequence
  chemically synthesized
catctataaaataggaataata

SEQ ID NO: 1134745 - DNA, 22 bp, Artificial Sequence
  chemically synthesized
tcatctataaaataggaataat

SEQ ID NO: 1134746 - DNA, 22 bp, Artificial Sequence
  chemically synthesized
atattattcctattttatagat

SEQ ID NO: 1134747 - DNA, 22 bp, Artificial Sequence
  chemically synthesized
aacaaggtcactttcatctata

SEQ ID NO: 1134748 - DNA, 22 bp, Artificial Sequence
  chemically synthesized
ttcctattttatagatgaaagt

SEQ ID NO: 1134749 - DNA, 22 bp, Artificial Sequence
  chemically synthesized
cctcaacaaggtcactttcatc

SEQ ID NO: 1134750 - DNA, 22 bp, Artificial Sequence
  chemically synthesized
ctattttatagatgaaagtgac

SEQ ID NO: 1134751 - DNA, 22 bp, Artificial Sequence
  chemically synthesized
tctgcctcaacaaggtcacttt

SEQ ID NO: 1134752 - DNA, 22 bp, Artificial Sequence
  chemically synthesized
ttttatagatgaaagtgacctt

SEQ ID NO: 1134753 - DNA, 22 bp, Artificial Sequence
  chemically synthesized
atctgcctcaacaaggtcactt

SEQ ID NO: 1134754 - DNA, 22 bp, Artificial Sequence
  chemically synthesized
tatctgcctcaacaaggtcact

SEQ ID NO: 1134755 - DNA, 22 bp, Artificial Sequence
  chemically synthesized
tatagatgaaagtgaccttgtt

SEQ ID NO: 1134756 - DNA, 22 bp, Artificial Sequence
  chemically synthesized
atagatgaaagtgaccttgttg

SEQ ID NO: 1134757 - DNA, 22 bp, Artificial Sequence
  chemically synthesized
tagatgaaagtgaccttgttga

SEQ ID NO: 1134758 - DNA, 22 bp, Artificial Sequence
  chemically synthesized
aaaagttttatctgcctcaaca

SEQ ID NO: 1134759 - DNA, 22 bp, Artificial Sequence
  chemically synthesized
ctaaaaagttttatctgcctca

SEQ ID NO: 1134760 - DNA, 22 bp, Artificial Sequence
  chemically synthesized
ctactaaaaagttttatctgcc

SEQ ID NO: 1134761 - DNA, 22 bp, Artificial Sequence
  chemically synthesized
gctactaaaaagttttatctgc

SEQ ID NO: 1134762 - DNA, 22 bp, Artificial Sequence
  chemically synthesized
tgctactaaaaagttttatctg

SEQ ID NO: 1134763 - DNA, 22 bp, Artificial Sequence
  chemically synthesized
gttgaggcagataaaacttttt

SEQ ID NO: 1134764 - DNA, 22 bp, Artificial Sequence
  chemically synthesized
tgctttgctactaaaaagtttt

SEQ ID NO: 1134765 - DNA, 22 bp, Artificial Sequence
  chemically synthesized
ttgaggcagataaaacttttta

SEQ ID NO: 1134766 - DNA, 22 bp, Artificial Sequence
  chemically synthesized
aggcagataaaactttttagta

SEQ ID NO: 1134767 - DNA, 22 bp, Artificial Sequence
  chemically synthesized
tatctatgctttgctactaaaa

SEQ ID NO: 1134768 - DNA, 22 bp, Artificial Sequence
  chemically synthesized
atatctatgctttgctactaaa

SEQ ID NO: 1134769 - DNA, 22 bp, Artificial Sequence
  chemically synthesized
gatttatatctatgctttgcta

SEQ ID NO: 1134770 - DNA, 22 bp, Artificial Sequence
  chemically synthesized
ggatttatatctatgctttgct

SEQ ID NO: 1134771 - DNA, 22 bp, Artificial Sequence
  chemically synthesized
tttagtagcaaagcatagatat

SEQ ID NO: 1134772 - DNA, 22 bp, Artificial Sequence
  chemically synthesized
agacttggatttatatctatgc

SEQ ID NO: 1134773 - DNA, 22 bp, Artificial Sequence
  chemically synthesized
ttagtagcaaagcatagatata

SEQ ID NO: 1134774 - DNA, 22 bp, Artificial Sequence
  chemically synthesized
tagtagcaaagcatagatataa

SEQ ID NO: 1134775 - DNA, 22 bp, Artificial Sequence
  chemically synthesized
agtagcaaagcatagatataaa

SEQ ID NO: 1134776 - DNA, 22 bp, Artificial Sequence
  chemically synthesized
gtagcaaagcatagatataaat

SEQ ID NO: 1134777 - DNA, 22 bp, Artificial Sequence
  chemically synthesized
gatgaatgaacattcagacttg

SEQ ID NO: 1134778 - DNA, 22 bp, Artificial Sequence
  chemically synthesized
ataagagttggatgaatgaaca

SEQ ID NO: 1134779 - DNA, 22 bp, Artificial Sequence
  chemically synthesized
aatgttcattcatccaactctt

SEQ ID NO: 1134780 - DNA, 22 bp, Artificial Sequence
  chemically synthesized
attcatccaactcttatcagct

SEQ ID NO: 1134781 - DNA, 22 bp, Artificial Sequence
  chemically synthesized
atccaactcttatcagctatgc

SEQ ID NO: 1134782 - DNA, 22 bp, Artificial Sequence
  chemically synthesized
ttatcagctatgctcacttgct

SEQ ID NO: 1134783 - DNA, 22 bp, Artificial Sequence
  chemically synthesized
atcagctatgctcacttgctcc

SEQ ID NO: 1134784 - DNA, 22 bp, Artificial Sequence
  chemically synthesized
tcagctatgctcacttgctcct

SEQ ID NO: 1134785 - DNA, 22 bp, Artificial Sequence
  chemically synthesized
aaaaaagtgtacaagtgtagga

SEQ ID NO: 1134786 - DNA, 22 bp, Artificial Sequence
  chemically synthesized
tgctcacttgctcctacacttg

SEQ ID NO: 1134787 - DNA, 22 bp, Artificial Sequence
  chemically synthesized
acttgctcctacacttgtacac

SEQ ID NO: 1134788 - DNA, 22 bp, Artificial Sequence
  chemically synthesized
gctcctacacttgtacactttt

SEQ ID NO: 1134789 - DNA, 22 bp, Artificial Sequence
  chemically synthesized
ctcctacacttgtacacttttt

SEQ ID NO: 1134790 - DNA, 22 bp, Artificial Sequence
  chemically synthesized
ctacacttgtacacttttttga

SEQ ID NO: 1134791 - DNA, 22 bp, Artificial Sequence
  chemically synthesized
cacttgtacacttttttgaatg

SEQ ID NO: 1134792 - DNA, 22 bp, Artificial Sequence
  chemically synthesized
aaaggaaaccaccattcaaaaa

SEQ ID NO: 1134793 - DNA, 22 bp, Artificial Sequence
  chemically synthesized
aaaaggaaaccaccattcaaaa

SEQ ID NO: 1134794 - DNA, 22 bp, Artificial Sequence
  chemically synthesized
gtacacttttttgaatggtggt

SEQ ID NO: 1134795 - DNA, 22 bp, Artificial Sequence
  chemically synthesized
tacacttttttgaatggtggtt

SEQ ID NO: 1134796 - DNA, 22 bp, Artificial Sequence
  chemically synthesized
ttttgaatggtggtttcctttt

SEQ ID NO: 1134797 - DNA, 22 bp, Artificial Sequence
  chemically synthesized
tttgaatggtggtttcctttta

SEQ ID NO: 1134798 - DNA, 22 bp, Artificial Sequence
  chemically synthesized
ttgaatggtggtttccttttaa

SEQ ID NO: 1134799 - DNA, 22 bp, Artificial Sequence
  chemically synthesized
tgaatggtggtttccttttaag

SEQ ID NO: 1134800 - DNA, 22 bp, Artificial Sequence
  chemically synthesized
gaatggtggtttccttttaagg

SEQ ID NO: 1134801 - DNA, 22 bp, Artificial Sequence
  chemically synthesized
aatggtggtttccttttaaggg

SEQ ID NO: 1134802 - DNA, 22 bp, Artificial Sequence
  chemically synthesized
ccttttaaggggtgtgtatttg

SEQ ID NO: 1134803 - DNA, 22 bp, Artificial Sequence
  chemically synthesized
cttttaaggggtgtgtatttgt

SEQ ID NO: 1134804 - DNA, 22 bp, Artificial Sequence
  chemically synthesized
ttaaggggtgtgtatttgtatg

SEQ ID NO: 1134805 - DNA, 22 bp, Artificial Sequence
  chemically synthesized
taaggggtgtgtatttgtatgc

SEQ ID NO: 1134806 - DNA, 22 bp, Artificial Sequence
  chemically synthesized
aaggggtgtgtatttgtatgca

SEQ ID NO: 1134807 - DNA, 22 bp, Artificial Sequence
  chemically synthesized
aggggtgtgtatttgtatgcat

SEQ ID NO: 1134808 - DNA, 22 bp, Artificial Sequence
  chemically synthesized
tatatgtgtgtgtatgcataca

SEQ ID NO: 1134809 - DNA, 22 bp, Artificial Sequence
  chemically synthesized
atatatgtgtgtgtatgcatac

SEQ ID NO: 1134810 - DNA, 22 bp, Artificial Sequence
  chemically synthesized
aatttatatatgtgtgtgtatg

SEQ ID NO: 1134811 - DNA, 22 bp, Artificial Sequence
  chemically synthesized
tgaatttatatatgtgtgtgta

SEQ ID NO: 1134812 - DNA, 22 bp, Artificial Sequence
  chemically synthesized
gtatgcatacacacacatatat

SEQ ID NO: 1134813 - DNA, 22 bp, Artificial Sequence
  chemically synthesized
tatgcatacacacacatatata

SEQ ID NO: 1134814 - DNA, 22 bp, Artificial Sequence
  chemically synthesized
agtattctgaatttatatatgt

SEQ ID NO: 1134815 - DNA, 22 bp, Artificial Sequence
  chemically synthesized
cagtattctgaatttatatatg

SEQ ID NO: 1134816 - DNA, 22 bp, Artificial Sequence
  chemically synthesized
caatttcagtattctgaattta

SEQ ID NO: 1134817 - DNA, 22 bp, Artificial Sequence
  chemically synthesized
acaatttcagtattctgaattt

SEQ ID NO: 1134818 - DNA, 22 bp, Artificial Sequence
  chemically synthesized
tttacaatttcagtattctgaa

SEQ ID NO: 1134819 - DNA, 22 bp, Artificial Sequence
  chemically synthesized
tgatgtgccattgtttacaatt

SEQ ID NO: 1134820 - DNA, 22 bp, Artificial Sequence
  chemically synthesized
agaatactgaaattgtaaacaa

SEQ ID NO: 1134821 - DNA, 22 bp, Artificial Sequence
  chemically synthesized
aaattgtaaacaatggcacatc

SEQ ID NO: 1134822 - DNA, 22 bp, Artificial Sequence
  chemically synthesized
tataatagttatgatgtgccat

SEQ ID NO: 1134823 - DNA, 22 bp, Artificial Sequence
  chemically synthesized
ctatataatagttatgatgtgc

SEQ ID NO: 1134824 - DNA, 22 bp, Artificial Sequence
  chemically synthesized
cctatataatagttatgatgtg

SEQ ID NO: 1134825 - DNA, 22 bp, Artificial Sequence
  chemically synthesized
taaacaatggcacatcataact

SEQ ID NO: 1134826 - DNA, 22 bp, Artificial Sequence
  chemically synthesized
ttcctatataatagttatgatg

SEQ ID NO: 1134827 - DNA, 22 bp, Artificial Sequence
  chemically synthesized
agtaattcttcctatataatag

SEQ ID NO: 1134828 - DNA, 22 bp, Artificial Sequence
  chemically synthesized
acattgagtaattcttcctata

SEQ ID NO: 1134829 - DNA, 22 bp, Artificial Sequence
  chemically synthesized
aacattgagtaattcttcctat

SEQ ID NO: 1134830 - DNA, 22 bp, Artificial Sequence
  chemically synthesized
ttatataggaagaattactcaa

SEQ ID NO: 1134831 - DNA, 22 bp, Artificial Sequence
  chemically synthesized
tataggaagaattactcaatgt

SEQ ID NO: 1134832 - DNA, 22 bp, Artificial Sequence
  chemically synthesized
ctcaatgttaaatatgtttggc

SEQ ID NO: 1134833 - DNA, 22 bp, Artificial Sequence
  chemically synthesized
aatgttaaatatgtttggctct

SEQ ID NO: 1134834 - DNA, 22 bp, Artificial Sequence
  chemically synthesized
aatatagcatgtcaagagccaa

SEQ ID NO: 1134835 - DNA, 22 bp, Artificial Sequence
  chemically synthesized
caatatagcatgtcaagagcca

SEQ ID NO: 1134836 - DNA, 22 bp, Artificial Sequence
  chemically synthesized
aatatgtttggctcttgacatg

SEQ ID NO: 1134837 - DNA, 22 bp, Artificial Sequence
  chemically synthesized
cacagatttcaatatagcatgt

SEQ ID NO: 1134838 - DNA, 22 bp, Artificial Sequence
  chemically synthesized
gcacagatttcaatatagcatg

SEQ ID NO: 1134839 - DNA, 22 bp, Artificial Sequence
  chemically synthesized
tgcacagatttcaatatagcat

SEQ ID NO: 1134840 - DNA, 22 bp, Artificial Sequence
  chemically synthesized
ggctcttgacatgctatattga

SEQ ID NO: 1134841 - DNA, 22 bp, Artificial Sequence
  chemically synthesized
gctcttgacatgctatattgaa

SEQ ID NO: 1134842 - DNA, 22 bp, Artificial Sequence
  chemically synthesized
attttgcacagatttcaatata

SEQ ID NO: 1134843 - DNA, 22 bp, Artificial Sequence
  chemically synthesized
ttgacatgctatattgaaatct

SEQ ID NO: 1134844 - DNA, 22 bp, Artificial Sequence
  chemically synthesized
actaattttgcacagatttcaa

SEQ ID NO: 1134845 - DNA, 22 bp, Artificial Sequence
  chemically synthesized
gacatgctatattgaaatctgt

SEQ ID NO: 1134846 - DNA, 22 bp, Artificial Sequence
  chemically synthesized
gactaattttgcacagatttca

SEQ ID NO: 1134847 - DNA, 22 bp, Artificial Sequence
  chemically synthesized
acatgctatattgaaatctgtg

SEQ ID NO: 1134848 - DNA, 22 bp, Artificial Sequence
  chemically synthesized
tgactaattttgcacagatttc

SEQ ID NO: 1134849 - DNA, 22 bp, Artificial Sequence
  chemically synthesized
tattgaaatctgtgcaaaatta

SEQ ID NO: 1134850 - DNA, 22 bp, Artificial Sequence
  chemically synthesized
aaatctgtgcaaaattagtcaa

SEQ ID NO: 1134851 - DNA, 22 bp, Artificial Sequence
  chemically synthesized
tgtgtgtgtagtgtattttgac

SEQ ID NO: 1134852 - DNA, 22 bp, Artificial Sequence
  chemically synthesized
tgcaaaattagtcaaaatacac

SEQ ID NO: 1134853 - DNA, 22 bp, Artificial Sequence
  chemically synthesized
attgtgtgtgtgtagtgtattt

SEQ ID NO: 1134854 - DNA, 22 bp, Artificial Sequence
  chemically synthesized
gtcaaaatacactacacacaca

SEQ ID NO: 1134855 - DNA, 22 bp, Artificial Sequence
  chemically synthesized
tcaacctgattgtgtgtgtgta

SEQ ID NO: 1134856 - DNA, 22 bp, Artificial Sequence
  chemically synthesized
atccacagttgtcaacctgatt

SEQ ID NO: 1134857 - DNA, 22 bp, Artificial Sequence
  chemically synthesized
gatccacagttgtcaacctgat

SEQ ID NO: 1134858 - DNA, 22 bp, Artificial Sequence
  chemically synthesized
cacacacacaatcaggttgaca

SEQ ID NO: 1134859 - DNA, 22 bp, Artificial Sequence
  chemically synthesized
acaactgtggatcaaggctttt

SEQ ID NO: 1134860 - DNA, 22 bp, Artificial Sequence
  chemically synthesized
tggatcaaggcttttcattgcg

SEQ ID NO: 1134861 - DNA, 22 bp, Artificial Sequence
  chemically synthesized
catatacatagacagacaacgc

SEQ ID NO: 1134862 - DNA, 22 bp, Artificial Sequence
  chemically synthesized
ttcattgcgttgtctgtctatg

SEQ ID NO: 1134863 - DNA, 22 bp, Artificial Sequence
  chemically synthesized
tcattgcgttgtctgtctatgt

SEQ ID NO: 1134864 - DNA, 22 bp, Artificial Sequence
  chemically synthesized
cattgcgttgtctgtctatgta

SEQ ID NO: 1134865 - DNA, 22 bp, Artificial Sequence
  chemically synthesized
attgcgttgtctgtctatgtat

SEQ ID NO: 1134866 - DNA, 22 bp, Artificial Sequence
  chemically synthesized
caaagggttacatatacataga

SEQ ID NO: 1134867 - DNA, 22 bp, Artificial Sequence
  chemically synthesized
cgttgtctgtctatgtatatgt

SEQ ID NO: 1134868 - DNA, 22 bp, Artificial Sequence
  chemically synthesized
atcactccaaagggttacatat

SEQ ID NO: 1134869 - DNA, 22 bp, Artificial Sequence
  chemically synthesized
tctgtctatgtatatgtaaccc

SEQ ID NO: 1134870 - DNA, 22 bp, Artificial Sequence
  chemically synthesized
ttgatcactccaaagggttaca

SEQ ID NO: 1134871 - DNA, 22 bp, Artificial Sequence
  chemically synthesized
attgatcactccaaagggttac

SEQ ID NO: 1134872 - DNA, 22 bp, Artificial Sequence
  chemically synthesized
tctatgtatatgtaaccctttg

SEQ ID NO: 1134873 - DNA, 22 bp, Artificial Sequence
  chemically synthesized
tgtatatgtaaccctttggagt

SEQ ID NO: 1134874 - DNA, 22 bp, Artificial Sequence
  chemically synthesized
aaacttattgatcactccaaag

SEQ ID NO: 1134875 - DNA, 22 bp, Artificial Sequence
  chemically synthesized
catgcccattaaaacttattga

SEQ ID NO: 1134876 - DNA, 22 bp, Artificial Sequence
  chemically synthesized
ctccatgcccattaaaacttat

SEQ ID NO: 1134877 - DNA, 22 bp, Artificial Sequence
  chemically synthesized
tggagtgatcaataagttttaa

SEQ ID NO: 1134878 - DNA, 22 bp, Artificial Sequence
  chemically synthesized
ggagtgatcaataagttttaat

SEQ ID NO: 1134879 - DNA, 22 bp, Artificial Sequence
  chemically synthesized
gagtgatcaataagttttaatg

SEQ ID NO: 1134880 - DNA, 22 bp, Artificial Sequence
  chemically synthesized
cagaagtgcaattcctccatgc

SEQ ID NO: 1134881 - DNA, 22 bp, Artificial Sequence
  chemically synthesized
aactgcagaagtgcaattcctc

SEQ ID NO: 1134882 - DNA, 22 bp, Artificial Sequence
  chemically synthesized
taatgggcatggaggaattgca

SEQ ID NO: 1134883 - DNA, 22 bp, Artificial Sequence
  chemically synthesized
aaactgcagaagtgcaattcct

SEQ ID NO: 1134884 - DNA, 22 bp, Artificial Sequence
  chemically synthesized
aatgggcatggaggaattgcac

SEQ ID NO: 1134885 - DNA, 22 bp, Artificial Sequence
  chemically synthesized
taaactgcagaagtgcaattcc

SEQ ID NO: 1134886 - DNA, 22 bp, Artificial Sequence
  chemically synthesized
atgggcatggaggaattgcact

SEQ ID NO: 1134887 - DNA, 22 bp, Artificial Sequence
  chemically synthesized
tgcagtatgttttaaactgcag

SEQ ID NO: 1134888 - DNA, 22 bp, Artificial Sequence
  chemically synthesized
tgattatgcagtatgttttaaa

SEQ ID NO: 1134889 - DNA, 22 bp, Artificial Sequence
  chemically synthesized
cacttctgcagtttaaaacata

SEQ ID NO: 1134890 - DNA, 22 bp, Artificial Sequence
  chemically synthesized
ctatgattatgcagtatgtttt

SEQ ID NO: 1134891 - DNA, 22 bp, Artificial Sequence
  chemically synthesized
ctgcagtttaaaacatactgca

SEQ ID NO: 1134892 - DNA, 22 bp, Artificial Sequence
  chemically synthesized
ttgctatgattatgcagtatgt

SEQ ID NO: 1134893 - DNA, 22 bp, Artificial Sequence
  chemically synthesized
tgcagtttaaaacatactgcat

SEQ ID NO: 1134894 - DNA, 22 bp, Artificial Sequence
  chemically synthesized
cagtttaaaacatactgcataa

SEQ ID NO: 1134895 - DNA, 22 bp, Artificial Sequence
  chemically synthesized
aagctgttgctatgattatgca

SEQ ID NO: 1134896 - DNA, 22 bp, Artificial Sequence
  chemically synthesized
aaaacatactgcataatcatag

SEQ ID NO: 1134897 - DNA, 22 bp, Artificial Sequence
  chemically synthesized
aaacatactgcataatcatagc

SEQ ID NO: 1134898 - DNA, 22 bp, Artificial Sequence
  chemically synthesized
tctaaagctgttgctatgatta

SEQ ID NO: 1134899 - DNA, 22 bp, Artificial Sequence
  chemically synthesized
ttatctaaagctgttgctatga

SEQ ID NO: 1134900 - DNA, 22 bp, Artificial Sequence
  chemically synthesized
cataatcatagcaacagcttta

SEQ ID NO: 1134901 - DNA, 22 bp, Artificial Sequence
  chemically synthesized
tcaattattatctaaagctgtt

SEQ ID NO: 1134902 - DNA, 22 bp, Artificial Sequence
  chemically synthesized
agcatggctatcaattattatc

SEQ ID NO: 1134903 - DNA, 22 bp, Artificial Sequence
  chemically synthesized
aagcatggctatcaattattat

SEQ ID NO: 1134904 - DNA, 22 bp, Artificial Sequence
  chemically synthesized
taagcatggctatcaattatta

SEQ ID NO: 1134905 - DNA, 22 bp, Artificial Sequence
  chemically synthesized
ttaagcatggctatcaattatt

SEQ ID NO: 1134906 - DNA, 22 bp, Artificial Sequence
  chemically synthesized
gtttttaagcatggctatcaat

SEQ ID NO: 1134907 - DNA, 22 bp, Artificial Sequence
  chemically synthesized
tagataataattgatagccatg

SEQ ID NO: 1134908 - DNA, 22 bp, Artificial Sequence
  chemically synthesized
agataataattgatagccatgc

SEQ ID NO: 1134909 - DNA, 22 bp, Artificial Sequence
  chemically synthesized
gataataattgatagccatgct

SEQ ID NO: 1134910 - DNA, 22 bp, Artificial Sequence
  chemically synthesized
tggagttggtttttaagcatgg

SEQ ID NO: 1134911 - DNA, 22 bp, Artificial Sequence
  chemically synthesized
atagccatgcttaaaaaccaac

SEQ ID NO: 1134912 - DNA, 22 bp, Artificial Sequence
  chemically synthesized
ccatgcctgtggagttggtttt

SEQ ID NO: 1134913 - DNA, 22 bp, Artificial Sequence
  chemically synthesized
tgctaccatgcctgtggagttg

SEQ ID NO: 1134914 - DNA, 22 bp, Artificial Sequence
  chemically synthesized
gtgctaccatgcctgtggagtt

SEQ ID NO: 1134915 - DNA, 22 bp, Artificial Sequence
  chemically synthesized
aaaaaccaactccacaggcatg

SEQ ID NO: 1134916 - DNA, 22 bp, Artificial Sequence
  chemically synthesized
aaaaccaactccacaggcatgg

SEQ ID NO: 1134917 - DNA, 22 bp, Artificial Sequence
  chemically synthesized
tgccttgtgctaccatgcctgt

SEQ ID NO: 1134918 - DNA, 22 bp, Artificial Sequence
  chemically synthesized
gtgccttgtgctaccatgcctg

SEQ ID NO: 1134919 - DNA, 22 bp, Artificial Sequence
  chemically synthesized
tgtgccttgtgctaccatgcct

SEQ ID NO: 1134920 - DNA, 22 bp, Artificial Sequence
  chemically synthesized
ttgtgccttgtgctaccatgcc

SEQ ID NO: 1134921 - DNA, 22 bp, Artificial Sequence
  chemically synthesized
cacaggcatggtagcacaaggc

SEQ ID NO: 1134922 - DNA, 22 bp, Artificial Sequence
  chemically synthesized
ccagatttttgtgccttgtgct

SEQ ID NO: 1134923 - DNA, 22 bp, Artificial Sequence
  chemically synthesized
accagatttttgtgccttgtgc

SEQ ID NO: 1134924 - DNA, 22 bp, Artificial Sequence
  chemically synthesized
taccagatttttgtgccttgtg

SEQ ID NO: 1134925 - DNA, 22 bp, Artificial Sequence
  chemically synthesized
gagatgcaaatctttaccagat

SEQ ID NO: 1134926 - DNA, 22 bp, Artificial Sequence
  chemically synthesized
agagatgcaaatctttaccaga

SEQ ID NO: 1134927 - DNA, 22 bp, Artificial Sequence
  chemically synthesized
cttagagatgcaaatctttacc

SEQ ID NO: 1134928 - DNA, 22 bp, Artificial Sequence
  chemically synthesized
gcttagagatgcaaatctttac

SEQ ID NO: 1134929 - DNA, 22 bp, Artificial Sequence
  chemically synthesized
tgcttagagatgcaaatcttta

SEQ ID NO: 1134930 - DNA, 22 bp, Artificial Sequence
  chemically synthesized
ttgcttagagatgcaaatcttt

SEQ ID NO: 1134931 - DNA, 22 bp, Artificial Sequence
  chemically synthesized
ttttgcttagagatgcaaatct

SEQ ID NO: 1134932 - DNA, 22 bp, Artificial Sequence
  chemically synthesized
cttttgcttagagatgcaaatc

SEQ ID NO: 1134933 - DNA, 22 bp, Artificial Sequence
  chemically synthesized
tcttttgcttagagatgcaaat

SEQ ID NO: 1134934 - DNA, 22 bp, Artificial Sequence
  chemically synthesized
gtaaagatttgcatctctaagc

SEQ ID NO: 1134935 - DNA, 22 bp, Artificial Sequence
  chemically synthesized
aacatataaatattttcttttg

SEQ ID NO: 1134936 - DNA, 22 bp, Artificial Sequence
  chemically synthesized
gcatctctaagcaaaagaaaat

SEQ ID NO: 1134937 - DNA, 22 bp, Artificial Sequence
  chemically synthesized
catctctaagcaaaagaaaata

SEQ ID NO: 1134938 - DNA, 22 bp, Artificial Sequence
  chemically synthesized
taagcaaaagaaaatatttata

SEQ ID NO: 1134939 - DNA, 22 bp, Artificial Sequence
  chemically synthesized
ccaaagttcaacatataaatat

SEQ ID NO: 1134940 - DNA, 22 bp, Artificial Sequence
  chemically synthesized
agcaaaagaaaatatttatatg

SEQ ID NO: 1134941 - DNA, 22 bp, Artificial Sequence
  chemically synthesized
tcccaaagttcaacatataaat

SEQ ID NO: 1134942 - DNA, 22 bp, Artificial Sequence
  chemically synthesized
cccaaggattctcccaaagttc

SEQ ID NO: 1134943 - DNA, 22 bp, Artificial Sequence
  chemically synthesized
gcccaaggattctcccaaagtt

SEQ ID NO: 1134944 - DNA, 22 bp, Artificial Sequence
  chemically synthesized
tgcccaaggattctcccaaagt

SEQ ID NO: 1134945 - DNA, 22 bp, Artificial Sequence
  chemically synthesized
ttgcccaaggattctcccaaag

SEQ ID NO: 1134946 - DNA, 22 bp, Artificial Sequence
  chemically synthesized
atatgttgaactttgggagaat

SEQ ID NO: 1134947 - DNA, 22 bp, Artificial Sequence
  chemically synthesized
tatgttgaactttgggagaatc

SEQ ID NO: 1134948 - DNA, 22 bp, Artificial Sequence
  chemically synthesized
atcttttgcccaaggattctcc

SEQ ID NO: 1134949 - DNA, 22 bp, Artificial Sequence
  chemically synthesized
aactttgggagaatccttgggc

SEQ ID NO: 1134950 - DNA, 22 bp, Artificial Sequence
  chemically synthesized
tgggagaatccttgggcaaaag

SEQ ID NO: 1134951 - DNA, 22 bp, Artificial Sequence
  chemically synthesized
tgaccatctgatcttttgccca

SEQ ID NO: 1134952 - DNA, 22 bp, Artificial Sequence
  chemically synthesized
gggagaatccttgggcaaaaga

SEQ ID NO: 1134953 - DNA, 22 bp, Artificial Sequence
  chemically synthesized
gtgaccatctgatcttttgccc

SEQ ID NO: 1134954 - DNA, 22 bp, Artificial Sequence
  chemically synthesized
ggagaatccttgggcaaaagat

SEQ ID NO: 1134955 - DNA, 22 bp, Artificial Sequence
  chemically synthesized
tgtgaccatctgatcttttgcc

SEQ ID NO: 1134956 - DNA, 22 bp, Artificial Sequence
  chemically synthesized
ctttgtgaccatctgatctttt

SEQ ID NO: 1134957 - DNA, 22 bp, Artificial Sequence
  chemically synthesized
cctttgtgaccatctgatcttt

SEQ ID NO: 1134958 - DNA, 22 bp, Artificial Sequence
  chemically synthesized
agcttcctttgtgaccatctga

SEQ ID NO: 1134959 - DNA, 22 bp, Artificial Sequence
  chemically synthesized
gggcaaaagatcagatggtcac

SEQ ID NO: 1134960 - DNA, 22 bp, Artificial Sequence
  chemically synthesized
ggcaaaagatcagatggtcaca

SEQ ID NO: 1134961 - DNA, 22 bp, Artificial Sequence
  chemically synthesized
gtaactcagcttcctttgtgac

SEQ ID NO: 1134962 - DNA, 22 bp, Artificial Sequence
  chemically synthesized
tgattagtaactcagcttcctt

SEQ ID NO: 1134963 - DNA, 22 bp, Artificial Sequence
  chemically synthesized
gtgattagtaactcagcttcct

SEQ ID NO: 1134964 - DNA, 22 bp, Artificial Sequence
  chemically synthesized
catccttgtgattagtaactca

SEQ ID NO: 1134965 - DNA, 22 bp, Artificial Sequence
  chemically synthesized
acatccttgtgattagtaactc

SEQ ID NO: 1134966 - DNA, 22 bp, Artificial Sequence
  chemically synthesized
tacatccttgtgattagtaact

SEQ ID NO: 1134967 - DNA, 22 bp, Artificial Sequence
  chemically synthesized
agttactaatcacaaggatgta

SEQ ID NO: 1134968 - DNA, 22 bp, Artificial Sequence
  chemically synthesized
ataagataaagcattttacatc

SEQ ID NO: 1134969 - DNA, 22 bp, Artificial Sequence
  chemically synthesized
ctaatcacaaggatgtaaaatg

SEQ ID NO: 1134970 - DNA, 22 bp, Artificial Sequence
  chemically synthesized
cataagataaagcattttacat

SEQ ID NO: 1134971 - DNA, 22 bp, Artificial Sequence
  chemically synthesized
atcacaaggatgtaaaatgctt

SEQ ID NO: 1134972 - DNA, 22 bp, Artificial Sequence
  chemically synthesized
tacttcataagataaagcattt

SEQ ID NO: 1134973 - DNA, 22 bp, Artificial Sequence
  chemically synthesized
tatacttcataagataaagcat

SEQ ID NO: 1134974 - DNA, 22 bp, Artificial Sequence
  chemically synthesized
tgggaagtcctctatacttcat

SEQ ID NO: 1134975 - DNA, 22 bp, Artificial Sequence
  chemically synthesized
agctatgggaagtcctctatac

SEQ ID NO: 1134976 - DNA, 22 bp, Artificial Sequence
  chemically synthesized
tatcttatgaagtatagaggac

SEQ ID NO: 1134977 - DNA, 22 bp, Artificial Sequence
  chemically synthesized
atcttatgaagtatagaggact

SEQ ID NO: 1134978 - DNA, 22 bp, Artificial Sequence
  chemically synthesized
tcttatgaagtatagaggactt

SEQ ID NO: 1134979 - DNA, 22 bp, Artificial Sequence
  chemically synthesized
cattcagctatgggaagtcctc

SEQ ID NO: 1134980 - DNA, 22 bp, Artificial Sequence
  chemically synthesized
atgaagtatagaggacttccca

SEQ ID NO: 1134981 - DNA, 22 bp, Artificial Sequence
  chemically synthesized
tgaagtatagaggacttcccat

SEQ ID NO: 1134982 - DNA, 22 bp, Artificial Sequence
  chemically synthesized
tatgctacattcagctatggga

SEQ ID NO: 1134983 - DNA, 22 bp, Artificial Sequence
  chemically synthesized
attgtatgctacattcagctat

SEQ ID NO: 1134984 - DNA, 22 bp, Artificial Sequence
  chemically synthesized
gcactcattgtatgctacattc

SEQ ID NO: 1134985 - DNA, 22 bp, Artificial Sequence
  chemically synthesized
ggcactcattgtatgctacatt

SEQ ID NO: 1134986 - DNA, 22 bp, Artificial Sequence
  chemically synthesized
tggcactcattgtatgctacat

SEQ ID NO: 1134987 - DNA, 22 bp, Artificial Sequence
  chemically synthesized
cccatagctgaatgtagcatac

SEQ ID NO: 1134988 - DNA, 22 bp, Artificial Sequence
  chemically synthesized
ccatagctgaatgtagcataca

SEQ ID NO: 1134989 - DNA, 22 bp, Artificial Sequence
  chemically synthesized
aactttggcactcattgtatgc

SEQ ID NO: 1134990 - DNA, 22 bp, Artificial Sequence
  chemically synthesized
tcctgaactttggcactcattg

SEQ ID NO: 1134991 - DNA, 22 bp, Artificial Sequence
  chemically synthesized
aatgtagcatacaatgagtgcc

SEQ ID NO: 1134992 - DNA, 22 bp, Artificial Sequence
  chemically synthesized
ctgtcctgaactttggcactca

SEQ ID NO: 1134993 - DNA, 22 bp, Artificial Sequence
  chemically synthesized
ccaggctactgtcctgaacttt

SEQ ID NO: 1134994 - DNA, 22 bp, Artificial Sequence
  chemically synthesized
gttaccaggctactgtcctgaa

SEQ ID NO: 1134995 - DNA, 22 bp, Artificial Sequence
  chemically synthesized
agttaccaggctactgtcctga

SEQ ID NO: 1134996 - DNA, 22 bp, Artificial Sequence
  chemically synthesized
tagttaccaggctactgtcctg

SEQ ID NO: 1134997 - DNA, 22 bp, Artificial Sequence
  chemically synthesized
atagtaaattttagttaccagg

SEQ ID NO: 1134998 - DNA, 22 bp, Artificial Sequence
  chemically synthesized
aggacagtagcctggtaactaa

SEQ ID NO: 1134999 - DNA, 22 bp, Artificial Sequence
  chemically synthesized
cagtaattaatagtaaatttta

SEQ ID NO: 1135000 - DNA, 22 bp, Artificial Sequence
  chemically synthesized
attacagtaattaatagtaaat

SEQ ID NO: 1135001 - DNA, 22 bp, Artificial Sequence
  chemically synthesized
gtaactaaaatttactattaat

SEQ ID NO: 1135002 - DNA, 22 bp, Artificial Sequence
  chemically synthesized
aaatttactattaattactgta

SEQ ID NO: 1135003 - DNA, 22 bp, Artificial Sequence
  chemically synthesized
taataataaattaattacagta

SEQ ID NO: 1135004 - DNA, 22 bp, Artificial Sequence
  chemically synthesized
actattaattactgtaattaat

SEQ ID NO: 1135005 - DNA, 22 bp, Artificial Sequence
  chemically synthesized
ttgtaataataaattaattaca

SEQ ID NO: 1135006 - DNA, 22 bp, Artificial Sequence
  chemically synthesized
ctattaattactgtaattaatt

SEQ ID NO: 1135007 - DNA, 22 bp, Artificial Sequence
  chemically synthesized
ttaattactgtaattaatttat

SEQ ID NO: 1135008 - DNA, 22 bp, Artificial Sequence
  chemically synthesized
aattattgtaataataaattaa

SEQ ID NO: 1135009 - DNA, 22 bp, Artificial Sequence
  chemically synthesized
attactgtaattaatttattat

SEQ ID NO: 1135010 - DNA, 22 bp, Artificial Sequence
  chemically synthesized
ttaaattattgtaataataaat

SEQ ID NO: 1135011 - DNA, 22 bp, Artificial Sequence
  chemically synthesized
ctgtaattaatttattattaca

SEQ ID NO: 1135012 - DNA, 22 bp, Artificial Sequence
  chemically synthesized
ttattaaattattgtaataata

SEQ ID NO: 1135013 - DNA, 22 bp, Artificial Sequence
  chemically synthesized
taattaatttattattacaata

SEQ ID NO: 1135014 - DNA, 22 bp, Artificial Sequence
  chemically synthesized
aattattattaaattattgtaa

SEQ ID NO: 1135015 - DNA, 22 bp, Artificial Sequence
  chemically synthesized
atttattattacaataatttaa

SEQ ID NO: 1135016 - DNA, 22 bp, Artificial Sequence
  chemically synthesized
attattacaataatttaataat

SEQ ID NO: 1135017 - DNA, 22 bp, Artificial Sequence
  chemically synthesized
ttattacaataatttaataata

SEQ ID NO: 1135018 - DNA, 22 bp, Artificial Sequence
  chemically synthesized
atataaattaaattattattaa

SEQ ID NO: 1135019 - DNA, 22 bp, Artificial Sequence
  chemically synthesized
ttacaataatttaataataatt

SEQ ID NO: 1135020 - DNA, 22 bp, Artificial Sequence
  chemically synthesized
ttaatataaattaaattattat

SEQ ID NO: 1135021 - DNA, 22 bp, Artificial Sequence
  chemically synthesized
caataatttaataataatttaa

SEQ ID NO: 1135022 - DNA, 22 bp, Artificial Sequence
  chemically synthesized
attattaatataaattaaatta

SEQ ID NO: 1135023 - DNA, 22 bp, Artificial Sequence
  chemically synthesized
aataataatttaatttatatta

SEQ ID NO: 1135024 - DNA, 22 bp, Artificial Sequence
  chemically synthesized
ataataatttaatttatattaa

SEQ ID NO: 1135025 - DNA, 22 bp, Artificial Sequence
  chemically synthesized
cagtaataaattaattattaat

SEQ ID NO: 1135026 - DNA, 22 bp, Artificial Sequence
  chemically synthesized
acagtaataaattaattattaa

SEQ ID NO: 1135027 - DNA, 22 bp, Artificial Sequence
  chemically synthesized
aatttatattaataattaattt

SEQ ID NO: 1135028 - DNA, 22 bp, Artificial Sequence
  chemically synthesized
ccttacagtaataaattaatta

SEQ ID NO: 1135029 - DNA, 22 bp, Artificial Sequence
  chemically synthesized
atttatattaataattaattta

SEQ ID NO: 1135030 - DNA, 22 bp, Artificial Sequence
  chemically synthesized
ttaccttacagtaataaattaa

SEQ ID NO: 1135031 - DNA, 22 bp, Artificial Sequence
  chemically synthesized
attaccttacagtaataaatta

SEQ ID NO: 1135032 - DNA, 22 bp, Artificial Sequence
  chemically synthesized
atattaataattaatttattac

SEQ ID NO: 1135033 - DNA, 22 bp, Artificial Sequence
  chemically synthesized
tattaccttacagtaataaatt

SEQ ID NO: 1135034 - DNA, 22 bp, Artificial Sequence
  chemically synthesized
tattaataattaatttattact

SEQ ID NO: 1135035 - DNA, 22 bp, Artificial Sequence
  chemically synthesized
ataattaatttattactgtaag

SEQ ID NO: 1135036 - DNA, 22 bp, Artificial Sequence
  chemically synthesized
aagaaattttattaccttacag

SEQ ID NO: 1135037 - DNA, 22 bp, Artificial Sequence
  chemically synthesized
ttcaagaaattttattacctta

SEQ ID NO: 1135038 - DNA, 22 bp, Artificial Sequence
  chemically synthesized
atttattactgtaaggtaataa

SEQ ID NO: 1135039 - DNA, 22 bp, Artificial Sequence
  chemically synthesized
attcaagaaattttattacctt

SEQ ID NO: 1135040 - DNA, 22 bp, Artificial Sequence
  chemically synthesized
attactgtaaggtaataaaatt

SEQ ID NO: 1135041 - DNA, 22 bp, Artificial Sequence
  chemically synthesized
ttactgtaaggtaataaaattt

SEQ ID NO: 1135042 - DNA, 22 bp, Artificial Sequence
  chemically synthesized
ctgtaaggtaataaaatttctt

SEQ ID NO: 1135043 - DNA, 22 bp, Artificial Sequence
  chemically synthesized
taaggtaataaaatttcttgaa

SEQ ID NO: 1135044 - DNA, 22 bp, Artificial Sequence
  chemically synthesized
aatgtcagtacttattcaagaa

SEQ ID NO: 1135045 - DNA, 22 bp, Artificial Sequence
  chemically synthesized
caatgtcagtacttattcaaga

SEQ ID NO: 1135046 - DNA, 22 bp, Artificial Sequence
  chemically synthesized
atgatttcaatgtcagtactta

SEQ ID NO: 1135047 - DNA, 22 bp, Artificial Sequence
  chemically synthesized
ctcatgatttcaatgtcagtac

SEQ ID NO: 1135048 - DNA, 22 bp, Artificial Sequence
  chemically synthesized
gctcatgatttcaatgtcagta

SEQ ID NO: 1135049 - DNA, 22 bp, Artificial Sequence
  chemically synthesized
tgctcatgatttcaatgtcagt

SEQ ID NO: 1135050 - DNA, 22 bp, Artificial Sequence
  chemically synthesized
cttgaataagtactgacattga

SEQ ID NO: 1135051 - DNA, 22 bp, Artificial Sequence
  chemically synthesized
ttgaataagtactgacattgaa

SEQ ID NO: 1135052 - DNA, 22 bp, Artificial Sequence
  chemically synthesized
gaataagtactgacattgaaat

SEQ ID NO: 1135053 - DNA, 22 bp, Artificial Sequence
  chemically synthesized
aataagtactgacattgaaatc

SEQ ID NO: 1135054 - DNA, 22 bp, Artificial Sequence
  chemically synthesized
acaataattttgctcatgattt

SEQ ID NO: 1135055 - DNA, 22 bp, Artificial Sequence
  chemically synthesized
gacaataattttgctcatgatt

SEQ ID NO: 1135056 - DNA, 22 bp, Artificial Sequence
  chemically synthesized
acattgaaatcatgagcaaaat

SEQ ID NO: 1135057 - DNA, 22 bp, Artificial Sequence
  chemically synthesized
agtatttgacaataattttgct

SEQ ID NO: 1135058 - DNA, 22 bp, Artificial Sequence
  chemically synthesized
taagtatttgacaataattttg

SEQ ID NO: 1135059 - DNA, 22 bp, Artificial Sequence
  chemically synthesized
ctaagtatttgacaataatttt

SEQ ID NO: 1135060 - DNA, 22 bp, Artificial Sequence
  chemically synthesized
aaatcatgagcaaaattattgt

SEQ ID NO: 1135061 - DNA, 22 bp, Artificial Sequence
  chemically synthesized
tgatgccttctaagtatttgac

SEQ ID NO: 1135062 - DNA, 22 bp, Artificial Sequence
  chemically synthesized
atgatgccttctaagtatttga

SEQ ID NO: 1135063 - DNA, 22 bp, Artificial Sequence
  chemically synthesized
ttgtcaaatacttagaaggcat

SEQ ID NO: 1135064 - DNA, 22 bp, Artificial Sequence
  chemically synthesized
tcaaatacttagaaggcatcat

SEQ ID NO: 1135065 - DNA, 22 bp, Artificial Sequence
  chemically synthesized
gaagaaacaaatgacttatgat

SEQ ID NO: 1135066 - DNA, 22 bp, Artificial Sequence
  chemically synthesized
cgaagaaacaaatgacttatga

SEQ ID NO: 1135067 - DNA, 22 bp, Artificial Sequence
  chemically synthesized
tttcgaagaaacaaatgactta

SEQ ID NO: 1135068 - DNA, 22 bp, Artificial Sequence
  chemically synthesized
agaaggcatcataagtcatttg

SEQ ID NO: 1135069 - DNA, 22 bp, Artificial Sequence
  chemically synthesized
atttcgaagaaacaaatgactt

SEQ ID NO: 1135070 - DNA, 22 bp, Artificial Sequence
  chemically synthesized
gaaggcatcataagtcatttgt

SEQ ID NO: 1135071 - DNA, 22 bp, Artificial Sequence
  chemically synthesized
tcatataatatttatttcgaag

SEQ ID NO: 1135072 - DNA, 22 bp, Artificial Sequence
  chemically synthesized
attatcatataatatttatttc

SEQ ID NO: 1135073 - DNA, 22 bp, Artificial Sequence
  chemically synthesized
aattatcatataatatttattt

SEQ ID NO: 1135074 - DNA, 22 bp, Artificial Sequence
  chemically synthesized
ttaattatcatataatatttat

SEQ ID NO: 1135075 - DNA, 22 bp, Artificial Sequence
  chemically synthesized
gtttcttcgaaataaatattat

SEQ ID NO: 1135076 - DNA, 22 bp, Artificial Sequence
  chemically synthesized
cttaattatcatataatattta

SEQ ID NO: 1135077 - DNA, 22 bp, Artificial Sequence
  chemically synthesized
tttcttcgaaataaatattata

SEQ ID NO: 1135078 - DNA, 22 bp, Artificial Sequence
  chemically synthesized
cttcgaaataaatattatatga

SEQ ID NO: 1135079 - DNA, 22 bp, Artificial Sequence
  chemically synthesized
ttcgaaataaatattatatgat

SEQ ID NO: 1135080 - DNA, 22 bp, Artificial Sequence
  chemically synthesized
cgaaataaatattatatgataa

SEQ ID NO: 1135081 - DNA, 22 bp, Artificial Sequence
  chemically synthesized
gaaataaatattatatgataat

SEQ ID NO: 1135082 - DNA, 22 bp, Artificial Sequence
  chemically synthesized
cagaataaaccttcttaattat

SEQ ID NO: 1135083 - DNA, 22 bp, Artificial Sequence
  chemically synthesized
acagaataaaccttcttaatta

SEQ ID NO: 1135084 - DNA, 22 bp, Artificial Sequence
  chemically synthesized
tacagaataaaccttcttaatt

SEQ ID NO: 1135085 - DNA, 22 bp, Artificial Sequence
  chemically synthesized
tatgataattaagaaggtttat

SEQ ID NO: 1135086 - DNA, 22 bp, Artificial Sequence
  chemically synthesized
gacagacagttttacagaataa

SEQ ID NO: 1135087 - DNA, 22 bp, Artificial Sequence
  chemically synthesized
agaaggtttattctgtaaaact

SEQ ID NO: 1135088 - DNA, 22 bp, Artificial Sequence
  chemically synthesized
aattggacagacagttttacag

SEQ ID NO: 1135089 - DNA, 22 bp, Artificial Sequence
  chemically synthesized
attctgtaaaactgtctgtcca

SEQ ID NO: 1135090 - DNA, 22 bp, Artificial Sequence
  chemically synthesized
ttctgtaaaactgtctgtccaa

SEQ ID NO: 1135091 - DNA, 22 bp, Artificial Sequence
  chemically synthesized
tgtaaaactgtctgtccaattt

SEQ ID NO: 1135092 - DNA, 22 bp, Artificial Sequence
  chemically synthesized
taaaactgtctgtccaatttaa

SEQ ID NO: 1135093 - DNA, 22 bp, Artificial Sequence
  chemically synthesized
aaatgaggaacaaaatacatta

SEQ ID NO: 1135094 - DNA, 22 bp, Artificial Sequence
  chemically synthesized
tctgtccaatttaatgtatttt

SEQ ID NO: 1135095 - DNA, 22 bp, Artificial Sequence
  chemically synthesized
aaaatgaggaacaaaatacatt

SEQ ID NO: 1135096 - DNA, 22 bp, Artificial Sequence
  chemically synthesized
tccaatttaatgtattttgttc

SEQ ID NO: 1135097 - DNA, 22 bp, Artificial Sequence
  chemically synthesized
aagacaatttaaaatgaggaac

SEQ ID NO: 1135098 - DNA, 22 bp, Artificial Sequence
  chemically synthesized
aatgtattttgttcctcatttt

SEQ ID NO: 1135099 - DNA, 22 bp, Artificial Sequence
  chemically synthesized
atgtattttgttcctcatttta

SEQ ID NO: 1135100 - DNA, 22 bp, Artificial Sequence
  chemically synthesized
tactaaagacaatttaaaatga

SEQ ID NO: 1135101 - DNA, 22 bp, Artificial Sequence
  chemically synthesized
gtactaaagacaatttaaaatg

SEQ ID NO: 1135102 - DNA, 22 bp, Artificial Sequence
  chemically synthesized
tgttcctcattttaaattgtct

SEQ ID NO: 1135103 - DNA, 22 bp, Artificial Sequence
  chemically synthesized
gttcctcattttaaattgtctt

SEQ ID NO: 1135104 - DNA, 22 bp, Artificial Sequence
  chemically synthesized
ttcctcattttaaattgtcttt

SEQ ID NO: 1135105 - DNA, 22 bp, Artificial Sequence
  chemically synthesized
atacaatttgtactaaagacaa

SEQ ID NO: 1135106 - DNA, 22 bp, Artificial Sequence
  chemically synthesized
ctcattttaaattgtctttagt

SEQ ID NO: 1135107 - DNA, 22 bp, Artificial Sequence
  chemically synthesized
tgatacaatttgtactaaagac

SEQ ID NO: 1135108 - DNA, 22 bp, Artificial Sequence
  chemically synthesized
ctgatacaatttgtactaaaga

SEQ ID NO: 1135109 - DNA, 22 bp, Artificial Sequence
  chemically synthesized
attttaaattgtctttagtaca

SEQ ID NO: 1135110 - DNA, 22 bp, Artificial Sequence
  chemically synthesized
tctgatacaatttgtactaaag

SEQ ID NO: 1135111 - DNA, 22 bp, Artificial Sequence
  chemically synthesized
tttctgatacaatttgtactaa

SEQ ID NO: 1135112 - DNA, 22 bp, Artificial Sequence
  chemically synthesized
ctttctgatacaatttgtacta

SEQ ID NO: 1135113 - DNA, 22 bp, Artificial Sequence
  chemically synthesized
taaattgtctttagtacaaatt

SEQ ID NO: 1135114 - DNA, 22 bp, Artificial Sequence
  chemically synthesized
aaattgtctttagtacaaattg

SEQ ID NO: 1135115 - DNA, 22 bp, Artificial Sequence
  chemically synthesized
ttctttctgatacaatttgtac

SEQ ID NO: 1135116 - DNA, 22 bp, Artificial Sequence
  chemically synthesized
aattgtctttagtacaaattgt

SEQ ID NO: 1135117 - DNA, 22 bp, Artificial Sequence
  chemically synthesized
tctttagtacaaattgtatcag

SEQ ID NO: 1135118 - DNA, 22 bp, Artificial Sequence
  chemically synthesized
tagtacaaattgtatcagaaag

SEQ ID NO: 1135119 - DNA, 22 bp, Artificial Sequence
  chemically synthesized
agtacaaattgtatcagaaaga

SEQ ID NO: 1135120 - DNA, 22 bp, Artificial Sequence
  chemically synthesized
gtacaaattgtatcagaaagaa

SEQ ID NO: 1135121 - DNA, 22 bp, Artificial Sequence
  chemically synthesized
tatcagaaagaagagatgtatg

SEQ ID NO: 1135122 - DNA, 22 bp, Artificial Sequence
  chemically synthesized
atatgaatccagaagacaacat

SEQ ID NO: 1135123 - DNA, 22 bp, Artificial Sequence
  chemically synthesized
aatatgaatccagaagacaaca

SEQ ID NO: 1135124 - DNA, 22 bp, Artificial Sequence
  chemically synthesized
cgtatttaatatgaatccagaa

SEQ ID NO: 1135125 - DNA, 22 bp, Artificial Sequence
  chemically synthesized
aaattccgtatttaatatgaat

SEQ ID NO: 1135126 - DNA, 22 bp, Artificial Sequence
  chemically synthesized
ctcaaattccgtatttaatatg

SEQ ID NO: 1135127 - DNA, 22 bp, Artificial Sequence
  chemically synthesized
tcttctggattcatattaaata

SEQ ID NO: 1135128 - DNA, 22 bp, Artificial Sequence
  chemically synthesized
ctggattcatattaaatacgga

SEQ ID NO: 1135129 - DNA, 22 bp, Artificial Sequence
  chemically synthesized
tggattcatattaaatacggaa

SEQ ID NO: 1135130 - DNA, 22 bp, Artificial Sequence
  chemically synthesized
gattcatattaaatacggaatt

SEQ ID NO: 1135131 - DNA, 22 bp, Artificial Sequence
  chemically synthesized
acacagttgctcaaattccgta

SEQ ID NO: 1135132 - DNA, 22 bp, Artificial Sequence
  chemically synthesized
atattaaatacggaatttgagc

SEQ ID NO: 1135133 - DNA, 22 bp, Artificial Sequence
  chemically synthesized
attcacacagttgctcaaattc

SEQ ID NO: 1135134 - DNA, 22 bp, Artificial Sequence
  chemically synthesized
aatacggaatttgagcaactgt

SEQ ID NO: 1135135 - DNA, 22 bp, Artificial Sequence
  chemically synthesized
caggtgcagttaattcacacag

SEQ ID NO: 1135136 - DNA, 22 bp, Artificial Sequence
  chemically synthesized
gcaggtgcagttaattcacaca

SEQ ID NO: 1135137 - DNA, 22 bp, Artificial Sequence
  chemically synthesized
tgcaggtgcagttaattcacac

SEQ ID NO: 1135138 - DNA, 22 bp, Artificial Sequence
  chemically synthesized
ttgcaggtgcagttaattcaca

SEQ ID NO: 1135139 - DNA, 22 bp, Artificial Sequence
  chemically synthesized
gagcaactgtgtgaattaactg

SEQ ID NO: 1135140 - DNA, 22 bp, Artificial Sequence
  chemically synthesized
agcaactgtgtgaattaactgc

SEQ ID NO: 1135141 - DNA, 22 bp, Artificial Sequence
  chemically synthesized
caatttttgcaggtgcagttaa

SEQ ID NO: 1135142 - DNA, 22 bp, Artificial Sequence
  chemically synthesized
gcaatttttgcaggtgcagtta

SEQ ID NO: 1135143 - DNA, 22 bp, Artificial Sequence
  chemically synthesized
tgcaatttttgcaggtgcagtt

SEQ ID NO: 1135144 - DNA, 22 bp, Artificial Sequence
  chemically synthesized
ctttgcaatttttgcaggtgca

SEQ ID NO: 1135145 - DNA, 22 bp, Artificial Sequence
  chemically synthesized
tgtgaattaactgcacctgcaa

SEQ ID NO: 1135146 - DNA, 22 bp, Artificial Sequence
  chemically synthesized
attgctttgcaatttttgcagg

SEQ ID NO: 1135147 - DNA, 22 bp, Artificial Sequence
  chemically synthesized
actgcacctgcaaaaattgcaa

SEQ ID NO: 1135148 - DNA, 22 bp, Artificial Sequence
  chemically synthesized
aatctcattgctttgcaatttt

SEQ ID NO: 1135149 - DNA, 22 bp, Artificial Sequence
  chemically synthesized
cacctgcaaaaattgcaaagca

SEQ ID NO: 1135150 - DNA, 22 bp, Artificial Sequence
  chemically synthesized
caaaaattgcaaagcaatgaga

SEQ ID NO: 1135151 - DNA, 22 bp, Artificial Sequence
  chemically synthesized
caaagcaatgagatttaatttt

SEQ ID NO: 1135152 - DNA, 22 bp, Artificial Sequence
  chemically synthesized
aatttttctgatccatctggcc

SEQ ID NO: 1135153 - DNA, 22 bp, Artificial Sequence
  chemically synthesized
atttttctgatccatctggcct

SEQ ID NO: 1135154 - DNA, 22 bp, Artificial Sequence
  chemically synthesized
ttctgatccatctggccttcct

SEQ ID NO: 1135155 - DNA, 22 bp, Artificial Sequence
  chemically synthesized
gatggtatgtagaggaaggcca

SEQ ID NO: 1135156 - DNA, 22 bp, Artificial Sequence
  chemically synthesized
tctgatccatctggccttcctc

SEQ ID NO: 1135157 - DNA, 22 bp, Artificial Sequence
  chemically synthesized
ctgatccatctggccttcctct

SEQ ID NO: 1135158 - DNA, 22 bp, Artificial Sequence
  chemically synthesized
tgatccatctggccttcctcta

SEQ ID NO: 1135159 - DNA, 22 bp, Artificial Sequence
  chemically synthesized
atccatctggccttcctctaca

SEQ ID NO: 1135160 - DNA, 22 bp, Artificial Sequence
  chemically synthesized
agtgttagatggtatgtagagg

SEQ ID NO: 1135161 - DNA, 22 bp, Artificial Sequence
  chemically synthesized
cagtgttagatggtatgtagag

SEQ ID NO: 1135162 - DNA, 22 bp, Artificial Sequence
  chemically synthesized
cttcagtgttagatggtatgta

SEQ ID NO: 1135163 - DNA, 22 bp, Artificial Sequence
  chemically synthesized
gccttcctctacataccatcta

SEQ ID NO: 1135164 - DNA, 22 bp, Artificial Sequence
  chemically synthesized
attacttcagtgttagatggta

SEQ ID NO: 1135165 - DNA, 22 bp, Artificial Sequence
  chemically synthesized
cattacttcagtgttagatggt

SEQ ID NO: 1135166 - DNA, 22 bp, Artificial Sequence
  chemically synthesized
cctctacataccatctaacact

SEQ ID NO: 1135167 - DNA, 22 bp, Artificial Sequence
  chemically synthesized
ctctacataccatctaacactg

SEQ ID NO: 1135168 - DNA, 22 bp, Artificial Sequence
  chemically synthesized
tacataccatctaacactgaag

SEQ ID NO: 1135169 - DNA, 22 bp, Artificial Sequence
  chemically synthesized
cataccatctaacactgaagta

SEQ ID NO: 1135170 - DNA, 22 bp, Artificial Sequence
  chemically synthesized
tagaatgtgtttcattacttca

SEQ ID NO: 1135171 - DNA, 22 bp, Artificial Sequence
  chemically synthesized
attatagaatgtgtttcattac

SEQ ID NO: 1135172 - DNA, 22 bp, Artificial Sequence
  chemically synthesized
acactgaagtaatgaaacacat

SEQ ID NO: 1135173 - DNA, 22 bp, Artificial Sequence
  chemically synthesized
aagtaatgaaacacattctata

SEQ ID NO: 1135174 - DNA, 22 bp, Artificial Sequence
  chemically synthesized
ataatatccatccctaattata

SEQ ID NO: 1135175 - DNA, 22 bp, Artificial Sequence
  chemically synthesized
gataatatccatccctaattat

SEQ ID NO: 1135176 - DNA, 22 bp, Artificial Sequence
  chemically synthesized
tacttgataatatccatcccta

SEQ ID NO: 1135177 - DNA, 22 bp, Artificial Sequence
  chemically synthesized
tataattagggatggatattat

SEQ ID NO: 1135178 - DNA, 22 bp, Artificial Sequence
  chemically synthesized
agcctatacttgataatatcca

SEQ ID NO: 1135179 - DNA, 22 bp, Artificial Sequence
  chemically synthesized
taattagggatggatattatca

SEQ ID NO: 1135180 - DNA, 22 bp, Artificial Sequence
  chemically synthesized
ctaagcctatacttgataatat

SEQ ID NO: 1135181 - DNA, 22 bp, Artificial Sequence
  chemically synthesized
cctaagcctatacttgataata

SEQ ID NO: 1135182 - DNA, 22 bp, Artificial Sequence
  chemically synthesized
tcctaagcctatacttgataat

SEQ ID NO: 1135183 - DNA, 22 bp, Artificial Sequence
  chemically synthesized
ttcctaagcctatacttgataa

SEQ ID NO: 1135184 - DNA, 22 bp, Artificial Sequence
  chemically synthesized
tttcctaagcctatacttgata

SEQ ID NO: 1135185 - DNA, 22 bp, Artificial Sequence
  chemically synthesized
gggatggatattatcaagtata

SEQ ID NO: 1135186 - DNA, 22 bp, Artificial Sequence
  chemically synthesized
tcaagtataggcttaggaaaaa

SEQ ID NO: 1135187 - DNA, 22 bp, Artificial Sequence
  chemically synthesized
aggaaaaagacttgtatttgtc

SEQ ID NO: 1135188 - DNA, 22 bp, Artificial Sequence
  chemically synthesized
ggaaaaagacttgtatttgtct

SEQ ID NO: 1135189 - DNA, 22 bp, Artificial Sequence
  chemically synthesized
gtatttgtctttatgtgttatt

SEQ ID NO: 1135190 - DNA, 22 bp, Artificial Sequence
  chemically synthesized
acaaaaaaatgaaataacacat

SEQ ID NO: 1135191 - DNA, 22 bp, Artificial Sequence
  chemically synthesized
tatttgtctttatgtgttattt

SEQ ID NO: 1135192 - DNA, 22 bp, Artificial Sequence
  chemically synthesized
ctgacaaaaaaatgaaataaca

SEQ ID NO: 1135193 - DNA, 22 bp, Artificial Sequence
  chemically synthesized
gtctttatgtgttatttcattt

SEQ ID NO: 1135194 - DNA, 22 bp, Artificial Sequence
  chemically synthesized
tctttatgtgttatttcatttt

SEQ ID NO: 1135195 - DNA, 22 bp, Artificial Sequence
  chemically synthesized
tctcctgacaaaaaaatgaaat

SEQ ID NO: 1135196 - DNA, 22 bp, Artificial Sequence
  chemically synthesized
ttatctcctgacaaaaaaatga

SEQ ID NO: 1135197 - DNA, 22 bp, Artificial Sequence
  chemically synthesized
tatgtgttatttcatttttttg

SEQ ID NO: 1135198 - DNA, 22 bp, Artificial Sequence
  chemically synthesized
atgtgttatttcatttttttgt

SEQ ID NO: 1135199 - DNA, 22 bp, Artificial Sequence
  chemically synthesized
tgtgttatttcatttttttgtc

SEQ ID NO: 1135200 - DNA, 22 bp, Artificial Sequence
  chemically synthesized
tttcatttttttgtcaggagat

SEQ ID NO: 1135201 - DNA, 22 bp, Artificial Sequence
  chemically synthesized
catttttttgtcaggagataat

SEQ ID NO: 1135202 - DNA, 22 bp, Artificial Sequence
  chemically synthesized
tatgatacgcctattatctcct

SEQ ID NO: 1135203 - DNA, 22 bp, Artificial Sequence
  chemically synthesized
atttttttgtcaggagataata

SEQ ID NO: 1135204 - DNA, 22 bp, Artificial Sequence
  chemically synthesized
ttttgtcaggagataataggcg

SEQ ID NO: 1135205 - DNA, 22 bp, Artificial Sequence
  chemically synthesized
tttgtcaggagataataggcgt

SEQ ID NO: 1135206 - DNA, 22 bp, Artificial Sequence
  chemically synthesized
ttgtcaggagataataggcgta

SEQ ID NO: 1135207 - DNA, 22 bp, Artificial Sequence
  chemically synthesized
tgtcaggagataataggcgtat

SEQ ID NO: 1135208 - DNA, 22 bp, Artificial Sequence
  chemically synthesized
agcatctgtatgatacgcctat

SEQ ID NO: 1135209 - DNA, 22 bp, Artificial Sequence
  chemically synthesized
gtcaggagataataggcgtatc

SEQ ID NO: 1135210 - DNA, 22 bp, Artificial Sequence
  chemically synthesized
tcaggagataataggcgtatca

SEQ ID NO: 1135211 - DNA, 22 bp, Artificial Sequence
  chemically synthesized
aaataccatacagacaaaatgc

SEQ ID NO: 1135212 - DNA, 22 bp, Artificial Sequence
  chemically synthesized
agcattttgtctgtatggtatt

SEQ ID NO: 1135213 - DNA, 22 bp, Artificial Sequence
  chemically synthesized
agtatgtcattaaaataccata

SEQ ID NO: 1135214 - DNA, 22 bp, Artificial Sequence
  chemically synthesized
actgagtatgtcattaaaatac

SEQ ID NO: 1135215 - DNA, 22 bp, Artificial Sequence
  chemically synthesized
tgtctgtatggtattttaatga

SEQ ID NO: 1135216 - DNA, 22 bp, Artificial Sequence
  chemically synthesized
gtctgtatggtattttaatgac

SEQ ID NO: 1135217 - DNA, 22 bp, Artificial Sequence
  chemically synthesized
tctgtatggtattttaatgaca

SEQ ID NO: 1135218 - DNA, 22 bp, Artificial Sequence
  chemically synthesized
tattcactgagtatgtcattaa

SEQ ID NO: 1135219 - DNA, 22 bp, Artificial Sequence
  chemically synthesized
tatggtattttaatgacatact

SEQ ID NO: 1135220 - DNA, 22 bp, Artificial Sequence
  chemically synthesized
cactgtattcactgagtatgtc

SEQ ID NO: 1135221 - DNA, 22 bp, Artificial Sequence
  chemically synthesized
ttacactgtattcactgagtat

SEQ ID NO: 1135222 - DNA, 22 bp, Artificial Sequence
  chemically synthesized
taatgacatactcagtgaatac

SEQ ID NO: 1135223 - DNA, 22 bp, Artificial Sequence
  chemically synthesized
aatgacatactcagtgaataca

SEQ ID NO: 1135224 - DNA, 22 bp, Artificial Sequence
  chemically synthesized
atgacatactcagtgaatacag

SEQ ID NO: 1135225 - DNA, 22 bp, Artificial Sequence
  chemically synthesized
tgaaattattacactgtattca

SEQ ID NO: 1135226 - DNA, 22 bp, Artificial Sequence
  chemically synthesized
attatgaaattattacactgta

SEQ ID NO: 1135227 - DNA, 22 bp, Artificial Sequence
  chemically synthesized
aattatgaaattattacactgt

SEQ ID NO: 1135228 - DNA, 22 bp, Artificial Sequence
  chemically synthesized
agtgaatacagtgtaataattt

SEQ ID NO: 1135229 - DNA, 22 bp, Artificial Sequence
  chemically synthesized
aaaggagacttaattatgaaat

SEQ ID NO: 1135230 - DNA, 22 bp, Artificial Sequence
  chemically synthesized
ttcaaaggagacttaattatga

SEQ ID NO: 1135231 - DNA, 22 bp, Artificial Sequence
  chemically synthesized
tccctattcaaaggagacttaa

SEQ ID NO: 1135232 - DNA, 22 bp, Artificial Sequence
  chemically synthesized
cataattaagtctcctttgaat

SEQ ID NO: 1135233 - DNA, 22 bp, Artificial Sequence
  chemically synthesized
ataattaagtctcctttgaata

SEQ ID NO: 1135234 - DNA, 22 bp, Artificial Sequence
  chemically synthesized
agtctcctttgaatagggatag

SEQ ID NO: 1135235 - DNA, 22 bp, Artificial Sequence
  chemically synthesized
ctttgaatagggataggatgtt

SEQ ID NO: 1135236 - DNA, 22 bp, Artificial Sequence
  chemically synthesized
tgaatagggataggatgttatt

SEQ ID NO: 1135237 - DNA, 22 bp, Artificial Sequence
  chemically synthesized
aaaaataatgataataacatcc

SEQ ID NO: 1135238 - DNA, 22 bp, Artificial Sequence
  chemically synthesized
gaatagggataggatgttatta

SEQ ID NO: 1135239 - DNA, 22 bp, Artificial Sequence
  chemically synthesized
aatagggataggatgttattat

SEQ ID NO: 1135240 - DNA, 22 bp, Artificial Sequence
  chemically synthesized
gaaaggcagctaaaaaataatg

SEQ ID NO: 1135241 - DNA, 22 bp, Artificial Sequence
  chemically synthesized
ccactggaaaggcagctaaaaa

SEQ ID NO: 1135242 - DNA, 22 bp, Artificial Sequence
  chemically synthesized
gccactggaaaggcagctaaaa

SEQ ID NO: 1135243 - DNA, 22 bp, Artificial Sequence
  chemically synthesized
ttatcattattttttagctgcc

SEQ ID NO: 1135244 - DNA, 22 bp, Artificial Sequence
  chemically synthesized
tgccactggaaaggcagctaaa

SEQ ID NO: 1135245 - DNA, 22 bp, Artificial Sequence
  chemically synthesized
ttgccactggaaaggcagctaa

SEQ ID NO: 1135246 - DNA, 22 bp, Artificial Sequence
  chemically synthesized
tcattattttttagctgccttt

SEQ ID NO: 1135247 - DNA, 22 bp, Artificial Sequence
  chemically synthesized
cttttgccactggaaaggcagc

SEQ ID NO: 1135248 - DNA, 22 bp, Artificial Sequence
  chemically synthesized
ctacttttgccactggaaaggc

SEQ ID NO: 1135249 - DNA, 22 bp, Artificial Sequence
  chemically synthesized
ttttttagctgcctttccagtg

SEQ ID NO: 1135250 - DNA, 22 bp, Artificial Sequence
  chemically synthesized
tttagctgcctttccagtggca

SEQ ID NO: 1135251 - DNA, 22 bp, Artificial Sequence
  chemically synthesized
ttagctgcctttccagtggcaa

SEQ ID NO: 1135252 - DNA, 22 bp, Artificial Sequence
  chemically synthesized
tagctgcctttccagtggcaaa

SEQ ID NO: 1135253 - DNA, 22 bp, Artificial Sequence
  chemically synthesized
agctgcctttccagtggcaaaa

SEQ ID NO: 1135254 - DNA, 22 bp, Artificial Sequence
  chemically synthesized
gctgcctttccagtggcaaaag

SEQ ID NO: 1135255 - DNA, 22 bp, Artificial Sequence
  chemically synthesized
cctttccagtggcaaaagtagg

SEQ ID NO: 1135256 - DNA, 22 bp, Artificial Sequence
  chemically synthesized
gtgaagaagattcctacttttg

SEQ ID NO: 1135257 - DNA, 22 bp, Artificial Sequence
  chemically synthesized
agtgaagaagattcctactttt

SEQ ID NO: 1135258 - DNA, 22 bp, Artificial Sequence
  chemically synthesized
tccagtggcaaaagtaggaatc

SEQ ID NO: 1135259 - DNA, 22 bp, Artificial Sequence
  chemically synthesized
ccagtggcaaaagtaggaatct

SEQ ID NO: 1135260 - DNA, 22 bp, Artificial Sequence
  chemically synthesized
cagtggcaaaagtaggaatctt

SEQ ID NO: 1135261 - DNA, 22 bp, Artificial Sequence
  chemically synthesized
gagtacttagtgaagaagattc

SEQ ID NO: 1135262 - DNA, 22 bp, Artificial Sequence
  chemically synthesized
tggagtacttagtgaagaagat

SEQ ID NO: 1135263 - DNA, 22 bp, Artificial Sequence
  chemically synthesized
tgtgaaactctggagtacttag

SEQ ID NO: 1135264 - DNA, 22 bp, Artificial Sequence
  chemically synthesized
atgtgaaactctggagtactta

SEQ ID NO: 1135265 - DNA, 22 bp, Artificial Sequence
  chemically synthesized
tatgtgaaactctggagtactt

SEQ ID NO: 1135266 - DNA, 22 bp, Artificial Sequence
  chemically synthesized
ttatgtgaaactctggagtact

SEQ ID NO: 1135267 - DNA, 22 bp, Artificial Sequence
  chemically synthesized
cttttatgtgaaactctggagt

SEQ ID NO: 1135268 - DNA, 22 bp, Artificial Sequence
  chemically synthesized
cttcactaagtactccagagtt

SEQ ID NO: 1135269 - DNA, 22 bp, Artificial Sequence
  chemically synthesized
gcttttatgtgaaactctggag

SEQ ID NO: 1135270 - DNA, 22 bp, Artificial Sequence
  chemically synthesized
ttcactaagtactccagagttt

SEQ ID NO: 1135271 - DNA, 22 bp, Artificial Sequence
  chemically synthesized
tgcttttatgtgaaactctgga

SEQ ID NO: 1135272 - DNA, 22 bp, Artificial Sequence
  chemically synthesized
cactaagtactccagagtttca

SEQ ID NO: 1135273 - DNA, 22 bp, Artificial Sequence
  chemically synthesized
tttgcttttatgtgaaactctg

SEQ ID NO: 1135274 - DNA, 22 bp, Artificial Sequence
  chemically synthesized
actaagtactccagagtttcac

SEQ ID NO: 1135275 - DNA, 22 bp, Artificial Sequence
  chemically synthesized
tctttgcttttatgtgaaactc

SEQ ID NO: 1135276 - DNA, 22 bp, Artificial Sequence
  chemically synthesized
ctctttgcttttatgtgaaact

SEQ ID NO: 1135277 - DNA, 22 bp, Artificial Sequence
  chemically synthesized
agtactccagagtttcacataa

SEQ ID NO: 1135278 - DNA, 22 bp, Artificial Sequence
  chemically synthesized
atatgtttctctttgcttttat

SEQ ID NO: 1135279 - DNA, 22 bp, Artificial Sequence
  chemically synthesized
cagagtttcacataaaagcaaa

SEQ ID NO: 1135280 - DNA, 22 bp, Artificial Sequence
  chemically synthesized
gatatgtttctctttgctttta

SEQ ID NO: 1135281 - DNA, 22 bp, Artificial Sequence
  chemically synthesized
tgatatgtttctctttgctttt

SEQ ID NO: 1135282 - DNA, 22 bp, Artificial Sequence
  chemically synthesized
cacataaaagcaaagagaaaca

SEQ ID NO: 1135283 - DNA, 22 bp, Artificial Sequence
  chemically synthesized
acataaaagcaaagagaaacat

SEQ ID NO: 1135284 - DNA, 22 bp, Artificial Sequence
  chemically synthesized
aatgtctttgatatgtttctct

SEQ ID NO: 1135285 - DNA, 22 bp, Artificial Sequence
  chemically synthesized
taaatgtctttgatatgtttct

SEQ ID NO: 1135286 - DNA, 22 bp, Artificial Sequence
  chemically synthesized
tagtggccatcgagttctaaat

SEQ ID NO: 1135287 - DNA, 22 bp, Artificial Sequence
  chemically synthesized
tatagtggccatcgagttctaa

SEQ ID NO: 1135288 - DNA, 22 bp, Artificial Sequence
  chemically synthesized
ctatagtggccatcgagttcta

SEQ ID NO: 1135289 - DNA, 22 bp, Artificial Sequence
  chemically synthesized
ggcagatttctatagtggccat

SEQ ID NO: 1135290 - DNA, 22 bp, Artificial Sequence
  chemically synthesized
agaactcgatggccactataga

SEQ ID NO: 1135291 - DNA, 22 bp, Artificial Sequence
  chemically synthesized
gaactcgatggccactatagaa

SEQ ID NO: 1135292 - DNA, 22 bp, Artificial Sequence
  chemically synthesized
gatggccactatagaaatctgc

SEQ ID NO: 1135293 - DNA, 22 bp, Artificial Sequence
  chemically synthesized
aaggaaaggtaagctaggcaga

SEQ ID NO: 1135294 - DNA, 22 bp, Artificial Sequence
  chemically synthesized
aaaggaaaggtaagctaggcag

SEQ ID NO: 1135295 - DNA, 22 bp, Artificial Sequence
  chemically synthesized
tagaaatctgcctagcttacct

SEQ ID NO: 1135296 - DNA, 22 bp, Artificial Sequence
  chemically synthesized
taaatttaaaggaaaggtaagc

SEQ ID NO: 1135297 - DNA, 22 bp, Artificial Sequence
  chemically synthesized
ataaatttaaaggaaaggtaag

SEQ ID NO: 1135298 - DNA, 22 bp, Artificial Sequence
  chemically synthesized
tttataaatttaaaggaaaggt

SEQ ID NO: 1135299 - DNA, 22 bp, Artificial Sequence
  chemically synthesized
atttataaatttaaaggaaagg

SEQ ID NO: 1135300 - DNA, 22 bp, Artificial Sequence
  chemically synthesized
tatttataaatttaaaggaaag

SEQ ID NO: 1135301 - DNA, 22 bp, Artificial Sequence
  chemically synthesized
cctagcttacctttcctttaaa

SEQ ID NO: 1135302 - DNA, 22 bp, Artificial Sequence
  chemically synthesized
tttatttataaatttaaaggaa

SEQ ID NO: 1135303 - DNA, 22 bp, Artificial Sequence
  chemically synthesized
gcttacctttcctttaaattta

SEQ ID NO: 1135304 - DNA, 22 bp, Artificial Sequence
  chemically synthesized
attctttatttataaatttaaa

SEQ ID NO: 1135305 - DNA, 22 bp, Artificial Sequence
  chemically synthesized
tcattctttatttataaattta

SEQ ID NO: 1135306 - DNA, 22 bp, Artificial Sequence
  chemically synthesized
acctttcctttaaatttataaa

SEQ ID NO: 1135307 - DNA, 22 bp, Artificial Sequence
  chemically synthesized
cctttcctttaaatttataaat

SEQ ID NO: 1135308 - DNA, 22 bp, Artificial Sequence
  chemically synthesized
tcctttaaatttataaataaag

SEQ ID NO: 1135309 - DNA, 22 bp, Artificial Sequence
  chemically synthesized
gaatctctcattctttatttat

SEQ ID NO: 1135310 - DNA, 22 bp, Artificial Sequence
  chemically synthesized
cctttaaatttataaataaaga

SEQ ID NO: 1135311 - DNA, 22 bp, Artificial Sequence
  chemically synthesized
ggaatctctcattctttattta

SEQ ID NO: 1135312 - DNA, 22 bp, Artificial Sequence
  chemically synthesized
ctttaaatttataaataaagaa

SEQ ID NO: 1135313 - DNA, 22 bp, Artificial Sequence
  chemically synthesized
ttggaatctctcattctttatt

SEQ ID NO: 1135314 - DNA, 22 bp, Artificial Sequence
  chemically synthesized
taaatttataaataaagaatga

SEQ ID NO: 1135315 - DNA, 22 bp, Artificial Sequence
  chemically synthesized
aaatttataaataaagaatgag

SEQ ID NO: 1135316 - DNA, 22 bp, Artificial Sequence
  chemically synthesized
aatttataaataaagaatgaga

SEQ ID NO: 1135317 - DNA, 22 bp, Artificial Sequence
  chemically synthesized
actcttggaatctctcattctt

SEQ ID NO: 1135318 - DNA, 22 bp, Artificial Sequence
  chemically synthesized
ataaataaagaatgagagattc

SEQ ID NO: 1135319 - DNA, 22 bp, Artificial Sequence
  chemically synthesized
agttaactcttggaatctctca

SEQ ID NO: 1135320 - DNA, 22 bp, Artificial Sequence
  chemically synthesized
taaataaagaatgagagattcc

SEQ ID NO: 1135321 - DNA, 22 bp, Artificial Sequence
  chemically synthesized
agtctgagttaactcttggaat

SEQ ID NO: 1135322 - DNA, 22 bp, Artificial Sequence
  chemically synthesized
atacattcagtctgagttaact

SEQ ID NO: 1135323 - DNA, 22 bp, Artificial Sequence
  chemically synthesized
aatacattcagtctgagttaac

SEQ ID NO: 1135324 - DNA, 22 bp, Artificial Sequence
  chemically synthesized
caagagttaactcagactgaat

SEQ ID NO: 1135325 - DNA, 22 bp, Artificial Sequence
  chemically synthesized
aaaaatttaatacattcagtct

SEQ ID NO: 1135326 - DNA, 22 bp, Artificial Sequence
  chemically synthesized
actcagactgaatgtattaaat

SEQ ID NO: 1135327 - DNA, 22 bp, Artificial Sequence
  chemically synthesized
agactgaatgtattaaattttt

SEQ ID NO: 1135328 - DNA, 22 bp, Artificial Sequence
  chemically synthesized
aatgtattaaattttttagtgc

SEQ ID NO: 1135329 - DNA, 22 bp, Artificial Sequence
  chemically synthesized
taacaatataaaatgtaagcac

SEQ ID NO: 1135330 - DNA, 22 bp, Artificial Sequence
  chemically synthesized
aattttttagtgcttacatttt

SEQ ID NO: 1135331 - DNA, 22 bp, Artificial Sequence
  chemically synthesized
tctgtaacaatataaaatgtaa

SEQ ID NO: 1135332 - DNA, 22 bp, Artificial Sequence
  chemically synthesized
tttagtgcttacattttatatt

SEQ ID NO: 1135333 - DNA, 22 bp, Artificial Sequence
  chemically synthesized
ttagtgcttacattttatattg

SEQ ID NO: 1135334 - DNA, 22 bp, Artificial Sequence
  chemically synthesized
tagtgcttacattttatattgt

SEQ ID NO: 1135335 - DNA, 22 bp, Artificial Sequence
  chemically synthesized
agtgcttacattttatattgtt

SEQ ID NO: 1135336 - DNA, 22 bp, Artificial Sequence
  chemically synthesized
gtgcttacattttatattgtta

SEQ ID NO: 1135337 - DNA, 22 bp, Artificial Sequence
  chemically synthesized
taaatgcattgtctgtaacaat

SEQ ID NO: 1135338 - DNA, 22 bp, Artificial Sequence
  chemically synthesized
gtaaatgcattgtctgtaacaa

SEQ ID NO: 1135339 - DNA, 22 bp, Artificial Sequence
  chemically synthesized
acattttatattgttacagaca

SEQ ID NO: 1135340 - DNA, 22 bp, Artificial Sequence
  chemically synthesized
cattttatattgttacagacaa

SEQ ID NO: 1135341 - DNA, 22 bp, Artificial Sequence
  chemically synthesized
ccttgtaaatgcattgtctgta

SEQ ID NO: 1135342 - DNA, 22 bp, Artificial Sequence
  chemically synthesized
accttgtaaatgcattgtctgt

SEQ ID NO: 1135343 - DNA, 22 bp, Artificial Sequence
  chemically synthesized
taccttgtaaatgcattgtctg

SEQ ID NO: 1135344 - DNA, 22 bp, Artificial Sequence
  chemically synthesized
tatattgttacagacaatgcat

SEQ ID NO: 1135345 - DNA, 22 bp, Artificial Sequence
  chemically synthesized
atattgttacagacaatgcatt

SEQ ID NO: 1135346 - DNA, 22 bp, Artificial Sequence
  chemically synthesized
tattgttacagacaatgcattt

SEQ ID NO: 1135347 - DNA, 22 bp, Artificial Sequence
  chemically synthesized
ttacagacaatgcatttacaag

SEQ ID NO: 1135348 - DNA, 22 bp, Artificial Sequence
  chemically synthesized
cagacaatgcatttacaaggta

SEQ ID NO: 1135349 - DNA, 22 bp, Artificial Sequence
  chemically synthesized
tatatcagtgcaataggtttta

SEQ ID NO: 1135350 - DNA, 22 bp, Artificial Sequence
  chemically synthesized
gtatatcagtgcaataggtttt

SEQ ID NO: 1135351 - DNA, 22 bp, Artificial Sequence
  chemically synthesized
acaaggtaaaacctattgcact

SEQ ID NO: 1135352 - DNA, 22 bp, Artificial Sequence
  chemically synthesized
caaggtaaaacctattgcactg

SEQ ID NO: 1135353 - DNA, 22 bp, Artificial Sequence
  chemically synthesized
agaatgggccttgtatatcagt

SEQ ID NO: 1135354 - DNA, 22 bp, Artificial Sequence
  chemically synthesized
gagaatgggccttgtatatcag

SEQ ID NO: 1135355 - DNA, 22 bp, Artificial Sequence
  chemically synthesized
ttgcactgatatacaaggccca

SEQ ID NO: 1135356 - DNA, 22 bp, Artificial Sequence
  chemically synthesized
cactgatatacaaggcccattc

SEQ ID NO: 1135357 - DNA, 22 bp, Artificial Sequence
  chemically synthesized
taataggtatttgagaatgggc

SEQ ID NO: 1135358 - DNA, 22 bp, Artificial Sequence
  chemically synthesized
atatacaaggcccattctcaaa

SEQ ID NO: 1135359 - DNA, 22 bp, Artificial Sequence
  chemically synthesized
caactataataggtatttgaga

SEQ ID NO: 1135360 - DNA, 22 bp, Artificial Sequence
  chemically synthesized
tctccaactataataggtattt

SEQ ID NO: 1135361 - DNA, 22 bp, Artificial Sequence
  chemically synthesized
ctatctccaactataataggta

SEQ ID NO: 1135362 - DNA, 22 bp, Artificial Sequence
  chemically synthesized
gctatctccaactataataggt

SEQ ID NO: 1135363 - DNA, 22 bp, Artificial Sequence
  chemically synthesized
tgctatctccaactataatagg

SEQ ID NO: 1135364 - DNA, 22 bp, Artificial Sequence
  chemically synthesized
tcaaatacctattatagttgga

SEQ ID NO: 1135365 - DNA, 22 bp, Artificial Sequence
  chemically synthesized
aaatacctattatagttggaga

SEQ ID NO: 1135366 - DNA, 22 bp, Artificial Sequence
  chemically synthesized
tatcattttgctatctccaact

SEQ ID NO: 1135367 - DNA, 22 bp, Artificial Sequence
  chemically synthesized
actgtatcattttgctatctcc

SEQ ID NO: 1135368 - DNA, 22 bp, Artificial Sequence
  chemically synthesized
ttatagttggagatagcaaaat

SEQ ID NO: 1135369 - DNA, 22 bp, Artificial Sequence
  chemically synthesized
tagttggagatagcaaaatgat

SEQ ID NO: 1135370 - DNA, 22 bp, Artificial Sequence
  chemically synthesized
gaaattaactgtatcattttgc

SEQ ID NO: 1135371 - DNA, 22 bp, Artificial Sequence
  chemically synthesized
ggaaattaactgtatcattttg

SEQ ID NO: 1135372 - DNA, 22 bp, Artificial Sequence
  chemically synthesized
tggaaattaactgtatcatttt

SEQ ID NO: 1135373 - DNA, 22 bp, Artificial Sequence
  chemically synthesized
gagatagcaaaatgatacagtt

SEQ ID NO: 1135374 - DNA, 22 bp, Artificial Sequence
  chemically synthesized
aaataactttggaaattaactg

SEQ ID NO: 1135375 - DNA, 22 bp, Artificial Sequence
  chemically synthesized
catctcaaataactttggaaat

SEQ ID NO: 1135376 - DNA, 22 bp, Artificial Sequence
  chemically synthesized
aagttacatctcaaataacttt

SEQ ID NO: 1135377 - DNA, 22 bp, Artificial Sequence
  chemically synthesized
gaagttacatctcaaataactt

SEQ ID NO: 1135378 - DNA, 22 bp, Artificial Sequence
  chemically synthesized
atttccaaagttatttgagatg

SEQ ID NO: 1135379 - DNA, 22 bp, Artificial Sequence
  chemically synthesized
ccaaagttatttgagatgtaac

SEQ ID NO: 1135380 - DNA, 22 bp, Artificial Sequence
  chemically synthesized
caaagttatttgagatgtaact

SEQ ID NO: 1135381 - DNA, 22 bp, Artificial Sequence
  chemically synthesized
tttgagatgtaacttcaaattt

SEQ ID NO: 1135382 - DNA, 22 bp, Artificial Sequence
  chemically synthesized
gagatgtaacttcaaattttct

SEQ ID NO: 1135383 - DNA, 22 bp, Artificial Sequence
  chemically synthesized
agatgtaacttcaaattttctt

SEQ ID NO: 1135384 - DNA, 22 bp, Artificial Sequence
  chemically synthesized
caaattttcttttttttttttt

SEQ ID NO: 1135385 - DNA, 22 bp, Artificial Sequence
  chemically synthesized
aaattttctttttttttttttt

SEQ ID NO: 1135386 - DNA, 22 bp, Artificial Sequence
  chemically synthesized
aaaaaaaaaaaaaaaaaaaaaa

SEQ ID NO: 1135387 - DNA, 22 bp, Artificial Sequence
  chemically synthesized
tctttttttttttttttttttt

SEQ ID NO: 1135388 - DNA, 22 bp, Artificial Sequence
  chemically synthesized
cttttttttttttttttttttt

SEQ ID NO: 1135389 - DNA, 22 bp, Artificial Sequence
  chemically synthesized
tttttttttttttttttttttt

SEQ ID NO: 1135390 - DNA, 22 bp, Artificial Sequence
  chemically synthesized
gtctcaaaaaaaaaaaaaaaaa

SEQ ID NO: 1135391 - DNA, 22 bp, Artificial Sequence
  chemically synthesized
tttttttttttttttttttttt

SEQ ID NO: 1135392 - DNA, 22 bp, Artificial Sequence
  chemically synthesized
cgtctcaaaaaaaaaaaaaaaa

SEQ ID NO: 1135393 - DNA, 22 bp, Artificial Sequence
  chemically synthesized
tttttttttttttttttttttt

SEQ ID NO: 1135394 - DNA, 22 bp, Artificial Sequence
  chemically synthesized
tttttttttttttttttttttt

SEQ ID NO: 1135395 - DNA, 22 bp, Artificial Sequence
  chemically synthesized
tttttttttttttttttttttt

SEQ ID NO: 1135396 - DNA, 22 bp, Artificial Sequence
  chemically synthesized
tttttttttttttttttttttt

SEQ ID NO: 1135397 - DNA, 22 bp, Artificial Sequence
  chemically synthesized
tttttttttttttttttttttt

SEQ ID NO: 1135398 - DNA, 22 bp, Artificial Sequence
  chemically synthesized
tttttttttttttttttttttt

SEQ ID NO: 1135399 - DNA, 22 bp, Artificial Sequence
  chemically synthesized
tttttttttttttttttttttg

SEQ ID NO: 1135400 - DNA, 22 bp, Artificial Sequence
  chemically synthesized
ttttttttttttttttttttga

SEQ ID NO: 1135401 - DNA, 22 bp, Artificial Sequence
  chemically synthesized
tttttttttttttttttttgag

SEQ ID NO: 1135402 - DNA, 22 bp, Artificial Sequence
  chemically synthesized
ttttttttttttttttttgaga

SEQ ID NO: 1135403 - DNA, 22 bp, Artificial Sequence
  chemically synthesized
tttttttttttttttttgagac

SEQ ID NO: 1135404 - DNA, 22 bp, Artificial Sequence
  chemically synthesized
ttttttttttttttttgagacg

SEQ ID NO: 1135405 - DNA, 22 bp, Artificial Sequence
  chemically synthesized
tttttttttttttttgagacga

SEQ ID NO: 1135406 - DNA, 22 bp, Artificial Sequence
  chemically synthesized
ttttttttttttttgagacgaa

SEQ ID NO: 1135407 - DNA, 22 bp, Artificial Sequence
  chemically synthesized
tttttttttttttgagacgaag

SEQ ID NO: 1135408 - DNA, 22 bp, Artificial Sequence
  chemically synthesized
ttttttttttttgagacgaagt

SEQ ID NO: 1135409 - DNA, 22 bp, Artificial Sequence
  chemically synthesized
tttttttttttgagacgaagtc

SEQ ID NO: 1135410 - DNA, 22 bp, Artificial Sequence
  chemically synthesized
ttttttttttgagacgaagtct

SEQ ID NO: 1135411 - DNA, 22 bp, Artificial Sequence
  chemically synthesized
tttttttttgagacgaagtctc

SEQ ID NO: 1135412 - DNA, 22 bp, Artificial Sequence
  chemically synthesized
ttttttttgagacgaagtctcg

SEQ ID NO: 1135413 - DNA, 22 bp, Artificial Sequence
  chemically synthesized
tttttttgagacgaagtctcgc

SEQ ID NO: 1135414 - DNA, 22 bp, Artificial Sequence
  chemically synthesized
ttttttgagacgaagtctcgct

SEQ ID NO: 1135415 - DNA, 22 bp, Artificial Sequence
  chemically synthesized
tttttgagacgaagtctcgctc

SEQ ID NO: 1135416 - DNA, 22 bp, Artificial Sequence
  chemically synthesized
ttttgagacgaagtctcgctct

SEQ ID NO: 1135417 - DNA, 22 bp, Artificial Sequence
  chemically synthesized
tttgagacgaagtctcgctctg

SEQ ID NO: 1135418 - DNA, 22 bp, Artificial Sequence
  chemically synthesized
cagccgggatgacagagcgaga

SEQ ID NO: 1135419 - DNA, 22 bp, Artificial Sequence
  chemically synthesized
ttgagacgaagtctcgctctgt

SEQ ID NO: 1135420 - DNA, 22 bp, Artificial Sequence
  chemically synthesized
tgagacgaagtctcgctctgtc

SEQ ID NO: 1135421 - DNA, 22 bp, Artificial Sequence
  chemically synthesized
gagacgaagtctcgctctgtca

SEQ ID NO: 1135422 - DNA, 22 bp, Artificial Sequence
  chemically synthesized
agacgaagtctcgctctgtcat

SEQ ID NO: 1135423 - DNA, 22 bp, Artificial Sequence
  chemically synthesized
cactccagccgggatgacagag

SEQ ID NO: 1135424 - DNA, 22 bp, Artificial Sequence
  chemically synthesized
gctctgtcatcccggctggagt

SEQ ID NO: 1135425 - DNA, 22 bp, Artificial Sequence
  chemically synthesized
tgtcatcccggctggagtgcag

SEQ ID NO: 1135426 - DNA, 22 bp, Artificial Sequence
  chemically synthesized
tcatcccggctggagtgcagtg

SEQ ID NO: 1135427 - DNA, 22 bp, Artificial Sequence
  chemically synthesized
cagtgagccgagatcatgccac

SEQ ID NO: 1135428 - DNA, 22 bp, Artificial Sequence
  chemically synthesized
gagtgcagtggcatgatctcgg

SEQ ID NO: 1135429 - DNA, 22 bp, Artificial Sequence
  chemically synthesized
aacccgggaggtggaggttgca

SEQ ID NO: 1135430 - DNA, 22 bp, Artificial Sequence
  chemically synthesized
gaacccgggaggtggaggttgc

SEQ ID NO: 1135431 - DNA, 22 bp, Artificial Sequence
  chemically synthesized
cttgaacccgggaggtggaggt

SEQ ID NO: 1135432 - DNA, 22 bp, Artificial Sequence
  chemically synthesized
ggctcactgcaacctccacctc

SEQ ID NO: 1135433 - DNA, 22 bp, Artificial Sequence
  chemically synthesized
actgcaacctccacctcccggg

SEQ ID NO: 1135434 - DNA, 22 bp, Artificial Sequence
  chemically synthesized
caacctccacctcccgggttca

SEQ ID NO: 1135435 - DNA, 22 bp, Artificial Sequence
  chemically synthesized
aggcaggagaattgcttgaacc

SEQ ID NO: 1135436 - DNA, 22 bp, Artificial Sequence
  chemically synthesized
cacctcccgggttcaagcaatt

SEQ ID NO: 1135437 - DNA, 22 bp, Artificial Sequence
  chemically synthesized
ggaggctgaggcaggagaattg

SEQ ID NO: 1135438 - DNA, 22 bp, Artificial Sequence
  chemically synthesized
ccgggttcaagcaattctcctg

SEQ ID NO: 1135439 - DNA, 22 bp, Artificial Sequence
  chemically synthesized
gggaggctgaggcaggagaatt

SEQ ID NO: 1135440 - DNA, 22 bp, Artificial Sequence
  chemically synthesized
cttgggaggctgaggcaggaga

SEQ ID NO: 1135441 - DNA, 22 bp, Artificial Sequence
  chemically synthesized
aagcaattctcctgcctcagcc

SEQ ID NO: 1135442 - DNA, 22 bp, Artificial Sequence
  chemically synthesized
cagctacttgggaggctgaggc

SEQ ID NO: 1135443 - DNA, 22 bp, Artificial Sequence
  chemically synthesized
taattgcagctacttgggaggc

SEQ ID NO: 1135444 - DNA, 22 bp, Artificial Sequence
  chemically synthesized
gtaattgcagctacttgggagg

SEQ ID NO: 1135445 - DNA, 22 bp, Artificial Sequence
  chemically synthesized
tcctgcctcagcctcccaagta

SEQ ID NO: 1135446 - DNA, 22 bp, Artificial Sequence
  chemically synthesized
ctgcctcagcctcccaagtagc

SEQ ID NO: 1135447 - DNA, 22 bp, Artificial Sequence
  chemically synthesized
cctcagcctcccaagtagctgc

SEQ ID NO: 1135448 - DNA, 22 bp, Artificial Sequence
  chemically synthesized
agcctcccaagtagctgcaatt

SEQ ID NO: 1135449 - DNA, 22 bp, Artificial Sequence
  chemically synthesized
ccaagtagctgcaattacaagc

SEQ ID NO: 1135450 - DNA, 22 bp, Artificial Sequence
  chemically synthesized
caattacaagcgcctgccacca

SEQ ID NO: 1135451 - DNA, 22 bp, Artificial Sequence
  chemically synthesized
caagcgcctgccaccatgcctg

SEQ ID NO: 1135452 - DNA, 22 bp, Artificial Sequence
  chemically synthesized
aaaatacaaaaaaagtagccag

SEQ ID NO: 1135453 - DNA, 22 bp, Artificial Sequence
  chemically synthesized
ccaccatgcctggctacttttt

SEQ ID NO: 1135454 - DNA, 22 bp, Artificial Sequence
  chemically synthesized
ctaaaaatacaaaaaaagtagc

SEQ ID NO: 1135455 - DNA, 22 bp, Artificial Sequence
  chemically synthesized
actaaaaatacaaaaaaagtag

SEQ ID NO: 1135456 - DNA, 22 bp, Artificial Sequence
  chemically synthesized
tactaaaaatacaaaaaaagta

SEQ ID NO: 1135457 - DNA, 22 bp, Artificial Sequence
  chemically synthesized
gctactttttttgtatttttag

SEQ ID NO: 1135458 - DNA, 22 bp, Artificial Sequence
  chemically synthesized
ctttttttgtatttttagtaaa

SEQ ID NO: 1135459 - DNA, 22 bp, Artificial Sequence
  chemically synthesized
tttttgtatttttagtaaagat

SEQ ID NO: 1135460 - DNA, 22 bp, Artificial Sequence
  chemically synthesized
ttttgtatttttagtaaagatg

SEQ ID NO: 1135461 - DNA, 22 bp, Artificial Sequence
  chemically synthesized
tttgtatttttagtaaagatgg

SEQ ID NO: 1135462 - DNA, 22 bp, Artificial Sequence
  chemically synthesized
ttgtatttttagtaaagatggg

SEQ ID NO: 1135463 - DNA, 22 bp, Artificial Sequence
  chemically synthesized
tgtatttttagtaaagatgggg

SEQ ID NO: 1135464 - DNA, 22 bp, Artificial Sequence
  chemically synthesized
gtatttttagtaaagatggggt

SEQ ID NO: 1135465 - DNA, 22 bp, Artificial Sequence
  chemically synthesized
tatttttagtaaagatggggtt

SEQ ID NO: 1135466 - DNA, 22 bp, Artificial Sequence
  chemically synthesized
gtcaacatggtgaaaccccatc

SEQ ID NO: 1135467 - DNA, 22 bp, Artificial Sequence
  chemically synthesized
ttagtaaagatggggtttcacc

SEQ ID NO: 1135468 - DNA, 22 bp, Artificial Sequence
  chemically synthesized
tagtaaagatggggtttcacca

SEQ ID NO: 1135469 - DNA, 22 bp, Artificial Sequence
  chemically synthesized
agtaaagatggggtttcaccat

SEQ ID NO: 1135470 - DNA, 22 bp, Artificial Sequence
  chemically synthesized
gtaaagatggggtttcaccatg

SEQ ID NO: 1135471 - DNA, 22 bp, Artificial Sequence
  chemically synthesized
aaaccagcctggtcaacatggt

SEQ ID NO: 1135472 - DNA, 22 bp, Artificial Sequence
  chemically synthesized
gaaaccagcctggtcaacatgg

SEQ ID NO: 1135473 - DNA, 22 bp, Artificial Sequence
  chemically synthesized
caccatgttgaccaggctggtt

SEQ ID NO: 1135474 - DNA, 22 bp, Artificial Sequence
  chemically synthesized
accatgttgaccaggctggttt

SEQ ID NO: 1135475 - DNA, 22 bp, Artificial Sequence
  chemically synthesized
aggtcaggagtttgaaaccagc

SEQ ID NO: 1135476 - DNA, 22 bp, Artificial Sequence
  chemically synthesized
accaggctggtttcaaactcct

SEQ ID NO: 1135477 - DNA, 22 bp, Artificial Sequence
  chemically synthesized
gtttcaaactcctgacctcaga

SEQ ID NO: 1135478 - DNA, 22 bp, Artificial Sequence
  chemically synthesized
caaactcctgacctcagatgat

SEQ ID NO: 1135479 - DNA, 22 bp, Artificial Sequence
  chemically synthesized
aaactcctgacctcagatgatt

SEQ ID NO: 1135480 - DNA, 22 bp, Artificial Sequence
  chemically synthesized
ggaggacaaggcaggcaaatca

SEQ ID NO: 1135481 - DNA, 22 bp, Artificial Sequence
  chemically synthesized
ctgacctcagatgatttgcctg

SEQ ID NO: 1135482 - DNA, 22 bp, Artificial Sequence
  chemically synthesized
gggaggacaaggcaggcaaatc

SEQ ID NO: 1135483 - DNA, 22 bp, Artificial Sequence
  chemically synthesized
tgggaggacaaggcaggcaaat

SEQ ID NO: 1135484 - DNA, 22 bp, Artificial Sequence
  chemically synthesized
acctcagatgatttgcctgcct

SEQ ID NO: 1135485 - DNA, 22 bp, Artificial Sequence
  chemically synthesized
agatgatttgcctgccttgtcc

SEQ ID NO: 1135486 - DNA, 22 bp, Artificial Sequence
  chemically synthesized
taatcccagtactttgggagga

SEQ ID NO: 1135487 - DNA, 22 bp, Artificial Sequence
  chemically synthesized
gtaatcccagtactttgggagg

SEQ ID NO: 1135488 - DNA, 22 bp, Artificial Sequence
  chemically synthesized
gcctgccttgtcctcccaaagt

SEQ ID NO: 1135489 - DNA, 22 bp, Artificial Sequence
  chemically synthesized
cctgccttgtcctcccaaagta

SEQ ID NO: 1135490 - DNA, 22 bp, Artificial Sequence
  chemically synthesized
ccttgtcctcccaaagtactgg

SEQ ID NO: 1135491 - DNA, 22 bp, Artificial Sequence
  chemically synthesized
acacttgtaatcccagtacttt

SEQ ID NO: 1135492 - DNA, 22 bp, Artificial Sequence
  chemically synthesized
gtcctcccaaagtactgggatt

SEQ ID NO: 1135493 - DNA, 22 bp, Artificial Sequence
  chemically synthesized
tcctcccaaagtactgggatta

SEQ ID NO: 1135494 - DNA, 22 bp, Artificial Sequence
  chemically synthesized
ccaaagtactgggattacaagt

SEQ ID NO: 1135495 - DNA, 22 bp, Artificial Sequence
  chemically synthesized
accgagtgtggtggctcacact

SEQ ID NO: 1135496 - DNA, 22 bp, Artificial Sequence
  chemically synthesized
ggattacaagtgtgagccacca

SEQ ID NO: 1135497 - DNA, 22 bp, Artificial Sequence
  chemically synthesized
aagttgaccgagtgtggtggct

SEQ ID NO: 1135498 - DNA, 22 bp, Artificial Sequence
  chemically synthesized
gaagttgaccgagtgtggtggc

SEQ ID NO: 1135499 - DNA, 22 bp, Artificial Sequence
  chemically synthesized
caagtgtgagccaccacactcg

SEQ ID NO: 1135500 - DNA, 22 bp, Artificial Sequence
  chemically synthesized
gaaaaatttgaagttgaccgag

SEQ ID NO: 1135501 - DNA, 22 bp, Artificial Sequence
  chemically synthesized
ttagaaaaatttgaagttgacc

SEQ ID NO: 1135502 - DNA, 22 bp, Artificial Sequence
  chemically synthesized
attagaaaaatttgaagttgac

SEQ ID NO: 1135503 - DNA, 22 bp, Artificial Sequence
  chemically synthesized
tattagaaaaatttgaagttga

SEQ ID NO: 1135504 - DNA, 22 bp, Artificial Sequence
  chemically synthesized
aagttttattagaaaaatttga

SEQ ID NO: 1135505 - DNA, 22 bp, Artificial Sequence
  chemically synthesized
ggtcaacttcaaatttttctaa

SEQ ID NO: 1135506 - DNA, 22 bp, Artificial Sequence
  chemically synthesized
aggttaaagttttattagaaaa

SEQ ID NO: 1135507 - DNA, 22 bp, Artificial Sequence
  chemically synthesized
ctcaggttaaagttttattaga

SEQ ID NO: 1135508 - DNA, 22 bp, Artificial Sequence
  chemically synthesized
caaatttttctaataaaacttt

SEQ ID NO: 1135509 - DNA, 22 bp, Artificial Sequence
  chemically synthesized
aaatttttctaataaaacttta

SEQ ID NO: 1135510 - DNA, 22 bp, Artificial Sequence
  chemically synthesized
ggtaattcctcaggttaaagtt

SEQ ID NO: 1135511 - DNA, 22 bp, Artificial Sequence
  chemically synthesized
gggtaattcctcaggttaaagt

SEQ ID NO: 1135512 - DNA, 22 bp, Artificial Sequence
  chemically synthesized
tgggtaattcctcaggttaaag

SEQ ID NO: 1135513 - DNA, 22 bp, Artificial Sequence
  chemically synthesized
ttctaataaaactttaacctga

SEQ ID NO: 1135514 - DNA, 22 bp, Artificial Sequence
  chemically synthesized
tctaataaaactttaacctgag

SEQ ID NO: 1135515 - DNA, 22 bp, Artificial Sequence
  chemically synthesized
ctaataaaactttaacctgagg

SEQ ID NO: 1135516 - DNA, 22 bp, Artificial Sequence
  chemically synthesized
taataaaactttaacctgagga

SEQ ID NO: 1135517 - DNA, 22 bp, Artificial Sequence
  chemically synthesized
ataaaactttaacctgaggaat

SEQ ID NO: 1135518 - DNA, 22 bp, Artificial Sequence
  chemically synthesized
agaacatgttttgggtaattcc

SEQ ID NO: 1135519 - DNA, 22 bp, Artificial Sequence
  chemically synthesized
gagaacatgttttgggtaattc

SEQ ID NO: 1135520 - DNA, 22 bp, Artificial Sequence
  chemically synthesized
taacctgaggaattacccaaaa

SEQ ID NO: 1135521 - DNA, 22 bp, Artificial Sequence
  chemically synthesized
aacctgaggaattacccaaaac

SEQ ID NO: 1135522 - DNA, 22 bp, Artificial Sequence
  chemically synthesized
acctgaggaattacccaaaaca

SEQ ID NO: 1135523 - DNA, 22 bp, Artificial Sequence
  chemically synthesized
aatttgagaacatgttttgggt

SEQ ID NO: 1135524 - DNA, 22 bp, Artificial Sequence
  chemically synthesized
aaatttgagaacatgttttggg

SEQ ID NO: 1135525 - DNA, 22 bp, Artificial Sequence
  chemically synthesized
aggaattacccaaaacatgttc

SEQ ID NO: 1135526 - DNA, 22 bp, Artificial Sequence
  chemically synthesized
ccttaaatttgagaacatgttt

SEQ ID NO: 1135527 - DNA, 22 bp, Artificial Sequence
  chemically synthesized
actcccttaaatttgagaacat

SEQ ID NO: 1135528 - DNA, 22 bp, Artificial Sequence
  chemically synthesized
cccaaaacatgttctcaaattt

SEQ ID NO: 1135529 - DNA, 22 bp, Artificial Sequence
  chemically synthesized
aggtcatagaattaactccctt

SEQ ID NO: 1135530 - DNA, 22 bp, Artificial Sequence
  chemically synthesized
aaggtcatagaattaactccct

SEQ ID NO: 1135531 - DNA, 22 bp, Artificial Sequence
  chemically synthesized
tcaaatttaagggagttaattc

SEQ ID NO: 1135532 - DNA, 22 bp, Artificial Sequence
  chemically synthesized
cttaaggtcatagaattaactc

SEQ ID NO: 1135533 - DNA, 22 bp, Artificial Sequence
  chemically synthesized
acttaaggtcatagaattaact

SEQ ID NO: 1135534 - DNA, 22 bp, Artificial Sequence
  chemically synthesized
aaatttaagggagttaattcta

SEQ ID NO: 1135535 - DNA, 22 bp, Artificial Sequence
  chemically synthesized
ttacttaaggtcatagaattaa

SEQ ID NO: 1135536 - DNA, 22 bp, Artificial Sequence
  chemically synthesized
cttacttaaggtcatagaatta

SEQ ID NO: 1135537 - DNA, 22 bp, Artificial Sequence
  chemically synthesized
cttcttacttaaggtcatagaa

SEQ ID NO: 1135538 - DNA, 22 bp, Artificial Sequence
  chemically synthesized
aagggagttaattctatgacct

SEQ ID NO: 1135539 - DNA, 22 bp, Artificial Sequence
  chemically synthesized
ccttcttacttaaggtcataga

SEQ ID NO: 1135540 - DNA, 22 bp, Artificial Sequence
  chemically synthesized
agggagttaattctatgacctt

SEQ ID NO: 1135541 - DNA, 22 bp, Artificial Sequence
  chemically synthesized
tgtttccttcttacttaaggtc

SEQ ID NO: 1135542 - DNA, 22 bp, Artificial Sequence
  chemically synthesized
gtgtttccttcttacttaaggt

SEQ ID NO: 1135543 - DNA, 22 bp, Artificial Sequence
  chemically synthesized
tgtgtttccttcttacttaagg

SEQ ID NO: 1135544 - DNA, 22 bp, Artificial Sequence
  chemically synthesized
attctatgaccttaagtaagaa

SEQ ID NO: 1135545 - DNA, 22 bp, Artificial Sequence
  chemically synthesized
ttttgtgtttccttcttactta

SEQ ID NO: 1135546 - DNA, 22 bp, Artificial Sequence
  chemically synthesized
attttgtgtttccttcttactt

SEQ ID NO: 1135547 - DNA, 22 bp, Artificial Sequence
  chemically synthesized
tatgaccttaagtaagaaggaa

SEQ ID NO: 1135548 - DNA, 22 bp, Artificial Sequence
  chemically synthesized
cttattttgtgtttccttctta

SEQ ID NO: 1135549 - DNA, 22 bp, Artificial Sequence
  chemically synthesized
acttattttgtgtttccttctt

SEQ ID NO: 1135550 - DNA, 22 bp, Artificial Sequence
  chemically synthesized
tgaccttaagtaagaaggaaac

SEQ ID NO: 1135551 - DNA, 22 bp, Artificial Sequence
  chemically synthesized
aagtaagaaggaaacacaaaat

SEQ ID NO: 1135552 - DNA, 22 bp, Artificial Sequence
  chemically synthesized
agtaagaaggaaacacaaaata

SEQ ID NO: 1135553 - DNA, 22 bp, Artificial Sequence
  chemically synthesized
aaataaaaataccttacttatt

SEQ ID NO: 1135554 - DNA, 22 bp, Artificial Sequence
  chemically synthesized
gaattaaaataaaaatacctta

SEQ ID NO: 1135555 - DNA, 22 bp, Artificial Sequence
  chemically synthesized
aaatctggaattaaaataaaaa

SEQ ID NO: 1135556 - DNA, 22 bp, Artificial Sequence
  chemically synthesized
aaaatctggaattaaaataaaa

SEQ ID NO: 1135557 - DNA, 22 bp, Artificial Sequence
  chemically synthesized
taaaatctggaattaaaataaa

SEQ ID NO: 1135558 - DNA, 22 bp, Artificial Sequence
  chemically synthesized
ttaaaatctggaattaaaataa

SEQ ID NO: 1135559 - DNA, 22 bp, Artificial Sequence
  chemically synthesized
tttaaaatctggaattaaaata

SEQ ID NO: 1135560 - DNA, 22 bp, Artificial Sequence
  chemically synthesized
ttattttaattccagattttaa

SEQ ID NO: 1135561 - DNA, 22 bp, Artificial Sequence
  chemically synthesized
tattttaattccagattttaaa

SEQ ID NO: 1135562 - DNA, 22 bp, Artificial Sequence
  chemically synthesized
attttaattccagattttaaaa

SEQ ID NO: 1135563 - DNA, 22 bp, Artificial Sequence
  chemically synthesized
ttttaattccagattttaaaaa

SEQ ID NO: 1135564 - DNA, 22 bp, Artificial Sequence
  chemically synthesized
aaaaagaaaataattttttaaa

SEQ ID NO: 1135565 - DNA, 22 bp, Artificial Sequence
  chemically synthesized
taattccagattttaaaaaatt

SEQ ID NO: 1135566 - DNA, 22 bp, Artificial Sequence
  chemically synthesized
aattccagattttaaaaaatta

SEQ ID NO: 1135567 - DNA, 22 bp, Artificial Sequence
  chemically synthesized
attccagattttaaaaaattat

SEQ ID NO: 1135568 - DNA, 22 bp, Artificial Sequence
  chemically synthesized
cagattttaaaaaattattttc

SEQ ID NO: 1135569 - DNA, 22 bp, Artificial Sequence
  chemically synthesized
atgccaattaaaaaagaaaata

SEQ ID NO: 1135570 - DNA, 22 bp, Artificial Sequence
  chemically synthesized
taaaaaattattttctttttta

SEQ ID NO: 1135571 - DNA, 22 bp, Artificial Sequence
  chemically synthesized
aaaaaattattttcttttttaa

SEQ ID NO: 1135572 - DNA, 22 bp, Artificial Sequence
  chemically synthesized
aaaaattattttcttttttaat

SEQ ID NO: 1135573 - DNA, 22 bp, Artificial Sequence
  chemically synthesized
gtaagcctgatgccaattaaaa

SEQ ID NO: 1135574 - DNA, 22 bp, Artificial Sequence
  chemically synthesized
ttttcttttttaattggcatca

SEQ ID NO: 1135575 - DNA, 22 bp, Artificial Sequence
  chemically synthesized
tcttttttaattggcatcaggc

SEQ ID NO: 1135576 - DNA, 22 bp, Artificial Sequence
  chemically synthesized
cacgactagtaagcctgatgcc

SEQ ID NO: 1135577 - DNA, 22 bp, Artificial Sequence
  chemically synthesized
cttttttaattggcatcaggct

SEQ ID NO: 1135578 - DNA, 22 bp, Artificial Sequence
  chemically synthesized
ttttttaattggcatcaggctt

SEQ ID NO: 1135579 - DNA, 22 bp, Artificial Sequence
  chemically synthesized
tccacgactagtaagcctgatg

SEQ ID NO: 1135580 - DNA, 22 bp, Artificial Sequence
  chemically synthesized
ttttaattggcatcaggcttac

SEQ ID NO: 1135581 - DNA, 22 bp, Artificial Sequence
  chemically synthesized
tttaattggcatcaggcttact

SEQ ID NO: 1135582 - DNA, 22 bp, Artificial Sequence
  chemically synthesized
ttaattggcatcaggcttacta

SEQ ID NO: 1135583 - DNA, 22 bp, Artificial Sequence
  chemically synthesized
taattggcatcaggcttactag

SEQ ID NO: 1135584 - DNA, 22 bp, Artificial Sequence
  chemically synthesized
aattggcatcaggcttactagt

SEQ ID NO: 1135585 - DNA, 22 bp, Artificial Sequence
  chemically synthesized
attggcatcaggcttactagtc

SEQ ID NO: 1135586 - DNA, 22 bp, Artificial Sequence
  chemically synthesized
aaagctctccacgactagtaag

SEQ ID NO: 1135587 - DNA, 22 bp, Artificial Sequence
  chemically synthesized
ctgaaagctctccacgactagt

SEQ ID NO: 1135588 - DNA, 22 bp, Artificial Sequence
  chemically synthesized
gcatcaggcttactagtcgtgg

SEQ ID NO: 1135589 - DNA, 22 bp, Artificial Sequence
  chemically synthesized
cctgaaagctctccacgactag

SEQ ID NO: 1135590 - DNA, 22 bp, Artificial Sequence
  chemically synthesized
cttcctgaaagctctccacgac

SEQ ID NO: 1135591 - DNA, 22 bp, Artificial Sequence
  chemically synthesized
attgcttcctgaaagctctcca

SEQ ID NO: 1135592 - DNA, 22 bp, Artificial Sequence
  chemically synthesized
cattgcttcctgaaagctctcc

SEQ ID NO: 1135593 - DNA, 22 bp, Artificial Sequence
  chemically synthesized
tcattgcttcctgaaagctctc

SEQ ID NO: 1135594 - DNA, 22 bp, Artificial Sequence
  chemically synthesized
ttcattgcttcctgaaagctct

SEQ ID NO: 1135595 - DNA, 22 bp, Artificial Sequence
  chemically synthesized
actagtcgtggagagctttcag

SEQ ID NO: 1135596 - DNA, 22 bp, Artificial Sequence
  chemically synthesized
ctagtcgtggagagctttcagg

SEQ ID NO: 1135597 - DNA, 22 bp, Artificial Sequence
  chemically synthesized
gtcgtggagagctttcaggaag

SEQ ID NO: 1135598 - DNA, 22 bp, Artificial Sequence
  chemically synthesized
aaagaccttttcattgcttcct

SEQ ID NO: 1135599 - DNA, 22 bp, Artificial Sequence
  chemically synthesized
aaaagaccttttcattgcttcc

SEQ ID NO: 1135600 - DNA, 22 bp, Artificial Sequence
  chemically synthesized
tttaaaagaccttttcattgct

SEQ ID NO: 1135601 - DNA, 22 bp, Artificial Sequence
  chemically synthesized
atttaaaagaccttttcattgc

SEQ ID NO: 1135602 - DNA, 22 bp, Artificial Sequence
  chemically synthesized
tatttaaaagaccttttcattg

SEQ ID NO: 1135603 - DNA, 22 bp, Artificial Sequence
  chemically synthesized
ttatttaaaagaccttttcatt

SEQ ID NO: 1135604 - DNA, 22 bp, Artificial Sequence
  chemically synthesized
tttatttaaaagaccttttcat

SEQ ID NO: 1135605 - DNA, 22 bp, Artificial Sequence
  chemically synthesized
tcaggaagcaatgaaaaggtct

SEQ ID NO: 1135606 - DNA, 22 bp, Artificial Sequence
  chemically synthesized
caggaagcaatgaaaaggtctt

SEQ ID NO: 1135607 - DNA, 22 bp, Artificial Sequence
  chemically synthesized
aggaagcaatgaaaaggtcttt

SEQ ID NO: 1135608 - DNA, 22 bp, Artificial Sequence
  chemically synthesized
aggctttttatttaaaagacct

SEQ ID NO: 1135609 - DNA, 22 bp, Artificial Sequence
  chemically synthesized
taaggctttttatttaaaagac

SEQ ID NO: 1135610 - DNA, 22 bp, Artificial Sequence
  chemically synthesized
aaaatactctaaggctttttat

SEQ ID NO: 1135611 - DNA, 22 bp, Artificial Sequence
  chemically synthesized
attaaaaatactctaaggcttt

SEQ ID NO: 1135612 - DNA, 22 bp, Artificial Sequence
  chemically synthesized
aattaaaaatactctaaggctt

SEQ ID NO: 1135613 - DNA, 22 bp, Artificial Sequence
  chemically synthesized
ttaaataaaaagccttagagta

SEQ ID NO: 1135614 - DNA, 22 bp, Artificial Sequence
  chemically synthesized
taaataaaaagccttagagtat

SEQ ID NO: 1135615 - DNA, 22 bp, Artificial Sequence
  chemically synthesized
aaataaaaagccttagagtatt

SEQ ID NO: 1135616 - DNA, 22 bp, Artificial Sequence
  chemically synthesized
aataaaaagccttagagtattt

SEQ ID NO: 1135617 - DNA, 22 bp, Artificial Sequence
  chemically synthesized
gccagtaagtttaattaaaaat

SEQ ID NO: 1135618 - DNA, 22 bp, Artificial Sequence
  chemically synthesized
ggccagtaagtttaattaaaaa

SEQ ID NO: 1135619 - DNA, 22 bp, Artificial Sequence
  chemically synthesized
tggccagtaagtttaattaaaa

SEQ ID NO: 1135620 - DNA, 22 bp, Artificial Sequence
  chemically synthesized
ttggccagtaagtttaattaaa

SEQ ID NO: 1135621 - DNA, 22 bp, Artificial Sequence
  chemically synthesized
tttggccagtaagtttaattaa

SEQ ID NO: 1135622 - DNA, 22 bp, Artificial Sequence
  chemically synthesized
ttttggccagtaagtttaatta

SEQ ID NO: 1135623 - DNA, 22 bp, Artificial Sequence
  chemically synthesized
agagtatttttaattaaactta

SEQ ID NO: 1135624 - DNA, 22 bp, Artificial Sequence
  chemically synthesized
ttttttggccagtaagtttaat

SEQ ID NO: 1135625 - DNA, 22 bp, Artificial Sequence
  chemically synthesized
gagtatttttaattaaacttac

SEQ ID NO: 1135626 - DNA, 22 bp, Artificial Sequence
  chemically synthesized
cttttttggccagtaagtttaa

SEQ ID NO: 1135627 - DNA, 22 bp, Artificial Sequence
  chemically synthesized
ttcttttttggccagtaagttt

SEQ ID NO: 1135628 - DNA, 22 bp, Artificial Sequence
  chemically synthesized
tcttcttttttggccagtaagt

SEQ ID NO: 1135629 - DNA, 22 bp, Artificial Sequence
  chemically synthesized
ttaattaaacttactggccaaa

SEQ ID NO: 1135630 - DNA, 22 bp, Artificial Sequence
  chemically synthesized
cctctcttcttttttggccagt

SEQ ID NO: 1135631 - DNA, 22 bp, Artificial Sequence
  chemically synthesized
taattaaacttactggccaaaa

SEQ ID NO: 1135632 - DNA, 22 bp, Artificial Sequence
  chemically synthesized
gcctctcttcttttttggccag

SEQ ID NO: 1135633 - DNA, 22 bp, Artificial Sequence
  chemically synthesized
aattaaacttactggccaaaaa

SEQ ID NO: 1135634 - DNA, 22 bp, Artificial Sequence
  chemically synthesized
attaaacttactggccaaaaaa

SEQ ID NO: 1135635 - DNA, 22 bp, Artificial Sequence
  chemically synthesized
aacttactggccaaaaaagaag

SEQ ID NO: 1135636 - DNA, 22 bp, Artificial Sequence
  chemically synthesized
caaatggtttgcctctcttctt

SEQ ID NO: 1135637 - DNA, 22 bp, Artificial Sequence
  chemically synthesized
actggccaaaaaagaagagagg

SEQ ID NO: 1135638 - DNA, 22 bp, Artificial Sequence
  chemically synthesized
ctggccaaaaaagaagagaggc

SEQ ID NO: 1135639 - DNA, 22 bp, Artificial Sequence
  chemically synthesized
gccaaaaaagaagagaggcaaa

SEQ ID NO: 1135640 - DNA, 22 bp, Artificial Sequence
  chemically synthesized
tacaagggggatatagttgcaa

SEQ ID NO: 1135641 - DNA, 22 bp, Artificial Sequence
  chemically synthesized
gtacaagggggatatagttgca

SEQ ID NO: 1135642 - DNA, 22 bp, Artificial Sequence
  chemically synthesized
tgtacaagggggatatagttgc

SEQ ID NO: 1135643 - DNA, 22 bp, Artificial Sequence
  chemically synthesized
tttgtacaagggggatatagtt

SEQ ID NO: 1135644 - DNA, 22 bp, Artificial Sequence
  chemically synthesized
tagacctctttgtacaaggggg

SEQ ID NO: 1135645 - DNA, 22 bp, Artificial Sequence
  chemically synthesized
gtagacctctttgtacaagggg

SEQ ID NO: 1135646 - DNA, 22 bp, Artificial Sequence
  chemically synthesized
gcaactatatcccccttgtaca

SEQ ID NO: 1135647 - DNA, 22 bp, Artificial Sequence
  chemically synthesized
tgtagacctctttgtacaaggg

SEQ ID NO: 1135648 - DNA, 22 bp, Artificial Sequence
  chemically synthesized
caactatatcccccttgtacaa

SEQ ID NO: 1135649 - DNA, 22 bp, Artificial Sequence
  chemically synthesized
tatcccccttgtacaaagaggt

SEQ ID NO: 1135650 - DNA, 22 bp, Artificial Sequence
  chemically synthesized
agagcatcattttgtagacctc

SEQ ID NO: 1135651 - DNA, 22 bp, Artificial Sequence
  chemically synthesized
tcagagcatcattttgtagacc

SEQ ID NO: 1135652 - DNA, 22 bp, Artificial Sequence
  chemically synthesized
gtacaaagaggtctacaaaatg

SEQ ID NO: 1135653 - DNA, 22 bp, Artificial Sequence
  chemically synthesized
tacaaagaggtctacaaaatga

SEQ ID NO: 1135654 - DNA, 22 bp, Artificial Sequence
  chemically synthesized
tacccattctcagagcatcatt

SEQ ID NO: 1135655 - DNA, 22 bp, Artificial Sequence
  chemically synthesized
gctgtacccattctcagagcat

SEQ ID NO: 1135656 - DNA, 22 bp, Artificial Sequence
  chemically synthesized
tggctgtacccattctcagagc

SEQ ID NO: 1135657 - DNA, 22 bp, Artificial Sequence
  chemically synthesized
caaaatgatgctctgagaatgg

SEQ ID NO: 1135658 - DNA, 22 bp, Artificial Sequence
  chemically synthesized
acgttctggctgtacccattct

SEQ ID NO: 1135659 - DNA, 22 bp, Artificial Sequence
  chemically synthesized
tgttcacgttctggctgtaccc

SEQ ID NO: 1135660 - DNA, 22 bp, Artificial Sequence
  chemically synthesized
atgttcacgttctggctgtacc

SEQ ID NO: 1135661 - DNA, 22 bp, Artificial Sequence
  chemically synthesized
tatgttcacgttctggctgtac

SEQ ID NO: 1135662 - DNA, 22 bp, Artificial Sequence
  chemically synthesized
tgagaatgggtacagccagaac

SEQ ID NO: 1135663 - DNA, 22 bp, Artificial Sequence
  chemically synthesized
agaatgggtacagccagaacgt

SEQ ID NO: 1135664 - DNA, 22 bp, Artificial Sequence
  chemically synthesized
ataaaatattttatgttcacgt

SEQ ID NO: 1135665 - DNA, 22 bp, Artificial Sequence
  chemically synthesized
cataaaatattttatgttcacg

SEQ ID NO: 1135666 - DNA, 22 bp, Artificial Sequence
  chemically synthesized
acccttcataaaatattttatg

SEQ ID NO: 1135667 - DNA, 22 bp, Artificial Sequence
  chemically synthesized
aacccttcataaaatattttat

SEQ ID NO: 1135668 - DNA, 22 bp, Artificial Sequence
  chemically synthesized
taacccttcataaaatatttta

SEQ ID NO: 1135669 - DNA, 22 bp, Artificial Sequence
  chemically synthesized
ttttaacccttcataaaatatt

SEQ ID NO: 1135670 - DNA, 22 bp, Artificial Sequence
  chemically synthesized
tattttaacccttcataaaata

SEQ ID NO: 1135671 - DNA, 22 bp, Artificial Sequence
  chemically synthesized
aagatcctctattttaaccctt

SEQ ID NO: 1135672 - DNA, 22 bp, Artificial Sequence
  chemically synthesized
aaagatcctctattttaaccct

SEQ ID NO: 1135673 - DNA, 22 bp, Artificial Sequence
  chemically synthesized
taaagatcctctattttaaccc

SEQ ID NO: 1135674 - DNA, 22 bp, Artificial Sequence
  chemically synthesized
tttaaagatcctctattttaac

SEQ ID NO: 1135675 - DNA, 22 bp, Artificial Sequence
  chemically synthesized
tatgaagggttaaaatagagga

SEQ ID NO: 1135676 - DNA, 22 bp, Artificial Sequence
  chemically synthesized
attctttaaagatcctctattt

SEQ ID NO: 1135677 - DNA, 22 bp, Artificial Sequence
  chemically synthesized
atgaagggttaaaatagaggat

SEQ ID NO: 1135678 - DNA, 22 bp, Artificial Sequence
  chemically synthesized
tgaagggttaaaatagaggatc

SEQ ID NO: 1135679 - DNA, 22 bp, Artificial Sequence
  chemically synthesized
tcattctttaaagatcctctat

SEQ ID NO: 1135680 - DNA, 22 bp, Artificial Sequence
  chemically synthesized
attctcattctttaaagatcct

SEQ ID NO: 1135681 - DNA, 22 bp, Artificial Sequence
  chemically synthesized
agttaattctcattctttaaag

SEQ ID NO: 1135682 - DNA, 22 bp, Artificial Sequence
  chemically synthesized
aaatagaggatctttaaagaat

SEQ ID NO: 1135683 - DNA, 22 bp, Artificial Sequence
  chemically synthesized
tgagttaattctcattctttaa

SEQ ID NO: 1135684 - DNA, 22 bp, Artificial Sequence
  chemically synthesized
ctgagttaattctcattcttta

SEQ ID NO: 1135685 - DNA, 22 bp, Artificial Sequence
  chemically synthesized
tctgagttaattctcattcttt

SEQ ID NO: 1135686 - DNA, 22 bp, Artificial Sequence
  chemically synthesized
ttctgagttaattctcattctt

SEQ ID NO: 1135687 - DNA, 22 bp, Artificial Sequence
  chemically synthesized
ttttctgagttaattctcattc

SEQ ID NO: 1135688 - DNA, 22 bp, Artificial Sequence
  chemically synthesized
cttttctgagttaattctcatt

SEQ ID NO: 1135689 - DNA, 22 bp, Artificial Sequence
  chemically synthesized
ttcttttctgagttaattctca

SEQ ID NO: 1135690 - DNA, 22 bp, Artificial Sequence
  chemically synthesized
taaagaatgagaattaactcag

SEQ ID NO: 1135691 - DNA, 22 bp, Artificial Sequence
  chemically synthesized
aaagaatgagaattaactcaga

SEQ ID NO: 1135692 - DNA, 22 bp, Artificial Sequence
  chemically synthesized
aagaatgagaattaactcagaa

SEQ ID NO: 1135693 - DNA, 22 bp, Artificial Sequence
  chemically synthesized
catgttcttcttttctgagtta

SEQ ID NO: 1135694 - DNA, 22 bp, Artificial Sequence
  chemically synthesized
acatgttcttcttttctgagtt

SEQ ID NO: 1135695 - DNA, 22 bp, Artificial Sequence
  chemically synthesized
tacatgttcttcttttctgagt

SEQ ID NO: 1135696 - DNA, 22 bp, Artificial Sequence
  chemically synthesized
tttacatgttcttcttttctga

SEQ ID NO: 1135697 - DNA, 22 bp, Artificial Sequence
  chemically synthesized
ctttacatgttcttcttttctg

SEQ ID NO: 1135698 - DNA, 22 bp, Artificial Sequence
  chemically synthesized
actcagaaaagaagaacatgta

SEQ ID NO: 1135699 - DNA, 22 bp, Artificial Sequence
  chemically synthesized
agaaaagaagaacatgtaaaga

SEQ ID NO: 1135700 - DNA, 22 bp, Artificial Sequence
  chemically synthesized
tcatcttggtacattggcatat

SEQ ID NO: 1135701 - DNA, 22 bp, Artificial Sequence
  chemically synthesized
catcttggtacattggcatatt

SEQ ID NO: 1135702 - DNA, 22 bp, Artificial Sequence
  chemically synthesized
atcttggtacattggcatattt

SEQ ID NO: 1135703 - DNA, 22 bp, Artificial Sequence
  chemically synthesized
ggtacattggcatatttctatt

SEQ ID NO: 1135704 - DNA, 22 bp, Artificial Sequence
  chemically synthesized
gtacattggcatatttctattt

SEQ ID NO: 1135705 - DNA, 22 bp, Artificial Sequence
  chemically synthesized
tacccaaaatgcaaatagaaat

SEQ ID NO: 1135706 - DNA, 22 bp, Artificial Sequence
  chemically synthesized
ttatacccaaaatgcaaataga

SEQ ID NO: 1135707 - DNA, 22 bp, Artificial Sequence
  chemically synthesized
attatacccaaaatgcaaatag

SEQ ID NO: 1135708 - DNA, 22 bp, Artificial Sequence
  chemically synthesized
tattatacccaaaatgcaaata

SEQ ID NO: 1135709 - DNA, 22 bp, Artificial Sequence
  chemically synthesized
ttattatacccaaaatgcaaat

SEQ ID NO: 1135710 - DNA, 22 bp, Artificial Sequence
  chemically synthesized
tttattatacccaaaatgcaaa

SEQ ID NO: 1135711 - DNA, 22 bp, Artificial Sequence
  chemically synthesized
gcatatttctatttgcattttg

SEQ ID NO: 1135712 - DNA, 22 bp, Artificial Sequence
  chemically synthesized
ctatttgcattttgggtataat

SEQ ID NO: 1135713 - DNA, 22 bp, Artificial Sequence
  chemically synthesized
tatttgcattttgggtataata

SEQ ID NO: 1135714 - DNA, 22 bp, Artificial Sequence
  chemically synthesized
tttgcattttgggtataataaa

SEQ ID NO: 1135715 - DNA, 22 bp, Artificial Sequence
  chemically synthesized
gcattttgggtataataaaaag

SEQ ID NO: 1135716 - DNA, 22 bp, Artificial Sequence
  chemically synthesized
cattttgggtataataaaaagc

SEQ ID NO: 1135717 - DNA, 22 bp, Artificial Sequence
  chemically synthesized
taaatgataagccagtgctttt

SEQ ID NO: 1135718 - DNA, 22 bp, Artificial Sequence
  chemically synthesized
tgggtataataaaaagcactgg

SEQ ID NO: 1135719 - DNA, 22 bp, Artificial Sequence
  chemically synthesized
gggtataataaaaagcactggc

SEQ ID NO: 1135720 - DNA, 22 bp, Artificial Sequence
  chemically synthesized
ggtataataaaaagcactggct

SEQ ID NO: 1135721 - DNA, 22 bp, Artificial Sequence
  chemically synthesized
gcttatcatttacagctatgtt

SEQ ID NO: 1135722 - DNA, 22 bp, Artificial Sequence
  chemically synthesized
atcatttacagctatgttttat

SEQ ID NO: 1135723 - DNA, 22 bp, Artificial Sequence
  chemically synthesized
tcaaatagtaatataaaacata

SEQ ID NO: 1135724 - DNA, 22 bp, Artificial Sequence
  chemically synthesized
tcatttacagctatgttttata

SEQ ID NO: 1135725 - DNA, 22 bp, Artificial Sequence
  chemically synthesized
ctatcaaatagtaatataaaac

SEQ ID NO: 1135726 - DNA, 22 bp, Artificial Sequence
  chemically synthesized
acagctatgttttatattacta

SEQ ID NO: 1135727 - DNA, 22 bp, Artificial Sequence
  chemically synthesized
cagctatgttttatattactat

SEQ ID NO: 1135728 - DNA, 22 bp, Artificial Sequence
  chemically synthesized
aaactcctatcaaatagtaata

SEQ ID NO: 1135729 - DNA, 22 bp, Artificial Sequence
  chemically synthesized
aaaactcctatcaaatagtaat

SEQ ID NO: 1135730 - DNA, 22 bp, Artificial Sequence
  chemically synthesized
tgttttatattactatttgata

SEQ ID NO: 1135731 - DNA, 22 bp, Artificial Sequence
  chemically synthesized
tatattactatttgataggagt

SEQ ID NO: 1135732 - DNA, 22 bp, Artificial Sequence
  chemically synthesized
atattactatttgataggagtt

SEQ ID NO: 1135733 - DNA, 22 bp, Artificial Sequence
  chemically synthesized
tattactatttgataggagttt

SEQ ID NO: 1135734 - DNA, 22 bp, Artificial Sequence
  chemically synthesized
atgggagatttaaaactcctat

SEQ ID NO: 1135735 - DNA, 22 bp, Artificial Sequence
  chemically synthesized
ctatttgataggagttttaaat

SEQ ID NO: 1135736 - DNA, 22 bp, Artificial Sequence
  chemically synthesized
tttgataggagttttaaatctc

SEQ ID NO: 1135737 - DNA, 22 bp, Artificial Sequence
  chemically synthesized
gataggagttttaaatctccca

SEQ ID NO: 1135738 - DNA, 22 bp, Artificial Sequence
  chemically synthesized
ataggagttttaaatctcccat

SEQ ID NO: 1135739 - DNA, 22 bp, Artificial Sequence
  chemically synthesized
ccgaagcaagcacctgatggga

SEQ ID NO: 1135740 - DNA, 22 bp, Artificial Sequence
  chemically synthesized
taaatctcccatcaggtgcttg

SEQ ID NO: 1135741 - DNA, 22 bp, Artificial Sequence
  chemically synthesized
aaatctcccatcaggtgcttgc

SEQ ID NO: 1135742 - DNA, 22 bp, Artificial Sequence
  chemically synthesized
aatctcccatcaggtgcttgct

SEQ ID NO: 1135743 - DNA, 22 bp, Artificial Sequence
  chemically synthesized
tgtgtgctgccgaagcaagcac

SEQ ID NO: 1135744 - DNA, 22 bp, Artificial Sequence
  chemically synthesized
ttatgtgtgctgccgaagcaag

SEQ ID NO: 1135745 - DNA, 22 bp, Artificial Sequence
  chemically synthesized
attatgtgtgctgccgaagcaa

SEQ ID NO: 1135746 - DNA, 22 bp, Artificial Sequence
  chemically synthesized
ccatcaggtgcttgcttcggca

SEQ ID NO: 1135747 - DNA, 22 bp, Artificial Sequence
  chemically synthesized
atgagagatttattatgtgtgc

SEQ ID NO: 1135748 - DNA, 22 bp, Artificial Sequence
  chemically synthesized
gcttcggcagcacacataataa

SEQ ID NO: 1135749 - DNA, 22 bp, Artificial Sequence
  chemically synthesized
cttcggcagcacacataataaa

SEQ ID NO: 1135750 - DNA, 22 bp, Artificial Sequence
  chemically synthesized
cggcagcacacataataaatct

SEQ ID NO: 1135751 - DNA, 22 bp, Artificial Sequence
  chemically synthesized
tatcctgatgagagatttatta

SEQ ID NO: 1135752 - DNA, 22 bp, Artificial Sequence
  chemically synthesized
ggcagcacacataataaatctc

SEQ ID NO: 1135753 - DNA, 22 bp, Artificial Sequence
  chemically synthesized
tatcatctatatcctgatgaga

SEQ ID NO: 1135754 - DNA, 22 bp, Artificial Sequence
  chemically synthesized
tatatcatctatatcctgatga

SEQ ID NO: 1135755 - DNA, 22 bp, Artificial Sequence
  chemically synthesized
ctatatcatctatatcctgatg

SEQ ID NO: 1135756 - DNA, 22 bp, Artificial Sequence
  chemically synthesized
tgtgtaccttctatatcatcta

SEQ ID NO: 1135757 - DNA, 22 bp, Artificial Sequence
  chemically synthesized
tcatcaggatatagatgatata

SEQ ID NO: 1135758 - DNA, 22 bp, Artificial Sequence
  chemically synthesized
atcaggatatagatgatataga

SEQ ID NO: 1135759 - DNA, 22 bp, Artificial Sequence
  chemically synthesized
tataattatgtgtaccttctat

SEQ ID NO: 1135760 - DNA, 22 bp, Artificial Sequence
  chemically synthesized
ttatataattatgtgtaccttc

SEQ ID NO: 1135761 - DNA, 22 bp, Artificial Sequence
  chemically synthesized
aaggatgcccaaaaagagaaaa

SEQ ID NO: 1135762 - DNA, 22 bp, Artificial Sequence
  chemically synthesized
tataataatcattttctctttt

SEQ ID NO: 1135763 - DNA, 22 bp, Artificial Sequence
  chemically synthesized
cattcaaggatgcccaaaaaga

SEQ ID NO: 1135764 - DNA, 22 bp, Artificial Sequence
  chemically synthesized
tgcctacattcaaggatgccca

SEQ ID NO: 1135765 - DNA, 22 bp, Artificial Sequence
  chemically synthesized
gtgcctacattcaaggatgccc

SEQ ID NO: 1135766 - DNA, 22 bp, Artificial Sequence
  chemically synthesized
tctctttttgggcatccttgaa

SEQ ID NO: 1135767 - DNA, 22 bp, Artificial Sequence
  chemically synthesized
ctctttttgggcatccttgaat

SEQ ID NO: 1135768 - DNA, 22 bp, Artificial Sequence
  chemically synthesized
tctttttgggcatccttgaatg

SEQ ID NO: 1135769 - DNA, 22 bp, Artificial Sequence
  chemically synthesized
tttttgggcatccttgaatgta

SEQ ID NO: 1135770 - DNA, 22 bp, Artificial Sequence
  chemically synthesized
tttgggcatccttgaatgtagg

SEQ ID NO: 1135771 - DNA, 22 bp, Artificial Sequence
  chemically synthesized
tatatgtttgtgcctacattca

SEQ ID NO: 1135772 - DNA, 22 bp, Artificial Sequence
  chemically synthesized
ttgggcatccttgaatgtaggc

SEQ ID NO: 1135773 - DNA, 22 bp, Artificial Sequence
  chemically synthesized
tgggcatccttgaatgtaggca

SEQ ID NO: 1135774 - DNA, 22 bp, Artificial Sequence
  chemically synthesized
gggcatccttgaatgtaggcac

SEQ ID NO: 1135775 - DNA, 22 bp, Artificial Sequence
  chemically synthesized
ggcatccttgaatgtaggcaca

SEQ ID NO: 1135776 - DNA, 22 bp, Artificial Sequence
  chemically synthesized
tgctgtatatgtttgtgcctac

SEQ ID NO: 1135777 - DNA, 22 bp, Artificial Sequence
  chemically synthesized
atgctgtatatgtttgtgccta

SEQ ID NO: 1135778 - DNA, 22 bp, Artificial Sequence
  chemically synthesized
atgtttatgctgtatatgtttg

SEQ ID NO: 1135779 - DNA, 22 bp, Artificial Sequence
  chemically synthesized
gaatgtaggcacaaacatatac

SEQ ID NO: 1135780 - DNA, 22 bp, Artificial Sequence
  chemically synthesized
aatgtaggcacaaacatataca

SEQ ID NO: 1135781 - DNA, 22 bp, Artificial Sequence
  chemically synthesized
tacatggcagttcatgtttatg

SEQ ID NO: 1135782 - DNA, 22 bp, Artificial Sequence
  chemically synthesized
gtacatggcagttcatgtttat

SEQ ID NO: 1135783 - DNA, 22 bp, Artificial Sequence
  chemically synthesized
ttgtacatggcagttcatgttt

SEQ ID NO: 1135784 - DNA, 22 bp, Artificial Sequence
  chemically synthesized
cttgtacatggcagttcatgtt

SEQ ID NO: 1135785 - DNA, 22 bp, Artificial Sequence
  chemically synthesized
ttcttgtacatggcagttcatg

SEQ ID NO: 1135786 - DNA, 22 bp, Artificial Sequence
  chemically synthesized
cctcttcttgtacatggcagtt

SEQ ID NO: 1135787 - DNA, 22 bp, Artificial Sequence
  chemically synthesized
gcctcttcttgtacatggcagt

SEQ ID NO: 1135788 - DNA, 22 bp, Artificial Sequence
  chemically synthesized
agaatttgcctcttcttgtaca

SEQ ID NO: 1135789 - DNA, 22 bp, Artificial Sequence
  chemically synthesized
ccatgtacaagaagaggcaaat

SEQ ID NO: 1135790 - DNA, 22 bp, Artificial Sequence
  chemically synthesized
agataaaatacatatgctcaga

SEQ ID NO: 1135791 - DNA, 22 bp, Artificial Sequence
  chemically synthesized
aagataaaatacatatgctcag

SEQ ID NO: 1135792 - DNA, 22 bp, Artificial Sequence
  chemically synthesized
taagataaaatacatatgctca

SEQ ID NO: 1135793 - DNA, 22 bp, Artificial Sequence
  chemically synthesized
tttaagataaaatacatatgct

SEQ ID NO: 1135794 - DNA, 22 bp, Artificial Sequence
  chemically synthesized
tgagcatatgtattttatctta

SEQ ID NO: 1135795 - DNA, 22 bp, Artificial Sequence
  chemically synthesized
tgagcacctctttaagataaaa

SEQ ID NO: 1135796 - DNA, 22 bp, Artificial Sequence
  chemically synthesized
agcatatgtattttatcttaaa

SEQ ID NO: 1135797 - DNA, 22 bp, Artificial Sequence
  chemically synthesized
aactgtgagcacctctttaaga

SEQ ID NO: 1135798 - DNA, 22 bp, Artificial Sequence
  chemically synthesized
tcaactgtgagcacctctttaa

SEQ ID NO: 1135799 - DNA, 22 bp, Artificial Sequence
  chemically synthesized
tatcttaaagaggtgctcacag

SEQ ID NO: 1135800 - DNA, 22 bp, Artificial Sequence
  chemically synthesized
caacattctcaactgtgagcac

SEQ ID NO: 1135801 - DNA, 22 bp, Artificial Sequence
  chemically synthesized
atcttaaagaggtgctcacagt

SEQ ID NO: 1135802 - DNA, 22 bp, Artificial Sequence
  chemically synthesized
gcaacattctcaactgtgagca

SEQ ID NO: 1135803 - DNA, 22 bp, Artificial Sequence
  chemically synthesized
tcttaaagaggtgctcacagtt

SEQ ID NO: 1135804 - DNA, 22 bp, Artificial Sequence
  chemically synthesized
tgcaacattctcaactgtgagc

SEQ ID NO: 1135805 - DNA, 22 bp, Artificial Sequence
  chemically synthesized
ttgcaacattctcaactgtgag

SEQ ID NO: 1135806 - DNA, 22 bp, Artificial Sequence
  chemically synthesized
aaagaggtgctcacagttgaga

SEQ ID NO: 1135807 - DNA, 22 bp, Artificial Sequence
  chemically synthesized
aagaggtgctcacagttgagaa

SEQ ID NO: 1135808 - DNA, 22 bp, Artificial Sequence
  chemically synthesized
acaacaatttttgcaacattct

SEQ ID NO: 1135809 - DNA, 22 bp, Artificial Sequence
  chemically synthesized
ctaacaacaatttttgcaacat

SEQ ID NO: 1135810 - DNA, 22 bp, Artificial Sequence
  chemically synthesized
acagttgagaatgttgcaaaaa

SEQ ID NO: 1135811 - DNA, 22 bp, Artificial Sequence
  chemically synthesized
tattgctaacaacaatttttgc

SEQ ID NO: 1135812 - DNA, 22 bp, Artificial Sequence
  chemically synthesized
ctatattgctaacaacaatttt

SEQ ID NO: 1135813 - DNA, 22 bp, Artificial Sequence
  chemically synthesized
agaatgttgcaaaaattgttgt

SEQ ID NO: 1135814 - DNA, 22 bp, Artificial Sequence
  chemically synthesized
gctatattgctaacaacaattt

SEQ ID NO: 1135815 - DNA, 22 bp, Artificial Sequence
  chemically synthesized
tgctatattgctaacaacaatt

SEQ ID NO: 1135816 - DNA, 22 bp, Artificial Sequence
  chemically synthesized
caaaaattgttgttagcaatat

SEQ ID NO: 1135817 - DNA, 22 bp, Artificial Sequence
  chemically synthesized
tgaatattttgctatattgcta

SEQ ID NO: 1135818 - DNA, 22 bp, Artificial Sequence
  chemically synthesized
gtgaatattttgctatattgct

SEQ ID NO: 1135819 - DNA, 22 bp, Artificial Sequence
  chemically synthesized
tgtgaatattttgctatattgc

SEQ ID NO: 1135820 - DNA, 22 bp, Artificial Sequence
  chemically synthesized
ttgttagcaatatagcaaaata

SEQ ID NO: 1135821 - DNA, 22 bp, Artificial Sequence
  chemically synthesized
ccattttgtgaatattttgcta

SEQ ID NO: 1135822 - DNA, 22 bp, Artificial Sequence
  chemically synthesized
ttagcaatatagcaaaatattc

SEQ ID NO: 1135823 - DNA, 22 bp, Artificial Sequence
  chemically synthesized
attcccattttgtgaatatttt

SEQ ID NO: 1135824 - DNA, 22 bp, Artificial Sequence
  chemically synthesized
gcaatatagcaaaatattcaca

SEQ ID NO: 1135825 - DNA, 22 bp, Artificial Sequence
  chemically synthesized
aaatatctcattcccattttgt

SEQ ID NO: 1135826 - DNA, 22 bp, Artificial Sequence
  chemically synthesized
aggttcaaatatctcattccca

SEQ ID NO: 1135827 - DNA, 22 bp, Artificial Sequence
  chemically synthesized
ttaaggttcaaatatctcattc

SEQ ID NO: 1135828 - DNA, 22 bp, Artificial Sequence
  chemically synthesized
attaaggttcaaatatctcatt

SEQ ID NO: 1135829 - DNA, 22 bp, Artificial Sequence
  chemically synthesized
acaaaatgggaatgagatattt

SEQ ID NO: 1135830 - DNA, 22 bp, Artificial Sequence
  chemically synthesized
tatgacttattaaggttcaaat

SEQ ID NO: 1135831 - DNA, 22 bp, Artificial Sequence
  chemically synthesized
gaaccttaataagtcatacaac

SEQ ID NO: 1135832 - DNA, 22 bp, Artificial Sequence
  chemically synthesized
aaccttaataagtcatacaact

SEQ ID NO: 1135833 - DNA, 22 bp, Artificial Sequence
  chemically synthesized
aggaataaggaaagttgtatga

SEQ ID NO: 1135834 - DNA, 22 bp, Artificial Sequence
  chemically synthesized
tcaggaataaggaaagttgtat

SEQ ID NO: 1135835 - DNA, 22 bp, Artificial Sequence
  chemically synthesized
ctcaggaataaggaaagttgta

SEQ ID NO: 1135836 - DNA, 22 bp, Artificial Sequence
  chemically synthesized
tctcaggaataaggaaagttgt

SEQ ID NO: 1135837 - DNA, 22 bp, Artificial Sequence
  chemically synthesized
aataagtcatacaactttcctt

SEQ ID NO: 1135838 - DNA, 22 bp, Artificial Sequence
  chemically synthesized
tttctcaggaataaggaaagtt

SEQ ID NO: 1135839 - DNA, 22 bp, Artificial Sequence
  chemically synthesized
ataagtcatacaactttcctta

SEQ ID NO: 1135840 - DNA, 22 bp, Artificial Sequence
  chemically synthesized
ctttctcaggaataaggaaagt

SEQ ID NO: 1135841 - DNA, 22 bp, Artificial Sequence
  chemically synthesized
tcttctttctcaggaataagga

SEQ ID NO: 1135842 - DNA, 22 bp, Artificial Sequence
  chemically synthesized
tccttattcctgagaaagaaga

SEQ ID NO: 1135843 - DNA, 22 bp, Artificial Sequence
  chemically synthesized
ccttattcctgagaaagaagac

SEQ ID NO: 1135844 - DNA, 22 bp, Artificial Sequence
  chemically synthesized
gtagaataaattgtcttctttc

SEQ ID NO: 1135845 - DNA, 22 bp, Artificial Sequence
  chemically synthesized
cttattcctgagaaagaagaca

SEQ ID NO: 1135846 - DNA, 22 bp, Artificial Sequence
  chemically synthesized
agtagaataaattgtcttcttt

SEQ ID NO: 1135847 - DNA, 22 bp, Artificial Sequence
  chemically synthesized
tagtagaataaattgtcttctt

SEQ ID NO: 1135848 - DNA, 22 bp, Artificial Sequence
  chemically synthesized
ttagtagaataaattgtcttct

SEQ ID NO: 1135849 - DNA, 22 bp, Artificial Sequence
  chemically synthesized
attcctgagaaagaagacaatt

SEQ ID NO: 1135850 - DNA, 22 bp, Artificial Sequence
  chemically synthesized
ttcctgagaaagaagacaattt

SEQ ID NO: 1135851 - DNA, 22 bp, Artificial Sequence
  chemically synthesized
ctgagaaagaagacaatttatt

SEQ ID NO: 1135852 - DNA, 22 bp, Artificial Sequence
  chemically synthesized
tggatttttagtagaataaatt

SEQ ID NO: 1135853 - DNA, 22 bp, Artificial Sequence
  chemically synthesized
agaaagaagacaatttattcta

SEQ ID NO: 1135854 - DNA, 22 bp, Artificial Sequence
  chemically synthesized
gtggatttttagtagaataaat

SEQ ID NO: 1135855 - DNA, 22 bp, Artificial Sequence
  chemically synthesized
tgtggatttttagtagaataaa

SEQ ID NO: 1135856 - DNA, 22 bp, Artificial Sequence
  chemically synthesized
tagttttgtggatttttagtag

SEQ ID NO: 1135857 - DNA, 22 bp, Artificial Sequence
  chemically synthesized
gtagttttgtggatttttagta

SEQ ID NO: 1135858 - DNA, 22 bp, Artificial Sequence
  chemically synthesized
tgtagttttgtggatttttagt

SEQ ID NO: 1135859 - DNA, 22 bp, Artificial Sequence
  chemically synthesized
attctactaaaaatccacaaaa

SEQ ID NO: 1135860 - DNA, 22 bp, Artificial Sequence
  chemically synthesized
aaggttttgtagttttgtggat

SEQ ID NO: 1135861 - DNA, 22 bp, Artificial Sequence
  chemically synthesized
ttctactaaaaatccacaaaac

SEQ ID NO: 1135862 - DNA, 22 bp, Artificial Sequence
  chemically synthesized
tactaaaaatccacaaaactac

SEQ ID NO: 1135863 - DNA, 22 bp, Artificial Sequence
  chemically synthesized
ctaaaaatccacaaaactacaa

SEQ ID NO: 1135864 - DNA, 22 bp, Artificial Sequence
  chemically synthesized
aaaatccacaaaactacaaaac

SEQ ID NO: 1135865 - DNA, 22 bp, Artificial Sequence
  chemically synthesized
aagcgagtctaaaggttttgta

SEQ ID NO: 1135866 - DNA, 22 bp, Artificial Sequence
  chemically synthesized
caagcgagtctaaaggttttgt

SEQ ID NO: 1135867 - DNA, 22 bp, Artificial Sequence
  chemically synthesized
tcaagcgagtctaaaggttttg

SEQ ID NO: 1135868 - DNA, 22 bp, Artificial Sequence
  chemically synthesized
ttcaagcgagtctaaaggtttt

SEQ ID NO: 1135869 - DNA, 22 bp, Artificial Sequence
  chemically synthesized
tttcaagcgagtctaaaggttt

SEQ ID NO: 1135870 - DNA, 22 bp, Artificial Sequence
  chemically synthesized
ttttcaagcgagtctaaaggtt

SEQ ID NO: 1135871 - DNA, 22 bp, Artificial Sequence
  chemically synthesized
tttttcaagcgagtctaaaggt

SEQ ID NO: 1135872 - DNA, 22 bp, Artificial Sequence
  chemically synthesized
ttttttcaagcgagtctaaagg

SEQ ID NO: 1135873 - DNA, 22 bp, Artificial Sequence
  chemically synthesized
tttttttcaagcgagtctaaag

SEQ ID NO: 1135874 - DNA, 22 bp, Artificial Sequence
  chemically synthesized
caaaacctttagactcgcttga

SEQ ID NO: 1135875 - DNA, 22 bp, Artificial Sequence
  chemically synthesized
tagactcgcttgaaaaaaaaaa

SEQ ID NO: 1135876 - DNA, 22 bp, Artificial Sequence
  chemically synthesized
agactcgcttgaaaaaaaaaat

SEQ ID NO: 1135877 - DNA, 22 bp, Artificial Sequence
  chemically synthesized
gactcgcttgaaaaaaaaaata

SEQ ID NO: 1135878 - DNA, 22 bp, Artificial Sequence
  chemically synthesized
gcttgaaaaaaaaaatatatat

SEQ ID NO: 1135879 - DNA, 22 bp, Artificial Sequence
  chemically synthesized
gtgtaagcatatatatatatat

SEQ ID NO: 1135880 - DNA, 22 bp, Artificial Sequence
  chemically synthesized
ggtgtaagcatatatatatata

SEQ ID NO: 1135881 - DNA, 22 bp, Artificial Sequence
  chemically synthesized
gaaaaaaaaaatatatatatat

SEQ ID NO: 1135882 - DNA, 22 bp, Artificial Sequence
  chemically synthesized
tggtgtaagcatatatatatat

SEQ ID NO: 1135883 - DNA, 22 bp, Artificial Sequence
  chemically synthesized
aaaaaaaaaatatatatatata

SEQ ID NO: 1135884 - DNA, 22 bp, Artificial Sequence
  chemically synthesized
agtagtatataccaggtgcttt

SEQ ID NO: 1135885 - DNA, 22 bp, Artificial Sequence
  chemically synthesized
tattaagtagtatataccaggt

SEQ ID NO: 1135886 - DNA, 22 bp, Artificial Sequence
  chemically synthesized
atattaagtagtatataccagg

SEQ ID NO: 1135887 - DNA, 22 bp, Artificial Sequence
  chemically synthesized
acaccaaagcacctggtatata

SEQ ID NO: 1135888 - DNA, 22 bp, Artificial Sequence
  chemically synthesized
caccaaagcacctggtatatac

SEQ ID NO: 1135889 - DNA, 22 bp, Artificial Sequence
  chemically synthesized
atatgtaatttatattaagtag

SEQ ID NO: 1135890 - DNA, 22 bp, Artificial Sequence
  chemically synthesized
aatatgtaatttatattaagta

SEQ ID NO: 1135891 - DNA, 22 bp, Artificial Sequence
  chemically synthesized
gtatatactacttaatataaat

SEQ ID NO: 1135892 - DNA, 22 bp, Artificial Sequence
  chemically synthesized
tatttaatatgtaatttatatt

SEQ ID NO: 1135893 - DNA, 22 bp, Artificial Sequence
  chemically synthesized
ctgtatttaatatgtaatttat

SEQ ID NO: 1135894 - DNA, 22 bp, Artificial Sequence
  chemically synthesized
cttaatataaattacatattaa

SEQ ID NO: 1135895 - DNA, 22 bp, Artificial Sequence
  chemically synthesized
taattactgtatttaatatgta

SEQ ID NO: 1135896 - DNA, 22 bp, Artificial Sequence
  chemically synthesized
aatataaattacatattaaata

SEQ ID NO: 1135897 - DNA, 22 bp, Artificial Sequence
  chemically synthesized
atataaattacatattaaatac

SEQ ID NO: 1135898 - DNA, 22 bp, Artificial Sequence
  chemically synthesized
cgccataaattgtaattactgt

SEQ ID NO: 1135899 - DNA, 22 bp, Artificial Sequence
  chemically synthesized
catattaaatacagtaattaca

SEQ ID NO: 1135900 - DNA, 22 bp, Artificial Sequence
  chemically synthesized
tcatattacgccataaattgta

SEQ ID NO: 1135901 - DNA, 22 bp, Artificial Sequence
  chemically synthesized
aatacagtaattacaatttatg

SEQ ID NO: 1135902 - DNA, 22 bp, Artificial Sequence
  chemically synthesized
taattatcatattacgccataa

SEQ ID NO: 1135903 - DNA, 22 bp, Artificial Sequence
  chemically synthesized
attgtaattatcatattacgcc

SEQ ID NO: 1135904 - DNA, 22 bp, Artificial Sequence
  chemically synthesized
caatttatggcgtaatatgata

SEQ ID NO: 1135905 - DNA, 22 bp, Artificial Sequence
  chemically synthesized
gtatgctaattgtaattatcat

SEQ ID NO: 1135906 - DNA, 22 bp, Artificial Sequence
  chemically synthesized
ggtatgctaattgtaattatca

SEQ ID NO: 1135907 - DNA, 22 bp, Artificial Sequence
  chemically synthesized
atggcgtaatatgataattaca

SEQ ID NO: 1135908 - DNA, 22 bp, Artificial Sequence
  chemically synthesized
tggcgtaatatgataattacaa

SEQ ID NO: 1135909 - DNA, 22 bp, Artificial Sequence
  chemically synthesized
caatttggtatgctaattgtaa

SEQ ID NO: 1135910 - DNA, 22 bp, Artificial Sequence
  chemically synthesized
acaatttggtatgctaattgta

SEQ ID NO: 1135911 - DNA, 22 bp, Artificial Sequence
  chemically synthesized
tacaatttggtatgctaattgt

SEQ ID NO: 1135912 - DNA, 22 bp, Artificial Sequence
  chemically synthesized
gtcatatgctttacaatttggt

SEQ ID NO: 1135913 - DNA, 22 bp, Artificial Sequence
  chemically synthesized
caattagcataccaaattgtaa

SEQ ID NO: 1135914 - DNA, 22 bp, Artificial Sequence
  chemically synthesized
gcataccaaattgtaaagcata

SEQ ID NO: 1135915 - DNA, 22 bp, Artificial Sequence
  chemically synthesized
aaagggtatattagtcatatgc

SEQ ID NO: 1135916 - DNA, 22 bp, Artificial Sequence
  chemically synthesized
ttgaaagggtatattagtcata

SEQ ID NO: 1135917 - DNA, 22 bp, Artificial Sequence
  chemically synthesized
taaagcatatgactaatatacc

SEQ ID NO: 1135918 - DNA, 22 bp, Artificial Sequence
  chemically synthesized
aaatcacatgtgctgttgaaag

SEQ ID NO: 1135919 - DNA, 22 bp, Artificial Sequence
  chemically synthesized
actgaaatcacatgtgctgttg

SEQ ID NO: 1135920 - DNA, 22 bp, Artificial Sequence
  chemically synthesized
atataccctttcaacagcacat

SEQ ID NO: 1135921 - DNA, 22 bp, Artificial Sequence
  chemically synthesized
gactgaaatcacatgtgctgtt

SEQ ID NO: 1135922 - DNA, 22 bp, Artificial Sequence
  chemically synthesized
atttgactgaaatcacatgtgc

SEQ ID NO: 1135923 - DNA, 22 bp, Artificial Sequence
  chemically synthesized
ctcatttgactgaaatcacatg

SEQ ID NO: 1135924 - DNA, 22 bp, Artificial Sequence
  chemically synthesized
cctcatttgactgaaatcacat

SEQ ID NO: 1135925 - DNA, 22 bp, Artificial Sequence
  chemically synthesized
tcctcatttgactgaaatcaca

SEQ ID NO: 1135926 - DNA, 22 bp, Artificial Sequence
  chemically synthesized
tcaacagcacatgtgatttcag

SEQ ID NO: 1135927 - DNA, 22 bp, Artificial Sequence
  chemically synthesized
caacagcacatgtgatttcagt

SEQ ID NO: 1135928 - DNA, 22 bp, Artificial Sequence
  chemically synthesized
aacagcacatgtgatttcagtc

SEQ ID NO: 1135929 - DNA, 22 bp, Artificial Sequence
  chemically synthesized
ctttcctcatttgactgaaatc

SEQ ID NO: 1135930 - DNA, 22 bp, Artificial Sequence
  chemically synthesized
aagcattactttcctcatttga

SEQ ID NO: 1135931 - DNA, 22 bp, Artificial Sequence
  chemically synthesized
gaagcattactttcctcatttg

SEQ ID NO: 1135932 - DNA, 22 bp, Artificial Sequence
  chemically synthesized
cagtcaaatgaggaaagtaatg

SEQ ID NO: 1135933 - DNA, 22 bp, Artificial Sequence
  chemically synthesized
agtcaaatgaggaaagtaatgc

SEQ ID NO: 1135934 - DNA, 22 bp, Artificial Sequence
  chemically synthesized
aaatataatgtatgtgatttga

SEQ ID NO: 1135935 - DNA, 22 bp, Artificial Sequence
  chemically synthesized
aaaatataatgtatgtgatttg

SEQ ID NO: 1135936 - DNA, 22 bp, Artificial Sequence
  chemically synthesized
taaaatataatgtatgtgattt

SEQ ID NO: 1135937 - DNA, 22 bp, Artificial Sequence
  chemically synthesized
atattttaaaatataatgtatg

SEQ ID NO: 1135938 - DNA, 22 bp, Artificial Sequence
  chemically synthesized
caaatcacatacattatatttt

SEQ ID NO: 1135939 - DNA, 22 bp, Artificial Sequence
  chemically synthesized
aaatcacatacattatatttta

SEQ ID NO: 1135940 - DNA, 22 bp, Artificial Sequence
  chemically synthesized
taattaatattttaaaatataa

SEQ ID NO: 1135941 - DNA, 22 bp, Artificial Sequence
  chemically synthesized
ttataattaatattttaaaata

SEQ ID NO: 1135942 - DNA, 22 bp, Artificial Sequence
  chemically synthesized
attataattaatattttaaaat

SEQ ID NO: 1135943 - DNA, 22 bp, Artificial Sequence
  chemically synthesized
tattttaaaatattaattataa

SEQ ID NO: 1135944 - DNA, 22 bp, Artificial Sequence
  chemically synthesized
taaaatattaattataataaat

SEQ ID NO: 1135945 - DNA, 22 bp, Artificial Sequence
  chemically synthesized
aaaatattaattataataaatt

SEQ ID NO: 1135946 - DNA, 22 bp, Artificial Sequence
  chemically synthesized
aaatattaattataataaattt

SEQ ID NO: 1135947 - DNA, 22 bp, Artificial Sequence
  chemically synthesized
attataataaatttcttactat

SEQ ID NO: 1135948 - DNA, 22 bp, Artificial Sequence
  chemically synthesized
aaaaaataaatgtgatagtaag

SEQ ID NO: 1135949 - DNA, 22 bp, Artificial Sequence
  chemically synthesized
aaaaaaataaatgtgatagtaa

SEQ ID NO: 1135950 - DNA, 22 bp, Artificial Sequence
  chemically synthesized
taataaatttcttactatcaca

SEQ ID NO: 1135951 - DNA, 22 bp, Artificial Sequence
  chemically synthesized
gaacttaaaaaaataaatgtga

SEQ ID NO: 1135952 - DNA, 22 bp, Artificial Sequence
  chemically synthesized
cttactatcacatttatttttt

SEQ ID NO: 1135953 - DNA, 22 bp, Artificial Sequence
  chemically synthesized
ttactatcacatttattttttt

SEQ ID NO: 1135954 - DNA, 22 bp, Artificial Sequence
  chemically synthesized
actatcacatttatttttttaa

SEQ ID NO: 1135955 - DNA, 22 bp, Artificial Sequence
  chemically synthesized
ctatcacatttatttttttaag

SEQ ID NO: 1135956 - DNA, 22 bp, Artificial Sequence
  chemically synthesized
tcacatttatttttttaagttc

SEQ ID NO: 1135957 - DNA, 22 bp, Artificial Sequence
  chemically synthesized
atttttttaagttccagggtac

SEQ ID NO: 1135958 - DNA, 22 bp, Artificial Sequence
  chemically synthesized
tttttttaagttccagggtaca

SEQ ID NO: 1135959 - DNA, 22 bp, Artificial Sequence
  chemically synthesized
cacatccaatacgtgtaccctg

SEQ ID NO: 1135960 - DNA, 22 bp, Artificial Sequence
  chemically synthesized
ttttaagttccagggtacacgt

SEQ ID NO: 1135961 - DNA, 22 bp, Artificial Sequence
  chemically synthesized
tttaagttccagggtacacgta

SEQ ID NO: 1135962 - DNA, 22 bp, Artificial Sequence
  chemically synthesized
ttaagttccagggtacacgtat

SEQ ID NO: 1135963 - DNA, 22 bp, Artificial Sequence
  chemically synthesized
taagttccagggtacacgtatt

SEQ ID NO: 1135964 - DNA, 22 bp, Artificial Sequence
  chemically synthesized
aagttccagggtacacgtattg

SEQ ID NO: 1135965 - DNA, 22 bp, Artificial Sequence
  chemically synthesized
agttccagggtacacgtattgg

SEQ ID NO: 1135966 - DNA, 22 bp, Artificial Sequence
  chemically synthesized
cagggtacacgtattggatgtg

SEQ ID NO: 1135967 - DNA, 22 bp, Artificial Sequence
  chemically synthesized
cataacaaacctacacatccaa

SEQ ID NO: 1135968 - DNA, 22 bp, Artificial Sequence
  chemically synthesized
cctccataacaaacctacacat

SEQ ID NO: 1135969 - DNA, 22 bp, Artificial Sequence
  chemically synthesized
acctccataacaaacctacaca

SEQ ID NO: 1135970 - DNA, 22 bp, Artificial Sequence
  chemically synthesized
gatgtgtaggtttgttatggag

SEQ ID NO: 1135971 - DNA, 22 bp, Artificial Sequence
  chemically synthesized
gttatggaggtaaatgtgtgcc

SEQ ID NO: 1135972 - DNA, 22 bp, Artificial Sequence
  chemically synthesized
ttatggaggtaaatgtgtgcca

SEQ ID NO: 1135973 - DNA, 22 bp, Artificial Sequence
  chemically synthesized
tggaggtaaatgtgtgccacgg

SEQ ID NO: 1135974 - DNA, 22 bp, Artificial Sequence
  chemically synthesized
taggtgcaccataccaccgtgg

SEQ ID NO: 1135975 - DNA, 22 bp, Artificial Sequence
  chemically synthesized
atgggtctgtaggtgcaccata

SEQ ID NO: 1135976 - DNA, 22 bp, Artificial Sequence
  chemically synthesized
cctaatgggtctgtaggtgcac

SEQ ID NO: 1135977 - DNA, 22 bp, Artificial Sequence
  chemically synthesized
aatatctacctaatgggtctgt

SEQ ID NO: 1135978 - DNA, 22 bp, Artificial Sequence
  chemically synthesized
ggctcaatatctacctaatggg

SEQ ID NO: 1135979 - DNA, 22 bp, Artificial Sequence
  chemically synthesized
cagacccattaggtagatattg

SEQ ID NO: 1135980 - DNA, 22 bp, Artificial Sequence
  chemically synthesized
acggatgctgggctcaatatct

SEQ ID NO: 1135981 - DNA, 22 bp, Artificial Sequence
  chemically synthesized
ggtagatattgagcccagcatc

SEQ ID NO: 1135982 - DNA, 22 bp, Artificial Sequence
  chemically synthesized
agcccagcatccgttagctatt

SEQ ID NO: 1135983 - DNA, 22 bp, Artificial Sequence
  chemically synthesized
ggagaggaggagagcatcagga

SEQ ID NO: 1135984 - DNA, 22 bp, Artificial Sequence
  chemically synthesized
ctgggagaggaggagagcatca

SEQ ID NO: 1135985 - DNA, 22 bp, Artificial Sequence
  chemically synthesized
gctatttttcctgatgctctcc

SEQ ID NO: 1135986 - DNA, 22 bp, Artificial Sequence
  chemically synthesized
ttgctgggagaggaggagagca

SEQ ID NO: 1135987 - DNA, 22 bp, Artificial Sequence
  chemically synthesized
tttttcctgatgctctcctcct

SEQ ID NO: 1135988 - DNA, 22 bp, Artificial Sequence
  chemically synthesized
ttcctgatgctctcctcctctc

SEQ ID NO: 1135989 - DNA, 22 bp, Artificial Sequence
  chemically synthesized
tcctgatgctctcctcctctcc

SEQ ID NO: 1135990 - DNA, 22 bp, Artificial Sequence
  chemically synthesized
cctgatgctctcctcctctccc

SEQ ID NO: 1135991 - DNA, 22 bp, Artificial Sequence
  chemically synthesized
gggcctgttgctgggagaggag

SEQ ID NO: 1135992 - DNA, 22 bp, Artificial Sequence
  chemically synthesized
ctgatgctctcctcctctccca

SEQ ID NO: 1135993 - DNA, 22 bp, Artificial Sequence
  chemically synthesized
atgctctcctcctctcccagca

SEQ ID NO: 1135994 - DNA, 22 bp, Artificial Sequence
  chemically synthesized
tcctcctctcccagcaacaggc

SEQ ID NO: 1135995 - DNA, 22 bp, Artificial Sequence
  chemically synthesized
ctcctctcccagcaacaggccc

SEQ ID NO: 1135996 - DNA, 22 bp, Artificial Sequence
  chemically synthesized
ctctcccagcaacaggccccag

SEQ ID NO: 1135997 - DNA, 22 bp, Artificial Sequence
  chemically synthesized
tcccagcaacaggccccagtgt

SEQ ID NO: 1135998 - DNA, 22 bp, Artificial Sequence
  chemically synthesized
ccagcaacaggccccagtgtgt

SEQ ID NO: 1135999 - DNA, 22 bp, Artificial Sequence
  chemically synthesized
aacaatgggaacacatgggcac

SEQ ID NO: 1136000 - DNA, 22 bp, Artificial Sequence
  chemically synthesized
ttctcttccctgtgcccatgtg

SEQ ID NO: 1136001 - DNA, 22 bp, Artificial Sequence
  chemically synthesized
tcttccctgtgcccatgtgttc

SEQ ID NO: 1136002 - DNA, 22 bp, Artificial Sequence
  chemically synthesized
ttccctgtgcccatgtgttccc

SEQ ID NO: 1136003 - DNA, 22 bp, Artificial Sequence
  chemically synthesized
ccctgtgcccatgtgttcccat

SEQ ID NO: 1136004 - DNA, 22 bp, Artificial Sequence
  chemically synthesized
cctgtgcccatgtgttcccatt

SEQ ID NO: 1136005 - DNA, 22 bp, Artificial Sequence
  chemically synthesized
tgcccatgtgttcccattgttc

SEQ ID NO: 1136006 - DNA, 22 bp, Artificial Sequence
  chemically synthesized
taagtaggagctgaacaatggg

SEQ ID NO: 1136007 - DNA, 22 bp, Artificial Sequence
  chemically synthesized
ataagtaggagctgaacaatgg

SEQ ID NO: 1136008 - DNA, 22 bp, Artificial Sequence
  chemically synthesized
acttataagtaggagctgaaca

SEQ ID NO: 1136009 - DNA, 22 bp, Artificial Sequence
  chemically synthesized
tcacttataagtaggagctgaa

SEQ ID NO: 1136010 - DNA, 22 bp, Artificial Sequence
  chemically synthesized
ccattgttcagctcctacttat

SEQ ID NO: 1136011 - DNA, 22 bp, Artificial Sequence
  chemically synthesized
catgttctcacttataagtagg

SEQ ID NO: 1136012 - DNA, 22 bp, Artificial Sequence
  chemically synthesized
ttcagctcctacttataagtga

SEQ ID NO: 1136013 - DNA, 22 bp, Artificial Sequence
  chemically synthesized
agctcctacttataagtgagaa

SEQ ID NO: 1136014 - DNA, 22 bp, Artificial Sequence
  chemically synthesized
ctacttataagtgagaacatgc

SEQ ID NO: 1136015 - DNA, 22 bp, Artificial Sequence
  chemically synthesized
cttataagtgagaacatgcagt

SEQ ID NO: 1136016 - DNA, 22 bp, Artificial Sequence
  chemically synthesized
ataagtgagaacatgcagtgtt

SEQ ID NO: 1136017 - DNA, 22 bp, Artificial Sequence
  chemically synthesized
taagtgagaacatgcagtgttt

SEQ ID NO: 1136018 - DNA, 22 bp, Artificial Sequence
  chemically synthesized
atgcgggaacagaaaaccaaac

SEQ ID NO: 1136019 - DNA, 22 bp, Artificial Sequence
  chemically synthesized
agcaaactaatgcgggaacaga

SEQ ID NO: 1136020 - DNA, 22 bp, Artificial Sequence
  chemically synthesized
tcagcaaactaatgcgggaaca

SEQ ID NO: 1136021 - DNA, 22 bp, Artificial Sequence
  chemically synthesized
ttctcagcaaactaatgcggga

SEQ ID NO: 1136022 - DNA, 22 bp, Artificial Sequence
  chemically synthesized
ggttttctgttcccgcattagt

SEQ ID NO: 1136023 - DNA, 22 bp, Artificial Sequence
  chemically synthesized
gttttctgttcccgcattagtt

SEQ ID NO: 1136024 - DNA, 22 bp, Artificial Sequence
  chemically synthesized
ttattctcagcaaactaatgcg

SEQ ID NO: 1136025 - DNA, 22 bp, Artificial Sequence
  chemically synthesized
tctgttcccgcattagtttgct

SEQ ID NO: 1136026 - DNA, 22 bp, Artificial Sequence
  chemically synthesized
ctgttcccgcattagtttgctg

SEQ ID NO: 1136027 - DNA, 22 bp, Artificial Sequence
  chemically synthesized
tgttcccgcattagtttgctga

SEQ ID NO: 1136028 - DNA, 22 bp, Artificial Sequence
  chemically synthesized
gaagctgttattctcagcaaac

SEQ ID NO: 1136029 - DNA, 22 bp, Artificial Sequence
  chemically synthesized
ttcccgcattagtttgctgaga

SEQ ID NO: 1136030 - DNA, 22 bp, Artificial Sequence
  chemically synthesized
ccgcattagtttgctgagaata

SEQ ID NO: 1136031 - DNA, 22 bp, Artificial Sequence
  chemically synthesized
gtttgctgagaataacagcttc

SEQ ID NO: 1136032 - DNA, 22 bp, Artificial Sequence
  chemically synthesized
gctgagaataacagcttccagc

SEQ ID NO: 1136033 - DNA, 22 bp, Artificial Sequence
  chemically synthesized
ctgagaataacagcttccagct

SEQ ID NO: 1136034 - DNA, 22 bp, Artificial Sequence
  chemically synthesized
agaataacagcttccagctaca

SEQ ID NO: 1136035 - DNA, 22 bp, Artificial Sequence
  chemically synthesized
cagagacatggatgtagctgga

SEQ ID NO: 1136036 - DNA, 22 bp, Artificial Sequence
  chemically synthesized
gcagagacatggatgtagctgg

SEQ ID NO: 1136037 - DNA, 22 bp, Artificial Sequence
  chemically synthesized
tgcagagacatggatgtagctg

SEQ ID NO: 1136038 - DNA, 22 bp, Artificial Sequence
  chemically synthesized
ccagctacatccatgtctctgc

SEQ ID NO: 1136039 - DNA, 22 bp, Artificial Sequence
  chemically synthesized
cagctacatccatgtctctgca

SEQ ID NO: 1136040 - DNA, 22 bp, Artificial Sequence
  chemically synthesized
catccatgtctctgcaaaggac

SEQ ID NO: 1136041 - DNA, 22 bp, Artificial Sequence
  chemically synthesized
tgcaaaggacatactctcattc

SEQ ID NO: 1136042 - DNA, 22 bp, Artificial Sequence
  chemically synthesized
caaaggacatactctcattcct

SEQ ID NO: 1136043 - DNA, 22 bp, Artificial Sequence
  chemically synthesized
tcattcctttttatggctgcat

SEQ ID NO: 1136044 - DNA, 22 bp, Artificial Sequence
  chemically synthesized
attcctttttatggctgcatac

SEQ ID NO: 1136045 - DNA, 22 bp, Artificial Sequence
  chemically synthesized
ctttttatggctgcatactatt

SEQ ID NO: 1136046 - DNA, 22 bp, Artificial Sequence
  chemically synthesized
tttatggctgcatactattcca

SEQ ID NO: 1136047 - DNA, 22 bp, Artificial Sequence
  chemically synthesized
ttatggctgcatactattccat

SEQ ID NO: 1136048 - DNA, 22 bp, Artificial Sequence
  chemically synthesized
tatggctgcatactattccatg

SEQ ID NO: 1136049 - DNA, 22 bp, Artificial Sequence
  chemically synthesized
atggctgcatactattccatgg

SEQ ID NO: 1136050 - DNA, 22 bp, Artificial Sequence
  chemically synthesized
tggctgcatactattccatggt

SEQ ID NO: 1136051 - DNA, 22 bp, Artificial Sequence
  chemically synthesized
catactattccatggtgtatat

SEQ ID NO: 1136052 - DNA, 22 bp, Artificial Sequence
  chemically synthesized
ttccatggtgtatatgtatcac

SEQ ID NO: 1136053 - DNA, 22 bp, Artificial Sequence
  chemically synthesized
gataaagaaaatgtgatacata

SEQ ID NO: 1136054 - DNA, 22 bp, Artificial Sequence
  chemically synthesized
catggtgtatatgtatcacatt

SEQ ID NO: 1136055 - DNA, 22 bp, Artificial Sequence
  chemically synthesized
tctttatccagtctatcattga

SEQ ID NO: 1136056 - DNA, 22 bp, Artificial Sequence
  chemically synthesized
ctttatccagtctatcattgat

SEQ ID NO: 1136057 - DNA, 22 bp, Artificial Sequence
  chemically synthesized
tttatccagtctatcattgatg

SEQ ID NO: 1136058 - DNA, 22 bp, Artificial Sequence
  chemically synthesized
tatccagtctatcattgatggg

SEQ ID NO: 1136059 - DNA, 22 bp, Artificial Sequence
  chemically synthesized
atccagtctatcattgatgggc

SEQ ID NO: 1136060 - DNA, 22 bp, Artificial Sequence
  chemically synthesized
tccagtctatcattgatgggca

SEQ ID NO: 1136061 - DNA, 22 bp, Artificial Sequence
  chemically synthesized
tcattgatgggcatttgggttg

SEQ ID NO: 1136062 - DNA, 22 bp, Artificial Sequence
  chemically synthesized
atgggcatttgggttgattcta

SEQ ID NO: 1136063 - DNA, 22 bp, Artificial Sequence
  chemically synthesized
acaatagcaaagacatagaatc

SEQ ID NO: 1136064 - DNA, 22 bp, Artificial Sequence
  chemically synthesized
ttcacaatagcaaagacataga

SEQ ID NO: 1136065 - DNA, 22 bp, Artificial Sequence
  chemically synthesized
gggttgattctatgtctttgct

SEQ ID NO: 1136066 - DNA, 22 bp, Artificial Sequence
  chemically synthesized
ggttgattctatgtctttgcta

SEQ ID NO: 1136067 - DNA, 22 bp, Artificial Sequence
  chemically synthesized
cagcactattcacaatagcaaa

SEQ ID NO: 1136068 - DNA, 22 bp, Artificial Sequence
  chemically synthesized
attctatgtctttgctattgtg

SEQ ID NO: 1136069 - DNA, 22 bp, Artificial Sequence
  chemically synthesized
attgcagcactattcacaatag

SEQ ID NO: 1136070 - DNA, 22 bp, Artificial Sequence
  chemically synthesized
tatgtctttgctattgtgaata

SEQ ID NO: 1136071 - DNA, 22 bp, Artificial Sequence
  chemically synthesized
tgtctttgctattgtgaatagt

SEQ ID NO: 1136072 - DNA, 22 bp, Artificial Sequence
  chemically synthesized
tatgttaattgcagcactattc

SEQ ID NO: 1136073 - DNA, 22 bp, Artificial Sequence
  chemically synthesized
gtatgttaattgcagcactatt

SEQ ID NO: 1136074 - DNA, 22 bp, Artificial Sequence
  chemically synthesized
tgctattgtgaatagtgctgca

SEQ ID NO: 1136075 - DNA, 22 bp, Artificial Sequence
  chemically synthesized
gctattgtgaatagtgctgcaa

SEQ ID NO: 1136076 - DNA, 22 bp, Artificial Sequence
  chemically synthesized
ctattgtgaatagtgctgcaat

SEQ ID NO: 1136077 - DNA, 22 bp, Artificial Sequence
  chemically synthesized
ttgtgaatagtgctgcaattaa

SEQ ID NO: 1136078 - DNA, 22 bp, Artificial Sequence
  chemically synthesized
tgaatagtgctgcaattaacat

SEQ ID NO: 1136079 - DNA, 22 bp, Artificial Sequence
  chemically synthesized
taaagatacatgcatttgtatg

SEQ ID NO: 1136080 - DNA, 22 bp, Artificial Sequence
  chemically synthesized
ttataaagatacatgcatttgt

SEQ ID NO: 1136081 - DNA, 22 bp, Artificial Sequence
  chemically synthesized
caattaacatacaaatgcatgt

SEQ ID NO: 1136082 - DNA, 22 bp, Artificial Sequence
  chemically synthesized
acatacaaatgcatgtatcttt

SEQ ID NO: 1136083 - DNA, 22 bp, Artificial Sequence
  chemically synthesized
tataataggatgatttatattc

SEQ ID NO: 1136084 - DNA, 22 bp, Artificial Sequence
  chemically synthesized
ataataggatgatttatattcc

SEQ ID NO: 1136085 - DNA, 22 bp, Artificial Sequence
  chemically synthesized
taataggatgatttatattcct

SEQ ID NO: 1136086 - DNA, 22 bp, Artificial Sequence
  chemically synthesized
gatatatacccaaaggaatata

SEQ ID NO: 1136087 - DNA, 22 bp, Artificial Sequence
  chemically synthesized
ctggatatatacccaaaggaat

SEQ ID NO: 1136088 - DNA, 22 bp, Artificial Sequence
  chemically synthesized
atattcctttgggtatatatcc

SEQ ID NO: 1136089 - DNA, 22 bp, Artificial Sequence
  chemically synthesized
tattcctttgggtatatatcca

SEQ ID NO: 1136090 - DNA, 22 bp, Artificial Sequence
  chemically synthesized
ctttgggtatatatccagtaac

SEQ ID NO: 1136091 - DNA, 22 bp, Artificial Sequence
  chemically synthesized
tgggtatatatccagtaacggc

SEQ ID NO: 1136092 - DNA, 22 bp, Artificial Sequence
  chemically synthesized
gggtatatatccagtaacggcc

SEQ ID NO: 1136093 - DNA, 22 bp, Artificial Sequence
  chemically synthesized
ggtatatatccagtaacggcct

SEQ ID NO: 1136094 - DNA, 22 bp, Artificial Sequence
  chemically synthesized
gaaccagaaatacccagcaagg

SEQ ID NO: 1136095 - DNA, 22 bp, Artificial Sequence
  chemically synthesized
aaagaactagaaccagaaatac

SEQ ID NO: 1136096 - DNA, 22 bp, Artificial Sequence
  chemically synthesized
ctcaaagaactagaaccagaaa

SEQ ID NO: 1136097 - DNA, 22 bp, Artificial Sequence
  chemically synthesized
gctgggtatttctggttctagt

SEQ ID NO: 1136098 - DNA, 22 bp, Artificial Sequence
  chemically synthesized
ctgggtatttctggttctagtt

SEQ ID NO: 1136099 - DNA, 22 bp, Artificial Sequence
  chemically synthesized
ggtatttctggttctagttctt

SEQ ID NO: 1136100 - DNA, 22 bp, Artificial Sequence
  chemically synthesized
ctggttctagttctttgaggaa

SEQ ID NO: 1136101 - DNA, 22 bp, Artificial Sequence
  chemically synthesized
tggttctagttctttgaggaac

SEQ ID NO: 1136102 - DNA, 22 bp, Artificial Sequence
  chemically synthesized
gttctagttctttgaggaacca

SEQ ID NO: 1136103 - DNA, 22 bp, Artificial Sequence
  chemically synthesized
tggaagacagtgtggtggttcc

SEQ ID NO: 1136104 - DNA, 22 bp, Artificial Sequence
  chemically synthesized
tagttctttgaggaaccaccac

SEQ ID NO: 1136105 - DNA, 22 bp, Artificial Sequence
  chemically synthesized
gttctttgaggaaccaccacac

SEQ ID NO: 1136106 - DNA, 22 bp, Artificial Sequence
  chemically synthesized
tttgaggaaccaccacactgtc

SEQ ID NO: 1136107 - DNA, 22 bp, Artificial Sequence
  chemically synthesized
tccattgtggaagacagtgtgg

SEQ ID NO: 1136108 - DNA, 22 bp, Artificial Sequence
  chemically synthesized
atccattgtggaagacagtgtg

SEQ ID NO: 1136109 - DNA, 22 bp, Artificial Sequence
  chemically synthesized
tgaggaaccaccacactgtctt

SEQ ID NO: 1136110 - DNA, 22 bp, Artificial Sequence
  chemically synthesized
gaggaaccaccacactgtcttc

SEQ ID NO: 1136111 - DNA, 22 bp, Artificial Sequence
  chemically synthesized
aggaaccaccacactgtcttcc

SEQ ID NO: 1136112 - DNA, 22 bp, Artificial Sequence
  chemically synthesized
gtttatccattgtggaagacag

SEQ ID NO: 1136113 - DNA, 22 bp, Artificial Sequence
  chemically synthesized
tcttccacaatggataaactaa

SEQ ID NO: 1136114 - DNA, 22 bp, Artificial Sequence
  chemically synthesized
gtgggaatgtaaattagtttat

SEQ ID NO: 1136115 - DNA, 22 bp, Artificial Sequence
  chemically synthesized
ccacaatggataaactaattta

SEQ ID NO: 1136116 - DNA, 22 bp, Artificial Sequence
  chemically synthesized
ttggtgggaatgtaaattagtt

SEQ ID NO: 1136117 - DNA, 22 bp, Artificial Sequence
  chemically synthesized
cacaatggataaactaatttac

SEQ ID NO: 1136118 - DNA, 22 bp, Artificial Sequence
  chemically synthesized
cactgttggtgggaatgtaaat

SEQ ID NO: 1136119 - DNA, 22 bp, Artificial Sequence
  chemically synthesized
acactgttggtgggaatgtaaa

SEQ ID NO: 1136120 - DNA, 22 bp, Artificial Sequence
  chemically synthesized
tacactgttggtgggaatgtaa

SEQ ID NO: 1136121 - DNA, 22 bp, Artificial Sequence
  chemically synthesized
ttacactgttggtgggaatgta

SEQ ID NO: 1136122 - DNA, 22 bp, Artificial Sequence
  chemically synthesized
atttacattcccaccaacagtg

SEQ ID NO: 1136123 - DNA, 22 bp, Artificial Sequence
  chemically synthesized
acattcccaccaacagtgtaaa

SEQ ID NO: 1136124 - DNA, 22 bp, Artificial Sequence
  chemically synthesized
cattcccaccaacagtgtaaaa

SEQ ID NO: 1136125 - DNA, 22 bp, Artificial Sequence
  chemically synthesized
agagaaatgggaatgcttttac

SEQ ID NO: 1136126 - DNA, 22 bp, Artificial Sequence
  chemically synthesized
ccaccaacagtgtaaaagcatt

SEQ ID NO: 1136127 - DNA, 22 bp, Artificial Sequence
  chemically synthesized
cagagaaatgggaatgctttta

SEQ ID NO: 1136128 - DNA, 22 bp, Artificial Sequence
  chemically synthesized
gcatggtttcagagaaatggga

SEQ ID NO: 1136129 - DNA, 22 bp, Artificial Sequence
  chemically synthesized
ccatttctctgaaaccatgcca

SEQ ID NO: 1136130 - DNA, 22 bp, Artificial Sequence
  chemically synthesized
ctctgaaaccatgccagcgtct

SEQ ID NO: 1136131 - DNA, 22 bp, Artificial Sequence
  chemically synthesized
tctgaaaccatgccagcgtctg

SEQ ID NO: 1136132 - DNA, 22 bp, Artificial Sequence
  chemically synthesized
tgaaaccatgccagcgtctgtt

SEQ ID NO: 1136133 - DNA, 22 bp, Artificial Sequence
  chemically synthesized
aaaccatgccagcgtctgttgt

SEQ ID NO: 1136134 - DNA, 22 bp, Artificial Sequence
  chemically synthesized
aaaagtcaagatacaacagacg

SEQ ID NO: 1136135 - DNA, 22 bp, Artificial Sequence
  chemically synthesized
aaaaagtcaagatacaacagac

SEQ ID NO: 1136136 - DNA, 22 bp, Artificial Sequence
  chemically synthesized
taaaaagtcaagatacaacaga

SEQ ID NO: 1136137 - DNA, 22 bp, Artificial Sequence
  chemically synthesized
ttaaaaagtcaagatacaacag

SEQ ID NO: 1136138 - DNA, 22 bp, Artificial Sequence
  chemically synthesized
ttgtatcttgactttttaaaaa

SEQ ID NO: 1136139 - DNA, 22 bp, Artificial Sequence
  chemically synthesized
tatcttgactttttaaaaatca

SEQ ID NO: 1136140 - DNA, 22 bp, Artificial Sequence
  chemically synthesized
acgccagacagaatggtgattt

SEQ ID NO: 1136141 - DNA, 22 bp, Artificial Sequence
  chemically synthesized
gactttttaaaaatcaccattc

SEQ ID NO: 1136142 - DNA, 22 bp, Artificial Sequence
  chemically synthesized
actttttaaaaatcaccattct

SEQ ID NO: 1136143 - DNA, 22 bp, Artificial Sequence
  chemically synthesized
tttaaaaatcaccattctgtct

SEQ ID NO: 1136144 - DNA, 22 bp, Artificial Sequence
  chemically synthesized
ttaaaaatcaccattctgtctg

SEQ ID NO: 1136145 - DNA, 22 bp, Artificial Sequence
  chemically synthesized
taaaaatcaccattctgtctgg

SEQ ID NO: 1136146 - DNA, 22 bp, Artificial Sequence
  chemically synthesized
aaaaatcaccattctgtctggc

SEQ ID NO: 1136147 - DNA, 22 bp, Artificial Sequence
  chemically synthesized
aaaatcaccattctgtctggcg

SEQ ID NO: 1136148 - DNA, 22 bp, Artificial Sequence
  chemically synthesized
agcacaccatctcacgccagac

SEQ ID NO: 1136149 - DNA, 22 bp, Artificial Sequence
  chemically synthesized
gcctcagcacaccatctcacgc

SEQ ID NO: 1136150 - DNA, 22 bp, Artificial Sequence
  chemically synthesized
tgtctggcgtgagatggtgtgc

SEQ ID NO: 1136151 - DNA, 22 bp, Artificial Sequence
  chemically synthesized
tctggcgtgagatggtgtgctg

SEQ ID NO: 1136152 - DNA, 22 bp, Artificial Sequence
  chemically synthesized
atccatattagcctcagcacac

SEQ ID NO: 1136153 - DNA, 22 bp, Artificial Sequence
  chemically synthesized
gcgtgagatggtgtgctgaggc

SEQ ID NO: 1136154 - DNA, 22 bp, Artificial Sequence
  chemically synthesized
aattcatccatattagcctcag

SEQ ID NO: 1136155 - DNA, 22 bp, Artificial Sequence
  chemically synthesized
tcaattcatccatattagcctc

SEQ ID NO: 1136156 - DNA, 22 bp, Artificial Sequence
  chemically synthesized
tctcaattcatccatattagcc

SEQ ID NO: 1136157 - DNA, 22 bp, Artificial Sequence
  chemically synthesized
ctctcaattcatccatattagc

SEQ ID NO: 1136158 - DNA, 22 bp, Artificial Sequence
  chemically synthesized
cttctctcaattcatccatatt

SEQ ID NO: 1136159 - DNA, 22 bp, Artificial Sequence
  chemically synthesized
aggctaatatggatgaattgag

SEQ ID NO: 1136160 - DNA, 22 bp, Artificial Sequence
  chemically synthesized
aagcctacttctctcaattcat

SEQ ID NO: 1136161 - DNA, 22 bp, Artificial Sequence
  chemically synthesized
gaagcctacttctctcaattca

SEQ ID NO: 1136162 - DNA, 22 bp, Artificial Sequence
  chemically synthesized
tgaagcctacttctctcaattc

SEQ ID NO: 1136163 - DNA, 22 bp, Artificial Sequence
  chemically synthesized
atatggatgaattgagagaagt

SEQ ID NO: 1136164 - DNA, 22 bp, Artificial Sequence
  chemically synthesized
tccacctttgaagcctacttct

SEQ ID NO: 1136165 - DNA, 22 bp, Artificial Sequence
  chemically synthesized
ttatccacctttgaagcctact

SEQ ID NO: 1136166 - DNA, 22 bp, Artificial Sequence
  chemically synthesized
ttattatccacctttgaagcct

SEQ ID NO: 1136167 - DNA, 22 bp, Artificial Sequence
  chemically synthesized
gttattatccacctttgaagcc

SEQ ID NO: 1136168 - DNA, 22 bp, Artificial Sequence
  chemically synthesized
agagaagtaggcttcaaaggtg

SEQ ID NO: 1136169 - DNA, 22 bp, Artificial Sequence
  chemically synthesized
agggaagtttgttattatccac

SEQ ID NO: 1136170 - DNA, 22 bp, Artificial Sequence
  chemically synthesized
gctcagggaagtttgttattat

SEQ ID NO: 1136171 - DNA, 22 bp, Artificial Sequence
  chemically synthesized
tagctcagggaagtttgttatt

SEQ ID NO: 1136172 - DNA, 22 bp, Artificial Sequence
  chemically synthesized
caaaggtggataataacaaact

SEQ ID NO: 1136173 - DNA, 22 bp, Artificial Sequence
  chemically synthesized
aaaggtggataataacaaactt

SEQ ID NO: 1136174 - DNA, 22 bp, Artificial Sequence
  chemically synthesized
ctctagctcagggaagtttgtt

SEQ ID NO: 1136175 - DNA, 22 bp, Artificial Sequence
  chemically synthesized
tcctctagctcagggaagtttg

SEQ ID NO: 1136176 - DNA, 22 bp, Artificial Sequence
  chemically synthesized
gaacattctcctctagctcagg

SEQ ID NO: 1136177 - DNA, 22 bp, Artificial Sequence
  chemically synthesized
ggttagaacattctcctctagc

SEQ ID NO: 1136178 - DNA, 22 bp, Artificial Sequence
  chemically synthesized
cattgggttagaacattctcct

SEQ ID NO: 1136179 - DNA, 22 bp, Artificial Sequence
  chemically synthesized
ccctgagctagaggagaatgtt

SEQ ID NO: 1136180 - DNA, 22 bp, Artificial Sequence
  chemically synthesized
gcattgggttagaacattctcc

SEQ ID NO: 1136181 - DNA, 22 bp, Artificial Sequence
  chemically synthesized
cctgagctagaggagaatgttc

SEQ ID NO: 1136182 - DNA, 22 bp, Artificial Sequence
  chemically synthesized
tttgcattgggttagaacattc

SEQ ID NO: 1136183 - DNA, 22 bp, Artificial Sequence
  chemically synthesized
gtttgcattgggttagaacatt

SEQ ID NO: 1136184 - DNA, 22 bp, Artificial Sequence
  chemically synthesized
agctagaggagaatgttctaac

SEQ ID NO: 1136185 - DNA, 22 bp, Artificial Sequence
  chemically synthesized
gcttgtttgcattgggttagaa

SEQ ID NO: 1136186 - DNA, 22 bp, Artificial Sequence
  chemically synthesized
gaggagaatgttctaacccaat

SEQ ID NO: 1136187 - DNA, 22 bp, Artificial Sequence
  chemically synthesized
ttagcttgtttgcattgggtta

SEQ ID NO: 1136188 - DNA, 22 bp, Artificial Sequence
  chemically synthesized
tcgtggttgttagcttgtttgc

SEQ ID NO: 1136189 - DNA, 22 bp, Artificial Sequence
  chemically synthesized
atcgtggttgttagcttgtttg

SEQ ID NO: 1136190 - DNA, 22 bp, Artificial Sequence
  chemically synthesized
tatcgtggttgttagcttgttt

SEQ ID NO: 1136191 - DNA, 22 bp, Artificial Sequence
  chemically synthesized
taacccaatgcaaacaagctaa

SEQ ID NO: 1136192 - DNA, 22 bp, Artificial Sequence
  chemically synthesized
acccaatgcaaacaagctaaca

SEQ ID NO: 1136193 - DNA, 22 bp, Artificial Sequence
  chemically synthesized
cgttttatcgtggttgttagct

SEQ ID NO: 1136194 - DNA, 22 bp, Artificial Sequence
  chemically synthesized
ttacgttttatcgtggttgtta

SEQ ID NO: 1136195 - DNA, 22 bp, Artificial Sequence
  chemically synthesized
ctgttacgttttatcgtggttg

SEQ ID NO: 1136196 - DNA, 22 bp, Artificial Sequence
  chemically synthesized
tccgctcctgttacgttttatc

SEQ ID NO: 1136197 - DNA, 22 bp, Artificial Sequence
  chemically synthesized
acaaccacgataaaacgtaaca

SEQ ID NO: 1136198 - DNA, 22 bp, Artificial Sequence
  chemically synthesized
gttatccgctcctgttacgttt

SEQ ID NO: 1136199 - DNA, 22 bp, Artificial Sequence
  chemically synthesized
tggttatccgctcctgttacgt

SEQ ID NO: 1136200 - DNA, 22 bp, Artificial Sequence
  chemically synthesized
ttctggttatccgctcctgtta

SEQ ID NO: 1136201 - DNA, 22 bp, Artificial Sequence
  chemically synthesized
gttattctggttatccgctcct

SEQ ID NO: 1136202 - DNA, 22 bp, Artificial Sequence
  chemically synthesized
taaactggttattctggttatc

SEQ ID NO: 1136203 - DNA, 22 bp, Artificial Sequence
  chemically synthesized
tgtaaactggttattctggtta

SEQ ID NO: 1136204 - DNA, 22 bp, Artificial Sequence
  chemically synthesized
ctctgtaaactggttattctgg

SEQ ID NO: 1136205 - DNA, 22 bp, Artificial Sequence
  chemically synthesized
atgttcctctgtaaactggtta

SEQ ID NO: 1136206 - DNA, 22 bp, Artificial Sequence
  chemically synthesized
tcaggtcattcatgttcctctg

SEQ ID NO: 1136207 - DNA, 22 bp, Artificial Sequence
  chemically synthesized
tatcaggtcattcatgttcctc

SEQ ID NO: 1136208 - DNA, 22 bp, Artificial Sequence
  chemically synthesized
agctctatcaggtcattcatgt

SEQ ID NO: 1136209 - DNA, 22 bp, Artificial Sequence
  chemically synthesized
tcagctctatcaggtcattcat

SEQ ID NO: 1136210 - DNA, 22 bp, Artificial Sequence
  chemically synthesized
ctcagctctatcaggtcattca

SEQ ID NO: 1136211 - DNA, 22 bp, Artificial Sequence
  chemically synthesized
acagaggaacatgaatgacctg

SEQ ID NO: 1136212 - DNA, 22 bp, Artificial Sequence
  chemically synthesized
cagaggaacatgaatgacctga

SEQ ID NO: 1136213 - DNA, 22 bp, Artificial Sequence
  chemically synthesized
cgtttctcagctctatcaggtc

SEQ ID NO: 1136214 - DNA, 22 bp, Artificial Sequence
  chemically synthesized
tcgtattgcgtttctcagctct

SEQ ID NO: 1136215 - DNA, 22 bp, Artificial Sequence
  chemically synthesized
tggagttgtcgtattgcgtttc

SEQ ID NO: 1136216 - DNA, 22 bp, Artificial Sequence
  chemically synthesized
atagagctgagaaacgcaatac

SEQ ID NO: 1136217 - DNA, 22 bp, Artificial Sequence
  chemically synthesized
attgtggagttgtcgtattgcg

SEQ ID NO: 1136218 - DNA, 22 bp, Artificial Sequence
  chemically synthesized
cattgtggagttgtcgtattgc

SEQ ID NO: 1136219 - DNA, 22 bp, Artificial Sequence
  chemically synthesized
agaaacgcaatacgacaactcc

SEQ ID NO: 1136220 - DNA, 22 bp, Artificial Sequence
  chemically synthesized
acaatgtgatttcattgtggag

SEQ ID NO: 1136221 - DNA, 22 bp, Artificial Sequence
  chemically synthesized
aggtattgacaatgtgatttca

SEQ ID NO: 1136222 - DNA, 22 bp, Artificial Sequence
  chemically synthesized
ttcaggtattgacaatgtgatt

SEQ ID NO: 1136223 - DNA, 22 bp, Artificial Sequence
  chemically synthesized
cacaatgaaatcacattgtcaa

SEQ ID NO: 1136224 - DNA, 22 bp, Artificial Sequence
  chemically synthesized
gtctattcaggtattgacaatg

SEQ ID NO: 1136225 - DNA, 22 bp, Artificial Sequence
  chemically synthesized
ggtctattcaggtattgacaat

SEQ ID NO: 1136226 - DNA, 22 bp, Artificial Sequence
  chemically synthesized
cttggtctattcaggtattgac

SEQ ID NO: 1136227 - DNA, 22 bp, Artificial Sequence
  chemically synthesized
tgcttggtctattcaggtattg

SEQ ID NO: 1136228 - DNA, 22 bp, Artificial Sequence
  chemically synthesized
ctctgcttggtctattcaggta

SEQ ID NO: 1136229 - DNA, 22 bp, Artificial Sequence
  chemically synthesized
cctctgcttggtctattcaggt

SEQ ID NO: 1136230 - DNA, 22 bp, Artificial Sequence
  chemically synthesized
tcctctgcttggtctattcagg

SEQ ID NO: 1136231 - DNA, 22 bp, Artificial Sequence
  chemically synthesized
tttcctctgcttggtctattca

SEQ ID NO: 1136232 - DNA, 22 bp, Artificial Sequence
  chemically synthesized
tcaatacctgaatagaccaagc

SEQ ID NO: 1136233 - DNA, 22 bp, Artificial Sequence
  chemically synthesized
agattctttcctctgcttggtc

SEQ ID NO: 1136234 - DNA, 22 bp, Artificial Sequence
  chemically synthesized
tgagattctttcctctgcttgg

SEQ ID NO: 1136235 - DNA, 22 bp, Artificial Sequence
  chemically synthesized
aatagaccaagcagaggaaaga

SEQ ID NO: 1136236 - DNA, 22 bp, Artificial Sequence
  chemically synthesized
aagctctgagattctttcctct

SEQ ID NO: 1136237 - DNA, 22 bp, Artificial Sequence
  chemically synthesized
caagctctgagattctttcctc

SEQ ID NO: 1136238 - DNA, 22 bp, Artificial Sequence
  chemically synthesized
agcaagatagtcttcaagctct

SEQ ID NO: 1136239 - DNA, 22 bp, Artificial Sequence
  chemically synthesized
cagcaagatagtcttcaagctc

SEQ ID NO: 1136240 - DNA, 22 bp, Artificial Sequence
  chemically synthesized
tttcagcaagatagtcttcaag

SEQ ID NO: 1136241 - DNA, 22 bp, Artificial Sequence
  chemically synthesized
atttcagcaagatagtcttcaa

SEQ ID NO: 1136242 - DNA, 22 bp, Artificial Sequence
  chemically synthesized
tcttatttcagcaagatagtct

SEQ ID NO: 1136243 - DNA, 22 bp, Artificial Sequence
  chemically synthesized
agagcttgaagactatcttgct

SEQ ID NO: 1136244 - DNA, 22 bp, Artificial Sequence
  chemically synthesized
cctgtcttatttcagcaagata

SEQ ID NO: 1136245 - DNA, 22 bp, Artificial Sequence
  chemically synthesized
tgcctgtcttatttcagcaaga

SEQ ID NO: 1136246 - DNA, 22 bp, Artificial Sequence
  chemically synthesized
ctgcctgtcttatttcagcaag

SEQ ID NO: 1136247 - DNA, 22 bp, Artificial Sequence
  chemically synthesized
tctgcctgtcttatttcagcaa

SEQ ID NO: 1136248 - DNA, 22 bp, Artificial Sequence
  chemically synthesized
ttctgcctgtcttatttcagca

SEQ ID NO: 1136249 - DNA, 22 bp, Artificial Sequence
  chemically synthesized
gaagactatcttgctgaaataa

SEQ ID NO: 1136250 - DNA, 22 bp, Artificial Sequence
  chemically synthesized
aagactatcttgctgaaataag

SEQ ID NO: 1136251 - DNA, 22 bp, Artificial Sequence
  chemically synthesized
atcttttctgcctgtcttattt

SEQ ID NO: 1136252 - DNA, 22 bp, Artificial Sequence
  chemically synthesized
taatcttttctgcctgtcttat

SEQ ID NO: 1136253 - DNA, 22 bp, Artificial Sequence
  chemically synthesized
tcttgctgaaataagacaggca

SEQ ID NO: 1136254 - DNA, 22 bp, Artificial Sequence
  chemically synthesized
tctaatcttttctgcctgtctt

SEQ ID NO: 1136255 - DNA, 22 bp, Artificial Sequence
  chemically synthesized
ctctaatcttttctgcctgtct

SEQ ID NO: 1136256 - DNA, 22 bp, Artificial Sequence
  chemically synthesized
tctctaatcttttctgcctgtc

SEQ ID NO: 1136257 - DNA, 22 bp, Artificial Sequence
  chemically synthesized
ttctctaatcttttctgcctgt

SEQ ID NO: 1136258 - DNA, 22 bp, Artificial Sequence
  chemically synthesized
gctgaaataagacaggcagaaa

SEQ ID NO: 1136259 - DNA, 22 bp, Artificial Sequence
  chemically synthesized
tttctctaatcttttctgcctg

SEQ ID NO: 1136260 - DNA, 22 bp, Artificial Sequence
  chemically synthesized
ctgaaataagacaggcagaaaa

SEQ ID NO: 1136261 - DNA, 22 bp, Artificial Sequence
  chemically synthesized
tttttctctaatcttttctgcc

SEQ ID NO: 1136262 - DNA, 22 bp, Artificial Sequence
  chemically synthesized
ctttttctctaatcttttctgc

SEQ ID NO: 1136263 - DNA, 22 bp, Artificial Sequence
  chemically synthesized
aaataagacaggcagaaaagat

SEQ ID NO: 1136264 - DNA, 22 bp, Artificial Sequence
  chemically synthesized
tctttttctctaatcttttctg

SEQ ID NO: 1136265 - DNA, 22 bp, Artificial Sequence
  chemically synthesized
ttctttttctctaatcttttct

SEQ ID NO: 1136266 - DNA, 22 bp, Artificial Sequence
  chemically synthesized
ttttctttttctctaatctttt

SEQ ID NO: 1136267 - DNA, 22 bp, Artificial Sequence
  chemically synthesized
ttcttttctttttctctaatct

SEQ ID NO: 1136268 - DNA, 22 bp, Artificial Sequence
  chemically synthesized
attcttttctttttctctaatc

SEQ ID NO: 1136269 - DNA, 22 bp, Artificial Sequence
  chemically synthesized
tattcttttctttttctctaat

SEQ ID NO: 1136270 - DNA, 22 bp, Artificial Sequence
  chemically synthesized
ttattcttttctttttctctaa

SEQ ID NO: 1136271 - DNA, 22 bp, Artificial Sequence
  chemically synthesized
atttttattcttttctttttct

SEQ ID NO: 1136272 - DNA, 22 bp, Artificial Sequence
  chemically synthesized
tacattcatttttattcttttc

SEQ ID NO: 1136273 - DNA, 22 bp, Artificial Sequence
  chemically synthesized
gtacattcatttttattctttt

SEQ ID NO: 1136274 - DNA, 22 bp, Artificial Sequence
  chemically synthesized
tgtacattcatttttattcttt

SEQ ID NO: 1136275 - DNA, 22 bp, Artificial Sequence
  chemically synthesized
gagaaaaagaaaagaataaaaa

SEQ ID NO: 1136276 - DNA, 22 bp, Artificial Sequence
  chemically synthesized
tcagacgttttgtacattcatt

SEQ ID NO: 1136277 - DNA, 22 bp, Artificial Sequence
  chemically synthesized
gtcagacgttttgtacattcat

SEQ ID NO: 1136278 - DNA, 22 bp, Artificial Sequence
  chemically synthesized
cataatcccacatttgtcagac

SEQ ID NO: 1136279 - DNA, 22 bp, Artificial Sequence
  chemically synthesized
acataatcccacatttgtcaga

SEQ ID NO: 1136280 - DNA, 22 bp, Artificial Sequence
  chemically synthesized
agaatttacataatcccacatt

SEQ ID NO: 1136281 - DNA, 22 bp, Artificial Sequence
  chemically synthesized
cagaatttacataatcccacat

SEQ ID NO: 1136282 - DNA, 22 bp, Artificial Sequence
  chemically synthesized
cttcagaatttacataatccca

SEQ ID NO: 1136283 - DNA, 22 bp, Artificial Sequence
  chemically synthesized
gcttcagaatttacataatccc

SEQ ID NO: 1136284 - DNA, 22 bp, Artificial Sequence
  chemically synthesized
tgcttcagaatttacataatcc

SEQ ID NO: 1136285 - DNA, 22 bp, Artificial Sequence
  chemically synthesized
acaaatgtgggattatgtaaat

SEQ ID NO: 1136286 - DNA, 22 bp, Artificial Sequence
  chemically synthesized
cccaaacagtctttgcttcaga

SEQ ID NO: 1136287 - DNA, 22 bp, Artificial Sequence
  chemically synthesized
tgtaaattctgaagcaaagact

SEQ ID NO: 1136288 - DNA, 22 bp, Artificial Sequence
  chemically synthesized
aggttccccaaacagtctttgc

SEQ ID NO: 1136289 - DNA, 22 bp, Artificial Sequence
  chemically synthesized
caggttccccaaacagtctttg

SEQ ID NO: 1136290 - DNA, 22 bp, Artificial Sequence
  chemically synthesized
tcaggttccccaaacagtcttt

SEQ ID NO: 1136291 - DNA, 22 bp, Artificial Sequence
  chemically synthesized
tttcaggttccccaaacagtct

SEQ ID NO: 1136292 - DNA, 22 bp, Artificial Sequence
  chemically synthesized
tgaagcaaagactgtttgggga

SEQ ID NO: 1136293 - DNA, 22 bp, Artificial Sequence
  chemically synthesized
aagcaaagactgtttggggaac

SEQ ID NO: 1136294 - DNA, 22 bp, Artificial Sequence
  chemically synthesized
cccgtctctttcaggttcccca

SEQ ID NO: 1136295 - DNA, 22 bp, Artificial Sequence
  chemically synthesized
tccccgtctctttcaggttccc

SEQ ID NO: 1136296 - DNA, 22 bp, Artificial Sequence
  chemically synthesized
cgttctccccgtctctttcagg

SEQ ID NO: 1136297 - DNA, 22 bp, Artificial Sequence
  chemically synthesized
tttggggaacctgaaagagacg

SEQ ID NO: 1136298 - DNA, 22 bp, Artificial Sequence
  chemically synthesized
gttccgttctccccgtctcttt

SEQ ID NO: 1136299 - DNA, 22 bp, Artificial Sequence
  chemically synthesized
ggttccgttctccccgtctctt

SEQ ID NO: 1136300 - DNA, 22 bp, Artificial Sequence
  chemically synthesized
ggggaacctgaaagagacgggg

SEQ ID NO: 1136301 - DNA, 22 bp, Artificial Sequence
  chemically synthesized
gggaacctgaaagagacgggga

SEQ ID NO: 1136302 - DNA, 22 bp, Artificial Sequence
  chemically synthesized
caacttggttccgttctccccg

SEQ ID NO: 1136303 - DNA, 22 bp, Artificial Sequence
  chemically synthesized
ccaacttggttccgttctcccc

SEQ ID NO: 1136304 - DNA, 22 bp, Artificial Sequence
  chemically synthesized
aaagagacggggagaacggaac

SEQ ID NO: 1136305 - DNA, 22 bp, Artificial Sequence
  chemically synthesized
aagtgtgatttccaacttggtt

SEQ ID NO: 1136306 - DNA, 22 bp, Artificial Sequence
  chemically synthesized
gatgatatcctgaagtgtgatt

SEQ ID NO: 1136307 - DNA, 22 bp, Artificial Sequence
  chemically synthesized
ctggatgatatcctgaagtgtg

SEQ ID NO: 1136308 - DNA, 22 bp, Artificial Sequence
  chemically synthesized
tcctggatgatatcctgaagtg

SEQ ID NO: 1136309 - DNA, 22 bp, Artificial Sequence
  chemically synthesized
gaaatcacacttcaggatatca

SEQ ID NO: 1136310 - DNA, 22 bp, Artificial Sequence
  chemically synthesized
gagaagttctcctggatgatat

SEQ ID NO: 1136311 - DNA, 22 bp, Artificial Sequence
  chemically synthesized
gattggagaagttctcctggat

SEQ ID NO: 1136312 - DNA, 22 bp, Artificial Sequence
  chemically synthesized
tagattggagaagttctcctgg

SEQ ID NO: 1136313 - DNA, 22 bp, Artificial Sequence
  chemically synthesized
caggatatcatccaggagaact

SEQ ID NO: 1136314 - DNA, 22 bp, Artificial Sequence
  chemically synthesized
ctagattggagaagttctcctg

SEQ ID NO: 1136315 - DNA, 22 bp, Artificial Sequence
  chemically synthesized
aggatatcatccaggagaactt

SEQ ID NO: 1136316 - DNA, 22 bp, Artificial Sequence
  chemically synthesized
tctagattggagaagttctcct

SEQ ID NO: 1136317 - DNA, 22 bp, Artificial Sequence
  chemically synthesized
gctttctagattggagaagttc

SEQ ID NO: 1136318 - DNA, 22 bp, Artificial Sequence
  chemically synthesized
gctggctttctagattggagaa

SEQ ID NO: 1136319 - DNA, 22 bp, Artificial Sequence
  chemically synthesized
ggctggctttctagattggaga

SEQ ID NO: 1136320 - DNA, 22 bp, Artificial Sequence
  chemically synthesized
aatgtttggctggctttctaga

SEQ ID NO: 1136321 - DNA, 22 bp, Artificial Sequence
  chemically synthesized
gaatgtttggctggctttctag

SEQ ID NO: 1136322 - DNA, 22 bp, Artificial Sequence
  chemically synthesized
ctccaatctagaaagccagcca

SEQ ID NO: 1136323 - DNA, 22 bp, Artificial Sequence
  chemically synthesized
aatttgaatgtttggctggctt

SEQ ID NO: 1136324 - DNA, 22 bp, Artificial Sequence
  chemically synthesized
tccaatctagaaagccagccaa

SEQ ID NO: 1136325 - DNA, 22 bp, Artificial Sequence
  chemically synthesized
caatctagaaagccagccaaac

SEQ ID NO: 1136326 - DNA, 22 bp, Artificial Sequence
  chemically synthesized
ctgaatttgaatgtttggctgg

SEQ ID NO: 1136327 - DNA, 22 bp, Artificial Sequence
  chemically synthesized
cctgaatttgaatgtttggctg

SEQ ID NO: 1136328 - DNA, 22 bp, Artificial Sequence
  chemically synthesized
tatttcctgaatttgaatgttt

SEQ ID NO: 1136329 - DNA, 22 bp, Artificial Sequence
  chemically synthesized
gaaagccagccaaacattcaaa

SEQ ID NO: 1136330 - DNA, 22 bp, Artificial Sequence
  chemically synthesized
gtatttcctgaatttgaatgtt

SEQ ID NO: 1136331 - DNA, 22 bp, Artificial Sequence
  chemically synthesized
agtgagtatcttgtatttcctg

SEQ ID NO: 1136332 - DNA, 22 bp, Artificial Sequence
  chemically synthesized
ctcagtgagtatcttgtatttc

SEQ ID NO: 1136333 - DNA, 22 bp, Artificial Sequence
  chemically synthesized
tgctcagtgagtatcttgtatt

SEQ ID NO: 1136334 - DNA, 22 bp, Artificial Sequence
  chemically synthesized
ctgctcagtgagtatcttgtat

SEQ ID NO: 1136335 - DNA, 22 bp, Artificial Sequence
  chemically synthesized
aaattcaggaaatacaagatac

SEQ ID NO: 1136336 - DNA, 22 bp, Artificial Sequence
  chemically synthesized
gcttctgctcagtgagtatctt

SEQ ID NO: 1136337 - DNA, 22 bp, Artificial Sequence
  chemically synthesized
aggaaatacaagatactcactg

SEQ ID NO: 1136338 - DNA, 22 bp, Artificial Sequence
  chemically synthesized
ggctggcttctgctcagtgagt

SEQ ID NO: 1136339 - DNA, 22 bp, Artificial Sequence
  chemically synthesized
aatgttgggctggcttctgctc

SEQ ID NO: 1136340 - DNA, 22 bp, Artificial Sequence
  chemically synthesized
gaatgttgggctggcttctgct

SEQ ID NO: 1136341 - DNA, 22 bp, Artificial Sequence
  chemically synthesized
aatttgaatgttgggctggctt

SEQ ID NO: 1136342 - DNA, 22 bp, Artificial Sequence
  chemically synthesized
actgagcagaagccagcccaac

SEQ ID NO: 1136343 - DNA, 22 bp, Artificial Sequence
  chemically synthesized
cctgaatttgaatgttgggctg

SEQ ID NO: 1136344 - DNA, 22 bp, Artificial Sequence
  chemically synthesized
agcagaagccagcccaacattc

SEQ ID NO: 1136345 - DNA, 22 bp, Artificial Sequence
  chemically synthesized
cattccctgaatttgaatgttg

SEQ ID NO: 1136346 - DNA, 22 bp, Artificial Sequence
  chemically synthesized
gcattccctgaatttgaatgtt

SEQ ID NO: 1136347 - DNA, 22 bp, Artificial Sequence
  chemically synthesized
agtatcttgcattccctgaatt

SEQ ID NO: 1136348 - DNA, 22 bp, Artificial Sequence
  chemically synthesized
ctcagtatcttgcattccctga

SEQ ID NO: 1136349 - DNA, 22 bp, Artificial Sequence
  chemically synthesized
gtctgctcagtatcttgcattc

SEQ ID NO: 1136350 - DNA, 22 bp, Artificial Sequence
  chemically synthesized
aaattcagggaatgcaagatac

SEQ ID NO: 1136351 - DNA, 22 bp, Artificial Sequence
  chemically synthesized
gggttggtctgctcagtatctt

SEQ ID NO: 1136352 - DNA, 22 bp, Artificial Sequence
  chemically synthesized
agggaatgcaagatactgagca

SEQ ID NO: 1136353 - DNA, 22 bp, Artificial Sequence
  chemically synthesized
cgtatgttggggttggtctgct

SEQ ID NO: 1136354 - DNA, 22 bp, Artificial Sequence
  chemically synthesized
tatgattacgtatgttggggtt

SEQ ID NO: 1136355 - DNA, 22 bp, Artificial Sequence
  chemically synthesized
agcagaccaaccccaacatacg

SEQ ID NO: 1136356 - DNA, 22 bp, Artificial Sequence
  chemically synthesized
gagaattgtatgattacgtatg

SEQ ID NO: 1136357 - DNA, 22 bp, Artificial Sequence
  chemically synthesized
aacctggagaattgtatgatta

SEQ ID NO: 1136358 - DNA, 22 bp, Artificial Sequence
  chemically synthesized
aaacctggagaattgtatgatt

SEQ ID NO: 1136359 - DNA, 22 bp, Artificial Sequence
  chemically synthesized
atttaaacctggagaattgtat

SEQ ID NO: 1136360 - DNA, 22 bp, Artificial Sequence
  chemically synthesized
catttaaacctggagaattgta

SEQ ID NO: 1136361 - DNA, 22 bp, Artificial Sequence
  chemically synthesized
tcatttaaacctggagaattgt

SEQ ID NO: 1136362 - DNA, 22 bp, Artificial Sequence
  chemically synthesized
tttcatttaaacctggagaatt

SEQ ID NO: 1136363 - DNA, 22 bp, Artificial Sequence
  chemically synthesized
ctttcatttaaacctggagaat

SEQ ID NO: 1136364 - DNA, 22 bp, Artificial Sequence
  chemically synthesized
tctttcatttaaacctggagaa

SEQ ID NO: 1136365 - DNA, 22 bp, Artificial Sequence
  chemically synthesized
ttctttcatttaaacctggaga

SEQ ID NO: 1136366 - DNA, 22 bp, Artificial Sequence
  chemically synthesized
tttctttcatttaaacctggag

SEQ ID NO: 1136367 - DNA, 22 bp, Artificial Sequence
  chemically synthesized
acattttttctttcatttaaac

SEQ ID NO: 1136368 - DNA, 22 bp, Artificial Sequence
  chemically synthesized
aacattttttctttcatttaaa

SEQ ID NO: 1136369 - DNA, 22 bp, Artificial Sequence
  chemically synthesized
tccttaacattttttctttcat

SEQ ID NO: 1136370 - DNA, 22 bp, Artificial Sequence
  chemically synthesized
tccaggtttaaatgaaagaaaa

SEQ ID NO: 1136371 - DNA, 22 bp, Artificial Sequence
  chemically synthesized
caggtttaaatgaaagaaaaaa

SEQ ID NO: 1136372 - DNA, 22 bp, Artificial Sequence
  chemically synthesized
gctgtccttaacattttttctt

SEQ ID NO: 1136373 - DNA, 22 bp, Artificial Sequence
  chemically synthesized
tggctgtccttaacattttttc

SEQ ID NO: 1136374 - DNA, 22 bp, Artificial Sequence
  chemically synthesized
tctggctgtccttaacattttt

SEQ ID NO: 1136375 - DNA, 22 bp, Artificial Sequence
  chemically synthesized
aaatgaaagaaaaaatgttaag

SEQ ID NO: 1136376 - DNA, 22 bp, Artificial Sequence
  chemically synthesized
tctctggctgtccttaacattt

SEQ ID NO: 1136377 - DNA, 22 bp, Artificial Sequence
  chemically synthesized
aatgaaagaaaaaatgttaagg

SEQ ID NO: 1136378 - DNA, 22 bp, Artificial Sequence
  chemically synthesized
ctctctggctgtccttaacatt

SEQ ID NO: 1136379 - DNA, 22 bp, Artificial Sequence
  chemically synthesized
tctctctggctgtccttaacat

SEQ ID NO: 1136380 - DNA, 22 bp, Artificial Sequence
  chemically synthesized
gcctttctctctggctgtcctt

SEQ ID NO: 1136381 - DNA, 22 bp, Artificial Sequence
  chemically synthesized
taggtaacctggcctttctctc

SEQ ID NO: 1136382 - DNA, 22 bp, Artificial Sequence
  chemically synthesized
gtaggtaacctggcctttctct

SEQ ID NO: 1136383 - DNA, 22 bp, Artificial Sequence
  chemically synthesized
aggacagccagagagaaaggcc

SEQ ID NO: 1136384 - DNA, 22 bp, Artificial Sequence
  chemically synthesized
tgtaggtaacctggcctttctc

SEQ ID NO: 1136385 - DNA, 22 bp, Artificial Sequence
  chemically synthesized
cctttgtaggtaacctggcctt

SEQ ID NO: 1136386 - DNA, 22 bp, Artificial Sequence
  chemically synthesized
ccctttgtaggtaacctggcct

SEQ ID NO: 1136387 - DNA, 22 bp, Artificial Sequence
  chemically synthesized
atgggcttccctttgtaggtaa

SEQ ID NO: 1136388 - DNA, 22 bp, Artificial Sequence
  chemically synthesized
ccctgatgggcttccctttgta

SEQ ID NO: 1136389 - DNA, 22 bp, Artificial Sequence
  chemically synthesized
ttaccctgatgggcttcccttt

SEQ ID NO: 1136390 - DNA, 22 bp, Artificial Sequence
  chemically synthesized
ctgttaccctgatgggcttccc

SEQ ID NO: 1136391 - DNA, 22 bp, Artificial Sequence
  chemically synthesized
cctacaaagggaagcccatcag

SEQ ID NO: 1136392 - DNA, 22 bp, Artificial Sequence
  chemically synthesized
caaagggaagcccatcagggta

SEQ ID NO: 1136393 - DNA, 22 bp, Artificial Sequence
  chemically synthesized
agagatctgctgttaccctgat

SEQ ID NO: 1136394 - DNA, 22 bp, Artificial Sequence
  chemically synthesized
ctgagagatctgctgttaccct

SEQ ID NO: 1136395 - DNA, 22 bp, Artificial Sequence
  chemically synthesized
tgctgagagatctgctgttacc

SEQ ID NO: 1136396 - DNA, 22 bp, Artificial Sequence
  chemically synthesized
ctgctgagagatctgctgttac

SEQ ID NO: 1136397 - DNA, 22 bp, Artificial Sequence
  chemically synthesized
tagggtttctgctgagagatct

SEQ ID NO: 1136398 - DNA, 22 bp, Artificial Sequence
  chemically synthesized
atagggtttctgctgagagatc

SEQ ID NO: 1136399 - DNA, 22 bp, Artificial Sequence
  chemically synthesized
gcttatagggtttctgctgaga

SEQ ID NO: 1136400 - DNA, 22 bp, Artificial Sequence
  chemically synthesized
ctggcttatagggtttctgctg

SEQ ID NO: 1136401 - DNA, 22 bp, Artificial Sequence
  chemically synthesized
tactggcttatagggtttctgc

SEQ ID NO: 1136402 - DNA, 22 bp, Artificial Sequence
  chemically synthesized
tcagcagaaaccctataagcca

SEQ ID NO: 1136403 - DNA, 22 bp, Artificial Sequence
  chemically synthesized
agcagaaaccctataagccagt

SEQ ID NO: 1136404 - DNA, 22 bp, Artificial Sequence
  chemically synthesized
gcccccaatctctactggctta

SEQ ID NO: 1136405 - DNA, 22 bp, Artificial Sequence
  chemically synthesized
aatattagcccccaatctctac

SEQ ID NO: 1136406 - DNA, 22 bp, Artificial Sequence
  chemically synthesized
taagccagtagagattgggggc

SEQ ID NO: 1136407 - DNA, 22 bp, Artificial Sequence
  chemically synthesized
acggtgttgaatattagccccc

SEQ ID NO: 1136408 - DNA, 22 bp, Artificial Sequence
  chemically synthesized
cacggtgttgaatattagcccc

SEQ ID NO: 1136409 - DNA, 22 bp, Artificial Sequence
  chemically synthesized
tcacggtgttgaatattagccc

SEQ ID NO: 1136410 - DNA, 22 bp, Artificial Sequence
  chemically synthesized
tttcacggtgttgaatattagc

SEQ ID NO: 1136411 - DNA, 22 bp, Artificial Sequence
  chemically synthesized
ctttcacggtgttgaatattag

SEQ ID NO: 1136412 - DNA, 22 bp, Artificial Sequence
  chemically synthesized
tctttcacggtgttgaatatta

SEQ ID NO: 1136413 - DNA, 22 bp, Artificial Sequence
  chemically synthesized
ttctttcacggtgttgaatatt

SEQ ID NO: 1136414 - DNA, 22 bp, Artificial Sequence
  chemically synthesized
ttttctttcacggtgttgaata

SEQ ID NO: 1136415 - DNA, 22 bp, Artificial Sequence
  chemically synthesized
ggggctaatattcaacaccgtg

SEQ ID NO: 1136416 - DNA, 22 bp, Artificial Sequence
  chemically synthesized
gaaattcttttctttcacggtg

SEQ ID NO: 1136417 - DNA, 22 bp, Artificial Sequence
  chemically synthesized
ggaaattcttttctttcacggt

SEQ ID NO: 1136418 - DNA, 22 bp, Artificial Sequence
  chemically synthesized
atattcaacaccgtgaaagaaa

SEQ ID NO: 1136419 - DNA, 22 bp, Artificial Sequence
  chemically synthesized
ccttggaaattcttttctttca

SEQ ID NO: 1136420 - DNA, 22 bp, Artificial Sequence
  chemically synthesized
tgccttggaaattcttttcttt

SEQ ID NO: 1136421 - DNA, 22 bp, Artificial Sequence
  chemically synthesized
aacaccgtgaaagaaaagaatt

SEQ ID NO: 1136422 - DNA, 22 bp, Artificial Sequence
  chemically synthesized
gatatgaaattctgccttggaa

SEQ ID NO: 1136423 - DNA, 22 bp, Artificial Sequence
  chemically synthesized
tctggatatgaaattctgcctt

SEQ ID NO: 1136424 - DNA, 22 bp, Artificial Sequence
  chemically synthesized
gtctggatatgaaattctgcct

SEQ ID NO: 1136425 - DNA, 22 bp, Artificial Sequence
  chemically synthesized
tgtctggatatgaaattctgcc

SEQ ID NO: 1136426 - DNA, 22 bp, Artificial Sequence
  chemically synthesized
ctttgtctggatatgaaattct

SEQ ID NO: 1136427 - DNA, 22 bp, Artificial Sequence
  chemically synthesized
actttgtctggatatgaaattc

SEQ ID NO: 1136428 - DNA, 22 bp, Artificial Sequence
  chemically synthesized
ccaaggcagaatttcatatcca

SEQ ID NO: 1136429 - DNA, 22 bp, Artificial Sequence
  chemically synthesized
caaggcagaatttcatatccag

SEQ ID NO: 1136430 - DNA, 22 bp, Artificial Sequence
  chemically synthesized
tgaagcttactttgtctggata

SEQ ID NO: 1136431 - DNA, 22 bp, Artificial Sequence
  chemically synthesized
atgaagcttactttgtctggat

SEQ ID NO: 1136432 - DNA, 22 bp, Artificial Sequence
  chemically synthesized
acttatgaagcttactttgtct

SEQ ID NO: 1136433 - DNA, 22 bp, Artificial Sequence
  chemically synthesized
cacttatgaagcttactttgtc

SEQ ID NO: 1136434 - DNA, 22 bp, Artificial Sequence
  chemically synthesized
cttcacttatgaagcttacttt

SEQ ID NO: 1136435 - DNA, 22 bp, Artificial Sequence
  chemically synthesized
catatccagacaaagtaagctt

SEQ ID NO: 1136436 - DNA, 22 bp, Artificial Sequence
  chemically synthesized
ccttcacttatgaagcttactt

SEQ ID NO: 1136437 - DNA, 22 bp, Artificial Sequence
  chemically synthesized
atatccagacaaagtaagcttc

SEQ ID NO: 1136438 - DNA, 22 bp, Artificial Sequence
  chemically synthesized
ttccttcacttatgaagcttac

SEQ ID NO: 1136439 - DNA, 22 bp, Artificial Sequence
  chemically synthesized
ttcttccttcacttatgaagct

SEQ ID NO: 1136440 - DNA, 22 bp, Artificial Sequence
  chemically synthesized
attcttccttcacttatgaagc

SEQ ID NO: 1136441 - DNA, 22 bp, Artificial Sequence
  chemically synthesized
tattcttccttcacttatgaag

SEQ ID NO: 1136442 - DNA, 22 bp, Artificial Sequence
  chemically synthesized
gaaaagattttattcttccttc

SEQ ID NO: 1136443 - DNA, 22 bp, Artificial Sequence
  chemically synthesized
tctggaaaagattttattcttc

SEQ ID NO: 1136444 - DNA, 22 bp, Artificial Sequence
  chemically synthesized
cataagtgaaggaagaataaaa

SEQ ID NO: 1136445 - DNA, 22 bp, Artificial Sequence
  chemically synthesized
gtctggaaaagattttattctt

SEQ ID NO: 1136446 - DNA, 22 bp, Artificial Sequence
  chemically synthesized
ataagtgaaggaagaataaaat

SEQ ID NO: 1136447 - DNA, 22 bp, Artificial Sequence
  chemically synthesized
cttgtctggaaaagattttatt

SEQ ID NO: 1136448 - DNA, 22 bp, Artificial Sequence
  chemically synthesized
gcttgtctggaaaagattttat

SEQ ID NO: 1136449 - DNA, 22 bp, Artificial Sequence
  chemically synthesized
catcaacatttgcttgtctgga

SEQ ID NO: 1136450 - DNA, 22 bp, Artificial Sequence
  chemically synthesized
ttccagacaagcaaatgttgat

SEQ ID NO: 1136451 - DNA, 22 bp, Artificial Sequence
  chemically synthesized
tccagacaagcaaatgttgatg

SEQ ID NO: 1136452 - DNA, 22 bp, Artificial Sequence
  chemically synthesized
ccagacaagcaaatgttgatgg

SEQ ID NO: 1136453 - DNA, 22 bp, Artificial Sequence
  chemically synthesized
cagacaagcaaatgttgatgga

SEQ ID NO: 1136454 - DNA, 22 bp, Artificial Sequence
  chemically synthesized
tgaaatacgatagtgacgaatt

SEQ ID NO: 1136455 - DNA, 22 bp, Artificial Sequence
  chemically synthesized
atggaattcgtcactatcgtat

SEQ ID NO: 1136456 - DNA, 22 bp, Artificial Sequence
  chemically synthesized
atcataattatgaaatacgata

SEQ ID NO: 1136457 - DNA, 22 bp, Artificial Sequence
  chemically synthesized
gatcataattatgaaatacgat

SEQ ID NO: 1136458 - DNA, 22 bp, Artificial Sequence
  chemically synthesized
tcttgatcataattatgaaata

SEQ ID NO: 1136459 - DNA, 22 bp, Artificial Sequence
  chemically synthesized
atcttgatcataattatgaaat

SEQ ID NO: 1136460 - DNA, 22 bp, Artificial Sequence
  chemically synthesized
gtcactatcgtatttcataatt

SEQ ID NO: 1136461 - DNA, 22 bp, Artificial Sequence
  chemically synthesized
tatcttgatcataattatgaaa

SEQ ID NO: 1136462 - DNA, 22 bp, Artificial Sequence
  chemically synthesized
tcgtatttcataattatgatca

SEQ ID NO: 1136463 - DNA, 22 bp, Artificial Sequence
  chemically synthesized
atcgatatatattttatcttga

SEQ ID NO: 1136464 - DNA, 22 bp, Artificial Sequence
  chemically synthesized
cataattatgatcaagataaaa

SEQ ID NO: 1136465 - DNA, 22 bp, Artificial Sequence
  chemically synthesized
ataattatgatcaagataaaat

SEQ ID NO: 1136466 - DNA, 22 bp, Artificial Sequence
  chemically synthesized
gccctgatcgatatatatttta

SEQ ID NO: 1136467 - DNA, 22 bp, Artificial Sequence
  chemically synthesized
ggccctgatcgatatatatttt

SEQ ID NO: 1136468 - DNA, 22 bp, Artificial Sequence
  chemically synthesized
tgatcaagataaaatatatatc

SEQ ID NO: 1136469 - DNA, 22 bp, Artificial Sequence
  chemically synthesized
ccttggccctgatcgatatata

SEQ ID NO: 1136470 - DNA, 22 bp, Artificial Sequence
  chemically synthesized
attgccttggccctgatcgata

SEQ ID NO: 1136471 - DNA, 22 bp, Artificial Sequence
  chemically synthesized
taattgccttggccctgatcga

SEQ ID NO: 1136472 - DNA, 22 bp, Artificial Sequence
  chemically synthesized
ctaattgccttggccctgatcg

SEQ ID NO: 1136473 - DNA, 22 bp, Artificial Sequence
  chemically synthesized
tctaattgccttggccctgatc

SEQ ID NO: 1136474 - DNA, 22 bp, Artificial Sequence
  chemically synthesized
ttctaattgccttggccctgat

SEQ ID NO: 1136475 - DNA, 22 bp, Artificial Sequence
  chemically synthesized
tttctaattgccttggccctga

SEQ ID NO: 1136476 - DNA, 22 bp, Artificial Sequence
  chemically synthesized
tgcagttttttctaattgcctt

SEQ ID NO: 1136477 - DNA, 22 bp, Artificial Sequence
  chemically synthesized
gtgcagttttttctaattgcct

SEQ ID NO: 1136478 - DNA, 22 bp, Artificial Sequence
  chemically synthesized
taatttgtgcagttttttctaa

SEQ ID NO: 1136479 - DNA, 22 bp, Artificial Sequence
  chemically synthesized
gtaatttgtgcagttttttcta

SEQ ID NO: 1136480 - DNA, 22 bp, Artificial Sequence
  chemically synthesized
taaacatacttgtaatttgtgc

SEQ ID NO: 1136481 - DNA, 22 bp, Artificial Sequence
  chemically synthesized
ataaacatacttgtaatttgtg

SEQ ID NO: 1136482 - DNA, 22 bp, Artificial Sequence
  chemically synthesized
tataaacatacttgtaatttgt

SEQ ID NO: 1136483 - DNA, 22 bp, Artificial Sequence
  chemically synthesized
gaaaaaactgcacaaattacaa

SEQ ID NO: 1136484 - DNA, 22 bp, Artificial Sequence
  chemically synthesized
ttataaacatacttgtaatttg

SEQ ID NO: 1136485 - DNA, 22 bp, Artificial Sequence
  chemically synthesized
tttataaacatacttgtaattt

SEQ ID NO: 1136486 - DNA, 22 bp, Artificial Sequence
  chemically synthesized
taattttttataaacatacttg

SEQ ID NO: 1136487 - DNA, 22 bp, Artificial Sequence
  chemically synthesized
cacaaattacaagtatgtttat

SEQ ID NO: 1136488 - DNA, 22 bp, Artificial Sequence
  chemically synthesized
cctgtaattttttataaacata

SEQ ID NO: 1136489 - DNA, 22 bp, Artificial Sequence
  chemically synthesized
caagtatgtttataaaaaatta

SEQ ID NO: 1136490 - DNA, 22 bp, Artificial Sequence
  chemically synthesized
aaatgatcatgattccctgtaa

SEQ ID NO: 1136491 - DNA, 22 bp, Artificial Sequence
  chemically synthesized
ataaaaaattacagggaatcat

SEQ ID NO: 1136492 - DNA, 22 bp, Artificial Sequence
  chemically synthesized
taaaaaattacagggaatcatg

SEQ ID NO: 1136493 - DNA, 22 bp, Artificial Sequence
  chemically synthesized
aaaactcaaatgatcatgattc

SEQ ID NO: 1136494 - DNA, 22 bp, Artificial Sequence
  chemically synthesized
aaaaactcaaatgatcatgatt

SEQ ID NO: 1136495 - DNA, 22 bp, Artificial Sequence
  chemically synthesized
taaaaactcaaatgatcatgat

SEQ ID NO: 1136496 - DNA, 22 bp, Artificial Sequence
  chemically synthesized
tttaaaaactcaaatgatcatg

SEQ ID NO: 1136497 - DNA, 22 bp, Artificial Sequence
  chemically synthesized
ctttaaaaactcaaatgatcat

SEQ ID NO: 1136498 - DNA, 22 bp, Artificial Sequence
  chemically synthesized
cagggaatcatgatcatttgag

SEQ ID NO: 1136499 - DNA, 22 bp, Artificial Sequence
  chemically synthesized
acttctttaaaaactcaaatga

SEQ ID NO: 1136500 - DNA, 22 bp, Artificial Sequence
  chemically synthesized
gattgacttctttaaaaactca

SEQ ID NO: 1136501 - DNA, 22 bp, Artificial Sequence
  chemically synthesized
gagtttttaaagaagtcaatcc

SEQ ID NO: 1136502 - DNA, 22 bp, Artificial Sequence
  chemically synthesized
agtttttaaagaagtcaatcca

SEQ ID NO: 1136503 - DNA, 22 bp, Artificial Sequence
  chemically synthesized
ttaaagaagtcaatccagggta

SEQ ID NO: 1136504 - DNA, 22 bp, Artificial Sequence
  chemically synthesized
taaagaagtcaatccagggtat

SEQ ID NO: 1136505 - DNA, 22 bp, Artificial Sequence
  chemically synthesized
aaagaagtcaatccagggtata

SEQ ID NO: 1136506 - DNA, 22 bp, Artificial Sequence
  chemically synthesized
aagaagtcaatccagggtatat

SEQ ID NO: 1136507 - DNA, 22 bp, Artificial Sequence
  chemically synthesized
caatgagaaaagagggcaaata

SEQ ID NO: 1136508 - DNA, 22 bp, Artificial Sequence
  chemically synthesized
acaatgagaaaagagggcaaat

SEQ ID NO: 1136509 - DNA, 22 bp, Artificial Sequence
  chemically synthesized
gaggcttacaatgagaaaagag

SEQ ID NO: 1136510 - DNA, 22 bp, Artificial Sequence
  chemically synthesized
tctggaggcttacaatgagaaa

SEQ ID NO: 1136511 - DNA, 22 bp, Artificial Sequence
  chemically synthesized
ctatctggaggcttacaatgag

SEQ ID NO: 1136512 - DNA, 22 bp, Artificial Sequence
  chemically synthesized
gctatctggaggcttacaatga

SEQ ID NO: 1136513 - DNA, 22 bp, Artificial Sequence
  chemically synthesized
gccctcttttctcattgtaagc

SEQ ID NO: 1136514 - DNA, 22 bp, Artificial Sequence
  chemically synthesized
ccctcttttctcattgtaagcc

SEQ ID NO: 1136515 - DNA, 22 bp, Artificial Sequence
  chemically synthesized
ttgctatctggaggcttacaat

SEQ ID NO: 1136516 - DNA, 22 bp, Artificial Sequence
  chemically synthesized
ttttctcattgtaagcctccag

SEQ ID NO: 1136517 - DNA, 22 bp, Artificial Sequence
  chemically synthesized
ttctcattgtaagcctccagat

SEQ ID NO: 1136518 - DNA, 22 bp, Artificial Sequence
  chemically synthesized
tctcattgtaagcctccagata

SEQ ID NO: 1136519 - DNA, 22 bp, Artificial Sequence
  chemically synthesized
ctcattgtaagcctccagatag

SEQ ID NO: 1136520 - DNA, 22 bp, Artificial Sequence
  chemically synthesized
tcattgtaagcctccagatagc

SEQ ID NO: 1136521 - DNA, 22 bp, Artificial Sequence
  chemically synthesized
attgtaagcctccagatagcaa

SEQ ID NO: 1136522 - DNA, 22 bp, Artificial Sequence
  chemically synthesized
gagagataataactcttgctat

SEQ ID NO: 1136523 - DNA, 22 bp, Artificial Sequence
  chemically synthesized
taagcctccagatagcaagagt

SEQ ID NO: 1136524 - DNA, 22 bp, Artificial Sequence
  chemically synthesized
aatgttggagagataataactc

SEQ ID NO: 1136525 - DNA, 22 bp, Artificial Sequence
  chemically synthesized
cagatagcaagagttattatct

SEQ ID NO: 1136526 - DNA, 22 bp, Artificial Sequence
  chemically synthesized
taaatgttggagagataataac

SEQ ID NO: 1136527 - DNA, 22 bp, Artificial Sequence
  chemically synthesized
ctaaatgttggagagataataa

SEQ ID NO: 1136528 - DNA, 22 bp, Artificial Sequence
  chemically synthesized
tctaaatgttggagagataata

SEQ ID NO: 1136529 - DNA, 22 bp, Artificial Sequence
  chemically synthesized
ttctaaatgttggagagataat

SEQ ID NO: 1136530 - DNA, 22 bp, Artificial Sequence
  chemically synthesized
tttctaaatgttggagagataa

SEQ ID NO: 1136531 - DNA, 22 bp, Artificial Sequence
  chemically synthesized
ttttctaaatgttggagagata

SEQ ID NO: 1136532 - DNA, 22 bp, Artificial Sequence
  chemically synthesized
tttttctaaatgttggagagat

SEQ ID NO: 1136533 - DNA, 22 bp, Artificial Sequence
  chemically synthesized
ttatctctccaacatttagaaa

SEQ ID NO: 1136534 - DNA, 22 bp, Artificial Sequence
  chemically synthesized
tctctccaacatttagaaaaaa

SEQ ID NO: 1136535 - DNA, 22 bp, Artificial Sequence
  chemically synthesized
tccaacatttagaaaaaaagta

SEQ ID NO: 1136536 - DNA, 22 bp, Artificial Sequence
  chemically synthesized
agaagatagaaaatactttttt

SEQ ID NO: 1136537 - DNA, 22 bp, Artificial Sequence
  chemically synthesized
caacatttagaaaaaaagtatt

SEQ ID NO: 1136538 - DNA, 22 bp, Artificial Sequence
  chemically synthesized
agaaaaaaagtattttctatct

SEQ ID NO: 1136539 - DNA, 22 bp, Artificial Sequence
  chemically synthesized
gaaaaaaagtattttctatctt

SEQ ID NO: 1136540 - DNA, 22 bp, Artificial Sequence
  chemically synthesized
gaaggtagcctaagaagataga

SEQ ID NO: 1136541 - DNA, 22 bp, Artificial Sequence
  chemically synthesized
attagaaggtagcctaagaaga

SEQ ID NO: 1136542 - DNA, 22 bp, Artificial Sequence
  chemically synthesized
agttgattagaaggtagcctaa

SEQ ID NO: 1136543 - DNA, 22 bp, Artificial Sequence
  chemically synthesized
aagttgattagaaggtagccta

SEQ ID NO: 1136544 - DNA, 22 bp, Artificial Sequence
  chemically synthesized
tctatcttcttaggctaccttc

SEQ ID NO: 1136545 - DNA, 22 bp, Artificial Sequence
  chemically synthesized
ctatcttcttaggctaccttct

SEQ ID NO: 1136546 - DNA, 22 bp, Artificial Sequence
  chemically synthesized
tatcttcttaggctaccttcta

SEQ ID NO: 1136547 - DNA, 22 bp, Artificial Sequence
  chemically synthesized
tcttcttaggctaccttctaat

SEQ ID NO: 1136548 - DNA, 22 bp, Artificial Sequence
  chemically synthesized
agggtatttaagttgattagaa

SEQ ID NO: 1136549 - DNA, 22 bp, Artificial Sequence
  chemically synthesized
cttaggctaccttctaatcaac

SEQ ID NO: 1136550 - DNA, 22 bp, Artificial Sequence
  chemically synthesized
ttaggctaccttctaatcaact

SEQ ID NO: 1136551 - DNA, 22 bp, Artificial Sequence
  chemically synthesized
aggctaccttctaatcaactta

SEQ ID NO: 1136552 - DNA, 22 bp, Artificial Sequence
  chemically synthesized
ggctaccttctaatcaacttaa

SEQ ID NO: 1136553 - DNA, 22 bp, Artificial Sequence
  chemically synthesized
ccttctaatcaacttaaatacc

SEQ ID NO: 1136554 - DNA, 22 bp, Artificial Sequence
  chemically synthesized
gacacaagctgagggtatttaa

SEQ ID NO: 1136555 - DNA, 22 bp, Artificial Sequence
  chemically synthesized
ctaatcaacttaaataccctca

SEQ ID NO: 1136556 - DNA, 22 bp, Artificial Sequence
  chemically synthesized
taatcaacttaaataccctcag

SEQ ID NO: 1136557 - DNA, 22 bp, Artificial Sequence
  chemically synthesized
atcaacttaaataccctcagct

SEQ ID NO: 1136558 - DNA, 22 bp, Artificial Sequence
  chemically synthesized
aataatacctggacacaagctg

SEQ ID NO: 1136559 - DNA, 22 bp, Artificial Sequence
  chemically synthesized
gaataatacctggacacaagct

SEQ ID NO: 1136560 - DNA, 22 bp, Artificial Sequence
  chemically synthesized
aaataccctcagcttgtgtcca

SEQ ID NO: 1136561 - DNA, 22 bp, Artificial Sequence
  chemically synthesized
aataccctcagcttgtgtccag

SEQ ID NO: 1136562 - DNA, 22 bp, Artificial Sequence
  chemically synthesized
acttgaataatacctggacaca

SEQ ID NO: 1136563 - DNA, 22 bp, Artificial Sequence
  chemically synthesized
gacttgaataatacctggacac

SEQ ID NO: 1136564 - DNA, 22 bp, Artificial Sequence
  chemically synthesized
agatttgacttgaataatacct

SEQ ID NO: 1136565 - DNA, 22 bp, Artificial Sequence
  chemically synthesized
agcttgtgtccaggtattattc

SEQ ID NO: 1136566 - DNA, 22 bp, Artificial Sequence
  chemically synthesized
gtgtccaggtattattcaagtc

SEQ ID NO: 1136567 - DNA, 22 bp, Artificial Sequence
  chemically synthesized
aaactcagatttgacttgaata

SEQ ID NO: 1136568 - DNA, 22 bp, Artificial Sequence
  chemically synthesized
tgtccaggtattattcaagtca

SEQ ID NO: 1136569 - DNA, 22 bp, Artificial Sequence
  chemically synthesized
caaactcagatttgacttgaat

SEQ ID NO: 1136570 - DNA, 22 bp, Artificial Sequence
  chemically synthesized
catttcaaactcagatttgact

SEQ ID NO: 1136571 - DNA, 22 bp, Artificial Sequence
  chemically synthesized
gcatttcaaactcagatttgac

SEQ ID NO: 1136572 - DNA, 22 bp, Artificial Sequence
  chemically synthesized
ttgcatttcaaactcagatttg

SEQ ID NO: 1136573 - DNA, 22 bp, Artificial Sequence
  chemically synthesized
tcttgcatttcaaactcagatt

SEQ ID NO: 1136574 - DNA, 22 bp, Artificial Sequence
  chemically synthesized
ttcaagtcaaatctgagtttga

SEQ ID NO: 1136575 - DNA, 22 bp, Artificial Sequence
  chemically synthesized
ctctcttgcatttcaaactcag

SEQ ID NO: 1136576 - DNA, 22 bp, Artificial Sequence
  chemically synthesized
aagtcaaatctgagtttgaaat

SEQ ID NO: 1136577 - DNA, 22 bp, Artificial Sequence
  chemically synthesized
ggaggactgctctcttgcattt

SEQ ID NO: 1136578 - DNA, 22 bp, Artificial Sequence
  chemically synthesized
agtttgaaatgcaagagagcag

SEQ ID NO: 1136579 - DNA, 22 bp, Artificial Sequence
  chemically synthesized
gaaatgcaagagagcagtcctc

SEQ ID NO: 1136580 - DNA, 22 bp, Artificial Sequence
  chemically synthesized
aaatgcaagagagcagtcctcc

SEQ ID NO: 1136581 - DNA, 22 bp, Artificial Sequence
  chemically synthesized
ctagctgattattttttcacgt

SEQ ID NO: 1136582 - DNA, 22 bp, Artificial Sequence
  chemically synthesized
gctgattattttttcacgtttt

SEQ ID NO: 1136583 - DNA, 22 bp, Artificial Sequence
  chemically synthesized
catggcaagagatcaaaacgtg

SEQ ID NO: 1136584 - DNA, 22 bp, Artificial Sequence
  chemically synthesized
attattttttcacgttttgatc

SEQ ID NO: 1136585 - DNA, 22 bp, Artificial Sequence
  chemically synthesized
ttttttcacgttttgatctctt

SEQ ID NO: 1136586 - DNA, 22 bp, Artificial Sequence
  chemically synthesized
tttcacgttttgatctcttgcc

SEQ ID NO: 1136587 - DNA, 22 bp, Artificial Sequence
  chemically synthesized
aagcagttgcatggcaagagat

SEQ ID NO: 1136588 - DNA, 22 bp, Artificial Sequence
  chemically synthesized
ttcacgttttgatctcttgcca

SEQ ID NO: 1136589 - DNA, 22 bp, Artificial Sequence
  chemically synthesized
gaagcagttgcatggcaagaga

SEQ ID NO: 1136590 - DNA, 22 bp, Artificial Sequence
  chemically synthesized
tcacgttttgatctcttgccat

SEQ ID NO: 1136591 - DNA, 22 bp, Artificial Sequence
  chemically synthesized
tgaagcagttgcatggcaagag

SEQ ID NO: 1136592 - DNA, 22 bp, Artificial Sequence
  chemically synthesized
cacgttttgatctcttgccatg

SEQ ID NO: 1136593 - DNA, 22 bp, Artificial Sequence
  chemically synthesized
ttgaagcagttgcatggcaaga

SEQ ID NO: 1136594 - DNA, 22 bp, Artificial Sequence
  chemically synthesized
acgttttgatctcttgccatgc

SEQ ID NO: 1136595 - DNA, 22 bp, Artificial Sequence
  chemically synthesized
accttttgaagcagttgcatgg

SEQ ID NO: 1136596 - DNA, 22 bp, Artificial Sequence
  chemically synthesized
gaccttttgaagcagttgcatg

SEQ ID NO: 1136597 - DNA, 22 bp, Artificial Sequence
  chemically synthesized
tgatctcttgccatgcaactgc

SEQ ID NO: 1136598 - DNA, 22 bp, Artificial Sequence
  chemically synthesized
tgaccttttgaagcagttgcat

SEQ ID NO: 1136599 - DNA, 22 bp, Artificial Sequence
  chemically synthesized
gatctcttgccatgcaactgct

SEQ ID NO: 1136600 - DNA, 22 bp, Artificial Sequence
  chemically synthesized
ttgaccttttgaagcagttgca

SEQ ID NO: 1136601 - DNA, 22 bp, Artificial Sequence
  chemically synthesized
atctcttgccatgcaactgctt

SEQ ID NO: 1136602 - DNA, 22 bp, Artificial Sequence
  chemically synthesized
ttgccatgcaactgcttcaaaa

SEQ ID NO: 1136603 - DNA, 22 bp, Artificial Sequence
  chemically synthesized
gccatgcaactgcttcaaaagg

SEQ ID NO: 1136604 - DNA, 22 bp, Artificial Sequence
  chemically synthesized
aggcatttttgaccttttgaag

SEQ ID NO: 1136605 - DNA, 22 bp, Artificial Sequence
  chemically synthesized
ccatgcaactgcttcaaaaggt

SEQ ID NO: 1136606 - DNA, 22 bp, Artificial Sequence
  chemically synthesized
gaggcatttttgaccttttgaa

SEQ ID NO: 1136607 - DNA, 22 bp, Artificial Sequence
  chemically synthesized
tgaggcatttttgaccttttga

SEQ ID NO: 1136608 - DNA, 22 bp, Artificial Sequence
  chemically synthesized
cttcaaaaggtcaaaaatgcct

SEQ ID NO: 1136609 - DNA, 22 bp, Artificial Sequence
  chemically synthesized
aggtcagagctttgaggcattt

SEQ ID NO: 1136610 - DNA, 22 bp, Artificial Sequence
  chemically synthesized
caaaaggtcaaaaatgcctcaa

SEQ ID NO: 1136611 - DNA, 22 bp, Artificial Sequence
  chemically synthesized
aaaaggtcaaaaatgcctcaaa

SEQ ID NO: 1136612 - DNA, 22 bp, Artificial Sequence
  chemically synthesized
ttcaggtcagagctttgaggca

SEQ ID NO: 1136613 - DNA, 22 bp, Artificial Sequence
  chemically synthesized
ctgttcaggtcagagctttgag

SEQ ID NO: 1136614 - DNA, 22 bp, Artificial Sequence
  chemically synthesized
cgcgtatgattgctgttcaggt

SEQ ID NO: 1136615 - DNA, 22 bp, Artificial Sequence
  chemically synthesized
gcgcgtatgattgctgttcagg

SEQ ID NO: 1136616 - DNA, 22 bp, Artificial Sequence
  chemically synthesized
aaagctctgacctgaacagcaa

SEQ ID NO: 1136617 - DNA, 22 bp, Artificial Sequence
  chemically synthesized
cttgcgcgtatgattgctgttc

SEQ ID NO: 1136618 - DNA, 22 bp, Artificial Sequence
  chemically synthesized
tgacctgaacagcaatcatacg

SEQ ID NO: 1136619 - DNA, 22 bp, Artificial Sequence
  chemically synthesized
acctgaacagcaatcatacgcg

SEQ ID NO: 1136620 - DNA, 22 bp, Artificial Sequence
  chemically synthesized
aacagcaatcatacgcgcaagc

SEQ ID NO: 1136621 - DNA, 22 bp, Artificial Sequence
  chemically synthesized
atataaagaacactgcttgcgc

SEQ ID NO: 1136622 - DNA, 22 bp, Artificial Sequence
  chemically synthesized
tactcatataaagaacactgct

SEQ ID NO: 1136623 - DNA, 22 bp, Artificial Sequence
  chemically synthesized
agatgacaaggcacccagttgt

SEQ ID NO: 1136624 - DNA, 22 bp, Artificial Sequence
  chemically synthesized
tttatatgagtacaactgggtg

SEQ ID NO: 1136625 - DNA, 22 bp, Artificial Sequence
  chemically synthesized
tatatgagtacaactgggtgcc

SEQ ID NO: 1136626 - DNA, 22 bp, Artificial Sequence
  chemically synthesized
atatgagtacaactgggtgcct

SEQ ID NO: 1136627 - DNA, 22 bp, Artificial Sequence
  chemically synthesized
tatgagtacaactgggtgcctt

SEQ ID NO: 1136628 - DNA, 22 bp, Artificial Sequence
  chemically synthesized
ggtgccttgtcatctcaatcac

SEQ ID NO: 1136629 - DNA, 22 bp, Artificial Sequence
  chemically synthesized
gtcatctcaatcacgatttcca

SEQ ID NO: 1136630 - DNA, 22 bp, Artificial Sequence
  chemically synthesized
tgaggcagggtgtggaaatcgt

SEQ ID NO: 1136631 - DNA, 22 bp, Artificial Sequence
  chemically synthesized
tcatctcaatcacgatttccac

SEQ ID NO: 1136632 - DNA, 22 bp, Artificial Sequence
  chemically synthesized
ttgtgaggcagggtgtggaaat

SEQ ID NO: 1136633 - DNA, 22 bp, Artificial Sequence
  chemically synthesized
aatcacgatttccacaccctgc

SEQ ID NO: 1136634 - DNA, 22 bp, Artificial Sequence
  chemically synthesized
aaacctattgtgaggcagggtg

SEQ ID NO: 1136635 - DNA, 22 bp, Artificial Sequence
  chemically synthesized
ccacaccctgcctcacaatagg

SEQ ID NO: 1136636 - DNA, 22 bp, Artificial Sequence
  chemically synthesized
cacaccctgcctcacaataggt

SEQ ID NO: 1136637 - DNA, 22 bp, Artificial Sequence
  chemically synthesized
ataatggttaaaacctattgtg

SEQ ID NO: 1136638 - DNA, 22 bp, Artificial Sequence
  chemically synthesized
tcataatggttaaaacctattg

SEQ ID NO: 1136639 - DNA, 22 bp, Artificial Sequence
  chemically synthesized
cctcacaataggttttaaccat

SEQ ID NO: 1136640 - DNA, 22 bp, Artificial Sequence
  chemically synthesized
acaataggttttaaccattatg

SEQ ID NO: 1136641 - DNA, 22 bp, Artificial Sequence
  chemically synthesized
taaccattatgagaactttgct

SEQ ID NO: 1136642 - DNA, 22 bp, Artificial Sequence
  chemically synthesized
gtataaagaatgagcaaagttc

SEQ ID NO: 1136643 - DNA, 22 bp, Artificial Sequence
  chemically synthesized
aaccattatgagaactttgctc

SEQ ID NO: 1136644 - DNA, 22 bp, Artificial Sequence
  chemically synthesized
accattatgagaactttgctca

SEQ ID NO: 1136645 - DNA, 22 bp, Artificial Sequence
  chemically synthesized
aataattagtataaagaatgag

SEQ ID NO: 1136646 - DNA, 22 bp, Artificial Sequence
  chemically synthesized
tgagaactttgctcattcttta

SEQ ID NO: 1136647 - DNA, 22 bp, Artificial Sequence
  chemically synthesized
aaataattagtataaagaatga

SEQ ID NO: 1136648 - DNA, 22 bp, Artificial Sequence
  chemically synthesized
taaataattagtataaagaatg

SEQ ID NO: 1136649 - DNA, 22 bp, Artificial Sequence
  chemically synthesized
ttaaataattagtataaagaat

SEQ ID NO: 1136650 - DNA, 22 bp, Artificial Sequence
  chemically synthesized
ttttaaataattagtataaaga

SEQ ID NO: 1136651 - DNA, 22 bp, Artificial Sequence
  chemically synthesized
tgctcattctttatactaatta

SEQ ID NO: 1136652 - DNA, 22 bp, Artificial Sequence
  chemically synthesized
gctcattctttatactaattat

SEQ ID NO: 1136653 - DNA, 22 bp, Artificial Sequence
  chemically synthesized
ctcattctttatactaattatt

SEQ ID NO: 1136654 - DNA, 22 bp, Artificial Sequence
  chemically synthesized
aaaaattcttttaaataattag

SEQ ID NO: 1136655 - DNA, 22 bp, Artificial Sequence
  chemically synthesized
caaaaattcttttaaataatta

SEQ ID NO: 1136656 - DNA, 22 bp, Artificial Sequence
  chemically synthesized
attctttatactaattatttaa

SEQ ID NO: 1136657 - DNA, 22 bp, Artificial Sequence
  chemically synthesized
tttcaaaaattcttttaaataa

SEQ ID NO: 1136658 - DNA, 22 bp, Artificial Sequence
  chemically synthesized
tttatactaattatttaaaaga

SEQ ID NO: 1136659 - DNA, 22 bp, Artificial Sequence
  chemically synthesized
tatactaattatttaaaagaat

SEQ ID NO: 1136660 - DNA, 22 bp, Artificial Sequence
  chemically synthesized
atactaattatttaaaagaatt

SEQ ID NO: 1136661 - DNA, 22 bp, Artificial Sequence
  chemically synthesized
aattgtttcaaaaattctttta

SEQ ID NO: 1136662 - DNA, 22 bp, Artificial Sequence
  chemically synthesized
tactaattatttaaaagaattt

SEQ ID NO: 1136663 - DNA, 22 bp, Artificial Sequence
  chemically synthesized
attatttaaaagaatttttgaa

SEQ ID NO: 1136664 - DNA, 22 bp, Artificial Sequence
  chemically synthesized
tttaaaagaatttttgaaacaa

SEQ ID NO: 1136665 - DNA, 22 bp, Artificial Sequence
  chemically synthesized
aaaagaatttttgaaacaattg

SEQ ID NO: 1136666 - DNA, 22 bp, Artificial Sequence
  chemically synthesized
acatgatatactcaattgtttc

SEQ ID NO: 1136667 - DNA, 22 bp, Artificial Sequence
  chemically synthesized
aaagaatttttgaaacaattga

SEQ ID NO: 1136668 - DNA, 22 bp, Artificial Sequence
  chemically synthesized
ctcacatgatatactcaattgt

SEQ ID NO: 1136669 - DNA, 22 bp, Artificial Sequence
  chemically synthesized
ttgaaacaattgagtatatcat

SEQ ID NO: 1136670 - DNA, 22 bp, Artificial Sequence
  chemically synthesized
atgactactcacatgatatact

SEQ ID NO: 1136671 - DNA, 22 bp, Artificial Sequence
  chemically synthesized
tgaaacaattgagtatatcatg

SEQ ID NO: 1136672 - DNA, 22 bp, Artificial Sequence
  chemically synthesized
gaaacaattgagtatatcatgt

SEQ ID NO: 1136673 - DNA, 22 bp, Artificial Sequence
  chemically synthesized
aaacaattgagtatatcatgtg

SEQ ID NO: 1136674 - DNA, 22 bp, Artificial Sequence
  chemically synthesized
attaatgactactcacatgata

SEQ ID NO: 1136675 - DNA, 22 bp, Artificial Sequence
  chemically synthesized
cattaatgactactcacatgat

SEQ ID NO: 1136676 - DNA, 22 bp, Artificial Sequence
  chemically synthesized
agtatatcatgtgagtagtcat

SEQ ID NO: 1136677 - DNA, 22 bp, Artificial Sequence
  chemically synthesized
tgggagaaaaatgagtttcatt

SEQ ID NO: 1136678 - DNA, 22 bp, Artificial Sequence
  chemically synthesized
taatgattgtgggagaaaaatg

SEQ ID NO: 1136679 - DNA, 22 bp, Artificial Sequence
  chemically synthesized
tataatgattgtgggagaaaaa

SEQ ID NO: 1136680 - DNA, 22 bp, Artificial Sequence
  chemically synthesized
ctataatgattgtgggagaaaa

SEQ ID NO: 1136681 - DNA, 22 bp, Artificial Sequence
  chemically synthesized
atgaaactcatttttctcccac

SEQ ID NO: 1136682 - DNA, 22 bp, Artificial Sequence
  chemically synthesized
tctataatgattgtgggagaaa

SEQ ID NO: 1136683 - DNA, 22 bp, Artificial Sequence
  chemically synthesized
atttttctcccacaatcattat

SEQ ID NO: 1136684 - DNA, 22 bp, Artificial Sequence
  chemically synthesized
tatgtacattttctataatgat

SEQ ID NO: 1136685 - DNA, 22 bp, Artificial Sequence
  chemically synthesized
gtatgtacattttctataatga

SEQ ID NO: 1136686 - DNA, 22 bp, Artificial Sequence
  chemically synthesized
ttctcccacaatcattatagaa

SEQ ID NO: 1136687 - DNA, 22 bp, Artificial Sequence
  chemically synthesized
tctcccacaatcattatagaaa

SEQ ID NO: 1136688 - DNA, 22 bp, Artificial Sequence
  chemically synthesized
ctcccacaatcattatagaaaa

SEQ ID NO: 1136689 - DNA, 22 bp, Artificial Sequence
  chemically synthesized
tcccacaatcattatagaaaat

SEQ ID NO: 1136690 - DNA, 22 bp, Artificial Sequence
  chemically synthesized
acttgtatgtacattttctata

SEQ ID NO: 1136691 - DNA, 22 bp, Artificial Sequence
  chemically synthesized
ccacaatcattatagaaaatgt

SEQ ID NO: 1136692 - DNA, 22 bp, Artificial Sequence
  chemically synthesized
aagaacaaagctcacttgtatg

SEQ ID NO: 1136693 - DNA, 22 bp, Artificial Sequence
  chemically synthesized
tagaaaatgtacatacaagtga

SEQ ID NO: 1136694 - DNA, 22 bp, Artificial Sequence
  chemically synthesized
gaagaacaaagctcacttgtat

SEQ ID NO: 1136695 - DNA, 22 bp, Artificial Sequence
  chemically synthesized
tgaagaacaaagctcacttgta

SEQ ID NO: 1136696 - DNA, 22 bp, Artificial Sequence
  chemically synthesized
tgactttgaagaacaaagctca

SEQ ID NO: 1136697 - DNA, 22 bp, Artificial Sequence
  chemically synthesized
taaggttgtgactttgaagaac

SEQ ID NO: 1136698 - DNA, 22 bp, Artificial Sequence
  chemically synthesized
tgttcttcaaagtcacaacctt

SEQ ID NO: 1136699 - DNA, 22 bp, Artificial Sequence
  chemically synthesized
gttcttcaaagtcacaacctta

SEQ ID NO: 1136700 - DNA, 22 bp, Artificial Sequence
  chemically synthesized
ttcttcaaagtcacaaccttac

SEQ ID NO: 1136701 - DNA, 22 bp, Artificial Sequence
  chemically synthesized
caagaatatgagctgtaaggtt

SEQ ID NO: 1136702 - DNA, 22 bp, Artificial Sequence
  chemically synthesized
ttcaaagtcacaaccttacagc

SEQ ID NO: 1136703 - DNA, 22 bp, Artificial Sequence
  chemically synthesized
caaagtcacaaccttacagctc

SEQ ID NO: 1136704 - DNA, 22 bp, Artificial Sequence
  chemically synthesized
aaagtcacaaccttacagctca

SEQ ID NO: 1136705 - DNA, 22 bp, Artificial Sequence
  chemically synthesized
cataaggagaattccaagaata

SEQ ID NO: 1136706 - DNA, 22 bp, Artificial Sequence
  chemically synthesized
acagctcatattcttggaattc

SEQ ID NO: 1136707 - DNA, 22 bp, Artificial Sequence
  chemically synthesized
cagctcatattcttggaattct

SEQ ID NO: 1136708 - DNA, 22 bp, Artificial Sequence
  chemically synthesized
aaattacataaggagaattcca

SEQ ID NO: 1136709 - DNA, 22 bp, Artificial Sequence
  chemically synthesized
attaaaattacataaggagaat

SEQ ID NO: 1136710 - DNA, 22 bp, Artificial Sequence
  chemically synthesized
atattcttggaattctccttat

SEQ ID NO: 1136711 - DNA, 22 bp, Artificial Sequence
  chemically synthesized
gattaaaattacataaggagaa

SEQ ID NO: 1136712 - DNA, 22 bp, Artificial Sequence
  chemically synthesized
accttgattaaaattacataag

SEQ ID NO: 1136713 - DNA, 22 bp, Artificial Sequence
  chemically synthesized
ttggaattctccttatgtaatt

SEQ ID NO: 1136714 - DNA, 22 bp, Artificial Sequence
  chemically synthesized
ggaattctccttatgtaatttt

SEQ ID NO: 1136715 - DNA, 22 bp, Artificial Sequence
  chemically synthesized
gaattctccttatgtaatttta

SEQ ID NO: 1136716 - DNA, 22 bp, Artificial Sequence
  chemically synthesized
aattgaccttgattaaaattac

SEQ ID NO: 1136717 - DNA, 22 bp, Artificial Sequence
  chemically synthesized
tccttatgtaattttaatcaag

SEQ ID NO: 1136718 - DNA, 22 bp, Artificial Sequence
  chemically synthesized
cttatgtaattttaatcaaggt

SEQ ID NO: 1136719 - DNA, 22 bp, Artificial Sequence
  chemically synthesized
tccatgttaaattgaccttgat

SEQ ID NO: 1136720 - DNA, 22 bp, Artificial Sequence
  chemically synthesized
atgtaattttaatcaaggtcaa

SEQ ID NO: 1136721 - DNA, 22 bp, Artificial Sequence
  chemically synthesized
atccatgttaaattgaccttga

SEQ ID NO: 1136722 - DNA, 22 bp, Artificial Sequence
  chemically synthesized
tgtaattttaatcaaggtcaat

SEQ ID NO: 1136723 - DNA, 22 bp, Artificial Sequence
  chemically synthesized
tatccatgttaaattgaccttg

SEQ ID NO: 1136724 - DNA, 22 bp, Artificial Sequence
  chemically synthesized
ttatccatgttaaattgacctt

SEQ ID NO: 1136725 - DNA, 22 bp, Artificial Sequence
  chemically synthesized
ttttatccatgttaaattgacc

SEQ ID NO: 1136726 - DNA, 22 bp, Artificial Sequence
  chemically synthesized
cttttatccatgttaaattgac

SEQ ID NO: 1136727 - DNA, 22 bp, Artificial Sequence
  chemically synthesized
tcttttatccatgttaaattga

SEQ ID NO: 1136728 - DNA, 22 bp, Artificial Sequence
  chemically synthesized
taatcaaggtcaatttaacatg

SEQ ID NO: 1136729 - DNA, 22 bp, Artificial Sequence
  chemically synthesized
aatcaaggtcaatttaacatgg

SEQ ID NO: 1136730 - DNA, 22 bp, Artificial Sequence
  chemically synthesized
attttcttttatccatgttaaa

SEQ ID NO: 1136731 - DNA, 22 bp, Artificial Sequence
  chemically synthesized
atcaaggtcaatttaacatgga

SEQ ID NO: 1136732 - DNA, 22 bp, Artificial Sequence
  chemically synthesized
aacatggataaaagaaaatcag

SEQ ID NO: 1136733 - DNA, 22 bp, Artificial Sequence
  chemically synthesized
acatggataaaagaaaatcagt

SEQ ID NO: 1136734 - DNA, 22 bp, Artificial Sequence
  chemically synthesized
ctcttatatgatactatttcgc

SEQ ID NO: 1136735 - DNA, 22 bp, Artificial Sequence
  chemically synthesized
ttatatgatactatttcgctgt

SEQ ID NO: 1136736 - DNA, 22 bp, Artificial Sequence
  chemically synthesized
atatgatactatttcgctgttg

SEQ ID NO: 1136737 - DNA, 22 bp, Artificial Sequence
  chemically synthesized
tatgatactatttcgctgttgt

SEQ ID NO: 1136738 - DNA, 22 bp, Artificial Sequence
  chemically synthesized
aaaggaggtaaacagagacaac

SEQ ID NO: 1136739 - DNA, 22 bp, Artificial Sequence
  chemically synthesized
tttcgctgttgtctctgtttac

SEQ ID NO: 1136740 - DNA, 22 bp, Artificial Sequence
  chemically synthesized
cgctgttgtctctgtttacctc

SEQ ID NO: 1136741 - DNA, 22 bp, Artificial Sequence
  chemically synthesized
gctgttgtctctgtttacctcc

SEQ ID NO: 1136742 - DNA, 22 bp, Artificial Sequence
  chemically synthesized
ttgtctctgtttacctcctttt

SEQ ID NO: 1136743 - DNA, 22 bp, Artificial Sequence
  chemically synthesized
tctctgtttacctccttttaat

SEQ ID NO: 1136744 - DNA, 22 bp, Artificial Sequence
  chemically synthesized
aggaaaagagaaattaaaagga

SEQ ID NO: 1136745 - DNA, 22 bp, Artificial Sequence
  chemically synthesized
ctcaggaaaagagaaattaaaa

SEQ ID NO: 1136746 - DNA, 22 bp, Artificial Sequence
  chemically synthesized
tgtttacctccttttaatttct

SEQ ID NO: 1136747 - DNA, 22 bp, Artificial Sequence
  chemically synthesized
tttacctccttttaatttctct

SEQ ID NO: 1136748 - DNA, 22 bp, Artificial Sequence
  chemically synthesized
acctccttttaatttctctttt

SEQ ID NO: 1136749 - DNA, 22 bp, Artificial Sequence
  chemically synthesized
cctccttttaatttctcttttc

SEQ ID NO: 1136750 - DNA, 22 bp, Artificial Sequence
  chemically synthesized
cttttaatttctcttttcctga

SEQ ID NO: 1136751 - DNA, 22 bp, Artificial Sequence
  chemically synthesized
ttaatttctcttttcctgagta

SEQ ID NO: 1136752 - DNA, 22 bp, Artificial Sequence
  chemically synthesized
taatttctcttttcctgagtag

SEQ ID NO: 1136753 - DNA, 22 bp, Artificial Sequence
  chemically synthesized
aatttctcttttcctgagtagc

SEQ ID NO: 1136754 - DNA, 22 bp, Artificial Sequence
  chemically synthesized
atttctcttttcctgagtagct

SEQ ID NO: 1136755 - DNA, 22 bp, Artificial Sequence
  chemically synthesized
ctcttttcctgagtagctccat

SEQ ID NO: 1136756 - DNA, 22 bp, Artificial Sequence
  chemically synthesized
tcttttcctgagtagctccatt

SEQ ID NO: 1136757 - DNA, 22 bp, Artificial Sequence
  chemically synthesized
acaggaaggtagaaatggagct

SEQ ID NO: 1136758 - DNA, 22 bp, Artificial Sequence
  chemically synthesized
ttttcctgagtagctccatttc

SEQ ID NO: 1136759 - DNA, 22 bp, Artificial Sequence
  chemically synthesized
ttcctgagtagctccatttcta

SEQ ID NO: 1136760 - DNA, 22 bp, Artificial Sequence
  chemically synthesized
tcctgagtagctccatttctac

SEQ ID NO: 1136761 - DNA, 22 bp, Artificial Sequence
  chemically synthesized
cctgagtagctccatttctacc

SEQ ID NO: 1136762 - DNA, 22 bp, Artificial Sequence
  chemically synthesized
agctcacaggaaggtagaaatg

SEQ ID NO: 1136763 - DNA, 22 bp, Artificial Sequence
  chemically synthesized
ctgagtagctccatttctacct

SEQ ID NO: 1136764 - DNA, 22 bp, Artificial Sequence
  chemically synthesized
gagctcacaggaaggtagaaat

SEQ ID NO: 1136765 - DNA, 22 bp, Artificial Sequence
  chemically synthesized
tgagctcacaggaaggtagaaa

SEQ ID NO: 1136766 - DNA, 22 bp, Artificial Sequence
  chemically synthesized
ttgagctcacaggaaggtagaa

SEQ ID NO: 1136767 - DNA, 22 bp, Artificial Sequence
  chemically synthesized
agtagctccatttctaccttcc

SEQ ID NO: 1136768 - DNA, 22 bp, Artificial Sequence
  chemically synthesized
tttttgagctcacaggaaggta

SEQ ID NO: 1136769 - DNA, 22 bp, Artificial Sequence
  chemically synthesized
gctgtttttgagctcacaggaa

SEQ ID NO: 1136770 - DNA, 22 bp, Artificial Sequence
  chemically synthesized
catttctaccttcctgtgagct

SEQ ID NO: 1136771 - DNA, 22 bp, Artificial Sequence
  chemically synthesized
ctggctgtttttgagctcacag

SEQ ID NO: 1136772 - DNA, 22 bp, Artificial Sequence
  chemically synthesized
gctggctgtttttgagctcaca

SEQ ID NO: 1136773 - DNA, 22 bp, Artificial Sequence
  chemically synthesized
tgctggctgtttttgagctcac

SEQ ID NO: 1136774 - DNA, 22 bp, Artificial Sequence
  chemically synthesized
ctaccttcctgtgagctcaaaa

SEQ ID NO: 1136775 - DNA, 22 bp, Artificial Sequence
  chemically synthesized
taccttcctgtgagctcaaaaa

SEQ ID NO: 1136776 - DNA, 22 bp, Artificial Sequence
  chemically synthesized
ccttcctgtgagctcaaaaaca

SEQ ID NO: 1136777 - DNA, 22 bp, Artificial Sequence
  chemically synthesized
cctgtgagctcaaaaacagcca

SEQ ID NO: 1136778 - DNA, 22 bp, Artificial Sequence
  chemically synthesized
ctgtgagctcaaaaacagccag

SEQ ID NO: 1136779 - DNA, 22 bp, Artificial Sequence
  chemically synthesized
atccaaatctttgctggctgtt

SEQ ID NO: 1136780 - DNA, 22 bp, Artificial Sequence
  chemically synthesized
tgagctcaaaaacagccagcaa

SEQ ID NO: 1136781 - DNA, 22 bp, Artificial Sequence
  chemically synthesized
aaaaacagccagcaaagatttg

SEQ ID NO: 1136782 - DNA, 22 bp, Artificial Sequence
  chemically synthesized
tcatgggattgatccaaatctt

SEQ ID NO: 1136783 - DNA, 22 bp, Artificial Sequence
  chemically synthesized
tgctgtcatgggattgatccaa

SEQ ID NO: 1136784 - DNA, 22 bp, Artificial Sequence
  chemically synthesized
caaaaattatgctgtcatggga

SEQ ID NO: 1136785 - DNA, 22 bp, Artificial Sequence
  chemically synthesized
ccaaaaattatgctgtcatggg

SEQ ID NO: 1136786 - DNA, 22 bp, Artificial Sequence
  chemically synthesized
tccaaaaattatgctgtcatgg

SEQ ID NO: 1136787 - DNA, 22 bp, Artificial Sequence
  chemically synthesized
ggatcaatcccatgacagcata

SEQ ID NO: 1136788 - DNA, 22 bp, Artificial Sequence
  chemically synthesized
gatcaatcccatgacagcataa

SEQ ID NO: 1136789 - DNA, 22 bp, Artificial Sequence
  chemically synthesized
cctttccaaaaattatgctgtc

SEQ ID NO: 1136790 - DNA, 22 bp, Artificial Sequence
  chemically synthesized
attgcctttccaaaaattatgc

SEQ ID NO: 1136791 - DNA, 22 bp, Artificial Sequence
  chemically synthesized
tcattgcctttccaaaaattat

SEQ ID NO: 1136792 - DNA, 22 bp, Artificial Sequence
  chemically synthesized
tctcattgcctttccaaaaatt

SEQ ID NO: 1136793 - DNA, 22 bp, Artificial Sequence
  chemically synthesized
ctctcattgcctttccaaaaat

SEQ ID NO: 1136794 - DNA, 22 bp, Artificial Sequence
  chemically synthesized
tctctcattgcctttccaaaaa

SEQ ID NO: 1136795 - DNA, 22 bp, Artificial Sequence
  chemically synthesized
agttttctctcattgcctttcc

SEQ ID NO: 1136796 - DNA, 22 bp, Artificial Sequence
  chemically synthesized
cagttttctctcattgcctttc

SEQ ID NO: 1136797 - DNA, 22 bp, Artificial Sequence
  chemically synthesized
tgtttcagttttctctcattgc

SEQ ID NO: 1136798 - DNA, 22 bp, Artificial Sequence
  chemically synthesized
atgtttcagttttctctcattg

SEQ ID NO: 1136799 - DNA, 22 bp, Artificial Sequence
  chemically synthesized
ttggaaaggcaatgagagaaaa

SEQ ID NO: 1136800 - DNA, 22 bp, Artificial Sequence
  chemically synthesized
tggaaaggcaatgagagaaaac

SEQ ID NO: 1136801 - DNA, 22 bp, Artificial Sequence
  chemically synthesized
ggaaaggcaatgagagaaaact

SEQ ID NO: 1136802 - DNA, 22 bp, Artificial Sequence
  chemically synthesized
agcttatgtttcagttttctct

SEQ ID NO: 1136803 - DNA, 22 bp, Artificial Sequence
  chemically synthesized
gaaaggcaatgagagaaaactg

SEQ ID NO: 1136804 - DNA, 22 bp, Artificial Sequence
  chemically synthesized
aagcttatgtttcagttttctc

SEQ ID NO: 1136805 - DNA, 22 bp, Artificial Sequence
  chemically synthesized
ttaagcttatgtttcagttttc

SEQ ID NO: 1136806 - DNA, 22 bp, Artificial Sequence
  chemically synthesized
cttaagcttatgtttcagtttt

SEQ ID NO: 1136807 - DNA, 22 bp, Artificial Sequence
  chemically synthesized
tcttaagcttatgtttcagttt

SEQ ID NO: 1136808 - DNA, 22 bp, Artificial Sequence
  chemically synthesized
ttcttaagcttatgtttcagtt

SEQ ID NO: 1136809 - DNA, 22 bp, Artificial Sequence
  chemically synthesized
agtttttcttaagcttatgttt

SEQ ID NO: 1136810 - DNA, 22 bp, Artificial Sequence
  chemically synthesized
gagtttttcttaagcttatgtt

SEQ ID NO: 1136811 - DNA, 22 bp, Artificial Sequence
  chemically synthesized
agcttgagtttttcttaagctt

SEQ ID NO: 1136812 - DNA, 22 bp, Artificial Sequence
  chemically synthesized
aaacataagcttaagaaaaact

SEQ ID NO: 1136813 - DNA, 22 bp, Artificial Sequence
  chemically synthesized
cagaacactaagcttgagtttt

SEQ ID NO: 1136814 - DNA, 22 bp, Artificial Sequence
  chemically synthesized
ccagaacactaagcttgagttt

SEQ ID NO: 1136815 - DNA, 22 bp, Artificial Sequence
  chemically synthesized
tccagaacactaagcttgagtt

SEQ ID NO: 1136816 - DNA, 22 bp, Artificial Sequence
  chemically synthesized
ttttccagaacactaagcttga

SEQ ID NO: 1136817 - DNA, 22 bp, Artificial Sequence
  chemically synthesized
aagaaaaactcaagcttagtgt

SEQ ID NO: 1136818 - DNA, 22 bp, Artificial Sequence
  chemically synthesized
agaaaaactcaagcttagtgtt

SEQ ID NO: 1136819 - DNA, 22 bp, Artificial Sequence
  chemically synthesized
aagcttagtgttctggaaaaca

SEQ ID NO: 1136820 - DNA, 22 bp, Artificial Sequence
  chemically synthesized
acatcatgtaagttgttttcca

SEQ ID NO: 1136821 - DNA, 22 bp, Artificial Sequence
  chemically synthesized
aacatcatgtaagttgttttcc

SEQ ID NO: 1136822 - DNA, 22 bp, Artificial Sequence
  chemically synthesized
agtgttctggaaaacaacttac

SEQ ID NO: 1136823 - DNA, 22 bp, Artificial Sequence
  chemically synthesized
gtgttctggaaaacaacttaca

SEQ ID NO: 1136824 - DNA, 22 bp, Artificial Sequence
  chemically synthesized
tggaaaacaacttacatgatgt

SEQ ID NO: 1136825 - DNA, 22 bp, Artificial Sequence
  chemically synthesized
gaaaacaacttacatgatgtta

SEQ ID NO: 1136826 - DNA, 22 bp, Artificial Sequence
  chemically synthesized
gaaataaataaaaggacttaac

SEQ ID NO: 1136827 - DNA, 22 bp, Artificial Sequence
  chemically synthesized
acatgatgttaagtccttttat

SEQ ID NO: 1136828 - DNA, 22 bp, Artificial Sequence
  chemically synthesized
catgatgttaagtccttttatt

SEQ ID NO: 1136829 - DNA, 22 bp, Artificial Sequence
  chemically synthesized
tgggctagaaataaataaaagg

SEQ ID NO: 1136830 - DNA, 22 bp, Artificial Sequence
  chemically synthesized
ttgtgggctagaaataaataaa

SEQ ID NO: 1136831 - DNA, 22 bp, Artificial Sequence
  chemically synthesized
ctattgtgggctagaaataaat

SEQ ID NO: 1136832 - DNA, 22 bp, Artificial Sequence
  chemically synthesized
agtccttttatttatttctagc

SEQ ID NO: 1136833 - DNA, 22 bp, Artificial Sequence
  chemically synthesized
cacgctcctattgtgggctaga

SEQ ID NO: 1136834 - DNA, 22 bp, Artificial Sequence
  chemically synthesized
ttatttatttctagcccacaat

SEQ ID NO: 1136835 - DNA, 22 bp, Artificial Sequence
  chemically synthesized
tatttatttctagcccacaata

SEQ ID NO: 1136836 - DNA, 22 bp, Artificial Sequence
  chemically synthesized
atttatttctagcccacaatag

SEQ ID NO: 1136837 - DNA, 22 bp, Artificial Sequence
  chemically synthesized
tttatttctagcccacaatagg

SEQ ID NO: 1136838 - DNA, 22 bp, Artificial Sequence
  chemically synthesized
atttctagcccacaataggagc

SEQ ID NO: 1136839 - DNA, 22 bp, Artificial Sequence
  chemically synthesized
aaacagttacacgctcctattg

SEQ ID NO: 1136840 - DNA, 22 bp, Artificial Sequence
  chemically synthesized
tttctagcccacaataggagcg

SEQ ID NO: 1136841 - DNA, 22 bp, Artificial Sequence
  chemically synthesized
caaacagttacacgctcctatt

SEQ ID NO: 1136842 - DNA, 22 bp, Artificial Sequence
  chemically synthesized
tcaaacagttacacgctcctat

SEQ ID NO: 1136843 - DNA, 22 bp, Artificial Sequence
  chemically synthesized
ctagcccacaataggagcgtgt

SEQ ID NO: 1136844 - DNA, 22 bp, Artificial Sequence
  chemically synthesized
tagcccacaataggagcgtgta

SEQ ID NO: 1136845 - DNA, 22 bp, Artificial Sequence
  chemically synthesized
ttttcaaacagttacacgctcc

SEQ ID NO: 1136846 - DNA, 22 bp, Artificial Sequence
  chemically synthesized
attttcaaacagttacacgctc

SEQ ID NO: 1136847 - DNA, 22 bp, Artificial Sequence
  chemically synthesized
gcccacaataggagcgtgtaac

SEQ ID NO: 1136848 - DNA, 22 bp, Artificial Sequence
  chemically synthesized
tattttcaaacagttacacgct

SEQ ID NO: 1136849 - DNA, 22 bp, Artificial Sequence
  chemically synthesized
attttattttcaaacagttaca

SEQ ID NO: 1136850 - DNA, 22 bp, Artificial Sequence
  chemically synthesized
aattttattttcaaacagttac

SEQ ID NO: 1136851 - DNA, 22 bp, Artificial Sequence
  chemically synthesized
taattttattttcaaacagtta

SEQ ID NO: 1136852 - DNA, 22 bp, Artificial Sequence
  chemically synthesized
ttaattttattttcaaacagtt

SEQ ID NO: 1136853 - DNA, 22 bp, Artificial Sequence
  chemically synthesized
cttttaattttattttcaaaca

SEQ ID NO: 1136854 - DNA, 22 bp, Artificial Sequence
  chemically synthesized
tctccttttaattttattttca

SEQ ID NO: 1136855 - DNA, 22 bp, Artificial Sequence
  chemically synthesized
tttgaaaataaaattaaaagga

SEQ ID NO: 1136856 - DNA, 22 bp, Artificial Sequence
  chemically synthesized
gaaaataaaattaaaaggagat

SEQ ID NO: 1136857 - DNA, 22 bp, Artificial Sequence
  chemically synthesized
aaaataaaattaaaaggagata

SEQ ID NO: 1136858 - DNA, 22 bp, Artificial Sequence
  chemically synthesized
aaaggagatagtgggccgggcg

SEQ ID NO: 1136859 - DNA, 22 bp, Artificial Sequence
  chemically synthesized
cagacataagtcaccgcgcccg

SEQ ID NO: 1136860 - DNA, 22 bp, Artificial Sequence
  chemically synthesized
agattacagacataagtcaccg

SEQ ID NO: 1136861 - DNA, 22 bp, Artificial Sequence
  chemically synthesized
ccaaagtgctgagattacagac

SEQ ID NO: 1136862 - DNA, 22 bp, Artificial Sequence
  chemically synthesized
ggcctcccaaagtgctgagatt

SEQ ID NO: 1136863 - DNA, 22 bp, Artificial Sequence
  chemically synthesized
cggcctcccaaagtgctgagat

SEQ ID NO: 1136864 - DNA, 22 bp, Artificial Sequence
  chemically synthesized
atgtctgtaatctcagcacttt

SEQ ID NO: 1136865 - DNA, 22 bp, Artificial Sequence
  chemically synthesized
tgtctgtaatctcagcactttg

SEQ ID NO: 1136866 - DNA, 22 bp, Artificial Sequence
  chemically synthesized
ccacttcggcctcccaaagtgc

SEQ ID NO: 1136867 - DNA, 22 bp, Artificial Sequence
  chemically synthesized
taatctcagcactttgggaggc

SEQ ID NO: 1136868 - DNA, 22 bp, Artificial Sequence
  chemically synthesized
tgatcctcccacttcggcctcc

SEQ ID NO: 1136869 - DNA, 22 bp, Artificial Sequence
  chemically synthesized
gtgatcctcccacttcggcctc

SEQ ID NO: 1136870 - DNA, 22 bp, Artificial Sequence
  chemically synthesized
agcactttgggaggccgaagtg

SEQ ID NO: 1136871 - DNA, 22 bp, Artificial Sequence
  chemically synthesized
accttgtgatcctcccacttcg

SEQ ID NO: 1136872 - DNA, 22 bp, Artificial Sequence
  chemically synthesized
ctgaccttgtgatcctcccact

SEQ ID NO: 1136873 - DNA, 22 bp, Artificial Sequence
  chemically synthesized
tgggaggccgaagtgggaggat

SEQ ID NO: 1136874 - DNA, 22 bp, Artificial Sequence
  chemically synthesized
gggaggccgaagtgggaggatc

SEQ ID NO: 1136875 - DNA, 22 bp, Artificial Sequence
  chemically synthesized
ggaggccgaagtgggaggatca

SEQ ID NO: 1136876 - DNA, 22 bp, Artificial Sequence
  chemically synthesized
gatctcctgaccttgtgatcct

SEQ ID NO: 1136877 - DNA, 22 bp, Artificial Sequence
  chemically synthesized
gccagggtggtctcgatctcct

SEQ ID NO: 1136878 - DNA, 22 bp, Artificial Sequence
  chemically synthesized
accatgttggccagggtggtct

SEQ ID NO: 1136879 - DNA, 22 bp, Artificial Sequence
  chemically synthesized
caccatgttggccagggtggtc

SEQ ID NO: 1136880 - DNA, 22 bp, Artificial Sequence
  chemically synthesized
gtagagatggggtttcaccatg

SEQ ID NO: 1136881 - DNA, 22 bp, Artificial Sequence
  chemically synthesized
agtagagatggggtttcaccat

SEQ ID NO: 1136882 - DNA, 22 bp, Artificial Sequence
  chemically synthesized
tagtagagatggggtttcacca

SEQ ID NO: 1136883 - DNA, 22 bp, Artificial Sequence
  chemically synthesized
gccaacatggtgaaaccccatc

SEQ ID NO: 1136884 - DNA, 22 bp, Artificial Sequence
  chemically synthesized
taattttagtagagatggggtt

SEQ ID NO: 1136885 - DNA, 22 bp, Artificial Sequence
  chemically synthesized
gtaattttagtagagatggggt

SEQ ID NO: 1136886 - DNA, 22 bp, Artificial Sequence
  chemically synthesized
tgtaattttagtagagatgggg

SEQ ID NO: 1136887 - DNA, 22 bp, Artificial Sequence
  chemically synthesized
ttgtaattttagtagagatggg

SEQ ID NO: 1136888 - DNA, 22 bp, Artificial Sequence
  chemically synthesized
tttgtaattttagtagagatgg

SEQ ID NO: 1136889 - DNA, 22 bp, Artificial Sequence
  chemically synthesized
attttttgtaattttagtagag

SEQ ID NO: 1136890 - DNA, 22 bp, Artificial Sequence
  chemically synthesized
tactaaaattacaaaaaattag

SEQ ID NO: 1136891 - DNA, 22 bp, Artificial Sequence
  chemically synthesized
ccatgacaccccactaattttt

SEQ ID NO: 1136892 - DNA, 22 bp, Artificial Sequence
  chemically synthesized
ctaaaattacaaaaaattagtg

SEQ ID NO: 1136893 - DNA, 22 bp, Artificial Sequence
  chemically synthesized
aaattacaaaaaattagtgggg

SEQ ID NO: 1136894 - DNA, 22 bp, Artificial Sequence
  chemically synthesized
caaaaaattagtggggtgtcat

SEQ ID NO: 1136895 - DNA, 22 bp, Artificial Sequence
  chemically synthesized
caggtgcctaccatgacacccc

SEQ ID NO: 1136896 - DNA, 22 bp, Artificial Sequence
  chemically synthesized
ggactacaggtgcctaccatga

SEQ ID NO: 1136897 - DNA, 22 bp, Artificial Sequence
  chemically synthesized
gtggggtgtcatggtaggcacc

SEQ ID NO: 1136898 - DNA, 22 bp, Artificial Sequence
  chemically synthesized
ccaagtagcagctgggactaca

SEQ ID NO: 1136899 - DNA, 22 bp, Artificial Sequence
  chemically synthesized
agcctcccaagtagcagctggg

SEQ ID NO: 1136900 - DNA, 22 bp, Artificial Sequence
  chemically synthesized
cctcagcctcccaagtagcagc

SEQ ID NO: 1136901 - DNA, 22 bp, Artificial Sequence
  chemically synthesized
ctgcctcagcctcccaagtagc

SEQ ID NO: 1136902 - DNA, 22 bp, Artificial Sequence
  chemically synthesized
tagtcccagctgctacttggga

SEQ ID NO: 1136903 - DNA, 22 bp, Artificial Sequence
  chemically synthesized
tcctgcctcagcctcccaagta

SEQ ID NO: 1136904 - DNA, 22 bp, Artificial Sequence
  chemically synthesized
acaccgttctcctgcctcagcc

SEQ ID NO: 1136905 - DNA, 22 bp, Artificial Sequence
  chemically synthesized
ctacttgggaggctgaggcagg

SEQ ID NO: 1136906 - DNA, 22 bp, Artificial Sequence
  chemically synthesized
cttgggaggctgaggcaggaga

SEQ ID NO: 1136907 - DNA, 22 bp, Artificial Sequence
  chemically synthesized
ggttcacaccgttctcctgcct

SEQ ID NO: 1136908 - DNA, 22 bp, Artificial Sequence
  chemically synthesized
gggaggctgaggcaggagaacg

SEQ ID NO: 1136909 - DNA, 22 bp, Artificial Sequence
  chemically synthesized
ctgggttcacaccgttctcctg

SEQ ID NO: 1136910 - DNA, 22 bp, Artificial Sequence
  chemically synthesized
ggaggctgaggcaggagaacgg

SEQ ID NO: 1136911 - DNA, 22 bp, Artificial Sequence
  chemically synthesized
cctcctgggttcacaccgttct

SEQ ID NO: 1136912 - DNA, 22 bp, Artificial Sequence
  chemically synthesized
tgcctcctgggttcacaccgtt

SEQ ID NO: 1136913 - DNA, 22 bp, Artificial Sequence
  chemically synthesized
aggcaggagaacggtgtgaacc

SEQ ID NO: 1136914 - DNA, 22 bp, Artificial Sequence
  chemically synthesized
caagctctgcctcctgggttca

SEQ ID NO: 1136915 - DNA, 22 bp, Artificial Sequence
  chemically synthesized
actgcaagctctgcctcctggg

SEQ ID NO: 1136916 - DNA, 22 bp, Artificial Sequence
  chemically synthesized
agctcactgcaagctctgcctc

SEQ ID NO: 1136917 - DNA, 22 bp, Artificial Sequence
  chemically synthesized
gagtgcagtggcacaatctcag

SEQ ID NO: 1136918 - DNA, 22 bp, Artificial Sequence
  chemically synthesized
gcagtgagctgagattgtgcca

SEQ ID NO: 1136919 - DNA, 22 bp, Artificial Sequence
  chemically synthesized
cagtgagctgagattgtgccac

SEQ ID NO: 1136920 - DNA, 22 bp, Artificial Sequence
  chemically synthesized
tgtcacccaggctggagtgcag

SEQ ID NO: 1136921 - DNA, 22 bp, Artificial Sequence
  chemically synthesized
agattgtgccactgcactccag

SEQ ID NO: 1136922 - DNA, 22 bp, Artificial Sequence
  chemically synthesized
actgtgtcacccaggctggagt

SEQ ID NO: 1136923 - DNA, 22 bp, Artificial Sequence
  chemically synthesized
tgccactgcactccagcctggg

SEQ ID NO: 1136924 - DNA, 22 bp, Artificial Sequence
  chemically synthesized
cactccagcctgggtgacacag

SEQ ID NO: 1136925 - DNA, 22 bp, Artificial Sequence
  chemically synthesized
agatggagtctcactgtgtcac

SEQ ID NO: 1136926 - DNA, 22 bp, Artificial Sequence
  chemically synthesized
gagatggagtctcactgtgtca

SEQ ID NO: 1136927 - DNA, 22 bp, Artificial Sequence
  chemically synthesized
tgagatggagtctcactgtgtc

SEQ ID NO: 1136928 - DNA, 22 bp, Artificial Sequence
  chemically synthesized
ttgagatggagtctcactgtgt

SEQ ID NO: 1136929 - DNA, 22 bp, Artificial Sequence
  chemically synthesized
cagcctgggtgacacagtgaga

SEQ ID NO: 1136930 - DNA, 22 bp, Artificial Sequence
  chemically synthesized
tttgagatggagtctcactgtg

SEQ ID NO: 1136931 - DNA, 22 bp, Artificial Sequence
  chemically synthesized
ttttgagatggagtctcactgt

SEQ ID NO: 1136932 - DNA, 22 bp, Artificial Sequence
  chemically synthesized
tttttgagatggagtctcactg

SEQ ID NO: 1136933 - DNA, 22 bp, Artificial Sequence
  chemically synthesized
ttttttgagatggagtctcact

SEQ ID NO: 1136934 - DNA, 22 bp, Artificial Sequence
  chemically synthesized
tttttttgagatggagtctcac

SEQ ID NO: 1136935 - DNA, 22 bp, Artificial Sequence
  chemically synthesized
ttttttttgagatggagtctca

SEQ ID NO: 1136936 - DNA, 22 bp, Artificial Sequence
  chemically synthesized
tttttttttgagatggagtctc

SEQ ID NO: 1136937 - DNA, 22 bp, Artificial Sequence
  chemically synthesized
ggtgacacagtgagactccatc

SEQ ID NO: 1136938 - DNA, 22 bp, Artificial Sequence
  chemically synthesized
ttttttttttgagatggagtct

SEQ ID NO: 1136939 - DNA, 22 bp, Artificial Sequence
  chemically synthesized
tttttttttttgagatggagtc

SEQ ID NO: 1136940 - DNA, 22 bp, Artificial Sequence
  chemically synthesized
ttttttttttttgagatggagt

SEQ ID NO: 1136941 - DNA, 22 bp, Artificial Sequence
  chemically synthesized
tttttttttttttgagatggag

SEQ ID NO: 1136942 - DNA, 22 bp, Artificial Sequence
  chemically synthesized
ttttttttttttttgagatgga

SEQ ID NO: 1136943 - DNA, 22 bp, Artificial Sequence
  chemically synthesized
tttttttttttttttgagatgg

SEQ ID NO: 1136944 - DNA, 22 bp, Artificial Sequence
  chemically synthesized
ttttttttttttttttgagatg

SEQ ID NO: 1136945 - DNA, 22 bp, Artificial Sequence
  chemically synthesized
tttttttttttttttttgagat

SEQ ID NO: 1136946 - DNA, 22 bp, Artificial Sequence
  chemically synthesized
ttttttttttttttttttgaga

SEQ ID NO: 1136947 - DNA, 22 bp, Artificial Sequence
  chemically synthesized
tttttttttttttttttttgag

SEQ ID NO: 1136948 - DNA, 22 bp, Artificial Sequence
  chemically synthesized
ttttttttttttttttttttga

SEQ ID NO: 1136949 - DNA, 22 bp, Artificial Sequence
  chemically synthesized
cttttttttttttttttttttt

SEQ ID NO: 1136950 - DNA, 22 bp, Artificial Sequence
  chemically synthesized
tctgcttttttttttttttttt

SEQ ID NO: 1136951 - DNA, 22 bp, Artificial Sequence
  chemically synthesized
catctcaaaaaaaaaaaaaaaa

SEQ ID NO: 1136952 - DNA, 22 bp, Artificial Sequence
  chemically synthesized
tatctgcttttttttttttttt

SEQ ID NO: 1136953 - DNA, 22 bp, Artificial Sequence
  chemically synthesized
tctatctgcttttttttttttt

SEQ ID NO: 1136954 - DNA, 22 bp, Artificial Sequence
  chemically synthesized
aaaaaaaaaaaaaaaaaaaaaa

SEQ ID NO: 1136955 - DNA, 22 bp, Artificial Sequence
  chemically synthesized
tggttctctatctgcttttttt

SEQ ID NO: 1136956 - DNA, 22 bp, Artificial Sequence
  chemically synthesized
gtggttctctatctgctttttt

SEQ ID NO: 1136957 - DNA, 22 bp, Artificial Sequence
  chemically synthesized
tgtggttctctatctgcttttt

SEQ ID NO: 1136958 - DNA, 22 bp, Artificial Sequence
  chemically synthesized
ttgtggttctctatctgctttt

SEQ ID NO: 1136959 - DNA, 22 bp, Artificial Sequence
  chemically synthesized
tttgtggttctctatctgcttt

SEQ ID NO: 1136960 - DNA, 22 bp, Artificial Sequence
  chemically synthesized
gagggctttttgtggttctcta

SEQ ID NO: 1136961 - DNA, 22 bp, Artificial Sequence
  chemically synthesized
agtgtgtctggagggctttttg

SEQ ID NO: 1136962 - DNA, 22 bp, Artificial Sequence
  chemically synthesized
atatgtaagtcatgtagttcag

SEQ ID NO: 1136963 - DNA, 22 bp, Artificial Sequence
  chemically synthesized
gatatgtaagtcatgtagttca

SEQ ID NO: 1136964 - DNA, 22 bp, Artificial Sequence
  chemically synthesized
cagacacactgaactacatgac

SEQ ID NO: 1136965 - DNA, 22 bp, Artificial Sequence
  chemically synthesized
agtttgatatgtaagtcatgta

SEQ ID NO: 1136966 - DNA, 22 bp, Artificial Sequence
  chemically synthesized
aactacatgacttacatatcaa

SEQ ID NO: 1136967 - DNA, 22 bp, Artificial Sequence
  chemically synthesized
catgacttacatatcaaactca

SEQ ID NO: 1136968 - DNA, 22 bp, Artificial Sequence
  chemically synthesized
aggggaaaaaggttgagtttga

SEQ ID NO: 1136969 - DNA, 22 bp, Artificial Sequence
  chemically synthesized
gaggggaaaaaggttgagtttg

SEQ ID NO: 1136970 - DNA, 22 bp, Artificial Sequence
  chemically synthesized
acatatcaaactcaaccttttt

SEQ ID NO: 1136971 - DNA, 22 bp, Artificial Sequence
  chemically synthesized
catatcaaactcaacctttttc

SEQ ID NO: 1136972 - DNA, 22 bp, Artificial Sequence
  chemically synthesized
aacctttttcccctcaaatgct

SEQ ID NO: 1136973 - DNA, 22 bp, Artificial Sequence
  chemically synthesized
tttcccctcaaatgctttcttg

SEQ ID NO: 1136974 - DNA, 22 bp, Artificial Sequence
  chemically synthesized
ttcccctcaaatgctttcttgt

SEQ ID NO: 1136975 - DNA, 22 bp, Artificial Sequence
  chemically synthesized
tcccctcaaatgctttcttgtc

SEQ ID NO: 1136976 - DNA, 22 bp, Artificial Sequence
  chemically synthesized
cccctcaaatgctttcttgtct

SEQ ID NO: 1136977 - DNA, 22 bp, Artificial Sequence
  chemically synthesized
ccctcaaatgctttcttgtcta

SEQ ID NO: 1136978 - DNA, 22 bp, Artificial Sequence
  chemically synthesized
aaatgctttcttgtctatgcct

SEQ ID NO: 1136979 - DNA, 22 bp, Artificial Sequence
  chemically synthesized
tcttgtctatgcctccatttta

SEQ ID NO: 1136980 - DNA, 22 bp, Artificial Sequence
  chemically synthesized
cttgtctatgcctccattttat

SEQ ID NO: 1136981 - DNA, 22 bp, Artificial Sequence
  chemically synthesized
ttgtctatgcctccattttatc

SEQ ID NO: 1136982 - DNA, 22 bp, Artificial Sequence
  chemically synthesized
gtctatgcctccattttatctt

SEQ ID NO: 1136983 - DNA, 22 bp, Artificial Sequence
  chemically synthesized
tctatgcctccattttatcttc

SEQ ID NO: 1136984 - DNA, 22 bp, Artificial Sequence
  chemically synthesized
atagggatacaatgaagataaa

SEQ ID NO: 1136985 - DNA, 22 bp, Artificial Sequence
  chemically synthesized
tgcctccattttatcttcattg

SEQ ID NO: 1136986 - DNA, 22 bp, Artificial Sequence
  chemically synthesized
ctcatagggatacaatgaagat

SEQ ID NO: 1136987 - DNA, 22 bp, Artificial Sequence
  chemically synthesized
gctcatagggatacaatgaaga

SEQ ID NO: 1136988 - DNA, 22 bp, Artificial Sequence
  chemically synthesized
acttgctcatagggatacaatg

SEQ ID NO: 1136989 - DNA, 22 bp, Artificial Sequence
  chemically synthesized
cattttatcttcattgtatccc

SEQ ID NO: 1136990 - DNA, 22 bp, Artificial Sequence
  chemically synthesized
cacttgctcatagggatacaat

SEQ ID NO: 1136991 - DNA, 22 bp, Artificial Sequence
  chemically synthesized
ttcacttgctcatagggataca

SEQ ID NO: 1136992 - DNA, 22 bp, Artificial Sequence
  chemically synthesized
tatcttcattgtatccctatga

SEQ ID NO: 1136993 - DNA, 22 bp, Artificial Sequence
  chemically synthesized
atcttcattgtatccctatgag

SEQ ID NO: 1136994 - DNA, 22 bp, Artificial Sequence
  chemically synthesized
tcttcattgtatccctatgagc

SEQ ID NO: 1136995 - DNA, 22 bp, Artificial Sequence
  chemically synthesized
cattgtatccctatgagcaagt

SEQ ID NO: 1136996 - DNA, 22 bp, Artificial Sequence
  chemically synthesized
attgtatccctatgagcaagtg

SEQ ID NO: 1136997 - DNA, 22 bp, Artificial Sequence
  chemically synthesized
cagcatgtatctcttcacttgc

SEQ ID NO: 1136998 - DNA, 22 bp, Artificial Sequence
  chemically synthesized
tatccctatgagcaagtgaaga

SEQ ID NO: 1136999 - DNA, 22 bp, Artificial Sequence
  chemically synthesized
tgagcaagtgaagagatacatg

SEQ ID NO: 1137000 - DNA, 22 bp, Artificial Sequence
  chemically synthesized
tgaaataaagtccaacatgcat

SEQ ID NO: 1137001 - DNA, 22 bp, Artificial Sequence
  chemically synthesized
atgaaataaagtccaacatgca

SEQ ID NO: 1137002 - DNA, 22 bp, Artificial Sequence
  chemically synthesized
tatgaaataaagtccaacatgc

SEQ ID NO: 1137003 - DNA, 22 bp, Artificial Sequence
  chemically synthesized
tttatgaaataaagtccaacat

SEQ ID NO: 1137004 - DNA, 22 bp, Artificial Sequence
  chemically synthesized
taatgcatgttggactttattt

SEQ ID NO: 1137005 - DNA, 22 bp, Artificial Sequence
  chemically synthesized
catggttctttatgaaataaag

SEQ ID NO: 1137006 - DNA, 22 bp, Artificial Sequence
  chemically synthesized
gcatggttctttatgaaataaa

SEQ ID NO: 1137007 - DNA, 22 bp, Artificial Sequence
  chemically synthesized
atttgcatggttctttatgaaa

SEQ ID NO: 1137008 - DNA, 22 bp, Artificial Sequence
  chemically synthesized
gatttgcatggttctttatgaa

SEQ ID NO: 1137009 - DNA, 22 bp, Artificial Sequence
  chemically synthesized
tgatttgcatggttctttatga

SEQ ID NO: 1137010 - DNA, 22 bp, Artificial Sequence
  chemically synthesized
gactttatttcataaagaacca

SEQ ID NO: 1137011 - DNA, 22 bp, Artificial Sequence
  chemically synthesized
gttttgatttgcatggttcttt

SEQ ID NO: 1137012 - DNA, 22 bp, Artificial Sequence
  chemically synthesized
tatttcataaagaaccatgcaa

SEQ ID NO: 1137013 - DNA, 22 bp, Artificial Sequence
  chemically synthesized
atttcataaagaaccatgcaaa

SEQ ID NO: 1137014 - DNA, 22 bp, Artificial Sequence
  chemically synthesized
tttcataaagaaccatgcaaat

SEQ ID NO: 1137015 - DNA, 22 bp, Artificial Sequence
  chemically synthesized
cataaagaaccatgcaaatcaa

SEQ ID NO: 1137016 - DNA, 22 bp, Artificial Sequence
  chemically synthesized
ataaagaaccatgcaaatcaaa

SEQ ID NO: 1137017 - DNA, 22 bp, Artificial Sequence
  chemically synthesized
taataaaagaatactggttttg

SEQ ID NO: 1137018 - DNA, 22 bp, Artificial Sequence
  chemically synthesized
tataataaaagaatactggttt

SEQ ID NO: 1137019 - DNA, 22 bp, Artificial Sequence
  chemically synthesized
tataattctataataaaagaat

SEQ ID NO: 1137020 - DNA, 22 bp, Artificial Sequence
  chemically synthesized
gtataattctataataaaagaa

SEQ ID NO: 1137021 - DNA, 22 bp, Artificial Sequence
  chemically synthesized
caacttgtataattctataata

SEQ ID NO: 1137022 - DNA, 22 bp, Artificial Sequence
  chemically synthesized
ccaacttgtataattctataat

SEQ ID NO: 1137023 - DNA, 22 bp, Artificial Sequence
  chemically synthesized
ttttattatagaattatacaag

SEQ ID NO: 1137024 - DNA, 22 bp, Artificial Sequence
  chemically synthesized
ttattatagaattatacaagtt

SEQ ID NO: 1137025 - DNA, 22 bp, Artificial Sequence
  chemically synthesized
tattatagaattatacaagttg

SEQ ID NO: 1137026 - DNA, 22 bp, Artificial Sequence
  chemically synthesized
attatagaattatacaagttgg

SEQ ID NO: 1137027 - DNA, 22 bp, Artificial Sequence
  chemically synthesized
acgtgatgtcttccaacttgta

SEQ ID NO: 1137028 - DNA, 22 bp, Artificial Sequence
  chemically synthesized
ttatagaattatacaagttgga

SEQ ID NO: 1137029 - DNA, 22 bp, Artificial Sequence
  chemically synthesized
tagaattatacaagttggaaga

SEQ ID NO: 1137030 - DNA, 22 bp, Artificial Sequence
  chemically synthesized
ggcaattgacgtgatgtcttcc

SEQ ID NO: 1137031 - DNA, 22 bp, Artificial Sequence
  chemically synthesized
tacaagttggaagacatcacgt

SEQ ID NO: 1137032 - DNA, 22 bp, Artificial Sequence
  chemically synthesized
gaagacatcacgtcaattgcct

SEQ ID NO: 1137033 - DNA, 22 bp, Artificial Sequence
  chemically synthesized
tgagaccaccacctaggcaatt

SEQ ID NO: 1137034 - DNA, 22 bp, Artificial Sequence
  chemically synthesized
gaaattatgagaccaccaccta

SEQ ID NO: 1137035 - DNA, 22 bp, Artificial Sequence
  chemically synthesized
cctagaaattatgagaccacca

SEQ ID NO: 1137036 - DNA, 22 bp, Artificial Sequence
  chemically synthesized
attccctagaaattatgagacc

SEQ ID NO: 1137037 - DNA, 22 bp, Artificial Sequence
  chemically synthesized
aattccctagaaattatgagac

SEQ ID NO: 1137038 - DNA, 22 bp, Artificial Sequence
  chemically synthesized
cctaggtggtggtctcataatt

SEQ ID NO: 1137039 - DNA, 22 bp, Artificial Sequence
  chemically synthesized
taattccctagaaattatgaga

SEQ ID NO: 1137040 - DNA, 22 bp, Artificial Sequence
  chemically synthesized
ttaattccctagaaattatgag

SEQ ID NO: 1137041 - DNA, 22 bp, Artificial Sequence
  chemically synthesized
ggtggtggtctcataatttcta

SEQ ID NO: 1137042 - DNA, 22 bp, Artificial Sequence
  chemically synthesized
tttttaattccctagaaattat

SEQ ID NO: 1137043 - DNA, 22 bp, Artificial Sequence
  chemically synthesized
atttttaattccctagaaatta

SEQ ID NO: 1137044 - DNA, 22 bp, Artificial Sequence
  chemically synthesized
aagccttatttttaattcccta

SEQ ID NO: 1137045 - DNA, 22 bp, Artificial Sequence
  chemically synthesized
gaagccttatttttaattccct

SEQ ID NO: 1137046 - DNA, 22 bp, Artificial Sequence
  chemically synthesized
ataatttctagggaattaaaaa

SEQ ID NO: 1137047 - DNA, 22 bp, Artificial Sequence
  chemically synthesized
ctagggaattaaaaataaggct

SEQ ID NO: 1137048 - DNA, 22 bp, Artificial Sequence
  chemically synthesized
tagggaattaaaaataaggctt

SEQ ID NO: 1137049 - DNA, 22 bp, Artificial Sequence
  chemically synthesized
gggaattaaaaataaggcttca

SEQ ID NO: 1137050 - DNA, 22 bp, Artificial Sequence
  chemically synthesized
gtagaaaagcatttgaagcctt

SEQ ID NO: 1137051 - DNA, 22 bp, Artificial Sequence
  chemically synthesized
caattggtagaaaagcatttga

SEQ ID NO: 1137052 - DNA, 22 bp, Artificial Sequence
  chemically synthesized
aaaataaggcttcaaatgcttt

SEQ ID NO: 1137053 - DNA, 22 bp, Artificial Sequence
  chemically synthesized
ttccaattggtagaaaagcatt

SEQ ID NO: 1137054 - DNA, 22 bp, Artificial Sequence
  chemically synthesized
attattccaattggtagaaaag

SEQ ID NO: 1137055 - DNA, 22 bp, Artificial Sequence
  chemically synthesized
gattattccaattggtagaaaa

SEQ ID NO: 1137056 - DNA, 22 bp, Artificial Sequence
  chemically synthesized
atttgattattccaattggtag

SEQ ID NO: 1137057 - DNA, 22 bp, Artificial Sequence
  chemically synthesized
caaatgcttttctaccaattgg

SEQ ID NO: 1137058 - DNA, 22 bp, Artificial Sequence
  chemically synthesized
aaatgcttttctaccaattgga

SEQ ID NO: 1137059 - DNA, 22 bp, Artificial Sequence
  chemically synthesized
ctgatttgattattccaattgg

SEQ ID NO: 1137060 - DNA, 22 bp, Artificial Sequence
  chemically synthesized
ttctaccaattggaataatcaa

SEQ ID NO: 1137061 - DNA, 22 bp, Artificial Sequence
  chemically synthesized
tctaccaattggaataatcaaa

SEQ ID NO: 1137062 - DNA, 22 bp, Artificial Sequence
  chemically synthesized
ctaccaattggaataatcaaat

SEQ ID NO: 1137063 - DNA, 22 bp, Artificial Sequence
  chemically synthesized
taccaattggaataatcaaatc

SEQ ID NO: 1137064 - DNA, 22 bp, Artificial Sequence
  chemically synthesized
ccaattggaataatcaaatcag

SEQ ID NO: 1137065 - DNA, 22 bp, Artificial Sequence
  chemically synthesized
gaataatcaaatcagtaatatt

SEQ ID NO: 1137066 - DNA, 22 bp, Artificial Sequence
  chemically synthesized
tacatgtcatcgaaatattact

SEQ ID NO: 1137067 - DNA, 22 bp, Artificial Sequence
  chemically synthesized
gtacatgtcatcgaaatattac

SEQ ID NO: 1137068 - DNA, 22 bp, Artificial Sequence
  chemically synthesized
atgaagtttgtacatgtcatcg

SEQ ID NO: 1137069 - DNA, 22 bp, Artificial Sequence
  chemically synthesized
gatgaagtttgtacatgtcatc

SEQ ID NO: 1137070 - DNA, 22 bp, Artificial Sequence
  chemically synthesized
tgatgaagtttgtacatgtcat

SEQ ID NO: 1137071 - DNA, 22 bp, Artificial Sequence
  chemically synthesized
ttgatgaagtttgtacatgtca

SEQ ID NO: 1137072 - DNA, 22 bp, Artificial Sequence
  chemically synthesized
tttgatgaagtttgtacatgtc

SEQ ID NO: 1137073 - DNA, 22 bp, Artificial Sequence
  chemically synthesized
ctttttgatgaagtttgtacat

SEQ ID NO: 1137074 - DNA, 22 bp, Artificial Sequence
  chemically synthesized
cgatgacatgtacaaacttcat

SEQ ID NO: 1137075 - DNA, 22 bp, Artificial Sequence
  chemically synthesized
gatgacatgtacaaacttcatc

SEQ ID NO: 1137076 - DNA, 22 bp, Artificial Sequence
  chemically synthesized
gaatgggactactttttgatga

SEQ ID NO: 1137077 - DNA, 22 bp, Artificial Sequence
  chemically synthesized
ggaatgggactactttttgatg

SEQ ID NO: 1137078 - DNA, 22 bp, Artificial Sequence
  chemically synthesized
ccttggaatgggactacttttt

SEQ ID NO: 1137079 - DNA, 22 bp, Artificial Sequence
  chemically synthesized
attcccttggaatgggactact

SEQ ID NO: 1137080 - DNA, 22 bp, Artificial Sequence
  chemically synthesized
catcaaaaagtagtcccattcc

SEQ ID NO: 1137081 - DNA, 22 bp, Artificial Sequence
  chemically synthesized
atcaaaaagtagtcccattcca

SEQ ID NO: 1137082 - DNA, 22 bp, Artificial Sequence
  chemically synthesized
tataaatatgctcattcccttg

SEQ ID NO: 1137083 - DNA, 22 bp, Artificial Sequence
  chemically synthesized
ggaatacactatataaatatgc

SEQ ID NO: 1137084 - DNA, 22 bp, Artificial Sequence
  chemically synthesized
caagggaatgagcatatttata

SEQ ID NO: 1137085 - DNA, 22 bp, Artificial Sequence
  chemically synthesized
gggaatacactatataaatatg

SEQ ID NO: 1137086 - DNA, 22 bp, Artificial Sequence
  chemically synthesized
ttgggaatacactatataaata

SEQ ID NO: 1137087 - DNA, 22 bp, Artificial Sequence
  chemically synthesized
cttgggaatacactatataaat

SEQ ID NO: 1137088 - DNA, 22 bp, Artificial Sequence
  chemically synthesized
atatagtgtattcccaagaagc

SEQ ID NO: 1137089 - DNA, 22 bp, Artificial Sequence
  chemically synthesized
tatagtgtattcccaagaagct

SEQ ID NO: 1137090 - DNA, 22 bp, Artificial Sequence
  chemically synthesized
aaatgtgaaaagggagagcttc

SEQ ID NO: 1137091 - DNA, 22 bp, Artificial Sequence
  chemically synthesized
cctgaaatgtgaaaagggagag

SEQ ID NO: 1137092 - DNA, 22 bp, Artificial Sequence
  chemically synthesized
ccaagaagctctcccttttcac

SEQ ID NO: 1137093 - DNA, 22 bp, Artificial Sequence
  chemically synthesized
cacaatgctccctgaaatgtga

SEQ ID NO: 1137094 - DNA, 22 bp, Artificial Sequence
  chemically synthesized
ccacaatgctccctgaaatgtg

SEQ ID NO: 1137095 - DNA, 22 bp, Artificial Sequence
  chemically synthesized
tccacaatgctccctgaaatgt

SEQ ID NO: 1137096 - DNA, 22 bp, Artificial Sequence
  chemically synthesized
tcccttttcacatttcagggag

SEQ ID NO: 1137097 - DNA, 22 bp, Artificial Sequence
  chemically synthesized
gttttccacaatgctccctgaa

SEQ ID NO: 1137098 - DNA, 22 bp, Artificial Sequence
  chemically synthesized
ccttttcacatttcagggagca

SEQ ID NO: 1137099 - DNA, 22 bp, Artificial Sequence
  chemically synthesized
tggttttccacaatgctccctg

SEQ ID NO: 1137100 - DNA, 22 bp, Artificial Sequence
  chemically synthesized
ttcacatttcagggagcattgt

SEQ ID NO: 1137101 - DNA, 22 bp, Artificial Sequence
  chemically synthesized
tcacatttcagggagcattgtg

SEQ ID NO: 1137102 - DNA, 22 bp, Artificial Sequence
  chemically synthesized
cacatttcagggagcattgtgg

SEQ ID NO: 1137103 - DNA, 22 bp, Artificial Sequence
  chemically synthesized
acatttcagggagcattgtgga

SEQ ID NO: 1137104 - DNA, 22 bp, Artificial Sequence
  chemically synthesized
cagggagcattgtggaaaacca

SEQ ID NO: 1137105 - DNA, 22 bp, Artificial Sequence
  chemically synthesized
agggagcattgtggaaaaccag

SEQ ID NO: 1137106 - DNA, 22 bp, Artificial Sequence
  chemically synthesized
tggaaaaccagaatgttgggat

SEQ ID NO: 1137107 - DNA, 22 bp, Artificial Sequence
  chemically synthesized
aagaaaatagacagtgatatgt

SEQ ID NO: 1137108 - DNA, 22 bp, Artificial Sequence
  chemically synthesized
aaagaaaatagacagtgatatg

SEQ ID NO: 1137109 - DNA, 22 bp, Artificial Sequence
  chemically synthesized
ggattcacacacatatcactgt

SEQ ID NO: 1137110 - DNA, 22 bp, Artificial Sequence
  chemically synthesized
acacacatatcactgtctattt

SEQ ID NO: 1137111 - DNA, 22 bp, Artificial Sequence
  chemically synthesized
aaataaatgtttaaagaaaata

SEQ ID NO: 1137112 - DNA, 22 bp, Artificial Sequence
  chemically synthesized
agcctaaaataaatgtttaaag

SEQ ID NO: 1137113 - DNA, 22 bp, Artificial Sequence
  chemically synthesized
ctgagcctaaaataaatgttta

SEQ ID NO: 1137114 - DNA, 22 bp, Artificial Sequence
  chemically synthesized
tctattttctttaaacatttat

SEQ ID NO: 1137115 - DNA, 22 bp, Artificial Sequence
  chemically synthesized
ttttctttaaacatttatttta

SEQ ID NO: 1137116 - DNA, 22 bp, Artificial Sequence
  chemically synthesized
tctttaaacatttattttaggc

SEQ ID NO: 1137117 - DNA, 22 bp, Artificial Sequence
  chemically synthesized
ctttaaacatttattttaggct

SEQ ID NO: 1137118 - DNA, 22 bp, Artificial Sequence
  chemically synthesized
tttaaacatttattttaggctc

SEQ ID NO: 1137119 - DNA, 22 bp, Artificial Sequence
  chemically synthesized
atatgtactcctgagcctaaaa

SEQ ID NO: 1137120 - DNA, 22 bp, Artificial Sequence
  chemically synthesized
catatgtactcctgagcctaaa

SEQ ID NO: 1137121 - DNA, 22 bp, Artificial Sequence
  chemically synthesized
taaacatttattttaggctcag

SEQ ID NO: 1137122 - DNA, 22 bp, Artificial Sequence
  chemically synthesized
aaacatttattttaggctcagg

SEQ ID NO: 1137123 - DNA, 22 bp, Artificial Sequence
  chemically synthesized
aacatttattttaggctcagga

SEQ ID NO: 1137124 - DNA, 22 bp, Artificial Sequence
  chemically synthesized
attttaggctcaggagtacata

SEQ ID NO: 1137125 - DNA, 22 bp, Artificial Sequence
  chemically synthesized
ttttaggctcaggagtacatat

SEQ ID NO: 1137126 - DNA, 22 bp, Artificial Sequence
  chemically synthesized
tgtaacaaaccttcatatgtac

SEQ ID NO: 1137127 - DNA, 22 bp, Artificial Sequence
  chemically synthesized
taggctcaggagtacatatgaa

SEQ ID NO: 1137128 - DNA, 22 bp, Artificial Sequence
  chemically synthesized
aggctcaggagtacatatgaag

SEQ ID NO: 1137129 - DNA, 22 bp, Artificial Sequence
  chemically synthesized
ggctcaggagtacatatgaagg

SEQ ID NO: 1137130 - DNA, 22 bp, Artificial Sequence
  chemically synthesized
cctatgtaacaaaccttcatat

SEQ ID NO: 1137131 - DNA, 22 bp, Artificial Sequence
  chemically synthesized
acctatgtaacaaaccttcata

SEQ ID NO: 1137132 - DNA, 22 bp, Artificial Sequence
  chemically synthesized
aggagtacatatgaaggtttgt

SEQ ID NO: 1137133 - DNA, 22 bp, Artificial Sequence
  chemically synthesized
tgacacacatttacctatgtaa

SEQ ID NO: 1137134 - DNA, 22 bp, Artificial Sequence
  chemically synthesized
gttacataggtaaatgtgtgtc

SEQ ID NO: 1137135 - DNA, 22 bp, Artificial Sequence
  chemically synthesized
ttacataggtaaatgtgtgtca

SEQ ID NO: 1137136 - DNA, 22 bp, Artificial Sequence
  chemically synthesized
cataggtaaatgtgtgtcacag

SEQ ID NO: 1137137 - DNA, 22 bp, Artificial Sequence
  chemically synthesized
gtaagcaaacccctgtgacaca

SEQ ID NO: 1137138 - DNA, 22 bp, Artificial Sequence
  chemically synthesized
ggtgatgaaataattggtaagc

SEQ ID NO: 1137139 - DNA, 22 bp, Artificial Sequence
  chemically synthesized
atacctgggtgatgaaataatt

SEQ ID NO: 1137140 - DNA, 22 bp, Artificial Sequence
  chemically synthesized
aatacctgggtgatgaaataat

SEQ ID NO: 1137141 - DNA, 22 bp, Artificial Sequence
  chemically synthesized
gcttaccaattatttcatcacc

SEQ ID NO: 1137142 - DNA, 22 bp, Artificial Sequence
  chemically synthesized
cttaccaattatttcatcaccc

SEQ ID NO: 1137143 - DNA, 22 bp, Artificial Sequence
  chemically synthesized
ggcttaatacctgggtgatgaa

SEQ ID NO: 1137144 - DNA, 22 bp, Artificial Sequence
  chemically synthesized
accaattatttcatcacccagg

SEQ ID NO: 1137145 - DNA, 22 bp, Artificial Sequence
  chemically synthesized
ccaattatttcatcacccaggt

SEQ ID NO: 1137146 - DNA, 22 bp, Artificial Sequence
  chemically synthesized
gatactgggcttaatacctggg

SEQ ID NO: 1137147 - DNA, 22 bp, Artificial Sequence
  chemically synthesized
ttggatactgggcttaatacct

SEQ ID NO: 1137148 - DNA, 22 bp, Artificial Sequence
  chemically synthesized
tttcatcacccaggtattaagc

SEQ ID NO: 1137149 - DNA, 22 bp, Artificial Sequence
  chemically synthesized
catcacccaggtattaagccca

SEQ ID NO: 1137150 - DNA, 22 bp, Artificial Sequence
  chemically synthesized
atcacccaggtattaagcccag

SEQ ID NO: 1137151 - DNA, 22 bp, Artificial Sequence
  chemically synthesized
agcccagtatccaatagtctta

SEQ ID NO: 1137152 - DNA, 22 bp, Artificial Sequence
  chemically synthesized
atttactgctcatctacttcct

SEQ ID NO: 1137153 - DNA, 22 bp, Artificial Sequence
  chemically synthesized
tttactgctcatctacttcctc

SEQ ID NO: 1137154 - DNA, 22 bp, Artificial Sequence
  chemically synthesized
aggtgggagggtgggaggaagt

SEQ ID NO: 1137155 - DNA, 22 bp, Artificial Sequence
  chemically synthesized
actgctcatctacttcctccca

SEQ ID NO: 1137156 - DNA, 22 bp, Artificial Sequence
  chemically synthesized
gaggtgggagggtgggaggaag

SEQ ID NO: 1137157 - DNA, 22 bp, Artificial Sequence
  chemically synthesized
ctgctcatctacttcctcccac

SEQ ID NO: 1137158 - DNA, 22 bp, Artificial Sequence
  chemically synthesized
cttgaggtgggagggtgggagg

SEQ ID NO: 1137159 - DNA, 22 bp, Artificial Sequence
  chemically synthesized
ctcatctacttcctcccaccct

SEQ ID NO: 1137160 - DNA, 22 bp, Artificial Sequence
  chemically synthesized
atctacttcctcccaccctccc

SEQ ID NO: 1137161 - DNA, 22 bp, Artificial Sequence
  chemically synthesized
ggatctacttgaggtgggaggg

SEQ ID NO: 1137162 - DNA, 22 bp, Artificial Sequence
  chemically synthesized
cttcctcccaccctcccacctc

SEQ ID NO: 1137163 - DNA, 22 bp, Artificial Sequence
  chemically synthesized
cctcccaccctcccacctcaag

SEQ ID NO: 1137164 - DNA, 22 bp, Artificial Sequence
  chemically synthesized
ctcccaccctcccacctcaagt

SEQ ID NO: 1137165 - DNA, 22 bp, Artificial Sequence
  chemically synthesized
ccaccctcccacctcaagtaga

SEQ ID NO: 1137166 - DNA, 22 bp, Artificial Sequence
  chemically synthesized
ccacctcaagtagatcccagtg

SEQ ID NO: 1137167 - DNA, 22 bp, Artificial Sequence
  chemically synthesized
aagtagatcccagtgtatgttg

SEQ ID NO: 1137168 - DNA, 22 bp, Artificial Sequence
  chemically synthesized
cagaccatagaggggatcaaca

SEQ ID NO: 1137169 - DNA, 22 bp, Artificial Sequence
  chemically synthesized
atacaatctgcagaccatagag

SEQ ID NO: 1137170 - DNA, 22 bp, Artificial Sequence
  chemically synthesized
gatacaatctgcagaccataga

SEQ ID NO: 1137171 - DNA, 22 bp, Artificial Sequence
  chemically synthesized
tgatacaatctgcagaccatag

SEQ ID NO: 1137172 - DNA, 22 bp, Artificial Sequence
  chemically synthesized
atcccctctatggtctgcagat

SEQ ID NO: 1137173 - DNA, 22 bp, Artificial Sequence
  chemically synthesized
agcctttgatacaatctgcaga

SEQ ID NO: 1137174 - DNA, 22 bp, Artificial Sequence
  chemically synthesized
ctaagcctttgatacaatctgc

SEQ ID NO: 1137175 - DNA, 22 bp, Artificial Sequence
  chemically synthesized
actaagcctttgatacaatctg

SEQ ID NO: 1137176 - DNA, 22 bp, Artificial Sequence
  chemically synthesized
tactaagcctttgatacaatct

SEQ ID NO: 1137177 - DNA, 22 bp, Artificial Sequence
  chemically synthesized
tatggtctgcagattgtatcaa

SEQ ID NO: 1137178 - DNA, 22 bp, Artificial Sequence
  chemically synthesized
tggtctgcagattgtatcaaag

SEQ ID NO: 1137179 - DNA, 22 bp, Artificial Sequence
  chemically synthesized
catctttactaagcctttgata

SEQ ID NO: 1137180 - DNA, 22 bp, Artificial Sequence
  chemically synthesized
cagattgtatcaaaggcttagt

SEQ ID NO: 1137181 - DNA, 22 bp, Artificial Sequence
  chemically synthesized
aaaatctacatctttactaagc

SEQ ID NO: 1137182 - DNA, 22 bp, Artificial Sequence
  chemically synthesized
tatcaaaggcttagtaaagatg

SEQ ID NO: 1137183 - DNA, 22 bp, Artificial Sequence
  chemically synthesized
tgataaggacctaaaaatctac

SEQ ID NO: 1137184 - DNA, 22 bp, Artificial Sequence
  chemically synthesized
agtaaagatgtagatttttagg

SEQ ID NO: 1137185 - DNA, 22 bp, Artificial Sequence
  chemically synthesized
gtaaagatgtagatttttaggt

SEQ ID NO: 1137186 - DNA, 22 bp, Artificial Sequence
  chemically synthesized
atccataagctgtgataaggac

SEQ ID NO: 1137187 - DNA, 22 bp, Artificial Sequence
  chemically synthesized
ttaggtccttatcacagcttat

SEQ ID NO: 1137188 - DNA, 22 bp, Artificial Sequence
  chemically synthesized
taggtccttatcacagcttatg

SEQ ID NO: 1137189 - DNA, 22 bp, Artificial Sequence
  chemically synthesized
aggtccttatcacagcttatgg

SEQ ID NO: 1137190 - DNA, 22 bp, Artificial Sequence
  chemically synthesized
agaaaatctcatccataagctg

SEQ ID NO: 1137191 - DNA, 22 bp, Artificial Sequence
  chemically synthesized
ggtccttatcacagcttatgga

SEQ ID NO: 1137192 - DNA, 22 bp, Artificial Sequence
  chemically synthesized
ctcagaaaatctcatccataag

SEQ ID NO: 1137193 - DNA, 22 bp, Artificial Sequence
  chemically synthesized
gctcagaaaatctcatccataa

SEQ ID NO: 1137194 - DNA, 22 bp, Artificial Sequence
  chemically synthesized
tgctcagaaaatctcatccata

SEQ ID NO: 1137195 - DNA, 22 bp, Artificial Sequence
  chemically synthesized
atcacagcttatggatgagatt

SEQ ID NO: 1137196 - DNA, 22 bp, Artificial Sequence
  chemically synthesized
tcacagcttatggatgagattt

SEQ ID NO: 1137197 - DNA, 22 bp, Artificial Sequence
  chemically synthesized
aacattttgctcagaaaatctc

SEQ ID NO: 1137198 - DNA, 22 bp, Artificial Sequence
  chemically synthesized
ctaaacattttgctcagaaaat

SEQ ID NO: 1137199 - DNA, 22 bp, Artificial Sequence
  chemically synthesized
atggatgagattttctgagcaa

SEQ ID NO: 1137200 - DNA, 22 bp, Artificial Sequence
  chemically synthesized
tggatgagattttctgagcaaa

SEQ ID NO: 1137201 - DNA, 22 bp, Artificial Sequence
  chemically synthesized
aaatgcatattcctaaacattt

SEQ ID NO: 1137202 - DNA, 22 bp, Artificial Sequence
  chemically synthesized
tctgagcaaaatgtttaggaat

SEQ ID NO: 1137203 - DNA, 22 bp, Artificial Sequence
  chemically synthesized
attaaaatgcatattcctaaac

SEQ ID NO: 1137204 - DNA, 22 bp, Artificial Sequence
  chemically synthesized
ctgagcaaaatgtttaggaata

SEQ ID NO: 1137205 - DNA, 22 bp, Artificial Sequence
  chemically synthesized
tgagcaaaatgtttaggaatat

SEQ ID NO: 1137206 - DNA, 22 bp, Artificial Sequence
  chemically synthesized
agcaaaatgtttaggaatatgc

SEQ ID NO: 1137207 - DNA, 22 bp, Artificial Sequence
  chemically synthesized
aggagctaattaaaatgcatat

SEQ ID NO: 1137208 - DNA, 22 bp, Artificial Sequence
  chemically synthesized
aggaatatgcattttaattagc

SEQ ID NO: 1137209 - DNA, 22 bp, Artificial Sequence
  chemically synthesized
ggaatatgcattttaattagct

SEQ ID NO: 1137210 - DNA, 22 bp, Artificial Sequence
  chemically synthesized
catagtagccacctgaggagct

SEQ ID NO: 1137211 - DNA, 22 bp, Artificial Sequence
  chemically synthesized
agtctgcatagtagccacctga

SEQ ID NO: 1137212 - DNA, 22 bp, Artificial Sequence
  chemically synthesized
taattagctcctcaggtggcta

SEQ ID NO: 1137213 - DNA, 22 bp, Artificial Sequence
  chemically synthesized
gagtctgcatagtagccacctg

SEQ ID NO: 1137214 - DNA, 22 bp, Artificial Sequence
  chemically synthesized
aattagctcctcaggtggctac

SEQ ID NO: 1137215 - DNA, 22 bp, Artificial Sequence
  chemically synthesized
attagctcctcaggtggctact

SEQ ID NO: 1137216 - DNA, 22 bp, Artificial Sequence
  chemically synthesized
gctcctcaggtggctactatgc

SEQ ID NO: 1137217 - DNA, 22 bp, Artificial Sequence
  chemically synthesized
aaacttgagtctgcatagtagc

SEQ ID NO: 1137218 - DNA, 22 bp, Artificial Sequence
  chemically synthesized
tcaaacttgagtctgcatagta

SEQ ID NO: 1137219 - DNA, 22 bp, Artificial Sequence
  chemically synthesized
ctcaggtggctactatgcagac

SEQ ID NO: 1137220 - DNA, 22 bp, Artificial Sequence
  chemically synthesized
aggtggctactatgcagactca

SEQ ID NO: 1137221 - DNA, 22 bp, Artificial Sequence
  chemically synthesized
catggagtggttctcaaacttg

SEQ ID NO: 1137222 - DNA, 22 bp, Artificial Sequence
  chemically synthesized
ctatgcagactcaagtttgaga

SEQ ID NO: 1137223 - DNA, 22 bp, Artificial Sequence
  chemically synthesized
tgcagactcaagtttgagaacc

SEQ ID NO: 1137224 - DNA, 22 bp, Artificial Sequence
  chemically synthesized
cattgcatggagtggttctcaa

SEQ ID NO: 1137225 - DNA, 22 bp, Artificial Sequence
  chemically synthesized
gcattgcatggagtggttctca

SEQ ID NO: 1137226 - DNA, 22 bp, Artificial Sequence
  chemically synthesized
atttgcattgcatggagtggtt

SEQ ID NO: 1137227 - DNA, 22 bp, Artificial Sequence
  chemically synthesized
aagtttgagaaccactccatgc

SEQ ID NO: 1137228 - DNA, 22 bp, Artificial Sequence
  chemically synthesized
gttcatttgcattgcatggagt

SEQ ID NO: 1137229 - DNA, 22 bp, Artificial Sequence
  chemically synthesized
tagttcatttgcattgcatgga

SEQ ID NO: 1137230 - DNA, 22 bp, Artificial Sequence
  chemically synthesized
ctagttcatttgcattgcatgg

SEQ ID NO: 1137231 - DNA, 22 bp, Artificial Sequence
  chemically synthesized
gagaaccactccatgcaatgca

SEQ ID NO: 1137232 - DNA, 22 bp, Artificial Sequence
  chemically synthesized
agaaccactccatgcaatgcaa

SEQ ID NO: 1137233 - DNA, 22 bp, Artificial Sequence
  chemically synthesized
taggtcatcttctagttcattt

SEQ ID NO: 1137234 - DNA, 22 bp, Artificial Sequence
  chemically synthesized
catgcaatgcaaatgaactaga

SEQ ID NO: 1137235 - DNA, 22 bp, Artificial Sequence
  chemically synthesized
actgtaggtcatcttctagttc

SEQ ID NO: 1137236 - DNA, 22 bp, Artificial Sequence
  chemically synthesized
taacagttaactgtaggtcatc

SEQ ID NO: 1137237 - DNA, 22 bp, Artificial Sequence
  chemically synthesized
gggagctgtaacagttaactgt

SEQ ID NO: 1137238 - DNA, 22 bp, Artificial Sequence
  chemically synthesized
gaagatgacctacagttaactg

SEQ ID NO: 1137239 - DNA, 22 bp, Artificial Sequence
  chemically synthesized
agggagctgtaacagttaactg

SEQ ID NO: 1137240 - DNA, 22 bp, Artificial Sequence
  chemically synthesized
cagttaactgttacagctccct

SEQ ID NO: 1137241 - DNA, 22 bp, Artificial Sequence
  chemically synthesized
agggacatgtttagggagctgt

SEQ ID NO: 1137242 - DNA, 22 bp, Artificial Sequence
  chemically synthesized
aagggacatgtttagggagctg

SEQ ID NO: 1137243 - DNA, 22 bp, Artificial Sequence
  chemically synthesized
taagggacatgtttagggagct

SEQ ID NO: 1137244 - DNA, 22 bp, Artificial Sequence
  chemically synthesized
ttaagggacatgtttagggagc

SEQ ID NO: 1137245 - DNA, 22 bp, Artificial Sequence
  chemically synthesized
actgttacagctccctaaacat

SEQ ID NO: 1137246 - DNA, 22 bp, Artificial Sequence
  chemically synthesized
ttacagctccctaaacatgtcc

SEQ ID NO: 1137247 - DNA, 22 bp, Artificial Sequence
  chemically synthesized
cagctccctaaacatgtccctt

SEQ ID NO: 1137248 - DNA, 22 bp, Artificial Sequence
  chemically synthesized
acgtgcatcccttttaagggac

SEQ ID NO: 1137249 - DNA, 22 bp, Artificial Sequence
  chemically synthesized
gacgtgcatcccttttaaggga

SEQ ID NO: 1137250 - DNA, 22 bp, Artificial Sequence
  chemically synthesized
tgacgtgcatcccttttaaggg

SEQ ID NO: 1137251 - DNA, 22 bp, Artificial Sequence
  chemically synthesized
cctaaacatgtcccttaaaagg

SEQ ID NO: 1137252 - DNA, 22 bp, Artificial Sequence
  chemically synthesized
ttttgacgtgcatcccttttaa

SEQ ID NO: 1137253 - DNA, 22 bp, Artificial Sequence
  chemically synthesized
aacatgtcccttaaaagggatg

SEQ ID NO: 1137254 - DNA, 22 bp, Artificial Sequence
  chemically synthesized
ataaagaaagttattttgacgt

SEQ ID NO: 1137255 - DNA, 22 bp, Artificial Sequence
  chemically synthesized
aaaagggatgcacgtcaaaata

SEQ ID NO: 1137256 - DNA, 22 bp, Artificial Sequence
  chemically synthesized
gataaagaaagttattttgacg

SEQ ID NO: 1137257 - DNA, 22 bp, Artificial Sequence
  chemically synthesized
aaagggatgcacgtcaaaataa

SEQ ID NO: 1137258 - DNA, 22 bp, Artificial Sequence
  chemically synthesized
tttgataaagaaagttattttg

SEQ ID NO: 1137259 - DNA, 22 bp, Artificial Sequence
  chemically synthesized
ccattatttgataaagaaagtt

SEQ ID NO: 1137260 - DNA, 22 bp, Artificial Sequence
  chemically synthesized
agaaagattgccattatttgat

SEQ ID NO: 1137261 - DNA, 22 bp, Artificial Sequence
  chemically synthesized
tctttatcaaataatggcaatc

SEQ ID NO: 1137262 - DNA, 22 bp, Artificial Sequence
  chemically synthesized
ctttatcaaataatggcaatct

SEQ ID NO: 1137263 - DNA, 22 bp, Artificial Sequence
  chemically synthesized
ccgtgttaagaaagattgccat

SEQ ID NO: 1137264 - DNA, 22 bp, Artificial Sequence
  chemically synthesized
tttatcaaataatggcaatctt

SEQ ID NO: 1137265 - DNA, 22 bp, Artificial Sequence
  chemically synthesized
tatcaaataatggcaatctttc

SEQ ID NO: 1137266 - DNA, 22 bp, Artificial Sequence
  chemically synthesized
atcaaataatggcaatctttct

SEQ ID NO: 1137267 - DNA, 22 bp, Artificial Sequence
  chemically synthesized
tcaaataatggcaatctttctt

SEQ ID NO: 1137268 - DNA, 22 bp, Artificial Sequence
  chemically synthesized
ccataaaatggtcagttgccgt

SEQ ID NO: 1137269 - DNA, 22 bp, Artificial Sequence
  chemically synthesized
ctgccataaaatggtcagttgc

SEQ ID NO: 1137270 - DNA, 22 bp, Artificial Sequence
  chemically synthesized
tcttaacacggcaactgaccat

SEQ ID NO: 1137271 - DNA, 22 bp, Artificial Sequence
  chemically synthesized
cttaacacggcaactgaccatt

SEQ ID NO: 1137272 - DNA, 22 bp, Artificial Sequence
  chemically synthesized
ttgctgccataaaatggtcagt

SEQ ID NO: 1137273 - DNA, 22 bp, Artificial Sequence
  chemically synthesized
ttaacacggcaactgaccattt

SEQ ID NO: 1137274 - DNA, 22 bp, Artificial Sequence
  chemically synthesized
aacacggcaactgaccatttta

SEQ ID NO: 1137275 - DNA, 22 bp, Artificial Sequence
  chemically synthesized
acacggcaactgaccattttat

SEQ ID NO: 1137276 - DNA, 22 bp, Artificial Sequence
  chemically synthesized
cacagattattgctgccataaa

SEQ ID NO: 1137277 - DNA, 22 bp, Artificial Sequence
  chemically synthesized
ccacagattattgctgccataa

SEQ ID NO: 1137278 - DNA, 22 bp, Artificial Sequence
  chemically synthesized
cttccacagattattgctgcca

SEQ ID NO: 1137279 - DNA, 22 bp, Artificial Sequence
  chemically synthesized
accattttatggcagcaataat

SEQ ID NO: 1137280 - DNA, 22 bp, Artificial Sequence
  chemically synthesized
tatggcagcaataatctgtgga

SEQ ID NO: 1137281 - DNA, 22 bp, Artificial Sequence
  chemically synthesized
atggcagcaataatctgtggaa

SEQ ID NO: 1137282 - DNA, 22 bp, Artificial Sequence
  chemically synthesized
tggcagcaataatctgtggaag

SEQ ID NO: 1137283 - DNA, 22 bp, Artificial Sequence
  chemically synthesized
ccatatgtacccattgcttcca

SEQ ID NO: 1137284 - DNA, 22 bp, Artificial Sequence
  chemically synthesized
agagtattcccatatgtaccca

SEQ ID NO: 1137285 - DNA, 22 bp, Artificial Sequence
  chemically synthesized
tggaagcaatgggtacatatgg

SEQ ID NO: 1137286 - DNA, 22 bp, Artificial Sequence
  chemically synthesized
acccaacactgagagtattccc

SEQ ID NO: 1137287 - DNA, 22 bp, Artificial Sequence
  chemically synthesized
aacccaacactgagagtattcc

SEQ ID NO: 1137288 - DNA, 22 bp, Artificial Sequence
  chemically synthesized
taacccaacactgagagtattc

SEQ ID NO: 1137289 - DNA, 22 bp, Artificial Sequence
  chemically synthesized
ttaacccaacactgagagtatt

SEQ ID NO: 1137290 - DNA, 22 bp, Artificial Sequence
  chemically synthesized
tttaacccaacactgagagtat

SEQ ID NO: 1137291 - DNA, 22 bp, Artificial Sequence
  chemically synthesized
atactttttaacccaacactga

SEQ ID NO: 1137292 - DNA, 22 bp, Artificial Sequence
  chemically synthesized
gatactttttaacccaacactg

SEQ ID NO: 1137293 - DNA, 22 bp, Artificial Sequence
  chemically synthesized
gtcaatttgatactttttaacc

SEQ ID NO: 1137294 - DNA, 22 bp, Artificial Sequence
  chemically synthesized
tcagtgttgggttaaaaagtat

SEQ ID NO: 1137295 - DNA, 22 bp, Artificial Sequence
  chemically synthesized
agtgttgggttaaaaagtatca

SEQ ID NO: 1137296 - DNA, 22 bp, Artificial Sequence
  chemically synthesized
ggttaaaaagtatcaaattgac

SEQ ID NO: 1137297 - DNA, 22 bp, Artificial Sequence
  chemically synthesized
aaaagtatcaaattgactaatg

SEQ ID NO: 1137298 - DNA, 22 bp, Artificial Sequence
  chemically synthesized
tgtaataaatacatgagacatt

SEQ ID NO: 1137299 - DNA, 22 bp, Artificial Sequence
  chemically synthesized
atgtaataaatacatgagacat

SEQ ID NO: 1137300 - DNA, 22 bp, Artificial Sequence
  chemically synthesized
gtatttatgtaataaatacatg

SEQ ID NO: 1137301 - DNA, 22 bp, Artificial Sequence
  chemically synthesized
actaatgtctcatgtatttatt

SEQ ID NO: 1137302 - DNA, 22 bp, Artificial Sequence
  chemically synthesized
atgtctcatgtatttattacat

SEQ ID NO: 1137303 - DNA, 22 bp, Artificial Sequence
  chemically synthesized
caatacattggtatttatgtaa

SEQ ID NO: 1137304 - DNA, 22 bp, Artificial Sequence
  chemically synthesized
gcaatacattggtatttatgta

SEQ ID NO: 1137305 - DNA, 22 bp, Artificial Sequence
  chemically synthesized
tgcaatacattggtatttatgt

SEQ ID NO: 1137306 - DNA, 22 bp, Artificial Sequence
  chemically synthesized
atgtatttattacataaatacc

SEQ ID NO: 1137307 - DNA, 22 bp, Artificial Sequence
  chemically synthesized
tttgcaatacattggtatttat

SEQ ID NO: 1137308 - DNA, 22 bp, Artificial Sequence
  chemically synthesized
ctttgcaatacattggtattta

SEQ ID NO: 1137309 - DNA, 22 bp, Artificial Sequence
  chemically synthesized
attacataaataccaatgtatt

SEQ ID NO: 1137310 - DNA, 22 bp, Artificial Sequence
  chemically synthesized
ttacataaataccaatgtattg

SEQ ID NO: 1137311 - DNA, 22 bp, Artificial Sequence
  chemically synthesized
cataaataccaatgtattgcaa

SEQ ID NO: 1137312 - DNA, 22 bp, Artificial Sequence
  chemically synthesized
cccatggcttctttgcaataca

SEQ ID NO: 1137313 - DNA, 22 bp, Artificial Sequence
  chemically synthesized
tgtgatctgcccatggcttctt

SEQ ID NO: 1137314 - DNA, 22 bp, Artificial Sequence
  chemically synthesized
atgtgatctgcccatggcttct

SEQ ID NO: 1137315 - DNA, 22 bp, Artificial Sequence
  chemically synthesized
tatgtgatctgcccatggcttc

SEQ ID NO: 1137316 - DNA, 22 bp, Artificial Sequence
  chemically synthesized
ttttatgtgatctgcccatggc

SEQ ID NO: 1137317 - DNA, 22 bp, Artificial Sequence
  chemically synthesized
ctgttttatgtgatctgcccat

SEQ ID NO: 1137318 - DNA, 22 bp, Artificial Sequence
  chemically synthesized
caaagaagccatgggcagatca

SEQ ID NO: 1137319 - DNA, 22 bp, Artificial Sequence
  chemically synthesized
ctcctgttttatgtgatctgcc

SEQ ID NO: 1137320 - DNA, 22 bp, Artificial Sequence
  chemically synthesized
tgattcctcctgttttatgtga

SEQ ID NO: 1137321 - DNA, 22 bp, Artificial Sequence
  chemically synthesized
tattatgattcctcctgtttta

SEQ ID NO: 1137322 - DNA, 22 bp, Artificial Sequence
  chemically synthesized
gtactatattatgattcctcct

SEQ ID NO: 1137323 - DNA, 22 bp, Artificial Sequence
  chemically synthesized
agtactatattatgattcctcc

SEQ ID NO: 1137324 - DNA, 22 bp, Artificial Sequence
  chemically synthesized
tagtactatattatgattcctc

SEQ ID NO: 1137325 - DNA, 22 bp, Artificial Sequence
  chemically synthesized
atagtagttttagtactatatt

SEQ ID NO: 1137326 - DNA, 22 bp, Artificial Sequence
  chemically synthesized
acctaatagtagttttagtact

SEQ ID NO: 1137327 - DNA, 22 bp, Artificial Sequence
  chemically synthesized
attgacctaatagtagttttag

SEQ ID NO: 1137328 - DNA, 22 bp, Artificial Sequence
  chemically synthesized
gcaattaattgacctaatagta

SEQ ID NO: 1137329 - DNA, 22 bp, Artificial Sequence
  chemically synthesized
agcaattaattgacctaatagt

SEQ ID NO: 1137330 - DNA, 22 bp, Artificial Sequence
  chemically synthesized
tagcaattaattgacctaatag

SEQ ID NO: 1137331 - DNA, 22 bp, Artificial Sequence
  chemically synthesized
aaactactattaggtcaattaa

SEQ ID NO: 1137332 - DNA, 22 bp, Artificial Sequence
  chemically synthesized
aacatactttagcaattaattg

SEQ ID NO: 1137333 - DNA, 22 bp, Artificial Sequence
  chemically synthesized
ctattaggtcaattaattgcta

SEQ ID NO: 1137334 - DNA, 22 bp, Artificial Sequence
  chemically synthesized
cattaaacatactttagcaatt

SEQ ID NO: 1137335 - DNA, 22 bp, Artificial Sequence
  chemically synthesized
ttaggtcaattaattgctaaag

SEQ ID NO: 1137336 - DNA, 22 bp, Artificial Sequence
  chemically synthesized
ccattaaacatactttagcaat

SEQ ID NO: 1137337 - DNA, 22 bp, Artificial Sequence
  chemically synthesized
tccattaaacatactttagcaa

SEQ ID NO: 1137338 - DNA, 22 bp, Artificial Sequence
  chemically synthesized
ggtcaattaattgctaaagtat

SEQ ID NO: 1137339 - DNA, 22 bp, Artificial Sequence
  chemically synthesized
ttttccattaaacatactttag

SEQ ID NO: 1137340 - DNA, 22 bp, Artificial Sequence
  chemically synthesized
gttttccattaaacatacttta

SEQ ID NO: 1137341 - DNA, 22 bp, Artificial Sequence
  chemically synthesized
catttgttttccattaaacata

SEQ ID NO: 1137342 - DNA, 22 bp, Artificial Sequence
  chemically synthesized
attgctaaagtatgtttaatgg

SEQ ID NO: 1137343 - DNA, 22 bp, Artificial Sequence
  chemically synthesized
ctaaagtatgtttaatggaaaa

SEQ ID NO: 1137344 - DNA, 22 bp, Artificial Sequence
  chemically synthesized
aagtatgtttaatggaaaacaa

SEQ ID NO: 1137345 - DNA, 22 bp, Artificial Sequence
  chemically synthesized
cataataaaaactccatttgtt

SEQ ID NO: 1137346 - DNA, 22 bp, Artificial Sequence
  chemically synthesized
aatggaaaacaaatggagtttt

SEQ ID NO: 1137347 - DNA, 22 bp, Artificial Sequence
  chemically synthesized
atggaaaacaaatggagttttt

SEQ ID NO: 1137348 - DNA, 22 bp, Artificial Sequence
  chemically synthesized
ccacacaatcattacataataa

SEQ ID NO: 1137349 - DNA, 22 bp, Artificial Sequence
  chemically synthesized
cccacacaatcattacataata

SEQ ID NO: 1137350 - DNA, 22 bp, Artificial Sequence
  chemically synthesized
taataatttcccacacaatcat

SEQ ID NO: 1137351 - DNA, 22 bp, Artificial Sequence
  chemically synthesized
ttattatgtaatgattgtgtgg

SEQ ID NO: 1137352 - DNA, 22 bp, Artificial Sequence
  chemically synthesized
tattatgtaatgattgtgtggg

SEQ ID NO: 1137353 - DNA, 22 bp, Artificial Sequence
  chemically synthesized
attatgtaatgattgtgtggga

SEQ ID NO: 1137354 - DNA, 22 bp, Artificial Sequence
  chemically synthesized
ttatgtaatgattgtgtgggaa

SEQ ID NO: 1137355 - DNA, 22 bp, Artificial Sequence
  chemically synthesized
tgtaatgattgtgtgggaaatt

SEQ ID NO: 1137356 - DNA, 22 bp, Artificial Sequence
  chemically synthesized
tgtgggaaattattacaattta

SEQ ID NO: 1137357 - DNA, 22 bp, Artificial Sequence
  chemically synthesized
aagaaatatgaatataaattgt

SEQ ID NO: 1137358 - DNA, 22 bp, Artificial Sequence
  chemically synthesized
gaagaaatatgaatataaattg

SEQ ID NO: 1137359 - DNA, 22 bp, Artificial Sequence
  chemically synthesized
taatttgaagaaatatgaatat

SEQ ID NO: 1137360 - DNA, 22 bp, Artificial Sequence
  chemically synthesized
ttacaatttatattcatatttc

SEQ ID NO: 1137361 - DNA, 22 bp, Artificial Sequence
  chemically synthesized
caatttatattcatatttcttc

SEQ ID NO: 1137362 - DNA, 22 bp, Artificial Sequence
  chemically synthesized
aaaaattataatttgaagaaat

SEQ ID NO: 1137363 - DNA, 22 bp, Artificial Sequence
  chemically synthesized
atattcatatttcttcaaatta

SEQ ID NO: 1137364 - DNA, 22 bp, Artificial Sequence
  chemically synthesized
tattcatatttcttcaaattat

SEQ ID NO: 1137365 - DNA, 22 bp, Artificial Sequence
  chemically synthesized
cgttaaaaaattataatttgaa

SEQ ID NO: 1137366 - DNA, 22 bp, Artificial Sequence
  chemically synthesized
acgttaaaaaattataatttga

SEQ ID NO: 1137367 - DNA, 22 bp, Artificial Sequence
  chemically synthesized
tacgttaaaaaattataatttg

SEQ ID NO: 1137368 - DNA, 22 bp, Artificial Sequence
  chemically synthesized
atatttcttcaaattataattt

SEQ ID NO: 1137369 - DNA, 22 bp, Artificial Sequence
  chemically synthesized
cttcaaattataattttttaac

SEQ ID NO: 1137370 - DNA, 22 bp, Artificial Sequence
  chemically synthesized
atccaattttacgttaaaaaat

SEQ ID NO: 1137371 - DNA, 22 bp, Artificial Sequence
  chemically synthesized
ttcaaattataattttttaacg

SEQ ID NO: 1137372 - DNA, 22 bp, Artificial Sequence
  chemically synthesized
aatccaattttacgttaaaaaa

SEQ ID NO: 1137373 - DNA, 22 bp, Artificial Sequence
  chemically synthesized
taatccaattttacgttaaaaa

SEQ ID NO: 1137374 - DNA, 22 bp, Artificial Sequence
  chemically synthesized
caaattataattttttaacgta

SEQ ID NO: 1137375 - DNA, 22 bp, Artificial Sequence
  chemically synthesized
ttaatccaattttacgttaaaa

SEQ ID NO: 1137376 - DNA, 22 bp, Artificial Sequence
  chemically synthesized
aaattataattttttaacgtaa

SEQ ID NO: 1137377 - DNA, 22 bp, Artificial Sequence
  chemically synthesized
cttttaatccaattttacgtta

SEQ ID NO: 1137378 - DNA, 22 bp, Artificial Sequence
  chemically synthesized
taattttttaacgtaaaattgg

SEQ ID NO: 1137379 - DNA, 22 bp, Artificial Sequence
  chemically synthesized
aatgttacttttaatccaattt

SEQ ID NO: 1137380 - DNA, 22 bp, Artificial Sequence
  chemically synthesized
tttaacgtaaaattggattaaa

SEQ ID NO: 1137381 - DNA, 22 bp, Artificial Sequence
  chemically synthesized
ttaacgtaaaattggattaaaa

SEQ ID NO: 1137382 - DNA, 22 bp, Artificial Sequence
  chemically synthesized
taacgtaaaattggattaaaag

SEQ ID NO: 1137383 - DNA, 22 bp, Artificial Sequence
  chemically synthesized
aacgtaaaattggattaaaagt

SEQ ID NO: 1137384 - DNA, 22 bp, Artificial Sequence
  chemically synthesized
acgtaaaattggattaaaagta

SEQ ID NO: 1137385 - DNA, 22 bp, Artificial Sequence
  chemically synthesized
aatcacagttcaatgttacttt

SEQ ID NO: 1137386 - DNA, 22 bp, Artificial Sequence
  chemically synthesized
caatcacagttcaatgttactt

SEQ ID NO: 1137387 - DNA, 22 bp, Artificial Sequence
  chemically synthesized
tcaatcacagttcaatgttact

SEQ ID NO: 1137388 - DNA, 22 bp, Artificial Sequence
  chemically synthesized
gattaaaagtaacattgaactg

SEQ ID NO: 1137389 - DNA, 22 bp, Artificial Sequence
  chemically synthesized
tatgattttcaatcacagttca

SEQ ID NO: 1137390 - DNA, 22 bp, Artificial Sequence
  chemically synthesized
aaagtaacattgaactgtgatt

SEQ ID NO: 1137391 - DNA, 22 bp, Artificial Sequence
  chemically synthesized
aactgtgattgaaaatcatata

SEQ ID NO: 1137392 - DNA, 22 bp, Artificial Sequence
  chemically synthesized
tgattgaaaatcatataggctg

SEQ ID NO: 1137393 - DNA, 22 bp, Artificial Sequence
  chemically synthesized
agacagcgtaataaaccagcct

SEQ ID NO: 1137394 - DNA, 22 bp, Artificial Sequence
  chemically synthesized
aagacagcgtaataaaccagcc

SEQ ID NO: 1137395 - DNA, 22 bp, Artificial Sequence
  chemically synthesized
aaaatcatataggctggtttat

SEQ ID NO: 1137396 - DNA, 22 bp, Artificial Sequence
  chemically synthesized
caggaatacaatttaagacagc

SEQ ID NO: 1137397 - DNA, 22 bp, Artificial Sequence
  chemically synthesized
gtttattacgctgtcttaaatt

SEQ ID NO: 1137398 - DNA, 22 bp, Artificial Sequence
  chemically synthesized
cctccaggaatacaatttaaga

SEQ ID NO: 1137399 - DNA, 22 bp, Artificial Sequence
  chemically synthesized
attacgctgtcttaaattgtat

SEQ ID NO: 1137400 - DNA, 22 bp, Artificial Sequence
  chemically synthesized
ttacgctgtcttaaattgtatt

SEQ ID NO: 1137401 - DNA, 22 bp, Artificial Sequence
  chemically synthesized
cgctgtcttaaattgtattcct

SEQ ID NO: 1137402 - DNA, 22 bp, Artificial Sequence
  chemically synthesized
tagtattgcctccaggaataca

SEQ ID NO: 1137403 - DNA, 22 bp, Artificial Sequence
  chemically synthesized
gtagtattgcctccaggaatac

SEQ ID NO: 1137404 - DNA, 22 bp, Artificial Sequence
  chemically synthesized
tcttaaattgtattcctggagg

SEQ ID NO: 1137405 - DNA, 22 bp, Artificial Sequence
  chemically synthesized
aaattgtattcctggaggcaat

SEQ ID NO: 1137406 - DNA, 22 bp, Artificial Sequence
  chemically synthesized
aattgtattcctggaggcaata

SEQ ID NO: 1137407 - DNA, 22 bp, Artificial Sequence
  chemically synthesized
tattcctggaggcaatactaca

SEQ ID NO: 1137408 - DNA, 22 bp, Artificial Sequence
  chemically synthesized
gagacatgaagtttgtagtatt

SEQ ID NO: 1137409 - DNA, 22 bp, Artificial Sequence
  chemically synthesized
ggagacatgaagtttgtagtat

SEQ ID NO: 1137410 - DNA, 22 bp, Artificial Sequence
  chemically synthesized
tggagacatgaagtttgtagta

SEQ ID NO: 1137411 - DNA, 22 bp, Artificial Sequence
  chemically synthesized
ttggagacatgaagtttgtagt

SEQ ID NO: 1137412 - DNA, 22 bp, Artificial Sequence
  chemically synthesized
ctggaggcaatactacaaactt

SEQ ID NO: 1137413 - DNA, 22 bp, Artificial Sequence
  chemically synthesized
gaggcaatactacaaacttcat

SEQ ID NO: 1137414 - DNA, 22 bp, Artificial Sequence
  chemically synthesized
ggaaatgccttttggagacatg

SEQ ID NO: 1137415 - DNA, 22 bp, Artificial Sequence
  chemically synthesized
aggaaatgccttttggagacat

SEQ ID NO: 1137416 - DNA, 22 bp, Artificial Sequence
  chemically synthesized
caaacttcatgtctccaaaagg

SEQ ID NO: 1137417 - DNA, 22 bp, Artificial Sequence
  chemically synthesized
catgtctccaaaaggcatttcc

SEQ ID NO: 1137418 - DNA, 22 bp, Artificial Sequence
  chemically synthesized
atgtctccaaaaggcatttcct

SEQ ID NO: 1137419 - DNA, 22 bp, Artificial Sequence
  chemically synthesized
ataagtagcacttaggaaatgc

SEQ ID NO: 1137420 - DNA, 22 bp, Artificial Sequence
  chemically synthesized
caaaaggcatttcctaagtgct

SEQ ID NO: 1137421 - DNA, 22 bp, Artificial Sequence
  chemically synthesized
acatctgataagtagcacttag

SEQ ID NO: 1137422 - DNA, 22 bp, Artificial Sequence
  chemically synthesized
agacctgacatctgataagtag

SEQ ID NO: 1137423 - DNA, 22 bp, Artificial Sequence
  chemically synthesized
gagacctgacatctgataagta

SEQ ID NO: 1137424 - DNA, 22 bp, Artificial Sequence
  chemically synthesized
ttgagacctgacatctgataag

SEQ ID NO: 1137425 - DNA, 22 bp, Artificial Sequence
  chemically synthesized
cctaagtgctacttatcagatg

SEQ ID NO: 1137426 - DNA, 22 bp, Artificial Sequence
  chemically synthesized
cttgagacctgacatctgataa

SEQ ID NO: 1137427 - DNA, 22 bp, Artificial Sequence
  chemically synthesized
ctaagtgctacttatcagatgt

SEQ ID NO: 1137428 - DNA, 22 bp, Artificial Sequence
  chemically synthesized
tcttgagacctgacatctgata

SEQ ID NO: 1137429 - DNA, 22 bp, Artificial Sequence
  chemically synthesized
agtgctacttatcagatgtcag

SEQ ID NO: 1137430 - DNA, 22 bp, Artificial Sequence
  chemically synthesized
ttttcttgagacctgacatctg

SEQ ID NO: 1137431 - DNA, 22 bp, Artificial Sequence
  chemically synthesized
gttttcttgagacctgacatct

SEQ ID NO: 1137432 - DNA, 22 bp, Artificial Sequence
  chemically synthesized
cttatcagatgtcaggtctcaa

SEQ ID NO: 1137433 - DNA, 22 bp, Artificial Sequence
  chemically synthesized
atcagatgtcaggtctcaagaa

SEQ ID NO: 1137434 - DNA, 22 bp, Artificial Sequence
  chemically synthesized
tcagatgtcaggtctcaagaaa

SEQ ID NO: 1137435 - DNA, 22 bp, Artificial Sequence
  chemically synthesized
agacaagtacatggaatttgtt

SEQ ID NO: 1137436 - DNA, 22 bp, Artificial Sequence
  chemically synthesized
tattgagacaagtacatggaat

SEQ ID NO: 1137437 - DNA, 22 bp, Artificial Sequence
  chemically synthesized
aagaaaacaaattccatgtact

SEQ ID NO: 1137438 - DNA, 22 bp, Artificial Sequence
  chemically synthesized
tatattgagacaagtacatgga

SEQ ID NO: 1137439 - DNA, 22 bp, Artificial Sequence
  chemically synthesized
ctctatattgagacaagtacat

SEQ ID NO: 1137440 - DNA, 22 bp, Artificial Sequence
  chemically synthesized
cctctatattgagacaagtaca

SEQ ID NO: 1137441 - DNA, 22 bp, Artificial Sequence
  chemically synthesized
catgtacttgtctcaatataga

SEQ ID NO: 1137442 - DNA, 22 bp, Artificial Sequence
  chemically synthesized
ggcaaatatttcctctatattg

SEQ ID NO: 1137443 - DNA, 22 bp, Artificial Sequence
  chemically synthesized
aggcaaatatttcctctatatt

SEQ ID NO: 1137444 - DNA, 22 bp, Artificial Sequence
  chemically synthesized
taggcaaatatttcctctatat

SEQ ID NO: 1137445 - DNA, 22 bp, Artificial Sequence
  chemically synthesized
gtctcaatatagaggaaatatt

SEQ ID NO: 1137446 - DNA, 22 bp, Artificial Sequence
  chemically synthesized
tctcaatatagaggaaatattt

SEQ ID NO: 1137447 - DNA, 22 bp, Artificial Sequence
  chemically synthesized
aatagattttaggcaaatattt

SEQ ID NO: 1137448 - DNA, 22 bp, Artificial Sequence
  chemically synthesized
aatatagaggaaatatttgcct

SEQ ID NO: 1137449 - DNA, 22 bp, Artificial Sequence
  chemically synthesized
catattcaatagattttaggca

SEQ ID NO: 1137450 - DNA, 22 bp, Artificial Sequence
  chemically synthesized
ccatattcaatagattttaggc

SEQ ID NO: 1137451 - DNA, 22 bp, Artificial Sequence
  chemically synthesized
gcctaaaatctattgaatatgg

SEQ ID NO: 1137452 - DNA, 22 bp, Artificial Sequence
  chemically synthesized
cctaaaatctattgaatatgga

SEQ ID NO: 1137453 - DNA, 22 bp, Artificial Sequence
  chemically synthesized
aaatctattgaatatggaagtg

SEQ ID NO: 1137454 - DNA, 22 bp, Artificial Sequence
  chemically synthesized
aatgcacaggcatacacttcca

SEQ ID NO: 1137455 - DNA, 22 bp, Artificial Sequence
  chemically synthesized
ttgaatatggaagtgtatgcct

SEQ ID NO: 1137456 - DNA, 22 bp, Artificial Sequence
  chemically synthesized
atagctcaatgcacaggcatac

SEQ ID NO: 1137457 - DNA, 22 bp, Artificial Sequence
  chemically synthesized
aatatggaagtgtatgcctgtg

SEQ ID NO: 1137458 - DNA, 22 bp, Artificial Sequence
  chemically synthesized
aaaattcatagctcaatgcaca

SEQ ID NO: 1137459 - DNA, 22 bp, Artificial Sequence
  chemically synthesized
ctcaaaattcatagctcaatgc

SEQ ID NO: 1137460 - DNA, 22 bp, Artificial Sequence
  chemically synthesized
actcaaaattcatagctcaatg

SEQ ID NO: 1137461 - DNA, 22 bp, Artificial Sequence
  chemically synthesized
tactcaaaattcatagctcaat

SEQ ID NO: 1137462 - DNA, 22 bp, Artificial Sequence
  chemically synthesized
tgcattgagctatgaattttga

SEQ ID NO: 1137463 - DNA, 22 bp, Artificial Sequence
  chemically synthesized
taaggaataactttactcaaaa

SEQ ID NO: 1137464 - DNA, 22 bp, Artificial Sequence
  chemically synthesized
agctatgaattttgagtaaagt

SEQ ID NO: 1137465 - DNA, 22 bp, Artificial Sequence
  chemically synthesized
gcattataaggaataactttac

SEQ ID NO: 1137466 - DNA, 22 bp, Artificial Sequence
  chemically synthesized
tgaattttgagtaaagttattc

SEQ ID NO: 1137467 - DNA, 22 bp, Artificial Sequence
  chemically synthesized
tgagtaaagttattccttataa

SEQ ID NO: 1137468 - DNA, 22 bp, Artificial Sequence
  chemically synthesized
gagtaaagttattccttataat

SEQ ID NO: 1137469 - DNA, 22 bp, Artificial Sequence
  chemically synthesized
agtaaagttattccttataatg

SEQ ID NO: 1137470 - DNA, 22 bp, Artificial Sequence
  chemically synthesized
ccacatagcctggcattataag

SEQ ID NO: 1137471 - DNA, 22 bp, Artificial Sequence
  chemically synthesized
tgccacatagcctggcattata

SEQ ID NO: 1137472 - DNA, 22 bp, Artificial Sequence
  chemically synthesized
ttccttataatgccaggctatg

SEQ ID NO: 1137473 - DNA, 22 bp, Artificial Sequence
  chemically synthesized
acatattctgccacatagcctg

SEQ ID NO: 1137474 - DNA, 22 bp, Artificial Sequence
  chemically synthesized
aacatattctgccacatagcct

SEQ ID NO: 1137475 - DNA, 22 bp, Artificial Sequence
  chemically synthesized
cttataatgccaggctatgtgg

SEQ ID NO: 1137476 - DNA, 22 bp, Artificial Sequence
  chemically synthesized
ataatgccaggctatgtggcag

SEQ ID NO: 1137477 - DNA, 22 bp, Artificial Sequence
  chemically synthesized
taatgccaggctatgtggcaga

SEQ ID NO: 1137478 - DNA, 22 bp, Artificial Sequence
  chemically synthesized
tatataatagtatttaacatat

SEQ ID NO: 1137479 - DNA, 22 bp, Artificial Sequence
  chemically synthesized
tgtggcagaatatgttaaatac

SEQ ID NO: 1137480 - DNA, 22 bp, Artificial Sequence
  chemically synthesized
aagatataaacattatatataa

SEQ ID NO: 1137481 - DNA, 22 bp, Artificial Sequence
  chemically synthesized
aatactattatatataatgttt

SEQ ID NO: 1137482 - DNA, 22 bp, Artificial Sequence
  chemically synthesized
ttatatataatgtttatatctt

SEQ ID NO: 1137483 - DNA, 22 bp, Artificial Sequence
  chemically synthesized
tatataatgtttatatcttgaa

SEQ ID NO: 1137484 - DNA, 22 bp, Artificial Sequence
  chemically synthesized
gatggtagaataatgagtagtc

SEQ ID NO: 1137485 - DNA, 22 bp, Artificial Sequence
  chemically synthesized
atatcttgaatgactactcatt

SEQ ID NO: 1137486 - DNA, 22 bp, Artificial Sequence
  chemically synthesized
tatcttgaatgactactcatta

SEQ ID NO: 1137487 - DNA, 22 bp, Artificial Sequence
  chemically synthesized
gaatgactactcattattctac

SEQ ID NO: 1137488 - DNA, 22 bp, Artificial Sequence
  chemically synthesized
tgtagttggatggtagaataat

SEQ ID NO: 1137489 - DNA, 22 bp, Artificial Sequence
  chemically synthesized
aatgactactcattattctacc

SEQ ID NO: 1137490 - DNA, 22 bp, Artificial Sequence
  chemically synthesized
atgtagttggatggtagaataa

SEQ ID NO: 1137491 - DNA, 22 bp, Artificial Sequence
  chemically synthesized
tcttatgtagttggatggtaga

SEQ ID NO: 1137492 - DNA, 22 bp, Artificial Sequence
  chemically synthesized
gtcttatgtagttggatggtag

SEQ ID NO: 1137493 - DNA, 22 bp, Artificial Sequence
  chemically synthesized
tgtcttatgtagttggatggta

SEQ ID NO: 1137494 - DNA, 22 bp, Artificial Sequence
  chemically synthesized
ttgtcttatgtagttggatggt

SEQ ID NO: 1137495 - DNA, 22 bp, Artificial Sequence
  chemically synthesized
ctcattattctaccatccaact

SEQ ID NO: 1137496 - DNA, 22 bp, Artificial Sequence
  chemically synthesized
tttgtcttatgtagttggatgg

SEQ ID NO: 1137497 - DNA, 22 bp, Artificial Sequence
  chemically synthesized
tttttgtcttatgtagttggat

SEQ ID NO: 1137498 - DNA, 22 bp, Artificial Sequence
  chemically synthesized
attattctaccatccaactaca

SEQ ID NO: 1137499 - DNA, 22 bp, Artificial Sequence
  chemically synthesized
ttctaccatccaactacataag

SEQ ID NO: 1137500 - DNA, 22 bp, Artificial Sequence
  chemically synthesized
aacctctttttgtcttatgtag

SEQ ID NO: 1137501 - DNA, 22 bp, Artificial Sequence
  chemically synthesized
taccatccaactacataagaca

SEQ ID NO: 1137502 - DNA, 22 bp, Artificial Sequence
  chemically synthesized
ccatccaactacataagacaaa

SEQ ID NO: 1137503 - DNA, 22 bp, Artificial Sequence
  chemically synthesized
aaagttgaacctctttttgtct

SEQ ID NO: 1137504 - DNA, 22 bp, Artificial Sequence
  chemically synthesized
cataagacaaaaagaggttcaa

SEQ ID NO: 1137505 - DNA, 22 bp, Artificial Sequence
  chemically synthesized
aaatggggtatcgttaaaagtt

SEQ ID NO: 1137506 - DNA, 22 bp, Artificial Sequence
  chemically synthesized
gtcactaaaatggggtatcgtt

SEQ ID NO: 1137507 - DNA, 22 bp, Artificial Sequence
  chemically synthesized
agtcactaaaatggggtatcgt

SEQ ID NO: 1137508 - DNA, 22 bp, Artificial Sequence
  chemically synthesized
aacttttaacgataccccattt

SEQ ID NO: 1137509 - DNA, 22 bp, Artificial Sequence
  chemically synthesized
aagatttagtcactaaaatggg

SEQ ID NO: 1137510 - DNA, 22 bp, Artificial Sequence
  chemically synthesized
aaagatttagtcactaaaatgg

SEQ ID NO: 1137511 - DNA, 22 bp, Artificial Sequence
  chemically synthesized
ttaacgataccccattttagtg

SEQ ID NO: 1137512 - DNA, 22 bp, Artificial Sequence
  chemically synthesized
taaagatttagtcactaaaatg

SEQ ID NO: 1137513 - DNA, 22 bp, Artificial Sequence
  chemically synthesized
taacgataccccattttagtga

SEQ ID NO: 1137514 - DNA, 22 bp, Artificial Sequence
  chemically synthesized
ttaaagatttagtcactaaaat

SEQ ID NO: 1137515 - DNA, 22 bp, Artificial Sequence
  chemically synthesized
aacgataccccattttagtgac

SEQ ID NO: 1137516 - DNA, 22 bp, Artificial Sequence
  chemically synthesized
acgataccccattttagtgact

SEQ ID NO: 1137517 - DNA, 22 bp, Artificial Sequence
  chemically synthesized
taataatttttaaagatttagt

SEQ ID NO: 1137518 - DNA, 22 bp, Artificial Sequence
  chemically synthesized
ttataataatttttaaagattt

SEQ ID NO: 1137519 - DNA, 22 bp, Artificial Sequence
  chemically synthesized
attataataatttttaaagatt

SEQ ID NO: 1137520 - DNA, 22 bp, Artificial Sequence
  chemically synthesized
tattataataatttttaaagat

SEQ ID NO: 1137521 - DNA, 22 bp, Artificial Sequence
  chemically synthesized
tagtgactaaatctttaaaaat

SEQ ID NO: 1137522 - DNA, 22 bp, Artificial Sequence
  chemically synthesized
agtgactaaatctttaaaaatt

SEQ ID NO: 1137523 - DNA, 22 bp, Artificial Sequence
  chemically synthesized
gtgactaaatctttaaaaatta

SEQ ID NO: 1137524 - DNA, 22 bp, Artificial Sequence
  chemically synthesized
aatctttaaaaattattataat

SEQ ID NO: 1137525 - DNA, 22 bp, Artificial Sequence
  chemically synthesized
gggtatgtggttttattataat

SEQ ID NO: 1137526 - DNA, 22 bp, Artificial Sequence
  chemically synthesized
ggggtatgtggttttattataa

SEQ ID NO: 1137527 - DNA, 22 bp, Artificial Sequence
  chemically synthesized
taaaaattattataataaaacc

SEQ ID NO: 1137528 - DNA, 22 bp, Artificial Sequence
  chemically synthesized
aaaaattattataataaaacca

SEQ ID NO: 1137529 - DNA, 22 bp, Artificial Sequence
  chemically synthesized
aaaattattataataaaaccac

SEQ ID NO: 1137530 - DNA, 22 bp, Artificial Sequence
  chemically synthesized
catttggggtatgtggttttat

SEQ ID NO: 1137531 - DNA, 22 bp, Artificial Sequence
  chemically synthesized
agctacatttggggtatgtggt

SEQ ID NO: 1137532 - DNA, 22 bp, Artificial Sequence
  chemically synthesized
ttataataaaaccacatacccc

SEQ ID NO: 1137533 - DNA, 22 bp, Artificial Sequence
  chemically synthesized
taataaaaccacataccccaaa

SEQ ID NO: 1137534 - DNA, 22 bp, Artificial Sequence
  chemically synthesized
tgaaaacatctcagctacattt

SEQ ID NO: 1137535 - DNA, 22 bp, Artificial Sequence
  chemically synthesized
tagattatgaaaacatctcagc

SEQ ID NO: 1137536 - DNA, 22 bp, Artificial Sequence
  chemically synthesized
acacatacgggctgtagattat

SEQ ID NO: 1137537 - DNA, 22 bp, Artificial Sequence
  chemically synthesized
agatgttttcataatctacagc

SEQ ID NO: 1137538 - DNA, 22 bp, Artificial Sequence
  chemically synthesized
tactaacacatacgggctgtag

SEQ ID NO: 1137539 - DNA, 22 bp, Artificial Sequence
  chemically synthesized
gttatactaacacatacgggct

SEQ ID NO: 1137540 - DNA, 22 bp, Artificial Sequence
  chemically synthesized
tcataatctacagcccgtatgt

SEQ ID NO: 1137541 - DNA, 22 bp, Artificial Sequence
  chemically synthesized
agttatactaacacatacgggc

SEQ ID NO: 1137542 - DNA, 22 bp, Artificial Sequence
  chemically synthesized
cataatctacagcccgtatgtg

SEQ ID NO: 1137543 - DNA, 22 bp, Artificial Sequence
  chemically synthesized
ataatctacagcccgtatgtgt

SEQ ID NO: 1137544 - DNA, 22 bp, Artificial Sequence
  chemically synthesized
cagcccgtatgtgttagtataa

SEQ ID NO: 1137545 - DNA, 22 bp, Artificial Sequence
  chemically synthesized
tgaatgtggcttagttatacta

SEQ ID NO: 1137546 - DNA, 22 bp, Artificial Sequence
  chemically synthesized
ataaaattatgaatgtggctta

SEQ ID NO: 1137547 - DNA, 22 bp, Artificial Sequence
  chemically synthesized
cataaaattatgaatgtggctt

SEQ ID NO: 1137548 - DNA, 22 bp, Artificial Sequence
  chemically synthesized
gtataactaagccacattcata

SEQ ID NO: 1137549 - DNA, 22 bp, Artificial Sequence
  chemically synthesized
atttcataaaattatgaatgtg

SEQ ID NO: 1137550 - DNA, 22 bp, Artificial Sequence
  chemically synthesized
ctgatttcataaaattatgaat

SEQ ID NO: 1137551 - DNA, 22 bp, Artificial Sequence
  chemically synthesized
agccacattcataattttatga

SEQ ID NO: 1137552 - DNA, 22 bp, Artificial Sequence
  chemically synthesized
ccatagactgctgatttcataa

SEQ ID NO: 1137553 - DNA, 22 bp, Artificial Sequence
  chemically synthesized
tgccatagactgctgatttcat

SEQ ID NO: 1137554 - DNA, 22 bp, Artificial Sequence
  chemically synthesized
ctgccatagactgctgatttca

SEQ ID NO: 1137555 - DNA, 22 bp, Artificial Sequence
  chemically synthesized
tctgccatagactgctgatttc

SEQ ID NO: 1137556 - DNA, 22 bp, Artificial Sequence
  chemically synthesized
ttctgccatagactgctgattt

SEQ ID NO: 1137557 - DNA, 22 bp, Artificial Sequence
  chemically synthesized
ataattttatgaaatcagcagt

SEQ ID NO: 1137558 - DNA, 22 bp, Artificial Sequence
  chemically synthesized
taccttttctgccatagactgc

SEQ ID NO: 1137559 - DNA, 22 bp, Artificial Sequence
  chemically synthesized
tatgaaatcagcagtctatggc

SEQ ID NO: 1137560 - DNA, 22 bp, Artificial Sequence
  chemically synthesized
atgaaatcagcagtctatggca

SEQ ID NO: 1137561 - DNA, 22 bp, Artificial Sequence
  chemically synthesized
ttgtaccttttctgccatagac

SEQ ID NO: 1137562 - DNA, 22 bp, Artificial Sequence
  chemically synthesized
tgaaatcagcagtctatggcag

SEQ ID NO: 1137563 - DNA, 22 bp, Artificial Sequence
  chemically synthesized
actattgtaccttttctgccat

SEQ ID NO: 1137564 - DNA, 22 bp, Artificial Sequence
  chemically synthesized
tctgactattgtaccttttctg

SEQ ID NO: 1137565 - DNA, 22 bp, Artificial Sequence
  chemically synthesized
attatctgactattgtaccttt

SEQ ID NO: 1137566 - DNA, 22 bp, Artificial Sequence
  chemically synthesized
tggcagaaaaggtacaatagtc

SEQ ID NO: 1137567 - DNA, 22 bp, Artificial Sequence
  chemically synthesized
gtgtagttaattatctgactat

SEQ ID NO: 1137568 - DNA, 22 bp, Artificial Sequence
  chemically synthesized
ttagtgtagttaattatctgac

SEQ ID NO: 1137569 - DNA, 22 bp, Artificial Sequence
  chemically synthesized
attagtgtagttaattatctga

SEQ ID NO: 1137570 - DNA, 22 bp, Artificial Sequence
  chemically synthesized
tattagtgtagttaattatctg

SEQ ID NO: 1137571 - DNA, 22 bp, Artificial Sequence
  chemically synthesized
ttattagtgtagttaattatct

SEQ ID NO: 1137572 - DNA, 22 bp, Artificial Sequence
  chemically synthesized
tttattagtgtagttaattatc

SEQ ID NO: 1137573 - DNA, 22 bp, Artificial Sequence
  chemically synthesized
gaaagttttttattagtgtagt

SEQ ID NO: 1137574 - DNA, 22 bp, Artificial Sequence
  chemically synthesized
ggaaagttttttattagtgtag

SEQ ID NO: 1137575 - DNA, 22 bp, Artificial Sequence
  chemically synthesized
ttggaaagttttttattagtgt

SEQ ID NO: 1137576 - DNA, 22 bp, Artificial Sequence
  chemically synthesized
cttggaaagttttttattagtg

SEQ ID NO: 1137577 - DNA, 22 bp, Artificial Sequence
  chemically synthesized
atttcttggaaagttttttatt

SEQ ID NO: 1137578 - DNA, 22 bp, Artificial Sequence
  chemically synthesized
gatttcttggaaagttttttat

SEQ ID NO: 1137579 - DNA, 22 bp, Artificial Sequence
  chemically synthesized
tgatttcttggaaagtttttta

SEQ ID NO: 1137580 - DNA, 22 bp, Artificial Sequence
  chemically synthesized
ttgatttcttggaaagtttttt

SEQ ID NO: 1137581 - DNA, 22 bp, Artificial Sequence
  chemically synthesized
actacactaataaaaaactttc

SEQ ID NO: 1137582 - DNA, 22 bp, Artificial Sequence
  chemically synthesized
cactaataaaaaactttccaag

SEQ ID NO: 1137583 - DNA, 22 bp, Artificial Sequence
  chemically synthesized
aggtcttttgatttcttggaaa

SEQ ID NO: 1137584 - DNA, 22 bp, Artificial Sequence
  chemically synthesized
ataaaaaactttccaagaaatc

SEQ ID NO: 1137585 - DNA, 22 bp, Artificial Sequence
  chemically synthesized
gggttcaggtcttttgatttct

SEQ ID NO: 1137586 - DNA, 22 bp, Artificial Sequence
  chemically synthesized
tccaagaaatcaaaagacctga

SEQ ID NO: 1137587 - DNA, 22 bp, Artificial Sequence
  chemically synthesized
ccaagaaatcaaaagacctgaa

SEQ ID NO: 1137588 - DNA, 22 bp, Artificial Sequence
  chemically synthesized
caagaaatcaaaagacctgaac

SEQ ID NO: 1137589 - DNA, 22 bp, Artificial Sequence
  chemically synthesized
gtggtaggagaactagggttca

SEQ ID NO: 1137590 - DNA, 22 bp, Artificial Sequence
  chemically synthesized
aagagaagttagtggtaggaga

SEQ ID NO: 1137591 - DNA, 22 bp, Artificial Sequence
  chemically synthesized
caagagaagttagtggtaggag

SEQ ID NO: 1137592 - DNA, 22 bp, Artificial Sequence
  chemically synthesized
tcaagagaagttagtggtagga

SEQ ID NO: 1137593 - DNA, 22 bp, Artificial Sequence
  chemically synthesized
aaccctagttctcctaccacta

SEQ ID NO: 1137594 - DNA, 22 bp, Artificial Sequence
  chemically synthesized
ttcaagagaagttagtggtagg

SEQ ID NO: 1137595 - DNA, 22 bp, Artificial Sequence
  chemically synthesized
gttctcctaccactaacttctc

SEQ ID NO: 1137596 - DNA, 22 bp, Artificial Sequence
  chemically synthesized
tcctaccactaacttctcttga

SEQ ID NO: 1137597 - DNA, 22 bp, Artificial Sequence
  chemically synthesized
ctaccactaacttctcttgaaa

SEQ ID NO: 1137598 - DNA, 22 bp, Artificial Sequence
  chemically synthesized
ccactaacttctcttgaaaaat

SEQ ID NO: 1137599 - DNA, 22 bp, Artificial Sequence
  chemically synthesized
gggaagaaaagtaaatttttca

SEQ ID NO: 1137600 - DNA, 22 bp, Artificial Sequence
  chemically synthesized
agggaagaaaagtaaatttttc

SEQ ID NO: 1137601 - DNA, 22 bp, Artificial Sequence
  chemically synthesized
acttctcttgaaaaatttactt

SEQ ID NO: 1137602 - DNA, 22 bp, Artificial Sequence
  chemically synthesized
ctcttgaaaaatttacttttct

SEQ ID NO: 1137603 - DNA, 22 bp, Artificial Sequence
  chemically synthesized
tcttgaaaaatttacttttctt

SEQ ID NO: 1137604 - DNA, 22 bp, Artificial Sequence
  chemically synthesized
ttgaaaaatttacttttcttcc

SEQ ID NO: 1137605 - DNA, 22 bp, Artificial Sequence
  chemically synthesized
gaaaaatttacttttcttccct

SEQ ID NO: 1137606 - DNA, 22 bp, Artificial Sequence
  chemically synthesized
aaaaatttacttttcttcccta

SEQ ID NO: 1137607 - DNA, 22 bp, Artificial Sequence
  chemically synthesized
agaaaaatgaaacttagggaag

SEQ ID NO: 1137608 - DNA, 22 bp, Artificial Sequence
  chemically synthesized
gagaaaaatgaaacttagggaa

SEQ ID NO: 1137609 - DNA, 22 bp, Artificial Sequence
  chemically synthesized
ttgagaaaaatgaaacttaggg

SEQ ID NO: 1137610 - DNA, 22 bp, Artificial Sequence
  chemically synthesized
acttttcttccctaagtttcat

SEQ ID NO: 1137611 - DNA, 22 bp, Artificial Sequence
  chemically synthesized
ctcttgagaaaaatgaaactta

SEQ ID NO: 1137612 - DNA, 22 bp, Artificial Sequence
  chemically synthesized
cttttcttccctaagtttcatt

SEQ ID NO: 1137613 - DNA, 22 bp, Artificial Sequence
  chemically synthesized
actcttgagaaaaatgaaactt

SEQ ID NO: 1137614 - DNA, 22 bp, Artificial Sequence
  chemically synthesized
tactcttgagaaaaatgaaact

SEQ ID NO: 1137615 - DNA, 22 bp, Artificial Sequence
  chemically synthesized
ttcttccctaagtttcattttt

SEQ ID NO: 1137616 - DNA, 22 bp, Artificial Sequence
  chemically synthesized
tcttccctaagtttcatttttc

SEQ ID NO: 1137617 - DNA, 22 bp, Artificial Sequence
  chemically synthesized
cttccctaagtttcatttttct

SEQ ID NO: 1137618 - DNA, 22 bp, Artificial Sequence
  chemically synthesized
ttccctaagtttcatttttctc

SEQ ID NO: 1137619 - DNA, 22 bp, Artificial Sequence
  chemically synthesized
cgttttactcttgagaaaaatg

SEQ ID NO: 1137620 - DNA, 22 bp, Artificial Sequence
  chemically synthesized
ccctaagtttcatttttctcaa

SEQ ID NO: 1137621 - DNA, 22 bp, Artificial Sequence
  chemically synthesized
cctaagtttcatttttctcaag

SEQ ID NO: 1137622 - DNA, 22 bp, Artificial Sequence
  chemically synthesized
agtttcatttttctcaagagta

SEQ ID NO: 1137623 - DNA, 22 bp, Artificial Sequence
  chemically synthesized
gccaactccgttttactcttga

SEQ ID NO: 1137624 - DNA, 22 bp, Artificial Sequence
  chemically synthesized
catttttctcaagagtaaaacg

SEQ ID NO: 1137625 - DNA, 22 bp, Artificial Sequence
  chemically synthesized
atttttctcaagagtaaaacgg

SEQ ID NO: 1137626 - DNA, 22 bp, Artificial Sequence
  chemically synthesized
ttctcaagagtaaaacggagtt

SEQ ID NO: 1137627 - DNA, 22 bp, Artificial Sequence
  chemically synthesized
tctcaagagtaaaacggagttg

SEQ ID NO: 1137628 - DNA, 22 bp, Artificial Sequence
  chemically synthesized
ctcaagagtaaaacggagttgg

SEQ ID NO: 1137629 - DNA, 22 bp, Artificial Sequence
  chemically synthesized
tcaagagtaaaacggagttggc

SEQ ID NO: 1137630 - DNA, 22 bp, Artificial Sequence
  chemically synthesized
aagagtaaaacggagttggcta

SEQ ID NO: 1137631 - DNA, 22 bp, Artificial Sequence
  chemically synthesized
gaaccacgaggaacattagcca

SEQ ID NO: 1137632 - DNA, 22 bp, Artificial Sequence
  chemically synthesized
ctagaaccacgaggaacattag

SEQ ID NO: 1137633 - DNA, 22 bp, Artificial Sequence
  chemically synthesized
gctaatgttcctcgtggttcta

SEQ ID NO: 1137634 - DNA, 22 bp, Artificial Sequence
  chemically synthesized
atgttcctcgtggttctagcaa

SEQ ID NO: 1137635 - DNA, 22 bp, Artificial Sequence
  chemically synthesized
accccaaatcagagattgctag

SEQ ID NO: 1137636 - DNA, 22 bp, Artificial Sequence
  chemically synthesized
ctcgtggttctagcaatctctg

SEQ ID NO: 1137637 - DNA, 22 bp, Artificial Sequence
  chemically synthesized
gtggttctagcaatctctgatt

SEQ ID NO: 1137638 - DNA, 22 bp, Artificial Sequence
  chemically synthesized
tagcaatctctgatttggggtt

SEQ ID NO: 1137639 - DNA, 22 bp, Artificial Sequence
  chemically synthesized
gcaatctctgatttggggttag

SEQ ID NO: 1137640 - DNA, 22 bp, Artificial Sequence
  chemically synthesized
tataatcacagtctaaccccaa

SEQ ID NO: 1137641 - DNA, 22 bp, Artificial Sequence
  chemically synthesized
ggaactgtataatcacagtcta

SEQ ID NO: 1137642 - DNA, 22 bp, Artificial Sequence
  chemically synthesized
tgatttggggttagactgtgat

SEQ ID NO: 1137643 - DNA, 22 bp, Artificial Sequence
  chemically synthesized
atttggggttagactgtgatta

SEQ ID NO: 1137644 - DNA, 22 bp, Artificial Sequence
  chemically synthesized
ggggttagactgtgattataca

SEQ ID NO: 1137645 - DNA, 22 bp, Artificial Sequence
  chemically synthesized
gggttagactgtgattatacag

SEQ ID NO: 1137646 - DNA, 22 bp, Artificial Sequence
  chemically synthesized
gactgtgattatacagttccca

SEQ ID NO: 1137647 - DNA, 22 bp, Artificial Sequence
  chemically synthesized
tgattatacagttcccagcatt

SEQ ID NO: 1137648 - DNA, 22 bp, Artificial Sequence
  chemically synthesized
gagcaggcgaacaaaatgctgg

SEQ ID NO: 1137649 - DNA, 22 bp, Artificial Sequence
  chemically synthesized
agagcaggcgaacaaaatgctg

SEQ ID NO: 1137650 - DNA, 22 bp, Artificial Sequence
  chemically synthesized
tacagttcccagcattttgttc

SEQ ID NO: 1137651 - DNA, 22 bp, Artificial Sequence
  chemically synthesized
agtgacttagagcaggcgaaca

SEQ ID NO: 1137652 - DNA, 22 bp, Artificial Sequence
  chemically synthesized
ccagcattttgttcgcctgctc

SEQ ID NO: 1137653 - DNA, 22 bp, Artificial Sequence
  chemically synthesized
tgttcgcctgctctaagtcact

SEQ ID NO: 1137654 - DNA, 22 bp, Artificial Sequence
  chemically synthesized
gttcgcctgctctaagtcactc

SEQ ID NO: 1137655 - DNA, 22 bp, Artificial Sequence
  chemically synthesized
ttcgcctgctctaagtcactca

SEQ ID NO: 1137656 - DNA, 22 bp, Artificial Sequence
  chemically synthesized
gcctgctctaagtcactcagtt

SEQ ID NO: 1137657 - DNA, 22 bp, Artificial Sequence
  chemically synthesized
ctctaagtcactcagttccccg

SEQ ID NO: 1137658 - DNA, 22 bp, Artificial Sequence
  chemically synthesized
cagcccaatagtaacggggaac

SEQ ID NO: 1137659 - DNA, 22 bp, Artificial Sequence
  chemically synthesized
taagtcactcagttccccgtta

SEQ ID NO: 1137660 - DNA, 22 bp, Artificial Sequence
  chemically synthesized
ccagcccaatagtaacggggaa

SEQ ID NO: 1137661 - DNA, 22 bp, Artificial Sequence
  chemically synthesized
agtcactcagttccccgttact

SEQ ID NO: 1137662 - DNA, 22 bp, Artificial Sequence
  chemically synthesized
ttccagcccaatagtaacgggg

SEQ ID NO: 1137663 - DNA, 22 bp, Artificial Sequence
  chemically synthesized
cttccagcccaatagtaacggg

SEQ ID NO: 1137664 - DNA, 22 bp, Artificial Sequence
  chemically synthesized
agttccccgttactattgggct

SEQ ID NO: 1137665 - DNA, 22 bp, Artificial Sequence
  chemically synthesized
gagtgaatttcttccagcccaa

SEQ ID NO: 1137666 - DNA, 22 bp, Artificial Sequence
  chemically synthesized
cccgttactattgggctggaag

SEQ ID NO: 1137667 - DNA, 22 bp, Artificial Sequence
  chemically synthesized
ccctagagtgaatttcttccag

SEQ ID NO: 1137668 - DNA, 22 bp, Artificial Sequence
  chemically synthesized
ctgccctagagtgaatttcttc

SEQ ID NO: 1137669 - DNA, 22 bp, Artificial Sequence
  chemically synthesized
ctattgggctggaagaaattca

SEQ ID NO: 1137670 - DNA, 22 bp, Artificial Sequence
  chemically synthesized
ttactgccctagagtgaatttc

SEQ ID NO: 1137671 - DNA, 22 bp, Artificial Sequence
  chemically synthesized
ttgggctggaagaaattcactc

SEQ ID NO: 1137672 - DNA, 22 bp, Artificial Sequence
  chemically synthesized
gttactgccctagagtgaattt

SEQ ID NO: 1137673 - DNA, 22 bp, Artificial Sequence
  chemically synthesized
ggctggaagaaattcactctag

SEQ ID NO: 1137674 - DNA, 22 bp, Artificial Sequence
  chemically synthesized
aacttgttactgccctagagtg

SEQ ID NO: 1137675 - DNA, 22 bp, Artificial Sequence
  chemically synthesized
gaagaaattcactctagggcag

SEQ ID NO: 1137676 - DNA, 22 bp, Artificial Sequence
  chemically synthesized
actgaacttgttactgccctag

SEQ ID NO: 1137677 - DNA, 22 bp, Artificial Sequence
  chemically synthesized
attaactgaacttgttactgcc

SEQ ID NO: 1137678 - DNA, 22 bp, Artificial Sequence
  chemically synthesized
actctagggcagtaacaagttc

SEQ ID NO: 1137679 - DNA, 22 bp, Artificial Sequence
  chemically synthesized
tagggcagtaacaagttcagtt

SEQ ID NO: 1137680 - DNA, 22 bp, Artificial Sequence
  chemically synthesized
gggcagtaacaagttcagttaa

SEQ ID NO: 1137681 - DNA, 22 bp, Artificial Sequence
  chemically synthesized
gagaatggtggtgaggtagagt

SEQ ID NO: 1137682 - DNA, 22 bp, Artificial Sequence
  chemically synthesized
agttaattagcactctacctca

SEQ ID NO: 1137683 - DNA, 22 bp, Artificial Sequence
  chemically synthesized
ttggagaatggtggtgaggtag

SEQ ID NO: 1137684 - DNA, 22 bp, Artificial Sequence
  chemically synthesized
attagcactctacctcaccacc

SEQ ID NO: 1137685 - DNA, 22 bp, Artificial Sequence
  chemically synthesized
ttgttggagaatggtggtgagg

SEQ ID NO: 1137686 - DNA, 22 bp, Artificial Sequence
  chemically synthesized
gttgttggagaatggtggtgag

SEQ ID NO: 1137687 - DNA, 22 bp, Artificial Sequence
  chemically synthesized
gcactctacctcaccaccattc

SEQ ID NO: 1137688 - DNA, 22 bp, Artificial Sequence
  chemically synthesized
tcttgttgttggagaatggtgg

SEQ ID NO: 1137689 - DNA, 22 bp, Artificial Sequence
  chemically synthesized
cctgtcttgttgttggagaatg

SEQ ID NO: 1137690 - DNA, 22 bp, Artificial Sequence
  chemically synthesized
tacctcaccaccattctccaac

SEQ ID NO: 1137691 - DNA, 22 bp, Artificial Sequence
  chemically synthesized
gcctgtcttgttgttggagaat

SEQ ID NO: 1137692 - DNA, 22 bp, Artificial Sequence
  chemically synthesized
tgcctgtcttgttgttggagaa

SEQ ID NO: 1137693 - DNA, 22 bp, Artificial Sequence
  chemically synthesized
cctcaccaccattctccaacaa

SEQ ID NO: 1137694 - DNA, 22 bp, Artificial Sequence
  chemically synthesized
ttgcctgtcttgttgttggaga

SEQ ID NO: 1137695 - DNA, 22 bp, Artificial Sequence
  chemically synthesized
ttttgcctgtcttgttgttgga

SEQ ID NO: 1137696 - DNA, 22 bp, Artificial Sequence
  chemically synthesized
accaccattctccaacaacaag

SEQ ID NO: 1137697 - DNA, 22 bp, Artificial Sequence
  chemically synthesized
tccaacaacaagacaggcaaaa

SEQ ID NO: 1137698 - DNA, 22 bp, Artificial Sequence
  chemically synthesized
caacaacaagacaggcaaaaga

SEQ ID NO: 1137699 - DNA, 22 bp, Artificial Sequence
  chemically synthesized
aataaaaacatgattcttttgc

SEQ ID NO: 1137700 - DNA, 22 bp, Artificial Sequence
  chemically synthesized
gttaaataaaaacatgattctt

SEQ ID NO: 1137701 - DNA, 22 bp, Artificial Sequence
  chemically synthesized
agttaaataaaaacatgattct

SEQ ID NO: 1137702 - DNA, 22 bp, Artificial Sequence
  chemically synthesized
tgtttagttaaataaaaacatg

SEQ ID NO: 1137703 - DNA, 22 bp, Artificial Sequence
  chemically synthesized
ccctgtgtttagttaaataaaa

SEQ ID NO: 1137704 - DNA, 22 bp, Artificial Sequence
  chemically synthesized
gccctgtgtttagttaaataaa

SEQ ID NO: 1137705 - DNA, 22 bp, Artificial Sequence
  chemically synthesized
tgccctgtgtttagttaaataa

SEQ ID NO: 1137706 - DNA, 22 bp, Artificial Sequence
  chemically synthesized
ttgccctgtgtttagttaaata

SEQ ID NO: 1137707 - DNA, 22 bp, Artificial Sequence
  chemically synthesized
gtttttgccctgtgtttagtta

SEQ ID NO: 1137708 - DNA, 22 bp, Artificial Sequence
  chemically synthesized
ttatttaactaaacacagggca

SEQ ID NO: 1137709 - DNA, 22 bp, Artificial Sequence
  chemically synthesized
tatttaactaaacacagggcaa

SEQ ID NO: 1137710 - DNA, 22 bp, Artificial Sequence
  chemically synthesized
atttaactaaacacagggcaaa

SEQ ID NO: 1137711 - DNA, 22 bp, Artificial Sequence
  chemically synthesized
tttaactaaacacagggcaaaa

SEQ ID NO: 1137712 - DNA, 22 bp, Artificial Sequence
  chemically synthesized
aactaaacacagggcaaaaact

SEQ ID NO: 1137713 - DNA, 22 bp, Artificial Sequence
  chemically synthesized
actaaacacagggcaaaaacta

SEQ ID NO: 1137714 - DNA, 22 bp, Artificial Sequence
  chemically synthesized
aacacagggcaaaaactaatct

SEQ ID NO: 1137715 - DNA, 22 bp, Artificial Sequence
  chemically synthesized
caaaagaagcaaccagattagt

SEQ ID NO: 1137716 - DNA, 22 bp, Artificial Sequence
  chemically synthesized
taaccctacaaaagaagcaacc

SEQ ID NO: 1137717 - DNA, 22 bp, Artificial Sequence
  chemically synthesized
atctggttgcttcttttgtagg

SEQ ID NO: 1137718 - DNA, 22 bp, Artificial Sequence
  chemically synthesized
gttgcttcttttgtagggttat

SEQ ID NO: 1137719 - DNA, 22 bp, Artificial Sequence
  chemically synthesized
agagagtgacattataacccta

SEQ ID NO: 1137720 - DNA, 22 bp, Artificial Sequence
  chemically synthesized
cttcttttgtagggttataatg

SEQ ID NO: 1137721 - DNA, 22 bp, Artificial Sequence
  chemically synthesized
cattaagagagtgacattataa

SEQ ID NO: 1137722 - DNA, 22 bp, Artificial Sequence
  chemically synthesized
cttttgtagggttataatgtca

SEQ ID NO: 1137723 - DNA, 22 bp, Artificial Sequence
  chemically synthesized
ttttgtagggttataatgtcac

SEQ ID NO: 1137724 - DNA, 22 bp, Artificial Sequence
  chemically synthesized
ttgtagggttataatgtcactc

SEQ ID NO: 1137725 - DNA, 22 bp, Artificial Sequence
  chemically synthesized
tgtagggttataatgtcactct

SEQ ID NO: 1137726 - DNA, 22 bp, Artificial Sequence
  chemically synthesized
gtagggttataatgtcactctc

SEQ ID NO: 1137727 - DNA, 22 bp, Artificial Sequence
  chemically synthesized
aacctgcattaagagagtgaca

SEQ ID NO: 1137728 - DNA, 22 bp, Artificial Sequence
  chemically synthesized
tagggttataatgtcactctct

SEQ ID NO: 1137729 - DNA, 22 bp, Artificial Sequence
  chemically synthesized
aaacctgcattaagagagtgac

SEQ ID NO: 1137730 - DNA, 22 bp, Artificial Sequence
  chemically synthesized
taaacctgcattaagagagtga

SEQ ID NO: 1137731 - DNA, 22 bp, Artificial Sequence
  chemically synthesized
ttaaacctgcattaagagagtg

SEQ ID NO: 1137732 - DNA, 22 bp, Artificial Sequence
  chemically synthesized
tttaaacctgcattaagagagt

SEQ ID NO: 1137733 - DNA, 22 bp, Artificial Sequence
  chemically synthesized
taatgtcactctcttaatgcag

SEQ ID NO: 1137734 - DNA, 22 bp, Artificial Sequence
  chemically synthesized
agagattttttaaacctgcatt

SEQ ID NO: 1137735 - DNA, 22 bp, Artificial Sequence
  chemically synthesized
tctcagagattttttaaacctg

SEQ ID NO: 1137736 - DNA, 22 bp, Artificial Sequence
  chemically synthesized
tcttaatgcaggtttaaaaaat

SEQ ID NO: 1137737 - DNA, 22 bp, Artificial Sequence
  chemically synthesized
ttaatgcaggtttaaaaaatct

SEQ ID NO: 1137738 - DNA, 22 bp, Artificial Sequence
  chemically synthesized
cagactatctcagagatttttt

SEQ ID NO: 1137739 - DNA, 22 bp, Artificial Sequence
  chemically synthesized
aatgcaggtttaaaaaatctct

SEQ ID NO: 1137740 - DNA, 22 bp, Artificial Sequence
  chemically synthesized
atgcaggtttaaaaaatctctg

SEQ ID NO: 1137741 - DNA, 22 bp, Artificial Sequence
  chemically synthesized
tcatgctacagactatctcaga

SEQ ID NO: 1137742 - DNA, 22 bp, Artificial Sequence
  chemically synthesized
aaaaaatctctgagatagtctg

SEQ ID NO: 1137743 - DNA, 22 bp, Artificial Sequence
  chemically synthesized
aaaaatctctgagatagtctgt

SEQ ID NO: 1137744 - DNA, 22 bp, Artificial Sequence
  chemically synthesized
gtgataccaattatcatgctac

SEQ ID NO: 1137745 - DNA, 22 bp, Artificial Sequence
  chemically synthesized
tgagatagtctgtagcatgata

SEQ ID NO: 1137746 - DNA, 22 bp, Artificial Sequence
  chemically synthesized
agatagtctgtagcatgataat

SEQ ID NO: 1137747 - DNA, 22 bp, Artificial Sequence
  chemically synthesized
tagcatgataattggtatcact

SEQ ID NO: 1137748 - DNA, 22 bp, Artificial Sequence
  chemically synthesized
aaaagagtacagcacaggttag

SEQ ID NO: 1137749 - DNA, 22 bp, Artificial Sequence
  chemically synthesized
gaaaagagtacagcacaggtta

SEQ ID NO: 1137750 - DNA, 22 bp, Artificial Sequence
  chemically synthesized
gtatcactaacctgtgctgtac

SEQ ID NO: 1137751 - DNA, 22 bp, Artificial Sequence
  chemically synthesized
gtccaaaaacttgaaaagagta

SEQ ID NO: 1137752 - DNA, 22 bp, Artificial Sequence
  chemically synthesized
agtccaaaaacttgaaaagagt

SEQ ID NO: 1137753 - DNA, 22 bp, Artificial Sequence
  chemically synthesized
acctgtgctgtactcttttcaa

SEQ ID NO: 1137754 - DNA, 22 bp, Artificial Sequence
  chemically synthesized
tgctgtactcttttcaagtttt

SEQ ID NO: 1137755 - DNA, 22 bp, Artificial Sequence
  chemically synthesized
ggataatttagtccaaaaactt

SEQ ID NO: 1137756 - DNA, 22 bp, Artificial Sequence
  chemically synthesized
tactcttttcaagtttttggac

SEQ ID NO: 1137757 - DNA, 22 bp, Artificial Sequence
  chemically synthesized
ttttcaagtttttggactaaat

SEQ ID NO: 1137758 - DNA, 22 bp, Artificial Sequence
  chemically synthesized
ttcaagtttttggactaaatta

SEQ ID NO: 1137759 - DNA, 22 bp, Artificial Sequence
  chemically synthesized
tcaagtttttggactaaattat

SEQ ID NO: 1137760 - DNA, 22 bp, Artificial Sequence
  chemically synthesized
cccggtgttgggataatttagt

SEQ ID NO: 1137761 - DNA, 22 bp, Artificial Sequence
  chemically synthesized
caagtttttggactaaattatc

SEQ ID NO: 1137762 - DNA, 22 bp, Artificial Sequence
  chemically synthesized
gcccggtgttgggataatttag

SEQ ID NO: 1137763 - DNA, 22 bp, Artificial Sequence
  chemically synthesized
aagtttttggactaaattatcc

SEQ ID NO: 1137764 - DNA, 22 bp, Artificial Sequence
  chemically synthesized
tgcccggtgttgggataattta

SEQ ID NO: 1137765 - DNA, 22 bp, Artificial Sequence
  chemically synthesized
ttggactaaattatcccaacac

SEQ ID NO: 1137766 - DNA, 22 bp, Artificial Sequence
  chemically synthesized
tggactaaattatcccaacacc

SEQ ID NO: 1137767 - DNA, 22 bp, Artificial Sequence
  chemically synthesized
ggactaaattatcccaacaccg

SEQ ID NO: 1137768 - DNA, 22 bp, Artificial Sequence
  chemically synthesized
gataactttgcccggtgttggg

SEQ ID NO: 1137769 - DNA, 22 bp, Artificial Sequence
  chemically synthesized
gactaaattatcccaacaccgg

SEQ ID NO: 1137770 - DNA, 22 bp, Artificial Sequence
  chemically synthesized
aattatcccaacaccgggcaaa

SEQ ID NO: 1137771 - DNA, 22 bp, Artificial Sequence
  chemically synthesized
tcccaacaccgggcaaagttat

SEQ ID NO: 1137772 - DNA, 22 bp, Artificial Sequence
  chemically synthesized
tccagccatgcttccgtcttct

SEQ ID NO: 1137773 - DNA, 22 bp, Artificial Sequence
  chemically synthesized
aagaataagtcagtgacccaga

SEQ ID NO: 1137774 - DNA, 22 bp, Artificial Sequence
  chemically synthesized
ccgtcttctgggtcactgactt

SEQ ID NO: 1137775 - DNA, 22 bp, Artificial Sequence
  chemically synthesized
cgtcttctgggtcactgactta

SEQ ID NO: 1137776 - DNA, 22 bp, Artificial Sequence
  chemically synthesized
aacactgaagaataagtcagtg

SEQ ID NO: 1137777 - DNA, 22 bp, Artificial Sequence
  chemically synthesized
caacactgaagaataagtcagt

SEQ ID NO: 1137778 - DNA, 22 bp, Artificial Sequence
  chemically synthesized
tcaacactgaagaataagtcag

SEQ ID NO: 1137779 - DNA, 22 bp, Artificial Sequence
  chemically synthesized
tttcaacactgaagaataagtc

SEQ ID NO: 1137780 - DNA, 22 bp, Artificial Sequence
  chemically synthesized
ctttcaacactgaagaataagt

SEQ ID NO: 1137781 - DNA, 22 bp, Artificial Sequence
  chemically synthesized
ctgggtcactgacttattcttc

SEQ ID NO: 1137782 - DNA, 22 bp, Artificial Sequence
  chemically synthesized
tgggtcactgacttattcttca

SEQ ID NO: 1137783 - DNA, 22 bp, Artificial Sequence
  chemically synthesized
ggtcactgacttattcttcagt

SEQ ID NO: 1137784 - DNA, 22 bp, Artificial Sequence
  chemically synthesized
acttattcttcagtgttgaaag

SEQ ID NO: 1137785 - DNA, 22 bp, Artificial Sequence
  chemically synthesized
aaacaagatcttctttcaacac

SEQ ID NO: 1137786 - DNA, 22 bp, Artificial Sequence
  chemically synthesized
attcttcagtgttgaaagaaga

SEQ ID NO: 1137787 - DNA, 22 bp, Artificial Sequence
  chemically synthesized
actcaaacaagatcttctttca

SEQ ID NO: 1137788 - DNA, 22 bp, Artificial Sequence
  chemically synthesized
ttcttcagtgttgaaagaagat

SEQ ID NO: 1137789 - DNA, 22 bp, Artificial Sequence
  chemically synthesized
ttcagtgttgaaagaagatctt

SEQ ID NO: 1137790 - DNA, 22 bp, Artificial Sequence
  chemically synthesized
tattcactcaaacaagatcttc

SEQ ID NO: 1137791 - DNA, 22 bp, Artificial Sequence
  chemically synthesized
cagtgttgaaagaagatcttgt

SEQ ID NO: 1137792 - DNA, 22 bp, Artificial Sequence
  chemically synthesized
agtgttgaaagaagatcttgtt

SEQ ID NO: 1137793 - DNA, 22 bp, Artificial Sequence
  chemically synthesized
aaagaagatcttgtttgagtga

SEQ ID NO: 1137794 - DNA, 22 bp, Artificial Sequence
  chemically synthesized
gtttgagtgaatacagtttgcc

SEQ ID NO: 1137795 - DNA, 22 bp, Artificial Sequence
  chemically synthesized
tttgagtgaatacagtttgccc

SEQ ID NO: 1137796 - DNA, 22 bp, Artificial Sequence
  chemically synthesized
gagtgaatacagtttgcccatg

SEQ ID NO: 1137797 - DNA, 22 bp, Artificial Sequence
  chemically synthesized
agtgaatacagtttgcccatgg

SEQ ID NO: 1137798 - DNA, 22 bp, Artificial Sequence
  chemically synthesized
gaaaagaaaaagcaatccatgg

SEQ ID NO: 1137799 - DNA, 22 bp, Artificial Sequence
  chemically synthesized
gcccatggattgctttttcttt

SEQ ID NO: 1137800 - DNA, 22 bp, Artificial Sequence
  chemically synthesized
cccatggattgctttttctttt

SEQ ID NO: 1137801 - DNA, 22 bp, Artificial Sequence
  chemically synthesized
aaagcggatctagaaaagaaaa

SEQ ID NO: 1137802 - DNA, 22 bp, Artificial Sequence
  chemically synthesized
aaaagcggatctagaaaagaaa

SEQ ID NO: 1137803 - DNA, 22 bp, Artificial Sequence
  chemically synthesized
taaaagcggatctagaaaagaa

SEQ ID NO: 1137804 - DNA, 22 bp, Artificial Sequence
  chemically synthesized
ctttttcttttctagatccgct

SEQ ID NO: 1137805 - DNA, 22 bp, Artificial Sequence
  chemically synthesized
acaggttttaaaagcggatcta

SEQ ID NO: 1137806 - DNA, 22 bp, Artificial Sequence
  chemically synthesized
aacaggttttaaaagcggatct

SEQ ID NO: 1137807 - DNA, 22 bp, Artificial Sequence
  chemically synthesized
taacaggttttaaaagcggatc

SEQ ID NO: 1137808 - DNA, 22 bp, Artificial Sequence
  chemically synthesized
tttcttttctagatccgctttt

SEQ ID NO: 1137809 - DNA, 22 bp, Artificial Sequence
  chemically synthesized
ttcttttctagatccgctttta

SEQ ID NO: 1137810 - DNA, 22 bp, Artificial Sequence
  chemically synthesized
tcttttctagatccgcttttaa

SEQ ID NO: 1137811 - DNA, 22 bp, Artificial Sequence
  chemically synthesized
ttttaacaggttttaaaagcgg

SEQ ID NO: 1137812 - DNA, 22 bp, Artificial Sequence
  chemically synthesized
cttttctagatccgcttttaaa

SEQ ID NO: 1137813 - DNA, 22 bp, Artificial Sequence
  chemically synthesized
gttttaacaggttttaaaagcg

SEQ ID NO: 1137814 - DNA, 22 bp, Artificial Sequence
  chemically synthesized
ttttctagatccgcttttaaaa

SEQ ID NO: 1137815 - DNA, 22 bp, Artificial Sequence
  chemically synthesized
ttgttttaacaggttttaaaag

SEQ ID NO: 1137816 - DNA, 22 bp, Artificial Sequence
  chemically synthesized
ttctagatccgcttttaaaacc

SEQ ID NO: 1137817 - DNA, 22 bp, Artificial Sequence
  chemically synthesized
cttgttttaacaggttttaaaa

SEQ ID NO: 1137818 - DNA, 22 bp, Artificial Sequence
  chemically synthesized
tctagatccgcttttaaaacct

SEQ ID NO: 1137819 - DNA, 22 bp, Artificial Sequence
  chemically synthesized
tcttgttttaacaggttttaaa

SEQ ID NO: 1137820 - DNA, 22 bp, Artificial Sequence
  chemically synthesized
ctagatccgcttttaaaacctg

SEQ ID NO: 1137821 - DNA, 22 bp, Artificial Sequence
  chemically synthesized
tagatccgcttttaaaacctgt

SEQ ID NO: 1137822 - DNA, 22 bp, Artificial Sequence
  chemically synthesized
gatccgcttttaaaacctgtta

SEQ ID NO: 1137823 - DNA, 22 bp, Artificial Sequence
  chemically synthesized
tgatctttcttgttttaacagg

SEQ ID NO: 1137824 - DNA, 22 bp, Artificial Sequence
  chemically synthesized
tgtgatctttcttgttttaaca

SEQ ID NO: 1137825 - DNA, 22 bp, Artificial Sequence
  chemically synthesized
ttctgtgatctttcttgtttta

SEQ ID NO: 1137826 - DNA, 22 bp, Artificial Sequence
  chemically synthesized
ttaaaacctgttaaaacaagaa

SEQ ID NO: 1137827 - DNA, 22 bp, Artificial Sequence
  chemically synthesized
attctgtgatctttcttgtttt

SEQ ID NO: 1137828 - DNA, 22 bp, Artificial Sequence
  chemically synthesized
taaaacctgttaaaacaagaaa

SEQ ID NO: 1137829 - DNA, 22 bp, Artificial Sequence
  chemically synthesized
aaaacctgttaaaacaagaaag

SEQ ID NO: 1137830 - DNA, 22 bp, Artificial Sequence
  chemically synthesized
aaacctgttaaaacaagaaaga

SEQ ID NO: 1137831 - DNA, 22 bp, Artificial Sequence
  chemically synthesized
ttaaaacaagaaagatcacaga

SEQ ID NO: 1137832 - DNA, 22 bp, Artificial Sequence
  chemically synthesized
aaacaagaaagatcacagaata

SEQ ID NO: 1137833 - DNA, 22 bp, Artificial Sequence
  chemically synthesized
tagtggtgtatggaatgcaacc

SEQ ID NO: 1137834 - DNA, 22 bp, Artificial Sequence
  chemically synthesized
aactatagtggtgtatggaatg

SEQ ID NO: 1137835 - DNA, 22 bp, Artificial Sequence
  chemically synthesized
ggttgcattccatacaccacta

SEQ ID NO: 1137836 - DNA, 22 bp, Artificial Sequence
  chemically synthesized
cattccatacaccactatagtt

SEQ ID NO: 1137837 - DNA, 22 bp, Artificial Sequence
  chemically synthesized
catacaccactatagttcaatc

SEQ ID NO: 1137838 - DNA, 22 bp, Artificial Sequence
  chemically synthesized
tagttcaatctgcttttgcgtg

SEQ ID NO: 1137839 - DNA, 22 bp, Artificial Sequence
  chemically synthesized
tgcaaatgagcaaatacacgca

SEQ ID NO: 1137840 - DNA, 22 bp, Artificial Sequence
  chemically synthesized
aatctgcttttgcgtgtatttg

SEQ ID NO: 1137841 - DNA, 22 bp, Artificial Sequence
  chemically synthesized
tctatgcaaatgagcaaataca

SEQ ID NO: 1137842 - DNA, 22 bp, Artificial Sequence
  chemically synthesized
atctatgcaaatgagcaaatac

SEQ ID NO: 1137843 - DNA, 22 bp, Artificial Sequence
  chemically synthesized
ttatctatgcaaatgagcaaat

SEQ ID NO: 1137844 - DNA, 22 bp, Artificial Sequence
  chemically synthesized
cttttgcgtgtatttgctcatt

SEQ ID NO: 1137845 - DNA, 22 bp, Artificial Sequence
  chemically synthesized
cttatctatgcaaatgagcaaa

SEQ ID NO: 1137846 - DNA, 22 bp, Artificial Sequence
  chemically synthesized
tcttatctatgcaaatgagcaa

SEQ ID NO: 1137847 - DNA, 22 bp, Artificial Sequence
  chemically synthesized
ttgcgtgtatttgctcatttgc

SEQ ID NO: 1137848 - DNA, 22 bp, Artificial Sequence
  chemically synthesized
tgcgtgtatttgctcatttgca

SEQ ID NO: 1137849 - DNA, 22 bp, Artificial Sequence
  chemically synthesized
gcgtgtatttgctcatttgcat

SEQ ID NO: 1137850 - DNA, 22 bp, Artificial Sequence
  chemically synthesized
cgtgtatttgctcatttgcata

SEQ ID NO: 1137851 - DNA, 22 bp, Artificial Sequence
  chemically synthesized
aaatattttcttatctatgcaa

SEQ ID NO: 1137852 - DNA, 22 bp, Artificial Sequence
  chemically synthesized
gctcatttgcatagataagaaa

SEQ ID NO: 1137853 - DNA, 22 bp, Artificial Sequence
  chemically synthesized
ctcatttgcatagataagaaaa

SEQ ID NO: 1137854 - DNA, 22 bp, Artificial Sequence
  chemically synthesized
atttgcatagataagaaaatat

SEQ ID NO: 1137855 - DNA, 22 bp, Artificial Sequence
  chemically synthesized
cgggcacgattgaaatattttc

SEQ ID NO: 1137856 - DNA, 22 bp, Artificial Sequence
  chemically synthesized
gcgggcacgattgaaatatttt

SEQ ID NO: 1137857 - DNA, 22 bp, Artificial Sequence
  chemically synthesized
gcatagataagaaaatatttca

SEQ ID NO: 1137858 - DNA, 22 bp, Artificial Sequence
  chemically synthesized
tgcgggcacgattgaaatattt

SEQ ID NO: 1137859 - DNA, 22 bp, Artificial Sequence
  chemically synthesized
catagataagaaaatatttcaa

SEQ ID NO: 1137860 - DNA, 22 bp, Artificial Sequence
  chemically synthesized
atcctttgcgggcacgattgaa

SEQ ID NO: 1137861 - DNA, 22 bp, Artificial Sequence
  chemically synthesized
gatcctttgcgggcacgattga

SEQ ID NO: 1137862 - DNA, 22 bp, Artificial Sequence
  chemically synthesized
tgatcctttgcgggcacgattg

SEQ ID NO: 1137863 - DNA, 22 bp, Artificial Sequence
  chemically synthesized
ttgatcctttgcgggcacgatt

SEQ ID NO: 1137864 - DNA, 22 bp, Artificial Sequence
  chemically synthesized
aacttttgatcctttgcgggca

SEQ ID NO: 1137865 - DNA, 22 bp, Artificial Sequence
  chemically synthesized
tgaacttttgatcctttgcggg

SEQ ID NO: 1137866 - DNA, 22 bp, Artificial Sequence
  chemically synthesized
ctgaacttttgatcctttgcgg

SEQ ID NO: 1137867 - DNA, 22 bp, Artificial Sequence
  chemically synthesized
tctgaacttttgatcctttgcg

SEQ ID NO: 1137868 - DNA, 22 bp, Artificial Sequence
  chemically synthesized
ttctgaacttttgatcctttgc

SEQ ID NO: 1137869 - DNA, 22 bp, Artificial Sequence
  chemically synthesized
caatcgtgcccgcaaaggatca

SEQ ID NO: 1137870 - DNA, 22 bp, Artificial Sequence
  chemically synthesized
aatcgtgcccgcaaaggatcaa

SEQ ID NO: 1137871 - DNA, 22 bp, Artificial Sequence
  chemically synthesized
tttttctgaacttttgatcctt

SEQ ID NO: 1137872 - DNA, 22 bp, Artificial Sequence
  chemically synthesized
tatttttctgaacttttgatcc

SEQ ID NO: 1137873 - DNA, 22 bp, Artificial Sequence
  chemically synthesized
cctctatttttctgaacttttg

SEQ ID NO: 1137874 - DNA, 22 bp, Artificial Sequence
  chemically synthesized
tacctctatttttctgaacttt

SEQ ID NO: 1137875 - DNA, 22 bp, Artificial Sequence
  chemically synthesized
ctacctctatttttctgaactt

SEQ ID NO: 1137876 - DNA, 22 bp, Artificial Sequence
  chemically synthesized
tctacctctatttttctgaact

SEQ ID NO: 1137877 - DNA, 22 bp, Artificial Sequence
  chemically synthesized
taactttctacctctatttttc

SEQ ID NO: 1137878 - DNA, 22 bp, Artificial Sequence
  chemically synthesized
gatagattataactttctacct

SEQ ID NO: 1137879 - DNA, 22 bp, Artificial Sequence
  chemically synthesized
agaaaaatagaggtagaaagtt

SEQ ID NO: 1137880 - DNA, 22 bp, Artificial Sequence
  chemically synthesized
ggataattagatagattataac

SEQ ID NO: 1137881 - DNA, 22 bp, Artificial Sequence
  chemically synthesized
gggataattagatagattataa

SEQ ID NO: 1137882 - DNA, 22 bp, Artificial Sequence
  chemically synthesized
ttgggataattagatagattat

SEQ ID NO: 1137883 - DNA, 22 bp, Artificial Sequence
  chemically synthesized
cttgggataattagatagatta

SEQ ID NO: 1137884 - DNA, 22 bp, Artificial Sequence
  chemically synthesized
aaacttcttgggataattagat

SEQ ID NO: 1137885 - DNA, 22 bp, Artificial Sequence
  chemically synthesized
caaacttcttgggataattaga

SEQ ID NO: 1137886 - DNA, 22 bp, Artificial Sequence
  chemically synthesized
ttcaaacttcttgggataatta

SEQ ID NO: 1137887 - DNA, 22 bp, Artificial Sequence
  chemically synthesized
tcttcaaacttcttgggataat

SEQ ID NO: 1137888 - DNA, 22 bp, Artificial Sequence
  chemically synthesized
taatctatctaattatcccaag

SEQ ID NO: 1137889 - DNA, 22 bp, Artificial Sequence
  chemically synthesized
ctcttcaaacttcttgggataa

SEQ ID NO: 1137890 - DNA, 22 bp, Artificial Sequence
  chemically synthesized
tctcttcaaacttcttgggata

SEQ ID NO: 1137891 - DNA, 22 bp, Artificial Sequence
  chemically synthesized
ttctcttcaaacttcttgggat

SEQ ID NO: 1137892 - DNA, 22 bp, Artificial Sequence
  chemically synthesized
ttttctcttcaaacttcttggg

SEQ ID NO: 1137893 - DNA, 22 bp, Artificial Sequence
  chemically synthesized
cttttctcttcaaacttcttgg

SEQ ID NO: 1137894 - DNA, 22 bp, Artificial Sequence
  chemically synthesized
tctaattatcccaagaagtttg

SEQ ID NO: 1137895 - DNA, 22 bp, Artificial Sequence
  chemically synthesized
ttcttttctcttcaaacttctt

SEQ ID NO: 1137896 - DNA, 22 bp, Artificial Sequence
  chemically synthesized
tcttcttttctcttcaaacttc

SEQ ID NO: 1137897 - DNA, 22 bp, Artificial Sequence
  chemically synthesized
ctcttcttttctcttcaaactt

SEQ ID NO: 1137898 - DNA, 22 bp, Artificial Sequence
  chemically synthesized
attatcccaagaagtttgaaga

SEQ ID NO: 1137899 - DNA, 22 bp, Artificial Sequence
  chemically synthesized
tctcttcttttctcttcaaact

SEQ ID NO: 1137900 - DNA, 22 bp, Artificial Sequence
  chemically synthesized
ttctcttcttttctcttcaaac

SEQ ID NO: 1137901 - DNA, 22 bp, Artificial Sequence
  chemically synthesized
ttttctcttcttttctcttcaa

SEQ ID NO: 1137902 - DNA, 22 bp, Artificial Sequence
  chemically synthesized
tcccaagaagtttgaagagaaa

SEQ ID NO: 1137903 - DNA, 22 bp, Artificial Sequence
  chemically synthesized
cttttctcttcttttctcttca

SEQ ID NO: 1137904 - DNA, 22 bp, Artificial Sequence
  chemically synthesized
agtttcttttctcttcttttct

SEQ ID NO: 1137905 - DNA, 22 bp, Artificial Sequence
  chemically synthesized
gagtttcttttctcttcttttc

SEQ ID NO: 1137906 - DNA, 22 bp, Artificial Sequence
  chemically synthesized
cgtttgagtttcttttctcttc

SEQ ID NO: 1137907 - DNA, 22 bp, Artificial Sequence
  chemically synthesized
gaagagaaaagaagagaaaaga

SEQ ID NO: 1137908 - DNA, 22 bp, Artificial Sequence
  chemically synthesized
tacgtttgagtttcttttctct

SEQ ID NO: 1137909 - DNA, 22 bp, Artificial Sequence
  chemically synthesized
aagagaaaagaagagaaaagaa

SEQ ID NO: 1137910 - DNA, 22 bp, Artificial Sequence
  chemically synthesized
ttctacgtttgagtttcttttc

SEQ ID NO: 1137911 - DNA, 22 bp, Artificial Sequence
  chemically synthesized
attctacgtttgagtttctttt

SEQ ID NO: 1137912 - DNA, 22 bp, Artificial Sequence
  chemically synthesized
tattctacgtttgagtttcttt

SEQ ID NO: 1137913 - DNA, 22 bp, Artificial Sequence
  chemically synthesized
gtaggtctttattctacgtttg

SEQ ID NO: 1137914 - DNA, 22 bp, Artificial Sequence
  chemically synthesized
tagtaggtctttattctacgtt

SEQ ID NO: 1137915 - DNA, 22 bp, Artificial Sequence
  chemically synthesized
cctctagtaggtctttattcta

SEQ ID NO: 1137916 - DNA, 22 bp, Artificial Sequence
  chemically synthesized
attacctctagtaggtctttat

SEQ ID NO: 1137917 - DNA, 22 bp, Artificial Sequence
  chemically synthesized
aattacctctagtaggtcttta

SEQ ID NO: 1137918 - DNA, 22 bp, Artificial Sequence
  chemically synthesized
aaacgtagaataaagacctact

SEQ ID NO: 1137919 - DNA, 22 bp, Artificial Sequence
  chemically synthesized
ttaattacctctagtaggtctt

SEQ ID NO: 1137920 - DNA, 22 bp, Artificial Sequence
  chemically synthesized
aaggtagctcttaattacctct

SEQ ID NO: 1137921 - DNA, 22 bp, Artificial Sequence
  chemically synthesized
caaggtagctcttaattacctc

SEQ ID NO: 1137922 - DNA, 22 bp, Artificial Sequence
  chemically synthesized
aaatatttcaaggtagctctta

SEQ ID NO: 1137923 - DNA, 22 bp, Artificial Sequence
  chemically synthesized
ctagaggtaattaagagctacc

SEQ ID NO: 1137924 - DNA, 22 bp, Artificial Sequence
  chemically synthesized
caaatatttcaaggtagctctt

SEQ ID NO: 1137925 - DNA, 22 bp, Artificial Sequence
  chemically synthesized
ttcaaatatttcaaggtagctc

SEQ ID NO: 1137926 - DNA, 22 bp, Artificial Sequence
  chemically synthesized
gaggtaattaagagctaccttg

SEQ ID NO: 1137927 - DNA, 22 bp, Artificial Sequence
  chemically synthesized
cttcaaatatttcaaggtagct

SEQ ID NO: 1137928 - DNA, 22 bp, Artificial Sequence
  chemically synthesized
tcttcaaatatttcaaggtagc

SEQ ID NO: 1137929 - DNA, 22 bp, Artificial Sequence
  chemically synthesized
gattttcttcaaatatttcaag

SEQ ID NO: 1137930 - DNA, 22 bp, Artificial Sequence
  chemically synthesized
ggattttcttcaaatatttcaa

SEQ ID NO: 1137931 - DNA, 22 bp, Artificial Sequence
  chemically synthesized
agagctaccttgaaatatttga

SEQ ID NO: 1137932 - DNA, 22 bp, Artificial Sequence
  chemically synthesized
acttggattttcttcaaatatt

SEQ ID NO: 1137933 - DNA, 22 bp, Artificial Sequence
  chemically synthesized
cacttggattttcttcaaatat

SEQ ID NO: 1137934 - DNA, 22 bp, Artificial Sequence
  chemically synthesized
tcacttggattttcttcaaata

SEQ ID NO: 1137935 - DNA, 22 bp, Artificial Sequence
  chemically synthesized
ttcacttggattttcttcaaat

SEQ ID NO: 1137936 - DNA, 22 bp, Artificial Sequence
  chemically synthesized
ccttgaaatatttgaagaaaat

SEQ ID NO: 1137937 - DNA, 22 bp, Artificial Sequence
  chemically synthesized
ccttttcacttggattttcttc

SEQ ID NO: 1137938 - DNA, 22 bp, Artificial Sequence
  chemically synthesized
gaaatatttgaagaaaatccaa

SEQ ID NO: 1137939 - DNA, 22 bp, Artificial Sequence
  chemically synthesized
aaatatttgaagaaaatccaag

SEQ ID NO: 1137940 - DNA, 22 bp, Artificial Sequence
  chemically synthesized
aagcaatattaccttttcactt

SEQ ID NO: 1137941 - DNA, 22 bp, Artificial Sequence
  chemically synthesized
gaagaaaatccaagtgaaaagg

SEQ ID NO: 1137942 - DNA, 22 bp, Artificial Sequence
  chemically synthesized
gaagcaatattaccttttcact

SEQ ID NO: 1137943 - DNA, 22 bp, Artificial Sequence
  chemically synthesized
aagaaaatccaagtgaaaaggt

SEQ ID NO: 1137944 - DNA, 22 bp, Artificial Sequence
  chemically synthesized
tgaagcaatattaccttttcac

SEQ ID NO: 1137945 - DNA, 22 bp, Artificial Sequence
  chemically synthesized
ttgaagcaatattaccttttca

SEQ ID NO: 1137946 - DNA, 22 bp, Artificial Sequence
  chemically synthesized
ccttttgaagcaatattacctt

SEQ ID NO: 1137947 - DNA, 22 bp, Artificial Sequence
  chemically synthesized
gccttttgaagcaatattacct

SEQ ID NO: 1137948 - DNA, 22 bp, Artificial Sequence
  chemically synthesized
tgccttttgaagcaatattacc

SEQ ID NO: 1137949 - DNA, 22 bp, Artificial Sequence
  chemically synthesized
ttttgccttttgaagcaatatt

SEQ ID NO: 1137950 - DNA, 22 bp, Artificial Sequence
  chemically synthesized
tgttttgccttttgaagcaata

SEQ ID NO: 1137951 - DNA, 22 bp, Artificial Sequence
  chemically synthesized
atctctgttttgccttttgaag

SEQ ID NO: 1137952 - DNA, 22 bp, Artificial Sequence
  chemically synthesized
cacatgttgatctctgttttgc

SEQ ID NO: 1137953 - DNA, 22 bp, Artificial Sequence
  chemically synthesized
ccacatgttgatctctgttttg

SEQ ID NO: 1137954 - DNA, 22 bp, Artificial Sequence
  chemically synthesized
cttcaaaaggcaaaacagagat

SEQ ID NO: 1137955 - DNA, 22 bp, Artificial Sequence
  chemically synthesized
atttccacatgttgatctctgt

SEQ ID NO: 1137956 - DNA, 22 bp, Artificial Sequence
  chemically synthesized
caaaaggcaaaacagagatcaa

SEQ ID NO: 1137957 - DNA, 22 bp, Artificial Sequence
  chemically synthesized
aaaaggcaaaacagagatcaac

SEQ ID NO: 1137958 - DNA, 22 bp, Artificial Sequence
  chemically synthesized
taatttccacatgttgatctct

SEQ ID NO: 1137959 - DNA, 22 bp, Artificial Sequence
  chemically synthesized
ctaatttccacatgttgatctc

SEQ ID NO: 1137960 - DNA, 22 bp, Artificial Sequence
  chemically synthesized
aggggaaatccaagatccgtgc

SEQ ID NO: 1137961 - DNA, 22 bp, Artificial Sequence
  chemically synthesized
gaaggcacggatcttggatttc

SEQ ID NO: 1137962 - DNA, 22 bp, Artificial Sequence
  chemically synthesized
cgtcaggaattaaggggaaatc

SEQ ID NO: 1137963 - DNA, 22 bp, Artificial Sequence
  chemically synthesized
aattccgtcaggaattaagggg

SEQ ID NO: 1137964 - DNA, 22 bp, Artificial Sequence
  chemically synthesized
gaattccgtcaggaattaaggg

SEQ ID NO: 1137965 - DNA, 22 bp, Artificial Sequence
  chemically synthesized
gtttgaattccgtcaggaatta

SEQ ID NO: 1137966 - DNA, 22 bp, Artificial Sequence
  chemically synthesized
ggatttccccttaattcctgac

SEQ ID NO: 1137967 - DNA, 22 bp, Artificial Sequence
  chemically synthesized
cgtttgaattccgtcaggaatt

SEQ ID NO: 1137968 - DNA, 22 bp, Artificial Sequence
  chemically synthesized
gatttccccttaattcctgacg

SEQ ID NO: 1137969 - DNA, 22 bp, Artificial Sequence
  chemically synthesized
tcgtttgaattccgtcaggaat

SEQ ID NO: 1137970 - DNA, 22 bp, Artificial Sequence
  chemically synthesized
ccccttaattcctgacggaatt

SEQ ID NO: 1137971 - DNA, 22 bp, Artificial Sequence
  chemically synthesized
cccttaattcctgacggaattc

SEQ ID NO: 1137972 - DNA, 22 bp, Artificial Sequence
  chemically synthesized
tcagttttcgtttgaattccgt

SEQ ID NO: 1137973 - DNA, 22 bp, Artificial Sequence
  chemically synthesized
aattcctgacggaattcaaacg

SEQ ID NO: 1137974 - DNA, 22 bp, Artificial Sequence
  chemically synthesized
attgtcagttttcgtttgaatt

SEQ ID NO: 1137975 - DNA, 22 bp, Artificial Sequence
  chemically synthesized
attcctgacggaattcaaacga

SEQ ID NO: 1137976 - DNA, 22 bp, Artificial Sequence
  chemically synthesized
ctgacggaattcaaacgaaaac

SEQ ID NO: 1137977 - DNA, 22 bp, Artificial Sequence
  chemically synthesized
gtacctgattgtcagttttcgt

SEQ ID NO: 1137978 - DNA, 22 bp, Artificial Sequence
  chemically synthesized
acggaattcaaacgaaaactga

SEQ ID NO: 1137979 - DNA, 22 bp, Artificial Sequence
  chemically synthesized
ctggtacctgattgtcagtttt

SEQ ID NO: 1137980 - DNA, 22 bp, Artificial Sequence
  chemically synthesized
aaacgaaaactgacaatcaggt

SEQ ID NO: 1137981 - DNA, 22 bp, Artificial Sequence
  chemically synthesized
agtactcctggtacctgattgt

SEQ ID NO: 1137982 - DNA, 22 bp, Artificial Sequence
  chemically synthesized
cagtactcctggtacctgattg

SEQ ID NO: 1137983 - DNA, 22 bp, Artificial Sequence
  chemically synthesized
ttcagtactcctggtacctgat

SEQ ID NO: 1137984 - DNA, 22 bp, Artificial Sequence
  chemically synthesized
cttcagtactcctggtacctga

SEQ ID NO: 1137985 - DNA, 22 bp, Artificial Sequence
  chemically synthesized
tcttcagtactcctggtacctg

SEQ ID NO: 1137986 - DNA, 22 bp, Artificial Sequence
  chemically synthesized
ttcttcagtactcctggtacct

SEQ ID NO: 1137987 - DNA, 22 bp, Artificial Sequence
  chemically synthesized
gcttttcttcagtactcctggt

SEQ ID NO: 1137988 - DNA, 22 bp, Artificial Sequence
  chemically synthesized
acaatcaggtaccaggagtact

SEQ ID NO: 1137989 - DNA, 22 bp, Artificial Sequence
  chemically synthesized
actagcttttcttcagtactcc

SEQ ID NO: 1137990 - DNA, 22 bp, Artificial Sequence
  chemically synthesized
agctcactagcttttcttcagt

SEQ ID NO: 1137991 - DNA, 22 bp, Artificial Sequence
  chemically synthesized
tcagctcactagcttttcttca

SEQ ID NO: 1137992 - DNA, 22 bp, Artificial Sequence
  chemically synthesized
ctcagctcactagcttttcttc

SEQ ID NO: 1137993 - DNA, 22 bp, Artificial Sequence
  chemically synthesized
tctcagctcactagcttttctt

SEQ ID NO: 1137994 - DNA, 22 bp, Artificial Sequence
  chemically synthesized
attttctcagctcactagcttt

SEQ ID NO: 1137995 - DNA, 22 bp, Artificial Sequence
  chemically synthesized
tcattttctcagctcactagct

SEQ ID NO: 1137996 - DNA, 22 bp, Artificial Sequence
  chemically synthesized
aagaaaagctagtgagctgaga

SEQ ID NO: 1137997 - DNA, 22 bp, Artificial Sequence
  chemically synthesized
gccattctcattttctcagctc

SEQ ID NO: 1137998 - DNA, 22 bp, Artificial Sequence
  chemically synthesized
agccattctcattttctcagct

SEQ ID NO: 1137999 - DNA, 22 bp, Artificial Sequence
  chemically synthesized
cttagccattctcattttctca

SEQ ID NO: 1138000 - DNA, 22 bp, Artificial Sequence
  chemically synthesized
ccttagccattctcattttctc

SEQ ID NO: 1138001 - DNA, 22 bp, Artificial Sequence
  chemically synthesized
gtgagctgagaaaatgagaatg

SEQ ID NO: 1138002 - DNA, 22 bp, Artificial Sequence
  chemically synthesized
agaaaatgagaatggctaagga

SEQ ID NO: 1138003 - DNA, 22 bp, Artificial Sequence
  chemically synthesized
agaatggcaagtttccttagcc

SEQ ID NO: 1138004 - DNA, 22 bp, Artificial Sequence
  chemically synthesized
cagaatggcaagtttccttagc

SEQ ID NO: 1138005 - DNA, 22 bp, Artificial Sequence
  chemically synthesized
aggaaacttgccattctgaaat

SEQ ID NO: 1138006 - DNA, 22 bp, Artificial Sequence
  chemically synthesized
tccaaataatcacagcatttca

SEQ ID NO: 1138007 - DNA, 22 bp, Artificial Sequence
  chemically synthesized
atccaaataatcacagcatttc

SEQ ID NO: 1138008 - DNA, 22 bp, Artificial Sequence
  chemically synthesized
tatccaaataatcacagcattt

SEQ ID NO: 1138009 - DNA, 22 bp, Artificial Sequence
  chemically synthesized
gccattctgaaatgctgtgatt

SEQ ID NO: 1138010 - DNA, 22 bp, Artificial Sequence
  chemically synthesized
ccattctgaaatgctgtgatta

SEQ ID NO: 1138011 - DNA, 22 bp, Artificial Sequence
  chemically synthesized
taattttatccaaataatcaca

SEQ ID NO: 1138012 - DNA, 22 bp, Artificial Sequence
  chemically synthesized
tgaaatgctgtgattatttgga

SEQ ID NO: 1138013 - DNA, 22 bp, Artificial Sequence
  chemically synthesized
aaatgctgtgattatttggata

SEQ ID NO: 1138014 - DNA, 22 bp, Artificial Sequence
  chemically synthesized
tgattatttggataaaattaca

SEQ ID NO: 1138015 - DNA, 22 bp, Artificial Sequence
  chemically synthesized
tggaaacaataatattgtaatt

SEQ ID NO: 1138016 - DNA, 22 bp, Artificial Sequence
  chemically synthesized
tttggataaaattacaatatta

SEQ ID NO: 1138017 - DNA, 22 bp, Artificial Sequence
  chemically synthesized
ggataaaattacaatattattg

SEQ ID NO: 1138018 - DNA, 22 bp, Artificial Sequence
  chemically synthesized
aaactgtggaaacaataatatt

SEQ ID NO: 1138019 - DNA, 22 bp, Artificial Sequence
  chemically synthesized
gataaaattacaatattattgt

SEQ ID NO: 1138020 - DNA, 22 bp, Artificial Sequence
  chemically synthesized
caatattattgtttccacagtt

SEQ ID NO: 1138021 - DNA, 22 bp, Artificial Sequence
  chemically synthesized
ttgtttccacagttttaacatt

SEQ ID NO: 1138022 - DNA, 22 bp, Artificial Sequence
  chemically synthesized
caaataatgaaccgaatgttaa

SEQ ID NO: 1138023 - DNA, 22 bp, Artificial Sequence
  chemically synthesized
tttccacagttttaacattcgg

SEQ ID NO: 1138024 - DNA, 22 bp, Artificial Sequence
  chemically synthesized
ccacagttttaacattcggttc

SEQ ID NO: 1138025 - DNA, 22 bp, Artificial Sequence
  chemically synthesized
tctccaaataatgaaccgaatg

SEQ ID NO: 1138026 - DNA, 22 bp, Artificial Sequence
  chemically synthesized
cacagttttaacattcggttca

SEQ ID NO: 1138027 - DNA, 22 bp, Artificial Sequence
  chemically synthesized
atctccaaataatgaaccgaat

SEQ ID NO: 1138028 - DNA, 22 bp, Artificial Sequence
  chemically synthesized
tatctccaaataatgaaccgaa

SEQ ID NO: 1138029 - DNA, 22 bp, Artificial Sequence
  chemically synthesized
taacattcggttcattatttgg

SEQ ID NO: 1138030 - DNA, 22 bp, Artificial Sequence
  chemically synthesized
aacattcggttcattatttgga

SEQ ID NO: 1138031 - DNA, 22 bp, Artificial Sequence
  chemically synthesized
acattcggttcattatttggag

SEQ ID NO: 1138032 - DNA, 22 bp, Artificial Sequence
  chemically synthesized
ggttcattatttggagataaaa

SEQ ID NO: 1138033 - DNA, 22 bp, Artificial Sequence
  chemically synthesized
attatttggagataaaatctca

SEQ ID NO: 1138034 - DNA, 22 bp, Artificial Sequence
  chemically synthesized
tttggagataaaatctcattat

SEQ ID NO: 1138035 - DNA, 22 bp, Artificial Sequence
  chemically synthesized
ggagataaaatctcattatgtg

SEQ ID NO: 1138036 - DNA, 22 bp, Artificial Sequence
  chemically synthesized
tggtcagtaaatcacataatga

SEQ ID NO: 1138037 - DNA, 22 bp, Artificial Sequence
  chemically synthesized
gagataaaatctcattatgtga

SEQ ID NO: 1138038 - DNA, 22 bp, Artificial Sequence
  chemically synthesized
atggtcagtaaatcacataatg

SEQ ID NO: 1138039 - DNA, 22 bp, Artificial Sequence
  chemically synthesized
tatggtcagtaaatcacataat

SEQ ID NO: 1138040 - DNA, 22 bp, Artificial Sequence
  chemically synthesized
caaaaattttatggtcagtaaa

SEQ ID NO: 1138041 - DNA, 22 bp, Artificial Sequence
  chemically synthesized
attatgtgatttactgaccata

SEQ ID NO: 1138042 - DNA, 22 bp, Artificial Sequence
  chemically synthesized
tgtgatttactgaccataaaat

SEQ ID NO: 1138043 - DNA, 22 bp, Artificial Sequence
  chemically synthesized
atggatgctacaaaaattttat

SEQ ID NO: 1138044 - DNA, 22 bp, Artificial Sequence
  chemically synthesized
attaatggatgctacaaaaatt

SEQ ID NO: 1138045 - DNA, 22 bp, Artificial Sequence
  chemically synthesized
actgaccataaaatttttgtag

SEQ ID NO: 1138046 - DNA, 22 bp, Artificial Sequence
  chemically synthesized
ctgaccataaaatttttgtagc

SEQ ID NO: 1138047 - DNA, 22 bp, Artificial Sequence
  chemically synthesized
attgattaatggatgctacaaa

SEQ ID NO: 1138048 - DNA, 22 bp, Artificial Sequence
  chemically synthesized
accataaaatttttgtagcatc

SEQ ID NO: 1138049 - DNA, 22 bp, Artificial Sequence
  chemically synthesized
ttgtagcatccattaatcaatt

SEQ ID NO: 1138050 - DNA, 22 bp, Artificial Sequence
  chemically synthesized
tgtagcatccattaatcaatta

SEQ ID NO: 1138051 - DNA, 22 bp, Artificial Sequence
  chemically synthesized
gtagcatccattaatcaattaa

SEQ ID NO: 1138052 - DNA, 22 bp, Artificial Sequence
  chemically synthesized
tagcatccattaatcaattaac

SEQ ID NO: 1138053 - DNA, 22 bp, Artificial Sequence
  chemically synthesized
aaataaccagatgttaattgat

SEQ ID NO: 1138054 - DNA, 22 bp, Artificial Sequence
  chemically synthesized
ctcaaataaccagatgttaatt

SEQ ID NO: 1138055 - DNA, 22 bp, Artificial Sequence
  chemically synthesized
atcaattaacatctggttattt

SEQ ID NO: 1138056 - DNA, 22 bp, Artificial Sequence
  chemically synthesized
aaaaataattactcaaataacc

SEQ ID NO: 1138057 - DNA, 22 bp, Artificial Sequence
  chemically synthesized
aaaaaataattactcaaataac

SEQ ID NO: 1138058 - DNA, 22 bp, Artificial Sequence
  chemically synthesized
taaaaaataattactcaaataa

SEQ ID NO: 1138059 - DNA, 22 bp, Artificial Sequence
  chemically synthesized
acatctggttatttgagtaatt

SEQ ID NO: 1138060 - DNA, 22 bp, Artificial Sequence
  chemically synthesized
gttttaaaaaataattactcaa

SEQ ID NO: 1138061 - DNA, 22 bp, Artificial Sequence
  chemically synthesized
caattagttttaaaaaataatt

SEQ ID NO: 1138062 - DNA, 22 bp, Artificial Sequence
  chemically synthesized
gttatttgagtaattatttttt

SEQ ID NO: 1138063 - DNA, 22 bp, Artificial Sequence
  chemically synthesized
tacaattagttttaaaaaataa

SEQ ID NO: 1138064 - DNA, 22 bp, Artificial Sequence
  chemically synthesized
tttgagtaattattttttaaaa

SEQ ID NO: 1138065 - DNA, 22 bp, Artificial Sequence
  chemically synthesized
gagtaattattttttaaaacta

SEQ ID NO: 1138066 - DNA, 22 bp, Artificial Sequence
  chemically synthesized
agtaattattttttaaaactaa

SEQ ID NO: 1138067 - DNA, 22 bp, Artificial Sequence
  chemically synthesized
atgggctctacaattagtttta

SEQ ID NO: 1138068 - DNA, 22 bp, Artificial Sequence
  chemically synthesized
aatgggctctacaattagtttt

SEQ ID NO: 1138069 - DNA, 22 bp, Artificial Sequence
  chemically synthesized
cttaatgggctctacaattagt

SEQ ID NO: 1138070 - DNA, 22 bp, Artificial Sequence
  chemically synthesized
acttaatgggctctacaattag

SEQ ID NO: 1138071 - DNA, 22 bp, Artificial Sequence
  chemically synthesized
tacttaatgggctctacaatta

SEQ ID NO: 1138072 - DNA, 22 bp, Artificial Sequence
  chemically synthesized
ttttttaaaactaattgtagag

SEQ ID NO: 1138073 - DNA, 22 bp, Artificial Sequence
  chemically synthesized
ttacttaatgggctctacaatt

SEQ ID NO: 1138074 - DNA, 22 bp, Artificial Sequence
  chemically synthesized
ttttacttaatgggctctacaa

SEQ ID NO: 1138075 - DNA, 22 bp, Artificial Sequence
  chemically synthesized
tttaaaactaattgtagagccc

SEQ ID NO: 1138076 - DNA, 22 bp, Artificial Sequence
  chemically synthesized
ttaaaactaattgtagagccca

SEQ ID NO: 1138077 - DNA, 22 bp, Artificial Sequence
  chemically synthesized
taaaactaattgtagagcccat

SEQ ID NO: 1138078 - DNA, 22 bp, Artificial Sequence
  chemically synthesized
aaaactaattgtagagcccatt

SEQ ID NO: 1138079 - DNA, 22 bp, Artificial Sequence
  chemically synthesized
gttcttttacttaatgggctct

SEQ ID NO: 1138080 - DNA, 22 bp, Artificial Sequence
  chemically synthesized
aaactaattgtagagcccatta

SEQ ID NO: 1138081 - DNA, 22 bp, Artificial Sequence
  chemically synthesized
agttcttttacttaatgggctc

SEQ ID NO: 1138082 - DNA, 22 bp, Artificial Sequence
  chemically synthesized
attgtagagcccattaagtaaa

SEQ ID NO: 1138083 - DNA, 22 bp, Artificial Sequence
  chemically synthesized
tagagcccattaagtaaaagaa

SEQ ID NO: 1138084 - DNA, 22 bp, Artificial Sequence
  chemically synthesized
tgtcatgcccagcgacttagtt

SEQ ID NO: 1138085 - DNA, 22 bp, Artificial Sequence
  chemically synthesized
atgtcatgcccagcgacttagt

SEQ ID NO: 1138086 - DNA, 22 bp, Artificial Sequence
  chemically synthesized
agtaaaagaactaagtcgctgg

SEQ ID NO: 1138087 - DNA, 22 bp, Artificial Sequence
  chemically synthesized
aagcatttatgtcatgcccagc

SEQ ID NO: 1138088 - DNA, 22 bp, Artificial Sequence
  chemically synthesized
agtcgctgggcatgacataaat

SEQ ID NO: 1138089 - DNA, 22 bp, Artificial Sequence
  chemically synthesized
aaaagagatgctgaagcattta

SEQ ID NO: 1138090 - DNA, 22 bp, Artificial Sequence
  chemically synthesized
tgaaaagagatgctgaagcatt

SEQ ID NO: 1138091 - DNA, 22 bp, Artificial Sequence
  chemically synthesized
ggcatgacataaatgcttcagc

SEQ ID NO: 1138092 - DNA, 22 bp, Artificial Sequence
  chemically synthesized
taaactctgaaaagagatgctg

SEQ ID NO: 1138093 - DNA, 22 bp, Artificial Sequence
  chemically synthesized
ataaactctgaaaagagatgct

SEQ ID NO: 1138094 - DNA, 22 bp, Artificial Sequence
  chemically synthesized
cagcatctcttttcagagttta

SEQ ID NO: 1138095 - DNA, 22 bp, Artificial Sequence
  chemically synthesized
agcatctcttttcagagtttat

SEQ ID NO: 1138096 - DNA, 22 bp, Artificial Sequence
  chemically synthesized
ataagacacataagtatttata

SEQ ID NO: 1138097 - DNA, 22 bp, Artificial Sequence
  chemically synthesized
ttttcagagtttataaatactt

SEQ ID NO: 1138098 - DNA, 22 bp, Artificial Sequence
  chemically synthesized
cataagacacataagtatttat

SEQ ID NO: 1138099 - DNA, 22 bp, Artificial Sequence
  chemically synthesized
ttcagagtttataaatacttat

SEQ ID NO: 1138100 - DNA, 22 bp, Artificial Sequence
  chemically synthesized
tcagagtttataaatacttatg

SEQ ID NO: 1138101 - DNA, 22 bp, Artificial Sequence
  chemically synthesized
cttcataagacacataagtatt

SEQ ID NO: 1138102 - DNA, 22 bp, Artificial Sequence
  chemically synthesized
cagagtttataaatacttatgt

SEQ ID NO: 1138103 - DNA, 22 bp, Artificial Sequence
  chemically synthesized
agagtttataaatacttatgtg

SEQ ID NO: 1138104 - DNA, 22 bp, Artificial Sequence
  chemically synthesized
ataaatacttatgtgtcttatg

SEQ ID NO: 1138105 - DNA, 22 bp, Artificial Sequence
  chemically synthesized
taaatacttatgtgtcttatga

SEQ ID NO: 1138106 - DNA, 22 bp, Artificial Sequence
  chemically synthesized
atgtgtcttatgaagcaatttt

SEQ ID NO: 1138107 - DNA, 22 bp, Artificial Sequence
  chemically synthesized
tgtgtcttatgaagcaattttt

SEQ ID NO: 1138108 - DNA, 22 bp, Artificial Sequence
  chemically synthesized
gaaatataaatggtataaaaat

SEQ ID NO: 1138109 - DNA, 22 bp, Artificial Sequence
  chemically synthesized
ggaaatataaatggtataaaaa

SEQ ID NO: 1138110 - DNA, 22 bp, Artificial Sequence
  chemically synthesized
tggaaatataaatggtataaaa

SEQ ID NO: 1138111 - DNA, 22 bp, Artificial Sequence
  chemically synthesized
atgaagcaatttttataccatt

SEQ ID NO: 1138112 - DNA, 22 bp, Artificial Sequence
  chemically synthesized
tgaagcaatttttataccattt

SEQ ID NO: 1138113 - DNA, 22 bp, Artificial Sequence
  chemically synthesized
acaggaactttggaaatataaa

SEQ ID NO: 1138114 - DNA, 22 bp, Artificial Sequence
  chemically synthesized
ttataccatttatatttccaaa

SEQ ID NO: 1138115 - DNA, 22 bp, Artificial Sequence
  chemically synthesized
tataccatttatatttccaaag

SEQ ID NO: 1138116 - DNA, 22 bp, Artificial Sequence
  chemically synthesized
ataccatttatatttccaaagt

SEQ ID NO: 1138117 - DNA, 22 bp, Artificial Sequence
  chemically synthesized
taccatttatatttccaaagtt

SEQ ID NO: 1138118 - DNA, 22 bp, Artificial Sequence
  chemically synthesized
cacagctcacaggaactttgga

SEQ ID NO: 1138119 - DNA, 22 bp, Artificial Sequence
  chemically synthesized
atatttccaaagttcctgtgag

SEQ ID NO: 1138120 - DNA, 22 bp, Artificial Sequence
  chemically synthesized
tatttccaaagttcctgtgagc

SEQ ID NO: 1138121 - DNA, 22 bp, Artificial Sequence
  chemically synthesized
taaccctccacagctcacagga

SEQ ID NO: 1138122 - DNA, 22 bp, Artificial Sequence
  chemically synthesized
gtaaccctccacagctcacagg

SEQ ID NO: 1138123 - DNA, 22 bp, Artificial Sequence
  chemically synthesized
ccaaagttcctgtgagctgtgg

SEQ ID NO: 1138124 - DNA, 22 bp, Artificial Sequence
  chemically synthesized
caaagttcctgtgagctgtgga

SEQ ID NO: 1138125 - DNA, 22 bp, Artificial Sequence
  chemically synthesized
ctgtgagctgtggagggttaca

SEQ ID NO: 1138126 - DNA, 22 bp, Artificial Sequence
  chemically synthesized
tgagctgtggagggttacaaac

SEQ ID NO: 1138127 - DNA, 22 bp, Artificial Sequence
  chemically synthesized
aaatcaaccaaagggagtttgt

SEQ ID NO: 1138128 - DNA, 22 bp, Artificial Sequence
  chemically synthesized
caaatcaaccaaagggagtttg

SEQ ID NO: 1138129 - DNA, 22 bp, Artificial Sequence
  chemically synthesized
tcaaatcaaccaaagggagttt

SEQ ID NO: 1138130 - DNA, 22 bp, Artificial Sequence
  chemically synthesized
tggagggttacaaactcccttt

SEQ ID NO: 1138131 - DNA, 22 bp, Artificial Sequence
  chemically synthesized
ctttcaaatcaaccaaagggag

SEQ ID NO: 1138132 - DNA, 22 bp, Artificial Sequence
  chemically synthesized
ttcctttcaaatcaaccaaagg

SEQ ID NO: 1138133 - DNA, 22 bp, Artificial Sequence
  chemically synthesized
attcctttcaaatcaaccaaag

SEQ ID NO: 1138134 - DNA, 22 bp, Artificial Sequence
  chemically synthesized
caaactccctttggttgatttg

SEQ ID NO: 1138135 - DNA, 22 bp, Artificial Sequence
  chemically synthesized
cctttggttgatttgaaaggaa

SEQ ID NO: 1138136 - DNA, 22 bp, Artificial Sequence
  chemically synthesized
acataaaccacttattcctttc

SEQ ID NO: 1138137 - DNA, 22 bp, Artificial Sequence
  chemically synthesized
cacataaaccacttattccttt

SEQ ID NO: 1138138 - DNA, 22 bp, Artificial Sequence
  chemically synthesized
tggttgatttgaaaggaataag

SEQ ID NO: 1138139 - DNA, 22 bp, Artificial Sequence
  chemically synthesized
ggttgatttgaaaggaataagt

SEQ ID NO: 1138140 - DNA, 22 bp, Artificial Sequence
  chemically synthesized
gttgatttgaaaggaataagtg

SEQ ID NO: 1138141 - DNA, 22 bp, Artificial Sequence
  chemically synthesized
atttcacataaaccacttattc

SEQ ID NO: 1138142 - DNA, 22 bp, Artificial Sequence
  chemically synthesized
atttgaaaggaataagtggttt

SEQ ID NO: 1138143 - DNA, 22 bp, Artificial Sequence
  chemically synthesized
ctgatttcacataaaccactta

SEQ ID NO: 1138144 - DNA, 22 bp, Artificial Sequence
  chemically synthesized
actgatttcacataaaccactt

SEQ ID NO: 1138145 - DNA, 22 bp, Artificial Sequence
  chemically synthesized
gaaaggaataagtggtttatgt

SEQ ID NO: 1138146 - DNA, 22 bp, Artificial Sequence
  chemically synthesized
aaaggaataagtggtttatgtg

SEQ ID NO: 1138147 - DNA, 22 bp, Artificial Sequence
  chemically synthesized
atttactgatttcacataaacc

SEQ ID NO: 1138148 - DNA, 22 bp, Artificial Sequence
  chemically synthesized
ccctgatttactgatttcacat

SEQ ID NO: 1138149 - DNA, 22 bp, Artificial Sequence
  chemically synthesized
atgtgaaatcagtaaatcaggg

SEQ ID NO: 1138150 - DNA, 22 bp, Artificial Sequence
  chemically synthesized
tgtgaaatcagtaaatcagggc

SEQ ID NO: 1138151 - DNA, 22 bp, Artificial Sequence
  chemically synthesized
agtcaagtaaaagaaaaactgc

SEQ ID NO: 1138152 - DNA, 22 bp, Artificial Sequence
  chemically synthesized
ctgagtcaagtaaaagaaaaac

SEQ ID NO: 1138153 - DNA, 22 bp, Artificial Sequence
  chemically synthesized
ttcttttacttgactcagtaac

SEQ ID NO: 1138154 - DNA, 22 bp, Artificial Sequence
  chemically synthesized
tcttttacttgactcagtaact

SEQ ID NO: 1138155 - DNA, 22 bp, Artificial Sequence
  chemically synthesized
tgtatcaggcaaagttactgag

SEQ ID NO: 1138156 - DNA, 22 bp, Artificial Sequence
  chemically synthesized
cttttacttgactcagtaactt

SEQ ID NO: 1138157 - DNA, 22 bp, Artificial Sequence
  chemically synthesized
ttttacttgactcagtaacttt

SEQ ID NO: 1138158 - DNA, 22 bp, Artificial Sequence
  chemically synthesized
ttacttgactcagtaactttgc

SEQ ID NO: 1138159 - DNA, 22 bp, Artificial Sequence
  chemically synthesized
tctgtgtatcaggcaaagttac

SEQ ID NO: 1138160 - DNA, 22 bp, Artificial Sequence
  chemically synthesized
tacttgactcagtaactttgcc

SEQ ID NO: 1138161 - DNA, 22 bp, Artificial Sequence
  chemically synthesized
gtctgtgtatcaggcaaagtta

SEQ ID NO: 1138162 - DNA, 22 bp, Artificial Sequence
  chemically synthesized
acttgactcagtaactttgcct

SEQ ID NO: 1138163 - DNA, 22 bp, Artificial Sequence
  chemically synthesized
cttgactcagtaactttgcctg

SEQ ID NO: 1138164 - DNA, 22 bp, Artificial Sequence
  chemically synthesized
gactcagtaactttgcctgata

SEQ ID NO: 1138165 - DNA, 22 bp, Artificial Sequence
  chemically synthesized
aatttgtctgtgtatcaggcaa

SEQ ID NO: 1138166 - DNA, 22 bp, Artificial Sequence
  chemically synthesized
actcagtaactttgcctgatac

SEQ ID NO: 1138167 - DNA, 22 bp, Artificial Sequence
  chemically synthesized
agtaactttgcctgatacacag

SEQ ID NO: 1138168 - DNA, 22 bp, Artificial Sequence
  chemically synthesized
tgcctgatacacagacaaattc

SEQ ID NO: 1138169 - DNA, 22 bp, Artificial Sequence
  chemically synthesized
gcctgatacacagacaaattca

SEQ ID NO: 1138170 - DNA, 22 bp, Artificial Sequence
  chemically synthesized
cctgatacacagacaaattcaa

SEQ ID NO: 1138171 - DNA, 22 bp, Artificial Sequence
  chemically synthesized
agtacccaggaattgaatttgt

SEQ ID NO: 1138172 - DNA, 22 bp, Artificial Sequence
  chemically synthesized
atacacagacaaattcaattcc

SEQ ID NO: 1138173 - DNA, 22 bp, Artificial Sequence
  chemically synthesized
agtcagggagtaatgttcagta

SEQ ID NO: 1138174 - DNA, 22 bp, Artificial Sequence
  chemically synthesized
aattcctgggtactgaacatta

SEQ ID NO: 1138175 - DNA, 22 bp, Artificial Sequence
  chemically synthesized
ctgggtactgaacattactccc

SEQ ID NO: 1138176 - DNA, 22 bp, Artificial Sequence
  chemically synthesized
cagattaagtcagggagtaatg

SEQ ID NO: 1138177 - DNA, 22 bp, Artificial Sequence
  chemically synthesized
acagattaagtcagggagtaat

SEQ ID NO: 1138178 - DNA, 22 bp, Artificial Sequence
  chemically synthesized
ggtactgaacattactccctga

SEQ ID NO: 1138179 - DNA, 22 bp, Artificial Sequence
  chemically synthesized
tttacagattaagtcagggagt

SEQ ID NO: 1138180 - DNA, 22 bp, Artificial Sequence
  chemically synthesized
gtttacagattaagtcagggag

SEQ ID NO: 1138181 - DNA, 22 bp, Artificial Sequence
  chemically synthesized
tgtttacagattaagtcaggga

SEQ ID NO: 1138182 - DNA, 22 bp, Artificial Sequence
  chemically synthesized
ctttgtttacagattaagtcag

SEQ ID NO: 1138183 - DNA, 22 bp, Artificial Sequence
  chemically synthesized
aacattactccctgacttaatc

SEQ ID NO: 1138184 - DNA, 22 bp, Artificial Sequence
  chemically synthesized
tcctttgtttacagattaagtc

SEQ ID NO: 1138185 - DNA, 22 bp, Artificial Sequence
  chemically synthesized
ctcctttgtttacagattaagt

SEQ ID NO: 1138186 - DNA, 22 bp, Artificial Sequence
  chemically synthesized
ttctcctttgtttacagattaa

SEQ ID NO: 1138187 - DNA, 22 bp, Artificial Sequence
  chemically synthesized
cttctcctttgtttacagatta

SEQ ID NO: 1138188 - DNA, 22 bp, Artificial Sequence
  chemically synthesized
ctccctgacttaatctgtaaac

SEQ ID NO: 1138189 - DNA, 22 bp, Artificial Sequence
  chemically synthesized
cttcttctcctttgtttacaga

SEQ ID NO: 1138190 - DNA, 22 bp, Artificial Sequence
  chemically synthesized
ccttcttctcctttgtttacag

SEQ ID NO: 1138191 - DNA, 22 bp, Artificial Sequence
  chemically synthesized
cctgacttaatctgtaaacaaa

SEQ ID NO: 1138192 - DNA, 22 bp, Artificial Sequence
  chemically synthesized
ttccttcttctcctttgtttac

SEQ ID NO: 1138193 - DNA, 22 bp, Artificial Sequence
  chemically synthesized
tcttccttcttctcctttgttt

SEQ ID NO: 1138194 - DNA, 22 bp, Artificial Sequence
  chemically synthesized
acttaatctgtaaacaaaggag

SEQ ID NO: 1138195 - DNA, 22 bp, Artificial Sequence
  chemically synthesized
ctcttccttcttctcctttgtt

SEQ ID NO: 1138196 - DNA, 22 bp, Artificial Sequence
  chemically synthesized
tttctcttccttcttctccttt

SEQ ID NO: 1138197 - DNA, 22 bp, Artificial Sequence
  chemically synthesized
aatctgtaaacaaaggagaaga

SEQ ID NO: 1138198 - DNA, 22 bp, Artificial Sequence
  chemically synthesized
atttctcttccttcttctcctt

SEQ ID NO: 1138199 - DNA, 22 bp, Artificial Sequence
  chemically synthesized
atctgtaaacaaaggagaagaa

SEQ ID NO: 1138200 - DNA, 22 bp, Artificial Sequence
  chemically synthesized
tatttctcttccttcttctcct

SEQ ID NO: 1138201 - DNA, 22 bp, Artificial Sequence
  chemically synthesized
ctttatttctcttccttcttct

SEQ ID NO: 1138202 - DNA, 22 bp, Artificial Sequence
  chemically synthesized
taaacaaaggagaagaaggaag

SEQ ID NO: 1138203 - DNA, 22 bp, Artificial Sequence
  chemically synthesized
tcctttatttctcttccttctt

SEQ ID NO: 1138204 - DNA, 22 bp, Artificial Sequence
  chemically synthesized
ctcctttatttctcttccttct

SEQ ID NO: 1138205 - DNA, 22 bp, Artificial Sequence
  chemically synthesized
tctcctttatttctcttccttc

SEQ ID NO: 1138206 - DNA, 22 bp, Artificial Sequence
  chemically synthesized
taagataattttctcctttatt

SEQ ID NO: 1138207 - DNA, 22 bp, Artificial Sequence
  chemically synthesized
agtggctgtaagataattttct

SEQ ID NO: 1138208 - DNA, 22 bp, Artificial Sequence
  chemically synthesized
ttaagtggctgtaagataattt

SEQ ID NO: 1138209 - DNA, 22 bp, Artificial Sequence
  chemically synthesized
ccaaatatggggttgttaagtg

SEQ ID NO: 1138210 - DNA, 22 bp, Artificial Sequence
  chemically synthesized
tcttacagccacttaacaaccc

SEQ ID NO: 1138211 - DNA, 22 bp, Artificial Sequence
  chemically synthesized
ctgccaaatatggggttgttaa

SEQ ID NO: 1138212 - DNA, 22 bp, Artificial Sequence
  chemically synthesized
gctgccaaatatggggttgtta

SEQ ID NO: 1138213 - DNA, 22 bp, Artificial Sequence
  chemically synthesized
acagccacttaacaaccccata

SEQ ID NO: 1138214 - DNA, 22 bp, Artificial Sequence
  chemically synthesized
cagccacttaacaaccccatat

SEQ ID NO: 1138215 - DNA, 22 bp, Artificial Sequence
  chemically synthesized
tatttgctgccaaatatggggt

SEQ ID NO: 1138216 - DNA, 22 bp, Artificial Sequence
  chemically synthesized
attgtatttgctgccaaatatg

SEQ ID NO: 1138217 - DNA, 22 bp, Artificial Sequence
  chemically synthesized
aacaaccccatatttggcagca

SEQ ID NO: 1138218 - DNA, 22 bp, Artificial Sequence
  chemically synthesized
acaaccccatatttggcagcaa

SEQ ID NO: 1138219 - DNA, 22 bp, Artificial Sequence
  chemically synthesized
cattcattgtatttgctgccaa

SEQ ID NO: 1138220 - DNA, 22 bp, Artificial Sequence
  chemically synthesized
acattcattgtatttgctgcca

SEQ ID NO: 1138221 - DNA, 22 bp, Artificial Sequence
  chemically synthesized
gtttacattcattgtatttgct

SEQ ID NO: 1138222 - DNA, 22 bp, Artificial Sequence
  chemically synthesized
agtttacattcattgtatttgc

SEQ ID NO: 1138223 - DNA, 22 bp, Artificial Sequence
  chemically synthesized
ggcagcaaatacaatgaatgta

SEQ ID NO: 1138224 - DNA, 22 bp, Artificial Sequence
  chemically synthesized
gcagcaaatacaatgaatgtaa

SEQ ID NO: 1138225 - DNA, 22 bp, Artificial Sequence
  chemically synthesized
ggaaagacaggtatcgcgattt

SEQ ID NO: 1138226 - DNA, 22 bp, Artificial Sequence
  chemically synthesized
cggaaagacaggtatcgcgatt

SEQ ID NO: 1138227 - DNA, 22 bp, Artificial Sequence
  chemically synthesized
tttcggaaagacaggtatcgcg

SEQ ID NO: 1138228 - DNA, 22 bp, Artificial Sequence
  chemically synthesized
gtttcggaaagacaggtatcgc

SEQ ID NO: 1138229 - DNA, 22 bp, Artificial Sequence
  chemically synthesized
catttgtttcggaaagacaggt

SEQ ID NO: 1138230 - DNA, 22 bp, Artificial Sequence
  chemically synthesized
acatttgtttcggaaagacagg

SEQ ID NO: 1138231 - DNA, 22 bp, Artificial Sequence
  chemically synthesized
aatcgcgatacctgtctttccg

SEQ ID NO: 1138232 - DNA, 22 bp, Artificial Sequence
  chemically synthesized
aataaacttacatttgtttcgg

SEQ ID NO: 1138233 - DNA, 22 bp, Artificial Sequence
  chemically synthesized
aaataaacttacatttgtttcg

SEQ ID NO: 1138234 - DNA, 22 bp, Artificial Sequence
  chemically synthesized
ttaaataaacttacatttgttt

SEQ ID NO: 1138235 - DNA, 22 bp, Artificial Sequence
  chemically synthesized
tctttccgaaacaaatgtaagt

SEQ ID NO: 1138236 - DNA, 22 bp, Artificial Sequence
  chemically synthesized
gttcttaaataaacttacattt

SEQ ID NO: 1138237 - DNA, 22 bp, Artificial Sequence
  chemically synthesized
tccgaaacaaatgtaagtttat

SEQ ID NO: 1138238 - DNA, 22 bp, Artificial Sequence
  chemically synthesized
ccgaaacaaatgtaagtttatt

SEQ ID NO: 1138239 - DNA, 22 bp, Artificial Sequence
  chemically synthesized
cgaaacaaatgtaagtttattt

SEQ ID NO: 1138240 - DNA, 22 bp, Artificial Sequence
  chemically synthesized
tggtatgttagttcttaaataa

SEQ ID NO: 1138241 - DNA, 22 bp, Artificial Sequence
  chemically synthesized
tgtggtatgttagttcttaaat

SEQ ID NO: 1138242 - DNA, 22 bp, Artificial Sequence
  chemically synthesized
ctctgtggtatgttagttctta

SEQ ID NO: 1138243 - DNA, 22 bp, Artificial Sequence
  chemically synthesized
gctctgtggtatgttagttctt

SEQ ID NO: 1138244 - DNA, 22 bp, Artificial Sequence
  chemically synthesized
atttaagaactaacataccaca

SEQ ID NO: 1138245 - DNA, 22 bp, Artificial Sequence
  chemically synthesized
tttaagaactaacataccacag

SEQ ID NO: 1138246 - DNA, 22 bp, Artificial Sequence
  chemically synthesized
aagaactaacataccacagagc

SEQ ID NO: 1138247 - DNA, 22 bp, Artificial Sequence
  chemically synthesized
agaactaacataccacagagca

SEQ ID NO: 1138248 - DNA, 22 bp, Artificial Sequence
  chemically synthesized
tgtcatgacaatttgctctgtg

SEQ ID NO: 1138249 - DNA, 22 bp, Artificial Sequence
  chemically synthesized
gtgtcatgacaatttgctctgt

SEQ ID NO: 1138250 - DNA, 22 bp, Artificial Sequence
  chemically synthesized
acataccacagagcaaattgtc

SEQ ID NO: 1138251 - DNA, 22 bp, Artificial Sequence
  chemically synthesized
gtgcatttgtgtcatgacaatt

SEQ ID NO: 1138252 - DNA, 22 bp, Artificial Sequence
  chemically synthesized
atgggcaattggtgcatttgtg

SEQ ID NO: 1138253 - DNA, 22 bp, Artificial Sequence
  chemically synthesized
catgggcaattggtgcatttgt

SEQ ID NO: 1138254 - DNA, 22 bp, Artificial Sequence
  chemically synthesized
cttcatgggcaattggtgcatt

SEQ ID NO: 1138255 - DNA, 22 bp, Artificial Sequence
  chemically synthesized
gcttcatgggcaattggtgcat

SEQ ID NO: 1138256 - DNA, 22 bp, Artificial Sequence
  chemically synthesized
tcatgacacaaatgcaccaatt

SEQ ID NO: 1138257 - DNA, 22 bp, Artificial Sequence
  chemically synthesized
tgcttcatgggcaattggtgca

SEQ ID NO: 1138258 - DNA, 22 bp, Artificial Sequence
  chemically synthesized
gggcactttgcttcatgggcaa

SEQ ID NO: 1138259 - DNA, 22 bp, Artificial Sequence
  chemically synthesized
ggggcactttgcttcatgggca

SEQ ID NO: 1138260 - DNA, 22 bp, Artificial Sequence
  chemically synthesized
ggtttggggcactttgcttcat

SEQ ID NO: 1138261 - DNA, 22 bp, Artificial Sequence
  chemically synthesized
taggtttggggcactttgcttc

SEQ ID NO: 1138262 - DNA, 22 bp, Artificial Sequence
  chemically synthesized
ctctaggtttggggcactttgc

SEQ ID NO: 1138263 - DNA, 22 bp, Artificial Sequence
  chemically synthesized
cccatgaagcaaagtgccccaa

SEQ ID NO: 1138264 - DNA, 22 bp, Artificial Sequence
  chemically synthesized
actgctctaggtttggggcact

SEQ ID NO: 1138265 - DNA, 22 bp, Artificial Sequence
  chemically synthesized
aggaaggtgtattgactgctct

SEQ ID NO: 1138266 - DNA, 22 bp, Artificial Sequence
  chemically synthesized
caggaaggtgtattgactgctc

SEQ ID NO: 1138267 - DNA, 22 bp, Artificial Sequence
  chemically synthesized
tcaggaaggtgtattgactgct

SEQ ID NO: 1138268 - DNA, 22 bp, Artificial Sequence
  chemically synthesized
ttcaggaaggtgtattgactgc

SEQ ID NO: 1138269 - DNA, 22 bp, Artificial Sequence
  chemically synthesized
tccttttcaggaaggtgtattg

SEQ ID NO: 1138270 - DNA, 22 bp, Artificial Sequence
  chemically synthesized
gagcagtcaatacaccttcctg

SEQ ID NO: 1138271 - DNA, 22 bp, Artificial Sequence
  chemically synthesized
gattgtccttttcaggaaggtg

SEQ ID NO: 1138272 - DNA, 22 bp, Artificial Sequence
  chemically synthesized
agattgtccttttcaggaaggt

SEQ ID NO: 1138273 - DNA, 22 bp, Artificial Sequence
  chemically synthesized
cttagattgtccttttcaggaa

SEQ ID NO: 1138274 - DNA, 22 bp, Artificial Sequence
  chemically synthesized
cctgaaaaggacaatctaagta

SEQ ID NO: 1138275 - DNA, 22 bp, Artificial Sequence
  chemically synthesized
ctgaaaaggacaatctaagtag

SEQ ID NO: 1138276 - DNA, 22 bp, Artificial Sequence
  chemically synthesized
aaaaggacaatctaagtagccc

SEQ ID NO: 1138277 - DNA, 22 bp, Artificial Sequence
  chemically synthesized
tcaatgcaggtgccatgccaaa

SEQ ID NO: 1138278 - DNA, 22 bp, Artificial Sequence
  chemically synthesized
agtagcccattttggcatggca

SEQ ID NO: 1138279 - DNA, 22 bp, Artificial Sequence
  chemically synthesized
agagctatcaatgcaggtgcca

SEQ ID NO: 1138280 - DNA, 22 bp, Artificial Sequence
  chemically synthesized
cagttcagagctatcaatgcag

SEQ ID NO: 1138281 - DNA, 22 bp, Artificial Sequence
  chemically synthesized
tggcatggcacctgcattgata

SEQ ID NO: 1138282 - DNA, 22 bp, Artificial Sequence
  chemically synthesized
ggcatggcacctgcattgatag

SEQ ID NO: 1138283 - DNA, 22 bp, Artificial Sequence
  chemically synthesized
tgcagttcagagctatcaatgc

SEQ ID NO: 1138284 - DNA, 22 bp, Artificial Sequence
  chemically synthesized
gcatggcacctgcattgatagc

SEQ ID NO: 1138285 - DNA, 22 bp, Artificial Sequence
  chemically synthesized
gagcattctgcagttcagagct

SEQ ID NO: 1138286 - DNA, 22 bp, Artificial Sequence
  chemically synthesized
cattgatagctctgaactgcag

SEQ ID NO: 1138287 - DNA, 22 bp, Artificial Sequence
  chemically synthesized
atagctctgaactgcagaatgc

SEQ ID NO: 1138288 - DNA, 22 bp, Artificial Sequence
  chemically synthesized
aaggagccactagagcattctg

SEQ ID NO: 1138289 - DNA, 22 bp, Artificial Sequence
  chemically synthesized
attgaaggagccactagagcat

SEQ ID NO: 1138290 - DNA, 22 bp, Artificial Sequence
  chemically synthesized
tgaactgcagaatgctctagtg

SEQ ID NO: 1138291 - DNA, 22 bp, Artificial Sequence
  chemically synthesized
aactgcagaatgctctagtggc

SEQ ID NO: 1138292 - DNA, 22 bp, Artificial Sequence
  chemically synthesized
cagaatgctctagtggctcctt

SEQ ID NO: 1138293 - DNA, 22 bp, Artificial Sequence
  chemically synthesized
agtaaaagacaaactaattgaa

SEQ ID NO: 1138294 - DNA, 22 bp, Artificial Sequence
  chemically synthesized
tagtggctccttcaattagttt

SEQ ID NO: 1138295 - DNA, 22 bp, Artificial Sequence
  chemically synthesized
tgagtaaaagacaaactaattg

SEQ ID NO: 1138296 - DNA, 22 bp, Artificial Sequence
  chemically synthesized
gtggctccttcaattagtttgt

SEQ ID NO: 1138297 - DNA, 22 bp, Artificial Sequence
  chemically synthesized
cttcaattagtttgtcttttac

SEQ ID NO: 1138298 - DNA, 22 bp, Artificial Sequence
  chemically synthesized
caattagtttgtcttttactca

SEQ ID NO: 1138299 - DNA, 22 bp, Artificial Sequence
  chemically synthesized
aattagtttgtcttttactcag

SEQ ID NO: 1138300 - DNA, 22 bp, Artificial Sequence
  chemically synthesized
caggtgaagcagattctgagta

SEQ ID NO: 1138301 - DNA, 22 bp, Artificial Sequence
  chemically synthesized
gtttgtcttttactcagaatct

SEQ ID NO: 1138302 - DNA, 22 bp, Artificial Sequence
  chemically synthesized
gtcttttactcagaatctgctt

SEQ ID NO: 1138303 - DNA, 22 bp, Artificial Sequence
  chemically synthesized
tcttttactcagaatctgcttc

SEQ ID NO: 1138304 - DNA, 22 bp, Artificial Sequence
  chemically synthesized
taacatactccaggtgaagcag

SEQ ID NO: 1138305 - DNA, 22 bp, Artificial Sequence
  chemically synthesized
ttactcagaatctgcttcacct

SEQ ID NO: 1138306 - DNA, 22 bp, Artificial Sequence
  chemically synthesized
tactcagaatctgcttcacctg

SEQ ID NO: 1138307 - DNA, 22 bp, Artificial Sequence
  chemically synthesized
actcagaatctgcttcacctgg

SEQ ID NO: 1138308 - DNA, 22 bp, Artificial Sequence
  chemically synthesized
ctcagaatctgcttcacctgga

SEQ ID NO: 1138309 - DNA, 22 bp, Artificial Sequence
  chemically synthesized
aactataacatactccaggtga

SEQ ID NO: 1138310 - DNA, 22 bp, Artificial Sequence
  chemically synthesized
agaatctgcttcacctggagta

SEQ ID NO: 1138311 - DNA, 22 bp, Artificial Sequence
  chemically synthesized
cttcacctggagtatgttatag

SEQ ID NO: 1138312 - DNA, 22 bp, Artificial Sequence
  chemically synthesized
cacctggagtatgttatagttc

SEQ ID NO: 1138313 - DNA, 22 bp, Artificial Sequence
  chemically synthesized
acctggagtatgttatagttca

SEQ ID NO: 1138314 - DNA, 22 bp, Artificial Sequence
  chemically synthesized
aaaatggcatgaagactgaact

SEQ ID NO: 1138315 - DNA, 22 bp, Artificial Sequence
  chemically synthesized
gagtatgttatagttcagtctt

SEQ ID NO: 1138316 - DNA, 22 bp, Artificial Sequence
  chemically synthesized
aaaaatggcatgaagactgaac

SEQ ID NO: 1138317 - DNA, 22 bp, Artificial Sequence
  chemically synthesized
cccttaaaaatggcatgaagac

SEQ ID NO: 1138318 - DNA, 22 bp, Artificial Sequence
  chemically synthesized
ccccttaaaaatggcatgaaga

SEQ ID NO: 1138319 - DNA, 22 bp, Artificial Sequence
  chemically synthesized
tttccccttaaaaatggcatga

SEQ ID NO: 1138320 - DNA, 22 bp, Artificial Sequence
  chemically synthesized
tagttcagtcttcatgccattt

SEQ ID NO: 1138321 - DNA, 22 bp, Artificial Sequence
  chemically synthesized
gtttccccttaaaaatggcatg

SEQ ID NO: 1138322 - DNA, 22 bp, Artificial Sequence
  chemically synthesized
tgtttccccttaaaaatggcat

SEQ ID NO: 1138323 - DNA, 22 bp, Artificial Sequence
  chemically synthesized
ctttgtttccccttaaaaatgg

SEQ ID NO: 1138324 - DNA, 22 bp, Artificial Sequence
  chemically synthesized
gctttgtttccccttaaaaatg

SEQ ID NO: 1138325 - DNA, 22 bp, Artificial Sequence
  chemically synthesized
agtcttcatgccatttttaagg

SEQ ID NO: 1138326 - DNA, 22 bp, Artificial Sequence
  chemically synthesized
aatcttgctttgtttcccctta

SEQ ID NO: 1138327 - DNA, 22 bp, Artificial Sequence
  chemically synthesized
catgccatttttaaggggaaac

SEQ ID NO: 1138328 - DNA, 22 bp, Artificial Sequence
  chemically synthesized
aaatcttgctttgtttcccctt

SEQ ID NO: 1138329 - DNA, 22 bp, Artificial Sequence
  chemically synthesized
atgccatttttaaggggaaaca

SEQ ID NO: 1138330 - DNA, 22 bp, Artificial Sequence
  chemically synthesized
ttaaggggaaacaaagcaagat

SEQ ID NO: 1138331 - DNA, 22 bp, Artificial Sequence
  chemically synthesized
taaggggaaacaaagcaagatt

SEQ ID NO: 1138332 - DNA, 22 bp, Artificial Sequence
  chemically synthesized
aaggggaaacaaagcaagattt

SEQ ID NO: 1138333 - DNA, 22 bp, Artificial Sequence
  chemically synthesized
gagatgaaacttaaatcttgct

SEQ ID NO: 1138334 - DNA, 22 bp, Artificial Sequence
  chemically synthesized
aggggaaacaaagcaagattta

SEQ ID NO: 1138335 - DNA, 22 bp, Artificial Sequence
  chemically synthesized
aggaaaaattagagatgaaact

SEQ ID NO: 1138336 - DNA, 22 bp, Artificial Sequence
  chemically synthesized
ttaaggaaaaattagagatgaa

SEQ ID NO: 1138337 - DNA, 22 bp, Artificial Sequence
  chemically synthesized
ttgttaaggaaaaattagagat

SEQ ID NO: 1138338 - DNA, 22 bp, Artificial Sequence
  chemically synthesized
attgttaaggaaaaattagaga

SEQ ID NO: 1138339 - DNA, 22 bp, Artificial Sequence
  chemically synthesized
aagtttcatctctaatttttcc

SEQ ID NO: 1138340 - DNA, 22 bp, Artificial Sequence
  chemically synthesized
agtttcatctctaatttttcct

SEQ ID NO: 1138341 - DNA, 22 bp, Artificial Sequence
  chemically synthesized
aacttattgttaaggaaaaatt

SEQ ID NO: 1138342 - DNA, 22 bp, Artificial Sequence
  chemically synthesized
catctctaatttttccttaaca

SEQ ID NO: 1138343 - DNA, 22 bp, Artificial Sequence
  chemically synthesized
atctctaatttttccttaacaa

SEQ ID NO: 1138344 - DNA, 22 bp, Artificial Sequence
  chemically synthesized
taatttttccttaacaataagt

SEQ ID NO: 1138345 - DNA, 22 bp, Artificial Sequence
  chemically synthesized
gaaaaatactgaacttattgtt

SEQ ID NO: 1138346 - DNA, 22 bp, Artificial Sequence
  chemically synthesized
agaaaaatactgaacttattgt

SEQ ID NO: 1138347 - DNA, 22 bp, Artificial Sequence
  chemically synthesized
atttttccttaacaataagttc

SEQ ID NO: 1138348 - DNA, 22 bp, Artificial Sequence
  chemically synthesized
ttccttaacaataagttcagta

SEQ ID NO: 1138349 - DNA, 22 bp, Artificial Sequence
  chemically synthesized
tccttaacaataagttcagtat

SEQ ID NO: 1138350 - DNA, 22 bp, Artificial Sequence
  chemically synthesized
aaacttagaaaaatactgaact

SEQ ID NO: 1138351 - DNA, 22 bp, Artificial Sequence
  chemically synthesized
ccttaacaataagttcagtatt

SEQ ID NO: 1138352 - DNA, 22 bp, Artificial Sequence
  chemically synthesized
caaacttagaaaaatactgaac

SEQ ID NO: 1138353 - DNA, 22 bp, Artificial Sequence
  chemically synthesized
cttaacaataagttcagtattt

SEQ ID NO: 1138354 - DNA, 22 bp, Artificial Sequence
  chemically synthesized
tcaaacttagaaaaatactgaa

SEQ ID NO: 1138355 - DNA, 22 bp, Artificial Sequence
  chemically synthesized
tttcaaacttagaaaaatactg

SEQ ID NO: 1138356 - DNA, 22 bp, Artificial Sequence
  chemically synthesized
aacaataagttcagtatttttc

SEQ ID NO: 1138357 - DNA, 22 bp, Artificial Sequence
  chemically synthesized
acaataagttcagtatttttct

SEQ ID NO: 1138358 - DNA, 22 bp, Artificial Sequence
  chemically synthesized
cattctttcaaacttagaaaaa

SEQ ID NO: 1138359 - DNA, 22 bp, Artificial Sequence
  chemically synthesized
ttgcattctttcaaacttagaa

SEQ ID NO: 1138360 - DNA, 22 bp, Artificial Sequence
  chemically synthesized
agtatttttctaagtttgaaag

SEQ ID NO: 1138361 - DNA, 22 bp, Artificial Sequence
  chemically synthesized
gtctattgcattctttcaaact

SEQ ID NO: 1138362 - DNA, 22 bp, Artificial Sequence
  chemically synthesized
ggtctattgcattctttcaaac

SEQ ID NO: 1138363 - DNA, 22 bp, Artificial Sequence
  chemically synthesized
tggtctattgcattctttcaaa

SEQ ID NO: 1138364 - DNA, 22 bp, Artificial Sequence
  chemically synthesized
ttctaagtttgaaagaatgcaa

SEQ ID NO: 1138365 - DNA, 22 bp, Artificial Sequence
  chemically synthesized
tattttggtctattgcattctt

SEQ ID NO: 1138366 - DNA, 22 bp, Artificial Sequence
  chemically synthesized
tctaagtttgaaagaatgcaat

SEQ ID NO: 1138367 - DNA, 22 bp, Artificial Sequence
  chemically synthesized
gtattttggtctattgcattct

SEQ ID NO: 1138368 - DNA, 22 bp, Artificial Sequence
  chemically synthesized
ctaagtttgaaagaatgcaata

SEQ ID NO: 1138369 - DNA, 22 bp, Artificial Sequence
  chemically synthesized
taagtttgaaagaatgcaatag

SEQ ID NO: 1138370 - DNA, 22 bp, Artificial Sequence
  chemically synthesized
agtttgaaagaatgcaatagac

SEQ ID NO: 1138371 - DNA, 22 bp, Artificial Sequence
  chemically synthesized
atttgtattttggtctattgca

SEQ ID NO: 1138372 - DNA, 22 bp, Artificial Sequence
  chemically synthesized
aatttgtattttggtctattgc

SEQ ID NO: 1138373 - DNA, 22 bp, Artificial Sequence
  chemically synthesized
gaaagaatgcaatagaccaaaa

SEQ ID NO: 1138374 - DNA, 22 bp, Artificial Sequence
  chemically synthesized
aaagaatgcaatagaccaaaat

SEQ ID NO: 1138375 - DNA, 22 bp, Artificial Sequence
  chemically synthesized
agtgtataatatcttaatttgt

SEQ ID NO: 1138376 - DNA, 22 bp, Artificial Sequence
  chemically synthesized
aattcagtgtataatatcttaa

SEQ ID NO: 1138377 - DNA, 22 bp, Artificial Sequence
  chemically synthesized
gaattcagtgtataatatctta

SEQ ID NO: 1138378 - DNA, 22 bp, Artificial Sequence
  chemically synthesized
atttgaattcagtgtataatat

SEQ ID NO: 1138379 - DNA, 22 bp, Artificial Sequence
  chemically synthesized
gatttgaattcagtgtataata

SEQ ID NO: 1138380 - DNA, 22 bp, Artificial Sequence
  chemically synthesized
tgatttgaattcagtgtataat

SEQ ID NO: 1138381 - DNA, 22 bp, Artificial Sequence
  chemically synthesized
ttttgatttgaattcagtgtat

SEQ ID NO: 1138382 - DNA, 22 bp, Artificial Sequence
  chemically synthesized
attttgatttgaattcagtgta

SEQ ID NO: 1138383 - DNA, 22 bp, Artificial Sequence
  chemically synthesized
tattttgatttgaattcagtgt

SEQ ID NO: 1138384 - DNA, 22 bp, Artificial Sequence
  chemically synthesized
agatattatacactgaattcaa

SEQ ID NO: 1138385 - DNA, 22 bp, Artificial Sequence
  chemically synthesized
tacactgaattcaaatcaaaat

SEQ ID NO: 1138386 - DNA, 22 bp, Artificial Sequence
  chemically synthesized
aattcaaatcaaaataaaactc

SEQ ID NO: 1138387 - DNA, 22 bp, Artificial Sequence
  chemically synthesized
aacccccacaccgtgagtttta

SEQ ID NO: 1138388 - DNA, 22 bp, Artificial Sequence
  chemically synthesized
aaatcaaaataaaactcacggt

SEQ ID NO: 1138389 - DNA, 22 bp, Artificial Sequence
  chemically synthesized
ctaaacccccacaccgtgagtt

SEQ ID NO: 1138390 - DNA, 22 bp, Artificial Sequence
  chemically synthesized
ttgctaaacccccacaccgtga

SEQ ID NO: 1138391 - DNA, 22 bp, Artificial Sequence
  chemically synthesized
cctattgctaaacccccacacc

SEQ ID NO: 1138392 - DNA, 22 bp, Artificial Sequence
  chemically synthesized
acggtgtgggggtttagcaata

SEQ ID NO: 1138393 - DNA, 22 bp, Artificial Sequence
  chemically synthesized
aaaacaaaaaagaaaaaccacc

SEQ ID NO: 1138394 - DNA, 22 bp, Artificial Sequence
  chemically synthesized
agcaataggtaggtggtttttc

SEQ ID NO: 1138395 - DNA, 22 bp, Artificial Sequence
  chemically synthesized
gcaataggtaggtggtttttct

SEQ ID NO: 1138396 - DNA, 22 bp, Artificial Sequence
  chemically synthesized
caactcaaaacaaaaaagaaaa

SEQ ID NO: 1138397 - DNA, 22 bp, Artificial Sequence
  chemically synthesized
gactccaactcaaaacaaaaaa

SEQ ID NO: 1138398 - DNA, 22 bp, Artificial Sequence
  chemically synthesized
ttcttttttgttttgagttgga

SEQ ID NO: 1138399 - DNA, 22 bp, Artificial Sequence
  chemically synthesized
tcttttttgttttgagttggag

SEQ ID NO: 1138400 - DNA, 22 bp, Artificial Sequence
  chemically synthesized
cttttttgttttgagttggagt

SEQ ID NO: 1138401 - DNA, 22 bp, Artificial Sequence
  chemically synthesized
ttttttgttttgagttggagtc

SEQ ID NO: 1138402 - DNA, 22 bp, Artificial Sequence
  chemically synthesized
ggcgacagagttagactccaac

SEQ ID NO: 1138403 - DNA, 22 bp, Artificial Sequence
  chemically synthesized
ttttgttttgagttggagtcta

SEQ ID NO: 1138404 - DNA, 22 bp, Artificial Sequence
  chemically synthesized
tttgttttgagttggagtctaa

SEQ ID NO: 1138405 - DNA, 22 bp, Artificial Sequence
  chemically synthesized
ttgttttgagttggagtctaac

SEQ ID NO: 1138406 - DNA, 22 bp, Artificial Sequence
  chemically synthesized
tgttttgagttggagtctaact

SEQ ID NO: 1138407 - DNA, 22 bp, Artificial Sequence
  chemically synthesized
gttttgagttggagtctaactc

SEQ ID NO: 1138408 - DNA, 22 bp, Artificial Sequence
  chemically synthesized
ttttgagttggagtctaactct

SEQ ID NO: 1138409 - DNA, 22 bp, Artificial Sequence
  chemically synthesized
cagcctgggcgacagagttaga

SEQ ID NO: 1138410 - DNA, 22 bp, Artificial Sequence
  chemically synthesized
tgagttggagtctaactctgtc

SEQ ID NO: 1138411 - DNA, 22 bp, Artificial Sequence
  chemically synthesized
gagttggagtctaactctgtcg

SEQ ID NO: 1138412 - DNA, 22 bp, Artificial Sequence
  chemically synthesized
agttggagtctaactctgtcgc

SEQ ID NO: 1138413 - DNA, 22 bp, Artificial Sequence
  chemically synthesized
cactccagcctgggcgacagag

SEQ ID NO: 1138414 - DNA, 22 bp, Artificial Sequence
  chemically synthesized
gagtctaactctgtcgcccagg

SEQ ID NO: 1138415 - DNA, 22 bp, Artificial Sequence
  chemically synthesized
actctgtcgcccaggctggagt

SEQ ID NO: 1138416 - DNA, 22 bp, Artificial Sequence
  chemically synthesized
tgtcgcccaggctggagtgcag

SEQ ID NO: 1138417 - DNA, 22 bp, Artificial Sequence
  chemically synthesized
tcgcccaggctggagtgcagtg

SEQ ID NO: 1138418 - DNA, 22 bp, Artificial Sequence
  chemically synthesized
cagtgagcagagatcatgccac

SEQ ID NO: 1138419 - DNA, 22 bp, Artificial Sequence
  chemically synthesized
gagtgcagtggcatgatctctg

SEQ ID NO: 1138420 - DNA, 22 bp, Artificial Sequence
  chemically synthesized
ggagacagaggctgcagtgagc

SEQ ID NO: 1138421 - DNA, 22 bp, Artificial Sequence
  chemically synthesized
aacctgggagacagaggctgca

SEQ ID NO: 1138422 - DNA, 22 bp, Artificial Sequence
  chemically synthesized
gaacctgggagacagaggctgc

SEQ ID NO: 1138423 - DNA, 22 bp, Artificial Sequence
  chemically synthesized
cttgaacctgggagacagaggc

SEQ ID NO: 1138424 - DNA, 22 bp, Artificial Sequence
  chemically synthesized
tgctcactgcagcctctgtctc

SEQ ID NO: 1138425 - DNA, 22 bp, Artificial Sequence
  chemically synthesized
ctcactgcagcctctgtctccc

SEQ ID NO: 1138426 - DNA, 22 bp, Artificial Sequence
  chemically synthesized
actgcagcctctgtctcccagg

SEQ ID NO: 1138427 - DNA, 22 bp, Artificial Sequence
  chemically synthesized
cagcctctgtctcccaggttca

SEQ ID NO: 1138428 - DNA, 22 bp, Artificial Sequence
  chemically synthesized
acaggagaattgcttgaacctg

SEQ ID NO: 1138429 - DNA, 22 bp, Artificial Sequence
  chemically synthesized
tgtctcccaggttcaagcaatt

SEQ ID NO: 1138430 - DNA, 22 bp, Artificial Sequence
  chemically synthesized
tctcccaggttcaagcaattct

SEQ ID NO: 1138431 - DNA, 22 bp, Artificial Sequence
  chemically synthesized
gtgaggctgacaggagaattgc

SEQ ID NO: 1138432 - DNA, 22 bp, Artificial Sequence
  chemically synthesized
ccaggttcaagcaattctcctg

SEQ ID NO: 1138433 - DNA, 22 bp, Artificial Sequence
  chemically synthesized
ctcgtgaggctgacaggagaat

SEQ ID NO: 1138434 - DNA, 22 bp, Artificial Sequence
  chemically synthesized
aagcaattctcctgtcagcctc

SEQ ID NO: 1138435 - DNA, 22 bp, Artificial Sequence
  chemically synthesized
taataccagctactcgtgaggc

SEQ ID NO: 1138436 - DNA, 22 bp, Artificial Sequence
  chemically synthesized
tcctgtcagcctcacgagtagc

SEQ ID NO: 1138437 - DNA, 22 bp, Artificial Sequence
  chemically synthesized
ctgtcagcctcacgagtagctg

SEQ ID NO: 1138438 - DNA, 22 bp, Artificial Sequence
  chemically synthesized
tcagcctcacgagtagctggta

SEQ ID NO: 1138439 - DNA, 22 bp, Artificial Sequence
  chemically synthesized
gtggcatgtgcctataatacca

SEQ ID NO: 1138440 - DNA, 22 bp, Artificial Sequence
  chemically synthesized
agtggcatgtgcctataatacc

SEQ ID NO: 1138441 - DNA, 22 bp, Artificial Sequence
  chemically synthesized
acgagtagctggtattataggc

SEQ ID NO: 1138442 - DNA, 22 bp, Artificial Sequence
  chemically synthesized
ggcttagtggcatgtgcctata

SEQ ID NO: 1138443 - DNA, 22 bp, Artificial Sequence
  chemically synthesized
gctgggcttagtggcatgtgcc

SEQ ID NO: 1138444 - DNA, 22 bp, Artificial Sequence
  chemically synthesized
gtattataggcacatgccacta

SEQ ID NO: 1138445 - DNA, 22 bp, Artificial Sequence
  chemically synthesized
aaaattagctgggcttagtggc

SEQ ID NO: 1138446 - DNA, 22 bp, Artificial Sequence
  chemically synthesized
aaaaattagctgggcttagtgg

SEQ ID NO: 1138447 - DNA, 22 bp, Artificial Sequence
  chemically synthesized
taggcacatgccactaagccca

SEQ ID NO: 1138448 - DNA, 22 bp, Artificial Sequence
  chemically synthesized
aaaatttaaaaattagctgggc

SEQ ID NO: 1138449 - DNA, 22 bp, Artificial Sequence
  chemically synthesized
taaaaatttaaaaattagctgg

SEQ ID NO: 1138450 - DNA, 22 bp, Artificial Sequence
  chemically synthesized
ctaaaaatttaaaaattagctg

SEQ ID NO: 1138451 - DNA, 22 bp, Artificial Sequence
  chemically synthesized
ttctaaaaatttaaaaattagc

SEQ ID NO: 1138452 - DNA, 22 bp, Artificial Sequence
  chemically synthesized
tctcttctaaaaatttaaaaat

SEQ ID NO: 1138453 - DNA, 22 bp, Artificial Sequence
  chemically synthesized
agcccagctaatttttaaattt

SEQ ID NO: 1138454 - DNA, 22 bp, Artificial Sequence
  chemically synthesized
ctgtctcttctaaaaatttaaa

SEQ ID NO: 1138455 - DNA, 22 bp, Artificial Sequence
  chemically synthesized
agactcctgtctcttctaaaaa

SEQ ID NO: 1138456 - DNA, 22 bp, Artificial Sequence
  chemically synthesized
atttttaaatttttagaagaga

SEQ ID NO: 1138457 - DNA, 22 bp, Artificial Sequence
  chemically synthesized
ttaaatttttagaagagacagg

SEQ ID NO: 1138458 - DNA, 22 bp, Artificial Sequence
  chemically synthesized
taaatttttagaagagacagga

SEQ ID NO: 1138459 - DNA, 22 bp, Artificial Sequence
  chemically synthesized
aaatttttagaagagacaggag

SEQ ID NO: 1138460 - DNA, 22 bp, Artificial Sequence
  chemically synthesized
aatttttagaagagacaggagt

SEQ ID NO: 1138461 - DNA, 22 bp, Artificial Sequence
  chemically synthesized
ttagaagagacaggagtctcaa

SEQ ID NO: 1138462 - DNA, 22 bp, Artificial Sequence
  chemically synthesized
tagaagagacaggagtctcaac

SEQ ID NO: 1138463 - DNA, 22 bp, Artificial Sequence
  chemically synthesized
agaagagacaggagtctcaaca

SEQ ID NO: 1138464 - DNA, 22 bp, Artificial Sequence
  chemically synthesized
gaagagacaggagtctcaacat

SEQ ID NO: 1138465 - DNA, 22 bp, Artificial Sequence
  chemically synthesized
agaccagccaggccaacatgtt

SEQ ID NO: 1138466 - DNA, 22 bp, Artificial Sequence
  chemically synthesized
aacatgttggcctggctggtct

SEQ ID NO: 1138467 - DNA, 22 bp, Artificial Sequence
  chemically synthesized
aggtcaggagattgagaccagc

SEQ ID NO: 1138468 - DNA, 22 bp, Artificial Sequence
  chemically synthesized
gaggtcaggagattgagaccag

SEQ ID NO: 1138469 - DNA, 22 bp, Artificial Sequence
  chemically synthesized
gcctggctggtctcaatctcct

SEQ ID NO: 1138470 - DNA, 22 bp, Artificial Sequence
  chemically synthesized
gctggtctcaatctcctgacct

SEQ ID NO: 1138471 - DNA, 22 bp, Artificial Sequence
  chemically synthesized
gtctcaatctcctgacctcaag

SEQ ID NO: 1138472 - DNA, 22 bp, Artificial Sequence
  chemically synthesized
aatctcctgacctcaagtgatc

SEQ ID NO: 1138473 - DNA, 22 bp, Artificial Sequence
  chemically synthesized
ggaggccaaggcgggtggatca

SEQ ID NO: 1138474 - DNA, 22 bp, Artificial Sequence
  chemically synthesized
ctgacctcaagtgatccacccg

SEQ ID NO: 1138475 - DNA, 22 bp, Artificial Sequence
  chemically synthesized
gggaggccaaggcgggtggatc

SEQ ID NO: 1138476 - DNA, 22 bp, Artificial Sequence
  chemically synthesized
tgggaggccaaggcgggtggat

SEQ ID NO: 1138477 - DNA, 22 bp, Artificial Sequence
  chemically synthesized
acctcaagtgatccacccgcct

SEQ ID NO: 1138478 - DNA, 22 bp, Artificial Sequence
  chemically synthesized
aagtgatccacccgccttggcc

SEQ ID NO: 1138479 - DNA, 22 bp, Artificial Sequence
  chemically synthesized
taatcccagcactttgggaggc

SEQ ID NO: 1138480 - DNA, 22 bp, Artificial Sequence
  chemically synthesized
atgcctgtaatcccagcacttt

SEQ ID NO: 1138481 - DNA, 22 bp, Artificial Sequence
  chemically synthesized
ggcctcccaaagtgctgggatt

SEQ ID NO: 1138482 - DNA, 22 bp, Artificial Sequence
  chemically synthesized
gcctcccaaagtgctgggatta

SEQ ID NO: 1138483 - DNA, 22 bp, Artificial Sequence
  chemically synthesized
ccaaagtgctgggattacaggc

SEQ ID NO: 1138484 - DNA, 22 bp, Artificial Sequence
  chemically synthesized
ggtatggtggctcatgcctgta

SEQ ID NO: 1138485 - DNA, 22 bp, Artificial Sequence
  chemically synthesized
ggctgggtatggtggctcatgc

SEQ ID NO: 1138486 - DNA, 22 bp, Artificial Sequence
  chemically synthesized
ggattacaggcatgagccacca

SEQ ID NO: 1138487 - DNA, 22 bp, Artificial Sequence
  chemically synthesized
ttgggctgggtatggtggctca

SEQ ID NO: 1138488 - DNA, 22 bp, Artificial Sequence
  chemically synthesized
tctattgggctgggtatggtgg

SEQ ID NO: 1138489 - DNA, 22 bp, Artificial Sequence
  chemically synthesized
caggcatgagccaccataccca

SEQ ID NO: 1138490 - DNA, 22 bp, Artificial Sequence
  chemically synthesized
aacaaaatgaatatgcaaaacc

SEQ ID NO: 1138491 - DNA, 22 bp, Artificial Sequence
  chemically synthesized
acaagtgaattaaacaaaatga

SEQ ID NO: 1138492 - DNA, 22 bp, Artificial Sequence
  chemically synthesized
tgcatattcattttgtttaatt

SEQ ID NO: 1138493 - DNA, 22 bp, Artificial Sequence
  chemically synthesized
gcatattcattttgtttaattc

SEQ ID NO: 1138494 - DNA, 22 bp, Artificial Sequence
  chemically synthesized
catattcattttgtttaattca

SEQ ID NO: 1138495 - DNA, 22 bp, Artificial Sequence
  chemically synthesized
atggaaaactaacaagtgaatt

SEQ ID NO: 1138496 - DNA, 22 bp, Artificial Sequence
  chemically synthesized
aatggaaaactaacaagtgaat

SEQ ID NO: 1138497 - DNA, 22 bp, Artificial Sequence
  chemically synthesized
attttgtttaattcacttgtta

SEQ ID NO: 1138498 - DNA, 22 bp, Artificial Sequence
  chemically synthesized
aatttaatggaaaactaacaag

SEQ ID NO: 1138499 - DNA, 22 bp, Artificial Sequence
  chemically synthesized
tgtttaattcacttgttagttt

SEQ ID NO: 1138500 - DNA, 22 bp, Artificial Sequence
  chemically synthesized
aaatttaatggaaaactaacaa

SEQ ID NO: 1138501 - DNA, 22 bp, Artificial Sequence
  chemically synthesized
gtttaattcacttgttagtttt

SEQ ID NO: 1138502 - DNA, 22 bp, Artificial Sequence
  chemically synthesized
tttaattcacttgttagttttc

SEQ ID NO: 1138503 - DNA, 22 bp, Artificial Sequence
  chemically synthesized
acttaaatttaatggaaaacta

SEQ ID NO: 1138504 - DNA, 22 bp, Artificial Sequence
  chemically synthesized
aattcacttgttagttttccat

SEQ ID NO: 1138505 - DNA, 22 bp, Artificial Sequence
  chemically synthesized
attcacttgttagttttccatt

SEQ ID NO: 1138506 - DNA, 22 bp, Artificial Sequence
  chemically synthesized
acttgttagttttccattaaat

SEQ ID NO: 1138507 - DNA, 22 bp, Artificial Sequence
  chemically synthesized
gttagttttccattaaatttaa

SEQ ID NO: 1138508 - DNA, 22 bp, Artificial Sequence
  chemically synthesized
ttagttttccattaaatttaag

SEQ ID NO: 1138509 - DNA, 22 bp, Artificial Sequence
  chemically synthesized
atgcaaatattcacttaaattt

SEQ ID NO: 1138510 - DNA, 22 bp, Artificial Sequence
  chemically synthesized
gttttccattaaatttaagtga

SEQ ID NO: 1138511 - DNA, 22 bp, Artificial Sequence
  chemically synthesized
tccattaaatttaagtgaatat

SEQ ID NO: 1138512 - DNA, 22 bp, Artificial Sequence
  chemically synthesized
gtactaatgcaaatattcactt

SEQ ID NO: 1138513 - DNA, 22 bp, Artificial Sequence
  chemically synthesized
ccattaaatttaagtgaatatt

SEQ ID NO: 1138514 - DNA, 22 bp, Artificial Sequence
  chemically synthesized
cattaaatttaagtgaatattt

SEQ ID NO: 1138515 - DNA, 22 bp, Artificial Sequence
  chemically synthesized
tagtactaatgcaaatattcac

SEQ ID NO: 1138516 - DNA, 22 bp, Artificial Sequence
  chemically synthesized
ttctagtactaatgcaaatatt

SEQ ID NO: 1138517 - DNA, 22 bp, Artificial Sequence
  chemically synthesized
gttctagtactaatgcaaatat

SEQ ID NO: 1138518 - DNA, 22 bp, Artificial Sequence
  chemically synthesized
aatttaagtgaatatttgcatt

SEQ ID NO: 1138519 - DNA, 22 bp, Artificial Sequence
  chemically synthesized
tgttctagtactaatgcaaata

SEQ ID NO: 1138520 - DNA, 22 bp, Artificial Sequence
  chemically synthesized
aagtgaatatttgcattagtac

SEQ ID NO: 1138521 - DNA, 22 bp, Artificial Sequence
  chemically synthesized
agtgaatatttgcattagtact

SEQ ID NO: 1138522 - DNA, 22 bp, Artificial Sequence
  chemically synthesized
gcattagtactagaacaaaggt

SEQ ID NO: 1138523 - DNA, 22 bp, Artificial Sequence
  chemically synthesized
cattagtactagaacaaaggtt

SEQ ID NO: 1138524 - DNA, 22 bp, Artificial Sequence
  chemically synthesized
ggacaggtagcatcaacctttg

SEQ ID NO: 1138525 - DNA, 22 bp, Artificial Sequence
  chemically synthesized
gggacaggtagcatcaaccttt

SEQ ID NO: 1138526 - DNA, 22 bp, Artificial Sequence
  chemically synthesized
gtactagaacaaaggttgatgc

SEQ ID NO: 1138527 - DNA, 22 bp, Artificial Sequence
  chemically synthesized
agcttgggacaggtagcatcaa

SEQ ID NO: 1138528 - DNA, 22 bp, Artificial Sequence
  chemically synthesized
tcagcttgggacaggtagcatc

SEQ ID NO: 1138529 - DNA, 22 bp, Artificial Sequence
  chemically synthesized
gaacaaaggttgatgctacctg

SEQ ID NO: 1138530 - DNA, 22 bp, Artificial Sequence
  chemically synthesized
aaatatggctctcagcttggga

SEQ ID NO: 1138531 - DNA, 22 bp, Artificial Sequence
  chemically synthesized
atgctacctgtcccaagctgag

SEQ ID NO: 1138532 - DNA, 22 bp, Artificial Sequence
  chemically synthesized
aaattcaaatatggctctcagc

SEQ ID NO: 1138533 - DNA, 22 bp, Artificial Sequence
  chemically synthesized
cctgtcccaagctgagagccat

SEQ ID NO: 1138534 - DNA, 22 bp, Artificial Sequence
  chemically synthesized
tcccaagctgagagccatattt

SEQ ID NO: 1138535 - DNA, 22 bp, Artificial Sequence
  chemically synthesized
gaggaatatacattgaaattca

SEQ ID NO: 1138536 - DNA, 22 bp, Artificial Sequence
  chemically synthesized
agagccatatttgaatttcaat

SEQ ID NO: 1138537 - DNA, 22 bp, Artificial Sequence
  chemically synthesized
taactggaggaatatacattga

SEQ ID NO: 1138538 - DNA, 22 bp, Artificial Sequence
  chemically synthesized
gaatttcaatgtatattcctcc

SEQ ID NO: 1138539 - DNA, 22 bp, Artificial Sequence
  chemically synthesized
aatttcaatgtatattcctcca

SEQ ID NO: 1138540 - DNA, 22 bp, Artificial Sequence
  chemically synthesized
caatgtatattcctccagttat

SEQ ID NO: 1138541 - DNA, 22 bp, Artificial Sequence
  chemically synthesized
aatgtatattcctccagttata

SEQ ID NO: 1138542 - DNA, 22 bp, Artificial Sequence
  chemically synthesized
ctccagttatagtgtcattttt

SEQ ID NO: 1138543 - DNA, 22 bp, Artificial Sequence
  chemically synthesized
catagtaaagaaaaaaaatgac

SEQ ID NO: 1138544 - DNA, 22 bp, Artificial Sequence
  chemically synthesized
ccatagtaaagaaaaaaaatga

SEQ ID NO: 1138545 - DNA, 22 bp, Artificial Sequence
  chemically synthesized
cagttatagtgtcatttttttt

SEQ ID NO: 1138546 - DNA, 22 bp, Artificial Sequence
  chemically synthesized
tccatagtaaagaaaaaaaatg

SEQ ID NO: 1138547 - DNA, 22 bp, Artificial Sequence
  chemically synthesized
tttccatagtaaagaaaaaaaa

SEQ ID NO: 1138548 - DNA, 22 bp, Artificial Sequence
  chemically synthesized
tagtgtcattttttttctttac

SEQ ID NO: 1138549 - DNA, 22 bp, Artificial Sequence
  chemically synthesized
tgcctctttccatagtaaagaa

SEQ ID NO: 1138550 - DNA, 22 bp, Artificial Sequence
  chemically synthesized
tttttctttactatggaaagag

SEQ ID NO: 1138551 - DNA, 22 bp, Artificial Sequence
  chemically synthesized
tgtatattgtgcctctttccat

SEQ ID NO: 1138552 - DNA, 22 bp, Artificial Sequence
  chemically synthesized
ttttctttactatggaaagagg

SEQ ID NO: 1138553 - DNA, 22 bp, Artificial Sequence
  chemically synthesized
gtgtatattgtgcctctttcca

SEQ ID NO: 1138554 - DNA, 22 bp, Artificial Sequence
  chemically synthesized
tttctttactatggaaagaggc

SEQ ID NO: 1138555 - DNA, 22 bp, Artificial Sequence
  chemically synthesized
tgtgtatattgtgcctctttcc

SEQ ID NO: 1138556 - DNA, 22 bp, Artificial Sequence
  chemically synthesized
ttctttactatggaaagaggca

SEQ ID NO: 1138557 - DNA, 22 bp, Artificial Sequence
  chemically synthesized
tctttactatggaaagaggcac

SEQ ID NO: 1138558 - DNA, 22 bp, Artificial Sequence
  chemically synthesized
ctttactatggaaagaggcaca

SEQ ID NO: 1138559 - DNA, 22 bp, Artificial Sequence
  chemically synthesized
tttactatggaaagaggcacaa

SEQ ID NO: 1138560 - DNA, 22 bp, Artificial Sequence
  chemically synthesized
tactatggaaagaggcacaata

SEQ ID NO: 1138561 - DNA, 22 bp, Artificial Sequence
  chemically synthesized
tgtctttgtgtatattgtgcct

SEQ ID NO: 1138562 - DNA, 22 bp, Artificial Sequence
  chemically synthesized
actatggaaagaggcacaatat

SEQ ID NO: 1138563 - DNA, 22 bp, Artificial Sequence
  chemically synthesized
gtgtctttgtgtatattgtgcc

SEQ ID NO: 1138564 - DNA, 22 bp, Artificial Sequence
  chemically synthesized
ctatggaaagaggcacaatata

SEQ ID NO: 1138565 - DNA, 22 bp, Artificial Sequence
  chemically synthesized
tggaaagaggcacaatatacac

SEQ ID NO: 1138566 - DNA, 22 bp, Artificial Sequence
  chemically synthesized
gatttgtgtctttgtgtatatt

SEQ ID NO: 1138567 - DNA, 22 bp, Artificial Sequence
  chemically synthesized
agatttgtgtctttgtgtatat

SEQ ID NO: 1138568 - DNA, 22 bp, Artificial Sequence
  chemically synthesized
tagatttgtgtctttgtgtata

SEQ ID NO: 1138569 - DNA, 22 bp, Artificial Sequence
  chemically synthesized
ttagatttgtgtctttgtgtat

SEQ ID NO: 1138570 - DNA, 22 bp, Artificial Sequence
  chemically synthesized
tttttagatttgtgtctttgtg

SEQ ID NO: 1138571 - DNA, 22 bp, Artificial Sequence
  chemically synthesized
atttttagatttgtgtctttgt

SEQ ID NO: 1138572 - DNA, 22 bp, Artificial Sequence
  chemically synthesized
tatttttagatttgtgtctttg

SEQ ID NO: 1138573 - DNA, 22 bp, Artificial Sequence
  chemically synthesized
ttatttttagatttgtgtcttt

SEQ ID NO: 1138574 - DNA, 22 bp, Artificial Sequence
  chemically synthesized
tttatttttagatttgtgtctt

SEQ ID NO: 1138575 - DNA, 22 bp, Artificial Sequence
  chemically synthesized
ttttatttttagatttgtgtct

SEQ ID NO: 1138576 - DNA, 22 bp, Artificial Sequence
  chemically synthesized
tttttatttttagatttgtgtc

SEQ ID NO: 1138577 - DNA, 22 bp, Artificial Sequence
  chemically synthesized
ttttttatttttagatttgtgt

SEQ ID NO: 1138578 - DNA, 22 bp, Artificial Sequence
  chemically synthesized
tttttttatttttagatttgtg

SEQ ID NO: 1138579 - DNA, 22 bp, Artificial Sequence
  chemically synthesized
gattttttttttatttttagat

SEQ ID NO: 1138580 - DNA, 22 bp, Artificial Sequence
  chemically synthesized
agattttttttttatttttaga

SEQ ID NO: 1138581 - DNA, 22 bp, Artificial Sequence
  chemically synthesized
tacttagattttttttttattt

SEQ ID NO: 1138582 - DNA, 22 bp, Artificial Sequence
  chemically synthesized
aaaataaaaaaaaaatctaagt

SEQ ID NO: 1138583 - DNA, 22 bp, Artificial Sequence
  chemically synthesized
agtaagtaagtcaaagaggatt

SEQ ID NO: 1138584 - DNA, 22 bp, Artificial Sequence
  chemically synthesized
tgagtaagtaagtcaaagagga

SEQ ID NO: 1138585 - DNA, 22 bp, Artificial Sequence
  chemically synthesized
agtacaatcctctttgacttac

SEQ ID NO: 1138586 - DNA, 22 bp, Artificial Sequence
  chemically synthesized
acattctgagtaagtaagtcaa

SEQ ID NO: 1138587 - DNA, 22 bp, Artificial Sequence
  chemically synthesized
taacattctgagtaagtaagtc

SEQ ID NO: 1138588 - DNA, 22 bp, Artificial Sequence
  chemically synthesized
ctaacattctgagtaagtaagt

SEQ ID NO: 1138589 - DNA, 22 bp, Artificial Sequence
  chemically synthesized
tttgacttacttactcagaatg

SEQ ID NO: 1138590 - DNA, 22 bp, Artificial Sequence
  chemically synthesized
aaatagtttctaacattctgag

SEQ ID NO: 1138591 - DNA, 22 bp, Artificial Sequence
  chemically synthesized
tgacttacttactcagaatgtt

SEQ ID NO: 1138592 - DNA, 22 bp, Artificial Sequence
  chemically synthesized
aaaatagtttctaacattctga

SEQ ID NO: 1138593 - DNA, 22 bp, Artificial Sequence
  chemically synthesized
gacttacttactcagaatgtta

SEQ ID NO: 1138594 - DNA, 22 bp, Artificial Sequence
  chemically synthesized
acttacttactcagaatgttag

SEQ ID NO: 1138595 - DNA, 22 bp, Artificial Sequence
  chemically synthesized
tttaaaatagtttctaacattc

SEQ ID NO: 1138596 - DNA, 22 bp, Artificial Sequence
  chemically synthesized
acttactcagaatgttagaaac

SEQ ID NO: 1138597 - DNA, 22 bp, Artificial Sequence
  chemically synthesized
cttactcagaatgttagaaact

SEQ ID NO: 1138598 - DNA, 22 bp, Artificial Sequence
  chemically synthesized
actcagaatgttagaaactatt

SEQ ID NO: 1138599 - DNA, 22 bp, Artificial Sequence
  chemically synthesized
ctcagaatgttagaaactattt

SEQ ID NO: 1138600 - DNA, 22 bp, Artificial Sequence
  chemically synthesized
agaatgttagaaactattttaa

SEQ ID NO: 1138601 - DNA, 22 bp, Artificial Sequence
  chemically synthesized
cacatatggctatttaaaatag

SEQ ID NO: 1138602 - DNA, 22 bp, Artificial Sequence
  chemically synthesized
acacatatggctatttaaaata

SEQ ID NO: 1138603 - DNA, 22 bp, Artificial Sequence
  chemically synthesized
agccttacacatatggctattt

SEQ ID NO: 1138604 - DNA, 22 bp, Artificial Sequence
  chemically synthesized
gaaactattttaaatagccata

SEQ ID NO: 1138605 - DNA, 22 bp, Artificial Sequence
  chemically synthesized
ttttaaatagccatatgtgtaa

SEQ ID NO: 1138606 - DNA, 22 bp, Artificial Sequence
  chemically synthesized
taaatagccatatgtgtaaggc

SEQ ID NO: 1138607 - DNA, 22 bp, Artificial Sequence
  chemically synthesized
aaatagccatatgtgtaaggct

SEQ ID NO: 1138608 - DNA, 22 bp, Artificial Sequence
  chemically synthesized
aatagccatatgtgtaaggctg

SEQ ID NO: 1138609 - DNA, 22 bp, Artificial Sequence
  chemically synthesized
aataatgggtagaccattcagc

SEQ ID NO: 1138610 - DNA, 22 bp, Artificial Sequence
  chemically synthesized
aaataatgggtagaccattcag

SEQ ID NO: 1138611 - DNA, 22 bp, Artificial Sequence
  chemically synthesized
tttaaataatgggtagaccatt

SEQ ID NO: 1138612 - DNA, 22 bp, Artificial Sequence
  chemically synthesized
gtttaaataatgggtagaccat

SEQ ID NO: 1138613 - DNA, 22 bp, Artificial Sequence
  chemically synthesized
tgtttaaataatgggtagacca

SEQ ID NO: 1138614 - DNA, 22 bp, Artificial Sequence
  chemically synthesized
catattttgtttaaataatggg

SEQ ID NO: 1138615 - DNA, 22 bp, Artificial Sequence
  chemically synthesized
aatggtctacccattatttaaa

SEQ ID NO: 1138616 - DNA, 22 bp, Artificial Sequence
  chemically synthesized
caaatcattacatattttgttt

SEQ ID NO: 1138617 - DNA, 22 bp, Artificial Sequence
  chemically synthesized
ccaaatcattacatattttgtt

SEQ ID NO: 1138618 - DNA, 22 bp, Artificial Sequence
  chemically synthesized
cccattatttaaacaaaatatg

SEQ ID NO: 1138619 - DNA, 22 bp, Artificial Sequence
  chemically synthesized
tttaaacaaaatatgtaatgat

SEQ ID NO: 1138620 - DNA, 22 bp, Artificial Sequence
  chemically synthesized
acatgtttccaaatcattacat

SEQ ID NO: 1138621 - DNA, 22 bp, Artificial Sequence
  chemically synthesized
tgacatgtttccaaatcattac

SEQ ID NO: 1138622 - DNA, 22 bp, Artificial Sequence
  chemically synthesized
aaacaaaatatgtaatgatttg

SEQ ID NO: 1138623 - DNA, 22 bp, Artificial Sequence
  chemically synthesized
ctgacatgtttccaaatcatta

SEQ ID NO: 1138624 - DNA, 22 bp, Artificial Sequence
  chemically synthesized
aacaaaatatgtaatgatttgg

SEQ ID NO: 1138625 - DNA, 22 bp, Artificial Sequence
  chemically synthesized
ttctgacatgtttccaaatcat

SEQ ID NO: 1138626 - DNA, 22 bp, Artificial Sequence
  chemically synthesized
ctcttctgacatgtttccaaat

SEQ ID NO: 1138627 - DNA, 22 bp, Artificial Sequence
  chemically synthesized
acactcctcttctgacatgttt

SEQ ID NO: 1138628 - DNA, 22 bp, Artificial Sequence
  chemically synthesized
tcacactcctcttctgacatgt

SEQ ID NO: 1138629 - DNA, 22 bp, Artificial Sequence
  chemically synthesized
ggaaacatgtcagaagaggagt

SEQ ID NO: 1138630 - DNA, 22 bp, Artificial Sequence
  chemically synthesized
gaaacatgtcagaagaggagtg

SEQ ID NO: 1138631 - DNA, 22 bp, Artificial Sequence
  chemically synthesized
aacataattctcacactcctct

SEQ ID NO: 1138632 - DNA, 22 bp, Artificial Sequence
  chemically synthesized
aaacataattctcacactcctc

SEQ ID NO: 1138633 - DNA, 22 bp, Artificial Sequence
  chemically synthesized
taaacataattctcacactcct

SEQ ID NO: 1138634 - DNA, 22 bp, Artificial Sequence
  chemically synthesized
tttaaacataattctcacactc

SEQ ID NO: 1138635 - DNA, 22 bp, Artificial Sequence
  chemically synthesized
ctttaaacataattctcacact

SEQ ID NO: 1138636 - DNA, 22 bp, Artificial Sequence
  chemically synthesized
ttctttaaacataattctcaca

SEQ ID NO: 1138637 - DNA, 22 bp, Artificial Sequence
  chemically synthesized
caatcctcttctttaaacataa

SEQ ID NO: 1138638 - DNA, 22 bp, Artificial Sequence
  chemically synthesized
ttgcaatcctcttctttaaaca

SEQ ID NO: 1138639 - DNA, 22 bp, Artificial Sequence
  chemically synthesized
attgcaatcctcttctttaaac

SEQ ID NO: 1138640 - DNA, 22 bp, Artificial Sequence
  chemically synthesized
tattgcaatcctcttctttaaa

SEQ ID NO: 1138641 - DNA, 22 bp, Artificial Sequence
  chemically synthesized
ttattgcaatcctcttctttaa

SEQ ID NO: 1138642 - DNA, 22 bp, Artificial Sequence
  chemically synthesized
ataggtttttattgcaatcctc

SEQ ID NO: 1138643 - DNA, 22 bp, Artificial Sequence
  chemically synthesized
tgtttaaagaagaggattgcaa

SEQ ID NO: 1138644 - DNA, 22 bp, Artificial Sequence
  chemically synthesized
ctcataggtttttattgcaatc

SEQ ID NO: 1138645 - DNA, 22 bp, Artificial Sequence
  chemically synthesized
aaagaagaggattgcaataaaa

SEQ ID NO: 1138646 - DNA, 22 bp, Artificial Sequence
  chemically synthesized
aagaagaggattgcaataaaaa

SEQ ID NO: 1138647 - DNA, 22 bp, Artificial Sequence
  chemically synthesized
ggtaccatgaggttactcatag

SEQ ID NO: 1138648 - DNA, 22 bp, Artificial Sequence
  chemically synthesized
aggtaccatgaggttactcata

SEQ ID NO: 1138649 - DNA, 22 bp, Artificial Sequence
  chemically synthesized
caataaaaacctatgagtaacc

SEQ ID NO: 1138650 - DNA, 22 bp, Artificial Sequence
  chemically synthesized
tttaggtaccatgaggttactc

SEQ ID NO: 1138651 - DNA, 22 bp, Artificial Sequence
  chemically synthesized
gtttaggtaccatgaggttact

SEQ ID NO: 1138652 - DNA, 22 bp, Artificial Sequence
  chemically synthesized
atttgtttaggtaccatgaggt

SEQ ID NO: 1138653 - DNA, 22 bp, Artificial Sequence
  chemically synthesized
catttgtttaggtaccatgagg

SEQ ID NO: 1138654 - DNA, 22 bp, Artificial Sequence
  chemically synthesized
tcatttgtttaggtaccatgag

SEQ ID NO: 1138655 - DNA, 22 bp, Artificial Sequence
  chemically synthesized
ttttcatttgtttaggtaccat

SEQ ID NO: 1138656 - DNA, 22 bp, Artificial Sequence
  chemically synthesized
tgagtaacctcatggtacctaa

SEQ ID NO: 1138657 - DNA, 22 bp, Artificial Sequence
  chemically synthesized
attttcatttgtttaggtacca

SEQ ID NO: 1138658 - DNA, 22 bp, Artificial Sequence
  chemically synthesized
atggtacctaaacaaatgaaaa

SEQ ID NO: 1138659 - DNA, 22 bp, Artificial Sequence
  chemically synthesized
ataataaaacaggaggcttatt

SEQ ID NO: 1138660 - DNA, 22 bp, Artificial Sequence
  chemically synthesized
aataataaaacaggaggcttat

SEQ ID NO: 1138661 - DNA, 22 bp, Artificial Sequence
  chemically synthesized
aacaaatgaaaataagcctcct

SEQ ID NO: 1138662 - DNA, 22 bp, Artificial Sequence
  chemically synthesized
atgtggcttaataataaaacag

SEQ ID NO: 1138663 - DNA, 22 bp, Artificial Sequence
  chemically synthesized
catgtggcttaataataaaaca

SEQ ID NO: 1138664 - DNA, 22 bp, Artificial Sequence
  chemically synthesized
ttcatgtggcttaataataaaa

SEQ ID NO: 1138665 - DNA, 22 bp, Artificial Sequence
  chemically synthesized
cttcatgtggcttaataataaa

SEQ ID NO: 1138666 - DNA, 22 bp, Artificial Sequence
  chemically synthesized
ctgttttattattaagccacat

SEQ ID NO: 1138667 - DNA, 22 bp, Artificial Sequence
  chemically synthesized
ccaaatgtttcttcatgtggct

SEQ ID NO: 1138668 - DNA, 22 bp, Artificial Sequence
  chemically synthesized
ttttattattaagccacatgaa

SEQ ID NO: 1138669 - DNA, 22 bp, Artificial Sequence
  chemically synthesized
accaaatgtttcttcatgtggc

SEQ ID NO: 1138670 - DNA, 22 bp, Artificial Sequence
  chemically synthesized
tattattaagccacatgaagaa

SEQ ID NO: 1138671 - DNA, 22 bp, Artificial Sequence
  chemically synthesized
attattaagccacatgaagaaa

SEQ ID NO: 1138672 - DNA, 22 bp, Artificial Sequence
  chemically synthesized
ttattaagccacatgaagaaac

SEQ ID NO: 1138673 - DNA, 22 bp, Artificial Sequence
  chemically synthesized
ttaagccacatgaagaaacatt

SEQ ID NO: 1138674 - DNA, 22 bp, Artificial Sequence
  chemically synthesized
taatgcttaccaaatgtttctt

SEQ ID NO: 1138675 - DNA, 22 bp, Artificial Sequence
  chemically synthesized
gtaatgcttaccaaatgtttct

SEQ ID NO: 1138676 - DNA, 22 bp, Artificial Sequence
  chemically synthesized
tgtaatgcttaccaaatgtttc

SEQ ID NO: 1138677 - DNA, 22 bp, Artificial Sequence
  chemically synthesized
agccacatgaagaaacatttgg

SEQ ID NO: 1138678 - DNA, 22 bp, Artificial Sequence
  chemically synthesized
ttgtaatgcttaccaaatgttt

SEQ ID NO: 1138679 - DNA, 22 bp, Artificial Sequence
  chemically synthesized
atttttgtaatgcttaccaaat

SEQ ID NO: 1138680 - DNA, 22 bp, Artificial Sequence
  chemically synthesized
catttttgtaatgcttaccaaa

SEQ ID NO: 1138681 - DNA, 22 bp, Artificial Sequence
  chemically synthesized
tcatttttgtaatgcttaccaa

SEQ ID NO: 1138682 - DNA, 22 bp, Artificial Sequence
  chemically synthesized
actttcatttttgtaatgctta

SEQ ID NO: 1138683 - DNA, 22 bp, Artificial Sequence
  chemically synthesized
cactttcatttttgtaatgctt

SEQ ID NO: 1138684 - DNA, 22 bp, Artificial Sequence
  chemically synthesized
tcactttcatttttgtaatgct

SEQ ID NO: 1138685 - DNA, 22 bp, Artificial Sequence
  chemically synthesized
ggtaagcattacaaaaatgaaa

SEQ ID NO: 1138686 - DNA, 22 bp, Artificial Sequence
  chemically synthesized
gtaagcattacaaaaatgaaag

SEQ ID NO: 1138687 - DNA, 22 bp, Artificial Sequence
  chemically synthesized
atggtgactttcactttcattt

SEQ ID NO: 1138688 - DNA, 22 bp, Artificial Sequence
  chemically synthesized
aatggtgactttcactttcatt

SEQ ID NO: 1138689 - DNA, 22 bp, Artificial Sequence
  chemically synthesized
taatggtgactttcactttcat

SEQ ID NO: 1138690 - DNA, 22 bp, Artificial Sequence
  chemically synthesized
ttaatggtgactttcactttca

SEQ ID NO: 1138691 - DNA, 22 bp, Artificial Sequence
  chemically synthesized
tttttaatggtgactttcactt

SEQ ID NO: 1138692 - DNA, 22 bp, Artificial Sequence
  chemically synthesized
atttttaatggtgactttcact

SEQ ID NO: 1138693 - DNA, 22 bp, Artificial Sequence
  chemically synthesized
tatttttaatggtgactttcac

SEQ ID NO: 1138694 - DNA, 22 bp, Artificial Sequence
  chemically synthesized
caaaaatgaaagtgaaagtcac

SEQ ID NO: 1138695 - DNA, 22 bp, Artificial Sequence
  chemically synthesized
attttatttttaatggtgactt

SEQ ID NO: 1138696 - DNA, 22 bp, Artificial Sequence
  chemically synthesized
taattttatttttaatggtgac

SEQ ID NO: 1138697 - DNA, 22 bp, Artificial Sequence
  chemically synthesized
taggcgtgagccaccacctcta

SEQ ID NO: 1138698 - DNA, 22 bp, Artificial Sequence
  chemically synthesized
aaaataaaattagaggtggtgg

SEQ ID NO: 1138699 - DNA, 22 bp, Artificial Sequence
  chemically synthesized
agattataggcgtgagccacca

SEQ ID NO: 1138700 - DNA, 22 bp, Artificial Sequence
  chemically synthesized
gaggtggtggctcacgcctata

SEQ ID NO: 1138701 - DNA, 22 bp, Artificial Sequence
  chemically synthesized
ccaaagtgctgagattataggc

SEQ ID NO: 1138702 - DNA, 22 bp, Artificial Sequence
  chemically synthesized
agcctcccaaagtgctgagatt

SEQ ID NO: 1138703 - DNA, 22 bp, Artificial Sequence
  chemically synthesized
acgcctataatctcagcacttt

SEQ ID NO: 1138704 - DNA, 22 bp, Artificial Sequence
  chemically synthesized
taatctcagcactttgggaggc

SEQ ID NO: 1138705 - DNA, 22 bp, Artificial Sequence
  chemically synthesized
gtgatccgcccgcctcagcctc

SEQ ID NO: 1138706 - DNA, 22 bp, Artificial Sequence
  chemically synthesized
agcactttgggaggctgaggcg

SEQ ID NO: 1138707 - DNA, 22 bp, Artificial Sequence
  chemically synthesized
acctcgtgatccgcccgcctca

SEQ ID NO: 1138708 - DNA, 22 bp, Artificial Sequence
  chemically synthesized
ctgacctcgtgatccgcccgcc

SEQ ID NO: 1138709 - DNA, 22 bp, Artificial Sequence
  chemically synthesized
tgggaggctgaggcgggcggat

SEQ ID NO: 1138710 - DNA, 22 bp, Artificial Sequence
  chemically synthesized
gggaggctgaggcgggcggatc

SEQ ID NO: 1138711 - DNA, 22 bp, Artificial Sequence
  chemically synthesized
ggaggctgaggcgggcggatca

SEQ ID NO: 1138712 - DNA, 22 bp, Artificial Sequence
  chemically synthesized
gaactcctgacctcgtgatccg

SEQ ID NO: 1138713 - DNA, 22 bp, Artificial Sequence
  chemically synthesized
aggcgggcggatcacgaggtca

SEQ ID NO: 1138714 - DNA, 22 bp, Artificial Sequence
  chemically synthesized
atctggaactcctgacctcgtg

SEQ ID NO: 1138715 - DNA, 22 bp, Artificial Sequence
  chemically synthesized
gccaggctgatctggaactcct

SEQ ID NO: 1138716 - DNA, 22 bp, Artificial Sequence
  chemically synthesized
tgttggccaggctgatctggaa

SEQ ID NO: 1138717 - DNA, 22 bp, Artificial Sequence
  chemically synthesized
actatgttggccaggctgatct

SEQ ID NO: 1138718 - DNA, 22 bp, Artificial Sequence
  chemically synthesized
cactatgttggccaggctgatc

SEQ ID NO: 1138719 - DNA, 22 bp, Artificial Sequence
  chemically synthesized
cagatcagcctggccaacatag

SEQ ID NO: 1138720 - DNA, 22 bp, Artificial Sequence
  chemically synthesized
gtacagacgaggtttcactatg

SEQ ID NO: 1138721 - DNA, 22 bp, Artificial Sequence
  chemically synthesized
agtacagacgaggtttcactat

SEQ ID NO: 1138722 - DNA, 22 bp, Artificial Sequence
  chemically synthesized
tagtacagacgaggtttcacta

SEQ ID NO: 1138723 - DNA, 22 bp, Artificial Sequence
  chemically synthesized
ttagtacagacgaggtttcact

SEQ ID NO: 1138724 - DNA, 22 bp, Artificial Sequence
  chemically synthesized
gccaacatagtgaaacctcgtc

SEQ ID NO: 1138725 - DNA, 22 bp, Artificial Sequence
  chemically synthesized
tatttttagtacagacgaggtt

SEQ ID NO: 1138726 - DNA, 22 bp, Artificial Sequence
  chemically synthesized
ttgtatttttagtacagacgag

SEQ ID NO: 1138727 - DNA, 22 bp, Artificial Sequence
  chemically synthesized
attattgtatttttagtacaga

SEQ ID NO: 1138728 - DNA, 22 bp, Artificial Sequence
  chemically synthesized
ccagctaattattgtattttta

SEQ ID NO: 1138729 - DNA, 22 bp, Artificial Sequence
  chemically synthesized
gtctgtactaaaaatacaataa

SEQ ID NO: 1138730 - DNA, 22 bp, Artificial Sequence
  chemically synthesized
tactaaaaatacaataattagc

SEQ ID NO: 1138731 - DNA, 22 bp, Artificial Sequence
  chemically synthesized
aaaatacaataattagctggga

SEQ ID NO: 1138732 - DNA, 22 bp, Artificial Sequence
  chemically synthesized
ggaccacaggcatgcaccaaca

SEQ ID NO: 1138733 - DNA, 22 bp, Artificial Sequence
  chemically synthesized
gctgggaatgttggtgcatgcc

SEQ ID NO: 1138734 - DNA, 22 bp, Artificial Sequence
  chemically synthesized
ggaatgttggtgcatgcctgtg

SEQ ID NO: 1138735 - DNA, 22 bp, Artificial Sequence
  chemically synthesized
agtcgctgggaccacaggcatg

SEQ ID NO: 1138736 - DNA, 22 bp, Artificial Sequence
  chemically synthesized
ctgagtcgctgggaccacaggc

SEQ ID NO: 1138737 - DNA, 22 bp, Artificial Sequence
  chemically synthesized
cctgagtcgctgggaccacagg

SEQ ID NO: 1138738 - DNA, 22 bp, Artificial Sequence
  chemically synthesized
gtgcatgcctgtggtcccagcg

SEQ ID NO: 1138739 - DNA, 22 bp, Artificial Sequence
  chemically synthesized
agcttcctgagtcgctgggacc

SEQ ID NO: 1138740 - DNA, 22 bp, Artificial Sequence
  chemically synthesized
cctcagcttcctgagtcgctgg

SEQ ID NO: 1138741 - DNA, 22 bp, Artificial Sequence
  chemically synthesized
gcctcagcttcctgagtcgctg

SEQ ID NO: 1138742 - DNA, 22 bp, Artificial Sequence
  chemically synthesized
cttgcctcagcttcctgagtcg

SEQ ID NO: 1138743 - DNA, 22 bp, Artificial Sequence
  chemically synthesized
tggtcccagcgactcaggaagc

SEQ ID NO: 1138744 - DNA, 22 bp, Artificial Sequence
  chemically synthesized
cagcgattccttgcctcagctt

SEQ ID NO: 1138745 - DNA, 22 bp, Artificial Sequence
  chemically synthesized
gttccagcgattccttgcctca

SEQ ID NO: 1138746 - DNA, 22 bp, Artificial Sequence
  chemically synthesized
cctggttccagcgattccttgc

SEQ ID NO: 1138747 - DNA, 22 bp, Artificial Sequence
  chemically synthesized
aggaagctgaggcaaggaatcg

SEQ ID NO: 1138748 - DNA, 22 bp, Artificial Sequence
  chemically synthesized
cctccctggttccagcgattcc

SEQ ID NO: 1138749 - DNA, 22 bp, Artificial Sequence
  chemically synthesized
tgcctccctggttccagcgatt

SEQ ID NO: 1138750 - DNA, 22 bp, Artificial Sequence
  chemically synthesized
aggcaaggaatcgctggaacca

SEQ ID NO: 1138751 - DNA, 22 bp, Artificial Sequence
  chemically synthesized
agggcaacctctgcctccctgg

SEQ ID NO: 1138752 - DNA, 22 bp, Artificial Sequence
  chemically synthesized
ggctcagggcaacctctgcctc

SEQ ID NO: 1138753 - DNA, 22 bp, Artificial Sequence
  chemically synthesized
gaaccagggaggcagaggttgc

SEQ ID NO: 1138754 - DNA, 22 bp, Artificial Sequence
  chemically synthesized
gagtgcagtggtgtgatctcgg

SEQ ID NO: 1138755 - DNA, 22 bp, Artificial Sequence
  chemically synthesized
ccctgagccgagatcacaccac

SEQ ID NO: 1138756 - DNA, 22 bp, Artificial Sequence
  chemically synthesized
cccaggctggagtgcagtggtg

SEQ ID NO: 1138757 - DNA, 22 bp, Artificial Sequence
  chemically synthesized
agccgagatcacaccactgcac

SEQ ID NO: 1138758 - DNA, 22 bp, Artificial Sequence
  chemically synthesized
ttgcccaggctggagtgcagtg

SEQ ID NO: 1138759 - DNA, 22 bp, Artificial Sequence
  chemically synthesized
tgttgcccaggctggagtgcag

SEQ ID NO: 1138760 - DNA, 22 bp, Artificial Sequence
  chemically synthesized
ctctgttgcccaggctggagtg

SEQ ID NO: 1138761 - DNA, 22 bp, Artificial Sequence
  chemically synthesized
gctctgttgcccaggctggagt

SEQ ID NO: 1138762 - DNA, 22 bp, Artificial Sequence
  chemically synthesized
cactccagcctgggcaacagag

SEQ ID NO: 1138763 - DNA, 22 bp, Artificial Sequence
  chemically synthesized
agatggagtcttgctctgttgc

SEQ ID NO: 1138764 - DNA, 22 bp, Artificial Sequence
  chemically synthesized
gagatggagtcttgctctgttg

SEQ ID NO: 1138765 - DNA, 22 bp, Artificial Sequence
  chemically synthesized
ttgagatggagtcttgctctgt

SEQ ID NO: 1138766 - DNA, 22 bp, Artificial Sequence
  chemically synthesized
cagcctgggcaacagagcaaga

SEQ ID NO: 1138767 - DNA, 22 bp, Artificial Sequence
  chemically synthesized
cttgagatggagtcttgctctg

SEQ ID NO: 1138768 - DNA, 22 bp, Artificial Sequence
  chemically synthesized
tcttgagatggagtcttgctct

SEQ ID NO: 1138769 - DNA, 22 bp, Artificial Sequence
  chemically synthesized
ttcttgagatggagtcttgctc

SEQ ID NO: 1138770 - DNA, 22 bp, Artificial Sequence
  chemically synthesized
tttcttgagatggagtcttgct

SEQ ID NO: 1138771 - DNA, 22 bp, Artificial Sequence
  chemically synthesized
ttttcttgagatggagtcttgc

SEQ ID NO: 1138772 - DNA, 22 bp, Artificial Sequence
  chemically synthesized
tttttcttgagatggagtcttg

SEQ ID NO: 1138773 - DNA, 22 bp, Artificial Sequence
  chemically synthesized
ttttttcttgagatggagtctt

SEQ ID NO: 1138774 - DNA, 22 bp, Artificial Sequence
  chemically synthesized
ggcaacagagcaagactccatc

SEQ ID NO: 1138775 - DNA, 22 bp, Artificial Sequence
  chemically synthesized
tttttttcttgagatggagtct

SEQ ID NO: 1138776 - DNA, 22 bp, Artificial Sequence
  chemically synthesized
ttttttttcttgagatggagtc

SEQ ID NO: 1138777 - DNA, 22 bp, Artificial Sequence
  chemically synthesized
tttttttttcttgagatggagt

SEQ ID NO: 1138778 - DNA, 22 bp, Artificial Sequence
  chemically synthesized
ttttttttttcttgagatggag

SEQ ID NO: 1138779 - DNA, 22 bp, Artificial Sequence
  chemically synthesized
gatttttttttttttcttgaga

SEQ ID NO: 1138780 - DNA, 22 bp, Artificial Sequence
  chemically synthesized
attggatttttttttttttctt

SEQ ID NO: 1138781 - DNA, 22 bp, Artificial Sequence
  chemically synthesized
ctaattggattttttttttttt

SEQ ID NO: 1138782 - DNA, 22 bp, Artificial Sequence
  chemically synthesized
cctaattggatttttttttttt

SEQ ID NO: 1138783 - DNA, 22 bp, Artificial Sequence
  chemically synthesized
tcctaattggattttttttttt

SEQ ID NO: 1138784 - DNA, 22 bp, Artificial Sequence
  chemically synthesized
catctcaagaaaaaaaaaaaaa

SEQ ID NO: 1138785 - DNA, 22 bp, Artificial Sequence
  chemically synthesized
ttcctaattggatttttttttt

SEQ ID NO: 1138786 - DNA, 22 bp, Artificial Sequence
  chemically synthesized
tttcctaattggattttttttt

SEQ ID NO: 1138787 - DNA, 22 bp, Artificial Sequence
  chemically synthesized
ttttcctaattggatttttttt

SEQ ID NO: 1138788 - DNA, 22 bp, Artificial Sequence
  chemically synthesized
aagaaaaaaaaaaaaatccaat

SEQ ID NO: 1138789 - DNA, 22 bp, Artificial Sequence
  chemically synthesized
agtgcacttttttcctaattgg

SEQ ID NO: 1138790 - DNA, 22 bp, Artificial Sequence
  chemically synthesized
gagtgcacttttttcctaattg

SEQ ID NO: 1138791 - DNA, 22 bp, Artificial Sequence
  chemically synthesized
ccttgagtgcacttttttccta

SEQ ID NO: 1138792 - DNA, 22 bp, Artificial Sequence
  chemically synthesized
accttgagtgcacttttttcct

SEQ ID NO: 1138793 - DNA, 22 bp, Artificial Sequence
  chemically synthesized
taccttgagtgcacttttttcc

SEQ ID NO: 1138794 - DNA, 22 bp, Artificial Sequence
  chemically synthesized
ctttaccttgagtgcacttttt

SEQ ID NO: 1138795 - DNA, 22 bp, Artificial Sequence
  chemically synthesized
actttaccttgagtgcactttt

SEQ ID NO: 1138796 - DNA, 22 bp, Artificial Sequence
  chemically synthesized
tactttaccttgagtgcacttt

SEQ ID NO: 1138797 - DNA, 22 bp, Artificial Sequence
  chemically synthesized
attttactttaccttgagtgca

SEQ ID NO: 1138798 - DNA, 22 bp, Artificial Sequence
  chemically synthesized
ggaaaaaagtgcactcaaggta

SEQ ID NO: 1138799 - DNA, 22 bp, Artificial Sequence
  chemically synthesized
taacattgattttactttacct

SEQ ID NO: 1138800 - DNA, 22 bp, Artificial Sequence
  chemically synthesized
aaggtaaagtaaaatcaatgtt

SEQ ID NO: 1138801 - DNA, 22 bp, Artificial Sequence
  chemically synthesized
aataatcacacaatgtaattat

SEQ ID NO: 1138802 - DNA, 22 bp, Artificial Sequence
  chemically synthesized
ttcaataatcacacaatgtaat

SEQ ID NO: 1138803 - DNA, 22 bp, Artificial Sequence
  chemically synthesized
attcaataatcacacaatgtaa

SEQ ID NO: 1138804 - DNA, 22 bp, Artificial Sequence
  chemically synthesized
atttattcaataatcacacaat

SEQ ID NO: 1138805 - DNA, 22 bp, Artificial Sequence
  chemically synthesized
taattacattgtgtgattattg

SEQ ID NO: 1138806 - DNA, 22 bp, Artificial Sequence
  chemically synthesized
cattgtgtgattattgaataaa

SEQ ID NO: 1138807 - DNA, 22 bp, Artificial Sequence
  chemically synthesized
tgtgattattgaataaatgaat

SEQ ID NO: 1138808 - DNA, 22 bp, Artificial Sequence
  chemically synthesized
tcatacagacatataaaaattc

SEQ ID NO: 1138809 - DNA, 22 bp, Artificial Sequence
  chemically synthesized
gtcatacagacatataaaaatt

SEQ ID NO: 1138810 - DNA, 22 bp, Artificial Sequence
  chemically synthesized
ttgaataaatgaatttttatat

SEQ ID NO: 1138811 - DNA, 22 bp, Artificial Sequence
  chemically synthesized
tgtcatacagacatataaaaat

SEQ ID NO: 1138812 - DNA, 22 bp, Artificial Sequence
  chemically synthesized
ttgtcatacagacatataaaaa

SEQ ID NO: 1138813 - DNA, 22 bp, Artificial Sequence
  chemically synthesized
aataaatgaatttttatatgtc

SEQ ID NO: 1138814 - DNA, 22 bp, Artificial Sequence
  chemically synthesized
agtgtttttgtcatacagacat

SEQ ID NO: 1138815 - DNA, 22 bp, Artificial Sequence
  chemically synthesized
ggttcagtgtttttgtcataca

SEQ ID NO: 1138816 - DNA, 22 bp, Artificial Sequence
  chemically synthesized
ttatatgtctgtatgacaaaaa

SEQ ID NO: 1138817 - DNA, 22 bp, Artificial Sequence
  chemically synthesized
tatatgtctgtatgacaaaaac

SEQ ID NO: 1138818 - DNA, 22 bp, Artificial Sequence
  chemically synthesized
atatgtctgtatgacaaaaaca

SEQ ID NO: 1138819 - DNA, 22 bp, Artificial Sequence
  chemically synthesized
tatgtctgtatgacaaaaacac

SEQ ID NO: 1138820 - DNA, 22 bp, Artificial Sequence
  chemically synthesized
ggtataagtctgggttcagtgt

SEQ ID NO: 1138821 - DNA, 22 bp, Artificial Sequence
  chemically synthesized
tatgacaaaaacactgaaccca

SEQ ID NO: 1138822 - DNA, 22 bp, Artificial Sequence
  chemically synthesized
ctaggtataagtctgggttcag

SEQ ID NO: 1138823 - DNA, 22 bp, Artificial Sequence
  chemically synthesized
actaggtataagtctgggttca

SEQ ID NO: 1138824 - DNA, 22 bp, Artificial Sequence
  chemically synthesized
aaatttactaggtataagtctg

SEQ ID NO: 1138825 - DNA, 22 bp, Artificial Sequence
  chemically synthesized
atatctaaaatttactaggtat

SEQ ID NO: 1138826 - DNA, 22 bp, Artificial Sequence
  chemically synthesized
aacccagacttatacctagtaa

SEQ ID NO: 1138827 - DNA, 22 bp, Artificial Sequence
  chemically synthesized
atactcatatctaaaatttact

SEQ ID NO: 1138828 - DNA, 22 bp, Artificial Sequence
  chemically synthesized
gatactcatatctaaaatttac

SEQ ID NO: 1138829 - DNA, 22 bp, Artificial Sequence
  chemically synthesized
tgatactcatatctaaaattta

SEQ ID NO: 1138830 - DNA, 22 bp, Artificial Sequence
  chemically synthesized
ttgatactcatatctaaaattt

SEQ ID NO: 1138831 - DNA, 22 bp, Artificial Sequence
  chemically synthesized
atacctagtaaattttagatat

SEQ ID NO: 1138832 - DNA, 22 bp, Artificial Sequence
  chemically synthesized
tacctagtaaattttagatatg

SEQ ID NO: 1138833 - DNA, 22 bp, Artificial Sequence
  chemically synthesized
gtaaattttagatatgagtatc

SEQ ID NO: 1138834 - DNA, 22 bp, Artificial Sequence
  chemically synthesized
ccatcatcatttttgatactca

SEQ ID NO: 1138835 - DNA, 22 bp, Artificial Sequence
  chemically synthesized
atctgccatcatcatttttgat

SEQ ID NO: 1138836 - DNA, 22 bp, Artificial Sequence
  chemically synthesized
tagatatgagtatcaaaaatga

SEQ ID NO: 1138837 - DNA, 22 bp, Artificial Sequence
  chemically synthesized
agatatgagtatcaaaaatgat

SEQ ID NO: 1138838 - DNA, 22 bp, Artificial Sequence
  chemically synthesized
gatatgagtatcaaaaatgatg

SEQ ID NO: 1138839 - DNA, 22 bp, Artificial Sequence
  chemically synthesized
agaccaaacaactaatctgcca

SEQ ID NO: 1138840 - DNA, 22 bp, Artificial Sequence
  chemically synthesized
gttgtttggtctcagtttctct

SEQ ID NO: 1138841 - DNA, 22 bp, Artificial Sequence
  chemically synthesized
tttggtctcagtttctctctct

SEQ ID NO: 1138842 - DNA, 22 bp, Artificial Sequence
  chemically synthesized
aaagacagaaaaagagagagaa

SEQ ID NO: 1138843 - DNA, 22 bp, Artificial Sequence
  chemically synthesized
ggtctcagtttctctctctttt

SEQ ID NO: 1138844 - DNA, 22 bp, Artificial Sequence
  chemically synthesized
ctgaaagacagaaaaagagaga

SEQ ID NO: 1138845 - DNA, 22 bp, Artificial Sequence
  chemically synthesized
gtctcagtttctctctcttttt

SEQ ID NO: 1138846 - DNA, 22 bp, Artificial Sequence
  chemically synthesized
agtttctctctctttttctgtc

SEQ ID NO: 1138847 - DNA, 22 bp, Artificial Sequence
  chemically synthesized
ctctctctttttctgtctttca

SEQ ID NO: 1138848 - DNA, 22 bp, Artificial Sequence
  chemically synthesized
ggagatgactactgaaagacag

SEQ ID NO: 1138849 - DNA, 22 bp, Artificial Sequence
  chemically synthesized
tctctctttttctgtctttcag

SEQ ID NO: 1138850 - DNA, 22 bp, Artificial Sequence
  chemically synthesized
tctctttttctgtctttcagta

SEQ ID NO: 1138851 - DNA, 22 bp, Artificial Sequence
  chemically synthesized
tctttttctgtctttcagtagt

SEQ ID NO: 1138852 - DNA, 22 bp, Artificial Sequence
  chemically synthesized
gaactgggagatgactactgaa

SEQ ID NO: 1138853 - DNA, 22 bp, Artificial Sequence
  chemically synthesized
tttttctgtctttcagtagtca

SEQ ID NO: 1138854 - DNA, 22 bp, Artificial Sequence
  chemically synthesized
tggaactgggagatgactactg

SEQ ID NO: 1138855 - DNA, 22 bp, Artificial Sequence
  chemically synthesized
tttctgtctttcagtagtcatc

SEQ ID NO: 1138856 - DNA, 22 bp, Artificial Sequence
  chemically synthesized
ttctgtctttcagtagtcatct

SEQ ID NO: 1138857 - DNA, 22 bp, Artificial Sequence
  chemically synthesized
tctgtctttcagtagtcatctc

SEQ ID NO: 1138858 - DNA, 22 bp, Artificial Sequence
  chemically synthesized
ctgtctttcagtagtcatctcc

SEQ ID NO: 1138859 - DNA, 22 bp, Artificial Sequence
  chemically synthesized
tgtctttcagtagtcatctccc

SEQ ID NO: 1138860 - DNA, 22 bp, Artificial Sequence
  chemically synthesized
tctttcagtagtcatctcccag

SEQ ID NO: 1138861 - DNA, 22 bp, Artificial Sequence
  chemically synthesized
ggggagttctggaactgggaga

SEQ ID NO: 1138862 - DNA, 22 bp, Artificial Sequence
  chemically synthesized
tcagtagtcatctcccagttcc

SEQ ID NO: 1138863 - DNA, 22 bp, Artificial Sequence
  chemically synthesized
cagtagtcatctcccagttcca

SEQ ID NO: 1138864 - DNA, 22 bp, Artificial Sequence
  chemically synthesized
agtagtcatctcccagttccag

SEQ ID NO: 1138865 - DNA, 22 bp, Artificial Sequence
  chemically synthesized
ataatcctgggggagttctgga

SEQ ID NO: 1138866 - DNA, 22 bp, Artificial Sequence
  chemically synthesized
agttaataatcctgggggagtt

SEQ ID NO: 1138867 - DNA, 22 bp, Artificial Sequence
  chemically synthesized
ccagttccagaactcccccagg

SEQ ID NO: 1138868 - DNA, 22 bp, Artificial Sequence
  chemically synthesized
cctcagttaataatcctggggg

SEQ ID NO: 1138869 - DNA, 22 bp, Artificial Sequence
  chemically synthesized
ctccctcagttaataatcctgg

SEQ ID NO: 1138870 - DNA, 22 bp, Artificial Sequence
  chemically synthesized
cctccctcagttaataatcctg

SEQ ID NO: 1138871 - DNA, 22 bp, Artificial Sequence
  chemically synthesized
cagaactcccccaggattatta

SEQ ID NO: 1138872 - DNA, 22 bp, Artificial Sequence
  chemically synthesized
tcctccctcagttaataatcct

SEQ ID NO: 1138873 - DNA, 22 bp, Artificial Sequence
  chemically synthesized
ttcctccctcagttaataatcc

SEQ ID NO: 1138874 - DNA, 22 bp, Artificial Sequence
  chemically synthesized
ttttcctccctcagttaataat

SEQ ID NO: 1138875 - DNA, 22 bp, Artificial Sequence
  chemically synthesized
cttttcctccctcagttaataa

SEQ ID NO: 1138876 - DNA, 22 bp, Artificial Sequence
  chemically synthesized
tcttttcctccctcagttaata

SEQ ID NO: 1138877 - DNA, 22 bp, Artificial Sequence
  chemically synthesized
tttcttttcctccctcagttaa

SEQ ID NO: 1138878 - DNA, 22 bp, Artificial Sequence
  chemically synthesized
ccccaggattattaactgaggg

SEQ ID NO: 1138879 - DNA, 22 bp, Artificial Sequence
  chemically synthesized
ctttcttttcctccctcagtta

SEQ ID NO: 1138880 - DNA, 22 bp, Artificial Sequence
  chemically synthesized
tctttcttttcctccctcagtt

SEQ ID NO: 1138881 - DNA, 22 bp, Artificial Sequence
  chemically synthesized
ttaactgagggaggaaaagaaa

SEQ ID NO: 1138882 - DNA, 22 bp, Artificial Sequence
  chemically synthesized
actgagggaggaaaagaaagaa

SEQ ID NO: 1138883 - DNA, 22 bp, Artificial Sequence
  chemically synthesized
gccccatcatggattttctttc

SEQ ID NO: 1138884 - DNA, 22 bp, Artificial Sequence
  chemically synthesized
agggaggaaaagaaagaaaatc

SEQ ID NO: 1138885 - DNA, 22 bp, Artificial Sequence
  chemically synthesized
atgtatctggccccatcatgga

SEQ ID NO: 1138886 - DNA, 22 bp, Artificial Sequence
  chemically synthesized
tgatctaatgtatctggcccca

SEQ ID NO: 1138887 - DNA, 22 bp, Artificial Sequence
  chemically synthesized
tatgatctaatgtatctggccc

SEQ ID NO: 1138888 - DNA, 22 bp, Artificial Sequence
  chemically synthesized
atgaattctatgatctaatgta

SEQ ID NO: 1138889 - DNA, 22 bp, Artificial Sequence
  chemically synthesized
taatgaattctatgatctaatg

SEQ ID NO: 1138890 - DNA, 22 bp, Artificial Sequence
  chemically synthesized
gatcatagaattcattagaatt

SEQ ID NO: 1138891 - DNA, 22 bp, Artificial Sequence
  chemically synthesized
attagaattaccttgtcctgtc

SEQ ID NO: 1138892 - DNA, 22 bp, Artificial Sequence
  chemically synthesized
gaattaccttgtcctgtctatc

SEQ ID NO: 1138893 - DNA, 22 bp, Artificial Sequence
  chemically synthesized
ccttgtcctgtctatccattga

SEQ ID NO: 1138894 - DNA, 22 bp, Artificial Sequence
  chemically synthesized
aaagaatcagcatcaatggata

SEQ ID NO: 1138895 - DNA, 22 bp, Artificial Sequence
  chemically synthesized
aaaagaatcagcatcaatggat

SEQ ID NO: 1138896 - DNA, 22 bp, Artificial Sequence
  chemically synthesized
gtcctgtctatccattgatgct

SEQ ID NO: 1138897 - DNA, 22 bp, Artificial Sequence
  chemically synthesized
tcctgtctatccattgatgctg

SEQ ID NO: 1138898 - DNA, 22 bp, Artificial Sequence
  chemically synthesized
agcttaaaagaatcagcatcaa

SEQ ID NO: 1138899 - DNA, 22 bp, Artificial Sequence
  chemically synthesized
tctatccattgatgctgattct

SEQ ID NO: 1138900 - DNA, 22 bp, Artificial Sequence
  chemically synthesized
tccattgatgctgattctttta

SEQ ID NO: 1138901 - DNA, 22 bp, Artificial Sequence
  chemically synthesized
atgctgattcttttaagcttag

SEQ ID NO: 1138902 - DNA, 22 bp, Artificial Sequence
  chemically synthesized
atatgcacatgtaagacctaag

SEQ ID NO: 1138903 - DNA, 22 bp, Artificial Sequence
  chemically synthesized
attcttttaagcttaggtctta

SEQ ID NO: 1138904 - DNA, 22 bp, Artificial Sequence
  chemically synthesized
aatatgcacatgtaagacctaa

SEQ ID NO: 1138905 - DNA, 22 bp, Artificial Sequence
  chemically synthesized
tttaatatgcacatgtaagacc

SEQ ID NO: 1138906 - DNA, 22 bp, Artificial Sequence
  chemically synthesized
ttttaagcttaggtcttacatg

SEQ ID NO: 1138907 - DNA, 22 bp, Artificial Sequence
  chemically synthesized
ttaagcttaggtcttacatgtg

SEQ ID NO: 1138908 - DNA, 22 bp, Artificial Sequence
  chemically synthesized
taagcttaggtcttacatgtgc

SEQ ID NO: 1138909 - DNA, 22 bp, Artificial Sequence
  chemically synthesized
aagcttaggtcttacatgtgca

SEQ ID NO: 1138910 - DNA, 22 bp, Artificial Sequence
  chemically synthesized
agcttaggtcttacatgtgcat

SEQ ID NO: 1138911 - DNA, 22 bp, Artificial Sequence
  chemically synthesized
aggtcttacatgtgcatattaa

SEQ ID NO: 1138912 - DNA, 22 bp, Artificial Sequence
  chemically synthesized
ggtcttacatgtgcatattaaa

SEQ ID NO: 1138913 - DNA, 22 bp, Artificial Sequence
  chemically synthesized
gtaacaaatcatagttatttaa

SEQ ID NO: 1138914 - DNA, 22 bp, Artificial Sequence
  chemically synthesized
acatgtgcatattaaataacta

SEQ ID NO: 1138915 - DNA, 22 bp, Artificial Sequence
  chemically synthesized
catgtgcatattaaataactat

SEQ ID NO: 1138916 - DNA, 22 bp, Artificial Sequence
  chemically synthesized
tgcaataattagtaacaaatca

SEQ ID NO: 1138917 - DNA, 22 bp, Artificial Sequence
  chemically synthesized
atgcaataattagtaacaaatc

SEQ ID NO: 1138918 - DNA, 22 bp, Artificial Sequence
  chemically synthesized
tatgcaataattagtaacaaat

SEQ ID NO: 1138919 - DNA, 22 bp, Artificial Sequence
  chemically synthesized
aataactatgatttgttactaa

SEQ ID NO: 1138920 - DNA, 22 bp, Artificial Sequence
  chemically synthesized
tgatttgttactaattattgca

SEQ ID NO: 1138921 - DNA, 22 bp, Artificial Sequence
  chemically synthesized
gttactaattattgcataaaat

SEQ ID NO: 1138922 - DNA, 22 bp, Artificial Sequence
  chemically synthesized
ttactaattattgcataaaata

SEQ ID NO: 1138923 - DNA, 22 bp, Artificial Sequence
  chemically synthesized
ctaattattgcataaaatatgt

SEQ ID NO: 1138924 - DNA, 22 bp, Artificial Sequence
  chemically synthesized
atatgtagaaatacatatttta

SEQ ID NO: 1138925 - DNA, 22 bp, Artificial Sequence
  chemically synthesized
attattgcataaaatatgtatt

SEQ ID NO: 1138926 - DNA, 22 bp, Artificial Sequence
  chemically synthesized
ttgatatgtagaaatacatatt

SEQ ID NO: 1138927 - DNA, 22 bp, Artificial Sequence
  chemically synthesized
ttgcataaaatatgtatttcta

SEQ ID NO: 1138928 - DNA, 22 bp, Artificial Sequence
  chemically synthesized
attattgatatgtagaaataca

SEQ ID NO: 1138929 - DNA, 22 bp, Artificial Sequence
  chemically synthesized
cataaaatatgtatttctacat

SEQ ID NO: 1138930 - DNA, 22 bp, Artificial Sequence
  chemically synthesized
tggttaattattgatatgtaga

SEQ ID NO: 1138931 - DNA, 22 bp, Artificial Sequence
  chemically synthesized
atagacctatggttaattattg

SEQ ID NO: 1138932 - DNA, 22 bp, Artificial Sequence
  chemically synthesized
ctacatatcaataattaaccat

SEQ ID NO: 1138933 - DNA, 22 bp, Artificial Sequence
  chemically synthesized
tacatatcaataattaaccata

SEQ ID NO: 1138934 - DNA, 22 bp, Artificial Sequence
  chemically synthesized
gcactcatagacctatggttaa

SEQ ID NO: 1138935 - DNA, 22 bp, Artificial Sequence
  chemically synthesized
catatcaataattaaccatagg

SEQ ID NO: 1138936 - DNA, 22 bp, Artificial Sequence
  chemically synthesized
tggcactcatagacctatggtt

SEQ ID NO: 1138937 - DNA, 22 bp, Artificial Sequence
  chemically synthesized
tgggtctctggcactcatagac

SEQ ID NO: 1138938 - DNA, 22 bp, Artificial Sequence
  chemically synthesized
tatgggtctctggcactcatag

SEQ ID NO: 1138939 - DNA, 22 bp, Artificial Sequence
  chemically synthesized
accataggtctatgagtgccag

SEQ ID NO: 1138940 - DNA, 22 bp, Artificial Sequence
  chemically synthesized
gagctctatgggtctctggcac

SEQ ID NO: 1138941 - DNA, 22 bp, Artificial Sequence
  chemically synthesized
tagagctctatgggtctctggc

SEQ ID NO: 1138942 - DNA, 22 bp, Artificial Sequence
  chemically synthesized
ctagagctctatgggtctctgg

SEQ ID NO: 1138943 - DNA, 22 bp, Artificial Sequence
  chemically synthesized
tctagagctctatgggtctctg

SEQ ID NO: 1138944 - DNA, 22 bp, Artificial Sequence
  chemically synthesized
tgagtgccagagacccatagag

SEQ ID NO: 1138945 - DNA, 22 bp, Artificial Sequence
  chemically synthesized
aattttctagagctctatgggt

SEQ ID NO: 1138946 - DNA, 22 bp, Artificial Sequence
  chemically synthesized
ccacctgaattttctagagctc

SEQ ID NO: 1138947 - DNA, 22 bp, Artificial Sequence
  chemically synthesized
gccacctgaattttctagagct

SEQ ID NO: 1138948 - DNA, 22 bp, Artificial Sequence
  chemically synthesized
tgccacctgaattttctagagc

SEQ ID NO: 1138949 - DNA, 22 bp, Artificial Sequence
  chemically synthesized
ttgccacctgaattttctagag

SEQ ID NO: 1138950 - DNA, 22 bp, Artificial Sequence
  chemically synthesized
cttttgccacctgaattttcta

SEQ ID NO: 1138951 - DNA, 22 bp, Artificial Sequence
  chemically synthesized
ccttttgccacctgaattttct

SEQ ID NO: 1138952 - DNA, 22 bp, Artificial Sequence
  chemically synthesized
gatcttccttttgccacctgaa

SEQ ID NO: 1138953 - DNA, 22 bp, Artificial Sequence
  chemically synthesized
tagatcttccttttgccacctg

SEQ ID NO: 1138954 - DNA, 22 bp, Artificial Sequence
  chemically synthesized
tctagatcttccttttgccacc

SEQ ID NO: 1138955 - DNA, 22 bp, Artificial Sequence
  chemically synthesized
tagaaaattcaggtggcaaaag

SEQ ID NO: 1138956 - DNA, 22 bp, Artificial Sequence
  chemically synthesized
gaaaattcaggtggcaaaagga

SEQ ID NO: 1138957 - DNA, 22 bp, Artificial Sequence
  chemically synthesized
tacacattctctagatcttcct

SEQ ID NO: 1138958 - DNA, 22 bp, Artificial Sequence
  chemically synthesized
gtacacattctctagatcttcc

SEQ ID NO: 1138959 - DNA, 22 bp, Artificial Sequence
  chemically synthesized
aggtggcaaaaggaagatctag

SEQ ID NO: 1138960 - DNA, 22 bp, Artificial Sequence
  chemically synthesized
ccttgtacacattctctagatc

SEQ ID NO: 1138961 - DNA, 22 bp, Artificial Sequence
  chemically synthesized
gccttgtacacattctctagat

SEQ ID NO: 1138962 - DNA, 22 bp, Artificial Sequence
  chemically synthesized
tgccttgtacacattctctaga

SEQ ID NO: 1138963 - DNA, 22 bp, Artificial Sequence
  chemically synthesized
gcctttgccttgtacacattct

SEQ ID NO: 1138964 - DNA, 22 bp, Artificial Sequence
  chemically synthesized
tcccagctggcctttgccttgt

SEQ ID NO: 1138965 - DNA, 22 bp, Artificial Sequence
  chemically synthesized
gagaatgtgtacaaggcaaagg

SEQ ID NO: 1138966 - DNA, 22 bp, Artificial Sequence
  chemically synthesized
ctatcccagctggcctttgcct

SEQ ID NO: 1138967 - DNA, 22 bp, Artificial Sequence
  chemically synthesized
actatcccagctggcctttgcc

SEQ ID NO: 1138968 - DNA, 22 bp, Artificial Sequence
  chemically synthesized
tactatcccagctggcctttgc

SEQ ID NO: 1138969 - DNA, 22 bp, Artificial Sequence
  chemically synthesized
ttactatcccagctggcctttg

SEQ ID NO: 1138970 - DNA, 22 bp, Artificial Sequence
  chemically synthesized
ttttactatcccagctggcctt

SEQ ID NO: 1138971 - DNA, 22 bp, Artificial Sequence
  chemically synthesized
ttcttttactatcccagctggc

SEQ ID NO: 1138972 - DNA, 22 bp, Artificial Sequence
  chemically synthesized
attcttttactatcccagctgg

SEQ ID NO: 1138973 - DNA, 22 bp, Artificial Sequence
  chemically synthesized
tttattcttttactatcccagc

SEQ ID NO: 1138974 - DNA, 22 bp, Artificial Sequence
  chemically synthesized
taaaaataaagtctgtttattc

SEQ ID NO: 1138975 - DNA, 22 bp, Artificial Sequence
  chemically synthesized
ggatagtaaaagaataaacaga

SEQ ID NO: 1138976 - DNA, 22 bp, Artificial Sequence
  chemically synthesized
tataaaaataaagtctgtttat

SEQ ID NO: 1138977 - DNA, 22 bp, Artificial Sequence
  chemically synthesized
ctataaaaataaagtctgttta

SEQ ID NO: 1138978 - DNA, 22 bp, Artificial Sequence
  chemically synthesized
gcttctataaaaataaagtctg

SEQ ID NO: 1138979 - DNA, 22 bp, Artificial Sequence
  chemically synthesized
ctggcttctataaaaataaagt

SEQ ID NO: 1138980 - DNA, 22 bp, Artificial Sequence
  chemically synthesized
cattcctggcttctataaaaat

SEQ ID NO: 1138981 - DNA, 22 bp, Artificial Sequence
  chemically synthesized
tatttttatagaagccaggaat

SEQ ID NO: 1138982 - DNA, 22 bp, Artificial Sequence
  chemically synthesized
atttttatagaagccaggaatg

SEQ ID NO: 1138983 - DNA, 22 bp, Artificial Sequence
  chemically synthesized
gaggtaggtctacattcctggc

SEQ ID NO: 1138984 - DNA, 22 bp, Artificial Sequence
  chemically synthesized
tttttatagaagccaggaatgt

SEQ ID NO: 1138985 - DNA, 22 bp, Artificial Sequence
  chemically synthesized
ggaggtaggtctacattcctgg

SEQ ID NO: 1138986 - DNA, 22 bp, Artificial Sequence
  chemically synthesized
ttatagaagccaggaatgtaga

SEQ ID NO: 1138987 - DNA, 22 bp, Artificial Sequence
  chemically synthesized
tatagaagccaggaatgtagac

SEQ ID NO: 1138988 - DNA, 22 bp, Artificial Sequence
  chemically synthesized
ccttggaggtaggtctacattc

SEQ ID NO: 1138989 - DNA, 22 bp, Artificial Sequence
  chemically synthesized
atagaagccaggaatgtagacc

SEQ ID NO: 1138990 - DNA, 22 bp, Artificial Sequence
  chemically synthesized
tagaagccaggaatgtagacct

SEQ ID NO: 1138991 - DNA, 22 bp, Artificial Sequence
  chemically synthesized
cctaccttggaggtaggtctac

SEQ ID NO: 1138992 - DNA, 22 bp, Artificial Sequence
  chemically synthesized
ctccctaccttggaggtaggtc

SEQ ID NO: 1138993 - DNA, 22 bp, Artificial Sequence
  chemically synthesized
cctccctaccttggaggtaggt

SEQ ID NO: 1138994 - DNA, 22 bp, Artificial Sequence
  chemically synthesized
taccttcctccctaccttggag

SEQ ID NO: 1138995 - DNA, 22 bp, Artificial Sequence
  chemically synthesized
actgtaccttcctccctacctt

SEQ ID NO: 1138996 - DNA, 22 bp, Artificial Sequence
  chemically synthesized
ttgactgtaccttcctccctac

SEQ ID NO: 1138997 - DNA, 22 bp, Artificial Sequence
  chemically synthesized
attgactgtaccttcctcccta

SEQ ID NO: 1138998 - DNA, 22 bp, Artificial Sequence
  chemically synthesized
cctccaaggtagggaggaaggt

SEQ ID NO: 1138999 - DNA, 22 bp, Artificial Sequence
  chemically synthesized
atttattgactgtaccttcctc

SEQ ID NO: 1139000 - DNA, 22 bp, Artificial Sequence
  chemically synthesized
caaggtagggaggaaggtacag

SEQ ID NO: 1139001 - DNA, 22 bp, Artificial Sequence
  chemically synthesized
acccagtctgatttattgactg

SEQ ID NO: 1139002 - DNA, 22 bp, Artificial Sequence
  chemically synthesized
ctgacccagtctgatttattga

SEQ ID NO: 1139003 - DNA, 22 bp, Artificial Sequence
  chemically synthesized
catatccactactgacccagtc

SEQ ID NO: 1139004 - DNA, 22 bp, Artificial Sequence
  chemically synthesized
tccatatccactactgacccag

SEQ ID NO: 1139005 - DNA, 22 bp, Artificial Sequence
  chemically synthesized
ctccatatccactactgaccca

SEQ ID NO: 1139006 - DNA, 22 bp, Artificial Sequence
  chemically synthesized
ttctccatatccactactgacc

SEQ ID NO: 1139007 - DNA, 22 bp, Artificial Sequence
  chemically synthesized
tctcttctccatatccactact

SEQ ID NO: 1139008 - DNA, 22 bp, Artificial Sequence
  chemically synthesized
tctgtctcttctccatatccac

SEQ ID NO: 1139009 - DNA, 22 bp, Artificial Sequence
  chemically synthesized
atctgtctcttctccatatcca

SEQ ID NO: 1139010 - DNA, 22 bp, Artificial Sequence
  chemically synthesized
ggtcagtagtggatatggagaa

SEQ ID NO: 1139011 - DNA, 22 bp, Artificial Sequence
  chemically synthesized
aacagcttatctgtctcttctc

SEQ ID NO: 1139012 - DNA, 22 bp, Artificial Sequence
  chemically synthesized
gaacagcttatctgtctcttct

SEQ ID NO: 1139013 - DNA, 22 bp, Artificial Sequence
  chemically synthesized
aaatcatcttgaacagcttatc

SEQ ID NO: 1139014 - DNA, 22 bp, Artificial Sequence
  chemically synthesized
caaatcatcttgaacagcttat

SEQ ID NO: 1139015 - DNA, 22 bp, Artificial Sequence
  chemically synthesized
acttcaaatcatcttgaacagc

SEQ ID NO: 1139016 - DNA, 22 bp, Artificial Sequence
  chemically synthesized
cacttcaaatcatcttgaacag

SEQ ID NO: 1139017 - DNA, 22 bp, Artificial Sequence
  chemically synthesized
tcacttcaaatcatcttgaaca

SEQ ID NO: 1139018 - DNA, 22 bp, Artificial Sequence
  chemically synthesized
ttcacttcaaatcatcttgaac

SEQ ID NO: 1139019 - DNA, 22 bp, Artificial Sequence
  chemically synthesized
tcttttcacttcaaatcatctt

SEQ ID NO: 1139020 - DNA, 22 bp, Artificial Sequence
  chemically synthesized
ttcaagatgatttgaagtgaaa

SEQ ID NO: 1139021 - DNA, 22 bp, Artificial Sequence
  chemically synthesized
aagatgatttgaagtgaaaaga

SEQ ID NO: 1139022 - DNA, 22 bp, Artificial Sequence
  chemically synthesized
taaggatacattatcttttcac

SEQ ID NO: 1139023 - DNA, 22 bp, Artificial Sequence
  chemically synthesized
gtaaggatacattatcttttca

SEQ ID NO: 1139024 - DNA, 22 bp, Artificial Sequence
  chemically synthesized
tgtaaggatacattatcttttc

SEQ ID NO: 1139025 - DNA, 22 bp, Artificial Sequence
  chemically synthesized
ttgtaaggatacattatctttt

SEQ ID NO: 1139026 - DNA, 22 bp, Artificial Sequence
  chemically synthesized
gaagtgaaaagataatgtatcc

SEQ ID NO: 1139027 - DNA, 22 bp, Artificial Sequence
  chemically synthesized
ggccttttgtaaggatacatta

SEQ ID NO: 1139028 - DNA, 22 bp, Artificial Sequence
  chemically synthesized
aagtgaaaagataatgtatcct

SEQ ID NO: 1139029 - DNA, 22 bp, Artificial Sequence
  chemically synthesized
ctgggccttttgtaaggataca

SEQ ID NO: 1139030 - DNA, 22 bp, Artificial Sequence
  chemically synthesized
cctgggccttttgtaaggatac

SEQ ID NO: 1139031 - DNA, 22 bp, Artificial Sequence
  chemically synthesized
acaaaaggcccaggaaaccttc

SEQ ID NO: 1139032 - DNA, 22 bp, Artificial Sequence
  chemically synthesized
caaaaggcccaggaaaccttca

SEQ ID NO: 1139033 - DNA, 22 bp, Artificial Sequence
  chemically synthesized
atgagagtgaggtgaaggtttc

SEQ ID NO: 1139034 - DNA, 22 bp, Artificial Sequence
  chemically synthesized
ctgatgagagtgaggtgaaggt

SEQ ID NO: 1139035 - DNA, 22 bp, Artificial Sequence
  chemically synthesized
tgcgtattcctgatgagagtga

SEQ ID NO: 1139036 - DNA, 22 bp, Artificial Sequence
  chemically synthesized
atgcgtattcctgatgagagtg

SEQ ID NO: 1139037 - DNA, 22 bp, Artificial Sequence
  chemically synthesized
ttatgcgtattcctgatgagag

SEQ ID NO: 1139038 - DNA, 22 bp, Artificial Sequence
  chemically synthesized
tcttatgcgtattcctgatgag

SEQ ID NO: 1139039 - DNA, 22 bp, Artificial Sequence
  chemically synthesized
cacctcactctcatcaggaata

SEQ ID NO: 1139040 - DNA, 22 bp, Artificial Sequence
  chemically synthesized
ttctcttatgcgtattcctgat

SEQ ID NO: 1139041 - DNA, 22 bp, Artificial Sequence
  chemically synthesized
acctcactctcatcaggaatac

SEQ ID NO: 1139042 - DNA, 22 bp, Artificial Sequence
  chemically synthesized
actctcatcaggaatacgcata

SEQ ID NO: 1139043 - DNA, 22 bp, Artificial Sequence
  chemically synthesized
gcattattctcttatgcgtatt

SEQ ID NO: 1139044 - DNA, 22 bp, Artificial Sequence
  chemically synthesized
ggcattattctcttatgcgtat

SEQ ID NO: 1139045 - DNA, 22 bp, Artificial Sequence
  chemically synthesized
tcatcaggaatacgcataagag

SEQ ID NO: 1139046 - DNA, 22 bp, Artificial Sequence
  chemically synthesized
tcttggcattattctcttatgc

SEQ ID NO: 1139047 - DNA, 22 bp, Artificial Sequence
  chemically synthesized
atcaggaatacgcataagagaa

SEQ ID NO: 1139048 - DNA, 22 bp, Artificial Sequence
  chemically synthesized
ccaatataggagaaattgtctt

SEQ ID NO: 1139049 - DNA, 22 bp, Artificial Sequence
  chemically synthesized
gccaatataggagaaattgtct

SEQ ID NO: 1139050 - DNA, 22 bp, Artificial Sequence
  chemically synthesized
tgccaatataggagaaattgtc

SEQ ID NO: 1139051 - DNA, 22 bp, Artificial Sequence
  chemically synthesized
aattttgccaatataggagaaa

SEQ ID NO: 1139052 - DNA, 22 bp, Artificial Sequence
  chemically synthesized
ctcctatattggcaaaattgag

SEQ ID NO: 1139053 - DNA, 22 bp, Artificial Sequence
  chemically synthesized
tcctatattggcaaaattgagt

SEQ ID NO: 1139054 - DNA, 22 bp, Artificial Sequence
  chemically synthesized
ctatattggcaaaattgagttt

SEQ ID NO: 1139055 - DNA, 22 bp, Artificial Sequence
  chemically synthesized
tattggcaaaattgagttttcc

SEQ ID NO: 1139056 - DNA, 22 bp, Artificial Sequence
  chemically synthesized
cacataatataggtggaaaact

SEQ ID NO: 1139057 - DNA, 22 bp, Artificial Sequence
  chemically synthesized
gcaaaattgagttttccaccta

SEQ ID NO: 1139058 - DNA, 22 bp, Artificial Sequence
  chemically synthesized
agttttccacctatattatgtg

SEQ ID NO: 1139059 - DNA, 22 bp, Artificial Sequence
  chemically synthesized
tccacctatattatgtgtagtt

SEQ ID NO: 1139060 - DNA, 22 bp, Artificial Sequence
  chemically synthesized
ccacctatattatgtgtagtta

SEQ ID NO: 1139061 - DNA, 22 bp, Artificial Sequence
  chemically synthesized
catgtagataagtaactacaca

SEQ ID NO: 1139062 - DNA, 22 bp, Artificial Sequence
  chemically synthesized
cacctatattatgtgtagttac

SEQ ID NO: 1139063 - DNA, 22 bp, Artificial Sequence
  chemically synthesized
acatgtagataagtaactacac

SEQ ID NO: 1139064 - DNA, 22 bp, Artificial Sequence
  chemically synthesized
tattatgtgtagttacttatct

SEQ ID NO: 1139065 - DNA, 22 bp, Artificial Sequence
  chemically synthesized
tgtgtagttacttatctacatg

SEQ ID NO: 1139066 - DNA, 22 bp, Artificial Sequence
  chemically synthesized
gagcacatcttacatgtagata

SEQ ID NO: 1139067 - DNA, 22 bp, Artificial Sequence
  chemically synthesized
cttatctacatgtaagatgtgc

SEQ ID NO: 1139068 - DNA, 22 bp, Artificial Sequence
  chemically synthesized
gaatgaattggagcacatctta

SEQ ID NO: 1139069 - DNA, 22 bp, Artificial Sequence
  chemically synthesized
atctacatgtaagatgtgctcc

SEQ ID NO: 1139070 - DNA, 22 bp, Artificial Sequence
  chemically synthesized
tctacatgtaagatgtgctcca

SEQ ID NO: 1139071 - DNA, 22 bp, Artificial Sequence
  chemically synthesized
gtgattagaatgaattggagca

SEQ ID NO: 1139072 - DNA, 22 bp, Artificial Sequence
  chemically synthesized
catgtaagatgtgctccaattc

SEQ ID NO: 1139073 - DNA, 22 bp, Artificial Sequence
  chemically synthesized
ccaaagtacaactggtgattag

SEQ ID NO: 1139074 - DNA, 22 bp, Artificial Sequence
  chemically synthesized
caattcattctaatcaccagtt

SEQ ID NO: 1139075 - DNA, 22 bp, Artificial Sequence
  chemically synthesized
attctaatcaccagttgtactt

SEQ ID NO: 1139076 - DNA, 22 bp, Artificial Sequence
  chemically synthesized
taatcaccagttgtactttggg

SEQ ID NO: 1139077 - DNA, 22 bp, Artificial Sequence
  chemically synthesized
atcaccagttgtactttgggag

SEQ ID NO: 1139078 - DNA, 22 bp, Artificial Sequence
  chemically synthesized
taatagatcaacctcccaaagt

SEQ ID NO: 1139079 - DNA, 22 bp, Artificial Sequence
  chemically synthesized
tgtaatagatcaacctcccaaa

SEQ ID NO: 1139080 - DNA, 22 bp, Artificial Sequence
  chemically synthesized
tactttgggaggttgatctatt

SEQ ID NO: 1139081 - DNA, 22 bp, Artificial Sequence
  chemically synthesized
tgggaggttgatctattacaga

SEQ ID NO: 1139082 - DNA, 22 bp, Artificial Sequence
  chemically synthesized
aagatgagaacctctgtaatag

SEQ ID NO: 1139083 - DNA, 22 bp, Artificial Sequence
  chemically synthesized
gggaggttgatctattacagag

SEQ ID NO: 1139084 - DNA, 22 bp, Artificial Sequence
  chemically synthesized
caagatgagaacctctgtaata

SEQ ID NO: 1139085 - DNA, 22 bp, Artificial Sequence
  chemically synthesized
ggaggttgatctattacagagg

SEQ ID NO: 1139086 - DNA, 22 bp, Artificial Sequence
  chemically synthesized
tcaagatgagaacctctgtaat

SEQ ID NO: 1139087 - DNA, 22 bp, Artificial Sequence
  chemically synthesized
tttcaagatgagaacctctgta

SEQ ID NO: 1139088 - DNA, 22 bp, Artificial Sequence
  chemically synthesized
atctattacagaggttctcatc

SEQ ID NO: 1139089 - DNA, 22 bp, Artificial Sequence
  chemically synthesized
atgttctttcaagatgagaacc

SEQ ID NO: 1139090 - DNA, 22 bp, Artificial Sequence
  chemically synthesized
tgatgttctttcaagatgagaa

SEQ ID NO: 1139091 - DNA, 22 bp, Artificial Sequence
  chemically synthesized
ttacagaggttctcatcttgaa

SEQ ID NO: 1139092 - DNA, 22 bp, Artificial Sequence
  chemically synthesized
cagaggttctcatcttgaaaga

SEQ ID NO: 1139093 - DNA, 22 bp, Artificial Sequence
  chemically synthesized
aggtaattctgatgttctttca

SEQ ID NO: 1139094 - DNA, 22 bp, Artificial Sequence
  chemically synthesized
caggtaattctgatgttctttc

SEQ ID NO: 1139095 - DNA, 22 bp, Artificial Sequence
  chemically synthesized
tcaggtaattctgatgttcttt

SEQ ID NO: 1139096 - DNA, 22 bp, Artificial Sequence
  chemically synthesized
tcatcttgaaagaacatcagaa

SEQ ID NO: 1139097 - DNA, 22 bp, Artificial Sequence
  chemically synthesized
atcttgaaagaacatcagaatt

SEQ ID NO: 1139098 - DNA, 22 bp, Artificial Sequence
  chemically synthesized
acaagcctttcaggtaattctg

SEQ ID NO: 1139099 - DNA, 22 bp, Artificial Sequence
  chemically synthesized
gaaagaacatcagaattacctg

SEQ ID NO: 1139100 - DNA, 22 bp, Artificial Sequence
  chemically synthesized
taacaagcctttcaggtaattc

SEQ ID NO: 1139101 - DNA, 22 bp, Artificial Sequence
  chemically synthesized
aaagaacatcagaattacctga

SEQ ID NO: 1139102 - DNA, 22 bp, Artificial Sequence
  chemically synthesized
cattctaacaagcctttcaggt

SEQ ID NO: 1139103 - DNA, 22 bp, Artificial Sequence
  chemically synthesized
gtcatctgcattctaacaagcc

SEQ ID NO: 1139104 - DNA, 22 bp, Artificial Sequence
  chemically synthesized
cctgaaaggcttgttagaatgc

SEQ ID NO: 1139105 - DNA, 22 bp, Artificial Sequence
  chemically synthesized
aaaggcttgttagaatgcagat

SEQ ID NO: 1139106 - DNA, 22 bp, Artificial Sequence
  chemically synthesized
gaagtggagcctagtcatctgc

SEQ ID NO: 1139107 - DNA, 22 bp, Artificial Sequence
  chemically synthesized
tggaagtggagcctagtcatct

SEQ ID NO: 1139108 - DNA, 22 bp, Artificial Sequence
  chemically synthesized
gttagaatgcagatgactaggc

SEQ ID NO: 1139109 - DNA, 22 bp, Artificial Sequence
  chemically synthesized
ttagaatgcagatgactaggct

SEQ ID NO: 1139110 - DNA, 22 bp, Artificial Sequence
  chemically synthesized
gaatgcagatgactaggctcca

SEQ ID NO: 1139111 - DNA, 22 bp, Artificial Sequence
  chemically synthesized
gaaactctggaagtggagccta

SEQ ID NO: 1139112 - DNA, 22 bp, Artificial Sequence
  chemically synthesized
agaaactctggaagtggagcct

SEQ ID NO: 1139113 - DNA, 22 bp, Artificial Sequence
  chemically synthesized
atttagaaactctggaagtgga

SEQ ID NO: 1139114 - DNA, 22 bp, Artificial Sequence
  chemically synthesized
ctgatttagaaactctggaagt

SEQ ID NO: 1139115 - DNA, 22 bp, Artificial Sequence
  chemically synthesized
ggctccacttccagagtttcta

SEQ ID NO: 1139116 - DNA, 22 bp, Artificial Sequence
  chemically synthesized
agacctactgatttagaaactc

SEQ ID NO: 1139117 - DNA, 22 bp, Artificial Sequence
  chemically synthesized
cagacctactgatttagaaact

SEQ ID NO: 1139118 - DNA, 22 bp, Artificial Sequence
  chemically synthesized
cacttccagagtttctaaatca

SEQ ID NO: 1139119 - DNA, 22 bp, Artificial Sequence
  chemically synthesized
ccagagtttctaaatcagtagg

SEQ ID NO: 1139120 - DNA, 22 bp, Artificial Sequence
  chemically synthesized
cagagtttctaaatcagtaggt

SEQ ID NO: 1139121 - DNA, 22 bp, Artificial Sequence
  chemically synthesized
ggccatcttcagacctactgat

SEQ ID NO: 1139122 - DNA, 22 bp, Artificial Sequence
  chemically synthesized
ttaggccatcttcagacctact

SEQ ID NO: 1139123 - DNA, 22 bp, Artificial Sequence
  chemically synthesized
ctaaatcagtaggtctgaagat

SEQ ID NO: 1139124 - DNA, 22 bp, Artificial Sequence
  chemically synthesized
taaatcagtaggtctgaagatg

SEQ ID NO: 1139125 - DNA, 22 bp, Artificial Sequence
  chemically synthesized
aatcagtaggtctgaagatggc

SEQ ID NO: 1139126 - DNA, 22 bp, Artificial Sequence
  chemically synthesized
ggaatgcacattgttaggccat

SEQ ID NO: 1139127 - DNA, 22 bp, Artificial Sequence
  chemically synthesized
ttaggaatgcacattgttaggc

SEQ ID NO: 1139128 - DNA, 22 bp, Artificial Sequence
  chemically synthesized
gttaggaatgcacattgttagg

SEQ ID NO: 1139129 - DNA, 22 bp, Artificial Sequence
  chemically synthesized
aagatggcctaacaatgtgcat

SEQ ID NO: 1139130 - DNA, 22 bp, Artificial Sequence
  chemically synthesized
acaatgtgcattcctaacaaat

SEQ ID NO: 1139131 - DNA, 22 bp, Artificial Sequence
  chemically synthesized
ctaacaaatttccttgatactg

SEQ ID NO: 1139132 - DNA, 22 bp, Artificial Sequence
  chemically synthesized
acaaatttccttgatactgatg

SEQ ID NO: 1139133 - DNA, 22 bp, Artificial Sequence
  chemically synthesized
ccccgaccggcagcatcagtat

SEQ ID NO: 1139134 - DNA, 22 bp, Artificial Sequence
  chemically synthesized
ccttgatactgatgctgccggt

SEQ ID NO: 1139135 - DNA, 22 bp, Artificial Sequence
  chemically synthesized
cttgatactgatgctgccggtc

SEQ ID NO: 1139136 - DNA, 22 bp, Artificial Sequence
  chemically synthesized
gatactgatgctgccggtcggg

SEQ ID NO: 1139137 - DNA, 22 bp, Artificial Sequence
  chemically synthesized
aaaatgtgttcccccgaccggc

SEQ ID NO: 1139138 - DNA, 22 bp, Artificial Sequence
  chemically synthesized
atactgatgctgccggtcgggg

SEQ ID NO: 1139139 - DNA, 22 bp, Artificial Sequence
  chemically synthesized
tcaaaatgtgttcccccgaccg

SEQ ID NO: 1139140 - DNA, 22 bp, Artificial Sequence
  chemically synthesized
ctcaaaatgtgttcccccgacc

SEQ ID NO: 1139141 - DNA, 22 bp, Artificial Sequence
  chemically synthesized
atgctgccggtcgggggaacac

SEQ ID NO: 1139142 - DNA, 22 bp, Artificial Sequence
  chemically synthesized
ccggtcgggggaacacattttg

SEQ ID NO: 1139143 - DNA, 22 bp, Artificial Sequence
  chemically synthesized
agacaggatcaatgcttctcaa

SEQ ID NO: 1139144 - DNA, 22 bp, Artificial Sequence
  chemically synthesized
attcagacaggatcaatgcttc

SEQ ID NO: 1139145 - DNA, 22 bp, Artificial Sequence
  chemically synthesized
tgagaagcattgatcctgtctg

SEQ ID NO: 1139146 - DNA, 22 bp, Artificial Sequence
  chemically synthesized
aaataattaattcagacaggat

SEQ ID NO: 1139147 - DNA, 22 bp, Artificial Sequence
  chemically synthesized
gagaagcattgatcctgtctga

SEQ ID NO: 1139148 - DNA, 22 bp, Artificial Sequence
  chemically synthesized
agaagcattgatcctgtctgaa

SEQ ID NO: 1139149 - DNA, 22 bp, Artificial Sequence
  chemically synthesized
ggatggccctcaaataattaat

SEQ ID NO: 1139150 - DNA, 22 bp, Artificial Sequence
  chemically synthesized
atcctgtctgaattaattattt

SEQ ID NO: 1139151 - DNA, 22 bp, Artificial Sequence
  chemically synthesized
ctgggatggccctcaaataatt

SEQ ID NO: 1139152 - DNA, 22 bp, Artificial Sequence
  chemically synthesized
tctgaattaattatttgagggc

SEQ ID NO: 1139153 - DNA, 22 bp, Artificial Sequence
  chemically synthesized
aactcctgggatggccctcaaa

SEQ ID NO: 1139154 - DNA, 22 bp, Artificial Sequence
  chemically synthesized
aattaattatttgagggccatc

SEQ ID NO: 1139155 - DNA, 22 bp, Artificial Sequence
  chemically synthesized
cctcaactcctgggatggccct

SEQ ID NO: 1139156 - DNA, 22 bp, Artificial Sequence
  chemically synthesized
acctcaactcctgggatggccc

SEQ ID NO: 1139157 - DNA, 22 bp, Artificial Sequence
  chemically synthesized
tacctcaactcctgggatggcc

SEQ ID NO: 1139158 - DNA, 22 bp, Artificial Sequence
  chemically synthesized
attatttgagggccatcccagg

SEQ ID NO: 1139159 - DNA, 22 bp, Artificial Sequence
  chemically synthesized
cctttacctcaactcctgggat

SEQ ID NO: 1139160 - DNA, 22 bp, Artificial Sequence
  chemically synthesized
tttgagggccatcccaggagtt

SEQ ID NO: 1139161 - DNA, 22 bp, Artificial Sequence
  chemically synthesized
ctacctttacctcaactcctgg

SEQ ID NO: 1139162 - DNA, 22 bp, Artificial Sequence
  chemically synthesized
gctacctttacctcaactcctg

SEQ ID NO: 1139163 - DNA, 22 bp, Artificial Sequence
  chemically synthesized
gagggccatcccaggagttgag

SEQ ID NO: 1139164 - DNA, 22 bp, Artificial Sequence
  chemically synthesized
agggccatcccaggagttgagg

SEQ ID NO: 1139165 - DNA, 22 bp, Artificial Sequence
  chemically synthesized
acttgctacctttacctcaact

SEQ ID NO: 1139166 - DNA, 22 bp, Artificial Sequence
  chemically synthesized
gacttgctacctttacctcaac

SEQ ID NO: 1139167 - DNA, 22 bp, Artificial Sequence
  chemically synthesized
tttgacttgctacctttacctc

SEQ ID NO: 1139168 - DNA, 22 bp, Artificial Sequence
  chemically synthesized
ctgtttgacttgctacctttac

SEQ ID NO: 1139169 - DNA, 22 bp, Artificial Sequence
  chemically synthesized
agcaagttcctgtttgacttgc

SEQ ID NO: 1139170 - DNA, 22 bp, Artificial Sequence
  chemically synthesized
aggtaaaggtagcaagtcaaac

SEQ ID NO: 1139171 - DNA, 22 bp, Artificial Sequence
  chemically synthesized
atggtaactgagcaagttcctg

SEQ ID NO: 1139172 - DNA, 22 bp, Artificial Sequence
  chemically synthesized
gctcagttaccatgagcacttc

SEQ ID NO: 1139173 - DNA, 22 bp, Artificial Sequence
  chemically synthesized
ctcagttaccatgagcacttca

SEQ ID NO: 1139174 - DNA, 22 bp, Artificial Sequence
  chemically synthesized
agttaccatgagcacttcatcc

SEQ ID NO: 1139175 - DNA, 22 bp, Artificial Sequence
  chemically synthesized
tgggatcaaaggacatggatga

SEQ ID NO: 1139176 - DNA, 22 bp, Artificial Sequence
  chemically synthesized
ccatgagcacttcatccatgtc

SEQ ID NO: 1139177 - DNA, 22 bp, Artificial Sequence
  chemically synthesized
aaatggctgtgggatcaaagga

SEQ ID NO: 1139178 - DNA, 22 bp, Artificial Sequence
  chemically synthesized
tcaaatggctgtgggatcaaag

SEQ ID NO: 1139179 - DNA, 22 bp, Artificial Sequence
  chemically synthesized
catccatgtcctttgatcccac

SEQ ID NO: 1139180 - DNA, 22 bp, Artificial Sequence
  chemically synthesized
atccatgtcctttgatcccaca

SEQ ID NO: 1139181 - DNA, 22 bp, Artificial Sequence
  chemically synthesized
aagatattctcaaatggctgtg

SEQ ID NO: 1139182 - DNA, 22 bp, Artificial Sequence
  chemically synthesized
tgatcccacagccatttgagaa

SEQ ID NO: 1139183 - DNA, 22 bp, Artificial Sequence
  chemically synthesized
gatcccacagccatttgagaat

SEQ ID NO: 1139184 - DNA, 22 bp, Artificial Sequence
  chemically synthesized
ggaattgaagatattctcaaat

SEQ ID NO: 1139185 - DNA, 22 bp, Artificial Sequence
  chemically synthesized
atcccacagccatttgagaata

SEQ ID NO: 1139186 - DNA, 22 bp, Artificial Sequence
  chemically synthesized
aggaattgaagatattctcaaa

SEQ ID NO: 1139187 - DNA, 22 bp, Artificial Sequence
  chemically synthesized
cagaagtacttaggaattgaag

SEQ ID NO: 1139188 - DNA, 22 bp, Artificial Sequence
  chemically synthesized
gagaatatcttcaattcctaag

SEQ ID NO: 1139189 - DNA, 22 bp, Artificial Sequence
  chemically synthesized
agaatatcttcaattcctaagt

SEQ ID NO: 1139190 - DNA, 22 bp, Artificial Sequence
  chemically synthesized
caattcctaagtacttctgtag

SEQ ID NO: 1139191 - DNA, 22 bp, Artificial Sequence
  chemically synthesized
aattcctaagtacttctgtagc

SEQ ID NO: 1139192 - DNA, 22 bp, Artificial Sequence
  chemically synthesized
tggtatataagggctacagaag

SEQ ID NO: 1139193 - DNA, 22 bp, Artificial Sequence
  chemically synthesized
ctaagtacttctgtagccctta

SEQ ID NO: 1139194 - DNA, 22 bp, Artificial Sequence
  chemically synthesized
agtacttctgtagcccttatat

SEQ ID NO: 1139195 - DNA, 22 bp, Artificial Sequence
  chemically synthesized
ctgtagcccttatataccataa

SEQ ID NO: 1139196 - DNA, 22 bp, Artificial Sequence
  chemically synthesized
tgtagcccttatataccataat

SEQ ID NO: 1139197 - DNA, 22 bp, Artificial Sequence
  chemically synthesized
tagcccttatataccataatct

SEQ ID NO: 1139198 - DNA, 22 bp, Artificial Sequence
  chemically synthesized
atataccataatctcttggatc

SEQ ID NO: 1139199 - DNA, 22 bp, Artificial Sequence
  chemically synthesized
gggaagcagggtgatccaagag

SEQ ID NO: 1139200 - DNA, 22 bp, Artificial Sequence
  chemically synthesized
tataccataatctcttggatca

SEQ ID NO: 1139201 - DNA, 22 bp, Artificial Sequence
  chemically synthesized
tggggaagcagggtgatccaag

SEQ ID NO: 1139202 - DNA, 22 bp, Artificial Sequence
  chemically synthesized
ttggatcaccctgcttccccag

SEQ ID NO: 1139203 - DNA, 22 bp, Artificial Sequence
  chemically synthesized
gggaaggacagctctggggaag

SEQ ID NO: 1139204 - DNA, 22 bp, Artificial Sequence
  chemically synthesized
ggatcaccctgcttccccagag

SEQ ID NO: 1139205 - DNA, 22 bp, Artificial Sequence
  chemically synthesized
gatcaccctgcttccccagagc

SEQ ID NO: 1139206 - DNA, 22 bp, Artificial Sequence
  chemically synthesized
ctggggaaggacagctctgggg

SEQ ID NO: 1139207 - DNA, 22 bp, Artificial Sequence
  chemically synthesized
gctggggaaggacagctctggg

SEQ ID NO: 1139208 - DNA, 22 bp, Artificial Sequence
  chemically synthesized
gcgtttgctggggaaggacagc

SEQ ID NO: 1139209 - DNA, 22 bp, Artificial Sequence
  chemically synthesized
cttccccagagctgtccttccc

SEQ ID NO: 1139210 - DNA, 22 bp, Artificial Sequence
  chemically synthesized
ttggcgtttgctggggaaggac

SEQ ID NO: 1139211 - DNA, 22 bp, Artificial Sequence
  chemically synthesized
ccccagagctgtccttccccag

SEQ ID NO: 1139212 - DNA, 22 bp, Artificial Sequence
  chemically synthesized
cccagagctgtccttccccagc

SEQ ID NO: 1139213 - DNA, 22 bp, Artificial Sequence
  chemically synthesized
tggggactgttggcgtttgctg

SEQ ID NO: 1139214 - DNA, 22 bp, Artificial Sequence
  chemically synthesized
ctgtggggactgttggcgtttg

SEQ ID NO: 1139215 - DNA, 22 bp, Artificial Sequence
  chemically synthesized
tccttccccagcaaacgccaac

SEQ ID NO: 1139216 - DNA, 22 bp, Artificial Sequence
  chemically synthesized
tgctgtggggactgttggcgtt

SEQ ID NO: 1139217 - DNA, 22 bp, Artificial Sequence
  chemically synthesized
ctgctgtggggactgttggcgt

SEQ ID NO: 1139218 - DNA, 22 bp, Artificial Sequence
  chemically synthesized
ccccagcaaacgccaacagtcc

SEQ ID NO: 1139219 - DNA, 22 bp, Artificial Sequence
  chemically synthesized
cccagcaaacgccaacagtccc

SEQ ID NO: 1139220 - DNA, 22 bp, Artificial Sequence
  chemically synthesized
agtaaatgtatttctgctgtgg

SEQ ID NO: 1139221 - DNA, 22 bp, Artificial Sequence
  chemically synthesized
ctgagtaaatgtatttctgctg

SEQ ID NO: 1139222 - DNA, 22 bp, Artificial Sequence
  chemically synthesized
ttcctgagtaaatgtatttctg

SEQ ID NO: 1139223 - DNA, 22 bp, Artificial Sequence
  chemically synthesized
actcaggaacaggtttcttctt

SEQ ID NO: 1139224 - DNA, 22 bp, Artificial Sequence
  chemically synthesized
ctcaggaacaggtttcttcttg

SEQ ID NO: 1139225 - DNA, 22 bp, Artificial Sequence
  chemically synthesized
aggaacaggtttcttcttgact

SEQ ID NO: 1139226 - DNA, 22 bp, Artificial Sequence
  chemically synthesized
tcgtgggaagatccaagtcaag

SEQ ID NO: 1139227 - DNA, 22 bp, Artificial Sequence
  chemically synthesized
cttcttgacttggatcttccca

SEQ ID NO: 1139228 - DNA, 22 bp, Artificial Sequence
  chemically synthesized
ttcttgacttggatcttcccac

SEQ ID NO: 1139229 - DNA, 22 bp, Artificial Sequence
  chemically synthesized
cttgacttggatcttcccacga

SEQ ID NO: 1139230 - DNA, 22 bp, Artificial Sequence
  chemically synthesized
ttgacttggatcttcccacgat

SEQ ID NO: 1139231 - DNA, 22 bp, Artificial Sequence
  chemically synthesized
gacttggatcttcccacgataa

SEQ ID NO: 1139232 - DNA, 22 bp, Artificial Sequence
  chemically synthesized
acttggatcttcccacgataat

SEQ ID NO: 1139233 - DNA, 22 bp, Artificial Sequence
  chemically synthesized
tagaatcacgtaaattatcgtg

SEQ ID NO: 1139234 - DNA, 22 bp, Artificial Sequence
  chemically synthesized
gtagaatcacgtaaattatcgt

SEQ ID NO: 1139235 - DNA, 22 bp, Artificial Sequence
  chemically synthesized
ggatcttcccacgataatttac

SEQ ID NO: 1139236 - DNA, 22 bp, Artificial Sequence
  chemically synthesized
gatcttcccacgataatttacg

SEQ ID NO: 1139237 - DNA, 22 bp, Artificial Sequence
  chemically synthesized
taagacttgtagaatcacgtaa

SEQ ID NO: 1139238 - DNA, 22 bp, Artificial Sequence
  chemically synthesized
cccacgataatttacgtgattc

SEQ ID NO: 1139239 - DNA, 22 bp, Artificial Sequence
  chemically synthesized
ccacgataatttacgtgattct

SEQ ID NO: 1139240 - DNA, 22 bp, Artificial Sequence
  chemically synthesized
tgaggtgaattataagacttgt

SEQ ID NO: 1139241 - DNA, 22 bp, Artificial Sequence
  chemically synthesized
atgaggtgaattataagacttg

SEQ ID NO: 1139242 - DNA, 22 bp, Artificial Sequence
  chemically synthesized
acgtgattctacaagtcttata

SEQ ID NO: 1139243 - DNA, 22 bp, Artificial Sequence
  chemically synthesized
tatgaggtgaattataagactt

SEQ ID NO: 1139244 - DNA, 22 bp, Artificial Sequence
  chemically synthesized
cgtgattctacaagtcttataa

SEQ ID NO: 1139245 - DNA, 22 bp, Artificial Sequence
  chemically synthesized
ttatgaggtgaattataagact

SEQ ID NO: 1139246 - DNA, 22 bp, Artificial Sequence
  chemically synthesized
tacaagtcttataattcacctc

SEQ ID NO: 1139247 - DNA, 22 bp, Artificial Sequence
  chemically synthesized
caagtcttataattcacctcat

SEQ ID NO: 1139248 - DNA, 22 bp, Artificial Sequence
  chemically synthesized
ataattcacctcataaaagcta

SEQ ID NO: 1139249 - DNA, 22 bp, Artificial Sequence
  chemically synthesized
taattcacctcataaaagctac

SEQ ID NO: 1139250 - DNA, 22 bp, Artificial Sequence
  chemically synthesized
acctcataaaagctactgtttc

SEQ ID NO: 1139251 - DNA, 22 bp, Artificial Sequence
  chemically synthesized
ataaaagctactgtttcttctt

SEQ ID NO: 1139252 - DNA, 22 bp, Artificial Sequence
  chemically synthesized
ctgtttcttctttcccttcatt

SEQ ID NO: 1139253 - DNA, 22 bp, Artificial Sequence
  chemically synthesized
gcatcagggataaaaatgaagg

SEQ ID NO: 1139254 - DNA, 22 bp, Artificial Sequence
  chemically synthesized
tttcttctttcccttcattttt

SEQ ID NO: 1139255 - DNA, 22 bp, Artificial Sequence
  chemically synthesized
ggcatcagggataaaaatgaag

SEQ ID NO: 1139256 - DNA, 22 bp, Artificial Sequence
  chemically synthesized
cttctttcccttcatttttatc

SEQ ID NO: 1139257 - DNA, 22 bp, Artificial Sequence
  chemically synthesized
ttctttcccttcatttttatcc

SEQ ID NO: 1139258 - DNA, 22 bp, Artificial Sequence
  chemically synthesized
atttggcatcagggataaaaat

SEQ ID NO: 1139259 - DNA, 22 bp, Artificial Sequence
  chemically synthesized
ctttcccttcatttttatccct

SEQ ID NO: 1139260 - DNA, 22 bp, Artificial Sequence
  chemically synthesized
tttcccttcatttttatccctg

SEQ ID NO: 1139261 - DNA, 22 bp, Artificial Sequence
  chemically synthesized
tcccttcatttttatccctgat

SEQ ID NO: 1139262 - DNA, 22 bp, Artificial Sequence
  chemically synthesized
aactgatttggcatcagggata

SEQ ID NO: 1139263 - DNA, 22 bp, Artificial Sequence
  chemically synthesized
cccttcatttttatccctgatg

SEQ ID NO: 1139264 - DNA, 22 bp, Artificial Sequence
  chemically synthesized
aaactgatttggcatcagggat

SEQ ID NO: 1139265 - DNA, 22 bp, Artificial Sequence
  chemically synthesized
ccttcatttttatccctgatgc

SEQ ID NO: 1139266 - DNA, 22 bp, Artificial Sequence
  chemically synthesized
taaactgatttggcatcaggga

SEQ ID NO: 1139267 - DNA, 22 bp, Artificial Sequence
  chemically synthesized
catttttatccctgatgccaaa

SEQ ID NO: 1139268 - DNA, 22 bp, Artificial Sequence
  chemically synthesized
atttttatccctgatgccaaat

SEQ ID NO: 1139269 - DNA, 22 bp, Artificial Sequence
  chemically synthesized
agttttaaactgatttggcatc

SEQ ID NO: 1139270 - DNA, 22 bp, Artificial Sequence
  chemically synthesized
aagttttaaactgatttggcat

SEQ ID NO: 1139271 - DNA, 22 bp, Artificial Sequence
  chemically synthesized
ttatccctgatgccaaatcagt

SEQ ID NO: 1139272 - DNA, 22 bp, Artificial Sequence
  chemically synthesized
tatccctgatgccaaatcagtt

SEQ ID NO: 1139273 - DNA, 22 bp, Artificial Sequence
  chemically synthesized
atttaagttttaaactgatttg

SEQ ID NO: 1139274 - DNA, 22 bp, Artificial Sequence
  chemically synthesized
atccctgatgccaaatcagttt

SEQ ID NO: 1139275 - DNA, 22 bp, Artificial Sequence
  chemically synthesized
tccctgatgccaaatcagttta

SEQ ID NO: 1139276 - DNA, 22 bp, Artificial Sequence
  chemically synthesized
atgccaaatcagtttaaaactt

SEQ ID NO: 1139277 - DNA, 22 bp, Artificial Sequence
  chemically synthesized
taatcaaaactgatttaagttt

SEQ ID NO: 1139278 - DNA, 22 bp, Artificial Sequence
  chemically synthesized
ataatcaaaactgatttaagtt

SEQ ID NO: 1139279 - DNA, 22 bp, Artificial Sequence
  chemically synthesized
tataatcaaaactgatttaagt

SEQ ID NO: 1139280 - DNA, 22 bp, Artificial Sequence
  chemically synthesized
ttataatcaaaactgatttaag

SEQ ID NO: 1139281 - DNA, 22 bp, Artificial Sequence
  chemically synthesized
tttataatcaaaactgatttaa

SEQ ID NO: 1139282 - DNA, 22 bp, Artificial Sequence
  chemically synthesized
ttttttataatcaaaactgatt

SEQ ID NO: 1139283 - DNA, 22 bp, Artificial Sequence
  chemically synthesized
ttattttttataatcaaaactg

SEQ ID NO: 1139284 - DNA, 22 bp, Artificial Sequence
  chemically synthesized
aaaacttaaatcagttttgatt

SEQ ID NO: 1139285 - DNA, 22 bp, Artificial Sequence
  chemically synthesized
aaacttaaatcagttttgatta

SEQ ID NO: 1139286 - DNA, 22 bp, Artificial Sequence
  chemically synthesized
aaatcagttttgattataaaaa

SEQ ID NO: 1139287 - DNA, 22 bp, Artificial Sequence
  chemically synthesized
aatcagttttgattataaaaaa

SEQ ID NO: 1139288 - DNA, 22 bp, Artificial Sequence
  chemically synthesized
tgattataaaaaataatagatc

SEQ ID NO: 1139289 - DNA, 22 bp, Artificial Sequence
  chemically synthesized
gattataaaaaataatagatct

SEQ ID NO: 1139290 - DNA, 22 bp, Artificial Sequence
  chemically synthesized
attataaaaaataatagatcta

SEQ ID NO: 1139291 - DNA, 22 bp, Artificial Sequence
  chemically synthesized
atatccaaatcatgtagatcta

SEQ ID NO: 1139292 - DNA, 22 bp, Artificial Sequence
  chemically synthesized
taaaaaataatagatctacatg

SEQ ID NO: 1139293 - DNA, 22 bp, Artificial Sequence
  chemically synthesized
ggattcatatccaaatcatgta

SEQ ID NO: 1139294 - DNA, 22 bp, Artificial Sequence
  chemically synthesized
gggattcatatccaaatcatgt

SEQ ID NO: 1139295 - DNA, 22 bp, Artificial Sequence
  chemically synthesized
tgggattcatatccaaatcatg

SEQ ID NO: 1139296 - DNA, 22 bp, Artificial Sequence
  chemically synthesized
gatctttgggattcatatccaa

SEQ ID NO: 1139297 - DNA, 22 bp, Artificial Sequence
  chemically synthesized
tagatctttgggattcatatcc

SEQ ID NO: 1139298 - DNA, 22 bp, Artificial Sequence
  chemically synthesized
ctctagatctttgggattcata

SEQ ID NO: 1139299 - DNA, 22 bp, Artificial Sequence
  chemically synthesized
catgatttggatatgaatccca

SEQ ID NO: 1139300 - DNA, 22 bp, Artificial Sequence
  chemically synthesized
gctctagatctttgggattcat

SEQ ID NO: 1139301 - DNA, 22 bp, Artificial Sequence
  chemically synthesized
atttgctctagatctttgggat

SEQ ID NO: 1139302 - DNA, 22 bp, Artificial Sequence
  chemically synthesized
aatttgctctagatctttggga

SEQ ID NO: 1139303 - DNA, 22 bp, Artificial Sequence
  chemically synthesized
ggatatgaatcccaaagatcta

SEQ ID NO: 1139304 - DNA, 22 bp, Artificial Sequence
  chemically synthesized
gatatgaatcccaaagatctag

SEQ ID NO: 1139305 - DNA, 22 bp, Artificial Sequence
  chemically synthesized
tgacatttaatttgctctagat

SEQ ID NO: 1139306 - DNA, 22 bp, Artificial Sequence
  chemically synthesized
gagcaaattaaatgtcataatc

SEQ ID NO: 1139307 - DNA, 22 bp, Artificial Sequence
  chemically synthesized
aggtgggaggtggggattatga

SEQ ID NO: 1139308 - DNA, 22 bp, Artificial Sequence
  chemically synthesized
ccattgaggtgggaggtgggga

SEQ ID NO: 1139309 - DNA, 22 bp, Artificial Sequence
  chemically synthesized
gccattgaggtgggaggtgggg

SEQ ID NO: 1139310 - DNA, 22 bp, Artificial Sequence
  chemically synthesized
aatgtcataatccccacctccc

SEQ ID NO: 1139311 - DNA, 22 bp, Artificial Sequence
  chemically synthesized
cttgccattgaggtgggaggtg

SEQ ID NO: 1139312 - DNA, 22 bp, Artificial Sequence
  chemically synthesized
tgtcctgcttgccattgaggtg

SEQ ID NO: 1139313 - DNA, 22 bp, Artificial Sequence
  chemically synthesized
ccacctcaatggcaagcaggac

SEQ ID NO: 1139314 - DNA, 22 bp, Artificial Sequence
  chemically synthesized
ataacccatgggattgtgtcct

SEQ ID NO: 1139315 - DNA, 22 bp, Artificial Sequence
  chemically synthesized
aatggcaagcaggacacaatcc

SEQ ID NO: 1139316 - DNA, 22 bp, Artificial Sequence
  chemically synthesized
aaaatagtatcactgataaccc

SEQ ID NO: 1139317 - DNA, 22 bp, Artificial Sequence
  chemically synthesized
caaaatagtatcactgataacc

SEQ ID NO: 1139318 - DNA, 22 bp, Artificial Sequence
  chemically synthesized
tttcaaaatagtatcactgata

SEQ ID NO: 1139319 - DNA, 22 bp, Artificial Sequence
  chemically synthesized
gtttcaaaatagtatcactgat

SEQ ID NO: 1139320 - DNA, 22 bp, Artificial Sequence
  chemically synthesized
tcagtgatactattttgaaaca

SEQ ID NO: 1139321 - DNA, 22 bp, Artificial Sequence
  chemically synthesized
caataagtgtaatttgtttcaa

SEQ ID NO: 1139322 - DNA, 22 bp, Artificial Sequence
  chemically synthesized
acaataagtgtaatttgtttca

SEQ ID NO: 1139323 - DNA, 22 bp, Artificial Sequence
  chemically synthesized
tacaataagtgtaatttgtttc

SEQ ID NO: 1139324 - DNA, 22 bp, Artificial Sequence
  chemically synthesized
tttacaataagtgtaatttgtt

SEQ ID NO: 1139325 - DNA, 22 bp, Artificial Sequence
  chemically synthesized
tctttacaataagtgtaatttg

SEQ ID NO: 1139326 - DNA, 22 bp, Artificial Sequence
  chemically synthesized
ctctttacaataagtgtaattt

SEQ ID NO: 1139327 - DNA, 22 bp, Artificial Sequence
  chemically synthesized
ttctctttacaataagtgtaat

SEQ ID NO: 1139328 - DNA, 22 bp, Artificial Sequence
  chemically synthesized
ttttgaaacaaattacacttat

SEQ ID NO: 1139329 - DNA, 22 bp, Artificial Sequence
  chemically synthesized
tcttctctttacaataagtgta

SEQ ID NO: 1139330 - DNA, 22 bp, Artificial Sequence
  chemically synthesized
tgaaacaaattacacttattgt

SEQ ID NO: 1139331 - DNA, 22 bp, Artificial Sequence
  chemically synthesized
gaaacaaattacacttattgta

SEQ ID NO: 1139332 - DNA, 22 bp, Artificial Sequence
  chemically synthesized
aaacaaattacacttattgtaa

SEQ ID NO: 1139333 - DNA, 22 bp, Artificial Sequence
  chemically synthesized
aactctcttctctttacaataa

SEQ ID NO: 1139334 - DNA, 22 bp, Artificial Sequence
  chemically synthesized
tgctaaactctcttctctttac

SEQ ID NO: 1139335 - DNA, 22 bp, Artificial Sequence
  chemically synthesized
cacttattgtaaagagaagaga

SEQ ID NO: 1139336 - DNA, 22 bp, Artificial Sequence
  chemically synthesized
attgtaaagagaagagagttta

SEQ ID NO: 1139337 - DNA, 22 bp, Artificial Sequence
  chemically synthesized
ttgtaaagagaagagagtttag

SEQ ID NO: 1139338 - DNA, 22 bp, Artificial Sequence
  chemically synthesized
taaagagaagagagtttagcac

SEQ ID NO: 1139339 - DNA, 22 bp, Artificial Sequence
  chemically synthesized
ggtatagatacactgtgctaaa

SEQ ID NO: 1139340 - DNA, 22 bp, Artificial Sequence
  chemically synthesized
catgtctaggtatagatacact

SEQ ID NO: 1139341 - DNA, 22 bp, Artificial Sequence
  chemically synthesized
actacatgtctaggtatagata

SEQ ID NO: 1139342 - DNA, 22 bp, Artificial Sequence
  chemically synthesized
cactacatgtctaggtatagat

SEQ ID NO: 1139343 - DNA, 22 bp, Artificial Sequence
  chemically synthesized
tcactacatgtctaggtataga

SEQ ID NO: 1139344 - DNA, 22 bp, Artificial Sequence
  chemically synthesized
agcacagtgtatctatacctag

SEQ ID NO: 1139345 - DNA, 22 bp, Artificial Sequence
  chemically synthesized
gcacagtgtatctatacctaga

SEQ ID NO: 1139346 - DNA, 22 bp, Artificial Sequence
  chemically synthesized
tcaccagttttcactacatgtc

SEQ ID NO: 1139347 - DNA, 22 bp, Artificial Sequence
  chemically synthesized
tacctagacatgtagtgaaaac

SEQ ID NO: 1139348 - DNA, 22 bp, Artificial Sequence
  chemically synthesized
gacatgtagtgaaaactggtga

SEQ ID NO: 1139349 - DNA, 22 bp, Artificial Sequence
  chemically synthesized
agacccaaaacaggtaccatct

SEQ ID NO: 1139350 - DNA, 22 bp, Artificial Sequence
  chemically synthesized
gtgacagatggtacctgttttg

SEQ ID NO: 1139351 - DNA, 22 bp, Artificial Sequence
  chemically synthesized
aaatatgtcacaatctgagacc

SEQ ID NO: 1139352 - DNA, 22 bp, Artificial Sequence
  chemically synthesized
attaaaatatgtcacaatctga

SEQ ID NO: 1139353 - DNA, 22 bp, Artificial Sequence
  chemically synthesized
ttttgggtctcagattgtgaca

SEQ ID NO: 1139354 - DNA, 22 bp, Artificial Sequence
  chemically synthesized
tgggtctcagattgtgacatat

SEQ ID NO: 1139355 - DNA, 22 bp, Artificial Sequence
  chemically synthesized
atgttcattaaaatatgtcaca

SEQ ID NO: 1139356 - DNA, 22 bp, Artificial Sequence
  chemically synthesized
gggtctcagattgtgacatatt

SEQ ID NO: 1139357 - DNA, 22 bp, Artificial Sequence
  chemically synthesized
aatgttcattaaaatatgtcac

SEQ ID NO: 1139358 - DNA, 22 bp, Artificial Sequence
  chemically synthesized
ggtctcagattgtgacatattt

SEQ ID NO: 1139359 - DNA, 22 bp, Artificial Sequence
  chemically synthesized
agattgtgacatattttaatga

SEQ ID NO: 1139360 - DNA, 22 bp, Artificial Sequence
  chemically synthesized
tgacatattttaatgaacatta

SEQ ID NO: 1139361 - DNA, 22 bp, Artificial Sequence
  chemically synthesized
aggcagtgaataagaatttaat

SEQ ID NO: 1139362 - DNA, 22 bp, Artificial Sequence
  chemically synthesized
taatgaacattaaattcttatt

SEQ ID NO: 1139363 - DNA, 22 bp, Artificial Sequence
  chemically synthesized
actcaggcagtgaataagaatt

SEQ ID NO: 1139364 - DNA, 22 bp, Artificial Sequence
  chemically synthesized
aatgaacattaaattcttattc

SEQ ID NO: 1139365 - DNA, 22 bp, Artificial Sequence
  chemically synthesized
atgaacattaaattcttattca

SEQ ID NO: 1139366 - DNA, 22 bp, Artificial Sequence
  chemically synthesized
ctgactcaggcagtgaataaga

SEQ ID NO: 1139367 - DNA, 22 bp, Artificial Sequence
  chemically synthesized
gctgactcaggcagtgaataag

SEQ ID NO: 1139368 - DNA, 22 bp, Artificial Sequence
  chemically synthesized
tgctgactcaggcagtgaataa

SEQ ID NO: 1139369 - DNA, 22 bp, Artificial Sequence
  chemically synthesized
ctttgctgactcaggcagtgaa

SEQ ID NO: 1139370 - DNA, 22 bp, Artificial Sequence
  chemically synthesized
aattcttattcactgcctgagt

SEQ ID NO: 1139371 - DNA, 22 bp, Artificial Sequence
  chemically synthesized
ttattcactgcctgagtcagca

SEQ ID NO: 1139372 - DNA, 22 bp, Artificial Sequence
  chemically synthesized
attcactgcctgagtcagcaaa

SEQ ID NO: 1139373 - DNA, 22 bp, Artificial Sequence
  chemically synthesized
aggtaaaattcctttgctgact

SEQ ID NO: 1139374 - DNA, 22 bp, Artificial Sequence
  chemically synthesized
ttcactgcctgagtcagcaaag

SEQ ID NO: 1139375 - DNA, 22 bp, Artificial Sequence
  chemically synthesized
gaggtaaaattcctttgctgac

SEQ ID NO: 1139376 - DNA, 22 bp, Artificial Sequence
  chemically synthesized
actgcctgagtcagcaaaggaa

SEQ ID NO: 1139377 - DNA, 22 bp, Artificial Sequence
  chemically synthesized
gaatttgaggtaaaattccttt

SEQ ID NO: 1139378 - DNA, 22 bp, Artificial Sequence
  chemically synthesized
cctgagtcagcaaaggaatttt

SEQ ID NO: 1139379 - DNA, 22 bp, Artificial Sequence
  chemically synthesized
agtcagcaaaggaattttacct

SEQ ID NO: 1139380 - DNA, 22 bp, Artificial Sequence
  chemically synthesized
gtctagaatttgaggtaaaatt

SEQ ID NO: 1139381 - DNA, 22 bp, Artificial Sequence
  chemically synthesized
acagctggtctagaatttgagg

SEQ ID NO: 1139382 - DNA, 22 bp, Artificial Sequence
  chemically synthesized
tacctcaaattctagaccagct

SEQ ID NO: 1139383 - DNA, 22 bp, Artificial Sequence
  chemically synthesized
acaaaacctgacagctggtcta

SEQ ID NO: 1139384 - DNA, 22 bp, Artificial Sequence
  chemically synthesized
acctcaaattctagaccagctg

SEQ ID NO: 1139385 - DNA, 22 bp, Artificial Sequence
  chemically synthesized
cctcaaattctagaccagctgt

SEQ ID NO: 1139386 - DNA, 22 bp, Artificial Sequence
  chemically synthesized
aaattctagaccagctgtcagg

SEQ ID NO: 1139387 - DNA, 22 bp, Artificial Sequence
  chemically synthesized
agccaattaacaaaacctgaca

SEQ ID NO: 1139388 - DNA, 22 bp, Artificial Sequence
  chemically synthesized
aagccaattaacaaaacctgac

SEQ ID NO: 1139389 - DNA, 22 bp, Artificial Sequence
  chemically synthesized
tagaccagctgtcaggttttgt

SEQ ID NO: 1139390 - DNA, 22 bp, Artificial Sequence
  chemically synthesized
gaccagctgtcaggttttgtta

SEQ ID NO: 1139391 - DNA, 22 bp, Artificial Sequence
  chemically synthesized
atagtttaagccaattaacaaa

SEQ ID NO: 1139392 - DNA, 22 bp, Artificial Sequence
  chemically synthesized
gatagtttaagccaattaacaa

SEQ ID NO: 1139393 - DNA, 22 bp, Artificial Sequence
  chemically synthesized
tcaggttttgttaattggctta

SEQ ID NO: 1139394 - DNA, 22 bp, Artificial Sequence
  chemically synthesized
tcatttgatagtttaagccaat

SEQ ID NO: 1139395 - DNA, 22 bp, Artificial Sequence
  chemically synthesized
gtcatttgatagtttaagccaa

SEQ ID NO: 1139396 - DNA, 22 bp, Artificial Sequence
  chemically synthesized
tgttaattggcttaaactatca

SEQ ID NO: 1139397 - DNA, 22 bp, Artificial Sequence
  chemically synthesized
gttaattggcttaaactatcaa

SEQ ID NO: 1139398 - DNA, 22 bp, Artificial Sequence
  chemically synthesized
ttaattggcttaaactatcaaa

SEQ ID NO: 1139399 - DNA, 22 bp, Artificial Sequence
  chemically synthesized
taggtcttgtcatttgatagtt

SEQ ID NO: 1139400 - DNA, 22 bp, Artificial Sequence
  chemically synthesized
tataggtcttgtcatttgatag

SEQ ID NO: 1139401 - DNA, 22 bp, Artificial Sequence
  chemically synthesized
attggcttaaactatcaaatga

SEQ ID NO: 1139402 - DNA, 22 bp, Artificial Sequence
  chemically synthesized
ctataggtcttgtcatttgata

SEQ ID NO: 1139403 - DNA, 22 bp, Artificial Sequence
  chemically synthesized
tctataggtcttgtcatttgat

SEQ ID NO: 1139404 - DNA, 22 bp, Artificial Sequence
  chemically synthesized
gcttaaactatcaaatgacaag

SEQ ID NO: 1139405 - DNA, 22 bp, Artificial Sequence
  chemically synthesized
aaactatcaaatgacaagacct

SEQ ID NO: 1139406 - DNA, 22 bp, Artificial Sequence
  chemically synthesized
aactatcaaatgacaagaccta

SEQ ID NO: 1139407 - DNA, 22 bp, Artificial Sequence
  chemically synthesized
tcaaatgacaagacctatagaa

SEQ ID NO: 1139408 - DNA, 22 bp, Artificial Sequence
  chemically synthesized
tgaacaaagagaaaatatgttt

SEQ ID NO: 1139409 - DNA, 22 bp, Artificial Sequence
  chemically synthesized
gtgaacaaagagaaaatatgtt

SEQ ID NO: 1139410 - DNA, 22 bp, Artificial Sequence
  chemically synthesized
cttgtgaacaaagagaaaatat

SEQ ID NO: 1139411 - DNA, 22 bp, Artificial Sequence
  chemically synthesized
gcttgtgaacaaagagaaaata

SEQ ID NO: 1139412 - DNA, 22 bp, Artificial Sequence
  chemically synthesized
tagaaaacatattttctctttg

SEQ ID NO: 1139413 - DNA, 22 bp, Artificial Sequence
  chemically synthesized
tgtcaccttgcttgtgaacaaa

SEQ ID NO: 1139414 - DNA, 22 bp, Artificial Sequence
  chemically synthesized
tgttatgtcaccttgcttgtga

SEQ ID NO: 1139415 - DNA, 22 bp, Artificial Sequence
  chemically synthesized
gtgttatgtcaccttgcttgtg

SEQ ID NO: 1139416 - DNA, 22 bp, Artificial Sequence
  chemically synthesized
tctctttgttcacaagcaaggt

SEQ ID NO: 1139417 - DNA, 22 bp, Artificial Sequence
  chemically synthesized
ctctttgttcacaagcaaggtg

SEQ ID NO: 1139418 - DNA, 22 bp, Artificial Sequence
  chemically synthesized
tctttgttcacaagcaaggtga

SEQ ID NO: 1139419 - DNA, 22 bp, Artificial Sequence
  chemically synthesized
tttgttcacaagcaaggtgaca

SEQ ID NO: 1139420 - DNA, 22 bp, Artificial Sequence
  chemically synthesized
aaatttgtgttatgtcaccttg

SEQ ID NO: 1139421 - DNA, 22 bp, Artificial Sequence
  chemically synthesized
tgttcacaagcaaggtgacata

SEQ ID NO: 1139422 - DNA, 22 bp, Artificial Sequence
  chemically synthesized
gttcacaagcaaggtgacataa

SEQ ID NO: 1139423 - DNA, 22 bp, Artificial Sequence
  chemically synthesized
ttcacaagcaaggtgacataac

SEQ ID NO: 1139424 - DNA, 22 bp, Artificial Sequence
  chemically synthesized
acaagcaaggtgacataacaca

SEQ ID NO: 1139425 - DNA, 22 bp, Artificial Sequence
  chemically synthesized
caataggattaaaatttgtgtt

SEQ ID NO: 1139426 - DNA, 22 bp, Artificial Sequence
  chemically synthesized
ccaataggattaaaatttgtgt

SEQ ID NO: 1139427 - DNA, 22 bp, Artificial Sequence
  chemically synthesized
tccaataggattaaaatttgtg

SEQ ID NO: 1139428 - DNA, 22 bp, Artificial Sequence
  chemically synthesized
agaaagtcaataattttccaat

SEQ ID NO: 1139429 - DNA, 22 bp, Artificial Sequence
  chemically synthesized
aagaaagtcaataattttccaa

SEQ ID NO: 1139430 - DNA, 22 bp, Artificial Sequence
  chemically synthesized
taagaaagtcaataattttcca

SEQ ID NO: 1139431 - DNA, 22 bp, Artificial Sequence
  chemically synthesized
ttaagaaagtcaataattttcc

SEQ ID NO: 1139432 - DNA, 22 bp, Artificial Sequence
  chemically synthesized
taatcctattggaaaattattg

SEQ ID NO: 1139433 - DNA, 22 bp, Artificial Sequence
  chemically synthesized
ttttaagaaagtcaataatttt

SEQ ID NO: 1139434 - DNA, 22 bp, Artificial Sequence
  chemically synthesized
aatcctattggaaaattattga

SEQ ID NO: 1139435 - DNA, 22 bp, Artificial Sequence
  chemically synthesized
atcctattggaaaattattgac

SEQ ID NO: 1139436 - DNA, 22 bp, Artificial Sequence
  chemically synthesized
ttggaaaattattgactttctt

SEQ ID NO: 1139437 - DNA, 22 bp, Artificial Sequence
  chemically synthesized
gaaaattattgactttcttaaa

SEQ ID NO: 1139438 - DNA, 22 bp, Artificial Sequence
  chemically synthesized
agggccataaaaatgctctttt

SEQ ID NO: 1139439 - DNA, 22 bp, Artificial Sequence
  chemically synthesized
ttgactttcttaaaagagcatt

SEQ ID NO: 1139440 - DNA, 22 bp, Artificial Sequence
  chemically synthesized
actttcttaaaagagcattttt

SEQ ID NO: 1139441 - DNA, 22 bp, Artificial Sequence
  chemically synthesized
gcctcagggccataaaaatgct

SEQ ID NO: 1139442 - DNA, 22 bp, Artificial Sequence
  chemically synthesized
tcttaaaagagcatttttatgg

SEQ ID NO: 1139443 - DNA, 22 bp, Artificial Sequence
  chemically synthesized
cttaaaagagcatttttatggc

SEQ ID NO: 1139444 - DNA, 22 bp, Artificial Sequence
  chemically synthesized
gctagcctcagggccataaaaa

SEQ ID NO: 1139445 - DNA, 22 bp, Artificial Sequence
  chemically synthesized
ttaaaagagcatttttatggcc

SEQ ID NO: 1139446 - DNA, 22 bp, Artificial Sequence
  chemically synthesized
ggctagcctcagggccataaaa

SEQ ID NO: 1139447 - DNA, 22 bp, Artificial Sequence
  chemically synthesized
aaaagagcatttttatggccct

SEQ ID NO: 1139448 - DNA, 22 bp, Artificial Sequence
  chemically synthesized
aaagagcatttttatggccctg

SEQ ID NO: 1139449 - DNA, 22 bp, Artificial Sequence
  chemically synthesized
ttatggccctgaggctagccaa

SEQ ID NO: 1139450 - DNA, 22 bp, Artificial Sequence
  chemically synthesized
tgagcagaaatcttggctagcc

SEQ ID NO: 1139451 - DNA, 22 bp, Artificial Sequence
  chemically synthesized
tatggccctgaggctagccaag

SEQ ID NO: 1139452 - DNA, 22 bp, Artificial Sequence
  chemically synthesized
gtgagcagaaatcttggctagc

SEQ ID NO: 1139453 - DNA, 22 bp, Artificial Sequence
  chemically synthesized
atggccctgaggctagccaaga

SEQ ID NO: 1139454 - DNA, 22 bp, Artificial Sequence
  chemically synthesized
tgtgagcagaaatcttggctag

SEQ ID NO: 1139455 - DNA, 22 bp, Artificial Sequence
  chemically synthesized
tggccctgaggctagccaagat

SEQ ID NO: 1139456 - DNA, 22 bp, Artificial Sequence
  chemically synthesized
ttgtgagcagaaatcttggcta

SEQ ID NO: 1139457 - DNA, 22 bp, Artificial Sequence
  chemically synthesized
acatttttgtgagcagaaatct

SEQ ID NO: 1139458 - DNA, 22 bp, Artificial Sequence
  chemically synthesized
aggctagccaagatttctgctc

SEQ ID NO: 1139459 - DNA, 22 bp, Artificial Sequence
  chemically synthesized
tgttaacatttttgtgagcaga

SEQ ID NO: 1139460 - DNA, 22 bp, Artificial Sequence
  chemically synthesized
tatgttaacatttttgtgagca

SEQ ID NO: 1139461 - DNA, 22 bp, Artificial Sequence
  chemically synthesized
gccaagatttctgctcacaaaa

SEQ ID NO: 1139462 - DNA, 22 bp, Artificial Sequence
  chemically synthesized
ctgctcacaaaaatgttaacat

SEQ ID NO: 1139463 - DNA, 22 bp, Artificial Sequence
  chemically synthesized
tgctcacaaaaatgttaacata

SEQ ID NO: 1139464 - DNA, 22 bp, Artificial Sequence
  chemically synthesized
ctcacaaaaatgttaacataga

SEQ ID NO: 1139465 - DNA, 22 bp, Artificial Sequence
  chemically synthesized
acaataatgtgcctctatgtta

SEQ ID NO: 1139466 - DNA, 22 bp, Artificial Sequence
  chemically synthesized
acaaaaatgttaacatagaggc

SEQ ID NO: 1139467 - DNA, 22 bp, Artificial Sequence
  chemically synthesized
taacaataatgtgcctctatgt

SEQ ID NO: 1139468 - DNA, 22 bp, Artificial Sequence
  chemically synthesized
ctaacaataatgtgcctctatg

SEQ ID NO: 1139469 - DNA, 22 bp, Artificial Sequence
  chemically synthesized
tcatttctaacaataatgtgcc

SEQ ID NO: 1139470 - DNA, 22 bp, Artificial Sequence
  chemically synthesized
acatagaggcacattattgtta

SEQ ID NO: 1139471 - DNA, 22 bp, Artificial Sequence
  chemically synthesized
agaactgtcatttctaacaata

SEQ ID NO: 1139472 - DNA, 22 bp, Artificial Sequence
  chemically synthesized
caactgagaactgtcatttcta

SEQ ID NO: 1139473 - DNA, 22 bp, Artificial Sequence
  chemically synthesized
ttgttagaaatgacagttctca

SEQ ID NO: 1139474 - DNA, 22 bp, Artificial Sequence
  chemically synthesized
ttagaaatgacagttctcagtt

SEQ ID NO: 1139475 - DNA, 22 bp, Artificial Sequence
  chemically synthesized
gaaaaaataactgcaactgaga

SEQ ID NO: 1139476 - DNA, 22 bp, Artificial Sequence
  chemically synthesized
gaaatgacagttctcagttgca

SEQ ID NO: 1139477 - DNA, 22 bp, Artificial Sequence
  chemically synthesized
ggaaaaaataactgcaactgag

SEQ ID NO: 1139478 - DNA, 22 bp, Artificial Sequence
  chemically synthesized
cttggaaaaaataactgcaact

SEQ ID NO: 1139479 - DNA, 22 bp, Artificial Sequence
  chemically synthesized
attccttggaaaaaataactgc

SEQ ID NO: 1139480 - DNA, 22 bp, Artificial Sequence
  chemically synthesized
tcagttgcagttattttttcca

SEQ ID NO: 1139481 - DNA, 22 bp, Artificial Sequence
  chemically synthesized
agttgcagttattttttccaag

SEQ ID NO: 1139482 - DNA, 22 bp, Artificial Sequence
  chemically synthesized
atatcagttgattccttggaaa

SEQ ID NO: 1139483 - DNA, 22 bp, Artificial Sequence
  chemically synthesized
cagttattttttccaaggaatc

SEQ ID NO: 1139484 - DNA, 22 bp, Artificial Sequence
  chemically synthesized
ttttttccaaggaatcaactga

SEQ ID NO: 1139485 - DNA, 22 bp, Artificial Sequence
  chemically synthesized
agtagtcctcatatcagttgat

SEQ ID NO: 1139486 - DNA, 22 bp, Artificial Sequence
  chemically synthesized
cagtagtcctcatatcagttga

SEQ ID NO: 1139487 - DNA, 22 bp, Artificial Sequence
  chemically synthesized
tttccaaggaatcaactgatat

SEQ ID NO: 1139488 - DNA, 22 bp, Artificial Sequence
  chemically synthesized
ttccaaggaatcaactgatatg

SEQ ID NO: 1139489 - DNA, 22 bp, Artificial Sequence
  chemically synthesized
tccaaggaatcaactgatatga

SEQ ID NO: 1139490 - DNA, 22 bp, Artificial Sequence
  chemically synthesized
tttcagtagtcctcatatcagt

SEQ ID NO: 1139491 - DNA, 22 bp, Artificial Sequence
  chemically synthesized
ccaaggaatcaactgatatgag

SEQ ID NO: 1139492 - DNA, 22 bp, Artificial Sequence
  chemically synthesized
caaggaatcaactgatatgagg

SEQ ID NO: 1139493 - DNA, 22 bp, Artificial Sequence
  chemically synthesized
aatctatttcagtagtcctcat

SEQ ID NO: 1139494 - DNA, 22 bp, Artificial Sequence
  chemically synthesized
caatctatttcagtagtcctca

SEQ ID NO: 1139495 - DNA, 22 bp, Artificial Sequence
  chemically synthesized
tcaatctatttcagtagtcctc

SEQ ID NO: 1139496 - DNA, 22 bp, Artificial Sequence
  chemically synthesized
atatgaggactactgaaataga

SEQ ID NO: 1139497 - DNA, 22 bp, Artificial Sequence
  chemically synthesized
aggtccaggcctttcaatctat

SEQ ID NO: 1139498 - DNA, 22 bp, Artificial Sequence
  chemically synthesized
ctgaaatagattgaaaggcctg

SEQ ID NO: 1139499 - DNA, 22 bp, Artificial Sequence
  chemically synthesized
aaatagattgaaaggcctggac

SEQ ID NO: 1139500 - DNA, 22 bp, Artificial Sequence
  chemically synthesized
agacatccagactcaggtccag

SEQ ID NO: 1139501 - DNA, 22 bp, Artificial Sequence
  chemically synthesized
aaaggcctggacctgagtctgg

SEQ ID NO: 1139502 - DNA, 22 bp, Artificial Sequence
  chemically synthesized
aaatgaacactaagacatccag

SEQ ID NO: 1139503 - DNA, 22 bp, Artificial Sequence
  chemically synthesized
aaaatgaacactaagacatcca

SEQ ID NO: 1139504 - DNA, 22 bp, Artificial Sequence
  chemically synthesized
gacctgagtctggatgtcttag

SEQ ID NO: 1139505 - DNA, 22 bp, Artificial Sequence
  chemically synthesized
agtctggatgtcttagtgttca

SEQ ID NO: 1139506 - DNA, 22 bp, Artificial Sequence
  chemically synthesized
gtatcagacttaaaatgaacac

SEQ ID NO: 1139507 - DNA, 22 bp, Artificial Sequence
  chemically synthesized
gatgtcttagtgttcattttaa

SEQ ID NO: 1139508 - DNA, 22 bp, Artificial Sequence
  chemically synthesized
caacattagtatcagacttaaa

SEQ ID NO: 1139509 - DNA, 22 bp, Artificial Sequence
  chemically synthesized
agtgttcattttaagtctgata

SEQ ID NO: 1139510 - DNA, 22 bp, Artificial Sequence
  chemically synthesized
gtgttcattttaagtctgatac

SEQ ID NO: 1139511 - DNA, 22 bp, Artificial Sequence
  chemically synthesized
tatcctacaacattagtatcag

SEQ ID NO: 1139512 - DNA, 22 bp, Artificial Sequence
  chemically synthesized
attttaagtctgatactaatgt

SEQ ID NO: 1139513 - DNA, 22 bp, Artificial Sequence
  chemically synthesized
taagtctgatactaatgttgta

SEQ ID NO: 1139514 - DNA, 22 bp, Artificial Sequence
  chemically synthesized
aagtctgatactaatgttgtag

SEQ ID NO: 1139515 - DNA, 22 bp, Artificial Sequence
  chemically synthesized
agtctgatactaatgttgtagg

SEQ ID NO: 1139516 - DNA, 22 bp, Artificial Sequence
  chemically synthesized
atactaatgttgtaggatacag

SEQ ID NO: 1139517 - DNA, 22 bp, Artificial Sequence
  chemically synthesized
atgttgtaggatacagatcctg

SEQ ID NO: 1139518 - DNA, 22 bp, Artificial Sequence
  chemically synthesized
taggatacagatcctgtgtttt

SEQ ID NO: 1139519 - DNA, 22 bp, Artificial Sequence
  chemically synthesized
caagagaaaatcgagatcaaga

SEQ ID NO: 1139520 - DNA, 22 bp, Artificial Sequence
  chemically synthesized
ccaagagaaaatcgagatcaag

SEQ ID NO: 1139521 - DNA, 22 bp, Artificial Sequence
  chemically synthesized
tttccaagagaaaatcgagatc

SEQ ID NO: 1139522 - DNA, 22 bp, Artificial Sequence
  chemically synthesized
tgttttttcttgatctcgattt

SEQ ID NO: 1139523 - DNA, 22 bp, Artificial Sequence
  chemically synthesized
gtttccaagagaaaatcgagat

SEQ ID NO: 1139524 - DNA, 22 bp, Artificial Sequence
  chemically synthesized
tttcttgatctcgattttctct

SEQ ID NO: 1139525 - DNA, 22 bp, Artificial Sequence
  chemically synthesized
agtttgtttccaagagaaaatc

SEQ ID NO: 1139526 - DNA, 22 bp, Artificial Sequence
  chemically synthesized
ttcttgatctcgattttctctt

SEQ ID NO: 1139527 - DNA, 22 bp, Artificial Sequence
  chemically synthesized
tcttgatctcgattttctcttg

SEQ ID NO: 1139528 - DNA, 22 bp, Artificial Sequence
  chemically synthesized
cttgatctcgattttctcttgg

SEQ ID NO: 1139529 - DNA, 22 bp, Artificial Sequence
  chemically synthesized
ctcagtttgtttccaagagaaa

SEQ ID NO: 1139530 - DNA, 22 bp, Artificial Sequence
  chemically synthesized
ttgatctcgattttctcttgga

SEQ ID NO: 1139531 - DNA, 22 bp, Artificial Sequence
  chemically synthesized
gatctcgattttctcttggaaa

SEQ ID NO: 1139532 - DNA, 22 bp, Artificial Sequence
  chemically synthesized
atctcgattttctcttggaaac

SEQ ID NO: 1139533 - DNA, 22 bp, Artificial Sequence
  chemically synthesized
gattttctcttggaaacaaact

SEQ ID NO: 1139534 - DNA, 22 bp, Artificial Sequence
  chemically synthesized
ggaccatctactcagtttgttt

SEQ ID NO: 1139535 - DNA, 22 bp, Artificial Sequence
  chemically synthesized
tctcttggaaacaaactgagta

SEQ ID NO: 1139536 - DNA, 22 bp, Artificial Sequence
  chemically synthesized
attaggaccatctactcagttt

SEQ ID NO: 1139537 - DNA, 22 bp, Artificial Sequence
  chemically synthesized
ctcttggaaacaaactgagtag

SEQ ID NO: 1139538 - DNA, 22 bp, Artificial Sequence
  chemically synthesized
tcttggaaacaaactgagtaga

SEQ ID NO: 1139539 - DNA, 22 bp, Artificial Sequence
  chemically synthesized
ttggaaacaaactgagtagatg

SEQ ID NO: 1139540 - DNA, 22 bp, Artificial Sequence
  chemically synthesized
ggaaacaaactgagtagatggt

SEQ ID NO: 1139541 - DNA, 22 bp, Artificial Sequence
  chemically synthesized
gaaacaaactgagtagatggtc

SEQ ID NO: 1139542 - DNA, 22 bp, Artificial Sequence
  chemically synthesized
cacatgtaaagttcattaggac

SEQ ID NO: 1139543 - DNA, 22 bp, Artificial Sequence
  chemically synthesized
agtagatggtcctaatgaactt

SEQ ID NO: 1139544 - DNA, 22 bp, Artificial Sequence
  chemically synthesized
attacacatgtaaagttcatta

SEQ ID NO: 1139545 - DNA, 22 bp, Artificial Sequence
  chemically synthesized
aatctcattacacatgtaaagt

SEQ ID NO: 1139546 - DNA, 22 bp, Artificial Sequence
  chemically synthesized
caatctcattacacatgtaaag

SEQ ID NO: 1139547 - DNA, 22 bp, Artificial Sequence
  chemically synthesized
ttcaatctcattacacatgtaa

SEQ ID NO: 1139548 - DNA, 22 bp, Artificial Sequence
  chemically synthesized
cttcaatctcattacacatgta

SEQ ID NO: 1139549 - DNA, 22 bp, Artificial Sequence
  chemically synthesized
atgaactttacatgtgtaatga

SEQ ID NO: 1139550 - DNA, 22 bp, Artificial Sequence
  chemically synthesized
gtgtttcttcaatctcattaca

SEQ ID NO: 1139551 - DNA, 22 bp, Artificial Sequence
  chemically synthesized
atctagtgtttcttcaatctca

SEQ ID NO: 1139552 - DNA, 22 bp, Artificial Sequence
  chemically synthesized
tacatgtgtaatgagattgaag

SEQ ID NO: 1139553 - DNA, 22 bp, Artificial Sequence
  chemically synthesized
acatgtgtaatgagattgaaga

SEQ ID NO: 1139554 - DNA, 22 bp, Artificial Sequence
  chemically synthesized
catgtgtaatgagattgaagaa

SEQ ID NO: 1139555 - DNA, 22 bp, Artificial Sequence
  chemically synthesized
catctcatctagtgtttcttca

SEQ ID NO: 1139556 - DNA, 22 bp, Artificial Sequence
  chemically synthesized
gcatctcatctagtgtttcttc

SEQ ID NO: 1139557 - DNA, 22 bp, Artificial Sequence
  chemically synthesized
tgcatctcatctagtgtttctt

SEQ ID NO: 1139558 - DNA, 22 bp, Artificial Sequence
  chemically synthesized
gatgagattttgcatctcatct

SEQ ID NO: 1139559 - DNA, 22 bp, Artificial Sequence
  chemically synthesized
aagaaacactagatgagatgca

SEQ ID NO: 1139560 - DNA, 22 bp, Artificial Sequence
  chemically synthesized
aagctagatgagattttgcatc

SEQ ID NO: 1139561 - DNA, 22 bp, Artificial Sequence
  chemically synthesized
gatgagatgcaaaatctcatct

SEQ ID NO: 1139562 - DNA, 22 bp, Artificial Sequence
  chemically synthesized
acaaaatccaaatatgttaaag

SEQ ID NO: 1139563 - DNA, 22 bp, Artificial Sequence
  chemically synthesized
atctagctttaacatatttgga

SEQ ID NO: 1139564 - DNA, 22 bp, Artificial Sequence
  chemically synthesized
gctttaacatatttggattttg

SEQ ID NO: 1139565 - DNA, 22 bp, Artificial Sequence
  chemically synthesized
taacatatttggattttgtcag

SEQ ID NO: 1139566 - DNA, 22 bp, Artificial Sequence
  chemically synthesized
ggaagccacaaactgacaaaat

SEQ ID NO: 1139567 - DNA, 22 bp, Artificial Sequence
  chemically synthesized
aacatatttggattttgtcagt

SEQ ID NO: 1139568 - DNA, 22 bp, Artificial Sequence
  chemically synthesized
aggaagccacaaactgacaaaa

SEQ ID NO: 1139569 - DNA, 22 bp, Artificial Sequence
  chemically synthesized
acatatttggattttgtcagtt

SEQ ID NO: 1139570 - DNA, 22 bp, Artificial Sequence
  chemically synthesized
ttaggaagccacaaactgacaa

SEQ ID NO: 1139571 - DNA, 22 bp, Artificial Sequence
  chemically synthesized
ttcttaggaagccacaaactga

SEQ ID NO: 1139572 - DNA, 22 bp, Artificial Sequence
  chemically synthesized
ggattttgtcagtttgtggctt

SEQ ID NO: 1139573 - DNA, 22 bp, Artificial Sequence
  chemically synthesized
gattttgtcagtttgtggcttc

SEQ ID NO: 1139574 - DNA, 22 bp, Artificial Sequence
  chemically synthesized
tgtcagtttgtggcttcctaag

SEQ ID NO: 1139575 - DNA, 22 bp, Artificial Sequence
  chemically synthesized
gtcagtttgtggcttcctaaga

SEQ ID NO: 1139576 - DNA, 22 bp, Artificial Sequence
  chemically synthesized
tcagtttgtggcttcctaagaa

SEQ ID NO: 1139577 - DNA, 22 bp, Artificial Sequence
  chemically synthesized
ccaatcaagaaagttgttctta

SEQ ID NO: 1139578 - DNA, 22 bp, Artificial Sequence
  chemically synthesized
accaatcaagaaagttgttctt

SEQ ID NO: 1139579 - DNA, 22 bp, Artificial Sequence
  chemically synthesized
gtggcttcctaagaacaacttt

SEQ ID NO: 1139580 - DNA, 22 bp, Artificial Sequence
  chemically synthesized
tggcttcctaagaacaactttc

SEQ ID NO: 1139581 - DNA, 22 bp, Artificial Sequence
  chemically synthesized
gatttaccaatcaagaaagttg

SEQ ID NO: 1139582 - DNA, 22 bp, Artificial Sequence
  chemically synthesized
cctaagaacaactttcttgatt

SEQ ID NO: 1139583 - DNA, 22 bp, Artificial Sequence
  chemically synthesized
actagatttaccaatcaagaaa

SEQ ID NO: 1139584 - DNA, 22 bp, Artificial Sequence
  chemically synthesized
ctaagaacaactttcttgattg

SEQ ID NO: 1139585 - DNA, 22 bp, Artificial Sequence
  chemically synthesized
ttgactagatttaccaatcaag

SEQ ID NO: 1139586 - DNA, 22 bp, Artificial Sequence
  chemically synthesized
agaacaactttcttgattggta

SEQ ID NO: 1139587 - DNA, 22 bp, Artificial Sequence
  chemically synthesized
catatattgttgactagattta

SEQ ID NO: 1139588 - DNA, 22 bp, Artificial Sequence
  chemically synthesized
tcttgattggtaaatctagtca

SEQ ID NO: 1139589 - DNA, 22 bp, Artificial Sequence
  chemically synthesized
cttgattggtaaatctagtcaa

SEQ ID NO: 1139590 - DNA, 22 bp, Artificial Sequence
  chemically synthesized
ctgcatatattgttgactagat

SEQ ID NO: 1139591 - DNA, 22 bp, Artificial Sequence
  chemically synthesized
ttgattggtaaatctagtcaac

SEQ ID NO: 1139592 - DNA, 22 bp, Artificial Sequence
  chemically synthesized
gattggtaaatctagtcaacaa

SEQ ID NO: 1139593 - DNA, 22 bp, Artificial Sequence
  chemically synthesized
attggtaaatctagtcaacaat

SEQ ID NO: 1139594 - DNA, 22 bp, Artificial Sequence
  chemically synthesized
gtaaatctagtcaacaatatat

SEQ ID NO: 1139595 - DNA, 22 bp, Artificial Sequence
  chemically synthesized
gtcaaagttcctgcatatattg

SEQ ID NO: 1139596 - DNA, 22 bp, Artificial Sequence
  chemically synthesized
gtcaacaatatatgcaggaact

SEQ ID NO: 1139597 - DNA, 22 bp, Artificial Sequence
  chemically synthesized
atatctagtcaaagttcctgca

SEQ ID NO: 1139598 - DNA, 22 bp, Artificial Sequence
  chemically synthesized
aatatctagtcaaagttcctgc

SEQ ID NO: 1139599 - DNA, 22 bp, Artificial Sequence
  chemically synthesized
caaatcttaatatctagtcaaa

SEQ ID NO: 1139600 - DNA, 22 bp, Artificial Sequence
  chemically synthesized
tgactagatattaagatttgga

SEQ ID NO: 1139601 - DNA, 22 bp, Artificial Sequence
  chemically synthesized
gactagatattaagatttggaa

SEQ ID NO: 1139602 - DNA, 22 bp, Artificial Sequence
  chemically synthesized
catgatgataaattccaaatct

SEQ ID NO: 1139603 - DNA, 22 bp, Artificial Sequence
  chemically synthesized
actagatattaagatttggaat

SEQ ID NO: 1139604 - DNA, 22 bp, Artificial Sequence
  chemically synthesized
acatgatgataaattccaaatc

SEQ ID NO: 1139605 - DNA, 22 bp, Artificial Sequence
  chemically synthesized
tacatgatgataaattccaaat

SEQ ID NO: 1139606 - DNA, 22 bp, Artificial Sequence
  chemically synthesized
gatattaagatttggaatttat

SEQ ID NO: 1139607 - DNA, 22 bp, Artificial Sequence
  chemically synthesized
ttttacatgatgataaattcca

SEQ ID NO: 1139608 - DNA, 22 bp, Artificial Sequence
  chemically synthesized
agatttggaatttatcatcatg

SEQ ID NO: 1139609 - DNA, 22 bp, Artificial Sequence
  chemically synthesized
ggaatttatcatcatgtaaaat

SEQ ID NO: 1139610 - DNA, 22 bp, Artificial Sequence
  chemically synthesized
gaatttatcatcatgtaaaata

SEQ ID NO: 1139611 - DNA, 22 bp, Artificial Sequence
  chemically synthesized
atcatcatgtaaaataactgta

SEQ ID NO: 1139612 - DNA, 22 bp, Artificial Sequence
  chemically synthesized
tcatcatgtaaaataactgtac

SEQ ID NO: 1139613 - DNA, 22 bp, Artificial Sequence
  chemically synthesized
gaaagtaccacatgccagaata

SEQ ID NO: 1139614 - DNA, 22 bp, Artificial Sequence
  chemically synthesized
ggaaagtaccacatgccagaat

SEQ ID NO: 1139615 - DNA, 22 bp, Artificial Sequence
  chemically synthesized
tggaaagtaccacatgccagaa

SEQ ID NO: 1139616 - DNA, 22 bp, Artificial Sequence
  chemically synthesized
tactattctggcatgtggtact

SEQ ID NO: 1139617 - DNA, 22 bp, Artificial Sequence
  chemically synthesized
cagccatctttggaaagtacca

SEQ ID NO: 1139618 - DNA, 22 bp, Artificial Sequence
  chemically synthesized
acagccatctttggaaagtacc

SEQ ID NO: 1139619 - DNA, 22 bp, Artificial Sequence
  chemically synthesized
ttctggcatgtggtactttcca

SEQ ID NO: 1139620 - DNA, 22 bp, Artificial Sequence
  chemically synthesized
tacagccatctttggaaagtac

SEQ ID NO: 1139621 - DNA, 22 bp, Artificial Sequence
  chemically synthesized
tggcatgtggtactttccaaag

SEQ ID NO: 1139622 - DNA, 22 bp, Artificial Sequence
  chemically synthesized
gcatgtggtactttccaaagat

SEQ ID NO: 1139623 - DNA, 22 bp, Artificial Sequence
  chemically synthesized
agatgaggatattttacagcca

SEQ ID NO: 1139624 - DNA, 22 bp, Artificial Sequence
  chemically synthesized
tccaaagatggctgtaaaatat

SEQ ID NO: 1139625 - DNA, 22 bp, Artificial Sequence
  chemically synthesized
ccaaagatggctgtaaaatatc

SEQ ID NO: 1139626 - DNA, 22 bp, Artificial Sequence
  chemically synthesized
caaagatggctgtaaaatatcc

SEQ ID NO: 1139627 - DNA, 22 bp, Artificial Sequence
  chemically synthesized
tagcaaagcatctgagatgagg

SEQ ID NO: 1139628 - DNA, 22 bp, Artificial Sequence
  chemically synthesized
taaaatatcctcatctcagatg

SEQ ID NO: 1139629 - DNA, 22 bp, Artificial Sequence
  chemically synthesized
atctcagatgctttgctataac

SEQ ID NO: 1139630 - DNA, 22 bp, Artificial Sequence
  chemically synthesized
agatgctttgctataacttgac

SEQ ID NO: 1139631 - DNA, 22 bp, Artificial Sequence
  chemically synthesized
atggagaaacaccaaggtcaag

SEQ ID NO: 1139632 - DNA, 22 bp, Artificial Sequence
  chemically synthesized
ctcatggagaaacaccaaggtc

SEQ ID NO: 1139633 - DNA, 22 bp, Artificial Sequence
  chemically synthesized
tgctataacttgaccttggtgt

SEQ ID NO: 1139634 - DNA, 22 bp, Artificial Sequence
  chemically synthesized
cctcatggagaaacaccaaggt

SEQ ID NO: 1139635 - DNA, 22 bp, Artificial Sequence
  chemically synthesized
gctataacttgaccttggtgtt

SEQ ID NO: 1139636 - DNA, 22 bp, Artificial Sequence
  chemically synthesized
ctataacttgaccttggtgttt

SEQ ID NO: 1139637 - DNA, 22 bp, Artificial Sequence
  chemically synthesized
atttcctcatggagaaacacca

SEQ ID NO: 1139638 - DNA, 22 bp, Artificial Sequence
  chemically synthesized
taacttgaccttggtgtttctc

SEQ ID NO: 1139639 - DNA, 22 bp, Artificial Sequence
  chemically synthesized
catttcctcatggagaaacacc

SEQ ID NO: 1139640 - DNA, 22 bp, Artificial Sequence
  chemically synthesized
gatttcatttcctcatggagaa

SEQ ID NO: 1139641 - DNA, 22 bp, Artificial Sequence
  chemically synthesized
gaccttggtgtttctccatgag

SEQ ID NO: 1139642 - DNA, 22 bp, Artificial Sequence
  chemically synthesized
accttggtgtttctccatgagg

SEQ ID NO: 1139643 - DNA, 22 bp, Artificial Sequence
  chemically synthesized
ggtgtttctccatgaggaaatg

SEQ ID NO: 1139644 - DNA, 22 bp, Artificial Sequence
  chemically synthesized
gtgtttctccatgaggaaatga

SEQ ID NO: 1139645 - DNA, 22 bp, Artificial Sequence
  chemically synthesized
ctccatgaggaaatgaaatcta

SEQ ID NO: 1139646 - DNA, 22 bp, Artificial Sequence
  chemically synthesized
tccatgaggaaatgaaatctaa

SEQ ID NO: 1139647 - DNA, 22 bp, Artificial Sequence
  chemically synthesized
aaggaaaagggaattagatttc

SEQ ID NO: 1139648 - DNA, 22 bp, Artificial Sequence
  chemically synthesized
catgaggaaatgaaatctaatt

SEQ ID NO: 1139649 - DNA, 22 bp, Artificial Sequence
  chemically synthesized
cccagattcaaggaaaagggaa

SEQ ID NO: 1139650 - DNA, 22 bp, Artificial Sequence
  chemically synthesized
attcccttttccttgaatctgg

SEQ ID NO: 1139651 - DNA, 22 bp, Artificial Sequence
  chemically synthesized
ccttttccttgaatctgggcag

SEQ ID NO: 1139652 - DNA, 22 bp, Artificial Sequence
  chemically synthesized
aaaaagtcacaagcctgcccag

SEQ ID NO: 1139653 - DNA, 22 bp, Artificial Sequence
  chemically synthesized
ttccttgaatctgggcaggctt

SEQ ID NO: 1139654 - DNA, 22 bp, Artificial Sequence
  chemically synthesized
tccttgaatctgggcaggcttg

SEQ ID NO: 1139655 - DNA, 22 bp, Artificial Sequence
  chemically synthesized
ccttgaatctgggcaggcttgt

SEQ ID NO: 1139656 - DNA, 22 bp, Artificial Sequence
  chemically synthesized
cttgaatctgggcaggcttgtg

SEQ ID NO: 1139657 - DNA, 22 bp, Artificial Sequence
  chemically synthesized
tgtgctgaaaaagtcacaagcc

SEQ ID NO: 1139658 - DNA, 22 bp, Artificial Sequence
  chemically synthesized
gaatctgggcaggcttgtgact

SEQ ID NO: 1139659 - DNA, 22 bp, Artificial Sequence
  chemically synthesized
aatctgggcaggcttgtgactt

SEQ ID NO: 1139660 - DNA, 22 bp, Artificial Sequence
  chemically synthesized
tgtgtgctgaaaaagtcacaag

SEQ ID NO: 1139661 - DNA, 22 bp, Artificial Sequence
  chemically synthesized
ggcaggcttgtgactttttcag

SEQ ID NO: 1139662 - DNA, 22 bp, Artificial Sequence
  chemically synthesized
gtgactttttcagcacacagaa

SEQ ID NO: 1139663 - DNA, 22 bp, Artificial Sequence
  chemically synthesized
tgactttttcagcacacagaat

SEQ ID NO: 1139664 - DNA, 22 bp, Artificial Sequence
  chemically synthesized
tttcagcacacagaatatgact

SEQ ID NO: 1139665 - DNA, 22 bp, Artificial Sequence
  chemically synthesized
ttcagcacacagaatatgactg

SEQ ID NO: 1139666 - DNA, 22 bp, Artificial Sequence
  chemically synthesized
tcagcacacagaatatgactga

SEQ ID NO: 1139667 - DNA, 22 bp, Artificial Sequence
  chemically synthesized
cagcacacagaatatgactgac

SEQ ID NO: 1139668 - DNA, 22 bp, Artificial Sequence
  chemically synthesized
agcacacagaatatgactgacc

SEQ ID NO: 1139669 - DNA, 22 bp, Artificial Sequence
  chemically synthesized
agacggtcaatcataatggtga

SEQ ID NO: 1139670 - DNA, 22 bp, Artificial Sequence
  chemically synthesized
cagacggtcaatcataatggtg

SEQ ID NO: 1139671 - DNA, 22 bp, Artificial Sequence
  chemically synthesized
accatcaccattatgattgacc

SEQ ID NO: 1139672 - DNA, 22 bp, Artificial Sequence
  chemically synthesized
aatacagaatcatgtgcttcag

SEQ ID NO: 1139673 - DNA, 22 bp, Artificial Sequence
  chemically synthesized
tgattgaccgtctgaagcacat

SEQ ID NO: 1139674 - DNA, 22 bp, Artificial Sequence
  chemically synthesized
gttaaatacagaatcatgtgct

SEQ ID NO: 1139675 - DNA, 22 bp, Artificial Sequence
  chemically synthesized
accgtctgaagcacatgattct

SEQ ID NO: 1139676 - DNA, 22 bp, Artificial Sequence
  chemically synthesized
ctagttaaatacagaatcatgt

SEQ ID NO: 1139677 - DNA, 22 bp, Artificial Sequence
  chemically synthesized
aagcacatgattctgtatttaa

SEQ ID NO: 1139678 - DNA, 22 bp, Artificial Sequence
  chemically synthesized
ggagcgaagatatattgctagt

SEQ ID NO: 1139679 - DNA, 22 bp, Artificial Sequence
  chemically synthesized
tgtatttaactagcaatatatc

SEQ ID NO: 1139680 - DNA, 22 bp, Artificial Sequence
  chemically synthesized
attaggagcgaagatatattgc

SEQ ID NO: 1139681 - DNA, 22 bp, Artificial Sequence
  chemically synthesized
tatttaactagcaatatatctt

SEQ ID NO: 1139682 - DNA, 22 bp, Artificial Sequence
  chemically synthesized
tgattaggagcgaagatatatt

SEQ ID NO: 1139683 - DNA, 22 bp, Artificial Sequence
  chemically synthesized
aactagcaatatatcttcgctc

SEQ ID NO: 1139684 - DNA, 22 bp, Artificial Sequence
  chemically synthesized
actagcaatatatcttcgctcc

SEQ ID NO: 1139685 - DNA, 22 bp, Artificial Sequence
  chemically synthesized
gcaatatatcttcgctcctaat

SEQ ID NO: 1139686 - DNA, 22 bp, Artificial Sequence
  chemically synthesized
tcaaaatgcagtcatgccctct

SEQ ID NO: 1139687 - DNA, 22 bp, Artificial Sequence
  chemically synthesized
cgctcctaatcagagggcatga

SEQ ID NO: 1139688 - DNA, 22 bp, Artificial Sequence
  chemically synthesized
gctcctaatcagagggcatgac

SEQ ID NO: 1139689 - DNA, 22 bp, Artificial Sequence
  chemically synthesized
attatcaaaatgcagtcatgcc

SEQ ID NO: 1139690 - DNA, 22 bp, Artificial Sequence
  chemically synthesized
ctaatcagagggcatgactgca

SEQ ID NO: 1139691 - DNA, 22 bp, Artificial Sequence
  chemically synthesized
atcagagggcatgactgcattt

SEQ ID NO: 1139692 - DNA, 22 bp, Artificial Sequence
  chemically synthesized
cattttgataatcagtggtcac

SEQ ID NO: 1139693 - DNA, 22 bp, Artificial Sequence
  chemically synthesized
agtaaataagtgagtgaccact

SEQ ID NO: 1139694 - DNA, 22 bp, Artificial Sequence
  chemically synthesized
cagtaaataagtgagtgaccac

SEQ ID NO: 1139695 - DNA, 22 bp, Artificial Sequence
  chemically synthesized
tcagtaaataagtgagtgacca

SEQ ID NO: 1139696 - DNA, 22 bp, Artificial Sequence
  chemically synthesized
tgataatcagtggtcactcact

SEQ ID NO: 1139697 - DNA, 22 bp, Artificial Sequence
  chemically synthesized
gataatcagtggtcactcactt

SEQ ID NO: 1139698 - DNA, 22 bp, Artificial Sequence
  chemically synthesized
ataatcagtggtcactcactta

SEQ ID NO: 1139699 - DNA, 22 bp, Artificial Sequence
  chemically synthesized
aggcaaaatgtgaatcctttca

SEQ ID NO: 1139700 - DNA, 22 bp, Artificial Sequence
  chemically synthesized
acttatttactgaaaggattca

SEQ ID NO: 1139701 - DNA, 22 bp, Artificial Sequence
  chemically synthesized
tcaggcaaaatgtgaatccttt

SEQ ID NO: 1139702 - DNA, 22 bp, Artificial Sequence
  chemically synthesized
ctcaggcaaaatgtgaatcctt

SEQ ID NO: 1139703 - DNA, 22 bp, Artificial Sequence
  chemically synthesized
ttctcaggcaaaatgtgaatcc

SEQ ID NO: 1139704 - DNA, 22 bp, Artificial Sequence
  chemically synthesized
atttactgaaaggattcacatt

SEQ ID NO: 1139705 - DNA, 22 bp, Artificial Sequence
  chemically synthesized
tttactgaaaggattcacattt

SEQ ID NO: 1139706 - DNA, 22 bp, Artificial Sequence
  chemically synthesized
ttcttctcaggcaaaatgtgaa

SEQ ID NO: 1139707 - DNA, 22 bp, Artificial Sequence
  chemically synthesized
actgaaaggattcacattttgc

SEQ ID NO: 1139708 - DNA, 22 bp, Artificial Sequence
  chemically synthesized
ctgaaaggattcacattttgcc

SEQ ID NO: 1139709 - DNA, 22 bp, Artificial Sequence
  chemically synthesized
aaaggattcacattttgcctga

SEQ ID NO: 1139710 - DNA, 22 bp, Artificial Sequence
  chemically synthesized
caaacattgttcttctcaggca

SEQ ID NO: 1139711 - DNA, 22 bp, Artificial Sequence
  chemically synthesized
acaaacattgttcttctcaggc

SEQ ID NO: 1139712 - DNA, 22 bp, Artificial Sequence
  chemically synthesized
cttacaaacattgttcttctca

SEQ ID NO: 1139713 - DNA, 22 bp, Artificial Sequence
  chemically synthesized
acattttgcctgagaagaacaa

SEQ ID NO: 1139714 - DNA, 22 bp, Artificial Sequence
  chemically synthesized
tgcctgagaagaacaatgtttg

SEQ ID NO: 1139715 - DNA, 22 bp, Artificial Sequence
  chemically synthesized
gcctgagaagaacaatgtttgt

SEQ ID NO: 1139716 - DNA, 22 bp, Artificial Sequence
  chemically synthesized
cctgagaagaacaatgtttgta

SEQ ID NO: 1139717 - DNA, 22 bp, Artificial Sequence
  chemically synthesized
aagcagaatattccttacaaac

SEQ ID NO: 1139718 - DNA, 22 bp, Artificial Sequence
  chemically synthesized
agaagaacaatgtttgtaagga

SEQ ID NO: 1139719 - DNA, 22 bp, Artificial Sequence
  chemically synthesized
aaagcagaatattccttacaaa

SEQ ID NO: 1139720 - DNA, 22 bp, Artificial Sequence
  chemically synthesized
cttaaagcagaatattccttac

SEQ ID NO: 1139721 - DNA, 22 bp, Artificial Sequence
  chemically synthesized
catctccttaaagcagaatatt

SEQ ID NO: 1139722 - DNA, 22 bp, Artificial Sequence
  chemically synthesized
gtaaggaatattctgctttaag

SEQ ID NO: 1139723 - DNA, 22 bp, Artificial Sequence
  chemically synthesized
taaggaatattctgctttaagg

SEQ ID NO: 1139724 - DNA, 22 bp, Artificial Sequence
  chemically synthesized
tgctttaaggagatgtaatcca

SEQ ID NO: 1139725 - DNA, 22 bp, Artificial Sequence
  chemically synthesized
ctttaaggagatgtaatccatg

SEQ ID NO: 1139726 - DNA, 22 bp, Artificial Sequence
  chemically synthesized
gaggaatggatgcatggattac

SEQ ID NO: 1139727 - DNA, 22 bp, Artificial Sequence
  chemically synthesized
taaggagatgtaatccatgcat

SEQ ID NO: 1139728 - DNA, 22 bp, Artificial Sequence
  chemically synthesized
aaggagatgtaatccatgcatc

SEQ ID NO: 1139729 - DNA, 22 bp, Artificial Sequence
  chemically synthesized
aggagatgtaatccatgcatcc

SEQ ID NO: 1139730 - DNA, 22 bp, Artificial Sequence
  chemically synthesized
tcatatctagaggaatggatgc

SEQ ID NO: 1139731 - DNA, 22 bp, Artificial Sequence
  chemically synthesized
tatcatatctagaggaatggat

SEQ ID NO: 1139732 - DNA, 22 bp, Artificial Sequence
  chemically synthesized
atgagggattctatcatatcta

SEQ ID NO: 1139733 - DNA, 22 bp, Artificial Sequence
  chemically synthesized
ctctagatatgatagaatccct

SEQ ID NO: 1139734 - DNA, 22 bp, Artificial Sequence
  chemically synthesized
tagatatgatagaatccctcat

SEQ ID NO: 1139735 - DNA, 22 bp, Artificial Sequence
  chemically synthesized
gatatgatagaatccctcatga

SEQ ID NO: 1139736 - DNA, 22 bp, Artificial Sequence
  chemically synthesized
tcacatgccacagagaggagag

SEQ ID NO: 1139737 - DNA, 22 bp, Artificial Sequence
  chemically synthesized
atgaatttatcctctcctctct

SEQ ID NO: 1139738 - DNA, 22 bp, Artificial Sequence
  chemically synthesized
atcctctcctctctgtggcatg

SEQ ID NO: 1139739 - DNA, 22 bp, Artificial Sequence
  chemically synthesized
tcctctcctctctgtggcatgt

SEQ ID NO: 1139740 - DNA, 22 bp, Artificial Sequence
  chemically synthesized
tcctctctgtggcatgtgacag

SEQ ID NO: 1139741 - DNA, 22 bp, Artificial Sequence
  chemically synthesized
ctctctgtggcatgtgacagtg

SEQ ID NO: 1139742 - DNA, 22 bp, Artificial Sequence
  chemically synthesized
tctgtggcatgtgacagtgtgt

SEQ ID NO: 1139743 - DNA, 22 bp, Artificial Sequence
  chemically synthesized
tgtggcatgtgacagtgtgtac

SEQ ID NO: 1139744 - DNA, 22 bp, Artificial Sequence
  chemically synthesized
tggcatgtgacagtgtgtacca

SEQ ID NO: 1139745 - DNA, 22 bp, Artificial Sequence
  chemically synthesized
aaaaaagtaggaagtggtacac

SEQ ID NO: 1139746 - DNA, 22 bp, Artificial Sequence
  chemically synthesized
caaaaaagtaggaagtggtaca

SEQ ID NO: 1139747 - DNA, 22 bp, Artificial Sequence
  chemically synthesized
cctacttttttgaaatctttat

SEQ ID NO: 1139748 - DNA, 22 bp, Artificial Sequence
  chemically synthesized
ctacttttttgaaatctttatt

SEQ ID NO: 1139749 - DNA, 22 bp, Artificial Sequence
  chemically synthesized
cttttttgaaatctttattctc

SEQ ID NO: 1139750 - DNA, 22 bp, Artificial Sequence
  chemically synthesized
ttttgaaatctttattctcctc

SEQ ID NO: 1139751 - DNA, 22 bp, Artificial Sequence
  chemically synthesized
tttgaaatctttattctcctca

SEQ ID NO: 1139752 - DNA, 22 bp, Artificial Sequence
  chemically synthesized
ttgaaatctttattctcctcac

SEQ ID NO: 1139753 - DNA, 22 bp, Artificial Sequence
  chemically synthesized
tgaaatctttattctcctcact

SEQ ID NO: 1139754 - DNA, 22 bp, Artificial Sequence
  chemically synthesized
gaaatctttattctcctcactt

SEQ ID NO: 1139755 - DNA, 22 bp, Artificial Sequence
  chemically synthesized
aaatctttattctcctcacttt

SEQ ID NO: 1139756 - DNA, 22 bp, Artificial Sequence
  chemically synthesized
tattctcctcacttttgtgata

SEQ ID NO: 1139757 - DNA, 22 bp, Artificial Sequence
  chemically synthesized
attctcctcacttttgtgatac

SEQ ID NO: 1139758 - DNA, 22 bp, Artificial Sequence
  chemically synthesized
ttctcctcacttttgtgatacc

SEQ ID NO: 1139759 - DNA, 22 bp, Artificial Sequence
  chemically synthesized
tcctcacttttgtgataccact

SEQ ID NO: 1139760 - DNA, 22 bp, Artificial Sequence
  chemically synthesized
ctcacttttgtgataccacttt

SEQ ID NO: 1139761 - DNA, 22 bp, Artificial Sequence
  chemically synthesized
acttttgtgataccactttccc

SEQ ID NO: 1139762 - DNA, 22 bp, Artificial Sequence
  chemically synthesized
agcagataccacaaggggaaag

SEQ ID NO: 1139763 - DNA, 22 bp, Artificial Sequence
  chemically synthesized
ttgtgataccactttccccttg

SEQ ID NO: 1139764 - DNA, 22 bp, Artificial Sequence
  chemically synthesized
tgtgataccactttccccttgt

SEQ ID NO: 1139765 - DNA, 22 bp, Artificial Sequence
  chemically synthesized
gtgataccactttccccttgtg

SEQ ID NO: 1139766 - DNA, 22 bp, Artificial Sequence
  chemically synthesized
tgataccactttccccttgtgg

SEQ ID NO: 1139767 - DNA, 22 bp, Artificial Sequence
  chemically synthesized
accaaaagattgagcagatacc

SEQ ID NO: 1139768 - DNA, 22 bp, Artificial Sequence
  chemically synthesized
tccccttgtggtatctgctcaa

SEQ ID NO: 1139769 - DNA, 22 bp, Artificial Sequence
  chemically synthesized
ccccttgtggtatctgctcaat

SEQ ID NO: 1139770 - DNA, 22 bp, Artificial Sequence
  chemically synthesized
cccttgtggtatctgctcaatc

SEQ ID NO: 1139771 - DNA, 22 bp, Artificial Sequence
  chemically synthesized
gtggtatctgctcaatcttttg

SEQ ID NO: 1139772 - DNA, 22 bp, Artificial Sequence
  chemically synthesized
tggtatctgctcaatcttttgg

SEQ ID NO: 1139773 - DNA, 22 bp, Artificial Sequence
  chemically synthesized
ctcaatcttttggtcaacatct

SEQ ID NO: 1139774 - DNA, 22 bp, Artificial Sequence
  chemically synthesized
aatcttttggtcaacatcttat

SEQ ID NO: 1139775 - DNA, 22 bp, Artificial Sequence
  chemically synthesized
ttggtcaacatcttatcctctg

SEQ ID NO: 1139776 - DNA, 22 bp, Artificial Sequence
  chemically synthesized
tggtcaacatcttatcctctgc

SEQ ID NO: 1139777 - DNA, 22 bp, Artificial Sequence
  chemically synthesized
ggtcaacatcttatcctctgcc

SEQ ID NO: 1139778 - DNA, 22 bp, Artificial Sequence
  chemically synthesized
gtcaacatcttatcctctgcct

SEQ ID NO: 1139779 - DNA, 22 bp, Artificial Sequence
  chemically synthesized
caatcaaggagtaggcagagga

SEQ ID NO: 1139780 - DNA, 22 bp, Artificial Sequence
  chemically synthesized
atcctctgcctactccttgatt

SEQ ID NO: 1139781 - DNA, 22 bp, Artificial Sequence
  chemically synthesized
tcctctgcctactccttgattg

SEQ ID NO: 1139782 - DNA, 22 bp, Artificial Sequence
  chemically synthesized
agggaggaatgtctacaatcaa

SEQ ID NO: 1139783 - DNA, 22 bp, Artificial Sequence
  chemically synthesized
cagggaggaatgtctacaatca

SEQ ID NO: 1139784 - DNA, 22 bp, Artificial Sequence
  chemically synthesized
tgcctactccttgattgtagac

SEQ ID NO: 1139785 - DNA, 22 bp, Artificial Sequence
  chemically synthesized
cctactccttgattgtagacat

SEQ ID NO: 1139786 - DNA, 22 bp, Artificial Sequence
  chemically synthesized
ctccttgattgtagacattcct

SEQ ID NO: 1139787 - DNA, 22 bp, Artificial Sequence
  chemically synthesized
cttgattgtagacattcctccc

SEQ ID NO: 1139788 - DNA, 22 bp, Artificial Sequence
  chemically synthesized
gattgtagacattcctccctga

SEQ ID NO: 1139789 - DNA, 22 bp, Artificial Sequence
  chemically synthesized
attgtagacattcctccctgaa

SEQ ID NO: 1139790 - DNA, 22 bp, Artificial Sequence
  chemically synthesized
tagacattcctccctgaaatct

SEQ ID NO: 1139791 - DNA, 22 bp, Artificial Sequence
  chemically synthesized
agtgaaacgaatagatttcagg

SEQ ID NO: 1139792 - DNA, 22 bp, Artificial Sequence
  chemically synthesized
ctccctgaaatctattcgtttc

SEQ ID NO: 1139793 - DNA, 22 bp, Artificial Sequence
  chemically synthesized
cctgaaatctattcgtttcact

SEQ ID NO: 1139794 - DNA, 22 bp, Artificial Sequence
  chemically synthesized
aaatctattcgtttcacttaat

SEQ ID NO: 1139795 - DNA, 22 bp, Artificial Sequence
  chemically synthesized
tgtagagtgacacattaagtga

SEQ ID NO: 1139796 - DNA, 22 bp, Artificial Sequence
  chemically synthesized
ttcgtttcacttaatgtgtcac

SEQ ID NO: 1139797 - DNA, 22 bp, Artificial Sequence
  chemically synthesized
agggattgtgtagagtgacaca

SEQ ID NO: 1139798 - DNA, 22 bp, Artificial Sequence
  chemically synthesized
gtttcacttaatgtgtcactct

SEQ ID NO: 1139799 - DNA, 22 bp, Artificial Sequence
  chemically synthesized
tgagggattgtgtagagtgaca

SEQ ID NO: 1139800 - DNA, 22 bp, Artificial Sequence
  chemically synthesized
ctgagggattgtgtagagtgac

SEQ ID NO: 1139801 - DNA, 22 bp, Artificial Sequence
  chemically synthesized
cacttaatgtgtcactctacac

SEQ ID NO: 1139802 - DNA, 22 bp, Artificial Sequence
  chemically synthesized
acttaatgtgtcactctacaca

SEQ ID NO: 1139803 - DNA, 22 bp, Artificial Sequence
  chemically synthesized
aatgtgtcactctacacaatcc

SEQ ID NO: 1139804 - DNA, 22 bp, Artificial Sequence
  chemically synthesized
atgtgtcactctacacaatccc

SEQ ID NO: 1139805 - DNA, 22 bp, Artificial Sequence
  chemically synthesized
tacacaatccctcagaagcatt

SEQ ID NO: 1139806 - DNA, 22 bp, Artificial Sequence
  chemically synthesized
agaagcaatcaaaatgcttctg

SEQ ID NO: 1139807 - DNA, 22 bp, Artificial Sequence
  chemically synthesized
cacaatccctcagaagcatttt

SEQ ID NO: 1139808 - DNA, 22 bp, Artificial Sequence
  chemically synthesized
attcagaagcaatcaaaatgct

SEQ ID NO: 1139809 - DNA, 22 bp, Artificial Sequence
  chemically synthesized
ttgattcagaagcaatcaaaat

SEQ ID NO: 1139810 - DNA, 22 bp, Artificial Sequence
  chemically synthesized
gttattgattcagaagcaatca

SEQ ID NO: 1139811 - DNA, 22 bp, Artificial Sequence
  chemically synthesized
agaagcattttgattgcttctg

SEQ ID NO: 1139812 - DNA, 22 bp, Artificial Sequence
  chemically synthesized
atgactagttattgattcagaa

SEQ ID NO: 1139813 - DNA, 22 bp, Artificial Sequence
  chemically synthesized
tgattgcttctgaatcaataac

SEQ ID NO: 1139814 - DNA, 22 bp, Artificial Sequence
  chemically synthesized
gattgcttctgaatcaataact

SEQ ID NO: 1139815 - DNA, 22 bp, Artificial Sequence
  chemically synthesized
attgcttctgaatcaataacta

SEQ ID NO: 1139816 - DNA, 22 bp, Artificial Sequence
  chemically synthesized
cttctgaatcaataactagtca

SEQ ID NO: 1139817 - DNA, 22 bp, Artificial Sequence
  chemically synthesized
agaaaatggttcatgactagtt

SEQ ID NO: 1139818 - DNA, 22 bp, Artificial Sequence
  chemically synthesized
ctgaatcaataactagtcatga

SEQ ID NO: 1139819 - DNA, 22 bp, Artificial Sequence
  chemically synthesized
tgaatcaataactagtcatgaa

SEQ ID NO: 1139820 - DNA, 22 bp, Artificial Sequence
  chemically synthesized
aatcaataactagtcatgaacc

SEQ ID NO: 1139821 - DNA, 22 bp, Artificial Sequence
  chemically synthesized
gaatctcagaaaatggttcatg

SEQ ID NO: 1139822 - DNA, 22 bp, Artificial Sequence
  chemically synthesized
cacaactagaatctcagaaaat

SEQ ID NO: 1139823 - DNA, 22 bp, Artificial Sequence
  chemically synthesized
acacaactagaatctcagaaaa

SEQ ID NO: 1139824 - DNA, 22 bp, Artificial Sequence
  chemically synthesized
gtcatgaaccattttctgagat

SEQ ID NO: 1139825 - DNA, 22 bp, Artificial Sequence
  chemically synthesized
gtttacacaactagaatctcag

SEQ ID NO: 1139826 - DNA, 22 bp, Artificial Sequence
  chemically synthesized
atcagttggtttacacaactag

SEQ ID NO: 1139827 - DNA, 22 bp, Artificial Sequence
  chemically synthesized
tctgagattctagttgtgtaaa

SEQ ID NO: 1139828 - DNA, 22 bp, Artificial Sequence
  chemically synthesized
ctgagattctagttgtgtaaac

SEQ ID NO: 1139829 - DNA, 22 bp, Artificial Sequence
  chemically synthesized
tgagattctagttgtgtaaacc

SEQ ID NO: 1139830 - DNA, 22 bp, Artificial Sequence
  chemically synthesized
cattaatcagttggtttacaca

SEQ ID NO: 1139831 - DNA, 22 bp, Artificial Sequence
  chemically synthesized
ccattaatcagttggtttacac

SEQ ID NO: 1139832 - DNA, 22 bp, Artificial Sequence
  chemically synthesized
agattctagttgtgtaaaccaa

SEQ ID NO: 1139833 - DNA, 22 bp, Artificial Sequence
  chemically synthesized
tccattaatcagttggtttaca

SEQ ID NO: 1139834 - DNA, 22 bp, Artificial Sequence
  chemically synthesized
tagttgtgtaaaccaactgatt

SEQ ID NO: 1139835 - DNA, 22 bp, Artificial Sequence
  chemically synthesized
gttgtgtaaaccaactgattaa

SEQ ID NO: 1139836 - DNA, 22 bp, Artificial Sequence
  chemically synthesized
aaaatcctttccattaatcagt

SEQ ID NO: 1139837 - DNA, 22 bp, Artificial Sequence
  chemically synthesized
tgtaaaccaactgattaatgga

SEQ ID NO: 1139838 - DNA, 22 bp, Artificial Sequence
  chemically synthesized
agacatccaagttaaaaatcct

SEQ ID NO: 1139839 - DNA, 22 bp, Artificial Sequence
  chemically synthesized
gagacatccaagttaaaaatcc

SEQ ID NO: 1139840 - DNA, 22 bp, Artificial Sequence
  chemically synthesized
attaatggaaaggatttttaac

SEQ ID NO: 1139841 - DNA, 22 bp, Artificial Sequence
  chemically synthesized
tgagacatccaagttaaaaatc

SEQ ID NO: 1139842 - DNA, 22 bp, Artificial Sequence
  chemically synthesized
atggaaaggatttttaacttgg

SEQ ID NO: 1139843 - DNA, 22 bp, Artificial Sequence
  chemically synthesized
cgtgtaaaatgtctttgagaca

SEQ ID NO: 1139844 - DNA, 22 bp, Artificial Sequence
  chemically synthesized
ttaacttggatgtctcaaagac

SEQ ID NO: 1139845 - DNA, 22 bp, Artificial Sequence
  chemically synthesized
taacttggatgtctcaaagaca

SEQ ID NO: 1139846 - DNA, 22 bp, Artificial Sequence
  chemically synthesized
aacttggatgtctcaaagacat

SEQ ID NO: 1139847 - DNA, 22 bp, Artificial Sequence
  chemically synthesized
acttggatgtctcaaagacatt

SEQ ID NO: 1139848 - DNA, 22 bp, Artificial Sequence
  chemically synthesized
ggatgtctcaaagacattttac

SEQ ID NO: 1139849 - DNA, 22 bp, Artificial Sequence
  chemically synthesized
gatatattccgtgtaaaatgtc

SEQ ID NO: 1139850 - DNA, 22 bp, Artificial Sequence
  chemically synthesized
gatgtctcaaagacattttaca

SEQ ID NO: 1139851 - DNA, 22 bp, Artificial Sequence
  chemically synthesized
ggatatattccgtgtaaaatgt

SEQ ID NO: 1139852 - DNA, 22 bp, Artificial Sequence
  chemically synthesized
agatttggatatattccgtgta

SEQ ID NO: 1139853 - DNA, 22 bp, Artificial Sequence
  chemically synthesized
cagatttggatatattccgtgt

SEQ ID NO: 1139854 - DNA, 22 bp, Artificial Sequence
  chemically synthesized
aaagacattttacacggaatat

SEQ ID NO: 1139855 - DNA, 22 bp, Artificial Sequence
  chemically synthesized
tttcagatttggatatattccg

SEQ ID NO: 1139856 - DNA, 22 bp, Artificial Sequence
  chemically synthesized
tacacggaatatatccaaatct

SEQ ID NO: 1139857 - DNA, 22 bp, Artificial Sequence
  chemically synthesized
acacggaatatatccaaatctg

SEQ ID NO: 1139858 - DNA, 22 bp, Artificial Sequence
  chemically synthesized
cacggaatatatccaaatctga

SEQ ID NO: 1139859 - DNA, 22 bp, Artificial Sequence
  chemically synthesized
gaatgacaaaaatgataattat

SEQ ID NO: 1139860 - DNA, 22 bp, Artificial Sequence
  chemically synthesized
ctggaatgacaaaaatgataat

SEQ ID NO: 1139861 - DNA, 22 bp, Artificial Sequence
  chemically synthesized
aaataattatcatttttgtcat

SEQ ID NO: 1139862 - DNA, 22 bp, Artificial Sequence
  chemically synthesized
tcatttttgtcattccagcaat

SEQ ID NO: 1139863 - DNA, 22 bp, Artificial Sequence
  chemically synthesized
ttgtcattccagcaattcctct

SEQ ID NO: 1139864 - DNA, 22 bp, Artificial Sequence
  chemically synthesized
tgtcattccagcaattcctctt

SEQ ID NO: 1139865 - DNA, 22 bp, Artificial Sequence
  chemically synthesized
acaggagaatagaagaggaatt

SEQ ID NO: 1139866 - DNA, 22 bp, Artificial Sequence
  chemically synthesized
gtcattccagcaattcctcttc

SEQ ID NO: 1139867 - DNA, 22 bp, Artificial Sequence
  chemically synthesized
tcattccagcaattcctcttct

SEQ ID NO: 1139868 - DNA, 22 bp, Artificial Sequence
  chemically synthesized
gccctaacaggagaatagaaga

SEQ ID NO: 1139869 - DNA, 22 bp, Artificial Sequence
  chemically synthesized
cagcaattcctcttctattctc

SEQ ID NO: 1139870 - DNA, 22 bp, Artificial Sequence
  chemically synthesized
ttagccctaacaggagaataga

SEQ ID NO: 1139871 - DNA, 22 bp, Artificial Sequence
  chemically synthesized
ctcttctattctcctgttaggg

SEQ ID NO: 1139872 - DNA, 22 bp, Artificial Sequence
  chemically synthesized
ggagggttattagccctaacag

SEQ ID NO: 1139873 - DNA, 22 bp, Artificial Sequence
  chemically synthesized
ttctattctcctgttagggcta

SEQ ID NO: 1139874 - DNA, 22 bp, Artificial Sequence
  chemically synthesized
ctaggagggttattagccctaa

SEQ ID NO: 1139875 - DNA, 22 bp, Artificial Sequence
  chemically synthesized
ctattctcctgttagggctaat

SEQ ID NO: 1139876 - DNA, 22 bp, Artificial Sequence
  chemically synthesized
tattctcctgttagggctaata

SEQ ID NO: 1139877 - DNA, 22 bp, Artificial Sequence
  chemically synthesized
ttctcctgttagggctaataac

SEQ ID NO: 1139878 - DNA, 22 bp, Artificial Sequence
  chemically synthesized
ggttcctaggagggttattagc

SEQ ID NO: 1139879 - DNA, 22 bp, Artificial Sequence
  chemically synthesized
tcctgttagggctaataaccct

SEQ ID NO: 1139880 - DNA, 22 bp, Artificial Sequence
  chemically synthesized
ctgttagggctaataaccctcc

SEQ ID NO: 1139881 - DNA, 22 bp, Artificial Sequence
  chemically synthesized
ttagggctaataaccctcctag

SEQ ID NO: 1139882 - DNA, 22 bp, Artificial Sequence
  chemically synthesized
ggtgactgggttcctaggaggg

SEQ ID NO: 1139883 - DNA, 22 bp, Artificial Sequence
  chemically synthesized
gggtgactgggttcctaggagg

SEQ ID NO: 1139884 - DNA, 22 bp, Artificial Sequence
  chemically synthesized
gggctaataaccctcctaggaa

SEQ ID NO: 1139885 - DNA, 22 bp, Artificial Sequence
  chemically synthesized
atttgggtgactgggttcctag

SEQ ID NO: 1139886 - DNA, 22 bp, Artificial Sequence
  chemically synthesized
catttgggtgactgggttccta

SEQ ID NO: 1139887 - DNA, 22 bp, Artificial Sequence
  chemically synthesized
ataaccctcctaggaacccagt

SEQ ID NO: 1139888 - DNA, 22 bp, Artificial Sequence
  chemically synthesized
gacatttcatttgggtgactgg

SEQ ID NO: 1139889 - DNA, 22 bp, Artificial Sequence
  chemically synthesized
ctagacatttcatttgggtgac

SEQ ID NO: 1139890 - DNA, 22 bp, Artificial Sequence
  chemically synthesized
ctaggaacccagtcacccaaat

SEQ ID NO: 1139891 - DNA, 22 bp, Artificial Sequence
  chemically synthesized
ggaacccagtcacccaaatgaa

SEQ ID NO: 1139892 - DNA, 22 bp, Artificial Sequence
  chemically synthesized
aaatggttcctagacatttcat

SEQ ID NO: 1139893 - DNA, 22 bp, Artificial Sequence
  chemically synthesized
gaaatggttcctagacatttca

SEQ ID NO: 1139894 - DNA, 22 bp, Artificial Sequence
  chemically synthesized
tgataagaggcagaagtttgaa

SEQ ID NO: 1139895 - DNA, 22 bp, Artificial Sequence
  chemically synthesized
gtgataagaggcagaagtttga

SEQ ID NO: 1139896 - DNA, 22 bp, Artificial Sequence
  chemically synthesized
ggaaccatttcaaacttctgcc

SEQ ID NO: 1139897 - DNA, 22 bp, Artificial Sequence
  chemically synthesized
caaacttctgcctcttatcaca

SEQ ID NO: 1139898 - DNA, 22 bp, Artificial Sequence
  chemically synthesized
aaacttctgcctcttatcacaa

SEQ ID NO: 1139899 - DNA, 22 bp, Artificial Sequence
  chemically synthesized
ctgcctcttatcacaagtttca

SEQ ID NO: 1139900 - DNA, 22 bp, Artificial Sequence
  chemically synthesized
agatgtgatgaatgaaacttgt

SEQ ID NO: 1139901 - DNA, 22 bp, Artificial Sequence
  chemically synthesized
tgcctcttatcacaagtttcat

SEQ ID NO: 1139902 - DNA, 22 bp, Artificial Sequence
  chemically synthesized
cctcttatcacaagtttcattc

SEQ ID NO: 1139903 - DNA, 22 bp, Artificial Sequence
  chemically synthesized
ttatcacaagtttcattcatca

SEQ ID NO: 1139904 - DNA, 22 bp, Artificial Sequence
  chemically synthesized
gaatgttaagatgtgatgaatg

SEQ ID NO: 1139905 - DNA, 22 bp, Artificial Sequence
  chemically synthesized
atcacaagtttcattcatcaca

SEQ ID NO: 1139906 - DNA, 22 bp, Artificial Sequence
  chemically synthesized
tcacaagtttcattcatcacat

SEQ ID NO: 1139907 - DNA, 22 bp, Artificial Sequence
  chemically synthesized
cattcatcacatcttaacattc

SEQ ID NO: 1139908 - DNA, 22 bp, Artificial Sequence
  chemically synthesized
attcatcacatcttaacattct

SEQ ID NO: 1139909 - DNA, 22 bp, Artificial Sequence
  chemically synthesized
atcacatcttaacattctaatg

SEQ ID NO: 1139910 - DNA, 22 bp, Artificial Sequence
  chemically synthesized
agataagaagagaaacattaga

SEQ ID NO: 1139911 - DNA, 22 bp, Artificial Sequence
  chemically synthesized
aacattctaatgtttctcttct

SEQ ID NO: 1139912 - DNA, 22 bp, Artificial Sequence
  chemically synthesized
ggcattaagataagaagagaaa

SEQ ID NO: 1139913 - DNA, 22 bp, Artificial Sequence
  chemically synthesized
acattctaatgtttctcttctt

SEQ ID NO: 1139914 - DNA, 22 bp, Artificial Sequence
  chemically synthesized
taatgtttctcttcttatctta

SEQ ID NO: 1139915 - DNA, 22 bp, Artificial Sequence
  chemically synthesized
atgtttctcttcttatcttaat

SEQ ID NO: 1139916 - DNA, 22 bp, Artificial Sequence
  chemically synthesized
agtagcattgggcattaagata

SEQ ID NO: 1139917 - DNA, 22 bp, Artificial Sequence
  chemically synthesized
ctcttcttatcttaatgcccaa

SEQ ID NO: 1139918 - DNA, 22 bp, Artificial Sequence
  chemically synthesized
aactaagtagcattgggcatta

SEQ ID NO: 1139919 - DNA, 22 bp, Artificial Sequence
  chemically synthesized
tcttcttatcttaatgcccaat

SEQ ID NO: 1139920 - DNA, 22 bp, Artificial Sequence
  chemically synthesized
ttcttatcttaatgcccaatgc

SEQ ID NO: 1139921 - DNA, 22 bp, Artificial Sequence
  chemically synthesized
cttatcttaatgcccaatgcta

SEQ ID NO: 1139922 - DNA, 22 bp, Artificial Sequence
  chemically synthesized
ttatcttaatgcccaatgctac

SEQ ID NO: 1139923 - DNA, 22 bp, Artificial Sequence
  chemically synthesized
atcttaatgcccaatgctactt

SEQ ID NO: 1139924 - DNA, 22 bp, Artificial Sequence
  chemically synthesized
tcttaatgcccaatgctactta

SEQ ID NO: 1139925 - DNA, 22 bp, Artificial Sequence
  chemically synthesized
aatgcccaatgctacttagttc

SEQ ID NO: 1139926 - DNA, 22 bp, Artificial Sequence
  chemically synthesized
atcagaagacctgaactaagta

SEQ ID NO: 1139927 - DNA, 22 bp, Artificial Sequence
  chemically synthesized
atgcccaatgctacttagttca

SEQ ID NO: 1139928 - DNA, 22 bp, Artificial Sequence
  chemically synthesized
cttagttcaggtcttctgatta

SEQ ID NO: 1139929 - DNA, 22 bp, Artificial Sequence
  chemically synthesized
atggtacgaggactaatcagaa

SEQ ID NO: 1139930 - DNA, 22 bp, Artificial Sequence
  chemically synthesized
gatggtacgaggactaatcaga

SEQ ID NO: 1139931 - DNA, 22 bp, Artificial Sequence
  chemically synthesized
agttcaggtcttctgattagtc

SEQ ID NO: 1139932 - DNA, 22 bp, Artificial Sequence
  chemically synthesized
gttcaggtcttctgattagtcc

SEQ ID NO: 1139933 - DNA, 22 bp, Artificial Sequence
  chemically synthesized
aggtcttctgattagtcctcgt

SEQ ID NO: 1139934 - DNA, 22 bp, Artificial Sequence
  chemically synthesized
ctgattagtcctcgtaccatca

SEQ ID NO: 1139935 - DNA, 22 bp, Artificial Sequence
  chemically synthesized
tgattagtcctcgtaccatcaa

SEQ ID NO: 1139936 - DNA, 22 bp, Artificial Sequence
  chemically synthesized
gtaggaagatgtttgatggtac

SEQ ID NO: 1139937 - DNA, 22 bp, Artificial Sequence
  chemically synthesized
ggtaggaagatgtttgatggta

SEQ ID NO: 1139938 - DNA, 22 bp, Artificial Sequence
  chemically synthesized
attagtcctcgtaccatcaaac

SEQ ID NO: 1139939 - DNA, 22 bp, Artificial Sequence
  chemically synthesized
tggtaggaagatgtttgatggt

SEQ ID NO: 1139940 - DNA, 22 bp, Artificial Sequence
  chemically synthesized
ttggtaggaagatgtttgatgg

SEQ ID NO: 1139941 - DNA, 22 bp, Artificial Sequence
  chemically synthesized
tttggtaggaagatgtttgatg

SEQ ID NO: 1139942 - DNA, 22 bp, Artificial Sequence
  chemically synthesized
gtcctcgtaccatcaaacatct

SEQ ID NO: 1139943 - DNA, 22 bp, Artificial Sequence
  chemically synthesized
tttttggtaggaagatgtttga

SEQ ID NO: 1139944 - DNA, 22 bp, Artificial Sequence
  chemically synthesized
gtaccatcaaacatcttcctac

SEQ ID NO: 1139945 - DNA, 22 bp, Artificial Sequence
  chemically synthesized
taattctttttggtaggaagat

SEQ ID NO: 1139946 - DNA, 22 bp, Artificial Sequence
  chemically synthesized
gtaattctttttggtaggaaga

SEQ ID NO: 1139947 - DNA, 22 bp, Artificial Sequence
  chemically synthesized
tgtaattctttttggtaggaag

SEQ ID NO: 1139948 - DNA, 22 bp, Artificial Sequence
  chemically synthesized
ttgtaattctttttggtaggaa

SEQ ID NO: 1139949 - DNA, 22 bp, Artificial Sequence
  chemically synthesized
catttttgtaattctttttggt

SEQ ID NO: 1139950 - DNA, 22 bp, Artificial Sequence
  chemically synthesized
gcatttttgtaattctttttgg

SEQ ID NO: 1139951 - DNA, 22 bp, Artificial Sequence
  chemically synthesized
cctaccaaaaagaattacaaaa

SEQ ID NO: 1139952 - DNA, 22 bp, Artificial Sequence
  chemically synthesized
ctaccaaaaagaattacaaaaa

SEQ ID NO: 1139953 - DNA, 22 bp, Artificial Sequence
  chemically synthesized
ccaaaaagaattacaaaaatgc

SEQ ID NO: 1139954 - DNA, 22 bp, Artificial Sequence
  chemically synthesized
caaaagaatcatatttgcattt

SEQ ID NO: 1139955 - DNA, 22 bp, Artificial Sequence
  chemically synthesized
gcaaaagaatcatatttgcatt

SEQ ID NO: 1139956 - DNA, 22 bp, Artificial Sequence
  chemically synthesized
agagtttgcaaaagaatcatat

SEQ ID NO: 1139957 - DNA, 22 bp, Artificial Sequence
  chemically synthesized
caaaaatgcaaatatgattctt

SEQ ID NO: 1139958 - DNA, 22 bp, Artificial Sequence
  chemically synthesized
atggggagccattgagagtttg

SEQ ID NO: 1139959 - DNA, 22 bp, Artificial Sequence
  chemically synthesized
cagctgatggggagccattgag

SEQ ID NO: 1139960 - DNA, 22 bp, Artificial Sequence
  chemically synthesized
ttttgcaaactctcaatggctc

SEQ ID NO: 1139961 - DNA, 22 bp, Artificial Sequence
  chemically synthesized
ttgcaaactctcaatggctccc

SEQ ID NO: 1139962 - DNA, 22 bp, Artificial Sequence
  chemically synthesized
tgcaaactctcaatggctcccc

SEQ ID NO: 1139963 - DNA, 22 bp, Artificial Sequence
  chemically synthesized
gcaaactctcaatggctcccca

SEQ ID NO: 1139964 - DNA, 22 bp, Artificial Sequence
  chemically synthesized
gcctgcagctgatggggagcca

SEQ ID NO: 1139965 - DNA, 22 bp, Artificial Sequence
  chemically synthesized
caaactctcaatggctccccat

SEQ ID NO: 1139966 - DNA, 22 bp, Artificial Sequence
  chemically synthesized
ggcctgcagctgatggggagcc

SEQ ID NO: 1139967 - DNA, 22 bp, Artificial Sequence
  chemically synthesized
tggcctgcagctgatggggagc

SEQ ID NO: 1139968 - DNA, 22 bp, Artificial Sequence
  chemically synthesized
tcaatggctccccatcagctgc

SEQ ID NO: 1139969 - DNA, 22 bp, Artificial Sequence
  chemically synthesized
tagttttggcctgcagctgatg

SEQ ID NO: 1139970 - DNA, 22 bp, Artificial Sequence
  chemically synthesized
gtagttttggcctgcagctgat

SEQ ID NO: 1139971 - DNA, 22 bp, Artificial Sequence
  chemically synthesized
aatggctccccatcagctgcag

SEQ ID NO: 1139972 - DNA, 22 bp, Artificial Sequence
  chemically synthesized
tatttgtagttttggcctgcag

SEQ ID NO: 1139973 - DNA, 22 bp, Artificial Sequence
  chemically synthesized
cccatcagctgcaggccaaaac

SEQ ID NO: 1139974 - DNA, 22 bp, Artificial Sequence
  chemically synthesized
caggccaaaactacaaatacag

SEQ ID NO: 1139975 - DNA, 22 bp, Artificial Sequence
  chemically synthesized
aaaacacgagtgcaaaaatatc

SEQ ID NO: 1139976 - DNA, 22 bp, Artificial Sequence
  chemically synthesized
caaatacagctgatatttttgc

SEQ ID NO: 1139977 - DNA, 22 bp, Artificial Sequence
  chemically synthesized
gaaaacacgagtgcaaaaatat

SEQ ID NO: 1139978 - DNA, 22 bp, Artificial Sequence
  chemically synthesized
tatatgtttgaaaacacgagtg

SEQ ID NO: 1139979 - DNA, 22 bp, Artificial Sequence
  chemically synthesized
atatttttgcactcgtgttttc

SEQ ID NO: 1139980 - DNA, 22 bp, Artificial Sequence
  chemically synthesized
ttgcactcgtgttttcaaacat

SEQ ID NO: 1139981 - DNA, 22 bp, Artificial Sequence
  chemically synthesized
tgcactcgtgttttcaaacata

SEQ ID NO: 1139982 - DNA, 22 bp, Artificial Sequence
  chemically synthesized
gcactcgtgttttcaaacatat

SEQ ID NO: 1139983 - DNA, 22 bp, Artificial Sequence
  chemically synthesized
cactcgtgttttcaaacatata

SEQ ID NO: 1139984 - DNA, 22 bp, Artificial Sequence
  chemically synthesized
agaaaagtaacctgtatatgtt

SEQ ID NO: 1139985 - DNA, 22 bp, Artificial Sequence
  chemically synthesized
gtgttttcaaacatatacaggt

SEQ ID NO: 1139986 - DNA, 22 bp, Artificial Sequence
  chemically synthesized
tcaaacatatacaggttacttt

SEQ ID NO: 1139987 - DNA, 22 bp, Artificial Sequence
  chemically synthesized
caaacatatacaggttactttt

SEQ ID NO: 1139988 - DNA, 22 bp, Artificial Sequence
  chemically synthesized
aaacatatacaggttacttttc

SEQ ID NO: 1139989 - DNA, 22 bp, Artificial Sequence
  chemically synthesized
ccgaaaatagagttcagaaaag

SEQ ID NO: 1139990 - DNA, 22 bp, Artificial Sequence
  chemically synthesized
cttttctgaactctattttcgg

SEQ ID NO: 1139991 - DNA, 22 bp, Artificial Sequence
  chemically synthesized
agtgatgtgactgccgaaaata

SEQ ID NO: 1139992 - DNA, 22 bp, Artificial Sequence
  chemically synthesized
ttctgaactctattttcggcag

SEQ ID NO: 1139993 - DNA, 22 bp, Artificial Sequence
  chemically synthesized
tctgaactctattttcggcagt

SEQ ID NO: 1139994 - DNA, 22 bp, Artificial Sequence
  chemically synthesized
ttaagtgatgtgactgccgaaa

SEQ ID NO: 1139995 - DNA, 22 bp, Artificial Sequence
  chemically synthesized
ctgaactctattttcggcagtc

SEQ ID NO: 1139996 - DNA, 22 bp, Artificial Sequence
  chemically synthesized
attaagtgatgtgactgccgaa

SEQ ID NO: 1139997 - DNA, 22 bp, Artificial Sequence
  chemically synthesized
tgaactctattttcggcagtca

SEQ ID NO: 1139998 - DNA, 22 bp, Artificial Sequence
  chemically synthesized
tattaagtgatgtgactgccga

SEQ ID NO: 1139999 - DNA, 22 bp, Artificial Sequence
  chemically synthesized
aactctattttcggcagtcaca

SEQ ID NO: 1140000 - DNA, 22 bp, Artificial Sequence
  chemically synthesized
tattttcggcagtcacatcact

SEQ ID NO: 1140001 - DNA, 22 bp, Artificial Sequence
  chemically synthesized
ttttcggcagtcacatcactta

SEQ ID NO: 1140002 - DNA, 22 bp, Artificial Sequence
  chemically synthesized
tcggcagtcacatcacttaata

SEQ ID NO: 1140003 - DNA, 22 bp, Artificial Sequence
  chemically synthesized
cggcagtcacatcacttaataa

SEQ ID NO: 1140004 - DNA, 22 bp, Artificial Sequence
  chemically synthesized
ggcagtcacatcacttaataaa

SEQ ID NO: 1140005 - DNA, 22 bp, Artificial Sequence
  chemically synthesized
aaagaatatggactttattaag

SEQ ID NO: 1140006 - DNA, 22 bp, Artificial Sequence
  chemically synthesized
ctcaaagaatatggactttatt

SEQ ID NO: 1140007 - DNA, 22 bp, Artificial Sequence
  chemically synthesized
ttgctcaaagaatatggacttt

SEQ ID NO: 1140008 - DNA, 22 bp, Artificial Sequence
  chemically synthesized
aataaagtccatattctttgag

SEQ ID NO: 1140009 - DNA, 22 bp, Artificial Sequence
  chemically synthesized
ataaagtccatattctttgagc

SEQ ID NO: 1140010 - DNA, 22 bp, Artificial Sequence
  chemically synthesized
ataagaaattattgctcaaaga

SEQ ID NO: 1140011 - DNA, 22 bp, Artificial Sequence
  chemically synthesized
ttgataagaaattattgctcaa

SEQ ID NO: 1140012 - DNA, 22 bp, Artificial Sequence
  chemically synthesized
ttattgataagaaattattgct

SEQ ID NO: 1140013 - DNA, 22 bp, Artificial Sequence
  chemically synthesized
attattgataagaaattattgc

SEQ ID NO: 1140014 - DNA, 22 bp, Artificial Sequence
  chemically synthesized
gcttattattgataagaaatta

SEQ ID NO: 1140015 - DNA, 22 bp, Artificial Sequence
  chemically synthesized
tttgagcaataatttcttatca

SEQ ID NO: 1140016 - DNA, 22 bp, Artificial Sequence
  chemically synthesized
tgagcaataatttcttatcaat

SEQ ID NO: 1140017 - DNA, 22 bp, Artificial Sequence
  chemically synthesized
gagcaataatttcttatcaata

SEQ ID NO: 1140018 - DNA, 22 bp, Artificial Sequence
  chemically synthesized
agcaataatttcttatcaataa

SEQ ID NO: 1140019 - DNA, 22 bp, Artificial Sequence
  chemically synthesized
caagctagcttattattgataa

SEQ ID NO: 1140020 - DNA, 22 bp, Artificial Sequence
  chemically synthesized
ttacaagctagcttattattga

SEQ ID NO: 1140021 - DNA, 22 bp, Artificial Sequence
  chemically synthesized
ttattacaagctagcttattat

SEQ ID NO: 1140022 - DNA, 22 bp, Artificial Sequence
  chemically synthesized
gttattacaagctagcttatta

SEQ ID NO: 1140023 - DNA, 22 bp, Artificial Sequence
  chemically synthesized
cttgttattacaagctagctta

SEQ ID NO: 1140024 - DNA, 22 bp, Artificial Sequence
  chemically synthesized
cttatcaataataagctagctt

SEQ ID NO: 1140025 - DNA, 22 bp, Artificial Sequence
  chemically synthesized
ttatcaataataagctagcttg

SEQ ID NO: 1140026 - DNA, 22 bp, Artificial Sequence
  chemically synthesized
atcaataataagctagcttgta

SEQ ID NO: 1140027 - DNA, 22 bp, Artificial Sequence
  chemically synthesized
tcaataataagctagcttgtaa

SEQ ID NO: 1140028 - DNA, 22 bp, Artificial Sequence
  chemically synthesized
tgtattacttgttattacaagc

SEQ ID NO: 1140029 - DNA, 22 bp, Artificial Sequence
  chemically synthesized
atgtattacttgttattacaag

SEQ ID NO: 1140030 - DNA, 22 bp, Artificial Sequence
  chemically synthesized
acttatgtattacttgttatta

SEQ ID NO: 1140031 - DNA, 22 bp, Artificial Sequence
  chemically synthesized
gcttgtaataacaagtaataca

SEQ ID NO: 1140032 - DNA, 22 bp, Artificial Sequence
  chemically synthesized
aaatagattcacttatgtatta

SEQ ID NO: 1140033 - DNA, 22 bp, Artificial Sequence
  chemically synthesized
gtaataacaagtaatacataag

SEQ ID NO: 1140034 - DNA, 22 bp, Artificial Sequence
  chemically synthesized
aaaatagattcacttatgtatt

SEQ ID NO: 1140035 - DNA, 22 bp, Artificial Sequence
  chemically synthesized
taataacaagtaatacataagt

SEQ ID NO: 1140036 - DNA, 22 bp, Artificial Sequence
  chemically synthesized
atttaaaatagattcacttatg

SEQ ID NO: 1140037 - DNA, 22 bp, Artificial Sequence
  chemically synthesized
aatttaaaatagattcacttat

SEQ ID NO: 1140038 - DNA, 22 bp, Artificial Sequence
  chemically synthesized
taatttaaaatagattcactta

SEQ ID NO: 1140039 - DNA, 22 bp, Artificial Sequence
  chemically synthesized
ttaatttaaaatagattcactt

SEQ ID NO: 1140040 - DNA, 22 bp, Artificial Sequence
  chemically synthesized
gtcttttaatttaaaatagatt

SEQ ID NO: 1140041 - DNA, 22 bp, Artificial Sequence
  chemically synthesized
attggtcttttaatttaaaata

SEQ ID NO: 1140042 - DNA, 22 bp, Artificial Sequence
  chemically synthesized
accctcattggtcttttaattt

SEQ ID NO: 1140043 - DNA, 22 bp, Artificial Sequence
  chemically synthesized
ttttaaattaaaagaccaatga

SEQ ID NO: 1140044 - DNA, 22 bp, Artificial Sequence
  chemically synthesized
taaattaaaagaccaatgaggg

SEQ ID NO: 1140045 - DNA, 22 bp, Artificial Sequence
  chemically synthesized
cataaatgctaaccctcattgg

SEQ ID NO: 1140046 - DNA, 22 bp, Artificial Sequence
  chemically synthesized
aaattaaaagaccaatgagggt

SEQ ID NO: 1140047 - DNA, 22 bp, Artificial Sequence
  chemically synthesized
aattaaaagaccaatgagggtt

SEQ ID NO: 1140048 - DNA, 22 bp, Artificial Sequence
  chemically synthesized
ctccataaatgctaaccctcat

SEQ ID NO: 1140049 - DNA, 22 bp, Artificial Sequence
  chemically synthesized
gctccataaatgctaaccctca

SEQ ID NO: 1140050 - DNA, 22 bp, Artificial Sequence
  chemically synthesized
tgctccataaatgctaaccctc

SEQ ID NO: 1140051 - DNA, 22 bp, Artificial Sequence
  chemically synthesized
ttgctccataaatgctaaccct

SEQ ID NO: 1140052 - DNA, 22 bp, Artificial Sequence
  chemically synthesized
aaagaccaatgagggttagcat

SEQ ID NO: 1140053 - DNA, 22 bp, Artificial Sequence
  chemically synthesized
tttgctccataaatgctaaccc

SEQ ID NO: 1140054 - DNA, 22 bp, Artificial Sequence
  chemically synthesized
ttttgctccataaatgctaacc

SEQ ID NO: 1140055 - DNA, 22 bp, Artificial Sequence
  chemically synthesized
tttttgctccataaatgctaac

SEQ ID NO: 1140056 - DNA, 22 bp, Artificial Sequence
  chemically synthesized
atacattttttttgctccataa

SEQ ID NO: 1140057 - DNA, 22 bp, Artificial Sequence
  chemically synthesized
catacattttttttgctccata

SEQ ID NO: 1140058 - DNA, 22 bp, Artificial Sequence
  chemically synthesized
tttcatacattttttttgctcc

SEQ ID NO: 1140059 - DNA, 22 bp, Artificial Sequence
  chemically synthesized
gtttcatacattttttttgctc

SEQ ID NO: 1140060 - DNA, 22 bp, Artificial Sequence
  chemically synthesized
gcatttatggagcaaaaaaaat

SEQ ID NO: 1140061 - DNA, 22 bp, Artificial Sequence
  chemically synthesized
tttgtttcatacattttttttg

SEQ ID NO: 1140062 - DNA, 22 bp, Artificial Sequence
  chemically synthesized
atttgtttcatacatttttttt

SEQ ID NO: 1140063 - DNA, 22 bp, Artificial Sequence
  chemically synthesized
tttatttgtttcatacattttt

SEQ ID NO: 1140064 - DNA, 22 bp, Artificial Sequence
  chemically synthesized
atggagcaaaaaaaatgtatga

SEQ ID NO: 1140065 - DNA, 22 bp, Artificial Sequence
  chemically synthesized
tggagcaaaaaaaatgtatgaa

SEQ ID NO: 1140066 - DNA, 22 bp, Artificial Sequence
  chemically synthesized
ccagctatttatttgtttcata

SEQ ID NO: 1140067 - DNA, 22 bp, Artificial Sequence
  chemically synthesized
accagctatttatttgtttcat

SEQ ID NO: 1140068 - DNA, 22 bp, Artificial Sequence
  chemically synthesized
taccagctatttatttgtttca

SEQ ID NO: 1140069 - DNA, 22 bp, Artificial Sequence
  chemically synthesized
aatacgtaccattttaccagct

SEQ ID NO: 1140070 - DNA, 22 bp, Artificial Sequence
  chemically synthesized
aaatacgtaccattttaccagc

SEQ ID NO: 1140071 - DNA, 22 bp, Artificial Sequence
  chemically synthesized
taaatacgtaccattttaccag

SEQ ID NO: 1140072 - DNA, 22 bp, Artificial Sequence
  chemically synthesized
attttaaatacgtaccatttta

SEQ ID NO: 1140073 - DNA, 22 bp, Artificial Sequence
  chemically synthesized
cactcattttaaatacgtacca

SEQ ID NO: 1140074 - DNA, 22 bp, Artificial Sequence
  chemically synthesized
ccactcattttaaatacgtacc

SEQ ID NO: 1140075 - DNA, 22 bp, Artificial Sequence
  chemically synthesized
tccactcattttaaatacgtac

SEQ ID NO: 1140076 - DNA, 22 bp, Artificial Sequence
  chemically synthesized
ttccactcattttaaatacgta

SEQ ID NO: 1140077 - DNA, 22 bp, Artificial Sequence
  chemically synthesized
gtaaaatggtacgtatttaaaa

SEQ ID NO: 1140078 - DNA, 22 bp, Artificial Sequence
  chemically synthesized
agtaaatttttccactcatttt

SEQ ID NO: 1140079 - DNA, 22 bp, Artificial Sequence
  chemically synthesized
aagtaaatttttccactcattt

SEQ ID NO: 1140080 - DNA, 22 bp, Artificial Sequence
  chemically synthesized
aacttaagtaaatttttccact

SEQ ID NO: 1140081 - DNA, 22 bp, Artificial Sequence
  chemically synthesized
taaacttaagtaaatttttcca

SEQ ID NO: 1140082 - DNA, 22 bp, Artificial Sequence
  chemically synthesized
ctaaacttaagtaaatttttcc

SEQ ID NO: 1140083 - DNA, 22 bp, Artificial Sequence
  chemically synthesized
aaaatgagtggaaaaatttact

SEQ ID NO: 1140084 - DNA, 22 bp, Artificial Sequence
  chemically synthesized
aaatgagtggaaaaatttactt

SEQ ID NO: 1140085 - DNA, 22 bp, Artificial Sequence
  chemically synthesized
ataataatgcaataatttctaa

SEQ ID NO: 1140086 - DNA, 22 bp, Artificial Sequence
  chemically synthesized
cataataatgcaataatttcta

SEQ ID NO: 1140087 - DNA, 22 bp, Artificial Sequence
  chemically synthesized
acttaagtttagaaattattgc

SEQ ID NO: 1140088 - DNA, 22 bp, Artificial Sequence
  chemically synthesized
cttaagtttagaaattattgca

SEQ ID NO: 1140089 - DNA, 22 bp, Artificial Sequence
  chemically synthesized
tacttcataataatgcaataat

SEQ ID NO: 1140090 - DNA, 22 bp, Artificial Sequence
  chemically synthesized
aagtttagaaattattgcatta

SEQ ID NO: 1140091 - DNA, 22 bp, Artificial Sequence
  chemically synthesized
agtttagaaattattgcattat

SEQ ID NO: 1140092 - DNA, 22 bp, Artificial Sequence
  chemically synthesized
cattgtacttcataataatgca

SEQ ID NO: 1140093 - DNA, 22 bp, Artificial Sequence
  chemically synthesized
agaaattattgcattattatga

SEQ ID NO: 1140094 - DNA, 22 bp, Artificial Sequence
  chemically synthesized
ttgcattgtacttcataataat

SEQ ID NO: 1140095 - DNA, 22 bp, Artificial Sequence
  chemically synthesized
gaaattattgcattattatgaa

SEQ ID NO: 1140096 - DNA, 22 bp, Artificial Sequence
  chemically synthesized
ttattgcattgtacttcataat

SEQ ID NO: 1140097 - DNA, 22 bp, Artificial Sequence
  chemically synthesized
attattgcattgtacttcataa

SEQ ID NO: 1140098 - DNA, 22 bp, Artificial Sequence
  chemically synthesized
tattattgcattgtacttcata

SEQ ID NO: 1140099 - DNA, 22 bp, Artificial Sequence
  chemically synthesized
ttgcattattatgaagtacaat

SEQ ID NO: 1140100 - DNA, 22 bp, Artificial Sequence
  chemically synthesized
acctttattattgcattgtact

SEQ ID NO: 1140101 - DNA, 22 bp, Artificial Sequence
  chemically synthesized
cattattatgaagtacaatgca

SEQ ID NO: 1140102 - DNA, 22 bp, Artificial Sequence
  chemically synthesized
cacctttattattgcattgtac

SEQ ID NO: 1140103 - DNA, 22 bp, Artificial Sequence
  chemically synthesized
ttatgaagtacaatgcaataat

SEQ ID NO: 1140104 - DNA, 22 bp, Artificial Sequence
  chemically synthesized
tgaagtacaatgcaataataaa

SEQ ID NO: 1140105 - DNA, 22 bp, Artificial Sequence
  chemically synthesized
cataatttcacctttattattg

SEQ ID NO: 1140106 - DNA, 22 bp, Artificial Sequence
  chemically synthesized
taagtagtgttccataatttca

SEQ ID NO: 1140107 - DNA, 22 bp, Artificial Sequence
  chemically synthesized
taaaacaaaatggttgtaagta

SEQ ID NO: 1140108 - DNA, 22 bp, Artificial Sequence
  chemically synthesized
ataaaacaaaatggttgtaagt

SEQ ID NO: 1140109 - DNA, 22 bp, Artificial Sequence
  chemically synthesized
tataaaacaaaatggttgtaag

SEQ ID NO: 1140110 - DNA, 22 bp, Artificial Sequence
  chemically synthesized
ttataaaacaaaatggttgtaa

SEQ ID NO: 1140111 - DNA, 22 bp, Artificial Sequence
  chemically synthesized
tggaacactacttacaaccatt

SEQ ID NO: 1140112 - DNA, 22 bp, Artificial Sequence
  chemically synthesized
atatgaacttttataaaacaaa

SEQ ID NO: 1140113 - DNA, 22 bp, Artificial Sequence
  chemically synthesized
cttacaaccattttgttttata

SEQ ID NO: 1140114 - DNA, 22 bp, Artificial Sequence
  chemically synthesized
gatatgaacttttataaaacaa

SEQ ID NO: 1140115 - DNA, 22 bp, Artificial Sequence
  chemically synthesized
acaaccattttgttttataaaa

SEQ ID NO: 1140116 - DNA, 22 bp, Artificial Sequence
  chemically synthesized
caaccattttgttttataaaag

SEQ ID NO: 1140117 - DNA, 22 bp, Artificial Sequence
  chemically synthesized
atttgatatgaacttttataaa

SEQ ID NO: 1140118 - DNA, 22 bp, Artificial Sequence
  chemically synthesized
aatgttcatttgatatgaactt

SEQ ID NO: 1140119 - DNA, 22 bp, Artificial Sequence
  chemically synthesized
tgttttataaaagttcatatca

SEQ ID NO: 1140120 - DNA, 22 bp, Artificial Sequence
  chemically synthesized
gttttataaaagttcatatcaa

SEQ ID NO: 1140121 - DNA, 22 bp, Artificial Sequence
  chemically synthesized
ttttataaaagttcatatcaaa

SEQ ID NO: 1140122 - DNA, 22 bp, Artificial Sequence
  chemically synthesized
attaaatgttcatttgatatga

SEQ ID NO: 1140123 - DNA, 22 bp, Artificial Sequence
  chemically synthesized
gattaaatgttcatttgatatg

SEQ ID NO: 1140124 - DNA, 22 bp, Artificial Sequence
  chemically synthesized
tataaaagttcatatcaaatga

SEQ ID NO: 1140125 - DNA, 22 bp, Artificial Sequence
  chemically synthesized
ataaaagttcatatcaaatgaa

SEQ ID NO: 1140126 - DNA, 22 bp, Artificial Sequence
  chemically synthesized
taaaagttcatatcaaatgaac

SEQ ID NO: 1140127 - DNA, 22 bp, Artificial Sequence
  chemically synthesized
atagatttgattaaatgttcat

SEQ ID NO: 1140128 - DNA, 22 bp, Artificial Sequence
  chemically synthesized
gatagatttgattaaatgttca

SEQ ID NO: 1140129 - DNA, 22 bp, Artificial Sequence
  chemically synthesized
tgatagatttgattaaatgttc

SEQ ID NO: 1140130 - DNA, 22 bp, Artificial Sequence
  chemically synthesized
ttgatagatttgattaaatgtt

SEQ ID NO: 1140131 - DNA, 22 bp, Artificial Sequence
  chemically synthesized
atatcaaatgaacatttaatca

SEQ ID NO: 1140132 - DNA, 22 bp, Artificial Sequence
  chemically synthesized
aaatttttgatagatttgatta

SEQ ID NO: 1140133 - DNA, 22 bp, Artificial Sequence
  chemically synthesized
aaaatttttgatagatttgatt

SEQ ID NO: 1140134 - DNA, 22 bp, Artificial Sequence
  chemically synthesized
ttaaaatttttgatagatttga

SEQ ID NO: 1140135 - DNA, 22 bp, Artificial Sequence
  chemically synthesized
cttaaaatttttgatagatttg

SEQ ID NO: 1140136 - DNA, 22 bp, Artificial Sequence
  chemically synthesized
tgatttcttaaaatttttgata

SEQ ID NO: 1140137 - DNA, 22 bp, Artificial Sequence
  chemically synthesized
atgatttcttaaaatttttgat

SEQ ID NO: 1140138 - DNA, 22 bp, Artificial Sequence
  chemically synthesized
tatgatttcttaaaatttttga

SEQ ID NO: 1140139 - DNA, 22 bp, Artificial Sequence
  chemically synthesized
aatcaaatctatcaaaaatttt

SEQ ID NO: 1140140 - DNA, 22 bp, Artificial Sequence
  chemically synthesized
atcaaatctatcaaaaatttta

SEQ ID NO: 1140141 - DNA, 22 bp, Artificial Sequence
  chemically synthesized
ctttatgatttcttaaaatttt

SEQ ID NO: 1140142 - DNA, 22 bp, Artificial Sequence
  chemically synthesized
tactttatgatttcttaaaatt

SEQ ID NO: 1140143 - DNA, 22 bp, Artificial Sequence
  chemically synthesized
tcaaaaattttaagaaatcata

SEQ ID NO: 1140144 - DNA, 22 bp, Artificial Sequence
  chemically synthesized
acgtgacatattctactttatg

SEQ ID NO: 1140145 - DNA, 22 bp, Artificial Sequence
  chemically synthesized
cacgtgacatattctactttat

SEQ ID NO: 1140146 - DNA, 22 bp, Artificial Sequence
  chemically synthesized
tcacgtgacatattctacttta

SEQ ID NO: 1140147 - DNA, 22 bp, Artificial Sequence
  chemically synthesized
ttcacgtgacatattctacttt

SEQ ID NO: 1140148 - DNA, 22 bp, Artificial Sequence
  chemically synthesized
taagaaatcataaagtagaata

SEQ ID NO: 1140149 - DNA, 22 bp, Artificial Sequence
  chemically synthesized
aagaaatcataaagtagaatat

SEQ ID NO: 1140150 - DNA, 22 bp, Artificial Sequence
  chemically synthesized
agaaatcataaagtagaatatg

SEQ ID NO: 1140151 - DNA, 22 bp, Artificial Sequence
  chemically synthesized
atttttcacgtgacatattcta

SEQ ID NO: 1140152 - DNA, 22 bp, Artificial Sequence
  chemically synthesized
aatttttcacgtgacatattct

SEQ ID NO: 1140153 - DNA, 22 bp, Artificial Sequence
  chemically synthesized
tgagtttaatttttcacgtgac

SEQ ID NO: 1140154 - DNA, 22 bp, Artificial Sequence
  chemically synthesized
atactatgagtttaatttttca

SEQ ID NO: 1140155 - DNA, 22 bp, Artificial Sequence
  chemically synthesized
gtaaaagaggccggtctgatac

SEQ ID NO: 1140156 - DNA, 22 bp, Artificial Sequence
  chemically synthesized
tagtaaaagaggccggtctgat

SEQ ID NO: 1140157 - DNA, 22 bp, Artificial Sequence
  chemically synthesized
ctagtaaaagaggccggtctga

SEQ ID NO: 1140158 - DNA, 22 bp, Artificial Sequence
  chemically synthesized
aactcatagtatcagaccggcc

SEQ ID NO: 1140159 - DNA, 22 bp, Artificial Sequence
  chemically synthesized
atagtatcagaccggcctcttt

SEQ ID NO: 1140160 - DNA, 22 bp, Artificial Sequence
  chemically synthesized
tcatttctagtaaaagaggccg

SEQ ID NO: 1140161 - DNA, 22 bp, Artificial Sequence
  chemically synthesized
atcatttctagtaaaagaggcc

SEQ ID NO: 1140162 - DNA, 22 bp, Artificial Sequence
  chemically synthesized
tatcatttctagtaaaagaggc

SEQ ID NO: 1140163 - DNA, 22 bp, Artificial Sequence
  chemically synthesized
tgaattttatcatttctagtaa

SEQ ID NO: 1140164 - DNA, 22 bp, Artificial Sequence
  chemically synthesized
tgtgaattttatcatttctagt

SEQ ID NO: 1140165 - DNA, 22 bp, Artificial Sequence
  chemically synthesized
ctctgtgaattttatcatttct

SEQ ID NO: 1140166 - DNA, 22 bp, Artificial Sequence
  chemically synthesized
actctgtgaattttatcatttc

SEQ ID NO: 1140167 - DNA, 22 bp, Artificial Sequence
  chemically synthesized
ttactctgtgaattttatcatt

SEQ ID NO: 1140168 - DNA, 22 bp, Artificial Sequence
  chemically synthesized
ttttactagaaatgataaaatt

SEQ ID NO: 1140169 - DNA, 22 bp, Artificial Sequence
  chemically synthesized
tcttactctgtgaattttatca

SEQ ID NO: 1140170 - DNA, 22 bp, Artificial Sequence
  chemically synthesized
ctcttactctgtgaattttatc

SEQ ID NO: 1140171 - DNA, 22 bp, Artificial Sequence
  chemically synthesized
ttactagaaatgataaaattca

SEQ ID NO: 1140172 - DNA, 22 bp, Artificial Sequence
  chemically synthesized
tactagaaatgataaaattcac

SEQ ID NO: 1140173 - DNA, 22 bp, Artificial Sequence
  chemically synthesized
actagaaatgataaaattcaca

SEQ ID NO: 1140174 - DNA, 22 bp, Artificial Sequence
  chemically synthesized
ctagaaatgataaaattcacag

SEQ ID NO: 1140175 - DNA, 22 bp, Artificial Sequence
  chemically synthesized
aagtttctcttactctgtgaat

SEQ ID NO: 1140176 - DNA, 22 bp, Artificial Sequence
  chemically synthesized
gaaatgataaaattcacagagt

SEQ ID NO: 1140177 - DNA, 22 bp, Artificial Sequence
  chemically synthesized
taaagtttctcttactctgtga

SEQ ID NO: 1140178 - DNA, 22 bp, Artificial Sequence
  chemically synthesized
acagagtaagagaaactttaga

SEQ ID NO: 1140179 - DNA, 22 bp, Artificial Sequence
  chemically synthesized
aaaaaaaaaaaaaaaactctaa

SEQ ID NO: 1140180 - DNA, 22 bp, Artificial Sequence
  chemically synthesized
aaaaaaaaaaaaaaaaactcta

SEQ ID NO: 1140181 - DNA, 22 bp, Artificial Sequence
  chemically synthesized
caagatttaaaaaaaaaaaaaa

SEQ ID NO: 1140182 - DNA, 22 bp, Artificial Sequence
  chemically synthesized
ccaagatttaaaaaaaaaaaaa

SEQ ID NO: 1140183 - DNA, 22 bp, Artificial Sequence
  chemically synthesized
tagagttttttttttttttttt

SEQ ID NO: 1140184 - DNA, 22 bp, Artificial Sequence
  chemically synthesized
agagttttttttttttttttta

SEQ ID NO: 1140185 - DNA, 22 bp, Artificial Sequence
  chemically synthesized
gagtttttttttttttttttaa

SEQ ID NO: 1140186 - DNA, 22 bp, Artificial Sequence
  chemically synthesized
ttttttttttttttaaatcttg

SEQ ID NO: 1140187 - DNA, 22 bp, Artificial Sequence
  chemically synthesized
agcaggaatttccaagatttaa

SEQ ID NO: 1140188 - DNA, 22 bp, Artificial Sequence
  chemically synthesized
tttttttttttttaaatcttgg

SEQ ID NO: 1140189 - DNA, 22 bp, Artificial Sequence
  chemically synthesized
cagcaggaatttccaagattta

SEQ ID NO: 1140190 - DNA, 22 bp, Artificial Sequence
  chemically synthesized
ttttttttttttaaatcttgga

SEQ ID NO: 1140191 - DNA, 22 bp, Artificial Sequence
  chemically synthesized
tttttttttttaaatcttggaa

SEQ ID NO: 1140192 - DNA, 22 bp, Artificial Sequence
  chemically synthesized
ttttttttttaaatcttggaaa

SEQ ID NO: 1140193 - DNA, 22 bp, Artificial Sequence
  chemically synthesized
tttttttttaaatcttggaaat

SEQ ID NO: 1140194 - DNA, 22 bp, Artificial Sequence
  chemically synthesized
gtttcagcaggaatttccaaga

SEQ ID NO: 1140195 - DNA, 22 bp, Artificial Sequence
  chemically synthesized
ttttttttaaatcttggaaatt

SEQ ID NO: 1140196 - DNA, 22 bp, Artificial Sequence
  chemically synthesized
ggtttcagcaggaatttccaag

SEQ ID NO: 1140197 - DNA, 22 bp, Artificial Sequence
  chemically synthesized
tttttttaaatcttggaaattc

SEQ ID NO: 1140198 - DNA, 22 bp, Artificial Sequence
  chemically synthesized
ttttttaaatcttggaaattcc

SEQ ID NO: 1140199 - DNA, 22 bp, Artificial Sequence
  chemically synthesized
tttttaaatcttggaaattcct

SEQ ID NO: 1140200 - DNA, 22 bp, Artificial Sequence
  chemically synthesized
ttttaaatcttggaaattcctg

SEQ ID NO: 1140201 - DNA, 22 bp, Artificial Sequence
  chemically synthesized
tttaaatcttggaaattcctgc

SEQ ID NO: 1140202 - DNA, 22 bp, Artificial Sequence
  chemically synthesized
ttaaatcttggaaattcctgct

SEQ ID NO: 1140203 - DNA, 22 bp, Artificial Sequence
  chemically synthesized
taaatcttggaaattcctgctg

SEQ ID NO: 1140204 - DNA, 22 bp, Artificial Sequence
  chemically synthesized
aaatcttggaaattcctgctga

SEQ ID NO: 1140205 - DNA, 22 bp, Artificial Sequence
  chemically synthesized
aagcatttggtttcagcaggaa

SEQ ID NO: 1140206 - DNA, 22 bp, Artificial Sequence
  chemically synthesized
aatcttggaaattcctgctgaa

SEQ ID NO: 1140207 - DNA, 22 bp, Artificial Sequence
  chemically synthesized
attgaagcatttggtttcagca

SEQ ID NO: 1140208 - DNA, 22 bp, Artificial Sequence
  chemically synthesized
cattgaagcatttggtttcagc

SEQ ID NO: 1140209 - DNA, 22 bp, Artificial Sequence
  chemically synthesized
ggaaattcctgctgaaaccaaa

SEQ ID NO: 1140210 - DNA, 22 bp, Artificial Sequence
  chemically synthesized
gaaattcctgctgaaaccaaat

SEQ ID NO: 1140211 - DNA, 22 bp, Artificial Sequence
  chemically synthesized
ctgctgaaaccaaatgcttcaa

SEQ ID NO: 1140212 - DNA, 22 bp, Artificial Sequence
  chemically synthesized
agaaaagacttcattgaagcat

SEQ ID NO: 1140213 - DNA, 22 bp, Artificial Sequence
  chemically synthesized
cagaaaagacttcattgaagca

SEQ ID NO: 1140214 - DNA, 22 bp, Artificial Sequence
  chemically synthesized
ctgaaaccaaatgcttcaatga

SEQ ID NO: 1140215 - DNA, 22 bp, Artificial Sequence
  chemically synthesized
aaaccaaatgcttcaatgaagt

SEQ ID NO: 1140216 - DNA, 22 bp, Artificial Sequence
  chemically synthesized
gcaataaatggatttcagaaaa

SEQ ID NO: 1140217 - DNA, 22 bp, Artificial Sequence
  chemically synthesized
ggcaataaatggatttcagaaa

SEQ ID NO: 1140218 - DNA, 22 bp, Artificial Sequence
  chemically synthesized
caatgaagtcttttctgaaatc

SEQ ID NO: 1140219 - DNA, 22 bp, Artificial Sequence
  chemically synthesized
tggcaataaatggatttcagaa

SEQ ID NO: 1140220 - DNA, 22 bp, Artificial Sequence
  chemically synthesized
aatgaagtcttttctgaaatcc

SEQ ID NO: 1140221 - DNA, 22 bp, Artificial Sequence
  chemically synthesized
tttggcaataaatggatttcag

SEQ ID NO: 1140222 - DNA, 22 bp, Artificial Sequence
  chemically synthesized
ctttggcaataaatggatttca

SEQ ID NO: 1140223 - DNA, 22 bp, Artificial Sequence
  chemically synthesized
ttctgaaatccatttattgcca

SEQ ID NO: 1140224 - DNA, 22 bp, Artificial Sequence
  chemically synthesized
tctgaaatccatttattgccaa

SEQ ID NO: 1140225 - DNA, 22 bp, Artificial Sequence
  chemically synthesized
ctgaaatccatttattgccaaa

SEQ ID NO: 1140226 - DNA, 22 bp, Artificial Sequence
  chemically synthesized
tgaaatccatttattgccaaag

SEQ ID NO: 1140227 - DNA, 22 bp, Artificial Sequence
  chemically synthesized
agaatgagatttctttggcaat

SEQ ID NO: 1140228 - DNA, 22 bp, Artificial Sequence
  chemically synthesized
gagaatgagatttctttggcaa

SEQ ID NO: 1140229 - DNA, 22 bp, Artificial Sequence
  chemically synthesized
aaatccatttattgccaaagaa

SEQ ID NO: 1140230 - DNA, 22 bp, Artificial Sequence
  chemically synthesized
tgagaatgagatttctttggca

SEQ ID NO: 1140231 - DNA, 22 bp, Artificial Sequence
  chemically synthesized
gagtgttttgagaatgagattt

SEQ ID NO: 1140232 - DNA, 22 bp, Artificial Sequence
  chemically synthesized
attgccaaagaaatctcattct

SEQ ID NO: 1140233 - DNA, 22 bp, Artificial Sequence
  chemically synthesized
ttgccaaagaaatctcattctc

SEQ ID NO: 1140234 - DNA, 22 bp, Artificial Sequence
  chemically synthesized
ccaaagaaatctcattctcaaa

SEQ ID NO: 1140235 - DNA, 22 bp, Artificial Sequence
  chemically synthesized
taaatacctcgagtgttttgag

SEQ ID NO: 1140236 - DNA, 22 bp, Artificial Sequence
  chemically synthesized
attataaatacctcgagtgttt

SEQ ID NO: 1140237 - DNA, 22 bp, Artificial Sequence
  chemically synthesized
attctcaaaacactcgaggtat

SEQ ID NO: 1140238 - DNA, 22 bp, Artificial Sequence
  chemically synthesized
tcaaaacactcgaggtatttat

SEQ ID NO: 1140239 - DNA, 22 bp, Artificial Sequence
  chemically synthesized
aaaacactcgaggtatttataa

SEQ ID NO: 1140240 - DNA, 22 bp, Artificial Sequence
  chemically synthesized
tcaaatgacattgattataaat

SEQ ID NO: 1140241 - DNA, 22 bp, Artificial Sequence
  chemically synthesized
gaggtatttataatcaatgtca

SEQ ID NO: 1140242 - DNA, 22 bp, Artificial Sequence
  chemically synthesized
aagcctatcaaatgacattgat

SEQ ID NO: 1140243 - DNA, 22 bp, Artificial Sequence
  chemically synthesized
ataatcaatgtcatttgatagg

SEQ ID NO: 1140244 - DNA, 22 bp, Artificial Sequence
  chemically synthesized
taatcaatgtcatttgataggc

SEQ ID NO: 1140245 - DNA, 22 bp, Artificial Sequence
  chemically synthesized
aagcaaaaaaaaattaaagcct

SEQ ID NO: 1140246 - DNA, 22 bp, Artificial Sequence
  chemically synthesized
caagcaaaaaaaaattaaagcc

SEQ ID NO: 1140247 - DNA, 22 bp, Artificial Sequence
  chemically synthesized
tcaagcaaaaaaaaattaaagc

SEQ ID NO: 1140248 - DNA, 22 bp, Artificial Sequence
  chemically synthesized
ttcaagcaaaaaaaaattaaag

SEQ ID NO: 1140249 - DNA, 22 bp, Artificial Sequence
  chemically synthesized
gtttttcaagcaaaaaaaaatt

SEQ ID NO: 1140250 - DNA, 22 bp, Artificial Sequence
  chemically synthesized
gataggctttaatttttttttg

SEQ ID NO: 1140251 - DNA, 22 bp, Artificial Sequence
  chemically synthesized
ataggctttaatttttttttgc

SEQ ID NO: 1140252 - DNA, 22 bp, Artificial Sequence
  chemically synthesized
taatttttttttgcttgaaaaa

SEQ ID NO: 1140253 - DNA, 22 bp, Artificial Sequence
  chemically synthesized
aatttttttttgcttgaaaaac

SEQ ID NO: 1140254 - DNA, 22 bp, Artificial Sequence
  chemically synthesized
atttttttttgcttgaaaaact

SEQ ID NO: 1140255 - DNA, 22 bp, Artificial Sequence
  chemically synthesized
ttttttgcttgaaaaactaggt

SEQ ID NO: 1140256 - DNA, 22 bp, Artificial Sequence
  chemically synthesized
tttttgcttgaaaaactaggtg

SEQ ID NO: 1140257 - DNA, 22 bp, Artificial Sequence
  chemically synthesized
ttttgcttgaaaaactaggtga

SEQ ID NO: 1140258 - DNA, 22 bp, Artificial Sequence
  chemically synthesized
tttgcttgaaaaactaggtgat

SEQ ID NO: 1140259 - DNA, 22 bp, Artificial Sequence
  chemically synthesized
ttgcttgaaaaactaggtgata

SEQ ID NO: 1140260 - DNA, 22 bp, Artificial Sequence
  chemically synthesized
tgcttgaaaaactaggtgatat

SEQ ID NO: 1140261 - DNA, 22 bp, Artificial Sequence
  chemically synthesized
gcttgaaaaactaggtgatatt

SEQ ID NO: 1140262 - DNA, 22 bp, Artificial Sequence
  chemically synthesized
cttgaaaaactaggtgatattg

SEQ ID NO: 1140263 - DNA, 22 bp, Artificial Sequence
  chemically synthesized
gaaaaactaggtgatattgttt

SEQ ID NO: 1140264 - DNA, 22 bp, Artificial Sequence
  chemically synthesized
aaaaactaggtgatattgtttg

SEQ ID NO: 1140265 - DNA, 22 bp, Artificial Sequence
  chemically synthesized
gagaacagagatccaaacaata

SEQ ID NO: 1140266 - DNA, 22 bp, Artificial Sequence
  chemically synthesized
ggagaacagagatccaaacaat

SEQ ID NO: 1140267 - DNA, 22 bp, Artificial Sequence
  chemically synthesized
ggtgatattgtttggatctctg

SEQ ID NO: 1140268 - DNA, 22 bp, Artificial Sequence
  chemically synthesized
aacatgagatttggagaacaga

SEQ ID NO: 1140269 - DNA, 22 bp, Artificial Sequence
  chemically synthesized
caacatgagatttggagaacag

SEQ ID NO: 1140270 - DNA, 22 bp, Artificial Sequence
  chemically synthesized
tttggatctctgttctccaaat

SEQ ID NO: 1140271 - DNA, 22 bp, Artificial Sequence
  chemically synthesized
ggatctctgttctccaaatctc

SEQ ID NO: 1140272 - DNA, 22 bp, Artificial Sequence
  chemically synthesized
gatctctgttctccaaatctca

SEQ ID NO: 1140273 - DNA, 22 bp, Artificial Sequence
  chemically synthesized
ggaatcacatttcaacatgaga

SEQ ID NO: 1140274 - DNA, 22 bp, Artificial Sequence
  chemically synthesized
tgttctccaaatctcatgttga

SEQ ID NO: 1140275 - DNA, 22 bp, Artificial Sequence
  chemically synthesized
ttctccaaatctcatgttgaaa

SEQ ID NO: 1140276 - DNA, 22 bp, Artificial Sequence
  chemically synthesized
tccaaatctcatgttgaaatgt

SEQ ID NO: 1140277 - DNA, 22 bp, Artificial Sequence
  chemically synthesized
caaatctcatgttgaaatgtga

SEQ ID NO: 1140278 - DNA, 22 bp, Artificial Sequence
  chemically synthesized
caatgctgggaatcacatttca

SEQ ID NO: 1140279 - DNA, 22 bp, Artificial Sequence
  chemically synthesized
cctccaatgctgggaatcacat

SEQ ID NO: 1140280 - DNA, 22 bp, Artificial Sequence
  chemically synthesized
atgttgaaatgtgattcccagc

SEQ ID NO: 1140281 - DNA, 22 bp, Artificial Sequence
  chemically synthesized
aaatgtgattcccagcattgga

SEQ ID NO: 1140282 - DNA, 22 bp, Artificial Sequence
  chemically synthesized
ccaccaggccctacctccaatg

SEQ ID NO: 1140283 - DNA, 22 bp, Artificial Sequence
  chemically synthesized
ccagcattggaggtagggcctg

SEQ ID NO: 1140284 - DNA, 22 bp, Artificial Sequence
  chemically synthesized
atgagccaatcacctcccacca

SEQ ID NO: 1140285 - DNA, 22 bp, Artificial Sequence
  chemically synthesized
gaggtagggcctggtgggaggt

SEQ ID NO: 1140286 - DNA, 22 bp, Artificial Sequence
  chemically synthesized
gtgggaggtgattggctcatga

SEQ ID NO: 1140287 - DNA, 22 bp, Artificial Sequence
  chemically synthesized
atgagacatccgccctcatgag

SEQ ID NO: 1140288 - DNA, 22 bp, Artificial Sequence
  chemically synthesized
agccattcatgagacatccgcc

SEQ ID NO: 1140289 - DNA, 22 bp, Artificial Sequence
  chemically synthesized
gctcatgagggcggatgtctca

SEQ ID NO: 1140290 - DNA, 22 bp, Artificial Sequence
  chemically synthesized
tgctaagccattcatgagacat

SEQ ID NO: 1140291 - DNA, 22 bp, Artificial Sequence
  chemically synthesized
atgagggcggatgtctcatgaa

SEQ ID NO: 1140292 - DNA, 22 bp, Artificial Sequence
  chemically synthesized
atcatgaaagggattgtgctaa

SEQ ID NO: 1140293 - DNA, 22 bp, Artificial Sequence
  chemically synthesized
atgaatggcttagcacaatccc

SEQ ID NO: 1140294 - DNA, 22 bp, Artificial Sequence
  chemically synthesized
actcatcatgaaagggattgtg

SEQ ID NO: 1140295 - DNA, 22 bp, Artificial Sequence
  chemically synthesized
agcacaatccctttcatgatga

SEQ ID NO: 1140296 - DNA, 22 bp, Artificial Sequence
  chemically synthesized
gcacaatccctttcatgatgag

SEQ ID NO: 1140297 - DNA, 22 bp, Artificial Sequence
  chemically synthesized
aatgggaactgactcatcatga

SEQ ID NO: 1140298 - DNA, 22 bp, Artificial Sequence
  chemically synthesized
actgaatgggaactgactcatc

SEQ ID NO: 1140299 - DNA, 22 bp, Artificial Sequence
  chemically synthesized
tcatgatgagtcagttcccatt

SEQ ID NO: 1140300 - DNA, 22 bp, Artificial Sequence
  chemically synthesized
catgatgagtcagttcccattc

SEQ ID NO: 1140301 - DNA, 22 bp, Artificial Sequence
  chemically synthesized
atgatgagtcagttcccattca

SEQ ID NO: 1140302 - DNA, 22 bp, Artificial Sequence
  chemically synthesized
atgtgaactaactgaatgggaa

SEQ ID NO: 1140303 - DNA, 22 bp, Artificial Sequence
  chemically synthesized
catgtgaactaactgaatggga

SEQ ID NO: 1140304 - DNA, 22 bp, Artificial Sequence
  chemically synthesized
aacaaccagatttcatgtgaac

SEQ ID NO: 1140305 - DNA, 22 bp, Artificial Sequence
  chemically synthesized
ccattcagttagttcacatgaa

SEQ ID NO: 1140306 - DNA, 22 bp, Artificial Sequence
  chemically synthesized
aaacaaccagatttcatgtgaa

SEQ ID NO: 1140307 - DNA, 22 bp, Artificial Sequence
  chemically synthesized
taaacaaccagatttcatgtga

SEQ ID NO: 1140308 - DNA, 22 bp, Artificial Sequence
  chemically synthesized
ttaaacaaccagatttcatgtg

SEQ ID NO: 1140309 - DNA, 22 bp, Artificial Sequence
  chemically synthesized
ttttaaacaaccagatttcatg

SEQ ID NO: 1140310 - DNA, 22 bp, Artificial Sequence
  chemically synthesized
agttagttcacatgaaatctgg

SEQ ID NO: 1140311 - DNA, 22 bp, Artificial Sequence
  chemically synthesized
gttcacatgaaatctggttgtt

SEQ ID NO: 1140312 - DNA, 22 bp, Artificial Sequence
  chemically synthesized
acatgaaatctggttgtttaaa

SEQ ID NO: 1140313 - DNA, 22 bp, Artificial Sequence
  chemically synthesized
gttgtttaaaagagtctgggac

SEQ ID NO: 1140314 - DNA, 22 bp, Artificial Sequence
  chemically synthesized
tttaaaagagtctgggaccttc

SEQ ID NO: 1140315 - DNA, 22 bp, Artificial Sequence
  chemically synthesized
aaaagagtctgggaccttcctc

SEQ ID NO: 1140316 - DNA, 22 bp, Artificial Sequence
  chemically synthesized
aaagagtctgggaccttcctct

SEQ ID NO: 1140317 - DNA, 22 bp, Artificial Sequence
  chemically synthesized
ggaccttcctcttatctctttt

SEQ ID NO: 1140318 - DNA, 22 bp, Artificial Sequence
  chemically synthesized
caagagtggaaacaaaagagat

SEQ ID NO: 1140319 - DNA, 22 bp, Artificial Sequence
  chemically synthesized
cctcttatctcttttgtttcca

SEQ ID NO: 1140320 - DNA, 22 bp, Artificial Sequence
  chemically synthesized
ctcttatctcttttgtttccac

SEQ ID NO: 1140321 - DNA, 22 bp, Artificial Sequence
  chemically synthesized
ttatctcttttgtttccactct

SEQ ID NO: 1140322 - DNA, 22 bp, Artificial Sequence
  chemically synthesized
atctcttttgtttccactcttg

SEQ ID NO: 1140323 - DNA, 22 bp, Artificial Sequence
  chemically synthesized
tctcttttgtttccactcttgc

SEQ ID NO: 1140324 - DNA, 22 bp, Artificial Sequence
  chemically synthesized
ttttgtttccactcttgcaatg

SEQ ID NO: 1140325 - DNA, 22 bp, Artificial Sequence
  chemically synthesized
ttgtttccactcttgcaatgtg

SEQ ID NO: 1140326 - DNA, 22 bp, Artificial Sequence
  chemically synthesized
tgtttccactcttgcaatgtga

SEQ ID NO: 1140327 - DNA, 22 bp, Artificial Sequence
  chemically synthesized
gtttccactcttgcaatgtgat

SEQ ID NO: 1140328 - DNA, 22 bp, Artificial Sequence
  chemically synthesized
tttccactcttgcaatgtgata

SEQ ID NO: 1140329 - DNA, 22 bp, Artificial Sequence
  chemically synthesized
ccactcttgcaatgtgatatac

SEQ ID NO: 1140330 - DNA, 22 bp, Artificial Sequence
  chemically synthesized
cactcttgcaatgtgatataca

SEQ ID NO: 1140331 - DNA, 22 bp, Artificial Sequence
  chemically synthesized
ttgcaatgtgatatacactggc

SEQ ID NO: 1140332 - DNA, 22 bp, Artificial Sequence
  chemically synthesized
gcaatgtgatatacactggctc

SEQ ID NO: 1140333 - DNA, 22 bp, Artificial Sequence
  chemically synthesized
caatgtgatatacactggctcc

SEQ ID NO: 1140334 - DNA, 22 bp, Artificial Sequence
  chemically synthesized
caatcatggcagaaggagaagg

SEQ ID NO: 1140335 - DNA, 22 bp, Artificial Sequence
  chemically synthesized
acaatcatggcagaaggagaag

SEQ ID NO: 1140336 - DNA, 22 bp, Artificial Sequence
  chemically synthesized
gctccccttctccttctgccat

SEQ ID NO: 1140337 - DNA, 22 bp, Artificial Sequence
  chemically synthesized
aggaagcttacaatcatggcag

SEQ ID NO: 1140338 - DNA, 22 bp, Artificial Sequence
  chemically synthesized
cccttctccttctgccatgatt

SEQ ID NO: 1140339 - DNA, 22 bp, Artificial Sequence
  chemically synthesized
ctccttctgccatgattgtaag

SEQ ID NO: 1140340 - DNA, 22 bp, Artificial Sequence
  chemically synthesized
tccttctgccatgattgtaagc

SEQ ID NO: 1140341 - DNA, 22 bp, Artificial Sequence
  chemically synthesized
cttctgccatgattgtaagctt

SEQ ID NO: 1140342 - DNA, 22 bp, Artificial Sequence
  chemically synthesized
gtaagtgcctcaggaagcttac

SEQ ID NO: 1140343 - DNA, 22 bp, Artificial Sequence
  chemically synthesized
ctgccatgattgtaagcttcct

SEQ ID NO: 1140344 - DNA, 22 bp, Artificial Sequence
  chemically synthesized
tgccatgattgtaagcttcctg

SEQ ID NO: 1140345 - DNA, 22 bp, Artificial Sequence
  chemically synthesized
ctggtaagtgcctcaggaagct

SEQ ID NO: 1140346 - DNA, 22 bp, Artificial Sequence
  chemically synthesized
ccatgattgtaagcttcctgag

SEQ ID NO: 1140347 - DNA, 22 bp, Artificial Sequence
  chemically synthesized
ctcctggtaagtgcctcaggaa

SEQ ID NO: 1140348 - DNA, 22 bp, Artificial Sequence
  chemically synthesized
taagcttcctgaggcacttacc

SEQ ID NO: 1140349 - DNA, 22 bp, Artificial Sequence
  chemically synthesized
cctgaggcacttaccaggagca

SEQ ID NO: 1140350 - DNA, 22 bp, Artificial Sequence
  chemically synthesized
ctgaggcacttaccaggagcag

SEQ ID NO: 1140351 - DNA, 22 bp, Artificial Sequence
  chemically synthesized
aggcacttaccaggagcagatg

SEQ ID NO: 1140352 - DNA, 22 bp, Artificial Sequence
  chemically synthesized
accaggagcagatgctggtgtc

SEQ ID NO: 1140353 - DNA, 22 bp, Artificial Sequence
  chemically synthesized
tacaagaagcatgacaccagca

SEQ ID NO: 1140354 - DNA, 22 bp, Artificial Sequence
  chemically synthesized
ccaggagcagatgctggtgtca

SEQ ID NO: 1140355 - DNA, 22 bp, Artificial Sequence
  chemically synthesized
caggctgtacaagaagcatgac

SEQ ID NO: 1140356 - DNA, 22 bp, Artificial Sequence
  chemically synthesized
tgcaggctgtacaagaagcatg

SEQ ID NO: 1140357 - DNA, 22 bp, Artificial Sequence
  chemically synthesized
atggttctgcaggctgtacaag

SEQ ID NO: 1140358 - DNA, 22 bp, Artificial Sequence
  chemically synthesized
gtgtcatgcttcttgtacagcc

SEQ ID NO: 1140359 - DNA, 22 bp, Artificial Sequence
  chemically synthesized
gctcatggttctgcaggctgta

SEQ ID NO: 1140360 - DNA, 22 bp, Artificial Sequence
  chemically synthesized
actggctcatggttctgcaggc

SEQ ID NO: 1140361 - DNA, 22 bp, Artificial Sequence
  chemically synthesized
aactggctcatggttctgcagg

SEQ ID NO: 1140362 - DNA, 22 bp, Artificial Sequence
  chemically synthesized
cttgtacagcctgcagaaccat

SEQ ID NO: 1140363 - DNA, 22 bp, Artificial Sequence
  chemically synthesized
ttgtacagcctgcagaaccatg

SEQ ID NO: 1140364 - DNA, 22 bp, Artificial Sequence
  chemically synthesized
gtacagcctgcagaaccatgag

SEQ ID NO: 1140365 - DNA, 22 bp, Artificial Sequence
  chemically synthesized
tacagcctgcagaaccatgagc

SEQ ID NO: 1140366 - DNA, 22 bp, Artificial Sequence
  chemically synthesized
cagaaccatgagccagttaaac

SEQ ID NO: 1140367 - DNA, 22 bp, Artificial Sequence
  chemically synthesized
tgaaataaagaggtttaactgg

SEQ ID NO: 1140368 - DNA, 22 bp, Artificial Sequence
  chemically synthesized
atgaaataaagaggtttaactg

SEQ ID NO: 1140369 - DNA, 22 bp, Artificial Sequence
  chemically synthesized
ggtaacttatgaaataaagagg

SEQ ID NO: 1140370 - DNA, 22 bp, Artificial Sequence
  chemically synthesized
ggactgggtaacttatgaaata

SEQ ID NO: 1140371 - DNA, 22 bp, Artificial Sequence
  chemically synthesized
aacctctttatttcataagtta

SEQ ID NO: 1140372 - DNA, 22 bp, Artificial Sequence
  chemically synthesized
agactgggactgggtaacttat

SEQ ID NO: 1140373 - DNA, 22 bp, Artificial Sequence
  chemically synthesized
tttatttcataagttacccagt

SEQ ID NO: 1140374 - DNA, 22 bp, Artificial Sequence
  chemically synthesized
tatttcataagttacccagtcc

SEQ ID NO: 1140375 - DNA, 22 bp, Artificial Sequence
  chemically synthesized
atttcataagttacccagtccc

SEQ ID NO: 1140376 - DNA, 22 bp, Artificial Sequence
  chemically synthesized
tttcataagttacccagtccca

SEQ ID NO: 1140377 - DNA, 22 bp, Artificial Sequence
  chemically synthesized
cataagttacccagtcccagtc

SEQ ID NO: 1140378 - DNA, 22 bp, Artificial Sequence
  chemically synthesized
ataagttacccagtcccagtct

SEQ ID NO: 1140379 - DNA, 22 bp, Artificial Sequence
  chemically synthesized
taaaggggtacctgagactggg

SEQ ID NO: 1140380 - DNA, 22 bp, Artificial Sequence
  chemically synthesized
ttataaaggggtacctgagact

SEQ ID NO: 1140381 - DNA, 22 bp, Artificial Sequence
  chemically synthesized
attataaaggggtacctgagac

SEQ ID NO: 1140382 - DNA, 22 bp, Artificial Sequence
  chemically synthesized
cccagtcccagtctcaggtacc

SEQ ID NO: 1140383 - DNA, 22 bp, Artificial Sequence
  chemically synthesized
gtttattataaaggggtacctg

SEQ ID NO: 1140384 - DNA, 22 bp, Artificial Sequence
  chemically synthesized
agtttattataaaggggtacct

SEQ ID NO: 1140385 - DNA, 22 bp, Artificial Sequence
  chemically synthesized
accttagtttattataaagggg

SEQ ID NO: 1140386 - DNA, 22 bp, Artificial Sequence
  chemically synthesized
aaccttagtttattataaaggg

SEQ ID NO: 1140387 - DNA, 22 bp, Artificial Sequence
  chemically synthesized
aggtacccctttataataaact

SEQ ID NO: 1140388 - DNA, 22 bp, Artificial Sequence
  chemically synthesized
atggagtttaaccttagtttat

SEQ ID NO: 1140389 - DNA, 22 bp, Artificial Sequence
  chemically synthesized
acattgatggagtttaacctta

SEQ ID NO: 1140390 - DNA, 22 bp, Artificial Sequence
  chemically synthesized
tataataaactaaggttaaact

SEQ ID NO: 1140391 - DNA, 22 bp, Artificial Sequence
  chemically synthesized
ataataaactaaggttaaactc

SEQ ID NO: 1140392 - DNA, 22 bp, Artificial Sequence
  chemically synthesized
taataaactaaggttaaactcc

SEQ ID NO: 1140393 - DNA, 22 bp, Artificial Sequence
  chemically synthesized
tcctgacattgatggagtttaa

SEQ ID NO: 1140394 - DNA, 22 bp, Artificial Sequence
  chemically synthesized
aggttaaactccatcaatgtca

SEQ ID NO: 1140395 - DNA, 22 bp, Artificial Sequence
  chemically synthesized
caagcgacggttatcctgacat

SEQ ID NO: 1140396 - DNA, 22 bp, Artificial Sequence
  chemically synthesized
aactccatcaatgtcaggataa

SEQ ID NO: 1140397 - DNA, 22 bp, Artificial Sequence
  chemically synthesized
catcaatgtcaggataaccgtc

SEQ ID NO: 1140398 - DNA, 22 bp, Artificial Sequence
  chemically synthesized
agaataatatgtgagagttaca

SEQ ID NO: 1140399 - DNA, 22 bp, Artificial Sequence
  chemically synthesized
tcagaataatatgtgagagtta

SEQ ID NO: 1140400 - DNA, 22 bp, Artificial Sequence
  chemically synthesized
attctcagaataatatgtgaga

SEQ ID NO: 1140401 - DNA, 22 bp, Artificial Sequence
  chemically synthesized
acgttgattctcagaataatat

SEQ ID NO: 1140402 - DNA, 22 bp, Artificial Sequence
  chemically synthesized
gtaactctcacatattattctg

SEQ ID NO: 1140403 - DNA, 22 bp, Artificial Sequence
  chemically synthesized
taactctcacatattattctga

SEQ ID NO: 1140404 - DNA, 22 bp, Artificial Sequence
  chemically synthesized
tcacatattattctgagaatca

SEQ ID NO: 1140405 - DNA, 22 bp, Artificial Sequence
  chemically synthesized
acatattattctgagaatcaac

SEQ ID NO: 1140406 - DNA, 22 bp, Artificial Sequence
  chemically synthesized
aaaaaatagactgacgttgatt

SEQ ID NO: 1140407 - DNA, 22 bp, Artificial Sequence
  chemically synthesized
taaaaaaatagactgacgttga

SEQ ID NO: 1140408 - DNA, 22 bp, Artificial Sequence
  chemically synthesized
ttctgagaatcaacgtcagtct

SEQ ID NO: 1140409 - DNA, 22 bp, Artificial Sequence
  chemically synthesized
tgagaatcaacgtcagtctatt

SEQ ID NO: 1140410 - DNA, 22 bp, Artificial Sequence
  chemically synthesized
agaatcaacgtcagtctatttt

SEQ ID NO: 1140411 - DNA, 22 bp, Artificial Sequence
  chemically synthesized
agcagcatagttctaaaaaaat

SEQ ID NO: 1140412 - DNA, 22 bp, Artificial Sequence
  chemically synthesized
taagcagcatagttctaaaaaa

SEQ ID NO: 1140413 - DNA, 22 bp, Artificial Sequence
  chemically synthesized
ataaagttctaagcagcatagt

SEQ ID NO: 1140414 - DNA, 22 bp, Artificial Sequence
  chemically synthesized
cataaagttctaagcagcatag

SEQ ID NO: 1140415 - DNA, 22 bp, Artificial Sequence
  chemically synthesized
tttttttagaactatgctgctt

SEQ ID NO: 1140416 - DNA, 22 bp, Artificial Sequence
  chemically synthesized
tcataaagttctaagcagcata

SEQ ID NO: 1140417 - DNA, 22 bp, Artificial Sequence
  chemically synthesized
ttttagaactatgctgcttaga

SEQ ID NO: 1140418 - DNA, 22 bp, Artificial Sequence
  chemically synthesized
tttagaactatgctgcttagaa

SEQ ID NO: 1140419 - DNA, 22 bp, Artificial Sequence
  chemically synthesized
ttagaactatgctgcttagaac

SEQ ID NO: 1140420 - DNA, 22 bp, Artificial Sequence
  chemically synthesized
tagaactatgctgcttagaact

SEQ ID NO: 1140421 - DNA, 22 bp, Artificial Sequence
  chemically synthesized
agaactatgctgcttagaactt

SEQ ID NO: 1140422 - DNA, 22 bp, Artificial Sequence
  chemically synthesized
gaactatgctgcttagaacttt

SEQ ID NO: 1140423 - DNA, 22 bp, Artificial Sequence
  chemically synthesized
tgagcctttcataaagttctaa

SEQ ID NO: 1140424 - DNA, 22 bp, Artificial Sequence
  chemically synthesized
tgctgcttagaactttatgaaa

SEQ ID NO: 1140425 - DNA, 22 bp, Artificial Sequence
  chemically synthesized
cttagaactttatgaaaggctc

SEQ ID NO: 1140426 - DNA, 22 bp, Artificial Sequence
  chemically synthesized
agaaatgtctgtgagcctttca

SEQ ID NO: 1140427 - DNA, 22 bp, Artificial Sequence
  chemically synthesized
agaactttatgaaaggctcaca

SEQ ID NO: 1140428 - DNA, 22 bp, Artificial Sequence
  chemically synthesized
gaactttatgaaaggctcacag

SEQ ID NO: 1140429 - DNA, 22 bp, Artificial Sequence
  chemically synthesized
tatgaaaggctcacagacattt

SEQ ID NO: 1140430 - DNA, 22 bp, Artificial Sequence
  chemically synthesized
atgaaaggctcacagacatttc

SEQ ID NO: 1140431 - DNA, 22 bp, Artificial Sequence
  chemically synthesized
tgaaaggctcacagacatttct

SEQ ID NO: 1140432 - DNA, 22 bp, Artificial Sequence
  chemically synthesized
ataaagtaatactaagaaatgt

SEQ ID NO: 1140433 - DNA, 22 bp, Artificial Sequence
  chemically synthesized
aaattaataaagtaatactaag

SEQ ID NO: 1140434 - DNA, 22 bp, Artificial Sequence
  chemically synthesized
acagacatttcttagtattact

SEQ ID NO: 1140435 - DNA, 22 bp, Artificial Sequence
  chemically synthesized
aattaaaattaataaagtaata

SEQ ID NO: 1140436 - DNA, 22 bp, Artificial Sequence
  chemically synthesized
caattaaaattaataaagtaat

SEQ ID NO: 1140437 - DNA, 22 bp, Artificial Sequence
  chemically synthesized
cttagtattactttattaattt

SEQ ID NO: 1140438 - DNA, 22 bp, Artificial Sequence
  chemically synthesized
ttagtattactttattaatttt

SEQ ID NO: 1140439 - DNA, 22 bp, Artificial Sequence
  chemically synthesized
agtattactttattaattttaa

SEQ ID NO: 1140440 - DNA, 22 bp, Artificial Sequence
  chemically synthesized
gtattactttattaattttaat

SEQ ID NO: 1140441 - DNA, 22 bp, Artificial Sequence
  chemically synthesized
ctttattaattttaattgaagt

SEQ ID NO: 1140442 - DNA, 22 bp, Artificial Sequence
  chemically synthesized
tattaattttaattgaagtctt

SEQ ID NO: 1140443 - DNA, 22 bp, Artificial Sequence
  chemically synthesized
attaattttaattgaagtctta

SEQ ID NO: 1140444 - DNA, 22 bp, Artificial Sequence
  chemically synthesized
ttaattttaattgaagtcttat

SEQ ID NO: 1140445 - DNA, 22 bp, Artificial Sequence
  chemically synthesized
attttaattgaagtcttattct

SEQ ID NO: 1140446 - DNA, 22 bp, Artificial Sequence
  chemically synthesized
taattgaagtcttattctggta

SEQ ID NO: 1140447 - DNA, 22 bp, Artificial Sequence
  chemically synthesized
aattgaagtcttattctggtat

SEQ ID NO: 1140448 - DNA, 22 bp, Artificial Sequence
  chemically synthesized
ataaaacatagcataccagaat

SEQ ID NO: 1140449 - DNA, 22 bp, Artificial Sequence
  chemically synthesized
attgaagtcttattctggtatg

SEQ ID NO: 1140450 - DNA, 22 bp, Artificial Sequence
  chemically synthesized
gataaaacatagcataccagaa

SEQ ID NO: 1140451 - DNA, 22 bp, Artificial Sequence
  chemically synthesized
ttgataaaacatagcataccag

SEQ ID NO: 1140452 - DNA, 22 bp, Artificial Sequence
  chemically synthesized
aagtcttattctggtatgctat

SEQ ID NO: 1140453 - DNA, 22 bp, Artificial Sequence
  chemically synthesized
tactcttgataaaacatagcat

SEQ ID NO: 1140454 - DNA, 22 bp, Artificial Sequence
  chemically synthesized
attctggtatgctatgttttat

SEQ ID NO: 1140455 - DNA, 22 bp, Artificial Sequence
  chemically synthesized
ttctggtatgctatgttttatc

SEQ ID NO: 1140456 - DNA, 22 bp, Artificial Sequence
  chemically synthesized
aaagttgtactcttgataaaac

SEQ ID NO: 1140457 - DNA, 22 bp, Artificial Sequence
  chemically synthesized
tggtatgctatgttttatcaag

SEQ ID NO: 1140458 - DNA, 22 bp, Artificial Sequence
  chemically synthesized
caaagttgtactcttgataaaa

SEQ ID NO: 1140459 - DNA, 22 bp, Artificial Sequence
  chemically synthesized
tcaaagttgtactcttgataaa

SEQ ID NO: 1140460 - DNA, 22 bp, Artificial Sequence
  chemically synthesized
gtatgctatgttttatcaagag

SEQ ID NO: 1140461 - DNA, 22 bp, Artificial Sequence
  chemically synthesized
ttcaaagttgtactcttgataa

SEQ ID NO: 1140462 - DNA, 22 bp, Artificial Sequence
  chemically synthesized
tttttcaaagttgtactcttga

SEQ ID NO: 1140463 - DNA, 22 bp, Artificial Sequence
  chemically synthesized
gtttttcaaagttgtactcttg

SEQ ID NO: 1140464 - DNA, 22 bp, Artificial Sequence
  chemically synthesized
tgtttttcaaagttgtactctt

SEQ ID NO: 1140465 - DNA, 22 bp, Artificial Sequence
  chemically synthesized
tgttttatcaagagtacaactt

SEQ ID NO: 1140466 - DNA, 22 bp, Artificial Sequence
  chemically synthesized
aactttgtttttcaaagttgta

SEQ ID NO: 1140467 - DNA, 22 bp, Artificial Sequence
  chemically synthesized
caactttgtttttcaaagttgt

SEQ ID NO: 1140468 - DNA, 22 bp, Artificial Sequence
  chemically synthesized
tcaactttgtttttcaaagttg

SEQ ID NO: 1140469 - DNA, 22 bp, Artificial Sequence
  chemically synthesized
tatcaagagtacaactttgaaa

SEQ ID NO: 1140470 - DNA, 22 bp, Artificial Sequence
  chemically synthesized
atcaagagtacaactttgaaaa

SEQ ID NO: 1140471 - DNA, 22 bp, Artificial Sequence
  chemically synthesized
tcaagagtacaactttgaaaaa

SEQ ID NO: 1140472 - DNA, 22 bp, Artificial Sequence
  chemically synthesized
taggtggattttcaactttgtt

SEQ ID NO: 1140473 - DNA, 22 bp, Artificial Sequence
  chemically synthesized
tgaaaaacaaagttgaaaatcc

SEQ ID NO: 1140474 - DNA, 22 bp, Artificial Sequence
  chemically synthesized
gaaaaacaaagttgaaaatcca

SEQ ID NO: 1140475 - DNA, 22 bp, Artificial Sequence
  chemically synthesized
aaaaacaaagttgaaaatccac

SEQ ID NO: 1140476 - DNA, 22 bp, Artificial Sequence
  chemically synthesized
aagtgggaaaaaactataggtg

SEQ ID NO: 1140477 - DNA, 22 bp, Artificial Sequence
  chemically synthesized
aattaaagtgggaaaaaactat

SEQ ID NO: 1140478 - DNA, 22 bp, Artificial Sequence
  chemically synthesized
aaaatccacctatagttttttc

SEQ ID NO: 1140479 - DNA, 22 bp, Artificial Sequence
  chemically synthesized
tgaattaaagtgggaaaaaact

SEQ ID NO: 1140480 - DNA, 22 bp, Artificial Sequence
  chemically synthesized
ctgaattaaagtgggaaaaaac

SEQ ID NO: 1140481 - DNA, 22 bp, Artificial Sequence
  chemically synthesized
tctgaattaaagtgggaaaaaa

SEQ ID NO: 1140482 - DNA, 22 bp, Artificial Sequence
  chemically synthesized
ttctgaattaaagtgggaaaaa

SEQ ID NO: 1140483 - DNA, 22 bp, Artificial Sequence
  chemically synthesized
cttttctgaattaaagtgggaa

SEQ ID NO: 1140484 - DNA, 22 bp, Artificial Sequence
  chemically synthesized
ctacttttctgaattaaagtgg

SEQ ID NO: 1140485 - DNA, 22 bp, Artificial Sequence
  chemically synthesized
tagttttttcccactttaattc

SEQ ID NO: 1140486 - DNA, 22 bp, Artificial Sequence
  chemically synthesized
tattgctacttttctgaattaa

SEQ ID NO: 1140487 - DNA, 22 bp, Artificial Sequence
  chemically synthesized
tttcccactttaattcagaaaa

SEQ ID NO: 1140488 - DNA, 22 bp, Artificial Sequence
  chemically synthesized
ttcccactttaattcagaaaag

SEQ ID NO: 1140489 - DNA, 22 bp, Artificial Sequence
  chemically synthesized
tcccactttaattcagaaaagt

SEQ ID NO: 1140490 - DNA, 22 bp, Artificial Sequence
  chemically synthesized
cccactttaattcagaaaagta

SEQ ID NO: 1140491 - DNA, 22 bp, Artificial Sequence
  chemically synthesized
ccactttaattcagaaaagtag

SEQ ID NO: 1140492 - DNA, 22 bp, Artificial Sequence
  chemically synthesized
aaagatgttatattgctacttt

SEQ ID NO: 1140493 - DNA, 22 bp, Artificial Sequence
  chemically synthesized
taattcagaaaagtagcaatat

SEQ ID NO: 1140494 - DNA, 22 bp, Artificial Sequence
  chemically synthesized
ttcaaagatgttatattgctac

SEQ ID NO: 1140495 - DNA, 22 bp, Artificial Sequence
  chemically synthesized
aattcagaaaagtagcaatata

SEQ ID NO: 1140496 - DNA, 22 bp, Artificial Sequence
  chemically synthesized
attcagaaaagtagcaatataa

SEQ ID NO: 1140497 - DNA, 22 bp, Artificial Sequence
  chemically synthesized
agaaaagtagcaatataacatc

SEQ ID NO: 1140498 - DNA, 22 bp, Artificial Sequence
  chemically synthesized
gatcatagattattcaaagatg

SEQ ID NO: 1140499 - DNA, 22 bp, Artificial Sequence
  chemically synthesized
ggatcatagattattcaaagat

SEQ ID NO: 1140500 - DNA, 22 bp, Artificial Sequence
  chemically synthesized
cttggatcatagattattcaaa

SEQ ID NO: 1140501 - DNA, 22 bp, Artificial Sequence
  chemically synthesized
gcttggatcatagattattcaa

SEQ ID NO: 1140502 - DNA, 22 bp, Artificial Sequence
  chemically synthesized
tgcttggatcatagattattca

SEQ ID NO: 1140503 - DNA, 22 bp, Artificial Sequence
  chemically synthesized
ttgcttggatcatagattattc

SEQ ID NO: 1140504 - DNA, 22 bp, Artificial Sequence
  chemically synthesized
tttttgcttggatcatagatta

SEQ ID NO: 1140505 - DNA, 22 bp, Artificial Sequence
  chemically synthesized
atttttgcttggatcatagatt

SEQ ID NO: 1140506 - DNA, 22 bp, Artificial Sequence
  chemically synthesized
tgaataatctatgatccaagca

SEQ ID NO: 1140507 - DNA, 22 bp, Artificial Sequence
  chemically synthesized
aatgtttatttttgcttggatc

SEQ ID NO: 1140508 - DNA, 22 bp, Artificial Sequence
  chemically synthesized
gaataatctatgatccaagcaa

SEQ ID NO: 1140509 - DNA, 22 bp, Artificial Sequence
  chemically synthesized
aataatctatgatccaagcaaa

SEQ ID NO: 1140510 - DNA, 22 bp, Artificial Sequence
  chemically synthesized
aatattaaatgtttatttttgc

SEQ ID NO: 1140511 - DNA, 22 bp, Artificial Sequence
  chemically synthesized
ttgaatattaaatgtttatttt

SEQ ID NO: 1140512 - DNA, 22 bp, Artificial Sequence
  chemically synthesized
tgatccaagcaaaaataaacat

SEQ ID NO: 1140513 - DNA, 22 bp, Artificial Sequence
  chemically synthesized
tgctattgaatattaaatgttt

SEQ ID NO: 1140514 - DNA, 22 bp, Artificial Sequence
  chemically synthesized
tatgctattgaatattaaatgt

SEQ ID NO: 1140515 - DNA, 22 bp, Artificial Sequence
  chemically synthesized
ctatgctattgaatattaaatg

SEQ ID NO: 1140516 - DNA, 22 bp, Artificial Sequence
  chemically synthesized
ttctatgctattgaatattaaa

SEQ ID NO: 1140517 - DNA, 22 bp, Artificial Sequence
  chemically synthesized
gtctcttctatgctattgaata

SEQ ID NO: 1140518 - DNA, 22 bp, Artificial Sequence
  chemically synthesized
agtctcttctatgctattgaat

SEQ ID NO: 1140519 - DNA, 22 bp, Artificial Sequence
  chemically synthesized
tttagtctcttctatgctattg

SEQ ID NO: 1140520 - DNA, 22 bp, Artificial Sequence
  chemically synthesized
ttatttagtctcttctatgcta

SEQ ID NO: 1140521 - DNA, 22 bp, Artificial Sequence
  chemically synthesized
aatattcaatagcatagaagag

SEQ ID NO: 1140522 - DNA, 22 bp, Artificial Sequence
  chemically synthesized
atattcaatagcatagaagaga

SEQ ID NO: 1140523 - DNA, 22 bp, Artificial Sequence
  chemically synthesized
tcactattatttagtctcttct

SEQ ID NO: 1140524 - DNA, 22 bp, Artificial Sequence
  chemically synthesized
aatagcatagaagagactaaat

SEQ ID NO: 1140525 - DNA, 22 bp, Artificial Sequence
  chemically synthesized
tatattatcactattatttagt

SEQ ID NO: 1140526 - DNA, 22 bp, Artificial Sequence
  chemically synthesized
aataatagtgataatatacagt

SEQ ID NO: 1140527 - DNA, 22 bp, Artificial Sequence
  chemically synthesized
taaaaacccagtactgtatatt

SEQ ID NO: 1140528 - DNA, 22 bp, Artificial Sequence
  chemically synthesized
ataaaaacccagtactgtatat

SEQ ID NO: 1140529 - DNA, 22 bp, Artificial Sequence
  chemically synthesized
aatggtcttataaaaacccagt

SEQ ID NO: 1140530 - DNA, 22 bp, Artificial Sequence
  chemically synthesized
caatggtcttataaaaacccag

SEQ ID NO: 1140531 - DNA, 22 bp, Artificial Sequence
  chemically synthesized
tcaatggtcttataaaaaccca

SEQ ID NO: 1140532 - DNA, 22 bp, Artificial Sequence
  chemically synthesized
gctttcaatggtcttataaaaa

SEQ ID NO: 1140533 - DNA, 22 bp, Artificial Sequence
  chemically synthesized
tagctttcaatggtcttataaa

SEQ ID NO: 1140534 - DNA, 22 bp, Artificial Sequence
  chemically synthesized
ctagctttcaatggtcttataa

SEQ ID NO: 1140535 - DNA, 22 bp, Artificial Sequence
  chemically synthesized
tctagctttcaatggtcttata

SEQ ID NO: 1140536 - DNA, 22 bp, Artificial Sequence
  chemically synthesized
ggtttttataagaccattgaaa

SEQ ID NO: 1140537 - DNA, 22 bp, Artificial Sequence
  chemically synthesized
ttataagaccattgaaagctag

SEQ ID NO: 1140538 - DNA, 22 bp, Artificial Sequence
  chemically synthesized
tataagaccattgaaagctaga

SEQ ID NO: 1140539 - DNA, 22 bp, Artificial Sequence
  chemically synthesized
ataagaccattgaaagctagaa

SEQ ID NO: 1140540 - DNA, 22 bp, Artificial Sequence
  chemically synthesized
gccgtatgtactttctagcttt

SEQ ID NO: 1140541 - DNA, 22 bp, Artificial Sequence
  chemically synthesized
taagaccattgaaagctagaaa

SEQ ID NO: 1140542 - DNA, 22 bp, Artificial Sequence
  chemically synthesized
aaaaactggccgtatgtacttt

SEQ ID NO: 1140543 - DNA, 22 bp, Artificial Sequence
  chemically synthesized
caaaaactggccgtatgtactt

SEQ ID NO: 1140544 - DNA, 22 bp, Artificial Sequence
  chemically synthesized
aaagctagaaagtacatacggc

SEQ ID NO: 1140545 - DNA, 22 bp, Artificial Sequence
  chemically synthesized
tcaagtcttcaaaaactggccg

SEQ ID NO: 1140546 - DNA, 22 bp, Artificial Sequence
  chemically synthesized
gaaagtacatacggccagtttt

SEQ ID NO: 1140547 - DNA, 22 bp, Artificial Sequence
  chemically synthesized
aagatcaaaatgaaatgttatc

SEQ ID NO: 1140548 - DNA, 22 bp, Artificial Sequence
  chemically synthesized
aaagatcaaaatgaaatgttat

SEQ ID NO: 1140549 - DNA, 22 bp, Artificial Sequence
  chemically synthesized
ttgaagacttgataacatttca

SEQ ID NO: 1140550 - DNA, 22 bp, Artificial Sequence
  chemically synthesized
taaagatcaaaatgaaatgtta

SEQ ID NO: 1140551 - DNA, 22 bp, Artificial Sequence
  chemically synthesized
tgaagacttgataacatttcat

SEQ ID NO: 1140552 - DNA, 22 bp, Artificial Sequence
  chemically synthesized
gaagacttgataacatttcatt

SEQ ID NO: 1140553 - DNA, 22 bp, Artificial Sequence
  chemically synthesized
aagacttgataacatttcattt

SEQ ID NO: 1140554 - DNA, 22 bp, Artificial Sequence
  chemically synthesized
gctttaaagatcaaaatgaaat

SEQ ID NO: 1140555 - DNA, 22 bp, Artificial Sequence
  chemically synthesized
gataacatttcattttgatctt

SEQ ID NO: 1140556 - DNA, 22 bp, Artificial Sequence
  chemically synthesized
ataacatttcattttgatcttt

SEQ ID NO: 1140557 - DNA, 22 bp, Artificial Sequence
  chemically synthesized
acacaactggctttaaagatca

SEQ ID NO: 1140558 - DNA, 22 bp, Artificial Sequence
  chemically synthesized
cattttgatctttaaagccagt

SEQ ID NO: 1140559 - DNA, 22 bp, Artificial Sequence
  chemically synthesized
attttgatctttaaagccagtt

SEQ ID NO: 1140560 - DNA, 22 bp, Artificial Sequence
  chemically synthesized
tgatctttaaagccagttgtgt

SEQ ID NO: 1140561 - DNA, 22 bp, Artificial Sequence
  chemically synthesized
gatctttaaagccagttgtgtg

SEQ ID NO: 1140562 - DNA, 22 bp, Artificial Sequence
  chemically synthesized
atctttaaagccagttgtgtga

SEQ ID NO: 1140563 - DNA, 22 bp, Artificial Sequence
  chemically synthesized
taaagccagttgtgtgaatctt

SEQ ID NO: 1140564 - DNA, 22 bp, Artificial Sequence
  chemically synthesized
aaagccagttgtgtgaatcttg

SEQ ID NO: 1140565 - DNA, 22 bp, Artificial Sequence
  chemically synthesized
aagccagttgtgtgaatcttgt

SEQ ID NO: 1140566 - DNA, 22 bp, Artificial Sequence
  chemically synthesized
agaaaaagaagatgcagtgaac

SEQ ID NO: 1140567 - DNA, 22 bp, Artificial Sequence
  chemically synthesized
cagaaaaagaagatgcagtgaa

SEQ ID NO: 1140568 - DNA, 22 bp, Artificial Sequence
  chemically synthesized
tgtgaatcttgttcactgcatc

SEQ ID NO: 1140569 - DNA, 22 bp, Artificial Sequence
  chemically synthesized
tcagaaaaagaagatgcagtga

SEQ ID NO: 1140570 - DNA, 22 bp, Artificial Sequence
  chemically synthesized
gttcactgcatcttctttttct

SEQ ID NO: 1140571 - DNA, 22 bp, Artificial Sequence
  chemically synthesized
ttcactgcatcttctttttctg

SEQ ID NO: 1140572 - DNA, 22 bp, Artificial Sequence
  chemically synthesized
gtgcatggctttcagaaaaaga

SEQ ID NO: 1140573 - DNA, 22 bp, Artificial Sequence
  chemically synthesized
agtgcatggctttcagaaaaag

SEQ ID NO: 1140574 - DNA, 22 bp, Artificial Sequence
  chemically synthesized
tagtgcatggctttcagaaaaa

SEQ ID NO: 1140575 - DNA, 22 bp, Artificial Sequence
  chemically synthesized
actgcatcttctttttctgaaa

SEQ ID NO: 1140576 - DNA, 22 bp, Artificial Sequence
  chemically synthesized
ttagtgcatggctttcagaaaa

SEQ ID NO: 1140577 - DNA, 22 bp, Artificial Sequence
  chemically synthesized
tttagtgcatggctttcagaaa

SEQ ID NO: 1140578 - DNA, 22 bp, Artificial Sequence
  chemically synthesized
catcttctttttctgaaagcca

SEQ ID NO: 1140579 - DNA, 22 bp, Artificial Sequence
  chemically synthesized
ctttttctgaaagccatgcact

SEQ ID NO: 1140580 - DNA, 22 bp, Artificial Sequence
  chemically synthesized
cagtgcctttttagtgcatggc

SEQ ID NO: 1140581 - DNA, 22 bp, Artificial Sequence
  chemically synthesized
tttttctgaaagccatgcacta

SEQ ID NO: 1140582 - DNA, 22 bp, Artificial Sequence
  chemically synthesized
gcagtgcctttttagtgcatgg

SEQ ID NO: 1140583 - DNA, 22 bp, Artificial Sequence
  chemically synthesized
tttctgaaagccatgcactaaa

SEQ ID NO: 1140584 - DNA, 22 bp, Artificial Sequence
  chemically synthesized
ttctgaaagccatgcactaaaa

SEQ ID NO: 1140585 - DNA, 22 bp, Artificial Sequence
  chemically synthesized
tctgaaagccatgcactaaaaa

SEQ ID NO: 1140586 - DNA, 22 bp, Artificial Sequence
  chemically synthesized
ctgaaagccatgcactaaaaag

SEQ ID NO: 1140587 - DNA, 22 bp, Artificial Sequence
  chemically synthesized
tgaaagccatgcactaaaaagg

SEQ ID NO: 1140588 - DNA, 22 bp, Artificial Sequence
  chemically synthesized
atgtcttgcagtgcctttttag

SEQ ID NO: 1140589 - DNA, 22 bp, Artificial Sequence
  chemically synthesized
aaagccatgcactaaaaaggca

SEQ ID NO: 1140590 - DNA, 22 bp, Artificial Sequence
  chemically synthesized
aatgtcttgcagtgccttttta

SEQ ID NO: 1140591 - DNA, 22 bp, Artificial Sequence
  chemically synthesized
taatgtcttgcagtgccttttt

SEQ ID NO: 1140592 - DNA, 22 bp, Artificial Sequence
  chemically synthesized
tttaatgtcttgcagtgccttt

SEQ ID NO: 1140593 - DNA, 22 bp, Artificial Sequence
  chemically synthesized
gaattctttaatgtcttgcagt

SEQ ID NO: 1140594 - DNA, 22 bp, Artificial Sequence
  chemically synthesized
ggaattctttaatgtcttgcag

SEQ ID NO: 1140595 - DNA, 22 bp, Artificial Sequence
  chemically synthesized
cttggaattctttaatgtcttg

SEQ ID NO: 1140596 - DNA, 22 bp, Artificial Sequence
  chemically synthesized
aaaaggcactgcaagacattaa

SEQ ID NO: 1140597 - DNA, 22 bp, Artificial Sequence
  chemically synthesized
ttccttggaattctttaatgtc

SEQ ID NO: 1140598 - DNA, 22 bp, Artificial Sequence
  chemically synthesized
attccttggaattctttaatgt

SEQ ID NO: 1140599 - DNA, 22 bp, Artificial Sequence
  chemically synthesized
tttattccttggaattctttaa

SEQ ID NO: 1140600 - DNA, 22 bp, Artificial Sequence
  chemically synthesized
atttattccttggaattcttta

SEQ ID NO: 1140601 - DNA, 22 bp, Artificial Sequence
  chemically synthesized
caagacattaaagaattccaag

SEQ ID NO: 1140602 - DNA, 22 bp, Artificial Sequence
  chemically synthesized
tgtttatttattccttggaatt

SEQ ID NO: 1140603 - DNA, 22 bp, Artificial Sequence
  chemically synthesized
atgtttatttattccttggaat

SEQ ID NO: 1140604 - DNA, 22 bp, Artificial Sequence
  chemically synthesized
aagaattccaaggaataaataa

SEQ ID NO: 1140605 - DNA, 22 bp, Artificial Sequence
  chemically synthesized
gaaaagtaaagatttatgttta

SEQ ID NO: 1140606 - DNA, 22 bp, Artificial Sequence
  chemically synthesized
caaggaataaataaacataaat

SEQ ID NO: 1140607 - DNA, 22 bp, Artificial Sequence
  chemically synthesized
aattggaaaagtaaagatttat

SEQ ID NO: 1140608 - DNA, 22 bp, Artificial Sequence
  chemically synthesized
tacttttccaatttaatatccc

SEQ ID NO: 1140609 - DNA, 22 bp, Artificial Sequence
  chemically synthesized
acttttccaatttaatatcccc

SEQ ID NO: 1140610 - DNA, 22 bp, Artificial Sequence
  chemically synthesized
taaaagacacggggggatatta

SEQ ID NO: 1140611 - DNA, 22 bp, Artificial Sequence
  chemically synthesized
cttttccaatttaatatccccc

SEQ ID NO: 1140612 - DNA, 22 bp, Artificial Sequence
  chemically synthesized
ttccaatttaatatccccccgt

SEQ ID NO: 1140613 - DNA, 22 bp, Artificial Sequence
  chemically synthesized
gctgtaaaagacacggggggat

SEQ ID NO: 1140614 - DNA, 22 bp, Artificial Sequence
  chemically synthesized
tccaatttaatatccccccgtg

SEQ ID NO: 1140615 - DNA, 22 bp, Artificial Sequence
  chemically synthesized
ccaatttaatatccccccgtgt

SEQ ID NO: 1140616 - DNA, 22 bp, Artificial Sequence
  chemically synthesized
caatttaatatccccccgtgtc

SEQ ID NO: 1140617 - DNA, 22 bp, Artificial Sequence
  chemically synthesized
aatatccccccgtgtcttttac

SEQ ID NO: 1140618 - DNA, 22 bp, Artificial Sequence
  chemically synthesized
atatccccccgtgtcttttaca

SEQ ID NO: 1140619 - DNA, 22 bp, Artificial Sequence
  chemically synthesized
ttacagctagtttctcacacat

SEQ ID NO: 1140620 - DNA, 22 bp, Artificial Sequence
  chemically synthesized
tacagctagtttctcacacatg

SEQ ID NO: 1140621 - DNA, 22 bp, Artificial Sequence
  chemically synthesized
acagctagtttctcacacatga

SEQ ID NO: 1140622 - DNA, 22 bp, Artificial Sequence
  chemically synthesized
cagctagtttctcacacatgac

SEQ ID NO: 1140623 - DNA, 22 bp, Artificial Sequence
  chemically synthesized
aagaacaggtgtgtcatgtgtg

SEQ ID NO: 1140624 - DNA, 22 bp, Artificial Sequence
  chemically synthesized
ctgaagaacaggtgtgtcatgt

SEQ ID NO: 1140625 - DNA, 22 bp, Artificial Sequence
  chemically synthesized
actgaagaacaggtgtgtcatg

SEQ ID NO: 1140626 - DNA, 22 bp, Artificial Sequence
  chemically synthesized
gtttctcacacatgacacacct

SEQ ID NO: 1140627 - DNA, 22 bp, Artificial Sequence
  chemically synthesized
ctcacacatgacacacctgttc

SEQ ID NO: 1140628 - DNA, 22 bp, Artificial Sequence
  chemically synthesized
tcacacatgacacacctgttct

SEQ ID NO: 1140629 - DNA, 22 bp, Artificial Sequence
  chemically synthesized
acacatgacacacctgttcttc

SEQ ID NO: 1140630 - DNA, 22 bp, Artificial Sequence
  chemically synthesized
aaatggcaacgtcttactgaag

SEQ ID NO: 1140631 - DNA, 22 bp, Artificial Sequence
  chemically synthesized
tcaaatggcaacgtcttactga

SEQ ID NO: 1140632 - DNA, 22 bp, Artificial Sequence
  chemically synthesized
ctcaaatggcaacgtcttactg

SEQ ID NO: 1140633 - DNA, 22 bp, Artificial Sequence
  chemically synthesized
ttcttcagtaagacgttgccat

SEQ ID NO: 1140634 - DNA, 22 bp, Artificial Sequence
  chemically synthesized
ttcagtaagacgttgccatttg

SEQ ID NO: 1140635 - DNA, 22 bp, Artificial Sequence
  chemically synthesized
cagtaagacgttgccatttgag

SEQ ID NO: 1140636 - DNA, 22 bp, Artificial Sequence
  chemically synthesized
caagacatccttctcaaatggc

SEQ ID NO: 1140637 - DNA, 22 bp, Artificial Sequence
  chemically synthesized
agtaagacgttgccatttgaga

SEQ ID NO: 1140638 - DNA, 22 bp, Artificial Sequence
  chemically synthesized
acaagacatccttctcaaatgg

SEQ ID NO: 1140639 - DNA, 22 bp, Artificial Sequence
  chemically synthesized
tacaagacatccttctcaaatg

SEQ ID NO: 1140640 - DNA, 22 bp, Artificial Sequence
  chemically synthesized
ttacaagacatccttctcaaat

SEQ ID NO: 1140641 - DNA, 22 bp, Artificial Sequence
  chemically synthesized
ttttacaagacatccttctcaa

SEQ ID NO: 1140642 - DNA, 22 bp, Artificial Sequence
  chemically synthesized
ggttcttttacaagacatcctt

SEQ ID NO: 1140643 - DNA, 22 bp, Artificial Sequence
  chemically synthesized
ccatttgagaaggatgtcttgt

SEQ ID NO: 1140644 - DNA, 22 bp, Artificial Sequence
  chemically synthesized
gagaaggatgtcttgtaaaaga

SEQ ID NO: 1140645 - DNA, 22 bp, Artificial Sequence
  chemically synthesized
agaaggatgtcttgtaaaagaa

SEQ ID NO: 1140646 - DNA, 22 bp, Artificial Sequence
  chemically synthesized
tagatggacagaagaccgctgg

SEQ ID NO: 1140647 - DNA, 22 bp, Artificial Sequence
  chemically synthesized
gtaaaagaacccagcggtcttc

SEQ ID NO: 1140648 - DNA, 22 bp, Artificial Sequence
  chemically synthesized
taaaagaacccagcggtcttct

SEQ ID NO: 1140649 - DNA, 22 bp, Artificial Sequence
  chemically synthesized
ctgtccatctacagatgtttgc

SEQ ID NO: 1140650 - DNA, 22 bp, Artificial Sequence
  chemically synthesized
ggagatcgatgggcaaacatct

SEQ ID NO: 1140651 - DNA, 22 bp, Artificial Sequence
  chemically synthesized
tgtccatctacagatgtttgcc

SEQ ID NO: 1140652 - DNA, 22 bp, Artificial Sequence
  chemically synthesized
tccatctacagatgtttgccca

SEQ ID NO: 1140653 - DNA, 22 bp, Artificial Sequence
  chemically synthesized
caggtattgggagatcgatggg

SEQ ID NO: 1140654 - DNA, 22 bp, Artificial Sequence
  chemically synthesized
cagatgtttgcccatcgatctc

SEQ ID NO: 1140655 - DNA, 22 bp, Artificial Sequence
  chemically synthesized
tccaggtattgggagatcgatg

SEQ ID NO: 1140656 - DNA, 22 bp, Artificial Sequence
  chemically synthesized
ctccaggtattgggagatcgat

SEQ ID NO: 1140657 - DNA, 22 bp, Artificial Sequence
  chemically synthesized
ttctccaggtattgggagatcg

SEQ ID NO: 1140658 - DNA, 22 bp, Artificial Sequence
  chemically synthesized
tctcttctccaggtattgggag

SEQ ID NO: 1140659 - DNA, 22 bp, Artificial Sequence
  chemically synthesized
gcccatcgatctcccaatacct

SEQ ID NO: 1140660 - DNA, 22 bp, Artificial Sequence
  chemically synthesized
cccatcgatctcccaatacctg

SEQ ID NO: 1140661 - DNA, 22 bp, Artificial Sequence
  chemically synthesized
attgtctcttctccaggtattg

SEQ ID NO: 1140662 - DNA, 22 bp, Artificial Sequence
  chemically synthesized
gattgtctcttctccaggtatt

SEQ ID NO: 1140663 - DNA, 22 bp, Artificial Sequence
  chemically synthesized
tgcttgattgtctcttctccag

SEQ ID NO: 1140664 - DNA, 22 bp, Artificial Sequence
  chemically synthesized
ccaatacctggagaagagacaa

SEQ ID NO: 1140665 - DNA, 22 bp, Artificial Sequence
  chemically synthesized
atgctgtgcttgattgtctctt

SEQ ID NO: 1140666 - DNA, 22 bp, Artificial Sequence
  chemically synthesized
ctgatgctgtgcttgattgtct

SEQ ID NO: 1140667 - DNA, 22 bp, Artificial Sequence
  chemically synthesized
gctgatgctgtgcttgattgtc

SEQ ID NO: 1140668 - DNA, 22 bp, Artificial Sequence
  chemically synthesized
tttgctgatgctgtgcttgatt

SEQ ID NO: 1140669 - DNA, 22 bp, Artificial Sequence
  chemically synthesized
gagaagagacaatcaagcacag

SEQ ID NO: 1140670 - DNA, 22 bp, Artificial Sequence
  chemically synthesized
ccaattgtttgctgatgctgtg

SEQ ID NO: 1140671 - DNA, 22 bp, Artificial Sequence
  chemically synthesized
ataaaacgtagttaccaattgt

SEQ ID NO: 1140672 - DNA, 22 bp, Artificial Sequence
  chemically synthesized
aataaaacgtagttaccaattg

SEQ ID NO: 1140673 - DNA, 22 bp, Artificial Sequence
  chemically synthesized
taataaaacgtagttaccaatt

SEQ ID NO: 1140674 - DNA, 22 bp, Artificial Sequence
  chemically synthesized
ttaataaaacgtagttaccaat

SEQ ID NO: 1140675 - DNA, 22 bp, Artificial Sequence
  chemically synthesized
atgccatttttaataaaacgta

SEQ ID NO: 1140676 - DNA, 22 bp, Artificial Sequence
  chemically synthesized
ttcatgccatttttaataaaac

SEQ ID NO: 1140677 - DNA, 22 bp, Artificial Sequence
  chemically synthesized
gtaactacgttttattaaaaat

SEQ ID NO: 1140678 - DNA, 22 bp, Artificial Sequence
  chemically synthesized
gcaaattattcatgccattttt

SEQ ID NO: 1140679 - DNA, 22 bp, Artificial Sequence
  chemically synthesized
ggcaaattattcatgccatttt

SEQ ID NO: 1140680 - DNA, 22 bp, Artificial Sequence
  chemically synthesized
tggcaaattattcatgccattt

SEQ ID NO: 1140681 - DNA, 22 bp, Artificial Sequence
  chemically synthesized
cgttttattaaaaatggcatga

SEQ ID NO: 1140682 - DNA, 22 bp, Artificial Sequence
  chemically synthesized
tattaaaaatggcatgaataat

SEQ ID NO: 1140683 - DNA, 22 bp, Artificial Sequence
  chemically synthesized
attaaaaatggcatgaataatt

SEQ ID NO: 1140684 - DNA, 22 bp, Artificial Sequence
  chemically synthesized
ttaaaaatggcatgaataattt

SEQ ID NO: 1140685 - DNA, 22 bp, Artificial Sequence
  chemically synthesized
agatactttggcaaattattca

SEQ ID NO: 1140686 - DNA, 22 bp, Artificial Sequence
  chemically synthesized
aaaatggcatgaataatttgcc

SEQ ID NO: 1140687 - DNA, 22 bp, Artificial Sequence
  chemically synthesized
gcgtacataggagactgagata

SEQ ID NO: 1140688 - DNA, 22 bp, Artificial Sequence
  chemically synthesized
tagcgtacataggagactgaga

SEQ ID NO: 1140689 - DNA, 22 bp, Artificial Sequence
  chemically synthesized
ctagcgtacataggagactgag

SEQ ID NO: 1140690 - DNA, 22 bp, Artificial Sequence
  chemically synthesized
gccaaagtatctcagtctccta

SEQ ID NO: 1140691 - DNA, 22 bp, Artificial Sequence
  chemically synthesized
ccaaagtatctcagtctcctat

SEQ ID NO: 1140692 - DNA, 22 bp, Artificial Sequence
  chemically synthesized
caacttctagcgtacataggag

SEQ ID NO: 1140693 - DNA, 22 bp, Artificial Sequence
  chemically synthesized
ccaacttctagcgtacatagga

SEQ ID NO: 1140694 - DNA, 22 bp, Artificial Sequence
  chemically synthesized
agtctcctatgtacgctagaag

SEQ ID NO: 1140695 - DNA, 22 bp, Artificial Sequence
  chemically synthesized
ctatgtacgctagaagttggaa

SEQ ID NO: 1140696 - DNA, 22 bp, Artificial Sequence
  chemically synthesized
tgtacgctagaagttggaaggg

SEQ ID NO: 1140697 - DNA, 22 bp, Artificial Sequence
  chemically synthesized
gaagttggaagggacactcttt

SEQ ID NO: 1140698 - DNA, 22 bp, Artificial Sequence
  chemically synthesized
aatgtaagcagatcagaaagag

SEQ ID NO: 1140699 - DNA, 22 bp, Artificial Sequence
  chemically synthesized
aaatgtaagcagatcagaaaga

SEQ ID NO: 1140700 - DNA, 22 bp, Artificial Sequence
  chemically synthesized
gaagggacactctttctgatct

SEQ ID NO: 1140701 - DNA, 22 bp, Artificial Sequence
  chemically synthesized
tttaaatgtaagcagatcagaa

SEQ ID NO: 1140702 - DNA, 22 bp, Artificial Sequence
  chemically synthesized
atttaaatgtaagcagatcaga

SEQ ID NO: 1140703 - DNA, 22 bp, Artificial Sequence
  chemically synthesized
tttctgatctgcttacatttaa

SEQ ID NO: 1140704 - DNA, 22 bp, Artificial Sequence
  chemically synthesized
tctgatctgcttacatttaaat

SEQ ID NO: 1140705 - DNA, 22 bp, Artificial Sequence
  chemically synthesized
ctgatctgcttacatttaaata

SEQ ID NO: 1140706 - DNA, 22 bp, Artificial Sequence
  chemically synthesized
tgatctgcttacatttaaataa

SEQ ID NO: 1140707 - DNA, 22 bp, Artificial Sequence
  chemically synthesized
atctgcttacatttaaataagt

SEQ ID NO: 1140708 - DNA, 22 bp, Artificial Sequence
  chemically synthesized
cttacatttaaataagtggtgt

SEQ ID NO: 1140709 - DNA, 22 bp, Artificial Sequence
  chemically synthesized
acatttaaataagtggtgtgac

SEQ ID NO: 1140710 - DNA, 22 bp, Artificial Sequence
  chemically synthesized
catttaaataagtggtgtgact

SEQ ID NO: 1140711 - DNA, 22 bp, Artificial Sequence
  chemically synthesized
aaataagtggtgtgactgtcat

SEQ ID NO: 1140712 - DNA, 22 bp, Artificial Sequence
  chemically synthesized
aataagtggtgtgactgtcatt

SEQ ID NO: 1140713 - DNA, 22 bp, Artificial Sequence
  chemically synthesized
gtgagataaagacaaatgacag

SEQ ID NO: 1140714 - DNA, 22 bp, Artificial Sequence
  chemically synthesized
ggtgagataaagacaaatgaca

SEQ ID NO: 1140715 - DNA, 22 bp, Artificial Sequence
  chemically synthesized
tcatttgtctttatctcaccaa

SEQ ID NO: 1140716 - DNA, 22 bp, Artificial Sequence
  chemically synthesized
tgaaaggtacaagacttggtga

SEQ ID NO: 1140717 - DNA, 22 bp, Artificial Sequence
  chemically synthesized
tatgaaaggtacaagacttggt

SEQ ID NO: 1140718 - DNA, 22 bp, Artificial Sequence
  chemically synthesized
gtctttatctcaccaagtcttg

SEQ ID NO: 1140719 - DNA, 22 bp, Artificial Sequence
  chemically synthesized
ctatgaaaggtacaagacttgg

SEQ ID NO: 1140720 - DNA, 22 bp, Artificial Sequence
  chemically synthesized
tctttatctcaccaagtcttgt

SEQ ID NO: 1140721 - DNA, 22 bp, Artificial Sequence
  chemically synthesized
tctatgaaaggtacaagacttg

SEQ ID NO: 1140722 - DNA, 22 bp, Artificial Sequence
  chemically synthesized
ttctatgaaaggtacaagactt

SEQ ID NO: 1140723 - DNA, 22 bp, Artificial Sequence
  chemically synthesized
tatctcaccaagtcttgtacct

SEQ ID NO: 1140724 - DNA, 22 bp, Artificial Sequence
  chemically synthesized
cttttctatgaaaggtacaaga

SEQ ID NO: 1140725 - DNA, 22 bp, Artificial Sequence
  chemically synthesized
atctcaccaagtcttgtacctt

SEQ ID NO: 1140726 - DNA, 22 bp, Artificial Sequence
  chemically synthesized
gcttttctatgaaaggtacaag

SEQ ID NO: 1140727 - DNA, 22 bp, Artificial Sequence
  chemically synthesized
tctcaccaagtcttgtaccttt

SEQ ID NO: 1140728 - DNA, 22 bp, Artificial Sequence
  chemically synthesized
tgcttttctatgaaaggtacaa

SEQ ID NO: 1140729 - DNA, 22 bp, Artificial Sequence
  chemically synthesized
tttgcttttctatgaaaggtac

SEQ ID NO: 1140730 - DNA, 22 bp, Artificial Sequence
  chemically synthesized
accaagtcttgtacctttcata

SEQ ID NO: 1140731 - DNA, 22 bp, Artificial Sequence
  chemically synthesized
tctctttgcttttctatgaaag

SEQ ID NO: 1140732 - DNA, 22 bp, Artificial Sequence
  chemically synthesized
gtctctttgcttttctatgaaa

SEQ ID NO: 1140733 - DNA, 22 bp, Artificial Sequence
  chemically synthesized
cttgtctctttgcttttctatg

SEQ ID NO: 1140734 - DNA, 22 bp, Artificial Sequence
  chemically synthesized
gtacctttcatagaaaagcaaa

SEQ ID NO: 1140735 - DNA, 22 bp, Artificial Sequence
  chemically synthesized
tacctttcatagaaaagcaaag

SEQ ID NO: 1140736 - DNA, 22 bp, Artificial Sequence
  chemically synthesized
atattgcttgtctctttgcttt

SEQ ID NO: 1140737 - DNA, 22 bp, Artificial Sequence
  chemically synthesized
catattgcttgtctctttgctt

SEQ ID NO: 1140738 - DNA, 22 bp, Artificial Sequence
  chemically synthesized
tcatagaaaagcaaagagacaa

SEQ ID NO: 1140739 - DNA, 22 bp, Artificial Sequence
  chemically synthesized
catagaaaagcaaagagacaag

SEQ ID NO: 1140740 - DNA, 22 bp, Artificial Sequence
  chemically synthesized
atagaaaagcaaagagacaagc

SEQ ID NO: 1140741 - DNA, 22 bp, Artificial Sequence
  chemically synthesized
tatagtggtataataaccactt

SEQ ID NO: 1140742 - DNA, 22 bp, Artificial Sequence
  chemically synthesized
atatagtggtataataaccact

SEQ ID NO: 1140743 - DNA, 22 bp, Artificial Sequence
  chemically synthesized
tatatagtggtataataaccac

SEQ ID NO: 1140744 - DNA, 22 bp, Artificial Sequence
  chemically synthesized
tggagccattttatatagtggt

SEQ ID NO: 1140745 - DNA, 22 bp, Artificial Sequence
  chemically synthesized
ctatggagccattttatatagt

SEQ ID NO: 1140746 - DNA, 22 bp, Artificial Sequence
  chemically synthesized
gctatggagccattttatatag

SEQ ID NO: 1140747 - DNA, 22 bp, Artificial Sequence
  chemically synthesized
ttataccactatataaaatggc

SEQ ID NO: 1140748 - DNA, 22 bp, Artificial Sequence
  chemically synthesized
catttgctatggagccatttta

SEQ ID NO: 1140749 - DNA, 22 bp, Artificial Sequence
  chemically synthesized
acatttgctatggagccatttt

SEQ ID NO: 1140750 - DNA, 22 bp, Artificial Sequence
  chemically synthesized
taccactatataaaatggctcc

SEQ ID NO: 1140751 - DNA, 22 bp, Artificial Sequence
  chemically synthesized
tcttacatttgctatggagcca

SEQ ID NO: 1140752 - DNA, 22 bp, Artificial Sequence
  chemically synthesized
ttatcttacatttgctatggag

SEQ ID NO: 1140753 - DNA, 22 bp, Artificial Sequence
  chemically synthesized
gttatcttacatttgctatgga

SEQ ID NO: 1140754 - DNA, 22 bp, Artificial Sequence
  chemically synthesized
tataaaatggctccatagcaaa

SEQ ID NO: 1140755 - DNA, 22 bp, Artificial Sequence
  chemically synthesized
tgttatcttacatttgctatgg

SEQ ID NO: 1140756 - DNA, 22 bp, Artificial Sequence
  chemically synthesized
tatgtatgtctttgttatctta

SEQ ID NO: 1140757 - DNA, 22 bp, Artificial Sequence
  chemically synthesized
catagcaaatgtaagataacaa

SEQ ID NO: 1140758 - DNA, 22 bp, Artificial Sequence
  chemically synthesized
tatatgtatgtctttgttatct

SEQ ID NO: 1140759 - DNA, 22 bp, Artificial Sequence
  chemically synthesized
tctatatgtatgtctttgttat

SEQ ID NO: 1140760 - DNA, 22 bp, Artificial Sequence
  chemically synthesized
caaaatcctctctatatgtatg

SEQ ID NO: 1140761 - DNA, 22 bp, Artificial Sequence
  chemically synthesized
actgcaaaatcctctctatatg

SEQ ID NO: 1140762 - DNA, 22 bp, Artificial Sequence
  chemically synthesized
tcactgcaaaatcctctctata

SEQ ID NO: 1140763 - DNA, 22 bp, Artificial Sequence
  chemically synthesized
ttctcactgcaaaatcctctct

SEQ ID NO: 1140764 - DNA, 22 bp, Artificial Sequence
  chemically synthesized
gttctcactgcaaaatcctctc

SEQ ID NO: 1140765 - DNA, 22 bp, Artificial Sequence
  chemically synthesized
cttgttctcactgcaaaatcct

SEQ ID NO: 1140766 - DNA, 22 bp, Artificial Sequence
  chemically synthesized
acttgttctcactgcaaaatcc

SEQ ID NO: 1140767 - DNA, 22 bp, Artificial Sequence
  chemically synthesized
tacttgttctcactgcaaaatc

SEQ ID NO: 1140768 - DNA, 22 bp, Artificial Sequence
  chemically synthesized
ttacttgttctcactgcaaaat

SEQ ID NO: 1140769 - DNA, 22 bp, Artificial Sequence
  chemically synthesized
aggaaaatacaccttttacttg

SEQ ID NO: 1140770 - DNA, 22 bp, Artificial Sequence
  chemically synthesized
tgcagtgagaacaagtaaaagg

SEQ ID NO: 1140771 - DNA, 22 bp, Artificial Sequence
  chemically synthesized
gcagtgagaacaagtaaaaggt

SEQ ID NO: 1140772 - DNA, 22 bp, Artificial Sequence
  chemically synthesized
cagtgagaacaagtaaaaggtg

SEQ ID NO: 1140773 - DNA, 22 bp, Artificial Sequence
  chemically synthesized
aaacctaaggaaaatacacctt

SEQ ID NO: 1140774 - DNA, 22 bp, Artificial Sequence
  chemically synthesized
caaacctaaggaaaatacacct

SEQ ID NO: 1140775 - DNA, 22 bp, Artificial Sequence
  chemically synthesized
tcaaacctaaggaaaatacacc

SEQ ID NO: 1140776 - DNA, 22 bp, Artificial Sequence
  chemically synthesized
gggtgtattttcaaacctaagg

SEQ ID NO: 1140777 - DNA, 22 bp, Artificial Sequence
  chemically synthesized
agggtgtattttcaaacctaag

SEQ ID NO: 1140778 - DNA, 22 bp, Artificial Sequence
  chemically synthesized
tagggtgtattttcaaacctaa

SEQ ID NO: 1140779 - DNA, 22 bp, Artificial Sequence
  chemically synthesized
tttagggtgtattttcaaacct

SEQ ID NO: 1140780 - DNA, 22 bp, Artificial Sequence
  chemically synthesized
ttctttagggtgtattttcaaa

SEQ ID NO: 1140781 - DNA, 22 bp, Artificial Sequence
  chemically synthesized
attctttagggtgtattttcaa

SEQ ID NO: 1140782 - DNA, 22 bp, Artificial Sequence
  chemically synthesized
tattctttagggtgtattttca

SEQ ID NO: 1140783 - DNA, 22 bp, Artificial Sequence
  chemically synthesized
ttattctttagggtgtattttc

SEQ ID NO: 1140784 - DNA, 22 bp, Artificial Sequence
  chemically synthesized
tccttaggtttgaaaatacacc

SEQ ID NO: 1140785 - DNA, 22 bp, Artificial Sequence
  chemically synthesized
ccttaggtttgaaaatacaccc

SEQ ID NO: 1140786 - DNA, 22 bp, Artificial Sequence
  chemically synthesized
cttaggtttgaaaatacaccct

SEQ ID NO: 1140787 - DNA, 22 bp, Artificial Sequence
  chemically synthesized
gacttttattctttagggtgta

SEQ ID NO: 1140788 - DNA, 22 bp, Artificial Sequence
  chemically synthesized
aggtttgaaaatacaccctaaa

SEQ ID NO: 1140789 - DNA, 22 bp, Artificial Sequence
  chemically synthesized
ggtttgaaaatacaccctaaag

SEQ ID NO: 1140790 - DNA, 22 bp, Artificial Sequence
  chemically synthesized
gaaaatacaccctaaagaataa

SEQ ID NO: 1140791 - DNA, 22 bp, Artificial Sequence
  chemically synthesized
gtagttagacttttattcttta

SEQ ID NO: 1140792 - DNA, 22 bp, Artificial Sequence
  chemically synthesized
aaaatacaccctaaagaataaa

SEQ ID NO: 1140793 - DNA, 22 bp, Artificial Sequence
  chemically synthesized
agtagttagacttttattcttt

SEQ ID NO: 1140794 - DNA, 22 bp, Artificial Sequence
  chemically synthesized
tttagtagttagacttttattc

SEQ ID NO: 1140795 - DNA, 22 bp, Artificial Sequence
  chemically synthesized
tatttagtagttagacttttat

SEQ ID NO: 1140796 - DNA, 22 bp, Artificial Sequence
  chemically synthesized
aagaataaaagtctaactacta

SEQ ID NO: 1140797 - DNA, 22 bp, Artificial Sequence
  chemically synthesized
aggcattctatttagtagttag

SEQ ID NO: 1140798 - DNA, 22 bp, Artificial Sequence
  chemically synthesized
gaggcattctatttagtagtta

SEQ ID NO: 1140799 - DNA, 22 bp, Artificial Sequence
  chemically synthesized
tgaggcattctatttagtagtt

SEQ ID NO: 1140800 - DNA, 22 bp, Artificial Sequence
  chemically synthesized
ttgaggcattctatttagtagt

SEQ ID NO: 1140801 - DNA, 22 bp, Artificial Sequence
  chemically synthesized
agagtcttttgaggcattctat

SEQ ID NO: 1140802 - DNA, 22 bp, Artificial Sequence
  chemically synthesized
actactaaatagaatgcctcaa

SEQ ID NO: 1140803 - DNA, 22 bp, Artificial Sequence
  chemically synthesized
aattaagagtcttttgaggcat

SEQ ID NO: 1140804 - DNA, 22 bp, Artificial Sequence
  chemically synthesized
caattaagagtcttttgaggca

SEQ ID NO: 1140805 - DNA, 22 bp, Artificial Sequence
  chemically synthesized
ctaaatagaatgcctcaaaaga

SEQ ID NO: 1140806 - DNA, 22 bp, Artificial Sequence
  chemically synthesized
tttcaattaagagtcttttgag

SEQ ID NO: 1140807 - DNA, 22 bp, Artificial Sequence
  chemically synthesized
aatagaatgcctcaaaagactc

SEQ ID NO: 1140808 - DNA, 22 bp, Artificial Sequence
  chemically synthesized
tgcaagattgtttcaattaaga

SEQ ID NO: 1140809 - DNA, 22 bp, Artificial Sequence
  chemically synthesized
attatgcaagattgtttcaatt

SEQ ID NO: 1140810 - DNA, 22 bp, Artificial Sequence
  chemically synthesized
aaaagactcttaattgaaacaa

SEQ ID NO: 1140811 - DNA, 22 bp, Artificial Sequence
  chemically synthesized
tcattatgcaagattgtttcaa

SEQ ID NO: 1140812 - DNA, 22 bp, Artificial Sequence
  chemically synthesized
ttaattgaaacaatcttgcata

SEQ ID NO: 1140813 - DNA, 22 bp, Artificial Sequence
  chemically synthesized
aattgaaacaatcttgcataat

SEQ ID NO: 1140814 - DNA, 22 bp, Artificial Sequence
  chemically synthesized
attgaaacaatcttgcataatg

SEQ ID NO: 1140815 - DNA, 22 bp, Artificial Sequence
  chemically synthesized
aaacaatcttgcataatgagaa

SEQ ID NO: 1140816 - DNA, 22 bp, Artificial Sequence
  chemically synthesized
caatccaaatggtaggcaattc

SEQ ID NO: 1140817 - DNA, 22 bp, Artificial Sequence
  chemically synthesized
tacaatccaaatggtaggcaat

SEQ ID NO: 1140818 - DNA, 22 bp, Artificial Sequence
  chemically synthesized
gcataatgagaattgcctacca

SEQ ID NO: 1140819 - DNA, 22 bp, Artificial Sequence
  chemically synthesized
ctacaatccaaatggtaggcaa

SEQ ID NO: 1140820 - DNA, 22 bp, Artificial Sequence
  chemically synthesized
cataatgagaattgcctaccat

SEQ ID NO: 1140821 - DNA, 22 bp, Artificial Sequence
  chemically synthesized
ttctacaatccaaatggtaggc

SEQ ID NO: 1140822 - DNA, 22 bp, Artificial Sequence
  chemically synthesized
cttctacaatccaaatggtagg

SEQ ID NO: 1140823 - DNA, 22 bp, Artificial Sequence
  chemically synthesized
tcttctacaatccaaatggtag

SEQ ID NO: 1140824 - DNA, 22 bp, Artificial Sequence
  chemically synthesized
agaattttcttctacaatccaa

SEQ ID NO: 1140825 - DNA, 22 bp, Artificial Sequence
  chemically synthesized
ctaagaattttcttctacaatc

SEQ ID NO: 1140826 - DNA, 22 bp, Artificial Sequence
  chemically synthesized
cctaccatttggattgtagaag

SEQ ID NO: 1140827 - DNA, 22 bp, Artificial Sequence
  chemically synthesized
ccatttggattgtagaagaaaa

SEQ ID NO: 1140828 - DNA, 22 bp, Artificial Sequence
  chemically synthesized
agttactaagaattttcttcta

SEQ ID NO: 1140829 - DNA, 22 bp, Artificial Sequence
  chemically synthesized
aagttactaagaattttcttct

SEQ ID NO: 1140830 - DNA, 22 bp, Artificial Sequence
  chemically synthesized
ggattgtagaagaaaattctta

SEQ ID NO: 1140831 - DNA, 22 bp, Artificial Sequence
  chemically synthesized
gattgtagaagaaaattcttag

SEQ ID NO: 1140832 - DNA, 22 bp, Artificial Sequence
  chemically synthesized
tagaagaaaattcttagtaact

SEQ ID NO: 1140833 - DNA, 22 bp, Artificial Sequence
  chemically synthesized
catagtaatagaatttaagtta

SEQ ID NO: 1140834 - DNA, 22 bp, Artificial Sequence
  chemically synthesized
ttagtaacttaaattctattac

SEQ ID NO: 1140835 - DNA, 22 bp, Artificial Sequence
  chemically synthesized
aaaaatctacatagtaatagaa

SEQ ID NO: 1140836 - DNA, 22 bp, Artificial Sequence
  chemically synthesized
agtaacttaaattctattacta

SEQ ID NO: 1140837 - DNA, 22 bp, Artificial Sequence
  chemically synthesized
gtaacttaaattctattactat

SEQ ID NO: 1140838 - DNA, 22 bp, Artificial Sequence
  chemically synthesized
aaattctattactatgtagatt

SEQ ID NO: 1140839 - DNA, 22 bp, Artificial Sequence
  chemically synthesized
agaaaattgaaaaatctacata

SEQ ID NO: 1140840 - DNA, 22 bp, Artificial Sequence
  chemically synthesized
aattctattactatgtagattt

SEQ ID NO: 1140841 - DNA, 22 bp, Artificial Sequence
  chemically synthesized
tattactatgtagatttttcaa

SEQ ID NO: 1140842 - DNA, 22 bp, Artificial Sequence
  chemically synthesized
ttactatgtagatttttcaatt

SEQ ID NO: 1140843 - DNA, 22 bp, Artificial Sequence
  chemically synthesized
taataattgagaaaattgaaaa

SEQ ID NO: 1140844 - DNA, 22 bp, Artificial Sequence
  chemically synthesized
gtaataattgagaaaattgaaa

SEQ ID NO: 1140845 - DNA, 22 bp, Artificial Sequence
  chemically synthesized
ctatgtagatttttcaattttc

SEQ ID NO: 1140846 - DNA, 22 bp, Artificial Sequence
  chemically synthesized
tgtaataattgagaaaattgaa

SEQ ID NO: 1140847 - DNA, 22 bp, Artificial Sequence
  chemically synthesized
ttgtaataattgagaaaattga

SEQ ID NO: 1140848 - DNA, 22 bp, Artificial Sequence
  chemically synthesized
tgtagatttttcaattttctca

SEQ ID NO: 1140849 - DNA, 22 bp, Artificial Sequence
  chemically synthesized
atacttttgtaataattgagaa

SEQ ID NO: 1140850 - DNA, 22 bp, Artificial Sequence
  chemically synthesized
aatacttttgtaataattgaga

SEQ ID NO: 1140851 - DNA, 22 bp, Artificial Sequence
  chemically synthesized
taatacttttgtaataattgag

SEQ ID NO: 1140852 - DNA, 22 bp, Artificial Sequence
  chemically synthesized
ttcaattttctcaattattaca

SEQ ID NO: 1140853 - DNA, 22 bp, Artificial Sequence
  chemically synthesized
tcaattttctcaattattacaa

SEQ ID NO: 1140854 - DNA, 22 bp, Artificial Sequence
  chemically synthesized
caattttctcaattattacaaa

SEQ ID NO: 1140855 - DNA, 22 bp, Artificial Sequence
  chemically synthesized
aattttctcaattattacaaaa

SEQ ID NO: 1140856 - DNA, 22 bp, Artificial Sequence
  chemically synthesized
tctcaattattacaaaagtatt

SEQ ID NO: 1140857 - DNA, 22 bp, Artificial Sequence
  chemically synthesized
ctcaattattacaaaagtatta

SEQ ID NO: 1140858 - DNA, 22 bp, Artificial Sequence
  chemically synthesized
tcaattattacaaaagtattaa

SEQ ID NO: 1140859 - DNA, 22 bp, Artificial Sequence
  chemically synthesized
gaaacagaaaattttaatactt

SEQ ID NO: 1140860 - DNA, 22 bp, Artificial Sequence
  chemically synthesized
aattattacaaaagtattaaaa

SEQ ID NO: 1140861 - DNA, 22 bp, Artificial Sequence
  chemically synthesized
agaaacagaaaattttaatact

SEQ ID NO: 1140862 - DNA, 22 bp, Artificial Sequence
  chemically synthesized
ttacaaaagtattaaaattttc

SEQ ID NO: 1140863 - DNA, 22 bp, Artificial Sequence
  chemically synthesized
caaaagtattaaaattttctgt

SEQ ID NO: 1140864 - DNA, 22 bp, Artificial Sequence
  chemically synthesized
gagtagtttagaaacagaaaat

SEQ ID NO: 1140865 - DNA, 22 bp, Artificial Sequence
  chemically synthesized
actagagtagtttagaaacaga

SEQ ID NO: 1140866 - DNA, 22 bp, Artificial Sequence
  chemically synthesized
tcactagagtagtttagaaaca

SEQ ID NO: 1140867 - DNA, 22 bp, Artificial Sequence
  chemically synthesized
ctcactagagtagtttagaaac

SEQ ID NO: 1140868 - DNA, 22 bp, Artificial Sequence
  chemically synthesized
tctcactagagtagtttagaaa

SEQ ID NO: 1140869 - DNA, 22 bp, Artificial Sequence
  chemically synthesized
aaattttctgtttctaaactac

SEQ ID NO: 1140870 - DNA, 22 bp, Artificial Sequence
  chemically synthesized
gttttctcactagagtagttta

SEQ ID NO: 1140871 - DNA, 22 bp, Artificial Sequence
  chemically synthesized
ttagttttctcactagagtagt

SEQ ID NO: 1140872 - DNA, 22 bp, Artificial Sequence
  chemically synthesized
tctgtttctaaactactctagt

SEQ ID NO: 1140873 - DNA, 22 bp, Artificial Sequence
  chemically synthesized
ctgtttctaaactactctagtg

SEQ ID NO: 1140874 - DNA, 22 bp, Artificial Sequence
  chemically synthesized
tgtttctaaactactctagtga

SEQ ID NO: 1140875 - DNA, 22 bp, Artificial Sequence
  chemically synthesized
tttctaaactactctagtgaga

SEQ ID NO: 1140876 - DNA, 22 bp, Artificial Sequence
  chemically synthesized
ctaaactactctagtgagaaaa

SEQ ID NO: 1140877 - DNA, 22 bp, Artificial Sequence
  chemically synthesized
agagattgttagttttctcact

SEQ ID NO: 1140878 - DNA, 22 bp, Artificial Sequence
  chemically synthesized
taaactactctagtgagaaaac

SEQ ID NO: 1140879 - DNA, 22 bp, Artificial Sequence
  chemically synthesized
aactactctagtgagaaaacta

SEQ ID NO: 1140880 - DNA, 22 bp, Artificial Sequence
  chemically synthesized
ctcagagattgttagttttctc

SEQ ID NO: 1140881 - DNA, 22 bp, Artificial Sequence
  chemically synthesized
actcagagattgttagttttct

SEQ ID NO: 1140882 - DNA, 22 bp, Artificial Sequence
  chemically synthesized
tactcagagattgttagttttc

SEQ ID NO: 1140883 - DNA, 22 bp, Artificial Sequence
  chemically synthesized
ttactcagagattgttagtttt

SEQ ID NO: 1140884 - DNA, 22 bp, Artificial Sequence
  chemically synthesized
ctctagtgagaaaactaacaat

SEQ ID NO: 1140885 - DNA, 22 bp, Artificial Sequence
  chemically synthesized
tagtgagaaaactaacaatctc

SEQ ID NO: 1140886 - DNA, 22 bp, Artificial Sequence
  chemically synthesized
gtgagaaaactaacaatctctg

SEQ ID NO: 1140887 - DNA, 22 bp, Artificial Sequence
  chemically synthesized
atgatatagtagtttttactca

SEQ ID NO: 1140888 - DNA, 22 bp, Artificial Sequence
  chemically synthesized
acaatctctgagtaaaaactac

SEQ ID NO: 1140889 - DNA, 22 bp, Artificial Sequence
  chemically synthesized
gtgacatgttaatgatatagta

SEQ ID NO: 1140890 - DNA, 22 bp, Artificial Sequence
  chemically synthesized
tgagtaaaaactactatatcat

SEQ ID NO: 1140891 - DNA, 22 bp, Artificial Sequence
  chemically synthesized
agtaaaaactactatatcatta

SEQ ID NO: 1140892 - DNA, 22 bp, Artificial Sequence
  chemically synthesized
gacattagtgacatgttaatga

SEQ ID NO: 1140893 - DNA, 22 bp, Artificial Sequence
  chemically synthesized
agacattagtgacatgttaatg

SEQ ID NO: 1140894 - DNA, 22 bp, Artificial Sequence
  chemically synthesized
ttagacattagtgacatgttaa

SEQ ID NO: 1140895 - DNA, 22 bp, Artificial Sequence
  chemically synthesized
ctatatcattaacatgtcacta

SEQ ID NO: 1140896 - DNA, 22 bp, Artificial Sequence
  chemically synthesized
tatcattaacatgtcactaatg

SEQ ID NO: 1140897 - DNA, 22 bp, Artificial Sequence
  chemically synthesized
acatgtcactaatgtctaagaa

SEQ ID NO: 1140898 - DNA, 22 bp, Artificial Sequence
  chemically synthesized
aaatagtgtgtgttcttagaca

SEQ ID NO: 1140899 - DNA, 22 bp, Artificial Sequence
  chemically synthesized
catattaaaatagtgtgtgttc

SEQ ID NO: 1140900 - DNA, 22 bp, Artificial Sequence
  chemically synthesized
atgtctaagaacacacactatt

SEQ ID NO: 1140901 - DNA, 22 bp, Artificial Sequence
  chemically synthesized
tgttacatattaaaatagtgtg

SEQ ID NO: 1140902 - DNA, 22 bp, Artificial Sequence
  chemically synthesized
atgttacatattaaaatagtgt

SEQ ID NO: 1140903 - DNA, 22 bp, Artificial Sequence
  chemically synthesized
gtttatgttacatattaaaata

SEQ ID NO: 1140904 - DNA, 22 bp, Artificial Sequence
  chemically synthesized
agaacacacactattttaatat

SEQ ID NO: 1140905 - DNA, 22 bp, Artificial Sequence
  chemically synthesized
atagttggtttatgttacatat

SEQ ID NO: 1140906 - DNA, 22 bp, Artificial Sequence
  chemically synthesized
ttttaatatgtaacataaacca

SEQ ID NO: 1140907 - DNA, 22 bp, Artificial Sequence
  chemically synthesized
taatatgtaacataaaccaact

SEQ ID NO: 1140908 - DNA, 22 bp, Artificial Sequence
  chemically synthesized
aatatgtaacataaaccaacta

SEQ ID NO: 1140909 - DNA, 22 bp, Artificial Sequence
  chemically synthesized
atatgtaacataaaccaactat

SEQ ID NO: 1140910 - DNA, 22 bp, Artificial Sequence
  chemically synthesized
caaaaatcattgatagttggtt

SEQ ID NO: 1140911 - DNA, 22 bp, Artificial Sequence
  chemically synthesized
ccaaaaatcattgatagttggt

SEQ ID NO: 1140912 - DNA, 22 bp, Artificial Sequence
  chemically synthesized
cttccaaaaatcattgatagtt

SEQ ID NO: 1140913 - DNA, 22 bp, Artificial Sequence
  chemically synthesized
ccttccaaaaatcattgatagt

SEQ ID NO: 1140914 - DNA, 22 bp, Artificial Sequence
  chemically synthesized
tccttccaaaaatcattgatag

SEQ ID NO: 1140915 - DNA, 22 bp, Artificial Sequence
  chemically synthesized
ttttccttccaaaaatcattga

SEQ ID NO: 1140916 - DNA, 22 bp, Artificial Sequence
  chemically synthesized
gttttccttccaaaaatcattg

SEQ ID NO: 1140917 - DNA, 22 bp, Artificial Sequence
  chemically synthesized
tcaatgatttttggaaggaaaa

SEQ ID NO: 1140918 - DNA, 22 bp, Artificial Sequence
  chemically synthesized
ttggaaggaaaacaaatattgt

SEQ ID NO: 1140919 - DNA, 22 bp, Artificial Sequence
  chemically synthesized
tggaaggaaaacaaatattgtg

SEQ ID NO: 1140920 - DNA, 22 bp, Artificial Sequence
  chemically synthesized
catagaaagcatcacaatattt

SEQ ID NO: 1140921 - DNA, 22 bp, Artificial Sequence
  chemically synthesized
ggaaggaaaacaaatattgtga

SEQ ID NO: 1140922 - DNA, 22 bp, Artificial Sequence
  chemically synthesized
gcatagaaagcatcacaatatt

SEQ ID NO: 1140923 - DNA, 22 bp, Artificial Sequence
  chemically synthesized
gaaggaaaacaaatattgtgat

SEQ ID NO: 1140924 - DNA, 22 bp, Artificial Sequence
  chemically synthesized
tgcatagaaagcatcacaatat

SEQ ID NO: 1140925 - DNA, 22 bp, Artificial Sequence
  chemically synthesized
ctttgcatagaaagcatcacaa

SEQ ID NO: 1140926 - DNA, 22 bp, Artificial Sequence
  chemically synthesized
cctttgcatagaaagcatcaca

SEQ ID NO: 1140927 - DNA, 22 bp, Artificial Sequence
  chemically synthesized
aaatgcttcctttgcatagaaa

SEQ ID NO: 1140928 - DNA, 22 bp, Artificial Sequence
  chemically synthesized
gaaatgcttcctttgcatagaa

SEQ ID NO: 1140929 - DNA, 22 bp, Artificial Sequence
  chemically synthesized
tgaaatgcttcctttgcataga

SEQ ID NO: 1140930 - DNA, 22 bp, Artificial Sequence
  chemically synthesized
tgatgctttctatgcaaaggaa

SEQ ID NO: 1140931 - DNA, 22 bp, Artificial Sequence
  chemically synthesized
ccattttgaaatgcttcctttg

SEQ ID NO: 1140932 - DNA, 22 bp, Artificial Sequence
  chemically synthesized
actgccattttgaaatgcttcc

SEQ ID NO: 1140933 - DNA, 22 bp, Artificial Sequence
  chemically synthesized
tctatgcaaaggaagcatttca

SEQ ID NO: 1140934 - DNA, 22 bp, Artificial Sequence
  chemically synthesized
ctatgcaaaggaagcatttcaa

SEQ ID NO: 1140935 - DNA, 22 bp, Artificial Sequence
  chemically synthesized
tatgcaaaggaagcatttcaaa

SEQ ID NO: 1140936 - DNA, 22 bp, Artificial Sequence
  chemically synthesized
agctaactgccattttgaaatg

SEQ ID NO: 1140937 - DNA, 22 bp, Artificial Sequence
  chemically synthesized
tgcaaaggaagcatttcaaaat

SEQ ID NO: 1140938 - DNA, 22 bp, Artificial Sequence
  chemically synthesized
caaaatggcagttagctcaacc

SEQ ID NO: 1140939 - DNA, 22 bp, Artificial Sequence
  chemically synthesized
aaaatggcagttagctcaacct

SEQ ID NO: 1140940 - DNA, 22 bp, Artificial Sequence
  chemically synthesized
taaagtgcatcataatgaggtt

SEQ ID NO: 1140941 - DNA, 22 bp, Artificial Sequence
  chemically synthesized
aggctataaagtgcatcataat

SEQ ID NO: 1140942 - DNA, 22 bp, Artificial Sequence
  chemically synthesized
gctcaacctcattatgatgcac

SEQ ID NO: 1140943 - DNA, 22 bp, Artificial Sequence
  chemically synthesized
aacctcattatgatgcacttta

SEQ ID NO: 1140944 - DNA, 22 bp, Artificial Sequence
  chemically synthesized
aaaattcaggctataaagtgca

SEQ ID NO: 1140945 - DNA, 22 bp, Artificial Sequence
  chemically synthesized
attatgatgcactttatagcct

SEQ ID NO: 1140946 - DNA, 22 bp, Artificial Sequence
  chemically synthesized
tgatgcactttatagcctgaat

SEQ ID NO: 1140947 - DNA, 22 bp, Artificial Sequence
  chemically synthesized
caaaaagttgaaaattcaggct

SEQ ID NO: 1140948 - DNA, 22 bp, Artificial Sequence
  chemically synthesized
tatagcctgaattttcaacttt

SEQ ID NO: 1140949 - DNA, 22 bp, Artificial Sequence
  chemically synthesized
atagcctgaattttcaactttt

SEQ ID NO: 1140950 - DNA, 22 bp, Artificial Sequence
  chemically synthesized
tagcctgaattttcaacttttt

SEQ ID NO: 1140951 - DNA, 22 bp, Artificial Sequence
  chemically synthesized
tatgaaaaagttacaaaaagtt

SEQ ID NO: 1140952 - DNA, 22 bp, Artificial Sequence
  chemically synthesized
atatgaaaaagttacaaaaagt

SEQ ID NO: 1140953 - DNA, 22 bp, Artificial Sequence
  chemically synthesized
tttatatgaaaaagttacaaaa

SEQ ID NO: 1140954 - DNA, 22 bp, Artificial Sequence
  chemically synthesized
aattttcaactttttgtaactt

SEQ ID NO: 1140955 - DNA, 22 bp, Artificial Sequence
  chemically synthesized
atttatatgaaaaagttacaaa

SEQ ID NO: 1140956 - DNA, 22 bp, Artificial Sequence
  chemically synthesized
ttatttatatgaaaaagttaca

SEQ ID NO: 1140957 - DNA, 22 bp, Artificial Sequence
  chemically synthesized
cttatttatatgaaaaagttac

SEQ ID NO: 1140958 - DNA, 22 bp, Artificial Sequence
  chemically synthesized
tcaactttttgtaactttttca

SEQ ID NO: 1140959 - DNA, 22 bp, Artificial Sequence
  chemically synthesized
caactttttgtaactttttcat

SEQ ID NO: 1140960 - DNA, 22 bp, Artificial Sequence
  chemically synthesized
aactttttgtaactttttcata

SEQ ID NO: 1140961 - DNA, 22 bp, Artificial Sequence
  chemically synthesized
tttgtaactttttcatataaat

SEQ ID NO: 1140962 - DNA, 22 bp, Artificial Sequence
  chemically synthesized
ttgtaactttttcatataaata

SEQ ID NO: 1140963 - DNA, 22 bp, Artificial Sequence
  chemically synthesized
tgtaactttttcatataaataa

SEQ ID NO: 1140964 - DNA, 22 bp, Artificial Sequence
  chemically synthesized
gtaactttttcatataaataag

SEQ ID NO: 1140965 - DNA, 22 bp, Artificial Sequence
  chemically synthesized
taactttttcatataaataaga

SEQ ID NO: 1140966 - DNA, 22 bp, Artificial Sequence
  chemically synthesized
tttcatataaataagaaactta

SEQ ID NO: 1140967 - DNA, 22 bp, Artificial Sequence
  chemically synthesized
ttcatataaataagaaacttat

SEQ ID NO: 1140968 - DNA, 22 bp, Artificial Sequence
  chemically synthesized
tcatataaataagaaacttatt

SEQ ID NO: 1140969 - DNA, 22 bp, Artificial Sequence
  chemically synthesized
catataaataagaaacttattt

SEQ ID NO: 1140970 - DNA, 22 bp, Artificial Sequence
  chemically synthesized
atataaataagaaacttatttt

SEQ ID NO: 1140971 - DNA, 22 bp, Artificial Sequence
  chemically synthesized
aaggtccaatatatatatgaga

SEQ ID NO: 1140972 - DNA, 22 bp, Artificial Sequence
  chemically synthesized
aaaggtccaatatatatatgag

SEQ ID NO: 1140973 - DNA, 22 bp, Artificial Sequence
  chemically synthesized
taaaggtccaatatatatatga

SEQ ID NO: 1140974 - DNA, 22 bp, Artificial Sequence
  chemically synthesized
gctttaaaggtccaatatatat

SEQ ID NO: 1140975 - DNA, 22 bp, Artificial Sequence
  chemically synthesized
attttctcatatatatattgga

SEQ ID NO: 1140976 - DNA, 22 bp, Artificial Sequence
  chemically synthesized
tagctttaaaggtccaatatat

SEQ ID NO: 1140977 - DNA, 22 bp, Artificial Sequence
  chemically synthesized
ttttctcatatatatattggac

SEQ ID NO: 1140978 - DNA, 22 bp, Artificial Sequence
  chemically synthesized
ctagctttaaaggtccaatata

SEQ ID NO: 1140979 - DNA, 22 bp, Artificial Sequence
  chemically synthesized
tctcatatatatattggacctt

SEQ ID NO: 1140980 - DNA, 22 bp, Artificial Sequence
  chemically synthesized
ctcatatatatattggaccttt

SEQ ID NO: 1140981 - DNA, 22 bp, Artificial Sequence
  chemically synthesized
tcatatatatattggaccttta

SEQ ID NO: 1140982 - DNA, 22 bp, Artificial Sequence
  chemically synthesized
tgatttctagctttaaaggtcc

SEQ ID NO: 1140983 - DNA, 22 bp, Artificial Sequence
  chemically synthesized
atatatatattggacctttaaa

SEQ ID NO: 1140984 - DNA, 22 bp, Artificial Sequence
  chemically synthesized
atgatttctagctttaaaggtc

SEQ ID NO: 1140985 - DNA, 22 bp, Artificial Sequence
  chemically synthesized
tatgatttctagctttaaaggt

SEQ ID NO: 1140986 - DNA, 22 bp, Artificial Sequence
  chemically synthesized
gacctttaaagctagaaatcat

SEQ ID NO: 1140987 - DNA, 22 bp, Artificial Sequence
  chemically synthesized
taaagctagaaatcataaaata

SEQ ID NO: 1140988 - DNA, 22 bp, Artificial Sequence
  chemically synthesized
aaagctagaaatcataaaatat

SEQ ID NO: 1140989 - DNA, 22 bp, Artificial Sequence
  chemically synthesized
aagctagaaatcataaaatatt

SEQ ID NO: 1140990 - DNA, 22 bp, Artificial Sequence
  chemically synthesized
gaaatcataaaatattgacgtg

SEQ ID NO: 1140991 - DNA, 22 bp, Artificial Sequence
  chemically synthesized
tataaaataaagcacgtcaata

SEQ ID NO: 1140992 - DNA, 22 bp, Artificial Sequence
  chemically synthesized
tatataaaataaagcacgtcaa

SEQ ID NO: 1140993 - DNA, 22 bp, Artificial Sequence
  chemically synthesized
attctatataaaataaagcacg

SEQ ID NO: 1140994 - DNA, 22 bp, Artificial Sequence
  chemically synthesized
taattctatataaaataaagca

SEQ ID NO: 1140995 - DNA, 22 bp, Artificial Sequence
  chemically synthesized
actctaattctatataaaataa

SEQ ID NO: 1140996 - DNA, 22 bp, Artificial Sequence
  chemically synthesized
taactctaattctatataaaat

SEQ ID NO: 1140997 - DNA, 22 bp, Artificial Sequence
  chemically synthesized
ctaactctaattctatataaaa

SEQ ID NO: 1140998 - DNA, 22 bp, Artificial Sequence
  chemically synthesized
tctaactctaattctatataaa

SEQ ID NO: 1140999 - DNA, 22 bp, Artificial Sequence
  chemically synthesized
acgtgctttattttatatagaa

SEQ ID NO: 1141000 - DNA, 22 bp, Artificial Sequence
  chemically synthesized
ttctaactctaattctatataa

SEQ ID NO: 1141001 - DNA, 22 bp, Artificial Sequence
  chemically synthesized
tattttatatagaattagagtt

SEQ ID NO: 1141002 - DNA, 22 bp, Artificial Sequence
  chemically synthesized
attttatatagaattagagtta

SEQ ID NO: 1141003 - DNA, 22 bp, Artificial Sequence
  chemically synthesized
taaacatttttctaactctaat

SEQ ID NO: 1141004 - DNA, 22 bp, Artificial Sequence
  chemically synthesized
ttttatatagaattagagttag

SEQ ID NO: 1141005 - DNA, 22 bp, Artificial Sequence
  chemically synthesized
tatatagaattagagttagaaa

SEQ ID NO: 1141006 - DNA, 22 bp, Artificial Sequence
  chemically synthesized
atatagaattagagttagaaaa

SEQ ID NO: 1141007 - DNA, 22 bp, Artificial Sequence
  chemically synthesized
tatagaattagagttagaaaaa

SEQ ID NO: 1141008 - DNA, 22 bp, Artificial Sequence
  chemically synthesized
aaaaatatgagttataaacatt

SEQ ID NO: 1141009 - DNA, 22 bp, Artificial Sequence
  chemically synthesized
caaaaatatgagttataaacat

SEQ ID NO: 1141010 - DNA, 22 bp, Artificial Sequence
  chemically synthesized
gagttagaaaaatgtttataac

SEQ ID NO: 1141011 - DNA, 22 bp, Artificial Sequence
  chemically synthesized
tcaaaaatatgagttataaaca

SEQ ID NO: 1141012 - DNA, 22 bp, Artificial Sequence
  chemically synthesized
ttcaaaaatatgagttataaac

SEQ ID NO: 1141013 - DNA, 22 bp, Artificial Sequence
  chemically synthesized
gaaaaatgtttataactcatat

SEQ ID NO: 1141014 - DNA, 22 bp, Artificial Sequence
  chemically synthesized
agtagatttttcaaaaatatga

SEQ ID NO: 1141015 - DNA, 22 bp, Artificial Sequence
  chemically synthesized
ataactcatatttttgaaaaat

SEQ ID NO: 1141016 - DNA, 22 bp, Artificial Sequence
  chemically synthesized
gacactgagtagatttttcaaa

SEQ ID NO: 1141017 - DNA, 22 bp, Artificial Sequence
  chemically synthesized
taactcatatttttgaaaaatc

SEQ ID NO: 1141018 - DNA, 22 bp, Artificial Sequence
  chemically synthesized
agacactgagtagatttttcaa

SEQ ID NO: 1141019 - DNA, 22 bp, Artificial Sequence
  chemically synthesized
atatttttgaaaaatctactca

SEQ ID NO: 1141020 - DNA, 22 bp, Artificial Sequence
  chemically synthesized
tgagaccttagacactgagtag

SEQ ID NO: 1141021 - DNA, 22 bp, Artificial Sequence
  chemically synthesized
ttgaaaaatctactcagtgtct

SEQ ID NO: 1141022 - DNA, 22 bp, Artificial Sequence
  chemically synthesized
tgaaaaatctactcagtgtcta

SEQ ID NO: 1141023 - DNA, 22 bp, Artificial Sequence
  chemically synthesized
gaaaaatctactcagtgtctaa

SEQ ID NO: 1141024 - DNA, 22 bp, Artificial Sequence
  chemically synthesized
aaaaatctactcagtgtctaag

SEQ ID NO: 1141025 - DNA, 22 bp, Artificial Sequence
  chemically synthesized
ctcagtgtctaaggtctcataa

SEQ ID NO: 1141026 - DNA, 22 bp, Artificial Sequence
  chemically synthesized
agtgtctaaggtctcataattt

SEQ ID NO: 1141027 - DNA, 22 bp, Artificial Sequence
  chemically synthesized
aggtctcataatttctatgtta

SEQ ID NO: 1141028 - DNA, 22 bp, Artificial Sequence
  chemically synthesized
ataatttctatgttactttata

SEQ ID NO: 1141029 - DNA, 22 bp, Artificial Sequence
  chemically synthesized
atacacatatgtagtataaagt

SEQ ID NO: 1141030 - DNA, 22 bp, Artificial Sequence
  chemically synthesized
ctatgttactttatactacata

SEQ ID NO: 1141031 - DNA, 22 bp, Artificial Sequence
  chemically synthesized
tatgttactttatactacatat

SEQ ID NO: 1141032 - DNA, 22 bp, Artificial Sequence
  chemically synthesized
tgttactttatactacatatgt

SEQ ID NO: 1141033 - DNA, 22 bp, Artificial Sequence
  chemically synthesized
ggtgggttaatacacatatgta

SEQ ID NO: 1141034 - DNA, 22 bp, Artificial Sequence
  chemically synthesized
taggtgggttaatacacatatg

SEQ ID NO: 1141035 - DNA, 22 bp, Artificial Sequence
  chemically synthesized
ctttatactacatatgtgtatt

SEQ ID NO: 1141036 - DNA, 22 bp, Artificial Sequence
  chemically synthesized
tatactacatatgtgtattaac

SEQ ID NO: 1141037 - DNA, 22 bp, Artificial Sequence
  chemically synthesized
atactacatatgtgtattaacc

SEQ ID NO: 1141038 - DNA, 22 bp, Artificial Sequence
  chemically synthesized
tactacatatgtgtattaaccc

SEQ ID NO: 1141039 - DNA, 22 bp, Artificial Sequence
  chemically synthesized
atatcctctaggtgggttaata

SEQ ID NO: 1141040 - DNA, 22 bp, Artificial Sequence
  chemically synthesized
catatgtgtattaacccaccta

SEQ ID NO: 1141041 - DNA, 22 bp, Artificial Sequence
  chemically synthesized
aatcatgtgttaatatcctcta

SEQ ID NO: 1141042 - DNA, 22 bp, Artificial Sequence
  chemically synthesized
aaatcatgtgttaatatcctct

SEQ ID NO: 1141043 - DNA, 22 bp, Artificial Sequence
  chemically synthesized
tttaaatcatgtgttaatatcc

SEQ ID NO: 1141044 - DNA, 22 bp, Artificial Sequence
  chemically synthesized
acccacctagaggatattaaca

SEQ ID NO: 1141045 - DNA, 22 bp, Artificial Sequence
  chemically synthesized
cattgtttaaatcatgtgttaa

SEQ ID NO: 1141046 - DNA, 22 bp, Artificial Sequence
  chemically synthesized
gcattgtttaaatcatgtgtta

SEQ ID NO: 1141047 - DNA, 22 bp, Artificial Sequence
  chemically synthesized
gaggatattaacacatgattta

SEQ ID NO: 1141048 - DNA, 22 bp, Artificial Sequence
  chemically synthesized
atttgcattgtttaaatcatgt

SEQ ID NO: 1141049 - DNA, 22 bp, Artificial Sequence
  chemically synthesized
catttgcattgtttaaatcatg

SEQ ID NO: 1141050 - DNA, 22 bp, Artificial Sequence
  chemically synthesized
atttcatttgcattgtttaaat

SEQ ID NO: 1141051 - DNA, 22 bp, Artificial Sequence
  chemically synthesized
acacatgatttaaacaatgcaa

SEQ ID NO: 1141052 - DNA, 22 bp, Artificial Sequence
  chemically synthesized
atgatgctaatttcatttgcat

SEQ ID NO: 1141053 - DNA, 22 bp, Artificial Sequence
  chemically synthesized
catgatgctaatttcatttgca

SEQ ID NO: 1141054 - DNA, 22 bp, Artificial Sequence
  chemically synthesized
tcatgatgctaatttcatttgc

SEQ ID NO: 1141055 - DNA, 22 bp, Artificial Sequence
  chemically synthesized
ttttcatgatgctaatttcatt

SEQ ID NO: 1141056 - DNA, 22 bp, Artificial Sequence
  chemically synthesized
aaacaatgcaaatgaaattagc

SEQ ID NO: 1141057 - DNA, 22 bp, Artificial Sequence
  chemically synthesized
aacaatgcaaatgaaattagca

SEQ ID NO: 1141058 - DNA, 22 bp, Artificial Sequence
  chemically synthesized
gcatcatgaaaataatccacct

SEQ ID NO: 1141059 - DNA, 22 bp, Artificial Sequence
  chemically synthesized
caaaaaaaaaaaaaataggtgg

SEQ ID NO: 1141060 - DNA, 22 bp, Artificial Sequence
  chemically synthesized
tctacaaaaaaaaaaaaaatag

SEQ ID NO: 1141061 - DNA, 22 bp, Artificial Sequence
  chemically synthesized
tgtctacaaaaaaaaaaaaaat

SEQ ID NO: 1141062 - DNA, 22 bp, Artificial Sequence
  chemically synthesized
ttttttttttttttgtagacag

SEQ ID NO: 1141063 - DNA, 22 bp, Artificial Sequence
  chemically synthesized
tttttttttttgtagacagagt

SEQ ID NO: 1141064 - DNA, 22 bp, Artificial Sequence
  chemically synthesized
ttttttttttgtagacagagtt

SEQ ID NO: 1141065 - DNA, 22 bp, Artificial Sequence
  chemically synthesized
tttttttttgtagacagagttt

SEQ ID NO: 1141066 - DNA, 22 bp, Artificial Sequence
  chemically synthesized
ttttttttgtagacagagtttt

SEQ ID NO: 1141067 - DNA, 22 bp, Artificial Sequence
  chemically synthesized
ggtgacaggagcaaaactctgt

SEQ ID NO: 1141068 - DNA, 22 bp, Artificial Sequence
  chemically synthesized
tttttttgtagacagagttttg

SEQ ID NO: 1141069 - DNA, 22 bp, Artificial Sequence
  chemically synthesized
ttttttgtagacagagttttgc

SEQ ID NO: 1141070 - DNA, 22 bp, Artificial Sequence
  chemically synthesized
tttttgtagacagagttttgct

SEQ ID NO: 1141071 - DNA, 22 bp, Artificial Sequence
  chemically synthesized
ttttgtagacagagttttgctc

SEQ ID NO: 1141072 - DNA, 22 bp, Artificial Sequence
  chemically synthesized
tttgtagacagagttttgctcc

SEQ ID NO: 1141073 - DNA, 22 bp, Artificial Sequence
  chemically synthesized
ttgtagacagagttttgctcct

SEQ ID NO: 1141074 - DNA, 22 bp, Artificial Sequence
  chemically synthesized
tgtagacagagttttgctcctg

SEQ ID NO: 1141075 - DNA, 22 bp, Artificial Sequence
  chemically synthesized
cagcctgggtgacaggagcaaa

SEQ ID NO: 1141076 - DNA, 22 bp, Artificial Sequence
  chemically synthesized
gtagacagagttttgctcctgt

SEQ ID NO: 1141077 - DNA, 22 bp, Artificial Sequence
  chemically synthesized
tagacagagttttgctcctgtc

SEQ ID NO: 1141078 - DNA, 22 bp, Artificial Sequence
  chemically synthesized
cactccagcctgggtgacagga

SEQ ID NO: 1141079 - DNA, 22 bp, Artificial Sequence
  chemically synthesized
tgctcctgtcacccaggctgga

SEQ ID NO: 1141080 - DNA, 22 bp, Artificial Sequence
  chemically synthesized
gctcctgtcacccaggctggag

SEQ ID NO: 1141081 - DNA, 22 bp, Artificial Sequence
  chemically synthesized
ctcctgtcacccaggctggagt

SEQ ID NO: 1141082 - DNA, 22 bp, Artificial Sequence
  chemically synthesized
ctgtcacccaggctggagtgca

SEQ ID NO: 1141083 - DNA, 22 bp, Artificial Sequence
  chemically synthesized
agatagtgccattgcactccag

SEQ ID NO: 1141084 - DNA, 22 bp, Artificial Sequence
  chemically synthesized
tcacccaggctggagtgcaatg

SEQ ID NO: 1141085 - DNA, 22 bp, Artificial Sequence
  chemically synthesized
cagtgagctgagatagtgccat

SEQ ID NO: 1141086 - DNA, 22 bp, Artificial Sequence
  chemically synthesized
gagtgcaatggcactatctcag

SEQ ID NO: 1141087 - DNA, 22 bp, Artificial Sequence
  chemically synthesized
aatccaggaggtggaggttgca

SEQ ID NO: 1141088 - DNA, 22 bp, Artificial Sequence
  chemically synthesized
tctcagctcactgcaacctcca

SEQ ID NO: 1141089 - DNA, 22 bp, Artificial Sequence
  chemically synthesized
cctgaatccaggaggtggaggt

SEQ ID NO: 1141090 - DNA, 22 bp, Artificial Sequence
  chemically synthesized
agctcactgcaacctccacctc

SEQ ID NO: 1141091 - DNA, 22 bp, Artificial Sequence
  chemically synthesized
actgcaacctccacctcctgga

SEQ ID NO: 1141092 - DNA, 22 bp, Artificial Sequence
  chemically synthesized
caacctccacctcctggattca

SEQ ID NO: 1141093 - DNA, 22 bp, Artificial Sequence
  chemically synthesized
aggcaggagaattccctgaatc

SEQ ID NO: 1141094 - DNA, 22 bp, Artificial Sequence
  chemically synthesized
cacctcctggattcagggaatt

SEQ ID NO: 1141095 - DNA, 22 bp, Artificial Sequence
  chemically synthesized
ctggattcagggaattctcctg

SEQ ID NO: 1141096 - DNA, 22 bp, Artificial Sequence
  chemically synthesized
gggaggctgaggcaggagaatt

SEQ ID NO: 1141097 - DNA, 22 bp, Artificial Sequence
  chemically synthesized
gattcagggaattctcctgcct

SEQ ID NO: 1141098 - DNA, 22 bp, Artificial Sequence
  chemically synthesized
ctggggaggctgaggcaggaga

SEQ ID NO: 1141099 - DNA, 22 bp, Artificial Sequence
  chemically synthesized
agggaattctcctgcctcagcc

SEQ ID NO: 1141100 - DNA, 22 bp, Artificial Sequence
  chemically synthesized
agctactggggaggctgaggca

SEQ ID NO: 1141101 - DNA, 22 bp, Artificial Sequence
  chemically synthesized
taatctcagctactggggaggc

SEQ ID NO: 1141102 - DNA, 22 bp, Artificial Sequence
  chemically synthesized
tcctgcctcagcctccccagta

SEQ ID NO: 1141103 - DNA, 22 bp, Artificial Sequence
  chemically synthesized
ctgcctcagcctccccagtagc

SEQ ID NO: 1141104 - DNA, 22 bp, Artificial Sequence
  chemically synthesized
cctcagcctccccagtagctga

SEQ ID NO: 1141105 - DNA, 22 bp, Artificial Sequence
  chemically synthesized
agcctccccagtagctgagatt

SEQ ID NO: 1141106 - DNA, 22 bp, Artificial Sequence
  chemically synthesized
cccagtagctgagattacaggc

SEQ ID NO: 1141107 - DNA, 22 bp, Artificial Sequence
  chemically synthesized
gccagacatggtggtggatgcc

SEQ ID NO: 1141108 - DNA, 22 bp, Artificial Sequence
  chemically synthesized
agattacaggcatccaccacca

SEQ ID NO: 1141109 - DNA, 22 bp, Artificial Sequence
  chemically synthesized
caggcatccaccaccatgtctg

SEQ ID NO: 1141110 - DNA, 22 bp, Artificial Sequence
  chemically synthesized
aaaatacaaaaattagccagac

SEQ ID NO: 1141111 - DNA, 22 bp, Artificial Sequence
  chemically synthesized
ctaaaaatacaaaaattagcca

SEQ ID NO: 1141112 - DNA, 22 bp, Artificial Sequence
  chemically synthesized
gctaatttttgtatttttagta

SEQ ID NO: 1141113 - DNA, 22 bp, Artificial Sequence
  chemically synthesized
atttttgtatttttagtagaca

SEQ ID NO: 1141114 - DNA, 22 bp, Artificial Sequence
  chemically synthesized
ttgtatttttagtagacacggg

SEQ ID NO: 1141115 - DNA, 22 bp, Artificial Sequence
  chemically synthesized
tgtatttttagtagacacgggg

SEQ ID NO: 1141116 - DNA, 22 bp, Artificial Sequence
  chemically synthesized
gtatttttagtagacacggggt

SEQ ID NO: 1141117 - DNA, 22 bp, Artificial Sequence
  chemically synthesized
tatttttagtagacacggggtt

SEQ ID NO: 1141118 - DNA, 22 bp, Artificial Sequence
  chemically synthesized
gccaagatggcgaaaccccgtg

SEQ ID NO: 1141119 - DNA, 22 bp, Artificial Sequence
  chemically synthesized
ttagtagacacggggtttcgcc

SEQ ID NO: 1141120 - DNA, 22 bp, Artificial Sequence
  chemically synthesized
tagtagacacggggtttcgcca

SEQ ID NO: 1141121 - DNA, 22 bp, Artificial Sequence
  chemically synthesized
agtagacacggggtttcgccat

SEQ ID NO: 1141122 - DNA, 22 bp, Artificial Sequence
  chemically synthesized
gtagacacggggtttcgccatc

SEQ ID NO: 1141123 - DNA, 22 bp, Artificial Sequence
  chemically synthesized
gagagcagcctggccaagatgg

SEQ ID NO: 1141124 - DNA, 22 bp, Artificial Sequence
  chemically synthesized
cgccatcttggccaggctgctc

SEQ ID NO: 1141125 - DNA, 22 bp, Artificial Sequence
  chemically synthesized
gccatcttggccaggctgctct

SEQ ID NO: 1141126 - DNA, 22 bp, Artificial Sequence
  chemically synthesized
aggtcaggagttcgagagcagc

SEQ ID NO: 1141127 - DNA, 22 bp, Artificial Sequence
  chemically synthesized
ggccaggctgctctcgaactcc

SEQ ID NO: 1141128 - DNA, 22 bp, Artificial Sequence
  chemically synthesized
gccaggctgctctcgaactcct

SEQ ID NO: 1141129 - DNA, 22 bp, Artificial Sequence
  chemically synthesized
ctctcgaactcctgacctcagg

SEQ ID NO: 1141130 - DNA, 22 bp, Artificial Sequence
  chemically synthesized
aggcaggtggatcacctgaggt

SEQ ID NO: 1141131 - DNA, 22 bp, Artificial Sequence
  chemically synthesized
tcgaactcctgacctcaggtga

SEQ ID NO: 1141132 - DNA, 22 bp, Artificial Sequence
  chemically synthesized
gaactcctgacctcaggtgatc

SEQ ID NO: 1141133 - DNA, 22 bp, Artificial Sequence
  chemically synthesized
ggaggctgaggcaggtggatca

SEQ ID NO: 1141134 - DNA, 22 bp, Artificial Sequence
  chemically synthesized
ctgacctcaggtgatccacctg

SEQ ID NO: 1141135 - DNA, 22 bp, Artificial Sequence
  chemically synthesized
gggaggctgaggcaggtggatc

SEQ ID NO: 1141136 - DNA, 22 bp, Artificial Sequence
  chemically synthesized
tgggaggctgaggcaggtggat

SEQ ID NO: 1141137 - DNA, 22 bp, Artificial Sequence
  chemically synthesized
acctcaggtgatccacctgcct

SEQ ID NO: 1141138 - DNA, 22 bp, Artificial Sequence
  chemically synthesized
aggtgatccacctgcctcagcc

SEQ ID NO: 1141139 - DNA, 22 bp, Artificial Sequence
  chemically synthesized
taatcccatcactttgggaggc

SEQ ID NO: 1141140 - DNA, 22 bp, Artificial Sequence
  chemically synthesized
cctcagcctcccaaagtgatgg

SEQ ID NO: 1141141 - DNA, 22 bp, Artificial Sequence
  chemically synthesized
atgcctgtaatcccatcacttt

SEQ ID NO: 1141142 - DNA, 22 bp, Artificial Sequence
  chemically synthesized
agcctcccaaagtgatgggatt

SEQ ID NO: 1141143 - DNA, 22 bp, Artificial Sequence
  chemically synthesized
ccaaagtgatgggattacaggc

SEQ ID NO: 1141144 - DNA, 22 bp, Artificial Sequence
  chemically synthesized
gggccaggtgcagtggctcatg

SEQ ID NO: 1141145 - DNA, 22 bp, Artificial Sequence
  chemically synthesized
caggcatgagccactgcacctg

SEQ ID NO: 1141146 - DNA, 22 bp, Artificial Sequence
  chemically synthesized
gaaataggtggattagggccag

SEQ ID NO: 1141147 - DNA, 22 bp, Artificial Sequence
  chemically synthesized
agaaataggtggattagggcca

SEQ ID NO: 1141148 - DNA, 22 bp, Artificial Sequence
  chemically synthesized
gtcacttagaaataggtggatt

SEQ ID NO: 1141149 - DNA, 22 bp, Artificial Sequence
  chemically synthesized
cacctggccctaatccacctat

SEQ ID NO: 1141150 - DNA, 22 bp, Artificial Sequence
  chemically synthesized
ctagtcacttagaaataggtgg

SEQ ID NO: 1141151 - DNA, 22 bp, Artificial Sequence
  chemically synthesized
tcctagtcacttagaaataggt

SEQ ID NO: 1141152 - DNA, 22 bp, Artificial Sequence
  chemically synthesized
gccctaatccacctatttctaa

SEQ ID NO: 1141153 - DNA, 22 bp, Artificial Sequence
  chemically synthesized
atccacctatttctaagtgact

SEQ ID NO: 1141154 - DNA, 22 bp, Artificial Sequence
  chemically synthesized
agaaacgtgactctcctagtca

SEQ ID NO: 1141155 - DNA, 22 bp, Artificial Sequence
  chemically synthesized
aagaaacgtgactctcctagtc

SEQ ID NO: 1141156 - DNA, 22 bp, Artificial Sequence
  chemically synthesized
tttctaagtgactaggagagtc

SEQ ID NO: 1141157 - DNA, 22 bp, Artificial Sequence
  chemically synthesized
ctaagtgactaggagagtcacg

SEQ ID NO: 1141158 - DNA, 22 bp, Artificial Sequence
  chemically synthesized
taagtgactaggagagtcacgt

SEQ ID NO: 1141159 - DNA, 22 bp, Artificial Sequence
  chemically synthesized
aacaatttaagaaacgtgactc

SEQ ID NO: 1141160 - DNA, 22 bp, Artificial Sequence
  chemically synthesized
agtgactaggagagtcacgttt

SEQ ID NO: 1141161 - DNA, 22 bp, Artificial Sequence
  chemically synthesized
ggagagtcacgtttcttaaatt

SEQ ID NO: 1141162 - DNA, 22 bp, Artificial Sequence
  chemically synthesized
agtggtgatagattaaacaatt

SEQ ID NO: 1141163 - DNA, 22 bp, Artificial Sequence
  chemically synthesized
aagtggtgatagattaaacaat

SEQ ID NO: 1141164 - DNA, 22 bp, Artificial Sequence
  chemically synthesized
taagtggtgatagattaaacaa

SEQ ID NO: 1141165 - DNA, 22 bp, Artificial Sequence
  chemically synthesized
ttaagtggtgatagattaaaca

SEQ ID NO: 1141166 - DNA, 22 bp, Artificial Sequence
  chemically synthesized
tttaagtggtgatagattaaac

SEQ ID NO: 1141167 - DNA, 22 bp, Artificial Sequence
  chemically synthesized
ttttaagtggtgatagattaaa

SEQ ID NO: 1141168 - DNA, 22 bp, Artificial Sequence
  chemically synthesized
tttttaagtggtgatagattaa

SEQ ID NO: 1141169 - DNA, 22 bp, Artificial Sequence
  chemically synthesized
ttttttaagtggtgatagatta

SEQ ID NO: 1141170 - DNA, 22 bp, Artificial Sequence
  chemically synthesized
cttaaattgtttaatctatcac

SEQ ID NO: 1141171 - DNA, 22 bp, Artificial Sequence
  chemically synthesized
ttaaattgtttaatctatcacc

SEQ ID NO: 1141172 - DNA, 22 bp, Artificial Sequence
  chemically synthesized
aaattgtttaatctatcaccac

SEQ ID NO: 1141173 - DNA, 22 bp, Artificial Sequence
  chemically synthesized
aattgtttaatctatcaccact

SEQ ID NO: 1141174 - DNA, 22 bp, Artificial Sequence
  chemically synthesized
tttaatctatcaccacttaaaa

SEQ ID NO: 1141175 - DNA, 22 bp, Artificial Sequence
  chemically synthesized
aatctatcaccacttaaaaaaa

SEQ ID NO: 1141176 - DNA, 22 bp, Artificial Sequence
  chemically synthesized
atctatcaccacttaaaaaaaa

SEQ ID NO: 1141177 - DNA, 22 bp, Artificial Sequence
  chemically synthesized
cccatgcgtgtattttttttta

SEQ ID NO: 1141178 - DNA, 22 bp, Artificial Sequence
  chemically synthesized
acccatgcgtgtattttttttt

SEQ ID NO: 1141179 - DNA, 22 bp, Artificial Sequence
  chemically synthesized
tcaccacttaaaaaaaaataca

SEQ ID NO: 1141180 - DNA, 22 bp, Artificial Sequence
  chemically synthesized
tttacccatgcgtgtatttttt

SEQ ID NO: 1141181 - DNA, 22 bp, Artificial Sequence
  chemically synthesized
tgtttacccatgcgtgtatttt

SEQ ID NO: 1141182 - DNA, 22 bp, Artificial Sequence
  chemically synthesized
ctgtttacccatgcgtgtattt

SEQ ID NO: 1141183 - DNA, 22 bp, Artificial Sequence
  chemically synthesized
ccttctgtttacccatgcgtgt

SEQ ID NO: 1141184 - DNA, 22 bp, Artificial Sequence
  chemically synthesized
aaaaaaaaatacacgcatgggt

SEQ ID NO: 1141185 - DNA, 22 bp, Artificial Sequence
  chemically synthesized
aaaaaaaatacacgcatgggta

SEQ ID NO: 1141186 - DNA, 22 bp, Artificial Sequence
  chemically synthesized
actgccttctgtttacccatgc

SEQ ID NO: 1141187 - DNA, 22 bp, Artificial Sequence
  chemically synthesized
taggaaaatgttgactgccttc

SEQ ID NO: 1141188 - DNA, 22 bp, Artificial Sequence
  chemically synthesized
atactgtaggaaaatgttgact

SEQ ID NO: 1141189 - DNA, 22 bp, Artificial Sequence
  chemically synthesized
tgttaatactgtaggaaaatgt

SEQ ID NO: 1141190 - DNA, 22 bp, Artificial Sequence
  chemically synthesized
tcctacagtattaacataatca

SEQ ID NO: 1141191 - DNA, 22 bp, Artificial Sequence
  chemically synthesized
catataagtacatgattatgtt

SEQ ID NO: 1141192 - DNA, 22 bp, Artificial Sequence
  chemically synthesized
cctacagtattaacataatcat

SEQ ID NO: 1141193 - DNA, 22 bp, Artificial Sequence
  chemically synthesized
ctacagtattaacataatcatg

SEQ ID NO: 1141194 - DNA, 22 bp, Artificial Sequence
  chemically synthesized
cagtattaacataatcatgtac

SEQ ID NO: 1141195 - DNA, 22 bp, Artificial Sequence
  chemically synthesized
agctgcatataagtacatgatt

SEQ ID NO: 1141196 - DNA, 22 bp, Artificial Sequence
  chemically synthesized
tgattgagctgcatataagtac

SEQ ID NO: 1141197 - DNA, 22 bp, Artificial Sequence
  chemically synthesized
atgattgagctgcatataagta

SEQ ID NO: 1141198 - DNA, 22 bp, Artificial Sequence
  chemically synthesized
acataatcatgtacttatatgc

SEQ ID NO: 1141199 - DNA, 22 bp, Artificial Sequence
  chemically synthesized
acttatgattgagctgcatata

SEQ ID NO: 1141200 - DNA, 22 bp, Artificial Sequence
  chemically synthesized
aaaactcacttatgattgagct

SEQ ID NO: 1141201 - DNA, 22 bp, Artificial Sequence
  chemically synthesized
atatgcagctcaatcataagtg

SEQ ID NO: 1141202 - DNA, 22 bp, Artificial Sequence
  chemically synthesized
tatgcagctcaatcataagtga

SEQ ID NO: 1141203 - DNA, 22 bp, Artificial Sequence
  chemically synthesized
tgaagaaaaactgaaaactcac

SEQ ID NO: 1141204 - DNA, 22 bp, Artificial Sequence
  chemically synthesized
atgaagaaaaactgaaaactca

SEQ ID NO: 1141205 - DNA, 22 bp, Artificial Sequence
  chemically synthesized
aatcataagtgagttttcagtt

SEQ ID NO: 1141206 - DNA, 22 bp, Artificial Sequence
  chemically synthesized
atatttatgaagaaaaactgaa

SEQ ID NO: 1141207 - DNA, 22 bp, Artificial Sequence
  chemically synthesized
tcagtttttcttcataaatatc

SEQ ID NO: 1141208 - DNA, 22 bp, Artificial Sequence
  chemically synthesized
cagtttttcttcataaatatca

SEQ ID NO: 1141209 - DNA, 22 bp, Artificial Sequence
  chemically synthesized
agtttttcttcataaatatcaa

SEQ ID NO: 1141210 - DNA, 22 bp, Artificial Sequence
  chemically synthesized
aaagcaataacattgatattta

SEQ ID NO: 1141211 - DNA, 22 bp, Artificial Sequence
  chemically synthesized
ttcttcataaatatcaatgtta

SEQ ID NO: 1141212 - DNA, 22 bp, Artificial Sequence
  chemically synthesized
tgctgaaagcaataacattgat

SEQ ID NO: 1141213 - DNA, 22 bp, Artificial Sequence
  chemically synthesized
tcttcataaatatcaatgttat

SEQ ID NO: 1141214 - DNA, 22 bp, Artificial Sequence
  chemically synthesized
cttcataaatatcaatgttatt

SEQ ID NO: 1141215 - DNA, 22 bp, Artificial Sequence
  chemically synthesized
ttcataaatatcaatgttattg

SEQ ID NO: 1141216 - DNA, 22 bp, Artificial Sequence
  chemically synthesized
cataaatatcaatgttattgct

SEQ ID NO: 1141217 - DNA, 22 bp, Artificial Sequence
  chemically synthesized
cattatgctgaaagcaataaca

SEQ ID NO: 1141218 - DNA, 22 bp, Artificial Sequence
  chemically synthesized
ataaatatcaatgttattgctt

SEQ ID NO: 1141219 - DNA, 22 bp, Artificial Sequence
  chemically synthesized
acagttacattatgctgaaagc

SEQ ID NO: 1141220 - DNA, 22 bp, Artificial Sequence
  chemically synthesized
ttgctttcagcataatgtaact

SEQ ID NO: 1141221 - DNA, 22 bp, Artificial Sequence
  chemically synthesized
caaaaaattaacagttacatta

SEQ ID NO: 1141222 - DNA, 22 bp, Artificial Sequence
  chemically synthesized
ctttcagcataatgtaactgtt

SEQ ID NO: 1141223 - DNA, 22 bp, Artificial Sequence
  chemically synthesized
tcagcataatgtaactgttaat

SEQ ID NO: 1141224 - DNA, 22 bp, Artificial Sequence
  chemically synthesized
cagcataatgtaactgttaatt

SEQ ID NO: 1141225 - DNA, 22 bp, Artificial Sequence
  chemically synthesized
agcataatgtaactgttaattt

SEQ ID NO: 1141226 - DNA, 22 bp, Artificial Sequence
  chemically synthesized
agtagaaagtgaaactacaaaa

SEQ ID NO: 1141227 - DNA, 22 bp, Artificial Sequence
  chemically synthesized
ttaattttttgtagtttcactt

SEQ ID NO: 1141228 - DNA, 22 bp, Artificial Sequence
  chemically synthesized
attttttgtagtttcactttct

SEQ ID NO: 1141229 - DNA, 22 bp, Artificial Sequence
  chemically synthesized
aaaataagttgagtagaaagtg

SEQ ID NO: 1141230 - DNA, 22 bp, Artificial Sequence
  chemically synthesized
tttgtagtttcactttctactc

SEQ ID NO: 1141231 - DNA, 22 bp, Artificial Sequence
  chemically synthesized
ttgtagtttcactttctactca

SEQ ID NO: 1141232 - DNA, 22 bp, Artificial Sequence
  chemically synthesized
tgtagtttcactttctactcaa

SEQ ID NO: 1141233 - DNA, 22 bp, Artificial Sequence
  chemically synthesized
gtagtttcactttctactcaac

SEQ ID NO: 1141234 - DNA, 22 bp, Artificial Sequence
  chemically synthesized
tagtttcactttctactcaact

SEQ ID NO: 1141235 - DNA, 22 bp, Artificial Sequence
  chemically synthesized
cactttctactcaacttatttt

SEQ ID NO: 1141236 - DNA, 22 bp, Artificial Sequence
  chemically synthesized
taaacataattcaaaataagtt

SEQ ID NO: 1141237 - DNA, 22 bp, Artificial Sequence
  chemically synthesized
actttctactcaacttattttg

SEQ ID NO: 1141238 - DNA, 22 bp, Artificial Sequence
  chemically synthesized
ttgtaaacataattcaaaataa

SEQ ID NO: 1141239 - DNA, 22 bp, Artificial Sequence
  chemically synthesized
attgtaaacataattcaaaata

SEQ ID NO: 1141240 - DNA, 22 bp, Artificial Sequence
  chemically synthesized
tctactcaacttattttgaatt

SEQ ID NO: 1141241 - DNA, 22 bp, Artificial Sequence
  chemically synthesized
tattgtaaacataattcaaaat

SEQ ID NO: 1141242 - DNA, 22 bp, Artificial Sequence
  chemically synthesized
ctactcaacttattttgaatta

SEQ ID NO: 1141243 - DNA, 22 bp, Artificial Sequence
  chemically synthesized
ttattgtaaacataattcaaaa

SEQ ID NO: 1141244 - DNA, 22 bp, Artificial Sequence
  chemically synthesized
tactcaacttattttgaattat

SEQ ID NO: 1141245 - DNA, 22 bp, Artificial Sequence
  chemically synthesized
ctcaacttattttgaattatgt

SEQ ID NO: 1141246 - DNA, 22 bp, Artificial Sequence
  chemically synthesized
aacttattttgaattatgttta

SEQ ID NO: 1141247 - DNA, 22 bp, Artificial Sequence
  chemically synthesized
tggcttttattgtaaacataat

SEQ ID NO: 1141248 - DNA, 22 bp, Artificial Sequence
  chemically synthesized
attttgaattatgtttacaata

SEQ ID NO: 1141249 - DNA, 22 bp, Artificial Sequence
  chemically synthesized
ttttgaattatgtttacaataa

SEQ ID NO: 1141250 - DNA, 22 bp, Artificial Sequence
  chemically synthesized
agcgctatggcttttattgtaa

SEQ ID NO: 1141251 - DNA, 22 bp, Artificial Sequence
  chemically synthesized
gagcgctatggcttttattgta

SEQ ID NO: 1141252 - DNA, 22 bp, Artificial Sequence
  chemically synthesized
tgaattatgtttacaataaaag

SEQ ID NO: 1141253 - DNA, 22 bp, Artificial Sequence
  chemically synthesized
gaattatgtttacaataaaagc

SEQ ID NO: 1141254 - DNA, 22 bp, Artificial Sequence
  chemically synthesized
aattatgtttacaataaaagcc

SEQ ID NO: 1141255 - DNA, 22 bp, Artificial Sequence
  chemically synthesized
tttgagcgctatggcttttatt

SEQ ID NO: 1141256 - DNA, 22 bp, Artificial Sequence
  chemically synthesized
tgtttacaataaaagccatagc

SEQ ID NO: 1141257 - DNA, 22 bp, Artificial Sequence
  chemically synthesized
gcatcactgtttgagcgctatg

SEQ ID NO: 1141258 - DNA, 22 bp, Artificial Sequence
  chemically synthesized
acaataaaagccatagcgctca

SEQ ID NO: 1141259 - DNA, 22 bp, Artificial Sequence
  chemically synthesized
caataaaagccatagcgctcaa

SEQ ID NO: 1141260 - DNA, 22 bp, Artificial Sequence
  chemically synthesized
tgggtatctcgcatcactgttt

SEQ ID NO: 1141261 - DNA, 22 bp, Artificial Sequence
  chemically synthesized
ctgtgggtatctcgcatcactg

SEQ ID NO: 1141262 - DNA, 22 bp, Artificial Sequence
  chemically synthesized
cctgtgggtatctcgcatcact

SEQ ID NO: 1141263 - DNA, 22 bp, Artificial Sequence
  chemically synthesized
aaacagtgatgcgagataccca

SEQ ID NO: 1141264 - DNA, 22 bp, Artificial Sequence
  chemically synthesized
gcacatttcctgtgggtatctc

SEQ ID NO: 1141265 - DNA, 22 bp, Artificial Sequence
  chemically synthesized
agctcgcacatttcctgtgggt

SEQ ID NO: 1141266 - DNA, 22 bp, Artificial Sequence
  chemically synthesized
aagctcgcacatttcctgtggg

SEQ ID NO: 1141267 - DNA, 22 bp, Artificial Sequence
  chemically synthesized
atttaagctcgcacatttcctg

SEQ ID NO: 1141268 - DNA, 22 bp, Artificial Sequence
  chemically synthesized
attgatttaagctcgcacattt

SEQ ID NO: 1141269 - DNA, 22 bp, Artificial Sequence
  chemically synthesized
aattcattgatttaagctcgca

SEQ ID NO: 1141270 - DNA, 22 bp, Artificial Sequence
  chemically synthesized
aagtgactaaattcattgattt

SEQ ID NO: 1141271 - DNA, 22 bp, Artificial Sequence
  chemically synthesized
gatggttgaagtgactaaattc

SEQ ID NO: 1141272 - DNA, 22 bp, Artificial Sequence
  chemically synthesized
aaatcaatgaatttagtcactt

SEQ ID NO: 1141273 - DNA, 22 bp, Artificial Sequence
  chemically synthesized
aatcaatgaatttagtcacttc

SEQ ID NO: 1141274 - DNA, 22 bp, Artificial Sequence
  chemically synthesized
gtaataattagatggttgaagt

SEQ ID NO: 1141275 - DNA, 22 bp, Artificial Sequence
  chemically synthesized
cgtaataattagatggttgaag

SEQ ID NO: 1141276 - DNA, 22 bp, Artificial Sequence
  chemically synthesized
cttcgtaataattagatggttg

SEQ ID NO: 1141277 - DNA, 22 bp, Artificial Sequence
  chemically synthesized
agtcacttcaaccatctaatta

SEQ ID NO: 1141278 - DNA, 22 bp, Artificial Sequence
  chemically synthesized
gtcacttcaaccatctaattat

SEQ ID NO: 1141279 - DNA, 22 bp, Artificial Sequence
  chemically synthesized
tatatactgcttcgtaataatt

SEQ ID NO: 1141280 - DNA, 22 bp, Artificial Sequence
  chemically synthesized
caaccatctaattattacgaag

SEQ ID NO: 1141281 - DNA, 22 bp, Artificial Sequence
  chemically synthesized
aaccatctaattattacgaagc

SEQ ID NO: 1141282 - DNA, 22 bp, Artificial Sequence
  chemically synthesized
gaaaaaacctatatatactgct

SEQ ID NO: 1141283 - DNA, 22 bp, Artificial Sequence
  chemically synthesized
agaaaaaacctatatatactgc

SEQ ID NO: 1141284 - DNA, 22 bp, Artificial Sequence
  chemically synthesized
attattacgaagcagtatatat

SEQ ID NO: 1141285 - DNA, 22 bp, Artificial Sequence
  chemically synthesized
tagaaaaaacctatatatactg

SEQ ID NO: 1141286 - DNA, 22 bp, Artificial Sequence
  chemically synthesized
ttacgaagcagtatatataggt

SEQ ID NO: 1141287 - DNA, 22 bp, Artificial Sequence
  chemically synthesized
cgaagcagtatatataggtttt

SEQ ID NO: 1141288 - DNA, 22 bp, Artificial Sequence
  chemically synthesized
aaaaaatgcaagtatgttttag

SEQ ID NO: 1141289 - DNA, 22 bp, Artificial Sequence
  chemically synthesized
gctaaaaaaatgcaagtatgtt

SEQ ID NO: 1141290 - DNA, 22 bp, Artificial Sequence
  chemically synthesized
tttctaaaacatacttgcattt

SEQ ID NO: 1141291 - DNA, 22 bp, Artificial Sequence
  chemically synthesized
ttctaaaacatacttgcatttt

SEQ ID NO: 1141292 - DNA, 22 bp, Artificial Sequence
  chemically synthesized
tctaaaacatacttgcattttt

SEQ ID NO: 1141293 - DNA, 22 bp, Artificial Sequence
  chemically synthesized
ctaaaacatacttgcatttttt

SEQ ID NO: 1141294 - DNA, 22 bp, Artificial Sequence
  chemically synthesized
ggaagttagctaaaaaaatgca

SEQ ID NO: 1141295 - DNA, 22 bp, Artificial Sequence
  chemically synthesized
taaaacatacttgcattttttt

SEQ ID NO: 1141296 - DNA, 22 bp, Artificial Sequence
  chemically synthesized
aaacatacttgcatttttttag

SEQ ID NO: 1141297 - DNA, 22 bp, Artificial Sequence
  chemically synthesized
acagggtcactaggaagttagc

SEQ ID NO: 1141298 - DNA, 22 bp, Artificial Sequence
  chemically synthesized
gcatttttttagctaacttcct

SEQ ID NO: 1141299 - DNA, 22 bp, Artificial Sequence
  chemically synthesized
catttttttagctaacttccta

SEQ ID NO: 1141300 - DNA, 22 bp, Artificial Sequence
  chemically synthesized
ttttagctaacttcctagtgac

SEQ ID NO: 1141301 - DNA, 22 bp, Artificial Sequence
  chemically synthesized
tttagctaacttcctagtgacc

SEQ ID NO: 1141302 - DNA, 22 bp, Artificial Sequence
  chemically synthesized
ttagctaacttcctagtgaccc

SEQ ID NO: 1141303 - DNA, 22 bp, Artificial Sequence
  chemically synthesized
tagctaacttcctagtgaccct

SEQ ID NO: 1141304 - DNA, 22 bp, Artificial Sequence
  chemically synthesized
acatgcactgacagggtcacta

SEQ ID NO: 1141305 - DNA, 22 bp, Artificial Sequence
  chemically synthesized
agctaacttcctagtgaccctg

SEQ ID NO: 1141306 - DNA, 22 bp, Artificial Sequence
  chemically synthesized
gctaacttcctagtgaccctgt

SEQ ID NO: 1141307 - DNA, 22 bp, Artificial Sequence
  chemically synthesized
cctgacatgcactgacagggtc

SEQ ID NO: 1141308 - DNA, 22 bp, Artificial Sequence
  chemically synthesized
acctgacatgcactgacagggt

SEQ ID NO: 1141309 - DNA, 22 bp, Artificial Sequence
  chemically synthesized
acttcctagtgaccctgtcagt

SEQ ID NO: 1141310 - DNA, 22 bp, Artificial Sequence
  chemically synthesized
tacctgacatgcactgacaggg

SEQ ID NO: 1141311 - DNA, 22 bp, Artificial Sequence
  chemically synthesized
cctagtgaccctgtcagtgcat

SEQ ID NO: 1141312 - DNA, 22 bp, Artificial Sequence
  chemically synthesized
ctagtgaccctgtcagtgcatg

SEQ ID NO: 1141313 - DNA, 22 bp, Artificial Sequence
  chemically synthesized
gtgaccctgtcagtgcatgtca

SEQ ID NO: 1141314 - DNA, 22 bp, Artificial Sequence
  chemically synthesized
cgtgccattttacctgacatgc

SEQ ID NO: 1141315 - DNA, 22 bp, Artificial Sequence
  chemically synthesized
ttacgtgccattttacctgaca

SEQ ID NO: 1141316 - DNA, 22 bp, Artificial Sequence
  chemically synthesized
gttacgtgccattttacctgac

SEQ ID NO: 1141317 - DNA, 22 bp, Artificial Sequence
  chemically synthesized
tgttacgtgccattttacctga

SEQ ID NO: 1141318 - DNA, 22 bp, Artificial Sequence
  chemically synthesized
tcagtgcatgtcaggtaaaatg

SEQ ID NO: 1141319 - DNA, 22 bp, Artificial Sequence
  chemically synthesized
accattttgttacgtgccattt

SEQ ID NO: 1141320 - DNA, 22 bp, Artificial Sequence
  chemically synthesized
ttaaccattttgttacgtgcca

SEQ ID NO: 1141321 - DNA, 22 bp, Artificial Sequence
  chemically synthesized
atctattaaccattttgttacg

SEQ ID NO: 1141322 - DNA, 22 bp, Artificial Sequence
  chemically synthesized
ccacaactaatctattaaccat

SEQ ID NO: 1141323 - DNA, 22 bp, Artificial Sequence
  chemically synthesized
tcccacaactaatctattaacc

SEQ ID NO: 1141324 - DNA, 22 bp, Artificial Sequence
  chemically synthesized
ctcccacaactaatctattaac

SEQ ID NO: 1141325 - DNA, 22 bp, Artificial Sequence
  chemically synthesized
tctcccacaactaatctattaa

SEQ ID NO: 1141326 - DNA, 22 bp, Artificial Sequence
  chemically synthesized
ttctcccacaactaatctatta

SEQ ID NO: 1141327 - DNA, 22 bp, Artificial Sequence
  chemically synthesized
tttctcccacaactaatctatt

SEQ ID NO: 1141328 - DNA, 22 bp, Artificial Sequence
  chemically synthesized
ttttctcccacaactaatctat

SEQ ID NO: 1141329 - DNA, 22 bp, Artificial Sequence
  chemically synthesized
aagcttttttctcccacaacta

SEQ ID NO: 1141330 - DNA, 22 bp, Artificial Sequence
  chemically synthesized
gaagcttttttctcccacaact

SEQ ID NO: 1141331 - DNA, 22 bp, Artificial Sequence
  chemically synthesized
atagattagttgtgggagaaaa

SEQ ID NO: 1141332 - DNA, 22 bp, Artificial Sequence
  chemically synthesized
catttgaagcttttttctccca

SEQ ID NO: 1141333 - DNA, 22 bp, Artificial Sequence
  chemically synthesized
tccatttgaagcttttttctcc

SEQ ID NO: 1141334 - DNA, 22 bp, Artificial Sequence
  chemically synthesized
ctccatttgaagcttttttctc

SEQ ID NO: 1141335 - DNA, 22 bp, Artificial Sequence
  chemically synthesized
tctccatttgaagcttttttct

SEQ ID NO: 1141336 - DNA, 22 bp, Artificial Sequence
  chemically synthesized
gttgtgggagaaaaaagcttca

SEQ ID NO: 1141337 - DNA, 22 bp, Artificial Sequence
  chemically synthesized
tgggagaaaaaagcttcaaatg

SEQ ID NO: 1141338 - DNA, 22 bp, Artificial Sequence
  chemically synthesized
agagataagattttctccattt

SEQ ID NO: 1141339 - DNA, 22 bp, Artificial Sequence
  chemically synthesized
aagagataagattttctccatt

SEQ ID NO: 1141340 - DNA, 22 bp, Artificial Sequence
  chemically synthesized
tacttaagagataagattttct

SEQ ID NO: 1141341 - DNA, 22 bp, Artificial Sequence
  chemically synthesized
atacttaagagataagattttc

SEQ ID NO: 1141342 - DNA, 22 bp, Artificial Sequence
  chemically synthesized
caaatggagaaaatcttatctc

SEQ ID NO: 1141343 - DNA, 22 bp, Artificial Sequence
  chemically synthesized
aaatggagaaaatcttatctct

SEQ ID NO: 1141344 - DNA, 22 bp, Artificial Sequence
  chemically synthesized
atctcttaagtataaactacac

SEQ ID NO: 1141345 - DNA, 22 bp, Artificial Sequence
  chemically synthesized
tctcttaagtataaactacacc

SEQ ID NO: 1141346 - DNA, 22 bp, Artificial Sequence
  chemically synthesized
ttaagtataaactacaccatct

SEQ ID NO: 1141347 - DNA, 22 bp, Artificial Sequence
  chemically synthesized
aagtataaactacaccatctac

SEQ ID NO: 1141348 - DNA, 22 bp, Artificial Sequence
  chemically synthesized
agtataaactacaccatctacc

SEQ ID NO: 1141349 - DNA, 22 bp, Artificial Sequence
  chemically synthesized
catcatcacgtcaggtagatgg

SEQ ID NO: 1141350 - DNA, 22 bp, Artificial Sequence
  chemically synthesized
tagatctgcatcatcacgtcag

SEQ ID NO: 1141351 - DNA, 22 bp, Artificial Sequence
  chemically synthesized
gtagatctgcatcatcacgtca

SEQ ID NO: 1141352 - DNA, 22 bp, Artificial Sequence
  chemically synthesized
caccatctacctgacgtgatga

SEQ ID NO: 1141353 - DNA, 22 bp, Artificial Sequence
  chemically synthesized
tgtagatctgcatcatcacgtc

SEQ ID NO: 1141354 - DNA, 22 bp, Artificial Sequence
  chemically synthesized
actttgtagatctgcatcatca

SEQ ID NO: 1141355 - DNA, 22 bp, Artificial Sequence
  chemically synthesized
gactttgtagatctgcatcatc

SEQ ID NO: 1141356 - DNA, 22 bp, Artificial Sequence
  chemically synthesized
tgactttgtagatctgcatcat

SEQ ID NO: 1141357 - DNA, 22 bp, Artificial Sequence
  chemically synthesized
cctgacgtgatgatgcagatct

SEQ ID NO: 1141358 - DNA, 22 bp, Artificial Sequence
  chemically synthesized
acgtgatgatgcagatctacaa

SEQ ID NO: 1141359 - DNA, 22 bp, Artificial Sequence
  chemically synthesized
ccacattttgactttgtagatc

SEQ ID NO: 1141360 - DNA, 22 bp, Artificial Sequence
  chemically synthesized
cccacattttgactttgtagat

SEQ ID NO: 1141361 - DNA, 22 bp, Artificial Sequence
  chemically synthesized
caataaatttcccacattttga

SEQ ID NO: 1141362 - DNA, 22 bp, Artificial Sequence
  chemically synthesized
caaagtcaaaatgtgggaaatt

SEQ ID NO: 1141363 - DNA, 22 bp, Artificial Sequence
  chemically synthesized
atgggctacaataaatttccca

SEQ ID NO: 1141364 - DNA, 22 bp, Artificial Sequence
  chemically synthesized
gagttgatgggctacaataaat

SEQ ID NO: 1141365 - DNA, 22 bp, Artificial Sequence
  chemically synthesized
actggagttgatgggctacaat

SEQ ID NO: 1141366 - DNA, 22 bp, Artificial Sequence
  chemically synthesized
cactggagttgatgggctacaa

SEQ ID NO: 1141367 - DNA, 22 bp, Artificial Sequence
  chemically synthesized
ttcactggagttgatgggctac

SEQ ID NO: 1141368 - DNA, 22 bp, Artificial Sequence
  chemically synthesized
cttcactggagttgatgggcta

SEQ ID NO: 1141369 - DNA, 22 bp, Artificial Sequence
  chemically synthesized
tcttcttcactggagttgatgg

SEQ ID NO: 1141370 - DNA, 22 bp, Artificial Sequence
  chemically synthesized
attgtagcccatcaactccagt

SEQ ID NO: 1141371 - DNA, 22 bp, Artificial Sequence
  chemically synthesized
actgtcttcttcactggagttg

SEQ ID NO: 1141372 - DNA, 22 bp, Artificial Sequence
  chemically synthesized
ttgtagcccatcaactccagtg

SEQ ID NO: 1141373 - DNA, 22 bp, Artificial Sequence
  chemically synthesized
gactgtcttcttcactggagtt

SEQ ID NO: 1141374 - DNA, 22 bp, Artificial Sequence
  chemically synthesized
tagcccatcaactccagtgaag

SEQ ID NO: 1141375 - DNA, 22 bp, Artificial Sequence
  chemically synthesized
ccttgactgtcttcttcactgg

SEQ ID NO: 1141376 - DNA, 22 bp, Artificial Sequence
  chemically synthesized
cccttgactgtcttcttcactg

SEQ ID NO: 1141377 - DNA, 22 bp, Artificial Sequence
  chemically synthesized
ttcccttgactgtcttcttcac

SEQ ID NO: 1141378 - DNA, 22 bp, Artificial Sequence
  chemically synthesized
cttcccttgactgtcttcttca

SEQ ID NO: 1141379 - DNA, 22 bp, Artificial Sequence
  chemically synthesized
tcccttcttcccttgactgtct

SEQ ID NO: 1141380 - DNA, 22 bp, Artificial Sequence
  chemically synthesized
gtcccttcttcccttgactgtc

SEQ ID NO: 1141381 - DNA, 22 bp, Artificial Sequence
  chemically synthesized
cagtgaagaagacagtcaaggg

SEQ ID NO: 1141382 - DNA, 22 bp, Artificial Sequence
  chemically synthesized
agtttgtcccttcttcccttga

SEQ ID NO: 1141383 - DNA, 22 bp, Artificial Sequence
  chemically synthesized
gagtttgtcccttcttcccttg

SEQ ID NO: 1141384 - DNA, 22 bp, Artificial Sequence
  chemically synthesized
tagcttgagtttgtcccttctt

SEQ ID NO: 1141385 - DNA, 22 bp, Artificial Sequence
  chemically synthesized
tgaatatgatgctatagcttga

SEQ ID NO: 1141386 - DNA, 22 bp, Artificial Sequence
  chemically synthesized
atgaatatgatgctatagcttg

SEQ ID NO: 1141387 - DNA, 22 bp, Artificial Sequence
  chemically synthesized
tttatgaatatgatgctatagc

SEQ ID NO: 1141388 - DNA, 22 bp, Artificial Sequence
  chemically synthesized
gtttatgaatatgatgctatag

SEQ ID NO: 1141389 - DNA, 22 bp, Artificial Sequence
  chemically synthesized
tgtttatgaatatgatgctata

SEQ ID NO: 1141390 - DNA, 22 bp, Artificial Sequence
  chemically synthesized
ttgtttatgaatatgatgctat

SEQ ID NO: 1141391 - DNA, 22 bp, Artificial Sequence
  chemically synthesized
tttgtttatgaatatgatgcta

SEQ ID NO: 1141392 - DNA, 22 bp, Artificial Sequence
  chemically synthesized
ttttgtttatgaatatgatgct

SEQ ID NO: 1141393 - DNA, 22 bp, Artificial Sequence
  chemically synthesized
aagctatagcatcatattcata

SEQ ID NO: 1141394 - DNA, 22 bp, Artificial Sequence
  chemically synthesized
aaagtcttttttgtttatgaat

SEQ ID NO: 1141395 - DNA, 22 bp, Artificial Sequence
  chemically synthesized
gaaagtcttttttgtttatgaa

SEQ ID NO: 1141396 - DNA, 22 bp, Artificial Sequence
  chemically synthesized
tagcatcatattcataaacaaa

SEQ ID NO: 1141397 - DNA, 22 bp, Artificial Sequence
  chemically synthesized
tatatacttgaaagtctttttt

SEQ ID NO: 1141398 - DNA, 22 bp, Artificial Sequence
  chemically synthesized
ataaacaaaaaagactttcaag

SEQ ID NO: 1141399 - DNA, 22 bp, Artificial Sequence
  chemically synthesized
gagagaagatgctatatatact

SEQ ID NO: 1141400 - DNA, 22 bp, Artificial Sequence
  chemically synthesized
tagcactagagagaagatgcta

SEQ ID NO: 1141401 - DNA, 22 bp, Artificial Sequence
  chemically synthesized
tcaagtatatatagcatcttct

SEQ ID NO: 1141402 - DNA, 22 bp, Artificial Sequence
  chemically synthesized
gtagcactagagagaagatgct

SEQ ID NO: 1141403 - DNA, 22 bp, Artificial Sequence
  chemically synthesized
caagtatatatagcatcttctc

SEQ ID NO: 1141404 - DNA, 22 bp, Artificial Sequence
  chemically synthesized
aagtatatatagcatcttctct

SEQ ID NO: 1141405 - DNA, 22 bp, Artificial Sequence
  chemically synthesized
tatgtcttgtagcactagagag

SEQ ID NO: 1141406 - DNA, 22 bp, Artificial Sequence
  chemically synthesized
agtggatactatatgtcttgta

SEQ ID NO: 1141407 - DNA, 22 bp, Artificial Sequence
  chemically synthesized
ctctctagtgctacaagacata

SEQ ID NO: 1141408 - DNA, 22 bp, Artificial Sequence
  chemically synthesized
cagtggatactatatgtcttgt

SEQ ID NO: 1141409 - DNA, 22 bp, Artificial Sequence
  chemically synthesized
tctctagtgctacaagacatat

SEQ ID NO: 1141410 - DNA, 22 bp, Artificial Sequence
  chemically synthesized
tctagtgctacaagacatatag

SEQ ID NO: 1141411 - DNA, 22 bp, Artificial Sequence
  chemically synthesized
cttcagtggatactatatgtct

SEQ ID NO: 1141412 - DNA, 22 bp, Artificial Sequence
  chemically synthesized
tagtgctacaagacatatagta

SEQ ID NO: 1141413 - DNA, 22 bp, Artificial Sequence
  chemically synthesized
gtgctacaagacatatagtatc

SEQ ID NO: 1141414 - DNA, 22 bp, Artificial Sequence
  chemically synthesized
aaatgctgcttcagtggatact

SEQ ID NO: 1141415 - DNA, 22 bp, Artificial Sequence
  chemically synthesized
aaaatgctgcttcagtggatac

SEQ ID NO: 1141416 - DNA, 22 bp, Artificial Sequence
  chemically synthesized
caagacatatagtatccactga

SEQ ID NO: 1141417 - DNA, 22 bp, Artificial Sequence
  chemically synthesized
caagcttaaaatgctgcttcag

SEQ ID NO: 1141418 - DNA, 22 bp, Artificial Sequence
  chemically synthesized
tggggttacaagcttaaaatgc

SEQ ID NO: 1141419 - DNA, 22 bp, Artificial Sequence
  chemically synthesized
cacctatggggttacaagctta

SEQ ID NO: 1141420 - DNA, 22 bp, Artificial Sequence
  chemically synthesized
aagcagcattttaagcttgtaa

SEQ ID NO: 1141421 - DNA, 22 bp, Artificial Sequence
  chemically synthesized
ccacctatggggttacaagctt

SEQ ID NO: 1141422 - DNA, 22 bp, Artificial Sequence
  chemically synthesized
tacatttccacctatggggtta

SEQ ID NO: 1141423 - DNA, 22 bp, Artificial Sequence
  chemically synthesized
taagcttgtaaccccataggtg

SEQ ID NO: 1141424 - DNA, 22 bp, Artificial Sequence
  chemically synthesized
aagcttgtaaccccataggtgg

SEQ ID NO: 1141425 - DNA, 22 bp, Artificial Sequence
  chemically synthesized
agcttgtaaccccataggtgga

SEQ ID NO: 1141426 - DNA, 22 bp, Artificial Sequence
  chemically synthesized
ataaattatacatttccaccta

SEQ ID NO: 1141427 - DNA, 22 bp, Artificial Sequence
  chemically synthesized
gtaaccccataggtggaaatgt

SEQ ID NO: 1141428 - DNA, 22 bp, Artificial Sequence
  chemically synthesized
taaccccataggtggaaatgta

SEQ ID NO: 1141429 - DNA, 22 bp, Artificial Sequence
  chemically synthesized
aaattaataaattatacatttc

SEQ ID NO: 1141430 - DNA, 22 bp, Artificial Sequence
  chemically synthesized
ccactaaaattaataaattata

SEQ ID NO: 1141431 - DNA, 22 bp, Artificial Sequence
  chemically synthesized
tattcccactaaaattaataaa

SEQ ID NO: 1141432 - DNA, 22 bp, Artificial Sequence
  chemically synthesized
gtattcccactaaaattaataa

SEQ ID NO: 1141433 - DNA, 22 bp, Artificial Sequence
  chemically synthesized
gatttgtattcccactaaaatt

SEQ ID NO: 1141434 - DNA, 22 bp, Artificial Sequence
  chemically synthesized
ggatttgtattcccactaaaat

SEQ ID NO: 1141435 - DNA, 22 bp, Artificial Sequence
  chemically synthesized
tttggatttgtattcccactaa

SEQ ID NO: 1141436 - DNA, 22 bp, Artificial Sequence
  chemically synthesized
atttggatttgtattcccacta

SEQ ID NO: 1141437 - DNA, 22 bp, Artificial Sequence
  chemically synthesized
tatttggatttgtattcccact

SEQ ID NO: 1141438 - DNA, 22 bp, Artificial Sequence
  chemically synthesized
attaattttagtgggaatacaa

SEQ ID NO: 1141439 - DNA, 22 bp, Artificial Sequence
  chemically synthesized
ttaattttagtgggaatacaaa

SEQ ID NO: 1141440 - DNA, 22 bp, Artificial Sequence
  chemically synthesized
attttagtgggaatacaaatcc

SEQ ID NO: 1141441 - DNA, 22 bp, Artificial Sequence
  chemically synthesized
tagtgggaatacaaatccaaat

SEQ ID NO: 1141442 - DNA, 22 bp, Artificial Sequence
  chemically synthesized
agtgggaatacaaatccaaata

SEQ ID NO: 1141443 - DNA, 22 bp, Artificial Sequence
  chemically synthesized
gtgggaatacaaatccaaataa

SEQ ID NO: 1141444 - DNA, 22 bp, Artificial Sequence
  chemically synthesized
gaataggggatctttatttgga

SEQ ID NO: 1141445 - DNA, 22 bp, Artificial Sequence
  chemically synthesized
tacaacctggaataggggatct

SEQ ID NO: 1141446 - DNA, 22 bp, Artificial Sequence
  chemically synthesized
aaaatgttatacaacctggaat

SEQ ID NO: 1141447 - DNA, 22 bp, Artificial Sequence
  chemically synthesized
gaaaatgttatacaacctggaa

SEQ ID NO: 1141448 - DNA, 22 bp, Artificial Sequence
  chemically synthesized
aataaatttgaaaatgttatac

SEQ ID NO: 1141449 - DNA, 22 bp, Artificial Sequence
  chemically synthesized
caataaatttgaaaatgttata

SEQ ID NO: 1141450 - DNA, 22 bp, Artificial Sequence
  chemically synthesized
ttccaggttgtataacattttc

SEQ ID NO: 1141451 - DNA, 22 bp, Artificial Sequence
  chemically synthesized
caggttgtataacattttcaaa

SEQ ID NO: 1141452 - DNA, 22 bp, Artificial Sequence
  chemically synthesized
agaatttcaataaatttgaaaa

SEQ ID NO: 1141453 - DNA, 22 bp, Artificial Sequence
  chemically synthesized
tataacattttcaaatttattg

SEQ ID NO: 1141454 - DNA, 22 bp, Artificial Sequence
  chemically synthesized
gtacatctcagaatttcaataa

SEQ ID NO: 1141455 - DNA, 22 bp, Artificial Sequence
  chemically synthesized
tcaaatttattgaaattctgag

SEQ ID NO: 1141456 - DNA, 22 bp, Artificial Sequence
  chemically synthesized
caaatttattgaaattctgaga

SEQ ID NO: 1141457 - DNA, 22 bp, Artificial Sequence
  chemically synthesized
aaatttattgaaattctgagat

SEQ ID NO: 1141458 - DNA, 22 bp, Artificial Sequence
  chemically synthesized
attgaaattctgagatgtacta

SEQ ID NO: 1141459 - DNA, 22 bp, Artificial Sequence
  chemically synthesized
aatgcatcccattagtacatct

SEQ ID NO: 1141460 - DNA, 22 bp, Artificial Sequence
  chemically synthesized
ttgaaattctgagatgtactaa

SEQ ID NO: 1141461 - DNA, 22 bp, Artificial Sequence
  chemically synthesized
aaattctgagatgtactaatgg

SEQ ID NO: 1141462 - DNA, 22 bp, Artificial Sequence
  chemically synthesized
caatattaaatgcatcccatta

SEQ ID NO: 1141463 - DNA, 22 bp, Artificial Sequence
  chemically synthesized
tgagatgtactaatgggatgca

SEQ ID NO: 1141464 - DNA, 22 bp, Artificial Sequence
  chemically synthesized
agatgtactaatgggatgcatt

SEQ ID NO: 1141465 - DNA, 22 bp, Artificial Sequence
  chemically synthesized
atgggatgcatttaatattgca

SEQ ID NO: 1141466 - DNA, 22 bp, Artificial Sequence
  chemically synthesized
atacagtgaacaaaactgcaat

SEQ ID NO: 1141467 - DNA, 22 bp, Artificial Sequence
  chemically synthesized
tgactcatacagtgaacaaaac

SEQ ID NO: 1141468 - DNA, 22 bp, Artificial Sequence
  chemically synthesized
gtgactcatacagtgaacaaaa

SEQ ID NO: 1141469 - DNA, 22 bp, Artificial Sequence
  chemically synthesized
tgtgactcatacagtgaacaaa

SEQ ID NO: 1141470 - DNA, 22 bp, Artificial Sequence
  chemically synthesized
aatattgcagttttgttcactg

SEQ ID NO: 1141471 - DNA, 22 bp, Artificial Sequence
  chemically synthesized
ttgtgactcatacagtgaacaa

SEQ ID NO: 1141472 - DNA, 22 bp, Artificial Sequence
  chemically synthesized
atattgcagttttgttcactgt

SEQ ID NO: 1141473 - DNA, 22 bp, Artificial Sequence
  chemically synthesized
tttgtgactcatacagtgaaca

SEQ ID NO: 1141474 - DNA, 22 bp, Artificial Sequence
  chemically synthesized
gttttttgtgactcatacagtg

SEQ ID NO: 1141475 - DNA, 22 bp, Artificial Sequence
  chemically synthesized
cagttttgttcactgtatgagt

SEQ ID NO: 1141476 - DNA, 22 bp, Artificial Sequence
  chemically synthesized
ttagttttttgtgactcataca

SEQ ID NO: 1141477 - DNA, 22 bp, Artificial Sequence
  chemically synthesized
tattagttttttgtgactcata

SEQ ID NO: 1141478 - DNA, 22 bp, Artificial Sequence
  chemically synthesized
tgttcactgtatgagtcacaaa

SEQ ID NO: 1141479 - DNA, 22 bp, Artificial Sequence
  chemically synthesized
ctctattagttttttgtgactc

SEQ ID NO: 1141480 - DNA, 22 bp, Artificial Sequence
  chemically synthesized
gttcactgtatgagtcacaaaa

SEQ ID NO: 1141481 - DNA, 22 bp, Artificial Sequence
  chemically synthesized
ttcactgtatgagtcacaaaaa

SEQ ID NO: 1141482 - DNA, 22 bp, Artificial Sequence
  chemically synthesized
actgtatgagtcacaaaaaact

SEQ ID NO: 1141483 - DNA, 22 bp, Artificial Sequence
  chemically synthesized
tatgagtcacaaaaaactaata

SEQ ID NO: 1141484 - DNA, 22 bp, Artificial Sequence
  chemically synthesized
tggataaaggagaactactcta

SEQ ID NO: 1141485 - DNA, 22 bp, Artificial Sequence
  chemically synthesized
atagagtagttctcctttatcc

SEQ ID NO: 1141486 - DNA, 22 bp, Artificial Sequence
  chemically synthesized
aagcatatcccctatggataaa

SEQ ID NO: 1141487 - DNA, 22 bp, Artificial Sequence
  chemically synthesized
gaagcatatcccctatggataa

SEQ ID NO: 1141488 - DNA, 22 bp, Artificial Sequence
  chemically synthesized
tgaagcatatcccctatggata

SEQ ID NO: 1141489 - DNA, 22 bp, Artificial Sequence
  chemically synthesized
tcctttatccataggggatatg

SEQ ID NO: 1141490 - DNA, 22 bp, Artificial Sequence
  chemically synthesized
aggattttgaagcatatcccct

SEQ ID NO: 1141491 - DNA, 22 bp, Artificial Sequence
  chemically synthesized
ctttatccataggggatatgct

SEQ ID NO: 1141492 - DNA, 22 bp, Artificial Sequence
  chemically synthesized
tatccataggggatatgcttca

SEQ ID NO: 1141493 - DNA, 22 bp, Artificial Sequence
  chemically synthesized
atccataggggatatgcttcaa

SEQ ID NO: 1141494 - DNA, 22 bp, Artificial Sequence
  chemically synthesized
tccataggggatatgcttcaaa

SEQ ID NO: 1141495 - DNA, 22 bp, Artificial Sequence
  chemically synthesized
ggcatccacctgaggattttga

SEQ ID NO: 1141496 - DNA, 22 bp, Artificial Sequence
  chemically synthesized
aggcatccacctgaggattttg

SEQ ID NO: 1141497 - DNA, 22 bp, Artificial Sequence
  chemically synthesized
taggcatccacctgaggatttt

SEQ ID NO: 1141498 - DNA, 22 bp, Artificial Sequence
  chemically synthesized
cagttttaggcatccacctgag

SEQ ID NO: 1141499 - DNA, 22 bp, Artificial Sequence
  chemically synthesized
cctgcagttttaggcatccacc

SEQ ID NO: 1141500 - DNA, 22 bp, Artificial Sequence
  chemically synthesized
caaaatcctcaggtggatgcct

SEQ ID NO: 1141501 - DNA, 22 bp, Artificial Sequence
  chemically synthesized
aaaatcctcaggtggatgccta

SEQ ID NO: 1141502 - DNA, 22 bp, Artificial Sequence
  chemically synthesized
tactacctgcagttttaggcat

SEQ ID NO: 1141503 - DNA, 22 bp, Artificial Sequence
  chemically synthesized
gtactacctgcagttttaggca

SEQ ID NO: 1141504 - DNA, 22 bp, Artificial Sequence
  chemically synthesized
tgtactacctgcagttttaggc

SEQ ID NO: 1141505 - DNA, 22 bp, Artificial Sequence
  chemically synthesized
aggtggatgcctaaaactgcag

SEQ ID NO: 1141506 - DNA, 22 bp, Artificial Sequence
  chemically synthesized
tatatagggttttgtactacct

SEQ ID NO: 1141507 - DNA, 22 bp, Artificial Sequence
  chemically synthesized
aaactgcaggtagtacaaaacc

SEQ ID NO: 1141508 - DNA, 22 bp, Artificial Sequence
  chemically synthesized
ataaatactatatatagggttt

SEQ ID NO: 1141509 - DNA, 22 bp, Artificial Sequence
  chemically synthesized
caggtagtacaaaaccctatat

SEQ ID NO: 1141510 - DNA, 22 bp, Artificial Sequence
  chemically synthesized
tatatagtatttatgaatttat

SEQ ID NO: 1141511 - DNA, 22 bp, Artificial Sequence
  chemically synthesized
cgaagaaagaaaaataaattca

SEQ ID NO: 1141512 - DNA, 22 bp, Artificial Sequence
  chemically synthesized
atgaatttatttttctttcttc

SEQ ID NO: 1141513 - DNA, 22 bp, Artificial Sequence
  chemically synthesized
tgaatttatttttctttcttcg

SEQ ID NO: 1141514 - DNA, 22 bp, Artificial Sequence
  chemically synthesized
tccgtgaaattgcgaagaaaga

SEQ ID NO: 1141515 - DNA, 22 bp, Artificial Sequence
  chemically synthesized
atttttctttcttcgcaatttc

SEQ ID NO: 1141516 - DNA, 22 bp, Artificial Sequence
  chemically synthesized
tttttctttcttcgcaatttca

SEQ ID NO: 1141517 - DNA, 22 bp, Artificial Sequence
  chemically synthesized
ttctttcttcgcaatttcacgg

SEQ ID NO: 1141518 - DNA, 22 bp, Artificial Sequence
  chemically synthesized
tctttcttcgcaatttcacgga

SEQ ID NO: 1141519 - DNA, 22 bp, Artificial Sequence
  chemically synthesized
ctttcttcgcaatttcacggat

SEQ ID NO: 1141520 - DNA, 22 bp, Artificial Sequence
  chemically synthesized
tttcttcgcaatttcacggata

SEQ ID NO: 1141521 - DNA, 22 bp, Artificial Sequence
  chemically synthesized
tcttcgcaatttcacggataga

SEQ ID NO: 1141522 - DNA, 22 bp, Artificial Sequence
  chemically synthesized
cttcgcaatttcacggatagac

SEQ ID NO: 1141523 - DNA, 22 bp, Artificial Sequence
  chemically synthesized
tggtaagagcaagtctatccgt

SEQ ID NO: 1141524 - DNA, 22 bp, Artificial Sequence
  chemically synthesized
ttcgcaatttcacggatagact

SEQ ID NO: 1141525 - DNA, 22 bp, Artificial Sequence
  chemically synthesized
cgcaatttcacggatagacttg

SEQ ID NO: 1141526 - DNA, 22 bp, Artificial Sequence
  chemically synthesized
gcaatttcacggatagacttgc

SEQ ID NO: 1141527 - DNA, 22 bp, Artificial Sequence
  chemically synthesized
aaaatctgtggtaagagcaagt

SEQ ID NO: 1141528 - DNA, 22 bp, Artificial Sequence
  chemically synthesized
cacggatagacttgctcttacc

SEQ ID NO: 1141529 - DNA, 22 bp, Artificial Sequence
  chemically synthesized
ctcaaaatctgtggtaagagca

SEQ ID NO: 1141530 - DNA, 22 bp, Artificial Sequence
  chemically synthesized
acggatagacttgctcttacca

SEQ ID NO: 1141531 - DNA, 22 bp, Artificial Sequence
  chemically synthesized
gggttgctcaaaatctgtggta

SEQ ID NO: 1141532 - DNA, 22 bp, Artificial Sequence
  chemically synthesized
gctcttaccacagattttgagc

SEQ ID NO: 1141533 - DNA, 22 bp, Artificial Sequence
  chemically synthesized
ctcttaccacagattttgagca

SEQ ID NO: 1141534 - DNA, 22 bp, Artificial Sequence
  chemically synthesized
ttaccacagattttgagcaacc

SEQ ID NO: 1141535 - DNA, 22 bp, Artificial Sequence
  chemically synthesized
accacagattttgagcaacccc

SEQ ID NO: 1141536 - DNA, 22 bp, Artificial Sequence
  chemically synthesized
ccacagattttgagcaacccca

SEQ ID NO: 1141537 - DNA, 22 bp, Artificial Sequence
  chemically synthesized
tgagcaaccccagcatgcgatt

SEQ ID NO: 1141538 - DNA, 22 bp, Artificial Sequence
  chemically synthesized
gagcaaccccagcatgcgattt

SEQ ID NO: 1141539 - DNA, 22 bp, Artificial Sequence
  chemically synthesized
agcaaccccagcatgcgatttt

SEQ ID NO: 1141540 - DNA, 22 bp, Artificial Sequence
  chemically synthesized
ataaggcaagaaaaaaatcgca

SEQ ID NO: 1141541 - DNA, 22 bp, Artificial Sequence
  chemically synthesized
aataaggcaagaaaaaaatcgc

SEQ ID NO: 1141542 - DNA, 22 bp, Artificial Sequence
  chemically synthesized
ccaacttaataaggcaagaaaa

SEQ ID NO: 1141543 - DNA, 22 bp, Artificial Sequence
  chemically synthesized
ttttcttgccttattaagttgg

SEQ ID NO: 1141544 - DNA, 22 bp, Artificial Sequence
  chemically synthesized
tttcttgccttattaagttggg

SEQ ID NO: 1141545 - DNA, 22 bp, Artificial Sequence
  chemically synthesized
tgtgaaaaggttcccaacttaa

SEQ ID NO: 1141546 - DNA, 22 bp, Artificial Sequence
  chemically synthesized
ttcttgccttattaagttggga

SEQ ID NO: 1141547 - DNA, 22 bp, Artificial Sequence
  chemically synthesized
atgtgaaaaggttcccaactta

SEQ ID NO: 1141548 - DNA, 22 bp, Artificial Sequence
  chemically synthesized
tcttgccttattaagttgggaa

SEQ ID NO: 1141549 - DNA, 22 bp, Artificial Sequence
  chemically synthesized
tatgtgaaaaggttcccaactt

SEQ ID NO: 1141550 - DNA, 22 bp, Artificial Sequence
  chemically synthesized
cttgccttattaagttgggaac

SEQ ID NO: 1141551 - DNA, 22 bp, Artificial Sequence
  chemically synthesized
ttgccttattaagttgggaacc

SEQ ID NO: 1141552 - DNA, 22 bp, Artificial Sequence
  chemically synthesized
tttatgtgaaaaggttcccaac

SEQ ID NO: 1141553 - DNA, 22 bp, Artificial Sequence
  chemically synthesized
ctttatgtgaaaaggttcccaa

SEQ ID NO: 1141554 - DNA, 22 bp, Artificial Sequence
  chemically synthesized
gccttattaagttgggaacctt

SEQ ID NO: 1141555 - DNA, 22 bp, Artificial Sequence
  chemically synthesized
tctttatgtgaaaaggttccca

SEQ ID NO: 1141556 - DNA, 22 bp, Artificial Sequence
  chemically synthesized
ccttattaagttgggaaccttt

SEQ ID NO: 1141557 - DNA, 22 bp, Artificial Sequence
  chemically synthesized
attaagttgggaaccttttcac

SEQ ID NO: 1141558 - DNA, 22 bp, Artificial Sequence
  chemically synthesized
ttaagttgggaaccttttcaca

SEQ ID NO: 1141559 - DNA, 22 bp, Artificial Sequence
  chemically synthesized
agttgggaaccttttcacataa

SEQ ID NO: 1141560 - DNA, 22 bp, Artificial Sequence
  chemically synthesized
tgaagggttttctttatgtgaa

SEQ ID NO: 1141561 - DNA, 22 bp, Artificial Sequence
  chemically synthesized
ggaaccttttcacataaagaaa

SEQ ID NO: 1141562 - DNA, 22 bp, Artificial Sequence
  chemically synthesized
ttcacataaagaaaacccttca

SEQ ID NO: 1141563 - DNA, 22 bp, Artificial Sequence
  chemically synthesized
tcacataaagaaaacccttcac

SEQ ID NO: 1141564 - DNA, 22 bp, Artificial Sequence
  chemically synthesized
cacataaagaaaacccttcaca

SEQ ID NO: 1141565 - DNA, 22 bp, Artificial Sequence
  chemically synthesized
acataaagaaaacccttcacag

SEQ ID NO: 1141566 - DNA, 22 bp, Artificial Sequence
  chemically synthesized
aaatatgccaaagaaaaactgt

SEQ ID NO: 1141567 - DNA, 22 bp, Artificial Sequence
  chemically synthesized
cacagtttttctttggcatatt

SEQ ID NO: 1141568 - DNA, 22 bp, Artificial Sequence
  chemically synthesized
acagtttttctttggcatattt

SEQ ID NO: 1141569 - DNA, 22 bp, Artificial Sequence
  chemically synthesized
tggtggcagttcaaatatgcca

SEQ ID NO: 1141570 - DNA, 22 bp, Artificial Sequence
  chemically synthesized
ttctttggcatatttgaactgc

SEQ ID NO: 1141571 - DNA, 22 bp, Artificial Sequence
  chemically synthesized
tctttggcatatttgaactgcc

SEQ ID NO: 1141572 - DNA, 22 bp, Artificial Sequence
  chemically synthesized
ctttggcatatttgaactgcca

SEQ ID NO: 1141573 - DNA, 22 bp, Artificial Sequence
  chemically synthesized
tttggcatatttgaactgccac

SEQ ID NO: 1141574 - DNA, 22 bp, Artificial Sequence
  chemically synthesized
tggcatatttgaactgccacca

SEQ ID NO: 1141575 - DNA, 22 bp, Artificial Sequence
  chemically synthesized
ggcatatttgaactgccaccat

SEQ ID NO: 1141576 - DNA, 22 bp, Artificial Sequence
  chemically synthesized
gcatatttgaactgccaccata

SEQ ID NO: 1141577 - DNA, 22 bp, Artificial Sequence
  chemically synthesized
gaactgccaccataactactct

SEQ ID NO: 1141578 - DNA, 22 bp, Artificial Sequence
  chemically synthesized
aactgccaccataactactctt

SEQ ID NO: 1141579 - DNA, 22 bp, Artificial Sequence
  chemically synthesized
ccaccataactactcttgcact

SEQ ID NO: 1141580 - DNA, 22 bp, Artificial Sequence
  chemically synthesized
gtcatggccccaaagtgcaaga

SEQ ID NO: 1141581 - DNA, 22 bp, Artificial Sequence
  chemically synthesized
agtcatggccccaaagtgcaag

SEQ ID NO: 1141582 - DNA, 22 bp, Artificial Sequence
  chemically synthesized
cttagtcatggccccaaagtgc

SEQ ID NO: 1141583 - DNA, 22 bp, Artificial Sequence
  chemically synthesized
acttagtcatggccccaaagtg

SEQ ID NO: 1141584 - DNA, 22 bp, Artificial Sequence
  chemically synthesized
tacttagtcatggccccaaagt

SEQ ID NO: 1141585 - DNA, 22 bp, Artificial Sequence
  chemically synthesized
gttttacttagtcatggcccca

SEQ ID NO: 1141586 - DNA, 22 bp, Artificial Sequence
  chemically synthesized
ctcttgcactttggggccatga

SEQ ID NO: 1141587 - DNA, 22 bp, Artificial Sequence
  chemically synthesized
ttgcactttggggccatgacta

SEQ ID NO: 1141588 - DNA, 22 bp, Artificial Sequence
  chemically synthesized
gcactttggggccatgactaag

SEQ ID NO: 1141589 - DNA, 22 bp, Artificial Sequence
  chemically synthesized
cactttggggccatgactaagt

SEQ ID NO: 1141590 - DNA, 22 bp, Artificial Sequence
  chemically synthesized
aagtcaccctagttttacttag

SEQ ID NO: 1141591 - DNA, 22 bp, Artificial Sequence
  chemically synthesized
tggggccatgactaagtaaaac

SEQ ID NO: 1141592 - DNA, 22 bp, Artificial Sequence
  chemically synthesized
ggggccatgactaagtaaaact

SEQ ID NO: 1141593 - DNA, 22 bp, Artificial Sequence
  chemically synthesized
gggccatgactaagtaaaacta

SEQ ID NO: 1141594 - DNA, 22 bp, Artificial Sequence
  chemically synthesized
tgttcaagtcaccctagtttta

SEQ ID NO: 1141595 - DNA, 22 bp, Artificial Sequence
  chemically synthesized
gtgttcaagtcaccctagtttt

SEQ ID NO: 1141596 - DNA, 22 bp, Artificial Sequence
  chemically synthesized
agtaaaactagggtgacttgaa

SEQ ID NO: 1141597 - DNA, 22 bp, Artificial Sequence
  chemically synthesized
gggtgacttgaacacaagcact

SEQ ID NO: 1141598 - DNA, 22 bp, Artificial Sequence
  chemically synthesized
tcatggtatcgcagtgcttgtg

SEQ ID NO: 1141599 - DNA, 22 bp, Artificial Sequence
  chemically synthesized
gaacacaagcactgcgatacca

SEQ ID NO: 1141600 - DNA, 22 bp, Artificial Sequence
  chemically synthesized
gaaacactgtcatggtatcgca

SEQ ID NO: 1141601 - DNA, 22 bp, Artificial Sequence
  chemically synthesized
aacacaagcactgcgataccat

SEQ ID NO: 1141602 - DNA, 22 bp, Artificial Sequence
  chemically synthesized
agaaacactgtcatggtatcgc

SEQ ID NO: 1141603 - DNA, 22 bp, Artificial Sequence
  chemically synthesized
ttagaaacactgtcatggtatc

SEQ ID NO: 1141604 - DNA, 22 bp, Artificial Sequence
  chemically synthesized
ggttcttagaaacactgtcatg

SEQ ID NO: 1141605 - DNA, 22 bp, Artificial Sequence
  chemically synthesized
tctaggttcttagaaacactgt

SEQ ID NO: 1141606 - DNA, 22 bp, Artificial Sequence
  chemically synthesized
cgataccatgacagtgtttcta

SEQ ID NO: 1141607 - DNA, 22 bp, Artificial Sequence
  chemically synthesized
agtacctgtctaggttcttaga

SEQ ID NO: 1141608 - DNA, 22 bp, Artificial Sequence
  chemically synthesized
ctcagtacctgtctaggttctt

SEQ ID NO: 1141609 - DNA, 22 bp, Artificial Sequence
  chemically synthesized
ctaagaacctagacaggtactg

SEQ ID NO: 1141610 - DNA, 22 bp, Artificial Sequence
  chemically synthesized
taagaacctagacaggtactga

SEQ ID NO: 1141611 - DNA, 22 bp, Artificial Sequence
  chemically synthesized
cccgcccattactcagtacctg

SEQ ID NO: 1141612 - DNA, 22 bp, Artificial Sequence
  chemically synthesized
agaacctagacaggtactgagt

SEQ ID NO: 1141613 - DNA, 22 bp, Artificial Sequence
  chemically synthesized
tcaatgttacccgcccattact

SEQ ID NO: 1141614 - DNA, 22 bp, Artificial Sequence
  chemically synthesized
gacaggtactgagtaatgggcg

SEQ ID NO: 1141615 - DNA, 22 bp, Artificial Sequence
  chemically synthesized
atgctgtcaatgttacccgccc

SEQ ID NO: 1141616 - DNA, 22 bp, Artificial Sequence
  chemically synthesized
catgctgtcaatgttacccgcc

SEQ ID NO: 1141617 - DNA, 22 bp, Artificial Sequence
  chemically synthesized
agtaatgggcgggtaacattga

SEQ ID NO: 1141618 - DNA, 22 bp, Artificial Sequence
  chemically synthesized
tccagcgtcttcatgctgtcaa

SEQ ID NO: 1141619 - DNA, 22 bp, Artificial Sequence
  chemically synthesized
gtccagcgtcttcatgctgtca

SEQ ID NO: 1141620 - DNA, 22 bp, Artificial Sequence
  chemically synthesized
tgtccagcgtcttcatgctgtc

SEQ ID NO: 1141621 - DNA, 22 bp, Artificial Sequence
  chemically synthesized
aatcacccctttgtccagcgtc

SEQ ID NO: 1141622 - DNA, 22 bp, Artificial Sequence
  chemically synthesized
acagcatgaagacgctggacaa

SEQ ID NO: 1141623 - DNA, 22 bp, Artificial Sequence
  chemically synthesized
acccaggactgaatcacccctt

SEQ ID NO: 1141624 - DNA, 22 bp, Artificial Sequence
  chemically synthesized
tctcacccaggactgaatcacc

SEQ ID NO: 1141625 - DNA, 22 bp, Artificial Sequence
  chemically synthesized
tgtctcacccaggactgaatca

SEQ ID NO: 1141626 - DNA, 22 bp, Artificial Sequence
  chemically synthesized
gacaaaggggtgattcagtcct

SEQ ID NO: 1141627 - DNA, 22 bp, Artificial Sequence
  chemically synthesized
tcccacctctgtctcacccagg

SEQ ID NO: 1141628 - DNA, 22 bp, Artificial Sequence
  chemically synthesized
tgctatcccacctctgtctcac

SEQ ID NO: 1141629 - DNA, 22 bp, Artificial Sequence
  chemically synthesized
gtgctatcccacctctgtctca

SEQ ID NO: 1141630 - DNA, 22 bp, Artificial Sequence
  chemically synthesized
agtcctgggtgagacagaggtg

SEQ ID NO: 1141631 - DNA, 22 bp, Artificial Sequence
  chemically synthesized
ggtgagacagaggtgggatagc

SEQ ID NO: 1141632 - DNA, 22 bp, Artificial Sequence
  chemically synthesized
agtagcataatgaaatcttgtg

SEQ ID NO: 1141633 - DNA, 22 bp, Artificial Sequence
  chemically synthesized
gagtagcataatgaaatcttgt

SEQ ID NO: 1141634 - DNA, 22 bp, Artificial Sequence
  chemically synthesized
tgagtagcataatgaaatcttg

SEQ ID NO: 1141635 - DNA, 22 bp, Artificial Sequence
  chemically synthesized
ttttgagtagcataatgaaatc

SEQ ID NO: 1141636 - DNA, 22 bp, Artificial Sequence
  chemically synthesized
catgctgttttgagtagcataa

SEQ ID NO: 1141637 - DNA, 22 bp, Artificial Sequence
  chemically synthesized
aattgcatgctgttttgagtag

SEQ ID NO: 1141638 - DNA, 22 bp, Artificial Sequence
  chemically synthesized
aaattgcatgctgttttgagta

SEQ ID NO: 1141639 - DNA, 22 bp, Artificial Sequence
  chemically synthesized
taaattgcatgctgttttgagt

SEQ ID NO: 1141640 - DNA, 22 bp, Artificial Sequence
  chemically synthesized
cattatgctactcaaaacagca

SEQ ID NO: 1141641 - DNA, 22 bp, Artificial Sequence
  chemically synthesized
attatgctactcaaaacagcat

SEQ ID NO: 1141642 - DNA, 22 bp, Artificial Sequence
  chemically synthesized
tgctactcaaaacagcatgcaa

SEQ ID NO: 1141643 - DNA, 22 bp, Artificial Sequence
  chemically synthesized
ataaattttaaattgcatgctg

SEQ ID NO: 1141644 - DNA, 22 bp, Artificial Sequence
  chemically synthesized
ctcaaaacagcatgcaatttaa

SEQ ID NO: 1141645 - DNA, 22 bp, Artificial Sequence
  chemically synthesized
aaaacagcatgcaatttaaaat

SEQ ID NO: 1141646 - DNA, 22 bp, Artificial Sequence
  chemically synthesized
cagaaataaacaattcataaat

SEQ ID NO: 1141647 - DNA, 22 bp, Artificial Sequence
  chemically synthesized
aaaatttatgaattgtttattt

SEQ ID NO: 1141648 - DNA, 22 bp, Artificial Sequence
  chemically synthesized
aaatttatgaattgtttatttc

SEQ ID NO: 1141649 - DNA, 22 bp, Artificial Sequence
  chemically synthesized
aatgaaaaattccagaaataaa

SEQ ID NO: 1141650 - DNA, 22 bp, Artificial Sequence
  chemically synthesized
atgaattgtttatttctggaat

SEQ ID NO: 1141651 - DNA, 22 bp, Artificial Sequence
  chemically synthesized
tgaattgtttatttctggaatt

SEQ ID NO: 1141652 - DNA, 22 bp, Artificial Sequence
  chemically synthesized
tttatttctggaatttttcatt

SEQ ID NO: 1141653 - DNA, 22 bp, Artificial Sequence
  chemically synthesized
atttctggaatttttcatttaa

SEQ ID NO: 1141654 - DNA, 22 bp, Artificial Sequence
  chemically synthesized
tttctggaatttttcatttaat

SEQ ID NO: 1141655 - DNA, 22 bp, Artificial Sequence
  chemically synthesized
ctggaatttttcatttaatatt

SEQ ID NO: 1141656 - DNA, 22 bp, Artificial Sequence
  chemically synthesized
tggaatttttcatttaatattt

SEQ ID NO: 1141657 - DNA, 22 bp, Artificial Sequence
  chemically synthesized
gaatttttcatttaatattttc

SEQ ID NO: 1141658 - DNA, 22 bp, Artificial Sequence
  chemically synthesized
gcagtcaaccacagtcagaaaa

SEQ ID NO: 1141659 - DNA, 22 bp, Artificial Sequence
  chemically synthesized
ttcatttaatattttctgactg

SEQ ID NO: 1141660 - DNA, 22 bp, Artificial Sequence
  chemically synthesized
tcatttaatattttctgactgt

SEQ ID NO: 1141661 - DNA, 22 bp, Artificial Sequence
  chemically synthesized
catttaatattttctgactgtg

SEQ ID NO: 1141662 - DNA, 22 bp, Artificial Sequence
  chemically synthesized
ctggcagtcaaccacagtcaga

SEQ ID NO: 1141663 - DNA, 22 bp, Artificial Sequence
  chemically synthesized
atttaatattttctgactgtgg

SEQ ID NO: 1141664 - DNA, 22 bp, Artificial Sequence
  chemically synthesized
aatattttctgactgtggttga

SEQ ID NO: 1141665 - DNA, 22 bp, Artificial Sequence
  chemically synthesized
aattactggcagtcaaccacag

SEQ ID NO: 1141666 - DNA, 22 bp, Artificial Sequence
  chemically synthesized
atattttctgactgtggttgac

SEQ ID NO: 1141667 - DNA, 22 bp, Artificial Sequence
  chemically synthesized
caattactggcagtcaaccaca

SEQ ID NO: 1141668 - DNA, 22 bp, Artificial Sequence
  chemically synthesized
gcttcaattactggcagtcaac

SEQ ID NO: 1141669 - DNA, 22 bp, Artificial Sequence
  chemically synthesized
ggcttcaattactggcagtcaa

SEQ ID NO: 1141670 - DNA, 22 bp, Artificial Sequence
  chemically synthesized
tctgactgtggttgactgccag

SEQ ID NO: 1141671 - DNA, 22 bp, Artificial Sequence
  chemically synthesized
ctgactgtggttgactgccagt

SEQ ID NO: 1141672 - DNA, 22 bp, Artificial Sequence
  chemically synthesized
tgactgtggttgactgccagta

SEQ ID NO: 1141673 - DNA, 22 bp, Artificial Sequence
  chemically synthesized
cttggcttcaattactggcagt

SEQ ID NO: 1141674 - DNA, 22 bp, Artificial Sequence
  chemically synthesized
actgtggttgactgccagtaat

SEQ ID NO: 1141675 - DNA, 22 bp, Artificial Sequence
  chemically synthesized
tccttggcttcaattactggca

SEQ ID NO: 1141676 - DNA, 22 bp, Artificial Sequence
  chemically synthesized
ctctccttggcttcaattactg

SEQ ID NO: 1141677 - DNA, 22 bp, Artificial Sequence
  chemically synthesized
tggttgactgccagtaattgaa

SEQ ID NO: 1141678 - DNA, 22 bp, Artificial Sequence
  chemically synthesized
gctctccttggcttcaattact

SEQ ID NO: 1141679 - DNA, 22 bp, Artificial Sequence
  chemically synthesized
tgctctccttggcttcaattac

SEQ ID NO: 1141680 - DNA, 22 bp, Artificial Sequence
  chemically synthesized
actgccagtaattgaagccaag

SEQ ID NO: 1141681 - DNA, 22 bp, Artificial Sequence
  chemically synthesized
ccagtaattgaagccaaggaga

SEQ ID NO: 1141682 - DNA, 22 bp, Artificial Sequence
  chemically synthesized
atccatggttttgctctccttg

SEQ ID NO: 1141683 - DNA, 22 bp, Artificial Sequence
  chemically synthesized
cctcatccatggttttgctctc

SEQ ID NO: 1141684 - DNA, 22 bp, Artificial Sequence
  chemically synthesized
aagccaaggagagcaaaaccat

SEQ ID NO: 1141685 - DNA, 22 bp, Artificial Sequence
  chemically synthesized
cctccctcatccatggttttgc

SEQ ID NO: 1141686 - DNA, 22 bp, Artificial Sequence
  chemically synthesized
cctccctccctcatccatggtt

SEQ ID NO: 1141687 - DNA, 22 bp, Artificial Sequence
  chemically synthesized
cctccctccctccctcatccat

SEQ ID NO: 1141688 - DNA, 22 bp, Artificial Sequence
  chemically synthesized
cctccctccctccctccctcat

SEQ ID NO: 1141689 - DNA, 22 bp, Artificial Sequence
  chemically synthesized
cctccctccctccctccctccc

SEQ ID NO: 1141690 - DNA, 22 bp, Artificial Sequence
  chemically synthesized
cagcaatccctccctccctccc

SEQ ID NO: 1141691 - DNA, 22 bp, Artificial Sequence
  chemically synthesized
attacagcaatccctccctccc

SEQ ID NO: 1141692 - DNA, 22 bp, Artificial Sequence
  chemically synthesized
aattacagcaatccctccctcc

SEQ ID NO: 1141693 - DNA, 22 bp, Artificial Sequence
  chemically synthesized
aaagagtgtttaattacagcaa

SEQ ID NO: 1141694 - DNA, 22 bp, Artificial Sequence
  chemically synthesized
tgtacctaaaagagtgtttaat

SEQ ID NO: 1141695 - DNA, 22 bp, Artificial Sequence
  chemically synthesized
cctatgtacctaaaagagtgtt

SEQ ID NO: 1141696 - DNA, 22 bp, Artificial Sequence
  chemically synthesized
ctgtaattaaacactcttttag

SEQ ID NO: 1141697 - DNA, 22 bp, Artificial Sequence
  chemically synthesized
taattaaacactcttttaggta

SEQ ID NO: 1141698 - DNA, 22 bp, Artificial Sequence
  chemically synthesized
aataggttgcctatgtacctaa

SEQ ID NO: 1141699 - DNA, 22 bp, Artificial Sequence
  chemically synthesized
aacactcttttaggtacatagg

SEQ ID NO: 1141700 - DNA, 22 bp, Artificial Sequence
  chemically synthesized
tgttaaataggttgcctatgta

SEQ ID NO: 1141701 - DNA, 22 bp, Artificial Sequence
  chemically synthesized
ttttaggtacataggcaaccta

SEQ ID NO: 1141702 - DNA, 22 bp, Artificial Sequence
  chemically synthesized
ttaggtacataggcaacctatt

SEQ ID NO: 1141703 - DNA, 22 bp, Artificial Sequence
  chemically synthesized
taggtacataggcaacctattt

SEQ ID NO: 1141704 - DNA, 22 bp, Artificial Sequence
  chemically synthesized
aatagttatgttaaataggttg

SEQ ID NO: 1141705 - DNA, 22 bp, Artificial Sequence
  chemically synthesized
aggtacataggcaacctattta

SEQ ID NO: 1141706 - DNA, 22 bp, Artificial Sequence
  chemically synthesized
aaatagttatgttaaataggtt

SEQ ID NO: 1141707 - DNA, 22 bp, Artificial Sequence
  chemically synthesized
ggtacataggcaacctatttaa

SEQ ID NO: 1141708 - DNA, 22 bp, Artificial Sequence
  chemically synthesized
taaatagttatgttaaataggt

SEQ ID NO: 1141709 - DNA, 22 bp, Artificial Sequence
  chemically synthesized
ttaaatagttatgttaaatagg

SEQ ID NO: 1141710 - DNA, 22 bp, Artificial Sequence
  chemically synthesized
tttaaatagttatgttaaatag

SEQ ID NO: 1141711 - DNA, 22 bp, Artificial Sequence
  chemically synthesized
agtggcattttttaaatagtta

SEQ ID NO: 1141712 - DNA, 22 bp, Artificial Sequence
  chemically synthesized
aagtggcattttttaaatagtt

SEQ ID NO: 1141713 - DNA, 22 bp, Artificial Sequence
  chemically synthesized
taagtggcattttttaaatagt

SEQ ID NO: 1141714 - DNA, 22 bp, Artificial Sequence
  chemically synthesized
tttaacataactatttaaaaaa

SEQ ID NO: 1141715 - DNA, 22 bp, Artificial Sequence
  chemically synthesized
aacataactatttaaaaaatgc

SEQ ID NO: 1141716 - DNA, 22 bp, Artificial Sequence
  chemically synthesized
acataactatttaaaaaatgcc

SEQ ID NO: 1141717 - DNA, 22 bp, Artificial Sequence
  chemically synthesized
tttaaaaaatgccacttaaagt

SEQ ID NO: 1141718 - DNA, 22 bp, Artificial Sequence
  chemically synthesized
gatataaagaacactttaagtg

SEQ ID NO: 1141719 - DNA, 22 bp, Artificial Sequence
  chemically synthesized
ggatataaagaacactttaagt

SEQ ID NO: 1141720 - DNA, 22 bp, Artificial Sequence
  chemically synthesized
aaaaaatgccacttaaagtgtt

SEQ ID NO: 1141721 - DNA, 22 bp, Artificial Sequence
  chemically synthesized
aaaaatgccacttaaagtgttc

SEQ ID NO: 1141722 - DNA, 22 bp, Artificial Sequence
  chemically synthesized
tttggatataaagaacacttta

SEQ ID NO: 1141723 - DNA, 22 bp, Artificial Sequence
  chemically synthesized
cattatttggatataaagaaca

SEQ ID NO: 1141724 - DNA, 22 bp, Artificial Sequence
  chemically synthesized
ctccattatttggatataaaga

SEQ ID NO: 1141725 - DNA, 22 bp, Artificial Sequence
  chemically synthesized
gctccattatttggatataaag

SEQ ID NO: 1141726 - DNA, 22 bp, Artificial Sequence
  chemically synthesized
aaagtgttctttatatccaaat

SEQ ID NO: 1141727 - DNA, 22 bp, Artificial Sequence
  chemically synthesized
aagtgttctttatatccaaata

SEQ ID NO: 1141728 - DNA, 22 bp, Artificial Sequence
  chemically synthesized
aatcataaacttgctccattat

SEQ ID NO: 1141729 - DNA, 22 bp, Artificial Sequence
  chemically synthesized
tttatatccaaataatggagca

SEQ ID NO: 1141730 - DNA, 22 bp, Artificial Sequence
  chemically synthesized
tatatccaaataatggagcaag

SEQ ID NO: 1141731 - DNA, 22 bp, Artificial Sequence
  chemically synthesized
atatccaaataatggagcaagt

SEQ ID NO: 1141732 - DNA, 22 bp, Artificial Sequence
  chemically synthesized
gctgaatcataaacttgctcca

SEQ ID NO: 1141733 - DNA, 22 bp, Artificial Sequence
  chemically synthesized
tatccaaataatggagcaagtt

SEQ ID NO: 1141734 - DNA, 22 bp, Artificial Sequence
  chemically synthesized
gatattagctgaatcataaact

SEQ ID NO: 1141735 - DNA, 22 bp, Artificial Sequence
  chemically synthesized
taacctagatattagctgaatc

SEQ ID NO: 1141736 - DNA, 22 bp, Artificial Sequence
  chemically synthesized
actgtaacctagatattagctg

SEQ ID NO: 1141737 - DNA, 22 bp, Artificial Sequence
  chemically synthesized
atgattcagctaatatctaggt

SEQ ID NO: 1141738 - DNA, 22 bp, Artificial Sequence
  chemically synthesized
tcattaactgtaacctagatat

SEQ ID NO: 1141739 - DNA, 22 bp, Artificial Sequence
  chemically synthesized
tgattcagctaatatctaggtt

SEQ ID NO: 1141740 - DNA, 22 bp, Artificial Sequence
  chemically synthesized
agctaatatctaggttacagtt

SEQ ID NO: 1141741 - DNA, 22 bp, Artificial Sequence
  chemically synthesized
atggctgtcattaactgtaacc

SEQ ID NO: 1141742 - DNA, 22 bp, Artificial Sequence
  chemically synthesized
atatctaggttacagttaatga

SEQ ID NO: 1141743 - DNA, 22 bp, Artificial Sequence
  chemically synthesized
ggttacagttaatgacagccat

SEQ ID NO: 1141744 - DNA, 22 bp, Artificial Sequence
  chemically synthesized
cagttaatgacagccatcaatg

SEQ ID NO: 1141745 - DNA, 22 bp, Artificial Sequence
  chemically synthesized
atgacagccatcaatgcattca

SEQ ID NO: 1141746 - DNA, 22 bp, Artificial Sequence
  chemically synthesized
atgatcaatgaatgaatgcatt

SEQ ID NO: 1141747 - DNA, 22 bp, Artificial Sequence
  chemically synthesized
tataataaattcatgatcaatg

SEQ ID NO: 1141748 - DNA, 22 bp, Artificial Sequence
  chemically synthesized
ttatataataaattcatgatca

SEQ ID NO: 1141749 - DNA, 22 bp, Artificial Sequence
  chemically synthesized
gttatataataaattcatgatc

SEQ ID NO: 1141750 - DNA, 22 bp, Artificial Sequence
  chemically synthesized
attcattgatcatgaatttatt

SEQ ID NO: 1141751 - DNA, 22 bp, Artificial Sequence
  chemically synthesized
attgatcatgaatttattatat

SEQ ID NO: 1141752 - DNA, 22 bp, Artificial Sequence
  chemically synthesized
gtacatatttgttatataataa

SEQ ID NO: 1141753 - DNA, 22 bp, Artificial Sequence
  chemically synthesized
ggtacatatttgttatataata

SEQ ID NO: 1141754 - DNA, 22 bp, Artificial Sequence
  chemically synthesized
atcatgaatttattatataaca

SEQ ID NO: 1141755 - DNA, 22 bp, Artificial Sequence
  chemically synthesized
attatataacaaatatgtacca

SEQ ID NO: 1141756 - DNA, 22 bp, Artificial Sequence
  chemically synthesized
ttatataacaaatatgtaccaa

SEQ ID NO: 1141757 - DNA, 22 bp, Artificial Sequence
  chemically synthesized
gcatatccagatatttggtaca

SEQ ID NO: 1141758 - DNA, 22 bp, Artificial Sequence
  chemically synthesized
tataacaaatatgtaccaaata

SEQ ID NO: 1141759 - DNA, 22 bp, Artificial Sequence
  chemically synthesized
ggcatatccagatatttggtac

SEQ ID NO: 1141760 - DNA, 22 bp, Artificial Sequence
  chemically synthesized
atatttggcatatccagatatt

SEQ ID NO: 1141761 - DNA, 22 bp, Artificial Sequence
  chemically synthesized
aatatttggcatatccagatat

SEQ ID NO: 1141762 - DNA, 22 bp, Artificial Sequence
  chemically synthesized
ttaatatttggcatatccagat

SEQ ID NO: 1141763 - DNA, 22 bp, Artificial Sequence
  chemically synthesized
tcttaatatttggcatatccag

SEQ ID NO: 1141764 - DNA, 22 bp, Artificial Sequence
  chemically synthesized
ctcttaatatttggcatatcca

SEQ ID NO: 1141765 - DNA, 22 bp, Artificial Sequence
  chemically synthesized
taacatcttctcttaatatttg

SEQ ID NO: 1141766 - DNA, 22 bp, Artificial Sequence
  chemically synthesized
gatatgccaaatattaagagaa

SEQ ID NO: 1141767 - DNA, 22 bp, Artificial Sequence
  chemically synthesized
agcctgtaacatcttctcttaa

SEQ ID NO: 1141768 - DNA, 22 bp, Artificial Sequence
  chemically synthesized
atgggacacaattgagcctgta

SEQ ID NO: 1141769 - DNA, 22 bp, Artificial Sequence
  chemically synthesized
agagaagatgttacaggctcaa

SEQ ID NO: 1141770 - DNA, 22 bp, Artificial Sequence
  chemically synthesized
catgggacacaattgagcctgt

SEQ ID NO: 1141771 - DNA, 22 bp, Artificial Sequence
  chemically synthesized
aacatggatttcatgggacaca

SEQ ID NO: 1141772 - DNA, 22 bp, Artificial Sequence
  chemically synthesized
caacatggatttcatgggacac

SEQ ID NO: 1141773 - DNA, 22 bp, Artificial Sequence
  chemically synthesized
caggctcaattgtgtcccatga

SEQ ID NO: 1141774 - DNA, 22 bp, Artificial Sequence
  chemically synthesized
aattgtgtcccatgaaatccat

SEQ ID NO: 1141775 - DNA, 22 bp, Artificial Sequence
  chemically synthesized
tgtcccatgaaatccatgttga

SEQ ID NO: 1141776 - DNA, 22 bp, Artificial Sequence
  chemically synthesized
cgatgtagtaggtggggcatag

SEQ ID NO: 1141777 - DNA, 22 bp, Artificial Sequence
  chemically synthesized
aagccctatgccccacctacta

SEQ ID NO: 1141778 - DNA, 22 bp, Artificial Sequence
  chemically synthesized
tgccccacctactacatcggaa

SEQ ID NO: 1141779 - DNA, 22 bp, Artificial Sequence
  chemically synthesized
caaatatgggcacattccgatg

SEQ ID NO: 1141780 - DNA, 22 bp, Artificial Sequence
  chemically synthesized
tctccaaatatgggcacattcc

SEQ ID NO: 1141781 - DNA, 22 bp, Artificial Sequence
  chemically synthesized
tatctccaaatatgggcacatt

SEQ ID NO: 1141782 - DNA, 22 bp, Artificial Sequence
  chemically synthesized
ctacatcggaatgtgcccatat

SEQ ID NO: 1141783 - DNA, 22 bp, Artificial Sequence
  chemically synthesized
catcggaatgtgcccatatttg

SEQ ID NO: 1141784 - DNA, 22 bp, Artificial Sequence
  chemically synthesized
taggctctatctccaaatatgg

SEQ ID NO: 1141785 - DNA, 22 bp, Artificial Sequence
  chemically synthesized
ataggctctatctccaaatatg

SEQ ID NO: 1141786 - DNA, 22 bp, Artificial Sequence
  chemically synthesized
tttataggctctatctccaaat

SEQ ID NO: 1141787 - DNA, 22 bp, Artificial Sequence
  chemically synthesized
atggtctatttataggctctat

SEQ ID NO: 1141788 - DNA, 22 bp, Artificial Sequence
  chemically synthesized
aatggtctatttataggctcta

SEQ ID NO: 1141789 - DNA, 22 bp, Artificial Sequence
  chemically synthesized
taacttaatggtctatttatag

SEQ ID NO: 1141790 - DNA, 22 bp, Artificial Sequence
  chemically synthesized
ggagatagagcctataaataga

SEQ ID NO: 1141791 - DNA, 22 bp, Artificial Sequence
  chemically synthesized
gagatagagcctataaatagac

SEQ ID NO: 1141792 - DNA, 22 bp, Artificial Sequence
  chemically synthesized
attgtaacttaatggtctattt

SEQ ID NO: 1141793 - DNA, 22 bp, Artificial Sequence
  chemically synthesized
atagactcattgtaacttaatg

SEQ ID NO: 1141794 - DNA, 22 bp, Artificial Sequence
  chemically synthesized
taaatagaccattaagttacaa

SEQ ID NO: 1141795 - DNA, 22 bp, Artificial Sequence
  chemically synthesized
gagtaaccctaatagactcatt

SEQ ID NO: 1141796 - DNA, 22 bp, Artificial Sequence
  chemically synthesized
gactagagtaaccctaatagac

SEQ ID NO: 1141797 - DNA, 22 bp, Artificial Sequence
  chemically synthesized
agttacaatgagtctattaggg

SEQ ID NO: 1141798 - DNA, 22 bp, Artificial Sequence
  chemically synthesized
caatgagtctattagggttact

SEQ ID NO: 1141799 - DNA, 22 bp, Artificial Sequence
  chemically synthesized
ttagggttactctagtccaata

SEQ ID NO: 1141800 - DNA, 22 bp, Artificial Sequence
  chemically synthesized
gggttactctagtccaatatga

SEQ ID NO: 1141801 - DNA, 22 bp, Artificial Sequence
  chemically synthesized
ataaggatacccatcatattgg

SEQ ID NO: 1141802 - DNA, 22 bp, Artificial Sequence
  chemically synthesized
tcataaggatacccatcatatt

SEQ ID NO: 1141803 - DNA, 22 bp, Artificial Sequence
  chemically synthesized
ctcataaggatacccatcatat

SEQ ID NO: 1141804 - DNA, 22 bp, Artificial Sequence
  chemically synthesized
ctctagtccaatatgatgggta

SEQ ID NO: 1141805 - DNA, 22 bp, Artificial Sequence
  chemically synthesized
ttctcataaggatacccatcat

SEQ ID NO: 1141806 - DNA, 22 bp, Artificial Sequence
  chemically synthesized
tagtccaatatgatgggtatcc

SEQ ID NO: 1141807 - DNA, 22 bp, Artificial Sequence
  chemically synthesized
ctcttctcataaggatacccat

SEQ ID NO: 1141808 - DNA, 22 bp, Artificial Sequence
  chemically synthesized
cctcttctcataaggataccca

SEQ ID NO: 1141809 - DNA, 22 bp, Artificial Sequence
  chemically synthesized
gtccaatatgatgggtatcctt

SEQ ID NO: 1141810 - DNA, 22 bp, Artificial Sequence
  chemically synthesized
tgtccaaatttcctcttctcat

SEQ ID NO: 1141811 - DNA, 22 bp, Artificial Sequence
  chemically synthesized
ctgtgtccaaatttcctcttct

SEQ ID NO: 1141812 - DNA, 22 bp, Artificial Sequence
  chemically synthesized
gctgtgtccaaatttcctcttc

SEQ ID NO: 1141813 - DNA, 22 bp, Artificial Sequence
  chemically synthesized
tgctgtgtccaaatttcctctt

SEQ ID NO: 1141814 - DNA, 22 bp, Artificial Sequence
  chemically synthesized
gtgttttgctgtgtccaaattt

SEQ ID NO: 1141815 - DNA, 22 bp, Artificial Sequence
  chemically synthesized
atgagaagaggaaatttggaca

SEQ ID NO: 1141816 - DNA, 22 bp, Artificial Sequence
  chemically synthesized
tgagaagaggaaatttggacac

SEQ ID NO: 1141817 - DNA, 22 bp, Artificial Sequence
  chemically synthesized
cacatatccctggtgttttgct

SEQ ID NO: 1141818 - DNA, 22 bp, Artificial Sequence
  chemically synthesized
tgttgcacatatccctggtgtt

SEQ ID NO: 1141819 - DNA, 22 bp, Artificial Sequence
  chemically synthesized
ggacacagcaaaacaccaggga

SEQ ID NO: 1141820 - DNA, 22 bp, Artificial Sequence
  chemically synthesized
gacacagcaaaacaccagggat

SEQ ID NO: 1141821 - DNA, 22 bp, Artificial Sequence
  chemically synthesized
tgtgttgcacatatccctggtg

SEQ ID NO: 1141822 - DNA, 22 bp, Artificial Sequence
  chemically synthesized
ctctgtgttgcacatatccctg

SEQ ID NO: 1141823 - DNA, 22 bp, Artificial Sequence
  chemically synthesized
tcctctgtgttgcacatatccc

SEQ ID NO: 1141824 - DNA, 22 bp, Artificial Sequence
  chemically synthesized
acgtggtctctcctctgtgttg

SEQ ID NO: 1141825 - DNA, 22 bp, Artificial Sequence
  chemically synthesized
tatcctcacgtggtctctcctc

SEQ ID NO: 1141826 - DNA, 22 bp, Artificial Sequence
  chemically synthesized
ctgtatcctcacgtggtctctc

SEQ ID NO: 1141827 - DNA, 22 bp, Artificial Sequence
  chemically synthesized
ttcctgtatcctcacgtggtct

SEQ ID NO: 1141828 - DNA, 22 bp, Artificial Sequence
  chemically synthesized
gttcctgtatcctcacgtggtc

SEQ ID NO: 1141829 - DNA, 22 bp, Artificial Sequence
  chemically synthesized
cagatgaatgccttgttcctgt

SEQ ID NO: 1141830 - DNA, 22 bp, Artificial Sequence
  chemically synthesized
gattgcagatgaatgccttgtt

SEQ ID NO: 1141831 - DNA, 22 bp, Artificial Sequence
  chemically synthesized
ggattgcagatgaatgccttgt

SEQ ID NO: 1141832 - DNA, 22 bp, Artificial Sequence
  chemically synthesized
cttggattgcagatgaatgcct

SEQ ID NO: 1141833 - DNA, 22 bp, Artificial Sequence
  chemically synthesized
tccttggattgcagatgaatgc

SEQ ID NO: 1141834 - DNA, 22 bp, Artificial Sequence
  chemically synthesized
tctccttggattgcagatgaat

SEQ ID NO: 1141835 - DNA, 22 bp, Artificial Sequence
  chemically synthesized
tgaggcctctctccttggattg

SEQ ID NO: 1141836 - DNA, 22 bp, Artificial Sequence
  chemically synthesized
gtgaggcctctctccttggatt

SEQ ID NO: 1141837 - DNA, 22 bp, Artificial Sequence
  chemically synthesized
ttgtgaggcctctctccttgga

SEQ ID NO: 1141838 - DNA, 22 bp, Artificial Sequence
  chemically synthesized
atctgcaatccaaggagagagg

SEQ ID NO: 1141839 - DNA, 22 bp, Artificial Sequence
  chemically synthesized
gtctcttgtgaggcctctctcc

SEQ ID NO: 1141840 - DNA, 22 bp, Artificial Sequence
  chemically synthesized
caatccaaggagagaggcctca

SEQ ID NO: 1141841 - DNA, 22 bp, Artificial Sequence
  chemically synthesized
gcaaggattggtctcttgtgag

SEQ ID NO: 1141842 - DNA, 22 bp, Artificial Sequence
  chemically synthesized
acaagagaccaatccttgccag

SEQ ID NO: 1141843 - DNA, 22 bp, Artificial Sequence
  chemically synthesized
aagaccaaggtactggcaagga

SEQ ID NO: 1141844 - DNA, 22 bp, Artificial Sequence
  chemically synthesized
ggggccagaagttcaagaccaa

SEQ ID NO: 1141845 - DNA, 22 bp, Artificial Sequence
  chemically synthesized
tgggggccagaagttcaagacc

SEQ ID NO: 1141846 - DNA, 22 bp, Artificial Sequence
  chemically synthesized
gccagtaccttggtcttgaact

SEQ ID NO: 1141847 - DNA, 22 bp, Artificial Sequence
  chemically synthesized
ccagtaccttggtcttgaactt

SEQ ID NO: 1141848 - DNA, 22 bp, Artificial Sequence
  chemically synthesized
accattctgggggccagaagtt

SEQ ID NO: 1141849 - DNA, 22 bp, Artificial Sequence
  chemically synthesized
tcaccattctgggggccagaag

SEQ ID NO: 1141850 - DNA, 22 bp, Artificial Sequence
  chemically synthesized
ctcaccattctgggggccagaa

SEQ ID NO: 1141851 - DNA, 22 bp, Artificial Sequence
  chemically synthesized
tctcaccattctgggggccaga

SEQ ID NO: 1141852 - DNA, 22 bp, Artificial Sequence
  chemically synthesized
ggtcttgaacttctggccccca

SEQ ID NO: 1141853 - DNA, 22 bp, Artificial Sequence
  chemically synthesized
gtcttgaacttctggcccccag

SEQ ID NO: 1141854 - DNA, 22 bp, Artificial Sequence
  chemically synthesized
gaacttctggcccccagaatgg

SEQ ID NO: 1141855 - DNA, 22 bp, Artificial Sequence
  chemically synthesized
aacttctggcccccagaatggt

SEQ ID NO: 1141856 - DNA, 22 bp, Artificial Sequence
  chemically synthesized
ctggcccccagaatggtgagaa

SEQ ID NO: 1141857 - DNA, 22 bp, Artificial Sequence
  chemically synthesized
tggcccccagaatggtgagaaa

SEQ ID NO: 1141858 - DNA, 22 bp, Artificial Sequence
  chemically synthesized
gcccccagaatggtgagaaagt

SEQ ID NO: 1141859 - DNA, 22 bp, Artificial Sequence
  chemically synthesized
aacaatacaaacactttctcac

SEQ ID NO: 1141860 - DNA, 22 bp, Artificial Sequence
  chemically synthesized
aaacaatacaaacactttctca

SEQ ID NO: 1141861 - DNA, 22 bp, Artificial Sequence
  chemically synthesized
gtggcttaaacaatacaaacac

SEQ ID NO: 1141862 - DNA, 22 bp, Artificial Sequence
  chemically synthesized
aaaaataacatggactggtggc

SEQ ID NO: 1141863 - DNA, 22 bp, Artificial Sequence
  chemically synthesized
gtattgtttaagccaccagtcc

SEQ ID NO: 1141864 - DNA, 22 bp, Artificial Sequence
  chemically synthesized
tattgtttaagccaccagtcca

SEQ ID NO: 1141865 - DNA, 22 bp, Artificial Sequence
  chemically synthesized
tcattaaaaaataacatggact

SEQ ID NO: 1141866 - DNA, 22 bp, Artificial Sequence
  chemically synthesized
tttaagccaccagtccatgtta

SEQ ID NO: 1141867 - DNA, 22 bp, Artificial Sequence
  chemically synthesized
aagccaccagtccatgttattt

SEQ ID NO: 1141868 - DNA, 22 bp, Artificial Sequence
  chemically synthesized
agccaccagtccatgttatttt

SEQ ID NO: 1141869 - DNA, 22 bp, Artificial Sequence
  chemically synthesized
tgagggctatcattaaaaaata

SEQ ID NO: 1141870 - DNA, 22 bp, Artificial Sequence
  chemically synthesized
gtgagggctatcattaaaaaat

SEQ ID NO: 1141871 - DNA, 22 bp, Artificial Sequence
  chemically synthesized
tgtgagggctatcattaaaaaa

SEQ ID NO: 1141872 - DNA, 22 bp, Artificial Sequence
  chemically synthesized
ctttgtgagggctatcattaaa

SEQ ID NO: 1141873 - DNA, 22 bp, Artificial Sequence
  chemically synthesized
ctcctttgtgagggctatcatt

SEQ ID NO: 1141874 - DNA, 22 bp, Artificial Sequence
  chemically synthesized
tattactcctttgtgagggcta

SEQ ID NO: 1141875 - DNA, 22 bp, Artificial Sequence
  chemically synthesized
ttttttaatgatagccctcaca

SEQ ID NO: 1141876 - DNA, 22 bp, Artificial Sequence
  chemically synthesized
gtattactcctttgtgagggct

SEQ ID NO: 1141877 - DNA, 22 bp, Artificial Sequence
  chemically synthesized
tgtattactcctttgtgagggc

SEQ ID NO: 1141878 - DNA, 22 bp, Artificial Sequence
  chemically synthesized
ttgtattactcctttgtgaggg

SEQ ID NO: 1141879 - DNA, 22 bp, Artificial Sequence
  chemically synthesized
tttaatgatagccctcacaaag

SEQ ID NO: 1141880 - DNA, 22 bp, Artificial Sequence
  chemically synthesized
ttaatgatagccctcacaaagg

SEQ ID NO: 1141881 - DNA, 22 bp, Artificial Sequence
  chemically synthesized
taatgatagccctcacaaagga

SEQ ID NO: 1141882 - DNA, 22 bp, Artificial Sequence
  chemically synthesized
aatgatagccctcacaaaggag

SEQ ID NO: 1141883 - DNA, 22 bp, Artificial Sequence
  chemically synthesized
tcttttgtattactcctttgtg

SEQ ID NO: 1141884 - DNA, 22 bp, Artificial Sequence
  chemically synthesized
atgatagccctcacaaaggagt

SEQ ID NO: 1141885 - DNA, 22 bp, Artificial Sequence
  chemically synthesized
attgtcttttgtattactcctt

SEQ ID NO: 1141886 - DNA, 22 bp, Artificial Sequence
  chemically synthesized
aattgtcttttgtattactcct

SEQ ID NO: 1141887 - DNA, 22 bp, Artificial Sequence
  chemically synthesized
tcttaattgtcttttgtattac

SEQ ID NO: 1141888 - DNA, 22 bp, Artificial Sequence
  chemically synthesized
acaaaggagtaatacaaaagac

SEQ ID NO: 1141889 - DNA, 22 bp, Artificial Sequence
  chemically synthesized
aaaaagaatccatctatcttaa

SEQ ID NO: 1141890 - DNA, 22 bp, Artificial Sequence
  chemically synthesized
gaaaaagaatccatctatctta

SEQ ID NO: 1141891 - DNA, 22 bp, Artificial Sequence
  chemically synthesized
ttgaaaaagaatccatctatct

SEQ ID NO: 1141892 - DNA, 22 bp, Artificial Sequence
  chemically synthesized
cttgaaaaagaatccatctatc

SEQ ID NO: 1141893 - DNA, 22 bp, Artificial Sequence
  chemically synthesized
agatagatggattctttttcaa

SEQ ID NO: 1141894 - DNA, 22 bp, Artificial Sequence
  chemically synthesized
gccaagtatttcttgaaaaaga

SEQ ID NO: 1141895 - DNA, 22 bp, Artificial Sequence
  chemically synthesized
agccaagtatttcttgaaaaag

SEQ ID NO: 1141896 - DNA, 22 bp, Artificial Sequence
  chemically synthesized
gacagacatttagccaagtatt

SEQ ID NO: 1141897 - DNA, 22 bp, Artificial Sequence
  chemically synthesized
tttttcaagaaatacttggcta

SEQ ID NO: 1141898 - DNA, 22 bp, Artificial Sequence
  chemically synthesized
ttcgacagacatttagccaagt

SEQ ID NO: 1141899 - DNA, 22 bp, Artificial Sequence
  chemically synthesized
tttcaagaaatacttggctaaa

SEQ ID NO: 1141900 - DNA, 22 bp, Artificial Sequence
  chemically synthesized
ttcaagaaatacttggctaaat

SEQ ID NO: 1141901 - DNA, 22 bp, Artificial Sequence
  chemically synthesized
tcaagaaatacttggctaaatg

SEQ ID NO: 1141902 - DNA, 22 bp, Artificial Sequence
  chemically synthesized
ttattcgacagacatttagcca

SEQ ID NO: 1141903 - DNA, 22 bp, Artificial Sequence
  chemically synthesized
caagaaatacttggctaaatgt

SEQ ID NO: 1141904 - DNA, 22 bp, Artificial Sequence
  chemically synthesized
aagaaatacttggctaaatgtc

SEQ ID NO: 1141905 - DNA, 22 bp, Artificial Sequence
  chemically synthesized
gtattattattcgacagacatt

SEQ ID NO: 1141906 - DNA, 22 bp, Artificial Sequence
  chemically synthesized
ggctaaatgtctgtcgaataat

SEQ ID NO: 1141907 - DNA, 22 bp, Artificial Sequence
  chemically synthesized
gctaaatgtctgtcgaataata

SEQ ID NO: 1141908 - DNA, 22 bp, Artificial Sequence
  chemically synthesized
acgggttggtattattattcga

SEQ ID NO: 1141909 - DNA, 22 bp, Artificial Sequence
  chemically synthesized
aacgggttggtattattattcg

SEQ ID NO: 1141910 - DNA, 22 bp, Artificial Sequence
  chemically synthesized
taacgggttggtattattattc

SEQ ID NO: 1141911 - DNA, 22 bp, Artificial Sequence
  chemically synthesized
aatgtctgtcgaataataatac

SEQ ID NO: 1141912 - DNA, 22 bp, Artificial Sequence
  chemically synthesized
tttaacgggttggtattattat

SEQ ID NO: 1141913 - DNA, 22 bp, Artificial Sequence
  chemically synthesized
caattctttaacgggttggtat

SEQ ID NO: 1141914 - DNA, 22 bp, Artificial Sequence
  chemically synthesized
gcaattctttaacgggttggta

SEQ ID NO: 1141915 - DNA, 22 bp, Artificial Sequence
  chemically synthesized
tcgaataataataccaacccgt

SEQ ID NO: 1141916 - DNA, 22 bp, Artificial Sequence
  chemically synthesized
acatttgcaattctttaacggg

SEQ ID NO: 1141917 - DNA, 22 bp, Artificial Sequence
  chemically synthesized
aacatttgcaattctttaacgg

SEQ ID NO: 1141918 - DNA, 22 bp, Artificial Sequence
  chemically synthesized
tttaacatttgcaattctttaa

SEQ ID NO: 1141919 - DNA, 22 bp, Artificial Sequence
  chemically synthesized
gtttaacatttgcaattcttta

SEQ ID NO: 1141920 - DNA, 22 bp, Artificial Sequence
  chemically synthesized
ttgtttaacatttgcaattctt

SEQ ID NO: 1141921 - DNA, 22 bp, Artificial Sequence
  chemically synthesized
aagaattgcaaatgttaaacaa

SEQ ID NO: 1141922 - DNA, 22 bp, Artificial Sequence
  chemically synthesized
ccatacatactcttgtttaaca

SEQ ID NO: 1141923 - DNA, 22 bp, Artificial Sequence
  chemically synthesized
cccatacatactcttgtttaac

SEQ ID NO: 1141924 - DNA, 22 bp, Artificial Sequence
  chemically synthesized
tcccatacatactcttgtttaa

SEQ ID NO: 1141925 - DNA, 22 bp, Artificial Sequence
  chemically synthesized
caaatgttaaacaagagtatgt

SEQ ID NO: 1141926 - DNA, 22 bp, Artificial Sequence
  chemically synthesized
ataatactttcccatacatact

SEQ ID NO: 1141927 - DNA, 22 bp, Artificial Sequence
  chemically synthesized
aacaagagtatgtatgggaaag

SEQ ID NO: 1141928 - DNA, 22 bp, Artificial Sequence
  chemically synthesized
aaattaataatactttcccata

SEQ ID NO: 1141929 - DNA, 22 bp, Artificial Sequence
  chemically synthesized
caaattaataatactttcccat

SEQ ID NO: 1141930 - DNA, 22 bp, Artificial Sequence
  chemically synthesized
tttcaaattaataatactttcc

SEQ ID NO: 1141931 - DNA, 22 bp, Artificial Sequence
  chemically synthesized
gtttcaaattaataatactttc

SEQ ID NO: 1141932 - DNA, 22 bp, Artificial Sequence
  chemically synthesized
aataacttgtttcaaattaata

SEQ ID NO: 1141933 - DNA, 22 bp, Artificial Sequence
  chemically synthesized
aaataacttgtttcaaattaat

SEQ ID NO: 1141934 - DNA, 22 bp, Artificial Sequence
  chemically synthesized
ttaaataacttgtttcaaatta

SEQ ID NO: 1141935 - DNA, 22 bp, Artificial Sequence
  chemically synthesized
ttaatttgaaacaagttattta

SEQ ID NO: 1141936 - DNA, 22 bp, Artificial Sequence
  chemically synthesized
atttgaaacaagttatttaaga

SEQ ID NO: 1141937 - DNA, 22 bp, Artificial Sequence
  chemically synthesized
taaacaacgaccaactcttaaa

SEQ ID NO: 1141938 - DNA, 22 bp, Artificial Sequence
  chemically synthesized
gaaacaagttatttaagagttg

SEQ ID NO: 1141939 - DNA, 22 bp, Artificial Sequence
  chemically synthesized
aaacaagttatttaagagttgg

SEQ ID NO: 1141940 - DNA, 22 bp, Artificial Sequence
  chemically synthesized
tttaagagttggtcgttgttta

SEQ ID NO: 1141941 - DNA, 22 bp, Artificial Sequence
  chemically synthesized
aagagttggtcgttgtttacaa

SEQ ID NO: 1141942 - DNA, 22 bp, Artificial Sequence
  chemically synthesized
agagttggtcgttgtttacaat

SEQ ID NO: 1141943 - DNA, 22 bp, Artificial Sequence
  chemically synthesized
gtcgttgtttacaatttgcttg

SEQ ID NO: 1141944 - DNA, 22 bp, Artificial Sequence
  chemically synthesized
atgtaagaaccatgatcaagca

SEQ ID NO: 1141945 - DNA, 22 bp, Artificial Sequence
  chemically synthesized
gatgtaagaaccatgatcaagc

SEQ ID NO: 1141946 - DNA, 22 bp, Artificial Sequence
  chemically synthesized
tttacaatttgcttgatcatgg

SEQ ID NO: 1141947 - DNA, 22 bp, Artificial Sequence
  chemically synthesized
acaatttgcttgatcatggttc

SEQ ID NO: 1141948 - DNA, 22 bp, Artificial Sequence
  chemically synthesized
gatttgatgtaagaaccatgat

SEQ ID NO: 1141949 - DNA, 22 bp, Artificial Sequence
  chemically synthesized
caatttgcttgatcatggttct

SEQ ID NO: 1141950 - DNA, 22 bp, Artificial Sequence
  chemically synthesized
agatttgatgtaagaaccatga

SEQ ID NO: 1141951 - DNA, 22 bp, Artificial Sequence
  chemically synthesized
ttagatttgatgtaagaaccat

SEQ ID NO: 1141952 - DNA, 22 bp, Artificial Sequence
  chemically synthesized
gcttgatcatggttcttacatc

SEQ ID NO: 1141953 - DNA, 22 bp, Artificial Sequence
  chemically synthesized
cttgatcatggttcttacatca

SEQ ID NO: 1141954 - DNA, 22 bp, Artificial Sequence
  chemically synthesized
gcagttcttagatttgatgtaa

SEQ ID NO: 1141955 - DNA, 22 bp, Artificial Sequence
  chemically synthesized
gatcatggttcttacatcaaat

SEQ ID NO: 1141956 - DNA, 22 bp, Artificial Sequence
  chemically synthesized
ggcagttcttagatttgatgta

SEQ ID NO: 1141957 - DNA, 22 bp, Artificial Sequence
  chemically synthesized
atcatggttcttacatcaaatc

SEQ ID NO: 1141958 - DNA, 22 bp, Artificial Sequence
  chemically synthesized
ttacatcaaatctaagaactgc

SEQ ID NO: 1141959 - DNA, 22 bp, Artificial Sequence
  chemically synthesized
acatcaaatctaagaactgcca

SEQ ID NO: 1141960 - DNA, 22 bp, Artificial Sequence
  chemically synthesized
catcaaatctaagaactgccaa

SEQ ID NO: 1141961 - DNA, 22 bp, Artificial Sequence
  chemically synthesized
agaactgccaagggtcatctat

SEQ ID NO: 1141962 - DNA, 22 bp, Artificial Sequence
  chemically synthesized
cagtgaatacagtaaaatagat

SEQ ID NO: 1141963 - DNA, 22 bp, Artificial Sequence
  chemically synthesized
tacagtgaatacagtaaaatag

SEQ ID NO: 1141964 - DNA, 22 bp, Artificial Sequence
  chemically synthesized
ccaagggtcatctattttactg

SEQ ID NO: 1141965 - DNA, 22 bp, Artificial Sequence
  chemically synthesized
ctacagtgaatacagtaaaata

SEQ ID NO: 1141966 - DNA, 22 bp, Artificial Sequence
  chemically synthesized
tctacagtgaatacagtaaaat

SEQ ID NO: 1141967 - DNA, 22 bp, Artificial Sequence
  chemically synthesized
atgggtgcctttctacagtgaa

SEQ ID NO: 1141968 - DNA, 22 bp, Artificial Sequence
  chemically synthesized
aatgggtgcctttctacagtga

SEQ ID NO: 1141969 - DNA, 22 bp, Artificial Sequence
  chemically synthesized
ttttactgtattcactgtagaa

SEQ ID NO: 1141970 - DNA, 22 bp, Artificial Sequence
  chemically synthesized
tactgtattcactgtagaaagg

SEQ ID NO: 1141971 - DNA, 22 bp, Artificial Sequence
  chemically synthesized
actgtattcactgtagaaaggc

SEQ ID NO: 1141972 - DNA, 22 bp, Artificial Sequence
  chemically synthesized
ctgtattcactgtagaaaggca

SEQ ID NO: 1141973 - DNA, 22 bp, Artificial Sequence
  chemically synthesized
tattcactgtagaaaggcaccc

SEQ ID NO: 1141974 - DNA, 22 bp, Artificial Sequence
  chemically synthesized
gtaaagatttaatgggtgcctt

SEQ ID NO: 1141975 - DNA, 22 bp, Artificial Sequence
  chemically synthesized
ttcgtaaagatttaatgggtgc

SEQ ID NO: 1141976 - DNA, 22 bp, Artificial Sequence
  chemically synthesized
actgtagaaaggcacccattaa

SEQ ID NO: 1141977 - DNA, 22 bp, Artificial Sequence
  chemically synthesized
attcgtaaagatttaatgggtg

SEQ ID NO: 1141978 - DNA, 22 bp, Artificial Sequence
  chemically synthesized
tagaaaggcacccattaaatct

SEQ ID NO: 1141979 - DNA, 22 bp, Artificial Sequence
  chemically synthesized
aacatttattcgtaaagattta

SEQ ID NO: 1141980 - DNA, 22 bp, Artificial Sequence
  chemically synthesized
aagactaaacatttattcgtaa

SEQ ID NO: 1141981 - DNA, 22 bp, Artificial Sequence
  chemically synthesized
gaagactaaacatttattcgta

SEQ ID NO: 1141982 - DNA, 22 bp, Artificial Sequence
  chemically synthesized
aatctttacgaataaatgttta

SEQ ID NO: 1141983 - DNA, 22 bp, Artificial Sequence
  chemically synthesized
tacgaataaatgtttagtcttc

SEQ ID NO: 1141984 - DNA, 22 bp, Artificial Sequence
  chemically synthesized
aagaatatacttgaagactaaa

SEQ ID NO: 1141985 - DNA, 22 bp, Artificial Sequence
  chemically synthesized
acgaataaatgtttagtcttca

SEQ ID NO: 1141986 - DNA, 22 bp, Artificial Sequence
  chemically synthesized
aaagaatatacttgaagactaa

SEQ ID NO: 1141987 - DNA, 22 bp, Artificial Sequence
  chemically synthesized
cgaataaatgtttagtcttcaa

SEQ ID NO: 1141988 - DNA, 22 bp, Artificial Sequence
  chemically synthesized
taaagaatatacttgaagacta

SEQ ID NO: 1141989 - DNA, 22 bp, Artificial Sequence
  chemically synthesized
gaaacctttaaagaatatactt

SEQ ID NO: 1141990 - DNA, 22 bp, Artificial Sequence
  chemically synthesized
agtcttcaagtatattctttaa

SEQ ID NO: 1141991 - DNA, 22 bp, Artificial Sequence
  chemically synthesized
tgttggaaacctttaaagaata

SEQ ID NO: 1141992 - DNA, 22 bp, Artificial Sequence
  chemically synthesized
gtcttcaagtatattctttaaa

SEQ ID NO: 1141993 - DNA, 22 bp, Artificial Sequence
  chemically synthesized
gtgttggaaacctttaaagaat

SEQ ID NO: 1141994 - DNA, 22 bp, Artificial Sequence
  chemically synthesized
tcttgtgttggaaacctttaaa

SEQ ID NO: 1141995 - DNA, 22 bp, Artificial Sequence
  chemically synthesized
caagtatattctttaaaggttt

SEQ ID NO: 1141996 - DNA, 22 bp, Artificial Sequence
  chemically synthesized
aagtatattctttaaaggtttc

SEQ ID NO: 1141997 - DNA, 22 bp, Artificial Sequence
  chemically synthesized
atgctgtcttgtgttggaaacc

SEQ ID NO: 1141998 - DNA, 22 bp, Artificial Sequence
  chemically synthesized
tttaaaggtttccaacacaaga

SEQ ID NO: 1141999 - DNA, 22 bp, Artificial Sequence
  chemically synthesized
taaaggtttccaacacaagaca

SEQ ID NO: 1142000 - DNA, 22 bp, Artificial Sequence
  chemically synthesized
aaaggtttccaacacaagacag

SEQ ID NO: 1142001 - DNA, 22 bp, Artificial Sequence
  chemically synthesized
aaggtttccaacacaagacagc

SEQ ID NO: 1142002 - DNA, 22 bp, Artificial Sequence
  chemically synthesized
aaggatatgtgttcatgctgtc

SEQ ID NO: 1142003 - DNA, 22 bp, Artificial Sequence
  chemically synthesized
ccaacacaagacagcatgaaca

SEQ ID NO: 1142004 - DNA, 22 bp, Artificial Sequence
  chemically synthesized
ctaaaggatatgtgttcatgct

SEQ ID NO: 1142005 - DNA, 22 bp, Artificial Sequence
  chemically synthesized
caacacaagacagcatgaacac

SEQ ID NO: 1142006 - DNA, 22 bp, Artificial Sequence
  chemically synthesized
agcaatagaatatgttactaaa

SEQ ID NO: 1142007 - DNA, 22 bp, Artificial Sequence
  chemically synthesized
aagcaatagaatatgttactaa

SEQ ID NO: 1142008 - DNA, 22 bp, Artificial Sequence
  chemically synthesized
tagtaacatattctattgctta

SEQ ID NO: 1142009 - DNA, 22 bp, Artificial Sequence
  chemically synthesized
agtaacatattctattgcttaa

SEQ ID NO: 1142010 - DNA, 22 bp, Artificial Sequence
  chemically synthesized
gtaacatattctattgcttaaa

SEQ ID NO: 1142011 - DNA, 22 bp, Artificial Sequence
  chemically synthesized
agagtaagataggtttaagcaa

SEQ ID NO: 1142012 - DNA, 22 bp, Artificial Sequence
  chemically synthesized
taagagtaagataggtttaagc

SEQ ID NO: 1142013 - DNA, 22 bp, Artificial Sequence
  chemically synthesized
ctaagagtaagataggtttaag

SEQ ID NO: 1142014 - DNA, 22 bp, Artificial Sequence
  chemically synthesized
tctaagagtaagataggtttaa

SEQ ID NO: 1142015 - DNA, 22 bp, Artificial Sequence
  chemically synthesized
tattgcttaaacctatcttact

SEQ ID NO: 1142016 - DNA, 22 bp, Artificial Sequence
  chemically synthesized
agtattttctaagagtaagata

SEQ ID NO: 1142017 - DNA, 22 bp, Artificial Sequence
  chemically synthesized
ttgcttaaacctatcttactct

SEQ ID NO: 1142018 - DNA, 22 bp, Artificial Sequence
  chemically synthesized
cttaaacctatcttactcttag

SEQ ID NO: 1142019 - DNA, 22 bp, Artificial Sequence
  chemically synthesized
attgagtattttctaagagtaa

SEQ ID NO: 1142020 - DNA, 22 bp, Artificial Sequence
  chemically synthesized
aaacctatcttactcttagaaa

SEQ ID NO: 1142021 - DNA, 22 bp, Artificial Sequence
  chemically synthesized
aacctatcttactcttagaaaa

SEQ ID NO: 1142022 - DNA, 22 bp, Artificial Sequence
  chemically synthesized
aattcattgagtattttctaag

SEQ ID NO: 1142023 - DNA, 22 bp, Artificial Sequence
  chemically synthesized
tcttactcttagaaaatactca

SEQ ID NO: 1142024 - DNA, 22 bp, Artificial Sequence
  chemically synthesized
gattcaattcattgagtatttt

SEQ ID NO: 1142025 - DNA, 22 bp, Artificial Sequence
  chemically synthesized
agattcaattcattgagtattt

SEQ ID NO: 1142026 - DNA, 22 bp, Artificial Sequence
  chemically synthesized
actcttagaaaatactcaatga

SEQ ID NO: 1142027 - DNA, 22 bp, Artificial Sequence
  chemically synthesized
ctcttagaaaatactcaatgaa

SEQ ID NO: 1142028 - DNA, 22 bp, Artificial Sequence
  chemically synthesized
ttagaaaatactcaatgaattg

SEQ ID NO: 1142029 - DNA, 22 bp, Artificial Sequence
  chemically synthesized
agaaaatactcaatgaattgaa

SEQ ID NO: 1142030 - DNA, 22 bp, Artificial Sequence
  chemically synthesized
gaaaatactcaatgaattgaat

SEQ ID NO: 1142031 - DNA, 22 bp, Artificial Sequence
  chemically synthesized
cagaagtgacttagattcaatt

SEQ ID NO: 1142032 - DNA, 22 bp, Artificial Sequence
  chemically synthesized
ctacagaagtgacttagattca

SEQ ID NO: 1142033 - DNA, 22 bp, Artificial Sequence
  chemically synthesized
gctacagaagtgacttagattc

SEQ ID NO: 1142034 - DNA, 22 bp, Artificial Sequence
  chemically synthesized
aatgaattgaatctaagtcact

SEQ ID NO: 1142035 - DNA, 22 bp, Artificial Sequence
  chemically synthesized
ccttgctacagaagtgacttag

SEQ ID NO: 1142036 - DNA, 22 bp, Artificial Sequence
  chemically synthesized
tgcctgccttgctacagaagtg

SEQ ID NO: 1142037 - DNA, 22 bp, Artificial Sequence
  chemically synthesized
aatctaagtcacttctgtagca

SEQ ID NO: 1142038 - DNA, 22 bp, Artificial Sequence
  chemically synthesized
agtcacttctgtagcaaggcag

SEQ ID NO: 1142039 - DNA, 22 bp, Artificial Sequence
  chemically synthesized
ctgtagcaaggcaggcatagtg

SEQ ID NO: 1142040 - DNA, 22 bp, Artificial Sequence
  chemically synthesized
tgtagcaaggcaggcatagtgc

SEQ ID NO: 1142041 - DNA, 22 bp, Artificial Sequence
  chemically synthesized
agatcagtggaaagcactatgc

SEQ ID NO: 1142042 - DNA, 22 bp, Artificial Sequence
  chemically synthesized
tagcaaggcaggcatagtgctt

SEQ ID NO: 1142043 - DNA, 22 bp, Artificial Sequence
  chemically synthesized
cactgagatcagtggaaagcac

SEQ ID NO: 1142044 - DNA, 22 bp, Artificial Sequence
  chemically synthesized
acactgagatcagtggaaagca

SEQ ID NO: 1142045 - DNA, 22 bp, Artificial Sequence
  chemically synthesized
cgcttacactgagatcagtgga

SEQ ID NO: 1142046 - DNA, 22 bp, Artificial Sequence
  chemically synthesized
ccgcttacactgagatcagtgg

SEQ ID NO: 1142047 - DNA, 22 bp, Artificial Sequence
  chemically synthesized
tccgcttacactgagatcagtg

SEQ ID NO: 1142048 - DNA, 22 bp, Artificial Sequence
  chemically synthesized
ttccgcttacactgagatcagt

SEQ ID NO: 1142049 - DNA, 22 bp, Artificial Sequence
  chemically synthesized
acttttccgcttacactgagat

SEQ ID NO: 1142050 - DNA, 22 bp, Artificial Sequence
  chemically synthesized
attcacttttccgcttacactg

SEQ ID NO: 1142051 - DNA, 22 bp, Artificial Sequence
  chemically synthesized
tccactgatctcagtgtaagcg

SEQ ID NO: 1142052 - DNA, 22 bp, Artificial Sequence
  chemically synthesized
ccactgatctcagtgtaagcgg

SEQ ID NO: 1142053 - DNA, 22 bp, Artificial Sequence
  chemically synthesized
taattcacttttccgcttacac

SEQ ID NO: 1142054 - DNA, 22 bp, Artificial Sequence
  chemically synthesized
cactgatctcagtgtaagcgga

SEQ ID NO: 1142055 - DNA, 22 bp, Artificial Sequence
  chemically synthesized
ctaattcacttttccgcttaca

SEQ ID NO: 1142056 - DNA, 22 bp, Artificial Sequence
  chemically synthesized
atctcagtgtaagcggaaaagt

SEQ ID NO: 1142057 - DNA, 22 bp, Artificial Sequence
  chemically synthesized
agtgtaagcggaaaagtgaatt

SEQ ID NO: 1142058 - DNA, 22 bp, Artificial Sequence
  chemically synthesized
cagcgtatgagcaagtaatttc

SEQ ID NO: 1142059 - DNA, 22 bp, Artificial Sequence
  chemically synthesized
acagcgtatgagcaagtaattt

SEQ ID NO: 1142060 - DNA, 22 bp, Artificial Sequence
  chemically synthesized
gaaattacttgctcatacgctg

SEQ ID NO: 1142061 - DNA, 22 bp, Artificial Sequence
  chemically synthesized
cttgctcatacgctgtaaacat

SEQ ID NO: 1142062 - DNA, 22 bp, Artificial Sequence
  chemically synthesized
gctcatacgctgtaaacatctg

SEQ ID NO: 1142063 - DNA, 22 bp, Artificial Sequence
  chemically synthesized
ctcatacgctgtaaacatctgc

SEQ ID NO: 1142064 - DNA, 22 bp, Artificial Sequence
  chemically synthesized
atacgctgtaaacatctgccca

SEQ ID NO: 1142065 - DNA, 22 bp, Artificial Sequence
  chemically synthesized
taaacatctgcccatacatttt

SEQ ID NO: 1142066 - DNA, 22 bp, Artificial Sequence
  chemically synthesized
tgcatatggcatcacaaaaatg

SEQ ID NO: 1142067 - DNA, 22 bp, Artificial Sequence
  chemically synthesized
gtgcatatggcatcacaaaaat

SEQ ID NO: 1142068 - DNA, 22 bp, Artificial Sequence
  chemically synthesized
cccatacatttttgtgatgcca

SEQ ID NO: 1142069 - DNA, 22 bp, Artificial Sequence
  chemically synthesized
tacttgtgcatatggcatcaca

SEQ ID NO: 1142070 - DNA, 22 bp, Artificial Sequence
  chemically synthesized
atacttgtgcatatggcatcac

SEQ ID NO: 1142071 - DNA, 22 bp, Artificial Sequence
  chemically synthesized
tttatacttgtgcatatggcat

SEQ ID NO: 1142072 - DNA, 22 bp, Artificial Sequence
  chemically synthesized
tctatttatacttgtgcatatg

SEQ ID NO: 1142073 - DNA, 22 bp, Artificial Sequence
  chemically synthesized
ttgtgatgccatatgcacaagt

SEQ ID NO: 1142074 - DNA, 22 bp, Artificial Sequence
  chemically synthesized
tgtgatgccatatgcacaagta

SEQ ID NO: 1142075 - DNA, 22 bp, Artificial Sequence
  chemically synthesized
gtgatgccatatgcacaagtat

SEQ ID NO: 1142076 - DNA, 22 bp, Artificial Sequence
  chemically synthesized
tgatgccatatgcacaagtata

SEQ ID NO: 1142077 - DNA, 22 bp, Artificial Sequence
  chemically synthesized
gtgtattatctatttatacttg

SEQ ID NO: 1142078 - DNA, 22 bp, Artificial Sequence
  chemically synthesized
cgtgtattatctatttatactt

SEQ ID NO: 1142079 - DNA, 22 bp, Artificial Sequence
  chemically synthesized
aagcacttcgtgtattatctat

SEQ ID NO: 1142080 - DNA, 22 bp, Artificial Sequence
  chemically synthesized
aaagcacttcgtgtattatcta

SEQ ID NO: 1142081 - DNA, 22 bp, Artificial Sequence
  chemically synthesized
agcaataaataggtaaatccat

SEQ ID NO: 1142082 - DNA, 22 bp, Artificial Sequence
  chemically synthesized
ctaagcaataaataggtaaatc

SEQ ID NO: 1142083 - DNA, 22 bp, Artificial Sequence
  chemically synthesized
taaatttatggatttacctatt

SEQ ID NO: 1142084 - DNA, 22 bp, Artificial Sequence
  chemically synthesized
aaatttatggatttacctattt

SEQ ID NO: 1142085 - DNA, 22 bp, Artificial Sequence
  chemically synthesized
aatttatggatttacctattta

SEQ ID NO: 1142086 - DNA, 22 bp, Artificial Sequence
  chemically synthesized
atggatttacctatttattgct

SEQ ID NO: 1142087 - DNA, 22 bp, Artificial Sequence
  chemically synthesized
tggatttacctatttattgctt

SEQ ID NO: 1142088 - DNA, 22 bp, Artificial Sequence
  chemically synthesized
aggccaatattgctaagcaata

SEQ ID NO: 1142089 - DNA, 22 bp, Artificial Sequence
  chemically synthesized
acctatttattgcttagcaata

SEQ ID NO: 1142090 - DNA, 22 bp, Artificial Sequence
  chemically synthesized
cctatttattgcttagcaatat

SEQ ID NO: 1142091 - DNA, 22 bp, Artificial Sequence
  chemically synthesized
aaattaaggccaatattgctaa

SEQ ID NO: 1142092 - DNA, 22 bp, Artificial Sequence
  chemically synthesized
tttattgcttagcaatattggc

SEQ ID NO: 1142093 - DNA, 22 bp, Artificial Sequence
  chemically synthesized
taattcaaattaaggccaatat

SEQ ID NO: 1142094 - DNA, 22 bp, Artificial Sequence
  chemically synthesized
attgcttagcaatattggcctt

SEQ ID NO: 1142095 - DNA, 22 bp, Artificial Sequence
  chemically synthesized
gtaattcaaattaaggccaata

SEQ ID NO: 1142096 - DNA, 22 bp, Artificial Sequence
  chemically synthesized
ttgcttagcaatattggcctta

SEQ ID NO: 1142097 - DNA, 22 bp, Artificial Sequence
  chemically synthesized
tgtaattcaaattaaggccaat

SEQ ID NO: 1142098 - DNA, 22 bp, Artificial Sequence
  chemically synthesized
tttgtaattcaaattaaggcca

SEQ ID NO: 1142099 - DNA, 22 bp, Artificial Sequence
  chemically synthesized
cttagcaatattggccttaatt

SEQ ID NO: 1142100 - DNA, 22 bp, Artificial Sequence
  chemically synthesized
agcaatattggccttaatttga

SEQ ID NO: 1142101 - DNA, 22 bp, Artificial Sequence
  chemically synthesized
attctttgtaattcaaattaag

SEQ ID NO: 1142102 - DNA, 22 bp, Artificial Sequence
  chemically synthesized
gcaatattggccttaatttgaa

SEQ ID NO: 1142103 - DNA, 22 bp, Artificial Sequence
  chemically synthesized
cattctttgtaattcaaattaa

SEQ ID NO: 1142104 - DNA, 22 bp, Artificial Sequence
  chemically synthesized
cttcattctttgtaattcaaat

SEQ ID NO: 1142105 - DNA, 22 bp, Artificial Sequence
  chemically synthesized
gcttcattctttgtaattcaaa

SEQ ID NO: 1142106 - DNA, 22 bp, Artificial Sequence
  chemically synthesized
tgcttcattctttgtaattcaa

SEQ ID NO: 1142107 - DNA, 22 bp, Artificial Sequence
  chemically synthesized
ctttgcttcattctttgtaatt

SEQ ID NO: 1142108 - DNA, 22 bp, Artificial Sequence
  chemically synthesized
gccttaatttgaattacaaaga

SEQ ID NO: 1142109 - DNA, 22 bp, Artificial Sequence
  chemically synthesized
aatttgaattacaaagaatgaa

SEQ ID NO: 1142110 - DNA, 22 bp, Artificial Sequence
  chemically synthesized
caattgctttgcttcattcttt

SEQ ID NO: 1142111 - DNA, 22 bp, Artificial Sequence
  chemically synthesized
atttgaattacaaagaatgaag

SEQ ID NO: 1142112 - DNA, 22 bp, Artificial Sequence
  chemically synthesized
ccaattgctttgcttcattctt

SEQ ID NO: 1142113 - DNA, 22 bp, Artificial Sequence
  chemically synthesized
gaattacaaagaatgaagcaaa

SEQ ID NO: 1142114 - DNA, 22 bp, Artificial Sequence
  chemically synthesized
aattacaaagaatgaagcaaag

SEQ ID NO: 1142115 - DNA, 22 bp, Artificial Sequence
  chemically synthesized
caaagaatgaagcaaagcaatt

SEQ ID NO: 1142116 - DNA, 22 bp, Artificial Sequence
  chemically synthesized
agggatatagtcttccaattgc

SEQ ID NO: 1142117 - DNA, 22 bp, Artificial Sequence
  chemically synthesized
cagagctgagggatatagtctt

SEQ ID NO: 1142118 - DNA, 22 bp, Artificial Sequence
  chemically synthesized
agtgattccagagctgagggat

SEQ ID NO: 1142119 - DNA, 22 bp, Artificial Sequence
  chemically synthesized
gagtgattccagagctgaggga

SEQ ID NO: 1142120 - DNA, 22 bp, Artificial Sequence
  chemically synthesized
tgagtgattccagagctgaggg

SEQ ID NO: 1142121 - DNA, 22 bp, Artificial Sequence
  chemically synthesized
gaagactatatccctcagctct

SEQ ID NO: 1142122 - DNA, 22 bp, Artificial Sequence
  chemically synthesized
tatccctcagctctggaatcac

SEQ ID NO: 1142123 - DNA, 22 bp, Artificial Sequence
  chemically synthesized
agctctggaatcactcaaagat

SEQ ID NO: 1142124 - DNA, 22 bp, Artificial Sequence
  chemically synthesized
tggaatcactcaaagatgctgg

SEQ ID NO: 1142125 - DNA, 22 bp, Artificial Sequence
  chemically synthesized
gaatcactcaaagatgctggtt

SEQ ID NO: 1142126 - DNA, 22 bp, Artificial Sequence
  chemically synthesized
aggcaatgataggaaccagcat

SEQ ID NO: 1142127 - DNA, 22 bp, Artificial Sequence
  chemically synthesized
aaagatgctggttcctatcatt

SEQ ID NO: 1142128 - DNA, 22 bp, Artificial Sequence
  chemically synthesized
tagccattcaggcaatgatagg

SEQ ID NO: 1142129 - DNA, 22 bp, Artificial Sequence
  chemically synthesized
ttatagccattcaggcaatgat

SEQ ID NO: 1142130 - DNA, 22 bp, Artificial Sequence
  chemically synthesized
gttatagccattcaggcaatga

SEQ ID NO: 1142131 - DNA, 22 bp, Artificial Sequence
  chemically synthesized
tgttatagccattcaggcaatg

SEQ ID NO: 1142132 - DNA, 22 bp, Artificial Sequence
  chemically synthesized
gttcctatcattgcctgaatgg

SEQ ID NO: 1142133 - DNA, 22 bp, Artificial Sequence
  chemically synthesized
acaattttgttatagccattca

SEQ ID NO: 1142134 - DNA, 22 bp, Artificial Sequence
  chemically synthesized
ctatcattgcctgaatggctat

SEQ ID NO: 1142135 - DNA, 22 bp, Artificial Sequence
  chemically synthesized
tcattgcctgaatggctataac

SEQ ID NO: 1142136 - DNA, 22 bp, Artificial Sequence
  chemically synthesized
tctaacaattttgttatagcca

SEQ ID NO: 1142137 - DNA, 22 bp, Artificial Sequence
  chemically synthesized
gtctaacaattttgttatagcc

SEQ ID NO: 1142138 - DNA, 22 bp, Artificial Sequence
  chemically synthesized
cctgaatggctataacaaaatt

SEQ ID NO: 1142139 - DNA, 22 bp, Artificial Sequence
  chemically synthesized
cacttgtctaacaattttgtta

SEQ ID NO: 1142140 - DNA, 22 bp, Artificial Sequence
  chemically synthesized
acacttgtctaacaattttgtt

SEQ ID NO: 1142141 - DNA, 22 bp, Artificial Sequence
  chemically synthesized
ttacacttgtctaacaattttg

SEQ ID NO: 1142142 - DNA, 22 bp, Artificial Sequence
  chemically synthesized
aatggctataacaaaattgtta

SEQ ID NO: 1142143 - DNA, 22 bp, Artificial Sequence
  chemically synthesized
cttacacttgtctaacaatttt

SEQ ID NO: 1142144 - DNA, 22 bp, Artificial Sequence
  chemically synthesized
taacaaaattgttagacaagtg

SEQ ID NO: 1142145 - DNA, 22 bp, Artificial Sequence
  chemically synthesized
tccaatttcttacacttgtcta

SEQ ID NO: 1142146 - DNA, 22 bp, Artificial Sequence
  chemically synthesized
atccaatttcttacacttgtct

SEQ ID NO: 1142147 - DNA, 22 bp, Artificial Sequence
  chemically synthesized
tatccaatttcttacacttgtc

SEQ ID NO: 1142148 - DNA, 22 bp, Artificial Sequence
  chemically synthesized
ttagacaagtgtaagaaattgg

SEQ ID NO: 1142149 - DNA, 22 bp, Artificial Sequence
  chemically synthesized
gccccattttatccaatttctt

SEQ ID NO: 1142150 - DNA, 22 bp, Artificial Sequence
  chemically synthesized
gacaagtgtaagaaattggata

SEQ ID NO: 1142151 - DNA, 22 bp, Artificial Sequence
  chemically synthesized
aaaaatatatgtattagcccca

SEQ ID NO: 1142152 - DNA, 22 bp, Artificial Sequence
  chemically synthesized
aaaaaatatatgtattagcccc

SEQ ID NO: 1142153 - DNA, 22 bp, Artificial Sequence
  chemically synthesized
taaaaaatatatgtattagccc

SEQ ID NO: 1142154 - DNA, 22 bp, Artificial Sequence
  chemically synthesized
tttaaaaaatatatgtattagc

SEQ ID NO: 1142155 - DNA, 22 bp, Artificial Sequence
  chemically synthesized
gataaaatggggctaatacata

SEQ ID NO: 1142156 - DNA, 22 bp, Artificial Sequence
  chemically synthesized
atacagtggttctttaaaaaat

SEQ ID NO: 1142157 - DNA, 22 bp, Artificial Sequence
  chemically synthesized
atacatatattttttaaagaac

SEQ ID NO: 1142158 - DNA, 22 bp, Artificial Sequence
  chemically synthesized
atcctaatacagtggttcttta

SEQ ID NO: 1142159 - DNA, 22 bp, Artificial Sequence
  chemically synthesized
taatcctaatacagtggttctt

SEQ ID NO: 1142160 - DNA, 22 bp, Artificial Sequence
  chemically synthesized
ctaatcctaatacagtggttct

SEQ ID NO: 1142161 - DNA, 22 bp, Artificial Sequence
  chemically synthesized
tttaaagaaccactgtattagg

SEQ ID NO: 1142162 - DNA, 22 bp, Artificial Sequence
  chemically synthesized
ttaaagaaccactgtattagga

SEQ ID NO: 1142163 - DNA, 22 bp, Artificial Sequence
  chemically synthesized
taaagaaccactgtattaggat

SEQ ID NO: 1142164 - DNA, 22 bp, Artificial Sequence
  chemically synthesized
aaagaaccactgtattaggatt

SEQ ID NO: 1142165 - DNA, 22 bp, Artificial Sequence
  chemically synthesized
aagaaccactgtattaggatta

SEQ ID NO: 1142166 - DNA, 22 bp, Artificial Sequence
  chemically synthesized
gagaagaggtttctaatcctaa

SEQ ID NO: 1142167 - DNA, 22 bp, Artificial Sequence
  chemically synthesized
tagagaagaggtttctaatcct

SEQ ID NO: 1142168 - DNA, 22 bp, Artificial Sequence
  chemically synthesized
tctagagaagaggtttctaatc

SEQ ID NO: 1142169 - DNA, 22 bp, Artificial Sequence
  chemically synthesized
ctctagagaagaggtttctaat

SEQ ID NO: 1142170 - DNA, 22 bp, Artificial Sequence
  chemically synthesized
tctctagagaagaggtttctaa

SEQ ID NO: 1142171 - DNA, 22 bp, Artificial Sequence
  chemically synthesized
ttctctagagaagaggtttcta

SEQ ID NO: 1142172 - DNA, 22 bp, Artificial Sequence
  chemically synthesized
tttctctagagaagaggtttct

SEQ ID NO: 1142173 - DNA, 22 bp, Artificial Sequence
  chemically synthesized
ttttctctagagaagaggtttc

SEQ ID NO: 1142174 - DNA, 22 bp, Artificial Sequence
  chemically synthesized
tattaggattagaaacctcttc

SEQ ID NO: 1142175 - DNA, 22 bp, Artificial Sequence
  chemically synthesized
tttttctctagagaagaggttt

SEQ ID NO: 1142176 - DNA, 22 bp, Artificial Sequence
  chemically synthesized
ttttttctctagagaagaggtt

SEQ ID NO: 1142177 - DNA, 22 bp, Artificial Sequence
  chemically synthesized
tttttttctctagagaagaggt

SEQ ID NO: 1142178 - DNA, 22 bp, Artificial Sequence
  chemically synthesized
ggattagaaacctcttctctag

SEQ ID NO: 1142179 - DNA, 22 bp, Artificial Sequence
  chemically synthesized
catattttttttttctctagag

SEQ ID NO: 1142180 - DNA, 22 bp, Artificial Sequence
  chemically synthesized
gaaacctcttctctagagaaaa

SEQ ID NO: 1142181 - DNA, 22 bp, Artificial Sequence
  chemically synthesized
aagttacatattttttttttct

SEQ ID NO: 1142182 - DNA, 22 bp, Artificial Sequence
  chemically synthesized
ttctctagagaaaaaaaaaata

SEQ ID NO: 1142183 - DNA, 22 bp, Artificial Sequence
  chemically synthesized
ctctagagaaaaaaaaaatatg

SEQ ID NO: 1142184 - DNA, 22 bp, Artificial Sequence
  chemically synthesized
tctagagaaaaaaaaaatatgt

SEQ ID NO: 1142185 - DNA, 22 bp, Artificial Sequence
  chemically synthesized
tagagaaaaaaaaaatatgtaa

SEQ ID NO: 1142186 - DNA, 22 bp, Artificial Sequence
  chemically synthesized
gagaaaaaaaaaatatgtaact

SEQ ID NO: 1142187 - DNA, 22 bp, Artificial Sequence
  chemically synthesized
agagaaacagagttgaagttac

SEQ ID NO: 1142188 - DNA, 22 bp, Artificial Sequence
  chemically synthesized
tacgtaaatagaaactcagaga

SEQ ID NO: 1142189 - DNA, 22 bp, Artificial Sequence
  chemically synthesized
caactctgtttctctgagtttc

SEQ ID NO: 1142190 - DNA, 22 bp, Artificial Sequence
  chemically synthesized
aactctgtttctctgagtttct

SEQ ID NO: 1142191 - DNA, 22 bp, Artificial Sequence
  chemically synthesized
ctatacgtaaatagaaactcag

SEQ ID NO: 1142192 - DNA, 22 bp, Artificial Sequence
  chemically synthesized
tgtttctctgagtttctattta

SEQ ID NO: 1142193 - DNA, 22 bp, Artificial Sequence
  chemically synthesized
tttctctgagtttctatttacg

SEQ ID NO: 1142194 - DNA, 22 bp, Artificial Sequence
  chemically synthesized
aagggattcctatacgtaaata

SEQ ID NO: 1142195 - DNA, 22 bp, Artificial Sequence
  chemically synthesized
ctctgagtttctatttacgtat

SEQ ID NO: 1142196 - DNA, 22 bp, Artificial Sequence
  chemically synthesized
tctgagtttctatttacgtata

SEQ ID NO: 1142197 - DNA, 22 bp, Artificial Sequence
  chemically synthesized
tgagtttctatttacgtatagg

SEQ ID NO: 1142198 - DNA, 22 bp, Artificial Sequence
  chemically synthesized
agtttctatttacgtataggaa

SEQ ID NO: 1142199 - DNA, 22 bp, Artificial Sequence
  chemically synthesized
aaagctcaagggattcctatac

SEQ ID NO: 1142200 - DNA, 22 bp, Artificial Sequence
  chemically synthesized
ctaaaagctcaagggattccta

SEQ ID NO: 1142201 - DNA, 22 bp, Artificial Sequence
  chemically synthesized
ctatttacgtataggaatccct

SEQ ID NO: 1142202 - DNA, 22 bp, Artificial Sequence
  chemically synthesized
tatttacgtataggaatccctt

SEQ ID NO: 1142203 - DNA, 22 bp, Artificial Sequence
  chemically synthesized
ttgctaaaagctcaagggattc

SEQ ID NO: 1142204 - DNA, 22 bp, Artificial Sequence
  chemically synthesized
tttacgtataggaatcccttga

SEQ ID NO: 1142205 - DNA, 22 bp, Artificial Sequence
  chemically synthesized
acgtataggaatcccttgagct

SEQ ID NO: 1142206 - DNA, 22 bp, Artificial Sequence
  chemically synthesized
cgtataggaatcccttgagctt

SEQ ID NO: 1142207 - DNA, 22 bp, Artificial Sequence
  chemically synthesized
taaaaatatgcattattgctaa

SEQ ID NO: 1142208 - DNA, 22 bp, Artificial Sequence
  chemically synthesized
tataaaaatatgcattattgct

SEQ ID NO: 1142209 - DNA, 22 bp, Artificial Sequence
  chemically synthesized
gagcttttagcaataatgcata

SEQ ID NO: 1142210 - DNA, 22 bp, Artificial Sequence
  chemically synthesized
gctctataaaaatatgcattat

SEQ ID NO: 1142211 - DNA, 22 bp, Artificial Sequence
  chemically synthesized
agcttttagcaataatgcatat

SEQ ID NO: 1142212 - DNA, 22 bp, Artificial Sequence
  chemically synthesized
agctctataaaaatatgcatta

SEQ ID NO: 1142213 - DNA, 22 bp, Artificial Sequence
  chemically synthesized
ttagcaataatgcatattttta

SEQ ID NO: 1142214 - DNA, 22 bp, Artificial Sequence
  chemically synthesized
tagcaataatgcatatttttat

SEQ ID NO: 1142215 - DNA, 22 bp, Artificial Sequence
  chemically synthesized
agcaataatgcatatttttata

SEQ ID NO: 1142216 - DNA, 22 bp, Artificial Sequence
  chemically synthesized
gcaataatgcatatttttatag

SEQ ID NO: 1142217 - DNA, 22 bp, Artificial Sequence
  chemically synthesized
tgtgtagaatgtttagctctat

SEQ ID NO: 1142218 - DNA, 22 bp, Artificial Sequence
  chemically synthesized
atgtgtagaatgtttagctcta

SEQ ID NO: 1142219 - DNA, 22 bp, Artificial Sequence
  chemically synthesized
catttatgtgtagaatgtttag

SEQ ID NO: 1142220 - DNA, 22 bp, Artificial Sequence
  chemically synthesized
acatttatgtgtagaatgttta

SEQ ID NO: 1142221 - DNA, 22 bp, Artificial Sequence
  chemically synthesized
tacatttatgtgtagaatgttt

SEQ ID NO: 1142222 - DNA, 22 bp, Artificial Sequence
  chemically synthesized
ttatagagctaaacattctaca

SEQ ID NO: 1142223 - DNA, 22 bp, Artificial Sequence
  chemically synthesized
tatagagctaaacattctacac

SEQ ID NO: 1142224 - DNA, 22 bp, Artificial Sequence
  chemically synthesized
atagagctaaacattctacaca

SEQ ID NO: 1142225 - DNA, 22 bp, Artificial Sequence
  chemically synthesized
gttttacatttatgtgtagaat

SEQ ID NO: 1142226 - DNA, 22 bp, Artificial Sequence
  chemically synthesized
tagagctaaacattctacacat

SEQ ID NO: 1142227 - DNA, 22 bp, Artificial Sequence
  chemically synthesized
attggttttacatttatgtgta

SEQ ID NO: 1142228 - DNA, 22 bp, Artificial Sequence
  chemically synthesized
aacattctacacataaatgtaa

SEQ ID NO: 1142229 - DNA, 22 bp, Artificial Sequence
  chemically synthesized
taattcattggttttacattta

SEQ ID NO: 1142230 - DNA, 22 bp, Artificial Sequence
  chemically synthesized
gtaattcattggttttacattt

SEQ ID NO: 1142231 - DNA, 22 bp, Artificial Sequence
  chemically synthesized
tgtaattcattggttttacatt

SEQ ID NO: 1142232 - DNA, 22 bp, Artificial Sequence
  chemically synthesized
tacacataaatgtaaaaccaat

SEQ ID NO: 1142233 - DNA, 22 bp, Artificial Sequence
  chemically synthesized
cacataaatgtaaaaccaatga

SEQ ID NO: 1142234 - DNA, 22 bp, Artificial Sequence
  chemically synthesized
tgagactttgtaattcattggt

SEQ ID NO: 1142235 - DNA, 22 bp, Artificial Sequence
  chemically synthesized
gtgagactttgtaattcattgg

SEQ ID NO: 1142236 - DNA, 22 bp, Artificial Sequence
  chemically synthesized
tgtgagactttgtaattcattg

SEQ ID NO: 1142237 - DNA, 22 bp, Artificial Sequence
  chemically synthesized
ccattttgtgagactttgtaat

SEQ ID NO: 1142238 - DNA, 22 bp, Artificial Sequence
  chemically synthesized
accattttgtgagactttgtaa

SEQ ID NO: 1142239 - DNA, 22 bp, Artificial Sequence
  chemically synthesized
taccattttgtgagactttgta

SEQ ID NO: 1142240 - DNA, 22 bp, Artificial Sequence
  chemically synthesized
ttaccattttgtgagactttgt

SEQ ID NO: 1142241 - DNA, 22 bp, Artificial Sequence
  chemically synthesized
ttttaccattttgtgagacttt

SEQ ID NO: 1142242 - DNA, 22 bp, Artificial Sequence
  chemically synthesized
cttttaccattttgtgagactt

SEQ ID NO: 1142243 - DNA, 22 bp, Artificial Sequence
  chemically synthesized
acttcttttaccattttgtgag

SEQ ID NO: 1142244 - DNA, 22 bp, Artificial Sequence
  chemically synthesized
caaagtctcacaaaatggtaaa

SEQ ID NO: 1142245 - DNA, 22 bp, Artificial Sequence
  chemically synthesized
acaaaatggtaaaagaagttaa

SEQ ID NO: 1142246 - DNA, 22 bp, Artificial Sequence
  chemically synthesized
agacaaaatgagaatataaata

SEQ ID NO: 1142247 - DNA, 22 bp, Artificial Sequence
  chemically synthesized
ctgagacaaaatgagaatataa

SEQ ID NO: 1142248 - DNA, 22 bp, Artificial Sequence
  chemically synthesized
ctgctgagacaaaatgagaata

SEQ ID NO: 1142249 - DNA, 22 bp, Artificial Sequence
  chemically synthesized
atttttatttatattctcattt

SEQ ID NO: 1142250 - DNA, 22 bp, Artificial Sequence
  chemically synthesized
actgctgagacaaaatgagaat

SEQ ID NO: 1142251 - DNA, 22 bp, Artificial Sequence
  chemically synthesized
ttatttatattctcattttgtc

SEQ ID NO: 1142252 - DNA, 22 bp, Artificial Sequence
  chemically synthesized
acttactgctgagacaaaatga

SEQ ID NO: 1142253 - DNA, 22 bp, Artificial Sequence
  chemically synthesized
tatttatattctcattttgtct

SEQ ID NO: 1142254 - DNA, 22 bp, Artificial Sequence
  chemically synthesized
cacttactgctgagacaaaatg

SEQ ID NO: 1142255 - DNA, 22 bp, Artificial Sequence
  chemically synthesized
atttatattctcattttgtctc

SEQ ID NO: 1142256 - DNA, 22 bp, Artificial Sequence
  chemically synthesized
tttatattctcattttgtctca

SEQ ID NO: 1142257 - DNA, 22 bp, Artificial Sequence
  chemically synthesized
gcttcacttactgctgagacaa

SEQ ID NO: 1142258 - DNA, 22 bp, Artificial Sequence
  chemically synthesized
atattctcattttgtctcagca

SEQ ID NO: 1142259 - DNA, 22 bp, Artificial Sequence
  chemically synthesized
agcttcacttactgctgagaca

SEQ ID NO: 1142260 - DNA, 22 bp, Artificial Sequence
  chemically synthesized
tattctcattttgtctcagcag

SEQ ID NO: 1142261 - DNA, 22 bp, Artificial Sequence
  chemically synthesized
tagcttcacttactgctgagac

SEQ ID NO: 1142262 - DNA, 22 bp, Artificial Sequence
  chemically synthesized
tcattttgtctcagcagtaagt

SEQ ID NO: 1142263 - DNA, 22 bp, Artificial Sequence
  chemically synthesized
acctttagcttcacttactgct

SEQ ID NO: 1142264 - DNA, 22 bp, Artificial Sequence
  chemically synthesized
attttgtctcagcagtaagtga

SEQ ID NO: 1142265 - DNA, 22 bp, Artificial Sequence
  chemically synthesized
tgtctcagcagtaagtgaagct

SEQ ID NO: 1142266 - DNA, 22 bp, Artificial Sequence
  chemically synthesized
gtctcagcagtaagtgaagcta

SEQ ID NO: 1142267 - DNA, 22 bp, Artificial Sequence
  chemically synthesized
tctcagcagtaagtgaagctaa

SEQ ID NO: 1142268 - DNA, 22 bp, Artificial Sequence
  chemically synthesized
agcagtaagtgaagctaaaggt

SEQ ID NO: 1142269 - DNA, 22 bp, Artificial Sequence
  chemically synthesized
gacgaagtgagctgacctttag

SEQ ID NO: 1142270 - DNA, 22 bp, Artificial Sequence
  chemically synthesized
aaggtcagctcacttcgtctaa

SEQ ID NO: 1142271 - DNA, 22 bp, Artificial Sequence
  chemically synthesized
gtccatgaaaatgttagacgaa

SEQ ID NO: 1142272 - DNA, 22 bp, Artificial Sequence
  chemically synthesized
agtccatgaaaatgttagacga

SEQ ID NO: 1142273 - DNA, 22 bp, Artificial Sequence
  chemically synthesized
tgatttagtccatgaaaatgtt

SEQ ID NO: 1142274 - DNA, 22 bp, Artificial Sequence
  chemically synthesized
acttcgtctaacattttcatgg

SEQ ID NO: 1142275 - DNA, 22 bp, Artificial Sequence
  chemically synthesized
cgtctaacattttcatggacta

SEQ ID NO: 1142276 - DNA, 22 bp, Artificial Sequence
  chemically synthesized
gtctaacattttcatggactaa

SEQ ID NO: 1142277 - DNA, 22 bp, Artificial Sequence
  chemically synthesized
acattttcatggactaaatcac

SEQ ID NO: 1142278 - DNA, 22 bp, Artificial Sequence
  chemically synthesized
tcatggactaaatcacaactcc

SEQ ID NO: 1142279 - DNA, 22 bp, Artificial Sequence
  chemically synthesized
catggactaaatcacaactcca

SEQ ID NO: 1142280 - DNA, 22 bp, Artificial Sequence
  chemically synthesized
atggactaaatcacaactccat

SEQ ID NO: 1142281 - DNA, 22 bp, Artificial Sequence
  chemically synthesized
agcatggacgataatggagttg

SEQ ID NO: 1142282 - DNA, 22 bp, Artificial Sequence
  chemically synthesized
aatcacaactccattatcgtcc

SEQ ID NO: 1142283 - DNA, 22 bp, Artificial Sequence
  chemically synthesized
tggatctgagcatggacgataa

SEQ ID NO: 1142284 - DNA, 22 bp, Artificial Sequence
  chemically synthesized
cccgttgtggatctgagcatgg

SEQ ID NO: 1142285 - DNA, 22 bp, Artificial Sequence
  chemically synthesized
cattatcgtccatgctcagatc

SEQ ID NO: 1142286 - DNA, 22 bp, Artificial Sequence
  chemically synthesized
tcgtccatgctcagatccacaa

SEQ ID NO: 1142287 - DNA, 22 bp, Artificial Sequence
  chemically synthesized
agatccacaacggggaggattt

SEQ ID NO: 1142288 - DNA, 22 bp, Artificial Sequence
  chemically synthesized
aatgggaggaaaaaatcctccc

SEQ ID NO: 1142289 - DNA, 22 bp, Artificial Sequence
  chemically synthesized
tttcctcccatttaattcacat

SEQ ID NO: 1142290 - DNA, 22 bp, Artificial Sequence
  chemically synthesized
ttcctcccatttaattcacatg

SEQ ID NO: 1142291 - DNA, 22 bp, Artificial Sequence
  chemically synthesized
tcctcccatttaattcacatgt

SEQ ID NO: 1142292 - DNA, 22 bp, Artificial Sequence
  chemically synthesized
cctcccatttaattcacatgtc

SEQ ID NO: 1142293 - DNA, 22 bp, Artificial Sequence
  chemically synthesized
ctcccatttaattcacatgtca

SEQ ID NO: 1142294 - DNA, 22 bp, Artificial Sequence
  chemically synthesized
ccatttaattcacatgtcatat

SEQ ID NO: 1142295 - DNA, 22 bp, Artificial Sequence
  chemically synthesized
gcacgtacaacaatatgacatg

SEQ ID NO: 1142296 - DNA, 22 bp, Artificial Sequence
  chemically synthesized
ggcacgtacaacaatatgacat

SEQ ID NO: 1142297 - DNA, 22 bp, Artificial Sequence
  chemically synthesized
aattcacatgtcatattgttgt

SEQ ID NO: 1142298 - DNA, 22 bp, Artificial Sequence
  chemically synthesized
attcacatgtcatattgttgta

SEQ ID NO: 1142299 - DNA, 22 bp, Artificial Sequence
  chemically synthesized
acatgtcatattgttgtacgtg

SEQ ID NO: 1142300 - DNA, 22 bp, Artificial Sequence
  chemically synthesized
agatgagaaatgtccttggcac

SEQ ID NO: 1142301 - DNA, 22 bp, Artificial Sequence
  chemically synthesized
ttgtacgtgccaaggacatttc

SEQ ID NO: 1142302 - DNA, 22 bp, Artificial Sequence
  chemically synthesized
tacgtgccaaggacatttctca

SEQ ID NO: 1142303 - DNA, 22 bp, Artificial Sequence
  chemically synthesized
aaccaaacaaaggaattcagat

SEQ ID NO: 1142304 - DNA, 22 bp, Artificial Sequence
  chemically synthesized
ctcatctgaattcctttgtttg

SEQ ID NO: 1142305 - DNA, 22 bp, Artificial Sequence
  chemically synthesized
tcatctgaattcctttgtttgg

SEQ ID NO: 1142306 - DNA, 22 bp, Artificial Sequence
  chemically synthesized
atctgaattcctttgtttggtt

SEQ ID NO: 1142307 - DNA, 22 bp, Artificial Sequence
  chemically synthesized
aaatagcaactcaaccaaacaa

SEQ ID NO: 1142308 - DNA, 22 bp, Artificial Sequence
  chemically synthesized
aattcctttgtttggttgagtt

SEQ ID NO: 1142309 - DNA, 22 bp, Artificial Sequence
  chemically synthesized
aattgaaatagcaactcaacca

SEQ ID NO: 1142310 - DNA, 22 bp, Artificial Sequence
  chemically synthesized
gaattgaaatagcaactcaacc

SEQ ID NO: 1142311 - DNA, 22 bp, Artificial Sequence
  chemically synthesized
tgaattgaaatagcaactcaac

SEQ ID NO: 1142312 - DNA, 22 bp, Artificial Sequence
  chemically synthesized
ttgaattgaaatagcaactcaa

SEQ ID NO: 1142313 - DNA, 22 bp, Artificial Sequence
  chemically synthesized
ctttgtttggttgagttgctat

SEQ ID NO: 1142314 - DNA, 22 bp, Artificial Sequence
  chemically synthesized
acttttgaattgaaatagcaac

SEQ ID NO: 1142315 - DNA, 22 bp, Artificial Sequence
  chemically synthesized
tgtttggttgagttgctatttc

SEQ ID NO: 1142316 - DNA, 22 bp, Artificial Sequence
  chemically synthesized
cacttttgaattgaaatagcaa

SEQ ID NO: 1142317 - DNA, 22 bp, Artificial Sequence
  chemically synthesized
gtttggttgagttgctatttca

SEQ ID NO: 1142318 - DNA, 22 bp, Artificial Sequence
  chemically synthesized
tcacttttgaattgaaatagca

SEQ ID NO: 1142319 - DNA, 22 bp, Artificial Sequence
  chemically synthesized
tttggttgagttgctatttcaa

SEQ ID NO: 1142320 - DNA, 22 bp, Artificial Sequence
  chemically synthesized
ttcacttttgaattgaaatagc

SEQ ID NO: 1142321 - DNA, 22 bp, Artificial Sequence
  chemically synthesized
ggttgagttgctatttcaattc

SEQ ID NO: 1142322 - DNA, 22 bp, Artificial Sequence
  chemically synthesized
gttgagttgctatttcaattca

SEQ ID NO: 1142323 - DNA, 22 bp, Artificial Sequence
  chemically synthesized
agttgctatttcaattcaaaag

SEQ ID NO: 1142324 - DNA, 22 bp, Artificial Sequence
  chemically synthesized
gtagccatttttcacttttgaa

SEQ ID NO: 1142325 - DNA, 22 bp, Artificial Sequence
  chemically synthesized
agtagccatttttcacttttga

SEQ ID NO: 1142326 - DNA, 22 bp, Artificial Sequence
  chemically synthesized
tagtagccatttttcacttttg

SEQ ID NO: 1142327 - DNA, 22 bp, Artificial Sequence
  chemically synthesized
ctatttcaattcaaaagtgaaa

SEQ ID NO: 1142328 - DNA, 22 bp, Artificial Sequence
  chemically synthesized
ttagtagccatttttcactttt

SEQ ID NO: 1142329 - DNA, 22 bp, Artificial Sequence
  chemically synthesized
ttttagtagccatttttcactt

SEQ ID NO: 1142330 - DNA, 22 bp, Artificial Sequence
  chemically synthesized
tttcaattcaaaagtgaaaaat

SEQ ID NO: 1142331 - DNA, 22 bp, Artificial Sequence
  chemically synthesized
caattcaaaagtgaaaaatggc

SEQ ID NO: 1142332 - DNA, 22 bp, Artificial Sequence
  chemically synthesized
aattcaaaagtgaaaaatggct

SEQ ID NO: 1142333 - DNA, 22 bp, Artificial Sequence
  chemically synthesized
aaaagtgaaaaatggctactaa

SEQ ID NO: 1142334 - DNA, 22 bp, Artificial Sequence
  chemically synthesized
tccaaatgttcttttagtagcc

SEQ ID NO: 1142335 - DNA, 22 bp, Artificial Sequence
  chemically synthesized
atccaaatgttcttttagtagc

SEQ ID NO: 1142336 - DNA, 22 bp, Artificial Sequence
  chemically synthesized
tatccaaatgttcttttagtag

SEQ ID NO: 1142337 - DNA, 22 bp, Artificial Sequence
  chemically synthesized
cctttatccaaatgttctttta

SEQ ID NO: 1142338 - DNA, 22 bp, Artificial Sequence
  chemically synthesized
agttacctttatccaaatgttc

SEQ ID NO: 1142339 - DNA, 22 bp, Artificial Sequence
  chemically synthesized
ctcagttacctttatccaaatg

SEQ ID NO: 1142340 - DNA, 22 bp, Artificial Sequence
  chemically synthesized
cctcagttacctttatccaaat

SEQ ID NO: 1142341 - DNA, 22 bp, Artificial Sequence
  chemically synthesized
tcctcagttacctttatccaaa

SEQ ID NO: 1142342 - DNA, 22 bp, Artificial Sequence
  chemically synthesized
ctaaaagaacatttggataaag

SEQ ID NO: 1142343 - DNA, 22 bp, Artificial Sequence
  chemically synthesized
aaagaacatttggataaaggta

SEQ ID NO: 1142344 - DNA, 22 bp, Artificial Sequence
  chemically synthesized
tcagattttcctcagttacctt

SEQ ID NO: 1142345 - DNA, 22 bp, Artificial Sequence
  chemically synthesized
gtcagattttcctcagttacct

SEQ ID NO: 1142346 - DNA, 22 bp, Artificial Sequence
  chemically synthesized
ggataaaggtaactgaggaaaa

SEQ ID NO: 1142347 - DNA, 22 bp, Artificial Sequence
  chemically synthesized
gataaaggtaactgaggaaaat

SEQ ID NO: 1142348 - DNA, 22 bp, Artificial Sequence
  chemically synthesized
ccaggcttgtcagattttcctc

SEQ ID NO: 1142349 - DNA, 22 bp, Artificial Sequence
  chemically synthesized
cctcccaggcttgtcagatttt

SEQ ID NO: 1142350 - DNA, 22 bp, Artificial Sequence
  chemically synthesized
acctcccaggcttgtcagattt

SEQ ID NO: 1142351 - DNA, 22 bp, Artificial Sequence
  chemically synthesized
agatttacctcccaggcttgtc

SEQ ID NO: 1142352 - DNA, 22 bp, Artificial Sequence
  chemically synthesized
aagatttacctcccaggcttgt

SEQ ID NO: 1142353 - DNA, 22 bp, Artificial Sequence
  chemically synthesized
aggaaaatctgacaagcctggg

SEQ ID NO: 1142354 - DNA, 22 bp, Artificial Sequence
  chemically synthesized
acaagcctgggaggtaaatctt

SEQ ID NO: 1142355 - DNA, 22 bp, Artificial Sequence
  chemically synthesized
aagggtcaccatacttaagatt

SEQ ID NO: 1142356 - DNA, 22 bp, Artificial Sequence
  chemically synthesized
ggaggtaaatcttaagtatggt

SEQ ID NO: 1142357 - DNA, 22 bp, Artificial Sequence
  chemically synthesized
cagtaaattcaagggtcaccat

SEQ ID NO: 1142358 - DNA, 22 bp, Artificial Sequence
  chemically synthesized
gctccagtaaattcaagggtca

SEQ ID NO: 1142359 - DNA, 22 bp, Artificial Sequence
  chemically synthesized
aagtatggtgacccttgaattt

SEQ ID NO: 1142360 - DNA, 22 bp, Artificial Sequence
  chemically synthesized
agtatggtgacccttgaattta

SEQ ID NO: 1142361 - DNA, 22 bp, Artificial Sequence
  chemically synthesized
tccctggctccagtaaattcaa

SEQ ID NO: 1142362 - DNA, 22 bp, Artificial Sequence
  chemically synthesized
tatccctggctccagtaaattc

SEQ ID NO: 1142363 - DNA, 22 bp, Artificial Sequence
  chemically synthesized
atattctatccctggctccagt

SEQ ID NO: 1142364 - DNA, 22 bp, Artificial Sequence
  chemically synthesized
catattctatccctggctccag

SEQ ID NO: 1142365 - DNA, 22 bp, Artificial Sequence
  chemically synthesized
gaatttactggagccagggata

SEQ ID NO: 1142366 - DNA, 22 bp, Artificial Sequence
  chemically synthesized
ggtttcatattctatccctggc

SEQ ID NO: 1142367 - DNA, 22 bp, Artificial Sequence
  chemically synthesized
aatttactggagccagggatag

SEQ ID NO: 1142368 - DNA, 22 bp, Artificial Sequence
  chemically synthesized
aggtttcatattctatccctgg

SEQ ID NO: 1142369 - DNA, 22 bp, Artificial Sequence
  chemically synthesized
actggagccagggatagaatat

SEQ ID NO: 1142370 - DNA, 22 bp, Artificial Sequence
  chemically synthesized
ctggagccagggatagaatatg

SEQ ID NO: 1142371 - DNA, 22 bp, Artificial Sequence
  chemically synthesized
gagccagggatagaatatgaaa

SEQ ID NO: 1142372 - DNA, 22 bp, Artificial Sequence
  chemically synthesized
atgggcacagtttaggtttcat

SEQ ID NO: 1142373 - DNA, 22 bp, Artificial Sequence
  chemically synthesized
acgccaatactgatgggcacag

SEQ ID NO: 1142374 - DNA, 22 bp, Artificial Sequence
  chemically synthesized
aacgccaatactgatgggcaca

SEQ ID NO: 1142375 - DNA, 22 bp, Artificial Sequence
  chemically synthesized
ttaacgccaatactgatgggca

SEQ ID NO: 1142376 - DNA, 22 bp, Artificial Sequence
  chemically synthesized
tctcttaacgccaatactgatg

SEQ ID NO: 1142377 - DNA, 22 bp, Artificial Sequence
  chemically synthesized
tatctcttaacgccaatactga

SEQ ID NO: 1142378 - DNA, 22 bp, Artificial Sequence
  chemically synthesized
aactgtgcccatcagtattggc

SEQ ID NO: 1142379 - DNA, 22 bp, Artificial Sequence
  chemically synthesized
tgcccatcagtattggcgttaa

SEQ ID NO: 1142380 - DNA, 22 bp, Artificial Sequence
  chemically synthesized
ggaacactctatctcttaacgc

SEQ ID NO: 1142381 - DNA, 22 bp, Artificial Sequence
  chemically synthesized
gcgttaagagatagagtgttcc

SEQ ID NO: 1142382 - DNA, 22 bp, Artificial Sequence
  chemically synthesized
gtggatatacgcctgggaacac

SEQ ID NO: 1142383 - DNA, 22 bp, Artificial Sequence
  chemically synthesized
agtggatatacgcctgggaaca

SEQ ID NO: 1142384 - DNA, 22 bp, Artificial Sequence
  chemically synthesized
agagatagagtgttcccaggcg

SEQ ID NO: 1142385 - DNA, 22 bp, Artificial Sequence
  chemically synthesized
cgccttagtggatatacgcctg

SEQ ID NO: 1142386 - DNA, 22 bp, Artificial Sequence
  chemically synthesized
ccgccttagtggatatacgcct

SEQ ID NO: 1142387 - DNA, 22 bp, Artificial Sequence
  chemically synthesized
tttccgccttagtggatatacg

SEQ ID NO: 1142388 - DNA, 22 bp, Artificial Sequence
  chemically synthesized
ccaggcgtatatccactaaggc

SEQ ID NO: 1142389 - DNA, 22 bp, Artificial Sequence
  chemically synthesized
tgtggtccatggcacataattg

SEQ ID NO: 1142390 - DNA, 22 bp, Artificial Sequence
  chemically synthesized
aggcggaaacaattatgtgcca

SEQ ID NO: 1142391 - DNA, 22 bp, Artificial Sequence
  chemically synthesized
atgcattgtgtggtccatggca

SEQ ID NO: 1142392 - DNA, 22 bp, Artificial Sequence
  chemically synthesized
ctgatgcattgtgtggtccatg

SEQ ID NO: 1142393 - DNA, 22 bp, Artificial Sequence
  chemically synthesized
tgtgccatggaccacacaatgc

SEQ ID NO: 1142394 - DNA, 22 bp, Artificial Sequence
  chemically synthesized
ataaagccccgttgctgatgca

SEQ ID NO: 1142395 - DNA, 22 bp, Artificial Sequence
  chemically synthesized
cataaagccccgttgctgatgc

SEQ ID NO: 1142396 - DNA, 22 bp, Artificial Sequence
  chemically synthesized
tcataaagccccgttgctgatg

SEQ ID NO: 1142397 - DNA, 22 bp, Artificial Sequence
  chemically synthesized
tttcataaagccccgttgctga

SEQ ID NO: 1142398 - DNA, 22 bp, Artificial Sequence
  chemically synthesized
cctctttcataaagccccgttg

SEQ ID NO: 1142399 - DNA, 22 bp, Artificial Sequence
  chemically synthesized
cctccctctttcataaagcccc

SEQ ID NO: 1142400 - DNA, 22 bp, Artificial Sequence
  chemically synthesized
tgcctccctctttcataaagcc

SEQ ID NO: 1142401 - DNA, 22 bp, Artificial Sequence
  chemically synthesized
ctgcctccctctttcataaagc

SEQ ID NO: 1142402 - DNA, 22 bp, Artificial Sequence
  chemically synthesized
tctgcctccctctttcataaag

SEQ ID NO: 1142403 - DNA, 22 bp, Artificial Sequence
  chemically synthesized
ttttctgcctccctctttcata

SEQ ID NO: 1142404 - DNA, 22 bp, Artificial Sequence
  chemically synthesized
tatgaaagagggaggcagaaaa

SEQ ID NO: 1142405 - DNA, 22 bp, Artificial Sequence
  chemically synthesized
atgaaagagggaggcagaaaac

SEQ ID NO: 1142406 - DNA, 22 bp, Artificial Sequence
  chemically synthesized
tgaaagagggaggcagaaaaca

SEQ ID NO: 1142407 - DNA, 22 bp, Artificial Sequence
  chemically synthesized
caataaaataagatgggttgtt

SEQ ID NO: 1142408 - DNA, 22 bp, Artificial Sequence
  chemically synthesized
acctgcaataaaataagatggg

SEQ ID NO: 1142409 - DNA, 22 bp, Artificial Sequence
  chemically synthesized
aacctgcaataaaataagatgg

SEQ ID NO: 1142410 - DNA, 22 bp, Artificial Sequence
  chemically synthesized
tagggtcttaacctgcaataaa

SEQ ID NO: 1142411 - DNA, 22 bp, Artificial Sequence
  chemically synthesized
attttattgcaggttaagaccc

SEQ ID NO: 1142412 - DNA, 22 bp, Artificial Sequence
  chemically synthesized
ttttattgcaggttaagaccct

SEQ ID NO: 1142413 - DNA, 22 bp, Artificial Sequence
  chemically synthesized
tattgcaggttaagaccctata

SEQ ID NO: 1142414 - DNA, 22 bp, Artificial Sequence
  chemically synthesized
attgcaggttaagaccctataa

SEQ ID NO: 1142415 - DNA, 22 bp, Artificial Sequence
  chemically synthesized
ttgcaggttaagaccctataat

SEQ ID NO: 1142416 - DNA, 22 bp, Artificial Sequence
  chemically synthesized
gcagagaagtgtattatagggt

SEQ ID NO: 1142417 - DNA, 22 bp, Artificial Sequence
  chemically synthesized
agcagagaagtgtattataggg

SEQ ID NO: 1142418 - DNA, 22 bp, Artificial Sequence
  chemically synthesized
caggttaagaccctataataca

SEQ ID NO: 1142419 - DNA, 22 bp, Artificial Sequence
  chemically synthesized
atttagcagagaagtgtattat

SEQ ID NO: 1142420 - DNA, 22 bp, Artificial Sequence
  chemically synthesized
agaccctataatacacttctct

SEQ ID NO: 1142421 - DNA, 22 bp, Artificial Sequence
  chemically synthesized
cacataaaattcatttagcaga

SEQ ID NO: 1142422 - DNA, 22 bp, Artificial Sequence
  chemically synthesized
taatacacttctctgctaaatg

SEQ ID NO: 1142423 - DNA, 22 bp, Artificial Sequence
  chemically synthesized
attacacataaaattcatttag

SEQ ID NO: 1142424 - DNA, 22 bp, Artificial Sequence
  chemically synthesized
ctctgctaaatgaattttatgt

SEQ ID NO: 1142425 - DNA, 22 bp, Artificial Sequence
  chemically synthesized
tctgctaaatgaattttatgtg

SEQ ID NO: 1142426 - DNA, 22 bp, Artificial Sequence
  chemically synthesized
agagggctcattacacataaaa

SEQ ID NO: 1142427 - DNA, 22 bp, Artificial Sequence
  chemically synthesized
tgctaaatgaattttatgtgta

SEQ ID NO: 1142428 - DNA, 22 bp, Artificial Sequence
  chemically synthesized
cagagggctcattacacataaa

SEQ ID NO: 1142429 - DNA, 22 bp, Artificial Sequence
  chemically synthesized
tcagagggctcattacacataa

SEQ ID NO: 1142430 - DNA, 22 bp, Artificial Sequence
  chemically synthesized
ctaaatgaattttatgtgtaat

SEQ ID NO: 1142431 - DNA, 22 bp, Artificial Sequence
  chemically synthesized
aatgaattttatgtgtaatgag

SEQ ID NO: 1142432 - DNA, 22 bp, Artificial Sequence
  chemically synthesized
tatgtgtaatgagccctctgaa

SEQ ID NO: 1142433 - DNA, 22 bp, Artificial Sequence
  chemically synthesized
atgtgtaatgagccctctgaaa

SEQ ID NO: 1142434 - DNA, 22 bp, Artificial Sequence
  chemically synthesized
tgtgtaatgagccctctgaaaa

SEQ ID NO: 1142435 - DNA, 22 bp, Artificial Sequence
  chemically synthesized
tgaaaatcccttatttcttgat

SEQ ID NO: 1142436 - DNA, 22 bp, Artificial Sequence
  chemically synthesized
aaaatcccttatttcttgattt

SEQ ID NO: 1142437 - DNA, 22 bp, Artificial Sequence
  chemically synthesized
ataaagtaagagaaaaatcaag

SEQ ID NO: 1142438 - DNA, 22 bp, Artificial Sequence
  chemically synthesized
ttgataaagtaagagaaaaatc

SEQ ID NO: 1142439 - DNA, 22 bp, Artificial Sequence
  chemically synthesized
atttcttgatttttctcttact

SEQ ID NO: 1142440 - DNA, 22 bp, Artificial Sequence
  chemically synthesized
tttcttgatttttctcttactt

SEQ ID NO: 1142441 - DNA, 22 bp, Artificial Sequence
  chemically synthesized
catagttgttgataaagtaaga

SEQ ID NO: 1142442 - DNA, 22 bp, Artificial Sequence
  chemically synthesized
cttgatttttctcttactttat

SEQ ID NO: 1142443 - DNA, 22 bp, Artificial Sequence
  chemically synthesized
ttgatttttctcttactttatc

SEQ ID NO: 1142444 - DNA, 22 bp, Artificial Sequence
  chemically synthesized
gatttttctcttactttatcaa

SEQ ID NO: 1142445 - DNA, 22 bp, Artificial Sequence
  chemically synthesized
actgcatagttgttgataaagt

SEQ ID NO: 1142446 - DNA, 22 bp, Artificial Sequence
  chemically synthesized
atttttctcttactttatcaac

SEQ ID NO: 1142447 - DNA, 22 bp, Artificial Sequence
  chemically synthesized
aactgcatagttgttgataaag

SEQ ID NO: 1142448 - DNA, 22 bp, Artificial Sequence
  chemically synthesized
taactgcatagttgttgataaa

SEQ ID NO: 1142449 - DNA, 22 bp, Artificial Sequence
  chemically synthesized
ttctcttactttatcaacaact

SEQ ID NO: 1142450 - DNA, 22 bp, Artificial Sequence
  chemically synthesized
tctcttactttatcaacaacta

SEQ ID NO: 1142451 - DNA, 22 bp, Artificial Sequence
  chemically synthesized
ctcttactttatcaacaactat

SEQ ID NO: 1142452 - DNA, 22 bp, Artificial Sequence
  chemically synthesized
tcttactttatcaacaactatg

SEQ ID NO: 1142453 - DNA, 22 bp, Artificial Sequence
  chemically synthesized
tacgttttaactgcatagttgt

SEQ ID NO: 1142454 - DNA, 22 bp, Artificial Sequence
  chemically synthesized
ttactttatcaacaactatgca

SEQ ID NO: 1142455 - DNA, 22 bp, Artificial Sequence
  chemically synthesized
atacgttttaactgcatagttg

SEQ ID NO: 1142456 - DNA, 22 bp, Artificial Sequence
  chemically synthesized
actttatcaacaactatgcagt

SEQ ID NO: 1142457 - DNA, 22 bp, Artificial Sequence
  chemically synthesized
ctttatcaacaactatgcagtt

SEQ ID NO: 1142458 - DNA, 22 bp, Artificial Sequence
  chemically synthesized
cttatacgttttaactgcatag

SEQ ID NO: 1142459 - DNA, 22 bp, Artificial Sequence
  chemically synthesized
tatcaacaactatgcagttaaa

SEQ ID NO: 1142460 - DNA, 22 bp, Artificial Sequence
  chemically synthesized
atcaacaactatgcagttaaaa

SEQ ID NO: 1142461 - DNA, 22 bp, Artificial Sequence
  chemically synthesized
tcaacaactatgcagttaaaac

SEQ ID NO: 1142462 - DNA, 22 bp, Artificial Sequence
  chemically synthesized
tgcagttaaaacgtataagcaa

SEQ ID NO: 1142463 - DNA, 22 bp, Artificial Sequence
  chemically synthesized
aacatcagtaagagtaagttgc

SEQ ID NO: 1142464 - DNA, 22 bp, Artificial Sequence
  chemically synthesized
caacatcagtaagagtaagttg

SEQ ID NO: 1142465 - DNA, 22 bp, Artificial Sequence
  chemically synthesized
aaacgtataagcaacttactct

SEQ ID NO: 1142466 - DNA, 22 bp, Artificial Sequence
  chemically synthesized
catttcaacatcagtaagagta

SEQ ID NO: 1142467 - DNA, 22 bp, Artificial Sequence
  chemically synthesized
ccatttcaacatcagtaagagt

SEQ ID NO: 1142468 - DNA, 22 bp, Artificial Sequence
  chemically synthesized
atgtgatttccatttcaacatc

SEQ ID NO: 1142469 - DNA, 22 bp, Artificial Sequence
  chemically synthesized
gatgtgatttccatttcaacat

SEQ ID NO: 1142470 - DNA, 22 bp, Artificial Sequence
  chemically synthesized
tgatgtgatttccatttcaaca

SEQ ID NO: 1142471 - DNA, 22 bp, Artificial Sequence
  chemically synthesized
actcttactgatgttgaaatgg

SEQ ID NO: 1142472 - DNA, 22 bp, Artificial Sequence
  chemically synthesized
ttgatgtgatttccatttcaac

SEQ ID NO: 1142473 - DNA, 22 bp, Artificial Sequence
  chemically synthesized
ctcttactgatgttgaaatgga

SEQ ID NO: 1142474 - DNA, 22 bp, Artificial Sequence
  chemically synthesized
ttactgatgttgaaatggaaat

SEQ ID NO: 1142475 - DNA, 22 bp, Artificial Sequence
  chemically synthesized
actgatgttgaaatggaaatca

SEQ ID NO: 1142476 - DNA, 22 bp, Artificial Sequence
  chemically synthesized
ctgatgttgaaatggaaatcac

SEQ ID NO: 1142477 - DNA, 22 bp, Artificial Sequence
  chemically synthesized
aatggtttttgatgtgatttcc

SEQ ID NO: 1142478 - DNA, 22 bp, Artificial Sequence
  chemically synthesized
caatggtttttgatgtgatttc

SEQ ID NO: 1142479 - DNA, 22 bp, Artificial Sequence
  chemically synthesized
atgttgaaatggaaatcacatc

SEQ ID NO: 1142480 - DNA, 22 bp, Artificial Sequence
  chemically synthesized
tcaatggtttttgatgtgattt

SEQ ID NO: 1142481 - DNA, 22 bp, Artificial Sequence
  chemically synthesized
ttcaatggtttttgatgtgatt

SEQ ID NO: 1142482 - DNA, 22 bp, Artificial Sequence
  chemically synthesized
tttcaatggtttttgatgtgat

SEQ ID NO: 1142483 - DNA, 22 bp, Artificial Sequence
  chemically synthesized
ttttcaatggtttttgatgtga

SEQ ID NO: 1142484 - DNA, 22 bp, Artificial Sequence
  chemically synthesized
aaatggaaatcacatcaaaaac

SEQ ID NO: 1142485 - DNA, 22 bp, Artificial Sequence
  chemically synthesized
tttttttcaatggtttttgatg

SEQ ID NO: 1142486 - DNA, 22 bp, Artificial Sequence
  chemically synthesized
gtttttttcaatggtttttgat

SEQ ID NO: 1142487 - DNA, 22 bp, Artificial Sequence
  chemically synthesized
tgtttttttcaatggtttttga

SEQ ID NO: 1142488 - DNA, 22 bp, Artificial Sequence
  chemically synthesized
ttgtttttttcaatggtttttg

SEQ ID NO: 1142489 - DNA, 22 bp, Artificial Sequence
  chemically synthesized
ataatggatttttgtttttttc

SEQ ID NO: 1142490 - DNA, 22 bp, Artificial Sequence
  chemically synthesized
cctcataatggatttttgtttt

SEQ ID NO: 1142491 - DNA, 22 bp, Artificial Sequence
  chemically synthesized
tgcctcataatggatttttgtt

SEQ ID NO: 1142492 - DNA, 22 bp, Artificial Sequence
  chemically synthesized
ctgcctcataatggatttttgt

SEQ ID NO: 1142493 - DNA, 22 bp, Artificial Sequence
  chemically synthesized
aaaaaaacaaaaatccattatg

SEQ ID NO: 1142494 - DNA, 22 bp, Artificial Sequence
  chemically synthesized
ccacatttctgcctcataatgg

SEQ ID NO: 1142495 - DNA, 22 bp, Artificial Sequence
  chemically synthesized
tgccacatttctgcctcataat

SEQ ID NO: 1142496 - DNA, 22 bp, Artificial Sequence
  chemically synthesized
agtaggactctgccacatttct

SEQ ID NO: 1142497 - DNA, 22 bp, Artificial Sequence
  chemically synthesized
ttcagtaggactctgccacatt

SEQ ID NO: 1142498 - DNA, 22 bp, Artificial Sequence
  chemically synthesized
tgaggcagaaatgtggcagagt

SEQ ID NO: 1142499 - DNA, 22 bp, Artificial Sequence
  chemically synthesized
aacactattcagtaggactctg

SEQ ID NO: 1142500 - DNA, 22 bp, Artificial Sequence
  chemically synthesized
gctaaacactattcagtaggac

SEQ ID NO: 1142501 - DNA, 22 bp, Artificial Sequence
  chemically synthesized
ggctaaacactattcagtagga

SEQ ID NO: 1142502 - DNA, 22 bp, Artificial Sequence
  chemically synthesized
ctgaatagtgtttagccaaggg

SEQ ID NO: 1142503 - DNA, 22 bp, Artificial Sequence
  chemically synthesized
agaaccaagccatacccttggc

SEQ ID NO: 1142504 - DNA, 22 bp, Artificial Sequence
  chemically synthesized
aatagtgtttagccaagggtat

SEQ ID NO: 1142505 - DNA, 22 bp, Artificial Sequence
  chemically synthesized
agccaagggtatggcttggttc

SEQ ID NO: 1142506 - DNA, 22 bp, Artificial Sequence
  chemically synthesized
gccaagggtatggcttggttct

SEQ ID NO: 1142507 - DNA, 22 bp, Artificial Sequence
  chemically synthesized
tagaaatgtgtaaaactgagaa

SEQ ID NO: 1142508 - DNA, 22 bp, Artificial Sequence
  chemically synthesized
gtagaaatgtgtaaaactgaga

SEQ ID NO: 1142509 - DNA, 22 bp, Artificial Sequence
  chemically synthesized
agtttgtagaaatgtgtaaaac

SEQ ID NO: 1142510 - DNA, 22 bp, Artificial Sequence
  chemically synthesized
ggttctcagttttacacatttc

SEQ ID NO: 1142511 - DNA, 22 bp, Artificial Sequence
  chemically synthesized
gttctcagttttacacatttct

SEQ ID NO: 1142512 - DNA, 22 bp, Artificial Sequence
  chemically synthesized
agttcagtttgtagaaatgtgt

SEQ ID NO: 1142513 - DNA, 22 bp, Artificial Sequence
  chemically synthesized
cagttcagtttgtagaaatgtg

SEQ ID NO: 1142514 - DNA, 22 bp, Artificial Sequence
  chemically synthesized
tcagttttacacatttctacaa

SEQ ID NO: 1142515 - DNA, 22 bp, Artificial Sequence
  chemically synthesized
agttttacacatttctacaaac

SEQ ID NO: 1142516 - DNA, 22 bp, Artificial Sequence
  chemically synthesized
tacacatttctacaaactgaac

SEQ ID NO: 1142517 - DNA, 22 bp, Artificial Sequence
  chemically synthesized
acacatttctacaaactgaact

SEQ ID NO: 1142518 - DNA, 22 bp, Artificial Sequence
  chemically synthesized
cacatttctacaaactgaactg

SEQ ID NO: 1142519 - DNA, 22 bp, Artificial Sequence
  chemically synthesized
tagtatggtgcttcagttcagt

SEQ ID NO: 1142520 - DNA, 22 bp, Artificial Sequence
  chemically synthesized
atagtatggtgcttcagttcag

SEQ ID NO: 1142521 - DNA, 22 bp, Artificial Sequence
  chemically synthesized
tatagtatggtgcttcagttca

SEQ ID NO: 1142522 - DNA, 22 bp, Artificial Sequence
  chemically synthesized
ctacaaactgaactgaagcacc

SEQ ID NO: 1142523 - DNA, 22 bp, Artificial Sequence
  chemically synthesized
tacaaactgaactgaagcacca

SEQ ID NO: 1142524 - DNA, 22 bp, Artificial Sequence
  chemically synthesized
caaactgaactgaagcaccata

SEQ ID NO: 1142525 - DNA, 22 bp, Artificial Sequence
  chemically synthesized
aactgaagcaccatactataaa

SEQ ID NO: 1142526 - DNA, 22 bp, Artificial Sequence
  chemically synthesized
aagcaccatactataaaatggt

SEQ ID NO: 1142527 - DNA, 22 bp, Artificial Sequence
  chemically synthesized
tacagtgaagatataaggtaca

SEQ ID NO: 1142528 - DNA, 22 bp, Artificial Sequence
  chemically synthesized
taaaatggtgtaccttatatct

SEQ ID NO: 1142529 - DNA, 22 bp, Artificial Sequence
  chemically synthesized
taccatatgttatacagtgaag

SEQ ID NO: 1142530 - DNA, 22 bp, Artificial Sequence
  chemically synthesized
atatcttcactgtataacatat

SEQ ID NO: 1142531 - DNA, 22 bp, Artificial Sequence
  chemically synthesized
tatcttcactgtataacatatg

SEQ ID NO: 1142532 - DNA, 22 bp, Artificial Sequence
  chemically synthesized
tccgccctgtaccatatgttat

SEQ ID NO: 1142533 - DNA, 22 bp, Artificial Sequence
  chemically synthesized
atccgccctgtaccatatgtta

SEQ ID NO: 1142534 - DNA, 22 bp, Artificial Sequence
  chemically synthesized
cactgtataacatatggtacag

SEQ ID NO: 1142535 - DNA, 22 bp, Artificial Sequence
  chemically synthesized
actgtataacatatggtacagg

SEQ ID NO: 1142536 - DNA, 22 bp, Artificial Sequence
  chemically synthesized
tataacatatggtacagggcgg

SEQ ID NO: 1142537 - DNA, 22 bp, Artificial Sequence
  chemically synthesized
atcaaaataggtttatccgccc

SEQ ID NO: 1142538 - DNA, 22 bp, Artificial Sequence
  chemically synthesized
ataactcatcaaaataggttta

SEQ ID NO: 1142539 - DNA, 22 bp, Artificial Sequence
  chemically synthesized
cataactcatcaaaataggttt

SEQ ID NO: 1142540 - DNA, 22 bp, Artificial Sequence
  chemically synthesized
tttcataactcatcaaaatagg

SEQ ID NO: 1142541 - DNA, 22 bp, Artificial Sequence
  chemically synthesized
cagtagttgtttcataactcat

SEQ ID NO: 1142542 - DNA, 22 bp, Artificial Sequence
  chemically synthesized
ccagtagttgtttcataactca

SEQ ID NO: 1142543 - DNA, 22 bp, Artificial Sequence
  chemically synthesized
ttttgatgagttatgaaacaac

SEQ ID NO: 1142544 - DNA, 22 bp, Artificial Sequence
  chemically synthesized
tgatgagttatgaaacaactac

SEQ ID NO: 1142545 - DNA, 22 bp, Artificial Sequence
  chemically synthesized
aaaaaacttccagtagttgttt

SEQ ID NO: 1142546 - DNA, 22 bp, Artificial Sequence
  chemically synthesized
gatgagttatgaaacaactact

SEQ ID NO: 1142547 - DNA, 22 bp, Artificial Sequence
  chemically synthesized
gaaaaaacttccagtagttgtt

SEQ ID NO: 1142548 - DNA, 22 bp, Artificial Sequence
  chemically synthesized
atgagttatgaaacaactactg

SEQ ID NO: 1142549 - DNA, 22 bp, Artificial Sequence
  chemically synthesized
tgaaaaaacttccagtagttgt

SEQ ID NO: 1142550 - DNA, 22 bp, Artificial Sequence
  chemically synthesized
ttgaaaaaacttccagtagttg

SEQ ID NO: 1142551 - DNA, 22 bp, Artificial Sequence
  chemically synthesized
tacttttgaaaaaacttccagt

SEQ ID NO: 1142552 - DNA, 22 bp, Artificial Sequence
  chemically synthesized
tgaaacaactactggaagtttt

SEQ ID NO: 1142553 - DNA, 22 bp, Artificial Sequence
  chemically synthesized
ctggaagttttttcaaaagtat

SEQ ID NO: 1142554 - DNA, 22 bp, Artificial Sequence
  chemically synthesized
gaagttttttcaaaagtataat

SEQ ID NO: 1142555 - DNA, 22 bp, Artificial Sequence
  chemically synthesized
aatagaagtaagaattatactt

SEQ ID NO: 1142556 - DNA, 22 bp, Artificial Sequence
  chemically synthesized
aaatagaagtaagaattatact

SEQ ID NO: 1142557 - DNA, 22 bp, Artificial Sequence
  chemically synthesized
tttcaaaagtataattcttact

SEQ ID NO: 1142558 - DNA, 22 bp, Artificial Sequence
  chemically synthesized
ttcaaaagtataattcttactt

SEQ ID NO: 1142559 - DNA, 22 bp, Artificial Sequence
  chemically synthesized
tcaaaagtataattcttacttc

SEQ ID NO: 1142560 - DNA, 22 bp, Artificial Sequence
  chemically synthesized
caaaagtataattcttacttct

SEQ ID NO: 1142561 - DNA, 22 bp, Artificial Sequence
  chemically synthesized
aaaagtataattcttacttcta

SEQ ID NO: 1142562 - DNA, 22 bp, Artificial Sequence
  chemically synthesized
caggatcatttaaatagaagta

SEQ ID NO: 1142563 - DNA, 22 bp, Artificial Sequence
  chemically synthesized
ttacaggatcatttaaatagaa

SEQ ID NO: 1142564 - DNA, 22 bp, Artificial Sequence
  chemically synthesized
ttacttctatttaaatgatcct

SEQ ID NO: 1142565 - DNA, 22 bp, Artificial Sequence
  chemically synthesized
acttctatttaaatgatcctgt

SEQ ID NO: 1142566 - DNA, 22 bp, Artificial Sequence
  chemically synthesized
cttctatttaaatgatcctgta

SEQ ID NO: 1142567 - DNA, 22 bp, Artificial Sequence
  chemically synthesized
agacaggagattattacaggat

SEQ ID NO: 1142568 - DNA, 22 bp, Artificial Sequence
  chemically synthesized
ctatttaaatgatcctgtaata

SEQ ID NO: 1142569 - DNA, 22 bp, Artificial Sequence
  chemically synthesized
tatttaaatgatcctgtaataa

SEQ ID NO: 1142570 - DNA, 22 bp, Artificial Sequence
  chemically synthesized
tttaaatgatcctgtaataatc

SEQ ID NO: 1142571 - DNA, 22 bp, Artificial Sequence
  chemically synthesized
agttcagacaggagattattac

SEQ ID NO: 1142572 - DNA, 22 bp, Artificial Sequence
  chemically synthesized
gagttcagacaggagattatta

SEQ ID NO: 1142573 - DNA, 22 bp, Artificial Sequence
  chemically synthesized
aaatgatcctgtaataatctcc

SEQ ID NO: 1142574 - DNA, 22 bp, Artificial Sequence
  chemically synthesized
aatgatcctgtaataatctcct

SEQ ID NO: 1142575 - DNA, 22 bp, Artificial Sequence
  chemically synthesized
cttgagttcagacaggagatta

SEQ ID NO: 1142576 - DNA, 22 bp, Artificial Sequence
  chemically synthesized
aaaattccttgagttcagacag

SEQ ID NO: 1142577 - DNA, 22 bp, Artificial Sequence
  chemically synthesized
taataatctcctgtctgaactc

SEQ ID NO: 1142578 - DNA, 22 bp, Artificial Sequence
  chemically synthesized
ctgtctgaactcaaggaatttt

SEQ ID NO: 1142579 - DNA, 22 bp, Artificial Sequence
  chemically synthesized
gaagtgacagctaaaaattcct

SEQ ID NO: 1142580 - DNA, 22 bp, Artificial Sequence
  chemically synthesized
ggaagtgacagctaaaaattcc

SEQ ID NO: 1142581 - DNA, 22 bp, Artificial Sequence
  chemically synthesized
tctgaactcaaggaatttttag

SEQ ID NO: 1142582 - DNA, 22 bp, Artificial Sequence
  chemically synthesized
tggaagtgacagctaaaaattc

SEQ ID NO: 1142583 - DNA, 22 bp, Artificial Sequence
  chemically synthesized
aactcaaggaatttttagctgt

SEQ ID NO: 1142584 - DNA, 22 bp, Artificial Sequence
  chemically synthesized
cccctttggaagtgacagctaa

SEQ ID NO: 1142585 - DNA, 22 bp, Artificial Sequence
  chemically synthesized
aaggaatttttagctgtcactt

SEQ ID NO: 1142586 - DNA, 22 bp, Artificial Sequence
  chemically synthesized
taacctgcccctttggaagtga

SEQ ID NO: 1142587 - DNA, 22 bp, Artificial Sequence
  chemically synthesized
ttagctgtcacttccaaagggg

SEQ ID NO: 1142588 - DNA, 22 bp, Artificial Sequence
  chemically synthesized
atctgtaacctgcccctttgga

SEQ ID NO: 1142589 - DNA, 22 bp, Artificial Sequence
  chemically synthesized
tagctgtcacttccaaaggggc

SEQ ID NO: 1142590 - DNA, 22 bp, Artificial Sequence
  chemically synthesized
agctgtcacttccaaaggggca

SEQ ID NO: 1142591 - DNA, 22 bp, Artificial Sequence
  chemically synthesized
gctgtcacttccaaaggggcag

SEQ ID NO: 1142592 - DNA, 22 bp, Artificial Sequence
  chemically synthesized
ctcatctgtaacctgccccttt

SEQ ID NO: 1142593 - DNA, 22 bp, Artificial Sequence
  chemically synthesized
cctcatctgtaacctgcccctt

SEQ ID NO: 1142594 - DNA, 22 bp, Artificial Sequence
  chemically synthesized
tcacttccaaaggggcaggtta

SEQ ID NO: 1142595 - DNA, 22 bp, Artificial Sequence
  chemically synthesized
tcagtttcctcatctgtaacct

SEQ ID NO: 1142596 - DNA, 22 bp, Artificial Sequence
  chemically synthesized
ccaaaggggcaggttacagatg

SEQ ID NO: 1142597 - DNA, 22 bp, Artificial Sequence
  chemically synthesized
caaaggggcaggttacagatga

SEQ ID NO: 1142598 - DNA, 22 bp, Artificial Sequence
  chemically synthesized
tctgtcagtttcctcatctgta

SEQ ID NO: 1142599 - DNA, 22 bp, Artificial Sequence
  chemically synthesized
acctatctgtcagtttcctcat

SEQ ID NO: 1142600 - DNA, 22 bp, Artificial Sequence
  chemically synthesized
aacctatctgtcagtttcctca

SEQ ID NO: 1142601 - DNA, 22 bp, Artificial Sequence
  chemically synthesized
cttaacctatctgtcagtttcc

SEQ ID NO: 1142602 - DNA, 22 bp, Artificial Sequence
  chemically synthesized
cagatgaggaaactgacagata

SEQ ID NO: 1142603 - DNA, 22 bp, Artificial Sequence
  chemically synthesized
agacaagttacttaacctatct

SEQ ID NO: 1142604 - DNA, 22 bp, Artificial Sequence
  chemically synthesized
tgacctcagacaagttacttaa

SEQ ID NO: 1142605 - DNA, 22 bp, Artificial Sequence
  chemically synthesized
tgtgacctcagacaagttactt

SEQ ID NO: 1142606 - DNA, 22 bp, Artificial Sequence
  chemically synthesized
acagataggttaagtaacttgt

SEQ ID NO: 1142607 - DNA, 22 bp, Artificial Sequence
  chemically synthesized
ctgtgacctcagacaagttact

SEQ ID NO: 1142608 - DNA, 22 bp, Artificial Sequence
  chemically synthesized
tggcttctgtgacctcagacaa

SEQ ID NO: 1142609 - DNA, 22 bp, Artificial Sequence
  chemically synthesized
agtaacttgtctgaggtcacag

SEQ ID NO: 1142610 - DNA, 22 bp, Artificial Sequence
  chemically synthesized
agtactgtggcttctgtgacct

SEQ ID NO: 1142611 - DNA, 22 bp, Artificial Sequence
  chemically synthesized
gtctgaggtcacagaagccaca

SEQ ID NO: 1142612 - DNA, 22 bp, Artificial Sequence
  chemically synthesized
tctgaggtcacagaagccacag

SEQ ID NO: 1142613 - DNA, 22 bp, Artificial Sequence
  chemically synthesized
aggtcacagaagccacagtact

SEQ ID NO: 1142614 - DNA, 22 bp, Artificial Sequence
  chemically synthesized
aggtcaaatcccagacactcag

SEQ ID NO: 1142615 - DNA, 22 bp, Artificial Sequence
  chemically synthesized
agtgtctgggatttgacctcag

SEQ ID NO: 1142616 - DNA, 22 bp, Artificial Sequence
  chemically synthesized
tagccaaatggatctgaggtca

SEQ ID NO: 1142617 - DNA, 22 bp, Artificial Sequence
  chemically synthesized
gtagccaaatggatctgaggtc

SEQ ID NO: 1142618 - DNA, 22 bp, Artificial Sequence
  chemically synthesized
ggatttgacctcagatccattt

SEQ ID NO: 1142619 - DNA, 22 bp, Artificial Sequence
  chemically synthesized
gacctcagatccatttggctac

SEQ ID NO: 1142620 - DNA, 22 bp, Artificial Sequence
  chemically synthesized
acctcagatccatttggctaca

SEQ ID NO: 1142621 - DNA, 22 bp, Artificial Sequence
  chemically synthesized
tgaacgagcatgaacttgtagc

SEQ ID NO: 1142622 - DNA, 22 bp, Artificial Sequence
  chemically synthesized
agatccatttggctacaagttc

SEQ ID NO: 1142623 - DNA, 22 bp, Artificial Sequence
  chemically synthesized
ggctacaagttcatgctcgttc

SEQ ID NO: 1142624 - DNA, 22 bp, Artificial Sequence
  chemically synthesized
gctacaagttcatgctcgttca

SEQ ID NO: 1142625 - DNA, 22 bp, Artificial Sequence
  chemically synthesized
aatgaataccattatgaacgag

SEQ ID NO: 1142626 - DNA, 22 bp, Artificial Sequence
  chemically synthesized
caagttcatgctcgttcataat

SEQ ID NO: 1142627 - DNA, 22 bp, Artificial Sequence
  chemically synthesized
ctgaatgaataccattatgaac

SEQ ID NO: 1142628 - DNA, 22 bp, Artificial Sequence
  chemically synthesized
atgctcgttcataatggtattc

SEQ ID NO: 1142629 - DNA, 22 bp, Artificial Sequence
  chemically synthesized
gttcataatggtattcattcag

SEQ ID NO: 1142630 - DNA, 22 bp, Artificial Sequence
  chemically synthesized
taatgaatgccctactgaatga

SEQ ID NO: 1142631 - DNA, 22 bp, Artificial Sequence
  chemically synthesized
ataatgaatgccctactgaatg

SEQ ID NO: 1142632 - DNA, 22 bp, Artificial Sequence
  chemically synthesized
ataatggtattcattcagtagg

SEQ ID NO: 1142633 - DNA, 22 bp, Artificial Sequence
  chemically synthesized
tataatgaatgccctactgaat

SEQ ID NO: 1142634 - DNA, 22 bp, Artificial Sequence
  chemically synthesized
ttataatgaatgccctactgaa

SEQ ID NO: 1142635 - DNA, 22 bp, Artificial Sequence
  chemically synthesized
attcagtagggcattcattata

SEQ ID NO: 1142636 - DNA, 22 bp, Artificial Sequence
  chemically synthesized
gaaggcatatcttttataatga

SEQ ID NO: 1142637 - DNA, 22 bp, Artificial Sequence
  chemically synthesized
agtagggcattcattataaaag

SEQ ID NO: 1142638 - DNA, 22 bp, Artificial Sequence
  chemically synthesized
attataaaagatatgccttcta

SEQ ID NO: 1142639 - DNA, 22 bp, Artificial Sequence
  chemically synthesized
tgtagcacaaattagaaggcat

SEQ ID NO: 1142640 - DNA, 22 bp, Artificial Sequence
  chemically synthesized
taaaagatatgccttctaattt

SEQ ID NO: 1142641 - DNA, 22 bp, Artificial Sequence
  chemically synthesized
taggttgtgtagcacaaattag

SEQ ID NO: 1142642 - DNA, 22 bp, Artificial Sequence
  chemically synthesized
actgtaggttgtgtagcacaaa

SEQ ID NO: 1142643 - DNA, 22 bp, Artificial Sequence
  chemically synthesized
ctaatttgtgctacacaaccta

SEQ ID NO: 1142644 - DNA, 22 bp, Artificial Sequence
  chemically synthesized
gatatctcactgtaggttgtgt

SEQ ID NO: 1142645 - DNA, 22 bp, Artificial Sequence
  chemically synthesized
taatttgtgctacacaacctac

SEQ ID NO: 1142646 - DNA, 22 bp, Artificial Sequence
  chemically synthesized
atttgtgctacacaacctacag

SEQ ID NO: 1142647 - DNA, 22 bp, Artificial Sequence
  chemically synthesized
gtgctacacaacctacagtgag

SEQ ID NO: 1142648 - DNA, 22 bp, Artificial Sequence
  chemically synthesized
tgctacacaacctacagtgaga

SEQ ID NO: 1142649 - DNA, 22 bp, Artificial Sequence
  chemically synthesized
ggcatctggatatctcactgta

SEQ ID NO: 1142650 - DNA, 22 bp, Artificial Sequence
  chemically synthesized
cacaacctacagtgagatatcc

SEQ ID NO: 1142651 - DNA, 22 bp, Artificial Sequence
  chemically synthesized
caaagggattcggcatctggat

SEQ ID NO: 1142652 - DNA, 22 bp, Artificial Sequence
  chemically synthesized
cagtgagatatccagatgccga

SEQ ID NO: 1142653 - DNA, 22 bp, Artificial Sequence
  chemically synthesized
aaacaaaatatgaaaagactcc

SEQ ID NO: 1142654 - DNA, 22 bp, Artificial Sequence
  chemically synthesized
ctaaaacaaaatatgaaaagac

SEQ ID NO: 1142655 - DNA, 22 bp, Artificial Sequence
  chemically synthesized
tgctaaaacaaaatatgaaaag

SEQ ID NO: 1142656 - DNA, 22 bp, Artificial Sequence
  chemically synthesized
ctgctaaaacaaaatatgaaaa

SEQ ID NO: 1142657 - DNA, 22 bp, Artificial Sequence
  chemically synthesized
tggagtcttttcatattttgtt

SEQ ID NO: 1142658 - DNA, 22 bp, Artificial Sequence
  chemically synthesized
ggagtcttttcatattttgttt

SEQ ID NO: 1142659 - DNA, 22 bp, Artificial Sequence
  chemically synthesized
gagtcttttcatattttgtttt

SEQ ID NO: 1142660 - DNA, 22 bp, Artificial Sequence
  chemically synthesized
gtcaaacttctgctaaaacaaa

SEQ ID NO: 1142661 - DNA, 22 bp, Artificial Sequence
  chemically synthesized
ttcatattttgttttagcagaa

SEQ ID NO: 1142662 - DNA, 22 bp, Artificial Sequence
  chemically synthesized
tcatattttgttttagcagaag

SEQ ID NO: 1142663 - DNA, 22 bp, Artificial Sequence
  chemically synthesized
aatctagtcaaacttctgctaa

SEQ ID NO: 1142664 - DNA, 22 bp, Artificial Sequence
  chemically synthesized
catattttgttttagcagaagt

SEQ ID NO: 1142665 - DNA, 22 bp, Artificial Sequence
  chemically synthesized
atattttgttttagcagaagtt

SEQ ID NO: 1142666 - DNA, 22 bp, Artificial Sequence
  chemically synthesized
aatgttaaatctagtcaaactt

SEQ ID NO: 1142667 - DNA, 22 bp, Artificial Sequence
  chemically synthesized
tgttttagcagaagtttgacta

SEQ ID NO: 1142668 - DNA, 22 bp, Artificial Sequence
  chemically synthesized
gttttagcagaagtttgactag

SEQ ID NO: 1142669 - DNA, 22 bp, Artificial Sequence
  chemically synthesized
ttttagcagaagtttgactaga

SEQ ID NO: 1142670 - DNA, 22 bp, Artificial Sequence
  chemically synthesized
gattaaatgttaaatctagtca

SEQ ID NO: 1142671 - DNA, 22 bp, Artificial Sequence
  chemically synthesized
tagcagaagtttgactagattt

SEQ ID NO: 1142672 - DNA, 22 bp, Artificial Sequence
  chemically synthesized
agcagaagtttgactagattta

SEQ ID NO: 1142673 - DNA, 22 bp, Artificial Sequence
  chemically synthesized
gcagaagtttgactagatttaa

SEQ ID NO: 1142674 - DNA, 22 bp, Artificial Sequence
  chemically synthesized
tgaagcagattagattaaatgt

SEQ ID NO: 1142675 - DNA, 22 bp, Artificial Sequence
  chemically synthesized
gactagatttaacatttaatct

SEQ ID NO: 1142676 - DNA, 22 bp, Artificial Sequence
  chemically synthesized
gtgaagcagattagattaaatg

SEQ ID NO: 1142677 - DNA, 22 bp, Artificial Sequence
  chemically synthesized
actagatttaacatttaatcta

SEQ ID NO: 1142678 - DNA, 22 bp, Artificial Sequence
  chemically synthesized
gatttaacatttaatctaatct

SEQ ID NO: 1142679 - DNA, 22 bp, Artificial Sequence
  chemically synthesized
acatccttgtgaagcagattag

SEQ ID NO: 1142680 - DNA, 22 bp, Artificial Sequence
  chemically synthesized
cacatccttgtgaagcagatta

SEQ ID NO: 1142681 - DNA, 22 bp, Artificial Sequence
  chemically synthesized
aacatttaatctaatctgcttc

SEQ ID NO: 1142682 - DNA, 22 bp, Artificial Sequence
  chemically synthesized
acatttaatctaatctgcttca

SEQ ID NO: 1142683 - DNA, 22 bp, Artificial Sequence
  chemically synthesized
agcttcacatccttgtgaagca

SEQ ID NO: 1142684 - DNA, 22 bp, Artificial Sequence
  chemically synthesized
aatctaatctgcttcacaagga

SEQ ID NO: 1142685 - DNA, 22 bp, Artificial Sequence
  chemically synthesized
atctaatctgcttcacaaggat

SEQ ID NO: 1142686 - DNA, 22 bp, Artificial Sequence
  chemically synthesized
taacattaagcttcacatcctt

SEQ ID NO: 1142687 - DNA, 22 bp, Artificial Sequence
  chemically synthesized
atctgcttcacaaggatgtgaa

SEQ ID NO: 1142688 - DNA, 22 bp, Artificial Sequence
  chemically synthesized
cttcacaaggatgtgaagctta

SEQ ID NO: 1142689 - DNA, 22 bp, Artificial Sequence
  chemically synthesized
cacaaggatgtgaagcttaatg

SEQ ID NO: 1142690 - DNA, 22 bp, Artificial Sequence
  chemically synthesized
acaaggatgtgaagcttaatgt

SEQ ID NO: 1142691 - DNA, 22 bp, Artificial Sequence
  chemically synthesized
aatcaaattataacattaagct

SEQ ID NO: 1142692 - DNA, 22 bp, Artificial Sequence
  chemically synthesized
gaatcaaattataacattaagc

SEQ ID NO: 1142693 - DNA, 22 bp, Artificial Sequence
  chemically synthesized
tgaatcaaattataacattaag

SEQ ID NO: 1142694 - DNA, 22 bp, Artificial Sequence
  chemically synthesized
ttgaatcaaattataacattaa

SEQ ID NO: 1142695 - DNA, 22 bp, Artificial Sequence
  chemically synthesized
aatgttataatttgattcaaaa

SEQ ID NO: 1142696 - DNA, 22 bp, Artificial Sequence
  chemically synthesized
atgttataatttgattcaaaaa

SEQ ID NO: 1142697 - DNA, 22 bp, Artificial Sequence
  chemically synthesized
cagtgtcaaatgtttttgaatc

SEQ ID NO: 1142698 - DNA, 22 bp, Artificial Sequence
  chemically synthesized
taatttgattcaaaaacatttg

SEQ ID NO: 1142699 - DNA, 22 bp, Artificial Sequence
  chemically synthesized
gattcaaaaacatttgacactg

SEQ ID NO: 1142700 - DNA, 22 bp, Artificial Sequence
  chemically synthesized
attcaaaaacatttgacactgt

SEQ ID NO: 1142701 - DNA, 22 bp, Artificial Sequence
  chemically synthesized
aacaaatacagagttacagtgt

SEQ ID NO: 1142702 - DNA, 22 bp, Artificial Sequence
  chemically synthesized
aaaaacatttgacactgtaact

SEQ ID NO: 1142703 - DNA, 22 bp, Artificial Sequence
  chemically synthesized
tgattaaacaaatacagagtta

SEQ ID NO: 1142704 - DNA, 22 bp, Artificial Sequence
  chemically synthesized
atgattaaacaaatacagagtt

SEQ ID NO: 1142705 - DNA, 22 bp, Artificial Sequence
  chemically synthesized
tatgattaaacaaatacagagt

SEQ ID NO: 1142706 - DNA, 22 bp, Artificial Sequence
  chemically synthesized
gacactgtaactctgtatttgt

SEQ ID NO: 1142707 - DNA, 22 bp, Artificial Sequence
  chemically synthesized
acactgtaactctgtatttgtt

SEQ ID NO: 1142708 - DNA, 22 bp, Artificial Sequence
  chemically synthesized
acgttttatgattaaacaaata

SEQ ID NO: 1142709 - DNA, 22 bp, Artificial Sequence
  chemically synthesized
ctgacgttttatgattaaacaa

SEQ ID NO: 1142710 - DNA, 22 bp, Artificial Sequence
  chemically synthesized
taactctgtatttgtttaatca

SEQ ID NO: 1142711 - DNA, 22 bp, Artificial Sequence
  chemically synthesized
gctgacgttttatgattaaaca

SEQ ID NO: 1142712 - DNA, 22 bp, Artificial Sequence
  chemically synthesized
tgtatttgtttaatcataaaac

SEQ ID NO: 1142713 - DNA, 22 bp, Artificial Sequence
  chemically synthesized
tatttgtttaatcataaaacgt

SEQ ID NO: 1142714 - DNA, 22 bp, Artificial Sequence
  chemically synthesized
gtttaatcataaaacgtcagca

SEQ ID NO: 1142715 - DNA, 22 bp, Artificial Sequence
  chemically synthesized
tttaatcataaaacgtcagcaa

SEQ ID NO: 1142716 - DNA, 22 bp, Artificial Sequence
  chemically synthesized
gaagtgcaagtatttgctgacg

SEQ ID NO: 1142717 - DNA, 22 bp, Artificial Sequence
  chemically synthesized
aatcataaaacgtcagcaaata

SEQ ID NO: 1142718 - DNA, 22 bp, Artificial Sequence
  chemically synthesized
atcataaaacgtcagcaaatac

SEQ ID NO: 1142719 - DNA, 22 bp, Artificial Sequence
  chemically synthesized
atctggaagtgcaagtatttgc

SEQ ID NO: 1142720 - DNA, 22 bp, Artificial Sequence
  chemically synthesized
aatctggaagtgcaagtatttg

SEQ ID NO: 1142721 - DNA, 22 bp, Artificial Sequence
  chemically synthesized
ttaatctggaagtgcaagtatt

SEQ ID NO: 1142722 - DNA, 22 bp, Artificial Sequence
  chemically synthesized
caaaggccacatgttcttaatc

SEQ ID NO: 1142723 - DNA, 22 bp, Artificial Sequence
  chemically synthesized
gcacttccagattaagaacatg

SEQ ID NO: 1142724 - DNA, 22 bp, Artificial Sequence
  chemically synthesized
cacttccagattaagaacatgt

SEQ ID NO: 1142725 - DNA, 22 bp, Artificial Sequence
  chemically synthesized
ccagattaagaacatgtggcct

SEQ ID NO: 1142726 - DNA, 22 bp, Artificial Sequence
  chemically synthesized
cagattaagaacatgtggcctt

SEQ ID NO: 1142727 - DNA, 22 bp, Artificial Sequence
  chemically synthesized
aaaataagtcctgcaaaggcca

SEQ ID NO: 1142728 - DNA, 22 bp, Artificial Sequence
  chemically synthesized
aaaaataagtcctgcaaaggcc

SEQ ID NO: 1142729 - DNA, 22 bp, Artificial Sequence
  chemically synthesized
taaaaataagtcctgcaaaggc

SEQ ID NO: 1142730 - DNA, 22 bp, Artificial Sequence
  chemically synthesized
ttaaaaataagtcctgcaaagg

SEQ ID NO: 1142731 - DNA, 22 bp, Artificial Sequence
  chemically synthesized
agaacatgtggcctttgcagga

SEQ ID NO: 1142732 - DNA, 22 bp, Artificial Sequence
  chemically synthesized
ccttttaaaaataagtcctgca

SEQ ID NO: 1142733 - DNA, 22 bp, Artificial Sequence
  chemically synthesized
accttttaaaaataagtcctgc

SEQ ID NO: 1142734 - DNA, 22 bp, Artificial Sequence
  chemically synthesized
tgcaggacttatttttaaaagg

SEQ ID NO: 1142735 - DNA, 22 bp, Artificial Sequence
  chemically synthesized
gcaggacttatttttaaaaggt

SEQ ID NO: 1142736 - DNA, 22 bp, Artificial Sequence
  chemically synthesized
caggacttatttttaaaaggta

SEQ ID NO: 1142737 - DNA, 22 bp, Artificial Sequence
  chemically synthesized
atttttaaaaggtaagtatgac

SEQ ID NO: 1142738 - DNA, 22 bp, Artificial Sequence
  chemically synthesized
atgaacaaatcagtcatactta

SEQ ID NO: 1142739 - DNA, 22 bp, Artificial Sequence
  chemically synthesized
tttttaaaaggtaagtatgact

SEQ ID NO: 1142740 - DNA, 22 bp, Artificial Sequence
  chemically synthesized
aatgaacaaatcagtcatactt

SEQ ID NO: 1142741 - DNA, 22 bp, Artificial Sequence
  chemically synthesized
ttaaaaggtaagtatgactgat

SEQ ID NO: 1142742 - DNA, 22 bp, Artificial Sequence
  chemically synthesized
taaaaggtaagtatgactgatt

SEQ ID NO: 1142743 - DNA, 22 bp, Artificial Sequence
  chemically synthesized
aaaaggtaagtatgactgattt

SEQ ID NO: 1142744 - DNA, 22 bp, Artificial Sequence
  chemically synthesized
aaaggtaagtatgactgatttg

SEQ ID NO: 1142745 - DNA, 22 bp, Artificial Sequence
  chemically synthesized
caaaggcagaatttaatgaaca

SEQ ID NO: 1142746 - DNA, 22 bp, Artificial Sequence
  chemically synthesized
atttgttcattaaattctgcct

SEQ ID NO: 1142747 - DNA, 22 bp, Artificial Sequence
  chemically synthesized
agcacaattgcaaaggcagaat

SEQ ID NO: 1142748 - DNA, 22 bp, Artificial Sequence
  chemically synthesized
cagcacaattgcaaaggcagaa

SEQ ID NO: 1142749 - DNA, 22 bp, Artificial Sequence
  chemically synthesized
tcagcacaattgcaaaggcaga

SEQ ID NO: 1142750 - DNA, 22 bp, Artificial Sequence
  chemically synthesized
gttcattaaattctgcctttgc

SEQ ID NO: 1142751 - DNA, 22 bp, Artificial Sequence
  chemically synthesized
ttcattaaattctgcctttgca

SEQ ID NO: 1142752 - DNA, 22 bp, Artificial Sequence
  chemically synthesized
attaaattctgcctttgcaatt

SEQ ID NO: 1142753 - DNA, 22 bp, Artificial Sequence
  chemically synthesized
cactttcagcacaattgcaaag

SEQ ID NO: 1142754 - DNA, 22 bp, Artificial Sequence
  chemically synthesized
aattctgcctttgcaattgtgc

SEQ ID NO: 1142755 - DNA, 22 bp, Artificial Sequence
  chemically synthesized
actacactttcagcacaattgc

SEQ ID NO: 1142756 - DNA, 22 bp, Artificial Sequence
  chemically synthesized
tgcctttgcaattgtgctgaaa

SEQ ID NO: 1142757 - DNA, 22 bp, Artificial Sequence
  chemically synthesized
cctttgcaattgtgctgaaagt

SEQ ID NO: 1142758 - DNA, 22 bp, Artificial Sequence
  chemically synthesized
aaatctcactacactttcagca

SEQ ID NO: 1142759 - DNA, 22 bp, Artificial Sequence
  chemically synthesized
tgcaattgtgctgaaagtgtag

SEQ ID NO: 1142760 - DNA, 22 bp, Artificial Sequence
  chemically synthesized
gcaattgtgctgaaagtgtagt

SEQ ID NO: 1142761 - DNA, 22 bp, Artificial Sequence
  chemically synthesized
caattgtgctgaaagtgtagtg

SEQ ID NO: 1142762 - DNA, 22 bp, Artificial Sequence
  chemically synthesized
gtgttaaaatctcactacactt

SEQ ID NO: 1142763 - DNA, 22 bp, Artificial Sequence
  chemically synthesized
cgtgttaaaatctcactacact

SEQ ID NO: 1142764 - DNA, 22 bp, Artificial Sequence
  chemically synthesized
ttcgtgttaaaatctcactaca

SEQ ID NO: 1142765 - DNA, 22 bp, Artificial Sequence
  chemically synthesized
cttcgtgttaaaatctcactac

SEQ ID NO: 1142766 - DNA, 22 bp, Artificial Sequence
  chemically synthesized
tgctgaaagtgtagtgagattt

SEQ ID NO: 1142767 - DNA, 22 bp, Artificial Sequence
  chemically synthesized
aaagtgtagtgagattttaaca

SEQ ID NO: 1142768 - DNA, 22 bp, Artificial Sequence
  chemically synthesized
taacacgaagaagcatgttctt

SEQ ID NO: 1142769 - DNA, 22 bp, Artificial Sequence
  chemically synthesized
aacacgaagaagcatgttcttc

SEQ ID NO: 1142770 - DNA, 22 bp, Artificial Sequence
  chemically synthesized
aaatagcgtagagaagaacatg

SEQ ID NO: 1142771 - DNA, 22 bp, Artificial Sequence
  chemically synthesized
acacgaagaagcatgttcttct

SEQ ID NO: 1142772 - DNA, 22 bp, Artificial Sequence
  chemically synthesized
actgaaatagcgtagagaagaa

SEQ ID NO: 1142773 - DNA, 22 bp, Artificial Sequence
  chemically synthesized
ttctctacgctatttcagtcag

SEQ ID NO: 1142774 - DNA, 22 bp, Artificial Sequence
  chemically synthesized
ctctacgctatttcagtcagtt

SEQ ID NO: 1142775 - DNA, 22 bp, Artificial Sequence
  chemically synthesized
tctacgctatttcagtcagttt

SEQ ID NO: 1142776 - DNA, 22 bp, Artificial Sequence
  chemically synthesized
tacgctatttcagtcagtttcc

SEQ ID NO: 1142777 - DNA, 22 bp, Artificial Sequence
  chemically synthesized
cgctatttcagtcagtttccta

SEQ ID NO: 1142778 - DNA, 22 bp, Artificial Sequence
  chemically synthesized
acacaaataaataatataggaa

SEQ ID NO: 1142779 - DNA, 22 bp, Artificial Sequence
  chemically synthesized
tttcagtcagtttcctatatta

SEQ ID NO: 1142780 - DNA, 22 bp, Artificial Sequence
  chemically synthesized
cagtcagtttcctatattattt

SEQ ID NO: 1142781 - DNA, 22 bp, Artificial Sequence
  chemically synthesized
agtcagtttcctatattattta

SEQ ID NO: 1142782 - DNA, 22 bp, Artificial Sequence
  chemically synthesized
tatactcacacaaataaataat

SEQ ID NO: 1142783 - DNA, 22 bp, Artificial Sequence
  chemically synthesized
gtatactcacacaaataaataa

SEQ ID NO: 1142784 - DNA, 22 bp, Artificial Sequence
  chemically synthesized
tgtatactcacacaaataaata

SEQ ID NO: 1142785 - DNA, 22 bp, Artificial Sequence
  chemically synthesized
cctatattatttatttgtgtga

SEQ ID NO: 1142786 - DNA, 22 bp, Artificial Sequence
  chemically synthesized
ctatattatttatttgtgtgag

SEQ ID NO: 1142787 - DNA, 22 bp, Artificial Sequence
  chemically synthesized
gcactttgtatactcacacaaa

SEQ ID NO: 1142788 - DNA, 22 bp, Artificial Sequence
  chemically synthesized
tattatttatttgtgtgagtat

SEQ ID NO: 1142789 - DNA, 22 bp, Artificial Sequence
  chemically synthesized
attagcactttgtatactcaca

SEQ ID NO: 1142790 - DNA, 22 bp, Artificial Sequence
  chemically synthesized
ttcattagcactttgtatactc

SEQ ID NO: 1142791 - DNA, 22 bp, Artificial Sequence
  chemically synthesized
tttatttgtgtgagtatacaaa

SEQ ID NO: 1142792 - DNA, 22 bp, Artificial Sequence
  chemically synthesized
attcattagcactttgtatact

SEQ ID NO: 1142793 - DNA, 22 bp, Artificial Sequence
  chemically synthesized
atttgtgtgagtatacaaagtg

SEQ ID NO: 1142794 - DNA, 22 bp, Artificial Sequence
  chemically synthesized
tttgtgtgagtatacaaagtgc

SEQ ID NO: 1142795 - DNA, 22 bp, Artificial Sequence
  chemically synthesized
gtgtgagtatacaaagtgctaa

SEQ ID NO: 1142796 - DNA, 22 bp, Artificial Sequence
  chemically synthesized
cagatttattcattagcacttt

SEQ ID NO: 1142797 - DNA, 22 bp, Artificial Sequence
  chemically synthesized
tgtgagtatacaaagtgctaat

SEQ ID NO: 1142798 - DNA, 22 bp, Artificial Sequence
  chemically synthesized
ccagatttattcattagcactt

SEQ ID NO: 1142799 - DNA, 22 bp, Artificial Sequence
  chemically synthesized
tccagatttattcattagcact

SEQ ID NO: 1142800 - DNA, 22 bp, Artificial Sequence
  chemically synthesized
ttccagatttattcattagcac

SEQ ID NO: 1142801 - DNA, 22 bp, Artificial Sequence
  chemically synthesized
atgaataaatctggaaaagcct

SEQ ID NO: 1142802 - DNA, 22 bp, Artificial Sequence
  chemically synthesized
gaaaagccttttgttgttgtca

SEQ ID NO: 1142803 - DNA, 22 bp, Artificial Sequence
  chemically synthesized
caaagaataacagcagtgacaa

SEQ ID NO: 1142804 - DNA, 22 bp, Artificial Sequence
  chemically synthesized
ttgttgttgtcactgctgttat

SEQ ID NO: 1142805 - DNA, 22 bp, Artificial Sequence
  chemically synthesized
tgttgttgtcactgctgttatt

SEQ ID NO: 1142806 - DNA, 22 bp, Artificial Sequence
  chemically synthesized
gttgttgtcactgctgttattc

SEQ ID NO: 1142807 - DNA, 22 bp, Artificial Sequence
  chemically synthesized
ttgttgtcactgctgttattct

SEQ ID NO: 1142808 - DNA, 22 bp, Artificial Sequence
  chemically synthesized
ttgtcactgctgttattctttg

SEQ ID NO: 1142809 - DNA, 22 bp, Artificial Sequence
  chemically synthesized
aataatatcctgcaaagaataa

SEQ ID NO: 1142810 - DNA, 22 bp, Artificial Sequence
  chemically synthesized
tcactgctgttattctttgcag

SEQ ID NO: 1142811 - DNA, 22 bp, Artificial Sequence
  chemically synthesized
ctgttattctttgcaggatatt

SEQ ID NO: 1142812 - DNA, 22 bp, Artificial Sequence
  chemically synthesized
ttattctttgcaggatattatt

SEQ ID NO: 1142813 - DNA, 22 bp, Artificial Sequence
  chemically synthesized
ttctttgcaggatattatttaa

SEQ ID NO: 1142814 - DNA, 22 bp, Artificial Sequence
  chemically synthesized
tttgcaggatattatttaatgt

SEQ ID NO: 1142815 - DNA, 22 bp, Artificial Sequence
  chemically synthesized
tgcaggatattatttaatgtct

SEQ ID NO: 1142816 - DNA, 22 bp, Artificial Sequence
  chemically synthesized
gcaggatattatttaatgtctt

SEQ ID NO: 1142817 - DNA, 22 bp, Artificial Sequence
  chemically synthesized
caggatattatttaatgtcttt

SEQ ID NO: 1142818 - DNA, 22 bp, Artificial Sequence
  chemically synthesized
ccaaaaaaaaaaaaaaaagaca

SEQ ID NO: 1142819 - DNA, 22 bp, Artificial Sequence
  chemically synthesized
agctgccaaaaaaaaaaaaaaa

SEQ ID NO: 1142820 - DNA, 22 bp, Artificial Sequence
  chemically synthesized
tttaatgtcttttttttttttt

SEQ ID NO: 1142821 - DNA, 22 bp, Artificial Sequence
  chemically synthesized
ttaagctgccaaaaaaaaaaaa

SEQ ID NO: 1142822 - DNA, 22 bp, Artificial Sequence
  chemically synthesized
attaagctgccaaaaaaaaaaa

SEQ ID NO: 1142823 - DNA, 22 bp, Artificial Sequence
  chemically synthesized
aatgtctttttttttttttttt

SEQ ID NO: 1142824 - DNA, 22 bp, Artificial Sequence
  chemically synthesized
atgtcttttttttttttttttg

SEQ ID NO: 1142825 - DNA, 22 bp, Artificial Sequence
  chemically synthesized
ttttttttttttttggcagctt

SEQ ID NO: 1142826 - DNA, 22 bp, Artificial Sequence
  chemically synthesized
tttttttttttttggcagctta

SEQ ID NO: 1142827 - DNA, 22 bp, Artificial Sequence
  chemically synthesized
ttttttttttttggcagcttaa

SEQ ID NO: 1142828 - DNA, 22 bp, Artificial Sequence
  chemically synthesized
tttttttttttggcagcttaat

SEQ ID NO: 1142829 - DNA, 22 bp, Artificial Sequence
  chemically synthesized
ttttttttttggcagcttaata

SEQ ID NO: 1142830 - DNA, 22 bp, Artificial Sequence
  chemically synthesized
tttttttttggcagcttaataa

SEQ ID NO: 1142831 - DNA, 22 bp, Artificial Sequence
  chemically synthesized
ttttttttggcagcttaataaa

SEQ ID NO: 1142832 - DNA, 22 bp, Artificial Sequence
  chemically synthesized
gagagtacagagtttattaagc

SEQ ID NO: 1142833 - DNA, 22 bp, Artificial Sequence
  chemically synthesized
tttttttggcagcttaataaac

SEQ ID NO: 1142834 - DNA, 22 bp, Artificial Sequence
  chemically synthesized
ttttttggcagcttaataaact

SEQ ID NO: 1142835 - DNA, 22 bp, Artificial Sequence
  chemically synthesized
tttttggcagcttaataaactc

SEQ ID NO: 1142836 - DNA, 22 bp, Artificial Sequence
  chemically synthesized
ttttggcagcttaataaactct

SEQ ID NO: 1142837 - DNA, 22 bp, Artificial Sequence
  chemically synthesized
tttggcagcttaataaactctg

SEQ ID NO: 1142838 - DNA, 22 bp, Artificial Sequence
  chemically synthesized
ttggcagcttaataaactctgt

SEQ ID NO: 1142839 - DNA, 22 bp, Artificial Sequence
  chemically synthesized
tggcagcttaataaactctgta

SEQ ID NO: 1142840 - DNA, 22 bp, Artificial Sequence
  chemically synthesized
ggcagcttaataaactctgtac

SEQ ID NO: 1142841 - DNA, 22 bp, Artificial Sequence
  chemically synthesized
gcagcttaataaactctgtact

SEQ ID NO: 1142842 - DNA, 22 bp, Artificial Sequence
  chemically synthesized
gtgggagctggagagtacagag

SEQ ID NO: 1142843 - DNA, 22 bp, Artificial Sequence
  chemically synthesized
aataaactctgtactctccagc

SEQ ID NO: 1142844 - DNA, 22 bp, Artificial Sequence
  chemically synthesized
ataaactctgtactctccagct

SEQ ID NO: 1142845 - DNA, 22 bp, Artificial Sequence
  chemically synthesized
aacagactggtgggagctggag

SEQ ID NO: 1142846 - DNA, 22 bp, Artificial Sequence
  chemically synthesized
tgtactctccagctcccaccag

SEQ ID NO: 1142847 - DNA, 22 bp, Artificial Sequence
  chemically synthesized
tactctccagctcccaccagtc

SEQ ID NO: 1142848 - DNA, 22 bp, Artificial Sequence
  chemically synthesized
gtatcccaattgaacagactgg

SEQ ID NO: 1142849 - DNA, 22 bp, Artificial Sequence
  chemically synthesized
tccagctcccaccagtctgttc

SEQ ID NO: 1142850 - DNA, 22 bp, Artificial Sequence
  chemically synthesized
tggtatcccaattgaacagact

SEQ ID NO: 1142851 - DNA, 22 bp, Artificial Sequence
  chemically synthesized
cagctcccaccagtctgttcaa

SEQ ID NO: 1142852 - DNA, 22 bp, Artificial Sequence
  chemically synthesized
ctggtatcccaattgaacagac

SEQ ID NO: 1142853 - DNA, 22 bp, Artificial Sequence
  chemically synthesized
tctggtatcccaattgaacaga

SEQ ID NO: 1142854 - DNA, 22 bp, Artificial Sequence
  chemically synthesized
ttttctggtatcccaattgaac

SEQ ID NO: 1142855 - DNA, 22 bp, Artificial Sequence
  chemically synthesized
attttctggtatcccaattgaa

SEQ ID NO: 1142856 - DNA, 22 bp, Artificial Sequence
  chemically synthesized
ccaccagtctgttcaattggga

SEQ ID NO: 1142857 - DNA, 22 bp, Artificial Sequence
  chemically synthesized
tattttctggtatcccaattga

SEQ ID NO: 1142858 - DNA, 22 bp, Artificial Sequence
  chemically synthesized
tttattttctggtatcccaatt

SEQ ID NO: 1142859 - DNA, 22 bp, Artificial Sequence
  chemically synthesized
ctctttattttctggtatccca

SEQ ID NO: 1142860 - DNA, 22 bp, Artificial Sequence
  chemically synthesized
ctgctctttattttctggtatc

SEQ ID NO: 1142861 - DNA, 22 bp, Artificial Sequence
  chemically synthesized
ttcaattgggataccagaaaat

SEQ ID NO: 1142862 - DNA, 22 bp, Artificial Sequence
  chemically synthesized
aattgggataccagaaaataaa

SEQ ID NO: 1142863 - DNA, 22 bp, Artificial Sequence
  chemically synthesized
gaactcctgctctttattttct

SEQ ID NO: 1142864 - DNA, 22 bp, Artificial Sequence
  chemically synthesized
agaactcctgctctttattttc

SEQ ID NO: 1142865 - DNA, 22 bp, Artificial Sequence
  chemically synthesized
cttagaactcctgctctttatt

SEQ ID NO: 1142866 - DNA, 22 bp, Artificial Sequence
  chemically synthesized
ggataccagaaaataaagagca

SEQ ID NO: 1142867 - DNA, 22 bp, Artificial Sequence
  chemically synthesized
gaatgctccttagaactcctgc

SEQ ID NO: 1142868 - DNA, 22 bp, Artificial Sequence
  chemically synthesized
cgctggaatgctccttagaact

SEQ ID NO: 1142869 - DNA, 22 bp, Artificial Sequence
  chemically synthesized
ttacgctggaatgctccttaga

SEQ ID NO: 1142870 - DNA, 22 bp, Artificial Sequence
  chemically synthesized
gaaggaacactgttacgctgga

SEQ ID NO: 1142871 - DNA, 22 bp, Artificial Sequence
  chemically synthesized
taaggagcattccagcgtaaca

SEQ ID NO: 1142872 - DNA, 22 bp, Artificial Sequence
  chemically synthesized
aggagcattccagcgtaacagt

SEQ ID NO: 1142873 - DNA, 22 bp, Artificial Sequence
  chemically synthesized
cagcgtaacagtgttccttcca

SEQ ID NO: 1142874 - DNA, 22 bp, Artificial Sequence
  chemically synthesized
ggaatgtgatgaatgctggaag

SEQ ID NO: 1142875 - DNA, 22 bp, Artificial Sequence
  chemically synthesized
cttccagcattcatcacattcc

SEQ ID NO: 1142876 - DNA, 22 bp, Artificial Sequence
  chemically synthesized
ccaaggaatgcctgggaatgtg

SEQ ID NO: 1142877 - DNA, 22 bp, Artificial Sequence
  chemically synthesized
ccagcattcatcacattcccag

SEQ ID NO: 1142878 - DNA, 22 bp, Artificial Sequence
  chemically synthesized
cagcattcatcacattcccagg

SEQ ID NO: 1142879 - DNA, 22 bp, Artificial Sequence
  chemically synthesized
aagctaccaaggaatgcctggg

SEQ ID NO: 1142880 - DNA, 22 bp, Artificial Sequence
  chemically synthesized
atcacattcccaggcattcctt

SEQ ID NO: 1142881 - DNA, 22 bp, Artificial Sequence
  chemically synthesized
ccaggcattccttggtagcttg

SEQ ID NO: 1142882 - DNA, 22 bp, Artificial Sequence
  chemically synthesized
cttggtagcttgaggtttcctc

SEQ ID NO: 1142883 - DNA, 22 bp, Artificial Sequence
  chemically synthesized
ggtagcttgaggtttcctcttc

SEQ ID NO: 1142884 - DNA, 22 bp, Artificial Sequence
  chemically synthesized
gtagcttgaggtttcctcttcc

SEQ ID NO: 1142885 - DNA, 22 bp, Artificial Sequence
  chemically synthesized
cgaggtataaaacgataaggaa

SEQ ID NO: 1142886 - DNA, 22 bp, Artificial Sequence
  chemically synthesized
gaggtttcctcttccttatcgt

SEQ ID NO: 1142887 - DNA, 22 bp, Artificial Sequence
  chemically synthesized
aggtttcctcttccttatcgtt

SEQ ID NO: 1142888 - DNA, 22 bp, Artificial Sequence
  chemically synthesized
cctcttccttatcgttttatac

SEQ ID NO: 1142889 - DNA, 22 bp, Artificial Sequence
  chemically synthesized
agagtctgcgaggtataaaacg

SEQ ID NO: 1142890 - DNA, 22 bp, Artificial Sequence
  chemically synthesized
ctcttccttatcgttttatacc

SEQ ID NO: 1142891 - DNA, 22 bp, Artificial Sequence
  chemically synthesized
ttccttatcgttttatacctcg

SEQ ID NO: 1142892 - DNA, 22 bp, Artificial Sequence
  chemically synthesized
ccttatcgttttatacctcgca

SEQ ID NO: 1142893 - DNA, 22 bp, Artificial Sequence
  chemically synthesized
cttatcgttttatacctcgcag

SEQ ID NO: 1142894 - DNA, 22 bp, Artificial Sequence
  chemically synthesized
aaggagctcagagtctgcgagg

SEQ ID NO: 1142895 - DNA, 22 bp, Artificial Sequence
  chemically synthesized
atcgttttatacctcgcagact

SEQ ID NO: 1142896 - DNA, 22 bp, Artificial Sequence
  chemically synthesized
tcgttttatacctcgcagactc

SEQ ID NO: 1142897 - DNA, 22 bp, Artificial Sequence
  chemically synthesized
tatacctcgcagactctgagct

SEQ ID NO: 1142898 - DNA, 22 bp, Artificial Sequence
  chemically synthesized
atacctcgcagactctgagctc

SEQ ID NO: 1142899 - DNA, 22 bp, Artificial Sequence
  chemically synthesized
tacctcgcagactctgagctcc

SEQ ID NO: 1142900 - DNA, 22 bp, Artificial Sequence
  chemically synthesized
gcagactctgagctccttgagg

SEQ ID NO: 1142901 - DNA, 22 bp, Artificial Sequence
  chemically synthesized
aaaggtaaggagcccacctcaa

SEQ ID NO: 1142902 - DNA, 22 bp, Artificial Sequence
  chemically synthesized
tgagctccttgaggtgggctcc

SEQ ID NO: 1142903 - DNA, 22 bp, Artificial Sequence
  chemically synthesized
acctcaaaggtaaggagcccac

SEQ ID NO: 1142904 - DNA, 22 bp, Artificial Sequence
  chemically synthesized
agctccttgaggtgggctcctt

SEQ ID NO: 1142905 - DNA, 22 bp, Artificial Sequence
  chemically synthesized
cttgaggtgggctccttacctt

SEQ ID NO: 1142906 - DNA, 22 bp, Artificial Sequence
  chemically synthesized
gaggtgggctccttacctttga

SEQ ID NO: 1142907 - DNA, 22 bp, Artificial Sequence
  chemically synthesized
aggtgggctccttacctttgag

SEQ ID NO: 1142908 - DNA, 22 bp, Artificial Sequence
  chemically synthesized
tgcaagacattaacctcaaagg

SEQ ID NO: 1142909 - DNA, 22 bp, Artificial Sequence
  chemically synthesized
gtgcaagacattaacctcaaag

SEQ ID NO: 1142910 - DNA, 22 bp, Artificial Sequence
  chemically synthesized
cttacctttgaggttaatgtct

SEQ ID NO: 1142911 - DNA, 22 bp, Artificial Sequence
  chemically synthesized
ggatatttgtgcaagacattaa

SEQ ID NO: 1142912 - DNA, 22 bp, Artificial Sequence
  chemically synthesized
gggatatttgtgcaagacatta

SEQ ID NO: 1142913 - DNA, 22 bp, Artificial Sequence
  chemically synthesized
acctttgaggttaatgtcttgc

SEQ ID NO: 1142914 - DNA, 22 bp, Artificial Sequence
  chemically synthesized
tgggatatttgtgcaagacatt

SEQ ID NO: 1142915 - DNA, 22 bp, Artificial Sequence
  chemically synthesized
cctttgaggttaatgtcttgca

SEQ ID NO: 1142916 - DNA, 22 bp, Artificial Sequence
  chemically synthesized
tgaggttaatgtcttgcacaaa

SEQ ID NO: 1142917 - DNA, 22 bp, Artificial Sequence
  chemically synthesized
agttttgggatatttgtgcaag

SEQ ID NO: 1142918 - DNA, 22 bp, Artificial Sequence
  chemically synthesized
gaggttaatgtcttgcacaaat

SEQ ID NO: 1142919 - DNA, 22 bp, Artificial Sequence
  chemically synthesized
aggttaatgtcttgcacaaata

SEQ ID NO: 1142920 - DNA, 22 bp, Artificial Sequence
  chemically synthesized
atgtcttgcacaaatatcccaa

SEQ ID NO: 1142921 - DNA, 22 bp, Artificial Sequence
  chemically synthesized
gcacaaatatcccaaaactgaa

SEQ ID NO: 1142922 - DNA, 22 bp, Artificial Sequence
  chemically synthesized
cacaaatatcccaaaactgaat

SEQ ID NO: 1142923 - DNA, 22 bp, Artificial Sequence
  chemically synthesized
ataacgacagtagtagtattca

SEQ ID NO: 1142924 - DNA, 22 bp, Artificial Sequence
  chemically synthesized
ttgataacgacagtagtagtat

SEQ ID NO: 1142925 - DNA, 22 bp, Artificial Sequence
  chemically synthesized
aatactactactgtcgttatca

SEQ ID NO: 1142926 - DNA, 22 bp, Artificial Sequence
  chemically synthesized
ctactgtcgttatcaataggtg

SEQ ID NO: 1142927 - DNA, 22 bp, Artificial Sequence
  chemically synthesized
ggtggggaaagccacctattga

SEQ ID NO: 1142928 - DNA, 22 bp, Artificial Sequence
  chemically synthesized
ctgtcgttatcaataggtggct

SEQ ID NO: 1142929 - DNA, 22 bp, Artificial Sequence
  chemically synthesized
tcgttatcaataggtggctttc

SEQ ID NO: 1142930 - DNA, 22 bp, Artificial Sequence
  chemically synthesized
tcaataggtggctttccccacc

SEQ ID NO: 1142931 - DNA, 22 bp, Artificial Sequence
  chemically synthesized
agacaaaagttgggtggggaaa

SEQ ID NO: 1142932 - DNA, 22 bp, Artificial Sequence
  chemically synthesized
taagacaaaagttgggtgggga

SEQ ID NO: 1142933 - DNA, 22 bp, Artificial Sequence
  chemically synthesized
tccccacccaacttttgtctta

SEQ ID NO: 1142934 - DNA, 22 bp, Artificial Sequence
  chemically synthesized
ccccacccaacttttgtcttag

SEQ ID NO: 1142935 - DNA, 22 bp, Artificial Sequence
  chemically synthesized
cccacccaacttttgtcttaga

SEQ ID NO: 1142936 - DNA, 22 bp, Artificial Sequence
  chemically synthesized
aaagatccaaaaaagatggttc

SEQ ID NO: 1142937 - DNA, 22 bp, Artificial Sequence
  chemically synthesized
ttgtcttagaaccatctttttt

SEQ ID NO: 1142938 - DNA, 22 bp, Artificial Sequence
  chemically synthesized
tgtcttagaaccatcttttttg

SEQ ID NO: 1142939 - DNA, 22 bp, Artificial Sequence
  chemically synthesized
gtcttagaaccatcttttttgg

SEQ ID NO: 1142940 - DNA, 22 bp, Artificial Sequence
  chemically synthesized
tcttagaaccatcttttttgga

SEQ ID NO: 1142941 - DNA, 22 bp, Artificial Sequence
  chemically synthesized
gcagattgaaagatccaaaaaa

SEQ ID NO: 1142942 - DNA, 22 bp, Artificial Sequence
  chemically synthesized
agaaccatcttttttggatctt

SEQ ID NO: 1142943 - DNA, 22 bp, Artificial Sequence
  chemically synthesized
gaaccatcttttttggatcttt

SEQ ID NO: 1142944 - DNA, 22 bp, Artificial Sequence
  chemically synthesized
tgtaatgattagcagattgaaa

SEQ ID NO: 1142945 - DNA, 22 bp, Artificial Sequence
  chemically synthesized
atgtaatgattagcagattgaa

SEQ ID NO: 1142946 - DNA, 22 bp, Artificial Sequence
  chemically synthesized
tatgtaatgattagcagattga

SEQ ID NO: 1142947 - DNA, 22 bp, Artificial Sequence
  chemically synthesized
ttttggatctttcaatctgcta

SEQ ID NO: 1142948 - DNA, 22 bp, Artificial Sequence
  chemically synthesized
tttggatctttcaatctgctaa

SEQ ID NO: 1142949 - DNA, 22 bp, Artificial Sequence
  chemically synthesized
ttggatctttcaatctgctaat

SEQ ID NO: 1142950 - DNA, 22 bp, Artificial Sequence
  chemically synthesized
tggatctttcaatctgctaatc

SEQ ID NO: 1142951 - DNA, 22 bp, Artificial Sequence
  chemically synthesized
ggatctttcaatctgctaatca

SEQ ID NO: 1142952 - DNA, 22 bp, Artificial Sequence
  chemically synthesized
tactttatgtaatgattagcag

SEQ ID NO: 1142953 - DNA, 22 bp, Artificial Sequence
  chemically synthesized
gatctttcaatctgctaatcat

SEQ ID NO: 1142954 - DNA, 22 bp, Artificial Sequence
  chemically synthesized
atactttatgtaatgattagca

SEQ ID NO: 1142955 - DNA, 22 bp, Artificial Sequence
  chemically synthesized
tcaatctgctaatcattacata

SEQ ID NO: 1142956 - DNA, 22 bp, Artificial Sequence
  chemically synthesized
caatctgctaatcattacataa

SEQ ID NO: 1142957 - DNA, 22 bp, Artificial Sequence
  chemically synthesized
aatctgctaatcattacataaa

SEQ ID NO: 1142958 - DNA, 22 bp, Artificial Sequence
  chemically synthesized
ctaatcattacataaagtataa

SEQ ID NO: 1142959 - DNA, 22 bp, Artificial Sequence
  chemically synthesized
atcattacataaagtataaact

SEQ ID NO: 1142960 - DNA, 22 bp, Artificial Sequence
  chemically synthesized
aagtgggaatgcaggaagttta

SEQ ID NO: 1142961 - DNA, 22 bp, Artificial Sequence
  chemically synthesized
cataaagtataaacttcctgca

SEQ ID NO: 1142962 - DNA, 22 bp, Artificial Sequence
  chemically synthesized
ggcaacagtagaactgaagtgg

SEQ ID NO: 1142963 - DNA, 22 bp, Artificial Sequence
  chemically synthesized
cctgcattcccacttcagttct

SEQ ID NO: 1142964 - DNA, 22 bp, Artificial Sequence
  chemically synthesized
ctgcattcccacttcagttcta

SEQ ID NO: 1142965 - DNA, 22 bp, Artificial Sequence
  chemically synthesized
cattcccacttcagttctactg

SEQ ID NO: 1142966 - DNA, 22 bp, Artificial Sequence
  chemically synthesized
caaagttgggcaacagtagaac

SEQ ID NO: 1142967 - DNA, 22 bp, Artificial Sequence
  chemically synthesized
ccacttcagttctactgttgcc

SEQ ID NO: 1142968 - DNA, 22 bp, Artificial Sequence
  chemically synthesized
cagttctactgttgcccaactt

SEQ ID NO: 1142969 - DNA, 22 bp, Artificial Sequence
  chemically synthesized
acagatattacaaagttgggca

SEQ ID NO: 1142970 - DNA, 22 bp, Artificial Sequence
  chemically synthesized
agttctactgttgcccaacttt

SEQ ID NO: 1142971 - DNA, 22 bp, Artificial Sequence
  chemically synthesized
ttcacagatattacaaagttgg

SEQ ID NO: 1142972 - DNA, 22 bp, Artificial Sequence
  chemically synthesized
gttcacagatattacaaagttg

SEQ ID NO: 1142973 - DNA, 22 bp, Artificial Sequence
  chemically synthesized
tactgttgcccaactttgtaat

SEQ ID NO: 1142974 - DNA, 22 bp, Artificial Sequence
  chemically synthesized
ctgttgcccaactttgtaatat

SEQ ID NO: 1142975 - DNA, 22 bp, Artificial Sequence
  chemically synthesized
agtttgttcacagatattacaa

SEQ ID NO: 1142976 - DNA, 22 bp, Artificial Sequence
  chemically synthesized
ttgcccaactttgtaatatctg

SEQ ID NO: 1142977 - DNA, 22 bp, Artificial Sequence
  chemically synthesized
cccaactttgtaatatctgtga

SEQ ID NO: 1142978 - DNA, 22 bp, Artificial Sequence
  chemically synthesized
tgtaatatctgtgaacaaactc

SEQ ID NO: 1142979 - DNA, 22 bp, Artificial Sequence
  chemically synthesized
gtaatatctgtgaacaaactca

SEQ ID NO: 1142980 - DNA, 22 bp, Artificial Sequence
  chemically synthesized
taatatctgtgaacaaactcaa

SEQ ID NO: 1142981 - DNA, 22 bp, Artificial Sequence
  chemically synthesized
aagcacagcaagattgagtttg

SEQ ID NO: 1142982 - DNA, 22 bp, Artificial Sequence
  chemically synthesized
tgaacaaactcaatcttgctgt

SEQ ID NO: 1142983 - DNA, 22 bp, Artificial Sequence
  chemically synthesized
gtgagaaaactaaagcacagca

SEQ ID NO: 1142984 - DNA, 22 bp, Artificial Sequence
  chemically synthesized
actggtgagaaaactaaagcac

SEQ ID NO: 1142985 - DNA, 22 bp, Artificial Sequence
  chemically synthesized
cactggtgagaaaactaaagca

SEQ ID NO: 1142986 - DNA, 22 bp, Artificial Sequence
  chemically synthesized
aatcttgctgtgctttagtttt

SEQ ID NO: 1142987 - DNA, 22 bp, Artificial Sequence
  chemically synthesized
tttcactggtgagaaaactaaa

SEQ ID NO: 1142988 - DNA, 22 bp, Artificial Sequence
  chemically synthesized
tatttcactggtgagaaaacta

SEQ ID NO: 1142989 - DNA, 22 bp, Artificial Sequence
  chemically synthesized
gctgtgctttagttttctcacc

SEQ ID NO: 1142990 - DNA, 22 bp, Artificial Sequence
  chemically synthesized
ctgtgctttagttttctcacca

SEQ ID NO: 1142991 - DNA, 22 bp, Artificial Sequence
  chemically synthesized
tctctatttcactggtgagaaa

SEQ ID NO: 1142992 - DNA, 22 bp, Artificial Sequence
  chemically synthesized
tgctttagttttctcaccagtg

SEQ ID NO: 1142993 - DNA, 22 bp, Artificial Sequence
  chemically synthesized
ttatctctatttcactggtgag

SEQ ID NO: 1142994 - DNA, 22 bp, Artificial Sequence
  chemically synthesized
tagttttctcaccagtgaaata

SEQ ID NO: 1142995 - DNA, 22 bp, Artificial Sequence
  chemically synthesized
tactattatctctatttcactg

SEQ ID NO: 1142996 - DNA, 22 bp, Artificial Sequence
  chemically synthesized
agttttctcaccagtgaaatag

SEQ ID NO: 1142997 - DNA, 22 bp, Artificial Sequence
  chemically synthesized
gttttctcaccagtgaaataga

SEQ ID NO: 1142998 - DNA, 22 bp, Artificial Sequence
  chemically synthesized
tctcaccagtgaaatagagata

SEQ ID NO: 1142999 - DNA, 22 bp, Artificial Sequence
  chemically synthesized
ctcaccagtgaaatagagataa

SEQ ID NO: 1143000 - DNA, 22 bp, Artificial Sequence
  chemically synthesized
tcaccagtgaaatagagataat

SEQ ID NO: 1143001 - DNA, 22 bp, Artificial Sequence
  chemically synthesized
accagtgaaatagagataatag

SEQ ID NO: 1143002 - DNA, 22 bp, Artificial Sequence
  chemically synthesized
ggagagtctgtactattatctc

SEQ ID NO: 1143003 - DNA, 22 bp, Artificial Sequence
  chemically synthesized
tctaggagagtctgtactatta

SEQ ID NO: 1143004 - DNA, 22 bp, Artificial Sequence
  chemically synthesized
cctgtctaggagagtctgtact

SEQ ID NO: 1143005 - DNA, 22 bp, Artificial Sequence
  chemically synthesized
gcagttacctgtctaggagagt

SEQ ID NO: 1143006 - DNA, 22 bp, Artificial Sequence
  chemically synthesized
accctagcagttacctgtctag

SEQ ID NO: 1143007 - DNA, 22 bp, Artificial Sequence
  chemically synthesized
tctgaccctagcagttacctgt

SEQ ID NO: 1143008 - DNA, 22 bp, Artificial Sequence
  chemically synthesized
atctatctgaccctagcagtta

SEQ ID NO: 1143009 - DNA, 22 bp, Artificial Sequence
  chemically synthesized
tcctagacaggtaactgctagg

SEQ ID NO: 1143010 - DNA, 22 bp, Artificial Sequence
  chemically synthesized
ctagacaggtaactgctagggt

SEQ ID NO: 1143011 - DNA, 22 bp, Artificial Sequence
  chemically synthesized
ttgatctatctgaccctagcag

SEQ ID NO: 1143012 - DNA, 22 bp, Artificial Sequence
  chemically synthesized
attgatctatctgaccctagca

SEQ ID NO: 1143013 - DNA, 22 bp, Artificial Sequence
  chemically synthesized
gacaggtaactgctagggtcag

SEQ ID NO: 1143014 - DNA, 22 bp, Artificial Sequence
  chemically synthesized
acatttattgatctatctgacc

SEQ ID NO: 1143015 - DNA, 22 bp, Artificial Sequence
  chemically synthesized
cacatttattgatctatctgac

SEQ ID NO: 1143016 - DNA, 22 bp, Artificial Sequence
  chemically synthesized
tcacatttattgatctatctga

SEQ ID NO: 1143017 - DNA, 22 bp, Artificial Sequence
  chemically synthesized
ctagggtcagatagatcaataa

SEQ ID NO: 1143018 - DNA, 22 bp, Artificial Sequence
  chemically synthesized
gggtcagatagatcaataaatg

SEQ ID NO: 1143019 - DNA, 22 bp, Artificial Sequence
  chemically synthesized
agagcactttcacatttattga

SEQ ID NO: 1143020 - DNA, 22 bp, Artificial Sequence
  chemically synthesized
aagagcactttcacatttattg

SEQ ID NO: 1143021 - DNA, 22 bp, Artificial Sequence
  chemically synthesized
atcacagatttaagagcacttt

SEQ ID NO: 1143022 - DNA, 22 bp, Artificial Sequence
  chemically synthesized
aataattcatcacagatttaag

SEQ ID NO: 1143023 - DNA, 22 bp, Artificial Sequence
  chemically synthesized
ttaaatctgtgatgaattattg

SEQ ID NO: 1143024 - DNA, 22 bp, Artificial Sequence
  chemically synthesized
tcacaagcatctcaataattca

SEQ ID NO: 1143025 - DNA, 22 bp, Artificial Sequence
  chemically synthesized
aaatctgtgatgaattattgag

SEQ ID NO: 1143026 - DNA, 22 bp, Artificial Sequence
  chemically synthesized
aatctgtgatgaattattgaga

SEQ ID NO: 1143027 - DNA, 22 bp, Artificial Sequence
  chemically synthesized
ctatcacaagcatctcaataat

SEQ ID NO: 1143028 - DNA, 22 bp, Artificial Sequence
  chemically synthesized
actatcacaagcatctcaataa

SEQ ID NO: 1143029 - DNA, 22 bp, Artificial Sequence
  chemically synthesized
tgatgaattattgagatgcttg

SEQ ID NO: 1143030 - DNA, 22 bp, Artificial Sequence
  chemically synthesized
aatccttactatcacaagcatc

SEQ ID NO: 1143031 - DNA, 22 bp, Artificial Sequence
  chemically synthesized
taaatccttactatcacaagca

SEQ ID NO: 1143032 - DNA, 22 bp, Artificial Sequence
  chemically synthesized
agctctaaatccttactatcac

SEQ ID NO: 1143033 - DNA, 22 bp, Artificial Sequence
  chemically synthesized
ttgagatgcttgtgatagtaag

SEQ ID NO: 1143034 - DNA, 22 bp, Artificial Sequence
  chemically synthesized
agatgcttgtgatagtaaggat

SEQ ID NO: 1143035 - DNA, 22 bp, Artificial Sequence
  chemically synthesized
tcgactgagctctaaatcctta

SEQ ID NO: 1143036 - DNA, 22 bp, Artificial Sequence
  chemically synthesized
atcgactgagctctaaatcctt

SEQ ID NO: 1143037 - DNA, 22 bp, Artificial Sequence
  chemically synthesized
tatcgactgagctctaaatcct

SEQ ID NO: 1143038 - DNA, 22 bp, Artificial Sequence
  chemically synthesized
ttatcgactgagctctaaatcc

SEQ ID NO: 1143039 - DNA, 22 bp, Artificial Sequence
  chemically synthesized
tttatcgactgagctctaaatc

SEQ ID NO: 1143040 - DNA, 22 bp, Artificial Sequence
  chemically synthesized
gtgatagtaaggatttagagct

SEQ ID NO: 1143041 - DNA, 22 bp, Artificial Sequence
  chemically synthesized
ttttatcgactgagctctaaat

SEQ ID NO: 1143042 - DNA, 22 bp, Artificial Sequence
  chemically synthesized
tgatagtaaggatttagagctc

SEQ ID NO: 1143043 - DNA, 22 bp, Artificial Sequence
  chemically synthesized
atttttttatcgactgagctct

SEQ ID NO: 1143044 - DNA, 22 bp, Artificial Sequence
  chemically synthesized
agagctcagtcgataaaaaaat

SEQ ID NO: 1143045 - DNA, 22 bp, Artificial Sequence
  chemically synthesized
gaataaaggctgatttttttat

SEQ ID NO: 1143046 - DNA, 22 bp, Artificial Sequence
  chemically synthesized
gagctcagtcgataaaaaaatc

SEQ ID NO: 1143047 - DNA, 22 bp, Artificial Sequence
  chemically synthesized
agtcgataaaaaaatcagcctt

SEQ ID NO: 1143048 - DNA, 22 bp, Artificial Sequence
  chemically synthesized
tcacatctggaataaaggctga

SEQ ID NO: 1143049 - DNA, 22 bp, Artificial Sequence
  chemically synthesized
atcacatctggaataaaggctg

SEQ ID NO: 1143050 - DNA, 22 bp, Artificial Sequence
  chemically synthesized
cagatttatcacatctggaata

SEQ ID NO: 1143051 - DNA, 22 bp, Artificial Sequence
  chemically synthesized
tcatgctccagatttatcacat

SEQ ID NO: 1143052 - DNA, 22 bp, Artificial Sequence
  chemically synthesized
tatcatgctccagatttatcac

SEQ ID NO: 1143053 - DNA, 22 bp, Artificial Sequence
  chemically synthesized
tattccagatgtgataaatctg

SEQ ID NO: 1143054 - DNA, 22 bp, Artificial Sequence
  chemically synthesized
attccagatgtgataaatctgg

SEQ ID NO: 1143055 - DNA, 22 bp, Artificial Sequence
  chemically synthesized
ttccagatgtgataaatctgga

SEQ ID NO: 1143056 - DNA, 22 bp, Artificial Sequence
  chemically synthesized
aaattctatcatgctccagatt

SEQ ID NO: 1143057 - DNA, 22 bp, Artificial Sequence
  chemically synthesized
cagatgtgataaatctggagca

SEQ ID NO: 1143058 - DNA, 22 bp, Artificial Sequence
  chemically synthesized
tattaaaattctatcatgctcc

SEQ ID NO: 1143059 - DNA, 22 bp, Artificial Sequence
  chemically synthesized
tatattaaaattctatcatgct

SEQ ID NO: 1143060 - DNA, 22 bp, Artificial Sequence
  chemically synthesized
tgttctatattaaaattctatc

SEQ ID NO: 1143061 - DNA, 22 bp, Artificial Sequence
  chemically synthesized
actgtgttctatattaaaattc

SEQ ID NO: 1143062 - DNA, 22 bp, Artificial Sequence
  chemically synthesized
cactgtgttctatattaaaatt

SEQ ID NO: 1143063 - DNA, 22 bp, Artificial Sequence
  chemically synthesized
gagcatgatagaattttaatat

SEQ ID NO: 1143064 - DNA, 22 bp, Artificial Sequence
  chemically synthesized
aaatgtttcactgtgttctata

SEQ ID NO: 1143065 - DNA, 22 bp, Artificial Sequence
  chemically synthesized
taaaatgtttcactgtgttcta

SEQ ID NO: 1143066 - DNA, 22 bp, Artificial Sequence
  chemically synthesized
ctaaaatgtttcactgtgttct

SEQ ID NO: 1143067 - DNA, 22 bp, Artificial Sequence
  chemically synthesized
tccttctaaaatgtttcactgt

SEQ ID NO: 1143068 - DNA, 22 bp, Artificial Sequence
  chemically synthesized
taatatagaacacagtgaaaca

SEQ ID NO: 1143069 - DNA, 22 bp, Artificial Sequence
  chemically synthesized
aatatagaacacagtgaaacat

SEQ ID NO: 1143070 - DNA, 22 bp, Artificial Sequence
  chemically synthesized
atatagaacacagtgaaacatt

SEQ ID NO: 1143071 - DNA, 22 bp, Artificial Sequence
  chemically synthesized
attgtccttctaaaatgtttca

SEQ ID NO: 1143072 - DNA, 22 bp, Artificial Sequence
  chemically synthesized
tcattaattgtccttctaaaat

SEQ ID NO: 1143073 - DNA, 22 bp, Artificial Sequence
  chemically synthesized
tagaaggacaattaatgataat

SEQ ID NO: 1143074 - DNA, 22 bp, Artificial Sequence
  chemically synthesized
agaaggacaattaatgataatt

SEQ ID NO: 1143075 - DNA, 22 bp, Artificial Sequence
  chemically synthesized
gaaggacaattaatgataattt

SEQ ID NO: 1143076 - DNA, 22 bp, Artificial Sequence
  chemically synthesized
atgataattttttttgcatttt

SEQ ID NO: 1143077 - DNA, 22 bp, Artificial Sequence
  chemically synthesized
tcaagtatagaaaaaaatgcaa

SEQ ID NO: 1143078 - DNA, 22 bp, Artificial Sequence
  chemically synthesized
atcaagtatagaaaaaaatgca

SEQ ID NO: 1143079 - DNA, 22 bp, Artificial Sequence
  chemically synthesized
tatcaagtatagaaaaaaatgc

SEQ ID NO: 1143080 - DNA, 22 bp, Artificial Sequence
  chemically synthesized
tttttgcatttttttctatact

SEQ ID NO: 1143081 - DNA, 22 bp, Artificial Sequence
  chemically synthesized
ttttgcatttttttctatactt

SEQ ID NO: 1143082 - DNA, 22 bp, Artificial Sequence
  chemically synthesized
tttgcatttttttctatacttg

SEQ ID NO: 1143083 - DNA, 22 bp, Artificial Sequence
  chemically synthesized
ttgcatttttttctatacttga

SEQ ID NO: 1143084 - DNA, 22 bp, Artificial Sequence
  chemically synthesized
tgcatttttttctatacttgat

SEQ ID NO: 1143085 - DNA, 22 bp, Artificial Sequence
  chemically synthesized
gcatttttttctatacttgata

SEQ ID NO: 1143086 - DNA, 22 bp, Artificial Sequence
  chemically synthesized
catttttttctatacttgataa

SEQ ID NO: 1143087 - DNA, 22 bp, Artificial Sequence
  chemically synthesized
tataaaacataagctttatcaa

SEQ ID NO: 1143088 - DNA, 22 bp, Artificial Sequence
  chemically synthesized
gtataaaacataagctttatca

SEQ ID NO: 1143089 - DNA, 22 bp, Artificial Sequence
  chemically synthesized
ttttctatacttgataaagctt

SEQ ID NO: 1143090 - DNA, 22 bp, Artificial Sequence
  chemically synthesized
tttctatacttgataaagctta

SEQ ID NO: 1143091 - DNA, 22 bp, Artificial Sequence
  chemically synthesized
ttgtataaaacataagctttat

SEQ ID NO: 1143092 - DNA, 22 bp, Artificial Sequence
  chemically synthesized
ttctatacttgataaagcttat

SEQ ID NO: 1143093 - DNA, 22 bp, Artificial Sequence
  chemically synthesized
tctatacttgataaagcttatg

SEQ ID NO: 1143094 - DNA, 22 bp, Artificial Sequence
  chemically synthesized
ctatacttgataaagcttatgt

SEQ ID NO: 1143095 - DNA, 22 bp, Artificial Sequence
  chemically synthesized
tatacttgataaagcttatgtt

SEQ ID NO: 1143096 - DNA, 22 bp, Artificial Sequence
  chemically synthesized
aattcttgtataaaacataagc

SEQ ID NO: 1143097 - DNA, 22 bp, Artificial Sequence
  chemically synthesized
tacttgataaagcttatgtttt

SEQ ID NO: 1143098 - DNA, 22 bp, Artificial Sequence
  chemically synthesized
caattcttgtataaaacataag

SEQ ID NO: 1143099 - DNA, 22 bp, Artificial Sequence
  chemically synthesized
tcaattcttgtataaaacataa

SEQ ID NO: 1143100 - DNA, 22 bp, Artificial Sequence
  chemically synthesized
gataaagcttatgttttataca

SEQ ID NO: 1143101 - DNA, 22 bp, Artificial Sequence
  chemically synthesized
ataaagcttatgttttatacaa

SEQ ID NO: 1143102 - DNA, 22 bp, Artificial Sequence
  chemically synthesized
atgttttatacaagaattgaaa

SEQ ID NO: 1143103 - DNA, 22 bp, Artificial Sequence
  chemically synthesized
tgttttatacaagaattgaaaa

SEQ ID NO: 1143104 - DNA, 22 bp, Artificial Sequence
  chemically synthesized
taaaggtaaaaattttcaattc

SEQ ID NO: 1143105 - DNA, 22 bp, Artificial Sequence
  chemically synthesized
tatacaagaattgaaaattttt

SEQ ID NO: 1143106 - DNA, 22 bp, Artificial Sequence
  chemically synthesized
atacaagaattgaaaattttta

SEQ ID NO: 1143107 - DNA, 22 bp, Artificial Sequence
  chemically synthesized
aaattgtaaaggtaaaaatttt

SEQ ID NO: 1143108 - DNA, 22 bp, Artificial Sequence
  chemically synthesized
tacaagaattgaaaatttttac

SEQ ID NO: 1143109 - DNA, 22 bp, Artificial Sequence
  chemically synthesized
aaaattgtaaaggtaaaaattt

SEQ ID NO: 1143110 - DNA, 22 bp, Artificial Sequence
  chemically synthesized
tttaaaattgtaaaggtaaaaa

SEQ ID NO: 1143111 - DNA, 22 bp, Artificial Sequence
  chemically synthesized
ttgtttaaaattgtaaaggtaa

SEQ ID NO: 1143112 - DNA, 22 bp, Artificial Sequence
  chemically synthesized
aaaatttttacctttacaattt

SEQ ID NO: 1143113 - DNA, 22 bp, Artificial Sequence
  chemically synthesized
ttacctttacaattttaaacaa

SEQ ID NO: 1143114 - DNA, 22 bp, Artificial Sequence
  chemically synthesized
tacctttacaattttaaacaac

SEQ ID NO: 1143115 - DNA, 22 bp, Artificial Sequence
  chemically synthesized
gaatatggccctgttgtttaaa

SEQ ID NO: 1143116 - DNA, 22 bp, Artificial Sequence
  chemically synthesized
acctttacaattttaaacaaca

SEQ ID NO: 1143117 - DNA, 22 bp, Artificial Sequence
  chemically synthesized
cctttacaattttaaacaacag

SEQ ID NO: 1143118 - DNA, 22 bp, Artificial Sequence
  chemically synthesized
ttggaatatggccctgttgttt

SEQ ID NO: 1143119 - DNA, 22 bp, Artificial Sequence
  chemically synthesized
tacaattttaaacaacagggcc

SEQ ID NO: 1143120 - DNA, 22 bp, Artificial Sequence
  chemically synthesized
acaattttaaacaacagggcca

SEQ ID NO: 1143121 - DNA, 22 bp, Artificial Sequence
  chemically synthesized
caattttaaacaacagggccat

SEQ ID NO: 1143122 - DNA, 22 bp, Artificial Sequence
  chemically synthesized
taaacaacagggccatattcca

SEQ ID NO: 1143123 - DNA, 22 bp, Artificial Sequence
  chemically synthesized
aaacaacagggccatattccaa

SEQ ID NO: 1143124 - DNA, 22 bp, Artificial Sequence
  chemically synthesized
aacaacagggccatattccaat

SEQ ID NO: 1143125 - DNA, 22 bp, Artificial Sequence
  chemically synthesized
aaagaaaaagaaaaaaaggata

SEQ ID NO: 1143126 - DNA, 22 bp, Artificial Sequence
  chemically synthesized
tctcaaagaaaaagaaaaaaag

SEQ ID NO: 1143127 - DNA, 22 bp, Artificial Sequence
  chemically synthesized
caataggtatcctttttttctt

SEQ ID NO: 1143128 - DNA, 22 bp, Artificial Sequence
  chemically synthesized
tgtctcaaagaaaaagaaaaaa

SEQ ID NO: 1143129 - DNA, 22 bp, Artificial Sequence
  chemically synthesized
tttttctttttctttgagacag

SEQ ID NO: 1143130 - DNA, 22 bp, Artificial Sequence
  chemically synthesized
ttttctttttctttgagacaga

SEQ ID NO: 1143131 - DNA, 22 bp, Artificial Sequence
  chemically synthesized
tttctttttctttgagacagag

SEQ ID NO: 1143132 - DNA, 22 bp, Artificial Sequence
  chemically synthesized
ttctttttctttgagacagagt

SEQ ID NO: 1143133 - DNA, 22 bp, Artificial Sequence
  chemically synthesized
tctttttctttgagacagagtc

SEQ ID NO: 1143134 - DNA, 22 bp, Artificial Sequence
  chemically synthesized
ctttttctttgagacagagtct

SEQ ID NO: 1143135 - DNA, 22 bp, Artificial Sequence
  chemically synthesized
ggggacagagaaagactctgtc

SEQ ID NO: 1143136 - DNA, 22 bp, Artificial Sequence
  chemically synthesized
tttttctttgagacagagtctt

SEQ ID NO: 1143137 - DNA, 22 bp, Artificial Sequence
  chemically synthesized
tttctttgagacagagtctttc

SEQ ID NO: 1143138 - DNA, 22 bp, Artificial Sequence
  chemically synthesized
ttctttgagacagagtctttct

SEQ ID NO: 1143139 - DNA, 22 bp, Artificial Sequence
  chemically synthesized
tctttgagacagagtctttctc

SEQ ID NO: 1143140 - DNA, 22 bp, Artificial Sequence
  chemically synthesized
ctttgagacagagtctttctct

SEQ ID NO: 1143141 - DNA, 22 bp, Artificial Sequence
  chemically synthesized
tttgagacagagtctttctctg

SEQ ID NO: 1143142 - DNA, 22 bp, Artificial Sequence
  chemically synthesized
cagcctaggggacagagaaaga

SEQ ID NO: 1143143 - DNA, 22 bp, Artificial Sequence
  chemically synthesized
tgagacagagtctttctctgtc

SEQ ID NO: 1143144 - DNA, 22 bp, Artificial Sequence
  chemically synthesized
tccagcctaggggacagagaaa

SEQ ID NO: 1143145 - DNA, 22 bp, Artificial Sequence
  chemically synthesized
gagacagagtctttctctgtcc

SEQ ID NO: 1143146 - DNA, 22 bp, Artificial Sequence
  chemically synthesized
agacagagtctttctctgtccc

SEQ ID NO: 1143147 - DNA, 22 bp, Artificial Sequence
  chemically synthesized
ctctccagcctaggggacagag

SEQ ID NO: 1143148 - DNA, 22 bp, Artificial Sequence
  chemically synthesized
tctctgtcccctaggctggaga

SEQ ID NO: 1143149 - DNA, 22 bp, Artificial Sequence
  chemically synthesized
ctctgtcccctaggctggagag

SEQ ID NO: 1143150 - DNA, 22 bp, Artificial Sequence
  chemically synthesized
tctgtcccctaggctggagagc

SEQ ID NO: 1143151 - DNA, 22 bp, Artificial Sequence
  chemically synthesized
tgtcccctaggctggagagcag

SEQ ID NO: 1143152 - DNA, 22 bp, Artificial Sequence
  chemically synthesized
tcccctaggctggagagcagtg

SEQ ID NO: 1143153 - DNA, 22 bp, Artificial Sequence
  chemically synthesized
ggctggagagcagtggcgcgat

SEQ ID NO: 1143154 - DNA, 22 bp, Artificial Sequence
  chemically synthesized
cagtgagccgagatcgcgccac

SEQ ID NO: 1143155 - DNA, 22 bp, Artificial Sequence
  chemically synthesized
gagagcagtggcgcgatctcgg

SEQ ID NO: 1143156 - DNA, 22 bp, Artificial Sequence
  chemically synthesized
ggtggtggaggttgcagtgagc

SEQ ID NO: 1143157 - DNA, 22 bp, Artificial Sequence
  chemically synthesized
gggtggtggaggttgcagtgag

SEQ ID NO: 1143158 - DNA, 22 bp, Artificial Sequence
  chemically synthesized
aacttgggtggtggaggttgca

SEQ ID NO: 1143159 - DNA, 22 bp, Artificial Sequence
  chemically synthesized
gaacttgggtggtggaggttgc

SEQ ID NO: 1143160 - DNA, 22 bp, Artificial Sequence
  chemically synthesized
ggctcactgcaacctccaccac

SEQ ID NO: 1143161 - DNA, 22 bp, Artificial Sequence
  chemically synthesized
actgcaacctccaccacccaag

SEQ ID NO: 1143162 - DNA, 22 bp, Artificial Sequence
  chemically synthesized
caacctccaccacccaagttca

SEQ ID NO: 1143163 - DNA, 22 bp, Artificial Sequence
  chemically synthesized
aggcacaagaatcccttgaact

SEQ ID NO: 1143164 - DNA, 22 bp, Artificial Sequence
  chemically synthesized
caccacccaagttcaagggatt

SEQ ID NO: 1143165 - DNA, 22 bp, Artificial Sequence
  chemically synthesized
ggaaactgaggcacaagaatcc

SEQ ID NO: 1143166 - DNA, 22 bp, Artificial Sequence
  chemically synthesized
gggaaactgaggcacaagaatc

SEQ ID NO: 1143167 - DNA, 22 bp, Artificial Sequence
  chemically synthesized
cttgggaaactgaggcacaaga

SEQ ID NO: 1143168 - DNA, 22 bp, Artificial Sequence
  chemically synthesized
aagggattcttgtgcctcagtt

SEQ ID NO: 1143169 - DNA, 22 bp, Artificial Sequence
  chemically synthesized
taatcccagctacttgggaaac

SEQ ID NO: 1143170 - DNA, 22 bp, Artificial Sequence
  chemically synthesized
ttgtgcctcagtttcccaagta

SEQ ID NO: 1143171 - DNA, 22 bp, Artificial Sequence
  chemically synthesized
gtgcctcagtttcccaagtagc

SEQ ID NO: 1143172 - DNA, 22 bp, Artificial Sequence
  chemically synthesized
tgcctcagtttcccaagtagct

SEQ ID NO: 1143173 - DNA, 22 bp, Artificial Sequence
  chemically synthesized
acacctgtaatcccagctactt

SEQ ID NO: 1143174 - DNA, 22 bp, Artificial Sequence
  chemically synthesized
agtttcccaagtagctgggatt

SEQ ID NO: 1143175 - DNA, 22 bp, Artificial Sequence
  chemically synthesized
cccaagtagctgggattacagg

SEQ ID NO: 1143176 - DNA, 22 bp, Artificial Sequence
  chemically synthesized
ccaagtagctgggattacaggt

SEQ ID NO: 1143177 - DNA, 22 bp, Artificial Sequence
  chemically synthesized
ggattacaggtgtgagacacca

SEQ ID NO: 1143178 - DNA, 22 bp, Artificial Sequence
  chemically synthesized
caggtgtgagacaccacacctg

SEQ ID NO: 1143179 - DNA, 22 bp, Artificial Sequence
  chemically synthesized
aaatacaaaaaagagccaggtg

SEQ ID NO: 1143180 - DNA, 22 bp, Artificial Sequence
  chemically synthesized
ctaaaatacaaaaaagagccag

SEQ ID NO: 1143181 - DNA, 22 bp, Artificial Sequence
  chemically synthesized
tactaaaatacaaaaaagagcc

SEQ ID NO: 1143182 - DNA, 22 bp, Artificial Sequence
  chemically synthesized
gctcttttttgtattttagtag

SEQ ID NO: 1143183 - DNA, 22 bp, Artificial Sequence
  chemically synthesized
ttttttgtattttagtagagat

SEQ ID NO: 1143184 - DNA, 22 bp, Artificial Sequence
  chemically synthesized
ttttgtattttagtagagatgg

SEQ ID NO: 1143185 - DNA, 22 bp, Artificial Sequence
  chemically synthesized
tttgtattttagtagagatggg

SEQ ID NO: 1143186 - DNA, 22 bp, Artificial Sequence
  chemically synthesized
ttgtattttagtagagatgggg

SEQ ID NO: 1143187 - DNA, 22 bp, Artificial Sequence
  chemically synthesized
tgtattttagtagagatggggt

SEQ ID NO: 1143188 - DNA, 22 bp, Artificial Sequence
  chemically synthesized
gtattttagtagagatggggtt

SEQ ID NO: 1143189 - DNA, 22 bp, Artificial Sequence
  chemically synthesized
tattttagtagagatggggttt

SEQ ID NO: 1143190 - DNA, 22 bp, Artificial Sequence
  chemically synthesized
tagtagagatggggtttcacca

SEQ ID NO: 1143191 - DNA, 22 bp, Artificial Sequence
  chemically synthesized
agtagagatggggtttcaccat

SEQ ID NO: 1143192 - DNA, 22 bp, Artificial Sequence
  chemically synthesized
gtagagatggggtttcaccatg

SEQ ID NO: 1143193 - DNA, 22 bp, Artificial Sequence
  chemically synthesized
agatgagaccagccaacatggt

SEQ ID NO: 1143194 - DNA, 22 bp, Artificial Sequence
  chemically synthesized
gagatgagaccagccaacatgg

SEQ ID NO: 1143195 - DNA, 22 bp, Artificial Sequence
  chemically synthesized
caccatgttggctggtctcatc

SEQ ID NO: 1143196 - DNA, 22 bp, Artificial Sequence
  chemically synthesized
accatgttggctggtctcatct

SEQ ID NO: 1143197 - DNA, 22 bp, Artificial Sequence
  chemically synthesized
aggtcaggagtttgagatgaga

SEQ ID NO: 1143198 - DNA, 22 bp, Artificial Sequence
  chemically synthesized
gaggtcaggagtttgagatgag

SEQ ID NO: 1143199 - DNA, 22 bp, Artificial Sequence
  chemically synthesized
gctggtctcatctcaaactcct

SEQ ID NO: 1143200 - DNA, 22 bp, Artificial Sequence
  chemically synthesized
gtctcatctcaaactcctgacc

SEQ ID NO: 1143201 - DNA, 22 bp, Artificial Sequence
  chemically synthesized
atctcaaactcctgacctcaag

SEQ ID NO: 1143202 - DNA, 22 bp, Artificial Sequence
  chemically synthesized
aaactcctgacctcaagtgatc

SEQ ID NO: 1143203 - DNA, 22 bp, Artificial Sequence
  chemically synthesized
cgaggccgaggcgggcagatca

SEQ ID NO: 1143204 - DNA, 22 bp, Artificial Sequence
  chemically synthesized
ctgacctcaagtgatctgcccg

SEQ ID NO: 1143205 - DNA, 22 bp, Artificial Sequence
  chemically synthesized
gcgaggccgaggcgggcagatc

SEQ ID NO: 1143206 - DNA, 22 bp, Artificial Sequence
  chemically synthesized
tgcgaggccgaggcgggcagat

SEQ ID NO: 1143207 - DNA, 22 bp, Artificial Sequence
  chemically synthesized
acctcaagtgatctgcccgcct

SEQ ID NO: 1143208 - DNA, 22 bp, Artificial Sequence
  chemically synthesized
aagtgatctgcccgcctcggcc

SEQ ID NO: 1143209 - DNA, 22 bp, Artificial Sequence
  chemically synthesized
caatcccagcactttgcgaggc

SEQ ID NO: 1143210 - DNA, 22 bp, Artificial Sequence
  chemically synthesized
cccgcctcggcctcgcaaagtg

SEQ ID NO: 1143211 - DNA, 22 bp, Artificial Sequence
  chemically synthesized
acgcctgcaatcccagcacttt

SEQ ID NO: 1143212 - DNA, 22 bp, Artificial Sequence
  chemically synthesized
ggcctcgcaaagtgctgggatt

SEQ ID NO: 1143213 - DNA, 22 bp, Artificial Sequence
  chemically synthesized
agtggctcacgcctgcaatccc

SEQ ID NO: 1143214 - DNA, 22 bp, Artificial Sequence
  chemically synthesized
gcaaagtgctgggattgcaggc

SEQ ID NO: 1143215 - DNA, 22 bp, Artificial Sequence
  chemically synthesized
gagcccgtgctcagtggctcac

SEQ ID NO: 1143216 - DNA, 22 bp, Artificial Sequence
  chemically synthesized
ggattgcaggcgtgagccactg

SEQ ID NO: 1143217 - DNA, 22 bp, Artificial Sequence
  chemically synthesized
ggagcccgtgctcagtggctca

SEQ ID NO: 1143218 - DNA, 22 bp, Artificial Sequence
  chemically synthesized
tggagcccgtgctcagtggctc

SEQ ID NO: 1143219 - DNA, 22 bp, Artificial Sequence
  chemically synthesized
ttggagcccgtgctcagtggct

SEQ ID NO: 1143220 - DNA, 22 bp, Artificial Sequence
  chemically synthesized
caggcgtgagccactgagcacg

SEQ ID NO: 1143221 - DNA, 22 bp, Artificial Sequence
  chemically synthesized
aaataagataccttttggagcc

SEQ ID NO: 1143222 - DNA, 22 bp, Artificial Sequence
  chemically synthesized
caaataagataccttttggagc

SEQ ID NO: 1143223 - DNA, 22 bp, Artificial Sequence
  chemically synthesized
tcaaataagataccttttggag

SEQ ID NO: 1143224 - DNA, 22 bp, Artificial Sequence
  chemically synthesized
ctttcaaataagataccttttg

SEQ ID NO: 1143225 - DNA, 22 bp, Artificial Sequence
  chemically synthesized
agcacgggctccaaaaggtatc

SEQ ID NO: 1143226 - DNA, 22 bp, Artificial Sequence
  chemically synthesized
gctttcaaataagatacctttt

SEQ ID NO: 1143227 - DNA, 22 bp, Artificial Sequence
  chemically synthesized
tgcacttgctttcaaataagat

SEQ ID NO: 1143228 - DNA, 22 bp, Artificial Sequence
  chemically synthesized
tatgcacttgctttcaaataag

SEQ ID NO: 1143229 - DNA, 22 bp, Artificial Sequence
  chemically synthesized
ctatgcacttgctttcaaataa

SEQ ID NO: 1143230 - DNA, 22 bp, Artificial Sequence
  chemically synthesized
caaaaggtatcttatttgaaag

SEQ ID NO: 1143231 - DNA, 22 bp, Artificial Sequence
  chemically synthesized
tcttctatgcacttgctttcaa

SEQ ID NO: 1143232 - DNA, 22 bp, Artificial Sequence
  chemically synthesized
atcttctatgcacttgctttca

SEQ ID NO: 1143233 - DNA, 22 bp, Artificial Sequence
  chemically synthesized
atttgaaagcaagtgcatagaa

SEQ ID NO: 1143234 - DNA, 22 bp, Artificial Sequence
  chemically synthesized
tttgaaagcaagtgcatagaag

SEQ ID NO: 1143235 - DNA, 22 bp, Artificial Sequence
  chemically synthesized
gaaagcaagtgcatagaagata

SEQ ID NO: 1143236 - DNA, 22 bp, Artificial Sequence
  chemically synthesized
aaagcaagtgcatagaagataa

SEQ ID NO: 1143237 - DNA, 22 bp, Artificial Sequence
  chemically synthesized
gcatgagacatagagggatatt

SEQ ID NO: 1143238 - DNA, 22 bp, Artificial Sequence
  chemically synthesized
tgatgtcaagagttggcatgag

SEQ ID NO: 1143239 - DNA, 22 bp, Artificial Sequence
  chemically synthesized
tatgtctcatgccaactcttga

SEQ ID NO: 1143240 - DNA, 22 bp, Artificial Sequence
  chemically synthesized
tgtctcatgccaactcttgaca

SEQ ID NO: 1143241 - DNA, 22 bp, Artificial Sequence
  chemically synthesized
tggatgaaaagttgtgatgtca

SEQ ID NO: 1143242 - DNA, 22 bp, Artificial Sequence
  chemically synthesized
atgccaactcttgacatcacaa

SEQ ID NO: 1143243 - DNA, 22 bp, Artificial Sequence
  chemically synthesized
gtggatgaaaagttgtgatgtc

SEQ ID NO: 1143244 - DNA, 22 bp, Artificial Sequence
  chemically synthesized
ttgtggatgaaaagttgtgatg

SEQ ID NO: 1143245 - DNA, 22 bp, Artificial Sequence
  chemically synthesized
cttgtggatgaaaagttgtgat

SEQ ID NO: 1143246 - DNA, 22 bp, Artificial Sequence
  chemically synthesized
tgatttcttgtggatgaaaagt

SEQ ID NO: 1143247 - DNA, 22 bp, Artificial Sequence
  chemically synthesized
ttgacatcacaacttttcatcc

SEQ ID NO: 1143248 - DNA, 22 bp, Artificial Sequence
  chemically synthesized
gtgatttcttgtggatgaaaag

SEQ ID NO: 1143249 - DNA, 22 bp, Artificial Sequence
  chemically synthesized
gacatcacaacttttcatccac

SEQ ID NO: 1143250 - DNA, 22 bp, Artificial Sequence
  chemically synthesized
acatcacaacttttcatccaca

SEQ ID NO: 1143251 - DNA, 22 bp, Artificial Sequence
  chemically synthesized
gaatttgtgatttcttgtggat

SEQ ID NO: 1143252 - DNA, 22 bp, Artificial Sequence
  chemically synthesized
ttcatccacaagaaatcacaaa

SEQ ID NO: 1143253 - DNA, 22 bp, Artificial Sequence
  chemically synthesized
tcatccacaagaaatcacaaat

SEQ ID NO: 1143254 - DNA, 22 bp, Artificial Sequence
  chemically synthesized
catccacaagaaatcacaaatt

SEQ ID NO: 1143255 - DNA, 22 bp, Artificial Sequence
  chemically synthesized
atccacaagaaatcacaaattc

SEQ ID NO: 1143256 - DNA, 22 bp, Artificial Sequence
  chemically synthesized
ggtatgtacgttagaatttgtg

SEQ ID NO: 1143257 - DNA, 22 bp, Artificial Sequence
  chemically synthesized
ttaggtatgtacgttagaattt

SEQ ID NO: 1143258 - DNA, 22 bp, Artificial Sequence
  chemically synthesized
attaggtatgtacgttagaatt

SEQ ID NO: 1143259 - DNA, 22 bp, Artificial Sequence
  chemically synthesized
tattaggtatgtacgttagaat

SEQ ID NO: 1143260 - DNA, 22 bp, Artificial Sequence
  chemically synthesized
tgcattttattaggtatgtacg

SEQ ID NO: 1143261 - DNA, 22 bp, Artificial Sequence
  chemically synthesized
atgcattttattaggtatgtac

SEQ ID NO: 1143262 - DNA, 22 bp, Artificial Sequence
  chemically synthesized
tcttatgcattttattaggtat

SEQ ID NO: 1143263 - DNA, 22 bp, Artificial Sequence
  chemically synthesized
taacgtacatacctaataaaat

SEQ ID NO: 1143264 - DNA, 22 bp, Artificial Sequence
  chemically synthesized
cattatcttatgcattttatta

SEQ ID NO: 1143265 - DNA, 22 bp, Artificial Sequence
  chemically synthesized
acgtacatacctaataaaatgc

SEQ ID NO: 1143266 - DNA, 22 bp, Artificial Sequence
  chemically synthesized
cacctacattatcttatgcatt

SEQ ID NO: 1143267 - DNA, 22 bp, Artificial Sequence
  chemically synthesized
ttacacctacattatcttatgc

SEQ ID NO: 1143268 - DNA, 22 bp, Artificial Sequence
  chemically synthesized
tgttacacctacattatcttat

SEQ ID NO: 1143269 - DNA, 22 bp, Artificial Sequence
  chemically synthesized
ataaaatgcataagataatgta

SEQ ID NO: 1143270 - DNA, 22 bp, Artificial Sequence
  chemically synthesized
ttctgttacacctacattatct

SEQ ID NO: 1143271 - DNA, 22 bp, Artificial Sequence
  chemically synthesized
cctattctgttacacctacatt

SEQ ID NO: 1143272 - DNA, 22 bp, Artificial Sequence
  chemically synthesized
ctacctattctgttacacctac

SEQ ID NO: 1143273 - DNA, 22 bp, Artificial Sequence
  chemically synthesized
gccacagtccccattactacct

SEQ ID NO: 1143274 - DNA, 22 bp, Artificial Sequence
  chemically synthesized
agccacagtccccattactacc

SEQ ID NO: 1143275 - DNA, 22 bp, Artificial Sequence
  chemically synthesized
atttagccacagtccccattac

SEQ ID NO: 1143276 - DNA, 22 bp, Artificial Sequence
  chemically synthesized
catttagccacagtccccatta

SEQ ID NO: 1143277 - DNA, 22 bp, Artificial Sequence
  chemically synthesized
ttcatttagccacagtccccat

SEQ ID NO: 1143278 - DNA, 22 bp, Artificial Sequence
  chemically synthesized
gcacaggctcttcatttagcca

SEQ ID NO: 1143279 - DNA, 22 bp, Artificial Sequence
  chemically synthesized
tagcacaggctcttcatttagc

SEQ ID NO: 1143280 - DNA, 22 bp, Artificial Sequence
  chemically synthesized
tctagcacaggctcttcattta

SEQ ID NO: 1143281 - DNA, 22 bp, Artificial Sequence
  chemically synthesized
ctctagcacaggctcttcattt

SEQ ID NO: 1143282 - DNA, 22 bp, Artificial Sequence
  chemically synthesized
tctctagcacaggctcttcatt

SEQ ID NO: 1143283 - DNA, 22 bp, Artificial Sequence
  chemically synthesized
ttttctctagcacaggctcttc

SEQ ID NO: 1143284 - DNA, 22 bp, Artificial Sequence
  chemically synthesized
tggctaaatgaagagcctgtgc

SEQ ID NO: 1143285 - DNA, 22 bp, Artificial Sequence
  chemically synthesized
ccctgttttctctagcacaggc

SEQ ID NO: 1143286 - DNA, 22 bp, Artificial Sequence
  chemically synthesized
aatgaagagcctgtgctagaga

SEQ ID NO: 1143287 - DNA, 22 bp, Artificial Sequence
  chemically synthesized
tgctagagaaaacagggcaact

SEQ ID NO: 1143288 - DNA, 22 bp, Artificial Sequence
  chemically synthesized
gagaaaacagggcaacttgact

SEQ ID NO: 1143289 - DNA, 22 bp, Artificial Sequence
  chemically synthesized
catagtaaccagagcaggagtc

SEQ ID NO: 1143290 - DNA, 22 bp, Artificial Sequence
  chemically synthesized
tacatagtaaccagagcaggag

SEQ ID NO: 1143291 - DNA, 22 bp, Artificial Sequence
  chemically synthesized
ctacatagtaaccagagcagga

SEQ ID NO: 1143292 - DNA, 22 bp, Artificial Sequence
  chemically synthesized
tctacatagtaaccagagcagg

SEQ ID NO: 1143293 - DNA, 22 bp, Artificial Sequence
  chemically synthesized
ttctacatagtaaccagagcag

SEQ ID NO: 1143294 - DNA, 22 bp, Artificial Sequence
  chemically synthesized
tttttctacatagtaaccagag

SEQ ID NO: 1143295 - DNA, 22 bp, Artificial Sequence
  chemically synthesized
gactcctgctctggttactatg

SEQ ID NO: 1143296 - DNA, 22 bp, Artificial Sequence
  chemically synthesized
actcctgctctggttactatgt

SEQ ID NO: 1143297 - DNA, 22 bp, Artificial Sequence
  chemically synthesized
gtctgtttttctacatagtaac

SEQ ID NO: 1143298 - DNA, 22 bp, Artificial Sequence
  chemically synthesized
agtctgtttttctacatagtaa

SEQ ID NO: 1143299 - DNA, 22 bp, Artificial Sequence
  chemically synthesized
ctgctctggttactatgtagaa

SEQ ID NO: 1143300 - DNA, 22 bp, Artificial Sequence
  chemically synthesized
ctctggttactatgtagaaaaa

SEQ ID NO: 1143301 - DNA, 22 bp, Artificial Sequence
  chemically synthesized
tggttactatgtagaaaaacag

SEQ ID NO: 1143302 - DNA, 22 bp, Artificial Sequence
  chemically synthesized
atgatccttagtctgtttttct

SEQ ID NO: 1143303 - DNA, 22 bp, Artificial Sequence
  chemically synthesized
gttactatgtagaaaaacagac

SEQ ID NO: 1143304 - DNA, 22 bp, Artificial Sequence
  chemically synthesized
ctatgtagaaaaacagactaag

SEQ ID NO: 1143305 - DNA, 22 bp, Artificial Sequence
  chemically synthesized
tgtagaaaaacagactaaggat

SEQ ID NO: 1143306 - DNA, 22 bp, Artificial Sequence
  chemically synthesized
gagaaagcaaatgatctgatga

SEQ ID NO: 1143307 - DNA, 22 bp, Artificial Sequence
  chemically synthesized
tagagaaagcaaatgatctgat

SEQ ID NO: 1143308 - DNA, 22 bp, Artificial Sequence
  chemically synthesized
tctagagaaagcaaatgatctg

SEQ ID NO: 1143309 - DNA, 22 bp, Artificial Sequence
  chemically synthesized
aggatcatcagatcatttgctt

SEQ ID NO: 1143310 - DNA, 22 bp, Artificial Sequence
  chemically synthesized
acctctctagagaaagcaaatg

SEQ ID NO: 1143311 - DNA, 22 bp, Artificial Sequence
  chemically synthesized
taacctctctagagaaagcaaa

SEQ ID NO: 1143312 - DNA, 22 bp, Artificial Sequence
  chemically synthesized
ctaacctctctagagaaagcaa

SEQ ID NO: 1143313 - DNA, 22 bp, Artificial Sequence
  chemically synthesized
agaatttctaacctctctagag

SEQ ID NO: 1143314 - DNA, 22 bp, Artificial Sequence
  chemically synthesized
gctttctctagagaggttagaa

SEQ ID NO: 1143315 - DNA, 22 bp, Artificial Sequence
  chemically synthesized
ctttctctagagaggttagaaa

SEQ ID NO: 1143316 - DNA, 22 bp, Artificial Sequence
  chemically synthesized
tctctagagaggttagaaattc

SEQ ID NO: 1143317 - DNA, 22 bp, Artificial Sequence
  chemically synthesized
ctctagagaggttagaaattct

SEQ ID NO: 1143318 - DNA, 22 bp, Artificial Sequence
  chemically synthesized
tctagagaggttagaaattctt

SEQ ID NO: 1143319 - DNA, 22 bp, Artificial Sequence
  chemically synthesized
tagagaggttagaaattcttag

SEQ ID NO: 1143320 - DNA, 22 bp, Artificial Sequence
  chemically synthesized
gagaggttagaaattcttagtt

SEQ ID NO: 1143321 - DNA, 22 bp, Artificial Sequence
  chemically synthesized
aaaaaaatgtgacatgaactaa

SEQ ID NO: 1143322 - DNA, 22 bp, Artificial Sequence
  chemically synthesized
gaaattcttagttcatgtcaca

SEQ ID NO: 1143323 - DNA, 22 bp, Artificial Sequence
  chemically synthesized
aaattgaaaaaaatgtgacatg

SEQ ID NO: 1143324 - DNA, 22 bp, Artificial Sequence
  chemically synthesized
gaaattgaaaaaaatgtgacat

SEQ ID NO: 1143325 - DNA, 22 bp, Artificial Sequence
  chemically synthesized
tttgaaattgaaaaaaatgtga

SEQ ID NO: 1143326 - DNA, 22 bp, Artificial Sequence
  chemically synthesized
ttagttcatgtcacattttttt

SEQ ID NO: 1143327 - DNA, 22 bp, Artificial Sequence
  chemically synthesized
agttcatgtcacatttttttca

SEQ ID NO: 1143328 - DNA, 22 bp, Artificial Sequence
  chemically synthesized
gttcatgtcacatttttttcaa

SEQ ID NO: 1143329 - DNA, 22 bp, Artificial Sequence
  chemically synthesized
ccattgtttgaaattgaaaaaa

SEQ ID NO: 1143330 - DNA, 22 bp, Artificial Sequence
  chemically synthesized
atgtcacatttttttcaatttc

SEQ ID NO: 1143331 - DNA, 22 bp, Artificial Sequence
  chemically synthesized
gctaccattgtttgaaattgaa

SEQ ID NO: 1143332 - DNA, 22 bp, Artificial Sequence
  chemically synthesized
ttagctaccattgtttgaaatt

SEQ ID NO: 1143333 - DNA, 22 bp, Artificial Sequence
  chemically synthesized
attagctaccattgtttgaaat

SEQ ID NO: 1143334 - DNA, 22 bp, Artificial Sequence
  chemically synthesized
ttttcaatttcaaacaatggta

SEQ ID NO: 1143335 - DNA, 22 bp, Artificial Sequence
  chemically synthesized
tttcaatttcaaacaatggtag

SEQ ID NO: 1143336 - DNA, 22 bp, Artificial Sequence
  chemically synthesized
ttcaatttcaaacaatggtagc

SEQ ID NO: 1143337 - DNA, 22 bp, Artificial Sequence
  chemically synthesized
tcaatttcaaacaatggtagct

SEQ ID NO: 1143338 - DNA, 22 bp, Artificial Sequence
  chemically synthesized
caatttcaaacaatggtagcta

SEQ ID NO: 1143339 - DNA, 22 bp, Artificial Sequence
  chemically synthesized
atagtagtttattagctaccat

SEQ ID NO: 1143340 - DNA, 22 bp, Artificial Sequence
  chemically synthesized
aatttcaaacaatggtagctaa

SEQ ID NO: 1143341 - DNA, 22 bp, Artificial Sequence
  chemically synthesized
aatagtagtttattagctacca

SEQ ID NO: 1143342 - DNA, 22 bp, Artificial Sequence
  chemically synthesized
caaacaatggtagctaataaac

SEQ ID NO: 1143343 - DNA, 22 bp, Artificial Sequence
  chemically synthesized
aaacaatggtagctaataaact

SEQ ID NO: 1143344 - DNA, 22 bp, Artificial Sequence
  chemically synthesized
tggtatttaatagtagtttatt

SEQ ID NO: 1143345 - DNA, 22 bp, Artificial Sequence
  chemically synthesized
gtccctatggtatttaatagta

SEQ ID NO: 1143346 - DNA, 22 bp, Artificial Sequence
  chemically synthesized
agtccctatggtatttaatagt

SEQ ID NO: 1143347 - DNA, 22 bp, Artificial Sequence
  chemically synthesized
tttagtccctatggtatttaat

SEQ ID NO: 1143348 - DNA, 22 bp, Artificial Sequence
  chemically synthesized
ataaactactattaaataccat

SEQ ID NO: 1143349 - DNA, 22 bp, Artificial Sequence
  chemically synthesized
tatttagtccctatggtattta

SEQ ID NO: 1143350 - DNA, 22 bp, Artificial Sequence
  chemically synthesized
ctattaaataccatagggacta

SEQ ID NO: 1143351 - DNA, 22 bp, Artificial Sequence
  chemically synthesized
gataaagttctatttagtccct

SEQ ID NO: 1143352 - DNA, 22 bp, Artificial Sequence
  chemically synthesized
ttaaataccatagggactaaat

SEQ ID NO: 1143353 - DNA, 22 bp, Artificial Sequence
  chemically synthesized
agataaagttctatttagtccc

SEQ ID NO: 1143354 - DNA, 22 bp, Artificial Sequence
  chemically synthesized
aataccatagggactaaataga

SEQ ID NO: 1143355 - DNA, 22 bp, Artificial Sequence
  chemically synthesized
cagatgtatttagataaagttc

SEQ ID NO: 1143356 - DNA, 22 bp, Artificial Sequence
  chemically synthesized
aaattacagatgtatttagata

SEQ ID NO: 1143357 - DNA, 22 bp, Artificial Sequence
  chemically synthesized
aatagaactttatctaaataca

SEQ ID NO: 1143358 - DNA, 22 bp, Artificial Sequence
  chemically synthesized
catctaaaattacagatgtatt

SEQ ID NO: 1143359 - DNA, 22 bp, Artificial Sequence
  chemically synthesized
ttgcatctaaaattacagatgt

SEQ ID NO: 1143360 - DNA, 22 bp, Artificial Sequence
  chemically synthesized
tatctaaatacatctgtaattt

SEQ ID NO: 1143361 - DNA, 22 bp, Artificial Sequence
  chemically synthesized
atctaaatacatctgtaatttt

SEQ ID NO: 1143362 - DNA, 22 bp, Artificial Sequence
  chemically synthesized
tctaaatacatctgtaatttta

SEQ ID NO: 1143363 - DNA, 22 bp, Artificial Sequence
  chemically synthesized
gtctattgcatctaaaattaca

SEQ ID NO: 1143364 - DNA, 22 bp, Artificial Sequence
  chemically synthesized
aatacatctgtaattttagatg

SEQ ID NO: 1143365 - DNA, 22 bp, Artificial Sequence
  chemically synthesized
ggaattggtctattgcatctaa

SEQ ID NO: 1143366 - DNA, 22 bp, Artificial Sequence
  chemically synthesized
taggaattggtctattgcatct

SEQ ID NO: 1143367 - DNA, 22 bp, Artificial Sequence
  chemically synthesized
ctaggaattggtctattgcatc

SEQ ID NO: 1143368 - DNA, 22 bp, Artificial Sequence
  chemically synthesized
tctaggaattggtctattgcat

SEQ ID NO: 1143369 - DNA, 22 bp, Artificial Sequence
  chemically synthesized
taattttagatgcaatagacca

SEQ ID NO: 1143370 - DNA, 22 bp, Artificial Sequence
  chemically synthesized
tgtctttctaggaattggtcta

SEQ ID NO: 1143371 - DNA, 22 bp, Artificial Sequence
  chemically synthesized
gtgtctttctaggaattggtct

SEQ ID NO: 1143372 - DNA, 22 bp, Artificial Sequence
  chemically synthesized
tagatgcaatagaccaattcct

SEQ ID NO: 1143373 - DNA, 22 bp, Artificial Sequence
  chemically synthesized
agatgcaatagaccaattccta

SEQ ID NO: 1143374 - DNA, 22 bp, Artificial Sequence
  chemically synthesized
gatgcaatagaccaattcctag

SEQ ID NO: 1143375 - DNA, 22 bp, Artificial Sequence
  chemically synthesized
gaatcatttgtgtctttctagg

SEQ ID NO: 1143376 - DNA, 22 bp, Artificial Sequence
  chemically synthesized
gagtcagctcgaatcatttgtg

SEQ ID NO: 1143377 - DNA, 22 bp, Artificial Sequence
  chemically synthesized
ggagtcagctcgaatcatttgt

SEQ ID NO: 1143378 - DNA, 22 bp, Artificial Sequence
  chemically synthesized
tggagtcagctcgaatcatttg

SEQ ID NO: 1143379 - DNA, 22 bp, Artificial Sequence
  chemically synthesized
ctagaaagacacaaatgattcg

SEQ ID NO: 1143380 - DNA, 22 bp, Artificial Sequence
  chemically synthesized
gaaagacacaaatgattcgagc

SEQ ID NO: 1143381 - DNA, 22 bp, Artificial Sequence
  chemically synthesized
cgttttggagtcagctcgaatc

SEQ ID NO: 1143382 - DNA, 22 bp, Artificial Sequence
  chemically synthesized
ccgttttggagtcagctcgaat

SEQ ID NO: 1143383 - DNA, 22 bp, Artificial Sequence
  chemically synthesized
tccgttttggagtcagctcgaa

SEQ ID NO: 1143384 - DNA, 22 bp, Artificial Sequence
  chemically synthesized
cagattttccgttttggagtca

SEQ ID NO: 1143385 - DNA, 22 bp, Artificial Sequence
  chemically synthesized
ccagattttccgttttggagtc

SEQ ID NO: 1143386 - DNA, 22 bp, Artificial Sequence
  chemically synthesized
tccagattttccgttttggagt

SEQ ID NO: 1143387 - DNA, 22 bp, Artificial Sequence
  chemically synthesized
ttccagattttccgttttggag

SEQ ID NO: 1143388 - DNA, 22 bp, Artificial Sequence
  chemically synthesized
gagctgactccaaaacggaaaa

SEQ ID NO: 1143389 - DNA, 22 bp, Artificial Sequence
  chemically synthesized
catttttccagattttccgttt

SEQ ID NO: 1143390 - DNA, 22 bp, Artificial Sequence
  chemically synthesized
actccaaaacggaaaatctgga

SEQ ID NO: 1143391 - DNA, 22 bp, Artificial Sequence
  chemically synthesized
aacattacatttttccagattt

SEQ ID NO: 1143392 - DNA, 22 bp, Artificial Sequence
  chemically synthesized
caacattacatttttccagatt

SEQ ID NO: 1143393 - DNA, 22 bp, Artificial Sequence
  chemically synthesized
caaaacggaaaatctggaaaaa

SEQ ID NO: 1143394 - DNA, 22 bp, Artificial Sequence
  chemically synthesized
gaatttcaacattacatttttc

SEQ ID NO: 1143395 - DNA, 22 bp, Artificial Sequence
  chemically synthesized
attggaatttcaacattacatt

SEQ ID NO: 1143396 - DNA, 22 bp, Artificial Sequence
  chemically synthesized
aattggaatttcaacattacat

SEQ ID NO: 1143397 - DNA, 22 bp, Artificial Sequence
  chemically synthesized
taattggaatttcaacattaca

SEQ ID NO: 1143398 - DNA, 22 bp, Artificial Sequence
  chemically synthesized
ttaattggaatttcaacattac

SEQ ID NO: 1143399 - DNA, 22 bp, Artificial Sequence
  chemically synthesized
gaaaaatgtaatgttgaaattc

SEQ ID NO: 1143400 - DNA, 22 bp, Artificial Sequence
  chemically synthesized
aaattccaattaaaaatggaca

SEQ ID NO: 1143401 - DNA, 22 bp, Artificial Sequence
  chemically synthesized
atacacataaaaatgtccattt

SEQ ID NO: 1143402 - DNA, 22 bp, Artificial Sequence
  chemically synthesized
aatacacataaaaatgtccatt

SEQ ID NO: 1143403 - DNA, 22 bp, Artificial Sequence
  chemically synthesized
caattaaaaatggacattttta

SEQ ID NO: 1143404 - DNA, 22 bp, Artificial Sequence
  chemically synthesized
tgtatttaatacacataaaaat

SEQ ID NO: 1143405 - DNA, 22 bp, Artificial Sequence
  chemically synthesized
atgtatttaatacacataaaaa

SEQ ID NO: 1143406 - DNA, 22 bp, Artificial Sequence
  chemically synthesized
tatgtatttaatacacataaaa

SEQ ID NO: 1143407 - DNA, 22 bp, Artificial Sequence
  chemically synthesized
aaaatggacatttttatgtgta

SEQ ID NO: 1143408 - DNA, 22 bp, Artificial Sequence
  chemically synthesized
ttatgtatttaatacacataaa

SEQ ID NO: 1143409 - DNA, 22 bp, Artificial Sequence
  chemically synthesized
aatttttatgtatttaatacac

SEQ ID NO: 1143410 - DNA, 22 bp, Artificial Sequence
  chemically synthesized
aaattaaatttttatgtattta

SEQ ID NO: 1143411 - DNA, 22 bp, Artificial Sequence
  chemically synthesized
aaaattaaatttttatgtattt

SEQ ID NO: 1143412 - DNA, 22 bp, Artificial Sequence
  chemically synthesized
ttatgtgtattaaatacataaa

SEQ ID NO: 1143413 - DNA, 22 bp, Artificial Sequence
  chemically synthesized
taaaattaaatttttatgtatt

SEQ ID NO: 1143414 - DNA, 22 bp, Artificial Sequence
  chemically synthesized
tatgtgtattaaatacataaaa

SEQ ID NO: 1143415 - DNA, 22 bp, Artificial Sequence
  chemically synthesized
atgtgtattaaatacataaaaa

SEQ ID NO: 1143416 - DNA, 22 bp, Artificial Sequence
  chemically synthesized
tgtgtattaaatacataaaaat

SEQ ID NO: 1143417 - DNA, 22 bp, Artificial Sequence
  chemically synthesized
aatacataaaaatttaatttta

SEQ ID NO: 1143418 - DNA, 22 bp, Artificial Sequence
  chemically synthesized
caaatgggaaattttaaaatta

SEQ ID NO: 1143419 - DNA, 22 bp, Artificial Sequence
  chemically synthesized
gcaaatgggaaattttaaaatt

SEQ ID NO: 1143420 - DNA, 22 bp, Artificial Sequence
  chemically synthesized
gaatttgcaaatgggaaatttt

SEQ ID NO: 1143421 - DNA, 22 bp, Artificial Sequence
  chemically synthesized
aattttaaaatttcccatttgc

SEQ ID NO: 1143422 - DNA, 22 bp, Artificial Sequence
  chemically synthesized
attttaaaatttcccatttgca

SEQ ID NO: 1143423 - DNA, 22 bp, Artificial Sequence
  chemically synthesized
ataactggaatttgcaaatggg

SEQ ID NO: 1143424 - DNA, 22 bp, Artificial Sequence
  chemically synthesized
cataactggaatttgcaaatgg

SEQ ID NO: 1143425 - DNA, 22 bp, Artificial Sequence
  chemically synthesized
taaaatttcccatttgcaaatt

SEQ ID NO: 1143426 - DNA, 22 bp, Artificial Sequence
  chemically synthesized
aaaatttcccatttgcaaattc

SEQ ID NO: 1143427 - DNA, 22 bp, Artificial Sequence
  chemically synthesized
gcttcataactggaatttgcaa

SEQ ID NO: 1143428 - DNA, 22 bp, Artificial Sequence
  chemically synthesized
aaatttcccatttgcaaattcc

SEQ ID NO: 1143429 - DNA, 22 bp, Artificial Sequence
  chemically synthesized
cccatttgcaaattccagttat

SEQ ID NO: 1143430 - DNA, 22 bp, Artificial Sequence
  chemically synthesized
gtaactggcttcataactggaa

SEQ ID NO: 1143431 - DNA, 22 bp, Artificial Sequence
  chemically synthesized
ccatttgcaaattccagttatg

SEQ ID NO: 1143432 - DNA, 22 bp, Artificial Sequence
  chemically synthesized
ggtaactggcttcataactgga

SEQ ID NO: 1143433 - DNA, 22 bp, Artificial Sequence
  chemically synthesized
gcaaattccagttatgaagcca

SEQ ID NO: 1143434 - DNA, 22 bp, Artificial Sequence
  chemically synthesized
caaattccagttatgaagccag

SEQ ID NO: 1143435 - DNA, 22 bp, Artificial Sequence
  chemically synthesized
tgcaggcttggtaactggcttc

SEQ ID NO: 1143436 - DNA, 22 bp, Artificial Sequence
  chemically synthesized
attatgcaggcttggtaactgg

SEQ ID NO: 1143437 - DNA, 22 bp, Artificial Sequence
  chemically synthesized
cagttatgaagccagttaccaa

SEQ ID NO: 1143438 - DNA, 22 bp, Artificial Sequence
  chemically synthesized
tgaagccagttaccaagcctgc

SEQ ID NO: 1143439 - DNA, 22 bp, Artificial Sequence
  chemically synthesized
agtacctgattatgcaggcttg

SEQ ID NO: 1143440 - DNA, 22 bp, Artificial Sequence
  chemically synthesized
aagtacctgattatgcaggctt

SEQ ID NO: 1143441 - DNA, 22 bp, Artificial Sequence
  chemically synthesized
ggtttaagtacctgattatgca

SEQ ID NO: 1143442 - DNA, 22 bp, Artificial Sequence
  chemically synthesized
ctaggtttaagtacctgattat

SEQ ID NO: 1143443 - DNA, 22 bp, Artificial Sequence
  chemically synthesized
gctaggtttaagtacctgatta

SEQ ID NO: 1143444 - DNA, 22 bp, Artificial Sequence
  chemically synthesized
ccaagcctgcataatcaggtac

SEQ ID NO: 1143445 - DNA, 22 bp, Artificial Sequence
  chemically synthesized
cataatcaggtacttaaaccta

SEQ ID NO: 1143446 - DNA, 22 bp, Artificial Sequence
  chemically synthesized
taatatgcttgctaggtttaag

SEQ ID NO: 1143447 - DNA, 22 bp, Artificial Sequence
  chemically synthesized
gtaatatgcttgctaggtttaa

SEQ ID NO: 1143448 - DNA, 22 bp, Artificial Sequence
  chemically synthesized
ttgtaatatgcttgctaggttt

SEQ ID NO: 1143449 - DNA, 22 bp, Artificial Sequence
  chemically synthesized
cttgtaatatgcttgctaggtt

SEQ ID NO: 1143450 - DNA, 22 bp, Artificial Sequence
  chemically synthesized
tcttgtaatatgcttgctaggt

SEQ ID NO: 1143451 - DNA, 22 bp, Artificial Sequence
  chemically synthesized
ctttcttgtaatatgcttgcta

SEQ ID NO: 1143452 - DNA, 22 bp, Artificial Sequence
  chemically synthesized
cctttcttgtaatatgcttgct

SEQ ID NO: 1143453 - DNA, 22 bp, Artificial Sequence
  chemically synthesized
tcctttcttgtaatatgcttgc

SEQ ID NO: 1143454 - DNA, 22 bp, Artificial Sequence
  chemically synthesized
ttttcctttcttgtaatatgct

SEQ ID NO: 1143455 - DNA, 22 bp, Artificial Sequence
  chemically synthesized
aaacctagcaagcatattacaa

SEQ ID NO: 1143456 - DNA, 22 bp, Artificial Sequence
  chemically synthesized
aacctagcaagcatattacaag

SEQ ID NO: 1143457 - DNA, 22 bp, Artificial Sequence
  chemically synthesized
ttattttcctttcttgtaatat

SEQ ID NO: 1143458 - DNA, 22 bp, Artificial Sequence
  chemically synthesized
gcctgttattttcctttcttgt

SEQ ID NO: 1143459 - DNA, 22 bp, Artificial Sequence
  chemically synthesized
gcaagcatattacaagaaagga

SEQ ID NO: 1143460 - DNA, 22 bp, Artificial Sequence
  chemically synthesized
caagaaaggaaaataacaggcc

SEQ ID NO: 1143461 - DNA, 22 bp, Artificial Sequence
  chemically synthesized
cgtccatgaaagtgattggcct

SEQ ID NO: 1143462 - DNA, 22 bp, Artificial Sequence
  chemically synthesized
acgtccatgaaagtgattggcc

SEQ ID NO: 1143463 - DNA, 22 bp, Artificial Sequence
  chemically synthesized
tacgtccatgaaagtgattggc

SEQ ID NO: 1143464 - DNA, 22 bp, Artificial Sequence
  chemically synthesized
ctttacgtccatgaaagtgatt

SEQ ID NO: 1143465 - DNA, 22 bp, Artificial Sequence
  chemically synthesized
cctttacgtccatgaaagtgat

SEQ ID NO: 1143466 - DNA, 22 bp, Artificial Sequence
  chemically synthesized
tcctttacgtccatgaaagtga

SEQ ID NO: 1143467 - DNA, 22 bp, Artificial Sequence
  chemically synthesized
ttcctttacgtccatgaaagtg

SEQ ID NO: 1143468 - DNA, 22 bp, Artificial Sequence
  chemically synthesized
atagtttttcctttacgtccat

SEQ ID NO: 1143469 - DNA, 22 bp, Artificial Sequence
  chemically synthesized
attcatagtttttcctttacgt

SEQ ID NO: 1143470 - DNA, 22 bp, Artificial Sequence
  chemically synthesized
gattcatagtttttcctttacg

SEQ ID NO: 1143471 - DNA, 22 bp, Artificial Sequence
  chemically synthesized
tgattcatagtttttcctttac

SEQ ID NO: 1143472 - DNA, 22 bp, Artificial Sequence
  chemically synthesized
tttgattcatagtttttccttt

SEQ ID NO: 1143473 - DNA, 22 bp, Artificial Sequence
  chemically synthesized
ctttgattcatagtttttcctt

SEQ ID NO: 1143474 - DNA, 22 bp, Artificial Sequence
  chemically synthesized
tcatggacgtaaaggaaaaact

SEQ ID NO: 1143475 - DNA, 22 bp, Artificial Sequence
  chemically synthesized
tctttgattcatagtttttcct

SEQ ID NO: 1143476 - DNA, 22 bp, Artificial Sequence
  chemically synthesized
catggacgtaaaggaaaaacta

SEQ ID NO: 1143477 - DNA, 22 bp, Artificial Sequence
  chemically synthesized
atggacgtaaaggaaaaactat

SEQ ID NO: 1143478 - DNA, 22 bp, Artificial Sequence
  chemically synthesized
gattttctttgattcatagttt

SEQ ID NO: 1143479 - DNA, 22 bp, Artificial Sequence
  chemically synthesized
ctagattttctttgattcatag

SEQ ID NO: 1143480 - DNA, 22 bp, Artificial Sequence
  chemically synthesized
tgtattgctagattttctttga

SEQ ID NO: 1143481 - DNA, 22 bp, Artificial Sequence
  chemically synthesized
gtgtattgctagattttctttg

SEQ ID NO: 1143482 - DNA, 22 bp, Artificial Sequence
  chemically synthesized
tgtgtattgctagattttcttt

SEQ ID NO: 1143483 - DNA, 22 bp, Artificial Sequence
  chemically synthesized
ttgtgtattgctagattttctt

SEQ ID NO: 1143484 - DNA, 22 bp, Artificial Sequence
  chemically synthesized
tttgtgtattgctagattttct

SEQ ID NO: 1143485 - DNA, 22 bp, Artificial Sequence
  chemically synthesized
ttttgtgtattgctagattttc

SEQ ID NO: 1143486 - DNA, 22 bp, Artificial Sequence
  chemically synthesized
tgaatcaaagaaaatctagcaa

SEQ ID NO: 1143487 - DNA, 22 bp, Artificial Sequence
  chemically synthesized
gataagacgtataatctttttt

SEQ ID NO: 1143488 - DNA, 22 bp, Artificial Sequence
  chemically synthesized
gcaatacacaaaaaagattata

SEQ ID NO: 1143489 - DNA, 22 bp, Artificial Sequence
  chemically synthesized
aacctggataagacgtataatc

SEQ ID NO: 1143490 - DNA, 22 bp, Artificial Sequence
  chemically synthesized
taataaactaaacctggataag

SEQ ID NO: 1143491 - DNA, 22 bp, Artificial Sequence
  chemically synthesized
ctgtaataaactaaacctggat

SEQ ID NO: 1143492 - DNA, 22 bp, Artificial Sequence
  chemically synthesized
cctgtaataaactaaacctgga

SEQ ID NO: 1143493 - DNA, 22 bp, Artificial Sequence
  chemically synthesized
ttcctgtaataaactaaacctg

SEQ ID NO: 1143494 - DNA, 22 bp, Artificial Sequence
  chemically synthesized
tacgtcttatccaggtttagtt

SEQ ID NO: 1143495 - DNA, 22 bp, Artificial Sequence
  chemically synthesized
cttcctgtaataaactaaacct

SEQ ID NO: 1143496 - DNA, 22 bp, Artificial Sequence
  chemically synthesized
tcttcctgtaataaactaaacc

SEQ ID NO: 1143497 - DNA, 22 bp, Artificial Sequence
  chemically synthesized
atccaggtttagtttattacag

SEQ ID NO: 1143498 - DNA, 22 bp, Artificial Sequence
  chemically synthesized
tccaggtttagtttattacagg

SEQ ID NO: 1143499 - DNA, 22 bp, Artificial Sequence
  chemically synthesized
aaaaagcctttcttcctgtaat

SEQ ID NO: 1143500 - DNA, 22 bp, Artificial Sequence
  chemically synthesized
atgctaaaaaagcctttcttcc

SEQ ID NO: 1143501 - DNA, 22 bp, Artificial Sequence
  chemically synthesized
agtttattacaggaagaaaggc

SEQ ID NO: 1143502 - DNA, 22 bp, Artificial Sequence
  chemically synthesized
gtttattacaggaagaaaggct

SEQ ID NO: 1143503 - DNA, 22 bp, Artificial Sequence
  chemically synthesized
taatgctaaaaaagcctttctt

SEQ ID NO: 1143504 - DNA, 22 bp, Artificial Sequence
  chemically synthesized
ctaatgctaaaaaagcctttct

SEQ ID NO: 1143505 - DNA, 22 bp, Artificial Sequence
  chemically synthesized
tctaatgctaaaaaagcctttc

SEQ ID NO: 1143506 - DNA, 22 bp, Artificial Sequence
  chemically synthesized
attacaggaagaaaggcttttt

SEQ ID NO: 1143507 - DNA, 22 bp, Artificial Sequence
  chemically synthesized
ttacaggaagaaaggctttttt

SEQ ID NO: 1143508 - DNA, 22 bp, Artificial Sequence
  chemically synthesized
gttttctaatgctaaaaaagcc

SEQ ID NO: 1143509 - DNA, 22 bp, Artificial Sequence
  chemically synthesized
agttttctaatgctaaaaaagc

SEQ ID NO: 1143510 - DNA, 22 bp, Artificial Sequence
  chemically synthesized
caggaagaaaggcttttttagc

SEQ ID NO: 1143511 - DNA, 22 bp, Artificial Sequence
  chemically synthesized
ttttagcattagaaaactaagt

SEQ ID NO: 1143512 - DNA, 22 bp, Artificial Sequence
  chemically synthesized
tttagcattagaaaactaagtc

SEQ ID NO: 1143513 - DNA, 22 bp, Artificial Sequence
  chemically synthesized
ttagcattagaaaactaagtca

SEQ ID NO: 1143514 - DNA, 22 bp, Artificial Sequence
  chemically synthesized
tagcattagaaaactaagtcat

SEQ ID NO: 1143515 - DNA, 22 bp, Artificial Sequence
  chemically synthesized
agcattagaaaactaagtcatg

SEQ ID NO: 1143516 - DNA, 22 bp, Artificial Sequence
  chemically synthesized
tatgtcaaatcacatgacttag

SEQ ID NO: 1143517 - DNA, 22 bp, Artificial Sequence
  chemically synthesized
gcattagaaaactaagtcatgt

SEQ ID NO: 1143518 - DNA, 22 bp, Artificial Sequence
  chemically synthesized
ctatatgtcaaatcacatgact

SEQ ID NO: 1143519 - DNA, 22 bp, Artificial Sequence
  chemically synthesized
tgctatatgtcaaatcacatga

SEQ ID NO: 1143520 - DNA, 22 bp, Artificial Sequence
  chemically synthesized
gaaaactaagtcatgtgatttg

SEQ ID NO: 1143521 - DNA, 22 bp, Artificial Sequence
  chemically synthesized
ttctgctatatgtcaaatcaca

SEQ ID NO: 1143522 - DNA, 22 bp, Artificial Sequence
  chemically synthesized
attctgctatatgtcaaatcac

SEQ ID NO: 1143523 - DNA, 22 bp, Artificial Sequence
  chemically synthesized
tattctgctatatgtcaaatca

SEQ ID NO: 1143524 - DNA, 22 bp, Artificial Sequence
  chemically synthesized
tttattctgctatatgtcaaat

SEQ ID NO: 1143525 - DNA, 22 bp, Artificial Sequence
  chemically synthesized
ctttattctgctatatgtcaaa

SEQ ID NO: 1143526 - DNA, 22 bp, Artificial Sequence
  chemically synthesized
agtcatgtgatttgacatatag

SEQ ID NO: 1143527 - DNA, 22 bp, Artificial Sequence
  chemically synthesized
ttctttattctgctatatgtca

SEQ ID NO: 1143528 - DNA, 22 bp, Artificial Sequence
  chemically synthesized
cttctttattctgctatatgtc

SEQ ID NO: 1143529 - DNA, 22 bp, Artificial Sequence
  chemically synthesized
tcttctttattctgctatatgt

SEQ ID NO: 1143530 - DNA, 22 bp, Artificial Sequence
  chemically synthesized
ttcttctttattctgctatatg

SEQ ID NO: 1143531 - DNA, 22 bp, Artificial Sequence
  chemically synthesized
gacatatagcagaataaagaag

SEQ ID NO: 1143532 - DNA, 22 bp, Artificial Sequence
  chemically synthesized
acatatagcagaataaagaaga

SEQ ID NO: 1143533 - DNA, 22 bp, Artificial Sequence
  chemically synthesized
agatggtcgtatttttcttctt

SEQ ID NO: 1143534 - DNA, 22 bp, Artificial Sequence
  chemically synthesized
gagatggtcgtatttttcttct

SEQ ID NO: 1143535 - DNA, 22 bp, Artificial Sequence
  chemically synthesized
cagaatcatttgagatggtcgt

SEQ ID NO: 1143536 - DNA, 22 bp, Artificial Sequence
  chemically synthesized
ccagaatcatttgagatggtcg

SEQ ID NO: 1143537 - DNA, 22 bp, Artificial Sequence
  chemically synthesized
tccagaatcatttgagatggtc

SEQ ID NO: 1143538 - DNA, 22 bp, Artificial Sequence
  chemically synthesized
ttccagaatcatttgagatggt

SEQ ID NO: 1143539 - DNA, 22 bp, Artificial Sequence
  chemically synthesized
tcatatatttttccagaatcat

SEQ ID NO: 1143540 - DNA, 22 bp, Artificial Sequence
  chemically synthesized
atcatatatttttccagaatca

SEQ ID NO: 1143541 - DNA, 22 bp, Artificial Sequence
  chemically synthesized
tatcatatatttttccagaatc

SEQ ID NO: 1143542 - DNA, 22 bp, Artificial Sequence
  chemically synthesized
aaatgattctggaaaaatatat

SEQ ID NO: 1143543 - DNA, 22 bp, Artificial Sequence
  chemically synthesized
ccggatgccaaattttatcata

SEQ ID NO: 1143544 - DNA, 22 bp, Artificial Sequence
  chemically synthesized
tggaaaaatatatgataaaatt

SEQ ID NO: 1143545 - DNA, 22 bp, Artificial Sequence
  chemically synthesized
gaaaaatatatgataaaatttg

SEQ ID NO: 1143546 - DNA, 22 bp, Artificial Sequence
  chemically synthesized
tcactaccggatgccaaatttt

SEQ ID NO: 1143547 - DNA, 22 bp, Artificial Sequence
  chemically synthesized
atcactaccggatgccaaattt

SEQ ID NO: 1143548 - DNA, 22 bp, Artificial Sequence
  chemically synthesized
tatcactaccggatgccaaatt

SEQ ID NO: 1143549 - DNA, 22 bp, Artificial Sequence
  chemically synthesized
agaggttttatcactaccggat

SEQ ID NO: 1143550 - DNA, 22 bp, Artificial Sequence
  chemically synthesized
taagaggttttatcactaccgg

SEQ ID NO: 1143551 - DNA, 22 bp, Artificial Sequence
  chemically synthesized
atattctaagaggttttatcac

SEQ ID NO: 1143552 - DNA, 22 bp, Artificial Sequence
  chemically synthesized
ggcatccggtagtgataaaacc

SEQ ID NO: 1143553 - DNA, 22 bp, Artificial Sequence
  chemically synthesized
aatattctaagaggttttatca

SEQ ID NO: 1143554 - DNA, 22 bp, Artificial Sequence
  chemically synthesized
gcatccggtagtgataaaacct

SEQ ID NO: 1143555 - DNA, 22 bp, Artificial Sequence
  chemically synthesized
ttaatattctaagaggttttat

SEQ ID NO: 1143556 - DNA, 22 bp, Artificial Sequence
  chemically synthesized
ttcttaatattctaagaggttt

SEQ ID NO: 1143557 - DNA, 22 bp, Artificial Sequence
  chemically synthesized
tgttcttaatattctaagaggt

SEQ ID NO: 1143558 - DNA, 22 bp, Artificial Sequence
  chemically synthesized
ctgttcttaatattctaagagg

SEQ ID NO: 1143559 - DNA, 22 bp, Artificial Sequence
  chemically synthesized
tagataccttctgttcttaata

SEQ ID NO: 1143560 - DNA, 22 bp, Artificial Sequence
  chemically synthesized
ttgtagataccttctgttctta

SEQ ID NO: 1143561 - DNA, 22 bp, Artificial Sequence
  chemically synthesized
gttgtagataccttctgttctt

SEQ ID NO: 1143562 - DNA, 22 bp, Artificial Sequence
  chemically synthesized
ttagaatattaagaacagaagg

SEQ ID NO: 1143563 - DNA, 22 bp, Artificial Sequence
  chemically synthesized
agaatattaagaacagaaggta

SEQ ID NO: 1143564 - DNA, 22 bp, Artificial Sequence
  chemically synthesized
gaatattaagaacagaaggtat

SEQ ID NO: 1143565 - DNA, 22 bp, Artificial Sequence
  chemically synthesized
taggtttgttgtagataccttc

SEQ ID NO: 1143566 - DNA, 22 bp, Artificial Sequence
  chemically synthesized
ctgtaggtttgttgtagatacc

SEQ ID NO: 1143567 - DNA, 22 bp, Artificial Sequence
  chemically synthesized
cctgtaggtttgttgtagatac

SEQ ID NO: 1143568 - DNA, 22 bp, Artificial Sequence
  chemically synthesized
tcctgtaggtttgttgtagata

SEQ ID NO: 1143569 - DNA, 22 bp, Artificial Sequence
  chemically synthesized
agaacagaaggtatctacaaca

SEQ ID NO: 1143570 - DNA, 22 bp, Artificial Sequence
  chemically synthesized
agtatgatctttcctgtaggtt

SEQ ID NO: 1143571 - DNA, 22 bp, Artificial Sequence
  chemically synthesized
caacaaacctacaggaaagatc

SEQ ID NO: 1143572 - DNA, 22 bp, Artificial Sequence
  chemically synthesized
ataaataatcattaagtatgat

SEQ ID NO: 1143573 - DNA, 22 bp, Artificial Sequence
  chemically synthesized
aataaataatcattaagtatga

SEQ ID NO: 1143574 - DNA, 22 bp, Artificial Sequence
  chemically synthesized
taataaataatcattaagtatg

SEQ ID NO: 1143575 - DNA, 22 bp, Artificial Sequence
  chemically synthesized
caggaaagatcatacttaatga

SEQ ID NO: 1143576 - DNA, 22 bp, Artificial Sequence
  chemically synthesized
agagggaagaactttaataaat

SEQ ID NO: 1143577 - DNA, 22 bp, Artificial Sequence
  chemically synthesized
aatgattatttattaaagttct

SEQ ID NO: 1143578 - DNA, 22 bp, Artificial Sequence
  chemically synthesized
atgattatttattaaagttctt

SEQ ID NO: 1143579 - DNA, 22 bp, Artificial Sequence
  chemically synthesized
agtctcagagggaagaacttta

SEQ ID NO: 1143580 - DNA, 22 bp, Artificial Sequence
  chemically synthesized
aagtctcagagggaagaacttt

SEQ ID NO: 1143581 - DNA, 22 bp, Artificial Sequence
  chemically synthesized
taagtctcagagggaagaactt

SEQ ID NO: 1143582 - DNA, 22 bp, Artificial Sequence
  chemically synthesized
attttaagtctcagagggaaga

SEQ ID NO: 1143583 - DNA, 22 bp, Artificial Sequence
  chemically synthesized
tttattaaagttcttccctctg

SEQ ID NO: 1143584 - DNA, 22 bp, Artificial Sequence
  chemically synthesized
tcattttaagtctcagagggaa

SEQ ID NO: 1143585 - DNA, 22 bp, Artificial Sequence
  chemically synthesized
ctcattttaagtctcagaggga

SEQ ID NO: 1143586 - DNA, 22 bp, Artificial Sequence
  chemically synthesized
attaaagttcttccctctgaga

SEQ ID NO: 1143587 - DNA, 22 bp, Artificial Sequence
  chemically synthesized
ttaaagttcttccctctgagac

SEQ ID NO: 1143588 - DNA, 22 bp, Artificial Sequence
  chemically synthesized
tttctcattttaagtctcagag

SEQ ID NO: 1143589 - DNA, 22 bp, Artificial Sequence
  chemically synthesized
atttctcattttaagtctcaga

SEQ ID NO: 1143590 - DNA, 22 bp, Artificial Sequence
  chemically synthesized
aagttcttccctctgagactta

SEQ ID NO: 1143591 - DNA, 22 bp, Artificial Sequence
  chemically synthesized
ttccctctgagacttaaaatga

SEQ ID NO: 1143592 - DNA, 22 bp, Artificial Sequence
  chemically synthesized
ccctctgagacttaaaatgaga

SEQ ID NO: 1143593 - DNA, 22 bp, Artificial Sequence
  chemically synthesized
tggatatttatttctcatttta

SEQ ID NO: 1143594 - DNA, 22 bp, Artificial Sequence
  chemically synthesized
cctctgagacttaaaatgagaa

SEQ ID NO: 1143595 - DNA, 22 bp, Artificial Sequence
  chemically synthesized
tgagacttaaaatgagaaataa

SEQ ID NO: 1143596 - DNA, 22 bp, Artificial Sequence
  chemically synthesized
agacttaaaatgagaaataaat

SEQ ID NO: 1143597 - DNA, 22 bp, Artificial Sequence
  chemically synthesized
aaaatgagaaataaatatccac

SEQ ID NO: 1143598 - DNA, 22 bp, Artificial Sequence
  chemically synthesized
aaatgagaaataaatatccaca

SEQ ID NO: 1143599 - DNA, 22 bp, Artificial Sequence
  chemically synthesized
gtacaatgggagtattgtggat

SEQ ID NO: 1143600 - DNA, 22 bp, Artificial Sequence
  chemically synthesized
tagtacaatgggagtattgtgg

SEQ ID NO: 1143601 - DNA, 22 bp, Artificial Sequence
  chemically synthesized
tataaatactctagtacaatgg

SEQ ID NO: 1143602 - DNA, 22 bp, Artificial Sequence
  chemically synthesized
tactgtataaatactctagtac

SEQ ID NO: 1143603 - DNA, 22 bp, Artificial Sequence
  chemically synthesized
ccattgtactagagtatttata

SEQ ID NO: 1143604 - DNA, 22 bp, Artificial Sequence
  chemically synthesized
acatattgtactgtataaatac

SEQ ID NO: 1143605 - DNA, 22 bp, Artificial Sequence
  chemically synthesized
cctgacatattgtactgtataa

SEQ ID NO: 1143606 - DNA, 22 bp, Artificial Sequence
  chemically synthesized
tactagagtatttatacagtac

SEQ ID NO: 1143607 - DNA, 22 bp, Artificial Sequence
  chemically synthesized
ccctgacatattgtactgtata

SEQ ID NO: 1143608 - DNA, 22 bp, Artificial Sequence
  chemically synthesized
tccctgacatattgtactgtat

SEQ ID NO: 1143609 - DNA, 22 bp, Artificial Sequence
  chemically synthesized
gagtatttatacagtacaatat

SEQ ID NO: 1143610 - DNA, 22 bp, Artificial Sequence
  chemically synthesized
attttccctgacatattgtact

SEQ ID NO: 1143611 - DNA, 22 bp, Artificial Sequence
  chemically synthesized
atacagtacaatatgtcaggga

SEQ ID NO: 1143612 - DNA, 22 bp, Artificial Sequence
  chemically synthesized
tacagtacaatatgtcagggaa

SEQ ID NO: 1143613 - DNA, 22 bp, Artificial Sequence
  chemically synthesized
atgtcattaattttccctgaca

SEQ ID NO: 1143614 - DNA, 22 bp, Artificial Sequence
  chemically synthesized
catgtcattaattttccctgac

SEQ ID NO: 1143615 - DNA, 22 bp, Artificial Sequence
  chemically synthesized
tcatgtcattaattttccctga

SEQ ID NO: 1143616 - DNA, 22 bp, Artificial Sequence
  chemically synthesized
ttcatgtcattaattttccctg

SEQ ID NO: 1143617 - DNA, 22 bp, Artificial Sequence
  chemically synthesized
tttttcatgtcattaattttcc

SEQ ID NO: 1143618 - DNA, 22 bp, Artificial Sequence
  chemically synthesized
caattatttttcatgtcattaa

SEQ ID NO: 1143619 - DNA, 22 bp, Artificial Sequence
  chemically synthesized
ccaattatttttcatgtcatta

SEQ ID NO: 1143620 - DNA, 22 bp, Artificial Sequence
  chemically synthesized
tccaattatttttcatgtcatt

SEQ ID NO: 1143621 - DNA, 22 bp, Artificial Sequence
  chemically synthesized
cctttccaattatttttcatgt

SEQ ID NO: 1143622 - DNA, 22 bp, Artificial Sequence
  chemically synthesized
tccctttccaattatttttcat

SEQ ID NO: 1143623 - DNA, 22 bp, Artificial Sequence
  chemically synthesized
ctccctttccaattatttttca

SEQ ID NO: 1143624 - DNA, 22 bp, Artificial Sequence
  chemically synthesized
tctccctttccaattatttttc

SEQ ID NO: 1143625 - DNA, 22 bp, Artificial Sequence
  chemically synthesized
tttctccctttccaattatttt

SEQ ID NO: 1143626 - DNA, 22 bp, Artificial Sequence
  chemically synthesized
ctttctccctttccaattattt

SEQ ID NO: 1143627 - DNA, 22 bp, Artificial Sequence
  chemically synthesized
tctttctccctttccaattatt

SEQ ID NO: 1143628 - DNA, 22 bp, Artificial Sequence
  chemically synthesized
atgacatgaaaaataattggaa

SEQ ID NO: 1143629 - DNA, 22 bp, Artificial Sequence
  chemically synthesized
agtaatgacagttttctttctc

SEQ ID NO: 1143630 - DNA, 22 bp, Artificial Sequence
  chemically synthesized
gagtaatgacagttttctttct

SEQ ID NO: 1143631 - DNA, 22 bp, Artificial Sequence
  chemically synthesized
tgagtaatgacagttttctttc

SEQ ID NO: 1143632 - DNA, 22 bp, Artificial Sequence
  chemically synthesized
ttgagtaatgacagttttcttt

SEQ ID NO: 1143633 - DNA, 22 bp, Artificial Sequence
  chemically synthesized
gaaagggagaaagaaaactgtc

SEQ ID NO: 1143634 - DNA, 22 bp, Artificial Sequence
  chemically synthesized
tttttgagtaatgacagttttc

SEQ ID NO: 1143635 - DNA, 22 bp, Artificial Sequence
  chemically synthesized
tcattactcaaaaacaacctat

SEQ ID NO: 1143636 - DNA, 22 bp, Artificial Sequence
  chemically synthesized
agatgtacatatataggttgtt

SEQ ID NO: 1143637 - DNA, 22 bp, Artificial Sequence
  chemically synthesized
ttcagatgtacatatataggtt

SEQ ID NO: 1143638 - DNA, 22 bp, Artificial Sequence
  chemically synthesized
ctcaaaaacaacctatatatgt

SEQ ID NO: 1143639 - DNA, 22 bp, Artificial Sequence
  chemically synthesized
aaaaacaacctatatatgtaca

SEQ ID NO: 1143640 - DNA, 22 bp, Artificial Sequence
  chemically synthesized
tagtattattcagatgtacata

SEQ ID NO: 1143641 - DNA, 22 bp, Artificial Sequence
  chemically synthesized
tctgtagtattattcagatgta

SEQ ID NO: 1143642 - DNA, 22 bp, Artificial Sequence
  chemically synthesized
tatatgtacatctgaataatac

SEQ ID NO: 1143643 - DNA, 22 bp, Artificial Sequence
  chemically synthesized
aatacattatctgtagtattat

SEQ ID NO: 1143644 - DNA, 22 bp, Artificial Sequence
  chemically synthesized
gaatacattatctgtagtatta

SEQ ID NO: 1143645 - DNA, 22 bp, Artificial Sequence
  chemically synthesized
ataatttgaatacattatctgt

SEQ ID NO: 1143646 - DNA, 22 bp, Artificial Sequence
  chemically synthesized
aataatttgaatacattatctg

SEQ ID NO: 1143647 - DNA, 22 bp, Artificial Sequence
  chemically synthesized
aataatactacagataatgtat

SEQ ID NO: 1143648 - DNA, 22 bp, Artificial Sequence
  chemically synthesized
cttaataatttgaatacattat

SEQ ID NO: 1143649 - DNA, 22 bp, Artificial Sequence
  chemically synthesized
acttaataatttgaatacatta

SEQ ID NO: 1143650 - DNA, 22 bp, Artificial Sequence
  chemically synthesized
catttacttaataatttgaata

SEQ ID NO: 1143651 - DNA, 22 bp, Artificial Sequence
  chemically synthesized
cagataatgtattcaaattatt

SEQ ID NO: 1143652 - DNA, 22 bp, Artificial Sequence
  chemically synthesized
aaattattaagtaaatgtagca

SEQ ID NO: 1143653 - DNA, 22 bp, Artificial Sequence
  chemically synthesized
tatccaggtaccatgctacatt

SEQ ID NO: 1143654 - DNA, 22 bp, Artificial Sequence
  chemically synthesized
gtatccaggtaccatgctacat

SEQ ID NO: 1143655 - DNA, 22 bp, Artificial Sequence
  chemically synthesized
ttaagtaaatgtagcatggtac

SEQ ID NO: 1143656 - DNA, 22 bp, Artificial Sequence
  chemically synthesized
gtcttgtatccaggtaccatgc

SEQ ID NO: 1143657 - DNA, 22 bp, Artificial Sequence
  chemically synthesized
ggtcttgtatccaggtaccatg

SEQ ID NO: 1143658 - DNA, 22 bp, Artificial Sequence
  chemically synthesized
agtaaatgtagcatggtacctg

SEQ ID NO: 1143659 - DNA, 22 bp, Artificial Sequence
  chemically synthesized
ttggtcttgtatccaggtacca

SEQ ID NO: 1143660 - DNA, 22 bp, Artificial Sequence
  chemically synthesized
cttggtcttgtatccaggtacc

SEQ ID NO: 1143661 - DNA, 22 bp, Artificial Sequence
  chemically synthesized
tcttggtcttgtatccaggtac

SEQ ID NO: 1143662 - DNA, 22 bp, Artificial Sequence
  chemically synthesized
ttcttggtcttgtatccaggta

SEQ ID NO: 1143663 - DNA, 22 bp, Artificial Sequence
  chemically synthesized
tttcttggtcttgtatccaggt

SEQ ID NO: 1143664 - DNA, 22 bp, Artificial Sequence
  chemically synthesized
ttttcttggtcttgtatccagg

SEQ ID NO: 1143665 - DNA, 22 bp, Artificial Sequence
  chemically synthesized
tttttcttggtcttgtatccag

SEQ ID NO: 1143666 - DNA, 22 bp, Artificial Sequence
  chemically synthesized
attttttttcttggtcttgtat

SEQ ID NO: 1143667 - DNA, 22 bp, Artificial Sequence
  chemically synthesized
gatacaagaccaagaaaaaaaa

SEQ ID NO: 1143668 - DNA, 22 bp, Artificial Sequence
  chemically synthesized
atataaagaaatacagttgatt

SEQ ID NO: 1143669 - DNA, 22 bp, Artificial Sequence
  chemically synthesized
tgctgatataaagaaatacagt

SEQ ID NO: 1143670 - DNA, 22 bp, Artificial Sequence
  chemically synthesized
gtgctgatataaagaaatacag

SEQ ID NO: 1143671 - DNA, 22 bp, Artificial Sequence
  chemically synthesized
tttgtgctgatataaagaaata

SEQ ID NO: 1143672 - DNA, 22 bp, Artificial Sequence
  chemically synthesized
tatttgtgctgatataaagaaa

SEQ ID NO: 1143673 - DNA, 22 bp, Artificial Sequence
  chemically synthesized
ctatttgtgctgatataaagaa

SEQ ID NO: 1143674 - DNA, 22 bp, Artificial Sequence
  chemically synthesized
tctatttgtgctgatataaaga

SEQ ID NO: 1143675 - DNA, 22 bp, Artificial Sequence
  chemically synthesized
attttctatttgtgctgatata

SEQ ID NO: 1143676 - DNA, 22 bp, Artificial Sequence
  chemically synthesized
cattttctatttgtgctgatat

SEQ ID NO: 1143677 - DNA, 22 bp, Artificial Sequence
  chemically synthesized
tatttctttatatcagcacaaa

SEQ ID NO: 1143678 - DNA, 22 bp, Artificial Sequence
  chemically synthesized
aaatttcattttctatttgtgc

SEQ ID NO: 1143679 - DNA, 22 bp, Artificial Sequence
  chemically synthesized
gaaatttcattttctatttgtg

SEQ ID NO: 1143680 - DNA, 22 bp, Artificial Sequence
  chemically synthesized
ctttatatcagcacaaatagaa

SEQ ID NO: 1143681 - DNA, 22 bp, Artificial Sequence
  chemically synthesized
tgaaatttcattttctatttgt

SEQ ID NO: 1143682 - DNA, 22 bp, Artificial Sequence
  chemically synthesized
tttatatcagcacaaatagaaa

SEQ ID NO: 1143683 - DNA, 22 bp, Artificial Sequence
  chemically synthesized
ttgaaatttcattttctatttg

SEQ ID NO: 1143684 - DNA, 22 bp, Artificial Sequence
  chemically synthesized
tatatcagcacaaatagaaaat

SEQ ID NO: 1143685 - DNA, 22 bp, Artificial Sequence
  chemically synthesized
atatcagcacaaatagaaaatg

SEQ ID NO: 1143686 - DNA, 22 bp, Artificial Sequence
  chemically synthesized
tatcagcacaaatagaaaatga

SEQ ID NO: 1143687 - DNA, 22 bp, Artificial Sequence
  chemically synthesized
tgaatatatttttgaaatttca

SEQ ID NO: 1143688 - DNA, 22 bp, Artificial Sequence
  chemically synthesized
ttatgaatatatttttgaaatt

SEQ ID NO: 1143689 - DNA, 22 bp, Artificial Sequence
  chemically synthesized
ctgttatgaatatatttttgaa

SEQ ID NO: 1143690 - DNA, 22 bp, Artificial Sequence
  chemically synthesized
gctgttatgaatatatttttga

SEQ ID NO: 1143691 - DNA, 22 bp, Artificial Sequence
  chemically synthesized
tgctgttatgaatatatttttg

SEQ ID NO: 1143692 - DNA, 22 bp, Artificial Sequence
  chemically synthesized
ttgctgttatgaatatattttt

SEQ ID NO: 1143693 - DNA, 22 bp, Artificial Sequence
  chemically synthesized
tatttttgctgttatgaatata

SEQ ID NO: 1143694 - DNA, 22 bp, Artificial Sequence
  chemically synthesized
atatttttgctgttatgaatat

SEQ ID NO: 1143695 - DNA, 22 bp, Artificial Sequence
  chemically synthesized
tatatttttgctgttatgaata

SEQ ID NO: 1143696 - DNA, 22 bp, Artificial Sequence
  chemically synthesized
ttatatttttgctgttatgaat

SEQ ID NO: 1143697 - DNA, 22 bp, Artificial Sequence
  chemically synthesized
caaaaatatattcataacagca

SEQ ID NO: 1143698 - DNA, 22 bp, Artificial Sequence
  chemically synthesized
aaaaatatattcataacagcaa

SEQ ID NO: 1143699 - DNA, 22 bp, Artificial Sequence
  chemically synthesized
ggtttttatatttttgctgtta

SEQ ID NO: 1143700 - DNA, 22 bp, Artificial Sequence
  chemically synthesized
gggtttttatatttttgctgtt

SEQ ID NO: 1143701 - DNA, 22 bp, Artificial Sequence
  chemically synthesized
ttgggtttttatatttttgctg

SEQ ID NO: 1143702 - DNA, 22 bp, Artificial Sequence
  chemically synthesized
cttgggtttttatatttttgct

SEQ ID NO: 1143703 - DNA, 22 bp, Artificial Sequence
  chemically synthesized
tttcttgggtttttatattttt

SEQ ID NO: 1143704 - DNA, 22 bp, Artificial Sequence
  chemically synthesized
atttcttgggtttttatatttt

SEQ ID NO: 1143705 - DNA, 22 bp, Artificial Sequence
  chemically synthesized
ataacagcaaaaatataaaaac

SEQ ID NO: 1143706 - DNA, 22 bp, Artificial Sequence
  chemically synthesized
agatttatttcttgggttttta

SEQ ID NO: 1143707 - DNA, 22 bp, Artificial Sequence
  chemically synthesized
tgagatttatttcttgggtttt

SEQ ID NO: 1143708 - DNA, 22 bp, Artificial Sequence
  chemically synthesized
tctgagatttatttcttgggtt

SEQ ID NO: 1143709 - DNA, 22 bp, Artificial Sequence
  chemically synthesized
ctctgagatttatttcttgggt

SEQ ID NO: 1143710 - DNA, 22 bp, Artificial Sequence
  chemically synthesized
tctctgagatttatttcttggg

SEQ ID NO: 1143711 - DNA, 22 bp, Artificial Sequence
  chemically synthesized
aactttctctgagatttatttc

SEQ ID NO: 1143712 - DNA, 22 bp, Artificial Sequence
  chemically synthesized
aaactttctctgagatttattt

SEQ ID NO: 1143713 - DNA, 22 bp, Artificial Sequence
  chemically synthesized
ttaaactttctctgagatttat

SEQ ID NO: 1143714 - DNA, 22 bp, Artificial Sequence
  chemically synthesized
aagtaaaggctcttaaactttc

SEQ ID NO: 1143715 - DNA, 22 bp, Artificial Sequence
  chemically synthesized
aaagtaaaggctcttaaacttt

SEQ ID NO: 1143716 - DNA, 22 bp, Artificial Sequence
  chemically synthesized
taaagtaaaggctcttaaactt

SEQ ID NO: 1143717 - DNA, 22 bp, Artificial Sequence
  chemically synthesized
ttaaagtaaaggctcttaaact

SEQ ID NO: 1143718 - DNA, 22 bp, Artificial Sequence
  chemically synthesized
agagaaagtttaagagccttta

SEQ ID NO: 1143719 - DNA, 22 bp, Artificial Sequence
  chemically synthesized
tagtttttaaagtaaaggctct

SEQ ID NO: 1143720 - DNA, 22 bp, Artificial Sequence
  chemically synthesized
atagtttttaaagtaaaggctc

SEQ ID NO: 1143721 - DNA, 22 bp, Artificial Sequence
  chemically synthesized
tatagtttttaaagtaaaggct

SEQ ID NO: 1143722 - DNA, 22 bp, Artificial Sequence
  chemically synthesized
aagagcctttactttaaaaact

SEQ ID NO: 1143723 - DNA, 22 bp, Artificial Sequence
  chemically synthesized
agagcctttactttaaaaacta

SEQ ID NO: 1143724 - DNA, 22 bp, Artificial Sequence
  chemically synthesized
aataatgttttatagtttttaa

SEQ ID NO: 1143725 - DNA, 22 bp, Artificial Sequence
  chemically synthesized
tcaataatgttttatagttttt

SEQ ID NO: 1143726 - DNA, 22 bp, Artificial Sequence
  chemically synthesized
tctcaataatgttttatagttt

SEQ ID NO: 1143727 - DNA, 22 bp, Artificial Sequence
  chemically synthesized
ctctcaataatgttttatagtt

SEQ ID NO: 1143728 - DNA, 22 bp, Artificial Sequence
  chemically synthesized
tctctcaataatgttttatagt

SEQ ID NO: 1143729 - DNA, 22 bp, Artificial Sequence
  chemically synthesized
tactttaaaaactataaaacat

SEQ ID NO: 1143730 - DNA, 22 bp, Artificial Sequence
  chemically synthesized
actttaaaaactataaaacatt

SEQ ID NO: 1143731 - DNA, 22 bp, Artificial Sequence
  chemically synthesized
ttttctctcaataatgttttat

SEQ ID NO: 1143732 - DNA, 22 bp, Artificial Sequence
  chemically synthesized
ctttaaaaactataaaacatta

SEQ ID NO: 1143733 - DNA, 22 bp, Artificial Sequence
  chemically synthesized
attttctctcaataatgtttta

SEQ ID NO: 1143734 - DNA, 22 bp, Artificial Sequence
  chemically synthesized
tattttctctcaataatgtttt

SEQ ID NO: 1143735 - DNA, 22 bp, Artificial Sequence
  chemically synthesized
taaaaactataaaacattattg

SEQ ID NO: 1143736 - DNA, 22 bp, Artificial Sequence
  chemically synthesized
aaaaactataaaacattattga

SEQ ID NO: 1143737 - DNA, 22 bp, Artificial Sequence
  chemically synthesized
aaaactataaaacattattgag

SEQ ID NO: 1143738 - DNA, 22 bp, Artificial Sequence
  chemically synthesized
ggtctttattttctctcaataa

SEQ ID NO: 1143739 - DNA, 22 bp, Artificial Sequence
  chemically synthesized
gttaggtctttattttctctca

SEQ ID NO: 1143740 - DNA, 22 bp, Artificial Sequence
  chemically synthesized
taaaacattattgagagaaaat

SEQ ID NO: 1143741 - DNA, 22 bp, Artificial Sequence
  chemically synthesized
agttaggtctttattttctctc

SEQ ID NO: 1143742 - DNA, 22 bp, Artificial Sequence
  chemically synthesized
atttagttaggtctttattttc

SEQ ID NO: 1143743 - DNA, 22 bp, Artificial Sequence
  chemically synthesized
catttagttaggtctttatttt

SEQ ID NO: 1143744 - DNA, 22 bp, Artificial Sequence
  chemically synthesized
tcatttagttaggtctttattt

SEQ ID NO: 1143745 - DNA, 22 bp, Artificial Sequence
  chemically synthesized
ttgagagaaaataaagacctaa

SEQ ID NO: 1143746 - DNA, 22 bp, Artificial Sequence
  chemically synthesized
agagaaaataaagacctaacta

SEQ ID NO: 1143747 - DNA, 22 bp, Artificial Sequence
  chemically synthesized
aatcctttcatttagttaggtc

SEQ ID NO: 1143748 - DNA, 22 bp, Artificial Sequence
  chemically synthesized
caatcctttcatttagttaggt

SEQ ID NO: 1143749 - DNA, 22 bp, Artificial Sequence
  chemically synthesized
tcaatcctttcatttagttagg

SEQ ID NO: 1143750 - DNA, 22 bp, Artificial Sequence
  chemically synthesized
tgtaaagtctttcaatcctttc

SEQ ID NO: 1143751 - DNA, 22 bp, Artificial Sequence
  chemically synthesized
ttatgtaaagtctttcaatcct

SEQ ID NO: 1143752 - DNA, 22 bp, Artificial Sequence
  chemically synthesized
attatgtaaagtctttcaatcc

SEQ ID NO: 1143753 - DNA, 22 bp, Artificial Sequence
  chemically synthesized
actaaatgaaaggattgaaaga

SEQ ID NO: 1143754 - DNA, 22 bp, Artificial Sequence
  chemically synthesized
tattatgtaaagtctttcaatc

SEQ ID NO: 1143755 - DNA, 22 bp, Artificial Sequence
  chemically synthesized
ttattatgtaaagtctttcaat

SEQ ID NO: 1143756 - DNA, 22 bp, Artificial Sequence
  chemically synthesized
aatgaaaggattgaaagacttt

SEQ ID NO: 1143757 - DNA, 22 bp, Artificial Sequence
  chemically synthesized
aaagactttacataataaaaat

SEQ ID NO: 1143758 - DNA, 22 bp, Artificial Sequence
  chemically synthesized
tacagaatcaacatttttatta

SEQ ID NO: 1143759 - DNA, 22 bp, Artificial Sequence
  chemically synthesized
gtacagaatcaacatttttatt

SEQ ID NO: 1143760 - DNA, 22 bp, Artificial Sequence
  chemically synthesized
tacataataaaaatgttgattc

SEQ ID NO: 1143761 - DNA, 22 bp, Artificial Sequence
  chemically synthesized
acataataaaaatgttgattct

SEQ ID NO: 1143762 - DNA, 22 bp, Artificial Sequence
  chemically synthesized
cataataaaaatgttgattctg

SEQ ID NO: 1143763 - DNA, 22 bp, Artificial Sequence
  chemically synthesized
gatcaacttgtacagaatcaac

SEQ ID NO: 1143764 - DNA, 22 bp, Artificial Sequence
  chemically synthesized
tggatcaacttgtacagaatca

SEQ ID NO: 1143765 - DNA, 22 bp, Artificial Sequence
  chemically synthesized
tctggatcaacttgtacagaat

SEQ ID NO: 1143766 - DNA, 22 bp, Artificial Sequence
  chemically synthesized
ttctctggatcaacttgtacag

SEQ ID NO: 1143767 - DNA, 22 bp, Artificial Sequence
  chemically synthesized
atctattctctggatcaacttg

SEQ ID NO: 1143768 - DNA, 22 bp, Artificial Sequence
  chemically synthesized
catctattctctggatcaactt

SEQ ID NO: 1143769 - DNA, 22 bp, Artificial Sequence
  chemically synthesized
attctgtacaagttgatccaga

SEQ ID NO: 1143770 - DNA, 22 bp, Artificial Sequence
  chemically synthesized
gatttcatctattctctggatc

SEQ ID NO: 1143771 - DNA, 22 bp, Artificial Sequence
  chemically synthesized
tgtacaagttgatccagagaat

SEQ ID NO: 1143772 - DNA, 22 bp, Artificial Sequence
  chemically synthesized
tacaagttgatccagagaatag

SEQ ID NO: 1143773 - DNA, 22 bp, Artificial Sequence
  chemically synthesized
attggatttcatctattctctg

SEQ ID NO: 1143774 - DNA, 22 bp, Artificial Sequence
  chemically synthesized
aattggatttcatctattctct

SEQ ID NO: 1143775 - DNA, 22 bp, Artificial Sequence
  chemically synthesized
taattggatttcatctattctc

SEQ ID NO: 1143776 - DNA, 22 bp, Artificial Sequence
  chemically synthesized
tggttttaattggatttcatct

SEQ ID NO: 1143777 - DNA, 22 bp, Artificial Sequence
  chemically synthesized
atccagagaatagatgaaatcc

SEQ ID NO: 1143778 - DNA, 22 bp, Artificial Sequence
  chemically synthesized
ctgtggttttaattggatttca

SEQ ID NO: 1143779 - DNA, 22 bp, Artificial Sequence
  chemically synthesized
cccccaaaaagaatctgctgtg

SEQ ID NO: 1143780 - DNA, 22 bp, Artificial Sequence
  chemically synthesized
aaaccacagcagattctttttg

SEQ ID NO: 1143781 - DNA, 22 bp, Artificial Sequence
  chemically synthesized
tgaaccctgcccccaaaaagaa

SEQ ID NO: 1143782 - DNA, 22 bp, Artificial Sequence
  chemically synthesized
gtgaaccctgcccccaaaaaga

SEQ ID NO: 1143783 - DNA, 22 bp, Artificial Sequence
  chemically synthesized
agaacagcttgtgaaccctgcc

SEQ ID NO: 1143784 - DNA, 22 bp, Artificial Sequence
  chemically synthesized
aagaacagcttgtgaaccctgc

SEQ ID NO: 1143785 - DNA, 22 bp, Artificial Sequence
  chemically synthesized
taagaacagcttgtgaaccctg

SEQ ID NO: 1143786 - DNA, 22 bp, Artificial Sequence
  chemically synthesized
tttttgggggcagggttcacaa

SEQ ID NO: 1143787 - DNA, 22 bp, Artificial Sequence
  chemically synthesized
tttgggggcagggttcacaagc

SEQ ID NO: 1143788 - DNA, 22 bp, Artificial Sequence
  chemically synthesized
ttgggggcagggttcacaagct

SEQ ID NO: 1143789 - DNA, 22 bp, Artificial Sequence
  chemically synthesized
tgggggcagggttcacaagctg

SEQ ID NO: 1143790 - DNA, 22 bp, Artificial Sequence
  chemically synthesized
gggggcagggttcacaagctgt

SEQ ID NO: 1143791 - DNA, 22 bp, Artificial Sequence
  chemically synthesized
ggggcagggttcacaagctgtt

SEQ ID NO: 1143792 - DNA, 22 bp, Artificial Sequence
  chemically synthesized
catatgaattttaagaacagct

SEQ ID NO: 1143793 - DNA, 22 bp, Artificial Sequence
  chemically synthesized
gatctccatatgaattttaaga

SEQ ID NO: 1143794 - DNA, 22 bp, Artificial Sequence
  chemically synthesized
cgatctccatatgaattttaag

SEQ ID NO: 1143795 - DNA, 22 bp, Artificial Sequence
  chemically synthesized
acaagctgttcttaaaattcat

SEQ ID NO: 1143796 - DNA, 22 bp, Artificial Sequence
  chemically synthesized
gccatttcgatctccatatgaa

SEQ ID NO: 1143797 - DNA, 22 bp, Artificial Sequence
  chemically synthesized
ggccatttcgatctccatatga

SEQ ID NO: 1143798 - DNA, 22 bp, Artificial Sequence
  chemically synthesized
tggccatttcgatctccatatg

SEQ ID NO: 1143799 - DNA, 22 bp, Artificial Sequence
  chemically synthesized
ttcttaaaattcatatggagat

SEQ ID NO: 1143800 - DNA, 22 bp, Artificial Sequence
  chemically synthesized
ttggccatttcgatctccatat

SEQ ID NO: 1143801 - DNA, 22 bp, Artificial Sequence
  chemically synthesized
ttaaaattcatatggagatcga

SEQ ID NO: 1143802 - DNA, 22 bp, Artificial Sequence
  chemically synthesized
cttttggccatttcgatctcca

SEQ ID NO: 1143803 - DNA, 22 bp, Artificial Sequence
  chemically synthesized
aaaattcatatggagatcgaaa

SEQ ID NO: 1143804 - DNA, 22 bp, Artificial Sequence
  chemically synthesized
aaattcatatggagatcgaaat

SEQ ID NO: 1143805 - DNA, 22 bp, Artificial Sequence
  chemically synthesized
actgcttttggccatttcgatc

SEQ ID NO: 1143806 - DNA, 22 bp, Artificial Sequence
  chemically synthesized
gactgcttttggccatttcgat

SEQ ID NO: 1143807 - DNA, 22 bp, Artificial Sequence
  chemically synthesized
atatggagatcgaaatggccaa

SEQ ID NO: 1143808 - DNA, 22 bp, Artificial Sequence
  chemically synthesized
tcttgactgcttttggccattt

SEQ ID NO: 1143809 - DNA, 22 bp, Artificial Sequence
  chemically synthesized
aagattatcttgactgcttttg

SEQ ID NO: 1143810 - DNA, 22 bp, Artificial Sequence
  chemically synthesized
aaagattatcttgactgctttt

SEQ ID NO: 1143811 - DNA, 22 bp, Artificial Sequence
  chemically synthesized
taaagattatcttgactgcttt

SEQ ID NO: 1143812 - DNA, 22 bp, Artificial Sequence
  chemically synthesized
ttaaagattatcttgactgctt

SEQ ID NO: 1143813 - DNA, 22 bp, Artificial Sequence
  chemically synthesized
tttaaagattatcttgactgct

SEQ ID NO: 1143814 - DNA, 22 bp, Artificial Sequence
  chemically synthesized
ctttttaaagattatcttgact

SEQ ID NO: 1143815 - DNA, 22 bp, Artificial Sequence
  chemically synthesized
cctttttaaagattatcttgac

SEQ ID NO: 1143816 - DNA, 22 bp, Artificial Sequence
  chemically synthesized
ttcctttttaaagattatcttg

SEQ ID NO: 1143817 - DNA, 22 bp, Artificial Sequence
  chemically synthesized
cttcctttttaaagattatctt

SEQ ID NO: 1143818 - DNA, 22 bp, Artificial Sequence
  chemically synthesized
tcttcctttttaaagattatct

SEQ ID NO: 1143819 - DNA, 22 bp, Artificial Sequence
  chemically synthesized
ttttcttcctttttaaagatta

SEQ ID NO: 1143820 - DNA, 22 bp, Artificial Sequence
  chemically synthesized
attttcttcctttttaaagatt

SEQ ID NO: 1143821 - DNA, 22 bp, Artificial Sequence
  chemically synthesized
tattttcttcctttttaaagat

SEQ ID NO: 1143822 - DNA, 22 bp, Artificial Sequence
  chemically synthesized
taaaaaggaagaaaataaaatg

SEQ ID NO: 1143823 - DNA, 22 bp, Artificial Sequence
  chemically synthesized
gtcagtaaaagccattttattt

SEQ ID NO: 1143824 - DNA, 22 bp, Artificial Sequence
  chemically synthesized
aaaaaggaagaaaataaaatgg

SEQ ID NO: 1143825 - DNA, 22 bp, Artificial Sequence
  chemically synthesized
aaaaggaagaaaataaaatggc

SEQ ID NO: 1143826 - DNA, 22 bp, Artificial Sequence
  chemically synthesized
gtcagttggtcagtaaaagcca

SEQ ID NO: 1143827 - DNA, 22 bp, Artificial Sequence
  chemically synthesized
ggtcagttggtcagtaaaagcc

SEQ ID NO: 1143828 - DNA, 22 bp, Artificial Sequence
  chemically synthesized
tggtcagttggtcagtaaaagc

SEQ ID NO: 1143829 - DNA, 22 bp, Artificial Sequence
  chemically synthesized
ttttggtcagttggtcagtaaa

SEQ ID NO: 1143830 - DNA, 22 bp, Artificial Sequence
  chemically synthesized
gttttggtcagttggtcagtaa

SEQ ID NO: 1143831 - DNA, 22 bp, Artificial Sequence
  chemically synthesized
agtttgttttggtcagttggtc

SEQ ID NO: 1143832 - DNA, 22 bp, Artificial Sequence
  chemically synthesized
ttactgaccaactgaccaaaac

SEQ ID NO: 1143833 - DNA, 22 bp, Artificial Sequence
  chemically synthesized
tactgaccaactgaccaaaaca

SEQ ID NO: 1143834 - DNA, 22 bp, Artificial Sequence
  chemically synthesized
actgaccaactgaccaaaacaa

SEQ ID NO: 1143835 - DNA, 22 bp, Artificial Sequence
  chemically synthesized
gtcacattaagtttgttttggt

SEQ ID NO: 1143836 - DNA, 22 bp, Artificial Sequence
  chemically synthesized
ctgaccaactgaccaaaacaaa

SEQ ID NO: 1143837 - DNA, 22 bp, Artificial Sequence
  chemically synthesized
agtcacattaagtttgttttgg

SEQ ID NO: 1143838 - DNA, 22 bp, Artificial Sequence
  chemically synthesized
accaactgaccaaaacaaactt

SEQ ID NO: 1143839 - DNA, 22 bp, Artificial Sequence
  chemically synthesized
gagtttagtcacattaagtttg

SEQ ID NO: 1143840 - DNA, 22 bp, Artificial Sequence
  chemically synthesized
tctagagtttagtcacattaag

SEQ ID NO: 1143841 - DNA, 22 bp, Artificial Sequence
  chemically synthesized
accaaaacaaacttaatgtgac

SEQ ID NO: 1143842 - DNA, 22 bp, Artificial Sequence
  chemically synthesized
aatgtgactaaactctagacag

SEQ ID NO: 1143843 - DNA, 22 bp, Artificial Sequence
  chemically synthesized
atgtgactaaactctagacagg

SEQ ID NO: 1143844 - DNA, 22 bp, Artificial Sequence
  chemically synthesized
tagtcaaataaaagcctgtcta

SEQ ID NO: 1143845 - DNA, 22 bp, Artificial Sequence
  chemically synthesized
aactctagacaggcttttattt

SEQ ID NO: 1143846 - DNA, 22 bp, Artificial Sequence
  chemically synthesized
tagacaggcttttatttgacta

SEQ ID NO: 1143847 - DNA, 22 bp, Artificial Sequence
  chemically synthesized
gacaggcttttatttgactata

SEQ ID NO: 1143848 - DNA, 22 bp, Artificial Sequence
  chemically synthesized
ttatttgactataggctcctga

SEQ ID NO: 1143849 - DNA, 22 bp, Artificial Sequence
  chemically synthesized
agaaaagagaggtcaggagcct

SEQ ID NO: 1143850 - DNA, 22 bp, Artificial Sequence
  chemically synthesized
tatttgactataggctcctgac

SEQ ID NO: 1143851 - DNA, 22 bp, Artificial Sequence
  chemically synthesized
atttgactataggctcctgacc

SEQ ID NO: 1143852 - DNA, 22 bp, Artificial Sequence
  chemically synthesized
taagaaaagagaggtcaggagc

SEQ ID NO: 1143853 - DNA, 22 bp, Artificial Sequence
  chemically synthesized
tttgactataggctcctgacct

SEQ ID NO: 1143854 - DNA, 22 bp, Artificial Sequence
  chemically synthesized
gactataggctcctgacctctc

SEQ ID NO: 1143855 - DNA, 22 bp, Artificial Sequence
  chemically synthesized
actataggctcctgacctctct

SEQ ID NO: 1143856 - DNA, 22 bp, Artificial Sequence
  chemically synthesized
taggctcctgacctctcttttc

SEQ ID NO: 1143857 - DNA, 22 bp, Artificial Sequence
  chemically synthesized
aagtaagcgctctaagaaaaga

SEQ ID NO: 1143858 - DNA, 22 bp, Artificial Sequence
  chemically synthesized
ctgacctctcttttcttagagc

SEQ ID NO: 1143859 - DNA, 22 bp, Artificial Sequence
  chemically synthesized
cctaaagtaagcgctctaagaa

SEQ ID NO: 1143860 - DNA, 22 bp, Artificial Sequence
  chemically synthesized
ccctaaagtaagcgctctaaga

SEQ ID NO: 1143861 - DNA, 22 bp, Artificial Sequence
  chemically synthesized
acctctcttttcttagagcgct

SEQ ID NO: 1143862 - DNA, 22 bp, Artificial Sequence
  chemically synthesized
tcttttcttagagcgcttactt

SEQ ID NO: 1143863 - DNA, 22 bp, Artificial Sequence
  chemically synthesized
caagtttccctaaagtaagcgc

SEQ ID NO: 1143864 - DNA, 22 bp, Artificial Sequence
  chemically synthesized
ttttcttagagcgcttacttta

SEQ ID NO: 1143865 - DNA, 22 bp, Artificial Sequence
  chemically synthesized
ttcttagagcgcttactttagg

SEQ ID NO: 1143866 - DNA, 22 bp, Artificial Sequence
  chemically synthesized
gttgcaagtttccctaaagtaa

SEQ ID NO: 1143867 - DNA, 22 bp, Artificial Sequence
  chemically synthesized
tcttagagcgcttactttaggg

SEQ ID NO: 1143868 - DNA, 22 bp, Artificial Sequence
  chemically synthesized
ggttgcaagtttccctaaagta

SEQ ID NO: 1143869 - DNA, 22 bp, Artificial Sequence
  chemically synthesized
cttagagcgcttactttaggga

SEQ ID NO: 1143870 - DNA, 22 bp, Artificial Sequence
  chemically synthesized
tggttgcaagtttccctaaagt

SEQ ID NO: 1143871 - DNA, 22 bp, Artificial Sequence
  chemically synthesized
ttagagcgcttactttagggaa

SEQ ID NO: 1143872 - DNA, 22 bp, Artificial Sequence
  chemically synthesized
ttggttgcaagtttccctaaag

SEQ ID NO: 1143873 - DNA, 22 bp, Artificial Sequence
  chemically synthesized
agagcgcttactttagggaaac

SEQ ID NO: 1143874 - DNA, 22 bp, Artificial Sequence
  chemically synthesized
gagcgcttactttagggaaact

SEQ ID NO: 1143875 - DNA, 22 bp, Artificial Sequence
  chemically synthesized
actttagggaaacttgcaacca

SEQ ID NO: 1143876 - DNA, 22 bp, Artificial Sequence
  chemically synthesized
ctttagggaaacttgcaaccaa

SEQ ID NO: 1143877 - DNA, 22 bp, Artificial Sequence
  chemically synthesized
tagggaaacttgcaaccaaaaa

SEQ ID NO: 1143878 - DNA, 22 bp, Artificial Sequence
  chemically synthesized
agggaaacttgcaaccaaaaac

SEQ ID NO: 1143879 - DNA, 22 bp, Artificial Sequence
  chemically synthesized
gggaaacttgcaaccaaaaaca

SEQ ID NO: 1143880 - DNA, 22 bp, Artificial Sequence
  chemically synthesized
aaagaggcagagaatatgtttt

SEQ ID NO: 1143881 - DNA, 22 bp, Artificial Sequence
  chemically synthesized
gcaaccaaaaacatattctctg

SEQ ID NO: 1143882 - DNA, 22 bp, Artificial Sequence
  chemically synthesized
caaccaaaaacatattctctgc

SEQ ID NO: 1143883 - DNA, 22 bp, Artificial Sequence
  chemically synthesized
catctcaaagaggcagagaata

SEQ ID NO: 1143884 - DNA, 22 bp, Artificial Sequence
  chemically synthesized
acatctcaaagaggcagagaat

SEQ ID NO: 1143885 - DNA, 22 bp, Artificial Sequence
  chemically synthesized
tagaagatttacatctcaaaga

SEQ ID NO: 1143886 - DNA, 22 bp, Artificial Sequence
  chemically synthesized
tctgcctctttgagatgtaaat

SEQ ID NO: 1143887 - DNA, 22 bp, Artificial Sequence
  chemically synthesized
tgcctctttgagatgtaaatct

SEQ ID NO: 1143888 - DNA, 22 bp, Artificial Sequence
  chemically synthesized
ccggattgtagaagatttacat

SEQ ID NO: 1143889 - DNA, 22 bp, Artificial Sequence
  chemically synthesized
cctctttgagatgtaaatcttc

SEQ ID NO: 1143890 - DNA, 22 bp, Artificial Sequence
  chemically synthesized
tttgagatgtaaatcttctaca

SEQ ID NO: 1143891 - DNA, 22 bp, Artificial Sequence
  chemically synthesized
tgagatgtaaatcttctacaat

SEQ ID NO: 1143892 - DNA, 22 bp, Artificial Sequence
  chemically synthesized
gagatgtaaatcttctacaatc

SEQ ID NO: 1143893 - DNA, 22 bp, Artificial Sequence
  chemically synthesized
agatgtaaatcttctacaatcc

SEQ ID NO: 1143894 - DNA, 22 bp, Artificial Sequence
  chemically synthesized
agaaagatattcccggattgta

SEQ ID NO: 1143895 - DNA, 22 bp, Artificial Sequence
  chemically synthesized
gagaaagatattcccggattgt

SEQ ID NO: 1143896 - DNA, 22 bp, Artificial Sequence
  chemically synthesized
ggtccttgagaaagatattccc

SEQ ID NO: 1143897 - DNA, 22 bp, Artificial Sequence
  chemically synthesized
ctacaatccgggaatatctttc

SEQ ID NO: 1143898 - DNA, 22 bp, Artificial Sequence
  chemically synthesized
ctaggtccttgagaaagatatt

SEQ ID NO: 1143899 - DNA, 22 bp, Artificial Sequence
  chemically synthesized
tacaatccgggaatatctttct

SEQ ID NO: 1143900 - DNA, 22 bp, Artificial Sequence
  chemically synthesized
caatccgggaatatctttctca

SEQ ID NO: 1143901 - DNA, 22 bp, Artificial Sequence
  chemically synthesized
aaagagatggctcctaggtcct

SEQ ID NO: 1143902 - DNA, 22 bp, Artificial Sequence
  chemically synthesized
caaagagatggctcctaggtcc

SEQ ID NO: 1143903 - DNA, 22 bp, Artificial Sequence
  chemically synthesized
catttcaaagagatggctccta

SEQ ID NO: 1143904 - DNA, 22 bp, Artificial Sequence
  chemically synthesized
tctcaaggacctaggagccatc

SEQ ID NO: 1143905 - DNA, 22 bp, Artificial Sequence
  chemically synthesized
ctcaaggacctaggagccatct

SEQ ID NO: 1143906 - DNA, 22 bp, Artificial Sequence
  chemically synthesized
tcaaggacctaggagccatctc

SEQ ID NO: 1143907 - DNA, 22 bp, Artificial Sequence
  chemically synthesized
aaggacctaggagccatctctt

SEQ ID NO: 1143908 - DNA, 22 bp, Artificial Sequence
  chemically synthesized
acaattacatttcaaagagatg

SEQ ID NO: 1143909 - DNA, 22 bp, Artificial Sequence
  chemically synthesized
tcattaacaattacatttcaaa

SEQ ID NO: 1143910 - DNA, 22 bp, Artificial Sequence
  chemically synthesized
ggagccatctctttgaaatgta

SEQ ID NO: 1143911 - DNA, 22 bp, Artificial Sequence
  chemically synthesized
tttgaaatgtaattgttaatga

SEQ ID NO: 1143912 - DNA, 22 bp, Artificial Sequence
  chemically synthesized
tgaaatgtaattgttaatgata

SEQ ID NO: 1143913 - DNA, 22 bp, Artificial Sequence
  chemically synthesized
gaaatgtaattgttaatgatag

SEQ ID NO: 1143914 - DNA, 22 bp, Artificial Sequence
  chemically synthesized
aaatgtaattgttaatgatagc

SEQ ID NO: 1143915 - DNA, 22 bp, Artificial Sequence
  chemically synthesized
ggagataggcgtgctatcatta

SEQ ID NO: 1143916 - DNA, 22 bp, Artificial Sequence
  chemically synthesized
ttaatgatagcacgcctatctc

SEQ ID NO: 1143917 - DNA, 22 bp, Artificial Sequence
  chemically synthesized
atgatagcacgcctatctccca

SEQ ID NO: 1143918 - DNA, 22 bp, Artificial Sequence
  chemically synthesized
tcccacagagactgggagatag

SEQ ID NO: 1143919 - DNA, 22 bp, Artificial Sequence
  chemically synthesized
ctgtcccacagagactgggaga

SEQ ID NO: 1143920 - DNA, 22 bp, Artificial Sequence
  chemically synthesized
ctactgtcccacagagactggg

SEQ ID NO: 1143921 - DNA, 22 bp, Artificial Sequence
  chemically synthesized
ggctcctactgtcccacagaga

SEQ ID NO: 1143922 - DNA, 22 bp, Artificial Sequence
  chemically synthesized
tctcccagtctctgtgggacag

SEQ ID NO: 1143923 - DNA, 22 bp, Artificial Sequence
  chemically synthesized
ccagtctctgtgggacagtagg

SEQ ID NO: 1143924 - DNA, 22 bp, Artificial Sequence
  chemically synthesized
atgaagttaggctcctactgtc

SEQ ID NO: 1143925 - DNA, 22 bp, Artificial Sequence
  chemically synthesized
aatgaagttaggctcctactgt

SEQ ID NO: 1143926 - DNA, 22 bp, Artificial Sequence
  chemically synthesized
tgtgggacagtaggagcctaac

SEQ ID NO: 1143927 - DNA, 22 bp, Artificial Sequence
  chemically synthesized
gcacttaatgaagttaggctcc

SEQ ID NO: 1143928 - DNA, 22 bp, Artificial Sequence
  chemically synthesized
tgggacagtaggagcctaactt

SEQ ID NO: 1143929 - DNA, 22 bp, Artificial Sequence
  chemically synthesized
attggcacttaatgaagttagg

SEQ ID NO: 1143930 - DNA, 22 bp, Artificial Sequence
  chemically synthesized
ttaattggcacttaatgaagtt

SEQ ID NO: 1143931 - DNA, 22 bp, Artificial Sequence
  chemically synthesized
tgattgttaattggcacttaat

SEQ ID NO: 1143932 - DNA, 22 bp, Artificial Sequence
  chemically synthesized
acttcattaagtgccaattaac

SEQ ID NO: 1143933 - DNA, 22 bp, Artificial Sequence
  chemically synthesized
ggcaatctgtgattgttaattg

SEQ ID NO: 1143934 - DNA, 22 bp, Artificial Sequence
  chemically synthesized
cattaagtgccaattaacaatc

SEQ ID NO: 1143935 - DNA, 22 bp, Artificial Sequence
  chemically synthesized
attaagtgccaattaacaatca

SEQ ID NO: 1143936 - DNA, 22 bp, Artificial Sequence
  chemically synthesized
agtgccaattaacaatcacaga

SEQ ID NO: 1143937 - DNA, 22 bp, Artificial Sequence
  chemically synthesized
ggatggtgattaggcaatctgt

SEQ ID NO: 1143938 - DNA, 22 bp, Artificial Sequence
  chemically synthesized
acaatcacagattgcctaatca

SEQ ID NO: 1143939 - DNA, 22 bp, Artificial Sequence
  chemically synthesized
gggggttaggatggtgattagg

SEQ ID NO: 1143940 - DNA, 22 bp, Artificial Sequence
  chemically synthesized
gaagatattagggggttaggat

SEQ ID NO: 1143941 - DNA, 22 bp, Artificial Sequence
  chemically synthesized
cctaatcaccatcctaaccccc

SEQ ID NO: 1143942 - DNA, 22 bp, Artificial Sequence
  chemically synthesized
atcaccatcctaaccccctaat

SEQ ID NO: 1143943 - DNA, 22 bp, Artificial Sequence
  chemically synthesized
gtagaaaaatactggaagatat

SEQ ID NO: 1143944 - DNA, 22 bp, Artificial Sequence
  chemically synthesized
accccctaatatcttccagtat

SEQ ID NO: 1143945 - DNA, 22 bp, Artificial Sequence
  chemically synthesized
aggagagctagtagaaaaatac

SEQ ID NO: 1143946 - DNA, 22 bp, Artificial Sequence
  chemically synthesized
atatcttccagtatttttctac

SEQ ID NO: 1143947 - DNA, 22 bp, Artificial Sequence
  chemically synthesized
agcactgaggagagctagtaga

SEQ ID NO: 1143948 - DNA, 22 bp, Artificial Sequence
  chemically synthesized
aagcactgaggagagctagtag

SEQ ID NO: 1143949 - DNA, 22 bp, Artificial Sequence
  chemically synthesized
ccagtatttttctactagctct

SEQ ID NO: 1143950 - DNA, 22 bp, Artificial Sequence
  chemically synthesized
cagtatttttctactagctctc

SEQ ID NO: 1143951 - DNA, 22 bp, Artificial Sequence
  chemically synthesized
ttctactagctctcctcagtgc

SEQ ID NO: 1143952 - DNA, 22 bp, Artificial Sequence
  chemically synthesized
tctactagctctcctcagtgct

SEQ ID NO: 1143953 - DNA, 22 bp, Artificial Sequence
  chemically synthesized
ctactagctctcctcagtgctt

SEQ ID NO: 1143954 - DNA, 22 bp, Artificial Sequence
  chemically synthesized
tactagctctcctcagtgctta

SEQ ID NO: 1143955 - DNA, 22 bp, Artificial Sequence
  chemically synthesized
ctagctctcctcagtgcttaaa

SEQ ID NO: 1143956 - DNA, 22 bp, Artificial Sequence
  chemically synthesized
gctctcctcagtgcttaaattc

SEQ ID NO: 1143957 - DNA, 22 bp, Artificial Sequence
  chemically synthesized
tcctcagtgcttaaattctctc

SEQ ID NO: 1143958 - DNA, 22 bp, Artificial Sequence
  chemically synthesized
aaagaaagacaggagagaattt

SEQ ID NO: 1143959 - DNA, 22 bp, Artificial Sequence
  chemically synthesized
ctcagtgcttaaattctctcct

SEQ ID NO: 1143960 - DNA, 22 bp, Artificial Sequence
  chemically synthesized
ctgaaagaaagacaggagagaa

SEQ ID NO: 1143961 - DNA, 22 bp, Artificial Sequence
  chemically synthesized
agtgcttaaattctctcctgtc

SEQ ID NO: 1143962 - DNA, 22 bp, Artificial Sequence
  chemically synthesized
tactgaaagaaagacaggagag

SEQ ID NO: 1143963 - DNA, 22 bp, Artificial Sequence
  chemically synthesized
ctactgaaagaaagacaggaga

SEQ ID NO: 1143964 - DNA, 22 bp, Artificial Sequence
  chemically synthesized
aaattctctcctgtctttcttt

SEQ ID NO: 1143965 - DNA, 22 bp, Artificial Sequence
  chemically synthesized
aattctctcctgtctttctttc

SEQ ID NO: 1143966 - DNA, 22 bp, Artificial Sequence
  chemically synthesized
tctcctgtctttctttcagtag

SEQ ID NO: 1143967 - DNA, 22 bp, Artificial Sequence
  chemically synthesized
tcctgtctttctttcagtagaa

SEQ ID NO: 1143968 - DNA, 22 bp, Artificial Sequence
  chemically synthesized
ctgtctttctttcagtagaaat

SEQ ID NO: 1143969 - DNA, 22 bp, Artificial Sequence
  chemically synthesized
tctttctttcagtagaaatgat

SEQ ID NO: 1143970 - DNA, 22 bp, Artificial Sequence
  chemically synthesized
tctttcagtagaaatgatttcc

SEQ ID NO: 1143971 - DNA, 22 bp, Artificial Sequence
  chemically synthesized
ctttcagtagaaatgatttcca

SEQ ID NO: 1143972 - DNA, 22 bp, Artificial Sequence
  chemically synthesized
tttcagtagaaatgatttccat

SEQ ID NO: 1143973 - DNA, 22 bp, Artificial Sequence
  chemically synthesized
tcagtagaaatgatttccatct

SEQ ID NO: 1143974 - DNA, 22 bp, Artificial Sequence
  chemically synthesized
cagtagaaatgatttccatctc

SEQ ID NO: 1143975 - DNA, 22 bp, Artificial Sequence
  chemically synthesized
ccataggagagagagatggaaa

SEQ ID NO: 1143976 - DNA, 22 bp, Artificial Sequence
  chemically synthesized
agtagaaatgatttccatctct

SEQ ID NO: 1143977 - DNA, 22 bp, Artificial Sequence
  chemically synthesized
ttgccataggagagagagatgg

SEQ ID NO: 1143978 - DNA, 22 bp, Artificial Sequence
  chemically synthesized
ccatctctctctcctatggcaa

SEQ ID NO: 1143979 - DNA, 22 bp, Artificial Sequence
  chemically synthesized
catctctctctcctatggcaat

SEQ ID NO: 1143980 - DNA, 22 bp, Artificial Sequence
  chemically synthesized
tggatcaagactattgccatag

SEQ ID NO: 1143981 - DNA, 22 bp, Artificial Sequence
  chemically synthesized
aattatggatcaagactattgc

SEQ ID NO: 1143982 - DNA, 22 bp, Artificial Sequence
  chemically synthesized
tctctcctatggcaatagtctt

SEQ ID NO: 1143983 - DNA, 22 bp, Artificial Sequence
  chemically synthesized
tctcctatggcaatagtcttga

SEQ ID NO: 1143984 - DNA, 22 bp, Artificial Sequence
  chemically synthesized
ctgaattatggatcaagactat

SEQ ID NO: 1143985 - DNA, 22 bp, Artificial Sequence
  chemically synthesized
tcctatggcaatagtcttgatc

SEQ ID NO: 1143986 - DNA, 22 bp, Artificial Sequence
  chemically synthesized
ctatggcaatagtcttgatcca

SEQ ID NO: 1143987 - DNA, 22 bp, Artificial Sequence
  chemically synthesized
tggcaatagtcttgatccataa

SEQ ID NO: 1143988 - DNA, 22 bp, Artificial Sequence
  chemically synthesized
aagactactgaattatggatca

SEQ ID NO: 1143989 - DNA, 22 bp, Artificial Sequence
  chemically synthesized
ttcaagactactgaattatgga

SEQ ID NO: 1143990 - DNA, 22 bp, Artificial Sequence
  chemically synthesized
attcaagactactgaattatgg

SEQ ID NO: 1143991 - DNA, 22 bp, Artificial Sequence
  chemically synthesized
tattcaagactactgaattatg

SEQ ID NO: 1143992 - DNA, 22 bp, Artificial Sequence
  chemically synthesized
gatccataattcagtagtcttg

SEQ ID NO: 1143993 - DNA, 22 bp, Artificial Sequence
  chemically synthesized
atccataattcagtagtcttga

SEQ ID NO: 1143994 - DNA, 22 bp, Artificial Sequence
  chemically synthesized
agtagtcttgaataaagtcttt

SEQ ID NO: 1143995 - DNA, 22 bp, Artificial Sequence
  chemically synthesized
gaataaagtctttcttgcctgt

SEQ ID NO: 1143996 - DNA, 22 bp, Artificial Sequence
  chemically synthesized
aataaagtctttcttgcctgtt

SEQ ID NO: 1143997 - DNA, 22 bp, Artificial Sequence
  chemically synthesized
tcttgcctgtttgtctggtgca

SEQ ID NO: 1143998 - DNA, 22 bp, Artificial Sequence
  chemically synthesized
taaaagaaaaaatgcaccagac

SEQ ID NO: 1143999 - DNA, 22 bp, Artificial Sequence
  chemically synthesized
cttgcctgtttgtctggtgcat

SEQ ID NO: 1144000 - DNA, 22 bp, Artificial Sequence
  chemically synthesized
ttgcctgtttgtctggtgcatt

SEQ ID NO: 1144001 - DNA, 22 bp, Artificial Sequence
  chemically synthesized
gcctgtttgtctggtgcatttt

SEQ ID NO: 1144002 - DNA, 22 bp, Artificial Sequence
  chemically synthesized
cctgtttgtctggtgcattttt

SEQ ID NO: 1144003 - DNA, 22 bp, Artificial Sequence
  chemically synthesized
tttgtctggtgcattttttctt

SEQ ID NO: 1144004 - DNA, 22 bp, Artificial Sequence
  chemically synthesized
gtaatattgtaaaagaaaaaat

SEQ ID NO: 1144005 - DNA, 22 bp, Artificial Sequence
  chemically synthesized
gtctggtgcattttttctttta

SEQ ID NO: 1144006 - DNA, 22 bp, Artificial Sequence
  chemically synthesized
tctggtgcattttttcttttac

SEQ ID NO: 1144007 - DNA, 22 bp, Artificial Sequence
  chemically synthesized
tatctggtaatattgtaaaaga

SEQ ID NO: 1144008 - DNA, 22 bp, Artificial Sequence
  chemically synthesized
gtgcattttttcttttacaata

SEQ ID NO: 1144009 - DNA, 22 bp, Artificial Sequence
  chemically synthesized
tttcttttacaatattaccaga

SEQ ID NO: 1144010 - DNA, 22 bp, Artificial Sequence
  chemically synthesized
ttcttttacaatattaccagat

SEQ ID NO: 1144011 - DNA, 22 bp, Artificial Sequence
  chemically synthesized
tcttttacaatattaccagata

SEQ ID NO: 1144012 - DNA, 22 bp, Artificial Sequence
  chemically synthesized
cttttacaatattaccagatac

SEQ ID NO: 1144013 - DNA, 22 bp, Artificial Sequence
  chemically synthesized
ttttacaatattaccagataca

SEQ ID NO: 1144014 - DNA, 22 bp, Artificial Sequence
  chemically synthesized
ccaggcccagcctgtatctggt

SEQ ID NO: 1144015 - DNA, 22 bp, Artificial Sequence
  chemically synthesized
ttacaatattaccagatacagg

SEQ ID NO: 1144016 - DNA, 22 bp, Artificial Sequence
  chemically synthesized
tacaatattaccagatacaggc

SEQ ID NO: 1144017 - DNA, 22 bp, Artificial Sequence
  chemically synthesized
acaatattaccagatacaggct

SEQ ID NO: 1144018 - DNA, 22 bp, Artificial Sequence
  chemically synthesized
caatattaccagatacaggctg

SEQ ID NO: 1144019 - DNA, 22 bp, Artificial Sequence
  chemically synthesized
ccagatacaggctgggcctggt

SEQ ID NO: 1144020 - DNA, 22 bp, Artificial Sequence
  chemically synthesized
caggcgtgagctaccaggccca

SEQ ID NO: 1144021 - DNA, 22 bp, Artificial Sequence
  chemically synthesized
ggattgcaggcgtgagctacca

SEQ ID NO: 1144022 - DNA, 22 bp, Artificial Sequence
  chemically synthesized
ggcctggtagctcacgcctgca

SEQ ID NO: 1144023 - DNA, 22 bp, Artificial Sequence
  chemically synthesized
ccgaagtgttgggattgcaggc

SEQ ID NO: 1144024 - DNA, 22 bp, Artificial Sequence
  chemically synthesized
gtagctcacgcctgcaatccca

SEQ ID NO: 1144025 - DNA, 22 bp, Artificial Sequence
  chemically synthesized
ggcctgccgaagtgttgggatt

SEQ ID NO: 1144026 - DNA, 22 bp, Artificial Sequence
  chemically synthesized
acgcctgcaatcccaacacttc

SEQ ID NO: 1144027 - DNA, 22 bp, Artificial Sequence
  chemically synthesized
ccagcctcggcctgccgaagtg

SEQ ID NO: 1144028 - DNA, 22 bp, Artificial Sequence
  chemically synthesized
caatcccaacacttcggcaggc

SEQ ID NO: 1144029 - DNA, 22 bp, Artificial Sequence
  chemically synthesized
aggtgatctgccagcctcggcc

SEQ ID NO: 1144030 - DNA, 22 bp, Artificial Sequence
  chemically synthesized
acctcaggtgatctgccagcct

SEQ ID NO: 1144031 - DNA, 22 bp, Artificial Sequence
  chemically synthesized
cggcaggccgaggctggcagat

SEQ ID NO: 1144032 - DNA, 22 bp, Artificial Sequence
  chemically synthesized
ggcaggccgaggctggcagatc

SEQ ID NO: 1144033 - DNA, 22 bp, Artificial Sequence
  chemically synthesized
ctgacctcaggtgatctgccag

SEQ ID NO: 1144034 - DNA, 22 bp, Artificial Sequence
  chemically synthesized
aactcctgacctcaggtgatct

SEQ ID NO: 1144035 - DNA, 22 bp, Artificial Sequence
  chemically synthesized
gaactcctgacctcaggtgatc

SEQ ID NO: 1144036 - DNA, 22 bp, Artificial Sequence
  chemically synthesized
gtcttgaactcctgacctcagg

SEQ ID NO: 1144037 - DNA, 22 bp, Artificial Sequence
  chemically synthesized
gcagatcacctgaggtcaggag

SEQ ID NO: 1144038 - DNA, 22 bp, Artificial Sequence
  chemically synthesized
gtcaggttggtcttgaactcct

SEQ ID NO: 1144039 - DNA, 22 bp, Artificial Sequence
  chemically synthesized
aggtcaggagttcaagaccaac

SEQ ID NO: 1144040 - DNA, 22 bp, Artificial Sequence
  chemically synthesized
accatgttggtcaggttggtct

SEQ ID NO: 1144041 - DNA, 22 bp, Artificial Sequence
  chemically synthesized
caccatgttggtcaggttggtc

SEQ ID NO: 1144042 - DNA, 22 bp, Artificial Sequence
  chemically synthesized
aagaccaacctgaccaacatgg

SEQ ID NO: 1144043 - DNA, 22 bp, Artificial Sequence
  chemically synthesized
agtagagacagggtttcaccat

SEQ ID NO: 1144044 - DNA, 22 bp, Artificial Sequence
  chemically synthesized
gagtagagacagggtttcacca

SEQ ID NO: 1144045 - DNA, 22 bp, Artificial Sequence
  chemically synthesized
tgagtagagacagggtttcacc

SEQ ID NO: 1144046 - DNA, 22 bp, Artificial Sequence
  chemically synthesized
accaacatggtgaaaccctgtc

SEQ ID NO: 1144047 - DNA, 22 bp, Artificial Sequence
  chemically synthesized
tattttgagtagagacagggtt

SEQ ID NO: 1144048 - DNA, 22 bp, Artificial Sequence
  chemically synthesized
gtattttgagtagagacagggt

SEQ ID NO: 1144049 - DNA, 22 bp, Artificial Sequence
  chemically synthesized
tgtattttgagtagagacaggg

SEQ ID NO: 1144050 - DNA, 22 bp, Artificial Sequence
  chemically synthesized
ttgtattttgagtagagacagg

SEQ ID NO: 1144051 - DNA, 22 bp, Artificial Sequence
  chemically synthesized
tttgtattttgagtagagacag

SEQ ID NO: 1144052 - DNA, 22 bp, Artificial Sequence
  chemically synthesized
ttttgtattttgagtagagaca

SEQ ID NO: 1144053 - DNA, 22 bp, Artificial Sequence
  chemically synthesized
tttttgtattttgagtagagac

SEQ ID NO: 1144054 - DNA, 22 bp, Artificial Sequence
  chemically synthesized
attttttttgtattttgagtag

SEQ ID NO: 1144055 - DNA, 22 bp, Artificial Sequence
  chemically synthesized
gctaattttttttgtattttga

SEQ ID NO: 1144056 - DNA, 22 bp, Artificial Sequence
  chemically synthesized
tctctactcaaaatacaaaaaa

SEQ ID NO: 1144057 - DNA, 22 bp, Artificial Sequence
  chemically synthesized
tactcaaaatacaaaaaaaatt

SEQ ID NO: 1144058 - DNA, 22 bp, Artificial Sequence
  chemically synthesized
ctcaaaatacaaaaaaaattag

SEQ ID NO: 1144059 - DNA, 22 bp, Artificial Sequence
  chemically synthesized
aaaatacaaaaaaaattagcca

SEQ ID NO: 1144060 - DNA, 22 bp, Artificial Sequence
  chemically synthesized
caggtgcccaccatcatgcctg

SEQ ID NO: 1144061 - DNA, 22 bp, Artificial Sequence
  chemically synthesized
gcaggtgcccaccatcatgcct

SEQ ID NO: 1144062 - DNA, 22 bp, Artificial Sequence
  chemically synthesized
ggtttgcaggtgcccaccatca

SEQ ID NO: 1144063 - DNA, 22 bp, Artificial Sequence
  chemically synthesized
gccaggcatgatggtgggcacc

SEQ ID NO: 1144064 - DNA, 22 bp, Artificial Sequence
  chemically synthesized
aatagctgggtttgcaggtgcc

SEQ ID NO: 1144065 - DNA, 22 bp, Artificial Sequence
  chemically synthesized
ctgaatagctgggtttgcaggt

SEQ ID NO: 1144066 - DNA, 22 bp, Artificial Sequence
  chemically synthesized
aacctcctgaatagctgggttt

SEQ ID NO: 1144067 - DNA, 22 bp, Artificial Sequence
  chemically synthesized
cctcaacctcctgaatagctgg

SEQ ID NO: 1144068 - DNA, 22 bp, Artificial Sequence
  chemically synthesized
ctgcctcaacctcctgaatagc

SEQ ID NO: 1144069 - DNA, 22 bp, Artificial Sequence
  chemically synthesized
tcctgcctcaacctcctgaata

SEQ ID NO: 1144070 - DNA, 22 bp, Artificial Sequence
  chemically synthesized
caaacccagctattcaggaggt

SEQ ID NO: 1144071 - DNA, 22 bp, Artificial Sequence
  chemically synthesized
aagcaattctcctgcctcaacc

SEQ ID NO: 1144072 - DNA, 22 bp, Artificial Sequence
  chemically synthesized
gttcaagcaattctcctgcctc

SEQ ID NO: 1144073 - DNA, 22 bp, Artificial Sequence
  chemically synthesized
ttcaggaggttgaggcaggaga

SEQ ID NO: 1144074 - DNA, 22 bp, Artificial Sequence
  chemically synthesized
aggaggttgaggcaggagaatt

SEQ ID NO: 1144075 - DNA, 22 bp, Artificial Sequence
  chemically synthesized
cctggttcaagcaattctcctg

SEQ ID NO: 1144076 - DNA, 22 bp, Artificial Sequence
  chemically synthesized
aggcaggagaattgcttgaacc

SEQ ID NO: 1144077 - DNA, 22 bp, Artificial Sequence
  chemically synthesized
aatgcaacatccgcctccctgg

SEQ ID NO: 1144078 - DNA, 22 bp, Artificial Sequence
  chemically synthesized
agctcaatgcaacatccgcctc

SEQ ID NO: 1144079 - DNA, 22 bp, Artificial Sequence
  chemically synthesized
cttgaaccagggaggcggatgt

SEQ ID NO: 1144080 - DNA, 22 bp, Artificial Sequence
  chemically synthesized
gaaccagggaggcggatgttgc

SEQ ID NO: 1144081 - DNA, 22 bp, Artificial Sequence
  chemically synthesized
aaccagggaggcggatgttgca

SEQ ID NO: 1144082 - DNA, 22 bp, Artificial Sequence
  chemically synthesized
gagtgcagtggcaagatctcag

SEQ ID NO: 1144083 - DNA, 22 bp, Artificial Sequence
  chemically synthesized
cattgagctgagatcttgccac

SEQ ID NO: 1144084 - DNA, 22 bp, Artificial Sequence
  chemically synthesized
cccaggctggagtgcagtggca

SEQ ID NO: 1144085 - DNA, 22 bp, Artificial Sequence
  chemically synthesized
agctgagatcttgccactgcac

SEQ ID NO: 1144086 - DNA, 22 bp, Artificial Sequence
  chemically synthesized
tacccaggctggagtgcagtgg

SEQ ID NO: 1144087 - DNA, 22 bp, Artificial Sequence
  chemically synthesized
ctacccaggctggagtgcagtg

SEQ ID NO: 1144088 - DNA, 22 bp, Artificial Sequence
  chemically synthesized
agatcttgccactgcactccag

SEQ ID NO: 1144089 - DNA, 22 bp, Artificial Sequence
  chemically synthesized
tttctacccaggctggagtgca

SEQ ID NO: 1144090 - DNA, 22 bp, Artificial Sequence
  chemically synthesized
gctgtttctacccaggctggag

SEQ ID NO: 1144091 - DNA, 22 bp, Artificial Sequence
  chemically synthesized
cgctgtttctacccaggctgga

SEQ ID NO: 1144092 - DNA, 22 bp, Artificial Sequence
  chemically synthesized
gccactgcactccagcctgggt

SEQ ID NO: 1144093 - DNA, 22 bp, Artificial Sequence
  chemically synthesized
ccactgcactccagcctgggta

SEQ ID NO: 1144094 - DNA, 22 bp, Artificial Sequence
  chemically synthesized
cactccagcctgggtagaaaca

SEQ ID NO: 1144095 - DNA, 22 bp, Artificial Sequence
  chemically synthesized
agatggagtttcgctgtttcta

SEQ ID NO: 1144096 - DNA, 22 bp, Artificial Sequence
  chemically synthesized
gagatggagtttcgctgtttct

SEQ ID NO: 1144097 - DNA, 22 bp, Artificial Sequence
  chemically synthesized
tgagatggagtttcgctgtttc

SEQ ID NO: 1144098 - DNA, 22 bp, Artificial Sequence
  chemically synthesized
cagcctgggtagaaacagcgaa

SEQ ID NO: 1144099 - DNA, 22 bp, Artificial Sequence
  chemically synthesized
ttgagatggagtttcgctgttt

SEQ ID NO: 1144100 - DNA, 22 bp, Artificial Sequence
  chemically synthesized
tttgagatggagtttcgctgtt

SEQ ID NO: 1144101 - DNA, 22 bp, Artificial Sequence
  chemically synthesized
ttttgagatggagtttcgctgt

SEQ ID NO: 1144102 - DNA, 22 bp, Artificial Sequence
  chemically synthesized
ggtagaaacagcgaaactccat

SEQ ID NO: 1144103 - DNA, 22 bp, Artificial Sequence
  chemically synthesized
atatatggtaatatttttttga

SEQ ID NO: 1144104 - DNA, 22 bp, Artificial Sequence
  chemically synthesized
aatatatggtaatatttttttg

SEQ ID NO: 1144105 - DNA, 22 bp, Artificial Sequence
  chemically synthesized
taatatatggtaatattttttt

SEQ ID NO: 1144106 - DNA, 22 bp, Artificial Sequence
  chemically synthesized
catctcaaaaaaatattaccat

SEQ ID NO: 1144107 - DNA, 22 bp, Artificial Sequence
  chemically synthesized
tgacaagttttaatatatggta

SEQ ID NO: 1144108 - DNA, 22 bp, Artificial Sequence
  chemically synthesized
aaaaaaatattaccatatatta

SEQ ID NO: 1144109 - DNA, 22 bp, Artificial Sequence
  chemically synthesized
tagcattatgacaagttttaat

SEQ ID NO: 1144110 - DNA, 22 bp, Artificial Sequence
  chemically synthesized
ctatagcattatgacaagtttt

SEQ ID NO: 1144111 - DNA, 22 bp, Artificial Sequence
  chemically synthesized
ccatatattaaaacttgtcata

SEQ ID NO: 1144112 - DNA, 22 bp, Artificial Sequence
  chemically synthesized
attactatagcattatgacaag

SEQ ID NO: 1144113 - DNA, 22 bp, Artificial Sequence
  chemically synthesized
aattactatagcattatgacaa

SEQ ID NO: 1144114 - DNA, 22 bp, Artificial Sequence
  chemically synthesized
taattactatagcattatgaca

SEQ ID NO: 1144115 - DNA, 22 bp, Artificial Sequence
  chemically synthesized
ttttaattactatagcattatg

SEQ ID NO: 1144116 - DNA, 22 bp, Artificial Sequence
  chemically synthesized
aaacttgtcataatgctatagt

SEQ ID NO: 1144117 - DNA, 22 bp, Artificial Sequence
  chemically synthesized
cacattgttttaattactatag

SEQ ID NO: 1144118 - DNA, 22 bp, Artificial Sequence
  chemically synthesized
gtcataatgctatagtaattaa

SEQ ID NO: 1144119 - DNA, 22 bp, Artificial Sequence
  chemically synthesized
tcataatgctatagtaattaaa

SEQ ID NO: 1144120 - DNA, 22 bp, Artificial Sequence
  chemically synthesized
attccacattgttttaattact

SEQ ID NO: 1144121 - DNA, 22 bp, Artificial Sequence
  chemically synthesized
atgctaattccacattgtttta

SEQ ID NO: 1144122 - DNA, 22 bp, Artificial Sequence
  chemically synthesized
tagtaattaaaacaatgtggaa

SEQ ID NO: 1144123 - DNA, 22 bp, Artificial Sequence
  chemically synthesized
tcctcatgctaattccacattg

SEQ ID NO: 1144124 - DNA, 22 bp, Artificial Sequence
  chemically synthesized
cctgtcctcatgctaattccac

SEQ ID NO: 1144125 - DNA, 22 bp, Artificial Sequence
  chemically synthesized
gcctgtcctcatgctaattcca

SEQ ID NO: 1144126 - DNA, 22 bp, Artificial Sequence
  chemically synthesized
cttgcctgtcctcatgctaatt

SEQ ID NO: 1144127 - DNA, 22 bp, Artificial Sequence
  chemically synthesized
aaacaatgtggaattagcatga

SEQ ID NO: 1144128 - DNA, 22 bp, Artificial Sequence
  chemically synthesized
tacttgcctgtcctcatgctaa

SEQ ID NO: 1144129 - DNA, 22 bp, Artificial Sequence
  chemically synthesized
tctacttgcctgtcctcatgct

SEQ ID NO: 1144130 - DNA, 22 bp, Artificial Sequence
  chemically synthesized
ctctacttgcctgtcctcatgc

SEQ ID NO: 1144131 - DNA, 22 bp, Artificial Sequence
  chemically synthesized
tttctctacttgcctgtcctca

SEQ ID NO: 1144132 - DNA, 22 bp, Artificial Sequence
  chemically synthesized
atttctctacttgcctgtcctc

SEQ ID NO: 1144133 - DNA, 22 bp, Artificial Sequence
  chemically synthesized
tatttctctacttgcctgtcct

SEQ ID NO: 1144134 - DNA, 22 bp, Artificial Sequence
  chemically synthesized
gcatgaggacaggcaagtagag

SEQ ID NO: 1144135 - DNA, 22 bp, Artificial Sequence
  chemically synthesized
atcagttttatttctctacttg

SEQ ID NO: 1144136 - DNA, 22 bp, Artificial Sequence
  chemically synthesized
taatcagttttatttctctact

SEQ ID NO: 1144137 - DNA, 22 bp, Artificial Sequence
  chemically synthesized
tggactctaatcagttttattt

SEQ ID NO: 1144138 - DNA, 22 bp, Artificial Sequence
  chemically synthesized
atggactctaatcagttttatt

SEQ ID NO: 1144139 - DNA, 22 bp, Artificial Sequence
  chemically synthesized
tacgtgcatggatcagtttatg

SEQ ID NO: 1144140 - DNA, 22 bp, Artificial Sequence
  chemically synthesized
attagagtccataaactgatcc

SEQ ID NO: 1144141 - DNA, 22 bp, Artificial Sequence
  chemically synthesized
gagtccataaactgatccatgc

SEQ ID NO: 1144142 - DNA, 22 bp, Artificial Sequence
  chemically synthesized
gaaataaaatgcctatacgtgc

SEQ ID NO: 1144143 - DNA, 22 bp, Artificial Sequence
  chemically synthesized
atccatgcacgtataggcattt

SEQ ID NO: 1144144 - DNA, 22 bp, Artificial Sequence
  chemically synthesized
acgaaaatattagaaataaaat

SEQ ID NO: 1144145 - DNA, 22 bp, Artificial Sequence
  chemically synthesized
gacgaaaatattagaaataaaa

SEQ ID NO: 1144146 - DNA, 22 bp, Artificial Sequence
  chemically synthesized
tgacgaaaatattagaaataaa

SEQ ID NO: 1144147 - DNA, 22 bp, Artificial Sequence
  chemically synthesized
tggtgtcatctttgacgaaaat

SEQ ID NO: 1144148 - DNA, 22 bp, Artificial Sequence
  chemically synthesized
tatttctaatattttcgtcaaa

SEQ ID NO: 1144149 - DNA, 22 bp, Artificial Sequence
  chemically synthesized
tgtggtgtcatctttgacgaaa

SEQ ID NO: 1144150 - DNA, 22 bp, Artificial Sequence
  chemically synthesized
atttctaatattttcgtcaaag

SEQ ID NO: 1144151 - DNA, 22 bp, Artificial Sequence
  chemically synthesized
tttctaatattttcgtcaaaga

SEQ ID NO: 1144152 - DNA, 22 bp, Artificial Sequence
  chemically synthesized
ctaatattttcgtcaaagatga

SEQ ID NO: 1144153 - DNA, 22 bp, Artificial Sequence
  chemically synthesized
taatattttcgtcaaagatgac

SEQ ID NO: 1144154 - DNA, 22 bp, Artificial Sequence
  chemically synthesized
aatattctgtggtgtcatcttt

SEQ ID NO: 1144155 - DNA, 22 bp, Artificial Sequence
  chemically synthesized
atattttcgtcaaagatgacac

SEQ ID NO: 1144156 - DNA, 22 bp, Artificial Sequence
  chemically synthesized
ctcaatattctgtggtgtcatc

SEQ ID NO: 1144157 - DNA, 22 bp, Artificial Sequence
  chemically synthesized
cctcaatattctgtggtgtcat

SEQ ID NO: 1144158 - DNA, 22 bp, Artificial Sequence
  chemically synthesized
tcctcaatattctgtggtgtca

SEQ ID NO: 1144159 - DNA, 22 bp, Artificial Sequence
  chemically synthesized
tcgtcaaagatgacaccacaga

SEQ ID NO: 1144160 - DNA, 22 bp, Artificial Sequence
  chemically synthesized
cgtcaaagatgacaccacagaa

SEQ ID NO: 1144161 - DNA, 22 bp, Artificial Sequence
  chemically synthesized
gtcaaagatgacaccacagaat

SEQ ID NO: 1144162 - DNA, 22 bp, Artificial Sequence
  chemically synthesized
aataagaccatcctttcctcaa

SEQ ID NO: 1144163 - DNA, 22 bp, Artificial Sequence
  chemically synthesized
caataagaccatcctttcctca

SEQ ID NO: 1144164 - DNA, 22 bp, Artificial Sequence
  chemically synthesized
tcaataagaccatcctttcctc

SEQ ID NO: 1144165 - DNA, 22 bp, Artificial Sequence
  chemically synthesized
caaagattttcaataagaccat

SEQ ID NO: 1144166 - DNA, 22 bp, Artificial Sequence
  chemically synthesized
ttgcaaagattttcaataagac

SEQ ID NO: 1144167 - DNA, 22 bp, Artificial Sequence
  chemically synthesized
aggaaaggatggtcttattgaa

SEQ ID NO: 1144168 - DNA, 22 bp, Artificial Sequence
  chemically synthesized
attgcaaagattttcaataaga

SEQ ID NO: 1144169 - DNA, 22 bp, Artificial Sequence
  chemically synthesized
attgaaaatctttgcaataaga

SEQ ID NO: 1144170 - DNA, 22 bp, Artificial Sequence
  chemically synthesized
aggaaaagatggtcttattgca

SEQ ID NO: 1144171 - DNA, 22 bp, Artificial Sequence
  chemically synthesized
ttgaaaatctttgcaataagac

SEQ ID NO: 1144172 - DNA, 22 bp, Artificial Sequence
  chemically synthesized
aaaatctttgcaataagaccat

SEQ ID NO: 1144173 - DNA, 22 bp, Artificial Sequence
  chemically synthesized
tagaatattgaggaaaagatgg

SEQ ID NO: 1144174 - DNA, 22 bp, Artificial Sequence
  chemically synthesized
tgcaataagaccatcttttcct

SEQ ID NO: 1144175 - DNA, 22 bp, Artificial Sequence
  chemically synthesized
gcaataagaccatcttttcctc

SEQ ID NO: 1144176 - DNA, 22 bp, Artificial Sequence
  chemically synthesized
caataagaccatcttttcctca

SEQ ID NO: 1144177 - DNA, 22 bp, Artificial Sequence
  chemically synthesized
gcactgtagaatattgaggaaa

SEQ ID NO: 1144178 - DNA, 22 bp, Artificial Sequence
  chemically synthesized
ttcctcaatattctacagtgcc

SEQ ID NO: 1144179 - DNA, 22 bp, Artificial Sequence
  chemically synthesized
aaacaacaagttggcactgtag

SEQ ID NO: 1144180 - DNA, 22 bp, Artificial Sequence
  chemically synthesized
tcctcaatattctacagtgcca

SEQ ID NO: 1144181 - DNA, 22 bp, Artificial Sequence
  chemically synthesized
cctcaatattctacagtgccaa

SEQ ID NO: 1144182 - DNA, 22 bp, Artificial Sequence
  chemically synthesized
ctcaatattctacagtgccaac

SEQ ID NO: 1144183 - DNA, 22 bp, Artificial Sequence
  chemically synthesized
aatattctacagtgccaacttg

SEQ ID NO: 1144184 - DNA, 22 bp, Artificial Sequence
  chemically synthesized
tacagtgccaacttgttgtttc

SEQ ID NO: 1144185 - DNA, 22 bp, Artificial Sequence
  chemically synthesized
cagtgccaacttgttgtttcag

SEQ ID NO: 1144186 - DNA, 22 bp, Artificial Sequence
  chemically synthesized
ccatatagatccaactgaaaca

SEQ ID NO: 1144187 - DNA, 22 bp, Artificial Sequence
  chemically synthesized
cccatatagatccaactgaaac

SEQ ID NO: 1144188 - DNA, 22 bp, Artificial Sequence
  chemically synthesized
tcccatatagatccaactgaaa

SEQ ID NO: 1144189 - DNA, 22 bp, Artificial Sequence
  chemically synthesized
ttcccatatagatccaactgaa

SEQ ID NO: 1144190 - DNA, 22 bp, Artificial Sequence
  chemically synthesized
tttcccatatagatccaactga

SEQ ID NO: 1144191 - DNA, 22 bp, Artificial Sequence
  chemically synthesized
gttgtttcagttggatctatat

SEQ ID NO: 1144192 - DNA, 22 bp, Artificial Sequence
  chemically synthesized
ttgtttcagttggatctatatg

SEQ ID NO: 1144193 - DNA, 22 bp, Artificial Sequence
  chemically synthesized
tttcagttggatctatatggga

SEQ ID NO: 1144194 - DNA, 22 bp, Artificial Sequence
  chemically synthesized
cagttggatctatatgggaaaa

SEQ ID NO: 1144195 - DNA, 22 bp, Artificial Sequence
  chemically synthesized
agttggatctatatgggaaaaa

SEQ ID NO: 1144196 - DNA, 22 bp, Artificial Sequence
  chemically synthesized
gatctatatgggaaaaaatgga

SEQ ID NO: 1144197 - DNA, 22 bp, Artificial Sequence
  chemically synthesized
tatgggaaaaaatggacattca

SEQ ID NO: 1144198 - DNA, 22 bp, Artificial Sequence
  chemically synthesized
caggtatgaggaagggatgaat

SEQ ID NO: 1144199 - DNA, 22 bp, Artificial Sequence
  chemically synthesized
ttacaggtatgaggaagggatg

SEQ ID NO: 1144200 - DNA, 22 bp, Artificial Sequence
  chemically synthesized
ttattacaggtatgaggaaggg

SEQ ID NO: 1144201 - DNA, 22 bp, Artificial Sequence
  chemically synthesized
atcccttcctcatacctgtaat

SEQ ID NO: 1144202 - DNA, 22 bp, Artificial Sequence
  chemically synthesized
caatccacctattattacaggt

SEQ ID NO: 1144203 - DNA, 22 bp, Artificial Sequence
  chemically synthesized
cctcatacctgtaataataggt

SEQ ID NO: 1144204 - DNA, 22 bp, Artificial Sequence
  chemically synthesized
gtattacaatccacctattatt

SEQ ID NO: 1144205 - DNA, 22 bp, Artificial Sequence
  chemically synthesized
ctcatacctgtaataataggtg

SEQ ID NO: 1144206 - DNA, 22 bp, Artificial Sequence
  chemically synthesized
cgtattacaatccacctattat

SEQ ID NO: 1144207 - DNA, 22 bp, Artificial Sequence
  chemically synthesized
tcgtattacaatccacctatta

SEQ ID NO: 1144208 - DNA, 22 bp, Artificial Sequence
  chemically synthesized
atacctgtaataataggtggat

SEQ ID NO: 1144209 - DNA, 22 bp, Artificial Sequence
  chemically synthesized
cctttcgtattacaatccacct

SEQ ID NO: 1144210 - DNA, 22 bp, Artificial Sequence
  chemically synthesized
acctttcgtattacaatccacc

SEQ ID NO: 1144211 - DNA, 22 bp, Artificial Sequence
  chemically synthesized
tacctttcgtattacaatccac

SEQ ID NO: 1144212 - DNA, 22 bp, Artificial Sequence
  chemically synthesized
taataataggtggattgtaata

SEQ ID NO: 1144213 - DNA, 22 bp, Artificial Sequence
  chemically synthesized
ttttacctttcgtattacaatc

SEQ ID NO: 1144214 - DNA, 22 bp, Artificial Sequence
  chemically synthesized
gttttacctttcgtattacaat

SEQ ID NO: 1144215 - DNA, 22 bp, Artificial Sequence
  chemically synthesized
tttgttttacctttcgtattac

SEQ ID NO: 1144216 - DNA, 22 bp, Artificial Sequence
  chemically synthesized
tataggaactgtttgttttacc

SEQ ID NO: 1144217 - DNA, 22 bp, Artificial Sequence
  chemically synthesized
taatacgaaaggtaaaacaaac

SEQ ID NO: 1144218 - DNA, 22 bp, Artificial Sequence
  chemically synthesized
ctatataggaactgtttgtttt

SEQ ID NO: 1144219 - DNA, 22 bp, Artificial Sequence
  chemically synthesized
ggttgctatataggaactgttt

SEQ ID NO: 1144220 - DNA, 22 bp, Artificial Sequence
  chemically synthesized
tggtcctgggttgctatatagg

SEQ ID NO: 1144221 - DNA, 22 bp, Artificial Sequence
  chemically synthesized
aagctatggtcctgggttgcta

SEQ ID NO: 1144222 - DNA, 22 bp, Artificial Sequence
  chemically synthesized
tgaagctatggtcctgggttgc

SEQ ID NO: 1144223 - DNA, 22 bp, Artificial Sequence
  chemically synthesized
ctatatagcaacccaggaccat

SEQ ID NO: 1144224 - DNA, 22 bp, Artificial Sequence
  chemically synthesized
aaattctgaagctatggtcctg

SEQ ID NO: 1144225 - DNA, 22 bp, Artificial Sequence
  chemically synthesized
aaaattctgaagctatggtcct

SEQ ID NO: 1144226 - DNA, 22 bp, Artificial Sequence
  chemically synthesized
tatagcaacccaggaccatagc

SEQ ID NO: 1144227 - DNA, 22 bp, Artificial Sequence
  chemically synthesized
taaaattctgaagctatggtcc

SEQ ID NO: 1144228 - DNA, 22 bp, Artificial Sequence
  chemically synthesized
ctttaaaattctgaagctatgg

SEQ ID NO: 1144229 - DNA, 22 bp, Artificial Sequence
  chemically synthesized
tactttaaaattctgaagctat

SEQ ID NO: 1144230 - DNA, 22 bp, Artificial Sequence
  chemically synthesized
tctactttaaaattctgaagct

SEQ ID NO: 1144231 - DNA, 22 bp, Artificial Sequence
  chemically synthesized
aaaataaaactctctactttaa

SEQ ID NO: 1144232 - DNA, 22 bp, Artificial Sequence
  chemically synthesized
aaaaataaaactctctacttta

SEQ ID NO: 1144233 - DNA, 22 bp, Artificial Sequence
  chemically synthesized
cagaattttaaagtagagagtt

SEQ ID NO: 1144234 - DNA, 22 bp, Artificial Sequence
  chemically synthesized
agaattttaaagtagagagttt

SEQ ID NO: 1144235 - DNA, 22 bp, Artificial Sequence
  chemically synthesized
agtttaaaaataaaactctcta

SEQ ID NO: 1144236 - DNA, 22 bp, Artificial Sequence
  chemically synthesized
tcctcagtttaaaaataaaact

SEQ ID NO: 1144237 - DNA, 22 bp, Artificial Sequence
  chemically synthesized
gtcctcagtttaaaaataaaac

SEQ ID NO: 1144238 - DNA, 22 bp, Artificial Sequence
  chemically synthesized
taaagtagagagttttattttt

SEQ ID NO: 1144239 - DNA, 22 bp, Artificial Sequence
  chemically synthesized
tgtcctcagtttaaaaataaaa

SEQ ID NO: 1144240 - DNA, 22 bp, Artificial Sequence
  chemically synthesized
aaagtagagagttttattttta

SEQ ID NO: 1144241 - DNA, 22 bp, Artificial Sequence
  chemically synthesized
ttgtcctcagtttaaaaataaa

SEQ ID NO: 1144242 - DNA, 22 bp, Artificial Sequence
  chemically synthesized
aagtagagagttttatttttaa

SEQ ID NO: 1144243 - DNA, 22 bp, Artificial Sequence
  chemically synthesized
gtgtacttttgtcctcagttta

SEQ ID NO: 1144244 - DNA, 22 bp, Artificial Sequence
  chemically synthesized
agtgtacttttgtcctcagttt

SEQ ID NO: 1144245 - DNA, 22 bp, Artificial Sequence
  chemically synthesized
tatttttaaactgaggacaaaa

SEQ ID NO: 1144246 - DNA, 22 bp, Artificial Sequence
  chemically synthesized
tgtttagtgtacttttgtcctc

SEQ ID NO: 1144247 - DNA, 22 bp, Artificial Sequence
  chemically synthesized
atttttaaactgaggacaaaag

SEQ ID NO: 1144248 - DNA, 22 bp, Artificial Sequence
  chemically synthesized
tttttaaactgaggacaaaagt

SEQ ID NO: 1144249 - DNA, 22 bp, Artificial Sequence
  chemically synthesized
ttatgtttagtgtacttttgtc

SEQ ID NO: 1144250 - DNA, 22 bp, Artificial Sequence
  chemically synthesized
ttaaactgaggacaaaagtaca

SEQ ID NO: 1144251 - DNA, 22 bp, Artificial Sequence
  chemically synthesized
tgttatgtttagtgtacttttg

SEQ ID NO: 1144252 - DNA, 22 bp, Artificial Sequence
  chemically synthesized
taaactgaggacaaaagtacac

SEQ ID NO: 1144253 - DNA, 22 bp, Artificial Sequence
  chemically synthesized
ctgttatgtttagtgtactttt

SEQ ID NO: 1144254 - DNA, 22 bp, Artificial Sequence
  chemically synthesized
aaactgaggacaaaagtacact

SEQ ID NO: 1144255 - DNA, 22 bp, Artificial Sequence
  chemically synthesized
tctgttatgtttagtgtacttt

SEQ ID NO: 1144256 - DNA, 22 bp, Artificial Sequence
  chemically synthesized
aactgaggacaaaagtacacta

SEQ ID NO: 1144257 - DNA, 22 bp, Artificial Sequence
  chemically synthesized
aggacaaaagtacactaaacat

SEQ ID NO: 1144258 - DNA, 22 bp, Artificial Sequence
  chemically synthesized
aatattttctgttatgtttagt

SEQ ID NO: 1144259 - DNA, 22 bp, Artificial Sequence
  chemically synthesized
caatattttctgttatgtttag

SEQ ID NO: 1144260 - DNA, 22 bp, Artificial Sequence
  chemically synthesized
acttcaatattttctgttatgt

SEQ ID NO: 1144261 - DNA, 22 bp, Artificial Sequence
  chemically synthesized
acatagttcacttcaatatttt

SEQ ID NO: 1144262 - DNA, 22 bp, Artificial Sequence
  chemically synthesized
aacatagttcacttcaatattt

SEQ ID NO: 1144263 - DNA, 22 bp, Artificial Sequence
  chemically synthesized
aacataacagaaaatattgaag

SEQ ID NO: 1144264 - DNA, 22 bp, Artificial Sequence
  chemically synthesized
aatttaacatagttcacttcaa

SEQ ID NO: 1144265 - DNA, 22 bp, Artificial Sequence
  chemically synthesized
aaatttaacatagttcacttca

SEQ ID NO: 1144266 - DNA, 22 bp, Artificial Sequence
  chemically synthesized
aagtgaactatgttaaatttaa

SEQ ID NO: 1144267 - DNA, 22 bp, Artificial Sequence
  chemically synthesized
ataaacagaagtttaaatttaa

SEQ ID NO: 1144268 - DNA, 22 bp, Artificial Sequence
  chemically synthesized
cataaacagaagtttaaattta

SEQ ID NO: 1144269 - DNA, 22 bp, Artificial Sequence
  chemically synthesized
ttcataaacagaagtttaaatt

SEQ ID NO: 1144270 - DNA, 22 bp, Artificial Sequence
  chemically synthesized
tgttaaatttaaacttctgttt

SEQ ID NO: 1144271 - DNA, 22 bp, Artificial Sequence
  chemically synthesized
aatttaaacttctgtttatgaa

SEQ ID NO: 1144272 - DNA, 22 bp, Artificial Sequence
  chemically synthesized
cgtaatgatatatctcttcata

SEQ ID NO: 1144273 - DNA, 22 bp, Artificial Sequence
  chemically synthesized
aaacttctgtttatgaagagat

SEQ ID NO: 1144274 - DNA, 22 bp, Artificial Sequence
  chemically synthesized
aacttctgtttatgaagagata

SEQ ID NO: 1144275 - DNA, 22 bp, Artificial Sequence
  chemically synthesized
actccgtaatgatatatctctt

SEQ ID NO: 1144276 - DNA, 22 bp, Artificial Sequence
  chemically synthesized
cactccgtaatgatatatctct

SEQ ID NO: 1144277 - DNA, 22 bp, Artificial Sequence
  chemically synthesized
tcactccgtaatgatatatctc

SEQ ID NO: 1144278 - DNA, 22 bp, Artificial Sequence
  chemically synthesized
ctgtttatgaagagatatatca

SEQ ID NO: 1144279 - DNA, 22 bp, Artificial Sequence
  chemically synthesized
ttcactccgtaatgatatatct

SEQ ID NO: 1144280 - DNA, 22 bp, Artificial Sequence
  chemically synthesized
tgtttatgaagagatatatcat

SEQ ID NO: 1144281 - DNA, 22 bp, Artificial Sequence
  chemically synthesized
tttatgaagagatatatcatta

SEQ ID NO: 1144282 - DNA, 22 bp, Artificial Sequence
  chemically synthesized
ccttttcactccgtaatgatat

SEQ ID NO: 1144283 - DNA, 22 bp, Artificial Sequence
  chemically synthesized
gccttttcactccgtaatgata

SEQ ID NO: 1144284 - DNA, 22 bp, Artificial Sequence
  chemically synthesized
atgaagagatatatcattacgg

SEQ ID NO: 1144285 - DNA, 22 bp, Artificial Sequence
  chemically synthesized
tgaagagatatatcattacgga

SEQ ID NO: 1144286 - DNA, 22 bp, Artificial Sequence
  chemically synthesized
aatgggtaccttgccttttcac

SEQ ID NO: 1144287 - DNA, 22 bp, Artificial Sequence
  chemically synthesized
gaatgggtaccttgccttttca

SEQ ID NO: 1144288 - DNA, 22 bp, Artificial Sequence
  chemically synthesized
tgaatgggtaccttgccttttc

SEQ ID NO: 1144289 - DNA, 22 bp, Artificial Sequence
  chemically synthesized
ttgaatgggtaccttgcctttt

SEQ ID NO: 1144290 - DNA, 22 bp, Artificial Sequence
  chemically synthesized
tttgaatgggtaccttgccttt

SEQ ID NO: 1144291 - DNA, 22 bp, Artificial Sequence
  chemically synthesized
tttttgaatgggtaccttgcct

SEQ ID NO: 1144292 - DNA, 22 bp, Artificial Sequence
  chemically synthesized
ctttttgaatgggtaccttgcc

SEQ ID NO: 1144293 - DNA, 22 bp, Artificial Sequence
  chemically synthesized
cggagtgaaaaggcaaggtacc

SEQ ID NO: 1144294 - DNA, 22 bp, Artificial Sequence
  chemically synthesized
tctttttgaatgggtaccttgc

SEQ ID NO: 1144295 - DNA, 22 bp, Artificial Sequence
  chemically synthesized
ttctttttgaatgggtaccttg

SEQ ID NO: 1144296 - DNA, 22 bp, Artificial Sequence
  chemically synthesized
catttttctttttgaatgggta

SEQ ID NO: 1144297 - DNA, 22 bp, Artificial Sequence
  chemically synthesized
tattacatttttctttttgaat

SEQ ID NO: 1144298 - DNA, 22 bp, Artificial Sequence
  chemically synthesized
atattacatttttctttttgaa

SEQ ID NO: 1144299 - DNA, 22 bp, Artificial Sequence
  chemically synthesized
tttatattacatttttcttttt

SEQ ID NO: 1144300 - DNA, 22 bp, Artificial Sequence
  chemically synthesized
ctgtttatattacatttttctt

SEQ ID NO: 1144301 - DNA, 22 bp, Artificial Sequence
  chemically synthesized
gctgtttatattacatttttct

SEQ ID NO: 1144302 - DNA, 22 bp, Artificial Sequence
  chemically synthesized
tgctgtttatattacatttttc

SEQ ID NO: 1144303 - DNA, 22 bp, Artificial Sequence
  chemically synthesized
tttgctgtttatattacatttt

SEQ ID NO: 1144304 - DNA, 22 bp, Artificial Sequence
  chemically synthesized
aaaaagaaaaatgtaatataaa

SEQ ID NO: 1144305 - DNA, 22 bp, Artificial Sequence
  chemically synthesized
ggtattctttgctgtttatatt

SEQ ID NO: 1144306 - DNA, 22 bp, Artificial Sequence
  chemically synthesized
tgggtattctttgctgtttata

SEQ ID NO: 1144307 - DNA, 22 bp, Artificial Sequence
  chemically synthesized
aaatatatatattctgggtatt

SEQ ID NO: 1144308 - DNA, 22 bp, Artificial Sequence
  chemically synthesized
aaaatatatatattctgggtat

SEQ ID NO: 1144309 - DNA, 22 bp, Artificial Sequence
  chemically synthesized
gtttaaaatatatatattctgg

SEQ ID NO: 1144310 - DNA, 22 bp, Artificial Sequence
  chemically synthesized
agtttaaaatatatatattctg

SEQ ID NO: 1144311 - DNA, 22 bp, Artificial Sequence
  chemically synthesized
tagtttaaaatatatatattct

SEQ ID NO: 1144312 - DNA, 22 bp, Artificial Sequence
  chemically synthesized
ttttagtttaaaatatatatat

SEQ ID NO: 1144313 - DNA, 22 bp, Artificial Sequence
  chemically synthesized
attttagtttaaaatatatata

SEQ ID NO: 1144314 - DNA, 22 bp, Artificial Sequence
  chemically synthesized
atttattttagtttaaaatata

SEQ ID NO: 1144315 - DNA, 22 bp, Artificial Sequence
  chemically synthesized
ctgatttattttagtttaaaat

SEQ ID NO: 1144316 - DNA, 22 bp, Artificial Sequence
  chemically synthesized
actgatttattttagtttaaaa

SEQ ID NO: 1144317 - DNA, 22 bp, Artificial Sequence
  chemically synthesized
ttactgatttattttagtttaa

SEQ ID NO: 1144318 - DNA, 22 bp, Artificial Sequence
  chemically synthesized
tcttactgatttattttagttt

SEQ ID NO: 1144319 - DNA, 22 bp, Artificial Sequence
  chemically synthesized
ctcttactgatttattttagtt

SEQ ID NO: 1144320 - DNA, 22 bp, Artificial Sequence
  chemically synthesized
tatttctcttactgatttattt

SEQ ID NO: 1144321 - DNA, 22 bp, Artificial Sequence
  chemically synthesized
tatatttctcttactgatttat

SEQ ID NO: 1144322 - DNA, 22 bp, Artificial Sequence
  chemically synthesized
ctatatttctcttactgattta

SEQ ID NO: 1144323 - DNA, 22 bp, Artificial Sequence
  chemically synthesized
tctatatttctcttactgattt

SEQ ID NO: 1144324 - DNA, 22 bp, Artificial Sequence
  chemically synthesized
taaactaaaataaatcagtaag

SEQ ID NO: 1144325 - DNA, 22 bp, Artificial Sequence
  chemically synthesized
aaactaaaataaatcagtaaga

SEQ ID NO: 1144326 - DNA, 22 bp, Artificial Sequence
  chemically synthesized
aactaaaataaatcagtaagag

SEQ ID NO: 1144327 - DNA, 22 bp, Artificial Sequence
  chemically synthesized
gattttctatatttctcttact

SEQ ID NO: 1144328 - DNA, 22 bp, Artificial Sequence
  chemically synthesized
aaataaatcagtaagagaaata

SEQ ID NO: 1144329 - DNA, 22 bp, Artificial Sequence
  chemically synthesized
ctggattttctatatttctctt

SEQ ID NO: 1144330 - DNA, 22 bp, Artificial Sequence
  chemically synthesized
tactggattttctatatttctc

SEQ ID NO: 1144331 - DNA, 22 bp, Artificial Sequence
  chemically synthesized
ctactggattttctatatttct

SEQ ID NO: 1144332 - DNA, 22 bp, Artificial Sequence
  chemically synthesized
tctactggattttctatatttc

SEQ ID NO: 1144333 - DNA, 22 bp, Artificial Sequence
  chemically synthesized
ttctactggattttctatattt

SEQ ID NO: 1144334 - DNA, 22 bp, Artificial Sequence
  chemically synthesized
tttttctactggattttctata

SEQ ID NO: 1144335 - DNA, 22 bp, Artificial Sequence
  chemically synthesized
aaatgcctgtttttctactgga

SEQ ID NO: 1144336 - DNA, 22 bp, Artificial Sequence
  chemically synthesized
tgaaatgcctgtttttctactg

SEQ ID NO: 1144337 - DNA, 22 bp, Artificial Sequence
  chemically synthesized
tctgaaatgcctgtttttctac

SEQ ID NO: 1144338 - DNA, 22 bp, Artificial Sequence
  chemically synthesized
ctctgaaatgcctgtttttcta

SEQ ID NO: 1144339 - DNA, 22 bp, Artificial Sequence
  chemically synthesized
ttctctgaaatgcctgtttttc

SEQ ID NO: 1144340 - DNA, 22 bp, Artificial Sequence
  chemically synthesized
aatgaactcttctctgaaatgc

SEQ ID NO: 1144341 - DNA, 22 bp, Artificial Sequence
  chemically synthesized
aaatgaactcttctctgaaatg

SEQ ID NO: 1144342 - DNA, 22 bp, Artificial Sequence
  chemically synthesized
gccatttaaatgaactcttctc

SEQ ID NO: 1144343 - DNA, 22 bp, Artificial Sequence
  chemically synthesized
ttggccatttaaatgaactctt

SEQ ID NO: 1144344 - DNA, 22 bp, Artificial Sequence
  chemically synthesized
ttattggccatttaaatgaact

SEQ ID NO: 1144345 - DNA, 22 bp, Artificial Sequence
  chemically synthesized
cagagaagagttcatttaaatg

SEQ ID NO: 1144346 - DNA, 22 bp, Artificial Sequence
  chemically synthesized
agagaagagttcatttaaatgg

SEQ ID NO: 1144347 - DNA, 22 bp, Artificial Sequence
  chemically synthesized
agttgttattggccatttaaat

SEQ ID NO: 1144348 - DNA, 22 bp, Artificial Sequence
  chemically synthesized
cagttgttattggccatttaaa

SEQ ID NO: 1144349 - DNA, 22 bp, Artificial Sequence
  chemically synthesized
tttcagttgttattggccattt

SEQ ID NO: 1144350 - DNA, 22 bp, Artificial Sequence
  chemically synthesized
atttaaatggccaataacaact

SEQ ID NO: 1144351 - DNA, 22 bp, Artificial Sequence
  chemically synthesized
aaatggccaataacaactgaaa

SEQ ID NO: 1144352 - DNA, 22 bp, Artificial Sequence
  chemically synthesized
aatggccaataacaactgaaat

SEQ ID NO: 1144353 - DNA, 22 bp, Artificial Sequence
  chemically synthesized
atgaccagtgaggcggaatact

SEQ ID NO: 1144354 - DNA, 22 bp, Artificial Sequence
  chemically synthesized
aaatagtattccgcctcactgg

SEQ ID NO: 1144355 - DNA, 22 bp, Artificial Sequence
  chemically synthesized
tatatactgatgaccagtgagg

SEQ ID NO: 1144356 - DNA, 22 bp, Artificial Sequence
  chemically synthesized
gtatatactgatgaccagtgag

SEQ ID NO: 1144357 - DNA, 22 bp, Artificial Sequence
  chemically synthesized
atttgtatatactgatgaccag

SEQ ID NO: 1144358 - DNA, 22 bp, Artificial Sequence
  chemically synthesized
catttgtatatactgatgacca

SEQ ID NO: 1144359 - DNA, 22 bp, Artificial Sequence
  chemically synthesized
tcatttgtatatactgatgacc

SEQ ID NO: 1144360 - DNA, 22 bp, Artificial Sequence
  chemically synthesized
ttcatttgtatatactgatgac

SEQ ID NO: 1144361 - DNA, 22 bp, Artificial Sequence
  chemically synthesized
cgcctcactggtcatcagtata

SEQ ID NO: 1144362 - DNA, 22 bp, Artificial Sequence
  chemically synthesized
atttttcatttgtatatactga

SEQ ID NO: 1144363 - DNA, 22 bp, Artificial Sequence
  chemically synthesized
tcatttttcatttgtatatact

SEQ ID NO: 1144364 - DNA, 22 bp, Artificial Sequence
  chemically synthesized
actggtcatcagtatatacaaa

SEQ ID NO: 1144365 - DNA, 22 bp, Artificial Sequence
  chemically synthesized
gtcatcagtatatacaaatgaa

SEQ ID NO: 1144366 - DNA, 22 bp, Artificial Sequence
  chemically synthesized
taatgtcatctctcatttttca

SEQ ID NO: 1144367 - DNA, 22 bp, Artificial Sequence
  chemically synthesized
ataatgtcatctctcatttttc

SEQ ID NO: 1144368 - DNA, 22 bp, Artificial Sequence
  chemically synthesized
tataatgtcatctctcattttt

SEQ ID NO: 1144369 - DNA, 22 bp, Artificial Sequence
  chemically synthesized
gtgactttataatgtcatctct

SEQ ID NO: 1144370 - DNA, 22 bp, Artificial Sequence
  chemically synthesized
tggtgactttataatgtcatct

SEQ ID NO: 1144371 - DNA, 22 bp, Artificial Sequence
  chemically synthesized
ctggtgactttataatgtcatc

SEQ ID NO: 1144372 - DNA, 22 bp, Artificial Sequence
  chemically synthesized
tctggtgactttataatgtcat

SEQ ID NO: 1144373 - DNA, 22 bp, Artificial Sequence
  chemically synthesized
agcctttctggtgactttataa

SEQ ID NO: 1144374 - DNA, 22 bp, Artificial Sequence
  chemically synthesized
gagcctttctggtgactttata

SEQ ID NO: 1144375 - DNA, 22 bp, Artificial Sequence
  chemically synthesized
atttgagcctttctggtgactt

SEQ ID NO: 1144376 - DNA, 22 bp, Artificial Sequence
  chemically synthesized
aatttgagcctttctggtgact

SEQ ID NO: 1144377 - DNA, 22 bp, Artificial Sequence
  chemically synthesized
taatttgagcctttctggtgac

SEQ ID NO: 1144378 - DNA, 22 bp, Artificial Sequence
  chemically synthesized
ttaatttgagcctttctggtga

SEQ ID NO: 1144379 - DNA, 22 bp, Artificial Sequence
  chemically synthesized
tttaatttgagcctttctggtg

SEQ ID NO: 1144380 - DNA, 22 bp, Artificial Sequence
  chemically synthesized
aactttttaatttgagcctttc

SEQ ID NO: 1144381 - DNA, 22 bp, Artificial Sequence
  chemically synthesized
taaagtcaccagaaaggctcaa

SEQ ID NO: 1144382 - DNA, 22 bp, Artificial Sequence
  chemically synthesized
ttaaactttttaatttgagcct

SEQ ID NO: 1144383 - DNA, 22 bp, Artificial Sequence
  chemically synthesized
gttaaactttttaatttgagcc

SEQ ID NO: 1144384 - DNA, 22 bp, Artificial Sequence
  chemically synthesized
tttgttaaactttttaatttga

SEQ ID NO: 1144385 - DNA, 22 bp, Artificial Sequence
  chemically synthesized
gtttgttaaactttttaatttg

SEQ ID NO: 1144386 - DNA, 22 bp, Artificial Sequence
  chemically synthesized
aatacttgtttgttaaactttt

SEQ ID NO: 1144387 - DNA, 22 bp, Artificial Sequence
  chemically synthesized
gaatacttgtttgttaaacttt

SEQ ID NO: 1144388 - DNA, 22 bp, Artificial Sequence
  chemically synthesized
ttgaatacttgtttgttaaact

SEQ ID NO: 1144389 - DNA, 22 bp, Artificial Sequence
  chemically synthesized
cttgaatacttgtttgttaaac

SEQ ID NO: 1144390 - DNA, 22 bp, Artificial Sequence
  chemically synthesized
aaattaaaaagtttaacaaaca

SEQ ID NO: 1144391 - DNA, 22 bp, Artificial Sequence
  chemically synthesized
atatcttcttgaatacttgttt

SEQ ID NO: 1144392 - DNA, 22 bp, Artificial Sequence
  chemically synthesized
aaaagtttaacaaacaagtatt

SEQ ID NO: 1144393 - DNA, 22 bp, Artificial Sequence
  chemically synthesized
catatcttcttgaatacttgtt

SEQ ID NO: 1144394 - DNA, 22 bp, Artificial Sequence
  chemically synthesized
cttcatatcttcttgaatactt

SEQ ID NO: 1144395 - DNA, 22 bp, Artificial Sequence
  chemically synthesized
aacaaacaagtattcaagaaga

SEQ ID NO: 1144396 - DNA, 22 bp, Artificial Sequence
  chemically synthesized
acaaacaagtattcaagaagat

SEQ ID NO: 1144397 - DNA, 22 bp, Artificial Sequence
  chemically synthesized
aagaagatatgaagcagtttgt

SEQ ID NO: 1144398 - DNA, 22 bp, Artificial Sequence
  chemically synthesized
accagtagtaaatgaaagtaca

SEQ ID NO: 1144399 - DNA, 22 bp, Artificial Sequence
  chemically synthesized
tcaccagtagtaaatgaaagta

SEQ ID NO: 1144400 - DNA, 22 bp, Artificial Sequence
  chemically synthesized
atattctcaccagtagtaaatg

SEQ ID NO: 1144401 - DNA, 22 bp, Artificial Sequence
  chemically synthesized
gtactttcatttactactggtg

SEQ ID NO: 1144402 - DNA, 22 bp, Artificial Sequence
  chemically synthesized
tactttcatttactactggtga

SEQ ID NO: 1144403 - DNA, 22 bp, Artificial Sequence
  chemically synthesized
tataaattcatattctcaccag

SEQ ID NO: 1144404 - DNA, 22 bp, Artificial Sequence
  chemically synthesized
tcatttactactggtgagaata

SEQ ID NO: 1144405 - DNA, 22 bp, Artificial Sequence
  chemically synthesized
catttactactggtgagaatat

SEQ ID NO: 1144406 - DNA, 22 bp, Artificial Sequence
  chemically synthesized
atttactactggtgagaatatg

SEQ ID NO: 1144407 - DNA, 22 bp, Artificial Sequence
  chemically synthesized
actactggtgagaatatgaatt

SEQ ID NO: 1144408 - DNA, 22 bp, Artificial Sequence
  chemically synthesized
caaagttgtataaattcatatt

SEQ ID NO: 1144409 - DNA, 22 bp, Artificial Sequence
  chemically synthesized
ctactggtgagaatatgaattt

SEQ ID NO: 1144410 - DNA, 22 bp, Artificial Sequence
  chemically synthesized
ccaaagttgtataaattcatat

SEQ ID NO: 1144411 - DNA, 22 bp, Artificial Sequence
  chemically synthesized
tccaaagttgtataaattcata

SEQ ID NO: 1144412 - DNA, 22 bp, Artificial Sequence
  chemically synthesized
ctggtgagaatatgaatttata

SEQ ID NO: 1144413 - DNA, 22 bp, Artificial Sequence
  chemically synthesized
gtgagaatatgaatttatacaa

SEQ ID NO: 1144414 - DNA, 22 bp, Artificial Sequence
  chemically synthesized
acaaagggttttccaaagttgt

SEQ ID NO: 1144415 - DNA, 22 bp, Artificial Sequence
  chemically synthesized
aagatattaacaaagggttttc

SEQ ID NO: 1144416 - DNA, 22 bp, Artificial Sequence
  chemically synthesized
atacaactttggaaaacccttt

SEQ ID NO: 1144417 - DNA, 22 bp, Artificial Sequence
  chemically synthesized
caagatattaacaaagggtttt

SEQ ID NO: 1144418 - DNA, 22 bp, Artificial Sequence
  chemically synthesized
tacaactttggaaaaccctttg

SEQ ID NO: 1144419 - DNA, 22 bp, Artificial Sequence
  chemically synthesized
tcaagatattaacaaagggttt

SEQ ID NO: 1144420 - DNA, 22 bp, Artificial Sequence
  chemically synthesized
gctttcaagatattaacaaagg

SEQ ID NO: 1144421 - DNA, 22 bp, Artificial Sequence
  chemically synthesized
agctttcaagatattaacaaag

SEQ ID NO: 1144422 - DNA, 22 bp, Artificial Sequence
  chemically synthesized
tggaaaaccctttgttaatatc

SEQ ID NO: 1144423 - DNA, 22 bp, Artificial Sequence
  chemically synthesized
ggaaaaccctttgttaatatct

SEQ ID NO: 1144424 - DNA, 22 bp, Artificial Sequence
  chemically synthesized
gaaaaccctttgttaatatctt

SEQ ID NO: 1144425 - DNA, 22 bp, Artificial Sequence
  chemically synthesized
tgttaatatcttgaaagctaaa

SEQ ID NO: 1144426 - DNA, 22 bp, Artificial Sequence
  chemically synthesized
ggtatatgcatatttagctttc

SEQ ID NO: 1144427 - DNA, 22 bp, Artificial Sequence
  chemically synthesized
gttaatatcttgaaagctaaat

SEQ ID NO: 1144428 - DNA, 22 bp, Artificial Sequence
  chemically synthesized
ttaatatcttgaaagctaaata

SEQ ID NO: 1144429 - DNA, 22 bp, Artificial Sequence
  chemically synthesized
atatcttgaaagctaaatatgc

SEQ ID NO: 1144430 - DNA, 22 bp, Artificial Sequence
  chemically synthesized
atcattgggtatatgcatattt

SEQ ID NO: 1144431 - DNA, 22 bp, Artificial Sequence
  chemically synthesized
aatcattgggtatatgcatatt

SEQ ID NO: 1144432 - DNA, 22 bp, Artificial Sequence
  chemically synthesized
ttaatcattgggtatatgcata

SEQ ID NO: 1144433 - DNA, 22 bp, Artificial Sequence
  chemically synthesized
cttaatcattgggtatatgcat

SEQ ID NO: 1144434 - DNA, 22 bp, Artificial Sequence
  chemically synthesized
gaaagctaaatatgcatatacc

SEQ ID NO: 1144435 - DNA, 22 bp, Artificial Sequence
  chemically synthesized
aaagctaaatatgcatataccc

SEQ ID NO: 1144436 - DNA, 22 bp, Artificial Sequence
  chemically synthesized
aatatgcatatacccaatgatt

SEQ ID NO: 1144437 - DNA, 22 bp, Artificial Sequence
  chemically synthesized
agaatagcatttcttaatcatt

SEQ ID NO: 1144438 - DNA, 22 bp, Artificial Sequence
  chemically synthesized
cctaagaatagcatttcttaat

SEQ ID NO: 1144439 - DNA, 22 bp, Artificial Sequence
  chemically synthesized
acctaagaatagcatttcttaa

SEQ ID NO: 1144440 - DNA, 22 bp, Artificial Sequence
  chemically synthesized
ggtatttacctaagaatagcat

SEQ ID NO: 1144441 - DNA, 22 bp, Artificial Sequence
  chemically synthesized
tattaggtatttacctaagaat

SEQ ID NO: 1144442 - DNA, 22 bp, Artificial Sequence
  chemically synthesized
gtattaggtatttacctaagaa

SEQ ID NO: 1144443 - DNA, 22 bp, Artificial Sequence
  chemically synthesized
tgtattaggtatttacctaaga

SEQ ID NO: 1144444 - DNA, 22 bp, Artificial Sequence
  chemically synthesized
agaaatgctattcttaggtaaa

SEQ ID NO: 1144445 - DNA, 22 bp, Artificial Sequence
  chemically synthesized
ttgtattaggtatttacctaag

SEQ ID NO: 1144446 - DNA, 22 bp, Artificial Sequence
  chemically synthesized
ttcttaggtaaatacctaatac

SEQ ID NO: 1144447 - DNA, 22 bp, Artificial Sequence
  chemically synthesized
ttaggtaaatacctaatacaaa

SEQ ID NO: 1144448 - DNA, 22 bp, Artificial Sequence
  chemically synthesized
aggtaaatacctaatacaaaag

SEQ ID NO: 1144449 - DNA, 22 bp, Artificial Sequence
  chemically synthesized
ggtaaatacctaatacaaaagt

SEQ ID NO: 1144450 - DNA, 22 bp, Artificial Sequence
  chemically synthesized
tgtatatatgtaaacttttgta

SEQ ID NO: 1144451 - DNA, 22 bp, Artificial Sequence
  chemically synthesized
gtgtatatatgtaaacttttgt

SEQ ID NO: 1144452 - DNA, 22 bp, Artificial Sequence
  chemically synthesized
tgtgtatatatgtaaacttttg

SEQ ID NO: 1144453 - DNA, 22 bp, Artificial Sequence
  chemically synthesized
ttgtgtatatatgtaaactttt

SEQ ID NO: 1144454 - DNA, 22 bp, Artificial Sequence
  chemically synthesized
atacaaaagtttacatatatac

SEQ ID NO: 1144455 - DNA, 22 bp, Artificial Sequence
  chemically synthesized
tacgtatatttttgtgtatata

SEQ ID NO: 1144456 - DNA, 22 bp, Artificial Sequence
  chemically synthesized
acatatatacacaaaaatatac

SEQ ID NO: 1144457 - DNA, 22 bp, Artificial Sequence
  chemically synthesized
catatatacacaaaaatatacg

SEQ ID NO: 1144458 - DNA, 22 bp, Artificial Sequence
  chemically synthesized
tcaacataaattgtacgtatat

SEQ ID NO: 1144459 - DNA, 22 bp, Artificial Sequence
  chemically synthesized
atctatcaacataaattgtacg

SEQ ID NO: 1144460 - DNA, 22 bp, Artificial Sequence
  chemically synthesized
caaataattcatctatcaacat

SEQ ID NO: 1144461 - DNA, 22 bp, Artificial Sequence
  chemically synthesized
ggaagcattacaaataattcat

SEQ ID NO: 1144462 - DNA, 22 bp, Artificial Sequence
  chemically synthesized
atgttgatagatgaattatttg

SEQ ID NO: 1144463 - DNA, 22 bp, Artificial Sequence
  chemically synthesized
tgttgatagatgaattatttgt

SEQ ID NO: 1144464 - DNA, 22 bp, Artificial Sequence
  chemically synthesized
cagttcggaagcattacaaata

SEQ ID NO: 1144465 - DNA, 22 bp, Artificial Sequence
  chemically synthesized
ccagttcggaagcattacaaat

SEQ ID NO: 1144466 - DNA, 22 bp, Artificial Sequence
  chemically synthesized
atagatgaattatttgtaatgc

SEQ ID NO: 1144467 - DNA, 22 bp, Artificial Sequence
  chemically synthesized
tttccagttcggaagcattaca

SEQ ID NO: 1144468 - DNA, 22 bp, Artificial Sequence
  chemically synthesized
gggttgtttccagttcggaagc

SEQ ID NO: 1144469 - DNA, 22 bp, Artificial Sequence
  chemically synthesized
tttgtaatgcttccgaactgga

SEQ ID NO: 1144470 - DNA, 22 bp, Artificial Sequence
  chemically synthesized
gtaatgcttccgaactggaaac

SEQ ID NO: 1144471 - DNA, 22 bp, Artificial Sequence
  chemically synthesized
taatgcttccgaactggaaaca

SEQ ID NO: 1144472 - DNA, 22 bp, Artificial Sequence
  chemically synthesized
agaaaattggggttgtttccag

SEQ ID NO: 1144473 - DNA, 22 bp, Artificial Sequence
  chemically synthesized
ttcagaaaattggggttgtttc

SEQ ID NO: 1144474 - DNA, 22 bp, Artificial Sequence
  chemically synthesized
tgttcagaaaattggggttgtt

SEQ ID NO: 1144475 - DNA, 22 bp, Artificial Sequence
  chemically synthesized
ccgaactggaaacaaccccaat

SEQ ID NO: 1144476 - DNA, 22 bp, Artificial Sequence
  chemically synthesized
cgaactggaaacaaccccaatt

SEQ ID NO: 1144477 - DNA, 22 bp, Artificial Sequence
  chemically synthesized
catattctgttcagaaaattgg

SEQ ID NO: 1144478 - DNA, 22 bp, Artificial Sequence
  chemically synthesized
acatattctgttcagaaaattg

SEQ ID NO: 1144479 - DNA, 22 bp, Artificial Sequence
  chemically synthesized
tacatattctgttcagaaaatt

SEQ ID NO: 1144480 - DNA, 22 bp, Artificial Sequence
  chemically synthesized
gaaacaaccccaattttctgaa

SEQ ID NO: 1144481 - DNA, 22 bp, Artificial Sequence
  chemically synthesized
tctgaacagaatatgtaaaatg

SEQ ID NO: 1144482 - DNA, 22 bp, Artificial Sequence
  chemically synthesized
ctgaacagaatatgtaaaatgt

SEQ ID NO: 1144483 - DNA, 22 bp, Artificial Sequence
  chemically synthesized
tatgaatataccacattttaca

SEQ ID NO: 1144484 - DNA, 22 bp, Artificial Sequence
  chemically synthesized
tgaacagaatatgtaaaatgtg

SEQ ID NO: 1144485 - DNA, 22 bp, Artificial Sequence
  chemically synthesized
gtatgaatataccacattttac

SEQ ID NO: 1144486 - DNA, 22 bp, Artificial Sequence
  chemically synthesized
tgtatgaatataccacatttta

SEQ ID NO: 1144487 - DNA, 22 bp, Artificial Sequence
  chemically synthesized
aacagaatatgtaaaatgtggt

SEQ ID NO: 1144488 - DNA, 22 bp, Artificial Sequence
  chemically synthesized
ctttgtatgaatataccacatt

SEQ ID NO: 1144489 - DNA, 22 bp, Artificial Sequence
  chemically synthesized
gatagaattactttgtatgaat

SEQ ID NO: 1144490 - DNA, 22 bp, Artificial Sequence
  chemically synthesized
atcgctggatagaattactttg

SEQ ID NO: 1144491 - DNA, 22 bp, Artificial Sequence
  chemically synthesized
catcgctggatagaattacttt

SEQ ID NO: 1144492 - DNA, 22 bp, Artificial Sequence
  chemically synthesized
tcatcgctggatagaattactt

SEQ ID NO: 1144493 - DNA, 22 bp, Artificial Sequence
  chemically synthesized
attttcatcgctggatagaatt

SEQ ID NO: 1144494 - DNA, 22 bp, Artificial Sequence
  chemically synthesized
atacaaagtaattctatccagc

SEQ ID NO: 1144495 - DNA, 22 bp, Artificial Sequence
  chemically synthesized
ttaattttcatcgctggataga

SEQ ID NO: 1144496 - DNA, 22 bp, Artificial Sequence
  chemically synthesized
attaattttcatcgctggatag

SEQ ID NO: 1144497 - DNA, 22 bp, Artificial Sequence
  chemically synthesized
tattaattttcatcgctggata

SEQ ID NO: 1144498 - DNA, 22 bp, Artificial Sequence
  chemically synthesized
ctttattaattttcatcgctgg

SEQ ID NO: 1144499 - DNA, 22 bp, Artificial Sequence
  chemically synthesized
tatccagcgatgaaaattaata

SEQ ID NO: 1144500 - DNA, 22 bp, Artificial Sequence
  chemically synthesized
tccagcgatgaaaattaataaa

SEQ ID NO: 1144501 - DNA, 22 bp, Artificial Sequence
  chemically synthesized
catatagcattactttattaat

SEQ ID NO: 1144502 - DNA, 22 bp, Artificial Sequence
  chemically synthesized
tgttgcatatagcattacttta

SEQ ID NO: 1144503 - DNA, 22 bp, Artificial Sequence
  chemically synthesized
actatgttgcatatagcattac

SEQ ID NO: 1144504 - DNA, 22 bp, Artificial Sequence
  chemically synthesized
ataaagtaatgctatatgcaac

SEQ ID NO: 1144505 - DNA, 22 bp, Artificial Sequence
  chemically synthesized
tgagattcactatgttgcatat

SEQ ID NO: 1144506 - DNA, 22 bp, Artificial Sequence
  chemically synthesized
gtgagattcactatgttgcata

SEQ ID NO: 1144507 - DNA, 22 bp, Artificial Sequence
  chemically synthesized
tatttgtgagattcactatgtt

SEQ ID NO: 1144508 - DNA, 22 bp, Artificial Sequence
  chemically synthesized
tatgcaacatagtgaatctcac

SEQ ID NO: 1144509 - DNA, 22 bp, Artificial Sequence
  chemically synthesized
gatactatatttgtgagattca

SEQ ID NO: 1144510 - DNA, 22 bp, Artificial Sequence
  chemically synthesized
actggatactatatttgtgaga

SEQ ID NO: 1144511 - DNA, 22 bp, Artificial Sequence
  chemically synthesized
cactggatactatatttgtgag

SEQ ID NO: 1144512 - DNA, 22 bp, Artificial Sequence
  chemically synthesized
tcactggatactatatttgtga

SEQ ID NO: 1144513 - DNA, 22 bp, Artificial Sequence
  chemically synthesized
ttcactggatactatatttgtg

SEQ ID NO: 1144514 - DNA, 22 bp, Artificial Sequence
  chemically synthesized
tttcactggatactatatttgt

SEQ ID NO: 1144515 - DNA, 22 bp, Artificial Sequence
  chemically synthesized
ttttcactggatactatatttg

SEQ ID NO: 1144516 - DNA, 22 bp, Artificial Sequence
  chemically synthesized
gcttttttcactggatactata

SEQ ID NO: 1144517 - DNA, 22 bp, Artificial Sequence
  chemically synthesized
actggcttttttcactggatac

SEQ ID NO: 1144518 - DNA, 22 bp, Artificial Sequence
  chemically synthesized
aactggcttttttcactggata

SEQ ID NO: 1144519 - DNA, 22 bp, Artificial Sequence
  chemically synthesized
taactggcttttttcactggat

SEQ ID NO: 1144520 - DNA, 22 bp, Artificial Sequence
  chemically synthesized
acaaatatagtatccagtgaaa

SEQ ID NO: 1144521 - DNA, 22 bp, Artificial Sequence
  chemically synthesized
ttaactggcttttttcactgga

SEQ ID NO: 1144522 - DNA, 22 bp, Artificial Sequence
  chemically synthesized
tttaactggcttttttcactgg

SEQ ID NO: 1144523 - DNA, 22 bp, Artificial Sequence
  chemically synthesized
tatatgcagttttttaactggc

SEQ ID NO: 1144524 - DNA, 22 bp, Artificial Sequence
  chemically synthesized
atatatgcagttttttaactgg

SEQ ID NO: 1144525 - DNA, 22 bp, Artificial Sequence
  chemically synthesized
tatatatgcagttttttaactg

SEQ ID NO: 1144526 - DNA, 22 bp, Artificial Sequence
  chemically synthesized
ttatatatgcagttttttaact

SEQ ID NO: 1144527 - DNA, 22 bp, Artificial Sequence
  chemically synthesized
atgtaaatgaaacttttatata

SEQ ID NO: 1144528 - DNA, 22 bp, Artificial Sequence
  chemically synthesized
gatgtaaatgaaacttttatat

SEQ ID NO: 1144529 - DNA, 22 bp, Artificial Sequence
  chemically synthesized
aaaaactgcatatataaaagtt

SEQ ID NO: 1144530 - DNA, 22 bp, Artificial Sequence
  chemically synthesized
acttgatgtaaatgaaactttt

SEQ ID NO: 1144531 - DNA, 22 bp, Artificial Sequence
  chemically synthesized
aacttgatgtaaatgaaacttt

SEQ ID NO: 1144532 - DNA, 22 bp, Artificial Sequence
  chemically synthesized
taacttgatgtaaatgaaactt

SEQ ID NO: 1144533 - DNA, 22 bp, Artificial Sequence
  chemically synthesized
ttaacttgatgtaaatgaaact

SEQ ID NO: 1144534 - DNA, 22 bp, Artificial Sequence
  chemically synthesized
catatataaaagtttcatttac

SEQ ID NO: 1144535 - DNA, 22 bp, Artificial Sequence
  chemically synthesized
tatttttaacttgatgtaaatg

SEQ ID NO: 1144536 - DNA, 22 bp, Artificial Sequence
  chemically synthesized
ctatatttttaacttgatgtaa

SEQ ID NO: 1144537 - DNA, 22 bp, Artificial Sequence
  chemically synthesized
gctatatttttaacttgatgta

SEQ ID NO: 1144538 - DNA, 22 bp, Artificial Sequence
  chemically synthesized
gtcttgctatatttttaacttg

SEQ ID NO: 1144539 - DNA, 22 bp, Artificial Sequence
  chemically synthesized
catttacatcaagttaaaaata

SEQ ID NO: 1144540 - DNA, 22 bp, Artificial Sequence
  chemically synthesized
atttacatcaagttaaaaatat

SEQ ID NO: 1144541 - DNA, 22 bp, Artificial Sequence
  chemically synthesized
caggttagtcttgctatatttt

SEQ ID NO: 1144542 - DNA, 22 bp, Artificial Sequence
  chemically synthesized
acatcaagttaaaaatatagca

SEQ ID NO: 1144543 - DNA, 22 bp, Artificial Sequence
  chemically synthesized
catcaagttaaaaatatagcaa

SEQ ID NO: 1144544 - DNA, 22 bp, Artificial Sequence
  chemically synthesized
taatgctgcaggttagtcttgc

SEQ ID NO: 1144545 - DNA, 22 bp, Artificial Sequence
  chemically synthesized
aaaatatagcaagactaacctg

SEQ ID NO: 1144546 - DNA, 22 bp, Artificial Sequence
  chemically synthesized
agttataatgctgcaggttagt

SEQ ID NO: 1144547 - DNA, 22 bp, Artificial Sequence
  chemically synthesized
gagttataatgctgcaggttag

SEQ ID NO: 1144548 - DNA, 22 bp, Artificial Sequence
  chemically synthesized
acctgcagcattataactcaag

SEQ ID NO: 1144549 - DNA, 22 bp, Artificial Sequence
  chemically synthesized
aaaggtaacatgtatcttgagt

SEQ ID NO: 1144550 - DNA, 22 bp, Artificial Sequence
  chemically synthesized
cagcattataactcaagataca

SEQ ID NO: 1144551 - DNA, 22 bp, Artificial Sequence
  chemically synthesized
ctcaaaggtaacatgtatcttg

SEQ ID NO: 1144552 - DNA, 22 bp, Artificial Sequence
  chemically synthesized
taactcaagatacatgttacct

SEQ ID NO: 1144553 - DNA, 22 bp, Artificial Sequence
  chemically synthesized
ccatctcctcaaaggtaacatg

SEQ ID NO: 1144554 - DNA, 22 bp, Artificial Sequence
  chemically synthesized
cccatctcctcaaaggtaacat

SEQ ID NO: 1144555 - DNA, 22 bp, Artificial Sequence
  chemically synthesized
ttcccatctcctcaaaggtaac

SEQ ID NO: 1144556 - DNA, 22 bp, Artificial Sequence
  chemically synthesized
aagatacatgttacctttgagg

SEQ ID NO: 1144557 - DNA, 22 bp, Artificial Sequence
  chemically synthesized
tggtatcataaactcttcccat

SEQ ID NO: 1144558 - DNA, 22 bp, Artificial Sequence
  chemically synthesized
cctttgaggagatgggaagagt

SEQ ID NO: 1144559 - DNA, 22 bp, Artificial Sequence
  chemically synthesized
tgaggagatgggaagagtttat

SEQ ID NO: 1144560 - DNA, 22 bp, Artificial Sequence
  chemically synthesized
gaggagatgggaagagtttatg

SEQ ID NO: 1144561 - DNA, 22 bp, Artificial Sequence
  chemically synthesized
aggagatgggaagagtttatga

SEQ ID NO: 1144562 - DNA, 22 bp, Artificial Sequence
  chemically synthesized
catcaagccctatggtatcata

SEQ ID NO: 1144563 - DNA, 22 bp, Artificial Sequence
  chemically synthesized
atgataccatagggcttgatgg

SEQ ID NO: 1144564 - DNA, 22 bp, Artificial Sequence
  chemically synthesized
tgataccatagggcttgatgga

SEQ ID NO: 1144565 - DNA, 22 bp, Artificial Sequence
  chemically synthesized
ccagcaaccaggaaacctccat

SEQ ID NO: 1144566 - DNA, 22 bp, Artificial Sequence
  chemically synthesized
gatggaggtttcctggttgctg

SEQ ID NO: 1144567 - DNA, 22 bp, Artificial Sequence
  chemically synthesized
atggaggtttcctggttgctgg

SEQ ID NO: 1144568 - DNA, 22 bp, Artificial Sequence
  chemically synthesized
cctggttgctggtaacatacta

SEQ ID NO: 1144569 - DNA, 22 bp, Artificial Sequence
  chemically synthesized
ctggttgctggtaacatactat

SEQ ID NO: 1144570 - DNA, 22 bp, Artificial Sequence
  chemically synthesized
gttgctggtaacatactatctt

SEQ ID NO: 1144571 - DNA, 22 bp, Artificial Sequence
  chemically synthesized
cacatccagaaaaagatagtat

SEQ ID NO: 1144572 - DNA, 22 bp, Artificial Sequence
  chemically synthesized
ctggtaacatactatctttttc

SEQ ID NO: 1144573 - DNA, 22 bp, Artificial Sequence
  chemically synthesized
tgattccacatccagaaaaaga

SEQ ID NO: 1144574 - DNA, 22 bp, Artificial Sequence
  chemically synthesized
gtaacatactatctttttctgg

SEQ ID NO: 1144575 - DNA, 22 bp, Artificial Sequence
  chemically synthesized
tctttttctggatgtggaatca

SEQ ID NO: 1144576 - DNA, 22 bp, Artificial Sequence
  chemically synthesized
tttctggatgtggaatcatagt

SEQ ID NO: 1144577 - DNA, 22 bp, Artificial Sequence
  chemically synthesized
cagaagtaacatactatgattc

SEQ ID NO: 1144578 - DNA, 22 bp, Artificial Sequence
  chemically synthesized
ttctggatgtggaatcatagta

SEQ ID NO: 1144579 - DNA, 22 bp, Artificial Sequence
  chemically synthesized
tctggatgtggaatcatagtat

SEQ ID NO: 1144580 - DNA, 22 bp, Artificial Sequence
  chemically synthesized
ctggatgtggaatcatagtatg

SEQ ID NO: 1144581 - DNA, 22 bp, Artificial Sequence
  chemically synthesized
ttacagaagtaacatactatga

SEQ ID NO: 1144582 - DNA, 22 bp, Artificial Sequence
  chemically synthesized
tggatgtggaatcatagtatgt

SEQ ID NO: 1144583 - DNA, 22 bp, Artificial Sequence
  chemically synthesized
attacagaagtaacatactatg

SEQ ID NO: 1144584 - DNA, 22 bp, Artificial Sequence
  chemically synthesized
gatgtggaatcatagtatgtta

SEQ ID NO: 1144585 - DNA, 22 bp, Artificial Sequence
  chemically synthesized
aagacttattacagaagtaaca

SEQ ID NO: 1144586 - DNA, 22 bp, Artificial Sequence
  chemically synthesized
aaagacttattacagaagtaac

SEQ ID NO: 1144587 - DNA, 22 bp, Artificial Sequence
  chemically synthesized
tagcttaaagacttattacaga

SEQ ID NO: 1144588 - DNA, 22 bp, Artificial Sequence
  chemically synthesized
taattatagcttaaagacttat

SEQ ID NO: 1144589 - DNA, 22 bp, Artificial Sequence
  chemically synthesized
cttctgtaataagtctttaagc

SEQ ID NO: 1144590 - DNA, 22 bp, Artificial Sequence
  chemically synthesized
ctgtaataagtctttaagctat

SEQ ID NO: 1144591 - DNA, 22 bp, Artificial Sequence
  chemically synthesized
tgtaataagtctttaagctata

SEQ ID NO: 1144592 - DNA, 22 bp, Artificial Sequence
  chemically synthesized
taataagtctttaagctataat

SEQ ID NO: 1144593 - DNA, 22 bp, Artificial Sequence
  chemically synthesized
taagctataattataacttatg

SEQ ID NO: 1144594 - DNA, 22 bp, Artificial Sequence
  chemically synthesized
aagctataattataacttatgt

SEQ ID NO: 1144595 - DNA, 22 bp, Artificial Sequence
  chemically synthesized
agctataattataacttatgtc

SEQ ID NO: 1144596 - DNA, 22 bp, Artificial Sequence
  chemically synthesized
aagtatcaagcaaaggacataa

SEQ ID NO: 1144597 - DNA, 22 bp, Artificial Sequence
  chemically synthesized
taattataacttatgtcctttg

SEQ ID NO: 1144598 - DNA, 22 bp, Artificial Sequence
  chemically synthesized
aattgaagtatcaagcaaagga

SEQ ID NO: 1144599 - DNA, 22 bp, Artificial Sequence
  chemically synthesized
aaattgaagtatcaagcaaagg

SEQ ID NO: 1144600 - DNA, 22 bp, Artificial Sequence
  chemically synthesized
taaattgaagtatcaagcaaag

SEQ ID NO: 1144601 - DNA, 22 bp, Artificial Sequence
  chemically synthesized
taacttatgtcctttgcttgat

SEQ ID NO: 1144602 - DNA, 22 bp, Artificial Sequence
  chemically synthesized
ttaaattgaagtatcaagcaaa

SEQ ID NO: 1144603 - DNA, 22 bp, Artificial Sequence
  chemically synthesized
tttaaattgaagtatcaagcaa

SEQ ID NO: 1144604 - DNA, 22 bp, Artificial Sequence
  chemically synthesized
atgtcctttgcttgatacttca

SEQ ID NO: 1144605 - DNA, 22 bp, Artificial Sequence
  chemically synthesized
tgtcctttgcttgatacttcaa

SEQ ID NO: 1144606 - DNA, 22 bp, Artificial Sequence
  chemically synthesized
tggtactttttaaattgaagta

SEQ ID NO: 1144607 - DNA, 22 bp, Artificial Sequence
  chemically synthesized
atggtactttttaaattgaagt

SEQ ID NO: 1144608 - DNA, 22 bp, Artificial Sequence
  chemically synthesized
tatggtactttttaaattgaag

SEQ ID NO: 1144609 - DNA, 22 bp, Artificial Sequence
  chemically synthesized
tgcttgatacttcaatttaaaa

SEQ ID NO: 1144610 - DNA, 22 bp, Artificial Sequence
  chemically synthesized
gcttgatacttcaatttaaaaa

SEQ ID NO: 1144611 - DNA, 22 bp, Artificial Sequence
  chemically synthesized
cttgatacttcaatttaaaaag

SEQ ID NO: 1144612 - DNA, 22 bp, Artificial Sequence
  chemically synthesized
gatacttcaatttaaaaagtac

SEQ ID NO: 1144613 - DNA, 22 bp, Artificial Sequence
  chemically synthesized
atacttcaatttaaaaagtacc

SEQ ID NO: 1144614 - DNA, 22 bp, Artificial Sequence
  chemically synthesized
caatttaaaaagtaccataaag

SEQ ID NO: 1144615 - DNA, 22 bp, Artificial Sequence
  chemically synthesized
aatttaaaaagtaccataaagt

SEQ ID NO: 1144616 - DNA, 22 bp, Artificial Sequence
  chemically synthesized
aaaaaaaaatgcaaactttatg

SEQ ID NO: 1144617 - DNA, 22 bp, Artificial Sequence
  chemically synthesized
tgaaaaaaaaatgcaaacttta

SEQ ID NO: 1144618 - DNA, 22 bp, Artificial Sequence
  chemically synthesized
aaaaagtaccataaagtttgca

SEQ ID NO: 1144619 - DNA, 22 bp, Artificial Sequence
  chemically synthesized
aaaagtaccataaagtttgcat

SEQ ID NO: 1144620 - DNA, 22 bp, Artificial Sequence
  chemically synthesized
atggttctgaaaaaaaaatgca

SEQ ID NO: 1144621 - DNA, 22 bp, Artificial Sequence
  chemically synthesized
ttgatggttctgaaaaaaaaat

SEQ ID NO: 1144622 - DNA, 22 bp, Artificial Sequence
  chemically synthesized
tctgttgatggttctgaaaaaa

SEQ ID NO: 1144623 - DNA, 22 bp, Artificial Sequence
  chemically synthesized
atctgttgatggttctgaaaaa

SEQ ID NO: 1144624 - DNA, 22 bp, Artificial Sequence
  chemically synthesized
tttatctgttgatggttctgaa

SEQ ID NO: 1144625 - DNA, 22 bp, Artificial Sequence
  chemically synthesized
gcatttttttttcagaaccatc

SEQ ID NO: 1144626 - DNA, 22 bp, Artificial Sequence
  chemically synthesized
catttttttttcagaaccatca

SEQ ID NO: 1144627 - DNA, 22 bp, Artificial Sequence
  chemically synthesized
tctgtttatctgttgatggttc

SEQ ID NO: 1144628 - DNA, 22 bp, Artificial Sequence
  chemically synthesized
ttatctgtttatctgttgatgg

SEQ ID NO: 1144629 - DNA, 22 bp, Artificial Sequence
  chemically synthesized
ttttttcagaaccatcaacaga

SEQ ID NO: 1144630 - DNA, 22 bp, Artificial Sequence
  chemically synthesized
tttttcagaaccatcaacagat

SEQ ID NO: 1144631 - DNA, 22 bp, Artificial Sequence
  chemically synthesized
ttttcagaaccatcaacagata

SEQ ID NO: 1144632 - DNA, 22 bp, Artificial Sequence
  chemically synthesized
tttcagaaccatcaacagataa

SEQ ID NO: 1144633 - DNA, 22 bp, Artificial Sequence
  chemically synthesized
ttcagaaccatcaacagataaa

SEQ ID NO: 1144634 - DNA, 22 bp, Artificial Sequence
  chemically synthesized
tcagaaccatcaacagataaac

SEQ ID NO: 1144635 - DNA, 22 bp, Artificial Sequence
  chemically synthesized
cagaaccatcaacagataaaca

SEQ ID NO: 1144636 - DNA, 22 bp, Artificial Sequence
  chemically synthesized
agaaccatcaacagataaacag

SEQ ID NO: 1144637 - DNA, 22 bp, Artificial Sequence
  chemically synthesized
tgtatatataacctgttatctg

SEQ ID NO: 1144638 - DNA, 22 bp, Artificial Sequence
  chemically synthesized
cattatgtatatataacctgtt

SEQ ID NO: 1144639 - DNA, 22 bp, Artificial Sequence
  chemically synthesized
tggccaaataacattgcattat

SEQ ID NO: 1144640 - DNA, 22 bp, Artificial Sequence
  chemically synthesized
atggccaaataacattgcatta

SEQ ID NO: 1144641 - DNA, 22 bp, Artificial Sequence
  chemically synthesized
tatggccaaataacattgcatt

SEQ ID NO: 1144642 - DNA, 22 bp, Artificial Sequence
  chemically synthesized
ttatggccaaataacattgcat

SEQ ID NO: 1144643 - DNA, 22 bp, Artificial Sequence
  chemically synthesized
tttatggccaaataacattgca

SEQ ID NO: 1144644 - DNA, 22 bp, Artificial Sequence
  chemically synthesized
tatatacataatgcaatgttat

SEQ ID NO: 1144645 - DNA, 22 bp, Artificial Sequence
  chemically synthesized
ctttttatggccaaataacatt

SEQ ID NO: 1144646 - DNA, 22 bp, Artificial Sequence
  chemically synthesized
attcctttttatggccaaataa

SEQ ID NO: 1144647 - DNA, 22 bp, Artificial Sequence
  chemically synthesized
cattcctttttatggccaaata

SEQ ID NO: 1144648 - DNA, 22 bp, Artificial Sequence
  chemically synthesized
tatttcattcctttttatggcc

SEQ ID NO: 1144649 - DNA, 22 bp, Artificial Sequence
  chemically synthesized
tttggccataaaaaggaatgaa

SEQ ID NO: 1144650 - DNA, 22 bp, Artificial Sequence
  chemically synthesized
caaatagctatatttcattcct

SEQ ID NO: 1144651 - DNA, 22 bp, Artificial Sequence
  chemically synthesized
ggccataaaaaggaatgaaata

SEQ ID NO: 1144652 - DNA, 22 bp, Artificial Sequence
  chemically synthesized
gccataaaaaggaatgaaatat

SEQ ID NO: 1144653 - DNA, 22 bp, Artificial Sequence
  chemically synthesized
ttgcaaatagctatatttcatt

SEQ ID NO: 1144654 - DNA, 22 bp, Artificial Sequence
  chemically synthesized
tgttgttgcaaatagctatatt

SEQ ID NO: 1144655 - DNA, 22 bp, Artificial Sequence
  chemically synthesized
atgttgttgcaaatagctatat

SEQ ID NO: 1144656 - DNA, 22 bp, Artificial Sequence
  chemically synthesized
catttatgttgttgcaaatagc

SEQ ID NO: 1144657 - DNA, 22 bp, Artificial Sequence
  chemically synthesized
cagttccatttatgttgttgca

SEQ ID NO: 1144658 - DNA, 22 bp, Artificial Sequence
  chemically synthesized
tttgcaacaacataaatggaac

SEQ ID NO: 1144659 - DNA, 22 bp, Artificial Sequence
  chemically synthesized
gcaacaacataaatggaactgg

SEQ ID NO: 1144660 - DNA, 22 bp, Artificial Sequence
  chemically synthesized
acataatgacctccagttccat

SEQ ID NO: 1144661 - DNA, 22 bp, Artificial Sequence
  chemically synthesized
caacaacataaatggaactgga

SEQ ID NO: 1144662 - DNA, 22 bp, Artificial Sequence
  chemically synthesized
aacataatgacctccagttcca

SEQ ID NO: 1144663 - DNA, 22 bp, Artificial Sequence
  chemically synthesized
tttaacataatgacctccagtt

SEQ ID NO: 1144664 - DNA, 22 bp, Artificial Sequence
  chemically synthesized
atttaacataatgacctccagt

SEQ ID NO: 1144665 - DNA, 22 bp, Artificial Sequence
  chemically synthesized
cttatttaacataatgacctcc

SEQ ID NO: 1144666 - DNA, 22 bp, Artificial Sequence
  chemically synthesized
tgcctgcttatttaacataatg

SEQ ID NO: 1144667 - DNA, 22 bp, Artificial Sequence
  chemically synthesized
tgtgcctgcttatttaacataa

SEQ ID NO: 1144668 - DNA, 22 bp, Artificial Sequence
  chemically synthesized
ctgtgcctgcttatttaacata

SEQ ID NO: 1144669 - DNA, 22 bp, Artificial Sequence
  chemically synthesized
tctgtgcctgcttatttaacat

SEQ ID NO: 1144670 - DNA, 22 bp, Artificial Sequence
  chemically synthesized
gaggtcattatgttaaataagc

SEQ ID NO: 1144671 - DNA, 22 bp, Artificial Sequence
  chemically synthesized
tctttctgtgcctgcttattta

SEQ ID NO: 1144672 - DNA, 22 bp, Artificial Sequence
  chemically synthesized
gtctttctgtgcctgcttattt

SEQ ID NO: 1144673 - DNA, 22 bp, Artificial Sequence
  chemically synthesized
tgttaaataagcaggcacagaa

SEQ ID NO: 1144674 - DNA, 22 bp, Artificial Sequence
  chemically synthesized
aataagcaggcacagaaagaca

SEQ ID NO: 1144675 - DNA, 22 bp, Artificial Sequence
  chemically synthesized
ccacatgtgaatgagaacatgt

SEQ ID NO: 1144676 - DNA, 22 bp, Artificial Sequence
  chemically synthesized
gctcccacatgtgaatgagaac

SEQ ID NO: 1144677 - DNA, 22 bp, Artificial Sequence
  chemically synthesized
agctcccacatgtgaatgagaa

SEQ ID NO: 1144678 - DNA, 22 bp, Artificial Sequence
  chemically synthesized
tagctcccacatgtgaatgaga

SEQ ID NO: 1144679 - DNA, 22 bp, Artificial Sequence
  chemically synthesized
ttagctcccacatgtgaatgag

SEQ ID NO: 1144680 - DNA, 22 bp, Artificial Sequence
  chemically synthesized
tttagctcccacatgtgaatga

SEQ ID NO: 1144681 - DNA, 22 bp, Artificial Sequence
  chemically synthesized
tcattcacatgtgggagctaaa

SEQ ID NO: 1144682 - DNA, 22 bp, Artificial Sequence
  chemically synthesized
tgagatccaattttttagctcc

SEQ ID NO: 1144683 - DNA, 22 bp, Artificial Sequence
  chemically synthesized
attcacatgtgggagctaaaaa

SEQ ID NO: 1144684 - DNA, 22 bp, Artificial Sequence
  chemically synthesized
tatgagatccaattttttagct

SEQ ID NO: 1144685 - DNA, 22 bp, Artificial Sequence
  chemically synthesized
acatgtgggagctaaaaaattg

SEQ ID NO: 1144686 - DNA, 22 bp, Artificial Sequence
  chemically synthesized
gctctatgagatccaatttttt

SEQ ID NO: 1144687 - DNA, 22 bp, Artificial Sequence
  chemically synthesized
tagctctatgagatccaatttt

SEQ ID NO: 1144688 - DNA, 22 bp, Artificial Sequence
  chemically synthesized
atctctagctctatgagatcca

SEQ ID NO: 1144689 - DNA, 22 bp, Artificial Sequence
  chemically synthesized
taatctctagctctatgagatc

SEQ ID NO: 1144690 - DNA, 22 bp, Artificial Sequence
  chemically synthesized
aaaaattggatctcatagagct

SEQ ID NO: 1144691 - DNA, 22 bp, Artificial Sequence
  chemically synthesized
tcattctaatctctagctctat

SEQ ID NO: 1144692 - DNA, 22 bp, Artificial Sequence
  chemically synthesized
gatctcatagagctagagatta

SEQ ID NO: 1144693 - DNA, 22 bp, Artificial Sequence
  chemically synthesized
cagtatctatcattctaatctc

SEQ ID NO: 1144694 - DNA, 22 bp, Artificial Sequence
  chemically synthesized
atagagctagagattagaatga

SEQ ID NO: 1144695 - DNA, 22 bp, Artificial Sequence
  chemically synthesized
ccagtctccagtatctatcatt

SEQ ID NO: 1144696 - DNA, 22 bp, Artificial Sequence
  chemically synthesized
cccagtctccagtatctatcat

SEQ ID NO: 1144697 - DNA, 22 bp, Artificial Sequence
  chemically synthesized
ttcccagtctccagtatctatc

SEQ ID NO: 1144698 - DNA, 22 bp, Artificial Sequence
  chemically synthesized
gagattagaatgatagatactg

SEQ ID NO: 1144699 - DNA, 22 bp, Artificial Sequence
  chemically synthesized
gaatgatagatactggagactg

SEQ ID NO: 1144700 - DNA, 22 bp, Artificial Sequence
  chemically synthesized
catccacacactcttcccagtc

SEQ ID NO: 1144701 - DNA, 22 bp, Artificial Sequence
  chemically synthesized
attccatccacacactcttccc

SEQ ID NO: 1144702 - DNA, 22 bp, Artificial Sequence
  chemically synthesized
cattccatccacacactcttcc

SEQ ID NO: 1144703 - DNA, 22 bp, Artificial Sequence
  chemically synthesized
ttcattccatccacacactctt

SEQ ID NO: 1144704 - DNA, 22 bp, Artificial Sequence
  chemically synthesized
tcttcattccatccacacactc

SEQ ID NO: 1144705 - DNA, 22 bp, Artificial Sequence
  chemically synthesized
gagactgggaagagtgtgtgga

SEQ ID NO: 1144706 - DNA, 22 bp, Artificial Sequence
  chemically synthesized
ggaagagtgtgtggatggaatg

SEQ ID NO: 1144707 - DNA, 22 bp, Artificial Sequence
  chemically synthesized
aacaacctctcttcattccatc

SEQ ID NO: 1144708 - DNA, 22 bp, Artificial Sequence
  chemically synthesized
agcgtatgtacccattaaacaa

SEQ ID NO: 1144709 - DNA, 22 bp, Artificial Sequence
  chemically synthesized
tctaagcgtatgtacccattaa

SEQ ID NO: 1144710 - DNA, 22 bp, Artificial Sequence
  chemically synthesized
tatctaagcgtatgtacccatt

SEQ ID NO: 1144711 - DNA, 22 bp, Artificial Sequence
  chemically synthesized
ctatctaagcgtatgtacccat

SEQ ID NO: 1144712 - DNA, 22 bp, Artificial Sequence
  chemically synthesized
cttctatctaagcgtatgtacc

SEQ ID NO: 1144713 - DNA, 22 bp, Artificial Sequence
  chemically synthesized
ttccttctatctaagcgtatgt

SEQ ID NO: 1144714 - DNA, 22 bp, Artificial Sequence
  chemically synthesized
attccttctatctaagcgtatg

SEQ ID NO: 1144715 - DNA, 22 bp, Artificial Sequence
  chemically synthesized
tttaatgggtacatacgcttag

SEQ ID NO: 1144716 - DNA, 22 bp, Artificial Sequence
  chemically synthesized
aatgggtacatacgcttagata

SEQ ID NO: 1144717 - DNA, 22 bp, Artificial Sequence
  chemically synthesized
atgggtacatacgcttagatag

SEQ ID NO: 1144718 - DNA, 22 bp, Artificial Sequence
  chemically synthesized
gaacttattccttctatctaag

SEQ ID NO: 1144719 - DNA, 22 bp, Artificial Sequence
  chemically synthesized
tcgaacattagaacttattcct

SEQ ID NO: 1144720 - DNA, 22 bp, Artificial Sequence
  chemically synthesized
ctatcgaacattagaacttatt

SEQ ID NO: 1144721 - DNA, 22 bp, Artificial Sequence
  chemically synthesized
agatagaaggaataagttctaa

SEQ ID NO: 1144722 - DNA, 22 bp, Artificial Sequence
  chemically synthesized
tgctatcgaacattagaactta

SEQ ID NO: 1144723 - DNA, 22 bp, Artificial Sequence
  chemically synthesized
gatagaaggaataagttctaat

SEQ ID NO: 1144724 - DNA, 22 bp, Artificial Sequence
  chemically synthesized
ctctgctatcgaacattagaac

SEQ ID NO: 1144725 - DNA, 22 bp, Artificial Sequence
  chemically synthesized
ctactctgctatcgaacattag

SEQ ID NO: 1144726 - DNA, 22 bp, Artificial Sequence
  chemically synthesized
cctactctgctatcgaacatta

SEQ ID NO: 1144727 - DNA, 22 bp, Artificial Sequence
  chemically synthesized
tatagtcttcctactctgctat

SEQ ID NO: 1144728 - DNA, 22 bp, Artificial Sequence
  chemically synthesized
taatgttcgatagcagagtagg

SEQ ID NO: 1144729 - DNA, 22 bp, Artificial Sequence
  chemically synthesized
atgttcgatagcagagtaggaa

SEQ ID NO: 1144730 - DNA, 22 bp, Artificial Sequence
  chemically synthesized
tatataattatatagtcttcct

SEQ ID NO: 1144731 - DNA, 22 bp, Artificial Sequence
  chemically synthesized
gatagcagagtaggaagactat

SEQ ID NO: 1144732 - DNA, 22 bp, Artificial Sequence
  chemically synthesized
ttgtatataattatatagtctt

SEQ ID NO: 1144733 - DNA, 22 bp, Artificial Sequence
  chemically synthesized
cactgttgtatataattatata

SEQ ID NO: 1144734 - DNA, 22 bp, Artificial Sequence
  chemically synthesized
ttacactgttgtatataattat

SEQ ID NO: 1144735 - DNA, 22 bp, Artificial Sequence
  chemically synthesized
gttacactgttgtatataatta

SEQ ID NO: 1144736 - DNA, 22 bp, Artificial Sequence
  chemically synthesized
tgttacactgttgtatataatt

SEQ ID NO: 1144737 - DNA, 22 bp, Artificial Sequence
  chemically synthesized
tataattatatacaacagtgta

SEQ ID NO: 1144738 - DNA, 22 bp, Artificial Sequence
  chemically synthesized
tatacaacagtgtaacaaaata

SEQ ID NO: 1144739 - DNA, 22 bp, Artificial Sequence
  chemically synthesized
tagagtacatgtgatattttgt

SEQ ID NO: 1144740 - DNA, 22 bp, Artificial Sequence
  chemically synthesized
atagagtacatgtgatattttg

SEQ ID NO: 1144741 - DNA, 22 bp, Artificial Sequence
  chemically synthesized
tacatacttatagagtacatgt

SEQ ID NO: 1144742 - DNA, 22 bp, Artificial Sequence
  chemically synthesized
gtacatacttatagagtacatg

SEQ ID NO: 1144743 - DNA, 22 bp, Artificial Sequence
  chemically synthesized
atacataatatttgtacatact

SEQ ID NO: 1144744 - DNA, 22 bp, Artificial Sequence
  chemically synthesized
ttgatacataatatttgtacat

SEQ ID NO: 1144745 - DNA, 22 bp, Artificial Sequence
  chemically synthesized
attgatacataatatttgtaca

SEQ ID NO: 1144746 - DNA, 22 bp, Artificial Sequence
  chemically synthesized
tataagtatgtacaaatattat

SEQ ID NO: 1144747 - DNA, 22 bp, Artificial Sequence
  chemically synthesized
agtttattgatacataatattt

SEQ ID NO: 1144748 - DNA, 22 bp, Artificial Sequence
  chemically synthesized
taagtatgtacaaatattatgt

SEQ ID NO: 1144749 - DNA, 22 bp, Artificial Sequence
  chemically synthesized
aagtttattgatacataatatt

SEQ ID NO: 1144750 - DNA, 22 bp, Artificial Sequence
  chemically synthesized
taagtttattgatacataatat

SEQ ID NO: 1144751 - DNA, 22 bp, Artificial Sequence
  chemically synthesized
ttaagtttattgatacataata

SEQ ID NO: 1144752 - DNA, 22 bp, Artificial Sequence
  chemically synthesized
caaaaaatttttaagtttattg

SEQ ID NO: 1144753 - DNA, 22 bp, Artificial Sequence
  chemically synthesized
acaaaaaatttttaagtttatt

SEQ ID NO: 1144754 - DNA, 22 bp, Artificial Sequence
  chemically synthesized
tgtatcaataaacttaaaaatt

SEQ ID NO: 1144755 - DNA, 22 bp, Artificial Sequence
  chemically synthesized
atacatttacaaaaaattttta

SEQ ID NO: 1144756 - DNA, 22 bp, Artificial Sequence
  chemically synthesized
aaaaattttttgtaaatgtatt

SEQ ID NO: 1144757 - DNA, 22 bp, Artificial Sequence
  chemically synthesized
aaaattttttgtaaatgtatta

SEQ ID NO: 1144758 - DNA, 22 bp, Artificial Sequence
  chemically synthesized
tgaatgcaagtgttaatacatt

SEQ ID NO: 1144759 - DNA, 22 bp, Artificial Sequence
  chemically synthesized
atgaatgcaagtgttaatacat

SEQ ID NO: 1144760 - DNA, 22 bp, Artificial Sequence
  chemically synthesized
tatgaatgcaagtgttaataca

SEQ ID NO: 1144761 - DNA, 22 bp, Artificial Sequence
  chemically synthesized
tttatgaatgcaagtgttaata

SEQ ID NO: 1144762 - DNA, 22 bp, Artificial Sequence
  chemically synthesized
tttgtaaatgtattaacacttg

SEQ ID NO: 1144763 - DNA, 22 bp, Artificial Sequence
  chemically synthesized
ttgtaaatgtattaacacttgc

SEQ ID NO: 1144764 - DNA, 22 bp, Artificial Sequence
  chemically synthesized
tgtaaatgtattaacacttgca

SEQ ID NO: 1144765 - DNA, 22 bp, Artificial Sequence
  chemically synthesized
gtaaatgtattaacacttgcat

SEQ ID NO: 1144766 - DNA, 22 bp, Artificial Sequence
  chemically synthesized
taaatgtattaacacttgcatt

SEQ ID NO: 1144767 - DNA, 22 bp, Artificial Sequence
  chemically synthesized
acacttgcattcataaagaata

SEQ ID NO: 1144768 - DNA, 22 bp, Artificial Sequence
  chemically synthesized
gcattcataaagaatattattg

SEQ ID NO: 1144769 - DNA, 22 bp, Artificial Sequence
  chemically synthesized
cattcataaagaatattattgg

SEQ ID NO: 1144770 - DNA, 22 bp, Artificial Sequence
  chemically synthesized
ataaagaatattattggccggg

SEQ ID NO: 1144771 - DNA, 22 bp, Artificial Sequence
  chemically synthesized
ttggccgggtggccgggcgtgg

SEQ ID NO: 1144772 - DNA, 22 bp, Artificial Sequence
  chemically synthesized
caggcgtgagccaccacgcccg

SEQ ID NO: 1144773 - DNA, 22 bp, Artificial Sequence
  chemically synthesized
gccgggtggccgggcgtggtgg

SEQ ID NO: 1144774 - DNA, 22 bp, Artificial Sequence
  chemically synthesized
ggattacaggcgtgagccacca

SEQ ID NO: 1144775 - DNA, 22 bp, Artificial Sequence
  chemically synthesized
ccaaagtgctgggattacaggc

SEQ ID NO: 1144776 - DNA, 22 bp, Artificial Sequence
  chemically synthesized
ggcctcccaaagtgctgggatt

SEQ ID NO: 1144777 - DNA, 22 bp, Artificial Sequence
  chemically synthesized
acgcctgtaatcccagcacttt

SEQ ID NO: 1144778 - DNA, 22 bp, Artificial Sequence
  chemically synthesized
taatcccagcactttgggaggc

SEQ ID NO: 1144779 - DNA, 22 bp, Artificial Sequence
  chemically synthesized
gtgatccgccagcctcggcctc

SEQ ID NO: 1144780 - DNA, 22 bp, Artificial Sequence
  chemically synthesized
acctcgtgatccgccagcctcg

SEQ ID NO: 1144781 - DNA, 22 bp, Artificial Sequence
  chemically synthesized
ctgacctcgtgatccgccagcc

SEQ ID NO: 1144782 - DNA, 22 bp, Artificial Sequence
  chemically synthesized
tgggaggccgaggctggcggat

SEQ ID NO: 1144783 - DNA, 22 bp, Artificial Sequence
  chemically synthesized
gggaggccgaggctggcggatc

SEQ ID NO: 1144784 - DNA, 22 bp, Artificial Sequence
  chemically synthesized
ggaggccgaggctggcggatca

SEQ ID NO: 1144785 - DNA, 22 bp, Artificial Sequence
  chemically synthesized
atctcctgacctcgtgatccgc

SEQ ID NO: 1144786 - DNA, 22 bp, Artificial Sequence
  chemically synthesized
gatctcctgacctcgtgatccg

SEQ ID NO: 1144787 - DNA, 22 bp, Artificial Sequence
  chemically synthesized
gtcttgatctcctgacctcgtg

SEQ ID NO: 1144788 - DNA, 22 bp, Artificial Sequence
  chemically synthesized
gcggatcacgaggtcaggagat

SEQ ID NO: 1144789 - DNA, 22 bp, Artificial Sequence
  chemically synthesized
gccaggttggtcttgatctcct

SEQ ID NO: 1144790 - DNA, 22 bp, Artificial Sequence
  chemically synthesized
tgttagccaggttggtcttgat

SEQ ID NO: 1144791 - DNA, 22 bp, Artificial Sequence
  chemically synthesized
actgtgttagccaggttggtct

SEQ ID NO: 1144792 - DNA, 22 bp, Artificial Sequence
  chemically synthesized
cactgtgttagccaggttggtc

SEQ ID NO: 1144793 - DNA, 22 bp, Artificial Sequence
  chemically synthesized
tagagatgggtttcactgtgtt

SEQ ID NO: 1144794 - DNA, 22 bp, Artificial Sequence
  chemically synthesized
tgtagagatgggtttcactgtg

SEQ ID NO: 1144795 - DNA, 22 bp, Artificial Sequence
  chemically synthesized
ctgtagagatgggtttcactgt

SEQ ID NO: 1144796 - DNA, 22 bp, Artificial Sequence
  chemically synthesized
tctgtagagatgggtttcactg

SEQ ID NO: 1144797 - DNA, 22 bp, Artificial Sequence
  chemically synthesized
gctaacacagtgaaacccatct

SEQ ID NO: 1144798 - DNA, 22 bp, Artificial Sequence
  chemically synthesized
tattttctgtagagatgggttt

SEQ ID NO: 1144799 - DNA, 22 bp, Artificial Sequence
  chemically synthesized
gtattttctgtagagatgggtt

SEQ ID NO: 1144800 - DNA, 22 bp, Artificial Sequence
  chemically synthesized
tgtattttctgtagagatgggt

SEQ ID NO: 1144801 - DNA, 22 bp, Artificial Sequence
  chemically synthesized
ttgtattttctgtagagatggg

SEQ ID NO: 1144802 - DNA, 22 bp, Artificial Sequence
  chemically synthesized
acacagtgaaacccatctctac

SEQ ID NO: 1144803 - DNA, 22 bp, Artificial Sequence
  chemically synthesized
tttgtattttctgtagagatgg

SEQ ID NO: 1144804 - DNA, 22 bp, Artificial Sequence
  chemically synthesized
attttttgtattttctgtagag

SEQ ID NO: 1144805 - DNA, 22 bp, Artificial Sequence
  chemically synthesized
gctaattttttgtattttctgt

SEQ ID NO: 1144806 - DNA, 22 bp, Artificial Sequence
  chemically synthesized
tacagaaaatacaaaaaattag

SEQ ID NO: 1144807 - DNA, 22 bp, Artificial Sequence
  chemically synthesized
ccaccacgcctggctaattttt

SEQ ID NO: 1144808 - DNA, 22 bp, Artificial Sequence
  chemically synthesized
cagaaaatacaaaaaattagcc

SEQ ID NO: 1144809 - DNA, 22 bp, Artificial Sequence
  chemically synthesized
caggcgcctgccaccacgcctg

SEQ ID NO: 1144810 - DNA, 22 bp, Artificial Sequence
  chemically synthesized
ggactgcaggcgcctgccacca

SEQ ID NO: 1144811 - DNA, 22 bp, Artificial Sequence
  chemically synthesized
gccaggcgtggtggcaggcgcc

SEQ ID NO: 1144812 - DNA, 22 bp, Artificial Sequence
  chemically synthesized
ccgagtagctgggactgcaggc

SEQ ID NO: 1144813 - DNA, 22 bp, Artificial Sequence
  chemically synthesized
agactcccgagtagctgggact

SEQ ID NO: 1144814 - DNA, 22 bp, Artificial Sequence
  chemically synthesized
cctcagactcccgagtagctgg

SEQ ID NO: 1144815 - DNA, 22 bp, Artificial Sequence
  chemically synthesized
ctacctcagactcccgagtagc

SEQ ID NO: 1144816 - DNA, 22 bp, Artificial Sequence
  chemically synthesized
tcctacctcagactcccgagta

SEQ ID NO: 1144817 - DNA, 22 bp, Artificial Sequence
  chemically synthesized
cagtcccagctactcgggagtc

SEQ ID NO: 1144818 - DNA, 22 bp, Artificial Sequence
  chemically synthesized
atgccattctcctacctcagac

SEQ ID NO: 1144819 - DNA, 22 bp, Artificial Sequence
  chemically synthesized
ctcgggagtctgaggtaggaga

SEQ ID NO: 1144820 - DNA, 22 bp, Artificial Sequence
  chemically synthesized
gggagtctgaggtaggagaatg

SEQ ID NO: 1144821 - DNA, 22 bp, Artificial Sequence
  chemically synthesized
ccgggttcatgccattctccta

SEQ ID NO: 1144822 - DNA, 22 bp, Artificial Sequence
  chemically synthesized
cctcccgggttcatgccattct

SEQ ID NO: 1144823 - DNA, 22 bp, Artificial Sequence
  chemically synthesized
tgcctcccgggttcatgccatt

SEQ ID NO: 1144824 - DNA, 22 bp, Artificial Sequence
  chemically synthesized
aggtaggagaatggcatgaacc

SEQ ID NO: 1144825 - DNA, 22 bp, Artificial Sequence
  chemically synthesized
taagctctgcctcccgggttca

SEQ ID NO: 1144826 - DNA, 22 bp, Artificial Sequence
  chemically synthesized
actgtaagctctgcctcccggg

SEQ ID NO: 1144827 - DNA, 22 bp, Artificial Sequence
  chemically synthesized
ggctcactgtaagctctgcctc

SEQ ID NO: 1144828 - DNA, 22 bp, Artificial Sequence
  chemically synthesized
gagtgcagtggcgcgatctcgg

SEQ ID NO: 1144829 - DNA, 22 bp, Artificial Sequence
  chemically synthesized
acagtgagccgagatcgcgcca

SEQ ID NO: 1144830 - DNA, 22 bp, Artificial Sequence
  chemically synthesized
cagtgagccgagatcgcgccac

SEQ ID NO: 1144831 - DNA, 22 bp, Artificial Sequence
  chemically synthesized
tcacccaggctggagtgcagtg

SEQ ID NO: 1144832 - DNA, 22 bp, Artificial Sequence
  chemically synthesized
tgtcacccaggctggagtgcag

SEQ ID NO: 1144833 - DNA, 22 bp, Artificial Sequence
  chemically synthesized
ctctgtcacccaggctggagtg

SEQ ID NO: 1144834 - DNA, 22 bp, Artificial Sequence
  chemically synthesized
cactccagcctgggtgacagag

SEQ ID NO: 1144835 - DNA, 22 bp, Artificial Sequence
  chemically synthesized
agacggagtcctgctctgtcac

SEQ ID NO: 1144836 - DNA, 22 bp, Artificial Sequence
  chemically synthesized
gagacggagtcctgctctgtca

SEQ ID NO: 1144837 - DNA, 22 bp, Artificial Sequence
  chemically synthesized
tgagacggagtcctgctctgtc

SEQ ID NO: 1144838 - DNA, 22 bp, Artificial Sequence
  chemically synthesized
ttgagacggagtcctgctctgt

SEQ ID NO: 1144839 - DNA, 22 bp, Artificial Sequence
  chemically synthesized
cagcctgggtgacagagcagga

SEQ ID NO: 1144840 - DNA, 22 bp, Artificial Sequence
  chemically synthesized
tttgagacggagtcctgctctg

SEQ ID NO: 1144841 - DNA, 22 bp, Artificial Sequence
  chemically synthesized
ttttgagacggagtcctgctct

SEQ ID NO: 1144842 - DNA, 22 bp, Artificial Sequence
  chemically synthesized
tttttgagacggagtcctgctc

SEQ ID NO: 1144843 - DNA, 22 bp, Artificial Sequence
  chemically synthesized
ttttttgagacggagtcctgct

SEQ ID NO: 1144844 - DNA, 22 bp, Artificial Sequence
  chemically synthesized
tttttttgagacggagtcctgc

SEQ ID NO: 1144845 - DNA, 22 bp, Artificial Sequence
  chemically synthesized
ttttttttgagacggagtcctg

SEQ ID NO: 1144846 - DNA, 22 bp, Artificial Sequence
  chemically synthesized
tttttttttgagacggagtcct

SEQ ID NO: 1144847 - DNA, 22 bp, Artificial Sequence
  chemically synthesized
ggtgacagagcaggactccgtc

SEQ ID NO: 1144848 - DNA, 22 bp, Artificial Sequence
  chemically synthesized
ttttttttttgagacggagtcc

SEQ ID NO: 1144849 - DNA, 22 bp, Artificial Sequence
  chemically synthesized
tttttttttttgagacggagtc

SEQ ID NO: 1144850 - DNA, 22 bp, Artificial Sequence
  chemically synthesized
ttttttttttttgagacggagt

SEQ ID NO: 1144851 - DNA, 22 bp, Artificial Sequence
  chemically synthesized
tttttttttttttgagacggag

SEQ ID NO: 1144852 - DNA, 22 bp, Artificial Sequence
  chemically synthesized
ttttttttttttttgagacgga

SEQ ID NO: 1144853 - DNA, 22 bp, Artificial Sequence
  chemically synthesized
tttttttttttttttgagacgg

SEQ ID NO: 1144854 - DNA, 22 bp, Artificial Sequence
  chemically synthesized
ttttttttttttttttgagacg

SEQ ID NO: 1144855 - DNA, 22 bp, Artificial Sequence
  chemically synthesized
tttttttttttttttttgagac

SEQ ID NO: 1144856 - DNA, 22 bp, Artificial Sequence
  chemically synthesized
ttttttttttttttttttgaga

SEQ ID NO: 1144857 - DNA, 22 bp, Artificial Sequence
  chemically synthesized
tttttttttttttttttttgag

SEQ ID NO: 1144858 - DNA, 22 bp, Artificial Sequence
  chemically synthesized
ttttttttttttttttttttga

SEQ ID NO: 1144859 - DNA, 22 bp, Artificial Sequence
  chemically synthesized
tttttttttttttttttttttg

SEQ ID NO: 1144860 - DNA, 22 bp, Artificial Sequence
  chemically synthesized
tttttttttttttttttttttt

SEQ ID NO: 1144861 - DNA, 22 bp, Artificial Sequence
  chemically synthesized
tttttttttttttttttttttt

SEQ ID NO: 1144862 - DNA, 22 bp, Artificial Sequence
  chemically synthesized
tttttttttttttttttttttt

SEQ ID NO: 1144863 - DNA, 22 bp, Artificial Sequence
  chemically synthesized
tttttttttttttttttttttt

SEQ ID NO: 1144864 - DNA, 22 bp, Artificial Sequence
  chemically synthesized
tttttttttttttttttttttt

SEQ ID NO: 1144865 - DNA, 22 bp, Artificial Sequence
  chemically synthesized
tttttttttttttttttttttt

SEQ ID NO: 1144866 - DNA, 22 bp, Artificial Sequence
  chemically synthesized
cgtctcaaaaaaaaaaaaaaaa

SEQ ID NO: 1144867 - DNA, 22 bp, Artificial Sequence
  chemically synthesized
tttttttttttttttttttttt

SEQ ID NO: 1144868 - DNA, 22 bp, Artificial Sequence
  chemically synthesized
tttttttttttttttttttttt

SEQ ID NO: 1144869 - DNA, 22 bp, Artificial Sequence
  chemically synthesized
tttttttttttttttttttttt

SEQ ID NO: 1144870 - DNA, 22 bp, Artificial Sequence
  chemically synthesized
aaaaaaaaaaaaaaaaaaaaaa

SEQ ID NO: 1144871 - DNA, 22 bp, Artificial Sequence
  chemically synthesized
gaacaataatattctttttttt

SEQ ID NO: 1144872 - DNA, 22 bp, Artificial Sequence
  chemically synthesized
caggggaaatataagcaagtat

SEQ ID NO: 1144873 - DNA, 22 bp, Artificial Sequence
  chemically synthesized
ttgttccagcatacttgcttat

SEQ ID NO: 1144874 - DNA, 22 bp, Artificial Sequence
  chemically synthesized
ttccagcatacttgcttatatt

SEQ ID NO: 1144875 - DNA, 22 bp, Artificial Sequence
  chemically synthesized
cagcatacttgcttatatttcc

SEQ ID NO: 1144876 - DNA, 22 bp, Artificial Sequence
  chemically synthesized
gcttatatttcccctgtaattt

SEQ ID NO: 1144877 - DNA, 22 bp, Artificial Sequence
  chemically synthesized
cttatatttcccctgtaatttt

SEQ ID NO: 1144878 - DNA, 22 bp, Artificial Sequence
  chemically synthesized
atatttcccctgtaattttgta

SEQ ID NO: 1144879 - DNA, 22 bp, Artificial Sequence
  chemically synthesized
tatttcccctgtaattttgtat

SEQ ID NO: 1144880 - DNA, 22 bp, Artificial Sequence
  chemically synthesized
cccctgtaattttgtatggtgg

SEQ ID NO: 1144881 - DNA, 22 bp, Artificial Sequence
  chemically synthesized
ccctgtaattttgtatggtggg

SEQ ID NO: 1144882 - DNA, 22 bp, Artificial Sequence
  chemically synthesized
taattttgtatggtgggtatta

SEQ ID NO: 1144883 - DNA, 22 bp, Artificial Sequence
  chemically synthesized
aaagataacagtgatcataata

SEQ ID NO: 1144884 - DNA, 22 bp, Artificial Sequence
  chemically synthesized
tgtatggtgggtattatgatca

SEQ ID NO: 1144885 - DNA, 22 bp, Artificial Sequence
  chemically synthesized
gtatggtgggtattatgatcac

SEQ ID NO: 1144886 - DNA, 22 bp, Artificial Sequence
  chemically synthesized
tatggtgggtattatgatcact

SEQ ID NO: 1144887 - DNA, 22 bp, Artificial Sequence
  chemically synthesized
tcaaatgaaactcaaagataac

SEQ ID NO: 1144888 - DNA, 22 bp, Artificial Sequence
  chemically synthesized
tgatcactgttatctttgagtt

SEQ ID NO: 1144889 - DNA, 22 bp, Artificial Sequence
  chemically synthesized
ttatctttgagtttcatttgat

SEQ ID NO: 1144890 - DNA, 22 bp, Artificial Sequence
  chemically synthesized
atgataaaaattatcaaatgaa

SEQ ID NO: 1144891 - DNA, 22 bp, Artificial Sequence
  chemically synthesized
tcatgataaaaattatcaaatg

SEQ ID NO: 1144892 - DNA, 22 bp, Artificial Sequence
  chemically synthesized
tctttgagtttcatttgataat

SEQ ID NO: 1144893 - DNA, 22 bp, Artificial Sequence
  chemically synthesized
tctcatgataaaaattatcaaa

SEQ ID NO: 1144894 - DNA, 22 bp, Artificial Sequence
  chemically synthesized
tgagtttcatttgataattttt

SEQ ID NO: 1144895 - DNA, 22 bp, Artificial Sequence
  chemically synthesized
gagtttcatttgataattttta

SEQ ID NO: 1144896 - DNA, 22 bp, Artificial Sequence
  chemically synthesized
agtttcatttgataatttttat

SEQ ID NO: 1144897 - DNA, 22 bp, Artificial Sequence
  chemically synthesized
catttgataatttttatcatga

SEQ ID NO: 1144898 - DNA, 22 bp, Artificial Sequence
  chemically synthesized
atttgataatttttatcatgag

SEQ ID NO: 1144899 - DNA, 22 bp, Artificial Sequence
  chemically synthesized
aacaataaattctctcatgata

SEQ ID NO: 1144900 - DNA, 22 bp, Artificial Sequence
  chemically synthesized
gataatttttatcatgagagaa

SEQ ID NO: 1144901 - DNA, 22 bp, Artificial Sequence
  chemically synthesized
ataatttttatcatgagagaat

SEQ ID NO: 1144902 - DNA, 22 bp, Artificial Sequence
  chemically synthesized
tgagttgaacaataaattctct

SEQ ID NO: 1144903 - DNA, 22 bp, Artificial Sequence
  chemically synthesized
atgagttgaacaataaattctc

SEQ ID NO: 1144904 - DNA, 22 bp, Artificial Sequence
  chemically synthesized
ttatcatgagagaatttattgt

SEQ ID NO: 1144905 - DNA, 22 bp, Artificial Sequence
  chemically synthesized
tatcatgagagaatttattgtt

SEQ ID NO: 1144906 - DNA, 22 bp, Artificial Sequence
  chemically synthesized
atcatgagagaatttattgttc

SEQ ID NO: 1144907 - DNA, 22 bp, Artificial Sequence
  chemically synthesized
tcatgagagaatttattgttca

SEQ ID NO: 1144908 - DNA, 22 bp, Artificial Sequence
  chemically synthesized
taatttatgagttgaacaataa

SEQ ID NO: 1144909 - DNA, 22 bp, Artificial Sequence
  chemically synthesized
ataatttatgagttgaacaata

SEQ ID NO: 1144910 - DNA, 22 bp, Artificial Sequence
  chemically synthesized
tataatttatgagttgaacaat

SEQ ID NO: 1144911 - DNA, 22 bp, Artificial Sequence
  chemically synthesized
actttataatttatgagttgaa

SEQ ID NO: 1144912 - DNA, 22 bp, Artificial Sequence
  chemically synthesized
tgactttataatttatgagttg

SEQ ID NO: 1144913 - DNA, 22 bp, Artificial Sequence
  chemically synthesized
ttctgactttataatttatgag

SEQ ID NO: 1144914 - DNA, 22 bp, Artificial Sequence
  chemically synthesized
tattctgactttataatttatg

SEQ ID NO: 1144915 - DNA, 22 bp, Artificial Sequence
  chemically synthesized
attgttcaactcataaattata

SEQ ID NO: 1144916 - DNA, 22 bp, Artificial Sequence
  chemically synthesized
ctattctgactttataatttat

SEQ ID NO: 1144917 - DNA, 22 bp, Artificial Sequence
  chemically synthesized
ttgttcaactcataaattataa

SEQ ID NO: 1144918 - DNA, 22 bp, Artificial Sequence
  chemically synthesized
tctattctgactttataattta

SEQ ID NO: 1144919 - DNA, 22 bp, Artificial Sequence
  chemically synthesized
ttcaactcataaattataaagt

SEQ ID NO: 1144920 - DNA, 22 bp, Artificial Sequence
  chemically synthesized
ttttctattctgactttataat

SEQ ID NO: 1144921 - DNA, 22 bp, Artificial Sequence
  chemically synthesized
aactcataaattataaagtcag

SEQ ID NO: 1144922 - DNA, 22 bp, Artificial Sequence
  chemically synthesized
aatctgttttctattctgactt

SEQ ID NO: 1144923 - DNA, 22 bp, Artificial Sequence
  chemically synthesized
ataaattataaagtcagaatag

SEQ ID NO: 1144924 - DNA, 22 bp, Artificial Sequence
  chemically synthesized
ctcaatctgttttctattctga

SEQ ID NO: 1144925 - DNA, 22 bp, Artificial Sequence
  chemically synthesized
gattactcaatctgttttctat

SEQ ID NO: 1144926 - DNA, 22 bp, Artificial Sequence
  chemically synthesized
taaagtcagaatagaaaacaga

SEQ ID NO: 1144927 - DNA, 22 bp, Artificial Sequence
  chemically synthesized
aaagaacacaatgtctggatta

SEQ ID NO: 1144928 - DNA, 22 bp, Artificial Sequence
  chemically synthesized
gaaagaacacaatgtctggatt

SEQ ID NO: 1144929 - DNA, 22 bp, Artificial Sequence
  chemically synthesized
agtaatccagacattgtgttct

SEQ ID NO: 1144930 - DNA, 22 bp, Artificial Sequence
  chemically synthesized
ggtagatttgaaagaacacaat

SEQ ID NO: 1144931 - DNA, 22 bp, Artificial Sequence
  chemically synthesized
gccaatagggtgttaggtagat

SEQ ID NO: 1144932 - DNA, 22 bp, Artificial Sequence
  chemically synthesized
tgttctttcaaatctacctaac

SEQ ID NO: 1144933 - DNA, 22 bp, Artificial Sequence
  chemically synthesized
ggccaatagggtgttaggtaga

SEQ ID NO: 1144934 - DNA, 22 bp, Artificial Sequence
  chemically synthesized
tttcaaatctacctaacaccct

SEQ ID NO: 1144935 - DNA, 22 bp, Artificial Sequence
  chemically synthesized
tcaaatctacctaacaccctat

SEQ ID NO: 1144936 - DNA, 22 bp, Artificial Sequence
  chemically synthesized
caaatctacctaacaccctatt

SEQ ID NO: 1144937 - DNA, 22 bp, Artificial Sequence
  chemically synthesized
aaatctacctaacaccctattg

SEQ ID NO: 1144938 - DNA, 22 bp, Artificial Sequence
  chemically synthesized
taatacatttggccaatagggt

SEQ ID NO: 1144939 - DNA, 22 bp, Artificial Sequence
  chemically synthesized
ttgtaatacatttggccaatag

SEQ ID NO: 1144940 - DNA, 22 bp, Artificial Sequence
  chemically synthesized
cctaacaccctattggccaaat

SEQ ID NO: 1144941 - DNA, 22 bp, Artificial Sequence
  chemically synthesized
acaccctattggccaaatgtat

SEQ ID NO: 1144942 - DNA, 22 bp, Artificial Sequence
  chemically synthesized
atacacggtctgttgtaataca

SEQ ID NO: 1144943 - DNA, 22 bp, Artificial Sequence
  chemically synthesized
ttggccaaatgtattacaacag

SEQ ID NO: 1144944 - DNA, 22 bp, Artificial Sequence
  chemically synthesized
tgttaatacacggtctgttgta

SEQ ID NO: 1144945 - DNA, 22 bp, Artificial Sequence
  chemically synthesized
gccaaatgtattacaacagacc

SEQ ID NO: 1144946 - DNA, 22 bp, Artificial Sequence
  chemically synthesized
atgttaatacacggtctgttgt

SEQ ID NO: 1144947 - DNA, 22 bp, Artificial Sequence
  chemically synthesized
aatttatgttaatacacggtct

SEQ ID NO: 1144948 - DNA, 22 bp, Artificial Sequence
  chemically synthesized
caatttatgttaatacacggtc

SEQ ID NO: 1144949 - DNA, 22 bp, Artificial Sequence
  chemically synthesized
gatttcaatttatgttaataca

SEQ ID NO: 1144950 - DNA, 22 bp, Artificial Sequence
  chemically synthesized
caacagaccgtgtattaacata

SEQ ID NO: 1144951 - DNA, 22 bp, Artificial Sequence
  chemically synthesized
acgctagatttcaatttatgtt

SEQ ID NO: 1144952 - DNA, 22 bp, Artificial Sequence
  chemically synthesized
acataaattgaaatctagcgtt

SEQ ID NO: 1144953 - DNA, 22 bp, Artificial Sequence
  chemically synthesized
taagtatacagttaacgctaga

SEQ ID NO: 1144954 - DNA, 22 bp, Artificial Sequence
  chemically synthesized
aaatctagcgttaactgtatac

SEQ ID NO: 1144955 - DNA, 22 bp, Artificial Sequence
  chemically synthesized
gcgttaactgtatacttacagc

SEQ ID NO: 1144956 - DNA, 22 bp, Artificial Sequence
  chemically synthesized
actgtatacttacagcacattg

SEQ ID NO: 1144957 - DNA, 22 bp, Artificial Sequence
  chemically synthesized
aacatccaaagccaatgtgctg

SEQ ID NO: 1144958 - DNA, 22 bp, Artificial Sequence
  chemically synthesized
gaacatccaaagccaatgtgct

SEQ ID NO: 1144959 - DNA, 22 bp, Artificial Sequence
  chemically synthesized
tatacttacagcacattggctt

SEQ ID NO: 1144960 - DNA, 22 bp, Artificial Sequence
  chemically synthesized
atgaaatttgaacatccaaagc

SEQ ID NO: 1144961 - DNA, 22 bp, Artificial Sequence
  chemically synthesized
acagcacattggctttggatgt

SEQ ID NO: 1144962 - DNA, 22 bp, Artificial Sequence
  chemically synthesized
cagcacattggctttggatgtt

SEQ ID NO: 1144963 - DNA, 22 bp, Artificial Sequence
  chemically synthesized
taatgaaatttgaacatccaaa

SEQ ID NO: 1144964 - DNA, 22 bp, Artificial Sequence
  chemically synthesized
aatattctaatgaaatttgaac

SEQ ID NO: 1144965 - DNA, 22 bp, Artificial Sequence
  chemically synthesized
gctttggatgttcaaatttcat

SEQ ID NO: 1144966 - DNA, 22 bp, Artificial Sequence
  chemically synthesized
tggatgttcaaatttcattaga

SEQ ID NO: 1144967 - DNA, 22 bp, Artificial Sequence
  chemically synthesized
ggatgttcaaatttcattagaa

SEQ ID NO: 1144968 - DNA, 22 bp, Artificial Sequence
  chemically synthesized
gatgttcaaatttcattagaat

SEQ ID NO: 1144969 - DNA, 22 bp, Artificial Sequence
  chemically synthesized
aaatttcattagaatattcaac

SEQ ID NO: 1144970 - DNA, 22 bp, Artificial Sequence
  chemically synthesized
cattagaatattcaacatttat

SEQ ID NO: 1144971 - DNA, 22 bp, Artificial Sequence
  chemically synthesized
tatcaagtataaataaatgttg

SEQ ID NO: 1144972 - DNA, 22 bp, Artificial Sequence
  chemically synthesized
attagaatattcaacatttatt

SEQ ID NO: 1144973 - DNA, 22 bp, Artificial Sequence
  chemically synthesized
gaatattcaacatttatttata

SEQ ID NO: 1144974 - DNA, 22 bp, Artificial Sequence
  chemically synthesized
cacattgtatcaagtataaata

SEQ ID NO: 1144975 - DNA, 22 bp, Artificial Sequence
  chemically synthesized
aactgcacattgtatcaagtat

SEQ ID NO: 1144976 - DNA, 22 bp, Artificial Sequence
  chemically synthesized
aacatttatttatacttgatac

SEQ ID NO: 1144977 - DNA, 22 bp, Artificial Sequence
  chemically synthesized
caactgcacattgtatcaagta

SEQ ID NO: 1144978 - DNA, 22 bp, Artificial Sequence
  chemically synthesized
tcaactgcacattgtatcaagt

SEQ ID NO: 1144979 - DNA, 22 bp, Artificial Sequence
  chemically synthesized
ttcaactgcacattgtatcaag

SEQ ID NO: 1144980 - DNA, 22 bp, Artificial Sequence
  chemically synthesized
tttcaactgcacattgtatcaa

SEQ ID NO: 1144981 - DNA, 22 bp, Artificial Sequence
  chemically synthesized
ttttttcaactgcacattgtat

SEQ ID NO: 1144982 - DNA, 22 bp, Artificial Sequence
  chemically synthesized
atttatacttgatacaatgtgc

SEQ ID NO: 1144983 - DNA, 22 bp, Artificial Sequence
  chemically synthesized
tttatacttgatacaatgtgca

SEQ ID NO: 1144984 - DNA, 22 bp, Artificial Sequence
  chemically synthesized
atacttgatacaatgtgcagtt

SEQ ID NO: 1144985 - DNA, 22 bp, Artificial Sequence
  chemically synthesized
tacttgatacaatgtgcagttg

SEQ ID NO: 1144986 - DNA, 22 bp, Artificial Sequence
  chemically synthesized
gatacaatgtgcagttgaaaaa

SEQ ID NO: 1144987 - DNA, 22 bp, Artificial Sequence
  chemically synthesized
atacaatgtgcagttgaaaaaa

SEQ ID NO: 1144988 - DNA, 22 bp, Artificial Sequence
  chemically synthesized
atatgtgcattgttttttcaac

SEQ ID NO: 1144989 - DNA, 22 bp, Artificial Sequence
  chemically synthesized
gatatgtgcattgttttttcaa

SEQ ID NO: 1144990 - DNA, 22 bp, Artificial Sequence
  chemically synthesized
tgatatgtgcattgttttttca

SEQ ID NO: 1144991 - DNA, 22 bp, Artificial Sequence
  chemically synthesized
atcagctttgatatgtgcattg

SEQ ID NO: 1144992 - DNA, 22 bp, Artificial Sequence
  chemically synthesized
gatcagctttgatatgtgcatt

SEQ ID NO: 1144993 - DNA, 22 bp, Artificial Sequence
  chemically synthesized
tgatcagctttgatatgtgcat

SEQ ID NO: 1144994 - DNA, 22 bp, Artificial Sequence
  chemically synthesized
aaaaaacaatgcacatatcaaa

SEQ ID NO: 1144995 - DNA, 22 bp, Artificial Sequence
  chemically synthesized
agtatgttttgatcagctttga

SEQ ID NO: 1144996 - DNA, 22 bp, Artificial Sequence
  chemically synthesized
gagtatgttttgatcagctttg

SEQ ID NO: 1144997 - DNA, 22 bp, Artificial Sequence
  chemically synthesized
tgagtatgttttgatcagcttt

SEQ ID NO: 1144998 - DNA, 22 bp, Artificial Sequence
  chemically synthesized
ttgagtatgttttgatcagctt

SEQ ID NO: 1144999 - DNA, 22 bp, Artificial Sequence
  chemically synthesized
gaaaacttttgagtatgttttg

SEQ ID NO: 1145000 - DNA, 22 bp, Artificial Sequence
  chemically synthesized
ttagaaaacttttgagtatgtt

SEQ ID NO: 1145001 - DNA, 22 bp, Artificial Sequence
  chemically synthesized
agttattagaaaacttttgagt

SEQ ID NO: 1145002 - DNA, 22 bp, Artificial Sequence
  chemically synthesized
atcaaaacatactcaaaagttt

SEQ ID NO: 1145003 - DNA, 22 bp, Artificial Sequence
  chemically synthesized
aaaagttttctaataactgaat

SEQ ID NO: 1145004 - DNA, 22 bp, Artificial Sequence
  chemically synthesized
aatataaaatggcacatgattc

SEQ ID NO: 1145005 - DNA, 22 bp, Artificial Sequence
  chemically synthesized
aaatataaaatggcacatgatt

SEQ ID NO: 1145006 - DNA, 22 bp, Artificial Sequence
  chemically synthesized
tctaataactgaatcatgtgcc

SEQ ID NO: 1145007 - DNA, 22 bp, Artificial Sequence
  chemically synthesized
ctaataactgaatcatgtgcca

SEQ ID NO: 1145008 - DNA, 22 bp, Artificial Sequence
  chemically synthesized
taataactgaatcatgtgccat

SEQ ID NO: 1145009 - DNA, 22 bp, Artificial Sequence
  chemically synthesized
cttaaatataaaatggcacatg

SEQ ID NO: 1145010 - DNA, 22 bp, Artificial Sequence
  chemically synthesized
acttaaatataaaatggcacat

SEQ ID NO: 1145011 - DNA, 22 bp, Artificial Sequence
  chemically synthesized
ataactgaatcatgtgccattt

SEQ ID NO: 1145012 - DNA, 22 bp, Artificial Sequence
  chemically synthesized
tttacttaaatataaaatggca

SEQ ID NO: 1145013 - DNA, 22 bp, Artificial Sequence
  chemically synthesized
atttacttaaatataaaatggc

SEQ ID NO: 1145014 - DNA, 22 bp, Artificial Sequence
  chemically synthesized
tatttacttaaatataaaatgg

SEQ ID NO: 1145015 - DNA, 22 bp, Artificial Sequence
  chemically synthesized
aatcatgtgccattttatattt

SEQ ID NO: 1145016 - DNA, 22 bp, Artificial Sequence
  chemically synthesized
ttttatttacttaaatataaaa

SEQ ID NO: 1145017 - DNA, 22 bp, Artificial Sequence
  chemically synthesized
attttatttacttaaatataaa

SEQ ID NO: 1145018 - DNA, 22 bp, Artificial Sequence
  chemically synthesized
tattttatttacttaaatataa

SEQ ID NO: 1145019 - DNA, 22 bp, Artificial Sequence
  chemically synthesized
ttattttatttacttaaatata

SEQ ID NO: 1145020 - DNA, 22 bp, Artificial Sequence
  chemically synthesized
tttattttatttacttaaatat

SEQ ID NO: 1145021 - DNA, 22 bp, Artificial Sequence
  chemically synthesized
gattttttattttatttactta

SEQ ID NO: 1145022 - DNA, 22 bp, Artificial Sequence
  chemically synthesized
tatatttaagtaaataaaataa

SEQ ID NO: 1145023 - DNA, 22 bp, Artificial Sequence
  chemically synthesized
atatttaagtaaataaaataaa

SEQ ID NO: 1145024 - DNA, 22 bp, Artificial Sequence
  chemically synthesized
tatttaagtaaataaaataaaa

SEQ ID NO: 1145025 - DNA, 22 bp, Artificial Sequence
  chemically synthesized
aggaactggattttttatttta

SEQ ID NO: 1145026 - DNA, 22 bp, Artificial Sequence
  chemically synthesized
gaggaactggattttttatttt

SEQ ID NO: 1145027 - DNA, 22 bp, Artificial Sequence
  chemically synthesized
aagtaaataaaataaaaaatcc

SEQ ID NO: 1145028 - DNA, 22 bp, Artificial Sequence
  chemically synthesized
agtaaataaaataaaaaatcca

SEQ ID NO: 1145029 - DNA, 22 bp, Artificial Sequence
  chemically synthesized
gtatgcttgaggaactggattt

SEQ ID NO: 1145030 - DNA, 22 bp, Artificial Sequence
  chemically synthesized
tgactggtatgcttgaggaact

SEQ ID NO: 1145031 - DNA, 22 bp, Artificial Sequence
  chemically synthesized
aattgtgactggtatgcttgag

SEQ ID NO: 1145032 - DNA, 22 bp, Artificial Sequence
  chemically synthesized
gaattgtgactggtatgcttga

SEQ ID NO: 1145033 - DNA, 22 bp, Artificial Sequence
  chemically synthesized
agcacttgaattgtgactggta

SEQ ID NO: 1145034 - DNA, 22 bp, Artificial Sequence
  chemically synthesized
gagcacttgaattgtgactggt

SEQ ID NO: 1145035 - DNA, 22 bp, Artificial Sequence
  chemically synthesized
tgagcacttgaattgtgactgg

SEQ ID NO: 1145036 - DNA, 22 bp, Artificial Sequence
  chemically synthesized
ctcaagcataccagtcacaatt

SEQ ID NO: 1145037 - DNA, 22 bp, Artificial Sequence
  chemically synthesized
ttttgagcacttgaattgtgac

SEQ ID NO: 1145038 - DNA, 22 bp, Artificial Sequence
  chemically synthesized
aagcataccagtcacaattcaa

SEQ ID NO: 1145039 - DNA, 22 bp, Artificial Sequence
  chemically synthesized
gctattttgagcacttgaattg

SEQ ID NO: 1145040 - DNA, 22 bp, Artificial Sequence
  chemically synthesized
ggctattttgagcacttgaatt

SEQ ID NO: 1145041 - DNA, 22 bp, Artificial Sequence
  chemically synthesized
tggctattttgagcacttgaat

SEQ ID NO: 1145042 - DNA, 22 bp, Artificial Sequence
  chemically synthesized
tacacctttggctattttgagc

SEQ ID NO: 1145043 - DNA, 22 bp, Artificial Sequence
  chemically synthesized
ctatacacctttggctattttg

SEQ ID NO: 1145044 - DNA, 22 bp, Artificial Sequence
  chemically synthesized
aagtgctcaaaatagccaaagg

SEQ ID NO: 1145045 - DNA, 22 bp, Artificial Sequence
  chemically synthesized
aaaatagccaaaggtgtatagc

SEQ ID NO: 1145046 - DNA, 22 bp, Artificial Sequence
  chemically synthesized
agtaaggaagttgctatacacc

SEQ ID NO: 1145047 - DNA, 22 bp, Artificial Sequence
  chemically synthesized
ttcagtaaggaagttgctatac

SEQ ID NO: 1145048 - DNA, 22 bp, Artificial Sequence
  chemically synthesized
gaacgacactgttcagtaagga

SEQ ID NO: 1145049 - DNA, 22 bp, Artificial Sequence
  chemically synthesized
tagaacgacactgttcagtaag

SEQ ID NO: 1145050 - DNA, 22 bp, Artificial Sequence
  chemically synthesized
ctagaacgacactgttcagtaa

SEQ ID NO: 1145051 - DNA, 22 bp, Artificial Sequence
  chemically synthesized
tctagaacgacactgttcagta

SEQ ID NO: 1145052 - DNA, 22 bp, Artificial Sequence
  chemically synthesized
ttctagaacgacactgttcagt

SEQ ID NO: 1145053 - DNA, 22 bp, Artificial Sequence
  chemically synthesized
ttttctagaacgacactgttca

SEQ ID NO: 1145054 - DNA, 22 bp, Artificial Sequence
  chemically synthesized
cttttctagaacgacactgttc

SEQ ID NO: 1145055 - DNA, 22 bp, Artificial Sequence
  chemically synthesized
tcttttctagaacgacactgtt

SEQ ID NO: 1145056 - DNA, 22 bp, Artificial Sequence
  chemically synthesized
ttcttttctagaacgacactgt

SEQ ID NO: 1145057 - DNA, 22 bp, Artificial Sequence
  chemically synthesized
tttcttttctagaacgacactg

SEQ ID NO: 1145058 - DNA, 22 bp, Artificial Sequence
  chemically synthesized
ttttcttttctagaacgacact

SEQ ID NO: 1145059 - DNA, 22 bp, Artificial Sequence
  chemically synthesized
ccttactgaacagtgtcgttct

SEQ ID NO: 1145060 - DNA, 22 bp, Artificial Sequence
  chemically synthesized
cttactgaacagtgtcgttcta

SEQ ID NO: 1145061 - DNA, 22 bp, Artificial Sequence
  chemically synthesized
actgaacagtgtcgttctagaa

SEQ ID NO: 1145062 - DNA, 22 bp, Artificial Sequence
  chemically synthesized
ctgaacagtgtcgttctagaaa

SEQ ID NO: 1145063 - DNA, 22 bp, Artificial Sequence
  chemically synthesized
aacagtgtcgttctagaaaaga

SEQ ID NO: 1145064 - DNA, 22 bp, Artificial Sequence
  chemically synthesized
gtatataaaatttttttctttt

SEQ ID NO: 1145065 - DNA, 22 bp, Artificial Sequence
  chemically synthesized
cattagtatataaaattttttt

SEQ ID NO: 1145066 - DNA, 22 bp, Artificial Sequence
  chemically synthesized
tagaaaagaaaaaaattttata

SEQ ID NO: 1145067 - DNA, 22 bp, Artificial Sequence
  chemically synthesized
gattgcattagtatataaaatt

SEQ ID NO: 1145068 - DNA, 22 bp, Artificial Sequence
  chemically synthesized
gaaaagaaaaaaattttatata

SEQ ID NO: 1145069 - DNA, 22 bp, Artificial Sequence
  chemically synthesized
tcacactcgattgcattagtat

SEQ ID NO: 1145070 - DNA, 22 bp, Artificial Sequence
  chemically synthesized
acacctgtcacactcgattgca

SEQ ID NO: 1145071 - DNA, 22 bp, Artificial Sequence
  chemically synthesized
tatatactaatgcaatcgagtg

SEQ ID NO: 1145072 - DNA, 22 bp, Artificial Sequence
  chemically synthesized
atatactaatgcaatcgagtgt

SEQ ID NO: 1145073 - DNA, 22 bp, Artificial Sequence
  chemically synthesized
tatactaatgcaatcgagtgtg

SEQ ID NO: 1145074 - DNA, 22 bp, Artificial Sequence
  chemically synthesized
atgcaatcgagtgtgacaggtg

SEQ ID NO: 1145075 - DNA, 22 bp, Artificial Sequence
  chemically synthesized
tataagcagtatatatatatta

SEQ ID NO: 1145076 - DNA, 22 bp, Artificial Sequence
  chemically synthesized
atataagcagtatatatatatt

SEQ ID NO: 1145077 - DNA, 22 bp, Artificial Sequence
  chemically synthesized
atatatatatactgcttatata

SEQ ID NO: 1145078 - DNA, 22 bp, Artificial Sequence
  chemically synthesized
tatatgtatatagtttatataa

SEQ ID NO: 1145079 - DNA, 22 bp, Artificial Sequence
  chemically synthesized
atatatgtatatagtttatata

SEQ ID NO: 1145080 - DNA, 22 bp, Artificial Sequence
  chemically synthesized
cttatataaactatatacatat

SEQ ID NO: 1145081 - DNA, 22 bp, Artificial Sequence
  chemically synthesized
atataaactatatacatatata

SEQ ID NO: 1145082 - DNA, 22 bp, Artificial Sequence
  chemically synthesized
tataaactatatacatatataa

SEQ ID NO: 1145083 - DNA, 22 bp, Artificial Sequence
  chemically synthesized
gaagagaatggtttatatatgt

SEQ ID NO: 1145084 - DNA, 22 bp, Artificial Sequence
  chemically synthesized
tagaagagaatggtttatatat

SEQ ID NO: 1145085 - DNA, 22 bp, Artificial Sequence
  chemically synthesized
ttctagaagagaatggtttata

SEQ ID NO: 1145086 - DNA, 22 bp, Artificial Sequence
  chemically synthesized
tatacatatataaaccattctc

SEQ ID NO: 1145087 - DNA, 22 bp, Artificial Sequence
  chemically synthesized
gaacaacactgttctagaagag

SEQ ID NO: 1145088 - DNA, 22 bp, Artificial Sequence
  chemically synthesized
tagaacaacactgttctagaag

SEQ ID NO: 1145089 - DNA, 22 bp, Artificial Sequence
  chemically synthesized
ctagaacaacactgttctagaa

SEQ ID NO: 1145090 - DNA, 22 bp, Artificial Sequence
  chemically synthesized
ttctagaacaacactgttctag

SEQ ID NO: 1145091 - DNA, 22 bp, Artificial Sequence
  chemically synthesized
tcttctagaacaacactgttct

SEQ ID NO: 1145092 - DNA, 22 bp, Artificial Sequence
  chemically synthesized
ctcttctagaacaacactgttc

SEQ ID NO: 1145093 - DNA, 22 bp, Artificial Sequence
  chemically synthesized
tctcttctagaacaacactgtt

SEQ ID NO: 1145094 - DNA, 22 bp, Artificial Sequence
  chemically synthesized
ttctcttctagaacaacactgt

SEQ ID NO: 1145095 - DNA, 22 bp, Artificial Sequence
  chemically synthesized
tcttctagaacagtgttgttct

SEQ ID NO: 1145096 - DNA, 22 bp, Artificial Sequence
  chemically synthesized
ttctagaacagtgttgttctag

SEQ ID NO: 1145097 - DNA, 22 bp, Artificial Sequence
  chemically synthesized
ctagaacagtgttgttctagaa

SEQ ID NO: 1145098 - DNA, 22 bp, Artificial Sequence
  chemically synthesized
tagaacagtgttgttctagaag

SEQ ID NO: 1145099 - DNA, 22 bp, Artificial Sequence
  chemically synthesized
gaacagtgttgttctagaagag

SEQ ID NO: 1145100 - DNA, 22 bp, Artificial Sequence
  chemically synthesized
gtacataaatatttttctcttc

SEQ ID NO: 1145101 - DNA, 22 bp, Artificial Sequence
  chemically synthesized
cattagtacataaatatttttc

SEQ ID NO: 1145102 - DNA, 22 bp, Artificial Sequence
  chemically synthesized
ttctagaagagaaaaatattta

SEQ ID NO: 1145103 - DNA, 22 bp, Artificial Sequence
  chemically synthesized
tagaagagaaaaatatttatgt

SEQ ID NO: 1145104 - DNA, 22 bp, Artificial Sequence
  chemically synthesized
aattgcattagtacataaatat

SEQ ID NO: 1145105 - DNA, 22 bp, Artificial Sequence
  chemically synthesized
gaagagaaaaatatttatgtac

SEQ ID NO: 1145106 - DNA, 22 bp, Artificial Sequence
  chemically synthesized
tcccactcaattgcattagtac

SEQ ID NO: 1145107 - DNA, 22 bp, Artificial Sequence
  chemically synthesized
gcacctgtcccactcaattgca

SEQ ID NO: 1145108 - DNA, 22 bp, Artificial Sequence
  chemically synthesized
agcacctgtcccactcaattgc

SEQ ID NO: 1145109 - DNA, 22 bp, Artificial Sequence
  chemically synthesized
tagcacctgtcccactcaattg

SEQ ID NO: 1145110 - DNA, 22 bp, Artificial Sequence
  chemically synthesized
atgtactaatgcaattgagtgg

SEQ ID NO: 1145111 - DNA, 22 bp, Artificial Sequence
  chemically synthesized
tgtactaatgcaattgagtggg

SEQ ID NO: 1145112 - DNA, 22 bp, Artificial Sequence
  chemically synthesized
ttttagcacctgtcccactcaa

SEQ ID NO: 1145113 - DNA, 22 bp, Artificial Sequence
  chemically synthesized
attttagcacctgtcccactca

SEQ ID NO: 1145114 - DNA, 22 bp, Artificial Sequence
  chemically synthesized
tttattttagcacctgtcccac

SEQ ID NO: 1145115 - DNA, 22 bp, Artificial Sequence
  chemically synthesized
atttattttagcacctgtccca

SEQ ID NO: 1145116 - DNA, 22 bp, Artificial Sequence
  chemically synthesized
atgcaattgagtgggacaggtg

SEQ ID NO: 1145117 - DNA, 22 bp, Artificial Sequence
  chemically synthesized
agtgggacaggtgctaaaataa

SEQ ID NO: 1145118 - DNA, 22 bp, Artificial Sequence
  chemically synthesized
aaataaataaatatatatgttt

SEQ ID NO: 1145119 - DNA, 22 bp, Artificial Sequence
  chemically synthesized
caagtacaaatatatataatat

SEQ ID NO: 1145120 - DNA, 22 bp, Artificial Sequence
  chemically synthesized
acaagtacaaatatatataata

SEQ ID NO: 1145121 - DNA, 22 bp, Artificial Sequence
  chemically synthesized
aatttacaagtacaaatatata

SEQ ID NO: 1145122 - DNA, 22 bp, Artificial Sequence
  chemically synthesized
atattatatatatttgtacttg

SEQ ID NO: 1145123 - DNA, 22 bp, Artificial Sequence
  chemically synthesized
tattatatatatttgtacttgt

SEQ ID NO: 1145124 - DNA, 22 bp, Artificial Sequence
  chemically synthesized
tatatatttgtacttgtaaatt

SEQ ID NO: 1145125 - DNA, 22 bp, Artificial Sequence
  chemically synthesized
catgaatgagttaaatttacaa

SEQ ID NO: 1145126 - DNA, 22 bp, Artificial Sequence
  chemically synthesized
gcatgaatgagttaaatttaca

SEQ ID NO: 1145127 - DNA, 22 bp, Artificial Sequence
  chemically synthesized
gtacttgtaaatttaactcatt

SEQ ID NO: 1145128 - DNA, 22 bp, Artificial Sequence
  chemically synthesized
tacttgtaaatttaactcattc

SEQ ID NO: 1145129 - DNA, 22 bp, Artificial Sequence
  chemically synthesized
gtaaatttaactcattcatgca

SEQ ID NO: 1145130 - DNA, 22 bp, Artificial Sequence
  chemically synthesized
taaatttaactcattcatgcaa

SEQ ID NO: 1145131 - DNA, 22 bp, Artificial Sequence
  chemically synthesized
aactcattcatgcaaatgctat

SEQ ID NO: 1145132 - DNA, 22 bp, Artificial Sequence
  chemically synthesized
actcattcatgcaaatgctata

SEQ ID NO: 1145133 - DNA, 22 bp, Artificial Sequence
  chemically synthesized
attcatgcaaatgctatatcta

SEQ ID NO: 1145134 - DNA, 22 bp, Artificial Sequence
  chemically synthesized
atatatatatgaatagatatag

SEQ ID NO: 1145135 - DNA, 22 bp, Artificial Sequence
  chemically synthesized
atgcaaatgctatatctattca

SEQ ID NO: 1145136 - DNA, 22 bp, Artificial Sequence
  chemically synthesized
ttcatatatatatgaatagata

SEQ ID NO: 1145137 - DNA, 22 bp, Artificial Sequence
  chemically synthesized
tatctattcatatatatatgaa

SEQ ID NO: 1145138 - DNA, 22 bp, Artificial Sequence
  chemically synthesized
ttcatatatatatgaatagata

SEQ ID NO: 1145139 - DNA, 22 bp, Artificial Sequence
  chemically synthesized
tataaaatgcaatatctattca

SEQ ID NO: 1145140 - DNA, 22 bp, Artificial Sequence
  chemically synthesized
atatatatatgaatagatattg

SEQ ID NO: 1145141 - DNA, 22 bp, Artificial Sequence
  chemically synthesized
tctgtataaaatgcaatatcta

SEQ ID NO: 1145142 - DNA, 22 bp, Artificial Sequence
  chemically synthesized
tctatctgtataaaatgcaata

SEQ ID NO: 1145143 - DNA, 22 bp, Artificial Sequence
  chemically synthesized
atgcaaatactatctatctgta

SEQ ID NO: 1145144 - DNA, 22 bp, Artificial Sequence
  chemically synthesized
attcatgcaaatactatctatc

SEQ ID NO: 1145145 - DNA, 22 bp, Artificial Sequence
  chemically synthesized
cattttatacagatagatagta

SEQ ID NO: 1145146 - DNA, 22 bp, Artificial Sequence
  chemically synthesized
actcattcatgcaaatactatc

SEQ ID NO: 1145147 - DNA, 22 bp, Artificial Sequence
  chemically synthesized
aactcattcatgcaaatactat

SEQ ID NO: 1145148 - DNA, 22 bp, Artificial Sequence
  chemically synthesized
tatacagatagatagtatttgc

SEQ ID NO: 1145149 - DNA, 22 bp, Artificial Sequence
  chemically synthesized
atacagatagatagtatttgca

SEQ ID NO: 1145150 - DNA, 22 bp, Artificial Sequence
  chemically synthesized
tacagatagatagtatttgcat

SEQ ID NO: 1145151 - DNA, 22 bp, Artificial Sequence
  chemically synthesized
taaatttaactcattcatgcaa

SEQ ID NO: 1145152 - DNA, 22 bp, Artificial Sequence
  chemically synthesized
gtacctgtaaatttaactcatt

SEQ ID NO: 1145153 - DNA, 22 bp, Artificial Sequence
  chemically synthesized
gcatgaatgagttaaatttaca

SEQ ID NO: 1145154 - DNA, 22 bp, Artificial Sequence
  chemically synthesized
catgaatgagttaaatttacag

SEQ ID NO: 1145155 - DNA, 22 bp, Artificial Sequence
  chemically synthesized
tgtaacacagtaatgtattcgt

SEQ ID NO: 1145156 - DNA, 22 bp, Artificial Sequence
  chemically synthesized
aatttacaggtacgaatacatt

SEQ ID NO: 1145157 - DNA, 22 bp, Artificial Sequence
  chemically synthesized
acaggtacgaatacattactgt

SEQ ID NO: 1145158 - DNA, 22 bp, Artificial Sequence
  chemically synthesized
caggtacgaatacattactgtg

SEQ ID NO: 1145159 - DNA, 22 bp, Artificial Sequence
  chemically synthesized
ctgtgttacataggtttctgta

SEQ ID NO: 1145160 - DNA, 22 bp, Artificial Sequence
  chemically synthesized
tgttacataggtttctgtattc

SEQ ID NO: 1145161 - DNA, 22 bp, Artificial Sequence
  chemically synthesized
atcagcaacgggggaatacaga

SEQ ID NO: 1145162 - DNA, 22 bp, Artificial Sequence
  chemically synthesized
ctaatcagcaacgggggaatac

SEQ ID NO: 1145163 - DNA, 22 bp, Artificial Sequence
  chemically synthesized
cataggtttctgtattcccccg

SEQ ID NO: 1145164 - DNA, 22 bp, Artificial Sequence
  chemically synthesized
actaatcagcaacgggggaata

SEQ ID NO: 1145165 - DNA, 22 bp, Artificial Sequence
  chemically synthesized
gtttactaatcagcaacggggg

SEQ ID NO: 1145166 - DNA, 22 bp, Artificial Sequence
  chemically synthesized
ggtttactaatcagcaacgggg

SEQ ID NO: 1145167 - DNA, 22 bp, Artificial Sequence
  chemically synthesized
tggtttactaatcagcaacggg

SEQ ID NO: 1145168 - DNA, 22 bp, Artificial Sequence
  chemically synthesized
ctgtattcccccgttgctgatt

SEQ ID NO: 1145169 - DNA, 22 bp, Artificial Sequence
  chemically synthesized
tgtattcccccgttgctgatta

SEQ ID NO: 1145170 - DNA, 22 bp, Artificial Sequence
  chemically synthesized
agttttggtttactaatcagca

SEQ ID NO: 1145171 - DNA, 22 bp, Artificial Sequence
  chemically synthesized
tattcccccgttgctgattagt

SEQ ID NO: 1145172 - DNA, 22 bp, Artificial Sequence
  chemically synthesized
cagttttggtttactaatcagc

SEQ ID NO: 1145173 - DNA, 22 bp, Artificial Sequence
  chemically synthesized
tcagttttggtttactaatcag

SEQ ID NO: 1145174 - DNA, 22 bp, Artificial Sequence
  chemically synthesized
ttcagttttggtttactaatca

SEQ ID NO: 1145175 - DNA, 22 bp, Artificial Sequence
  chemically synthesized
tttcagttttggtttactaatc

SEQ ID NO: 1145176 - DNA, 22 bp, Artificial Sequence
  chemically synthesized
ttttcagttttggtttactaat

SEQ ID NO: 1145177 - DNA, 22 bp, Artificial Sequence
  chemically synthesized
ccccgttgctgattagtaaacc

SEQ ID NO: 1145178 - DNA, 22 bp, Artificial Sequence
  chemically synthesized
tgtgatttttttcagttttggt

SEQ ID NO: 1145179 - DNA, 22 bp, Artificial Sequence
  chemically synthesized
ctgattagtaaaccaaaactga

SEQ ID NO: 1145180 - DNA, 22 bp, Artificial Sequence
  chemically synthesized
attagtaaaccaaaactgaaaa

SEQ ID NO: 1145181 - DNA, 22 bp, Artificial Sequence
  chemically synthesized
gtaaaccaaaactgaaaaaaat

SEQ ID NO: 1145182 - DNA, 22 bp, Artificial Sequence
  chemically synthesized
tgaaaattatgtgatttttttc

SEQ ID NO: 1145183 - DNA, 22 bp, Artificial Sequence
  chemically synthesized
gtgaaaattatgtgattttttt

SEQ ID NO: 1145184 - DNA, 22 bp, Artificial Sequence
  chemically synthesized
tgtggccttgtgaaaattatgt

SEQ ID NO: 1145185 - DNA, 22 bp, Artificial Sequence
  chemically synthesized
aaaaaaatcacataattttcac

SEQ ID NO: 1145186 - DNA, 22 bp, Artificial Sequence
  chemically synthesized
ctatgtggccttgtgaaaatta

SEQ ID NO: 1145187 - DNA, 22 bp, Artificial Sequence
  chemically synthesized
gctatgtggccttgtgaaaatt

SEQ ID NO: 1145188 - DNA, 22 bp, Artificial Sequence
  chemically synthesized
atagtagaaatttgctatgtgg

SEQ ID NO: 1145189 - DNA, 22 bp, Artificial Sequence
  chemically synthesized
tcacaaggccacatagcaaatt

SEQ ID NO: 1145190 - DNA, 22 bp, Artificial Sequence
  chemically synthesized
cacaaggccacatagcaaattt

SEQ ID NO: 1145191 - DNA, 22 bp, Artificial Sequence
  chemically synthesized
acaaggccacatagcaaatttc

SEQ ID NO: 1145192 - DNA, 22 bp, Artificial Sequence
  chemically synthesized
aaattcatagtagaaatttgct

SEQ ID NO: 1145193 - DNA, 22 bp, Artificial Sequence
  chemically synthesized
tcaaattcatagtagaaatttg

SEQ ID NO: 1145194 - DNA, 22 bp, Artificial Sequence
  chemically synthesized
ccaatctctcaaattcatagta

SEQ ID NO: 1145195 - DNA, 22 bp, Artificial Sequence
  chemically synthesized
tcccaatctctcaaattcatag

SEQ ID NO: 1145196 - DNA, 22 bp, Artificial Sequence
  chemically synthesized
ctcccaatctctcaaattcata

SEQ ID NO: 1145197 - DNA, 22 bp, Artificial Sequence
  chemically synthesized
agatttctcccaatctctcaaa

SEQ ID NO: 1145198 - DNA, 22 bp, Artificial Sequence
  chemically synthesized
ctactatgaatttgagagattg

SEQ ID NO: 1145199 - DNA, 22 bp, Artificial Sequence
  chemically synthesized
tactatgaatttgagagattgg

SEQ ID NO: 1145200 - DNA, 22 bp, Artificial Sequence
  chemically synthesized
ctatgaatttgagagattggga

SEQ ID NO: 1145201 - DNA, 22 bp, Artificial Sequence
  chemically synthesized
aacctgagatttctcccaatct

SEQ ID NO: 1145202 - DNA, 22 bp, Artificial Sequence
  chemically synthesized
tgaatttgagagattgggagaa

SEQ ID NO: 1145203 - DNA, 22 bp, Artificial Sequence
  chemically synthesized
gagagattgggagaaatctcag

SEQ ID NO: 1145204 - DNA, 22 bp, Artificial Sequence
  chemically synthesized
agagattgggagaaatctcagg

SEQ ID NO: 1145205 - DNA, 22 bp, Artificial Sequence
  chemically synthesized
agatgtgtgacaactcaacctg

SEQ ID NO: 1145206 - DNA, 22 bp, Artificial Sequence
  chemically synthesized
ggagaaatctcaggttgagttg

SEQ ID NO: 1145207 - DNA, 22 bp, Artificial Sequence
  chemically synthesized
gtattcagatgtgtgacaactc

SEQ ID NO: 1145208 - DNA, 22 bp, Artificial Sequence
  chemically synthesized
acactggtattcagatgtgtga

SEQ ID NO: 1145209 - DNA, 22 bp, Artificial Sequence
  chemically synthesized
aggttgagttgtcacacatctg

SEQ ID NO: 1145210 - DNA, 22 bp, Artificial Sequence
  chemically synthesized
agttgtcacacatctgaatacc

SEQ ID NO: 1145211 - DNA, 22 bp, Artificial Sequence
  chemically synthesized
tcacacatctgaataccagtgt

SEQ ID NO: 1145212 - DNA, 22 bp, Artificial Sequence
  chemically synthesized
caggtggcaaggctgacactgg

SEQ ID NO: 1145213 - DNA, 22 bp, Artificial Sequence
  chemically synthesized
gcaggtggcaaggctgacactg

SEQ ID NO: 1145214 - DNA, 22 bp, Artificial Sequence
  chemically synthesized
aataccagtgtcagccttgcca

SEQ ID NO: 1145215 - DNA, 22 bp, Artificial Sequence
  chemically synthesized
atatagcttgcaggtggcaagg

SEQ ID NO: 1145216 - DNA, 22 bp, Artificial Sequence
  chemically synthesized
aatccaagttcatatagcttgc

SEQ ID NO: 1145217 - DNA, 22 bp, Artificial Sequence
  chemically synthesized
gccacctgcaagctatatgaac

SEQ ID NO: 1145218 - DNA, 22 bp, Artificial Sequence
  chemically synthesized
ccacctgcaagctatatgaact

SEQ ID NO: 1145219 - DNA, 22 bp, Artificial Sequence
  chemically synthesized
caagctatatgaacttggattt

SEQ ID NO: 1145220 - DNA, 22 bp, Artificial Sequence
  chemically synthesized
tatgaacttggatttaacttca

SEQ ID NO: 1145221 - DNA, 22 bp, Artificial Sequence
  chemically synthesized
ggatttaacttcattatgcatt

SEQ ID NO: 1145222 - DNA, 22 bp, Artificial Sequence
  chemically synthesized
gatttaacttcattatgcattg

SEQ ID NO: 1145223 - DNA, 22 bp, Artificial Sequence
  chemically synthesized
aacttcattatgcattggcttt

SEQ ID NO: 1145224 - DNA, 22 bp, Artificial Sequence
  chemically synthesized
acttcattatgcattggctttc

SEQ ID NO: 1145225 - DNA, 22 bp, Artificial Sequence
  chemically synthesized
tatcacaaatgagaaagccaat

SEQ ID NO: 1145226 - DNA, 22 bp, Artificial Sequence
  chemically synthesized
cattatgcattggctttctcat

SEQ ID NO: 1145227 - DNA, 22 bp, Artificial Sequence
  chemically synthesized
attatgcattggctttctcatt

SEQ ID NO: 1145228 - DNA, 22 bp, Artificial Sequence
  chemically synthesized
tgcattggctttctcatttgtg

SEQ ID NO: 1145229 - DNA, 22 bp, Artificial Sequence
  chemically synthesized
gctttctcatttgtgatatagg

SEQ ID NO: 1145230 - DNA, 22 bp, Artificial Sequence
  chemically synthesized
tatgtaatgccaaccctatatc

SEQ ID NO: 1145231 - DNA, 22 bp, Artificial Sequence
  chemically synthesized
gtatgtaatgccaaccctatat

SEQ ID NO: 1145232 - DNA, 22 bp, Artificial Sequence
  chemically synthesized
tctcatttgtgatatagggttg

SEQ ID NO: 1145233 - DNA, 22 bp, Artificial Sequence
  chemically synthesized
tgtatgtaatgccaaccctata

SEQ ID NO: 1145234 - DNA, 22 bp, Artificial Sequence
  chemically synthesized
ctcatttgtgatatagggttgg

SEQ ID NO: 1145235 - DNA, 22 bp, Artificial Sequence
  chemically synthesized
tcatttgtgatatagggttggc

SEQ ID NO: 1145236 - DNA, 22 bp, Artificial Sequence
  chemically synthesized
atttgtgatatagggttggcat

SEQ ID NO: 1145237 - DNA, 22 bp, Artificial Sequence
  chemically synthesized
catgctttgtatgtaatgccaa

SEQ ID NO: 1145238 - DNA, 22 bp, Artificial Sequence
  chemically synthesized
gtgatatagggttggcattaca

SEQ ID NO: 1145239 - DNA, 22 bp, Artificial Sequence
  chemically synthesized
acatgctttgtatgtaatgcca

SEQ ID NO: 1145240 - DNA, 22 bp, Artificial Sequence
  chemically synthesized
tgatatagggttggcattacat

SEQ ID NO: 1145241 - DNA, 22 bp, Artificial Sequence
  chemically synthesized
tacatgctttgtatgtaatgcc

SEQ ID NO: 1145242 - DNA, 22 bp, Artificial Sequence
  chemically synthesized
aggagttttacatgctttgtat

SEQ ID NO: 1145243 - DNA, 22 bp, Artificial Sequence
  chemically synthesized
caggagttttacatgctttgta

SEQ ID NO: 1145244 - DNA, 22 bp, Artificial Sequence
  chemically synthesized
tcaggagttttacatgctttgt

SEQ ID NO: 1145245 - DNA, 22 bp, Artificial Sequence
  chemically synthesized
ttcaggagttttacatgctttg

SEQ ID NO: 1145246 - DNA, 22 bp, Artificial Sequence
  chemically synthesized
gcattacatacaaagcatgtaa

SEQ ID NO: 1145247 - DNA, 22 bp, Artificial Sequence
  chemically synthesized
tttttcaggagttttacatgct

SEQ ID NO: 1145248 - DNA, 22 bp, Artificial Sequence
  chemically synthesized
ttatttttcaggagttttacat

SEQ ID NO: 1145249 - DNA, 22 bp, Artificial Sequence
  chemically synthesized
catacaaagcatgtaaaactcc

SEQ ID NO: 1145250 - DNA, 22 bp, Artificial Sequence
  chemically synthesized
gattattatttttcaggagttt

SEQ ID NO: 1145251 - DNA, 22 bp, Artificial Sequence
  chemically synthesized
ttagattattatttttcaggag

SEQ ID NO: 1145252 - DNA, 22 bp, Artificial Sequence
  chemically synthesized
taattattagattattattttt

SEQ ID NO: 1145253 - DNA, 22 bp, Artificial Sequence
  chemically synthesized
ctgaaaaataataatctaataa

SEQ ID NO: 1145254 - DNA, 22 bp, Artificial Sequence
  chemically synthesized
aaaaataataatctaataatta

SEQ ID NO: 1145255 - DNA, 22 bp, Artificial Sequence
  chemically synthesized
cccaagaagcaataattataat

SEQ ID NO: 1145256 - DNA, 22 bp, Artificial Sequence
  chemically synthesized
ttgcccaagaagcaataattat

SEQ ID NO: 1145257 - DNA, 22 bp, Artificial Sequence
  chemically synthesized
gttgcccaagaagcaataatta

SEQ ID NO: 1145258 - DNA, 22 bp, Artificial Sequence
  chemically synthesized
ataattataattattgcttctt

SEQ ID NO: 1145259 - DNA, 22 bp, Artificial Sequence
  chemically synthesized
taattattgcttcttgggcaac

SEQ ID NO: 1145260 - DNA, 22 bp, Artificial Sequence
  chemically synthesized
agcatcaacatttgttgcccaa

SEQ ID NO: 1145261 - DNA, 22 bp, Artificial Sequence
  chemically synthesized
ttgcttcttgggcaacaaatgt

SEQ ID NO: 1145262 - DNA, 22 bp, Artificial Sequence
  chemically synthesized
cttcttgggcaacaaatgttga

SEQ ID NO: 1145263 - DNA, 22 bp, Artificial Sequence
  chemically synthesized
cttgggcaacaaatgttgatgc

SEQ ID NO: 1145264 - DNA, 22 bp, Artificial Sequence
  chemically synthesized
ttgggcaacaaatgttgatgct

SEQ ID NO: 1145265 - DNA, 22 bp, Artificial Sequence
  chemically synthesized
gggcaacaaatgttgatgctta

SEQ ID NO: 1145266 - DNA, 22 bp, Artificial Sequence
  chemically synthesized
ggcaacaaatgttgatgcttag

SEQ ID NO: 1145267 - DNA, 22 bp, Artificial Sequence
  chemically synthesized
aatgtgatggaaataatccaca

SEQ ID NO: 1145268 - DNA, 22 bp, Artificial Sequence
  chemically synthesized
atgcttagctttgtggattatt

SEQ ID NO: 1145269 - DNA, 22 bp, Artificial Sequence
  chemically synthesized
aaatgtgatggaaataatccac

SEQ ID NO: 1145270 - DNA, 22 bp, Artificial Sequence
  chemically synthesized
taaatgtgatggaaataatcca

SEQ ID NO: 1145271 - DNA, 22 bp, Artificial Sequence
  chemically synthesized
agctttgtggattatttccatc

SEQ ID NO: 1145272 - DNA, 22 bp, Artificial Sequence
  chemically synthesized
gctttgtggattatttccatca

SEQ ID NO: 1145273 - DNA, 22 bp, Artificial Sequence
  chemically synthesized
tgtggattatttccatcacatt

SEQ ID NO: 1145274 - DNA, 22 bp, Artificial Sequence
  chemically synthesized
aaaaaaactttaaatgtgatgg

SEQ ID NO: 1145275 - DNA, 22 bp, Artificial Sequence
  chemically synthesized
gtggattatttccatcacattt

SEQ ID NO: 1145276 - DNA, 22 bp, Artificial Sequence
  chemically synthesized
aaaaaaaactttaaatgtgatg

SEQ ID NO: 1145277 - DNA, 22 bp, Artificial Sequence
  chemically synthesized
tggattatttccatcacattta

SEQ ID NO: 1145278 - DNA, 22 bp, Artificial Sequence
  chemically synthesized
tttccatcacatttaaagtttt

SEQ ID NO: 1145279 - DNA, 22 bp, Artificial Sequence
  chemically synthesized
aatgcatttaaaaaaaacttta

SEQ ID NO: 1145280 - DNA, 22 bp, Artificial Sequence
  chemically synthesized
ccatcacatttaaagttttttt

SEQ ID NO: 1145281 - DNA, 22 bp, Artificial Sequence
  chemically synthesized
catcacatttaaagtttttttt

SEQ ID NO: 1145282 - DNA, 22 bp, Artificial Sequence
  chemically synthesized
gtgaattaaatgcatttaaaaa

SEQ ID NO: 1145283 - DNA, 22 bp, Artificial Sequence
  chemically synthesized
ggtgaattaaatgcatttaaaa

SEQ ID NO: 1145284 - DNA, 22 bp, Artificial Sequence
  chemically synthesized
aaagttttttttaaatgcattt

SEQ ID NO: 1145285 - DNA, 22 bp, Artificial Sequence
  chemically synthesized
aagttttttttaaatgcattta

SEQ ID NO: 1145286 - DNA, 22 bp, Artificial Sequence
  chemically synthesized
tatttggtgaattaaatgcatt

SEQ ID NO: 1145287 - DNA, 22 bp, Artificial Sequence
  chemically synthesized
atatttggtgaattaaatgcat

SEQ ID NO: 1145288 - DNA, 22 bp, Artificial Sequence
  chemically synthesized
tatatttggtgaattaaatgca

SEQ ID NO: 1145289 - DNA, 22 bp, Artificial Sequence
  chemically synthesized
tttttaaatgcatttaattcac

SEQ ID NO: 1145290 - DNA, 22 bp, Artificial Sequence
  chemically synthesized
attttatatttggtgaattaaa

SEQ ID NO: 1145291 - DNA, 22 bp, Artificial Sequence
  chemically synthesized
ttttaaatgcatttaattcacc

SEQ ID NO: 1145292 - DNA, 22 bp, Artificial Sequence
  chemically synthesized
tttaaatgcatttaattcacca

SEQ ID NO: 1145293 - DNA, 22 bp, Artificial Sequence
  chemically synthesized
ttaaatgcatttaattcaccaa

SEQ ID NO: 1145294 - DNA, 22 bp, Artificial Sequence
  chemically synthesized
ctaattttatatttggtgaatt

SEQ ID NO: 1145295 - DNA, 22 bp, Artificial Sequence
  chemically synthesized
taaatgcatttaattcaccaaa

SEQ ID NO: 1145296 - DNA, 22 bp, Artificial Sequence
  chemically synthesized
aaatgcatttaattcaccaaat

SEQ ID NO: 1145297 - DNA, 22 bp, Artificial Sequence
  chemically synthesized
aatgcatttaattcaccaaata

SEQ ID NO: 1145298 - DNA, 22 bp, Artificial Sequence
  chemically synthesized
gttcctaattttatatttggtg

SEQ ID NO: 1145299 - DNA, 22 bp, Artificial Sequence
  chemically synthesized
tagttcctaattttatatttgg

SEQ ID NO: 1145300 - DNA, 22 bp, Artificial Sequence
  chemically synthesized
gctctagttcctaattttatat

SEQ ID NO: 1145301 - DNA, 22 bp, Artificial Sequence
  chemically synthesized
cgctctagttcctaattttata

SEQ ID NO: 1145302 - DNA, 22 bp, Artificial Sequence
  chemically synthesized
aattcaccaaatataaaattag

SEQ ID NO: 1145303 - DNA, 22 bp, Artificial Sequence
  chemically synthesized
attcaccaaatataaaattagg

SEQ ID NO: 1145304 - DNA, 22 bp, Artificial Sequence
  chemically synthesized
accaaatataaaattaggaact

SEQ ID NO: 1145305 - DNA, 22 bp, Artificial Sequence
  chemically synthesized
atgtttcgctctagttcctaat

SEQ ID NO: 1145306 - DNA, 22 bp, Artificial Sequence
  chemically synthesized
gatgtttcgctctagttcctaa

SEQ ID NO: 1145307 - DNA, 22 bp, Artificial Sequence
  chemically synthesized
tgatgtttcgctctagttccta

SEQ ID NO: 1145308 - DNA, 22 bp, Artificial Sequence
  chemically synthesized
aaacattttgatgtttcgctct

SEQ ID NO: 1145309 - DNA, 22 bp, Artificial Sequence
  chemically synthesized
ggaactagagcgaaacatcaaa

SEQ ID NO: 1145310 - DNA, 22 bp, Artificial Sequence
  chemically synthesized
gagcgaaacatcaaaatgtttc

SEQ ID NO: 1145311 - DNA, 22 bp, Artificial Sequence
  chemically synthesized
tgaagaggaatatggttgaaac

SEQ ID NO: 1145312 - DNA, 22 bp, Artificial Sequence
  chemically synthesized
atgaagaggaatatggttgaaa

SEQ ID NO: 1145313 - DNA, 22 bp, Artificial Sequence
  chemically synthesized
tttatgaagaggaatatggttg

SEQ ID NO: 1145314 - DNA, 22 bp, Artificial Sequence
  chemically synthesized
caaccatattcctcttcataaa

SEQ ID NO: 1145315 - DNA, 22 bp, Artificial Sequence
  chemically synthesized
aaccatattcctcttcataaat

SEQ ID NO: 1145316 - DNA, 22 bp, Artificial Sequence
  chemically synthesized
agaaatagaagttatttatgaa

SEQ ID NO: 1145317 - DNA, 22 bp, Artificial Sequence
  chemically synthesized
tcaaattaagaaatagaagtta

SEQ ID NO: 1145318 - DNA, 22 bp, Artificial Sequence
  chemically synthesized
ctcttcataaataacttctatt

SEQ ID NO: 1145319 - DNA, 22 bp, Artificial Sequence
  chemically synthesized
ttcataaataacttctatttct

SEQ ID NO: 1145320 - DNA, 22 bp, Artificial Sequence
  chemically synthesized
cataaataacttctatttctta

SEQ ID NO: 1145321 - DNA, 22 bp, Artificial Sequence
  chemically synthesized
ataaataacttctatttcttaa

SEQ ID NO: 1145322 - DNA, 22 bp, Artificial Sequence
  chemically synthesized
gaccctatcaaattaagaaata

SEQ ID NO: 1145323 - DNA, 22 bp, Artificial Sequence
  chemically synthesized
tagaatgttagaccctatcaaa

SEQ ID NO: 1145324 - DNA, 22 bp, Artificial Sequence
  chemically synthesized
ctatttcttaatttgatagggt

SEQ ID NO: 1145325 - DNA, 22 bp, Artificial Sequence
  chemically synthesized
atagaatgttagaccctatcaa

SEQ ID NO: 1145326 - DNA, 22 bp, Artificial Sequence
  chemically synthesized
tatttcttaatttgatagggtc

SEQ ID NO: 1145327 - DNA, 22 bp, Artificial Sequence
  chemically synthesized
tatagaatgttagaccctatca

SEQ ID NO: 1145328 - DNA, 22 bp, Artificial Sequence
  chemically synthesized
tttcttaatttgatagggtcta

SEQ ID NO: 1145329 - DNA, 22 bp, Artificial Sequence
  chemically synthesized
cttaatttgatagggtctaaca

SEQ ID NO: 1145330 - DNA, 22 bp, Artificial Sequence
  chemically synthesized
ttaatttgatagggtctaacat

SEQ ID NO: 1145331 - DNA, 22 bp, Artificial Sequence
  chemically synthesized
aatttgatagggtctaacattc

SEQ ID NO: 1145332 - DNA, 22 bp, Artificial Sequence
  chemically synthesized
atttgatagggtctaacattct

SEQ ID NO: 1145333 - DNA, 22 bp, Artificial Sequence
  chemically synthesized
gatagggtctaacattctataa

SEQ ID NO: 1145334 - DNA, 22 bp, Artificial Sequence
  chemically synthesized
atagggtctaacattctataaa

SEQ ID NO: 1145335 - DNA, 22 bp, Artificial Sequence
  chemically synthesized
acattctataaaattttctttc

SEQ ID NO: 1145336 - DNA, 22 bp, Artificial Sequence
  chemically synthesized
gggatagtatgagaaagaaaat

SEQ ID NO: 1145337 - DNA, 22 bp, Artificial Sequence
  chemically synthesized
cgggatagtatgagaaagaaaa

SEQ ID NO: 1145338 - DNA, 22 bp, Artificial Sequence
  chemically synthesized
tataaaattttctttctcatac

SEQ ID NO: 1145339 - DNA, 22 bp, Artificial Sequence
  chemically synthesized
taaaattttctttctcatacta

SEQ ID NO: 1145340 - DNA, 22 bp, Artificial Sequence
  chemically synthesized
tagtacatatcttcgggatagt

SEQ ID NO: 1145341 - DNA, 22 bp, Artificial Sequence
  chemically synthesized
atagtacatatcttcgggatag

SEQ ID NO: 1145342 - DNA, 22 bp, Artificial Sequence
  chemically synthesized
tctttctcatactatcccgaag

SEQ ID NO: 1145343 - DNA, 22 bp, Artificial Sequence
  chemically synthesized
tatagtacatatcttcgggata

SEQ ID NO: 1145344 - DNA, 22 bp, Artificial Sequence
  chemically synthesized
ctttctcatactatcccgaaga

SEQ ID NO: 1145345 - DNA, 22 bp, Artificial Sequence
  chemically synthesized
ttatagtacatatcttcgggat

SEQ ID NO: 1145346 - DNA, 22 bp, Artificial Sequence
  chemically synthesized
tttctcatactatcccgaagat

SEQ ID NO: 1145347 - DNA, 22 bp, Artificial Sequence
  chemically synthesized
tctcatactatcccgaagatat

SEQ ID NO: 1145348 - DNA, 22 bp, Artificial Sequence
  chemically synthesized
ctcatactatcccgaagatatg

SEQ ID NO: 1145349 - DNA, 22 bp, Artificial Sequence
  chemically synthesized
tcatactatcccgaagatatgt

SEQ ID NO: 1145350 - DNA, 22 bp, Artificial Sequence
  chemically synthesized
aaatttttatagtacatatctt

SEQ ID NO: 1145351 - DNA, 22 bp, Artificial Sequence
  chemically synthesized
atactatcccgaagatatgtac

SEQ ID NO: 1145352 - DNA, 22 bp, Artificial Sequence
  chemically synthesized
tcccgaagatatgtactataaa

SEQ ID NO: 1145353 - DNA, 22 bp, Artificial Sequence
  chemically synthesized
ggtaactgaaatttttatagta

SEQ ID NO: 1145354 - DNA, 22 bp, Artificial Sequence
  chemically synthesized
aatgtcagttaggtaactgaaa

SEQ ID NO: 1145355 - DNA, 22 bp, Artificial Sequence
  chemically synthesized
taaaaatttcagttacctaact

SEQ ID NO: 1145356 - DNA, 22 bp, Artificial Sequence
  chemically synthesized
atcacctaaatgtcagttaggt

SEQ ID NO: 1145357 - DNA, 22 bp, Artificial Sequence
  chemically synthesized
tcatcacctaaatgtcagttag

SEQ ID NO: 1145358 - DNA, 22 bp, Artificial Sequence
  chemically synthesized
tctcatcacctaaatgtcagtt

SEQ ID NO: 1145359 - DNA, 22 bp, Artificial Sequence
  chemically synthesized
ctctcatcacctaaatgtcagt

SEQ ID NO: 1145360 - DNA, 22 bp, Artificial Sequence
  chemically synthesized
tctctcatcacctaaatgtcag

SEQ ID NO: 1145361 - DNA, 22 bp, Artificial Sequence
  chemically synthesized
cagttacctaactgacatttag

SEQ ID NO: 1145362 - DNA, 22 bp, Artificial Sequence
  chemically synthesized
ttctctcatcacctaaatgtca

SEQ ID NO: 1145363 - DNA, 22 bp, Artificial Sequence
  chemically synthesized
agttacctaactgacatttagg

SEQ ID NO: 1145364 - DNA, 22 bp, Artificial Sequence
  chemically synthesized
cctaactgacatttaggtgatg

SEQ ID NO: 1145365 - DNA, 22 bp, Artificial Sequence
  chemically synthesized
actgacatttaggtgatgagag

SEQ ID NO: 1145366 - DNA, 22 bp, Artificial Sequence
  chemically synthesized
acatttaggtgatgagagaaaa

SEQ ID NO: 1145367 - DNA, 22 bp, Artificial Sequence
  chemically synthesized
aggtgatgagagaaaaatctga

SEQ ID NO: 1145368 - DNA, 22 bp, Artificial Sequence
  chemically synthesized
ggtgatgagagaaaaatctgac

SEQ ID NO: 1145369 - DNA, 22 bp, Artificial Sequence
  chemically synthesized
agaaagacgataaagtcagatt

SEQ ID NO: 1145370 - DNA, 22 bp, Artificial Sequence
  chemically synthesized
ttcagaaagacgataaagtcag

SEQ ID NO: 1145371 - DNA, 22 bp, Artificial Sequence
  chemically synthesized
tgaaaggtagttgttcagaaag

SEQ ID NO: 1145372 - DNA, 22 bp, Artificial Sequence
  chemically synthesized
actttatcgtctttctgaacaa

SEQ ID NO: 1145373 - DNA, 22 bp, Artificial Sequence
  chemically synthesized
tactgtgaaaggtagttgttca

SEQ ID NO: 1145374 - DNA, 22 bp, Artificial Sequence
  chemically synthesized
tatcgtctttctgaacaactac

SEQ ID NO: 1145375 - DNA, 22 bp, Artificial Sequence
  chemically synthesized
atcgtctttctgaacaactacc

SEQ ID NO: 1145376 - DNA, 22 bp, Artificial Sequence
  chemically synthesized
tcgtctttctgaacaactacct

SEQ ID NO: 1145377 - DNA, 22 bp, Artificial Sequence
  chemically synthesized
tctgaacaactacctttcacag

SEQ ID NO: 1145378 - DNA, 22 bp, Artificial Sequence
  chemically synthesized
ctgaacaactacctttcacagt

SEQ ID NO: 1145379 - DNA, 22 bp, Artificial Sequence
  chemically synthesized
tgaacaactacctttcacagta

SEQ ID NO: 1145380 - DNA, 22 bp, Artificial Sequence
  chemically synthesized
aacaactacctttcacagtata

SEQ ID NO: 1145381 - DNA, 22 bp, Artificial Sequence
  chemically synthesized
gaaagaaaatgctatactgtga

SEQ ID NO: 1145382 - DNA, 22 bp, Artificial Sequence
  chemically synthesized
ggaaagaaaatgctatactgtg

SEQ ID NO: 1145383 - DNA, 22 bp, Artificial Sequence
  chemically synthesized
cctttcacagtatagcattttc

SEQ ID NO: 1145384 - DNA, 22 bp, Artificial Sequence
  chemically synthesized
tcacagtatagcattttctttc

SEQ ID NO: 1145385 - DNA, 22 bp, Artificial Sequence
  chemically synthesized
cacagtatagcattttctttcc

SEQ ID NO: 1145386 - DNA, 22 bp, Artificial Sequence
  chemically synthesized
acagtatagcattttctttcca

SEQ ID NO: 1145387 - DNA, 22 bp, Artificial Sequence
  chemically synthesized
aaataacaaagccacttggaaa

SEQ ID NO: 1145388 - DNA, 22 bp, Artificial Sequence
  chemically synthesized
tctttccaagtggctttgttat

SEQ ID NO: 1145389 - DNA, 22 bp, Artificial Sequence
  chemically synthesized
ctttccaagtggctttgttatt

SEQ ID NO: 1145390 - DNA, 22 bp, Artificial Sequence
  chemically synthesized
tttccaagtggctttgttattt

SEQ ID NO: 1145391 - DNA, 22 bp, Artificial Sequence
  chemically synthesized
tccaagtggctttgttatttta

SEQ ID NO: 1145392 - DNA, 22 bp, Artificial Sequence
  chemically synthesized
caaagagaatgttaaaataaca

SEQ ID NO: 1145393 - DNA, 22 bp, Artificial Sequence
  chemically synthesized
ccaagtggctttgttattttaa

SEQ ID NO: 1145394 - DNA, 22 bp, Artificial Sequence
  chemically synthesized
caagtggctttgttattttaac

SEQ ID NO: 1145395 - DNA, 22 bp, Artificial Sequence
  chemically synthesized
agttacaaagagaatgttaaaa

SEQ ID NO: 1145396 - DNA, 22 bp, Artificial Sequence
  chemically synthesized
tatctcagttacaaagagaatg

SEQ ID NO: 1145397 - DNA, 22 bp, Artificial Sequence
  chemically synthesized
tgttattttaacattctctttg

SEQ ID NO: 1145398 - DNA, 22 bp, Artificial Sequence
  chemically synthesized
gttattttaacattctctttgt

SEQ ID NO: 1145399 - DNA, 22 bp, Artificial Sequence
  chemically synthesized
ttattttaacattctctttgta

SEQ ID NO: 1145400 - DNA, 22 bp, Artificial Sequence
  chemically synthesized
ttttaacattctctttgtaact

SEQ ID NO: 1145401 - DNA, 22 bp, Artificial Sequence
  chemically synthesized
taacattctctttgtaactgag

SEQ ID NO: 1145402 - DNA, 22 bp, Artificial Sequence
  chemically synthesized
aacattctctttgtaactgaga

SEQ ID NO: 1145403 - DNA, 22 bp, Artificial Sequence
  chemically synthesized
acattctctttgtaactgagat

SEQ ID NO: 1145404 - DNA, 22 bp, Artificial Sequence
  chemically synthesized
caaagggaatgtgctatatctc

SEQ ID NO: 1145405 - DNA, 22 bp, Artificial Sequence
  chemically synthesized
tctttgtaactgagatatagca

SEQ ID NO: 1145406 - DNA, 22 bp, Artificial Sequence
  chemically synthesized
tttgtaactgagatatagcaca

SEQ ID NO: 1145407 - DNA, 22 bp, Artificial Sequence
  chemically synthesized
tgtaactgagatatagcacatt

SEQ ID NO: 1145408 - DNA, 22 bp, Artificial Sequence
  chemically synthesized
gtaactgagatatagcacattc

SEQ ID NO: 1145409 - DNA, 22 bp, Artificial Sequence
  chemically synthesized
taactgagatatagcacattcc

SEQ ID NO: 1145410 - DNA, 22 bp, Artificial Sequence
  chemically synthesized
agatatagcacattccctttgt

SEQ ID NO: 1145411 - DNA, 22 bp, Artificial Sequence
  chemically synthesized
tgtaacatgagtatcacacagg

SEQ ID NO: 1145412 - DNA, 22 bp, Artificial Sequence
  chemically synthesized
gtgtaacatgagtatcacacag

SEQ ID NO: 1145413 - DNA, 22 bp, Artificial Sequence
  chemically synthesized
cctttgtaacctgtgtgatact

SEQ ID NO: 1145414 - DNA, 22 bp, Artificial Sequence
  chemically synthesized
acttgtgtaacatgagtatcac

SEQ ID NO: 1145415 - DNA, 22 bp, Artificial Sequence
  chemically synthesized
aacttgtgtaacatgagtatca

SEQ ID NO: 1145416 - DNA, 22 bp, Artificial Sequence
  chemically synthesized
tgtaacctgtgtgatactcatg

SEQ ID NO: 1145417 - DNA, 22 bp, Artificial Sequence
  chemically synthesized
taacttgtgtaacatgagtatc

SEQ ID NO: 1145418 - DNA, 22 bp, Artificial Sequence
  chemically synthesized
gtaacctgtgtgatactcatgt

SEQ ID NO: 1145419 - DNA, 22 bp, Artificial Sequence
  chemically synthesized
taacctgtgtgatactcatgtt

SEQ ID NO: 1145420 - DNA, 22 bp, Artificial Sequence
  chemically synthesized
atagttttaacttgtgtaacat

SEQ ID NO: 1145421 - DNA, 22 bp, Artificial Sequence
  chemically synthesized
tgtgatactcatgttacacaag

SEQ ID NO: 1145422 - DNA, 22 bp, Artificial Sequence
  chemically synthesized
gtgtcgttaatagttttaactt

SEQ ID NO: 1145423 - DNA, 22 bp, Artificial Sequence
  chemically synthesized
atgttacacaagttaaaactat

SEQ ID NO: 1145424 - DNA, 22 bp, Artificial Sequence
  chemically synthesized
ttagtgtcgttaatagttttaa

SEQ ID NO: 1145425 - DNA, 22 bp, Artificial Sequence
  chemically synthesized
ctgttagtgtcgttaatagttt

SEQ ID NO: 1145426 - DNA, 22 bp, Artificial Sequence
  chemically synthesized
cacaagttaaaactattaacga

SEQ ID NO: 1145427 - DNA, 22 bp, Artificial Sequence
  chemically synthesized
gacattgctgttagtgtcgtta

SEQ ID NO: 1145428 - DNA, 22 bp, Artificial Sequence
  chemically synthesized
ggacattgctgttagtgtcgtt

SEQ ID NO: 1145429 - DNA, 22 bp, Artificial Sequence
  chemically synthesized
tggacattgctgttagtgtcgt

SEQ ID NO: 1145430 - DNA, 22 bp, Artificial Sequence
  chemically synthesized
tttggacattgctgttagtgtc

SEQ ID NO: 1145431 - DNA, 22 bp, Artificial Sequence
  chemically synthesized
aaactattaacgacactaacag

SEQ ID NO: 1145432 - DNA, 22 bp, Artificial Sequence
  chemically synthesized
ttaacgacactaacagcaatgt

SEQ ID NO: 1145433 - DNA, 22 bp, Artificial Sequence
  chemically synthesized
acgacactaacagcaatgtcca

SEQ ID NO: 1145434 - DNA, 22 bp, Artificial Sequence
  chemically synthesized
atggtaacatctctttggacat

SEQ ID NO: 1145435 - DNA, 22 bp, Artificial Sequence
  chemically synthesized
aatggtaacatctctttggaca

SEQ ID NO: 1145436 - DNA, 22 bp, Artificial Sequence
  chemically synthesized
acagcaatgtccaaagagatgt

SEQ ID NO: 1145437 - DNA, 22 bp, Artificial Sequence
  chemically synthesized
ccattaaatgtctgtcattctt

SEQ ID NO: 1145438 - DNA, 22 bp, Artificial Sequence
  chemically synthesized
gataagtagacaataagaatga

SEQ ID NO: 1145439 - DNA, 22 bp, Artificial Sequence
  chemically synthesized
aatgtctgtcattcttattgtc

SEQ ID NO: 1145440 - DNA, 22 bp, Artificial Sequence
  chemically synthesized
tcattcttattgtctacttatc

SEQ ID NO: 1145441 - DNA, 22 bp, Artificial Sequence
  chemically synthesized
aaggtgacaaatctggataagt

SEQ ID NO: 1145442 - DNA, 22 bp, Artificial Sequence
  chemically synthesized
aaaggtgacaaatctggataag

SEQ ID NO: 1145443 - DNA, 22 bp, Artificial Sequence
  chemically synthesized
taaaggtgacaaatctggataa

SEQ ID NO: 1145444 - DNA, 22 bp, Artificial Sequence
  chemically synthesized
ttattgtctacttatccagatt

SEQ ID NO: 1145445 - DNA, 22 bp, Artificial Sequence
  chemically synthesized
ttaaaggtgacaaatctggata

SEQ ID NO: 1145446 - DNA, 22 bp, Artificial Sequence
  chemically synthesized
attgtctacttatccagatttg

SEQ ID NO: 1145447 - DNA, 22 bp, Artificial Sequence
  chemically synthesized
ttgtctacttatccagatttgt

SEQ ID NO: 1145448 - DNA, 22 bp, Artificial Sequence
  chemically synthesized
tctacttatccagatttgtcac

SEQ ID NO: 1145449 - DNA, 22 bp, Artificial Sequence
  chemically synthesized
cttatccagatttgtcaccttt

SEQ ID NO: 1145450 - DNA, 22 bp, Artificial Sequence
  chemically synthesized
atccagatttgtcacctttaaa

SEQ ID NO: 1145451 - DNA, 22 bp, Artificial Sequence
  chemically synthesized
tccagatttgtcacctttaaaa

SEQ ID NO: 1145452 - DNA, 22 bp, Artificial Sequence
  chemically synthesized
accaacagtgataatttttaaa

SEQ ID NO: 1145453 - DNA, 22 bp, Artificial Sequence
  chemically synthesized
gaccaacagtgataatttttaa

SEQ ID NO: 1145454 - DNA, 22 bp, Artificial Sequence
  chemically synthesized
tgaccaacagtgataattttta

SEQ ID NO: 1145455 - DNA, 22 bp, Artificial Sequence
  chemically synthesized
ttttgaccaacagtgataattt

SEQ ID NO: 1145456 - DNA, 22 bp, Artificial Sequence
  chemically synthesized
gtcacctttaaaaattatcact

SEQ ID NO: 1145457 - DNA, 22 bp, Artificial Sequence
  chemically synthesized
tcacctttaaaaattatcactg

SEQ ID NO: 1145458 - DNA, 22 bp, Artificial Sequence
  chemically synthesized
ccaattattttgaccaacagtg

SEQ ID NO: 1145459 - DNA, 22 bp, Artificial Sequence
  chemically synthesized
taaaaattatcactgttggtca

SEQ ID NO: 1145460 - DNA, 22 bp, Artificial Sequence
  chemically synthesized
tgccaattattttgaccaacag

SEQ ID NO: 1145461 - DNA, 22 bp, Artificial Sequence
  chemically synthesized
aaaaattatcactgttggtcaa

SEQ ID NO: 1145462 - DNA, 22 bp, Artificial Sequence
  chemically synthesized
aaaattatcactgttggtcaaa

SEQ ID NO: 1145463 - DNA, 22 bp, Artificial Sequence
  chemically synthesized
cattctgccaattattttgacc

SEQ ID NO: 1145464 - DNA, 22 bp, Artificial Sequence
  chemically synthesized
tcactgttggtcaaaataattg

SEQ ID NO: 1145465 - DNA, 22 bp, Artificial Sequence
  chemically synthesized
ttggtcaaaataattggcagaa

SEQ ID NO: 1145466 - DNA, 22 bp, Artificial Sequence
  chemically synthesized
gtcaaaataattggcagaatgt

SEQ ID NO: 1145467 - DNA, 22 bp, Artificial Sequence
  chemically synthesized
gcagaatgtagtatttgacttc

SEQ ID NO: 1145468 - DNA, 22 bp, Artificial Sequence
  chemically synthesized
aatataatggcaaaatataaag

SEQ ID NO: 1145469 - DNA, 22 bp, Artificial Sequence
  chemically synthesized
gacttctttatattttgccatt

SEQ ID NO: 1145470 - DNA, 22 bp, Artificial Sequence
  chemically synthesized
acttctttatattttgccatta

SEQ ID NO: 1145471 - DNA, 22 bp, Artificial Sequence
  chemically synthesized
ctttatattttgccattatatt

SEQ ID NO: 1145472 - DNA, 22 bp, Artificial Sequence
  chemically synthesized
tttatattttgccattatattc

SEQ ID NO: 1145473 - DNA, 22 bp, Artificial Sequence
  chemically synthesized
tatattttgccattatattcag

SEQ ID NO: 1145474 - DNA, 22 bp, Artificial Sequence
  chemically synthesized
atattttgccattatattcaga

SEQ ID NO: 1145475 - DNA, 22 bp, Artificial Sequence
  chemically synthesized
tattttgccattatattcagat

SEQ ID NO: 1145476 - DNA, 22 bp, Artificial Sequence
  chemically synthesized
ataagaaaaaacaatctgaata

SEQ ID NO: 1145477 - DNA, 22 bp, Artificial Sequence
  chemically synthesized
cataagaaaaaacaatctgaat

SEQ ID NO: 1145478 - DNA, 22 bp, Artificial Sequence
  chemically synthesized
tcataagaaaaaacaatctgaa

SEQ ID NO: 1145479 - DNA, 22 bp, Artificial Sequence
  chemically synthesized
tgccattatattcagattgttt

SEQ ID NO: 1145480 - DNA, 22 bp, Artificial Sequence
  chemically synthesized
gccattatattcagattgtttt

SEQ ID NO: 1145481 - DNA, 22 bp, Artificial Sequence
  chemically synthesized
ctttcataagaaaaaacaatct

SEQ ID NO: 1145482 - DNA, 22 bp, Artificial Sequence
  chemically synthesized
ccattatattcagattgttttt

SEQ ID NO: 1145483 - DNA, 22 bp, Artificial Sequence
  chemically synthesized
tattcagattgttttttcttat

SEQ ID NO: 1145484 - DNA, 22 bp, Artificial Sequence
  chemically synthesized
aaaattactttcataagaaaaa

SEQ ID NO: 1145485 - DNA, 22 bp, Artificial Sequence
  chemically synthesized
tcaaaattactttcataagaaa

SEQ ID NO: 1145486 - DNA, 22 bp, Artificial Sequence
  chemically synthesized
agattgttttttcttatgaaag

SEQ ID NO: 1145487 - DNA, 22 bp, Artificial Sequence
  chemically synthesized
ttttttcttatgaaagtaattt

SEQ ID NO: 1145488 - DNA, 22 bp, Artificial Sequence
  chemically synthesized
tttcttatgaaagtaattttga

SEQ ID NO: 1145489 - DNA, 22 bp, Artificial Sequence
  chemically synthesized
ttcttatgaaagtaattttgag

SEQ ID NO: 1145490 - DNA, 22 bp, Artificial Sequence
  chemically synthesized
aaaagcatgattctcaaaatta

SEQ ID NO: 1145491 - DNA, 22 bp, Artificial Sequence
  chemically synthesized
tcttatgaaagtaattttgaga

SEQ ID NO: 1145492 - DNA, 22 bp, Artificial Sequence
  chemically synthesized
aaaaagcatgattctcaaaatt

SEQ ID NO: 1145493 - DNA, 22 bp, Artificial Sequence
  chemically synthesized
cttatgaaagtaattttgagaa

SEQ ID NO: 1145494 - DNA, 22 bp, Artificial Sequence
  chemically synthesized
taaaaagcatgattctcaaaat

SEQ ID NO: 1145495 - DNA, 22 bp, Artificial Sequence
  chemically synthesized
ttatgaaagtaattttgagaat

SEQ ID NO: 1145496 - DNA, 22 bp, Artificial Sequence
  chemically synthesized
atgaaagtaattttgagaatca

SEQ ID NO: 1145497 - DNA, 22 bp, Artificial Sequence
  chemically synthesized
tgaaagtaattttgagaatcat

SEQ ID NO: 1145498 - DNA, 22 bp, Artificial Sequence
  chemically synthesized
agctttaaaaagcatgattctc

SEQ ID NO: 1145499 - DNA, 22 bp, Artificial Sequence
  chemically synthesized
cagctttaaaaagcatgattct

SEQ ID NO: 1145500 - DNA, 22 bp, Artificial Sequence
  chemically synthesized
tgagaatcatgctttttaaagc

SEQ ID NO: 1145501 - DNA, 22 bp, Artificial Sequence
  chemically synthesized
tagagaacttcagctttaaaaa

SEQ ID NO: 1145502 - DNA, 22 bp, Artificial Sequence
  chemically synthesized
gagaatcatgctttttaaagct

SEQ ID NO: 1145503 - DNA, 22 bp, Artificial Sequence
  chemically synthesized
agaatcatgctttttaaagctg

SEQ ID NO: 1145504 - DNA, 22 bp, Artificial Sequence
  chemically synthesized
tgtagagaacttcagctttaaa

SEQ ID NO: 1145505 - DNA, 22 bp, Artificial Sequence
  chemically synthesized
attctgtagagaacttcagctt

SEQ ID NO: 1145506 - DNA, 22 bp, Artificial Sequence
  chemically synthesized
cctcattctgtagagaacttca

SEQ ID NO: 1145507 - DNA, 22 bp, Artificial Sequence
  chemically synthesized
tccctcattctgtagagaactt

SEQ ID NO: 1145508 - DNA, 22 bp, Artificial Sequence
  chemically synthesized
tttaaagctgaagttctctaca

SEQ ID NO: 1145509 - DNA, 22 bp, Artificial Sequence
  chemically synthesized
ttaaagctgaagttctctacag

SEQ ID NO: 1145510 - DNA, 22 bp, Artificial Sequence
  chemically synthesized
taaagctgaagttctctacaga

SEQ ID NO: 1145511 - DNA, 22 bp, Artificial Sequence
  chemically synthesized
aaagctgaagttctctacagaa

SEQ ID NO: 1145512 - DNA, 22 bp, Artificial Sequence
  chemically synthesized
aagctgaagttctctacagaat

SEQ ID NO: 1145513 - DNA, 22 bp, Artificial Sequence
  chemically synthesized
aagttctctacagaatgaggga

SEQ ID NO: 1145514 - DNA, 22 bp, Artificial Sequence
  chemically synthesized
gtagaagcataattctccctca

SEQ ID NO: 1145515 - DNA, 22 bp, Artificial Sequence
  chemically synthesized
tctacagaatgagggagaatta

SEQ ID NO: 1145516 - DNA, 22 bp, Artificial Sequence
  chemically synthesized
tctagtagaagcataattctcc

SEQ ID NO: 1145517 - DNA, 22 bp, Artificial Sequence
  chemically synthesized
tacagaatgagggagaattatg

SEQ ID NO: 1145518 - DNA, 22 bp, Artificial Sequence
  chemically synthesized
atctagtagaagcataattctc

SEQ ID NO: 1145519 - DNA, 22 bp, Artificial Sequence
  chemically synthesized
cagaatgagggagaattatgct

SEQ ID NO: 1145520 - DNA, 22 bp, Artificial Sequence
  chemically synthesized
cccaatcttatctagtagaagc

SEQ ID NO: 1145521 - DNA, 22 bp, Artificial Sequence
  chemically synthesized
tgcttctactagataagattgg

SEQ ID NO: 1145522 - DNA, 22 bp, Artificial Sequence
  chemically synthesized
ctactagataagattgggcagt

SEQ ID NO: 1145523 - DNA, 22 bp, Artificial Sequence
  chemically synthesized
tactagataagattgggcagta

SEQ ID NO: 1145524 - DNA, 22 bp, Artificial Sequence
  chemically synthesized
ctagataagattgggcagtatt

SEQ ID NO: 1145525 - DNA, 22 bp, Artificial Sequence
  chemically synthesized
gataagattgggcagtatttcc

SEQ ID NO: 1145526 - DNA, 22 bp, Artificial Sequence
  chemically synthesized
ggcagtatttccttttattttc

SEQ ID NO: 1145527 - DNA, 22 bp, Artificial Sequence
  chemically synthesized
caatacaggtggagtgcaagaa

SEQ ID NO: 1145528 - DNA, 22 bp, Artificial Sequence
  chemically synthesized
ccaatacaggtggagtgcaaga

SEQ ID NO: 1145529 - DNA, 22 bp, Artificial Sequence
  chemically synthesized
ccttttattttcttgcactcca

SEQ ID NO: 1145530 - DNA, 22 bp, Artificial Sequence
  chemically synthesized
cttttattttcttgcactccac

SEQ ID NO: 1145531 - DNA, 22 bp, Artificial Sequence
  chemically synthesized
ttattttcttgcactccacctg

SEQ ID NO: 1145532 - DNA, 22 bp, Artificial Sequence
  chemically synthesized
tattttcttgcactccacctgt

SEQ ID NO: 1145533 - DNA, 22 bp, Artificial Sequence
  chemically synthesized
attttcttgcactccacctgta

SEQ ID NO: 1145534 - DNA, 22 bp, Artificial Sequence
  chemically synthesized
ttttcttgcactccacctgtat

SEQ ID NO: 1145535 - DNA, 22 bp, Artificial Sequence
  chemically synthesized
caatgtcccttccaatacaggt

SEQ ID NO: 1145536 - DNA, 22 bp, Artificial Sequence
  chemically synthesized
tcttgcactccacctgtattgg

SEQ ID NO: 1145537 - DNA, 22 bp, Artificial Sequence
  chemically synthesized
cttgcactccacctgtattgga

SEQ ID NO: 1145538 - DNA, 22 bp, Artificial Sequence
  chemically synthesized
ttgcactccacctgtattggaa

SEQ ID NO: 1145539 - DNA, 22 bp, Artificial Sequence
  chemically synthesized
gcactccacctgtattggaagg

SEQ ID NO: 1145540 - DNA, 22 bp, Artificial Sequence
  chemically synthesized
cactccacctgtattggaaggg

SEQ ID NO: 1145541 - DNA, 22 bp, Artificial Sequence
  chemically synthesized
atagcctccaatgtcccttcca

SEQ ID NO: 1145542 - DNA, 22 bp, Artificial Sequence
  chemically synthesized
gatagcctccaatgtcccttcc

SEQ ID NO: 1145543 - DNA, 22 bp, Artificial Sequence
  chemically synthesized
cacctgtattggaagggacatt

SEQ ID NO: 1145544 - DNA, 22 bp, Artificial Sequence
  chemically synthesized
gacttgatagcctccaatgtcc

SEQ ID NO: 1145545 - DNA, 22 bp, Artificial Sequence
  chemically synthesized
tattggaagggacattggaggc

SEQ ID NO: 1145546 - DNA, 22 bp, Artificial Sequence
  chemically synthesized
gaagggacattggaggctatca

SEQ ID NO: 1145547 - DNA, 22 bp, Artificial Sequence
  chemically synthesized
agtgggaagttagacttgatag

SEQ ID NO: 1145548 - DNA, 22 bp, Artificial Sequence
  chemically synthesized
gaggctatcaagtctaacttcc

SEQ ID NO: 1145549 - DNA, 22 bp, Artificial Sequence
  chemically synthesized
tcaagtctaacttcccactcag

SEQ ID NO: 1145550 - DNA, 22 bp, Artificial Sequence
  chemically synthesized
aaagaggtgacatactgagtgg

SEQ ID NO: 1145551 - DNA, 22 bp, Artificial Sequence
  chemically synthesized
aaaagaggtgacatactgagtg

SEQ ID NO: 1145552 - DNA, 22 bp, Artificial Sequence
  chemically synthesized
taaaagaggtgacatactgagt

SEQ ID NO: 1145553 - DNA, 22 bp, Artificial Sequence
  chemically synthesized
acttcccactcagtatgtcacc

SEQ ID NO: 1145554 - DNA, 22 bp, Artificial Sequence
  chemically synthesized
cccactcagtatgtcacctctt

SEQ ID NO: 1145555 - DNA, 22 bp, Artificial Sequence
  chemically synthesized
ccactcagtatgtcacctcttt

SEQ ID NO: 1145556 - DNA, 22 bp, Artificial Sequence
  chemically synthesized
aagtatgttttaaaagaggtga

SEQ ID NO: 1145557 - DNA, 22 bp, Artificial Sequence
  chemically synthesized
agtatgtcacctcttttaaaac

SEQ ID NO: 1145558 - DNA, 22 bp, Artificial Sequence
  chemically synthesized
atgttcaagtatgttttaaaag

SEQ ID NO: 1145559 - DNA, 22 bp, Artificial Sequence
  chemically synthesized
gaatctcatgttcaagtatgtt

SEQ ID NO: 1145560 - DNA, 22 bp, Artificial Sequence
  chemically synthesized
ttttaaaacatacttgaacatg

SEQ ID NO: 1145561 - DNA, 22 bp, Artificial Sequence
  chemically synthesized
ttaaaacatacttgaacatgag

SEQ ID NO: 1145562 - DNA, 22 bp, Artificial Sequence
  chemically synthesized
taaaacatacttgaacatgaga

SEQ ID NO: 1145563 - DNA, 22 bp, Artificial Sequence
  chemically synthesized
aaaacatacttgaacatgagat

SEQ ID NO: 1145564 - DNA, 22 bp, Artificial Sequence
  chemically synthesized
acacaaactggaatctcatgtt

SEQ ID NO: 1145565 - DNA, 22 bp, Artificial Sequence
  chemically synthesized
aaacatacttgaacatgagatt

SEQ ID NO: 1145566 - DNA, 22 bp, Artificial Sequence
  chemically synthesized
aacacaaactggaatctcatgt

SEQ ID NO: 1145567 - DNA, 22 bp, Artificial Sequence
  chemically synthesized
ataatatttaacacaaactgga

SEQ ID NO: 1145568 - DNA, 22 bp, Artificial Sequence
  chemically synthesized
gaacatgagattccagtttgtg

SEQ ID NO: 1145569 - DNA, 22 bp, Artificial Sequence
  chemically synthesized
aacatgagattccagtttgtgt

SEQ ID NO: 1145570 - DNA, 22 bp, Artificial Sequence
  chemically synthesized
attaataatatttaacacaaac

SEQ ID NO: 1145571 - DNA, 22 bp, Artificial Sequence
  chemically synthesized
cattaataatatttaacacaaa

SEQ ID NO: 1145572 - DNA, 22 bp, Artificial Sequence
  chemically synthesized
ttcattaataatatttaacaca

SEQ ID NO: 1145573 - DNA, 22 bp, Artificial Sequence
  chemically synthesized
ttcttcattaataatatttaac

SEQ ID NO: 1145574 - DNA, 22 bp, Artificial Sequence
  chemically synthesized
cagtttgtgttaaatattatta

SEQ ID NO: 1145575 - DNA, 22 bp, Artificial Sequence
  chemically synthesized
gtgttaaatattattaatgaag

SEQ ID NO: 1145576 - DNA, 22 bp, Artificial Sequence
  chemically synthesized
tgttaaatattattaatgaaga

SEQ ID NO: 1145577 - DNA, 22 bp, Artificial Sequence
  chemically synthesized
aatattattaatgaagaacagc

SEQ ID NO: 1145578 - DNA, 22 bp, Artificial Sequence
  chemically synthesized
tggaaagtggtgagctgttctt

SEQ ID NO: 1145579 - DNA, 22 bp, Artificial Sequence
  chemically synthesized
ttaatgaagaacagctcaccac

SEQ ID NO: 1145580 - DNA, 22 bp, Artificial Sequence
  chemically synthesized
atgaagaacagctcaccacttt

SEQ ID NO: 1145581 - DNA, 22 bp, Artificial Sequence
  chemically synthesized
caatgcgataagagctgtggaa

SEQ ID NO: 1145582 - DNA, 22 bp, Artificial Sequence
  chemically synthesized
acaatgcgataagagctgtgga

SEQ ID NO: 1145583 - DNA, 22 bp, Artificial Sequence
  chemically synthesized
ttacaatgcgataagagctgtg

SEQ ID NO: 1145584 - DNA, 22 bp, Artificial Sequence
  chemically synthesized
accactttccacagctcttatc

SEQ ID NO: 1145585 - DNA, 22 bp, Artificial Sequence
  chemically synthesized
tccacagctcttatcgcattgt

SEQ ID NO: 1145586 - DNA, 22 bp, Artificial Sequence
  chemically synthesized
ccacagctcttatcgcattgta

SEQ ID NO: 1145587 - DNA, 22 bp, Artificial Sequence
  chemically synthesized
cacagctcttatcgcattgtaa

SEQ ID NO: 1145588 - DNA, 22 bp, Artificial Sequence
  chemically synthesized
ttatcgcattgtaagaatgctc

SEQ ID NO: 1145589 - DNA, 22 bp, Artificial Sequence
  chemically synthesized
atcgcattgtaagaatgctctg

SEQ ID NO: 1145590 - DNA, 22 bp, Artificial Sequence
  chemically synthesized
tcatcatcagcccagagcattc

SEQ ID NO: 1145591 - DNA, 22 bp, Artificial Sequence
  chemically synthesized
tcgcattgtaagaatgctctgg

SEQ ID NO: 1145592 - DNA, 22 bp, Artificial Sequence
  chemically synthesized
ttatcatcatcagcccagagca

SEQ ID NO: 1145593 - DNA, 22 bp, Artificial Sequence
  chemically synthesized
ttattatcatcatcagcccaga

SEQ ID NO: 1145594 - DNA, 22 bp, Artificial Sequence
  chemically synthesized
taagaatgctctgggctgatga

SEQ ID NO: 1145595 - DNA, 22 bp, Artificial Sequence
  chemically synthesized
ctattattatcatcatcagccc

SEQ ID NO: 1145596 - DNA, 22 bp, Artificial Sequence
  chemically synthesized
gttactattattatcatcatca

SEQ ID NO: 1145597 - DNA, 22 bp, Artificial Sequence
  chemically synthesized
tgggctgatgatgataataata

SEQ ID NO: 1145598 - DNA, 22 bp, Artificial Sequence
  chemically synthesized
ggctgatgatgataataatagt

SEQ ID NO: 1145599 - DNA, 22 bp, Artificial Sequence
  chemically synthesized
atgatgataataatagtaacta

SEQ ID NO: 1145600 - DNA, 22 bp, Artificial Sequence
  chemically synthesized
aaatatagtaagcaataataat

SEQ ID NO: 1145601 - DNA, 22 bp, Artificial Sequence
  chemically synthesized
atattattattgcttactatat

SEQ ID NO: 1145602 - DNA, 22 bp, Artificial Sequence
  chemically synthesized
aaaatcactgaaatatagtaag

SEQ ID NO: 1145603 - DNA, 22 bp, Artificial Sequence
  chemically synthesized
aaaaatcactgaaatatagtaa

SEQ ID NO: 1145604 - DNA, 22 bp, Artificial Sequence
  chemically synthesized
ttattgcttactatatttcagt

SEQ ID NO: 1145605 - DNA, 22 bp, Artificial Sequence
  chemically synthesized
ttgcttactatatttcagtgat

SEQ ID NO: 1145606 - DNA, 22 bp, Artificial Sequence
  chemically synthesized
aagcatttaaaaatcactgaaa

SEQ ID NO: 1145607 - DNA, 22 bp, Artificial Sequence
  chemically synthesized
cttactatatttcagtgatttt

SEQ ID NO: 1145608 - DNA, 22 bp, Artificial Sequence
  chemically synthesized
actatatttcagtgatttttaa

SEQ ID NO: 1145609 - DNA, 22 bp, Artificial Sequence
  chemically synthesized
ctatatttcagtgatttttaaa

SEQ ID NO: 1145610 - DNA, 22 bp, Artificial Sequence
  chemically synthesized
agaagctaaagcatttaaaaat

SEQ ID NO: 1145611 - DNA, 22 bp, Artificial Sequence
  chemically synthesized
tatttcagtgatttttaaatgc

SEQ ID NO: 1145612 - DNA, 22 bp, Artificial Sequence
  chemically synthesized
cagtgatttttaaatgctttag

SEQ ID NO: 1145613 - DNA, 22 bp, Artificial Sequence
  chemically synthesized
agtgatttttaaatgctttagc

SEQ ID NO: 1145614 - DNA, 22 bp, Artificial Sequence
  chemically synthesized
ttaaatgctttagcttctcaac

SEQ ID NO: 1145615 - DNA, 22 bp, Artificial Sequence
  chemically synthesized
taaatgctttagcttctcaact

SEQ ID NO: 1145616 - DNA, 22 bp, Artificial Sequence
  chemically synthesized
aaatgctttagcttctcaacta

SEQ ID NO: 1145617 - DNA, 22 bp, Artificial Sequence
  chemically synthesized
aatgctttagcttctcaactac

SEQ ID NO: 1145618 - DNA, 22 bp, Artificial Sequence
  chemically synthesized
taaagggtaaaagggtagttga

SEQ ID NO: 1145619 - DNA, 22 bp, Artificial Sequence
  chemically synthesized
tagcttctcaactaccctttta

SEQ ID NO: 1145620 - DNA, 22 bp, Artificial Sequence
  chemically synthesized
agcttctcaactacccttttac

SEQ ID NO: 1145621 - DNA, 22 bp, Artificial Sequence
  chemically synthesized
gcttctcaactacccttttacc

SEQ ID NO: 1145622 - DNA, 22 bp, Artificial Sequence
  chemically synthesized
ctcaactacccttttacccttt

SEQ ID NO: 1145623 - DNA, 22 bp, Artificial Sequence
  chemically synthesized
tcagatatctgtaaagggtaaa

SEQ ID NO: 1145624 - DNA, 22 bp, Artificial Sequence
  chemically synthesized
tcaactacccttttacccttta

SEQ ID NO: 1145625 - DNA, 22 bp, Artificial Sequence
  chemically synthesized
aactacccttttaccctttaca

SEQ ID NO: 1145626 - DNA, 22 bp, Artificial Sequence
  chemically synthesized
cattatcagatatctgtaaagg

SEQ ID NO: 1145627 - DNA, 22 bp, Artificial Sequence
  chemically synthesized
cccttttaccctttacagatat

SEQ ID NO: 1145628 - DNA, 22 bp, Artificial Sequence
  chemically synthesized
gaacctacattatcagatatct

SEQ ID NO: 1145629 - DNA, 22 bp, Artificial Sequence
  chemically synthesized
ttaccctttacagatatctgat

SEQ ID NO: 1145630 - DNA, 22 bp, Artificial Sequence
  chemically synthesized
taccctttacagatatctgata

SEQ ID NO: 1145631 - DNA, 22 bp, Artificial Sequence
  chemically synthesized
accctttacagatatctgataa

SEQ ID NO: 1145632 - DNA, 22 bp, Artificial Sequence
  chemically synthesized
ccctttacagatatctgataat

SEQ ID NO: 1145633 - DNA, 22 bp, Artificial Sequence
  chemically synthesized
tattagaacctacattatcaga

SEQ ID NO: 1145634 - DNA, 22 bp, Artificial Sequence
  chemically synthesized
tacagatatctgataatgtagg

SEQ ID NO: 1145635 - DNA, 22 bp, Artificial Sequence
  chemically synthesized
acagatatctgataatgtaggt

SEQ ID NO: 1145636 - DNA, 22 bp, Artificial Sequence
  chemically synthesized
cagatatctgataatgtaggtt

SEQ ID NO: 1145637 - DNA, 22 bp, Artificial Sequence
  chemically synthesized
atatgaagattgtattagaacc

SEQ ID NO: 1145638 - DNA, 22 bp, Artificial Sequence
  chemically synthesized
aatatgaagattgtattagaac

SEQ ID NO: 1145639 - DNA, 22 bp, Artificial Sequence
  chemically synthesized
taatatgaagattgtattagaa

SEQ ID NO: 1145640 - DNA, 22 bp, Artificial Sequence
  chemically synthesized
ataatgtaggttctaatacaat

SEQ ID NO: 1145641 - DNA, 22 bp, Artificial Sequence
  chemically synthesized
cccatctttaatatgaagattg

SEQ ID NO: 1145642 - DNA, 22 bp, Artificial Sequence
  chemically synthesized
ccccatctttaatatgaagatt

SEQ ID NO: 1145643 - DNA, 22 bp, Artificial Sequence
  chemically synthesized
gtttccccatctttaatatgaa

SEQ ID NO: 1145644 - DNA, 22 bp, Artificial Sequence
  chemically synthesized
agtttccccatctttaatatga

SEQ ID NO: 1145645 - DNA, 22 bp, Artificial Sequence
  chemically synthesized
taatacaatcttcatattaaag

SEQ ID NO: 1145646 - DNA, 22 bp, Artificial Sequence
  chemically synthesized
tagtttccccatctttaatatg

SEQ ID NO: 1145647 - DNA, 22 bp, Artificial Sequence
  chemically synthesized
atacaatcttcatattaaagat

SEQ ID NO: 1145648 - DNA, 22 bp, Artificial Sequence
  chemically synthesized
gctttagtttccccatctttaa

SEQ ID NO: 1145649 - DNA, 22 bp, Artificial Sequence
  chemically synthesized
ggctttagtttccccatcttta

SEQ ID NO: 1145650 - DNA, 22 bp, Artificial Sequence
  chemically synthesized
catattaaagatggggaaacta

SEQ ID NO: 1145651 - DNA, 22 bp, Artificial Sequence
  chemically synthesized
atattaaagatggggaaactaa

SEQ ID NO: 1145652 - DNA, 22 bp, Artificial Sequence
  chemically synthesized
accatccttggctttagtttcc

SEQ ID NO: 1145653 - DNA, 22 bp, Artificial Sequence
  chemically synthesized
aaccatccttggctttagtttc

SEQ ID NO: 1145654 - DNA, 22 bp, Artificial Sequence
  chemically synthesized
aagatggggaaactaaagccaa

SEQ ID NO: 1145655 - DNA, 22 bp, Artificial Sequence
  chemically synthesized
ggcaagtcacttaaccatcctt

SEQ ID NO: 1145656 - DNA, 22 bp, Artificial Sequence
  chemically synthesized
gggcaagtcacttaaccatcct

SEQ ID NO: 1145657 - DNA, 22 bp, Artificial Sequence
  chemically synthesized
tgggcaagtcacttaaccatcc

SEQ ID NO: 1145658 - DNA, 22 bp, Artificial Sequence
  chemically synthesized
aagccaaggatggttaagtgac

SEQ ID NO: 1145659 - DNA, 22 bp, Artificial Sequence
  chemically synthesized
cagtatacctttgggcaagtca

SEQ ID NO: 1145660 - DNA, 22 bp, Artificial Sequence
  chemically synthesized
tctacagtatacctttgggcaa

SEQ ID NO: 1145661 - DNA, 22 bp, Artificial Sequence
  chemically synthesized
atctacagtatacctttgggca

SEQ ID NO: 1145662 - DNA, 22 bp, Artificial Sequence
  chemically synthesized
cttatctacagtatacctttgg

SEQ ID NO: 1145663 - DNA, 22 bp, Artificial Sequence
  chemically synthesized
agtgacttgcccaaaggtatac

SEQ ID NO: 1145664 - DNA, 22 bp, Artificial Sequence
  chemically synthesized
ttccttatctacagtatacctt

SEQ ID NO: 1145665 - DNA, 22 bp, Artificial Sequence
  chemically synthesized
tgttccttatctacagtatacc

SEQ ID NO: 1145666 - DNA, 22 bp, Artificial Sequence
  chemically synthesized
ctctgttccttatctacagtat

SEQ ID NO: 1145667 - DNA, 22 bp, Artificial Sequence
  chemically synthesized
gcccaaaggtatactgtagata

SEQ ID NO: 1145668 - DNA, 22 bp, Artificial Sequence
  chemically synthesized
cccaaaggtatactgtagataa

SEQ ID NO: 1145669 - DNA, 22 bp, Artificial Sequence
  chemically synthesized
ctgctctgttccttatctacag

SEQ ID NO: 1145670 - DNA, 22 bp, Artificial Sequence
  chemically synthesized
cctgctctgttccttatctaca

SEQ ID NO: 1145671 - DNA, 22 bp, Artificial Sequence
  chemically synthesized
gaaatagacccttcctgctctg

SEQ ID NO: 1145672 - DNA, 22 bp, Artificial Sequence
  chemically synthesized
tagataaggaacagagcaggaa

SEQ ID NO: 1145673 - DNA, 22 bp, Artificial Sequence
  chemically synthesized
tagaaatagacccttcctgctc

SEQ ID NO: 1145674 - DNA, 22 bp, Artificial Sequence
  chemically synthesized
agaggagaaactctagaaatag

SEQ ID NO: 1145675 - DNA, 22 bp, Artificial Sequence
  chemically synthesized
taaggtaattaagaggagaaac

SEQ ID NO: 1145676 - DNA, 22 bp, Artificial Sequence
  chemically synthesized
ttgtaaggtaattaagaggaga

SEQ ID NO: 1145677 - DNA, 22 bp, Artificial Sequence
  chemically synthesized
tttctagagtttctcctcttaa

SEQ ID NO: 1145678 - DNA, 22 bp, Artificial Sequence
  chemically synthesized
gttgtaaggtaattaagaggag

SEQ ID NO: 1145679 - DNA, 22 bp, Artificial Sequence
  chemically synthesized
tgttgtaaggtaattaagagga

SEQ ID NO: 1145680 - DNA, 22 bp, Artificial Sequence
  chemically synthesized
ttgttgtaaggtaattaagagg

SEQ ID NO: 1145681 - DNA, 22 bp, Artificial Sequence
  chemically synthesized
ctagagtttctcctcttaatta

SEQ ID NO: 1145682 - DNA, 22 bp, Artificial Sequence
  chemically synthesized
tttgttgtaaggtaattaagag

SEQ ID NO: 1145683 - DNA, 22 bp, Artificial Sequence
  chemically synthesized
tagagtttctcctcttaattac

SEQ ID NO: 1145684 - DNA, 22 bp, Artificial Sequence
  chemically synthesized
gagtttctcctcttaattacct

SEQ ID NO: 1145685 - DNA, 22 bp, Artificial Sequence
  chemically synthesized
ctcctcttaattaccttacaac

SEQ ID NO: 1145686 - DNA, 22 bp, Artificial Sequence
  chemically synthesized
tcctcttaattaccttacaaca

SEQ ID NO: 1145687 - DNA, 22 bp, Artificial Sequence
  chemically synthesized
ctcttaattaccttacaacaaa

SEQ ID NO: 1145688 - DNA, 22 bp, Artificial Sequence
  chemically synthesized
aaagggagagctttttgttgta

SEQ ID NO: 1145689 - DNA, 22 bp, Artificial Sequence
  chemically synthesized
aaaagggagagctttttgttgt

SEQ ID NO: 1145690 - DNA, 22 bp, Artificial Sequence
  chemically synthesized
ttaattaccttacaacaaaaag

SEQ ID NO: 1145691 - DNA, 22 bp, Artificial Sequence
  chemically synthesized
aattaccttacaacaaaaagct

SEQ ID NO: 1145692 - DNA, 22 bp, Artificial Sequence
  chemically synthesized
attaccttacaacaaaaagctc

SEQ ID NO: 1145693 - DNA, 22 bp, Artificial Sequence
  chemically synthesized
acttaaaagggagagctttttg

SEQ ID NO: 1145694 - DNA, 22 bp, Artificial Sequence
  chemically synthesized
gacttaaaagggagagcttttt

SEQ ID NO: 1145695 - DNA, 22 bp, Artificial Sequence
  chemically synthesized
tgacttaaaagggagagctttt

SEQ ID NO: 1145696 - DNA, 22 bp, Artificial Sequence
  chemically synthesized
ttgacttaaaagggagagcttt

SEQ ID NO: 1145697 - DNA, 22 bp, Artificial Sequence
  chemically synthesized
ccttacaacaaaaagctctccc

SEQ ID NO: 1145698 - DNA, 22 bp, Artificial Sequence
  chemically synthesized
tttgacttaaaagggagagctt

SEQ ID NO: 1145699 - DNA, 22 bp, Artificial Sequence
  chemically synthesized
ttttgacttaaaagggagagct

SEQ ID NO: 1145700 - DNA, 22 bp, Artificial Sequence
  chemically synthesized
acaacaaaaagctctccctttt

SEQ ID NO: 1145701 - DNA, 22 bp, Artificial Sequence
  chemically synthesized
caacaaaaagctctccctttta

SEQ ID NO: 1145702 - DNA, 22 bp, Artificial Sequence
  chemically synthesized
caagaaagatttttttgactta

SEQ ID NO: 1145703 - DNA, 22 bp, Artificial Sequence
  chemically synthesized
tcccttttaagtcaaaaaaatc

SEQ ID NO: 1145704 - DNA, 22 bp, Artificial Sequence
  chemically synthesized
ccttttaagtcaaaaaaatctt

SEQ ID NO: 1145705 - DNA, 22 bp, Artificial Sequence
  chemically synthesized
gatataattccaagaaagattt

SEQ ID NO: 1145706 - DNA, 22 bp, Artificial Sequence
  chemically synthesized
ttaagtcaaaaaaatctttctt

SEQ ID NO: 1145707 - DNA, 22 bp, Artificial Sequence
  chemically synthesized
taagtcaaaaaaatctttcttg

SEQ ID NO: 1145708 - DNA, 22 bp, Artificial Sequence
  chemically synthesized
aagtcaaaaaaatctttcttgg

SEQ ID NO: 1145709 - DNA, 22 bp, Artificial Sequence
  chemically synthesized
agtcaaaaaaatctttcttgga

SEQ ID NO: 1145710 - DNA, 22 bp, Artificial Sequence
  chemically synthesized
tgaacagacggttggatataat

SEQ ID NO: 1145711 - DNA, 22 bp, Artificial Sequence
  chemically synthesized
tcttggaattatatccaaccgt

SEQ ID NO: 1145712 - DNA, 22 bp, Artificial Sequence
  chemically synthesized
cttggaattatatccaaccgtc

SEQ ID NO: 1145713 - DNA, 22 bp, Artificial Sequence
  chemically synthesized
ttggaattatatccaaccgtct

SEQ ID NO: 1145714 - DNA, 22 bp, Artificial Sequence
  chemically synthesized
ggaattatatccaaccgtctgt

SEQ ID NO: 1145715 - DNA, 22 bp, Artificial Sequence
  chemically synthesized
gaattatatccaaccgtctgtt

SEQ ID NO: 1145716 - DNA, 22 bp, Artificial Sequence
  chemically synthesized
aatgaacctatgaacagacggt

SEQ ID NO: 1145717 - DNA, 22 bp, Artificial Sequence
  chemically synthesized
tatccaaccgtctgttcatagg

SEQ ID NO: 1145718 - DNA, 22 bp, Artificial Sequence
  chemically synthesized
taagataactgaatgaacctat

SEQ ID NO: 1145719 - DNA, 22 bp, Artificial Sequence
  chemically synthesized
gtaagataactgaatgaaccta

SEQ ID NO: 1145720 - DNA, 22 bp, Artificial Sequence
  chemically synthesized
ttgtaagataactgaatgaacc

SEQ ID NO: 1145721 - DNA, 22 bp, Artificial Sequence
  chemically synthesized
ttcataggttcattcagttatc

SEQ ID NO: 1145722 - DNA, 22 bp, Artificial Sequence
  chemically synthesized
ataggttcattcagttatctta

SEQ ID NO: 1145723 - DNA, 22 bp, Artificial Sequence
  chemically synthesized
attcagttatcttacaagaatt

SEQ ID NO: 1145724 - DNA, 22 bp, Artificial Sequence
  chemically synthesized
agttatcttacaagaattactg

SEQ ID NO: 1145725 - DNA, 22 bp, Artificial Sequence
  chemically synthesized
tcagatacaagtaatcagtaat

SEQ ID NO: 1145726 - DNA, 22 bp, Artificial Sequence
  chemically synthesized
tcttacaagaattactgattac

SEQ ID NO: 1145727 - DNA, 22 bp, Artificial Sequence
  chemically synthesized
cattgtcagatacaagtaatca

SEQ ID NO: 1145728 - DNA, 22 bp, Artificial Sequence
  chemically synthesized
acaagaattactgattacttgt

SEQ ID NO: 1145729 - DNA, 22 bp, Artificial Sequence
  chemically synthesized
caagaattactgattacttgta

SEQ ID NO: 1145730 - DNA, 22 bp, Artificial Sequence
  chemically synthesized
cctgcattgtcagatacaagta

SEQ ID NO: 1145731 - DNA, 22 bp, Artificial Sequence
  chemically synthesized
gcctgcattgtcagatacaagt

SEQ ID NO: 1145732 - DNA, 22 bp, Artificial Sequence
  chemically synthesized
ttgcctgcattgtcagatacaa

SEQ ID NO: 1145733 - DNA, 22 bp, Artificial Sequence
  chemically synthesized
ctgattacttgtatctgacaat

SEQ ID NO: 1145734 - DNA, 22 bp, Artificial Sequence
  chemically synthesized
attacttgtatctgacaatgca

SEQ ID NO: 1145735 - DNA, 22 bp, Artificial Sequence
  chemically synthesized
cacattcttgcctgcattgtca

SEQ ID NO: 1145736 - DNA, 22 bp, Artificial Sequence
  chemically synthesized
acacattcttgcctgcattgtc

SEQ ID NO: 1145737 - DNA, 22 bp, Artificial Sequence
  chemically synthesized
cttgtatctgacaatgcaggca

SEQ ID NO: 1145738 - DNA, 22 bp, Artificial Sequence
  chemically synthesized
gtatctgacaatgcaggcaaga

SEQ ID NO: 1145739 - DNA, 22 bp, Artificial Sequence
  chemically synthesized
tatctgacaatgcaggcaagaa

SEQ ID NO: 1145740 - DNA, 22 bp, Artificial Sequence
  chemically synthesized
acaatgcaggcaagaatgtgta

SEQ ID NO: 1145741 - DNA, 22 bp, Artificial Sequence
  chemically synthesized
catgagatgtgtcttacacatt

SEQ ID NO: 1145742 - DNA, 22 bp, Artificial Sequence
  chemically synthesized
aattacatgagatgtgtcttac

SEQ ID NO: 1145743 - DNA, 22 bp, Artificial Sequence
  chemically synthesized
gaatctaaattacatgagatgt

SEQ ID NO: 1145744 - DNA, 22 bp, Artificial Sequence
  chemically synthesized
ttagaatctaaattacatgaga

SEQ ID NO: 1145745 - DNA, 22 bp, Artificial Sequence
  chemically synthesized
attagaatctaaattacatgag

SEQ ID NO: 1145746 - DNA, 22 bp, Artificial Sequence
  chemically synthesized
tattagaatctaaattacatga

SEQ ID NO: 1145747 - DNA, 22 bp, Artificial Sequence
  chemically synthesized
ttattagaatctaaattacatg

SEQ ID NO: 1145748 - DNA, 22 bp, Artificial Sequence
  chemically synthesized
ttttattagaatctaaattaca

SEQ ID NO: 1145749 - DNA, 22 bp, Artificial Sequence
  chemically synthesized
ctcttttattagaatctaaatt

SEQ ID NO: 1145750 - DNA, 22 bp, Artificial Sequence
  chemically synthesized
actcttttattagaatctaaat

SEQ ID NO: 1145751 - DNA, 22 bp, Artificial Sequence
  chemically synthesized
tactcttttattagaatctaaa

SEQ ID NO: 1145752 - DNA, 22 bp, Artificial Sequence
  chemically synthesized
atgtaatttagattctaataaa

SEQ ID NO: 1145753 - DNA, 22 bp, Artificial Sequence
  chemically synthesized
atgtgctttactcttttattag

SEQ ID NO: 1145754 - DNA, 22 bp, Artificial Sequence
  chemically synthesized
atattaatgtgctttactcttt

SEQ ID NO: 1145755 - DNA, 22 bp, Artificial Sequence
  chemically synthesized
agattctaataaaagagtaaag

SEQ ID NO: 1145756 - DNA, 22 bp, Artificial Sequence
  chemically synthesized
gattctaataaaagagtaaagc

SEQ ID NO: 1145757 - DNA, 22 bp, Artificial Sequence
  chemically synthesized
cagttaatattaatgtgcttta

SEQ ID NO: 1145758 - DNA, 22 bp, Artificial Sequence
  chemically synthesized
taataaaagagtaaagcacatt

SEQ ID NO: 1145759 - DNA, 22 bp, Artificial Sequence
  chemically synthesized
gcagttaatattaatgtgcttt

SEQ ID NO: 1145760 - DNA, 22 bp, Artificial Sequence
  chemically synthesized
tgcagttaatattaatgtgctt

SEQ ID NO: 1145761 - DNA, 22 bp, Artificial Sequence
  chemically synthesized
ataaaagagtaaagcacattaa

SEQ ID NO: 1145762 - DNA, 22 bp, Artificial Sequence
  chemically synthesized
ttgcagttaatattaatgtgct

SEQ ID NO: 1145763 - DNA, 22 bp, Artificial Sequence
  chemically synthesized
ggcaccgatcatatacttttgc

SEQ ID NO: 1145764 - DNA, 22 bp, Artificial Sequence
  chemically synthesized
gggcaccgatcatatacttttg

SEQ ID NO: 1145765 - DNA, 22 bp, Artificial Sequence
  chemically synthesized
atattaactgcaaaagtatatg

SEQ ID NO: 1145766 - DNA, 22 bp, Artificial Sequence
  chemically synthesized
tttgggcaccgatcatatactt

SEQ ID NO: 1145767 - DNA, 22 bp, Artificial Sequence
  chemically synthesized
actgcaaaagtatatgatcggt

SEQ ID NO: 1145768 - DNA, 22 bp, Artificial Sequence
  chemically synthesized
tgtctgtttgggcaccgatcat

SEQ ID NO: 1145769 - DNA, 22 bp, Artificial Sequence
  chemically synthesized
caaaagtatatgatcggtgccc

SEQ ID NO: 1145770 - DNA, 22 bp, Artificial Sequence
  chemically synthesized
attgtgtctgtttgggcaccga

SEQ ID NO: 1145771 - DNA, 22 bp, Artificial Sequence
  chemically synthesized
taccctaattgtgtctgtttgg

SEQ ID NO: 1145772 - DNA, 22 bp, Artificial Sequence
  chemically synthesized
tgccatgtctgtaccctaattg

SEQ ID NO: 1145773 - DNA, 22 bp, Artificial Sequence
  chemically synthesized
gtgccatgtctgtaccctaatt

SEQ ID NO: 1145774 - DNA, 22 bp, Artificial Sequence
  chemically synthesized
tgtgccatgtctgtaccctaat

SEQ ID NO: 1145775 - DNA, 22 bp, Artificial Sequence
  chemically synthesized
tttgtgccatgtctgtacccta

SEQ ID NO: 1145776 - DNA, 22 bp, Artificial Sequence
  chemically synthesized
cctctttgtgccatgtctgtac

SEQ ID NO: 1145777 - DNA, 22 bp, Artificial Sequence
  chemically synthesized
ctccctctttgtgccatgtctg

SEQ ID NO: 1145778 - DNA, 22 bp, Artificial Sequence
  chemically synthesized
gggtacagacatggcacaaaga

SEQ ID NO: 1145779 - DNA, 22 bp, Artificial Sequence
  chemically synthesized
gtgatgactactccctctttgt

SEQ ID NO: 1145780 - DNA, 22 bp, Artificial Sequence
  chemically synthesized
cctagtgatgactactccctct

SEQ ID NO: 1145781 - DNA, 22 bp, Artificial Sequence
  chemically synthesized
tacctagtgatgactactccct

SEQ ID NO: 1145782 - DNA, 22 bp, Artificial Sequence
  chemically synthesized
gccactctacctagtgatgact

SEQ ID NO: 1145783 - DNA, 22 bp, Artificial Sequence
  chemically synthesized
catgaaattggccactctacct

SEQ ID NO: 1145784 - DNA, 22 bp, Artificial Sequence
  chemically synthesized
ctccatgaaattggccactcta

SEQ ID NO: 1145785 - DNA, 22 bp, Artificial Sequence
  chemically synthesized
cctccatgaaattggccactct

SEQ ID NO: 1145786 - DNA, 22 bp, Artificial Sequence
  chemically synthesized
tcctccatgaaattggccactc

SEQ ID NO: 1145787 - DNA, 22 bp, Artificial Sequence
  chemically synthesized
aagttttcctccatgaaattgg

SEQ ID NO: 1145788 - DNA, 22 bp, Artificial Sequence
  chemically synthesized
caagttttcctccatgaaattg

SEQ ID NO: 1145789 - DNA, 22 bp, Artificial Sequence
  chemically synthesized
ggtagagtggccaatttcatgg

SEQ ID NO: 1145790 - DNA, 22 bp, Artificial Sequence
  chemically synthesized
atttcaagttttcctccatgaa

SEQ ID NO: 1145791 - DNA, 22 bp, Artificial Sequence
  chemically synthesized
catggaggaaaacttgaaatga

SEQ ID NO: 1145792 - DNA, 22 bp, Artificial Sequence
  chemically synthesized
tgtatagaaaactcatttcaag

SEQ ID NO: 1145793 - DNA, 22 bp, Artificial Sequence
  chemically synthesized
atggaggaaaacttgaaatgag

SEQ ID NO: 1145794 - DNA, 22 bp, Artificial Sequence
  chemically synthesized
atctatgtatagaaaactcatt

SEQ ID NO: 1145795 - DNA, 22 bp, Artificial Sequence
  chemically synthesized
catctatgtatagaaaactcat

SEQ ID NO: 1145796 - DNA, 22 bp, Artificial Sequence
  chemically synthesized
ataatttcatctatgtatagaa

SEQ ID NO: 1145797 - DNA, 22 bp, Artificial Sequence
  chemically synthesized
gataatttcatctatgtataga

SEQ ID NO: 1145798 - DNA, 22 bp, Artificial Sequence
  chemically synthesized
gaaatgagttttctatacatag

SEQ ID NO: 1145799 - DNA, 22 bp, Artificial Sequence
  chemically synthesized
tgataatttcatctatgtatag

SEQ ID NO: 1145800 - DNA, 22 bp, Artificial Sequence
  chemically synthesized
aaatgagttttctatacataga

SEQ ID NO: 1145801 - DNA, 22 bp, Artificial Sequence
  chemically synthesized
ctttgataatttcatctatgta

SEQ ID NO: 1145802 - DNA, 22 bp, Artificial Sequence
  chemically synthesized
tctatacatagatgaaattatc

SEQ ID NO: 1145803 - DNA, 22 bp, Artificial Sequence
  chemically synthesized
ctatacatagatgaaattatca

SEQ ID NO: 1145804 - DNA, 22 bp, Artificial Sequence
  chemically synthesized
tatacatagatgaaattatcaa

SEQ ID NO: 1145805 - DNA, 22 bp, Artificial Sequence
  chemically synthesized
ataagatctgctttgataattt

SEQ ID NO: 1145806 - DNA, 22 bp, Artificial Sequence
  chemically synthesized
cataagatctgctttgataatt

SEQ ID NO: 1145807 - DNA, 22 bp, Artificial Sequence
  chemically synthesized
tacatagatgaaattatcaaag

SEQ ID NO: 1145808 - DNA, 22 bp, Artificial Sequence
  chemically synthesized
cttcataagatctgctttgata

SEQ ID NO: 1145809 - DNA, 22 bp, Artificial Sequence
  chemically synthesized
tgcttcataagatctgctttga

SEQ ID NO: 1145810 - DNA, 22 bp, Artificial Sequence
  chemically synthesized
tcaaagcagatcttatgaagca

SEQ ID NO: 1145811 - DNA, 22 bp, Artificial Sequence
  chemically synthesized
aacagacgactctgcttcataa

SEQ ID NO: 1145812 - DNA, 22 bp, Artificial Sequence
  chemically synthesized
aaacagacgactctgcttcata

SEQ ID NO: 1145813 - DNA, 22 bp, Artificial Sequence
  chemically synthesized
atgaagcagagtcgtctgttta

SEQ ID NO: 1145814 - DNA, 22 bp, Artificial Sequence
  chemically synthesized
tgaagcagagtcgtctgtttaa

SEQ ID NO: 1145815 - DNA, 22 bp, Artificial Sequence
  chemically synthesized
cacataccaccgggtttaaaca

SEQ ID NO: 1145816 - DNA, 22 bp, Artificial Sequence
  chemically synthesized
gcacataccaccgggtttaaac

SEQ ID NO: 1145817 - DNA, 22 bp, Artificial Sequence
  chemically synthesized
tgcacataccaccgggtttaaa

SEQ ID NO: 1145818 - DNA, 22 bp, Artificial Sequence
  chemically synthesized
tttgcacataccaccgggttta

SEQ ID NO: 1145819 - DNA, 22 bp, Artificial Sequence
  chemically synthesized
cgacctctttgcacataccacc

SEQ ID NO: 1145820 - DNA, 22 bp, Artificial Sequence
  chemically synthesized
tttaaacccggtggtatgtgca

SEQ ID NO: 1145821 - DNA, 22 bp, Artificial Sequence
  chemically synthesized
aaacccggtggtatgtgcaaag

SEQ ID NO: 1145822 - DNA, 22 bp, Artificial Sequence
  chemically synthesized
aacccggtggtatgtgcaaaga

SEQ ID NO: 1145823 - DNA, 22 bp, Artificial Sequence
  chemically synthesized
tatgttacgacctctttgcaca

SEQ ID NO: 1145824 - DNA, 22 bp, Artificial Sequence
  chemically synthesized
ataccctgtatgttacgacctc

SEQ ID NO: 1145825 - DNA, 22 bp, Artificial Sequence
  chemically synthesized
tgataccctgtatgttacgacc

SEQ ID NO: 1145826 - DNA, 22 bp, Artificial Sequence
  chemically synthesized
ctgataccctgtatgttacgac

SEQ ID NO: 1145827 - DNA, 22 bp, Artificial Sequence
  chemically synthesized
tttctgataccctgtatgttac

SEQ ID NO: 1145828 - DNA, 22 bp, Artificial Sequence
  chemically synthesized
atacaagctgtttctgataccc

SEQ ID NO: 1145829 - DNA, 22 bp, Artificial Sequence
  chemically synthesized
attcatacaagctgtttctgat

SEQ ID NO: 1145830 - DNA, 22 bp, Artificial Sequence
  chemically synthesized
gattcatacaagctgtttctga

SEQ ID NO: 1145831 - DNA, 22 bp, Artificial Sequence
  chemically synthesized
catttgattcatacaagctgtt

SEQ ID NO: 1145832 - DNA, 22 bp, Artificial Sequence
  chemically synthesized
aacctgcatttgattcatacaa

SEQ ID NO: 1145833 - DNA, 22 bp, Artificial Sequence
  chemically synthesized
tgtccctcaacctgcatttgat

SEQ ID NO: 1145834 - DNA, 22 bp, Artificial Sequence
  chemically synthesized
atgtccctcaacctgcatttga

SEQ ID NO: 1145835 - DNA, 22 bp, Artificial Sequence
  chemically synthesized
tatgtccctcaacctgcatttg

SEQ ID NO: 1145836 - DNA, 22 bp, Artificial Sequence
  chemically synthesized
ctttatgtccctcaacctgcat

SEQ ID NO: 1145837 - DNA, 22 bp, Artificial Sequence
  chemically synthesized
gtatgaatcaaatgcaggttga

SEQ ID NO: 1145838 - DNA, 22 bp, Artificial Sequence
  chemically synthesized
tatgaatcaaatgcaggttgag

SEQ ID NO: 1145839 - DNA, 22 bp, Artificial Sequence
  chemically synthesized
tctgctttatgtccctcaacct

SEQ ID NO: 1145840 - DNA, 22 bp, Artificial Sequence
  chemically synthesized
atgttatctgctttatgtccct

SEQ ID NO: 1145841 - DNA, 22 bp, Artificial Sequence
  chemically synthesized
tctcatgttatctgctttatgt

SEQ ID NO: 1145842 - DNA, 22 bp, Artificial Sequence
  chemically synthesized
gtctcatgttatctgctttatg

SEQ ID NO: 1145843 - DNA, 22 bp, Artificial Sequence
  chemically synthesized
agggacataaagcagataacat

SEQ ID NO: 1145844 - DNA, 22 bp, Artificial Sequence
  chemically synthesized
tagacttgtctcatgttatctg

SEQ ID NO: 1145845 - DNA, 22 bp, Artificial Sequence
  chemically synthesized
tatagacttgtctcatgttatc

SEQ ID NO: 1145846 - DNA, 22 bp, Artificial Sequence
  chemically synthesized
ccagtctctatagacttgtctc

SEQ ID NO: 1145847 - DNA, 22 bp, Artificial Sequence
  chemically synthesized
ctaccagtctctatagacttgt

SEQ ID NO: 1145848 - DNA, 22 bp, Artificial Sequence
  chemically synthesized
actcctaccagtctctatagac

SEQ ID NO: 1145849 - DNA, 22 bp, Artificial Sequence
  chemically synthesized
cctgactcctaccagtctctat

SEQ ID NO: 1145850 - DNA, 22 bp, Artificial Sequence
  chemically synthesized
attacctgactcctaccagtct

SEQ ID NO: 1145851 - DNA, 22 bp, Artificial Sequence
  chemically synthesized
gattacctgactcctaccagtc

SEQ ID NO: 1145852 - DNA, 22 bp, Artificial Sequence
  chemically synthesized
tagagactggtaggagtcaggt

SEQ ID NO: 1145853 - DNA, 22 bp, Artificial Sequence
  chemically synthesized
caaggtatttgattacctgact

SEQ ID NO: 1145854 - DNA, 22 bp, Artificial Sequence
  chemically synthesized
gcctacaaggtatttgattacc

SEQ ID NO: 1145855 - DNA, 22 bp, Artificial Sequence
  chemically synthesized
ggcctacaaggtatttgattac

SEQ ID NO: 1145856 - DNA, 22 bp, Artificial Sequence
  chemically synthesized
gtaggagtcaggtaatcaaata

SEQ ID NO: 1145857 - DNA, 22 bp, Artificial Sequence
  chemically synthesized
tggcctacaaggtatttgatta

SEQ ID NO: 1145858 - DNA, 22 bp, Artificial Sequence
  chemically synthesized
atactttggcctacaaggtatt

SEQ ID NO: 1145859 - DNA, 22 bp, Artificial Sequence
  chemically synthesized
tgatactttggcctacaaggta

SEQ ID NO: 1145860 - DNA, 22 bp, Artificial Sequence
  chemically synthesized
cagattctgatactttggccta

SEQ ID NO: 1145861 - DNA, 22 bp, Artificial Sequence
  chemically synthesized
ccagattctgatactttggcct

SEQ ID NO: 1145862 - DNA, 22 bp, Artificial Sequence
  chemically synthesized
tccagattctgatactttggcc

SEQ ID NO: 1145863 - DNA, 22 bp, Artificial Sequence
  chemically synthesized
agtcactttccagattctgata

SEQ ID NO: 1145864 - DNA, 22 bp, Artificial Sequence
  chemically synthesized
gtaggccaaagtatcagaatct

SEQ ID NO: 1145865 - DNA, 22 bp, Artificial Sequence
  chemically synthesized
taggccaaagtatcagaatctg

SEQ ID NO: 1145866 - DNA, 22 bp, Artificial Sequence
  chemically synthesized
aaatcctgagtcactttccaga

SEQ ID NO: 1145867 - DNA, 22 bp, Artificial Sequence
  chemically synthesized
aaaatcctgagtcactttccag

SEQ ID NO: 1145868 - DNA, 22 bp, Artificial Sequence
  chemically synthesized
cttaaaatcctgagtcactttc

SEQ ID NO: 1145869 - DNA, 22 bp, Artificial Sequence
  chemically synthesized
gcttaaaatcctgagtcacttt

SEQ ID NO: 1145870 - DNA, 22 bp, Artificial Sequence
  chemically synthesized
tgcttaaaatcctgagtcactt

SEQ ID NO: 1145871 - DNA, 22 bp, Artificial Sequence
  chemically synthesized
ctttgcttaaaatcctgagtca

SEQ ID NO: 1145872 - DNA, 22 bp, Artificial Sequence
  chemically synthesized
tcctttgcttaaaatcctgagt

SEQ ID NO: 1145873 - DNA, 22 bp, Artificial Sequence
  chemically synthesized
gaaagtgactcaggattttaag

SEQ ID NO: 1145874 - DNA, 22 bp, Artificial Sequence
  chemically synthesized
atcgttctcctttgcttaaaat

SEQ ID NO: 1145875 - DNA, 22 bp, Artificial Sequence
  chemically synthesized
aatcgttctcctttgcttaaaa

SEQ ID NO: 1145876 - DNA, 22 bp, Artificial Sequence
  chemically synthesized
tttaatcgttctcctttgctta

SEQ ID NO: 1145877 - DNA, 22 bp, Artificial Sequence
  chemically synthesized
aggattttaagcaaaggagaac

SEQ ID NO: 1145878 - DNA, 22 bp, Artificial Sequence
  chemically synthesized
ccaagagcctgtttaatcgttc

SEQ ID NO: 1145879 - DNA, 22 bp, Artificial Sequence
  chemically synthesized
taagcaaaggagaacgattaaa

SEQ ID NO: 1145880 - DNA, 22 bp, Artificial Sequence
  chemically synthesized
aagcaaaggagaacgattaaac

SEQ ID NO: 1145881 - DNA, 22 bp, Artificial Sequence
  chemically synthesized
agcaaaggagaacgattaaaca

SEQ ID NO: 1145882 - DNA, 22 bp, Artificial Sequence
  chemically synthesized
aagtcagtgtgggttcccaaga

SEQ ID NO: 1145883 - DNA, 22 bp, Artificial Sequence
  chemically synthesized
aacaggctcttgggaacccaca

SEQ ID NO: 1145884 - DNA, 22 bp, Artificial Sequence
  chemically synthesized
cacattgaagtcagtgtgggtt

SEQ ID NO: 1145885 - DNA, 22 bp, Artificial Sequence
  chemically synthesized
ttgggaacccacactgacttca

SEQ ID NO: 1145886 - DNA, 22 bp, Artificial Sequence
  chemically synthesized
gggaacccacactgacttcaat

SEQ ID NO: 1145887 - DNA, 22 bp, Artificial Sequence
  chemically synthesized
ggaacccacactgacttcaatg

SEQ ID NO: 1145888 - DNA, 22 bp, Artificial Sequence
  chemically synthesized
catccaatctccacattgaagt

SEQ ID NO: 1145889 - DNA, 22 bp, Artificial Sequence
  chemically synthesized
ccatccaatctccacattgaag

SEQ ID NO: 1145890 - DNA, 22 bp, Artificial Sequence
  chemically synthesized
ttccatccaatctccacattga

SEQ ID NO: 1145891 - DNA, 22 bp, Artificial Sequence
  chemically synthesized
ccgctcttccatccaatctcca

SEQ ID NO: 1145892 - DNA, 22 bp, Artificial Sequence
  chemically synthesized
accgctcttccatccaatctcc

SEQ ID NO: 1145893 - DNA, 22 bp, Artificial Sequence
  chemically synthesized
acttcaatgtggagattggatg

SEQ ID NO: 1145894 - DNA, 22 bp, Artificial Sequence
  chemically synthesized
caatgtggagattggatggaag

SEQ ID NO: 1145895 - DNA, 22 bp, Artificial Sequence
  chemically synthesized
agtcttaccgctcttccatcca

SEQ ID NO: 1145896 - DNA, 22 bp, Artificial Sequence
  chemically synthesized
aatgtggagattggatggaaga

SEQ ID NO: 1145897 - DNA, 22 bp, Artificial Sequence
  chemically synthesized
cagtcttaccgctcttccatcc

SEQ ID NO: 1145898 - DNA, 22 bp, Artificial Sequence
  chemically synthesized
ccttcagtcttaccgctcttcc

SEQ ID NO: 1145899 - DNA, 22 bp, Artificial Sequence
  chemically synthesized
gccttcagtcttaccgctcttc

SEQ ID NO: 1145900 - DNA, 22 bp, Artificial Sequence
  chemically synthesized
gatggaagagcggtaagactga

SEQ ID NO: 1145901 - DNA, 22 bp, Artificial Sequence
  chemically synthesized
aaggcaaggactttgggggctt

SEQ ID NO: 1145902 - DNA, 22 bp, Artificial Sequence
  chemically synthesized
aaggtataggccatatcataag

SEQ ID NO: 1145903 - DNA, 22 bp, Artificial Sequence
  chemically synthesized
tcaaggtataggccatatcata

SEQ ID NO: 1145904 - DNA, 22 bp, Artificial Sequence
  chemically synthesized
ctcaaggtataggccatatcat

SEQ ID NO: 1145905 - DNA, 22 bp, Artificial Sequence
  chemically synthesized
tgggggcttatgatatggccta

SEQ ID NO: 1145906 - DNA, 22 bp, Artificial Sequence
  chemically synthesized
gggggcttatgatatggcctat

SEQ ID NO: 1145907 - DNA, 22 bp, Artificial Sequence
  chemically synthesized
ggggcttatgatatggcctata

SEQ ID NO: 1145908 - DNA, 22 bp, Artificial Sequence
  chemically synthesized
tcaacatttctcaaggtatagg

SEQ ID NO: 1145909 - DNA, 22 bp, Artificial Sequence
  chemically synthesized
gtcaacatttctcaaggtatag

SEQ ID NO: 1145910 - DNA, 22 bp, Artificial Sequence
  chemically synthesized
atgatatggcctataccttgag

SEQ ID NO: 1145911 - DNA, 22 bp, Artificial Sequence
  chemically synthesized
ttgtcaacatttctcaaggtat

SEQ ID NO: 1145912 - DNA, 22 bp, Artificial Sequence
  chemically synthesized
tgatatggcctataccttgaga

SEQ ID NO: 1145913 - DNA, 22 bp, Artificial Sequence
  chemically synthesized
ttcttgtcaacatttctcaagg

SEQ ID NO: 1145914 - DNA, 22 bp, Artificial Sequence
  chemically synthesized
gttcttgtcaacatttctcaag

SEQ ID NO: 1145915 - DNA, 22 bp, Artificial Sequence
  chemically synthesized
tgttcttgtcaacatttctcaa

SEQ ID NO: 1145916 - DNA, 22 bp, Artificial Sequence
  chemically synthesized
atctttgttcttgtcaacattt

SEQ ID NO: 1145917 - DNA, 22 bp, Artificial Sequence
  chemically synthesized
catctttgttcttgtcaacatt

SEQ ID NO: 1145918 - DNA, 22 bp, Artificial Sequence
  chemically synthesized
taccttgagaaatgttgacaag

SEQ ID NO: 1145919 - DNA, 22 bp, Artificial Sequence
  chemically synthesized
tttcatctttgttcttgtcaac

SEQ ID NO: 1145920 - DNA, 22 bp, Artificial Sequence
  chemically synthesized
ttatttcatctttgttcttgtc

SEQ ID NO: 1145921 - DNA, 22 bp, Artificial Sequence
  chemically synthesized
attatttcatctttgttcttgt

SEQ ID NO: 1145922 - DNA, 22 bp, Artificial Sequence
  chemically synthesized
gagaaatgttgacaagaacaaa

SEQ ID NO: 1145923 - DNA, 22 bp, Artificial Sequence
  chemically synthesized
agaaatgttgacaagaacaaag

SEQ ID NO: 1145924 - DNA, 22 bp, Artificial Sequence
  chemically synthesized
tatttattatttcatctttgtt

SEQ ID NO: 1145925 - DNA, 22 bp, Artificial Sequence
  chemically synthesized
gtatttattatttcatctttgt

SEQ ID NO: 1145926 - DNA, 22 bp, Artificial Sequence
  chemically synthesized
tcttgtatttattatttcatct

SEQ ID NO: 1145927 - DNA, 22 bp, Artificial Sequence
  chemically synthesized
atcttgtatttattatttcatc

SEQ ID NO: 1145928 - DNA, 22 bp, Artificial Sequence
  chemically synthesized
acaagaacaaagatgaaataat

SEQ ID NO: 1145929 - DNA, 22 bp, Artificial Sequence
  chemically synthesized
aaccttatcttgtatttattat

SEQ ID NO: 1145930 - DNA, 22 bp, Artificial Sequence
  chemically synthesized
tcaaccttatcttgtatttatt

SEQ ID NO: 1145931 - DNA, 22 bp, Artificial Sequence
  chemically synthesized
ctcaaccttatcttgtatttat

SEQ ID NO: 1145932 - DNA, 22 bp, Artificial Sequence
  chemically synthesized
catgcaatgtcaaaatatttct

SEQ ID NO: 1145933 - DNA, 22 bp, Artificial Sequence
  chemically synthesized
gcatgcaatgtcaaaatatttc

SEQ ID NO: 1145934 - DNA, 22 bp, Artificial Sequence
  chemically synthesized
tgcatgcaatgtcaaaatattt

SEQ ID NO: 1145935 - DNA, 22 bp, Artificial Sequence
  chemically synthesized
tgagccctttgcatgcaatgtc

SEQ ID NO: 1145936 - DNA, 22 bp, Artificial Sequence
  chemically synthesized
agaaatattttgacattgcatg

SEQ ID NO: 1145937 - DNA, 22 bp, Artificial Sequence
  chemically synthesized
atgagccctttgcatgcaatgt

SEQ ID NO: 1145938 - DNA, 22 bp, Artificial Sequence
  chemically synthesized
ccttatgagccctttgcatgca

SEQ ID NO: 1145939 - DNA, 22 bp, Artificial Sequence
  chemically synthesized
cccttatgagccctttgcatgc

SEQ ID NO: 1145940 - DNA, 22 bp, Artificial Sequence
  chemically synthesized
tcccttatgagccctttgcatg

SEQ ID NO: 1145941 - DNA, 22 bp, Artificial Sequence
  chemically synthesized
tgacattgcatgcaaagggctc

SEQ ID NO: 1145942 - DNA, 22 bp, Artificial Sequence
  chemically synthesized
gacattgcatgcaaagggctca

SEQ ID NO: 1145943 - DNA, 22 bp, Artificial Sequence
  chemically synthesized
tcctttcccttatgagcccttt

SEQ ID NO: 1145944 - DNA, 22 bp, Artificial Sequence
  chemically synthesized
acattgcatgcaaagggctcat

SEQ ID NO: 1145945 - DNA, 22 bp, Artificial Sequence
  chemically synthesized
catgcaaagggctcataaggga

SEQ ID NO: 1145946 - DNA, 22 bp, Artificial Sequence
  chemically synthesized
atccctgtcctttcccttatga

SEQ ID NO: 1145947 - DNA, 22 bp, Artificial Sequence
  chemically synthesized
ataagggaaaggacagggatga

SEQ ID NO: 1145948 - DNA, 22 bp, Artificial Sequence
  chemically synthesized
gagtcatccccaaattcatccc

SEQ ID NO: 1145949 - DNA, 22 bp, Artificial Sequence
  chemically synthesized
taccagaaacctagagtcatcc

SEQ ID NO: 1145950 - DNA, 22 bp, Artificial Sequence
  chemically synthesized
ggggatgactctaggtttctgg

SEQ ID NO: 1145951 - DNA, 22 bp, Artificial Sequence
  chemically synthesized
gggatgactctaggtttctggt

SEQ ID NO: 1145952 - DNA, 22 bp, Artificial Sequence
  chemically synthesized
tcatgacacctgtaccagaaac

SEQ ID NO: 1145953 - DNA, 22 bp, Artificial Sequence
  chemically synthesized
atcatgacacctgtaccagaaa

SEQ ID NO: 1145954 - DNA, 22 bp, Artificial Sequence
  chemically synthesized
gcacttatcatgacacctgtac

SEQ ID NO: 1145955 - DNA, 22 bp, Artificial Sequence
  chemically synthesized
taggtttctggtacaggtgtca

SEQ ID NO: 1145956 - DNA, 22 bp, Artificial Sequence
  chemically synthesized
ggtttctggtacaggtgtcatg

SEQ ID NO: 1145957 - DNA, 22 bp, Artificial Sequence
  chemically synthesized
cactggcacttatcatgacacc

SEQ ID NO: 1145958 - DNA, 22 bp, Artificial Sequence
  chemically synthesized
ctggtacaggtgtcatgataag

SEQ ID NO: 1145959 - DNA, 22 bp, Artificial Sequence
  chemically synthesized
tggtacaggtgtcatgataagt

SEQ ID NO: 1145960 - DNA, 22 bp, Artificial Sequence
  chemically synthesized
tcattgcactggcacttatcat

SEQ ID NO: 1145961 - DNA, 22 bp, Artificial Sequence
  chemically synthesized
gtacaggtgtcatgataagtgc

SEQ ID NO: 1145962 - DNA, 22 bp, Artificial Sequence
  chemically synthesized
gtcattgcactggcacttatca

SEQ ID NO: 1145963 - DNA, 22 bp, Artificial Sequence
  chemically synthesized
tgtcattgcactggcacttatc

SEQ ID NO: 1145964 - DNA, 22 bp, Artificial Sequence
  chemically synthesized
ttgtcattgcactggcacttat

SEQ ID NO: 1145965 - DNA, 22 bp, Artificial Sequence
  chemically synthesized
tttttgtcattgcactggcact

SEQ ID NO: 1145966 - DNA, 22 bp, Artificial Sequence
  chemically synthesized
atttttgtcattgcactggcac

SEQ ID NO: 1145967 - DNA, 22 bp, Artificial Sequence
  chemically synthesized
ttatttttgtcattgcactggc

SEQ ID NO: 1145968 - DNA, 22 bp, Artificial Sequence
  chemically synthesized
cttatttttgtcattgcactgg

SEQ ID NO: 1145969 - DNA, 22 bp, Artificial Sequence
  chemically synthesized
aatttcttatttttgtcattgc

SEQ ID NO: 1145970 - DNA, 22 bp, Artificial Sequence
  chemically synthesized
ctgaatttcttatttttgtcat

SEQ ID NO: 1145971 - DNA, 22 bp, Artificial Sequence
  chemically synthesized
actgaatttcttatttttgtca

SEQ ID NO: 1145972 - DNA, 22 bp, Artificial Sequence
  chemically synthesized
cttactgaatttcttatttttg

SEQ ID NO: 1145973 - DNA, 22 bp, Artificial Sequence
  chemically synthesized
ccttactgaatttcttattttt

SEQ ID NO: 1145974 - DNA, 22 bp, Artificial Sequence
  chemically synthesized
tccttactgaatttcttatttt

SEQ ID NO: 1145975 - DNA, 22 bp, Artificial Sequence
  chemically synthesized
ctttccttactgaatttcttat

SEQ ID NO: 1145976 - DNA, 22 bp, Artificial Sequence
  chemically synthesized
aacctgctttccttactgaatt

SEQ ID NO: 1145977 - DNA, 22 bp, Artificial Sequence
  chemically synthesized
aaacctgctttccttactgaat

SEQ ID NO: 1145978 - DNA, 22 bp, Artificial Sequence
  chemically synthesized
taaacctgctttccttactgaa

SEQ ID NO: 1145979 - DNA, 22 bp, Artificial Sequence
  chemically synthesized
ctttaaacctgctttccttact

SEQ ID NO: 1145980 - DNA, 22 bp, Artificial Sequence
  chemically synthesized
cctttaaacctgctttccttac

SEQ ID NO: 1145981 - DNA, 22 bp, Artificial Sequence
  chemically synthesized
ccttcctttaaacctgctttcc

SEQ ID NO: 1145982 - DNA, 22 bp, Artificial Sequence
  chemically synthesized
agtaaggaaagcaggtttaaag

SEQ ID NO: 1145983 - DNA, 22 bp, Artificial Sequence
  chemically synthesized
tacattgccttcctttaaacct

SEQ ID NO: 1145984 - DNA, 22 bp, Artificial Sequence
  chemically synthesized
actgtacattgccttcctttaa

SEQ ID NO: 1145985 - DNA, 22 bp, Artificial Sequence
  chemically synthesized
cctcactgtacattgccttcct

SEQ ID NO: 1145986 - DNA, 22 bp, Artificial Sequence
  chemically synthesized
acctcactgtacattgccttcc

SEQ ID NO: 1145987 - DNA, 22 bp, Artificial Sequence
  chemically synthesized
aaaggaaggcaatgtacagtga

SEQ ID NO: 1145988 - DNA, 22 bp, Artificial Sequence
  chemically synthesized
aaggaaggcaatgtacagtgag

SEQ ID NO: 1145989 - DNA, 22 bp, Artificial Sequence
  chemically synthesized
aacaagatgaaacttacctcac

SEQ ID NO: 1145990 - DNA, 22 bp, Artificial Sequence
  chemically synthesized
aaactcaacaagatgaaactta

SEQ ID NO: 1145991 - DNA, 22 bp, Artificial Sequence
  chemically synthesized
caaactcaacaagatgaaactt

SEQ ID NO: 1145992 - DNA, 22 bp, Artificial Sequence
  chemically synthesized
aagtccaaacaacacttcaaac

SEQ ID NO: 1145993 - DNA, 22 bp, Artificial Sequence
  chemically synthesized
catcttgttgagtttgaagtgt

SEQ ID NO: 1145994 - DNA, 22 bp, Artificial Sequence
  chemically synthesized
gaagtccaaacaacacttcaaa

SEQ ID NO: 1145995 - DNA, 22 bp, Artificial Sequence
  chemically synthesized
atcttgttgagtttgaagtgtt

SEQ ID NO: 1145996 - DNA, 22 bp, Artificial Sequence
  chemically synthesized
gttgagtttgaagtgttgtttg

SEQ ID NO: 1145997 - DNA, 22 bp, Artificial Sequence
  chemically synthesized
ttgagtttgaagtgttgtttgg

SEQ ID NO: 1145998 - DNA, 22 bp, Artificial Sequence
  chemically synthesized
agtttgaagtgttgtttggact

SEQ ID NO: 1145999 - DNA, 22 bp, Artificial Sequence
  chemically synthesized
aacacatccttgaagtccaaac

SEQ ID NO: 1146000 - DNA, 22 bp, Artificial Sequence
  chemically synthesized
tgaacacatccttgaagtccaa

SEQ ID NO: 1146001 - DNA, 22 bp, Artificial Sequence
  chemically synthesized
ctgaacacatccttgaagtcca

SEQ ID NO: 1146002 - DNA, 22 bp, Artificial Sequence
  chemically synthesized
gaagtgttgtttggacttcaag

SEQ ID NO: 1146003 - DNA, 22 bp, Artificial Sequence
  chemically synthesized
aagtgttgtttggacttcaagg

SEQ ID NO: 1146004 - DNA, 22 bp, Artificial Sequence
  chemically synthesized
tcttctgaacacatccttgaag

SEQ ID NO: 1146005 - DNA, 22 bp, Artificial Sequence
  chemically synthesized
attatcttctgaacacatcctt

SEQ ID NO: 1146006 - DNA, 22 bp, Artificial Sequence
  chemically synthesized
tttggacttcaaggatgtgttc

SEQ ID NO: 1146007 - DNA, 22 bp, Artificial Sequence
  chemically synthesized
taattatcttctgaacacatcc

SEQ ID NO: 1146008 - DNA, 22 bp, Artificial Sequence
  chemically synthesized
ctaattatcttctgaacacatc

SEQ ID NO: 1146009 - DNA, 22 bp, Artificial Sequence
  chemically synthesized
ggacttcaaggatgtgttcaga

SEQ ID NO: 1146010 - DNA, 22 bp, Artificial Sequence
  chemically synthesized
ttctaattatcttctgaacaca

SEQ ID NO: 1146011 - DNA, 22 bp, Artificial Sequence
  chemically synthesized
gacttcaaggatgtgttcagaa

SEQ ID NO: 1146012 - DNA, 22 bp, Artificial Sequence
  chemically synthesized
cttctaattatcttctgaacac

SEQ ID NO: 1146013 - DNA, 22 bp, Artificial Sequence
  chemically synthesized
tcttctaattatcttctgaaca

SEQ ID NO: 1146014 - DNA, 22 bp, Artificial Sequence
  chemically synthesized
caaggatgtgttcagaagataa

SEQ ID NO: 1146015 - DNA, 22 bp, Artificial Sequence
  chemically synthesized
aaggatgtgttcagaagataat

SEQ ID NO: 1146016 - DNA, 22 bp, Artificial Sequence
  chemically synthesized
agtccattttcttctaattatc

SEQ ID NO: 1146017 - DNA, 22 bp, Artificial Sequence
  chemically synthesized
ctgagtccattttcttctaatt

SEQ ID NO: 1146018 - DNA, 22 bp, Artificial Sequence
  chemically synthesized
cctgagtccattttcttctaat

SEQ ID NO: 1146019 - DNA, 22 bp, Artificial Sequence
  chemically synthesized
tcctgagtccattttcttctaa

SEQ ID NO: 1146020 - DNA, 22 bp, Artificial Sequence
  chemically synthesized
agaagataattagaagaaaatg

SEQ ID NO: 1146021 - DNA, 22 bp, Artificial Sequence
  chemically synthesized
cccagatctttcctgagtccat

SEQ ID NO: 1146022 - DNA, 22 bp, Artificial Sequence
  chemically synthesized
tgcccagatctttcctgagtcc

SEQ ID NO: 1146023 - DNA, 22 bp, Artificial Sequence
  chemically synthesized
ctgcccagatctttcctgagtc

SEQ ID NO: 1146024 - DNA, 22 bp, Artificial Sequence
  chemically synthesized
gaagaaaatggactcaggaaag

SEQ ID NO: 1146025 - DNA, 22 bp, Artificial Sequence
  chemically synthesized
gatgtcttctgcccagatcttt

SEQ ID NO: 1146026 - DNA, 22 bp, Artificial Sequence
  chemically synthesized
tggatgtcttctgcccagatct

SEQ ID NO: 1146027 - DNA, 22 bp, Artificial Sequence
  chemically synthesized
aggaaagatctgggcagaagac

SEQ ID NO: 1146028 - DNA, 22 bp, Artificial Sequence
  chemically synthesized
gtaactctggatgtcttctgcc

SEQ ID NO: 1146029 - DNA, 22 bp, Artificial Sequence
  chemically synthesized
ggcagaagacatccagagttac

SEQ ID NO: 1146030 - DNA, 22 bp, Artificial Sequence
  chemically synthesized
ccaacttctgtctgcttctgat

SEQ ID NO: 1146031 - DNA, 22 bp, Artificial Sequence
  chemically synthesized
aaaatgtcataatatcagaagc

SEQ ID NO: 1146032 - DNA, 22 bp, Artificial Sequence
  chemically synthesized
caaaatgtcataatatcagaag

SEQ ID NO: 1146033 - DNA, 22 bp, Artificial Sequence
  chemically synthesized
tcaaaatgtcataatatcagaa

SEQ ID NO: 1146034 - DNA, 22 bp, Artificial Sequence
  chemically synthesized
ttcaaaatgtcataatatcaga

SEQ ID NO: 1146035 - DNA, 22 bp, Artificial Sequence
  chemically synthesized
ctgtctgcttctgatattatga

SEQ ID NO: 1146036 - DNA, 22 bp, Artificial Sequence
  chemically synthesized
tgtctgcttctgatattatgac

SEQ ID NO: 1146037 - DNA, 22 bp, Artificial Sequence
  chemically synthesized
tctgcttctgatattatgacat

SEQ ID NO: 1146038 - DNA, 22 bp, Artificial Sequence
  chemically synthesized
tggtttttcaaaatgtcataat

SEQ ID NO: 1146039 - DNA, 22 bp, Artificial Sequence
  chemically synthesized
tatggtttttcaaaatgtcata

SEQ ID NO: 1146040 - DNA, 22 bp, Artificial Sequence
  chemically synthesized
cttctgatattatgacattttg

SEQ ID NO: 1146041 - DNA, 22 bp, Artificial Sequence
  chemically synthesized
tctatggtttttcaaaatgtca

SEQ ID NO: 1146042 - DNA, 22 bp, Artificial Sequence
  chemically synthesized
ctctatggtttttcaaaatgtc

SEQ ID NO: 1146043 - DNA, 22 bp, Artificial Sequence
  chemically synthesized
tctctatggtttttcaaaatgt

SEQ ID NO: 1146044 - DNA, 22 bp, Artificial Sequence
  chemically synthesized
ctgatattatgacattttgaaa

SEQ ID NO: 1146045 - DNA, 22 bp, Artificial Sequence
  chemically synthesized
tgatattatgacattttgaaaa

SEQ ID NO: 1146046 - DNA, 22 bp, Artificial Sequence
  chemically synthesized
atattatgacattttgaaaaac

SEQ ID NO: 1146047 - DNA, 22 bp, Artificial Sequence
  chemically synthesized
tgacattttgaaaaaccataga

SEQ ID NO: 1146048 - DNA, 22 bp, Artificial Sequence
  chemically synthesized
tgaaaaaccatagagaaagtgc

SEQ ID NO: 1146049 - DNA, 22 bp, Artificial Sequence
  chemically synthesized
gaaaaaccatagagaaagtgcc

SEQ ID NO: 1146050 - DNA, 22 bp, Artificial Sequence
  chemically synthesized
aaaaaccatagagaaagtgcct

SEQ ID NO: 1146051 - DNA, 22 bp, Artificial Sequence
  chemically synthesized
tgatggtgaaaaaggaaggcac

SEQ ID NO: 1146052 - DNA, 22 bp, Artificial Sequence
  chemically synthesized
ttgtgatggtgaaaaaggaagg

SEQ ID NO: 1146053 - DNA, 22 bp, Artificial Sequence
  chemically synthesized
cctttttcaccatcacaatagt

SEQ ID NO: 1146054 - DNA, 22 bp, Artificial Sequence
  chemically synthesized
ctttttcaccatcacaatagtg

SEQ ID NO: 1146055 - DNA, 22 bp, Artificial Sequence
  chemically synthesized
tttcaccatcacaatagtgttc

SEQ ID NO: 1146056 - DNA, 22 bp, Artificial Sequence
  chemically synthesized
ttcaccatcacaatagtgttca

SEQ ID NO: 1146057 - DNA, 22 bp, Artificial Sequence
  chemically synthesized
tcaccatcacaatagtgttcat

SEQ ID NO: 1146058 - DNA, 22 bp, Artificial Sequence
  chemically synthesized
caccatcacaatagtgttcatg

SEQ ID NO: 1146059 - DNA, 22 bp, Artificial Sequence
  chemically synthesized
accatcacaatagtgttcatgt

SEQ ID NO: 1146060 - DNA, 22 bp, Artificial Sequence
  chemically synthesized
atcatagggaaatggcacatga

SEQ ID NO: 1146061 - DNA, 22 bp, Artificial Sequence
  chemically synthesized
aaaaataactaatcatagggaa

SEQ ID NO: 1146062 - DNA, 22 bp, Artificial Sequence
  chemically synthesized
atgtgccatttccctatgatta

SEQ ID NO: 1146063 - DNA, 22 bp, Artificial Sequence
  chemically synthesized
attaaaaaataactaatcatag

SEQ ID NO: 1146064 - DNA, 22 bp, Artificial Sequence
  chemically synthesized
aattaaaaaataactaatcata

SEQ ID NO: 1146065 - DNA, 22 bp, Artificial Sequence
  chemically synthesized
tttaattaaaaaataactaatc

SEQ ID NO: 1146066 - DNA, 22 bp, Artificial Sequence
  chemically synthesized
ccctatgattagttatttttta

SEQ ID NO: 1146067 - DNA, 22 bp, Artificial Sequence
  chemically synthesized
cctatgattagttattttttaa

SEQ ID NO: 1146068 - DNA, 22 bp, Artificial Sequence
  chemically synthesized
tgattagttattttttaattaa

SEQ ID NO: 1146069 - DNA, 22 bp, Artificial Sequence
  chemically synthesized
tagagtgggcgattatttaatt

SEQ ID NO: 1146070 - DNA, 22 bp, Artificial Sequence
  chemically synthesized
gtagagtgggcgattatttaat

SEQ ID NO: 1146071 - DNA, 22 bp, Artificial Sequence
  chemically synthesized
gttattttttaattaaataatc

SEQ ID NO: 1146072 - DNA, 22 bp, Artificial Sequence
  chemically synthesized
ttttttaattaaataatcgccc

SEQ ID NO: 1146073 - DNA, 22 bp, Artificial Sequence
  chemically synthesized
tttaattaaataatcgcccact

SEQ ID NO: 1146074 - DNA, 22 bp, Artificial Sequence
  chemically synthesized
ttaattaaataatcgcccactc

SEQ ID NO: 1146075 - DNA, 22 bp, Artificial Sequence
  chemically synthesized
taattaaataatcgcccactct

SEQ ID NO: 1146076 - DNA, 22 bp, Artificial Sequence
  chemically synthesized
aattaaataatcgcccactcta

SEQ ID NO: 1146077 - DNA, 22 bp, Artificial Sequence
  chemically synthesized
attaaataatcgcccactctac

SEQ ID NO: 1146078 - DNA, 22 bp, Artificial Sequence
  chemically synthesized
tgaagaatatttgtagagtggg

SEQ ID NO: 1146079 - DNA, 22 bp, Artificial Sequence
  chemically synthesized
aataatcgcccactctacaaat

SEQ ID NO: 1146080 - DNA, 22 bp, Artificial Sequence
  chemically synthesized
agatggcagcatcctgtgaaga

SEQ ID NO: 1146081 - DNA, 22 bp, Artificial Sequence
  chemically synthesized
tcagatggcagcatcctgtgaa

SEQ ID NO: 1146082 - DNA, 22 bp, Artificial Sequence
  chemically synthesized
tacaaatattcttcacaggatg

SEQ ID NO: 1146083 - DNA, 22 bp, Artificial Sequence
  chemically synthesized
ctcagatggcagcatcctgtga

SEQ ID NO: 1146084 - DNA, 22 bp, Artificial Sequence
  chemically synthesized
tctcagatggcagcatcctgtg

SEQ ID NO: 1146085 - DNA, 22 bp, Artificial Sequence
  chemically synthesized
caaatattcttcacaggatgct

SEQ ID NO: 1146086 - DNA, 22 bp, Artificial Sequence
  chemically synthesized
gcaggattttctcagatggcag

SEQ ID NO: 1146087 - DNA, 22 bp, Artificial Sequence
  chemically synthesized
ttcacaggatgctgccatctga

SEQ ID NO: 1146088 - DNA, 22 bp, Artificial Sequence
  chemically synthesized
agcaggattttctcagatggca

SEQ ID NO: 1146089 - DNA, 22 bp, Artificial Sequence
  chemically synthesized
cacaggatgctgccatctgaga

SEQ ID NO: 1146090 - DNA, 22 bp, Artificial Sequence
  chemically synthesized
acaggatgctgccatctgagaa

SEQ ID NO: 1146091 - DNA, 22 bp, Artificial Sequence
  chemically synthesized
tcttagcaggattttctcagat

SEQ ID NO: 1146092 - DNA, 22 bp, Artificial Sequence
  chemically synthesized
tatcttagcaggattttctcag

SEQ ID NO: 1146093 - DNA, 22 bp, Artificial Sequence
  chemically synthesized
gtactctatcttagcaggattt

SEQ ID NO: 1146094 - DNA, 22 bp, Artificial Sequence
  chemically synthesized
ccatctgagaaaatcctgctaa

SEQ ID NO: 1146095 - DNA, 22 bp, Artificial Sequence
  chemically synthesized
agaaaatcctgctaagatagag

SEQ ID NO: 1146096 - DNA, 22 bp, Artificial Sequence
  chemically synthesized
cgcccacgattggtactctatc

SEQ ID NO: 1146097 - DNA, 22 bp, Artificial Sequence
  chemically synthesized
acgcccacgattggtactctat

SEQ ID NO: 1146098 - DNA, 22 bp, Artificial Sequence
  chemically synthesized
tacgcccacgattggtactcta

SEQ ID NO: 1146099 - DNA, 22 bp, Artificial Sequence
  chemically synthesized
tattttacgcccacgattggta

SEQ ID NO: 1146100 - DNA, 22 bp, Artificial Sequence
  chemically synthesized
ctaagatagagtaccaatcgtg

SEQ ID NO: 1146101 - DNA, 22 bp, Artificial Sequence
  chemically synthesized
agatagagtaccaatcgtgggc

SEQ ID NO: 1146102 - DNA, 22 bp, Artificial Sequence
  chemically synthesized
aatacactgtattttacgccca

SEQ ID NO: 1146103 - DNA, 22 bp, Artificial Sequence
  chemically synthesized
gaatacactgtattttacgccc

SEQ ID NO: 1146104 - DNA, 22 bp, Artificial Sequence
  chemically synthesized
atttgaatacactgtattttac

SEQ ID NO: 1146105 - DNA, 22 bp, Artificial Sequence
  chemically synthesized
tgctgatttgaatacactgtat

SEQ ID NO: 1146106 - DNA, 22 bp, Artificial Sequence
  chemically synthesized
tatgctgatttgaatacactgt

SEQ ID NO: 1146107 - DNA, 22 bp, Artificial Sequence
  chemically synthesized
tactctatgctgatttgaatac

SEQ ID NO: 1146108 - DNA, 22 bp, Artificial Sequence
  chemically synthesized
ataattatactctatgctgatt

SEQ ID NO: 1146109 - DNA, 22 bp, Artificial Sequence
  chemically synthesized
catgaactaataattatactct

SEQ ID NO: 1146110 - DNA, 22 bp, Artificial Sequence
  chemically synthesized
aaatcagcatagagtataatta

SEQ ID NO: 1146111 - DNA, 22 bp, Artificial Sequence
  chemically synthesized
gattacatgaactaataattat

SEQ ID NO: 1146112 - DNA, 22 bp, Artificial Sequence
  chemically synthesized
tgatatagtgtctagattacat

SEQ ID NO: 1146113 - DNA, 22 bp, Artificial Sequence
  chemically synthesized
ttagttcatgtaatctagacac

SEQ ID NO: 1146114 - DNA, 22 bp, Artificial Sequence
  chemically synthesized
gttcatgtaatctagacactat

SEQ ID NO: 1146115 - DNA, 22 bp, Artificial Sequence
  chemically synthesized
atgtaatctagacactatatca

SEQ ID NO: 1146116 - DNA, 22 bp, Artificial Sequence
  chemically synthesized
atgcaatcacagactgtgatat

SEQ ID NO: 1146117 - DNA, 22 bp, Artificial Sequence
  chemically synthesized
gttaatgcaatcacagactgtg

SEQ ID NO: 1146118 - DNA, 22 bp, Artificial Sequence
  chemically synthesized
agttaatgcaatcacagactgt

SEQ ID NO: 1146119 - DNA, 22 bp, Artificial Sequence
  chemically synthesized
gacactatatcacagtctgtga

SEQ ID NO: 1146120 - DNA, 22 bp, Artificial Sequence
  chemically synthesized
ttagttaatgcaatcacagact

SEQ ID NO: 1146121 - DNA, 22 bp, Artificial Sequence
  chemically synthesized
tatcacagtctgtgattgcatt

SEQ ID NO: 1146122 - DNA, 22 bp, Artificial Sequence
  chemically synthesized
aggatgatacagattcttagtt

SEQ ID NO: 1146123 - DNA, 22 bp, Artificial Sequence
  chemically synthesized
tgattgcattaactaagaatct

SEQ ID NO: 1146124 - DNA, 22 bp, Artificial Sequence
  chemically synthesized
atattaaggatgatacagattc

SEQ ID NO: 1146125 - DNA, 22 bp, Artificial Sequence
  chemically synthesized
gatattaaggatgatacagatt

SEQ ID NO: 1146126 - DNA, 22 bp, Artificial Sequence
  chemically synthesized
cattaactaagaatctgtatca

SEQ ID NO: 1146127 - DNA, 22 bp, Artificial Sequence
  chemically synthesized
actaagaatctgtatcatcctt

SEQ ID NO: 1146128 - DNA, 22 bp, Artificial Sequence
  chemically synthesized
agaatctgtatcatccttaata

SEQ ID NO: 1146129 - DNA, 22 bp, Artificial Sequence
  chemically synthesized
aaacaagcttgatattaaggat

SEQ ID NO: 1146130 - DNA, 22 bp, Artificial Sequence
  chemically synthesized
gaaacaagcttgatattaagga

SEQ ID NO: 1146131 - DNA, 22 bp, Artificial Sequence
  chemically synthesized
tgaaacaagcttgatattaagg

SEQ ID NO: 1146132 - DNA, 22 bp, Artificial Sequence
  chemically synthesized
ctttgaaacaagcttgatatta

SEQ ID NO: 1146133 - DNA, 22 bp, Artificial Sequence
  chemically synthesized
actttgaaacaagcttgatatt

SEQ ID NO: 1146134 - DNA, 22 bp, Artificial Sequence
  chemically synthesized
tatcatccttaatatcaagctt

SEQ ID NO: 1146135 - DNA, 22 bp, Artificial Sequence
  chemically synthesized
aatatcaagcttgtttcaaagt

SEQ ID NO: 1146136 - DNA, 22 bp, Artificial Sequence
  chemically synthesized
atatcaagcttgtttcaaagta

SEQ ID NO: 1146137 - DNA, 22 bp, Artificial Sequence
  chemically synthesized
gtttcaaagtaagcatgtgcac

SEQ ID NO: 1146138 - DNA, 22 bp, Artificial Sequence
  chemically synthesized
tttcaaagtaagcatgtgcact

SEQ ID NO: 1146139 - DNA, 22 bp, Artificial Sequence
  chemically synthesized
caaagtaagcatgtgcactcta

SEQ ID NO: 1146140 - DNA, 22 bp, Artificial Sequence
  chemically synthesized
aaagtaagcatgtgcactctat

SEQ ID NO: 1146141 - DNA, 22 bp, Artificial Sequence
  chemically synthesized
tatctcatatgtgcttatgttt

SEQ ID NO: 1146142 - DNA, 22 bp, Artificial Sequence
  chemically synthesized
tctcatatgtgcttatgtttat

SEQ ID NO: 1146143 - DNA, 22 bp, Artificial Sequence
  chemically synthesized
atatgtgcttatgtttatgtat

SEQ ID NO: 1146144 - DNA, 22 bp, Artificial Sequence
  chemically synthesized
atgtttatgtatatgtatgtat

SEQ ID NO: 1146145 - DNA, 22 bp, Artificial Sequence
  chemically synthesized
tgtttatgtatatgtatgtata

SEQ ID NO: 1146146 - DNA, 22 bp, Artificial Sequence
  chemically synthesized
atgtatatgtatgtatatacat

SEQ ID NO: 1146147 - DNA, 22 bp, Artificial Sequence
  chemically synthesized
tgtatatgtatgtatatacata

SEQ ID NO: 1146148 - DNA, 22 bp, Artificial Sequence
  chemically synthesized
tgcatatgtatatatatgtata

SEQ ID NO: 1146149 - DNA, 22 bp, Artificial Sequence
  chemically synthesized
gtgcatatgtatatatatgtat

SEQ ID NO: 1146150 - DNA, 22 bp, Artificial Sequence
  chemically synthesized
tgtgcatatgtatatatatgta

SEQ ID NO: 1146151 - DNA, 22 bp, Artificial Sequence
  chemically synthesized
tatatatacatacgtacatctt

SEQ ID NO: 1146152 - DNA, 22 bp, Artificial Sequence
  chemically synthesized
tatatatatacatacgtacatc

SEQ ID NO: 1146153 - DNA, 22 bp, Artificial Sequence
  chemically synthesized
ctatatatatacatacgtacat

SEQ ID NO: 1146154 - DNA, 22 bp, Artificial Sequence
  chemically synthesized
tgtttctatatatatacatacg

SEQ ID NO: 1146155 - DNA, 22 bp, Artificial Sequence
  chemically synthesized
atgtttctatatatatacatac

SEQ ID NO: 1146156 - DNA, 22 bp, Artificial Sequence
  chemically synthesized
tatgtttctatatatatacata

SEQ ID NO: 1146157 - DNA, 22 bp, Artificial Sequence
  chemically synthesized
tttatgtttctatatatataca

SEQ ID NO: 1146158 - DNA, 22 bp, Artificial Sequence
  chemically synthesized
tatacatctctttatgtttcta

SEQ ID NO: 1146159 - DNA, 22 bp, Artificial Sequence
  chemically synthesized
atatacatctctttatgtttct

SEQ ID NO: 1146160 - DNA, 22 bp, Artificial Sequence
  chemically synthesized
aatttatatacatctctttatg

SEQ ID NO: 1146161 - DNA, 22 bp, Artificial Sequence
  chemically synthesized
tataaaaatatatgtataaatg

SEQ ID NO: 1146162 - DNA, 22 bp, Artificial Sequence
  chemically synthesized
aactatatacacatttatacat

SEQ ID NO: 1146163 - DNA, 22 bp, Artificial Sequence
  chemically synthesized
actatatacacatttatacata

SEQ ID NO: 1146164 - DNA, 22 bp, Artificial Sequence
  chemically synthesized
tctatataaaaatatatgtata

SEQ ID NO: 1146165 - DNA, 22 bp, Artificial Sequence
  chemically synthesized
gtctatataaaaatatatgtat

SEQ ID NO: 1146166 - DNA, 22 bp, Artificial Sequence
  chemically synthesized
tatacacatttatacatatatt

SEQ ID NO: 1146167 - DNA, 22 bp, Artificial Sequence
  chemically synthesized
tgtctatataaaaatatatgta

SEQ ID NO: 1146168 - DNA, 22 bp, Artificial Sequence
  chemically synthesized
atacatatatttttatatagac

SEQ ID NO: 1146169 - DNA, 22 bp, Artificial Sequence
  chemically synthesized
tacatatatttttatatagaca

SEQ ID NO: 1146170 - DNA, 22 bp, Artificial Sequence
  chemically synthesized
ttatatagacaaaattacatgt

SEQ ID NO: 1146171 - DNA, 22 bp, Artificial Sequence
  chemically synthesized
tatatagacaaaattacatgta

SEQ ID NO: 1146172 - DNA, 22 bp, Artificial Sequence
  chemically synthesized
atatagacaaaattacatgtat

SEQ ID NO: 1146173 - DNA, 22 bp, Artificial Sequence
  chemically synthesized
tatagacaaaattacatgtatt

SEQ ID NO: 1146174 - DNA, 22 bp, Artificial Sequence
  chemically synthesized
catgtatttttacacacttaca

SEQ ID NO: 1146175 - DNA, 22 bp, Artificial Sequence
  chemically synthesized
ttacacacttacatttatatat

SEQ ID NO: 1146176 - DNA, 22 bp, Artificial Sequence
  chemically synthesized
tacacacttacatttatatata

SEQ ID NO: 1146177 - DNA, 22 bp, Artificial Sequence
  chemically synthesized
acacacttacatttatatatat

SEQ ID NO: 1146178 - DNA, 22 bp, Artificial Sequence
  chemically synthesized
cacacttacatttatatatatt

SEQ ID NO: 1146179 - DNA, 22 bp, Artificial Sequence
  chemically synthesized
tagatataaatgtaaatatata

SEQ ID NO: 1146180 - DNA, 22 bp, Artificial Sequence
  chemically synthesized
acatttatatatatttacattt

SEQ ID NO: 1146181 - DNA, 22 bp, Artificial Sequence
  chemically synthesized
catttatatatatttacattta

SEQ ID NO: 1146182 - DNA, 22 bp, Artificial Sequence
  chemically synthesized
ccatctatagatataaatgtaa

SEQ ID NO: 1146183 - DNA, 22 bp, Artificial Sequence
  chemically synthesized
cccatctatagatataaatgta

SEQ ID NO: 1146184 - DNA, 22 bp, Artificial Sequence
  chemically synthesized
atatatatttacatttatatct

SEQ ID NO: 1146185 - DNA, 22 bp, Artificial Sequence
  chemically synthesized
tatatatttacatttatatcta

SEQ ID NO: 1146186 - DNA, 22 bp, Artificial Sequence
  chemically synthesized
acttcccatctatagatataaa

SEQ ID NO: 1146187 - DNA, 22 bp, Artificial Sequence
  chemically synthesized
acatttatatctatagatggga

SEQ ID NO: 1146188 - DNA, 22 bp, Artificial Sequence
  chemically synthesized
catttatatctatagatgggaa

SEQ ID NO: 1146189 - DNA, 22 bp, Artificial Sequence
  chemically synthesized
atatctatagatgggaagtcag

SEQ ID NO: 1146190 - DNA, 22 bp, Artificial Sequence
  chemically synthesized
tatctatagatgggaagtcaga

SEQ ID NO: 1146191 - DNA, 22 bp, Artificial Sequence
  chemically synthesized
agatacaaagggtctgacttcc

SEQ ID NO: 1146192 - DNA, 22 bp, Artificial Sequence
  chemically synthesized
gagatacaaagggtctgacttc

SEQ ID NO: 1146193 - DNA, 22 bp, Artificial Sequence
  chemically synthesized
gtttgagatacaaagggtctga

SEQ ID NO: 1146194 - DNA, 22 bp, Artificial Sequence
  chemically synthesized
tagatgggaagtcagacccttt

SEQ ID NO: 1146195 - DNA, 22 bp, Artificial Sequence
  chemically synthesized
aattagtttgagatacaaaggg

SEQ ID NO: 1146196 - DNA, 22 bp, Artificial Sequence
  chemically synthesized
tgtatctcaaactaattcaact

SEQ ID NO: 1146197 - DNA, 22 bp, Artificial Sequence
  chemically synthesized
gtatctcaaactaattcaactg

SEQ ID NO: 1146198 - DNA, 22 bp, Artificial Sequence
  chemically synthesized
tatctcaaactaattcaactga

SEQ ID NO: 1146199 - DNA, 22 bp, Artificial Sequence
  chemically synthesized
aaactaattcaactgatttata

SEQ ID NO: 1146200 - DNA, 22 bp, Artificial Sequence
  chemically synthesized
aaaatgcaagtagtataaatca

SEQ ID NO: 1146201 - DNA, 22 bp, Artificial Sequence
  chemically synthesized
aaaaatgcaagtagtataaatc

SEQ ID NO: 1146202 - DNA, 22 bp, Artificial Sequence
  chemically synthesized
taaaaatgcaagtagtataaat

SEQ ID NO: 1146203 - DNA, 22 bp, Artificial Sequence
  chemically synthesized
ttaaaaatgcaagtagtataaa

SEQ ID NO: 1146204 - DNA, 22 bp, Artificial Sequence
  chemically synthesized
tttaaaaatgcaagtagtataa

SEQ ID NO: 1146205 - DNA, 22 bp, Artificial Sequence
  chemically synthesized
attcaactgatttatactactt

SEQ ID NO: 1146206 - DNA, 22 bp, Artificial Sequence
  chemically synthesized
ctttttaaaaatgcaagtagta

SEQ ID NO: 1146207 - DNA, 22 bp, Artificial Sequence
  chemically synthesized
aactgatttatactacttgcat

SEQ ID NO: 1146208 - DNA, 22 bp, Artificial Sequence
  chemically synthesized
ctgctttttaaaaatgcaagta

SEQ ID NO: 1146209 - DNA, 22 bp, Artificial Sequence
  chemically synthesized
atttatactacttgcattttta

SEQ ID NO: 1146210 - DNA, 22 bp, Artificial Sequence
  chemically synthesized
atactacttgcatttttaaaaa

SEQ ID NO: 1146211 - DNA, 22 bp, Artificial Sequence
  chemically synthesized
tactacttgcatttttaaaaag

SEQ ID NO: 1146212 - DNA, 22 bp, Artificial Sequence
  chemically synthesized
gaaatgttgctgctttttaaaa

SEQ ID NO: 1146213 - DNA, 22 bp, Artificial Sequence
  chemically synthesized
cttgcatttttaaaaagcagca

SEQ ID NO: 1146214 - DNA, 22 bp, Artificial Sequence
  chemically synthesized
tagttcgaaatgttgctgcttt

SEQ ID NO: 1146215 - DNA, 22 bp, Artificial Sequence
  chemically synthesized
atagttcgaaatgttgctgctt

SEQ ID NO: 1146216 - DNA, 22 bp, Artificial Sequence
  chemically synthesized
gcatttttaaaaagcagcaaca

SEQ ID NO: 1146217 - DNA, 22 bp, Artificial Sequence
  chemically synthesized
catttttaaaaagcagcaacat

SEQ ID NO: 1146218 - DNA, 22 bp, Artificial Sequence
  chemically synthesized
atgtttatagttcgaaatgttg

SEQ ID NO: 1146219 - DNA, 22 bp, Artificial Sequence
  chemically synthesized
ttaaaaagcagcaacatttcga

SEQ ID NO: 1146220 - DNA, 22 bp, Artificial Sequence
  chemically synthesized
taaaaagcagcaacatttcgaa

SEQ ID NO: 1146221 - DNA, 22 bp, Artificial Sequence
  chemically synthesized
aaaaagcagcaacatttcgaac

SEQ ID NO: 1146222 - DNA, 22 bp, Artificial Sequence
  chemically synthesized
aaaagcagcaacatttcgaact

SEQ ID NO: 1146223 - DNA, 22 bp, Artificial Sequence
  chemically synthesized
agtcagaaaactcatgtttata

SEQ ID NO: 1146224 - DNA, 22 bp, Artificial Sequence
  chemically synthesized
aagtcagaaaactcatgtttat

SEQ ID NO: 1146225 - DNA, 22 bp, Artificial Sequence
  chemically synthesized
taagtcagaaaactcatgttta

SEQ ID NO: 1146226 - DNA, 22 bp, Artificial Sequence
  chemically synthesized
ttttaagtcagaaaactcatgt

SEQ ID NO: 1146227 - DNA, 22 bp, Artificial Sequence
  chemically synthesized
cgaactataaacatgagttttc

SEQ ID NO: 1146228 - DNA, 22 bp, Artificial Sequence
  chemically synthesized
gaactataaacatgagttttct

SEQ ID NO: 1146229 - DNA, 22 bp, Artificial Sequence
  chemically synthesized
ttgttttaagtcagaaaactca

SEQ ID NO: 1146230 - DNA, 22 bp, Artificial Sequence
  chemically synthesized
taaacatgagttttctgactta

SEQ ID NO: 1146231 - DNA, 22 bp, Artificial Sequence
  chemically synthesized
catcctattgttttaagtcaga

SEQ ID NO: 1146232 - DNA, 22 bp, Artificial Sequence
  chemically synthesized
tctgacttaaaacaataggatg

SEQ ID NO: 1146233 - DNA, 22 bp, Artificial Sequence
  chemically synthesized
ctgacttaaaacaataggatgt

SEQ ID NO: 1146234 - DNA, 22 bp, Artificial Sequence
  chemically synthesized
tgacttaaaacaataggatgta

SEQ ID NO: 1146235 - DNA, 22 bp, Artificial Sequence
  chemically synthesized
acttaaaacaataggatgtaac

SEQ ID NO: 1146236 - DNA, 22 bp, Artificial Sequence
  chemically synthesized
aaaacaataggatgtaacattt

SEQ ID NO: 1146237 - DNA, 22 bp, Artificial Sequence
  chemically synthesized
aaacaataggatgtaacatttg

SEQ ID NO: 1146238 - DNA, 22 bp, Artificial Sequence
  chemically synthesized
gaatatcatatacaaatgttac

SEQ ID NO: 1146239 - DNA, 22 bp, Artificial Sequence
  chemically synthesized
aggagttagaatatcatataca

SEQ ID NO: 1146240 - DNA, 22 bp, Artificial Sequence
  chemically synthesized
tgtcctgaggagttagaatatc

SEQ ID NO: 1146241 - DNA, 22 bp, Artificial Sequence
  chemically synthesized
gtatatgatattctaactcctc

SEQ ID NO: 1146242 - DNA, 22 bp, Artificial Sequence
  chemically synthesized
tagctatgtcctgaggagttag

SEQ ID NO: 1146243 - DNA, 22 bp, Artificial Sequence
  chemically synthesized
tatatgatattctaactcctca

SEQ ID NO: 1146244 - DNA, 22 bp, Artificial Sequence
  chemically synthesized
atagctatgtcctgaggagtta

SEQ ID NO: 1146245 - DNA, 22 bp, Artificial Sequence
  chemically synthesized
gaaggtttatagctatgtcctg

SEQ ID NO: 1146246 - DNA, 22 bp, Artificial Sequence
  chemically synthesized
agaaggtttatagctatgtcct

SEQ ID NO: 1146247 - DNA, 22 bp, Artificial Sequence
  chemically synthesized
taactcctcaggacatagctat

SEQ ID NO: 1146248 - DNA, 22 bp, Artificial Sequence
  chemically synthesized
acttagaaggtttatagctatg

SEQ ID NO: 1146249 - DNA, 22 bp, Artificial Sequence
  chemically synthesized
actcctcaggacatagctataa

SEQ ID NO: 1146250 - DNA, 22 bp, Artificial Sequence
  chemically synthesized
ctcaggacatagctataaacct

SEQ ID NO: 1146251 - DNA, 22 bp, Artificial Sequence
  chemically synthesized
aggacatagctataaaccttct

SEQ ID NO: 1146252 - DNA, 22 bp, Artificial Sequence
  chemically synthesized
ccatattaacttagaaggttta

SEQ ID NO: 1146253 - DNA, 22 bp, Artificial Sequence
  chemically synthesized
ctcccatattaacttagaaggt

SEQ ID NO: 1146254 - DNA, 22 bp, Artificial Sequence
  chemically synthesized
tgctcccatattaacttagaag

SEQ ID NO: 1146255 - DNA, 22 bp, Artificial Sequence
  chemically synthesized
ctgctcccatattaacttagaa

SEQ ID NO: 1146256 - DNA, 22 bp, Artificial Sequence
  chemically synthesized
taaaccttctaagttaatatgg

SEQ ID NO: 1146257 - DNA, 22 bp, Artificial Sequence
  chemically synthesized
atggaatatttctgctcccata

SEQ ID NO: 1146258 - DNA, 22 bp, Artificial Sequence
  chemically synthesized
ctaagttaatatgggagcagaa

SEQ ID NO: 1146259 - DNA, 22 bp, Artificial Sequence
  chemically synthesized
taagttaatatgggagcagaaa

SEQ ID NO: 1146260 - DNA, 22 bp, Artificial Sequence
  chemically synthesized
agttaatatgggagcagaaata

SEQ ID NO: 1146261 - DNA, 22 bp, Artificial Sequence
  chemically synthesized
atatgggagcagaaatattcca

SEQ ID NO: 1146262 - DNA, 22 bp, Artificial Sequence
  chemically synthesized
taggagtggttaatggaatatt

SEQ ID NO: 1146263 - DNA, 22 bp, Artificial Sequence
  chemically synthesized
tgtaaagtgtgcccctgtagga

SEQ ID NO: 1146264 - DNA, 22 bp, Artificial Sequence
  chemically synthesized
cattaaccactcctacaggggc

SEQ ID NO: 1146265 - DNA, 22 bp, Artificial Sequence
  chemically synthesized
tgtgtaaagtgtgcccctgtag

SEQ ID NO: 1146266 - DNA, 22 bp, Artificial Sequence
  chemically synthesized
accactcctacaggggcacact

SEQ ID NO: 1146267 - DNA, 22 bp, Artificial Sequence
  chemically synthesized
gggctctgtgtaaagtgtgccc

SEQ ID NO: 1146268 - DNA, 22 bp, Artificial Sequence
  chemically synthesized
gctggggctctgtgtaaagtgt

SEQ ID NO: 1146269 - DNA, 22 bp, Artificial Sequence
  chemically synthesized
agctggggctctgtgtaaagtg

SEQ ID NO: 1146270 - DNA, 22 bp, Artificial Sequence
  chemically synthesized
ctacaggggcacactttacaca

SEQ ID NO: 1146271 - DNA, 22 bp, Artificial Sequence
  chemically synthesized
caggggcacactttacacagag

SEQ ID NO: 1146272 - DNA, 22 bp, Artificial Sequence
  chemically synthesized
aggatttagctggggctctgtg

SEQ ID NO: 1146273 - DNA, 22 bp, Artificial Sequence
  chemically synthesized
gaggatttagctggggctctgt

SEQ ID NO: 1146274 - DNA, 22 bp, Artificial Sequence
  chemically synthesized
tacacagagccccagctaaatc

SEQ ID NO: 1146275 - DNA, 22 bp, Artificial Sequence
  chemically synthesized
acacagagccccagctaaatcc

SEQ ID NO: 1146276 - DNA, 22 bp, Artificial Sequence
  chemically synthesized
cacagagccccagctaaatcct

SEQ ID NO: 1146277 - DNA, 22 bp, Artificial Sequence
  chemically synthesized
gggaaggaagccatttgaggat

SEQ ID NO: 1146278 - DNA, 22 bp, Artificial Sequence
  chemically synthesized
tggggaaggaagccatttgagg

SEQ ID NO: 1146279 - DNA, 22 bp, Artificial Sequence
  chemically synthesized
aaaattctggggaaggaagcca

SEQ ID NO: 1146280 - DNA, 22 bp, Artificial Sequence
  chemically synthesized
aatcctcaaatggcttccttcc

SEQ ID NO: 1146281 - DNA, 22 bp, Artificial Sequence
  chemically synthesized
cgtgctgaaaattctggggaag

SEQ ID NO: 1146282 - DNA, 22 bp, Artificial Sequence
  chemically synthesized
acgtgctgaaaattctggggaa

SEQ ID NO: 1146283 - DNA, 22 bp, Artificial Sequence
  chemically synthesized
aaatggcttccttccccagaat

SEQ ID NO: 1146284 - DNA, 22 bp, Artificial Sequence
  chemically synthesized
atttacgtgctgaaaattctgg

SEQ ID NO: 1146285 - DNA, 22 bp, Artificial Sequence
  chemically synthesized
ccttccccagaattttcagcac

SEQ ID NO: 1146286 - DNA, 22 bp, Artificial Sequence
  chemically synthesized
cttccccagaattttcagcacg

SEQ ID NO: 1146287 - DNA, 22 bp, Artificial Sequence
  chemically synthesized
gtatctgatttacgtgctgaaa

SEQ ID NO: 1146288 - DNA, 22 bp, Artificial Sequence
  chemically synthesized
tagtatctgatttacgtgctga

SEQ ID NO: 1146289 - DNA, 22 bp, Artificial Sequence
  chemically synthesized
ccccagaattttcagcacgtaa

SEQ ID NO: 1146290 - DNA, 22 bp, Artificial Sequence
  chemically synthesized
ctagtatctgatttacgtgctg

SEQ ID NO: 1146291 - DNA, 22 bp, Artificial Sequence
  chemically synthesized
cccagaattttcagcacgtaaa

SEQ ID NO: 1146292 - DNA, 22 bp, Artificial Sequence
  chemically synthesized
tctagtatctgatttacgtgct

SEQ ID NO: 1146293 - DNA, 22 bp, Artificial Sequence
  chemically synthesized
ctttctagtatctgatttacgt

SEQ ID NO: 1146294 - DNA, 22 bp, Artificial Sequence
  chemically synthesized
tcagcacgtaaatcagatacta

SEQ ID NO: 1146295 - DNA, 22 bp, Artificial Sequence
  chemically synthesized
cagcacgtaaatcagatactag

SEQ ID NO: 1146296 - DNA, 22 bp, Artificial Sequence
  chemically synthesized
atatattcctttctagtatctg

SEQ ID NO: 1146297 - DNA, 22 bp, Artificial Sequence
  chemically synthesized
agcacgtaaatcagatactaga

SEQ ID NO: 1146298 - DNA, 22 bp, Artificial Sequence
  chemically synthesized
aatatattcctttctagtatct

SEQ ID NO: 1146299 - DNA, 22 bp, Artificial Sequence
  chemically synthesized
taatatattcctttctagtatc

SEQ ID NO: 1146300 - DNA, 22 bp, Artificial Sequence
  chemically synthesized
tgttttaatatattcctttcta

SEQ ID NO: 1146301 - DNA, 22 bp, Artificial Sequence
  chemically synthesized
gtgggtgagtctgtgttttaat

SEQ ID NO: 1146302 - DNA, 22 bp, Artificial Sequence
  chemically synthesized
gaaaggaatatattaaaacaca

SEQ ID NO: 1146303 - DNA, 22 bp, Artificial Sequence
  chemically synthesized
tgagtgttcgtgggtgagtctg

SEQ ID NO: 1146304 - DNA, 22 bp, Artificial Sequence
  chemically synthesized
tatgagtgttcgtgggtgagtc

SEQ ID NO: 1146305 - DNA, 22 bp, Artificial Sequence
  chemically synthesized
tctatgagtgttcgtgggtgag

SEQ ID NO: 1146306 - DNA, 22 bp, Artificial Sequence
  chemically synthesized
ctctatgagtgttcgtgggtga

SEQ ID NO: 1146307 - DNA, 22 bp, Artificial Sequence
  chemically synthesized
tctctatgagtgttcgtgggtg

SEQ ID NO: 1146308 - DNA, 22 bp, Artificial Sequence
  chemically synthesized
aaacacagactcacccacgaac

SEQ ID NO: 1146309 - DNA, 22 bp, Artificial Sequence
  chemically synthesized
tctttctctatgagtgttcgtg

SEQ ID NO: 1146310 - DNA, 22 bp, Artificial Sequence
  chemically synthesized
acccacgaacactcatagagaa

SEQ ID NO: 1146311 - DNA, 22 bp, Artificial Sequence
  chemically synthesized
gtaaggtgagtctatctttctc

SEQ ID NO: 1146312 - DNA, 22 bp, Artificial Sequence
  chemically synthesized
ttggtaaggtgagtctatcttt

SEQ ID NO: 1146313 - DNA, 22 bp, Artificial Sequence
  chemically synthesized
attggtaaggtgagtctatctt

SEQ ID NO: 1146314 - DNA, 22 bp, Artificial Sequence
  chemically synthesized
tttattggtaaggtgagtctat

SEQ ID NO: 1146315 - DNA, 22 bp, Artificial Sequence
  chemically synthesized
atagagaaagatagactcacct

SEQ ID NO: 1146316 - DNA, 22 bp, Artificial Sequence
  chemically synthesized
cgtgatactgtttattggtaag

SEQ ID NO: 1146317 - DNA, 22 bp, Artificial Sequence
  chemically synthesized
tgcgtgatactgtttattggta

SEQ ID NO: 1146318 - DNA, 22 bp, Artificial Sequence
  chemically synthesized
accttaccaataaacagtatca

SEQ ID NO: 1146319 - DNA, 22 bp, Artificial Sequence
  chemically synthesized
gcaaagcctctgcgtgatactg

SEQ ID NO: 1146320 - DNA, 22 bp, Artificial Sequence
  chemically synthesized
agcaaagcctctgcgtgatact

SEQ ID NO: 1146321 - DNA, 22 bp, Artificial Sequence
  chemically synthesized
tagcaaagcctctgcgtgatac

SEQ ID NO: 1146322 - DNA, 22 bp, Artificial Sequence
  chemically synthesized
accaataaacagtatcacgcag

SEQ ID NO: 1146323 - DNA, 22 bp, Artificial Sequence
  chemically synthesized
ttagcaaagcctctgcgtgata

SEQ ID NO: 1146324 - DNA, 22 bp, Artificial Sequence
  chemically synthesized
ccaataaacagtatcacgcaga

SEQ ID NO: 1146325 - DNA, 22 bp, Artificial Sequence
  chemically synthesized
aaccttttagcaaagcctctgc

SEQ ID NO: 1146326 - DNA, 22 bp, Artificial Sequence
  chemically synthesized
ctgaaccttttagcaaagcctc

SEQ ID NO: 1146327 - DNA, 22 bp, Artificial Sequence
  chemically synthesized
cctgaaccttttagcaaagcct

SEQ ID NO: 1146328 - DNA, 22 bp, Artificial Sequence
  chemically synthesized
tcctgaaccttttagcaaagcc

SEQ ID NO: 1146329 - DNA, 22 bp, Artificial Sequence
  chemically synthesized
attttcctgaaccttttagcaa

SEQ ID NO: 1146330 - DNA, 22 bp, Artificial Sequence
  chemically synthesized
tgattttcctgaaccttttagc

SEQ ID NO: 1146331 - DNA, 22 bp, Artificial Sequence
  chemically synthesized
aggtattctgattttcctgaac

SEQ ID NO: 1146332 - DNA, 22 bp, Artificial Sequence
  chemically synthesized
gaggtattctgattttcctgaa

SEQ ID NO: 1146333 - DNA, 22 bp, Artificial Sequence
  chemically synthesized
tgctaaaaggttcaggaaaatc

SEQ ID NO: 1146334 - DNA, 22 bp, Artificial Sequence
  chemically synthesized
gctaaaaggttcaggaaaatca

SEQ ID NO: 1146335 - DNA, 22 bp, Artificial Sequence
  chemically synthesized
ctaaaaggttcaggaaaatcag

SEQ ID NO: 1146336 - DNA, 22 bp, Artificial Sequence
  chemically synthesized
aaaggttcaggaaaatcagaat

SEQ ID NO: 1146337 - DNA, 22 bp, Artificial Sequence
  chemically synthesized
aggaaaatcagaatacctcaaa

SEQ ID NO: 1146338 - DNA, 22 bp, Artificial Sequence
  chemically synthesized
atccaatggaatggaatgaatt

SEQ ID NO: 1146339 - DNA, 22 bp, Artificial Sequence
  chemically synthesized
gctgatccaatggaatggaatg

SEQ ID NO: 1146340 - DNA, 22 bp, Artificial Sequence
  chemically synthesized
aattggctgatccaatggaatg

SEQ ID NO: 1146341 - DNA, 22 bp, Artificial Sequence
  chemically synthesized
aaattcattccattccattgga

SEQ ID NO: 1146342 - DNA, 22 bp, Artificial Sequence
  chemically synthesized
ttaaattggctgatccaatgga

SEQ ID NO: 1146343 - DNA, 22 bp, Artificial Sequence
  chemically synthesized
attaaattggctgatccaatgg

SEQ ID NO: 1146344 - DNA, 22 bp, Artificial Sequence
  chemically synthesized
attccattccattggatcagcc

SEQ ID NO: 1146345 - DNA, 22 bp, Artificial Sequence
  chemically synthesized
gacttattaaattggctgatcc

SEQ ID NO: 1146346 - DNA, 22 bp, Artificial Sequence
  chemically synthesized
cattccattggatcagccaatt

SEQ ID NO: 1146347 - DNA, 22 bp, Artificial Sequence
  chemically synthesized
ttagacttattaaattggctga

SEQ ID NO: 1146348 - DNA, 22 bp, Artificial Sequence
  chemically synthesized
gttagacttattaaattggctg

SEQ ID NO: 1146349 - DNA, 22 bp, Artificial Sequence
  chemically synthesized
tgttagacttattaaattggct

SEQ ID NO: 1146350 - DNA, 22 bp, Artificial Sequence
  chemically synthesized
cattggatcagccaatttaata

SEQ ID NO: 1146351 - DNA, 22 bp, Artificial Sequence
  chemically synthesized
ttttgttagacttattaaattg

SEQ ID NO: 1146352 - DNA, 22 bp, Artificial Sequence
  chemically synthesized
gatcagccaatttaataagtct

SEQ ID NO: 1146353 - DNA, 22 bp, Artificial Sequence
  chemically synthesized
agacaaattattttgttagact

SEQ ID NO: 1146354 - DNA, 22 bp, Artificial Sequence
  chemically synthesized
aataagtctaacaaaataattt

SEQ ID NO: 1146355 - DNA, 22 bp, Artificial Sequence
  chemically synthesized
ataagtctaacaaaataatttg

SEQ ID NO: 1146356 - DNA, 22 bp, Artificial Sequence
  chemically synthesized
tggtagtattaagacaaattat

SEQ ID NO: 1146357 - DNA, 22 bp, Artificial Sequence
  chemically synthesized
gtggtagtattaagacaaatta

SEQ ID NO: 1146358 - DNA, 22 bp, Artificial Sequence
  chemically synthesized
tgtggtagtattaagacaaatt

SEQ ID NO: 1146359 - DNA, 22 bp, Artificial Sequence
  chemically synthesized
acaaaataatttgtcttaatac

SEQ ID NO: 1146360 - DNA, 22 bp, Artificial Sequence
  chemically synthesized
tagaaatactttgtggtagtat

SEQ ID NO: 1146361 - DNA, 22 bp, Artificial Sequence
  chemically synthesized
gtagaaatactttgtggtagta

SEQ ID NO: 1146362 - DNA, 22 bp, Artificial Sequence
  chemically synthesized
gtcttaatactaccacaaagta

SEQ ID NO: 1146363 - DNA, 22 bp, Artificial Sequence
  chemically synthesized
tcttaatactaccacaaagtat

SEQ ID NO: 1146364 - DNA, 22 bp, Artificial Sequence
  chemically synthesized
aacaatttgtagaaatactttg

SEQ ID NO: 1146365 - DNA, 22 bp, Artificial Sequence
  chemically synthesized
aatactaccacaaagtatttct

SEQ ID NO: 1146366 - DNA, 22 bp, Artificial Sequence
  chemically synthesized
atactaccacaaagtatttcta

SEQ ID NO: 1146367 - DNA, 22 bp, Artificial Sequence
  chemically synthesized
ccacaaagtatttctacaaatt

SEQ ID NO: 1146368 - DNA, 22 bp, Artificial Sequence
  chemically synthesized
tatcagatgacattaaacaatt

SEQ ID NO: 1146369 - DNA, 22 bp, Artificial Sequence
  chemically synthesized
atatcagatgacattaaacaat

SEQ ID NO: 1146370 - DNA, 22 bp, Artificial Sequence
  chemically synthesized
tatatcagatgacattaaacaa

SEQ ID NO: 1146371 - DNA, 22 bp, Artificial Sequence
  chemically synthesized
ctacaaattgtttaatgtcatc

SEQ ID NO: 1146372 - DNA, 22 bp, Artificial Sequence
  chemically synthesized
tacaaattgtttaatgtcatct

SEQ ID NO: 1146373 - DNA, 22 bp, Artificial Sequence
  chemically synthesized
caaattgtttaatgtcatctga

SEQ ID NO: 1146374 - DNA, 22 bp, Artificial Sequence
  chemically synthesized
tttaatgtcatctgatataaag

SEQ ID NO: 1146375 - DNA, 22 bp, Artificial Sequence
  chemically synthesized
aatgtcatctgatataaagttg

SEQ ID NO: 1146376 - DNA, 22 bp, Artificial Sequence
  chemically synthesized
agtcatgtaaaccaactttata

SEQ ID NO: 1146377 - DNA, 22 bp, Artificial Sequence
  chemically synthesized
atgtcatctgatataaagttgg

SEQ ID NO: 1146378 - DNA, 22 bp, Artificial Sequence
  chemically synthesized
aaattgagtcatgtaaaccaac

SEQ ID NO: 1146379 - DNA, 22 bp, Artificial Sequence
  chemically synthesized
gctaaaattgagtcatgtaaac

SEQ ID NO: 1146380 - DNA, 22 bp, Artificial Sequence
  chemically synthesized
atataaagttggtttacatgac

SEQ ID NO: 1146381 - DNA, 22 bp, Artificial Sequence
  chemically synthesized
cattcgctaaaattgagtcatg

SEQ ID NO: 1146382 - DNA, 22 bp, Artificial Sequence
  chemically synthesized
agctacattcgctaaaattgag

SEQ ID NO: 1146383 - DNA, 22 bp, Artificial Sequence
  chemically synthesized
gtttacatgactcaattttagc

SEQ ID NO: 1146384 - DNA, 22 bp, Artificial Sequence
  chemically synthesized
acatgactcaattttagcgaat

SEQ ID NO: 1146385 - DNA, 22 bp, Artificial Sequence
  chemically synthesized
catgactcaattttagcgaatg

SEQ ID NO: 1146386 - DNA, 22 bp, Artificial Sequence
  chemically synthesized
agaactaagctacattcgctaa

SEQ ID NO: 1146387 - DNA, 22 bp, Artificial Sequence
  chemically synthesized
taagaactaagctacattcgct

SEQ ID NO: 1146388 - DNA, 22 bp, Artificial Sequence
  chemically synthesized
ctaagaactaagctacattcgc

SEQ ID NO: 1146389 - DNA, 22 bp, Artificial Sequence
  chemically synthesized
tctaagaactaagctacattcg

SEQ ID NO: 1146390 - DNA, 22 bp, Artificial Sequence
  chemically synthesized
aattttagcgaatgtagcttag

SEQ ID NO: 1146391 - DNA, 22 bp, Artificial Sequence
  chemically synthesized
tagcgaatgtagcttagttctt

SEQ ID NO: 1146392 - DNA, 22 bp, Artificial Sequence
  chemically synthesized
agcgaatgtagcttagttctta

SEQ ID NO: 1146393 - DNA, 22 bp, Artificial Sequence
  chemically synthesized
gcgaatgtagcttagttcttag

SEQ ID NO: 1146394 - DNA, 22 bp, Artificial Sequence
  chemically synthesized
cagatgagatagttttctaaga

SEQ ID NO: 1146395 - DNA, 22 bp, Artificial Sequence
  chemically synthesized
gcagatgagatagttttctaag

SEQ ID NO: 1146396 - DNA, 22 bp, Artificial Sequence
  chemically synthesized
tgcagatgagatagttttctaa

SEQ ID NO: 1146397 - DNA, 22 bp, Artificial Sequence
  chemically synthesized
ttgcagatgagatagttttcta

SEQ ID NO: 1146398 - DNA, 22 bp, Artificial Sequence
  chemically synthesized
agttcttagaaaactatctcat

SEQ ID NO: 1146399 - DNA, 22 bp, Artificial Sequence
  chemically synthesized
gttcttagaaaactatctcatc

SEQ ID NO: 1146400 - DNA, 22 bp, Artificial Sequence
  chemically synthesized
ttagaaaactatctcatctgca

SEQ ID NO: 1146401 - DNA, 22 bp, Artificial Sequence
  chemically synthesized
aaggaataatttttgcagatga

SEQ ID NO: 1146402 - DNA, 22 bp, Artificial Sequence
  chemically synthesized
agaaaactatctcatctgcaaa

SEQ ID NO: 1146403 - DNA, 22 bp, Artificial Sequence
  chemically synthesized
gaaaactatctcatctgcaaaa

SEQ ID NO: 1146404 - DNA, 22 bp, Artificial Sequence
  chemically synthesized
cctgaaggaataatttttgcag

SEQ ID NO: 1146405 - DNA, 22 bp, Artificial Sequence
  chemically synthesized
ttgcctgaaggaataatttttg

SEQ ID NO: 1146406 - DNA, 22 bp, Artificial Sequence
  chemically synthesized
attgcctgaaggaataattttt

SEQ ID NO: 1146407 - DNA, 22 bp, Artificial Sequence
  chemically synthesized
tctcatctgcaaaaattattcc

SEQ ID NO: 1146408 - DNA, 22 bp, Artificial Sequence
  chemically synthesized
atctgcaaaaattattccttca

SEQ ID NO: 1146409 - DNA, 22 bp, Artificial Sequence
  chemically synthesized
caaaaattattccttcaggcaa

SEQ ID NO: 1146410 - DNA, 22 bp, Artificial Sequence
  chemically synthesized
ataaacatatttattgcctgaa

SEQ ID NO: 1146411 - DNA, 22 bp, Artificial Sequence
  chemically synthesized
ttccttcaggcaataaatatgt

SEQ ID NO: 1146412 - DNA, 22 bp, Artificial Sequence
  chemically synthesized
atgcagttaataaacatattta

SEQ ID NO: 1146413 - DNA, 22 bp, Artificial Sequence
  chemically synthesized
cttcaggcaataaatatgttta

SEQ ID NO: 1146414 - DNA, 22 bp, Artificial Sequence
  chemically synthesized
tctcatgcagttaataaacata

SEQ ID NO: 1146415 - DNA, 22 bp, Artificial Sequence
  chemically synthesized
caggcaataaatatgtttatta

SEQ ID NO: 1146416 - DNA, 22 bp, Artificial Sequence
  chemically synthesized
atctcatgcagttaataaacat

SEQ ID NO: 1146417 - DNA, 22 bp, Artificial Sequence
  chemically synthesized
aggcaataaatatgtttattaa

SEQ ID NO: 1146418 - DNA, 22 bp, Artificial Sequence
  chemically synthesized
acttatctcatgcagttaataa

SEQ ID NO: 1146419 - DNA, 22 bp, Artificial Sequence
  chemically synthesized
tcacttatctcatgcagttaat

SEQ ID NO: 1146420 - DNA, 22 bp, Artificial Sequence
  chemically synthesized
ctcacttatctcatgcagttaa

SEQ ID NO: 1146421 - DNA, 22 bp, Artificial Sequence
  chemically synthesized
gtatggtttctcacttatctca

SEQ ID NO: 1146422 - DNA, 22 bp, Artificial Sequence
  chemically synthesized
attaactgcatgagataagtga

SEQ ID NO: 1146423 - DNA, 22 bp, Artificial Sequence
  chemically synthesized
ttaactgcatgagataagtgag

SEQ ID NO: 1146424 - DNA, 22 bp, Artificial Sequence
  chemically synthesized
actggtatggtttctcacttat

SEQ ID NO: 1146425 - DNA, 22 bp, Artificial Sequence
  chemically synthesized
actgcatgagataagtgagaaa

SEQ ID NO: 1146426 - DNA, 22 bp, Artificial Sequence
  chemically synthesized
catgagataagtgagaaaccat

SEQ ID NO: 1146427 - DNA, 22 bp, Artificial Sequence
  chemically synthesized
aacatgaggccatgctcactgg

SEQ ID NO: 1146428 - DNA, 22 bp, Artificial Sequence
  chemically synthesized
ttaaacatgaggccatgctcac

SEQ ID NO: 1146429 - DNA, 22 bp, Artificial Sequence
  chemically synthesized
gatcagattattaaacatgagg

SEQ ID NO: 1146430 - DNA, 22 bp, Artificial Sequence
  chemically synthesized
ggatcagattattaaacatgag

SEQ ID NO: 1146431 - DNA, 22 bp, Artificial Sequence
  chemically synthesized
tggatcagattattaaacatga

SEQ ID NO: 1146432 - DNA, 22 bp, Artificial Sequence
  chemically synthesized
gaaaacacaattttggatcaga

SEQ ID NO: 1146433 - DNA, 22 bp, Artificial Sequence
  chemically synthesized
atgtttaataatctgatccaaa

SEQ ID NO: 1146434 - DNA, 22 bp, Artificial Sequence
  chemically synthesized
aataatctgatccaaaattgtg

SEQ ID NO: 1146435 - DNA, 22 bp, Artificial Sequence
  chemically synthesized
ataatctgatccaaaattgtgt

SEQ ID NO: 1146436 - DNA, 22 bp, Artificial Sequence
  chemically synthesized
aagaaggaaaacctggaaaaca

SEQ ID NO: 1146437 - DNA, 22 bp, Artificial Sequence
  chemically synthesized
atccaaaattgtgttttccagg

SEQ ID NO: 1146438 - DNA, 22 bp, Artificial Sequence
  chemically synthesized
caagaaggaaaacctggaaaac

SEQ ID NO: 1146439 - DNA, 22 bp, Artificial Sequence
  chemically synthesized
tcaagaaggaaaacctggaaaa

SEQ ID NO: 1146440 - DNA, 22 bp, Artificial Sequence
  chemically synthesized
ttttcaagaaggaaaacctgga

SEQ ID NO: 1146441 - DNA, 22 bp, Artificial Sequence
  chemically synthesized
tattttcaagaaggaaaacctg

SEQ ID NO: 1146442 - DNA, 22 bp, Artificial Sequence
  chemically synthesized
tgttttccaggttttccttctt

SEQ ID NO: 1146443 - DNA, 22 bp, Artificial Sequence
  chemically synthesized
tccaggttttccttcttgaaaa

SEQ ID NO: 1146444 - DNA, 22 bp, Artificial Sequence
  chemically synthesized
ccaggttttccttcttgaaaat

SEQ ID NO: 1146445 - DNA, 22 bp, Artificial Sequence
  chemically synthesized
caggttttccttcttgaaaata

SEQ ID NO: 1146446 - DNA, 22 bp, Artificial Sequence
  chemically synthesized
tccttcttgaaaatagaatact

SEQ ID NO: 1146447 - DNA, 22 bp, Artificial Sequence
  chemically synthesized
accgtcacaacaagtattctat

SEQ ID NO: 1146448 - DNA, 22 bp, Artificial Sequence
  chemically synthesized
ccttcttgaaaatagaatactt

SEQ ID NO: 1146449 - DNA, 22 bp, Artificial Sequence
  chemically synthesized
cttcttgaaaatagaatacttg

SEQ ID NO: 1146450 - DNA, 22 bp, Artificial Sequence
  chemically synthesized
cttgaaaatagaatacttgttg

SEQ ID NO: 1146451 - DNA, 22 bp, Artificial Sequence
  chemically synthesized
ttgaaaatagaatacttgttgt

SEQ ID NO: 1146452 - DNA, 22 bp, Artificial Sequence
  chemically synthesized
gaaaatagaatacttgttgtga

SEQ ID NO: 1146453 - DNA, 22 bp, Artificial Sequence
  chemically synthesized
aaaatagaatacttgttgtgac

SEQ ID NO: 1146454 - DNA, 22 bp, Artificial Sequence
  chemically synthesized
acacataatattaaccgtcaca

SEQ ID NO: 1146455 - DNA, 22 bp, Artificial Sequence
  chemically synthesized
gttgtgacggttaatattatgt

SEQ ID NO: 1146456 - DNA, 22 bp, Artificial Sequence
  chemically synthesized
catgaagttgacacataatatt

SEQ ID NO: 1146457 - DNA, 22 bp, Artificial Sequence
  chemically synthesized
ttgtgacggttaatattatgtg

SEQ ID NO: 1146458 - DNA, 22 bp, Artificial Sequence
  chemically synthesized
tgacggttaatattatgtgtca

SEQ ID NO: 1146459 - DNA, 22 bp, Artificial Sequence
  chemically synthesized
aattccatgaagttgacacata

SEQ ID NO: 1146460 - DNA, 22 bp, Artificial Sequence
  chemically synthesized
atattatgtgtcaacttcatgg

SEQ ID NO: 1146461 - DNA, 22 bp, Artificial Sequence
  chemically synthesized
ggcatccctcaattccatgaag

SEQ ID NO: 1146462 - DNA, 22 bp, Artificial Sequence
  chemically synthesized
tgtgtcaacttcatggaattga

SEQ ID NO: 1146463 - DNA, 22 bp, Artificial Sequence
  chemically synthesized
atcagtgatctaggcatccctc

SEQ ID NO: 1146464 - DNA, 22 bp, Artificial Sequence
  chemically synthesized
catcagtgatctaggcatccct

SEQ ID NO: 1146465 - DNA, 22 bp, Artificial Sequence
  chemically synthesized
catggaattgagggatgcctag

SEQ ID NO: 1146466 - DNA, 22 bp, Artificial Sequence
  chemically synthesized
atggaattgagggatgcctaga

SEQ ID NO: 1146467 - DNA, 22 bp, Artificial Sequence
  chemically synthesized
agggatgcctagatcactgatg

SEQ ID NO: 1146468 - DNA, 22 bp, Artificial Sequence
  chemically synthesized
gatcactgatgaagtattgttt

SEQ ID NO: 1146469 - DNA, 22 bp, Artificial Sequence
  chemically synthesized
acagacacacccggaagaaaca

SEQ ID NO: 1146470 - DNA, 22 bp, Artificial Sequence
  chemically synthesized
tcacagacacacccggaagaaa

SEQ ID NO: 1146471 - DNA, 22 bp, Artificial Sequence
  chemically synthesized
atgaagtattgtttcttccggg

SEQ ID NO: 1146472 - DNA, 22 bp, Artificial Sequence
  chemically synthesized
cactctcacagacacacccgga

SEQ ID NO: 1146473 - DNA, 22 bp, Artificial Sequence
  chemically synthesized
gctacactctcacagacacacc

SEQ ID NO: 1146474 - DNA, 22 bp, Artificial Sequence
  chemically synthesized
ggctacactctcacagacacac

SEQ ID NO: 1146475 - DNA, 22 bp, Artificial Sequence
  chemically synthesized
tggctacactctcacagacaca

SEQ ID NO: 1146476 - DNA, 22 bp, Artificial Sequence
  chemically synthesized
tttcttccgggtgtgtctgtga

SEQ ID NO: 1146477 - DNA, 22 bp, Artificial Sequence
  chemically synthesized
tttggctacactctcacagaca

SEQ ID NO: 1146478 - DNA, 22 bp, Artificial Sequence
  chemically synthesized
ctttggctacactctcacagac

SEQ ID NO: 1146479 - DNA, 22 bp, Artificial Sequence
  chemically synthesized
cttccgggtgtgtctgtgagag

SEQ ID NO: 1146480 - DNA, 22 bp, Artificial Sequence
  chemically synthesized
ttccgggtgtgtctgtgagagt

SEQ ID NO: 1146481 - DNA, 22 bp, Artificial Sequence
  chemically synthesized
ccgggtgtgtctgtgagagtgt

SEQ ID NO: 1146482 - DNA, 22 bp, Artificial Sequence
  chemically synthesized
cgggtgtgtctgtgagagtgta

SEQ ID NO: 1146483 - DNA, 22 bp, Artificial Sequence
  chemically synthesized
tgagagtgtagccaaagaaggc

SEQ ID NO: 1146484 - DNA, 22 bp, Artificial Sequence
  chemically synthesized
gtccacatgtcagccttctttg

SEQ ID NO: 1146485 - DNA, 22 bp, Artificial Sequence
  chemically synthesized
ccagtccactggtccacatgtc

SEQ ID NO: 1146486 - DNA, 22 bp, Artificial Sequence
  chemically synthesized
tcccagtccactggtccacatg

SEQ ID NO: 1146487 - DNA, 22 bp, Artificial Sequence
  chemically synthesized
ctctcccagtccactggtccac

SEQ ID NO: 1146488 - DNA, 22 bp, Artificial Sequence
  chemically synthesized
cctctcccagtccactggtcca

SEQ ID NO: 1146489 - DNA, 22 bp, Artificial Sequence
  chemically synthesized
acatgtggaccagtggactggg

SEQ ID NO: 1146490 - DNA, 22 bp, Artificial Sequence
  chemically synthesized
agggtgggccttcctctcccag

SEQ ID NO: 1146491 - DNA, 22 bp, Artificial Sequence
  chemically synthesized
ggagaggaaggcccaccctcaa

SEQ ID NO: 1146492 - DNA, 22 bp, Artificial Sequence
  chemically synthesized
ggtggtgcccacccacattgag

SEQ ID NO: 1146493 - DNA, 22 bp, Artificial Sequence
  chemically synthesized
attgggtggtgcccacccacat

SEQ ID NO: 1146494 - DNA, 22 bp, Artificial Sequence
  chemically synthesized
gcagctgattgggtggtgccca

SEQ ID NO: 1146495 - DNA, 22 bp, Artificial Sequence
  chemically synthesized
aatgtgggtgggcaccacccaa

SEQ ID NO: 1146496 - DNA, 22 bp, Artificial Sequence
  chemically synthesized
actggcagctgattgggtggtg

SEQ ID NO: 1146497 - DNA, 22 bp, Artificial Sequence
  chemically synthesized
gtctaactggcagctgattggg

SEQ ID NO: 1146498 - DNA, 22 bp, Artificial Sequence
  chemically synthesized
tagtctaactggcagctgattg

SEQ ID NO: 1146499 - DNA, 22 bp, Artificial Sequence
  chemically synthesized
ttctagtctaactggcagctga

SEQ ID NO: 1146500 - DNA, 22 bp, Artificial Sequence
  chemically synthesized
gttctagtctaactggcagctg

SEQ ID NO: 1146501 - DNA, 22 bp, Artificial Sequence
  chemically synthesized
tgttctagtctaactggcagct

SEQ ID NO: 1146502 - DNA, 22 bp, Artificial Sequence
  chemically synthesized
gctttgttctagtctaactggc

SEQ ID NO: 1146503 - DNA, 22 bp, Artificial Sequence
  chemically synthesized
ctggctttgttctagtctaact

SEQ ID NO: 1146504 - DNA, 22 bp, Artificial Sequence
  chemically synthesized
tcctggctttgttctagtctaa

SEQ ID NO: 1146505 - DNA, 22 bp, Artificial Sequence
  chemically synthesized
ttctcctggctttgttctagtc

SEQ ID NO: 1146506 - DNA, 22 bp, Artificial Sequence
  chemically synthesized
ccagttagactagaacaaagcc

SEQ ID NO: 1146507 - DNA, 22 bp, Artificial Sequence
  chemically synthesized
tccctgttctcctggctttgtt

SEQ ID NO: 1146508 - DNA, 22 bp, Artificial Sequence
  chemically synthesized
atccctgttctcctggctttgt

SEQ ID NO: 1146509 - DNA, 22 bp, Artificial Sequence
  chemically synthesized
tatccctgttctcctggctttg

SEQ ID NO: 1146510 - DNA, 22 bp, Artificial Sequence
  chemically synthesized
ctttatccctgttctcctggct

SEQ ID NO: 1146511 - DNA, 22 bp, Artificial Sequence
  chemically synthesized
gactagaacaaagccaggagaa

SEQ ID NO: 1146512 - DNA, 22 bp, Artificial Sequence
  chemically synthesized
gaacaaagccaggagaacaggg

SEQ ID NO: 1146513 - DNA, 22 bp, Artificial Sequence
  chemically synthesized
ccaagcaagctactttatccct

SEQ ID NO: 1146514 - DNA, 22 bp, Artificial Sequence
  chemically synthesized
accaagcaagctactttatccc

SEQ ID NO: 1146515 - DNA, 22 bp, Artificial Sequence
  chemically synthesized
gcttggtaagtttactcactct

SEQ ID NO: 1146516 - DNA, 22 bp, Artificial Sequence
  chemically synthesized
cttggtaagtttactcactctc

SEQ ID NO: 1146517 - DNA, 22 bp, Artificial Sequence
  chemically synthesized
ggtaagtttactcactctcttc

SEQ ID NO: 1146518 - DNA, 22 bp, Artificial Sequence
  chemically synthesized
gtaagtttactcactctcttcc

SEQ ID NO: 1146519 - DNA, 22 bp, Artificial Sequence
  chemically synthesized
ccccgcagggcacaggaagaga

SEQ ID NO: 1146520 - DNA, 22 bp, Artificial Sequence
  chemically synthesized
actcactctcttcctgtgccct

SEQ ID NO: 1146521 - DNA, 22 bp, Artificial Sequence
  chemically synthesized
ctcactctcttcctgtgccctg

SEQ ID NO: 1146522 - DNA, 22 bp, Artificial Sequence
  chemically synthesized
actctcttcctgtgccctgcgg

SEQ ID NO: 1146523 - DNA, 22 bp, Artificial Sequence
  chemically synthesized
tcttcctgtgccctgcggggca

SEQ ID NO: 1146524 - DNA, 22 bp, Artificial Sequence
  chemically synthesized
ttcctgtgccctgcggggcagt

SEQ ID NO: 1146525 - DNA, 22 bp, Artificial Sequence
  chemically synthesized
cctgtgccctgcggggcagttg

SEQ ID NO: 1146526 - DNA, 22 bp, Artificial Sequence
  chemically synthesized
ctgtgccctgcggggcagttgg

SEQ ID NO: 1146527 - DNA, 22 bp, Artificial Sequence
  chemically synthesized
tgccctgcggggcagttggctt

SEQ ID NO: 1146528 - DNA, 22 bp, Artificial Sequence
  chemically synthesized
cggggcagttggcttcctctcc

SEQ ID NO: 1146529 - DNA, 22 bp, Artificial Sequence
  chemically synthesized
atgtccgagggcaggaggagag

SEQ ID NO: 1146530 - DNA, 22 bp, Artificial Sequence
  chemically synthesized
gcttcctctcctcctgccctcg

SEQ ID NO: 1146531 - DNA, 22 bp, Artificial Sequence
  chemically synthesized
gagtctgatgtccgagggcagg

SEQ ID NO: 1146532 - DNA, 22 bp, Artificial Sequence
  chemically synthesized
cctctcctcctgccctcggaca

SEQ ID NO: 1146533 - DNA, 22 bp, Artificial Sequence
  chemically synthesized
ctctcctcctgccctcggacat

SEQ ID NO: 1146534 - DNA, 22 bp, Artificial Sequence
  chemically synthesized
tcctcctgccctcggacatcag

SEQ ID NO: 1146535 - DNA, 22 bp, Artificial Sequence
  chemically synthesized
gagtcctggagtctgatgtccg

SEQ ID NO: 1146536 - DNA, 22 bp, Artificial Sequence
  chemically synthesized
ctcctgccctcggacatcagac

SEQ ID NO: 1146537 - DNA, 22 bp, Artificial Sequence
  chemically synthesized
ctgccctcggacatcagactcc

SEQ ID NO: 1146538 - DNA, 22 bp, Artificial Sequence
  chemically synthesized
ccctcggacatcagactccagg

SEQ ID NO: 1146539 - DNA, 22 bp, Artificial Sequence
  chemically synthesized
gagaacctggagtcctggagtc

SEQ ID NO: 1146540 - DNA, 22 bp, Artificial Sequence
  chemically synthesized
ggacatcagactccaggactcc

SEQ ID NO: 1146541 - DNA, 22 bp, Artificial Sequence
  chemically synthesized
caggactccaggttctccagtc

SEQ ID NO: 1146542 - DNA, 22 bp, Artificial Sequence
  chemically synthesized
caggttctccagtctttggact

SEQ ID NO: 1146543 - DNA, 22 bp, Artificial Sequence
  chemically synthesized
gtgtaagtcccccagtccaaag

SEQ ID NO: 1146544 - DNA, 22 bp, Artificial Sequence
  chemically synthesized
tccagtctttggactgggggac

SEQ ID NO: 1146545 - DNA, 22 bp, Artificial Sequence
  chemically synthesized
cagtctttggactgggggactt

SEQ ID NO: 1146546 - DNA, 22 bp, Artificial Sequence
  chemically synthesized
ggaaatcactggtgtaagtccc

SEQ ID NO: 1146547 - DNA, 22 bp, Artificial Sequence
  chemically synthesized
tggactgggggacttacaccag

SEQ ID NO: 1146548 - DNA, 22 bp, Artificial Sequence
  chemically synthesized
ggactgggggacttacaccagt

SEQ ID NO: 1146549 - DNA, 22 bp, Artificial Sequence
  chemically synthesized
gactgggggacttacaccagtg

SEQ ID NO: 1146550 - DNA, 22 bp, Artificial Sequence
  chemically synthesized
gagcccctgggaaatcactggt

SEQ ID NO: 1146551 - DNA, 22 bp, Artificial Sequence
  chemically synthesized
agagcccctgggaaatcactgg

SEQ ID NO: 1146552 - DNA, 22 bp, Artificial Sequence
  chemically synthesized
ggggacttacaccagtgatttc

SEQ ID NO: 1146553 - DNA, 22 bp, Artificial Sequence
  chemically synthesized
acaccagtgatttcccaggggc

SEQ ID NO: 1146554 - DNA, 22 bp, Artificial Sequence
  chemically synthesized
caccagtgatttcccaggggct

SEQ ID NO: 1146555 - DNA, 22 bp, Artificial Sequence
  chemically synthesized
agtgtgaggccaaaggccttag

SEQ ID NO: 1146556 - DNA, 22 bp, Artificial Sequence
  chemically synthesized
cccaggggctctaaggcctttg

SEQ ID NO: 1146557 - DNA, 22 bp, Artificial Sequence
  chemically synthesized
tcagtgtgaggccaaaggcctt

SEQ ID NO: 1146558 - DNA, 22 bp, Artificial Sequence
  chemically synthesized
ccaggggctctaaggcctttgg

SEQ ID NO: 1146559 - DNA, 22 bp, Artificial Sequence
  chemically synthesized
taaggcctttggcctcacactg

SEQ ID NO: 1146560 - DNA, 22 bp, Artificial Sequence
  chemically synthesized
acagtgcagctctcagtgtgag

SEQ ID NO: 1146561 - DNA, 22 bp, Artificial Sequence
  chemically synthesized
aggcctttggcctcacactgag

SEQ ID NO: 1146562 - DNA, 22 bp, Artificial Sequence
  chemically synthesized
tggcctcacactgagagctgca

SEQ ID NO: 1146563 - DNA, 22 bp, Artificial Sequence
  chemically synthesized
ggcctcacactgagagctgcac

SEQ ID NO: 1146564 - DNA, 22 bp, Artificial Sequence
  chemically synthesized
gcctcacactgagagctgcact

SEQ ID NO: 1146565 - DNA, 22 bp, Artificial Sequence
  chemically synthesized
acactgagagctgcactgtcag

SEQ ID NO: 1146566 - DNA, 22 bp, Artificial Sequence
  chemically synthesized
aagaccagagaagctgacagtg

SEQ ID NO: 1146567 - DNA, 22 bp, Artificial Sequence
  chemically synthesized
agagctgcactgtcagcttctc

SEQ ID NO: 1146568 - DNA, 22 bp, Artificial Sequence
  chemically synthesized
cactgtcagcttctctggtctt

SEQ ID NO: 1146569 - DNA, 22 bp, Artificial Sequence
  chemically synthesized
tcagcttctctggtcttgaggc

SEQ ID NO: 1146570 - DNA, 22 bp, Artificial Sequence
  chemically synthesized
ctctggtcttgaggcttttgga

SEQ ID NO: 1146571 - DNA, 22 bp, Artificial Sequence
  chemically synthesized
gtgcagtccaagtccaaaagcc

SEQ ID NO: 1146572 - DNA, 22 bp, Artificial Sequence
  chemically synthesized
tctggtcttgaggcttttggac

SEQ ID NO: 1146573 - DNA, 22 bp, Artificial Sequence
  chemically synthesized
tggtcttgaggcttttggactt

SEQ ID NO: 1146574 - DNA, 22 bp, Artificial Sequence
  chemically synthesized
gtcttgaggcttttggacttgg

SEQ ID NO: 1146575 - DNA, 22 bp, Artificial Sequence
  chemically synthesized
gtagcctggtgcagtccaagtc

SEQ ID NO: 1146576 - DNA, 22 bp, Artificial Sequence
  chemically synthesized
gaggcttttggacttggactgc

SEQ ID NO: 1146577 - DNA, 22 bp, Artificial Sequence
  chemically synthesized
aggcttttggacttggactgca

SEQ ID NO: 1146578 - DNA, 22 bp, Artificial Sequence
  chemically synthesized
ttggacttggactgcaccaggc

SEQ ID NO: 1146579 - DNA, 22 bp, Artificial Sequence
  chemically synthesized
tggacttggactgcaccaggct

SEQ ID NO: 1146580 - DNA, 22 bp, Artificial Sequence
  chemically synthesized
ggacttggactgcaccaggcta

SEQ ID NO: 1146581 - DNA, 22 bp, Artificial Sequence
  chemically synthesized
gacttggactgcaccaggctac

SEQ ID NO: 1146582 - DNA, 22 bp, Artificial Sequence
  chemically synthesized
ggactgcaccaggctactaggt

SEQ ID NO: 1146583 - DNA, 22 bp, Artificial Sequence
  chemically synthesized
ggagaagagagaacctagtagc

SEQ ID NO: 1146584 - DNA, 22 bp, Artificial Sequence
  chemically synthesized
gactgcaccaggctactaggtt

SEQ ID NO: 1146585 - DNA, 22 bp, Artificial Sequence
  chemically synthesized
caccaggctactaggttctctc

SEQ ID NO: 1146586 - DNA, 22 bp, Artificial Sequence
  chemically synthesized
caagctgggagaagagagaacc

SEQ ID NO: 1146587 - DNA, 22 bp, Artificial Sequence
  chemically synthesized
ctaggttctctcttctcccagc

SEQ ID NO: 1146588 - DNA, 22 bp, Artificial Sequence
  chemically synthesized
ggttctctcttctcccagcttg

SEQ ID NO: 1146589 - DNA, 22 bp, Artificial Sequence
  chemically synthesized
tctcttctcccagcttgcagat

SEQ ID NO: 1146590 - DNA, 22 bp, Artificial Sequence
  chemically synthesized
tcttctcccagcttgcagatgg

SEQ ID NO: 1146591 - DNA, 22 bp, Artificial Sequence
  chemically synthesized
ttctcccagcttgcagatggcg

SEQ ID NO: 1146592 - DNA, 22 bp, Artificial Sequence
  chemically synthesized
ctcccagcttgcagatggcgta

SEQ ID NO: 1146593 - DNA, 22 bp, Artificial Sequence
  chemically synthesized
tcccagcttgcagatggcgtat

SEQ ID NO: 1146594 - DNA, 22 bp, Artificial Sequence
  chemically synthesized
ccagcttgcagatggcgtatca

SEQ ID NO: 1146595 - DNA, 22 bp, Artificial Sequence
  chemically synthesized
caaggtgaagtcccatgatacg

SEQ ID NO: 1146596 - DNA, 22 bp, Artificial Sequence
  chemically synthesized
gcagatggcgtatcatgggact

SEQ ID NO: 1146597 - DNA, 22 bp, Artificial Sequence
  chemically synthesized
cagatggcgtatcatgggactt

SEQ ID NO: 1146598 - DNA, 22 bp, Artificial Sequence
  chemically synthesized
acatgattacaaggtgaagtcc

SEQ ID NO: 1146599 - DNA, 22 bp, Artificial Sequence
  chemically synthesized
gctcacatgattacaaggtgaa

SEQ ID NO: 1146600 - DNA, 22 bp, Artificial Sequence
  chemically synthesized
tcatggagaattggctcacatg

SEQ ID NO: 1146601 - DNA, 22 bp, Artificial Sequence
  chemically synthesized
caccttgtaatcatgtgagcca

SEQ ID NO: 1146602 - DNA, 22 bp, Artificial Sequence
  chemically synthesized
atcatggagaattggctcacat

SEQ ID NO: 1146603 - DNA, 22 bp, Artificial Sequence
  chemically synthesized
accttgtaatcatgtgagccaa

SEQ ID NO: 1146604 - DNA, 22 bp, Artificial Sequence
  chemically synthesized
gtaatcatgtgagccaattctc

SEQ ID NO: 1146605 - DNA, 22 bp, Artificial Sequence
  chemically synthesized
taatcatgtgagccaattctcc

SEQ ID NO: 1146606 - DNA, 22 bp, Artificial Sequence
  chemically synthesized
ggagtttatcatggagaattgg

SEQ ID NO: 1146607 - DNA, 22 bp, Artificial Sequence
  chemically synthesized
aggagtttatcatggagaattg

SEQ ID NO: 1146608 - DNA, 22 bp, Artificial Sequence
  chemically synthesized
tccatgataaactcctaaatgt

SEQ ID NO: 1146609 - DNA, 22 bp, Artificial Sequence
  chemically synthesized
catgataaactcctaaatgtat

SEQ ID NO: 1146610 - DNA, 22 bp, Artificial Sequence
  chemically synthesized
ctaaatgtatattttatataca

SEQ ID NO: 1146611 - DNA, 22 bp, Artificial Sequence
  chemically synthesized
aatgtatattttatatacacat

SEQ ID NO: 1146612 - DNA, 22 bp, Artificial Sequence
  chemically synthesized
tatatacacatatatacatcta

SEQ ID NO: 1146613 - DNA, 22 bp, Artificial Sequence
  chemically synthesized
atatacacatatatacatctat

SEQ ID NO: 1146614 - DNA, 22 bp, Artificial Sequence
  chemically synthesized
tatacacatatatacatctatc

SEQ ID NO: 1146615 - DNA, 22 bp, Artificial Sequence
  chemically synthesized
gatggatggatggatggataga

SEQ ID NO: 1146616 - DNA, 22 bp, Artificial Sequence
  chemically synthesized
tctatccatccatccatccatc

SEQ ID NO: 1146617 - DNA, 22 bp, Artificial Sequence
  chemically synthesized
tccatccatccatccatccagt

SEQ ID NO: 1146618 - DNA, 22 bp, Artificial Sequence
  chemically synthesized
gaaggacagaacccactggatg

SEQ ID NO: 1146619 - DNA, 22 bp, Artificial Sequence
  chemically synthesized
tagaaggacagaacccactgga

SEQ ID NO: 1146620 - DNA, 22 bp, Artificial Sequence
  chemically synthesized
tctagaaggacagaacccactg

SEQ ID NO: 1146621 - DNA, 22 bp, Artificial Sequence
  chemically synthesized
aggttctctagaaggacagaac

SEQ ID NO: 1146622 - DNA, 22 bp, Artificial Sequence
  chemically synthesized
tgtccttctagagaaccttaat

SEQ ID NO: 1146623 - DNA, 22 bp, Artificial Sequence
  chemically synthesized
tccttctagagaaccttaatac

SEQ ID NO: 1146624 - DNA, 22 bp, Artificial Sequence
  chemically synthesized
ctagagaaccttaatacactct

SEQ ID NO: 1146625 - DNA, 22 bp, Artificial Sequence
  chemically synthesized
tagagaaccttaatacactctg

SEQ ID NO: 1146626 - DNA, 22 bp, Artificial Sequence
  chemically synthesized
gagaaccttaatacactctgtc

SEQ ID NO: 1146627 - DNA, 22 bp, Artificial Sequence
  chemically synthesized
taaagaatggataaagacagag

SEQ ID NO: 1146628 - DNA, 22 bp, Artificial Sequence
  chemically synthesized
aatacactctgtctttatccat

SEQ ID NO: 1146629 - DNA, 22 bp, Artificial Sequence
  chemically synthesized
atacactctgtctttatccatt

SEQ ID NO: 1146630 - DNA, 22 bp, Artificial Sequence
  chemically synthesized
ataaaaataattataaagaatg

SEQ ID NO: 1146631 - DNA, 22 bp, Artificial Sequence
  chemically synthesized
tgtctttatccattctttataa

SEQ ID NO: 1146632 - DNA, 22 bp, Artificial Sequence
  chemically synthesized
ctaataaaaataattataaaga

SEQ ID NO: 1146633 - DNA, 22 bp, Artificial Sequence
  chemically synthesized
tctttatccattctttataatt

SEQ ID NO: 1146634 - DNA, 22 bp, Artificial Sequence
  chemically synthesized
cctaataaaaataattataaag

SEQ ID NO: 1146635 - DNA, 22 bp, Artificial Sequence
  chemically synthesized
tcctaataaaaataattataaa

SEQ ID NO: 1146636 - DNA, 22 bp, Artificial Sequence
  chemically synthesized
tatccattctttataattattt

SEQ ID NO: 1146637 - DNA, 22 bp, Artificial Sequence
  chemically synthesized
atccattctttataattatttt

SEQ ID NO: 1146638 - DNA, 22 bp, Artificial Sequence
  chemically synthesized
attttcctaataaaaataatta

SEQ ID NO: 1146639 - DNA, 22 bp, Artificial Sequence
  chemically synthesized
tccattctttataattattttt

SEQ ID NO: 1146640 - DNA, 22 bp, Artificial Sequence
  chemically synthesized
gattttcctaataaaaataatt

SEQ ID NO: 1146641 - DNA, 22 bp, Artificial Sequence
  chemically synthesized
tgattttcctaataaaaataat

SEQ ID NO: 1146642 - DNA, 22 bp, Artificial Sequence
  chemically synthesized
tttataattatttttattagga

SEQ ID NO: 1146643 - DNA, 22 bp, Artificial Sequence
  chemically synthesized
tataattatttttattaggaaa

SEQ ID NO: 1146644 - DNA, 22 bp, Artificial Sequence
  chemically synthesized
ataattatttttattaggaaaa

SEQ ID NO: 1146645 - DNA, 22 bp, Artificial Sequence
  chemically synthesized
taattatttttattaggaaaat

SEQ ID NO: 1146646 - DNA, 22 bp, Artificial Sequence
  chemically synthesized
tcatatcgtattttgattttcc

SEQ ID NO: 1146647 - DNA, 22 bp, Artificial Sequence
  chemically synthesized
tttttattaggaaaatcaaaat

SEQ ID NO: 1146648 - DNA, 22 bp, Artificial Sequence
  chemically synthesized
ttattaggaaaatcaaaatacg

SEQ ID NO: 1146649 - DNA, 22 bp, Artificial Sequence
  chemically synthesized
tattaggaaaatcaaaatacga

SEQ ID NO: 1146650 - DNA, 22 bp, Artificial Sequence
  chemically synthesized
attaggaaaatcaaaatacgat

SEQ ID NO: 1146651 - DNA, 22 bp, Artificial Sequence
  chemically synthesized
ttaggaaaatcaaaatacgata

SEQ ID NO: 1146652 - DNA, 22 bp, Artificial Sequence
  chemically synthesized
ggaaaatcaaaatacgatatga

SEQ ID NO: 1146653 - DNA, 22 bp, Artificial Sequence
  chemically synthesized
ggcaacatagcaagactatcat

SEQ ID NO: 1146654 - DNA, 22 bp, Artificial Sequence
  chemically synthesized
gcctgggcaacatagcaagact

SEQ ID NO: 1146655 - DNA, 22 bp, Artificial Sequence
  chemically synthesized
aaagattagcctgggcaacata

SEQ ID NO: 1146656 - DNA, 22 bp, Artificial Sequence
  chemically synthesized
gctatgttgcccaggctaatct

SEQ ID NO: 1146657 - DNA, 22 bp, Artificial Sequence
  chemically synthesized
ctatgttgcccaggctaatctt

SEQ ID NO: 1146658 - DNA, 22 bp, Artificial Sequence
  chemically synthesized
agcccagaagttcaaagattag

SEQ ID NO: 1146659 - DNA, 22 bp, Artificial Sequence
  chemically synthesized
tgttgcccaggctaatctttga

SEQ ID NO: 1146660 - DNA, 22 bp, Artificial Sequence
  chemically synthesized
gagcccagaagttcaaagatta

SEQ ID NO: 1146661 - DNA, 22 bp, Artificial Sequence
  chemically synthesized
cttgagcccagaagttcaaaga

SEQ ID NO: 1146662 - DNA, 22 bp, Artificial Sequence
  chemically synthesized
cccaggctaatctttgaacttc

SEQ ID NO: 1146663 - DNA, 22 bp, Artificial Sequence
  chemically synthesized
atctttgaacttctgggctcaa

SEQ ID NO: 1146664 - DNA, 22 bp, Artificial Sequence
  chemically synthesized
gggagagaatattgcttgagcc

SEQ ID NO: 1146665 - DNA, 22 bp, Artificial Sequence
  chemically synthesized
tgaacttctgggctcaagcaat

SEQ ID NO: 1146666 - DNA, 22 bp, Artificial Sequence
  chemically synthesized
gaacttctgggctcaagcaata

SEQ ID NO: 1146667 - DNA, 22 bp, Artificial Sequence
  chemically synthesized
aacttctgggctcaagcaatat

SEQ ID NO: 1146668 - DNA, 22 bp, Artificial Sequence
  chemically synthesized
gaaggctggggagagaatattg

SEQ ID NO: 1146669 - DNA, 22 bp, Artificial Sequence
  chemically synthesized
ctgggctcaagcaatattctct

SEQ ID NO: 1146670 - DNA, 22 bp, Artificial Sequence
  chemically synthesized
ggaaggctggggagagaatatt

SEQ ID NO: 1146671 - DNA, 22 bp, Artificial Sequence
  chemically synthesized
tgggctcaagcaatattctctc

SEQ ID NO: 1146672 - DNA, 22 bp, Artificial Sequence
  chemically synthesized
tggaaggctggggagagaatat

SEQ ID NO: 1146673 - DNA, 22 bp, Artificial Sequence
  chemically synthesized
ggctcaagcaatattctctccc

SEQ ID NO: 1146674 - DNA, 22 bp, Artificial Sequence
  chemically synthesized
aagcaatattctctccccagcc

SEQ ID NO: 1146675 - DNA, 22 bp, Artificial Sequence
  chemically synthesized
taatcccagcactttggaaggc

SEQ ID NO: 1146676 - DNA, 22 bp, Artificial Sequence
  chemically synthesized
tctccccagccttccaaagtgc

SEQ ID NO: 1146677 - DNA, 22 bp, Artificial Sequence
  chemically synthesized
tccccagccttccaaagtgctg

SEQ ID NO: 1146678 - DNA, 22 bp, Artificial Sequence
  chemically synthesized
acacctgtaatcccagcacttt

SEQ ID NO: 1146679 - DNA, 22 bp, Artificial Sequence
  chemically synthesized
cccagccttccaaagtgctggg

SEQ ID NO: 1146680 - DNA, 22 bp, Artificial Sequence
  chemically synthesized
ccaaagtgctgggattacaggt

SEQ ID NO: 1146681 - DNA, 22 bp, Artificial Sequence
  chemically synthesized
caaagtgctgggattacaggtg

SEQ ID NO: 1146682 - DNA, 22 bp, Artificial Sequence
  chemically synthesized
ggtacagtggctcacacctgta

SEQ ID NO: 1146683 - DNA, 22 bp, Artificial Sequence
  chemically synthesized
ggattacaggtgtgagccactg

SEQ ID NO: 1146684 - DNA, 22 bp, Artificial Sequence
  chemically synthesized
caggtgtgagccactgtaccta

SEQ ID NO: 1146685 - DNA, 22 bp, Artificial Sequence
  chemically synthesized
aaagtatatgaaaagaatgagg

SEQ ID NO: 1146686 - DNA, 22 bp, Artificial Sequence
  chemically synthesized
tacctagcctcattcttttcat

SEQ ID NO: 1146687 - DNA, 22 bp, Artificial Sequence
  chemically synthesized
gagaattaaaagtatatgaaaa

SEQ ID NO: 1146688 - DNA, 22 bp, Artificial Sequence
  chemically synthesized
ggagaattaaaagtatatgaaa

SEQ ID NO: 1146689 - DNA, 22 bp, Artificial Sequence
  chemically synthesized
tggagaattaaaagtatatgaa

SEQ ID NO: 1146690 - DNA, 22 bp, Artificial Sequence
  chemically synthesized
gcctcattcttttcatatactt

SEQ ID NO: 1146691 - DNA, 22 bp, Artificial Sequence
  chemically synthesized
attcttttcatatacttttaat

SEQ ID NO: 1146692 - DNA, 22 bp, Artificial Sequence
  chemically synthesized
atattttggagaattaaaagta

SEQ ID NO: 1146693 - DNA, 22 bp, Artificial Sequence
  chemically synthesized
ttttcatatacttttaattctc

SEQ ID NO: 1146694 - DNA, 22 bp, Artificial Sequence
  chemically synthesized
cctaatattttggagaattaaa

SEQ ID NO: 1146695 - DNA, 22 bp, Artificial Sequence
  chemically synthesized
ttcatatacttttaattctcca

SEQ ID NO: 1146696 - DNA, 22 bp, Artificial Sequence
  chemically synthesized
tcatatacttttaattctccaa

SEQ ID NO: 1146697 - DNA, 22 bp, Artificial Sequence
  chemically synthesized
ctgcctaatattttggagaatt

SEQ ID NO: 1146698 - DNA, 22 bp, Artificial Sequence
  chemically synthesized
catatacttttaattctccaaa

SEQ ID NO: 1146699 - DNA, 22 bp, Artificial Sequence
  chemically synthesized
atatacttttaattctccaaaa

SEQ ID NO: 1146700 - DNA, 22 bp, Artificial Sequence
  chemically synthesized
aagttactgcctaatattttgg

SEQ ID NO: 1146701 - DNA, 22 bp, Artificial Sequence
  chemically synthesized
ttaattctccaaaatattaggc

SEQ ID NO: 1146702 - DNA, 22 bp, Artificial Sequence
  chemically synthesized
taattctccaaaatattaggca

SEQ ID NO: 1146703 - DNA, 22 bp, Artificial Sequence
  chemically synthesized
aattctccaaaatattaggcag

SEQ ID NO: 1146704 - DNA, 22 bp, Artificial Sequence
  chemically synthesized
atattgaagttactgcctaata

SEQ ID NO: 1146705 - DNA, 22 bp, Artificial Sequence
  chemically synthesized
attctccaaaatattaggcagt

SEQ ID NO: 1146706 - DNA, 22 bp, Artificial Sequence
  chemically synthesized
aatattgaagttactgcctaat

SEQ ID NO: 1146707 - DNA, 22 bp, Artificial Sequence
  chemically synthesized
taatattgaagttactgcctaa

SEQ ID NO: 1146708 - DNA, 22 bp, Artificial Sequence
  chemically synthesized
tccaaaatattaggcagtaact

SEQ ID NO: 1146709 - DNA, 22 bp, Artificial Sequence
  chemically synthesized
caaaatattaggcagtaacttc

SEQ ID NO: 1146710 - DNA, 22 bp, Artificial Sequence
  chemically synthesized
aaatactttaatattgaagtta

SEQ ID NO: 1146711 - DNA, 22 bp, Artificial Sequence
  chemically synthesized
ttaaaatactttaatattgaag

SEQ ID NO: 1146712 - DNA, 22 bp, Artificial Sequence
  chemically synthesized
gttaaaatactttaatattgaa

SEQ ID NO: 1146713 - DNA, 22 bp, Artificial Sequence
  chemically synthesized
tgttaaaatactttaatattga

SEQ ID NO: 1146714 - DNA, 22 bp, Artificial Sequence
  chemically synthesized
ggcagtaacttcaatattaaag

SEQ ID NO: 1146715 - DNA, 22 bp, Artificial Sequence
  chemically synthesized
ttttgttaaaatactttaatat

SEQ ID NO: 1146716 - DNA, 22 bp, Artificial Sequence
  chemically synthesized
aattattttgttaaaatacttt

SEQ ID NO: 1146717 - DNA, 22 bp, Artificial Sequence
  chemically synthesized
gaattattttgttaaaatactt

SEQ ID NO: 1146718 - DNA, 22 bp, Artificial Sequence
  chemically synthesized
caatattaaagtattttaacaa

SEQ ID NO: 1146719 - DNA, 22 bp, Artificial Sequence
  chemically synthesized
aatattaaagtattttaacaaa

SEQ ID NO: 1146720 - DNA, 22 bp, Artificial Sequence
  chemically synthesized
aagtattttaacaaaataattc

SEQ ID NO: 1146721 - DNA, 22 bp, Artificial Sequence
  chemically synthesized
ccatataaaaggcatttgaatt

SEQ ID NO: 1146722 - DNA, 22 bp, Artificial Sequence
  chemically synthesized
tgccatataaaaggcatttgaa

SEQ ID NO: 1146723 - DNA, 22 bp, Artificial Sequence
  chemically synthesized
taacaaaataattcaaatgcct

SEQ ID NO: 1146724 - DNA, 22 bp, Artificial Sequence
  chemically synthesized
ctgccatataaaaggcatttga

SEQ ID NO: 1146725 - DNA, 22 bp, Artificial Sequence
  chemically synthesized
aacaaaataattcaaatgcctt

SEQ ID NO: 1146726 - DNA, 22 bp, Artificial Sequence
  chemically synthesized
acaaaataattcaaatgccttt

SEQ ID NO: 1146727 - DNA, 22 bp, Artificial Sequence
  chemically synthesized
aaatgccttttatatggcagaa

SEQ ID NO: 1146728 - DNA, 22 bp, Artificial Sequence
  chemically synthesized
ttatatggcagaaattctcctg

SEQ ID NO: 1146729 - DNA, 22 bp, Artificial Sequence
  chemically synthesized
tatatggcagaaattctcctgg

SEQ ID NO: 1146730 - DNA, 22 bp, Artificial Sequence
  chemically synthesized
atatggcagaaattctcctggt

SEQ ID NO: 1146731 - DNA, 22 bp, Artificial Sequence
  chemically synthesized
tgtggtcatagaaccaggagaa

SEQ ID NO: 1146732 - DNA, 22 bp, Artificial Sequence
  chemically synthesized
tatggcagaaattctcctggtt

SEQ ID NO: 1146733 - DNA, 22 bp, Artificial Sequence
  chemically synthesized
aaggtctgtgtggtcatagaac

SEQ ID NO: 1146734 - DNA, 22 bp, Artificial Sequence
  chemically synthesized
tcctggttctatgaccacacag

SEQ ID NO: 1146735 - DNA, 22 bp, Artificial Sequence
  chemically synthesized
ctggttctatgaccacacagac

SEQ ID NO: 1146736 - DNA, 22 bp, Artificial Sequence
  chemically synthesized
tagatgtattgaaggtctgtgt

SEQ ID NO: 1146737 - DNA, 22 bp, Artificial Sequence
  chemically synthesized
gttctatgaccacacagacctt

SEQ ID NO: 1146738 - DNA, 22 bp, Artificial Sequence
  chemically synthesized
tatgaccacacagaccttcaat

SEQ ID NO: 1146739 - DNA, 22 bp, Artificial Sequence
  chemically synthesized
tgaccacacagaccttcaatac

SEQ ID NO: 1146740 - DNA, 22 bp, Artificial Sequence
  chemically synthesized
agagccaactatagatgtattg

SEQ ID NO: 1146741 - DNA, 22 bp, Artificial Sequence
  chemically synthesized
aaagttgagagccaactataga

SEQ ID NO: 1146742 - DNA, 22 bp, Artificial Sequence
  chemically synthesized
caatacatctatagttggctct

SEQ ID NO: 1146743 - DNA, 22 bp, Artificial Sequence
  chemically synthesized
aatacatctatagttggctctc

SEQ ID NO: 1146744 - DNA, 22 bp, Artificial Sequence
  chemically synthesized
tacaagttaaaagttgagagcc

SEQ ID NO: 1146745 - DNA, 22 bp, Artificial Sequence
  chemically synthesized
tgtacaagttaaaagttgagag

SEQ ID NO: 1146746 - DNA, 22 bp, Artificial Sequence
  chemically synthesized
ttctgtacaagttaaaagttga

SEQ ID NO: 1146747 - DNA, 22 bp, Artificial Sequence
  chemically synthesized
tagttggctctcaacttttaac

SEQ ID NO: 1146748 - DNA, 22 bp, Artificial Sequence
  chemically synthesized
gctctcaacttttaacttgtac

SEQ ID NO: 1146749 - DNA, 22 bp, Artificial Sequence
  chemically synthesized
ggtatgttattctgtacaagtt

SEQ ID NO: 1146750 - DNA, 22 bp, Artificial Sequence
  chemically synthesized
aggtatgttattctgtacaagt

SEQ ID NO: 1146751 - DNA, 22 bp, Artificial Sequence
  chemically synthesized
taggtatgttattctgtacaag

SEQ ID NO: 1146752 - DNA, 22 bp, Artificial Sequence
  chemically synthesized
tcaacttttaacttgtacagaa

SEQ ID NO: 1146753 - DNA, 22 bp, Artificial Sequence
  chemically synthesized
ttaggtatgttattctgtacaa

SEQ ID NO: 1146754 - DNA, 22 bp, Artificial Sequence
  chemically synthesized
aacttttaacttgtacagaata

SEQ ID NO: 1146755 - DNA, 22 bp, Artificial Sequence
  chemically synthesized
tttttaggtatgttattctgta

SEQ ID NO: 1146756 - DNA, 22 bp, Artificial Sequence
  chemically synthesized
ttaacttgtacagaataacata

SEQ ID NO: 1146757 - DNA, 22 bp, Artificial Sequence
  chemically synthesized
taacttgtacagaataacatac

SEQ ID NO: 1146758 - DNA, 22 bp, Artificial Sequence
  chemically synthesized
aacttgtacagaataacatacc

SEQ ID NO: 1146759 - DNA, 22 bp, Artificial Sequence
  chemically synthesized
acttgtacagaataacatacct

SEQ ID NO: 1146760 - DNA, 22 bp, Artificial Sequence
  chemically synthesized
aaaccctatttttaggtatgtt

SEQ ID NO: 1146761 - DNA, 22 bp, Artificial Sequence
  chemically synthesized
gtacagaataacatacctaaaa

SEQ ID NO: 1146762 - DNA, 22 bp, Artificial Sequence
  chemically synthesized
tacagaataacatacctaaaaa

SEQ ID NO: 1146763 - DNA, 22 bp, Artificial Sequence
  chemically synthesized
aaaatagggttttaatggtttt

SEQ ID NO: 1146764 - DNA, 22 bp, Artificial Sequence
  chemically synthesized
caaagaaaaagcaaaaccatta

SEQ ID NO: 1146765 - DNA, 22 bp, Artificial Sequence
  chemically synthesized
ccaaagaaaaagcaaaaccatt

SEQ ID NO: 1146766 - DNA, 22 bp, Artificial Sequence
  chemically synthesized
taatggttttgctttttctttg

SEQ ID NO: 1146767 - DNA, 22 bp, Artificial Sequence
  chemically synthesized
aatggttttgctttttctttgg

SEQ ID NO: 1146768 - DNA, 22 bp, Artificial Sequence
  chemically synthesized
atggttttgctttttctttgga

SEQ ID NO: 1146769 - DNA, 22 bp, Artificial Sequence
  chemically synthesized
atgaaaatgtcttccaaagaaa

SEQ ID NO: 1146770 - DNA, 22 bp, Artificial Sequence
  chemically synthesized
taatgaaaatgtcttccaaaga

SEQ ID NO: 1146771 - DNA, 22 bp, Artificial Sequence
  chemically synthesized
tgctttttctttggaagacatt

SEQ ID NO: 1146772 - DNA, 22 bp, Artificial Sequence
  chemically synthesized
gctttttctttggaagacattt

SEQ ID NO: 1146773 - DNA, 22 bp, Artificial Sequence
  chemically synthesized
ctttttctttggaagacatttt

SEQ ID NO: 1146774 - DNA, 22 bp, Artificial Sequence
  chemically synthesized
tttctttggaagacattttcat

SEQ ID NO: 1146775 - DNA, 22 bp, Artificial Sequence
  chemically synthesized
ttctttggaagacattttcatt

SEQ ID NO: 1146776 - DNA, 22 bp, Artificial Sequence
  chemically synthesized
tctttggaagacattttcatta

SEQ ID NO: 1146777 - DNA, 22 bp, Artificial Sequence
  chemically synthesized
tagaagatgctctaatgaaaat

SEQ ID NO: 1146778 - DNA, 22 bp, Artificial Sequence
  chemically synthesized
ctttggaagacattttcattag

SEQ ID NO: 1146779 - DNA, 22 bp, Artificial Sequence
  chemically synthesized
atagaagatgctctaatgaaaa

SEQ ID NO: 1146780 - DNA, 22 bp, Artificial Sequence
  chemically synthesized
tttggaagacattttcattaga

SEQ ID NO: 1146781 - DNA, 22 bp, Artificial Sequence
  chemically synthesized
tggaagacattttcattagagc

SEQ ID NO: 1146782 - DNA, 22 bp, Artificial Sequence
  chemically synthesized
ggaagacattttcattagagca

SEQ ID NO: 1146783 - DNA, 22 bp, Artificial Sequence
  chemically synthesized
gaagacattttcattagagcat

SEQ ID NO: 1146784 - DNA, 22 bp, Artificial Sequence
  chemically synthesized
agcccatagcttatagaagatg

SEQ ID NO: 1146785 - DNA, 22 bp, Artificial Sequence
  chemically synthesized
tcattagagcatcttctataag

SEQ ID NO: 1146786 - DNA, 22 bp, Artificial Sequence
  chemically synthesized
cattagagcatcttctataagc

SEQ ID NO: 1146787 - DNA, 22 bp, Artificial Sequence
  chemically synthesized
attagagcatcttctataagct

SEQ ID NO: 1146788 - DNA, 22 bp, Artificial Sequence
  chemically synthesized
gagcatcttctataagctatgg

SEQ ID NO: 1146789 - DNA, 22 bp, Artificial Sequence
  chemically synthesized
ctataagctatgggcttaacca

SEQ ID NO: 1146790 - DNA, 22 bp, Artificial Sequence
  chemically synthesized
tataagctatgggcttaaccat

SEQ ID NO: 1146791 - DNA, 22 bp, Artificial Sequence
  chemically synthesized
taagctatgggcttaaccatgt

SEQ ID NO: 1146792 - DNA, 22 bp, Artificial Sequence
  chemically synthesized
ataaagaaagaaggagaaacat

SEQ ID NO: 1146793 - DNA, 22 bp, Artificial Sequence
  chemically synthesized
tgggcttaaccatgtttctcct

SEQ ID NO: 1146794 - DNA, 22 bp, Artificial Sequence
  chemically synthesized
taataaagaaagaaggagaaac

SEQ ID NO: 1146795 - DNA, 22 bp, Artificial Sequence
  chemically synthesized
ctaataaagaaagaaggagaaa

SEQ ID NO: 1146796 - DNA, 22 bp, Artificial Sequence
  chemically synthesized
tttctaataaagaaagaaggag

SEQ ID NO: 1146797 - DNA, 22 bp, Artificial Sequence
  chemically synthesized
aaccatgtttctccttctttct

SEQ ID NO: 1146798 - DNA, 22 bp, Artificial Sequence
  chemically synthesized
accatgtttctccttctttctt

SEQ ID NO: 1146799 - DNA, 22 bp, Artificial Sequence
  chemically synthesized
ggagataactgtttctaataaa

SEQ ID NO: 1146800 - DNA, 22 bp, Artificial Sequence
  chemically synthesized
ctccttctttctttattagaaa

SEQ ID NO: 1146801 - DNA, 22 bp, Artificial Sequence
  chemically synthesized
gggagataactgtttctaataa

SEQ ID NO: 1146802 - DNA, 22 bp, Artificial Sequence
  chemically synthesized
tccttctttctttattagaaac

SEQ ID NO: 1146803 - DNA, 22 bp, Artificial Sequence
  chemically synthesized
ttgggagataactgtttctaat

SEQ ID NO: 1146804 - DNA, 22 bp, Artificial Sequence
  chemically synthesized
cttctttctttattagaaacag

SEQ ID NO: 1146805 - DNA, 22 bp, Artificial Sequence
  chemically synthesized
ttcttgggagataactgtttct

SEQ ID NO: 1146806 - DNA, 22 bp, Artificial Sequence
  chemically synthesized
ctttctttattagaaacagtta

SEQ ID NO: 1146807 - DNA, 22 bp, Artificial Sequence
  chemically synthesized
gttcttgggagataactgtttc

SEQ ID NO: 1146808 - DNA, 22 bp, Artificial Sequence
  chemically synthesized
tttctttattagaaacagttat

SEQ ID NO: 1146809 - DNA, 22 bp, Artificial Sequence
  chemically synthesized
tgttcttgggagataactgttt

SEQ ID NO: 1146810 - DNA, 22 bp, Artificial Sequence
  chemically synthesized
ttgttcttgggagataactgtt

SEQ ID NO: 1146811 - DNA, 22 bp, Artificial Sequence
  chemically synthesized
tctttattagaaacagttatct

SEQ ID NO: 1146812 - DNA, 22 bp, Artificial Sequence
  chemically synthesized
ctttattagaaacagttatctc

SEQ ID NO: 1146813 - DNA, 22 bp, Artificial Sequence
  chemically synthesized
tttattagaaacagttatctcc

SEQ ID NO: 1146814 - DNA, 22 bp, Artificial Sequence
  chemically synthesized
tattagaaacagttatctccca

SEQ ID NO: 1146815 - DNA, 22 bp, Artificial Sequence
  chemically synthesized
attagaaacagttatctcccaa

SEQ ID NO: 1146816 - DNA, 22 bp, Artificial Sequence
  chemically synthesized
ttagaaacagttatctcccaag

SEQ ID NO: 1146817 - DNA, 22 bp, Artificial Sequence
  chemically synthesized
gaaacagttatctcccaagaac

SEQ ID NO: 1146818 - DNA, 22 bp, Artificial Sequence
  chemically synthesized
tctcccaagaacaaaaggcttt

SEQ ID NO: 1146819 - DNA, 22 bp, Artificial Sequence
  chemically synthesized
ccaagaacaaaaggctttcttt

SEQ ID NO: 1146820 - DNA, 22 bp, Artificial Sequence
  chemically synthesized
taaaaagaccataaagaaagcc

SEQ ID NO: 1146821 - DNA, 22 bp, Artificial Sequence
  chemically synthesized
catgaaaaaagactataaaaag

SEQ ID NO: 1146822 - DNA, 22 bp, Artificial Sequence
  chemically synthesized
gcatgaaaaaagactataaaaa

SEQ ID NO: 1146823 - DNA, 22 bp, Artificial Sequence
  chemically synthesized
tctttatggtctttttatagtc

SEQ ID NO: 1146824 - DNA, 22 bp, Artificial Sequence
  chemically synthesized
ctttatggtctttttatagtct

SEQ ID NO: 1146825 - DNA, 22 bp, Artificial Sequence
  chemically synthesized
tttatggtctttttatagtctt

SEQ ID NO: 1146826 - DNA, 22 bp, Artificial Sequence
  chemically synthesized
tatggtctttttatagtctttt

SEQ ID NO: 1146827 - DNA, 22 bp, Artificial Sequence
  chemically synthesized
atggtctttttatagtcttttt

SEQ ID NO: 1146828 - DNA, 22 bp, Artificial Sequence
  chemically synthesized
tggtctttttatagtctttttt

SEQ ID NO: 1146829 - DNA, 22 bp, Artificial Sequence
  chemically synthesized
taaaaacttgcatgaaaaaaga

SEQ ID NO: 1146830 - DNA, 22 bp, Artificial Sequence
  chemically synthesized
ataaaaacttgcatgaaaaaag

SEQ ID NO: 1146831 - DNA, 22 bp, Artificial Sequence
  chemically synthesized
tttatagtcttttttcatgcaa

SEQ ID NO: 1146832 - DNA, 22 bp, Artificial Sequence
  chemically synthesized
ttatagtcttttttcatgcaag

SEQ ID NO: 1146833 - DNA, 22 bp, Artificial Sequence
  chemically synthesized
tatagtcttttttcatgcaagt

SEQ ID NO: 1146834 - DNA, 22 bp, Artificial Sequence
  chemically synthesized
atagtcttttttcatgcaagtt

SEQ ID NO: 1146835 - DNA, 22 bp, Artificial Sequence
  chemically synthesized
tagtcttttttcatgcaagttt

SEQ ID NO: 1146836 - DNA, 22 bp, Artificial Sequence
  chemically synthesized
ttttcatgcaagtttttataaa

SEQ ID NO: 1146837 - DNA, 22 bp, Artificial Sequence
  chemically synthesized
tttcatgcaagtttttataaac

SEQ ID NO: 1146838 - DNA, 22 bp, Artificial Sequence
  chemically synthesized
ttcatgcaagtttttataaacc

SEQ ID NO: 1146839 - DNA, 22 bp, Artificial Sequence
  chemically synthesized
tcatgcaagtttttataaacca

SEQ ID NO: 1146840 - DNA, 22 bp, Artificial Sequence
  chemically synthesized
catgcaagtttttataaaccac

SEQ ID NO: 1146841 - DNA, 22 bp, Artificial Sequence
  chemically synthesized
atgcaagtttttataaaccacg

SEQ ID NO: 1146842 - DNA, 22 bp, Artificial Sequence
  chemically synthesized
ttataaaccacgctctcttgat

SEQ ID NO: 1146843 - DNA, 22 bp, Artificial Sequence
  chemically synthesized
tataaaccacgctctcttgatt

SEQ ID NO: 1146844 - DNA, 22 bp, Artificial Sequence
  chemically synthesized
ataaaccacgctctcttgattt

SEQ ID NO: 1146845 - DNA, 22 bp, Artificial Sequence
  chemically synthesized
taaaccacgctctcttgattta

SEQ ID NO: 1146846 - DNA, 22 bp, Artificial Sequence
  chemically synthesized
ggatggataaatggtaaatcaa

SEQ ID NO: 1146847 - DNA, 22 bp, Artificial Sequence
  chemically synthesized
taggatggataaatggtaaatc

SEQ ID NO: 1146848 - DNA, 22 bp, Artificial Sequence
  chemically synthesized
ctaggatggataaatggtaaat

SEQ ID NO: 1146849 - DNA, 22 bp, Artificial Sequence
  chemically synthesized
tcttgatttaccatttatccat

SEQ ID NO: 1146850 - DNA, 22 bp, Artificial Sequence
  chemically synthesized
ttgatttaccatttatccatcc

SEQ ID NO: 1146851 - DNA, 22 bp, Artificial Sequence
  chemically synthesized
gatttaccatttatccatccta

SEQ ID NO: 1146852 - DNA, 22 bp, Artificial Sequence
  chemically synthesized
atttaccatttatccatcctag

SEQ ID NO: 1146853 - DNA, 22 bp, Artificial Sequence
  chemically synthesized
accatttatccatcctagaaac

SEQ ID NO: 1146854 - DNA, 22 bp, Artificial Sequence
  chemically synthesized
ccatttatccatcctagaaact

SEQ ID NO: 1146855 - DNA, 22 bp, Artificial Sequence
  chemically synthesized
gtggaggtgggtagagtttcta

SEQ ID NO: 1146856 - DNA, 22 bp, Artificial Sequence
  chemically synthesized
atccatcctagaaactctaccc

SEQ ID NO: 1146857 - DNA, 22 bp, Artificial Sequence
  chemically synthesized
tccatcctagaaactctaccca

SEQ ID NO: 1146858 - DNA, 22 bp, Artificial Sequence
  chemically synthesized
gaaactctacccacctccacca

SEQ ID NO: 1146859 - DNA, 22 bp, Artificial Sequence
  chemically synthesized
ccatcataagtgagattggtgg

SEQ ID NO: 1146860 - DNA, 22 bp, Artificial Sequence
  chemically synthesized
tacccacctccaccaatctcac

SEQ ID NO: 1146861 - DNA, 22 bp, Artificial Sequence
  chemically synthesized
ctgccatcataagtgagattgg

SEQ ID NO: 1146862 - DNA, 22 bp, Artificial Sequence
  chemically synthesized
cccacctccaccaatctcactt

SEQ ID NO: 1146863 - DNA, 22 bp, Artificial Sequence
  chemically synthesized
ctgctgccatcataagtgagat

SEQ ID NO: 1146864 - DNA, 22 bp, Artificial Sequence
  chemically synthesized
caccaatctcacttatgatggc

SEQ ID NO: 1146865 - DNA, 22 bp, Artificial Sequence
  chemically synthesized
cagacaggctgctgctgccatc

SEQ ID NO: 1146866 - DNA, 22 bp, Artificial Sequence
  chemically synthesized
acttatgatggcagcagcagcc

SEQ ID NO: 1146867 - DNA, 22 bp, Artificial Sequence
  chemically synthesized
atgatggcagcagcagcctgtc

SEQ ID NO: 1146868 - DNA, 22 bp, Artificial Sequence
  chemically synthesized
tgatggcagcagcagcctgtct

SEQ ID NO: 1146869 - DNA, 22 bp, Artificial Sequence
  chemically synthesized
cagtggccgctccagacaggct

SEQ ID NO: 1146870 - DNA, 22 bp, Artificial Sequence
  chemically synthesized
gcagtggccgctccagacaggc

SEQ ID NO: 1146871 - DNA, 22 bp, Artificial Sequence
  chemically synthesized
tgcagtggccgctccagacagg

SEQ ID NO: 1146872 - DNA, 22 bp, Artificial Sequence
  chemically synthesized
gcatctttgcagtggccgctcc

SEQ ID NO: 1146873 - DNA, 22 bp, Artificial Sequence
  chemically synthesized
cagctggcatctttgcagtggc

SEQ ID NO: 1146874 - DNA, 22 bp, Artificial Sequence
  chemically synthesized
tctggagcggccactgcaaaga

SEQ ID NO: 1146875 - DNA, 22 bp, Artificial Sequence
  chemically synthesized
ctgcagctggcatctttgcagt

SEQ ID NO: 1146876 - DNA, 22 bp, Artificial Sequence
  chemically synthesized
gctgcagctggcatctttgcag

SEQ ID NO: 1146877 - DNA, 22 bp, Artificial Sequence
  chemically synthesized
gagcggccactgcaaagatgcc

SEQ ID NO: 1146878 - DNA, 22 bp, Artificial Sequence
  chemically synthesized
ccttgctgcagctggcatcttt

SEQ ID NO: 1146879 - DNA, 22 bp, Artificial Sequence
  chemically synthesized
gccacgcctcccttgctgcagc

SEQ ID NO: 1146880 - DNA, 22 bp, Artificial Sequence
  chemically synthesized
caaagatgccagctgcagcaag

SEQ ID NO: 1146881 - DNA, 22 bp, Artificial Sequence
  chemically synthesized
cagcaagggaggcgtggccagg

SEQ ID NO: 1146882 - DNA, 22 bp, Artificial Sequence
  chemically synthesized
cacacagtgcacagccctggcc

SEQ ID NO: 1146883 - DNA, 22 bp, Artificial Sequence
  chemically synthesized
gtggctccacacagtgcacagc

SEQ ID NO: 1146884 - DNA, 22 bp, Artificial Sequence
  chemically synthesized
ggtggctccacacagtgcacag

SEQ ID NO: 1146885 - DNA, 22 bp, Artificial Sequence
  chemically synthesized
gcccttggtggctccacacagt

SEQ ID NO: 1146886 - DNA, 22 bp, Artificial Sequence
  chemically synthesized
ctggcccttggtggctccacac

SEQ ID NO: 1146887 - DNA, 22 bp, Artificial Sequence
  chemically synthesized
ttcctggcccttggtggctcca

SEQ ID NO: 1146888 - DNA, 22 bp, Artificial Sequence
  chemically synthesized
gttcctggcccttggtggctcc

SEQ ID NO: 1146889 - DNA, 22 bp, Artificial Sequence
  chemically synthesized
tgcactgtgtggagccaccaag

SEQ ID NO: 1146890 - DNA, 22 bp, Artificial Sequence
  chemically synthesized
cttgttcctggcccttggtggc

SEQ ID NO: 1146891 - DNA, 22 bp, Artificial Sequence
  chemically synthesized
ctgcttgttcctggcccttggt

SEQ ID NO: 1146892 - DNA, 22 bp, Artificial Sequence
  chemically synthesized
tgtggagccaccaagggccagg

SEQ ID NO: 1146893 - DNA, 22 bp, Artificial Sequence
  chemically synthesized
agtagggagcagcgctcctgct

SEQ ID NO: 1146894 - DNA, 22 bp, Artificial Sequence
  chemically synthesized
ccaactcagtagggagcagcgc

SEQ ID NO: 1146895 - DNA, 22 bp, Artificial Sequence
  chemically synthesized
ccaccctgccaactcagtaggg

SEQ ID NO: 1146896 - DNA, 22 bp, Artificial Sequence
  chemically synthesized
ctccctactgagttggcagggt

SEQ ID NO: 1146897 - DNA, 22 bp, Artificial Sequence
  chemically synthesized
cctactgagttggcagggtggg

SEQ ID NO: 1146898 - DNA, 22 bp, Artificial Sequence
  chemically synthesized
gaagcatggggctcccaccctg

SEQ ID NO: 1146899 - DNA, 22 bp, Artificial Sequence
  chemically synthesized
ctgagttggcagggtgggagcc

SEQ ID NO: 1146900 - DNA, 22 bp, Artificial Sequence
  chemically synthesized
agttggcagggtgggagcccca

SEQ ID NO: 1146901 - DNA, 22 bp, Artificial Sequence
  chemically synthesized
cacctggaagcatggggctccc

SEQ ID NO: 1146902 - DNA, 22 bp, Artificial Sequence
  chemically synthesized
gcagggtgggagccccatgctt

SEQ ID NO: 1146903 - DNA, 22 bp, Artificial Sequence
  chemically synthesized
cagctgcacctggaagcatggg

SEQ ID NO: 1146904 - DNA, 22 bp, Artificial Sequence
  chemically synthesized
ggtggctgcagctgcacctgga

SEQ ID NO: 1146905 - DNA, 22 bp, Artificial Sequence
  chemically synthesized
tggctgggtggctgcagctgca

SEQ ID NO: 1146906 - DNA, 22 bp, Artificial Sequence
  chemically synthesized
ccaggtgcagctgcagccaccc

SEQ ID NO: 1146907 - DNA, 22 bp, Artificial Sequence
  chemically synthesized
caggtgcagctgcagccaccca

SEQ ID NO: 1146908 - DNA, 22 bp, Artificial Sequence
  chemically synthesized
cagccacccagccacagctccg

SEQ ID NO: 1146909 - DNA, 22 bp, Artificial Sequence
  chemically synthesized
cggacctgggcattcctgcgct

SEQ ID NO: 1146910 - DNA, 22 bp, Artificial Sequence
  chemically synthesized
ccaggcccccaagagcgcagga

SEQ ID NO: 1146911 - DNA, 22 bp, Artificial Sequence
  chemically synthesized
cccaggcccccaagagcgcagg

SEQ ID NO: 1146912 - DNA, 22 bp, Artificial Sequence
  chemically synthesized
ggcattcctgcgctcttggggg

SEQ ID NO: 1146913 - DNA, 22 bp, Artificial Sequence
  chemically synthesized
ctgcgctcttgggggcctggga

SEQ ID NO: 1146914 - DNA, 22 bp, Artificial Sequence
  chemically synthesized
cgctcttgggggcctgggaagc

SEQ ID NO: 1146915 - DNA, 22 bp, Artificial Sequence
  chemically synthesized
ttgggggcctgggaagcccccc

SEQ ID NO: 1146916 - DNA, 22 bp, Artificial Sequence
  chemically synthesized
gtatgtggaggcaggggggctt

SEQ ID NO: 1146917 - DNA, 22 bp, Artificial Sequence
  chemically synthesized
gggggcctgggaagcccccctg

SEQ ID NO: 1146918 - DNA, 22 bp, Artificial Sequence
  chemically synthesized
agtatgtggaggcaggggggct

SEQ ID NO: 1146919 - DNA, 22 bp, Artificial Sequence
  chemically synthesized
ggggcctgggaagcccccctgc

SEQ ID NO: 1146920 - DNA, 22 bp, Artificial Sequence
  chemically synthesized
ttagtatgtggaggcagggggg

SEQ ID NO: 1146921 - DNA, 22 bp, Artificial Sequence
  chemically synthesized
cttagtatgtggaggcaggggg

SEQ ID NO: 1146922 - DNA, 22 bp, Artificial Sequence
  chemically synthesized
ggaagcccccctgcctccacat

SEQ ID NO: 1146923 - DNA, 22 bp, Artificial Sequence
  chemically synthesized
cctccacatactaagaagtgcc

SEQ ID NO: 1146924 - DNA, 22 bp, Artificial Sequence
  chemically synthesized
cacatactaagaagtgcctgct

SEQ ID NO: 1146925 - DNA, 22 bp, Artificial Sequence
  chemically synthesized
agaagtgcctgctcccactccc

SEQ ID NO: 1146926 - DNA, 22 bp, Artificial Sequence
  chemically synthesized
ctcccactccctggcatctcct

SEQ ID NO: 1146927 - DNA, 22 bp, Artificial Sequence
  chemically synthesized
ccactccctggcatctcctcgc

SEQ ID NO: 1146928 - DNA, 22 bp, Artificial Sequence
  chemically synthesized
cctggcatctcctcgctccccg

SEQ ID NO: 1146929 - DNA, 22 bp, Artificial Sequence
  chemically synthesized
ccaggagccagtgcggggagcg

SEQ ID NO: 1146930 - DNA, 22 bp, Artificial Sequence
  chemically synthesized
tcccaggagccagtgcggggag

SEQ ID NO: 1146931 - DNA, 22 bp, Artificial Sequence
  chemically synthesized
gcatctcctcgctccccgcact

SEQ ID NO: 1146932 - DNA, 22 bp, Artificial Sequence
  chemically synthesized
ctcccaggagccagtgcgggga

SEQ ID NO: 1146933 - DNA, 22 bp, Artificial Sequence
  chemically synthesized
cttctcccaggagccagtgcgg

SEQ ID NO: 1146934 - DNA, 22 bp, Artificial Sequence
  chemically synthesized
gcttctcccaggagccagtgcg

SEQ ID NO: 1146935 - DNA, 22 bp, Artificial Sequence
  chemically synthesized
tgcttctcccaggagccagtgc

SEQ ID NO: 1146936 - DNA, 22 bp, Artificial Sequence
  chemically synthesized
ctcgctccccgcactggctcct

SEQ ID NO: 1146937 - DNA, 22 bp, Artificial Sequence
  chemically synthesized
gctccccgcactggctcctggg

SEQ ID NO: 1146938 - DNA, 22 bp, Artificial Sequence
  chemically synthesized
cccgcactggctcctgggagaa

SEQ ID NO: 1146939 - DNA, 22 bp, Artificial Sequence
  chemically synthesized
gccgcaactttgcttctcccag

SEQ ID NO: 1146940 - DNA, 22 bp, Artificial Sequence
  chemically synthesized
ggccgcaactttgcttctccca

SEQ ID NO: 1146941 - DNA, 22 bp, Artificial Sequence
  chemically synthesized
gtcttggccgcaactttgcttc

SEQ ID NO: 1146942 - DNA, 22 bp, Artificial Sequence
  chemically synthesized
gctcctgggagaagcaaagttg

SEQ ID NO: 1146943 - DNA, 22 bp, Artificial Sequence
  chemically synthesized
ctgggagaagcaaagttgcggc

SEQ ID NO: 1146944 - DNA, 22 bp, Artificial Sequence
  chemically synthesized
ggagaagcaaagttgcggccaa

SEQ ID NO: 1146945 - DNA, 22 bp, Artificial Sequence
  chemically synthesized
cgacaacacctggtcttggccg

SEQ ID NO: 1146946 - DNA, 22 bp, Artificial Sequence
  chemically synthesized
cggccaagaccaggtgttgtcg

SEQ ID NO: 1146947 - DNA, 22 bp, Artificial Sequence
  chemically synthesized
tcccgagcacacacataaccag

SEQ ID NO: 1146948 - DNA, 22 bp, Artificial Sequence
  chemically synthesized
tcgcaacctgactggttatgtg

SEQ ID NO: 1146949 - DNA, 22 bp, Artificial Sequence
  chemically synthesized
actggttatgtgtgtgctcggg

SEQ ID NO: 1146950 - DNA, 22 bp, Artificial Sequence
  chemically synthesized
gcatgccagcactgtcccgagc

SEQ ID NO: 1146951 - DNA, 22 bp, Artificial Sequence
  chemically synthesized
gttatgtgtgtgctcgggacag

SEQ ID NO: 1146952 - DNA, 22 bp, Artificial Sequence
  chemically synthesized
tgtgtgtgctcgggacagtgct

SEQ ID NO: 1146953 - DNA, 22 bp, Artificial Sequence
  chemically synthesized
gggacagtgctggcatgccagc

SEQ ID NO: 1146954 - DNA, 22 bp, Artificial Sequence
  chemically synthesized
gcatgccagccccctgctgcct

SEQ ID NO: 1146955 - DNA, 22 bp, Artificial Sequence
  chemically synthesized
ctgccttgcgcccgtctggact

SEQ ID NO: 1146956 - DNA, 22 bp, Artificial Sequence
  chemically synthesized
atcagtgcccaaagtccagacg

SEQ ID NO: 1146957 - DNA, 22 bp, Artificial Sequence
  chemically synthesized
ccttgcgcccgtctggactttg

SEQ ID NO: 1146958 - DNA, 22 bp, Artificial Sequence
  chemically synthesized
gcgcccgtctggactttgggca

SEQ ID NO: 1146959 - DNA, 22 bp, Artificial Sequence
  chemically synthesized
cgcccgtctggactttgggcac

SEQ ID NO: 1146960 - DNA, 22 bp, Artificial Sequence
  chemically synthesized
ccatgctcatcagtgcccaaag

SEQ ID NO: 1146961 - DNA, 22 bp, Artificial Sequence
  chemically synthesized
tcccatgctcatcagtgcccaa

SEQ ID NO: 1146962 - DNA, 22 bp, Artificial Sequence
  chemically synthesized
tctcccatgctcatcagtgccc

SEQ ID NO: 1146963 - DNA, 22 bp, Artificial Sequence
  chemically synthesized
gactttgggcactgatgagcat

SEQ ID NO: 1146964 - DNA, 22 bp, Artificial Sequence
  chemically synthesized
agcctctctcccatgctcatca

SEQ ID NO: 1146965 - DNA, 22 bp, Artificial Sequence
  chemically synthesized
tgggcactgatgagcatgggag

SEQ ID NO: 1146966 - DNA, 22 bp, Artificial Sequence
  chemically synthesized
gggcactgatgagcatgggaga

SEQ ID NO: 1146967 - DNA, 22 bp, Artificial Sequence
  chemically synthesized
ggcactgatgagcatgggagag

SEQ ID NO: 1146968 - DNA, 22 bp, Artificial Sequence
  chemically synthesized
agtccccactcagcctctctcc

SEQ ID NO: 1146969 - DNA, 22 bp, Artificial Sequence
  chemically synthesized
atgagcatgggagagaggctga

SEQ ID NO: 1146970 - DNA, 22 bp, Artificial Sequence
  chemically synthesized
caggcccacaccgaaccatcct

SEQ ID NO: 1146971 - DNA, 22 bp, Artificial Sequence
  chemically synthesized
agtggggactgaggatggttcg

SEQ ID NO: 1146972 - DNA, 22 bp, Artificial Sequence
  chemically synthesized
aggatggttcggtgtgggcctg

SEQ ID NO: 1146973 - DNA, 22 bp, Artificial Sequence
  chemically synthesized
taccaaggggtacctgcaggcc

SEQ ID NO: 1146974 - DNA, 22 bp, Artificial Sequence
  chemically synthesized
ataccaaggggtacctgcaggc

SEQ ID NO: 1146975 - DNA, 22 bp, Artificial Sequence
  chemically synthesized
ggtgtgggcctgcaggtacccc

SEQ ID NO: 1146976 - DNA, 22 bp, Artificial Sequence
  chemically synthesized
ggcagtttataccaaggggtac

SEQ ID NO: 1146977 - DNA, 22 bp, Artificial Sequence
  chemically synthesized
caggtaccccttggtataaact

SEQ ID NO: 1146978 - DNA, 22 bp, Artificial Sequence
  chemically synthesized
ggtataaactgcctaggctaca

SEQ ID NO: 1146979 - DNA, 22 bp, Artificial Sequence
  chemically synthesized
gtataaactgcctaggctacat

SEQ ID NO: 1146980 - DNA, 22 bp, Artificial Sequence
  chemically synthesized
ccaccatcaacatgccatccat

SEQ ID NO: 1146981 - DNA, 22 bp, Artificial Sequence
  chemically synthesized
cctaggctacatggatggcatg

SEQ ID NO: 1146982 - DNA, 22 bp, Artificial Sequence
  chemically synthesized
ctgccaccatcaacatgccatc

SEQ ID NO: 1146983 - DNA, 22 bp, Artificial Sequence
  chemically synthesized
ggctacatggatggcatgttga

SEQ ID NO: 1146984 - DNA, 22 bp, Artificial Sequence
  chemically synthesized
cctcctgccaccatcaacatgc

SEQ ID NO: 1146985 - DNA, 22 bp, Artificial Sequence
  chemically synthesized
catggatggcatgttgatggtg

SEQ ID NO: 1146986 - DNA, 22 bp, Artificial Sequence
  chemically synthesized
cccaggagccagtctgcctcct

SEQ ID NO: 1146987 - DNA, 22 bp, Artificial Sequence
  chemically synthesized
tgcccaggagccagtctgcctc

SEQ ID NO: 1146988 - DNA, 22 bp, Artificial Sequence
  chemically synthesized
ctgcccaggagccagtctgcct

SEQ ID NO: 1146989 - DNA, 22 bp, Artificial Sequence
  chemically synthesized
atggtggcaggaggcagactgg

SEQ ID NO: 1146990 - DNA, 22 bp, Artificial Sequence
  chemically synthesized
tctgcccaggagccagtctgcc

SEQ ID NO: 1146991 - DNA, 22 bp, Artificial Sequence
  chemically synthesized
ctttctgcccaggagccagtct

SEQ ID NO: 1146992 - DNA, 22 bp, Artificial Sequence
  chemically synthesized
ctcctttctgcccaggagccag

SEQ ID NO: 1146993 - DNA, 22 bp, Artificial Sequence
  chemically synthesized
tggatctgctcctttctgccca

SEQ ID NO: 1146994 - DNA, 22 bp, Artificial Sequence
  chemically synthesized
tgtggatctgctcctttctgcc

SEQ ID NO: 1146995 - DNA, 22 bp, Artificial Sequence
  chemically synthesized
tctgtggatctgctcctttctg

SEQ ID NO: 1146996 - DNA, 22 bp, Artificial Sequence
  chemically synthesized
ctctgtggatctgctcctttct

SEQ ID NO: 1146997 - DNA, 22 bp, Artificial Sequence
  chemically synthesized
gctcctgggcagaaaggagcag

SEQ ID NO: 1146998 - DNA, 22 bp, Artificial Sequence
  chemically synthesized
ctgggcagaaaggagcagatcc

SEQ ID NO: 1146999 - DNA, 22 bp, Artificial Sequence
  chemically synthesized
ggcagaaaggagcagatccaca

SEQ ID NO: 1147000 - DNA, 22 bp, Artificial Sequence
  chemically synthesized
aaggaggggtttctctgtggat

SEQ ID NO: 1147001 - DNA, 22 bp, Artificial Sequence
  chemically synthesized
gaaggaggggtttctctgtgga

SEQ ID NO: 1147002 - DNA, 22 bp, Artificial Sequence
  chemically synthesized
gcttgaaggaggggtttctctg

SEQ ID NO: 1147003 - DNA, 22 bp, Artificial Sequence
  chemically synthesized
ggcttgaaggaggggtttctct

SEQ ID NO: 1147004 - DNA, 22 bp, Artificial Sequence
  chemically synthesized
ttggcttgaaggaggggtttct

SEQ ID NO: 1147005 - DNA, 22 bp, Artificial Sequence
  chemically synthesized
aggccattcttggcttgaagga

SEQ ID NO: 1147006 - DNA, 22 bp, Artificial Sequence
  chemically synthesized
caggccattcttggcttgaagg

SEQ ID NO: 1147007 - DNA, 22 bp, Artificial Sequence
  chemically synthesized
cttcaagccaagaatggcctga

SEQ ID NO: 1147008 - DNA, 22 bp, Artificial Sequence
  chemically synthesized
caagccaagaatggcctgaagc

SEQ ID NO: 1147009 - DNA, 22 bp, Artificial Sequence
  chemically synthesized
aagccaagaatggcctgaagcc

SEQ ID NO: 1147010 - DNA, 22 bp, Artificial Sequence
  chemically synthesized
gcagcccagcccccaggcttca

SEQ ID NO: 1147011 - DNA, 22 bp, Artificial Sequence
  chemically synthesized
cacccagaactggcagcccagc

SEQ ID NO: 1147012 - DNA, 22 bp, Artificial Sequence
  chemically synthesized
aagcctgggggctgggctgcca

SEQ ID NO: 1147013 - DNA, 22 bp, Artificial Sequence
  chemically synthesized
ggggctgggctgccagttctgg

SEQ ID NO: 1147014 - DNA, 22 bp, Artificial Sequence
  chemically synthesized
ggccacaaactccacccagaac

SEQ ID NO: 1147015 - DNA, 22 bp, Artificial Sequence
  chemically synthesized
tgggccacaaactccacccaga

SEQ ID NO: 1147016 - DNA, 22 bp, Artificial Sequence
  chemically synthesized
ggctgccagttctgggtggagt

SEQ ID NO: 1147017 - DNA, 22 bp, Artificial Sequence
  chemically synthesized
attctgggccacaaactccacc

SEQ ID NO: 1147018 - DNA, 22 bp, Artificial Sequence
  chemically synthesized
tcattctgggccacaaactcca

SEQ ID NO: 1147019 - DNA, 22 bp, Artificial Sequence
  chemically synthesized
ccagttctgggtggagtttgtg

SEQ ID NO: 1147020 - DNA, 22 bp, Artificial Sequence
  chemically synthesized
tgggtggagtttgtggcccaga

SEQ ID NO: 1147021 - DNA, 22 bp, Artificial Sequence
  chemically synthesized
ggtggagtttgtggcccagaat

SEQ ID NO: 1147022 - DNA, 22 bp, Artificial Sequence
  chemically synthesized
gtggcccagaatgagaacttat

SEQ ID NO: 1147023 - DNA, 22 bp, Artificial Sequence
  chemically synthesized
tggcccagaatgagaacttatg

SEQ ID NO: 1147024 - DNA, 22 bp, Artificial Sequence
  chemically synthesized
atggtgctttttctgggcctat

SEQ ID NO: 1147025 - DNA, 22 bp, Artificial Sequence
  chemically synthesized
tggtgctttttctgggcctatc

SEQ ID NO: 1147026 - DNA, 22 bp, Artificial Sequence
  chemically synthesized
gtccatggacatccatggatag

SEQ ID NO: 1147027 - DNA, 22 bp, Artificial Sequence
  chemically synthesized
tttctgggcctatccatggatg

SEQ ID NO: 1147028 - DNA, 22 bp, Artificial Sequence
  chemically synthesized
ttctgggcctatccatggatgt

SEQ ID NO: 1147029 - DNA, 22 bp, Artificial Sequence
  chemically synthesized
attggtccatggacatccatgg

SEQ ID NO: 1147030 - DNA, 22 bp, Artificial Sequence
  chemically synthesized
tctgggcctatccatggatgtc

SEQ ID NO: 1147031 - DNA, 22 bp, Artificial Sequence
  chemically synthesized
ctgggcctatccatggatgtcc

SEQ ID NO: 1147032 - DNA, 22 bp, Artificial Sequence
  chemically synthesized
taattggtccatggacatccat

SEQ ID NO: 1147033 - DNA, 22 bp, Artificial Sequence
  chemically synthesized
tgggcctatccatggatgtcca

SEQ ID NO: 1147034 - DNA, 22 bp, Artificial Sequence
  chemically synthesized
ggcctatccatggatgtccatg

SEQ ID NO: 1147035 - DNA, 22 bp, Artificial Sequence
  chemically synthesized
tccatggatgtccatggaccaa

SEQ ID NO: 1147036 - DNA, 22 bp, Artificial Sequence
  chemically synthesized
ggaagggaggaggtacattcta

SEQ ID NO: 1147037 - DNA, 22 bp, Artificial Sequence
  chemically synthesized
tgggctcggaagggaggaggta

SEQ ID NO: 1147038 - DNA, 22 bp, Artificial Sequence
  chemically synthesized
atgggctcggaagggaggaggt

SEQ ID NO: 1147039 - DNA, 22 bp, Artificial Sequence
  chemically synthesized
tatgggctcggaagggaggagg

SEQ ID NO: 1147040 - DNA, 22 bp, Artificial Sequence
  chemically synthesized
ttatgggctcggaagggaggag

SEQ ID NO: 1147041 - DNA, 22 bp, Artificial Sequence
  chemically synthesized
gaatgtacctcctcccttccga

SEQ ID NO: 1147042 - DNA, 22 bp, Artificial Sequence
  chemically synthesized
gggtttttatgggctcggaagg

SEQ ID NO: 1147043 - DNA, 22 bp, Artificial Sequence
  chemically synthesized
agtctggggtttttatgggctc

SEQ ID NO: 1147044 - DNA, 22 bp, Artificial Sequence
  chemically synthesized
ctcccttccgagcccataaaaa

SEQ ID NO: 1147045 - DNA, 22 bp, Artificial Sequence
  chemically synthesized
tctgagtctggggtttttatgg

SEQ ID NO: 1147046 - DNA, 22 bp, Artificial Sequence
  chemically synthesized
gtctgagtctggggtttttatg

SEQ ID NO: 1147047 - DNA, 22 bp, Artificial Sequence
  chemically synthesized
ccttccgagcccataaaaaccc

SEQ ID NO: 1147048 - DNA, 22 bp, Artificial Sequence
  chemically synthesized
ccgagcccataaaaaccccaga

SEQ ID NO: 1147049 - DNA, 22 bp, Artificial Sequence
  chemically synthesized
agtttgtctgagtctggggttt

SEQ ID NO: 1147050 - DNA, 22 bp, Artificial Sequence
  chemically synthesized
cgagcccataaaaaccccagac

SEQ ID NO: 1147051 - DNA, 22 bp, Artificial Sequence
  chemically synthesized
gtagtcccaatgtctaagtttg

SEQ ID NO: 1147052 - DNA, 22 bp, Artificial Sequence
  chemically synthesized
cggctggtagtcccaatgtcta

SEQ ID NO: 1147053 - DNA, 22 bp, Artificial Sequence
  chemically synthesized
agacaaacttagacattgggac

SEQ ID NO: 1147054 - DNA, 22 bp, Artificial Sequence
  chemically synthesized
ctgcggctggtagtcccaatgt

SEQ ID NO: 1147055 - DNA, 22 bp, Artificial Sequence
  chemically synthesized
cctgcggctggtagtcccaatg

SEQ ID NO: 1147056 - DNA, 22 bp, Artificial Sequence
  chemically synthesized
cttcctgcggctggtagtccca

SEQ ID NO: 1147057 - DNA, 22 bp, Artificial Sequence
  chemically synthesized
agacattgggactaccagccgc

SEQ ID NO: 1147058 - DNA, 22 bp, Artificial Sequence
  chemically synthesized
gacattgggactaccagccgca

SEQ ID NO: 1147059 - DNA, 22 bp, Artificial Sequence
  chemically synthesized
ggactaccagccgcaggaagga

SEQ ID NO: 1147060 - DNA, 22 bp, Artificial Sequence
  chemically synthesized
ccagccgcaggaaggagctacc

SEQ ID NO: 1147061 - DNA, 22 bp, Artificial Sequence
  chemically synthesized
aagagtcaaggagacacaaagt

SEQ ID NO: 1147062 - DNA, 22 bp, Artificial Sequence
  chemically synthesized
cctactttgtgtctccttgact

SEQ ID NO: 1147063 - DNA, 22 bp, Artificial Sequence
  chemically synthesized
ctttgtgtctccttgactcttc

SEQ ID NO: 1147064 - DNA, 22 bp, Artificial Sequence
  chemically synthesized
tgtgtctccttgactcttcagg

SEQ ID NO: 1147065 - DNA, 22 bp, Artificial Sequence
  chemically synthesized
gtgtctccttgactcttcagga

SEQ ID NO: 1147066 - DNA, 22 bp, Artificial Sequence
  chemically synthesized
tgtctccttgactcttcaggat

SEQ ID NO: 1147067 - DNA, 22 bp, Artificial Sequence
  chemically synthesized
tgcaggcaggtcatcctgaaga

SEQ ID NO: 1147068 - DNA, 22 bp, Artificial Sequence
  chemically synthesized
atgcaggcaggtcatcctgaag

SEQ ID NO: 1147069 - DNA, 22 bp, Artificial Sequence
  chemically synthesized
tatgcaggcaggtcatcctgaa

SEQ ID NO: 1147070 - DNA, 22 bp, Artificial Sequence
  chemically synthesized
ctttatgcaggcaggtcatcct

SEQ ID NO: 1147071 - DNA, 22 bp, Artificial Sequence
  chemically synthesized
cttgactcttcaggatgacctg

SEQ ID NO: 1147072 - DNA, 22 bp, Artificial Sequence
  chemically synthesized
gactcttcaggatgacctgcct

SEQ ID NO: 1147073 - DNA, 22 bp, Artificial Sequence
  chemically synthesized
actcttcaggatgacctgcctg

SEQ ID NO: 1147074 - DNA, 22 bp, Artificial Sequence
  chemically synthesized
ttcaggatgacctgcctgcata

SEQ ID NO: 1147075 - DNA, 22 bp, Artificial Sequence
  chemically synthesized
caggatgacctgcctgcataaa

SEQ ID NO: 1147076 - DNA, 22 bp, Artificial Sequence
  chemically synthesized
aggatgacctgcctgcataaag

SEQ ID NO: 1147077 - DNA, 22 bp, Artificial Sequence
  chemically synthesized
cctgcataaaggagccacccac

SEQ ID NO: 1147078 - DNA, 22 bp, Artificial Sequence
  chemically synthesized
cataaaggagccacccaccatg

SEQ ID NO: 1147079 - DNA, 22 bp, Artificial Sequence
  chemically synthesized
tgagtagagaggagacccatgg

SEQ ID NO: 1147080 - DNA, 22 bp, Artificial Sequence
  chemically synthesized
ctctctactcacagctgcacac

SEQ ID NO: 1147081 - DNA, 22 bp, Artificial Sequence
  chemically synthesized
tctactcacagctgcacactcc

SEQ ID NO: 1147082 - DNA, 22 bp, Artificial Sequence
  chemically synthesized
tactcacagctgcacactccct

SEQ ID NO: 1147083 - DNA, 22 bp, Artificial Sequence
  chemically synthesized
ctcacagctgcacactccctgg

SEQ ID NO: 1147084 - DNA, 22 bp, Artificial Sequence
  chemically synthesized
acagctgcacactccctgggac

SEQ ID NO: 1147085 - DNA, 22 bp, Artificial Sequence
  chemically synthesized
cacaggcaggtcgtcccaggga

SEQ ID NO: 1147086 - DNA, 22 bp, Artificial Sequence
  chemically synthesized
ccacaggcaggtcgtcccaggg

SEQ ID NO: 1147087 - DNA, 22 bp, Artificial Sequence
  chemically synthesized
tccacaggcaggtcgtcccagg

SEQ ID NO: 1147088 - DNA, 22 bp, Artificial Sequence
  chemically synthesized
ctttccacaggcaggtcgtccc

SEQ ID NO: 1147089 - DNA, 22 bp, Artificial Sequence
  chemically synthesized
cacactccctgggacgacctgc

SEQ ID NO: 1147090 - DNA, 22 bp, Artificial Sequence
  chemically synthesized
cctgggacgacctgcctgtgga

SEQ ID NO: 1147091 - DNA, 22 bp, Artificial Sequence
  chemically synthesized
ggacgacctgcctgtggaaagg

SEQ ID NO: 1147092 - DNA, 22 bp, Artificial Sequence
  chemically synthesized
aggataccacggtgggtagctc

SEQ ID NO: 1147093 - DNA, 22 bp, Artificial Sequence
  chemically synthesized
cctgtggaaaggagctacccac

SEQ ID NO: 1147094 - DNA, 22 bp, Artificial Sequence
  chemically synthesized
tcaggataccacggtgggtagc

SEQ ID NO: 1147095 - DNA, 22 bp, Artificial Sequence
  chemically synthesized
tggaaaggagctacccaccgtg

SEQ ID NO: 1147096 - DNA, 22 bp, Artificial Sequence
  chemically synthesized
cccaccgtggtatcctgagagc

SEQ ID NO: 1147097 - DNA, 22 bp, Artificial Sequence
  chemically synthesized
agcgagagaacagctctcagga

SEQ ID NO: 1147098 - DNA, 22 bp, Artificial Sequence
  chemically synthesized
attgagcgagagaacagctctc

SEQ ID NO: 1147099 - DNA, 22 bp, Artificial Sequence
  chemically synthesized
cattgagcgagagaacagctct

SEQ ID NO: 1147100 - DNA, 22 bp, Artificial Sequence
  chemically synthesized
agagctgttctctcgctcaatg

SEQ ID NO: 1147101 - DNA, 22 bp, Artificial Sequence
  chemically synthesized
ttctctcgctcaatgaagctcc

SEQ ID NO: 1147102 - DNA, 22 bp, Artificial Sequence
  chemically synthesized
tctcgctcaatgaagctcctct

SEQ ID NO: 1147103 - DNA, 22 bp, Artificial Sequence
  chemically synthesized
tcgctcaatgaagctcctctgc

SEQ ID NO: 1147104 - DNA, 22 bp, Artificial Sequence
  chemically synthesized
gctcaatgaagctcctctgcac

SEQ ID NO: 1147105 - DNA, 22 bp, Artificial Sequence
  chemically synthesized
gagggtgagcaaggtgcagagg

SEQ ID NO: 1147106 - DNA, 22 bp, Artificial Sequence
  chemically synthesized
aatgaagctcctctgcaccttg

SEQ ID NO: 1147107 - DNA, 22 bp, Artificial Sequence
  chemically synthesized
ctctgcaccttgctcaccctcc

SEQ ID NO: 1147108 - DNA, 22 bp, Artificial Sequence
  chemically synthesized
tgcaccttgctcaccctccagt

SEQ ID NO: 1147109 - DNA, 22 bp, Artificial Sequence
  chemically synthesized
caccttgctcaccctccagttg

SEQ ID NO: 1147110 - DNA, 22 bp, Artificial Sequence
  chemically synthesized
gctcaccctccagttgtccatg

SEQ ID NO: 1147111 - DNA, 22 bp, Artificial Sequence
  chemically synthesized
ctcaccctccagttgtccatgt

SEQ ID NO: 1147112 - DNA, 22 bp, Artificial Sequence
  chemically synthesized
accctccagttgtccatgtacc

SEQ ID NO: 1147113 - DNA, 22 bp, Artificial Sequence
  chemically synthesized
cagttgtccatgtacctcattc

SEQ ID NO: 1147114 - DNA, 22 bp, Artificial Sequence
  chemically synthesized
tcccatgtccaggaagaatgag

SEQ ID NO: 1147115 - DNA, 22 bp, Artificial Sequence
  chemically synthesized
gtcccatgtccaggaagaatga

SEQ ID NO: 1147116 - DNA, 22 bp, Artificial Sequence
  chemically synthesized
tccatgtacctcattcttcctg

SEQ ID NO: 1147117 - DNA, 22 bp, Artificial Sequence
  chemically synthesized
ttgtcccatgtccaggaagaat

SEQ ID NO: 1147118 - DNA, 22 bp, Artificial Sequence
  chemically synthesized
agttcttgtcccatgtccagga

SEQ ID NO: 1147119 - DNA, 22 bp, Artificial Sequence
  chemically synthesized
attcttcctggacatgggacaa

SEQ ID NO: 1147120 - DNA, 22 bp, Artificial Sequence
  chemically synthesized
ttcctggacatgggacaagaac

SEQ ID NO: 1147121 - DNA, 22 bp, Artificial Sequence
  chemically synthesized
agcaagtcctgagttcttgtcc

SEQ ID NO: 1147122 - DNA, 22 bp, Artificial Sequence
  chemically synthesized
cctggacatgggacaagaactc

SEQ ID NO: 1147123 - DNA, 22 bp, Artificial Sequence
  chemically synthesized
ctggacatgggacaagaactca

SEQ ID NO: 1147124 - DNA, 22 bp, Artificial Sequence
  chemically synthesized
gacatgggacaagaactcagga

SEQ ID NO: 1147125 - DNA, 22 bp, Artificial Sequence
  chemically synthesized
ccattcagcaagtcctgagttc

SEQ ID NO: 1147126 - DNA, 22 bp, Artificial Sequence
  chemically synthesized
tcctgccattcagcaagtcctg

SEQ ID NO: 1147127 - DNA, 22 bp, Artificial Sequence
  chemically synthesized
gtcctgccattcagcaagtcct

SEQ ID NO: 1147128 - DNA, 22 bp, Artificial Sequence
  chemically synthesized
tgtcctgccattcagcaagtcc

SEQ ID NO: 1147129 - DNA, 22 bp, Artificial Sequence
  chemically synthesized
ttgtcctgccattcagcaagtc

SEQ ID NO: 1147130 - DNA, 22 bp, Artificial Sequence
  chemically synthesized
tttgtcctgccattcagcaagt

SEQ ID NO: 1147131 - DNA, 22 bp, Artificial Sequence
  chemically synthesized
tttttgtcctgccattcagcaa

SEQ ID NO: 1147132 - DNA, 22 bp, Artificial Sequence
  chemically synthesized
cagctctttttgtcctgccatt

SEQ ID NO: 1147133 - DNA, 22 bp, Artificial Sequence
  chemically synthesized
aggacttgctgaatggcaggac

SEQ ID NO: 1147134 - DNA, 22 bp, Artificial Sequence
  chemically synthesized
tgttacagctctttttgtcctg

SEQ ID NO: 1147135 - DNA, 22 bp, Artificial Sequence
  chemically synthesized
gtgttacagctctttttgtcct

SEQ ID NO: 1147136 - DNA, 22 bp, Artificial Sequence
  chemically synthesized
gctgaatggcaggacaaaaaga

SEQ ID NO: 1147137 - DNA, 22 bp, Artificial Sequence
  chemically synthesized
ctgaatggcaggacaaaaagag

SEQ ID NO: 1147138 - DNA, 22 bp, Artificial Sequence
  chemically synthesized
tttgtgttacagctctttttgt

SEQ ID NO: 1147139 - DNA, 22 bp, Artificial Sequence
  chemically synthesized
aatggcaggacaaaaagagctg

SEQ ID NO: 1147140 - DNA, 22 bp, Artificial Sequence
  chemically synthesized
agccctgtttgtgttacagctc

SEQ ID NO: 1147141 - DNA, 22 bp, Artificial Sequence
  chemically synthesized
cagccctgtttgtgttacagct

SEQ ID NO: 1147142 - DNA, 22 bp, Artificial Sequence
  chemically synthesized
taacacaaacagggctgaaaca

SEQ ID NO: 1147143 - DNA, 22 bp, Artificial Sequence
  chemically synthesized
cccatagcatggtgagtggggg

SEQ ID NO: 1147144 - DNA, 22 bp, Artificial Sequence
  chemically synthesized
aaacatgccccccactcaccat

SEQ ID NO: 1147145 - DNA, 22 bp, Artificial Sequence
  chemically synthesized
attgcccatagcatggtgagtg

SEQ ID NO: 1147146 - DNA, 22 bp, Artificial Sequence
  chemically synthesized
tcattgcccatagcatggtgag

SEQ ID NO: 1147147 - DNA, 22 bp, Artificial Sequence
  chemically synthesized
ctcattgcccatagcatggtga

SEQ ID NO: 1147148 - DNA, 22 bp, Artificial Sequence
  chemically synthesized
tttctcattgcccatagcatgg

SEQ ID NO: 1147149 - DNA, 22 bp, Artificial Sequence
  chemically synthesized
tgtttctcattgcccatagcat

SEQ ID NO: 1147150 - DNA, 22 bp, Artificial Sequence
  chemically synthesized
tctgtttctcattgcccatagc

SEQ ID NO: 1147151 - DNA, 22 bp, Artificial Sequence
  chemically synthesized
ctctgtttctcattgcccatag

SEQ ID NO: 1147152 - DNA, 22 bp, Artificial Sequence
  chemically synthesized
ttctctgtttctcattgcccat

SEQ ID NO: 1147153 - DNA, 22 bp, Artificial Sequence
  chemically synthesized
accatgctatgggcaatgagaa

SEQ ID NO: 1147154 - DNA, 22 bp, Artificial Sequence
  chemically synthesized
tgggcaatgagaaacagagaag

SEQ ID NO: 1147155 - DNA, 22 bp, Artificial Sequence
  chemically synthesized
caaaaggccacagctcttctct

SEQ ID NO: 1147156 - DNA, 22 bp, Artificial Sequence
  chemically synthesized
tgcaaaaggccacagctcttct

SEQ ID NO: 1147157 - DNA, 22 bp, Artificial Sequence
  chemically synthesized
ggctctgcaaaaggccacagct

SEQ ID NO: 1147158 - DNA, 22 bp, Artificial Sequence
  chemically synthesized
tggccttttgcagagcccagac

SEQ ID NO: 1147159 - DNA, 22 bp, Artificial Sequence
  chemically synthesized
aggagccccaaggtctgggctc

SEQ ID NO: 1147160 - DNA, 22 bp, Artificial Sequence
  chemically synthesized
gaggagccccaaggtctgggct

SEQ ID NO: 1147161 - DNA, 22 bp, Artificial Sequence
  chemically synthesized
gcttgaggagccccaaggtctg

SEQ ID NO: 1147162 - DNA, 22 bp, Artificial Sequence
  chemically synthesized
ttgcagagcccagaccttgggg

SEQ ID NO: 1147163 - DNA, 22 bp, Artificial Sequence
  chemically synthesized
tgcagagcccagaccttggggc

SEQ ID NO: 1147164 - DNA, 22 bp, Artificial Sequence
  chemically synthesized
gcagagcccagaccttggggct

SEQ ID NO: 1147165 - DNA, 22 bp, Artificial Sequence
  chemically synthesized
cagagcccagaccttggggctc

SEQ ID NO: 1147166 - DNA, 22 bp, Artificial Sequence
  chemically synthesized
cagcatgccacaaccctggctt

SEQ ID NO: 1147167 - DNA, 22 bp, Artificial Sequence
  chemically synthesized
ggggctcctcaagccagggttg

SEQ ID NO: 1147168 - DNA, 22 bp, Artificial Sequence
  chemically synthesized
gggctcctcaagccagggttgt

SEQ ID NO: 1147169 - DNA, 22 bp, Artificial Sequence
  chemically synthesized
ctcaagccagggttgtggcatg

SEQ ID NO: 1147170 - DNA, 22 bp, Artificial Sequence
  chemically synthesized
aagccagggttgtggcatgctg

SEQ ID NO: 1147171 - DNA, 22 bp, Artificial Sequence
  chemically synthesized
tggcatgctgtaacatgctcct

SEQ ID NO: 1147172 - DNA, 22 bp, Artificial Sequence
  chemically synthesized
taacatgctccttggggctctg

SEQ ID NO: 1147173 - DNA, 22 bp, Artificial Sequence
  chemically synthesized
agagacaccaggaaccacagag

SEQ ID NO: 1147174 - DNA, 22 bp, Artificial Sequence
  chemically synthesized
cttggggctctgtggttcctgg

SEQ ID NO: 1147175 - DNA, 22 bp, Artificial Sequence
  chemically synthesized
aaagctcagagacaccaggaac

SEQ ID NO: 1147176 - DNA, 22 bp, Artificial Sequence
  chemically synthesized
ggggctctgtggttcctggtgt

SEQ ID NO: 1147177 - DNA, 22 bp, Artificial Sequence
  chemically synthesized
gggctctgtggttcctggtgtc

SEQ ID NO: 1147178 - DNA, 22 bp, Artificial Sequence
  chemically synthesized
tgtggttcctggtgtctctgag

SEQ ID NO: 1147179 - DNA, 22 bp, Artificial Sequence
  chemically synthesized
tggttcctggtgtctctgagct

SEQ ID NO: 1147180 - DNA, 22 bp, Artificial Sequence
  chemically synthesized
ctggtgtctctgagctttcagg

SEQ ID NO: 1147181 - DNA, 22 bp, Artificial Sequence
  chemically synthesized
gtgtctctgagctttcaggtgc

SEQ ID NO: 1147182 - DNA, 22 bp, Artificial Sequence
  chemically synthesized
gacaggggatcgcggtggcacc

SEQ ID NO: 1147183 - DNA, 22 bp, Artificial Sequence
  chemically synthesized
tgagctttcaggtgccaccgcg

SEQ ID NO: 1147184 - DNA, 22 bp, Artificial Sequence
  chemically synthesized
agctttcaggtgccaccgcgat

SEQ ID NO: 1147185 - DNA, 22 bp, Artificial Sequence
  chemically synthesized
tcaggtgccaccgcgatcccct

SEQ ID NO: 1147186 - DNA, 22 bp, Artificial Sequence
  chemically synthesized
caggtgccaccgcgatcccctg

SEQ ID NO: 1147187 - DNA, 22 bp, Artificial Sequence
  chemically synthesized
aggtgccaccgcgatcccctgt

SEQ ID NO: 1147188 - DNA, 22 bp, Artificial Sequence
  chemically synthesized
caggcaccaatgtctggacagg

SEQ ID NO: 1147189 - DNA, 22 bp, Artificial Sequence
  chemically synthesized
ctgcaggcaccaatgtctggac

SEQ ID NO: 1147190 - DNA, 22 bp, Artificial Sequence
  chemically synthesized
tgctgcaggcaccaatgtctgg

SEQ ID NO: 1147191 - DNA, 22 bp, Artificial Sequence
  chemically synthesized
ctgctgcaggcaccaatgtctg

SEQ ID NO: 1147192 - DNA, 22 bp, Artificial Sequence
  chemically synthesized
tccagacattggtgcctgcagc

SEQ ID NO: 1147193 - DNA, 22 bp, Artificial Sequence
  chemically synthesized
gtgcctgcagcagaagctactt

SEQ ID NO: 1147194 - DNA, 22 bp, Artificial Sequence
  chemically synthesized
gaccagatgtaccacaagtagc

SEQ ID NO: 1147195 - DNA, 22 bp, Artificial Sequence
  chemically synthesized
cagcagaagctacttgtggtac

SEQ ID NO: 1147196 - DNA, 22 bp, Artificial Sequence
  chemically synthesized
tggctggaccagatgtaccaca

SEQ ID NO: 1147197 - DNA, 22 bp, Artificial Sequence
  chemically synthesized
cttgtggtacatctggtccagc

SEQ ID NO: 1147198 - DNA, 22 bp, Artificial Sequence
  chemically synthesized
catgtgaggctgtggctggacc

SEQ ID NO: 1147199 - DNA, 22 bp, Artificial Sequence
  chemically synthesized
gtggtacatctggtccagccac

SEQ ID NO: 1147200 - DNA, 22 bp, Artificial Sequence
  chemically synthesized
tggtacatctggtccagccaca

SEQ ID NO: 1147201 - DNA, 22 bp, Artificial Sequence
  chemically synthesized
gtggcagctccatgtgaggctg

SEQ ID NO: 1147202 - DNA, 22 bp, Artificial Sequence
  chemically synthesized
gtccagccacagcctcacatgg

SEQ ID NO: 1147203 - DNA, 22 bp, Artificial Sequence
  chemically synthesized
caggcaccagtactggtggcag

SEQ ID NO: 1147204 - DNA, 22 bp, Artificial Sequence
  chemically synthesized
acatggagctgccaccagtact

SEQ ID NO: 1147205 - DNA, 22 bp, Artificial Sequence
  chemically synthesized
ccaccagtactggtgcctgtag

SEQ ID NO: 1147206 - DNA, 22 bp, Artificial Sequence
  chemically synthesized
cagcggaaggcagctacaggca

SEQ ID NO: 1147207 - DNA, 22 bp, Artificial Sequence
  chemically synthesized
gtgcctgtagctgccttccgct

SEQ ID NO: 1147208 - DNA, 22 bp, Artificial Sequence
  chemically synthesized
tagctgccttccgctgcagctg

SEQ ID NO: 1147209 - DNA, 22 bp, Artificial Sequence
  chemically synthesized
tgcacagacaggcatgccagct

SEQ ID NO: 1147210 - DNA, 22 bp, Artificial Sequence
  chemically synthesized
ccttccgctgcagctggcatgc

SEQ ID NO: 1147211 - DNA, 22 bp, Artificial Sequence
  chemically synthesized
ccgctgcagctggcatgcctgt

SEQ ID NO: 1147212 - DNA, 22 bp, Artificial Sequence
  chemically synthesized
cgctgcagctggcatgcctgtc

SEQ ID NO: 1147213 - DNA, 22 bp, Artificial Sequence
  chemically synthesized
gccactgtgcacagacaggcat

SEQ ID NO: 1147214 - DNA, 22 bp, Artificial Sequence
  chemically synthesized
cagctggcatgcctgtctgtgc

SEQ ID NO: 1147215 - DNA, 22 bp, Artificial Sequence
  chemically synthesized
gcatgcctgtctgtgcacagtg

SEQ ID NO: 1147216 - DNA, 22 bp, Artificial Sequence
  chemically synthesized
tctgtgcacagtggccaggcct

SEQ ID NO: 1147217 - DNA, 22 bp, Artificial Sequence
  chemically synthesized
tgcacagtggccaggcctcatg

SEQ ID NO: 1147218 - DNA, 22 bp, Artificial Sequence
  chemically synthesized
atgctcgcttgctcacatacct

SEQ ID NO: 1147219 - DNA, 22 bp, Artificial Sequence
  chemically synthesized
gcttgctcacatacctcttact

SEQ ID NO: 1147220 - DNA, 22 bp, Artificial Sequence
  chemically synthesized
gctcacatacctcttactgctc

SEQ ID NO: 1147221 - DNA, 22 bp, Artificial Sequence
  chemically synthesized
ctcacatacctcttactgctct

SEQ ID NO: 1147222 - DNA, 22 bp, Artificial Sequence
  chemically synthesized
acatacctcttactgctctgtg

SEQ ID NO: 1147223 - DNA, 22 bp, Artificial Sequence
  chemically synthesized
ccaagggcaagccaggcacaga

SEQ ID NO: 1147224 - DNA, 22 bp, Artificial Sequence
  chemically synthesized
ttactgctctgtgcctggcttg

SEQ ID NO: 1147225 - DNA, 22 bp, Artificial Sequence
  chemically synthesized
actgctctgtgcctggcttgcc

SEQ ID NO: 1147226 - DNA, 22 bp, Artificial Sequence
  chemically synthesized
ctgctctgtgcctggcttgccc

SEQ ID NO: 1147227 - DNA, 22 bp, Artificial Sequence
  chemically synthesized
ctctgtgcctggcttgcccttg

SEQ ID NO: 1147228 - DNA, 22 bp, Artificial Sequence
  chemically synthesized
tgtgcctggcttgcccttggca

SEQ ID NO: 1147229 - DNA, 22 bp, Artificial Sequence
  chemically synthesized
tgcctggcttgcccttggcagg

SEQ ID NO: 1147230 - DNA, 22 bp, Artificial Sequence
  chemically synthesized
gcccggatccccatgcctgcca

SEQ ID NO: 1147231 - DNA, 22 bp, Artificial Sequence
  chemically synthesized
gcttgcccttggcaggcatggg

SEQ ID NO: 1147232 - DNA, 22 bp, Artificial Sequence
  chemically synthesized
ctggcccggatccccatgcctg

SEQ ID NO: 1147233 - DNA, 22 bp, Artificial Sequence
  chemically synthesized
gcccttggcaggcatggggatc

SEQ ID NO: 1147234 - DNA, 22 bp, Artificial Sequence
  chemically synthesized
cccttggcaggcatggggatcc

SEQ ID NO: 1147235 - DNA, 22 bp, Artificial Sequence
  chemically synthesized
cactactggcccggatccccat

SEQ ID NO: 1147236 - DNA, 22 bp, Artificial Sequence
  chemically synthesized
gcactactggcccggatcccca

SEQ ID NO: 1147237 - DNA, 22 bp, Artificial Sequence
  chemically synthesized
ggcaggcatggggatccgggcc

SEQ ID NO: 1147238 - DNA, 22 bp, Artificial Sequence
  chemically synthesized
gcttgcactactggcccggatc

SEQ ID NO: 1147239 - DNA, 22 bp, Artificial Sequence
  chemically synthesized
gcaggcatggggatccgggcca

SEQ ID NO: 1147240 - DNA, 22 bp, Artificial Sequence
  chemically synthesized
ggcttgcactactggcccggat

SEQ ID NO: 1147241 - DNA, 22 bp, Artificial Sequence
  chemically synthesized
tgcttggcttgcactactggcc

SEQ ID NO: 1147242 - DNA, 22 bp, Artificial Sequence
  chemically synthesized
gcaggctgtgcttggcttgcac

SEQ ID NO: 1147243 - DNA, 22 bp, Artificial Sequence
  chemically synthesized
agcctggcaggctgtgcttggc

SEQ ID NO: 1147244 - DNA, 22 bp, Artificial Sequence
  chemically synthesized
cacccactcagcctggcaggct

SEQ ID NO: 1147245 - DNA, 22 bp, Artificial Sequence
  chemically synthesized
gcacccactcagcctggcaggc

SEQ ID NO: 1147246 - DNA, 22 bp, Artificial Sequence
  chemically synthesized
cttgcacccactcagcctggca

SEQ ID NO: 1147247 - DNA, 22 bp, Artificial Sequence
  chemically synthesized
ggctccttgcacccactcagcc

SEQ ID NO: 1147248 - DNA, 22 bp, Artificial Sequence
  chemically synthesized
ccaggctgagtgggtgcaagga

SEQ ID NO: 1147249 - DNA, 22 bp, Artificial Sequence
  chemically synthesized
tgcccgctgggctccttgcacc

SEQ ID NO: 1147250 - DNA, 22 bp, Artificial Sequence
  chemically synthesized
gtgcccgctgggctccttgcac

SEQ ID NO: 1147251 - DNA, 22 bp, Artificial Sequence
  chemically synthesized
cttgtgcccgctgggctccttg

SEQ ID NO: 1147252 - DNA, 22 bp, Artificial Sequence
  chemically synthesized
gcttgtgcccgctgggctcctt

SEQ ID NO: 1147253 - DNA, 22 bp, Artificial Sequence
  chemically synthesized
tgcttgtgcccgctgggctcct

SEQ ID NO: 1147254 - DNA, 22 bp, Artificial Sequence
  chemically synthesized
agtgggtgcaaggagcccagcg

SEQ ID NO: 1147255 - DNA, 22 bp, Artificial Sequence
  chemically synthesized
ggttttgcttgtgcccgctggg

SEQ ID NO: 1147256 - DNA, 22 bp, Artificial Sequence
  chemically synthesized
tctgggttttgcttgtgcccgc

SEQ ID NO: 1147257 - DNA, 22 bp, Artificial Sequence
  chemically synthesized
tgtctgggttttgcttgtgccc

SEQ ID NO: 1147258 - DNA, 22 bp, Artificial Sequence
  chemically synthesized
tggccggcagcacctctgtctg

SEQ ID NO: 1147259 - DNA, 22 bp, Artificial Sequence
  chemically synthesized
tgtggccggcagcacctctgtc

SEQ ID NO: 1147260 - DNA, 22 bp, Artificial Sequence
  chemically synthesized
ccagccagaaacctctgtggcc

SEQ ID NO: 1147261 - DNA, 22 bp, Artificial Sequence
  chemically synthesized
gccagccagaaacctctgtggc

SEQ ID NO: 1147262 - DNA, 22 bp, Artificial Sequence
  chemically synthesized
tgccagccagaaacctctgtgg

SEQ ID NO: 1147263 - DNA, 22 bp, Artificial Sequence
  chemically synthesized
ccggccacagaggtttctggct

SEQ ID NO: 1147264 - DNA, 22 bp, Artificial Sequence
  chemically synthesized
ggtgtcactttgccagccagaa

SEQ ID NO: 1147265 - DNA, 22 bp, Artificial Sequence
  chemically synthesized
gggtgtcactttgccagccaga

SEQ ID NO: 1147266 - DNA, 22 bp, Artificial Sequence
  chemically synthesized
ctggctggcaaagtgacaccca

SEQ ID NO: 1147267 - DNA, 22 bp, Artificial Sequence
  chemically synthesized
tggctggcaaagtgacacccaa

SEQ ID NO: 1147268 - DNA, 22 bp, Artificial Sequence
  chemically synthesized
gctggcaaagtgacacccaagg

SEQ ID NO: 1147269 - DNA, 22 bp, Artificial Sequence
  chemically synthesized
gcaaagtgacacccaaggatcc

SEQ ID NO: 1147270 - DNA, 22 bp, Artificial Sequence
  chemically synthesized
gaggaaaatggataaagtgtgc

SEQ ID NO: 1147271 - DNA, 22 bp, Artificial Sequence
  chemically synthesized
acatgcacactttatccatttt

SEQ ID NO: 1147272 - DNA, 22 bp, Artificial Sequence
  chemically synthesized
catgcacactttatccattttc

SEQ ID NO: 1147273 - DNA, 22 bp, Artificial Sequence
  chemically synthesized
aatcatacattggaggaaaatg

SEQ ID NO: 1147274 - DNA, 22 bp, Artificial Sequence
  chemically synthesized
agatctaaatcatacattggag

SEQ ID NO: 1147275 - DNA, 22 bp, Artificial Sequence
  chemically synthesized
tatccattttcctccaatgtat

SEQ ID NO: 1147276 - DNA, 22 bp, Artificial Sequence
  chemically synthesized
atccattttcctccaatgtatg

SEQ ID NO: 1147277 - DNA, 22 bp, Artificial Sequence
  chemically synthesized
tccattttcctccaatgtatga

SEQ ID NO: 1147278 - DNA, 22 bp, Artificial Sequence
  chemically synthesized
agctaagatctaaatcatacat

SEQ ID NO: 1147279 - DNA, 22 bp, Artificial Sequence
  chemically synthesized
aagctaagatctaaatcataca

SEQ ID NO: 1147280 - DNA, 22 bp, Artificial Sequence
  chemically synthesized
taagctaagatctaaatcatac

SEQ ID NO: 1147281 - DNA, 22 bp, Artificial Sequence
  chemically synthesized
tttaagctaagatctaaatcat

SEQ ID NO: 1147282 - DNA, 22 bp, Artificial Sequence
  chemically synthesized
tcctccaatgtatgatttagat

SEQ ID NO: 1147283 - DNA, 22 bp, Artificial Sequence
  chemically synthesized
ctttaagctaagatctaaatca

SEQ ID NO: 1147284 - DNA, 22 bp, Artificial Sequence
  chemically synthesized
cctccaatgtatgatttagatc

SEQ ID NO: 1147285 - DNA, 22 bp, Artificial Sequence
  chemically synthesized
tctttaagctaagatctaaatc

SEQ ID NO: 1147286 - DNA, 22 bp, Artificial Sequence
  chemically synthesized
ctccaatgtatgatttagatct

SEQ ID NO: 1147287 - DNA, 22 bp, Artificial Sequence
  chemically synthesized
caatgtatgatttagatcttag

SEQ ID NO: 1147288 - DNA, 22 bp, Artificial Sequence
  chemically synthesized
aggaaagttttctttaagctaa

SEQ ID NO: 1147289 - DNA, 22 bp, Artificial Sequence
  chemically synthesized
ctgaggaaagttttctttaagc

SEQ ID NO: 1147290 - DNA, 22 bp, Artificial Sequence
  chemically synthesized
agatcttagcttaaagaaaact

SEQ ID NO: 1147291 - DNA, 22 bp, Artificial Sequence
  chemically synthesized
gatcttagcttaaagaaaactt

SEQ ID NO: 1147292 - DNA, 22 bp, Artificial Sequence
  chemically synthesized
agcttaaagaaaactttcctca

SEQ ID NO: 1147293 - DNA, 22 bp, Artificial Sequence
  chemically synthesized
gcttaaagaaaactttcctcag

SEQ ID NO: 1147294 - DNA, 22 bp, Artificial Sequence
  chemically synthesized
aaagaaaactttcctcaggaat

SEQ ID NO: 1147295 - DNA, 22 bp, Artificial Sequence
  chemically synthesized
aagaaaactttcctcaggaatc

SEQ ID NO: 1147296 - DNA, 22 bp, Artificial Sequence
  chemically synthesized
aacgcaacagatgattcctgag

SEQ ID NO: 1147297 - DNA, 22 bp, Artificial Sequence
  chemically synthesized
gaacgcaacagatgattcctga

SEQ ID NO: 1147298 - DNA, 22 bp, Artificial Sequence
  chemically synthesized
tgaacgcaacagatgattcctg

SEQ ID NO: 1147299 - DNA, 22 bp, Artificial Sequence
  chemically synthesized
aactttgaacgcaacagatgat

SEQ ID NO: 1147300 - DNA, 22 bp, Artificial Sequence
  chemically synthesized
tcctcaggaatcatctgttgcg

SEQ ID NO: 1147301 - DNA, 22 bp, Artificial Sequence
  chemically synthesized
cctcaggaatcatctgttgcgt

SEQ ID NO: 1147302 - DNA, 22 bp, Artificial Sequence
  chemically synthesized
ctcaggaatcatctgttgcgtt

SEQ ID NO: 1147303 - DNA, 22 bp, Artificial Sequence
  chemically synthesized
gactgaactttgaacgcaacag

SEQ ID NO: 1147304 - DNA, 22 bp, Artificial Sequence
  chemically synthesized
agactgaactttgaacgcaaca

SEQ ID NO: 1147305 - DNA, 22 bp, Artificial Sequence
  chemically synthesized
aggaatcatctgttgcgttcaa

SEQ ID NO: 1147306 - DNA, 22 bp, Artificial Sequence
  chemically synthesized
acttagactgaactttgaacgc

SEQ ID NO: 1147307 - DNA, 22 bp, Artificial Sequence
  chemically synthesized
tgacttagactgaactttgaac

SEQ ID NO: 1147308 - DNA, 22 bp, Artificial Sequence
  chemically synthesized
ctctgacttagactgaactttg

SEQ ID NO: 1147309 - DNA, 22 bp, Artificial Sequence
  chemically synthesized
ttgcgttcaaagttcagtctaa

SEQ ID NO: 1147310 - DNA, 22 bp, Artificial Sequence
  chemically synthesized
cgttcaaagttcagtctaagtc

SEQ ID NO: 1147311 - DNA, 22 bp, Artificial Sequence
  chemically synthesized
aaagttcagtctaagtcagagt

SEQ ID NO: 1147312 - DNA, 22 bp, Artificial Sequence
  chemically synthesized
tgacaggaaattactctgactt

SEQ ID NO: 1147313 - DNA, 22 bp, Artificial Sequence
  chemically synthesized
gtgacaggaaattactctgact

SEQ ID NO: 1147314 - DNA, 22 bp, Artificial Sequence
  chemically synthesized
tgtgacaggaaattactctgac

SEQ ID NO: 1147315 - DNA, 22 bp, Artificial Sequence
  chemically synthesized
ttgtgacaggaaattactctga

SEQ ID NO: 1147316 - DNA, 22 bp, Artificial Sequence
  chemically synthesized
agtctaagtcagagtaatttcc

SEQ ID NO: 1147317 - DNA, 22 bp, Artificial Sequence
  chemically synthesized
agtcagagtaatttcctgtcac

SEQ ID NO: 1147318 - DNA, 22 bp, Artificial Sequence
  chemically synthesized
taaaggcaaaaaataagctttt

SEQ ID NO: 1147319 - DNA, 22 bp, Artificial Sequence
  chemically synthesized
ataaaggcaaaaaataagcttt

SEQ ID NO: 1147320 - DNA, 22 bp, Artificial Sequence
  chemically synthesized
cctgtcacaaaagcttattttt

SEQ ID NO: 1147321 - DNA, 22 bp, Artificial Sequence
  chemically synthesized
tttataaaggcaaaaaataagc

SEQ ID NO: 1147322 - DNA, 22 bp, Artificial Sequence
  chemically synthesized
ctgtcacaaaagcttatttttt

SEQ ID NO: 1147323 - DNA, 22 bp, Artificial Sequence
  chemically synthesized
atttataaaggcaaaaaataag

SEQ ID NO: 1147324 - DNA, 22 bp, Artificial Sequence
  chemically synthesized
tcacaaaagcttattttttgcc

SEQ ID NO: 1147325 - DNA, 22 bp, Artificial Sequence
  chemically synthesized
attttttgcctttataaataag

SEQ ID NO: 1147326 - DNA, 22 bp, Artificial Sequence
  chemically synthesized
ttttttgcctttataaataagt

SEQ ID NO: 1147327 - DNA, 22 bp, Artificial Sequence
  chemically synthesized
aagaatggatgcaacttattta

SEQ ID NO: 1147328 - DNA, 22 bp, Artificial Sequence
  chemically synthesized
tttgcctttataaataagttgc

SEQ ID NO: 1147329 - DNA, 22 bp, Artificial Sequence
  chemically synthesized
ttgcctttataaataagttgca

SEQ ID NO: 1147330 - DNA, 22 bp, Artificial Sequence
  chemically synthesized
tgcctttataaataagttgcat

SEQ ID NO: 1147331 - DNA, 22 bp, Artificial Sequence
  chemically synthesized
gcctttataaataagttgcatc

SEQ ID NO: 1147332 - DNA, 22 bp, Artificial Sequence
  chemically synthesized
cctttataaataagttgcatcc

SEQ ID NO: 1147333 - DNA, 22 bp, Artificial Sequence
  chemically synthesized
tataaataagttgcatccattc

SEQ ID NO: 1147334 - DNA, 22 bp, Artificial Sequence
  chemically synthesized
ataaataagttgcatccattct

SEQ ID NO: 1147335 - DNA, 22 bp, Artificial Sequence
  chemically synthesized
taaataagttgcatccattctt

SEQ ID NO: 1147336 - DNA, 22 bp, Artificial Sequence
  chemically synthesized
aaaatgagcaaatgttaaagaa

SEQ ID NO: 1147337 - DNA, 22 bp, Artificial Sequence
  chemically synthesized
aaaaatgagcaaatgttaaaga

SEQ ID NO: 1147338 - DNA, 22 bp, Artificial Sequence
  chemically synthesized
taaaaatgagcaaatgttaaag

SEQ ID NO: 1147339 - DNA, 22 bp, Artificial Sequence
  chemically synthesized
ttaaaaatgagcaaatgttaaa

SEQ ID NO: 1147340 - DNA, 22 bp, Artificial Sequence
  chemically synthesized
catccattctttaacatttgct

SEQ ID NO: 1147341 - DNA, 22 bp, Artificial Sequence
  chemically synthesized
ataaagtatttttaaaaatgag

SEQ ID NO: 1147342 - DNA, 22 bp, Artificial Sequence
  chemically synthesized
tttaacatttgctcatttttaa

SEQ ID NO: 1147343 - DNA, 22 bp, Artificial Sequence
  chemically synthesized
taacatttgctcatttttaaaa

SEQ ID NO: 1147344 - DNA, 22 bp, Artificial Sequence
  chemically synthesized
aacatttgctcatttttaaaaa

SEQ ID NO: 1147345 - DNA, 22 bp, Artificial Sequence
  chemically synthesized
acatttgctcatttttaaaaat

SEQ ID NO: 1147346 - DNA, 22 bp, Artificial Sequence
  chemically synthesized
gctcatttttaaaaatacttta

SEQ ID NO: 1147347 - DNA, 22 bp, Artificial Sequence
  chemically synthesized
ctcatttttaaaaatactttat

SEQ ID NO: 1147348 - DNA, 22 bp, Artificial Sequence
  chemically synthesized
atttttaaaaatactttattaa

SEQ ID NO: 1147349 - DNA, 22 bp, Artificial Sequence
  chemically synthesized
ttaaaaatactttattaatgtc

SEQ ID NO: 1147350 - DNA, 22 bp, Artificial Sequence
  chemically synthesized
taaaaatactttattaatgtct

SEQ ID NO: 1147351 - DNA, 22 bp, Artificial Sequence
  chemically synthesized
aaaaatactttattaatgtcta

SEQ ID NO: 1147352 - DNA, 22 bp, Artificial Sequence
  chemically synthesized
aaaatactttattaatgtctat

SEQ ID NO: 1147353 - DNA, 22 bp, Artificial Sequence
  chemically synthesized
tattaatgtctatttttatact

SEQ ID NO: 1147354 - DNA, 22 bp, Artificial Sequence
  chemically synthesized
attaatgtctatttttatactg

SEQ ID NO: 1147355 - DNA, 22 bp, Artificial Sequence
  chemically synthesized
gtacatgcaatccagtataaaa

SEQ ID NO: 1147356 - DNA, 22 bp, Artificial Sequence
  chemically synthesized
ttaatgtctatttttatactgg

SEQ ID NO: 1147357 - DNA, 22 bp, Artificial Sequence
  chemically synthesized
ggtacatgcaatccagtataaa

SEQ ID NO: 1147358 - DNA, 22 bp, Artificial Sequence
  chemically synthesized
ttggtacatgcaatccagtata

SEQ ID NO: 1147359 - DNA, 22 bp, Artificial Sequence
  chemically synthesized
atgtctatttttatactggatt

SEQ ID NO: 1147360 - DNA, 22 bp, Artificial Sequence
  chemically synthesized
cgctcttggtacatgcaatcca

SEQ ID NO: 1147361 - DNA, 22 bp, Artificial Sequence
  chemically synthesized
tttttatactggattgcatgta

SEQ ID NO: 1147362 - DNA, 22 bp, Artificial Sequence
  chemically synthesized
ttatactggattgcatgtacca

SEQ ID NO: 1147363 - DNA, 22 bp, Artificial Sequence
  chemically synthesized
tatactggattgcatgtaccaa

SEQ ID NO: 1147364 - DNA, 22 bp, Artificial Sequence
  chemically synthesized
atactggattgcatgtaccaag

SEQ ID NO: 1147365 - DNA, 22 bp, Artificial Sequence
  chemically synthesized
tactggattgcatgtaccaaga

SEQ ID NO: 1147366 - DNA, 22 bp, Artificial Sequence
  chemically synthesized
gattgcatgtaccaagagcgca

SEQ ID NO: 1147367 - DNA, 22 bp, Artificial Sequence
  chemically synthesized
catgtaccaagagcgcagttcc

SEQ ID NO: 1147368 - DNA, 22 bp, Artificial Sequence
  chemically synthesized
tgataggcaggtaggcatggga

SEQ ID NO: 1147369 - DNA, 22 bp, Artificial Sequence
  chemically synthesized
ccatgcctacctgcctatcata

SEQ ID NO: 1147370 - DNA, 22 bp, Artificial Sequence
  chemically synthesized
tcatccatggtcactatgatag

SEQ ID NO: 1147371 - DNA, 22 bp, Artificial Sequence
  chemically synthesized
gtcatccatggtcactatgata

SEQ ID NO: 1147372 - DNA, 22 bp, Artificial Sequence
  chemically synthesized
cttgtcatccatggtcactatg

SEQ ID NO: 1147373 - DNA, 22 bp, Artificial Sequence
  chemically synthesized
cctgcctatcatagtgaccatg

SEQ ID NO: 1147374 - DNA, 22 bp, Artificial Sequence
  chemically synthesized
attccttgtcatccatggtcac

SEQ ID NO: 1147375 - DNA, 22 bp, Artificial Sequence
  chemically synthesized
cctatcatagtgaccatggatg

SEQ ID NO: 1147376 - DNA, 22 bp, Artificial Sequence
  chemically synthesized
tcatagtgaccatggatgacaa

SEQ ID NO: 1147377 - DNA, 22 bp, Artificial Sequence
  chemically synthesized
tagtagaatgctaattccttgt

SEQ ID NO: 1147378 - DNA, 22 bp, Artificial Sequence
  chemically synthesized
gtagtagaatgctaattccttg

SEQ ID NO: 1147379 - DNA, 22 bp, Artificial Sequence
  chemically synthesized
tgtagtagaatgctaattcctt

SEQ ID NO: 1147380 - DNA, 22 bp, Artificial Sequence
  chemically synthesized
tttgtagtagaatgctaattcc

SEQ ID NO: 1147381 - DNA, 22 bp, Artificial Sequence
  chemically synthesized
cctctttgtagtagaatgctaa

SEQ ID NO: 1147382 - DNA, 22 bp, Artificial Sequence
  chemically synthesized
agtctccctctttgtagtagaa

SEQ ID NO: 1147383 - DNA, 22 bp, Artificial Sequence
  chemically synthesized
tatctcagtctccctctttgta

SEQ ID NO: 1147384 - DNA, 22 bp, Artificial Sequence
  chemically synthesized
gcattctactacaaagagggag

SEQ ID NO: 1147385 - DNA, 22 bp, Artificial Sequence
  chemically synthesized
tactacaaagagggagactgag

SEQ ID NO: 1147386 - DNA, 22 bp, Artificial Sequence
  chemically synthesized
ctacaaagagggagactgagat

SEQ ID NO: 1147387 - DNA, 22 bp, Artificial Sequence
  chemically synthesized
caaagagggagactgagatata

SEQ ID NO: 1147388 - DNA, 22 bp, Artificial Sequence
  chemically synthesized
gaacaatggtgactatatctca

SEQ ID NO: 1147389 - DNA, 22 bp, Artificial Sequence
  chemically synthesized
gaaccctggaacaatggtgact

SEQ ID NO: 1147390 - DNA, 22 bp, Artificial Sequence
  chemically synthesized
ggaaccctggaacaatggtgac

SEQ ID NO: 1147391 - DNA, 22 bp, Artificial Sequence
  chemically synthesized
cttggaaccctggaacaatggt

SEQ ID NO: 1147392 - DNA, 22 bp, Artificial Sequence
  chemically synthesized
ccttggaaccctggaacaatgg

SEQ ID NO: 1147393 - DNA, 22 bp, Artificial Sequence
  chemically synthesized
agatatagtcaccattgttcca

SEQ ID NO: 1147394 - DNA, 22 bp, Artificial Sequence
  chemically synthesized
ccttccttggaaccctggaaca

SEQ ID NO: 1147395 - DNA, 22 bp, Artificial Sequence
  chemically synthesized
ctgccttccttggaaccctgga

SEQ ID NO: 1147396 - DNA, 22 bp, Artificial Sequence
  chemically synthesized
agagcctactgccttccttgga

SEQ ID NO: 1147397 - DNA, 22 bp, Artificial Sequence
  chemically synthesized
gagagcctactgccttccttgg

SEQ ID NO: 1147398 - DNA, 22 bp, Artificial Sequence
  chemically synthesized
ttccagggttccaaggaaggca

SEQ ID NO: 1147399 - DNA, 22 bp, Artificial Sequence
  chemically synthesized
cagggttccaaggaaggcagta

SEQ ID NO: 1147400 - DNA, 22 bp, Artificial Sequence
  chemically synthesized
caaggaaggcagtaggctctca

SEQ ID NO: 1147401 - DNA, 22 bp, Artificial Sequence
  chemically synthesized
cgatgggtaatttgagagccta

SEQ ID NO: 1147402 - DNA, 22 bp, Artificial Sequence
  chemically synthesized
gttgcgatgggtaatttgagag

SEQ ID NO: 1147403 - DNA, 22 bp, Artificial Sequence
  chemically synthesized
ccctggttgcgatgggtaattt

SEQ ID NO: 1147404 - DNA, 22 bp, Artificial Sequence
  chemically synthesized
tctaccctggttgcgatgggta

SEQ ID NO: 1147405 - DNA, 22 bp, Artificial Sequence
  chemically synthesized
tcaaattacccatcgcaaccag

SEQ ID NO: 1147406 - DNA, 22 bp, Artificial Sequence
  chemically synthesized
tcactatctaccctggttgcga

SEQ ID NO: 1147407 - DNA, 22 bp, Artificial Sequence
  chemically synthesized
gtcactatctaccctggttgcg

SEQ ID NO: 1147408 - DNA, 22 bp, Artificial Sequence
  chemically synthesized
aaattacccatcgcaaccaggg

SEQ ID NO: 1147409 - DNA, 22 bp, Artificial Sequence
  chemically synthesized
cccatcgcaaccagggtagata

SEQ ID NO: 1147410 - DNA, 22 bp, Artificial Sequence
  chemically synthesized
aaaaaaagaatttgtcactatc

SEQ ID NO: 1147411 - DNA, 22 bp, Artificial Sequence
  chemically synthesized
ggtaaccaggtaagacagttaa

SEQ ID NO: 1147412 - DNA, 22 bp, Artificial Sequence
  chemically synthesized
tgttgggtaaccaggtaagaca

SEQ ID NO: 1147413 - DNA, 22 bp, Artificial Sequence
  chemically synthesized
ttttttttaactgtcttacctg

SEQ ID NO: 1147414 - DNA, 22 bp, Artificial Sequence
  chemically synthesized
ttttttaactgtcttacctggt

SEQ ID NO: 1147415 - DNA, 22 bp, Artificial Sequence
  chemically synthesized
tttttaactgtcttacctggtt

SEQ ID NO: 1147416 - DNA, 22 bp, Artificial Sequence
  chemically synthesized
ttttaactgtcttacctggtta

SEQ ID NO: 1147417 - DNA, 22 bp, Artificial Sequence
  chemically synthesized
tttaactgtcttacctggttac

SEQ ID NO: 1147418 - DNA, 22 bp, Artificial Sequence
  chemically synthesized
ttaactgtcttacctggttacc

SEQ ID NO: 1147419 - DNA, 22 bp, Artificial Sequence
  chemically synthesized
taactgtcttacctggttaccc

SEQ ID NO: 1147420 - DNA, 22 bp, Artificial Sequence
  chemically synthesized
aactgtcttacctggttaccca

SEQ ID NO: 1147421 - DNA, 22 bp, Artificial Sequence
  chemically synthesized
actgtcttacctggttacccaa

SEQ ID NO: 1147422 - DNA, 22 bp, Artificial Sequence
  chemically synthesized
tcttacctggttacccaacaca

SEQ ID NO: 1147423 - DNA, 22 bp, Artificial Sequence
  chemically synthesized
tgtcccagggattgtgttgggt

SEQ ID NO: 1147424 - DNA, 22 bp, Artificial Sequence
  chemically synthesized
ctatgtcccagggattgtgttg

SEQ ID NO: 1147425 - DNA, 22 bp, Artificial Sequence
  chemically synthesized
acctggttacccaacacaatcc

SEQ ID NO: 1147426 - DNA, 22 bp, Artificial Sequence
  chemically synthesized
actatgtcccagggattgtgtt

SEQ ID NO: 1147427 - DNA, 22 bp, Artificial Sequence
  chemically synthesized
cctggttacccaacacaatccc

SEQ ID NO: 1147428 - DNA, 22 bp, Artificial Sequence
  chemically synthesized
ttactatgtcccagggattgtg

SEQ ID NO: 1147429 - DNA, 22 bp, Artificial Sequence
  chemically synthesized
gttacccaacacaatccctggg

SEQ ID NO: 1147430 - DNA, 22 bp, Artificial Sequence
  chemically synthesized
tgttcttactatgtcccaggga

SEQ ID NO: 1147431 - DNA, 22 bp, Artificial Sequence
  chemically synthesized
cccaacacaatccctgggacat

SEQ ID NO: 1147432 - DNA, 22 bp, Artificial Sequence
  chemically synthesized
gttatgttcttactatgtccca

SEQ ID NO: 1147433 - DNA, 22 bp, Artificial Sequence
  chemically synthesized
aacaagtactcgttatgttctt

SEQ ID NO: 1147434 - DNA, 22 bp, Artificial Sequence
  chemically synthesized
caacaagtactcgttatgttct

SEQ ID NO: 1147435 - DNA, 22 bp, Artificial Sequence
  chemically synthesized
tcaacaagtactcgttatgttc

SEQ ID NO: 1147436 - DNA, 22 bp, Artificial Sequence
  chemically synthesized
ggacatagtaagaacataacga

SEQ ID NO: 1147437 - DNA, 22 bp, Artificial Sequence
  chemically synthesized
ttcaacaagtactcgttatgtt

SEQ ID NO: 1147438 - DNA, 22 bp, Artificial Sequence
  chemically synthesized
tttcaacaagtactcgttatgt

SEQ ID NO: 1147439 - DNA, 22 bp, Artificial Sequence
  chemically synthesized
ttttcaacaagtactcgttatg

SEQ ID NO: 1147440 - DNA, 22 bp, Artificial Sequence
  chemically synthesized
aatttttttcaacaagtactcg

SEQ ID NO: 1147441 - DNA, 22 bp, Artificial Sequence
  chemically synthesized
gaatttttttcaacaagtactc

SEQ ID NO: 1147442 - DNA, 22 bp, Artificial Sequence
  chemically synthesized
cacatcccatttgaattttttt

SEQ ID NO: 1147443 - DNA, 22 bp, Artificial Sequence
  chemically synthesized
agcattccacatcccatttgaa

SEQ ID NO: 1147444 - DNA, 22 bp, Artificial Sequence
  chemically synthesized
gttgaaaaaaattcaaatggga

SEQ ID NO: 1147445 - DNA, 22 bp, Artificial Sequence
  chemically synthesized
ttgaaaaaaattcaaatgggat

SEQ ID NO: 1147446 - DNA, 22 bp, Artificial Sequence
  chemically synthesized
taagcattccacatcccatttg

SEQ ID NO: 1147447 - DNA, 22 bp, Artificial Sequence
  chemically synthesized
ctaagcattccacatcccattt

SEQ ID NO: 1147448 - DNA, 22 bp, Artificial Sequence
  chemically synthesized
tctaagcattccacatcccatt

SEQ ID NO: 1147449 - DNA, 22 bp, Artificial Sequence
  chemically synthesized
aaaaaaattcaaatgggatgtg

SEQ ID NO: 1147450 - DNA, 22 bp, Artificial Sequence
  chemically synthesized
tttctaagcattccacatccca

SEQ ID NO: 1147451 - DNA, 22 bp, Artificial Sequence
  chemically synthesized
aaatgggatgtggaatgcttag

SEQ ID NO: 1147452 - DNA, 22 bp, Artificial Sequence
  chemically synthesized
ccacatctctttctaagcattc

SEQ ID NO: 1147453 - DNA, 22 bp, Artificial Sequence
  chemically synthesized
gaggtcattaccacatctcttt

SEQ ID NO: 1147454 - DNA, 22 bp, Artificial Sequence
  chemically synthesized
agaggtcattaccacatctctt

SEQ ID NO: 1147455 - DNA, 22 bp, Artificial Sequence
  chemically synthesized
tagaggtcattaccacatctct

SEQ ID NO: 1147456 - DNA, 22 bp, Artificial Sequence
  chemically synthesized
agttttagaggtcattaccaca

SEQ ID NO: 1147457 - DNA, 22 bp, Artificial Sequence
  chemically synthesized
cagttttagaggtcattaccac

SEQ ID NO: 1147458 - DNA, 22 bp, Artificial Sequence
  chemically synthesized
agaaagagatgtggtaatgacc

SEQ ID NO: 1147459 - DNA, 22 bp, Artificial Sequence
  chemically synthesized
gaaagagatgtggtaatgacct

SEQ ID NO: 1147460 - DNA, 22 bp, Artificial Sequence
  chemically synthesized
tatagtcttcagttttagaggt

SEQ ID NO: 1147461 - DNA, 22 bp, Artificial Sequence
  chemically synthesized
atatagtcttcagttttagagg

SEQ ID NO: 1147462 - DNA, 22 bp, Artificial Sequence
  chemically synthesized
gtcatttatatagtcttcagtt

SEQ ID NO: 1147463 - DNA, 22 bp, Artificial Sequence
  chemically synthesized
aaattggtcatttatatagtct

SEQ ID NO: 1147464 - DNA, 22 bp, Artificial Sequence
  chemically synthesized
taaaactgaagactatataaat

SEQ ID NO: 1147465 - DNA, 22 bp, Artificial Sequence
  chemically synthesized
aaactgaagactatataaatga

SEQ ID NO: 1147466 - DNA, 22 bp, Artificial Sequence
  chemically synthesized
taactaaaattggtcatttata

SEQ ID NO: 1147467 - DNA, 22 bp, Artificial Sequence
  chemically synthesized
ataactaaaattggtcatttat

SEQ ID NO: 1147468 - DNA, 22 bp, Artificial Sequence
  chemically synthesized
tataactaaaattggtcattta

SEQ ID NO: 1147469 - DNA, 22 bp, Artificial Sequence
  chemically synthesized
aagactatataaatgaccaatt

SEQ ID NO: 1147470 - DNA, 22 bp, Artificial Sequence
  chemically synthesized
aattttataactaaaattggtc

SEQ ID NO: 1147471 - DNA, 22 bp, Artificial Sequence
  chemically synthesized
tataaatgaccaattttagtta

SEQ ID NO: 1147472 - DNA, 22 bp, Artificial Sequence
  chemically synthesized
taaactaaattttataactaaa

SEQ ID NO: 1147473 - DNA, 22 bp, Artificial Sequence
  chemically synthesized
ataaactaaattttataactaa

SEQ ID NO: 1147474 - DNA, 22 bp, Artificial Sequence
  chemically synthesized
tataaactaaattttataacta

SEQ ID NO: 1147475 - DNA, 22 bp, Artificial Sequence
  chemically synthesized
ttataaactaaattttataact

SEQ ID NO: 1147476 - DNA, 22 bp, Artificial Sequence
  chemically synthesized
agaaatatttttataaactaaa

SEQ ID NO: 1147477 - DNA, 22 bp, Artificial Sequence
  chemically synthesized
tagttataaaatttagtttata

SEQ ID NO: 1147478 - DNA, 22 bp, Artificial Sequence
  chemically synthesized
agttataaaatttagtttataa

SEQ ID NO: 1147479 - DNA, 22 bp, Artificial Sequence
  chemically synthesized
gttataaaatttagtttataaa

SEQ ID NO: 1147480 - DNA, 22 bp, Artificial Sequence
  chemically synthesized
attgagaaatatttttataaac

SEQ ID NO: 1147481 - DNA, 22 bp, Artificial Sequence
  chemically synthesized
gattgagaaatatttttataaa

SEQ ID NO: 1147482 - DNA, 22 bp, Artificial Sequence
  chemically synthesized
taaaatttagtttataaaaata

SEQ ID NO: 1147483 - DNA, 22 bp, Artificial Sequence
  chemically synthesized
tttgattgagaaatatttttat

SEQ ID NO: 1147484 - DNA, 22 bp, Artificial Sequence
  chemically synthesized
atttgattgagaaatattttta

SEQ ID NO: 1147485 - DNA, 22 bp, Artificial Sequence
  chemically synthesized
acttatttgattgagaaatatt

SEQ ID NO: 1147486 - DNA, 22 bp, Artificial Sequence
  chemically synthesized
agtttataaaaatatttctcaa

SEQ ID NO: 1147487 - DNA, 22 bp, Artificial Sequence
  chemically synthesized
gtttataaaaatatttctcaat

SEQ ID NO: 1147488 - DNA, 22 bp, Artificial Sequence
  chemically synthesized
ataaaaatatttctcaatcaaa

SEQ ID NO: 1147489 - DNA, 22 bp, Artificial Sequence
  chemically synthesized
taaaaatatttctcaatcaaat

SEQ ID NO: 1147490 - DNA, 22 bp, Artificial Sequence
  chemically synthesized
ctcaatcaaataagttaactgg

SEQ ID NO: 1147491 - DNA, 22 bp, Artificial Sequence
  chemically synthesized
tcaatcaaataagttaactggc

SEQ ID NO: 1147492 - DNA, 22 bp, Artificial Sequence
  chemically synthesized
ataggcagtgatgccagttaac

SEQ ID NO: 1147493 - DNA, 22 bp, Artificial Sequence
  chemically synthesized
cataggcagtgatgccagttaa

SEQ ID NO: 1147494 - DNA, 22 bp, Artificial Sequence
  chemically synthesized
aatcaaataagttaactggcat

SEQ ID NO: 1147495 - DNA, 22 bp, Artificial Sequence
  chemically synthesized
tttcataggcagtgatgccagt

SEQ ID NO: 1147496 - DNA, 22 bp, Artificial Sequence
  chemically synthesized
actggcatcactgcctatgaaa

SEQ ID NO: 1147497 - DNA, 22 bp, Artificial Sequence
  chemically synthesized
gcatcactgcctatgaaacaga

SEQ ID NO: 1147498 - DNA, 22 bp, Artificial Sequence
  chemically synthesized
cctatgaaacagactctctacg

SEQ ID NO: 1147499 - DNA, 22 bp, Artificial Sequence
  chemically synthesized
caggatgtcagtgcgtagagag

SEQ ID NO: 1147500 - DNA, 22 bp, Artificial Sequence
  chemically synthesized
ccaggatgtcagtgcgtagaga

SEQ ID NO: 1147501 - DNA, 22 bp, Artificial Sequence
  chemically synthesized
tgaaacagactctctacgcact

SEQ ID NO: 1147502 - DNA, 22 bp, Artificial Sequence
  chemically synthesized
gaggcttccaggatgtcagtgc

SEQ ID NO: 1147503 - DNA, 22 bp, Artificial Sequence
  chemically synthesized
agaggcttccaggatgtcagtg

SEQ ID NO: 1147504 - DNA, 22 bp, Artificial Sequence
  chemically synthesized
tagaggcttccaggatgtcagt

SEQ ID NO: 1147505 - DNA, 22 bp, Artificial Sequence
  chemically synthesized
actttagaggcttccaggatgt

SEQ ID NO: 1147506 - DNA, 22 bp, Artificial Sequence
  chemically synthesized
tctacgcactgacatcctggaa

SEQ ID NO: 1147507 - DNA, 22 bp, Artificial Sequence
  chemically synthesized
aactttagaggcttccaggatg

SEQ ID NO: 1147508 - DNA, 22 bp, Artificial Sequence
  chemically synthesized
tacgcactgacatcctggaagc

SEQ ID NO: 1147509 - DNA, 22 bp, Artificial Sequence
  chemically synthesized
cgcactgacatcctggaagcct

SEQ ID NO: 1147510 - DNA, 22 bp, Artificial Sequence
  chemically synthesized
tccttaactttagaggcttcca

SEQ ID NO: 1147511 - DNA, 22 bp, Artificial Sequence
  chemically synthesized
gtccttaactttagaggcttcc

SEQ ID NO: 1147512 - DNA, 22 bp, Artificial Sequence
  chemically synthesized
acatcctggaagcctctaaagt

SEQ ID NO: 1147513 - DNA, 22 bp, Artificial Sequence
  chemically synthesized
gagtcttgtccttaactttaga

SEQ ID NO: 1147514 - DNA, 22 bp, Artificial Sequence
  chemically synthesized
gaagcctctaaagttaaggaca

SEQ ID NO: 1147515 - DNA, 22 bp, Artificial Sequence
  chemically synthesized
cagattagagtcttgtccttaa

SEQ ID NO: 1147516 - DNA, 22 bp, Artificial Sequence
  chemically synthesized
ctgcagattagagtcttgtcct

SEQ ID NO: 1147517 - DNA, 22 bp, Artificial Sequence
  chemically synthesized
taaagttaaggacaagactcta

SEQ ID NO: 1147518 - DNA, 22 bp, Artificial Sequence
  chemically synthesized
aagttaaggacaagactctaat

SEQ ID NO: 1147519 - DNA, 22 bp, Artificial Sequence
  chemically synthesized
agcaatgttactgcagattaga

SEQ ID NO: 1147520 - DNA, 22 bp, Artificial Sequence
  chemically synthesized
aggacaagactctaatctgcag

SEQ ID NO: 1147521 - DNA, 22 bp, Artificial Sequence
  chemically synthesized
tccctcagcaatgttactgcag

SEQ ID NO: 1147522 - DNA, 22 bp, Artificial Sequence
  chemically synthesized
gtccctcagcaatgttactgca

SEQ ID NO: 1147523 - DNA, 22 bp, Artificial Sequence
  chemically synthesized
agcttgtccctcagcaatgtta

SEQ ID NO: 1147524 - DNA, 22 bp, Artificial Sequence
  chemically synthesized
taatctgcagtaacattgctga

SEQ ID NO: 1147525 - DNA, 22 bp, Artificial Sequence
  chemically synthesized
atctgcagtaacattgctgagg

SEQ ID NO: 1147526 - DNA, 22 bp, Artificial Sequence
  chemically synthesized
aaaggttcagcttgtccctcag

SEQ ID NO: 1147527 - DNA, 22 bp, Artificial Sequence
  chemically synthesized
cagtaacattgctgagggacaa

SEQ ID NO: 1147528 - DNA, 22 bp, Artificial Sequence
  chemically synthesized
tcaaaggttcagcttgtccctc

SEQ ID NO: 1147529 - DNA, 22 bp, Artificial Sequence
  chemically synthesized
tctcaaaggttcagcttgtccc

SEQ ID NO: 1147530 - DNA, 22 bp, Artificial Sequence
  chemically synthesized
ctctcaaaggttcagcttgtcc

SEQ ID NO: 1147531 - DNA, 22 bp, Artificial Sequence
  chemically synthesized
tctctcaaaggttcagcttgtc

SEQ ID NO: 1147532 - DNA, 22 bp, Artificial Sequence
  chemically synthesized
tttctctcaaaggttcagcttg

SEQ ID NO: 1147533 - DNA, 22 bp, Artificial Sequence
  chemically synthesized
ctgagggacaagctgaaccttt

SEQ ID NO: 1147534 - DNA, 22 bp, Artificial Sequence
  chemically synthesized
gattctttctctcaaaggttca

SEQ ID NO: 1147535 - DNA, 22 bp, Artificial Sequence
  chemically synthesized
agggacaagctgaacctttgag

SEQ ID NO: 1147536 - DNA, 22 bp, Artificial Sequence
  chemically synthesized
cgataattagattctttctctc

SEQ ID NO: 1147537 - DNA, 22 bp, Artificial Sequence
  chemically synthesized
tccgataattagattctttctc

SEQ ID NO: 1147538 - DNA, 22 bp, Artificial Sequence
  chemically synthesized
aacctttgagagaaagaatcta

SEQ ID NO: 1147539 - DNA, 22 bp, Artificial Sequence
  chemically synthesized
tgagagaaagaatctaattatc

SEQ ID NO: 1147540 - DNA, 22 bp, Artificial Sequence
  chemically synthesized
gagagaaagaatctaattatcg

SEQ ID NO: 1147541 - DNA, 22 bp, Artificial Sequence
  chemically synthesized
agagaaagaatctaattatcgg

SEQ ID NO: 1147542 - DNA, 22 bp, Artificial Sequence
  chemically synthesized
aaaagtgtgctctccgataatt

SEQ ID NO: 1147543 - DNA, 22 bp, Artificial Sequence
  chemically synthesized
tgaaaagtgtgctctccgataa

SEQ ID NO: 1147544 - DNA, 22 bp, Artificial Sequence
  chemically synthesized
attatcggagagcacacttttc

SEQ ID NO: 1147545 - DNA, 22 bp, Artificial Sequence
  chemically synthesized
tcggagagcacacttttcagaa

SEQ ID NO: 1147546 - DNA, 22 bp, Artificial Sequence
  chemically synthesized
tgaagtgtaatattctgaaaag

SEQ ID NO: 1147547 - DNA, 22 bp, Artificial Sequence
  chemically synthesized
atgaagtgtaatattctgaaaa

SEQ ID NO: 1147548 - DNA, 22 bp, Artificial Sequence
  chemically synthesized
ttcagaatattacacttcataa

SEQ ID NO: 1147549 - DNA, 22 bp, Artificial Sequence
  chemically synthesized
tcagaatattacacttcataag

SEQ ID NO: 1147550 - DNA, 22 bp, Artificial Sequence
  chemically synthesized
cagaatattacacttcataagc

SEQ ID NO: 1147551 - DNA, 22 bp, Artificial Sequence
  chemically synthesized
aaagatgacatagcttatgaag

SEQ ID NO: 1147552 - DNA, 22 bp, Artificial Sequence
  chemically synthesized
agaatattacacttcataagct

SEQ ID NO: 1147553 - DNA, 22 bp, Artificial Sequence
  chemically synthesized
tgaaagatgacatagcttatga

SEQ ID NO: 1147554 - DNA, 22 bp, Artificial Sequence
  chemically synthesized
ctgaaagatgacatagcttatg

SEQ ID NO: 1147555 - DNA, 22 bp, Artificial Sequence
  chemically synthesized
gagtttctgaaagatgacatag

SEQ ID NO: 1147556 - DNA, 22 bp, Artificial Sequence
  chemically synthesized
cacttcataagctatgtcatct

SEQ ID NO: 1147557 - DNA, 22 bp, Artificial Sequence
  chemically synthesized
agagtttctgaaagatgacata

SEQ ID NO: 1147558 - DNA, 22 bp, Artificial Sequence
  chemically synthesized
cataagctatgtcatctttcag

SEQ ID NO: 1147559 - DNA, 22 bp, Artificial Sequence
  chemically synthesized
ataagctatgtcatctttcaga

SEQ ID NO: 1147560 - DNA, 22 bp, Artificial Sequence
  chemically synthesized
tgtcatctttcagaaactctaa

SEQ ID NO: 1147561 - DNA, 22 bp, Artificial Sequence
  chemically synthesized
tcagaaactctaagcatatatt

SEQ ID NO: 1147562 - DNA, 22 bp, Artificial Sequence
  chemically synthesized
cagaaactctaagcatatattc

SEQ ID NO: 1147563 - DNA, 22 bp, Artificial Sequence
  chemically synthesized
agaaactctaagcatatattct

SEQ ID NO: 1147564 - DNA, 22 bp, Artificial Sequence
  chemically synthesized
taagcatatattctgacctgtc

SEQ ID NO: 1147565 - DNA, 22 bp, Artificial Sequence
  chemically synthesized
aagaaaaccaaagacaggtcag

SEQ ID NO: 1147566 - DNA, 22 bp, Artificial Sequence
  chemically synthesized
gaagaaaaccaaagacaggtca

SEQ ID NO: 1147567 - DNA, 22 bp, Artificial Sequence
  chemically synthesized
agcatatattctgacctgtctt

SEQ ID NO: 1147568 - DNA, 22 bp, Artificial Sequence
  chemically synthesized
gaaaaggtttgaagaaaaccaa

SEQ ID NO: 1147569 - DNA, 22 bp, Artificial Sequence
  chemically synthesized
ggaaaaggtttgaagaaaacca

SEQ ID NO: 1147570 - DNA, 22 bp, Artificial Sequence
  chemically synthesized
tgacctgtctttggttttcttc

SEQ ID NO: 1147571 - DNA, 22 bp, Artificial Sequence
  chemically synthesized
tggaaaaggtttgaagaaaacc

SEQ ID NO: 1147572 - DNA, 22 bp, Artificial Sequence
  chemically synthesized
acctgtctttggttttcttcaa

SEQ ID NO: 1147573 - DNA, 22 bp, Artificial Sequence
  chemically synthesized
tttggaaaaggtttgaagaaaa

SEQ ID NO: 1147574 - DNA, 22 bp, Artificial Sequence
  chemically synthesized
ctttggaaaaggtttgaagaaa

SEQ ID NO: 1147575 - DNA, 22 bp, Artificial Sequence
  chemically synthesized
tctttggttttcttcaaacctt

SEQ ID NO: 1147576 - DNA, 22 bp, Artificial Sequence
  chemically synthesized
gagtcttctttggaaaaggttt

SEQ ID NO: 1147577 - DNA, 22 bp, Artificial Sequence
  chemically synthesized
tggttttcttcaaaccttttcc

SEQ ID NO: 1147578 - DNA, 22 bp, Artificial Sequence
  chemically synthesized
agagtcttctttggaaaaggtt

SEQ ID NO: 1147579 - DNA, 22 bp, Artificial Sequence
  chemically synthesized
ggttttcttcaaaccttttcca

SEQ ID NO: 1147580 - DNA, 22 bp, Artificial Sequence
  chemically synthesized
tagagtcttctttggaaaaggt

SEQ ID NO: 1147581 - DNA, 22 bp, Artificial Sequence
  chemically synthesized
gttttcttcaaaccttttccaa

SEQ ID NO: 1147582 - DNA, 22 bp, Artificial Sequence
  chemically synthesized
tcttcaaaccttttccaaagaa

SEQ ID NO: 1147583 - DNA, 22 bp, Artificial Sequence
  chemically synthesized
cttcaaaccttttccaaagaag

SEQ ID NO: 1147584 - DNA, 22 bp, Artificial Sequence
  chemically synthesized
ttcaaaccttttccaaagaaga

SEQ ID NO: 1147585 - DNA, 22 bp, Artificial Sequence
  chemically synthesized
caaaccttttccaaagaagact

SEQ ID NO: 1147586 - DNA, 22 bp, Artificial Sequence
  chemically synthesized
aaatacctttagagtcttcttt

SEQ ID NO: 1147587 - DNA, 22 bp, Artificial Sequence
  chemically synthesized
aaaccttttccaaagaagactc

SEQ ID NO: 1147588 - DNA, 22 bp, Artificial Sequence
  chemically synthesized
aaaatacctttagagtcttctt

SEQ ID NO: 1147589 - DNA, 22 bp, Artificial Sequence
  chemically synthesized
taaaatacctttagagtcttct

SEQ ID NO: 1147590 - DNA, 22 bp, Artificial Sequence
  chemically synthesized
actttaaaatacctttagagtc

SEQ ID NO: 1147591 - DNA, 22 bp, Artificial Sequence
  chemically synthesized
ttccaaagaagactctaaaggt

SEQ ID NO: 1147592 - DNA, 22 bp, Artificial Sequence
  chemically synthesized
taactttaaaatacctttagag

SEQ ID NO: 1147593 - DNA, 22 bp, Artificial Sequence
  chemically synthesized
tccaaagaagactctaaaggta

SEQ ID NO: 1147594 - DNA, 22 bp, Artificial Sequence
  chemically synthesized
ccaaagaagactctaaaggtat

SEQ ID NO: 1147595 - DNA, 22 bp, Artificial Sequence
  chemically synthesized
tctaactttaaaatacctttag

SEQ ID NO: 1147596 - DNA, 22 bp, Artificial Sequence
  chemically synthesized
caaagaagactctaaaggtatt

SEQ ID NO: 1147597 - DNA, 22 bp, Artificial Sequence
  chemically synthesized
ctctaactttaaaataccttta

SEQ ID NO: 1147598 - DNA, 22 bp, Artificial Sequence
  chemically synthesized
ggatttctctaactttaaaata

SEQ ID NO: 1147599 - DNA, 22 bp, Artificial Sequence
  chemically synthesized
aggatttctctaactttaaaat

SEQ ID NO: 1147600 - DNA, 22 bp, Artificial Sequence
  chemically synthesized
taggatttctctaactttaaaa

SEQ ID NO: 1147601 - DNA, 22 bp, Artificial Sequence
  chemically synthesized
taaaggtattttaaagttagag

SEQ ID NO: 1147602 - DNA, 22 bp, Artificial Sequence
  chemically synthesized
aaggtattttaaagttagagaa

SEQ ID NO: 1147603 - DNA, 22 bp, Artificial Sequence
  chemically synthesized
tgatgatattttaggatttctc

SEQ ID NO: 1147604 - DNA, 22 bp, Artificial Sequence
  chemically synthesized
ttatgatgatattttaggattt

SEQ ID NO: 1147605 - DNA, 22 bp, Artificial Sequence
  chemically synthesized
taaagttagagaaatcctaaaa

SEQ ID NO: 1147606 - DNA, 22 bp, Artificial Sequence
  chemically synthesized
aaagttagagaaatcctaaaat

SEQ ID NO: 1147607 - DNA, 22 bp, Artificial Sequence
  chemically synthesized
tattatgatgatattttaggat

SEQ ID NO: 1147608 - DNA, 22 bp, Artificial Sequence
  chemically synthesized
aagttagagaaatcctaaaata

SEQ ID NO: 1147609 - DNA, 22 bp, Artificial Sequence
  chemically synthesized
gagaaatcctaaaatatcatca

SEQ ID NO: 1147610 - DNA, 22 bp, Artificial Sequence
  chemically synthesized
taaattctattatgatgatatt

SEQ ID NO: 1147611 - DNA, 22 bp, Artificial Sequence
  chemically synthesized
tgtaaattctattatgatgata

SEQ ID NO: 1147612 - DNA, 22 bp, Artificial Sequence
  chemically synthesized
ttctgtaaattctattatgatg

SEQ ID NO: 1147613 - DNA, 22 bp, Artificial Sequence
  chemically synthesized
attctgtaaattctattatgat

SEQ ID NO: 1147614 - DNA, 22 bp, Artificial Sequence
  chemically synthesized
atttattctgtaaattctatta

SEQ ID NO: 1147615 - DNA, 22 bp, Artificial Sequence
  chemically synthesized
aaatatcatcataatagaattt

SEQ ID NO: 1147616 - DNA, 22 bp, Artificial Sequence
  chemically synthesized
catgtattgatttattctgtaa

SEQ ID NO: 1147617 - DNA, 22 bp, Artificial Sequence
  chemically synthesized
acagaataaatcaatacatgca

SEQ ID NO: 1147618 - DNA, 22 bp, Artificial Sequence
  chemically synthesized
cagaataaatcaatacatgcag

SEQ ID NO: 1147619 - DNA, 22 bp, Artificial Sequence
  chemically synthesized
caataggatatatctgcatgta

SEQ ID NO: 1147620 - DNA, 22 bp, Artificial Sequence
  chemically synthesized
ccaataggatatatctgcatgt

SEQ ID NO: 1147621 - DNA, 22 bp, Artificial Sequence
  chemically synthesized
aaaatacttccaataggatata

SEQ ID NO: 1147622 - DNA, 22 bp, Artificial Sequence
  chemically synthesized
taaaaatacttccaataggata

SEQ ID NO: 1147623 - DNA, 22 bp, Artificial Sequence
  chemically synthesized
gaactctaaaaatacttccaat

SEQ ID NO: 1147624 - DNA, 22 bp, Artificial Sequence
  chemically synthesized
agttagaactctaaaaatactt

SEQ ID NO: 1147625 - DNA, 22 bp, Artificial Sequence
  chemically synthesized
ttggaagtatttttagagttct

SEQ ID NO: 1147626 - DNA, 22 bp, Artificial Sequence
  chemically synthesized
acaccctgagttagaactctaa

SEQ ID NO: 1147627 - DNA, 22 bp, Artificial Sequence
  chemically synthesized
aacaccctgagttagaactcta

SEQ ID NO: 1147628 - DNA, 22 bp, Artificial Sequence
  chemically synthesized
gaagtatttttagagttctaac

SEQ ID NO: 1147629 - DNA, 22 bp, Artificial Sequence
  chemically synthesized
ttagagttctaactcagggtgt

SEQ ID NO: 1147630 - DNA, 22 bp, Artificial Sequence
  chemically synthesized
tagagttctaactcagggtgtt

SEQ ID NO: 1147631 - DNA, 22 bp, Artificial Sequence
  chemically synthesized
agagttctaactcagggtgtta

SEQ ID NO: 1147632 - DNA, 22 bp, Artificial Sequence
  chemically synthesized
gagttctaactcagggtgttaa

SEQ ID NO: 1147633 - DNA, 22 bp, Artificial Sequence
  chemically synthesized
taactcagggtgttaagtatgc

SEQ ID NO: 1147634 - DNA, 22 bp, Artificial Sequence
  chemically synthesized
actcagggtgttaagtatgcat

SEQ ID NO: 1147635 - DNA, 22 bp, Artificial Sequence
  chemically synthesized
agggtgttaagtatgcatctct

SEQ ID NO: 1147636 - DNA, 22 bp, Artificial Sequence
  chemically synthesized
gtccaataaggaagagagatgc

SEQ ID NO: 1147637 - DNA, 22 bp, Artificial Sequence
  chemically synthesized
agtccaataaggaagagagatg

SEQ ID NO: 1147638 - DNA, 22 bp, Artificial Sequence
  chemically synthesized
agtatgcatctctcttccttat

SEQ ID NO: 1147639 - DNA, 22 bp, Artificial Sequence
  chemically synthesized
tcttccttattggactaaatgg

SEQ ID NO: 1147640 - DNA, 22 bp, Artificial Sequence
  chemically synthesized
ttccttattggactaaatgggg

SEQ ID NO: 1147641 - DNA, 22 bp, Artificial Sequence
  chemically synthesized
ccttattggactaaatggggac

SEQ ID NO: 1147642 - DNA, 22 bp, Artificial Sequence
  chemically synthesized
cttattggactaaatggggact

SEQ ID NO: 1147643 - DNA, 22 bp, Artificial Sequence
  chemically synthesized
attggactaaatggggacttcc

SEQ ID NO: 1147644 - DNA, 22 bp, Artificial Sequence
  chemically synthesized
ttggactaaatggggacttccc

SEQ ID NO: 1147645 - DNA, 22 bp, Artificial Sequence
  chemically synthesized
gactaaatggggacttcccttc

SEQ ID NO: 1147646 - DNA, 22 bp, Artificial Sequence
  chemically synthesized
aatggggacttcccttcctact

SEQ ID NO: 1147647 - DNA, 22 bp, Artificial Sequence
  chemically synthesized
cccttcctactttcccccatct

SEQ ID NO: 1147648 - DNA, 22 bp, Artificial Sequence
  chemically synthesized
gtaaagaggtacagatggggga

SEQ ID NO: 1147649 - DNA, 22 bp, Artificial Sequence
  chemically synthesized
ccttcctactttcccccatctg

SEQ ID NO: 1147650 - DNA, 22 bp, Artificial Sequence
  chemically synthesized
ggtaaagaggtacagatggggg

SEQ ID NO: 1147651 - DNA, 22 bp, Artificial Sequence
  chemically synthesized
tggtaaagaggtacagatgggg

SEQ ID NO: 1147652 - DNA, 22 bp, Artificial Sequence
  chemically synthesized
cctactttcccccatctgtacc

SEQ ID NO: 1147653 - DNA, 22 bp, Artificial Sequence
  chemically synthesized
ctactttcccccatctgtacct

SEQ ID NO: 1147654 - DNA, 22 bp, Artificial Sequence
  chemically synthesized
tctttggtaaagaggtacagat

SEQ ID NO: 1147655 - DNA, 22 bp, Artificial Sequence
  chemically synthesized
ctttcccccatctgtacctctt

SEQ ID NO: 1147656 - DNA, 22 bp, Artificial Sequence
  chemically synthesized
tcccccatctgtacctctttac

SEQ ID NO: 1147657 - DNA, 22 bp, Artificial Sequence
  chemically synthesized
cccccatctgtacctctttacc

SEQ ID NO: 1147658 - DNA, 22 bp, Artificial Sequence
  chemically synthesized
ccccatctgtacctctttacca

SEQ ID NO: 1147659 - DNA, 22 bp, Artificial Sequence
  chemically synthesized
tacctctttaccaaagacagct

SEQ ID NO: 1147660 - DNA, 22 bp, Artificial Sequence
  chemically synthesized
aaaaaggatagccagctgtctt

SEQ ID NO: 1147661 - DNA, 22 bp, Artificial Sequence
  chemically synthesized
tttaccaaagacagctggctat

SEQ ID NO: 1147662 - DNA, 22 bp, Artificial Sequence
  chemically synthesized
taccaaagacagctggctatcc

SEQ ID NO: 1147663 - DNA, 22 bp, Artificial Sequence
  chemically synthesized
accaaagacagctggctatcct

SEQ ID NO: 1147664 - DNA, 22 bp, Artificial Sequence
  chemically synthesized
ccaaagacagctggctatcctt

SEQ ID NO: 1147665 - DNA, 22 bp, Artificial Sequence
  chemically synthesized
aaatgccatccagaggctcaaa

SEQ ID NO: 1147666 - DNA, 22 bp, Artificial Sequence
  chemically synthesized
gctatcctttttgagcctctgg

SEQ ID NO: 1147667 - DNA, 22 bp, Artificial Sequence
  chemically synthesized
ttgaaatgccatccagaggctc

SEQ ID NO: 1147668 - DNA, 22 bp, Artificial Sequence
  chemically synthesized
tgttgaaatgccatccagaggc

SEQ ID NO: 1147669 - DNA, 22 bp, Artificial Sequence
  chemically synthesized
tcctttttgagcctctggatgg

SEQ ID NO: 1147670 - DNA, 22 bp, Artificial Sequence
  chemically synthesized
aaattctgttgaaatgccatcc

SEQ ID NO: 1147671 - DNA, 22 bp, Artificial Sequence
  chemically synthesized
tttgagcctctggatggcattt

SEQ ID NO: 1147672 - DNA, 22 bp, Artificial Sequence
  chemically synthesized
ttgagcctctggatggcatttc

SEQ ID NO: 1147673 - DNA, 22 bp, Artificial Sequence
  chemically synthesized
tgagcctctggatggcatttca

SEQ ID NO: 1147674 - DNA, 22 bp, Artificial Sequence
  chemically synthesized
gagcctctggatggcatttcaa

SEQ ID NO: 1147675 - DNA, 22 bp, Artificial Sequence
  chemically synthesized
agcctctggatggcatttcaac

SEQ ID NO: 1147676 - DNA, 22 bp, Artificial Sequence
  chemically synthesized
cactaaaattctgttgaaatgc

SEQ ID NO: 1147677 - DNA, 22 bp, Artificial Sequence
  chemically synthesized
tggatggcatttcaacagaatt

SEQ ID NO: 1147678 - DNA, 22 bp, Artificial Sequence
  chemically synthesized
gatggcatttcaacagaatttt

SEQ ID NO: 1147679 - DNA, 22 bp, Artificial Sequence
  chemically synthesized
atccattgcactaaaattctgt

SEQ ID NO: 1147680 - DNA, 22 bp, Artificial Sequence
  chemically synthesized
catccattgcactaaaattctg

SEQ ID NO: 1147681 - DNA, 22 bp, Artificial Sequence
  chemically synthesized
cttcatccattgcactaaaatt

SEQ ID NO: 1147682 - DNA, 22 bp, Artificial Sequence
  chemically synthesized
caacagaattttagtgcaatgg

SEQ ID NO: 1147683 - DNA, 22 bp, Artificial Sequence
  chemically synthesized
aacagaattttagtgcaatgga

SEQ ID NO: 1147684 - DNA, 22 bp, Artificial Sequence
  chemically synthesized
atcaccacaattccttcatcca

SEQ ID NO: 1147685 - DNA, 22 bp, Artificial Sequence
  chemically synthesized
tagtgcaatggatgaaggaatt

SEQ ID NO: 1147686 - DNA, 22 bp, Artificial Sequence
  chemically synthesized
agtgcaatggatgaaggaattg

SEQ ID NO: 1147687 - DNA, 22 bp, Artificial Sequence
  chemically synthesized
gtgcaatggatgaaggaattgt

SEQ ID NO: 1147688 - DNA, 22 bp, Artificial Sequence
  chemically synthesized
gcatccctcatcaccacaattc

SEQ ID NO: 1147689 - DNA, 22 bp, Artificial Sequence
  chemically synthesized
gccctggcatccctcatcacca

SEQ ID NO: 1147690 - DNA, 22 bp, Artificial Sequence
  chemically synthesized
cgccctggcatccctcatcacc

SEQ ID NO: 1147691 - DNA, 22 bp, Artificial Sequence
  chemically synthesized
cttcgccctggcatccctcatc

SEQ ID NO: 1147692 - DNA, 22 bp, Artificial Sequence
  chemically synthesized
ccttcgccctggcatccctcat

SEQ ID NO: 1147693 - DNA, 22 bp, Artificial Sequence
  chemically synthesized
ttccttcgccctggcatccctc

SEQ ID NO: 1147694 - DNA, 22 bp, Artificial Sequence
  chemically synthesized
tcttccttcgccctggcatccc

SEQ ID NO: 1147695 - DNA, 22 bp, Artificial Sequence
  chemically synthesized
ctcttccttcgccctggcatcc

SEQ ID NO: 1147696 - DNA, 22 bp, Artificial Sequence
  chemically synthesized
tggtgatgagggatgccagggc

SEQ ID NO: 1147697 - DNA, 22 bp, Artificial Sequence
  chemically synthesized
acgccttctcttccttcgccct

SEQ ID NO: 1147698 - DNA, 22 bp, Artificial Sequence
  chemically synthesized
agtgcccatctcacgccttctc

SEQ ID NO: 1147699 - DNA, 22 bp, Artificial Sequence
  chemically synthesized
gtgttgagtgcccatctcacgc

SEQ ID NO: 1147700 - DNA, 22 bp, Artificial Sequence
  chemically synthesized
ttagtgttgagtgcccatctca

SEQ ID NO: 1147701 - DNA, 22 bp, Artificial Sequence
  chemically synthesized
aaaacctattagtgttgagtgc

SEQ ID NO: 1147702 - DNA, 22 bp, Artificial Sequence
  chemically synthesized
ctcaaaacctattagtgttgag

SEQ ID NO: 1147703 - DNA, 22 bp, Artificial Sequence
  chemically synthesized
ttcctcaaaacctattagtgtt

SEQ ID NO: 1147704 - DNA, 22 bp, Artificial Sequence
  chemically synthesized
attcctcaaaacctattagtgt

SEQ ID NO: 1147705 - DNA, 22 bp, Artificial Sequence
  chemically synthesized
acttattcctcaaaacctatta

SEQ ID NO: 1147706 - DNA, 22 bp, Artificial Sequence
  chemically synthesized
aacttattcctcaaaacctatt

SEQ ID NO: 1147707 - DNA, 22 bp, Artificial Sequence
  chemically synthesized
tccttaacttattcctcaaaac

SEQ ID NO: 1147708 - DNA, 22 bp, Artificial Sequence
  chemically synthesized
aacactaataggttttgaggaa

SEQ ID NO: 1147709 - DNA, 22 bp, Artificial Sequence
  chemically synthesized
gctatccttaacttattcctca

SEQ ID NO: 1147710 - DNA, 22 bp, Artificial Sequence
  chemically synthesized
ataggttttgaggaataagtta

SEQ ID NO: 1147711 - DNA, 22 bp, Artificial Sequence
  chemically synthesized
tgaggaataagttaaggatagc

SEQ ID NO: 1147712 - DNA, 22 bp, Artificial Sequence
  chemically synthesized
gagcagagtctggctatcctta

SEQ ID NO: 1147713 - DNA, 22 bp, Artificial Sequence
  chemically synthesized
gaggaataagttaaggatagcc

SEQ ID NO: 1147714 - DNA, 22 bp, Artificial Sequence
  chemically synthesized
aggaataagttaaggatagcca

SEQ ID NO: 1147715 - DNA, 22 bp, Artificial Sequence
  chemically synthesized
ttagagcagagtctggctatcc

SEQ ID NO: 1147716 - DNA, 22 bp, Artificial Sequence
  chemically synthesized
attagagcagagtctggctatc

SEQ ID NO: 1147717 - DNA, 22 bp, Artificial Sequence
  chemically synthesized
tattagagcagagtctggctat

SEQ ID NO: 1147718 - DNA, 22 bp, Artificial Sequence
  chemically synthesized
ttattagagcagagtctggcta

SEQ ID NO: 1147719 - DNA, 22 bp, Artificial Sequence
  chemically synthesized
tttattagagcagagtctggct

SEQ ID NO: 1147720 - DNA, 22 bp, Artificial Sequence
  chemically synthesized
aggatagccagactctgctcta

SEQ ID NO: 1147721 - DNA, 22 bp, Artificial Sequence
  chemically synthesized
gcaggctttttattagagcaga

SEQ ID NO: 1147722 - DNA, 22 bp, Artificial Sequence
  chemically synthesized
agcaggctttttattagagcag

SEQ ID NO: 1147723 - DNA, 22 bp, Artificial Sequence
  chemically synthesized
tgctctaataaaaagcctgcta

SEQ ID NO: 1147724 - DNA, 22 bp, Artificial Sequence
  chemically synthesized
agagaaggatcttagcaggctt

SEQ ID NO: 1147725 - DNA, 22 bp, Artificial Sequence
  chemically synthesized
ctctaataaaaagcctgctaag

SEQ ID NO: 1147726 - DNA, 22 bp, Artificial Sequence
  chemically synthesized
taataaaaagcctgctaagatc

SEQ ID NO: 1147727 - DNA, 22 bp, Artificial Sequence
  chemically synthesized
ataaaaagcctgctaagatcct

SEQ ID NO: 1147728 - DNA, 22 bp, Artificial Sequence
  chemically synthesized
ctaagatccttctctgagtcct

SEQ ID NO: 1147729 - DNA, 22 bp, Artificial Sequence
  chemically synthesized
agatccttctctgagtcctgat

SEQ ID NO: 1147730 - DNA, 22 bp, Artificial Sequence
  chemically synthesized
aaagaaaaacaatcatcaggac

SEQ ID NO: 1147731 - DNA, 22 bp, Artificial Sequence
  chemically synthesized
ctctgagtcctgatgattgttt

SEQ ID NO: 1147732 - DNA, 22 bp, Artificial Sequence
  chemically synthesized
tctgagtcctgatgattgtttt

SEQ ID NO: 1147733 - DNA, 22 bp, Artificial Sequence
  chemically synthesized
tgagtcctgatgattgtttttc

SEQ ID NO: 1147734 - DNA, 22 bp, Artificial Sequence
  chemically synthesized
gatcccctaaaagaaaaacaat

SEQ ID NO: 1147735 - DNA, 22 bp, Artificial Sequence
  chemically synthesized
ggatcccctaaaagaaaaacaa

SEQ ID NO: 1147736 - DNA, 22 bp, Artificial Sequence
  chemically synthesized
agtcctgatgattgtttttctt

SEQ ID NO: 1147737 - DNA, 22 bp, Artificial Sequence
  chemically synthesized
atgattgtttttcttttagggg

SEQ ID NO: 1147738 - DNA, 22 bp, Artificial Sequence
  chemically synthesized
tttttcttttaggggatccaaa

SEQ ID NO: 1147739 - DNA, 22 bp, Artificial Sequence
  chemically synthesized
ttcttttaggggatccaaatac

SEQ ID NO: 1147740 - DNA, 22 bp, Artificial Sequence
  chemically synthesized
tcttttaggggatccaaatacc

SEQ ID NO: 1147741 - DNA, 22 bp, Artificial Sequence
  chemically synthesized
cttttaggggatccaaatacct

SEQ ID NO: 1147742 - DNA, 22 bp, Artificial Sequence
  chemically synthesized
ttttaggggatccaaatacctg

SEQ ID NO: 1147743 - DNA, 22 bp, Artificial Sequence
  chemically synthesized
caggaaagagaaacaggtattt

SEQ ID NO: 1147744 - DNA, 22 bp, Artificial Sequence
  chemically synthesized
ttaggggatccaaatacctgtt

SEQ ID NO: 1147745 - DNA, 22 bp, Artificial Sequence
  chemically synthesized
taggggatccaaatacctgttt

SEQ ID NO: 1147746 - DNA, 22 bp, Artificial Sequence
  chemically synthesized
aggggatccaaatacctgtttc

SEQ ID NO: 1147747 - DNA, 22 bp, Artificial Sequence
  chemically synthesized
ggggatccaaatacctgtttct

SEQ ID NO: 1147748 - DNA, 22 bp, Artificial Sequence
  chemically synthesized
gaagaattacaggaaagagaaa

SEQ ID NO: 1147749 - DNA, 22 bp, Artificial Sequence
  chemically synthesized
tttctctttcctgtaattcttc

SEQ ID NO: 1147750 - DNA, 22 bp, Artificial Sequence
  chemically synthesized
gtagacgtaattagaagaatta

SEQ ID NO: 1147751 - DNA, 22 bp, Artificial Sequence
  chemically synthesized
ctctttcctgtaattcttctaa

SEQ ID NO: 1147752 - DNA, 22 bp, Artificial Sequence
  chemically synthesized
tggtagacgtaattagaagaat

SEQ ID NO: 1147753 - DNA, 22 bp, Artificial Sequence
  chemically synthesized
tctttcctgtaattcttctaat

SEQ ID NO: 1147754 - DNA, 22 bp, Artificial Sequence
  chemically synthesized
tttcctgtaattcttctaatta

SEQ ID NO: 1147755 - DNA, 22 bp, Artificial Sequence
  chemically synthesized
tcctgtaattcttctaattacg

SEQ ID NO: 1147756 - DNA, 22 bp, Artificial Sequence
  chemically synthesized
cctgtaattcttctaattacgt

SEQ ID NO: 1147757 - DNA, 22 bp, Artificial Sequence
  chemically synthesized
ctgtaattcttctaattacgtc

SEQ ID NO: 1147758 - DNA, 22 bp, Artificial Sequence
  chemically synthesized
taattcttctaattacgtctac

SEQ ID NO: 1147759 - DNA, 22 bp, Artificial Sequence
  chemically synthesized
agagggattctggtagacgtaa

SEQ ID NO: 1147760 - DNA, 22 bp, Artificial Sequence
  chemically synthesized
gactgagagggattctggtaga

SEQ ID NO: 1147761 - DNA, 22 bp, Artificial Sequence
  chemically synthesized
ttctaattacgtctaccagaat

SEQ ID NO: 1147762 - DNA, 22 bp, Artificial Sequence
  chemically synthesized
ctaattacgtctaccagaatcc

SEQ ID NO: 1147763 - DNA, 22 bp, Artificial Sequence
  chemically synthesized
taattacgtctaccagaatccc

SEQ ID NO: 1147764 - DNA, 22 bp, Artificial Sequence
  chemically synthesized
attacgtctaccagaatccctc

SEQ ID NO: 1147765 - DNA, 22 bp, Artificial Sequence
  chemically synthesized
atactggactgagagggattct

SEQ ID NO: 1147766 - DNA, 22 bp, Artificial Sequence
  chemically synthesized
aatactggactgagagggattc

SEQ ID NO: 1147767 - DNA, 22 bp, Artificial Sequence
  chemically synthesized
cgtctaccagaatccctctcag

SEQ ID NO: 1147768 - DNA, 22 bp, Artificial Sequence
  chemically synthesized
atatgtttaatactggactgag

SEQ ID NO: 1147769 - DNA, 22 bp, Artificial Sequence
  chemically synthesized
ccagaatccctctcagtccagt

SEQ ID NO: 1147770 - DNA, 22 bp, Artificial Sequence
  chemically synthesized
aatatgtttaatactggactga

SEQ ID NO: 1147771 - DNA, 22 bp, Artificial Sequence
  chemically synthesized
taatatgtttaatactggactg

SEQ ID NO: 1147772 - DNA, 22 bp, Artificial Sequence
  chemically synthesized
tggactttaatatgtttaatac

SEQ ID NO: 1147773 - DNA, 22 bp, Artificial Sequence
  chemically synthesized
tcagtccagtattaaacatatt

SEQ ID NO: 1147774 - DNA, 22 bp, Artificial Sequence
  chemically synthesized
agtccagtattaaacatattaa

SEQ ID NO: 1147775 - DNA, 22 bp, Artificial Sequence
  chemically synthesized
agagactgtggactttaatatg

SEQ ID NO: 1147776 - DNA, 22 bp, Artificial Sequence
  chemically synthesized
cagagactgtggactttaatat

SEQ ID NO: 1147777 - DNA, 22 bp, Artificial Sequence
  chemically synthesized
aacatattaaagtccacagtct

SEQ ID NO: 1147778 - DNA, 22 bp, Artificial Sequence
  chemically synthesized
gggtagcttcagagactgtgga

SEQ ID NO: 1147779 - DNA, 22 bp, Artificial Sequence
  chemically synthesized
tagggtagcttcagagactgtg

SEQ ID NO: 1147780 - DNA, 22 bp, Artificial Sequence
  chemically synthesized
taattctagggtagcttcagag

SEQ ID NO: 1147781 - DNA, 22 bp, Artificial Sequence
  chemically synthesized
aagtccacagtctctgaagcta

SEQ ID NO: 1147782 - DNA, 22 bp, Artificial Sequence
  chemically synthesized
ggtatattataattctagggta

SEQ ID NO: 1147783 - DNA, 22 bp, Artificial Sequence
  chemically synthesized
tgaagctaccctagaattataa

SEQ ID NO: 1147784 - DNA, 22 bp, Artificial Sequence
  chemically synthesized
aagctaccctagaattataata

SEQ ID NO: 1147785 - DNA, 22 bp, Artificial Sequence
  chemically synthesized
ccctagaattataatataccca

SEQ ID NO: 1147786 - DNA, 22 bp, Artificial Sequence
  chemically synthesized
acacaaataccctgggtatatt

SEQ ID NO: 1147787 - DNA, 22 bp, Artificial Sequence
  chemically synthesized
aacacaaataccctgggtatat

SEQ ID NO: 1147788 - DNA, 22 bp, Artificial Sequence
  chemically synthesized
gaattataatatacccagggta

SEQ ID NO: 1147789 - DNA, 22 bp, Artificial Sequence
  chemically synthesized
taatatacccagggtatttgtg

SEQ ID NO: 1147790 - DNA, 22 bp, Artificial Sequence
  chemically synthesized
ataaagtataaaaacataaaaa

SEQ ID NO: 1147791 - DNA, 22 bp, Artificial Sequence
  chemically synthesized
gtgttaaatttttttatgtttt

SEQ ID NO: 1147792 - DNA, 22 bp, Artificial Sequence
  chemically synthesized
tgttaaatttttttatgttttt

SEQ ID NO: 1147793 - DNA, 22 bp, Artificial Sequence
  chemically synthesized
aatttttttatgtttttatact

SEQ ID NO: 1147794 - DNA, 22 bp, Artificial Sequence
  chemically synthesized
aaagattgataaagtataaaaa

SEQ ID NO: 1147795 - DNA, 22 bp, Artificial Sequence
  chemically synthesized
ttttatgtttttatactttatc

SEQ ID NO: 1147796 - DNA, 22 bp, Artificial Sequence
  chemically synthesized
tttatgtttttatactttatca

SEQ ID NO: 1147797 - DNA, 22 bp, Artificial Sequence
  chemically synthesized
ttatgtttttatactttatcaa

SEQ ID NO: 1147798 - DNA, 22 bp, Artificial Sequence
  chemically synthesized
tatgtttttatactttatcaat

SEQ ID NO: 1147799 - DNA, 22 bp, Artificial Sequence
  chemically synthesized
atgtttttatactttatcaatc

SEQ ID NO: 1147800 - DNA, 22 bp, Artificial Sequence
  chemically synthesized
tgtttttatactttatcaatct

SEQ ID NO: 1147801 - DNA, 22 bp, Artificial Sequence
  chemically synthesized
ttatactttatcaatcttttaa

SEQ ID NO: 1147802 - DNA, 22 bp, Artificial Sequence
  chemically synthesized
tatactttatcaatcttttaat

SEQ ID NO: 1147803 - DNA, 22 bp, Artificial Sequence
  chemically synthesized
atactttatcaatcttttaata

SEQ ID NO: 1147804 - DNA, 22 bp, Artificial Sequence
  chemically synthesized
tactttatcaatcttttaatac

SEQ ID NO: 1147805 - DNA, 22 bp, Artificial Sequence
  chemically synthesized
tatcaatcttttaatactttat

SEQ ID NO: 1147806 - DNA, 22 bp, Artificial Sequence
  chemically synthesized
atcaatcttttaatactttatg

SEQ ID NO: 1147807 - DNA, 22 bp, Artificial Sequence
  chemically synthesized
tcaatcttttaatactttatga

SEQ ID NO: 1147808 - DNA, 22 bp, Artificial Sequence
  chemically synthesized
ttaatactttatgatttctcct

SEQ ID NO: 1147809 - DNA, 22 bp, Artificial Sequence
  chemically synthesized
taatactttatgatttctcctt

SEQ ID NO: 1147810 - DNA, 22 bp, Artificial Sequence
  chemically synthesized
aatactttatgatttctcctta

SEQ ID NO: 1147811 - DNA, 22 bp, Artificial Sequence
  chemically synthesized
atactttatgatttctccttac

SEQ ID NO: 1147812 - DNA, 22 bp, Artificial Sequence
  chemically synthesized
tatgatttctccttactcctcc

SEQ ID NO: 1147813 - DNA, 22 bp, Artificial Sequence
  chemically synthesized
atgatttctccttactcctcct

SEQ ID NO: 1147814 - DNA, 22 bp, Artificial Sequence
  chemically synthesized
tgatttctccttactcctcctt

SEQ ID NO: 1147815 - DNA, 22 bp, Artificial Sequence
  chemically synthesized
ctccttactcctccttctgtac

SEQ ID NO: 1147816 - DNA, 22 bp, Artificial Sequence
  chemically synthesized
tccttactcctccttctgtacc

SEQ ID NO: 1147817 - DNA, 22 bp, Artificial Sequence
  chemically synthesized
cttactcctccttctgtaccat

SEQ ID NO: 1147818 - DNA, 22 bp, Artificial Sequence
  chemically synthesized
actcctccttctgtaccatctt

SEQ ID NO: 1147819 - DNA, 22 bp, Artificial Sequence
  chemically synthesized
ctcctccttctgtaccatcttc

SEQ ID NO: 1147820 - DNA, 22 bp, Artificial Sequence
  chemically synthesized
ctccttctgtaccatcttctcg

SEQ ID NO: 1147821 - DNA, 22 bp, Artificial Sequence
  chemically synthesized
cttctgtaccatcttctcgtcc

SEQ ID NO: 1147822 - DNA, 22 bp, Artificial Sequence
  chemically synthesized
ctgtaccatcttctcgtcctct

SEQ ID NO: 1147823 - DNA, 22 bp, Artificial Sequence
  chemically synthesized
aaagcaagaagaagaggacgag

SEQ ID NO: 1147824 - DNA, 22 bp, Artificial Sequence
  chemically synthesized
tgtaccatcttctcgtcctctt

SEQ ID NO: 1147825 - DNA, 22 bp, Artificial Sequence
  chemically synthesized
aaaagcaagaagaagaggacga

SEQ ID NO: 1147826 - DNA, 22 bp, Artificial Sequence
  chemically synthesized
taaaagcaagaagaagaggacg

SEQ ID NO: 1147827 - DNA, 22 bp, Artificial Sequence
  chemically synthesized
taccatcttctcgtcctcttct

SEQ ID NO: 1147828 - DNA, 22 bp, Artificial Sequence
  chemically synthesized
ttaaaagcaagaagaagaggac

SEQ ID NO: 1147829 - DNA, 22 bp, Artificial Sequence
  chemically synthesized
tttaaaagcaagaagaagagga

SEQ ID NO: 1147830 - DNA, 22 bp, Artificial Sequence
  chemically synthesized
ctttttaaaagcaagaagaaga

SEQ ID NO: 1147831 - DNA, 22 bp, Artificial Sequence
  chemically synthesized
actttttaaaagcaagaagaag

SEQ ID NO: 1147832 - DNA, 22 bp, Artificial Sequence
  chemically synthesized
ctcgtcctcttcttcttgcttt

SEQ ID NO: 1147833 - DNA, 22 bp, Artificial Sequence
  chemically synthesized
gtttactttttaaaagcaagaa

SEQ ID NO: 1147834 - DNA, 22 bp, Artificial Sequence
  chemically synthesized
tcgtcctcttcttcttgctttt

SEQ ID NO: 1147835 - DNA, 22 bp, Artificial Sequence
  chemically synthesized
gtcctcttcttcttgcttttaa

SEQ ID NO: 1147836 - DNA, 22 bp, Artificial Sequence
  chemically synthesized
cctagtttactttttaaaagca

SEQ ID NO: 1147837 - DNA, 22 bp, Artificial Sequence
  chemically synthesized
acctagtttactttttaaaagc

SEQ ID NO: 1147838 - DNA, 22 bp, Artificial Sequence
  chemically synthesized
ttcttcttgcttttaaaaagta

SEQ ID NO: 1147839 - DNA, 22 bp, Artificial Sequence
  chemically synthesized
tcttacctagtttactttttaa

SEQ ID NO: 1147840 - DNA, 22 bp, Artificial Sequence
  chemically synthesized
gtcttacctagtttacttttta

SEQ ID NO: 1147841 - DNA, 22 bp, Artificial Sequence
  chemically synthesized
cttcttgcttttaaaaagtaaa

SEQ ID NO: 1147842 - DNA, 22 bp, Artificial Sequence
  chemically synthesized
ttcttgcttttaaaaagtaaac

SEQ ID NO: 1147843 - DNA, 22 bp, Artificial Sequence
  chemically synthesized
cttgcttttaaaaagtaaacta

SEQ ID NO: 1147844 - DNA, 22 bp, Artificial Sequence
  chemically synthesized
ttgcttttaaaaagtaaactag

SEQ ID NO: 1147845 - DNA, 22 bp, Artificial Sequence
  chemically synthesized
gcttttaaaaagtaaactaggt

SEQ ID NO: 1147846 - DNA, 22 bp, Artificial Sequence
  chemically synthesized
cttttaaaaagtaaactaggta

SEQ ID NO: 1147847 - DNA, 22 bp, Artificial Sequence
  chemically synthesized
ttaaaaagtaaactaggtaaga

SEQ ID NO: 1147848 - DNA, 22 bp, Artificial Sequence
  chemically synthesized
taaaaagtaaactaggtaagac

SEQ ID NO: 1147849 - DNA, 22 bp, Artificial Sequence
  chemically synthesized
aaaaagtaaactaggtaagaca

SEQ ID NO: 1147850 - DNA, 22 bp, Artificial Sequence
  chemically synthesized
aaaagtaaactaggtaagacaa

SEQ ID NO: 1147851 - DNA, 22 bp, Artificial Sequence
  chemically synthesized
caagtgatataatcttgtctta

SEQ ID NO: 1147852 - DNA, 22 bp, Artificial Sequence
  chemically synthesized
gcaagtgatataatcttgtctt

SEQ ID NO: 1147853 - DNA, 22 bp, Artificial Sequence
  chemically synthesized
tgcaagtgatataatcttgtct

SEQ ID NO: 1147854 - DNA, 22 bp, Artificial Sequence
  chemically synthesized
tttgcaagtgatataatcttgt

SEQ ID NO: 1147855 - DNA, 22 bp, Artificial Sequence
  chemically synthesized
ggttctttgcaagtgatataat

SEQ ID NO: 1147856 - DNA, 22 bp, Artificial Sequence
  chemically synthesized
ggtaagacaagattatatcact

SEQ ID NO: 1147857 - DNA, 22 bp, Artificial Sequence
  chemically synthesized
aggttctttgcaagtgatataa

SEQ ID NO: 1147858 - DNA, 22 bp, Artificial Sequence
  chemically synthesized
ttaggttctttgcaagtgatat

SEQ ID NO: 1147859 - DNA, 22 bp, Artificial Sequence
  chemically synthesized
tatcacttgcaaagaacctaag

SEQ ID NO: 1147860 - DNA, 22 bp, Artificial Sequence
  chemically synthesized
aaacagagatgattcttaggtt

SEQ ID NO: 1147861 - DNA, 22 bp, Artificial Sequence
  chemically synthesized
gaaacagagatgattcttaggt

SEQ ID NO: 1147862 - DNA, 22 bp, Artificial Sequence
  chemically synthesized
tgaaacagagatgattcttagg

SEQ ID NO: 1147863 - DNA, 22 bp, Artificial Sequence
  chemically synthesized
gcaaagaacctaagaatcatct

SEQ ID NO: 1147864 - DNA, 22 bp, Artificial Sequence
  chemically synthesized
actttgaaacagagatgattct

SEQ ID NO: 1147865 - DNA, 22 bp, Artificial Sequence
  chemically synthesized
caaagaacctaagaatcatctc

SEQ ID NO: 1147866 - DNA, 22 bp, Artificial Sequence
  chemically synthesized
gactttgaaacagagatgattc

SEQ ID NO: 1147867 - DNA, 22 bp, Artificial Sequence
  chemically synthesized
catttgactttgaaacagagat

SEQ ID NO: 1147868 - DNA, 22 bp, Artificial Sequence
  chemically synthesized
ccatttgactttgaaacagaga

SEQ ID NO: 1147869 - DNA, 22 bp, Artificial Sequence
  chemically synthesized
cttccatttgactttgaaacag

SEQ ID NO: 1147870 - DNA, 22 bp, Artificial Sequence
  chemically synthesized
agaatcatctctgtttcaaagt

SEQ ID NO: 1147871 - DNA, 22 bp, Artificial Sequence
  chemically synthesized
tgcttccatttgactttgaaac

SEQ ID NO: 1147872 - DNA, 22 bp, Artificial Sequence
  chemically synthesized
tgtttcaaagtcaaatggaagc

SEQ ID NO: 1147873 - DNA, 22 bp, Artificial Sequence
  chemically synthesized
tttcaaagtcaaatggaagcag

SEQ ID NO: 1147874 - DNA, 22 bp, Artificial Sequence
  chemically synthesized
tcgtggaatgctctgcttccat

SEQ ID NO: 1147875 - DNA, 22 bp, Artificial Sequence
  chemically synthesized
caaagtcaaatggaagcagagc

SEQ ID NO: 1147876 - DNA, 22 bp, Artificial Sequence
  chemically synthesized
aaagtcaaatggaagcagagca

SEQ ID NO: 1147877 - DNA, 22 bp, Artificial Sequence
  chemically synthesized
gaattgtcgtggaatgctctgc

SEQ ID NO: 1147878 - DNA, 22 bp, Artificial Sequence
  chemically synthesized
gctggaattgtcgtggaatgct

SEQ ID NO: 1147879 - DNA, 22 bp, Artificial Sequence
  chemically synthesized
ttggctggaattgtcgtggaat

SEQ ID NO: 1147880 - DNA, 22 bp, Artificial Sequence
  chemically synthesized
actattggctggaattgtcgtg

SEQ ID NO: 1147881 - DNA, 22 bp, Artificial Sequence
  chemically synthesized
aactattggctggaattgtcgt

SEQ ID NO: 1147882 - DNA, 22 bp, Artificial Sequence
  chemically synthesized
tttaactattggctggaattgt

SEQ ID NO: 1147883 - DNA, 22 bp, Artificial Sequence
  chemically synthesized
atttaactattggctggaattg

SEQ ID NO: 1147884 - DNA, 22 bp, Artificial Sequence
  chemically synthesized
tatttaactattggctggaatt

SEQ ID NO: 1147885 - DNA, 22 bp, Artificial Sequence
  chemically synthesized
tactttatttaactattggctg

SEQ ID NO: 1147886 - DNA, 22 bp, Artificial Sequence
  chemically synthesized
cacgacaattccagccaatagt

SEQ ID NO: 1147887 - DNA, 22 bp, Artificial Sequence
  chemically synthesized
tatactttatttaactattggc

SEQ ID NO: 1147888 - DNA, 22 bp, Artificial Sequence
  chemically synthesized
agttctatactttatttaacta

SEQ ID NO: 1147889 - DNA, 22 bp, Artificial Sequence
  chemically synthesized
gagttctatactttatttaact

SEQ ID NO: 1147890 - DNA, 22 bp, Artificial Sequence
  chemically synthesized
cagccaatagttaaataaagta

SEQ ID NO: 1147891 - DNA, 22 bp, Artificial Sequence
  chemically synthesized
aataaagtatagaactcaagca

SEQ ID NO: 1147892 - DNA, 22 bp, Artificial Sequence
  chemically synthesized
agtcccaaaagaatccatgctt

SEQ ID NO: 1147893 - DNA, 22 bp, Artificial Sequence
  chemically synthesized
cagtcccaaaagaatccatgct

SEQ ID NO: 1147894 - DNA, 22 bp, Artificial Sequence
  chemically synthesized
cttcagtcccaaaagaatccat

SEQ ID NO: 1147895 - DNA, 22 bp, Artificial Sequence
  chemically synthesized
aagcatggattcttttgggact

SEQ ID NO: 1147896 - DNA, 22 bp, Artificial Sequence
  chemically synthesized
catcccatcagttccttcagtc

SEQ ID NO: 1147897 - DNA, 22 bp, Artificial Sequence
  chemically synthesized
attccatcccatcagttccttc

SEQ ID NO: 1147898 - DNA, 22 bp, Artificial Sequence
  chemically synthesized
gattccatcccatcagttcctt

SEQ ID NO: 1147899 - DNA, 22 bp, Artificial Sequence
  chemically synthesized
ttttgggactgaaggaactgat

SEQ ID NO: 1147900 - DNA, 22 bp, Artificial Sequence
  chemically synthesized
tgattccatcccatcagttcct

SEQ ID NO: 1147901 - DNA, 22 bp, Artificial Sequence
  chemically synthesized
ttgggactgaaggaactgatgg

SEQ ID NO: 1147902 - DNA, 22 bp, Artificial Sequence
  chemically synthesized
tttgattccatcccatcagttc

SEQ ID NO: 1147903 - DNA, 22 bp, Artificial Sequence
  chemically synthesized
tgggactgaaggaactgatggg

SEQ ID NO: 1147904 - DNA, 22 bp, Artificial Sequence
  chemically synthesized
ctttgattccatcccatcagtt

SEQ ID NO: 1147905 - DNA, 22 bp, Artificial Sequence
  chemically synthesized
gggactgaaggaactgatggga

SEQ ID NO: 1147906 - DNA, 22 bp, Artificial Sequence
  chemically synthesized
tctttgattccatcccatcagt

SEQ ID NO: 1147907 - DNA, 22 bp, Artificial Sequence
  chemically synthesized
ggactgaaggaactgatgggat

SEQ ID NO: 1147908 - DNA, 22 bp, Artificial Sequence
  chemically synthesized
ttctttgattccatcccatcag

SEQ ID NO: 1147909 - DNA, 22 bp, Artificial Sequence
  chemically synthesized
aaggaactgatgggatggaatc

SEQ ID NO: 1147910 - DNA, 22 bp, Artificial Sequence
  chemically synthesized
taacttttctttgattccatcc

SEQ ID NO: 1147911 - DNA, 22 bp, Artificial Sequence
  chemically synthesized
ctataacttttctttgattcca

SEQ ID NO: 1147912 - DNA, 22 bp, Artificial Sequence
  chemically synthesized
gctataacttttctttgattcc

SEQ ID NO: 1147913 - DNA, 22 bp, Artificial Sequence
  chemically synthesized
atgggatggaatcaaagaaaag

SEQ ID NO: 1147914 - DNA, 22 bp, Artificial Sequence
  chemically synthesized
aaaggaatcaagtggagagaaa

SEQ ID NO: 1147915 - DNA, 22 bp, Artificial Sequence
  chemically synthesized
tagcaagggctttctctccact

SEQ ID NO: 1147916 - DNA, 22 bp, Artificial Sequence
  chemically synthesized
tctctccacttgattcctttta

SEQ ID NO: 1147917 - DNA, 22 bp, Artificial Sequence
  chemically synthesized
aaagggcagcattaaaaggaat

SEQ ID NO: 1147918 - DNA, 22 bp, Artificial Sequence
  chemically synthesized
ctctccacttgattccttttaa

SEQ ID NO: 1147919 - DNA, 22 bp, Artificial Sequence
  chemically synthesized
tctccacttgattccttttaat

SEQ ID NO: 1147920 - DNA, 22 bp, Artificial Sequence
  chemically synthesized
tccacttgattccttttaatgc

SEQ ID NO: 1147921 - DNA, 22 bp, Artificial Sequence
  chemically synthesized
cacttgattccttttaatgctg

SEQ ID NO: 1147922 - DNA, 22 bp, Artificial Sequence
  chemically synthesized
gtatctaaaagggcagcattaa

SEQ ID NO: 1147923 - DNA, 22 bp, Artificial Sequence
  chemically synthesized
gattccttttaatgctgccctt

SEQ ID NO: 1147924 - DNA, 22 bp, Artificial Sequence
  chemically synthesized
attccttttaatgctgcccttt

SEQ ID NO: 1147925 - DNA, 22 bp, Artificial Sequence
  chemically synthesized
gactagtatctaaaagggcagc

SEQ ID NO: 1147926 - DNA, 22 bp, Artificial Sequence
  chemically synthesized
cttttaatgctgcccttttaga

SEQ ID NO: 1147927 - DNA, 22 bp, Artificial Sequence
  chemically synthesized
ttaatgctgcccttttagatac

SEQ ID NO: 1147928 - DNA, 22 bp, Artificial Sequence
  chemically synthesized
taatgctgcccttttagatact

SEQ ID NO: 1147929 - DNA, 22 bp, Artificial Sequence
  chemically synthesized
aatgctgcccttttagatacta

SEQ ID NO: 1147930 - DNA, 22 bp, Artificial Sequence
  chemically synthesized
atgctgcccttttagatactag

SEQ ID NO: 1147931 - DNA, 22 bp, Artificial Sequence
  chemically synthesized
agataatctagactagtatcta

SEQ ID NO: 1147932 - DNA, 22 bp, Artificial Sequence
  chemically synthesized
aagataatctagactagtatct

SEQ ID NO: 1147933 - DNA, 22 bp, Artificial Sequence
  chemically synthesized
taagataatctagactagtatc

SEQ ID NO: 1147934 - DNA, 22 bp, Artificial Sequence
  chemically synthesized
cccttttagatactagtctaga

SEQ ID NO: 1147935 - DNA, 22 bp, Artificial Sequence
  chemically synthesized
ttagatactagtctagattatc

SEQ ID NO: 1147936 - DNA, 22 bp, Artificial Sequence
  chemically synthesized
tagatactagtctagattatct

SEQ ID NO: 1147937 - DNA, 22 bp, Artificial Sequence
  chemically synthesized
agatactagtctagattatctt

SEQ ID NO: 1147938 - DNA, 22 bp, Artificial Sequence
  chemically synthesized
gatactagtctagattatctta

SEQ ID NO: 1147939 - DNA, 22 bp, Artificial Sequence
  chemically synthesized
tagtgtcatgtgactttaagat

SEQ ID NO: 1147940 - DNA, 22 bp, Artificial Sequence
  chemically synthesized
tgtagtgtcatgtgactttaag

SEQ ID NO: 1147941 - DNA, 22 bp, Artificial Sequence
  chemically synthesized
gtctagattatcttaaagtcac

SEQ ID NO: 1147942 - DNA, 22 bp, Artificial Sequence
  chemically synthesized
gattatcttaaagtcacatgac

SEQ ID NO: 1147943 - DNA, 22 bp, Artificial Sequence
  chemically synthesized
tatagctctgtagtgtcatgtg

SEQ ID NO: 1147944 - DNA, 22 bp, Artificial Sequence
  chemically synthesized
tatatagctctgtagtgtcatg

SEQ ID NO: 1147945 - DNA, 22 bp, Artificial Sequence
  chemically synthesized
tcttaaagtcacatgacactac

SEQ ID NO: 1147946 - DNA, 22 bp, Artificial Sequence
  chemically synthesized
cctctatatagctctgtagtgt

SEQ ID NO: 1147947 - DNA, 22 bp, Artificial Sequence
  chemically synthesized
aaagtcacatgacactacagag

SEQ ID NO: 1147948 - DNA, 22 bp, Artificial Sequence
  chemically synthesized
gcctctatatagctctgtagtg

SEQ ID NO: 1147949 - DNA, 22 bp, Artificial Sequence
  chemically synthesized
aagtcacatgacactacagagc

SEQ ID NO: 1147950 - DNA, 22 bp, Artificial Sequence
  chemically synthesized
tgcctctatatagctctgtagt

SEQ ID NO: 1147951 - DNA, 22 bp, Artificial Sequence
  chemically synthesized
attttgcctctatatagctctg

SEQ ID NO: 1147952 - DNA, 22 bp, Artificial Sequence
  chemically synthesized
tcattttgcctctatatagctc

SEQ ID NO: 1147953 - DNA, 22 bp, Artificial Sequence
  chemically synthesized
atgttctcattttgcctctata

SEQ ID NO: 1147954 - DNA, 22 bp, Artificial Sequence
  chemically synthesized
gatgttctcattttgcctctat

SEQ ID NO: 1147955 - DNA, 22 bp, Artificial Sequence
  chemically synthesized
tgatgttctcattttgcctcta

SEQ ID NO: 1147956 - DNA, 22 bp, Artificial Sequence
  chemically synthesized
ttgatgttctcattttgcctct

SEQ ID NO: 1147957 - DNA, 22 bp, Artificial Sequence
  chemically synthesized
cagagctatatagaggcaaaat

SEQ ID NO: 1147958 - DNA, 22 bp, Artificial Sequence
  chemically synthesized
ttttgatgttctcattttgcct

SEQ ID NO: 1147959 - DNA, 22 bp, Artificial Sequence
  chemically synthesized
ctcttttgatgttctcattttg

SEQ ID NO: 1147960 - DNA, 22 bp, Artificial Sequence
  chemically synthesized
cctcttttgatgttctcatttt

SEQ ID NO: 1147961 - DNA, 22 bp, Artificial Sequence
  chemically synthesized
tcctcttttgatgttctcattt

SEQ ID NO: 1147962 - DNA, 22 bp, Artificial Sequence
  chemically synthesized
tatagaggcaaaatgagaacat

SEQ ID NO: 1147963 - DNA, 22 bp, Artificial Sequence
  chemically synthesized
tttcctcttttgatgttctcat

SEQ ID NO: 1147964 - DNA, 22 bp, Artificial Sequence
  chemically synthesized
ctttcctcttttgatgttctca

SEQ ID NO: 1147965 - DNA, 22 bp, Artificial Sequence
  chemically synthesized
aatcttctttcctcttttgatg

SEQ ID NO: 1147966 - DNA, 22 bp, Artificial Sequence
  chemically synthesized
caatcttctttcctcttttgat

SEQ ID NO: 1147967 - DNA, 22 bp, Artificial Sequence
  chemically synthesized
tcttcaatcttctttcctcttt

SEQ ID NO: 1147968 - DNA, 22 bp, Artificial Sequence
  chemically synthesized
gtcttcaatcttctttcctctt

SEQ ID NO: 1147969 - DNA, 22 bp, Artificial Sequence
  chemically synthesized
tgtcttcaatcttctttcctct

SEQ ID NO: 1147970 - DNA, 22 bp, Artificial Sequence
  chemically synthesized
ttgtcttcaatcttctttcctc

SEQ ID NO: 1147971 - DNA, 22 bp, Artificial Sequence
  chemically synthesized
ttttgtcttcaatcttctttcc

SEQ ID NO: 1147972 - DNA, 22 bp, Artificial Sequence
  chemically synthesized
ctcttttgtcttcaatcttctt

SEQ ID NO: 1147973 - DNA, 22 bp, Artificial Sequence
  chemically synthesized
cagcctcctcttttgtcttcaa

SEQ ID NO: 1147974 - DNA, 22 bp, Artificial Sequence
  chemically synthesized
ccagcctcctcttttgtcttca

SEQ ID NO: 1147975 - DNA, 22 bp, Artificial Sequence
  chemically synthesized
ccttccagcctcctcttttgtc

SEQ ID NO: 1147976 - DNA, 22 bp, Artificial Sequence
  chemically synthesized
ctgccttccagcctcctctttt

SEQ ID NO: 1147977 - DNA, 22 bp, Artificial Sequence
  chemically synthesized
aagacaaaagaggaggctggaa

SEQ ID NO: 1147978 - DNA, 22 bp, Artificial Sequence
  chemically synthesized
atggctactgccttccagcctc

SEQ ID NO: 1147979 - DNA, 22 bp, Artificial Sequence
  chemically synthesized
aatggctactgccttccagcct

SEQ ID NO: 1147980 - DNA, 22 bp, Artificial Sequence
  chemically synthesized
taatggctactgccttccagcc

SEQ ID NO: 1147981 - DNA, 22 bp, Artificial Sequence
  chemically synthesized
catacccctttaatggctactg

SEQ ID NO: 1147982 - DNA, 22 bp, Artificial Sequence
  chemically synthesized
gaaggcagtagccattaaaggg

SEQ ID NO: 1147983 - DNA, 22 bp, Artificial Sequence
  chemically synthesized
tccatgattgcataccccttta

SEQ ID NO: 1147984 - DNA, 22 bp, Artificial Sequence
  chemically synthesized
gtccatgattgcataccccttt

SEQ ID NO: 1147985 - DNA, 22 bp, Artificial Sequence
  chemically synthesized
catttgtccatgattgcatacc

SEQ ID NO: 1147986 - DNA, 22 bp, Artificial Sequence
  chemically synthesized
tctgcatttgtccatgattgca

SEQ ID NO: 1147987 - DNA, 22 bp, Artificial Sequence
  chemically synthesized
tatctgcatttgtccatgattg

SEQ ID NO: 1147988 - DNA, 22 bp, Artificial Sequence
  chemically synthesized
aaggggtatgcaatcatggaca

SEQ ID NO: 1147989 - DNA, 22 bp, Artificial Sequence
  chemically synthesized
aactctatctgcatttgtccat

SEQ ID NO: 1147990 - DNA, 22 bp, Artificial Sequence
  chemically synthesized
aaactctatctgcatttgtcca

SEQ ID NO: 1147991 - DNA, 22 bp, Artificial Sequence
  chemically synthesized
cttaaactctatctgcatttgt

SEQ ID NO: 1147992 - DNA, 22 bp, Artificial Sequence
  chemically synthesized
gcttaaactctatctgcatttg

SEQ ID NO: 1147993 - DNA, 22 bp, Artificial Sequence
  chemically synthesized
atttgcttaaactctatctgca

SEQ ID NO: 1147994 - DNA, 22 bp, Artificial Sequence
  chemically synthesized
tccctaatttgcttaaactcta

SEQ ID NO: 1147995 - DNA, 22 bp, Artificial Sequence
  chemically synthesized
attatccctaatttgcttaaac

SEQ ID NO: 1147996 - DNA, 22 bp, Artificial Sequence
  chemically synthesized
aagcaaattagggataatcagt

SEQ ID NO: 1147997 - DNA, 22 bp, Artificial Sequence
  chemically synthesized
agcaaattagggataatcagta

SEQ ID NO: 1147998 - DNA, 22 bp, Artificial Sequence
  chemically synthesized
aatatcggtaaatgtactgatt

SEQ ID NO: 1147999 - DNA, 22 bp, Artificial Sequence
  chemically synthesized
ctaaatatcggtaaatgtactg

SEQ ID NO: 1148000 - DNA, 22 bp, Artificial Sequence
  chemically synthesized
gggataatcagtacatttaccg

SEQ ID NO: 1148001 - DNA, 22 bp, Artificial Sequence
  chemically synthesized
gcccaaagacatctactaaata

SEQ ID NO: 1148002 - DNA, 22 bp, Artificial Sequence
  chemically synthesized
ggcccaaagacatctactaaat

SEQ ID NO: 1148003 - DNA, 22 bp, Artificial Sequence
  chemically synthesized
tggcccaaagacatctactaaa

SEQ ID NO: 1148004 - DNA, 22 bp, Artificial Sequence
  chemically synthesized
tttggcccaaagacatctacta

SEQ ID NO: 1148005 - DNA, 22 bp, Artificial Sequence
  chemically synthesized
ctttggcccaaagacatctact

SEQ ID NO: 1148006 - DNA, 22 bp, Artificial Sequence
  chemically synthesized
accgatatttagtagatgtctt

SEQ ID NO: 1148007 - DNA, 22 bp, Artificial Sequence
  chemically synthesized
ccgatatttagtagatgtcttt

SEQ ID NO: 1148008 - DNA, 22 bp, Artificial Sequence
  chemically synthesized
tttctttggcccaaagacatct

SEQ ID NO: 1148009 - DNA, 22 bp, Artificial Sequence
  chemically synthesized
atttctttggcccaaagacatc

SEQ ID NO: 1148010 - DNA, 22 bp, Artificial Sequence
  chemically synthesized
tatttctttggcccaaagacat

SEQ ID NO: 1148011 - DNA, 22 bp, Artificial Sequence
  chemically synthesized
cctttatttctttggcccaaag

SEQ ID NO: 1148012 - DNA, 22 bp, Artificial Sequence
  chemically synthesized
tgcctttatttctttggcccaa

SEQ ID NO: 1148013 - DNA, 22 bp, Artificial Sequence
  chemically synthesized
agtagatgtctttgggccaaag

SEQ ID NO: 1148014 - DNA, 22 bp, Artificial Sequence
  chemically synthesized
ctgcctttatttctttggccca

SEQ ID NO: 1148015 - DNA, 22 bp, Artificial Sequence
  chemically synthesized
gtagatgtctttgggccaaaga

SEQ ID NO: 1148016 - DNA, 22 bp, Artificial Sequence
  chemically synthesized
tctgcctttatttctttggccc

SEQ ID NO: 1148017 - DNA, 22 bp, Artificial Sequence
  chemically synthesized
ttttctgcctttatttctttgg

SEQ ID NO: 1148018 - DNA, 22 bp, Artificial Sequence
  chemically synthesized
attttctgcctttatttctttg

SEQ ID NO: 1148019 - DNA, 22 bp, Artificial Sequence
  chemically synthesized
accttattttctgcctttattt

SEQ ID NO: 1148020 - DNA, 22 bp, Artificial Sequence
  chemically synthesized
caccttattttctgcctttatt

SEQ ID NO: 1148021 - DNA, 22 bp, Artificial Sequence
  chemically synthesized
tgggccaaagaaataaaggcag

SEQ ID NO: 1148022 - DNA, 22 bp, Artificial Sequence
  chemically synthesized
tcaccttattttctgcctttat

SEQ ID NO: 1148023 - DNA, 22 bp, Artificial Sequence
  chemically synthesized
gggccaaagaaataaaggcaga

SEQ ID NO: 1148024 - DNA, 22 bp, Artificial Sequence
  chemically synthesized
ggccaaagaaataaaggcagaa

SEQ ID NO: 1148025 - DNA, 22 bp, Artificial Sequence
  chemically synthesized
attttcaccttattttctgcct

SEQ ID NO: 1148026 - DNA, 22 bp, Artificial Sequence
  chemically synthesized
cattttcaccttattttctgcc

SEQ ID NO: 1148027 - DNA, 22 bp, Artificial Sequence
  chemically synthesized
tcattttcaccttattttctgc

SEQ ID NO: 1148028 - DNA, 22 bp, Artificial Sequence
  chemically synthesized
ctttcattttcaccttattttc

SEQ ID NO: 1148029 - DNA, 22 bp, Artificial Sequence
  chemically synthesized
gctttcattttcaccttatttt

SEQ ID NO: 1148030 - DNA, 22 bp, Artificial Sequence
  chemically synthesized
cttgctttcattttcaccttat

SEQ ID NO: 1148031 - DNA, 22 bp, Artificial Sequence
  chemically synthesized
tacttgctttcattttcacctt

SEQ ID NO: 1148032 - DNA, 22 bp, Artificial Sequence
  chemically synthesized
ctacttgctttcattttcacct

SEQ ID NO: 1148033 - DNA, 22 bp, Artificial Sequence
  chemically synthesized
tctacttgctttcattttcacc

SEQ ID NO: 1148034 - DNA, 22 bp, Artificial Sequence
  chemically synthesized
ttttctacttgctttcattttc

SEQ ID NO: 1148035 - DNA, 22 bp, Artificial Sequence
  chemically synthesized
gttttctacttgctttcatttt

SEQ ID NO: 1148036 - DNA, 22 bp, Artificial Sequence
  chemically synthesized
tatttgttttctacttgctttc

SEQ ID NO: 1148037 - DNA, 22 bp, Artificial Sequence
  chemically synthesized
tgtatttgttttctacttgctt

SEQ ID NO: 1148038 - DNA, 22 bp, Artificial Sequence
  chemically synthesized
ctgtatttgttttctacttgct

SEQ ID NO: 1148039 - DNA, 22 bp, Artificial Sequence
  chemically synthesized
ttctgtatttgttttctacttg

SEQ ID NO: 1148040 - DNA, 22 bp, Artificial Sequence
  chemically synthesized
tactcttctgtatttgttttct

SEQ ID NO: 1148041 - DNA, 22 bp, Artificial Sequence
  chemically synthesized
tatggtgggcctatactcttct

SEQ ID NO: 1148042 - DNA, 22 bp, Artificial Sequence
  chemically synthesized
acagatggttgtatggtgggcc

SEQ ID NO: 1148043 - DNA, 22 bp, Artificial Sequence
  chemically synthesized
aaaaacagtccgtagaactcac

SEQ ID NO: 1148044 - DNA, 22 bp, Artificial Sequence
  chemically synthesized
gaaaaacagtccgtagaactca

SEQ ID NO: 1148045 - DNA, 22 bp, Artificial Sequence
  chemically synthesized
aggcatcttgaaaaacagtccg

SEQ ID NO: 1148046 - DNA, 22 bp, Artificial Sequence
  chemically synthesized
tgagttctacggactgtttttc

SEQ ID NO: 1148047 - DNA, 22 bp, Artificial Sequence
  chemically synthesized
tgtggttaaggcatcttgaaaa

SEQ ID NO: 1148048 - DNA, 22 bp, Artificial Sequence
  chemically synthesized
gtgtggttaaggcatcttgaaa

SEQ ID NO: 1148049 - DNA, 22 bp, Artificial Sequence
  chemically synthesized
tacggactgtttttcaagatgc

SEQ ID NO: 1148050 - DNA, 22 bp, Artificial Sequence
  chemically synthesized
cggactgtttttcaagatgcct

SEQ ID NO: 1148051 - DNA, 22 bp, Artificial Sequence
  chemically synthesized
tttttcaagatgccttaaccac

SEQ ID NO: 1148052 - DNA, 22 bp, Artificial Sequence
  chemically synthesized
ttcaagatgccttaaccacaca

SEQ ID NO: 1148053 - DNA, 22 bp, Artificial Sequence
  chemically synthesized
tcaagatgccttaaccacacaa

SEQ ID NO: 1148054 - DNA, 22 bp, Artificial Sequence
  chemically synthesized
caagatgccttaaccacacaag

SEQ ID NO: 1148055 - DNA, 22 bp, Artificial Sequence
  chemically synthesized
aagatgccttaaccacacaagc

SEQ ID NO: 1148056 - DNA, 22 bp, Artificial Sequence
  chemically synthesized
atccaaggtgatgcttgtgtgg

SEQ ID NO: 1148057 - DNA, 22 bp, Artificial Sequence
  chemically synthesized
aaccacacaagcatcaccttgg

SEQ ID NO: 1148058 - DNA, 22 bp, Artificial Sequence
  chemically synthesized
aatataattcatccaaggtgat

SEQ ID NO: 1148059 - DNA, 22 bp, Artificial Sequence
  chemically synthesized
accacacaagcatcaccttgga

SEQ ID NO: 1148060 - DNA, 22 bp, Artificial Sequence
  chemically synthesized
caatataattcatccaaggtga

SEQ ID NO: 1148061 - DNA, 22 bp, Artificial Sequence
  chemically synthesized
tcaatataattcatccaaggtg

SEQ ID NO: 1148062 - DNA, 22 bp, Artificial Sequence
  chemically synthesized
ttcaatataattcatccaaggt

SEQ ID NO: 1148063 - DNA, 22 bp, Artificial Sequence
  chemically synthesized
ggatgaattatattgaaaagct

SEQ ID NO: 1148064 - DNA, 22 bp, Artificial Sequence
  chemically synthesized
gatgaattatattgaaaagcta

SEQ ID NO: 1148065 - DNA, 22 bp, Artificial Sequence
  chemically synthesized
acccagtgtgaatagcttttca

SEQ ID NO: 1148066 - DNA, 22 bp, Artificial Sequence
  chemically synthesized
gctgacccagtgtgaatagctt

SEQ ID NO: 1148067 - DNA, 22 bp, Artificial Sequence
  chemically synthesized
tattgaaaagctattcacactg

SEQ ID NO: 1148068 - DNA, 22 bp, Artificial Sequence
  chemically synthesized
atcattagctgacccagtgtga

SEQ ID NO: 1148069 - DNA, 22 bp, Artificial Sequence
  chemically synthesized
catcattagctgacccagtgtg

SEQ ID NO: 1148070 - DNA, 22 bp, Artificial Sequence
  chemically synthesized
aaaagctattcacactgggtca

SEQ ID NO: 1148071 - DNA, 22 bp, Artificial Sequence
  chemically synthesized
ttcacactgggtcagctaatga

SEQ ID NO: 1148072 - DNA, 22 bp, Artificial Sequence
  chemically synthesized
acactgggtcagctaatgatga

SEQ ID NO: 1148073 - DNA, 22 bp, Artificial Sequence
  chemically synthesized
aaagcacccatttcatcattag

SEQ ID NO: 1148074 - DNA, 22 bp, Artificial Sequence
  chemically synthesized
ggtcagctaatgatgaaatggg

SEQ ID NO: 1148075 - DNA, 22 bp, Artificial Sequence
  chemically synthesized
aaataacaattgaaagcaccca

SEQ ID NO: 1148076 - DNA, 22 bp, Artificial Sequence
  chemically synthesized
aaaataacaattgaaagcaccc

SEQ ID NO: 1148077 - DNA, 22 bp, Artificial Sequence
  chemically synthesized
atgatgaaatgggtgctttcaa

SEQ ID NO: 1148078 - DNA, 22 bp, Artificial Sequence
  chemically synthesized
catttaaaataacaattgaaag

SEQ ID NO: 1148079 - DNA, 22 bp, Artificial Sequence
  chemically synthesized
ccatttaaaataacaattgaaa

SEQ ID NO: 1148080 - DNA, 22 bp, Artificial Sequence
  chemically synthesized
tcaattgttattttaaatggaa

SEQ ID NO: 1148081 - DNA, 22 bp, Artificial Sequence
  chemically synthesized
caattgttattttaaatggaaa

SEQ ID NO: 1148082 - DNA, 22 bp, Artificial Sequence
  chemically synthesized
aggcatggagtatttccattta

SEQ ID NO: 1148083 - DNA, 22 bp, Artificial Sequence
  chemically synthesized
aattgttattttaaatggaaat

SEQ ID NO: 1148084 - DNA, 22 bp, Artificial Sequence
  chemically synthesized
taaggcatggagtatttccatt

SEQ ID NO: 1148085 - DNA, 22 bp, Artificial Sequence
  chemically synthesized
ctaaggcatggagtatttccat

SEQ ID NO: 1148086 - DNA, 22 bp, Artificial Sequence
  chemically synthesized
tctaaggcatggagtatttcca

SEQ ID NO: 1148087 - DNA, 22 bp, Artificial Sequence
  chemically synthesized
ttctaaggcatggagtatttcc

SEQ ID NO: 1148088 - DNA, 22 bp, Artificial Sequence
  chemically synthesized
ttattttaaatggaaatactcc

SEQ ID NO: 1148089 - DNA, 22 bp, Artificial Sequence
  chemically synthesized
ttttaaatggaaatactccatg

SEQ ID NO: 1148090 - DNA, 22 bp, Artificial Sequence
  chemically synthesized
taaatggaaatactccatgcct

SEQ ID NO: 1148091 - DNA, 22 bp, Artificial Sequence
  chemically synthesized
aaatggaaatactccatgcctt

SEQ ID NO: 1148092 - DNA, 22 bp, Artificial Sequence
  chemically synthesized
aatggaaatactccatgcctta

SEQ ID NO: 1148093 - DNA, 22 bp, Artificial Sequence
  chemically synthesized
aatgcagacatttttctaaggc

SEQ ID NO: 1148094 - DNA, 22 bp, Artificial Sequence
  chemically synthesized
aaatgcagacatttttctaagg

SEQ ID NO: 1148095 - DNA, 22 bp, Artificial Sequence
  chemically synthesized
catgccttagaaaaatgtctgc

SEQ ID NO: 1148096 - DNA, 22 bp, Artificial Sequence
  chemically synthesized
aaaaaaatttaaatgcagacat

SEQ ID NO: 1148097 - DNA, 22 bp, Artificial Sequence
  chemically synthesized
gttaaaaaaaatttaaatgcag

SEQ ID NO: 1148098 - DNA, 22 bp, Artificial Sequence
  chemically synthesized
agaaaaatgtctgcatttaaat

SEQ ID NO: 1148099 - DNA, 22 bp, Artificial Sequence
  chemically synthesized
gaaaaatgtctgcatttaaatt

SEQ ID NO: 1148100 - DNA, 22 bp, Artificial Sequence
  chemically synthesized
ctggttaaaaaaaatttaaatg

SEQ ID NO: 1148101 - DNA, 22 bp, Artificial Sequence
  chemically synthesized
aagggaggttactggttaaaaa

SEQ ID NO: 1148102 - DNA, 22 bp, Artificial Sequence
  chemically synthesized
catttaaattttttttaaccag

SEQ ID NO: 1148103 - DNA, 22 bp, Artificial Sequence
  chemically synthesized
aaattttttttaaccagtaacc

SEQ ID NO: 1148104 - DNA, 22 bp, Artificial Sequence
  chemically synthesized
aattttttttaaccagtaacct

SEQ ID NO: 1148105 - DNA, 22 bp, Artificial Sequence
  chemically synthesized
tttttaaccagtaacctccctt

SEQ ID NO: 1148106 - DNA, 22 bp, Artificial Sequence
  chemically synthesized
ttttaaccagtaacctcccttc

SEQ ID NO: 1148107 - DNA, 22 bp, Artificial Sequence
  chemically synthesized
tttaaccagtaacctcccttca

SEQ ID NO: 1148108 - DNA, 22 bp, Artificial Sequence
  chemically synthesized
ggaagcaggggttgaagggagg

SEQ ID NO: 1148109 - DNA, 22 bp, Artificial Sequence
  chemically synthesized
ttaaccagtaacctcccttcaa

SEQ ID NO: 1148110 - DNA, 22 bp, Artificial Sequence
  chemically synthesized
taaccagtaacctcccttcaac

SEQ ID NO: 1148111 - DNA, 22 bp, Artificial Sequence
  chemically synthesized
aaccagtaacctcccttcaacc

SEQ ID NO: 1148112 - DNA, 22 bp, Artificial Sequence
  chemically synthesized
accagtaacctcccttcaaccc

SEQ ID NO: 1148113 - DNA, 22 bp, Artificial Sequence
  chemically synthesized
aataaggctgggaagcaggggt

SEQ ID NO: 1148114 - DNA, 22 bp, Artificial Sequence
  chemically synthesized
ccttcaacccctgcttcccagc

SEQ ID NO: 1148115 - DNA, 22 bp, Artificial Sequence
  chemically synthesized
atattaaataaggctgggaagc

SEQ ID NO: 1148116 - DNA, 22 bp, Artificial Sequence
  chemically synthesized
caacccctgcttcccagcctta

SEQ ID NO: 1148117 - DNA, 22 bp, Artificial Sequence
  chemically synthesized
aacccctgcttcccagccttat

SEQ ID NO: 1148118 - DNA, 22 bp, Artificial Sequence
  chemically synthesized
aattaatattaaataaggctgg

SEQ ID NO: 1148119 - DNA, 22 bp, Artificial Sequence
  chemically synthesized
caattaatattaaataaggctg

SEQ ID NO: 1148120 - DNA, 22 bp, Artificial Sequence
  chemically synthesized
cttcccagccttatttaatatt

SEQ ID NO: 1148121 - DNA, 22 bp, Artificial Sequence
  chemically synthesized
cccagccttatttaatattaat

SEQ ID NO: 1148122 - DNA, 22 bp, Artificial Sequence
  chemically synthesized
ccagccttatttaatattaatt

SEQ ID NO: 1148123 - DNA, 22 bp, Artificial Sequence
  chemically synthesized
ccagaaaatttcaattaatatt

SEQ ID NO: 1148124 - DNA, 22 bp, Artificial Sequence
  chemically synthesized
accagaaaatttcaattaatat

SEQ ID NO: 1148125 - DNA, 22 bp, Artificial Sequence
  chemically synthesized
taccagaaaatttcaattaata

SEQ ID NO: 1148126 - DNA, 22 bp, Artificial Sequence
  chemically synthesized
atttaatattaattgaaatttt

SEQ ID NO: 1148127 - DNA, 22 bp, Artificial Sequence
  chemically synthesized
atactttaccagaaaatttcaa

SEQ ID NO: 1148128 - DNA, 22 bp, Artificial Sequence
  chemically synthesized
tttaatattaattgaaattttc

SEQ ID NO: 1148129 - DNA, 22 bp, Artificial Sequence
  chemically synthesized
aatattaattgaaattttctgg

SEQ ID NO: 1148130 - DNA, 22 bp, Artificial Sequence
  chemically synthesized
atattaattgaaattttctggt

SEQ ID NO: 1148131 - DNA, 22 bp, Artificial Sequence
  chemically synthesized
attgaaattttctggtaaagta

SEQ ID NO: 1148132 - DNA, 22 bp, Artificial Sequence
  chemically synthesized
aaattttctggtaaagtattag

SEQ ID NO: 1148133 - DNA, 22 bp, Artificial Sequence
  chemically synthesized
cggatgggtaaaatctaatact

SEQ ID NO: 1148134 - DNA, 22 bp, Artificial Sequence
  chemically synthesized
tctggtaaagtattagatttta

SEQ ID NO: 1148135 - DNA, 22 bp, Artificial Sequence
  chemically synthesized
actgcggatgggtaaaatctaa

SEQ ID NO: 1148136 - DNA, 22 bp, Artificial Sequence
  chemically synthesized
ctggtaaagtattagattttac

SEQ ID NO: 1148137 - DNA, 22 bp, Artificial Sequence
  chemically synthesized
tggtaaagtattagattttacc

SEQ ID NO: 1148138 - DNA, 22 bp, Artificial Sequence
  chemically synthesized
gtaaagtattagattttaccca

SEQ ID NO: 1148139 - DNA, 22 bp, Artificial Sequence
  chemically synthesized
gattttacccatccgcagttag

SEQ ID NO: 1148140 - DNA, 22 bp, Artificial Sequence
  chemically synthesized
atacaatagtaactaactgcgg

SEQ ID NO: 1148141 - DNA, 22 bp, Artificial Sequence
  chemically synthesized
tgatacaatagtaactaactgc

SEQ ID NO: 1148142 - DNA, 22 bp, Artificial Sequence
  chemically synthesized
tacccatccgcagttagttact

SEQ ID NO: 1148143 - DNA, 22 bp, Artificial Sequence
  chemically synthesized
acccatccgcagttagttacta

SEQ ID NO: 1148144 - DNA, 22 bp, Artificial Sequence
  chemically synthesized
cccatccgcagttagttactat

SEQ ID NO: 1148145 - DNA, 22 bp, Artificial Sequence
  chemically synthesized
cataattctgatacaatagtaa

SEQ ID NO: 1148146 - DNA, 22 bp, Artificial Sequence
  chemically synthesized
aagaattccataattctgatac

SEQ ID NO: 1148147 - DNA, 22 bp, Artificial Sequence
  chemically synthesized
aaagaattccataattctgata

SEQ ID NO: 1148148 - DNA, 22 bp, Artificial Sequence
  chemically synthesized
gttactattgtatcagaattat

SEQ ID NO: 1148149 - DNA, 22 bp, Artificial Sequence
  chemically synthesized
ctattgtatcagaattatggaa

SEQ ID NO: 1148150 - DNA, 22 bp, Artificial Sequence
  chemically synthesized
tgatttaaagaattccataatt

SEQ ID NO: 1148151 - DNA, 22 bp, Artificial Sequence
  chemically synthesized
ttgtatcagaattatggaattc

SEQ ID NO: 1148152 - DNA, 22 bp, Artificial Sequence
  chemically synthesized
tatcagaattatggaattcttt

SEQ ID NO: 1148153 - DNA, 22 bp, Artificial Sequence
  chemically synthesized
aagtgctgtgatttaaagaatt

SEQ ID NO: 1148154 - DNA, 22 bp, Artificial Sequence
  chemically synthesized
tggaattctttaaatcacagca

SEQ ID NO: 1148155 - DNA, 22 bp, Artificial Sequence
  chemically synthesized
ataatcagctgaagtgctgtga

SEQ ID NO: 1148156 - DNA, 22 bp, Artificial Sequence
  chemically synthesized
tttaaatcacagcacttcagct

SEQ ID NO: 1148157 - DNA, 22 bp, Artificial Sequence
  chemically synthesized
taaatcacagcacttcagctga

SEQ ID NO: 1148158 - DNA, 22 bp, Artificial Sequence
  chemically synthesized
aaatcacagcacttcagctgat

SEQ ID NO: 1148159 - DNA, 22 bp, Artificial Sequence
  chemically synthesized
aatcacagcacttcagctgatt

SEQ ID NO: 1148160 - DNA, 22 bp, Artificial Sequence
  chemically synthesized
cagctgattatgagtgtgtgta

SEQ ID NO: 1148161 - DNA, 22 bp, Artificial Sequence
  chemically synthesized
agctgattatgagtgtgtgtat

SEQ ID NO: 1148162 - DNA, 22 bp, Artificial Sequence
  chemically synthesized
attatgagtgtgtgtatattgt

SEQ ID NO: 1148163 - DNA, 22 bp, Artificial Sequence
  chemically synthesized
gaatacaatatgtgtacaatat

SEQ ID NO: 1148164 - DNA, 22 bp, Artificial Sequence
  chemically synthesized
tgagtgtgtgtatattgtacac

SEQ ID NO: 1148165 - DNA, 22 bp, Artificial Sequence
  chemically synthesized
agaatacaatatgtgtacaata

SEQ ID NO: 1148166 - DNA, 22 bp, Artificial Sequence
  chemically synthesized
aaatacttagaatacaatatgt

SEQ ID NO: 1148167 - DNA, 22 bp, Artificial Sequence
  chemically synthesized
tatattaaaatacttagaatac

SEQ ID NO: 1148168 - DNA, 22 bp, Artificial Sequence
  chemically synthesized
atatattaaaatacttagaata

SEQ ID NO: 1148169 - DNA, 22 bp, Artificial Sequence
  chemically synthesized
tacacatattgtattctaagta

SEQ ID NO: 1148170 - DNA, 22 bp, Artificial Sequence
  chemically synthesized
gaatgcaatttatatattaaaa

SEQ ID NO: 1148171 - DNA, 22 bp, Artificial Sequence
  chemically synthesized
tattctaagtattttaatatat

SEQ ID NO: 1148172 - DNA, 22 bp, Artificial Sequence
  chemically synthesized
agaatgcaatttatatattaaa

SEQ ID NO: 1148173 - DNA, 22 bp, Artificial Sequence
  chemically synthesized
taagtattttaatatataaatt

SEQ ID NO: 1148174 - DNA, 22 bp, Artificial Sequence
  chemically synthesized
agtattttaatatataaattgc

SEQ ID NO: 1148175 - DNA, 22 bp, Artificial Sequence
  chemically synthesized
aaaatttagaatgcaatttata

SEQ ID NO: 1148176 - DNA, 22 bp, Artificial Sequence
  chemically synthesized
aaaaatttagaatgcaatttat

SEQ ID NO: 1148177 - DNA, 22 bp, Artificial Sequence
  chemically synthesized
taaaaatttagaatgcaattta

SEQ ID NO: 1148178 - DNA, 22 bp, Artificial Sequence
  chemically synthesized
taatatataaattgcattctaa

SEQ ID NO: 1148179 - DNA, 22 bp, Artificial Sequence
  chemically synthesized
aatatataaattgcattctaaa

SEQ ID NO: 1148180 - DNA, 22 bp, Artificial Sequence
  chemically synthesized
atatataaattgcattctaaat

SEQ ID NO: 1148181 - DNA, 22 bp, Artificial Sequence
  chemically synthesized
aaaagtattttaaaaatttaga

SEQ ID NO: 1148182 - DNA, 22 bp, Artificial Sequence
  chemically synthesized
gaaaagtattttaaaaatttag

SEQ ID NO: 1148183 - DNA, 22 bp, Artificial Sequence
  chemically synthesized
taacttgaaaagtattttaaaa

SEQ ID NO: 1148184 - DNA, 22 bp, Artificial Sequence
  chemically synthesized
cattctaaatttttaaaatact

SEQ ID NO: 1148185 - DNA, 22 bp, Artificial Sequence
  chemically synthesized
taaatttttaaaatacttttca

SEQ ID NO: 1148186 - DNA, 22 bp, Artificial Sequence
  chemically synthesized
aatttttaaaatacttttcaag

SEQ ID NO: 1148187 - DNA, 22 bp, Artificial Sequence
  chemically synthesized
aaagaactataacttgaaaagt

SEQ ID NO: 1148188 - DNA, 22 bp, Artificial Sequence
  chemically synthesized
aaaagaactataacttgaaaag

SEQ ID NO: 1148189 - DNA, 22 bp, Artificial Sequence
  chemically synthesized
taaaagaactataacttgaaaa

SEQ ID NO: 1148190 - DNA, 22 bp, Artificial Sequence
  chemically synthesized
ttaaaatacttttcaagttata

SEQ ID NO: 1148191 - DNA, 22 bp, Artificial Sequence
  chemically synthesized
taaaatacttttcaagttatag

SEQ ID NO: 1148192 - DNA, 22 bp, Artificial Sequence
  chemically synthesized
aaaatacttttcaagttatagt

SEQ ID NO: 1148193 - DNA, 22 bp, Artificial Sequence
  chemically synthesized
aaatacttttcaagttatagtt

SEQ ID NO: 1148194 - DNA, 22 bp, Artificial Sequence
  chemically synthesized
aatatgtcctttaaaagaacta

SEQ ID NO: 1148195 - DNA, 22 bp, Artificial Sequence
  chemically synthesized
ttcaagttatagttcttttaaa

SEQ ID NO: 1148196 - DNA, 22 bp, Artificial Sequence
  chemically synthesized
tcaagttatagttcttttaaag

SEQ ID NO: 1148197 - DNA, 22 bp, Artificial Sequence
  chemically synthesized
caagttatagttcttttaaagg

SEQ ID NO: 1148198 - DNA, 22 bp, Artificial Sequence
  chemically synthesized
aagttatagttcttttaaagga

SEQ ID NO: 1148199 - DNA, 22 bp, Artificial Sequence
  chemically synthesized
gtaaactaaatatgtcctttaa

SEQ ID NO: 1148200 - DNA, 22 bp, Artificial Sequence
  chemically synthesized
agtaaactaaatatgtccttta

SEQ ID NO: 1148201 - DNA, 22 bp, Artificial Sequence
  chemically synthesized
tagttcttttaaaggacatatt

SEQ ID NO: 1148202 - DNA, 22 bp, Artificial Sequence
  chemically synthesized
cttagtaaactaaatatgtcct

SEQ ID NO: 1148203 - DNA, 22 bp, Artificial Sequence
  chemically synthesized
gcttagtaaactaaatatgtcc

SEQ ID NO: 1148204 - DNA, 22 bp, Artificial Sequence
  chemically synthesized
tgcttagtaaactaaatatgtc

SEQ ID NO: 1148205 - DNA, 22 bp, Artificial Sequence
  chemically synthesized
ttttgcttagtaaactaaatat

SEQ ID NO: 1148206 - DNA, 22 bp, Artificial Sequence
  chemically synthesized
ttttaaaggacatatttagttt

SEQ ID NO: 1148207 - DNA, 22 bp, Artificial Sequence
  chemically synthesized
ttaaaggacatatttagtttac

SEQ ID NO: 1148208 - DNA, 22 bp, Artificial Sequence
  chemically synthesized
taaaggacatatttagtttact

SEQ ID NO: 1148209 - DNA, 22 bp, Artificial Sequence
  chemically synthesized
aaaggacatatttagtttacta

SEQ ID NO: 1148210 - DNA, 22 bp, Artificial Sequence
  chemically synthesized
aaggacatatttagtttactaa

SEQ ID NO: 1148211 - DNA, 22 bp, Artificial Sequence
  chemically synthesized
aggtcagattattttgcttagt

SEQ ID NO: 1148212 - DNA, 22 bp, Artificial Sequence
  chemically synthesized
aaggtcagattattttgcttag

SEQ ID NO: 1148213 - DNA, 22 bp, Artificial Sequence
  chemically synthesized
agtttactaagcaaaataatct

SEQ ID NO: 1148214 - DNA, 22 bp, Artificial Sequence
  chemically synthesized
gtttactaagcaaaataatctg

SEQ ID NO: 1148215 - DNA, 22 bp, Artificial Sequence
  chemically synthesized
actaagcaaaataatctgacct

SEQ ID NO: 1148216 - DNA, 22 bp, Artificial Sequence
  chemically synthesized
ctaagcaaaataatctgacctt

SEQ ID NO: 1148217 - DNA, 22 bp, Artificial Sequence
  chemically synthesized
gaagaacaacttaaggtcagat

SEQ ID NO: 1148218 - DNA, 22 bp, Artificial Sequence
  chemically synthesized
ggaagaacaacttaaggtcaga

SEQ ID NO: 1148219 - DNA, 22 bp, Artificial Sequence
  chemically synthesized
tggaagaacaacttaaggtcag

SEQ ID NO: 1148220 - DNA, 22 bp, Artificial Sequence
  chemically synthesized
agcaaaataatctgaccttaag

SEQ ID NO: 1148221 - DNA, 22 bp, Artificial Sequence
  chemically synthesized
ctttggaagaacaacttaaggt

SEQ ID NO: 1148222 - DNA, 22 bp, Artificial Sequence
  chemically synthesized
ctgctttggaagaacaacttaa

SEQ ID NO: 1148223 - DNA, 22 bp, Artificial Sequence
  chemically synthesized
accttaagttgttcttccaaag

SEQ ID NO: 1148224 - DNA, 22 bp, Artificial Sequence
  chemically synthesized
aagttgttcttccaaagcagca

SEQ ID NO: 1148225 - DNA, 22 bp, Artificial Sequence
  chemically synthesized
agttgttcttccaaagcagcag

SEQ ID NO: 1148226 - DNA, 22 bp, Artificial Sequence
  chemically synthesized
gtggagatcacgcaactgctgc

SEQ ID NO: 1148227 - DNA, 22 bp, Artificial Sequence
  chemically synthesized
ttcttccaaagcagcagttgcg

SEQ ID NO: 1148228 - DNA, 22 bp, Artificial Sequence
  chemically synthesized
ttccaaagcagcagttgcgtga

SEQ ID NO: 1148229 - DNA, 22 bp, Artificial Sequence
  chemically synthesized
ccaaagcagcagttgcgtgatc

SEQ ID NO: 1148230 - DNA, 22 bp, Artificial Sequence
  chemically synthesized
caaagcagcagttgcgtgatct

SEQ ID NO: 1148231 - DNA, 22 bp, Artificial Sequence
  chemically synthesized
atgaatctagtggagatcacgc

SEQ ID NO: 1148232 - DNA, 22 bp, Artificial Sequence
  chemically synthesized
cgtgatctccactagattcatc

SEQ ID NO: 1148233 - DNA, 22 bp, Artificial Sequence
  chemically synthesized
acatggtggtggtagttgatga

SEQ ID NO: 1148234 - DNA, 22 bp, Artificial Sequence
  chemically synthesized
cactagattcatcaactaccac

SEQ ID NO: 1148235 - DNA, 22 bp, Artificial Sequence
  chemically synthesized
actcacatggtggtggtagttg

SEQ ID NO: 1148236 - DNA, 22 bp, Artificial Sequence
  chemically synthesized
tcactcacatggtggtggtagt

SEQ ID NO: 1148237 - DNA, 22 bp, Artificial Sequence
  chemically synthesized
tctcactcacatggtggtggta

SEQ ID NO: 1148238 - DNA, 22 bp, Artificial Sequence
  chemically synthesized
gattcatcaactaccaccacca

SEQ ID NO: 1148239 - DNA, 22 bp, Artificial Sequence
  chemically synthesized
atcaactaccaccaccatgtga

SEQ ID NO: 1148240 - DNA, 22 bp, Artificial Sequence
  chemically synthesized
ccaccaccatgtgagtgagaga

SEQ ID NO: 1148241 - DNA, 22 bp, Artificial Sequence
  chemically synthesized
gaacaagaacaagtcagggtca

SEQ ID NO: 1148242 - DNA, 22 bp, Artificial Sequence
  chemically synthesized
aagaagatctagaacaagaaca

SEQ ID NO: 1148243 - DNA, 22 bp, Artificial Sequence
  chemically synthesized
caagaagatctagaacaagaac

SEQ ID NO: 1148244 - DNA, 22 bp, Artificial Sequence
  chemically synthesized
accctgacttgttcttgttcta

SEQ ID NO: 1148245 - DNA, 22 bp, Artificial Sequence
  chemically synthesized
acttgttcttgttctagatctt

SEQ ID NO: 1148246 - DNA, 22 bp, Artificial Sequence
  chemically synthesized
aggtgcttcaagaagatctaga

SEQ ID NO: 1148247 - DNA, 22 bp, Artificial Sequence
  chemically synthesized
caggtgcttcaagaagatctag

SEQ ID NO: 1148248 - DNA, 22 bp, Artificial Sequence
  chemically synthesized
tcaggtgcttcaagaagatcta

SEQ ID NO: 1148249 - DNA, 22 bp, Artificial Sequence
  chemically synthesized
gttcttgttctagatcttcttg

SEQ ID NO: 1148250 - DNA, 22 bp, Artificial Sequence
  chemically synthesized
ttcttgttctagatcttcttga

SEQ ID NO: 1148251 - DNA, 22 bp, Artificial Sequence
  chemically synthesized
tctttcaggtgcttcaagaaga

SEQ ID NO: 1148252 - DNA, 22 bp, Artificial Sequence
  chemically synthesized
atctttcaggtgcttcaagaag

SEQ ID NO: 1148253 - DNA, 22 bp, Artificial Sequence
  chemically synthesized
ttgttctagatcttcttgaagc

SEQ ID NO: 1148254 - DNA, 22 bp, Artificial Sequence
  chemically synthesized
tatctttcaggtgcttcaagaa

SEQ ID NO: 1148255 - DNA, 22 bp, Artificial Sequence
  chemically synthesized
gttctagatcttcttgaagcac

SEQ ID NO: 1148256 - DNA, 22 bp, Artificial Sequence
  chemically synthesized
ttctagatcttcttgaagcacc

SEQ ID NO: 1148257 - DNA, 22 bp, Artificial Sequence
  chemically synthesized
tagatcttcttgaagcacctga

SEQ ID NO: 1148258 - DNA, 22 bp, Artificial Sequence
  chemically synthesized
gatcttcttgaagcacctgaaa

SEQ ID NO: 1148259 - DNA, 22 bp, Artificial Sequence
  chemically synthesized
aaacattttatctttcaggtgc

SEQ ID NO: 1148260 - DNA, 22 bp, Artificial Sequence
  chemically synthesized
aaaacattttatctttcaggtg

SEQ ID NO: 1148261 - DNA, 22 bp, Artificial Sequence
  chemically synthesized
taaaacattttatctttcaggt

SEQ ID NO: 1148262 - DNA, 22 bp, Artificial Sequence
  chemically synthesized
ctttaaaacattttatctttca

SEQ ID NO: 1148263 - DNA, 22 bp, Artificial Sequence
  chemically synthesized
cttgaagcacctgaaagataaa

SEQ ID NO: 1148264 - DNA, 22 bp, Artificial Sequence
  chemically synthesized
cctttaaaacattttatctttc

SEQ ID NO: 1148265 - DNA, 22 bp, Artificial Sequence
  chemically synthesized
ttgaagcacctgaaagataaaa

SEQ ID NO: 1148266 - DNA, 22 bp, Artificial Sequence
  chemically synthesized
gaagcacctgaaagataaaatg

SEQ ID NO: 1148267 - DNA, 22 bp, Artificial Sequence
  chemically synthesized
aagcacctgaaagataaaatgt

SEQ ID NO: 1148268 - DNA, 22 bp, Artificial Sequence
  chemically synthesized
atttcctttaaaacattttatc

SEQ ID NO: 1148269 - DNA, 22 bp, Artificial Sequence
  chemically synthesized
aatttcctttaaaacattttat

SEQ ID NO: 1148270 - DNA, 22 bp, Artificial Sequence
  chemically synthesized
taatttcctttaaaacatttta

SEQ ID NO: 1148271 - DNA, 22 bp, Artificial Sequence
  chemically synthesized
aaagataaaatgttttaaagga

SEQ ID NO: 1148272 - DNA, 22 bp, Artificial Sequence
  chemically synthesized
taaaggaaattaaaatgatatt

SEQ ID NO: 1148273 - DNA, 22 bp, Artificial Sequence
  chemically synthesized
aaaggaaattaaaatgatattc

SEQ ID NO: 1148274 - DNA, 22 bp, Artificial Sequence
  chemically synthesized
aaggaaattaaaatgatattct

SEQ ID NO: 1148275 - DNA, 22 bp, Artificial Sequence
  chemically synthesized
aacacacatgtaagaatatcat

SEQ ID NO: 1148276 - DNA, 22 bp, Artificial Sequence
  chemically synthesized
caacacacatgtaagaatatca

SEQ ID NO: 1148277 - DNA, 22 bp, Artificial Sequence
  chemically synthesized
aaatgatattcttacatgtgtg

SEQ ID NO: 1148278 - DNA, 22 bp, Artificial Sequence
  chemically synthesized
agagcaaatcatttcaacacac

SEQ ID NO: 1148279 - DNA, 22 bp, Artificial Sequence
  chemically synthesized
gagagcaaatcatttcaacaca

SEQ ID NO: 1148280 - DNA, 22 bp, Artificial Sequence
  chemically synthesized
ttacatgtgtgttgaaatgatt

SEQ ID NO: 1148281 - DNA, 22 bp, Artificial Sequence
  chemically synthesized
acatgtgtgttgaaatgatttg

SEQ ID NO: 1148282 - DNA, 22 bp, Artificial Sequence
  chemically synthesized
accatttgagagcaaatcattt

SEQ ID NO: 1148283 - DNA, 22 bp, Artificial Sequence
  chemically synthesized
catgtgtgttgaaatgatttgc

SEQ ID NO: 1148284 - DNA, 22 bp, Artificial Sequence
  chemically synthesized
caccatttgagagcaaatcatt

SEQ ID NO: 1148285 - DNA, 22 bp, Artificial Sequence
  chemically synthesized
aaatgatttgctctcaaatggt

SEQ ID NO: 1148286 - DNA, 22 bp, Artificial Sequence
  chemically synthesized
gctctcaaatggtgaaatttat

SEQ ID NO: 1148287 - DNA, 22 bp, Artificial Sequence
  chemically synthesized
ctctcaaatggtgaaatttatt

SEQ ID NO: 1148288 - DNA, 22 bp, Artificial Sequence
  chemically synthesized
agatgtagcagaaataaatttc

SEQ ID NO: 1148289 - DNA, 22 bp, Artificial Sequence
  chemically synthesized
tcaaatggtgaaatttatttct

SEQ ID NO: 1148290 - DNA, 22 bp, Artificial Sequence
  chemically synthesized
aaatggtgaaatttatttctgc

SEQ ID NO: 1148291 - DNA, 22 bp, Artificial Sequence
  chemically synthesized
atttctgctacatctcaggtac

SEQ ID NO: 1148292 - DNA, 22 bp, Artificial Sequence
  chemically synthesized
tttctgctacatctcaggtact

SEQ ID NO: 1148293 - DNA, 22 bp, Artificial Sequence
  chemically synthesized
ataaaaaatgggagtacctgag

SEQ ID NO: 1148294 - DNA, 22 bp, Artificial Sequence
  chemically synthesized
ctgctacatctcaggtactccc

SEQ ID NO: 1148295 - DNA, 22 bp, Artificial Sequence
  chemically synthesized
tgctacatctcaggtactccca

SEQ ID NO: 1148296 - DNA, 22 bp, Artificial Sequence
  chemically synthesized
ggttaataaaaaatgggagtac

SEQ ID NO: 1148297 - DNA, 22 bp, Artificial Sequence
  chemically synthesized
ctacatctcaggtactcccatt

SEQ ID NO: 1148298 - DNA, 22 bp, Artificial Sequence
  chemically synthesized
aggttaataaaaaatgggagta

SEQ ID NO: 1148299 - DNA, 22 bp, Artificial Sequence
  chemically synthesized
taggttaataaaaaatgggagt

SEQ ID NO: 1148300 - DNA, 22 bp, Artificial Sequence
  chemically synthesized
catctcaggtactcccattttt

SEQ ID NO: 1148301 - DNA, 22 bp, Artificial Sequence
  chemically synthesized
aggtactcccattttttattaa

SEQ ID NO: 1148302 - DNA, 22 bp, Artificial Sequence
  chemically synthesized
gaatggttttaggttaataaaa

SEQ ID NO: 1148303 - DNA, 22 bp, Artificial Sequence
  chemically synthesized
ggaatggttttaggttaataaa

SEQ ID NO: 1148304 - DNA, 22 bp, Artificial Sequence
  chemically synthesized
gcttggaatggttttaggttaa

SEQ ID NO: 1148305 - DNA, 22 bp, Artificial Sequence
  chemically synthesized
ccattttttattaacctaaaac

SEQ ID NO: 1148306 - DNA, 22 bp, Artificial Sequence
  chemically synthesized
tttattaacctaaaaccattcc

SEQ ID NO: 1148307 - DNA, 22 bp, Artificial Sequence
  chemically synthesized
ttattaacctaaaaccattcca

SEQ ID NO: 1148308 - DNA, 22 bp, Artificial Sequence
  chemically synthesized
tattaacctaaaaccattccaa

SEQ ID NO: 1148309 - DNA, 22 bp, Artificial Sequence
  chemically synthesized
attaacctaaaaccattccaag

SEQ ID NO: 1148310 - DNA, 22 bp, Artificial Sequence
  chemically synthesized
ttaacctaaaaccattccaagc

SEQ ID NO: 1148311 - DNA, 22 bp, Artificial Sequence
  chemically synthesized
acctaaaaccattccaagccaa

SEQ ID NO: 1148312 - DNA, 22 bp, Artificial Sequence
  chemically synthesized
aaaccattccaagccaattttc

SEQ ID NO: 1148313 - DNA, 22 bp, Artificial Sequence
  chemically synthesized
agcgtcatagcagaaaattggc

SEQ ID NO: 1148314 - DNA, 22 bp, Artificial Sequence
  chemically synthesized
ctgagcgtcatagcagaaaatt

SEQ ID NO: 1148315 - DNA, 22 bp, Artificial Sequence
  chemically synthesized
gctgagcgtcatagcagaaaat

SEQ ID NO: 1148316 - DNA, 22 bp, Artificial Sequence
  chemically synthesized
tgctgagcgtcatagcagaaaa

SEQ ID NO: 1148317 - DNA, 22 bp, Artificial Sequence
  chemically synthesized
caagccaattttctgctatgac

SEQ ID NO: 1148318 - DNA, 22 bp, Artificial Sequence
  chemically synthesized
tctgctatgacgctcagcaaaa

SEQ ID NO: 1148319 - DNA, 22 bp, Artificial Sequence
  chemically synthesized
ctgctatgacgctcagcaaaat

SEQ ID NO: 1148320 - DNA, 22 bp, Artificial Sequence
  chemically synthesized
tgctatgacgctcagcaaaatt

SEQ ID NO: 1148321 - DNA, 22 bp, Artificial Sequence
  chemically synthesized
ctatgacgctcagcaaaattta

SEQ ID NO: 1148322 - DNA, 22 bp, Artificial Sequence
  chemically synthesized
acaatagaacatataaattttg

SEQ ID NO: 1148323 - DNA, 22 bp, Artificial Sequence
  chemically synthesized
tgacgctcagcaaaatttatat

SEQ ID NO: 1148324 - DNA, 22 bp, Artificial Sequence
  chemically synthesized
aattaacaatagaacatataaa

SEQ ID NO: 1148325 - DNA, 22 bp, Artificial Sequence
  chemically synthesized
agcaaaatttatatgttctatt

SEQ ID NO: 1148326 - DNA, 22 bp, Artificial Sequence
  chemically synthesized
cagttaaattaacaatagaaca

SEQ ID NO: 1148327 - DNA, 22 bp, Artificial Sequence
  chemically synthesized
ccagttaaattaacaatagaac

SEQ ID NO: 1148328 - DNA, 22 bp, Artificial Sequence
  chemically synthesized
tccagttaaattaacaatagaa

SEQ ID NO: 1148329 - DNA, 22 bp, Artificial Sequence
  chemically synthesized
atatgttctattgttaatttaa

SEQ ID NO: 1148330 - DNA, 22 bp, Artificial Sequence
  chemically synthesized
gatactttccagttaaattaac

SEQ ID NO: 1148331 - DNA, 22 bp, Artificial Sequence
  chemically synthesized
tatgttctattgttaatttaac

SEQ ID NO: 1148332 - DNA, 22 bp, Artificial Sequence
  chemically synthesized
tagatactttccagttaaatta

SEQ ID NO: 1148333 - DNA, 22 bp, Artificial Sequence
  chemically synthesized
tctagatactttccagttaaat

SEQ ID NO: 1148334 - DNA, 22 bp, Artificial Sequence
  chemically synthesized
ctctagatactttccagttaaa

SEQ ID NO: 1148335 - DNA, 22 bp, Artificial Sequence
  chemically synthesized
tattgttaatttaactggaaag

SEQ ID NO: 1148336 - DNA, 22 bp, Artificial Sequence
  chemically synthesized
tcttctctagatactttccagt

SEQ ID NO: 1148337 - DNA, 22 bp, Artificial Sequence
  chemically synthesized
ttgttaatttaactggaaagta

SEQ ID NO: 1148338 - DNA, 22 bp, Artificial Sequence
  chemically synthesized
gtcttctctagatactttccag

SEQ ID NO: 1148339 - DNA, 22 bp, Artificial Sequence
  chemically synthesized
ttaatttaactggaaagtatct

SEQ ID NO: 1148340 - DNA, 22 bp, Artificial Sequence
  chemically synthesized
atttaactggaaagtatctaga

SEQ ID NO: 1148341 - DNA, 22 bp, Artificial Sequence
  chemically synthesized
acatttgtcttctctagatact

SEQ ID NO: 1148342 - DNA, 22 bp, Artificial Sequence
  chemically synthesized
aacatttgtcttctctagatac

SEQ ID NO: 1148343 - DNA, 22 bp, Artificial Sequence
  chemically synthesized
ttaacatttgtcttctctagat

SEQ ID NO: 1148344 - DNA, 22 bp, Artificial Sequence
  chemically synthesized
aactggaaagtatctagagaag

SEQ ID NO: 1148345 - DNA, 22 bp, Artificial Sequence
  chemically synthesized
cttaacatttgtcttctctaga

SEQ ID NO: 1148346 - DNA, 22 bp, Artificial Sequence
  chemically synthesized
actggaaagtatctagagaaga

SEQ ID NO: 1148347 - DNA, 22 bp, Artificial Sequence
  chemically synthesized
tcttaacatttgtcttctctag

SEQ ID NO: 1148348 - DNA, 22 bp, Artificial Sequence
  chemically synthesized
gaaagtatctagagaagacaaa

SEQ ID NO: 1148349 - DNA, 22 bp, Artificial Sequence
  chemically synthesized
tacctttcttaacatttgtctt

SEQ ID NO: 1148350 - DNA, 22 bp, Artificial Sequence
  chemically synthesized
ctgtacctttcttaacatttgt

SEQ ID NO: 1148351 - DNA, 22 bp, Artificial Sequence
  chemically synthesized
gagaagacaaatgttaagaaag

SEQ ID NO: 1148352 - DNA, 22 bp, Artificial Sequence
  chemically synthesized
agaaaggtacagcaggatgttc

SEQ ID NO: 1148353 - DNA, 22 bp, Artificial Sequence
  chemically synthesized
aaagggagaaagggggtgggat

SEQ ID NO: 1148354 - DNA, 22 bp, Artificial Sequence
  chemically synthesized
gaaagggagaaagggggtggga

SEQ ID NO: 1148355 - DNA, 22 bp, Artificial Sequence
  chemically synthesized
tccttctcatcccacccccttt

SEQ ID NO: 1148356 - DNA, 22 bp, Artificial Sequence
  chemically synthesized
cttctcatcccaccccctttct

SEQ ID NO: 1148357 - DNA, 22 bp, Artificial Sequence
  chemically synthesized
ctcatcccaccccctttctccc

SEQ ID NO: 1148358 - DNA, 22 bp, Artificial Sequence
  chemically synthesized
tcatcccaccccctttctccct

SEQ ID NO: 1148359 - DNA, 22 bp, Artificial Sequence
  chemically synthesized
atcccaccccctttctcccttt

SEQ ID NO: 1148360 - DNA, 22 bp, Artificial Sequence
  chemically synthesized
taggaaaaaagtccttgaaagg

SEQ ID NO: 1148361 - DNA, 22 bp, Artificial Sequence
  chemically synthesized
atagttgtaggaaaaaagtcct

SEQ ID NO: 1148362 - DNA, 22 bp, Artificial Sequence
  chemically synthesized
tctccctttcaaggactttttt

SEQ ID NO: 1148363 - DNA, 22 bp, Artificial Sequence
  chemically synthesized
ctccctttcaaggacttttttc

SEQ ID NO: 1148364 - DNA, 22 bp, Artificial Sequence
  chemically synthesized
tccctttcaaggacttttttcc

SEQ ID NO: 1148365 - DNA, 22 bp, Artificial Sequence
  chemically synthesized
cctttcaaggacttttttccta

SEQ ID NO: 1148366 - DNA, 22 bp, Artificial Sequence
  chemically synthesized
tcaaggacttttttcctacaac

SEQ ID NO: 1148367 - DNA, 22 bp, Artificial Sequence
  chemically synthesized
caaggacttttttcctacaact

SEQ ID NO: 1148368 - DNA, 22 bp, Artificial Sequence
  chemically synthesized
aaggacttttttcctacaacta

SEQ ID NO: 1148369 - DNA, 22 bp, Artificial Sequence
  chemically synthesized
aaaatgccagaagtgctgatag

SEQ ID NO: 1148370 - DNA, 22 bp, Artificial Sequence
  chemically synthesized
ttttcctacaactatcagcact

SEQ ID NO: 1148371 - DNA, 22 bp, Artificial Sequence
  chemically synthesized
tttcctacaactatcagcactt

SEQ ID NO: 1148372 - DNA, 22 bp, Artificial Sequence
  chemically synthesized
ttcctacaactatcagcacttc

SEQ ID NO: 1148373 - DNA, 22 bp, Artificial Sequence
  chemically synthesized
tcctacaactatcagcacttct

SEQ ID NO: 1148374 - DNA, 22 bp, Artificial Sequence
  chemically synthesized
cctacaactatcagcacttctg

SEQ ID NO: 1148375 - DNA, 22 bp, Artificial Sequence
  chemically synthesized
ctacaactatcagcacttctgg

SEQ ID NO: 1148376 - DNA, 22 bp, Artificial Sequence
  chemically synthesized
caactatcagcacttctggcat

SEQ ID NO: 1148377 - DNA, 22 bp, Artificial Sequence
  chemically synthesized
tcagcacttctggcattttcag

SEQ ID NO: 1148378 - DNA, 22 bp, Artificial Sequence
  chemically synthesized
agtagagaagaagagcctgaaa

SEQ ID NO: 1148379 - DNA, 22 bp, Artificial Sequence
  chemically synthesized
ctggcattttcaggctcttctt

SEQ ID NO: 1148380 - DNA, 22 bp, Artificial Sequence
  chemically synthesized
tggcattttcaggctcttcttc

SEQ ID NO: 1148381 - DNA, 22 bp, Artificial Sequence
  chemically synthesized
gcattttcaggctcttcttctc

SEQ ID NO: 1148382 - DNA, 22 bp, Artificial Sequence
  chemically synthesized
tcaggctcttcttctctactga

SEQ ID NO: 1148383 - DNA, 22 bp, Artificial Sequence
  chemically synthesized
caggctcttcttctctactgaa

SEQ ID NO: 1148384 - DNA, 22 bp, Artificial Sequence
  chemically synthesized
aggctcttcttctctactgaac

SEQ ID NO: 1148385 - DNA, 22 bp, Artificial Sequence
  chemically synthesized
tggtaatggagaagttcagtag

SEQ ID NO: 1148386 - DNA, 22 bp, Artificial Sequence
  chemically synthesized
atggtaatggagaagttcagta

SEQ ID NO: 1148387 - DNA, 22 bp, Artificial Sequence
  chemically synthesized
tatggtaatggagaagttcagt

SEQ ID NO: 1148388 - DNA, 22 bp, Artificial Sequence
  chemically synthesized
ttatggtaatggagaagttcag

SEQ ID NO: 1148389 - DNA, 22 bp, Artificial Sequence
  chemically synthesized
ttcttctctactgaacttctcc

SEQ ID NO: 1148390 - DNA, 22 bp, Artificial Sequence
  chemically synthesized
tttttatggtaatggagaagtt

SEQ ID NO: 1148391 - DNA, 22 bp, Artificial Sequence
  chemically synthesized
cttctctactgaacttctccat

SEQ ID NO: 1148392 - DNA, 22 bp, Artificial Sequence
  chemically synthesized
atttttatggtaatggagaagt

SEQ ID NO: 1148393 - DNA, 22 bp, Artificial Sequence
  chemically synthesized
ttctctactgaacttctccatt

SEQ ID NO: 1148394 - DNA, 22 bp, Artificial Sequence
  chemically synthesized
tatttttatggtaatggagaag

SEQ ID NO: 1148395 - DNA, 22 bp, Artificial Sequence
  chemically synthesized
ctctactgaacttctccattac

SEQ ID NO: 1148396 - DNA, 22 bp, Artificial Sequence
  chemically synthesized
tctactgaacttctccattacc

SEQ ID NO: 1148397 - DNA, 22 bp, Artificial Sequence
  chemically synthesized
ttttatttttatggtaatggag

SEQ ID NO: 1148398 - DNA, 22 bp, Artificial Sequence
  chemically synthesized
gttttatttttatggtaatgga

SEQ ID NO: 1148399 - DNA, 22 bp, Artificial Sequence
  chemically synthesized
tactgaacttctccattaccat

SEQ ID NO: 1148400 - DNA, 22 bp, Artificial Sequence
  chemically synthesized
ctgaacttctccattaccataa

SEQ ID NO: 1148401 - DNA, 22 bp, Artificial Sequence
  chemically synthesized
aacttctccattaccataaaaa

SEQ ID NO: 1148402 - DNA, 22 bp, Artificial Sequence
  chemically synthesized
ctccattaccataaaaataaaa

SEQ ID NO: 1148403 - DNA, 22 bp, Artificial Sequence
  chemically synthesized
tccattaccataaaaataaaac

SEQ ID NO: 1148404 - DNA, 22 bp, Artificial Sequence
  chemically synthesized
gatcaagagtttgttttatttt

SEQ ID NO: 1148405 - DNA, 22 bp, Artificial Sequence
  chemically synthesized
cattaccataaaaataaaacaa

SEQ ID NO: 1148406 - DNA, 22 bp, Artificial Sequence
  chemically synthesized
ttggatcaagagtttgttttat

SEQ ID NO: 1148407 - DNA, 22 bp, Artificial Sequence
  chemically synthesized
gttggatcaagagtttgtttta

SEQ ID NO: 1148408 - DNA, 22 bp, Artificial Sequence
  chemically synthesized
ccataaaaataaaacaaactct

SEQ ID NO: 1148409 - DNA, 22 bp, Artificial Sequence
  chemically synthesized
ttgatccaacaaaccggtcctc

SEQ ID NO: 1148410 - DNA, 22 bp, Artificial Sequence
  chemically synthesized
gatccaacaaaccggtcctcct

SEQ ID NO: 1148411 - DNA, 22 bp, Artificial Sequence
  chemically synthesized
atccaacaaaccggtcctccta

SEQ ID NO: 1148412 - DNA, 22 bp, Artificial Sequence
  chemically synthesized
agtgaagaggaacacataatag

SEQ ID NO: 1148413 - DNA, 22 bp, Artificial Sequence
  chemically synthesized
cagtgaagaggaacacataata

SEQ ID NO: 1148414 - DNA, 22 bp, Artificial Sequence
  chemically synthesized
tcagtgaagaggaacacataat

SEQ ID NO: 1148415 - DNA, 22 bp, Artificial Sequence
  chemically synthesized
ttcagtgaagaggaacacataa

SEQ ID NO: 1148416 - DNA, 22 bp, Artificial Sequence
  chemically synthesized
ctactgtcctattatgtgttcc

SEQ ID NO: 1148417 - DNA, 22 bp, Artificial Sequence
  chemically synthesized
tttcagtgaagaggaacacata

SEQ ID NO: 1148418 - DNA, 22 bp, Artificial Sequence
  chemically synthesized
ttttcagtgaagaggaacacat

SEQ ID NO: 1148419 - DNA, 22 bp, Artificial Sequence
  chemically synthesized
tttttcagtgaagaggaacaca

SEQ ID NO: 1148420 - DNA, 22 bp, Artificial Sequence
  chemically synthesized
ctgtcctattatgtgttcctct

SEQ ID NO: 1148421 - DNA, 22 bp, Artificial Sequence
  chemically synthesized
ttttttcagtgaagaggaacac

SEQ ID NO: 1148422 - DNA, 22 bp, Artificial Sequence
  chemically synthesized
tttttttcagtgaagaggaaca

SEQ ID NO: 1148423 - DNA, 22 bp, Artificial Sequence
  chemically synthesized
ttttttttcagtgaagaggaac

SEQ ID NO: 1148424 - DNA, 22 bp, Artificial Sequence
  chemically synthesized
tcctattatgtgttcctcttca

SEQ ID NO: 1148425 - DNA, 22 bp, Artificial Sequence
  chemically synthesized
tttttttttcagtgaagaggaa

SEQ ID NO: 1148426 - DNA, 22 bp, Artificial Sequence
  chemically synthesized
ttttttttttcagtgaagagga

SEQ ID NO: 1148427 - DNA, 22 bp, Artificial Sequence
  chemically synthesized
tttttttttttttcagtgaaga

SEQ ID NO: 1148428 - DNA, 22 bp, Artificial Sequence
  chemically synthesized
ttatgtgttcctcttcactgaa

SEQ ID NO: 1148429 - DNA, 22 bp, Artificial Sequence
  chemically synthesized
gtttttttttttttcagtgaag

SEQ ID NO: 1148430 - DNA, 22 bp, Artificial Sequence
  chemically synthesized
tgtgttcctcttcactgaaaaa

SEQ ID NO: 1148431 - DNA, 22 bp, Artificial Sequence
  chemically synthesized
ctcttcactgaaaaaaaaaaaa

SEQ ID NO: 1148432 - DNA, 22 bp, Artificial Sequence
  chemically synthesized
taggatacatttgttttttttt

SEQ ID NO: 1148433 - DNA, 22 bp, Artificial Sequence
  chemically synthesized
ttcactgaaaaaaaaaaaaaca

SEQ ID NO: 1148434 - DNA, 22 bp, Artificial Sequence
  chemically synthesized
cactgaaaaaaaaaaaaacaaa

SEQ ID NO: 1148435 - DNA, 22 bp, Artificial Sequence
  chemically synthesized
actgaaaaaaaaaaaaacaaat

SEQ ID NO: 1148436 - DNA, 22 bp, Artificial Sequence
  chemically synthesized
aaaaaaaaaaaaacaaatgtat

SEQ ID NO: 1148437 - DNA, 22 bp, Artificial Sequence
  chemically synthesized
tagttactgtgcctacatattt

SEQ ID NO: 1148438 - DNA, 22 bp, Artificial Sequence
  chemically synthesized
ctgtgcctacatatttatccta

SEQ ID NO: 1148439 - DNA, 22 bp, Artificial Sequence
  chemically synthesized
tgcctacatatttatcctacta

SEQ ID NO: 1148440 - DNA, 22 bp, Artificial Sequence
  chemically synthesized
gtgggcaaagtgaatagtagga

SEQ ID NO: 1148441 - DNA, 22 bp, Artificial Sequence
  chemically synthesized
catatttatcctactattcact

SEQ ID NO: 1148442 - DNA, 22 bp, Artificial Sequence
  chemically synthesized
aatgggttagtgggcaaagtga

SEQ ID NO: 1148443 - DNA, 22 bp, Artificial Sequence
  chemically synthesized
caatgggttagtgggcaaagtg

SEQ ID NO: 1148444 - DNA, 22 bp, Artificial Sequence
  chemically synthesized
atcctactattcactttgccca

SEQ ID NO: 1148445 - DNA, 22 bp, Artificial Sequence
  chemically synthesized
tcctactattcactttgcccac

SEQ ID NO: 1148446 - DNA, 22 bp, Artificial Sequence
  chemically synthesized
ctattcactttgcccactaacc

SEQ ID NO: 1148447 - DNA, 22 bp, Artificial Sequence
  chemically synthesized
ttcactttgcccactaacccat

SEQ ID NO: 1148448 - DNA, 22 bp, Artificial Sequence
  chemically synthesized
caaaagatatttcaatgggtta

SEQ ID NO: 1148449 - DNA, 22 bp, Artificial Sequence
  chemically synthesized
actttgcccactaacccattga

SEQ ID NO: 1148450 - DNA, 22 bp, Artificial Sequence
  chemically synthesized
acaaaagatatttcaatgggtt

SEQ ID NO: 1148451 - DNA, 22 bp, Artificial Sequence
  chemically synthesized
tacaaaagatatttcaatgggt

SEQ ID NO: 1148452 - DNA, 22 bp, Artificial Sequence
  chemically synthesized
tgcccactaacccattgaaata

SEQ ID NO: 1148453 - DNA, 22 bp, Artificial Sequence
  chemically synthesized
gcccactaacccattgaaatat

SEQ ID NO: 1148454 - DNA, 22 bp, Artificial Sequence
  chemically synthesized
cccactaacccattgaaatatc

SEQ ID NO: 1148455 - DNA, 22 bp, Artificial Sequence
  chemically synthesized
atggtgtcctttacaaaagata

SEQ ID NO: 1148456 - DNA, 22 bp, Artificial Sequence
  chemically synthesized
acccattgaaatatcttttgta

SEQ ID NO: 1148457 - DNA, 22 bp, Artificial Sequence
  chemically synthesized
aaatatcttttgtaaaggacac

SEQ ID NO: 1148458 - DNA, 22 bp, Artificial Sequence
  chemically synthesized
ggaacatgaaagttgatggtgt

SEQ ID NO: 1148459 - DNA, 22 bp, Artificial Sequence
  chemically synthesized
aggaacatgaaagttgatggtg

SEQ ID NO: 1148460 - DNA, 22 bp, Artificial Sequence
  chemically synthesized
ttgtaaaggacaccatcaactt

SEQ ID NO: 1148461 - DNA, 22 bp, Artificial Sequence
  chemically synthesized
tgtaaaggacaccatcaacttt

SEQ ID NO: 1148462 - DNA, 22 bp, Artificial Sequence
  chemically synthesized
gtaaaggacaccatcaactttc

SEQ ID NO: 1148463 - DNA, 22 bp, Artificial Sequence
  chemically synthesized
taaaggacaccatcaactttca

SEQ ID NO: 1148464 - DNA, 22 bp, Artificial Sequence
  chemically synthesized
aatttaggaacatgaaagttga

SEQ ID NO: 1148465 - DNA, 22 bp, Artificial Sequence
  chemically synthesized
ttgaatttaggaacatgaaagt

SEQ ID NO: 1148466 - DNA, 22 bp, Artificial Sequence
  chemically synthesized
taacaaatggttattgaattta

SEQ ID NO: 1148467 - DNA, 22 bp, Artificial Sequence
  chemically synthesized
tcatgttcctaaattcaataac

SEQ ID NO: 1148468 - DNA, 22 bp, Artificial Sequence
  chemically synthesized
catgttcctaaattcaataacc

SEQ ID NO: 1148469 - DNA, 22 bp, Artificial Sequence
  chemically synthesized
atgttcctaaattcaataacca

SEQ ID NO: 1148470 - DNA, 22 bp, Artificial Sequence
  chemically synthesized
ctaaattcaataaccatttgtt

SEQ ID NO: 1148471 - DNA, 22 bp, Artificial Sequence
  chemically synthesized
aattcaataaccatttgttata

SEQ ID NO: 1148472 - DNA, 22 bp, Artificial Sequence
  chemically synthesized
aataaccatttgttatagcgtc

SEQ ID NO: 1148473 - DNA, 22 bp, Artificial Sequence
  chemically synthesized
gtaatcaacatgtcaagtaaga

SEQ ID NO: 1148474 - DNA, 22 bp, Artificial Sequence
  chemically synthesized
gttatagcgtcttacttgacat

SEQ ID NO: 1148475 - DNA, 22 bp, Artificial Sequence
  chemically synthesized
ttatagcgtcttacttgacatg

SEQ ID NO: 1148476 - DNA, 22 bp, Artificial Sequence
  chemically synthesized
ggttagtaatcaacatgtcaag

SEQ ID NO: 1148477 - DNA, 22 bp, Artificial Sequence
  chemically synthesized
tagcgtcttacttgacatgttg

SEQ ID NO: 1148478 - DNA, 22 bp, Artificial Sequence
  chemically synthesized
acttgacatgttgattactaac

SEQ ID NO: 1148479 - DNA, 22 bp, Artificial Sequence
  chemically synthesized
cttgacatgttgattactaacc

SEQ ID NO: 1148480 - DNA, 22 bp, Artificial Sequence
  chemically synthesized
gacatgttgattactaacctaa

SEQ ID NO: 1148481 - DNA, 22 bp, Artificial Sequence
  chemically synthesized
acatgttgattactaacctaat

SEQ ID NO: 1148482 - DNA, 22 bp, Artificial Sequence
  chemically synthesized
attactaacctaattggccact

SEQ ID NO: 1148483 - DNA, 22 bp, Artificial Sequence
  chemically synthesized
ctaacctaattggccactccct

SEQ ID NO: 1148484 - DNA, 22 bp, Artificial Sequence
  chemically synthesized
acctaattggccactccctcat

SEQ ID NO: 1148485 - DNA, 22 bp, Artificial Sequence
  chemically synthesized
attggccactccctcattcttg

SEQ ID NO: 1148486 - DNA, 22 bp, Artificial Sequence
  chemically synthesized
gccactccctcattcttgacac

SEQ ID NO: 1148487 - DNA, 22 bp, Artificial Sequence
  chemically synthesized
cctcattcttgacaccttctct

SEQ ID NO: 1148488 - DNA, 22 bp, Artificial Sequence
  chemically synthesized
attcttgacaccttctcttgat

SEQ ID NO: 1148489 - DNA, 22 bp, Artificial Sequence
  chemically synthesized
ttgacaccttctcttgattacc

SEQ ID NO: 1148490 - DNA, 22 bp, Artificial Sequence
  chemically synthesized
gacaccttctcttgattaccct

SEQ ID NO: 1148491 - DNA, 22 bp, Artificial Sequence
  chemically synthesized
acaccttctcttgattaccctc

SEQ ID NO: 1148492 - DNA, 22 bp, Artificial Sequence
  chemically synthesized
ctcttgattaccctcctaccta

SEQ ID NO: 1148493 - DNA, 22 bp, Artificial Sequence
  chemically synthesized
tcttgattaccctcctacctat

SEQ ID NO: 1148494 - DNA, 22 bp, Artificial Sequence
  chemically synthesized
ttgattaccctcctacctatgt

SEQ ID NO: 1148495 - DNA, 22 bp, Artificial Sequence
  chemically synthesized
gattaccctcctacctatgtgc

SEQ ID NO: 1148496 - DNA, 22 bp, Artificial Sequence
  chemically synthesized
attaccctcctacctatgtgct

SEQ ID NO: 1148497 - DNA, 22 bp, Artificial Sequence
  chemically synthesized
ccctcctacctatgtgctactt

SEQ ID NO: 1148498 - DNA, 22 bp, Artificial Sequence
  chemically synthesized
ctacctatgtgctacttttttt

SEQ ID NO: 1148499 - DNA, 22 bp, Artificial Sequence
  chemically synthesized
cctatgtgctactttttttatt

SEQ ID NO: 1148500 - DNA, 22 bp, Artificial Sequence
  chemically synthesized
tgtgctactttttttatttttt

SEQ ID NO: 1148501 - DNA, 22 bp, Artificial Sequence
  chemically synthesized
caaaatagaaaaaaaaaataaa

SEQ ID NO: 1148502 - DNA, 22 bp, Artificial Sequence
  chemically synthesized
ctttttttattttttttttcta

SEQ ID NO: 1148503 - DNA, 22 bp, Artificial Sequence
  chemically synthesized
tttttattttttttttctattt

SEQ ID NO: 1148504 - DNA, 22 bp, Artificial Sequence
  chemically synthesized
ttttattttttttttctatttt

SEQ ID NO: 1148505 - DNA, 22 bp, Artificial Sequence
  chemically synthesized
tttattttttttttctattttg

SEQ ID NO: 1148506 - DNA, 22 bp, Artificial Sequence
  chemically synthesized
ttattttttttttctattttgg

SEQ ID NO: 1148507 - DNA, 22 bp, Artificial Sequence
  chemically synthesized
tattttttttttctattttgga

SEQ ID NO: 1148508 - DNA, 22 bp, Artificial Sequence
  chemically synthesized
attttttttttctattttggag

SEQ ID NO: 1148509 - DNA, 22 bp, Artificial Sequence
  chemically synthesized
ttttttttttctattttggaga

SEQ ID NO: 1148510 - DNA, 22 bp, Artificial Sequence
  chemically synthesized
tttttttctattttggagacgg

SEQ ID NO: 1148511 - DNA, 22 bp, Artificial Sequence
  chemically synthesized
ttttttctattttggagacgga

SEQ ID NO: 1148512 - DNA, 22 bp, Artificial Sequence
  chemically synthesized
tttttctattttggagacggat

SEQ ID NO: 1148513 - DNA, 22 bp, Artificial Sequence
  chemically synthesized
ttttctattttggagacggatt

SEQ ID NO: 1148514 - DNA, 22 bp, Artificial Sequence
  chemically synthesized
tttctattttggagacggattc

SEQ ID NO: 1148515 - DNA, 22 bp, Artificial Sequence
  chemically synthesized
ttctattttggagacggattct

SEQ ID NO: 1148516 - DNA, 22 bp, Artificial Sequence
  chemically synthesized
ggtgacacagtgagaatccgtc

SEQ ID NO: 1148517 - DNA, 22 bp, Artificial Sequence
  chemically synthesized
tctattttggagacggattctc

SEQ ID NO: 1148518 - DNA, 22 bp, Artificial Sequence
  chemically synthesized
ctattttggagacggattctca

SEQ ID NO: 1148519 - DNA, 22 bp, Artificial Sequence
  chemically synthesized
tattttggagacggattctcac

SEQ ID NO: 1148520 - DNA, 22 bp, Artificial Sequence
  chemically synthesized
ttttggagacggattctcactg

SEQ ID NO: 1148521 - DNA, 22 bp, Artificial Sequence
  chemically synthesized
caccctgggtgacacagtgaga

SEQ ID NO: 1148522 - DNA, 22 bp, Artificial Sequence
  chemically synthesized
tggagacggattctcactgtgt

SEQ ID NO: 1148523 - DNA, 22 bp, Artificial Sequence
  chemically synthesized
ggagacggattctcactgtgtc

SEQ ID NO: 1148524 - DNA, 22 bp, Artificial Sequence
  chemically synthesized
gagacggattctcactgtgtca

SEQ ID NO: 1148525 - DNA, 22 bp, Artificial Sequence
  chemically synthesized
gcattccaccctgggtgacaca

SEQ ID NO: 1148526 - DNA, 22 bp, Artificial Sequence
  chemically synthesized
tcactgtgtcacccagggtgga

SEQ ID NO: 1148527 - DNA, 22 bp, Artificial Sequence
  chemically synthesized
actgtgtcacccagggtggaat

SEQ ID NO: 1148528 - DNA, 22 bp, Artificial Sequence
  chemically synthesized
tgtcacccagggtggaatgcca

SEQ ID NO: 1148529 - DNA, 22 bp, Artificial Sequence
  chemically synthesized
cagtgagccgagatcatgccat

SEQ ID NO: 1148530 - DNA, 22 bp, Artificial Sequence
  chemically synthesized
gcagtgagccgagatcatgcca

SEQ ID NO: 1148531 - DNA, 22 bp, Artificial Sequence
  chemically synthesized
aacccggtaggtggagtttgca

SEQ ID NO: 1148532 - DNA, 22 bp, Artificial Sequence
  chemically synthesized
gaacccggtaggtggagtttgc

SEQ ID NO: 1148533 - DNA, 22 bp, Artificial Sequence
  chemically synthesized
ggctcactgcaaactccaccta

SEQ ID NO: 1148534 - DNA, 22 bp, Artificial Sequence
  chemically synthesized
actgcaaactccacctaccggg

SEQ ID NO: 1148535 - DNA, 22 bp, Artificial Sequence
  chemically synthesized
caaactccacctaccgggttca

SEQ ID NO: 1148536 - DNA, 22 bp, Artificial Sequence
  chemically synthesized
aggcaggagaatcccttgaacc

SEQ ID NO: 1148537 - DNA, 22 bp, Artificial Sequence
  chemically synthesized
cacctaccgggttcaagggatt

SEQ ID NO: 1148538 - DNA, 22 bp, Artificial Sequence
  chemically synthesized
ccgggttcaagggattctcctg

SEQ ID NO: 1148539 - DNA, 22 bp, Artificial Sequence
  chemically synthesized
gggaggctgaggcaggagaatc

SEQ ID NO: 1148540 - DNA, 22 bp, Artificial Sequence
  chemically synthesized
ctcgggaggctgaggcaggaga

SEQ ID NO: 1148541 - DNA, 22 bp, Artificial Sequence
  chemically synthesized
aagggattctcctgcctcagcc

SEQ ID NO: 1148542 - DNA, 22 bp, Artificial Sequence
  chemically synthesized
agctactcgggaggctgaggca

SEQ ID NO: 1148543 - DNA, 22 bp, Artificial Sequence
  chemically synthesized
taatctcagctactcgggaggc

SEQ ID NO: 1148544 - DNA, 22 bp, Artificial Sequence
  chemically synthesized
tcctgcctcagcctcccgagta

SEQ ID NO: 1148545 - DNA, 22 bp, Artificial Sequence
  chemically synthesized
ctgcctcagcctcccgagtagc

SEQ ID NO: 1148546 - DNA, 22 bp, Artificial Sequence
  chemically synthesized
cctcagcctcccgagtagctga

SEQ ID NO: 1148547 - DNA, 22 bp, Artificial Sequence
  chemically synthesized
agcctcccgagtagctgagatt

SEQ ID NO: 1148548 - DNA, 22 bp, Artificial Sequence
  chemically synthesized
ccgagtagctgagattacaggt

SEQ ID NO: 1148549 - DNA, 22 bp, Artificial Sequence
  chemically synthesized
ggcgtggtggtgtgcacctgta

SEQ ID NO: 1148550 - DNA, 22 bp, Artificial Sequence
  chemically synthesized
gctgggcgtggtggtgtgcacc

SEQ ID NO: 1148551 - DNA, 22 bp, Artificial Sequence
  chemically synthesized
agattacaggtgcacaccacca

SEQ ID NO: 1148552 - DNA, 22 bp, Artificial Sequence
  chemically synthesized
caggtgcacaccaccacgccca

SEQ ID NO: 1148553 - DNA, 22 bp, Artificial Sequence
  chemically synthesized
aaaatacaaaaaattagctggg

SEQ ID NO: 1148554 - DNA, 22 bp, Artificial Sequence
  chemically synthesized
aactgaaaatacaaaaaattag

SEQ ID NO: 1148555 - DNA, 22 bp, Artificial Sequence
  chemically synthesized
attttttgtattttcagttgag

SEQ ID NO: 1148556 - DNA, 22 bp, Artificial Sequence
  chemically synthesized
tttgtattttcagttgagacgg

SEQ ID NO: 1148557 - DNA, 22 bp, Artificial Sequence
  chemically synthesized
ttgtattttcagttgagacggg

SEQ ID NO: 1148558 - DNA, 22 bp, Artificial Sequence
  chemically synthesized
tgtattttcagttgagacggga

SEQ ID NO: 1148559 - DNA, 22 bp, Artificial Sequence
  chemically synthesized
gtattttcagttgagacgggat

SEQ ID NO: 1148560 - DNA, 22 bp, Artificial Sequence
  chemically synthesized
tattttcagttgagacgggatt

SEQ ID NO: 1148561 - DNA, 22 bp, Artificial Sequence
  chemically synthesized
gccaacgtggtgaaatcccgtc

SEQ ID NO: 1148562 - DNA, 22 bp, Artificial Sequence
  chemically synthesized
tcagttgagacgggatttcacc

SEQ ID NO: 1148563 - DNA, 22 bp, Artificial Sequence
  chemically synthesized
cagttgagacgggatttcacca

SEQ ID NO: 1148564 - DNA, 22 bp, Artificial Sequence
  chemically synthesized
agttgagacgggatttcaccac

SEQ ID NO: 1148565 - DNA, 22 bp, Artificial Sequence
  chemically synthesized
agacgggatttcaccacgttgg

SEQ ID NO: 1148566 - DNA, 22 bp, Artificial Sequence
  chemically synthesized
agagcagcctggccaacgtggt

SEQ ID NO: 1148567 - DNA, 22 bp, Artificial Sequence
  chemically synthesized
gagagcagcctggccaacgtgg

SEQ ID NO: 1148568 - DNA, 22 bp, Artificial Sequence
  chemically synthesized
caccacgttggccaggctgctc

SEQ ID NO: 1148569 - DNA, 22 bp, Artificial Sequence
  chemically synthesized
accacgttggccaggctgctct

SEQ ID NO: 1148570 - DNA, 22 bp, Artificial Sequence
  chemically synthesized
aggtcaggagtttgagagcagc

SEQ ID NO: 1148571 - DNA, 22 bp, Artificial Sequence
  chemically synthesized
cctgaggtcaggagtttgagag

SEQ ID NO: 1148572 - DNA, 22 bp, Artificial Sequence
  chemically synthesized
gccaggctgctctcaaactcct

SEQ ID NO: 1148573 - DNA, 22 bp, Artificial Sequence
  chemically synthesized
ctctcaaactcctgacctcagg

SEQ ID NO: 1148574 - DNA, 22 bp, Artificial Sequence
  chemically synthesized
aggtgggtagattacctgaggt

SEQ ID NO: 1148575 - DNA, 22 bp, Artificial Sequence
  chemically synthesized
tcaaactcctgacctcaggtaa

SEQ ID NO: 1148576 - DNA, 22 bp, Artificial Sequence
  chemically synthesized
aaactcctgacctcaggtaatc

SEQ ID NO: 1148577 - DNA, 22 bp, Artificial Sequence
  chemically synthesized
ggaggctgaggtgggtagatta

SEQ ID NO: 1148578 - DNA, 22 bp, Artificial Sequence
  chemically synthesized
ctgacctcaggtaatctaccca

SEQ ID NO: 1148579 - DNA, 22 bp, Artificial Sequence
  chemically synthesized
gggaggctgaggtgggtagatt

SEQ ID NO: 1148580 - DNA, 22 bp, Artificial Sequence
  chemically synthesized
tgggaggctgaggtgggtagat

SEQ ID NO: 1148581 - DNA, 22 bp, Artificial Sequence
  chemically synthesized
acctcaggtaatctacccacct

SEQ ID NO: 1148582 - DNA, 22 bp, Artificial Sequence
  chemically synthesized
aggtaatctacccacctcagcc

SEQ ID NO: 1148583 - DNA, 22 bp, Artificial Sequence
  chemically synthesized
agcactttgggaggctgaggtg

SEQ ID NO: 1148584 - DNA, 22 bp, Artificial Sequence
  chemically synthesized
taatctcagcactttgggaggc

SEQ ID NO: 1148585 - DNA, 22 bp, Artificial Sequence
  chemically synthesized
gtaatctcagcactttgggagg

SEQ ID NO: 1148586 - DNA, 22 bp, Artificial Sequence
  chemically synthesized
cccacctcagcctcccaaagtg

SEQ ID NO: 1148587 - DNA, 22 bp, Artificial Sequence
  chemically synthesized
acgtttgtaatctcagcacttt

SEQ ID NO: 1148588 - DNA, 22 bp, Artificial Sequence
  chemically synthesized
agcctcccaaagtgctgagatt

SEQ ID NO: 1148589 - DNA, 22 bp, Artificial Sequence
  chemically synthesized
ccaaagtgctgagattacaaac

SEQ ID NO: 1148590 - DNA, 22 bp, Artificial Sequence
  chemically synthesized
agattacaaacgtgagccactg

SEQ ID NO: 1148591 - DNA, 22 bp, Artificial Sequence
  chemically synthesized
caaacgtgagccactgtgcctg

SEQ ID NO: 1148592 - DNA, 22 bp, Artificial Sequence
  chemically synthesized
aaaagtagtgtataggccaggc

SEQ ID NO: 1148593 - DNA, 22 bp, Artificial Sequence
  chemically synthesized
tgcctggcctatacactacttt

SEQ ID NO: 1148594 - DNA, 22 bp, Artificial Sequence
  chemically synthesized
gcctatacactactttttagct

SEQ ID NO: 1148595 - DNA, 22 bp, Artificial Sequence
  chemically synthesized
tacactactttttagctccttt

SEQ ID NO: 1148596 - DNA, 22 bp, Artificial Sequence
  chemically synthesized
ctttttagctcctttactcgtt

SEQ ID NO: 1148597 - DNA, 22 bp, Artificial Sequence
  chemically synthesized
agcggaagggaaaaaacgagta

SEQ ID NO: 1148598 - DNA, 22 bp, Artificial Sequence
  chemically synthesized
tttagctcctttactcgttttt

SEQ ID NO: 1148599 - DNA, 22 bp, Artificial Sequence
  chemically synthesized
gagcggaagggaaaaaacgagt

SEQ ID NO: 1148600 - DNA, 22 bp, Artificial Sequence
  chemically synthesized
ttagctcctttactcgtttttt

SEQ ID NO: 1148601 - DNA, 22 bp, Artificial Sequence
  chemically synthesized
tagctcctttactcgttttttc

SEQ ID NO: 1148602 - DNA, 22 bp, Artificial Sequence
  chemically synthesized
agctcctttactcgttttttcc

SEQ ID NO: 1148603 - DNA, 22 bp, Artificial Sequence
  chemically synthesized
gctcctttactcgttttttccc

SEQ ID NO: 1148604 - DNA, 22 bp, Artificial Sequence
  chemically synthesized
tagtttgagcggaagggaaaaa

SEQ ID NO: 1148605 - DNA, 22 bp, Artificial Sequence
  chemically synthesized
gtagtttgagcggaagggaaaa

SEQ ID NO: 1148606 - DNA, 22 bp, Artificial Sequence
  chemically synthesized
ctttactcgttttttcccttcc

SEQ ID NO: 1148607 - DNA, 22 bp, Artificial Sequence
  chemically synthesized
tactcgttttttcccttccgct

SEQ ID NO: 1148608 - DNA, 22 bp, Artificial Sequence
  chemically synthesized
atttgtagtttgagcggaaggg

SEQ ID NO: 1148609 - DNA, 22 bp, Artificial Sequence
  chemically synthesized
actcgttttttcccttccgctc

SEQ ID NO: 1148610 - DNA, 22 bp, Artificial Sequence
  chemically synthesized
ctcgttttttcccttccgctca

SEQ ID NO: 1148611 - DNA, 22 bp, Artificial Sequence
  chemically synthesized
gttttttcccttccgctcaaac

SEQ ID NO: 1148612 - DNA, 22 bp, Artificial Sequence
  chemically synthesized
acatctgatttgtagtttgagc

SEQ ID NO: 1148613 - DNA, 22 bp, Artificial Sequence
  chemically synthesized
tttcccttccgctcaaactaca

SEQ ID NO: 1148614 - DNA, 22 bp, Artificial Sequence
  chemically synthesized
ttcccttccgctcaaactacaa

SEQ ID NO: 1148615 - DNA, 22 bp, Artificial Sequence
  chemically synthesized
tcccttccgctcaaactacaaa

SEQ ID NO: 1148616 - DNA, 22 bp, Artificial Sequence
  chemically synthesized
cccttccgctcaaactacaaat

SEQ ID NO: 1148617 - DNA, 22 bp, Artificial Sequence
  chemically synthesized
ccttccgctcaaactacaaatc

SEQ ID NO: 1148618 - DNA, 22 bp, Artificial Sequence
  chemically synthesized
ccgctcaaactacaaatcagat

SEQ ID NO: 1148619 - DNA, 22 bp, Artificial Sequence
  chemically synthesized
cgctcaaactacaaatcagatg

SEQ ID NO: 1148620 - DNA, 22 bp, Artificial Sequence
  chemically synthesized
taaatcggactgacatctgatt

SEQ ID NO: 1148621 - DNA, 22 bp, Artificial Sequence
  chemically synthesized
ataaatcggactgacatctgat

SEQ ID NO: 1148622 - DNA, 22 bp, Artificial Sequence
  chemically synthesized
tataaatcggactgacatctga

SEQ ID NO: 1148623 - DNA, 22 bp, Artificial Sequence
  chemically synthesized
ttataaatcggactgacatctg

SEQ ID NO: 1148624 - DNA, 22 bp, Artificial Sequence
  chemically synthesized
aaactacaaatcagatgtcagt

SEQ ID NO: 1148625 - DNA, 22 bp, Artificial Sequence
  chemically synthesized
gtttttataaatcggactgaca

SEQ ID NO: 1148626 - DNA, 22 bp, Artificial Sequence
  chemically synthesized
caaatcagatgtcagtccgatt

SEQ ID NO: 1148627 - DNA, 22 bp, Artificial Sequence
  chemically synthesized
ttggtttttataaatcggactg

SEQ ID NO: 1148628 - DNA, 22 bp, Artificial Sequence
  chemically synthesized
gtatgatagaaatctattggtt

SEQ ID NO: 1148629 - DNA, 22 bp, Artificial Sequence
  chemically synthesized
agtatgatagaaatctattggt

SEQ ID NO: 1148630 - DNA, 22 bp, Artificial Sequence
  chemically synthesized
ttagtatgatagaaatctattg

SEQ ID NO: 1148631 - DNA, 22 bp, Artificial Sequence
  chemically synthesized
cttagtatgatagaaatctatt

SEQ ID NO: 1148632 - DNA, 22 bp, Artificial Sequence
  chemically synthesized
tcttagtatgatagaaatctat

SEQ ID NO: 1148633 - DNA, 22 bp, Artificial Sequence
  chemically synthesized
ataaaaaccaatagatttctat

SEQ ID NO: 1148634 - DNA, 22 bp, Artificial Sequence
  chemically synthesized
tttcttagtatgatagaaatct

SEQ ID NO: 1148635 - DNA, 22 bp, Artificial Sequence
  chemically synthesized
taaaaaccaatagatttctatc

SEQ ID NO: 1148636 - DNA, 22 bp, Artificial Sequence
  chemically synthesized
ctttcttagtatgatagaaatc

SEQ ID NO: 1148637 - DNA, 22 bp, Artificial Sequence
  chemically synthesized
tctttcttagtatgatagaaat

SEQ ID NO: 1148638 - DNA, 22 bp, Artificial Sequence
  chemically synthesized
aattttctttcttagtatgata

SEQ ID NO: 1148639 - DNA, 22 bp, Artificial Sequence
  chemically synthesized
ctatcatactaagaaagaaaat

SEQ ID NO: 1148640 - DNA, 22 bp, Artificial Sequence
  chemically synthesized
tatcatactaagaaagaaaatt

SEQ ID NO: 1148641 - DNA, 22 bp, Artificial Sequence
  chemically synthesized
tcatactaagaaagaaaattta

SEQ ID NO: 1148642 - DNA, 22 bp, Artificial Sequence
  chemically synthesized
aggtagagaagttaaattttct

SEQ ID NO: 1148643 - DNA, 22 bp, Artificial Sequence
  chemically synthesized
caggtagagaagttaaattttc

SEQ ID NO: 1148644 - DNA, 22 bp, Artificial Sequence
  chemically synthesized
agaaagaaaatttaacttctct

SEQ ID NO: 1148645 - DNA, 22 bp, Artificial Sequence
  chemically synthesized
gatcatataagaatttcaggta

SEQ ID NO: 1148646 - DNA, 22 bp, Artificial Sequence
  chemically synthesized
aacttctctacctgaaattctt

SEQ ID NO: 1148647 - DNA, 22 bp, Artificial Sequence
  chemically synthesized
acttctctacctgaaattctta

SEQ ID NO: 1148648 - DNA, 22 bp, Artificial Sequence
  chemically synthesized
ctctacctgaaattcttatatg

SEQ ID NO: 1148649 - DNA, 22 bp, Artificial Sequence
  chemically synthesized
tctacctgaaattcttatatga

SEQ ID NO: 1148650 - DNA, 22 bp, Artificial Sequence
  chemically synthesized
tacctgaaattcttatatgatc

SEQ ID NO: 1148651 - DNA, 22 bp, Artificial Sequence
  chemically synthesized
cctgaaattcttatatgatcta

SEQ ID NO: 1148652 - DNA, 22 bp, Artificial Sequence
  chemically synthesized
aaattcttatatgatctagcac

SEQ ID NO: 1148653 - DNA, 22 bp, Artificial Sequence
  chemically synthesized
gtgaggtagtcaggtgctagat

SEQ ID NO: 1148654 - DNA, 22 bp, Artificial Sequence
  chemically synthesized
ttatatgatctagcacctgact

SEQ ID NO: 1148655 - DNA, 22 bp, Artificial Sequence
  chemically synthesized
gactggtgaggtagtcaggtgc

SEQ ID NO: 1148656 - DNA, 22 bp, Artificial Sequence
  chemically synthesized
atatgatctagcacctgactac

SEQ ID NO: 1148657 - DNA, 22 bp, Artificial Sequence
  chemically synthesized
tatgatctagcacctgactacc

SEQ ID NO: 1148658 - DNA, 22 bp, Artificial Sequence
  chemically synthesized
gcacctgactacctcaccagtc

SEQ ID NO: 1148659 - DNA, 22 bp, Artificial Sequence
  chemically synthesized
actacctcaccagtctaattgt

SEQ ID NO: 1148660 - DNA, 22 bp, Artificial Sequence
  chemically synthesized
cctcaccagtctaattgtatac

SEQ ID NO: 1148661 - DNA, 22 bp, Artificial Sequence
  chemically synthesized
tgagggcgagaatggtatacaa

SEQ ID NO: 1148662 - DNA, 22 bp, Artificial Sequence
  chemically synthesized
accagtctaattgtataccatt

SEQ ID NO: 1148663 - DNA, 22 bp, Artificial Sequence
  chemically synthesized
aaacactgtgagggcgagaatg

SEQ ID NO: 1148664 - DNA, 22 bp, Artificial Sequence
  chemically synthesized
tgaaacactgtgagggcgagaa

SEQ ID NO: 1148665 - DNA, 22 bp, Artificial Sequence
  chemically synthesized
attgtataccattctcgccctc

SEQ ID NO: 1148666 - DNA, 22 bp, Artificial Sequence
  chemically synthesized
tataccattctcgccctcacag

SEQ ID NO: 1148667 - DNA, 22 bp, Artificial Sequence
  chemically synthesized
tcgccctcacagtgtttcagaa

SEQ ID NO: 1148668 - DNA, 22 bp, Artificial Sequence
  chemically synthesized
gccctcacagtgtttcagaatg

SEQ ID NO: 1148669 - DNA, 22 bp, Artificial Sequence
  chemically synthesized
acagtgtttcagaatgacttgc

SEQ ID NO: 1148670 - DNA, 22 bp, Artificial Sequence
  chemically synthesized
gaagagagacaaagcaagtcat

SEQ ID NO: 1148671 - DNA, 22 bp, Artificial Sequence
  chemically synthesized
ggaagagagacaaagcaagtca

SEQ ID NO: 1148672 - DNA, 22 bp, Artificial Sequence
  chemically synthesized
tggaagagagacaaagcaagtc

SEQ ID NO: 1148673 - DNA, 22 bp, Artificial Sequence
  chemically synthesized
ttggaagagagacaaagcaagt

SEQ ID NO: 1148674 - DNA, 22 bp, Artificial Sequence
  chemically synthesized
cagaatgacttgctttgtctct

SEQ ID NO: 1148675 - DNA, 22 bp, Artificial Sequence
  chemically synthesized
agaatgacttgctttgtctctc

SEQ ID NO: 1148676 - DNA, 22 bp, Artificial Sequence
  chemically synthesized
acacatttttggaagagagaca

SEQ ID NO: 1148677 - DNA, 22 bp, Artificial Sequence
  chemically synthesized
gacacatttttggaagagagac

SEQ ID NO: 1148678 - DNA, 22 bp, Artificial Sequence
  chemically synthesized
gctttgtctctcttccaaaaat

SEQ ID NO: 1148679 - DNA, 22 bp, Artificial Sequence
  chemically synthesized
ctttgtctctcttccaaaaatg

SEQ ID NO: 1148680 - DNA, 22 bp, Artificial Sequence
  chemically synthesized
tgtctctcttccaaaaatgtgt

SEQ ID NO: 1148681 - DNA, 22 bp, Artificial Sequence
  chemically synthesized
gtctctcttccaaaaatgtgtc

SEQ ID NO: 1148682 - DNA, 22 bp, Artificial Sequence
  chemically synthesized
tctctcttccaaaaatgtgtca

SEQ ID NO: 1148683 - DNA, 22 bp, Artificial Sequence
  chemically synthesized
gtagagggaacagcttgacaca

SEQ ID NO: 1148684 - DNA, 22 bp, Artificial Sequence
  chemically synthesized
tcttccaaaaatgtgtcaagct

SEQ ID NO: 1148685 - DNA, 22 bp, Artificial Sequence
  chemically synthesized
ttccaaaaatgtgtcaagctgt

SEQ ID NO: 1148686 - DNA, 22 bp, Artificial Sequence
  chemically synthesized
ccaaaaatgtgtcaagctgttc

SEQ ID NO: 1148687 - DNA, 22 bp, Artificial Sequence
  chemically synthesized
caaaaatgtgtcaagctgttcc

SEQ ID NO: 1148688 - DNA, 22 bp, Artificial Sequence
  chemically synthesized
gaagaaaagcaatcctggtaga

SEQ ID NO: 1148689 - DNA, 22 bp, Artificial Sequence
  chemically synthesized
ttccctctaccaggattgcttt

SEQ ID NO: 1148690 - DNA, 22 bp, Artificial Sequence
  chemically synthesized
aacatctggaagaaaagcaatc

SEQ ID NO: 1148691 - DNA, 22 bp, Artificial Sequence
  chemically synthesized
aaacatctggaagaaaagcaat

SEQ ID NO: 1148692 - DNA, 22 bp, Artificial Sequence
  chemically synthesized
cctctaccaggattgcttttct

SEQ ID NO: 1148693 - DNA, 22 bp, Artificial Sequence
  chemically synthesized
taccaggattgcttttcttcca

SEQ ID NO: 1148694 - DNA, 22 bp, Artificial Sequence
  chemically synthesized
ccaggattgcttttcttccaga

SEQ ID NO: 1148695 - DNA, 22 bp, Artificial Sequence
  chemically synthesized
cttttcttccagatgtttaaat

SEQ ID NO: 1148696 - DNA, 22 bp, Artificial Sequence
  chemically synthesized
ttcttccagatgtttaaatcat

SEQ ID NO: 1148697 - DNA, 22 bp, Artificial Sequence
  chemically synthesized
aatgataaagaaatgatttaaa

SEQ ID NO: 1148698 - DNA, 22 bp, Artificial Sequence
  chemically synthesized
tcttccagatgtttaaatcatt

SEQ ID NO: 1148699 - DNA, 22 bp, Artificial Sequence
  chemically synthesized
cttccagatgtttaaatcattt

SEQ ID NO: 1148700 - DNA, 22 bp, Artificial Sequence
  chemically synthesized
ttccagatgtttaaatcatttc

SEQ ID NO: 1148701 - DNA, 22 bp, Artificial Sequence
  chemically synthesized
ccagatgtttaaatcatttctt

SEQ ID NO: 1148702 - DNA, 22 bp, Artificial Sequence
  chemically synthesized
cagatgtttaaatcatttcttt

SEQ ID NO: 1148703 - DNA, 22 bp, Artificial Sequence
  chemically synthesized
agtcctgaatgataaagaaatg

SEQ ID NO: 1148704 - DNA, 22 bp, Artificial Sequence
  chemically synthesized
cattgagtcctgaatgataaag

SEQ ID NO: 1148705 - DNA, 22 bp, Artificial Sequence
  chemically synthesized
acattgagtcctgaatgataaa

SEQ ID NO: 1148706 - DNA, 22 bp, Artificial Sequence
  chemically synthesized
aaatcatttctttatcattcag

SEQ ID NO: 1148707 - DNA, 22 bp, Artificial Sequence
  chemically synthesized
aatcatttctttatcattcagg

SEQ ID NO: 1148708 - DNA, 22 bp, Artificial Sequence
  chemically synthesized
ctttatcattcaggactcaatg

SEQ ID NO: 1148709 - DNA, 22 bp, Artificial Sequence
  chemically synthesized
tttatcattcaggactcaatgt

SEQ ID NO: 1148710 - DNA, 22 bp, Artificial Sequence
  chemically synthesized
tatcattcaggactcaatgtaa

SEQ ID NO: 1148711 - DNA, 22 bp, Artificial Sequence
  chemically synthesized
ggtaggtgacacttacattgag

SEQ ID NO: 1148712 - DNA, 22 bp, Artificial Sequence
  chemically synthesized
atcattcaggactcaatgtaag

SEQ ID NO: 1148713 - DNA, 22 bp, Artificial Sequence
  chemically synthesized
tcattcaggactcaatgtaagt

SEQ ID NO: 1148714 - DNA, 22 bp, Artificial Sequence
  chemically synthesized
taggtaggtgacacttacattg

SEQ ID NO: 1148715 - DNA, 22 bp, Artificial Sequence
  chemically synthesized
ctctaggtaggtgacacttaca

SEQ ID NO: 1148716 - DNA, 22 bp, Artificial Sequence
  chemically synthesized
aggactcaatgtaagtgtcacc

SEQ ID NO: 1148717 - DNA, 22 bp, Artificial Sequence
  chemically synthesized
aatgtaagtgtcacctacctag

SEQ ID NO: 1148718 - DNA, 22 bp, Artificial Sequence
  chemically synthesized
atgaaaagctgctctaggtagg

SEQ ID NO: 1148719 - DNA, 22 bp, Artificial Sequence
  chemically synthesized
ctcatgaaaagctgctctaggt

SEQ ID NO: 1148720 - DNA, 22 bp, Artificial Sequence
  chemically synthesized
gctcatgaaaagctgctctagg

SEQ ID NO: 1148721 - DNA, 22 bp, Artificial Sequence
  chemically synthesized
gatagtttgctcatgaaaagct

SEQ ID NO: 1148722 - DNA, 22 bp, Artificial Sequence
  chemically synthesized
cctagagcagcttttcatgagc

SEQ ID NO: 1148723 - DNA, 22 bp, Artificial Sequence
  chemically synthesized
gagcagcttttcatgagcaaac

SEQ ID NO: 1148724 - DNA, 22 bp, Artificial Sequence
  chemically synthesized
gggagcaacattggatagtttg

SEQ ID NO: 1148725 - DNA, 22 bp, Artificial Sequence
  chemically synthesized
ctagggagcaacattggatagt

SEQ ID NO: 1148726 - DNA, 22 bp, Artificial Sequence
  chemically synthesized
ttcatgagcaaactatccaatg

SEQ ID NO: 1148727 - DNA, 22 bp, Artificial Sequence
  chemically synthesized
tcatgagcaaactatccaatgt

SEQ ID NO: 1148728 - DNA, 22 bp, Artificial Sequence
  chemically synthesized
catgagcaaactatccaatgtt

SEQ ID NO: 1148729 - DNA, 22 bp, Artificial Sequence
  chemically synthesized
atgagcaaactatccaatgttg

SEQ ID NO: 1148730 - DNA, 22 bp, Artificial Sequence
  chemically synthesized
tccaatgttgctccctagtaat

SEQ ID NO: 1148731 - DNA, 22 bp, Artificial Sequence
  chemically synthesized
aaaaaatgacagaaatggtgaa

SEQ ID NO: 1148732 - DNA, 22 bp, Artificial Sequence
  chemically synthesized
ctccctagtaattcaccatttc

SEQ ID NO: 1148733 - DNA, 22 bp, Artificial Sequence
  chemically synthesized
cctagtaattcaccatttctgt

SEQ ID NO: 1148734 - DNA, 22 bp, Artificial Sequence
  chemically synthesized
tgattaaaaaaatgacagaaat

SEQ ID NO: 1148735 - DNA, 22 bp, Artificial Sequence
  chemically synthesized
gtaattcaccatttctgtcatt

SEQ ID NO: 1148736 - DNA, 22 bp, Artificial Sequence
  chemically synthesized
accatttctgtcatttttttaa

SEQ ID NO: 1148737 - DNA, 22 bp, Artificial Sequence
  chemically synthesized
ctgtcatttttttaatcatagt

SEQ ID NO: 1148738 - DNA, 22 bp, Artificial Sequence
  chemically synthesized
agtagtgacaatactatgatta

SEQ ID NO: 1148739 - DNA, 22 bp, Artificial Sequence
  chemically synthesized
tgtcatttttttaatcatagta

SEQ ID NO: 1148740 - DNA, 22 bp, Artificial Sequence
  chemically synthesized
tcatttttttaatcatagtatt

SEQ ID NO: 1148741 - DNA, 22 bp, Artificial Sequence
  chemically synthesized
ttgagtagtgacaatactatga

SEQ ID NO: 1148742 - DNA, 22 bp, Artificial Sequence
  chemically synthesized
ttttaatcatagtattgtcact

SEQ ID NO: 1148743 - DNA, 22 bp, Artificial Sequence
  chemically synthesized
tttaatcatagtattgtcacta

SEQ ID NO: 1148744 - DNA, 22 bp, Artificial Sequence
  chemically synthesized
ttaatcatagtattgtcactac

SEQ ID NO: 1148745 - DNA, 22 bp, Artificial Sequence
  chemically synthesized
taatcatagtattgtcactact

SEQ ID NO: 1148746 - DNA, 22 bp, Artificial Sequence
  chemically synthesized
aatcatagtattgtcactactc

SEQ ID NO: 1148747 - DNA, 22 bp, Artificial Sequence
  chemically synthesized
atcatagtattgtcactactca

SEQ ID NO: 1148748 - DNA, 22 bp, Artificial Sequence
  chemically synthesized
atacataagaaattattgagta

SEQ ID NO: 1148749 - DNA, 22 bp, Artificial Sequence
  chemically synthesized
agctgatacataagaaattatt

SEQ ID NO: 1148750 - DNA, 22 bp, Artificial Sequence
  chemically synthesized
tcactactcaataatttcttat

SEQ ID NO: 1148751 - DNA, 22 bp, Artificial Sequence
  chemically synthesized
ctcaataatttcttatgtatca

SEQ ID NO: 1148752 - DNA, 22 bp, Artificial Sequence
  chemically synthesized
aataatttcttatgtatcagct

SEQ ID NO: 1148753 - DNA, 22 bp, Artificial Sequence
  chemically synthesized
cttatgtatcagcttagtcctt

SEQ ID NO: 1148754 - DNA, 22 bp, Artificial Sequence
  chemically synthesized
ttatgtatcagcttagtccttt

SEQ ID NO: 1148755 - DNA, 22 bp, Artificial Sequence
  chemically synthesized
atgtatcagcttagtccttttg

SEQ ID NO: 1148756 - DNA, 22 bp, Artificial Sequence
  chemically synthesized
tgtatcagcttagtccttttgt

SEQ ID NO: 1148757 - DNA, 22 bp, Artificial Sequence
  chemically synthesized
tagtaagtagagacaaaaggac

SEQ ID NO: 1148758 - DNA, 22 bp, Artificial Sequence
  chemically synthesized
ttatagtaagtagagacaaaag

SEQ ID NO: 1148759 - DNA, 22 bp, Artificial Sequence
  chemically synthesized
cctattatagtaagtagagaca

SEQ ID NO: 1148760 - DNA, 22 bp, Artificial Sequence
  chemically synthesized
agtccttttgtctctacttact

SEQ ID NO: 1148761 - DNA, 22 bp, Artificial Sequence
  chemically synthesized
gtccttttgtctctacttacta

SEQ ID NO: 1148762 - DNA, 22 bp, Artificial Sequence
  chemically synthesized
gtggactgcctattatagtaag

SEQ ID NO: 1148763 - DNA, 22 bp, Artificial Sequence
  chemically synthesized
tagtggactgcctattatagta

SEQ ID NO: 1148764 - DNA, 22 bp, Artificial Sequence
  chemically synthesized
ttgtctctacttactataatag

SEQ ID NO: 1148765 - DNA, 22 bp, Artificial Sequence
  chemically synthesized
tgtctctacttactataatagg

SEQ ID NO: 1148766 - DNA, 22 bp, Artificial Sequence
  chemically synthesized
gtctctacttactataataggc

SEQ ID NO: 1148767 - DNA, 22 bp, Artificial Sequence
  chemically synthesized
ttctagtggactgcctattata

SEQ ID NO: 1148768 - DNA, 22 bp, Artificial Sequence
  chemically synthesized
tctctacttactataataggca

SEQ ID NO: 1148769 - DNA, 22 bp, Artificial Sequence
  chemically synthesized
tgttctagtggactgcctatta

SEQ ID NO: 1148770 - DNA, 22 bp, Artificial Sequence
  chemically synthesized
tacttactataataggcagtcc

SEQ ID NO: 1148771 - DNA, 22 bp, Artificial Sequence
  chemically synthesized
cttactataataggcagtccac

SEQ ID NO: 1148772 - DNA, 22 bp, Artificial Sequence
  chemically synthesized
actataataggcagtccactag

SEQ ID NO: 1148773 - DNA, 22 bp, Artificial Sequence
  chemically synthesized
ctataataggcagtccactaga

SEQ ID NO: 1148774 - DNA, 22 bp, Artificial Sequence
  chemically synthesized
taataggcagtccactagaaca

SEQ ID NO: 1148775 - DNA, 22 bp, Artificial Sequence
  chemically synthesized
gaacagagatgccctctgtcct

SEQ ID NO: 1148776 - DNA, 22 bp, Artificial Sequence
  chemically synthesized
taatacatagtgagaaggacag

SEQ ID NO: 1148777 - DNA, 22 bp, Artificial Sequence
  chemically synthesized
gtaatacatagtgagaaggaca

SEQ ID NO: 1148778 - DNA, 22 bp, Artificial Sequence
  chemically synthesized
cttgtaatacatagtgagaagg

SEQ ID NO: 1148779 - DNA, 22 bp, Artificial Sequence
  chemically synthesized
gcttgtaatacatagtgagaag

SEQ ID NO: 1148780 - DNA, 22 bp, Artificial Sequence
  chemically synthesized
tttgcttgtaatacatagtgag

SEQ ID NO: 1148781 - DNA, 22 bp, Artificial Sequence
  chemically synthesized
atttgcttgtaatacatagtga

SEQ ID NO: 1148782 - DNA, 22 bp, Artificial Sequence
  chemically synthesized
tatttgcttgtaatacatagtg

SEQ ID NO: 1148783 - DNA, 22 bp, Artificial Sequence
  chemically synthesized
tgtccttctcactatgtattac

SEQ ID NO: 1148784 - DNA, 22 bp, Artificial Sequence
  chemically synthesized
tccttctcactatgtattacaa

SEQ ID NO: 1148785 - DNA, 22 bp, Artificial Sequence
  chemically synthesized
atctttatttgcttgtaataca

SEQ ID NO: 1148786 - DNA, 22 bp, Artificial Sequence
  chemically synthesized
ttgatctttatttgcttgtaat

SEQ ID NO: 1148787 - DNA, 22 bp, Artificial Sequence
  chemically synthesized
attgatctttatttgcttgtaa

SEQ ID NO: 1148788 - DNA, 22 bp, Artificial Sequence
  chemically synthesized
ctcactatgtattacaagcaaa

SEQ ID NO: 1148789 - DNA, 22 bp, Artificial Sequence
  chemically synthesized
tcactatgtattacaagcaaat

SEQ ID NO: 1148790 - DNA, 22 bp, Artificial Sequence
  chemically synthesized
actatgtattacaagcaaataa

SEQ ID NO: 1148791 - DNA, 22 bp, Artificial Sequence
  chemically synthesized
tgtattacaagcaaataaagat

SEQ ID NO: 1148792 - DNA, 22 bp, Artificial Sequence
  chemically synthesized
acaaatgtttattgatctttat

SEQ ID NO: 1148793 - DNA, 22 bp, Artificial Sequence
  chemically synthesized
tctgacaaatgtttattgatct

SEQ ID NO: 1148794 - DNA, 22 bp, Artificial Sequence
  chemically synthesized
caagcaaataaagatcaataaa

SEQ ID NO: 1148795 - DNA, 22 bp, Artificial Sequence
  chemically synthesized
atctgacaaatgtttattgatc

SEQ ID NO: 1148796 - DNA, 22 bp, Artificial Sequence
  chemically synthesized
cccaaacccccacatggtacca

SEQ ID NO: 1148797 - DNA, 22 bp, Artificial Sequence
  chemically synthesized
ccccaaacccccacatggtacc

SEQ ID NO: 1148798 - DNA, 22 bp, Artificial Sequence
  chemically synthesized
gtcagataaatggtaccatgtg

SEQ ID NO: 1148799 - DNA, 22 bp, Artificial Sequence
  chemically synthesized
tccccaaacccccacatggtac

SEQ ID NO: 1148800 - DNA, 22 bp, Artificial Sequence
  chemically synthesized
tcagataaatggtaccatgtgg

SEQ ID NO: 1148801 - DNA, 22 bp, Artificial Sequence
  chemically synthesized
tgcatgttttccccaaaccccc

SEQ ID NO: 1148802 - DNA, 22 bp, Artificial Sequence
  chemically synthesized
atctgtgcatgttttccccaaa

SEQ ID NO: 1148803 - DNA, 22 bp, Artificial Sequence
  chemically synthesized
ggggaaaacatgcacagatgag

SEQ ID NO: 1148804 - DNA, 22 bp, Artificial Sequence
  chemically synthesized
gggaaaacatgcacagatgagt

SEQ ID NO: 1148805 - DNA, 22 bp, Artificial Sequence
  chemically synthesized
tgcaatcaggaaggaacaaact

SEQ ID NO: 1148806 - DNA, 22 bp, Artificial Sequence
  chemically synthesized
gtgcaatcaggaaggaacaaac

SEQ ID NO: 1148807 - DNA, 22 bp, Artificial Sequence
  chemically synthesized
tgtgcaatcaggaaggaacaaa

SEQ ID NO: 1148808 - DNA, 22 bp, Artificial Sequence
  chemically synthesized
taatctttgtgcaatcaggaag

SEQ ID NO: 1148809 - DNA, 22 bp, Artificial Sequence
  chemically synthesized
tattgtaatctttgtgcaatca

SEQ ID NO: 1148810 - DNA, 22 bp, Artificial Sequence
  chemically synthesized
gttccttcctgattgcacaaag

SEQ ID NO: 1148811 - DNA, 22 bp, Artificial Sequence
  chemically synthesized
ttatattgtaatctttgtgcaa

SEQ ID NO: 1148812 - DNA, 22 bp, Artificial Sequence
  chemically synthesized
ttccttcctgattgcacaaaga

SEQ ID NO: 1148813 - DNA, 22 bp, Artificial Sequence
  chemically synthesized
ctattatattgtaatctttgtg

SEQ ID NO: 1148814 - DNA, 22 bp, Artificial Sequence
  chemically synthesized
cttcctgattgcacaaagatta

SEQ ID NO: 1148815 - DNA, 22 bp, Artificial Sequence
  chemically synthesized
cctattatattgtaatctttgt

SEQ ID NO: 1148816 - DNA, 22 bp, Artificial Sequence
  chemically synthesized
ttcctattatattgtaatcttt

SEQ ID NO: 1148817 - DNA, 22 bp, Artificial Sequence
  chemically synthesized
cctgattgcacaaagattacaa

SEQ ID NO: 1148818 - DNA, 22 bp, Artificial Sequence
  chemically synthesized
ctgattgcacaaagattacaat

SEQ ID NO: 1148819 - DNA, 22 bp, Artificial Sequence
  chemically synthesized
attcttcctattatattgtaat

SEQ ID NO: 1148820 - DNA, 22 bp, Artificial Sequence
  chemically synthesized
attgcacaaagattacaatata

SEQ ID NO: 1148821 - DNA, 22 bp, Artificial Sequence
  chemically synthesized
cacaaagattacaatataatag

SEQ ID NO: 1148822 - DNA, 22 bp, Artificial Sequence
  chemically synthesized
caccaaaaatcactaattcttc

SEQ ID NO: 1148823 - DNA, 22 bp, Artificial Sequence
  chemically synthesized
caatataataggaagaattagt

SEQ ID NO: 1148824 - DNA, 22 bp, Artificial Sequence
  chemically synthesized
tgattacaccaaaaatcactaa

SEQ ID NO: 1148825 - DNA, 22 bp, Artificial Sequence
  chemically synthesized
gtgtaattgtgattacaccaaa

SEQ ID NO: 1148826 - DNA, 22 bp, Artificial Sequence
  chemically synthesized
gtgatttttggtgtaatcacaa

SEQ ID NO: 1148827 - DNA, 22 bp, Artificial Sequence
  chemically synthesized
aggttagtgtaattgtgattac

SEQ ID NO: 1148828 - DNA, 22 bp, Artificial Sequence
  chemically synthesized
ttgaggttagtgtaattgtgat

SEQ ID NO: 1148829 - DNA, 22 bp, Artificial Sequence
  chemically synthesized
tgttgaggttagtgtaattgtg

SEQ ID NO: 1148830 - DNA, 22 bp, Artificial Sequence
  chemically synthesized
ctgttgaggttagtgtaattgt

SEQ ID NO: 1148831 - DNA, 22 bp, Artificial Sequence
  chemically synthesized
ttggtgtaatcacaattacact

SEQ ID NO: 1148832 - DNA, 22 bp, Artificial Sequence
  chemically synthesized
tctgttgaggttagtgtaattg

SEQ ID NO: 1148833 - DNA, 22 bp, Artificial Sequence
  chemically synthesized
tggtgtaatcacaattacacta

SEQ ID NO: 1148834 - DNA, 22 bp, Artificial Sequence
  chemically synthesized
ggtgtaatcacaattacactaa

SEQ ID NO: 1148835 - DNA, 22 bp, Artificial Sequence
  chemically synthesized
gtgtaatcacaattacactaac

SEQ ID NO: 1148836 - DNA, 22 bp, Artificial Sequence
  chemically synthesized
ttttctgttgaggttagtgtaa

SEQ ID NO: 1148837 - DNA, 22 bp, Artificial Sequence
  chemically synthesized
agaccaagtggttattttctgt

SEQ ID NO: 1148838 - DNA, 22 bp, Artificial Sequence
  chemically synthesized
cactaacctcaacagaaaataa

SEQ ID NO: 1148839 - DNA, 22 bp, Artificial Sequence
  chemically synthesized
agttgagaccaagtggttattt

SEQ ID NO: 1148840 - DNA, 22 bp, Artificial Sequence
  chemically synthesized
acctcaacagaaaataaccact

SEQ ID NO: 1148841 - DNA, 22 bp, Artificial Sequence
  chemically synthesized
aacagaaaataaccacttggtc

SEQ ID NO: 1148842 - DNA, 22 bp, Artificial Sequence
  chemically synthesized
gggttcagttgagaccaagtgg

SEQ ID NO: 1148843 - DNA, 22 bp, Artificial Sequence
  chemically synthesized
tcctagggttcagttgagacca

SEQ ID NO: 1148844 - DNA, 22 bp, Artificial Sequence
  chemically synthesized
atcctagggttcagttgagacc

SEQ ID NO: 1148845 - DNA, 22 bp, Artificial Sequence
  chemically synthesized
tatcctagggttcagttgagac

SEQ ID NO: 1148846 - DNA, 22 bp, Artificial Sequence
  chemically synthesized
gttttatcctagggttcagttg

SEQ ID NO: 1148847 - DNA, 22 bp, Artificial Sequence
  chemically synthesized
tggttttatcctagggttcagt

SEQ ID NO: 1148848 - DNA, 22 bp, Artificial Sequence
  chemically synthesized
ttctggttttatcctagggttc

SEQ ID NO: 1148849 - DNA, 22 bp, Artificial Sequence
  chemically synthesized
ggtctcaactgaaccctaggat

SEQ ID NO: 1148850 - DNA, 22 bp, Artificial Sequence
  chemically synthesized
gtctcaactgaaccctaggata

SEQ ID NO: 1148851 - DNA, 22 bp, Artificial Sequence
  chemically synthesized
aattattctggttttatcctag

SEQ ID NO: 1148852 - DNA, 22 bp, Artificial Sequence
  chemically synthesized
gaattattctggttttatccta

SEQ ID NO: 1148853 - DNA, 22 bp, Artificial Sequence
  chemically synthesized
aactgaaccctaggataaaacc

SEQ ID NO: 1148854 - DNA, 22 bp, Artificial Sequence
  chemically synthesized
aaccctaggataaaaccagaat

SEQ ID NO: 1148855 - DNA, 22 bp, Artificial Sequence
  chemically synthesized
ggataaaaccagaataattcaa

SEQ ID NO: 1148856 - DNA, 22 bp, Artificial Sequence
  chemically synthesized
gaaaggcagtatttgaattatt

SEQ ID NO: 1148857 - DNA, 22 bp, Artificial Sequence
  chemically synthesized
taagttagaaaggcagtatttg

SEQ ID NO: 1148858 - DNA, 22 bp, Artificial Sequence
  chemically synthesized
gtaagttagaaaggcagtattt

SEQ ID NO: 1148859 - DNA, 22 bp, Artificial Sequence
  chemically synthesized
aaatactgcctttctaacttac

SEQ ID NO: 1148860 - DNA, 22 bp, Artificial Sequence
  chemically synthesized
agagccacatttgtaagttaga

SEQ ID NO: 1148861 - DNA, 22 bp, Artificial Sequence
  chemically synthesized
cagagccacatttgtaagttag

SEQ ID NO: 1148862 - DNA, 22 bp, Artificial Sequence
  chemically synthesized
tcagagccacatttgtaagtta

SEQ ID NO: 1148863 - DNA, 22 bp, Artificial Sequence
  chemically synthesized
ttcagagccacatttgtaagtt

SEQ ID NO: 1148864 - DNA, 22 bp, Artificial Sequence
  chemically synthesized
tttcagagccacatttgtaagt

SEQ ID NO: 1148865 - DNA, 22 bp, Artificial Sequence
  chemically synthesized
cctttctaacttacaaatgtgg

SEQ ID NO: 1148866 - DNA, 22 bp, Artificial Sequence
  chemically synthesized
tctaacttacaaatgtggctct

SEQ ID NO: 1148867 - DNA, 22 bp, Artificial Sequence
  chemically synthesized
ctaacttacaaatgtggctctg

SEQ ID NO: 1148868 - DNA, 22 bp, Artificial Sequence
  chemically synthesized
taacttacaaatgtggctctga

SEQ ID NO: 1148869 - DNA, 22 bp, Artificial Sequence
  chemically synthesized
acttacaaatgtggctctgaaa

SEQ ID NO: 1148870 - DNA, 22 bp, Artificial Sequence
  chemically synthesized
acaaatgtggctctgaaaaaat

SEQ ID NO: 1148871 - DNA, 22 bp, Artificial Sequence
  chemically synthesized
caaatgtggctctgaaaaaatc

SEQ ID NO: 1148872 - DNA, 22 bp, Artificial Sequence
  chemically synthesized
atagggggaaatgattttttca

SEQ ID NO: 1148873 - DNA, 22 bp, Artificial Sequence
  chemically synthesized
aatagggggaaatgattttttc

SEQ ID NO: 1148874 - DNA, 22 bp, Artificial Sequence
  chemically synthesized
acttaatagggggaaatgattt

SEQ ID NO: 1148875 - DNA, 22 bp, Artificial Sequence
  chemically synthesized
tgaaaaaatcatttccccctat

SEQ ID NO: 1148876 - DNA, 22 bp, Artificial Sequence
  chemically synthesized
aaaaaatcatttccccctatta

SEQ ID NO: 1148877 - DNA, 22 bp, Artificial Sequence
  chemically synthesized
tgacagcctcacttaatagggg

SEQ ID NO: 1148878 - DNA, 22 bp, Artificial Sequence
  chemically synthesized
gtgacagcctcacttaataggg

SEQ ID NO: 1148879 - DNA, 22 bp, Artificial Sequence
  chemically synthesized
tgtgacagcctcacttaatagg

SEQ ID NO: 1148880 - DNA, 22 bp, Artificial Sequence
  chemically synthesized
ttttgtgacagcctcacttaat

SEQ ID NO: 1148881 - DNA, 22 bp, Artificial Sequence
  chemically synthesized
ccccctattaagtgaggctgtc

SEQ ID NO: 1148882 - DNA, 22 bp, Artificial Sequence
  chemically synthesized
cccctattaagtgaggctgtca

SEQ ID NO: 1148883 - DNA, 22 bp, Artificial Sequence
  chemically synthesized
gaaatactgttttgtgacagcc

SEQ ID NO: 1148884 - DNA, 22 bp, Artificial Sequence
  chemically synthesized
ttaagtgaggctgtcacaaaac

SEQ ID NO: 1148885 - DNA, 22 bp, Artificial Sequence
  chemically synthesized
agtgaggctgtcacaaaacagt

SEQ ID NO: 1148886 - DNA, 22 bp, Artificial Sequence
  chemically synthesized
aaaagattggaaatactgtttt

SEQ ID NO: 1148887 - DNA, 22 bp, Artificial Sequence
  chemically synthesized
aaaaagattggaaatactgttt

SEQ ID NO: 1148888 - DNA, 22 bp, Artificial Sequence
  chemically synthesized
taaaaagattggaaatactgtt

SEQ ID NO: 1148889 - DNA, 22 bp, Artificial Sequence
  chemically synthesized
ttaaaaagattggaaatactgt

SEQ ID NO: 1148890 - DNA, 22 bp, Artificial Sequence
  chemically synthesized
tcacaaaacagtatttccaatc

SEQ ID NO: 1148891 - DNA, 22 bp, Artificial Sequence
  chemically synthesized
tacatcatgtttttaaaaagat

SEQ ID NO: 1148892 - DNA, 22 bp, Artificial Sequence
  chemically synthesized
ccaatctttttaaaaacatgat

SEQ ID NO: 1148893 - DNA, 22 bp, Artificial Sequence
  chemically synthesized
caatctttttaaaaacatgatg

SEQ ID NO: 1148894 - DNA, 22 bp, Artificial Sequence
  chemically synthesized
caaaataattgtacatcatgtt

SEQ ID NO: 1148895 - DNA, 22 bp, Artificial Sequence
  chemically synthesized
tttaaaaacatgatgtacaatt

SEQ ID NO: 1148896 - DNA, 22 bp, Artificial Sequence
  chemically synthesized
ttaaaaacatgatgtacaatta

SEQ ID NO: 1148897 - DNA, 22 bp, Artificial Sequence
  chemically synthesized
atcattacaaaataattgtaca

SEQ ID NO: 1148898 - DNA, 22 bp, Artificial Sequence
  chemically synthesized
taaaaacatgatgtacaattat

SEQ ID NO: 1148899 - DNA, 22 bp, Artificial Sequence
  chemically synthesized
aaaaacatgatgtacaattatt

SEQ ID NO: 1148900 - DNA, 22 bp, Artificial Sequence
  chemically synthesized
aaaacatgatgtacaattattt

SEQ ID NO: 1148901 - DNA, 22 bp, Artificial Sequence
  chemically synthesized
ttcatcattacaaaataattgt

SEQ ID NO: 1148902 - DNA, 22 bp, Artificial Sequence
  chemically synthesized
cccctgttcatcattacaaaat

SEQ ID NO: 1148903 - DNA, 22 bp, Artificial Sequence
  chemically synthesized
acccctgttcatcattacaaaa

SEQ ID NO: 1148904 - DNA, 22 bp, Artificial Sequence
  chemically synthesized
tgtttacccctgttcatcatta

SEQ ID NO: 1148905 - DNA, 22 bp, Artificial Sequence
  chemically synthesized
ctgtgtttacccctgttcatca

SEQ ID NO: 1148906 - DNA, 22 bp, Artificial Sequence
  chemically synthesized
ttcctgtgtttacccctgttca

SEQ ID NO: 1148907 - DNA, 22 bp, Artificial Sequence
  chemically synthesized
ttttgtaatgatgaacaggggt

SEQ ID NO: 1148908 - DNA, 22 bp, Artificial Sequence
  chemically synthesized
attcctgtgtttacccctgttc

SEQ ID NO: 1148909 - DNA, 22 bp, Artificial Sequence
  chemically synthesized
tgtaatgatgaacaggggtaaa

SEQ ID NO: 1148910 - DNA, 22 bp, Artificial Sequence
  chemically synthesized
gtaatgatgaacaggggtaaac

SEQ ID NO: 1148911 - DNA, 22 bp, Artificial Sequence
  chemically synthesized
atttattcctgtgtttacccct

SEQ ID NO: 1148912 - DNA, 22 bp, Artificial Sequence
  chemically synthesized
taatgatgaacaggggtaaaca

SEQ ID NO: 1148913 - DNA, 22 bp, Artificial Sequence
  chemically synthesized
cccctaatttattcctgtgttt

SEQ ID NO: 1148914 - DNA, 22 bp, Artificial Sequence
  chemically synthesized
acccctaatttattcctgtgtt

SEQ ID NO: 1148915 - DNA, 22 bp, Artificial Sequence
  chemically synthesized
tttacccctaatttattcctgt

SEQ ID NO: 1148916 - DNA, 22 bp, Artificial Sequence
  chemically synthesized
gtttacccctaatttattcctg

SEQ ID NO: 1148917 - DNA, 22 bp, Artificial Sequence
  chemically synthesized
tgtttacccctaatttattcct

SEQ ID NO: 1148918 - DNA, 22 bp, Artificial Sequence
  chemically synthesized
ctttgtttacccctaatttatt

SEQ ID NO: 1148919 - DNA, 22 bp, Artificial Sequence
  chemically synthesized
gagcagcctcctttgtttaccc

SEQ ID NO: 1148920 - DNA, 22 bp, Artificial Sequence
  chemically synthesized
tagagcagcctcctttgtttac

SEQ ID NO: 1148921 - DNA, 22 bp, Artificial Sequence
  chemically synthesized
gttctagagcagcctcctttgt

SEQ ID NO: 1148922 - DNA, 22 bp, Artificial Sequence
  chemically synthesized
ggttctagagcagcctcctttg

SEQ ID NO: 1148923 - DNA, 22 bp, Artificial Sequence
  chemically synthesized
ggggtaaacaaaggaggctgct

SEQ ID NO: 1148924 - DNA, 22 bp, Artificial Sequence
  chemically synthesized
gagcacccaggcaacatacctt

SEQ ID NO: 1148925 - DNA, 22 bp, Artificial Sequence
  chemically synthesized
ctctagaaccaaggtatgttgc

SEQ ID NO: 1148926 - DNA, 22 bp, Artificial Sequence
  chemically synthesized
tagaaccaaggtatgttgcctg

SEQ ID NO: 1148927 - DNA, 22 bp, Artificial Sequence
  chemically synthesized
gaaccaaggtatgttgcctggg

SEQ ID NO: 1148928 - DNA, 22 bp, Artificial Sequence
  chemically synthesized
tgggatctggagcacccaggca

SEQ ID NO: 1148929 - DNA, 22 bp, Artificial Sequence
  chemically synthesized
atgggatctggagcacccaggc

SEQ ID NO: 1148930 - DNA, 22 bp, Artificial Sequence
  chemically synthesized
cctgggtgctccagatcccata

SEQ ID NO: 1148931 - DNA, 22 bp, Artificial Sequence
  chemically synthesized
ggtgctccagatcccataagac

SEQ ID NO: 1148932 - DNA, 22 bp, Artificial Sequence
  chemically synthesized
cagatcccataagaccttaccc

SEQ ID NO: 1148933 - DNA, 22 bp, Artificial Sequence
  chemically synthesized
accctgttacactatttattat

SEQ ID NO: 1148934 - DNA, 22 bp, Artificial Sequence
  chemically synthesized
agagaaatcccaataataaata

SEQ ID NO: 1148935 - DNA, 22 bp, Artificial Sequence
  chemically synthesized
ccctgttacactatttattatt

SEQ ID NO: 1148936 - DNA, 22 bp, Artificial Sequence
  chemically synthesized
ttcagagaaatcccaataataa

SEQ ID NO: 1148937 - DNA, 22 bp, Artificial Sequence
  chemically synthesized
ttacactatttattattgggat

SEQ ID NO: 1148938 - DNA, 22 bp, Artificial Sequence
  chemically synthesized
cactatttattattgggatttc

SEQ ID NO: 1148939 - DNA, 22 bp, Artificial Sequence
  chemically synthesized
aaatagctattcagagaaatcc

SEQ ID NO: 1148940 - DNA, 22 bp, Artificial Sequence
  chemically synthesized
tttattattgggatttctctga

SEQ ID NO: 1148941 - DNA, 22 bp, Artificial Sequence
  chemically synthesized
attattgggatttctctgaata

SEQ ID NO: 1148942 - DNA, 22 bp, Artificial Sequence
  chemically synthesized
ttattgggatttctctgaatag

SEQ ID NO: 1148943 - DNA, 22 bp, Artificial Sequence
  chemically synthesized
gaagtctcaaatagctattcag

SEQ ID NO: 1148944 - DNA, 22 bp, Artificial Sequence
  chemically synthesized
ttgggatttctctgaatagcta

SEQ ID NO: 1148945 - DNA, 22 bp, Artificial Sequence
  chemically synthesized
ggatttctctgaatagctattt

SEQ ID NO: 1148946 - DNA, 22 bp, Artificial Sequence
  chemically synthesized
cctagaagtctcaaatagctat

SEQ ID NO: 1148947 - DNA, 22 bp, Artificial Sequence
  chemically synthesized
ctctgaatagctatttgagact

SEQ ID NO: 1148948 - DNA, 22 bp, Artificial Sequence
  chemically synthesized
tctgaatagctatttgagactt

SEQ ID NO: 1148949 - DNA, 22 bp, Artificial Sequence
  chemically synthesized
tgaatagctatttgagacttct

SEQ ID NO: 1148950 - DNA, 22 bp, Artificial Sequence
  chemically synthesized
aatagctatttgagacttctag

SEQ ID NO: 1148951 - DNA, 22 bp, Artificial Sequence
  chemically synthesized
agaaacaaagtagttgcctaga

SEQ ID NO: 1148952 - DNA, 22 bp, Artificial Sequence
  chemically synthesized
taagaaacaaagtagttgccta

SEQ ID NO: 1148953 - DNA, 22 bp, Artificial Sequence
  chemically synthesized
tttgagacttctaggcaactac

SEQ ID NO: 1148954 - DNA, 22 bp, Artificial Sequence
  chemically synthesized
gagacttctaggcaactacttt

SEQ ID NO: 1148955 - DNA, 22 bp, Artificial Sequence
  chemically synthesized
agacttctaggcaactactttg

SEQ ID NO: 1148956 - DNA, 22 bp, Artificial Sequence
  chemically synthesized
ctaggcaactactttgtttctt

SEQ ID NO: 1148957 - DNA, 22 bp, Artificial Sequence
  chemically synthesized
taggcaactactttgtttctta

SEQ ID NO: 1148958 - DNA, 22 bp, Artificial Sequence
  chemically synthesized
ggcaactactttgtttcttaga

SEQ ID NO: 1148959 - DNA, 22 bp, Artificial Sequence
  chemically synthesized
tgtaacaaaatgttctaagaaa

SEQ ID NO: 1148960 - DNA, 22 bp, Artificial Sequence
  chemically synthesized
tgttatgtaacaaaatgttcta

SEQ ID NO: 1148961 - DNA, 22 bp, Artificial Sequence
  chemically synthesized
gtgttatgtaacaaaatgttct

SEQ ID NO: 1148962 - DNA, 22 bp, Artificial Sequence
  chemically synthesized
ctttgtttcttagaacattttg

SEQ ID NO: 1148963 - DNA, 22 bp, Artificial Sequence
  chemically synthesized
ttgtgttatgtaacaaaatgtt

SEQ ID NO: 1148964 - DNA, 22 bp, Artificial Sequence
  chemically synthesized
tgtttcttagaacattttgtta

SEQ ID NO: 1148965 - DNA, 22 bp, Artificial Sequence
  chemically synthesized
gtttcttagaacattttgttac

SEQ ID NO: 1148966 - DNA, 22 bp, Artificial Sequence
  chemically synthesized
tttcttagaacattttgttaca

SEQ ID NO: 1148967 - DNA, 22 bp, Artificial Sequence
  chemically synthesized
cactcttgtgttatgtaacaaa

SEQ ID NO: 1148968 - DNA, 22 bp, Artificial Sequence
  chemically synthesized
cttagaacattttgttacataa

SEQ ID NO: 1148969 - DNA, 22 bp, Artificial Sequence
  chemically synthesized
tccactcttgtgttatgtaaca

SEQ ID NO: 1148970 - DNA, 22 bp, Artificial Sequence
  chemically synthesized
ttagaacattttgttacataac

SEQ ID NO: 1148971 - DNA, 22 bp, Artificial Sequence
  chemically synthesized
ctccactcttgtgttatgtaac

SEQ ID NO: 1148972 - DNA, 22 bp, Artificial Sequence
  chemically synthesized
agaacattttgttacataacac

SEQ ID NO: 1148973 - DNA, 22 bp, Artificial Sequence
  chemically synthesized
gaacattttgttacataacaca

SEQ ID NO: 1148974 - DNA, 22 bp, Artificial Sequence
  chemically synthesized
tttctccactcttgtgttatgt

SEQ ID NO: 1148975 - DNA, 22 bp, Artificial Sequence
  chemically synthesized
gtttctccactcttgtgttatg

SEQ ID NO: 1148976 - DNA, 22 bp, Artificial Sequence
  chemically synthesized
tgttacataacacaagagtgga

SEQ ID NO: 1148977 - DNA, 22 bp, Artificial Sequence
  chemically synthesized
gttacataacacaagagtggag

SEQ ID NO: 1148978 - DNA, 22 bp, Artificial Sequence
  chemically synthesized
ttacataacacaagagtggaga

SEQ ID NO: 1148979 - DNA, 22 bp, Artificial Sequence
  chemically synthesized
cataacacaagagtggagaaac

SEQ ID NO: 1148980 - DNA, 22 bp, Artificial Sequence
  chemically synthesized
ccagaaagtaacgggaaatgtc

SEQ ID NO: 1148981 - DNA, 22 bp, Artificial Sequence
  chemically synthesized
gccagaaagtaacgggaaatgt

SEQ ID NO: 1148982 - DNA, 22 bp, Artificial Sequence
  chemically synthesized
gggacatttcccgttactttct

SEQ ID NO: 1148983 - DNA, 22 bp, Artificial Sequence
  chemically synthesized
ggacatttcccgttactttctg

SEQ ID NO: 1148984 - DNA, 22 bp, Artificial Sequence
  chemically synthesized
cccgttactttctggcaaacgt

SEQ ID NO: 1148985 - DNA, 22 bp, Artificial Sequence
  chemically synthesized
ccgttactttctggcaaacgtg

SEQ ID NO: 1148986 - DNA, 22 bp, Artificial Sequence
  chemically synthesized
caagtagggacagcacgtttgc

SEQ ID NO: 1148987 - DNA, 22 bp, Artificial Sequence
  chemically synthesized
gcaagtagggacagcacgtttg

SEQ ID NO: 1148988 - DNA, 22 bp, Artificial Sequence
  chemically synthesized
tgcaagtagggacagcacgttt

SEQ ID NO: 1148989 - DNA, 22 bp, Artificial Sequence
  chemically synthesized
ctttctggcaaacgtgctgtcc

SEQ ID NO: 1148990 - DNA, 22 bp, Artificial Sequence
  chemically synthesized
ttttgcaagtagggacagcacg

SEQ ID NO: 1148991 - DNA, 22 bp, Artificial Sequence
  chemically synthesized
tctggcaaacgtgctgtcccta

SEQ ID NO: 1148992 - DNA, 22 bp, Artificial Sequence
  chemically synthesized
ttgttttgcaagtagggacagc

SEQ ID NO: 1148993 - DNA, 22 bp, Artificial Sequence
  chemically synthesized
ctggcaaacgtgctgtccctac

SEQ ID NO: 1148994 - DNA, 22 bp, Artificial Sequence
  chemically synthesized
tggcaaacgtgctgtccctact

SEQ ID NO: 1148995 - DNA, 22 bp, Artificial Sequence
  chemically synthesized
gcaaacgtgctgtccctacttg

SEQ ID NO: 1148996 - DNA, 22 bp, Artificial Sequence
  chemically synthesized
agcactgttgttttgcaagtag

SEQ ID NO: 1148997 - DNA, 22 bp, Artificial Sequence
  chemically synthesized
tccctacttgcaaaacaacagt

SEQ ID NO: 1148998 - DNA, 22 bp, Artificial Sequence
  chemically synthesized
ataggtgctaagcactgttgtt

SEQ ID NO: 1148999 - DNA, 22 bp, Artificial Sequence
  chemically synthesized
cttgcaaaacaacagtgcttag

SEQ ID NO: 1149000 - DNA, 22 bp, Artificial Sequence
  chemically synthesized
gactgataggtgctaagcactg

SEQ ID NO: 1149001 - DNA, 22 bp, Artificial Sequence
  chemically synthesized
gcaaaacaacagtgcttagcac

SEQ ID NO: 1149002 - DNA, 22 bp, Artificial Sequence
  chemically synthesized
caaaacaacagtgcttagcacc

SEQ ID NO: 1149003 - DNA, 22 bp, Artificial Sequence
  chemically synthesized
agagctagactgataggtgcta

SEQ ID NO: 1149004 - DNA, 22 bp, Artificial Sequence
  chemically synthesized
aatacctaagagctagactgat

SEQ ID NO: 1149005 - DNA, 22 bp, Artificial Sequence
  chemically synthesized
gaatacctaagagctagactga

SEQ ID NO: 1149006 - DNA, 22 bp, Artificial Sequence
  chemically synthesized
agcacctatcagtctagctctt

SEQ ID NO: 1149007 - DNA, 22 bp, Artificial Sequence
  chemically synthesized
gcacctatcagtctagctctta

SEQ ID NO: 1149008 - DNA, 22 bp, Artificial Sequence
  chemically synthesized
ccatagagtttgaatacctaag

SEQ ID NO: 1149009 - DNA, 22 bp, Artificial Sequence
  chemically synthesized
tcagtctagctcttaggtattc

SEQ ID NO: 1149010 - DNA, 22 bp, Artificial Sequence
  chemically synthesized
cacctgccatagagtttgaata

SEQ ID NO: 1149011 - DNA, 22 bp, Artificial Sequence
  chemically synthesized
ccacctgccatagagtttgaat

SEQ ID NO: 1149012 - DNA, 22 bp, Artificial Sequence
  chemically synthesized
gctcttaggtattcaaactcta

SEQ ID NO: 1149013 - DNA, 22 bp, Artificial Sequence
  chemically synthesized
ccttccacctgccatagagttt

SEQ ID NO: 1149014 - DNA, 22 bp, Artificial Sequence
  chemically synthesized
ttaggtattcaaactctatggc

SEQ ID NO: 1149015 - DNA, 22 bp, Artificial Sequence
  chemically synthesized
aggtattcaaactctatggcag

SEQ ID NO: 1149016 - DNA, 22 bp, Artificial Sequence
  chemically synthesized
ggtattcaaactctatggcagg

SEQ ID NO: 1149017 - DNA, 22 bp, Artificial Sequence
  chemically synthesized
ataagttcccttccacctgcca

SEQ ID NO: 1149018 - DNA, 22 bp, Artificial Sequence
  chemically synthesized
aaactctatggcaggtggaagg

SEQ ID NO: 1149019 - DNA, 22 bp, Artificial Sequence
  chemically synthesized
tatggcaggtggaagggaactt

SEQ ID NO: 1149020 - DNA, 22 bp, Artificial Sequence
  chemically synthesized
agccatcctaataagttccctt

SEQ ID NO: 1149021 - DNA, 22 bp, Artificial Sequence
  chemically synthesized
tggcaggtggaagggaacttat

SEQ ID NO: 1149022 - DNA, 22 bp, Artificial Sequence
  chemically synthesized
tgattcagccatcctaataagt

SEQ ID NO: 1149023 - DNA, 22 bp, Artificial Sequence
  chemically synthesized
agattgtgattcagccatccta

SEQ ID NO: 1149024 - DNA, 22 bp, Artificial Sequence
  chemically synthesized
gagattgtgattcagccatcct

SEQ ID NO: 1149025 - DNA, 22 bp, Artificial Sequence
  chemically synthesized
atgcatttgagattgtgattca

SEQ ID NO: 1149026 - DNA, 22 bp, Artificial Sequence
  chemically synthesized
attaggatggctgaatcacaat

SEQ ID NO: 1149027 - DNA, 22 bp, Artificial Sequence
  chemically synthesized
ttaggatggctgaatcacaatc

SEQ ID NO: 1149028 - DNA, 22 bp, Artificial Sequence
  chemically synthesized
ggatggctgaatcacaatctca

SEQ ID NO: 1149029 - DNA, 22 bp, Artificial Sequence
  chemically synthesized
aatcacaatctcaaatgcatga

SEQ ID NO: 1149030 - DNA, 22 bp, Artificial Sequence
  chemically synthesized
ggataaaaatgctcatgcattt

SEQ ID NO: 1149031 - DNA, 22 bp, Artificial Sequence
  chemically synthesized
aaatgcatgagcatttttatcc

SEQ ID NO: 1149032 - DNA, 22 bp, Artificial Sequence
  chemically synthesized
gaaaataagaagcctaggataa

SEQ ID NO: 1149033 - DNA, 22 bp, Artificial Sequence
  chemically synthesized
cgaaaataagaagcctaggata

SEQ ID NO: 1149034 - DNA, 22 bp, Artificial Sequence
  chemically synthesized
aggcttcgaaaataagaagcct

SEQ ID NO: 1149035 - DNA, 22 bp, Artificial Sequence
  chemically synthesized
ttatcctaggcttcttattttc

SEQ ID NO: 1149036 - DNA, 22 bp, Artificial Sequence
  chemically synthesized
tatcctaggcttcttattttcg

SEQ ID NO: 1149037 - DNA, 22 bp, Artificial Sequence
  chemically synthesized
atcctaggcttcttattttcga

SEQ ID NO: 1149038 - DNA, 22 bp, Artificial Sequence
  chemically synthesized
tcctaggcttcttattttcgaa

SEQ ID NO: 1149039 - DNA, 22 bp, Artificial Sequence
  chemically synthesized
aaatgttgaggcttcgaaaata

SEQ ID NO: 1149040 - DNA, 22 bp, Artificial Sequence
  chemically synthesized
taaaatgttgaggcttcgaaaa

SEQ ID NO: 1149041 - DNA, 22 bp, Artificial Sequence
  chemically synthesized
ggcttcttattttcgaagcctc

SEQ ID NO: 1149042 - DNA, 22 bp, Artificial Sequence
  chemically synthesized
cttattttcgaagcctcaacat

SEQ ID NO: 1149043 - DNA, 22 bp, Artificial Sequence
  chemically synthesized
tagtgttctaaaatgttgaggc

SEQ ID NO: 1149044 - DNA, 22 bp, Artificial Sequence
  chemically synthesized
ttattttcgaagcctcaacatt

SEQ ID NO: 1149045 - DNA, 22 bp, Artificial Sequence
  chemically synthesized
atagtgttctaaaatgttgagg

SEQ ID NO: 1149046 - DNA, 22 bp, Artificial Sequence
  chemically synthesized
tatagtgttctaaaatgttgag

SEQ ID NO: 1149047 - DNA, 22 bp, Artificial Sequence
  chemically synthesized
attttcgaagcctcaacatttt

SEQ ID NO: 1149048 - DNA, 22 bp, Artificial Sequence
  chemically synthesized
ttttcgaagcctcaacatttta

SEQ ID NO: 1149049 - DNA, 22 bp, Artificial Sequence
  chemically synthesized
tcgaagcctcaacattttagaa

SEQ ID NO: 1149050 - DNA, 22 bp, Artificial Sequence
  chemically synthesized
cgaagcctcaacattttagaac

SEQ ID NO: 1149051 - DNA, 22 bp, Artificial Sequence
  chemically synthesized
gaagcctcaacattttagaaca

SEQ ID NO: 1149052 - DNA, 22 bp, Artificial Sequence
  chemically synthesized
aacattttagaacactataaaa

SEQ ID NO: 1149053 - DNA, 22 bp, Artificial Sequence
  chemically synthesized
tagaacactataaaatcacttc

SEQ ID NO: 1149054 - DNA, 22 bp, Artificial Sequence
  chemically synthesized
agaacactataaaatcacttct

SEQ ID NO: 1149055 - DNA, 22 bp, Artificial Sequence
  chemically synthesized
gaacactataaaatcacttctt

SEQ ID NO: 1149056 - DNA, 22 bp, Artificial Sequence
  chemically synthesized
gagagacgaagtaaaaagaagt

SEQ ID NO: 1149057 - DNA, 22 bp, Artificial Sequence
  chemically synthesized
taaaatcacttctttttacttc

SEQ ID NO: 1149058 - DNA, 22 bp, Artificial Sequence
  chemically synthesized
ctttttacttcgtctctctaga

SEQ ID NO: 1149059 - DNA, 22 bp, Artificial Sequence
  chemically synthesized
tttttacttcgtctctctagat

SEQ ID NO: 1149060 - DNA, 22 bp, Artificial Sequence
  chemically synthesized
tttacttcgtctctctagattt

SEQ ID NO: 1149061 - DNA, 22 bp, Artificial Sequence
  chemically synthesized
ttacttcgtctctctagatttt

SEQ ID NO: 1149062 - DNA, 22 bp, Artificial Sequence
  chemically synthesized
tacttcgtctctctagattttc

SEQ ID NO: 1149063 - DNA, 22 bp, Artificial Sequence
  chemically synthesized
aaaatgtagtatgaaaatctag

SEQ ID NO: 1149064 - DNA, 22 bp, Artificial Sequence
  chemically synthesized
acttcgtctctctagattttca

SEQ ID NO: 1149065 - DNA, 22 bp, Artificial Sequence
  chemically synthesized
gaaaatgtagtatgaaaatcta

SEQ ID NO: 1149066 - DNA, 22 bp, Artificial Sequence
  chemically synthesized
cttcgtctctctagattttcat

SEQ ID NO: 1149067 - DNA, 22 bp, Artificial Sequence
  chemically synthesized
cgtctctctagattttcatact

SEQ ID NO: 1149068 - DNA, 22 bp, Artificial Sequence
  chemically synthesized
acttgaaaatgtagtatgaaaa

SEQ ID NO: 1149069 - DNA, 22 bp, Artificial Sequence
  chemically synthesized
gtctctctagattttcatacta

SEQ ID NO: 1149070 - DNA, 22 bp, Artificial Sequence
  chemically synthesized
cacttgaaaatgtagtatgaaa

SEQ ID NO: 1149071 - DNA, 22 bp, Artificial Sequence
  chemically synthesized
cttcacttgaaaatgtagtatg

SEQ ID NO: 1149072 - DNA, 22 bp, Artificial Sequence
  chemically synthesized
tctagattttcatactacattt

SEQ ID NO: 1149073 - DNA, 22 bp, Artificial Sequence
  chemically synthesized
tagattttcatactacattttc

SEQ ID NO: 1149074 - DNA, 22 bp, Artificial Sequence
  chemically synthesized
aattgcttcacttgaaaatgta

SEQ ID NO: 1149075 - DNA, 22 bp, Artificial Sequence
  chemically synthesized
gattttcatactacattttcaa

SEQ ID NO: 1149076 - DNA, 22 bp, Artificial Sequence
  chemically synthesized
taaattgcttcacttgaaaatg

SEQ ID NO: 1149077 - DNA, 22 bp, Artificial Sequence
  chemically synthesized
ttctaaattgcttcacttgaaa

SEQ ID NO: 1149078 - DNA, 22 bp, Artificial Sequence
  chemically synthesized
tcatactacattttcaagtgaa

SEQ ID NO: 1149079 - DNA, 22 bp, Artificial Sequence
  chemically synthesized
attctaaattgcttcacttgaa

SEQ ID NO: 1149080 - DNA, 22 bp, Artificial Sequence
  chemically synthesized
catactacattttcaagtgaag

SEQ ID NO: 1149081 - DNA, 22 bp, Artificial Sequence
  chemically synthesized
tattctaaattgcttcacttga

SEQ ID NO: 1149082 - DNA, 22 bp, Artificial Sequence
  chemically synthesized
atactacattttcaagtgaagc

SEQ ID NO: 1149083 - DNA, 22 bp, Artificial Sequence
  chemically synthesized
cattttcaagtgaagcaattta

SEQ ID NO: 1149084 - DNA, 22 bp, Artificial Sequence
  chemically synthesized
tcaagtgaagcaatttagaata

SEQ ID NO: 1149085 - DNA, 22 bp, Artificial Sequence
  chemically synthesized
caagtgaagcaatttagaataa

SEQ ID NO: 1149086 - DNA, 22 bp, Artificial Sequence
  chemically synthesized
aagtgaagcaatttagaataaa

SEQ ID NO: 1149087 - DNA, 22 bp, Artificial Sequence
  chemically synthesized
agaataaaatgactatgcatct

SEQ ID NO: 1149088 - DNA, 22 bp, Artificial Sequence
  chemically synthesized
cacacacaaaatagatgcatag

SEQ ID NO: 1149089 - DNA, 22 bp, Artificial Sequence
  chemically synthesized
gaataaaatgactatgcatcta

SEQ ID NO: 1149090 - DNA, 22 bp, Artificial Sequence
  chemically synthesized
tgcatctattttgtgtgtgcaa

SEQ ID NO: 1149091 - DNA, 22 bp, Artificial Sequence
  chemically synthesized
ttttgtgtgtgcaatctatact

SEQ ID NO: 1149092 - DNA, 22 bp, Artificial Sequence
  chemically synthesized
tgtgtgtgcaatctatactgcc

SEQ ID NO: 1149093 - DNA, 22 bp, Artificial Sequence
  chemically synthesized
gtgtgtgcaatctatactgcct

SEQ ID NO: 1149094 - DNA, 22 bp, Artificial Sequence
  chemically synthesized
tgtgtgcaatctatactgccta

SEQ ID NO: 1149095 - DNA, 22 bp, Artificial Sequence
  chemically synthesized
gaatgtcaaaggcatgataggc

SEQ ID NO: 1149096 - DNA, 22 bp, Artificial Sequence
  chemically synthesized
tggaatgtcaaaggcatgatag

SEQ ID NO: 1149097 - DNA, 22 bp, Artificial Sequence
  chemically synthesized
tactgcctatcatgcctttgac

SEQ ID NO: 1149098 - DNA, 22 bp, Artificial Sequence
  chemically synthesized
taagctctggaatgtcaaaggc

SEQ ID NO: 1149099 - DNA, 22 bp, Artificial Sequence
  chemically synthesized
cctatcatgcctttgacattcc

SEQ ID NO: 1149100 - DNA, 22 bp, Artificial Sequence
  chemically synthesized
accattataagctctggaatgt

SEQ ID NO: 1149101 - DNA, 22 bp, Artificial Sequence
  chemically synthesized
tcatgcctttgacattccagag

SEQ ID NO: 1149102 - DNA, 22 bp, Artificial Sequence
  chemically synthesized
ttaaccattataagctctggaa

SEQ ID NO: 1149103 - DNA, 22 bp, Artificial Sequence
  chemically synthesized
attaaccattataagctctgga

SEQ ID NO: 1149104 - DNA, 22 bp, Artificial Sequence
  chemically synthesized
tattaaccattataagctctgg

SEQ ID NO: 1149105 - DNA, 22 bp, Artificial Sequence
  chemically synthesized
tgacattccagagcttataatg

SEQ ID NO: 1149106 - DNA, 22 bp, Artificial Sequence
  chemically synthesized
gacattccagagcttataatgg

SEQ ID NO: 1149107 - DNA, 22 bp, Artificial Sequence
  chemically synthesized
acattccagagcttataatggt

SEQ ID NO: 1149108 - DNA, 22 bp, Artificial Sequence
  chemically synthesized
cagagcttataatggttaataa

SEQ ID NO: 1149109 - DNA, 22 bp, Artificial Sequence
  chemically synthesized
atggcaaaaagagttttattaa

SEQ ID NO: 1149110 - DNA, 22 bp, Artificial Sequence
  chemically synthesized
ataatggttaataaaactcttt

SEQ ID NO: 1149111 - DNA, 22 bp, Artificial Sequence
  chemically synthesized
gcctcatggcaaaaagagtttt

SEQ ID NO: 1149112 - DNA, 22 bp, Artificial Sequence
  chemically synthesized
taatggttaataaaactctttt

SEQ ID NO: 1149113 - DNA, 22 bp, Artificial Sequence
  chemically synthesized
ggcctcatggcaaaaagagttt

SEQ ID NO: 1149114 - DNA, 22 bp, Artificial Sequence
  chemically synthesized
tggcctcatggcaaaaagagtt

SEQ ID NO: 1149115 - DNA, 22 bp, Artificial Sequence
  chemically synthesized
ttggcctcatggcaaaaagagt

SEQ ID NO: 1149116 - DNA, 22 bp, Artificial Sequence
  chemically synthesized
catttttggcctcatggcaaaa

SEQ ID NO: 1149117 - DNA, 22 bp, Artificial Sequence
  chemically synthesized
ccatttttggcctcatggcaaa

SEQ ID NO: 1149118 - DNA, 22 bp, Artificial Sequence
  chemically synthesized
ataaaactctttttgccatgag

SEQ ID NO: 1149119 - DNA, 22 bp, Artificial Sequence
  chemically synthesized
atgtttccatttttggcctcat

SEQ ID NO: 1149120 - DNA, 22 bp, Artificial Sequence
  chemically synthesized
aatgtttccatttttggcctca

SEQ ID NO: 1149121 - DNA, 22 bp, Artificial Sequence
  chemically synthesized
taatgtttccatttttggcctc

SEQ ID NO: 1149122 - DNA, 22 bp, Artificial Sequence
  chemically synthesized
tttttgccatgaggccaaaaat

SEQ ID NO: 1149123 - DNA, 22 bp, Artificial Sequence
  chemically synthesized
tttgccatgaggccaaaaatgg

SEQ ID NO: 1149124 - DNA, 22 bp, Artificial Sequence
  chemically synthesized
ttgccatgaggccaaaaatgga

SEQ ID NO: 1149125 - DNA, 22 bp, Artificial Sequence
  chemically synthesized
aattttaatgtttccatttttg

SEQ ID NO: 1149126 - DNA, 22 bp, Artificial Sequence
  chemically synthesized
tgccatgaggccaaaaatggaa

SEQ ID NO: 1149127 - DNA, 22 bp, Artificial Sequence
  chemically synthesized
gccatgaggccaaaaatggaaa

SEQ ID NO: 1149128 - DNA, 22 bp, Artificial Sequence
  chemically synthesized
tgaattttaatgtttccatttt

SEQ ID NO: 1149129 - DNA, 22 bp, Artificial Sequence
  chemically synthesized
ccatgaggccaaaaatggaaac

SEQ ID NO: 1149130 - DNA, 22 bp, Artificial Sequence
  chemically synthesized
tcaaggacaactctgaatttta

SEQ ID NO: 1149131 - DNA, 22 bp, Artificial Sequence
  chemically synthesized
aacatgactgtcaaggacaact

SEQ ID NO: 1149132 - DNA, 22 bp, Artificial Sequence
  chemically synthesized
aaattcagagttgtccttgaca

SEQ ID NO: 1149133 - DNA, 22 bp, Artificial Sequence
  chemically synthesized
agagttgtccttgacagtcatg

SEQ ID NO: 1149134 - DNA, 22 bp, Artificial Sequence
  chemically synthesized
agaaaacacagactcaacatga

SEQ ID NO: 1149135 - DNA, 22 bp, Artificial Sequence
  chemically synthesized
tccttgacagtcatgttgagtc

SEQ ID NO: 1149136 - DNA, 22 bp, Artificial Sequence
  chemically synthesized
gacagtcatgttgagtctgtgt

SEQ ID NO: 1149137 - DNA, 22 bp, Artificial Sequence
  chemically synthesized
acagtcatgttgagtctgtgtt

SEQ ID NO: 1149138 - DNA, 22 bp, Artificial Sequence
  chemically synthesized
tataactcagaaaacacagact

SEQ ID NO: 1149139 - DNA, 22 bp, Artificial Sequence
  chemically synthesized
atataactcagaaaacacagac

SEQ ID NO: 1149140 - DNA, 22 bp, Artificial Sequence
  chemically synthesized
tcttatataactcagaaaacac

SEQ ID NO: 1149141 - DNA, 22 bp, Artificial Sequence
  chemically synthesized
agtctgtgttttctgagttata

SEQ ID NO: 1149142 - DNA, 22 bp, Artificial Sequence
  chemically synthesized
ccagtcctgtcttatataactc

SEQ ID NO: 1149143 - DNA, 22 bp, Artificial Sequence
  chemically synthesized
tgttttctgagttatataagac

SEQ ID NO: 1149144 - DNA, 22 bp, Artificial Sequence
  chemically synthesized
tctgagttatataagacaggac

SEQ ID NO: 1149145 - DNA, 22 bp, Artificial Sequence
  chemically synthesized
aaaatgttcccagtcctgtctt

SEQ ID NO: 1149146 - DNA, 22 bp, Artificial Sequence
  chemically synthesized
ctgagttatataagacaggact

SEQ ID NO: 1149147 - DNA, 22 bp, Artificial Sequence
  chemically synthesized
caaaatgttcccagtcctgtct

SEQ ID NO: 1149148 - DNA, 22 bp, Artificial Sequence
  chemically synthesized
tgagttatataagacaggactg

SEQ ID NO: 1149149 - DNA, 22 bp, Artificial Sequence
  chemically synthesized
agttatataagacaggactggg

SEQ ID NO: 1149150 - DNA, 22 bp, Artificial Sequence
  chemically synthesized
acaccttcaaaatgttcccagt

SEQ ID NO: 1149151 - DNA, 22 bp, Artificial Sequence
  chemically synthesized
tataagacaggactgggaacat

SEQ ID NO: 1149152 - DNA, 22 bp, Artificial Sequence
  chemically synthesized
ccggctgacaccttcaaaatgt

SEQ ID NO: 1149153 - DNA, 22 bp, Artificial Sequence
  chemically synthesized
aaacattcccggctgacacctt

SEQ ID NO: 1149154 - DNA, 22 bp, Artificial Sequence
  chemically synthesized
ggaacattttgaaggtgtcagc

SEQ ID NO: 1149155 - DNA, 22 bp, Artificial Sequence
  chemically synthesized
gaaacattcccggctgacacct

SEQ ID NO: 1149156 - DNA, 22 bp, Artificial Sequence
  chemically synthesized
tttgaaacattcccggctgaca

SEQ ID NO: 1149157 - DNA, 22 bp, Artificial Sequence
  chemically synthesized
ttatttgaaacattcccggctg

SEQ ID NO: 1149158 - DNA, 22 bp, Artificial Sequence
  chemically synthesized
tgaaggtgtcagccgggaatgt

SEQ ID NO: 1149159 - DNA, 22 bp, Artificial Sequence
  chemically synthesized
gaaggtgtcagccgggaatgtt

SEQ ID NO: 1149160 - DNA, 22 bp, Artificial Sequence
  chemically synthesized
attattatttgaaacattcccg

SEQ ID NO: 1149161 - DNA, 22 bp, Artificial Sequence
  chemically synthesized
aaggtgtcagccgggaatgttt

SEQ ID NO: 1149162 - DNA, 22 bp, Artificial Sequence
  chemically synthesized
aattattatttgaaacattccc

SEQ ID NO: 1149163 - DNA, 22 bp, Artificial Sequence
  chemically synthesized
taattattatttgaaacattcc

SEQ ID NO: 1149164 - DNA, 22 bp, Artificial Sequence
  chemically synthesized
tcattttaattattatttgaaa

SEQ ID NO: 1149165 - DNA, 22 bp, Artificial Sequence
  chemically synthesized
gccaccaaattatcattttaat

SEQ ID NO: 1149166 - DNA, 22 bp, Artificial Sequence
  chemically synthesized
caaataataattaaaatgataa

SEQ ID NO: 1149167 - DNA, 22 bp, Artificial Sequence
  chemically synthesized
aaataataattaaaatgataat

SEQ ID NO: 1149168 - DNA, 22 bp, Artificial Sequence
  chemically synthesized
tgatacactggccaccaaatta

SEQ ID NO: 1149169 - DNA, 22 bp, Artificial Sequence
  chemically synthesized
atgatacactggccaccaaatt

SEQ ID NO: 1149170 - DNA, 22 bp, Artificial Sequence
  chemically synthesized
aaatgataatttggtggccagt

SEQ ID NO: 1149171 - DNA, 22 bp, Artificial Sequence
  chemically synthesized
agaaaaccaacttatgatacac

SEQ ID NO: 1149172 - DNA, 22 bp, Artificial Sequence
  chemically synthesized
ggtggccagtgtatcataagtt

SEQ ID NO: 1149173 - DNA, 22 bp, Artificial Sequence
  chemically synthesized
gtggccagtgtatcataagttg

SEQ ID NO: 1149174 - DNA, 22 bp, Artificial Sequence
  chemically synthesized
aattcagaaaaccaacttatga

SEQ ID NO: 1149175 - DNA, 22 bp, Artificial Sequence
  chemically synthesized
actaaattcagaaaaccaactt

SEQ ID NO: 1149176 - DNA, 22 bp, Artificial Sequence
  chemically synthesized
gttttctgaatttagtcaattc

SEQ ID NO: 1149177 - DNA, 22 bp, Artificial Sequence
  chemically synthesized
aaggacagaaaagaattgacta

SEQ ID NO: 1149178 - DNA, 22 bp, Artificial Sequence
  chemically synthesized
tctgaatttagtcaattctttt

SEQ ID NO: 1149179 - DNA, 22 bp, Artificial Sequence
  chemically synthesized
attgaaggacagaaaagaattg

SEQ ID NO: 1149180 - DNA, 22 bp, Artificial Sequence
  chemically synthesized
ctgaatttagtcaattcttttc

SEQ ID NO: 1149181 - DNA, 22 bp, Artificial Sequence
  chemically synthesized
tgaatttagtcaattcttttct

SEQ ID NO: 1149182 - DNA, 22 bp, Artificial Sequence
  chemically synthesized
aatttagtcaattcttttctgt

SEQ ID NO: 1149183 - DNA, 22 bp, Artificial Sequence
  chemically synthesized
agtcaattcttttctgtccttc

SEQ ID NO: 1149184 - DNA, 22 bp, Artificial Sequence
  chemically synthesized
tatatactcattgaaggacaga

SEQ ID NO: 1149185 - DNA, 22 bp, Artificial Sequence
  chemically synthesized
gtcaattcttttctgtccttca

SEQ ID NO: 1149186 - DNA, 22 bp, Artificial Sequence
  chemically synthesized
ttttctgtccttcaatgagtat

SEQ ID NO: 1149187 - DNA, 22 bp, Artificial Sequence
  chemically synthesized
ttctgtccttcaatgagtatat

SEQ ID NO: 1149188 - DNA, 22 bp, Artificial Sequence
  chemically synthesized
tctgtccttcaatgagtatata

SEQ ID NO: 1149189 - DNA, 22 bp, Artificial Sequence
  chemically synthesized
ctgtccttcaatgagtatatat

SEQ ID NO: 1149190 - DNA, 22 bp, Artificial Sequence
  chemically synthesized
tgtccttcaatgagtatatata

SEQ ID NO: 1149191 - DNA, 22 bp, Artificial Sequence
  chemically synthesized
taatatatgtaattatatatac

SEQ ID NO: 1149192 - DNA, 22 bp, Artificial Sequence
  chemically synthesized
tccttcaatgagtatatataat

SEQ ID NO: 1149193 - DNA, 22 bp, Artificial Sequence
  chemically synthesized
gtaatatatgtaattatatata

SEQ ID NO: 1149194 - DNA, 22 bp, Artificial Sequence
  chemically synthesized
tgtaatatatgtaattatatat

SEQ ID NO: 1149195 - DNA, 22 bp, Artificial Sequence
  chemically synthesized
caatgagtatatataattacat

SEQ ID NO: 1149196 - DNA, 22 bp, Artificial Sequence
  chemically synthesized
aatgagtatatataattacata

SEQ ID NO: 1149197 - DNA, 22 bp, Artificial Sequence
  chemically synthesized
taattttgtaatatatgtaatt

SEQ ID NO: 1149198 - DNA, 22 bp, Artificial Sequence
  chemically synthesized
gtaattttgtaatatatgtaat

SEQ ID NO: 1149199 - DNA, 22 bp, Artificial Sequence
  chemically synthesized
cttgtaattttgtaatatatgt

SEQ ID NO: 1149200 - DNA, 22 bp, Artificial Sequence
  chemically synthesized
acttgtaattttgtaatatatg

SEQ ID NO: 1149201 - DNA, 22 bp, Artificial Sequence
  chemically synthesized
tttacttgtaattttgtaatat

SEQ ID NO: 1149202 - DNA, 22 bp, Artificial Sequence
  chemically synthesized
gcattatttacttgtaattttg

SEQ ID NO: 1149203 - DNA, 22 bp, Artificial Sequence
  chemically synthesized
catatattacaaaattacaagt

SEQ ID NO: 1149204 - DNA, 22 bp, Artificial Sequence
  chemically synthesized
caaaattacaagtaaataatgc

SEQ ID NO: 1149205 - DNA, 22 bp, Artificial Sequence
  chemically synthesized
catgtaaaaatgaaaactggca

SEQ ID NO: 1149206 - DNA, 22 bp, Artificial Sequence
  chemically synthesized
caagtaaataatgccagttttc

SEQ ID NO: 1149207 - DNA, 22 bp, Artificial Sequence
  chemically synthesized
acatgtaaaaatgaaaactggc

SEQ ID NO: 1149208 - DNA, 22 bp, Artificial Sequence
  chemically synthesized
tgaaaaagcaatttacatgtaa

SEQ ID NO: 1149209 - DNA, 22 bp, Artificial Sequence
  chemically synthesized
tcatttttacatgtaaattgct

SEQ ID NO: 1149210 - DNA, 22 bp, Artificial Sequence
  chemically synthesized
aaattgtgaaaaagcaatttac

SEQ ID NO: 1149211 - DNA, 22 bp, Artificial Sequence
  chemically synthesized
catttttacatgtaaattgctt

SEQ ID NO: 1149212 - DNA, 22 bp, Artificial Sequence
  chemically synthesized
atttttacatgtaaattgcttt

SEQ ID NO: 1149213 - DNA, 22 bp, Artificial Sequence
  chemically synthesized
ttacatgtaaattgctttttca

SEQ ID NO: 1149214 - DNA, 22 bp, Artificial Sequence
  chemically synthesized
tacatgtaaattgctttttcac

SEQ ID NO: 1149215 - DNA, 22 bp, Artificial Sequence
  chemically synthesized
acatgtaaattgctttttcaca

SEQ ID NO: 1149216 - DNA, 22 bp, Artificial Sequence
  chemically synthesized
catgtaaattgctttttcacaa

SEQ ID NO: 1149217 - DNA, 22 bp, Artificial Sequence
  chemically synthesized
agtaaaatatattaaaattgtg

SEQ ID NO: 1149218 - DNA, 22 bp, Artificial Sequence
  chemically synthesized
aagtaaaatatattaaaattgt

SEQ ID NO: 1149219 - DNA, 22 bp, Artificial Sequence
  chemically synthesized
ttaagtaaaatatattaaaatt

SEQ ID NO: 1149220 - DNA, 22 bp, Artificial Sequence
  chemically synthesized
cttaagtaaaatatattaaaat

SEQ ID NO: 1149221 - DNA, 22 bp, Artificial Sequence
  chemically synthesized
ctttttcacaattttaatatat

SEQ ID NO: 1149222 - DNA, 22 bp, Artificial Sequence
  chemically synthesized
tttcacaattttaatatatttt

SEQ ID NO: 1149223 - DNA, 22 bp, Artificial Sequence
  chemically synthesized
cacttcttaagtaaaatatatt

SEQ ID NO: 1149224 - DNA, 22 bp, Artificial Sequence
  chemically synthesized
ttcacaattttaatatatttta

SEQ ID NO: 1149225 - DNA, 22 bp, Artificial Sequence
  chemically synthesized
acacttcttaagtaaaatatat

SEQ ID NO: 1149226 - DNA, 22 bp, Artificial Sequence
  chemically synthesized
tcacaattttaatatattttac

SEQ ID NO: 1149227 - DNA, 22 bp, Artificial Sequence
  chemically synthesized
cacaattttaatatattttact

SEQ ID NO: 1149228 - DNA, 22 bp, Artificial Sequence
  chemically synthesized
ttacacttcttaagtaaaatat

SEQ ID NO: 1149229 - DNA, 22 bp, Artificial Sequence
  chemically synthesized
acaattttaatatattttactt

SEQ ID NO: 1149230 - DNA, 22 bp, Artificial Sequence
  chemically synthesized
cttacacttcttaagtaaaata

SEQ ID NO: 1149231 - DNA, 22 bp, Artificial Sequence
  chemically synthesized
tcttacacttcttaagtaaaat

SEQ ID NO: 1149232 - DNA, 22 bp, Artificial Sequence
  chemically synthesized
ttcttacacttcttaagtaaaa

SEQ ID NO: 1149233 - DNA, 22 bp, Artificial Sequence
  chemically synthesized
taatatattttacttaagaagt

SEQ ID NO: 1149234 - DNA, 22 bp, Artificial Sequence
  chemically synthesized
aatatattttacttaagaagtg

SEQ ID NO: 1149235 - DNA, 22 bp, Artificial Sequence
  chemically synthesized
atatattttacttaagaagtgt

SEQ ID NO: 1149236 - DNA, 22 bp, Artificial Sequence
  chemically synthesized
tacttaagaagtgtaagaaaaa

SEQ ID NO: 1149237 - DNA, 22 bp, Artificial Sequence
  chemically synthesized
acttaagaagtgtaagaaaaac

SEQ ID NO: 1149238 - DNA, 22 bp, Artificial Sequence
  chemically synthesized
catggatccaatgtttttctta

SEQ ID NO: 1149239 - DNA, 22 bp, Artificial Sequence
  chemically synthesized
cttaagaagtgtaagaaaaaca

SEQ ID NO: 1149240 - DNA, 22 bp, Artificial Sequence
  chemically synthesized
aagaagtgtaagaaaaacattg

SEQ ID NO: 1149241 - DNA, 22 bp, Artificial Sequence
  chemically synthesized
attccatggatccaatgttttt

SEQ ID NO: 1149242 - DNA, 22 bp, Artificial Sequence
  chemically synthesized
agaagtgtaagaaaaacattgg

SEQ ID NO: 1149243 - DNA, 22 bp, Artificial Sequence
  chemically synthesized
gattcattccatggatccaatg

SEQ ID NO: 1149244 - DNA, 22 bp, Artificial Sequence
  chemically synthesized
aataagagttggattcattcca

SEQ ID NO: 1149245 - DNA, 22 bp, Artificial Sequence
  chemically synthesized
gatccatggaatgaatccaact

SEQ ID NO: 1149246 - DNA, 22 bp, Artificial Sequence
  chemically synthesized
aaagactcaataagagttggat

SEQ ID NO: 1149247 - DNA, 22 bp, Artificial Sequence
  chemically synthesized
aaaagactcaataagagttgga

SEQ ID NO: 1149248 - DNA, 22 bp, Artificial Sequence
  chemically synthesized
taaaagactcaataagagttgg

SEQ ID NO: 1149249 - DNA, 22 bp, Artificial Sequence
  chemically synthesized
atcacatagactttaaaagact

SEQ ID NO: 1149250 - DNA, 22 bp, Artificial Sequence
  chemically synthesized
gatcacatagactttaaaagac

SEQ ID NO: 1149251 - DNA, 22 bp, Artificial Sequence
  chemically synthesized
ttattgagtcttttaaagtcta

SEQ ID NO: 1149252 - DNA, 22 bp, Artificial Sequence
  chemically synthesized
attgagtcttttaaagtctatg

SEQ ID NO: 1149253 - DNA, 22 bp, Artificial Sequence
  chemically synthesized
ttgagtcttttaaagtctatgt

SEQ ID NO: 1149254 - DNA, 22 bp, Artificial Sequence
  chemically synthesized
agtcttttaaagtctatgtgat

SEQ ID NO: 1149255 - DNA, 22 bp, Artificial Sequence
  chemically synthesized
ttaaagtctatgtgatcaaacg

SEQ ID NO: 1149256 - DNA, 22 bp, Artificial Sequence
  chemically synthesized
taaagtctatgtgatcaaacgt

SEQ ID NO: 1149257 - DNA, 22 bp, Artificial Sequence
  chemically synthesized
aaagtctatgtgatcaaacgta

SEQ ID NO: 1149258 - DNA, 22 bp, Artificial Sequence
  chemically synthesized
aagtctatgtgatcaaacgtac

SEQ ID NO: 1149259 - DNA, 22 bp, Artificial Sequence
  chemically synthesized
agtaatggagaatatagtacgt

SEQ ID NO: 1149260 - DNA, 22 bp, Artificial Sequence
  chemically synthesized
tgtgatcaaacgtactatattc

SEQ ID NO: 1149261 - DNA, 22 bp, Artificial Sequence
  chemically synthesized
tattctccattacttagttgtt

SEQ ID NO: 1149262 - DNA, 22 bp, Artificial Sequence
  chemically synthesized
tccattacttagttgttctgat

SEQ ID NO: 1149263 - DNA, 22 bp, Artificial Sequence
  chemically synthesized
cattacttagttgttctgattt

SEQ ID NO: 1149264 - DNA, 22 bp, Artificial Sequence
  chemically synthesized
cttagttgttctgattttgttt

SEQ ID NO: 1149265 - DNA, 22 bp, Artificial Sequence
  chemically synthesized
agttgttctgattttgtttcgt

SEQ ID NO: 1149266 - DNA, 22 bp, Artificial Sequence
  chemically synthesized
gttgttctgattttgtttcgtt

SEQ ID NO: 1149267 - DNA, 22 bp, Artificial Sequence
  chemically synthesized
taaaacaaatagatgaacgaaa

SEQ ID NO: 1149268 - DNA, 22 bp, Artificial Sequence
  chemically synthesized
ttctgattttgtttcgttcatc

SEQ ID NO: 1149269 - DNA, 22 bp, Artificial Sequence
  chemically synthesized
tgattttgtttcgttcatctat

SEQ ID NO: 1149270 - DNA, 22 bp, Artificial Sequence
  chemically synthesized
attttgtttcgttcatctattt

SEQ ID NO: 1149271 - DNA, 22 bp, Artificial Sequence
  chemically synthesized
caattataaaacaaatagatga

SEQ ID NO: 1149272 - DNA, 22 bp, Artificial Sequence
  chemically synthesized
ccaattataaaacaaatagatg

SEQ ID NO: 1149273 - DNA, 22 bp, Artificial Sequence
  chemically synthesized
tgtttcgttcatctatttgttt

SEQ ID NO: 1149274 - DNA, 22 bp, Artificial Sequence
  chemically synthesized
gtttcgttcatctatttgtttt

SEQ ID NO: 1149275 - DNA, 22 bp, Artificial Sequence
  chemically synthesized
tttcgttcatctatttgtttta

SEQ ID NO: 1149276 - DNA, 22 bp, Artificial Sequence
  chemically synthesized
cgttcatctatttgttttataa

SEQ ID NO: 1149277 - DNA, 22 bp, Artificial Sequence
  chemically synthesized
gttcatctatttgttttataat

SEQ ID NO: 1149278 - DNA, 22 bp, Artificial Sequence
  chemically synthesized
atctatttgttttataattgga

SEQ ID NO: 1149279 - DNA, 22 bp, Artificial Sequence
  chemically synthesized
tttgttttataattggaaatgg

SEQ ID NO: 1149280 - DNA, 22 bp, Artificial Sequence
  chemically synthesized
gttttataattggaaatggcat

SEQ ID NO: 1149281 - DNA, 22 bp, Artificial Sequence
  chemically synthesized
ttttataattggaaatggcatt

SEQ ID NO: 1149282 - DNA, 22 bp, Artificial Sequence
  chemically synthesized
atcaatatggcaagaatgccat

SEQ ID NO: 1149283 - DNA, 22 bp, Artificial Sequence
  chemically synthesized
tataattggaaatggcattctt

SEQ ID NO: 1149284 - DNA, 22 bp, Artificial Sequence
  chemically synthesized
gatcaatatggcaagaatgcca

SEQ ID NO: 1149285 - DNA, 22 bp, Artificial Sequence
  chemically synthesized
ataattggaaatggcattcttg

SEQ ID NO: 1149286 - DNA, 22 bp, Artificial Sequence
  chemically synthesized
taattggaaatggcattcttgc

SEQ ID NO: 1149287 - DNA, 22 bp, Artificial Sequence
  chemically synthesized
gaaatggcattcttgccatatt

SEQ ID NO: 1149288 - DNA, 22 bp, Artificial Sequence
  chemically synthesized
ttgccatattgatcaagggttt

SEQ ID NO: 1149289 - DNA, 22 bp, Artificial Sequence
  chemically synthesized
gccatattgatcaagggtttat

SEQ ID NO: 1149290 - DNA, 22 bp, Artificial Sequence
  chemically synthesized
ccatattgatcaagggtttata

SEQ ID NO: 1149291 - DNA, 22 bp, Artificial Sequence
  chemically synthesized
ccaagcataaaatataaaccct

SEQ ID NO: 1149292 - DNA, 22 bp, Artificial Sequence
  chemically synthesized
tgccaagcataaaatataaacc

SEQ ID NO: 1149293 - DNA, 22 bp, Artificial Sequence
  chemically synthesized
ctgccaagcataaaatataaac

SEQ ID NO: 1149294 - DNA, 22 bp, Artificial Sequence
  chemically synthesized
atcaagggtttatattttatgc

SEQ ID NO: 1149295 - DNA, 22 bp, Artificial Sequence
  chemically synthesized
gcacttctgccaagcataaaat

SEQ ID NO: 1149296 - DNA, 22 bp, Artificial Sequence
  chemically synthesized
cgttagcacttctgccaagcat

SEQ ID NO: 1149297 - DNA, 22 bp, Artificial Sequence
  chemically synthesized
acgttagcacttctgccaagca

SEQ ID NO: 1149298 - DNA, 22 bp, Artificial Sequence
  chemically synthesized
tacgttagcacttctgccaagc

SEQ ID NO: 1149299 - DNA, 22 bp, Artificial Sequence
  chemically synthesized
atattttatgcttggcagaagt

SEQ ID NO: 1149300 - DNA, 22 bp, Artificial Sequence
  chemically synthesized
tattttatgcttggcagaagtg

SEQ ID NO: 1149301 - DNA, 22 bp, Artificial Sequence
  chemically synthesized
tatgcttggcagaagtgctaac

SEQ ID NO: 1149302 - DNA, 22 bp, Artificial Sequence
  chemically synthesized
gtggtactttacgttagcactt

SEQ ID NO: 1149303 - DNA, 22 bp, Artificial Sequence
  chemically synthesized
atgcttggcagaagtgctaacg

SEQ ID NO: 1149304 - DNA, 22 bp, Artificial Sequence
  chemically synthesized
agtggtactttacgttagcact

SEQ ID NO: 1149305 - DNA, 22 bp, Artificial Sequence
  chemically synthesized
tgcttggcagaagtgctaacgt

SEQ ID NO: 1149306 - DNA, 22 bp, Artificial Sequence
  chemically synthesized
tagtggtactttacgttagcac

SEQ ID NO: 1149307 - DNA, 22 bp, Artificial Sequence
  chemically synthesized
tttagtggtactttacgttagc

SEQ ID NO: 1149308 - DNA, 22 bp, Artificial Sequence
  chemically synthesized
tctttagtggtactttacgtta

SEQ ID NO: 1149309 - DNA, 22 bp, Artificial Sequence
  chemically synthesized
ggcagaagtgctaacgtaaagt

SEQ ID NO: 1149310 - DNA, 22 bp, Artificial Sequence
  chemically synthesized
gcagaagtgctaacgtaaagta

SEQ ID NO: 1149311 - DNA, 22 bp, Artificial Sequence
  chemically synthesized
acaactctctttagtggtactt

SEQ ID NO: 1149312 - DNA, 22 bp, Artificial Sequence
  chemically synthesized
acgtaaagtaccactaaagaga

SEQ ID NO: 1149313 - DNA, 22 bp, Artificial Sequence
  chemically synthesized
tcatctcacaactctctttagt

SEQ ID NO: 1149314 - DNA, 22 bp, Artificial Sequence
  chemically synthesized
atgctatcatctcacaactctc

SEQ ID NO: 1149315 - DNA, 22 bp, Artificial Sequence
  chemically synthesized
aatgctatcatctcacaactct

SEQ ID NO: 1149316 - DNA, 22 bp, Artificial Sequence
  chemically synthesized
taatgctatcatctcacaactc

SEQ ID NO: 1149317 - DNA, 22 bp, Artificial Sequence
  chemically synthesized
gattttaatgctatcatctcac

SEQ ID NO: 1149318 - DNA, 22 bp, Artificial Sequence
  chemically synthesized
aagagagttgtgagatgatagc

SEQ ID NO: 1149319 - DNA, 22 bp, Artificial Sequence
  chemically synthesized
tgttagattttaatgctatcat

SEQ ID NO: 1149320 - DNA, 22 bp, Artificial Sequence
  chemically synthesized
gtgttagattttaatgctatca

SEQ ID NO: 1149321 - DNA, 22 bp, Artificial Sequence
  chemically synthesized
ttgtgttagattttaatgctat

SEQ ID NO: 1149322 - DNA, 22 bp, Artificial Sequence
  chemically synthesized
tgagatgatagcattaaaatct

SEQ ID NO: 1149323 - DNA, 22 bp, Artificial Sequence
  chemically synthesized
accgtaagtccagagggttctt

SEQ ID NO: 1149324 - DNA, 22 bp, Artificial Sequence
  chemically synthesized
aaatctaacacaagaaccctct

SEQ ID NO: 1149325 - DNA, 22 bp, Artificial Sequence
  chemically synthesized
tactcaccgtaagtccagaggg

SEQ ID NO: 1149326 - DNA, 22 bp, Artificial Sequence
  chemically synthesized
gtactcaccgtaagtccagagg

SEQ ID NO: 1149327 - DNA, 22 bp, Artificial Sequence
  chemically synthesized
acacaagaaccctctggactta

SEQ ID NO: 1149328 - DNA, 22 bp, Artificial Sequence
  chemically synthesized
cttgtactcaccgtaagtccag

SEQ ID NO: 1149329 - DNA, 22 bp, Artificial Sequence
  chemically synthesized
ccttgtactcaccgtaagtcca

SEQ ID NO: 1149330 - DNA, 22 bp, Artificial Sequence
  chemically synthesized
tttccttgtactcaccgtaagt

SEQ ID NO: 1149331 - DNA, 22 bp, Artificial Sequence
  chemically synthesized
atttccttgtactcaccgtaag

SEQ ID NO: 1149332 - DNA, 22 bp, Artificial Sequence
  chemically synthesized
tatttccttgtactcaccgtaa

SEQ ID NO: 1149333 - DNA, 22 bp, Artificial Sequence
  chemically synthesized
ctttatttccttgtactcaccg

SEQ ID NO: 1149334 - DNA, 22 bp, Artificial Sequence
  chemically synthesized
tggacttacggtgagtacaagg

SEQ ID NO: 1149335 - DNA, 22 bp, Artificial Sequence
  chemically synthesized
gacttacggtgagtacaaggaa

SEQ ID NO: 1149336 - DNA, 22 bp, Artificial Sequence
  chemically synthesized
cccactcctttatttccttgta

SEQ ID NO: 1149337 - DNA, 22 bp, Artificial Sequence
  chemically synthesized
ccccactcctttatttccttgt

SEQ ID NO: 1149338 - DNA, 22 bp, Artificial Sequence
  chemically synthesized
tccccactcctttatttccttg

SEQ ID NO: 1149339 - DNA, 22 bp, Artificial Sequence
  chemically synthesized
acggtgagtacaaggaaataaa

SEQ ID NO: 1149340 - DNA, 22 bp, Artificial Sequence
  chemically synthesized
cggtgagtacaaggaaataaag

SEQ ID NO: 1149341 - DNA, 22 bp, Artificial Sequence
  chemically synthesized
tagagagcctttccccactcct

SEQ ID NO: 1149342 - DNA, 22 bp, Artificial Sequence
  chemically synthesized
gtcactgtagagagcctttccc

SEQ ID NO: 1149343 - DNA, 22 bp, Artificial Sequence
  chemically synthesized
agtcactgtagagagcctttcc

SEQ ID NO: 1149344 - DNA, 22 bp, Artificial Sequence
  chemically synthesized
ttagtcactgtagagagccttt

SEQ ID NO: 1149345 - DNA, 22 bp, Artificial Sequence
  chemically synthesized
aacgttcttagtcactgtagag

SEQ ID NO: 1149346 - DNA, 22 bp, Artificial Sequence
  chemically synthesized
caacgttcttagtcactgtaga

SEQ ID NO: 1149347 - DNA, 22 bp, Artificial Sequence
  chemically synthesized
ttcaacgttcttagtcactgta

SEQ ID NO: 1149348 - DNA, 22 bp, Artificial Sequence
  chemically synthesized
gactcttcaacgttcttagtca

SEQ ID NO: 1149349 - DNA, 22 bp, Artificial Sequence
  chemically synthesized
tggactcttcaacgttcttagt

SEQ ID NO: 1149350 - DNA, 22 bp, Artificial Sequence
  chemically synthesized
tctacagtgactaagaacgttg

SEQ ID NO: 1149351 - DNA, 22 bp, Artificial Sequence
  chemically synthesized
tacagtgactaagaacgttgaa

SEQ ID NO: 1149352 - DNA, 22 bp, Artificial Sequence
  chemically synthesized
cagtgactaagaacgttgaaga

SEQ ID NO: 1149353 - DNA, 22 bp, Artificial Sequence
  chemically synthesized
cagcactctggactcttcaacg

SEQ ID NO: 1149354 - DNA, 22 bp, Artificial Sequence
  chemically synthesized
ctccagcactctggactcttca

SEQ ID NO: 1149355 - DNA, 22 bp, Artificial Sequence
  chemically synthesized
agaacgttgaagagtccagagt

SEQ ID NO: 1149356 - DNA, 22 bp, Artificial Sequence
  chemically synthesized
tgcaaatctactccagcactct

SEQ ID NO: 1149357 - DNA, 22 bp, Artificial Sequence
  chemically synthesized
atgcaaatctactccagcactc

SEQ ID NO: 1149358 - DNA, 22 bp, Artificial Sequence
  chemically synthesized
aagagtccagagtgctggagta

SEQ ID NO: 1149359 - DNA, 22 bp, Artificial Sequence
  chemically synthesized
aatcaaatgtaccttatgcaaa

SEQ ID NO: 1149360 - DNA, 22 bp, Artificial Sequence
  chemically synthesized
gagtagatttgcataaggtaca

SEQ ID NO: 1149361 - DNA, 22 bp, Artificial Sequence
  chemically synthesized
gaaataacattaaatcaaatgt

SEQ ID NO: 1149362 - DNA, 22 bp, Artificial Sequence
  chemically synthesized
gcataaggtacatttgatttaa

SEQ ID NO: 1149363 - DNA, 22 bp, Artificial Sequence
  chemically synthesized
cataaggtacatttgatttaat

SEQ ID NO: 1149364 - DNA, 22 bp, Artificial Sequence
  chemically synthesized
gatttaatgttatttccagtat

SEQ ID NO: 1149365 - DNA, 22 bp, Artificial Sequence
  chemically synthesized
atttaatgttatttccagtatc

SEQ ID NO: 1149366 - DNA, 22 bp, Artificial Sequence
  chemically synthesized
aatgttatttccagtatctctt

SEQ ID NO: 1149367 - DNA, 22 bp, Artificial Sequence
  chemically synthesized
atgttatttccagtatctcttc

SEQ ID NO: 1149368 - DNA, 22 bp, Artificial Sequence
  chemically synthesized
aaaagtcatagaggagaagaga

SEQ ID NO: 1149369 - DNA, 22 bp, Artificial Sequence
  chemically synthesized
aaaaagtcatagaggagaagag

SEQ ID NO: 1149370 - DNA, 22 bp, Artificial Sequence
  chemically synthesized
taaaaagtcatagaggagaaga

SEQ ID NO: 1149371 - DNA, 22 bp, Artificial Sequence
  chemically synthesized
tttccagtatctcttctcctct

SEQ ID NO: 1149372 - DNA, 22 bp, Artificial Sequence
  chemically synthesized
ccagtatctcttctcctctatg

SEQ ID NO: 1149373 - DNA, 22 bp, Artificial Sequence
  chemically synthesized
cagtatctcttctcctctatga

SEQ ID NO: 1149374 - DNA, 22 bp, Artificial Sequence
  chemically synthesized
ttctcctctatgactttttaaa

SEQ ID NO: 1149375 - DNA, 22 bp, Artificial Sequence
  chemically synthesized
ctcctctatgactttttaaaat

SEQ ID NO: 1149376 - DNA, 22 bp, Artificial Sequence
  chemically synthesized
tcctctatgactttttaaaatt

SEQ ID NO: 1149377 - DNA, 22 bp, Artificial Sequence
  chemically synthesized
ctctatgactttttaaaattgt

SEQ ID NO: 1149378 - DNA, 22 bp, Artificial Sequence
  chemically synthesized
agaaagaagaaatacaatttta

SEQ ID NO: 1149379 - DNA, 22 bp, Artificial Sequence
  chemically synthesized
tatgactttttaaaattgtatt

SEQ ID NO: 1149380 - DNA, 22 bp, Artificial Sequence
  chemically synthesized
tgactttttaaaattgtatttc

SEQ ID NO: 1149381 - DNA, 22 bp, Artificial Sequence
  chemically synthesized
gctgagaaagaagaaatacaat

SEQ ID NO: 1149382 - DNA, 22 bp, Artificial Sequence
  chemically synthesized
attagctgagaaagaagaaata

SEQ ID NO: 1149383 - DNA, 22 bp, Artificial Sequence
  chemically synthesized
tttaaaattgtatttcttcttt

SEQ ID NO: 1149384 - DNA, 22 bp, Artificial Sequence
  chemically synthesized
ttaaaattgtatttcttctttc

SEQ ID NO: 1149385 - DNA, 22 bp, Artificial Sequence
  chemically synthesized
ctaattagctgagaaagaagaa

SEQ ID NO: 1149386 - DNA, 22 bp, Artificial Sequence
  chemically synthesized
taaaattgtatttcttctttct

SEQ ID NO: 1149387 - DNA, 22 bp, Artificial Sequence
  chemically synthesized
aaaattgtatttcttctttctc

SEQ ID NO: 1149388 - DNA, 22 bp, Artificial Sequence
  chemically synthesized
aaattgtatttcttctttctca

SEQ ID NO: 1149389 - DNA, 22 bp, Artificial Sequence
  chemically synthesized
attcctaattagctgagaaaga

SEQ ID NO: 1149390 - DNA, 22 bp, Artificial Sequence
  chemically synthesized
aattcctaattagctgagaaag

SEQ ID NO: 1149391 - DNA, 22 bp, Artificial Sequence
  chemically synthesized
tatttcttctttctcagctaat

SEQ ID NO: 1149392 - DNA, 22 bp, Artificial Sequence
  chemically synthesized
gtttaattcctaattagctgag

SEQ ID NO: 1149393 - DNA, 22 bp, Artificial Sequence
  chemically synthesized
agtttaattcctaattagctga

SEQ ID NO: 1149394 - DNA, 22 bp, Artificial Sequence
  chemically synthesized
tagtttaattcctaattagctg

SEQ ID NO: 1149395 - DNA, 22 bp, Artificial Sequence
  chemically synthesized
ttagtttaattcctaattagct

SEQ ID NO: 1149396 - DNA, 22 bp, Artificial Sequence
  chemically synthesized
tttagtttaattcctaattagc

SEQ ID NO: 1149397 - DNA, 22 bp, Artificial Sequence
  chemically synthesized
cttctttctcagctaattagga

SEQ ID NO: 1149398 - DNA, 22 bp, Artificial Sequence
  chemically synthesized
ttttagtttaattcctaattag

SEQ ID NO: 1149399 - DNA, 22 bp, Artificial Sequence
  chemically synthesized
ttctttctcagctaattaggaa

SEQ ID NO: 1149400 - DNA, 22 bp, Artificial Sequence
  chemically synthesized
ctttctcagctaattaggaatt

SEQ ID NO: 1149401 - DNA, 22 bp, Artificial Sequence
  chemically synthesized
tttctcagctaattaggaatta

SEQ ID NO: 1149402 - DNA, 22 bp, Artificial Sequence
  chemically synthesized
accttttttagtttaattccta

SEQ ID NO: 1149403 - DNA, 22 bp, Artificial Sequence
  chemically synthesized
tctcagctaattaggaattaaa

SEQ ID NO: 1149404 - DNA, 22 bp, Artificial Sequence
  chemically synthesized
aaccttttttagtttaattcct

SEQ ID NO: 1149405 - DNA, 22 bp, Artificial Sequence
  chemically synthesized
ctcagctaattaggaattaaac

SEQ ID NO: 1149406 - DNA, 22 bp, Artificial Sequence
  chemically synthesized
tcagctaattaggaattaaact

SEQ ID NO: 1149407 - DNA, 22 bp, Artificial Sequence
  chemically synthesized
agctaattaggaattaaactaa

SEQ ID NO: 1149408 - DNA, 22 bp, Artificial Sequence
  chemically synthesized
attaggaattaaactaaaaaag

SEQ ID NO: 1149409 - DNA, 22 bp, Artificial Sequence
  chemically synthesized
ggaattaaactaaaaaaggtta

SEQ ID NO: 1149410 - DNA, 22 bp, Artificial Sequence
  chemically synthesized
aaaaaagtcagtttaacctttt

SEQ ID NO: 1149411 - DNA, 22 bp, Artificial Sequence
  chemically synthesized
aactaaaaaaggttaaactgac

SEQ ID NO: 1149412 - DNA, 22 bp, Artificial Sequence
  chemically synthesized
gtgtgctcaaaaaagtcagttt

SEQ ID NO: 1149413 - DNA, 22 bp, Artificial Sequence
  chemically synthesized
agtgtgctcaaaaaagtcagtt

SEQ ID NO: 1149414 - DNA, 22 bp, Artificial Sequence
  chemically synthesized
aaaaaggttaaactgacttttt

SEQ ID NO: 1149415 - DNA, 22 bp, Artificial Sequence
  chemically synthesized
tttagtgtgctcaaaaaagtca

SEQ ID NO: 1149416 - DNA, 22 bp, Artificial Sequence
  chemically synthesized
cagctatttagtgtgctcaaaa

SEQ ID NO: 1149417 - DNA, 22 bp, Artificial Sequence
  chemically synthesized
acagctatttagtgtgctcaaa

SEQ ID NO: 1149418 - DNA, 22 bp, Artificial Sequence
  chemically synthesized
aactgacttttttgagcacact

SEQ ID NO: 1149419 - DNA, 22 bp, Artificial Sequence
  chemically synthesized
tcttacagctatttagtgtgct

SEQ ID NO: 1149420 - DNA, 22 bp, Artificial Sequence
  chemically synthesized
gtcttacagctatttagtgtgc

SEQ ID NO: 1149421 - DNA, 22 bp, Artificial Sequence
  chemically synthesized
tgtcttacagctatttagtgtg

SEQ ID NO: 1149422 - DNA, 22 bp, Artificial Sequence
  chemically synthesized
acttttttgagcacactaaata

SEQ ID NO: 1149423 - DNA, 22 bp, Artificial Sequence
  chemically synthesized
ttgtcttacagctatttagtgt

SEQ ID NO: 1149424 - DNA, 22 bp, Artificial Sequence
  chemically synthesized
ttttgagcacactaaatagctg

SEQ ID NO: 1149425 - DNA, 22 bp, Artificial Sequence
  chemically synthesized
tttgagcacactaaatagctgt

SEQ ID NO: 1149426 - DNA, 22 bp, Artificial Sequence
  chemically synthesized
ttgagcacactaaatagctgta

SEQ ID NO: 1149427 - DNA, 22 bp, Artificial Sequence
  chemically synthesized
tgagcacactaaatagctgtaa

SEQ ID NO: 1149428 - DNA, 22 bp, Artificial Sequence
  chemically synthesized
gagcacactaaatagctgtaag

SEQ ID NO: 1149429 - DNA, 22 bp, Artificial Sequence
  chemically synthesized
agcacactaaatagctgtaaga

SEQ ID NO: 1149430 - DNA, 22 bp, Artificial Sequence
  chemically synthesized
ccatagcttttgtcttacagct

SEQ ID NO: 1149431 - DNA, 22 bp, Artificial Sequence
  chemically synthesized
accatagcttttgtcttacagc

SEQ ID NO: 1149432 - DNA, 22 bp, Artificial Sequence
  chemically synthesized
taccatagcttttgtcttacag

SEQ ID NO: 1149433 - DNA, 22 bp, Artificial Sequence
  chemically synthesized
ttttaccatagcttttgtctta

SEQ ID NO: 1149434 - DNA, 22 bp, Artificial Sequence
  chemically synthesized
ctgttttaccatagcttttgtc

SEQ ID NO: 1149435 - DNA, 22 bp, Artificial Sequence
  chemically synthesized
aatagctgtaagacaaaagcta

SEQ ID NO: 1149436 - DNA, 22 bp, Artificial Sequence
  chemically synthesized
actgttttaccatagcttttgt

SEQ ID NO: 1149437 - DNA, 22 bp, Artificial Sequence
  chemically synthesized
taagacaaaagctatggtaaaa

SEQ ID NO: 1149438 - DNA, 22 bp, Artificial Sequence
  chemically synthesized
agaaaataggagacgtgcttac

SEQ ID NO: 1149439 - DNA, 22 bp, Artificial Sequence
  chemically synthesized
tggtaaaacagtaagcacgtct

SEQ ID NO: 1149440 - DNA, 22 bp, Artificial Sequence
  chemically synthesized
aagtctgagaaaataggagacg

SEQ ID NO: 1149441 - DNA, 22 bp, Artificial Sequence
  chemically synthesized
gaagtctgagaaaataggagac

SEQ ID NO: 1149442 - DNA, 22 bp, Artificial Sequence
  chemically synthesized
gcatttgaagtctgagaaaata

SEQ ID NO: 1149443 - DNA, 22 bp, Artificial Sequence
  chemically synthesized
cgcatttgaagtctgagaaaat

SEQ ID NO: 1149444 - DNA, 22 bp, Artificial Sequence
  chemically synthesized
tttcgcatttgaagtctgagaa

SEQ ID NO: 1149445 - DNA, 22 bp, Artificial Sequence
  chemically synthesized
atttcgcatttgaagtctgaga

SEQ ID NO: 1149446 - DNA, 22 bp, Artificial Sequence
  chemically synthesized
ctattttctcagacttcaaatg

SEQ ID NO: 1149447 - DNA, 22 bp, Artificial Sequence
  chemically synthesized
atatttatttcgcatttgaagt

SEQ ID NO: 1149448 - DNA, 22 bp, Artificial Sequence
  chemically synthesized
ttttctcagacttcaaatgcga

SEQ ID NO: 1149449 - DNA, 22 bp, Artificial Sequence
  chemically synthesized
actaatatttatttcgcatttg

SEQ ID NO: 1149450 - DNA, 22 bp, Artificial Sequence
  chemically synthesized
tctcagacttcaaatgcgaaat

SEQ ID NO: 1149451 - DNA, 22 bp, Artificial Sequence
  chemically synthesized
ctcagacttcaaatgcgaaata

SEQ ID NO: 1149452 - DNA, 22 bp, Artificial Sequence
  chemically synthesized
tcagacttcaaatgcgaaataa

SEQ ID NO: 1149453 - DNA, 22 bp, Artificial Sequence
  chemically synthesized
tattcactaatatttatttcgc

SEQ ID NO: 1149454 - DNA, 22 bp, Artificial Sequence
  chemically synthesized
agacttcaaatgcgaaataaat

SEQ ID NO: 1149455 - DNA, 22 bp, Artificial Sequence
  chemically synthesized
caaatgcgaaataaatattagt

SEQ ID NO: 1149456 - DNA, 22 bp, Artificial Sequence
  chemically synthesized
aaatgcgaaataaatattagtg

SEQ ID NO: 1149457 - DNA, 22 bp, Artificial Sequence
  chemically synthesized
atacagttatattcactaatat

SEQ ID NO: 1149458 - DNA, 22 bp, Artificial Sequence
  chemically synthesized
gctaatacagttatattcacta

SEQ ID NO: 1149459 - DNA, 22 bp, Artificial Sequence
  chemically synthesized
aggagattagctaatacagtta

SEQ ID NO: 1149460 - DNA, 22 bp, Artificial Sequence
  chemically synthesized
gtgaatataactgtattagcta

SEQ ID NO: 1149461 - DNA, 22 bp, Artificial Sequence
  chemically synthesized
atattaaggagattagctaata

SEQ ID NO: 1149462 - DNA, 22 bp, Artificial Sequence
  chemically synthesized
ctgatattaaggagattagcta

SEQ ID NO: 1149463 - DNA, 22 bp, Artificial Sequence
  chemically synthesized
gctgatattaaggagattagct

SEQ ID NO: 1149464 - DNA, 22 bp, Artificial Sequence
  chemically synthesized
tgctgatattaaggagattagc

SEQ ID NO: 1149465 - DNA, 22 bp, Artificial Sequence
  chemically synthesized
tattttgctgatattaaggaga

SEQ ID NO: 1149466 - DNA, 22 bp, Artificial Sequence
  chemically synthesized
tattagctaatctccttaatat

SEQ ID NO: 1149467 - DNA, 22 bp, Artificial Sequence
  chemically synthesized
gctaatctccttaatatcagca

SEQ ID NO: 1149468 - DNA, 22 bp, Artificial Sequence
  chemically synthesized
ataatctgtattttgctgatat

SEQ ID NO: 1149469 - DNA, 22 bp, Artificial Sequence
  chemically synthesized
atctccttaatatcagcaaaat

SEQ ID NO: 1149470 - DNA, 22 bp, Artificial Sequence
  chemically synthesized
cttaatatcagcaaaatacaga

SEQ ID NO: 1149471 - DNA, 22 bp, Artificial Sequence
  chemically synthesized
catagttcataatctgtatttt

SEQ ID NO: 1149472 - DNA, 22 bp, Artificial Sequence
  chemically synthesized
aatatcagcaaaatacagatta

SEQ ID NO: 1149473 - DNA, 22 bp, Artificial Sequence
  chemically synthesized
atatcagcaaaatacagattat

SEQ ID NO: 1149474 - DNA, 22 bp, Artificial Sequence
  chemically synthesized
aacgttgcatagttcataatct

SEQ ID NO: 1149475 - DNA, 22 bp, Artificial Sequence
  chemically synthesized
tgaactatgcaacgttcagggt

SEQ ID NO: 1149476 - DNA, 22 bp, Artificial Sequence
  chemically synthesized
tgcaacgttcagggtttacttt

SEQ ID NO: 1149477 - DNA, 22 bp, Artificial Sequence
  chemically synthesized
taagaatcagtgtaaaagtaaa

SEQ ID NO: 1149478 - DNA, 22 bp, Artificial Sequence
  chemically synthesized
gtaagaatcagtgtaaaagtaa

SEQ ID NO: 1149479 - DNA, 22 bp, Artificial Sequence
  chemically synthesized
cttgtaagaatcagtgtaaaag

SEQ ID NO: 1149480 - DNA, 22 bp, Artificial Sequence
  chemically synthesized
ctacttgtaagaatcagtgtaa

SEQ ID NO: 1149481 - DNA, 22 bp, Artificial Sequence
  chemically synthesized
agggtttacttttacactgatt

SEQ ID NO: 1149482 - DNA, 22 bp, Artificial Sequence
  chemically synthesized
tgctacttgtaagaatcagtgt

SEQ ID NO: 1149483 - DNA, 22 bp, Artificial Sequence
  chemically synthesized
ctgctacttgtaagaatcagtg

SEQ ID NO: 1149484 - DNA, 22 bp, Artificial Sequence
  chemically synthesized
acttttacactgattcttacaa

SEQ ID NO: 1149485 - DNA, 22 bp, Artificial Sequence
  chemically synthesized
cttttacactgattcttacaag

SEQ ID NO: 1149486 - DNA, 22 bp, Artificial Sequence
  chemically synthesized
gcgtttctgctacttgtaagaa

SEQ ID NO: 1149487 - DNA, 22 bp, Artificial Sequence
  chemically synthesized
ttacactgattcttacaagtag

SEQ ID NO: 1149488 - DNA, 22 bp, Artificial Sequence
  chemically synthesized
tacactgattcttacaagtagc

SEQ ID NO: 1149489 - DNA, 22 bp, Artificial Sequence
  chemically synthesized
acactgattcttacaagtagca

SEQ ID NO: 1149490 - DNA, 22 bp, Artificial Sequence
  chemically synthesized
cactgattcttacaagtagcag

SEQ ID NO: 1149491 - DNA, 22 bp, Artificial Sequence
  chemically synthesized
tgtctggcgtttctgctacttg

SEQ ID NO: 1149492 - DNA, 22 bp, Artificial Sequence
  chemically synthesized
atgtctggcgtttctgctactt

SEQ ID NO: 1149493 - DNA, 22 bp, Artificial Sequence
  chemically synthesized
tatgtctggcgtttctgctact

SEQ ID NO: 1149494 - DNA, 22 bp, Artificial Sequence
  chemically synthesized
ttatgtctggcgtttctgctac

SEQ ID NO: 1149495 - DNA, 22 bp, Artificial Sequence
  chemically synthesized
tttatgtctggcgtttctgcta

SEQ ID NO: 1149496 - DNA, 22 bp, Artificial Sequence
  chemically synthesized
attcttacaagtagcagaaacg

SEQ ID NO: 1149497 - DNA, 22 bp, Artificial Sequence
  chemically synthesized
ttacaagtagcagaaacgccag

SEQ ID NO: 1149498 - DNA, 22 bp, Artificial Sequence
  chemically synthesized
cagctttttatgtctggcgttt

SEQ ID NO: 1149499 - DNA, 22 bp, Artificial Sequence
  chemically synthesized
acaagtagcagaaacgccagac

SEQ ID NO: 1149500 - DNA, 22 bp, Artificial Sequence
  chemically synthesized
caagtagcagaaacgccagaca

SEQ ID NO: 1149501 - DNA, 22 bp, Artificial Sequence
  chemically synthesized
actccagctttttatgtctggc

SEQ ID NO: 1149502 - DNA, 22 bp, Artificial Sequence
  chemically synthesized
aactccagctttttatgtctgg

SEQ ID NO: 1149503 - DNA, 22 bp, Artificial Sequence
  chemically synthesized
taactccagctttttatgtctg

SEQ ID NO: 1149504 - DNA, 22 bp, Artificial Sequence
  chemically synthesized
ttaactccagctttttatgtct

SEQ ID NO: 1149505 - DNA, 22 bp, Artificial Sequence
  chemically synthesized
tttaactccagctttttatgtc

SEQ ID NO: 1149506 - DNA, 22 bp, Artificial Sequence
  chemically synthesized
aactttttaactccagcttttt

SEQ ID NO: 1149507 - DNA, 22 bp, Artificial Sequence
  chemically synthesized
gcagaacaattgaactttttaa

SEQ ID NO: 1149508 - DNA, 22 bp, Artificial Sequence
  chemically synthesized
ggcagaacaattgaacttttta

SEQ ID NO: 1149509 - DNA, 22 bp, Artificial Sequence
  chemically synthesized
gtttggcagaacaattgaactt

SEQ ID NO: 1149510 - DNA, 22 bp, Artificial Sequence
  chemically synthesized
ctagtttggcagaacaattgaa

SEQ ID NO: 1149511 - DNA, 22 bp, Artificial Sequence
  chemically synthesized
gagttaaaaagttcaattgttc

SEQ ID NO: 1149512 - DNA, 22 bp, Artificial Sequence
  chemically synthesized
aaaagttcaattgttctgccaa

SEQ ID NO: 1149513 - DNA, 22 bp, Artificial Sequence
  chemically synthesized
atggattcctagtttggcagaa

SEQ ID NO: 1149514 - DNA, 22 bp, Artificial Sequence
  chemically synthesized
ttcatggattcctagtttggca

SEQ ID NO: 1149515 - DNA, 22 bp, Artificial Sequence
  chemically synthesized
attcatggattcctagtttggc

SEQ ID NO: 1149516 - DNA, 22 bp, Artificial Sequence
  chemically synthesized
tattcatggattcctagtttgg

SEQ ID NO: 1149517 - DNA, 22 bp, Artificial Sequence
  chemically synthesized
aattgttctgccaaactaggaa

SEQ ID NO: 1149518 - DNA, 22 bp, Artificial Sequence
  chemically synthesized
ttctgccaaactaggaatccat

SEQ ID NO: 1149519 - DNA, 22 bp, Artificial Sequence
  chemically synthesized
tgccaaactaggaatccatgaa

SEQ ID NO: 1149520 - DNA, 22 bp, Artificial Sequence
  chemically synthesized
ccaaactaggaatccatgaata

SEQ ID NO: 1149521 - DNA, 22 bp, Artificial Sequence
  chemically synthesized
ccccaatgatcaaggcctttat

SEQ ID NO: 1149522 - DNA, 22 bp, Artificial Sequence
  chemically synthesized
ggaatccatgaataaaggcctt

SEQ ID NO: 1149523 - DNA, 22 bp, Artificial Sequence
  chemically synthesized
accccaatgatcaaggccttta

SEQ ID NO: 1149524 - DNA, 22 bp, Artificial Sequence
  chemically synthesized
taccccaatgatcaaggccttt

SEQ ID NO: 1149525 - DNA, 22 bp, Artificial Sequence
  chemically synthesized
tttaccccaatgatcaaggcct

SEQ ID NO: 1149526 - DNA, 22 bp, Artificial Sequence
  chemically synthesized
gatcattggggtaaagaatgcc

SEQ ID NO: 1149527 - DNA, 22 bp, Artificial Sequence
  chemically synthesized
gagaaacaggcaggcattcttt

SEQ ID NO: 1149528 - DNA, 22 bp, Artificial Sequence
  chemically synthesized
atcattggggtaaagaatgcct

SEQ ID NO: 1149529 - DNA, 22 bp, Artificial Sequence
  chemically synthesized
caactggagaaacaggcaggca

SEQ ID NO: 1149530 - DNA, 22 bp, Artificial Sequence
  chemically synthesized
ccaactggagaaacaggcaggc

SEQ ID NO: 1149531 - DNA, 22 bp, Artificial Sequence
  chemically synthesized
gggtaaagaatgcctgcctgtt

SEQ ID NO: 1149532 - DNA, 22 bp, Artificial Sequence
  chemically synthesized
tccaactggagaaacaggcagg

SEQ ID NO: 1149533 - DNA, 22 bp, Artificial Sequence
  chemically synthesized
tttccaactggagaaacaggca

SEQ ID NO: 1149534 - DNA, 22 bp, Artificial Sequence
  chemically synthesized
ctttccaactggagaaacaggc

SEQ ID NO: 1149535 - DNA, 22 bp, Artificial Sequence
  chemically synthesized
atttctttccaactggagaaac

SEQ ID NO: 1149536 - DNA, 22 bp, Artificial Sequence
  chemically synthesized
agaattcatttctttccaactg

SEQ ID NO: 1149537 - DNA, 22 bp, Artificial Sequence
  chemically synthesized
gagaattcatttctttccaact

SEQ ID NO: 1149538 - DNA, 22 bp, Artificial Sequence
  chemically synthesized
cctgtttctccagttggaaaga

SEQ ID NO: 1149539 - DNA, 22 bp, Artificial Sequence
  chemically synthesized
ttgagaattcatttctttccaa

SEQ ID NO: 1149540 - DNA, 22 bp, Artificial Sequence
  chemically synthesized
tttctccagttggaaagaaatg

SEQ ID NO: 1149541 - DNA, 22 bp, Artificial Sequence
  chemically synthesized
ctccagttggaaagaaatgaat

SEQ ID NO: 1149542 - DNA, 22 bp, Artificial Sequence
  chemically synthesized
tccagttggaaagaaatgaatt

SEQ ID NO: 1149543 - DNA, 22 bp, Artificial Sequence
  chemically synthesized
aatactcttgagaattcatttc

SEQ ID NO: 1149544 - DNA, 22 bp, Artificial Sequence
  chemically synthesized
aaatactcttgagaattcattt

SEQ ID NO: 1149545 - DNA, 22 bp, Artificial Sequence
  chemically synthesized
cagttggaaagaaatgaattct

SEQ ID NO: 1149546 - DNA, 22 bp, Artificial Sequence
  chemically synthesized
taaatactcttgagaattcatt

SEQ ID NO: 1149547 - DNA, 22 bp, Artificial Sequence
  chemically synthesized
ttaaatactcttgagaattcat

SEQ ID NO: 1149548 - DNA, 22 bp, Artificial Sequence
  chemically synthesized
tttaaatactcttgagaattca

SEQ ID NO: 1149549 - DNA, 22 bp, Artificial Sequence
  chemically synthesized
ttttaaatactcttgagaattc

SEQ ID NO: 1149550 - DNA, 22 bp, Artificial Sequence
  chemically synthesized
tttttaaatactcttgagaatt

SEQ ID NO: 1149551 - DNA, 22 bp, Artificial Sequence
  chemically synthesized
gaaagaaatgaattctcaagag

SEQ ID NO: 1149552 - DNA, 22 bp, Artificial Sequence
  chemically synthesized
ttttttttaaatactcttgaga

SEQ ID NO: 1149553 - DNA, 22 bp, Artificial Sequence
  chemically synthesized
gcatattattttttttaaatac

SEQ ID NO: 1149554 - DNA, 22 bp, Artificial Sequence
  chemically synthesized
agcatattattttttttaaata

SEQ ID NO: 1149555 - DNA, 22 bp, Artificial Sequence
  chemically synthesized
tagcatattattttttttaaat

SEQ ID NO: 1149556 - DNA, 22 bp, Artificial Sequence
  chemically synthesized
tcaagagtatttaaaaaaaata

SEQ ID NO: 1149557 - DNA, 22 bp, Artificial Sequence
  chemically synthesized
aagagtatttaaaaaaaataat

SEQ ID NO: 1149558 - DNA, 22 bp, Artificial Sequence
  chemically synthesized
caacactttagcatattatttt

SEQ ID NO: 1149559 - DNA, 22 bp, Artificial Sequence
  chemically synthesized
acaacactttagcatattattt

SEQ ID NO: 1149560 - DNA, 22 bp, Artificial Sequence
  chemically synthesized
aaaaaaaataatatgctaaagt

SEQ ID NO: 1149561 - DNA, 22 bp, Artificial Sequence
  chemically synthesized
aaaaaaataatatgctaaagtg

SEQ ID NO: 1149562 - DNA, 22 bp, Artificial Sequence
  chemically synthesized
aatatagccttacaacacttta

SEQ ID NO: 1149563 - DNA, 22 bp, Artificial Sequence
  chemically synthesized
taattaaatatagccttacaac

SEQ ID NO: 1149564 - DNA, 22 bp, Artificial Sequence
  chemically synthesized
aaattgtaattaaatatagcct

SEQ ID NO: 1149565 - DNA, 22 bp, Artificial Sequence
  chemically synthesized
aaaattgtaattaaatatagcc

SEQ ID NO: 1149566 - DNA, 22 bp, Artificial Sequence
  chemically synthesized
aagtgttgtaaggctatattta

SEQ ID NO: 1149567 - DNA, 22 bp, Artificial Sequence
  chemically synthesized
taaggctatatttaattacaat

SEQ ID NO: 1149568 - DNA, 22 bp, Artificial Sequence
  chemically synthesized
tatttaattacaattttaaata

SEQ ID NO: 1149569 - DNA, 22 bp, Artificial Sequence
  chemically synthesized
aattacaattttaaatactgac

SEQ ID NO: 1149570 - DNA, 22 bp, Artificial Sequence
  chemically synthesized
attacaattttaaatactgact

SEQ ID NO: 1149571 - DNA, 22 bp, Artificial Sequence
  chemically synthesized
aaatccataagaagtcagtatt

SEQ ID NO: 1149572 - DNA, 22 bp, Artificial Sequence
  chemically synthesized
caattttaaatactgacttctt

SEQ ID NO: 1149573 - DNA, 22 bp, Artificial Sequence
  chemically synthesized
taaatactgacttcttatggat

SEQ ID NO: 1149574 - DNA, 22 bp, Artificial Sequence
  chemically synthesized
tgacaaattgaaatccataaga

SEQ ID NO: 1149575 - DNA, 22 bp, Artificial Sequence
  chemically synthesized
aaatactgacttcttatggatt

SEQ ID NO: 1149576 - DNA, 22 bp, Artificial Sequence
  chemically synthesized
aatactgacttcttatggattt

SEQ ID NO: 1149577 - DNA, 22 bp, Artificial Sequence
  chemically synthesized
atctatgacaaattgaaatcca

SEQ ID NO: 1149578 - DNA, 22 bp, Artificial Sequence
  chemically synthesized
acttcttatggatttcaatttg

SEQ ID NO: 1149579 - DNA, 22 bp, Artificial Sequence
  chemically synthesized
cttatggatttcaatttgtcat

SEQ ID NO: 1149580 - DNA, 22 bp, Artificial Sequence
  chemically synthesized
ttatggatttcaatttgtcata

SEQ ID NO: 1149581 - DNA, 22 bp, Artificial Sequence
  chemically synthesized
tataaattcatctatgacaaat

SEQ ID NO: 1149582 - DNA, 22 bp, Artificial Sequence
  chemically synthesized
atggatttcaatttgtcataga

SEQ ID NO: 1149583 - DNA, 22 bp, Artificial Sequence
  chemically synthesized
tggatttcaatttgtcatagat

SEQ ID NO: 1149584 - DNA, 22 bp, Artificial Sequence
  chemically synthesized
cgttgtataaattcatctatga

SEQ ID NO: 1149585 - DNA, 22 bp, Artificial Sequence
  chemically synthesized
caatttgtcatagatgaattta

SEQ ID NO: 1149586 - DNA, 22 bp, Artificial Sequence
  chemically synthesized
aatttgtcatagatgaatttat

SEQ ID NO: 1149587 - DNA, 22 bp, Artificial Sequence
  chemically synthesized
gtcatagatgaatttatacaac

SEQ ID NO: 1149588 - DNA, 22 bp, Artificial Sequence
  chemically synthesized
tcatagatgaatttatacaacg

SEQ ID NO: 1149589 - DNA, 22 bp, Artificial Sequence
  chemically synthesized
gcaaatccaatataaatctccg

SEQ ID NO: 1149590 - DNA, 22 bp, Artificial Sequence
  chemically synthesized
attagcaaatccaatataaatc

SEQ ID NO: 1149591 - DNA, 22 bp, Artificial Sequence
  chemically synthesized
aattagcaaatccaatataaat

SEQ ID NO: 1149592 - DNA, 22 bp, Artificial Sequence
  chemically synthesized
atacaacggagatttatattgg

SEQ ID NO: 1149593 - DNA, 22 bp, Artificial Sequence
  chemically synthesized
tacaacggagatttatattgga

SEQ ID NO: 1149594 - DNA, 22 bp, Artificial Sequence
  chemically synthesized
aggcttaattagcaaatccaat

SEQ ID NO: 1149595 - DNA, 22 bp, Artificial Sequence
  chemically synthesized
caggcttaattagcaaatccaa

SEQ ID NO: 1149596 - DNA, 22 bp, Artificial Sequence
  chemically synthesized
atatttcaggcttaattagcaa

SEQ ID NO: 1149597 - DNA, 22 bp, Artificial Sequence
  chemically synthesized
atattggatttgctaattaagc

SEQ ID NO: 1149598 - DNA, 22 bp, Artificial Sequence
  chemically synthesized
tattggatttgctaattaagcc

SEQ ID NO: 1149599 - DNA, 22 bp, Artificial Sequence
  chemically synthesized
gctcatatttcaggcttaatta

SEQ ID NO: 1149600 - DNA, 22 bp, Artificial Sequence
  chemically synthesized
ggctcatatttcaggcttaatt

SEQ ID NO: 1149601 - DNA, 22 bp, Artificial Sequence
  chemically synthesized
tttggctcatatttcaggctta

SEQ ID NO: 1149602 - DNA, 22 bp, Artificial Sequence
  chemically synthesized
gatttgctaattaagcctgaaa

SEQ ID NO: 1149603 - DNA, 22 bp, Artificial Sequence
  chemically synthesized
gctaattaagcctgaaatatga

SEQ ID NO: 1149604 - DNA, 22 bp, Artificial Sequence
  chemically synthesized
ctaattaagcctgaaatatgag

SEQ ID NO: 1149605 - DNA, 22 bp, Artificial Sequence
  chemically synthesized
gaaactatttggctcatatttc

SEQ ID NO: 1149606 - DNA, 22 bp, Artificial Sequence
  chemically synthesized
ggaaactatttggctcatattt

SEQ ID NO: 1149607 - DNA, 22 bp, Artificial Sequence
  chemically synthesized
attaagcctgaaatatgagcca

SEQ ID NO: 1149608 - DNA, 22 bp, Artificial Sequence
  chemically synthesized
tatttggaaactatttggctca

SEQ ID NO: 1149609 - DNA, 22 bp, Artificial Sequence
  chemically synthesized
agcctgaaatatgagccaaata

SEQ ID NO: 1149610 - DNA, 22 bp, Artificial Sequence
  chemically synthesized
aaatatgagccaaatagtttcc

SEQ ID NO: 1149611 - DNA, 22 bp, Artificial Sequence
  chemically synthesized
gggatgcatctatatttggaaa

SEQ ID NO: 1149612 - DNA, 22 bp, Artificial Sequence
  chemically synthesized
tagggatgcatctatatttgga

SEQ ID NO: 1149613 - DNA, 22 bp, Artificial Sequence
  chemically synthesized
tctagggatgcatctatatttg

SEQ ID NO: 1149614 - DNA, 22 bp, Artificial Sequence
  chemically synthesized
ctctagggatgcatctatattt

SEQ ID NO: 1149615 - DNA, 22 bp, Artificial Sequence
  chemically synthesized
tgtacttctctagggatgcatc

SEQ ID NO: 1149616 - DNA, 22 bp, Artificial Sequence
  chemically synthesized
gtgtacttctctagggatgcat

SEQ ID NO: 1149617 - DNA, 22 bp, Artificial Sequence
  chemically synthesized
tgtgtacttctctagggatgca

SEQ ID NO: 1149618 - DNA, 22 bp, Artificial Sequence
  chemically synthesized
ccaaatatagatgcatccctag

SEQ ID NO: 1149619 - DNA, 22 bp, Artificial Sequence
  chemically synthesized
ttgtgtacttctctagggatgc

SEQ ID NO: 1149620 - DNA, 22 bp, Artificial Sequence
  chemically synthesized
caaatatagatgcatccctaga

SEQ ID NO: 1149621 - DNA, 22 bp, Artificial Sequence
  chemically synthesized
acagacaaacatttttgtgtac

SEQ ID NO: 1149622 - DNA, 22 bp, Artificial Sequence
  chemically synthesized
tgacagacaaacatttttgtgt

SEQ ID NO: 1149623 - DNA, 22 bp, Artificial Sequence
  chemically synthesized
ctgacagacaaacatttttgtg

SEQ ID NO: 1149624 - DNA, 22 bp, Artificial Sequence
  chemically synthesized
tctgacagacaaacatttttgt

SEQ ID NO: 1149625 - DNA, 22 bp, Artificial Sequence
  chemically synthesized
gagaagtacacaaaaatgtttg

SEQ ID NO: 1149626 - DNA, 22 bp, Artificial Sequence
  chemically synthesized
ttttctgacagacaaacatttt

SEQ ID NO: 1149627 - DNA, 22 bp, Artificial Sequence
  chemically synthesized
aaggtattattttctgacagac

SEQ ID NO: 1149628 - DNA, 22 bp, Artificial Sequence
  chemically synthesized
gaaggtattattttctgacaga

SEQ ID NO: 1149629 - DNA, 22 bp, Artificial Sequence
  chemically synthesized
atttgaaggtattattttctga

SEQ ID NO: 1149630 - DNA, 22 bp, Artificial Sequence
  chemically synthesized
aatttgaaggtattattttctg

SEQ ID NO: 1149631 - DNA, 22 bp, Artificial Sequence
  chemically synthesized
taatttgaaggtattattttct

SEQ ID NO: 1149632 - DNA, 22 bp, Artificial Sequence
  chemically synthesized
gtctgtcagaaaataatacctt

SEQ ID NO: 1149633 - DNA, 22 bp, Artificial Sequence
  chemically synthesized
tctgtcagaaaataataccttc

SEQ ID NO: 1149634 - DNA, 22 bp, Artificial Sequence
  chemically synthesized
caatattttaatttgaaggtat

SEQ ID NO: 1149635 - DNA, 22 bp, Artificial Sequence
  chemically synthesized
tcagaaaataataccttcaaat

SEQ ID NO: 1149636 - DNA, 22 bp, Artificial Sequence
  chemically synthesized
tattacaatattttaatttgaa

SEQ ID NO: 1149637 - DNA, 22 bp, Artificial Sequence
  chemically synthesized
acaatattatattacaatattt

SEQ ID NO: 1149638 - DNA, 22 bp, Artificial Sequence
  chemically synthesized
aacaatattatattacaatatt

SEQ ID NO: 1149639 - DNA, 22 bp, Artificial Sequence
  chemically synthesized
taacaatattatattacaatat

SEQ ID NO: 1149640 - DNA, 22 bp, Artificial Sequence
  chemically synthesized
caaattaaaatattgtaatata

SEQ ID NO: 1149641 - DNA, 22 bp, Artificial Sequence
  chemically synthesized
aaattaaaatattgtaatataa

SEQ ID NO: 1149642 - DNA, 22 bp, Artificial Sequence
  chemically synthesized
aaatattgtaatataatattgt

SEQ ID NO: 1149643 - DNA, 22 bp, Artificial Sequence
  chemically synthesized
ataaaggaaaacattttaacaa

SEQ ID NO: 1149644 - DNA, 22 bp, Artificial Sequence
  chemically synthesized
aataaaggaaaacattttaaca

SEQ ID NO: 1149645 - DNA, 22 bp, Artificial Sequence
  chemically synthesized
taatataatattgttaaaatgt

SEQ ID NO: 1149646 - DNA, 22 bp, Artificial Sequence
  chemically synthesized
taataaaggaaaacattttaac

SEQ ID NO: 1149647 - DNA, 22 bp, Artificial Sequence
  chemically synthesized
ttaataaaggaaaacattttaa

SEQ ID NO: 1149648 - DNA, 22 bp, Artificial Sequence
  chemically synthesized
gaagcttttaataaaggaaaac

SEQ ID NO: 1149649 - DNA, 22 bp, Artificial Sequence
  chemically synthesized
ttaaaatgttttcctttattaa

SEQ ID NO: 1149650 - DNA, 22 bp, Artificial Sequence
  chemically synthesized
aaatgttttcctttattaaaag

SEQ ID NO: 1149651 - DNA, 22 bp, Artificial Sequence
  chemically synthesized
tcctttattaaaagcttccaga

SEQ ID NO: 1149652 - DNA, 22 bp, Artificial Sequence
  chemically synthesized
cctttattaaaagcttccagat

SEQ ID NO: 1149653 - DNA, 22 bp, Artificial Sequence
  chemically synthesized
ctttattaaaagcttccagatt

SEQ ID NO: 1149654 - DNA, 22 bp, Artificial Sequence
  chemically synthesized
tattaaaagcttccagattgta

SEQ ID NO: 1149655 - DNA, 22 bp, Artificial Sequence
  chemically synthesized
attaaaagcttccagattgtac

SEQ ID NO: 1149656 - DNA, 22 bp, Artificial Sequence
  chemically synthesized
ttaaaagcttccagattgtaca

SEQ ID NO: 1149657 - DNA, 22 bp, Artificial Sequence
  chemically synthesized
aaagcttccagattgtacatac

SEQ ID NO: 1149658 - DNA, 22 bp, Artificial Sequence
  chemically synthesized
ccagattgtacatacacataca

SEQ ID NO: 1149659 - DNA, 22 bp, Artificial Sequence
  chemically synthesized
cagattgtacatacacatacac

SEQ ID NO: 1149660 - DNA, 22 bp, Artificial Sequence
  chemically synthesized
gtatgtgtgtatatatgtgtat

SEQ ID NO: 1149661 - DNA, 22 bp, Artificial Sequence
  chemically synthesized
tacatacacatacacatatata

SEQ ID NO: 1149662 - DNA, 22 bp, Artificial Sequence
  chemically synthesized
ggtactttattatgcatttatt

SEQ ID NO: 1149663 - DNA, 22 bp, Artificial Sequence
  chemically synthesized
ataaaataatgaaaataaatgc

SEQ ID NO: 1149664 - DNA, 22 bp, Artificial Sequence
  chemically synthesized
aataaaataatgaaaataaatg

SEQ ID NO: 1149665 - DNA, 22 bp, Artificial Sequence
  chemically synthesized
taataaaataatgaaaataaat

SEQ ID NO: 1149666 - DNA, 22 bp, Artificial Sequence
  chemically synthesized
ctttaataaaataatgaaaata

SEQ ID NO: 1149667 - DNA, 22 bp, Artificial Sequence
  chemically synthesized
tattatgcatttattttcatta

SEQ ID NO: 1149668 - DNA, 22 bp, Artificial Sequence
  chemically synthesized
attatgcatttattttcattat

SEQ ID NO: 1149669 - DNA, 22 bp, Artificial Sequence
  chemically synthesized
ttatgcatttattttcattatt

SEQ ID NO: 1149670 - DNA, 22 bp, Artificial Sequence
  chemically synthesized
tgcatttattttcattatttta

SEQ ID NO: 1149671 - DNA, 22 bp, Artificial Sequence
  chemically synthesized
caaaagcattcctttaataaaa

SEQ ID NO: 1149672 - DNA, 22 bp, Artificial Sequence
  chemically synthesized
attttcattattttattaaagg

SEQ ID NO: 1149673 - DNA, 22 bp, Artificial Sequence
  chemically synthesized
ttttcattattttattaaagga

SEQ ID NO: 1149674 - DNA, 22 bp, Artificial Sequence
  chemically synthesized
tcattattttattaaaggaatg

SEQ ID NO: 1149675 - DNA, 22 bp, Artificial Sequence
  chemically synthesized
cattattttattaaaggaatgc

SEQ ID NO: 1149676 - DNA, 22 bp, Artificial Sequence
  chemically synthesized
attattttattaaaggaatgct

SEQ ID NO: 1149677 - DNA, 22 bp, Artificial Sequence
  chemically synthesized
gtaagtgttacaaaagcattcc

SEQ ID NO: 1149678 - DNA, 22 bp, Artificial Sequence
  chemically synthesized
ttttattaaaggaatgcttttg

SEQ ID NO: 1149679 - DNA, 22 bp, Artificial Sequence
  chemically synthesized
tattaaaggaatgcttttgtaa

SEQ ID NO: 1149680 - DNA, 22 bp, Artificial Sequence
  chemically synthesized
attaaaggaatgcttttgtaac

SEQ ID NO: 1149681 - DNA, 22 bp, Artificial Sequence
  chemically synthesized
ttaaaggaatgcttttgtaaca

SEQ ID NO: 1149682 - DNA, 22 bp, Artificial Sequence
  chemically synthesized
aaatctggtaagtgttacaaaa

SEQ ID NO: 1149683 - DNA, 22 bp, Artificial Sequence
  chemically synthesized
gaaatctggtaagtgttacaaa

SEQ ID NO: 1149684 - DNA, 22 bp, Artificial Sequence
  chemically synthesized
aaggaatgcttttgtaacactt

SEQ ID NO: 1149685 - DNA, 22 bp, Artificial Sequence
  chemically synthesized
ttgtaacacttaccagatttca

SEQ ID NO: 1149686 - DNA, 22 bp, Artificial Sequence
  chemically synthesized
tgtaacacttaccagatttcaa

SEQ ID NO: 1149687 - DNA, 22 bp, Artificial Sequence
  chemically synthesized
gtaacacttaccagatttcaaa

SEQ ID NO: 1149688 - DNA, 22 bp, Artificial Sequence
  chemically synthesized
taacacttaccagatttcaaac

SEQ ID NO: 1149689 - DNA, 22 bp, Artificial Sequence
  chemically synthesized
ggaacatgatagatgtttgaaa

SEQ ID NO: 1149690 - DNA, 22 bp, Artificial Sequence
  chemically synthesized
actaggaacatgatagatgttt

SEQ ID NO: 1149691 - DNA, 22 bp, Artificial Sequence
  chemically synthesized
aactaggaacatgatagatgtt

SEQ ID NO: 1149692 - DNA, 22 bp, Artificial Sequence
  chemically synthesized
accagatttcaaacatctatca

SEQ ID NO: 1149693 - DNA, 22 bp, Artificial Sequence
  chemically synthesized
ccagatttcaaacatctatcat

SEQ ID NO: 1149694 - DNA, 22 bp, Artificial Sequence
  chemically synthesized
caaacatctatcatgttcctag

SEQ ID NO: 1149695 - DNA, 22 bp, Artificial Sequence
  chemically synthesized
aaacatctatcatgttcctagt

SEQ ID NO: 1149696 - DNA, 22 bp, Artificial Sequence
  chemically synthesized
ataatggtaatgaaatttaact

SEQ ID NO: 1149697 - DNA, 22 bp, Artificial Sequence
  chemically synthesized
tcatgttcctagttaaatttca

SEQ ID NO: 1149698 - DNA, 22 bp, Artificial Sequence
  chemically synthesized
tatctaataatggtaatgaaat

SEQ ID NO: 1149699 - DNA, 22 bp, Artificial Sequence
  chemically synthesized
gtatctaataatggtaatgaaa

SEQ ID NO: 1149700 - DNA, 22 bp, Artificial Sequence
  chemically synthesized
ctagttaaatttcattaccatt

SEQ ID NO: 1149701 - DNA, 22 bp, Artificial Sequence
  chemically synthesized
gttaaatttcattaccattatt

SEQ ID NO: 1149702 - DNA, 22 bp, Artificial Sequence
  chemically synthesized
gtaacatttgtatctaataatg

SEQ ID NO: 1149703 - DNA, 22 bp, Artificial Sequence
  chemically synthesized
aatttcattaccattattagat

SEQ ID NO: 1149704 - DNA, 22 bp, Artificial Sequence
  chemically synthesized
cattaccattattagatacaaa

SEQ ID NO: 1149705 - DNA, 22 bp, Artificial Sequence
  chemically synthesized
attaccattattagatacaaat

SEQ ID NO: 1149706 - DNA, 22 bp, Artificial Sequence
  chemically synthesized
ccattattagatacaaatgtta

SEQ ID NO: 1149707 - DNA, 22 bp, Artificial Sequence
  chemically synthesized
acaacaaacattggtaacattt

SEQ ID NO: 1149708 - DNA, 22 bp, Artificial Sequence
  chemically synthesized
gacaacaaacattggtaacatt

SEQ ID NO: 1149709 - DNA, 22 bp, Artificial Sequence
  chemically synthesized
ttagatacaaatgttaccaatg

SEQ ID NO: 1149710 - DNA, 22 bp, Artificial Sequence
  chemically synthesized
gatacaaatgttaccaatgttt

SEQ ID NO: 1149711 - DNA, 22 bp, Artificial Sequence
  chemically synthesized
acatttgacaacaaacattggt

SEQ ID NO: 1149712 - DNA, 22 bp, Artificial Sequence
  chemically synthesized
gacatttgacaacaaacattgg

SEQ ID NO: 1149713 - DNA, 22 bp, Artificial Sequence
  chemically synthesized
tttgacatttgacaacaaacat

SEQ ID NO: 1149714 - DNA, 22 bp, Artificial Sequence
  chemically synthesized
ccaatgtttgttgtcaaatgtc

SEQ ID NO: 1149715 - DNA, 22 bp, Artificial Sequence
  chemically synthesized
gttgtcaaatgtcaaataatgt

SEQ ID NO: 1149716 - DNA, 22 bp, Artificial Sequence
  chemically synthesized
ttgtcaaatgtcaaataatgta

SEQ ID NO: 1149717 - DNA, 22 bp, Artificial Sequence
  chemically synthesized
tcaaatgtcaaataatgtattt

SEQ ID NO: 1149718 - DNA, 22 bp, Artificial Sequence
  chemically synthesized
tcataaagaaaaaaatacatta

SEQ ID NO: 1149719 - DNA, 22 bp, Artificial Sequence
  chemically synthesized
gtcataaagaaaaaaatacatt

SEQ ID NO: 1149720 - DNA, 22 bp, Artificial Sequence
  chemically synthesized
ttgtcataaagaaaaaaataca

SEQ ID NO: 1149721 - DNA, 22 bp, Artificial Sequence
  chemically synthesized
tcttgtcataaagaaaaaaata

SEQ ID NO: 1149722 - DNA, 22 bp, Artificial Sequence
  chemically synthesized
ctcttgtcataaagaaaaaaat

SEQ ID NO: 1149723 - DNA, 22 bp, Artificial Sequence
  chemically synthesized
tctcttgtcataaagaaaaaaa

SEQ ID NO: 1149724 - DNA, 22 bp, Artificial Sequence
  chemically synthesized
ttctcttgtcataaagaaaaaa

SEQ ID NO: 1149725 - DNA, 22 bp, Artificial Sequence
  chemically synthesized
gccttttctcttgtcataaaga

SEQ ID NO: 1149726 - DNA, 22 bp, Artificial Sequence
  chemically synthesized
ttggccttttctcttgtcataa

SEQ ID NO: 1149727 - DNA, 22 bp, Artificial Sequence
  chemically synthesized
actgttggccttttctcttgtc

SEQ ID NO: 1149728 - DNA, 22 bp, Artificial Sequence
  chemically synthesized
ttttctttatgacaagagaaaa

SEQ ID NO: 1149729 - DNA, 22 bp, Artificial Sequence
  chemically synthesized
tttctttatgacaagagaaaag

SEQ ID NO: 1149730 - DNA, 22 bp, Artificial Sequence
  chemically synthesized
ttctttatgacaagagaaaagg

SEQ ID NO: 1149731 - DNA, 22 bp, Artificial Sequence
  chemically synthesized
tctttatgacaagagaaaaggc

SEQ ID NO: 1149732 - DNA, 22 bp, Artificial Sequence
  chemically synthesized
ctttatgacaagagaaaaggcc

SEQ ID NO: 1149733 - DNA, 22 bp, Artificial Sequence
  chemically synthesized
catctcactgttggccttttct

SEQ ID NO: 1149734 - DNA, 22 bp, Artificial Sequence
  chemically synthesized
tttatgacaagagaaaaggcca

SEQ ID NO: 1149735 - DNA, 22 bp, Artificial Sequence
  chemically synthesized
tatgacaagagaaaaggccaac

SEQ ID NO: 1149736 - DNA, 22 bp, Artificial Sequence
  chemically synthesized
atgacaagagaaaaggccaaca

SEQ ID NO: 1149737 - DNA, 22 bp, Artificial Sequence
  chemically synthesized
tgacaagagaaaaggccaacag

SEQ ID NO: 1149738 - DNA, 22 bp, Artificial Sequence
  chemically synthesized
atgttacatctcactgttggcc

SEQ ID NO: 1149739 - DNA, 22 bp, Artificial Sequence
  chemically synthesized
aatgttacatctcactgttggc

SEQ ID NO: 1149740 - DNA, 22 bp, Artificial Sequence
  chemically synthesized
ttaatgttacatctcactgttg

SEQ ID NO: 1149741 - DNA, 22 bp, Artificial Sequence
  chemically synthesized
ggcattcttaatgttacatctc

SEQ ID NO: 1149742 - DNA, 22 bp, Artificial Sequence
  chemically synthesized
tccaatctaggcattcttaatg

SEQ ID NO: 1149743 - DNA, 22 bp, Artificial Sequence
  chemically synthesized
gtccaatctaggcattcttaat

SEQ ID NO: 1149744 - DNA, 22 bp, Artificial Sequence
  chemically synthesized
tttgtccaatctaggcattctt

SEQ ID NO: 1149745 - DNA, 22 bp, Artificial Sequence
  chemically synthesized
agaatgcctagattggacaaac

SEQ ID NO: 1149746 - DNA, 22 bp, Artificial Sequence
  chemically synthesized
acagaggtataacaaaaactgt

SEQ ID NO: 1149747 - DNA, 22 bp, Artificial Sequence
  chemically synthesized
gattggacaaacagtttttgtt

SEQ ID NO: 1149748 - DNA, 22 bp, Artificial Sequence
  chemically synthesized
ttcacagaggtataacaaaaac

SEQ ID NO: 1149749 - DNA, 22 bp, Artificial Sequence
  chemically synthesized
gacaaacagtttttgttatacc

SEQ ID NO: 1149750 - DNA, 22 bp, Artificial Sequence
  chemically synthesized
gaagaaatacaattattcacag

SEQ ID NO: 1149751 - DNA, 22 bp, Artificial Sequence
  chemically synthesized
ttgttatacctctgtgaataat

SEQ ID NO: 1149752 - DNA, 22 bp, Artificial Sequence
  chemically synthesized
agaagaaatacaattattcaca

SEQ ID NO: 1149753 - DNA, 22 bp, Artificial Sequence
  chemically synthesized
tgttatacctctgtgaataatt

SEQ ID NO: 1149754 - DNA, 22 bp, Artificial Sequence
  chemically synthesized
gttatacctctgtgaataattg

SEQ ID NO: 1149755 - DNA, 22 bp, Artificial Sequence
  chemically synthesized
ttatacctctgtgaataattgt

SEQ ID NO: 1149756 - DNA, 22 bp, Artificial Sequence
  chemically synthesized
tttagaagaaatacaattattc

SEQ ID NO: 1149757 - DNA, 22 bp, Artificial Sequence
  chemically synthesized
atttagaagaaatacaattatt

SEQ ID NO: 1149758 - DNA, 22 bp, Artificial Sequence
  chemically synthesized
tacctctgtgaataattgtatt

SEQ ID NO: 1149759 - DNA, 22 bp, Artificial Sequence
  chemically synthesized
gagacttatttagaagaaatac

SEQ ID NO: 1149760 - DNA, 22 bp, Artificial Sequence
  chemically synthesized
tgtgaataattgtatttcttct

SEQ ID NO: 1149761 - DNA, 22 bp, Artificial Sequence
  chemically synthesized
tgaataattgtatttcttctaa

SEQ ID NO: 1149762 - DNA, 22 bp, Artificial Sequence
  chemically synthesized
actagagacttatttagaagaa

SEQ ID NO: 1149763 - DNA, 22 bp, Artificial Sequence
  chemically synthesized
aactagagacttatttagaaga

SEQ ID NO: 1149764 - DNA, 22 bp, Artificial Sequence
  chemically synthesized
taactagagacttatttagaag

SEQ ID NO: 1149765 - DNA, 22 bp, Artificial Sequence
  chemically synthesized
tatttcttctaaataagtctct

SEQ ID NO: 1149766 - DNA, 22 bp, Artificial Sequence
  chemically synthesized
agccctttaactagagacttat

SEQ ID NO: 1149767 - DNA, 22 bp, Artificial Sequence
  chemically synthesized
ttaagccctttaactagagact

SEQ ID NO: 1149768 - DNA, 22 bp, Artificial Sequence
  chemically synthesized
gttaagccctttaactagagac

SEQ ID NO: 1149769 - DNA, 22 bp, Artificial Sequence
  chemically synthesized
cttctaaataagtctctagtta

SEQ ID NO: 1149770 - DNA, 22 bp, Artificial Sequence
  chemically synthesized
tgttaagccctttaactagaga

SEQ ID NO: 1149771 - DNA, 22 bp, Artificial Sequence
  chemically synthesized
ttctaaataagtctctagttaa

SEQ ID NO: 1149772 - DNA, 22 bp, Artificial Sequence
  chemically synthesized
ctaaataagtctctagttaaag

SEQ ID NO: 1149773 - DNA, 22 bp, Artificial Sequence
  chemically synthesized
taaataagtctctagttaaagg

SEQ ID NO: 1149774 - DNA, 22 bp, Artificial Sequence
  chemically synthesized
aataagtctctagttaaagggc

SEQ ID NO: 1149775 - DNA, 22 bp, Artificial Sequence
  chemically synthesized
tagttaaagggcttaacaaaat

SEQ ID NO: 1149776 - DNA, 22 bp, Artificial Sequence
  chemically synthesized
agggagtaacaaattttgttaa

SEQ ID NO: 1149777 - DNA, 22 bp, Artificial Sequence
  chemically synthesized
gttaaagggcttaacaaaattt

SEQ ID NO: 1149778 - DNA, 22 bp, Artificial Sequence
  chemically synthesized
aagggcttaacaaaatttgtta

SEQ ID NO: 1149779 - DNA, 22 bp, Artificial Sequence
  chemically synthesized
ggaacatgtactaagggagtaa

SEQ ID NO: 1149780 - DNA, 22 bp, Artificial Sequence
  chemically synthesized
aacaaaatttgttactccctta

SEQ ID NO: 1149781 - DNA, 22 bp, Artificial Sequence
  chemically synthesized
acaaaatttgttactcccttag

SEQ ID NO: 1149782 - DNA, 22 bp, Artificial Sequence
  chemically synthesized
gttactcccttagtacatgttc

SEQ ID NO: 1149783 - DNA, 22 bp, Artificial Sequence
  chemically synthesized
ttactcccttagtacatgttcc

SEQ ID NO: 1149784 - DNA, 22 bp, Artificial Sequence
  chemically synthesized
aataataaaattgggaacatgt

SEQ ID NO: 1149785 - DNA, 22 bp, Artificial Sequence
  chemically synthesized
aaataataaaattgggaacatg

SEQ ID NO: 1149786 - DNA, 22 bp, Artificial Sequence
  chemically synthesized
ctcccttagtacatgttcccaa

SEQ ID NO: 1149787 - DNA, 22 bp, Artificial Sequence
  chemically synthesized
ccttagtacatgttcccaattt

SEQ ID NO: 1149788 - DNA, 22 bp, Artificial Sequence
  chemically synthesized
agtacatgttcccaattttatt

SEQ ID NO: 1149789 - DNA, 22 bp, Artificial Sequence
  chemically synthesized
gtacatgttcccaattttatta

SEQ ID NO: 1149790 - DNA, 22 bp, Artificial Sequence
  chemically synthesized
ccaattttattatttaaacctg

SEQ ID NO: 1149791 - DNA, 22 bp, Artificial Sequence
  chemically synthesized
tattatttaaacctgacttttc

SEQ ID NO: 1149792 - DNA, 22 bp, Artificial Sequence
  chemically synthesized
aaagaagtacaagaaaagtcag

SEQ ID NO: 1149793 - DNA, 22 bp, Artificial Sequence
  chemically synthesized
attatttaaacctgacttttct

SEQ ID NO: 1149794 - DNA, 22 bp, Artificial Sequence
  chemically synthesized
aaaagaagtacaagaaaagtca

SEQ ID NO: 1149795 - DNA, 22 bp, Artificial Sequence
  chemically synthesized
ttatttaaacctgacttttctt

SEQ ID NO: 1149796 - DNA, 22 bp, Artificial Sequence
  chemically synthesized
tttaaacctgacttttcttgta

SEQ ID NO: 1149797 - DNA, 22 bp, Artificial Sequence
  chemically synthesized
aaacctgacttttcttgtactt

SEQ ID NO: 1149798 - DNA, 22 bp, Artificial Sequence
  chemically synthesized
aacctgacttttcttgtacttc

SEQ ID NO: 1149799 - DNA, 22 bp, Artificial Sequence
  chemically synthesized
atggcatttaaaagaagtacaa

SEQ ID NO: 1149800 - DNA, 22 bp, Artificial Sequence
  chemically synthesized
acttttcttgtacttcttttaa

SEQ ID NO: 1149801 - DNA, 22 bp, Artificial Sequence
  chemically synthesized
ttcttgtacttcttttaaatgc

SEQ ID NO: 1149802 - DNA, 22 bp, Artificial Sequence
  chemically synthesized
tcttgtacttcttttaaatgcc

SEQ ID NO: 1149803 - DNA, 22 bp, Artificial Sequence
  chemically synthesized
agtatcactgatggcatttaaa

SEQ ID NO: 1149804 - DNA, 22 bp, Artificial Sequence
  chemically synthesized
cttgtacttcttttaaatgcca

SEQ ID NO: 1149805 - DNA, 22 bp, Artificial Sequence
  chemically synthesized
ttgtacttcttttaaatgccat

SEQ ID NO: 1149806 - DNA, 22 bp, Artificial Sequence
  chemically synthesized
gtacttcttttaaatgccatca

SEQ ID NO: 1149807 - DNA, 22 bp, Artificial Sequence
  chemically synthesized
tacttcttttaaatgccatcag

SEQ ID NO: 1149808 - DNA, 22 bp, Artificial Sequence
  chemically synthesized
cttttaaatgccatcagtgata

SEQ ID NO: 1149809 - DNA, 22 bp, Artificial Sequence
  chemically synthesized
ttttaaatgccatcagtgatac

SEQ ID NO: 1149810 - DNA, 22 bp, Artificial Sequence
  chemically synthesized
ttaaatgccatcagtgatactg

SEQ ID NO: 1149811 - DNA, 22 bp, Artificial Sequence
  chemically synthesized
taaatgccatcagtgatactga

SEQ ID NO: 1149812 - DNA, 22 bp, Artificial Sequence
  chemically synthesized
aaatgccatcagtgatactgaa

SEQ ID NO: 1149813 - DNA, 22 bp, Artificial Sequence
  chemically synthesized
aatgccatcagtgatactgaat

SEQ ID NO: 1149814 - DNA, 22 bp, Artificial Sequence
  chemically synthesized
acatggacaagagccagaagaa

SEQ ID NO: 1149815 - DNA, 22 bp, Artificial Sequence
  chemically synthesized
gacatggacaagagccagaaga

SEQ ID NO: 1149816 - DNA, 22 bp, Artificial Sequence
  chemically synthesized
aattcttctggctcttgtccat

SEQ ID NO: 1149817 - DNA, 22 bp, Artificial Sequence
  chemically synthesized
aaaaccaacttgacatggacaa

SEQ ID NO: 1149818 - DNA, 22 bp, Artificial Sequence
  chemically synthesized
gaaaaccaacttgacatggaca

SEQ ID NO: 1149819 - DNA, 22 bp, Artificial Sequence
  chemically synthesized
tgaaaaccaacttgacatggac

SEQ ID NO: 1149820 - DNA, 22 bp, Artificial Sequence
  chemically synthesized
ttctggctcttgtccatgtcaa

SEQ ID NO: 1149821 - DNA, 22 bp, Artificial Sequence
  chemically synthesized
ttgaaaaccaacttgacatgga

SEQ ID NO: 1149822 - DNA, 22 bp, Artificial Sequence
  chemically synthesized
ctggctcttgtccatgtcaagt

SEQ ID NO: 1149823 - DNA, 22 bp, Artificial Sequence
  chemically synthesized
tggctcttgtccatgtcaagtt

SEQ ID NO: 1149824 - DNA, 22 bp, Artificial Sequence
  chemically synthesized
gctcttgtccatgtcaagttgg

SEQ ID NO: 1149825 - DNA, 22 bp, Artificial Sequence
  chemically synthesized
agccacttttgaaaaccaactt

SEQ ID NO: 1149826 - DNA, 22 bp, Artificial Sequence
  chemically synthesized
ttgtccatgtcaagttggtttt

SEQ ID NO: 1149827 - DNA, 22 bp, Artificial Sequence
  chemically synthesized
taagccacttttgaaaaccaac

SEQ ID NO: 1149828 - DNA, 22 bp, Artificial Sequence
  chemically synthesized
gtccatgtcaagttggttttca

SEQ ID NO: 1149829 - DNA, 22 bp, Artificial Sequence
  chemically synthesized
ctaagccacttttgaaaaccaa

SEQ ID NO: 1149830 - DNA, 22 bp, Artificial Sequence
  chemically synthesized
tccatgtcaagttggttttcaa

SEQ ID NO: 1149831 - DNA, 22 bp, Artificial Sequence
  chemically synthesized
tctaagccacttttgaaaacca

SEQ ID NO: 1149832 - DNA, 22 bp, Artificial Sequence
  chemically synthesized
ttctaagccacttttgaaaacc

SEQ ID NO: 1149833 - DNA, 22 bp, Artificial Sequence
  chemically synthesized
cagtggtttttctaagccactt

SEQ ID NO: 1149834 - DNA, 22 bp, Artificial Sequence
  chemically synthesized
tccagtggtttttctaagccac

SEQ ID NO: 1149835 - DNA, 22 bp, Artificial Sequence
  chemically synthesized
gttttcaaaagtggcttagaaa

SEQ ID NO: 1149836 - DNA, 22 bp, Artificial Sequence
  chemically synthesized
tcaaaagtggcttagaaaaacc

SEQ ID NO: 1149837 - DNA, 22 bp, Artificial Sequence
  chemically synthesized
caaaagtggcttagaaaaacca

SEQ ID NO: 1149838 - DNA, 22 bp, Artificial Sequence
  chemically synthesized
aaaagtggcttagaaaaaccac

SEQ ID NO: 1149839 - DNA, 22 bp, Artificial Sequence
  chemically synthesized
aagtggctctccagtggttttt

SEQ ID NO: 1149840 - DNA, 22 bp, Artificial Sequence
  chemically synthesized
agaaaaaccactggagagccac

SEQ ID NO: 1149841 - DNA, 22 bp, Artificial Sequence
  chemically synthesized
gaaaaaccactggagagccact

SEQ ID NO: 1149842 - DNA, 22 bp, Artificial Sequence
  chemically synthesized
gaataaacactgaagtggctct

SEQ ID NO: 1149843 - DNA, 22 bp, Artificial Sequence
  chemically synthesized
gagagccacttcagtgtttatt

SEQ ID NO: 1149844 - DNA, 22 bp, Artificial Sequence
  chemically synthesized
cagtgtttattctagatctatg

SEQ ID NO: 1149845 - DNA, 22 bp, Artificial Sequence
  chemically synthesized
agtgtttattctagatctatgc

SEQ ID NO: 1149846 - DNA, 22 bp, Artificial Sequence
  chemically synthesized
agaaagggtaaaatagcataga

SEQ ID NO: 1149847 - DNA, 22 bp, Artificial Sequence
  chemically synthesized
taagaaagggtaaaatagcata

SEQ ID NO: 1149848 - DNA, 22 bp, Artificial Sequence
  chemically synthesized
attctagatctatgctatttta

SEQ ID NO: 1149849 - DNA, 22 bp, Artificial Sequence
  chemically synthesized
ttctagatctatgctattttac

SEQ ID NO: 1149850 - DNA, 22 bp, Artificial Sequence
  chemically synthesized
tagatctatgctattttaccct

SEQ ID NO: 1149851 - DNA, 22 bp, Artificial Sequence
  chemically synthesized
gatctatgctattttacccttt

SEQ ID NO: 1149852 - DNA, 22 bp, Artificial Sequence
  chemically synthesized
catgtgttctaagaaagggtaa

SEQ ID NO: 1149853 - DNA, 22 bp, Artificial Sequence
  chemically synthesized
acatgtgttctaagaaagggta

SEQ ID NO: 1149854 - DNA, 22 bp, Artificial Sequence
  chemically synthesized
tacatgtgttctaagaaagggt

SEQ ID NO: 1149855 - DNA, 22 bp, Artificial Sequence
  chemically synthesized
tgctattttaccctttcttaga

SEQ ID NO: 1149856 - DNA, 22 bp, Artificial Sequence
  chemically synthesized
ttttacatgtgttctaagaaag

SEQ ID NO: 1149857 - DNA, 22 bp, Artificial Sequence
  chemically synthesized
ttttaccctttcttagaacaca

SEQ ID NO: 1149858 - DNA, 22 bp, Artificial Sequence
  chemically synthesized
agtattattttacatgtgttct

SEQ ID NO: 1149859 - DNA, 22 bp, Artificial Sequence
  chemically synthesized
taccctttcttagaacacatgt

SEQ ID NO: 1149860 - DNA, 22 bp, Artificial Sequence
  chemically synthesized
accctttcttagaacacatgta

SEQ ID NO: 1149861 - DNA, 22 bp, Artificial Sequence
  chemically synthesized
ccctttcttagaacacatgtaa

SEQ ID NO: 1149862 - DNA, 22 bp, Artificial Sequence
  chemically synthesized
ctaagtattattttacatgtgt

SEQ ID NO: 1149863 - DNA, 22 bp, Artificial Sequence
  chemically synthesized
cctaagtattattttacatgtg

SEQ ID NO: 1149864 - DNA, 22 bp, Artificial Sequence
  chemically synthesized
tttcctaagtattattttacat

SEQ ID NO: 1149865 - DNA, 22 bp, Artificial Sequence
  chemically synthesized
tcttagaacacatgtaaaataa

SEQ ID NO: 1149866 - DNA, 22 bp, Artificial Sequence
  chemically synthesized
atttcctaagtattattttaca

SEQ ID NO: 1149867 - DNA, 22 bp, Artificial Sequence
  chemically synthesized
cttagaacacatgtaaaataat

SEQ ID NO: 1149868 - DNA, 22 bp, Artificial Sequence
  chemically synthesized
tatttcctaagtattattttac

SEQ ID NO: 1149869 - DNA, 22 bp, Artificial Sequence
  chemically synthesized
ttagaacacatgtaaaataata

SEQ ID NO: 1149870 - DNA, 22 bp, Artificial Sequence
  chemically synthesized
agaacacatgtaaaataatact

SEQ ID NO: 1149871 - DNA, 22 bp, Artificial Sequence
  chemically synthesized
gaacacatgtaaaataatactt

SEQ ID NO: 1149872 - DNA, 22 bp, Artificial Sequence
  chemically synthesized
catgtctttatttcctaagtat

SEQ ID NO: 1149873 - DNA, 22 bp, Artificial Sequence
  chemically synthesized
cataattccatgtctttatttc

SEQ ID NO: 1149874 - DNA, 22 bp, Artificial Sequence
  chemically synthesized
acataattccatgtctttattt

SEQ ID NO: 1149875 - DNA, 22 bp, Artificial Sequence
  chemically synthesized
gccttacataattccatgtctt

SEQ ID NO: 1149876 - DNA, 22 bp, Artificial Sequence
  chemically synthesized
aggaaataaagacatggaatta

SEQ ID NO: 1149877 - DNA, 22 bp, Artificial Sequence
  chemically synthesized
cctagccttacataattccatg

SEQ ID NO: 1149878 - DNA, 22 bp, Artificial Sequence
  chemically synthesized
ggaaataaagacatggaattat

SEQ ID NO: 1149879 - DNA, 22 bp, Artificial Sequence
  chemically synthesized
ccctagccttacataattccat

SEQ ID NO: 1149880 - DNA, 22 bp, Artificial Sequence
  chemically synthesized
aacatcaaatcaaaaatttccc

SEQ ID NO: 1149881 - DNA, 22 bp, Artificial Sequence
  chemically synthesized
aaacatcaaatcaaaaatttcc

SEQ ID NO: 1149882 - DNA, 22 bp, Artificial Sequence
  chemically synthesized
tgtaaggctagggaaatttttg

SEQ ID NO: 1149883 - DNA, 22 bp, Artificial Sequence
  chemically synthesized
taaacatcaaatcaaaaatttc

SEQ ID NO: 1149884 - DNA, 22 bp, Artificial Sequence
  chemically synthesized
acctttaaacatcaaatcaaaa

SEQ ID NO: 1149885 - DNA, 22 bp, Artificial Sequence
  chemically synthesized
cacctttaaacatcaaatcaaa

SEQ ID NO: 1149886 - DNA, 22 bp, Artificial Sequence
  chemically synthesized
ttcacctttaaacatcaaatca

SEQ ID NO: 1149887 - DNA, 22 bp, Artificial Sequence
  chemically synthesized
gggaaatttttgatttgatgtt

SEQ ID NO: 1149888 - DNA, 22 bp, Artificial Sequence
  chemically synthesized
ctcttcacctttaaacatcaaa

SEQ ID NO: 1149889 - DNA, 22 bp, Artificial Sequence
  chemically synthesized
ttgctcttcacctttaaacatc

SEQ ID NO: 1149890 - DNA, 22 bp, Artificial Sequence
  chemically synthesized
attattgctcttcacctttaaa

SEQ ID NO: 1149891 - DNA, 22 bp, Artificial Sequence
  chemically synthesized
ttgatttgatgtttaaaggtga

SEQ ID NO: 1149892 - DNA, 22 bp, Artificial Sequence
  chemically synthesized
tgatttgatgtttaaaggtgaa

SEQ ID NO: 1149893 - DNA, 22 bp, Artificial Sequence
  chemically synthesized
gatttgatgtttaaaggtgaag

SEQ ID NO: 1149894 - DNA, 22 bp, Artificial Sequence
  chemically synthesized
atttgatgtttaaaggtgaaga

SEQ ID NO: 1149895 - DNA, 22 bp, Artificial Sequence
  chemically synthesized
gattaattattgctcttcacct

SEQ ID NO: 1149896 - DNA, 22 bp, Artificial Sequence
  chemically synthesized
cgattaattattgctcttcacc

SEQ ID NO: 1149897 - DNA, 22 bp, Artificial Sequence
  chemically synthesized
tcgattaattattgctcttcac

SEQ ID NO: 1149898 - DNA, 22 bp, Artificial Sequence
  chemically synthesized
gatgtttaaaggtgaagagcaa

SEQ ID NO: 1149899 - DNA, 22 bp, Artificial Sequence
  chemically synthesized
atgtttaaaggtgaagagcaat

SEQ ID NO: 1149900 - DNA, 22 bp, Artificial Sequence
  chemically synthesized
cctttcgattaattattgctct

SEQ ID NO: 1149901 - DNA, 22 bp, Artificial Sequence
  chemically synthesized
aaaggtgaagagcaataattaa

SEQ ID NO: 1149902 - DNA, 22 bp, Artificial Sequence
  chemically synthesized
aaggtgaagagcaataattaat

SEQ ID NO: 1149903 - DNA, 22 bp, Artificial Sequence
  chemically synthesized
tactgcctttcgattaattatt

SEQ ID NO: 1149904 - DNA, 22 bp, Artificial Sequence
  chemically synthesized
ttatactgcctttcgattaatt

SEQ ID NO: 1149905 - DNA, 22 bp, Artificial Sequence
  chemically synthesized
tattatactgcctttcgattaa

SEQ ID NO: 1149906 - DNA, 22 bp, Artificial Sequence
  chemically synthesized
ctattatactgcctttcgatta

SEQ ID NO: 1149907 - DNA, 22 bp, Artificial Sequence
  chemically synthesized
tctattatactgcctttcgatt

SEQ ID NO: 1149908 - DNA, 22 bp, Artificial Sequence
  chemically synthesized
ttttctattatactgcctttcg

SEQ ID NO: 1149909 - DNA, 22 bp, Artificial Sequence
  chemically synthesized
gttttctattatactgcctttc

SEQ ID NO: 1149910 - DNA, 22 bp, Artificial Sequence
  chemically synthesized
tgttttctattatactgccttt

SEQ ID NO: 1149911 - DNA, 22 bp, Artificial Sequence
  chemically synthesized
ttgttttctattatactgcctt

SEQ ID NO: 1149912 - DNA, 22 bp, Artificial Sequence
  chemically synthesized
tttttgttttctattatactgc

SEQ ID NO: 1149913 - DNA, 22 bp, Artificial Sequence
  chemically synthesized
gtttttgttttctattatactg

SEQ ID NO: 1149914 - DNA, 22 bp, Artificial Sequence
  chemically synthesized
atcgaaaggcagtataatagaa

SEQ ID NO: 1149915 - DNA, 22 bp, Artificial Sequence
  chemically synthesized
caggatacccatccttgttttt

SEQ ID NO: 1149916 - DNA, 22 bp, Artificial Sequence
  chemically synthesized
acaggatacccatccttgtttt

SEQ ID NO: 1149917 - DNA, 22 bp, Artificial Sequence
  chemically synthesized
ccatcgaatttacaggataccc

SEQ ID NO: 1149918 - DNA, 22 bp, Artificial Sequence
  chemically synthesized
tcccatcgaatttacaggatac

SEQ ID NO: 1149919 - DNA, 22 bp, Artificial Sequence
  chemically synthesized
ctcccatcgaatttacaggata

SEQ ID NO: 1149920 - DNA, 22 bp, Artificial Sequence
  chemically synthesized
taaattcgatgggagaagcttt

SEQ ID NO: 1149921 - DNA, 22 bp, Artificial Sequence
  chemically synthesized
gatgggagaagcttttgtttta

SEQ ID NO: 1149922 - DNA, 22 bp, Artificial Sequence
  chemically synthesized
tggccaaaagaaatagacaagt

SEQ ID NO: 1149923 - DNA, 22 bp, Artificial Sequence
  chemically synthesized
ttgttttacttgtctatttctt

SEQ ID NO: 1149924 - DNA, 22 bp, Artificial Sequence
  chemically synthesized
tgctatggccaaaagaaataga

SEQ ID NO: 1149925 - DNA, 22 bp, Artificial Sequence
  chemically synthesized
tgttttacttgtctatttcttt

SEQ ID NO: 1149926 - DNA, 22 bp, Artificial Sequence
  chemically synthesized
gttttacttgtctatttctttt

SEQ ID NO: 1149927 - DNA, 22 bp, Artificial Sequence
  chemically synthesized
ttttacttgtctatttcttttg

SEQ ID NO: 1149928 - DNA, 22 bp, Artificial Sequence
  chemically synthesized
tacttgtctatttcttttggcc

SEQ ID NO: 1149929 - DNA, 22 bp, Artificial Sequence
  chemically synthesized
agtctatgctatggccaaaaga

SEQ ID NO: 1149930 - DNA, 22 bp, Artificial Sequence
  chemically synthesized
acttgtctatttcttttggcca

SEQ ID NO: 1149931 - DNA, 22 bp, Artificial Sequence
  chemically synthesized
cttgtctatttcttttggccat

SEQ ID NO: 1149932 - DNA, 22 bp, Artificial Sequence
  chemically synthesized
gtctatttcttttggccatagc

SEQ ID NO: 1149933 - DNA, 22 bp, Artificial Sequence
  chemically synthesized
tctatttcttttggccatagca

SEQ ID NO: 1149934 - DNA, 22 bp, Artificial Sequence
  chemically synthesized
catagctgagtctatgctatgg

SEQ ID NO: 1149935 - DNA, 22 bp, Artificial Sequence
  chemically synthesized
ccatagctgagtctatgctatg

SEQ ID NO: 1149936 - DNA, 22 bp, Artificial Sequence
  chemically synthesized
tttcttttggccatagcataga

SEQ ID NO: 1149937 - DNA, 22 bp, Artificial Sequence
  chemically synthesized
tccatagctgagtctatgctat

SEQ ID NO: 1149938 - DNA, 22 bp, Artificial Sequence
  chemically synthesized
tttccatagctgagtctatgct

SEQ ID NO: 1149939 - DNA, 22 bp, Artificial Sequence
  chemically synthesized
cttttggccatagcatagactc

SEQ ID NO: 1149940 - DNA, 22 bp, Artificial Sequence
  chemically synthesized
ttttggccatagcatagactca

SEQ ID NO: 1149941 - DNA, 22 bp, Artificial Sequence
  chemically synthesized
ttctttccatagctgagtctat

SEQ ID NO: 1149942 - DNA, 22 bp, Artificial Sequence
  chemically synthesized
ttggccatagcatagactcagc

SEQ ID NO: 1149943 - DNA, 22 bp, Artificial Sequence
  chemically synthesized
tggccatagcatagactcagct

SEQ ID NO: 1149944 - DNA, 22 bp, Artificial Sequence
  chemically synthesized
ggccatagcatagactcagcta

SEQ ID NO: 1149945 - DNA, 22 bp, Artificial Sequence
  chemically synthesized
ctgttctttccatagctgagtc

SEQ ID NO: 1149946 - DNA, 22 bp, Artificial Sequence
  chemically synthesized
gccatagcatagactcagctat

SEQ ID NO: 1149947 - DNA, 22 bp, Artificial Sequence
  chemically synthesized
cctgttctttccatagctgagt

SEQ ID NO: 1149948 - DNA, 22 bp, Artificial Sequence
  chemically synthesized
tcctgttctttccatagctgag

SEQ ID NO: 1149949 - DNA, 22 bp, Artificial Sequence
  chemically synthesized
ttcctgttctttccatagctga

SEQ ID NO: 1149950 - DNA, 22 bp, Artificial Sequence
  chemically synthesized
ttttcctgttctttccatagct

SEQ ID NO: 1149951 - DNA, 22 bp, Artificial Sequence
  chemically synthesized
ttcttttcctgttctttccata

SEQ ID NO: 1149952 - DNA, 22 bp, Artificial Sequence
  chemically synthesized
agctatggaaagaacaggaaaa

SEQ ID NO: 1149953 - DNA, 22 bp, Artificial Sequence
  chemically synthesized
tggaaagaacaggaaaagaaca

SEQ ID NO: 1149954 - DNA, 22 bp, Artificial Sequence
  chemically synthesized
catataggtaacagctgttctt

SEQ ID NO: 1149955 - DNA, 22 bp, Artificial Sequence
  chemically synthesized
acatataggtaacagctgttct

SEQ ID NO: 1149956 - DNA, 22 bp, Artificial Sequence
  chemically synthesized
tacatataggtaacagctgttc

SEQ ID NO: 1149957 - DNA, 22 bp, Artificial Sequence
  chemically synthesized
aaaaaaaaaaaaactttacata

SEQ ID NO: 1149958 - DNA, 22 bp, Artificial Sequence
  chemically synthesized
ttacctatatgtaaagtttttt

SEQ ID NO: 1149959 - DNA, 22 bp, Artificial Sequence
  chemically synthesized
cctatatgtaaagttttttttt

SEQ ID NO: 1149960 - DNA, 22 bp, Artificial Sequence
  chemically synthesized
tatgtaaagttttttttttttt

SEQ ID NO: 1149961 - DNA, 22 bp, Artificial Sequence
  chemically synthesized
aatgaagtcggaggagtagtta

SEQ ID NO: 1149962 - DNA, 22 bp, Artificial Sequence
  chemically synthesized
tttttttttttaactactcctc

SEQ ID NO: 1149963 - DNA, 22 bp, Artificial Sequence
  chemically synthesized
ttttttttttaactactcctcc

SEQ ID NO: 1149964 - DNA, 22 bp, Artificial Sequence
  chemically synthesized
tttttttttaactactcctccg

SEQ ID NO: 1149965 - DNA, 22 bp, Artificial Sequence
  chemically synthesized
ttttttttaactactcctccga

SEQ ID NO: 1149966 - DNA, 22 bp, Artificial Sequence
  chemically synthesized
tttttttaactactcctccgac

SEQ ID NO: 1149967 - DNA, 22 bp, Artificial Sequence
  chemically synthesized
ttttttaactactcctccgact

SEQ ID NO: 1149968 - DNA, 22 bp, Artificial Sequence
  chemically synthesized
ggtattcaatgaagtcggagga

SEQ ID NO: 1149969 - DNA, 22 bp, Artificial Sequence
  chemically synthesized
tttttaactactcctccgactt

SEQ ID NO: 1149970 - DNA, 22 bp, Artificial Sequence
  chemically synthesized
ttttaactactcctccgacttc

SEQ ID NO: 1149971 - DNA, 22 bp, Artificial Sequence
  chemically synthesized
tttaactactcctccgacttca

SEQ ID NO: 1149972 - DNA, 22 bp, Artificial Sequence
  chemically synthesized
ttgggtattcaatgaagtcgga

SEQ ID NO: 1149973 - DNA, 22 bp, Artificial Sequence
  chemically synthesized
ttaactactcctccgacttcat

SEQ ID NO: 1149974 - DNA, 22 bp, Artificial Sequence
  chemically synthesized
taactactcctccgacttcatt

SEQ ID NO: 1149975 - DNA, 22 bp, Artificial Sequence
  chemically synthesized
aactactcctccgacttcattg

SEQ ID NO: 1149976 - DNA, 22 bp, Artificial Sequence
  chemically synthesized
actactcctccgacttcattga

SEQ ID NO: 1149977 - DNA, 22 bp, Artificial Sequence
  chemically synthesized
gctgttgggtattcaatgaagt

SEQ ID NO: 1149978 - DNA, 22 bp, Artificial Sequence
  chemically synthesized
ctcctccgacttcattgaatac

SEQ ID NO: 1149979 - DNA, 22 bp, Artificial Sequence
  chemically synthesized
ctccgacttcattgaataccca

SEQ ID NO: 1149980 - DNA, 22 bp, Artificial Sequence
  chemically synthesized
cgacttcattgaatacccaaca

SEQ ID NO: 1149981 - DNA, 22 bp, Artificial Sequence
  chemically synthesized
cattgaatacccaacagctaat

SEQ ID NO: 1149982 - DNA, 22 bp, Artificial Sequence
  chemically synthesized
caagtaccggcaattagctgtt

SEQ ID NO: 1149983 - DNA, 22 bp, Artificial Sequence
  chemically synthesized
attgaatacccaacagctaatt

SEQ ID NO: 1149984 - DNA, 22 bp, Artificial Sequence
  chemically synthesized
aatacccaacagctaattgccg

SEQ ID NO: 1149985 - DNA, 22 bp, Artificial Sequence
  chemically synthesized
tgtgtgtgtgacctgcaagtac

SEQ ID NO: 1149986 - DNA, 22 bp, Artificial Sequence
  chemically synthesized
gtgtgtgtgtgacctgcaagta

SEQ ID NO: 1149987 - DNA, 22 bp, Artificial Sequence
  chemically synthesized
attgccggtacttgcaggtcac

SEQ ID NO: 1149988 - DNA, 22 bp, Artificial Sequence
  chemically synthesized
ccggtacttgcaggtcacacac

SEQ ID NO: 1149989 - DNA, 22 bp, Artificial Sequence
  chemically synthesized
gcaggtcacacacacacaaaca

SEQ ID NO: 1149990 - DNA, 22 bp, Artificial Sequence
  chemically synthesized
caggtcacacacacacaaacac

SEQ ID NO: 1149991 - DNA, 22 bp, Artificial Sequence
  chemically synthesized
tgtgtgtgtgtgtgtgtgtgtg

SEQ ID NO: 1149992 - DNA, 22 bp, Artificial Sequence
  chemically synthesized
gtgtgtgtgtgtgtgtgtgtgt

SEQ ID NO: 1149993 - DNA, 22 bp, Artificial Sequence
  chemically synthesized
tgtgtgtgtgtgtgtgtgtgtg

SEQ ID NO: 1149994 - DNA, 22 bp, Artificial Sequence
  chemically synthesized
ggggtgtgttttgtgtgtgtgt

SEQ ID NO: 1149995 - DNA, 22 bp, Artificial Sequence
  chemically synthesized
taggggtgtgttttgtgtgtgt

SEQ ID NO: 1149996 - DNA, 22 bp, Artificial Sequence
  chemically synthesized
ctaggggtgtgttttgtgtgtg

SEQ ID NO: 1149997 - DNA, 22 bp, Artificial Sequence
  chemically synthesized
tttctaggggtgtgttttgtgt

SEQ ID NO: 1149998 - DNA, 22 bp, Artificial Sequence
  chemically synthesized
tgttgtttctaggggtgtgttt

SEQ ID NO: 1149999 - DNA, 22 bp, Artificial Sequence
  chemically synthesized
tgtgttgtttctaggggtgtgt

SEQ ID NO: 1150000 - DNA, 22 bp, Artificial Sequence
  chemically synthesized
atgatgaacagcgttctgtgtt

SEQ ID NO: 1150001 - DNA, 22 bp, Artificial Sequence
  chemically synthesized
caattcatgatgaacagcgttc

SEQ ID NO: 1150002 - DNA, 22 bp, Artificial Sequence
  chemically synthesized
gaaacaacacagaacgctgttc

SEQ ID NO: 1150003 - DNA, 22 bp, Artificial Sequence
  chemically synthesized
ccaattcatgatgaacagcgtt

SEQ ID NO: 1150004 - DNA, 22 bp, Artificial Sequence
  chemically synthesized
ccttccaattcatgatgaacag

SEQ ID NO: 1150005 - DNA, 22 bp, Artificial Sequence
  chemically synthesized
gagacaatagattgccttccaa

SEQ ID NO: 1150006 - DNA, 22 bp, Artificial Sequence
  chemically synthesized
ttcatcatgaattggaaggcaa

SEQ ID NO: 1150007 - DNA, 22 bp, Artificial Sequence
  chemically synthesized
ggagacaatagattgccttcca

SEQ ID NO: 1150008 - DNA, 22 bp, Artificial Sequence
  chemically synthesized
tggagacaatagattgccttcc

SEQ ID NO: 1150009 - DNA, 22 bp, Artificial Sequence
  chemically synthesized
ttggagacaatagattgccttc

SEQ ID NO: 1150010 - DNA, 22 bp, Artificial Sequence
  chemically synthesized
atcatgaattggaaggcaatct

SEQ ID NO: 1150011 - DNA, 22 bp, Artificial Sequence
  chemically synthesized
aagtcatttttggagacaatag

SEQ ID NO: 1150012 - DNA, 22 bp, Artificial Sequence
  chemically synthesized
aaagtcatttttggagacaata

SEQ ID NO: 1150013 - DNA, 22 bp, Artificial Sequence
  chemically synthesized
taaagtcatttttggagacaat

SEQ ID NO: 1150014 - DNA, 22 bp, Artificial Sequence
  chemically synthesized
gaaggcaatctattgtctccaa

SEQ ID NO: 1150015 - DNA, 22 bp, Artificial Sequence
  chemically synthesized
attttaaagtcatttttggaga

SEQ ID NO: 1150016 - DNA, 22 bp, Artificial Sequence
  chemically synthesized
ttgtctccaaaaatgactttaa

SEQ ID NO: 1150017 - DNA, 22 bp, Artificial Sequence
  chemically synthesized
aatatattaattttaaagtcat

SEQ ID NO: 1150018 - DNA, 22 bp, Artificial Sequence
  chemically synthesized
tctccaaaaatgactttaaaat

SEQ ID NO: 1150019 - DNA, 22 bp, Artificial Sequence
  chemically synthesized
caaaaatgactttaaaattaat

SEQ ID NO: 1150020 - DNA, 22 bp, Artificial Sequence
  chemically synthesized
aacatctaaatatattaatttt

SEQ ID NO: 1150021 - DNA, 22 bp, Artificial Sequence
  chemically synthesized
taattaaacatctaaatatatt

SEQ ID NO: 1150022 - DNA, 22 bp, Artificial Sequence
  chemically synthesized
gtaattaaacatctaaatatat

SEQ ID NO: 1150023 - DNA, 22 bp, Artificial Sequence
  chemically synthesized
taaaattaatatatttagatgt

SEQ ID NO: 1150024 - DNA, 22 bp, Artificial Sequence
  chemically synthesized
aaaattaatatatttagatgtt

SEQ ID NO: 1150025 - DNA, 22 bp, Artificial Sequence
  chemically synthesized
aaattaatatatttagatgttt

SEQ ID NO: 1150026 - DNA, 22 bp, Artificial Sequence
  chemically synthesized
aatatttgtaattaaacatcta

SEQ ID NO: 1150027 - DNA, 22 bp, Artificial Sequence
  chemically synthesized
ctgaatatttgtaattaaacat

SEQ ID NO: 1150028 - DNA, 22 bp, Artificial Sequence
  chemically synthesized
atatatttagatgtttaattac

SEQ ID NO: 1150029 - DNA, 22 bp, Artificial Sequence
  chemically synthesized
caaactactgaatatttgtaat

SEQ ID NO: 1150030 - DNA, 22 bp, Artificial Sequence
  chemically synthesized
agatgtttaattacaaatattc

SEQ ID NO: 1150031 - DNA, 22 bp, Artificial Sequence
  chemically synthesized
gatgtttaattacaaatattca

SEQ ID NO: 1150032 - DNA, 22 bp, Artificial Sequence
  chemically synthesized
agataaactacaaactactgaa

SEQ ID NO: 1150033 - DNA, 22 bp, Artificial Sequence
  chemically synthesized
aattacaaatattcagtagttt

SEQ ID NO: 1150034 - DNA, 22 bp, Artificial Sequence
  chemically synthesized
attacaaatattcagtagtttg

SEQ ID NO: 1150035 - DNA, 22 bp, Artificial Sequence
  chemically synthesized
ttgagataaactacaaactact

SEQ ID NO: 1150036 - DNA, 22 bp, Artificial Sequence
  chemically synthesized
attgagataaactacaaactac

SEQ ID NO: 1150037 - DNA, 22 bp, Artificial Sequence
  chemically synthesized
caaatattcagtagtttgtagt

SEQ ID NO: 1150038 - DNA, 22 bp, Artificial Sequence
  chemically synthesized
agtagtttgtagtttatctcaa

SEQ ID NO: 1150039 - DNA, 22 bp, Artificial Sequence
  chemically synthesized
tgtgtgcatttattgagataaa

SEQ ID NO: 1150040 - DNA, 22 bp, Artificial Sequence
  chemically synthesized
atgtgtgcatttattgagataa

SEQ ID NO: 1150041 - DNA, 22 bp, Artificial Sequence
  chemically synthesized
cttatgtgtgcatttattgaga

SEQ ID NO: 1150042 - DNA, 22 bp, Artificial Sequence
  chemically synthesized
ccttatgtgtgcatttattgag

SEQ ID NO: 1150043 - DNA, 22 bp, Artificial Sequence
  chemically synthesized
tccttatgtgtgcatttattga

SEQ ID NO: 1150044 - DNA, 22 bp, Artificial Sequence
  chemically synthesized
gtagtttatctcaataaatgca

SEQ ID NO: 1150045 - DNA, 22 bp, Artificial Sequence
  chemically synthesized
tagtttatctcaataaatgcac

SEQ ID NO: 1150046 - DNA, 22 bp, Artificial Sequence
  chemically synthesized
gtctttccttatgtgtgcattt

SEQ ID NO: 1150047 - DNA, 22 bp, Artificial Sequence
  chemically synthesized
atctcaataaatgcacacataa

SEQ ID NO: 1150048 - DNA, 22 bp, Artificial Sequence
  chemically synthesized
gttagtctttccttatgtgtgc

SEQ ID NO: 1150049 - DNA, 22 bp, Artificial Sequence
  chemically synthesized
tctcaataaatgcacacataag

SEQ ID NO: 1150050 - DNA, 22 bp, Artificial Sequence
  chemically synthesized
tcgttagtctttccttatgtgt

SEQ ID NO: 1150051 - DNA, 22 bp, Artificial Sequence
  chemically synthesized
ctcgttagtctttccttatgtg

SEQ ID NO: 1150052 - DNA, 22 bp, Artificial Sequence
  chemically synthesized
tctcgttagtctttccttatgt

SEQ ID NO: 1150053 - DNA, 22 bp, Artificial Sequence
  chemically synthesized
aataaatgcacacataaggaaa

SEQ ID NO: 1150054 - DNA, 22 bp, Artificial Sequence
  chemically synthesized
ttctcgttagtctttccttatg

SEQ ID NO: 1150055 - DNA, 22 bp, Artificial Sequence
  chemically synthesized
tttctcgttagtctttccttat

SEQ ID NO: 1150056 - DNA, 22 bp, Artificial Sequence
  chemically synthesized
ttttctcgttagtctttcctta

SEQ ID NO: 1150057 - DNA, 22 bp, Artificial Sequence
  chemically synthesized
caatttttttctcgttagtctt

SEQ ID NO: 1150058 - DNA, 22 bp, Artificial Sequence
  chemically synthesized
ctacaatttttttctcgttagt

SEQ ID NO: 1150059 - DNA, 22 bp, Artificial Sequence
  chemically synthesized
gctacaatttttttctcgttag

SEQ ID NO: 1150060 - DNA, 22 bp, Artificial Sequence
  chemically synthesized
tgtttgctacaatttttttctc

SEQ ID NO: 1150061 - DNA, 22 bp, Artificial Sequence
  chemically synthesized
atgtttgctacaatttttttct

SEQ ID NO: 1150062 - DNA, 22 bp, Artificial Sequence
  chemically synthesized
tatgtttgctacaatttttttc

SEQ ID NO: 1150063 - DNA, 22 bp, Artificial Sequence
  chemically synthesized
caaattttatgtttgctacaat

SEQ ID NO: 1150064 - DNA, 22 bp, Artificial Sequence
  chemically synthesized
acgagaaaaaaattgtagcaaa

SEQ ID NO: 1150065 - DNA, 22 bp, Artificial Sequence
  chemically synthesized
gcaaattttatgtttgctacaa

SEQ ID NO: 1150066 - DNA, 22 bp, Artificial Sequence
  chemically synthesized
tgcaaattttatgtttgctaca

SEQ ID NO: 1150067 - DNA, 22 bp, Artificial Sequence
  chemically synthesized
atgtcctttgcaaattttatgt

SEQ ID NO: 1150068 - DNA, 22 bp, Artificial Sequence
  chemically synthesized
aatgtcctttgcaaattttatg

SEQ ID NO: 1150069 - DNA, 22 bp, Artificial Sequence
  chemically synthesized
ttaatgtcctttgcaaatttta

SEQ ID NO: 1150070 - DNA, 22 bp, Artificial Sequence
  chemically synthesized
tagcaaacataaaatttgcaaa

SEQ ID NO: 1150071 - DNA, 22 bp, Artificial Sequence
  chemically synthesized
aattcttaatgtcctttgcaaa

SEQ ID NO: 1150072 - DNA, 22 bp, Artificial Sequence
  chemically synthesized
tgaattcttaatgtcctttgca

SEQ ID NO: 1150073 - DNA, 22 bp, Artificial Sequence
  chemically synthesized
ctgaattcttaatgtcctttgc

SEQ ID NO: 1150074 - DNA, 22 bp, Artificial Sequence
  chemically synthesized
gaaccttctgaattcttaatgt

SEQ ID NO: 1150075 - DNA, 22 bp, Artificial Sequence
  chemically synthesized
ctagaaccttctgaattcttaa

SEQ ID NO: 1150076 - DNA, 22 bp, Artificial Sequence
  chemically synthesized
gcaaaggacattaagaattcag

SEQ ID NO: 1150077 - DNA, 22 bp, Artificial Sequence
  chemically synthesized
caaaggacattaagaattcaga

SEQ ID NO: 1150078 - DNA, 22 bp, Artificial Sequence
  chemically synthesized
ttcctagaaccttctgaattct

SEQ ID NO: 1150079 - DNA, 22 bp, Artificial Sequence
  chemically synthesized
tattcctagaaccttctgaatt

SEQ ID NO: 1150080 - DNA, 22 bp, Artificial Sequence
  chemically synthesized
aactctattcctagaaccttct

SEQ ID NO: 1150081 - DNA, 22 bp, Artificial Sequence
  chemically synthesized
agaattcagaaggttctaggaa

SEQ ID NO: 1150082 - DNA, 22 bp, Artificial Sequence
  chemically synthesized
gactcaactctattcctagaac

SEQ ID NO: 1150083 - DNA, 22 bp, Artificial Sequence
  chemically synthesized
agaaggttctaggaatagagtt

SEQ ID NO: 1150084 - DNA, 22 bp, Artificial Sequence
  chemically synthesized
gatgttagactcaactctattc

SEQ ID NO: 1150085 - DNA, 22 bp, Artificial Sequence
  chemically synthesized
ctggatgttagactcaactcta

SEQ ID NO: 1150086 - DNA, 22 bp, Artificial Sequence
  chemically synthesized
cctggatgttagactcaactct

SEQ ID NO: 1150087 - DNA, 22 bp, Artificial Sequence
  chemically synthesized
tcctggatgttagactcaactc

SEQ ID NO: 1150088 - DNA, 22 bp, Artificial Sequence
  chemically synthesized
tttcctggatgttagactcaac

SEQ ID NO: 1150089 - DNA, 22 bp, Artificial Sequence
  chemically synthesized
ctttcctggatgttagactcaa

SEQ ID NO: 1150090 - DNA, 22 bp, Artificial Sequence
  chemically synthesized
taggaatagagttgagtctaac

SEQ ID NO: 1150091 - DNA, 22 bp, Artificial Sequence
  chemically synthesized
ggaatagagttgagtctaacat

SEQ ID NO: 1150092 - DNA, 22 bp, Artificial Sequence
  chemically synthesized
agatacttctttcctggatgtt

SEQ ID NO: 1150093 - DNA, 22 bp, Artificial Sequence
  chemically synthesized
aagatacttctttcctggatgt

SEQ ID NO: 1150094 - DNA, 22 bp, Artificial Sequence
  chemically synthesized
taagatacttctttcctggatg

SEQ ID NO: 1150095 - DNA, 22 bp, Artificial Sequence
  chemically synthesized
ttaagatacttctttcctggat

SEQ ID NO: 1150096 - DNA, 22 bp, Artificial Sequence
  chemically synthesized
tttaagatacttctttcctgga

SEQ ID NO: 1150097 - DNA, 22 bp, Artificial Sequence
  chemically synthesized
ttttaagatacttctttcctgg

SEQ ID NO: 1150098 - DNA, 22 bp, Artificial Sequence
  chemically synthesized
agtctaacatccaggaaagaag

SEQ ID NO: 1150099 - DNA, 22 bp, Artificial Sequence
  chemically synthesized
acatccaggaaagaagtatctt

SEQ ID NO: 1150100 - DNA, 22 bp, Artificial Sequence
  chemically synthesized
atgagacagcttttttaagata

SEQ ID NO: 1150101 - DNA, 22 bp, Artificial Sequence
  chemically synthesized
ttcatgagacagcttttttaag

SEQ ID NO: 1150102 - DNA, 22 bp, Artificial Sequence
  chemically synthesized
gttcatgagacagcttttttaa

SEQ ID NO: 1150103 - DNA, 22 bp, Artificial Sequence
  chemically synthesized
tgttcatgagacagctttttta

SEQ ID NO: 1150104 - DNA, 22 bp, Artificial Sequence
  chemically synthesized
ttgttcatgagacagctttttt

SEQ ID NO: 1150105 - DNA, 22 bp, Artificial Sequence
  chemically synthesized
tttgttcatgagacagcttttt

SEQ ID NO: 1150106 - DNA, 22 bp, Artificial Sequence
  chemically synthesized
ttttgttcatgagacagctttt

SEQ ID NO: 1150107 - DNA, 22 bp, Artificial Sequence
  chemically synthesized
gggatttttttgttcatgagac

SEQ ID NO: 1150108 - DNA, 22 bp, Artificial Sequence
  chemically synthesized
aaaaaagctgtctcatgaacaa

SEQ ID NO: 1150109 - DNA, 22 bp, Artificial Sequence
  chemically synthesized
aaaaagctgtctcatgaacaaa

SEQ ID NO: 1150110 - DNA, 22 bp, Artificial Sequence
  chemically synthesized
gtatctagggatttttttgttc

SEQ ID NO: 1150111 - DNA, 22 bp, Artificial Sequence
  chemically synthesized
tctcatgaacaaaaaaatccct

SEQ ID NO: 1150112 - DNA, 22 bp, Artificial Sequence
  chemically synthesized
atgaacaaaaaaatccctagat

SEQ ID NO: 1150113 - DNA, 22 bp, Artificial Sequence
  chemically synthesized
acatgatcattagtatctaggg

SEQ ID NO: 1150114 - DNA, 22 bp, Artificial Sequence
  chemically synthesized
aattaacatgatcattagtatc

SEQ ID NO: 1150115 - DNA, 22 bp, Artificial Sequence
  chemically synthesized
gaattaacatgatcattagtat

SEQ ID NO: 1150116 - DNA, 22 bp, Artificial Sequence
  chemically synthesized
gatactaatgatcatgttaatt

SEQ ID NO: 1150117 - DNA, 22 bp, Artificial Sequence
  chemically synthesized
tccagatgtcttgaattaacat

SEQ ID NO: 1150118 - DNA, 22 bp, Artificial Sequence
  chemically synthesized
ctgtccagatgtcttgaattaa

SEQ ID NO: 1150119 - DNA, 22 bp, Artificial Sequence
  chemically synthesized
atgatcatgttaattcaagaca

SEQ ID NO: 1150120 - DNA, 22 bp, Artificial Sequence
  chemically synthesized
attcaagacatctggacaggaa

SEQ ID NO: 1150121 - DNA, 22 bp, Artificial Sequence
  chemically synthesized
aaaaaaagtcaattcctgtcca

SEQ ID NO: 1150122 - DNA, 22 bp, Artificial Sequence
  chemically synthesized
gaaaaaaagtcaattcctgtcc

SEQ ID NO: 1150123 - DNA, 22 bp, Artificial Sequence
  chemically synthesized
aagacatctggacaggaattga

SEQ ID NO: 1150124 - DNA, 22 bp, Artificial Sequence
  chemically synthesized
tttgaaaaaaagtcaattcctg

SEQ ID NO: 1150125 - DNA, 22 bp, Artificial Sequence
  chemically synthesized
atttgaaaaaaagtcaattcct

SEQ ID NO: 1150126 - DNA, 22 bp, Artificial Sequence
  chemically synthesized
tatttgaaaaaaagtcaattcc

SEQ ID NO: 1150127 - DNA, 22 bp, Artificial Sequence
  chemically synthesized
ttatttgaaaaaaagtcaattc

SEQ ID NO: 1150128 - DNA, 22 bp, Artificial Sequence
  chemically synthesized
aagtttttatttgaaaaaaagt

SEQ ID NO: 1150129 - DNA, 22 bp, Artificial Sequence
  chemically synthesized
gacaggaattgactttttttca

SEQ ID NO: 1150130 - DNA, 22 bp, Artificial Sequence
  chemically synthesized
gaagtttttatttgaaaaaaag

SEQ ID NO: 1150131 - DNA, 22 bp, Artificial Sequence
  chemically synthesized
tacttgaagtttttatttgaaa

SEQ ID NO: 1150132 - DNA, 22 bp, Artificial Sequence
  chemically synthesized
atctgtacttgaagtttttatt

SEQ ID NO: 1150133 - DNA, 22 bp, Artificial Sequence
  chemically synthesized
actttttttcaaataaaaactt

SEQ ID NO: 1150134 - DNA, 22 bp, Artificial Sequence
  chemically synthesized
tgatctgtacttgaagttttta

SEQ ID NO: 1150135 - DNA, 22 bp, Artificial Sequence
  chemically synthesized
ctgatctgtacttgaagttttt

SEQ ID NO: 1150136 - DNA, 22 bp, Artificial Sequence
  chemically synthesized
tctgatctgtacttgaagtttt

SEQ ID NO: 1150137 - DNA, 22 bp, Artificial Sequence
  chemically synthesized
tttttcaaataaaaacttcaag

SEQ ID NO: 1150138 - DNA, 22 bp, Artificial Sequence
  chemically synthesized
ttttcaaataaaaacttcaagt

SEQ ID NO: 1150139 - DNA, 22 bp, Artificial Sequence
  chemically synthesized
tttcaaataaaaacttcaagta

SEQ ID NO: 1150140 - DNA, 22 bp, Artificial Sequence
  chemically synthesized
ttcaaataaaaacttcaagtac

SEQ ID NO: 1150141 - DNA, 22 bp, Artificial Sequence
  chemically synthesized
tcaaataaaaacttcaagtaca

SEQ ID NO: 1150142 - DNA, 22 bp, Artificial Sequence
  chemically synthesized
caaataaaaacttcaagtacag

SEQ ID NO: 1150143 - DNA, 22 bp, Artificial Sequence
  chemically synthesized
acactttctgatctgtacttga

SEQ ID NO: 1150144 - DNA, 22 bp, Artificial Sequence
  chemically synthesized
aaataaaaacttcaagtacaga

SEQ ID NO: 1150145 - DNA, 22 bp, Artificial Sequence
  chemically synthesized
caagtacagatcagaaagtgtt

SEQ ID NO: 1150146 - DNA, 22 bp, Artificial Sequence
  chemically synthesized
ccaagaaatcctaacactttct

SEQ ID NO: 1150147 - DNA, 22 bp, Artificial Sequence
  chemically synthesized
aagtacagatcagaaagtgtta

SEQ ID NO: 1150148 - DNA, 22 bp, Artificial Sequence
  chemically synthesized
cccaagaaatcctaacactttc

SEQ ID NO: 1150149 - DNA, 22 bp, Artificial Sequence
  chemically synthesized
ccaccccatcatttcccaagaa

SEQ ID NO: 1150150 - DNA, 22 bp, Artificial Sequence
  chemically synthesized
cctaccaccccatcatttccca

SEQ ID NO: 1150151 - DNA, 22 bp, Artificial Sequence
  chemically synthesized
ggatttcttgggaaatgatggg

SEQ ID NO: 1150152 - DNA, 22 bp, Artificial Sequence
  chemically synthesized
cttgggaaatgatggggtggta

SEQ ID NO: 1150153 - DNA, 22 bp, Artificial Sequence
  chemically synthesized
ttgggaaatgatggggtggtag

SEQ ID NO: 1150154 - DNA, 22 bp, Artificial Sequence
  chemically synthesized
gggaaatgatggggtggtaggt

SEQ ID NO: 1150155 - DNA, 22 bp, Artificial Sequence
  chemically synthesized
ggaaatgatggggtggtaggta

SEQ ID NO: 1150156 - DNA, 22 bp, Artificial Sequence
  chemically synthesized
atttttttcactcttttcctct

SEQ ID NO: 1150157 - DNA, 22 bp, Artificial Sequence
  chemically synthesized
tttttttcactcttttcctcta

SEQ ID NO: 1150158 - DNA, 22 bp, Artificial Sequence
  chemically synthesized
ttttcactcttttcctctatgc

SEQ ID NO: 1150159 - DNA, 22 bp, Artificial Sequence
  chemically synthesized
tttcactcttttcctctatgcc

SEQ ID NO: 1150160 - DNA, 22 bp, Artificial Sequence
  chemically synthesized
ttcactcttttcctctatgccc

SEQ ID NO: 1150161 - DNA, 22 bp, Artificial Sequence
  chemically synthesized
tcactcttttcctctatgcccc

SEQ ID NO: 1150162 - DNA, 22 bp, Artificial Sequence
  chemically synthesized
cactcttttcctctatgcccca

SEQ ID NO: 1150163 - DNA, 22 bp, Artificial Sequence
  chemically synthesized
actcttttcctctatgccccat

SEQ ID NO: 1150164 - DNA, 22 bp, Artificial Sequence
  chemically synthesized
ttttcctctatgccccattcct

SEQ ID NO: 1150165 - DNA, 22 bp, Artificial Sequence
  chemically synthesized
ttcctctatgccccattccttc

SEQ ID NO: 1150166 - DNA, 22 bp, Artificial Sequence
  chemically synthesized
tcctctatgccccattccttct

SEQ ID NO: 1150167 - DNA, 22 bp, Artificial Sequence
  chemically synthesized
cctctatgccccattccttcta

SEQ ID NO: 1150168 - DNA, 22 bp, Artificial Sequence
  chemically synthesized
ctctatgccccattccttctac

SEQ ID NO: 1150169 - DNA, 22 bp, Artificial Sequence
  chemically synthesized
tatgccccattccttctaccac

SEQ ID NO: 1150170 - DNA, 22 bp, Artificial Sequence
  chemically synthesized
gcccagtgtagaggtggtagaa

SEQ ID NO: 1150171 - DNA, 22 bp, Artificial Sequence
  chemically synthesized
tgccccattccttctaccacct

SEQ ID NO: 1150172 - DNA, 22 bp, Artificial Sequence
  chemically synthesized
cttctaccacctctacactggg

SEQ ID NO: 1150173 - DNA, 22 bp, Artificial Sequence
  chemically synthesized
ctaccacctctacactgggcta

SEQ ID NO: 1150174 - DNA, 22 bp, Artificial Sequence
  chemically synthesized
taccacctctacactgggctag

SEQ ID NO: 1150175 - DNA, 22 bp, Artificial Sequence
  chemically synthesized
ccacctctacactgggctaggc

SEQ ID NO: 1150176 - DNA, 22 bp, Artificial Sequence
  chemically synthesized
tacactgggctaggctctatat

SEQ ID NO: 1150177 - DNA, 22 bp, Artificial Sequence
  chemically synthesized
aggccagcaagggatatagagc

SEQ ID NO: 1150178 - DNA, 22 bp, Artificial Sequence
  chemically synthesized
cactgggctaggctctatatcc

SEQ ID NO: 1150179 - DNA, 22 bp, Artificial Sequence
  chemically synthesized
ggctaggctctatatcccttgc

SEQ ID NO: 1150180 - DNA, 22 bp, Artificial Sequence
  chemically synthesized
ggctctatatcccttgctggcc

SEQ ID NO: 1150181 - DNA, 22 bp, Artificial Sequence
  chemically synthesized
cagatcatatcattcaggccag

SEQ ID NO: 1150182 - DNA, 22 bp, Artificial Sequence
  chemically synthesized
tatatcccttgctggcctgaat

SEQ ID NO: 1150183 - DNA, 22 bp, Artificial Sequence
  chemically synthesized
ccagatcatatcattcaggcca

SEQ ID NO: 1150184 - DNA, 22 bp, Artificial Sequence
  chemically synthesized
tccagatcatatcattcaggcc

SEQ ID NO: 1150185 - DNA, 22 bp, Artificial Sequence
  chemically synthesized
tatcccttgctggcctgaatga

SEQ ID NO: 1150186 - DNA, 22 bp, Artificial Sequence
  chemically synthesized
gctggcctgaatgatatgatct

SEQ ID NO: 1150187 - DNA, 22 bp, Artificial Sequence
  chemically synthesized
ctggcctgaatgatatgatctg

SEQ ID NO: 1150188 - DNA, 22 bp, Artificial Sequence
  chemically synthesized
gcctgaatgatatgatctggaa

SEQ ID NO: 1150189 - DNA, 22 bp, Artificial Sequence
  chemically synthesized
aatgatatgatctggaaaggac

SEQ ID NO: 1150190 - DNA, 22 bp, Artificial Sequence
  chemically synthesized
caaataaaatcgaaagtccttt

SEQ ID NO: 1150191 - DNA, 22 bp, Artificial Sequence
  chemically synthesized
actgcaaataaaatcgaaagtc

SEQ ID NO: 1150192 - DNA, 22 bp, Artificial Sequence
  chemically synthesized
cactgcaaataaaatcgaaagt

SEQ ID NO: 1150193 - DNA, 22 bp, Artificial Sequence
  chemically synthesized
gaaaggactttcgattttattt

SEQ ID NO: 1150194 - DNA, 22 bp, Artificial Sequence
  chemically synthesized
gcaaagtgaatatttcactgca

SEQ ID NO: 1150195 - DNA, 22 bp, Artificial Sequence
  chemically synthesized
tcgattttatttgcagtgaaat

SEQ ID NO: 1150196 - DNA, 22 bp, Artificial Sequence
  chemically synthesized
agcaaagtgaatatttcactgc

SEQ ID NO: 1150197 - DNA, 22 bp, Artificial Sequence
  chemically synthesized
cgattttatttgcagtgaaata

SEQ ID NO: 1150198 - DNA, 22 bp, Artificial Sequence
  chemically synthesized
gattttatttgcagtgaaatat

SEQ ID NO: 1150199 - DNA, 22 bp, Artificial Sequence
  chemically synthesized
tatttgcagtgaaatattcact

SEQ ID NO: 1150200 - DNA, 22 bp, Artificial Sequence
  chemically synthesized
atttgcagtgaaatattcactt

SEQ ID NO: 1150201 - DNA, 22 bp, Artificial Sequence
  chemically synthesized
tttgcagtgaaatattcacttt

SEQ ID NO: 1150202 - DNA, 22 bp, Artificial Sequence
  chemically synthesized
gcagtgaaatattcactttgct

SEQ ID NO: 1150203 - DNA, 22 bp, Artificial Sequence
  chemically synthesized
cagtgaaatattcactttgcta

SEQ ID NO: 1150204 - DNA, 22 bp, Artificial Sequence
  chemically synthesized
tgaccagccaggcttagcaaag

SEQ ID NO: 1150205 - DNA, 22 bp, Artificial Sequence
  chemically synthesized
gacaatactgtgaccagccagg

SEQ ID NO: 1150206 - DNA, 22 bp, Artificial Sequence
  chemically synthesized
actttgctaagcctggctggtc

SEQ ID NO: 1150207 - DNA, 22 bp, Artificial Sequence
  chemically synthesized
tgctaagcctggctggtcacag

SEQ ID NO: 1150208 - DNA, 22 bp, Artificial Sequence
  chemically synthesized
gctaagcctggctggtcacagt

SEQ ID NO: 1150209 - DNA, 22 bp, Artificial Sequence
  chemically synthesized
ctaagcctggctggtcacagta

SEQ ID NO: 1150210 - DNA, 22 bp, Artificial Sequence
  chemically synthesized
agcctggctggtcacagtattg

SEQ ID NO: 1150211 - DNA, 22 bp, Artificial Sequence
  chemically synthesized
atggaaagctagacaatactgt

SEQ ID NO: 1150212 - DNA, 22 bp, Artificial Sequence
  chemically synthesized
catggaaagctagacaatactg

SEQ ID NO: 1150213 - DNA, 22 bp, Artificial Sequence
  chemically synthesized
gctggtcacagtattgtctagc

SEQ ID NO: 1150214 - DNA, 22 bp, Artificial Sequence
  chemically synthesized
gtcacagtattgtctagctttc

SEQ ID NO: 1150215 - DNA, 22 bp, Artificial Sequence
  chemically synthesized
tataccgtaaatagatcttcat

SEQ ID NO: 1150216 - DNA, 22 bp, Artificial Sequence
  chemically synthesized
tctagctttccatgaagatcta

SEQ ID NO: 1150217 - DNA, 22 bp, Artificial Sequence
  chemically synthesized
gctttccatgaagatctattta

SEQ ID NO: 1150218 - DNA, 22 bp, Artificial Sequence
  chemically synthesized
tccatgaagatctatttacggt

SEQ ID NO: 1150219 - DNA, 22 bp, Artificial Sequence
  chemically synthesized
ccatgaagatctatttacggta

SEQ ID NO: 1150220 - DNA, 22 bp, Artificial Sequence
  chemically synthesized
catgaagatctatttacggtat

SEQ ID NO: 1150221 - DNA, 22 bp, Artificial Sequence
  chemically synthesized
taacaaagttatataccgtaaa

SEQ ID NO: 1150222 - DNA, 22 bp, Artificial Sequence
  chemically synthesized
ataacaaagttatataccgtaa

SEQ ID NO: 1150223 - DNA, 22 bp, Artificial Sequence
  chemically synthesized
agcaaatttataacaaagttat

SEQ ID NO: 1150224 - DNA, 22 bp, Artificial Sequence
  chemically synthesized
tttacggtatataactttgtta

SEQ ID NO: 1150225 - DNA, 22 bp, Artificial Sequence
  chemically synthesized
acggtatataactttgttataa

SEQ ID NO: 1150226 - DNA, 22 bp, Artificial Sequence
  chemically synthesized
cggtatataactttgttataaa

SEQ ID NO: 1150227 - DNA, 22 bp, Artificial Sequence
  chemically synthesized
aaatattcagcaaatttataac

SEQ ID NO: 1150228 - DNA, 22 bp, Artificial Sequence
  chemically synthesized
aaaatattcagcaaatttataa

SEQ ID NO: 1150229 - DNA, 22 bp, Artificial Sequence
  chemically synthesized
tttaaaatattcagcaaattta

SEQ ID NO: 1150230 - DNA, 22 bp, Artificial Sequence
  chemically synthesized
tgttataaatttgctgaatatt

SEQ ID NO: 1150231 - DNA, 22 bp, Artificial Sequence
  chemically synthesized
gttataaatttgctgaatattt

SEQ ID NO: 1150232 - DNA, 22 bp, Artificial Sequence
  chemically synthesized
ttataaatttgctgaatatttt

SEQ ID NO: 1150233 - DNA, 22 bp, Artificial Sequence
  chemically synthesized
aggaagattatttaaaatattc

SEQ ID NO: 1150234 - DNA, 22 bp, Artificial Sequence
  chemically synthesized
taaatttgctgaatattttaaa

SEQ ID NO: 1150235 - DNA, 22 bp, Artificial Sequence
  chemically synthesized
ttgaggaagattatttaaaata

SEQ ID NO: 1150236 - DNA, 22 bp, Artificial Sequence
  chemically synthesized
gctgaatattttaaataatctt

SEQ ID NO: 1150237 - DNA, 22 bp, Artificial Sequence
  chemically synthesized
ctgaatattttaaataatcttc

SEQ ID NO: 1150238 - DNA, 22 bp, Artificial Sequence
  chemically synthesized
aatattttaaataatcttcctc

SEQ ID NO: 1150239 - DNA, 22 bp, Artificial Sequence
  chemically synthesized
gggtagcctgttgaggaagatt

SEQ ID NO: 1150240 - DNA, 22 bp, Artificial Sequence
  chemically synthesized
tagggtagcctgttgaggaaga

SEQ ID NO: 1150241 - DNA, 22 bp, Artificial Sequence
  chemically synthesized
ctagggtagcctgttgaggaag

SEQ ID NO: 1150242 - DNA, 22 bp, Artificial Sequence
  chemically synthesized
tctagggtagcctgttgaggaa

SEQ ID NO: 1150243 - DNA, 22 bp, Artificial Sequence
  chemically synthesized
ttctagggtagcctgttgagga

SEQ ID NO: 1150244 - DNA, 22 bp, Artificial Sequence
  chemically synthesized
taaataatcttcctcaacaggc

SEQ ID NO: 1150245 - DNA, 22 bp, Artificial Sequence
  chemically synthesized
aaataatcttcctcaacaggct

SEQ ID NO: 1150246 - DNA, 22 bp, Artificial Sequence
  chemically synthesized
aataatcttcctcaacaggcta

SEQ ID NO: 1150247 - DNA, 22 bp, Artificial Sequence
  chemically synthesized
cctcaacaggctaccctagaaa

SEQ ID NO: 1150248 - DNA, 22 bp, Artificial Sequence
  chemically synthesized
ctcaacaggctaccctagaaaa

SEQ ID NO: 1150249 - DNA, 22 bp, Artificial Sequence
  chemically synthesized
aacaggctaccctagaaaagct

SEQ ID NO: 1150250 - DNA, 22 bp, Artificial Sequence
  chemically synthesized
agtaagtgaatatcaaaagctt

SEQ ID NO: 1150251 - DNA, 22 bp, Artificial Sequence
  chemically synthesized
aagtaagtgaatatcaaaagct

SEQ ID NO: 1150252 - DNA, 22 bp, Artificial Sequence
  chemically synthesized
ccctagaaaagcttttgatatt

SEQ ID NO: 1150253 - DNA, 22 bp, Artificial Sequence
  chemically synthesized
gaaaagcttttgatattcactt

SEQ ID NO: 1150254 - DNA, 22 bp, Artificial Sequence
  chemically synthesized
aatcacatttaagtaagtgaat

SEQ ID NO: 1150255 - DNA, 22 bp, Artificial Sequence
  chemically synthesized
ttgatattcacttacttaaatg

SEQ ID NO: 1150256 - DNA, 22 bp, Artificial Sequence
  chemically synthesized
tgatattcacttacttaaatgt

SEQ ID NO: 1150257 - DNA, 22 bp, Artificial Sequence
  chemically synthesized
gatattcacttacttaaatgtg

SEQ ID NO: 1150258 - DNA, 22 bp, Artificial Sequence
  chemically synthesized
atattcacttacttaaatgtga

SEQ ID NO: 1150259 - DNA, 22 bp, Artificial Sequence
  chemically synthesized
ataaagatattcaatcacattt

SEQ ID NO: 1150260 - DNA, 22 bp, Artificial Sequence
  chemically synthesized
acttacttaaatgtgattgaat

SEQ ID NO: 1150261 - DNA, 22 bp, Artificial Sequence
  chemically synthesized
acttaaatgtgattgaatatct

SEQ ID NO: 1150262 - DNA, 22 bp, Artificial Sequence
  chemically synthesized
cttaaatgtgattgaatatctt

SEQ ID NO: 1150263 - DNA, 22 bp, Artificial Sequence
  chemically synthesized
aaatgtgattgaatatctttat

SEQ ID NO: 1150264 - DNA, 22 bp, Artificial Sequence
  chemically synthesized
atataagaactaataaagatat

SEQ ID NO: 1150265 - DNA, 22 bp, Artificial Sequence
  chemically synthesized
aatgtgattgaatatctttatt

SEQ ID NO: 1150266 - DNA, 22 bp, Artificial Sequence
  chemically synthesized
tgatataagaactaataaagat

SEQ ID NO: 1150267 - DNA, 22 bp, Artificial Sequence
  chemically synthesized
aatatctttattagttcttata

SEQ ID NO: 1150268 - DNA, 22 bp, Artificial Sequence
  chemically synthesized
tattagttcttatatcagaaca

SEQ ID NO: 1150269 - DNA, 22 bp, Artificial Sequence
  chemically synthesized
attagttcttatatcagaacac

SEQ ID NO: 1150270 - DNA, 22 bp, Artificial Sequence
  chemically synthesized
ttagttcttatatcagaacaca

SEQ ID NO: 1150271 - DNA, 22 bp, Artificial Sequence
  chemically synthesized
gttcttatatcagaacacactg

SEQ ID NO: 1150272 - DNA, 22 bp, Artificial Sequence
  chemically synthesized
acaaaaagataaaatcagtgtg

SEQ ID NO: 1150273 - DNA, 22 bp, Artificial Sequence
  chemically synthesized
ttatatcagaacacactgattt

SEQ ID NO: 1150274 - DNA, 22 bp, Artificial Sequence
  chemically synthesized
taacaaaaagataaaatcagtg

SEQ ID NO: 1150275 - DNA, 22 bp, Artificial Sequence
  chemically synthesized
atatcagaacacactgatttta

SEQ ID NO: 1150276 - DNA, 22 bp, Artificial Sequence
  chemically synthesized
ctaacaaaaagataaaatcagt

SEQ ID NO: 1150277 - DNA, 22 bp, Artificial Sequence
  chemically synthesized
tatcagaacacactgattttat

SEQ ID NO: 1150278 - DNA, 22 bp, Artificial Sequence
  chemically synthesized
atttctaacaaaaagataaaat

SEQ ID NO: 1150279 - DNA, 22 bp, Artificial Sequence
  chemically synthesized
attttatctttttgttagaaat

SEQ ID NO: 1150280 - DNA, 22 bp, Artificial Sequence
  chemically synthesized
tatctttttgttagaaatgaat

SEQ ID NO: 1150281 - DNA, 22 bp, Artificial Sequence
  chemically synthesized
atctttttgttagaaatgaatg

SEQ ID NO: 1150282 - DNA, 22 bp, Artificial Sequence
  chemically synthesized
tctttttgttagaaatgaatgt

SEQ ID NO: 1150283 - DNA, 22 bp, Artificial Sequence
  chemically synthesized
gcagaaacataaacattcattt

SEQ ID NO: 1150284 - DNA, 22 bp, Artificial Sequence
  chemically synthesized
tttgttagaaatgaatgtttat

SEQ ID NO: 1150285 - DNA, 22 bp, Artificial Sequence
  chemically synthesized
ttgttagaaatgaatgtttatg

SEQ ID NO: 1150286 - DNA, 22 bp, Artificial Sequence
  chemically synthesized
tgttagaaatgaatgtttatgt

SEQ ID NO: 1150287 - DNA, 22 bp, Artificial Sequence
  chemically synthesized
gttagaaatgaatgtttatgtt

SEQ ID NO: 1150288 - DNA, 22 bp, Artificial Sequence
  chemically synthesized
ggagttggcagaaacataaaca

SEQ ID NO: 1150289 - DNA, 22 bp, Artificial Sequence
  chemically synthesized
ttagaaatgaatgtttatgttt

SEQ ID NO: 1150290 - DNA, 22 bp, Artificial Sequence
  chemically synthesized
aggagttggcagaaacataaac

SEQ ID NO: 1150291 - DNA, 22 bp, Artificial Sequence
  chemically synthesized
gaaatgaatgtttatgtttctg

SEQ ID NO: 1150292 - DNA, 22 bp, Artificial Sequence
  chemically synthesized
gtagcttaggagttggcagaaa

SEQ ID NO: 1150293 - DNA, 22 bp, Artificial Sequence
  chemically synthesized
ggtagcttaggagttggcagaa

SEQ ID NO: 1150294 - DNA, 22 bp, Artificial Sequence
  chemically synthesized
atgtttctgccaactcctaagc

SEQ ID NO: 1150295 - DNA, 22 bp, Artificial Sequence
  chemically synthesized
tgtttctgccaactcctaagct

SEQ ID NO: 1150296 - DNA, 22 bp, Artificial Sequence
  chemically synthesized
agaacccccatttggtagctta

SEQ ID NO: 1150297 - DNA, 22 bp, Artificial Sequence
  chemically synthesized
ctgccaactcctaagctaccaa

SEQ ID NO: 1150298 - DNA, 22 bp, Artificial Sequence
  chemically synthesized
cagaacccccatttggtagctt

SEQ ID NO: 1150299 - DNA, 22 bp, Artificial Sequence
  chemically synthesized
tgccaactcctaagctaccaaa

SEQ ID NO: 1150300 - DNA, 22 bp, Artificial Sequence
  chemically synthesized
tcagaacccccatttggtagct

SEQ ID NO: 1150301 - DNA, 22 bp, Artificial Sequence
  chemically synthesized
ccaactcctaagctaccaaatg

SEQ ID NO: 1150302 - DNA, 22 bp, Artificial Sequence
  chemically synthesized
ctaagctaccaaatgggggttc

SEQ ID NO: 1150303 - DNA, 22 bp, Artificial Sequence
  chemically synthesized
aaacagtctttcagaaccccca

SEQ ID NO: 1150304 - DNA, 22 bp, Artificial Sequence
  chemically synthesized
agctaccaaatgggggttctga

SEQ ID NO: 1150305 - DNA, 22 bp, Artificial Sequence
  chemically synthesized
cattgaaacagtctttcagaac

SEQ ID NO: 1150306 - DNA, 22 bp, Artificial Sequence
  chemically synthesized
ccaaatgggggttctgaaagac

SEQ ID NO: 1150307 - DNA, 22 bp, Artificial Sequence
  chemically synthesized
tccattgaaacagtctttcaga

SEQ ID NO: 1150308 - DNA, 22 bp, Artificial Sequence
  chemically synthesized
aaatctctccattgaaacagtc

SEQ ID NO: 1150309 - DNA, 22 bp, Artificial Sequence
  chemically synthesized
caaatctctccattgaaacagt

SEQ ID NO: 1150310 - DNA, 22 bp, Artificial Sequence
  chemically synthesized
tcaaatctctccattgaaacag

SEQ ID NO: 1150311 - DNA, 22 bp, Artificial Sequence
  chemically synthesized
tgaaagactgtttcaatggaga

SEQ ID NO: 1150312 - DNA, 22 bp, Artificial Sequence
  chemically synthesized
aaagactgtttcaatggagaga

SEQ ID NO: 1150313 - DNA, 22 bp, Artificial Sequence
  chemically synthesized
tatagcctttcaaatctctcca

SEQ ID NO: 1150314 - DNA, 22 bp, Artificial Sequence
  chemically synthesized
gtatagcctttcaaatctctcc

SEQ ID NO: 1150315 - DNA, 22 bp, Artificial Sequence
  chemically synthesized
tttcaatggagagatttgaaag

SEQ ID NO: 1150316 - DNA, 22 bp, Artificial Sequence
  chemically synthesized
caatggagagatttgaaaggct

SEQ ID NO: 1150317 - DNA, 22 bp, Artificial Sequence
  chemically synthesized
gtgtgcttgtatagcctttcaa

SEQ ID NO: 1150318 - DNA, 22 bp, Artificial Sequence
  chemically synthesized
aatggagagatttgaaaggcta

SEQ ID NO: 1150319 - DNA, 22 bp, Artificial Sequence
  chemically synthesized
agtgtgcttgtatagcctttca

SEQ ID NO: 1150320 - DNA, 22 bp, Artificial Sequence
  chemically synthesized
agaagcatttagtgtgcttgta

SEQ ID NO: 1150321 - DNA, 22 bp, Artificial Sequence
  chemically synthesized
gaaaggctatacaagcacacta

SEQ ID NO: 1150322 - DNA, 22 bp, Artificial Sequence
  chemically synthesized
ttgagaagcatttagtgtgctt

SEQ ID NO: 1150323 - DNA, 22 bp, Artificial Sequence
  chemically synthesized
aaaggctatacaagcacactaa

SEQ ID NO: 1150324 - DNA, 22 bp, Artificial Sequence
  chemically synthesized
aggctattgagaagcatttagt

SEQ ID NO: 1150325 - DNA, 22 bp, Artificial Sequence
  chemically synthesized
caggctattgagaagcatttag

SEQ ID NO: 1150326 - DNA, 22 bp, Artificial Sequence
  chemically synthesized
tacaagcacactaaatgcttct

SEQ ID NO: 1150327 - DNA, 22 bp, Artificial Sequence
  chemically synthesized
agtccccttcaggctattgaga

SEQ ID NO: 1150328 - DNA, 22 bp, Artificial Sequence
  chemically synthesized
ttgagtccccttcaggctattg

SEQ ID NO: 1150329 - DNA, 22 bp, Artificial Sequence
  chemically synthesized
attgagtccccttcaggctatt

SEQ ID NO: 1150330 - DNA, 22 bp, Artificial Sequence
  chemically synthesized
aatgcttctcaatagcctgaag

SEQ ID NO: 1150331 - DNA, 22 bp, Artificial Sequence
  chemically synthesized
gtatttattgagtccccttcag

SEQ ID NO: 1150332 - DNA, 22 bp, Artificial Sequence
  chemically synthesized
cgtatttattgagtccccttca

SEQ ID NO: 1150333 - DNA, 22 bp, Artificial Sequence
  chemically synthesized
tcgtatttattgagtccccttc

SEQ ID NO: 1150334 - DNA, 22 bp, Artificial Sequence
  chemically synthesized
ctcaatagcctgaaggggactc

SEQ ID NO: 1150335 - DNA, 22 bp, Artificial Sequence
  chemically synthesized
ttcgtatttattgagtcccctt

SEQ ID NO: 1150336 - DNA, 22 bp, Artificial Sequence
  chemically synthesized
tcaatagcctgaaggggactca

SEQ ID NO: 1150337 - DNA, 22 bp, Artificial Sequence
  chemically synthesized
ttttcgtatttattgagtcccc

SEQ ID NO: 1150338 - DNA, 22 bp, Artificial Sequence
  chemically synthesized
aatagcctgaaggggactcaat

SEQ ID NO: 1150339 - DNA, 22 bp, Artificial Sequence
  chemically synthesized
cttttcgtatttattgagtccc

SEQ ID NO: 1150340 - DNA, 22 bp, Artificial Sequence
  chemically synthesized
aaggggactcaataaatacgaa

SEQ ID NO: 1150341 - DNA, 22 bp, Artificial Sequence
  chemically synthesized
aaacagtttcttttcgtattta

SEQ ID NO: 1150342 - DNA, 22 bp, Artificial Sequence
  chemically synthesized
aaaacagtttcttttcgtattt

SEQ ID NO: 1150343 - DNA, 22 bp, Artificial Sequence
  chemically synthesized
taaaacagtttcttttcgtatt

SEQ ID NO: 1150344 - DNA, 22 bp, Artificial Sequence
  chemically synthesized
ttaaaacagtttcttttcgtat

SEQ ID NO: 1150345 - DNA, 22 bp, Artificial Sequence
  chemically synthesized
tttttaaaacagtttcttttcg

SEQ ID NO: 1150346 - DNA, 22 bp, Artificial Sequence
  chemically synthesized
atttttaaaacagtttcttttc

SEQ ID NO: 1150347 - DNA, 22 bp, Artificial Sequence
  chemically synthesized
tatttttaaaacagtttctttt

SEQ ID NO: 1150348 - DNA, 22 bp, Artificial Sequence
  chemically synthesized
aataaatacgaaaagaaactgt

SEQ ID NO: 1150349 - DNA, 22 bp, Artificial Sequence
  chemically synthesized
ctttatttttaaaacagtttct

SEQ ID NO: 1150350 - DNA, 22 bp, Artificial Sequence
  chemically synthesized
tctactttatttttaaaacagt

SEQ ID NO: 1150351 - DNA, 22 bp, Artificial Sequence
  chemically synthesized
attgtctactttatttttaaaa

SEQ ID NO: 1150352 - DNA, 22 bp, Artificial Sequence
  chemically synthesized
ttttaaaaataaagtagacaat

SEQ ID NO: 1150353 - DNA, 22 bp, Artificial Sequence
  chemically synthesized
taaaaataaagtagacaattaa

SEQ ID NO: 1150354 - DNA, 22 bp, Artificial Sequence
  chemically synthesized
aaaaataaagtagacaattaat

SEQ ID NO: 1150355 - DNA, 22 bp, Artificial Sequence
  chemically synthesized
aaaataaagtagacaattaatg

SEQ ID NO: 1150356 - DNA, 22 bp, Artificial Sequence
  chemically synthesized
catatgtaggagtacattaatt

SEQ ID NO: 1150357 - DNA, 22 bp, Artificial Sequence
  chemically synthesized
ccatatgtaggagtacattaat

SEQ ID NO: 1150358 - DNA, 22 bp, Artificial Sequence
  chemically synthesized
tccatatgtaggagtacattaa

SEQ ID NO: 1150359 - DNA, 22 bp, Artificial Sequence
  chemically synthesized
ttccatatgtaggagtacatta

SEQ ID NO: 1150360 - DNA, 22 bp, Artificial Sequence
  chemically synthesized
tgtccttttccatatgtaggag

SEQ ID NO: 1150361 - DNA, 22 bp, Artificial Sequence
  chemically synthesized
atcctatgtccttttccatatg

SEQ ID NO: 1150362 - DNA, 22 bp, Artificial Sequence
  chemically synthesized
atgtactcctacatatggaaaa

SEQ ID NO: 1150363 - DNA, 22 bp, Artificial Sequence
  chemically synthesized
catcctatgtccttttccatat

SEQ ID NO: 1150364 - DNA, 22 bp, Artificial Sequence
  chemically synthesized
tttcatcctatgtccttttcca

SEQ ID NO: 1150365 - DNA, 22 bp, Artificial Sequence
  chemically synthesized
ctacatatggaaaaggacatag

SEQ ID NO: 1150366 - DNA, 22 bp, Artificial Sequence
  chemically synthesized
catatggaaaaggacataggat

SEQ ID NO: 1150367 - DNA, 22 bp, Artificial Sequence
  chemically synthesized
gtcaatctatttcatcctatgt

SEQ ID NO: 1150368 - DNA, 22 bp, Artificial Sequence
  chemically synthesized
ggtcaatctatttcatcctatg

SEQ ID NO: 1150369 - DNA, 22 bp, Artificial Sequence
  chemically synthesized
tggtcaatctatttcatcctat

SEQ ID NO: 1150370 - DNA, 22 bp, Artificial Sequence
  chemically synthesized
atagtcatgcacaagttttggt

SEQ ID NO: 1150371 - DNA, 22 bp, Artificial Sequence
  chemically synthesized
ctcatagtcatgcacaagtttt

SEQ ID NO: 1150372 - DNA, 22 bp, Artificial Sequence
  chemically synthesized
tctcctcatagtcatgcacaag

SEQ ID NO: 1150373 - DNA, 22 bp, Artificial Sequence
  chemically synthesized
ctgtctcctcatagtcatgcac

SEQ ID NO: 1150374 - DNA, 22 bp, Artificial Sequence
  chemically synthesized
actgtctcctcatagtcatgca

SEQ ID NO: 1150375 - DNA, 22 bp, Artificial Sequence
  chemically synthesized
accaaaacttgtgcatgactat

SEQ ID NO: 1150376 - DNA, 22 bp, Artificial Sequence
  chemically synthesized
tactgtctcctcatagtcatgc

SEQ ID NO: 1150377 - DNA, 22 bp, Artificial Sequence
  chemically synthesized
cagttttactgtctcctcatag

SEQ ID NO: 1150378 - DNA, 22 bp, Artificial Sequence
  chemically synthesized
gtgcatgactatgaggagacag

SEQ ID NO: 1150379 - DNA, 22 bp, Artificial Sequence
  chemically synthesized
actacagttttactgtctcctc

SEQ ID NO: 1150380 - DNA, 22 bp, Artificial Sequence
  chemically synthesized
tgcatgactatgaggagacagt

SEQ ID NO: 1150381 - DNA, 22 bp, Artificial Sequence
  chemically synthesized
gactacagttttactgtctcct

SEQ ID NO: 1150382 - DNA, 22 bp, Artificial Sequence
  chemically synthesized
tgactacagttttactgtctcc

SEQ ID NO: 1150383 - DNA, 22 bp, Artificial Sequence
  chemically synthesized
ttgactacagttttactgtctc

SEQ ID NO: 1150384 - DNA, 22 bp, Artificial Sequence
  chemically synthesized
cacttttgactacagttttact

SEQ ID NO: 1150385 - DNA, 22 bp, Artificial Sequence
  chemically synthesized
tgaggagacagtaaaactgtag

SEQ ID NO: 1150386 - DNA, 22 bp, Artificial Sequence
  chemically synthesized
agatgctacacttttgactaca

SEQ ID NO: 1150387 - DNA, 22 bp, Artificial Sequence
  chemically synthesized
cagatgctacacttttgactac

SEQ ID NO: 1150388 - DNA, 22 bp, Artificial Sequence
  chemically synthesized
atttcagatgctacacttttga

SEQ ID NO: 1150389 - DNA, 22 bp, Artificial Sequence
  chemically synthesized
tagtcaaaagtgtagcatctga

SEQ ID NO: 1150390 - DNA, 22 bp, Artificial Sequence
  chemically synthesized
cacatagaaaatctgatttcag

SEQ ID NO: 1150391 - DNA, 22 bp, Artificial Sequence
  chemically synthesized
caggaattacacatagaaaatc

SEQ ID NO: 1150392 - DNA, 22 bp, Artificial Sequence
  chemically synthesized
ccaggaattacacatagaaaat

SEQ ID NO: 1150393 - DNA, 22 bp, Artificial Sequence
  chemically synthesized
aaatcagattttctatgtgtaa

SEQ ID NO: 1150394 - DNA, 22 bp, Artificial Sequence
  chemically synthesized
atgcttccaggaattacacata

SEQ ID NO: 1150395 - DNA, 22 bp, Artificial Sequence
  chemically synthesized
ttgatgcttccaggaattacac

SEQ ID NO: 1150396 - DNA, 22 bp, Artificial Sequence
  chemically synthesized
gttattgatgcttccaggaatt

SEQ ID NO: 1150397 - DNA, 22 bp, Artificial Sequence
  chemically synthesized
tctatgtgtaattcctggaagc

SEQ ID NO: 1150398 - DNA, 22 bp, Artificial Sequence
  chemically synthesized
ctatgtgtaattcctggaagca

SEQ ID NO: 1150399 - DNA, 22 bp, Artificial Sequence
  chemically synthesized
tatgtgtaattcctggaagcat

SEQ ID NO: 1150400 - DNA, 22 bp, Artificial Sequence
  chemically synthesized
tgtgtaattcctggaagcatca

SEQ ID NO: 1150401 - DNA, 22 bp, Artificial Sequence
  chemically synthesized
aaagtcacgtgattggttattg

SEQ ID NO: 1150402 - DNA, 22 bp, Artificial Sequence
  chemically synthesized
ctggaagcatcaataaccaatc

SEQ ID NO: 1150403 - DNA, 22 bp, Artificial Sequence
  chemically synthesized
tcaaagtcacgtgattggttat

SEQ ID NO: 1150404 - DNA, 22 bp, Artificial Sequence
  chemically synthesized
ctcaaagtcacgtgattggtta

SEQ ID NO: 1150405 - DNA, 22 bp, Artificial Sequence
  chemically synthesized
tctcaaagtcacgtgattggtt

SEQ ID NO: 1150406 - DNA, 22 bp, Artificial Sequence
  chemically synthesized
gaagcatcaataaccaatcacg

SEQ ID NO: 1150407 - DNA, 22 bp, Artificial Sequence
  chemically synthesized
atgactttctcaaagtcacgtg

SEQ ID NO: 1150408 - DNA, 22 bp, Artificial Sequence
  chemically synthesized
gtgtggttgatgactttctcaa

SEQ ID NO: 1150409 - DNA, 22 bp, Artificial Sequence
  chemically synthesized
ggtgtggttgatgactttctca

SEQ ID NO: 1150410 - DNA, 22 bp, Artificial Sequence
  chemically synthesized
aggcttggtgtggttgatgact

SEQ ID NO: 1150411 - DNA, 22 bp, Artificial Sequence
  chemically synthesized
tgagaaagtcatcaaccacacc

SEQ ID NO: 1150412 - DNA, 22 bp, Artificial Sequence
  chemically synthesized
gagaaagtcatcaaccacacca

SEQ ID NO: 1150413 - DNA, 22 bp, Artificial Sequence
  chemically synthesized
agaaagtcatcaaccacaccaa

SEQ ID NO: 1150414 - DNA, 22 bp, Artificial Sequence
  chemically synthesized
ggaagctgaggcttggtgtggt

SEQ ID NO: 1150415 - DNA, 22 bp, Artificial Sequence
  chemically synthesized
caaattaggaagctgaggcttg

SEQ ID NO: 1150416 - DNA, 22 bp, Artificial Sequence
  chemically synthesized
acaaattaggaagctgaggctt

SEQ ID NO: 1150417 - DNA, 22 bp, Artificial Sequence
  chemically synthesized
tacaaattaggaagctgaggct

SEQ ID NO: 1150418 - DNA, 22 bp, Artificial Sequence
  chemically synthesized
gttttacaaattaggaagctga

SEQ ID NO: 1150419 - DNA, 22 bp, Artificial Sequence
  chemically synthesized
agttttacaaattaggaagctg

SEQ ID NO: 1150420 - DNA, 22 bp, Artificial Sequence
  chemically synthesized
tcttagttttacaaattaggaa

SEQ ID NO: 1150421 - DNA, 22 bp, Artificial Sequence
  chemically synthesized
ttatcttagttttacaaattag

SEQ ID NO: 1150422 - DNA, 22 bp, Artificial Sequence
  chemically synthesized
attatcttagttttacaaatta

SEQ ID NO: 1150423 - DNA, 22 bp, Artificial Sequence
  chemically synthesized
tattatcttagttttacaaatt

SEQ ID NO: 1150424 - DNA, 22 bp, Artificial Sequence
  chemically synthesized
agcttcctaatttgtaaaacta

SEQ ID NO: 1150425 - DNA, 22 bp, Artificial Sequence
  chemically synthesized
cctaatttgtaaaactaagata

SEQ ID NO: 1150426 - DNA, 22 bp, Artificial Sequence
  chemically synthesized
ctaatttgtaaaactaagataa

SEQ ID NO: 1150427 - DNA, 22 bp, Artificial Sequence
  chemically synthesized
atttgtaaaactaagataataa

SEQ ID NO: 1150428 - DNA, 22 bp, Artificial Sequence
  chemically synthesized
gtaaaactaagataataaaact

SEQ ID NO: 1150429 - DNA, 22 bp, Artificial Sequence
  chemically synthesized
taaaactaagataataaaactg

SEQ ID NO: 1150430 - DNA, 22 bp, Artificial Sequence
  chemically synthesized
accacataaagaaataggcagt

SEQ ID NO: 1150431 - DNA, 22 bp, Artificial Sequence
  chemically synthesized
aaccacataaagaaataggcag

SEQ ID NO: 1150432 - DNA, 22 bp, Artificial Sequence
  chemically synthesized
agataataaaactgcctatttc

SEQ ID NO: 1150433 - DNA, 22 bp, Artificial Sequence
  chemically synthesized
ttaaccacataaagaaataggc

SEQ ID NO: 1150434 - DNA, 22 bp, Artificial Sequence
  chemically synthesized
cttaaccacataaagaaatagg

SEQ ID NO: 1150435 - DNA, 22 bp, Artificial Sequence
  chemically synthesized
aatcttcttaaccacataaaga

SEQ ID NO: 1150436 - DNA, 22 bp, Artificial Sequence
  chemically synthesized
ttcaatcttcttaaccacataa

SEQ ID NO: 1150437 - DNA, 22 bp, Artificial Sequence
  chemically synthesized
attcaatcttcttaaccacata

SEQ ID NO: 1150438 - DNA, 22 bp, Artificial Sequence
  chemically synthesized
cctatttctttatgtggttaag

SEQ ID NO: 1150439 - DNA, 22 bp, Artificial Sequence
  chemically synthesized
ccttattcaatcttcttaacca

SEQ ID NO: 1150440 - DNA, 22 bp, Artificial Sequence
  chemically synthesized
accttattcaatcttcttaacc

SEQ ID NO: 1150441 - DNA, 22 bp, Artificial Sequence
  chemically synthesized
tttctttatgtggttaagaaga

SEQ ID NO: 1150442 - DNA, 22 bp, Artificial Sequence
  chemically synthesized
taccttattcaatcttcttaac

SEQ ID NO: 1150443 - DNA, 22 bp, Artificial Sequence
  chemically synthesized
ctttatgtggttaagaagattg

SEQ ID NO: 1150444 - DNA, 22 bp, Artificial Sequence
  chemically synthesized
tttatgtggttaagaagattga

SEQ ID NO: 1150445 - DNA, 22 bp, Artificial Sequence
  chemically synthesized
tatgtggttaagaagattgaat

SEQ ID NO: 1150446 - DNA, 22 bp, Artificial Sequence
  chemically synthesized
atgtggttaagaagattgaata

SEQ ID NO: 1150447 - DNA, 22 bp, Artificial Sequence
  chemically synthesized
tgtggttaagaagattgaataa

SEQ ID NO: 1150448 - DNA, 22 bp, Artificial Sequence
  chemically synthesized
agaagattgaataaggtaaaac

SEQ ID NO: 1150449 - DNA, 22 bp, Artificial Sequence
  chemically synthesized
caggcaaaatgcaaaacagttt

SEQ ID NO: 1150450 - DNA, 22 bp, Artificial Sequence
  chemically synthesized
ccaggcaaaatgcaaaacagtt

SEQ ID NO: 1150451 - DNA, 22 bp, Artificial Sequence
  chemically synthesized
tccaggcaaaatgcaaaacagt

SEQ ID NO: 1150452 - DNA, 22 bp, Artificial Sequence
  chemically synthesized
aataaggtaaaactgttttgca

SEQ ID NO: 1150453 - DNA, 22 bp, Artificial Sequence
  chemically synthesized
ttttccaggcaaaatgcaaaac

SEQ ID NO: 1150454 - DNA, 22 bp, Artificial Sequence
  chemically synthesized
tattgttttccaggcaaaatgc

SEQ ID NO: 1150455 - DNA, 22 bp, Artificial Sequence
  chemically synthesized
atattgttttccaggcaaaatg

SEQ ID NO: 1150456 - DNA, 22 bp, Artificial Sequence
  chemically synthesized
gaatttatattgttttccaggc

SEQ ID NO: 1150457 - DNA, 22 bp, Artificial Sequence
  chemically synthesized
ttttgcattttgcctggaaaac

SEQ ID NO: 1150458 - DNA, 22 bp, Artificial Sequence
  chemically synthesized
ggaatttatattgttttccagg

SEQ ID NO: 1150459 - DNA, 22 bp, Artificial Sequence
  chemically synthesized
tggaatttatattgttttccag

SEQ ID NO: 1150460 - DNA, 22 bp, Artificial Sequence
  chemically synthesized
ttggaatttatattgttttcca

SEQ ID NO: 1150461 - DNA, 22 bp, Artificial Sequence
  chemically synthesized
tgcattttgcctggaaaacaat

SEQ ID NO: 1150462 - DNA, 22 bp, Artificial Sequence
  chemically synthesized
gcattttgcctggaaaacaata

SEQ ID NO: 1150463 - DNA, 22 bp, Artificial Sequence
  chemically synthesized
cattttgcctggaaaacaatat

SEQ ID NO: 1150464 - DNA, 22 bp, Artificial Sequence
  chemically synthesized
atatttttggaatttatattgt

SEQ ID NO: 1150465 - DNA, 22 bp, Artificial Sequence
  chemically synthesized
tgcctggaaaacaatataaatt

SEQ ID NO: 1150466 - DNA, 22 bp, Artificial Sequence
  chemically synthesized
gcctggaaaacaatataaattc

SEQ ID NO: 1150467 - DNA, 22 bp, Artificial Sequence
  chemically synthesized
cctggaaaacaatataaattcc

SEQ ID NO: 1150468 - DNA, 22 bp, Artificial Sequence
  chemically synthesized
gatgctaatatttttggaattt

SEQ ID NO: 1150469 - DNA, 22 bp, Artificial Sequence
  chemically synthesized
gaaaacaatataaattccaaaa

SEQ ID NO: 1150470 - DNA, 22 bp, Artificial Sequence
  chemically synthesized
attagatgctaatatttttgga

SEQ ID NO: 1150471 - DNA, 22 bp, Artificial Sequence
  chemically synthesized
aactaattagatgctaatattt

SEQ ID NO: 1150472 - DNA, 22 bp, Artificial Sequence
  chemically synthesized
caactaattagatgctaatatt

SEQ ID NO: 1150473 - DNA, 22 bp, Artificial Sequence
  chemically synthesized
tcaactaattagatgctaatat

SEQ ID NO: 1150474 - DNA, 22 bp, Artificial Sequence
  chemically synthesized
tttcaactaattagatgctaat

SEQ ID NO: 1150475 - DNA, 22 bp, Artificial Sequence
  chemically synthesized
caaaaatattagcatctaatta

SEQ ID NO: 1150476 - DNA, 22 bp, Artificial Sequence
  chemically synthesized
aatatgaattctttcaactaat

SEQ ID NO: 1150477 - DNA, 22 bp, Artificial Sequence
  chemically synthesized
gcatctaattagttgaaagaat

SEQ ID NO: 1150478 - DNA, 22 bp, Artificial Sequence
  chemically synthesized
attagttgaaagaattcatatt

SEQ ID NO: 1150479 - DNA, 22 bp, Artificial Sequence
  chemically synthesized
atataaatatggctaaatatga

SEQ ID NO: 1150480 - DNA, 22 bp, Artificial Sequence
  chemically synthesized
gttgaaagaattcatatttagc

SEQ ID NO: 1150481 - DNA, 22 bp, Artificial Sequence
  chemically synthesized
gatataaatatggctaaatatg

SEQ ID NO: 1150482 - DNA, 22 bp, Artificial Sequence
  chemically synthesized
tgatataaatatggctaaatat

SEQ ID NO: 1150483 - DNA, 22 bp, Artificial Sequence
  chemically synthesized
aaagaattcatatttagccata

SEQ ID NO: 1150484 - DNA, 22 bp, Artificial Sequence
  chemically synthesized
aaaactttgatataaatatggc

SEQ ID NO: 1150485 - DNA, 22 bp, Artificial Sequence
  chemically synthesized
caaaactttgatataaatatgg

SEQ ID NO: 1150486 - DNA, 22 bp, Artificial Sequence
  chemically synthesized
atatttagccatatttatatca

SEQ ID NO: 1150487 - DNA, 22 bp, Artificial Sequence
  chemically synthesized
gtttcaaaactttgatataaat

SEQ ID NO: 1150488 - DNA, 22 bp, Artificial Sequence
  chemically synthesized
agtttcaaaactttgatataaa

SEQ ID NO: 1150489 - DNA, 22 bp, Artificial Sequence
  chemically synthesized
agccatatttatatcaaagttt

SEQ ID NO: 1150490 - DNA, 22 bp, Artificial Sequence
  chemically synthesized
gccatatttatatcaaagtttt

SEQ ID NO: 1150491 - DNA, 22 bp, Artificial Sequence
  chemically synthesized
cagtttagtttcaaaactttga

SEQ ID NO: 1150492 - DNA, 22 bp, Artificial Sequence
  chemically synthesized
ggtcattgcagtttagtttcaa

SEQ ID NO: 1150493 - DNA, 22 bp, Artificial Sequence
  chemically synthesized
atatcaaagttttgaaactaaa

SEQ ID NO: 1150494 - DNA, 22 bp, Artificial Sequence
  chemically synthesized
tatcaaagttttgaaactaaac

SEQ ID NO: 1150495 - DNA, 22 bp, Artificial Sequence
  chemically synthesized
ggttaggtcattgcagtttagt

SEQ ID NO: 1150496 - DNA, 22 bp, Artificial Sequence
  chemically synthesized
gtattaggttaggtcattgcag

SEQ ID NO: 1150497 - DNA, 22 bp, Artificial Sequence
  chemically synthesized
tgaaactaaactgcaatgacct

SEQ ID NO: 1150498 - DNA, 22 bp, Artificial Sequence
  chemically synthesized
gaaactaaactgcaatgaccta

SEQ ID NO: 1150499 - DNA, 22 bp, Artificial Sequence
  chemically synthesized
aaactaaactgcaatgacctaa

SEQ ID NO: 1150500 - DNA, 22 bp, Artificial Sequence
  chemically synthesized
aactgcaatgacctaacctaat

SEQ ID NO: 1150501 - DNA, 22 bp, Artificial Sequence
  chemically synthesized
caatgacctaacctaatactaa

SEQ ID NO: 1150502 - DNA, 22 bp, Artificial Sequence
  chemically synthesized
gatgagggtaaaatagattagt

SEQ ID NO: 1150503 - DNA, 22 bp, Artificial Sequence
  chemically synthesized
acctaatactaatctattttac

SEQ ID NO: 1150504 - DNA, 22 bp, Artificial Sequence
  chemically synthesized
atactaatctattttaccctca

SEQ ID NO: 1150505 - DNA, 22 bp, Artificial Sequence
  chemically synthesized
atctattttaccctcatctaat

SEQ ID NO: 1150506 - DNA, 22 bp, Artificial Sequence
  chemically synthesized
ttttaccctcatctaatacatt

SEQ ID NO: 1150507 - DNA, 22 bp, Artificial Sequence
  chemically synthesized
taccctcatctaatacattctg

SEQ ID NO: 1150508 - DNA, 22 bp, Artificial Sequence
  chemically synthesized
accctcatctaatacattctga

SEQ ID NO: 1150509 - DNA, 22 bp, Artificial Sequence
  chemically synthesized
ccctcatctaatacattctgac

SEQ ID NO: 1150510 - DNA, 22 bp, Artificial Sequence
  chemically synthesized
gaaaggatgatagtcagaatgt

SEQ ID NO: 1150511 - DNA, 22 bp, Artificial Sequence
  chemically synthesized
ttagaaaggatgatagtcagaa

SEQ ID NO: 1150512 - DNA, 22 bp, Artificial Sequence
  chemically synthesized
atctaatacattctgactatca

SEQ ID NO: 1150513 - DNA, 22 bp, Artificial Sequence
  chemically synthesized
atacattctgactatcatcctt

SEQ ID NO: 1150514 - DNA, 22 bp, Artificial Sequence
  chemically synthesized
tgatgtctattagaaaggatga

SEQ ID NO: 1150515 - DNA, 22 bp, Artificial Sequence
  chemically synthesized
atgatgtctattagaaaggatg

SEQ ID NO: 1150516 - DNA, 22 bp, Artificial Sequence
  chemically synthesized
tgactatcatcctttctaatag

SEQ ID NO: 1150517 - DNA, 22 bp, Artificial Sequence
  chemically synthesized
cacttatgatgtctattagaaa

SEQ ID NO: 1150518 - DNA, 22 bp, Artificial Sequence
  chemically synthesized
actatcatcctttctaatagac

SEQ ID NO: 1150519 - DNA, 22 bp, Artificial Sequence
  chemically synthesized
ctgcacttatgatgtctattag

SEQ ID NO: 1150520 - DNA, 22 bp, Artificial Sequence
  chemically synthesized
cctgcacttatgatgtctatta

SEQ ID NO: 1150521 - DNA, 22 bp, Artificial Sequence
  chemically synthesized
tcatcctttctaatagacatca

SEQ ID NO: 1150522 - DNA, 22 bp, Artificial Sequence
  chemically synthesized
ttcctgcacttatgatgtctat

SEQ ID NO: 1150523 - DNA, 22 bp, Artificial Sequence
  chemically synthesized
tcttcctgcacttatgatgtct

SEQ ID NO: 1150524 - DNA, 22 bp, Artificial Sequence
  chemically synthesized
tctaatagacatcataagtgca

SEQ ID NO: 1150525 - DNA, 22 bp, Artificial Sequence
  chemically synthesized
ctaatagacatcataagtgcag

SEQ ID NO: 1150526 - DNA, 22 bp, Artificial Sequence
  chemically synthesized
taatagacatcataagtgcagg

SEQ ID NO: 1150527 - DNA, 22 bp, Artificial Sequence
  chemically synthesized
atagacatcataagtgcaggaa

SEQ ID NO: 1150528 - DNA, 22 bp, Artificial Sequence
  chemically synthesized
aaaaatcacattctcttcctgc

SEQ ID NO: 1150529 - DNA, 22 bp, Artificial Sequence
  chemically synthesized
caaaaatcacattctcttcctg

SEQ ID NO: 1150530 - DNA, 22 bp, Artificial Sequence
  chemically synthesized
tcaaaaatcacattctcttcct

SEQ ID NO: 1150531 - DNA, 22 bp, Artificial Sequence
  chemically synthesized
ttcaaaaatcacattctcttcc

SEQ ID NO: 1150532 - DNA, 22 bp, Artificial Sequence
  chemically synthesized
atgacttttcaaaaatcacatt

SEQ ID NO: 1150533 - DNA, 22 bp, Artificial Sequence
  chemically synthesized
catgacttttcaaaaatcacat

SEQ ID NO: 1150534 - DNA, 22 bp, Artificial Sequence
  chemically synthesized
tcatgacttttcaaaaatcaca

SEQ ID NO: 1150535 - DNA, 22 bp, Artificial Sequence
  chemically synthesized
ttttcatgacttttcaaaaatc

SEQ ID NO: 1150536 - DNA, 22 bp, Artificial Sequence
  chemically synthesized
gttttcatgacttttcaaaaat

SEQ ID NO: 1150537 - DNA, 22 bp, Artificial Sequence
  chemically synthesized
acttgttttcatgacttttcaa

SEQ ID NO: 1150538 - DNA, 22 bp, Artificial Sequence
  chemically synthesized
cacttgttttcatgacttttca

SEQ ID NO: 1150539 - DNA, 22 bp, Artificial Sequence
  chemically synthesized
taacttcacttgttttcatgac

SEQ ID NO: 1150540 - DNA, 22 bp, Artificial Sequence
  chemically synthesized
ctgtaacttcacttgttttcat

SEQ ID NO: 1150541 - DNA, 22 bp, Artificial Sequence
  chemically synthesized
gctgtaacttcacttgttttca

SEQ ID NO: 1150542 - DNA, 22 bp, Artificial Sequence
  chemically synthesized
ttgaaaagtcatgaaaacaagt

SEQ ID NO: 1150543 - DNA, 22 bp, Artificial Sequence
  chemically synthesized
tgctgtaacttcacttgttttc

SEQ ID NO: 1150544 - DNA, 22 bp, Artificial Sequence
  chemically synthesized
tgaaaagtcatgaaaacaagtg

SEQ ID NO: 1150545 - DNA, 22 bp, Artificial Sequence
  chemically synthesized
gaaaagtcatgaaaacaagtga

SEQ ID NO: 1150546 - DNA, 22 bp, Artificial Sequence
  chemically synthesized
aaaagtcatgaaaacaagtgaa

SEQ ID NO: 1150547 - DNA, 22 bp, Artificial Sequence
  chemically synthesized
aaactttgctgtaacttcactt

SEQ ID NO: 1150548 - DNA, 22 bp, Artificial Sequence
  chemically synthesized
aaaactttgctgtaacttcact

SEQ ID NO: 1150549 - DNA, 22 bp, Artificial Sequence
  chemically synthesized
cagaccttaaaactttgctgta

SEQ ID NO: 1150550 - DNA, 22 bp, Artificial Sequence
  chemically synthesized
tccagaccttaaaactttgctg

SEQ ID NO: 1150551 - DNA, 22 bp, Artificial Sequence
  chemically synthesized
ctccagaccttaaaactttgct

SEQ ID NO: 1150552 - DNA, 22 bp, Artificial Sequence
  chemically synthesized
tatatttctccagaccttaaaa

SEQ ID NO: 1150553 - DNA, 22 bp, Artificial Sequence
  chemically synthesized
ctgtatatttctccagacctta

SEQ ID NO: 1150554 - DNA, 22 bp, Artificial Sequence
  chemically synthesized
cagcaaagttttaaggtctgga

SEQ ID NO: 1150555 - DNA, 22 bp, Artificial Sequence
  chemically synthesized
actgtatatttctccagacctt

SEQ ID NO: 1150556 - DNA, 22 bp, Artificial Sequence
  chemically synthesized
acacttactgtatatttctcca

SEQ ID NO: 1150557 - DNA, 22 bp, Artificial Sequence
  chemically synthesized
aacacttactgtatatttctcc

SEQ ID NO: 1150558 - DNA, 22 bp, Artificial Sequence
  chemically synthesized
taaggtctggagaaatatacag

SEQ ID NO: 1150559 - DNA, 22 bp, Artificial Sequence
  chemically synthesized
aaggtctggagaaatatacagt

SEQ ID NO: 1150560 - DNA, 22 bp, Artificial Sequence
  chemically synthesized
aggtctggagaaatatacagta

SEQ ID NO: 1150561 - DNA, 22 bp, Artificial Sequence
  chemically synthesized
aggatttaacacttactgtata

SEQ ID NO: 1150562 - DNA, 22 bp, Artificial Sequence
  chemically synthesized
aaggatttaacacttactgtat

SEQ ID NO: 1150563 - DNA, 22 bp, Artificial Sequence
  chemically synthesized
tttaaggatttaacacttactg

SEQ ID NO: 1150564 - DNA, 22 bp, Artificial Sequence
  chemically synthesized
gagaaatatacagtaagtgtta

SEQ ID NO: 1150565 - DNA, 22 bp, Artificial Sequence
  chemically synthesized
aggtattatttaaggatttaac

SEQ ID NO: 1150566 - DNA, 22 bp, Artificial Sequence
  chemically synthesized
gaagttcaggtattatttaagg

SEQ ID NO: 1150567 - DNA, 22 bp, Artificial Sequence
  chemically synthesized
aatccttaaataatacctgaac

SEQ ID NO: 1150568 - DNA, 22 bp, Artificial Sequence
  chemically synthesized
aaataatacctgaacttccaat

SEQ ID NO: 1150569 - DNA, 22 bp, Artificial Sequence
  chemically synthesized
aataatacctgaacttccaatt

SEQ ID NO: 1150570 - DNA, 22 bp, Artificial Sequence
  chemically synthesized
atgtagtgtaaataaattggaa

SEQ ID NO: 1150571 - DNA, 22 bp, Artificial Sequence
  chemically synthesized
ttaatgtagtgtaaataaattg

SEQ ID NO: 1150572 - DNA, 22 bp, Artificial Sequence
  chemically synthesized
attaatgtagtgtaaataaatt

SEQ ID NO: 1150573 - DNA, 22 bp, Artificial Sequence
  chemically synthesized
tattaatgtagtgtaaataaat

SEQ ID NO: 1150574 - DNA, 22 bp, Artificial Sequence
  chemically synthesized
ttattaatgtagtgtaaataaa

SEQ ID NO: 1150575 - DNA, 22 bp, Artificial Sequence
  chemically synthesized
aacttccaatttatttacacta

SEQ ID NO: 1150576 - DNA, 22 bp, Artificial Sequence
  chemically synthesized
cttttattaatgtagtgtaaat

SEQ ID NO: 1150577 - DNA, 22 bp, Artificial Sequence
  chemically synthesized
ccaatttatttacactacatta

SEQ ID NO: 1150578 - DNA, 22 bp, Artificial Sequence
  chemically synthesized
caatttatttacactacattaa

SEQ ID NO: 1150579 - DNA, 22 bp, Artificial Sequence
  chemically synthesized
aacctacttttattaatgtagt

SEQ ID NO: 1150580 - DNA, 22 bp, Artificial Sequence
  chemically synthesized
gaacctacttttattaatgtag

SEQ ID NO: 1150581 - DNA, 22 bp, Artificial Sequence
  chemically synthesized
atttacactacattaataaaag

SEQ ID NO: 1150582 - DNA, 22 bp, Artificial Sequence
  chemically synthesized
tttacactacattaataaaagt

SEQ ID NO: 1150583 - DNA, 22 bp, Artificial Sequence
  chemically synthesized
acactacattaataaaagtagg

SEQ ID NO: 1150584 - DNA, 22 bp, Artificial Sequence
  chemically synthesized
cactacattaataaaagtaggt

SEQ ID NO: 1150585 - DNA, 22 bp, Artificial Sequence
  chemically synthesized
cattaataaaagtaggttcaaa

SEQ ID NO: 1150586 - DNA, 22 bp, Artificial Sequence
  chemically synthesized
ataaaagtaggttcaaactacc

SEQ ID NO: 1150587 - DNA, 22 bp, Artificial Sequence
  chemically synthesized
tgataaccatcagatgaggtag

SEQ ID NO: 1150588 - DNA, 22 bp, Artificial Sequence
  chemically synthesized
tgtgataaccatcagatgaggt

SEQ ID NO: 1150589 - DNA, 22 bp, Artificial Sequence
  chemically synthesized
ctgtgataaccatcagatgagg

SEQ ID NO: 1150590 - DNA, 22 bp, Artificial Sequence
  chemically synthesized
tctgtgataaccatcagatgag

SEQ ID NO: 1150591 - DNA, 22 bp, Artificial Sequence
  chemically synthesized
ttctgtgataaccatcagatga

SEQ ID NO: 1150592 - DNA, 22 bp, Artificial Sequence
  chemically synthesized
aaactacctcatctgatggtta

SEQ ID NO: 1150593 - DNA, 22 bp, Artificial Sequence
  chemically synthesized
cctcatctgatggttatcacag

SEQ ID NO: 1150594 - DNA, 22 bp, Artificial Sequence
  chemically synthesized
cccatgcaaatttttctgtgat

SEQ ID NO: 1150595 - DNA, 22 bp, Artificial Sequence
  chemically synthesized
atctgatggttatcacagaaaa

SEQ ID NO: 1150596 - DNA, 22 bp, Artificial Sequence
  chemically synthesized
atggttatcacagaaaaatttg

SEQ ID NO: 1150597 - DNA, 22 bp, Artificial Sequence
  chemically synthesized
tcacagaaaaatttgcatgggc

SEQ ID NO: 1150598 - DNA, 22 bp, Artificial Sequence
  chemically synthesized
catgacatatgtctgcccatgc

SEQ ID NO: 1150599 - DNA, 22 bp, Artificial Sequence
  chemically synthesized
actccatgacatatgtctgccc

SEQ ID NO: 1150600 - DNA, 22 bp, Artificial Sequence
  chemically synthesized
tcctcactccatgacatatgtc

SEQ ID NO: 1150601 - DNA, 22 bp, Artificial Sequence
  chemically synthesized
gcatgggcagacatatgtcatg

SEQ ID NO: 1150602 - DNA, 22 bp, Artificial Sequence
  chemically synthesized
catgggcagacatatgtcatgg

SEQ ID NO: 1150603 - DNA, 22 bp, Artificial Sequence
  chemically synthesized
gggactgtcctcactccatgac

SEQ ID NO: 1150604 - DNA, 22 bp, Artificial Sequence
  chemically synthesized
gtgattagggactgtcctcact

SEQ ID NO: 1150605 - DNA, 22 bp, Artificial Sequence
  chemically synthesized
cgtgattagggactgtcctcac

SEQ ID NO: 1150606 - DNA, 22 bp, Artificial Sequence
  chemically synthesized
ccatttcgtgattagggactgt

SEQ ID NO: 1150607 - DNA, 22 bp, Artificial Sequence
  chemically synthesized
agggctaccatttcgtgattag

SEQ ID NO: 1150608 - DNA, 22 bp, Artificial Sequence
  chemically synthesized
atcacgaaatggtagccctcaa

SEQ ID NO: 1150609 - DNA, 22 bp, Artificial Sequence
  chemically synthesized
tagaaagagtaggaaaggcaag

SEQ ID NO: 1150610 - DNA, 22 bp, Artificial Sequence
  chemically synthesized
aattctcttgcctttcctactc

SEQ ID NO: 1150611 - DNA, 22 bp, Artificial Sequence
  chemically synthesized
tcttgcctttcctactctttct

SEQ ID NO: 1150612 - DNA, 22 bp, Artificial Sequence
  chemically synthesized
ttgcctttcctactctttctac

SEQ ID NO: 1150613 - DNA, 22 bp, Artificial Sequence
  chemically synthesized
gcctttcctactctttctacaa

SEQ ID NO: 1150614 - DNA, 22 bp, Artificial Sequence
  chemically synthesized
cctttcctactctttctacaat

SEQ ID NO: 1150615 - DNA, 22 bp, Artificial Sequence
  chemically synthesized
tcctactctttctacaatccat

SEQ ID NO: 1150616 - DNA, 22 bp, Artificial Sequence
  chemically synthesized
cctactctttctacaatccatg

SEQ ID NO: 1150617 - DNA, 22 bp, Artificial Sequence
  chemically synthesized
ctactctttctacaatccatgc

SEQ ID NO: 1150618 - DNA, 22 bp, Artificial Sequence
  chemically synthesized
ctctttctacaatccatgcatg

SEQ ID NO: 1150619 - DNA, 22 bp, Artificial Sequence
  chemically synthesized
tttctacaatccatgcatgcac

SEQ ID NO: 1150620 - DNA, 22 bp, Artificial Sequence
  chemically synthesized
tctacaatccatgcatgcaccc

SEQ ID NO: 1150621 - DNA, 22 bp, Artificial Sequence
  chemically synthesized
ctacaatccatgcatgcaccca

SEQ ID NO: 1150622 - DNA, 22 bp, Artificial Sequence
  chemically synthesized
tacaatccatgcatgcacccac

SEQ ID NO: 1150623 - DNA, 22 bp, Artificial Sequence
  chemically synthesized
caatccatgcatgcacccaccc

SEQ ID NO: 1150624 - DNA, 22 bp, Artificial Sequence
  chemically synthesized
tatgcagaatgtatgggtgggt

SEQ ID NO: 1150625 - DNA, 22 bp, Artificial Sequence
  chemically synthesized
taactatatgcagaatgtatgg

SEQ ID NO: 1150626 - DNA, 22 bp, Artificial Sequence
  chemically synthesized
tgtaactatatgcagaatgtat

SEQ ID NO: 1150627 - DNA, 22 bp, Artificial Sequence
  chemically synthesized
attctgtaactatatgcagaat

SEQ ID NO: 1150628 - DNA, 22 bp, Artificial Sequence
  chemically synthesized
aattctgtaactatatgcagaa

SEQ ID NO: 1150629 - DNA, 22 bp, Artificial Sequence
  chemically synthesized
taattctgtaactatatgcaga

SEQ ID NO: 1150630 - DNA, 22 bp, Artificial Sequence
  chemically synthesized
attttaattctgtaactatatg

SEQ ID NO: 1150631 - DNA, 22 bp, Artificial Sequence
  chemically synthesized
atctgattttaattctgtaact

SEQ ID NO: 1150632 - DNA, 22 bp, Artificial Sequence
  chemically synthesized
aatctgattttaattctgtaac

SEQ ID NO: 1150633 - DNA, 22 bp, Artificial Sequence
  chemically synthesized
taatctgattttaattctgtaa

SEQ ID NO: 1150634 - DNA, 22 bp, Artificial Sequence
  chemically synthesized
ttaatctgattttaattctgta

SEQ ID NO: 1150635 - DNA, 22 bp, Artificial Sequence
  chemically synthesized
tgcatatagttacagaattaaa

SEQ ID NO: 1150636 - DNA, 22 bp, Artificial Sequence
  chemically synthesized
catatagttacagaattaaaat

SEQ ID NO: 1150637 - DNA, 22 bp, Artificial Sequence
  chemically synthesized
gtttttaatctgattttaattc

SEQ ID NO: 1150638 - DNA, 22 bp, Artificial Sequence
  chemically synthesized
ttggtttttaatctgattttaa

SEQ ID NO: 1150639 - DNA, 22 bp, Artificial Sequence
  chemically synthesized
cagaattaaaatcagattaaaa

SEQ ID NO: 1150640 - DNA, 22 bp, Artificial Sequence
  chemically synthesized
aatgttattggtttttaatctg

SEQ ID NO: 1150641 - DNA, 22 bp, Artificial Sequence
  chemically synthesized
ttcaatgttattggtttttaat

SEQ ID NO: 1150642 - DNA, 22 bp, Artificial Sequence
  chemically synthesized
attcaatgttattggtttttaa

SEQ ID NO: 1150643 - DNA, 22 bp, Artificial Sequence
  chemically synthesized
tttattcaatgttattggtttt

SEQ ID NO: 1150644 - DNA, 22 bp, Artificial Sequence
  chemically synthesized
aaatcagattaaaaaccaataa

SEQ ID NO: 1150645 - DNA, 22 bp, Artificial Sequence
  chemically synthesized
taattatttattcaatgttatt

SEQ ID NO: 1150646 - DNA, 22 bp, Artificial Sequence
  chemically synthesized
ataattatttattcaatgttat

SEQ ID NO: 1150647 - DNA, 22 bp, Artificial Sequence
  chemically synthesized
tataattatttattcaatgtta

SEQ ID NO: 1150648 - DNA, 22 bp, Artificial Sequence
  chemically synthesized
aaaaccaataacattgaataaa

SEQ ID NO: 1150649 - DNA, 22 bp, Artificial Sequence
  chemically synthesized
agtaaaggcattttataattat

SEQ ID NO: 1150650 - DNA, 22 bp, Artificial Sequence
  chemically synthesized
cagtaaaggcattttataatta

SEQ ID NO: 1150651 - DNA, 22 bp, Artificial Sequence
  chemically synthesized
tcagtaaaggcattttataatt

SEQ ID NO: 1150652 - DNA, 22 bp, Artificial Sequence
  chemically synthesized
ttttcagtaaaggcattttata

SEQ ID NO: 1150653 - DNA, 22 bp, Artificial Sequence
  chemically synthesized
aataaataattataaaatgcct

SEQ ID NO: 1150654 - DNA, 22 bp, Artificial Sequence
  chemically synthesized
aataattattttcagtaaaggc

SEQ ID NO: 1150655 - DNA, 22 bp, Artificial Sequence
  chemically synthesized
caataattattttcagtaaagg

SEQ ID NO: 1150656 - DNA, 22 bp, Artificial Sequence
  chemically synthesized
tcaataattattttcagtaaag

SEQ ID NO: 1150657 - DNA, 22 bp, Artificial Sequence
  chemically synthesized
ttcaataattattttcagtaaa

SEQ ID NO: 1150658 - DNA, 22 bp, Artificial Sequence
  chemically synthesized
tttcaataattattttcagtaa

SEQ ID NO: 1150659 - DNA, 22 bp, Artificial Sequence
  chemically synthesized
taaaatgcctttactgaaaata

SEQ ID NO: 1150660 - DNA, 22 bp, Artificial Sequence
  chemically synthesized
tttttcaataattattttcagt

SEQ ID NO: 1150661 - DNA, 22 bp, Artificial Sequence
  chemically synthesized
ctttttcaataattattttcag

SEQ ID NO: 1150662 - DNA, 22 bp, Artificial Sequence
  chemically synthesized
tctttttcaataattattttca

SEQ ID NO: 1150663 - DNA, 22 bp, Artificial Sequence
  chemically synthesized
ttctttttcaataattattttc

SEQ ID NO: 1150664 - DNA, 22 bp, Artificial Sequence
  chemically synthesized
ttttctttttcaataattattt

SEQ ID NO: 1150665 - DNA, 22 bp, Artificial Sequence
  chemically synthesized
cttttctttttcaataattatt

SEQ ID NO: 1150666 - DNA, 22 bp, Artificial Sequence
  chemically synthesized
tactgaaaataattattgaaaa

SEQ ID NO: 1150667 - DNA, 22 bp, Artificial Sequence
  chemically synthesized
actgaaaataattattgaaaaa

SEQ ID NO: 1150668 - DNA, 22 bp, Artificial Sequence
  chemically synthesized
ctgaaaataattattgaaaaag

SEQ ID NO: 1150669 - DNA, 22 bp, Artificial Sequence
  chemically synthesized
aaaataattattgaaaaagaaa

SEQ ID NO: 1150670 - DNA, 22 bp, Artificial Sequence
  chemically synthesized
ccaataatcttcttttcttttt

SEQ ID NO: 1150671 - DNA, 22 bp, Artificial Sequence
  chemically synthesized
tcccaataatcttcttttcttt

SEQ ID NO: 1150672 - DNA, 22 bp, Artificial Sequence
  chemically synthesized
tctcccaataatcttcttttct

SEQ ID NO: 1150673 - DNA, 22 bp, Artificial Sequence
  chemically synthesized
ttgaaaaagaaaagaagattat

SEQ ID NO: 1150674 - DNA, 22 bp, Artificial Sequence
  chemically synthesized
aaaaagaaaagaagattattgg

SEQ ID NO: 1150675 - DNA, 22 bp, Artificial Sequence
  chemically synthesized
caccccaactctctcccaataa

SEQ ID NO: 1150676 - DNA, 22 bp, Artificial Sequence
  chemically synthesized
ccaccccaactctctcccaata

SEQ ID NO: 1150677 - DNA, 22 bp, Artificial Sequence
  chemically synthesized
tccaccccaactctctcccaat

SEQ ID NO: 1150678 - DNA, 22 bp, Artificial Sequence
  chemically synthesized
aaactttccaccccaactctct

SEQ ID NO: 1150679 - DNA, 22 bp, Artificial Sequence
  chemically synthesized
cctgaaactttccaccccaact

SEQ ID NO: 1150680 - DNA, 22 bp, Artificial Sequence
  chemically synthesized
tgcctgaaactttccaccccaa

SEQ ID NO: 1150681 - DNA, 22 bp, Artificial Sequence
  chemically synthesized
ttgggagagagttggggtggaa

SEQ ID NO: 1150682 - DNA, 22 bp, Artificial Sequence
  chemically synthesized
ggagagagttggggtggaaagt

SEQ ID NO: 1150683 - DNA, 22 bp, Artificial Sequence
  chemically synthesized
tgctctgcctgaaactttccac

SEQ ID NO: 1150684 - DNA, 22 bp, Artificial Sequence
  chemically synthesized
tgtgctctgcctgaaactttcc

SEQ ID NO: 1150685 - DNA, 22 bp, Artificial Sequence
  chemically synthesized
ctctgtgctctgcctgaaactt

SEQ ID NO: 1150686 - DNA, 22 bp, Artificial Sequence
  chemically synthesized
cctctgtgctctgcctgaaact

SEQ ID NO: 1150687 - DNA, 22 bp, Artificial Sequence
  chemically synthesized
gggtggaaagtttcaggcagag

SEQ ID NO: 1150688 - DNA, 22 bp, Artificial Sequence
  chemically synthesized
caggcagagcacagaggaaatg

SEQ ID NO: 1150689 - DNA, 22 bp, Artificial Sequence
  chemically synthesized
aggcagagcacagaggaaatgc

SEQ ID NO: 1150690 - DNA, 22 bp, Artificial Sequence
  chemically synthesized
gcagcacaatgcatagcatttc

SEQ ID NO: 1150691 - DNA, 22 bp, Artificial Sequence
  chemically synthesized
ttagcagcacaatgcatagcat

SEQ ID NO: 1150692 - DNA, 22 bp, Artificial Sequence
  chemically synthesized
tgttagcagcacaatgcatagc

SEQ ID NO: 1150693 - DNA, 22 bp, Artificial Sequence
  chemically synthesized
tattctgttagcagcacaatgc

SEQ ID NO: 1150694 - DNA, 22 bp, Artificial Sequence
  chemically synthesized
acaactatattctgttagcagc

SEQ ID NO: 1150695 - DNA, 22 bp, Artificial Sequence
  chemically synthesized
cacaactatattctgttagcag

SEQ ID NO: 1150696 - DNA, 22 bp, Artificial Sequence
  chemically synthesized
tgcattgtgctgctaacagaat

SEQ ID NO: 1150697 - DNA, 22 bp, Artificial Sequence
  chemically synthesized
aatttcacaactatattctgtt

SEQ ID NO: 1150698 - DNA, 22 bp, Artificial Sequence
  chemically synthesized
tgctgctaacagaatatagttg

SEQ ID NO: 1150699 - DNA, 22 bp, Artificial Sequence
  chemically synthesized
gaactgaatttcacaactatat

SEQ ID NO: 1150700 - DNA, 22 bp, Artificial Sequence
  chemically synthesized
ctaacagaatatagttgtgaaa

SEQ ID NO: 1150701 - DNA, 22 bp, Artificial Sequence
  chemically synthesized
acagaatatagttgtgaaattc

SEQ ID NO: 1150702 - DNA, 22 bp, Artificial Sequence
  chemically synthesized
agcaggaggataatcattggaa

SEQ ID NO: 1150703 - DNA, 22 bp, Artificial Sequence
  chemically synthesized
tgaaattcagttccaatgatta

SEQ ID NO: 1150704 - DNA, 22 bp, Artificial Sequence
  chemically synthesized
agttccaatgattatcctcctg

SEQ ID NO: 1150705 - DNA, 22 bp, Artificial Sequence
  chemically synthesized
caatgattatcctcctgctcag

SEQ ID NO: 1150706 - DNA, 22 bp, Artificial Sequence
  chemically synthesized
tcctcctgctcagacggtattg

SEQ ID NO: 1150707 - DNA, 22 bp, Artificial Sequence
  chemically synthesized
tgataagaatggcaataccgtc

SEQ ID NO: 1150708 - DNA, 22 bp, Artificial Sequence
  chemically synthesized
atgataagaatggcaataccgt

SEQ ID NO: 1150709 - DNA, 22 bp, Artificial Sequence
  chemically synthesized
ctgctcagacggtattgccatt

SEQ ID NO: 1150710 - DNA, 22 bp, Artificial Sequence
  chemically synthesized
ctcagacggtattgccattctt

SEQ ID NO: 1150711 - DNA, 22 bp, Artificial Sequence
  chemically synthesized
agacggtattgccattcttatc

SEQ ID NO: 1150712 - DNA, 22 bp, Artificial Sequence
  chemically synthesized
ccattcttatcataagcctata

SEQ ID NO: 1150713 - DNA, 22 bp, Artificial Sequence
  chemically synthesized
taagggaaacaggaatataggc

SEQ ID NO: 1150714 - DNA, 22 bp, Artificial Sequence
  chemically synthesized
ttatcataagcctatattcctg

SEQ ID NO: 1150715 - DNA, 22 bp, Artificial Sequence
  chemically synthesized
atcataagcctatattcctgtt

SEQ ID NO: 1150716 - DNA, 22 bp, Artificial Sequence
  chemically synthesized
tcataagcctatattcctgttt

SEQ ID NO: 1150717 - DNA, 22 bp, Artificial Sequence
  chemically synthesized
tattcctgtttcccttatagtc

SEQ ID NO: 1150718 - DNA, 22 bp, Artificial Sequence
  chemically synthesized
aaatagaggaaaaagagactat

SEQ ID NO: 1150719 - DNA, 22 bp, Artificial Sequence
  chemically synthesized
ctgtttcccttatagtctcttt

SEQ ID NO: 1150720 - DNA, 22 bp, Artificial Sequence
  chemically synthesized
aaaatagaggaaaaagagacta

SEQ ID NO: 1150721 - DNA, 22 bp, Artificial Sequence
  chemically synthesized
taaaatagaggaaaaagagact

SEQ ID NO: 1150722 - DNA, 22 bp, Artificial Sequence
  chemically synthesized
tttcccttatagtctctttttc

SEQ ID NO: 1150723 - DNA, 22 bp, Artificial Sequence
  chemically synthesized
tttaaaatagaggaaaaagaga

SEQ ID NO: 1150724 - DNA, 22 bp, Artificial Sequence
  chemically synthesized
cccttatagtctctttttcctc

SEQ ID NO: 1150725 - DNA, 22 bp, Artificial Sequence
  chemically synthesized
ccttatagtctctttttcctct

SEQ ID NO: 1150726 - DNA, 22 bp, Artificial Sequence
  chemically synthesized
tagttctttaaaatagaggaaa

SEQ ID NO: 1150727 - DNA, 22 bp, Artificial Sequence
  chemically synthesized
atagtctctttttcctctattt

SEQ ID NO: 1150728 - DNA, 22 bp, Artificial Sequence
  chemically synthesized
tagtctctttttcctctatttt

SEQ ID NO: 1150729 - DNA, 22 bp, Artificial Sequence
  chemically synthesized
ctgtagttctttaaaatagagg

SEQ ID NO: 1150730 - DNA, 22 bp, Artificial Sequence
  chemically synthesized
ctcctgtagttctttaaaatag

SEQ ID NO: 1150731 - DNA, 22 bp, Artificial Sequence
  chemically synthesized
tttttcctctattttaaagaac

SEQ ID NO: 1150732 - DNA, 22 bp, Artificial Sequence
  chemically synthesized
tttcctctattttaaagaacta

SEQ ID NO: 1150733 - DNA, 22 bp, Artificial Sequence
  chemically synthesized
ttcctctattttaaagaactac

SEQ ID NO: 1150734 - DNA, 22 bp, Artificial Sequence
  chemically synthesized
tcctctattttaaagaactaca

SEQ ID NO: 1150735 - DNA, 22 bp, Artificial Sequence
  chemically synthesized
cctctattttaaagaactacag

SEQ ID NO: 1150736 - DNA, 22 bp, Artificial Sequence
  chemically synthesized
ctctattttaaagaactacagg

SEQ ID NO: 1150737 - DNA, 22 bp, Artificial Sequence
  chemically synthesized
atcaccattactcctgtagttc

SEQ ID NO: 1150738 - DNA, 22 bp, Artificial Sequence
  chemically synthesized
tattttaaagaactacaggagt

SEQ ID NO: 1150739 - DNA, 22 bp, Artificial Sequence
  chemically synthesized
ttttaaagaactacaggagtaa

SEQ ID NO: 1150740 - DNA, 22 bp, Artificial Sequence
  chemically synthesized
taaagaactacaggagtaatgg

SEQ ID NO: 1150741 - DNA, 22 bp, Artificial Sequence
  chemically synthesized
aaagaactacaggagtaatggt

SEQ ID NO: 1150742 - DNA, 22 bp, Artificial Sequence
  chemically synthesized
aagaactacaggagtaatggtg

SEQ ID NO: 1150743 - DNA, 22 bp, Artificial Sequence
  chemically synthesized
atgaaataattcatcaccatta

SEQ ID NO: 1150744 - DNA, 22 bp, Artificial Sequence
  chemically synthesized
aatgaaataattcatcaccatt

SEQ ID NO: 1150745 - DNA, 22 bp, Artificial Sequence
  chemically synthesized
caggagtaatggtgatgaatta

SEQ ID NO: 1150746 - DNA, 22 bp, Artificial Sequence
  chemically synthesized
agaatcaaaatgcttaatgaaa

SEQ ID NO: 1150747 - DNA, 22 bp, Artificial Sequence
  chemically synthesized
aatactcagaatcaaaatgctt

SEQ ID NO: 1150748 - DNA, 22 bp, Artificial Sequence
  chemically synthesized
tttcattaagcattttgattct

SEQ ID NO: 1150749 - DNA, 22 bp, Artificial Sequence
  chemically synthesized
cacattaaatactcagaatcaa

SEQ ID NO: 1150750 - DNA, 22 bp, Artificial Sequence
  chemically synthesized
cattaagcattttgattctgag

SEQ ID NO: 1150751 - DNA, 22 bp, Artificial Sequence
  chemically synthesized
attaagcattttgattctgagt

SEQ ID NO: 1150752 - DNA, 22 bp, Artificial Sequence
  chemically synthesized
agcattttgattctgagtattt

SEQ ID NO: 1150753 - DNA, 22 bp, Artificial Sequence
  chemically synthesized
tgattctgagtatttaatgtgt

SEQ ID NO: 1150754 - DNA, 22 bp, Artificial Sequence
  chemically synthesized
gattctgagtatttaatgtgta

SEQ ID NO: 1150755 - DNA, 22 bp, Artificial Sequence
  chemically synthesized
attctgagtatttaatgtgtag

SEQ ID NO: 1150756 - DNA, 22 bp, Artificial Sequence
  chemically synthesized
tgagtatttaatgtgtagctac

SEQ ID NO: 1150757 - DNA, 22 bp, Artificial Sequence
  chemically synthesized
agtatttaatgtgtagctacca

SEQ ID NO: 1150758 - DNA, 22 bp, Artificial Sequence
  chemically synthesized
aatgtgtagctaccactactgc

SEQ ID NO: 1150759 - DNA, 22 bp, Artificial Sequence
  chemically synthesized
atgtgtagctaccactactgct

SEQ ID NO: 1150760 - DNA, 22 bp, Artificial Sequence
  chemically synthesized
aaacatagagtaagcagtagtg

SEQ ID NO: 1150761 - DNA, 22 bp, Artificial Sequence
  chemically synthesized
caaacatagagtaagcagtagt

SEQ ID NO: 1150762 - DNA, 22 bp, Artificial Sequence
  chemically synthesized
ccactactgcttactctatgtt

SEQ ID NO: 1150763 - DNA, 22 bp, Artificial Sequence
  chemically synthesized
ctgcttactctatgtttgaaga

SEQ ID NO: 1150764 - DNA, 22 bp, Artificial Sequence
  chemically synthesized
tgtgcatatgagtcttcaaaca

SEQ ID NO: 1150765 - DNA, 22 bp, Artificial Sequence
  chemically synthesized
cttactctatgtttgaagactc

SEQ ID NO: 1150766 - DNA, 22 bp, Artificial Sequence
  chemically synthesized
actctatgtttgaagactcata

SEQ ID NO: 1150767 - DNA, 22 bp, Artificial Sequence
  chemically synthesized
ctctatgtttgaagactcatat

SEQ ID NO: 1150768 - DNA, 22 bp, Artificial Sequence
  chemically synthesized
tatgtttgaagactcatatgca

SEQ ID NO: 1150769 - DNA, 22 bp, Artificial Sequence
  chemically synthesized
tgtttgaagactcatatgcaca

SEQ ID NO: 1150770 - DNA, 22 bp, Artificial Sequence
  chemically synthesized
gaagactcatatgcacacagtc

SEQ ID NO: 1150771 - DNA, 22 bp, Artificial Sequence
  chemically synthesized
aagactcatatgcacacagtct

SEQ ID NO: 1150772 - DNA, 22 bp, Artificial Sequence
  chemically synthesized
gatagaaggtacagagactgtg

SEQ ID NO: 1150773 - DNA, 22 bp, Artificial Sequence
  chemically synthesized
atatgcacacagtctctgtacc

SEQ ID NO: 1150774 - DNA, 22 bp, Artificial Sequence
  chemically synthesized
ggaatgtctagatagaaggtac

SEQ ID NO: 1150775 - DNA, 22 bp, Artificial Sequence
  chemically synthesized
ccaggattgggaatgtctagat

SEQ ID NO: 1150776 - DNA, 22 bp, Artificial Sequence
  chemically synthesized
tgtaccttctatctagacattc

SEQ ID NO: 1150777 - DNA, 22 bp, Artificial Sequence
  chemically synthesized
taccttctatctagacattccc

SEQ ID NO: 1150778 - DNA, 22 bp, Artificial Sequence
  chemically synthesized
gattcccaggattgggaatgtc

SEQ ID NO: 1150779 - DNA, 22 bp, Artificial Sequence
  chemically synthesized
ggattcccaggattgggaatgt

SEQ ID NO: 1150780 - DNA, 22 bp, Artificial Sequence
  chemically synthesized
ctatctagacattcccaatcct

SEQ ID NO: 1150781 - DNA, 22 bp, Artificial Sequence
  chemically synthesized
tatctagacattcccaatcctg

SEQ ID NO: 1150782 - DNA, 22 bp, Artificial Sequence
  chemically synthesized
tctagacattcccaatcctggg

SEQ ID NO: 1150783 - DNA, 22 bp, Artificial Sequence
  chemically synthesized
tggcatttggattcccaggatt

SEQ ID NO: 1150784 - DNA, 22 bp, Artificial Sequence
  chemically synthesized
gacattcccaatcctgggaatc

SEQ ID NO: 1150785 - DNA, 22 bp, Artificial Sequence
  chemically synthesized
aagatgttgtggcatttggatt

SEQ ID NO: 1150786 - DNA, 22 bp, Artificial Sequence
  chemically synthesized
ccaatcctgggaatccaaatgc

SEQ ID NO: 1150787 - DNA, 22 bp, Artificial Sequence
  chemically synthesized
gaagatgttgtggcatttggat

SEQ ID NO: 1150788 - DNA, 22 bp, Artificial Sequence
  chemically synthesized
ggaatccaaatgccacaacatc

SEQ ID NO: 1150789 - DNA, 22 bp, Artificial Sequence
  chemically synthesized
cagagaagtgacaaagagattt

SEQ ID NO: 1150790 - DNA, 22 bp, Artificial Sequence
  chemically synthesized
gagcagttgcagagaagtgaca

SEQ ID NO: 1150791 - DNA, 22 bp, Artificial Sequence
  chemically synthesized
caaatctctttgtcacttctct

SEQ ID NO: 1150792 - DNA, 22 bp, Artificial Sequence
  chemically synthesized
aaatctctttgtcacttctctg

SEQ ID NO: 1150793 - DNA, 22 bp, Artificial Sequence
  chemically synthesized
gagactagagcagttgcagaga

SEQ ID NO: 1150794 - DNA, 22 bp, Artificial Sequence
  chemically synthesized
tttgtcacttctctgcaactgc

SEQ ID NO: 1150795 - DNA, 22 bp, Artificial Sequence
  chemically synthesized
tgtcacttctctgcaactgctc

SEQ ID NO: 1150796 - DNA, 22 bp, Artificial Sequence
  chemically synthesized
gtcacttctctgcaactgctct

SEQ ID NO: 1150797 - DNA, 22 bp, Artificial Sequence
  chemically synthesized
tcacttctctgcaactgctcta

SEQ ID NO: 1150798 - DNA, 22 bp, Artificial Sequence
  chemically synthesized
agatcctagagactagagcagt

SEQ ID NO: 1150799 - DNA, 22 bp, Artificial Sequence
  chemically synthesized
ctctgcaactgctctagtctct

SEQ ID NO: 1150800 - DNA, 22 bp, Artificial Sequence
  chemically synthesized
tctgcaactgctctagtctcta

SEQ ID NO: 1150801 - DNA, 22 bp, Artificial Sequence
  chemically synthesized
cacctgagatcctagagactag

SEQ ID NO: 1150802 - DNA, 22 bp, Artificial Sequence
  chemically synthesized
tgcaactgctctagtctctagg

SEQ ID NO: 1150803 - DNA, 22 bp, Artificial Sequence
  chemically synthesized
caactgctctagtctctaggat

SEQ ID NO: 1150804 - DNA, 22 bp, Artificial Sequence
  chemically synthesized
actccacctgagatcctagaga

SEQ ID NO: 1150805 - DNA, 22 bp, Artificial Sequence
  chemically synthesized
gactccacctgagatcctagag

SEQ ID NO: 1150806 - DNA, 22 bp, Artificial Sequence
  chemically synthesized
ctctagtctctaggatctcagg

SEQ ID NO: 1150807 - DNA, 22 bp, Artificial Sequence
  chemically synthesized
tagtctctaggatctcaggtgg

SEQ ID NO: 1150808 - DNA, 22 bp, Artificial Sequence
  chemically synthesized
gtctctaggatctcaggtggag

SEQ ID NO: 1150809 - DNA, 22 bp, Artificial Sequence
  chemically synthesized
cagtgaagcttgactccacctg

SEQ ID NO: 1150810 - DNA, 22 bp, Artificial Sequence
  chemically synthesized
taggatctcaggtggagtcaag

SEQ ID NO: 1150811 - DNA, 22 bp, Artificial Sequence
  chemically synthesized
ggatctcaggtggagtcaagct

SEQ ID NO: 1150812 - DNA, 22 bp, Artificial Sequence
  chemically synthesized
agattccagtgaagcttgactc

SEQ ID NO: 1150813 - DNA, 22 bp, Artificial Sequence
  chemically synthesized
gagattccagtgaagcttgact

SEQ ID NO: 1150814 - DNA, 22 bp, Artificial Sequence
  chemically synthesized
tgagattccagtgaagcttgac

SEQ ID NO: 1150815 - DNA, 22 bp, Artificial Sequence
  chemically synthesized
aggtggagtcaagcttcactgg

SEQ ID NO: 1150816 - DNA, 22 bp, Artificial Sequence
  chemically synthesized
cattttgagattccagtgaagc

SEQ ID NO: 1150817 - DNA, 22 bp, Artificial Sequence
  chemically synthesized
tccattttgagattccagtgaa

SEQ ID NO: 1150818 - DNA, 22 bp, Artificial Sequence
  chemically synthesized
tctccattttgagattccagtg

SEQ ID NO: 1150819 - DNA, 22 bp, Artificial Sequence
  chemically synthesized
ctctccattttgagattccagt

SEQ ID NO: 1150820 - DNA, 22 bp, Artificial Sequence
  chemically synthesized
agaccatttctctccattttga

SEQ ID NO: 1150821 - DNA, 22 bp, Artificial Sequence
  chemically synthesized
gagaccatttctctccattttg

SEQ ID NO: 1150822 - DNA, 22 bp, Artificial Sequence
  chemically synthesized
cactggaatctcaaaatggaga

SEQ ID NO: 1150823 - DNA, 22 bp, Artificial Sequence
  chemically synthesized
tgagaccatttctctccatttt

SEQ ID NO: 1150824 - DNA, 22 bp, Artificial Sequence
  chemically synthesized
actggaatctcaaaatggagag

SEQ ID NO: 1150825 - DNA, 22 bp, Artificial Sequence
  chemically synthesized
cctttgagaccatttctctcca

SEQ ID NO: 1150826 - DNA, 22 bp, Artificial Sequence
  chemically synthesized
gaatctcaaaatggagagaaat

SEQ ID NO: 1150827 - DNA, 22 bp, Artificial Sequence
  chemically synthesized
tctgcctttgagaccatttctc

SEQ ID NO: 1150828 - DNA, 22 bp, Artificial Sequence
  chemically synthesized
aaaatggagagaaatggtctca

SEQ ID NO: 1150829 - DNA, 22 bp, Artificial Sequence
  chemically synthesized
acctgtctgcctttgagaccat

SEQ ID NO: 1150830 - DNA, 22 bp, Artificial Sequence
  chemically synthesized
gacctgtctgcctttgagacca

SEQ ID NO: 1150831 - DNA, 22 bp, Artificial Sequence
  chemically synthesized
tgacctgtctgcctttgagacc

SEQ ID NO: 1150832 - DNA, 22 bp, Artificial Sequence
  chemically synthesized
actttgacctgtctgcctttga

SEQ ID NO: 1150833 - DNA, 22 bp, Artificial Sequence
  chemically synthesized
aactttgacctgtctgcctttg

SEQ ID NO: 1150834 - DNA, 22 bp, Artificial Sequence
  chemically synthesized
taactttgacctgtctgccttt

SEQ ID NO: 1150835 - DNA, 22 bp, Artificial Sequence
  chemically synthesized
attttaactttgacctgtctgc

SEQ ID NO: 1150836 - DNA, 22 bp, Artificial Sequence
  chemically synthesized
tgattttaactttgacctgtct

SEQ ID NO: 1150837 - DNA, 22 bp, Artificial Sequence
  chemically synthesized
aaaggcagacaggtcaaagtta

SEQ ID NO: 1150838 - DNA, 22 bp, Artificial Sequence
  chemically synthesized
gtagattctgattttaactttg

SEQ ID NO: 1150839 - DNA, 22 bp, Artificial Sequence
  chemically synthesized
attggtagattctgattttaac

SEQ ID NO: 1150840 - DNA, 22 bp, Artificial Sequence
  chemically synthesized
agtattaattggtagattctga

SEQ ID NO: 1150841 - DNA, 22 bp, Artificial Sequence
  chemically synthesized
cagtattaattggtagattctg

SEQ ID NO: 1150842 - DNA, 22 bp, Artificial Sequence
  chemically synthesized
aaatcagaatctaccaattaat

SEQ ID NO: 1150843 - DNA, 22 bp, Artificial Sequence
  chemically synthesized
aaggtaacttcagtattaattg

SEQ ID NO: 1150844 - DNA, 22 bp, Artificial Sequence
  chemically synthesized
ttcaaggtaacttcagtattaa

SEQ ID NO: 1150845 - DNA, 22 bp, Artificial Sequence
  chemically synthesized
ccaattaatactgaagttacct

SEQ ID NO: 1150846 - DNA, 22 bp, Artificial Sequence
  chemically synthesized
aggagttgttcaaggtaacttc

SEQ ID NO: 1150847 - DNA, 22 bp, Artificial Sequence
  chemically synthesized
aaggagttgttcaaggtaactt

SEQ ID NO: 1150848 - DNA, 22 bp, Artificial Sequence
  chemically synthesized
atactgaagttaccttgaacaa

SEQ ID NO: 1150849 - DNA, 22 bp, Artificial Sequence
  chemically synthesized
aaagagtttaaggagttgttca

SEQ ID NO: 1150850 - DNA, 22 bp, Artificial Sequence
  chemically synthesized
aagttaccttgaacaactcctt

SEQ ID NO: 1150851 - DNA, 22 bp, Artificial Sequence
  chemically synthesized
ccttgaacaactccttaaactc

SEQ ID NO: 1150852 - DNA, 22 bp, Artificial Sequence
  chemically synthesized
gaacaactccttaaactctttg

SEQ ID NO: 1150853 - DNA, 22 bp, Artificial Sequence
  chemically synthesized
aacaactccttaaactctttga

SEQ ID NO: 1150854 - DNA, 22 bp, Artificial Sequence
  chemically synthesized
cagacaaatagatgtgttcaaa

SEQ ID NO: 1150855 - DNA, 22 bp, Artificial Sequence
  chemically synthesized
acagacaaatagatgtgttcaa

SEQ ID NO: 1150856 - DNA, 22 bp, Artificial Sequence
  chemically synthesized
tacagacaaatagatgtgttca

SEQ ID NO: 1150857 - DNA, 22 bp, Artificial Sequence
  chemically synthesized
cttaaactctttgaacacatct

SEQ ID NO: 1150858 - DNA, 22 bp, Artificial Sequence
  chemically synthesized
aaactctttgaacacatctatt

SEQ ID NO: 1150859 - DNA, 22 bp, Artificial Sequence
  chemically synthesized
attttacagacaaatagatgtg

SEQ ID NO: 1150860 - DNA, 22 bp, Artificial Sequence
  chemically synthesized
aactctttgaacacatctattt

SEQ ID NO: 1150861 - DNA, 22 bp, Artificial Sequence
  chemically synthesized
gattttacagacaaatagatgt

SEQ ID NO: 1150862 - DNA, 22 bp, Artificial Sequence
  chemically synthesized
tttgaacacatctatttgtctg

SEQ ID NO: 1150863 - DNA, 22 bp, Artificial Sequence
  chemically synthesized
atacttgattttacagacaaat

SEQ ID NO: 1150864 - DNA, 22 bp, Artificial Sequence
  chemically synthesized
tgaacacatctatttgtctgta

SEQ ID NO: 1150865 - DNA, 22 bp, Artificial Sequence
  chemically synthesized
gaacacatctatttgtctgtaa

SEQ ID NO: 1150866 - DNA, 22 bp, Artificial Sequence
  chemically synthesized
aacacatctatttgtctgtaaa

SEQ ID NO: 1150867 - DNA, 22 bp, Artificial Sequence
  chemically synthesized
gaaggatattaatacttgattt

SEQ ID NO: 1150868 - DNA, 22 bp, Artificial Sequence
  chemically synthesized
tttgtctgtaaaatcaagtatt

SEQ ID NO: 1150869 - DNA, 22 bp, Artificial Sequence
  chemically synthesized
gtctgtaaaatcaagtattaat

SEQ ID NO: 1150870 - DNA, 22 bp, Artificial Sequence
  chemically synthesized
gcctggaaggatattaatactt

SEQ ID NO: 1150871 - DNA, 22 bp, Artificial Sequence
  chemically synthesized
tctgtaaaatcaagtattaata

SEQ ID NO: 1150872 - DNA, 22 bp, Artificial Sequence
  chemically synthesized
taaaatcaagtattaatatcct

SEQ ID NO: 1150873 - DNA, 22 bp, Artificial Sequence
  chemically synthesized
taagtgtctggcctggaaggat

SEQ ID NO: 1150874 - DNA, 22 bp, Artificial Sequence
  chemically synthesized
tgtaagtgtctggcctggaagg

SEQ ID NO: 1150875 - DNA, 22 bp, Artificial Sequence
  chemically synthesized
atatccttccaggccagacact

SEQ ID NO: 1150876 - DNA, 22 bp, Artificial Sequence
  chemically synthesized
ccaggccagacacttacagaac

SEQ ID NO: 1150877 - DNA, 22 bp, Artificial Sequence
  chemically synthesized
caggccagacacttacagaaca

SEQ ID NO: 1150878 - DNA, 22 bp, Artificial Sequence
  chemically synthesized
tggtggtagaatagaatgttct

SEQ ID NO: 1150879 - DNA, 22 bp, Artificial Sequence
  chemically synthesized
tgtggtggtagaatagaatgtt

SEQ ID NO: 1150880 - DNA, 22 bp, Artificial Sequence
  chemically synthesized
acagaacattctattctaccac

SEQ ID NO: 1150881 - DNA, 22 bp, Artificial Sequence
  chemically synthesized
cagaacattctattctaccacc

SEQ ID NO: 1150882 - DNA, 22 bp, Artificial Sequence
  chemically synthesized
tattctaccaccacagaatgta

SEQ ID NO: 1150883 - DNA, 22 bp, Artificial Sequence
  chemically synthesized
ttctaccaccacagaatgtaca

SEQ ID NO: 1150884 - DNA, 22 bp, Artificial Sequence
  chemically synthesized
taccaccacagaatgtacatta

SEQ ID NO: 1150885 - DNA, 22 bp, Artificial Sequence
  chemically synthesized
ccaccacagaatgtacattatt

SEQ ID NO: 1150886 - DNA, 22 bp, Artificial Sequence
  chemically synthesized
ataatgatccacgtgcagatga

SEQ ID NO: 1150887 - DNA, 22 bp, Artificial Sequence
  chemically synthesized
gataatgatccacgtgcagatg

SEQ ID NO: 1150888 - DNA, 22 bp, Artificial Sequence
  chemically synthesized
tgataatgatccacgtgcagat

SEQ ID NO: 1150889 - DNA, 22 bp, Artificial Sequence
  chemically synthesized
ttgataatgatccacgtgcaga

SEQ ID NO: 1150890 - DNA, 22 bp, Artificial Sequence
  chemically synthesized
aatttttgataatgatccacgt

SEQ ID NO: 1150891 - DNA, 22 bp, Artificial Sequence
  chemically synthesized
ttctcatctgcacgtggatcat

SEQ ID NO: 1150892 - DNA, 22 bp, Artificial Sequence
  chemically synthesized
caatttttgataatgatccacg

SEQ ID NO: 1150893 - DNA, 22 bp, Artificial Sequence
  chemically synthesized
tcaatttttgataatgatccac

SEQ ID NO: 1150894 - DNA, 22 bp, Artificial Sequence
  chemically synthesized
tcatctgcacgtggatcattat

SEQ ID NO: 1150895 - DNA, 22 bp, Artificial Sequence
  chemically synthesized
atctgcacgtggatcattatca

SEQ ID NO: 1150896 - DNA, 22 bp, Artificial Sequence
  chemically synthesized
gcacattttcaatttttgataa

SEQ ID NO: 1150897 - DNA, 22 bp, Artificial Sequence
  chemically synthesized
cacgtggatcattatcaaaaat

SEQ ID NO: 1150898 - DNA, 22 bp, Artificial Sequence
  chemically synthesized
tggcctagcacattttcaattt

SEQ ID NO: 1150899 - DNA, 22 bp, Artificial Sequence
  chemically synthesized
gtggcctagcacattttcaatt

SEQ ID NO: 1150900 - DNA, 22 bp, Artificial Sequence
  chemically synthesized
tcaaaaattgaaaatgtgctag

SEQ ID NO: 1150901 - DNA, 22 bp, Artificial Sequence
  chemically synthesized
agaaccaccttgtggcctagca

SEQ ID NO: 1150902 - DNA, 22 bp, Artificial Sequence
  chemically synthesized
aaaatgtgctaggccacaaggt

SEQ ID NO: 1150903 - DNA, 22 bp, Artificial Sequence
  chemically synthesized
aaaatgtgttaagaaccacctt

SEQ ID NO: 1150904 - DNA, 22 bp, Artificial Sequence
  chemically synthesized
aaaaatgtgttaagaaccacct

SEQ ID NO: 1150905 - DNA, 22 bp, Artificial Sequence
  chemically synthesized
taaaaatgtgttaagaaccacc

SEQ ID NO: 1150906 - DNA, 22 bp, Artificial Sequence
  chemically synthesized
ttaaaaatgtgttaagaaccac

SEQ ID NO: 1150907 - DNA, 22 bp, Artificial Sequence
  chemically synthesized
tttaaaaatgtgttaagaacca

SEQ ID NO: 1150908 - DNA, 22 bp, Artificial Sequence
  chemically synthesized
ttttaaaaatgtgttaagaacc

SEQ ID NO: 1150909 - DNA, 22 bp, Artificial Sequence
  chemically synthesized
ggccacaaggtggttcttaaca

SEQ ID NO: 1150910 - DNA, 22 bp, Artificial Sequence
  chemically synthesized
atttttttaaaaatgtgttaag

SEQ ID NO: 1150911 - DNA, 22 bp, Artificial Sequence
  chemically synthesized
gatttttttaaaaatgtgttaa

SEQ ID NO: 1150912 - DNA, 22 bp, Artificial Sequence
  chemically synthesized
tgatttttttaaaaatgtgtta

SEQ ID NO: 1150913 - DNA, 22 bp, Artificial Sequence
  chemically synthesized
atatgattttgatttttttaaa

SEQ ID NO: 1150914 - DNA, 22 bp, Artificial Sequence
  chemically synthesized
gatatgattttgatttttttaa

SEQ ID NO: 1150915 - DNA, 22 bp, Artificial Sequence
  chemically synthesized
ttaacacatttttaaaaaaatc

SEQ ID NO: 1150916 - DNA, 22 bp, Artificial Sequence
  chemically synthesized
aacacatttttaaaaaaatcaa

SEQ ID NO: 1150917 - DNA, 22 bp, Artificial Sequence
  chemically synthesized
acacatttttaaaaaaatcaaa

SEQ ID NO: 1150918 - DNA, 22 bp, Artificial Sequence
  chemically synthesized
ttaaaaaaatcaaaatcatatc

SEQ ID NO: 1150919 - DNA, 22 bp, Artificial Sequence
  chemically synthesized
taaaaaaatcaaaatcatatca

SEQ ID NO: 1150920 - DNA, 22 bp, Artificial Sequence
  chemically synthesized
aaaaaaatcaaaatcatatcaa

SEQ ID NO: 1150921 - DNA, 22 bp, Artificial Sequence
  chemically synthesized
aaaaaatcaaaatcatatcaag

SEQ ID NO: 1150922 - DNA, 22 bp, Artificial Sequence
  chemically synthesized
tggtgcaagaagatgcttgata

SEQ ID NO: 1150923 - DNA, 22 bp, Artificial Sequence
  chemically synthesized
cactgtggtgcaagaagatgct

SEQ ID NO: 1150924 - DNA, 22 bp, Artificial Sequence
  chemically synthesized
ccactgtggtgcaagaagatgc

SEQ ID NO: 1150925 - DNA, 22 bp, Artificial Sequence
  chemically synthesized
tccactgtggtgcaagaagatg

SEQ ID NO: 1150926 - DNA, 22 bp, Artificial Sequence
  chemically synthesized
ttccactgtggtgcaagaagat

SEQ ID NO: 1150927 - DNA, 22 bp, Artificial Sequence
  chemically synthesized
tttccactgtggtgcaagaaga

SEQ ID NO: 1150928 - DNA, 22 bp, Artificial Sequence
  chemically synthesized
ttttccactgtggtgcaagaag

SEQ ID NO: 1150929 - DNA, 22 bp, Artificial Sequence
  chemically synthesized
gtttttttccactgtggtgcaa

SEQ ID NO: 1150930 - DNA, 22 bp, Artificial Sequence
  chemically synthesized
tagtttttttccactgtggtgc

SEQ ID NO: 1150931 - DNA, 22 bp, Artificial Sequence
  chemically synthesized
ctagtttttttccactgtggtg

SEQ ID NO: 1150932 - DNA, 22 bp, Artificial Sequence
  chemically synthesized
atttctagtttttttccactgt

SEQ ID NO: 1150933 - DNA, 22 bp, Artificial Sequence
  chemically synthesized
cttgcaccacagtggaaaaaaa

SEQ ID NO: 1150934 - DNA, 22 bp, Artificial Sequence
  chemically synthesized
ttgcaccacagtggaaaaaaac

SEQ ID NO: 1150935 - DNA, 22 bp, Artificial Sequence
  chemically synthesized
gtactcatttctagtttttttc

SEQ ID NO: 1150936 - DNA, 22 bp, Artificial Sequence
  chemically synthesized
gcaccacagtggaaaaaaacta

SEQ ID NO: 1150937 - DNA, 22 bp, Artificial Sequence
  chemically synthesized
ggtactcatttctagttttttt

SEQ ID NO: 1150938 - DNA, 22 bp, Artificial Sequence
  chemically synthesized
caccacagtggaaaaaaactag

SEQ ID NO: 1150939 - DNA, 22 bp, Artificial Sequence
  chemically synthesized
ttggtactcatttctagttttt

SEQ ID NO: 1150940 - DNA, 22 bp, Artificial Sequence
  chemically synthesized
cttggtactcatttctagtttt

SEQ ID NO: 1150941 - DNA, 22 bp, Artificial Sequence
  chemically synthesized
aggagtcttcttggtactcatt

SEQ ID NO: 1150942 - DNA, 22 bp, Artificial Sequence
  chemically synthesized
aaggagtcttcttggtactcat

SEQ ID NO: 1150943 - DNA, 22 bp, Artificial Sequence
  chemically synthesized
gaaatgagtaccaagaagactc

SEQ ID NO: 1150944 - DNA, 22 bp, Artificial Sequence
  chemically synthesized
tatagatttaaggagtcttctt

SEQ ID NO: 1150945 - DNA, 22 bp, Artificial Sequence
  chemically synthesized
gtatagatttaaggagtcttct

SEQ ID NO: 1150946 - DNA, 22 bp, Artificial Sequence
  chemically synthesized
catgtatttgtatagatttaag

SEQ ID NO: 1150947 - DNA, 22 bp, Artificial Sequence
  chemically synthesized
ccatgtatttgtatagatttaa

SEQ ID NO: 1150948 - DNA, 22 bp, Artificial Sequence
  chemically synthesized
atttccatgtatttgtatagat

SEQ ID NO: 1150949 - DNA, 22 bp, Artificial Sequence
  chemically synthesized
aatttccatgtatttgtataga

SEQ ID NO: 1150950 - DNA, 22 bp, Artificial Sequence
  chemically synthesized
tttaatttccatgtatttgtat

SEQ ID NO: 1150951 - DNA, 22 bp, Artificial Sequence
  chemically synthesized
cttaaatctatacaaatacatg

SEQ ID NO: 1150952 - DNA, 22 bp, Artificial Sequence
  chemically synthesized
aaatctatacaaatacatggaa

SEQ ID NO: 1150953 - DNA, 22 bp, Artificial Sequence
  chemically synthesized
aatctatacaaatacatggaaa

SEQ ID NO: 1150954 - DNA, 22 bp, Artificial Sequence
  chemically synthesized
aggagcaggttgtttaatttcc

SEQ ID NO: 1150955 - DNA, 22 bp, Artificial Sequence
  chemically synthesized
tacaaatacatggaaattaaac

SEQ ID NO: 1150956 - DNA, 22 bp, Artificial Sequence
  chemically synthesized
tccaaagatcattcaggagcag

SEQ ID NO: 1150957 - DNA, 22 bp, Artificial Sequence
  chemically synthesized
attgtccaaagatcattcagga

SEQ ID NO: 1150958 - DNA, 22 bp, Artificial Sequence
  chemically synthesized
cattgtccaaagatcattcagg

SEQ ID NO: 1150959 - DNA, 22 bp, Artificial Sequence
  chemically synthesized
aacaacctgctcctgaatgatc

SEQ ID NO: 1150960 - DNA, 22 bp, Artificial Sequence
  chemically synthesized
atttcattgtccaaagatcatt

SEQ ID NO: 1150961 - DNA, 22 bp, Artificial Sequence
  chemically synthesized
gatttcattgtccaaagatcat

SEQ ID NO: 1150962 - DNA, 22 bp, Artificial Sequence
  chemically synthesized
cttgatttcattgtccaaagat

SEQ ID NO: 1150963 - DNA, 22 bp, Artificial Sequence
  chemically synthesized
ccttgatttcattgtccaaaga

SEQ ID NO: 1150964 - DNA, 22 bp, Artificial Sequence
  chemically synthesized
ctcctgaatgatctttggacaa

SEQ ID NO: 1150965 - DNA, 22 bp, Artificial Sequence
  chemically synthesized
ttccttgatttcattgtccaaa

SEQ ID NO: 1150966 - DNA, 22 bp, Artificial Sequence
  chemically synthesized
cttccttgatttcattgtccaa

SEQ ID NO: 1150967 - DNA, 22 bp, Artificial Sequence
  chemically synthesized
ctgaatgatctttggacaatga

SEQ ID NO: 1150968 - DNA, 22 bp, Artificial Sequence
  chemically synthesized
aatgatctttggacaatgaaat

SEQ ID NO: 1150969 - DNA, 22 bp, Artificial Sequence
  chemically synthesized
atttcttccttgatttcattgt

SEQ ID NO: 1150970 - DNA, 22 bp, Artificial Sequence
  chemically synthesized
aatttcttccttgatttcattg

SEQ ID NO: 1150971 - DNA, 22 bp, Artificial Sequence
  chemically synthesized
taatttcttccttgatttcatt

SEQ ID NO: 1150972 - DNA, 22 bp, Artificial Sequence
  chemically synthesized
tggacaatgaaatcaaggaaga

SEQ ID NO: 1150973 - DNA, 22 bp, Artificial Sequence
  chemically synthesized
ggacaatgaaatcaaggaagaa

SEQ ID NO: 1150974 - DNA, 22 bp, Artificial Sequence
  chemically synthesized
gacaatgaaatcaaggaagaaa

SEQ ID NO: 1150975 - DNA, 22 bp, Artificial Sequence
  chemically synthesized
aaaaagttttaatttcttcctt

SEQ ID NO: 1150976 - DNA, 22 bp, Artificial Sequence
  chemically synthesized
caaaaagttttaatttcttcct

SEQ ID NO: 1150977 - DNA, 22 bp, Artificial Sequence
  chemically synthesized
tttcaaaaagttttaatttctt

SEQ ID NO: 1150978 - DNA, 22 bp, Artificial Sequence
  chemically synthesized
gtttcaaaaagttttaatttct

SEQ ID NO: 1150979 - DNA, 22 bp, Artificial Sequence
  chemically synthesized
tttgtttcaaaaagttttaatt

SEQ ID NO: 1150980 - DNA, 22 bp, Artificial Sequence
  chemically synthesized
atttgtttcaaaaagttttaat

SEQ ID NO: 1150981 - DNA, 22 bp, Artificial Sequence
  chemically synthesized
tatttgtttcaaaaagttttaa

SEQ ID NO: 1150982 - DNA, 22 bp, Artificial Sequence
  chemically synthesized
ttatttgtttcaaaaagtttta

SEQ ID NO: 1150983 - DNA, 22 bp, Artificial Sequence
  chemically synthesized
tttatttgtttcaaaaagtttt

SEQ ID NO: 1150984 - DNA, 22 bp, Artificial Sequence
  chemically synthesized
tttttatttgtttcaaaaagtt

SEQ ID NO: 1150985 - DNA, 22 bp, Artificial Sequence
  chemically synthesized
tatgtctctttttatttgtttc

SEQ ID NO: 1150986 - DNA, 22 bp, Artificial Sequence
  chemically synthesized
aaactttttgaaacaaataaaa

SEQ ID NO: 1150987 - DNA, 22 bp, Artificial Sequence
  chemically synthesized
tttgaaacaaataaaaagagac

SEQ ID NO: 1150988 - DNA, 22 bp, Artificial Sequence
  chemically synthesized
ttgaaacaaataaaaagagaca

SEQ ID NO: 1150989 - DNA, 22 bp, Artificial Sequence
  chemically synthesized
tgaaacaaataaaaagagacat

SEQ ID NO: 1150990 - DNA, 22 bp, Artificial Sequence
  chemically synthesized
gaaacaaataaaaagagacata

SEQ ID NO: 1150991 - DNA, 22 bp, Artificial Sequence
  chemically synthesized
aaacaaataaaaagagacatac

SEQ ID NO: 1150992 - DNA, 22 bp, Artificial Sequence
  chemically synthesized
tatcccagaggtggaggtatgt

SEQ ID NO: 1150993 - DNA, 22 bp, Artificial Sequence
  chemically synthesized
ctgtatcccagaggtggaggta

SEQ ID NO: 1150994 - DNA, 22 bp, Artificial Sequence
  chemically synthesized
gctgtatcccagaggtggaggt

SEQ ID NO: 1150995 - DNA, 22 bp, Artificial Sequence
  chemically synthesized
tgctgtatcccagaggtggagg

SEQ ID NO: 1150996 - DNA, 22 bp, Artificial Sequence
  chemically synthesized
ttgctgtatcccagaggtggag

SEQ ID NO: 1150997 - DNA, 22 bp, Artificial Sequence
  chemically synthesized
cttttgctgtatcccagaggtg

SEQ ID NO: 1150998 - DNA, 22 bp, Artificial Sequence
  chemically synthesized
ggactgcttttgctgtatccca

SEQ ID NO: 1150999 - DNA, 22 bp, Artificial Sequence
  chemically synthesized
aggactgcttttgctgtatccc

SEQ ID NO: 1151000 - DNA, 22 bp, Artificial Sequence
  chemically synthesized
cacctctgggatacagcaaaag

SEQ ID NO: 1151001 - DNA, 22 bp, Artificial Sequence
  chemically synthesized
catcttaggactgcttttgctg

SEQ ID NO: 1151002 - DNA, 22 bp, Artificial Sequence
  chemically synthesized
ccatcttaggactgcttttgct

SEQ ID NO: 1151003 - DNA, 22 bp, Artificial Sequence
  chemically synthesized
tgggatacagcaaaagcagtcc

SEQ ID NO: 1151004 - DNA, 22 bp, Artificial Sequence
  chemically synthesized
ggatacagcaaaagcagtccta

SEQ ID NO: 1151005 - DNA, 22 bp, Artificial Sequence
  chemically synthesized
taaatttccatcttaggactgc

SEQ ID NO: 1151006 - DNA, 22 bp, Artificial Sequence
  chemically synthesized
atgctataaatttccatcttag

SEQ ID NO: 1151007 - DNA, 22 bp, Artificial Sequence
  chemically synthesized
gtgtaggcagttaatgctataa

SEQ ID NO: 1151008 - DNA, 22 bp, Artificial Sequence
  chemically synthesized
ggtgtaggcagttaatgctata

SEQ ID NO: 1151009 - DNA, 22 bp, Artificial Sequence
  chemically synthesized
agatggaaatttatagcattaa

SEQ ID NO: 1151010 - DNA, 22 bp, Artificial Sequence
  chemically synthesized
tggtgtaggcagttaatgctat

SEQ ID NO: 1151011 - DNA, 22 bp, Artificial Sequence
  chemically synthesized
ttggtgtaggcagttaatgcta

SEQ ID NO: 1151012 - DNA, 22 bp, Artificial Sequence
  chemically synthesized
tttggtgtaggcagttaatgct

SEQ ID NO: 1151013 - DNA, 22 bp, Artificial Sequence
  chemically synthesized
tctttttggtgtaggcagttaa

SEQ ID NO: 1151014 - DNA, 22 bp, Artificial Sequence
  chemically synthesized
tatctttttggtgtaggcagtt

SEQ ID NO: 1151015 - DNA, 22 bp, Artificial Sequence
  chemically synthesized
ctatctttttggtgtaggcagt

SEQ ID NO: 1151016 - DNA, 22 bp, Artificial Sequence
  chemically synthesized
tctatctttttggtgtaggcag

SEQ ID NO: 1151017 - DNA, 22 bp, Artificial Sequence
  chemically synthesized
atagcattaactgcctacacca

SEQ ID NO: 1151018 - DNA, 22 bp, Artificial Sequence
  chemically synthesized
tagcattaactgcctacaccaa

SEQ ID NO: 1151019 - DNA, 22 bp, Artificial Sequence
  chemically synthesized
gatctttctatctttttggtgt

SEQ ID NO: 1151020 - DNA, 22 bp, Artificial Sequence
  chemically synthesized
agatctttctatctttttggtg

SEQ ID NO: 1151021 - DNA, 22 bp, Artificial Sequence
  chemically synthesized
tagatctttctatctttttggt

SEQ ID NO: 1151022 - DNA, 22 bp, Artificial Sequence
  chemically synthesized
actgcctacaccaaaaagatag

SEQ ID NO: 1151023 - DNA, 22 bp, Artificial Sequence
  chemically synthesized
attttagatctttctatctttt

SEQ ID NO: 1151024 - DNA, 22 bp, Artificial Sequence
  chemically synthesized
cctacaccaaaaagatagaaag

SEQ ID NO: 1151025 - DNA, 22 bp, Artificial Sequence
  chemically synthesized
ctaattttagatctttctatct

SEQ ID NO: 1151026 - DNA, 22 bp, Artificial Sequence
  chemically synthesized
gctaattttagatctttctatc

SEQ ID NO: 1151027 - DNA, 22 bp, Artificial Sequence
  chemically synthesized
caccaaaaagatagaaagatct

SEQ ID NO: 1151028 - DNA, 22 bp, Artificial Sequence
  chemically synthesized
gtttgctaattttagatctttc

SEQ ID NO: 1151029 - DNA, 22 bp, Artificial Sequence
  chemically synthesized
aagtacaatattagtttgctaa

SEQ ID NO: 1151030 - DNA, 22 bp, Artificial Sequence
  chemically synthesized
attgaagtacaatattagtttg

SEQ ID NO: 1151031 - DNA, 22 bp, Artificial Sequence
  chemically synthesized
gttcattgaagtacaatattag

SEQ ID NO: 1151032 - DNA, 22 bp, Artificial Sequence
  chemically synthesized
aaattagcaaactaatattgta

SEQ ID NO: 1151033 - DNA, 22 bp, Artificial Sequence
  chemically synthesized
tagttcattgaagtacaatatt

SEQ ID NO: 1151034 - DNA, 22 bp, Artificial Sequence
  chemically synthesized
ctagttcattgaagtacaatat

SEQ ID NO: 1151035 - DNA, 22 bp, Artificial Sequence
  chemically synthesized
tctagttcattgaagtacaata

SEQ ID NO: 1151036 - DNA, 22 bp, Artificial Sequence
  chemically synthesized
gcaaactaatattgtacttcaa

SEQ ID NO: 1151037 - DNA, 22 bp, Artificial Sequence
  chemically synthesized
gttttctagttcattgaagtac

SEQ ID NO: 1151038 - DNA, 22 bp, Artificial Sequence
  chemically synthesized
ggttttctagttcattgaagta

SEQ ID NO: 1151039 - DNA, 22 bp, Artificial Sequence
  chemically synthesized
ttggttttctagttcattgaag

SEQ ID NO: 1151040 - DNA, 22 bp, Artificial Sequence
  chemically synthesized
ttcttggttttctagttcattg

SEQ ID NO: 1151041 - DNA, 22 bp, Artificial Sequence
  chemically synthesized
atattgtacttcaatgaactag

SEQ ID NO: 1151042 - DNA, 22 bp, Artificial Sequence
  chemically synthesized
gttcttggttttctagttcatt

SEQ ID NO: 1151043 - DNA, 22 bp, Artificial Sequence
  chemically synthesized
ggtttgttcttggttttctagt

SEQ ID NO: 1151044 - DNA, 22 bp, Artificial Sequence
  chemically synthesized
tacttcaatgaactagaaaacc

SEQ ID NO: 1151045 - DNA, 22 bp, Artificial Sequence
  chemically synthesized
cggtttgttcttggttttctag

SEQ ID NO: 1151046 - DNA, 22 bp, Artificial Sequence
  chemically synthesized
gtttcggtttgttcttggtttt

SEQ ID NO: 1151047 - DNA, 22 bp, Artificial Sequence
  chemically synthesized
caatgaactagaaaaccaagaa

SEQ ID NO: 1151048 - DNA, 22 bp, Artificial Sequence
  chemically synthesized
ggtttcggtttgttcttggttt

SEQ ID NO: 1151049 - DNA, 22 bp, Artificial Sequence
  chemically synthesized
aatgaactagaaaaccaagaac

SEQ ID NO: 1151050 - DNA, 22 bp, Artificial Sequence
  chemically synthesized
tggtttcggtttgttcttggtt

SEQ ID NO: 1151051 - DNA, 22 bp, Artificial Sequence
  chemically synthesized
gctttggtttcggtttgttctt

SEQ ID NO: 1151052 - DNA, 22 bp, Artificial Sequence
  chemically synthesized
ctagctttggtttcggtttgtt

SEQ ID NO: 1151053 - DNA, 22 bp, Artificial Sequence
  chemically synthesized
gaaaaccaagaacaaaccgaaa

SEQ ID NO: 1151054 - DNA, 22 bp, Artificial Sequence
  chemically synthesized
tgctagctttggtttcggtttg

SEQ ID NO: 1151055 - DNA, 22 bp, Artificial Sequence
  chemically synthesized
tattctgctagctttggtttcg

SEQ ID NO: 1151056 - DNA, 22 bp, Artificial Sequence
  chemically synthesized
atattctgctagctttggtttc

SEQ ID NO: 1151057 - DNA, 22 bp, Artificial Sequence
  chemically synthesized
ttatattctgctagctttggtt

SEQ ID NO: 1151058 - DNA, 22 bp, Artificial Sequence
  chemically synthesized
cttatattctgctagctttggt

SEQ ID NO: 1151059 - DNA, 22 bp, Artificial Sequence
  chemically synthesized
tttcttatattctgctagcttt

SEQ ID NO: 1151060 - DNA, 22 bp, Artificial Sequence
  chemically synthesized
ttatttcttatattctgctagc

SEQ ID NO: 1151061 - DNA, 22 bp, Artificial Sequence
  chemically synthesized
atcattgttatttcttatattc

SEQ ID NO: 1151062 - DNA, 22 bp, Artificial Sequence
  chemically synthesized
tgatcattgttatttcttatat

SEQ ID NO: 1151063 - DNA, 22 bp, Artificial Sequence
  chemically synthesized
ctctgatcattgttatttctta

SEQ ID NO: 1151064 - DNA, 22 bp, Artificial Sequence
  chemically synthesized
tgctctgatcattgttatttct

SEQ ID NO: 1151065 - DNA, 22 bp, Artificial Sequence
  chemically synthesized
gcagaatataagaaataacaat

SEQ ID NO: 1151066 - DNA, 22 bp, Artificial Sequence
  chemically synthesized
gttctgctctgatcattgttat

SEQ ID NO: 1151067 - DNA, 22 bp, Artificial Sequence
  chemically synthesized
agttctgctctgatcattgtta

SEQ ID NO: 1151068 - DNA, 22 bp, Artificial Sequence
  chemically synthesized
atttagttctgctctgatcatt

SEQ ID NO: 1151069 - DNA, 22 bp, Artificial Sequence
  chemically synthesized
catttagttctgctctgatcat

SEQ ID NO: 1151070 - DNA, 22 bp, Artificial Sequence
  chemically synthesized
agtttcatttagttctgctctg

SEQ ID NO: 1151071 - DNA, 22 bp, Artificial Sequence
  chemically synthesized
tctcagtttcatttagttctgc

SEQ ID NO: 1151072 - DNA, 22 bp, Artificial Sequence
  chemically synthesized
ttatctcagtttcatttagttc

SEQ ID NO: 1151073 - DNA, 22 bp, Artificial Sequence
  chemically synthesized
attatctcagtttcatttagtt

SEQ ID NO: 1151074 - DNA, 22 bp, Artificial Sequence
  chemically synthesized
tattatctcagtttcatttagt

SEQ ID NO: 1151075 - DNA, 22 bp, Artificial Sequence
  chemically synthesized
ttattatctcagtttcatttag

SEQ ID NO: 1151076 - DNA, 22 bp, Artificial Sequence
  chemically synthesized
tcttttattatctcagtttcat

SEQ ID NO: 1151077 - DNA, 22 bp, Artificial Sequence
  chemically synthesized
gtcttttattatctcagtttca

SEQ ID NO: 1151078 - DNA, 22 bp, Artificial Sequence
  chemically synthesized
tgtcttttattatctcagtttc

SEQ ID NO: 1151079 - DNA, 22 bp, Artificial Sequence
  chemically synthesized
ttgtcttttattatctcagttt

SEQ ID NO: 1151080 - DNA, 22 bp, Artificial Sequence
  chemically synthesized
tttgtcttttattatctcagtt

SEQ ID NO: 1151081 - DNA, 22 bp, Artificial Sequence
  chemically synthesized
attttttgtcttttattatctc

SEQ ID NO: 1151082 - DNA, 22 bp, Artificial Sequence
  chemically synthesized
aattttttgtcttttattatct

SEQ ID NO: 1151083 - DNA, 22 bp, Artificial Sequence
  chemically synthesized
taattttttgtcttttattatc

SEQ ID NO: 1151084 - DNA, 22 bp, Artificial Sequence
  chemically synthesized
aatgaaactgagataataaaag

SEQ ID NO: 1151085 - DNA, 22 bp, Artificial Sequence
  chemically synthesized
ttaattttttgtcttttattat

SEQ ID NO: 1151086 - DNA, 22 bp, Artificial Sequence
  chemically synthesized
tttaattttttgtcttttatta

SEQ ID NO: 1151087 - DNA, 22 bp, Artificial Sequence
  chemically synthesized
ttttaattttttgtcttttatt

SEQ ID NO: 1151088 - DNA, 22 bp, Artificial Sequence
  chemically synthesized
atttttttaattttttgtcttt

SEQ ID NO: 1151089 - DNA, 22 bp, Artificial Sequence
  chemically synthesized
taatttttttaattttttgtct

SEQ ID NO: 1151090 - DNA, 22 bp, Artificial Sequence
  chemically synthesized
agataataaaagacaaaaaatt

SEQ ID NO: 1151091 - DNA, 22 bp, Artificial Sequence
  chemically synthesized
tctaatttttttaattttttgt

SEQ ID NO: 1151092 - DNA, 22 bp, Artificial Sequence
  chemically synthesized
aaagaaaactctctaatttttt

SEQ ID NO: 1151093 - DNA, 22 bp, Artificial Sequence
  chemically synthesized
caaagaaaactctctaattttt

SEQ ID NO: 1151094 - DNA, 22 bp, Artificial Sequence
  chemically synthesized
tcaaagaaaactctctaatttt

SEQ ID NO: 1151095 - DNA, 22 bp, Artificial Sequence
  chemically synthesized
ttcaaagaaaactctctaattt

SEQ ID NO: 1151096 - DNA, 22 bp, Artificial Sequence
  chemically synthesized
tcttttcaaagaaaactctcta

SEQ ID NO: 1151097 - DNA, 22 bp, Artificial Sequence
  chemically synthesized
atcttttcaaagaaaactctct

SEQ ID NO: 1151098 - DNA, 22 bp, Artificial Sequence
  chemically synthesized
tttatcttttcaaagaaaactc

SEQ ID NO: 1151099 - DNA, 22 bp, Artificial Sequence
  chemically synthesized
aaaaaattagagagttttcttt

SEQ ID NO: 1151100 - DNA, 22 bp, Artificial Sequence
  chemically synthesized
gtttatcttttcaaagaaaact

SEQ ID NO: 1151101 - DNA, 22 bp, Artificial Sequence
  chemically synthesized
tgtttatcttttcaaagaaaac

SEQ ID NO: 1151102 - DNA, 22 bp, Artificial Sequence
  chemically synthesized
attttgtttatcttttcaaaga

SEQ ID NO: 1151103 - DNA, 22 bp, Artificial Sequence
  chemically synthesized
ttaattttgtttatcttttcaa

SEQ ID NO: 1151104 - DNA, 22 bp, Artificial Sequence
  chemically synthesized
gagagttttctttgaaaagata

SEQ ID NO: 1151105 - DNA, 22 bp, Artificial Sequence
  chemically synthesized
gtggcctattaattttgtttat

SEQ ID NO: 1151106 - DNA, 22 bp, Artificial Sequence
  chemically synthesized
tctttgaaaagataaacaaaat

SEQ ID NO: 1151107 - DNA, 22 bp, Artificial Sequence
  chemically synthesized
ctttgaaaagataaacaaaatt

SEQ ID NO: 1151108 - DNA, 22 bp, Artificial Sequence
  chemically synthesized
tttgaaaagataaacaaaatta

SEQ ID NO: 1151109 - DNA, 22 bp, Artificial Sequence
  chemically synthesized
gctagtggcctattaattttgt

SEQ ID NO: 1151110 - DNA, 22 bp, Artificial Sequence
  chemically synthesized
tgaaaagataaacaaaattaat

SEQ ID NO: 1151111 - DNA, 22 bp, Artificial Sequence
  chemically synthesized
gaaaagataaacaaaattaata

SEQ ID NO: 1151112 - DNA, 22 bp, Artificial Sequence
  chemically synthesized
aaaagataaacaaaattaatag

SEQ ID NO: 1151113 - DNA, 22 bp, Artificial Sequence
  chemically synthesized
atctagctagtggcctattaat

SEQ ID NO: 1151114 - DNA, 22 bp, Artificial Sequence
  chemically synthesized
gttaatctagctagtggcctat

SEQ ID NO: 1151115 - DNA, 22 bp, Artificial Sequence
  chemically synthesized
ggttaatctagctagtggccta

SEQ ID NO: 1151116 - DNA, 22 bp, Artificial Sequence
  chemically synthesized
ttggttaatctagctagtggcc

SEQ ID NO: 1151117 - DNA, 22 bp, Artificial Sequence
  chemically synthesized
cttggttaatctagctagtggc

SEQ ID NO: 1151118 - DNA, 22 bp, Artificial Sequence
  chemically synthesized
tcttggttaatctagctagtgg

SEQ ID NO: 1151119 - DNA, 22 bp, Artificial Sequence
  chemically synthesized
ttcttggttaatctagctagtg

SEQ ID NO: 1151120 - DNA, 22 bp, Artificial Sequence
  chemically synthesized
tttcttggttaatctagctagt

SEQ ID NO: 1151121 - DNA, 22 bp, Artificial Sequence
  chemically synthesized
ttttcttggttaatctagctag

SEQ ID NO: 1151122 - DNA, 22 bp, Artificial Sequence
  chemically synthesized
tttttttcttggttaatctagc

SEQ ID NO: 1151123 - DNA, 22 bp, Artificial Sequence
  chemically synthesized
ataggccactagctagattaac

SEQ ID NO: 1151124 - DNA, 22 bp, Artificial Sequence
  chemically synthesized
tgtttttttcttggttaatcta

SEQ ID NO: 1151125 - DNA, 22 bp, Artificial Sequence
  chemically synthesized
ctgtttttttcttggttaatct

SEQ ID NO: 1151126 - DNA, 22 bp, Artificial Sequence
  chemically synthesized
ttctgtttttttcttggttaat

SEQ ID NO: 1151127 - DNA, 22 bp, Artificial Sequence
  chemically synthesized
attcttctgtttttttcttggt

SEQ ID NO: 1151128 - DNA, 22 bp, Artificial Sequence
  chemically synthesized
gattcttctgtttttttcttgg

SEQ ID NO: 1151129 - DNA, 22 bp, Artificial Sequence
  chemically synthesized
gctagattaaccaagaaaaaaa

SEQ ID NO: 1151130 - DNA, 22 bp, Artificial Sequence
  chemically synthesized
tttgattcttctgtttttttct

SEQ ID NO: 1151131 - DNA, 22 bp, Artificial Sequence
  chemically synthesized
atttgattcttctgtttttttc

SEQ ID NO: 1151132 - DNA, 22 bp, Artificial Sequence
  chemically synthesized
gattaaccaagaaaaaaacaga

SEQ ID NO: 1151133 - DNA, 22 bp, Artificial Sequence
  chemically synthesized
cttatttgattcttctgttttt

SEQ ID NO: 1151134 - DNA, 22 bp, Artificial Sequence
  chemically synthesized
gcttatttgattcttctgtttt

SEQ ID NO: 1151135 - DNA, 22 bp, Artificial Sequence
  chemically synthesized
tgcttatttgattcttctgttt

SEQ ID NO: 1151136 - DNA, 22 bp, Artificial Sequence
  chemically synthesized
accaagaaaaaaacagaagaat

SEQ ID NO: 1151137 - DNA, 22 bp, Artificial Sequence
  chemically synthesized
actttgcttatttgattcttct

SEQ ID NO: 1151138 - DNA, 22 bp, Artificial Sequence
  chemically synthesized
tgactttgcttatttgattctt

SEQ ID NO: 1151139 - DNA, 22 bp, Artificial Sequence
  chemically synthesized
tcatctctgactttgcttattt

SEQ ID NO: 1151140 - DNA, 22 bp, Artificial Sequence
  chemically synthesized
taacgtcacatctatcatctct

SEQ ID NO: 1151141 - DNA, 22 bp, Artificial Sequence
  chemically synthesized
tggtatcagttgtaacgtcaca

SEQ ID NO: 1151142 - DNA, 22 bp, Artificial Sequence
  chemically synthesized
tatggtatcagttgtaacgtca

SEQ ID NO: 1151143 - DNA, 22 bp, Artificial Sequence
  chemically synthesized
ctatggtatcagttgtaacgtc

SEQ ID NO: 1151144 - DNA, 22 bp, Artificial Sequence
  chemically synthesized
gtatttctatggtatcagttgt

SEQ ID NO: 1151145 - DNA, 22 bp, Artificial Sequence
  chemically synthesized
cgtatttctatggtatcagttg

SEQ ID NO: 1151146 - DNA, 22 bp, Artificial Sequence
  chemically synthesized
tcgtatttctatggtatcagtt

SEQ ID NO: 1151147 - DNA, 22 bp, Artificial Sequence
  chemically synthesized
ataatctttcgtatttctatgg

SEQ ID NO: 1151148 - DNA, 22 bp, Artificial Sequence
  chemically synthesized
caactgataccatagaaatacg

SEQ ID NO: 1151149 - DNA, 22 bp, Artificial Sequence
  chemically synthesized
ataccatagaaatacgaaagat

SEQ ID NO: 1151150 - DNA, 22 bp, Artificial Sequence
  chemically synthesized
gagatgcccatagtagtctgat

SEQ ID NO: 1151151 - DNA, 22 bp, Artificial Sequence
  chemically synthesized
tgtacctagagatgcccatagt

SEQ ID NO: 1151152 - DNA, 22 bp, Artificial Sequence
  chemically synthesized
gtgtacctagagatgcccatag

SEQ ID NO: 1151153 - DNA, 22 bp, Artificial Sequence
  chemically synthesized
tcagactactatgggcatctct

SEQ ID NO: 1151154 - DNA, 22 bp, Artificial Sequence
  chemically synthesized
atttgtgtacctagagatgccc

SEQ ID NO: 1151155 - DNA, 22 bp, Artificial Sequence
  chemically synthesized
taatttgtgtacctagagatgc

SEQ ID NO: 1151156 - DNA, 22 bp, Artificial Sequence
  chemically synthesized
ctaatttgtgtacctagagatg

SEQ ID NO: 1151157 - DNA, 22 bp, Artificial Sequence
  chemically synthesized
tctaatttgtgtacctagagat

SEQ ID NO: 1151158 - DNA, 22 bp, Artificial Sequence
  chemically synthesized
ctatgggcatctctaggtacac

SEQ ID NO: 1151159 - DNA, 22 bp, Artificial Sequence
  chemically synthesized
tgggcatctctaggtacacaaa

SEQ ID NO: 1151160 - DNA, 22 bp, Artificial Sequence
  chemically synthesized
cagattttctaatttgtgtacc

SEQ ID NO: 1151161 - DNA, 22 bp, Artificial Sequence
  chemically synthesized
ctccagattttctaatttgtgt

SEQ ID NO: 1151162 - DNA, 22 bp, Artificial Sequence
  chemically synthesized
cctccagattttctaatttgtg

SEQ ID NO: 1151163 - DNA, 22 bp, Artificial Sequence
  chemically synthesized
atttcctccagattttctaatt

SEQ ID NO: 1151164 - DNA, 22 bp, Artificial Sequence
  chemically synthesized
taggtacacaaattagaaaatc

SEQ ID NO: 1151165 - DNA, 22 bp, Artificial Sequence
  chemically synthesized
ttcatttcctccagattttcta

SEQ ID NO: 1151166 - DNA, 22 bp, Artificial Sequence
  chemically synthesized
ggtacacaaattagaaaatctg

SEQ ID NO: 1151167 - DNA, 22 bp, Artificial Sequence
  chemically synthesized
attcatttcctccagattttct

SEQ ID NO: 1151168 - DNA, 22 bp, Artificial Sequence
  chemically synthesized
gaaaatctggaggaaatgaata

SEQ ID NO: 1151169 - DNA, 22 bp, Artificial Sequence
  chemically synthesized
atatgtatccaggaatttattc

SEQ ID NO: 1151170 - DNA, 22 bp, Artificial Sequence
  chemically synthesized
gaggaaatgaataaattcctgg

SEQ ID NO: 1151171 - DNA, 22 bp, Artificial Sequence
  chemically synthesized
ggagttgatatgtatccaggaa

SEQ ID NO: 1151172 - DNA, 22 bp, Artificial Sequence
  chemically synthesized
gggagttgatatgtatccagga

SEQ ID NO: 1151173 - DNA, 22 bp, Artificial Sequence
  chemically synthesized
tgggagttgatatgtatccagg

SEQ ID NO: 1151174 - DNA, 22 bp, Artificial Sequence
  chemically synthesized
aattttgggagttgatatgtat

SEQ ID NO: 1151175 - DNA, 22 bp, Artificial Sequence
  chemically synthesized
tggttcaattttgggagttgat

SEQ ID NO: 1151176 - DNA, 22 bp, Artificial Sequence
  chemically synthesized
gtggttcaattttgggagttga

SEQ ID NO: 1151177 - DNA, 22 bp, Artificial Sequence
  chemically synthesized
ctggatacatatcaactcccaa

SEQ ID NO: 1151178 - DNA, 22 bp, Artificial Sequence
  chemically synthesized
ttgtggttcaattttgggagtt

SEQ ID NO: 1151179 - DNA, 22 bp, Artificial Sequence
  chemically synthesized
cttgtggttcaattttgggagt

SEQ ID NO: 1151180 - DNA, 22 bp, Artificial Sequence
  chemically synthesized
gatacatatcaactcccaaaat

SEQ ID NO: 1151181 - DNA, 22 bp, Artificial Sequence
  chemically synthesized
cttcttgtggttcaattttggg

SEQ ID NO: 1151182 - DNA, 22 bp, Artificial Sequence
  chemically synthesized
gcttcttgtggttcaattttgg

SEQ ID NO: 1151183 - DNA, 22 bp, Artificial Sequence
  chemically synthesized
tgcttcttgtggttcaattttg

SEQ ID NO: 1151184 - DNA, 22 bp, Artificial Sequence
  chemically synthesized
ttgcttcttgtggttcaatttt

SEQ ID NO: 1151185 - DNA, 22 bp, Artificial Sequence
  chemically synthesized
ccaaaattgaaccacaagaagc

SEQ ID NO: 1151186 - DNA, 22 bp, Artificial Sequence
  chemically synthesized
tccaagatttttgcttcttgtg

SEQ ID NO: 1151187 - DNA, 22 bp, Artificial Sequence
  chemically synthesized
gtctgtccaagatttttgcttc

SEQ ID NO: 1151188 - DNA, 22 bp, Artificial Sequence
  chemically synthesized
ttggtctgtccaagatttttgc

SEQ ID NO: 1151189 - DNA, 22 bp, Artificial Sequence
  chemically synthesized
aaccacaagaagcaaaaatctt

SEQ ID NO: 1151190 - DNA, 22 bp, Artificial Sequence
  chemically synthesized
ttattggtctgtccaagatttt

SEQ ID NO: 1151191 - DNA, 22 bp, Artificial Sequence
  chemically synthesized
gttattggtctgtccaagattt

SEQ ID NO: 1151192 - DNA, 22 bp, Artificial Sequence
  chemically synthesized
tttgttattggtctgtccaaga

SEQ ID NO: 1151193 - DNA, 22 bp, Artificial Sequence
  chemically synthesized
actatttgttattggtctgtcc

SEQ ID NO: 1151194 - DNA, 22 bp, Artificial Sequence
  chemically synthesized
cactatttgttattggtctgtc

SEQ ID NO: 1151195 - DNA, 22 bp, Artificial Sequence
  chemically synthesized
agtttcactatttgttattggt

SEQ ID NO: 1151196 - DNA, 22 bp, Artificial Sequence
  chemically synthesized
attcagtttcactatttgttat

SEQ ID NO: 1151197 - DNA, 22 bp, Artificial Sequence
  chemically synthesized
ggacagaccaataacaaatagt

SEQ ID NO: 1151198 - DNA, 22 bp, Artificial Sequence
  chemically synthesized
gacagaccaataacaaatagtg

SEQ ID NO: 1151199 - DNA, 22 bp, Artificial Sequence
  chemically synthesized
ctgattcagtttcactatttgt

SEQ ID NO: 1151200 - DNA, 22 bp, Artificial Sequence
  chemically synthesized
ttactgattcagtttcactatt

SEQ ID NO: 1151201 - DNA, 22 bp, Artificial Sequence
  chemically synthesized
attactgattcagtttcactat

SEQ ID NO: 1151202 - DNA, 22 bp, Artificial Sequence
  chemically synthesized
ggagatatttattactgattca

SEQ ID NO: 1151203 - DNA, 22 bp, Artificial Sequence
  chemically synthesized
ttgggagatatttattactgat

SEQ ID NO: 1151204 - DNA, 22 bp, Artificial Sequence
  chemically synthesized
attgggagatatttattactga

SEQ ID NO: 1151205 - DNA, 22 bp, Artificial Sequence
  chemically synthesized
tattgggagatatttattactg

SEQ ID NO: 1151206 - DNA, 22 bp, Artificial Sequence
  chemically synthesized
ttttattgggagatatttatta

SEQ ID NO: 1151207 - DNA, 22 bp, Artificial Sequence
  chemically synthesized
attttattgggagatatttatt

SEQ ID NO: 1151208 - DNA, 22 bp, Artificial Sequence
  chemically synthesized
tattttattgggagatatttat

SEQ ID NO: 1151209 - DNA, 22 bp, Artificial Sequence
  chemically synthesized
aatcagtaataaatatctccca

SEQ ID NO: 1151210 - DNA, 22 bp, Artificial Sequence
  chemically synthesized
agctttattttattgggagata

SEQ ID NO: 1151211 - DNA, 22 bp, Artificial Sequence
  chemically synthesized
gtcctgagctttattttattgg

SEQ ID NO: 1151212 - DNA, 22 bp, Artificial Sequence
  chemically synthesized
ccaataaaataaagctcaggac

SEQ ID NO: 1151213 - DNA, 22 bp, Artificial Sequence
  chemically synthesized
tgaatacgtctggtcctgagct

SEQ ID NO: 1151214 - DNA, 22 bp, Artificial Sequence
  chemically synthesized
ggctgtgaatacgtctggtcct

SEQ ID NO: 1151215 - DNA, 22 bp, Artificial Sequence
  chemically synthesized
gtagaattcggctgtgaatacg

SEQ ID NO: 1151216 - DNA, 22 bp, Artificial Sequence
  chemically synthesized
aggaccagacgtattcacagcc

SEQ ID NO: 1151217 - DNA, 22 bp, Artificial Sequence
  chemically synthesized
catgtctggtagaattcggctg

SEQ ID NO: 1151218 - DNA, 22 bp, Artificial Sequence
  chemically synthesized
gcatgtctggtagaattcggct

SEQ ID NO: 1151219 - DNA, 22 bp, Artificial Sequence
  chemically synthesized
tgcatgtctggtagaattcggc

SEQ ID NO: 1151220 - DNA, 22 bp, Artificial Sequence
  chemically synthesized
tttgcatgtctggtagaattcg

SEQ ID NO: 1151221 - DNA, 22 bp, Artificial Sequence
  chemically synthesized
acagccgaattctaccagacat

SEQ ID NO: 1151222 - DNA, 22 bp, Artificial Sequence
  chemically synthesized
gtaccagttctttgcatgtctg

SEQ ID NO: 1151223 - DNA, 22 bp, Artificial Sequence
  chemically synthesized
taccagacatgcaaagaactgg

SEQ ID NO: 1151224 - DNA, 22 bp, Artificial Sequence
  chemically synthesized
ccagacatgcaaagaactggta

SEQ ID NO: 1151225 - DNA, 22 bp, Artificial Sequence
  chemically synthesized
caataggattggtaccagttct

SEQ ID NO: 1151226 - DNA, 22 bp, Artificial Sequence
  chemically synthesized
caacagttacaataggattggt

SEQ ID NO: 1151227 - DNA, 22 bp, Artificial Sequence
  chemically synthesized
gcaacagttacaataggattgg

SEQ ID NO: 1151228 - DNA, 22 bp, Artificial Sequence
  chemically synthesized
tgcaacagttacaataggattg

SEQ ID NO: 1151229 - DNA, 22 bp, Artificial Sequence
  chemically synthesized
atattttgcaacagttacaata

SEQ ID NO: 1151230 - DNA, 22 bp, Artificial Sequence
  chemically synthesized
gatattttgcaacagttacaat

SEQ ID NO: 1151231 - DNA, 22 bp, Artificial Sequence
  chemically synthesized
gtaccaatcctattgtaactgt

SEQ ID NO: 1151232 - DNA, 22 bp, Artificial Sequence
  chemically synthesized
tttgatattttgcaacagttac

SEQ ID NO: 1151233 - DNA, 22 bp, Artificial Sequence
  chemically synthesized
gtttgatattttgcaacagtta

SEQ ID NO: 1151234 - DNA, 22 bp, Artificial Sequence
  chemically synthesized
ttgtttgatattttgcaacagt

SEQ ID NO: 1151235 - DNA, 22 bp, Artificial Sequence
  chemically synthesized
ctcttgtttgatattttgcaac

SEQ ID NO: 1151236 - DNA, 22 bp, Artificial Sequence
  chemically synthesized
cctcttgtttgatattttgcaa

SEQ ID NO: 1151237 - DNA, 22 bp, Artificial Sequence
  chemically synthesized
ttgtaactgttgcaaaatatca

SEQ ID NO: 1151238 - DNA, 22 bp, Artificial Sequence
  chemically synthesized
taactgttgcaaaatatcaaac

SEQ ID NO: 1151239 - DNA, 22 bp, Artificial Sequence
  chemically synthesized
gggagaatttcctcttgtttga

SEQ ID NO: 1151240 - DNA, 22 bp, Artificial Sequence
  chemically synthesized
ttgcaaaatatcaaacaagagg

SEQ ID NO: 1151241 - DNA, 22 bp, Artificial Sequence
  chemically synthesized
attagggagaatttcctcttgt

SEQ ID NO: 1151242 - DNA, 22 bp, Artificial Sequence
  chemically synthesized
caaaatatcaaacaagaggaaa

SEQ ID NO: 1151243 - DNA, 22 bp, Artificial Sequence
  chemically synthesized
gtagaattaattagggagaatt

SEQ ID NO: 1151244 - DNA, 22 bp, Artificial Sequence
  chemically synthesized
cgtagaattaattagggagaat

SEQ ID NO: 1151245 - DNA, 22 bp, Artificial Sequence
  chemically synthesized
gcttcgtagaattaattaggga

SEQ ID NO: 1151246 - DNA, 22 bp, Artificial Sequence
  chemically synthesized
tccctaattaattctacgaagc

SEQ ID NO: 1151247 - DNA, 22 bp, Artificial Sequence
  chemically synthesized
cctaattaattctacgaagcca

SEQ ID NO: 1151248 - DNA, 22 bp, Artificial Sequence
  chemically synthesized
gtatcatggtgatactggcttc

SEQ ID NO: 1151249 - DNA, 22 bp, Artificial Sequence
  chemically synthesized
attaattctacgaagccagtat

SEQ ID NO: 1151250 - DNA, 22 bp, Artificial Sequence
  chemically synthesized
ggtatcatggtgatactggctt

SEQ ID NO: 1151251 - DNA, 22 bp, Artificial Sequence
  chemically synthesized
tggtatcatggtgatactggct

SEQ ID NO: 1151252 - DNA, 22 bp, Artificial Sequence
  chemically synthesized
attctacgaagccagtatcacc

SEQ ID NO: 1151253 - DNA, 22 bp, Artificial Sequence
  chemically synthesized
cctttggtatcatggtgatact

SEQ ID NO: 1151254 - DNA, 22 bp, Artificial Sequence
  chemically synthesized
tacgaagccagtatcaccatga

SEQ ID NO: 1151255 - DNA, 22 bp, Artificial Sequence
  chemically synthesized
cctgcctttggtatcatggtga

SEQ ID NO: 1151256 - DNA, 22 bp, Artificial Sequence
  chemically synthesized
cgaagccagtatcaccatgata

SEQ ID NO: 1151257 - DNA, 22 bp, Artificial Sequence
  chemically synthesized
acctgcctttggtatcatggtg

SEQ ID NO: 1151258 - DNA, 22 bp, Artificial Sequence
  chemically synthesized
tgtccttacctgcctttggtat

SEQ ID NO: 1151259 - DNA, 22 bp, Artificial Sequence
  chemically synthesized
ttgtgtccttacctgcctttgg

SEQ ID NO: 1151260 - DNA, 22 bp, Artificial Sequence
  chemically synthesized
gttgtgtccttacctgcctttg

SEQ ID NO: 1151261 - DNA, 22 bp, Artificial Sequence
  chemically synthesized
tgttgtgtccttacctgccttt

SEQ ID NO: 1151262 - DNA, 22 bp, Artificial Sequence
  chemically synthesized
ttgttgtgtccttacctgcctt

SEQ ID NO: 1151263 - DNA, 22 bp, Artificial Sequence
  chemically synthesized
tttgttgtgtccttacctgcct

SEQ ID NO: 1151264 - DNA, 22 bp, Artificial Sequence
  chemically synthesized
ctttttgttgtgtccttacctg

SEQ ID NO: 1151265 - DNA, 22 bp, Artificial Sequence
  chemically synthesized
cctttttgttgtgtccttacct

SEQ ID NO: 1151266 - DNA, 22 bp, Artificial Sequence
  chemically synthesized
tggtttcctttttgttgtgtcc

SEQ ID NO: 1151267 - DNA, 22 bp, Artificial Sequence
  chemically synthesized
gcctgtggtttcctttttgttg

SEQ ID NO: 1151268 - DNA, 22 bp, Artificial Sequence
  chemically synthesized
atcagggatattggcctgtggt

SEQ ID NO: 1151269 - DNA, 22 bp, Artificial Sequence
  chemically synthesized
tgttcatcagggatattggcct

SEQ ID NO: 1151270 - DNA, 22 bp, Artificial Sequence
  chemically synthesized
catctatgttcatcagggatat

SEQ ID NO: 1151271 - DNA, 22 bp, Artificial Sequence
  chemically synthesized
gcatctatgttcatcagggata

SEQ ID NO: 1151272 - DNA, 22 bp, Artificial Sequence
  chemically synthesized
tgcatctatgttcatcagggat

SEQ ID NO: 1151273 - DNA, 22 bp, Artificial Sequence
  chemically synthesized
ttgcatctatgttcatcaggga

SEQ ID NO: 1151274 - DNA, 22 bp, Artificial Sequence
  chemically synthesized
aggatttttgcatctatgttca

SEQ ID NO: 1151275 - DNA, 22 bp, Artificial Sequence
  chemically synthesized
ttgaggatttttgcatctatgt

SEQ ID NO: 1151276 - DNA, 22 bp, Artificial Sequence
  chemically synthesized
tgttgaggatttttgcatctat

SEQ ID NO: 1151277 - DNA, 22 bp, Artificial Sequence
  chemically synthesized
atgaacatagatgcaaaaatcc

SEQ ID NO: 1151278 - DNA, 22 bp, Artificial Sequence
  chemically synthesized
gcattctgttgaggatttttgc

SEQ ID NO: 1151279 - DNA, 22 bp, Artificial Sequence
  chemically synthesized
ctagcattctgttgaggatttt

SEQ ID NO: 1151280 - DNA, 22 bp, Artificial Sequence
  chemically synthesized
gctagcattctgttgaggattt

SEQ ID NO: 1151281 - DNA, 22 bp, Artificial Sequence
  chemically synthesized
gtttgctagcattctgttgagg

SEQ ID NO: 1151282 - DNA, 22 bp, Artificial Sequence
  chemically synthesized
ggtttgctagcattctgttgag

SEQ ID NO: 1151283 - DNA, 22 bp, Artificial Sequence
  chemically synthesized
ggtttggtttgctagcattctg

SEQ ID NO: 1151284 - DNA, 22 bp, Artificial Sequence
  chemically synthesized
gggtttggtttgctagcattct

SEQ ID NO: 1151285 - DNA, 22 bp, Artificial Sequence
  chemically synthesized
tgggtttggtttgctagcattc

SEQ ID NO: 1151286 - DNA, 22 bp, Artificial Sequence
  chemically synthesized
ttgggtttggtttgctagcatt

SEQ ID NO: 1151287 - DNA, 22 bp, Artificial Sequence
  chemically synthesized
tgcttttgggtttggtttgcta

SEQ ID NO: 1151288 - DNA, 22 bp, Artificial Sequence
  chemically synthesized
aacagaatgctagcaaaccaaa

SEQ ID NO: 1151289 - DNA, 22 bp, Artificial Sequence
  chemically synthesized
ttatgcttttgggtttggtttg

SEQ ID NO: 1151290 - DNA, 22 bp, Artificial Sequence
  chemically synthesized
gttatgcttttgggtttggttt

SEQ ID NO: 1151291 - DNA, 22 bp, Artificial Sequence
  chemically synthesized
tgttatgcttttgggtttggtt

SEQ ID NO: 1151292 - DNA, 22 bp, Artificial Sequence
  chemically synthesized
ttgttatgcttttgggtttggt

SEQ ID NO: 1151293 - DNA, 22 bp, Artificial Sequence
  chemically synthesized
tttgttatgcttttgggtttgg

SEQ ID NO: 1151294 - DNA, 22 bp, Artificial Sequence
  chemically synthesized
tctttttgttatgcttttgggt

SEQ ID NO: 1151295 - DNA, 22 bp, Artificial Sequence
  chemically synthesized
gcaaaccaaacccaaaagcata

SEQ ID NO: 1151296 - DNA, 22 bp, Artificial Sequence
  chemically synthesized
tcatgtattatctttttgttat

SEQ ID NO: 1151297 - DNA, 22 bp, Artificial Sequence
  chemically synthesized
ttgtcatgtattatctttttgt

SEQ ID NO: 1151298 - DNA, 22 bp, Artificial Sequence
  chemically synthesized
acgttattgtcatgtattatct

SEQ ID NO: 1151299 - DNA, 22 bp, Artificial Sequence
  chemically synthesized
gcataaagctcacgttattgtc

SEQ ID NO: 1151300 - DNA, 22 bp, Artificial Sequence
  chemically synthesized
cctggcataaagctcacgttat

SEQ ID NO: 1151301 - DNA, 22 bp, Artificial Sequence
  chemically synthesized
cctacctggcataaagctcacg

SEQ ID NO: 1151302 - DNA, 22 bp, Artificial Sequence
  chemically synthesized
catatatccctgcctacctggc

SEQ ID NO: 1151303 - DNA, 22 bp, Artificial Sequence
  chemically synthesized
tgcatatatccctgcctacctg

SEQ ID NO: 1151304 - DNA, 22 bp, Artificial Sequence
  chemically synthesized
ctctgcatatatccctgcctac

SEQ ID NO: 1151305 - DNA, 22 bp, Artificial Sequence
  chemically synthesized
tatgccaggtaggcagggatat

SEQ ID NO: 1151306 - DNA, 22 bp, Artificial Sequence
  chemically synthesized
atgccaggtaggcagggatata

SEQ ID NO: 1151307 - DNA, 22 bp, Artificial Sequence
  chemically synthesized
tgccaggtaggcagggatatat

SEQ ID NO: 1151308 - DNA, 22 bp, Artificial Sequence
  chemically synthesized
tgtggtgaatcacagatattgc

SEQ ID NO: 1151309 - DNA, 22 bp, Artificial Sequence
  chemically synthesized
tgttatgtggtgaatcacagat

SEQ ID NO: 1151310 - DNA, 22 bp, Artificial Sequence
  chemically synthesized
tgattcaccacataacacaata

SEQ ID NO: 1151311 - DNA, 22 bp, Artificial Sequence
  chemically synthesized
caccacacaaaacatatattgt

SEQ ID NO: 1151312 - DNA, 22 bp, Artificial Sequence
  chemically synthesized
accacataacacaatatatgtt

SEQ ID NO: 1151313 - DNA, 22 bp, Artificial Sequence
  chemically synthesized
catatattgcaccacacaaaac

SEQ ID NO: 1151314 - DNA, 22 bp, Artificial Sequence
  chemically synthesized
tgcatatattgcaccacacaaa

SEQ ID NO: 1151315 - DNA, 22 bp, Artificial Sequence
  chemically synthesized
ctctgcatatattgcaccacac

SEQ ID NO: 1151316 - DNA, 22 bp, Artificial Sequence
  chemically synthesized
tgtgtggtgcaatatatgcaga

SEQ ID NO: 1151317 - DNA, 22 bp, Artificial Sequence
  chemically synthesized
gtgtggtgcaatatatgcagag

SEQ ID NO: 1151318 - DNA, 22 bp, Artificial Sequence
  chemically synthesized
tgtggtgcaatatatgcagagc

SEQ ID NO: 1151319 - DNA, 22 bp, Artificial Sequence
  chemically synthesized
tgtggtgaatcacatatattgc

SEQ ID NO: 1151320 - DNA, 22 bp, Artificial Sequence
  chemically synthesized
atgtggtgaatcacatatattg

SEQ ID NO: 1151321 - DNA, 22 bp, Artificial Sequence
  chemically synthesized
tatgtggtgaatcacatatatt

SEQ ID NO: 1151322 - DNA, 22 bp, Artificial Sequence
  chemically synthesized
ttatgtggtgaatcacatatat

SEQ ID NO: 1151323 - DNA, 22 bp, Artificial Sequence
  chemically synthesized
tttatgtggtgaatcacatata

SEQ ID NO: 1151324 - DNA, 22 bp, Artificial Sequence
  chemically synthesized
tttttatgtggtgaatcacata

SEQ ID NO: 1151325 - DNA, 22 bp, Artificial Sequence
  chemically synthesized
attctttttatgtggtgaatca

SEQ ID NO: 1151326 - DNA, 22 bp, Artificial Sequence
  chemically synthesized
aattctttttatgtggtgaatc

SEQ ID NO: 1151327 - DNA, 22 bp, Artificial Sequence
  chemically synthesized
taattctttttatgtggtgaat

SEQ ID NO: 1151328 - DNA, 22 bp, Artificial Sequence
  chemically synthesized
ttaattctttttatgtggtgaa

SEQ ID NO: 1151329 - DNA, 22 bp, Artificial Sequence
  chemically synthesized
tttttaattctttttatgtggt

SEQ ID NO: 1151330 - DNA, 22 bp, Artificial Sequence
  chemically synthesized
gtttttaattctttttatgtgg

SEQ ID NO: 1151331 - DNA, 22 bp, Artificial Sequence
  chemically synthesized
tgtttttaattctttttatgtg

SEQ ID NO: 1151332 - DNA, 22 bp, Artificial Sequence
  chemically synthesized
ttgtttttaattctttttatgt

SEQ ID NO: 1151333 - DNA, 22 bp, Artificial Sequence
  chemically synthesized
tttgtttttaattctttttatg

SEQ ID NO: 1151334 - DNA, 22 bp, Artificial Sequence
  chemically synthesized
accacataaaaagaattaaaaa

SEQ ID NO: 1151335 - DNA, 22 bp, Artificial Sequence
  chemically synthesized
agatgatcatatgttttttgtt

SEQ ID NO: 1151336 - DNA, 22 bp, Artificial Sequence
  chemically synthesized
ttgagatgatcatatgtttttt

SEQ ID NO: 1151337 - DNA, 22 bp, Artificial Sequence
  chemically synthesized
catctattgagatgatcatatg

SEQ ID NO: 1151338 - DNA, 22 bp, Artificial Sequence
  chemically synthesized
aaaacaaaaaacatatgatcat

SEQ ID NO: 1151339 - DNA, 22 bp, Artificial Sequence
  chemically synthesized
tgcatctattgagatgatcata

SEQ ID NO: 1151340 - DNA, 22 bp, Artificial Sequence
  chemically synthesized
ctgcatctattgagatgatcat

SEQ ID NO: 1151341 - DNA, 22 bp, Artificial Sequence
  chemically synthesized
tctgcatctattgagatgatca

SEQ ID NO: 1151342 - DNA, 22 bp, Artificial Sequence
  chemically synthesized
ttctgcatctattgagatgatc

SEQ ID NO: 1151343 - DNA, 22 bp, Artificial Sequence
  chemically synthesized
tcaaatgccttttctgcatcta

SEQ ID NO: 1151344 - DNA, 22 bp, Artificial Sequence
  chemically synthesized
atcaaatgccttttctgcatct

SEQ ID NO: 1151345 - DNA, 22 bp, Artificial Sequence
  chemically synthesized
tatcaaatgccttttctgcatc

SEQ ID NO: 1151346 - DNA, 22 bp, Artificial Sequence
  chemically synthesized
gattttatcaaatgccttttct

SEQ ID NO: 1151347 - DNA, 22 bp, Artificial Sequence
  chemically synthesized
aatagatgcagaaaaggcattt

SEQ ID NO: 1151348 - DNA, 22 bp, Artificial Sequence
  chemically synthesized
gggagaggctggattttatcaa

SEQ ID NO: 1151349 - DNA, 22 bp, Artificial Sequence
  chemically synthesized
ggggagaggctggattttatca

SEQ ID NO: 1151350 - DNA, 22 bp, Artificial Sequence
  chemically synthesized
tcttggggagaggctggatttt

SEQ ID NO: 1151351 - DNA, 22 bp, Artificial Sequence
  chemically synthesized
atcttggggagaggctggattt

SEQ ID NO: 1151352 - DNA, 22 bp, Artificial Sequence
  chemically synthesized
tatcttggggagaggctggatt

SEQ ID NO: 1151353 - DNA, 22 bp, Artificial Sequence
  chemically synthesized
gataaaatccagcctctcccca

SEQ ID NO: 1151354 - DNA, 22 bp, Artificial Sequence
  chemically synthesized
ataaaatccagcctctccccaa

SEQ ID NO: 1151355 - DNA, 22 bp, Artificial Sequence
  chemically synthesized
agggtctttatcttggggagag

SEQ ID NO: 1151356 - DNA, 22 bp, Artificial Sequence
  chemically synthesized
ttgagggtctttatcttgggga

SEQ ID NO: 1151357 - DNA, 22 bp, Artificial Sequence
  chemically synthesized
gttgttgagggtctttatcttg

SEQ ID NO: 1151358 - DNA, 22 bp, Artificial Sequence
  chemically synthesized
tccccaagataaagaccctcaa

SEQ ID NO: 1151359 - DNA, 22 bp, Artificial Sequence
  chemically synthesized
aatgcctagttgttgagggtct

SEQ ID NO: 1151360 - DNA, 22 bp, Artificial Sequence
  chemically synthesized
caatgcctagttgttgagggtc

SEQ ID NO: 1151361 - DNA, 22 bp, Artificial Sequence
  chemically synthesized
cccaagataaagaccctcaaca

SEQ ID NO: 1151362 - DNA, 22 bp, Artificial Sequence
  chemically synthesized
tcaatgcctagttgttgagggt

SEQ ID NO: 1151363 - DNA, 22 bp, Artificial Sequence
  chemically synthesized
tttcaatgcctagttgttgagg

SEQ ID NO: 1151364 - DNA, 22 bp, Artificial Sequence
  chemically synthesized
agatatgttctttcaatgccta

SEQ ID NO: 1151365 - DNA, 22 bp, Artificial Sequence
  chemically synthesized
gagatatgttctttcaatgcct

SEQ ID NO: 1151366 - DNA, 22 bp, Artificial Sequence
  chemically synthesized
tgagatatgttctttcaatgcc

SEQ ID NO: 1151367 - DNA, 22 bp, Artificial Sequence
  chemically synthesized
ttttgagatatgttctttcaat

SEQ ID NO: 1151368 - DNA, 22 bp, Artificial Sequence
  chemically synthesized
aacaactaggcattgaaagaac

SEQ ID NO: 1151369 - DNA, 22 bp, Artificial Sequence
  chemically synthesized
ttattttgagatatgttctttc

SEQ ID NO: 1151370 - DNA, 22 bp, Artificial Sequence
  chemically synthesized
gttattttgagatatgttcttt

SEQ ID NO: 1151371 - DNA, 22 bp, Artificial Sequence
  chemically synthesized
tgttattttgagatatgttctt

SEQ ID NO: 1151372 - DNA, 22 bp, Artificial Sequence
  chemically synthesized
ttgttattttgagatatgttct

SEQ ID NO: 1151373 - DNA, 22 bp, Artificial Sequence
  chemically synthesized
ggcattgaaagaacatatctca

SEQ ID NO: 1151374 - DNA, 22 bp, Artificial Sequence
  chemically synthesized
aaagaacatatctcaaaataac

SEQ ID NO: 1151375 - DNA, 22 bp, Artificial Sequence
  chemically synthesized
tcatatatgacttttgttattt

SEQ ID NO: 1151376 - DNA, 22 bp, Artificial Sequence
  chemically synthesized
gtcatatatgacttttgttatt

SEQ ID NO: 1151377 - DNA, 22 bp, Artificial Sequence
  chemically synthesized
gtttgtcatatatgacttttgt

SEQ ID NO: 1151378 - DNA, 22 bp, Artificial Sequence
  chemically synthesized
ggtttgtcatatatgacttttg

SEQ ID NO: 1151379 - DNA, 22 bp, Artificial Sequence
  chemically synthesized
ttggtttgtcatatatgacttt

SEQ ID NO: 1151380 - DNA, 22 bp, Artificial Sequence
  chemically synthesized
aaaataacaaaagtcatatatg

SEQ ID NO: 1151381 - DNA, 22 bp, Artificial Sequence
  chemically synthesized
gctcttggtttgtcatatatga

SEQ ID NO: 1151382 - DNA, 22 bp, Artificial Sequence
  chemically synthesized
gtatgatgttggctcttggttt

SEQ ID NO: 1151383 - DNA, 22 bp, Artificial Sequence
  chemically synthesized
agtatgatgttggctcttggtt

SEQ ID NO: 1151384 - DNA, 22 bp, Artificial Sequence
  chemically synthesized
tttagtatgatgttggctcttg

SEQ ID NO: 1151385 - DNA, 22 bp, Artificial Sequence
  chemically synthesized
ctgtttagtatgatgttggctc

SEQ ID NO: 1151386 - DNA, 22 bp, Artificial Sequence
  chemically synthesized
aacatgttcctgtttagtatga

SEQ ID NO: 1151387 - DNA, 22 bp, Artificial Sequence
  chemically synthesized
tcaacatgttcctgtttagtat

SEQ ID NO: 1151388 - DNA, 22 bp, Artificial Sequence
  chemically synthesized
ggggaggggggtgctctcaaca

SEQ ID NO: 1151389 - DNA, 22 bp, Artificial Sequence
  chemically synthesized
gggggaggggggtgctctcaac

SEQ ID NO: 1151390 - DNA, 22 bp, Artificial Sequence
  chemically synthesized
aacaggaacatgttgagagcac

SEQ ID NO: 1151391 - DNA, 22 bp, Artificial Sequence
  chemically synthesized
ttgggggaggggggtgctctca

SEQ ID NO: 1151392 - DNA, 22 bp, Artificial Sequence
  chemically synthesized
tagttcttgggggaggggggtg

SEQ ID NO: 1151393 - DNA, 22 bp, Artificial Sequence
  chemically synthesized
ttgtagttcttgggggaggggg

SEQ ID NO: 1151394 - DNA, 22 bp, Artificial Sequence
  chemically synthesized
gttgtagttcttgggggagggg

SEQ ID NO: 1151395 - DNA, 22 bp, Artificial Sequence
  chemically synthesized
agagcacccccctcccccaaga

SEQ ID NO: 1151396 - DNA, 22 bp, Artificial Sequence
  chemically synthesized
tcttgttgtagttcttggggga

SEQ ID NO: 1151397 - DNA, 22 bp, Artificial Sequence
  chemically synthesized
gtcttgttgtagttcttggggg

SEQ ID NO: 1151398 - DNA, 22 bp, Artificial Sequence
  chemically synthesized
ccccaagaactacaacaagaca

SEQ ID NO: 1151399 - DNA, 22 bp, Artificial Sequence
  chemically synthesized
gagcagtgaaaatgggtatcct

SEQ ID NO: 1151400 - DNA, 22 bp, Artificial Sequence
  chemically synthesized
caacaagacaaggatacccatt

SEQ ID NO: 1151401 - DNA, 22 bp, Artificial Sequence
  chemically synthesized
aattggagcagtgaaaatgggt

SEQ ID NO: 1151402 - DNA, 22 bp, Artificial Sequence
  chemically synthesized
tgttgaattggagcagtgaaaa

SEQ ID NO: 1151403 - DNA, 22 bp, Artificial Sequence
  chemically synthesized
cagtactatgttgaattggagc

SEQ ID NO: 1151404 - DNA, 22 bp, Artificial Sequence
  chemically synthesized
ccagtactatgttgaattggag

SEQ ID NO: 1151405 - DNA, 22 bp, Artificial Sequence
  chemically synthesized
tcactgctccaattcaacatag

SEQ ID NO: 1151406 - DNA, 22 bp, Artificial Sequence
  chemically synthesized
ggacttccagtactatgttgaa

SEQ ID NO: 1151407 - DNA, 22 bp, Artificial Sequence
  chemically synthesized
cactgctccaattcaacatagt

SEQ ID NO: 1151408 - DNA, 22 bp, Artificial Sequence
  chemically synthesized
actgctccaattcaacatagta

SEQ ID NO: 1151409 - DNA, 22 bp, Artificial Sequence
  chemically synthesized
gctaggacttccagtactatgt

SEQ ID NO: 1151410 - DNA, 22 bp, Artificial Sequence
  chemically synthesized
ctccaattcaacatagtactgg

SEQ ID NO: 1151411 - DNA, 22 bp, Artificial Sequence
  chemically synthesized
tagctaggacttccagtactat

SEQ ID NO: 1151412 - DNA, 22 bp, Artificial Sequence
  chemically synthesized
caattcaacatagtactggaag

SEQ ID NO: 1151413 - DNA, 22 bp, Artificial Sequence
  chemically synthesized
ctctagctaggacttccagtac

SEQ ID NO: 1151414 - DNA, 22 bp, Artificial Sequence
  chemically synthesized
attgctctagctaggacttcca

SEQ ID NO: 1151415 - DNA, 22 bp, Artificial Sequence
  chemically synthesized
aacatagtactggaagtcctag

SEQ ID NO: 1151416 - DNA, 22 bp, Artificial Sequence
  chemically synthesized
cctgattgctctagctaggact

SEQ ID NO: 1151417 - DNA, 22 bp, Artificial Sequence
  chemically synthesized
gcctgattgctctagctaggac

SEQ ID NO: 1151418 - DNA, 22 bp, Artificial Sequence
  chemically synthesized
ttgcctgattgctctagctagg

SEQ ID NO: 1151419 - DNA, 22 bp, Artificial Sequence
  chemically synthesized
tcttgcctgattgctctagcta

SEQ ID NO: 1151420 - DNA, 22 bp, Artificial Sequence
  chemically synthesized
ctcttgcctgattgctctagct

SEQ ID NO: 1151421 - DNA, 22 bp, Artificial Sequence
  chemically synthesized
tctcttgcctgattgctctagc

SEQ ID NO: 1151422 - DNA, 22 bp, Artificial Sequence
  chemically synthesized
tttctcttgcctgattgctcta

SEQ ID NO: 1151423 - DNA, 22 bp, Artificial Sequence
  chemically synthesized
gaagtcctagctagagcaatca

SEQ ID NO: 1151424 - DNA, 22 bp, Artificial Sequence
  chemically synthesized
ctttctcttgcctgattgctct

SEQ ID NO: 1151425 - DNA, 22 bp, Artificial Sequence
  chemically synthesized
tttctttctcttgcctgattgc

SEQ ID NO: 1151426 - DNA, 22 bp, Artificial Sequence
  chemically synthesized
atttctttctcttgcctgattg

SEQ ID NO: 1151427 - DNA, 22 bp, Artificial Sequence
  chemically synthesized
tatttctttctcttgcctgatt

SEQ ID NO: 1151428 - DNA, 22 bp, Artificial Sequence
  chemically synthesized
ttatttctttctcttgcctgat

SEQ ID NO: 1151429 - DNA, 22 bp, Artificial Sequence
  chemically synthesized
gctagagcaatcaggcaagaga

SEQ ID NO: 1151430 - DNA, 22 bp, Artificial Sequence
  chemically synthesized
gagcaatcaggcaagagaaaga

SEQ ID NO: 1151431 - DNA, 22 bp, Artificial Sequence
  chemically synthesized
gatgccttttatttctttctct

SEQ ID NO: 1151432 - DNA, 22 bp, Artificial Sequence
  chemically synthesized
ggatgccttttatttctttctc

SEQ ID NO: 1151433 - DNA, 22 bp, Artificial Sequence
  chemically synthesized
ccaatttggatgccttttattt

SEQ ID NO: 1151434 - DNA, 22 bp, Artificial Sequence
  chemically synthesized
cccaatttggatgccttttatt

SEQ ID NO: 1151435 - DNA, 22 bp, Artificial Sequence
  chemically synthesized
tcccaatttggatgccttttat

SEQ ID NO: 1151436 - DNA, 22 bp, Artificial Sequence
  chemically synthesized
ttcccaatttggatgcctttta

SEQ ID NO: 1151437 - DNA, 22 bp, Artificial Sequence
  chemically synthesized
tttcccaatttggatgcctttt

SEQ ID NO: 1151438 - DNA, 22 bp, Artificial Sequence
  chemically synthesized
tttttcccaatttggatgcctt

SEQ ID NO: 1151439 - DNA, 22 bp, Artificial Sequence
  chemically synthesized
ctttttcccaatttggatgcct

SEQ ID NO: 1151440 - DNA, 22 bp, Artificial Sequence
  chemically synthesized
tctttttcccaatttggatgcc

SEQ ID NO: 1151441 - DNA, 22 bp, Artificial Sequence
  chemically synthesized
actttctttttcccaatttgga

SEQ ID NO: 1151442 - DNA, 22 bp, Artificial Sequence
  chemically synthesized
gactttctttttcccaatttgg

SEQ ID NO: 1151443 - DNA, 22 bp, Artificial Sequence
  chemically synthesized
ggaaaaagaaagtcaaatgatt

SEQ ID NO: 1151444 - DNA, 22 bp, Artificial Sequence
  chemically synthesized
tcatcagtgaagagaaatcatt

SEQ ID NO: 1151445 - DNA, 22 bp, Artificial Sequence
  chemically synthesized
gatgtaaaatcctatcatcagt

SEQ ID NO: 1151446 - DNA, 22 bp, Artificial Sequence
  chemically synthesized
tagatgtaaaatcctatcatca

SEQ ID NO: 1151447 - DNA, 22 bp, Artificial Sequence
  chemically synthesized
ctagatgtaaaatcctatcatc

SEQ ID NO: 1151448 - DNA, 22 bp, Artificial Sequence
  chemically synthesized
tctagatgtaaaatcctatcat

SEQ ID NO: 1151449 - DNA, 22 bp, Artificial Sequence
  chemically synthesized
ctcttcactgatgataggattt

SEQ ID NO: 1151450 - DNA, 22 bp, Artificial Sequence
  chemically synthesized
tcttcactgatgataggatttt

SEQ ID NO: 1151451 - DNA, 22 bp, Artificial Sequence
  chemically synthesized
ttcactgatgataggattttac

SEQ ID NO: 1151452 - DNA, 22 bp, Artificial Sequence
  chemically synthesized
cactgatgataggattttacat

SEQ ID NO: 1151453 - DNA, 22 bp, Artificial Sequence
  chemically synthesized
agggttttctagatgtaaaatc

SEQ ID NO: 1151454 - DNA, 22 bp, Artificial Sequence
  chemically synthesized
actgatgataggattttacatc

SEQ ID NO: 1151455 - DNA, 22 bp, Artificial Sequence
  chemically synthesized
aagggttttctagatgtaaaat

SEQ ID NO: 1151456 - DNA, 22 bp, Artificial Sequence
  chemically synthesized
atgataggattttacatctaga

SEQ ID NO: 1151457 - DNA, 22 bp, Artificial Sequence
  chemically synthesized
gaggagtcttaagggttttcta

SEQ ID NO: 1151458 - DNA, 22 bp, Artificial Sequence
  chemically synthesized
ggaggagtcttaagggttttct

SEQ ID NO: 1151459 - DNA, 22 bp, Artificial Sequence
  chemically synthesized
tggaggagtcttaagggttttc

SEQ ID NO: 1151460 - DNA, 22 bp, Artificial Sequence
  chemically synthesized
ttggaggagtcttaagggtttt

SEQ ID NO: 1151461 - DNA, 22 bp, Artificial Sequence
  chemically synthesized
tacatctagaaaacccttaaga

SEQ ID NO: 1151462 - DNA, 22 bp, Artificial Sequence
  chemically synthesized
acatctagaaaacccttaagac

SEQ ID NO: 1151463 - DNA, 22 bp, Artificial Sequence
  chemically synthesized
catctagaaaacccttaagact

SEQ ID NO: 1151464 - DNA, 22 bp, Artificial Sequence
  chemically synthesized
gaaaacccttaagactcctcca

SEQ ID NO: 1151465 - DNA, 22 bp, Artificial Sequence
  chemically synthesized
tcaaatatagggtccttttgga

SEQ ID NO: 1151466 - DNA, 22 bp, Artificial Sequence
  chemically synthesized
atcaaatatagggtccttttgg

SEQ ID NO: 1151467 - DNA, 22 bp, Artificial Sequence
  chemically synthesized
aagactcctccaaaaggaccct

SEQ ID NO: 1151468 - DNA, 22 bp, Artificial Sequence
  chemically synthesized
agactcctccaaaaggacccta

SEQ ID NO: 1151469 - DNA, 22 bp, Artificial Sequence
  chemically synthesized
aagtcatttatcaaatataggg

SEQ ID NO: 1151470 - DNA, 22 bp, Artificial Sequence
  chemically synthesized
ctccaaaaggaccctatatttg

SEQ ID NO: 1151471 - DNA, 22 bp, Artificial Sequence
  chemically synthesized
ctgaagtcatttatcaaatata

SEQ ID NO: 1151472 - DNA, 22 bp, Artificial Sequence
  chemically synthesized
caaaaggaccctatatttgata

SEQ ID NO: 1151473 - DNA, 22 bp, Artificial Sequence
  chemically synthesized
actgaagtcatttatcaaatat

SEQ ID NO: 1151474 - DNA, 22 bp, Artificial Sequence
  chemically synthesized
tactgaagtcatttatcaaata

SEQ ID NO: 1151475 - DNA, 22 bp, Artificial Sequence
  chemically synthesized
aaactttactgaagtcatttat

SEQ ID NO: 1151476 - DNA, 22 bp, Artificial Sequence
  chemically synthesized
tatttgataaatgacttcagta

SEQ ID NO: 1151477 - DNA, 22 bp, Artificial Sequence
  chemically synthesized
atatcctgaaactttactgaag

SEQ ID NO: 1151478 - DNA, 22 bp, Artificial Sequence
  chemically synthesized
catatcctgaaactttactgaa

SEQ ID NO: 1151479 - DNA, 22 bp, Artificial Sequence
  chemically synthesized
gataaatgacttcagtaaagtt

SEQ ID NO: 1151480 - DNA, 22 bp, Artificial Sequence
  chemically synthesized
ataaatgacttcagtaaagttt

SEQ ID NO: 1151481 - DNA, 22 bp, Artificial Sequence
  chemically synthesized
atttcatatcctgaaactttac

SEQ ID NO: 1151482 - DNA, 22 bp, Artificial Sequence
  chemically synthesized
tacattgatttcatatcctgaa

SEQ ID NO: 1151483 - DNA, 22 bp, Artificial Sequence
  chemically synthesized
gtacattgatttcatatcctga

SEQ ID NO: 1151484 - DNA, 22 bp, Artificial Sequence
  chemically synthesized
tgtacattgatttcatatcctg

SEQ ID NO: 1151485 - DNA, 22 bp, Artificial Sequence
  chemically synthesized
cagtaaagtttcaggatatgaa

SEQ ID NO: 1151486 - DNA, 22 bp, Artificial Sequence
  chemically synthesized
agtaaagtttcaggatatgaaa

SEQ ID NO: 1151487 - DNA, 22 bp, Artificial Sequence
  chemically synthesized
ccaattttgtacattgatttca

SEQ ID NO: 1151488 - DNA, 22 bp, Artificial Sequence
  chemically synthesized
caggatatgaaatcaatgtaca

SEQ ID NO: 1151489 - DNA, 22 bp, Artificial Sequence
  chemically synthesized
aggatatgaaatcaatgtacaa

SEQ ID NO: 1151490 - DNA, 22 bp, Artificial Sequence
  chemically synthesized
gtgtatagaaatgctaccaatt

SEQ ID NO: 1151491 - DNA, 22 bp, Artificial Sequence
  chemically synthesized
ttggtgtatagaaatgctacca

SEQ ID NO: 1151492 - DNA, 22 bp, Artificial Sequence
  chemically synthesized
atcattattggtgtatagaaat

SEQ ID NO: 1151493 - DNA, 22 bp, Artificial Sequence
  chemically synthesized
gatcattattggtgtatagaaa

SEQ ID NO: 1151494 - DNA, 22 bp, Artificial Sequence
  chemically synthesized
agcttgatcattattggtgtat

SEQ ID NO: 1151495 - DNA, 22 bp, Artificial Sequence
  chemically synthesized
gtagcatttctatacaccaata

SEQ ID NO: 1151496 - DNA, 22 bp, Artificial Sequence
  chemically synthesized
tcagcttgatcattattggtgt

SEQ ID NO: 1151497 - DNA, 22 bp, Artificial Sequence
  chemically synthesized
gttctcagcttgatcattattg

SEQ ID NO: 1151498 - DNA, 22 bp, Artificial Sequence
  chemically synthesized
ggttctcagcttgatcattatt

SEQ ID NO: 1151499 - DNA, 22 bp, Artificial Sequence
  chemically synthesized
ctatacaccaataatgatcaag

SEQ ID NO: 1151500 - DNA, 22 bp, Artificial Sequence
  chemically synthesized
tatacaccaataatgatcaagc

SEQ ID NO: 1151501 - DNA, 22 bp, Artificial Sequence
  chemically synthesized
atttggttctcagcttgatcat

SEQ ID NO: 1151502 - DNA, 22 bp, Artificial Sequence
  chemically synthesized
gatttggttctcagcttgatca

SEQ ID NO: 1151503 - DNA, 22 bp, Artificial Sequence
  chemically synthesized
tacaccaataatgatcaagctg

SEQ ID NO: 1151504 - DNA, 22 bp, Artificial Sequence
  chemically synthesized
ttgatttggttctcagcttgat

SEQ ID NO: 1151505 - DNA, 22 bp, Artificial Sequence
  chemically synthesized
agttcttgatttggttctcagc

SEQ ID NO: 1151506 - DNA, 22 bp, Artificial Sequence
  chemically synthesized
taaatgagattgagttcttgat

SEQ ID NO: 1151507 - DNA, 22 bp, Artificial Sequence
  chemically synthesized
ttgtaaatgagattgagttctt

SEQ ID NO: 1151508 - DNA, 22 bp, Artificial Sequence
  chemically synthesized
agaaccaaatcaagaactcaat

SEQ ID NO: 1151509 - DNA, 22 bp, Artificial Sequence
  chemically synthesized
tagttgttgtaaatgagattga

SEQ ID NO: 1151510 - DNA, 22 bp, Artificial Sequence
  chemically synthesized
gtagttgttgtaaatgagattg

SEQ ID NO: 1151511 - DNA, 22 bp, Artificial Sequence
  chemically synthesized
tgtagttgttgtaaatgagatt

SEQ ID NO: 1151512 - DNA, 22 bp, Artificial Sequence
  chemically synthesized
ttgtagttgttgtaaatgagat

SEQ ID NO: 1151513 - DNA, 22 bp, Artificial Sequence
  chemically synthesized
tttgtagttgttgtaaatgaga

SEQ ID NO: 1151514 - DNA, 22 bp, Artificial Sequence
  chemically synthesized
ttttgtagttgttgtaaatgag

SEQ ID NO: 1151515 - DNA, 22 bp, Artificial Sequence
  chemically synthesized
tttttgtagttgttgtaaatga

SEQ ID NO: 1151516 - DNA, 22 bp, Artificial Sequence
  chemically synthesized
ttttttgtagttgttgtaaatg

SEQ ID NO: 1151517 - DNA, 22 bp, Artificial Sequence
  chemically synthesized
tttttttgtagttgttgtaaat

SEQ ID NO: 1151518 - DNA, 22 bp, Artificial Sequence
  chemically synthesized
ttttttttgtagttgttgtaaa

SEQ ID NO: 1151519 - DNA, 22 bp, Artificial Sequence
  chemically synthesized
tttttttttgtagttgttgtaa

SEQ ID NO: 1151520 - DNA, 22 bp, Artificial Sequence
  chemically synthesized
aatctcatttacaacaactaca

SEQ ID NO: 1151521 - DNA, 22 bp, Artificial Sequence
  chemically synthesized
ggtattttttttttttgtagtt

SEQ ID NO: 1151522 - DNA, 22 bp, Artificial Sequence
  chemically synthesized
atttacaacaactacaaaaaaa

SEQ ID NO: 1151523 - DNA, 22 bp, Artificial Sequence
  chemically synthesized
ctaggtattttttttttttgta

SEQ ID NO: 1151524 - DNA, 22 bp, Artificial Sequence
  chemically synthesized
acaacaactacaaaaaaaaaaa

SEQ ID NO: 1151525 - DNA, 22 bp, Artificial Sequence
  chemically synthesized
caacaactacaaaaaaaaaaaa

SEQ ID NO: 1151526 - DNA, 22 bp, Artificial Sequence
  chemically synthesized
aaggcattcctaggtatttttt

SEQ ID NO: 1151527 - DNA, 22 bp, Artificial Sequence
  chemically synthesized
aaaggcattcctaggtattttt

SEQ ID NO: 1151528 - DNA, 22 bp, Artificial Sequence
  chemically synthesized
tttaaaggcattcctaggtatt

SEQ ID NO: 1151529 - DNA, 22 bp, Artificial Sequence
  chemically synthesized
caaaaaaaaaaaatacctagga

SEQ ID NO: 1151530 - DNA, 22 bp, Artificial Sequence
  chemically synthesized
gtttaaaggcattcctaggtat

SEQ ID NO: 1151531 - DNA, 22 bp, Artificial Sequence
  chemically synthesized
tgtttaaaggcattcctaggta

SEQ ID NO: 1151532 - DNA, 22 bp, Artificial Sequence
  chemically synthesized
ttgtttaaaggcattcctaggt

SEQ ID NO: 1151533 - DNA, 22 bp, Artificial Sequence
  chemically synthesized
tttgtttaaaggcattcctagg

SEQ ID NO: 1151534 - DNA, 22 bp, Artificial Sequence
  chemically synthesized
ttttgtttaaaggcattcctag

SEQ ID NO: 1151535 - DNA, 22 bp, Artificial Sequence
  chemically synthesized
acttttttgtttaaaggcattc

SEQ ID NO: 1151536 - DNA, 22 bp, Artificial Sequence
  chemically synthesized
cacttttttgtttaaaggcatt

SEQ ID NO: 1151537 - DNA, 22 bp, Artificial Sequence
  chemically synthesized
tcacttttttgtttaaaggcat

SEQ ID NO: 1151538 - DNA, 22 bp, Artificial Sequence
  chemically synthesized
ggaatgcctttaaacaaaaaag

SEQ ID NO: 1151539 - DNA, 22 bp, Artificial Sequence
  chemically synthesized
tagacacctttcacttttttgt

SEQ ID NO: 1151540 - DNA, 22 bp, Artificial Sequence
  chemically synthesized
gtagacacctttcacttttttg

SEQ ID NO: 1151541 - DNA, 22 bp, Artificial Sequence
  chemically synthesized
cttgtagacacctttcactttt

SEQ ID NO: 1151542 - DNA, 22 bp, Artificial Sequence
  chemically synthesized
tccttgtagacacctttcactt

SEQ ID NO: 1151543 - DNA, 22 bp, Artificial Sequence
  chemically synthesized
taaacaaaaaagtgaaaggtgt

SEQ ID NO: 1151544 - DNA, 22 bp, Artificial Sequence
  chemically synthesized
aaacaaaaaagtgaaaggtgtc

SEQ ID NO: 1151545 - DNA, 22 bp, Artificial Sequence
  chemically synthesized
aacaaaaaagtgaaaggtgtct

SEQ ID NO: 1151546 - DNA, 22 bp, Artificial Sequence
  chemically synthesized
tagttctccttgtagacacctt

SEQ ID NO: 1151547 - DNA, 22 bp, Artificial Sequence
  chemically synthesized
gtagttctccttgtagacacct

SEQ ID NO: 1151548 - DNA, 22 bp, Artificial Sequence
  chemically synthesized
tgtagttctccttgtagacacc

SEQ ID NO: 1151549 - DNA, 22 bp, Artificial Sequence
  chemically synthesized
atgggtgttttgtagttctcct

SEQ ID NO: 1151550 - DNA, 22 bp, Artificial Sequence
  chemically synthesized
catgggtgttttgtagttctcc

SEQ ID NO: 1151551 - DNA, 22 bp, Artificial Sequence
  chemically synthesized
tttcatgggtgttttgtagttc

SEQ ID NO: 1151552 - DNA, 22 bp, Artificial Sequence
  chemically synthesized
atttcatgggtgttttgtagtt

SEQ ID NO: 1151553 - DNA, 22 bp, Artificial Sequence
  chemically synthesized
caaggagaactacaaaacaccc

SEQ ID NO: 1151554 - DNA, 22 bp, Artificial Sequence
  chemically synthesized
tgatttatttcatgggtgtttt

SEQ ID NO: 1151555 - DNA, 22 bp, Artificial Sequence
  chemically synthesized
tgtcatctatgatttatttcat

SEQ ID NO: 1151556 - DNA, 22 bp, Artificial Sequence
  chemically synthesized
gtgtcatctatgatttatttca

SEQ ID NO: 1151557 - DNA, 22 bp, Artificial Sequence
  chemically synthesized
caaaacacccatgaaataaatc

SEQ ID NO: 1151558 - DNA, 22 bp, Artificial Sequence
  chemically synthesized
tttgtgtcatctatgatttatt

SEQ ID NO: 1151559 - DNA, 22 bp, Artificial Sequence
  chemically synthesized
gtttgtgtcatctatgatttat

SEQ ID NO: 1151560 - DNA, 22 bp, Artificial Sequence
  chemically synthesized
catttgtttgtgtcatctatga

SEQ ID NO: 1151561 - DNA, 22 bp, Artificial Sequence
  chemically synthesized
ccatttgtttgtgtcatctatg

SEQ ID NO: 1151562 - DNA, 22 bp, Artificial Sequence
  chemically synthesized
tccatttgtttgtgtcatctat

SEQ ID NO: 1151563 - DNA, 22 bp, Artificial Sequence
  chemically synthesized
ttccatttgtttgtgtcatcta

SEQ ID NO: 1151564 - DNA, 22 bp, Artificial Sequence
  chemically synthesized
ccaatccatgagcagggaaagt

SEQ ID NO: 1151565 - DNA, 22 bp, Artificial Sequence
  chemically synthesized
atgctcccaatccatgagcagg

SEQ ID NO: 1151566 - DNA, 22 bp, Artificial Sequence
  chemically synthesized
acaatattgatgctcccaatcc

SEQ ID NO: 1151567 - DNA, 22 bp, Artificial Sequence
  chemically synthesized
tccctgctcatggattgggagc

SEQ ID NO: 1151568 - DNA, 22 bp, Artificial Sequence
  chemically synthesized
aacaatattgatgctcccaatc

SEQ ID NO: 1151569 - DNA, 22 bp, Artificial Sequence
  chemically synthesized
ccctgctcatggattgggagca

SEQ ID NO: 1151570 - DNA, 22 bp, Artificial Sequence
  chemically synthesized
taacaatattgatgctcccaat

SEQ ID NO: 1151571 - DNA, 22 bp, Artificial Sequence
  chemically synthesized
cctgctcatggattgggagcat

SEQ ID NO: 1151572 - DNA, 22 bp, Artificial Sequence
  chemically synthesized
ttttaacaatattgatgctccc

SEQ ID NO: 1151573 - DNA, 22 bp, Artificial Sequence
  chemically synthesized
ctcatggattgggagcatcaat

SEQ ID NO: 1151574 - DNA, 22 bp, Artificial Sequence
  chemically synthesized
atggattgggagcatcaatatt

SEQ ID NO: 1151575 - DNA, 22 bp, Artificial Sequence
  chemically synthesized
ggagcatcaatattgttaaaat

SEQ ID NO: 1151576 - DNA, 22 bp, Artificial Sequence
  chemically synthesized
agcagtgtggttattttaacaa

SEQ ID NO: 1151577 - DNA, 22 bp, Artificial Sequence
  chemically synthesized
gagcagtgtggttattttaaca

SEQ ID NO: 1151578 - DNA, 22 bp, Artificial Sequence
  chemically synthesized
tgagcagtgtggttattttaac

SEQ ID NO: 1151579 - DNA, 22 bp, Artificial Sequence
  chemically synthesized
ctttgagcagtgtggttatttt

SEQ ID NO: 1151580 - DNA, 22 bp, Artificial Sequence
  chemically synthesized
taaattgctttgagcagtgtgg

SEQ ID NO: 1151581 - DNA, 22 bp, Artificial Sequence
  chemically synthesized
ttaaaataaccacactgctcaa

SEQ ID NO: 1151582 - DNA, 22 bp, Artificial Sequence
  chemically synthesized
aaataaccacactgctcaaagc

SEQ ID NO: 1151583 - DNA, 22 bp, Artificial Sequence
  chemically synthesized
aatctgtaaattgctttgagca

SEQ ID NO: 1151584 - DNA, 22 bp, Artificial Sequence
  chemically synthesized
tgttcaatctgtaaattgcttt

SEQ ID NO: 1151585 - DNA, 22 bp, Artificial Sequence
  chemically synthesized
ctcaaagcaatttacagattga

SEQ ID NO: 1151586 - DNA, 22 bp, Artificial Sequence
  chemically synthesized
taaggactgtgttcaatctgta

SEQ ID NO: 1151587 - DNA, 22 bp, Artificial Sequence
  chemically synthesized
ataaggactgtgttcaatctgt

SEQ ID NO: 1151588 - DNA, 22 bp, Artificial Sequence
  chemically synthesized
aaagcaatttacagattgaaca

SEQ ID NO: 1151589 - DNA, 22 bp, Artificial Sequence
  chemically synthesized
gtaatttataaggactgtgttc

SEQ ID NO: 1151590 - DNA, 22 bp, Artificial Sequence
  chemically synthesized
acagattgaacacagtccttat

SEQ ID NO: 1151591 - DNA, 22 bp, Artificial Sequence
  chemically synthesized
cagattgaacacagtccttata

SEQ ID NO: 1151592 - DNA, 22 bp, Artificial Sequence
  chemically synthesized
aacacagtccttataaattacc

SEQ ID NO: 1151593 - DNA, 22 bp, Artificial Sequence
  chemically synthesized
tgaaaaatgatgttggtaattt

SEQ ID NO: 1151594 - DNA, 22 bp, Artificial Sequence
  chemically synthesized
tgtgaaaaatgatgttggtaat

SEQ ID NO: 1151595 - DNA, 22 bp, Artificial Sequence
  chemically synthesized
attctgtgaaaaatgatgttgg

SEQ ID NO: 1151596 - DNA, 22 bp, Artificial Sequence
  chemically synthesized
taattctgtgaaaaatgatgtt

SEQ ID NO: 1151597 - DNA, 22 bp, Artificial Sequence
  chemically synthesized
ctaattctgtgaaaaatgatgt

SEQ ID NO: 1151598 - DNA, 22 bp, Artificial Sequence
  chemically synthesized
ataaattaccaacatcattttt

SEQ ID NO: 1151599 - DNA, 22 bp, Artificial Sequence
  chemically synthesized
tctaattctgtgaaaaatgatg

SEQ ID NO: 1151600 - DNA, 22 bp, Artificial Sequence
  chemically synthesized
taaattaccaacatcatttttc

SEQ ID NO: 1151601 - DNA, 22 bp, Artificial Sequence
  chemically synthesized
ttctaattctgtgaaaaatgat

SEQ ID NO: 1151602 - DNA, 22 bp, Artificial Sequence
  chemically synthesized
tttctaattctgtgaaaaatga

SEQ ID NO: 1151603 - DNA, 22 bp, Artificial Sequence
  chemically synthesized
tctttttctaattctgtgaaaa

SEQ ID NO: 1151604 - DNA, 22 bp, Artificial Sequence
  chemically synthesized
ccaacatcatttttcacagaat

SEQ ID NO: 1151605 - DNA, 22 bp, Artificial Sequence
  chemically synthesized
ctatctttttctaattctgtga

SEQ ID NO: 1151606 - DNA, 22 bp, Artificial Sequence
  chemically synthesized
actatctttttctaattctgtg

SEQ ID NO: 1151607 - DNA, 22 bp, Artificial Sequence
  chemically synthesized
tactatctttttctaattctgt

SEQ ID NO: 1151608 - DNA, 22 bp, Artificial Sequence
  chemically synthesized
tgtattttactatctttttcta

SEQ ID NO: 1151609 - DNA, 22 bp, Artificial Sequence
  chemically synthesized
ttcacagaattagaaaaagata

SEQ ID NO: 1151610 - DNA, 22 bp, Artificial Sequence
  chemically synthesized
tatgtattttactatctttttc

SEQ ID NO: 1151611 - DNA, 22 bp, Artificial Sequence
  chemically synthesized
tcacagaattagaaaaagatag

SEQ ID NO: 1151612 - DNA, 22 bp, Artificial Sequence
  chemically synthesized
cacagaattagaaaaagatagt

SEQ ID NO: 1151613 - DNA, 22 bp, Artificial Sequence
  chemically synthesized
tctatgtattttactatctttt

SEQ ID NO: 1151614 - DNA, 22 bp, Artificial Sequence
  chemically synthesized
acagaattagaaaaagatagta

SEQ ID NO: 1151615 - DNA, 22 bp, Artificial Sequence
  chemically synthesized
attctctatgtattttactatc

SEQ ID NO: 1151616 - DNA, 22 bp, Artificial Sequence
  chemically synthesized
gattctctatgtattttactat

SEQ ID NO: 1151617 - DNA, 22 bp, Artificial Sequence
  chemically synthesized
tgattctctatgtattttacta

SEQ ID NO: 1151618 - DNA, 22 bp, Artificial Sequence
  chemically synthesized
ttgattctctatgtattttact

SEQ ID NO: 1151619 - DNA, 22 bp, Artificial Sequence
  chemically synthesized
tttgattctctatgtattttac

SEQ ID NO: 1151620 - DNA, 22 bp, Artificial Sequence
  chemically synthesized
ttttgattctctatgtatttta

SEQ ID NO: 1151621 - DNA, 22 bp, Artificial Sequence
  chemically synthesized
gaaaaagatagtaaaatacata

SEQ ID NO: 1151622 - DNA, 22 bp, Artificial Sequence
  chemically synthesized
ttttttgattctctatgtattt

SEQ ID NO: 1151623 - DNA, 22 bp, Artificial Sequence
  chemically synthesized
ggctcttttttgattctctatg

SEQ ID NO: 1151624 - DNA, 22 bp, Artificial Sequence
  chemically synthesized
gggctcttttttgattctctat

SEQ ID NO: 1151625 - DNA, 22 bp, Artificial Sequence
  chemically synthesized
tttgggctcttttttgattctc

SEQ ID NO: 1151626 - DNA, 22 bp, Artificial Sequence
  chemically synthesized
actatttgggctcttttttgat

SEQ ID NO: 1151627 - DNA, 22 bp, Artificial Sequence
  chemically synthesized
gactatttgggctcttttttga

SEQ ID NO: 1151628 - DNA, 22 bp, Artificial Sequence
  chemically synthesized
tgactatttgggctcttttttg

SEQ ID NO: 1151629 - DNA, 22 bp, Artificial Sequence
  chemically synthesized
ctttgactatttgggctctttt

SEQ ID NO: 1151630 - DNA, 22 bp, Artificial Sequence
  chemically synthesized
gcattgctttgactatttgggc

SEQ ID NO: 1151631 - DNA, 22 bp, Artificial Sequence
  chemically synthesized
agcattgctttgactatttggg

SEQ ID NO: 1151632 - DNA, 22 bp, Artificial Sequence
  chemically synthesized
cttagcattgctttgactattt

SEQ ID NO: 1151633 - DNA, 22 bp, Artificial Sequence
  chemically synthesized
gcttagcattgctttgactatt

SEQ ID NO: 1151634 - DNA, 22 bp, Artificial Sequence
  chemically synthesized
ttgcttagcattgctttgacta

SEQ ID NO: 1151635 - DNA, 22 bp, Artificial Sequence
  chemically synthesized
cttgcttagcattgctttgact

SEQ ID NO: 1151636 - DNA, 22 bp, Artificial Sequence
  chemically synthesized
ttcttgcttagcattgctttga

SEQ ID NO: 1151637 - DNA, 22 bp, Artificial Sequence
  chemically synthesized
ttcttcttgcttagcattgctt

SEQ ID NO: 1151638 - DNA, 22 bp, Artificial Sequence
  chemically synthesized
attcttcttgcttagcattgct

SEQ ID NO: 1151639 - DNA, 22 bp, Artificial Sequence
  chemically synthesized
tattcttcttgcttagcattgc

SEQ ID NO: 1151640 - DNA, 22 bp, Artificial Sequence
  chemically synthesized
aactttattcttcttgcttagc

SEQ ID NO: 1151641 - DNA, 22 bp, Artificial Sequence
  chemically synthesized
caactttattcttcttgcttag

SEQ ID NO: 1151642 - DNA, 22 bp, Artificial Sequence
  chemically synthesized
agcaagaagaataaagttgaag

SEQ ID NO: 1151643 - DNA, 22 bp, Artificial Sequence
  chemically synthesized
aagtcaggtaatgtgatgcctt

SEQ ID NO: 1151644 - DNA, 22 bp, Artificial Sequence
  chemically synthesized
gaagtcaggtaatgtgatgcct

SEQ ID NO: 1151645 - DNA, 22 bp, Artificial Sequence
  chemically synthesized
gtataatttgaagtcaggtaat

SEQ ID NO: 1151646 - DNA, 22 bp, Artificial Sequence
  chemically synthesized
agtataatttgaagtcaggtaa

SEQ ID NO: 1151647 - DNA, 22 bp, Artificial Sequence
  chemically synthesized
aaggcatcacattacctgactt

SEQ ID NO: 1151648 - DNA, 22 bp, Artificial Sequence
  chemically synthesized
tagtataatttgaagtcaggta

SEQ ID NO: 1151649 - DNA, 22 bp, Artificial Sequence
  chemically synthesized
ttagtataatttgaagtcaggt

SEQ ID NO: 1151650 - DNA, 22 bp, Artificial Sequence
  chemically synthesized
tagccttttagtataatttgaa

SEQ ID NO: 1151651 - DNA, 22 bp, Artificial Sequence
  chemically synthesized
ctgtagccttttagtataattt

SEQ ID NO: 1151652 - DNA, 22 bp, Artificial Sequence
  chemically synthesized
cctgacttcaaattatactaaa

SEQ ID NO: 1151653 - DNA, 22 bp, Artificial Sequence
  chemically synthesized
gttactgtagccttttagtata

SEQ ID NO: 1151654 - DNA, 22 bp, Artificial Sequence
  chemically synthesized
ggttactgtagccttttagtat

SEQ ID NO: 1151655 - DNA, 22 bp, Artificial Sequence
  chemically synthesized
tggttactgtagccttttagta

SEQ ID NO: 1151656 - DNA, 22 bp, Artificial Sequence
  chemically synthesized
acttcaaattatactaaaaggc

SEQ ID NO: 1151657 - DNA, 22 bp, Artificial Sequence
  chemically synthesized
ttttggttactgtagcctttta

SEQ ID NO: 1151658 - DNA, 22 bp, Artificial Sequence
  chemically synthesized
caaattatactaaaaggctaca

SEQ ID NO: 1151659 - DNA, 22 bp, Artificial Sequence
  chemically synthesized
aaattatactaaaaggctacag

SEQ ID NO: 1151660 - DNA, 22 bp, Artificial Sequence
  chemically synthesized
tactaaaaggctacagtaacca

SEQ ID NO: 1151661 - DNA, 22 bp, Artificial Sequence
  chemically synthesized
aaaggctacagtaaccaaaaca

SEQ ID NO: 1151662 - DNA, 22 bp, Artificial Sequence
  chemically synthesized
taccagtaccatactgttttgg

SEQ ID NO: 1151663 - DNA, 22 bp, Artificial Sequence
  chemically synthesized
ataccagtaccatactgttttg

SEQ ID NO: 1151664 - DNA, 22 bp, Artificial Sequence
  chemically synthesized
tataccagtaccatactgtttt

SEQ ID NO: 1151665 - DNA, 22 bp, Artificial Sequence
  chemically synthesized
ttataccagtaccatactgttt

SEQ ID NO: 1151666 - DNA, 22 bp, Artificial Sequence
  chemically synthesized
cagtaaccaaaacagtatggta

SEQ ID NO: 1151667 - DNA, 22 bp, Artificial Sequence
  chemically synthesized
tttttataccagtaccatactg

SEQ ID NO: 1151668 - DNA, 22 bp, Artificial Sequence
  chemically synthesized
tatgtatctgtttttataccag

SEQ ID NO: 1151669 - DNA, 22 bp, Artificial Sequence
  chemically synthesized
aatcaatctatatgtatctgtt

SEQ ID NO: 1151670 - DNA, 22 bp, Artificial Sequence
  chemically synthesized
gttaaatcaatctatatgtatc

SEQ ID NO: 1151671 - DNA, 22 bp, Artificial Sequence
  chemically synthesized
gtataaaaacagatacatatag

SEQ ID NO: 1151672 - DNA, 22 bp, Artificial Sequence
  chemically synthesized
ggttaaatcaatctatatgtat

SEQ ID NO: 1151673 - DNA, 22 bp, Artificial Sequence
  chemically synthesized
atttggttaaatcaatctatat

SEQ ID NO: 1151674 - DNA, 22 bp, Artificial Sequence
  chemically synthesized
aatttggttaaatcaatctata

SEQ ID NO: 1151675 - DNA, 22 bp, Artificial Sequence
  chemically synthesized
ttaatttggttaaatcaatcta

SEQ ID NO: 1151676 - DNA, 22 bp, Artificial Sequence
  chemically synthesized
ggttcttaatttggttaaatca

SEQ ID NO: 1151677 - DNA, 22 bp, Artificial Sequence
  chemically synthesized
tatctgggttcttaatttggtt

SEQ ID NO: 1151678 - DNA, 22 bp, Artificial Sequence
  chemically synthesized
atatctgggttcttaatttggt

SEQ ID NO: 1151679 - DNA, 22 bp, Artificial Sequence
  chemically synthesized
tatatctgggttcttaatttgg

SEQ ID NO: 1151680 - DNA, 22 bp, Artificial Sequence
  chemically synthesized
atttaaccaaattaagaaccca

SEQ ID NO: 1151681 - DNA, 22 bp, Artificial Sequence
  chemically synthesized
aaccaaattaagaacccagata

SEQ ID NO: 1151682 - DNA, 22 bp, Artificial Sequence
  chemically synthesized
accaaattaagaacccagatat

SEQ ID NO: 1151683 - DNA, 22 bp, Artificial Sequence
  chemically synthesized
gtcatagatatgtggttttata

SEQ ID NO: 1151684 - DNA, 22 bp, Artificial Sequence
  chemically synthesized
agaacccagatataaaaccaca

SEQ ID NO: 1151685 - DNA, 22 bp, Artificial Sequence
  chemically synthesized
aagatgtgttggtcatagatat

SEQ ID NO: 1151686 - DNA, 22 bp, Artificial Sequence
  chemically synthesized
ttaaagatgtgttggtcataga

SEQ ID NO: 1151687 - DNA, 22 bp, Artificial Sequence
  chemically synthesized
gttaaagatgtgttggtcatag

SEQ ID NO: 1151688 - DNA, 22 bp, Artificial Sequence
  chemically synthesized
tgttaaagatgtgttggtcata

SEQ ID NO: 1151689 - DNA, 22 bp, Artificial Sequence
  chemically synthesized
ctttgttaaagatgtgttggtc

SEQ ID NO: 1151690 - DNA, 22 bp, Artificial Sequence
  chemically synthesized
actttgttaaagatgtgttggt

SEQ ID NO: 1151691 - DNA, 22 bp, Artificial Sequence
  chemically synthesized
tactttgttaaagatgtgttgg

SEQ ID NO: 1151692 - DNA, 22 bp, Artificial Sequence
  chemically synthesized
ttactttgttaaagatgtgttg

SEQ ID NO: 1151693 - DNA, 22 bp, Artificial Sequence
  chemically synthesized
tttactttgttaaagatgtgtt

SEQ ID NO: 1151694 - DNA, 22 bp, Artificial Sequence
  chemically synthesized
ttttactttgttaaagatgtgt

SEQ ID NO: 1151695 - DNA, 22 bp, Artificial Sequence
  chemically synthesized
tgaccaacacatctttaacaaa

SEQ ID NO: 1151696 - DNA, 22 bp, Artificial Sequence
  chemically synthesized
cccagtgtatatatacattttt

SEQ ID NO: 1151697 - DNA, 22 bp, Artificial Sequence
  chemically synthesized
taacaaagtaaaaaaatgtata

SEQ ID NO: 1151698 - DNA, 22 bp, Artificial Sequence
  chemically synthesized
ccccagtgtatatatacatttt

SEQ ID NO: 1151699 - DNA, 22 bp, Artificial Sequence
  chemically synthesized
aacaaagtaaaaaaatgtatat

SEQ ID NO: 1151700 - DNA, 22 bp, Artificial Sequence
  chemically synthesized
tccccagtgtatatatacattt

SEQ ID NO: 1151701 - DNA, 22 bp, Artificial Sequence
  chemically synthesized
acaaagtaaaaaaatgtatata

SEQ ID NO: 1151702 - DNA, 22 bp, Artificial Sequence
  chemically synthesized
aataggatgtcctttccccagt

SEQ ID NO: 1151703 - DNA, 22 bp, Artificial Sequence
  chemically synthesized
ctgaataggatgtcctttcccc

SEQ ID NO: 1151704 - DNA, 22 bp, Artificial Sequence
  chemically synthesized
actgaataggatgtcctttccc

SEQ ID NO: 1151705 - DNA, 22 bp, Artificial Sequence
  chemically synthesized
cagcacaatttactgaatagga

SEQ ID NO: 1151706 - DNA, 22 bp, Artificial Sequence
  chemically synthesized
gggaaaggacatcctattcagt

SEQ ID NO: 1151707 - DNA, 22 bp, Artificial Sequence
  chemically synthesized
acagcacaatttactgaatagg

SEQ ID NO: 1151708 - DNA, 22 bp, Artificial Sequence
  chemically synthesized
tccaatatttacagcacaattt

SEQ ID NO: 1151709 - DNA, 22 bp, Artificial Sequence
  chemically synthesized
ttcagtaaattgtgctgtaaat

SEQ ID NO: 1151710 - DNA, 22 bp, Artificial Sequence
  chemically synthesized
tgactatccaatatttacagca

SEQ ID NO: 1151711 - DNA, 22 bp, Artificial Sequence
  chemically synthesized
atgactatccaatatttacagc

SEQ ID NO: 1151712 - DNA, 22 bp, Artificial Sequence
  chemically synthesized
agtaaattgtgctgtaaatatt

SEQ ID NO: 1151713 - DNA, 22 bp, Artificial Sequence
  chemically synthesized
cttatgactatccaatatttac

SEQ ID NO: 1151714 - DNA, 22 bp, Artificial Sequence
  chemically synthesized
tgcttatgactatccaatattt

SEQ ID NO: 1151715 - DNA, 22 bp, Artificial Sequence
  chemically synthesized
ctgcttatgactatccaatatt

SEQ ID NO: 1151716 - DNA, 22 bp, Artificial Sequence
  chemically synthesized
ttctgcttatgactatccaata

SEQ ID NO: 1151717 - DNA, 22 bp, Artificial Sequence
  chemically synthesized
tgctgtaaatattggatagtca

SEQ ID NO: 1151718 - DNA, 22 bp, Artificial Sequence
  chemically synthesized
attcttctgcttatgactatcc

SEQ ID NO: 1151719 - DNA, 22 bp, Artificial Sequence
  chemically synthesized
cattcttctgcttatgactatc

SEQ ID NO: 1151720 - DNA, 22 bp, Artificial Sequence
  chemically synthesized
taaatattggatagtcataagc

SEQ ID NO: 1151721 - DNA, 22 bp, Artificial Sequence
  chemically synthesized
tgacccagtttcattcttctgc

SEQ ID NO: 1151722 - DNA, 22 bp, Artificial Sequence
  chemically synthesized
gatagtcataagcagaagaatg

SEQ ID NO: 1151723 - DNA, 22 bp, Artificial Sequence
  chemically synthesized
atgacccagtttcattcttctg

SEQ ID NO: 1151724 - DNA, 22 bp, Artificial Sequence
  chemically synthesized
tatatggtgatttatgacccag

SEQ ID NO: 1151725 - DNA, 22 bp, Artificial Sequence
  chemically synthesized
gtatatggtgatttatgaccca

SEQ ID NO: 1151726 - DNA, 22 bp, Artificial Sequence
  chemically synthesized
tgtatatggtgatttatgaccc

SEQ ID NO: 1151727 - DNA, 22 bp, Artificial Sequence
  chemically synthesized
ttgtatatggtgatttatgacc

SEQ ID NO: 1151728 - DNA, 22 bp, Artificial Sequence
  chemically synthesized
atttttgtatatggtgatttat

SEQ ID NO: 1151729 - DNA, 22 bp, Artificial Sequence
  chemically synthesized
agttaatttttgtatatggtga

SEQ ID NO: 1151730 - DNA, 22 bp, Artificial Sequence
  chemically synthesized
gagttaatttttgtatatggtg

SEQ ID NO: 1151731 - DNA, 22 bp, Artificial Sequence
  chemically synthesized
tgagttaatttttgtatatggt

SEQ ID NO: 1151732 - DNA, 22 bp, Artificial Sequence
  chemically synthesized
ggtcataaatcaccatatacaa

SEQ ID NO: 1151733 - DNA, 22 bp, Artificial Sequence
  chemically synthesized
atacattttgagttaatttttg

SEQ ID NO: 1151734 - DNA, 22 bp, Artificial Sequence
  chemically synthesized
aatacattttgagttaattttt

SEQ ID NO: 1151735 - DNA, 22 bp, Artificial Sequence
  chemically synthesized
taatacattttgagttaatttt

SEQ ID NO: 1151736 - DNA, 22 bp, Artificial Sequence
  chemically synthesized
agtctttaatacattttgagtt

SEQ ID NO: 1151737 - DNA, 22 bp, Artificial Sequence
  chemically synthesized
aagtctttaatacattttgagt

SEQ ID NO: 1151738 - DNA, 22 bp, Artificial Sequence
  chemically synthesized
catttaagtctttaatacattt

SEQ ID NO: 1151739 - DNA, 22 bp, Artificial Sequence
  chemically synthesized
acatttaagtctttaatacatt

SEQ ID NO: 1151740 - DNA, 22 bp, Artificial Sequence
  chemically synthesized
actcaaaatgtattaaagactt

SEQ ID NO: 1151741 - DNA, 22 bp, Artificial Sequence
  chemically synthesized
aggtcttacatttaagtcttta

SEQ ID NO: 1151742 - DNA, 22 bp, Artificial Sequence
  chemically synthesized
caggtcttacatttaagtcttt

SEQ ID NO: 1151743 - DNA, 22 bp, Artificial Sequence
  chemically synthesized
tcaggtcttacatttaagtctt

SEQ ID NO: 1151744 - DNA, 22 bp, Artificial Sequence
  chemically synthesized
aaaatgtattaaagacttaaat

SEQ ID NO: 1151745 - DNA, 22 bp, Artificial Sequence
  chemically synthesized
tattttcaggtcttacatttaa

SEQ ID NO: 1151746 - DNA, 22 bp, Artificial Sequence
  chemically synthesized
atattttcaggtcttacattta

SEQ ID NO: 1151747 - DNA, 22 bp, Artificial Sequence
  chemically synthesized
tatattttcaggtcttacattt

SEQ ID NO: 1151748 - DNA, 22 bp, Artificial Sequence
  chemically synthesized
ttatattttcaggtcttacatt

SEQ ID NO: 1151749 - DNA, 22 bp, Artificial Sequence
  chemically synthesized
aagacttaaatgtaagacctga

SEQ ID NO: 1151750 - DNA, 22 bp, Artificial Sequence
  chemically synthesized
ggatttttatattttcaggtct

SEQ ID NO: 1151751 - DNA, 22 bp, Artificial Sequence
  chemically synthesized
aggatttttatattttcaggtc

SEQ ID NO: 1151752 - DNA, 22 bp, Artificial Sequence
  chemically synthesized
taggatttttatattttcaggt

SEQ ID NO: 1151753 - DNA, 22 bp, Artificial Sequence
  chemically synthesized
ttaggatttttatattttcagg

SEQ ID NO: 1151754 - DNA, 22 bp, Artificial Sequence
  chemically synthesized
aaatgtaagacctgaaaatata

SEQ ID NO: 1151755 - DNA, 22 bp, Artificial Sequence
  chemically synthesized
ttttaggatttttatattttca

SEQ ID NO: 1151756 - DNA, 22 bp, Artificial Sequence
  chemically synthesized
aatgtaagacctgaaaatataa

SEQ ID NO: 1151757 - DNA, 22 bp, Artificial Sequence
  chemically synthesized
cttttaggatttttatattttc

SEQ ID NO: 1151758 - DNA, 22 bp, Artificial Sequence
  chemically synthesized
tcttttaggatttttatatttt

SEQ ID NO: 1151759 - DNA, 22 bp, Artificial Sequence
  chemically synthesized
ggttttcttttaggatttttat

SEQ ID NO: 1151760 - DNA, 22 bp, Artificial Sequence
  chemically synthesized
ctaggttttcttttaggatttt

SEQ ID NO: 1151761 - DNA, 22 bp, Artificial Sequence
  chemically synthesized
cctaggttttcttttaggattt

SEQ ID NO: 1151762 - DNA, 22 bp, Artificial Sequence
  chemically synthesized
tcctaggttttcttttaggatt

SEQ ID NO: 1151763 - DNA, 22 bp, Artificial Sequence
  chemically synthesized
ttcctaggttttcttttaggat

SEQ ID NO: 1151764 - DNA, 22 bp, Artificial Sequence
  chemically synthesized
aaaatataaaaatcctaaaaga

SEQ ID NO: 1151765 - DNA, 22 bp, Artificial Sequence
  chemically synthesized
aaagaaaacctaggaaaaactc

SEQ ID NO: 1151766 - DNA, 22 bp, Artificial Sequence
  chemically synthesized
cccaagccagtgtcgagaagag

SEQ ID NO: 1151767 - DNA, 22 bp, Artificial Sequence
  chemically synthesized
gcccaagccagtgtcgagaaga

SEQ ID NO: 1151768 - DNA, 22 bp, Artificial Sequence
  chemically synthesized
tgcccaagccagtgtcgagaag

SEQ ID NO: 1151769 - DNA, 22 bp, Artificial Sequence
  chemically synthesized
tttgcccaagccagtgtcgaga

SEQ ID NO: 1151770 - DNA, 22 bp, Artificial Sequence
  chemically synthesized
ggaaaaactcttctcgacactg

SEQ ID NO: 1151771 - DNA, 22 bp, Artificial Sequence
  chemically synthesized
ttctcgacactggcttgggcaa

SEQ ID NO: 1151772 - DNA, 22 bp, Artificial Sequence
  chemically synthesized
gtcataaattctttgcccaagc

SEQ ID NO: 1151773 - DNA, 22 bp, Artificial Sequence
  chemically synthesized
agtcataaattctttgcccaag

SEQ ID NO: 1151774 - DNA, 22 bp, Artificial Sequence
  chemically synthesized
ctcgacactggcttgggcaaag

SEQ ID NO: 1151775 - DNA, 22 bp, Artificial Sequence
  chemically synthesized
tcgacactggcttgggcaaaga

SEQ ID NO: 1151776 - DNA, 22 bp, Artificial Sequence
  chemically synthesized
gacactggcttgggcaaagaat

SEQ ID NO: 1151777 - DNA, 22 bp, Artificial Sequence
  chemically synthesized
agtacttagtcataaattcttt

SEQ ID NO: 1151778 - DNA, 22 bp, Artificial Sequence
  chemically synthesized
gagtacttagtcataaattctt

SEQ ID NO: 1151779 - DNA, 22 bp, Artificial Sequence
  chemically synthesized
tgagtacttagtcataaattct

SEQ ID NO: 1151780 - DNA, 22 bp, Artificial Sequence
  chemically synthesized
ttgagtacttagtcataaattc

SEQ ID NO: 1151781 - DNA, 22 bp, Artificial Sequence
  chemically synthesized
gcttgggcaaagaatttatgac

SEQ ID NO: 1151782 - DNA, 22 bp, Artificial Sequence
  chemically synthesized
tttttgagtacttagtcataaa

SEQ ID NO: 1151783 - DNA, 22 bp, Artificial Sequence
  chemically synthesized
gtttttgagtacttagtcataa

SEQ ID NO: 1151784 - DNA, 22 bp, Artificial Sequence
  chemically synthesized
gggcaaagaatttatgactaag

SEQ ID NO: 1151785 - DNA, 22 bp, Artificial Sequence
  chemically synthesized
tgtttttgagtacttagtcata

SEQ ID NO: 1151786 - DNA, 22 bp, Artificial Sequence
  chemically synthesized
ggcaaagaatttatgactaagt

SEQ ID NO: 1151787 - DNA, 22 bp, Artificial Sequence
  chemically synthesized
ttgtttttgagtacttagtcat

SEQ ID NO: 1151788 - DNA, 22 bp, Artificial Sequence
  chemically synthesized
cttttgtttttgagtacttagt

SEQ ID NO: 1151789 - DNA, 22 bp, Artificial Sequence
  chemically synthesized
tctacttttgtttttgagtact

SEQ ID NO: 1151790 - DNA, 22 bp, Artificial Sequence
  chemically synthesized
gtctacttttgtttttgagtac

SEQ ID NO: 1151791 - DNA, 22 bp, Artificial Sequence
  chemically synthesized
atgactaagtactcaaaaacaa

SEQ ID NO: 1151792 - DNA, 22 bp, Artificial Sequence
  chemically synthesized
tgactaagtactcaaaaacaaa

SEQ ID NO: 1151793 - DNA, 22 bp, Artificial Sequence
  chemically synthesized
catttgtctacttttgtttttg

SEQ ID NO: 1151794 - DNA, 22 bp, Artificial Sequence
  chemically synthesized
agttccatttgtctacttttgt

SEQ ID NO: 1151795 - DNA, 22 bp, Artificial Sequence
  chemically synthesized
agtactcaaaaacaaaagtaga

SEQ ID NO: 1151796 - DNA, 22 bp, Artificial Sequence
  chemically synthesized
aaattaagttccatttgtctac

SEQ ID NO: 1151797 - DNA, 22 bp, Artificial Sequence
  chemically synthesized
aaaattaagttccatttgtcta

SEQ ID NO: 1151798 - DNA, 22 bp, Artificial Sequence
  chemically synthesized
aaaaacaaaagtagacaaatgg

SEQ ID NO: 1151799 - DNA, 22 bp, Artificial Sequence
  chemically synthesized
taaaattaagttccatttgtct

SEQ ID NO: 1151800 - DNA, 22 bp, Artificial Sequence
  chemically synthesized
agaagattttaaaattaagttc

SEQ ID NO: 1151801 - DNA, 22 bp, Artificial Sequence
  chemically synthesized
ttcagaagattttaaaattaag

SEQ ID NO: 1151802 - DNA, 22 bp, Artificial Sequence
  chemically synthesized
ctgttcagaagattttaaaatt

SEQ ID NO: 1151803 - DNA, 22 bp, Artificial Sequence
  chemically synthesized
gctgttcagaagattttaaaat

SEQ ID NO: 1151804 - DNA, 22 bp, Artificial Sequence
  chemically synthesized
tgctgttcagaagattttaaaa

SEQ ID NO: 1151805 - DNA, 22 bp, Artificial Sequence
  chemically synthesized
ttgctgttcagaagattttaaa

SEQ ID NO: 1151806 - DNA, 22 bp, Artificial Sequence
  chemically synthesized
tttttgctgttcagaagatttt

SEQ ID NO: 1151807 - DNA, 22 bp, Artificial Sequence
  chemically synthesized
gtttttgctgttcagaagattt

SEQ ID NO: 1151808 - DNA, 22 bp, Artificial Sequence
  chemically synthesized
tttgtttttgctgttcagaaga

SEQ ID NO: 1151809 - DNA, 22 bp, Artificial Sequence
  chemically synthesized
gtttgtttttgctgttcagaag

SEQ ID NO: 1151810 - DNA, 22 bp, Artificial Sequence
  chemically synthesized
aattttaaaatcttctgaacag

SEQ ID NO: 1151811 - DNA, 22 bp, Artificial Sequence
  chemically synthesized
attttaaaatcttctgaacagc

SEQ ID NO: 1151812 - DNA, 22 bp, Artificial Sequence
  chemically synthesized
tttgtttgtttttgctgttcag

SEQ ID NO: 1151813 - DNA, 22 bp, Artificial Sequence
  chemically synthesized
gtttgtttgtttttgctgttca

SEQ ID NO: 1151814 - DNA, 22 bp, Artificial Sequence
  chemically synthesized
tgtttgtttgtttttgctgttc

SEQ ID NO: 1151815 - DNA, 22 bp, Artificial Sequence
  chemically synthesized
taaaatcttctgaacagcaaaa

SEQ ID NO: 1151816 - DNA, 22 bp, Artificial Sequence
  chemically synthesized
ttgtttgtttgtttttgctgtt

SEQ ID NO: 1151817 - DNA, 22 bp, Artificial Sequence
  chemically synthesized
aaaatcttctgaacagcaaaaa

SEQ ID NO: 1151818 - DNA, 22 bp, Artificial Sequence
  chemically synthesized
tttgtttgtttgtttttgctgt

SEQ ID NO: 1151819 - DNA, 22 bp, Artificial Sequence
  chemically synthesized
aaatcttctgaacagcaaaaac

SEQ ID NO: 1151820 - DNA, 22 bp, Artificial Sequence
  chemically synthesized
ttttgtttgtttgtttttgctg

SEQ ID NO: 1151821 - DNA, 22 bp, Artificial Sequence
  chemically synthesized
tttttttgtttgtttgtttttg

SEQ ID NO: 1151822 - DNA, 22 bp, Artificial Sequence
  chemically synthesized
gtttttttgtttgtttgttttt

SEQ ID NO: 1151823 - DNA, 22 bp, Artificial Sequence
  chemically synthesized
tgtttttttgtttgtttgtttt

SEQ ID NO: 1151824 - DNA, 22 bp, Artificial Sequence
  chemically synthesized
ttgtttttttgtttgtttgttt

SEQ ID NO: 1151825 - DNA, 22 bp, Artificial Sequence
  chemically synthesized
ctgaacagcaaaaacaaacaaa

SEQ ID NO: 1151826 - DNA, 22 bp, Artificial Sequence
  chemically synthesized
tttgtttttttgtttgtttgtt

SEQ ID NO: 1151827 - DNA, 22 bp, Artificial Sequence
  chemically synthesized
tgaacagcaaaaacaaacaaac

SEQ ID NO: 1151828 - DNA, 22 bp, Artificial Sequence
  chemically synthesized
aacagcaaaaacaaacaaacaa

SEQ ID NO: 1151829 - DNA, 22 bp, Artificial Sequence
  chemically synthesized
ttttttgtttttttgtttgttt

SEQ ID NO: 1151830 - DNA, 22 bp, Artificial Sequence
  chemically synthesized
attgttttttgtttttttgttt

SEQ ID NO: 1151831 - DNA, 22 bp, Artificial Sequence
  chemically synthesized
ttgattgttttttgtttttttg

SEQ ID NO: 1151832 - DNA, 22 bp, Artificial Sequence
  chemically synthesized
tgttgattgttttttgtttttt

SEQ ID NO: 1151833 - DNA, 22 bp, Artificial Sequence
  chemically synthesized
attctgttgattgttttttgtt

SEQ ID NO: 1151834 - DNA, 22 bp, Artificial Sequence
  chemically synthesized
ttcattctgttgattgtttttt

SEQ ID NO: 1151835 - DNA, 22 bp, Artificial Sequence
  chemically synthesized
tctgttcattctgttgattgtt

SEQ ID NO: 1151836 - DNA, 22 bp, Artificial Sequence
  chemically synthesized
taagttgtctgttcattctgtt

SEQ ID NO: 1151837 - DNA, 22 bp, Artificial Sequence
  chemically synthesized
tataagttgtctgttcattctg

SEQ ID NO: 1151838 - DNA, 22 bp, Artificial Sequence
  chemically synthesized
cattctataagttgtctgttca

SEQ ID NO: 1151839 - DNA, 22 bp, Artificial Sequence
  chemically synthesized
ccattctataagttgtctgttc

SEQ ID NO: 1151840 - DNA, 22 bp, Artificial Sequence
  chemically synthesized
tccattctataagttgtctgtt

SEQ ID NO: 1151841 - DNA, 22 bp, Artificial Sequence
  chemically synthesized
ttttccattctataagttgtct

SEQ ID NO: 1151842 - DNA, 22 bp, Artificial Sequence
  chemically synthesized
ggaattgttttccattctataa

SEQ ID NO: 1151843 - DNA, 22 bp, Artificial Sequence
  chemically synthesized
gatgtatagttcggaattgttt

SEQ ID NO: 1151844 - DNA, 22 bp, Artificial Sequence
  chemically synthesized
atagaatggaaaacaattccga

SEQ ID NO: 1151845 - DNA, 22 bp, Artificial Sequence
  chemically synthesized
tagaatggaaaacaattccgaa

SEQ ID NO: 1151846 - DNA, 22 bp, Artificial Sequence
  chemically synthesized
ttagatgtatagttcggaattg

SEQ ID NO: 1151847 - DNA, 22 bp, Artificial Sequence
  chemically synthesized
gttagatgtatagttcggaatt

SEQ ID NO: 1151848 - DNA, 22 bp, Artificial Sequence
  chemically synthesized
tgttagatgtatagttcggaat

SEQ ID NO: 1151849 - DNA, 22 bp, Artificial Sequence
  chemically synthesized
ttgttagatgtatagttcggaa

SEQ ID NO: 1151850 - DNA, 22 bp, Artificial Sequence
  chemically synthesized
tttgttagatgtatagttcgga

SEQ ID NO: 1151851 - DNA, 22 bp, Artificial Sequence
  chemically synthesized
gttttttgttagatgtatagtt

SEQ ID NO: 1151852 - DNA, 22 bp, Artificial Sequence
  chemically synthesized
gatattagttttttgttagatg

SEQ ID NO: 1151853 - DNA, 22 bp, Artificial Sequence
  chemically synthesized
tagatattagttttttgttaga

SEQ ID NO: 1151854 - DNA, 22 bp, Artificial Sequence
  chemically synthesized
cgaactatacatctaacaaaaa

SEQ ID NO: 1151855 - DNA, 22 bp, Artificial Sequence
  chemically synthesized
gattctagatattagttttttg

SEQ ID NO: 1151856 - DNA, 22 bp, Artificial Sequence
  chemically synthesized
agattctagatattagtttttt

SEQ ID NO: 1151857 - DNA, 22 bp, Artificial Sequence
  chemically synthesized
tagattctagatattagttttt

SEQ ID NO: 1151858 - DNA, 22 bp, Artificial Sequence
  chemically synthesized
tacatctaacaaaaaactaata

SEQ ID NO: 1151859 - DNA, 22 bp, Artificial Sequence
  chemically synthesized
ttagattctagatattagtttt

SEQ ID NO: 1151860 - DNA, 22 bp, Artificial Sequence
  chemically synthesized
cttttagattctagatattagt

SEQ ID NO: 1151861 - DNA, 22 bp, Artificial Sequence
  chemically synthesized
acaaaaaactaatatctagaat

SEQ ID NO: 1151862 - DNA, 22 bp, Artificial Sequence
  chemically synthesized
agttacttttagattctagata

SEQ ID NO: 1151863 - DNA, 22 bp, Artificial Sequence
  chemically synthesized
ttgagttacttttagattctag

SEQ ID NO: 1151864 - DNA, 22 bp, Artificial Sequence
  chemically synthesized
gttgagttacttttagattcta

SEQ ID NO: 1151865 - DNA, 22 bp, Artificial Sequence
  chemically synthesized
ttgttgagttacttttagattc

SEQ ID NO: 1151866 - DNA, 22 bp, Artificial Sequence
  chemically synthesized
cttgttgagttacttttagatt

SEQ ID NO: 1151867 - DNA, 22 bp, Artificial Sequence
  chemically synthesized
ttcttgttgagttacttttaga

SEQ ID NO: 1151868 - DNA, 22 bp, Artificial Sequence
  chemically synthesized
cttcttgttgagttacttttag

SEQ ID NO: 1151869 - DNA, 22 bp, Artificial Sequence
  chemically synthesized
atatctagaatctaaaagtaac

SEQ ID NO: 1151870 - DNA, 22 bp, Artificial Sequence
  chemically synthesized
tcttcttgttgagttactttta

SEQ ID NO: 1151871 - DNA, 22 bp, Artificial Sequence
  chemically synthesized
ttcttcttgttgagttactttt

SEQ ID NO: 1151872 - DNA, 22 bp, Artificial Sequence
  chemically synthesized
tttttcttcttgttgagttact

SEQ ID NO: 1151873 - DNA, 22 bp, Artificial Sequence
  chemically synthesized
gaatctaaaagtaactcaacaa

SEQ ID NO: 1151874 - DNA, 22 bp, Artificial Sequence
  chemically synthesized
tctatttttcttcttgttgagt

SEQ ID NO: 1151875 - DNA, 22 bp, Artificial Sequence
  chemically synthesized
aaagtaactcaacaagaagaaa

SEQ ID NO: 1151876 - DNA, 22 bp, Artificial Sequence
  chemically synthesized
atggggttatctatttttcttc

SEQ ID NO: 1151877 - DNA, 22 bp, Artificial Sequence
  chemically synthesized
aatggggttatctatttttctt

SEQ ID NO: 1151878 - DNA, 22 bp, Artificial Sequence
  chemically synthesized
taatggggttatctatttttct

SEQ ID NO: 1151879 - DNA, 22 bp, Artificial Sequence
  chemically synthesized
ttaatggggttatctatttttc

SEQ ID NO: 1151880 - DNA, 22 bp, Artificial Sequence
  chemically synthesized
tttaatggggttatctattttt

SEQ ID NO: 1151881 - DNA, 22 bp, Artificial Sequence
  chemically synthesized
aacaagaagaaaaatagataac

SEQ ID NO: 1151882 - DNA, 22 bp, Artificial Sequence
  chemically synthesized
ctttttaatggggttatctatt

SEQ ID NO: 1151883 - DNA, 22 bp, Artificial Sequence
  chemically synthesized
cctactttttaatggggttatc

SEQ ID NO: 1151884 - DNA, 22 bp, Artificial Sequence
  chemically synthesized
gcctactttttaatggggttat

SEQ ID NO: 1151885 - DNA, 22 bp, Artificial Sequence
  chemically synthesized
tgcctactttttaatggggtta

SEQ ID NO: 1151886 - DNA, 22 bp, Artificial Sequence
  chemically synthesized
atgtcctttgcctactttttaa

SEQ ID NO: 1151887 - DNA, 22 bp, Artificial Sequence
  chemically synthesized
ctaatgtcctttgcctactttt

SEQ ID NO: 1151888 - DNA, 22 bp, Artificial Sequence
  chemically synthesized
aaaaatgtctgctaatgtcctt

SEQ ID NO: 1151889 - DNA, 22 bp, Artificial Sequence
  chemically synthesized
aaaagtaggcaaaggacattag

SEQ ID NO: 1151890 - DNA, 22 bp, Artificial Sequence
  chemically synthesized
aaaaaatgtctgctaatgtcct

SEQ ID NO: 1151891 - DNA, 22 bp, Artificial Sequence
  chemically synthesized
taaaaaatgtctgctaatgtcc

SEQ ID NO: 1151892 - DNA, 22 bp, Artificial Sequence
  chemically synthesized
ttaaaaaatgtctgctaatgtc

SEQ ID NO: 1151893 - DNA, 22 bp, Artificial Sequence
  chemically synthesized
ttttaaaaaatgtctgctaatg

SEQ ID NO: 1151894 - DNA, 22 bp, Artificial Sequence
  chemically synthesized
cttttaaaaaatgtctgctaat

SEQ ID NO: 1151895 - DNA, 22 bp, Artificial Sequence
  chemically synthesized
tatatcttcttttaaaaaatgt

SEQ ID NO: 1151896 - DNA, 22 bp, Artificial Sequence
  chemically synthesized
gtatatcttcttttaaaaaatg

SEQ ID NO: 1151897 - DNA, 22 bp, Artificial Sequence
  chemically synthesized
gcagacattttttaaaagaaga

SEQ ID NO: 1151898 - DNA, 22 bp, Artificial Sequence
  chemically synthesized
gccacttgtatatcttctttta

SEQ ID NO: 1151899 - DNA, 22 bp, Artificial Sequence
  chemically synthesized
ttggccacttgtatatcttctt

SEQ ID NO: 1151900 - DNA, 22 bp, Artificial Sequence
  chemically synthesized
gttggccacttgtatatcttct

SEQ ID NO: 1151901 - DNA, 22 bp, Artificial Sequence
  chemically synthesized
tttaaaagaagatatacaagtg

SEQ ID NO: 1151902 - DNA, 22 bp, Artificial Sequence
  chemically synthesized
ttaaaagaagatatacaagtgg

SEQ ID NO: 1151903 - DNA, 22 bp, Artificial Sequence
  chemically synthesized
taaaagaagatatacaagtggc

SEQ ID NO: 1151904 - DNA, 22 bp, Artificial Sequence
  chemically synthesized
atatgtttgttggccacttgta

SEQ ID NO: 1151905 - DNA, 22 bp, Artificial Sequence
  chemically synthesized
aaaagaagatatacaagtggcc

SEQ ID NO: 1151906 - DNA, 22 bp, Artificial Sequence
  chemically synthesized
aaagaagatatacaagtggcca

SEQ ID NO: 1151907 - DNA, 22 bp, Artificial Sequence
  chemically synthesized
tcatatgtttgttggccacttg

SEQ ID NO: 1151908 - DNA, 22 bp, Artificial Sequence
  chemically synthesized
ctcatatgtttgttggccactt

SEQ ID NO: 1151909 - DNA, 22 bp, Artificial Sequence
  chemically synthesized
tctcatatgtttgttggccact

SEQ ID NO: 1151910 - DNA, 22 bp, Artificial Sequence
  chemically synthesized
agcattttctcatatgtttgtt

SEQ ID NO: 1151911 - DNA, 22 bp, Artificial Sequence
  chemically synthesized
gtgatgttgagcattttctcat

SEQ ID NO: 1151912 - DNA, 22 bp, Artificial Sequence
  chemically synthesized
atgattagtgatgttgagcatt

SEQ ID NO: 1151913 - DNA, 22 bp, Artificial Sequence
  chemically synthesized
tgatgattagtgatgttgagca

SEQ ID NO: 1151914 - DNA, 22 bp, Artificial Sequence
  chemically synthesized
tctgatgattagtgatgttgag

SEQ ID NO: 1151915 - DNA, 22 bp, Artificial Sequence
  chemically synthesized
ctctgatgattagtgatgttga

SEQ ID NO: 1151916 - DNA, 22 bp, Artificial Sequence
  chemically synthesized
catttctctgatgattagtgat

SEQ ID NO: 1151917 - DNA, 22 bp, Artificial Sequence
  chemically synthesized
gcatttctctgatgattagtga

SEQ ID NO: 1151918 - DNA, 22 bp, Artificial Sequence
  chemically synthesized
atttgcatttctctgatgatta

SEQ ID NO: 1151919 - DNA, 22 bp, Artificial Sequence
  chemically synthesized
aatttgcatttctctgatgatt

SEQ ID NO: 1151920 - DNA, 22 bp, Artificial Sequence
  chemically synthesized
taatttgcatttctctgatgat

SEQ ID NO: 1151921 - DNA, 22 bp, Artificial Sequence
  chemically synthesized
aacatcactaatcatcagagaa

SEQ ID NO: 1151922 - DNA, 22 bp, Artificial Sequence
  chemically synthesized
tggttttaatttgcatttctct

SEQ ID NO: 1151923 - DNA, 22 bp, Artificial Sequence
  chemically synthesized
gtggttttaatttgcatttctc

SEQ ID NO: 1151924 - DNA, 22 bp, Artificial Sequence
  chemically synthesized
cttgtggttttaatttgcattt

SEQ ID NO: 1151925 - DNA, 22 bp, Artificial Sequence
  chemically synthesized
atcatcagagaaatgcaaatta

SEQ ID NO: 1151926 - DNA, 22 bp, Artificial Sequence
  chemically synthesized
gtgtgagatcatatctccttgt

SEQ ID NO: 1151927 - DNA, 22 bp, Artificial Sequence
  chemically synthesized
attggtgtgagatcatatctcc

SEQ ID NO: 1151928 - DNA, 22 bp, Artificial Sequence
  chemically synthesized
aaaccacaaggagatatgatct

SEQ ID NO: 1151929 - DNA, 22 bp, Artificial Sequence
  chemically synthesized
aaaaaaacaaataatagccata

SEQ ID NO: 1151930 - DNA, 22 bp, Artificial Sequence
  chemically synthesized
acaccaatcagtatggctatta

SEQ ID NO: 1151931 - DNA, 22 bp, Artificial Sequence
  chemically synthesized
aatgacattgaaaaaaacaaat

SEQ ID NO: 1151932 - DNA, 22 bp, Artificial Sequence
  chemically synthesized
aaatgacattgaaaaaaacaaa

SEQ ID NO: 1151933 - DNA, 22 bp, Artificial Sequence
  chemically synthesized
taaatgacattgaaaaaaacaa

SEQ ID NO: 1151934 - DNA, 22 bp, Artificial Sequence
  chemically synthesized
ttaaatgacattgaaaaaaaca

SEQ ID NO: 1151935 - DNA, 22 bp, Artificial Sequence
  chemically synthesized
ttatttgtttttttcaatgtca

SEQ ID NO: 1151936 - DNA, 22 bp, Artificial Sequence
  chemically synthesized
tttgtttttttcaatgtcattt

SEQ ID NO: 1151937 - DNA, 22 bp, Artificial Sequence
  chemically synthesized
gtttttttcaatgtcatttaaa

SEQ ID NO: 1151938 - DNA, 22 bp, Artificial Sequence
  chemically synthesized
tacccacaaatttttaaatgac

SEQ ID NO: 1151939 - DNA, 22 bp, Artificial Sequence
  chemically synthesized
tttttttcaatgtcatttaaaa

SEQ ID NO: 1151940 - DNA, 22 bp, Artificial Sequence
  chemically synthesized
tgtacccacaaatttttaaatg

SEQ ID NO: 1151941 - DNA, 22 bp, Artificial Sequence
  chemically synthesized
ttttcaatgtcatttaaaaatt

SEQ ID NO: 1151942 - DNA, 22 bp, Artificial Sequence
  chemically synthesized
tttcaatgtcatttaaaaattt

SEQ ID NO: 1151943 - DNA, 22 bp, Artificial Sequence
  chemically synthesized
ctctgtacccacaaatttttaa

SEQ ID NO: 1151944 - DNA, 22 bp, Artificial Sequence
  chemically synthesized
ttcaatgtcatttaaaaatttg

SEQ ID NO: 1151945 - DNA, 22 bp, Artificial Sequence
  chemically synthesized
tcaatgtcatttaaaaatttgt

SEQ ID NO: 1151946 - DNA, 22 bp, Artificial Sequence
  chemically synthesized
caatgtcatttaaaaatttgtg

SEQ ID NO: 1151947 - DNA, 22 bp, Artificial Sequence
  chemically synthesized
aatgtcatttaaaaatttgtgg

SEQ ID NO: 1151948 - DNA, 22 bp, Artificial Sequence
  chemically synthesized
aaaaatttgtgggtacagagta

SEQ ID NO: 1151949 - DNA, 22 bp, Artificial Sequence
  chemically synthesized
aaaatttgtgggtacagagtag

SEQ ID NO: 1151950 - DNA, 22 bp, Artificial Sequence
  chemically synthesized
gtgggtacagagtaggtgtatt

SEQ ID NO: 1151951 - DNA, 22 bp, Artificial Sequence
  chemically synthesized
atgtaccccacaaatacaccta

SEQ ID NO: 1151952 - DNA, 22 bp, Artificial Sequence
  chemically synthesized
tgggtacagagtaggtgtattt

SEQ ID NO: 1151953 - DNA, 22 bp, Artificial Sequence
  chemically synthesized
tatcaaaacatctcatgtaccc

SEQ ID NO: 1151954 - DNA, 22 bp, Artificial Sequence
  chemically synthesized
catgcctgtatcaaaacatctc

SEQ ID NO: 1151955 - DNA, 22 bp, Artificial Sequence
  chemically synthesized
gtggggtacatgagatgttttg

SEQ ID NO: 1151956 - DNA, 22 bp, Artificial Sequence
  chemically synthesized
gcatgcctgtatcaaaacatct

SEQ ID NO: 1151957 - DNA, 22 bp, Artificial Sequence
  chemically synthesized
tggggtacatgagatgttttga

SEQ ID NO: 1151958 - DNA, 22 bp, Artificial Sequence
  chemically synthesized
tgcatgcctgtatcaaaacatc

SEQ ID NO: 1151959 - DNA, 22 bp, Artificial Sequence
  chemically synthesized
actttgcatgcctgtatcaaaa

SEQ ID NO: 1151960 - DNA, 22 bp, Artificial Sequence
  chemically synthesized
cactttgcatgcctgtatcaaa

SEQ ID NO: 1151961 - DNA, 22 bp, Artificial Sequence
  chemically synthesized
tttcactttgcatgcctgtatc

SEQ ID NO: 1151962 - DNA, 22 bp, Artificial Sequence
  chemically synthesized
tgatacaggcatgcaaagtgaa

SEQ ID NO: 1151963 - DNA, 22 bp, Artificial Sequence
  chemically synthesized
gatacaggcatgcaaagtgaaa

SEQ ID NO: 1151964 - DNA, 22 bp, Artificial Sequence
  chemically synthesized
atacaggcatgcaaagtgaaat

SEQ ID NO: 1151965 - DNA, 22 bp, Artificial Sequence
  chemically synthesized
catgatgtgattatttcacttt

SEQ ID NO: 1151966 - DNA, 22 bp, Artificial Sequence
  chemically synthesized
tccatgatgtgattatttcact

SEQ ID NO: 1151967 - DNA, 22 bp, Artificial Sequence
  chemically synthesized
aattctccatgatgtgattatt

SEQ ID NO: 1151968 - DNA, 22 bp, Artificial Sequence
  chemically synthesized
aggtgatagatactaaattctc

SEQ ID NO: 1151969 - DNA, 22 bp, Artificial Sequence
  chemically synthesized
aaggtgatagatactaaattct

SEQ ID NO: 1151970 - DNA, 22 bp, Artificial Sequence
  chemically synthesized
agtatctatcaccttaagcatt

SEQ ID NO: 1151971 - DNA, 22 bp, Artificial Sequence
  chemically synthesized
gtatctatcaccttaagcattt

SEQ ID NO: 1151972 - DNA, 22 bp, Artificial Sequence
  chemically synthesized
taagacaaaggacaaatgctta

SEQ ID NO: 1151973 - DNA, 22 bp, Artificial Sequence
  chemically synthesized
gtaagacaaaggacaaatgctt

SEQ ID NO: 1151974 - DNA, 22 bp, Artificial Sequence
  chemically synthesized
cttgtaagacaaaggacaaatg

SEQ ID NO: 1151975 - DNA, 22 bp, Artificial Sequence
  chemically synthesized
tcaccttaagcatttgtccttt

SEQ ID NO: 1151976 - DNA, 22 bp, Artificial Sequence
  chemically synthesized
ggttgcttgtaagacaaaggac

SEQ ID NO: 1151977 - DNA, 22 bp, Artificial Sequence
  chemically synthesized
aagcatttgtcctttgtcttac

SEQ ID NO: 1151978 - DNA, 22 bp, Artificial Sequence
  chemically synthesized
agcatttgtcctttgtcttaca

SEQ ID NO: 1151979 - DNA, 22 bp, Artificial Sequence
  chemically synthesized
gtcctttgtcttacaagcaacc

SEQ ID NO: 1151980 - DNA, 22 bp, Artificial Sequence
  chemically synthesized
tcctttgtcttacaagcaacct

SEQ ID NO: 1151981 - DNA, 22 bp, Artificial Sequence
  chemically synthesized
tgaaagcatataattaggttgc

SEQ ID NO: 1151982 - DNA, 22 bp, Artificial Sequence
  chemically synthesized
tgtcttacaagcaacctaatta

SEQ ID NO: 1151983 - DNA, 22 bp, Artificial Sequence
  chemically synthesized
gtcttacaagcaacctaattat

SEQ ID NO: 1151984 - DNA, 22 bp, Artificial Sequence
  chemically synthesized
tcttacaagcaacctaattata

SEQ ID NO: 1151985 - DNA, 22 bp, Artificial Sequence
  chemically synthesized
acaagcaacctaattatatgct

SEQ ID NO: 1151986 - DNA, 22 bp, Artificial Sequence
  chemically synthesized
caagcaacctaattatatgctt

SEQ ID NO: 1151987 - DNA, 22 bp, Artificial Sequence
  chemically synthesized
caataactgtgaaagcatataa

SEQ ID NO: 1151988 - DNA, 22 bp, Artificial Sequence
  chemically synthesized
acaataactgtgaaagcatata

SEQ ID NO: 1151989 - DNA, 22 bp, Artificial Sequence
  chemically synthesized
tacaataactgtgaaagcatat

SEQ ID NO: 1151990 - DNA, 22 bp, Artificial Sequence
  chemically synthesized
tacattttacaataactgtgaa

SEQ ID NO: 1151991 - DNA, 22 bp, Artificial Sequence
  chemically synthesized
gtacattttacaataactgtga

SEQ ID NO: 1151992 - DNA, 22 bp, Artificial Sequence
  chemically synthesized
attatatgctttcacagttatt

SEQ ID NO: 1151993 - DNA, 22 bp, Artificial Sequence
  chemically synthesized
tatgctttcacagttattgtaa

SEQ ID NO: 1151994 - DNA, 22 bp, Artificial Sequence
  chemically synthesized
tcacagttattgtaaaatgtac

SEQ ID NO: 1151995 - DNA, 22 bp, Artificial Sequence
  chemically synthesized
cacagttattgtaaaatgtaca

SEQ ID NO: 1151996 - DNA, 22 bp, Artificial Sequence
  chemically synthesized
acagttattgtaaaatgtacaa

SEQ ID NO: 1151997 - DNA, 22 bp, Artificial Sequence
  chemically synthesized
tggtcaataataacttgtacat

SEQ ID NO: 1151998 - DNA, 22 bp, Artificial Sequence
  chemically synthesized
ttgtaaaatgtacaagttatta

SEQ ID NO: 1151999 - DNA, 22 bp, Artificial Sequence
  chemically synthesized
taaaatgtacaagttattattg

SEQ ID NO: 1152000 - DNA, 22 bp, Artificial Sequence
  chemically synthesized
atcatatcatacagtaactatg

SEQ ID NO: 1152001 - DNA, 22 bp, Artificial Sequence
  chemically synthesized
gatcatatcatacagtaactat

SEQ ID NO: 1152002 - DNA, 22 bp, Artificial Sequence
  chemically synthesized
ttattgaccatagttactgtat

SEQ ID NO: 1152003 - DNA, 22 bp, Artificial Sequence
  chemically synthesized
ttgaccatagttactgtatgat

SEQ ID NO: 1152004 - DNA, 22 bp, Artificial Sequence
  chemically synthesized
accatagttactgtatgatatg

SEQ ID NO: 1152005 - DNA, 22 bp, Artificial Sequence
  chemically synthesized
ctgtatgatatgatcaaatatt

SEQ ID NO: 1152006 - DNA, 22 bp, Artificial Sequence
  chemically synthesized
tatgatatgatcaaatattatg

SEQ ID NO: 1152007 - DNA, 22 bp, Artificial Sequence
  chemically synthesized
gaaagaatgaaaagacataata

SEQ ID NO: 1152008 - DNA, 22 bp, Artificial Sequence
  chemically synthesized
cagttagaaagaatgaaaagac

SEQ ID NO: 1152009 - DNA, 22 bp, Artificial Sequence
  chemically synthesized
tgtcttttcattctttctaact

SEQ ID NO: 1152010 - DNA, 22 bp, Artificial Sequence
  chemically synthesized
ggtacaaaaattacagttagaa

SEQ ID NO: 1152011 - DNA, 22 bp, Artificial Sequence
  chemically synthesized
ttgggtacaaaaattacagtta

SEQ ID NO: 1152012 - DNA, 22 bp, Artificial Sequence
  chemically synthesized
ttcattctttctaactgtaatt

SEQ ID NO: 1152013 - DNA, 22 bp, Artificial Sequence
  chemically synthesized
tcattctttctaactgtaattt

SEQ ID NO: 1152014 - DNA, 22 bp, Artificial Sequence
  chemically synthesized
cattctttctaactgtaatttt

SEQ ID NO: 1152015 - DNA, 22 bp, Artificial Sequence
  chemically synthesized
attctttctaactgtaattttt

SEQ ID NO: 1152016 - DNA, 22 bp, Artificial Sequence
  chemically synthesized
tttctaactgtaatttttgtac

SEQ ID NO: 1152017 - DNA, 22 bp, Artificial Sequence
  chemically synthesized
tctaactgtaatttttgtaccc

SEQ ID NO: 1152018 - DNA, 22 bp, Artificial Sequence
  chemically synthesized
ctaactgtaatttttgtaccca

SEQ ID NO: 1152019 - DNA, 22 bp, Artificial Sequence
  chemically synthesized
taactgtaatttttgtacccaa

SEQ ID NO: 1152020 - DNA, 22 bp, Artificial Sequence
  chemically synthesized
actgtaatttttgtacccaata

SEQ ID NO: 1152021 - DNA, 22 bp, Artificial Sequence
  chemically synthesized
taatttttgtacccaataacca

SEQ ID NO: 1152022 - DNA, 22 bp, Artificial Sequence
  chemically synthesized
ttgtacccaataaccatcccca

SEQ ID NO: 1152023 - DNA, 22 bp, Artificial Sequence
  chemically synthesized
tgtacccaataaccatccccac

SEQ ID NO: 1152024 - DNA, 22 bp, Artificial Sequence
  chemically synthesized
gtacccaataaccatccccacc

SEQ ID NO: 1152025 - DNA, 22 bp, Artificial Sequence
  chemically synthesized
tacccaataaccatccccacct

SEQ ID NO: 1152026 - DNA, 22 bp, Artificial Sequence
  chemically synthesized
ggaagggtggtggaagggaggt

SEQ ID NO: 1152027 - DNA, 22 bp, Artificial Sequence
  chemically synthesized
tcagagactgggaagggtggtg

SEQ ID NO: 1152028 - DNA, 22 bp, Artificial Sequence
  chemically synthesized
ccttccaccacccttcccagtc

SEQ ID NO: 1152029 - DNA, 22 bp, Artificial Sequence
  chemically synthesized
ccaccacccttcccagtctctg

SEQ ID NO: 1152030 - DNA, 22 bp, Artificial Sequence
  chemically synthesized
caccacccttcccagtctctga

SEQ ID NO: 1152031 - DNA, 22 bp, Artificial Sequence
  chemically synthesized
cccagtctctgataaccatcct

SEQ ID NO: 1152032 - DNA, 22 bp, Artificial Sequence
  chemically synthesized
ccagtctctgataaccatcctt

SEQ ID NO: 1152033 - DNA, 22 bp, Artificial Sequence
  chemically synthesized
tgataaccatccttctactctc

SEQ ID NO: 1152034 - DNA, 22 bp, Artificial Sequence
  chemically synthesized
ataaccatccttctactctcta

SEQ ID NO: 1152035 - DNA, 22 bp, Artificial Sequence
  chemically synthesized
aagtcatggaaatagagagtag

SEQ ID NO: 1152036 - DNA, 22 bp, Artificial Sequence
  chemically synthesized
aaacaattgaagtcatggaaat

SEQ ID NO: 1152037 - DNA, 22 bp, Artificial Sequence
  chemically synthesized
ctactctctatttccatgactt

SEQ ID NO: 1152038 - DNA, 22 bp, Artificial Sequence
  chemically synthesized
tactctctatttccatgacttc

SEQ ID NO: 1152039 - DNA, 22 bp, Artificial Sequence
  chemically synthesized
ctctctatttccatgacttcaa

SEQ ID NO: 1152040 - DNA, 22 bp, Artificial Sequence
  chemically synthesized
aaaattaaaacaattgaagtca

SEQ ID NO: 1152041 - DNA, 22 bp, Artificial Sequence
  chemically synthesized
tctatttccatgacttcaattg

SEQ ID NO: 1152042 - DNA, 22 bp, Artificial Sequence
  chemically synthesized
tatttccatgacttcaattgtt

SEQ ID NO: 1152043 - DNA, 22 bp, Artificial Sequence
  chemically synthesized
tttccatgacttcaattgtttt

SEQ ID NO: 1152044 - DNA, 22 bp, Artificial Sequence
  chemically synthesized
ccatgacttcaattgttttaat

SEQ ID NO: 1152045 - DNA, 22 bp, Artificial Sequence
  chemically synthesized
tgggatctaaaaattaaaacaa

SEQ ID NO: 1152046 - DNA, 22 bp, Artificial Sequence
  chemically synthesized
catgacttcaattgttttaatt

SEQ ID NO: 1152047 - DNA, 22 bp, Artificial Sequence
  chemically synthesized
gtgggatctaaaaattaaaaca

SEQ ID NO: 1152048 - DNA, 22 bp, Artificial Sequence
  chemically synthesized
tttgtgggatctaaaaattaaa

SEQ ID NO: 1152049 - DNA, 22 bp, Artificial Sequence
  chemically synthesized
atttgtgggatctaaaaattaa

SEQ ID NO: 1152050 - DNA, 22 bp, Artificial Sequence
  chemically synthesized
caattgttttaatttttagatc

SEQ ID NO: 1152051 - DNA, 22 bp, Artificial Sequence
  chemically synthesized
acttatttgtgggatctaaaaa

SEQ ID NO: 1152052 - DNA, 22 bp, Artificial Sequence
  chemically synthesized
aattgttttaatttttagatcc

SEQ ID NO: 1152053 - DNA, 22 bp, Artificial Sequence
  chemically synthesized
tgacttatttgtgggatctaaa

SEQ ID NO: 1152054 - DNA, 22 bp, Artificial Sequence
  chemically synthesized
ttttaatttttagatcccacaa

SEQ ID NO: 1152055 - DNA, 22 bp, Artificial Sequence
  chemically synthesized
tgttctgacttatttgtgggat

SEQ ID NO: 1152056 - DNA, 22 bp, Artificial Sequence
  chemically synthesized
atgttctgacttatttgtggga

SEQ ID NO: 1152057 - DNA, 22 bp, Artificial Sequence
  chemically synthesized
taatttttagatcccacaaata

SEQ ID NO: 1152058 - DNA, 22 bp, Artificial Sequence
  chemically synthesized
aatttttagatcccacaaataa

SEQ ID NO: 1152059 - DNA, 22 bp, Artificial Sequence
  chemically synthesized
ttatgttctgacttatttgtgg

SEQ ID NO: 1152060 - DNA, 22 bp, Artificial Sequence
  chemically synthesized
atttttagatcccacaaataag

SEQ ID NO: 1152061 - DNA, 22 bp, Artificial Sequence
  chemically synthesized
ttagatcccacaaataagtcag

SEQ ID NO: 1152062 - DNA, 22 bp, Artificial Sequence
  chemically synthesized
tagatcccacaaataagtcaga

SEQ ID NO: 1152063 - DNA, 22 bp, Artificial Sequence
  chemically synthesized
agatcccacaaataagtcagaa

SEQ ID NO: 1152064 - DNA, 22 bp, Artificial Sequence
  chemically synthesized
gatcccacaaataagtcagaac

SEQ ID NO: 1152065 - DNA, 22 bp, Artificial Sequence
  chemically synthesized
agtgaaataagccaggcacaga

SEQ ID NO: 1152066 - DNA, 22 bp, Artificial Sequence
  chemically synthesized
tgttaagtgaaataagccaggc

SEQ ID NO: 1152067 - DNA, 22 bp, Artificial Sequence
  chemically synthesized
gtctttctgtgcctggcttatt

SEQ ID NO: 1152068 - DNA, 22 bp, Artificial Sequence
  chemically synthesized
tctttctgtgcctggcttattt

SEQ ID NO: 1152069 - DNA, 22 bp, Artificial Sequence
  chemically synthesized
tctgtgcctggcttatttcact

SEQ ID NO: 1152070 - DNA, 22 bp, Artificial Sequence
  chemically synthesized
ctgtgcctggcttatttcactt

SEQ ID NO: 1152071 - DNA, 22 bp, Artificial Sequence
  chemically synthesized
tgtgcctggcttatttcactta

SEQ ID NO: 1152072 - DNA, 22 bp, Artificial Sequence
  chemically synthesized
gagatcgttatgttaagtgaaa

SEQ ID NO: 1152073 - DNA, 22 bp, Artificial Sequence
  chemically synthesized
tgcctggcttatttcacttaac

SEQ ID NO: 1152074 - DNA, 22 bp, Artificial Sequence
  chemically synthesized
gcttatttcacttaacataacg

SEQ ID NO: 1152075 - DNA, 22 bp, Artificial Sequence
  chemically synthesized
atttcacttaacataacgatct

SEQ ID NO: 1152076 - DNA, 22 bp, Artificial Sequence
  chemically synthesized
tttcacttaacataacgatctc

SEQ ID NO: 1152077 - DNA, 22 bp, Artificial Sequence
  chemically synthesized
cacttaacataacgatctctag

SEQ ID NO: 1152078 - DNA, 22 bp, Artificial Sequence
  chemically synthesized
acttaacataacgatctctagt

SEQ ID NO: 1152079 - DNA, 22 bp, Artificial Sequence
  chemically synthesized
aacataacgatctctagttcca

SEQ ID NO: 1152080 - DNA, 22 bp, Artificial Sequence
  chemically synthesized
gaacaatgtggatggaactaga

SEQ ID NO: 1152081 - DNA, 22 bp, Artificial Sequence
  chemically synthesized
acataacgatctctagttccat

SEQ ID NO: 1152082 - DNA, 22 bp, Artificial Sequence
  chemically synthesized
ggaacaatgtggatggaactag

SEQ ID NO: 1152083 - DNA, 22 bp, Artificial Sequence
  chemically synthesized
tcatttggaacaatgtggatgg

SEQ ID NO: 1152084 - DNA, 22 bp, Artificial Sequence
  chemically synthesized
tagttccatccacattgttcca

SEQ ID NO: 1152085 - DNA, 22 bp, Artificial Sequence
  chemically synthesized
gttccatccacattgttccaaa

SEQ ID NO: 1152086 - DNA, 22 bp, Artificial Sequence
  chemically synthesized
catccacattgttccaaatgac

SEQ ID NO: 1152087 - DNA, 22 bp, Artificial Sequence
  chemically synthesized
aaaaaatgagatactgtcattt

SEQ ID NO: 1152088 - DNA, 22 bp, Artificial Sequence
  chemically synthesized
aaaaaaatgagatactgtcatt

SEQ ID NO: 1152089 - DNA, 22 bp, Artificial Sequence
  chemically synthesized
ttccaaatgacagtatctcatt

SEQ ID NO: 1152090 - DNA, 22 bp, Artificial Sequence
  chemically synthesized
caaatgacagtatctcattttt

SEQ ID NO: 1152091 - DNA, 22 bp, Artificial Sequence
  chemically synthesized
atgacaggtatccccttaaaaa

SEQ ID NO: 1152092 - DNA, 22 bp, Artificial Sequence
  chemically synthesized
aatgacaggtatccccttaaaa

SEQ ID NO: 1152093 - DNA, 22 bp, Artificial Sequence
  chemically synthesized
taatgacaggtatccccttaaa

SEQ ID NO: 1152094 - DNA, 22 bp, Artificial Sequence
  chemically synthesized
ttaatgacaggtatccccttaa

SEQ ID NO: 1152095 - DNA, 22 bp, Artificial Sequence
  chemically synthesized
tttaatgacaggtatcccctta

SEQ ID NO: 1152096 - DNA, 22 bp, Artificial Sequence
  chemically synthesized
ttttaatgacaggtatcccctt

SEQ ID NO: 1152097 - DNA, 22 bp, Artificial Sequence
  chemically synthesized
atttttttaaggggatacctgt

SEQ ID NO: 1152098 - DNA, 22 bp, Artificial Sequence
  chemically synthesized
acttttttaatgacaggtatcc

SEQ ID NO: 1152099 - DNA, 22 bp, Artificial Sequence
  chemically synthesized
gacttttttaatgacaggtatc

SEQ ID NO: 1152100 - DNA, 22 bp, Artificial Sequence
  chemically synthesized
ttttaaggggatacctgtcatt

SEQ ID NO: 1152101 - DNA, 22 bp, Artificial Sequence
  chemically synthesized
tttgacttttttaatgacaggt

SEQ ID NO: 1152102 - DNA, 22 bp, Artificial Sequence
  chemically synthesized
tttaaggggatacctgtcatta

SEQ ID NO: 1152103 - DNA, 22 bp, Artificial Sequence
  chemically synthesized
ttaaggggatacctgtcattaa

SEQ ID NO: 1152104 - DNA, 22 bp, Artificial Sequence
  chemically synthesized
taaggggatacctgtcattaaa

SEQ ID NO: 1152105 - DNA, 22 bp, Artificial Sequence
  chemically synthesized
ttgtttgacttttttaatgaca

SEQ ID NO: 1152106 - DNA, 22 bp, Artificial Sequence
  chemically synthesized
aaggggatacctgtcattaaaa

SEQ ID NO: 1152107 - DNA, 22 bp, Artificial Sequence
  chemically synthesized
aggggatacctgtcattaaaaa

SEQ ID NO: 1152108 - DNA, 22 bp, Artificial Sequence
  chemically synthesized
ttgttgtttgacttttttaatg

SEQ ID NO: 1152109 - DNA, 22 bp, Artificial Sequence
  chemically synthesized
ccaacacctgttgttgtttgac

SEQ ID NO: 1152110 - DNA, 22 bp, Artificial Sequence
  chemically synthesized
tcattaaaaaagtcaaacaaca

SEQ ID NO: 1152111 - DNA, 22 bp, Artificial Sequence
  chemically synthesized
gccaacacctgttgttgtttga

SEQ ID NO: 1152112 - DNA, 22 bp, Artificial Sequence
  chemically synthesized
aaaaagtcaaacaacaacaggt

SEQ ID NO: 1152113 - DNA, 22 bp, Artificial Sequence
  chemically synthesized
cacatccttgccaacacctgtt

SEQ ID NO: 1152114 - DNA, 22 bp, Artificial Sequence
  chemically synthesized
tccacatccttgccaacacctg

SEQ ID NO: 1152115 - DNA, 22 bp, Artificial Sequence
  chemically synthesized
ctccacatccttgccaacacct

SEQ ID NO: 1152116 - DNA, 22 bp, Artificial Sequence
  chemically synthesized
tctccacatccttgccaacacc

SEQ ID NO: 1152117 - DNA, 22 bp, Artificial Sequence
  chemically synthesized
ttctccacatccttgccaacac

SEQ ID NO: 1152118 - DNA, 22 bp, Artificial Sequence
  chemically synthesized
ttttctccacatccttgccaac

SEQ ID NO: 1152119 - DNA, 22 bp, Artificial Sequence
  chemically synthesized
cttttctccacatccttgccaa

SEQ ID NO: 1152120 - DNA, 22 bp, Artificial Sequence
  chemically synthesized
tcttttctccacatccttgcca

SEQ ID NO: 1152121 - DNA, 22 bp, Artificial Sequence
  chemically synthesized
gcaaggatgtggagaaaagaaa

SEQ ID NO: 1152122 - DNA, 22 bp, Artificial Sequence
  chemically synthesized
ccaccaagagtgaataaacatt

SEQ ID NO: 1152123 - DNA, 22 bp, Artificial Sequence
  chemically synthesized
cattcccaccaagagtgaataa

SEQ ID NO: 1152124 - DNA, 22 bp, Artificial Sequence
  chemically synthesized
acattcccaccaagagtgaata

SEQ ID NO: 1152125 - DNA, 22 bp, Artificial Sequence
  chemically synthesized
acttacattcccaccaagagtg

SEQ ID NO: 1152126 - DNA, 22 bp, Artificial Sequence
  chemically synthesized
tattaacttacattcccaccaa

SEQ ID NO: 1152127 - DNA, 22 bp, Artificial Sequence
  chemically synthesized
atattaacttacattcccacca

SEQ ID NO: 1152128 - DNA, 22 bp, Artificial Sequence
  chemically synthesized
attcactcttggtgggaatgta

SEQ ID NO: 1152129 - DNA, 22 bp, Artificial Sequence
  chemically synthesized
ttcactcttggtgggaatgtaa

SEQ ID NO: 1152130 - DNA, 22 bp, Artificial Sequence
  chemically synthesized
actcttggtgggaatgtaagtt

SEQ ID NO: 1152131 - DNA, 22 bp, Artificial Sequence
  chemically synthesized
cataatgtttatattaacttac

SEQ ID NO: 1152132 - DNA, 22 bp, Artificial Sequence
  chemically synthesized
ttggtgggaatgtaagttaata

SEQ ID NO: 1152133 - DNA, 22 bp, Artificial Sequence
  chemically synthesized
acataatgtttatattaactta

SEQ ID NO: 1152134 - DNA, 22 bp, Artificial Sequence
  chemically synthesized
tacataatgtttatattaactt

SEQ ID NO: 1152135 - DNA, 22 bp, Artificial Sequence
  chemically synthesized
ggtgggaatgtaagttaatata

SEQ ID NO: 1152136 - DNA, 22 bp, Artificial Sequence
  chemically synthesized
gtgggaatgtaagttaatataa

SEQ ID NO: 1152137 - DNA, 22 bp, Artificial Sequence
  chemically synthesized
ttttacataatgtttatattaa

SEQ ID NO: 1152138 - DNA, 22 bp, Artificial Sequence
  chemically synthesized
catactgttttacataatgttt

SEQ ID NO: 1152139 - DNA, 22 bp, Artificial Sequence
  chemically synthesized
atataaacattatgtaaaacag

SEQ ID NO: 1152140 - DNA, 22 bp, Artificial Sequence
  chemically synthesized
agaaatctccatactgttttac

SEQ ID NO: 1152141 - DNA, 22 bp, Artificial Sequence
  chemically synthesized
gagaaatctccatactgtttta

SEQ ID NO: 1152142 - DNA, 22 bp, Artificial Sequence
  chemically synthesized
tgagaaatctccatactgtttt

SEQ ID NO: 1152143 - DNA, 22 bp, Artificial Sequence
  chemically synthesized
tttgagaaatctccatactgtt

SEQ ID NO: 1152144 - DNA, 22 bp, Artificial Sequence
  chemically synthesized
agttctttgagaaatctccata

SEQ ID NO: 1152145 - DNA, 22 bp, Artificial Sequence
  chemically synthesized
aagttctttgagaaatctccat

SEQ ID NO: 1152146 - DNA, 22 bp, Artificial Sequence
  chemically synthesized
tgtaaaacagtatggagatttc

SEQ ID NO: 1152147 - DNA, 22 bp, Artificial Sequence
  chemically synthesized
taagttctttgagaaatctcca

SEQ ID NO: 1152148 - DNA, 22 bp, Artificial Sequence
  chemically synthesized
tgttttaagttctttgagaaat

SEQ ID NO: 1152149 - DNA, 22 bp, Artificial Sequence
  chemically synthesized
ctcaaagaacttaaaacacaac

SEQ ID NO: 1152150 - DNA, 22 bp, Artificial Sequence
  chemically synthesized
caggatccaatagttgtgtttt

SEQ ID NO: 1152151 - DNA, 22 bp, Artificial Sequence
  chemically synthesized
tcaaagaacttaaaacacaact

SEQ ID NO: 1152152 - DNA, 22 bp, Artificial Sequence
  chemically synthesized
aaagaacttaaaacacaactat

SEQ ID NO: 1152153 - DNA, 22 bp, Artificial Sequence
  chemically synthesized
ggattgcaggatccaatagttg

SEQ ID NO: 1152154 - DNA, 22 bp, Artificial Sequence
  chemically synthesized
aaaacacaactattggatcctg

SEQ ID NO: 1152155 - DNA, 22 bp, Artificial Sequence
  chemically synthesized
aaacacaactattggatcctgc

SEQ ID NO: 1152156 - DNA, 22 bp, Artificial Sequence
  chemically synthesized
ttggatcctgcaatcctagtac

SEQ ID NO: 1152157 - DNA, 22 bp, Artificial Sequence
  chemically synthesized
agtatatacccagtactaggat

SEQ ID NO: 1152158 - DNA, 22 bp, Artificial Sequence
  chemically synthesized
gatcctgcaatcctagtactgg

SEQ ID NO: 1152159 - DNA, 22 bp, Artificial Sequence
  chemically synthesized
ttgagtatatacccagtactag

SEQ ID NO: 1152160 - DNA, 22 bp, Artificial Sequence
  chemically synthesized
gttgagtatatacccagtacta

SEQ ID NO: 1152161 - DNA, 22 bp, Artificial Sequence
  chemically synthesized
tgttgagtatatacccagtact

SEQ ID NO: 1152162 - DNA, 22 bp, Artificial Sequence
  chemically synthesized
ttgttgagtatatacccagtac

SEQ ID NO: 1152163 - DNA, 22 bp, Artificial Sequence
  chemically synthesized
tttttgttgagtatatacccag

SEQ ID NO: 1152164 - DNA, 22 bp, Artificial Sequence
  chemically synthesized
caatcctagtactgggtatata

SEQ ID NO: 1152165 - DNA, 22 bp, Artificial Sequence
  chemically synthesized
ttgtttttgttgagtatatacc

SEQ ID NO: 1152166 - DNA, 22 bp, Artificial Sequence
  chemically synthesized
gttgtttttgttgagtatatac

SEQ ID NO: 1152167 - DNA, 22 bp, Artificial Sequence
  chemically synthesized
tgttgtttttgttgagtatata

SEQ ID NO: 1152168 - DNA, 22 bp, Artificial Sequence
  chemically synthesized
ttgttgtttttgttgagtatat

SEQ ID NO: 1152169 - DNA, 22 bp, Artificial Sequence
  chemically synthesized
tttgttgtttttgttgagtata

SEQ ID NO: 1152170 - DNA, 22 bp, Artificial Sequence
  chemically synthesized
gtactgggtatatactcaacaa

SEQ ID NO: 1152171 - DNA, 22 bp, Artificial Sequence
  chemically synthesized
ggtatatactcaacaaaaacaa

SEQ ID NO: 1152172 - DNA, 22 bp, Artificial Sequence
  chemically synthesized
atgtaacactttttgttgtttt

SEQ ID NO: 1152173 - DNA, 22 bp, Artificial Sequence
  chemically synthesized
catgtaacactttttgttgttt

SEQ ID NO: 1152174 - DNA, 22 bp, Artificial Sequence
  chemically synthesized
tcatgtaacactttttgttgtt

SEQ ID NO: 1152175 - DNA, 22 bp, Artificial Sequence
  chemically synthesized
ttcatgtaacactttttgttgt

SEQ ID NO: 1152176 - DNA, 22 bp, Artificial Sequence
  chemically synthesized
tttcatgtaacactttttgttg

SEQ ID NO: 1152177 - DNA, 22 bp, Artificial Sequence
  chemically synthesized
aacaaaaacaacaaaaagtgtt

SEQ ID NO: 1152178 - DNA, 22 bp, Artificial Sequence
  chemically synthesized
caggtagctttttcatgtaaca

SEQ ID NO: 1152179 - DNA, 22 bp, Artificial Sequence
  chemically synthesized
catgaaaaagctacctgcagtt

SEQ ID NO: 1152180 - DNA, 22 bp, Artificial Sequence
  chemically synthesized
tgataaacatacaactgcaggt

SEQ ID NO: 1152181 - DNA, 22 bp, Artificial Sequence
  chemically synthesized
taaatagtgctatgataaacat

SEQ ID NO: 1152182 - DNA, 22 bp, Artificial Sequence
  chemically synthesized
cctgcagttgtatgtttatcat

SEQ ID NO: 1152183 - DNA, 22 bp, Artificial Sequence
  chemically synthesized
ttgtaaatagtgctatgataaa

SEQ ID NO: 1152184 - DNA, 22 bp, Artificial Sequence
  chemically synthesized
cagttgtatgtttatcatagca

SEQ ID NO: 1152185 - DNA, 22 bp, Artificial Sequence
  chemically synthesized
ctattgtaaatagtgctatgat

SEQ ID NO: 1152186 - DNA, 22 bp, Artificial Sequence
  chemically synthesized
gctattgtaaatagtgctatga

SEQ ID NO: 1152187 - DNA, 22 bp, Artificial Sequence
  chemically synthesized
tgctattgtaaatagtgctatg

SEQ ID NO: 1152188 - DNA, 22 bp, Artificial Sequence
  chemically synthesized
tttgctattgtaaatagtgcta

SEQ ID NO: 1152189 - DNA, 22 bp, Artificial Sequence
  chemically synthesized
tatgtttatcatagcactattt

SEQ ID NO: 1152190 - DNA, 22 bp, Artificial Sequence
  chemically synthesized
attctttgctattgtaaatagt

SEQ ID NO: 1152191 - DNA, 22 bp, Artificial Sequence
  chemically synthesized
atcatagcactatttacaatag

SEQ ID NO: 1152192 - DNA, 22 bp, Artificial Sequence
  chemically synthesized
tcatagcactatttacaatagc

SEQ ID NO: 1152193 - DNA, 22 bp, Artificial Sequence
  chemically synthesized
ggttgattctttgctattgtaa

SEQ ID NO: 1152194 - DNA, 22 bp, Artificial Sequence
  chemically synthesized
aggttgattctttgctattgta

SEQ ID NO: 1152195 - DNA, 22 bp, Artificial Sequence
  chemically synthesized
tttacaatagcaaagaatcaac

SEQ ID NO: 1152196 - DNA, 22 bp, Artificial Sequence
  chemically synthesized
atggacgcttaggttgattctt

SEQ ID NO: 1152197 - DNA, 22 bp, Artificial Sequence
  chemically synthesized
acaatagcaaagaatcaaccta

SEQ ID NO: 1152198 - DNA, 22 bp, Artificial Sequence
  chemically synthesized
ctgatggacgcttaggttgatt

SEQ ID NO: 1152199 - DNA, 22 bp, Artificial Sequence
  chemically synthesized
caatagcaaagaatcaacctaa

SEQ ID NO: 1152200 - DNA, 22 bp, Artificial Sequence
  chemically synthesized
actgatggacgcttaggttgat

SEQ ID NO: 1152201 - DNA, 22 bp, Artificial Sequence
  chemically synthesized
tccaatcatttactgatggacg

SEQ ID NO: 1152202 - DNA, 22 bp, Artificial Sequence
  chemically synthesized
atccaatcatttactgatggac

SEQ ID NO: 1152203 - DNA, 22 bp, Artificial Sequence
  chemically synthesized
tatccaatcatttactgatgga

SEQ ID NO: 1152204 - DNA, 22 bp, Artificial Sequence
  chemically synthesized
tttatccaatcatttactgatg

SEQ ID NO: 1152205 - DNA, 22 bp, Artificial Sequence
  chemically synthesized
ctttatccaatcatttactgat

SEQ ID NO: 1152206 - DNA, 22 bp, Artificial Sequence
  chemically synthesized
tctttatccaatcatttactga

SEQ ID NO: 1152207 - DNA, 22 bp, Artificial Sequence
  chemically synthesized
agcgtccatcagtaaatgattg

SEQ ID NO: 1152208 - DNA, 22 bp, Artificial Sequence
  chemically synthesized
gataaagaaaatgtgatatgca

SEQ ID NO: 1152209 - DNA, 22 bp, Artificial Sequence
  chemically synthesized
tggtgtgtgtgtatatatgtgt

SEQ ID NO: 1152210 - DNA, 22 bp, Artificial Sequence
  chemically synthesized
tgtggtgtgtgtgtatatatgt

SEQ ID NO: 1152211 - DNA, 22 bp, Artificial Sequence
  chemically synthesized
tgtagtgttctgtggtgtgtgt

SEQ ID NO: 1152212 - DNA, 22 bp, Artificial Sequence
  chemically synthesized
ggctgtgtagtgttctgtggtg

SEQ ID NO: 1152213 - DNA, 22 bp, Artificial Sequence
  chemically synthesized
aggctgtgtagtgttctgtggt

SEQ ID NO: 1152214 - DNA, 22 bp, Artificial Sequence
  chemically synthesized
ttaggctgtgtagtgttctgtg

SEQ ID NO: 1152215 - DNA, 22 bp, Artificial Sequence
  chemically synthesized
cttaggctgtgtagtgttctgt

SEQ ID NO: 1152216 - DNA, 22 bp, Artificial Sequence
  chemically synthesized
tcttaggctgtgtagtgttctg

SEQ ID NO: 1152217 - DNA, 22 bp, Artificial Sequence
  chemically synthesized
atactttcttaggctgtgtagt

SEQ ID NO: 1152218 - DNA, 22 bp, Artificial Sequence
  chemically synthesized
catactttcttaggctgtgtag

SEQ ID NO: 1152219 - DNA, 22 bp, Artificial Sequence
  chemically synthesized
cacagcctaagaaagtatgaaa

SEQ ID NO: 1152220 - DNA, 22 bp, Artificial Sequence
  chemically synthesized
caaaagacaggatttcatactt

SEQ ID NO: 1152221 - DNA, 22 bp, Artificial Sequence
  chemically synthesized
agaaagtatgaaatcctgtctt

SEQ ID NO: 1152222 - DNA, 22 bp, Artificial Sequence
  chemically synthesized
atgtaactgcaaaagacaggat

SEQ ID NO: 1152223 - DNA, 22 bp, Artificial Sequence
  chemically synthesized
ttcatgtaactgcaaaagacag

SEQ ID NO: 1152224 - DNA, 22 bp, Artificial Sequence
  chemically synthesized
ctattcatgtaactgcaaaaga

SEQ ID NO: 1152225 - DNA, 22 bp, Artificial Sequence
  chemically synthesized
tagttcctattcatgtaactgc

SEQ ID NO: 1152226 - DNA, 22 bp, Artificial Sequence
  chemically synthesized
tcttttgcagttacatgaatag

SEQ ID NO: 1152227 - DNA, 22 bp, Artificial Sequence
  chemically synthesized
ttgcagttacatgaataggaac

SEQ ID NO: 1152228 - DNA, 22 bp, Artificial Sequence
  chemically synthesized
tgcagttacatgaataggaact

SEQ ID NO: 1152229 - DNA, 22 bp, Artificial Sequence
  chemically synthesized
gcagttacatgaataggaacta

SEQ ID NO: 1152230 - DNA, 22 bp, Artificial Sequence
  chemically synthesized
cagttacatgaataggaactat

SEQ ID NO: 1152231 - DNA, 22 bp, Artificial Sequence
  chemically synthesized
ggataatggcctatagttccta

SEQ ID NO: 1152232 - DNA, 22 bp, Artificial Sequence
  chemically synthesized
aggataatggcctatagttcct

SEQ ID NO: 1152233 - DNA, 22 bp, Artificial Sequence
  chemically synthesized
acttaggataatggcctatagt

SEQ ID NO: 1152234 - DNA, 22 bp, Artificial Sequence
  chemically synthesized
catgaataggaactataggcca

SEQ ID NO: 1152235 - DNA, 22 bp, Artificial Sequence
  chemically synthesized
cacttaggataatggcctatag

SEQ ID NO: 1152236 - DNA, 22 bp, Artificial Sequence
  chemically synthesized
cttcacttaggataatggccta

SEQ ID NO: 1152237 - DNA, 22 bp, Artificial Sequence
  chemically synthesized
caagttacttcacttaggataa

SEQ ID NO: 1152238 - DNA, 22 bp, Artificial Sequence
  chemically synthesized
ccaagttacttcacttaggata

SEQ ID NO: 1152239 - DNA, 22 bp, Artificial Sequence
  chemically synthesized
tttccaagttacttcacttagg

SEQ ID NO: 1152240 - DNA, 22 bp, Artificial Sequence
  chemically synthesized
taggccattatcctaagtgaag

SEQ ID NO: 1152241 - DNA, 22 bp, Artificial Sequence
  chemically synthesized
tgtttccaagttacttcactta

SEQ ID NO: 1152242 - DNA, 22 bp, Artificial Sequence
  chemically synthesized
ctgtttccaagttacttcactt

SEQ ID NO: 1152243 - DNA, 22 bp, Artificial Sequence
  chemically synthesized
ggtttctgtttccaagttactt

SEQ ID NO: 1152244 - DNA, 22 bp, Artificial Sequence
  chemically synthesized
aggtttctgtttccaagttact

SEQ ID NO: 1152245 - DNA, 22 bp, Artificial Sequence
  chemically synthesized
tcctaagtgaagtaacttggaa

SEQ ID NO: 1152246 - DNA, 22 bp, Artificial Sequence
  chemically synthesized
catttaggtttctgtttccaag

SEQ ID NO: 1152247 - DNA, 22 bp, Artificial Sequence
  chemically synthesized
agtgaagtaacttggaaacaga

SEQ ID NO: 1152248 - DNA, 22 bp, Artificial Sequence
  chemically synthesized
ggaaacagaaacctaaatgcaa

SEQ ID NO: 1152249 - DNA, 22 bp, Artificial Sequence
  chemically synthesized
gaaacagaaacctaaatgcaac

SEQ ID NO: 1152250 - DNA, 22 bp, Artificial Sequence
  chemically synthesized
taagcgagaacatgttgcattt

SEQ ID NO: 1152251 - DNA, 22 bp, Artificial Sequence
  chemically synthesized
ataagcgagaacatgttgcatt

SEQ ID NO: 1152252 - DNA, 22 bp, Artificial Sequence
  chemically synthesized
ttataagcgagaacatgttgca

SEQ ID NO: 1152253 - DNA, 22 bp, Artificial Sequence
  chemically synthesized
cttataagcgagaacatgttgc

SEQ ID NO: 1152254 - DNA, 22 bp, Artificial Sequence
  chemically synthesized
ttcttataagcgagaacatgtt

SEQ ID NO: 1152255 - DNA, 22 bp, Artificial Sequence
  chemically synthesized
cttcttataagcgagaacatgt

SEQ ID NO: 1152256 - DNA, 22 bp, Artificial Sequence
  chemically synthesized
gtttcttcttataagcgagaac

SEQ ID NO: 1152257 - DNA, 22 bp, Artificial Sequence
  chemically synthesized
agtttcttcttataagcgagaa

SEQ ID NO: 1152258 - DNA, 22 bp, Artificial Sequence
  chemically synthesized
aatgcaacatgttctcgcttat

SEQ ID NO: 1152259 - DNA, 22 bp, Artificial Sequence
  chemically synthesized
tttagtttcttcttataagcga

SEQ ID NO: 1152260 - DNA, 22 bp, Artificial Sequence
  chemically synthesized
gtttagtttcttcttataagcg

SEQ ID NO: 1152261 - DNA, 22 bp, Artificial Sequence
  chemically synthesized
tgtttagtttcttcttataagc

SEQ ID NO: 1152262 - DNA, 22 bp, Artificial Sequence
  chemically synthesized
tcgcttataagaagaaactaaa

SEQ ID NO: 1152263 - DNA, 22 bp, Artificial Sequence
  chemically synthesized
gcttataagaagaaactaaaca

SEQ ID NO: 1152264 - DNA, 22 bp, Artificial Sequence
  chemically synthesized
ataagaagaaactaaacaaagg

SEQ ID NO: 1152265 - DNA, 22 bp, Artificial Sequence
  chemically synthesized
taagaagaaactaaacaaaggg

SEQ ID NO: 1152266 - DNA, 22 bp, Artificial Sequence
  chemically synthesized
gatgtccgtgtgtaccctttgt

SEQ ID NO: 1152267 - DNA, 22 bp, Artificial Sequence
  chemically synthesized
tagatgtccgtgtgtacccttt

SEQ ID NO: 1152268 - DNA, 22 bp, Artificial Sequence
  chemically synthesized
cactctagatgtccgtgtgtac

SEQ ID NO: 1152269 - DNA, 22 bp, Artificial Sequence
  chemically synthesized
ttccactctagatgtccgtgtg

SEQ ID NO: 1152270 - DNA, 22 bp, Artificial Sequence
  chemically synthesized
aacaaagggtacacacggacat

SEQ ID NO: 1152271 - DNA, 22 bp, Artificial Sequence
  chemically synthesized
tattattccactctagatgtcc

SEQ ID NO: 1152272 - DNA, 22 bp, Artificial Sequence
  chemically synthesized
atattattccactctagatgtc

SEQ ID NO: 1152273 - DNA, 22 bp, Artificial Sequence
  chemically synthesized
cagtttatattattccactcta

SEQ ID NO: 1152274 - DNA, 22 bp, Artificial Sequence
  chemically synthesized
ccagtttatattattccactct

SEQ ID NO: 1152275 - DNA, 22 bp, Artificial Sequence
  chemically synthesized
tagtttccagtttatattattc

SEQ ID NO: 1152276 - DNA, 22 bp, Artificial Sequence
  chemically synthesized
gtagtttccagtttatattatt

SEQ ID NO: 1152277 - DNA, 22 bp, Artificial Sequence
  chemically synthesized
tgtagtttccagtttatattat

SEQ ID NO: 1152278 - DNA, 22 bp, Artificial Sequence
  chemically synthesized
ttgtagtttccagtttatatta

SEQ ID NO: 1152279 - DNA, 22 bp, Artificial Sequence
  chemically synthesized
gagtggaataatataaactgga

SEQ ID NO: 1152280 - DNA, 22 bp, Artificial Sequence
  chemically synthesized
taatcttttgtagtttccagtt

SEQ ID NO: 1152281 - DNA, 22 bp, Artificial Sequence
  chemically synthesized
ccagcctataatcttttgtagt

SEQ ID NO: 1152282 - DNA, 22 bp, Artificial Sequence
  chemically synthesized
gaaactacaaaagattataggc

SEQ ID NO: 1152283 - DNA, 22 bp, Artificial Sequence
  chemically synthesized
acccccctaccagcctataatc

SEQ ID NO: 1152284 - DNA, 22 bp, Artificial Sequence
  chemically synthesized
caaaagattataggctggtagg

SEQ ID NO: 1152285 - DNA, 22 bp, Artificial Sequence
  chemically synthesized
acccctcacccccctaccagcc

SEQ ID NO: 1152286 - DNA, 22 bp, Artificial Sequence
  chemically synthesized
cacccctcacccccctaccagc

SEQ ID NO: 1152287 - DNA, 22 bp, Artificial Sequence
  chemically synthesized
tcacccctcacccccctaccag

SEQ ID NO: 1152288 - DNA, 22 bp, Artificial Sequence
  chemically synthesized
ttcacccctcacccccctacca

SEQ ID NO: 1152289 - DNA, 22 bp, Artificial Sequence
  chemically synthesized
taggctggtaggggggtgaggg

SEQ ID NO: 1152290 - DNA, 22 bp, Artificial Sequence
  chemically synthesized
aataggtaatttttcacccctc

SEQ ID NO: 1152291 - DNA, 22 bp, Artificial Sequence
  chemically synthesized
gtaggggggtgaggggtgaaaa

SEQ ID NO: 1152292 - DNA, 22 bp, Artificial Sequence
  chemically synthesized
tactcaataggtaatttttcac

SEQ ID NO: 1152293 - DNA, 22 bp, Artificial Sequence
  chemically synthesized
aatagcgaacactatactcaat

SEQ ID NO: 1152294 - DNA, 22 bp, Artificial Sequence
  chemically synthesized
cctattgagtatagtgttcgct

SEQ ID NO: 1152295 - DNA, 22 bp, Artificial Sequence
  chemically synthesized
ttgagtatagtgttcgctattc

SEQ ID NO: 1152296 - DNA, 22 bp, Artificial Sequence
  chemically synthesized
agtatagtgttcgctattcaga

SEQ ID NO: 1152297 - DNA, 22 bp, Artificial Sequence
  chemically synthesized
gtatatccataatctgaatagc

SEQ ID NO: 1152298 - DNA, 22 bp, Artificial Sequence
  chemically synthesized
agtatatccataatctgaatag

SEQ ID NO: 1152299 - DNA, 22 bp, Artificial Sequence
  chemically synthesized
tagtatatccataatctgaata

SEQ ID NO: 1152300 - DNA, 22 bp, Artificial Sequence
  chemically synthesized
ggattttagtatatccataatc

SEQ ID NO: 1152301 - DNA, 22 bp, Artificial Sequence
  chemically synthesized
gctattcagattatggatatac

SEQ ID NO: 1152302 - DNA, 22 bp, Artificial Sequence
  chemically synthesized
ttcagattatggatatactaaa

SEQ ID NO: 1152303 - DNA, 22 bp, Artificial Sequence
  chemically synthesized
agattatggatatactaaaatc

SEQ ID NO: 1152304 - DNA, 22 bp, Artificial Sequence
  chemically synthesized
tggatatactaaaatcccagac

SEQ ID NO: 1152305 - DNA, 22 bp, Artificial Sequence
  chemically synthesized
aaatcccagactccaccactac

SEQ ID NO: 1152306 - DNA, 22 bp, Artificial Sequence
  chemically synthesized
catggatatatcgtgtagtggt

SEQ ID NO: 1152307 - DNA, 22 bp, Artificial Sequence
  chemically synthesized
ttacatggatatatcgtgtagt

SEQ ID NO: 1152308 - DNA, 22 bp, Artificial Sequence
  chemically synthesized
gttacatggatatatcgtgtag

SEQ ID NO: 1152309 - DNA, 22 bp, Artificial Sequence
  chemically synthesized
caccactacacgatatatccat

SEQ ID NO: 1152310 - DNA, 22 bp, Artificial Sequence
  chemically synthesized
cacgatatatccatgtaacaaa

SEQ ID NO: 1152311 - DNA, 22 bp, Artificial Sequence
  chemically synthesized
agggggtgcatgtgcaggtttg

SEQ ID NO: 1152312 - DNA, 22 bp, Artificial Sequence
  chemically synthesized
aaatagattgagggggtgcatg

SEQ ID NO: 1152313 - DNA, 22 bp, Artificial Sequence
  chemically synthesized
aaaatagattgagggggtgcat

SEQ ID NO: 1152314 - DNA, 22 bp, Artificial Sequence
  chemically synthesized
taaaatagattgagggggtgca

SEQ ID NO: 1152315 - DNA, 22 bp, Artificial Sequence
  chemically synthesized
cacatgcaccccctcaatctat

SEQ ID NO: 1152316 - DNA, 22 bp, Artificial Sequence
  chemically synthesized
gaagaagttttaaaatagattg

SEQ ID NO: 1152317 - DNA, 22 bp, Artificial Sequence
  chemically synthesized
agaagaagttttaaaatagatt

SEQ ID NO: 1152318 - DNA, 22 bp, Artificial Sequence
  chemically synthesized
aatctattttaaaacttcttct

SEQ ID NO: 1152319 - DNA, 22 bp, Artificial Sequence
  chemically synthesized
gtaataagcatgtcttagaaga

SEQ ID NO: 1152320 - DNA, 22 bp, Artificial Sequence
  chemically synthesized
ttttaaaacttcttctaagaca

SEQ ID NO: 1152321 - DNA, 22 bp, Artificial Sequence
  chemically synthesized
tagtaataagcatgtcttagaa

SEQ ID NO: 1152322 - DNA, 22 bp, Artificial Sequence
  chemically synthesized
taaaacttcttctaagacatgc

SEQ ID NO: 1152323 - DNA, 22 bp, Artificial Sequence
  chemically synthesized
aaaacttcttctaagacatgct

SEQ ID NO: 1152324 - DNA, 22 bp, Artificial Sequence
  chemically synthesized
actctagtaataagcatgtctt

SEQ ID NO: 1152325 - DNA, 22 bp, Artificial Sequence
  chemically synthesized
aaacttcttctaagacatgctt

SEQ ID NO: 1152326 - DNA, 22 bp, Artificial Sequence
  chemically synthesized
aactctagtaataagcatgtct

SEQ ID NO: 1152327 - DNA, 22 bp, Artificial Sequence
  chemically synthesized
atttaactctagtaataagcat

SEQ ID NO: 1152328 - DNA, 22 bp, Artificial Sequence
  chemically synthesized
cttctaagacatgcttattact

SEQ ID NO: 1152329 - DNA, 22 bp, Artificial Sequence
  chemically synthesized
ttctaagacatgcttattacta

SEQ ID NO: 1152330 - DNA, 22 bp, Artificial Sequence
  chemically synthesized
tctcatttaactctagtaataa

SEQ ID NO: 1152331 - DNA, 22 bp, Artificial Sequence
  chemically synthesized
ctaagacatgcttattactaga

SEQ ID NO: 1152332 - DNA, 22 bp, Artificial Sequence
  chemically synthesized
taagacatgcttattactagag

SEQ ID NO: 1152333 - DNA, 22 bp, Artificial Sequence
  chemically synthesized
agacatgcttattactagagtt

SEQ ID NO: 1152334 - DNA, 22 bp, Artificial Sequence
  chemically synthesized
atgtattgtctcatttaactct

SEQ ID NO: 1152335 - DNA, 22 bp, Artificial Sequence
  chemically synthesized
attactagagttaaatgagaca

SEQ ID NO: 1152336 - DNA, 22 bp, Artificial Sequence
  chemically synthesized
aagttaatgtattgtctcattt

SEQ ID NO: 1152337 - DNA, 22 bp, Artificial Sequence
  chemically synthesized
ttactagagttaaatgagacaa

SEQ ID NO: 1152338 - DNA, 22 bp, Artificial Sequence
  chemically synthesized
ctagagttaaatgagacaatac

SEQ ID NO: 1152339 - DNA, 22 bp, Artificial Sequence
  chemically synthesized
gagttaaatgagacaatacatt

SEQ ID NO: 1152340 - DNA, 22 bp, Artificial Sequence
  chemically synthesized
tacaagctgaagttaatgtatt

SEQ ID NO: 1152341 - DNA, 22 bp, Artificial Sequence
  chemically synthesized
aatgagacaatacattaacttc

SEQ ID NO: 1152342 - DNA, 22 bp, Artificial Sequence
  chemically synthesized
agcactgtacaagctgaagtta

SEQ ID NO: 1152343 - DNA, 22 bp, Artificial Sequence
  chemically synthesized
ccaaatctaagcactgtacaag

SEQ ID NO: 1152344 - DNA, 22 bp, Artificial Sequence
  chemically synthesized
acttcagcttgtacagtgctta

SEQ ID NO: 1152345 - DNA, 22 bp, Artificial Sequence
  chemically synthesized
accacctaccaaatctaagcac

SEQ ID NO: 1152346 - DNA, 22 bp, Artificial Sequence
  chemically synthesized
cagcttgtacagtgcttagatt

SEQ ID NO: 1152347 - DNA, 22 bp, Artificial Sequence
  chemically synthesized
agcttgtacagtgcttagattt

SEQ ID NO: 1152348 - DNA, 22 bp, Artificial Sequence
  chemically synthesized
ctcaccacctaccaaatctaag

SEQ ID NO: 1152349 - DNA, 22 bp, Artificial Sequence
  chemically synthesized
cctcaccacctaccaaatctaa

SEQ ID NO: 1152350 - DNA, 22 bp, Artificial Sequence
  chemically synthesized
gtacagtgcttagatttggtag

SEQ ID NO: 1152351 - DNA, 22 bp, Artificial Sequence
  chemically synthesized
tacagtgcttagatttggtagg

SEQ ID NO: 1152352 - DNA, 22 bp, Artificial Sequence
  chemically synthesized
agatttggtaggtggtgaggaa

SEQ ID NO: 1152353 - DNA, 22 bp, Artificial Sequence
  chemically synthesized
gatttggtaggtggtgaggaaa

SEQ ID NO: 1152354 - DNA, 22 bp, Artificial Sequence
  chemically synthesized
ggtaggtggtgaggaaatgctt

SEQ ID NO: 1152355 - DNA, 22 bp, Artificial Sequence
  chemically synthesized
gtaggtggtgaggaaatgctta

SEQ ID NO: 1152356 - DNA, 22 bp, Artificial Sequence
  chemically synthesized
attttctttcatttctgacgta

SEQ ID NO: 1152357 - DNA, 22 bp, Artificial Sequence
  chemically synthesized
ttttctttcatttctgacgtat

SEQ ID NO: 1152358 - DNA, 22 bp, Artificial Sequence
  chemically synthesized
tctttcatttctgacgtattca

SEQ ID NO: 1152359 - DNA, 22 bp, Artificial Sequence
  chemically synthesized
ctttcatttctgacgtattcac

SEQ ID NO: 1152360 - DNA, 22 bp, Artificial Sequence
  chemically synthesized
tttcatttctgacgtattcaca

SEQ ID NO: 1152361 - DNA, 22 bp, Artificial Sequence
  chemically synthesized
tcatttctgacgtattcacatt

SEQ ID NO: 1152362 - DNA, 22 bp, Artificial Sequence
  chemically synthesized
catttctgacgtattcacatta

SEQ ID NO: 1152363 - DNA, 22 bp, Artificial Sequence
  chemically synthesized
atttctgacgtattcacattat

SEQ ID NO: 1152364 - DNA, 22 bp, Artificial Sequence
  chemically synthesized
ctgacgtattcacattatcctt

SEQ ID NO: 1152365 - DNA, 22 bp, Artificial Sequence
  chemically synthesized
tgacgtattcacattatccttg

SEQ ID NO: 1152366 - DNA, 22 bp, Artificial Sequence
  chemically synthesized
agtgtaagaatgcaaggataat

SEQ ID NO: 1152367 - DNA, 22 bp, Artificial Sequence
  chemically synthesized
acgtattcacattatccttgca

SEQ ID NO: 1152368 - DNA, 22 bp, Artificial Sequence
  chemically synthesized
acattatccttgcattcttaca

SEQ ID NO: 1152369 - DNA, 22 bp, Artificial Sequence
  chemically synthesized
catgaatctcagtgtaagaatg

SEQ ID NO: 1152370 - DNA, 22 bp, Artificial Sequence
  chemically synthesized
ccatgaatctcagtgtaagaat

SEQ ID NO: 1152371 - DNA, 22 bp, Artificial Sequence
  chemically synthesized
tttccatgaatctcagtgtaag

SEQ ID NO: 1152372 - DNA, 22 bp, Artificial Sequence
  chemically synthesized
tccttgcattcttacactgaga

SEQ ID NO: 1152373 - DNA, 22 bp, Artificial Sequence
  chemically synthesized
gcattcttacactgagattcat

SEQ ID NO: 1152374 - DNA, 22 bp, Artificial Sequence
  chemically synthesized
cattcttacactgagattcatg

SEQ ID NO: 1152375 - DNA, 22 bp, Artificial Sequence
  chemically synthesized
aaaagggctatttccatgaatc

SEQ ID NO: 1152376 - DNA, 22 bp, Artificial Sequence
  chemically synthesized
ttacactgagattcatggaaat

SEQ ID NO: 1152377 - DNA, 22 bp, Artificial Sequence
  chemically synthesized
acactgagattcatggaaatag

SEQ ID NO: 1152378 - DNA, 22 bp, Artificial Sequence
  chemically synthesized
cactgagattcatggaaatagc

SEQ ID NO: 1152379 - DNA, 22 bp, Artificial Sequence
  chemically synthesized
agattcatggaaatagcccttt

SEQ ID NO: 1152380 - DNA, 22 bp, Artificial Sequence
  chemically synthesized
atggaaatagcccttttgagca

SEQ ID NO: 1152381 - DNA, 22 bp, Artificial Sequence
  chemically synthesized
gaaataaatagtgatgctcaaa

SEQ ID NO: 1152382 - DNA, 22 bp, Artificial Sequence
  chemically synthesized
ttagaaataaatagtgatgctc

SEQ ID NO: 1152383 - DNA, 22 bp, Artificial Sequence
  chemically synthesized
ccaagttattagaaataaatag

SEQ ID NO: 1152384 - DNA, 22 bp, Artificial Sequence
  chemically synthesized
ttgagcatcactatttatttct

SEQ ID NO: 1152385 - DNA, 22 bp, Artificial Sequence
  chemically synthesized
tgagcatcactatttatttcta

SEQ ID NO: 1152386 - DNA, 22 bp, Artificial Sequence
  chemically synthesized
gagcatcactatttatttctaa

SEQ ID NO: 1152387 - DNA, 22 bp, Artificial Sequence
  chemically synthesized
agcatcactatttatttctaat

SEQ ID NO: 1152388 - DNA, 22 bp, Artificial Sequence
  chemically synthesized
tttatttctaataacttggtaa

SEQ ID NO: 1152389 - DNA, 22 bp, Artificial Sequence
  chemically synthesized
atttctaataacttggtaatca

SEQ ID NO: 1152390 - DNA, 22 bp, Artificial Sequence
  chemically synthesized
tttctaataacttggtaatcac

SEQ ID NO: 1152391 - DNA, 22 bp, Artificial Sequence
  chemically synthesized
ctaataacttggtaatcacatt

SEQ ID NO: 1152392 - DNA, 22 bp, Artificial Sequence
  chemically synthesized
taataacttggtaatcacatta

SEQ ID NO: 1152393 - DNA, 22 bp, Artificial Sequence
  chemically synthesized
ataatggaaatataatgtgatt

SEQ ID NO: 1152394 - DNA, 22 bp, Artificial Sequence
  chemically synthesized
aataatggaaatataatgtgat

SEQ ID NO: 1152395 - DNA, 22 bp, Artificial Sequence
  chemically synthesized
ataacttggtaatcacattata

SEQ ID NO: 1152396 - DNA, 22 bp, Artificial Sequence
  chemically synthesized
ggtaatcacattatatttccat

SEQ ID NO: 1152397 - DNA, 22 bp, Artificial Sequence
  chemically synthesized
gtaatcacattatatttccatt

SEQ ID NO: 1152398 - DNA, 22 bp, Artificial Sequence
  chemically synthesized
aggatatttaataatggaaata

SEQ ID NO: 1152399 - DNA, 22 bp, Artificial Sequence
  chemically synthesized
gcacactgaggatatttaataa

SEQ ID NO: 1152400 - DNA, 22 bp, Artificial Sequence
  chemically synthesized
ggcacactgaggatatttaata

SEQ ID NO: 1152401 - DNA, 22 bp, Artificial Sequence
  chemically synthesized
tggcacactgaggatatttaat

SEQ ID NO: 1152402 - DNA, 22 bp, Artificial Sequence
  chemically synthesized
tatttccattattaaatatcct

SEQ ID NO: 1152403 - DNA, 22 bp, Artificial Sequence
  chemically synthesized
cagttttggcacactgaggata

SEQ ID NO: 1152404 - DNA, 22 bp, Artificial Sequence
  chemically synthesized
ccattattaaatatcctcagtg

SEQ ID NO: 1152405 - DNA, 22 bp, Artificial Sequence
  chemically synthesized
cattattaaatatcctcagtgt

SEQ ID NO: 1152406 - DNA, 22 bp, Artificial Sequence
  chemically synthesized
ttaaatatcctcagtgtgccaa

SEQ ID NO: 1152407 - DNA, 22 bp, Artificial Sequence
  chemically synthesized
aatatcctcagtgtgccaaaac

SEQ ID NO: 1152408 - DNA, 22 bp, Artificial Sequence
  chemically synthesized
cataatggtctacagttttggc

SEQ ID NO: 1152409 - DNA, 22 bp, Artificial Sequence
  chemically synthesized
acataatggtctacagttttgg

SEQ ID NO: 1152410 - DNA, 22 bp, Artificial Sequence
  chemically synthesized
tacataatggtctacagttttg

SEQ ID NO: 1152411 - DNA, 22 bp, Artificial Sequence
  chemically synthesized
ttacataatggtctacagtttt

SEQ ID NO: 1152412 - DNA, 22 bp, Artificial Sequence
  chemically synthesized
tttttacataatggtctacagt

SEQ ID NO: 1152413 - DNA, 22 bp, Artificial Sequence
  chemically synthesized
agtgtgccaaaactgtagacca

SEQ ID NO: 1152414 - DNA, 22 bp, Artificial Sequence
  chemically synthesized
aactatttttacataatggtct

SEQ ID NO: 1152415 - DNA, 22 bp, Artificial Sequence
  chemically synthesized
tagaccattatgtaaaaatagt

SEQ ID NO: 1152416 - DNA, 22 bp, Artificial Sequence
  chemically synthesized
aaaaagcactaaactattttta

SEQ ID NO: 1152417 - DNA, 22 bp, Artificial Sequence
  chemically synthesized
gtaagactaaaaaagcactaaa

SEQ ID NO: 1152418 - DNA, 22 bp, Artificial Sequence
  chemically synthesized
tgtaaaaatagtttagtgcttt

SEQ ID NO: 1152419 - DNA, 22 bp, Artificial Sequence
  chemically synthesized
agtcatatctagtaagactaaa

SEQ ID NO: 1152420 - DNA, 22 bp, Artificial Sequence
  chemically synthesized
agtgcttttttagtcttactag

SEQ ID NO: 1152421 - DNA, 22 bp, Artificial Sequence
  chemically synthesized
tctaagtcatatctagtaagac

SEQ ID NO: 1152422 - DNA, 22 bp, Artificial Sequence
  chemically synthesized
gtgcttttttagtcttactaga

SEQ ID NO: 1152423 - DNA, 22 bp, Artificial Sequence
  chemically synthesized
atctaagtcatatctagtaaga

SEQ ID NO: 1152424 - DNA, 22 bp, Artificial Sequence
  chemically synthesized
tatctaagtcatatctagtaag

SEQ ID NO: 1152425 - DNA, 22 bp, Artificial Sequence
  chemically synthesized
ttatctaagtcatatctagtaa

SEQ ID NO: 1152426 - DNA, 22 bp, Artificial Sequence
  chemically synthesized
ttttagtcttactagatatgac

SEQ ID NO: 1152427 - DNA, 22 bp, Artificial Sequence
  chemically synthesized
tttagtcttactagatatgact

SEQ ID NO: 1152428 - DNA, 22 bp, Artificial Sequence
  chemically synthesized
aatttttatctaagtcatatct

SEQ ID NO: 1152429 - DNA, 22 bp, Artificial Sequence
  chemically synthesized
ttagtcttactagatatgactt

SEQ ID NO: 1152430 - DNA, 22 bp, Artificial Sequence
  chemically synthesized
tagtcttactagatatgactta

SEQ ID NO: 1152431 - DNA, 22 bp, Artificial Sequence
  chemically synthesized
agtcttactagatatgacttag

SEQ ID NO: 1152432 - DNA, 22 bp, Artificial Sequence
  chemically synthesized
gtcttactagatatgacttaga

SEQ ID NO: 1152433 - DNA, 22 bp, Artificial Sequence
  chemically synthesized
acaattaaatttttatctaagt

SEQ ID NO: 1152434 - DNA, 22 bp, Artificial Sequence
  chemically synthesized
aacaattaaatttttatctaag

SEQ ID NO: 1152435 - DNA, 22 bp, Artificial Sequence
  chemically synthesized
actagatatgacttagataaaa

SEQ ID NO: 1152436 - DNA, 22 bp, Artificial Sequence
  chemically synthesized
taacaattaaatttttatctaa

SEQ ID NO: 1152437 - DNA, 22 bp, Artificial Sequence
  chemically synthesized
ctagatatgacttagataaaaa

SEQ ID NO: 1152438 - DNA, 22 bp, Artificial Sequence
  chemically synthesized
gatatgacttagataaaaattt

SEQ ID NO: 1152439 - DNA, 22 bp, Artificial Sequence
  chemically synthesized
tatcctttaacaattaaatttt

SEQ ID NO: 1152440 - DNA, 22 bp, Artificial Sequence
  chemically synthesized
agataaaaatttaattgttaaa

SEQ ID NO: 1152441 - DNA, 22 bp, Artificial Sequence
  chemically synthesized
gataaaaatttaattgttaaag

SEQ ID NO: 1152442 - DNA, 22 bp, Artificial Sequence
  chemically synthesized
gaagtaatgatactgtatcctt

SEQ ID NO: 1152443 - DNA, 22 bp, Artificial Sequence
  chemically synthesized
aattgttaaaggatacagtatc

SEQ ID NO: 1152444 - DNA, 22 bp, Artificial Sequence
  chemically synthesized
attggaagtaatgatactgtat

SEQ ID NO: 1152445 - DNA, 22 bp, Artificial Sequence
  chemically synthesized
attgttaaaggatacagtatca

SEQ ID NO: 1152446 - DNA, 22 bp, Artificial Sequence
  chemically synthesized
ttcattggaagtaatgatactg

SEQ ID NO: 1152447 - DNA, 22 bp, Artificial Sequence
  chemically synthesized
attcattggaagtaatgatact

SEQ ID NO: 1152448 - DNA, 22 bp, Artificial Sequence
  chemically synthesized
ttaaaggatacagtatcattac

SEQ ID NO: 1152449 - DNA, 22 bp, Artificial Sequence
  chemically synthesized
ttattcattggaagtaatgata

SEQ ID NO: 1152450 - DNA, 22 bp, Artificial Sequence
  chemically synthesized
aaggatacagtatcattacttc

SEQ ID NO: 1152451 - DNA, 22 bp, Artificial Sequence
  chemically synthesized
tcttattcattggaagtaatga

SEQ ID NO: 1152452 - DNA, 22 bp, Artificial Sequence
  chemically synthesized
gtagtactctcttattcattgg

SEQ ID NO: 1152453 - DNA, 22 bp, Artificial Sequence
  chemically synthesized
cttccaatgaataagagagtac

SEQ ID NO: 1152454 - DNA, 22 bp, Artificial Sequence
  chemically synthesized
gtacatctggtagtactctctt

SEQ ID NO: 1152455 - DNA, 22 bp, Artificial Sequence
  chemically synthesized
ccaatgaataagagagtactac

SEQ ID NO: 1152456 - DNA, 22 bp, Artificial Sequence
  chemically synthesized
ctggtacatctggtagtactct

SEQ ID NO: 1152457 - DNA, 22 bp, Artificial Sequence
  chemically synthesized
caatgaataagagagtactacc

SEQ ID NO: 1152458 - DNA, 22 bp, Artificial Sequence
  chemically synthesized
tactggtacatctggtagtact

SEQ ID NO: 1152459 - DNA, 22 bp, Artificial Sequence
  chemically synthesized
ctactggtacatctggtagtac

SEQ ID NO: 1152460 - DNA, 22 bp, Artificial Sequence
  chemically synthesized
gtagatttctactggtacatct

SEQ ID NO: 1152461 - DNA, 22 bp, Artificial Sequence
  chemically synthesized
atactagtagatttctactggt

SEQ ID NO: 1152462 - DNA, 22 bp, Artificial Sequence
  chemically synthesized
taatactagtagatttctactg

SEQ ID NO: 1152463 - DNA, 22 bp, Artificial Sequence
  chemically synthesized
ctaatactagtagatttctact

SEQ ID NO: 1152464 - DNA, 22 bp, Artificial Sequence
  chemically synthesized
ccagatgtaccagtagaaatct

SEQ ID NO: 1152465 - DNA, 22 bp, Artificial Sequence
  chemically synthesized
gtggatttctaatactagtaga

SEQ ID NO: 1152466 - DNA, 22 bp, Artificial Sequence
  chemically synthesized
tagtggatttctaatactagta

SEQ ID NO: 1152467 - DNA, 22 bp, Artificial Sequence
  chemically synthesized
ctagtggatttctaatactagt

SEQ ID NO: 1152468 - DNA, 22 bp, Artificial Sequence
  chemically synthesized
tgaacagaatttctagtggatt

SEQ ID NO: 1152469 - DNA, 22 bp, Artificial Sequence
  chemically synthesized
ctagtattagaaatccactaga

SEQ ID NO: 1152470 - DNA, 22 bp, Artificial Sequence
  chemically synthesized
ttatgaacagaatttctagtgg

SEQ ID NO: 1152471 - DNA, 22 bp, Artificial Sequence
  chemically synthesized
gtattagaaatccactagaaat

SEQ ID NO: 1152472 - DNA, 22 bp, Artificial Sequence
  chemically synthesized
tgttatgaacagaatttctagt

SEQ ID NO: 1152473 - DNA, 22 bp, Artificial Sequence
  chemically synthesized
ctgttatgaacagaatttctag

SEQ ID NO: 1152474 - DNA, 22 bp, Artificial Sequence
  chemically synthesized
gaaatccactagaaattctgtt

SEQ ID NO: 1152475 - DNA, 22 bp, Artificial Sequence
  chemically synthesized
atatttctgttatgaacagaat

SEQ ID NO: 1152476 - DNA, 22 bp, Artificial Sequence
  chemically synthesized
aatatttctgttatgaacagaa

SEQ ID NO: 1152477 - DNA, 22 bp, Artificial Sequence
  chemically synthesized
tttaatatttctgttatgaaca

SEQ ID NO: 1152478 - DNA, 22 bp, Artificial Sequence
  chemically synthesized
gaaattctgttcataacagaaa

SEQ ID NO: 1152479 - DNA, 22 bp, Artificial Sequence
  chemically synthesized
tcctgtttaatatttctgttat

SEQ ID NO: 1152480 - DNA, 22 bp, Artificial Sequence
  chemically synthesized
tgttcataacagaaatattaaa

SEQ ID NO: 1152481 - DNA, 22 bp, Artificial Sequence
  chemically synthesized
ttcataacagaaatattaaaca

SEQ ID NO: 1152482 - DNA, 22 bp, Artificial Sequence
  chemically synthesized
ataacagaaatattaaacagga

SEQ ID NO: 1152483 - DNA, 22 bp, Artificial Sequence
  chemically synthesized
aagaatatggagaactatcctg

SEQ ID NO: 1152484 - DNA, 22 bp, Artificial Sequence
  chemically synthesized
tgaagaatatggagaactatcc

SEQ ID NO: 1152485 - DNA, 22 bp, Artificial Sequence
  chemically synthesized
ctgaagaatatggagaactatc

SEQ ID NO: 1152486 - DNA, 22 bp, Artificial Sequence
  chemically synthesized
tctgaagaatatggagaactat

SEQ ID NO: 1152487 - DNA, 22 bp, Artificial Sequence
  chemically synthesized
ttctgaagaatatggagaacta

SEQ ID NO: 1152488 - DNA, 22 bp, Artificial Sequence
  chemically synthesized
tttctgaagaatatggagaact

SEQ ID NO: 1152489 - DNA, 22 bp, Artificial Sequence
  chemically synthesized
aacaggatagttctccatattc

SEQ ID NO: 1152490 - DNA, 22 bp, Artificial Sequence
  chemically synthesized
aatatgatactttttctgaaga

SEQ ID NO: 1152491 - DNA, 22 bp, Artificial Sequence
  chemically synthesized
tccatattcttcagaaaaagta

SEQ ID NO: 1152492 - DNA, 22 bp, Artificial Sequence
  chemically synthesized
catattcttcagaaaaagtatc

SEQ ID NO: 1152493 - DNA, 22 bp, Artificial Sequence
  chemically synthesized
aaatataaggttgaatatgata

SEQ ID NO: 1152494 - DNA, 22 bp, Artificial Sequence
  chemically synthesized
ttcagaaaaagtatcatattca

SEQ ID NO: 1152495 - DNA, 22 bp, Artificial Sequence
  chemically synthesized
cagaaaaagtatcatattcaac

SEQ ID NO: 1152496 - DNA, 22 bp, Artificial Sequence
  chemically synthesized
agaaaaagtatcatattcaacc

SEQ ID NO: 1152497 - DNA, 22 bp, Artificial Sequence
  chemically synthesized
aaccttatattttaacacggga

SEQ ID NO: 1152498 - DNA, 22 bp, Artificial Sequence
  chemically synthesized
atattttaacacgggattggat

SEQ ID NO: 1152499 - DNA, 22 bp, Artificial Sequence
  chemically synthesized
tattttaacacgggattggatt

SEQ ID NO: 1152500 - DNA, 22 bp, Artificial Sequence
  chemically synthesized
taacacgggattggatttacgg

SEQ ID NO: 1152501 - DNA, 22 bp, Artificial Sequence
  chemically synthesized
aacacgggattggatttacgga

SEQ ID NO: 1152502 - DNA, 22 bp, Artificial Sequence
  chemically synthesized
acacgggattggatttacggac

SEQ ID NO: 1152503 - DNA, 22 bp, Artificial Sequence
  chemically synthesized
taacaaaatgcatgtccgtaaa

SEQ ID NO: 1152504 - DNA, 22 bp, Artificial Sequence
  chemically synthesized
ataacaaaatgcatgtccgtaa

SEQ ID NO: 1152505 - DNA, 22 bp, Artificial Sequence
  chemically synthesized
gatttacggacatgcattttgt

SEQ ID NO: 1152506 - DNA, 22 bp, Artificial Sequence
  chemically synthesized
acggacatgcattttgttataa

SEQ ID NO: 1152507 - DNA, 22 bp, Artificial Sequence
  chemically synthesized
cggacatgcattttgttataag

SEQ ID NO: 1152508 - DNA, 22 bp, Artificial Sequence
  chemically synthesized
tcaaatgtatgaccgtatctta

SEQ ID NO: 1152509 - DNA, 22 bp, Artificial Sequence
  chemically synthesized
atcaaatgtatgaccgtatctt

SEQ ID NO: 1152510 - DNA, 22 bp, Artificial Sequence
  chemically synthesized
cttatcaaatgtatgaccgtat

SEQ ID NO: 1152511 - DNA, 22 bp, Artificial Sequence
  chemically synthesized
ccttatcaaatgtatgaccgta

SEQ ID NO: 1152512 - DNA, 22 bp, Artificial Sequence
  chemically synthesized
tccttatcaaatgtatgaccgt

SEQ ID NO: 1152513 - DNA, 22 bp, Artificial Sequence
  chemically synthesized
tgttataagatacggtcataca

SEQ ID NO: 1152514 - DNA, 22 bp, Artificial Sequence
  chemically synthesized
gttataagatacggtcatacat

SEQ ID NO: 1152515 - DNA, 22 bp, Artificial Sequence
  chemically synthesized
ttataagatacggtcatacatt

SEQ ID NO: 1152516 - DNA, 22 bp, Artificial Sequence
  chemically synthesized
taagatacggtcatacatttga

SEQ ID NO: 1152517 - DNA, 22 bp, Artificial Sequence
  chemically synthesized
aggcaataattttccttatcaa

SEQ ID NO: 1152518 - DNA, 22 bp, Artificial Sequence
  chemically synthesized
aaggcaataattttccttatca

SEQ ID NO: 1152519 - DNA, 22 bp, Artificial Sequence
  chemically synthesized
taaggcaataattttccttatc

SEQ ID NO: 1152520 - DNA, 22 bp, Artificial Sequence
  chemically synthesized
gataaggaaaattattgcctta

SEQ ID NO: 1152521 - DNA, 22 bp, Artificial Sequence
  chemically synthesized
ataaggaaaattattgccttaa

SEQ ID NO: 1152522 - DNA, 22 bp, Artificial Sequence
  chemically synthesized
agacacacatgataacatgaat

SEQ ID NO: 1152523 - DNA, 22 bp, Artificial Sequence
  chemically synthesized
ttgccttaaaattcatgttatc

SEQ ID NO: 1152524 - DNA, 22 bp, Artificial Sequence
  chemically synthesized
ccttaaaattcatgttatcatg

SEQ ID NO: 1152525 - DNA, 22 bp, Artificial Sequence
  chemically synthesized
aaaattcatgttatcatgtgtg

SEQ ID NO: 1152526 - DNA, 22 bp, Artificial Sequence
  chemically synthesized
aaattcatgttatcatgtgtgt

SEQ ID NO: 1152527 - DNA, 22 bp, Artificial Sequence
  chemically synthesized
caagaaagctaagacacacatg

SEQ ID NO: 1152528 - DNA, 22 bp, Artificial Sequence
  chemically synthesized
acaagaaagctaagacacacat

SEQ ID NO: 1152529 - DNA, 22 bp, Artificial Sequence
  chemically synthesized
atgttatcatgtgtgtcttagc

SEQ ID NO: 1152530 - DNA, 22 bp, Artificial Sequence
  chemically synthesized
tcatgtgtgtcttagctttctt

SEQ ID NO: 1152531 - DNA, 22 bp, Artificial Sequence
  chemically synthesized
gggaaaccttacaagaaagcta

SEQ ID NO: 1152532 - DNA, 22 bp, Artificial Sequence
  chemically synthesized
agggaaaccttacaagaaagct

SEQ ID NO: 1152533 - DNA, 22 bp, Artificial Sequence
  chemically synthesized
tagggaaaccttacaagaaagc

SEQ ID NO: 1152534 - DNA, 22 bp, Artificial Sequence
  chemically synthesized
aaatgcattttagggaaacctt

SEQ ID NO: 1152535 - DNA, 22 bp, Artificial Sequence
  chemically synthesized
agctttcttgtaaggtttccct

SEQ ID NO: 1152536 - DNA, 22 bp, Artificial Sequence
  chemically synthesized
aaaatgcattttagggaaacct

SEQ ID NO: 1152537 - DNA, 22 bp, Artificial Sequence
  chemically synthesized
gctttcttgtaaggtttcccta

SEQ ID NO: 1152538 - DNA, 22 bp, Artificial Sequence
  chemically synthesized
taaaatgcattttagggaaacc

SEQ ID NO: 1152539 - DNA, 22 bp, Artificial Sequence
  chemically synthesized
tcttgtaaggtttccctaaaat

SEQ ID NO: 1152540 - DNA, 22 bp, Artificial Sequence
  chemically synthesized
cttgtaaggtttccctaaaatg

SEQ ID NO: 1152541 - DNA, 22 bp, Artificial Sequence
  chemically synthesized
ttgtaaggtttccctaaaatgc

SEQ ID NO: 1152542 - DNA, 22 bp, Artificial Sequence
  chemically synthesized
gtaaggtttccctaaaatgcat

SEQ ID NO: 1152543 - DNA, 22 bp, Artificial Sequence
  chemically synthesized
taaggtttccctaaaatgcatt

SEQ ID NO: 1152544 - DNA, 22 bp, Artificial Sequence
  chemically synthesized
taaaaaacattttaaaatgcat

SEQ ID NO: 1152545 - DNA, 22 bp, Artificial Sequence
  chemically synthesized
attataaaaaacattttaaaat

SEQ ID NO: 1152546 - DNA, 22 bp, Artificial Sequence
  chemically synthesized
ccctaaaatgcattttaaaatg

SEQ ID NO: 1152547 - DNA, 22 bp, Artificial Sequence
  chemically synthesized
cctaaaatgcattttaaaatgt

SEQ ID NO: 1152548 - DNA, 22 bp, Artificial Sequence
  chemically synthesized
aaatgcattttaaaatgttttt

SEQ ID NO: 1152549 - DNA, 22 bp, Artificial Sequence
  chemically synthesized
taaaatgttttttataattagt

SEQ ID NO: 1152550 - DNA, 22 bp, Artificial Sequence
  chemically synthesized
aaaatgttttttataattagtt

SEQ ID NO: 1152551 - DNA, 22 bp, Artificial Sequence
  chemically synthesized
ataatgtagataaactaattat

SEQ ID NO: 1152552 - DNA, 22 bp, Artificial Sequence
  chemically synthesized
aaatgttttttataattagttt

SEQ ID NO: 1152553 - DNA, 22 bp, Artificial Sequence
  chemically synthesized
tttataattagtttatctacat

SEQ ID NO: 1152554 - DNA, 22 bp, Artificial Sequence
  chemically synthesized
ttataattagtttatctacatt

SEQ ID NO: 1152555 - DNA, 22 bp, Artificial Sequence
  chemically synthesized
tataattagtttatctacatta

SEQ ID NO: 1152556 - DNA, 22 bp, Artificial Sequence
  chemically synthesized
ataattagtttatctacattat

SEQ ID NO: 1152557 - DNA, 22 bp, Artificial Sequence
  chemically synthesized
taattagtttatctacattatt

SEQ ID NO: 1152558 - DNA, 22 bp, Artificial Sequence
  chemically synthesized
gtttatctacattattaatttt

SEQ ID NO: 1152559 - DNA, 22 bp, Artificial Sequence
  chemically synthesized
gtataggtaatacaaaattaat

SEQ ID NO: 1152560 - DNA, 22 bp, Artificial Sequence
  chemically synthesized
cgtataggtaatacaaaattaa

SEQ ID NO: 1152561 - DNA, 22 bp, Artificial Sequence
  chemically synthesized
tcgtataggtaatacaaaatta

SEQ ID NO: 1152562 - DNA, 22 bp, Artificial Sequence
  chemically synthesized
atctacattattaattttgtat

SEQ ID NO: 1152563 - DNA, 22 bp, Artificial Sequence
  chemically synthesized
tctacattattaattttgtatt

SEQ ID NO: 1152564 - DNA, 22 bp, Artificial Sequence
  chemically synthesized
tttcgtataggtaatacaaaat

SEQ ID NO: 1152565 - DNA, 22 bp, Artificial Sequence
  chemically synthesized
cattattaattttgtattacct

SEQ ID NO: 1152566 - DNA, 22 bp, Artificial Sequence
  chemically synthesized
agttctttcgtataggtaatac

SEQ ID NO: 1152567 - DNA, 22 bp, Artificial Sequence
  chemically synthesized
cagttctttcgtataggtaata

SEQ ID NO: 1152568 - DNA, 22 bp, Artificial Sequence
  chemically synthesized
ttaattttgtattacctatacg

SEQ ID NO: 1152569 - DNA, 22 bp, Artificial Sequence
  chemically synthesized
attttgtattacctatacgaaa

SEQ ID NO: 1152570 - DNA, 22 bp, Artificial Sequence
  chemically synthesized
tgtattacctatacgaaagaac

SEQ ID NO: 1152571 - DNA, 22 bp, Artificial Sequence
  chemically synthesized
gtattacctatacgaaagaact

SEQ ID NO: 1152572 - DNA, 22 bp, Artificial Sequence
  chemically synthesized
tattacctatacgaaagaactg

SEQ ID NO: 1152573 - DNA, 22 bp, Artificial Sequence
  chemically synthesized
taacaatcaatttcagttcttt

SEQ ID NO: 1152574 - DNA, 22 bp, Artificial Sequence
  chemically synthesized
cctatacgaaagaactgaaatt

SEQ ID NO: 1152575 - DNA, 22 bp, Artificial Sequence
  chemically synthesized
tacgaaagaactgaaattgatt

SEQ ID NO: 1152576 - DNA, 22 bp, Artificial Sequence
  chemically synthesized
aaccagtactgtaacaatcaat

SEQ ID NO: 1152577 - DNA, 22 bp, Artificial Sequence
  chemically synthesized
tgaaccagtactgtaacaatca

SEQ ID NO: 1152578 - DNA, 22 bp, Artificial Sequence
  chemically synthesized
tctgaaccagtactgtaacaat

SEQ ID NO: 1152579 - DNA, 22 bp, Artificial Sequence
  chemically synthesized
tctctgaaccagtactgtaaca

SEQ ID NO: 1152580 - DNA, 22 bp, Artificial Sequence
  chemically synthesized
tctctctgaaccagtactgtaa

SEQ ID NO: 1152581 - DNA, 22 bp, Artificial Sequence
  chemically synthesized
aaattgattgttacagtactgg

SEQ ID NO: 1152582 - DNA, 22 bp, Artificial Sequence
  chemically synthesized
tctctctctgaaccagtactgt

SEQ ID NO: 1152583 - DNA, 22 bp, Artificial Sequence
  chemically synthesized
attgttacagtactggttcaga

SEQ ID NO: 1152584 - DNA, 22 bp, Artificial Sequence
  chemically synthesized
ttacagtactggttcagagaga

SEQ ID NO: 1152585 - DNA, 22 bp, Artificial Sequence
  chemically synthesized
cagtactggttcagagagagag

SEQ ID NO: 1152586 - DNA, 22 bp, Artificial Sequence
  chemically synthesized
atgtaaaatgtctctctctctc

SEQ ID NO: 1152587 - DNA, 22 bp, Artificial Sequence
  chemically synthesized
gtctcatgtaaaatgtctctct

SEQ ID NO: 1152588 - DNA, 22 bp, Artificial Sequence
  chemically synthesized
gttcagagagagagagacattt

SEQ ID NO: 1152589 - DNA, 22 bp, Artificial Sequence
  chemically synthesized
agttagtctcatgtaaaatgtc

SEQ ID NO: 1152590 - DNA, 22 bp, Artificial Sequence
  chemically synthesized
agagagagagagacattttaca

SEQ ID NO: 1152591 - DNA, 22 bp, Artificial Sequence
  chemically synthesized
ctgagttagtctcatgtaaaat

SEQ ID NO: 1152592 - DNA, 22 bp, Artificial Sequence
  chemically synthesized
actgagttagtctcatgtaaaa

SEQ ID NO: 1152593 - DNA, 22 bp, Artificial Sequence
  chemically synthesized
atttactgagttagtctcatgt

SEQ ID NO: 1152594 - DNA, 22 bp, Artificial Sequence
  chemically synthesized
taatttactgagttagtctcat

SEQ ID NO: 1152595 - DNA, 22 bp, Artificial Sequence
  chemically synthesized
ctaatttactgagttagtctca

SEQ ID NO: 1152596 - DNA, 22 bp, Artificial Sequence
  chemically synthesized
tttctaatttactgagttagtc

SEQ ID NO: 1152597 - DNA, 22 bp, Artificial Sequence
  chemically synthesized
tacatgagactaactcagtaaa

SEQ ID NO: 1152598 - DNA, 22 bp, Artificial Sequence
  chemically synthesized
acatgagactaactcagtaaat

SEQ ID NO: 1152599 - DNA, 22 bp, Artificial Sequence
  chemically synthesized
catgagactaactcagtaaatt

SEQ ID NO: 1152600 - DNA, 22 bp, Artificial Sequence
  chemically synthesized
actcagtaaattagaaataggg

SEQ ID NO: 1152601 - DNA, 22 bp, Artificial Sequence
  chemically synthesized
agtaaattagaaatagggtact

SEQ ID NO: 1152602 - DNA, 22 bp, Artificial Sequence
  chemically synthesized
aaggaaaaaaataagtacccta

SEQ ID NO: 1152603 - DNA, 22 bp, Artificial Sequence
  chemically synthesized
aaaggaaaaaaataagtaccct

SEQ ID NO: 1152604 - DNA, 22 bp, Artificial Sequence
  chemically synthesized
gaaatagggtacttattttttt

SEQ ID NO: 1152605 - DNA, 22 bp, Artificial Sequence
  chemically synthesized
caatggtgtttaaaggaaaaaa

SEQ ID NO: 1152606 - DNA, 22 bp, Artificial Sequence
  chemically synthesized
tccaatggtgtttaaaggaaaa

SEQ ID NO: 1152607 - DNA, 22 bp, Artificial Sequence
  chemically synthesized
acctctccaatggtgtttaaag

SEQ ID NO: 1152608 - DNA, 22 bp, Artificial Sequence
  chemically synthesized
atttttttcctttaaacaccat

SEQ ID NO: 1152609 - DNA, 22 bp, Artificial Sequence
  chemically synthesized
tttttttcctttaaacaccatt

SEQ ID NO: 1152610 - DNA, 22 bp, Artificial Sequence
  chemically synthesized
ttttcctttaaacaccattgga

SEQ ID NO: 1152611 - DNA, 22 bp, Artificial Sequence
  chemically synthesized
tttcctttaaacaccattggag

SEQ ID NO: 1152612 - DNA, 22 bp, Artificial Sequence
  chemically synthesized
ttcctttaaacaccattggaga

SEQ ID NO: 1152613 - DNA, 22 bp, Artificial Sequence
  chemically synthesized
tcctttaaacaccattggagag

SEQ ID NO: 1152614 - DNA, 22 bp, Artificial Sequence
  chemically synthesized
cctttaaacaccattggagagg

SEQ ID NO: 1152615 - DNA, 22 bp, Artificial Sequence
  chemically synthesized
ctttaaacaccattggagaggt

SEQ ID NO: 1152616 - DNA, 22 bp, Artificial Sequence
  chemically synthesized
atgagaagacactgacctctcc

SEQ ID NO: 1152617 - DNA, 22 bp, Artificial Sequence
  chemically synthesized
taaacaccattggagaggtcag

SEQ ID NO: 1152618 - DNA, 22 bp, Artificial Sequence
  chemically synthesized
aaacaccattggagaggtcagt

SEQ ID NO: 1152619 - DNA, 22 bp, Artificial Sequence
  chemically synthesized
aacaccattggagaggtcagtg

SEQ ID NO: 1152620 - DNA, 22 bp, Artificial Sequence
  chemically synthesized
ctcatgagaagacactgacctc

SEQ ID NO: 1152621 - DNA, 22 bp, Artificial Sequence
  chemically synthesized
cctcatgagaagacactgacct

SEQ ID NO: 1152622 - DNA, 22 bp, Artificial Sequence
  chemically synthesized
taatacttcctcatgagaagac

SEQ ID NO: 1152623 - DNA, 22 bp, Artificial Sequence
  chemically synthesized
gagaggtcagtgtcttctcatg

SEQ ID NO: 1152624 - DNA, 22 bp, Artificial Sequence
  chemically synthesized
gtaatacttcctcatgagaaga

SEQ ID NO: 1152625 - DNA, 22 bp, Artificial Sequence
  chemically synthesized
ttgtaatacttcctcatgagaa

SEQ ID NO: 1152626 - DNA, 22 bp, Artificial Sequence
  chemically synthesized
ctcttgtaatacttcctcatga

SEQ ID NO: 1152627 - DNA, 22 bp, Artificial Sequence
  chemically synthesized
attactcttgtaatacttcctc

SEQ ID NO: 1152628 - DNA, 22 bp, Artificial Sequence
  chemically synthesized
cattactcttgtaatacttcct

SEQ ID NO: 1152629 - DNA, 22 bp, Artificial Sequence
  chemically synthesized
tacttcattactcttgtaatac

SEQ ID NO: 1152630 - DNA, 22 bp, Artificial Sequence
  chemically synthesized
ctcatgaggaagtattacaaga

SEQ ID NO: 1152631 - DNA, 22 bp, Artificial Sequence
  chemically synthesized
tcatgaggaagtattacaagag

SEQ ID NO: 1152632 - DNA, 22 bp, Artificial Sequence
  chemically synthesized
ttatacttcattactcttgtaa

SEQ ID NO: 1152633 - DNA, 22 bp, Artificial Sequence
  chemically synthesized
atgaggaagtattacaagagta

SEQ ID NO: 1152634 - DNA, 22 bp, Artificial Sequence
  chemically synthesized
gttattatacttcattactctt

SEQ ID NO: 1152635 - DNA, 22 bp, Artificial Sequence
  chemically synthesized
acattagttattatacttcatt

SEQ ID NO: 1152636 - DNA, 22 bp, Artificial Sequence
  chemically synthesized
caagagtaatgaagtataataa

SEQ ID NO: 1152637 - DNA, 22 bp, Artificial Sequence
  chemically synthesized
gaggcactaacattagttatta

SEQ ID NO: 1152638 - DNA, 22 bp, Artificial Sequence
  chemically synthesized
agaggcactaacattagttatt

SEQ ID NO: 1152639 - DNA, 22 bp, Artificial Sequence
  chemically synthesized
tcatcttagaggcactaacatt

SEQ ID NO: 1152640 - DNA, 22 bp, Artificial Sequence
  chemically synthesized
tgtcatcttagaggcactaaca

SEQ ID NO: 1152641 - DNA, 22 bp, Artificial Sequence
  chemically synthesized
atcaagactctgtcatcttaga

SEQ ID NO: 1152642 - DNA, 22 bp, Artificial Sequence
  chemically synthesized
atgttagtgcctctaagatgac

SEQ ID NO: 1152643 - DNA, 22 bp, Artificial Sequence
  chemically synthesized
tacctgatcaagactctgtcat

SEQ ID NO: 1152644 - DNA, 22 bp, Artificial Sequence
  chemically synthesized
gtgcctctaagatgacagagtc

SEQ ID NO: 1152645 - DNA, 22 bp, Artificial Sequence
  chemically synthesized
taagatgacagagtcttgatca

SEQ ID NO: 1152646 - DNA, 22 bp, Artificial Sequence
  chemically synthesized
cgaaaattatacctgatcaaga

SEQ ID NO: 1152647 - DNA, 22 bp, Artificial Sequence
  chemically synthesized
agatgacagagtcttgatcagg

SEQ ID NO: 1152648 - DNA, 22 bp, Artificial Sequence
  chemically synthesized
gatcaggtataattttcgtagc

SEQ ID NO: 1152649 - DNA, 22 bp, Artificial Sequence
  chemically synthesized
atcaggtataattttcgtagct

SEQ ID NO: 1152650 - DNA, 22 bp, Artificial Sequence
  chemically synthesized
acagtatatcggtatagctacg

SEQ ID NO: 1152651 - DNA, 22 bp, Artificial Sequence
  chemically synthesized
gacagtatatcggtatagctac

SEQ ID NO: 1152652 - DNA, 22 bp, Artificial Sequence
  chemically synthesized
tttgacagtatatcggtatagc

SEQ ID NO: 1152653 - DNA, 22 bp, Artificial Sequence
  chemically synthesized
gtttgacagtatatcggtatag

SEQ ID NO: 1152654 - DNA, 22 bp, Artificial Sequence
  chemically synthesized
tgtttgacagtatatcggtata

SEQ ID NO: 1152655 - DNA, 22 bp, Artificial Sequence
  chemically synthesized
tcgtagctataccgatatactg

SEQ ID NO: 1152656 - DNA, 22 bp, Artificial Sequence
  chemically synthesized
cgtagctataccgatatactgt

SEQ ID NO: 1152657 - DNA, 22 bp, Artificial Sequence
  chemically synthesized
gtagctataccgatatactgtc

SEQ ID NO: 1152658 - DNA, 22 bp, Artificial Sequence
  chemically synthesized
taccgatatactgtcaaacaaa

SEQ ID NO: 1152659 - DNA, 22 bp, Artificial Sequence
  chemically synthesized
gaatgtcacagctttgtttgac

SEQ ID NO: 1152660 - DNA, 22 bp, Artificial Sequence
  chemically synthesized
agaatgtcacagctttgtttga

SEQ ID NO: 1152661 - DNA, 22 bp, Artificial Sequence
  chemically synthesized
cttagaatgtcacagctttgtt

SEQ ID NO: 1152662 - DNA, 22 bp, Artificial Sequence
  chemically synthesized
tcaaacaaagctgtgacattct

SEQ ID NO: 1152663 - DNA, 22 bp, Artificial Sequence
  chemically synthesized
agtaacattacttagaatgtca

SEQ ID NO: 1152664 - DNA, 22 bp, Artificial Sequence
  chemically synthesized
attcagtaacattacttagaat

SEQ ID NO: 1152665 - DNA, 22 bp, Artificial Sequence
  chemically synthesized
agtattgattcagtaacattac

SEQ ID NO: 1152666 - DNA, 22 bp, Artificial Sequence
  chemically synthesized
tgacattctaagtaatgttact

SEQ ID NO: 1152667 - DNA, 22 bp, Artificial Sequence
  chemically synthesized
ctgagtattgattcagtaacat

SEQ ID NO: 1152668 - DNA, 22 bp, Artificial Sequence
  chemically synthesized
taagtaatgttactgaatcaat

SEQ ID NO: 1152669 - DNA, 22 bp, Artificial Sequence
  chemically synthesized
gaaattactgagtattgattca

SEQ ID NO: 1152670 - DNA, 22 bp, Artificial Sequence
  chemically synthesized
agtaatgttactgaatcaatac

SEQ ID NO: 1152671 - DNA, 22 bp, Artificial Sequence
  chemically synthesized
ttagaaattactgagtattgat

SEQ ID NO: 1152672 - DNA, 22 bp, Artificial Sequence
  chemically synthesized
attagaaattactgagtattga

SEQ ID NO: 1152673 - DNA, 22 bp, Artificial Sequence
  chemically synthesized
tattagaaattactgagtattg

SEQ ID NO: 1152674 - DNA, 22 bp, Artificial Sequence
  chemically synthesized
ctttattagaaattactgagta

SEQ ID NO: 1152675 - DNA, 22 bp, Artificial Sequence
  chemically synthesized
actttattagaaattactgagt

SEQ ID NO: 1152676 - DNA, 22 bp, Artificial Sequence
  chemically synthesized
ctgaatcaatactcagtaattt

SEQ ID NO: 1152677 - DNA, 22 bp, Artificial Sequence
  chemically synthesized
tttactttattagaaattactg

SEQ ID NO: 1152678 - DNA, 22 bp, Artificial Sequence
  chemically synthesized
aatcaatactcagtaatttcta

SEQ ID NO: 1152679 - DNA, 22 bp, Artificial Sequence
  chemically synthesized
ttatttactttattagaaatta

SEQ ID NO: 1152680 - DNA, 22 bp, Artificial Sequence
  chemically synthesized
tcagattattatttactttatt

SEQ ID NO: 1152681 - DNA, 22 bp, Artificial Sequence
  chemically synthesized
agtaatttctaataaagtaaat

SEQ ID NO: 1152682 - DNA, 22 bp, Artificial Sequence
  chemically synthesized
gctatcagattattatttactt

SEQ ID NO: 1152683 - DNA, 22 bp, Artificial Sequence
  chemically synthesized
tagctatcagattattatttac

SEQ ID NO: 1152684 - DNA, 22 bp, Artificial Sequence
  chemically synthesized
ctagctatcagattattattta

SEQ ID NO: 1152685 - DNA, 22 bp, Artificial Sequence
  chemically synthesized
ctaataaagtaaataataatct

SEQ ID NO: 1152686 - DNA, 22 bp, Artificial Sequence
  chemically synthesized
taataaagtaaataataatctg

SEQ ID NO: 1152687 - DNA, 22 bp, Artificial Sequence
  chemically synthesized
ataaagtaaataataatctgat

SEQ ID NO: 1152688 - DNA, 22 bp, Artificial Sequence
  chemically synthesized
caaatcaagtatttctagctat

SEQ ID NO: 1152689 - DNA, 22 bp, Artificial Sequence
  chemically synthesized
acaaatcaagtatttctagcta

SEQ ID NO: 1152690 - DNA, 22 bp, Artificial Sequence
  chemically synthesized
tacaaatcaagtatttctagct

SEQ ID NO: 1152691 - DNA, 22 bp, Artificial Sequence
  chemically synthesized
ttttacaaatcaagtatttcta

SEQ ID NO: 1152692 - DNA, 22 bp, Artificial Sequence
  chemically synthesized
attttacaaatcaagtatttct

SEQ ID NO: 1152693 - DNA, 22 bp, Artificial Sequence
  chemically synthesized
ttattttacaaatcaagtattt

SEQ ID NO: 1152694 - DNA, 22 bp, Artificial Sequence
  chemically synthesized
atagctagaaatacttgatttg

SEQ ID NO: 1152695 - DNA, 22 bp, Artificial Sequence
  chemically synthesized
gaaatacttgatttgtaaaata

SEQ ID NO: 1152696 - DNA, 22 bp, Artificial Sequence
  chemically synthesized
gatttgtaaaataagaatatgg

SEQ ID NO: 1152697 - DNA, 22 bp, Artificial Sequence
  chemically synthesized
atttgtaaaataagaatatggg

SEQ ID NO: 1152698 - DNA, 22 bp, Artificial Sequence
  chemically synthesized
gtaaaataagaatatgggcatg

SEQ ID NO: 1152699 - DNA, 22 bp, Artificial Sequence
  chemically synthesized
taaaataagaatatgggcatgg

SEQ ID NO: 1152700 - DNA, 22 bp, Artificial Sequence
  chemically synthesized
aaataataataatataaaatcc

SEQ ID NO: 1152701 - DNA, 22 bp, Artificial Sequence
  chemically synthesized
ttaaaataataataatataaaa

SEQ ID NO: 1152702 - DNA, 22 bp, Artificial Sequence
  chemically synthesized
tagattattaaaataataataa

SEQ ID NO: 1152703 - DNA, 22 bp, Artificial Sequence
  chemically synthesized
tatattattattattttaataa

SEQ ID NO: 1152704 - DNA, 22 bp, Artificial Sequence
  chemically synthesized
atattattattattttaataat

SEQ ID NO: 1152705 - DNA, 22 bp, Artificial Sequence
  chemically synthesized
tattattattattttaataatc

SEQ ID NO: 1152706 - DNA, 22 bp, Artificial Sequence
  chemically synthesized
cacagtaatgctatagattatt

SEQ ID NO: 1152707 - DNA, 22 bp, Artificial Sequence
  chemically synthesized
gcacagtaatgctatagattat

SEQ ID NO: 1152708 - DNA, 22 bp, Artificial Sequence
  chemically synthesized
ttattattttaataatctatag

SEQ ID NO: 1152709 - DNA, 22 bp, Artificial Sequence
  chemically synthesized
ttattttaataatctatagcat

SEQ ID NO: 1152710 - DNA, 22 bp, Artificial Sequence
  chemically synthesized
ttttaataatctatagcattac

SEQ ID NO: 1152711 - DNA, 22 bp, Artificial Sequence
  chemically synthesized
taataatctatagcattactgt

SEQ ID NO: 1152712 - DNA, 22 bp, Artificial Sequence
  chemically synthesized
aataatctatagcattactgtg

SEQ ID NO: 1152713 - DNA, 22 bp, Artificial Sequence
  chemically synthesized
ataatctatagcattactgtgc

SEQ ID NO: 1152714 - DNA, 22 bp, Artificial Sequence
  chemically synthesized
caagggtatatttgcacagtaa

SEQ ID NO: 1152715 - DNA, 22 bp, Artificial Sequence
  chemically synthesized
tagcattactgtgcaaatatac

SEQ ID NO: 1152716 - DNA, 22 bp, Artificial Sequence
  chemically synthesized
ctgtgcaaatatacccttggaa

SEQ ID NO: 1152717 - DNA, 22 bp, Artificial Sequence
  chemically synthesized
acaagcatcatattccaagggt

SEQ ID NO: 1152718 - DNA, 22 bp, Artificial Sequence
  chemically synthesized
tgcaaatatacccttggaatat

SEQ ID NO: 1152719 - DNA, 22 bp, Artificial Sequence
  chemically synthesized
ttaacaagcatcatattccaag

SEQ ID NO: 1152720 - DNA, 22 bp, Artificial Sequence
  chemically synthesized
tattaacaagcatcatattcca

SEQ ID NO: 1152721 - DNA, 22 bp, Artificial Sequence
  chemically synthesized
ggaatatgatgcttgttaatag

SEQ ID NO: 1152722 - DNA, 22 bp, Artificial Sequence
  chemically synthesized
gaatatgatgcttgttaataga

SEQ ID NO: 1152723 - DNA, 22 bp, Artificial Sequence
  chemically synthesized
atatcccataagaattctatta

SEQ ID NO: 1152724 - DNA, 22 bp, Artificial Sequence
  chemically synthesized
gttaatagaattcttatgggat

SEQ ID NO: 1152725 - DNA, 22 bp, Artificial Sequence
  chemically synthesized
ttaatagaattcttatgggata

SEQ ID NO: 1152726 - DNA, 22 bp, Artificial Sequence
  chemically synthesized
agaagacatctaatatcccata

SEQ ID NO: 1152727 - DNA, 22 bp, Artificial Sequence
  chemically synthesized
atagaattcttatgggatatta

SEQ ID NO: 1152728 - DNA, 22 bp, Artificial Sequence
  chemically synthesized
ttatgggatattagatgtcttc

SEQ ID NO: 1152729 - DNA, 22 bp, Artificial Sequence
  chemically synthesized
aaatcgaattgagaagacatct

SEQ ID NO: 1152730 - DNA, 22 bp, Artificial Sequence
  chemically synthesized
aaaatcgaattgagaagacatc

SEQ ID NO: 1152731 - DNA, 22 bp, Artificial Sequence
  chemically synthesized
atgggatattagatgtcttctc

SEQ ID NO: 1152732 - DNA, 22 bp, Artificial Sequence
  chemically synthesized
taaaatcgaattgagaagacat

SEQ ID NO: 1152733 - DNA, 22 bp, Artificial Sequence
  chemically synthesized
tgggatattagatgtcttctca

SEQ ID NO: 1152734 - DNA, 22 bp, Artificial Sequence
  chemically synthesized
ttaaaatcgaattgagaagaca

SEQ ID NO: 1152735 - DNA, 22 bp, Artificial Sequence
  chemically synthesized
caatttttaaaatcgaattgag

SEQ ID NO: 1152736 - DNA, 22 bp, Artificial Sequence
  chemically synthesized
gatgtcttctcaattcgatttt

SEQ ID NO: 1152737 - DNA, 22 bp, Artificial Sequence
  chemically synthesized
agttacaatttttaaaatcgaa

SEQ ID NO: 1152738 - DNA, 22 bp, Artificial Sequence
  chemically synthesized
ctcaattcgattttaaaaattg

SEQ ID NO: 1152739 - DNA, 22 bp, Artificial Sequence
  chemically synthesized
tcaattcgattttaaaaattgt

SEQ ID NO: 1152740 - DNA, 22 bp, Artificial Sequence
  chemically synthesized
aattcgattttaaaaattgtaa

SEQ ID NO: 1152741 - DNA, 22 bp, Artificial Sequence
  chemically synthesized
gattttaaaaattgtaactgaa

SEQ ID NO: 1152742 - DNA, 22 bp, Artificial Sequence
  chemically synthesized
taaaaattgtaactgaatatca

SEQ ID NO: 1152743 - DNA, 22 bp, Artificial Sequence
  chemically synthesized
aaaaattgtaactgaatatcat

SEQ ID NO: 1152744 - DNA, 22 bp, Artificial Sequence
  chemically synthesized
aaaattgtaactgaatatcatg

SEQ ID NO: 1152745 - DNA, 22 bp, Artificial Sequence
  chemically synthesized
cgtagtagtatgtgcatgatat

SEQ ID NO: 1152746 - DNA, 22 bp, Artificial Sequence
  chemically synthesized
taactgaatatcatgcacatac

SEQ ID NO: 1152747 - DNA, 22 bp, Artificial Sequence
  chemically synthesized
tagtctacgtagtagtatgtgc

SEQ ID NO: 1152748 - DNA, 22 bp, Artificial Sequence
  chemically synthesized
atagtctacgtagtagtatgtg

SEQ ID NO: 1152749 - DNA, 22 bp, Artificial Sequence
  chemically synthesized
tatagtctacgtagtagtatgt

SEQ ID NO: 1152750 - DNA, 22 bp, Artificial Sequence
  chemically synthesized
ttatagtctacgtagtagtatg

SEQ ID NO: 1152751 - DNA, 22 bp, Artificial Sequence
  chemically synthesized
aatatcatgcacatactactac

SEQ ID NO: 1152752 - DNA, 22 bp, Artificial Sequence
  chemically synthesized
ctacgtagactataaaagtgtg

SEQ ID NO: 1152753 - DNA, 22 bp, Artificial Sequence
  chemically synthesized
cgtagactataaaagtgtgatg

SEQ ID NO: 1152754 - DNA, 22 bp, Artificial Sequence
  chemically synthesized
tgtaaaaaagaacatcacactt

SEQ ID NO: 1152755 - DNA, 22 bp, Artificial Sequence
  chemically synthesized
atgtaaaaaagaacatcacact

SEQ ID NO: 1152756 - DNA, 22 bp, Artificial Sequence
  chemically synthesized
gaagtttatgtaaaaaagaaca

SEQ ID NO: 1152757 - DNA, 22 bp, Artificial Sequence
  chemically synthesized
taaaagtgtgatgttctttttt

SEQ ID NO: 1152758 - DNA, 22 bp, Artificial Sequence
  chemically synthesized
acataaatgattggaagtttat

SEQ ID NO: 1152759 - DNA, 22 bp, Artificial Sequence
  chemically synthesized
gacataaatgattggaagttta

SEQ ID NO: 1152760 - DNA, 22 bp, Artificial Sequence
  chemically synthesized
tgacataaatgattggaagttt

SEQ ID NO: 1152761 - DNA, 22 bp, Artificial Sequence
  chemically synthesized
ttttttacataaacttccaatc

SEQ ID NO: 1152762 - DNA, 22 bp, Artificial Sequence
  chemically synthesized
ttttgacataaatgattggaag

SEQ ID NO: 1152763 - DNA, 22 bp, Artificial Sequence
  chemically synthesized
ttttacataaacttccaatcat

SEQ ID NO: 1152764 - DNA, 22 bp, Artificial Sequence
  chemically synthesized
tttacataaacttccaatcatt

SEQ ID NO: 1152765 - DNA, 22 bp, Artificial Sequence
  chemically synthesized
ttacataaacttccaatcattt

SEQ ID NO: 1152766 - DNA, 22 bp, Artificial Sequence
  chemically synthesized
tacataaacttccaatcattta

SEQ ID NO: 1152767 - DNA, 22 bp, Artificial Sequence
  chemically synthesized
acataaacttccaatcatttat

SEQ ID NO: 1152768 - DNA, 22 bp, Artificial Sequence
  chemically synthesized
cataaacttccaatcatttatg

SEQ ID NO: 1152769 - DNA, 22 bp, Artificial Sequence
  chemically synthesized
agtggtagtattattttgacat

SEQ ID NO: 1152770 - DNA, 22 bp, Artificial Sequence
  chemically synthesized
gagtggtagtattattttgaca

SEQ ID NO: 1152771 - DNA, 22 bp, Artificial Sequence
  chemically synthesized
ccaatcatttatgtcaaaataa

SEQ ID NO: 1152772 - DNA, 22 bp, Artificial Sequence
  chemically synthesized
caatcatttatgtcaaaataat

SEQ ID NO: 1152773 - DNA, 22 bp, Artificial Sequence
  chemically synthesized
gtttgagtggtagtattatttt

SEQ ID NO: 1152774 - DNA, 22 bp, Artificial Sequence
  chemically synthesized
atgtcaaaataatactaccact

SEQ ID NO: 1152775 - DNA, 22 bp, Artificial Sequence
  chemically synthesized
tgtcaaaataatactaccactc

SEQ ID NO: 1152776 - DNA, 22 bp, Artificial Sequence
  chemically synthesized
tgaaattggtttgagtggtagt

SEQ ID NO: 1152777 - DNA, 22 bp, Artificial Sequence
  chemically synthesized
actatgaaattggtttgagtgg

SEQ ID NO: 1152778 - DNA, 22 bp, Artificial Sequence
  chemically synthesized
aaccattgactatgaaattggt

SEQ ID NO: 1152779 - DNA, 22 bp, Artificial Sequence
  chemically synthesized
ccactcaaaccaatttcatagt

SEQ ID NO: 1152780 - DNA, 22 bp, Artificial Sequence
  chemically synthesized
atagtgctaaaccattgactat

SEQ ID NO: 1152781 - DNA, 22 bp, Artificial Sequence
  chemically synthesized
aaaccaatttcatagtcaatgg

SEQ ID NO: 1152782 - DNA, 22 bp, Artificial Sequence
  chemically synthesized
aatagtgctaaaccattgacta

SEQ ID NO: 1152783 - DNA, 22 bp, Artificial Sequence
  chemically synthesized
catagtcaatggtttagcacta

SEQ ID NO: 1152784 - DNA, 22 bp, Artificial Sequence
  chemically synthesized
atagtcaatggtttagcactat

SEQ ID NO: 1152785 - DNA, 22 bp, Artificial Sequence
  chemically synthesized
ccatatgcaaatatcttaatag

SEQ ID NO: 1152786 - DNA, 22 bp, Artificial Sequence
  chemically synthesized
cattcccatatgcaaatatctt

SEQ ID NO: 1152787 - DNA, 22 bp, Artificial Sequence
  chemically synthesized
agcactattaagatatttgcat

SEQ ID NO: 1152788 - DNA, 22 bp, Artificial Sequence
  chemically synthesized
ttgcattcccatatgcaaatat

SEQ ID NO: 1152789 - DNA, 22 bp, Artificial Sequence
  chemically synthesized
gcactattaagatatttgcata

SEQ ID NO: 1152790 - DNA, 22 bp, Artificial Sequence
  chemically synthesized
tgttgcattcccatatgcaaat

SEQ ID NO: 1152791 - DNA, 22 bp, Artificial Sequence
  chemically synthesized
tctctgttgcattcccatatgc

SEQ ID NO: 1152792 - DNA, 22 bp, Artificial Sequence
  chemically synthesized
ttaagatatttgcatatgggaa

SEQ ID NO: 1152793 - DNA, 22 bp, Artificial Sequence
  chemically synthesized
tatctctgttgcattcccatat

SEQ ID NO: 1152794 - DNA, 22 bp, Artificial Sequence
  chemically synthesized
ctatctctgttgcattcccata

SEQ ID NO: 1152795 - DNA, 22 bp, Artificial Sequence
  chemically synthesized
agatatttgcatatgggaatgc

SEQ ID NO: 1152796 - DNA, 22 bp, Artificial Sequence
  chemically synthesized
cttctatctctgttgcattccc

SEQ ID NO: 1152797 - DNA, 22 bp, Artificial Sequence
  chemically synthesized
ccttctatctctgttgcattcc

SEQ ID NO: 1152798 - DNA, 22 bp, Artificial Sequence
  chemically synthesized
tccttctatctctgttgcattc

SEQ ID NO: 1152799 - DNA, 22 bp, Artificial Sequence
  chemically synthesized
ttccttctatctctgttgcatt

SEQ ID NO: 1152800 - DNA, 22 bp, Artificial Sequence
  chemically synthesized
tttccttctatctctgttgcat

SEQ ID NO: 1152801 - DNA, 22 bp, Artificial Sequence
  chemically synthesized
ttttccttctatctctgttgca

SEQ ID NO: 1152802 - DNA, 22 bp, Artificial Sequence
  chemically synthesized
gcatatgggaatgcaacagaga

SEQ ID NO: 1152803 - DNA, 22 bp, Artificial Sequence
  chemically synthesized
catatgggaatgcaacagagat

SEQ ID NO: 1152804 - DNA, 22 bp, Artificial Sequence
  chemically synthesized
cttttttccttctatctctgtt

SEQ ID NO: 1152805 - DNA, 22 bp, Artificial Sequence
  chemically synthesized
ccttttttccttctatctctgt

SEQ ID NO: 1152806 - DNA, 22 bp, Artificial Sequence
  chemically synthesized
tccttttttccttctatctctg

SEQ ID NO: 1152807 - DNA, 22 bp, Artificial Sequence
  chemically synthesized
actttccttttttccttctatc

SEQ ID NO: 1152808 - DNA, 22 bp, Artificial Sequence
  chemically synthesized
tgactttccttttttccttcta

SEQ ID NO: 1152809 - DNA, 22 bp, Artificial Sequence
  chemically synthesized
aatctctgactttccttttttc

SEQ ID NO: 1152810 - DNA, 22 bp, Artificial Sequence
  chemically synthesized
caatctctgactttcctttttt

SEQ ID NO: 1152811 - DNA, 22 bp, Artificial Sequence
  chemically synthesized
gtgtcttcaatctctgactttc

SEQ ID NO: 1152812 - DNA, 22 bp, Artificial Sequence
  chemically synthesized
tggtgtcttcaatctctgactt

SEQ ID NO: 1152813 - DNA, 22 bp, Artificial Sequence
  chemically synthesized
tctctggtgtcttcaatctctg

SEQ ID NO: 1152814 - DNA, 22 bp, Artificial Sequence
  chemically synthesized
gtgatgttatctctggtgtctt

SEQ ID NO: 1152815 - DNA, 22 bp, Artificial Sequence
  chemically synthesized
cctggtgatgttatctctggtg

SEQ ID NO: 1152816 - DNA, 22 bp, Artificial Sequence
  chemically synthesized
acctggtgatgttatctctggt

SEQ ID NO: 1152817 - DNA, 22 bp, Artificial Sequence
  chemically synthesized
aagacaccagagataacatcac

SEQ ID NO: 1152818 - DNA, 22 bp, Artificial Sequence
  chemically synthesized
taaagtggcttacctggtgatg

SEQ ID NO: 1152819 - DNA, 22 bp, Artificial Sequence
  chemically synthesized
tagaaaaatacatctgtaaagt

SEQ ID NO: 1152820 - DNA, 22 bp, Artificial Sequence
  chemically synthesized
ataaagctgtagaaaaatacat

SEQ ID NO: 1152821 - DNA, 22 bp, Artificial Sequence
  chemically synthesized
tacagatgtatttttctacagc

SEQ ID NO: 1152822 - DNA, 22 bp, Artificial Sequence
  chemically synthesized
acagatgtatttttctacagct

SEQ ID NO: 1152823 - DNA, 22 bp, Artificial Sequence
  chemically synthesized
cagatgtatttttctacagctt

SEQ ID NO: 1152824 - DNA, 22 bp, Artificial Sequence
  chemically synthesized
ttctacagctttatgaattttt

SEQ ID NO: 1152825 - DNA, 22 bp, Artificial Sequence
  chemically synthesized
tctacagctttatgaatttttt

SEQ ID NO: 1152826 - DNA, 22 bp, Artificial Sequence
  chemically synthesized
ctacagctttatgaattttttt

SEQ ID NO: 1152827 - DNA, 22 bp, Artificial Sequence
  chemically synthesized
ggcatacagcaaaaaaaaattc

SEQ ID NO: 1152828 - DNA, 22 bp, Artificial Sequence
  chemically synthesized
tacagctttatgaatttttttt

SEQ ID NO: 1152829 - DNA, 22 bp, Artificial Sequence
  chemically synthesized
cagctttatgaatttttttttg

SEQ ID NO: 1152830 - DNA, 22 bp, Artificial Sequence
  chemically synthesized
aaacgttgggcatacagcaaaa

SEQ ID NO: 1152831 - DNA, 22 bp, Artificial Sequence
  chemically synthesized
tatgaatttttttttgctgtat

SEQ ID NO: 1152832 - DNA, 22 bp, Artificial Sequence
  chemically synthesized
atgaatttttttttgctgtatg

SEQ ID NO: 1152833 - DNA, 22 bp, Artificial Sequence
  chemically synthesized
tgaatttttttttgctgtatgc

SEQ ID NO: 1152834 - DNA, 22 bp, Artificial Sequence
  chemically synthesized
aattaaaacgttgggcatacag

SEQ ID NO: 1152835 - DNA, 22 bp, Artificial Sequence
  chemically synthesized
caattaaaacgttgggcataca

SEQ ID NO: 1152836 - DNA, 22 bp, Artificial Sequence
  chemically synthesized
ttttttgctgtatgcccaacgt

SEQ ID NO: 1152837 - DNA, 22 bp, Artificial Sequence
  chemically synthesized
tttttgctgtatgcccaacgtt

SEQ ID NO: 1152838 - DNA, 22 bp, Artificial Sequence
  chemically synthesized
ttttgctgtatgcccaacgttt

SEQ ID NO: 1152839 - DNA, 22 bp, Artificial Sequence
  chemically synthesized
tttgctgtatgcccaacgtttt

SEQ ID NO: 1152840 - DNA, 22 bp, Artificial Sequence
  chemically synthesized
ataatttcaattaaaacgttgg

SEQ ID NO: 1152841 - DNA, 22 bp, Artificial Sequence
  chemically synthesized
ttgctgtatgcccaacgtttta

SEQ ID NO: 1152842 - DNA, 22 bp, Artificial Sequence
  chemically synthesized
gataatttcaattaaaacgttg

SEQ ID NO: 1152843 - DNA, 22 bp, Artificial Sequence
  chemically synthesized
tgctgtatgcccaacgttttaa

SEQ ID NO: 1152844 - DNA, 22 bp, Artificial Sequence
  chemically synthesized
gctgtatgcccaacgttttaat

SEQ ID NO: 1152845 - DNA, 22 bp, Artificial Sequence
  chemically synthesized
ctgtatgcccaacgttttaatt

SEQ ID NO: 1152846 - DNA, 22 bp, Artificial Sequence
  chemically synthesized
tatgcccaacgttttaattgaa

SEQ ID NO: 1152847 - DNA, 22 bp, Artificial Sequence
  chemically synthesized
acaagggcatgaaagtttgata

SEQ ID NO: 1152848 - DNA, 22 bp, Artificial Sequence
  chemically synthesized
taattgaaattatcaaactttc

SEQ ID NO: 1152849 - DNA, 22 bp, Artificial Sequence
  chemically synthesized
tgacaagggcatgaaagtttga

SEQ ID NO: 1152850 - DNA, 22 bp, Artificial Sequence
  chemically synthesized
aattgaaattatcaaactttca

SEQ ID NO: 1152851 - DNA, 22 bp, Artificial Sequence
  chemically synthesized
ctgacaagggcatgaaagtttg

SEQ ID NO: 1152852 - DNA, 22 bp, Artificial Sequence
  chemically synthesized
attgaaattatcaaactttcat

SEQ ID NO: 1152853 - DNA, 22 bp, Artificial Sequence
  chemically synthesized
tctgacaagggcatgaaagttt

SEQ ID NO: 1152854 - DNA, 22 bp, Artificial Sequence
  chemically synthesized
aaattatcaaactttcatgccc

SEQ ID NO: 1152855 - DNA, 22 bp, Artificial Sequence
  chemically synthesized
actttctgacaagggcatgaaa

SEQ ID NO: 1152856 - DNA, 22 bp, Artificial Sequence
  chemically synthesized
tcaaactttcatgcccttgtca

SEQ ID NO: 1152857 - DNA, 22 bp, Artificial Sequence
  chemically synthesized
catcatggctaactttctgaca

SEQ ID NO: 1152858 - DNA, 22 bp, Artificial Sequence
  chemically synthesized
tcatgcccttgtcagaaagtta

SEQ ID NO: 1152859 - DNA, 22 bp, Artificial Sequence
  chemically synthesized
catgcccttgtcagaaagttag

SEQ ID NO: 1152860 - DNA, 22 bp, Artificial Sequence
  chemically synthesized
atgcccttgtcagaaagttagc

SEQ ID NO: 1152861 - DNA, 22 bp, Artificial Sequence
  chemically synthesized
gtcagaaagttagccatgatgg

SEQ ID NO: 1152862 - DNA, 22 bp, Artificial Sequence
  chemically synthesized
tccaaatcgtctccatcatggc

SEQ ID NO: 1152863 - DNA, 22 bp, Artificial Sequence
  chemically synthesized
tcagaaagttagccatgatgga

SEQ ID NO: 1152864 - DNA, 22 bp, Artificial Sequence
  chemically synthesized
ttatccaaatcgtctccatcat

SEQ ID NO: 1152865 - DNA, 22 bp, Artificial Sequence
  chemically synthesized
attatccaaatcgtctccatca

SEQ ID NO: 1152866 - DNA, 22 bp, Artificial Sequence
  chemically synthesized
tattatccaaatcgtctccatc

SEQ ID NO: 1152867 - DNA, 22 bp, Artificial Sequence
  chemically synthesized
gttttattatccaaatcgtctc

SEQ ID NO: 1152868 - DNA, 22 bp, Artificial Sequence
  chemically synthesized
gccatgatggagacgatttgga

SEQ ID NO: 1152869 - DNA, 22 bp, Artificial Sequence
  chemically synthesized
actagttttattatccaaatcg

SEQ ID NO: 1152870 - DNA, 22 bp, Artificial Sequence
  chemically synthesized
tattgactagttttattatcca

SEQ ID NO: 1152871 - DNA, 22 bp, Artificial Sequence
  chemically synthesized
attatattgactagttttatta

SEQ ID NO: 1152872 - DNA, 22 bp, Artificial Sequence
  chemically synthesized
tgattatattgactagttttat

SEQ ID NO: 1152873 - DNA, 22 bp, Artificial Sequence
  chemically synthesized
ggataataaaactagtcaatat

SEQ ID NO: 1152874 - DNA, 22 bp, Artificial Sequence
  chemically synthesized
gataataaaactagtcaatata

SEQ ID NO: 1152875 - DNA, 22 bp, Artificial Sequence
  chemically synthesized
gaacacatgttctgattatatt

SEQ ID NO: 1152876 - DNA, 22 bp, Artificial Sequence
  chemically synthesized
agaacacatgttctgattatat

SEQ ID NO: 1152877 - DNA, 22 bp, Artificial Sequence
  chemically synthesized
tagaacacatgttctgattata

SEQ ID NO: 1152878 - DNA, 22 bp, Artificial Sequence
  chemically synthesized
ttagaacacatgttctgattat

SEQ ID NO: 1152879 - DNA, 22 bp, Artificial Sequence
  chemically synthesized
gtcaatataatcagaacatgtg

SEQ ID NO: 1152880 - DNA, 22 bp, Artificial Sequence
  chemically synthesized
agtaaatgtttttagaacacat

SEQ ID NO: 1152881 - DNA, 22 bp, Artificial Sequence
  chemically synthesized
atgctcagtaaatgtttttaga

SEQ ID NO: 1152882 - DNA, 22 bp, Artificial Sequence
  chemically synthesized
gtcaataattgatgctcagtaa

SEQ ID NO: 1152883 - DNA, 22 bp, Artificial Sequence
  chemically synthesized
agtcaataattgatgctcagta

SEQ ID NO: 1152884 - DNA, 22 bp, Artificial Sequence
  chemically synthesized
taaaaacatttactgagcatca

SEQ ID NO: 1152885 - DNA, 22 bp, Artificial Sequence
  chemically synthesized
aaaacatttactgagcatcaat

SEQ ID NO: 1152886 - DNA, 22 bp, Artificial Sequence
  chemically synthesized
agagtgcttagtcaataattga

SEQ ID NO: 1152887 - DNA, 22 bp, Artificial Sequence
  chemically synthesized
cagagtgcttagtcaataattg

SEQ ID NO: 1152888 - DNA, 22 bp, Artificial Sequence
  chemically synthesized
tcagagtgcttagtcaataatt

SEQ ID NO: 1152889 - DNA, 22 bp, Artificial Sequence
  chemically synthesized
actgagcatcaattattgacta

SEQ ID NO: 1152890 - DNA, 22 bp, Artificial Sequence
  chemically synthesized
ctgagcatcaattattgactaa

SEQ ID NO: 1152891 - DNA, 22 bp, Artificial Sequence
  chemically synthesized
tgttttcagagtgcttagtcaa

SEQ ID NO: 1152892 - DNA, 22 bp, Artificial Sequence
  chemically synthesized
agcatcaattattgactaagca

SEQ ID NO: 1152893 - DNA, 22 bp, Artificial Sequence
  chemically synthesized
gtgttttcagagtgcttagtca

SEQ ID NO: 1152894 - DNA, 22 bp, Artificial Sequence
  chemically synthesized
tgtgttttcagagtgcttagtc

SEQ ID NO: 1152895 - DNA, 22 bp, Artificial Sequence
  chemically synthesized
ttgtgttttcagagtgcttagt

SEQ ID NO: 1152896 - DNA, 22 bp, Artificial Sequence
  chemically synthesized
ttttgtgttttcagagtgctta

SEQ ID NO: 1152897 - DNA, 22 bp, Artificial Sequence
  chemically synthesized
cttttgtgttttcagagtgctt

SEQ ID NO: 1152898 - DNA, 22 bp, Artificial Sequence
  chemically synthesized
ttgactaagcactctgaaaaca

SEQ ID NO: 1152899 - DNA, 22 bp, Artificial Sequence
  chemically synthesized
actaagcactctgaaaacacaa

SEQ ID NO: 1152900 - DNA, 22 bp, Artificial Sequence
  chemically synthesized
agcactctgaaaacacaaaaga

SEQ ID NO: 1152901 - DNA, 22 bp, Artificial Sequence
  chemically synthesized
taaccagagagccagatttctt

SEQ ID NO: 1152902 - DNA, 22 bp, Artificial Sequence
  chemically synthesized
tgaaaacacaaaagaaatctgg

SEQ ID NO: 1152903 - DNA, 22 bp, Artificial Sequence
  chemically synthesized
aaaacacaaaagaaatctggct

SEQ ID NO: 1152904 - DNA, 22 bp, Artificial Sequence
  chemically synthesized
tattataaccagagagccagat

SEQ ID NO: 1152905 - DNA, 22 bp, Artificial Sequence
  chemically synthesized
aaaaaatactgtattataacca

SEQ ID NO: 1152906 - DNA, 22 bp, Artificial Sequence
  chemically synthesized
gctctctggttataatacagta

SEQ ID NO: 1152907 - DNA, 22 bp, Artificial Sequence
  chemically synthesized
taatctgaaaaaatactgtatt

SEQ ID NO: 1152908 - DNA, 22 bp, Artificial Sequence
  chemically synthesized
tctggttataatacagtatttt

SEQ ID NO: 1152909 - DNA, 22 bp, Artificial Sequence
  chemically synthesized
tggttataatacagtatttttt

SEQ ID NO: 1152910 - DNA, 22 bp, Artificial Sequence
  chemically synthesized
gttataatacagtattttttca

SEQ ID NO: 1152911 - DNA, 22 bp, Artificial Sequence
  chemically synthesized
taatacagtattttttcagatt

SEQ ID NO: 1152912 - DNA, 22 bp, Artificial Sequence
  chemically synthesized
tttcagattatagtgtttatcc

SEQ ID NO: 1152913 - DNA, 22 bp, Artificial Sequence
  chemically synthesized
tgatggtaagggggataaacac

SEQ ID NO: 1152914 - DNA, 22 bp, Artificial Sequence
  chemically synthesized
ttcagattatagtgtttatccc

SEQ ID NO: 1152915 - DNA, 22 bp, Artificial Sequence
  chemically synthesized
tcagattatagtgtttatcccc

SEQ ID NO: 1152916 - DNA, 22 bp, Artificial Sequence
  chemically synthesized
cagattatagtgtttatccccc

SEQ ID NO: 1152917 - DNA, 22 bp, Artificial Sequence
  chemically synthesized
agattatagtgtttatccccct

SEQ ID NO: 1152918 - DNA, 22 bp, Artificial Sequence
  chemically synthesized
atggttatgatggtaaggggga

SEQ ID NO: 1152919 - DNA, 22 bp, Artificial Sequence
  chemically synthesized
aatggttatgatggtaaggggg

SEQ ID NO: 1152920 - DNA, 22 bp, Artificial Sequence
  chemically synthesized
tagtgtttatcccccttaccat

SEQ ID NO: 1152921 - DNA, 22 bp, Artificial Sequence
  chemically synthesized
atcccccttaccatcataacca

SEQ ID NO: 1152922 - DNA, 22 bp, Artificial Sequence
  chemically synthesized
atgaaagtttaatggttatgat

SEQ ID NO: 1152923 - DNA, 22 bp, Artificial Sequence
  chemically synthesized
tcccccttaccatcataaccat

SEQ ID NO: 1152924 - DNA, 22 bp, Artificial Sequence
  chemically synthesized
aatgaaagtttaatggttatga

SEQ ID NO: 1152925 - DNA, 22 bp, Artificial Sequence
  chemically synthesized
accatcataaccattaaacttt

SEQ ID NO: 1152926 - DNA, 22 bp, Artificial Sequence
  chemically synthesized
ccatcataaccattaaactttc

SEQ ID NO: 1152927 - DNA, 22 bp, Artificial Sequence
  chemically synthesized
ataagtgcttaatgaaagttta

SEQ ID NO: 1152928 - DNA, 22 bp, Artificial Sequence
  chemically synthesized
ccctcataagtgcttaatgaaa

SEQ ID NO: 1152929 - DNA, 22 bp, Artificial Sequence
  chemically synthesized
gccctcataagtgcttaatgaa

SEQ ID NO: 1152930 - DNA, 22 bp, Artificial Sequence
  chemically synthesized
tgccctcataagtgcttaatga

SEQ ID NO: 1152931 - DNA, 22 bp, Artificial Sequence
  chemically synthesized
ttgccctcataagtgcttaatg

SEQ ID NO: 1152932 - DNA, 22 bp, Artificial Sequence
  chemically synthesized
tcttttgccctcataagtgctt

SEQ ID NO: 1152933 - DNA, 22 bp, Artificial Sequence
  chemically synthesized
aactttcattaagcacttatga

SEQ ID NO: 1152934 - DNA, 22 bp, Artificial Sequence
  chemically synthesized
ctgtcttttgccctcataagtg

SEQ ID NO: 1152935 - DNA, 22 bp, Artificial Sequence
  chemically synthesized
cctgtcttttgccctcataagt

SEQ ID NO: 1152936 - DNA, 22 bp, Artificial Sequence
  chemically synthesized
tcattaagcacttatgagggca

SEQ ID NO: 1152937 - DNA, 22 bp, Artificial Sequence
  chemically synthesized
tttcctgtcttttgccctcata

SEQ ID NO: 1152938 - DNA, 22 bp, Artificial Sequence
  chemically synthesized
cattaagcacttatgagggcaa

SEQ ID NO: 1152939 - DNA, 22 bp, Artificial Sequence
  chemically synthesized
atttcctgtcttttgccctcat

SEQ ID NO: 1152940 - DNA, 22 bp, Artificial Sequence
  chemically synthesized
attaagcacttatgagggcaaa

SEQ ID NO: 1152941 - DNA, 22 bp, Artificial Sequence
  chemically synthesized
tatttcctgtcttttgccctca

SEQ ID NO: 1152942 - DNA, 22 bp, Artificial Sequence
  chemically synthesized
agcacttatgagggcaaaagac

SEQ ID NO: 1152943 - DNA, 22 bp, Artificial Sequence
  chemically synthesized
attttatttcctgtcttttgcc

SEQ ID NO: 1152944 - DNA, 22 bp, Artificial Sequence
  chemically synthesized
cattttatttcctgtcttttgc

SEQ ID NO: 1152945 - DNA, 22 bp, Artificial Sequence
  chemically synthesized
atgagggcaaaagacaggaaat

SEQ ID NO: 1152946 - DNA, 22 bp, Artificial Sequence
  chemically synthesized
tgagggcaaaagacaggaaata

SEQ ID NO: 1152947 - DNA, 22 bp, Artificial Sequence
  chemically synthesized
tgaagtttcattttatttcctg

SEQ ID NO: 1152948 - DNA, 22 bp, Artificial Sequence
  chemically synthesized
ctatgaagtttcattttatttc

SEQ ID NO: 1152949 - DNA, 22 bp, Artificial Sequence
  chemically synthesized
tgctatgaagtttcattttatt

SEQ ID NO: 1152950 - DNA, 22 bp, Artificial Sequence
  chemically synthesized
ctgctatgaagtttcattttat

SEQ ID NO: 1152951 - DNA, 22 bp, Artificial Sequence
  chemically synthesized
tttctgctatgaagtttcattt

SEQ ID NO: 1152952 - DNA, 22 bp, Artificial Sequence
  chemically synthesized
gtttctgctatgaagtttcatt

SEQ ID NO: 1152953 - DNA, 22 bp, Artificial Sequence
  chemically synthesized
tttgtttctgctatgaagtttc

SEQ ID NO: 1152954 - DNA, 22 bp, Artificial Sequence
  chemically synthesized
catgttgtttgtttctgctatg

SEQ ID NO: 1152955 - DNA, 22 bp, Artificial Sequence
  chemically synthesized
aaattacatgttgtttgtttct

SEQ ID NO: 1152956 - DNA, 22 bp, Artificial Sequence
  chemically synthesized
catagcagaaacaaacaacatg

SEQ ID NO: 1152957 - DNA, 22 bp, Artificial Sequence
  chemically synthesized
atagcagaaacaaacaacatgt

SEQ ID NO: 1152958 - DNA, 22 bp, Artificial Sequence
  chemically synthesized
gcaaggttaaaattacatgttg

SEQ ID NO: 1152959 - DNA, 22 bp, Artificial Sequence
  chemically synthesized
agcaaggttaaaattacatgtt

SEQ ID NO: 1152960 - DNA, 22 bp, Artificial Sequence
  chemically synthesized
atatttagcaaggttaaaatta

SEQ ID NO: 1152961 - DNA, 22 bp, Artificial Sequence
  chemically synthesized
tcatatttagcaaggttaaaat

SEQ ID NO: 1152962 - DNA, 22 bp, Artificial Sequence
  chemically synthesized
actctcatatttagcaaggtta

SEQ ID NO: 1152963 - DNA, 22 bp, Artificial Sequence
  chemically synthesized
gcaaactcactctcatatttag

SEQ ID NO: 1152964 - DNA, 22 bp, Artificial Sequence
  chemically synthesized
taaccttgctaaatatgagagt

SEQ ID NO: 1152965 - DNA, 22 bp, Artificial Sequence
  chemically synthesized
aaccttgctaaatatgagagtg

SEQ ID NO: 1152966 - DNA, 22 bp, Artificial Sequence
  chemically synthesized
accttgctaaatatgagagtga

SEQ ID NO: 1152967 - DNA, 22 bp, Artificial Sequence
  chemically synthesized
gtggttagcaaactcactctca

SEQ ID NO: 1152968 - DNA, 22 bp, Artificial Sequence
  chemically synthesized
agtggttagcaaactcactctc

SEQ ID NO: 1152969 - DNA, 22 bp, Artificial Sequence
  chemically synthesized
tagtggttagcaaactcactct

SEQ ID NO: 1152970 - DNA, 22 bp, Artificial Sequence
  chemically synthesized
ttagtggttagcaaactcactc

SEQ ID NO: 1152971 - DNA, 22 bp, Artificial Sequence
  chemically synthesized
gctaaatatgagagtgagtttg

SEQ ID NO: 1152972 - DNA, 22 bp, Artificial Sequence
  chemically synthesized
ctaaatatgagagtgagtttgc

SEQ ID NO: 1152973 - DNA, 22 bp, Artificial Sequence
  chemically synthesized
aatatgagagtgagtttgctaa

SEQ ID NO: 1152974 - DNA, 22 bp, Artificial Sequence
  chemically synthesized
gctaaccactaaaagcaccact

SEQ ID NO: 1152975 - DNA, 22 bp, Artificial Sequence
  chemically synthesized
ctaaccactaaaagcaccactt

SEQ ID NO: 1152976 - DNA, 22 bp, Artificial Sequence
  chemically synthesized
accactaaaagcaccacttgat

SEQ ID NO: 1152977 - DNA, 22 bp, Artificial Sequence
  chemically synthesized
acagtgccataggatcaagtgg

SEQ ID NO: 1152978 - DNA, 22 bp, Artificial Sequence
  chemically synthesized
gacagtgccataggatcaagtg

SEQ ID NO: 1152979 - DNA, 22 bp, Artificial Sequence
  chemically synthesized
aaagcaccacttgatcctatgg

SEQ ID NO: 1152980 - DNA, 22 bp, Artificial Sequence
  chemically synthesized
agtttgacagtgccataggatc

SEQ ID NO: 1152981 - DNA, 22 bp, Artificial Sequence
  chemically synthesized
agttaagtttgacagtgccata

SEQ ID NO: 1152982 - DNA, 22 bp, Artificial Sequence
  chemically synthesized
gatcctatggcactgtcaaact

SEQ ID NO: 1152983 - DNA, 22 bp, Artificial Sequence
  chemically synthesized
atcctatggcactgtcaaactt

SEQ ID NO: 1152984 - DNA, 22 bp, Artificial Sequence
  chemically synthesized
tggcactgtcaaacttaactga

SEQ ID NO: 1152985 - DNA, 22 bp, Artificial Sequence
  chemically synthesized
gaagaaggataagtgattcagt

SEQ ID NO: 1152986 - DNA, 22 bp, Artificial Sequence
  chemically synthesized
tcaaacttaactgaatcactta

SEQ ID NO: 1152987 - DNA, 22 bp, Artificial Sequence
  chemically synthesized
aactgaatcacttatccttctt

SEQ ID NO: 1152988 - DNA, 22 bp, Artificial Sequence
  chemically synthesized
actgaatcacttatccttcttc

SEQ ID NO: 1152989 - DNA, 22 bp, Artificial Sequence
  chemically synthesized
aatcacttatccttcttccaac

SEQ ID NO: 1152990 - DNA, 22 bp, Artificial Sequence
  chemically synthesized
atccttcttccaactattgcat

SEQ ID NO: 1152991 - DNA, 22 bp, Artificial Sequence
  chemically synthesized
tccttcttccaactattgcatt

SEQ ID NO: 1152992 - DNA, 22 bp, Artificial Sequence
  chemically synthesized
cttccaactattgcatttctct

SEQ ID NO: 1152993 - DNA, 22 bp, Artificial Sequence
  chemically synthesized
ttccaactattgcatttctctt

SEQ ID NO: 1152994 - DNA, 22 bp, Artificial Sequence
  chemically synthesized
ccaactattgcatttctctttt

SEQ ID NO: 1152995 - DNA, 22 bp, Artificial Sequence
  chemically synthesized
caactattgcatttctcttttt

SEQ ID NO: 1152996 - DNA, 22 bp, Artificial Sequence
  chemically synthesized
agaaaataggcagtgaaaaaga

SEQ ID NO: 1152997 - DNA, 22 bp, Artificial Sequence
  chemically synthesized
ttgcatttctctttttcactgc

SEQ ID NO: 1152998 - DNA, 22 bp, Artificial Sequence
  chemically synthesized
catttctctttttcactgccta

SEQ ID NO: 1152999 - DNA, 22 bp, Artificial Sequence
  chemically synthesized
gtaattaagaaaataggcagtg

SEQ ID NO: 1153000 - DNA, 22 bp, Artificial Sequence
  chemically synthesized
ctctttttcactgcctattttc

SEQ ID NO: 1153001 - DNA, 22 bp, Artificial Sequence
  chemically synthesized
tctttttcactgcctattttct

SEQ ID NO: 1153002 - DNA, 22 bp, Artificial Sequence
  chemically synthesized
agattggtaattaagaaaatag

SEQ ID NO: 1153003 - DNA, 22 bp, Artificial Sequence
  chemically synthesized
tttttcactgcctattttctta

SEQ ID NO: 1153004 - DNA, 22 bp, Artificial Sequence
  chemically synthesized
gagattggtaattaagaaaata

SEQ ID NO: 1153005 - DNA, 22 bp, Artificial Sequence
  chemically synthesized
tttcactgcctattttcttaat

SEQ ID NO: 1153006 - DNA, 22 bp, Artificial Sequence
  chemically synthesized
ttcactgcctattttcttaatt

SEQ ID NO: 1153007 - DNA, 22 bp, Artificial Sequence
  chemically synthesized
tcactgcctattttcttaatta

SEQ ID NO: 1153008 - DNA, 22 bp, Artificial Sequence
  chemically synthesized
cactgcctattttcttaattac

SEQ ID NO: 1153009 - DNA, 22 bp, Artificial Sequence
  chemically synthesized
actgcctattttcttaattacc

SEQ ID NO: 1153010 - DNA, 22 bp, Artificial Sequence
  chemically synthesized
ggacttgagattggtaattaag

SEQ ID NO: 1153011 - DNA, 22 bp, Artificial Sequence
  chemically synthesized
cctattttcttaattaccaatc

SEQ ID NO: 1153012 - DNA, 22 bp, Artificial Sequence
  chemically synthesized
ttttcttaattaccaatctcaa

SEQ ID NO: 1153013 - DNA, 22 bp, Artificial Sequence
  chemically synthesized
ggcaattgggacttgagattgg

SEQ ID NO: 1153014 - DNA, 22 bp, Artificial Sequence
  chemically synthesized
tcttaattaccaatctcaagtc

SEQ ID NO: 1153015 - DNA, 22 bp, Artificial Sequence
  chemically synthesized
cttaattaccaatctcaagtcc

SEQ ID NO: 1153016 - DNA, 22 bp, Artificial Sequence
  chemically synthesized
ttaattaccaatctcaagtccc

SEQ ID NO: 1153017 - DNA, 22 bp, Artificial Sequence
  chemically synthesized
ggactgggcaattgggacttga

SEQ ID NO: 1153018 - DNA, 22 bp, Artificial Sequence
  chemically synthesized
aattaccaatctcaagtcccaa

SEQ ID NO: 1153019 - DNA, 22 bp, Artificial Sequence
  chemically synthesized
attaccaatctcaagtcccaat

SEQ ID NO: 1153020 - DNA, 22 bp, Artificial Sequence
  chemically synthesized
tgggactgggcaattgggactt

SEQ ID NO: 1153021 - DNA, 22 bp, Artificial Sequence
  chemically synthesized
ccaatctcaagtcccaattgcc

SEQ ID NO: 1153022 - DNA, 22 bp, Artificial Sequence
  chemically synthesized
aagtcccaattgcccagtccca

SEQ ID NO: 1153023 - DNA, 22 bp, Artificial Sequence
  chemically synthesized
aaagtaatagattctgggactg

SEQ ID NO: 1153024 - DNA, 22 bp, Artificial Sequence
  chemically synthesized
cccagtcccagaatctattact

SEQ ID NO: 1153025 - DNA, 22 bp, Artificial Sequence
  chemically synthesized
ggatatgaacaaaaagctcaaa

SEQ ID NO: 1153026 - DNA, 22 bp, Artificial Sequence
  chemically synthesized
aggatatgaacaaaaagctcaa

SEQ ID NO: 1153027 - DNA, 22 bp, Artificial Sequence
  chemically synthesized
gatttaggatatgaacaaaaag

SEQ ID NO: 1153028 - DNA, 22 bp, Artificial Sequence
  chemically synthesized
ttactttgagctttttgttcat

SEQ ID NO: 1153029 - DNA, 22 bp, Artificial Sequence
  chemically synthesized
ctttgagctttttgttcatatc

SEQ ID NO: 1153030 - DNA, 22 bp, Artificial Sequence
  chemically synthesized
tgagctttttgttcatatccta

SEQ ID NO: 1153031 - DNA, 22 bp, Artificial Sequence
  chemically synthesized
gagctttttgttcatatcctaa

SEQ ID NO: 1153032 - DNA, 22 bp, Artificial Sequence
  chemically synthesized
agctttttgttcatatcctaaa

SEQ ID NO: 1153033 - DNA, 22 bp, Artificial Sequence
  chemically synthesized
tttgttcatatcctaaatctag

SEQ ID NO: 1153034 - DNA, 22 bp, Artificial Sequence
  chemically synthesized
ttgttcatatcctaaatctagt

SEQ ID NO: 1153035 - DNA, 22 bp, Artificial Sequence
  chemically synthesized
tgttcatatcctaaatctagtc

SEQ ID NO: 1153036 - DNA, 22 bp, Artificial Sequence
  chemically synthesized
gttcatatcctaaatctagtcc

SEQ ID NO: 1153037 - DNA, 22 bp, Artificial Sequence
  chemically synthesized
ttcatatcctaaatctagtcct

SEQ ID NO: 1153038 - DNA, 22 bp, Artificial Sequence
  chemically synthesized
atatcctaaatctagtcctatt

SEQ ID NO: 1153039 - DNA, 22 bp, Artificial Sequence
  chemically synthesized
gatatcaaatcaaaaccaatag

SEQ ID NO: 1153040 - DNA, 22 bp, Artificial Sequence
  chemically synthesized
tggatatcaaatcaaaaccaat

SEQ ID NO: 1153041 - DNA, 22 bp, Artificial Sequence
  chemically synthesized
aatctagtcctattggttttga

SEQ ID NO: 1153042 - DNA, 22 bp, Artificial Sequence
  chemically synthesized
gtcctattggttttgatttgat

SEQ ID NO: 1153043 - DNA, 22 bp, Artificial Sequence
  chemically synthesized
ttggttttgatttgatatccag

SEQ ID NO: 1153044 - DNA, 22 bp, Artificial Sequence
  chemically synthesized
gttttgatttgatatccagaat

SEQ ID NO: 1153045 - DNA, 22 bp, Artificial Sequence
  chemically synthesized
tgatttgatatccagaatgctt

SEQ ID NO: 1153046 - DNA, 22 bp, Artificial Sequence
  chemically synthesized
taaacaggtacaaagcattctg

SEQ ID NO: 1153047 - DNA, 22 bp, Artificial Sequence
  chemically synthesized
gatttgatatccagaatgcttt

SEQ ID NO: 1153048 - DNA, 22 bp, Artificial Sequence
  chemically synthesized
atttgatatccagaatgctttg

SEQ ID NO: 1153049 - DNA, 22 bp, Artificial Sequence
  chemically synthesized
gatatccagaatgctttgtacc

SEQ ID NO: 1153050 - DNA, 22 bp, Artificial Sequence
  chemically synthesized
atatccagaatgctttgtacct

SEQ ID NO: 1153051 - DNA, 22 bp, Artificial Sequence
  chemically synthesized
tgtacctgtttacaatttttgt

SEQ ID NO: 1153052 - DNA, 22 bp, Artificial Sequence
  chemically synthesized
gtacctgtttacaatttttgtt

SEQ ID NO: 1153053 - DNA, 22 bp, Artificial Sequence
  chemically synthesized
tacctgtttacaatttttgttg

SEQ ID NO: 1153054 - DNA, 22 bp, Artificial Sequence
  chemically synthesized
aatgaaagcaatgacaacaaaa

SEQ ID NO: 1153055 - DNA, 22 bp, Artificial Sequence
  chemically synthesized
tttacaatttttgttgtcattg

SEQ ID NO: 1153056 - DNA, 22 bp, Artificial Sequence
  chemically synthesized
acaatttttgttgtcattgctt

SEQ ID NO: 1153057 - DNA, 22 bp, Artificial Sequence
  chemically synthesized
caatttttgttgtcattgcttt

SEQ ID NO: 1153058 - DNA, 22 bp, Artificial Sequence
  chemically synthesized
ttgttgtcattgctttcattca

SEQ ID NO: 1153059 - DNA, 22 bp, Artificial Sequence
  chemically synthesized
tgttgtcattgctttcattcag

SEQ ID NO: 1153060 - DNA, 22 bp, Artificial Sequence
  chemically synthesized
gttgtcattgctttcattcagg

SEQ ID NO: 1153061 - DNA, 22 bp, Artificial Sequence
  chemically synthesized
ttgtcattgctttcattcaggc

SEQ ID NO: 1153062 - DNA, 22 bp, Artificial Sequence
  chemically synthesized
aaagtatatagagcctgaatga

SEQ ID NO: 1153063 - DNA, 22 bp, Artificial Sequence
  chemically synthesized
tcattgctttcattcaggctct

SEQ ID NO: 1153064 - DNA, 22 bp, Artificial Sequence
  chemically synthesized
ctgaaagtatatagagcctgaa

SEQ ID NO: 1153065 - DNA, 22 bp, Artificial Sequence
  chemically synthesized
ctttcattcaggctctatatac

SEQ ID NO: 1153066 - DNA, 22 bp, Artificial Sequence
  chemically synthesized
tcattcaggctctatatacttt

SEQ ID NO: 1153067 - DNA, 22 bp, Artificial Sequence
  chemically synthesized
cattcaggctctatatactttc

SEQ ID NO: 1153068 - DNA, 22 bp, Artificial Sequence
  chemically synthesized
attcaggctctatatactttca

SEQ ID NO: 1153069 - DNA, 22 bp, Artificial Sequence
  chemically synthesized
agaggatattgctgaaagtata

SEQ ID NO: 1153070 - DNA, 22 bp, Artificial Sequence
  chemically synthesized
aggctctatatactttcagcaa

SEQ ID NO: 1153071 - DNA, 22 bp, Artificial Sequence
  chemically synthesized
tatatactttcagcaatatcct

SEQ ID NO: 1153072 - DNA, 22 bp, Artificial Sequence
  chemically synthesized
tatactttcagcaatatcctct

SEQ ID NO: 1153073 - DNA, 22 bp, Artificial Sequence
  chemically synthesized
tcagcaatatcctcttaacatg

SEQ ID NO: 1153074 - DNA, 22 bp, Artificial Sequence
  chemically synthesized
cagcaatatcctcttaacatgt

SEQ ID NO: 1153075 - DNA, 22 bp, Artificial Sequence
  chemically synthesized
agcaatatcctcttaacatgtt

SEQ ID NO: 1153076 - DNA, 22 bp, Artificial Sequence
  chemically synthesized
ttaacatgttttccggcctcct

SEQ ID NO: 1153077 - DNA, 22 bp, Artificial Sequence
  chemically synthesized
aacatgttttccggcctcctgt

SEQ ID NO: 1153078 - DNA, 22 bp, Artificial Sequence
  chemically synthesized
acatgttttccggcctcctgtt

SEQ ID NO: 1153079 - DNA, 22 bp, Artificial Sequence
  chemically synthesized
tccggcctcctgtttctctgct

SEQ ID NO: 1153080 - DNA, 22 bp, Artificial Sequence
  chemically synthesized
ccggcctcctgtttctctgctc

SEQ ID NO: 1153081 - DNA, 22 bp, Artificial Sequence
  chemically synthesized
cggcctcctgtttctctgctct

SEQ ID NO: 1153082 - DNA, 22 bp, Artificial Sequence
  chemically synthesized
aggataaataaaagagcagaga

SEQ ID NO: 1153083 - DNA, 22 bp, Artificial Sequence
  chemically synthesized
gaggataaataaaagagcagag

SEQ ID NO: 1153084 - DNA, 22 bp, Artificial Sequence
  chemically synthesized
tgaggataaataaaagagcaga

SEQ ID NO: 1153085 - DNA, 22 bp, Artificial Sequence
  chemically synthesized
ttgaggataaataaaagagcag

SEQ ID NO: 1153086 - DNA, 22 bp, Artificial Sequence
  chemically synthesized
tttgaggataaataaaagagca

SEQ ID NO: 1153087 - DNA, 22 bp, Artificial Sequence
  chemically synthesized
ctgtttctctgctcttttattt

SEQ ID NO: 1153088 - DNA, 22 bp, Artificial Sequence
  chemically synthesized
tttctctgctcttttatttatc

SEQ ID NO: 1153089 - DNA, 22 bp, Artificial Sequence
  chemically synthesized
ctctgctcttttatttatcctc

SEQ ID NO: 1153090 - DNA, 22 bp, Artificial Sequence
  chemically synthesized
tctgctcttttatttatcctca

SEQ ID NO: 1153091 - DNA, 22 bp, Artificial Sequence
  chemically synthesized
agaagatattttttgaggataa

SEQ ID NO: 1153092 - DNA, 22 bp, Artificial Sequence
  chemically synthesized
tgctcttttatttatcctcaaa

SEQ ID NO: 1153093 - DNA, 22 bp, Artificial Sequence
  chemically synthesized
aagaagatattttttgaggata

SEQ ID NO: 1153094 - DNA, 22 bp, Artificial Sequence
  chemically synthesized
ctcttttatttatcctcaaaaa

SEQ ID NO: 1153095 - DNA, 22 bp, Artificial Sequence
  chemically synthesized
ttttatttatcctcaaaaaata

SEQ ID NO: 1153096 - DNA, 22 bp, Artificial Sequence
  chemically synthesized
atatttaagaagatattttttg

SEQ ID NO: 1153097 - DNA, 22 bp, Artificial Sequence
  chemically synthesized
ttatttatcctcaaaaaatatc

SEQ ID NO: 1153098 - DNA, 22 bp, Artificial Sequence
  chemically synthesized
aatatttaagaagatatttttt

SEQ ID NO: 1153099 - DNA, 22 bp, Artificial Sequence
  chemically synthesized
tatttatcctcaaaaaatatct

SEQ ID NO: 1153100 - DNA, 22 bp, Artificial Sequence
  chemically synthesized
atttatcctcaaaaaatatctt

SEQ ID NO: 1153101 - DNA, 22 bp, Artificial Sequence
  chemically synthesized
tttatcctcaaaaaatatcttc

SEQ ID NO: 1153102 - DNA, 22 bp, Artificial Sequence
  chemically synthesized
tcttaatatttaagaagatatt

SEQ ID NO: 1153103 - DNA, 22 bp, Artificial Sequence
  chemically synthesized
atcttaatatttaagaagatat

SEQ ID NO: 1153104 - DNA, 22 bp, Artificial Sequence
  chemically synthesized
atcctcaaaaaatatcttctta

SEQ ID NO: 1153105 - DNA, 22 bp, Artificial Sequence
  chemically synthesized
tcctcaaaaaatatcttcttaa

SEQ ID NO: 1153106 - DNA, 22 bp, Artificial Sequence
  chemically synthesized
aaaaaatatcttcttaaatatt

SEQ ID NO: 1153107 - DNA, 22 bp, Artificial Sequence
  chemically synthesized
ggaaaacttatcttaatattta

SEQ ID NO: 1153108 - DNA, 22 bp, Artificial Sequence
  chemically synthesized
aggaaaacttatcttaatattt

SEQ ID NO: 1153109 - DNA, 22 bp, Artificial Sequence
  chemically synthesized
cttaaatattaagataagtttt

SEQ ID NO: 1153110 - DNA, 22 bp, Artificial Sequence
  chemically synthesized
ttaaatattaagataagttttc

SEQ ID NO: 1153111 - DNA, 22 bp, Artificial Sequence
  chemically synthesized
aaatattaagataagttttcct

SEQ ID NO: 1153112 - DNA, 22 bp, Artificial Sequence
  chemically synthesized
aatattaagataagttttccta

SEQ ID NO: 1153113 - DNA, 22 bp, Artificial Sequence
  chemically synthesized
gaaatagcagcaatttaggaaa

SEQ ID NO: 1153114 - DNA, 22 bp, Artificial Sequence
  chemically synthesized
agataagttttcctaaattgct

SEQ ID NO: 1153115 - DNA, 22 bp, Artificial Sequence
  chemically synthesized
aactagaaatagcagcaattta

SEQ ID NO: 1153116 - DNA, 22 bp, Artificial Sequence
  chemically synthesized
tcctaaattgctgctatttcta

SEQ ID NO: 1153117 - DNA, 22 bp, Artificial Sequence
  chemically synthesized
cctaaattgctgctatttctag

SEQ ID NO: 1153118 - DNA, 22 bp, Artificial Sequence
  chemically synthesized
ctaaattgctgctatttctagt

SEQ ID NO: 1153119 - DNA, 22 bp, Artificial Sequence
  chemically synthesized
atgagaaattaaactagaaata

SEQ ID NO: 1153120 - DNA, 22 bp, Artificial Sequence
  chemically synthesized
aattgctgctatttctagttta

SEQ ID NO: 1153121 - DNA, 22 bp, Artificial Sequence
  chemically synthesized
ttcatgagaaattaaactagaa

SEQ ID NO: 1153122 - DNA, 22 bp, Artificial Sequence
  chemically synthesized
ctgctatttctagtttaatttc

SEQ ID NO: 1153123 - DNA, 22 bp, Artificial Sequence
  chemically synthesized
ctatttctagtttaatttctca

SEQ ID NO: 1153124 - DNA, 22 bp, Artificial Sequence
  chemically synthesized
tttctagtttaatttctcatga

SEQ ID NO: 1153125 - DNA, 22 bp, Artificial Sequence
  chemically synthesized
ctagtttaatttctcatgaata

SEQ ID NO: 1153126 - DNA, 22 bp, Artificial Sequence
  chemically synthesized
tagtttaatttctcatgaataa

SEQ ID NO: 1153127 - DNA, 22 bp, Artificial Sequence
  chemically synthesized
gtttaatttctcatgaataatg

SEQ ID NO: 1153128 - DNA, 22 bp, Artificial Sequence
  chemically synthesized
tgagtaacaggaaaccattatt

SEQ ID NO: 1153129 - DNA, 22 bp, Artificial Sequence
  chemically synthesized
aatttctcatgaataatggttt

SEQ ID NO: 1153130 - DNA, 22 bp, Artificial Sequence
  chemically synthesized
atttctcatgaataatggtttc

SEQ ID NO: 1153131 - DNA, 22 bp, Artificial Sequence
  chemically synthesized
tatgagtaacaggaaaccatta

SEQ ID NO: 1153132 - DNA, 22 bp, Artificial Sequence
  chemically synthesized
ctcatgaataatggtttcctgt

SEQ ID NO: 1153133 - DNA, 22 bp, Artificial Sequence
  chemically synthesized
tcatgaataatggtttcctgtt

SEQ ID NO: 1153134 - DNA, 22 bp, Artificial Sequence
  chemically synthesized
atgaataatggtttcctgttac

SEQ ID NO: 1153135 - DNA, 22 bp, Artificial Sequence
  chemically synthesized
cagtagtagttctatgagtaac

SEQ ID NO: 1153136 - DNA, 22 bp, Artificial Sequence
  chemically synthesized
gcagtagtagttctatgagtaa

SEQ ID NO: 1153137 - DNA, 22 bp, Artificial Sequence
  chemically synthesized
cctgttactcatagaactacta

SEQ ID NO: 1153138 - DNA, 22 bp, Artificial Sequence
  chemically synthesized
aggcatttgcagtagtagttct

SEQ ID NO: 1153139 - DNA, 22 bp, Artificial Sequence
  chemically synthesized
ctgttactcatagaactactac

SEQ ID NO: 1153140 - DNA, 22 bp, Artificial Sequence
  chemically synthesized
ttactcatagaactactactgc

SEQ ID NO: 1153141 - DNA, 22 bp, Artificial Sequence
  chemically synthesized
ctcatagaactactactgcaaa

SEQ ID NO: 1153142 - DNA, 22 bp, Artificial Sequence
  chemically synthesized
atagaactactactgcaaatgc

SEQ ID NO: 1153143 - DNA, 22 bp, Artificial Sequence
  chemically synthesized
tataaaagactcaggcatttgc

SEQ ID NO: 1153144 - DNA, 22 bp, Artificial Sequence
  chemically synthesized
atataaaagactcaggcatttg

SEQ ID NO: 1153145 - DNA, 22 bp, Artificial Sequence
  chemically synthesized
ctactgcaaatgcctgagtctt

SEQ ID NO: 1153146 - DNA, 22 bp, Artificial Sequence
  chemically synthesized
ctgcaaatgcctgagtctttta

SEQ ID NO: 1153147 - DNA, 22 bp, Artificial Sequence
  chemically synthesized
caaatgcctgagtcttttatat

SEQ ID NO: 1153148 - DNA, 22 bp, Artificial Sequence
  chemically synthesized
agtcttttatataagactcatg

SEQ ID NO: 1153149 - DNA, 22 bp, Artificial Sequence
  chemically synthesized
atcatggagggtgatcatgagt

SEQ ID NO: 1153150 - DNA, 22 bp, Artificial Sequence
  chemically synthesized
ttatataagactcatgatcacc

SEQ ID NO: 1153151 - DNA, 22 bp, Artificial Sequence
  chemically synthesized
tatataagactcatgatcaccc

SEQ ID NO: 1153152 - DNA, 22 bp, Artificial Sequence
  chemically synthesized
atataagactcatgatcaccct

SEQ ID NO: 1153153 - DNA, 22 bp, Artificial Sequence
  chemically synthesized
tataagactcatgatcaccctc

SEQ ID NO: 1153154 - DNA, 22 bp, Artificial Sequence
  chemically synthesized
agcctgatcatggagggtgatc

SEQ ID NO: 1153155 - DNA, 22 bp, Artificial Sequence
  chemically synthesized
aagcctgatcatggagggtgat

SEQ ID NO: 1153156 - DNA, 22 bp, Artificial Sequence
  chemically synthesized
gaggatttaagcctgatcatgg

SEQ ID NO: 1153157 - DNA, 22 bp, Artificial Sequence
  chemically synthesized
atgatcaccctccatgatcagg

SEQ ID NO: 1153158 - DNA, 22 bp, Artificial Sequence
  chemically synthesized
aatgctggaggatttaagcctg

SEQ ID NO: 1153159 - DNA, 22 bp, Artificial Sequence
  chemically synthesized
tactgaatgctggaggatttaa

SEQ ID NO: 1153160 - DNA, 22 bp, Artificial Sequence
  chemically synthesized
catgatcaggcttaaatcctcc

SEQ ID NO: 1153161 - DNA, 22 bp, Artificial Sequence
  chemically synthesized
tactatactgaatgctggagga

SEQ ID NO: 1153162 - DNA, 22 bp, Artificial Sequence
  chemically synthesized
gtactatactgaatgctggagg

SEQ ID NO: 1153163 - DNA, 22 bp, Artificial Sequence
  chemically synthesized
aaatcctccagcattcagtata

SEQ ID NO: 1153164 - DNA, 22 bp, Artificial Sequence
  chemically synthesized
aatcctccagcattcagtatag

SEQ ID NO: 1153165 - DNA, 22 bp, Artificial Sequence
  chemically synthesized
cgatgtcttgtactatactgaa

SEQ ID NO: 1153166 - DNA, 22 bp, Artificial Sequence
  chemically synthesized
acgatgtcttgtactatactga

SEQ ID NO: 1153167 - DNA, 22 bp, Artificial Sequence
  chemically synthesized
cagcattcagtatagtacaaga

SEQ ID NO: 1153168 - DNA, 22 bp, Artificial Sequence
  chemically synthesized
agtatagtacaagacatcgtaa

SEQ ID NO: 1153169 - DNA, 22 bp, Artificial Sequence
  chemically synthesized
tgaagaatgcagaaaccaatca

SEQ ID NO: 1153170 - DNA, 22 bp, Artificial Sequence
  chemically synthesized
tagcacatgggtgctgtgaaga

SEQ ID NO: 1153171 - DNA, 22 bp, Artificial Sequence
  chemically synthesized
gtttctgcattcttcacagcac

SEQ ID NO: 1153172 - DNA, 22 bp, Artificial Sequence
  chemically synthesized
attatagcacatgggtgctgtg

SEQ ID NO: 1153173 - DNA, 22 bp, Artificial Sequence
  chemically synthesized
ctgcattcttcacagcacccat

SEQ ID NO: 1153174 - DNA, 22 bp, Artificial Sequence
  chemically synthesized
tgcattcttcacagcacccatg

SEQ ID NO: 1153175 - DNA, 22 bp, Artificial Sequence
  chemically synthesized
cattcttcacagcacccatgtg

SEQ ID NO: 1153176 - DNA, 22 bp, Artificial Sequence
  chemically synthesized
ttcacagcacccatgtgctata

SEQ ID NO: 1153177 - DNA, 22 bp, Artificial Sequence
  chemically synthesized
aacaaaccctcattatagcaca

SEQ ID NO: 1153178 - DNA, 22 bp, Artificial Sequence
  chemically synthesized
cacagcacccatgtgctataat

SEQ ID NO: 1153179 - DNA, 22 bp, Artificial Sequence
  chemically synthesized
acagcacccatgtgctataatg

SEQ ID NO: 1153180 - DNA, 22 bp, Artificial Sequence
  chemically synthesized
catatcactgaacaaaccctca

SEQ ID NO: 1153181 - DNA, 22 bp, Artificial Sequence
  chemically synthesized
ttccatatcactgaacaaaccc

SEQ ID NO: 1153182 - DNA, 22 bp, Artificial Sequence
  chemically synthesized
tattccatatcactgaacaaac

SEQ ID NO: 1153183 - DNA, 22 bp, Artificial Sequence
  chemically synthesized
taatgagggtttgttcagtgat

SEQ ID NO: 1153184 - DNA, 22 bp, Artificial Sequence
  chemically synthesized
cattctattccatatcactgaa

SEQ ID NO: 1153185 - DNA, 22 bp, Artificial Sequence
  chemically synthesized
cattgcattctattccatatca

SEQ ID NO: 1153186 - DNA, 22 bp, Artificial Sequence
  chemically synthesized
attccattgcattctattccat

SEQ ID NO: 1153187 - DNA, 22 bp, Artificial Sequence
  chemically synthesized
cattccattgcattctattcca

SEQ ID NO: 1153188 - DNA, 22 bp, Artificial Sequence
  chemically synthesized
gttcagtgatatggaatagaat

SEQ ID NO: 1153189 - DNA, 22 bp, Artificial Sequence
  chemically synthesized
ttcagtgatatggaatagaatg

SEQ ID NO: 1153190 - DNA, 22 bp, Artificial Sequence
  chemically synthesized
atttcattccattgcattctat

SEQ ID NO: 1153191 - DNA, 22 bp, Artificial Sequence
  chemically synthesized
agtgatatggaatagaatgcaa

SEQ ID NO: 1153192 - DNA, 22 bp, Artificial Sequence
  chemically synthesized
catttcattccattgcattcta

SEQ ID NO: 1153193 - DNA, 22 bp, Artificial Sequence
  chemically synthesized
acatttcatttcattccattgc

SEQ ID NO: 1153194 - DNA, 22 bp, Artificial Sequence
  chemically synthesized
ccaaaggatctgacatttcatt

SEQ ID NO: 1153195 - DNA, 22 bp, Artificial Sequence
  chemically synthesized
tgccaaaggatctgacatttca

SEQ ID NO: 1153196 - DNA, 22 bp, Artificial Sequence
  chemically synthesized
ggtataattctgccaaaggatc

SEQ ID NO: 1153197 - DNA, 22 bp, Artificial Sequence
  chemically synthesized
cagagaaggattaggtataatt

SEQ ID NO: 1153198 - DNA, 22 bp, Artificial Sequence
  chemically synthesized
tggcagaattatacctaatcct

SEQ ID NO: 1153199 - DNA, 22 bp, Artificial Sequence
  chemically synthesized
atgttacagagaaggattaggt

SEQ ID NO: 1153200 - DNA, 22 bp, Artificial Sequence
  chemically synthesized
ggcagaattatacctaatcctt

SEQ ID NO: 1153201 - DNA, 22 bp, Artificial Sequence
  chemically synthesized
gcagaattatacctaatccttc

SEQ ID NO: 1153202 - DNA, 22 bp, Artificial Sequence
  chemically synthesized
gatgttcatgttacagagaagg

SEQ ID NO: 1153203 - DNA, 22 bp, Artificial Sequence
  chemically synthesized
tacctaatccttctctgtaaca

SEQ ID NO: 1153204 - DNA, 22 bp, Artificial Sequence
  chemically synthesized
atccttctctgtaacatgaaca

SEQ ID NO: 1153205 - DNA, 22 bp, Artificial Sequence
  chemically synthesized
aaatgatctagatgttcatgtt

SEQ ID NO: 1153206 - DNA, 22 bp, Artificial Sequence
  chemically synthesized
aaaatgatctagatgttcatgt

SEQ ID NO: 1153207 - DNA, 22 bp, Artificial Sequence
  chemically synthesized
taaaatgatctagatgttcatg

SEQ ID NO: 1153208 - DNA, 22 bp, Artificial Sequence
  chemically synthesized
ctctgtaacatgaacatctaga

SEQ ID NO: 1153209 - DNA, 22 bp, Artificial Sequence
  chemically synthesized
tctgtaacatgaacatctagat

SEQ ID NO: 1153210 - DNA, 22 bp, Artificial Sequence
  chemically synthesized
tgtaacatgaacatctagatca

SEQ ID NO: 1153211 - DNA, 22 bp, Artificial Sequence
  chemically synthesized
gtgacctttaaaatgatctaga

SEQ ID NO: 1153212 - DNA, 22 bp, Artificial Sequence
  chemically synthesized
taacatgaacatctagatcatt

SEQ ID NO: 1153213 - DNA, 22 bp, Artificial Sequence
  chemically synthesized
atctggtgacctttaaaatgat

SEQ ID NO: 1153214 - DNA, 22 bp, Artificial Sequence
  chemically synthesized
gatcattttaaaggtcaccaga

SEQ ID NO: 1153215 - DNA, 22 bp, Artificial Sequence
  chemically synthesized
tgaaatatcctcatctggtgac

SEQ ID NO: 1153216 - DNA, 22 bp, Artificial Sequence
  chemically synthesized
taaaggtcaccagatgaggata

SEQ ID NO: 1153217 - DNA, 22 bp, Artificial Sequence
  chemically synthesized
aaaggtcaccagatgaggatat

SEQ ID NO: 1153218 - DNA, 22 bp, Artificial Sequence
  chemically synthesized
aaggtcaccagatgaggatatt

SEQ ID NO: 1153219 - DNA, 22 bp, Artificial Sequence
  chemically synthesized
ccaagattgtgaaatatcctca

SEQ ID NO: 1153220 - DNA, 22 bp, Artificial Sequence
  chemically synthesized
ggttgccaagattgtgaaatat

SEQ ID NO: 1153221 - DNA, 22 bp, Artificial Sequence
  chemically synthesized
gggttgccaagattgtgaaata

SEQ ID NO: 1153222 - DNA, 22 bp, Artificial Sequence
  chemically synthesized
aaggcagacatttgggttgcca

SEQ ID NO: 1153223 - DNA, 22 bp, Artificial Sequence
  chemically synthesized
cacaatcttggcaacccaaatg

SEQ ID NO: 1153224 - DNA, 22 bp, Artificial Sequence
  chemically synthesized
gttaaaggcagacatttgggtt

SEQ ID NO: 1153225 - DNA, 22 bp, Artificial Sequence
  chemically synthesized
acaatcttggcaacccaaatgt

SEQ ID NO: 1153226 - DNA, 22 bp, Artificial Sequence
  chemically synthesized
aaggttagttaaaggcagacat

SEQ ID NO: 1153227 - DNA, 22 bp, Artificial Sequence
  chemically synthesized
gaaggttagttaaaggcagaca

SEQ ID NO: 1153228 - DNA, 22 bp, Artificial Sequence
  chemically synthesized
ggcaacccaaatgtctgccttt

SEQ ID NO: 1153229 - DNA, 22 bp, Artificial Sequence
  chemically synthesized
gcaacccaaatgtctgccttta

SEQ ID NO: 1153230 - DNA, 22 bp, Artificial Sequence
  chemically synthesized
ttgaaggttagttaaaggcaga

SEQ ID NO: 1153231 - DNA, 22 bp, Artificial Sequence
  chemically synthesized
cttgaaggttagttaaaggcag

SEQ ID NO: 1153232 - DNA, 22 bp, Artificial Sequence
  chemically synthesized
tcttgaaggttagttaaaggca

SEQ ID NO: 1153233 - DNA, 22 bp, Artificial Sequence
  chemically synthesized
ttcttgaaggttagttaaaggc

SEQ ID NO: 1153234 - DNA, 22 bp, Artificial Sequence
  chemically synthesized
tccttttcttgaaggttagtta

SEQ ID NO: 1153235 - DNA, 22 bp, Artificial Sequence
  chemically synthesized
cctttaactaaccttcaagaaa

SEQ ID NO: 1153236 - DNA, 22 bp, Artificial Sequence
  chemically synthesized
agtcacctatccttttcttgaa

SEQ ID NO: 1153237 - DNA, 22 bp, Artificial Sequence
  chemically synthesized
taactaaccttcaagaaaagga

SEQ ID NO: 1153238 - DNA, 22 bp, Artificial Sequence
  chemically synthesized
aactaaccttcaagaaaaggat

SEQ ID NO: 1153239 - DNA, 22 bp, Artificial Sequence
  chemically synthesized
actaaccttcaagaaaaggata

SEQ ID NO: 1153240 - DNA, 22 bp, Artificial Sequence
  chemically synthesized
gaaactcagtcacctatccttt

SEQ ID NO: 1153241 - DNA, 22 bp, Artificial Sequence
  chemically synthesized
agaaactcagtcacctatcctt

SEQ ID NO: 1153242 - DNA, 22 bp, Artificial Sequence
  chemically synthesized
accttcaagaaaaggataggtg

SEQ ID NO: 1153243 - DNA, 22 bp, Artificial Sequence
  chemically synthesized
ttagaaactcagtcacctatcc

SEQ ID NO: 1153244 - DNA, 22 bp, Artificial Sequence
  chemically synthesized
caagaaaaggataggtgactga

SEQ ID NO: 1153245 - DNA, 22 bp, Artificial Sequence
  chemically synthesized
aagaaaaggataggtgactgag

SEQ ID NO: 1153246 - DNA, 22 bp, Artificial Sequence
  chemically synthesized
agtagcctcttagaaactcagt

SEQ ID NO: 1153247 - DNA, 22 bp, Artificial Sequence
  chemically synthesized
atacaaactaagtagcctctta

SEQ ID NO: 1153248 - DNA, 22 bp, Artificial Sequence
  chemically synthesized
attaatacaaactaagtagcct

SEQ ID NO: 1153249 - DNA, 22 bp, Artificial Sequence
  chemically synthesized
agtttctaagaggctacttagt

SEQ ID NO: 1153250 - DNA, 22 bp, Artificial Sequence
  chemically synthesized
ctaagaggctacttagtttgta

SEQ ID NO: 1153251 - DNA, 22 bp, Artificial Sequence
  chemically synthesized
taagaggctacttagtttgtat

SEQ ID NO: 1153252 - DNA, 22 bp, Artificial Sequence
  chemically synthesized
agaggctacttagtttgtatta

SEQ ID NO: 1153253 - DNA, 22 bp, Artificial Sequence
  chemically synthesized
tatgtgaaatactgattaatac

SEQ ID NO: 1153254 - DNA, 22 bp, Artificial Sequence
  chemically synthesized
cttagtttgtattaatcagtat

SEQ ID NO: 1153255 - DNA, 22 bp, Artificial Sequence
  chemically synthesized
agtttgtattaatcagtatttc

SEQ ID NO: 1153256 - DNA, 22 bp, Artificial Sequence
  chemically synthesized
gtttgtattaatcagtatttca

SEQ ID NO: 1153257 - DNA, 22 bp, Artificial Sequence
  chemically synthesized
agtgaaggttatatgtgaaata

SEQ ID NO: 1153258 - DNA, 22 bp, Artificial Sequence
  chemically synthesized
gtattaatcagtatttcacata

SEQ ID NO: 1153259 - DNA, 22 bp, Artificial Sequence
  chemically synthesized
cagtgaaggttatatgtgaaat

SEQ ID NO: 1153260 - DNA, 22 bp, Artificial Sequence
  chemically synthesized
tattaatcagtatttcacatat

SEQ ID NO: 1153261 - DNA, 22 bp, Artificial Sequence
  chemically synthesized
acttcagtgaaggttatatgtg

SEQ ID NO: 1153262 - DNA, 22 bp, Artificial Sequence
  chemically synthesized
atcagtatttcacatataacct

SEQ ID NO: 1153263 - DNA, 22 bp, Artificial Sequence
  chemically synthesized
tgacttcagtgaaggttatatg

SEQ ID NO: 1153264 - DNA, 22 bp, Artificial Sequence
  chemically synthesized
tattctgacttcagtgaaggtt

SEQ ID NO: 1153265 - DNA, 22 bp, Artificial Sequence
  chemically synthesized
tatattctgacttcagtgaagg

SEQ ID NO: 1153266 - DNA, 22 bp, Artificial Sequence
  chemically synthesized
cacatataaccttcactgaagt

SEQ ID NO: 1153267 - DNA, 22 bp, Artificial Sequence
  chemically synthesized
acatataaccttcactgaagtc

SEQ ID NO: 1153268 - DNA, 22 bp, Artificial Sequence
  chemically synthesized
cactgaagtcagaatatagagt

SEQ ID NO: 1153269 - DNA, 22 bp, Artificial Sequence
  chemically synthesized
actgaagtcagaatatagagta

SEQ ID NO: 1153270 - DNA, 22 bp, Artificial Sequence
  chemically synthesized
ccgatgtgaatatatactctat

SEQ ID NO: 1153271 - DNA, 22 bp, Artificial Sequence
  chemically synthesized
gccgatgtgaatatatactcta

SEQ ID NO: 1153272 - DNA, 22 bp, Artificial Sequence
  chemically synthesized
aagtcagaatatagagtatata

SEQ ID NO: 1153273 - DNA, 22 bp, Artificial Sequence
  chemically synthesized
caagaatttgccgatgtgaata

SEQ ID NO: 1153274 - DNA, 22 bp, Artificial Sequence
  chemically synthesized
caaattacaagaatttgccgat

SEQ ID NO: 1153275 - DNA, 22 bp, Artificial Sequence
  chemically synthesized
acaaattacaagaatttgccga

SEQ ID NO: 1153276 - DNA, 22 bp, Artificial Sequence
  chemically synthesized
tacaaattacaagaatttgccg

SEQ ID NO: 1153277 - DNA, 22 bp, Artificial Sequence
  chemically synthesized
acatcggcaaattcttgtaatt

SEQ ID NO: 1153278 - DNA, 22 bp, Artificial Sequence
  chemically synthesized
ttgtaatttgtaaagtctttgt

SEQ ID NO: 1153279 - DNA, 22 bp, Artificial Sequence
  chemically synthesized
gtgacagcatcaacaaagactt

SEQ ID NO: 1153280 - DNA, 22 bp, Artificial Sequence
  chemically synthesized
ggtgacagcatcaacaaagact

SEQ ID NO: 1153281 - DNA, 22 bp, Artificial Sequence
  chemically synthesized
gtaatttgtaaagtctttgttg

SEQ ID NO: 1153282 - DNA, 22 bp, Artificial Sequence
  chemically synthesized
taatttgtaaagtctttgttga

SEQ ID NO: 1153283 - DNA, 22 bp, Artificial Sequence
  chemically synthesized
gtaaagtctttgttgatgctgt

SEQ ID NO: 1153284 - DNA, 22 bp, Artificial Sequence
  chemically synthesized
taaagtctttgttgatgctgtc

SEQ ID NO: 1153285 - DNA, 22 bp, Artificial Sequence
  chemically synthesized
tgttgatgctgtcaccaaggtt

SEQ ID NO: 1153286 - DNA, 22 bp, Artificial Sequence
  chemically synthesized
gttgatgctgtcaccaaggtta

SEQ ID NO: 1153287 - DNA, 22 bp, Artificial Sequence
  chemically synthesized
tgcatagatgcataaccttggt

SEQ ID NO: 1153288 - DNA, 22 bp, Artificial Sequence
  chemically synthesized
ttgatgctgtcaccaaggttat

SEQ ID NO: 1153289 - DNA, 22 bp, Artificial Sequence
  chemically synthesized
gtgcatagatgcataaccttgg

SEQ ID NO: 1153290 - DNA, 22 bp, Artificial Sequence
  chemically synthesized
tgtgcatagatgcataaccttg

SEQ ID NO: 1153291 - DNA, 22 bp, Artificial Sequence
  chemically synthesized
ttgtgcatagatgcataacctt

SEQ ID NO: 1153292 - DNA, 22 bp, Artificial Sequence
  chemically synthesized
atgctgtcaccaaggttatgca

SEQ ID NO: 1153293 - DNA, 22 bp, Artificial Sequence
  chemically synthesized
gacttttgtgcatagatgcata

SEQ ID NO: 1153294 - DNA, 22 bp, Artificial Sequence
  chemically synthesized
agacttttgtgcatagatgcat

SEQ ID NO: 1153295 - DNA, 22 bp, Artificial Sequence
  chemically synthesized
tcaccaaggttatgcatctatg

SEQ ID NO: 1153296 - DNA, 22 bp, Artificial Sequence
  chemically synthesized
agagatttagacttttgtgcat

SEQ ID NO: 1153297 - DNA, 22 bp, Artificial Sequence
  chemically synthesized
gagagatttagacttttgtgca

SEQ ID NO: 1153298 - DNA, 22 bp, Artificial Sequence
  chemically synthesized
tgagagatttagacttttgtgc

SEQ ID NO: 1153299 - DNA, 22 bp, Artificial Sequence
  chemically synthesized
ttgagagatttagacttttgtg

SEQ ID NO: 1153300 - DNA, 22 bp, Artificial Sequence
  chemically synthesized
tgcatctatgcacaaaagtcta

SEQ ID NO: 1153301 - DNA, 22 bp, Artificial Sequence
  chemically synthesized
ttttgagagatttagacttttg

SEQ ID NO: 1153302 - DNA, 22 bp, Artificial Sequence
  chemically synthesized
cattcttttgagagatttagac

SEQ ID NO: 1153303 - DNA, 22 bp, Artificial Sequence
  chemically synthesized
ccattcttttgagagatttaga

SEQ ID NO: 1153304 - DNA, 22 bp, Artificial Sequence
  chemically synthesized
tccattcttttgagagatttag

SEQ ID NO: 1153305 - DNA, 22 bp, Artificial Sequence
  chemically synthesized
tgcacaaaagtctaaatctctc

SEQ ID NO: 1153306 - DNA, 22 bp, Artificial Sequence
  chemically synthesized
ggttttccattcttttgagaga

SEQ ID NO: 1153307 - DNA, 22 bp, Artificial Sequence
  chemically synthesized
gctaggttttccattcttttga

SEQ ID NO: 1153308 - DNA, 22 bp, Artificial Sequence
  chemically synthesized
ctagctaggttttccattcttt

SEQ ID NO: 1153309 - DNA, 22 bp, Artificial Sequence
  chemically synthesized
actagctaggttttccattctt

SEQ ID NO: 1153310 - DNA, 22 bp, Artificial Sequence
  chemically synthesized
aatctctcaaaagaatggaaaa

SEQ ID NO: 1153311 - DNA, 22 bp, Artificial Sequence
  chemically synthesized
agtttactagctaggttttcca

SEQ ID NO: 1153312 - DNA, 22 bp, Artificial Sequence
  chemically synthesized
tcaaaagaatggaaaacctagc

SEQ ID NO: 1153313 - DNA, 22 bp, Artificial Sequence
  chemically synthesized
aaaagaatggaaaacctagcta

SEQ ID NO: 1153314 - DNA, 22 bp, Artificial Sequence
  chemically synthesized
aagctgagtttactagctaggt

SEQ ID NO: 1153315 - DNA, 22 bp, Artificial Sequence
  chemically synthesized
aaagctgagtttactagctagg

SEQ ID NO: 1153316 - DNA, 22 bp, Artificial Sequence
  chemically synthesized
cgatgaagtttaaagctgagtt

SEQ ID NO: 1153317 - DNA, 22 bp, Artificial Sequence
  chemically synthesized
gctagtaaactcagctttaaac

SEQ ID NO: 1153318 - DNA, 22 bp, Artificial Sequence
  chemically synthesized
gtaaactcagctttaaacttca

SEQ ID NO: 1153319 - DNA, 22 bp, Artificial Sequence
  chemically synthesized
gcacagtgagactgcgatgaag

SEQ ID NO: 1153320 - DNA, 22 bp, Artificial Sequence
  chemically synthesized
agctttaaacttcatcgcagtc

SEQ ID NO: 1153321 - DNA, 22 bp, Artificial Sequence
  chemically synthesized
ctggcacagtgagactgcgatg

SEQ ID NO: 1153322 - DNA, 22 bp, Artificial Sequence
  chemically synthesized
tctcctggcacagtgagactgc

SEQ ID NO: 1153323 - DNA, 22 bp, Artificial Sequence
  chemically synthesized
taaacttcatcgcagtctcact

SEQ ID NO: 1153324 - DNA, 22 bp, Artificial Sequence
  chemically synthesized
gtctcctggcacagtgagactg

SEQ ID NO: 1153325 - DNA, 22 bp, Artificial Sequence
  chemically synthesized
aaacttcatcgcagtctcactg

SEQ ID NO: 1153326 - DNA, 22 bp, Artificial Sequence
  chemically synthesized
tgtctcctggcacagtgagact

SEQ ID NO: 1153327 - DNA, 22 bp, Artificial Sequence
  chemically synthesized
aacttcatcgcagtctcactgt

SEQ ID NO: 1153328 - DNA, 22 bp, Artificial Sequence
  chemically synthesized
ttgtctcctggcacagtgagac

SEQ ID NO: 1153329 - DNA, 22 bp, Artificial Sequence
  chemically synthesized
catcgcagtctcactgtgccag

SEQ ID NO: 1153330 - DNA, 22 bp, Artificial Sequence
  chemically synthesized
atcgcagtctcactgtgccagg

SEQ ID NO: 1153331 - DNA, 22 bp, Artificial Sequence
  chemically synthesized
acagtgaaatcttttgtctcct

SEQ ID NO: 1153332 - DNA, 22 bp, Artificial Sequence
  chemically synthesized
aacagtgaaatcttttgtctcc

SEQ ID NO: 1153333 - DNA, 22 bp, Artificial Sequence
  chemically synthesized
actgtgccaggagacaaaagat

SEQ ID NO: 1153334 - DNA, 22 bp, Artificial Sequence
  chemically synthesized
tgccaggagacaaaagatttca

SEQ ID NO: 1153335 - DNA, 22 bp, Artificial Sequence
  chemically synthesized
aaaaggaaaatatttaacagtg

SEQ ID NO: 1153336 - DNA, 22 bp, Artificial Sequence
  chemically synthesized
caaaaggaaaatatttaacagt

SEQ ID NO: 1153337 - DNA, 22 bp, Artificial Sequence
  chemically synthesized
tcaaaaggaaaatatttaacag

SEQ ID NO: 1153338 - DNA, 22 bp, Artificial Sequence
  chemically synthesized
ttcaaaaggaaaatatttaaca

SEQ ID NO: 1153339 - DNA, 22 bp, Artificial Sequence
  chemically synthesized
tttcaaaaggaaaatatttaac

SEQ ID NO: 1153340 - DNA, 22 bp, Artificial Sequence
  chemically synthesized
ttttcaaaaggaaaatatttaa

SEQ ID NO: 1153341 - DNA, 22 bp, Artificial Sequence
  chemically synthesized
cactgttaaatattttcctttt

SEQ ID NO: 1153342 - DNA, 22 bp, Artificial Sequence
  chemically synthesized
actgttaaatattttccttttg

SEQ ID NO: 1153343 - DNA, 22 bp, Artificial Sequence
  chemically synthesized
gaggcatttttttcaaaaggaa

SEQ ID NO: 1153344 - DNA, 22 bp, Artificial Sequence
  chemically synthesized
ggaggcatttttttcaaaagga

SEQ ID NO: 1153345 - DNA, 22 bp, Artificial Sequence
  chemically synthesized
tggaggcatttttttcaaaagg

SEQ ID NO: 1153346 - DNA, 22 bp, Artificial Sequence
  chemically synthesized
ttaaatattttccttttgaaaa

SEQ ID NO: 1153347 - DNA, 22 bp, Artificial Sequence
  chemically synthesized
aatattttccttttgaaaaaaa

SEQ ID NO: 1153348 - DNA, 22 bp, Artificial Sequence
  chemically synthesized
ccattttggaggcatttttttc

SEQ ID NO: 1153349 - DNA, 22 bp, Artificial Sequence
  chemically synthesized
gccattttggaggcattttttt

SEQ ID NO: 1153350 - DNA, 22 bp, Artificial Sequence
  chemically synthesized
tccttttgaaaaaaatgcctcc

SEQ ID NO: 1153351 - DNA, 22 bp, Artificial Sequence
  chemically synthesized
ccttttgaaaaaaatgcctcca

SEQ ID NO: 1153352 - DNA, 22 bp, Artificial Sequence
  chemically synthesized
cttttgaaaaaaatgcctccaa

SEQ ID NO: 1153353 - DNA, 22 bp, Artificial Sequence
  chemically synthesized
ttgaaaaaaatgcctccaaaat

SEQ ID NO: 1153354 - DNA, 22 bp, Artificial Sequence
  chemically synthesized
tgaaaaaaatgcctccaaaatg

SEQ ID NO: 1153355 - DNA, 22 bp, Artificial Sequence
  chemically synthesized
gaaaaaaatgcctccaaaatgg

SEQ ID NO: 1153356 - DNA, 22 bp, Artificial Sequence
  chemically synthesized
aaaaaaatgcctccaaaatggc

SEQ ID NO: 1153357 - DNA, 22 bp, Artificial Sequence
  chemically synthesized
atagtaaagaagtttgccattt

SEQ ID NO: 1153358 - DNA, 22 bp, Artificial Sequence
  chemically synthesized
attaatagtaaagaagtttgcc

SEQ ID NO: 1153359 - DNA, 22 bp, Artificial Sequence
  chemically synthesized
cattaatagtaaagaagtttgc

SEQ ID NO: 1153360 - DNA, 22 bp, Artificial Sequence
  chemically synthesized
tcattaatagtaaagaagtttg

SEQ ID NO: 1153361 - DNA, 22 bp, Artificial Sequence
  chemically synthesized
caaaatggcaaacttctttact

SEQ ID NO: 1153362 - DNA, 22 bp, Artificial Sequence
  chemically synthesized
agctttcattaatagtaaagaa

SEQ ID NO: 1153363 - DNA, 22 bp, Artificial Sequence
  chemically synthesized
gagctttcattaatagtaaaga

SEQ ID NO: 1153364 - DNA, 22 bp, Artificial Sequence
  chemically synthesized
ctttactattaatgaaagctca

SEQ ID NO: 1153365 - DNA, 22 bp, Artificial Sequence
  chemically synthesized
tttactattaatgaaagctcaa

SEQ ID NO: 1153366 - DNA, 22 bp, Artificial Sequence
  chemically synthesized
aggaggaaaagccttgagcttt

SEQ ID NO: 1153367 - DNA, 22 bp, Artificial Sequence
  chemically synthesized
tactattaatgaaagctcaagg

SEQ ID NO: 1153368 - DNA, 22 bp, Artificial Sequence
  chemically synthesized
actattaatgaaagctcaaggc

SEQ ID NO: 1153369 - DNA, 22 bp, Artificial Sequence
  chemically synthesized
ctattaatgaaagctcaaggct

SEQ ID NO: 1153370 - DNA, 22 bp, Artificial Sequence
  chemically synthesized
ttgaggaggaaaagccttgagc

SEQ ID NO: 1153371 - DNA, 22 bp, Artificial Sequence
  chemically synthesized
ttaatgaaagctcaaggctttt

SEQ ID NO: 1153372 - DNA, 22 bp, Artificial Sequence
  chemically synthesized
atgaaagctcaaggcttttcct

SEQ ID NO: 1153373 - DNA, 22 bp, Artificial Sequence
  chemically synthesized
aaggcttttcctcctcaatagc

SEQ ID NO: 1153374 - DNA, 22 bp, Artificial Sequence
  chemically synthesized
gaaggagtggcatgatgctatt

SEQ ID NO: 1153375 - DNA, 22 bp, Artificial Sequence
  chemically synthesized
ttcctcctcaatagcatcatgc

SEQ ID NO: 1153376 - DNA, 22 bp, Artificial Sequence
  chemically synthesized
tcctcctcaatagcatcatgcc

SEQ ID NO: 1153377 - DNA, 22 bp, Artificial Sequence
  chemically synthesized
cctcgaaggagtggcatgatgc

SEQ ID NO: 1153378 - DNA, 22 bp, Artificial Sequence
  chemically synthesized
cctcctcaatagcatcatgcca

SEQ ID NO: 1153379 - DNA, 22 bp, Artificial Sequence
  chemically synthesized
ccctcgaaggagtggcatgatg

SEQ ID NO: 1153380 - DNA, 22 bp, Artificial Sequence
  chemically synthesized
ctcctcaatagcatcatgccac

SEQ ID NO: 1153381 - DNA, 22 bp, Artificial Sequence
  chemically synthesized
ctcaatagcatcatgccactcc

SEQ ID NO: 1153382 - DNA, 22 bp, Artificial Sequence
  chemically synthesized
aatagcatcatgccactccttc

SEQ ID NO: 1153383 - DNA, 22 bp, Artificial Sequence
  chemically synthesized
acaaagaatgaaaggatttccc

SEQ ID NO: 1153384 - DNA, 22 bp, Artificial Sequence
  chemically synthesized
cttcgagggaaatcctttcatt

SEQ ID NO: 1153385 - DNA, 22 bp, Artificial Sequence
  chemically synthesized
cgagggaaatcctttcattctt

SEQ ID NO: 1153386 - DNA, 22 bp, Artificial Sequence
  chemically synthesized
gtgatgttgacaaagaatgaaa

SEQ ID NO: 1153387 - DNA, 22 bp, Artificial Sequence
  chemically synthesized
gagggaaatcctttcattcttt

SEQ ID NO: 1153388 - DNA, 22 bp, Artificial Sequence
  chemically synthesized
ttagtgatgttgacaaagaatg

SEQ ID NO: 1153389 - DNA, 22 bp, Artificial Sequence
  chemically synthesized
attagtgatgttgacaaagaat

SEQ ID NO: 1153390 - DNA, 22 bp, Artificial Sequence
  chemically synthesized
tcattctttgtcaacatcacta

SEQ ID NO: 1153391 - DNA, 22 bp, Artificial Sequence
  chemically synthesized
cattctttgtcaacatcactaa

SEQ ID NO: 1153392 - DNA, 22 bp, Artificial Sequence
  chemically synthesized
attctttgtcaacatcactaat

SEQ ID NO: 1153393 - DNA, 22 bp, Artificial Sequence
  chemically synthesized
aggggtagaatttattagtgat

SEQ ID NO: 1153394 - DNA, 22 bp, Artificial Sequence
  chemically synthesized
aaggggtagaatttattagtga

SEQ ID NO: 1153395 - DNA, 22 bp, Artificial Sequence
  chemically synthesized
tttgtcaacatcactaataaat

SEQ ID NO: 1153396 - DNA, 22 bp, Artificial Sequence
  chemically synthesized
tgtcaacatcactaataaattc

SEQ ID NO: 1153397 - DNA, 22 bp, Artificial Sequence
  chemically synthesized
tcttaaggggtagaatttatta

SEQ ID NO: 1153398 - DNA, 22 bp, Artificial Sequence
  chemically synthesized
gtcaacatcactaataaattct

SEQ ID NO: 1153399 - DNA, 22 bp, Artificial Sequence
  chemically synthesized
gtcttaaggggtagaatttatt

SEQ ID NO: 1153400 - DNA, 22 bp, Artificial Sequence
  chemically synthesized
tcaacatcactaataaattcta

SEQ ID NO: 1153401 - DNA, 22 bp, Artificial Sequence
  chemically synthesized
tgtcttaaggggtagaatttat

SEQ ID NO: 1153402 - DNA, 22 bp, Artificial Sequence
  chemically synthesized
ttgtcttaaggggtagaattta

SEQ ID NO: 1153403 - DNA, 22 bp, Artificial Sequence
  chemically synthesized
tttgtcttaaggggtagaattt

SEQ ID NO: 1153404 - DNA, 22 bp, Artificial Sequence
  chemically synthesized
ttttgtcttaaggggtagaatt

SEQ ID NO: 1153405 - DNA, 22 bp, Artificial Sequence
  chemically synthesized
gtcttttttgtcttaaggggta

SEQ ID NO: 1153406 - DNA, 22 bp, Artificial Sequence
  chemically synthesized
ataaattctaccccttaagaca

SEQ ID NO: 1153407 - DNA, 22 bp, Artificial Sequence
  chemically synthesized
gctggtcttttttgtcttaagg

SEQ ID NO: 1153408 - DNA, 22 bp, Artificial Sequence
  chemically synthesized
tagctggtcttttttgtcttaa

SEQ ID NO: 1153409 - DNA, 22 bp, Artificial Sequence
  chemically synthesized
taccccttaagacaaaaaagac

SEQ ID NO: 1153410 - DNA, 22 bp, Artificial Sequence
  chemically synthesized
ccccttaagacaaaaaagacca

SEQ ID NO: 1153411 - DNA, 22 bp, Artificial Sequence
  chemically synthesized
aagacaaaaaagaccagctaga

SEQ ID NO: 1153412 - DNA, 22 bp, Artificial Sequence
  chemically synthesized
agacaaaaaagaccagctagaa

SEQ ID NO: 1153413 - DNA, 22 bp, Artificial Sequence
  chemically synthesized
tgaaaaaatatatcacatataa

SEQ ID NO: 1153414 - DNA, 22 bp, Artificial Sequence
  chemically synthesized
ccctgtgaaaaaatatatcaca

SEQ ID NO: 1153415 - DNA, 22 bp, Artificial Sequence
  chemically synthesized
gaattatatgtgatatattttt

SEQ ID NO: 1153416 - DNA, 22 bp, Artificial Sequence
  chemically synthesized
attcccctgtgaaaaaatatat

SEQ ID NO: 1153417 - DNA, 22 bp, Artificial Sequence
  chemically synthesized
tcattcccctgtgaaaaaatat

SEQ ID NO: 1153418 - DNA, 22 bp, Artificial Sequence
  chemically synthesized
tatgtgatatattttttcacag

SEQ ID NO: 1153419 - DNA, 22 bp, Artificial Sequence
  chemically synthesized
tttcacaggggaatgagaggtt

SEQ ID NO: 1153420 - DNA, 22 bp, Artificial Sequence
  chemically synthesized
ttcacaggggaatgagaggttc

SEQ ID NO: 1153421 - DNA, 22 bp, Artificial Sequence
  chemically synthesized
tcacaggggaatgagaggttcg

SEQ ID NO: 1153422 - DNA, 22 bp, Artificial Sequence
  chemically synthesized
cacaggggaatgagaggttcga

SEQ ID NO: 1153423 - DNA, 22 bp, Artificial Sequence
  chemically synthesized
acaggggaatgagaggttcgat

SEQ ID NO: 1153424 - DNA, 22 bp, Artificial Sequence
  chemically synthesized
gggagtaaacaaatcgaacctc

SEQ ID NO: 1153425 - DNA, 22 bp, Artificial Sequence
  chemically synthesized
tggggagtaaacaaatcgaacc

SEQ ID NO: 1153426 - DNA, 22 bp, Artificial Sequence
  chemically synthesized
ctggggagtaaacaaatcgaac

SEQ ID NO: 1153427 - DNA, 22 bp, Artificial Sequence
  chemically synthesized
tctggggagtaaacaaatcgaa

SEQ ID NO: 1153428 - DNA, 22 bp, Artificial Sequence
  chemically synthesized
gatttgtttactccccagaaag

SEQ ID NO: 1153429 - DNA, 22 bp, Artificial Sequence
  chemically synthesized
gtttactccccagaaagactca

SEQ ID NO: 1153430 - DNA, 22 bp, Artificial Sequence
  chemically synthesized
tttactccccagaaagactcac

SEQ ID NO: 1153431 - DNA, 22 bp, Artificial Sequence
  chemically synthesized
aggcacccaagagtgagtcttt

SEQ ID NO: 1153432 - DNA, 22 bp, Artificial Sequence
  chemically synthesized
gaggcacccaagagtgagtctt

SEQ ID NO: 1153433 - DNA, 22 bp, Artificial Sequence
  chemically synthesized
tgaggcacccaagagtgagtct

SEQ ID NO: 1153434 - DNA, 22 bp, Artificial Sequence
  chemically synthesized
actccccagaaagactcactct

SEQ ID NO: 1153435 - DNA, 22 bp, Artificial Sequence
  chemically synthesized
ctccccagaaagactcactctt

SEQ ID NO: 1153436 - DNA, 22 bp, Artificial Sequence
  chemically synthesized
gctttgaggcacccaagagtga

SEQ ID NO: 1153437 - DNA, 22 bp, Artificial Sequence
  chemically synthesized
cccagaaagactcactcttggg

SEQ ID NO: 1153438 - DNA, 22 bp, Artificial Sequence
  chemically synthesized
agctttgaggcacccaagagtg

SEQ ID NO: 1153439 - DNA, 22 bp, Artificial Sequence
  chemically synthesized
tagctttgaggcacccaagagt

SEQ ID NO: 1153440 - DNA, 22 bp, Artificial Sequence
  chemically synthesized
ctttagctttgaggcacccaag

SEQ ID NO: 1153441 - DNA, 22 bp, Artificial Sequence
  chemically synthesized
gctttagctttgaggcacccaa

SEQ ID NO: 1153442 - DNA, 22 bp, Artificial Sequence
  chemically synthesized
gaggtttgctttagctttgagg

SEQ ID NO: 1153443 - DNA, 22 bp, Artificial Sequence
  chemically synthesized
actcttgggtgcctcaaagcta

SEQ ID NO: 1153444 - DNA, 22 bp, Artificial Sequence
  chemically synthesized
agaggtttgctttagctttgag

SEQ ID NO: 1153445 - DNA, 22 bp, Artificial Sequence
  chemically synthesized
ttgggtgcctcaaagctaaagc

SEQ ID NO: 1153446 - DNA, 22 bp, Artificial Sequence
  chemically synthesized
gggtgcctcaaagctaaagcaa

SEQ ID NO: 1153447 - DNA, 22 bp, Artificial Sequence
  chemically synthesized
ggtgcctcaaagctaaagcaaa

SEQ ID NO: 1153448 - DNA, 22 bp, Artificial Sequence
  chemically synthesized
tagggagagaatttagaggttt

SEQ ID NO: 1153449 - DNA, 22 bp, Artificial Sequence
  chemically synthesized
aaagctaaagcaaacctctaaa

SEQ ID NO: 1153450 - DNA, 22 bp, Artificial Sequence
  chemically synthesized
ctgtagggagagaatttagagg

SEQ ID NO: 1153451 - DNA, 22 bp, Artificial Sequence
  chemically synthesized
aagcaaacctctaaattctctc

SEQ ID NO: 1153452 - DNA, 22 bp, Artificial Sequence
  chemically synthesized
atagacattgctgtagggagag

SEQ ID NO: 1153453 - DNA, 22 bp, Artificial Sequence
  chemically synthesized
catagacattgctgtagggaga

SEQ ID NO: 1153454 - DNA, 22 bp, Artificial Sequence
  chemically synthesized
taaattctctccctacagcaat

SEQ ID NO: 1153455 - DNA, 22 bp, Artificial Sequence
  chemically synthesized
atccttcatagacattgctgta

SEQ ID NO: 1153456 - DNA, 22 bp, Artificial Sequence
  chemically synthesized
aattctctccctacagcaatgt

SEQ ID NO: 1153457 - DNA, 22 bp, Artificial Sequence
  chemically synthesized
tctccctacagcaatgtctatg

SEQ ID NO: 1153458 - DNA, 22 bp, Artificial Sequence
  chemically synthesized
tccctacagcaatgtctatgaa

SEQ ID NO: 1153459 - DNA, 22 bp, Artificial Sequence
  chemically synthesized
cctacagcaatgtctatgaagg

SEQ ID NO: 1153460 - DNA, 22 bp, Artificial Sequence
  chemically synthesized
ggagaaaccactcatccttcat

SEQ ID NO: 1153461 - DNA, 22 bp, Artificial Sequence
  chemically synthesized
cagcaatgtctatgaaggatga

SEQ ID NO: 1153462 - DNA, 22 bp, Artificial Sequence
  chemically synthesized
gggagaaaccactcatccttca

SEQ ID NO: 1153463 - DNA, 22 bp, Artificial Sequence
  chemically synthesized
caccatttgggagaaaccactc

SEQ ID NO: 1153464 - DNA, 22 bp, Artificial Sequence
  chemically synthesized
tgaaggatgagtggtttctccc

SEQ ID NO: 1153465 - DNA, 22 bp, Artificial Sequence
  chemically synthesized
gctgcaccatttgggagaaacc

SEQ ID NO: 1153466 - DNA, 22 bp, Artificial Sequence
  chemically synthesized
aattggctgcaccatttgggag

SEQ ID NO: 1153467 - DNA, 22 bp, Artificial Sequence
  chemically synthesized
ctcccaaatggtgcagccaatt

SEQ ID NO: 1153468 - DNA, 22 bp, Artificial Sequence
  chemically synthesized
tcccaaatggtgcagccaattg

SEQ ID NO: 1153469 - DNA, 22 bp, Artificial Sequence
  chemically synthesized
ccaaatggtgcagccaattgaa

SEQ ID NO: 1153470 - DNA, 22 bp, Artificial Sequence
  chemically synthesized
ggtaaccaagaaaagttcaatt

SEQ ID NO: 1153471 - DNA, 22 bp, Artificial Sequence
  chemically synthesized
tgggtaaccaagaaaagttcaa

SEQ ID NO: 1153472 - DNA, 22 bp, Artificial Sequence
  chemically synthesized
ctctgggtaaccaagaaaagtt

SEQ ID NO: 1153473 - DNA, 22 bp, Artificial Sequence
  chemically synthesized
actctgggtaaccaagaaaagt

SEQ ID NO: 1153474 - DNA, 22 bp, Artificial Sequence
  chemically synthesized
tactctgggtaaccaagaaaag

SEQ ID NO: 1153475 - DNA, 22 bp, Artificial Sequence
  chemically synthesized
tttactctgggtaaccaagaaa

SEQ ID NO: 1153476 - DNA, 22 bp, Artificial Sequence
  chemically synthesized
aacttttcttggttacccagag

SEQ ID NO: 1153477 - DNA, 22 bp, Artificial Sequence
  chemically synthesized
gccaaactctttactctgggta

SEQ ID NO: 1153478 - DNA, 22 bp, Artificial Sequence
  chemically synthesized
ttcttggttacccagagtaaag

SEQ ID NO: 1153479 - DNA, 22 bp, Artificial Sequence
  chemically synthesized
tcttggttacccagagtaaaga

SEQ ID NO: 1153480 - DNA, 22 bp, Artificial Sequence
  chemically synthesized
cttggttacccagagtaaagag

SEQ ID NO: 1153481 - DNA, 22 bp, Artificial Sequence
  chemically synthesized
aatctagccaaactctttactc

SEQ ID NO: 1153482 - DNA, 22 bp, Artificial Sequence
  chemically synthesized
ttggttacccagagtaaagagt

SEQ ID NO: 1153483 - DNA, 22 bp, Artificial Sequence
  chemically synthesized
ggttacccagagtaaagagttt

SEQ ID NO: 1153484 - DNA, 22 bp, Artificial Sequence
  chemically synthesized
ttaaatctagccaaactcttta

SEQ ID NO: 1153485 - DNA, 22 bp, Artificial Sequence
  chemically synthesized
gttacccagagtaaagagtttg

SEQ ID NO: 1153486 - DNA, 22 bp, Artificial Sequence
  chemically synthesized
ctattaaatctagccaaactct

SEQ ID NO: 1153487 - DNA, 22 bp, Artificial Sequence
  chemically synthesized
cccagagtaaagagtttggcta

SEQ ID NO: 1153488 - DNA, 22 bp, Artificial Sequence
  chemically synthesized
tatggtggttactattaaatct

SEQ ID NO: 1153489 - DNA, 22 bp, Artificial Sequence
  chemically synthesized
atcctatatggtggttactatt

SEQ ID NO: 1153490 - DNA, 22 bp, Artificial Sequence
  chemically synthesized
ggctagatttaatagtaaccac

SEQ ID NO: 1153491 - DNA, 22 bp, Artificial Sequence
  chemically synthesized
gctagatttaatagtaaccacc

SEQ ID NO: 1153492 - DNA, 22 bp, Artificial Sequence
  chemically synthesized
gatttaatagtaaccaccatat

SEQ ID NO: 1153493 - DNA, 22 bp, Artificial Sequence
  chemically synthesized
aatagtaaccaccatataggat

SEQ ID NO: 1153494 - DNA, 22 bp, Artificial Sequence
  chemically synthesized
atagtaaccaccatataggatc

SEQ ID NO: 1153495 - DNA, 22 bp, Artificial Sequence
  chemically synthesized
ggtaaggtaaagcaattgatcc

SEQ ID NO: 1153496 - DNA, 22 bp, Artificial Sequence
  chemically synthesized
gcaattaggtaaggtaaagcaa

SEQ ID NO: 1153497 - DNA, 22 bp, Artificial Sequence
  chemically synthesized
aacctggcaattaggtaaggta

SEQ ID NO: 1153498 - DNA, 22 bp, Artificial Sequence
  chemically synthesized
ctgaacctggcaattaggtaag

SEQ ID NO: 1153499 - DNA, 22 bp, Artificial Sequence
  chemically synthesized
actgaacctggcaattaggtaa

SEQ ID NO: 1153500 - DNA, 22 bp, Artificial Sequence
  chemically synthesized
tactgaacctggcaattaggta

SEQ ID NO: 1153501 - DNA, 22 bp, Artificial Sequence
  chemically synthesized
ttactgaacctggcaattaggt

SEQ ID NO: 1153502 - DNA, 22 bp, Artificial Sequence
  chemically synthesized
ctttaccttacctaattgccag

SEQ ID NO: 1153503 - DNA, 22 bp, Artificial Sequence
  chemically synthesized
taccttacctaattgccaggtt

SEQ ID NO: 1153504 - DNA, 22 bp, Artificial Sequence
  chemically synthesized
accttacctaattgccaggttc

SEQ ID NO: 1153505 - DNA, 22 bp, Artificial Sequence
  chemically synthesized
ccttacctaattgccaggttca

SEQ ID NO: 1153506 - DNA, 22 bp, Artificial Sequence
  chemically synthesized
acctaattgccaggttcagtaa

SEQ ID NO: 1153507 - DNA, 22 bp, Artificial Sequence
  chemically synthesized
cctaattgccaggttcagtaaa

SEQ ID NO: 1153508 - DNA, 22 bp, Artificial Sequence
  chemically synthesized
attgccaggttcagtaaaagtg

SEQ ID NO: 1153509 - DNA, 22 bp, Artificial Sequence
  chemically synthesized
ccaggttcagtaaaagtgactt

SEQ ID NO: 1153510 - DNA, 22 bp, Artificial Sequence
  chemically synthesized
tgaaatgtcaggaagataagtc

SEQ ID NO: 1153511 - DNA, 22 bp, Artificial Sequence
  chemically synthesized
agtaaaagtgacttatcttcct

SEQ ID NO: 1153512 - DNA, 22 bp, Artificial Sequence
  chemically synthesized
agacactgtgaaatgtcaggaa

SEQ ID NO: 1153513 - DNA, 22 bp, Artificial Sequence
  chemically synthesized
gaaattcagacactgtgaaatg

SEQ ID NO: 1153514 - DNA, 22 bp, Artificial Sequence
  chemically synthesized
atcttcctgacatttcacagtg

SEQ ID NO: 1153515 - DNA, 22 bp, Artificial Sequence
  chemically synthesized
tcttcctgacatttcacagtgt

SEQ ID NO: 1153516 - DNA, 22 bp, Artificial Sequence
  chemically synthesized
cctgacatttcacagtgtctga

SEQ ID NO: 1153517 - DNA, 22 bp, Artificial Sequence
  chemically synthesized
ctgacatttcacagtgtctgaa

SEQ ID NO: 1153518 - DNA, 22 bp, Artificial Sequence
  chemically synthesized
acatttcacagtgtctgaattt

SEQ ID NO: 1153519 - DNA, 22 bp, Artificial Sequence
  chemically synthesized
tgaggcaggctagaaattcaga

SEQ ID NO: 1153520 - DNA, 22 bp, Artificial Sequence
  chemically synthesized
ttatgaggcaggctagaaattc

SEQ ID NO: 1153521 - DNA, 22 bp, Artificial Sequence
  chemically synthesized
attatgaggcaggctagaaatt

SEQ ID NO: 1153522 - DNA, 22 bp, Artificial Sequence
  chemically synthesized
cacagtgtctgaatttctagcc

SEQ ID NO: 1153523 - DNA, 22 bp, Artificial Sequence
  chemically synthesized
tattatgaggcaggctagaaat

SEQ ID NO: 1153524 - DNA, 22 bp, Artificial Sequence
  chemically synthesized
acagtgtctgaatttctagcct

SEQ ID NO: 1153525 - DNA, 22 bp, Artificial Sequence
  chemically synthesized
aacagcattttattatgaggca

SEQ ID NO: 1153526 - DNA, 22 bp, Artificial Sequence
  chemically synthesized
aatttctagcctgcctcataat

SEQ ID NO: 1153527 - DNA, 22 bp, Artificial Sequence
  chemically synthesized
caacagcattttattatgaggc

SEQ ID NO: 1153528 - DNA, 22 bp, Artificial Sequence
  chemically synthesized
atttcaacagcattttattatg

SEQ ID NO: 1153529 - DNA, 22 bp, Artificial Sequence
  chemically synthesized
ctagcctgcctcataataaaat

SEQ ID NO: 1153530 - DNA, 22 bp, Artificial Sequence
  chemically synthesized
catttcaacagcattttattat

SEQ ID NO: 1153531 - DNA, 22 bp, Artificial Sequence
  chemically synthesized
tagcctgcctcataataaaatg

SEQ ID NO: 1153532 - DNA, 22 bp, Artificial Sequence
  chemically synthesized
gcctgcctcataataaaatgct

SEQ ID NO: 1153533 - DNA, 22 bp, Artificial Sequence
  chemically synthesized
tcttcatttcaacagcatttta

SEQ ID NO: 1153534 - DNA, 22 bp, Artificial Sequence
  chemically synthesized
ctatcttcatttcaacagcatt

SEQ ID NO: 1153535 - DNA, 22 bp, Artificial Sequence
  chemically synthesized
cctcataataaaatgctgttga

SEQ ID NO: 1153536 - DNA, 22 bp, Artificial Sequence
  chemically synthesized
gctatcttcatttcaacagcat

SEQ ID NO: 1153537 - DNA, 22 bp, Artificial Sequence
  chemically synthesized
tgctatcttcatttcaacagca

SEQ ID NO: 1153538 - DNA, 22 bp, Artificial Sequence
  chemically synthesized
ataataaaatgctgttgaaatg

SEQ ID NO: 1153539 - DNA, 22 bp, Artificial Sequence
  chemically synthesized
tgacaggatcctttgctatctt

SEQ ID NO: 1153540 - DNA, 22 bp, Artificial Sequence
  chemically synthesized
tgtgacaggatcctttgctatc

SEQ ID NO: 1153541 - DNA, 22 bp, Artificial Sequence
  chemically synthesized
ttgaaatgaagatagcaaagga

SEQ ID NO: 1153542 - DNA, 22 bp, Artificial Sequence
  chemically synthesized
aaatgaagatagcaaaggatcc

SEQ ID NO: 1153543 - DNA, 22 bp, Artificial Sequence
  chemically synthesized
tatattctgtgacaggatcctt

SEQ ID NO: 1153544 - DNA, 22 bp, Artificial Sequence
  chemically synthesized
tgtatattctgtgacaggatcc

SEQ ID NO: 1153545 - DNA, 22 bp, Artificial Sequence
  chemically synthesized
ctgtatattctgtgacaggatc

SEQ ID NO: 1153546 - DNA, 22 bp, Artificial Sequence
  chemically synthesized
cagatatgcttctgtatattct

SEQ ID NO: 1153547 - DNA, 22 bp, Artificial Sequence
  chemically synthesized
tcacagaatatacagaagcata

SEQ ID NO: 1153548 - DNA, 22 bp, Artificial Sequence
  chemically synthesized
tgaatattacagatatgcttct

SEQ ID NO: 1153549 - DNA, 22 bp, Artificial Sequence
  chemically synthesized
caagtacactgtgaatattaca

SEQ ID NO: 1153550 - DNA, 22 bp, Artificial Sequence
  chemically synthesized
gcaagtacactgtgaatattac

SEQ ID NO: 1153551 - DNA, 22 bp, Artificial Sequence
  chemically synthesized
caaatcttgcaagtacactgtg

SEQ ID NO: 1153552 - DNA, 22 bp, Artificial Sequence
  chemically synthesized
gcaaatcttgcaagtacactgt

SEQ ID NO: 1153553 - DNA, 22 bp, Artificial Sequence
  chemically synthesized
taatattcacagtgtacttgca

SEQ ID NO: 1153554 - DNA, 22 bp, Artificial Sequence
  chemically synthesized
aaatgtttgcaaatcttgcaag

SEQ ID NO: 1153555 - DNA, 22 bp, Artificial Sequence
  chemically synthesized
acagtgtacttgcaagatttgc

SEQ ID NO: 1153556 - DNA, 22 bp, Artificial Sequence
  chemically synthesized
gagggcaagattaaaatgtttg

SEQ ID NO: 1153557 - DNA, 22 bp, Artificial Sequence
  chemically synthesized
gcaagatttgcaaacattttaa

SEQ ID NO: 1153558 - DNA, 22 bp, Artificial Sequence
  chemically synthesized
caagatttgcaaacattttaat

SEQ ID NO: 1153559 - DNA, 22 bp, Artificial Sequence
  chemically synthesized
aactggagggcaagattaaaat

SEQ ID NO: 1153560 - DNA, 22 bp, Artificial Sequence
  chemically synthesized
tcaactggagggcaagattaaa

SEQ ID NO: 1153561 - DNA, 22 bp, Artificial Sequence
  chemically synthesized
tctcaactggagggcaagatta

SEQ ID NO: 1153562 - DNA, 22 bp, Artificial Sequence
  chemically synthesized
gcaaacattttaatcttgccct

SEQ ID NO: 1153563 - DNA, 22 bp, Artificial Sequence
  chemically synthesized
tctctcaactggagggcaagat

SEQ ID NO: 1153564 - DNA, 22 bp, Artificial Sequence
  chemically synthesized
caaacattttaatcttgccctc

SEQ ID NO: 1153565 - DNA, 22 bp, Artificial Sequence
  chemically synthesized
tctctctcaactggagggcaag

SEQ ID NO: 1153566 - DNA, 22 bp, Artificial Sequence
  chemically synthesized
tctctctctcaactggagggca

SEQ ID NO: 1153567 - DNA, 22 bp, Artificial Sequence
  chemically synthesized
ctctctctctctcaactggagg

SEQ ID NO: 1153568 - DNA, 22 bp, Artificial Sequence
  chemically synthesized
taatcttgccctccagttgaga

SEQ ID NO: 1153569 - DNA, 22 bp, Artificial Sequence
  chemically synthesized
aatcttgccctccagttgagag

SEQ ID NO: 1153570 - DNA, 22 bp, Artificial Sequence
  chemically synthesized
atcttgccctccagttgagaga

SEQ ID NO: 1153571 - DNA, 22 bp, Artificial Sequence
  chemically synthesized
gccctccagttgagagagagag

SEQ ID NO: 1153572 - DNA, 22 bp, Artificial Sequence
  chemically synthesized
ccctccagttgagagagagaga

SEQ ID NO: 1153573 - DNA, 22 bp, Artificial Sequence
  chemically synthesized
cagttgagagagagagagcagg

SEQ ID NO: 1153574 - DNA, 22 bp, Artificial Sequence
  chemically synthesized
agatcagaggtcgcctgctctc

SEQ ID NO: 1153575 - DNA, 22 bp, Artificial Sequence
  chemically synthesized
ctcagatcagaggtcgcctgct

SEQ ID NO: 1153576 - DNA, 22 bp, Artificial Sequence
  chemically synthesized
agagagagagagcaggcgacct

SEQ ID NO: 1153577 - DNA, 22 bp, Artificial Sequence
  chemically synthesized
tgctcagatcagaggtcgcctg

SEQ ID NO: 1153578 - DNA, 22 bp, Artificial Sequence
  chemically synthesized
aattctgctcagatcagaggtc

SEQ ID NO: 1153579 - DNA, 22 bp, Artificial Sequence
  chemically synthesized
aaattctgctcagatcagaggt

SEQ ID NO: 1153580 - DNA, 22 bp, Artificial Sequence
  chemically synthesized
atttaaattctgctcagatcag

SEQ ID NO: 1153581 - DNA, 22 bp, Artificial Sequence
  chemically synthesized
ggaattgatttaaattctgctc

SEQ ID NO: 1153582 - DNA, 22 bp, Artificial Sequence
  chemically synthesized
ctgggaattgatttaaattctg

SEQ ID NO: 1153583 - DNA, 22 bp, Artificial Sequence
  chemically synthesized
tgatctgagcagaatttaaatc

SEQ ID NO: 1153584 - DNA, 22 bp, Artificial Sequence
  chemically synthesized
ttgctgggaattgatttaaatt

SEQ ID NO: 1153585 - DNA, 22 bp, Artificial Sequence
  chemically synthesized
attgctgggaattgatttaaat

SEQ ID NO: 1153586 - DNA, 22 bp, Artificial Sequence
  chemically synthesized
atctgagcagaatttaaatcaa

SEQ ID NO: 1153587 - DNA, 22 bp, Artificial Sequence
  chemically synthesized
tattgctgggaattgatttaaa

SEQ ID NO: 1153588 - DNA, 22 bp, Artificial Sequence
  chemically synthesized
agcagaatttaaatcaattccc

SEQ ID NO: 1153589 - DNA, 22 bp, Artificial Sequence
  chemically synthesized
aaatcaattcccagcaataaaa

SEQ ID NO: 1153590 - DNA, 22 bp, Artificial Sequence
  chemically synthesized
aatcaattcccagcaataaaat

SEQ ID NO: 1153591 - DNA, 22 bp, Artificial Sequence
  chemically synthesized
aagaaaagatacagattttatt

SEQ ID NO: 1153592 - DNA, 22 bp, Artificial Sequence
  chemically synthesized
ccagcaataaaatctgtatctt

SEQ ID NO: 1153593 - DNA, 22 bp, Artificial Sequence
  chemically synthesized
cagatgacaaaattaaagaaaa

SEQ ID NO: 1153594 - DNA, 22 bp, Artificial Sequence
  chemically synthesized
tatcttttctttaattttgtca

SEQ ID NO: 1153595 - DNA, 22 bp, Artificial Sequence
  chemically synthesized
aagatgattgcagatgacaaaa

SEQ ID NO: 1153596 - DNA, 22 bp, Artificial Sequence
  chemically synthesized
aaagatgattgcagatgacaaa

SEQ ID NO: 1153597 - DNA, 22 bp, Artificial Sequence
  chemically synthesized
ttaaagatgattgcagatgaca

SEQ ID NO: 1153598 - DNA, 22 bp, Artificial Sequence
  chemically synthesized
ttctttaattttgtcatctgca

SEQ ID NO: 1153599 - DNA, 22 bp, Artificial Sequence
  chemically synthesized
cttaaagatgattgcagatgac

SEQ ID NO: 1153600 - DNA, 22 bp, Artificial Sequence
  chemically synthesized
tctttaattttgtcatctgcaa

SEQ ID NO: 1153601 - DNA, 22 bp, Artificial Sequence
  chemically synthesized
tcttaaagatgattgcagatga

SEQ ID NO: 1153602 - DNA, 22 bp, Artificial Sequence
  chemically synthesized
ctttaattttgtcatctgcaat

SEQ ID NO: 1153603 - DNA, 22 bp, Artificial Sequence
  chemically synthesized
ttcttaaagatgattgcagatg

SEQ ID NO: 1153604 - DNA, 22 bp, Artificial Sequence
  chemically synthesized
tttaattttgtcatctgcaatc

SEQ ID NO: 1153605 - DNA, 22 bp, Artificial Sequence
  chemically synthesized
tttcttaaagatgattgcagat

SEQ ID NO: 1153606 - DNA, 22 bp, Artificial Sequence
  chemically synthesized
taattttgtcatctgcaatcat

SEQ ID NO: 1153607 - DNA, 22 bp, Artificial Sequence
  chemically synthesized
aattttgtcatctgcaatcatc

SEQ ID NO: 1153608 - DNA, 22 bp, Artificial Sequence
  chemically synthesized
attttgtcatctgcaatcatct

SEQ ID NO: 1153609 - DNA, 22 bp, Artificial Sequence
  chemically synthesized
tgtcatctgcaatcatctttaa

SEQ ID NO: 1153610 - DNA, 22 bp, Artificial Sequence
  chemically synthesized
gtcatctgcaatcatctttaag

SEQ ID NO: 1153611 - DNA, 22 bp, Artificial Sequence
  chemically synthesized
tcatctgcaatcatctttaaga

SEQ ID NO: 1153612 - DNA, 22 bp, Artificial Sequence
  chemically synthesized
tgccatcaccattttttcttaa

SEQ ID NO: 1153613 - DNA, 22 bp, Artificial Sequence
  chemically synthesized
gtgccatcaccattttttctta

SEQ ID NO: 1153614 - DNA, 22 bp, Artificial Sequence
  chemically synthesized
caatcatctttaagaaaaaatg

SEQ ID NO: 1153615 - DNA, 22 bp, Artificial Sequence
  chemically synthesized
aatccttgtgccatcaccattt

SEQ ID NO: 1153616 - DNA, 22 bp, Artificial Sequence
  chemically synthesized
taagaaaaaatggtgatggcac

SEQ ID NO: 1153617 - DNA, 22 bp, Artificial Sequence
  chemically synthesized
aagaaaaaatggtgatggcaca

SEQ ID NO: 1153618 - DNA, 22 bp, Artificial Sequence
  chemically synthesized
agaaaaaatggtgatggcacaa

SEQ ID NO: 1153619 - DNA, 22 bp, Artificial Sequence
  chemically synthesized
tgtagatagacattaaatcctt

SEQ ID NO: 1153620 - DNA, 22 bp, Artificial Sequence
  chemically synthesized
gtgtagatagacattaaatcct

SEQ ID NO: 1153621 - DNA, 22 bp, Artificial Sequence
  chemically synthesized
tgtgtagatagacattaaatcc

SEQ ID NO: 1153622 - DNA, 22 bp, Artificial Sequence
  chemically synthesized
gctttgtgtagatagacattaa

SEQ ID NO: 1153623 - DNA, 22 bp, Artificial Sequence
  chemically synthesized
agctttgtgtagatagacatta

SEQ ID NO: 1153624 - DNA, 22 bp, Artificial Sequence
  chemically synthesized
tagctttgtgtagatagacatt

SEQ ID NO: 1153625 - DNA, 22 bp, Artificial Sequence
  chemically synthesized
ttagctttgtgtagatagacat

SEQ ID NO: 1153626 - DNA, 22 bp, Artificial Sequence
  chemically synthesized
tttttagctttgtgtagataga

SEQ ID NO: 1153627 - DNA, 22 bp, Artificial Sequence
  chemically synthesized
atttttagctttgtgtagatag

SEQ ID NO: 1153628 - DNA, 22 bp, Artificial Sequence
  chemically synthesized
aatgtctatctacacaaagcta

SEQ ID NO: 1153629 - DNA, 22 bp, Artificial Sequence
  chemically synthesized
atgtctatctacacaaagctaa

SEQ ID NO: 1153630 - DNA, 22 bp, Artificial Sequence
  chemically synthesized
atataatatttatttttagctt

SEQ ID NO: 1153631 - DNA, 22 bp, Artificial Sequence
  chemically synthesized
tctacacaaagctaaaaataaa

SEQ ID NO: 1153632 - DNA, 22 bp, Artificial Sequence
  chemically synthesized
acctaatataatatttattttt

SEQ ID NO: 1153633 - DNA, 22 bp, Artificial Sequence
  chemically synthesized
taacctaatataatatttattt

SEQ ID NO: 1153634 - DNA, 22 bp, Artificial Sequence
  chemically synthesized
cacaaagctaaaaataaatatt

SEQ ID NO: 1153635 - DNA, 22 bp, Artificial Sequence
  chemically synthesized
ctaacctaatataatatttatt

SEQ ID NO: 1153636 - DNA, 22 bp, Artificial Sequence
  chemically synthesized
aaaataaatattatattaggtt

SEQ ID NO: 1153637 - DNA, 22 bp, Artificial Sequence
  chemically synthesized
catcaccaaacttctaacctaa

SEQ ID NO: 1153638 - DNA, 22 bp, Artificial Sequence
  chemically synthesized
ctgcatcaccaaacttctaacc

SEQ ID NO: 1153639 - DNA, 22 bp, Artificial Sequence
  chemically synthesized
tattaggttagaagtttggtga

SEQ ID NO: 1153640 - DNA, 22 bp, Artificial Sequence
  chemically synthesized
ccatctgctgcatcaccaaact

SEQ ID NO: 1153641 - DNA, 22 bp, Artificial Sequence
  chemically synthesized
ggttagaagtttggtgatgcag

SEQ ID NO: 1153642 - DNA, 22 bp, Artificial Sequence
  chemically synthesized
gaagtttggtgatgcagcagat

SEQ ID NO: 1153643 - DNA, 22 bp, Artificial Sequence
  chemically synthesized
ggtgatgcagcagatgggagtt

SEQ ID NO: 1153644 - DNA, 22 bp, Artificial Sequence
  chemically synthesized
gtgatgcagcagatgggagttg

SEQ ID NO: 1153645 - DNA, 22 bp, Artificial Sequence
  chemically synthesized
gagtccccacaaaagcaactcc

SEQ ID NO: 1153646 - DNA, 22 bp, Artificial Sequence
  chemically synthesized
agagtccccacaaaagcaactc

SEQ ID NO: 1153647 - DNA, 22 bp, Artificial Sequence
  chemically synthesized
cttttgtggggactctaaggtt

SEQ ID NO: 1153648 - DNA, 22 bp, Artificial Sequence
  chemically synthesized
ttgtggggactctaaggttact

SEQ ID NO: 1153649 - DNA, 22 bp, Artificial Sequence
  chemically synthesized
tgtggggactctaaggttactg

SEQ ID NO: 1153650 - DNA, 22 bp, Artificial Sequence
  chemically synthesized
gtggggactctaaggttactga

SEQ ID NO: 1153651 - DNA, 22 bp, Artificial Sequence
  chemically synthesized
tggggactctaaggttactgat

SEQ ID NO: 1153652 - DNA, 22 bp, Artificial Sequence
  chemically synthesized
acaacaaaatgcatcagtaacc

SEQ ID NO: 1153653 - DNA, 22 bp, Artificial Sequence
  chemically synthesized
tgacaacaaaatgcatcagtaa

SEQ ID NO: 1153654 - DNA, 22 bp, Artificial Sequence
  chemically synthesized
ctgacaacaaaatgcatcagta

SEQ ID NO: 1153655 - DNA, 22 bp, Artificial Sequence
  chemically synthesized
cttctgacaacaaaatgcatca

SEQ ID NO: 1153656 - DNA, 22 bp, Artificial Sequence
  chemically synthesized
tccttctgacaacaaaatgcat

SEQ ID NO: 1153657 - DNA, 22 bp, Artificial Sequence
  chemically synthesized
taaggttactgatgcattttgt

SEQ ID NO: 1153658 - DNA, 22 bp, Artificial Sequence
  chemically synthesized
ctccttctgacaacaaaatgca

SEQ ID NO: 1153659 - DNA, 22 bp, Artificial Sequence
  chemically synthesized
aggttactgatgcattttgttg

SEQ ID NO: 1153660 - DNA, 22 bp, Artificial Sequence
  chemically synthesized
ctgatgcattttgttgtcagaa

SEQ ID NO: 1153661 - DNA, 22 bp, Artificial Sequence
  chemically synthesized
atgcattttgttgtcagaagga

SEQ ID NO: 1153662 - DNA, 22 bp, Artificial Sequence
  chemically synthesized
aaagtaaggaaatttctccttc

SEQ ID NO: 1153663 - DNA, 22 bp, Artificial Sequence
  chemically synthesized
tgttgtcagaaggagaaatttc

SEQ ID NO: 1153664 - DNA, 22 bp, Artificial Sequence
  chemically synthesized
gttgtcagaaggagaaatttcc

SEQ ID NO: 1153665 - DNA, 22 bp, Artificial Sequence
  chemically synthesized
ttgtcagaaggagaaatttcct

SEQ ID NO: 1153666 - DNA, 22 bp, Artificial Sequence
  chemically synthesized
tcagaaggagaaatttccttac

SEQ ID NO: 1153667 - DNA, 22 bp, Artificial Sequence
  chemically synthesized
taaatcattgaaagtaaggaaa

SEQ ID NO: 1153668 - DNA, 22 bp, Artificial Sequence
  chemically synthesized
ccaagaattgtaaatcattgaa

SEQ ID NO: 1153669 - DNA, 22 bp, Artificial Sequence
  chemically synthesized
cccaagaattgtaaatcattga

SEQ ID NO: 1153670 - DNA, 22 bp, Artificial Sequence
  chemically synthesized
tcccaagaattgtaaatcattg

SEQ ID NO: 1153671 - DNA, 22 bp, Artificial Sequence
  chemically synthesized
ttcccaagaattgtaaatcatt

SEQ ID NO: 1153672 - DNA, 22 bp, Artificial Sequence
  chemically synthesized
tttcccaagaattgtaaatcat

SEQ ID NO: 1153673 - DNA, 22 bp, Artificial Sequence
  chemically synthesized
ccttactttcaatgatttacaa

SEQ ID NO: 1153674 - DNA, 22 bp, Artificial Sequence
  chemically synthesized
ttttcccaagaattgtaaatca

SEQ ID NO: 1153675 - DNA, 22 bp, Artificial Sequence
  chemically synthesized
cttactttcaatgatttacaat

SEQ ID NO: 1153676 - DNA, 22 bp, Artificial Sequence
  chemically synthesized
tttttcccaagaattgtaaatc

SEQ ID NO: 1153677 - DNA, 22 bp, Artificial Sequence
  chemically synthesized
actttcaatgatttacaattct

SEQ ID NO: 1153678 - DNA, 22 bp, Artificial Sequence
  chemically synthesized
ctttcaatgatttacaattctt

SEQ ID NO: 1153679 - DNA, 22 bp, Artificial Sequence
  chemically synthesized
cagctttttttcccaagaattg

SEQ ID NO: 1153680 - DNA, 22 bp, Artificial Sequence
  chemically synthesized
tcaatgatttacaattcttggg

SEQ ID NO: 1153681 - DNA, 22 bp, Artificial Sequence
  chemically synthesized
gcagctttttttcccaagaatt

SEQ ID NO: 1153682 - DNA, 22 bp, Artificial Sequence
  chemically synthesized
caatgatttacaattcttggga

SEQ ID NO: 1153683 - DNA, 22 bp, Artificial Sequence
  chemically synthesized
tgcagctttttttcccaagaat

SEQ ID NO: 1153684 - DNA, 22 bp, Artificial Sequence
  chemically synthesized
aatgatttacaattcttgggaa

SEQ ID NO: 1153685 - DNA, 22 bp, Artificial Sequence
  chemically synthesized
aatcgctttgcagctttttttc

SEQ ID NO: 1153686 - DNA, 22 bp, Artificial Sequence
  chemically synthesized
acaattcttgggaaaaaaagct

SEQ ID NO: 1153687 - DNA, 22 bp, Artificial Sequence
  chemically synthesized
caattcttgggaaaaaaagctg

SEQ ID NO: 1153688 - DNA, 22 bp, Artificial Sequence
  chemically synthesized
ttgggaaaaaaagctgcaaagc

SEQ ID NO: 1153689 - DNA, 22 bp, Artificial Sequence
  chemically synthesized
gggaaaaaaagctgcaaagcga

SEQ ID NO: 1153690 - DNA, 22 bp, Artificial Sequence
  chemically synthesized
ggaaaaaaagctgcaaagcgat

SEQ ID NO: 1153691 - DNA, 22 bp, Artificial Sequence
  chemically synthesized
tatagtcgttgaatcgctttgc

SEQ ID NO: 1153692 - DNA, 22 bp, Artificial Sequence
  chemically synthesized
atatagtcgttgaatcgctttg

SEQ ID NO: 1153693 - DNA, 22 bp, Artificial Sequence
  chemically synthesized
tttatatagtcgttgaatcgct

SEQ ID NO: 1153694 - DNA, 22 bp, Artificial Sequence
  chemically synthesized
atttatatagtcgttgaatcgc

SEQ ID NO: 1153695 - DNA, 22 bp, Artificial Sequence
  chemically synthesized
aagccttatttatatagtcgtt

SEQ ID NO: 1153696 - DNA, 22 bp, Artificial Sequence
  chemically synthesized
caaagcgattcaacgactatat

SEQ ID NO: 1153697 - DNA, 22 bp, Artificial Sequence
  chemically synthesized
aaactaaagccttatttatata

SEQ ID NO: 1153698 - DNA, 22 bp, Artificial Sequence
  chemically synthesized
agttcaaactaaagccttattt

SEQ ID NO: 1153699 - DNA, 22 bp, Artificial Sequence
  chemically synthesized
aacgactatataaataaggctt

SEQ ID NO: 1153700 - DNA, 22 bp, Artificial Sequence
  chemically synthesized
ggtaactgagttcaaactaaag

SEQ ID NO: 1153701 - DNA, 22 bp, Artificial Sequence
  chemically synthesized
tataaataaggctttagtttga

SEQ ID NO: 1153702 - DNA, 22 bp, Artificial Sequence
  chemically synthesized
gggtaactgagttcaaactaaa

SEQ ID NO: 1153703 - DNA, 22 bp, Artificial Sequence
  chemically synthesized
tgggtaactgagttcaaactaa

SEQ ID NO: 1153704 - DNA, 22 bp, Artificial Sequence
  chemically synthesized
tttgggtaactgagttcaaact

SEQ ID NO: 1153705 - DNA, 22 bp, Artificial Sequence
  chemically synthesized
ctttgggtaactgagttcaaac

SEQ ID NO: 1153706 - DNA, 22 bp, Artificial Sequence
  chemically synthesized
cttctttgggtaactgagttca

SEQ ID NO: 1153707 - DNA, 22 bp, Artificial Sequence
  chemically synthesized
tagtttgaactcagttacccaa

SEQ ID NO: 1153708 - DNA, 22 bp, Artificial Sequence
  chemically synthesized
agtttgaactcagttacccaaa

SEQ ID NO: 1153709 - DNA, 22 bp, Artificial Sequence
  chemically synthesized
gtttgaactcagttacccaaag

SEQ ID NO: 1153710 - DNA, 22 bp, Artificial Sequence
  chemically synthesized
gaactcagttacccaaagaagt

SEQ ID NO: 1153711 - DNA, 22 bp, Artificial Sequence
  chemically synthesized
aactcagttacccaaagaagta

SEQ ID NO: 1153712 - DNA, 22 bp, Artificial Sequence
  chemically synthesized
agttacccaaagaagtaacatt

SEQ ID NO: 1153713 - DNA, 22 bp, Artificial Sequence
  chemically synthesized
cccaaagaagtaacatttattt

SEQ ID NO: 1153714 - DNA, 22 bp, Artificial Sequence
  chemically synthesized
ataaaacaaaagaaaataaatg

SEQ ID NO: 1153715 - DNA, 22 bp, Artificial Sequence
  chemically synthesized
cataaaacaaaagaaaataaat

SEQ ID NO: 1153716 - DNA, 22 bp, Artificial Sequence
  chemically synthesized
ccacacttcataaaacaaaaga

SEQ ID NO: 1153717 - DNA, 22 bp, Artificial Sequence
  chemically synthesized
gccacacttcataaaacaaaag

SEQ ID NO: 1153718 - DNA, 22 bp, Artificial Sequence
  chemically synthesized
gtcttgccacacttcataaaac

SEQ ID NO: 1153719 - DNA, 22 bp, Artificial Sequence
  chemically synthesized
attttcttttgttttatgaagt

SEQ ID NO: 1153720 - DNA, 22 bp, Artificial Sequence
  chemically synthesized
ttttcttttgttttatgaagtg

SEQ ID NO: 1153721 - DNA, 22 bp, Artificial Sequence
  chemically synthesized
ttagtcttgccacacttcataa

SEQ ID NO: 1153722 - DNA, 22 bp, Artificial Sequence
  chemically synthesized
gttagtcttgccacacttcata

SEQ ID NO: 1153723 - DNA, 22 bp, Artificial Sequence
  chemically synthesized
tgttagtcttgccacacttcat

SEQ ID NO: 1153724 - DNA, 22 bp, Artificial Sequence
  chemically synthesized
tcttttgttttatgaagtgtgg

SEQ ID NO: 1153725 - DNA, 22 bp, Artificial Sequence
  chemically synthesized
cttttgttttatgaagtgtggc

SEQ ID NO: 1153726 - DNA, 22 bp, Artificial Sequence
  chemically synthesized
ttttgttttatgaagtgtggca

SEQ ID NO: 1153727 - DNA, 22 bp, Artificial Sequence
  chemically synthesized
ttttgttagtcttgccacactt

SEQ ID NO: 1153728 - DNA, 22 bp, Artificial Sequence
  chemically synthesized
ttgttttatgaagtgtggcaag

SEQ ID NO: 1153729 - DNA, 22 bp, Artificial Sequence
  chemically synthesized
tgttttatgaagtgtggcaaga

SEQ ID NO: 1153730 - DNA, 22 bp, Artificial Sequence
  chemically synthesized
gttttatgaagtgtggcaagac

SEQ ID NO: 1153731 - DNA, 22 bp, Artificial Sequence
  chemically synthesized
ttttatgaagtgtggcaagact

SEQ ID NO: 1153732 - DNA, 22 bp, Artificial Sequence
  chemically synthesized
tatgaagtgtggcaagactaac

SEQ ID NO: 1153733 - DNA, 22 bp, Artificial Sequence
  chemically synthesized
atgaagtgtggcaagactaaca

SEQ ID NO: 1153734 - DNA, 22 bp, Artificial Sequence
  chemically synthesized
tgaagtgtggcaagactaacaa

SEQ ID NO: 1153735 - DNA, 22 bp, Artificial Sequence
  chemically synthesized
aaggaacactgttttgttagtc

SEQ ID NO: 1153736 - DNA, 22 bp, Artificial Sequence
  chemically synthesized
acaaaacagtgttcctttaatt

SEQ ID NO: 1153737 - DNA, 22 bp, Artificial Sequence
  chemically synthesized
aaaggagcatacatacagaatt

SEQ ID NO: 1153738 - DNA, 22 bp, Artificial Sequence
  chemically synthesized
agactaaaaggagcatacatac

SEQ ID NO: 1153739 - DNA, 22 bp, Artificial Sequence
  chemically synthesized
aagactaaaaggagcatacata

SEQ ID NO: 1153740 - DNA, 22 bp, Artificial Sequence
  chemically synthesized
ctttaattctgtatgtatgctc

SEQ ID NO: 1153741 - DNA, 22 bp, Artificial Sequence
  chemically synthesized
taagactaaaaggagcatacat

SEQ ID NO: 1153742 - DNA, 22 bp, Artificial Sequence
  chemically synthesized
ttaagactaaaaggagcataca

SEQ ID NO: 1153743 - DNA, 22 bp, Artificial Sequence
  chemically synthesized
taattctgtatgtatgctcctt

SEQ ID NO: 1153744 - DNA, 22 bp, Artificial Sequence
  chemically synthesized
aattctgtatgtatgctccttt

SEQ ID NO: 1153745 - DNA, 22 bp, Artificial Sequence
  chemically synthesized
attctgtatgtatgctcctttt

SEQ ID NO: 1153746 - DNA, 22 bp, Artificial Sequence
  chemically synthesized
tcttttaagactaaaaggagca

SEQ ID NO: 1153747 - DNA, 22 bp, Artificial Sequence
  chemically synthesized
tgtatgtatgctccttttagtc

SEQ ID NO: 1153748 - DNA, 22 bp, Artificial Sequence
  chemically synthesized
tattgtcttttaagactaaaag

SEQ ID NO: 1153749 - DNA, 22 bp, Artificial Sequence
  chemically synthesized
tatgtatgctccttttagtctt

SEQ ID NO: 1153750 - DNA, 22 bp, Artificial Sequence
  chemically synthesized
cttttagtcttaaaagacaata

SEQ ID NO: 1153751 - DNA, 22 bp, Artificial Sequence
  chemically synthesized
aaacatgtacattatattgtct

SEQ ID NO: 1153752 - DNA, 22 bp, Artificial Sequence
  chemically synthesized
ttagtcttaaaagacaatataa

SEQ ID NO: 1153753 - DNA, 22 bp, Artificial Sequence
  chemically synthesized
tagtcttaaaagacaatataat

SEQ ID NO: 1153754 - DNA, 22 bp, Artificial Sequence
  chemically synthesized
agtcttaaaagacaatataatg

SEQ ID NO: 1153755 - DNA, 22 bp, Artificial Sequence
  chemically synthesized
gtcttaaaagacaatataatgt

SEQ ID NO: 1153756 - DNA, 22 bp, Artificial Sequence
  chemically synthesized
aacctgaaacatgtacattata

SEQ ID NO: 1153757 - DNA, 22 bp, Artificial Sequence
  chemically synthesized
aaacctgaaacatgtacattat

SEQ ID NO: 1153758 - DNA, 22 bp, Artificial Sequence
  chemically synthesized
aaaagacaatataatgtacatg

SEQ ID NO: 1153759 - DNA, 22 bp, Artificial Sequence
  chemically synthesized
aaagacaatataatgtacatgt

SEQ ID NO: 1153760 - DNA, 22 bp, Artificial Sequence
  chemically synthesized
tttaaacctgaaacatgtacat

SEQ ID NO: 1153761 - DNA, 22 bp, Artificial Sequence
  chemically synthesized
atttaaacctgaaacatgtaca

SEQ ID NO: 1153762 - DNA, 22 bp, Artificial Sequence
  chemically synthesized
tatttaaacctgaaacatgtac

SEQ ID NO: 1153763 - DNA, 22 bp, Artificial Sequence
  chemically synthesized
actttatttaaacctgaaacat

SEQ ID NO: 1153764 - DNA, 22 bp, Artificial Sequence
  chemically synthesized
gcaaagagttgactttatttaa

SEQ ID NO: 1153765 - DNA, 22 bp, Artificial Sequence
  chemically synthesized
agcaaagagttgactttattta

SEQ ID NO: 1153766 - DNA, 22 bp, Artificial Sequence
  chemically synthesized
caggtttaaataaagtcaactc

SEQ ID NO: 1153767 - DNA, 22 bp, Artificial Sequence
  chemically synthesized
aggtttaaataaagtcaactct

SEQ ID NO: 1153768 - DNA, 22 bp, Artificial Sequence
  chemically synthesized
aaataaagtcaactctttgcta

SEQ ID NO: 1153769 - DNA, 22 bp, Artificial Sequence
  chemically synthesized
aataaagtcaactctttgctaa

SEQ ID NO: 1153770 - DNA, 22 bp, Artificial Sequence
  chemically synthesized
acatcaaacaatttagcaaaga

SEQ ID NO: 1153771 - DNA, 22 bp, Artificial Sequence
  chemically synthesized
aacatcaaacaatttagcaaag

SEQ ID NO: 1153772 - DNA, 22 bp, Artificial Sequence
  chemically synthesized
tttgctaaattgtttgatgtta

SEQ ID NO: 1153773 - DNA, 22 bp, Artificial Sequence
  chemically synthesized
tgctaaattgtttgatgttaag

SEQ ID NO: 1153774 - DNA, 22 bp, Artificial Sequence
  chemically synthesized
gctaaattgtttgatgttaagt

SEQ ID NO: 1153775 - DNA, 22 bp, Artificial Sequence
  chemically synthesized
ctaaattgtttgatgttaagtc

SEQ ID NO: 1153776 - DNA, 22 bp, Artificial Sequence
  chemically synthesized
gcgagaagaaggtgacttaaca

SEQ ID NO: 1153777 - DNA, 22 bp, Artificial Sequence
  chemically synthesized
ggcgagaagaaggtgacttaac

SEQ ID NO: 1153778 - DNA, 22 bp, Artificial Sequence
  chemically synthesized
aattgtttgatgttaagtcacc

SEQ ID NO: 1153779 - DNA, 22 bp, Artificial Sequence
  chemically synthesized
tggcgagaagaaggtgacttaa

SEQ ID NO: 1153780 - DNA, 22 bp, Artificial Sequence
  chemically synthesized
tttgatgttaagtcaccttctt

SEQ ID NO: 1153781 - DNA, 22 bp, Artificial Sequence
  chemically synthesized
gatgttaagtcaccttcttctc

SEQ ID NO: 1153782 - DNA, 22 bp, Artificial Sequence
  chemically synthesized
atgttaagtcaccttcttctcg

SEQ ID NO: 1153783 - DNA, 22 bp, Artificial Sequence
  chemically synthesized
gcaacaattttggcgagaagaa

SEQ ID NO: 1153784 - DNA, 22 bp, Artificial Sequence
  chemically synthesized
ggcaacaattttggcgagaaga

SEQ ID NO: 1153785 - DNA, 22 bp, Artificial Sequence
  chemically synthesized
ttggcaacaattttggcgagaa

SEQ ID NO: 1153786 - DNA, 22 bp, Artificial Sequence
  chemically synthesized
cttggcaacaattttggcgaga

SEQ ID NO: 1153787 - DNA, 22 bp, Artificial Sequence
  chemically synthesized
agtcaccttcttctcgccaaaa

SEQ ID NO: 1153788 - DNA, 22 bp, Artificial Sequence
  chemically synthesized
tttcttggcaacaattttggcg

SEQ ID NO: 1153789 - DNA, 22 bp, Artificial Sequence
  chemically synthesized
gtttcttggcaacaattttggc

SEQ ID NO: 1153790 - DNA, 22 bp, Artificial Sequence
  chemically synthesized
tgtttcttggcaacaattttgg

SEQ ID NO: 1153791 - DNA, 22 bp, Artificial Sequence
  chemically synthesized
ttgtttcttggcaacaattttg

SEQ ID NO: 1153792 - DNA, 22 bp, Artificial Sequence
  chemically synthesized
ttttgtttcttggcaacaattt

SEQ ID NO: 1153793 - DNA, 22 bp, Artificial Sequence
  chemically synthesized
cttctcgccaaaattgttgcca

SEQ ID NO: 1153794 - DNA, 22 bp, Artificial Sequence
  chemically synthesized
ttctcgccaaaattgttgccaa

SEQ ID NO: 1153795 - DNA, 22 bp, Artificial Sequence
  chemically synthesized
ctcgccaaaattgttgccaaga

SEQ ID NO: 1153796 - DNA, 22 bp, Artificial Sequence
  chemically synthesized
tcgccaaaattgttgccaagaa

SEQ ID NO: 1153797 - DNA, 22 bp, Artificial Sequence
  chemically synthesized
gccaaaattgttgccaagaaac

SEQ ID NO: 1153798 - DNA, 22 bp, Artificial Sequence
  chemically synthesized
ataatgctcttttgtttcttgg

SEQ ID NO: 1153799 - DNA, 22 bp, Artificial Sequence
  chemically synthesized
aatattgataatgctcttttgt

SEQ ID NO: 1153800 - DNA, 22 bp, Artificial Sequence
  chemically synthesized
ttgccaagaaacaaaagagcat

SEQ ID NO: 1153801 - DNA, 22 bp, Artificial Sequence
  chemically synthesized
ccaagaaacaaaagagcattat

SEQ ID NO: 1153802 - DNA, 22 bp, Artificial Sequence
  chemically synthesized
aagtcctgaatattgataatgc

SEQ ID NO: 1153803 - DNA, 22 bp, Artificial Sequence
  chemically synthesized
atattcaagtcctgaatattga

SEQ ID NO: 1153804 - DNA, 22 bp, Artificial Sequence
  chemically synthesized
tcaatattcaggacttgaatat

SEQ ID NO: 1153805 - DNA, 22 bp, Artificial Sequence
  chemically synthesized
agggaaagattcatattcaagt

SEQ ID NO: 1153806 - DNA, 22 bp, Artificial Sequence
  chemically synthesized
aggacttgaatatgaatctttc

SEQ ID NO: 1153807 - DNA, 22 bp, Artificial Sequence
  chemically synthesized
taaaaattaagggaaagattca

SEQ ID NO: 1153808 - DNA, 22 bp, Artificial Sequence
  chemically synthesized
ataaaaattaagggaaagattc

SEQ ID NO: 1153809 - DNA, 22 bp, Artificial Sequence
  chemically synthesized
tataaaaattaagggaaagatt

SEQ ID NO: 1153810 - DNA, 22 bp, Artificial Sequence
  chemically synthesized
ttataaaaattaagggaaagat

SEQ ID NO: 1153811 - DNA, 22 bp, Artificial Sequence
  chemically synthesized
tttataaaaattaagggaaaga

SEQ ID NO: 1153812 - DNA, 22 bp, Artificial Sequence
  chemically synthesized
ttttataaaaattaagggaaag

SEQ ID NO: 1153813 - DNA, 22 bp, Artificial Sequence
  chemically synthesized
tttttataaaaattaagggaaa

SEQ ID NO: 1153814 - DNA, 22 bp, Artificial Sequence
  chemically synthesized
gaatatgaatctttcccttaat

SEQ ID NO: 1153815 - DNA, 22 bp, Artificial Sequence
  chemically synthesized
ttttttataaaaattaagggaa

SEQ ID NO: 1153816 - DNA, 22 bp, Artificial Sequence
  chemically synthesized
aatatgaatctttcccttaatt

SEQ ID NO: 1153817 - DNA, 22 bp, Artificial Sequence
  chemically synthesized
tttttttataaaaattaaggga

SEQ ID NO: 1153818 - DNA, 22 bp, Artificial Sequence
  chemically synthesized
acagattttttttttataaaaa

SEQ ID NO: 1153819 - DNA, 22 bp, Artificial Sequence
  chemically synthesized
gacagattttttttttataaaa

SEQ ID NO: 1153820 - DNA, 22 bp, Artificial Sequence
  chemically synthesized
tcccttaatttttataaaaaaa

SEQ ID NO: 1153821 - DNA, 22 bp, Artificial Sequence
  chemically synthesized
cccttaatttttataaaaaaaa

SEQ ID NO: 1153822 - DNA, 22 bp, Artificial Sequence
  chemically synthesized
ccttaatttttataaaaaaaaa

SEQ ID NO: 1153823 - DNA, 22 bp, Artificial Sequence
  chemically synthesized
aaatatttgacagatttttttt

SEQ ID NO: 1153824 - DNA, 22 bp, Artificial Sequence
  chemically synthesized
aatttttataaaaaaaaaatct

SEQ ID NO: 1153825 - DNA, 22 bp, Artificial Sequence
  chemically synthesized
gaaatatttgacagattttttt

SEQ ID NO: 1153826 - DNA, 22 bp, Artificial Sequence
  chemically synthesized
atttttataaaaaaaaaatctg

SEQ ID NO: 1153827 - DNA, 22 bp, Artificial Sequence
  chemically synthesized
tgaaatatttgacagatttttt

SEQ ID NO: 1153828 - DNA, 22 bp, Artificial Sequence
  chemically synthesized
ttgaaatatttgacagattttt

SEQ ID NO: 1153829 - DNA, 22 bp, Artificial Sequence
  chemically synthesized
tttgaaatatttgacagatttt

SEQ ID NO: 1153830 - DNA, 22 bp, Artificial Sequence
  chemically synthesized
ttataaaaaaaaaatctgtcaa

SEQ ID NO: 1153831 - DNA, 22 bp, Artificial Sequence
  chemically synthesized
tataaaaaaaaaatctgtcaaa

SEQ ID NO: 1153832 - DNA, 22 bp, Artificial Sequence
  chemically synthesized
ataaaaaaaaaatctgtcaaat

SEQ ID NO: 1153833 - DNA, 22 bp, Artificial Sequence
  chemically synthesized
taaaaaaaaaatctgtcaaata

SEQ ID NO: 1153834 - DNA, 22 bp, Artificial Sequence
  chemically synthesized
acaatattttttgaaatatttg

SEQ ID NO: 1153835 - DNA, 22 bp, Artificial Sequence
  chemically synthesized
gacaatattttttgaaatattt

SEQ ID NO: 1153836 - DNA, 22 bp, Artificial Sequence
  chemically synthesized
acagatttgacaatattttttg

SEQ ID NO: 1153837 - DNA, 22 bp, Artificial Sequence
  chemically synthesized
gacagatttgacaatatttttt

SEQ ID NO: 1153838 - DNA, 22 bp, Artificial Sequence
  chemically synthesized
tcaaatatttcaaaaaatattg

SEQ ID NO: 1153839 - DNA, 22 bp, Artificial Sequence
  chemically synthesized
tgacagatttgacaatattttt

SEQ ID NO: 1153840 - DNA, 22 bp, Artificial Sequence
  chemically synthesized
ttgacagatttgacaatatttt

SEQ ID NO: 1153841 - DNA, 22 bp, Artificial Sequence
  chemically synthesized
tttgacagatttgacaatattt

SEQ ID NO: 1153842 - DNA, 22 bp, Artificial Sequence
  chemically synthesized
ttttgacagatttgacaatatt

SEQ ID NO: 1153843 - DNA, 22 bp, Artificial Sequence
  chemically synthesized
tttttgacagatttgacaatat

SEQ ID NO: 1153844 - DNA, 22 bp, Artificial Sequence
  chemically synthesized
ttttttgacagatttgacaata

SEQ ID NO: 1153845 - DNA, 22 bp, Artificial Sequence
  chemically synthesized
ttttttttgacagatttgacaa

SEQ ID NO: 1153846 - DNA, 22 bp, Artificial Sequence
  chemically synthesized
caaaaaatattgtcaaatctgt

SEQ ID NO: 1153847 - DNA, 22 bp, Artificial Sequence
  chemically synthesized
aaaaaatattgtcaaatctgtc

SEQ ID NO: 1153848 - DNA, 22 bp, Artificial Sequence
  chemically synthesized
agcactcttttttttgacagat

SEQ ID NO: 1153849 - DNA, 22 bp, Artificial Sequence
  chemically synthesized
gagcactcttttttttgacaga

SEQ ID NO: 1153850 - DNA, 22 bp, Artificial Sequence
  chemically synthesized
tttgagcactcttttttttgac

SEQ ID NO: 1153851 - DNA, 22 bp, Artificial Sequence
  chemically synthesized
tcaaatctgtcaaaaaaaagag

SEQ ID NO: 1153852 - DNA, 22 bp, Artificial Sequence
  chemically synthesized
actatttgagcactcttttttt

SEQ ID NO: 1153853 - DNA, 22 bp, Artificial Sequence
  chemically synthesized
aactatttgagcactctttttt

SEQ ID NO: 1153854 - DNA, 22 bp, Artificial Sequence
  chemically synthesized
taactatttgagcactcttttt

SEQ ID NO: 1153855 - DNA, 22 bp, Artificial Sequence
  chemically synthesized
ttaactatttgagcactctttt

SEQ ID NO: 1153856 - DNA, 22 bp, Artificial Sequence
  chemically synthesized
cttttaactatttgagcactct

SEQ ID NO: 1153857 - DNA, 22 bp, Artificial Sequence
  chemically synthesized
tcaaaaaaaagagtgctcaaat

SEQ ID NO: 1153858 - DNA, 22 bp, Artificial Sequence
  chemically synthesized
ctacttttaactatttgagcac

SEQ ID NO: 1153859 - DNA, 22 bp, Artificial Sequence
  chemically synthesized
aaatagttaaaagtaggagttg

SEQ ID NO: 1153860 - DNA, 22 bp, Artificial Sequence
  chemically synthesized
agagagtaaggccaactcctac

SEQ ID NO: 1153861 - DNA, 22 bp, Artificial Sequence
  chemically synthesized
gctcagagagtaaggccaactc

SEQ ID NO: 1153862 - DNA, 22 bp, Artificial Sequence
  chemically synthesized
tggctcagagagtaaggccaac

SEQ ID NO: 1153863 - DNA, 22 bp, Artificial Sequence
  chemically synthesized
ctggctcagagagtaaggccaa

SEQ ID NO: 1153864 - DNA, 22 bp, Artificial Sequence
  chemically synthesized
tctggctcagagagtaaggcca

SEQ ID NO: 1153865 - DNA, 22 bp, Artificial Sequence
  chemically synthesized
aaagtaggagttggccttactc

SEQ ID NO: 1153866 - DNA, 22 bp, Artificial Sequence
  chemically synthesized
gttttctggctcagagagtaag

SEQ ID NO: 1153867 - DNA, 22 bp, Artificial Sequence
  chemically synthesized
gccttactctctgagccagaaa

SEQ ID NO: 1153868 - DNA, 22 bp, Artificial Sequence
  chemically synthesized
actctctgagccagaaaaccaa

SEQ ID NO: 1153869 - DNA, 22 bp, Artificial Sequence
  chemically synthesized
ctctctgagccagaaaaccaat

SEQ ID NO: 1153870 - DNA, 22 bp, Artificial Sequence
  chemically synthesized
tctgagccagaaaaccaatgcc

SEQ ID NO: 1153871 - DNA, 22 bp, Artificial Sequence
  chemically synthesized
tgagccagaaaaccaatgcctt

SEQ ID NO: 1153872 - DNA, 22 bp, Artificial Sequence
  chemically synthesized
agccagaaaaccaatgccttct

SEQ ID NO: 1153873 - DNA, 22 bp, Artificial Sequence
  chemically synthesized
aagggcataaagaggccagaag

SEQ ID NO: 1153874 - DNA, 22 bp, Artificial Sequence
  chemically synthesized
aaagggcataaagaggccagaa

SEQ ID NO: 1153875 - DNA, 22 bp, Artificial Sequence
  chemically synthesized
tttaaagggcataaagaggcca

SEQ ID NO: 1153876 - DNA, 22 bp, Artificial Sequence
  chemically synthesized
atttaaagggcataaagaggcc

SEQ ID NO: 1153877 - DNA, 22 bp, Artificial Sequence
  chemically synthesized
tttatttaaagggcataaagag

SEQ ID NO: 1153878 - DNA, 22 bp, Artificial Sequence
  chemically synthesized
atttatttaaagggcataaaga

SEQ ID NO: 1153879 - DNA, 22 bp, Artificial Sequence
  chemically synthesized
tttatttatttaaagggcataa

SEQ ID NO: 1153880 - DNA, 22 bp, Artificial Sequence
  chemically synthesized
ctggcctctttatgccctttaa

SEQ ID NO: 1153881 - DNA, 22 bp, Artificial Sequence
  chemically synthesized
tggcctctttatgccctttaaa

SEQ ID NO: 1153882 - DNA, 22 bp, Artificial Sequence
  chemically synthesized
gcctctttatgccctttaaata

SEQ ID NO: 1153883 - DNA, 22 bp, Artificial Sequence
  chemically synthesized
caggcattatttatttatttaa

SEQ ID NO: 1153884 - DNA, 22 bp, Artificial Sequence
  chemically synthesized
tttatgccctttaaataaataa

SEQ ID NO: 1153885 - DNA, 22 bp, Artificial Sequence
  chemically synthesized
tatgccctttaaataaataaat

SEQ ID NO: 1153886 - DNA, 22 bp, Artificial Sequence
  chemically synthesized
cctccaggcattatttatttat

SEQ ID NO: 1153887 - DNA, 22 bp, Artificial Sequence
  chemically synthesized
atgccctttaaataaataaata

SEQ ID NO: 1153888 - DNA, 22 bp, Artificial Sequence
  chemically synthesized
acctccaggcattatttattta

SEQ ID NO: 1153889 - DNA, 22 bp, Artificial Sequence
  chemically synthesized
tgccctttaaataaataaataa

SEQ ID NO: 1153890 - DNA, 22 bp, Artificial Sequence
  chemically synthesized
tacctccaggcattatttattt

SEQ ID NO: 1153891 - DNA, 22 bp, Artificial Sequence
  chemically synthesized
taaataaataaataatgcctgg

SEQ ID NO: 1153892 - DNA, 22 bp, Artificial Sequence
  chemically synthesized
aaataaataaataatgcctgga

SEQ ID NO: 1153893 - DNA, 22 bp, Artificial Sequence
  chemically synthesized
aataaataaataatgcctggag

SEQ ID NO: 1153894 - DNA, 22 bp, Artificial Sequence
  chemically synthesized
tgtaacattttacctccaggca

SEQ ID NO: 1153895 - DNA, 22 bp, Artificial Sequence
  chemically synthesized
attatgtaacattttacctcca

SEQ ID NO: 1153896 - DNA, 22 bp, Artificial Sequence
  chemically synthesized
gaggtaaaatgttacataatca

SEQ ID NO: 1153897 - DNA, 22 bp, Artificial Sequence
  chemically synthesized
cataatcaacttgcatatactc

SEQ ID NO: 1153898 - DNA, 22 bp, Artificial Sequence
  chemically synthesized
gcatatactcctgttgccttct

SEQ ID NO: 1153899 - DNA, 22 bp, Artificial Sequence
  chemically synthesized
catatactcctgttgccttctt

SEQ ID NO: 1153900 - DNA, 22 bp, Artificial Sequence
  chemically synthesized
aagaaaaaatgtgaaacaaaag

SEQ ID NO: 1153901 - DNA, 22 bp, Artificial Sequence
  chemically synthesized
gaagaaaaaatgtgaaacaaaa

SEQ ID NO: 1153902 - DNA, 22 bp, Artificial Sequence
  chemically synthesized
ctgttgccttcttttgtttcac

SEQ ID NO: 1153903 - DNA, 22 bp, Artificial Sequence
  chemically synthesized
ttgccttcttttgtttcacatt

SEQ ID NO: 1153904 - DNA, 22 bp, Artificial Sequence
  chemically synthesized
ccttgaagaaaaaatgtgaaac

SEQ ID NO: 1153905 - DNA, 22 bp, Artificial Sequence
  chemically synthesized
ccttcttttgtttcacattttt

SEQ ID NO: 1153906 - DNA, 22 bp, Artificial Sequence
  chemically synthesized
cttttgtttcacattttttctt

SEQ ID NO: 1153907 - DNA, 22 bp, Artificial Sequence
  chemically synthesized
ttttgtttcacattttttcttc

SEQ ID NO: 1153908 - DNA, 22 bp, Artificial Sequence
  chemically synthesized
tgaaattgccttgaagaaaaaa

SEQ ID NO: 1153909 - DNA, 22 bp, Artificial Sequence
  chemically synthesized
ttgtttcacattttttcttcaa

SEQ ID NO: 1153910 - DNA, 22 bp, Artificial Sequence
  chemically synthesized
tgtttcacattttttcttcaag

SEQ ID NO: 1153911 - DNA, 22 bp, Artificial Sequence
  chemically synthesized
gtttcacattttttcttcaagg

SEQ ID NO: 1153912 - DNA, 22 bp, Artificial Sequence
  chemically synthesized
tttcacattttttcttcaaggc

SEQ ID NO: 1153913 - DNA, 22 bp, Artificial Sequence
  chemically synthesized
atgactatgaaattgccttgaa

SEQ ID NO: 1153914 - DNA, 22 bp, Artificial Sequence
  chemically synthesized
cacattttttcttcaaggcaat

SEQ ID NO: 1153915 - DNA, 22 bp, Artificial Sequence
  chemically synthesized
acattttttcttcaaggcaatt

SEQ ID NO: 1153916 - DNA, 22 bp, Artificial Sequence
  chemically synthesized
taatgactatgaaattgccttg

SEQ ID NO: 1153917 - DNA, 22 bp, Artificial Sequence
  chemically synthesized
ctaatgactatgaaattgcctt

SEQ ID NO: 1153918 - DNA, 22 bp, Artificial Sequence
  chemically synthesized
tttcttcaaggcaatttcatag

SEQ ID NO: 1153919 - DNA, 22 bp, Artificial Sequence
  chemically synthesized
ttcttcaaggcaatttcatagt

SEQ ID NO: 1153920 - DNA, 22 bp, Artificial Sequence
  chemically synthesized
tcttcaaggcaatttcatagtc

SEQ ID NO: 1153921 - DNA, 22 bp, Artificial Sequence
  chemically synthesized
cttcaaggcaatttcatagtca

SEQ ID NO: 1153922 - DNA, 22 bp, Artificial Sequence
  chemically synthesized
ttcaaggcaatttcatagtcat

SEQ ID NO: 1153923 - DNA, 22 bp, Artificial Sequence
  chemically synthesized
caaggcaatttcatagtcatta

SEQ ID NO: 1153924 - DNA, 22 bp, Artificial Sequence
  chemically synthesized
aaggcaatttcatagtcattag

SEQ ID NO: 1153925 - DNA, 22 bp, Artificial Sequence
  chemically synthesized
aaagtatgccatttctaatgac

SEQ ID NO: 1153926 - DNA, 22 bp, Artificial Sequence
  chemically synthesized
gaaagtatgccatttctaatga

SEQ ID NO: 1153927 - DNA, 22 bp, Artificial Sequence
  chemically synthesized
cttgaaagtatgccatttctaa

SEQ ID NO: 1153928 - DNA, 22 bp, Artificial Sequence
  chemically synthesized
catagtcattagaaatggcata

SEQ ID NO: 1153929 - DNA, 22 bp, Artificial Sequence
  chemically synthesized
attacttgaaagtatgccattt

SEQ ID NO: 1153930 - DNA, 22 bp, Artificial Sequence
  chemically synthesized
atagtcattagaaatggcatac

SEQ ID NO: 1153931 - DNA, 22 bp, Artificial Sequence
  chemically synthesized
ttcattacttgaaagtatgcca

SEQ ID NO: 1153932 - DNA, 22 bp, Artificial Sequence
  chemically synthesized
gaaatggcatactttcaagtaa

SEQ ID NO: 1153933 - DNA, 22 bp, Artificial Sequence
  chemically synthesized
aatatattattcattacttgaa

SEQ ID NO: 1153934 - DNA, 22 bp, Artificial Sequence
  chemically synthesized
aaatatattattcattacttga

SEQ ID NO: 1153935 - DNA, 22 bp, Artificial Sequence
  chemically synthesized
tcataaaatttaaatatattat

SEQ ID NO: 1153936 - DNA, 22 bp, Artificial Sequence
  chemically synthesized
tcaagtaatgaataatatattt

SEQ ID NO: 1153937 - DNA, 22 bp, Artificial Sequence
  chemically synthesized
caagtaatgaataatatattta

SEQ ID NO: 1153938 - DNA, 22 bp, Artificial Sequence
  chemically synthesized
aagtaatgaataatatatttaa

SEQ ID NO: 1153939 - DNA, 22 bp, Artificial Sequence
  chemically synthesized
acaaatattgtcataaaattta

SEQ ID NO: 1153940 - DNA, 22 bp, Artificial Sequence
  chemically synthesized
gacaaatattgtcataaaattt

SEQ ID NO: 1153941 - DNA, 22 bp, Artificial Sequence
  chemically synthesized
aaattttatgacaatatttgtc

SEQ ID NO: 1153942 - DNA, 22 bp, Artificial Sequence
  chemically synthesized
aattttatgacaatatttgtca

SEQ ID NO: 1153943 - DNA, 22 bp, Artificial Sequence
  chemically synthesized
tatgacaatatttgtcaaacgt

SEQ ID NO: 1153944 - DNA, 22 bp, Artificial Sequence
  chemically synthesized
atgacaatatttgtcaaacgtt

SEQ ID NO: 1153945 - DNA, 22 bp, Artificial Sequence
  chemically synthesized
tgacaatatttgtcaaacgttt

SEQ ID NO: 1153946 - DNA, 22 bp, Artificial Sequence
  chemically synthesized
gtcaaacgttttccatttcatt

SEQ ID NO: 1153947 - DNA, 22 bp, Artificial Sequence
  chemically synthesized
tcaaacgttttccatttcattc

SEQ ID NO: 1153948 - DNA, 22 bp, Artificial Sequence
  chemically synthesized
aaagatataatgtgaatgaaat

SEQ ID NO: 1153949 - DNA, 22 bp, Artificial Sequence
  chemically synthesized
tgaaagatataatgtgaatgaa

SEQ ID NO: 1153950 - DNA, 22 bp, Artificial Sequence
  chemically synthesized
ctgaaagatataatgtgaatga

SEQ ID NO: 1153951 - DNA, 22 bp, Artificial Sequence
  chemically synthesized
tctgaaagatataatgtgaatg

SEQ ID NO: 1153952 - DNA, 22 bp, Artificial Sequence
  chemically synthesized
ttctgaaagatataatgtgaat

SEQ ID NO: 1153953 - DNA, 22 bp, Artificial Sequence
  chemically synthesized
tttctgaaagatataatgtgaa

SEQ ID NO: 1153954 - DNA, 22 bp, Artificial Sequence
  chemically synthesized
tccatttcattcacattatatc

SEQ ID NO: 1153955 - DNA, 22 bp, Artificial Sequence
  chemically synthesized
ccatttcattcacattatatct

SEQ ID NO: 1153956 - DNA, 22 bp, Artificial Sequence
  chemically synthesized
catttcattcacattatatctt

SEQ ID NO: 1153957 - DNA, 22 bp, Artificial Sequence
  chemically synthesized
tagttttttctgaaagatataa

SEQ ID NO: 1153958 - DNA, 22 bp, Artificial Sequence
  chemically synthesized
gtagttttttctgaaagatata

SEQ ID NO: 1153959 - DNA, 22 bp, Artificial Sequence
  chemically synthesized
tgtagttttttctgaaagatat

SEQ ID NO: 1153960 - DNA, 22 bp, Artificial Sequence
  chemically synthesized
cattcacattatatctttcaga

SEQ ID NO: 1153961 - DNA, 22 bp, Artificial Sequence
  chemically synthesized
attcacattatatctttcagaa

SEQ ID NO: 1153962 - DNA, 22 bp, Artificial Sequence
  chemically synthesized
acattatatctttcagaaaaaa

SEQ ID NO: 1153963 - DNA, 22 bp, Artificial Sequence
  chemically synthesized
aaatgttttgtagttttttctg

SEQ ID NO: 1153964 - DNA, 22 bp, Artificial Sequence
  chemically synthesized
tatctttcagaaaaaactacaa

SEQ ID NO: 1153965 - DNA, 22 bp, Artificial Sequence
  chemically synthesized
tcagaaaaaactacaaaacatt

SEQ ID NO: 1153966 - DNA, 22 bp, Artificial Sequence
  chemically synthesized
ccaggtacctgaaatgttttgt

SEQ ID NO: 1153967 - DNA, 22 bp, Artificial Sequence
  chemically synthesized
cagaaaaaactacaaaacattt

SEQ ID NO: 1153968 - DNA, 22 bp, Artificial Sequence
  chemically synthesized
agaaaaaactacaaaacatttc

SEQ ID NO: 1153969 - DNA, 22 bp, Artificial Sequence
  chemically synthesized
tgccaggtacctgaaatgtttt

SEQ ID NO: 1153970 - DNA, 22 bp, Artificial Sequence
  chemically synthesized
atattctgccaggtacctgaaa

SEQ ID NO: 1153971 - DNA, 22 bp, Artificial Sequence
  chemically synthesized
aatattctgccaggtacctgaa

SEQ ID NO: 1153972 - DNA, 22 bp, Artificial Sequence
  chemically synthesized
caaaacatttcaggtacctggc

SEQ ID NO: 1153973 - DNA, 22 bp, Artificial Sequence
  chemically synthesized
tccaggatcttaatattctgcc

SEQ ID NO: 1153974 - DNA, 22 bp, Artificial Sequence
  chemically synthesized
caggtacctggcagaatattaa

SEQ ID NO: 1153975 - DNA, 22 bp, Artificial Sequence
  chemically synthesized
aggtacctggcagaatattaag

SEQ ID NO: 1153976 - DNA, 22 bp, Artificial Sequence
  chemically synthesized
gcagaatattaagatcctggat

SEQ ID NO: 1153977 - DNA, 22 bp, Artificial Sequence
  chemically synthesized
aggtgagacaagctatccagga

SEQ ID NO: 1153978 - DNA, 22 bp, Artificial Sequence
  chemically synthesized
attaaggtgagacaagctatcc

SEQ ID NO: 1153979 - DNA, 22 bp, Artificial Sequence
  chemically synthesized
cattaaggtgagacaagctatc

SEQ ID NO: 1153980 - DNA, 22 bp, Artificial Sequence
  chemically synthesized
ttcattaaggtgagacaagcta

SEQ ID NO: 1153981 - DNA, 22 bp, Artificial Sequence
  chemically synthesized
agatcctggatagcttgtctca

SEQ ID NO: 1153982 - DNA, 22 bp, Artificial Sequence
  chemically synthesized
aacagactcttcattaaggtga

SEQ ID NO: 1153983 - DNA, 22 bp, Artificial Sequence
  chemically synthesized
gatagcttgtctcaccttaatg

SEQ ID NO: 1153984 - DNA, 22 bp, Artificial Sequence
  chemically synthesized
ggacgctgaacagactcttcat

SEQ ID NO: 1153985 - DNA, 22 bp, Artificial Sequence
  chemically synthesized
gtctcaccttaatgaagagtct

SEQ ID NO: 1153986 - DNA, 22 bp, Artificial Sequence
  chemically synthesized
gggacgctgaacagactcttca

SEQ ID NO: 1153987 - DNA, 22 bp, Artificial Sequence
  chemically synthesized
tctcaccttaatgaagagtctg

SEQ ID NO: 1153988 - DNA, 22 bp, Artificial Sequence
  chemically synthesized
gcttgggacgctgaacagactc

SEQ ID NO: 1153989 - DNA, 22 bp, Artificial Sequence
  chemically synthesized
accttaatgaagagtctgttca

SEQ ID NO: 1153990 - DNA, 22 bp, Artificial Sequence
  chemically synthesized
agcttgggacgctgaacagact

SEQ ID NO: 1153991 - DNA, 22 bp, Artificial Sequence
  chemically synthesized
ttagcttgggacgctgaacaga

SEQ ID NO: 1153992 - DNA, 22 bp, Artificial Sequence
  chemically synthesized
aatgaagagtctgttcagcgtc

SEQ ID NO: 1153993 - DNA, 22 bp, Artificial Sequence
  chemically synthesized
atgaagagtctgttcagcgtcc

SEQ ID NO: 1153994 - DNA, 22 bp, Artificial Sequence
  chemically synthesized
tgaaggaagttcttagcttggg

SEQ ID NO: 1153995 - DNA, 22 bp, Artificial Sequence
  chemically synthesized
ttcagcgtcccaagctaagaac

SEQ ID NO: 1153996 - DNA, 22 bp, Artificial Sequence
  chemically synthesized
agcgtcccaagctaagaacttc

SEQ ID NO: 1153997 - DNA, 22 bp, Artificial Sequence
  chemically synthesized
gggcagctatgaaggaagttct

SEQ ID NO: 1153998 - DNA, 22 bp, Artificial Sequence
  chemically synthesized
agaacttccttcatagctgccc

SEQ ID NO: 1153999 - DNA, 22 bp, Artificial Sequence
  chemically synthesized
agtacggataacctagggcagc

SEQ ID NO: 1154000 - DNA, 22 bp, Artificial Sequence
  chemically synthesized
ccttcatagctgccctaggtta

SEQ ID NO: 1154001 - DNA, 22 bp, Artificial Sequence
  chemically synthesized
cttcatagctgccctaggttat

SEQ ID NO: 1154002 - DNA, 22 bp, Artificial Sequence
  chemically synthesized
catagctgccctaggttatccg

SEQ ID NO: 1154003 - DNA, 22 bp, Artificial Sequence
  chemically synthesized
atagctgccctaggttatccgt

SEQ ID NO: 1154004 - DNA, 22 bp, Artificial Sequence
  chemically synthesized
gcatagctaagtacggataacc

SEQ ID NO: 1154005 - DNA, 22 bp, Artificial Sequence
  chemically synthesized
ccctaggttatccgtacttagc

SEQ ID NO: 1154006 - DNA, 22 bp, Artificial Sequence
  chemically synthesized
ggttatccgtacttagctatgc

SEQ ID NO: 1154007 - DNA, 22 bp, Artificial Sequence
  chemically synthesized
tccgtacttagctatgctaaca

SEQ ID NO: 1154008 - DNA, 22 bp, Artificial Sequence
  chemically synthesized
agctatgctaacattcttcttc

SEQ ID NO: 1154009 - DNA, 22 bp, Artificial Sequence
  chemically synthesized
gctatgctaacattcttcttct

SEQ ID NO: 1154010 - DNA, 22 bp, Artificial Sequence
  chemically synthesized
caaaagagcagtagaagaagaa

SEQ ID NO: 1154011 - DNA, 22 bp, Artificial Sequence
  chemically synthesized
tgctaacattcttcttctactg

SEQ ID NO: 1154012 - DNA, 22 bp, Artificial Sequence
  chemically synthesized
acattcttcttctactgctctt

SEQ ID NO: 1154013 - DNA, 22 bp, Artificial Sequence
  chemically synthesized
ttcttctactgctcttttggag

SEQ ID NO: 1154014 - DNA, 22 bp, Artificial Sequence
  chemically synthesized
cttctactgctcttttggagct

SEQ ID NO: 1154015 - DNA, 22 bp, Artificial Sequence
  chemically synthesized
ttctactgctcttttggagctc

SEQ ID NO: 1154016 - DNA, 22 bp, Artificial Sequence
  chemically synthesized
ctactgctcttttggagctctt

SEQ ID NO: 1154017 - DNA, 22 bp, Artificial Sequence
  chemically synthesized
tactgctcttttggagctcttc

SEQ ID NO: 1154018 - DNA, 22 bp, Artificial Sequence
  chemically synthesized
ctgctcttttggagctcttctc

SEQ ID NO: 1154019 - DNA, 22 bp, Artificial Sequence
  chemically synthesized
ctcttttggagctcttctccct

SEQ ID NO: 1154020 - DNA, 22 bp, Artificial Sequence
  chemically synthesized
ttttggagctcttctccctgga

SEQ ID NO: 1154021 - DNA, 22 bp, Artificial Sequence
  chemically synthesized
ttggagctcttctccctggatt

SEQ ID NO: 1154022 - DNA, 22 bp, Artificial Sequence
  chemically synthesized
tggagctcttctccctggattt

SEQ ID NO: 1154023 - DNA, 22 bp, Artificial Sequence
  chemically synthesized
gagtgtaaagcgaaatccaggg

SEQ ID NO: 1154024 - DNA, 22 bp, Artificial Sequence
  chemically synthesized
ggagctcttctccctggatttc

SEQ ID NO: 1154025 - DNA, 22 bp, Artificial Sequence
  chemically synthesized
gagctcttctccctggatttcg

SEQ ID NO: 1154026 - DNA, 22 bp, Artificial Sequence
  chemically synthesized
ttctccctggatttcgctttac

SEQ ID NO: 1154027 - DNA, 22 bp, Artificial Sequence
  chemically synthesized
gatgcctggagtgtaaagcgaa

SEQ ID NO: 1154028 - DNA, 22 bp, Artificial Sequence
  chemically synthesized
ctccctggatttcgctttacac

SEQ ID NO: 1154029 - DNA, 22 bp, Artificial Sequence
  chemically synthesized
tccctggatttcgctttacact

SEQ ID NO: 1154030 - DNA, 22 bp, Artificial Sequence
  chemically synthesized
ctggatgcctggagtgtaaagc

SEQ ID NO: 1154031 - DNA, 22 bp, Artificial Sequence
  chemically synthesized
cctggatttcgctttacactcc

SEQ ID NO: 1154032 - DNA, 22 bp, Artificial Sequence
  chemically synthesized
ctgctggatgcctggagtgtaa

SEQ ID NO: 1154033 - DNA, 22 bp, Artificial Sequence
  chemically synthesized
gatttcgctttacactccaggc

SEQ ID NO: 1154034 - DNA, 22 bp, Artificial Sequence
  chemically synthesized
cgctttacactccaggcatcca

SEQ ID NO: 1154035 - DNA, 22 bp, Artificial Sequence
  chemically synthesized
gctttacactccaggcatccag

SEQ ID NO: 1154036 - DNA, 22 bp, Artificial Sequence
  chemically synthesized
tacactccaggcatccagcagc

SEQ ID NO: 1154037 - DNA, 22 bp, Artificial Sequence
  chemically synthesized
acactccaggcatccagcagca

SEQ ID NO: 1154038 - DNA, 22 bp, Artificial Sequence
  chemically synthesized
cactccaggcatccagcagcag

SEQ ID NO: 1154039 - DNA, 22 bp, Artificial Sequence
  chemically synthesized
caggcatccagcagcagtgtcc

SEQ ID NO: 1154040 - DNA, 22 bp, Artificial Sequence
  chemically synthesized
aacatcagaaggcaggacactg

SEQ ID NO: 1154041 - DNA, 22 bp, Artificial Sequence
  chemically synthesized
ggccacgtaacactgaacatca

SEQ ID NO: 1154042 - DNA, 22 bp, Artificial Sequence
  chemically synthesized
ccttctgatgttcagtgttacg

SEQ ID NO: 1154043 - DNA, 22 bp, Artificial Sequence
  chemically synthesized
ctgatgttcagtgttacgtggc

SEQ ID NO: 1154044 - DNA, 22 bp, Artificial Sequence
  chemically synthesized
tgatgttcagtgttacgtggcc

SEQ ID NO: 1154045 - DNA, 22 bp, Artificial Sequence
  chemically synthesized
atgttcagtgttacgtggccta

SEQ ID NO: 1154046 - DNA, 22 bp, Artificial Sequence
  chemically synthesized
gaaaaggccaagattaggccac

SEQ ID NO: 1154047 - DNA, 22 bp, Artificial Sequence
  chemically synthesized
agaaaaggccaagattaggcca

SEQ ID NO: 1154048 - DNA, 22 bp, Artificial Sequence
  chemically synthesized
tagaaaaggccaagattaggcc

SEQ ID NO: 1154049 - DNA, 22 bp, Artificial Sequence
  chemically synthesized
agtgttacgtggcctaatcttg

SEQ ID NO: 1154050 - DNA, 22 bp, Artificial Sequence
  chemically synthesized
aagtattttagaaaaggccaag

SEQ ID NO: 1154051 - DNA, 22 bp, Artificial Sequence
  chemically synthesized
cgtggcctaatcttggcctttt

SEQ ID NO: 1154052 - DNA, 22 bp, Artificial Sequence
  chemically synthesized
gaagttgaagtattttagaaaa

SEQ ID NO: 1154053 - DNA, 22 bp, Artificial Sequence
  chemically synthesized
ggaagttgaagtattttagaaa

SEQ ID NO: 1154054 - DNA, 22 bp, Artificial Sequence
  chemically synthesized
tggaagttgaagtattttagaa

SEQ ID NO: 1154055 - DNA, 22 bp, Artificial Sequence
  chemically synthesized
atcttggccttttctaaaatac

SEQ ID NO: 1154056 - DNA, 22 bp, Artificial Sequence
  chemically synthesized
ttggaagttgaagtattttaga

SEQ ID NO: 1154057 - DNA, 22 bp, Artificial Sequence
  chemically synthesized
ggccttttctaaaatacttcaa

SEQ ID NO: 1154058 - DNA, 22 bp, Artificial Sequence
  chemically synthesized
gccttttctaaaatacttcaac

SEQ ID NO: 1154059 - DNA, 22 bp, Artificial Sequence
  chemically synthesized
ttctaaaatacttcaacttcca

SEQ ID NO: 1154060 - DNA, 22 bp, Artificial Sequence
  chemically synthesized
tctaaaatacttcaacttccaa

SEQ ID NO: 1154061 - DNA, 22 bp, Artificial Sequence
  chemically synthesized
ctaaaatacttcaacttccaaa

SEQ ID NO: 1154062 - DNA, 22 bp, Artificial Sequence
  chemically synthesized
taaaatacttcaacttccaaaa

SEQ ID NO: 1154063 - DNA, 22 bp, Artificial Sequence
  chemically synthesized
aaatacttcaacttccaaaagt

SEQ ID NO: 1154064 - DNA, 22 bp, Artificial Sequence
  chemically synthesized
aatgtgtccaatacttttggaa

SEQ ID NO: 1154065 - DNA, 22 bp, Artificial Sequence
  chemically synthesized
aaatgtgtccaatacttttgga

SEQ ID NO: 1154066 - DNA, 22 bp, Artificial Sequence
  chemically synthesized
caacttccaaaagtattggaca

SEQ ID NO: 1154067 - DNA, 22 bp, Artificial Sequence
  chemically synthesized
aacttccaaaagtattggacac

SEQ ID NO: 1154068 - DNA, 22 bp, Artificial Sequence
  chemically synthesized
cagtcacagtttaaatgtgtcc

SEQ ID NO: 1154069 - DNA, 22 bp, Artificial Sequence
  chemically synthesized
ccaaaagtattggacacattta

SEQ ID NO: 1154070 - DNA, 22 bp, Artificial Sequence
  chemically synthesized
ccagtcacagtttaaatgtgtc

SEQ ID NO: 1154071 - DNA, 22 bp, Artificial Sequence
  chemically synthesized
caaaagtattggacacatttaa

SEQ ID NO: 1154072 - DNA, 22 bp, Artificial Sequence
  chemically synthesized
cttccagtcacagtttaaatgt

SEQ ID NO: 1154073 - DNA, 22 bp, Artificial Sequence
  chemically synthesized
gtgttccttccagtcacagttt

SEQ ID NO: 1154074 - DNA, 22 bp, Artificial Sequence
  chemically synthesized
tagtgttccttccagtcacagt

SEQ ID NO: 1154075 - DNA, 22 bp, Artificial Sequence
  chemically synthesized
gacacatttaaactgtgactgg

SEQ ID NO: 1154076 - DNA, 22 bp, Artificial Sequence
  chemically synthesized
ctagtgttccttccagtcacag

SEQ ID NO: 1154077 - DNA, 22 bp, Artificial Sequence
  chemically synthesized
tttctagtgttccttccagtca

SEQ ID NO: 1154078 - DNA, 22 bp, Artificial Sequence
  chemically synthesized
gtttctagtgttccttccagtc

SEQ ID NO: 1154079 - DNA, 22 bp, Artificial Sequence
  chemically synthesized
aaactgtgactggaaggaacac

SEQ ID NO: 1154080 - DNA, 22 bp, Artificial Sequence
  chemically synthesized
aactgtgactggaaggaacact

SEQ ID NO: 1154081 - DNA, 22 bp, Artificial Sequence
  chemically synthesized
tgactggaaggaacactagaaa

SEQ ID NO: 1154082 - DNA, 22 bp, Artificial Sequence
  chemically synthesized
gaaggaacactagaaacaaact

SEQ ID NO: 1154083 - DNA, 22 bp, Artificial Sequence
  chemically synthesized
gaaataaaagagtgagtttgtt

SEQ ID NO: 1154084 - DNA, 22 bp, Artificial Sequence
  chemically synthesized
ggaaataaaagagtgagtttgt

SEQ ID NO: 1154085 - DNA, 22 bp, Artificial Sequence
  chemically synthesized
tggaaataaaagagtgagtttg

SEQ ID NO: 1154086 - DNA, 22 bp, Artificial Sequence
  chemically synthesized
ctttggaaataaaagagtgagt

SEQ ID NO: 1154087 - DNA, 22 bp, Artificial Sequence
  chemically synthesized
actttggaaataaaagagtgag

SEQ ID NO: 1154088 - DNA, 22 bp, Artificial Sequence
  chemically synthesized
tactttggaaataaaagagtga

SEQ ID NO: 1154089 - DNA, 22 bp, Artificial Sequence
  chemically synthesized
gaaacaaactcactcttttatt

SEQ ID NO: 1154090 - DNA, 22 bp, Artificial Sequence
  chemically synthesized
tatctttactttggaaataaaa

SEQ ID NO: 1154091 - DNA, 22 bp, Artificial Sequence
  chemically synthesized
tgtatctttactttggaaataa

SEQ ID NO: 1154092 - DNA, 22 bp, Artificial Sequence
  chemically synthesized
tctgtatctttactttggaaat

SEQ ID NO: 1154093 - DNA, 22 bp, Artificial Sequence
  chemically synthesized
actcttttatttccaaagtaaa

SEQ ID NO: 1154094 - DNA, 22 bp, Artificial Sequence
  chemically synthesized
ttttatttccaaagtaaagata

SEQ ID NO: 1154095 - DNA, 22 bp, Artificial Sequence
  chemically synthesized
ttatttccaaagtaaagataca

SEQ ID NO: 1154096 - DNA, 22 bp, Artificial Sequence
  chemically synthesized
tatttccaaagtaaagatacag

SEQ ID NO: 1154097 - DNA, 22 bp, Artificial Sequence
  chemically synthesized
atttccaaagtaaagatacaga

SEQ ID NO: 1154098 - DNA, 22 bp, Artificial Sequence
  chemically synthesized
tttccaaagtaaagatacagag

SEQ ID NO: 1154099 - DNA, 22 bp, Artificial Sequence
  chemically synthesized
atgtcccaggttctctgtatct

SEQ ID NO: 1154100 - DNA, 22 bp, Artificial Sequence
  chemically synthesized
aatgtcccaggttctctgtatc

SEQ ID NO: 1154101 - DNA, 22 bp, Artificial Sequence
  chemically synthesized
ccaaagtaaagatacagagaac

SEQ ID NO: 1154102 - DNA, 22 bp, Artificial Sequence
  chemically synthesized
caaagtaaagatacagagaacc

SEQ ID NO: 1154103 - DNA, 22 bp, Artificial Sequence
  chemically synthesized
caaacatcacttaatgtcccag

SEQ ID NO: 1154104 - DNA, 22 bp, Artificial Sequence
  chemically synthesized
ccaaacatcacttaatgtccca

SEQ ID NO: 1154105 - DNA, 22 bp, Artificial Sequence
  chemically synthesized
tccaaacatcacttaatgtccc

SEQ ID NO: 1154106 - DNA, 22 bp, Artificial Sequence
  chemically synthesized
tcattttccaaacatcacttaa

SEQ ID NO: 1154107 - DNA, 22 bp, Artificial Sequence
  chemically synthesized
aattgtcattttccaaacatca

SEQ ID NO: 1154108 - DNA, 22 bp, Artificial Sequence
  chemically synthesized
ggacattaagtgatgtttggaa

SEQ ID NO: 1154109 - DNA, 22 bp, Artificial Sequence
  chemically synthesized
actaaattgtcattttccaaac

SEQ ID NO: 1154110 - DNA, 22 bp, Artificial Sequence
  chemically synthesized
agtgatgtttggaaaatgacaa

SEQ ID NO: 1154111 - DNA, 22 bp, Artificial Sequence
  chemically synthesized
ccactaactaaattgtcatttt

SEQ ID NO: 1154112 - DNA, 22 bp, Artificial Sequence
  chemically synthesized
taccactaactaaattgtcatt

SEQ ID NO: 1154113 - DNA, 22 bp, Artificial Sequence
  chemically synthesized
cagttctaccactaactaaatt

SEQ ID NO: 1154114 - DNA, 22 bp, Artificial Sequence
  chemically synthesized
ggaaaatgacaatttagttagt

SEQ ID NO: 1154115 - DNA, 22 bp, Artificial Sequence
  chemically synthesized
gaaaatgacaatttagttagtg

SEQ ID NO: 1154116 - DNA, 22 bp, Artificial Sequence
  chemically synthesized
gagctccagttctaccactaac

SEQ ID NO: 1154117 - DNA, 22 bp, Artificial Sequence
  chemically synthesized
agttagtggtagaactggagct

SEQ ID NO: 1154118 - DNA, 22 bp, Artificial Sequence
  chemically synthesized
gttagtggtagaactggagctc

SEQ ID NO: 1154119 - DNA, 22 bp, Artificial Sequence
  chemically synthesized
gaagccagaattcgagctccag

SEQ ID NO: 1154120 - DNA, 22 bp, Artificial Sequence
  chemically synthesized
gtggtagaactggagctcgaat

SEQ ID NO: 1154121 - DNA, 22 bp, Artificial Sequence
  chemically synthesized
ccactagaagccagaattcgag

SEQ ID NO: 1154122 - DNA, 22 bp, Artificial Sequence
  chemically synthesized
tcccactagaagccagaattcg

SEQ ID NO: 1154123 - DNA, 22 bp, Artificial Sequence
  chemically synthesized
ctcccactagaagccagaattc

SEQ ID NO: 1154124 - DNA, 22 bp, Artificial Sequence
  chemically synthesized
gagctcgaattctggcttctag

SEQ ID NO: 1154125 - DNA, 22 bp, Artificial Sequence
  chemically synthesized
gaattctggcttctagtgggag

SEQ ID NO: 1154126 - DNA, 22 bp, Artificial Sequence
  chemically synthesized
acccaagacaaacttctcccac

SEQ ID NO: 1154127 - DNA, 22 bp, Artificial Sequence
  chemically synthesized
tggcttctagtgggagaagttt

SEQ ID NO: 1154128 - DNA, 22 bp, Artificial Sequence
  chemically synthesized
gcttctagtgggagaagtttgt

SEQ ID NO: 1154129 - DNA, 22 bp, Artificial Sequence
  chemically synthesized
ctagtgggagaagtttgtcttg

SEQ ID NO: 1154130 - DNA, 22 bp, Artificial Sequence
  chemically synthesized
tagtgggagaagtttgtcttgg

SEQ ID NO: 1154131 - DNA, 22 bp, Artificial Sequence
  chemically synthesized
gaggaatctaacccaagacaaa

SEQ ID NO: 1154132 - DNA, 22 bp, Artificial Sequence
  chemically synthesized
ggaggaatctaacccaagacaa

SEQ ID NO: 1154133 - DNA, 22 bp, Artificial Sequence
  chemically synthesized
gtgggagaagtttgtcttgggt

SEQ ID NO: 1154134 - DNA, 22 bp, Artificial Sequence
  chemically synthesized
tggaggaatctaacccaagaca

SEQ ID NO: 1154135 - DNA, 22 bp, Artificial Sequence
  chemically synthesized
ttggaggaatctaacccaagac

SEQ ID NO: 1154136 - DNA, 22 bp, Artificial Sequence
  chemically synthesized
aggatgtgtttttggaggaatc

SEQ ID NO: 1154137 - DNA, 22 bp, Artificial Sequence
  chemically synthesized
gtcttgggttagattcctccaa

SEQ ID NO: 1154138 - DNA, 22 bp, Artificial Sequence
  chemically synthesized
tcttgggttagattcctccaaa

SEQ ID NO: 1154139 - DNA, 22 bp, Artificial Sequence
  chemically synthesized
ttcaggatgtgtttttggagga

SEQ ID NO: 1154140 - DNA, 22 bp, Artificial Sequence
  chemically synthesized
gttcaggatgtgtttttggagg

SEQ ID NO: 1154141 - DNA, 22 bp, Artificial Sequence
  chemically synthesized
tgttcaggatgtgtttttggag

SEQ ID NO: 1154142 - DNA, 22 bp, Artificial Sequence
  chemically synthesized
gggttagattcctccaaaaaca

SEQ ID NO: 1154143 - DNA, 22 bp, Artificial Sequence
  chemically synthesized
ttgttcaggatgtgtttttgga

SEQ ID NO: 1154144 - DNA, 22 bp, Artificial Sequence
  chemically synthesized
ggttagattcctccaaaaacac

SEQ ID NO: 1154145 - DNA, 22 bp, Artificial Sequence
  chemically synthesized
gattcctccaaaaacacatcct

SEQ ID NO: 1154146 - DNA, 22 bp, Artificial Sequence
  chemically synthesized
acaaatcttttgttcaggatgt

SEQ ID NO: 1154147 - DNA, 22 bp, Artificial Sequence
  chemically synthesized
ctccaaaaacacatcctgaaca

SEQ ID NO: 1154148 - DNA, 22 bp, Artificial Sequence
  chemically synthesized
ttcacaaatcttttgttcagga

SEQ ID NO: 1154149 - DNA, 22 bp, Artificial Sequence
  chemically synthesized
gttcacaaatcttttgttcagg

SEQ ID NO: 1154150 - DNA, 22 bp, Artificial Sequence
  chemically synthesized
caaaaacacatcctgaacaaaa

SEQ ID NO: 1154151 - DNA, 22 bp, Artificial Sequence
  chemically synthesized
tttgttcacaaatcttttgttc

SEQ ID NO: 1154152 - DNA, 22 bp, Artificial Sequence
  chemically synthesized
atttgttcacaaatcttttgtt

SEQ ID NO: 1154153 - DNA, 22 bp, Artificial Sequence
  chemically synthesized
aacaaaagatttgtgaacaaat

SEQ ID NO: 1154154 - DNA, 22 bp, Artificial Sequence
  chemically synthesized
caaataaaccatttatttgttc

SEQ ID NO: 1154155 - DNA, 22 bp, Artificial Sequence
  chemically synthesized
accctccaaataaaccatttat

SEQ ID NO: 1154156 - DNA, 22 bp, Artificial Sequence
  chemically synthesized
gtgaacaaataaatggtttatt

SEQ ID NO: 1154157 - DNA, 22 bp, Artificial Sequence
  chemically synthesized
tgaacaaataaatggtttattt

SEQ ID NO: 1154158 - DNA, 22 bp, Artificial Sequence
  chemically synthesized
cgagttcaccctccaaataaac

SEQ ID NO: 1154159 - DNA, 22 bp, Artificial Sequence
  chemically synthesized
acgagttcaccctccaaataaa

SEQ ID NO: 1154160 - DNA, 22 bp, Artificial Sequence
  chemically synthesized
ataatgccttacgagttcaccc

SEQ ID NO: 1154161 - DNA, 22 bp, Artificial Sequence
  chemically synthesized
tcataatgccttacgagttcac

SEQ ID NO: 1154162 - DNA, 22 bp, Artificial Sequence
  chemically synthesized
atttggagggtgaactcgtaag

SEQ ID NO: 1154163 - DNA, 22 bp, Artificial Sequence
  chemically synthesized
tttggagggtgaactcgtaagg

SEQ ID NO: 1154164 - DNA, 22 bp, Artificial Sequence
  chemically synthesized
ggagggtgaactcgtaaggcat

SEQ ID NO: 1154165 - DNA, 22 bp, Artificial Sequence
  chemically synthesized
gagggtgaactcgtaaggcatt

SEQ ID NO: 1154166 - DNA, 22 bp, Artificial Sequence
  chemically synthesized
aacgtccccgtgctctcataat

SEQ ID NO: 1154167 - DNA, 22 bp, Artificial Sequence
  chemically synthesized
ctgaacgtccccgtgctctcat

SEQ ID NO: 1154168 - DNA, 22 bp, Artificial Sequence
  chemically synthesized
cctgaacgtccccgtgctctca

SEQ ID NO: 1154169 - DNA, 22 bp, Artificial Sequence
  chemically synthesized
gtaaggcattatgagagcacgg

SEQ ID NO: 1154170 - DNA, 22 bp, Artificial Sequence
  chemically synthesized
tgagagcacggggacgttcagg

SEQ ID NO: 1154171 - DNA, 22 bp, Artificial Sequence
  chemically synthesized
caggtatccacagggtaacttc

SEQ ID NO: 1154172 - DNA, 22 bp, Artificial Sequence
  chemically synthesized
agctccaggtatccacagggta

SEQ ID NO: 1154173 - DNA, 22 bp, Artificial Sequence
  chemically synthesized
aggaagttaccctgtggatacc

SEQ ID NO: 1154174 - DNA, 22 bp, Artificial Sequence
  chemically synthesized
cccagtaagactgagctccagg

SEQ ID NO: 1154175 - DNA, 22 bp, Artificial Sequence
  chemically synthesized
ccctgtggatacctggagctca

SEQ ID NO: 1154176 - DNA, 22 bp, Artificial Sequence
  chemically synthesized
tggatacctggagctcagtctt

SEQ ID NO: 1154177 - DNA, 22 bp, Artificial Sequence
  chemically synthesized
agagattccccagtaagactga

SEQ ID NO: 1154178 - DNA, 22 bp, Artificial Sequence
  chemically synthesized
cagagattccccagtaagactg

SEQ ID NO: 1154179 - DNA, 22 bp, Artificial Sequence
  chemically synthesized
tcagagattccccagtaagact

SEQ ID NO: 1154180 - DNA, 22 bp, Artificial Sequence
  chemically synthesized
gagctcagtcttactggggaat

SEQ ID NO: 1154181 - DNA, 22 bp, Artificial Sequence
  chemically synthesized
cacagtctttcagagattcccc

SEQ ID NO: 1154182 - DNA, 22 bp, Artificial Sequence
  chemically synthesized
tccacagtctttcagagattcc

SEQ ID NO: 1154183 - DNA, 22 bp, Artificial Sequence
  chemically synthesized
agtcttactggggaatctctga

SEQ ID NO: 1154184 - DNA, 22 bp, Artificial Sequence
  chemically synthesized
actggggaatctctgaaagact

SEQ ID NO: 1154185 - DNA, 22 bp, Artificial Sequence
  chemically synthesized
ctggggaatctctgaaagactg

SEQ ID NO: 1154186 - DNA, 22 bp, Artificial Sequence
  chemically synthesized
aggtatattctccacagtcttt

SEQ ID NO: 1154187 - DNA, 22 bp, Artificial Sequence
  chemically synthesized
gggaatctctgaaagactgtgg

SEQ ID NO: 1154188 - DNA, 22 bp, Artificial Sequence
  chemically synthesized
taaggtatattctccacagtct

SEQ ID NO: 1154189 - DNA, 22 bp, Artificial Sequence
  chemically synthesized
ctaaggtatattctccacagtc

SEQ ID NO: 1154190 - DNA, 22 bp, Artificial Sequence
  chemically synthesized
tgaaagactgtggagaatatac

SEQ ID NO: 1154191 - DNA, 22 bp, Artificial Sequence
  chemically synthesized
aaagactgtggagaatatacct

SEQ ID NO: 1154192 - DNA, 22 bp, Artificial Sequence
  chemically synthesized
tggagaatataccttagaaatg

SEQ ID NO: 1154193 - DNA, 22 bp, Artificial Sequence
  chemically synthesized
tcccatagtgggacatttctaa

SEQ ID NO: 1154194 - DNA, 22 bp, Artificial Sequence
  chemically synthesized
gtcccatagtgggacatttcta

SEQ ID NO: 1154195 - DNA, 22 bp, Artificial Sequence
  chemically synthesized
tgtcccatagtgggacatttct

SEQ ID NO: 1154196 - DNA, 22 bp, Artificial Sequence
  chemically synthesized
tagaatctttgtcccatagtgg

SEQ ID NO: 1154197 - DNA, 22 bp, Artificial Sequence
  chemically synthesized
agaaatgtcccactatgggaca

SEQ ID NO: 1154198 - DNA, 22 bp, Artificial Sequence
  chemically synthesized
gaaatgtcccactatgggacaa

SEQ ID NO: 1154199 - DNA, 22 bp, Artificial Sequence
  chemically synthesized
atagagaaatcctgtagaatct

SEQ ID NO: 1154200 - DNA, 22 bp, Artificial Sequence
  chemically synthesized
tgggacaaagattctacaggat

SEQ ID NO: 1154201 - DNA, 22 bp, Artificial Sequence
  chemically synthesized
tacaggatttctctatcaactt

SEQ ID NO: 1154202 - DNA, 22 bp, Artificial Sequence
  chemically synthesized
caggatttctctatcaactttt

SEQ ID NO: 1154203 - DNA, 22 bp, Artificial Sequence
  chemically synthesized
gccaatgaggagtaaaagttga

SEQ ID NO: 1154204 - DNA, 22 bp, Artificial Sequence
  chemically synthesized
agccaatgaggagtaaaagttg

SEQ ID NO: 1154205 - DNA, 22 bp, Artificial Sequence
  chemically synthesized
cccttagccaatgaggagtaaa

SEQ ID NO: 1154206 - DNA, 22 bp, Artificial Sequence
  chemically synthesized
ctctatcaacttttactcctca

SEQ ID NO: 1154207 - DNA, 22 bp, Artificial Sequence
  chemically synthesized
tctatcaacttttactcctcat

SEQ ID NO: 1154208 - DNA, 22 bp, Artificial Sequence
  chemically synthesized
tatcaacttttactcctcattg

SEQ ID NO: 1154209 - DNA, 22 bp, Artificial Sequence
  chemically synthesized
tcaacttttactcctcattggc

SEQ ID NO: 1154210 - DNA, 22 bp, Artificial Sequence
  chemically synthesized
ttactcctcattggctaagggc

SEQ ID NO: 1154211 - DNA, 22 bp, Artificial Sequence
  chemically synthesized
tactcctcattggctaagggca

SEQ ID NO: 1154212 - DNA, 22 bp, Artificial Sequence
  chemically synthesized
actcctcattggctaagggcag

SEQ ID NO: 1154213 - DNA, 22 bp, Artificial Sequence
  chemically synthesized
gtgccaccagagctgcccttag

SEQ ID NO: 1154214 - DNA, 22 bp, Artificial Sequence
  chemically synthesized
ctcctcattggctaagggcagc

SEQ ID NO: 1154215 - DNA, 22 bp, Artificial Sequence
  chemically synthesized
ctcattggctaagggcagctct

SEQ ID NO: 1154216 - DNA, 22 bp, Artificial Sequence
  chemically synthesized
attggctaagggcagctctggt

SEQ ID NO: 1154217 - DNA, 22 bp, Artificial Sequence
  chemically synthesized
gctaagggcagctctggtggca

SEQ ID NO: 1154218 - DNA, 22 bp, Artificial Sequence
  chemically synthesized
agggcagctctggtggcactaa

SEQ ID NO: 1154219 - DNA, 22 bp, Artificial Sequence
  chemically synthesized
aaggtggacaggaagtggaatt

SEQ ID NO: 1154220 - DNA, 22 bp, Artificial Sequence
  chemically synthesized
gaaggtggacaggaagtggaat

SEQ ID NO: 1154221 - DNA, 22 bp, Artificial Sequence
  chemically synthesized
tggtggcactaattccacttcc

SEQ ID NO: 1154222 - DNA, 22 bp, Artificial Sequence
  chemically synthesized
gtggcactaattccacttcctg

SEQ ID NO: 1154223 - DNA, 22 bp, Artificial Sequence
  chemically synthesized
agccagtttgaaggtggacagg

SEQ ID NO: 1154224 - DNA, 22 bp, Artificial Sequence
  chemically synthesized
cagccagtttgaaggtggacag

SEQ ID NO: 1154225 - DNA, 22 bp, Artificial Sequence
  chemically synthesized
attccacttcctgtccaccttc

SEQ ID NO: 1154226 - DNA, 22 bp, Artificial Sequence
  chemically synthesized
cacttcctgtccaccttcaaac

SEQ ID NO: 1154227 - DNA, 22 bp, Artificial Sequence
  chemically synthesized
cctgtccaccttcaaactggct

SEQ ID NO: 1154228 - DNA, 22 bp, Artificial Sequence
  chemically synthesized
ctgtccaccttcaaactggctg

SEQ ID NO: 1154229 - DNA, 22 bp, Artificial Sequence
  chemically synthesized
gtgcagaaccatttcagccagt

SEQ ID NO: 1154230 - DNA, 22 bp, Artificial Sequence
  chemically synthesized
tccaccttcaaactggctgaaa

SEQ ID NO: 1154231 - DNA, 22 bp, Artificial Sequence
  chemically synthesized
tggtgcagaaccatttcagcca

SEQ ID NO: 1154232 - DNA, 22 bp, Artificial Sequence
  chemically synthesized
ctggtgcagaaccatttcagcc

SEQ ID NO: 1154233 - DNA, 22 bp, Artificial Sequence
  chemically synthesized
caaactggctgaaatggttctg

SEQ ID NO: 1154234 - DNA, 22 bp, Artificial Sequence
  chemically synthesized
aaactggctgaaatggttctgc

SEQ ID NO: 1154235 - DNA, 22 bp, Artificial Sequence
  chemically synthesized
gctgaaatggttctgcaccaga

SEQ ID NO: 1154236 - DNA, 22 bp, Artificial Sequence
  chemically synthesized
ccggagggtatttctggtgcag

SEQ ID NO: 1154237 - DNA, 22 bp, Artificial Sequence
  chemically synthesized
taccggagggtatttctggtgc

SEQ ID NO: 1154238 - DNA, 22 bp, Artificial Sequence
  chemically synthesized
aaatggttctgcaccagaaata

SEQ ID NO: 1154239 - DNA, 22 bp, Artificial Sequence
  chemically synthesized
tctaccggagggtatttctggt

SEQ ID NO: 1154240 - DNA, 22 bp, Artificial Sequence
  chemically synthesized
tctctaccggagggtatttctg

SEQ ID NO: 1154241 - DNA, 22 bp, Artificial Sequence
  chemically synthesized
ctctctaccggagggtatttct

SEQ ID NO: 1154242 - DNA, 22 bp, Artificial Sequence
  chemically synthesized
tgcaccagaaataccctccggt

SEQ ID NO: 1154243 - DNA, 22 bp, Artificial Sequence
  chemically synthesized
caccagaaataccctccggtag

SEQ ID NO: 1154244 - DNA, 22 bp, Artificial Sequence
  chemically synthesized
atgtacagcaatggcttctctc

SEQ ID NO: 1154245 - DNA, 22 bp, Artificial Sequence
  chemically synthesized
cggtagagagaagccattgctg

SEQ ID NO: 1154246 - DNA, 22 bp, Artificial Sequence
  chemically synthesized
gacaaggttgatgtacagcaat

SEQ ID NO: 1154247 - DNA, 22 bp, Artificial Sequence
  chemically synthesized
ggtcatggattggacaaggttg

SEQ ID NO: 1154248 - DNA, 22 bp, Artificial Sequence
  chemically synthesized
ctgtacatcaaccttgtccaat

SEQ ID NO: 1154249 - DNA, 22 bp, Artificial Sequence
  chemically synthesized
tacatcaaccttgtccaatcca

SEQ ID NO: 1154250 - DNA, 22 bp, Artificial Sequence
  chemically synthesized
aaagccatcctgggtcatggat

SEQ ID NO: 1154251 - DNA, 22 bp, Artificial Sequence
  chemically synthesized
gtccaatccatgacccaggatg

SEQ ID NO: 1154252 - DNA, 22 bp, Artificial Sequence
  chemically synthesized
tccaatccatgacccaggatgg

SEQ ID NO: 1154253 - DNA, 22 bp, Artificial Sequence
  chemically synthesized
ggccacattgaaagccatcctg

SEQ ID NO: 1154254 - DNA, 22 bp, Artificial Sequence
  chemically synthesized
tgttgggccacattgaaagcca

SEQ ID NO: 1154255 - DNA, 22 bp, Artificial Sequence
  chemically synthesized
gtgttgggccacattgaaagcc

SEQ ID NO: 1154256 - DNA, 22 bp, Artificial Sequence
  chemically synthesized
caaatttgtgttgggccacatt

SEQ ID NO: 1154257 - DNA, 22 bp, Artificial Sequence
  chemically synthesized
acaaatttgtgttgggccacat

SEQ ID NO: 1154258 - DNA, 22 bp, Artificial Sequence
  chemically synthesized
tcaatgtggcccaacacaaatt

SEQ ID NO: 1154259 - DNA, 22 bp, Artificial Sequence
  chemically synthesized
agaaagtttacaaatttgtgtt

SEQ ID NO: 1154260 - DNA, 22 bp, Artificial Sequence
  chemically synthesized
caatgtggcccaacacaaattt

SEQ ID NO: 1154261 - DNA, 22 bp, Artificial Sequence
  chemically synthesized
aagaaagtttacaaatttgtgt

SEQ ID NO: 1154262 - DNA, 22 bp, Artificial Sequence
  chemically synthesized
aatgtggcccaacacaaatttg

SEQ ID NO: 1154263 - DNA, 22 bp, Artificial Sequence
  chemically synthesized
taagaaagtttacaaatttgtg

SEQ ID NO: 1154264 - DNA, 22 bp, Artificial Sequence
  chemically synthesized
aaaaaatattttaagaaagttt

SEQ ID NO: 1154265 - DNA, 22 bp, Artificial Sequence
  chemically synthesized
gtaaactttcttaaaatatttt

SEQ ID NO: 1154266 - DNA, 22 bp, Artificial Sequence
  chemically synthesized
taaactttcttaaaatattttt

SEQ ID NO: 1154267 - DNA, 22 bp, Artificial Sequence
  chemically synthesized
aaagaaataattgaaaaaatat

SEQ ID NO: 1154268 - DNA, 22 bp, Artificial Sequence
  chemically synthesized
tcttaaaatattttttcaatta

SEQ ID NO: 1154269 - DNA, 22 bp, Artificial Sequence
  chemically synthesized
cttaaaatattttttcaattat

SEQ ID NO: 1154270 - DNA, 22 bp, Artificial Sequence
  chemically synthesized
ttaaaatattttttcaattatt

SEQ ID NO: 1154271 - DNA, 22 bp, Artificial Sequence
  chemically synthesized
gtgaactaaaagaaataattga

SEQ ID NO: 1154272 - DNA, 22 bp, Artificial Sequence
  chemically synthesized
aaaatattttttcaattatttc

SEQ ID NO: 1154273 - DNA, 22 bp, Artificial Sequence
  chemically synthesized
aaatattttttcaattatttct

SEQ ID NO: 1154274 - DNA, 22 bp, Artificial Sequence
  chemically synthesized
tttcaattatttcttttagttc

SEQ ID NO: 1154275 - DNA, 22 bp, Artificial Sequence
  chemically synthesized
atgatagctggtgaactaaaag

SEQ ID NO: 1154276 - DNA, 22 bp, Artificial Sequence
  chemically synthesized
ttcaattatttcttttagttca

SEQ ID NO: 1154277 - DNA, 22 bp, Artificial Sequence
  chemically synthesized
tcaattatttcttttagttcac

SEQ ID NO: 1154278 - DNA, 22 bp, Artificial Sequence
  chemically synthesized
caattatttcttttagttcacc

SEQ ID NO: 1154279 - DNA, 22 bp, Artificial Sequence
  chemically synthesized
aattatttcttttagttcacca

SEQ ID NO: 1154280 - DNA, 22 bp, Artificial Sequence
  chemically synthesized
acactaatgatagctggtgaac

SEQ ID NO: 1154281 - DNA, 22 bp, Artificial Sequence
  chemically synthesized
tttcttttagttcaccagctat

SEQ ID NO: 1154282 - DNA, 22 bp, Artificial Sequence
  chemically synthesized
cttttagttcaccagctatcat

SEQ ID NO: 1154283 - DNA, 22 bp, Artificial Sequence
  chemically synthesized
ttttagttcaccagctatcatt

SEQ ID NO: 1154284 - DNA, 22 bp, Artificial Sequence
  chemically synthesized
ttagttcaccagctatcattag

SEQ ID NO: 1154285 - DNA, 22 bp, Artificial Sequence
  chemically synthesized
tagttcaccagctatcattagt

SEQ ID NO: 1154286 - DNA, 22 bp, Artificial Sequence
  chemically synthesized
agttcaccagctatcattagtg

SEQ ID NO: 1154287 - DNA, 22 bp, Artificial Sequence
  chemically synthesized
gttcaccagctatcattagtgt

SEQ ID NO: 1154288 - DNA, 22 bp, Artificial Sequence
  chemically synthesized
accagctatcattagtgttagt

SEQ ID NO: 1154289 - DNA, 22 bp, Artificial Sequence
  chemically synthesized
ggccacacataaaatatactaa

SEQ ID NO: 1154290 - DNA, 22 bp, Artificial Sequence
  chemically synthesized
gggccacacataaaatatacta

SEQ ID NO: 1154291 - DNA, 22 bp, Artificial Sequence
  chemically synthesized
tcattagtgttagtatatttta

SEQ ID NO: 1154292 - DNA, 22 bp, Artificial Sequence
  chemically synthesized
tcttgggccacacataaaatat

SEQ ID NO: 1154293 - DNA, 22 bp, Artificial Sequence
  chemically synthesized
gtgttagtatattttatgtgtg

SEQ ID NO: 1154294 - DNA, 22 bp, Artificial Sequence
  chemically synthesized
gaagaattgtcttgggccacac

SEQ ID NO: 1154295 - DNA, 22 bp, Artificial Sequence
  chemically synthesized
gtatattttatgtgtggcccaa

SEQ ID NO: 1154296 - DNA, 22 bp, Artificial Sequence
  chemically synthesized
tatgtgtggcccaagacaattc

SEQ ID NO: 1154297 - DNA, 22 bp, Artificial Sequence
  chemically synthesized
atgtgtggcccaagacaattct

SEQ ID NO: 1154298 - DNA, 22 bp, Artificial Sequence
  chemically synthesized
ggcgacattggaagaattgtct

SEQ ID NO: 1154299 - DNA, 22 bp, Artificial Sequence
  chemically synthesized
tgtgtggcccaagacaattctt

SEQ ID NO: 1154300 - DNA, 22 bp, Artificial Sequence
  chemically synthesized
cctgggcgacattggaagaatt

SEQ ID NO: 1154301 - DNA, 22 bp, Artificial Sequence
  chemically synthesized
ccctgggcgacattggaagaat

SEQ ID NO: 1154302 - DNA, 22 bp, Artificial Sequence
  chemically synthesized
gcttccctgggcgacattggaa

SEQ ID NO: 1154303 - DNA, 22 bp, Artificial Sequence
  chemically synthesized
ttccaatgtcgcccagggaagc

SEQ ID NO: 1154304 - DNA, 22 bp, Artificial Sequence
  chemically synthesized
ccaatgtcgcccagggaagcca

SEQ ID NO: 1154305 - DNA, 22 bp, Artificial Sequence
  chemically synthesized
caatgtcgcccagggaagccaa

SEQ ID NO: 1154306 - DNA, 22 bp, Artificial Sequence
  chemically synthesized
tataaaccaggggtgtccaacc

SEQ ID NO: 1154307 - DNA, 22 bp, Artificial Sequence
  chemically synthesized
gacacccctggtttatatagac

SEQ ID NO: 1154308 - DNA, 22 bp, Artificial Sequence
  chemically synthesized
catgcagaaagtgtctatataa

SEQ ID NO: 1154309 - DNA, 22 bp, Artificial Sequence
  chemically synthesized
gaagttacatgcagaaagtgtc

SEQ ID NO: 1154310 - DNA, 22 bp, Artificial Sequence
  chemically synthesized
gtttatatagacactttctgca

SEQ ID NO: 1154311 - DNA, 22 bp, Artificial Sequence
  chemically synthesized
cactggaagttacatgcagaaa

SEQ ID NO: 1154312 - DNA, 22 bp, Artificial Sequence
  chemically synthesized
atatagacactttctgcatgta

SEQ ID NO: 1154313 - DNA, 22 bp, Artificial Sequence
  chemically synthesized
tatagacactttctgcatgtaa

SEQ ID NO: 1154314 - DNA, 22 bp, Artificial Sequence
  chemically synthesized
gcctacactggaagttacatgc

SEQ ID NO: 1154315 - DNA, 22 bp, Artificial Sequence
  chemically synthesized
ggcctacactggaagttacatg

SEQ ID NO: 1154316 - DNA, 22 bp, Artificial Sequence
  chemically synthesized
ccttggcctacactggaagtta

SEQ ID NO: 1154317 - DNA, 22 bp, Artificial Sequence
  chemically synthesized
cccttggcctacactggaagtt

SEQ ID NO: 1154318 - DNA, 22 bp, Artificial Sequence
  chemically synthesized
tcccttggcctacactggaagt

SEQ ID NO: 1154319 - DNA, 22 bp, Artificial Sequence
  chemically synthesized
tctgcatgtaacttccagtgta

SEQ ID NO: 1154320 - DNA, 22 bp, Artificial Sequence
  chemically synthesized
tttcccttggcctacactggaa

SEQ ID NO: 1154321 - DNA, 22 bp, Artificial Sequence
  chemically synthesized
ctgcatgtaacttccagtgtag

SEQ ID NO: 1154322 - DNA, 22 bp, Artificial Sequence
  chemically synthesized
tgcatgtaacttccagtgtagg

SEQ ID NO: 1154323 - DNA, 22 bp, Artificial Sequence
  chemically synthesized
catgtaacttccagtgtaggcc

SEQ ID NO: 1154324 - DNA, 22 bp, Artificial Sequence
  chemically synthesized
ccctctttcccttggcctacac

SEQ ID NO: 1154325 - DNA, 22 bp, Artificial Sequence
  chemically synthesized
tatctgccctctttcccttggc

SEQ ID NO: 1154326 - DNA, 22 bp, Artificial Sequence
  chemically synthesized
ccagtgtaggccaagggaaaga

SEQ ID NO: 1154327 - DNA, 22 bp, Artificial Sequence
  chemically synthesized
cagtgtaggccaagggaaagag

SEQ ID NO: 1154328 - DNA, 22 bp, Artificial Sequence
  chemically synthesized
acactatatctgccctctttcc

SEQ ID NO: 1154329 - DNA, 22 bp, Artificial Sequence
  chemically synthesized
gttgacactatatctgccctct

SEQ ID NO: 1154330 - DNA, 22 bp, Artificial Sequence
  chemically synthesized
tcgttgacactatatctgccct

SEQ ID NO: 1154331 - DNA, 22 bp, Artificial Sequence
  chemically synthesized
tctcgttgacactatatctgcc

SEQ ID NO: 1154332 - DNA, 22 bp, Artificial Sequence
  chemically synthesized
ctctcgttgacactatatctgc

SEQ ID NO: 1154333 - DNA, 22 bp, Artificial Sequence
  chemically synthesized
cttctctcgttgacactatatc

SEQ ID NO: 1154334 - DNA, 22 bp, Artificial Sequence
  chemically synthesized
gcttctctcgttgacactatat

SEQ ID NO: 1154335 - DNA, 22 bp, Artificial Sequence
  chemically synthesized
cgatgtggcacatttgcttctc

SEQ ID NO: 1154336 - DNA, 22 bp, Artificial Sequence
  chemically synthesized
ccgatgtggcacatttgcttct

SEQ ID NO: 1154337 - DNA, 22 bp, Artificial Sequence
  chemically synthesized
tccgatgtggcacatttgcttc

SEQ ID NO: 1154338 - DNA, 22 bp, Artificial Sequence
  chemically synthesized
ttccgatgtggcacatttgctt

SEQ ID NO: 1154339 - DNA, 22 bp, Artificial Sequence
  chemically synthesized
accgtaccgcttttccgatgtg

SEQ ID NO: 1154340 - DNA, 22 bp, Artificial Sequence
  chemically synthesized
taaccgtaccgcttttccgatg

SEQ ID NO: 1154341 - DNA, 22 bp, Artificial Sequence
  chemically synthesized
tctaaccgtaccgcttttccga

SEQ ID NO: 1154342 - DNA, 22 bp, Artificial Sequence
  chemically synthesized
gttctctaaccgtaccgctttt

SEQ ID NO: 1154343 - DNA, 22 bp, Artificial Sequence
  chemically synthesized
ggtacagtgctagttctctaac

SEQ ID NO: 1154344 - DNA, 22 bp, Artificial Sequence
  chemically synthesized
aagaagaagttaggtacagtgc

SEQ ID NO: 1154345 - DNA, 22 bp, Artificial Sequence
  chemically synthesized
gagaactagcactgtacctaac

SEQ ID NO: 1154346 - DNA, 22 bp, Artificial Sequence
  chemically synthesized
agcacctgaagaagaagttagg

SEQ ID NO: 1154347 - DNA, 22 bp, Artificial Sequence
  chemically synthesized
gcactgtacctaacttcttctt

SEQ ID NO: 1154348 - DNA, 22 bp, Artificial Sequence
  chemically synthesized
attgagcacctgaagaagaagt

SEQ ID NO: 1154349 - DNA, 22 bp, Artificial Sequence
  chemically synthesized
tacctaacttcttcttcaggtg

SEQ ID NO: 1154350 - DNA, 22 bp, Artificial Sequence
  chemically synthesized
acttcttcttcaggtgctcaat

SEQ ID NO: 1154351 - DNA, 22 bp, Artificial Sequence
  chemically synthesized
tcatatagatactaattgagca

SEQ ID NO: 1154352 - DNA, 22 bp, Artificial Sequence
  chemically synthesized
gtcatatagatactaattgagc

SEQ ID NO: 1154353 - DNA, 22 bp, Artificial Sequence
  chemically synthesized
cttcttcaggtgctcaattagt

SEQ ID NO: 1154354 - DNA, 22 bp, Artificial Sequence
  chemically synthesized
ttcttcaggtgctcaattagta

SEQ ID NO: 1154355 - DNA, 22 bp, Artificial Sequence
  chemically synthesized
cttgtcatatagatactaattg

SEQ ID NO: 1154356 - DNA, 22 bp, Artificial Sequence
  chemically synthesized
cttcaggtgctcaattagtatc

SEQ ID NO: 1154357 - DNA, 22 bp, Artificial Sequence
  chemically synthesized
ttcaggtgctcaattagtatct

SEQ ID NO: 1154358 - DNA, 22 bp, Artificial Sequence
  chemically synthesized
caggtgctcaattagtatctat

SEQ ID NO: 1154359 - DNA, 22 bp, Artificial Sequence
  chemically synthesized
aggtgctcaattagtatctata

SEQ ID NO: 1154360 - DNA, 22 bp, Artificial Sequence
  chemically synthesized
tgattacttgtcatatagatac

SEQ ID NO: 1154361 - DNA, 22 bp, Artificial Sequence
  chemically synthesized
taactgtgattacttgtcatat

SEQ ID NO: 1154362 - DNA, 22 bp, Artificial Sequence
  chemically synthesized
aattagtatctatatgacaagt

SEQ ID NO: 1154363 - DNA, 22 bp, Artificial Sequence
  chemically synthesized
gtatctatatgacaagtaatca

SEQ ID NO: 1154364 - DNA, 22 bp, Artificial Sequence
  chemically synthesized
tgtagaaattgtaactgtgatt

SEQ ID NO: 1154365 - DNA, 22 bp, Artificial Sequence
  chemically synthesized
tatgacaagtaatcacagttac

SEQ ID NO: 1154366 - DNA, 22 bp, Artificial Sequence
  chemically synthesized
caattatgtagaaattgtaact

SEQ ID NO: 1154367 - DNA, 22 bp, Artificial Sequence
  chemically synthesized
tattgcaattatgtagaaattg

SEQ ID NO: 1154368 - DNA, 22 bp, Artificial Sequence
  chemically synthesized
caatttctacataattgcaata

SEQ ID NO: 1154369 - DNA, 22 bp, Artificial Sequence
  chemically synthesized
ctacataattgcaatacagttg

SEQ ID NO: 1154370 - DNA, 22 bp, Artificial Sequence
  chemically synthesized
tacataattgcaatacagttga

SEQ ID NO: 1154371 - DNA, 22 bp, Artificial Sequence
  chemically synthesized
cataattgcaatacagttgatg

SEQ ID NO: 1154372 - DNA, 22 bp, Artificial Sequence
  chemically synthesized
tgccatcaggaaaaaaacatca

SEQ ID NO: 1154373 - DNA, 22 bp, Artificial Sequence
  chemically synthesized
caatacagttgatgtttttttc

SEQ ID NO: 1154374 - DNA, 22 bp, Artificial Sequence
  chemically synthesized
ctatgccatcaggaaaaaaaca

SEQ ID NO: 1154375 - DNA, 22 bp, Artificial Sequence
  chemically synthesized
atgtttttttcctgatggcata

SEQ ID NO: 1154376 - DNA, 22 bp, Artificial Sequence
  chemically synthesized
tggtaatccccgtctgctatgc

SEQ ID NO: 1154377 - DNA, 22 bp, Artificial Sequence
  chemically synthesized
ttttcctgatggcatagcagac

SEQ ID NO: 1154378 - DNA, 22 bp, Artificial Sequence
  chemically synthesized
tttcctgatggcatagcagacg

SEQ ID NO: 1154379 - DNA, 22 bp, Artificial Sequence
  chemically synthesized
ttcctgatggcatagcagacgg

SEQ ID NO: 1154380 - DNA, 22 bp, Artificial Sequence
  chemically synthesized
tcctgatggcatagcagacggg

SEQ ID NO: 1154381 - DNA, 22 bp, Artificial Sequence
  chemically synthesized
cctgatggcatagcagacgggg

SEQ ID NO: 1154382 - DNA, 22 bp, Artificial Sequence
  chemically synthesized
ctgatggcatagcagacgggga

SEQ ID NO: 1154383 - DNA, 22 bp, Artificial Sequence
  chemically synthesized
taactatggtaatccccgtctg

SEQ ID NO: 1154384 - DNA, 22 bp, Artificial Sequence
  chemically synthesized
atggcatagcagacggggatta

SEQ ID NO: 1154385 - DNA, 22 bp, Artificial Sequence
  chemically synthesized
agaagaactgtaactatggtaa

SEQ ID NO: 1154386 - DNA, 22 bp, Artificial Sequence
  chemically synthesized
aagaagaactgtaactatggta

SEQ ID NO: 1154387 - DNA, 22 bp, Artificial Sequence
  chemically synthesized
gcatttaagaagaactgtaact

SEQ ID NO: 1154388 - DNA, 22 bp, Artificial Sequence
  chemically synthesized
agatctagcatttaagaagaac

SEQ ID NO: 1154389 - DNA, 22 bp, Artificial Sequence
  chemically synthesized
ccatagttacagttcttcttaa

SEQ ID NO: 1154390 - DNA, 22 bp, Artificial Sequence
  chemically synthesized
taagatctagcatttaagaaga

SEQ ID NO: 1154391 - DNA, 22 bp, Artificial Sequence
  chemically synthesized
cagttcttcttaaatgctagat

SEQ ID NO: 1154392 - DNA, 22 bp, Artificial Sequence
  chemically synthesized
ttcttaaatgctagatcttaga

SEQ ID NO: 1154393 - DNA, 22 bp, Artificial Sequence
  chemically synthesized
cttaaatgctagatcttagagg

SEQ ID NO: 1154394 - DNA, 22 bp, Artificial Sequence
  chemically synthesized
acccccaggagtcctctaagat

SEQ ID NO: 1154395 - DNA, 22 bp, Artificial Sequence
  chemically synthesized
ttaaatgctagatcttagagga

SEQ ID NO: 1154396 - DNA, 22 bp, Artificial Sequence
  chemically synthesized
aaatgctagatcttagaggact

SEQ ID NO: 1154397 - DNA, 22 bp, Artificial Sequence
  chemically synthesized
ttgacccccaggagtcctctaa

SEQ ID NO: 1154398 - DNA, 22 bp, Artificial Sequence
  chemically synthesized
aatgctagatcttagaggactc

SEQ ID NO: 1154399 - DNA, 22 bp, Artificial Sequence
  chemically synthesized
ttattgacccccaggagtcctc

SEQ ID NO: 1154400 - DNA, 22 bp, Artificial Sequence
  chemically synthesized
ctattattgacccccaggagtc

SEQ ID NO: 1154401 - DNA, 22 bp, Artificial Sequence
  chemically synthesized
actattattgacccccaggagt

SEQ ID NO: 1154402 - DNA, 22 bp, Artificial Sequence
  chemically synthesized
gatcttagaggactcctggggg

SEQ ID NO: 1154403 - DNA, 22 bp, Artificial Sequence
  chemically synthesized
agaggactcctgggggtcaata

SEQ ID NO: 1154404 - DNA, 22 bp, Artificial Sequence
  chemically synthesized
gaggactcctgggggtcaataa

SEQ ID NO: 1154405 - DNA, 22 bp, Artificial Sequence
  chemically synthesized
ctgggggtcaataatagtaagg

SEQ ID NO: 1154406 - DNA, 22 bp, Artificial Sequence
  chemically synthesized
ggggtcaataatagtaagggct

SEQ ID NO: 1154407 - DNA, 22 bp, Artificial Sequence
  chemically synthesized
aatgacaaatggggccagccct

SEQ ID NO: 1154408 - DNA, 22 bp, Artificial Sequence
  chemically synthesized
gaatgacaaatggggccagccc

SEQ ID NO: 1154409 - DNA, 22 bp, Artificial Sequence
  chemically synthesized
tgaatgacaaatggggccagcc

SEQ ID NO: 1154410 - DNA, 22 bp, Artificial Sequence
  chemically synthesized
agttttgaatgacaaatggggc

SEQ ID NO: 1154411 - DNA, 22 bp, Artificial Sequence
  chemically synthesized
cagttttgaatgacaaatgggg

SEQ ID NO: 1154412 - DNA, 22 bp, Artificial Sequence
  chemically synthesized
atgagcttcagttttgaatgac

SEQ ID NO: 1154413 - DNA, 22 bp, Artificial Sequence
  chemically synthesized
aatgagcttcagttttgaatga

SEQ ID NO: 1154414 - DNA, 22 bp, Artificial Sequence
  chemically synthesized
gccccatttgtcattcaaaact

SEQ ID NO: 1154415 - DNA, 22 bp, Artificial Sequence
  chemically synthesized
agtttaatgagcttcagttttg

SEQ ID NO: 1154416 - DNA, 22 bp, Artificial Sequence
  chemically synthesized
aagtttaatgagcttcagtttt

SEQ ID NO: 1154417 - DNA, 22 bp, Artificial Sequence
  chemically synthesized
taagtttaatgagcttcagttt

SEQ ID NO: 1154418 - DNA, 22 bp, Artificial Sequence
  chemically synthesized
ttaagtttaatgagcttcagtt

SEQ ID NO: 1154419 - DNA, 22 bp, Artificial Sequence
  chemically synthesized
tttaagtttaatgagcttcagt

SEQ ID NO: 1154420 - DNA, 22 bp, Artificial Sequence
  chemically synthesized
ttttaagtttaatgagcttcag

SEQ ID NO: 1154421 - DNA, 22 bp, Artificial Sequence
  chemically synthesized
gtcattcaaaactgaagctcat

SEQ ID NO: 1154422 - DNA, 22 bp, Artificial Sequence
  chemically synthesized
tttttaagtttaatgagcttca

SEQ ID NO: 1154423 - DNA, 22 bp, Artificial Sequence
  chemically synthesized
tcattcaaaactgaagctcatt

SEQ ID NO: 1154424 - DNA, 22 bp, Artificial Sequence
  chemically synthesized
gagttttttttaagtttaatga

SEQ ID NO: 1154425 - DNA, 22 bp, Artificial Sequence
  chemically synthesized
aaaactgaagctcattaaactt

SEQ ID NO: 1154426 - DNA, 22 bp, Artificial Sequence
  chemically synthesized
tagagttttttttaagtttaat

SEQ ID NO: 1154427 - DNA, 22 bp, Artificial Sequence
  chemically synthesized
agttctagagttttttttaagt

SEQ ID NO: 1154428 - DNA, 22 bp, Artificial Sequence
  chemically synthesized
aagctcattaaacttaaaaaaa

SEQ ID NO: 1154429 - DNA, 22 bp, Artificial Sequence
  chemically synthesized
taagttctagagttttttttaa

SEQ ID NO: 1154430 - DNA, 22 bp, Artificial Sequence
  chemically synthesized
ctaagttctagagtttttttta

SEQ ID NO: 1154431 - DNA, 22 bp, Artificial Sequence
  chemically synthesized
tttctaagttctagagtttttt

SEQ ID NO: 1154432 - DNA, 22 bp, Artificial Sequence
  chemically synthesized
attaaacttaaaaaaaactcta

SEQ ID NO: 1154433 - DNA, 22 bp, Artificial Sequence
  chemically synthesized
atttctaagttctagagttttt

SEQ ID NO: 1154434 - DNA, 22 bp, Artificial Sequence
  chemically synthesized
aacttaaaaaaaactctagaac

SEQ ID NO: 1154435 - DNA, 22 bp, Artificial Sequence
  chemically synthesized
aaaaaaaactctagaacttaga

SEQ ID NO: 1154436 - DNA, 22 bp, Artificial Sequence
  chemically synthesized
aaaaaaactctagaacttagaa

SEQ ID NO: 1154437 - DNA, 22 bp, Artificial Sequence
  chemically synthesized
tagaacttagaaataaatgtat

SEQ ID NO: 1154438 - DNA, 22 bp, Artificial Sequence
  chemically synthesized
gaacttagaaataaatgtatct

SEQ ID NO: 1154439 - DNA, 22 bp, Artificial Sequence
  chemically synthesized
catgcaaatgaaagatacattt

SEQ ID NO: 1154440 - DNA, 22 bp, Artificial Sequence
  chemically synthesized
ccatgcaaatgaaagatacatt

SEQ ID NO: 1154441 - DNA, 22 bp, Artificial Sequence
  chemically synthesized
ttccatgcaaatgaaagataca

SEQ ID NO: 1154442 - DNA, 22 bp, Artificial Sequence
  chemically synthesized
agaaataaatgtatctttcatt

SEQ ID NO: 1154443 - DNA, 22 bp, Artificial Sequence
  chemically synthesized
gaaataaatgtatctttcattt

SEQ ID NO: 1154444 - DNA, 22 bp, Artificial Sequence
  chemically synthesized
cagttcttccatgcaaatgaaa

SEQ ID NO: 1154445 - DNA, 22 bp, Artificial Sequence
  chemically synthesized
acagttcttccatgcaaatgaa

SEQ ID NO: 1154446 - DNA, 22 bp, Artificial Sequence
  chemically synthesized
tacagttcttccatgcaaatga

SEQ ID NO: 1154447 - DNA, 22 bp, Artificial Sequence
  chemically synthesized
tcatttgcatggaagaactgta

SEQ ID NO: 1154448 - DNA, 22 bp, Artificial Sequence
  chemically synthesized
catttgcatggaagaactgtaa

SEQ ID NO: 1154449 - DNA, 22 bp, Artificial Sequence
  chemically synthesized
atttgcatggaagaactgtaaa

SEQ ID NO: 1154450 - DNA, 22 bp, Artificial Sequence
  chemically synthesized
agtcatatatagctttacagtt

SEQ ID NO: 1154451 - DNA, 22 bp, Artificial Sequence
  chemically synthesized
gcatggaagaactgtaaagcta

SEQ ID NO: 1154452 - DNA, 22 bp, Artificial Sequence
  chemically synthesized
catggaagaactgtaaagctat

SEQ ID NO: 1154453 - DNA, 22 bp, Artificial Sequence
  chemically synthesized
taatattcagtcatatatagct

SEQ ID NO: 1154454 - DNA, 22 bp, Artificial Sequence
  chemically synthesized
ataatattcagtcatatatagc

SEQ ID NO: 1154455 - DNA, 22 bp, Artificial Sequence
  chemically synthesized
tataatattcagtcatatatag

SEQ ID NO: 1154456 - DNA, 22 bp, Artificial Sequence
  chemically synthesized
ttataatattcagtcatatata

SEQ ID NO: 1154457 - DNA, 22 bp, Artificial Sequence
  chemically synthesized
tttataatattcagtcatatat

SEQ ID NO: 1154458 - DNA, 22 bp, Artificial Sequence
  chemically synthesized
tttttataatattcagtcatat

SEQ ID NO: 1154459 - DNA, 22 bp, Artificial Sequence
  chemically synthesized
tctttttataatattcagtcat

SEQ ID NO: 1154460 - DNA, 22 bp, Artificial Sequence
  chemically synthesized
taaagctatatatgactgaata

SEQ ID NO: 1154461 - DNA, 22 bp, Artificial Sequence
  chemically synthesized
tctctttttataatattcagtc

SEQ ID NO: 1154462 - DNA, 22 bp, Artificial Sequence
  chemically synthesized
attctctctttttataatattc

SEQ ID NO: 1154463 - DNA, 22 bp, Artificial Sequence
  chemically synthesized
aattctctctttttataatatt

SEQ ID NO: 1154464 - DNA, 22 bp, Artificial Sequence
  chemically synthesized
tatatgactgaatattataaaa

SEQ ID NO: 1154465 - DNA, 22 bp, Artificial Sequence
  chemically synthesized
tcaaacttaattctctcttttt

SEQ ID NO: 1154466 - DNA, 22 bp, Artificial Sequence
  chemically synthesized
gtcaaacttaattctctctttt

SEQ ID NO: 1154467 - DNA, 22 bp, Artificial Sequence
  chemically synthesized
tgtcaaacttaattctctcttt

SEQ ID NO: 1154468 - DNA, 22 bp, Artificial Sequence
  chemically synthesized
ttgtcaaacttaattctctctt

SEQ ID NO: 1154469 - DNA, 22 bp, Artificial Sequence
  chemically synthesized
aatattataaaaagagagaatt

SEQ ID NO: 1154470 - DNA, 22 bp, Artificial Sequence
  chemically synthesized
ccttttgtcaaacttaattctc

SEQ ID NO: 1154471 - DNA, 22 bp, Artificial Sequence
  chemically synthesized
taaaaagagagaattaagtttg

SEQ ID NO: 1154472 - DNA, 22 bp, Artificial Sequence
  chemically synthesized
gaaatctgccttttgtcaaact

SEQ ID NO: 1154473 - DNA, 22 bp, Artificial Sequence
  chemically synthesized
cgaaatctgccttttgtcaaac

SEQ ID NO: 1154474 - DNA, 22 bp, Artificial Sequence
  chemically synthesized
ataccttcgaaatctgcctttt

SEQ ID NO: 1154475 - DNA, 22 bp, Artificial Sequence
  chemically synthesized
agtttgacaaaaggcagatttc

SEQ ID NO: 1154476 - DNA, 22 bp, Artificial Sequence
  chemically synthesized
cctcataccttcgaaatctgcc

SEQ ID NO: 1154477 - DNA, 22 bp, Artificial Sequence
  chemically synthesized
acctcataccttcgaaatctgc

SEQ ID NO: 1154478 - DNA, 22 bp, Artificial Sequence
  chemically synthesized
tacctcataccttcgaaatctg

SEQ ID NO: 1154479 - DNA, 22 bp, Artificial Sequence
  chemically synthesized
gacaaaaggcagatttcgaagg

SEQ ID NO: 1154480 - DNA, 22 bp, Artificial Sequence
  chemically synthesized
ctttacctcataccttcgaaat

SEQ ID NO: 1154481 - DNA, 22 bp, Artificial Sequence
  chemically synthesized
acaaaaggcagatttcgaaggt

SEQ ID NO: 1154482 - DNA, 22 bp, Artificial Sequence
  chemically synthesized
ctcctttacctcataccttcga

SEQ ID NO: 1154483 - DNA, 22 bp, Artificial Sequence
  chemically synthesized
cgaaggtatgaggtaaaggagc

SEQ ID NO: 1154484 - DNA, 22 bp, Artificial Sequence
  chemically synthesized
gaaggtatgaggtaaaggagca

SEQ ID NO: 1154485 - DNA, 22 bp, Artificial Sequence
  chemically synthesized
aataggaatatctgctccttta

SEQ ID NO: 1154486 - DNA, 22 bp, Artificial Sequence
  chemically synthesized
gaataggaatatctgctccttt

SEQ ID NO: 1154487 - DNA, 22 bp, Artificial Sequence
  chemically synthesized
tgaataggaatatctgctcctt

SEQ ID NO: 1154488 - DNA, 22 bp, Artificial Sequence
  chemically synthesized
tggctttgaataggaatatctg

SEQ ID NO: 1154489 - DNA, 22 bp, Artificial Sequence
  chemically synthesized
atggctttgaataggaatatct

SEQ ID NO: 1154490 - DNA, 22 bp, Artificial Sequence
  chemically synthesized
gatttatggctttgaataggaa

SEQ ID NO: 1154491 - DNA, 22 bp, Artificial Sequence
  chemically synthesized
ggatttatggctttgaatagga

SEQ ID NO: 1154492 - DNA, 22 bp, Artificial Sequence
  chemically synthesized
tggatttatggctttgaatagg

SEQ ID NO: 1154493 - DNA, 22 bp, Artificial Sequence
  chemically synthesized
ttggatttatggctttgaatag

SEQ ID NO: 1154494 - DNA, 22 bp, Artificial Sequence
  chemically synthesized
tggtttttggatttatggcttt

SEQ ID NO: 1154495 - DNA, 22 bp, Artificial Sequence
  chemically synthesized
ctattcaaagccataaatccaa

SEQ ID NO: 1154496 - DNA, 22 bp, Artificial Sequence
  chemically synthesized
tgatctgtggtttttggattta

SEQ ID NO: 1154497 - DNA, 22 bp, Artificial Sequence
  chemically synthesized
atgatctgtggtttttggattt

SEQ ID NO: 1154498 - DNA, 22 bp, Artificial Sequence
  chemically synthesized
ttcaaagccataaatccaaaaa

SEQ ID NO: 1154499 - DNA, 22 bp, Artificial Sequence
  chemically synthesized
cttatgatctgtggtttttgga

SEQ ID NO: 1154500 - DNA, 22 bp, Artificial Sequence
  chemically synthesized
aaagccataaatccaaaaacca

SEQ ID NO: 1154501 - DNA, 22 bp, Artificial Sequence
  chemically synthesized
tacttatgatctgtggtttttg

SEQ ID NO: 1154502 - DNA, 22 bp, Artificial Sequence
  chemically synthesized
gcaactctacttatgatctgtg

SEQ ID NO: 1154503 - DNA, 22 bp, Artificial Sequence
  chemically synthesized
tctggcaactctacttatgatc

SEQ ID NO: 1154504 - DNA, 22 bp, Artificial Sequence
  chemically synthesized
atctggcaactctacttatgat

SEQ ID NO: 1154505 - DNA, 22 bp, Artificial Sequence
  chemically synthesized
tatctggcaactctacttatga

SEQ ID NO: 1154506 - DNA, 22 bp, Artificial Sequence
  chemically synthesized
ttttatctggcaactctactta

SEQ ID NO: 1154507 - DNA, 22 bp, Artificial Sequence
  chemically synthesized
attttatctggcaactctactt

SEQ ID NO: 1154508 - DNA, 22 bp, Artificial Sequence
  chemically synthesized
tattttatctggcaactctact

SEQ ID NO: 1154509 - DNA, 22 bp, Artificial Sequence
  chemically synthesized
ttattttatctggcaactctac

SEQ ID NO: 1154510 - DNA, 22 bp, Artificial Sequence
  chemically synthesized
agtgtcttttattttatctggc

SEQ ID NO: 1154511 - DNA, 22 bp, Artificial Sequence
  chemically synthesized
ctgagtgtcttttattttatct

SEQ ID NO: 1154512 - DNA, 22 bp, Artificial Sequence
  chemically synthesized
gctgagtgtcttttattttatc

SEQ ID NO: 1154513 - DNA, 22 bp, Artificial Sequence
  chemically synthesized
tgctgagtgtcttttattttat

SEQ ID NO: 1154514 - DNA, 22 bp, Artificial Sequence
  chemically synthesized
acattttgctgagtgtctttta

SEQ ID NO: 1154515 - DNA, 22 bp, Artificial Sequence
  chemically synthesized
ccagataaaataaaagacactc

SEQ ID NO: 1154516 - DNA, 22 bp, Artificial Sequence
  chemically synthesized
aaattcacattttgctgagtgt

SEQ ID NO: 1154517 - DNA, 22 bp, Artificial Sequence
  chemically synthesized
tctgaaattcacattttgctga

SEQ ID NO: 1154518 - DNA, 22 bp, Artificial Sequence
  chemically synthesized
atctgaaattcacattttgctg

SEQ ID NO: 1154519 - DNA, 22 bp, Artificial Sequence
  chemically synthesized
tttatctgaaattcacattttg

SEQ ID NO: 1154520 - DNA, 22 bp, Artificial Sequence
  chemically synthesized
attgtttatctgaaattcacat

SEQ ID NO: 1154521 - DNA, 22 bp, Artificial Sequence
  chemically synthesized
ttcattgtttatctgaaattca

SEQ ID NO: 1154522 - DNA, 22 bp, Artificial Sequence
  chemically synthesized
agcaaaatgtgaatttcagata

SEQ ID NO: 1154523 - DNA, 22 bp, Artificial Sequence
  chemically synthesized
gtgtgtgtcccaaattgttcat

SEQ ID NO: 1154524 - DNA, 22 bp, Artificial Sequence
  chemically synthesized
agtgtgtgtcccaaattgttca

SEQ ID NO: 1154525 - DNA, 22 bp, Artificial Sequence
  chemically synthesized
cagataaacaatgaacaatttg

SEQ ID NO: 1154526 - DNA, 22 bp, Artificial Sequence
  chemically synthesized
agataaacaatgaacaatttgg

SEQ ID NO: 1154527 - DNA, 22 bp, Artificial Sequence
  chemically synthesized
ttagtgtgtgtcccaaattgtt

SEQ ID NO: 1154528 - DNA, 22 bp, Artificial Sequence
  chemically synthesized
cttagtgtgtgtcccaaattgt

SEQ ID NO: 1154529 - DNA, 22 bp, Artificial Sequence
  chemically synthesized
tcttagtgtgtgtcccaaattg

SEQ ID NO: 1154530 - DNA, 22 bp, Artificial Sequence
  chemically synthesized
gggacacacactaagaaaatta

SEQ ID NO: 1154531 - DNA, 22 bp, Artificial Sequence
  chemically synthesized
ggacacacactaagaaaattat

SEQ ID NO: 1154532 - DNA, 22 bp, Artificial Sequence
  chemically synthesized
agataaacaacaaataattttc

SEQ ID NO: 1154533 - DNA, 22 bp, Artificial Sequence
  chemically synthesized
cagataaacaacaaataatttt

SEQ ID NO: 1154534 - DNA, 22 bp, Artificial Sequence
  chemically synthesized
agaaaattatttgttgtttatc

SEQ ID NO: 1154535 - DNA, 22 bp, Artificial Sequence
  chemically synthesized
aatgtaaatttcagataaacaa

SEQ ID NO: 1154536 - DNA, 22 bp, Artificial Sequence
  chemically synthesized
aaatgtaaatttcagataaaca

SEQ ID NO: 1154537 - DNA, 22 bp, Artificial Sequence
  chemically synthesized
cttaaatgtaaatttcagataa

SEQ ID NO: 1154538 - DNA, 22 bp, Artificial Sequence
  chemically synthesized
tttgttgtttatctgaaattta

SEQ ID NO: 1154539 - DNA, 22 bp, Artificial Sequence
  chemically synthesized
gttgtttatctgaaatttacat

SEQ ID NO: 1154540 - DNA, 22 bp, Artificial Sequence
  chemically synthesized
ttgtttatctgaaatttacatt

SEQ ID NO: 1154541 - DNA, 22 bp, Artificial Sequence
  chemically synthesized
tttatctgaaatttacatttaa

SEQ ID NO: 1154542 - DNA, 22 bp, Artificial Sequence
  chemically synthesized
atctgaaatttacatttaagta

SEQ ID NO: 1154543 - DNA, 22 bp, Artificial Sequence
  chemically synthesized
tctgaaatttacatttaagtag

SEQ ID NO: 1154544 - DNA, 22 bp, Artificial Sequence
  chemically synthesized
aaatttacatttaagtaggctt

SEQ ID NO: 1154545 - DNA, 22 bp, Artificial Sequence
  chemically synthesized
gcagacacaaataaaagaagcc

SEQ ID NO: 1154546 - DNA, 22 bp, Artificial Sequence
  chemically synthesized
acatttaagtaggcttctttta

SEQ ID NO: 1154547 - DNA, 22 bp, Artificial Sequence
  chemically synthesized
agcagacacaaataaaagaagc

SEQ ID NO: 1154548 - DNA, 22 bp, Artificial Sequence
  chemically synthesized
catttaagtaggcttcttttat

SEQ ID NO: 1154549 - DNA, 22 bp, Artificial Sequence
  chemically synthesized
aagtaggcttcttttatttgtg

SEQ ID NO: 1154550 - DNA, 22 bp, Artificial Sequence
  chemically synthesized
agtaggcttcttttatttgtgt

SEQ ID NO: 1154551 - DNA, 22 bp, Artificial Sequence
  chemically synthesized
ccacatttagcagacacaaata

SEQ ID NO: 1154552 - DNA, 22 bp, Artificial Sequence
  chemically synthesized
gggttgccacatttagcagaca

SEQ ID NO: 1154553 - DNA, 22 bp, Artificial Sequence
  chemically synthesized
cttttatttgtgtctgctaaat

SEQ ID NO: 1154554 - DNA, 22 bp, Artificial Sequence
  chemically synthesized
ttttatttgtgtctgctaaatg

SEQ ID NO: 1154555 - DNA, 22 bp, Artificial Sequence
  chemically synthesized
ttatttgtgtctgctaaatgtg

SEQ ID NO: 1154556 - DNA, 22 bp, Artificial Sequence
  chemically synthesized
tatttgtgtctgctaaatgtgg

SEQ ID NO: 1154557 - DNA, 22 bp, Artificial Sequence
  chemically synthesized
atttgtgtctgctaaatgtggc

SEQ ID NO: 1154558 - DNA, 22 bp, Artificial Sequence
  chemically synthesized
tttgtgtctgctaaatgtggca

SEQ ID NO: 1154559 - DNA, 22 bp, Artificial Sequence
  chemically synthesized
gtgtctgctaaatgtggcaacc

SEQ ID NO: 1154560 - DNA, 22 bp, Artificial Sequence
  chemically synthesized
tcccaggattagggttgccaca

SEQ ID NO: 1154561 - DNA, 22 bp, Artificial Sequence
  chemically synthesized
tgtctgctaaatgtggcaaccc

SEQ ID NO: 1154562 - DNA, 22 bp, Artificial Sequence
  chemically synthesized
taattgtcccaggattagggtt

SEQ ID NO: 1154563 - DNA, 22 bp, Artificial Sequence
  chemically synthesized
ctaaatgtggcaaccctaatcc

SEQ ID NO: 1154564 - DNA, 22 bp, Artificial Sequence
  chemically synthesized
gtaattgtcccaggattagggt

SEQ ID NO: 1154565 - DNA, 22 bp, Artificial Sequence
  chemically synthesized
tgtaattgtcccaggattaggg

SEQ ID NO: 1154566 - DNA, 22 bp, Artificial Sequence
  chemically synthesized
aatgtggcaaccctaatcctgg

SEQ ID NO: 1154567 - DNA, 22 bp, Artificial Sequence
  chemically synthesized
atcctgggacaattacaaagga

SEQ ID NO: 1154568 - DNA, 22 bp, Artificial Sequence
  chemically synthesized
ggacaattacaaaggatcttgt

SEQ ID NO: 1154569 - DNA, 22 bp, Artificial Sequence
  chemically synthesized
atgaggaaacacacacacacac

SEQ ID NO: 1154570 - DNA, 22 bp, Artificial Sequence
  chemically synthesized
caaaggatcttgtgtgtgtgtg

SEQ ID NO: 1154571 - DNA, 22 bp, Artificial Sequence
  chemically synthesized
aattcatgaggaaacacacaca

SEQ ID NO: 1154572 - DNA, 22 bp, Artificial Sequence
  chemically synthesized
ctcaattcatgaggaaacacac

SEQ ID NO: 1154573 - DNA, 22 bp, Artificial Sequence
  chemically synthesized
ctgctcaattcatgaggaaaca

SEQ ID NO: 1154574 - DNA, 22 bp, Artificial Sequence
  chemically synthesized
gtgtgtgtgtgtgtttcctcat

SEQ ID NO: 1154575 - DNA, 22 bp, Artificial Sequence
  chemically synthesized
tgtgtgtgtgtgtttcctcatg

SEQ ID NO: 1154576 - DNA, 22 bp, Artificial Sequence
  chemically synthesized
aaataggctcctgctcaattca

SEQ ID NO: 1154577 - DNA, 22 bp, Artificial Sequence
  chemically synthesized
ttgaaataggctcctgctcaat

SEQ ID NO: 1154578 - DNA, 22 bp, Artificial Sequence
  chemically synthesized
ttgttgaaataggctcctgctc

SEQ ID NO: 1154579 - DNA, 22 bp, Artificial Sequence
  chemically synthesized
cctcatgaattgagcaggagcc

SEQ ID NO: 1154580 - DNA, 22 bp, Artificial Sequence
  chemically synthesized
attgttgaaataggctcctgct

SEQ ID NO: 1154581 - DNA, 22 bp, Artificial Sequence
  chemically synthesized
ctcatgaattgagcaggagcct

SEQ ID NO: 1154582 - DNA, 22 bp, Artificial Sequence
  chemically synthesized
tattgttgaaataggctcctgc

SEQ ID NO: 1154583 - DNA, 22 bp, Artificial Sequence
  chemically synthesized
atgaattgagcaggagcctatt

SEQ ID NO: 1154584 - DNA, 22 bp, Artificial Sequence
  chemically synthesized
agttttattgttgaaataggct

SEQ ID NO: 1154585 - DNA, 22 bp, Artificial Sequence
  chemically synthesized
tgagttttattgttgaaatagg

SEQ ID NO: 1154586 - DNA, 22 bp, Artificial Sequence
  chemically synthesized
agcaggagcctatttcaacaat

SEQ ID NO: 1154587 - DNA, 22 bp, Artificial Sequence
  chemically synthesized
gctctgagttttattgttgaaa

SEQ ID NO: 1154588 - DNA, 22 bp, Artificial Sequence
  chemically synthesized
caattagctctgagttttattg

SEQ ID NO: 1154589 - DNA, 22 bp, Artificial Sequence
  chemically synthesized
tttcaacaataaaactcagagc

SEQ ID NO: 1154590 - DNA, 22 bp, Artificial Sequence
  chemically synthesized
caacaataaaactcagagctaa

SEQ ID NO: 1154591 - DNA, 22 bp, Artificial Sequence
  chemically synthesized
aacaataaaactcagagctaat

SEQ ID NO: 1154592 - DNA, 22 bp, Artificial Sequence
  chemically synthesized
ataagtgccataaaatattaca

SEQ ID NO: 1154593 - DNA, 22 bp, Artificial Sequence
  chemically synthesized
aataagtgccataaaatattac

SEQ ID NO: 1154594 - DNA, 22 bp, Artificial Sequence
  chemically synthesized
taataagtgccataaaatatta

SEQ ID NO: 1154595 - DNA, 22 bp, Artificial Sequence
  chemically synthesized
agagctaattgtaatattttat

SEQ ID NO: 1154596 - DNA, 22 bp, Artificial Sequence
  chemically synthesized
ttttaataagtgccataaaata

SEQ ID NO: 1154597 - DNA, 22 bp, Artificial Sequence
  chemically synthesized
attttaataagtgccataaaat

SEQ ID NO: 1154598 - DNA, 22 bp, Artificial Sequence
  chemically synthesized
tattttaataagtgccataaaa

SEQ ID NO: 1154599 - DNA, 22 bp, Artificial Sequence
  chemically synthesized
attgtaatattttatggcactt

SEQ ID NO: 1154600 - DNA, 22 bp, Artificial Sequence
  chemically synthesized
taatattttatggcacttatta

SEQ ID NO: 1154601 - DNA, 22 bp, Artificial Sequence
  chemically synthesized
tgagggtgctttattttaataa

SEQ ID NO: 1154602 - DNA, 22 bp, Artificial Sequence
  chemically synthesized
tatggcacttattaaaataaag

SEQ ID NO: 1154603 - DNA, 22 bp, Artificial Sequence
  chemically synthesized
atggcacttattaaaataaagc

SEQ ID NO: 1154604 - DNA, 22 bp, Artificial Sequence
  chemically synthesized
tggcacttattaaaataaagca

SEQ ID NO: 1154605 - DNA, 22 bp, Artificial Sequence
  chemically synthesized
tccaaaattatgagggtgcttt

SEQ ID NO: 1154606 - DNA, 22 bp, Artificial Sequence
  chemically synthesized
atccaaaattatgagggtgctt

SEQ ID NO: 1154607 - DNA, 22 bp, Artificial Sequence
  chemically synthesized
ttatccaaaattatgagggtgc

SEQ ID NO: 1154608 - DNA, 22 bp, Artificial Sequence
  chemically synthesized
attaaaataaagcaccctcata

SEQ ID NO: 1154609 - DNA, 22 bp, Artificial Sequence
  chemically synthesized
cttatccaaaattatgagggtg

SEQ ID NO: 1154610 - DNA, 22 bp, Artificial Sequence
  chemically synthesized
ttaaaataaagcaccctcataa

SEQ ID NO: 1154611 - DNA, 22 bp, Artificial Sequence
  chemically synthesized
aaataaagcaccctcataattt

SEQ ID NO: 1154612 - DNA, 22 bp, Artificial Sequence
  chemically synthesized
caataatatttcttatccaaaa

SEQ ID NO: 1154613 - DNA, 22 bp, Artificial Sequence
  chemically synthesized
tacaataatatttcttatccaa

SEQ ID NO: 1154614 - DNA, 22 bp, Artificial Sequence
  chemically synthesized
ctacaataatatttcttatcca

SEQ ID NO: 1154615 - DNA, 22 bp, Artificial Sequence
  chemically synthesized
ataattttggataagaaatatt

SEQ ID NO: 1154616 - DNA, 22 bp, Artificial Sequence
  chemically synthesized
agacttctacaataatatttct

SEQ ID NO: 1154617 - DNA, 22 bp, Artificial Sequence
  chemically synthesized
ttgagacttctacaataatatt

SEQ ID NO: 1154618 - DNA, 22 bp, Artificial Sequence
  chemically synthesized
tggataagaaatattattgtag

SEQ ID NO: 1154619 - DNA, 22 bp, Artificial Sequence
  chemically synthesized
ttattgagacttctacaataat

SEQ ID NO: 1154620 - DNA, 22 bp, Artificial Sequence
  chemically synthesized
ggataagaaatattattgtaga

SEQ ID NO: 1154621 - DNA, 22 bp, Artificial Sequence
  chemically synthesized
gataagaaatattattgtagaa

SEQ ID NO: 1154622 - DNA, 22 bp, Artificial Sequence
  chemically synthesized
tgttattgagacttctacaata

SEQ ID NO: 1154623 - DNA, 22 bp, Artificial Sequence
  chemically synthesized
ctgttattgagacttctacaat

SEQ ID NO: 1154624 - DNA, 22 bp, Artificial Sequence
  chemically synthesized
tttctgttattgagacttctac

SEQ ID NO: 1154625 - DNA, 22 bp, Artificial Sequence
  chemically synthesized
gtttctgttattgagacttcta

SEQ ID NO: 1154626 - DNA, 22 bp, Artificial Sequence
  chemically synthesized
tgtttctgttattgagacttct

SEQ ID NO: 1154627 - DNA, 22 bp, Artificial Sequence
  chemically synthesized
ttgtttctgttattgagacttc

SEQ ID NO: 1154628 - DNA, 22 bp, Artificial Sequence
  chemically synthesized
tttgtttctgttattgagactt

SEQ ID NO: 1154629 - DNA, 22 bp, Artificial Sequence
  chemically synthesized
ttttgtttctgttattgagact

SEQ ID NO: 1154630 - DNA, 22 bp, Artificial Sequence
  chemically synthesized
tttttgtttctgttattgagac

SEQ ID NO: 1154631 - DNA, 22 bp, Artificial Sequence
  chemically synthesized
ttttttgtttctgttattgaga

SEQ ID NO: 1154632 - DNA, 22 bp, Artificial Sequence
  chemically synthesized
ttgtagaagtctcaataacaga

SEQ ID NO: 1154633 - DNA, 22 bp, Artificial Sequence
  chemically synthesized
tagaagtctcaataacagaaac

SEQ ID NO: 1154634 - DNA, 22 bp, Artificial Sequence
  chemically synthesized
ccagaaagcatttttttttgtt

SEQ ID NO: 1154635 - DNA, 22 bp, Artificial Sequence
  chemically synthesized
aataacagaaacaaaaaaaaat

SEQ ID NO: 1154636 - DNA, 22 bp, Artificial Sequence
  chemically synthesized
gctgccagaaagcatttttttt

SEQ ID NO: 1154637 - DNA, 22 bp, Artificial Sequence
  chemically synthesized
cctcgctgccagaaagcatttt

SEQ ID NO: 1154638 - DNA, 22 bp, Artificial Sequence
  chemically synthesized
tgctccctcgctgccagaaagc

SEQ ID NO: 1154639 - DNA, 22 bp, Artificial Sequence
  chemically synthesized
cagttatgctccctcgctgcca

SEQ ID NO: 1154640 - DNA, 22 bp, Artificial Sequence
  chemically synthesized
ccagttatgctccctcgctgcc

SEQ ID NO: 1154641 - DNA, 22 bp, Artificial Sequence
  chemically synthesized
tacatttccagttatgctccct

SEQ ID NO: 1154642 - DNA, 22 bp, Artificial Sequence
  chemically synthesized
gtacatttccagttatgctccc

SEQ ID NO: 1154643 - DNA, 22 bp, Artificial Sequence
  chemically synthesized
tctggcagcgagggagcataac

SEQ ID NO: 1154644 - DNA, 22 bp, Artificial Sequence
  chemically synthesized
ctggcagcgagggagcataact

SEQ ID NO: 1154645 - DNA, 22 bp, Artificial Sequence
  chemically synthesized
tggcagcgagggagcataactg

SEQ ID NO: 1154646 - DNA, 22 bp, Artificial Sequence
  chemically synthesized
cttgtacatttccagttatgct

SEQ ID NO: 1154647 - DNA, 22 bp, Artificial Sequence
  chemically synthesized
acttgtacatttccagttatgc

SEQ ID NO: 1154648 - DNA, 22 bp, Artificial Sequence
  chemically synthesized
gcagcgagggagcataactgga

SEQ ID NO: 1154649 - DNA, 22 bp, Artificial Sequence
  chemically synthesized
agtttacttgtacatttccagt

SEQ ID NO: 1154650 - DNA, 22 bp, Artificial Sequence
  chemically synthesized
cagtttacttgtacatttccag

SEQ ID NO: 1154651 - DNA, 22 bp, Artificial Sequence
  chemically synthesized
ttcagtttacttgtacatttcc

SEQ ID NO: 1154652 - DNA, 22 bp, Artificial Sequence
  chemically synthesized
cttcagtttacttgtacatttc

SEQ ID NO: 1154653 - DNA, 22 bp, Artificial Sequence
  chemically synthesized
tcttcagtttacttgtacattt

SEQ ID NO: 1154654 - DNA, 22 bp, Artificial Sequence
  chemically synthesized
ttcttcagtttacttgtacatt

SEQ ID NO: 1154655 - DNA, 22 bp, Artificial Sequence
  chemically synthesized
tttcttcagtttacttgtacat

SEQ ID NO: 1154656 - DNA, 22 bp, Artificial Sequence
  chemically synthesized
ttttcttcagtttacttgtaca

SEQ ID NO: 1154657 - DNA, 22 bp, Artificial Sequence
  chemically synthesized
catcttttttcttcagtttact

SEQ ID NO: 1154658 - DNA, 22 bp, Artificial Sequence
  chemically synthesized
ccatcttttttcttcagtttac

SEQ ID NO: 1154659 - DNA, 22 bp, Artificial Sequence
  chemically synthesized
gaaatgtacaagtaaactgaag

SEQ ID NO: 1154660 - DNA, 22 bp, Artificial Sequence
  chemically synthesized
atatttccatcttttttcttca

SEQ ID NO: 1154661 - DNA, 22 bp, Artificial Sequence
  chemically synthesized
aatgttaatatttccatctttt

SEQ ID NO: 1154662 - DNA, 22 bp, Artificial Sequence
  chemically synthesized
aaatgttaatatttccatcttt

SEQ ID NO: 1154663 - DNA, 22 bp, Artificial Sequence
  chemically synthesized
taaatgttaatatttccatctt

SEQ ID NO: 1154664 - DNA, 22 bp, Artificial Sequence
  chemically synthesized
ttaaatgttaatatttccatct

SEQ ID NO: 1154665 - DNA, 22 bp, Artificial Sequence
  chemically synthesized
tttaaatgttaatatttccatc

SEQ ID NO: 1154666 - DNA, 22 bp, Artificial Sequence
  chemically synthesized
aagaaaaaagatggaaatatta

SEQ ID NO: 1154667 - DNA, 22 bp, Artificial Sequence
  chemically synthesized
tagaatatgacattttttaaat

SEQ ID NO: 1154668 - DNA, 22 bp, Artificial Sequence
  chemically synthesized
tatagaatatgacattttttaa

SEQ ID NO: 1154669 - DNA, 22 bp, Artificial Sequence
  chemically synthesized
ctatagaatatgacatttttta

SEQ ID NO: 1154670 - DNA, 22 bp, Artificial Sequence
  chemically synthesized
tctatagaatatgacatttttt

SEQ ID NO: 1154671 - DNA, 22 bp, Artificial Sequence
  chemically synthesized
ttctatagaatatgacattttt

SEQ ID NO: 1154672 - DNA, 22 bp, Artificial Sequence
  chemically synthesized
cttttctatagaatatgacatt

SEQ ID NO: 1154673 - DNA, 22 bp, Artificial Sequence
  chemically synthesized
acatttaaaaaatgtcatattc

SEQ ID NO: 1154674 - DNA, 22 bp, Artificial Sequence
  chemically synthesized
aaaaaatgtcatattctataga

SEQ ID NO: 1154675 - DNA, 22 bp, Artificial Sequence
  chemically synthesized
aagcattgcttttctatagaat

SEQ ID NO: 1154676 - DNA, 22 bp, Artificial Sequence
  chemically synthesized
aaaaatgtcatattctatagaa

SEQ ID NO: 1154677 - DNA, 22 bp, Artificial Sequence
  chemically synthesized
tatagaaaagcaatgcttcaga

SEQ ID NO: 1154678 - DNA, 22 bp, Artificial Sequence
  chemically synthesized
tagaaaagcaatgcttcagact

SEQ ID NO: 1154679 - DNA, 22 bp, Artificial Sequence
  chemically synthesized
atgataaatgagagtctgaagc

SEQ ID NO: 1154680 - DNA, 22 bp, Artificial Sequence
  chemically synthesized
gatgataaatgagagtctgaag

SEQ ID NO: 1154681 - DNA, 22 bp, Artificial Sequence
  chemically synthesized
gccaagcttgatgataaatgag

SEQ ID NO: 1154682 - DNA, 22 bp, Artificial Sequence
  chemically synthesized
cagactctcatttatcatcaag

SEQ ID NO: 1154683 - DNA, 22 bp, Artificial Sequence
  chemically synthesized
aagctggccaagcttgatgata

SEQ ID NO: 1154684 - DNA, 22 bp, Artificial Sequence
  chemically synthesized
agactctcatttatcatcaagc

SEQ ID NO: 1154685 - DNA, 22 bp, Artificial Sequence
  chemically synthesized
tcatttatcatcaagcttggcc

SEQ ID NO: 1154686 - DNA, 22 bp, Artificial Sequence
  chemically synthesized
atttatcatcaagcttggccag

SEQ ID NO: 1154687 - DNA, 22 bp, Artificial Sequence
  chemically synthesized
tagtaaattgaagctggccaag

SEQ ID NO: 1154688 - DNA, 22 bp, Artificial Sequence
  chemically synthesized
atagtaaattgaagctggccaa

SEQ ID NO: 1154689 - DNA, 22 bp, Artificial Sequence
  chemically synthesized
atcatcaagcttggccagcttc

SEQ ID NO: 1154690 - DNA, 22 bp, Artificial Sequence
  chemically synthesized
tcatcaagcttggccagcttca

SEQ ID NO: 1154691 - DNA, 22 bp, Artificial Sequence
  chemically synthesized
aatttatagtaaattgaagctg

SEQ ID NO: 1154692 - DNA, 22 bp, Artificial Sequence
  chemically synthesized
cattcaatttatagtaaattga

SEQ ID NO: 1154693 - DNA, 22 bp, Artificial Sequence
  chemically synthesized
acattcaatttatagtaaattg

SEQ ID NO: 1154694 - DNA, 22 bp, Artificial Sequence
  chemically synthesized
tacattcaatttatagtaaatt

SEQ ID NO: 1154695 - DNA, 22 bp, Artificial Sequence
  chemically synthesized
ggccagcttcaatttactataa

SEQ ID NO: 1154696 - DNA, 22 bp, Artificial Sequence
  chemically synthesized
gccagcttcaatttactataaa

SEQ ID NO: 1154697 - DNA, 22 bp, Artificial Sequence
  chemically synthesized
atgtaattttacattcaattta

SEQ ID NO: 1154698 - DNA, 22 bp, Artificial Sequence
  chemically synthesized
aatgtaattttacattcaattt

SEQ ID NO: 1154699 - DNA, 22 bp, Artificial Sequence
  chemically synthesized
caatttactataaattgaatgt

SEQ ID NO: 1154700 - DNA, 22 bp, Artificial Sequence
  chemically synthesized
taatgtaattttacattcaatt

SEQ ID NO: 1154701 - DNA, 22 bp, Artificial Sequence
  chemically synthesized
aatttactataaattgaatgta

SEQ ID NO: 1154702 - DNA, 22 bp, Artificial Sequence
  chemically synthesized
ttaatgtaattttacattcaat

SEQ ID NO: 1154703 - DNA, 22 bp, Artificial Sequence
  chemically synthesized
tttaatgtaattttacattcaa

SEQ ID NO: 1154704 - DNA, 22 bp, Artificial Sequence
  chemically synthesized
ttttaatgtaattttacattca

SEQ ID NO: 1154705 - DNA, 22 bp, Artificial Sequence
  chemically synthesized
tttttaatgtaattttacattc

SEQ ID NO: 1154706 - DNA, 22 bp, Artificial Sequence
  chemically synthesized
actataaattgaatgtaaaatt

SEQ ID NO: 1154707 - DNA, 22 bp, Artificial Sequence
  chemically synthesized
ctataaattgaatgtaaaatta

SEQ ID NO: 1154708 - DNA, 22 bp, Artificial Sequence
  chemically synthesized
taaattgaatgtaaaattacat

SEQ ID NO: 1154709 - DNA, 22 bp, Artificial Sequence
  chemically synthesized
cgattttttttaatgtaatttt

SEQ ID NO: 1154710 - DNA, 22 bp, Artificial Sequence
  chemically synthesized
aatgtaaaattacattaaaaaa

SEQ ID NO: 1154711 - DNA, 22 bp, Artificial Sequence
  chemically synthesized
aataataaggctacgatttttt

SEQ ID NO: 1154712 - DNA, 22 bp, Artificial Sequence
  chemically synthesized
aaataataaggctacgattttt

SEQ ID NO: 1154713 - DNA, 22 bp, Artificial Sequence
  chemically synthesized
cattaaaaaaaatcgtagcctt

SEQ ID NO: 1154714 - DNA, 22 bp, Artificial Sequence
  chemically synthesized
aaaaaaatcgtagccttattat

SEQ ID NO: 1154715 - DNA, 22 bp, Artificial Sequence
  chemically synthesized
taatgcaaatttaaataataag

SEQ ID NO: 1154716 - DNA, 22 bp, Artificial Sequence
  chemically synthesized
gtaatgcaaatttaaataataa

SEQ ID NO: 1154717 - DNA, 22 bp, Artificial Sequence
  chemically synthesized
cttgtaatgcaaatttaaataa

SEQ ID NO: 1154718 - DNA, 22 bp, Artificial Sequence
  chemically synthesized
atagggattacttgtaatgcaa

SEQ ID NO: 1154719 - DNA, 22 bp, Artificial Sequence
  chemically synthesized
attatttaaatttgcattacaa

SEQ ID NO: 1154720 - DNA, 22 bp, Artificial Sequence
  chemically synthesized
catagggattacttgtaatgca

SEQ ID NO: 1154721 - DNA, 22 bp, Artificial Sequence
  chemically synthesized
ttatttaaatttgcattacaag

SEQ ID NO: 1154722 - DNA, 22 bp, Artificial Sequence
  chemically synthesized
tttaaatttgcattacaagtaa

SEQ ID NO: 1154723 - DNA, 22 bp, Artificial Sequence
  chemically synthesized
aaatttgcattacaagtaatcc

SEQ ID NO: 1154724 - DNA, 22 bp, Artificial Sequence
  chemically synthesized
aatttgcattacaagtaatccc

SEQ ID NO: 1154725 - DNA, 22 bp, Artificial Sequence
  chemically synthesized
gaagacagacttcatagggatt

SEQ ID NO: 1154726 - DNA, 22 bp, Artificial Sequence
  chemically synthesized
gcattacaagtaatccctatga

SEQ ID NO: 1154727 - DNA, 22 bp, Artificial Sequence
  chemically synthesized
cattacaagtaatccctatgaa

SEQ ID NO: 1154728 - DNA, 22 bp, Artificial Sequence
  chemically synthesized
ctggaagacagacttcataggg

SEQ ID NO: 1154729 - DNA, 22 bp, Artificial Sequence
  chemically synthesized
cctggaagacagacttcatagg

SEQ ID NO: 1154730 - DNA, 22 bp, Artificial Sequence
  chemically synthesized
tcctggaagacagacttcatag

SEQ ID NO: 1154731 - DNA, 22 bp, Artificial Sequence
  chemically synthesized
caagtaatccctatgaagtctg

SEQ ID NO: 1154732 - DNA, 22 bp, Artificial Sequence
  chemically synthesized
ctttcctggaagacagacttca

SEQ ID NO: 1154733 - DNA, 22 bp, Artificial Sequence
  chemically synthesized
gctttcctggaagacagacttc

SEQ ID NO: 1154734 - DNA, 22 bp, Artificial Sequence
  chemically synthesized
aaaatttgctttcctggaagac

SEQ ID NO: 1154735 - DNA, 22 bp, Artificial Sequence
  chemically synthesized
ttaaaaatttgctttcctggaa

SEQ ID NO: 1154736 - DNA, 22 bp, Artificial Sequence
  chemically synthesized
tgaagtctgtcttccaggaaag

SEQ ID NO: 1154737 - DNA, 22 bp, Artificial Sequence
  chemically synthesized
attaaaaatttgctttcctgga

SEQ ID NO: 1154738 - DNA, 22 bp, Artificial Sequence
  chemically synthesized
tcttccaggaaagcaaattttt

SEQ ID NO: 1154739 - DNA, 22 bp, Artificial Sequence
  chemically synthesized
ccaggaaagcaaatttttaata

SEQ ID NO: 1154740 - DNA, 22 bp, Artificial Sequence
  chemically synthesized
caggaaagcaaatttttaataa

SEQ ID NO: 1154741 - DNA, 22 bp, Artificial Sequence
  chemically synthesized
ttaataaatcacataccctgcg

SEQ ID NO: 1154742 - DNA, 22 bp, Artificial Sequence
  chemically synthesized
taataaatcacataccctgcgt

SEQ ID NO: 1154743 - DNA, 22 bp, Artificial Sequence
  chemically synthesized
tggatgagaacaacgcagggta

SEQ ID NO: 1154744 - DNA, 22 bp, Artificial Sequence
  chemically synthesized
aataaatcacataccctgcgtt

SEQ ID NO: 1154745 - DNA, 22 bp, Artificial Sequence
  chemically synthesized
gtggatgagaacaacgcagggt

SEQ ID NO: 1154746 - DNA, 22 bp, Artificial Sequence
  chemically synthesized
ataaatcacataccctgcgttg

SEQ ID NO: 1154747 - DNA, 22 bp, Artificial Sequence
  chemically synthesized
cgttgttctcatccacaaatat

SEQ ID NO: 1154748 - DNA, 22 bp, Artificial Sequence
  chemically synthesized
gaaaagaaatcaaacatatttg

SEQ ID NO: 1154749 - DNA, 22 bp, Artificial Sequence
  chemically synthesized
ggaaaagaaatcaaacatattt

SEQ ID NO: 1154750 - DNA, 22 bp, Artificial Sequence
  chemically synthesized
ttctcatccacaaatatgtttg

SEQ ID NO: 1154751 - DNA, 22 bp, Artificial Sequence
  chemically synthesized
tcatccacaaatatgtttgatt

SEQ ID NO: 1154752 - DNA, 22 bp, Artificial Sequence
  chemically synthesized
atccacaaatatgtttgatttc

SEQ ID NO: 1154753 - DNA, 22 bp, Artificial Sequence
  chemically synthesized
gtatttggaaaagaaatcaaac

SEQ ID NO: 1154754 - DNA, 22 bp, Artificial Sequence
  chemically synthesized
cgtatttggaaaagaaatcaaa

SEQ ID NO: 1154755 - DNA, 22 bp, Artificial Sequence
  chemically synthesized
tcgtatttggaaaagaaatcaa

SEQ ID NO: 1154756 - DNA, 22 bp, Artificial Sequence
  chemically synthesized
ttcgtatttggaaaagaaatca

SEQ ID NO: 1154757 - DNA, 22 bp, Artificial Sequence
  chemically synthesized
ggcttttcgtatttggaaaaga

SEQ ID NO: 1154758 - DNA, 22 bp, Artificial Sequence
  chemically synthesized
gatttcttttccaaatacgaaa

SEQ ID NO: 1154759 - DNA, 22 bp, Artificial Sequence
  chemically synthesized
atttcttttccaaatacgaaaa

SEQ ID NO: 1154760 - DNA, 22 bp, Artificial Sequence
  chemically synthesized
cttttccaaatacgaaaagcct

SEQ ID NO: 1154761 - DNA, 22 bp, Artificial Sequence
  chemically synthesized
ttttccaaatacgaaaagccta

SEQ ID NO: 1154762 - DNA, 22 bp, Artificial Sequence
  chemically synthesized
ttccaaatacgaaaagcctagc

SEQ ID NO: 1154763 - DNA, 22 bp, Artificial Sequence
  chemically synthesized
tccaaatacgaaaagcctagct

SEQ ID NO: 1154764 - DNA, 22 bp, Artificial Sequence
  chemically synthesized
ccaaatacgaaaagcctagcta

SEQ ID NO: 1154765 - DNA, 22 bp, Artificial Sequence
  chemically synthesized
aaaaatacagcatagctaggct

SEQ ID NO: 1154766 - DNA, 22 bp, Artificial Sequence
  chemically synthesized
caaatacgaaaagcctagctat

SEQ ID NO: 1154767 - DNA, 22 bp, Artificial Sequence
  chemically synthesized
aaaaaatacagcatagctaggc

SEQ ID NO: 1154768 - DNA, 22 bp, Artificial Sequence
  chemically synthesized
taaaaaatacagcatagctagg

SEQ ID NO: 1154769 - DNA, 22 bp, Artificial Sequence
  chemically synthesized
ttaaaaaatacagcatagctag

SEQ ID NO: 1154770 - DNA, 22 bp, Artificial Sequence
  chemically synthesized
tttaaaaaatacagcatagcta

SEQ ID NO: 1154771 - DNA, 22 bp, Artificial Sequence
  chemically synthesized
ttttaaaaaatacagcatagct

SEQ ID NO: 1154772 - DNA, 22 bp, Artificial Sequence
  chemically synthesized
tttttttaaaaaatacagcata

SEQ ID NO: 1154773 - DNA, 22 bp, Artificial Sequence
  chemically synthesized
ttgtttttttaaaaaatacagc

SEQ ID NO: 1154774 - DNA, 22 bp, Artificial Sequence
  chemically synthesized
ttgttgtttttttaaaaaatac

SEQ ID NO: 1154775 - DNA, 22 bp, Artificial Sequence
  chemically synthesized
gttgttgtttttttaaaaaata

SEQ ID NO: 1154776 - DNA, 22 bp, Artificial Sequence
  chemically synthesized
gctatgctgtattttttaaaaa

SEQ ID NO: 1154777 - DNA, 22 bp, Artificial Sequence
  chemically synthesized
tgctgtattttttaaaaaaaca

SEQ ID NO: 1154778 - DNA, 22 bp, Artificial Sequence
  chemically synthesized
agacatttgttgttgttttttt

SEQ ID NO: 1154779 - DNA, 22 bp, Artificial Sequence
  chemically synthesized
tattttttaaaaaaacaacaac

SEQ ID NO: 1154780 - DNA, 22 bp, Artificial Sequence
  chemically synthesized
tttaaaaaaacaacaacaaatg

SEQ ID NO: 1154781 - DNA, 22 bp, Artificial Sequence
  chemically synthesized
ttaaaaaaacaacaacaaatgt

SEQ ID NO: 1154782 - DNA, 22 bp, Artificial Sequence
  chemically synthesized
taaaaaaacaacaacaaatgtc

SEQ ID NO: 1154783 - DNA, 22 bp, Artificial Sequence
  chemically synthesized
aaaaaaacaacaacaaatgtct

SEQ ID NO: 1154784 - DNA, 22 bp, Artificial Sequence
  chemically synthesized
aaaaaacaacaacaaatgtctt

SEQ ID NO: 1154785 - DNA, 22 bp, Artificial Sequence
  chemically synthesized
cagcagcacaaaatggattaag

SEQ ID NO: 1154786 - DNA, 22 bp, Artificial Sequence
  chemically synthesized
ttacagcagcacaaaatggatt

SEQ ID NO: 1154787 - DNA, 22 bp, Artificial Sequence
  chemically synthesized
gttacagcagcacaaaatggat

SEQ ID NO: 1154788 - DNA, 22 bp, Artificial Sequence
  chemically synthesized
tgttacagcagcacaaaatgga

SEQ ID NO: 1154789 - DNA, 22 bp, Artificial Sequence
  chemically synthesized
ttgttacagcagcacaaaatgg

SEQ ID NO: 1154790 - DNA, 22 bp, Artificial Sequence
  chemically synthesized
tttttgttacagcagcacaaaa

SEQ ID NO: 1154791 - DNA, 22 bp, Artificial Sequence
  chemically synthesized
agttatttttgttacagcagca

SEQ ID NO: 1154792 - DNA, 22 bp, Artificial Sequence
  chemically synthesized
aatccattttgtgctgctgtaa

SEQ ID NO: 1154793 - DNA, 22 bp, Artificial Sequence
  chemically synthesized
atccattttgtgctgctgtaac

SEQ ID NO: 1154794 - DNA, 22 bp, Artificial Sequence
  chemically synthesized
tcagttatttttgttacagcag

SEQ ID NO: 1154795 - DNA, 22 bp, Artificial Sequence
  chemically synthesized
attctcagttatttttgttaca

SEQ ID NO: 1154796 - DNA, 22 bp, Artificial Sequence
  chemically synthesized
tgtgctgctgtaacaaaaataa

SEQ ID NO: 1154797 - DNA, 22 bp, Artificial Sequence
  chemically synthesized
cctcattctcagttatttttgt

SEQ ID NO: 1154798 - DNA, 22 bp, Artificial Sequence
  chemically synthesized
gtgctgctgtaacaaaaataac

SEQ ID NO: 1154799 - DNA, 22 bp, Artificial Sequence
  chemically synthesized
tgctgctgtaacaaaaataact

SEQ ID NO: 1154800 - DNA, 22 bp, Artificial Sequence
  chemically synthesized
aattacctcattctcagttatt

SEQ ID NO: 1154801 - DNA, 22 bp, Artificial Sequence
  chemically synthesized
ctgtaacaaaaataactgagaa

SEQ ID NO: 1154802 - DNA, 22 bp, Artificial Sequence
  chemically synthesized
ctaaattacctcattctcagtt

SEQ ID NO: 1154803 - DNA, 22 bp, Artificial Sequence
  chemically synthesized
cctaaattacctcattctcagt

SEQ ID NO: 1154804 - DNA, 22 bp, Artificial Sequence
  chemically synthesized
taacaaaaataactgagaatga

SEQ ID NO: 1154805 - DNA, 22 bp, Artificial Sequence
  chemically synthesized
ttcctaaattacctcattctca

SEQ ID NO: 1154806 - DNA, 22 bp, Artificial Sequence
  chemically synthesized
agaatgaggtaatttaggaaga

SEQ ID NO: 1154807 - DNA, 22 bp, Artificial Sequence
  chemically synthesized
tgaaaaaataaaggtacattct

SEQ ID NO: 1154808 - DNA, 22 bp, Artificial Sequence
  chemically synthesized
aggaagaatgtacctttatttt

SEQ ID NO: 1154809 - DNA, 22 bp, Artificial Sequence
  chemically synthesized
gagaactgtgaaaaaataaagg

SEQ ID NO: 1154810 - DNA, 22 bp, Artificial Sequence
  chemically synthesized
ggaagaatgtacctttattttt

SEQ ID NO: 1154811 - DNA, 22 bp, Artificial Sequence
  chemically synthesized
ccaaactcgagaactgtgaaaa

SEQ ID NO: 1154812 - DNA, 22 bp, Artificial Sequence
  chemically synthesized
cccaaactcgagaactgtgaaa

SEQ ID NO: 1154813 - DNA, 22 bp, Artificial Sequence
  chemically synthesized
gatttcccaaactcgagaactg

SEQ ID NO: 1154814 - DNA, 22 bp, Artificial Sequence
  chemically synthesized
ggatttcccaaactcgagaact

SEQ ID NO: 1154815 - DNA, 22 bp, Artificial Sequence
  chemically synthesized
tattttttcacagttctcgagt

SEQ ID NO: 1154816 - DNA, 22 bp, Artificial Sequence
  chemically synthesized
attttttcacagttctcgagtt

SEQ ID NO: 1154817 - DNA, 22 bp, Artificial Sequence
  chemically synthesized
ttttttcacagttctcgagttt

SEQ ID NO: 1154818 - DNA, 22 bp, Artificial Sequence
  chemically synthesized
atcttggatttcccaaactcga

SEQ ID NO: 1154819 - DNA, 22 bp, Artificial Sequence
  chemically synthesized
tttcacagttctcgagtttggg

SEQ ID NO: 1154820 - DNA, 22 bp, Artificial Sequence
  chemically synthesized
gatcttggatttcccaaactcg

SEQ ID NO: 1154821 - DNA, 22 bp, Artificial Sequence
  chemically synthesized
ttcacagttctcgagtttggga

SEQ ID NO: 1154822 - DNA, 22 bp, Artificial Sequence
  chemically synthesized
tcacagttctcgagtttgggaa

SEQ ID NO: 1154823 - DNA, 22 bp, Artificial Sequence
  chemically synthesized
cacagttctcgagtttgggaaa

SEQ ID NO: 1154824 - DNA, 22 bp, Artificial Sequence
  chemically synthesized
acagttctcgagtttgggaaat

SEQ ID NO: 1154825 - DNA, 22 bp, Artificial Sequence
  chemically synthesized
acatcttgatcttggatttccc

SEQ ID NO: 1154826 - DNA, 22 bp, Artificial Sequence
  chemically synthesized
tcgagtttgggaaatccaagat

SEQ ID NO: 1154827 - DNA, 22 bp, Artificial Sequence
  chemically synthesized
gagtttgggaaatccaagatca

SEQ ID NO: 1154828 - DNA, 22 bp, Artificial Sequence
  chemically synthesized
accagatgctaacatcttgatc

SEQ ID NO: 1154829 - DNA, 22 bp, Artificial Sequence
  chemically synthesized
gggaaatccaagatcaagatgt

SEQ ID NO: 1154830 - DNA, 22 bp, Artificial Sequence
  chemically synthesized
ggaaatccaagatcaagatgtt

SEQ ID NO: 1154831 - DNA, 22 bp, Artificial Sequence
  chemically synthesized
tgaaaaggccctcaccagatgc

SEQ ID NO: 1154832 - DNA, 22 bp, Artificial Sequence
  chemically synthesized
tgtgaaaaggccctcaccagat

SEQ ID NO: 1154833 - DNA, 22 bp, Artificial Sequence
  chemically synthesized
gcatctggtgagggccttttca

SEQ ID NO: 1154834 - DNA, 22 bp, Artificial Sequence
  chemically synthesized
gtgagggccttttcacagagtt

SEQ ID NO: 1154835 - DNA, 22 bp, Artificial Sequence
  chemically synthesized
caccatgcaccaccatgtgaaa

SEQ ID NO: 1154836 - DNA, 22 bp, Artificial Sequence
  chemically synthesized
ttcacagagttttcacatggtg

SEQ ID NO: 1154837 - DNA, 22 bp, Artificial Sequence
  chemically synthesized
tcacagagttttcacatggtgg

SEQ ID NO: 1154838 - DNA, 22 bp, Artificial Sequence
  chemically synthesized
cacagagttttcacatggtggt

SEQ ID NO: 1154839 - DNA, 22 bp, Artificial Sequence
  chemically synthesized
acagagttttcacatggtggtg

SEQ ID NO: 1154840 - DNA, 22 bp, Artificial Sequence
  chemically synthesized
accctccaccatgcaccaccat

SEQ ID NO: 1154841 - DNA, 22 bp, Artificial Sequence
  chemically synthesized
gaccctccaccatgcaccacca

SEQ ID NO: 1154842 - DNA, 22 bp, Artificial Sequence
  chemically synthesized
ttgaccctccaccatgcaccac

SEQ ID NO: 1154843 - DNA, 22 bp, Artificial Sequence
  chemically synthesized
tctcttgaccctccaccatgca

SEQ ID NO: 1154844 - DNA, 22 bp, Artificial Sequence
  chemically synthesized
tcacatggtggtgcatggtgga

SEQ ID NO: 1154845 - DNA, 22 bp, Artificial Sequence
  chemically synthesized
cacatggtggtgcatggtggag

SEQ ID NO: 1154846 - DNA, 22 bp, Artificial Sequence
  chemically synthesized
acatggtggtgcatggtggagg

SEQ ID NO: 1154847 - DNA, 22 bp, Artificial Sequence
  chemically synthesized
ctatctcttgaccctccaccat

SEQ ID NO: 1154848 - DNA, 22 bp, Artificial Sequence
  chemically synthesized
tcctatctcttgaccctccacc

SEQ ID NO: 1154849 - DNA, 22 bp, Artificial Sequence
  chemically synthesized
acacagtgttctcctatctctt

SEQ ID NO: 1154850 - DNA, 22 bp, Artificial Sequence
  chemically synthesized
cacacagtgttctcctatctct

SEQ ID NO: 1154851 - DNA, 22 bp, Artificial Sequence
  chemically synthesized
tgtgaagcctcttttatatggg

SEQ ID NO: 1154852 - DNA, 22 bp, Artificial Sequence
  chemically synthesized
agaataggatcaagtcccatat

SEQ ID NO: 1154853 - DNA, 22 bp, Artificial Sequence
  chemically synthesized
aagaataggatcaagtcccata

SEQ ID NO: 1154854 - DNA, 22 bp, Artificial Sequence
  chemically synthesized
ccttaagaataggatcaagtcc

SEQ ID NO: 1154855 - DNA, 22 bp, Artificial Sequence
  chemically synthesized
ttttatatgggacttgatccta

SEQ ID NO: 1154856 - DNA, 22 bp, Artificial Sequence
  chemically synthesized
ctcccttaagaataggatcaag

SEQ ID NO: 1154857 - DNA, 22 bp, Artificial Sequence
  chemically synthesized
ttatatgggacttgatcctatt

SEQ ID NO: 1154858 - DNA, 22 bp, Artificial Sequence
  chemically synthesized
tatatgggacttgatcctattc

SEQ ID NO: 1154859 - DNA, 22 bp, Artificial Sequence
  chemically synthesized
atatgggacttgatcctattct

SEQ ID NO: 1154860 - DNA, 22 bp, Artificial Sequence
  chemically synthesized
tatgggacttgatcctattctt

SEQ ID NO: 1154861 - DNA, 22 bp, Artificial Sequence
  chemically synthesized
gatcctattcttaagggaggag

SEQ ID NO: 1154862 - DNA, 22 bp, Artificial Sequence
  chemically synthesized
atcctattcttaagggaggagc

SEQ ID NO: 1154863 - DNA, 22 bp, Artificial Sequence
  chemically synthesized
ttcttaagggaggagccctgat

SEQ ID NO: 1154864 - DNA, 22 bp, Artificial Sequence
  chemically synthesized
agggtgaataatccatcagggc

SEQ ID NO: 1154865 - DNA, 22 bp, Artificial Sequence
  chemically synthesized
ttaagggaggagccctgatgga

SEQ ID NO: 1154866 - DNA, 22 bp, Artificial Sequence
  chemically synthesized
aagggtgaataatccatcaggg

SEQ ID NO: 1154867 - DNA, 22 bp, Artificial Sequence
  chemically synthesized
aagggaggagccctgatggatt

SEQ ID NO: 1154868 - DNA, 22 bp, Artificial Sequence
  chemically synthesized
agggaggagccctgatggatta

SEQ ID NO: 1154869 - DNA, 22 bp, Artificial Sequence
  chemically synthesized
ggagatggaatatttaagggtg

SEQ ID NO: 1154870 - DNA, 22 bp, Artificial Sequence
  chemically synthesized
atggattattcacccttaaata

SEQ ID NO: 1154871 - DNA, 22 bp, Artificial Sequence
  chemically synthesized
tattaggagatggaatatttaa

SEQ ID NO: 1154872 - DNA, 22 bp, Artificial Sequence
  chemically synthesized
ttcacccttaaatattccatct

SEQ ID NO: 1154873 - DNA, 22 bp, Artificial Sequence
  chemically synthesized
acccttaaatattccatctcct

SEQ ID NO: 1154874 - DNA, 22 bp, Artificial Sequence
  chemically synthesized
aggtgattgtattaggagatgg

SEQ ID NO: 1154875 - DNA, 22 bp, Artificial Sequence
  chemically synthesized
aaatattccatctcctaataca

SEQ ID NO: 1154876 - DNA, 22 bp, Artificial Sequence
  chemically synthesized
aatattccatctcctaatacaa

SEQ ID NO: 1154877 - DNA, 22 bp, Artificial Sequence
  chemically synthesized
caaaattcaggtgattgtatta

SEQ ID NO: 1154878 - DNA, 22 bp, Artificial Sequence
  chemically synthesized
catctcctaatacaatcacctg

SEQ ID NO: 1154879 - DNA, 22 bp, Artificial Sequence
  chemically synthesized
ctaatacaatcacctgaatttt

SEQ ID NO: 1154880 - DNA, 22 bp, Artificial Sequence
  chemically synthesized
aataagtcccctccaaaattca

SEQ ID NO: 1154881 - DNA, 22 bp, Artificial Sequence
  chemically synthesized
atacaatcacctgaattttgga

SEQ ID NO: 1154882 - DNA, 22 bp, Artificial Sequence
  chemically synthesized
gaataagtcccctccaaaattc

SEQ ID NO: 1154883 - DNA, 22 bp, Artificial Sequence
  chemically synthesized
caatggcttgaataagtcccct

SEQ ID NO: 1154884 - DNA, 22 bp, Artificial Sequence
  chemically synthesized
ttgcaatggcttgaataagtcc

SEQ ID NO: 1154885 - DNA, 22 bp, Artificial Sequence
  chemically synthesized
aattttggaggggacttattca

SEQ ID NO: 1154886 - DNA, 22 bp, Artificial Sequence
  chemically synthesized
gttgcaatggcttgaataagtc

SEQ ID NO: 1154887 - DNA, 22 bp, Artificial Sequence
  chemically synthesized
tgttgcaatggcttgaataagt

SEQ ID NO: 1154888 - DNA, 22 bp, Artificial Sequence
  chemically synthesized
tggaggggacttattcaagcca

SEQ ID NO: 1154889 - DNA, 22 bp, Artificial Sequence
  chemically synthesized
ggaggggacttattcaagccat

SEQ ID NO: 1154890 - DNA, 22 bp, Artificial Sequence
  chemically synthesized
gaggggacttattcaagccatt

SEQ ID NO: 1154891 - DNA, 22 bp, Artificial Sequence
  chemically synthesized
caatctttgttgcaatggcttg

SEQ ID NO: 1154892 - DNA, 22 bp, Artificial Sequence
  chemically synthesized
gcaatctttgttgcaatggctt

SEQ ID NO: 1154893 - DNA, 22 bp, Artificial Sequence
  chemically synthesized
tgcaatctttgttgcaatggct

SEQ ID NO: 1154894 - DNA, 22 bp, Artificial Sequence
  chemically synthesized
ttgcaatctttgttgcaatggc

SEQ ID NO: 1154895 - DNA, 22 bp, Artificial Sequence
  chemically synthesized
tttttgcaatctttgttgcaat

SEQ ID NO: 1154896 - DNA, 22 bp, Artificial Sequence
  chemically synthesized
attcaagccattgcaacaaaga

SEQ ID NO: 1154897 - DNA, 22 bp, Artificial Sequence
  chemically synthesized
ttcaagccattgcaacaaagat

SEQ ID NO: 1154898 - DNA, 22 bp, Artificial Sequence
  chemically synthesized
attgtttttgcaatctttgttg

SEQ ID NO: 1154899 - DNA, 22 bp, Artificial Sequence
  chemically synthesized
aagccattgcaacaaagattgc

SEQ ID NO: 1154900 - DNA, 22 bp, Artificial Sequence
  chemically synthesized
cctaattgtttttgcaatcttt

SEQ ID NO: 1154901 - DNA, 22 bp, Artificial Sequence
  chemically synthesized
acctaattgtttttgcaatctt

SEQ ID NO: 1154902 - DNA, 22 bp, Artificial Sequence
  chemically synthesized
tacctaattgtttttgcaatct

SEQ ID NO: 1154903 - DNA, 22 bp, Artificial Sequence
  chemically synthesized
ttacctaattgtttttgcaatc

SEQ ID NO: 1154904 - DNA, 22 bp, Artificial Sequence
  chemically synthesized
tttttacctaattgtttttgca

SEQ ID NO: 1154905 - DNA, 22 bp, Artificial Sequence
  chemically synthesized
caacaaagattgcaaaaacaat

SEQ ID NO: 1154906 - DNA, 22 bp, Artificial Sequence
  chemically synthesized
aaaattatttttacctaattgt

SEQ ID NO: 1154907 - DNA, 22 bp, Artificial Sequence
  chemically synthesized
aaaaattatttttacctaattg

SEQ ID NO: 1154908 - DNA, 22 bp, Artificial Sequence
  chemically synthesized
taaaaattatttttacctaatt

SEQ ID NO: 1154909 - DNA, 22 bp, Artificial Sequence
  chemically synthesized
caaaaacaattaggtaaaaata

SEQ ID NO: 1154910 - DNA, 22 bp, Artificial Sequence
  chemically synthesized
aagtcagccatattttaaaaat

SEQ ID NO: 1154911 - DNA, 22 bp, Artificial Sequence
  chemically synthesized
aaagtcagccatattttaaaaa

SEQ ID NO: 1154912 - DNA, 22 bp, Artificial Sequence
  chemically synthesized
ggtaaaaataatttttaaaata

SEQ ID NO: 1154913 - DNA, 22 bp, Artificial Sequence
  chemically synthesized
aaacttaaagtcagccatattt

SEQ ID NO: 1154914 - DNA, 22 bp, Artificial Sequence
  chemically synthesized
ttaaaatatggctgactttaag

SEQ ID NO: 1154915 - DNA, 22 bp, Artificial Sequence
  chemically synthesized
taaaatatggctgactttaagt

SEQ ID NO: 1154916 - DNA, 22 bp, Artificial Sequence
  chemically synthesized
aaaatatggctgactttaagtt

SEQ ID NO: 1154917 - DNA, 22 bp, Artificial Sequence
  chemically synthesized
aaatatggctgactttaagttt

SEQ ID NO: 1154918 - DNA, 22 bp, Artificial Sequence
  chemically synthesized
atgggagagaattaaaacttaa

SEQ ID NO: 1154919 - DNA, 22 bp, Artificial Sequence
  chemically synthesized
actttaagttttaattctctcc

SEQ ID NO: 1154920 - DNA, 22 bp, Artificial Sequence
  chemically synthesized
taagttttaattctctcccatc

SEQ ID NO: 1154921 - DNA, 22 bp, Artificial Sequence
  chemically synthesized
aagttttaattctctcccatca

SEQ ID NO: 1154922 - DNA, 22 bp, Artificial Sequence
  chemically synthesized
agttttaattctctcccatcaa

SEQ ID NO: 1154923 - DNA, 22 bp, Artificial Sequence
  chemically synthesized
taattctctcccatcaaccatg

SEQ ID NO: 1154924 - DNA, 22 bp, Artificial Sequence
  chemically synthesized
aattctctcccatcaaccatgt

SEQ ID NO: 1154925 - DNA, 22 bp, Artificial Sequence
  chemically synthesized
attctctcccatcaaccatgtc

SEQ ID NO: 1154926 - DNA, 22 bp, Artificial Sequence
  chemically synthesized
tctcccatcaaccatgtcatct

SEQ ID NO: 1154927 - DNA, 22 bp, Artificial Sequence
  chemically synthesized
tacacagtaacacagatgacat

SEQ ID NO: 1154928 - DNA, 22 bp, Artificial Sequence
  chemically synthesized
tcccatcaaccatgtcatctgt

SEQ ID NO: 1154929 - DNA, 22 bp, Artificial Sequence
  chemically synthesized
ccatcaaccatgtcatctgtgt

SEQ ID NO: 1154930 - DNA, 22 bp, Artificial Sequence
  chemically synthesized
tgtatagtacctatacacagta

SEQ ID NO: 1154931 - DNA, 22 bp, Artificial Sequence
  chemically synthesized
tgtgtatagtacctatacacag

SEQ ID NO: 1154932 - DNA, 22 bp, Artificial Sequence
  chemically synthesized
tgttactgtgtataggtactat

SEQ ID NO: 1154933 - DNA, 22 bp, Artificial Sequence
  chemically synthesized
ctgtgtataggtactatacaca

SEQ ID NO: 1154934 - DNA, 22 bp, Artificial Sequence
  chemically synthesized
gaaagcaaactctgtgtatagt

SEQ ID NO: 1154935 - DNA, 22 bp, Artificial Sequence
  chemically synthesized
tgtataggtactatacacagag

SEQ ID NO: 1154936 - DNA, 22 bp, Artificial Sequence
  chemically synthesized
ctagaaagcaaactctgtgtat

SEQ ID NO: 1154937 - DNA, 22 bp, Artificial Sequence
  chemically synthesized
tactagaaagcaaactctgtgt

SEQ ID NO: 1154938 - DNA, 22 bp, Artificial Sequence
  chemically synthesized
ctactagaaagcaaactctgtg

SEQ ID NO: 1154939 - DNA, 22 bp, Artificial Sequence
  chemically synthesized
tctactagaaagcaaactctgt

SEQ ID NO: 1154940 - DNA, 22 bp, Artificial Sequence
  chemically synthesized
cgtgctttctactagaaagcaa

SEQ ID NO: 1154941 - DNA, 22 bp, Artificial Sequence
  chemically synthesized
tacacagagtttgctttctagt

SEQ ID NO: 1154942 - DNA, 22 bp, Artificial Sequence
  chemically synthesized
tgttgcgtgctttctactagaa

SEQ ID NO: 1154943 - DNA, 22 bp, Artificial Sequence
  chemically synthesized
atgttgcgtgctttctactaga

SEQ ID NO: 1154944 - DNA, 22 bp, Artificial Sequence
  chemically synthesized
gctttctagtagaaagcacgca

SEQ ID NO: 1154945 - DNA, 22 bp, Artificial Sequence
  chemically synthesized
ctttctagtagaaagcacgcaa

SEQ ID NO: 1154946 - DNA, 22 bp, Artificial Sequence
  chemically synthesized
tctagtagaaagcacgcaacat

SEQ ID NO: 1154947 - DNA, 22 bp, Artificial Sequence
  chemically synthesized
ctagtagaaagcacgcaacata

SEQ ID NO: 1154948 - DNA, 22 bp, Artificial Sequence
  chemically synthesized
tagtagaaagcacgcaacataa

SEQ ID NO: 1154949 - DNA, 22 bp, Artificial Sequence
  chemically synthesized
gtagaaagcacgcaacataaga

SEQ ID NO: 1154950 - DNA, 22 bp, Artificial Sequence
  chemically synthesized
aaacgccaagtacaacaacata

SEQ ID NO: 1154951 - DNA, 22 bp, Artificial Sequence
  chemically synthesized
aagacctaaaacgccaagtaca

SEQ ID NO: 1154952 - DNA, 22 bp, Artificial Sequence
  chemically synthesized
ccttatgttgttgtacttggcg

SEQ ID NO: 1154953 - DNA, 22 bp, Artificial Sequence
  chemically synthesized
gaagacctaaaacgccaagtac

SEQ ID NO: 1154954 - DNA, 22 bp, Artificial Sequence
  chemically synthesized
atgttgttgtacttggcgtttt

SEQ ID NO: 1154955 - DNA, 22 bp, Artificial Sequence
  chemically synthesized
tgttgttgtacttggcgtttta

SEQ ID NO: 1154956 - DNA, 22 bp, Artificial Sequence
  chemically synthesized
atcttgaagacctaaaacgcca

SEQ ID NO: 1154957 - DNA, 22 bp, Artificial Sequence
  chemically synthesized
ttgtacttggcgttttaggtct

SEQ ID NO: 1154958 - DNA, 22 bp, Artificial Sequence
  chemically synthesized
gacctgatcttgaagacctaaa

SEQ ID NO: 1154959 - DNA, 22 bp, Artificial Sequence
  chemically synthesized
ggacctgatcttgaagacctaa

SEQ ID NO: 1154960 - DNA, 22 bp, Artificial Sequence
  chemically synthesized
tacttggcgttttaggtcttca

SEQ ID NO: 1154961 - DNA, 22 bp, Artificial Sequence
  chemically synthesized
ttggacctgatcttgaagacct

SEQ ID NO: 1154962 - DNA, 22 bp, Artificial Sequence
  chemically synthesized
ggcgttttaggtcttcaagatc

SEQ ID NO: 1154963 - DNA, 22 bp, Artificial Sequence
  chemically synthesized
gcgttttaggtcttcaagatca

SEQ ID NO: 1154964 - DNA, 22 bp, Artificial Sequence
  chemically synthesized
taggtcttcaagatcaggtcca

SEQ ID NO: 1154965 - DNA, 22 bp, Artificial Sequence
  chemically synthesized
aggtcttcaagatcaggtccaa

SEQ ID NO: 1154966 - DNA, 22 bp, Artificial Sequence
  chemically synthesized
ggtcttcaagatcaggtccaag

SEQ ID NO: 1154967 - DNA, 22 bp, Artificial Sequence
  chemically synthesized
caagatcaggtccaagaggctc

SEQ ID NO: 1154968 - DNA, 22 bp, Artificial Sequence
  chemically synthesized
aagatcaggtccaagaggctct

SEQ ID NO: 1154969 - DNA, 22 bp, Artificial Sequence
  chemically synthesized
ttcctccattttccttgttctt

SEQ ID NO: 1154970 - DNA, 22 bp, Artificial Sequence
  chemically synthesized
cctccattttccttgttctttc

SEQ ID NO: 1154971 - DNA, 22 bp, Artificial Sequence
  chemically synthesized
acaaaaacagaagaaagaacaa

SEQ ID NO: 1154972 - DNA, 22 bp, Artificial Sequence
  chemically synthesized
ctccattttccttgttctttct

SEQ ID NO: 1154973 - DNA, 22 bp, Artificial Sequence
  chemically synthesized
cattttccttgttctttcttct

SEQ ID NO: 1154974 - DNA, 22 bp, Artificial Sequence
  chemically synthesized
gctaacaaaaacagaagaaaga

SEQ ID NO: 1154975 - DNA, 22 bp, Artificial Sequence
  chemically synthesized
tccttgttctttcttctgtttt

SEQ ID NO: 1154976 - DNA, 22 bp, Artificial Sequence
  chemically synthesized
ccttgttctttcttctgttttt

SEQ ID NO: 1154977 - DNA, 22 bp, Artificial Sequence
  chemically synthesized
cttgttctttcttctgtttttg

SEQ ID NO: 1154978 - DNA, 22 bp, Artificial Sequence
  chemically synthesized
aatgactggctaacaaaaacag

SEQ ID NO: 1154979 - DNA, 22 bp, Artificial Sequence
  chemically synthesized
gttctttcttctgtttttgtta

SEQ ID NO: 1154980 - DNA, 22 bp, Artificial Sequence
  chemically synthesized
ttctttcttctgtttttgttag

SEQ ID NO: 1154981 - DNA, 22 bp, Artificial Sequence
  chemically synthesized
tttcttctgtttttgttagcca

SEQ ID NO: 1154982 - DNA, 22 bp, Artificial Sequence
  chemically synthesized
tcttctgtttttgttagccagt

SEQ ID NO: 1154983 - DNA, 22 bp, Artificial Sequence
  chemically synthesized
cttctgtttttgttagccagtc

SEQ ID NO: 1154984 - DNA, 22 bp, Artificial Sequence
  chemically synthesized
aaagagttgaatgactggctaa

SEQ ID NO: 1154985 - DNA, 22 bp, Artificial Sequence
  chemically synthesized
ttctgtttttgttagccagtca

SEQ ID NO: 1154986 - DNA, 22 bp, Artificial Sequence
  chemically synthesized
ctgtttttgttagccagtcatt

SEQ ID NO: 1154987 - DNA, 22 bp, Artificial Sequence
  chemically synthesized
tgtttttgttagccagtcattc

SEQ ID NO: 1154988 - DNA, 22 bp, Artificial Sequence
  chemically synthesized
tttttgttagccagtcattcaa

SEQ ID NO: 1154989 - DNA, 22 bp, Artificial Sequence
  chemically synthesized
ttgttagccagtcattcaactc

SEQ ID NO: 1154990 - DNA, 22 bp, Artificial Sequence
  chemically synthesized
tgttagccagtcattcaactct

SEQ ID NO: 1154991 - DNA, 22 bp, Artificial Sequence
  chemically synthesized
gttagccagtcattcaactctt

SEQ ID NO: 1154992 - DNA, 22 bp, Artificial Sequence
  chemically synthesized
ttagccagtcattcaactcttt

SEQ ID NO: 1154993 - DNA, 22 bp, Artificial Sequence
  chemically synthesized
gccagtcattcaactctttcag

SEQ ID NO: 1154994 - DNA, 22 bp, Artificial Sequence
  chemically synthesized
cagaatcagaaactgaaagagt

SEQ ID NO: 1154995 - DNA, 22 bp, Artificial Sequence
  chemically synthesized
atggatctccagaatcagaaac

SEQ ID NO: 1154996 - DNA, 22 bp, Artificial Sequence
  chemically synthesized
aatggatctccagaatcagaaa

SEQ ID NO: 1154997 - DNA, 22 bp, Artificial Sequence
  chemically synthesized
aactctttcagtttctgattct

SEQ ID NO: 1154998 - DNA, 22 bp, Artificial Sequence
  chemically synthesized
taatggatctccagaatcagaa

SEQ ID NO: 1154999 - DNA, 22 bp, Artificial Sequence
  chemically synthesized
tttcagtttctgattctggaga

SEQ ID NO: 1155000 - DNA, 22 bp, Artificial Sequence
  chemically synthesized
tcagtttctgattctggagatc

SEQ ID NO: 1155001 - DNA, 22 bp, Artificial Sequence
  chemically synthesized
cagtttctgattctggagatcc

SEQ ID NO: 1155002 - DNA, 22 bp, Artificial Sequence
  chemically synthesized
agtttctgattctggagatcca

SEQ ID NO: 1155003 - DNA, 22 bp, Artificial Sequence
  chemically synthesized
catagagttttaatggatctcc

SEQ ID NO: 1155004 - DNA, 22 bp, Artificial Sequence
  chemically synthesized
acatagagttttaatggatctc

SEQ ID NO: 1155005 - DNA, 22 bp, Artificial Sequence
  chemically synthesized
ctgattctggagatccattaaa

SEQ ID NO: 1155006 - DNA, 22 bp, Artificial Sequence
  chemically synthesized
tgattctggagatccattaaaa

SEQ ID NO: 1155007 - DNA, 22 bp, Artificial Sequence
  chemically synthesized
agtttacatagagttttaatgg

SEQ ID NO: 1155008 - DNA, 22 bp, Artificial Sequence
  chemically synthesized
attctggagatccattaaaact

SEQ ID NO: 1155009 - DNA, 22 bp, Artificial Sequence
  chemically synthesized
cagtttacatagagttttaatg

SEQ ID NO: 1155010 - DNA, 22 bp, Artificial Sequence
  chemically synthesized
tcagtttacatagagttttaat

SEQ ID NO: 1155011 - DNA, 22 bp, Artificial Sequence
  chemically synthesized
tggagatccattaaaactctat

SEQ ID NO: 1155012 - DNA, 22 bp, Artificial Sequence
  chemically synthesized
gagatccattaaaactctatgt

SEQ ID NO: 1155013 - DNA, 22 bp, Artificial Sequence
  chemically synthesized
aaattttcagtttacatagagt

SEQ ID NO: 1155014 - DNA, 22 bp, Artificial Sequence
  chemically synthesized
caaattttcagtttacatagag

SEQ ID NO: 1155015 - DNA, 22 bp, Artificial Sequence
  chemically synthesized
tcaaattttcagtttacataga

SEQ ID NO: 1155016 - DNA, 22 bp, Artificial Sequence
  chemically synthesized
tttcaaattttcagtttacata

SEQ ID NO: 1155017 - DNA, 22 bp, Artificial Sequence
  chemically synthesized
ctttcaaattttcagtttacat

SEQ ID NO: 1155018 - DNA, 22 bp, Artificial Sequence
  chemically synthesized
aaactctatgtaaactgaaaat

SEQ ID NO: 1155019 - DNA, 22 bp, Artificial Sequence
  chemically synthesized
tatgtaaactgaaaatttgaaa

SEQ ID NO: 1155020 - DNA, 22 bp, Artificial Sequence
  chemically synthesized
tgtaaactgaaaatttgaaaga

SEQ ID NO: 1155021 - DNA, 22 bp, Artificial Sequence
  chemically synthesized
aaagaggtcataataggcttct

SEQ ID NO: 1155022 - DNA, 22 bp, Artificial Sequence
  chemically synthesized
caaagaggtcataataggcttc

SEQ ID NO: 1155023 - DNA, 22 bp, Artificial Sequence
  chemically synthesized
aaaatttgaaagaagcctatta

SEQ ID NO: 1155024 - DNA, 22 bp, Artificial Sequence
  chemically synthesized
tcaaagaggtcataataggctt

SEQ ID NO: 1155025 - DNA, 22 bp, Artificial Sequence
  chemically synthesized
ctttcaaagaggtcataatagg

SEQ ID NO: 1155026 - DNA, 22 bp, Artificial Sequence
  chemically synthesized
gaaagaagcctattatgacctc

SEQ ID NO: 1155027 - DNA, 22 bp, Artificial Sequence
  chemically synthesized
aaagaagcctattatgacctct

SEQ ID NO: 1155028 - DNA, 22 bp, Artificial Sequence
  chemically synthesized
agtaataagttgctttcaaaga

SEQ ID NO: 1155029 - DNA, 22 bp, Artificial Sequence
  chemically synthesized
ttatgacctctttgaaagcaac

SEQ ID NO: 1155030 - DNA, 22 bp, Artificial Sequence
  chemically synthesized
tgacctctttgaaagcaactta

SEQ ID NO: 1155031 - DNA, 22 bp, Artificial Sequence
  chemically synthesized
tgatgttcagtaataagttgct

SEQ ID NO: 1155032 - DNA, 22 bp, Artificial Sequence
  chemically synthesized
cattgtgatgttcagtaataag

SEQ ID NO: 1155033 - DNA, 22 bp, Artificial Sequence
  chemically synthesized
tttgaaagcaacttattactga

SEQ ID NO: 1155034 - DNA, 22 bp, Artificial Sequence
  chemically synthesized
acattgtgatgttcagtaataa

SEQ ID NO: 1155035 - DNA, 22 bp, Artificial Sequence
  chemically synthesized
tacattgtgatgttcagtaata

SEQ ID NO: 1155036 - DNA, 22 bp, Artificial Sequence
  chemically synthesized
tgaaagcaacttattactgaac

SEQ ID NO: 1155037 - DNA, 22 bp, Artificial Sequence
  chemically synthesized
gaaagcaacttattactgaaca

SEQ ID NO: 1155038 - DNA, 22 bp, Artificial Sequence
  chemically synthesized
aaagcaacttattactgaacat

SEQ ID NO: 1155039 - DNA, 22 bp, Artificial Sequence
  chemically synthesized
ttttacattgtgatgttcagta

SEQ ID NO: 1155040 - DNA, 22 bp, Artificial Sequence
  chemically synthesized
ttgttttacattgtgatgttca

SEQ ID NO: 1155041 - DNA, 22 bp, Artificial Sequence
  chemically synthesized
tattgttttacattgtgatgtt

SEQ ID NO: 1155042 - DNA, 22 bp, Artificial Sequence
  chemically synthesized
attactgaacatcacaatgtaa

SEQ ID NO: 1155043 - DNA, 22 bp, Artificial Sequence
  chemically synthesized
ttactgaacatcacaatgtaaa

SEQ ID NO: 1155044 - DNA, 22 bp, Artificial Sequence
  chemically synthesized
taaattctattgttttacattg

SEQ ID NO: 1155045 - DNA, 22 bp, Artificial Sequence
  chemically synthesized
ctgaacatcacaatgtaaaaca

SEQ ID NO: 1155046 - DNA, 22 bp, Artificial Sequence
  chemically synthesized
aacatcacaatgtaaaacaata

SEQ ID NO: 1155047 - DNA, 22 bp, Artificial Sequence
  chemically synthesized
catatattataaattctattgt

SEQ ID NO: 1155048 - DNA, 22 bp, Artificial Sequence
  chemically synthesized
ataatatatggaatgttcgcat

SEQ ID NO: 1155049 - DNA, 22 bp, Artificial Sequence
  chemically synthesized
taatatatggaatgttcgcatt

SEQ ID NO: 1155050 - DNA, 22 bp, Artificial Sequence
  chemically synthesized
aatgtccaatagatgcccccaa

SEQ ID NO: 1155051 - DNA, 22 bp, Artificial Sequence
  chemically synthesized
tcaatgtccaatagatgccccc

SEQ ID NO: 1155052 - DNA, 22 bp, Artificial Sequence
  chemically synthesized
ctcaatgtccaatagatgcccc

SEQ ID NO: 1155053 - DNA, 22 bp, Artificial Sequence
  chemically synthesized
gcatttgggggcatctattgga

SEQ ID NO: 1155054 - DNA, 22 bp, Artificial Sequence
  chemically synthesized
catccttctcaatgtccaatag

SEQ ID NO: 1155055 - DNA, 22 bp, Artificial Sequence
  chemically synthesized
acatccttctcaatgtccaata

SEQ ID NO: 1155056 - DNA, 22 bp, Artificial Sequence
  chemically synthesized
gggggcatctattggacattga

SEQ ID NO: 1155057 - DNA, 22 bp, Artificial Sequence
  chemically synthesized
cttacatccttctcaatgtcca

SEQ ID NO: 1155058 - DNA, 22 bp, Artificial Sequence
  chemically synthesized
ggggcatctattggacattgag

SEQ ID NO: 1155059 - DNA, 22 bp, Artificial Sequence
  chemically synthesized
acttacatccttctcaatgtcc

SEQ ID NO: 1155060 - DNA, 22 bp, Artificial Sequence
  chemically synthesized
tacttacatccttctcaatgtc

SEQ ID NO: 1155061 - DNA, 22 bp, Artificial Sequence
  chemically synthesized
ttggacattgagaaggatgtaa

SEQ ID NO: 1155062 - DNA, 22 bp, Artificial Sequence
  chemically synthesized
atagtgggctttacttacatcc

SEQ ID NO: 1155063 - DNA, 22 bp, Artificial Sequence
  chemically synthesized
gacattgagaaggatgtaagta

SEQ ID NO: 1155064 - DNA, 22 bp, Artificial Sequence
  chemically synthesized
agaaggatgtaagtaaagccca

SEQ ID NO: 1155065 - DNA, 22 bp, Artificial Sequence
  chemically synthesized
cggggtgactgatagtgggctt

SEQ ID NO: 1155066 - DNA, 22 bp, Artificial Sequence
  chemically synthesized
agaaataatagttccggggtga

SEQ ID NO: 1155067 - DNA, 22 bp, Artificial Sequence
  chemically synthesized
tcagtcaccccggaactattat

SEQ ID NO: 1155068 - DNA, 22 bp, Artificial Sequence
  chemically synthesized
taagtctgagaaataatagttc

SEQ ID NO: 1155069 - DNA, 22 bp, Artificial Sequence
  chemically synthesized
ttataagtctgagaaataatag

SEQ ID NO: 1155070 - DNA, 22 bp, Artificial Sequence
  chemically synthesized
tgaactattataagtctgagaa

SEQ ID NO: 1155071 - DNA, 22 bp, Artificial Sequence
  chemically synthesized
gtgaactattataagtctgaga

SEQ ID NO: 1155072 - DNA, 22 bp, Artificial Sequence
  chemically synthesized
ttatttctcagacttataatag

SEQ ID NO: 1155073 - DNA, 22 bp, Artificial Sequence
  chemically synthesized
tttctcagacttataatagttc

SEQ ID NO: 1155074 - DNA, 22 bp, Artificial Sequence
  chemically synthesized
ctcagacttataatagttcaca

SEQ ID NO: 1155075 - DNA, 22 bp, Artificial Sequence
  chemically synthesized
gaaatcaggatttgtgaactat

SEQ ID NO: 1155076 - DNA, 22 bp, Artificial Sequence
  chemically synthesized
tcagacttataatagttcacaa

SEQ ID NO: 1155077 - DNA, 22 bp, Artificial Sequence
  chemically synthesized
agaaatcaggatttgtgaacta

SEQ ID NO: 1155078 - DNA, 22 bp, Artificial Sequence
  chemically synthesized
tagaaatcaggatttgtgaact

SEQ ID NO: 1155079 - DNA, 22 bp, Artificial Sequence
  chemically synthesized
agacttataatagttcacaaat

SEQ ID NO: 1155080 - DNA, 22 bp, Artificial Sequence
  chemically synthesized
ttagaaatcaggatttgtgaac

SEQ ID NO: 1155081 - DNA, 22 bp, Artificial Sequence
  chemically synthesized
ataatagttcacaaatcctgat

SEQ ID NO: 1155082 - DNA, 22 bp, Artificial Sequence
  chemically synthesized
taatagttcacaaatcctgatt

SEQ ID NO: 1155083 - DNA, 22 bp, Artificial Sequence
  chemically synthesized
tgtgaaagtttttagaaatcag

SEQ ID NO: 1155084 - DNA, 22 bp, Artificial Sequence
  chemically synthesized
actatgtgaaagtttttagaaa

SEQ ID NO: 1155085 - DNA, 22 bp, Artificial Sequence
  chemically synthesized
acaaatcctgatttctaaaaac

SEQ ID NO: 1155086 - DNA, 22 bp, Artificial Sequence
  chemically synthesized
gttgactatgtgaaagttttta

SEQ ID NO: 1155087 - DNA, 22 bp, Artificial Sequence
  chemically synthesized
agttgactatgtgaaagttttt

SEQ ID NO: 1155088 - DNA, 22 bp, Artificial Sequence
  chemically synthesized
atttctaaaaactttcacatag

SEQ ID NO: 1155089 - DNA, 22 bp, Artificial Sequence
  chemically synthesized
acatttagttgactatgtgaaa

SEQ ID NO: 1155090 - DNA, 22 bp, Artificial Sequence
  chemically synthesized
ctaaaaactttcacatagtcaa

SEQ ID NO: 1155091 - DNA, 22 bp, Artificial Sequence
  chemically synthesized
taaaaactttcacatagtcaac

SEQ ID NO: 1155092 - DNA, 22 bp, Artificial Sequence
  chemically synthesized
aaaactttcacatagtcaacta

SEQ ID NO: 1155093 - DNA, 22 bp, Artificial Sequence
  chemically synthesized
gcatgttcacatttagttgact

SEQ ID NO: 1155094 - DNA, 22 bp, Artificial Sequence
  chemically synthesized
agttagcatgttcacatttagt

SEQ ID NO: 1155095 - DNA, 22 bp, Artificial Sequence
  chemically synthesized
tcacatagtcaactaaatgtga

SEQ ID NO: 1155096 - DNA, 22 bp, Artificial Sequence
  chemically synthesized
cagttagcatgttcacatttag

SEQ ID NO: 1155097 - DNA, 22 bp, Artificial Sequence
  chemically synthesized
cacatagtcaactaaatgtgaa

SEQ ID NO: 1155098 - DNA, 22 bp, Artificial Sequence
  chemically synthesized
acatagtcaactaaatgtgaac

SEQ ID NO: 1155099 - DNA, 22 bp, Artificial Sequence
  chemically synthesized
cacttcagttagcatgttcaca

SEQ ID NO: 1155100 - DNA, 22 bp, Artificial Sequence
  chemically synthesized
gcacttcagttagcatgttcac

SEQ ID NO: 1155101 - DNA, 22 bp, Artificial Sequence
  chemically synthesized
tgcacttcagttagcatgttca

SEQ ID NO: 1155102 - DNA, 22 bp, Artificial Sequence
  chemically synthesized
aatgtgaacatgctaactgaag

SEQ ID NO: 1155103 - DNA, 22 bp, Artificial Sequence
  chemically synthesized
tcagatgctttgcacttcagtt

SEQ ID NO: 1155104 - DNA, 22 bp, Artificial Sequence
  chemically synthesized
gtcaattatcagatgctttgca

SEQ ID NO: 1155105 - DNA, 22 bp, Artificial Sequence
  chemically synthesized
agtcaattatcagatgctttgc

SEQ ID NO: 1155106 - DNA, 22 bp, Artificial Sequence
  chemically synthesized
cttagtcaattatcagatgctt

SEQ ID NO: 1155107 - DNA, 22 bp, Artificial Sequence
  chemically synthesized
actgaagtgcaaagcatctgat

SEQ ID NO: 1155108 - DNA, 22 bp, Artificial Sequence
  chemically synthesized
aagtgcaaagcatctgataatt

SEQ ID NO: 1155109 - DNA, 22 bp, Artificial Sequence
  chemically synthesized
ccaaaatatactacttagtcaa

SEQ ID NO: 1155110 - DNA, 22 bp, Artificial Sequence
  chemically synthesized
ataattgactaagtagtatatt

SEQ ID NO: 1155111 - DNA, 22 bp, Artificial Sequence
  chemically synthesized
actaagtagtatattttggcag

SEQ ID NO: 1155112 - DNA, 22 bp, Artificial Sequence
  chemically synthesized
agtagtatattttggcagttgt

SEQ ID NO: 1155113 - DNA, 22 bp, Artificial Sequence
  chemically synthesized
aataatgagaatgtaaacgaac

SEQ ID NO: 1155114 - DNA, 22 bp, Artificial Sequence
  chemically synthesized
tggcagttgttcgtttacattc

SEQ ID NO: 1155115 - DNA, 22 bp, Artificial Sequence
  chemically synthesized
ggcagttgttcgtttacattct

SEQ ID NO: 1155116 - DNA, 22 bp, Artificial Sequence
  chemically synthesized
gcagttgttcgtttacattctc

SEQ ID NO: 1155117 - DNA, 22 bp, Artificial Sequence
  chemically synthesized
ttcgtttacattctcattattt

SEQ ID NO: 1155118 - DNA, 22 bp, Artificial Sequence
  chemically synthesized
gtttacattctcattatttagt

SEQ ID NO: 1155119 - DNA, 22 bp, Artificial Sequence
  chemically synthesized
accaccacacatactaaataat

SEQ ID NO: 1155120 - DNA, 22 bp, Artificial Sequence
  chemically synthesized
aaccaccacacatactaaataa

SEQ ID NO: 1155121 - DNA, 22 bp, Artificial Sequence
  chemically synthesized
taaccaccacacatactaaata

SEQ ID NO: 1155122 - DNA, 22 bp, Artificial Sequence
  chemically synthesized
acattctcattatttagtatgt

SEQ ID NO: 1155123 - DNA, 22 bp, Artificial Sequence
  chemically synthesized
cattctcattatttagtatgtg

SEQ ID NO: 1155124 - DNA, 22 bp, Artificial Sequence
  chemically synthesized
tcattatttagtatgtgtggtg

SEQ ID NO: 1155125 - DNA, 22 bp, Artificial Sequence
  chemically synthesized
attatttagtatgtgtggtggt

SEQ ID NO: 1155126 - DNA, 22 bp, Artificial Sequence
  chemically synthesized
tggccatctttaaccaccacac

SEQ ID NO: 1155127 - DNA, 22 bp, Artificial Sequence
  chemically synthesized
gtggccatctttaaccaccaca

SEQ ID NO: 1155128 - DNA, 22 bp, Artificial Sequence
  chemically synthesized
tttagtatgtgtggtggttaaa

SEQ ID NO: 1155129 - DNA, 22 bp, Artificial Sequence
  chemically synthesized
agtatgtgtggtggttaaagat

SEQ ID NO: 1155130 - DNA, 22 bp, Artificial Sequence
  chemically synthesized
gtatgtgtggtggttaaagatg

SEQ ID NO: 1155131 - DNA, 22 bp, Artificial Sequence
  chemically synthesized
aagatggccacaaattctttgt

SEQ ID NO: 1155132 - DNA, 22 bp, Artificial Sequence
  chemically synthesized
aagggaaaagtgacaaagaatt

SEQ ID NO: 1155133 - DNA, 22 bp, Artificial Sequence
  chemically synthesized
gaagggaaaagtgacaaagaat

SEQ ID NO: 1155134 - DNA, 22 bp, Artificial Sequence
  chemically synthesized
ttgaagggaaaagtgacaaaga

SEQ ID NO: 1155135 - DNA, 22 bp, Artificial Sequence
  chemically synthesized
atctcttgaagggaaaagtgac

SEQ ID NO: 1155136 - DNA, 22 bp, Artificial Sequence
  chemically synthesized
tttgtcacttttcccttcaaga

SEQ ID NO: 1155137 - DNA, 22 bp, Artificial Sequence
  chemically synthesized
tgtcacttttcccttcaagaga

SEQ ID NO: 1155138 - DNA, 22 bp, Artificial Sequence
  chemically synthesized
gtcacttttcccttcaagagat

SEQ ID NO: 1155139 - DNA, 22 bp, Artificial Sequence
  chemically synthesized
tcacttttcccttcaagagatg

SEQ ID NO: 1155140 - DNA, 22 bp, Artificial Sequence
  chemically synthesized
ttcccttcaagagatgaggtct

SEQ ID NO: 1155141 - DNA, 22 bp, Artificial Sequence
  chemically synthesized
tcccttcaagagatgaggtcta

SEQ ID NO: 1155142 - DNA, 22 bp, Artificial Sequence
  chemically synthesized
cccttcaagagatgaggtctat

SEQ ID NO: 1155143 - DNA, 22 bp, Artificial Sequence
  chemically synthesized
ccttcaagagatgaggtctatt

SEQ ID NO: 1155144 - DNA, 22 bp, Artificial Sequence
  chemically synthesized
acagggatggaaaatagacctc

SEQ ID NO: 1155145 - DNA, 22 bp, Artificial Sequence
  chemically synthesized
caagagatgaggtctattttcc

SEQ ID NO: 1155146 - DNA, 22 bp, Artificial Sequence
  chemically synthesized
aagagatgaggtctattttcca

SEQ ID NO: 1155147 - DNA, 22 bp, Artificial Sequence
  chemically synthesized
ttttccatccctgtgaatatga

SEQ ID NO: 1155148 - DNA, 22 bp, Artificial Sequence
  chemically synthesized
tccatccctgtgaatatgatct

SEQ ID NO: 1155149 - DNA, 22 bp, Artificial Sequence
  chemically synthesized
ccatccctgtgaatatgatctg

SEQ ID NO: 1155150 - DNA, 22 bp, Artificial Sequence
  chemically synthesized
catccctgtgaatatgatctgg

SEQ ID NO: 1155151 - DNA, 22 bp, Artificial Sequence
  chemically synthesized
tgaatatgatctggacttgtgt

SEQ ID NO: 1155152 - DNA, 22 bp, Artificial Sequence
  chemically synthesized
tggtcaaaaaaaaaaacacaag

SEQ ID NO: 1155153 - DNA, 22 bp, Artificial Sequence
  chemically synthesized
tgtggtcaaaaaaaaaaacaca

SEQ ID NO: 1155154 - DNA, 22 bp, Artificial Sequence
  chemically synthesized
gacttgtgtttttttttttgac

SEQ ID NO: 1155155 - DNA, 22 bp, Artificial Sequence
  chemically synthesized
tgccacattctgtggtcaaaaa

SEQ ID NO: 1155156 - DNA, 22 bp, Artificial Sequence
  chemically synthesized
gtgtttttttttttgaccacag

SEQ ID NO: 1155157 - DNA, 22 bp, Artificial Sequence
  chemically synthesized
tgtttttttttttgaccacaga

SEQ ID NO: 1155158 - DNA, 22 bp, Artificial Sequence
  chemically synthesized
ttttttttgaccacagaatgtg

SEQ ID NO: 1155159 - DNA, 22 bp, Artificial Sequence
  chemically synthesized
tttttttgaccacagaatgtgg

SEQ ID NO: 1155160 - DNA, 22 bp, Artificial Sequence
  chemically synthesized
ttttttgaccacagaatgtggc

SEQ ID NO: 1155161 - DNA, 22 bp, Artificial Sequence
  chemically synthesized
tttttgaccacagaatgtggca

SEQ ID NO: 1155162 - DNA, 22 bp, Artificial Sequence
  chemically synthesized
ttttgaccacagaatgtggcat

SEQ ID NO: 1155163 - DNA, 22 bp, Artificial Sequence
  chemically synthesized
tttgaccacagaatgtggcata

SEQ ID NO: 1155164 - DNA, 22 bp, Artificial Sequence
  chemically synthesized
ttgaccacagaatgtggcataa

SEQ ID NO: 1155165 - DNA, 22 bp, Artificial Sequence
  chemically synthesized
gtgtggtgtcagttatgccaca

SEQ ID NO: 1155166 - DNA, 22 bp, Artificial Sequence
  chemically synthesized
tgaccacagaatgtggcataac

SEQ ID NO: 1155167 - DNA, 22 bp, Artificial Sequence
  chemically synthesized
gaccacagaatgtggcataact

SEQ ID NO: 1155168 - DNA, 22 bp, Artificial Sequence
  chemically synthesized
accacagaatgtggcataactg

SEQ ID NO: 1155169 - DNA, 22 bp, Artificial Sequence
  chemically synthesized
gaattggtgtggtgtcagttat

SEQ ID NO: 1155170 - DNA, 22 bp, Artificial Sequence
  chemically synthesized
ggaattggtgtggtgtcagtta

SEQ ID NO: 1155171 - DNA, 22 bp, Artificial Sequence
  chemically synthesized
cacttggaattggtgtggtgtc

SEQ ID NO: 1155172 - DNA, 22 bp, Artificial Sequence
  chemically synthesized
tagcctacacttggaattggtg

SEQ ID NO: 1155173 - DNA, 22 bp, Artificial Sequence
  chemically synthesized
atagcctacacttggaattggt

SEQ ID NO: 1155174 - DNA, 22 bp, Artificial Sequence
  chemically synthesized
tatagcctacacttggaattgg

SEQ ID NO: 1155175 - DNA, 22 bp, Artificial Sequence
  chemically synthesized
ttatagcctacacttggaattg

SEQ ID NO: 1155176 - DNA, 22 bp, Artificial Sequence
  chemically synthesized
ttttatagcctacacttggaat

SEQ ID NO: 1155177 - DNA, 22 bp, Artificial Sequence
  chemically synthesized
acaccacaccaattccaagtgt

SEQ ID NO: 1155178 - DNA, 22 bp, Artificial Sequence
  chemically synthesized
ccagttcttttatagcctacac

SEQ ID NO: 1155179 - DNA, 22 bp, Artificial Sequence
  chemically synthesized
caagtgtaggctataaaagaac

SEQ ID NO: 1155180 - DNA, 22 bp, Artificial Sequence
  chemically synthesized
taaaagaactggcagcatttgt

SEQ ID NO: 1155181 - DNA, 22 bp, Artificial Sequence
  chemically synthesized
aagagaggaagaaatacaaatg

SEQ ID NO: 1155182 - DNA, 22 bp, Artificial Sequence
  chemically synthesized
caagagaggaagaaatacaaat

SEQ ID NO: 1155183 - DNA, 22 bp, Artificial Sequence
  chemically synthesized
ggcttcaagagaggaagaaata

SEQ ID NO: 1155184 - DNA, 22 bp, Artificial Sequence
  chemically synthesized
gcagcatttgtatttcttcctc

SEQ ID NO: 1155185 - DNA, 22 bp, Artificial Sequence
  chemically synthesized
gtatttcttcctctcttgaagc

SEQ ID NO: 1155186 - DNA, 22 bp, Artificial Sequence
  chemically synthesized
tatttcttcctctcttgaagcc

SEQ ID NO: 1155187 - DNA, 22 bp, Artificial Sequence
  chemically synthesized
cagcatggaatctaggcttcaa

SEQ ID NO: 1155188 - DNA, 22 bp, Artificial Sequence
  chemically synthesized
acagcatggaatctaggcttca

SEQ ID NO: 1155189 - DNA, 22 bp, Artificial Sequence
  chemically synthesized
tacagcatggaatctaggcttc

SEQ ID NO: 1155190 - DNA, 22 bp, Artificial Sequence
  chemically synthesized
cttcctctcttgaagcctagat

SEQ ID NO: 1155191 - DNA, 22 bp, Artificial Sequence
  chemically synthesized
ttcctctcttgaagcctagatt

SEQ ID NO: 1155192 - DNA, 22 bp, Artificial Sequence
  chemically synthesized
ctttacagcatggaatctaggc

SEQ ID NO: 1155193 - DNA, 22 bp, Artificial Sequence
  chemically synthesized
cctctcttgaagcctagattcc

SEQ ID NO: 1155194 - DNA, 22 bp, Artificial Sequence
  chemically synthesized
ctctcttgaagcctagattcca

SEQ ID NO: 1155195 - DNA, 22 bp, Artificial Sequence
  chemically synthesized
tcttgaagcctagattccatgc

SEQ ID NO: 1155196 - DNA, 22 bp, Artificial Sequence
  chemically synthesized
gcctcctttacagcatggaatc

SEQ ID NO: 1155197 - DNA, 22 bp, Artificial Sequence
  chemically synthesized
ttgaagcctagattccatgctg

SEQ ID NO: 1155198 - DNA, 22 bp, Artificial Sequence
  chemically synthesized
gaagcctagattccatgctgta

SEQ ID NO: 1155199 - DNA, 22 bp, Artificial Sequence
  chemically synthesized
aagcctagattccatgctgtaa

SEQ ID NO: 1155200 - DNA, 22 bp, Artificial Sequence
  chemically synthesized
gattccatgctgtaaaggaggc

SEQ ID NO: 1155201 - DNA, 22 bp, Artificial Sequence
  chemically synthesized
ggtagtgtagcctggcctcctt

SEQ ID NO: 1155202 - DNA, 22 bp, Artificial Sequence
  chemically synthesized
catgctgtaaaggaggccaggc

SEQ ID NO: 1155203 - DNA, 22 bp, Artificial Sequence
  chemically synthesized
atgattcggtagtgtagcctgg

SEQ ID NO: 1155204 - DNA, 22 bp, Artificial Sequence
  chemically synthesized
taatgattcggtagtgtagcct

SEQ ID NO: 1155205 - DNA, 22 bp, Artificial Sequence
  chemically synthesized
taaaggaggccaggctacacta

SEQ ID NO: 1155206 - DNA, 22 bp, Artificial Sequence
  chemically synthesized
tatggtctctaatgattcggta

SEQ ID NO: 1155207 - DNA, 22 bp, Artificial Sequence
  chemically synthesized
ctatatggtctctaatgattcg

SEQ ID NO: 1155208 - DNA, 22 bp, Artificial Sequence
  chemically synthesized
cactaccgaatcattagagacc

SEQ ID NO: 1155209 - DNA, 22 bp, Artificial Sequence
  chemically synthesized
ccgaatcattagagaccatata

SEQ ID NO: 1155210 - DNA, 22 bp, Artificial Sequence
  chemically synthesized
cagaatcactcctatatggtct

SEQ ID NO: 1155211 - DNA, 22 bp, Artificial Sequence
  chemically synthesized
tcctgcagaatcactcctatat

SEQ ID NO: 1155212 - DNA, 22 bp, Artificial Sequence
  chemically synthesized
atcctgcagaatcactcctata

SEQ ID NO: 1155213 - DNA, 22 bp, Artificial Sequence
  chemically synthesized
tatcctgcagaatcactcctat

SEQ ID NO: 1155214 - DNA, 22 bp, Artificial Sequence
  chemically synthesized
gagaccatataggagtgattct

SEQ ID NO: 1155215 - DNA, 22 bp, Artificial Sequence
  chemically synthesized
atacagtattttatcctgcaga

SEQ ID NO: 1155216 - DNA, 22 bp, Artificial Sequence
  chemically synthesized
taatacagtattttatcctgca

SEQ ID NO: 1155217 - DNA, 22 bp, Artificial Sequence
  chemically synthesized
ctaatacagtattttatcctgc

SEQ ID NO: 1155218 - DNA, 22 bp, Artificial Sequence
  chemically synthesized
acttctaatacagtattttatc

SEQ ID NO: 1155219 - DNA, 22 bp, Artificial Sequence
  chemically synthesized
tgcaggataaaatactgtatta

SEQ ID NO: 1155220 - DNA, 22 bp, Artificial Sequence
  chemically synthesized
gaagctcacttctaatacagta

SEQ ID NO: 1155221 - DNA, 22 bp, Artificial Sequence
  chemically synthesized
caggataaaatactgtattaga

SEQ ID NO: 1155222 - DNA, 22 bp, Artificial Sequence
  chemically synthesized
agctggaagctcacttctaata

SEQ ID NO: 1155223 - DNA, 22 bp, Artificial Sequence
  chemically synthesized
tgctgagctggaagctcacttc

SEQ ID NO: 1155224 - DNA, 22 bp, Artificial Sequence
  chemically synthesized
ggctgtgctgagctggaagctc

SEQ ID NO: 1155225 - DNA, 22 bp, Artificial Sequence
  chemically synthesized
gggctgtgctgagctggaagct

SEQ ID NO: 1155226 - DNA, 22 bp, Artificial Sequence
  chemically synthesized
tattagaagtgagcttccagct

SEQ ID NO: 1155227 - DNA, 22 bp, Artificial Sequence
  chemically synthesized
gaagtgagcttccagctcagca

SEQ ID NO: 1155228 - DNA, 22 bp, Artificial Sequence
  chemically synthesized
ggggtcaccccttgggctgtgc

SEQ ID NO: 1155229 - DNA, 22 bp, Artificial Sequence
  chemically synthesized
ccagctcagcacagcccaaggg

SEQ ID NO: 1155230 - DNA, 22 bp, Artificial Sequence
  chemically synthesized
cagctcagcacagcccaagggg

SEQ ID NO: 1155231 - DNA, 22 bp, Artificial Sequence
  chemically synthesized
tagctgggggtcaccccttggg

SEQ ID NO: 1155232 - DNA, 22 bp, Artificial Sequence
  chemically synthesized
atagctgggggtcaccccttgg

SEQ ID NO: 1155233 - DNA, 22 bp, Artificial Sequence
  chemically synthesized
tatagctgggggtcaccccttg

SEQ ID NO: 1155234 - DNA, 22 bp, Artificial Sequence
  chemically synthesized
agcacagcccaaggggtgaccc

SEQ ID NO: 1155235 - DNA, 22 bp, Artificial Sequence
  chemically synthesized
gttttatagctgggggtcaccc

SEQ ID NO: 1155236 - DNA, 22 bp, Artificial Sequence
  chemically synthesized
ctagttttatagctgggggtca

SEQ ID NO: 1155237 - DNA, 22 bp, Artificial Sequence
  chemically synthesized
tattactagttttatagctggg

SEQ ID NO: 1155238 - DNA, 22 bp, Artificial Sequence
  chemically synthesized
atattactagttttatagctgg

SEQ ID NO: 1155239 - DNA, 22 bp, Artificial Sequence
  chemically synthesized
tatattactagttttatagctg

SEQ ID NO: 1155240 - DNA, 22 bp, Artificial Sequence
  chemically synthesized
ttatattactagttttatagct

SEQ ID NO: 1155241 - DNA, 22 bp, Artificial Sequence
  chemically synthesized
tttttatattactagttttata

SEQ ID NO: 1155242 - DNA, 22 bp, Artificial Sequence
  chemically synthesized
agccaggttgtttttatattac

SEQ ID NO: 1155243 - DNA, 22 bp, Artificial Sequence
  chemically synthesized
taaaactagtaatataaaaaca

SEQ ID NO: 1155244 - DNA, 22 bp, Artificial Sequence
  chemically synthesized
gtaatataaaaacaacctggct

SEQ ID NO: 1155245 - DNA, 22 bp, Artificial Sequence
  chemically synthesized
aagaccgagaatataagcaggg

SEQ ID NO: 1155246 - DNA, 22 bp, Artificial Sequence
  chemically synthesized
gctgagccctgcttatattctc

SEQ ID NO: 1155247 - DNA, 22 bp, Artificial Sequence
  chemically synthesized
agccctgcttatattctcggtc

SEQ ID NO: 1155248 - DNA, 22 bp, Artificial Sequence
  chemically synthesized
cgtcatgatctgaagaccgaga

SEQ ID NO: 1155249 - DNA, 22 bp, Artificial Sequence
  chemically synthesized
cttatattctcggtcttcagat

SEQ ID NO: 1155250 - DNA, 22 bp, Artificial Sequence
  chemically synthesized
taattgcgtcatgatctgaaga

SEQ ID NO: 1155251 - DNA, 22 bp, Artificial Sequence
  chemically synthesized
ataattgcgtcatgatctgaag

SEQ ID NO: 1155252 - DNA, 22 bp, Artificial Sequence
  chemically synthesized
atattctcggtcttcagatcat

SEQ ID NO: 1155253 - DNA, 22 bp, Artificial Sequence
  chemically synthesized
tattctcggtcttcagatcatg

SEQ ID NO: 1155254 - DNA, 22 bp, Artificial Sequence
  chemically synthesized
tcggtcttcagatcatgacgca

SEQ ID NO: 1155255 - DNA, 22 bp, Artificial Sequence
  chemically synthesized
ggtcttcagatcatgacgcaat

SEQ ID NO: 1155256 - DNA, 22 bp, Artificial Sequence
  chemically synthesized
aaacaatttataattgcgtcat

SEQ ID NO: 1155257 - DNA, 22 bp, Artificial Sequence
  chemically synthesized
cagatcatgacgcaattataaa

SEQ ID NO: 1155258 - DNA, 22 bp, Artificial Sequence
  chemically synthesized
agatcatgacgcaattataaat

SEQ ID NO: 1155259 - DNA, 22 bp, Artificial Sequence
  chemically synthesized
atgggttaaaacaatttataat

SEQ ID NO: 1155260 - DNA, 22 bp, Artificial Sequence
  chemically synthesized
aatgggttaaaacaatttataa

SEQ ID NO: 1155261 - DNA, 22 bp, Artificial Sequence
  chemically synthesized
taaattgttttaacccattaag

SEQ ID NO: 1155262 - DNA, 22 bp, Artificial Sequence
  chemically synthesized
ttttaacccattaagtttggac

SEQ ID NO: 1155263 - DNA, 22 bp, Artificial Sequence
  chemically synthesized
taacccattaagtttggacgtc

SEQ ID NO: 1155264 - DNA, 22 bp, Artificial Sequence
  chemically synthesized
tgtgtatcaaatgacgtccaaa

SEQ ID NO: 1155265 - DNA, 22 bp, Artificial Sequence
  chemically synthesized
aacccattaagtttggacgtca

SEQ ID NO: 1155266 - DNA, 22 bp, Artificial Sequence
  chemically synthesized
gtgtgtatcaaatgacgtccaa

SEQ ID NO: 1155267 - DNA, 22 bp, Artificial Sequence
  chemically synthesized
acccattaagtttggacgtcat

SEQ ID NO: 1155268 - DNA, 22 bp, Artificial Sequence
  chemically synthesized
tttgtgtgtatcaaatgacgtc

SEQ ID NO: 1155269 - DNA, 22 bp, Artificial Sequence
  chemically synthesized
gtctatttgtgtgtatcaaatg

SEQ ID NO: 1155270 - DNA, 22 bp, Artificial Sequence
  chemically synthesized
agtttggacgtcatttgataca

SEQ ID NO: 1155271 - DNA, 22 bp, Artificial Sequence
  chemically synthesized
tagtctatttgtgtgtatcaaa

SEQ ID NO: 1155272 - DNA, 22 bp, Artificial Sequence
  chemically synthesized
tctagtctatttgtgtgtatca

SEQ ID NO: 1155273 - DNA, 22 bp, Artificial Sequence
  chemically synthesized
ctctagtctatttgtgtgtatc

SEQ ID NO: 1155274 - DNA, 22 bp, Artificial Sequence
  chemically synthesized
ggacgtcatttgatacacacaa

SEQ ID NO: 1155275 - DNA, 22 bp, Artificial Sequence
  chemically synthesized
tctctagtctatttgtgtgtat

SEQ ID NO: 1155276 - DNA, 22 bp, Artificial Sequence
  chemically synthesized
gacgtcatttgatacacacaaa

SEQ ID NO: 1155277 - DNA, 22 bp, Artificial Sequence
  chemically synthesized
gatacacacaaatagactagag

SEQ ID NO: 1155278 - DNA, 22 bp, Artificial Sequence
  chemically synthesized
atacacacaaatagactagaga

SEQ ID NO: 1155279 - DNA, 22 bp, Artificial Sequence
  chemically synthesized
tggggaaaaagcaccctttctc

SEQ ID NO: 1155280 - DNA, 22 bp, Artificial Sequence
  chemically synthesized
gtggggaaaaagcaccctttct

SEQ ID NO: 1155281 - DNA, 22 bp, Artificial Sequence
  chemically synthesized
tgtggggaaaaagcaccctttc

SEQ ID NO: 1155282 - DNA, 22 bp, Artificial Sequence
  chemically synthesized
tatctttgtggggaaaaagcac

SEQ ID NO: 1155283 - DNA, 22 bp, Artificial Sequence
  chemically synthesized
tatatctttgtggggaaaaagc

SEQ ID NO: 1155284 - DNA, 22 bp, Artificial Sequence
  chemically synthesized
ctatatctttgtggggaaaaag

SEQ ID NO: 1155285 - DNA, 22 bp, Artificial Sequence
  chemically synthesized
gagaaagggtgctttttcccca

SEQ ID NO: 1155286 - DNA, 22 bp, Artificial Sequence
  chemically synthesized
tctatatctttgtggggaaaaa

SEQ ID NO: 1155287 - DNA, 22 bp, Artificial Sequence
  chemically synthesized
ttttctatatctttgtggggaa

SEQ ID NO: 1155288 - DNA, 22 bp, Artificial Sequence
  chemically synthesized
tttccccacaaagatatagaaa

SEQ ID NO: 1155289 - DNA, 22 bp, Artificial Sequence
  chemically synthesized
ttccccacaaagatatagaaaa

SEQ ID NO: 1155290 - DNA, 22 bp, Artificial Sequence
  chemically synthesized
cccagcccactattttctatat

SEQ ID NO: 1155291 - DNA, 22 bp, Artificial Sequence
  chemically synthesized
tccccacaaagatatagaaaat

SEQ ID NO: 1155292 - DNA, 22 bp, Artificial Sequence
  chemically synthesized
ccccacaaagatatagaaaata

SEQ ID NO: 1155293 - DNA, 22 bp, Artificial Sequence
  chemically synthesized
cccacaaagatatagaaaatag

SEQ ID NO: 1155294 - DNA, 22 bp, Artificial Sequence
  chemically synthesized
attacccagcccactattttct

SEQ ID NO: 1155295 - DNA, 22 bp, Artificial Sequence
  chemically synthesized
aattcattacccagcccactat

SEQ ID NO: 1155296 - DNA, 22 bp, Artificial Sequence
  chemically synthesized
aaattcattacccagcccacta

SEQ ID NO: 1155297 - DNA, 22 bp, Artificial Sequence
  chemically synthesized
taaattcattacccagcccact

SEQ ID NO: 1155298 - DNA, 22 bp, Artificial Sequence
  chemically synthesized
gactttaaattcattacccagc

SEQ ID NO: 1155299 - DNA, 22 bp, Artificial Sequence
  chemically synthesized
ggactttaaattcattacccag

SEQ ID NO: 1155300 - DNA, 22 bp, Artificial Sequence
  chemically synthesized
tggactttaaattcattaccca

SEQ ID NO: 1155301 - DNA, 22 bp, Artificial Sequence
  chemically synthesized
ggcctttggactttaaattcat

SEQ ID NO: 1155302 - DNA, 22 bp, Artificial Sequence
  chemically synthesized
ggtaatgaatttaaagtccaaa

SEQ ID NO: 1155303 - DNA, 22 bp, Artificial Sequence
  chemically synthesized
tgaacctaggcctttggacttt

SEQ ID NO: 1155304 - DNA, 22 bp, Artificial Sequence
  chemically synthesized
ggctgtgaacctaggcctttgg

SEQ ID NO: 1155305 - DNA, 22 bp, Artificial Sequence
  chemically synthesized
ccgctgggctgtgaacctaggc

SEQ ID NO: 1155306 - DNA, 22 bp, Artificial Sequence
  chemically synthesized
aaagtccaaaggcctaggttca

SEQ ID NO: 1155307 - DNA, 22 bp, Artificial Sequence
  chemically synthesized
accgctgggctgtgaacctagg

SEQ ID NO: 1155308 - DNA, 22 bp, Artificial Sequence
  chemically synthesized
aagtccaaaggcctaggttcac

SEQ ID NO: 1155309 - DNA, 22 bp, Artificial Sequence
  chemically synthesized
tagagcttaccgctgggctgtg

SEQ ID NO: 1155310 - DNA, 22 bp, Artificial Sequence
  chemically synthesized
gttgtagagcttaccgctgggc

SEQ ID NO: 1155311 - DNA, 22 bp, Artificial Sequence
  chemically synthesized
ggttcacagcccagcggtaagc

SEQ ID NO: 1155312 - DNA, 22 bp, Artificial Sequence
  chemically synthesized
agaacctggttgtagagcttac

SEQ ID NO: 1155313 - DNA, 22 bp, Artificial Sequence
  chemically synthesized
acagcccagcggtaagctctac

SEQ ID NO: 1155314 - DNA, 22 bp, Artificial Sequence
  chemically synthesized
aagaacctggttgtagagctta

SEQ ID NO: 1155315 - DNA, 22 bp, Artificial Sequence
  chemically synthesized
agaacgtttaagaacctggttg

SEQ ID NO: 1155316 - DNA, 22 bp, Artificial Sequence
  chemically synthesized
tacaaccaggttcttaaacgtt

SEQ ID NO: 1155317 - DNA, 22 bp, Artificial Sequence
  chemically synthesized
caaccaggttcttaaacgttct

SEQ ID NO: 1155318 - DNA, 22 bp, Artificial Sequence
  chemically synthesized
gaaatgtaattgagaacgttta

SEQ ID NO: 1155319 - DNA, 22 bp, Artificial Sequence
  chemically synthesized
atgctggaaatgtaattgagaa

SEQ ID NO: 1155320 - DNA, 22 bp, Artificial Sequence
  chemically synthesized
ttaaacgttctcaattacattt

SEQ ID NO: 1155321 - DNA, 22 bp, Artificial Sequence
  chemically synthesized
aaacgttctcaattacatttcc

SEQ ID NO: 1155322 - DNA, 22 bp, Artificial Sequence
  chemically synthesized
aacgttctcaattacatttcca

SEQ ID NO: 1155323 - DNA, 22 bp, Artificial Sequence
  chemically synthesized
tcccatgtccctgatgctggaa

SEQ ID NO: 1155324 - DNA, 22 bp, Artificial Sequence
  chemically synthesized
tcaattacatttccagcatcag

SEQ ID NO: 1155325 - DNA, 22 bp, Artificial Sequence
  chemically synthesized
aattacatttccagcatcaggg

SEQ ID NO: 1155326 - DNA, 22 bp, Artificial Sequence
  chemically synthesized
catttccagcatcagggacatg

SEQ ID NO: 1155327 - DNA, 22 bp, Artificial Sequence
  chemically synthesized
ccagcatcagggacatgggata

SEQ ID NO: 1155328 - DNA, 22 bp, Artificial Sequence
  chemically synthesized
cagcatcagggacatgggataa

SEQ ID NO: 1155329 - DNA, 22 bp, Artificial Sequence
  chemically synthesized
ataggcaaaacattatcccatg

SEQ ID NO: 1155330 - DNA, 22 bp, Artificial Sequence
  chemically synthesized
tgtaattaataggcaaaacatt

SEQ ID NO: 1155331 - DNA, 22 bp, Artificial Sequence
  chemically synthesized
aacataaagttgtgtaattaat

SEQ ID NO: 1155332 - DNA, 22 bp, Artificial Sequence
  chemically synthesized
atcctcaacataaagttgtgta

SEQ ID NO: 1155333 - DNA, 22 bp, Artificial Sequence
  chemically synthesized
tgcctattaattacacaacttt

SEQ ID NO: 1155334 - DNA, 22 bp, Artificial Sequence
  chemically synthesized
catcctcaacataaagttgtgt

SEQ ID NO: 1155335 - DNA, 22 bp, Artificial Sequence
  chemically synthesized
gcctattaattacacaacttta

SEQ ID NO: 1155336 - DNA, 22 bp, Artificial Sequence
  chemically synthesized
tcatcctcaacataaagttgtg

SEQ ID NO: 1155337 - DNA, 22 bp, Artificial Sequence
  chemically synthesized
cctattaattacacaactttat

SEQ ID NO: 1155338 - DNA, 22 bp, Artificial Sequence
  chemically synthesized
ttaattacacaactttatgttg

SEQ ID NO: 1155339 - DNA, 22 bp, Artificial Sequence
  chemically synthesized
attacacaactttatgttgagg

SEQ ID NO: 1155340 - DNA, 22 bp, Artificial Sequence
  chemically synthesized
cacaactttatgttgaggatga

SEQ ID NO: 1155341 - DNA, 22 bp, Artificial Sequence
  chemically synthesized
tatgttgaggatgaaaacacat

SEQ ID NO: 1155342 - DNA, 22 bp, Artificial Sequence
  chemically synthesized
atgttgaggatgaaaacacatt

SEQ ID NO: 1155343 - DNA, 22 bp, Artificial Sequence
  chemically synthesized
tgttgaggatgaaaacacatta

SEQ ID NO: 1155344 - DNA, 22 bp, Artificial Sequence
  chemically synthesized
atgaatgaacaataatgtgttt

SEQ ID NO: 1155345 - DNA, 22 bp, Artificial Sequence
  chemically synthesized
aggatgaaaacacattattgtt

SEQ ID NO: 1155346 - DNA, 22 bp, Artificial Sequence
  chemically synthesized
aattaatgaatgaacaataatg

SEQ ID NO: 1155347 - DNA, 22 bp, Artificial Sequence
  chemically synthesized
gttgaattaatgaatgaacaat

SEQ ID NO: 1155348 - DNA, 22 bp, Artificial Sequence
  chemically synthesized
ggttgaattaatgaatgaacaa

SEQ ID NO: 1155349 - DNA, 22 bp, Artificial Sequence
  chemically synthesized
tggttgaattaatgaatgaaca

SEQ ID NO: 1155350 - DNA, 22 bp, Artificial Sequence
  chemically synthesized
aaattttggttgaattaatgaa

SEQ ID NO: 1155351 - DNA, 22 bp, Artificial Sequence
  chemically synthesized
ttgttcattcattaattcaacc

SEQ ID NO: 1155352 - DNA, 22 bp, Artificial Sequence
  chemically synthesized
catctcaaattttggttgaatt

SEQ ID NO: 1155353 - DNA, 22 bp, Artificial Sequence
  chemically synthesized
gcatctcaaattttggttgaat

SEQ ID NO: 1155354 - DNA, 22 bp, Artificial Sequence
  chemically synthesized
ttcattcattaattcaaccaaa

SEQ ID NO: 1155355 - DNA, 22 bp, Artificial Sequence
  chemically synthesized
attcattaattcaaccaaaatt

SEQ ID NO: 1155356 - DNA, 22 bp, Artificial Sequence
  chemically synthesized
atttgcatctcaaattttggtt

SEQ ID NO: 1155357 - DNA, 22 bp, Artificial Sequence
  chemically synthesized
tcatttgcatctcaaattttgg

SEQ ID NO: 1155358 - DNA, 22 bp, Artificial Sequence
  chemically synthesized
ctcatttgcatctcaaattttg

SEQ ID NO: 1155359 - DNA, 22 bp, Artificial Sequence
  chemically synthesized
attaattcaaccaaaatttgag

SEQ ID NO: 1155360 - DNA, 22 bp, Artificial Sequence
  chemically synthesized
attcaaccaaaatttgagatgc

SEQ ID NO: 1155361 - DNA, 22 bp, Artificial Sequence
  chemically synthesized
aaccaaaatttgagatgcaaat

SEQ ID NO: 1155362 - DNA, 22 bp, Artificial Sequence
  chemically synthesized
aaataaccatcagcacttctca

SEQ ID NO: 1155363 - DNA, 22 bp, Artificial Sequence
  chemically synthesized
aaaataaccatcagcacttctc

SEQ ID NO: 1155364 - DNA, 22 bp, Artificial Sequence
  chemically synthesized
gagatgcaaatgagaagtgctg

SEQ ID NO: 1155365 - DNA, 22 bp, Artificial Sequence
  chemically synthesized
taaaataaccatcagcacttct

SEQ ID NO: 1155366 - DNA, 22 bp, Artificial Sequence
  chemically synthesized
agatgcaaatgagaagtgctga

SEQ ID NO: 1155367 - DNA, 22 bp, Artificial Sequence
  chemically synthesized
ctttaaaataaccatcagcact

SEQ ID NO: 1155368 - DNA, 22 bp, Artificial Sequence
  chemically synthesized
cctttaaaataaccatcagcac

SEQ ID NO: 1155369 - DNA, 22 bp, Artificial Sequence
  chemically synthesized
taaagagtatttcctttaaaat

SEQ ID NO: 1155370 - DNA, 22 bp, Artificial Sequence
  chemically synthesized
ataaagagtatttcctttaaaa

SEQ ID NO: 1155371 - DNA, 22 bp, Artificial Sequence
  chemically synthesized
atggttattttaaaggaaatac

SEQ ID NO: 1155372 - DNA, 22 bp, Artificial Sequence
  chemically synthesized
ttttaaaggaaatactctttat

SEQ ID NO: 1155373 - DNA, 22 bp, Artificial Sequence
  chemically synthesized
aacatgatgtttataaagagta

SEQ ID NO: 1155374 - DNA, 22 bp, Artificial Sequence
  chemically synthesized
aaacatgatgtttataaagagt

SEQ ID NO: 1155375 - DNA, 22 bp, Artificial Sequence
  chemically synthesized
taaacatgatgtttataaagag

SEQ ID NO: 1155376 - DNA, 22 bp, Artificial Sequence
  chemically synthesized
taaaggaaatactctttataaa

SEQ ID NO: 1155377 - DNA, 22 bp, Artificial Sequence
  chemically synthesized
aaaggaaatactctttataaac

SEQ ID NO: 1155378 - DNA, 22 bp, Artificial Sequence
  chemically synthesized
aaggaaatactctttataaaca

SEQ ID NO: 1155379 - DNA, 22 bp, Artificial Sequence
  chemically synthesized
aaaaatgctttaaacatgatgt

SEQ ID NO: 1155380 - DNA, 22 bp, Artificial Sequence
  chemically synthesized
gaaaaatgctttaaacatgatg

SEQ ID NO: 1155381 - DNA, 22 bp, Artificial Sequence
  chemically synthesized
tgaaaaatgctttaaacatgat

SEQ ID NO: 1155382 - DNA, 22 bp, Artificial Sequence
  chemically synthesized
tttataaacatcatgtttaaag

SEQ ID NO: 1155383 - DNA, 22 bp, Artificial Sequence
  chemically synthesized
tataaacatcatgtttaaagca

SEQ ID NO: 1155384 - DNA, 22 bp, Artificial Sequence
  chemically synthesized
ataaacatcatgtttaaagcat

SEQ ID NO: 1155385 - DNA, 22 bp, Artificial Sequence
  chemically synthesized
taaacatcatgtttaaagcatt

SEQ ID NO: 1155386 - DNA, 22 bp, Artificial Sequence
  chemically synthesized
agaatatagttttgaaaaatgc

SEQ ID NO: 1155387 - DNA, 22 bp, Artificial Sequence
  chemically synthesized
aaagcatttttcaaaactatat

SEQ ID NO: 1155388 - DNA, 22 bp, Artificial Sequence
  chemically synthesized
aagcatttttcaaaactatatt

SEQ ID NO: 1155389 - DNA, 22 bp, Artificial Sequence
  chemically synthesized
taagatcaatgttcagaatata

SEQ ID NO: 1155390 - DNA, 22 bp, Artificial Sequence
  chemically synthesized
ttcaaaactatattctgaacat

SEQ ID NO: 1155391 - DNA, 22 bp, Artificial Sequence
  chemically synthesized
tcaaaactatattctgaacatt

SEQ ID NO: 1155392 - DNA, 22 bp, Artificial Sequence
  chemically synthesized
caaaactatattctgaacattg

SEQ ID NO: 1155393 - DNA, 22 bp, Artificial Sequence
  chemically synthesized
aaattataagatcaatgttcag

SEQ ID NO: 1155394 - DNA, 22 bp, Artificial Sequence
  chemically synthesized
aaaactatattctgaacattga

SEQ ID NO: 1155395 - DNA, 22 bp, Artificial Sequence
  chemically synthesized
attcaaattataagatcaatgt

SEQ ID NO: 1155396 - DNA, 22 bp, Artificial Sequence
  chemically synthesized
ctaattcaaattataagatcaa

SEQ ID NO: 1155397 - DNA, 22 bp, Artificial Sequence
  chemically synthesized
tattctgaacattgatcttata

SEQ ID NO: 1155398 - DNA, 22 bp, Artificial Sequence
  chemically synthesized
tgaacattgatcttataatttg

SEQ ID NO: 1155399 - DNA, 22 bp, Artificial Sequence
  chemically synthesized
aacattgatcttataatttgaa

SEQ ID NO: 1155400 - DNA, 22 bp, Artificial Sequence
  chemically synthesized
aaaataacatattcctaattca

SEQ ID NO: 1155401 - DNA, 22 bp, Artificial Sequence
  chemically synthesized
atcttataatttgaattaggaa

SEQ ID NO: 1155402 - DNA, 22 bp, Artificial Sequence
  chemically synthesized
ataatttgaattaggaatatgt

SEQ ID NO: 1155403 - DNA, 22 bp, Artificial Sequence
  chemically synthesized
taatttgaattaggaatatgtt

SEQ ID NO: 1155404 - DNA, 22 bp, Artificial Sequence
  chemically synthesized
tgtattcaaaataacatattcc

SEQ ID NO: 1155405 - DNA, 22 bp, Artificial Sequence
  chemically synthesized
gaattaggaatatgttattttg

SEQ ID NO: 1155406 - DNA, 22 bp, Artificial Sequence
  chemically synthesized
aattaggaatatgttattttga

SEQ ID NO: 1155407 - DNA, 22 bp, Artificial Sequence
  chemically synthesized
gagtaaaattatgtattcaaaa

SEQ ID NO: 1155408 - DNA, 22 bp, Artificial Sequence
  chemically synthesized
ggaatatgttattttgaataca

SEQ ID NO: 1155409 - DNA, 22 bp, Artificial Sequence
  chemically synthesized
agagtaaaattatgtattcaaa

SEQ ID NO: 1155410 - DNA, 22 bp, Artificial Sequence
  chemically synthesized
tagagtaaaattatgtattcaa

SEQ ID NO: 1155411 - DNA, 22 bp, Artificial Sequence
  chemically synthesized
ttttgaatacataattttactc

SEQ ID NO: 1155412 - DNA, 22 bp, Artificial Sequence
  chemically synthesized
cagtaaagattttagagtaaaa

SEQ ID NO: 1155413 - DNA, 22 bp, Artificial Sequence
  chemically synthesized
tgaatacataattttactctaa

SEQ ID NO: 1155414 - DNA, 22 bp, Artificial Sequence
  chemically synthesized
ccagtaaagattttagagtaaa

SEQ ID NO: 1155415 - DNA, 22 bp, Artificial Sequence
  chemically synthesized
gaatacataattttactctaaa

SEQ ID NO: 1155416 - DNA, 22 bp, Artificial Sequence
  chemically synthesized
aatacataattttactctaaaa

SEQ ID NO: 1155417 - DNA, 22 bp, Artificial Sequence
  chemically synthesized
atggaaacttccagtaaagatt

SEQ ID NO: 1155418 - DNA, 22 bp, Artificial Sequence
  chemically synthesized
tactctaaaatctttactggaa

SEQ ID NO: 1155419 - DNA, 22 bp, Artificial Sequence
  chemically synthesized
actctaaaatctttactggaag

SEQ ID NO: 1155420 - DNA, 22 bp, Artificial Sequence
  chemically synthesized
ctctaaaatctttactggaagt

SEQ ID NO: 1155421 - DNA, 22 bp, Artificial Sequence
  chemically synthesized
taaaatctttactggaagtttc

SEQ ID NO: 1155422 - DNA, 22 bp, Artificial Sequence
  chemically synthesized
aaatctttactggaagtttcca

SEQ ID NO: 1155423 - DNA, 22 bp, Artificial Sequence
  chemically synthesized
aatgtgatgattaatggaaact

SEQ ID NO: 1155424 - DNA, 22 bp, Artificial Sequence
  chemically synthesized
aaatgtgatgattaatggaaac

SEQ ID NO: 1155425 - DNA, 22 bp, Artificial Sequence
  chemically synthesized
tactggaagtttccattaatca

SEQ ID NO: 1155426 - DNA, 22 bp, Artificial Sequence
  chemically synthesized
actggaagtttccattaatcat

SEQ ID NO: 1155427 - DNA, 22 bp, Artificial Sequence
  chemically synthesized
ctggaagtttccattaatcatc

SEQ ID NO: 1155428 - DNA, 22 bp, Artificial Sequence
  chemically synthesized
tgtgtttaaatgtgatgattaa

SEQ ID NO: 1155429 - DNA, 22 bp, Artificial Sequence
  chemically synthesized
gtgtgtttaaatgtgatgatta

SEQ ID NO: 1155430 - DNA, 22 bp, Artificial Sequence
  chemically synthesized
gaagtttccattaatcatcaca

SEQ ID NO: 1155431 - DNA, 22 bp, Artificial Sequence
  chemically synthesized
tgtgtgtttaaatgtgatgatt

SEQ ID NO: 1155432 - DNA, 22 bp, Artificial Sequence
  chemically synthesized
ccattaatcatcacatttaaac

SEQ ID NO: 1155433 - DNA, 22 bp, Artificial Sequence
  chemically synthesized
cattaatcatcacatttaaaca

SEQ ID NO: 1155434 - DNA, 22 bp, Artificial Sequence
  chemically synthesized
tgtgtgcactttgtgtgtttaa

SEQ ID NO: 1155435 - DNA, 22 bp, Artificial Sequence
  chemically synthesized
atcatcacatttaaacacacaa

SEQ ID NO: 1155436 - DNA, 22 bp, Artificial Sequence
  chemically synthesized
agctatgtgtgcactttgtgtg

SEQ ID NO: 1155437 - DNA, 22 bp, Artificial Sequence
  chemically synthesized
tcagctatgtgtgcactttgtg

SEQ ID NO: 1155438 - DNA, 22 bp, Artificial Sequence
  chemically synthesized
aaacacacaaagtgcacacata

SEQ ID NO: 1155439 - DNA, 22 bp, Artificial Sequence
  chemically synthesized
aacacacaaagtgcacacatag

SEQ ID NO: 1155440 - DNA, 22 bp, Artificial Sequence
  chemically synthesized
aaaaacactctcagctatgtgt

SEQ ID NO: 1155441 - DNA, 22 bp, Artificial Sequence
  chemically synthesized
ttaaaaaacactctcagctatg

SEQ ID NO: 1155442 - DNA, 22 bp, Artificial Sequence
  chemically synthesized
aatctgttaaaaaacactctca

SEQ ID NO: 1155443 - DNA, 22 bp, Artificial Sequence
  chemically synthesized
agagtgttttttaacagattta

SEQ ID NO: 1155444 - DNA, 22 bp, Artificial Sequence
  chemically synthesized
aaacagccaaaaaattaaatct

SEQ ID NO: 1155445 - DNA, 22 bp, Artificial Sequence
  chemically synthesized
tttaacagatttaattttttgg

SEQ ID NO: 1155446 - DNA, 22 bp, Artificial Sequence
  chemically synthesized
ttaacagatttaattttttggc

SEQ ID NO: 1155447 - DNA, 22 bp, Artificial Sequence
  chemically synthesized
taacagatttaattttttggct

SEQ ID NO: 1155448 - DNA, 22 bp, Artificial Sequence
  chemically synthesized
aacagatttaattttttggctg

SEQ ID NO: 1155449 - DNA, 22 bp, Artificial Sequence
  chemically synthesized
gtgaatctaaaacagccaaaaa

SEQ ID NO: 1155450 - DNA, 22 bp, Artificial Sequence
  chemically synthesized
acagatttaattttttggctgt

SEQ ID NO: 1155451 - DNA, 22 bp, Artificial Sequence
  chemically synthesized
cgtgaatctaaaacagccaaaa

SEQ ID NO: 1155452 - DNA, 22 bp, Artificial Sequence
  chemically synthesized
tcgtgaatctaaaacagccaaa

SEQ ID NO: 1155453 - DNA, 22 bp, Artificial Sequence
  chemically synthesized
ttcgtgaatctaaaacagccaa

SEQ ID NO: 1155454 - DNA, 22 bp, Artificial Sequence
  chemically synthesized
atttttcgtgaatctaaaacag

SEQ ID NO: 1155455 - DNA, 22 bp, Artificial Sequence
  chemically synthesized
aattttttggctgttttagatt

SEQ ID NO: 1155456 - DNA, 22 bp, Artificial Sequence
  chemically synthesized
attttttggctgttttagattc

SEQ ID NO: 1155457 - DNA, 22 bp, Artificial Sequence
  chemically synthesized
attaatttttcgtgaatctaaa

SEQ ID NO: 1155458 - DNA, 22 bp, Artificial Sequence
  chemically synthesized
tttggctgttttagattcacga

SEQ ID NO: 1155459 - DNA, 22 bp, Artificial Sequence
  chemically synthesized
ttggctgttttagattcacgaa

SEQ ID NO: 1155460 - DNA, 22 bp, Artificial Sequence
  chemically synthesized
tggctgttttagattcacgaaa

SEQ ID NO: 1155461 - DNA, 22 bp, Artificial Sequence
  chemically synthesized
ggctgttttagattcacgaaaa

SEQ ID NO: 1155462 - DNA, 22 bp, Artificial Sequence
  chemically synthesized
gctgttttagattcacgaaaaa

SEQ ID NO: 1155463 - DNA, 22 bp, Artificial Sequence
  chemically synthesized
taatctcattaatttttcgtga

SEQ ID NO: 1155464 - DNA, 22 bp, Artificial Sequence
  chemically synthesized
ttttagattcacgaaaaattaa

SEQ ID NO: 1155465 - DNA, 22 bp, Artificial Sequence
  chemically synthesized
tattataatctcattaattttt

SEQ ID NO: 1155466 - DNA, 22 bp, Artificial Sequence
  chemically synthesized
gtattataatctcattaatttt

SEQ ID NO: 1155467 - DNA, 22 bp, Artificial Sequence
  chemically synthesized
tagattcacgaaaaattaatga

SEQ ID NO: 1155468 - DNA, 22 bp, Artificial Sequence
  chemically synthesized
tgtattataatctcattaattt

SEQ ID NO: 1155469 - DNA, 22 bp, Artificial Sequence
  chemically synthesized
agattcacgaaaaattaatgag

SEQ ID NO: 1155470 - DNA, 22 bp, Artificial Sequence
  chemically synthesized
gattcacgaaaaattaatgaga

SEQ ID NO: 1155471 - DNA, 22 bp, Artificial Sequence
  chemically synthesized
tttgtattataatctcattaat

SEQ ID NO: 1155472 - DNA, 22 bp, Artificial Sequence
  chemically synthesized
acgaaaaattaatgagattata

SEQ ID NO: 1155473 - DNA, 22 bp, Artificial Sequence
  chemically synthesized
tatgataactctttgtattata

SEQ ID NO: 1155474 - DNA, 22 bp, Artificial Sequence
  chemically synthesized
atgagattataatacaaagagt

SEQ ID NO: 1155475 - DNA, 22 bp, Artificial Sequence
  chemically synthesized
agtgcaagttatatgataactc

SEQ ID NO: 1155476 - DNA, 22 bp, Artificial Sequence
  chemically synthesized
taatacaaagagttatcatata

SEQ ID NO: 1155477 - DNA, 22 bp, Artificial Sequence
  chemically synthesized
ataaaacgggagactgagtgca

SEQ ID NO: 1155478 - DNA, 22 bp, Artificial Sequence
  chemically synthesized
tcatataacttgcactcagtct

SEQ ID NO: 1155479 - DNA, 22 bp, Artificial Sequence
  chemically synthesized
gcactcagtctcccgttttatt

SEQ ID NO: 1155480 - DNA, 22 bp, Artificial Sequence
  chemically synthesized
cactcagtctcccgttttatta

SEQ ID NO: 1155481 - DNA, 22 bp, Artificial Sequence
  chemically synthesized
agtctcccgttttattaacatc

SEQ ID NO: 1155482 - DNA, 22 bp, Artificial Sequence
  chemically synthesized
cataataacataagatgttaat

SEQ ID NO: 1155483 - DNA, 22 bp, Artificial Sequence
  chemically synthesized
ccgttttattaacatcttatgt

SEQ ID NO: 1155484 - DNA, 22 bp, Artificial Sequence
  chemically synthesized
tattaacatcttatgttattat

SEQ ID NO: 1155485 - DNA, 22 bp, Artificial Sequence
  chemically synthesized
attaacatcttatgttattatg

SEQ ID NO: 1155486 - DNA, 22 bp, Artificial Sequence
  chemically synthesized
taagagatgttccataataaca

SEQ ID NO: 1155487 - DNA, 22 bp, Artificial Sequence
  chemically synthesized
ttaacatcttatgttattatgg

SEQ ID NO: 1155488 - DNA, 22 bp, Artificial Sequence
  chemically synthesized
acatcttatgttattatggaac

SEQ ID NO: 1155489 - DNA, 22 bp, Artificial Sequence
  chemically synthesized
attgtaagagatgttccataat

SEQ ID NO: 1155490 - DNA, 22 bp, Artificial Sequence
  chemically synthesized
attaattgtaagagatgttcca

SEQ ID NO: 1155491 - DNA, 22 bp, Artificial Sequence
  chemically synthesized
atgttattatggaacatctctt

SEQ ID NO: 1155492 - DNA, 22 bp, Artificial Sequence
  chemically synthesized
tgttattatggaacatctctta

SEQ ID NO: 1155493 - DNA, 22 bp, Artificial Sequence
  chemically synthesized
gttcattaattgtaagagatgt

SEQ ID NO: 1155494 - DNA, 22 bp, Artificial Sequence
  chemically synthesized
ttatggaacatctcttacaatt

SEQ ID NO: 1155495 - DNA, 22 bp, Artificial Sequence
  chemically synthesized
tggaacatctcttacaattaat

SEQ ID NO: 1155496 - DNA, 22 bp, Artificial Sequence
  chemically synthesized
atgcacaaatattggttcatta

SEQ ID NO: 1155497 - DNA, 22 bp, Artificial Sequence
  chemically synthesized
ttacaattaatgaaccaatatt

SEQ ID NO: 1155498 - DNA, 22 bp, Artificial Sequence
  chemically synthesized
cagctaatgcacaaatattggt

SEQ ID NO: 1155499 - DNA, 22 bp, Artificial Sequence
  chemically synthesized
acaattaatgaaccaatatttg

SEQ ID NO: 1155500 - DNA, 22 bp, Artificial Sequence
  chemically synthesized
caattaatgaaccaatatttgt

SEQ ID NO: 1155501 - DNA, 22 bp, Artificial Sequence
  chemically synthesized
atgaaccaatatttgtgcatta

SEQ ID NO: 1155502 - DNA, 22 bp, Artificial Sequence
  chemically synthesized
gtgcattagctggagactatta

SEQ ID NO: 1155503 - DNA, 22 bp, Artificial Sequence
  chemically synthesized
tgcattagctggagactattat

SEQ ID NO: 1155504 - DNA, 22 bp, Artificial Sequence
  chemically synthesized
aggaaatcagaatataataata

SEQ ID NO: 1155505 - DNA, 22 bp, Artificial Sequence
  chemically synthesized
aaggaaatcagaatataataat

SEQ ID NO: 1155506 - DNA, 22 bp, Artificial Sequence
  chemically synthesized
gctggagactattattatattc

SEQ ID NO: 1155507 - DNA, 22 bp, Artificial Sequence
  chemically synthesized
gagactattattatattctgat

SEQ ID NO: 1155508 - DNA, 22 bp, Artificial Sequence
  chemically synthesized
ttattatattctgatttcctta

SEQ ID NO: 1155509 - DNA, 22 bp, Artificial Sequence
  chemically synthesized
ttatattctgatttccttaaac

SEQ ID NO: 1155510 - DNA, 22 bp, Artificial Sequence
  chemically synthesized
aaatacaaaaaatagtttaagg

SEQ ID NO: 1155511 - DNA, 22 bp, Artificial Sequence
  chemically synthesized
tattctgatttccttaaactat

SEQ ID NO: 1155512 - DNA, 22 bp, Artificial Sequence
  chemically synthesized
tgatttccttaaactatttttt

SEQ ID NO: 1155513 - DNA, 22 bp, Artificial Sequence
  chemically synthesized
atttccttaaactattttttgt

SEQ ID NO: 1155514 - DNA, 22 bp, Artificial Sequence
  chemically synthesized
gagagatactgaaatacaaaaa

SEQ ID NO: 1155515 - DNA, 22 bp, Artificial Sequence
  chemically synthesized
ccttaaactattttttgtattt

SEQ ID NO: 1155516 - DNA, 22 bp, Artificial Sequence
  chemically synthesized
ggagagatactgaaatacaaaa

SEQ ID NO: 1155517 - DNA, 22 bp, Artificial Sequence
  chemically synthesized
cttaaactattttttgtatttc

SEQ ID NO: 1155518 - DNA, 22 bp, Artificial Sequence
  chemically synthesized
aaactattttttgtatttcagt

SEQ ID NO: 1155519 - DNA, 22 bp, Artificial Sequence
  chemically synthesized
aactattttttgtatttcagta

SEQ ID NO: 1155520 - DNA, 22 bp, Artificial Sequence
  chemically synthesized
ttttttgtatttcagtatctct

SEQ ID NO: 1155521 - DNA, 22 bp, Artificial Sequence
  chemically synthesized
tttgtatttcagtatctctcca

SEQ ID NO: 1155522 - DNA, 22 bp, Artificial Sequence
  chemically synthesized
ttgtatttcagtatctctccaa

SEQ ID NO: 1155523 - DNA, 22 bp, Artificial Sequence
  chemically synthesized
tgtatttcagtatctctccaag

SEQ ID NO: 1155524 - DNA, 22 bp, Artificial Sequence
  chemically synthesized
gtatttcagtatctctccaagg

SEQ ID NO: 1155525 - DNA, 22 bp, Artificial Sequence
  chemically synthesized
tatttcagtatctctccaagga

SEQ ID NO: 1155526 - DNA, 22 bp, Artificial Sequence
  chemically synthesized
agtgtaatatggaatccttgga

SEQ ID NO: 1155527 - DNA, 22 bp, Artificial Sequence
  chemically synthesized
cagtatctctccaaggattcca

SEQ ID NO: 1155528 - DNA, 22 bp, Artificial Sequence
  chemically synthesized
agtatctctccaaggattccat

SEQ ID NO: 1155529 - DNA, 22 bp, Artificial Sequence
  chemically synthesized
tccaaggattccatattacact

SEQ ID NO: 1155530 - DNA, 22 bp, Artificial Sequence
  chemically synthesized
caaggattccatattacactca

SEQ ID NO: 1155531 - DNA, 22 bp, Artificial Sequence
  chemically synthesized
aggaaacaggacaattgagtgt

SEQ ID NO: 1155532 - DNA, 22 bp, Artificial Sequence
  chemically synthesized
catattacactcaattgtcctg

SEQ ID NO: 1155533 - DNA, 22 bp, Artificial Sequence
  chemically synthesized
cactcaattgtcctgtttcctt

SEQ ID NO: 1155534 - DNA, 22 bp, Artificial Sequence
  chemically synthesized
aattgtcctgtttccttaatct

SEQ ID NO: 1155535 - DNA, 22 bp, Artificial Sequence
  chemically synthesized
tcatagccaaaagcagattaag

SEQ ID NO: 1155536 - DNA, 22 bp, Artificial Sequence
  chemically synthesized
tcctgtttccttaatctgcttt

SEQ ID NO: 1155537 - DNA, 22 bp, Artificial Sequence
  chemically synthesized
tttccttaatctgcttttggct

SEQ ID NO: 1155538 - DNA, 22 bp, Artificial Sequence
  chemically synthesized
agaaactgtcatagccaaaagc

SEQ ID NO: 1155539 - DNA, 22 bp, Artificial Sequence
  chemically synthesized
tgagaaactgtcatagccaaaa

SEQ ID NO: 1155540 - DNA, 22 bp, Artificial Sequence
  chemically synthesized
ccttaatctgcttttggctatg

SEQ ID NO: 1155541 - DNA, 22 bp, Artificial Sequence
  chemically synthesized
cttaatctgcttttggctatga

SEQ ID NO: 1155542 - DNA, 22 bp, Artificial Sequence
  chemically synthesized
aatctgcttttggctatgacag

SEQ ID NO: 1155543 - DNA, 22 bp, Artificial Sequence
  chemically synthesized
atctgcttttggctatgacagt

SEQ ID NO: 1155544 - DNA, 22 bp, Artificial Sequence
  chemically synthesized
cttttggctatgacagtttctc

SEQ ID NO: 1155545 - DNA, 22 bp, Artificial Sequence
  chemically synthesized
ccagaaaaattctgagaaactg

SEQ ID NO: 1155546 - DNA, 22 bp, Artificial Sequence
  chemically synthesized
ttggctatgacagtttctcaga

SEQ ID NO: 1155547 - DNA, 22 bp, Artificial Sequence
  chemically synthesized
tggctatgacagtttctcagaa

SEQ ID NO: 1155548 - DNA, 22 bp, Artificial Sequence
  chemically synthesized
ggctatgacagtttctcagaat

SEQ ID NO: 1155549 - DNA, 22 bp, Artificial Sequence
  chemically synthesized
gctatgacagtttctcagaatt

SEQ ID NO: 1155550 - DNA, 22 bp, Artificial Sequence
  chemically synthesized
aaaactgccagaaaaattctga

SEQ ID NO: 1155551 - DNA, 22 bp, Artificial Sequence
  chemically synthesized
aaaaactgccagaaaaattctg

SEQ ID NO: 1155552 - DNA, 22 bp, Artificial Sequence
  chemically synthesized
tgacagtttctcagaatttttc

SEQ ID NO: 1155553 - DNA, 22 bp, Artificial Sequence
  chemically synthesized
taaaaactgccagaaaaattct

SEQ ID NO: 1155554 - DNA, 22 bp, Artificial Sequence
  chemically synthesized
ttaaaaactgccagaaaaattc

SEQ ID NO: 1155555 - DNA, 22 bp, Artificial Sequence
  chemically synthesized
ctcagaatttttctggcagttt

SEQ ID NO: 1155556 - DNA, 22 bp, Artificial Sequence
  chemically synthesized
tcagaatttttctggcagtttt

SEQ ID NO: 1155557 - DNA, 22 bp, Artificial Sequence
  chemically synthesized
gccagcacttttaaaaactgcc

SEQ ID NO: 1155558 - DNA, 22 bp, Artificial Sequence
  chemically synthesized
agaatttttctggcagttttta

SEQ ID NO: 1155559 - DNA, 22 bp, Artificial Sequence
  chemically synthesized
ttctggcagtttttaaaagtgc

SEQ ID NO: 1155560 - DNA, 22 bp, Artificial Sequence
  chemically synthesized
tctggcagtttttaaaagtgct

SEQ ID NO: 1155561 - DNA, 22 bp, Artificial Sequence
  chemically synthesized
ctggcagtttttaaaagtgctg

SEQ ID NO: 1155562 - DNA, 22 bp, Artificial Sequence
  chemically synthesized
tggcagtttttaaaagtgctgg

SEQ ID NO: 1155563 - DNA, 22 bp, Artificial Sequence
  chemically synthesized
gcagtttttaaaagtgctggcc

SEQ ID NO: 1155564 - DNA, 22 bp, Artificial Sequence
  chemically synthesized
caaaataccagcctggccagca

SEQ ID NO: 1155565 - DNA, 22 bp, Artificial Sequence
  chemically synthesized
ttaaaagtgctggccaggctgg

SEQ ID NO: 1155566 - DNA, 22 bp, Artificial Sequence
  chemically synthesized
taaaagtgctggccaggctggt

SEQ ID NO: 1155567 - DNA, 22 bp, Artificial Sequence
  chemically synthesized
aaaagtgctggccaggctggta

SEQ ID NO: 1155568 - DNA, 22 bp, Artificial Sequence
  chemically synthesized
aaagtgctggccaggctggtat

SEQ ID NO: 1155569 - DNA, 22 bp, Artificial Sequence
  chemically synthesized
agaggcatactacaaaatacca

SEQ ID NO: 1155570 - DNA, 22 bp, Artificial Sequence
  chemically synthesized
gccaggctggtattttgtagta

SEQ ID NO: 1155571 - DNA, 22 bp, Artificial Sequence
  chemically synthesized
gtattttgtagtatgcctctca

SEQ ID NO: 1155572 - DNA, 22 bp, Artificial Sequence
  chemically synthesized
tgtagtatgcctctcagtgggg

SEQ ID NO: 1155573 - DNA, 22 bp, Artificial Sequence
  chemically synthesized
gtagtatgcctctcagtgggga

SEQ ID NO: 1155574 - DNA, 22 bp, Artificial Sequence
  chemically synthesized
tagtatgcctctcagtggggat

SEQ ID NO: 1155575 - DNA, 22 bp, Artificial Sequence
  chemically synthesized
tgaggaaaaaaaatcagacaaa

SEQ ID NO: 1155576 - DNA, 22 bp, Artificial Sequence
  chemically synthesized
tcagtggggatttgtctgattt

SEQ ID NO: 1155577 - DNA, 22 bp, Artificial Sequence
  chemically synthesized
agtggggatttgtctgattttt

SEQ ID NO: 1155578 - DNA, 22 bp, Artificial Sequence
  chemically synthesized
attatgaggaaaaaaaatcaga

SEQ ID NO: 1155579 - DNA, 22 bp, Artificial Sequence
  chemically synthesized
aattatgaggaaaaaaaatcag

SEQ ID NO: 1155580 - DNA, 22 bp, Artificial Sequence
  chemically synthesized
gtctgattttttttcctcataa

SEQ ID NO: 1155581 - DNA, 22 bp, Artificial Sequence
  chemically synthesized
tctgattttttttcctcataat

SEQ ID NO: 1155582 - DNA, 22 bp, Artificial Sequence
  chemically synthesized
aaaaaccccagtttaattatga

SEQ ID NO: 1155583 - DNA, 22 bp, Artificial Sequence
  chemically synthesized
attttttttcctcataattaaa

SEQ ID NO: 1155584 - DNA, 22 bp, Artificial Sequence
  chemically synthesized
caaaaaccccagtttaattatg

SEQ ID NO: 1155585 - DNA, 22 bp, Artificial Sequence
  chemically synthesized
tcaaaaaccccagtttaattat

SEQ ID NO: 1155586 - DNA, 22 bp, Artificial Sequence
  chemically synthesized
tttttcctcataattaaactgg

SEQ ID NO: 1155587 - DNA, 22 bp, Artificial Sequence
  chemically synthesized
ttttcctcataattaaactggg

SEQ ID NO: 1155588 - DNA, 22 bp, Artificial Sequence
  chemically synthesized
tttcctcataattaaactgggg

SEQ ID NO: 1155589 - DNA, 22 bp, Artificial Sequence
  chemically synthesized
ttcctcataattaaactggggt

SEQ ID NO: 1155590 - DNA, 22 bp, Artificial Sequence
  chemically synthesized
tcctcataattaaactggggtt

SEQ ID NO: 1155591 - DNA, 22 bp, Artificial Sequence
  chemically synthesized
tggtctttcaaaaaccccagtt

SEQ ID NO: 1155592 - DNA, 22 bp, Artificial Sequence
  chemically synthesized
cctcataattaaactggggttt

SEQ ID NO: 1155593 - DNA, 22 bp, Artificial Sequence
  chemically synthesized
ctcataattaaactggggtttt

SEQ ID NO: 1155594 - DNA, 22 bp, Artificial Sequence
  chemically synthesized
tgtggtctttcaaaaaccccag

SEQ ID NO: 1155595 - DNA, 22 bp, Artificial Sequence
  chemically synthesized
ctgtggtctttcaaaaacccca

SEQ ID NO: 1155596 - DNA, 22 bp, Artificial Sequence
  chemically synthesized
ataattaaactggggtttttga

SEQ ID NO: 1155597 - DNA, 22 bp, Artificial Sequence
  chemically synthesized
cttctgtggtctttcaaaaacc

SEQ ID NO: 1155598 - DNA, 22 bp, Artificial Sequence
  chemically synthesized
aactggggtttttgaaagacca

SEQ ID NO: 1155599 - DNA, 22 bp, Artificial Sequence
  chemically synthesized
gggtttttgaaagaccacagaa

SEQ ID NO: 1155600 - DNA, 22 bp, Artificial Sequence
  chemically synthesized
aaatggcccattacttctgtgg

SEQ ID NO: 1155601 - DNA, 22 bp, Artificial Sequence
  chemically synthesized
aaaatggcccattacttctgtg

SEQ ID NO: 1155602 - DNA, 22 bp, Artificial Sequence
  chemically synthesized
ttgaaagaccacagaagtaatg

SEQ ID NO: 1155603 - DNA, 22 bp, Artificial Sequence
  chemically synthesized
tgaaagaccacagaagtaatgg

SEQ ID NO: 1155604 - DNA, 22 bp, Artificial Sequence
  chemically synthesized
gaaagaccacagaagtaatggg

SEQ ID NO: 1155605 - DNA, 22 bp, Artificial Sequence
  chemically synthesized
aaagaccacagaagtaatgggc

SEQ ID NO: 1155606 - DNA, 22 bp, Artificial Sequence
  chemically synthesized
taaaatgtgcttaaaatggccc

SEQ ID NO: 1155607 - DNA, 22 bp, Artificial Sequence
  chemically synthesized
ataaaatgtgcttaaaatggcc

SEQ ID NO: 1155608 - DNA, 22 bp, Artificial Sequence
  chemically synthesized
tataaaatgtgcttaaaatggc

SEQ ID NO: 1155609 - DNA, 22 bp, Artificial Sequence
  chemically synthesized
agggtatatatgctttataaaa

SEQ ID NO: 1155610 - DNA, 22 bp, Artificial Sequence
  chemically synthesized
taagcacattttataaagcata

SEQ ID NO: 1155611 - DNA, 22 bp, Artificial Sequence
  chemically synthesized
aagcacattttataaagcatat

SEQ ID NO: 1155612 - DNA, 22 bp, Artificial Sequence
  chemically synthesized
agcacattttataaagcatata

SEQ ID NO: 1155613 - DNA, 22 bp, Artificial Sequence
  chemically synthesized
ataagtcacgttgagggtatat

SEQ ID NO: 1155614 - DNA, 22 bp, Artificial Sequence
  chemically synthesized
tataaagcatatataccctcaa

SEQ ID NO: 1155615 - DNA, 22 bp, Artificial Sequence
  chemically synthesized
ataaagcatatataccctcaac

SEQ ID NO: 1155616 - DNA, 22 bp, Artificial Sequence
  chemically synthesized
taaagcatatataccctcaacg

SEQ ID NO: 1155617 - DNA, 22 bp, Artificial Sequence
  chemically synthesized
acattgataagtcacgttgagg

SEQ ID NO: 1155618 - DNA, 22 bp, Artificial Sequence
  chemically synthesized
aacattgataagtcacgttgag

SEQ ID NO: 1155619 - DNA, 22 bp, Artificial Sequence
  chemically synthesized
aacgtgacttatcaatgttaaa

SEQ ID NO: 1155620 - DNA, 22 bp, Artificial Sequence
  chemically synthesized
gccaggtggtcacatttaacat

SEQ ID NO: 1155621 - DNA, 22 bp, Artificial Sequence
  chemically synthesized
agccaggtggtcacatttaaca

SEQ ID NO: 1155622 - DNA, 22 bp, Artificial Sequence
  chemically synthesized
tagccaggtggtcacatttaac

SEQ ID NO: 1155623 - DNA, 22 bp, Artificial Sequence
  chemically synthesized
ctttagccaggtggtcacattt

SEQ ID NO: 1155624 - DNA, 22 bp, Artificial Sequence
  chemically synthesized
atcaatgttaaatgtgaccacc

SEQ ID NO: 1155625 - DNA, 22 bp, Artificial Sequence
  chemically synthesized
ttactttagccaggtggtcaca

SEQ ID NO: 1155626 - DNA, 22 bp, Artificial Sequence
  chemically synthesized
tcaatgttaaatgtgaccacct

SEQ ID NO: 1155627 - DNA, 22 bp, Artificial Sequence
  chemically synthesized
aatgtgaccacctggctaaagt

SEQ ID NO: 1155628 - DNA, 22 bp, Artificial Sequence
  chemically synthesized
tagtggataaacatgacaccta

SEQ ID NO: 1155629 - DNA, 22 bp, Artificial Sequence
  chemically synthesized
atagtggataaacatgacacct

SEQ ID NO: 1155630 - DNA, 22 bp, Artificial Sequence
  chemically synthesized
gctaaagtaataggtgtcatgt

SEQ ID NO: 1155631 - DNA, 22 bp, Artificial Sequence
  chemically synthesized
tatagtggataaacatgacacc

SEQ ID NO: 1155632 - DNA, 22 bp, Artificial Sequence
  chemically synthesized
aagtaataggtgtcatgtttat

SEQ ID NO: 1155633 - DNA, 22 bp, Artificial Sequence
  chemically synthesized
atccactataaagttactcttt

SEQ ID NO: 1155634 - DNA, 22 bp, Artificial Sequence
  chemically synthesized
tccactataaagttactctttc

SEQ ID NO: 1155635 - DNA, 22 bp, Artificial Sequence
  chemically synthesized
taaagttactctttccccctct

SEQ ID NO: 1155636 - DNA, 22 bp, Artificial Sequence
  chemically synthesized
aaaaacagtgtgaaaagagggg

SEQ ID NO: 1155637 - DNA, 22 bp, Artificial Sequence
  chemically synthesized
ttaaaaaacagtgtgaaaagag

SEQ ID NO: 1155638 - DNA, 22 bp, Artificial Sequence
  chemically synthesized
attaaaaaacagtgtgaaaaga

SEQ ID NO: 1155639 - DNA, 22 bp, Artificial Sequence
  chemically synthesized
ctctttccccctcttttcacac

SEQ ID NO: 1155640 - DNA, 22 bp, Artificial Sequence
  chemically synthesized
ttattaaaaaacagtgtgaaaa

SEQ ID NO: 1155641 - DNA, 22 bp, Artificial Sequence
  chemically synthesized
cttattaaaaaacagtgtgaaa

SEQ ID NO: 1155642 - DNA, 22 bp, Artificial Sequence
  chemically synthesized
tttccccctcttttcacactgt

SEQ ID NO: 1155643 - DNA, 22 bp, Artificial Sequence
  chemically synthesized
tcttattaaaaaacagtgtgaa

SEQ ID NO: 1155644 - DNA, 22 bp, Artificial Sequence
  chemically synthesized
tccccctcttttcacactgttt

SEQ ID NO: 1155645 - DNA, 22 bp, Artificial Sequence
  chemically synthesized
ccccctcttttcacactgtttt

SEQ ID NO: 1155646 - DNA, 22 bp, Artificial Sequence
  chemically synthesized
cccctcttttcacactgttttt

SEQ ID NO: 1155647 - DNA, 22 bp, Artificial Sequence
  chemically synthesized
ttttcacactgttttttaataa

SEQ ID NO: 1155648 - DNA, 22 bp, Artificial Sequence
  chemically synthesized
ttcacactgttttttaataaga

SEQ ID NO: 1155649 - DNA, 22 bp, Artificial Sequence
  chemically synthesized
tcacactgttttttaataagaa

SEQ ID NO: 1155650 - DNA, 22 bp, Artificial Sequence
  chemically synthesized
tgtatagtgactttcttattaa

SEQ ID NO: 1155651 - DNA, 22 bp, Artificial Sequence
  chemically synthesized
cacactgttttttaataagaaa

SEQ ID NO: 1155652 - DNA, 22 bp, Artificial Sequence
  chemically synthesized
acactgttttttaataagaaag

SEQ ID NO: 1155653 - DNA, 22 bp, Artificial Sequence
  chemically synthesized
ttttttaataagaaagtcacta

SEQ ID NO: 1155654 - DNA, 22 bp, Artificial Sequence
  chemically synthesized
tttaataagaaagtcactatac

SEQ ID NO: 1155655 - DNA, 22 bp, Artificial Sequence
  chemically synthesized
cacaggggctgtgtatagtgac

SEQ ID NO: 1155656 - DNA, 22 bp, Artificial Sequence
  chemically synthesized
ttaataagaaagtcactataca

SEQ ID NO: 1155657 - DNA, 22 bp, Artificial Sequence
  chemically synthesized
taataagaaagtcactatacac

SEQ ID NO: 1155658 - DNA, 22 bp, Artificial Sequence
  chemically synthesized
aataagaaagtcactatacaca

SEQ ID NO: 1155659 - DNA, 22 bp, Artificial Sequence
  chemically synthesized
ataagaaagtcactatacacag

SEQ ID NO: 1155660 - DNA, 22 bp, Artificial Sequence
  chemically synthesized
cccactccacaggggctgtgta

SEQ ID NO: 1155661 - DNA, 22 bp, Artificial Sequence
  chemically synthesized
tacacagcccctgtggagtggg

SEQ ID NO: 1155662 - DNA, 22 bp, Artificial Sequence
  chemically synthesized
acggagagggaatgtaactccc

SEQ ID NO: 1155663 - DNA, 22 bp, Artificial Sequence
  chemically synthesized
tggagtggggagttacattccc

SEQ ID NO: 1155664 - DNA, 22 bp, Artificial Sequence
  chemically synthesized
ccctcacggagagggaatgtaa

SEQ ID NO: 1155665 - DNA, 22 bp, Artificial Sequence
  chemically synthesized
tgccctcacggagagggaatgt

SEQ ID NO: 1155666 - DNA, 22 bp, Artificial Sequence
  chemically synthesized
tctgccctcacggagagggaat

SEQ ID NO: 1155667 - DNA, 22 bp, Artificial Sequence
  chemically synthesized
ctctgccctcacggagagggaa

SEQ ID NO: 1155668 - DNA, 22 bp, Artificial Sequence
  chemically synthesized
tgtaacttctctgccctcacgg

SEQ ID NO: 1155669 - DNA, 22 bp, Artificial Sequence
  chemically synthesized
atgtaacttctctgccctcacg

SEQ ID NO: 1155670 - DNA, 22 bp, Artificial Sequence
  chemically synthesized
cattccctctccgtgagggcag

SEQ ID NO: 1155671 - DNA, 22 bp, Artificial Sequence
  chemically synthesized
cctctccgtgagggcagagaag

SEQ ID NO: 1155672 - DNA, 22 bp, Artificial Sequence
  chemically synthesized
caaaaacttatgtaacttctct

SEQ ID NO: 1155673 - DNA, 22 bp, Artificial Sequence
  chemically synthesized
tccgtgagggcagagaagttac

SEQ ID NO: 1155674 - DNA, 22 bp, Artificial Sequence
  chemically synthesized
cgtgagggcagagaagttacat

SEQ ID NO: 1155675 - DNA, 22 bp, Artificial Sequence
  chemically synthesized
caatgcagaaaaaactccaaaa

SEQ ID NO: 1155676 - DNA, 22 bp, Artificial Sequence
  chemically synthesized
cataagtttttggagttttttc

SEQ ID NO: 1155677 - DNA, 22 bp, Artificial Sequence
  chemically synthesized
ttggagttttttctgcattgga

SEQ ID NO: 1155678 - DNA, 22 bp, Artificial Sequence
  chemically synthesized
tggagttttttctgcattggag

SEQ ID NO: 1155679 - DNA, 22 bp, Artificial Sequence
  chemically synthesized
ggagttttttctgcattggaga

SEQ ID NO: 1155680 - DNA, 22 bp, Artificial Sequence
  chemically synthesized
gagttttttctgcattggagat

SEQ ID NO: 1155681 - DNA, 22 bp, Artificial Sequence
  chemically synthesized
tttctgcattggagatttgtct

SEQ ID NO: 1155682 - DNA, 22 bp, Artificial Sequence
  chemically synthesized
ttctgcattggagatttgtctc

SEQ ID NO: 1155683 - DNA, 22 bp, Artificial Sequence
  chemically synthesized
tctgcattggagatttgtctct

SEQ ID NO: 1155684 - DNA, 22 bp, Artificial Sequence
  chemically synthesized
ctgcattggagatttgtctcta

SEQ ID NO: 1155685 - DNA, 22 bp, Artificial Sequence
  chemically synthesized
tgcattggagatttgtctctat

SEQ ID NO: 1155686 - DNA, 22 bp, Artificial Sequence
  chemically synthesized
cattggagatttgtctctattc

SEQ ID NO: 1155687 - DNA, 22 bp, Artificial Sequence
  chemically synthesized
ataaataaatggaggaatagag

SEQ ID NO: 1155688 - DNA, 22 bp, Artificial Sequence
  chemically synthesized
cataaataaatggaggaataga

SEQ ID NO: 1155689 - DNA, 22 bp, Artificial Sequence
  chemically synthesized
gagatttgtctctattcctcca

SEQ ID NO: 1155690 - DNA, 22 bp, Artificial Sequence
  chemically synthesized
gtctctattcctccatttattt

SEQ ID NO: 1155691 - DNA, 22 bp, Artificial Sequence
  chemically synthesized
tctctattcctccatttattta

SEQ ID NO: 1155692 - DNA, 22 bp, Artificial Sequence
  chemically synthesized
tattcctccatttatttatgaa

SEQ ID NO: 1155693 - DNA, 22 bp, Artificial Sequence
  chemically synthesized
ttcctccatttatttatgaaat

SEQ ID NO: 1155694 - DNA, 22 bp, Artificial Sequence
  chemically synthesized
tgtaaataaataatttcataaa

SEQ ID NO: 1155695 - DNA, 22 bp, Artificial Sequence
  chemically synthesized
ctccatttatttatgaaattat

SEQ ID NO: 1155696 - DNA, 22 bp, Artificial Sequence
  chemically synthesized
catttatttatgaaattattta

SEQ ID NO: 1155697 - DNA, 22 bp, Artificial Sequence
  chemically synthesized
atttatgaaattatttatttac

SEQ ID NO: 1155698 - DNA, 22 bp, Artificial Sequence
  chemically synthesized
tttatgaaattatttatttaca

SEQ ID NO: 1155699 - DNA, 22 bp, Artificial Sequence
  chemically synthesized
atgaaattatttatttacatag

SEQ ID NO: 1155700 - DNA, 22 bp, Artificial Sequence
  chemically synthesized
tgaaattatttatttacatagc

SEQ ID NO: 1155701 - DNA, 22 bp, Artificial Sequence
  chemically synthesized
tacatgagtccatgctatgtaa

SEQ ID NO: 1155702 - DNA, 22 bp, Artificial Sequence
  chemically synthesized
tttatttacatagcatggactc

SEQ ID NO: 1155703 - DNA, 22 bp, Artificial Sequence
  chemically synthesized
atttacatagcatggactcatg

SEQ ID NO: 1155704 - DNA, 22 bp, Artificial Sequence
  chemically synthesized
tttacatagcatggactcatgt

SEQ ID NO: 1155705 - DNA, 22 bp, Artificial Sequence
  chemically synthesized
acatagcatggactcatgtata

SEQ ID NO: 1155706 - DNA, 22 bp, Artificial Sequence
  chemically synthesized
catagcatggactcatgtatag

SEQ ID NO: 1155707 - DNA, 22 bp, Artificial Sequence
  chemically synthesized
gcccaaagtatcaaataactat

SEQ ID NO: 1155708 - DNA, 22 bp, Artificial Sequence
  chemically synthesized
agcccaaagtatcaaataacta

SEQ ID NO: 1155709 - DNA, 22 bp, Artificial Sequence
  chemically synthesized
gatttagcccaaagtatcaaat

SEQ ID NO: 1155710 - DNA, 22 bp, Artificial Sequence
  chemically synthesized
atgtatagttatttgatacttt

SEQ ID NO: 1155711 - DNA, 22 bp, Artificial Sequence
  chemically synthesized
gtattggatttagcccaaagta

SEQ ID NO: 1155712 - DNA, 22 bp, Artificial Sequence
  chemically synthesized
tttgatactttgggctaaatcc

SEQ ID NO: 1155713 - DNA, 22 bp, Artificial Sequence
  chemically synthesized
gatactttgggctaaatccaat

SEQ ID NO: 1155714 - DNA, 22 bp, Artificial Sequence
  chemically synthesized
atactttgggctaaatccaata

SEQ ID NO: 1155715 - DNA, 22 bp, Artificial Sequence
  chemically synthesized
tgggctaaatccaatactagtt

SEQ ID NO: 1155716 - DNA, 22 bp, Artificial Sequence
  chemically synthesized
gggctaaatccaatactagttt

SEQ ID NO: 1155717 - DNA, 22 bp, Artificial Sequence
  chemically synthesized
ggctaaatccaatactagtttt

SEQ ID NO: 1155718 - DNA, 22 bp, Artificial Sequence
  chemically synthesized
aatccaatactagtttttgctt

SEQ ID NO: 1155719 - DNA, 22 bp, Artificial Sequence
  chemically synthesized
agcaaaaatccaaagcaaaaac

SEQ ID NO: 1155720 - DNA, 22 bp, Artificial Sequence
  chemically synthesized
gagcaaaaatccaaagcaaaaa

SEQ ID NO: 1155721 - DNA, 22 bp, Artificial Sequence
  chemically synthesized
tttgagcaaaaatccaaagcaa

SEQ ID NO: 1155722 - DNA, 22 bp, Artificial Sequence
  chemically synthesized
gaactatttgagcaaaaatcca

SEQ ID NO: 1155723 - DNA, 22 bp, Artificial Sequence
  chemically synthesized
gtttttgctttggatttttgct

SEQ ID NO: 1155724 - DNA, 22 bp, Artificial Sequence
  chemically synthesized
ttgctttggatttttgctcaaa

SEQ ID NO: 1155725 - DNA, 22 bp, Artificial Sequence
  chemically synthesized
tgctttggatttttgctcaaat

SEQ ID NO: 1155726 - DNA, 22 bp, Artificial Sequence
  chemically synthesized
gctttggatttttgctcaaata

SEQ ID NO: 1155727 - DNA, 22 bp, Artificial Sequence
  chemically synthesized
ctttggatttttgctcaaatag

SEQ ID NO: 1155728 - DNA, 22 bp, Artificial Sequence
  chemically synthesized
tggatttttgctcaaatagttc

SEQ ID NO: 1155729 - DNA, 22 bp, Artificial Sequence
  chemically synthesized
ggatttttgctcaaatagttcc

SEQ ID NO: 1155730 - DNA, 22 bp, Artificial Sequence
  chemically synthesized
gatttttgctcaaatagttcca

SEQ ID NO: 1155731 - DNA, 22 bp, Artificial Sequence
  chemically synthesized
ccaatgtccaaagctggaacta

SEQ ID NO: 1155732 - DNA, 22 bp, Artificial Sequence
  chemically synthesized
cccaatgtccaaagctggaact

SEQ ID NO: 1155733 - DNA, 22 bp, Artificial Sequence
  chemically synthesized
ttgctcaaatagttccagcttt

SEQ ID NO: 1155734 - DNA, 22 bp, Artificial Sequence
  chemically synthesized
tgctcaaatagttccagctttg

SEQ ID NO: 1155735 - DNA, 22 bp, Artificial Sequence
  chemically synthesized
gctcaaatagttccagctttgg

SEQ ID NO: 1155736 - DNA, 22 bp, Artificial Sequence
  chemically synthesized
ctcaaatagttccagctttgga

SEQ ID NO: 1155737 - DNA, 22 bp, Artificial Sequence
  chemically synthesized
aaatagttccagctttggacat

SEQ ID NO: 1155738 - DNA, 22 bp, Artificial Sequence
  chemically synthesized
agagacttcccaatgtccaaag

SEQ ID NO: 1155739 - DNA, 22 bp, Artificial Sequence
  chemically synthesized
cagctttggacattgggaagtc

SEQ ID NO: 1155740 - DNA, 22 bp, Artificial Sequence
  chemically synthesized
tggacattgggaagtctcttag

SEQ ID NO: 1155741 - DNA, 22 bp, Artificial Sequence
  chemically synthesized
ggacattgggaagtctcttagt

SEQ ID NO: 1155742 - DNA, 22 bp, Artificial Sequence
  chemically synthesized
gacattgggaagtctcttagtt

SEQ ID NO: 1155743 - DNA, 22 bp, Artificial Sequence
  chemically synthesized
ggaagtctcttagttggcttct

SEQ ID NO: 1155744 - DNA, 22 bp, Artificial Sequence
  chemically synthesized
atgggatgtgtcaaagaagcca

SEQ ID NO: 1155745 - DNA, 22 bp, Artificial Sequence
  chemically synthesized
ttagttggcttctttgacacat

SEQ ID NO: 1155746 - DNA, 22 bp, Artificial Sequence
  chemically synthesized
agttggcttctttgacacatcc

SEQ ID NO: 1155747 - DNA, 22 bp, Artificial Sequence
  chemically synthesized
gttggcttctttgacacatccc

SEQ ID NO: 1155748 - DNA, 22 bp, Artificial Sequence
  chemically synthesized
gcttctttgacacatcccatca

SEQ ID NO: 1155749 - DNA, 22 bp, Artificial Sequence
  chemically synthesized
aacaaaaaacactgatgggatg

SEQ ID NO: 1155750 - DNA, 22 bp, Artificial Sequence
  chemically synthesized
taaacaaaaaacactgatggga

SEQ ID NO: 1155751 - DNA, 22 bp, Artificial Sequence
  chemically synthesized
ctttgacacatcccatcagtgt

SEQ ID NO: 1155752 - DNA, 22 bp, Artificial Sequence
  chemically synthesized
tttgacacatcccatcagtgtt

SEQ ID NO: 1155753 - DNA, 22 bp, Artificial Sequence
  chemically synthesized
gctctaaacaaaaaacactgat

SEQ ID NO: 1155754 - DNA, 22 bp, Artificial Sequence
  chemically synthesized
tgacacatcccatcagtgtttt

SEQ ID NO: 1155755 - DNA, 22 bp, Artificial Sequence
  chemically synthesized
gacacatcccatcagtgttttt

SEQ ID NO: 1155756 - DNA, 22 bp, Artificial Sequence
  chemically synthesized
acacatcccatcagtgtttttt

SEQ ID NO: 1155757 - DNA, 22 bp, Artificial Sequence
  chemically synthesized
cacggtctcgctctaaacaaaa

SEQ ID NO: 1155758 - DNA, 22 bp, Artificial Sequence
  chemically synthesized
aactccacggtctcgctctaaa

SEQ ID NO: 1155759 - DNA, 22 bp, Artificial Sequence
  chemically synthesized
tttgtttagagcgagaccgtgg

SEQ ID NO: 1155760 - DNA, 22 bp, Artificial Sequence
  chemically synthesized
ttgtttagagcgagaccgtgga

SEQ ID NO: 1155761 - DNA, 22 bp, Artificial Sequence
  chemically synthesized
tgtttagagcgagaccgtggag

SEQ ID NO: 1155762 - DNA, 22 bp, Artificial Sequence
  chemically synthesized
gtttagagcgagaccgtggagt

SEQ ID NO: 1155763 - DNA, 22 bp, Artificial Sequence
  chemically synthesized
tttagagcgagaccgtggagtt

SEQ ID NO: 1155764 - DNA, 22 bp, Artificial Sequence
  chemically synthesized
agagcgagaccgtggagtttag

SEQ ID NO: 1155765 - DNA, 22 bp, Artificial Sequence
  chemically synthesized
gagcgagaccgtggagtttagc

SEQ ID NO: 1155766 - DNA, 22 bp, Artificial Sequence
  chemically synthesized
gtagtgccagatagtaagaaca

SEQ ID NO: 1155767 - DNA, 22 bp, Artificial Sequence
  chemically synthesized
ggtagtgccagatagtaagaac

SEQ ID NO: 1155768 - DNA, 22 bp, Artificial Sequence
  chemically synthesized
agcatgttcttactatctggca

SEQ ID NO: 1155769 - DNA, 22 bp, Artificial Sequence
  chemically synthesized
gcatgttcttactatctggcac

SEQ ID NO: 1155770 - DNA, 22 bp, Artificial Sequence
  chemically synthesized
gaacatttggtagtgccagata

SEQ ID NO: 1155771 - DNA, 22 bp, Artificial Sequence
  chemically synthesized
ttactatctggcactaccaaat

SEQ ID NO: 1155772 - DNA, 22 bp, Artificial Sequence
  chemically synthesized
actatctggcactaccaaatgt

SEQ ID NO: 1155773 - DNA, 22 bp, Artificial Sequence
  chemically synthesized
ctatctggcactaccaaatgtt

SEQ ID NO: 1155774 - DNA, 22 bp, Artificial Sequence
  chemically synthesized
tctggcactaccaaatgttcca

SEQ ID NO: 1155775 - DNA, 22 bp, Artificial Sequence
  chemically synthesized
gcactaccaaatgttccaggct

SEQ ID NO: 1155776 - DNA, 22 bp, Artificial Sequence
  chemically synthesized
ccaaatgttccaggctcatttt

SEQ ID NO: 1155777 - DNA, 22 bp, Artificial Sequence
  chemically synthesized
ggaaagggaatatagaaaatga

SEQ ID NO: 1155778 - DNA, 22 bp, Artificial Sequence
  chemically synthesized
acactaggaaagggaatataga

SEQ ID NO: 1155779 - DNA, 22 bp, Artificial Sequence
  chemically synthesized
caggctcattttctatattccc

SEQ ID NO: 1155780 - DNA, 22 bp, Artificial Sequence
  chemically synthesized
taacactaggaaagggaatata

SEQ ID NO: 1155781 - DNA, 22 bp, Artificial Sequence
  chemically synthesized
attctaacactaggaaagggaa

SEQ ID NO: 1155782 - DNA, 22 bp, Artificial Sequence
  chemically synthesized
attttctatattccctttccta

SEQ ID NO: 1155783 - DNA, 22 bp, Artificial Sequence
  chemically synthesized
tctatattccctttcctagtgt

SEQ ID NO: 1155784 - DNA, 22 bp, Artificial Sequence
  chemically synthesized
ctatattccctttcctagtgtt

SEQ ID NO: 1155785 - DNA, 22 bp, Artificial Sequence
  chemically synthesized
tatattccctttcctagtgtta

SEQ ID NO: 1155786 - DNA, 22 bp, Artificial Sequence
  chemically synthesized
tattccctttcctagtgttaga

SEQ ID NO: 1155787 - DNA, 22 bp, Artificial Sequence
  chemically synthesized
tggagaaacagctgattctaac

SEQ ID NO: 1155788 - DNA, 22 bp, Artificial Sequence
  chemically synthesized
cctttcctagtgttagaatcag

SEQ ID NO: 1155789 - DNA, 22 bp, Artificial Sequence
  chemically synthesized
tcctagtgttagaatcagctgt

SEQ ID NO: 1155790 - DNA, 22 bp, Artificial Sequence
  chemically synthesized
cctagtgttagaatcagctgtt

SEQ ID NO: 1155791 - DNA, 22 bp, Artificial Sequence
  chemically synthesized
ctagtgttagaatcagctgttt

SEQ ID NO: 1155792 - DNA, 22 bp, Artificial Sequence
  chemically synthesized
gtgttagaatcagctgtttctc

SEQ ID NO: 1155793 - DNA, 22 bp, Artificial Sequence
  chemically synthesized
gaatcagctgtttctccacagt

SEQ ID NO: 1155794 - DNA, 22 bp, Artificial Sequence
  chemically synthesized
tttctccacagtgttctggttc

SEQ ID NO: 1155795 - DNA, 22 bp, Artificial Sequence
  chemically synthesized
ctccacagtgttctggttcctt

SEQ ID NO: 1155796 - DNA, 22 bp, Artificial Sequence
  chemically synthesized
tccacagtgttctggttccttt

SEQ ID NO: 1155797 - DNA, 22 bp, Artificial Sequence
  chemically synthesized
cacagtgttctggttccttttt

SEQ ID NO: 1155798 - DNA, 22 bp, Artificial Sequence
  chemically synthesized
tggttccttttttttttttttt

SEQ ID NO: 1155799 - DNA, 22 bp, Artificial Sequence
  chemically synthesized
aagaaaaaaaaaaaaaaaaaaa

SEQ ID NO: 1155800 - DNA, 22 bp, Artificial Sequence
  chemically synthesized
gttccttttttttttttttttt

SEQ ID NO: 1155801 - DNA, 22 bp, Artificial Sequence
  chemically synthesized
aaagaaaaaaaaaaaaaaaaaa

SEQ ID NO: 1155802 - DNA, 22 bp, Artificial Sequence
  chemically synthesized
taaagaaaaaaaaaaaaaaaaa

SEQ ID NO: 1155803 - DNA, 22 bp, Artificial Sequence
  chemically synthesized
tttaaagaaaaaaaaaaaaaaa

SEQ ID NO: 1155804 - DNA, 22 bp, Artificial Sequence
  chemically synthesized
cttttttttttttttttttttt

SEQ ID NO: 1155805 - DNA, 22 bp, Artificial Sequence
  chemically synthesized
tttttttttttttttttttttt

SEQ ID NO: 1155806 - DNA, 22 bp, Artificial Sequence
  chemically synthesized
tttttttttttttttttttttt

SEQ ID NO: 1155807 - DNA, 22 bp, Artificial Sequence
  chemically synthesized
tttttttttttttttttttttc

SEQ ID NO: 1155808 - DNA, 22 bp, Artificial Sequence
  chemically synthesized
ttttttttttttttttttttct

SEQ ID NO: 1155809 - DNA, 22 bp, Artificial Sequence
  chemically synthesized
tttttttttttttttttttctt

SEQ ID NO: 1155810 - DNA, 22 bp, Artificial Sequence
  chemically synthesized
ttttttttttttttttttcttt

SEQ ID NO: 1155811 - DNA, 22 bp, Artificial Sequence
  chemically synthesized
tttttttttttttttttcttta

SEQ ID NO: 1155812 - DNA, 22 bp, Artificial Sequence
  chemically synthesized
agtaacattctttaaagaaaaa

SEQ ID NO: 1155813 - DNA, 22 bp, Artificial Sequence
  chemically synthesized
ttttttttttttttttctttaa

SEQ ID NO: 1155814 - DNA, 22 bp, Artificial Sequence
  chemically synthesized
cagtaacattctttaaagaaaa

SEQ ID NO: 1155815 - DNA, 22 bp, Artificial Sequence
  chemically synthesized
tttttttttttttttctttaaa

SEQ ID NO: 1155816 - DNA, 22 bp, Artificial Sequence
  chemically synthesized
ttttttttttttttctttaaag

SEQ ID NO: 1155817 - DNA, 22 bp, Artificial Sequence
  chemically synthesized
tttttttttttttctttaaaga

SEQ ID NO: 1155818 - DNA, 22 bp, Artificial Sequence
  chemically synthesized
ttttttttttttctttaaagaa

SEQ ID NO: 1155819 - DNA, 22 bp, Artificial Sequence
  chemically synthesized
tttttttttttctttaaagaat

SEQ ID NO: 1155820 - DNA, 22 bp, Artificial Sequence
  chemically synthesized
ggtttcagtaacattctttaaa

SEQ ID NO: 1155821 - DNA, 22 bp, Artificial Sequence
  chemically synthesized
ttttttttttctttaaagaatg

SEQ ID NO: 1155822 - DNA, 22 bp, Artificial Sequence
  chemically synthesized
gggtttcagtaacattctttaa

SEQ ID NO: 1155823 - DNA, 22 bp, Artificial Sequence
  chemically synthesized
tttttttttctttaaagaatgt

SEQ ID NO: 1155824 - DNA, 22 bp, Artificial Sequence
  chemically synthesized
ttttttttctttaaagaatgtt

SEQ ID NO: 1155825 - DNA, 22 bp, Artificial Sequence
  chemically synthesized
tttttttctttaaagaatgtta

SEQ ID NO: 1155826 - DNA, 22 bp, Artificial Sequence
  chemically synthesized
ttttttctttaaagaatgttac

SEQ ID NO: 1155827 - DNA, 22 bp, Artificial Sequence
  chemically synthesized
tttttctttaaagaatgttact

SEQ ID NO: 1155828 - DNA, 22 bp, Artificial Sequence
  chemically synthesized
ttttctttaaagaatgttactg

SEQ ID NO: 1155829 - DNA, 22 bp, Artificial Sequence
  chemically synthesized
tttctttaaagaatgttactga

SEQ ID NO: 1155830 - DNA, 22 bp, Artificial Sequence
  chemically synthesized
ttctttaaagaatgttactgaa

SEQ ID NO: 1155831 - DNA, 22 bp, Artificial Sequence
  chemically synthesized
tctttaaagaatgttactgaaa

SEQ ID NO: 1155832 - DNA, 22 bp, Artificial Sequence
  chemically synthesized
ctttaaagaatgttactgaaac

SEQ ID NO: 1155833 - DNA, 22 bp, Artificial Sequence
  chemically synthesized
tttaaagaatgttactgaaacc

SEQ ID NO: 1155834 - DNA, 22 bp, Artificial Sequence
  chemically synthesized
taaagaatgttactgaaaccca

SEQ ID NO: 1155835 - DNA, 22 bp, Artificial Sequence
  chemically synthesized
gcaacaggatcttgggtttcag

SEQ ID NO: 1155836 - DNA, 22 bp, Artificial Sequence
  chemically synthesized
aaagaatgttactgaaacccaa

SEQ ID NO: 1155837 - DNA, 22 bp, Artificial Sequence
  chemically synthesized
aagaatgttactgaaacccaag

SEQ ID NO: 1155838 - DNA, 22 bp, Artificial Sequence
  chemically synthesized
ctgaaacccaagatcctgttgc

SEQ ID NO: 1155839 - DNA, 22 bp, Artificial Sequence
  chemically synthesized
aaacccaagatcctgttgctag

SEQ ID NO: 1155840 - DNA, 22 bp, Artificial Sequence
  chemically synthesized
gaagcaaggagcatacctagca

SEQ ID NO: 1155841 - DNA, 22 bp, Artificial Sequence
  chemically synthesized
caacaccctagaagcaaggagc

SEQ ID NO: 1155842 - DNA, 22 bp, Artificial Sequence
  chemically synthesized
ttgctaggtatgctccttgctt

SEQ ID NO: 1155843 - DNA, 22 bp, Artificial Sequence
  chemically synthesized
ctaggtatgctccttgcttcta

SEQ ID NO: 1155844 - DNA, 22 bp, Artificial Sequence
  chemically synthesized
ggtatgctccttgcttctaggg

SEQ ID NO: 1155845 - DNA, 22 bp, Artificial Sequence
  chemically synthesized
taagctacaacaccctagaagc

SEQ ID NO: 1155846 - DNA, 22 bp, Artificial Sequence
  chemically synthesized
cttgcttctagggtgttgtagc

SEQ ID NO: 1155847 - DNA, 22 bp, Artificial Sequence
  chemically synthesized
gcttctagggtgttgtagctta

SEQ ID NO: 1155848 - DNA, 22 bp, Artificial Sequence
  chemically synthesized
cttctagggtgttgtagcttac

SEQ ID NO: 1155849 - DNA, 22 bp, Artificial Sequence
  chemically synthesized
ctagggtgttgtagcttacagg

SEQ ID NO: 1155850 - DNA, 22 bp, Artificial Sequence
  chemically synthesized
tagggtgttgtagcttacagga

SEQ ID NO: 1155851 - DNA, 22 bp, Artificial Sequence
  chemically synthesized
gggtgttgtagcttacaggacc

SEQ ID NO: 1155852 - DNA, 22 bp, Artificial Sequence
  chemically synthesized
tgtcaacccagaggtcctgtaa

SEQ ID NO: 1155853 - DNA, 22 bp, Artificial Sequence
  chemically synthesized
atgtcaacccagaggtcctgta

SEQ ID NO: 1155854 - DNA, 22 bp, Artificial Sequence
  chemically synthesized
tatgtcaacccagaggtcctgt

SEQ ID NO: 1155855 - DNA, 22 bp, Artificial Sequence
  chemically synthesized
tttatgtcaacccagaggtcct

SEQ ID NO: 1155856 - DNA, 22 bp, Artificial Sequence
  chemically synthesized
ctttatgtcaacccagaggtcc

SEQ ID NO: 1155857 - DNA, 22 bp, Artificial Sequence
  chemically synthesized
tagcttacaggacctctgggtt

SEQ ID NO: 1155858 - DNA, 22 bp, Artificial Sequence
  chemically synthesized
acaggacctctgggttgacata

SEQ ID NO: 1155859 - DNA, 22 bp, Artificial Sequence
  chemically synthesized
caggacctctgggttgacataa

SEQ ID NO: 1155860 - DNA, 22 bp, Artificial Sequence
  chemically synthesized
acacatccacttctttatgtca

SEQ ID NO: 1155861 - DNA, 22 bp, Artificial Sequence
  chemically synthesized
tgggttgacataaagaagtgga

SEQ ID NO: 1155862 - DNA, 22 bp, Artificial Sequence
  chemically synthesized
ggttgacataaagaagtggatg

SEQ ID NO: 1155863 - DNA, 22 bp, Artificial Sequence
  chemically synthesized
acataaagaagtggatgtgtga

SEQ ID NO: 1155864 - DNA, 22 bp, Artificial Sequence
  chemically synthesized
tgggtgagtacacactcacaca

SEQ ID NO: 1155865 - DNA, 22 bp, Artificial Sequence
  chemically synthesized
atgggtgagtacacactcacac

SEQ ID NO: 1155866 - DNA, 22 bp, Artificial Sequence
  chemically synthesized
tatatagaagtatttatgggtg

SEQ ID NO: 1155867 - DNA, 22 bp, Artificial Sequence
  chemically synthesized
acccataaatacttctatatat

SEQ ID NO: 1155868 - DNA, 22 bp, Artificial Sequence
  chemically synthesized
atacagatgagataattatata

SEQ ID NO: 1155869 - DNA, 22 bp, Artificial Sequence
  chemically synthesized
ggttaatacagatgagataatt

SEQ ID NO: 1155870 - DNA, 22 bp, Artificial Sequence
  chemically synthesized
ctatatataattatctcatctg

SEQ ID NO: 1155871 - DNA, 22 bp, Artificial Sequence
  chemically synthesized
tatatataattatctcatctgt

SEQ ID NO: 1155872 - DNA, 22 bp, Artificial Sequence
  chemically synthesized
atattaggttaatacagatgag

SEQ ID NO: 1155873 - DNA, 22 bp, Artificial Sequence
  chemically synthesized
tatataattatctcatctgtat

SEQ ID NO: 1155874 - DNA, 22 bp, Artificial Sequence
  chemically synthesized
tctcatctgtattaacctaata

SEQ ID NO: 1155875 - DNA, 22 bp, Artificial Sequence
  chemically synthesized
atctgtattaacctaatattaa

SEQ ID NO: 1155876 - DNA, 22 bp, Artificial Sequence
  chemically synthesized
tattaacctaatattaatttat

SEQ ID NO: 1155877 - DNA, 22 bp, Artificial Sequence
  chemically synthesized
acctaatattaatttatccatc

SEQ ID NO: 1155878 - DNA, 22 bp, Artificial Sequence
  chemically synthesized
atattaatttatccatctctct

SEQ ID NO: 1155879 - DNA, 22 bp, Artificial Sequence
  chemically synthesized
atttatccatctctctccacct

SEQ ID NO: 1155880 - DNA, 22 bp, Artificial Sequence
  chemically synthesized
atccatctctctccaccttgtg

SEQ ID NO: 1155881 - DNA, 22 bp, Artificial Sequence
  chemically synthesized
tccatctctctccaccttgtga

SEQ ID NO: 1155882 - DNA, 22 bp, Artificial Sequence
  chemically synthesized
acagataaggaacagaagtcac

SEQ ID NO: 1155883 - DNA, 22 bp, Artificial Sequence
  chemically synthesized
tctccaccttgtgacttctgtt

SEQ ID NO: 1155884 - DNA, 22 bp, Artificial Sequence
  chemically synthesized
tccaccttgtgacttctgttcc

SEQ ID NO: 1155885 - DNA, 22 bp, Artificial Sequence
  chemically synthesized
caccttgtgacttctgttcctt

SEQ ID NO: 1155886 - DNA, 22 bp, Artificial Sequence
  chemically synthesized
gtgacttctgttccttatctgt

SEQ ID NO: 1155887 - DNA, 22 bp, Artificial Sequence
  chemically synthesized
aagaggtagttcacagataagg

SEQ ID NO: 1155888 - DNA, 22 bp, Artificial Sequence
  chemically synthesized
tgacttctgttccttatctgtg

SEQ ID NO: 1155889 - DNA, 22 bp, Artificial Sequence
  chemically synthesized
ctgttccttatctgtgaactac

SEQ ID NO: 1155890 - DNA, 22 bp, Artificial Sequence
  chemically synthesized
tgttccttatctgtgaactacc

SEQ ID NO: 1155891 - DNA, 22 bp, Artificial Sequence
  chemically synthesized
ttccttatctgtgaactacctc

SEQ ID NO: 1155892 - DNA, 22 bp, Artificial Sequence
  chemically synthesized
aaaaaaaagttgaagaggtagt

SEQ ID NO: 1155893 - DNA, 22 bp, Artificial Sequence
  chemically synthesized
cttatctgtgaactacctcttc

SEQ ID NO: 1155894 - DNA, 22 bp, Artificial Sequence
  chemically synthesized
atctgtgaactacctcttcaac

SEQ ID NO: 1155895 - DNA, 22 bp, Artificial Sequence
  chemically synthesized
tctgtgaactacctcttcaact

SEQ ID NO: 1155896 - DNA, 22 bp, Artificial Sequence
  chemically synthesized
tgaactacctcttcaacttttt

SEQ ID NO: 1155897 - DNA, 22 bp, Artificial Sequence
  chemically synthesized
aagaggtagttcaaaaaaaagt

SEQ ID NO: 1155898 - DNA, 22 bp, Artificial Sequence
  chemically synthesized
cctcttcaacttttttttgaac

SEQ ID NO: 1155899 - DNA, 22 bp, Artificial Sequence
  chemically synthesized
ttcaacttttttttgaactacc

SEQ ID NO: 1155900 - DNA, 22 bp, Artificial Sequence
  chemically synthesized
aaaatgttgaagaggtagttca

SEQ ID NO: 1155901 - DNA, 22 bp, Artificial Sequence
  chemically synthesized
caacttttttttgaactacctc

SEQ ID NO: 1155902 - DNA, 22 bp, Artificial Sequence
  chemically synthesized
aacttttttttgaactacctct

SEQ ID NO: 1155903 - DNA, 22 bp, Artificial Sequence
  chemically synthesized
taactcaaaatgttgaagaggt

SEQ ID NO: 1155904 - DNA, 22 bp, Artificial Sequence
  chemically synthesized
ttttttgaactacctcttcaac

SEQ ID NO: 1155905 - DNA, 22 bp, Artificial Sequence
  chemically synthesized
ataactcaaaatgttgaagagg

SEQ ID NO: 1155906 - DNA, 22 bp, Artificial Sequence
  chemically synthesized
tttttgaactacctcttcaaca

SEQ ID NO: 1155907 - DNA, 22 bp, Artificial Sequence
  chemically synthesized
ttttgaactacctcttcaacat

SEQ ID NO: 1155908 - DNA, 22 bp, Artificial Sequence
  chemically synthesized
ttataactcaaaatgttgaaga

SEQ ID NO: 1155909 - DNA, 22 bp, Artificial Sequence
  chemically synthesized
tttgaactacctcttcaacatt

SEQ ID NO: 1155910 - DNA, 22 bp, Artificial Sequence
  chemically synthesized
cttataactcaaaatgttgaag

SEQ ID NO: 1155911 - DNA, 22 bp, Artificial Sequence
  chemically synthesized
ttgaactacctcttcaacattt

SEQ ID NO: 1155912 - DNA, 22 bp, Artificial Sequence
  chemically synthesized
tgaactacctcttcaacatttt

SEQ ID NO: 1155913 - DNA, 22 bp, Artificial Sequence
  chemically synthesized
gaactacctcttcaacattttg

SEQ ID NO: 1155914 - DNA, 22 bp, Artificial Sequence
  chemically synthesized
aactacctcttcaacattttga

SEQ ID NO: 1155915 - DNA, 22 bp, Artificial Sequence
  chemically synthesized
agtttcttataactcaaaatgt

SEQ ID NO: 1155916 - DNA, 22 bp, Artificial Sequence
  chemically synthesized
gagtttcttataactcaaaatg

SEQ ID NO: 1155917 - DNA, 22 bp, Artificial Sequence
  chemically synthesized
tgagtttcttataactcaaaat

SEQ ID NO: 1155918 - DNA, 22 bp, Artificial Sequence
  chemically synthesized
ttgagtttcttataactcaaaa

SEQ ID NO: 1155919 - DNA, 22 bp, Artificial Sequence
  chemically synthesized
cctcttcaacattttgagttat

SEQ ID NO: 1155920 - DNA, 22 bp, Artificial Sequence
  chemically synthesized
ttcaacattttgagttataaga

SEQ ID NO: 1155921 - DNA, 22 bp, Artificial Sequence
  chemically synthesized
caacattttgagttataagaaa

SEQ ID NO: 1155922 - DNA, 22 bp, Artificial Sequence
  chemically synthesized
aacattttgagttataagaaac

SEQ ID NO: 1155923 - DNA, 22 bp, Artificial Sequence
  chemically synthesized
aagaaatcatttttgagtttct

SEQ ID NO: 1155924 - DNA, 22 bp, Artificial Sequence
  chemically synthesized
aaagaaatcatttttgagtttc

SEQ ID NO: 1155925 - DNA, 22 bp, Artificial Sequence
  chemically synthesized
tgagttataagaaactcaaaaa

SEQ ID NO: 1155926 - DNA, 22 bp, Artificial Sequence
  chemically synthesized
gagttataagaaactcaaaaat

SEQ ID NO: 1155927 - DNA, 22 bp, Artificial Sequence
  chemically synthesized
agttataagaaactcaaaaatg

SEQ ID NO: 1155928 - DNA, 22 bp, Artificial Sequence
  chemically synthesized
gtttaaagaaatcatttttgag

SEQ ID NO: 1155929 - DNA, 22 bp, Artificial Sequence
  chemically synthesized
tagtttaaagaaatcatttttg

SEQ ID NO: 1155930 - DNA, 22 bp, Artificial Sequence
  chemically synthesized
ctagtttaaagaaatcattttt

SEQ ID NO: 1155931 - DNA, 22 bp, Artificial Sequence
  chemically synthesized
taagaaactcaaaaatgatttc

SEQ ID NO: 1155932 - DNA, 22 bp, Artificial Sequence
  chemically synthesized
aacttctagtttaaagaaatca

SEQ ID NO: 1155933 - DNA, 22 bp, Artificial Sequence
  chemically synthesized
aaaaatgatttctttaaactag

SEQ ID NO: 1155934 - DNA, 22 bp, Artificial Sequence
  chemically synthesized
ctttaaactagaagttgagatg

SEQ ID NO: 1155935 - DNA, 22 bp, Artificial Sequence
  chemically synthesized
tttaaactagaagttgagatga

SEQ ID NO: 1155936 - DNA, 22 bp, Artificial Sequence
  chemically synthesized
taaactagaagttgagatgacc

SEQ ID NO: 1155937 - DNA, 22 bp, Artificial Sequence
  chemically synthesized
aaactagaagttgagatgaccg

SEQ ID NO: 1155938 - DNA, 22 bp, Artificial Sequence
  chemically synthesized
aactagaagttgagatgaccgc

SEQ ID NO: 1155939 - DNA, 22 bp, Artificial Sequence
  chemically synthesized
gaagttgagatgaccgctgttc

SEQ ID NO: 1155940 - DNA, 22 bp, Artificial Sequence
  chemically synthesized
agatgaccgctgttcatgtttg

SEQ ID NO: 1155941 - DNA, 22 bp, Artificial Sequence
  chemically synthesized
agcagcatgaggagccaaacat

SEQ ID NO: 1155942 - DNA, 22 bp, Artificial Sequence
  chemically synthesized
tggattcagcagcatgaggagc

SEQ ID NO: 1155943 - DNA, 22 bp, Artificial Sequence
  chemically synthesized
ttcatgtttggctcctcatgct

SEQ ID NO: 1155944 - DNA, 22 bp, Artificial Sequence
  chemically synthesized
tctgtggattcagcagcatgag

SEQ ID NO: 1155945 - DNA, 22 bp, Artificial Sequence
  chemically synthesized
atgtttggctcctcatgctgct

SEQ ID NO: 1155946 - DNA, 22 bp, Artificial Sequence
  chemically synthesized
tgtctgtggattcagcagcatg

SEQ ID NO: 1155947 - DNA, 22 bp, Artificial Sequence
  chemically synthesized
tctgtctgtggattcagcagca

SEQ ID NO: 1155948 - DNA, 22 bp, Artificial Sequence
  chemically synthesized
ctctgtctgtggattcagcagc

SEQ ID NO: 1155949 - DNA, 22 bp, Artificial Sequence
  chemically synthesized
tctctgtctgtggattcagcag

SEQ ID NO: 1155950 - DNA, 22 bp, Artificial Sequence
  chemically synthesized
ggctcctcatgctgctgaatcc

SEQ ID NO: 1155951 - DNA, 22 bp, Artificial Sequence
  chemically synthesized
gctcctcatgctgctgaatcca

SEQ ID NO: 1155952 - DNA, 22 bp, Artificial Sequence
  chemically synthesized
ctcatgctgctgaatccacaga

SEQ ID NO: 1155953 - DNA, 22 bp, Artificial Sequence
  chemically synthesized
atgctgctgaatccacagacag

SEQ ID NO: 1155954 - DNA, 22 bp, Artificial Sequence
  chemically synthesized
tatggtaacccctttctctgtc

SEQ ID NO: 1155955 - DNA, 22 bp, Artificial Sequence
  chemically synthesized
ctgaatccacagacagagaaag

SEQ ID NO: 1155956 - DNA, 22 bp, Artificial Sequence
  chemically synthesized
tgtatggtaacccctttctctg

SEQ ID NO: 1155957 - DNA, 22 bp, Artificial Sequence
  chemically synthesized
aatccacagacagagaaagggg

SEQ ID NO: 1155958 - DNA, 22 bp, Artificial Sequence
  chemically synthesized
ggttctgtatggtaaccccttt

SEQ ID NO: 1155959 - DNA, 22 bp, Artificial Sequence
  chemically synthesized
aggttctgtatggtaacccctt

SEQ ID NO: 1155960 - DNA, 22 bp, Artificial Sequence
  chemically synthesized
tgcttaggttctgtatggtaac

SEQ ID NO: 1155961 - DNA, 22 bp, Artificial Sequence
  chemically synthesized
gtgcttaggttctgtatggtaa

SEQ ID NO: 1155962 - DNA, 22 bp, Artificial Sequence
  chemically synthesized
accatttgtgcttaggttctgt

SEQ ID NO: 1155963 - DNA, 22 bp, Artificial Sequence
  chemically synthesized
agttgaccatttgtgcttaggt

SEQ ID NO: 1155964 - DNA, 22 bp, Artificial Sequence
  chemically synthesized
ccatacagaacctaagcacaaa

SEQ ID NO: 1155965 - DNA, 22 bp, Artificial Sequence
  chemically synthesized
ggtgaactcagttgaccatttg

SEQ ID NO: 1155966 - DNA, 22 bp, Artificial Sequence
  chemically synthesized
tattgggtgaactcagttgacc

SEQ ID NO: 1155967 - DNA, 22 bp, Artificial Sequence
  chemically synthesized
agcacaaatggtcaactgagtt

SEQ ID NO: 1155968 - DNA, 22 bp, Artificial Sequence
  chemically synthesized
ccccgcattgtattgggtgaac

SEQ ID NO: 1155969 - DNA, 22 bp, Artificial Sequence
  chemically synthesized
gccccgcattgtattgggtgaa

SEQ ID NO: 1155970 - DNA, 22 bp, Artificial Sequence
  chemically synthesized
cttgccccgcattgtattgggt

SEQ ID NO: 1155971 - DNA, 22 bp, Artificial Sequence
  chemically synthesized
agttcacccaatacaatgcggg

SEQ ID NO: 1155972 - DNA, 22 bp, Artificial Sequence
  chemically synthesized
atgtagtactacttgccccgca

SEQ ID NO: 1155973 - DNA, 22 bp, Artificial Sequence
  chemically synthesized
acccaatacaatgcggggcaag

SEQ ID NO: 1155974 - DNA, 22 bp, Artificial Sequence
  chemically synthesized
taatgtagtactacttgccccg

SEQ ID NO: 1155975 - DNA, 22 bp, Artificial Sequence
  chemically synthesized
ctaatgtagtactacttgcccc

SEQ ID NO: 1155976 - DNA, 22 bp, Artificial Sequence
  chemically synthesized
tctaatgtagtactacttgccc

SEQ ID NO: 1155977 - DNA, 22 bp, Artificial Sequence
  chemically synthesized
gcaaatgcccatagttttctaa

SEQ ID NO: 1155978 - DNA, 22 bp, Artificial Sequence
  chemically synthesized
ctggcaaatgcccatagttttc

SEQ ID NO: 1155979 - DNA, 22 bp, Artificial Sequence
  chemically synthesized
cattagaaaactatgggcattt

SEQ ID NO: 1155980 - DNA, 22 bp, Artificial Sequence
  chemically synthesized
agagactcctggcaaatgccca

SEQ ID NO: 1155981 - DNA, 22 bp, Artificial Sequence
  chemically synthesized
gaaaactatgggcatttgccag

SEQ ID NO: 1155982 - DNA, 22 bp, Artificial Sequence
  chemically synthesized
tgggcatttgccaggagtctct

SEQ ID NO: 1155983 - DNA, 22 bp, Artificial Sequence
  chemically synthesized
tcatatatgggtatactaagag

SEQ ID NO: 1155984 - DNA, 22 bp, Artificial Sequence
  chemically synthesized
gccaggagtctcttagtatacc

SEQ ID NO: 1155985 - DNA, 22 bp, Artificial Sequence
  chemically synthesized
ccaggagtctcttagtataccc

SEQ ID NO: 1155986 - DNA, 22 bp, Artificial Sequence
  chemically synthesized
acactatcatatatgggtatac

SEQ ID NO: 1155987 - DNA, 22 bp, Artificial Sequence
  chemically synthesized
gttaacactatcatatatgggt

SEQ ID NO: 1155988 - DNA, 22 bp, Artificial Sequence
  chemically synthesized
ttggttaacactatcatatatg

SEQ ID NO: 1155989 - DNA, 22 bp, Artificial Sequence
  chemically synthesized
attggttaacactatcatatat

SEQ ID NO: 1155990 - DNA, 22 bp, Artificial Sequence
  chemically synthesized
ttagtatacccatatatgatag

SEQ ID NO: 1155991 - DNA, 22 bp, Artificial Sequence
  chemically synthesized
tattggttaacactatcatata

SEQ ID NO: 1155992 - DNA, 22 bp, Artificial Sequence
  chemically synthesized
ttattggttaacactatcatat

SEQ ID NO: 1155993 - DNA, 22 bp, Artificial Sequence
  chemically synthesized
agtatacccatatatgatagtg

SEQ ID NO: 1155994 - DNA, 22 bp, Artificial Sequence
  chemically synthesized
tttattggttaacactatcata

SEQ ID NO: 1155995 - DNA, 22 bp, Artificial Sequence
  chemically synthesized
gtatacccatatatgatagtgt

SEQ ID NO: 1155996 - DNA, 22 bp, Artificial Sequence
  chemically synthesized
ttttattggttaacactatcat

SEQ ID NO: 1155997 - DNA, 22 bp, Artificial Sequence
  chemically synthesized
tttttattggttaacactatca

SEQ ID NO: 1155998 - DNA, 22 bp, Artificial Sequence
  chemically synthesized
ttttttttattggttaacacta

SEQ ID NO: 1155999 - DNA, 22 bp, Artificial Sequence
  chemically synthesized
tgttttttttattggttaacac

SEQ ID NO: 1156000 - DNA, 22 bp, Artificial Sequence
  chemically synthesized
ctgttttttttattggttaaca

SEQ ID NO: 1156001 - DNA, 22 bp, Artificial Sequence
  chemically synthesized
atcgagtatcttctgttttttt

SEQ ID NO: 1156002 - DNA, 22 bp, Artificial Sequence
  chemically synthesized
accaataaaaaaaacagaagat

SEQ ID NO: 1156003 - DNA, 22 bp, Artificial Sequence
  chemically synthesized
catattgatcgagtatcttctg

SEQ ID NO: 1156004 - DNA, 22 bp, Artificial Sequence
  chemically synthesized
ccatattgatcgagtatcttct

SEQ ID NO: 1156005 - DNA, 22 bp, Artificial Sequence
  chemically synthesized
gtgtttccatattgatcgagta

SEQ ID NO: 1156006 - DNA, 22 bp, Artificial Sequence
  chemically synthesized
ttagtgtttccatattgatcga

SEQ ID NO: 1156007 - DNA, 22 bp, Artificial Sequence
  chemically synthesized
gatcaatatggaaacactaata

SEQ ID NO: 1156008 - DNA, 22 bp, Artificial Sequence
  chemically synthesized
caaagaaccatattattagtgt

SEQ ID NO: 1156009 - DNA, 22 bp, Artificial Sequence
  chemically synthesized
ccaaagaaccatattattagtg

SEQ ID NO: 1156010 - DNA, 22 bp, Artificial Sequence
  chemically synthesized
ataatatggttctttggaagga

SEQ ID NO: 1156011 - DNA, 22 bp, Artificial Sequence
  chemically synthesized
gtgggaaataaaaaacatcctt

SEQ ID NO: 1156012 - DNA, 22 bp, Artificial Sequence
  chemically synthesized
agtgggaaataaaaaacatcct

SEQ ID NO: 1156013 - DNA, 22 bp, Artificial Sequence
  chemically synthesized
accttagtgggaaataaaaaac

SEQ ID NO: 1156014 - DNA, 22 bp, Artificial Sequence
  chemically synthesized
tttggaaggatgttttttattt

SEQ ID NO: 1156015 - DNA, 22 bp, Artificial Sequence
  chemically synthesized
gaccttagtgggaaataaaaaa

SEQ ID NO: 1156016 - DNA, 22 bp, Artificial Sequence
  chemically synthesized
tgaccttagtgggaaataaaaa

SEQ ID NO: 1156017 - DNA, 22 bp, Artificial Sequence
  chemically synthesized
tggaaggatgttttttatttcc

SEQ ID NO: 1156018 - DNA, 22 bp, Artificial Sequence
  chemically synthesized
ggaaggatgttttttatttccc

SEQ ID NO: 1156019 - DNA, 22 bp, Artificial Sequence
  chemically synthesized
gaaggatgttttttatttccca

SEQ ID NO: 1156020 - DNA, 22 bp, Artificial Sequence
  chemically synthesized
cgtactttgaccttagtgggaa

SEQ ID NO: 1156021 - DNA, 22 bp, Artificial Sequence
  chemically synthesized
gttgcgtactttgaccttagtg

SEQ ID NO: 1156022 - DNA, 22 bp, Artificial Sequence
  chemically synthesized
tagttgcgtactttgaccttag

SEQ ID NO: 1156023 - DNA, 22 bp, Artificial Sequence
  chemically synthesized
tttatttcccactaaggtcaaa

SEQ ID NO: 1156024 - DNA, 22 bp, Artificial Sequence
  chemically synthesized
ctagttgcgtactttgacctta

SEQ ID NO: 1156025 - DNA, 22 bp, Artificial Sequence
  chemically synthesized
ttatttcccactaaggtcaaag

SEQ ID NO: 1156026 - DNA, 22 bp, Artificial Sequence
  chemically synthesized
tatttcccactaaggtcaaagt

SEQ ID NO: 1156027 - DNA, 22 bp, Artificial Sequence
  chemically synthesized
ttctagttgcgtactttgacct

SEQ ID NO: 1156028 - DNA, 22 bp, Artificial Sequence
  chemically synthesized
atttcccactaaggtcaaagta

SEQ ID NO: 1156029 - DNA, 22 bp, Artificial Sequence
  chemically synthesized
cttctagttgcgtactttgacc

SEQ ID NO: 1156030 - DNA, 22 bp, Artificial Sequence
  chemically synthesized
tttcccactaaggtcaaagtac

SEQ ID NO: 1156031 - DNA, 22 bp, Artificial Sequence
  chemically synthesized
cccactaaggtcaaagtacgca

SEQ ID NO: 1156032 - DNA, 22 bp, Artificial Sequence
  chemically synthesized
ccactaaggtcaaagtacgcaa

SEQ ID NO: 1156033 - DNA, 22 bp, Artificial Sequence
  chemically synthesized
aggtcaaagtacgcaactagaa

SEQ ID NO: 1156034 - DNA, 22 bp, Artificial Sequence
  chemically synthesized
tggcagaatttcttctagttgc

SEQ ID NO: 1156035 - DNA, 22 bp, Artificial Sequence
  chemically synthesized
ctatggcagaatttcttctagt

SEQ ID NO: 1156036 - DNA, 22 bp, Artificial Sequence
  chemically synthesized
gttactatggcagaatttcttc

SEQ ID NO: 1156037 - DNA, 22 bp, Artificial Sequence
  chemically synthesized
ggttactatggcagaatttctt

SEQ ID NO: 1156038 - DNA, 22 bp, Artificial Sequence
  chemically synthesized
tcttggttactatggcagaatt

SEQ ID NO: 1156039 - DNA, 22 bp, Artificial Sequence
  chemically synthesized
gaagaaattctgccatagtaac

SEQ ID NO: 1156040 - DNA, 22 bp, Artificial Sequence
  chemically synthesized
atacaatgctgtcttggttact

SEQ ID NO: 1156041 - DNA, 22 bp, Artificial Sequence
  chemically synthesized
tgctaatacaatgctgtcttgg

SEQ ID NO: 1156042 - DNA, 22 bp, Artificial Sequence
  chemically synthesized
tgccatagtaaccaagacagca

SEQ ID NO: 1156043 - DNA, 22 bp, Artificial Sequence
  chemically synthesized
atgctaatacaatgctgtcttg

SEQ ID NO: 1156044 - DNA, 22 bp, Artificial Sequence
  chemically synthesized
tatgctaatacaatgctgtctt

SEQ ID NO: 1156045 - DNA, 22 bp, Artificial Sequence
  chemically synthesized
ccatagtaaccaagacagcatt

SEQ ID NO: 1156046 - DNA, 22 bp, Artificial Sequence
  chemically synthesized
ttatgctaatacaatgctgtct

SEQ ID NO: 1156047 - DNA, 22 bp, Artificial Sequence
  chemically synthesized
atcagtttttatgctaatacaa

SEQ ID NO: 1156048 - DNA, 22 bp, Artificial Sequence
  chemically synthesized
cactgatcagtttttatgctaa

SEQ ID NO: 1156049 - DNA, 22 bp, Artificial Sequence
  chemically synthesized
tgttccactgatcagtttttat

SEQ ID NO: 1156050 - DNA, 22 bp, Artificial Sequence
  chemically synthesized
ttatgttccactgatcagtttt

SEQ ID NO: 1156051 - DNA, 22 bp, Artificial Sequence
  chemically synthesized
tattagcataaaaactgatcag

SEQ ID NO: 1156052 - DNA, 22 bp, Artificial Sequence
  chemically synthesized
tattatgttccactgatcagtt

SEQ ID NO: 1156053 - DNA, 22 bp, Artificial Sequence
  chemically synthesized
tctattatgttccactgatcag

SEQ ID NO: 1156054 - DNA, 22 bp, Artificial Sequence
  chemically synthesized
gcataaaaactgatcagtggaa

SEQ ID NO: 1156055 - DNA, 22 bp, Artificial Sequence
  chemically synthesized
ggttctctattatgttccactg

SEQ ID NO: 1156056 - DNA, 22 bp, Artificial Sequence
  chemically synthesized
ctgggttctctattatgttcca

SEQ ID NO: 1156057 - DNA, 22 bp, Artificial Sequence
  chemically synthesized
ttcctgggttctctattatgtt

SEQ ID NO: 1156058 - DNA, 22 bp, Artificial Sequence
  chemically synthesized
attcctgggttctctattatgt

SEQ ID NO: 1156059 - DNA, 22 bp, Artificial Sequence
  chemically synthesized
atcagtggaacataatagagaa

SEQ ID NO: 1156060 - DNA, 22 bp, Artificial Sequence
  chemically synthesized
atttattcctgggttctctatt

SEQ ID NO: 1156061 - DNA, 22 bp, Artificial Sequence
  chemically synthesized
aatgcaaatgcattaatttatt

SEQ ID NO: 1156062 - DNA, 22 bp, Artificial Sequence
  chemically synthesized
atgcatttgcattcaactgatt

SEQ ID NO: 1156063 - DNA, 22 bp, Artificial Sequence
  chemically synthesized
acacccatgtccaaaatcagtt

SEQ ID NO: 1156064 - DNA, 22 bp, Artificial Sequence
  chemically synthesized
gacacccatgtccaaaatcagt

SEQ ID NO: 1156065 - DNA, 22 bp, Artificial Sequence
  chemically synthesized
ttgacacccatgtccaaaatca

SEQ ID NO: 1156066 - DNA, 22 bp, Artificial Sequence
  chemically synthesized
gcattcaactgattttggacat

SEQ ID NO: 1156067 - DNA, 22 bp, Artificial Sequence
  chemically synthesized
cattcaactgattttggacatg

SEQ ID NO: 1156068 - DNA, 22 bp, Artificial Sequence
  chemically synthesized
aactgattttggacatgggtgt

SEQ ID NO: 1156069 - DNA, 22 bp, Artificial Sequence
  chemically synthesized
acggtgtgttcttgacacccat

SEQ ID NO: 1156070 - DNA, 22 bp, Artificial Sequence
  chemically synthesized
attttggacatgggtgtcaaga

SEQ ID NO: 1156071 - DNA, 22 bp, Artificial Sequence
  chemically synthesized
tcctcacggtgtgttcttgaca

SEQ ID NO: 1156072 - DNA, 22 bp, Artificial Sequence
  chemically synthesized
tggacatgggtgtcaagaacac

SEQ ID NO: 1156073 - DNA, 22 bp, Artificial Sequence
  chemically synthesized
ggacatgggtgtcaagaacaca

SEQ ID NO: 1156074 - DNA, 22 bp, Artificial Sequence
  chemically synthesized
gacatgggtgtcaagaacacac

SEQ ID NO: 1156075 - DNA, 22 bp, Artificial Sequence
  chemically synthesized
aagagggtgtcctgtcctcacg

SEQ ID NO: 1156076 - DNA, 22 bp, Artificial Sequence
  chemically synthesized
ctgaagagggtgtcctgtcctc

SEQ ID NO: 1156077 - DNA, 22 bp, Artificial Sequence
  chemically synthesized
gctgaagagggtgtcctgtcct

SEQ ID NO: 1156078 - DNA, 22 bp, Artificial Sequence
  chemically synthesized
gtagcatttgctgaagagggtg

SEQ ID NO: 1156079 - DNA, 22 bp, Artificial Sequence
  chemically synthesized
ctggtagcatttgctgaagagg

SEQ ID NO: 1156080 - DNA, 22 bp, Artificial Sequence
  chemically synthesized
cctggtagcatttgctgaagag

SEQ ID NO: 1156081 - DNA, 22 bp, Artificial Sequence
  chemically synthesized
tcctggtagcatttgctgaaga

SEQ ID NO: 1156082 - DNA, 22 bp, Artificial Sequence
  chemically synthesized
ttcctggtagcatttgctgaag

SEQ ID NO: 1156083 - DNA, 22 bp, Artificial Sequence
  chemically synthesized
cttttcctggtagcatttgctg

SEQ ID NO: 1156084 - DNA, 22 bp, Artificial Sequence
  chemically synthesized
acttttcctggtagcatttgct

SEQ ID NO: 1156085 - DNA, 22 bp, Artificial Sequence
  chemically synthesized
ttacttttcctggtagcatttg

SEQ ID NO: 1156086 - DNA, 22 bp, Artificial Sequence
  chemically synthesized
ttcagcaaatgctaccaggaaa

SEQ ID NO: 1156087 - DNA, 22 bp, Artificial Sequence
  chemically synthesized
cagcaaatgctaccaggaaaag

SEQ ID NO: 1156088 - DNA, 22 bp, Artificial Sequence
  chemically synthesized
agcaaatgctaccaggaaaagt

SEQ ID NO: 1156089 - DNA, 22 bp, Artificial Sequence
  chemically synthesized
catgtagattcttacttttcct

SEQ ID NO: 1156090 - DNA, 22 bp, Artificial Sequence
  chemically synthesized
tgcatgtagattcttacttttc

SEQ ID NO: 1156091 - DNA, 22 bp, Artificial Sequence
  chemically synthesized
ctgcatgtagattcttactttt

SEQ ID NO: 1156092 - DNA, 22 bp, Artificial Sequence
  chemically synthesized
ttctgcatgtagattcttactt

SEQ ID NO: 1156093 - DNA, 22 bp, Artificial Sequence
  chemically synthesized
attcttctgcatgtagattctt

SEQ ID NO: 1156094 - DNA, 22 bp, Artificial Sequence
  chemically synthesized
ccaggaaaagtaagaatctaca

SEQ ID NO: 1156095 - DNA, 22 bp, Artificial Sequence
  chemically synthesized
cattcttctgcatgtagattct

SEQ ID NO: 1156096 - DNA, 22 bp, Artificial Sequence
  chemically synthesized
atttcattcttctgcatgtaga

SEQ ID NO: 1156097 - DNA, 22 bp, Artificial Sequence
  chemically synthesized
catgcagaagaatgaaattaga

SEQ ID NO: 1156098 - DNA, 22 bp, Artificial Sequence
  chemically synthesized
tatgtggcaagggataagggtc

SEQ ID NO: 1156099 - DNA, 22 bp, Artificial Sequence
  chemically synthesized
gtatgtggcaagggataagggt

SEQ ID NO: 1156100 - DNA, 22 bp, Artificial Sequence
  chemically synthesized
tgtatgtggcaagggataaggg

SEQ ID NO: 1156101 - DNA, 22 bp, Artificial Sequence
  chemically synthesized
ttgtatgtggcaagggataagg

SEQ ID NO: 1156102 - DNA, 22 bp, Artificial Sequence
  chemically synthesized
gtttttgtatgtggcaagggat

SEQ ID NO: 1156103 - DNA, 22 bp, Artificial Sequence
  chemically synthesized
gacccttatcccttgccacata

SEQ ID NO: 1156104 - DNA, 22 bp, Artificial Sequence
  chemically synthesized
aaattggtttttgtatgtggca

SEQ ID NO: 1156105 - DNA, 22 bp, Artificial Sequence
  chemically synthesized
caaattggtttttgtatgtggc

SEQ ID NO: 1156106 - DNA, 22 bp, Artificial Sequence
  chemically synthesized
atcccttgccacatacaaaaac

SEQ ID NO: 1156107 - DNA, 22 bp, Artificial Sequence
  chemically synthesized
tcccttgccacatacaaaaacc

SEQ ID NO: 1156108 - DNA, 22 bp, Artificial Sequence
  chemically synthesized
atccatttcaaattggtttttg

SEQ ID NO: 1156109 - DNA, 22 bp, Artificial Sequence
  chemically synthesized
aatccatttcaaattggttttt

SEQ ID NO: 1156110 - DNA, 22 bp, Artificial Sequence
  chemically synthesized
taatccatttcaaattggtttt

SEQ ID NO: 1156111 - DNA, 22 bp, Artificial Sequence
  chemically synthesized
ttaatccatttcaaattggttt

SEQ ID NO: 1156112 - DNA, 22 bp, Artificial Sequence
  chemically synthesized
gccacatacaaaaaccaatttg

SEQ ID NO: 1156113 - DNA, 22 bp, Artificial Sequence
  chemically synthesized
ccacatacaaaaaccaatttga

SEQ ID NO: 1156114 - DNA, 22 bp, Artificial Sequence
  chemically synthesized
agtttttaatccatttcaaatt

SEQ ID NO: 1156115 - DNA, 22 bp, Artificial Sequence
  chemically synthesized
aagtttttaatccatttcaaat

SEQ ID NO: 1156116 - DNA, 22 bp, Artificial Sequence
  chemically synthesized
aatttaagtttttaatccattt

SEQ ID NO: 1156117 - DNA, 22 bp, Artificial Sequence
  chemically synthesized
aaatttaagtttttaatccatt

SEQ ID NO: 1156118 - DNA, 22 bp, Artificial Sequence
  chemically synthesized
agtcttaaatttaagtttttaa

SEQ ID NO: 1156119 - DNA, 22 bp, Artificial Sequence
  chemically synthesized
gagtcttaaatttaagttttta

SEQ ID NO: 1156120 - DNA, 22 bp, Artificial Sequence
  chemically synthesized
tgagtcttaaatttaagttttt

SEQ ID NO: 1156121 - DNA, 22 bp, Artificial Sequence
  chemically synthesized
gaaatggattaaaaacttaaat

SEQ ID NO: 1156122 - DNA, 22 bp, Artificial Sequence
  chemically synthesized
aaatggattaaaaacttaaatt

SEQ ID NO: 1156123 - DNA, 22 bp, Artificial Sequence
  chemically synthesized
agagttttgagtcttaaattta

SEQ ID NO: 1156124 - DNA, 22 bp, Artificial Sequence
  chemically synthesized
aaaacttaaatttaagactcaa

SEQ ID NO: 1156125 - DNA, 22 bp, Artificial Sequence
  chemically synthesized
atagattgagagttttgagtct

SEQ ID NO: 1156126 - DNA, 22 bp, Artificial Sequence
  chemically synthesized
ctaatagattgagagttttgag

SEQ ID NO: 1156127 - DNA, 22 bp, Artificial Sequence
  chemically synthesized
aaatttaagactcaaaactctc

SEQ ID NO: 1156128 - DNA, 22 bp, Artificial Sequence
  chemically synthesized
tactaatagattgagagttttg

SEQ ID NO: 1156129 - DNA, 22 bp, Artificial Sequence
  chemically synthesized
aatttaagactcaaaactctca

SEQ ID NO: 1156130 - DNA, 22 bp, Artificial Sequence
  chemically synthesized
ctactaatagattgagagtttt

SEQ ID NO: 1156131 - DNA, 22 bp, Artificial Sequence
  chemically synthesized
tctactaatagattgagagttt

SEQ ID NO: 1156132 - DNA, 22 bp, Artificial Sequence
  chemically synthesized
aagactcaaaactctcaatcta

SEQ ID NO: 1156133 - DNA, 22 bp, Artificial Sequence
  chemically synthesized
agactcaaaactctcaatctat

SEQ ID NO: 1156134 - DNA, 22 bp, Artificial Sequence
  chemically synthesized
tgttttctactaatagattgag

SEQ ID NO: 1156135 - DNA, 22 bp, Artificial Sequence
  chemically synthesized
tatgttttctactaatagattg

SEQ ID NO: 1156136 - DNA, 22 bp, Artificial Sequence
  chemically synthesized
aaaactctcaatctattagtag

SEQ ID NO: 1156137 - DNA, 22 bp, Artificial Sequence
  chemically synthesized
tcctctatgttttctactaata

SEQ ID NO: 1156138 - DNA, 22 bp, Artificial Sequence
  chemically synthesized
gtcctctatgttttctactaat

SEQ ID NO: 1156139 - DNA, 22 bp, Artificial Sequence
  chemically synthesized
tcaatctattagtagaaaacat

SEQ ID NO: 1156140 - DNA, 22 bp, Artificial Sequence
  chemically synthesized
aatctattagtagaaaacatag

SEQ ID NO: 1156141 - DNA, 22 bp, Artificial Sequence
  chemically synthesized
tgatgaagcttgtcctctatgt

SEQ ID NO: 1156142 - DNA, 22 bp, Artificial Sequence
  chemically synthesized
ttagtagaaaacatagaggaca

SEQ ID NO: 1156143 - DNA, 22 bp, Artificial Sequence
  chemically synthesized
gtagaaaacatagaggacaagc

SEQ ID NO: 1156144 - DNA, 22 bp, Artificial Sequence
  chemically synthesized
cccaaataattgtgatgaagct

SEQ ID NO: 1156145 - DNA, 22 bp, Artificial Sequence
  chemically synthesized
ttgcccaaataattgtgatgaa

SEQ ID NO: 1156146 - DNA, 22 bp, Artificial Sequence
  chemically synthesized
aaaagttattgcccaaataatt

SEQ ID NO: 1156147 - DNA, 22 bp, Artificial Sequence
  chemically synthesized
catcacaattatttgggcaata

SEQ ID NO: 1156148 - DNA, 22 bp, Artificial Sequence
  chemically synthesized
atcacaattatttgggcaataa

SEQ ID NO: 1156149 - DNA, 22 bp, Artificial Sequence
  chemically synthesized
cagtcatattcaaaagttattg

SEQ ID NO: 1156150 - DNA, 22 bp, Artificial Sequence
  chemically synthesized
acagtcatattcaaaagttatt

SEQ ID NO: 1156151 - DNA, 22 bp, Artificial Sequence
  chemically synthesized
tacagtcatattcaaaagttat

SEQ ID NO: 1156152 - DNA, 22 bp, Artificial Sequence
  chemically synthesized
ttacagtcatattcaaaagtta

SEQ ID NO: 1156153 - DNA, 22 bp, Artificial Sequence
  chemically synthesized
tttgggcaataacttttgaata

SEQ ID NO: 1156154 - DNA, 22 bp, Artificial Sequence
  chemically synthesized
tgcttttacagtcatattcaaa

SEQ ID NO: 1156155 - DNA, 22 bp, Artificial Sequence
  chemically synthesized
gggcaataacttttgaatatga

SEQ ID NO: 1156156 - DNA, 22 bp, Artificial Sequence
  chemically synthesized
gtgcttttacagtcatattcaa

SEQ ID NO: 1156157 - DNA, 22 bp, Artificial Sequence
  chemically synthesized
ggcaataacttttgaatatgac

SEQ ID NO: 1156158 - DNA, 22 bp, Artificial Sequence
  chemically synthesized
cttgtgcttttacagtcatatt

SEQ ID NO: 1156159 - DNA, 22 bp, Artificial Sequence
  chemically synthesized
ttgcttgtgcttttacagtcat

SEQ ID NO: 1156160 - DNA, 22 bp, Artificial Sequence
  chemically synthesized
gttgcttgtgcttttacagtca

SEQ ID NO: 1156161 - DNA, 22 bp, Artificial Sequence
  chemically synthesized
tgttgcttgtgcttttacagtc

SEQ ID NO: 1156162 - DNA, 22 bp, Artificial Sequence
  chemically synthesized
ttgttgcttgtgcttttacagt

SEQ ID NO: 1156163 - DNA, 22 bp, Artificial Sequence
  chemically synthesized
ttgaatatgactgtaaaagcac

SEQ ID NO: 1156164 - DNA, 22 bp, Artificial Sequence
  chemically synthesized
cttttgttgcttgtgcttttac

SEQ ID NO: 1156165 - DNA, 22 bp, Artificial Sequence
  chemically synthesized
tgaatatgactgtaaaagcaca

SEQ ID NO: 1156166 - DNA, 22 bp, Artificial Sequence
  chemically synthesized
gcttttgttgcttgtgctttta

SEQ ID NO: 1156167 - DNA, 22 bp, Artificial Sequence
  chemically synthesized
gaatatgactgtaaaagcacaa

SEQ ID NO: 1156168 - DNA, 22 bp, Artificial Sequence
  chemically synthesized
tgcttttgttgcttgtgctttt

SEQ ID NO: 1156169 - DNA, 22 bp, Artificial Sequence
  chemically synthesized
aatatgactgtaaaagcacaag

SEQ ID NO: 1156170 - DNA, 22 bp, Artificial Sequence
  chemically synthesized
ttgcttttgttgcttgtgcttt

SEQ ID NO: 1156171 - DNA, 22 bp, Artificial Sequence
  chemically synthesized
tttttgcttttgttgcttgtgc

SEQ ID NO: 1156172 - DNA, 22 bp, Artificial Sequence
  chemically synthesized
agtctatttttgcttttgttgc

SEQ ID NO: 1156173 - DNA, 22 bp, Artificial Sequence
  chemically synthesized
taaaagcacaagcaacaaaagc

SEQ ID NO: 1156174 - DNA, 22 bp, Artificial Sequence
  chemically synthesized
gtataagtcctcagtctatttt

SEQ ID NO: 1156175 - DNA, 22 bp, Artificial Sequence
  chemically synthesized
ggtataagtcctcagtctattt

SEQ ID NO: 1156176 - DNA, 22 bp, Artificial Sequence
  chemically synthesized
gtttggtataagtcctcagtct

SEQ ID NO: 1156177 - DNA, 22 bp, Artificial Sequence
  chemically synthesized
agtttggtataagtcctcagtc

SEQ ID NO: 1156178 - DNA, 22 bp, Artificial Sequence
  chemically synthesized
tagtttggtataagtcctcagt

SEQ ID NO: 1156179 - DNA, 22 bp, Artificial Sequence
  chemically synthesized
ttagtttggtataagtcctcag

SEQ ID NO: 1156180 - DNA, 22 bp, Artificial Sequence
  chemically synthesized
tgcagaaatttttagtttggta

SEQ ID NO: 1156181 - DNA, 22 bp, Artificial Sequence
  chemically synthesized
ctgtgcagaaatttttagtttg

SEQ ID NO: 1156182 - DNA, 22 bp, Artificial Sequence
  chemically synthesized
aggacttataccaaactaaaaa

SEQ ID NO: 1156183 - DNA, 22 bp, Artificial Sequence
  chemically synthesized
gctgtgcagaaatttttagttt

SEQ ID NO: 1156184 - DNA, 22 bp, Artificial Sequence
  chemically synthesized
tgctgtgcagaaatttttagtt

SEQ ID NO: 1156185 - DNA, 22 bp, Artificial Sequence
  chemically synthesized
ttgctgtgcagaaatttttagt

SEQ ID NO: 1156186 - DNA, 22 bp, Artificial Sequence
  chemically synthesized
tttgctgtgcagaaatttttag

SEQ ID NO: 1156187 - DNA, 22 bp, Artificial Sequence
  chemically synthesized
ttttgctgtgcagaaattttta

SEQ ID NO: 1156188 - DNA, 22 bp, Artificial Sequence
  chemically synthesized
ataccaaactaaaaatttctgc

SEQ ID NO: 1156189 - DNA, 22 bp, Artificial Sequence
  chemically synthesized
taccaaactaaaaatttctgca

SEQ ID NO: 1156190 - DNA, 22 bp, Artificial Sequence
  chemically synthesized
atttttttgctgtgcagaaatt

SEQ ID NO: 1156191 - DNA, 22 bp, Artificial Sequence
  chemically synthesized
aatttttttgctgtgcagaaat

SEQ ID NO: 1156192 - DNA, 22 bp, Artificial Sequence
  chemically synthesized
taatttttttgctgtgcagaaa

SEQ ID NO: 1156193 - DNA, 22 bp, Artificial Sequence
  chemically synthesized
attttaatttttttgctgtgca

SEQ ID NO: 1156194 - DNA, 22 bp, Artificial Sequence
  chemically synthesized
aattttaatttttttgctgtgc

SEQ ID NO: 1156195 - DNA, 22 bp, Artificial Sequence
  chemically synthesized
taattttaatttttttgctgtg

SEQ ID NO: 1156196 - DNA, 22 bp, Artificial Sequence
  chemically synthesized
aaaatttctgcacagcaaaaaa

SEQ ID NO: 1156197 - DNA, 22 bp, Artificial Sequence
  chemically synthesized
attttaattttaatttttttgc

SEQ ID NO: 1156198 - DNA, 22 bp, Artificial Sequence
  chemically synthesized
aattttaattttaatttttttg

SEQ ID NO: 1156199 - DNA, 22 bp, Artificial Sequence
  chemically synthesized
taattttaattttaattttttt

SEQ ID NO: 1156200 - DNA, 22 bp, Artificial Sequence
  chemically synthesized
ttaattttaattttaatttttt

SEQ ID NO: 1156201 - DNA, 22 bp, Artificial Sequence
  chemically synthesized
ctgcacagcaaaaaaattaaaa

SEQ ID NO: 1156202 - DNA, 22 bp, Artificial Sequence
  chemically synthesized
tgcacagcaaaaaaattaaaat

SEQ ID NO: 1156203 - DNA, 22 bp, Artificial Sequence
  chemically synthesized
atttttaattttaattttaatt

SEQ ID NO: 1156204 - DNA, 22 bp, Artificial Sequence
  chemically synthesized
cacagcaaaaaaattaaaatta

SEQ ID NO: 1156205 - DNA, 22 bp, Artificial Sequence
  chemically synthesized
ttaatttttaattttaatttta

SEQ ID NO: 1156206 - DNA, 22 bp, Artificial Sequence
  chemically synthesized
tgttaatttttaattttaattt

SEQ ID NO: 1156207 - DNA, 22 bp, Artificial Sequence
  chemically synthesized
ctctgttaatttttaattttaa

SEQ ID NO: 1156208 - DNA, 22 bp, Artificial Sequence
  chemically synthesized
actctgttaatttttaatttta

SEQ ID NO: 1156209 - DNA, 22 bp, Artificial Sequence
  chemically synthesized
tactctgttaatttttaatttt

SEQ ID NO: 1156210 - DNA, 22 bp, Artificial Sequence
  chemically synthesized
tttactctgttaatttttaatt

SEQ ID NO: 1156211 - DNA, 22 bp, Artificial Sequence
  chemically synthesized
aaattaaaattaaaaattaaca

SEQ ID NO: 1156212 - DNA, 22 bp, Artificial Sequence
  chemically synthesized
gatatctctttactctgttaat

SEQ ID NO: 1156213 - DNA, 22 bp, Artificial Sequence
  chemically synthesized
aaattaaaaattaacagagtaa

SEQ ID NO: 1156214 - DNA, 22 bp, Artificial Sequence
  chemically synthesized
ttggatatctctttactctgtt

SEQ ID NO: 1156215 - DNA, 22 bp, Artificial Sequence
  chemically synthesized
tattggatatctctttactctg

SEQ ID NO: 1156216 - DNA, 22 bp, Artificial Sequence
  chemically synthesized
aaaattaacagagtaaagagat

SEQ ID NO: 1156217 - DNA, 22 bp, Artificial Sequence
  chemically synthesized
attctattggatatctctttac

SEQ ID NO: 1156218 - DNA, 22 bp, Artificial Sequence
  chemically synthesized
tcattctattggatatctcttt

SEQ ID NO: 1156219 - DNA, 22 bp, Artificial Sequence
  chemically synthesized
ctcattctattggatatctctt

SEQ ID NO: 1156220 - DNA, 22 bp, Artificial Sequence
  chemically synthesized
tctcattctattggatatctct

SEQ ID NO: 1156221 - DNA, 22 bp, Artificial Sequence
  chemically synthesized
ttctcattctattggatatctc

SEQ ID NO: 1156222 - DNA, 22 bp, Artificial Sequence
  chemically synthesized
acagagtaaagagatatccaat

SEQ ID NO: 1156223 - DNA, 22 bp, Artificial Sequence
  chemically synthesized
caaatatttttctcattctatt

SEQ ID NO: 1156224 - DNA, 22 bp, Artificial Sequence
  chemically synthesized
gcaaatatttttctcattctat

SEQ ID NO: 1156225 - DNA, 22 bp, Artificial Sequence
  chemically synthesized
tatgaacccccatcagatatat

SEQ ID NO: 1156226 - DNA, 22 bp, Artificial Sequence
  chemically synthesized
atatgaacccccatcagatata

SEQ ID NO: 1156227 - DNA, 22 bp, Artificial Sequence
  chemically synthesized
tatatgaacccccatcagatat

SEQ ID NO: 1156228 - DNA, 22 bp, Artificial Sequence
  chemically synthesized
ttatatgaacccccatcagata

SEQ ID NO: 1156229 - DNA, 22 bp, Artificial Sequence
  chemically synthesized
gcaaactatatatctgatgggg

SEQ ID NO: 1156230 - DNA, 22 bp, Artificial Sequence
  chemically synthesized
caaactatatatctgatggggg

SEQ ID NO: 1156231 - DNA, 22 bp, Artificial Sequence
  chemically synthesized
catatttttatatgaaccccca

SEQ ID NO: 1156232 - DNA, 22 bp, Artificial Sequence
  chemically synthesized
ccatatttttatatgaaccccc

SEQ ID NO: 1156233 - DNA, 22 bp, Artificial Sequence
  chemically synthesized
tatatctgatgggggttcatat

SEQ ID NO: 1156234 - DNA, 22 bp, Artificial Sequence
  chemically synthesized
ttccatatttttatatgaaccc

SEQ ID NO: 1156235 - DNA, 22 bp, Artificial Sequence
  chemically synthesized
cttccatatttttatatgaacc

SEQ ID NO: 1156236 - DNA, 22 bp, Artificial Sequence
  chemically synthesized
aatttcttccatatttttatat

SEQ ID NO: 1156237 - DNA, 22 bp, Artificial Sequence
  chemically synthesized
atgggggttcatataaaaatat

SEQ ID NO: 1156238 - DNA, 22 bp, Artificial Sequence
  chemically synthesized
gttgaatttcttccatattttt

SEQ ID NO: 1156239 - DNA, 22 bp, Artificial Sequence
  chemically synthesized
atataaaaatatggaagaaatt

SEQ ID NO: 1156240 - DNA, 22 bp, Artificial Sequence
  chemically synthesized
tggagttggttgaatttcttcc

SEQ ID NO: 1156241 - DNA, 22 bp, Artificial Sequence
  chemically synthesized
ctatggagttggttgaatttct

SEQ ID NO: 1156242 - DNA, 22 bp, Artificial Sequence
  chemically synthesized
gctatggagttggttgaatttc

SEQ ID NO: 1156243 - DNA, 22 bp, Artificial Sequence
  chemically synthesized
ttgctatggagttggttgaatt

SEQ ID NO: 1156244 - DNA, 22 bp, Artificial Sequence
  chemically synthesized
cttgctatggagttggttgaat

SEQ ID NO: 1156245 - DNA, 22 bp, Artificial Sequence
  chemically synthesized
tcttgctatggagttggttgaa

SEQ ID NO: 1156246 - DNA, 22 bp, Artificial Sequence
  chemically synthesized
ttttcttgctatggagttggtt

SEQ ID NO: 1156247 - DNA, 22 bp, Artificial Sequence
  chemically synthesized
gttttcttgctatggagttggt

SEQ ID NO: 1156248 - DNA, 22 bp, Artificial Sequence
  chemically synthesized
tttgttttcttgctatggagtt

SEQ ID NO: 1156249 - DNA, 22 bp, Artificial Sequence
  chemically synthesized
aaccaactccatagcaagaaaa

SEQ ID NO: 1156250 - DNA, 22 bp, Artificial Sequence
  chemically synthesized
atcaggttatttgttttcttgc

SEQ ID NO: 1156251 - DNA, 22 bp, Artificial Sequence
  chemically synthesized
aatcaggttatttgttttcttg

SEQ ID NO: 1156252 - DNA, 22 bp, Artificial Sequence
  chemically synthesized
taatcaggttatttgttttctt

SEQ ID NO: 1156253 - DNA, 22 bp, Artificial Sequence
  chemically synthesized
ttaatcaggttatttgttttct

SEQ ID NO: 1156254 - DNA, 22 bp, Artificial Sequence
  chemically synthesized
tttttaatcaggttatttgttt

SEQ ID NO: 1156255 - DNA, 22 bp, Artificial Sequence
  chemically synthesized
catagcaagaaaacaaataacc

SEQ ID NO: 1156256 - DNA, 22 bp, Artificial Sequence
  chemically synthesized
cctatttttaatcaggttattt

SEQ ID NO: 1156257 - DNA, 22 bp, Artificial Sequence
  chemically synthesized
gcctatttttaatcaggttatt

SEQ ID NO: 1156258 - DNA, 22 bp, Artificial Sequence
  chemically synthesized
tgcctatttttaatcaggttat

SEQ ID NO: 1156259 - DNA, 22 bp, Artificial Sequence
  chemically synthesized
ttgcctatttttaatcaggtta

SEQ ID NO: 1156260 - DNA, 22 bp, Artificial Sequence
  chemically synthesized
gtcttttgcctatttttaatca

SEQ ID NO: 1156261 - DNA, 22 bp, Artificial Sequence
  chemically synthesized
ggtcttttgcctatttttaatc

SEQ ID NO: 1156262 - DNA, 22 bp, Artificial Sequence
  chemically synthesized
tggtcttttgcctatttttaat

SEQ ID NO: 1156263 - DNA, 22 bp, Artificial Sequence
  chemically synthesized
ttttggtcttttgcctattttt

SEQ ID NO: 1156264 - DNA, 22 bp, Artificial Sequence
  chemically synthesized
attaaaaataggcaaaagacca

SEQ ID NO: 1156265 - DNA, 22 bp, Artificial Sequence
  chemically synthesized
aaaataggcaaaagaccaaaat

SEQ ID NO: 1156266 - DNA, 22 bp, Artificial Sequence
  chemically synthesized
tgataaatgtctattttggtct

SEQ ID NO: 1156267 - DNA, 22 bp, Artificial Sequence
  chemically synthesized
atgataaatgtctattttggtc

SEQ ID NO: 1156268 - DNA, 22 bp, Artificial Sequence
  chemically synthesized
tatgataaatgtctattttggt

SEQ ID NO: 1156269 - DNA, 22 bp, Artificial Sequence
  chemically synthesized
ttatgataaatgtctattttgg

SEQ ID NO: 1156270 - DNA, 22 bp, Artificial Sequence
  chemically synthesized
tcccttttatgataaatgtcta

SEQ ID NO: 1156271 - DNA, 22 bp, Artificial Sequence
  chemically synthesized
gtcccttttatgataaatgtct

SEQ ID NO: 1156272 - DNA, 22 bp, Artificial Sequence
  chemically synthesized
tccatttgtcccttttatgata

SEQ ID NO: 1156273 - DNA, 22 bp, Artificial Sequence
  chemically synthesized
tgttatccatttgtccctttta

SEQ ID NO: 1156274 - DNA, 22 bp, Artificial Sequence
  chemically synthesized
atatctgtgttatccatttgtc

SEQ ID NO: 1156275 - DNA, 22 bp, Artificial Sequence
  chemically synthesized
atcataaaagggacaaatggat

SEQ ID NO: 1156276 - DNA, 22 bp, Artificial Sequence
  chemically synthesized
catatctgtgttatccatttgt

SEQ ID NO: 1156277 - DNA, 22 bp, Artificial Sequence
  chemically synthesized
tcataaaagggacaaatggata

SEQ ID NO: 1156278 - DNA, 22 bp, Artificial Sequence
  chemically synthesized
tcatatctgtgttatccatttg

SEQ ID NO: 1156279 - DNA, 22 bp, Artificial Sequence
  chemically synthesized
ttcatatctgtgttatccattt

SEQ ID NO: 1156280 - DNA, 22 bp, Artificial Sequence
  chemically synthesized
tttcatatctgtgttatccatt

SEQ ID NO: 1156281 - DNA, 22 bp, Artificial Sequence
  chemically synthesized
agcattttttcatatctgtgtt

SEQ ID NO: 1156282 - DNA, 22 bp, Artificial Sequence
  chemically synthesized
ttgagcattttttcatatctgt

SEQ ID NO: 1156283 - DNA, 22 bp, Artificial Sequence
  chemically synthesized
gtgctgttgagcattttttcat

SEQ ID NO: 1156284 - DNA, 22 bp, Artificial Sequence
  chemically synthesized
ccagatgattagtgctgttgag

SEQ ID NO: 1156285 - DNA, 22 bp, Artificial Sequence
  chemically synthesized
cccagatgattagtgctgttga

SEQ ID NO: 1156286 - DNA, 22 bp, Artificial Sequence
  chemically synthesized
catttcccagatgattagtgct

SEQ ID NO: 1156287 - DNA, 22 bp, Artificial Sequence
  chemically synthesized
gcatttcccagatgattagtgc

SEQ ID NO: 1156288 - DNA, 22 bp, Artificial Sequence
  chemically synthesized
atttgcatttcccagatgatta

SEQ ID NO: 1156289 - DNA, 22 bp, Artificial Sequence
  chemically synthesized
aatttgcatttcccagatgatt

SEQ ID NO: 1156290 - DNA, 22 bp, Artificial Sequence
  chemically synthesized
taatttgcatttcccagatgat

SEQ ID NO: 1156291 - DNA, 22 bp, Artificial Sequence
  chemically synthesized
aacagcactaatcatctgggaa

SEQ ID NO: 1156292 - DNA, 22 bp, Artificial Sequence
  chemically synthesized
tggttttaatttgcatttccca

SEQ ID NO: 1156293 - DNA, 22 bp, Artificial Sequence
  chemically synthesized
attgtggttttaatttgcattt

SEQ ID NO: 1156294 - DNA, 22 bp, Artificial Sequence
  chemically synthesized
atcatctgggaaatgcaaatta

SEQ ID NO: 1156295 - DNA, 22 bp, Artificial Sequence
  chemically synthesized
atacctcattgtggttttaatt

SEQ ID NO: 1156296 - DNA, 22 bp, Artificial Sequence
  chemically synthesized
ggaaatgcaaattaaaaccaca

SEQ ID NO: 1156297 - DNA, 22 bp, Artificial Sequence
  chemically synthesized
caagtaagctgatacctcattg

SEQ ID NO: 1156298 - DNA, 22 bp, Artificial Sequence
  chemically synthesized
gcaagtaagctgatacctcatt

SEQ ID NO: 1156299 - DNA, 22 bp, Artificial Sequence
  chemically synthesized
tgcaagtaagctgatacctcat

SEQ ID NO: 1156300 - DNA, 22 bp, Artificial Sequence
  chemically synthesized
tttgcaagtaagctgatacctc

SEQ ID NO: 1156301 - DNA, 22 bp, Artificial Sequence
  chemically synthesized
ctttgcaagtaagctgatacct

SEQ ID NO: 1156302 - DNA, 22 bp, Artificial Sequence
  chemically synthesized
aaaccacaatgaggtatcagct

SEQ ID NO: 1156303 - DNA, 22 bp, Artificial Sequence
  chemically synthesized
tctttgcaagtaagctgatacc

SEQ ID NO: 1156304 - DNA, 22 bp, Artificial Sequence
  chemically synthesized
ttctttgcaagtaagctgatac

SEQ ID NO: 1156305 - DNA, 22 bp, Artificial Sequence
  chemically synthesized
ccttttctttgcaagtaagctg

SEQ ID NO: 1156306 - DNA, 22 bp, Artificial Sequence
  chemically synthesized
acttgcaaagaaaagggaacac

SEQ ID NO: 1156307 - DNA, 22 bp, Artificial Sequence
  chemically synthesized
cttgcaaagaaaagggaacact

SEQ ID NO: 1156308 - DNA, 22 bp, Artificial Sequence
  chemically synthesized
gcaaagaaaagggaacacttat

SEQ ID NO: 1156309 - DNA, 22 bp, Artificial Sequence
  chemically synthesized
caaagaaaagggaacacttata

SEQ ID NO: 1156310 - DNA, 22 bp, Artificial Sequence
  chemically synthesized
ccacaaacagtgtataagtgtt

SEQ ID NO: 1156311 - DNA, 22 bp, Artificial Sequence
  chemically synthesized
cactcccacaaacagtgtataa

SEQ ID NO: 1156312 - DNA, 22 bp, Artificial Sequence
  chemically synthesized
acactcccacaaacagtgtata

SEQ ID NO: 1156313 - DNA, 22 bp, Artificial Sequence
  chemically synthesized
aaataatttacactcccacaaa

SEQ ID NO: 1156314 - DNA, 22 bp, Artificial Sequence
  chemically synthesized
atacactgtttgtgggagtgta

SEQ ID NO: 1156315 - DNA, 22 bp, Artificial Sequence
  chemically synthesized
tacactgtttgtgggagtgtaa

SEQ ID NO: 1156316 - DNA, 22 bp, Artificial Sequence
  chemically synthesized
aacaatagttgaaataatttac

SEQ ID NO: 1156317 - DNA, 22 bp, Artificial Sequence
  chemically synthesized
tttgtgggagtgtaaattattt

SEQ ID NO: 1156318 - DNA, 22 bp, Artificial Sequence
  chemically synthesized
caacaatagttgaaataattta

SEQ ID NO: 1156319 - DNA, 22 bp, Artificial Sequence
  chemically synthesized
tcaacaatagttgaaataattt

SEQ ID NO: 1156320 - DNA, 22 bp, Artificial Sequence
  chemically synthesized
gtgggagtgtaaattatttcaa

SEQ ID NO: 1156321 - DNA, 22 bp, Artificial Sequence
  chemically synthesized
tgggagtgtaaattatttcaac

SEQ ID NO: 1156322 - DNA, 22 bp, Artificial Sequence
  chemically synthesized
ttttcaacaatagttgaaataa

SEQ ID NO: 1156323 - DNA, 22 bp, Artificial Sequence
  chemically synthesized
tttcaactattgttgaaaacag

SEQ ID NO: 1156324 - DNA, 22 bp, Artificial Sequence
  chemically synthesized
tggaatcaccacactgttttca

SEQ ID NO: 1156325 - DNA, 22 bp, Artificial Sequence
  chemically synthesized
gtggaatcaccacactgttttc

SEQ ID NO: 1156326 - DNA, 22 bp, Artificial Sequence
  chemically synthesized
caactattgttgaaaacagtgt

SEQ ID NO: 1156327 - DNA, 22 bp, Artificial Sequence
  chemically synthesized
tgtggaatcaccacactgtttt

SEQ ID NO: 1156328 - DNA, 22 bp, Artificial Sequence
  chemically synthesized
aactattgttgaaaacagtgtg

SEQ ID NO: 1156329 - DNA, 22 bp, Artificial Sequence
  chemically synthesized
ttgttgaaaacagtgtggtgat

SEQ ID NO: 1156330 - DNA, 22 bp, Artificial Sequence
  chemically synthesized
aggtctttgtggaatcaccaca

SEQ ID NO: 1156331 - DNA, 22 bp, Artificial Sequence
  chemically synthesized
gaggtctttgtggaatcaccac

SEQ ID NO: 1156332 - DNA, 22 bp, Artificial Sequence
  chemically synthesized
ttgaaaacagtgtggtgattcc

SEQ ID NO: 1156333 - DNA, 22 bp, Artificial Sequence
  chemically synthesized
tgaggtctttgtggaatcacca

SEQ ID NO: 1156334 - DNA, 22 bp, Artificial Sequence
  chemically synthesized
aaaacagtgtggtgattccaca

SEQ ID NO: 1156335 - DNA, 22 bp, Artificial Sequence
  chemically synthesized
ttttgaggtctttgtggaatca

SEQ ID NO: 1156336 - DNA, 22 bp, Artificial Sequence
  chemically synthesized
tgttttgaggtctttgtggaat

SEQ ID NO: 1156337 - DNA, 22 bp, Artificial Sequence
  chemically synthesized
cacaaagacctcaaaacagaac

SEQ ID NO: 1156338 - DNA, 22 bp, Artificial Sequence
  chemically synthesized
ggtccaatggtagttctgtttt

SEQ ID NO: 1156339 - DNA, 22 bp, Artificial Sequence
  chemically synthesized
ctgggtccaatggtagttctgt

SEQ ID NO: 1156340 - DNA, 22 bp, Artificial Sequence
  chemically synthesized
aaaacagaactaccattggacc

SEQ ID NO: 1156341 - DNA, 22 bp, Artificial Sequence
  chemically synthesized
ccattggacccagcaatcctat

SEQ ID NO: 1156342 - DNA, 22 bp, Artificial Sequence
  chemically synthesized
agtgtatacacaataataggat

SEQ ID NO: 1156343 - DNA, 22 bp, Artificial Sequence
  chemically synthesized
aagtgtatacacaataatagga

SEQ ID NO: 1156344 - DNA, 22 bp, Artificial Sequence
  chemically synthesized
taagtgtatacacaataatagg

SEQ ID NO: 1156345 - DNA, 22 bp, Artificial Sequence
  chemically synthesized
gacccagcaatcctattattgt

SEQ ID NO: 1156346 - DNA, 22 bp, Artificial Sequence
  chemically synthesized
ctttaagtgtatacacaataat

SEQ ID NO: 1156347 - DNA, 22 bp, Artificial Sequence
  chemically synthesized
tattcctttaagtgtatacaca

SEQ ID NO: 1156348 - DNA, 22 bp, Artificial Sequence
  chemically synthesized
atattcctttaagtgtatacac

SEQ ID NO: 1156349 - DNA, 22 bp, Artificial Sequence
  chemically synthesized
ttattgtgtatacacttaaagg

SEQ ID NO: 1156350 - DNA, 22 bp, Artificial Sequence
  chemically synthesized
ttgtgtatacacttaaaggaat

SEQ ID NO: 1156351 - DNA, 22 bp, Artificial Sequence
  chemically synthesized
gtagaatgatttatattccttt

SEQ ID NO: 1156352 - DNA, 22 bp, Artificial Sequence
  chemically synthesized
tgtatacacttaaaggaatata

SEQ ID NO: 1156353 - DNA, 22 bp, Artificial Sequence
  chemically synthesized
ggtagaatgatttatattcctt

SEQ ID NO: 1156354 - DNA, 22 bp, Artificial Sequence
  chemically synthesized
tggtagaatgatttatattcct

SEQ ID NO: 1156355 - DNA, 22 bp, Artificial Sequence
  chemically synthesized
ttggtagaatgatttatattcc

SEQ ID NO: 1156356 - DNA, 22 bp, Artificial Sequence
  chemically synthesized
tttggtagaatgatttatattc

SEQ ID NO: 1156357 - DNA, 22 bp, Artificial Sequence
  chemically synthesized
aaaggaatataaatcattctac

SEQ ID NO: 1156358 - DNA, 22 bp, Artificial Sequence
  chemically synthesized
aaggaatataaatcattctacc

SEQ ID NO: 1156359 - DNA, 22 bp, Artificial Sequence
  chemically synthesized
taccaaaaagacacatgcacac

SEQ ID NO: 1156360 - DNA, 22 bp, Artificial Sequence
  chemically synthesized
ccacgaacatatgtgtgcatgt

SEQ ID NO: 1156361 - DNA, 22 bp, Artificial Sequence
  chemically synthesized
ccaaaaagacacatgcacacat

SEQ ID NO: 1156362 - DNA, 22 bp, Artificial Sequence
  chemically synthesized
tgaatagtgctgccacgaacat

SEQ ID NO: 1156363 - DNA, 22 bp, Artificial Sequence
  chemically synthesized
tgattgtgaatagtgctgccac

SEQ ID NO: 1156364 - DNA, 22 bp, Artificial Sequence
  chemically synthesized
gtgattgtgaatagtgctgcca

SEQ ID NO: 1156365 - DNA, 22 bp, Artificial Sequence
  chemically synthesized
tgtgattgtgaatagtgctgcc

SEQ ID NO: 1156366 - DNA, 22 bp, Artificial Sequence
  chemically synthesized
tctttgtgattgtgaatagtgc

SEQ ID NO: 1156367 - DNA, 22 bp, Artificial Sequence
  chemically synthesized
attgtctttgtgattgtgaata

SEQ ID NO: 1156368 - DNA, 22 bp, Artificial Sequence
  chemically synthesized
gtggcagcactattcacaatca

SEQ ID NO: 1156369 - DNA, 22 bp, Artificial Sequence
  chemically synthesized
ggttgattgtctttgtgattgt

SEQ ID NO: 1156370 - DNA, 22 bp, Artificial Sequence
  chemically synthesized
aggttgattgtctttgtgattg

SEQ ID NO: 1156371 - DNA, 22 bp, Artificial Sequence
  chemically synthesized
ttcacaatcacaaagacaatca

SEQ ID NO: 1156372 - DNA, 22 bp, Artificial Sequence
  chemically synthesized
ataagcatttaggttgattgtc

SEQ ID NO: 1156373 - DNA, 22 bp, Artificial Sequence
  chemically synthesized
acaatcacaaagacaatcaacc

SEQ ID NO: 1156374 - DNA, 22 bp, Artificial Sequence
  chemically synthesized
ccactgataagcatttaggttg

SEQ ID NO: 1156375 - DNA, 22 bp, Artificial Sequence
  chemically synthesized
accactgataagcatttaggtt

SEQ ID NO: 1156376 - DNA, 22 bp, Artificial Sequence
  chemically synthesized
tccagtttaccactgataagca

SEQ ID NO: 1156377 - DNA, 22 bp, Artificial Sequence
  chemically synthesized
atccagtttaccactgataagc

SEQ ID NO: 1156378 - DNA, 22 bp, Artificial Sequence
  chemically synthesized
tatccagtttaccactgataag

SEQ ID NO: 1156379 - DNA, 22 bp, Artificial Sequence
  chemically synthesized
tttatccagtttaccactgata

SEQ ID NO: 1156380 - DNA, 22 bp, Artificial Sequence
  chemically synthesized
ctttatccagtttaccactgat

SEQ ID NO: 1156381 - DNA, 22 bp, Artificial Sequence
  chemically synthesized
tctttatccagtttaccactga

SEQ ID NO: 1156382 - DNA, 22 bp, Artificial Sequence
  chemically synthesized
aatgcttatcagtggtaaactg

SEQ ID NO: 1156383 - DNA, 22 bp, Artificial Sequence
  chemically synthesized
ccacattttctttatccagttt

SEQ ID NO: 1156384 - DNA, 22 bp, Artificial Sequence
  chemically synthesized
accacattttctttatccagtt

SEQ ID NO: 1156385 - DNA, 22 bp, Artificial Sequence
  chemically synthesized
atcagtggtaaactggataaag

SEQ ID NO: 1156386 - DNA, 22 bp, Artificial Sequence
  chemically synthesized
tcagtggtaaactggataaaga

SEQ ID NO: 1156387 - DNA, 22 bp, Artificial Sequence
  chemically synthesized
catggtatgtgtttaccacatt

SEQ ID NO: 1156388 - DNA, 22 bp, Artificial Sequence
  chemically synthesized
gataaagaaaatgtggtaaaca

SEQ ID NO: 1156389 - DNA, 22 bp, Artificial Sequence
  chemically synthesized
atggccgcatagtattccatgg

SEQ ID NO: 1156390 - DNA, 22 bp, Artificial Sequence
  chemically synthesized
catggccgcatagtattccatg

SEQ ID NO: 1156391 - DNA, 22 bp, Artificial Sequence
  chemically synthesized
tcatggccgcatagtattccat

SEQ ID NO: 1156392 - DNA, 22 bp, Artificial Sequence
  chemically synthesized
ttcatggccgcatagtattcca

SEQ ID NO: 1156393 - DNA, 22 bp, Artificial Sequence
  chemically synthesized
tttcatggccgcatagtattcc

SEQ ID NO: 1156394 - DNA, 22 bp, Artificial Sequence
  chemically synthesized
tttttcatggccgcatagtatt

SEQ ID NO: 1156395 - DNA, 22 bp, Artificial Sequence
  chemically synthesized
ctctttttcatggccgcatagt

SEQ ID NO: 1156396 - DNA, 22 bp, Artificial Sequence
  chemically synthesized
actctttttcatggccgcatag

SEQ ID NO: 1156397 - DNA, 22 bp, Artificial Sequence
  chemically synthesized
tgcggccatgaaaaagagtaag

SEQ ID NO: 1156398 - DNA, 22 bp, Artificial Sequence
  chemically synthesized
caaagaacataatcttactctt

SEQ ID NO: 1156399 - DNA, 22 bp, Artificial Sequence
  chemically synthesized
tgcaaagaacataatcttactc

SEQ ID NO: 1156400 - DNA, 22 bp, Artificial Sequence
  chemically synthesized
ctgcaaagaacataatcttact

SEQ ID NO: 1156401 - DNA, 22 bp, Artificial Sequence
  chemically synthesized
cgtttctgcaaagaacataatc

SEQ ID NO: 1156402 - DNA, 22 bp, Artificial Sequence
  chemically synthesized
atctacgtttctgcaaagaaca

SEQ ID NO: 1156403 - DNA, 22 bp, Artificial Sequence
  chemically synthesized
catctacgtttctgcaaagaac

SEQ ID NO: 1156404 - DNA, 22 bp, Artificial Sequence
  chemically synthesized
cagcttcatctacgtttctgca

SEQ ID NO: 1156405 - DNA, 22 bp, Artificial Sequence
  chemically synthesized
tgttctttgcagaaacgtagat

SEQ ID NO: 1156406 - DNA, 22 bp, Artificial Sequence
  chemically synthesized
tttgcagaaacgtagatgaagc

SEQ ID NO: 1156407 - DNA, 22 bp, Artificial Sequence
  chemically synthesized
tgcagaaacgtagatgaagctg

SEQ ID NO: 1156408 - DNA, 22 bp, Artificial Sequence
  chemically synthesized
gcagaaacgtagatgaagctgg

SEQ ID NO: 1156409 - DNA, 22 bp, Artificial Sequence
  chemically synthesized
cagaaacgtagatgaagctgga

SEQ ID NO: 1156410 - DNA, 22 bp, Artificial Sequence
  chemically synthesized
aggataatggcctccagcttca

SEQ ID NO: 1156411 - DNA, 22 bp, Artificial Sequence
  chemically synthesized
ctaaggataatggcctccagct

SEQ ID NO: 1156412 - DNA, 22 bp, Artificial Sequence
  chemically synthesized
gctaaggataatggcctccagc

SEQ ID NO: 1156413 - DNA, 22 bp, Artificial Sequence
  chemically synthesized
tgctaaggataatggcctccag

SEQ ID NO: 1156414 - DNA, 22 bp, Artificial Sequence
  chemically synthesized
ttttgctaaggataatggcctc

SEQ ID NO: 1156415 - DNA, 22 bp, Artificial Sequence
  chemically synthesized
cgttattttgctaaggataatg

SEQ ID NO: 1156416 - DNA, 22 bp, Artificial Sequence
  chemically synthesized
tgcgttattttgctaaggataa

SEQ ID NO: 1156417 - DNA, 22 bp, Artificial Sequence
  chemically synthesized
ctgcgttattttgctaaggata

SEQ ID NO: 1156418 - DNA, 22 bp, Artificial Sequence
  chemically synthesized
tttctgcgttattttgctaagg

SEQ ID NO: 1156419 - DNA, 22 bp, Artificial Sequence
  chemically synthesized
gaggccattatccttagcaaaa

SEQ ID NO: 1156420 - DNA, 22 bp, Artificial Sequence
  chemically synthesized
tgtttctgcgttattttgctaa

SEQ ID NO: 1156421 - DNA, 22 bp, Artificial Sequence
  chemically synthesized
ctgtttctgcgttattttgcta

SEQ ID NO: 1156422 - DNA, 22 bp, Artificial Sequence
  chemically synthesized
tctgtttctgcgttattttgct

SEQ ID NO: 1156423 - DNA, 22 bp, Artificial Sequence
  chemically synthesized
gttttctgtttctgcgttattt

SEQ ID NO: 1156424 - DNA, 22 bp, Artificial Sequence
  chemically synthesized
ggttttctgtttctgcgttatt

SEQ ID NO: 1156425 - DNA, 22 bp, Artificial Sequence
  chemically synthesized
tccttagcaaaataacgcagaa

SEQ ID NO: 1156426 - DNA, 22 bp, Artificial Sequence
  chemically synthesized
agcaaaataacgcagaaacaga

SEQ ID NO: 1156427 - DNA, 22 bp, Artificial Sequence
  chemically synthesized
gcaaaataacgcagaaacagaa

SEQ ID NO: 1156428 - DNA, 22 bp, Artificial Sequence
  chemically synthesized
taagtgagaacgtggtgtattt

SEQ ID NO: 1156429 - DNA, 22 bp, Artificial Sequence
  chemically synthesized
ataagtgagaacgtggtgtatt

SEQ ID NO: 1156430 - DNA, 22 bp, Artificial Sequence
  chemically synthesized
ccacttataagtgagaacgtgg

SEQ ID NO: 1156431 - DNA, 22 bp, Artificial Sequence
  chemically synthesized
gctcccacttataagtgagaac

SEQ ID NO: 1156432 - DNA, 22 bp, Artificial Sequence
  chemically synthesized
agctcccacttataagtgagaa

SEQ ID NO: 1156433 - DNA, 22 bp, Artificial Sequence
  chemically synthesized
atcatttagctcccacttataa

SEQ ID NO: 1156434 - DNA, 22 bp, Artificial Sequence
  chemically synthesized
tcatcatttagctcccacttat

SEQ ID NO: 1156435 - DNA, 22 bp, Artificial Sequence
  chemically synthesized
tcacttataagtgggagctaaa

SEQ ID NO: 1156436 - DNA, 22 bp, Artificial Sequence
  chemically synthesized
acttataagtgggagctaaatg

SEQ ID NO: 1156437 - DNA, 22 bp, Artificial Sequence
  chemically synthesized
ataagtgggagctaaatgatga

SEQ ID NO: 1156438 - DNA, 22 bp, Artificial Sequence
  chemically synthesized
taagtgggagctaaatgatgag

SEQ ID NO: 1156439 - DNA, 22 bp, Artificial Sequence
  chemically synthesized
tgtgcccatgtgttctcatcat

SEQ ID NO: 1156440 - DNA, 22 bp, Artificial Sequence
  chemically synthesized
tatgtgcccatgtgttctcatc

SEQ ID NO: 1156441 - DNA, 22 bp, Artificial Sequence
  chemically synthesized
cctctatgtgcccatgtgttct

SEQ ID NO: 1156442 - DNA, 22 bp, Artificial Sequence
  chemically synthesized
ccctctatgtgcccatgtgttc

SEQ ID NO: 1156443 - DNA, 22 bp, Artificial Sequence
  chemically synthesized
tttccctctatgtgcccatgtg

SEQ ID NO: 1156444 - DNA, 22 bp, Artificial Sequence
  chemically synthesized
aatgatgagaacacatgggcac

SEQ ID NO: 1156445 - DNA, 22 bp, Artificial Sequence
  chemically synthesized
ttgtttccctctatgtgcccat

SEQ ID NO: 1156446 - DNA, 22 bp, Artificial Sequence
  chemically synthesized
caataggccccatgtctgttgt

SEQ ID NO: 1156447 - DNA, 22 bp, Artificial Sequence
  chemically synthesized
caaactccaataggccccatgt

SEQ ID NO: 1156448 - DNA, 22 bp, Artificial Sequence
  chemically synthesized
ccaccctccaaactccaatagg

SEQ ID NO: 1156449 - DNA, 22 bp, Artificial Sequence
  chemically synthesized
tgccaccctccaaactccaata

SEQ ID NO: 1156450 - DNA, 22 bp, Artificial Sequence
  chemically synthesized
ctgccaccctccaaactccaat

SEQ ID NO: 1156451 - DNA, 22 bp, Artificial Sequence
  chemically synthesized
cttctgccaccctccaaactcc

SEQ ID NO: 1156452 - DNA, 22 bp, Artificial Sequence
  chemically synthesized
ccttctgccaccctccaaactc

SEQ ID NO: 1156453 - DNA, 22 bp, Artificial Sequence
  chemically synthesized
tccttctgccaccctccaaact

SEQ ID NO: 1156454 - DNA, 22 bp, Artificial Sequence
  chemically synthesized
tttccttctgccaccctccaaa

SEQ ID NO: 1156455 - DNA, 22 bp, Artificial Sequence
  chemically synthesized
attctttccttctgccaccctc

SEQ ID NO: 1156456 - DNA, 22 bp, Artificial Sequence
  chemically synthesized
ttggagtttggagggtggcaga

SEQ ID NO: 1156457 - DNA, 22 bp, Artificial Sequence
  chemically synthesized
ctaattctttccttctgccacc

SEQ ID NO: 1156458 - DNA, 22 bp, Artificial Sequence
  chemically synthesized
cctaattctttccttctgccac

SEQ ID NO: 1156459 - DNA, 22 bp, Artificial Sequence
  chemically synthesized
gagtttggagggtggcagaagg

SEQ ID NO: 1156460 - DNA, 22 bp, Artificial Sequence
  chemically synthesized
tcctaattctttccttctgcca

SEQ ID NO: 1156461 - DNA, 22 bp, Artificial Sequence
  chemically synthesized
ttcctaattctttccttctgcc

SEQ ID NO: 1156462 - DNA, 22 bp, Artificial Sequence
  chemically synthesized
tttcctaattctttccttctgc

SEQ ID NO: 1156463 - DNA, 22 bp, Artificial Sequence
  chemically synthesized
ttttttcctaattctttccttc

SEQ ID NO: 1156464 - DNA, 22 bp, Artificial Sequence
  chemically synthesized
ggagggtggcagaaggaaagaa

SEQ ID NO: 1156465 - DNA, 22 bp, Artificial Sequence
  chemically synthesized
gagggtggcagaaggaaagaat

SEQ ID NO: 1156466 - DNA, 22 bp, Artificial Sequence
  chemically synthesized
gttattttttcctaattctttc

SEQ ID NO: 1156467 - DNA, 22 bp, Artificial Sequence
  chemically synthesized
attagttattttttcctaattc

SEQ ID NO: 1156468 - DNA, 22 bp, Artificial Sequence
  chemically synthesized
gtactcattagttattttttcc

SEQ ID NO: 1156469 - DNA, 22 bp, Artificial Sequence
  chemically synthesized
agtactcattagttattttttc

SEQ ID NO: 1156470 - DNA, 22 bp, Artificial Sequence
  chemically synthesized
ggaaaaaataactaatgagtac

SEQ ID NO: 1156471 - DNA, 22 bp, Artificial Sequence
  chemically synthesized
atcaccaggtataagcttagta

SEQ ID NO: 1156472 - DNA, 22 bp, Artificial Sequence
  chemically synthesized
catcaccaggtataagcttagt

SEQ ID NO: 1156473 - DNA, 22 bp, Artificial Sequence
  chemically synthesized
tttcatcaccaggtataagctt

SEQ ID NO: 1156474 - DNA, 22 bp, Artificial Sequence
  chemically synthesized
atgagtactaagcttatacctg

SEQ ID NO: 1156475 - DNA, 22 bp, Artificial Sequence
  chemically synthesized
tacagattatttcatcaccagg

SEQ ID NO: 1156476 - DNA, 22 bp, Artificial Sequence
  chemically synthesized
ttgtacagattatttcatcacc

SEQ ID NO: 1156477 - DNA, 22 bp, Artificial Sequence
  chemically synthesized
agcttatacctggtgatgaaat

SEQ ID NO: 1156478 - DNA, 22 bp, Artificial Sequence
  chemically synthesized
attgtacagattatttcatcac

SEQ ID NO: 1156479 - DNA, 22 bp, Artificial Sequence
  chemically synthesized
atacctggtgatgaaataatct

SEQ ID NO: 1156480 - DNA, 22 bp, Artificial Sequence
  chemically synthesized
tacctggtgatgaaataatctg

SEQ ID NO: 1156481 - DNA, 22 bp, Artificial Sequence
  chemically synthesized
gtgatgaaataatctgtacaat

SEQ ID NO: 1156482 - DNA, 22 bp, Artificial Sequence
  chemically synthesized
tgtcatggaagtttattgtaca

SEQ ID NO: 1156483 - DNA, 22 bp, Artificial Sequence
  chemically synthesized
gtgtcatggaagtttattgtac

SEQ ID NO: 1156484 - DNA, 22 bp, Artificial Sequence
  chemically synthesized
tacaataaacttccatgacaca

SEQ ID NO: 1156485 - DNA, 22 bp, Artificial Sequence
  chemically synthesized
catgggtaaacttgtgtcatgg

SEQ ID NO: 1156486 - DNA, 22 bp, Artificial Sequence
  chemically synthesized
ttacatgggtaaacttgtgtca

SEQ ID NO: 1156487 - DNA, 22 bp, Artificial Sequence
  chemically synthesized
gttacatgggtaaacttgtgtc

SEQ ID NO: 1156488 - DNA, 22 bp, Artificial Sequence
  chemically synthesized
tgttacatgggtaaacttgtgt

SEQ ID NO: 1156489 - DNA, 22 bp, Artificial Sequence
  chemically synthesized
ccatgacacaagtttacccatg

SEQ ID NO: 1156490 - DNA, 22 bp, Artificial Sequence
  chemically synthesized
catgacacaagtttacccatgt

SEQ ID NO: 1156491 - DNA, 22 bp, Artificial Sequence
  chemically synthesized
acccatgtaacaaaactgcaca

SEQ ID NO: 1156492 - DNA, 22 bp, Artificial Sequence
  chemically synthesized
cccatgtaacaaaactgcacat

SEQ ID NO: 1156493 - DNA, 22 bp, Artificial Sequence
  chemically synthesized
ggtgcaagggtacatgtgcagt

SEQ ID NO: 1156494 - DNA, 22 bp, Artificial Sequence
  chemically synthesized
aggtgcaagggtacatgtgcag

SEQ ID NO: 1156495 - DNA, 22 bp, Artificial Sequence
  chemically synthesized
taggtgcaagggtacatgtgca

SEQ ID NO: 1156496 - DNA, 22 bp, Artificial Sequence
  chemically synthesized
ttaggtgcaagggtacatgtgc

SEQ ID NO: 1156497 - DNA, 22 bp, Artificial Sequence
  chemically synthesized
acttttaggtgcaagggtacat

SEQ ID NO: 1156498 - DNA, 22 bp, Artificial Sequence
  chemically synthesized
aacttttaggtgcaagggtaca

SEQ ID NO: 1156499 - DNA, 22 bp, Artificial Sequence
  chemically synthesized
taacttttaggtgcaagggtac

SEQ ID NO: 1156500 - DNA, 22 bp, Artificial Sequence
  chemically synthesized
tattttaacttttaggtgcaag

SEQ ID NO: 1156501 - DNA, 22 bp, Artificial Sequence
  chemically synthesized
cacatgtacccttgcacctaaa

SEQ ID NO: 1156502 - DNA, 22 bp, Artificial Sequence
  chemically synthesized
ttatattttaacttttaggtgc

SEQ ID NO: 1156503 - DNA, 22 bp, Artificial Sequence
  chemically synthesized
ctattatattttaacttttagg

SEQ ID NO: 1156504 - DNA, 22 bp, Artificial Sequence
  chemically synthesized
attactattatattttaacttt

SEQ ID NO: 1156505 - DNA, 22 bp, Artificial Sequence
  chemically synthesized
gcacctaaaagttaaaatataa

SEQ ID NO: 1156506 - DNA, 22 bp, Artificial Sequence
  chemically synthesized
cacctaaaagttaaaatataat

SEQ ID NO: 1156507 - DNA, 22 bp, Artificial Sequence
  chemically synthesized
aaagttaaaatataatagtaat

SEQ ID NO: 1156508 - DNA, 22 bp, Artificial Sequence
  chemically synthesized
acaaagatatcgttaattacta

SEQ ID NO: 1156509 - DNA, 22 bp, Artificial Sequence
  chemically synthesized
gacaaagatatcgttaattact

SEQ ID NO: 1156510 - DNA, 22 bp, Artificial Sequence
  chemically synthesized
tgacaaagatatcgttaattac

SEQ ID NO: 1156511 - DNA, 22 bp, Artificial Sequence
  chemically synthesized
ttgacaaagatatcgttaatta

SEQ ID NO: 1156512 - DNA, 22 bp, Artificial Sequence
  chemically synthesized
aaatataatagtaattaacgat

SEQ ID NO: 1156513 - DNA, 22 bp, Artificial Sequence
  chemically synthesized
ttttgacaaagatatcgttaat

SEQ ID NO: 1156514 - DNA, 22 bp, Artificial Sequence
  chemically synthesized
cttttgacaaagatatcgttaa

SEQ ID NO: 1156515 - DNA, 22 bp, Artificial Sequence
  chemically synthesized
tcttttgacaaagatatcgtta

SEQ ID NO: 1156516 - DNA, 22 bp, Artificial Sequence
  chemically synthesized
ttcttttgacaaagatatcgtt

SEQ ID NO: 1156517 - DNA, 22 bp, Artificial Sequence
  chemically synthesized
tttcttttgacaaagatatcgt

SEQ ID NO: 1156518 - DNA, 22 bp, Artificial Sequence
  chemically synthesized
ttttcttttgacaaagatatcg

SEQ ID NO: 1156519 - DNA, 22 bp, Artificial Sequence
  chemically synthesized
ttttttcttttgacaaagatat

SEQ ID NO: 1156520 - DNA, 22 bp, Artificial Sequence
  chemically synthesized
cttttttcttttgacaaagata

SEQ ID NO: 1156521 - DNA, 22 bp, Artificial Sequence
  chemically synthesized
ttcttttttcttttgacaaaga

SEQ ID NO: 1156522 - DNA, 22 bp, Artificial Sequence
  chemically synthesized
acgatatctttgtcaaaagaaa

SEQ ID NO: 1156523 - DNA, 22 bp, Artificial Sequence
  chemically synthesized
tgtcaaaagaaaaaagaagaga

SEQ ID NO: 1156524 - DNA, 22 bp, Artificial Sequence
  chemically synthesized
gtcaaaagaaaaaagaagagat

SEQ ID NO: 1156525 - DNA, 22 bp, Artificial Sequence
  chemically synthesized
tcaaaagaaaaaagaagagatt

SEQ ID NO: 1156526 - DNA, 22 bp, Artificial Sequence
  chemically synthesized
acaaaagtgaggtgataatctc

SEQ ID NO: 1156527 - DNA, 22 bp, Artificial Sequence
  chemically synthesized
gatagtagccatgctaacaaaa

SEQ ID NO: 1156528 - DNA, 22 bp, Artificial Sequence
  chemically synthesized
ggatagtagccatgctaacaaa

SEQ ID NO: 1156529 - DNA, 22 bp, Artificial Sequence
  chemically synthesized
tggatagtagccatgctaacaa

SEQ ID NO: 1156530 - DNA, 22 bp, Artificial Sequence
  chemically synthesized
tcacctcacttttgttagcatg

SEQ ID NO: 1156531 - DNA, 22 bp, Artificial Sequence
  chemically synthesized
ttttggatagtagccatgctaa

SEQ ID NO: 1156532 - DNA, 22 bp, Artificial Sequence
  chemically synthesized
gttttggatagtagccatgcta

SEQ ID NO: 1156533 - DNA, 22 bp, Artificial Sequence
  chemically synthesized
tgttttggatagtagccatgct

SEQ ID NO: 1156534 - DNA, 22 bp, Artificial Sequence
  chemically synthesized
ttgttttggatagtagccatgc

SEQ ID NO: 1156535 - DNA, 22 bp, Artificial Sequence
  chemically synthesized
tttgttttggatagtagccatg

SEQ ID NO: 1156536 - DNA, 22 bp, Artificial Sequence
  chemically synthesized
acttttgttagcatggctacta

SEQ ID NO: 1156537 - DNA, 22 bp, Artificial Sequence
  chemically synthesized
ttttgttttggatagtagccat

SEQ ID NO: 1156538 - DNA, 22 bp, Artificial Sequence
  chemically synthesized
tttttgttttggatagtagcca

SEQ ID NO: 1156539 - DNA, 22 bp, Artificial Sequence
  chemically synthesized
ttgttagcatggctactatcca

SEQ ID NO: 1156540 - DNA, 22 bp, Artificial Sequence
  chemically synthesized
tgttagcatggctactatccaa

SEQ ID NO: 1156541 - DNA, 22 bp, Artificial Sequence
  chemically synthesized
tctttttttgttttggatagta

SEQ ID NO: 1156542 - DNA, 22 bp, Artificial Sequence
  chemically synthesized
gttagcatggctactatccaaa

SEQ ID NO: 1156543 - DNA, 22 bp, Artificial Sequence
  chemically synthesized
atctttttttgttttggatagt

SEQ ID NO: 1156544 - DNA, 22 bp, Artificial Sequence
  chemically synthesized
ttagcatggctactatccaaaa

SEQ ID NO: 1156545 - DNA, 22 bp, Artificial Sequence
  chemically synthesized
gcatggctactatccaaaacaa

SEQ ID NO: 1156546 - DNA, 22 bp, Artificial Sequence
  chemically synthesized
tcaacatttatctttttttgtt

SEQ ID NO: 1156547 - DNA, 22 bp, Artificial Sequence
  chemically synthesized
ctatccaaaacaaaaaaagata

SEQ ID NO: 1156548 - DNA, 22 bp, Artificial Sequence
  chemically synthesized
tccaaaacaaaaaaagataaat

SEQ ID NO: 1156549 - DNA, 22 bp, Artificial Sequence
  chemically synthesized
aatcgttatcaacatttatctt

SEQ ID NO: 1156550 - DNA, 22 bp, Artificial Sequence
  chemically synthesized
ctaaatcgttatcaacatttat

SEQ ID NO: 1156551 - DNA, 22 bp, Artificial Sequence
  chemically synthesized
cctaaatcgttatcaacattta

SEQ ID NO: 1156552 - DNA, 22 bp, Artificial Sequence
  chemically synthesized
tcctaaatcgttatcaacattt

SEQ ID NO: 1156553 - DNA, 22 bp, Artificial Sequence
  chemically synthesized
ttcctaaatcgttatcaacatt

SEQ ID NO: 1156554 - DNA, 22 bp, Artificial Sequence
  chemically synthesized
tttcctaaatcgttatcaacat

SEQ ID NO: 1156555 - DNA, 22 bp, Artificial Sequence
  chemically synthesized
ataacgatttaggaaaaaggca

SEQ ID NO: 1156556 - DNA, 22 bp, Artificial Sequence
  chemically synthesized
caggtacgtaatacatgccttt

SEQ ID NO: 1156557 - DNA, 22 bp, Artificial Sequence
  chemically synthesized
gcaggtacgtaatacatgcctt

SEQ ID NO: 1156558 - DNA, 22 bp, Artificial Sequence
  chemically synthesized
tgcaggtacgtaatacatgcct

SEQ ID NO: 1156559 - DNA, 22 bp, Artificial Sequence
  chemically synthesized
ttgcaggtacgtaatacatgcc

SEQ ID NO: 1156560 - DNA, 22 bp, Artificial Sequence
  chemically synthesized
aggaaaaaggcatgtattacgt

SEQ ID NO: 1156561 - DNA, 22 bp, Artificial Sequence
  chemically synthesized
acttttgcaggtacgtaataca

SEQ ID NO: 1156562 - DNA, 22 bp, Artificial Sequence
  chemically synthesized
ggaaaaaggcatgtattacgta

SEQ ID NO: 1156563 - DNA, 22 bp, Artificial Sequence
  chemically synthesized
aacttttgcaggtacgtaatac

SEQ ID NO: 1156564 - DNA, 22 bp, Artificial Sequence
  chemically synthesized
taacttttgcaggtacgtaata

SEQ ID NO: 1156565 - DNA, 22 bp, Artificial Sequence
  chemically synthesized
ttaacttttgcaggtacgtaat

SEQ ID NO: 1156566 - DNA, 22 bp, Artificial Sequence
  chemically synthesized
gtaatttttaacttttgcaggt

SEQ ID NO: 1156567 - DNA, 22 bp, Artificial Sequence
  chemically synthesized
attagtaatttttaacttttgc

SEQ ID NO: 1156568 - DNA, 22 bp, Artificial Sequence
  chemically synthesized
aattagtaatttttaacttttg

SEQ ID NO: 1156569 - DNA, 22 bp, Artificial Sequence
  chemically synthesized
taattagtaatttttaactttt

SEQ ID NO: 1156570 - DNA, 22 bp, Artificial Sequence
  chemically synthesized
ttaattagtaatttttaacttt

SEQ ID NO: 1156571 - DNA, 22 bp, Artificial Sequence
  chemically synthesized
tttaattagtaatttttaactt

SEQ ID NO: 1156572 - DNA, 22 bp, Artificial Sequence
  chemically synthesized
cgtacctgcaaaagttaaaaat

SEQ ID NO: 1156573 - DNA, 22 bp, Artificial Sequence
  chemically synthesized
ttttaattagtaatttttaact

SEQ ID NO: 1156574 - DNA, 22 bp, Artificial Sequence
  chemically synthesized
tttttaattagtaatttttaac

SEQ ID NO: 1156575 - DNA, 22 bp, Artificial Sequence
  chemically synthesized
ttttttaattagtaatttttaa

SEQ ID NO: 1156576 - DNA, 22 bp, Artificial Sequence
  chemically synthesized
ttttttttaattagtaattttt

SEQ ID NO: 1156577 - DNA, 22 bp, Artificial Sequence
  chemically synthesized
cttttttttaattagtaatttt

SEQ ID NO: 1156578 - DNA, 22 bp, Artificial Sequence
  chemically synthesized
tcttttttttaattagtaattt

SEQ ID NO: 1156579 - DNA, 22 bp, Artificial Sequence
  chemically synthesized
caaaagttaaaaattactaatt

SEQ ID NO: 1156580 - DNA, 22 bp, Artificial Sequence
  chemically synthesized
aaaattactaattaaaaaaaag

SEQ ID NO: 1156581 - DNA, 22 bp, Artificial Sequence
  chemically synthesized
cagtgtgtaaaggttttctttt

SEQ ID NO: 1156582 - DNA, 22 bp, Artificial Sequence
  chemically synthesized
acagtgtgtaaaggttttcttt

SEQ ID NO: 1156583 - DNA, 22 bp, Artificial Sequence
  chemically synthesized
ctaattaaaaaaaagaaaacct

SEQ ID NO: 1156584 - DNA, 22 bp, Artificial Sequence
  chemically synthesized
attaaaaaaaagaaaaccttta

SEQ ID NO: 1156585 - DNA, 22 bp, Artificial Sequence
  chemically synthesized
ccatttacagtgtgtaaaggtt

SEQ ID NO: 1156586 - DNA, 22 bp, Artificial Sequence
  chemically synthesized
aaaaaaagaaaacctttacaca

SEQ ID NO: 1156587 - DNA, 22 bp, Artificial Sequence
  chemically synthesized
ccattcccatttacagtgtgta

SEQ ID NO: 1156588 - DNA, 22 bp, Artificial Sequence
  chemically synthesized
attgccattcccatttacagtg

SEQ ID NO: 1156589 - DNA, 22 bp, Artificial Sequence
  chemically synthesized
tactgattgccattcccattta

SEQ ID NO: 1156590 - DNA, 22 bp, Artificial Sequence
  chemically synthesized
tacacactgtaaatgggaatgg

SEQ ID NO: 1156591 - DNA, 22 bp, Artificial Sequence
  chemically synthesized
acacactgtaaatgggaatggc

SEQ ID NO: 1156592 - DNA, 22 bp, Artificial Sequence
  chemically synthesized
cacactgtaaatgggaatggca

SEQ ID NO: 1156593 - DNA, 22 bp, Artificial Sequence
  chemically synthesized
catgatgcctgtactgattgcc

SEQ ID NO: 1156594 - DNA, 22 bp, Artificial Sequence
  chemically synthesized
taaatgggaatggcaatcagta

SEQ ID NO: 1156595 - DNA, 22 bp, Artificial Sequence
  chemically synthesized
ccatgatgcctgtactgattgc

SEQ ID NO: 1156596 - DNA, 22 bp, Artificial Sequence
  chemically synthesized
tccatgatgcctgtactgattg

SEQ ID NO: 1156597 - DNA, 22 bp, Artificial Sequence
  chemically synthesized
ttttccatgatgcctgtactga

SEQ ID NO: 1156598 - DNA, 22 bp, Artificial Sequence
  chemically synthesized
atactgttttccatgatgcctg

SEQ ID NO: 1156599 - DNA, 22 bp, Artificial Sequence
  chemically synthesized
catactgttttccatgatgcct

SEQ ID NO: 1156600 - DNA, 22 bp, Artificial Sequence
  chemically synthesized
aaggagccttcatactgttttc

SEQ ID NO: 1156601 - DNA, 22 bp, Artificial Sequence
  chemically synthesized
caaggagccttcatactgtttt

SEQ ID NO: 1156602 - DNA, 22 bp, Artificial Sequence
  chemically synthesized
atatttcaaggagccttcatac

SEQ ID NO: 1156603 - DNA, 22 bp, Artificial Sequence
  chemically synthesized
ttcatatttcaaggagccttca

SEQ ID NO: 1156604 - DNA, 22 bp, Artificial Sequence
  chemically synthesized
ttgttcatatttcaaggagcct

SEQ ID NO: 1156605 - DNA, 22 bp, Artificial Sequence
  chemically synthesized
gttgttcatatttcaaggagcc

SEQ ID NO: 1156606 - DNA, 22 bp, Artificial Sequence
  chemically synthesized
tgttgttcatatttcaaggagc

SEQ ID NO: 1156607 - DNA, 22 bp, Artificial Sequence
  chemically synthesized
tagttttgttgttcatatttca

SEQ ID NO: 1156608 - DNA, 22 bp, Artificial Sequence
  chemically synthesized
cttgaaatatgaacaacaaaac

SEQ ID NO: 1156609 - DNA, 22 bp, Artificial Sequence
  chemically synthesized
tatcatattgtagttttgttgt

SEQ ID NO: 1156610 - DNA, 22 bp, Artificial Sequence
  chemically synthesized
gtatcatattgtagttttgttg

SEQ ID NO: 1156611 - DNA, 22 bp, Artificial Sequence
  chemically synthesized
tgtatcatattgtagttttgtt

SEQ ID NO: 1156612 - DNA, 22 bp, Artificial Sequence
  chemically synthesized
gaaatatgaacaacaaaactac

SEQ ID NO: 1156613 - DNA, 22 bp, Artificial Sequence
  chemically synthesized
aaatatgaacaacaaaactaca

SEQ ID NO: 1156614 - DNA, 22 bp, Artificial Sequence
  chemically synthesized
atagtgggattttgtatcatat

SEQ ID NO: 1156615 - DNA, 22 bp, Artificial Sequence
  chemically synthesized
caatatgatacaaaatcccact

SEQ ID NO: 1156616 - DNA, 22 bp, Artificial Sequence
  chemically synthesized
tatatataattcatagtgggat

SEQ ID NO: 1156617 - DNA, 22 bp, Artificial Sequence
  chemically synthesized
gtatatataattcatagtggga

SEQ ID NO: 1156618 - DNA, 22 bp, Artificial Sequence
  chemically synthesized
tgtatatataattcatagtggg

SEQ ID NO: 1156619 - DNA, 22 bp, Artificial Sequence
  chemically synthesized
ctttgtatatataattcatagt

SEQ ID NO: 1156620 - DNA, 22 bp, Artificial Sequence
  chemically synthesized
cctttgtatatataattcatag

SEQ ID NO: 1156621 - DNA, 22 bp, Artificial Sequence
  chemically synthesized
atttcctttgtatatataattc

SEQ ID NO: 1156622 - DNA, 22 bp, Artificial Sequence
  chemically synthesized
catttcctttgtatatataatt

SEQ ID NO: 1156623 - DNA, 22 bp, Artificial Sequence
  chemically synthesized
atttcatttcctttgtatatat

SEQ ID NO: 1156624 - DNA, 22 bp, Artificial Sequence
  chemically synthesized
tgaattatatatacaaaggaaa

SEQ ID NO: 1156625 - DNA, 22 bp, Artificial Sequence
  chemically synthesized
acatactgatttcatttccttt

SEQ ID NO: 1156626 - DNA, 22 bp, Artificial Sequence
  chemically synthesized
gacatactgatttcatttcctt

SEQ ID NO: 1156627 - DNA, 22 bp, Artificial Sequence
  chemically synthesized
tgacatactgatttcatttcct

SEQ ID NO: 1156628 - DNA, 22 bp, Artificial Sequence
  chemically synthesized
tttgacatactgatttcatttc

SEQ ID NO: 1156629 - DNA, 22 bp, Artificial Sequence
  chemically synthesized
tatatacaaaggaaatgaaatc

SEQ ID NO: 1156630 - DNA, 22 bp, Artificial Sequence
  chemically synthesized
ctttgacatactgatttcattt

SEQ ID NO: 1156631 - DNA, 22 bp, Artificial Sequence
  chemically synthesized
caataaaaatggtagtgcagat

SEQ ID NO: 1156632 - DNA, 22 bp, Artificial Sequence
  chemically synthesized
gccatgaatagtgctgcaataa

SEQ ID NO: 1156633 - DNA, 22 bp, Artificial Sequence
  chemically synthesized
cactaccatttttattgcagca

SEQ ID NO: 1156634 - DNA, 22 bp, Artificial Sequence
  chemically synthesized
ggccatgaatagtgctgcaata

SEQ ID NO: 1156635 - DNA, 22 bp, Artificial Sequence
  chemically synthesized
ccatttttattgcagcactatt

SEQ ID NO: 1156636 - DNA, 22 bp, Artificial Sequence
  chemically synthesized
catatcttggccatgaatagtg

SEQ ID NO: 1156637 - DNA, 22 bp, Artificial Sequence
  chemically synthesized
ttattgcagcactattcatggc

SEQ ID NO: 1156638 - DNA, 22 bp, Artificial Sequence
  chemically synthesized
tattgcagcactattcatggcc

SEQ ID NO: 1156639 - DNA, 22 bp, Artificial Sequence
  chemically synthesized
attccatatcttggccatgaat

SEQ ID NO: 1156640 - DNA, 22 bp, Artificial Sequence
  chemically synthesized
attgcagcactattcatggcca

SEQ ID NO: 1156641 - DNA, 22 bp, Artificial Sequence
  chemically synthesized
ttgcagcactattcatggccaa

SEQ ID NO: 1156642 - DNA, 22 bp, Artificial Sequence
  chemically synthesized
cagcactattcatggccaagat

SEQ ID NO: 1156643 - DNA, 22 bp, Artificial Sequence
  chemically synthesized
gattgattccatatcttggcca

SEQ ID NO: 1156644 - DNA, 22 bp, Artificial Sequence
  chemically synthesized
ggattgattccatatcttggcc

SEQ ID NO: 1156645 - DNA, 22 bp, Artificial Sequence
  chemically synthesized
ttcatggccaagatatggaatc

SEQ ID NO: 1156646 - DNA, 22 bp, Artificial Sequence
  chemically synthesized
atggccaagatatggaatcaat

SEQ ID NO: 1156647 - DNA, 22 bp, Artificial Sequence
  chemically synthesized
gtggatatttggattgattcca

SEQ ID NO: 1156648 - DNA, 22 bp, Artificial Sequence
  chemically synthesized
atatgttggtggatatttggat

SEQ ID NO: 1156649 - DNA, 22 bp, Artificial Sequence
  chemically synthesized
tccgttcatatgttggtggata

SEQ ID NO: 1156650 - DNA, 22 bp, Artificial Sequence
  chemically synthesized
atccgttcatatgttggtggat

SEQ ID NO: 1156651 - DNA, 22 bp, Artificial Sequence
  chemically synthesized
tatccgttcatatgttggtgga

SEQ ID NO: 1156652 - DNA, 22 bp, Artificial Sequence
  chemically synthesized
tttatccgttcatatgttggtg

SEQ ID NO: 1156653 - DNA, 22 bp, Artificial Sequence
  chemically synthesized
ctttatccgttcatatgttggt

SEQ ID NO: 1156654 - DNA, 22 bp, Artificial Sequence
  chemically synthesized
tctttatccgttcatatgttgg

SEQ ID NO: 1156655 - DNA, 22 bp, Artificial Sequence
  chemically synthesized
tatatatgtataccacattttc

SEQ ID NO: 1156656 - DNA, 22 bp, Artificial Sequence
  chemically synthesized
cattgtatatatgtataccaca

SEQ ID NO: 1156657 - DNA, 22 bp, Artificial Sequence
  chemically synthesized
aatagtattccattgtatatat

SEQ ID NO: 1156658 - DNA, 22 bp, Artificial Sequence
  chemically synthesized
tggctgaatagtattccattgt

SEQ ID NO: 1156659 - DNA, 22 bp, Artificial Sequence
  chemically synthesized
atggctgaatagtattccattg

SEQ ID NO: 1156660 - DNA, 22 bp, Artificial Sequence
  chemically synthesized
tatggctgaatagtattccatt

SEQ ID NO: 1156661 - DNA, 22 bp, Artificial Sequence
  chemically synthesized
ttatggctgaatagtattccat

SEQ ID NO: 1156662 - DNA, 22 bp, Artificial Sequence
  chemically synthesized
tttatggctgaatagtattcca

SEQ ID NO: 1156663 - DNA, 22 bp, Artificial Sequence
  chemically synthesized
ttttatggctgaatagtattcc

SEQ ID NO: 1156664 - DNA, 22 bp, Artificial Sequence
  chemically synthesized
ttttttatggctgaatagtatt

SEQ ID NO: 1156665 - DNA, 22 bp, Artificial Sequence
  chemically synthesized
ttcttttttatggctgaatagt

SEQ ID NO: 1156666 - DNA, 22 bp, Artificial Sequence
  chemically synthesized
attcttttttatggctgaatag

SEQ ID NO: 1156667 - DNA, 22 bp, Artificial Sequence
  chemically synthesized
tattcttttttatggctgaata

SEQ ID NO: 1156668 - DNA, 22 bp, Artificial Sequence
  chemically synthesized
ttcagccataaaaaagaataaa

SEQ ID NO: 1156669 - DNA, 22 bp, Artificial Sequence
  chemically synthesized
caaatgacagtattttattctt

SEQ ID NO: 1156670 - DNA, 22 bp, Artificial Sequence
  chemically synthesized
agccataaaaaagaataaaata

SEQ ID NO: 1156671 - DNA, 22 bp, Artificial Sequence
  chemically synthesized
ttgcaaatgacagtattttatt

SEQ ID NO: 1156672 - DNA, 22 bp, Artificial Sequence
  chemically synthesized
atccatgttgttgcaaatgaca

SEQ ID NO: 1156673 - DNA, 22 bp, Artificial Sequence
  chemically synthesized
caggttcatccatgttgttgca

SEQ ID NO: 1156674 - DNA, 22 bp, Artificial Sequence
  chemically synthesized
tcatttgcaacaacatggatga

SEQ ID NO: 1156675 - DNA, 22 bp, Artificial Sequence
  chemically synthesized
gcaacaacatggatgaacctgg

SEQ ID NO: 1156676 - DNA, 22 bp, Artificial Sequence
  chemically synthesized
acataatatcctccaggttcat

SEQ ID NO: 1156677 - DNA, 22 bp, Artificial Sequence
  chemically synthesized
caacaacatggatgaacctgga

SEQ ID NO: 1156678 - DNA, 22 bp, Artificial Sequence
  chemically synthesized
aacataatatcctccaggttca

SEQ ID NO: 1156679 - DNA, 22 bp, Artificial Sequence
  chemically synthesized
acttaacataatatcctccagg

SEQ ID NO: 1156680 - DNA, 22 bp, Artificial Sequence
  chemically synthesized
cacttaacataatatcctccag

SEQ ID NO: 1156681 - DNA, 22 bp, Artificial Sequence
  chemically synthesized
tttcacttaacataatatcctc

SEQ ID NO: 1156682 - DNA, 22 bp, Artificial Sequence
  chemically synthesized
atttcacttaacataatatcct

SEQ ID NO: 1156683 - DNA, 22 bp, Artificial Sequence
  chemically synthesized
gcttatttcacttaacataata

SEQ ID NO: 1156684 - DNA, 22 bp, Artificial Sequence
  chemically synthesized
ctggcttatttcacttaacata

SEQ ID NO: 1156685 - DNA, 22 bp, Artificial Sequence
  chemically synthesized
actggcttatttcacttaacat

SEQ ID NO: 1156686 - DNA, 22 bp, Artificial Sequence
  chemically synthesized
tactggcttatttcacttaaca

SEQ ID NO: 1156687 - DNA, 22 bp, Artificial Sequence
  chemically synthesized
gaggatattatgttaagtgaaa

SEQ ID NO: 1156688 - DNA, 22 bp, Artificial Sequence
  chemically synthesized
tttactggcttatttcacttaa

SEQ ID NO: 1156689 - DNA, 22 bp, Artificial Sequence
  chemically synthesized
ctttactggcttatttcactta

SEQ ID NO: 1156690 - DNA, 22 bp, Artificial Sequence
  chemically synthesized
tctttactggcttatttcactt

SEQ ID NO: 1156691 - DNA, 22 bp, Artificial Sequence
  chemically synthesized
tttctttactggcttatttcac

SEQ ID NO: 1156692 - DNA, 22 bp, Artificial Sequence
  chemically synthesized
ctttctttactggcttatttca

SEQ ID NO: 1156693 - DNA, 22 bp, Artificial Sequence
  chemically synthesized
tctttctttactggcttatttc

SEQ ID NO: 1156694 - DNA, 22 bp, Artificial Sequence
  chemically synthesized
tgttaagtgaaataagccagta

SEQ ID NO: 1156695 - DNA, 22 bp, Artificial Sequence
  chemically synthesized
agtgaaataagccagtaaagaa

SEQ ID NO: 1156696 - DNA, 22 bp, Artificial Sequence
  chemically synthesized
ggcagtggttttctttctttac

SEQ ID NO: 1156697 - DNA, 22 bp, Artificial Sequence
  chemically synthesized
cacatataagtgaaattaggca

SEQ ID NO: 1156698 - DNA, 22 bp, Artificial Sequence
  chemically synthesized
gattccacatataagtgaaatt

SEQ ID NO: 1156699 - DNA, 22 bp, Artificial Sequence
  chemically synthesized
agattccacatataagtgaaat

SEQ ID NO: 1156700 - DNA, 22 bp, Artificial Sequence
  chemically synthesized
tagattccacatataagtgaaa

SEQ ID NO: 1156701 - DNA, 22 bp, Artificial Sequence
  chemically synthesized
ttagattccacatataagtgaa

SEQ ID NO: 1156702 - DNA, 22 bp, Artificial Sequence
  chemically synthesized
ttttagattccacatataagtg

SEQ ID NO: 1156703 - DNA, 22 bp, Artificial Sequence
  chemically synthesized
cctaatttcacttatatgtgga

SEQ ID NO: 1156704 - DNA, 22 bp, Artificial Sequence
  chemically synthesized
atttcacttatatgtggaatct

SEQ ID NO: 1156705 - DNA, 22 bp, Artificial Sequence
  chemically synthesized
cacttatatgtggaatctaaaa

SEQ ID NO: 1156706 - DNA, 22 bp, Artificial Sequence
  chemically synthesized
tgggatcagctcttttagattc

SEQ ID NO: 1156707 - DNA, 22 bp, Artificial Sequence
  chemically synthesized
acttatatgtggaatctaaaag

SEQ ID NO: 1156708 - DNA, 22 bp, Artificial Sequence
  chemically synthesized
tgtgggatcagctcttttagat

SEQ ID NO: 1156709 - DNA, 22 bp, Artificial Sequence
  chemically synthesized
ctgtgggatcagctcttttaga

SEQ ID NO: 1156710 - DNA, 22 bp, Artificial Sequence
  chemically synthesized
atatgtggaatctaaaagagct

SEQ ID NO: 1156711 - DNA, 22 bp, Artificial Sequence
  chemically synthesized
tatgtggaatctaaaagagctg

SEQ ID NO: 1156712 - DNA, 22 bp, Artificial Sequence
  chemically synthesized
cttctgtgggatcagctctttt

SEQ ID NO: 1156713 - DNA, 22 bp, Artificial Sequence
  chemically synthesized
cctacttctgtgggatcagctc

SEQ ID NO: 1156714 - DNA, 22 bp, Artificial Sequence
  chemically synthesized
attccctacttctgtgggatca

SEQ ID NO: 1156715 - DNA, 22 bp, Artificial Sequence
  chemically synthesized
ttcattccctacttctgtggga

SEQ ID NO: 1156716 - DNA, 22 bp, Artificial Sequence
  chemically synthesized
aaagagctgatcccacagaagt

SEQ ID NO: 1156717 - DNA, 22 bp, Artificial Sequence
  chemically synthesized
gtaaccactattcattccctac

SEQ ID NO: 1156718 - DNA, 22 bp, Artificial Sequence
  chemically synthesized
atcccacagaagtagggaatga

SEQ ID NO: 1156719 - DNA, 22 bp, Artificial Sequence
  chemically synthesized
tggtaaccactattcattccct

SEQ ID NO: 1156720 - DNA, 22 bp, Artificial Sequence
  chemically synthesized
agcctctggtaaccactattca

SEQ ID NO: 1156721 - DNA, 22 bp, Artificial Sequence
  chemically synthesized
cccataaccacctcagcctctg

SEQ ID NO: 1156722 - DNA, 22 bp, Artificial Sequence
  chemically synthesized
ccccataaccacctcagcctct

SEQ ID NO: 1156723 - DNA, 22 bp, Artificial Sequence
  chemically synthesized
ccccttccccataaccacctca

SEQ ID NO: 1156724 - DNA, 22 bp, Artificial Sequence
  chemically synthesized
ccagaggctgaggtggttatgg

SEQ ID NO: 1156725 - DNA, 22 bp, Artificial Sequence
  chemically synthesized
catacctcccccttccccataa

SEQ ID NO: 1156726 - DNA, 22 bp, Artificial Sequence
  chemically synthesized
aggtggttatggggaaggggga

SEQ ID NO: 1156727 - DNA, 22 bp, Artificial Sequence
  chemically synthesized
aaaagtatctccatacctcccc

SEQ ID NO: 1156728 - DNA, 22 bp, Artificial Sequence
  chemically synthesized
gaaaagtatctccatacctccc

SEQ ID NO: 1156729 - DNA, 22 bp, Artificial Sequence
  chemically synthesized
tggggaagggggaggtatggag

SEQ ID NO: 1156730 - DNA, 22 bp, Artificial Sequence
  chemically synthesized
tatatcccttgaaaagtatctc

SEQ ID NO: 1156731 - DNA, 22 bp, Artificial Sequence
  chemically synthesized
tgactatatatcccttgaaaag

SEQ ID NO: 1156732 - DNA, 22 bp, Artificial Sequence
  chemically synthesized
actgtgactatatatcccttga

SEQ ID NO: 1156733 - DNA, 22 bp, Artificial Sequence
  chemically synthesized
gactgtgactatatatcccttg

SEQ ID NO: 1156734 - DNA, 22 bp, Artificial Sequence
  chemically synthesized
tgactgtgactatatatccctt

SEQ ID NO: 1156735 - DNA, 22 bp, Artificial Sequence
  chemically synthesized
aatattttgactgtgactatat

SEQ ID NO: 1156736 - DNA, 22 bp, Artificial Sequence
  chemically synthesized
gaatattttgactgtgactata

SEQ ID NO: 1156737 - DNA, 22 bp, Artificial Sequence
  chemically synthesized
ttcaagggatatatagtcacag

SEQ ID NO: 1156738 - DNA, 22 bp, Artificial Sequence
  chemically synthesized
tcaagggatatatagtcacagt

SEQ ID NO: 1156739 - DNA, 22 bp, Artificial Sequence
  chemically synthesized
caagggatatatagtcacagtc

SEQ ID NO: 1156740 - DNA, 22 bp, Artificial Sequence
  chemically synthesized
aagggatatatagtcacagtca

SEQ ID NO: 1156741 - DNA, 22 bp, Artificial Sequence
  chemically synthesized
taaaatacatcacttgaatatt

SEQ ID NO: 1156742 - DNA, 22 bp, Artificial Sequence
  chemically synthesized
tagtcaccatgctgtaaaatac

SEQ ID NO: 1156743 - DNA, 22 bp, Artificial Sequence
  chemically synthesized
gctgtagtcaccatgctgtaaa

SEQ ID NO: 1156744 - DNA, 22 bp, Artificial Sequence
  chemically synthesized
aagtgatgtattttacagcatg

SEQ ID NO: 1156745 - DNA, 22 bp, Artificial Sequence
  chemically synthesized
attagctgtagtcaccatgctg

SEQ ID NO: 1156746 - DNA, 22 bp, Artificial Sequence
  chemically synthesized
cattagctgtagtcaccatgct

SEQ ID NO: 1156747 - DNA, 22 bp, Artificial Sequence
  chemically synthesized
tcattagctgtagtcaccatgc

SEQ ID NO: 1156748 - DNA, 22 bp, Artificial Sequence
  chemically synthesized
tacagcatggtgactacagcta

SEQ ID NO: 1156749 - DNA, 22 bp, Artificial Sequence
  chemically synthesized
acagcatggtgactacagctaa

SEQ ID NO: 1156750 - DNA, 22 bp, Artificial Sequence
  chemically synthesized
cagcatggtgactacagctaat

SEQ ID NO: 1156751 - DNA, 22 bp, Artificial Sequence
  chemically synthesized
aagagtatattttcattagctg

SEQ ID NO: 1156752 - DNA, 22 bp, Artificial Sequence
  chemically synthesized
caagagtatattttcattagct

SEQ ID NO: 1156753 - DNA, 22 bp, Artificial Sequence
  chemically synthesized
tcaagagtatattttcattagc

SEQ ID NO: 1156754 - DNA, 22 bp, Artificial Sequence
  chemically synthesized
ttcaagagtatattttcattag

SEQ ID NO: 1156755 - DNA, 22 bp, Artificial Sequence
  chemically synthesized
catttttcaagagtatattttc

SEQ ID NO: 1156756 - DNA, 22 bp, Artificial Sequence
  chemically synthesized
tacatttttcaagagtatattt

SEQ ID NO: 1156757 - DNA, 22 bp, Artificial Sequence
  chemically synthesized
cagctaatgaaaatatactctt

SEQ ID NO: 1156758 - DNA, 22 bp, Artificial Sequence
  chemically synthesized
tctacatttttcaagagtatat

SEQ ID NO: 1156759 - DNA, 22 bp, Artificial Sequence
  chemically synthesized
tctctacatttttcaagagtat

SEQ ID NO: 1156760 - DNA, 22 bp, Artificial Sequence
  chemically synthesized
tctctctacatttttcaagagt

SEQ ID NO: 1156761 - DNA, 22 bp, Artificial Sequence
  chemically synthesized
atgaaaatatactcttgaaaaa

SEQ ID NO: 1156762 - DNA, 22 bp, Artificial Sequence
  chemically synthesized
acgtcctctctctctacatttt

SEQ ID NO: 1156763 - DNA, 22 bp, Artificial Sequence
  chemically synthesized
aacgtcctctctctctacattt

SEQ ID NO: 1156764 - DNA, 22 bp, Artificial Sequence
  chemically synthesized
ttgaaaaatgtagagagagagg

SEQ ID NO: 1156765 - DNA, 22 bp, Artificial Sequence
  chemically synthesized
gaaaaatgtagagagagaggac

SEQ ID NO: 1156766 - DNA, 22 bp, Artificial Sequence
  chemically synthesized
aaaaatgtagagagagaggacg

SEQ ID NO: 1156767 - DNA, 22 bp, Artificial Sequence
  chemically synthesized
tggtgggaatatttaacgtcct

SEQ ID NO: 1156768 - DNA, 22 bp, Artificial Sequence
  chemically synthesized
atggtgggaatatttaacgtcc

SEQ ID NO: 1156769 - DNA, 22 bp, Artificial Sequence
  chemically synthesized
tatggtgggaatatttaacgtc

SEQ ID NO: 1156770 - DNA, 22 bp, Artificial Sequence
  chemically synthesized
ttatggtgggaatatttaacgt

SEQ ID NO: 1156771 - DNA, 22 bp, Artificial Sequence
  chemically synthesized
tcatttttatggtgggaatatt

SEQ ID NO: 1156772 - DNA, 22 bp, Artificial Sequence
  chemically synthesized
atcatttttatggtgggaatat

SEQ ID NO: 1156773 - DNA, 22 bp, Artificial Sequence
  chemically synthesized
catatttatcatttttatggtg

SEQ ID NO: 1156774 - DNA, 22 bp, Artificial Sequence
  chemically synthesized
acatatttatcatttttatggt

SEQ ID NO: 1156775 - DNA, 22 bp, Artificial Sequence
  chemically synthesized
aatattcccaccataaaaatga

SEQ ID NO: 1156776 - DNA, 22 bp, Artificial Sequence
  chemically synthesized
ccttacatatttatcattttta

SEQ ID NO: 1156777 - DNA, 22 bp, Artificial Sequence
  chemically synthesized
ccaccataaaaatgataaatat

SEQ ID NO: 1156778 - DNA, 22 bp, Artificial Sequence
  chemically synthesized
acatatgcattaccttacatat

SEQ ID NO: 1156779 - DNA, 22 bp, Artificial Sequence
  chemically synthesized
attaacatatgcattaccttac

SEQ ID NO: 1156780 - DNA, 22 bp, Artificial Sequence
  chemically synthesized
gctaattaacatatgcattacc

SEQ ID NO: 1156781 - DNA, 22 bp, Artificial Sequence
  chemically synthesized
aatctagctaattaacatatgc

SEQ ID NO: 1156782 - DNA, 22 bp, Artificial Sequence
  chemically synthesized
tggaacagttgaatctagctaa

SEQ ID NO: 1156783 - DNA, 22 bp, Artificial Sequence
  chemically synthesized
attagctagattcaactgttcc

SEQ ID NO: 1156784 - DNA, 22 bp, Artificial Sequence
  chemically synthesized
gctagattcaactgttccacaa

SEQ ID NO: 1156785 - DNA, 22 bp, Artificial Sequence
  chemically synthesized
agtaaatatatattgtggaaca

SEQ ID NO: 1156786 - DNA, 22 bp, Artificial Sequence
  chemically synthesized
tgagtaaatatatattgtggaa

SEQ ID NO: 1156787 - DNA, 22 bp, Artificial Sequence
  chemically synthesized
ctgagtaaatatatattgtgga

SEQ ID NO: 1156788 - DNA, 22 bp, Artificial Sequence
  chemically synthesized
gattcaactgttccacaatata

SEQ ID NO: 1156789 - DNA, 22 bp, Artificial Sequence
  chemically synthesized
aactgttccacaatatatattt

SEQ ID NO: 1156790 - DNA, 22 bp, Artificial Sequence
  chemically synthesized
ttccacaatatatatttactca

SEQ ID NO: 1156791 - DNA, 22 bp, Artificial Sequence
  chemically synthesized
cacaatatatatttactcagaa

SEQ ID NO: 1156792 - DNA, 22 bp, Artificial Sequence
  chemically synthesized
atcatgtacaacgtgatgcttc

SEQ ID NO: 1156793 - DNA, 22 bp, Artificial Sequence
  chemically synthesized
actcagaagcatcacgttgtac

SEQ ID NO: 1156794 - DNA, 22 bp, Artificial Sequence
  chemically synthesized
tatattcatcatgtacaacgtg

SEQ ID NO: 1156795 - DNA, 22 bp, Artificial Sequence
  chemically synthesized
ctcagaagcatcacgttgtaca

SEQ ID NO: 1156796 - DNA, 22 bp, Artificial Sequence
  chemically synthesized
agaagcatcacgttgtacatga

SEQ ID NO: 1156797 - DNA, 22 bp, Artificial Sequence
  chemically synthesized
acagataaaattgtatattcat

SEQ ID NO: 1156798 - DNA, 22 bp, Artificial Sequence
  chemically synthesized
aattgacagataaaattgtata

SEQ ID NO: 1156799 - DNA, 22 bp, Artificial Sequence
  chemically synthesized
tacatgatgaatatacaatttt

SEQ ID NO: 1156800 - DNA, 22 bp, Artificial Sequence
  chemically synthesized
aaattgacagataaaattgtat

SEQ ID NO: 1156801 - DNA, 22 bp, Artificial Sequence
  chemically synthesized
taaattgacagataaaattgta

SEQ ID NO: 1156802 - DNA, 22 bp, Artificial Sequence
  chemically synthesized
ctttaaattgacagataaaatt

SEQ ID NO: 1156803 - DNA, 22 bp, Artificial Sequence
  chemically synthesized
aaccctactttaaattgacaga

SEQ ID NO: 1156804 - DNA, 22 bp, Artificial Sequence
  chemically synthesized
aaaccctactttaaattgacag

SEQ ID NO: 1156805 - DNA, 22 bp, Artificial Sequence
  chemically synthesized
taaaccctactttaaattgaca

SEQ ID NO: 1156806 - DNA, 22 bp, Artificial Sequence
  chemically synthesized
ttaaaccctactttaaattgac

SEQ ID NO: 1156807 - DNA, 22 bp, Artificial Sequence
  chemically synthesized
tttaaaccctactttaaattga

SEQ ID NO: 1156808 - DNA, 22 bp, Artificial Sequence
  chemically synthesized
ctttttaaaccctactttaaat

SEQ ID NO: 1156809 - DNA, 22 bp, Artificial Sequence
  chemically synthesized
tatctgtcaatttaaagtaggg

SEQ ID NO: 1156810 - DNA, 22 bp, Artificial Sequence
  chemically synthesized
atctgtcaatttaaagtagggt

SEQ ID NO: 1156811 - DNA, 22 bp, Artificial Sequence
  chemically synthesized
tctgtcaatttaaagtagggtt

SEQ ID NO: 1156812 - DNA, 22 bp, Artificial Sequence
  chemically synthesized
aacattgctttttaaaccctac

SEQ ID NO: 1156813 - DNA, 22 bp, Artificial Sequence
  chemically synthesized
tcaatttaaagtagggtttaaa

SEQ ID NO: 1156814 - DNA, 22 bp, Artificial Sequence
  chemically synthesized
taaacattgctttttaaaccct

SEQ ID NO: 1156815 - DNA, 22 bp, Artificial Sequence
  chemically synthesized
ctaaacattgctttttaaaccc

SEQ ID NO: 1156816 - DNA, 22 bp, Artificial Sequence
  chemically synthesized
aaagtagggtttaaaaagcaat

SEQ ID NO: 1156817 - DNA, 22 bp, Artificial Sequence
  chemically synthesized
aagtagggtttaaaaagcaatg

SEQ ID NO: 1156818 - DNA, 22 bp, Artificial Sequence
  chemically synthesized
tcaatttctaaacattgctttt

SEQ ID NO: 1156819 - DNA, 22 bp, Artificial Sequence
  chemically synthesized
aaatgctatcaatttctaaaca

SEQ ID NO: 1156820 - DNA, 22 bp, Artificial Sequence
  chemically synthesized
gaaatgctatcaatttctaaac

SEQ ID NO: 1156821 - DNA, 22 bp, Artificial Sequence
  chemically synthesized
aaaaagcaatgtttagaaattg

SEQ ID NO: 1156822 - DNA, 22 bp, Artificial Sequence
  chemically synthesized
aaaagcaatgtttagaaattga

SEQ ID NO: 1156823 - DNA, 22 bp, Artificial Sequence
  chemically synthesized
tttgaaatgctatcaatttcta

SEQ ID NO: 1156824 - DNA, 22 bp, Artificial Sequence
  chemically synthesized
ttgtttgaaatgctatcaattt

SEQ ID NO: 1156825 - DNA, 22 bp, Artificial Sequence
  chemically synthesized
attgtttgaaatgctatcaatt

SEQ ID NO: 1156826 - DNA, 22 bp, Artificial Sequence
  chemically synthesized
tattgtttgaaatgctatcaat

SEQ ID NO: 1156827 - DNA, 22 bp, Artificial Sequence
  chemically synthesized
tattttattgtttgaaatgcta

SEQ ID NO: 1156828 - DNA, 22 bp, Artificial Sequence
  chemically synthesized
atattttattgtttgaaatgct

SEQ ID NO: 1156829 - DNA, 22 bp, Artificial Sequence
  chemically synthesized
tatattttattgtttgaaatgc

SEQ ID NO: 1156830 - DNA, 22 bp, Artificial Sequence
  chemically synthesized
agaaattgatagcatttcaaac

SEQ ID NO: 1156831 - DNA, 22 bp, Artificial Sequence
  chemically synthesized
ttatattttattgtttgaaatg

SEQ ID NO: 1156832 - DNA, 22 bp, Artificial Sequence
  chemically synthesized
gaaattgatagcatttcaaaca

SEQ ID NO: 1156833 - DNA, 22 bp, Artificial Sequence
  chemically synthesized
atagcatttcaaacaataaaat

SEQ ID NO: 1156834 - DNA, 22 bp, Artificial Sequence
  chemically synthesized
aacagacccaacttttatattt

SEQ ID NO: 1156835 - DNA, 22 bp, Artificial Sequence
  chemically synthesized
caaacaataaaatataaaagtt

SEQ ID NO: 1156836 - DNA, 22 bp, Artificial Sequence
  chemically synthesized
aaacaataaaatataaaagttg

SEQ ID NO: 1156837 - DNA, 22 bp, Artificial Sequence
  chemically synthesized
ggtctgttgagtgtgtgtgtgg

SEQ ID NO: 1156838 - DNA, 22 bp, Artificial Sequence
  chemically synthesized
ccaatagtatgcagcatccaca

SEQ ID NO: 1156839 - DNA, 22 bp, Artificial Sequence
  chemically synthesized
ttgagtgtgtgtgtggatgctg

SEQ ID NO: 1156840 - DNA, 22 bp, Artificial Sequence
  chemically synthesized
ctgccaatagtatgcagcatcc

SEQ ID NO: 1156841 - DNA, 22 bp, Artificial Sequence
  chemically synthesized
agtgtgtgtgtggatgctgcat

SEQ ID NO: 1156842 - DNA, 22 bp, Artificial Sequence
  chemically synthesized
cctgccaatagtatgcagcatc

SEQ ID NO: 1156843 - DNA, 22 bp, Artificial Sequence
  chemically synthesized
tcctgccaatagtatgcagcat

SEQ ID NO: 1156844 - DNA, 22 bp, Artificial Sequence
  chemically synthesized
tctttcctgccaatagtatgca

SEQ ID NO: 1156845 - DNA, 22 bp, Artificial Sequence
  chemically synthesized
tatctttcctgccaatagtatg

SEQ ID NO: 1156846 - DNA, 22 bp, Artificial Sequence
  chemically synthesized
agtgtgttctatctttcctgcc

SEQ ID NO: 1156847 - DNA, 22 bp, Artificial Sequence
  chemically synthesized
gagtgtgttctatctttcctgc

SEQ ID NO: 1156848 - DNA, 22 bp, Artificial Sequence
  chemically synthesized
catactattggcaggaaagata

SEQ ID NO: 1156849 - DNA, 22 bp, Artificial Sequence
  chemically synthesized
ttggcaggaaagatagaacaca

SEQ ID NO: 1156850 - DNA, 22 bp, Artificial Sequence
  chemically synthesized
gcaggaaagatagaacacactc

SEQ ID NO: 1156851 - DNA, 22 bp, Artificial Sequence
  chemically synthesized
agcgaaacatatttgagtgtgt

SEQ ID NO: 1156852 - DNA, 22 bp, Artificial Sequence
  chemically synthesized
ctgagcgaaacatatttgagtg

SEQ ID NO: 1156853 - DNA, 22 bp, Artificial Sequence
  chemically synthesized
aaatatgtttcgctcagtagac

SEQ ID NO: 1156854 - DNA, 22 bp, Artificial Sequence
  chemically synthesized
acataaatgtgtaagtagtcta

SEQ ID NO: 1156855 - DNA, 22 bp, Artificial Sequence
  chemically synthesized
cacataaatgtgtaagtagtct

SEQ ID NO: 1156856 - DNA, 22 bp, Artificial Sequence
  chemically synthesized
cgctcagtagactacttacaca

SEQ ID NO: 1156857 - DNA, 22 bp, Artificial Sequence
  chemically synthesized
gctcagtagactacttacacat

SEQ ID NO: 1156858 - DNA, 22 bp, Artificial Sequence
  chemically synthesized
agtagactacttacacatttat

SEQ ID NO: 1156859 - DNA, 22 bp, Artificial Sequence
  chemically synthesized
ccccgacccttcacataaatgt

SEQ ID NO: 1156860 - DNA, 22 bp, Artificial Sequence
  chemically synthesized
cccccgacccttcacataaatg

SEQ ID NO: 1156861 - DNA, 22 bp, Artificial Sequence
  chemically synthesized
tcccccgacccttcacataaat

SEQ ID NO: 1156862 - DNA, 22 bp, Artificial Sequence
  chemically synthesized
ttcccccgacccttcacataaa

SEQ ID NO: 1156863 - DNA, 22 bp, Artificial Sequence
  chemically synthesized
tttttcccccgacccttcacat

SEQ ID NO: 1156864 - DNA, 22 bp, Artificial Sequence
  chemically synthesized
cttacacatttatgtgaagggt

SEQ ID NO: 1156865 - DNA, 22 bp, Artificial Sequence
  chemically synthesized
ttatttttcccccgacccttca

SEQ ID NO: 1156866 - DNA, 22 bp, Artificial Sequence
  chemically synthesized
acacatttatgtgaagggtcgg

SEQ ID NO: 1156867 - DNA, 22 bp, Artificial Sequence
  chemically synthesized
attatttttcccccgacccttc

SEQ ID NO: 1156868 - DNA, 22 bp, Artificial Sequence
  chemically synthesized
cacatttatgtgaagggtcggg

SEQ ID NO: 1156869 - DNA, 22 bp, Artificial Sequence
  chemically synthesized
tcgtttattatttttcccccga

SEQ ID NO: 1156870 - DNA, 22 bp, Artificial Sequence
  chemically synthesized
atgtgaagggtcgggggaaaaa

SEQ ID NO: 1156871 - DNA, 22 bp, Artificial Sequence
  chemically synthesized
tgtgaagggtcgggggaaaaat

SEQ ID NO: 1156872 - DNA, 22 bp, Artificial Sequence
  chemically synthesized
actatcgtttattatttttccc

SEQ ID NO: 1156873 - DNA, 22 bp, Artificial Sequence
  chemically synthesized
cactatcgtttattatttttcc

SEQ ID NO: 1156874 - DNA, 22 bp, Artificial Sequence
  chemically synthesized
cttcactatcgtttattatttt

SEQ ID NO: 1156875 - DNA, 22 bp, Artificial Sequence
  chemically synthesized
gctccttcactatcgtttatta

SEQ ID NO: 1156876 - DNA, 22 bp, Artificial Sequence
  chemically synthesized
ggtcctggctccttcactatcg

SEQ ID NO: 1156877 - DNA, 22 bp, Artificial Sequence
  chemically synthesized
ttaggtcctggctccttcacta

SEQ ID NO: 1156878 - DNA, 22 bp, Artificial Sequence
  chemically synthesized
ttgttaggtcctggctccttca

SEQ ID NO: 1156879 - DNA, 22 bp, Artificial Sequence
  chemically synthesized
gttgttaggtcctggctccttc

SEQ ID NO: 1156880 - DNA, 22 bp, Artificial Sequence
  chemically synthesized
tgttgttaggtcctggctcctt

SEQ ID NO: 1156881 - DNA, 22 bp, Artificial Sequence
  chemically synthesized
tctttgttgttaggtcctggct

SEQ ID NO: 1156882 - DNA, 22 bp, Artificial Sequence
  chemically synthesized
ggtcagttgtctttgttgttag

SEQ ID NO: 1156883 - DNA, 22 bp, Artificial Sequence
  chemically synthesized
cggggatgctaggtcagttgtc

SEQ ID NO: 1156884 - DNA, 22 bp, Artificial Sequence
  chemically synthesized
acaacaaagacaactgacctag

SEQ ID NO: 1156885 - DNA, 22 bp, Artificial Sequence
  chemically synthesized
cagttccggggatgctaggtca

SEQ ID NO: 1156886 - DNA, 22 bp, Artificial Sequence
  chemically synthesized
ccagttccggggatgctaggtc

SEQ ID NO: 1156887 - DNA, 22 bp, Artificial Sequence
  chemically synthesized
ttccagttccggggatgctagg

SEQ ID NO: 1156888 - DNA, 22 bp, Artificial Sequence
  chemically synthesized
cttccagttccggggatgctag

SEQ ID NO: 1156889 - DNA, 22 bp, Artificial Sequence
  chemically synthesized
tcttccagttccggggatgcta

SEQ ID NO: 1156890 - DNA, 22 bp, Artificial Sequence
  chemically synthesized
ttcttccagttccggggatgct

SEQ ID NO: 1156891 - DNA, 22 bp, Artificial Sequence
  chemically synthesized
tttcttccagttccggggatgc

SEQ ID NO: 1156892 - DNA, 22 bp, Artificial Sequence
  chemically synthesized
ttttcttccagttccggggatg

SEQ ID NO: 1156893 - DNA, 22 bp, Artificial Sequence
  chemically synthesized
cttttttcttccagttccgggg

SEQ ID NO: 1156894 - DNA, 22 bp, Artificial Sequence
  chemically synthesized
ccttttttcttccagttccggg

SEQ ID NO: 1156895 - DNA, 22 bp, Artificial Sequence
  chemically synthesized
acctagcatccccggaactgga

SEQ ID NO: 1156896 - DNA, 22 bp, Artificial Sequence
  chemically synthesized
ttccttttttcttccagttccg

SEQ ID NO: 1156897 - DNA, 22 bp, Artificial Sequence
  chemically synthesized
tcttccttttttcttccagttc

SEQ ID NO: 1156898 - DNA, 22 bp, Artificial Sequence
  chemically synthesized
gcatccccggaactggaagaaa

SEQ ID NO: 1156899 - DNA, 22 bp, Artificial Sequence
  chemically synthesized
cggcaacagctctcttcctttt

SEQ ID NO: 1156900 - DNA, 22 bp, Artificial Sequence
  chemically synthesized
agctccggcaacagctctcttc

SEQ ID NO: 1156901 - DNA, 22 bp, Artificial Sequence
  chemically synthesized
gaagaaaaaaggaagagagctg

SEQ ID NO: 1156902 - DNA, 22 bp, Artificial Sequence
  chemically synthesized
actgagctccggcaacagctct

SEQ ID NO: 1156903 - DNA, 22 bp, Artificial Sequence
  chemically synthesized
tcactgagctccggcaacagct

SEQ ID NO: 1156904 - DNA, 22 bp, Artificial Sequence
  chemically synthesized
attctcactgagctccggcaac

SEQ ID NO: 1156905 - DNA, 22 bp, Artificial Sequence
  chemically synthesized
taattctcactgagctccggca

SEQ ID NO: 1156906 - DNA, 22 bp, Artificial Sequence
  chemically synthesized
catgtctctaattctcactgag

SEQ ID NO: 1156907 - DNA, 22 bp, Artificial Sequence
  chemically synthesized
ttgccggagctcagtgagaatt

SEQ ID NO: 1156908 - DNA, 22 bp, Artificial Sequence
  chemically synthesized
ttccatgtctctaattctcact

SEQ ID NO: 1156909 - DNA, 22 bp, Artificial Sequence
  chemically synthesized
gttccatgtctctaattctcac

SEQ ID NO: 1156910 - DNA, 22 bp, Artificial Sequence
  chemically synthesized
ccggagctcagtgagaattaga

SEQ ID NO: 1156911 - DNA, 22 bp, Artificial Sequence
  chemically synthesized
ttgttccatgtctctaattctc

SEQ ID NO: 1156912 - DNA, 22 bp, Artificial Sequence
  chemically synthesized
gacagctcttgttccatgtctc

SEQ ID NO: 1156913 - DNA, 22 bp, Artificial Sequence
  chemically synthesized
agtgagaattagagacatggaa

SEQ ID NO: 1156914 - DNA, 22 bp, Artificial Sequence
  chemically synthesized
ttggacagctcttgttccatgt

SEQ ID NO: 1156915 - DNA, 22 bp, Artificial Sequence
  chemically synthesized
ctgttggacagctcttgttcca

SEQ ID NO: 1156916 - DNA, 22 bp, Artificial Sequence
  chemically synthesized
gagacatggaacaagagctgtc

SEQ ID NO: 1156917 - DNA, 22 bp, Artificial Sequence
  chemically synthesized
cagctactgttggacagctctt

SEQ ID NO: 1156918 - DNA, 22 bp, Artificial Sequence
  chemically synthesized
aactacagctactgttggacag

SEQ ID NO: 1156919 - DNA, 22 bp, Artificial Sequence
  chemically synthesized
aaactacagctactgttggaca

SEQ ID NO: 1156920 - DNA, 22 bp, Artificial Sequence
  chemically synthesized
ttaaactacagctactgttgga

SEQ ID NO: 1156921 - DNA, 22 bp, Artificial Sequence
  chemically synthesized
ctcttaaactacagctactgtt

SEQ ID NO: 1156922 - DNA, 22 bp, Artificial Sequence
  chemically synthesized
tgttcctcttaaactacagcta

SEQ ID NO: 1156923 - DNA, 22 bp, Artificial Sequence
  chemically synthesized
tccaacagtagctgtagtttaa

SEQ ID NO: 1156924 - DNA, 22 bp, Artificial Sequence
  chemically synthesized
gaattgtgttcctcttaaacta

SEQ ID NO: 1156925 - DNA, 22 bp, Artificial Sequence
  chemically synthesized
tggagtggctggaattgtgttc

SEQ ID NO: 1156926 - DNA, 22 bp, Artificial Sequence
  chemically synthesized
tagtttaagaggaacacaattc

SEQ ID NO: 1156927 - DNA, 22 bp, Artificial Sequence
  chemically synthesized
ctgtggagtggctggaattgtg

SEQ ID NO: 1156928 - DNA, 22 bp, Artificial Sequence
  chemically synthesized
actgtggagtggctggaattgt

SEQ ID NO: 1156929 - DNA, 22 bp, Artificial Sequence
  chemically synthesized
ttactgtggagtggctggaatt

SEQ ID NO: 1156930 - DNA, 22 bp, Artificial Sequence
  chemically synthesized
aagaggaacacaattccagcca

SEQ ID NO: 1156931 - DNA, 22 bp, Artificial Sequence
  chemically synthesized
cttactgtggagtggctggaat

SEQ ID NO: 1156932 - DNA, 22 bp, Artificial Sequence
  chemically synthesized
agaggaacacaattccagccac

SEQ ID NO: 1156933 - DNA, 22 bp, Artificial Sequence
  chemically synthesized
tttcttactgtggagtggctgg

SEQ ID NO: 1156934 - DNA, 22 bp, Artificial Sequence
  chemically synthesized
tgtttcttactgtggagtggct

SEQ ID NO: 1156935 - DNA, 22 bp, Artificial Sequence
  chemically synthesized
ctgtttcttactgtggagtggc

SEQ ID NO: 1156936 - DNA, 22 bp, Artificial Sequence
  chemically synthesized
ttctgtttcttactgtggagtg

SEQ ID NO: 1156937 - DNA, 22 bp, Artificial Sequence
  chemically synthesized
ctcttctgtttcttactgtgga

SEQ ID NO: 1156938 - DNA, 22 bp, Artificial Sequence
  chemically synthesized
cctcttctgtttcttactgtgg

SEQ ID NO: 1156939 - DNA, 22 bp, Artificial Sequence
  chemically synthesized
ttcctcttctgtttcttactgt

SEQ ID NO: 1156940 - DNA, 22 bp, Artificial Sequence
  chemically synthesized
cagccactccacagtaagaaac

SEQ ID NO: 1156941 - DNA, 22 bp, Artificial Sequence
  chemically synthesized
tcttcctcttctgtttcttact

SEQ ID NO: 1156942 - DNA, 22 bp, Artificial Sequence
  chemically synthesized
ctcttcctcttctgtttcttac

SEQ ID NO: 1156943 - DNA, 22 bp, Artificial Sequence
  chemically synthesized
tctcttcctcttctgtttctta

SEQ ID NO: 1156944 - DNA, 22 bp, Artificial Sequence
  chemically synthesized
ttctcttcctcttctgtttctt

SEQ ID NO: 1156945 - DNA, 22 bp, Artificial Sequence
  chemically synthesized
cacagtaagaaacagaagagga

SEQ ID NO: 1156946 - DNA, 22 bp, Artificial Sequence
  chemically synthesized
tggtacttttctcttcctcttc

SEQ ID NO: 1156947 - DNA, 22 bp, Artificial Sequence
  chemically synthesized
gcaagagggtgaaagcagagat

SEQ ID NO: 1156948 - DNA, 22 bp, Artificial Sequence
  chemically synthesized
tgctttcaccctcttgccagtg

SEQ ID NO: 1156949 - DNA, 22 bp, Artificial Sequence
  chemically synthesized
agccaatgggaggcactggcaa

SEQ ID NO: 1156950 - DNA, 22 bp, Artificial Sequence
  chemically synthesized
ctttcaccctcttgccagtgcc

SEQ ID NO: 1156951 - DNA, 22 bp, Artificial Sequence
  chemically synthesized
cagccaatgggaggcactggca

SEQ ID NO: 1156952 - DNA, 22 bp, Artificial Sequence
  chemically synthesized
tcaccctcttgccagtgcctcc

SEQ ID NO: 1156953 - DNA, 22 bp, Artificial Sequence
  chemically synthesized
caccctcttgccagtgcctccc

SEQ ID NO: 1156954 - DNA, 22 bp, Artificial Sequence
  chemically synthesized
accctcttgccagtgcctccca

SEQ ID NO: 1156955 - DNA, 22 bp, Artificial Sequence
  chemically synthesized
aagtacttcagccaatgggagg

SEQ ID NO: 1156956 - DNA, 22 bp, Artificial Sequence
  chemically synthesized
ttgccagtgcctcccattggct

SEQ ID NO: 1156957 - DNA, 22 bp, Artificial Sequence
  chemically synthesized
ctaaagtacttcagccaatggg

SEQ ID NO: 1156958 - DNA, 22 bp, Artificial Sequence
  chemically synthesized
gccagtgcctcccattggctga

SEQ ID NO: 1156959 - DNA, 22 bp, Artificial Sequence
  chemically synthesized
ccagtgcctcccattggctgaa

SEQ ID NO: 1156960 - DNA, 22 bp, Artificial Sequence
  chemically synthesized
gttgctaaagtacttcagccaa

SEQ ID NO: 1156961 - DNA, 22 bp, Artificial Sequence
  chemically synthesized
ggttgctaaagtacttcagcca

SEQ ID NO: 1156962 - DNA, 22 bp, Artificial Sequence
  chemically synthesized
tggttgctaaagtacttcagcc

SEQ ID NO: 1156963 - DNA, 22 bp, Artificial Sequence
  chemically synthesized
gcctttggttgctaaagtactt

SEQ ID NO: 1156964 - DNA, 22 bp, Artificial Sequence
  chemically synthesized
ggcctttggttgctaaagtact

SEQ ID NO: 1156965 - DNA, 22 bp, Artificial Sequence
  chemically synthesized
ccattggctgaagtactttagc

SEQ ID NO: 1156966 - DNA, 22 bp, Artificial Sequence
  chemically synthesized
ttggcctttggttgctaaagta

SEQ ID NO: 1156967 - DNA, 22 bp, Artificial Sequence
  chemically synthesized
ctcttggcctttggttgctaaa

SEQ ID NO: 1156968 - DNA, 22 bp, Artificial Sequence
  chemically synthesized
gctgaagtactttagcaaccaa

SEQ ID NO: 1156969 - DNA, 22 bp, Artificial Sequence
  chemically synthesized
aagtactttagcaaccaaaggc

SEQ ID NO: 1156970 - DNA, 22 bp, Artificial Sequence
  chemically synthesized
cccaggttcctcttggcctttg

SEQ ID NO: 1156971 - DNA, 22 bp, Artificial Sequence
  chemically synthesized
ttacccaggttcctcttggcct

SEQ ID NO: 1156972 - DNA, 22 bp, Artificial Sequence
  chemically synthesized
tagcaaccaaaggccaagagga

SEQ ID NO: 1156973 - DNA, 22 bp, Artificial Sequence
  chemically synthesized
tgttacccaggttcctcttggc

SEQ ID NO: 1156974 - DNA, 22 bp, Artificial Sequence
  chemically synthesized
agcaaccaaaggccaagaggaa

SEQ ID NO: 1156975 - DNA, 22 bp, Artificial Sequence
  chemically synthesized
ctgttacccaggttcctcttgg

SEQ ID NO: 1156976 - DNA, 22 bp, Artificial Sequence
  chemically synthesized
gcaaccaaaggccaagaggaac

SEQ ID NO: 1156977 - DNA, 22 bp, Artificial Sequence
  chemically synthesized
tctgttacccaggttcctcttg

SEQ ID NO: 1156978 - DNA, 22 bp, Artificial Sequence
  chemically synthesized
gattttctgttacccaggttcc

SEQ ID NO: 1156979 - DNA, 22 bp, Artificial Sequence
  chemically synthesized
aaagaggatgaagtctagattt

SEQ ID NO: 1156980 - DNA, 22 bp, Artificial Sequence
  chemically synthesized
ggtaacagaaaatctagacttc

SEQ ID NO: 1156981 - DNA, 22 bp, Artificial Sequence
  chemically synthesized
ttcaaagaggatgaagtctaga

SEQ ID NO: 1156982 - DNA, 22 bp, Artificial Sequence
  chemically synthesized
tgttcaaagaggatgaagtcta

SEQ ID NO: 1156983 - DNA, 22 bp, Artificial Sequence
  chemically synthesized
ctctgttcaaagaggatgaagt

SEQ ID NO: 1156984 - DNA, 22 bp, Artificial Sequence
  chemically synthesized
gctctgttcaaagaggatgaag

SEQ ID NO: 1156985 - DNA, 22 bp, Artificial Sequence
  chemically synthesized
ttgctctgttcaaagaggatga

SEQ ID NO: 1156986 - DNA, 22 bp, Artificial Sequence
  chemically synthesized
cttgctctgttcaaagaggatg

SEQ ID NO: 1156987 - DNA, 22 bp, Artificial Sequence
  chemically synthesized
cttcttgctctgttcaaagagg

SEQ ID NO: 1156988 - DNA, 22 bp, Artificial Sequence
  chemically synthesized
tccttcttgctctgttcaaaga

SEQ ID NO: 1156989 - DNA, 22 bp, Artificial Sequence
  chemically synthesized
ctccttcttgctctgttcaaag

SEQ ID NO: 1156990 - DNA, 22 bp, Artificial Sequence
  chemically synthesized
gacttcatcctctttgaacaga

SEQ ID NO: 1156991 - DNA, 22 bp, Artificial Sequence
  chemically synthesized
tctccttcttgctctgttcaaa

SEQ ID NO: 1156992 - DNA, 22 bp, Artificial Sequence
  chemically synthesized
ttctccttcttgctctgttcaa

SEQ ID NO: 1156993 - DNA, 22 bp, Artificial Sequence
  chemically synthesized
catcctctttgaacagagcaag

SEQ ID NO: 1156994 - DNA, 22 bp, Artificial Sequence
  chemically synthesized
acttttctccttcttgctctgt

SEQ ID NO: 1156995 - DNA, 22 bp, Artificial Sequence
  chemically synthesized
atcctctttgaacagagcaaga

SEQ ID NO: 1156996 - DNA, 22 bp, Artificial Sequence
  chemically synthesized
cacttttctccttcttgctctg

SEQ ID NO: 1156997 - DNA, 22 bp, Artificial Sequence
  chemically synthesized
atttcacttttctccttcttgc

SEQ ID NO: 1156998 - DNA, 22 bp, Artificial Sequence
  chemically synthesized
tttgaacagagcaagaaggaga

SEQ ID NO: 1156999 - DNA, 22 bp, Artificial Sequence
  chemically synthesized
tgaacagagcaagaaggagaaa

SEQ ID NO: 1157000 - DNA, 22 bp, Artificial Sequence
  chemically synthesized
gaacagagcaagaaggagaaaa

SEQ ID NO: 1157001 - DNA, 22 bp, Artificial Sequence
  chemically synthesized
aacagagcaagaaggagaaaag

SEQ ID NO: 1157002 - DNA, 22 bp, Artificial Sequence
  chemically synthesized
gcagattcatttcacttttctc

SEQ ID NO: 1157003 - DNA, 22 bp, Artificial Sequence
  chemically synthesized
agcagattcatttcacttttct

SEQ ID NO: 1157004 - DNA, 22 bp, Artificial Sequence
  chemically synthesized
tttagcagattcatttcacttt

SEQ ID NO: 1157005 - DNA, 22 bp, Artificial Sequence
  chemically synthesized
tgtttagcagattcatttcact

SEQ ID NO: 1157006 - DNA, 22 bp, Artificial Sequence
  chemically synthesized
ctctgtttagcagattcatttc

SEQ ID NO: 1157007 - DNA, 22 bp, Artificial Sequence
  chemically synthesized
atagttactctgtttagcagat

SEQ ID NO: 1157008 - DNA, 22 bp, Artificial Sequence
  chemically synthesized
gatagttactctgtttagcaga

SEQ ID NO: 1157009 - DNA, 22 bp, Artificial Sequence
  chemically synthesized
tgatagttactctgtttagcag

SEQ ID NO: 1157010 - DNA, 22 bp, Artificial Sequence
  chemically synthesized
agtattttgatagttactctgt

SEQ ID NO: 1157011 - DNA, 22 bp, Artificial Sequence
  chemically synthesized
aagtattttgatagttactctg

SEQ ID NO: 1157012 - DNA, 22 bp, Artificial Sequence
  chemically synthesized
atttaagtattttgatagttac

SEQ ID NO: 1157013 - DNA, 22 bp, Artificial Sequence
  chemically synthesized
ctaaacagagtaactatcaaaa

SEQ ID NO: 1157014 - DNA, 22 bp, Artificial Sequence
  chemically synthesized
tactaatttaagtattttgata

SEQ ID NO: 1157015 - DNA, 22 bp, Artificial Sequence
  chemically synthesized
aacagagtaactatcaaaatac

SEQ ID NO: 1157016 - DNA, 22 bp, Artificial Sequence
  chemically synthesized
atactaatttaagtattttgat

SEQ ID NO: 1157017 - DNA, 22 bp, Artificial Sequence
  chemically synthesized
aatacacttatactaatttaag

SEQ ID NO: 1157018 - DNA, 22 bp, Artificial Sequence
  chemically synthesized
aaatacacttatactaatttaa

SEQ ID NO: 1157019 - DNA, 22 bp, Artificial Sequence
  chemically synthesized
taaatacacttatactaattta

SEQ ID NO: 1157020 - DNA, 22 bp, Artificial Sequence
  chemically synthesized
tcaaaatacttaaattagtata

SEQ ID NO: 1157021 - DNA, 22 bp, Artificial Sequence
  chemically synthesized
ttttaaatacacttatactaat

SEQ ID NO: 1157022 - DNA, 22 bp, Artificial Sequence
  chemically synthesized
gttttaaatacacttatactaa

SEQ ID NO: 1157023 - DNA, 22 bp, Artificial Sequence
  chemically synthesized
tgttttaaatacacttatacta

SEQ ID NO: 1157024 - DNA, 22 bp, Artificial Sequence
  chemically synthesized
ttgttttaaatacacttatact

SEQ ID NO: 1157025 - DNA, 22 bp, Artificial Sequence
  chemically synthesized
aaattagtataagtgtatttaa

SEQ ID NO: 1157026 - DNA, 22 bp, Artificial Sequence
  chemically synthesized
tatccttttgttttaaatacac

SEQ ID NO: 1157027 - DNA, 22 bp, Artificial Sequence
  chemically synthesized
aattagtataagtgtatttaaa

SEQ ID NO: 1157028 - DNA, 22 bp, Artificial Sequence
  chemically synthesized
gtatccttttgttttaaataca

SEQ ID NO: 1157029 - DNA, 22 bp, Artificial Sequence
  chemically synthesized
tgtatccttttgttttaaatac

SEQ ID NO: 1157030 - DNA, 22 bp, Artificial Sequence
  chemically synthesized
gtataagtgtatttaaaacaaa

SEQ ID NO: 1157031 - DNA, 22 bp, Artificial Sequence
  chemically synthesized
atggaattttgtatccttttgt

SEQ ID NO: 1157032 - DNA, 22 bp, Artificial Sequence
  chemically synthesized
aaaacaaaaggatacaaaattc

SEQ ID NO: 1157033 - DNA, 22 bp, Artificial Sequence
  chemically synthesized
aaacaaaaggatacaaaattcc

SEQ ID NO: 1157034 - DNA, 22 bp, Artificial Sequence
  chemically synthesized
gtgtatgaggataaagatgctg

SEQ ID NO: 1157035 - DNA, 22 bp, Artificial Sequence
  chemically synthesized
gcattagtgtatgaggataaag

SEQ ID NO: 1157036 - DNA, 22 bp, Artificial Sequence
  chemically synthesized
catcagcatctttatcctcata

SEQ ID NO: 1157037 - DNA, 22 bp, Artificial Sequence
  chemically synthesized
aatagcctggcattagtgtatg

SEQ ID NO: 1157038 - DNA, 22 bp, Artificial Sequence
  chemically synthesized
aaatagcctggcattagtgtat

SEQ ID NO: 1157039 - DNA, 22 bp, Artificial Sequence
  chemically synthesized
tatcctcatacactaatgccag

SEQ ID NO: 1157040 - DNA, 22 bp, Artificial Sequence
  chemically synthesized
atcctcatacactaatgccagg

SEQ ID NO: 1157041 - DNA, 22 bp, Artificial Sequence
  chemically synthesized
gggtttaaatagcctggcatta

SEQ ID NO: 1157042 - DNA, 22 bp, Artificial Sequence
  chemically synthesized
tcctcatacactaatgccaggc

SEQ ID NO: 1157043 - DNA, 22 bp, Artificial Sequence
  chemically synthesized
atacactaatgccaggctattt

SEQ ID NO: 1157044 - DNA, 22 bp, Artificial Sequence
  chemically synthesized
catgttggggtttaaatagcct

SEQ ID NO: 1157045 - DNA, 22 bp, Artificial Sequence
  chemically synthesized
atgccaggctatttaaacccca

SEQ ID NO: 1157046 - DNA, 22 bp, Artificial Sequence
  chemically synthesized
catacaggttccatgttggggt

SEQ ID NO: 1157047 - DNA, 22 bp, Artificial Sequence
  chemically synthesized
tttaaaccccaacatggaacct

SEQ ID NO: 1157048 - DNA, 22 bp, Artificial Sequence
  chemically synthesized
aaaccccaacatggaacctgta

SEQ ID NO: 1157049 - DNA, 22 bp, Artificial Sequence
  chemically synthesized
aaccccaacatggaacctgtat

SEQ ID NO: 1157050 - DNA, 22 bp, Artificial Sequence
  chemically synthesized
tatgtaatgttacataccactc

SEQ ID NO: 1157051 - DNA, 22 bp, Artificial Sequence
  chemically synthesized
tatgaagagtgtgagtggtatg

SEQ ID NO: 1157052 - DNA, 22 bp, Artificial Sequence
  chemically synthesized
atatgaagagtgtgagtggtat

SEQ ID NO: 1157053 - DNA, 22 bp, Artificial Sequence
  chemically synthesized
tatatgaagagtgtgagtggta

SEQ ID NO: 1157054 - DNA, 22 bp, Artificial Sequence
  chemically synthesized
taattttatatgaagagtgtga

SEQ ID NO: 1157055 - DNA, 22 bp, Artificial Sequence
  chemically synthesized
cataccactcacactcttcata

SEQ ID NO: 1157056 - DNA, 22 bp, Artificial Sequence
  chemically synthesized
cctgtaattttatatgaagagt

SEQ ID NO: 1157057 - DNA, 22 bp, Artificial Sequence
  chemically synthesized
ccctgtaattttatatgaagag

SEQ ID NO: 1157058 - DNA, 22 bp, Artificial Sequence
  chemically synthesized
tttccctgtaattttatatgaa

SEQ ID NO: 1157059 - DNA, 22 bp, Artificial Sequence
  chemically synthesized
ccctgtttccctgtaattttat

SEQ ID NO: 1157060 - DNA, 22 bp, Artificial Sequence
  chemically synthesized
acactcttcatataaaattaca

SEQ ID NO: 1157061 - DNA, 22 bp, Artificial Sequence
  chemically synthesized
cccctgtttccctgtaatttta

SEQ ID NO: 1157062 - DNA, 22 bp, Artificial Sequence
  chemically synthesized
cttcccctgtttccctgtaatt

SEQ ID NO: 1157063 - DNA, 22 bp, Artificial Sequence
  chemically synthesized
acttcccctgtttccctgtaat

SEQ ID NO: 1157064 - DNA, 22 bp, Artificial Sequence
  chemically synthesized
ttcatataaaattacagggaaa

SEQ ID NO: 1157065 - DNA, 22 bp, Artificial Sequence
  chemically synthesized
catataaaattacagggaaaca

SEQ ID NO: 1157066 - DNA, 22 bp, Artificial Sequence
  chemically synthesized
gtttacttcccctgtttccctg

SEQ ID NO: 1157067 - DNA, 22 bp, Artificial Sequence
  chemically synthesized
atataaaattacagggaaacag

SEQ ID NO: 1157068 - DNA, 22 bp, Artificial Sequence
  chemically synthesized
ctggtttacttcccctgtttcc

SEQ ID NO: 1157069 - DNA, 22 bp, Artificial Sequence
  chemically synthesized
actggtttacttcccctgtttc

SEQ ID NO: 1157070 - DNA, 22 bp, Artificial Sequence
  chemically synthesized
tactggtttacttcccctgttt

SEQ ID NO: 1157071 - DNA, 22 bp, Artificial Sequence
  chemically synthesized
ttttactggtttacttcccctg

SEQ ID NO: 1157072 - DNA, 22 bp, Artificial Sequence
  chemically synthesized
attttactggtttacttcccct

SEQ ID NO: 1157073 - DNA, 22 bp, Artificial Sequence
  chemically synthesized
tattttactggtttacttcccc

SEQ ID NO: 1157074 - DNA, 22 bp, Artificial Sequence
  chemically synthesized
cagggaaacaggggaagtaaac

SEQ ID NO: 1157075 - DNA, 22 bp, Artificial Sequence
  chemically synthesized
tattttattttactggtttact

SEQ ID NO: 1157076 - DNA, 22 bp, Artificial Sequence
  chemically synthesized
atattttattttactggtttac

SEQ ID NO: 1157077 - DNA, 22 bp, Artificial Sequence
  chemically synthesized
tatattttattttactggttta

SEQ ID NO: 1157078 - DNA, 22 bp, Artificial Sequence
  chemically synthesized
ttatattttattttactggttt

SEQ ID NO: 1157079 - DNA, 22 bp, Artificial Sequence
  chemically synthesized
tcttttatattttattttactg

SEQ ID NO: 1157080 - DNA, 22 bp, Artificial Sequence
  chemically synthesized
tggagccattatcttttatatt

SEQ ID NO: 1157081 - DNA, 22 bp, Artificial Sequence
  chemically synthesized
ggaccagctatggagccattat

SEQ ID NO: 1157082 - DNA, 22 bp, Artificial Sequence
  chemically synthesized
cggaccagctatggagccatta

SEQ ID NO: 1157083 - DNA, 22 bp, Artificial Sequence
  chemically synthesized
ataacaaccccaatacttcgga

SEQ ID NO: 1157084 - DNA, 22 bp, Artificial Sequence
  chemically synthesized
tgataacaaccccaatacttcg

SEQ ID NO: 1157085 - DNA, 22 bp, Artificial Sequence
  chemically synthesized
catagctggtccgaagtattgg

SEQ ID NO: 1157086 - DNA, 22 bp, Artificial Sequence
  chemically synthesized
gtccgaagtattggggttgtta

SEQ ID NO: 1157087 - DNA, 22 bp, Artificial Sequence
  chemically synthesized
gaagaaagctctgataacaacc

SEQ ID NO: 1157088 - DNA, 22 bp, Artificial Sequence
  chemically synthesized
gggttgttatcagagctttctt

SEQ ID NO: 1157089 - DNA, 22 bp, Artificial Sequence
  chemically synthesized
ttatcagagctttcttccaata

SEQ ID NO: 1157090 - DNA, 22 bp, Artificial Sequence
  chemically synthesized
tcagagctttcttccaatatgc

SEQ ID NO: 1157091 - DNA, 22 bp, Artificial Sequence
  chemically synthesized
aaaaggaatatgaaatgcatat

SEQ ID NO: 1157092 - DNA, 22 bp, Artificial Sequence
  chemically synthesized
tcaaaaggaatatgaaatgcat

SEQ ID NO: 1157093 - DNA, 22 bp, Artificial Sequence
  chemically synthesized
tcttccaatatgcatttcatat

SEQ ID NO: 1157094 - DNA, 22 bp, Artificial Sequence
  chemically synthesized
cttccaatatgcatttcatatt

SEQ ID NO: 1157095 - DNA, 22 bp, Artificial Sequence
  chemically synthesized
ttccaatatgcatttcatattc

SEQ ID NO: 1157096 - DNA, 22 bp, Artificial Sequence
  chemically synthesized
ccaatatgcatttcatattcct

SEQ ID NO: 1157097 - DNA, 22 bp, Artificial Sequence
  chemically synthesized
caatatgcatttcatattcctt

SEQ ID NO: 1157098 - DNA, 22 bp, Artificial Sequence
  chemically synthesized
taaacactctcaaaaggaatat

SEQ ID NO: 1157099 - DNA, 22 bp, Artificial Sequence
  chemically synthesized
ttgtaaacactctcaaaaggaa

SEQ ID NO: 1157100 - DNA, 22 bp, Artificial Sequence
  chemically synthesized
aattattgtaaacactctcaaa

SEQ ID NO: 1157101 - DNA, 22 bp, Artificial Sequence
  chemically synthesized
catattccttttgagagtgttt

SEQ ID NO: 1157102 - DNA, 22 bp, Artificial Sequence
  chemically synthesized
atattccttttgagagtgttta

SEQ ID NO: 1157103 - DNA, 22 bp, Artificial Sequence
  chemically synthesized
cttttgagagtgtttacaataa

SEQ ID NO: 1157104 - DNA, 22 bp, Artificial Sequence
  chemically synthesized
ttgagagtgtttacaataattt

SEQ ID NO: 1157105 - DNA, 22 bp, Artificial Sequence
  chemically synthesized
tgagagtgtttacaataattta

SEQ ID NO: 1157106 - DNA, 22 bp, Artificial Sequence
  chemically synthesized
gagagtgtttacaataatttag

SEQ ID NO: 1157107 - DNA, 22 bp, Artificial Sequence
  chemically synthesized
agagtgtttacaataatttaga

SEQ ID NO: 1157108 - DNA, 22 bp, Artificial Sequence
  chemically synthesized
aaagtcaataaatagtgcaatc

SEQ ID NO: 1157109 - DNA, 22 bp, Artificial Sequence
  chemically synthesized
acaataatttagattgcactat

SEQ ID NO: 1157110 - DNA, 22 bp, Artificial Sequence
  chemically synthesized
caataatttagattgcactatt

SEQ ID NO: 1157111 - DNA, 22 bp, Artificial Sequence
  chemically synthesized
aaatgttaaaagtcaataaata

SEQ ID NO: 1157112 - DNA, 22 bp, Artificial Sequence
  chemically synthesized
taaaatgttaaaagtcaataaa

SEQ ID NO: 1157113 - DNA, 22 bp, Artificial Sequence
  chemically synthesized
agattgcactatttattgactt

SEQ ID NO: 1157114 - DNA, 22 bp, Artificial Sequence
  chemically synthesized
gattgcactatttattgacttt

SEQ ID NO: 1157115 - DNA, 22 bp, Artificial Sequence
  chemically synthesized
cactatttattgacttttaaca

SEQ ID NO: 1157116 - DNA, 22 bp, Artificial Sequence
  chemically synthesized
tttattgacttttaacatttta

SEQ ID NO: 1157117 - DNA, 22 bp, Artificial Sequence
  chemically synthesized
attgacttttaacattttagag

SEQ ID NO: 1157118 - DNA, 22 bp, Artificial Sequence
  chemically synthesized
ttgacttttaacattttagaga

SEQ ID NO: 1157119 - DNA, 22 bp, Artificial Sequence
  chemically synthesized
atggtaaatgtgtctctaaaat

SEQ ID NO: 1157120 - DNA, 22 bp, Artificial Sequence
  chemically synthesized
acttttaacattttagagacac

SEQ ID NO: 1157121 - DNA, 22 bp, Artificial Sequence
  chemically synthesized
ctcatggtaaatgtgtctctaa

SEQ ID NO: 1157122 - DNA, 22 bp, Artificial Sequence
  chemically synthesized
ttaacattttagagacacattt

SEQ ID NO: 1157123 - DNA, 22 bp, Artificial Sequence
  chemically synthesized
taacattttagagacacattta

SEQ ID NO: 1157124 - DNA, 22 bp, Artificial Sequence
  chemically synthesized
aacattttagagacacatttac

SEQ ID NO: 1157125 - DNA, 22 bp, Artificial Sequence
  chemically synthesized
acattttagagacacatttacc

SEQ ID NO: 1157126 - DNA, 22 bp, Artificial Sequence
  chemically synthesized
caatgttcctcatggtaaatgt

SEQ ID NO: 1157127 - DNA, 22 bp, Artificial Sequence
  chemically synthesized
attgcaatgttcctcatggtaa

SEQ ID NO: 1157128 - DNA, 22 bp, Artificial Sequence
  chemically synthesized
tagagacacatttaccatgagg

SEQ ID NO: 1157129 - DNA, 22 bp, Artificial Sequence
  chemically synthesized
agagacacatttaccatgagga

SEQ ID NO: 1157130 - DNA, 22 bp, Artificial Sequence
  chemically synthesized
tgattgcaatgttcctcatggt

SEQ ID NO: 1157131 - DNA, 22 bp, Artificial Sequence
  chemically synthesized
gagacacatttaccatgaggaa

SEQ ID NO: 1157132 - DNA, 22 bp, Artificial Sequence
  chemically synthesized
ctgattgcaatgttcctcatgg

SEQ ID NO: 1157133 - DNA, 22 bp, Artificial Sequence
  chemically synthesized
ataacttctgattgcaatgttc

SEQ ID NO: 1157134 - DNA, 22 bp, Artificial Sequence
  chemically synthesized
tcataacttctgattgcaatgt

SEQ ID NO: 1157135 - DNA, 22 bp, Artificial Sequence
  chemically synthesized
accatgaggaacattgcaatca

SEQ ID NO: 1157136 - DNA, 22 bp, Artificial Sequence
  chemically synthesized
ccatgaggaacattgcaatcag

SEQ ID NO: 1157137 - DNA, 22 bp, Artificial Sequence
  chemically synthesized
ttctcataacttctgattgcaa

SEQ ID NO: 1157138 - DNA, 22 bp, Artificial Sequence
  chemically synthesized
attctcataacttctgattgca

SEQ ID NO: 1157139 - DNA, 22 bp, Artificial Sequence
  chemically synthesized
caatcagaagttatgagaataa

SEQ ID NO: 1157140 - DNA, 22 bp, Artificial Sequence
  chemically synthesized
ataaatgaaagtttattctcat

SEQ ID NO: 1157141 - DNA, 22 bp, Artificial Sequence
  chemically synthesized
gataaatgaaagtttattctca

SEQ ID NO: 1157142 - DNA, 22 bp, Artificial Sequence
  chemically synthesized
tgtttgataaatgaaagtttat

SEQ ID NO: 1157143 - DNA, 22 bp, Artificial Sequence
  chemically synthesized
gtgtttgataaatgaaagttta

SEQ ID NO: 1157144 - DNA, 22 bp, Artificial Sequence
  chemically synthesized
tgtgtttgataaatgaaagttt

SEQ ID NO: 1157145 - DNA, 22 bp, Artificial Sequence
  chemically synthesized
ttgtgtttgataaatgaaagtt

SEQ ID NO: 1157146 - DNA, 22 bp, Artificial Sequence
  chemically synthesized
tttgtgtttgataaatgaaagt

SEQ ID NO: 1157147 - DNA, 22 bp, Artificial Sequence
  chemically synthesized
tgagaataaactttcatttatc

SEQ ID NO: 1157148 - DNA, 22 bp, Artificial Sequence
  chemically synthesized
ctttttgtgtttgataaatgaa

SEQ ID NO: 1157149 - DNA, 22 bp, Artificial Sequence
  chemically synthesized
tcatttatcaaacacaaaaagt

SEQ ID NO: 1157150 - DNA, 22 bp, Artificial Sequence
  chemically synthesized
catttatcaaacacaaaaagta

SEQ ID NO: 1157151 - DNA, 22 bp, Artificial Sequence
  chemically synthesized
atttatcaaacacaaaaagtag

SEQ ID NO: 1157152 - DNA, 22 bp, Artificial Sequence
  chemically synthesized
ataaaaataaaatgtctacttt

SEQ ID NO: 1157153 - DNA, 22 bp, Artificial Sequence
  chemically synthesized
atcaaacacaaaaagtagacat

SEQ ID NO: 1157154 - DNA, 22 bp, Artificial Sequence
  chemically synthesized
tcaaacacaaaaagtagacatt

SEQ ID NO: 1157155 - DNA, 22 bp, Artificial Sequence
  chemically synthesized
tcataaaaataaaatgtctact

SEQ ID NO: 1157156 - DNA, 22 bp, Artificial Sequence
  chemically synthesized
ctcataaaaataaaatgtctac

SEQ ID NO: 1157157 - DNA, 22 bp, Artificial Sequence
  chemically synthesized
tttctcataaaaataaaatgtc

SEQ ID NO: 1157158 - DNA, 22 bp, Artificial Sequence
  chemically synthesized
ttgtttctcataaaaataaaat

SEQ ID NO: 1157159 - DNA, 22 bp, Artificial Sequence
  chemically synthesized
tgttgtttctcataaaaataaa

SEQ ID NO: 1157160 - DNA, 22 bp, Artificial Sequence
  chemically synthesized
atctctgttgtttctcataaaa

SEQ ID NO: 1157161 - DNA, 22 bp, Artificial Sequence
  chemically synthesized
tatttttatgagaaacaacaga

SEQ ID NO: 1157162 - DNA, 22 bp, Artificial Sequence
  chemically synthesized
atttttatgagaaacaacagag

SEQ ID NO: 1157163 - DNA, 22 bp, Artificial Sequence
  chemically synthesized
tttttatgagaaacaacagaga

SEQ ID NO: 1157164 - DNA, 22 bp, Artificial Sequence
  chemically synthesized
aatggatatctcatctctgttg

SEQ ID NO: 1157165 - DNA, 22 bp, Artificial Sequence
  chemically synthesized
aaatggatatctcatctctgtt

SEQ ID NO: 1157166 - DNA, 22 bp, Artificial Sequence
  chemically synthesized
ttatgagaaacaacagagatga

SEQ ID NO: 1157167 - DNA, 22 bp, Artificial Sequence
  chemically synthesized
tatgagaaacaacagagatgag

SEQ ID NO: 1157168 - DNA, 22 bp, Artificial Sequence
  chemically synthesized
atgagaaacaacagagatgaga

SEQ ID NO: 1157169 - DNA, 22 bp, Artificial Sequence
  chemically synthesized
tgagaaacaacagagatgagat

SEQ ID NO: 1157170 - DNA, 22 bp, Artificial Sequence
  chemically synthesized
cacttaaatggatatctcatct

SEQ ID NO: 1157171 - DNA, 22 bp, Artificial Sequence
  chemically synthesized
ccacttaaatggatatctcatc

SEQ ID NO: 1157172 - DNA, 22 bp, Artificial Sequence
  chemically synthesized
cttccacttaaatggatatctc

SEQ ID NO: 1157173 - DNA, 22 bp, Artificial Sequence
  chemically synthesized
gcttccacttaaatggatatct

SEQ ID NO: 1157174 - DNA, 22 bp, Artificial Sequence
  chemically synthesized
tgcttccacttaaatggatatc

SEQ ID NO: 1157175 - DNA, 22 bp, Artificial Sequence
  chemically synthesized
ttgcttccacttaaatggatat

SEQ ID NO: 1157176 - DNA, 22 bp, Artificial Sequence
  chemically synthesized
agtttttgcttccacttaaatg

SEQ ID NO: 1157177 - DNA, 22 bp, Artificial Sequence
  chemically synthesized
cagtttttgcttccacttaaat

SEQ ID NO: 1157178 - DNA, 22 bp, Artificial Sequence
  chemically synthesized
tcagtttttgcttccacttaaa

SEQ ID NO: 1157179 - DNA, 22 bp, Artificial Sequence
  chemically synthesized
gcaactttcagtttttgcttcc

SEQ ID NO: 1157180 - DNA, 22 bp, Artificial Sequence
  chemically synthesized
aagtggaagcaaaaactgaaag

SEQ ID NO: 1157181 - DNA, 22 bp, Artificial Sequence
  chemically synthesized
aaatactagcaactttcagttt

SEQ ID NO: 1157182 - DNA, 22 bp, Artificial Sequence
  chemically synthesized
agtggaagcaaaaactgaaagt

SEQ ID NO: 1157183 - DNA, 22 bp, Artificial Sequence
  chemically synthesized
caaatactagcaactttcagtt

SEQ ID NO: 1157184 - DNA, 22 bp, Artificial Sequence
  chemically synthesized
tcaaatactagcaactttcagt

SEQ ID NO: 1157185 - DNA, 22 bp, Artificial Sequence
  chemically synthesized
aaagttgctagtatttgaaagc

SEQ ID NO: 1157186 - DNA, 22 bp, Artificial Sequence
  chemically synthesized
ctagtatttgaaagcatcattt

SEQ ID NO: 1157187 - DNA, 22 bp, Artificial Sequence
  chemically synthesized
gtatttgaaagcatcatttact

SEQ ID NO: 1157188 - DNA, 22 bp, Artificial Sequence
  chemically synthesized
tccaaaagcaaaaagtaaatga

SEQ ID NO: 1157189 - DNA, 22 bp, Artificial Sequence
  chemically synthesized
gaaagcatcatttactttttgc

SEQ ID NO: 1157190 - DNA, 22 bp, Artificial Sequence
  chemically synthesized
aaagcatcatttactttttgct

SEQ ID NO: 1157191 - DNA, 22 bp, Artificial Sequence
  chemically synthesized
aaggaaatgtctgtccaaaagc

SEQ ID NO: 1157192 - DNA, 22 bp, Artificial Sequence
  chemically synthesized
ttgaaggaaatgtctgtccaaa

SEQ ID NO: 1157193 - DNA, 22 bp, Artificial Sequence
  chemically synthesized
gttgaaggaaatgtctgtccaa

SEQ ID NO: 1157194 - DNA, 22 bp, Artificial Sequence
  chemically synthesized
actttttgcttttggacagaca

SEQ ID NO: 1157195 - DNA, 22 bp, Artificial Sequence
  chemically synthesized
ctttttgcttttggacagacat

SEQ ID NO: 1157196 - DNA, 22 bp, Artificial Sequence
  chemically synthesized
tttgcttttggacagacatttc

SEQ ID NO: 1157197 - DNA, 22 bp, Artificial Sequence
  chemically synthesized
ttgcttttggacagacatttcc

SEQ ID NO: 1157198 - DNA, 22 bp, Artificial Sequence
  chemically synthesized
tgcttttggacagacatttcct

SEQ ID NO: 1157199 - DNA, 22 bp, Artificial Sequence
  chemically synthesized
gcttttggacagacatttcctt

SEQ ID NO: 1157200 - DNA, 22 bp, Artificial Sequence
  chemically synthesized
cttttggacagacatttccttc

SEQ ID NO: 1157201 - DNA, 22 bp, Artificial Sequence
  chemically synthesized
agtaaagatttgttgaaggaaa

SEQ ID NO: 1157202 - DNA, 22 bp, Artificial Sequence
  chemically synthesized
ttggacagacatttccttcaac

SEQ ID NO: 1157203 - DNA, 22 bp, Artificial Sequence
  chemically synthesized
tggacagacatttccttcaaca

SEQ ID NO: 1157204 - DNA, 22 bp, Artificial Sequence
  chemically synthesized
ggacagacatttccttcaacaa

SEQ ID NO: 1157205 - DNA, 22 bp, Artificial Sequence
  chemically synthesized
gacagacatttccttcaacaaa

SEQ ID NO: 1157206 - DNA, 22 bp, Artificial Sequence
  chemically synthesized
ccttcaacaaatctttactgag

SEQ ID NO: 1157207 - DNA, 22 bp, Artificial Sequence
  chemically synthesized
cttcaacaaatctttactgagt

SEQ ID NO: 1157208 - DNA, 22 bp, Artificial Sequence
  chemically synthesized
catagatatgaaactcagtaaa

SEQ ID NO: 1157209 - DNA, 22 bp, Artificial Sequence
  chemically synthesized
caacaaatctttactgagtttc

SEQ ID NO: 1157210 - DNA, 22 bp, Artificial Sequence
  chemically synthesized
ctgcatagatatgaaactcagt

SEQ ID NO: 1157211 - DNA, 22 bp, Artificial Sequence
  chemically synthesized
aacaaatctttactgagtttca

SEQ ID NO: 1157212 - DNA, 22 bp, Artificial Sequence
  chemically synthesized
cctgcatagatatgaaactcag

SEQ ID NO: 1157213 - DNA, 22 bp, Artificial Sequence
  chemically synthesized
tactgagtttcatatctatgca

SEQ ID NO: 1157214 - DNA, 22 bp, Artificial Sequence
  chemically synthesized
actgagtttcatatctatgcag

SEQ ID NO: 1157215 - DNA, 22 bp, Artificial Sequence
  chemically synthesized
ctgagtttcatatctatgcagg

SEQ ID NO: 1157216 - DNA, 22 bp, Artificial Sequence
  chemically synthesized
acaaatatgagtttcctgcata

SEQ ID NO: 1157217 - DNA, 22 bp, Artificial Sequence
  chemically synthesized
agtttcatatctatgcaggaaa

SEQ ID NO: 1157218 - DNA, 22 bp, Artificial Sequence
  chemically synthesized
ctaacaaatatgagtttcctgc

SEQ ID NO: 1157219 - DNA, 22 bp, Artificial Sequence
  chemically synthesized
catatctatgcaggaaactcat

SEQ ID NO: 1157220 - DNA, 22 bp, Artificial Sequence
  chemically synthesized
atatctatgcaggaaactcata

SEQ ID NO: 1157221 - DNA, 22 bp, Artificial Sequence
  chemically synthesized
tccattcctaacaaatatgagt

SEQ ID NO: 1157222 - DNA, 22 bp, Artificial Sequence
  chemically synthesized
gtccattcctaacaaatatgag

SEQ ID NO: 1157223 - DNA, 22 bp, Artificial Sequence
  chemically synthesized
tgtccattcctaacaaatatga

SEQ ID NO: 1157224 - DNA, 22 bp, Artificial Sequence
  chemically synthesized
tgcaggaaactcatatttgtta

SEQ ID NO: 1157225 - DNA, 22 bp, Artificial Sequence
  chemically synthesized
aagataggtattttgtccattc

SEQ ID NO: 1157226 - DNA, 22 bp, Artificial Sequence
  chemically synthesized
atatttgttaggaatggacaaa

SEQ ID NO: 1157227 - DNA, 22 bp, Artificial Sequence
  chemically synthesized
aaattgaagataggtattttgt

SEQ ID NO: 1157228 - DNA, 22 bp, Artificial Sequence
  chemically synthesized
gttaggaatggacaaaatacct

SEQ ID NO: 1157229 - DNA, 22 bp, Artificial Sequence
  chemically synthesized
gaaattgaagataggtattttg

SEQ ID NO: 1157230 - DNA, 22 bp, Artificial Sequence
  chemically synthesized
ttaggaatggacaaaataccta

SEQ ID NO: 1157231 - DNA, 22 bp, Artificial Sequence
  chemically synthesized
cttgaaattgaagataggtatt

SEQ ID NO: 1157232 - DNA, 22 bp, Artificial Sequence
  chemically synthesized
ggaatggacaaaatacctatct

SEQ ID NO: 1157233 - DNA, 22 bp, Artificial Sequence
  chemically synthesized
agctacttgaaattgaagatag

SEQ ID NO: 1157234 - DNA, 22 bp, Artificial Sequence
  chemically synthesized
taagctacttgaaattgaagat

SEQ ID NO: 1157235 - DNA, 22 bp, Artificial Sequence
  chemically synthesized
atagtctctaagctacttgaaa

SEQ ID NO: 1157236 - DNA, 22 bp, Artificial Sequence
  chemically synthesized
taatagtctctaagctacttga

SEQ ID NO: 1157237 - DNA, 22 bp, Artificial Sequence
  chemically synthesized
tcttcaatttcaagtagcttag

SEQ ID NO: 1157238 - DNA, 22 bp, Artificial Sequence
  chemically synthesized
tgtctctaatagtctctaagct

SEQ ID NO: 1157239 - DNA, 22 bp, Artificial Sequence
  chemically synthesized
caatttcaagtagcttagagac

SEQ ID NO: 1157240 - DNA, 22 bp, Artificial Sequence
  chemically synthesized
atgtctctaatagtctctaagc

SEQ ID NO: 1157241 - DNA, 22 bp, Artificial Sequence
  chemically synthesized
aatttcaagtagcttagagact

SEQ ID NO: 1157242 - DNA, 22 bp, Artificial Sequence
  chemically synthesized
tatttatgtctctaatagtctc

SEQ ID NO: 1157243 - DNA, 22 bp, Artificial Sequence
  chemically synthesized
caagtagcttagagactattag

SEQ ID NO: 1157244 - DNA, 22 bp, Artificial Sequence
  chemically synthesized
gtatttatgtctctaatagtct

SEQ ID NO: 1157245 - DNA, 22 bp, Artificial Sequence
  chemically synthesized
aagtagcttagagactattaga

SEQ ID NO: 1157246 - DNA, 22 bp, Artificial Sequence
  chemically synthesized
tgtatttatgtctctaatagtc

SEQ ID NO: 1157247 - DNA, 22 bp, Artificial Sequence
  chemically synthesized
ttgtatttatgtctctaatagt

SEQ ID NO: 1157248 - DNA, 22 bp, Artificial Sequence
  chemically synthesized
tttttgtatttatgtctctaat

SEQ ID NO: 1157249 - DNA, 22 bp, Artificial Sequence
  chemically synthesized
attatttttgtatttatgtctc

SEQ ID NO: 1157250 - DNA, 22 bp, Artificial Sequence
  chemically synthesized
agagactattagagacataaat

SEQ ID NO: 1157251 - DNA, 22 bp, Artificial Sequence
  chemically synthesized
gagactattagagacataaata

SEQ ID NO: 1157252 - DNA, 22 bp, Artificial Sequence
  chemically synthesized
taattatttttgtatttatgtc

SEQ ID NO: 1157253 - DNA, 22 bp, Artificial Sequence
  chemically synthesized
tattctaattatttttgtattt

SEQ ID NO: 1157254 - DNA, 22 bp, Artificial Sequence
  chemically synthesized
atattctaattatttttgtatt

SEQ ID NO: 1157255 - DNA, 22 bp, Artificial Sequence
  chemically synthesized
ttagagacataaatacaaaaat

SEQ ID NO: 1157256 - DNA, 22 bp, Artificial Sequence
  chemically synthesized
ttatattctaattatttttgta

SEQ ID NO: 1157257 - DNA, 22 bp, Artificial Sequence
  chemically synthesized
cttatattctaattatttttgt

SEQ ID NO: 1157258 - DNA, 22 bp, Artificial Sequence
  chemically synthesized
gagacataaatacaaaaataat

SEQ ID NO: 1157259 - DNA, 22 bp, Artificial Sequence
  chemically synthesized
taatggatttcttatattctaa

SEQ ID NO: 1157260 - DNA, 22 bp, Artificial Sequence
  chemically synthesized
attataatggatttcttatatt

SEQ ID NO: 1157261 - DNA, 22 bp, Artificial Sequence
  chemically synthesized
gaatataagaaatccattataa

SEQ ID NO: 1157262 - DNA, 22 bp, Artificial Sequence
  chemically synthesized
aggaatgtatataaatctaatt

SEQ ID NO: 1157263 - DNA, 22 bp, Artificial Sequence
  chemically synthesized
cctcaggaatgtatataaatct

SEQ ID NO: 1157264 - DNA, 22 bp, Artificial Sequence
  chemically synthesized
ctccctcaggaatgtatataaa

SEQ ID NO: 1157265 - DNA, 22 bp, Artificial Sequence
  chemically synthesized
actccctcaggaatgtatataa

SEQ ID NO: 1157266 - DNA, 22 bp, Artificial Sequence
  chemically synthesized
taattagatttatatacattcc

SEQ ID NO: 1157267 - DNA, 22 bp, Artificial Sequence
  chemically synthesized
cttactccctcaggaatgtata

SEQ ID NO: 1157268 - DNA, 22 bp, Artificial Sequence
  chemically synthesized
tccttactccctcaggaatgta

SEQ ID NO: 1157269 - DNA, 22 bp, Artificial Sequence
  chemically synthesized
gatttatatacattcctgaggg

SEQ ID NO: 1157270 - DNA, 22 bp, Artificial Sequence
  chemically synthesized
tatcctctccttactccctcag

SEQ ID NO: 1157271 - DNA, 22 bp, Artificial Sequence
  chemically synthesized
gtatcctctccttactccctca

SEQ ID NO: 1157272 - DNA, 22 bp, Artificial Sequence
  chemically synthesized
atatacattcctgagggagtaa

SEQ ID NO: 1157273 - DNA, 22 bp, Artificial Sequence
  chemically synthesized
tatacattcctgagggagtaag

SEQ ID NO: 1157274 - DNA, 22 bp, Artificial Sequence
  chemically synthesized
ctgagggagtaaggagaggata

SEQ ID NO: 1157275 - DNA, 22 bp, Artificial Sequence
  chemically synthesized
caggtcaatttgtatcctctcc

SEQ ID NO: 1157276 - DNA, 22 bp, Artificial Sequence
  chemically synthesized
agggagtaaggagaggatacaa

SEQ ID NO: 1157277 - DNA, 22 bp, Artificial Sequence
  chemically synthesized
ccaatgactgcaggtcaatttg

SEQ ID NO: 1157278 - DNA, 22 bp, Artificial Sequence
  chemically synthesized
ttcccaatgactgcaggtcaat

SEQ ID NO: 1157279 - DNA, 22 bp, Artificial Sequence
  chemically synthesized
cgaggacactgttcccaatgac

SEQ ID NO: 1157280 - DNA, 22 bp, Artificial Sequence
  chemically synthesized
tgcgaggacactgttcccaatg

SEQ ID NO: 1157281 - DNA, 22 bp, Artificial Sequence
  chemically synthesized
acctgcagtcattgggaacagt

SEQ ID NO: 1157282 - DNA, 22 bp, Artificial Sequence
  chemically synthesized
tgtgttctgcgaggacactgtt

SEQ ID NO: 1157283 - DNA, 22 bp, Artificial Sequence
  chemically synthesized
cagtcattgggaacagtgtcct

SEQ ID NO: 1157284 - DNA, 22 bp, Artificial Sequence
  chemically synthesized
ggctgtgtgttctgcgaggaca

SEQ ID NO: 1157285 - DNA, 22 bp, Artificial Sequence
  chemically synthesized
aggctgtgtgttctgcgaggac

SEQ ID NO: 1157286 - DNA, 22 bp, Artificial Sequence
  chemically synthesized
ttaggctgtgtgttctgcgagg

SEQ ID NO: 1157287 - DNA, 22 bp, Artificial Sequence
  chemically synthesized
ggaacagtgtcctcgcagaaca

SEQ ID NO: 1157288 - DNA, 22 bp, Artificial Sequence
  chemically synthesized
aactcttaggctgtgtgttctg

SEQ ID NO: 1157289 - DNA, 22 bp, Artificial Sequence
  chemically synthesized
aagtctcaactcttaggctgtg

SEQ ID NO: 1157290 - DNA, 22 bp, Artificial Sequence
  chemically synthesized
caagtctcaactcttaggctgt

SEQ ID NO: 1157291 - DNA, 22 bp, Artificial Sequence
  chemically synthesized
tcaagtctcaactcttaggctg

SEQ ID NO: 1157292 - DNA, 22 bp, Artificial Sequence
  chemically synthesized
ttcaagtctcaactcttaggct

SEQ ID NO: 1157293 - DNA, 22 bp, Artificial Sequence
  chemically synthesized
gcagaacacacagcctaagagt

SEQ ID NO: 1157294 - DNA, 22 bp, Artificial Sequence
  chemically synthesized
atgaatgaatttttcaagtctc

SEQ ID NO: 1157295 - DNA, 22 bp, Artificial Sequence
  chemically synthesized
agagttgagacttgaaaaattc

SEQ ID NO: 1157296 - DNA, 22 bp, Artificial Sequence
  chemically synthesized
gtaaattaatgaatgaattttt

SEQ ID NO: 1157297 - DNA, 22 bp, Artificial Sequence
  chemically synthesized
cgtaaattaatgaatgaatttt

SEQ ID NO: 1157298 - DNA, 22 bp, Artificial Sequence
  chemically synthesized
agacttgaaaaattcattcatt

SEQ ID NO: 1157299 - DNA, 22 bp, Artificial Sequence
  chemically synthesized
tatatttcgtaaattaatgaat

SEQ ID NO: 1157300 - DNA, 22 bp, Artificial Sequence
  chemically synthesized
gaaaaattcattcattaattta

SEQ ID NO: 1157301 - DNA, 22 bp, Artificial Sequence
  chemically synthesized
aaaaattcattcattaatttac

SEQ ID NO: 1157302 - DNA, 22 bp, Artificial Sequence
  chemically synthesized
aataattgtatatttcgtaaat

SEQ ID NO: 1157303 - DNA, 22 bp, Artificial Sequence
  chemically synthesized
attcattaatttacgaaatata

SEQ ID NO: 1157304 - DNA, 22 bp, Artificial Sequence
  chemically synthesized
attaatttacgaaatatacaat

SEQ ID NO: 1157305 - DNA, 22 bp, Artificial Sequence
  chemically synthesized
atttacgaaatatacaattatt

SEQ ID NO: 1157306 - DNA, 22 bp, Artificial Sequence
  chemically synthesized
acgaaatatacaattattgagt

SEQ ID NO: 1157307 - DNA, 22 bp, Artificial Sequence
  chemically synthesized
cgaaatatacaattattgagta

SEQ ID NO: 1157308 - DNA, 22 bp, Artificial Sequence
  chemically synthesized
catccgtagtatccaggtactc

SEQ ID NO: 1157309 - DNA, 22 bp, Artificial Sequence
  chemically synthesized
tccatccgtagtatccaggtac

SEQ ID NO: 1157310 - DNA, 22 bp, Artificial Sequence
  chemically synthesized
cctctccatccgtagtatccag

SEQ ID NO: 1157311 - DNA, 22 bp, Artificial Sequence
  chemically synthesized
gcctctccatccgtagtatcca

SEQ ID NO: 1157312 - DNA, 22 bp, Artificial Sequence
  chemically synthesized
ttgagtacctggatactacgga

SEQ ID NO: 1157313 - DNA, 22 bp, Artificial Sequence
  chemically synthesized
cttgcctctccatccgtagtat

SEQ ID NO: 1157314 - DNA, 22 bp, Artificial Sequence
  chemically synthesized
ccttgcctctccatccgtagta

SEQ ID NO: 1157315 - DNA, 22 bp, Artificial Sequence
  chemically synthesized
agtacctggatactacggatgg

SEQ ID NO: 1157316 - DNA, 22 bp, Artificial Sequence
  chemically synthesized
gtcttccttgcctctccatccg

SEQ ID NO: 1157317 - DNA, 22 bp, Artificial Sequence
  chemically synthesized
gatactacggatggagaggcaa

SEQ ID NO: 1157318 - DNA, 22 bp, Artificial Sequence
  chemically synthesized
tgttggtcttccttgcctctcc

SEQ ID NO: 1157319 - DNA, 22 bp, Artificial Sequence
  chemically synthesized
cggatggagaggcaaggaagac

SEQ ID NO: 1157320 - DNA, 22 bp, Artificial Sequence
  chemically synthesized
caagatagcaaggggctgtgtt

SEQ ID NO: 1157321 - DNA, 22 bp, Artificial Sequence
  chemically synthesized
acccgccatccatataaactcc

SEQ ID NO: 1157322 - DNA, 22 bp, Artificial Sequence
  chemically synthesized
gctatcttggagtttatatgga

SEQ ID NO: 1157323 - DNA, 22 bp, Artificial Sequence
  chemically synthesized
ctatcttggagtttatatggat

SEQ ID NO: 1157324 - DNA, 22 bp, Artificial Sequence
  chemically synthesized
tcttggagtttatatggatggc

SEQ ID NO: 1157325 - DNA, 22 bp, Artificial Sequence
  chemically synthesized
tggccctcacccgccatccata

SEQ ID NO: 1157326 - DNA, 22 bp, Artificial Sequence
  chemically synthesized
ggagtttatatggatggcgggt

SEQ ID NO: 1157327 - DNA, 22 bp, Artificial Sequence
  chemically synthesized
tctgtggccctcacccgccatc

SEQ ID NO: 1157328 - DNA, 22 bp, Artificial Sequence
  chemically synthesized
gagtttatatggatggcgggtg

SEQ ID NO: 1157329 - DNA, 22 bp, Artificial Sequence
  chemically synthesized
atatggatggcgggtgagggcc

SEQ ID NO: 1157330 - DNA, 22 bp, Artificial Sequence
  chemically synthesized
tatggatggcgggtgagggcca

SEQ ID NO: 1157331 - DNA, 22 bp, Artificial Sequence
  chemically synthesized
tatgtattatctgtggccctca

SEQ ID NO: 1157332 - DNA, 22 bp, Artificial Sequence
  chemically synthesized
agctatatgtattatctgtggc

SEQ ID NO: 1157333 - DNA, 22 bp, Artificial Sequence
  chemically synthesized
ttgagctatatgtattatctgt

SEQ ID NO: 1157334 - DNA, 22 bp, Artificial Sequence
  chemically synthesized
atggcctgttgagctatatgta

SEQ ID NO: 1157335 - DNA, 22 bp, Artificial Sequence
  chemically synthesized
taaccaactaatggcctgttga

SEQ ID NO: 1157336 - DNA, 22 bp, Artificial Sequence
  chemically synthesized
aacaggccattagttggttata

SEQ ID NO: 1157337 - DNA, 22 bp, Artificial Sequence
  chemically synthesized
atagtatgatcacattataacc

SEQ ID NO: 1157338 - DNA, 22 bp, Artificial Sequence
  chemically synthesized
catagtatgatcacattataac

SEQ ID NO: 1157339 - DNA, 22 bp, Artificial Sequence
  chemically synthesized
atttcatagtatgatcacatta

SEQ ID NO: 1157340 - DNA, 22 bp, Artificial Sequence
  chemically synthesized
tcatttcatagtatgatcacat

SEQ ID NO: 1157341 - DNA, 22 bp, Artificial Sequence
  chemically synthesized
gttggttataatgtgatcatac

SEQ ID NO: 1157342 - DNA, 22 bp, Artificial Sequence
  chemically synthesized
ctctcatttcatagtatgatca

SEQ ID NO: 1157343 - DNA, 22 bp, Artificial Sequence
  chemically synthesized
gttataatgtgatcatactatg

SEQ ID NO: 1157344 - DNA, 22 bp, Artificial Sequence
  chemically synthesized
aattgctctcatttcatagtat

SEQ ID NO: 1157345 - DNA, 22 bp, Artificial Sequence
  chemically synthesized
taatgtgatcatactatgaaat

SEQ ID NO: 1157346 - DNA, 22 bp, Artificial Sequence
  chemically synthesized
aattcaattgctctcatttcat

SEQ ID NO: 1157347 - DNA, 22 bp, Artificial Sequence
  chemically synthesized
cagactcaattcaattgctctc

SEQ ID NO: 1157348 - DNA, 22 bp, Artificial Sequence
  chemically synthesized
acagactcaattcaattgctct

SEQ ID NO: 1157349 - DNA, 22 bp, Artificial Sequence
  chemically synthesized
tacagactcaattcaattgctc

SEQ ID NO: 1157350 - DNA, 22 bp, Artificial Sequence
  chemically synthesized
tgaaatgagagcaattgaattg

SEQ ID NO: 1157351 - DNA, 22 bp, Artificial Sequence
  chemically synthesized
aaggcccccctttacagactca

SEQ ID NO: 1157352 - DNA, 22 bp, Artificial Sequence
  chemically synthesized
cactaaaggcccccctttacag

SEQ ID NO: 1157353 - DNA, 22 bp, Artificial Sequence
  chemically synthesized
aattgagtctgtaaaggggggc

SEQ ID NO: 1157354 - DNA, 22 bp, Artificial Sequence
  chemically synthesized
agtctgtaaaggggggccttta

SEQ ID NO: 1157355 - DNA, 22 bp, Artificial Sequence
  chemically synthesized
tccagtactgcactaaaggccc

SEQ ID NO: 1157356 - DNA, 22 bp, Artificial Sequence
  chemically synthesized
taaaggggggcctttagtgcag

SEQ ID NO: 1157357 - DNA, 22 bp, Artificial Sequence
  chemically synthesized
acagttgtccagtactgcacta

SEQ ID NO: 1157358 - DNA, 22 bp, Artificial Sequence
  chemically synthesized
cacagttgtccagtactgcact

SEQ ID NO: 1157359 - DNA, 22 bp, Artificial Sequence
  chemically synthesized
agtcttcacagttgtccagtac

SEQ ID NO: 1157360 - DNA, 22 bp, Artificial Sequence
  chemically synthesized
cagtcttcacagttgtccagta

SEQ ID NO: 1157361 - DNA, 22 bp, Artificial Sequence
  chemically synthesized
tagtgcagtactggacaactgt

SEQ ID NO: 1157362 - DNA, 22 bp, Artificial Sequence
  chemically synthesized
acttcagtcttcacagttgtcc

SEQ ID NO: 1157363 - DNA, 22 bp, Artificial Sequence
  chemically synthesized
agtgcagtactggacaactgtg

SEQ ID NO: 1157364 - DNA, 22 bp, Artificial Sequence
  chemically synthesized
gtgcagtactggacaactgtga

SEQ ID NO: 1157365 - DNA, 22 bp, Artificial Sequence
  chemically synthesized
tgacttcagtcttcacagttgt

SEQ ID NO: 1157366 - DNA, 22 bp, Artificial Sequence
  chemically synthesized
ctgacttcagtcttcacagttg

SEQ ID NO: 1157367 - DNA, 22 bp, Artificial Sequence
  chemically synthesized
cttctgacttcagtcttcacag

SEQ ID NO: 1157368 - DNA, 22 bp, Artificial Sequence
  chemically synthesized
actacttctgacttcagtcttc

SEQ ID NO: 1157369 - DNA, 22 bp, Artificial Sequence
  chemically synthesized
cactacttctgacttcagtctt

SEQ ID NO: 1157370 - DNA, 22 bp, Artificial Sequence
  chemically synthesized
tcactacttctgacttcagtct

SEQ ID NO: 1157371 - DNA, 22 bp, Artificial Sequence
  chemically synthesized
gacaactgtgaagactgaagtc

SEQ ID NO: 1157372 - DNA, 22 bp, Artificial Sequence
  chemically synthesized
ttcactacttctgacttcagtc

SEQ ID NO: 1157373 - DNA, 22 bp, Artificial Sequence
  chemically synthesized
tttcactacttctgacttcagt

SEQ ID NO: 1157374 - DNA, 22 bp, Artificial Sequence
  chemically synthesized
tttttcactacttctgacttca

SEQ ID NO: 1157375 - DNA, 22 bp, Artificial Sequence
  chemically synthesized
ctttttcactacttctgacttc

SEQ ID NO: 1157376 - DNA, 22 bp, Artificial Sequence
  chemically synthesized
tgaagactgaagtcagaagtag

SEQ ID NO: 1157377 - DNA, 22 bp, Artificial Sequence
  chemically synthesized
taccttctttttcactacttct

SEQ ID NO: 1157378 - DNA, 22 bp, Artificial Sequence
  chemically synthesized
ataccttctttttcactacttc

SEQ ID NO: 1157379 - DNA, 22 bp, Artificial Sequence
  chemically synthesized
aagtcagaagtagtgaaaaaga

SEQ ID NO: 1157380 - DNA, 22 bp, Artificial Sequence
  chemically synthesized
gaaagagtttataccttctttt

SEQ ID NO: 1157381 - DNA, 22 bp, Artificial Sequence
  chemically synthesized
cgtctagaaagagtttatacct

SEQ ID NO: 1157382 - DNA, 22 bp, Artificial Sequence
  chemically synthesized
ccgtctagaaagagtttatacc

SEQ ID NO: 1157383 - DNA, 22 bp, Artificial Sequence
  chemically synthesized
tccgtctagaaagagtttatac

SEQ ID NO: 1157384 - DNA, 22 bp, Artificial Sequence
  chemically synthesized
tttccgtctagaaagagtttat

SEQ ID NO: 1157385 - DNA, 22 bp, Artificial Sequence
  chemically synthesized
ctttccgtctagaaagagttta

SEQ ID NO: 1157386 - DNA, 22 bp, Artificial Sequence
  chemically synthesized
tctttccgtctagaaagagttt

SEQ ID NO: 1157387 - DNA, 22 bp, Artificial Sequence
  chemically synthesized
acaggtctttctttccgtctag

SEQ ID NO: 1157388 - DNA, 22 bp, Artificial Sequence
  chemically synthesized
cacaggtctttctttccgtcta

SEQ ID NO: 1157389 - DNA, 22 bp, Artificial Sequence
  chemically synthesized
tcacaggtctttctttccgtct

SEQ ID NO: 1157390 - DNA, 22 bp, Artificial Sequence
  chemically synthesized
tttctagacggaaagaaagacc

SEQ ID NO: 1157391 - DNA, 22 bp, Artificial Sequence
  chemically synthesized
tctagacggaaagaaagacctg

SEQ ID NO: 1157392 - DNA, 22 bp, Artificial Sequence
  chemically synthesized
ctagacggaaagaaagacctgt

SEQ ID NO: 1157393 - DNA, 22 bp, Artificial Sequence
  chemically synthesized
tagacggaaagaaagacctgtg

SEQ ID NO: 1157394 - DNA, 22 bp, Artificial Sequence
  chemically synthesized
gacggaaagaaagacctgtgaa

SEQ ID NO: 1157395 - DNA, 22 bp, Artificial Sequence
  chemically synthesized
tgatgtgacagggcctttcaca

SEQ ID NO: 1157396 - DNA, 22 bp, Artificial Sequence
  chemically synthesized
tgtgatgtgacagggcctttca

SEQ ID NO: 1157397 - DNA, 22 bp, Artificial Sequence
  chemically synthesized
ctctgtgatgtgacagggcctt

SEQ ID NO: 1157398 - DNA, 22 bp, Artificial Sequence
  chemically synthesized
cggttcctctgtgatgtgacag

SEQ ID NO: 1157399 - DNA, 22 bp, Artificial Sequence
  chemically synthesized
ccggttcctctgtgatgtgaca

SEQ ID NO: 1157400 - DNA, 22 bp, Artificial Sequence
  chemically synthesized
tgaaaggccctgtcacatcaca

SEQ ID NO: 1157401 - DNA, 22 bp, Artificial Sequence
  chemically synthesized
gatttccggttcctctgtgatg

SEQ ID NO: 1157402 - DNA, 22 bp, Artificial Sequence
  chemically synthesized
cactggatttccggttcctctg

SEQ ID NO: 1157403 - DNA, 22 bp, Artificial Sequence
  chemically synthesized
tcacatcacagaggaaccggaa

SEQ ID NO: 1157404 - DNA, 22 bp, Artificial Sequence
  chemically synthesized
tgcgatcaagctgcactggatt

SEQ ID NO: 1157405 - DNA, 22 bp, Artificial Sequence
  chemically synthesized
gtgcgatcaagctgcactggat

SEQ ID NO: 1157406 - DNA, 22 bp, Artificial Sequence
  chemically synthesized
caccttgtgcgatcaagctgca

SEQ ID NO: 1157407 - DNA, 22 bp, Artificial Sequence
  chemically synthesized
tacaaccatcctgcaccttgtg

SEQ ID NO: 1157408 - DNA, 22 bp, Artificial Sequence
  chemically synthesized
gatcgcacaaggtgcaggatgg

SEQ ID NO: 1157409 - DNA, 22 bp, Artificial Sequence
  chemically synthesized
atcgcacaaggtgcaggatggt

SEQ ID NO: 1157410 - DNA, 22 bp, Artificial Sequence
  chemically synthesized
tgatactgtacaaccatcctgc

SEQ ID NO: 1157411 - DNA, 22 bp, Artificial Sequence
  chemically synthesized
aggtaggctatgatactgtaca

SEQ ID NO: 1157412 - DNA, 22 bp, Artificial Sequence
  chemically synthesized
tacagtatcatagcctacctta

SEQ ID NO: 1157413 - DNA, 22 bp, Artificial Sequence
  chemically synthesized
tggacccacagattaaggtagg

SEQ ID NO: 1157414 - DNA, 22 bp, Artificial Sequence
  chemically synthesized
tgtggacccacagattaaggta

SEQ ID NO: 1157415 - DNA, 22 bp, Artificial Sequence
  chemically synthesized
aagaaatctctgtggacccaca

SEQ ID NO: 1157416 - DNA, 22 bp, Artificial Sequence
  chemically synthesized
ccttaatctgtgggtccacaga

SEQ ID NO: 1157417 - DNA, 22 bp, Artificial Sequence
  chemically synthesized
aatctgtgggtccacagagatt

SEQ ID NO: 1157418 - DNA, 22 bp, Artificial Sequence
  chemically synthesized
atctgtgggtccacagagattt

SEQ ID NO: 1157419 - DNA, 22 bp, Artificial Sequence
  chemically synthesized
gggcagagctcaagaaatctct

SEQ ID NO: 1157420 - DNA, 22 bp, Artificial Sequence
  chemically synthesized
ggggcagagctcaagaaatctc

SEQ ID NO: 1157421 - DNA, 22 bp, Artificial Sequence
  chemically synthesized
tgggtccacagagatttcttga

SEQ ID NO: 1157422 - DNA, 22 bp, Artificial Sequence
  chemically synthesized
agatttggggcagagctcaaga

SEQ ID NO: 1157423 - DNA, 22 bp, Artificial Sequence
  chemically synthesized
cagatttggggcagagctcaag

SEQ ID NO: 1157424 - DNA, 22 bp, Artificial Sequence
  chemically synthesized
aaatttcagatttggggcagag

SEQ ID NO: 1157425 - DNA, 22 bp, Artificial Sequence
  chemically synthesized
cttgagctctgccccaaatctg

SEQ ID NO: 1157426 - DNA, 22 bp, Artificial Sequence
  chemically synthesized
ttgagctctgccccaaatctga

SEQ ID NO: 1157427 - DNA, 22 bp, Artificial Sequence
  chemically synthesized
ggtgttcaaatttcagatttgg

SEQ ID NO: 1157428 - DNA, 22 bp, Artificial Sequence
  chemically synthesized
gagctctgccccaaatctgaaa

SEQ ID NO: 1157429 - DNA, 22 bp, Artificial Sequence
  chemically synthesized
agctctgccccaaatctgaaat

SEQ ID NO: 1157430 - DNA, 22 bp, Artificial Sequence
  chemically synthesized
ctgggtgttcaaatttcagatt

SEQ ID NO: 1157431 - DNA, 22 bp, Artificial Sequence
  chemically synthesized
tgccccaaatctgaaatttgaa

SEQ ID NO: 1157432 - DNA, 22 bp, Artificial Sequence
  chemically synthesized
ccccaaatctgaaatttgaaca

SEQ ID NO: 1157433 - DNA, 22 bp, Artificial Sequence
  chemically synthesized
aaatttgaacacccagtaatct

SEQ ID NO: 1157434 - DNA, 22 bp, Artificial Sequence
  chemically synthesized
gaacacccagtaatctttcatg

SEQ ID NO: 1157435 - DNA, 22 bp, Artificial Sequence
  chemically synthesized
aacacccagtaatctttcatgt

SEQ ID NO: 1157436 - DNA, 22 bp, Artificial Sequence
  chemically synthesized
taaaatgaaaccacgatagaac

SEQ ID NO: 1157437 - DNA, 22 bp, Artificial Sequence
  chemically synthesized
gtaaaatgaaaccacgatagaa

SEQ ID NO: 1157438 - DNA, 22 bp, Artificial Sequence
  chemically synthesized
tcatgttctatcgtggtttcat

SEQ ID NO: 1157439 - DNA, 22 bp, Artificial Sequence
  chemically synthesized
catgttctatcgtggtttcatt

SEQ ID NO: 1157440 - DNA, 22 bp, Artificial Sequence
  chemically synthesized
atgttctatcgtggtttcattt

SEQ ID NO: 1157441 - DNA, 22 bp, Artificial Sequence
  chemically synthesized
agtccaagtttgtaaaatgaaa

SEQ ID NO: 1157442 - DNA, 22 bp, Artificial Sequence
  chemically synthesized
tgagtccaagtttgtaaaatga

SEQ ID NO: 1157443 - DNA, 22 bp, Artificial Sequence
  chemically synthesized
tatcgtggtttcattttacaaa

SEQ ID NO: 1157444 - DNA, 22 bp, Artificial Sequence
  chemically synthesized
tcgtggtttcattttacaaact

SEQ ID NO: 1157445 - DNA, 22 bp, Artificial Sequence
  chemically synthesized
gtcaatctctgagtccaagttt

SEQ ID NO: 1157446 - DNA, 22 bp, Artificial Sequence
  chemically synthesized
ttggtcaatctctgagtccaag

SEQ ID NO: 1157447 - DNA, 22 bp, Artificial Sequence
  chemically synthesized
cattttacaaacttggactcag

SEQ ID NO: 1157448 - DNA, 22 bp, Artificial Sequence
  chemically synthesized
attggtcaatctctgagtccaa

SEQ ID NO: 1157449 - DNA, 22 bp, Artificial Sequence
  chemically synthesized
attttacaaacttggactcaga

SEQ ID NO: 1157450 - DNA, 22 bp, Artificial Sequence
  chemically synthesized
ttattggtcaatctctgagtcc

SEQ ID NO: 1157451 - DNA, 22 bp, Artificial Sequence
  chemically synthesized
cttattggtcaatctctgagtc

SEQ ID NO: 1157452 - DNA, 22 bp, Artificial Sequence
  chemically synthesized
tacaaacttggactcagagatt

SEQ ID NO: 1157453 - DNA, 22 bp, Artificial Sequence
  chemically synthesized
ttcttattggtcaatctctgag

SEQ ID NO: 1157454 - DNA, 22 bp, Artificial Sequence
  chemically synthesized
acaaacttggactcagagattg

SEQ ID NO: 1157455 - DNA, 22 bp, Artificial Sequence
  chemically synthesized
caaacttggactcagagattga

SEQ ID NO: 1157456 - DNA, 22 bp, Artificial Sequence
  chemically synthesized
ggactcagagattgaccaataa

SEQ ID NO: 1157457 - DNA, 22 bp, Artificial Sequence
  chemically synthesized
gactcagagattgaccaataag

SEQ ID NO: 1157458 - DNA, 22 bp, Artificial Sequence
  chemically synthesized
tgtgtacatctcttcttattgg

SEQ ID NO: 1157459 - DNA, 22 bp, Artificial Sequence
  chemically synthesized
atgtgtacatctcttcttattg

SEQ ID NO: 1157460 - DNA, 22 bp, Artificial Sequence
  chemically synthesized
agagattgaccaataagaagag

SEQ ID NO: 1157461 - DNA, 22 bp, Artificial Sequence
  chemically synthesized
accaataagaagagatgtacac

SEQ ID NO: 1157462 - DNA, 22 bp, Artificial Sequence
  chemically synthesized
agagaaaaaaaaaaaaagaaga

SEQ ID NO: 1157463 - DNA, 22 bp, Artificial Sequence
  chemically synthesized
ttaagagaaaaaaaaaaaaaga

SEQ ID NO: 1157464 - DNA, 22 bp, Artificial Sequence
  chemically synthesized
tattaagagaaaaaaaaaaaaa

SEQ ID NO: 1157465 - DNA, 22 bp, Artificial Sequence
  chemically synthesized
tctctattaagagaaaaaaaaa

SEQ ID NO: 1157466 - DNA, 22 bp, Artificial Sequence
  chemically synthesized
tatcttctttttttttttttct

SEQ ID NO: 1157467 - DNA, 22 bp, Artificial Sequence
  chemically synthesized
gtctctattaagagaaaaaaaa

SEQ ID NO: 1157468 - DNA, 22 bp, Artificial Sequence
  chemically synthesized
atcttctttttttttttttctc

SEQ ID NO: 1157469 - DNA, 22 bp, Artificial Sequence
  chemically synthesized
tcttctttttttttttttctct

SEQ ID NO: 1157470 - DNA, 22 bp, Artificial Sequence
  chemically synthesized
ctttttttttttttctcttaat

SEQ ID NO: 1157471 - DNA, 22 bp, Artificial Sequence
  chemically synthesized
tttttttttttttctcttaata

SEQ ID NO: 1157472 - DNA, 22 bp, Artificial Sequence
  chemically synthesized
tttttttttttctcttaataga

SEQ ID NO: 1157473 - DNA, 22 bp, Artificial Sequence
  chemically synthesized
ttttttttttctcttaatagag

SEQ ID NO: 1157474 - DNA, 22 bp, Artificial Sequence
  chemically synthesized
tttttttttctcttaatagaga

SEQ ID NO: 1157475 - DNA, 22 bp, Artificial Sequence
  chemically synthesized
ttttttttctcttaatagagac

SEQ ID NO: 1157476 - DNA, 22 bp, Artificial Sequence
  chemically synthesized
tttttttctcttaatagagaca

SEQ ID NO: 1157477 - DNA, 22 bp, Artificial Sequence
  chemically synthesized
ttttttctcttaatagagacaa

SEQ ID NO: 1157478 - DNA, 22 bp, Artificial Sequence
  chemically synthesized
tttttctcttaatagagacaag

SEQ ID NO: 1157479 - DNA, 22 bp, Artificial Sequence
  chemically synthesized
ttttctcttaatagagacaagg

SEQ ID NO: 1157480 - DNA, 22 bp, Artificial Sequence
  chemically synthesized
tttctcttaatagagacaaggt

SEQ ID NO: 1157481 - DNA, 22 bp, Artificial Sequence
  chemically synthesized
ttctcttaatagagacaaggtc

SEQ ID NO: 1157482 - DNA, 22 bp, Artificial Sequence
  chemically synthesized
tctcttaatagagacaaggtct

SEQ ID NO: 1157483 - DNA, 22 bp, Artificial Sequence
  chemically synthesized
ggcaacataatgagaccttgtc

SEQ ID NO: 1157484 - DNA, 22 bp, Artificial Sequence
  chemically synthesized
ctcttaatagagacaaggtctc

SEQ ID NO: 1157485 - DNA, 22 bp, Artificial Sequence
  chemically synthesized
tcttaatagagacaaggtctca

SEQ ID NO: 1157486 - DNA, 22 bp, Artificial Sequence
  chemically synthesized
ttaatagagacaaggtctcatt

SEQ ID NO: 1157487 - DNA, 22 bp, Artificial Sequence
  chemically synthesized
aatagagacaaggtctcattat

SEQ ID NO: 1157488 - DNA, 22 bp, Artificial Sequence
  chemically synthesized
atagagacaaggtctcattatg

SEQ ID NO: 1157489 - DNA, 22 bp, Artificial Sequence
  chemically synthesized
aagaccagcctgggcaacataa

SEQ ID NO: 1157490 - DNA, 22 bp, Artificial Sequence
  chemically synthesized
aggagttgaagaccagcctggg

SEQ ID NO: 1157491 - DNA, 22 bp, Artificial Sequence
  chemically synthesized
attatgttgcccaggctggtct

SEQ ID NO: 1157492 - DNA, 22 bp, Artificial Sequence
  chemically synthesized
agctaaggagttgaagaccagc

SEQ ID NO: 1157493 - DNA, 22 bp, Artificial Sequence
  chemically synthesized
gagctaaggagttgaagaccag

SEQ ID NO: 1157494 - DNA, 22 bp, Artificial Sequence
  chemically synthesized
tgttgcccaggctggtcttcaa

SEQ ID NO: 1157495 - DNA, 22 bp, Artificial Sequence
  chemically synthesized
cttgagctaaggagttgaagac

SEQ ID NO: 1157496 - DNA, 22 bp, Artificial Sequence
  chemically synthesized
cccaggctggtcttcaactcct

SEQ ID NO: 1157497 - DNA, 22 bp, Artificial Sequence
  chemically synthesized
gtcttcaactccttagctcaag

SEQ ID NO: 1157498 - DNA, 22 bp, Artificial Sequence
  chemically synthesized
caactccttagctcaagcaatc

SEQ ID NO: 1157499 - DNA, 22 bp, Artificial Sequence
  chemically synthesized
aactccttagctcaagcaatcc

SEQ ID NO: 1157500 - DNA, 22 bp, Artificial Sequence
  chemically synthesized
ggaggccaaggggagaggattg

SEQ ID NO: 1157501 - DNA, 22 bp, Artificial Sequence
  chemically synthesized
cttagctcaagcaatcctctcc

SEQ ID NO: 1157502 - DNA, 22 bp, Artificial Sequence
  chemically synthesized
gggaggccaaggggagaggatt

SEQ ID NO: 1157503 - DNA, 22 bp, Artificial Sequence
  chemically synthesized
tgggaggccaaggggagaggat

SEQ ID NO: 1157504 - DNA, 22 bp, Artificial Sequence
  chemically synthesized
ttgggaggccaaggggagagga

SEQ ID NO: 1157505 - DNA, 22 bp, Artificial Sequence
  chemically synthesized
agctcaagcaatcctctcccct

SEQ ID NO: 1157506 - DNA, 22 bp, Artificial Sequence
  chemically synthesized
gctcaagcaatcctctcccctt

SEQ ID NO: 1157507 - DNA, 22 bp, Artificial Sequence
  chemically synthesized
aagcaatcctctccccttggcc

SEQ ID NO: 1157508 - DNA, 22 bp, Artificial Sequence
  chemically synthesized
taatcccagcacttttgggagg

SEQ ID NO: 1157509 - DNA, 22 bp, Artificial Sequence
  chemically synthesized
tccccttggcctcccaaaagtg

SEQ ID NO: 1157510 - DNA, 22 bp, Artificial Sequence
  chemically synthesized
cccttggcctcccaaaagtgct

SEQ ID NO: 1157511 - DNA, 22 bp, Artificial Sequence
  chemically synthesized
gcgcctataatcccagcacttt

SEQ ID NO: 1157512 - DNA, 22 bp, Artificial Sequence
  chemically synthesized
ggcctcccaaaagtgctgggat

SEQ ID NO: 1157513 - DNA, 22 bp, Artificial Sequence
  chemically synthesized
gcctcccaaaagtgctgggatt

SEQ ID NO: 1157514 - DNA, 22 bp, Artificial Sequence
  chemically synthesized
ggggactcgcgcctataatccc

SEQ ID NO: 1157515 - DNA, 22 bp, Artificial Sequence
  chemically synthesized
ccaaaagtgctgggattatagg

SEQ ID NO: 1157516 - DNA, 22 bp, Artificial Sequence
  chemically synthesized
ggttcggggactcgcgcctata

SEQ ID NO: 1157517 - DNA, 22 bp, Artificial Sequence
  chemically synthesized
gctgggttcggggactcgcgcc

SEQ ID NO: 1157518 - DNA, 22 bp, Artificial Sequence
  chemically synthesized
ggattataggcgcgagtccccg

SEQ ID NO: 1157519 - DNA, 22 bp, Artificial Sequence
  chemically synthesized
taggcgcgagtccccgaaccca

SEQ ID NO: 1157520 - DNA, 22 bp, Artificial Sequence
  chemically synthesized
taaagagaaaacacctggctgg

SEQ ID NO: 1157521 - DNA, 22 bp, Artificial Sequence
  chemically synthesized
ataaagagaaaacacctggctg

SEQ ID NO: 1157522 - DNA, 22 bp, Artificial Sequence
  chemically synthesized
tatcccacttataaagagaaaa

SEQ ID NO: 1157523 - DNA, 22 bp, Artificial Sequence
  chemically synthesized
tgtatcccacttataaagagaa

SEQ ID NO: 1157524 - DNA, 22 bp, Artificial Sequence
  chemically synthesized
ctgtatcccacttataaagaga

SEQ ID NO: 1157525 - DNA, 22 bp, Artificial Sequence
  chemically synthesized
tctctttataagtgggatacag

SEQ ID NO: 1157526 - DNA, 22 bp, Artificial Sequence
  chemically synthesized
ctctttataagtgggatacaga

SEQ ID NO: 1157527 - DNA, 22 bp, Artificial Sequence
  chemically synthesized
tctttataagtgggatacagaa

SEQ ID NO: 1157528 - DNA, 22 bp, Artificial Sequence
  chemically synthesized
tttataagtgggatacagaaac

SEQ ID NO: 1157529 - DNA, 22 bp, Artificial Sequence
  chemically synthesized
tataagtgggatacagaaacat

SEQ ID NO: 1157530 - DNA, 22 bp, Artificial Sequence
  chemically synthesized
ataagtgggatacagaaacatc

SEQ ID NO: 1157531 - DNA, 22 bp, Artificial Sequence
  chemically synthesized
taagtgggatacagaaacatct

SEQ ID NO: 1157532 - DNA, 22 bp, Artificial Sequence
  chemically synthesized
ccccaaaaatccccaaccagat

SEQ ID NO: 1157533 - DNA, 22 bp, Artificial Sequence
  chemically synthesized
gtccctaccccaaaaatcccca

SEQ ID NO: 1157534 - DNA, 22 bp, Artificial Sequence
  chemically synthesized
tggtccctaccccaaaaatccc

SEQ ID NO: 1157535 - DNA, 22 bp, Artificial Sequence
  chemically synthesized
gttggggatttttggggtaggg

SEQ ID NO: 1157536 - DNA, 22 bp, Artificial Sequence
  chemically synthesized
gggatttttggggtagggacca

SEQ ID NO: 1157537 - DNA, 22 bp, Artificial Sequence
  chemically synthesized
cacacacccagccattctggtc

SEQ ID NO: 1157538 - DNA, 22 bp, Artificial Sequence
  chemically synthesized
gcacacacccagccattctggt

SEQ ID NO: 1157539 - DNA, 22 bp, Artificial Sequence
  chemically synthesized
ttggggtagggaccagaatggc

SEQ ID NO: 1157540 - DNA, 22 bp, Artificial Sequence
  chemically synthesized
tggggtagggaccagaatggct

SEQ ID NO: 1157541 - DNA, 22 bp, Artificial Sequence
  chemically synthesized
ggggtagggaccagaatggctg

SEQ ID NO: 1157542 - DNA, 22 bp, Artificial Sequence
  chemically synthesized
gggtagggaccagaatggctgg

SEQ ID NO: 1157543 - DNA, 22 bp, Artificial Sequence
  chemically synthesized
agccatcccgtttgcacacacc

SEQ ID NO: 1157544 - DNA, 22 bp, Artificial Sequence
  chemically synthesized
aaatattgagccatcccgtttg

SEQ ID NO: 1157545 - DNA, 22 bp, Artificial Sequence
  chemically synthesized
ggtgtgtgcaaacgggatggct

SEQ ID NO: 1157546 - DNA, 22 bp, Artificial Sequence
  chemically synthesized
taccagtcattaaaatattgag

SEQ ID NO: 1157547 - DNA, 22 bp, Artificial Sequence
  chemically synthesized
atgtgactgtaccagtcattaa

SEQ ID NO: 1157548 - DNA, 22 bp, Artificial Sequence
  chemically synthesized
aatattttaatgactggtacag

SEQ ID NO: 1157549 - DNA, 22 bp, Artificial Sequence
  chemically synthesized
ggagacattgatgtgactgtac

SEQ ID NO: 1157550 - DNA, 22 bp, Artificial Sequence
  chemically synthesized
taatgactggtacagtcacatc

SEQ ID NO: 1157551 - DNA, 22 bp, Artificial Sequence
  chemically synthesized
aatgactggtacagtcacatca

SEQ ID NO: 1157552 - DNA, 22 bp, Artificial Sequence
  chemically synthesized
gctgggagacattgatgtgact

SEQ ID NO: 1157553 - DNA, 22 bp, Artificial Sequence
  chemically synthesized
atgactggtacagtcacatcaa

SEQ ID NO: 1157554 - DNA, 22 bp, Artificial Sequence
  chemically synthesized
ggctgggagacattgatgtgac

SEQ ID NO: 1157555 - DNA, 22 bp, Artificial Sequence
  chemically synthesized
tttggctgggagacattgatgt

SEQ ID NO: 1157556 - DNA, 22 bp, Artificial Sequence
  chemically synthesized
tatttggctgggagacattgat

SEQ ID NO: 1157557 - DNA, 22 bp, Artificial Sequence
  chemically synthesized
gtacagtcacatcaatgtctcc

SEQ ID NO: 1157558 - DNA, 22 bp, Artificial Sequence
  chemically synthesized
ccagccaaatagagccctgctt

SEQ ID NO: 1157559 - DNA, 22 bp, Artificial Sequence
  chemically synthesized
atgaagagagaaaaagcagggc

SEQ ID NO: 1157560 - DNA, 22 bp, Artificial Sequence
  chemically synthesized
agaaccactaatgaagagagaa

SEQ ID NO: 1157561 - DNA, 22 bp, Artificial Sequence
  chemically synthesized
cagaaccactaatgaagagaga

SEQ ID NO: 1157562 - DNA, 22 bp, Artificial Sequence
  chemically synthesized
tcagaaccactaatgaagagag

SEQ ID NO: 1157563 - DNA, 22 bp, Artificial Sequence
  chemically synthesized
ctttttctctcttcattagtgg

SEQ ID NO: 1157564 - DNA, 22 bp, Artificial Sequence
  chemically synthesized
tttctctcttcattagtggttc

SEQ ID NO: 1157565 - DNA, 22 bp, Artificial Sequence
  chemically synthesized
ttctctcttcattagtggttct

SEQ ID NO: 1157566 - DNA, 22 bp, Artificial Sequence
  chemically synthesized
tctctcttcattagtggttctg

SEQ ID NO: 1157567 - DNA, 22 bp, Artificial Sequence
  chemically synthesized
ctctcttcattagtggttctga

SEQ ID NO: 1157568 - DNA, 22 bp, Artificial Sequence
  chemically synthesized
tctcttcattagtggttctgaa

SEQ ID NO: 1157569 - DNA, 22 bp, Artificial Sequence
  chemically synthesized
tcttcattagtggttctgaaag

SEQ ID NO: 1157570 - DNA, 22 bp, Artificial Sequence
  chemically synthesized
ttcattagtggttctgaaagtg

SEQ ID NO: 1157571 - DNA, 22 bp, Artificial Sequence
  chemically synthesized
cattagtggttctgaaagtgtg

SEQ ID NO: 1157572 - DNA, 22 bp, Artificial Sequence
  chemically synthesized
attagtggttctgaaagtgtgg

SEQ ID NO: 1157573 - DNA, 22 bp, Artificial Sequence
  chemically synthesized
gtggttctgaaagtgtggttac

SEQ ID NO: 1157574 - DNA, 22 bp, Artificial Sequence
  chemically synthesized
gtccagggtccagtaaccacac

SEQ ID NO: 1157575 - DNA, 22 bp, Artificial Sequence
  chemically synthesized
ttggtccagggtccagtaacca

SEQ ID NO: 1157576 - DNA, 22 bp, Artificial Sequence
  chemically synthesized
tgaaagtgtggttactggaccc

SEQ ID NO: 1157577 - DNA, 22 bp, Artificial Sequence
  chemically synthesized
aaagtgtggttactggaccctg

SEQ ID NO: 1157578 - DNA, 22 bp, Artificial Sequence
  chemically synthesized
atgctgttggtccagggtccag

SEQ ID NO: 1157579 - DNA, 22 bp, Artificial Sequence
  chemically synthesized
ctggaccctggaccaacagcat

SEQ ID NO: 1157580 - DNA, 22 bp, Artificial Sequence
  chemically synthesized
ggggatgggctgatgctgttgg

SEQ ID NO: 1157581 - DNA, 22 bp, Artificial Sequence
  chemically synthesized
taggggatgggctgatgctgtt

SEQ ID NO: 1157582 - DNA, 22 bp, Artificial Sequence
  chemically synthesized
gaccctggaccaacagcatcag

SEQ ID NO: 1157583 - DNA, 22 bp, Artificial Sequence
  chemically synthesized
ctaggggatgggctgatgctgt

SEQ ID NO: 1157584 - DNA, 22 bp, Artificial Sequence
  chemically synthesized
gaccaacagcatcagcccatcc

SEQ ID NO: 1157585 - DNA, 22 bp, Artificial Sequence
  chemically synthesized
gcaagtttctaggggatgggct

SEQ ID NO: 1157586 - DNA, 22 bp, Artificial Sequence
  chemically synthesized
tagcaagtttctaggggatggg

SEQ ID NO: 1157587 - DNA, 22 bp, Artificial Sequence
  chemically synthesized
ctagcaagtttctaggggatgg

SEQ ID NO: 1157588 - DNA, 22 bp, Artificial Sequence
  chemically synthesized
cacttctagcaagtttctaggg

SEQ ID NO: 1157589 - DNA, 22 bp, Artificial Sequence
  chemically synthesized
gcacttctagcaagtttctagg

SEQ ID NO: 1157590 - DNA, 22 bp, Artificial Sequence
  chemically synthesized
aatttgcacttctagcaagttt

SEQ ID NO: 1157591 - DNA, 22 bp, Artificial Sequence
  chemically synthesized
gaatttgcacttctagcaagtt

SEQ ID NO: 1157592 - DNA, 22 bp, Artificial Sequence
  chemically synthesized
tgaatttgcacttctagcaagt

SEQ ID NO: 1157593 - DNA, 22 bp, Artificial Sequence
  chemically synthesized
gcaagttttgaatttgcacttc

SEQ ID NO: 1157594 - DNA, 22 bp, Artificial Sequence
  chemically synthesized
gaaacttgctagaagtgcaaat

SEQ ID NO: 1157595 - DNA, 22 bp, Artificial Sequence
  chemically synthesized
tagcaagttttgaatttgcact

SEQ ID NO: 1157596 - DNA, 22 bp, Artificial Sequence
  chemically synthesized
ctagcaagttttgaatttgcac

SEQ ID NO: 1157597 - DNA, 22 bp, Artificial Sequence
  chemically synthesized
gctagaagtgcaaattcaaaac

SEQ ID NO: 1157598 - DNA, 22 bp, Artificial Sequence
  chemically synthesized
ctagaagtgcaaattcaaaact

SEQ ID NO: 1157599 - DNA, 22 bp, Artificial Sequence
  chemically synthesized
gaagtgcaaattcaaaacttgc

SEQ ID NO: 1157600 - DNA, 22 bp, Artificial Sequence
  chemically synthesized
cacacacttctagcaagttttg

SEQ ID NO: 1157601 - DNA, 22 bp, Artificial Sequence
  chemically synthesized
gcacacacttctagcaagtttt

SEQ ID NO: 1157602 - DNA, 22 bp, Artificial Sequence
  chemically synthesized
aaaacttgctagaagtgtgtgc

SEQ ID NO: 1157603 - DNA, 22 bp, Artificial Sequence
  chemically synthesized
agtaagtgtgagtcttgcacac

SEQ ID NO: 1157604 - DNA, 22 bp, Artificial Sequence
  chemically synthesized
gctagaagtgtgtgcaagactc

SEQ ID NO: 1157605 - DNA, 22 bp, Artificial Sequence
  chemically synthesized
ctagaagtgtgtgcaagactca

SEQ ID NO: 1157606 - DNA, 22 bp, Artificial Sequence
  chemically synthesized
attcagtaagtgtgagtcttgc

SEQ ID NO: 1157607 - DNA, 22 bp, Artificial Sequence
  chemically synthesized
tgattcagtaagtgtgagtctt

SEQ ID NO: 1157608 - DNA, 22 bp, Artificial Sequence
  chemically synthesized
gaagtgtgtgcaagactcacac

SEQ ID NO: 1157609 - DNA, 22 bp, Artificial Sequence
  chemically synthesized
ctgattcagtaagtgtgagtct

SEQ ID NO: 1157610 - DNA, 22 bp, Artificial Sequence
  chemically synthesized
atcccagagtttctgattcagt

SEQ ID NO: 1157611 - DNA, 22 bp, Artificial Sequence
  chemically synthesized
acacttactgaatcagaaactc

SEQ ID NO: 1157612 - DNA, 22 bp, Artificial Sequence
  chemically synthesized
gacctcatcccagagtttctga

SEQ ID NO: 1157613 - DNA, 22 bp, Artificial Sequence
  chemically synthesized
tagacctcatcccagagtttct

SEQ ID NO: 1157614 - DNA, 22 bp, Artificial Sequence
  chemically synthesized
ctagacctcatcccagagtttc

SEQ ID NO: 1157615 - DNA, 22 bp, Artificial Sequence
  chemically synthesized
actgaatcagaaactctgggat

SEQ ID NO: 1157616 - DNA, 22 bp, Artificial Sequence
  chemically synthesized
ctgaatcagaaactctgggatg

SEQ ID NO: 1157617 - DNA, 22 bp, Artificial Sequence
  chemically synthesized
aatcagaaactctgggatgagg

SEQ ID NO: 1157618 - DNA, 22 bp, Artificial Sequence
  chemically synthesized
aaatacacatttctagacctca

SEQ ID NO: 1157619 - DNA, 22 bp, Artificial Sequence
  chemically synthesized
ttaaaatacacatttctagacc

SEQ ID NO: 1157620 - DNA, 22 bp, Artificial Sequence
  chemically synthesized
tgggatgaggtctagaaatgtg

SEQ ID NO: 1157621 - DNA, 22 bp, Artificial Sequence
  chemically synthesized
ggatgaggtctagaaatgtgta

SEQ ID NO: 1157622 - DNA, 22 bp, Artificial Sequence
  chemically synthesized
gaagtcctgttaaaatacacat

SEQ ID NO: 1157623 - DNA, 22 bp, Artificial Sequence
  chemically synthesized
gaaatgtgtattttaacaggac

SEQ ID NO: 1157624 - DNA, 22 bp, Artificial Sequence
  chemically synthesized
taacaggacttccaggtgactg

SEQ ID NO: 1157625 - DNA, 22 bp, Artificial Sequence
  chemically synthesized
aacaggacttccaggtgactga

SEQ ID NO: 1157626 - DNA, 22 bp, Artificial Sequence
  chemically synthesized
acaggacttccaggtgactgat

SEQ ID NO: 1157627 - DNA, 22 bp, Artificial Sequence
  chemically synthesized
aagtgtgagtatgcatcagtca

SEQ ID NO: 1157628 - DNA, 22 bp, Artificial Sequence
  chemically synthesized
caagtgtgagtatgcatcagtc

SEQ ID NO: 1157629 - DNA, 22 bp, Artificial Sequence
  chemically synthesized
tcaagtgtgagtatgcatcagt

SEQ ID NO: 1157630 - DNA, 22 bp, Artificial Sequence
  chemically synthesized
ccaggtgactgatgcatactca

SEQ ID NO: 1157631 - DNA, 22 bp, Artificial Sequence
  chemically synthesized
caggtgactgatgcatactcac

SEQ ID NO: 1157632 - DNA, 22 bp, Artificial Sequence
  chemically synthesized
gagcagtaattttcaagtgtga

SEQ ID NO: 1157633 - DNA, 22 bp, Artificial Sequence
  chemically synthesized
atgcatactcacacttgaaaat

SEQ ID NO: 1157634 - DNA, 22 bp, Artificial Sequence
  chemically synthesized
cctagagcagtaattttcaagt

SEQ ID NO: 1157635 - DNA, 22 bp, Artificial Sequence
  chemically synthesized
acacttgaaaattactgctcta

SEQ ID NO: 1157636 - DNA, 22 bp, Artificial Sequence
  chemically synthesized
tagaataaagttacctagagca

SEQ ID NO: 1157637 - DNA, 22 bp, Artificial Sequence
  chemically synthesized
gtagaataaagttacctagagc

SEQ ID NO: 1157638 - DNA, 22 bp, Artificial Sequence
  chemically synthesized
gaaaattactgctctaggtaac

SEQ ID NO: 1157639 - DNA, 22 bp, Artificial Sequence
  chemically synthesized
aaaattactgctctaggtaact

SEQ ID NO: 1157640 - DNA, 22 bp, Artificial Sequence
  chemically synthesized
tgtttgtagaataaagttacct

SEQ ID NO: 1157641 - DNA, 22 bp, Artificial Sequence
  chemically synthesized
ctgctctaggtaactttattct

SEQ ID NO: 1157642 - DNA, 22 bp, Artificial Sequence
  chemically synthesized
ctctaggtaactttattctaca

SEQ ID NO: 1157643 - DNA, 22 bp, Artificial Sequence
  chemically synthesized
ggtgagttgtgtttgtagaata

SEQ ID NO: 1157644 - DNA, 22 bp, Artificial Sequence
  chemically synthesized
gggtgagttgtgtttgtagaat

SEQ ID NO: 1157645 - DNA, 22 bp, Artificial Sequence
  chemically synthesized
taggtaactttattctacaaac

SEQ ID NO: 1157646 - DNA, 22 bp, Artificial Sequence
  chemically synthesized
ggtaactttattctacaaacac

SEQ ID NO: 1157647 - DNA, 22 bp, Artificial Sequence
  chemically synthesized
cagaatttgggtgagttgtgtt

SEQ ID NO: 1157648 - DNA, 22 bp, Artificial Sequence
  chemically synthesized
tgcagaatttgggtgagttgtg

SEQ ID NO: 1157649 - DNA, 22 bp, Artificial Sequence
  chemically synthesized
tattctacaaacacaactcacc

SEQ ID NO: 1157650 - DNA, 22 bp, Artificial Sequence
  chemically synthesized
attctacaaacacaactcaccc

SEQ ID NO: 1157651 - DNA, 22 bp, Artificial Sequence
  chemically synthesized
ttctacaaacacaactcaccca

SEQ ID NO: 1157652 - DNA, 22 bp, Artificial Sequence
  chemically synthesized
gtctctgcagaatttgggtgag

SEQ ID NO: 1157653 - DNA, 22 bp, Artificial Sequence
  chemically synthesized
tacaaacacaactcacccaaat

SEQ ID NO: 1157654 - DNA, 22 bp, Artificial Sequence
  chemically synthesized
ggtctctgcagaatttgggtga

SEQ ID NO: 1157655 - DNA, 22 bp, Artificial Sequence
  chemically synthesized
caaacacaactcacccaaattc

SEQ ID NO: 1157656 - DNA, 22 bp, Artificial Sequence
  chemically synthesized
atatcttggtctctgcagaatt

SEQ ID NO: 1157657 - DNA, 22 bp, Artificial Sequence
  chemically synthesized
atgttaatatcttggtctctgc

SEQ ID NO: 1157658 - DNA, 22 bp, Artificial Sequence
  chemically synthesized
acccaaattctgcagagaccaa

SEQ ID NO: 1157659 - DNA, 22 bp, Artificial Sequence
  chemically synthesized
ttaatgttaatatcttggtctc

SEQ ID NO: 1157660 - DNA, 22 bp, Artificial Sequence
  chemically synthesized
ctattaatgttaatatcttggt

SEQ ID NO: 1157661 - DNA, 22 bp, Artificial Sequence
  chemically synthesized
tgcagagaccaagatattaaca

SEQ ID NO: 1157662 - DNA, 22 bp, Artificial Sequence
  chemically synthesized
tcctcctattaatgttaatatc

SEQ ID NO: 1157663 - DNA, 22 bp, Artificial Sequence
  chemically synthesized
cagagaccaagatattaacatt

SEQ ID NO: 1157664 - DNA, 22 bp, Artificial Sequence
  chemically synthesized
gcagttgtcctcctattaatgt

SEQ ID NO: 1157665 - DNA, 22 bp, Artificial Sequence
  chemically synthesized
gggattggcagttgtcctccta

SEQ ID NO: 1157666 - DNA, 22 bp, Artificial Sequence
  chemically synthesized
ctggggattggcagttgtcctc

SEQ ID NO: 1157667 - DNA, 22 bp, Artificial Sequence
  chemically synthesized
acattaataggaggacaactgc

SEQ ID NO: 1157668 - DNA, 22 bp, Artificial Sequence
  chemically synthesized
ataggaggacaactgccaatcc

SEQ ID NO: 1157669 - DNA, 22 bp, Artificial Sequence
  chemically synthesized
atagtaatctcctggggattgg

SEQ ID NO: 1157670 - DNA, 22 bp, Artificial Sequence
  chemically synthesized
ccaatccccaggagattactat

SEQ ID NO: 1157671 - DNA, 22 bp, Artificial Sequence
  chemically synthesized
atgtcaaaataattcatagtaa

SEQ ID NO: 1157672 - DNA, 22 bp, Artificial Sequence
  chemically synthesized
ctatgaattattttgacatgag

SEQ ID NO: 1157673 - DNA, 22 bp, Artificial Sequence
  chemically synthesized
tgaattattttgacatgagact

SEQ ID NO: 1157674 - DNA, 22 bp, Artificial Sequence
  chemically synthesized
ttttgacatgagacttttacat

SEQ ID NO: 1157675 - DNA, 22 bp, Artificial Sequence
  chemically synthesized
tgacatgagacttttacattct

SEQ ID NO: 1157676 - DNA, 22 bp, Artificial Sequence
  chemically synthesized
gacatgagacttttacattctc

SEQ ID NO: 1157677 - DNA, 22 bp, Artificial Sequence
  chemically synthesized
acatgagacttttacattctct

SEQ ID NO: 1157678 - DNA, 22 bp, Artificial Sequence
  chemically synthesized
taagtggaggtgaagtcaggaa

SEQ ID NO: 1157679 - DNA, 22 bp, Artificial Sequence
  chemically synthesized
ttacattctcttcctgacttca

SEQ ID NO: 1157680 - DNA, 22 bp, Artificial Sequence
  chemically synthesized
tgtaagtggaggtgaagtcagg

SEQ ID NO: 1157681 - DNA, 22 bp, Artificial Sequence
  chemically synthesized
tacattctcttcctgacttcac

SEQ ID NO: 1157682 - DNA, 22 bp, Artificial Sequence
  chemically synthesized
acattctcttcctgacttcacc

SEQ ID NO: 1157683 - DNA, 22 bp, Artificial Sequence
  chemically synthesized
tctgtaagtggaggtgaagtca

SEQ ID NO: 1157684 - DNA, 22 bp, Artificial Sequence
  chemically synthesized
cattctcttcctgacttcacct

SEQ ID NO: 1157685 - DNA, 22 bp, Artificial Sequence
  chemically synthesized
tctctgtaagtggaggtgaagt

SEQ ID NO: 1157686 - DNA, 22 bp, Artificial Sequence
  chemically synthesized
ctctctgtaagtggaggtgaag

SEQ ID NO: 1157687 - DNA, 22 bp, Artificial Sequence
  chemically synthesized
tcttcctgacttcacctccact

SEQ ID NO: 1157688 - DNA, 22 bp, Artificial Sequence
  chemically synthesized
ttcctgacttcacctccactta

SEQ ID NO: 1157689 - DNA, 22 bp, Artificial Sequence
  chemically synthesized
cctgacttcacctccacttaca

SEQ ID NO: 1157690 - DNA, 22 bp, Artificial Sequence
  chemically synthesized
ctgacttcacctccacttacag

SEQ ID NO: 1157691 - DNA, 22 bp, Artificial Sequence
  chemically synthesized
acttcacctccacttacagaga

SEQ ID NO: 1157692 - DNA, 22 bp, Artificial Sequence
  chemically synthesized
gcagtcacacttctctctgtaa

SEQ ID NO: 1157693 - DNA, 22 bp, Artificial Sequence
  chemically synthesized
cacctccacttacagagagaag

SEQ ID NO: 1157694 - DNA, 22 bp, Artificial Sequence
  chemically synthesized
acctccacttacagagagaagt

SEQ ID NO: 1157695 - DNA, 22 bp, Artificial Sequence
  chemically synthesized
gcagttggcagtcacacttctc

SEQ ID NO: 1157696 - DNA, 22 bp, Artificial Sequence
  chemically synthesized
ggcagttggcagtcacacttct

SEQ ID NO: 1157697 - DNA, 22 bp, Artificial Sequence
  chemically synthesized
cacttacagagagaagtgtgac

SEQ ID NO: 1157698 - DNA, 22 bp, Artificial Sequence
  chemically synthesized
tggcagttggcagtcacacttc

SEQ ID NO: 1157699 - DNA, 22 bp, Artificial Sequence
  chemically synthesized
tttggcagttggcagtcacact

SEQ ID NO: 1157700 - DNA, 22 bp, Artificial Sequence
  chemically synthesized
acagagagaagtgtgactgcca

SEQ ID NO: 1157701 - DNA, 22 bp, Artificial Sequence
  chemically synthesized
cagagagaagtgtgactgccaa

SEQ ID NO: 1157702 - DNA, 22 bp, Artificial Sequence
  chemically synthesized
aggtagaacccattctttggca

SEQ ID NO: 1157703 - DNA, 22 bp, Artificial Sequence
  chemically synthesized
ccaactgccaaagaatgggttc

SEQ ID NO: 1157704 - DNA, 22 bp, Artificial Sequence
  chemically synthesized
gagcctcaggtagaacccattc

SEQ ID NO: 1157705 - DNA, 22 bp, Artificial Sequence
  chemically synthesized
ggagcctcaggtagaacccatt

SEQ ID NO: 1157706 - DNA, 22 bp, Artificial Sequence
  chemically synthesized
tggagcctcaggtagaacccat

SEQ ID NO: 1157707 - DNA, 22 bp, Artificial Sequence
  chemically synthesized
ttggagcctcaggtagaaccca

SEQ ID NO: 1157708 - DNA, 22 bp, Artificial Sequence
  chemically synthesized
tttggagcctcaggtagaaccc

SEQ ID NO: 1157709 - DNA, 22 bp, Artificial Sequence
  chemically synthesized
ccaaagaatgggttctacctga

SEQ ID NO: 1157710 - DNA, 22 bp, Artificial Sequence
  chemically synthesized
ctttttggagcctcaggtagaa

SEQ ID NO: 1157711 - DNA, 22 bp, Artificial Sequence
  chemically synthesized
tacctgaggctccaaaaagcag

SEQ ID NO: 1157712 - DNA, 22 bp, Artificial Sequence
  chemically synthesized
cctgaggctccaaaaagcagga

SEQ ID NO: 1157713 - DNA, 22 bp, Artificial Sequence
  chemically synthesized
agacacatgaaatcctgctttt

SEQ ID NO: 1157714 - DNA, 22 bp, Artificial Sequence
  chemically synthesized
cagacacatgaaatcctgcttt

SEQ ID NO: 1157715 - DNA, 22 bp, Artificial Sequence
  chemically synthesized
aggctccaaaaagcaggatttc

SEQ ID NO: 1157716 - DNA, 22 bp, Artificial Sequence
  chemically synthesized
atgcttcagacacatgaaatcc

SEQ ID NO: 1157717 - DNA, 22 bp, Artificial Sequence
  chemically synthesized
catgcttcagacacatgaaatc

SEQ ID NO: 1157718 - DNA, 22 bp, Artificial Sequence
  chemically synthesized
caaaaagcaggatttcatgtgt

SEQ ID NO: 1157719 - DNA, 22 bp, Artificial Sequence
  chemically synthesized
atttcatgcttcagacacatga

SEQ ID NO: 1157720 - DNA, 22 bp, Artificial Sequence
  chemically synthesized
aggttaatttcatgcttcagac

SEQ ID NO: 1157721 - DNA, 22 bp, Artificial Sequence
  chemically synthesized
tgaggttaatttcatgcttcag

SEQ ID NO: 1157722 - DNA, 22 bp, Artificial Sequence
  chemically synthesized
ttctgaggttaatttcatgctt

SEQ ID NO: 1157723 - DNA, 22 bp, Artificial Sequence
  chemically synthesized
gttctgaggttaatttcatgct

SEQ ID NO: 1157724 - DNA, 22 bp, Artificial Sequence
  chemically synthesized
catgtgtctgaagcatgaaatt

SEQ ID NO: 1157725 - DNA, 22 bp, Artificial Sequence
  chemically synthesized
atgtgtctgaagcatgaaatta

SEQ ID NO: 1157726 - DNA, 22 bp, Artificial Sequence
  chemically synthesized
aaacttgttctgaggttaattt

SEQ ID NO: 1157727 - DNA, 22 bp, Artificial Sequence
  chemically synthesized
caaacttgttctgaggttaatt

SEQ ID NO: 1157728 - DNA, 22 bp, Artificial Sequence
  chemically synthesized
tcaaacttgttctgaggttaat

SEQ ID NO: 1157729 - DNA, 22 bp, Artificial Sequence
  chemically synthesized
aagcatgaaattaacctcagaa

SEQ ID NO: 1157730 - DNA, 22 bp, Artificial Sequence
  chemically synthesized
ttttcaaacttgttctgaggtt

SEQ ID NO: 1157731 - DNA, 22 bp, Artificial Sequence
  chemically synthesized
tgttttcaaacttgttctgagg

SEQ ID NO: 1157732 - DNA, 22 bp, Artificial Sequence
  chemically synthesized
ctgttttcaaacttgttctgag

SEQ ID NO: 1157733 - DNA, 22 bp, Artificial Sequence
  chemically synthesized
ttctgttttcaaacttgttctg

SEQ ID NO: 1157734 - DNA, 22 bp, Artificial Sequence
  chemically synthesized
ggttcttctgttttcaaacttg

SEQ ID NO: 1157735 - DNA, 22 bp, Artificial Sequence
  chemically synthesized
aggttcttctgttttcaaactt

SEQ ID NO: 1157736 - DNA, 22 bp, Artificial Sequence
  chemically synthesized
acctcagaacaagtttgaaaac

SEQ ID NO: 1157737 - DNA, 22 bp, Artificial Sequence
  chemically synthesized
agaacaagtttgaaaacagaag

SEQ ID NO: 1157738 - DNA, 22 bp, Artificial Sequence
  chemically synthesized
cacaatccttaggttcttctgt

SEQ ID NO: 1157739 - DNA, 22 bp, Artificial Sequence
  chemically synthesized
gaaaacagaagaacctaaggat

SEQ ID NO: 1157740 - DNA, 22 bp, Artificial Sequence
  chemically synthesized
aaaacagaagaacctaaggatt

SEQ ID NO: 1157741 - DNA, 22 bp, Artificial Sequence
  chemically synthesized
gtatcacacctccacaatcctt

SEQ ID NO: 1157742 - DNA, 22 bp, Artificial Sequence
  chemically synthesized
ttagtatcacacctccacaatc

SEQ ID NO: 1157743 - DNA, 22 bp, Artificial Sequence
  chemically synthesized
attagtatcacacctccacaat

SEQ ID NO: 1157744 - DNA, 22 bp, Artificial Sequence
  chemically synthesized
gtgcttattagtatcacacctc

SEQ ID NO: 1157745 - DNA, 22 bp, Artificial Sequence
  chemically synthesized
cgtgcttattagtatcacacct

SEQ ID NO: 1157746 - DNA, 22 bp, Artificial Sequence
  chemically synthesized
tcgtgcttattagtatcacacc

SEQ ID NO: 1157747 - DNA, 22 bp, Artificial Sequence
  chemically synthesized
aggattgtggaggtgtgatact

SEQ ID NO: 1157748 - DNA, 22 bp, Artificial Sequence
  chemically synthesized
ttttcgtgcttattagtatcac

SEQ ID NO: 1157749 - DNA, 22 bp, Artificial Sequence
  chemically synthesized
gttttcgtgcttattagtatca

SEQ ID NO: 1157750 - DNA, 22 bp, Artificial Sequence
  chemically synthesized
tgttttcgtgcttattagtatc

SEQ ID NO: 1157751 - DNA, 22 bp, Artificial Sequence
  chemically synthesized
ttgttttcgtgcttattagtat

SEQ ID NO: 1157752 - DNA, 22 bp, Artificial Sequence
  chemically synthesized
tttgttttcgtgcttattagta

SEQ ID NO: 1157753 - DNA, 22 bp, Artificial Sequence
  chemically synthesized
tggaggtgtgatactaataagc

SEQ ID NO: 1157754 - DNA, 22 bp, Artificial Sequence
  chemically synthesized
ataagcacgaaaacaaaaagca

SEQ ID NO: 1157755 - DNA, 22 bp, Artificial Sequence
  chemically synthesized
caacaatgggatgaatgctttt

SEQ ID NO: 1157756 - DNA, 22 bp, Artificial Sequence
  chemically synthesized
ccaacaatgggatgaatgcttt

SEQ ID NO: 1157757 - DNA, 22 bp, Artificial Sequence
  chemically synthesized
tccaacaatgggatgaatgctt

SEQ ID NO: 1157758 - DNA, 22 bp, Artificial Sequence
  chemically synthesized
agaatcctttccaacaatggga

SEQ ID NO: 1157759 - DNA, 22 bp, Artificial Sequence
  chemically synthesized
aaacatctcagaatcctttcca

SEQ ID NO: 1157760 - DNA, 22 bp, Artificial Sequence
  chemically synthesized
atcccattgttggaaaggattc

SEQ ID NO: 1157761 - DNA, 22 bp, Artificial Sequence
  chemically synthesized
aattaaaacatctcagaatcct

SEQ ID NO: 1157762 - DNA, 22 bp, Artificial Sequence
  chemically synthesized
tcaattaaaacatctcagaatc

SEQ ID NO: 1157763 - DNA, 22 bp, Artificial Sequence
  chemically synthesized
ctcaattaaaacatctcagaat

SEQ ID NO: 1157764 - DNA, 22 bp, Artificial Sequence
  chemically synthesized
tctcaattaaaacatctcagaa

SEQ ID NO: 1157765 - DNA, 22 bp, Artificial Sequence
  chemically synthesized
ttggaaaggattctgagatgtt

SEQ ID NO: 1157766 - DNA, 22 bp, Artificial Sequence
  chemically synthesized
gaaaggattctgagatgtttta

SEQ ID NO: 1157767 - DNA, 22 bp, Artificial Sequence
  chemically synthesized
tgagatgttttaattgagaaaa

SEQ ID NO: 1157768 - DNA, 22 bp, Artificial Sequence
  chemically synthesized
agatgttttaattgagaaaata

SEQ ID NO: 1157769 - DNA, 22 bp, Artificial Sequence
  chemically synthesized
tagtaaggaaaagaaatatttt

SEQ ID NO: 1157770 - DNA, 22 bp, Artificial Sequence
  chemically synthesized
taattgagaaaatatttctttt

SEQ ID NO: 1157771 - DNA, 22 bp, Artificial Sequence
  chemically synthesized
aattgagaaaatatttcttttc

SEQ ID NO: 1157772 - DNA, 22 bp, Artificial Sequence
  chemically synthesized
attgagaaaatatttcttttcc

SEQ ID NO: 1157773 - DNA, 22 bp, Artificial Sequence
  chemically synthesized
agaaaatatttcttttccttac

SEQ ID NO: 1157774 - DNA, 22 bp, Artificial Sequence
  chemically synthesized
gtcaaggcctgtagtaaggaaa

SEQ ID NO: 1157775 - DNA, 22 bp, Artificial Sequence
  chemically synthesized
atatctagtcaaggcctgtagt

SEQ ID NO: 1157776 - DNA, 22 bp, Artificial Sequence
  chemically synthesized
cttttccttactacaggccttg

SEQ ID NO: 1157777 - DNA, 22 bp, Artificial Sequence
  chemically synthesized
ctaatatctagtcaaggcctgt

SEQ ID NO: 1157778 - DNA, 22 bp, Artificial Sequence
  chemically synthesized
ttttccttactacaggccttga

SEQ ID NO: 1157779 - DNA, 22 bp, Artificial Sequence
  chemically synthesized
gctaatatctagtcaaggcctg

SEQ ID NO: 1157780 - DNA, 22 bp, Artificial Sequence
  chemically synthesized
ttccttactacaggccttgact

SEQ ID NO: 1157781 - DNA, 22 bp, Artificial Sequence
  chemically synthesized
tccttactacaggccttgacta

SEQ ID NO: 1157782 - DNA, 22 bp, Artificial Sequence
  chemically synthesized
tttgctaatatctagtcaaggc

SEQ ID NO: 1157783 - DNA, 22 bp, Artificial Sequence
  chemically synthesized
ccttactacaggccttgactag

SEQ ID NO: 1157784 - DNA, 22 bp, Artificial Sequence
  chemically synthesized
cttactacaggccttgactaga

SEQ ID NO: 1157785 - DNA, 22 bp, Artificial Sequence
  chemically synthesized
ctatttgctaatatctagtcaa

SEQ ID NO: 1157786 - DNA, 22 bp, Artificial Sequence
  chemically synthesized
actacaggccttgactagatat

SEQ ID NO: 1157787 - DNA, 22 bp, Artificial Sequence
  chemically synthesized
ctacaggccttgactagatatt

SEQ ID NO: 1157788 - DNA, 22 bp, Artificial Sequence
  chemically synthesized
caggccttgactagatattagc

SEQ ID NO: 1157789 - DNA, 22 bp, Artificial Sequence
  chemically synthesized
gactagatattagcaaatagta

SEQ ID NO: 1157790 - DNA, 22 bp, Artificial Sequence
  chemically synthesized
actagatattagcaaatagtag

SEQ ID NO: 1157791 - DNA, 22 bp, Artificial Sequence
  chemically synthesized
gatattagcaaatagtagtcca

SEQ ID NO: 1157792 - DNA, 22 bp, Artificial Sequence
  chemically synthesized
gcaaatagtagtccatatgctg

SEQ ID NO: 1157793 - DNA, 22 bp, Artificial Sequence
  chemically synthesized
gtatgagaccaaatccagcata

SEQ ID NO: 1157794 - DNA, 22 bp, Artificial Sequence
  chemically synthesized
aattagtatgagaccaaatcca

SEQ ID NO: 1157795 - DNA, 22 bp, Artificial Sequence
  chemically synthesized
caattagtatgagaccaaatcc

SEQ ID NO: 1157796 - DNA, 22 bp, Artificial Sequence
  chemically synthesized
tcaattagtatgagaccaaatc

SEQ ID NO: 1157797 - DNA, 22 bp, Artificial Sequence
  chemically synthesized
ttttcaattagtatgagaccaa

SEQ ID NO: 1157798 - DNA, 22 bp, Artificial Sequence
  chemically synthesized
attttcaattagtatgagacca

SEQ ID NO: 1157799 - DNA, 22 bp, Artificial Sequence
  chemically synthesized
aatttattttcaattagtatga

SEQ ID NO: 1157800 - DNA, 22 bp, Artificial Sequence
  chemically synthesized
caatttattttcaattagtatg

SEQ ID NO: 1157801 - DNA, 22 bp, Artificial Sequence
  chemically synthesized
gatttggtctcatactaattga
